United States Patent 7,888,497 (BIOINFORMATICALLY DETECTABLE GROUP OF NOVEL REGULATORY OLIGONUCLEOTIDES AND USES THEREOF) - sequence listing, part 104

SEQ ID NO: 4399616 - DNA, 17 bp, Homo sapiens
tttatatcttgtttaca

SEQ ID NO: 4399617 - DNA, 20 bp, Homo sapiens
tttatatgcttactgatata

SEQ ID NO: 4399618 - DNA, 18 bp, Homo sapiens
tttatatgggtttatttt

SEQ ID NO: 4399619 - DNA, 17 bp, Homo sapiens
tttatatgtacatgaga

SEQ ID NO: 4399620 - DNA, 21 bp, Homo sapiens
tttatatgtaccgtaggcttt

SEQ ID NO: 4399621 - DNA, 21 bp, Homo sapiens
tttatattagttgctttgtta

SEQ ID NO: 4399622 - DNA, 23 bp, Homo sapiens
tttatattataactctgtataat

SEQ ID NO: 4399623 - DNA, 20 bp, Homo sapiens
tttatattgtttttatatat

SEQ ID NO: 4399624 - DNA, 15 bp, Homo sapiens
tttatatttattgtt

SEQ ID NO: 4399625 - DNA, 16 bp, Homo sapiens
tttatatttattgtta

SEQ ID NO: 4399626 - DNA, 17 bp, Homo sapiens
tttatatttcctttatg

SEQ ID NO: 4399627 - DNA, 19 bp, Homo sapiens
tttatatttcctttatgtg

SEQ ID NO: 4399628 - DNA, 21 bp, Homo sapiens
tttatatttcctttatgtgaa

SEQ ID NO: 4399629 - DNA, 19 bp, Homo sapiens
tttatcaatgtgtctttct

SEQ ID NO: 4399630 - DNA, 20 bp, Homo sapiens
tttatcaatgtgtctttcta

SEQ ID NO: 4399631 - DNA, 17 bp, Homo sapiens
tttatcacacttctgtg

SEQ ID NO: 4399632 - DNA, 19 bp, Homo sapiens
tttatcagggaaactaaga

SEQ ID NO: 4399633 - DNA, 16 bp, Homo sapiens
tttatcatgaagcctg

SEQ ID NO: 4399634 - DNA, 19 bp, Homo sapiens
tttatcatgaatgctttta

SEQ ID NO: 4399635 - DNA, 14 bp, Homo sapiens
tttatcccatttta

SEQ ID NO: 4399636 - DNA, 14 bp, Homo sapiens
tttatcctgtattc

SEQ ID NO: 4399637 - DNA, 23 bp, Homo sapiens
tttatcctgtattcttgtttgaa

SEQ ID NO: 4399638 - DNA, 19 bp, Homo sapiens
tttatctataatttaccta

SEQ ID NO: 4399639 - DNA, 20 bp, Homo sapiens
tttatctatataaaataact

SEQ ID NO: 4399640 - DNA, 21 bp, Homo sapiens
tttatctcagatgttaaaata

SEQ ID NO: 4399641 - DNA, 16 bp, Homo sapiens
tttatctgtaattgta

SEQ ID NO: 4399642 - DNA, 14 bp, Homo sapiens
tttatctttaccaa

SEQ ID NO: 4399643 - DNA, 13 bp, Homo sapiens
tttatctttgtgt

SEQ ID NO: 4399644 - DNA, 14 bp, Homo sapiens
tttatgaacattgt

SEQ ID NO: 4399645 - DNA, 16 bp, Homo sapiens
tttatgaacattgtac

SEQ ID NO: 4399646 - DNA, 17 bp, Homo sapiens
tttatgaacattgtact

SEQ ID NO: 4399647 - DNA, 19 bp, Homo sapiens
tttatgattttcataactt

SEQ ID NO: 4399648 - DNA, 17 bp, Homo sapiens
tttatgcagcaaatata

SEQ ID NO: 4399649 - DNA, 15 bp, Homo sapiens
tttatggatgattaa

SEQ ID NO: 4399650 - DNA, 12 bp, Homo sapiens
tttatgtacaac

SEQ ID NO: 4399651 - DNA, 19 bp, Homo sapiens
tttatgtagtaattgacat

SEQ ID NO: 4399652 - DNA, 11 bp, Homo sapiens
tttatgtctgg

SEQ ID NO: 4399653 - DNA, 20 bp, Homo sapiens
tttatgtgaaatgctttctg

SEQ ID NO: 4399654 - DNA, 15 bp, Homo sapiens
tttatgtgaattttt

SEQ ID NO: 4399655 - DNA, 16 bp, Homo sapiens
tttatgtgaattttta

SEQ ID NO: 4399656 - DNA, 22 bp, Homo sapiens
tttatgtgtgaggagctgctgg

SEQ ID NO: 4399657 - DNA, 15 bp, Homo sapiens
tttatgttatgagga

SEQ ID NO: 4399658 - DNA, 20 bp, Homo sapiens
tttattaagctttttggaat

SEQ ID NO: 4399659 - DNA, 19 bp, Homo sapiens
tttattaatcttagtgtat

SEQ ID NO: 4399660 - DNA, 12 bp, Homo sapiens
tttattaatgca

SEQ ID NO: 4399661 - DNA, 13 bp, Homo sapiens
tttattacaaatg

SEQ ID NO: 4399662 - DNA, 19 bp, Homo sapiens
tttattacaaatgcaaatt

SEQ ID NO: 4399663 - DNA, 16 bp, Homo sapiens
tttattacatatgatt

SEQ ID NO: 4399664 - DNA, 16 bp, Homo sapiens
tttattatgcattata

SEQ ID NO: 4399665 - DNA, 18 bp, Homo sapiens
tttattatggttagctgt

SEQ ID NO: 4399666 - DNA, 18 bp, Homo sapiens
tttattccagaatgctgt

SEQ ID NO: 4399667 - DNA, 14 bp, Homo sapiens
tttattccctgccc

SEQ ID NO: 4399668 - DNA, 16 bp, Homo sapiens
tttattccctgcccaa

SEQ ID NO: 4399669 - DNA, 21 bp, Homo sapiens
tttattccctgcccaaaccct

SEQ ID NO: 4399670 - DNA, 15 bp, Homo sapiens
tttattccttctgta

SEQ ID NO: 4399671 - DNA, 14 bp, Homo sapiens
tttattccttgtga

SEQ ID NO: 4399672 - DNA, 16 bp, Homo sapiens
tttattctatctgttt

SEQ ID NO: 4399673 - DNA, 18 bp, Homo sapiens
tttattgaatactgtctg

SEQ ID NO: 4399674 - DNA, 23 bp, Homo sapiens
tttattgaatactgtctgtatct

SEQ ID NO: 4399675 - DNA, 22 bp, Homo sapiens
tttattgacaggtcttttcaaa

SEQ ID NO: 4399676 - DNA, 18 bp, Homo sapiens
tttattgagattttccat

SEQ ID NO: 4399677 - DNA, 12 bp, Homo sapiens
tttattgccttc

SEQ ID NO: 4399678 - DNA, 14 bp, Homo sapiens
tttattgttagaaa

SEQ ID NO: 4399679 - DNA, 22 bp, Homo sapiens
tttattgtttaaaatcatttct

SEQ ID NO: 4399680 - DNA, 17 bp, Homo sapiens
tttattgtttgatgttt

SEQ ID NO: 4399681 - DNA, 22 bp, Homo sapiens
tttatttaaaaaactaaaaact

SEQ ID NO: 4399682 - DNA, 16 bp, Homo sapiens
tttatttaaaactctg

SEQ ID NO: 4399683 - DNA, 19 bp, Homo sapiens
tttatttcaataaatcttt

SEQ ID NO: 4399684 - DNA, 15 bp, Homo sapiens
tttatttcaatgtaa

SEQ ID NO: 4399685 - DNA, 23 bp, Homo sapiens
tttatttcatttacaaaagattt

SEQ ID NO: 4399686 - DNA, 20 bp, Homo sapiens
tttatttccaatgtttcaag

SEQ ID NO: 4399687 - DNA, 21 bp, Homo sapiens
tttatttcctcagctgtacaa

SEQ ID NO: 4399688 - DNA, 14 bp, Homo sapiens
tttcattacttgaa

SEQ ID NO: 4399689 - DNA, 16 bp, Homo sapiens
tttcattacttgaatg

SEQ ID NO: 4399690 - DNA, 21 bp, Homo sapiens
tttcattatgctttgaacttt

SEQ ID NO: 4399691 - DNA, 20 bp, Homo sapiens
tttcattcaacacattttta

SEQ ID NO: 4399692 - DNA, 16 bp, Homo sapiens
tttcattcggtgtgaa

SEQ ID NO: 4399693 - DNA, 21 bp, Homo sapiens
tttcattcggtgtgaactttt

SEQ ID NO: 4399694 - DNA, 15 bp, Homo sapiens
tttcattctcagaat

SEQ ID NO: 4399695 - DNA, 16 bp, Homo sapiens
tttcattgccagtgtc

SEQ ID NO: 4399696 - DNA, 16 bp, Homo sapiens
tttcattgctaagact

SEQ ID NO: 4399697 - DNA, 13 bp, Homo sapiens
tttcattgtgatt

SEQ ID NO: 4399698 - DNA, 18 bp, Homo sapiens
tttcattgtgatttatat

SEQ ID NO: 4399699 - DNA, 22 bp, Homo sapiens
tttcattgtgatttatatataa

SEQ ID NO: 4399700 - DNA, 13 bp, Homo sapiens
tttcatttccagc

SEQ ID NO: 4399701 - DNA, 12 bp, Homo sapiens
tttcatttgctg

SEQ ID NO: 4399702 - DNA, 13 bp, Homo sapiens
tttcatttgtaaa

SEQ ID NO: 4399703 - DNA, 17 bp, Homo sapiens
tttcatttgtaaaaatg

SEQ ID NO: 4399704 - DNA, 14 bp, Homo sapiens
tttcattttaaaaa

SEQ ID NO: 4399705 - DNA, 22 bp, Homo sapiens
tttcattttaatatataattta

SEQ ID NO: 4399706 - DNA, 23 bp, Homo sapiens
tttccaaaagtggctagtcctca

SEQ ID NO: 4399707 - DNA, 19 bp, Homo sapiens
tttccaaaatctcccattt

SEQ ID NO: 4399708 - DNA, 19 bp, Homo sapiens
tttccaactactaatagaa

SEQ ID NO: 4399709 - DNA, 16 bp, Homo sapiens
tttccaagaggctgta

SEQ ID NO: 4399710 - DNA, 20 bp, Homo sapiens
tttccaagtcatttttgttt

SEQ ID NO: 4399711 - DNA, 19 bp, Homo sapiens
tttccaatattttaataaa

SEQ ID NO: 4399712 - DNA, 15 bp, Homo sapiens
tttccaatgccacag

SEQ ID NO: 4399713 - DNA, 22 bp, Homo sapiens
tttccacaagattcccagagac

SEQ ID NO: 4399714 - DNA, 14 bp, Homo sapiens
tttccacacgcatt

SEQ ID NO: 4399715 - DNA, 13 bp, Homo sapiens
tttccacagattt

SEQ ID NO: 4399716 - DNA, 16 bp, Homo sapiens
tttccacataaatttt

SEQ ID NO: 4399717 - DNA, 20 bp, Homo sapiens
tttccacataaattttaatt

SEQ ID NO: 4399718 - DNA, 16 bp, Homo sapiens
tttccactaaaaatat

SEQ ID NO: 4399719 - DNA, 16 bp, Homo sapiens
tttccactccattgtc

SEQ ID NO: 4399720 - DNA, 21 bp, Homo sapiens
tttccactggcttttgcctgt

SEQ ID NO: 4399721 - DNA, 15 bp, Homo sapiens
tttccagcattttta

SEQ ID NO: 4399722 - DNA, 17 bp, Homo sapiens
tttccagccttatgtgt

SEQ ID NO: 4399723 - DNA, 15 bp, Homo sapiens
tttccaggctggttc

SEQ ID NO: 4399724 - DNA, 22 bp, Homo sapiens
tttccaggctggttcggatttg

SEQ ID NO: 4399725 - DNA, 18 bp, Homo sapiens
tttccagtgacttgcaat

SEQ ID NO: 4399726 - DNA, 17 bp, Homo sapiens
tttccagttcctctttt

SEQ ID NO: 4399727 - DNA, 15 bp, Homo sapiens
tttccataaatttgg

SEQ ID NO: 4399728 - DNA, 19 bp, Homo sapiens
tttccatagtgttaactgt

SEQ ID NO: 4399729 - DNA, 23 bp, Homo sapiens
tttccatcaactcccaacttctt

SEQ ID NO: 4399730 - DNA, 12 bp, Homo sapiens
tttccatcatgt

SEQ ID NO: 4399731 - DNA, 17 bp, Homo sapiens
tttccatcatgtctgta

SEQ ID NO: 4399732 - DNA, 15 bp, Homo sapiens
tttccattaactatt

SEQ ID NO: 4399733 - DNA, 18 bp, Homo sapiens
tttccatttggcactatg

SEQ ID NO: 4399734 - DNA, 19 bp, Homo sapiens
tttcccacctctctcccca

SEQ ID NO: 4399735 - DNA, 23 bp, Homo sapiens
tttcccactcattctgaattaat

SEQ ID NO: 4399736 - DNA, 17 bp, Homo sapiens
tttcccaggagaccatt

SEQ ID NO: 4399737 - DNA, 15 bp, Homo sapiens
tttcccagttaaaga

SEQ ID NO: 4399738 - DNA, 12 bp, Homo sapiens
tttcccatctgc

SEQ ID NO: 4399739 - DNA, 13 bp, Homo sapiens
tttcccatctgca

SEQ ID NO: 4399740 - DNA, 22 bp, Homo sapiens
tttcccatctgcaccccttctc

SEQ ID NO: 4399741 - DNA, 23 bp, Homo sapiens
tttccccacccccctctctttct

SEQ ID NO: 4399742 - DNA, 23 bp, Homo sapiens
tttccccagaccgatccttccca

SEQ ID NO: 4399743 - DNA, 13 bp, Homo sapiens
tttccccccactc

SEQ ID NO: 4399744 - DNA, 17 bp, Homo sapiens
tttccccccactctccc

SEQ ID NO: 4399745 - DNA, 19 bp, Homo sapiens
tttccccccactctcccca

SEQ ID NO: 4399746 - DNA, 23 bp, Homo sapiens
tttccccccactctccccacact

SEQ ID NO: 4399747 - DNA, 23 bp, Homo sapiens
tttcccccttcccatttcttccc

SEQ ID NO: 4399748 - DNA, 18 bp, Homo sapiens
tttccccggtcccttgag

SEQ ID NO: 4399749 - DNA, 20 bp, Homo sapiens
tttccctactgaaccctgcc

SEQ ID NO: 4399750 - DNA, 14 bp, Homo sapiens
tttccctatcttct

SEQ ID NO: 4399751 - DNA, 23 bp, Homo sapiens
tttccctcaaatgcgcgtgtgca

SEQ ID NO: 4399752 - DNA, 14 bp, Homo sapiens
tttccctcagtgaa

SEQ ID NO: 4399753 - DNA, 22 bp, Homo sapiens
tttccctcccaacagagctggg

SEQ ID NO: 4399754 - DNA, 14 bp, Homo sapiens
tttccctctgctgc

SEQ ID NO: 4399755 - DNA, 21 bp, Homo sapiens
tttccctggaactcctggcct

SEQ ID NO: 4399756 - DNA, 19 bp, Homo sapiens
tttccgcccactcctggga

SEQ ID NO: 4399757 - DNA, 24 bp, Homo sapiens
tttccgctgtcgccccaggccctc

SEQ ID NO: 4399758 - DNA, 19 bp, Homo sapiens
tttccgtgaactctggtgc

SEQ ID NO: 4399759 - DNA, 15 bp, Homo sapiens
tttcctaagacattt

SEQ ID NO: 4399760 - DNA, 21 bp, Homo sapiens
tttcctaagacatttttcatt

SEQ ID NO: 4399761 - DNA, 12 bp, Homo sapiens
tttcctaatact

SEQ ID NO: 4399762 - DNA, 21 bp, Homo sapiens
tttcctacaggcagtctctct

SEQ ID NO: 4399763 - DNA, 17 bp, Homo sapiens
tttcctatcatgttaac

SEQ ID NO: 4399764 - DNA, 23 bp, Homo sapiens
tttcctatctagcatttatttct

SEQ ID NO: 4399765 - DNA, 13 bp, Homo sapiens
tttcctatttaat

SEQ ID NO: 4399766 - DNA, 18 bp, Homo sapiens
tttcctatttaatacagc

SEQ ID NO: 4399767 - DNA, 11 bp, Homo sapiens
tttcctcagtg

SEQ ID NO: 4399768 - DNA, 10 bp, Homo sapiens
tttcctcctg

SEQ ID NO: 4399769 - DNA, 12 bp, Homo sapiens
tttcctcctttc

SEQ ID NO: 4399770 - DNA, 23 bp, Homo sapiens
tttcctctgaggatgatgtactt

SEQ ID NO: 4399771 - DNA, 15 bp, Homo sapiens
tttcctctgctggaa

SEQ ID NO: 4399772 - DNA, 17 bp, Homo sapiens
tttcctcttagaagaat

SEQ ID NO: 4399773 - DNA, 13 bp, Homo sapiens
tttcctcttgtga

SEQ ID NO: 4399774 - DNA, 23 bp, Homo sapiens
tttcctgatggggaagggacttt

SEQ ID NO: 4399775 - DNA, 12 bp, Homo sapiens
tttcctgccctg

SEQ ID NO: 4399776 - DNA, 16 bp, Homo sapiens
tttcctgccctgtcca

SEQ ID NO: 4399777 - DNA, 17 bp, Homo sapiens
tttcctgcgtcccagcc

SEQ ID NO: 4399778 - DNA, 18 bp, Homo sapiens
tttcctgcgtcccagcct

SEQ ID NO: 4399779 - DNA, 19 bp, Homo sapiens
tttcctgcgtcccagcctg

SEQ ID NO: 4399780 - DNA, 19 bp, Homo sapiens
tttcctggccctccactcc

SEQ ID NO: 4399781 - DNA, 15 bp, Homo sapiens
tttcctgggccagaa

SEQ ID NO: 4399782 - DNA, 19 bp, Homo sapiens
tttcctggtgccaatttca

SEQ ID NO: 4399783 - DNA, 19 bp, Homo sapiens
tttcctgtaatatatttat

SEQ ID NO: 4399784 - DNA, 12 bp, Homo sapiens
tttcctgtcctg

SEQ ID NO: 4399785 - DNA, 13 bp, Homo sapiens
tttcctgtcctgc

SEQ ID NO: 4399786 - DNA, 19 bp, Homo sapiens
tttcctgtggaataaagat

SEQ ID NO: 4399787 - DNA, 13 bp, Homo sapiens
tttcctgttcagc

SEQ ID NO: 4399788 - DNA, 13 bp, Homo sapiens
tttcctgtttgaa

SEQ ID NO: 4399789 - DNA, 22 bp, Homo sapiens
tttcctgtttgaaatatcatgt

SEQ ID NO: 4399790 - DNA, 16 bp, Homo sapiens
tttccttatttgcctt

SEQ ID NO: 4399791 - DNA, 17 bp, Homo sapiens
tttccttatttgccttc

SEQ ID NO: 4399792 - DNA, 14 bp, Homo sapiens
tttccttccatccc

SEQ ID NO: 4399793 - DNA, 11 bp, Homo sapiens
tttccttccct

SEQ ID NO: 4399794 - DNA, 19 bp, Homo sapiens
tttccttcccttttctgtt

SEQ ID NO: 4399795 - DNA, 13 bp, Homo sapiens
tttccttctggtt

SEQ ID NO: 4399796 - DNA, 12 bp, Homo sapiens
tttccttctttg

SEQ ID NO: 4399797 - DNA, 20 bp, Homo sapiens
tttccttgctatttcaataa

SEQ ID NO: 4399798 - DNA, 14 bp, Homo sapiens
tttccttgtcccgt

SEQ ID NO: 4399799 - DNA, 13 bp, Homo sapiens
tttccttgtgcaa

SEQ ID NO: 4399800 - DNA, 12 bp, Homo sapiens
tttcctttaaaa

SEQ ID NO: 4399801 - DNA, 17 bp, Homo sapiens
tttcctttatgtgaatt

SEQ ID NO: 4399802 - DNA, 18 bp, Homo sapiens
tttcctttttgacactga

SEQ ID NO: 4399803 - DNA, 19 bp, Homo sapiens
tttcctttttgacactgaa

SEQ ID NO: 4399804 - DNA, 20 bp, Homo sapiens
tttccttttttcccataaga

SEQ ID NO: 4399805 - DNA, 14 bp, Homo sapiens
tttcgaccctgggg

SEQ ID NO: 4399806 - DNA, 13 bp, Homo sapiens
tttctaaaagctt

SEQ ID NO: 4399807 - DNA, 22 bp, Homo sapiens
tttctatgcttgtaactgtctt

SEQ ID NO: 4399808 - DNA, 18 bp, Homo sapiens
tttctatggctttcaaag

SEQ ID NO: 4399809 - DNA, 19 bp, Homo sapiens
tttctatggctttcaaagc

SEQ ID NO: 4399810 - DNA, 20 bp, Homo sapiens
tttctattatggaaaactgt

SEQ ID NO: 4399811 - DNA, 17 bp, Homo sapiens
tttctatttctcctcca

SEQ ID NO: 4399812 - DNA, 16 bp, Homo sapiens
tttctcactaaatctt

SEQ ID NO: 4399813 - DNA, 20 bp, Homo sapiens
tttctcaggagcttcaatga

SEQ ID NO: 4399814 - DNA, 15 bp, Homo sapiens
tttctccagtgctgt

SEQ ID NO: 4399815 - DNA, 16 bp, Homo sapiens
tttctccatcccctcc

SEQ ID NO: 4399816 - DNA, 20 bp, Homo sapiens
tttctccatcccctccctgc

SEQ ID NO: 4399817 - DNA, 16 bp, Homo sapiens
tttctcccaagaaacc

SEQ ID NO: 4399818 - DNA, 17 bp, Homo sapiens
tttctcccctgccccca

SEQ ID NO: 4399819 - DNA, 20 bp, Homo sapiens
tttctcccctgcccccagga

SEQ ID NO: 4399820 - DNA, 14 bp, Homo sapiens
tttctcctcagaag

SEQ ID NO: 4399821 - DNA, 12 bp, Homo sapiens
tttctcctgtga

SEQ ID NO: 4399822 - DNA, 19 bp, Homo sapiens
tttctcctttaattgtaaa

SEQ ID NO: 4399823 - DNA, 14 bp, Homo sapiens
tttctcctttacca

SEQ ID NO: 4399824 - DNA, 20 bp, Homo sapiens
tttctcctttgcaatagcag

SEQ ID NO: 4399825 - DNA, 23 bp, Homo sapiens
tttctctaatgttgtatcatact

SEQ ID NO: 4399826 - DNA, 20 bp, Homo sapiens
tttctctctctctacctttt

SEQ ID NO: 4399827 - DNA, 14 bp, Homo sapiens
tttctctcttttgt

SEQ ID NO: 4399828 - DNA, 12 bp, Homo sapiens
tttctctgctgt

SEQ ID NO: 4399829 - DNA, 19 bp, Homo sapiens
tttctctggcagcataatt

SEQ ID NO: 4399830 - DNA, 16 bp, Homo sapiens
tttctctgtacttttc

SEQ ID NO: 4399831 - DNA, 20 bp, Homo sapiens
tttctcttccccttagaaac

SEQ ID NO: 4399832 - DNA, 16 bp, Homo sapiens
tttctgaactgttaca

SEQ ID NO: 4399833 - DNA, 13 bp, Homo sapiens
tttctgagaaaga

SEQ ID NO: 4399834 - DNA, 22 bp, Homo sapiens
tttctgagaaagactattcaaa

SEQ ID NO: 4399835 - DNA, 11 bp, Homo sapiens
tttctgaggag

SEQ ID NO: 4399836 - DNA, 21 bp, Homo sapiens
tttctgagtgagttttactct

SEQ ID NO: 4399837 - DNA, 19 bp, Homo sapiens
tttctgatggtataaacag

SEQ ID NO: 4399838 - DNA, 12 bp, Homo sapiens
tttctgattctt

SEQ ID NO: 4399839 - DNA, 14 bp, Homo sapiens
tttctgattctttt

SEQ ID NO: 4399840 - DNA, 20 bp, Homo sapiens
tttctgatttctgaagtgct

SEQ ID NO: 4399841 - DNA, 17 bp, Homo sapiens
tttctgcatatgttgaa

SEQ ID NO: 4399842 - DNA, 14 bp, Homo sapiens
tttctgccctggct

SEQ ID NO: 4399843 - DNA, 15 bp, Homo sapiens
tttctgccctggctg

SEQ ID NO: 4399844 - DNA, 20 bp, Homo sapiens
tttctgccctggctgctgcc

SEQ ID NO: 4399845 - DNA, 13 bp, Homo sapiens
tttctggaagact

SEQ ID NO: 4399846 - DNA, 12 bp, Homo sapiens
tttctggactgg

SEQ ID NO: 4399847 - DNA, 22 bp, Homo sapiens
tttctggcgcccctgcctgtgc

SEQ ID NO: 4399848 - DNA, 19 bp, Homo sapiens
tttctggctgtgatcttaa

SEQ ID NO: 4399849 - DNA, 14 bp, Homo sapiens
tttctggggcctag

SEQ ID NO: 4399850 - DNA, 11 bp, Homo sapiens
tttctgggggc

SEQ ID NO: 4399851 - DNA, 21 bp, Homo sapiens
tttctggtgctaagtctgatg

SEQ ID NO: 4399852 - DNA, 15 bp, Homo sapiens
tttctgtaaactctg

SEQ ID NO: 4399853 - DNA, 14 bp, Homo sapiens
tttctgtatttaat

SEQ ID NO: 4399854 - DNA, 17 bp, Homo sapiens
tttctgtggctggctct

SEQ ID NO: 4399855 - DNA, 16 bp, Homo sapiens
tttctgttatttttaa

SEQ ID NO: 4399856 - DNA, 21 bp, Homo sapiens
tttctgttatttttaagcttt

SEQ ID NO: 4399857 - DNA, 12 bp, Homo sapiens
tttctgttccaa

SEQ ID NO: 4399858 - DNA, 16 bp, Homo sapiens
tttctgttccaaattc

SEQ ID NO: 4399859 - DNA, 14 bp, Homo sapiens
tttctgttctagtt

SEQ ID NO: 4399860 - DNA, 12 bp, Homo sapiens
tttctgttttct

SEQ ID NO: 4399861 - DNA, 20 bp, Homo sapiens
tttctgttttgtttttttct

SEQ ID NO: 4399862 - DNA, 18 bp, Homo sapiens
tttcttaaataagaaact

SEQ ID NO: 4399863 - DNA, 13 bp, Homo sapiens
tttcttaacttct

SEQ ID NO: 4399864 - DNA, 21 bp, Homo sapiens
tttcttaacttcttgcttctt

SEQ ID NO: 4399865 - DNA, 23 bp, Homo sapiens
tttcttaattattataaaaatat

SEQ ID NO: 4399866 - DNA, 16 bp, Homo sapiens
tttcttatgtgacatt

SEQ ID NO: 4399867 - DNA, 17 bp, Homo sapiens
tttcttatttcatttct

SEQ ID NO: 4399868 - DNA, 16 bp, Homo sapiens
tttcttcaatggttct

SEQ ID NO: 4399869 - DNA, 14 bp, Homo sapiens
tttcttcattgtaa

SEQ ID NO: 4399870 - DNA, 17 bp, Homo sapiens
tttcttcatttctctgc

SEQ ID NO: 4399871 - DNA, 14 bp, Homo sapiens
tttcttcccatcac

SEQ ID NO: 4399872 - DNA, 13 bp, Homo sapiens
tttcttccctgct

SEQ ID NO: 4399873 - DNA, 21 bp, Homo sapiens
tttcttccctgctttgcatct

SEQ ID NO: 4399874 - DNA, 17 bp, Homo sapiens
tttcttcctaccaagtc

SEQ ID NO: 4399875 - DNA, 22 bp, Homo sapiens
tttcttcctaccaagtcaaact

SEQ ID NO: 4399876 - DNA, 23 bp, Homo sapiens
tttcttcctaccaagtcaaactt

SEQ ID NO: 4399877 - DNA, 14 bp, Homo sapiens
tttcttcgctggac

SEQ ID NO: 4399878 - DNA, 13 bp, Homo sapiens
tttcttctattaa

SEQ ID NO: 4399879 - DNA, 17 bp, Homo sapiens
tttcttctgaagattct

SEQ ID NO: 4399880 - DNA, 21 bp, Homo sapiens
tttcttcttttttaagttgtc

SEQ ID NO: 4399881 - DNA, 12 bp, Homo sapiens
tttcttgcctct

SEQ ID NO: 4399882 - DNA, 15 bp, Homo sapiens
tttcttgtgtagatt

SEQ ID NO: 4399883 - DNA, 12 bp, Homo sapiens
tttcttgtttat

SEQ ID NO: 4399884 - DNA, 13 bp, Homo sapiens
tttctttaactgc

SEQ ID NO: 4399885 - DNA, 17 bp, Homo sapiens
tttctttacttatctct

SEQ ID NO: 4399886 - DNA, 17 bp, Homo sapiens
tttctttcccatgtatt

SEQ ID NO: 4399887 - DNA, 22 bp, Homo sapiens
tttctttcccatgtatttgtta

SEQ ID NO: 4399888 - DNA, 18 bp, Homo sapiens
tttctttcctcctttcct

SEQ ID NO: 4399889 - DNA, 12 bp, Homo sapiens
tttctttccttt

SEQ ID NO: 4399890 - DNA, 13 bp, Homo sapiens
tttctttctagtt

SEQ ID NO: 4399891 - DNA, 10 bp, Homo sapiens
tttctttctt

SEQ ID NO: 4399892 - DNA, 14 bp, Homo sapiens
tttctttgcctctg

SEQ ID NO: 4399893 - DNA, 17 bp, Homo sapiens
tttctttggtgcctttc

SEQ ID NO: 4399894 - DNA, 19 bp, Homo sapiens
tttctttggtgcctttcct

SEQ ID NO: 4399895 - DNA, 12 bp, Homo sapiens
tttcttttaaaa

SEQ ID NO: 4399896 - DNA, 15 bp, Homo sapiens
tttcttttagaaaag

SEQ ID NO: 4399897 - DNA, 20 bp, Homo sapiens
tttctttttaactttaccaa

SEQ ID NO: 4399898 - DNA, 16 bp, Homo sapiens
tttcttttttaaatta

SEQ ID NO: 4399899 - DNA, 18 bp, Homo sapiens
tttctttttttttaagtt

SEQ ID NO: 4399900 - DNA, 19 bp, Homo sapiens
tttcttttttttttcgtct

SEQ ID NO: 4399901 - DNA, 14 bp, Homo sapiens
tttgaaaaaagctc

SEQ ID NO: 4399902 - DNA, 21 bp, Homo sapiens
tttgaaaaaagctcatttcat

SEQ ID NO: 4399903 - DNA, 18 bp, Homo sapiens
tttgcccatttacacttt

SEQ ID NO: 4399904 - DNA, 12 bp, Homo sapiens
tttgccctttga

SEQ ID NO: 4399905 - DNA, 17 bp, Homo sapiens
tttgcctcttccagtct

SEQ ID NO: 4399906 - DNA, 20 bp, Homo sapiens
tttgcctcttctttgtgcct

SEQ ID NO: 4399907 - DNA, 22 bp, Homo sapiens
tttgcctcttctttgtgccttt

SEQ ID NO: 4399908 - DNA, 16 bp, Homo sapiens
tttgcctgaggctgta

SEQ ID NO: 4399909 - DNA, 15 bp, Homo sapiens
tttgcctgcagtttc

SEQ ID NO: 4399910 - DNA, 13 bp, Homo sapiens
tttgcctgtaaga

SEQ ID NO: 4399911 - DNA, 18 bp, Homo sapiens
tttgctaatgtataatgt

SEQ ID NO: 4399912 - DNA, 13 bp, Homo sapiens
tttgctactgagt

SEQ ID NO: 4399913 - DNA, 16 bp, Homo sapiens
tttgctatctgggctg

SEQ ID NO: 4399914 - DNA, 12 bp, Homo sapiens
tttgctatgtaa

SEQ ID NO: 4399915 - DNA, 22 bp, Homo sapiens
tttgctctctgtgaccctaaga

SEQ ID NO: 4399916 - DNA, 15 bp, Homo sapiens
tttgctgaattcctt

SEQ ID NO: 4399917 - DNA, 17 bp, Homo sapiens
tttgctgaattccttta

SEQ ID NO: 4399918 - DNA, 18 bp, Homo sapiens
tttgctgaattcctttac

SEQ ID NO: 4399919 - DNA, 22 bp, Homo sapiens
tttgctgctgcccatgtttcaa

SEQ ID NO: 4399920 - DNA, 13 bp, Homo sapiens
tttgctgtagaag

SEQ ID NO: 4399921 - DNA, 21 bp, Homo sapiens
tttgctgtagaagatggcact

SEQ ID NO: 4399922 - DNA, 22 bp, Homo sapiens
tttgctgttgggtttttgctgt

SEQ ID NO: 4399923 - DNA, 13 bp, Homo sapiens
tttgcttaaaata

SEQ ID NO: 4399924 - DNA, 16 bp, Homo sapiens
tttgcttaaaatatgt

SEQ ID NO: 4399925 - DNA, 20 bp, Homo sapiens
tttgcttaaaatatgtgaag

SEQ ID NO: 4399926 - DNA, 14 bp, Homo sapiens
tttgcttctagagc

SEQ ID NO: 4399927 - DNA, 16 bp, Homo sapiens
tttgcttgaacacagt

SEQ ID NO: 4399928 - DNA, 17 bp, Homo sapiens
tttgcttgaacacagta

SEQ ID NO: 4399929 - DNA, 12 bp, Homo sapiens
tttgctttaatg

SEQ ID NO: 4399930 - DNA, 15 bp, Homo sapiens
tttgctttaatgaga

SEQ ID NO: 4399931 - DNA, 15 bp, Homo sapiens
tttgctttcttgtct

SEQ ID NO: 4399932 - DNA, 14 bp, Homo sapiens
tttgctttggaaac

SEQ ID NO: 4399933 - DNA, 17 bp, Homo sapiens
tttggaaactcaaggaa

SEQ ID NO: 4399934 - DNA, 13 bp, Homo sapiens
tttggaaagtaca

SEQ ID NO: 4399935 - DNA, 15 bp, Homo sapiens
tttggaaagtacact

SEQ ID NO: 4399936 - DNA, 21 bp, Homo sapiens
tttggaattgaacgactgtat

SEQ ID NO: 4399937 - DNA, 23 bp, Homo sapiens
tttggacagctgataaatttaat

SEQ ID NO: 4399938 - DNA, 15 bp, Homo sapiens
tttggactttgtata

SEQ ID NO: 4399939 - DNA, 15 bp, Homo sapiens
tttggatatgtaaaa

SEQ ID NO: 4399940 - DNA, 20 bp, Homo sapiens
tttggatctccaattgcctc

SEQ ID NO: 4399941 - DNA, 18 bp, Homo sapiens
tttggatgtctgtagcat

SEQ ID NO: 4399942 - DNA, 16 bp, Homo sapiens
tttggatttgacattg

SEQ ID NO: 4399943 - DNA, 17 bp, Homo sapiens
tttggcatgggacagac

SEQ ID NO: 4399944 - DNA, 13 bp, Homo sapiens
tttggcattatct

SEQ ID NO: 4399945 - DNA, 23 bp, Homo sapiens
tttggccaatgcacctaaagaaa

SEQ ID NO: 4399946 - DNA, 12 bp, Homo sapiens
tttggcccaggg

SEQ ID NO: 4399947 - DNA, 21 bp, Homo sapiens
tttggcctggggtgcatctcc

SEQ ID NO: 4399948 - DNA, 14 bp, Homo sapiens
tttggccttaagaa

SEQ ID NO: 4399949 - DNA, 15 bp, Homo sapiens
tttggccttaagaac

SEQ ID NO: 4399950 - DNA, 14 bp, Homo sapiens
tttggcttgctgtt

SEQ ID NO: 4399951 - DNA, 21 bp, Homo sapiens
tttgggaagaatccagtatta

SEQ ID NO: 4399952 - DNA, 19 bp, Homo sapiens
tttgggatagagaatgttc

SEQ ID NO: 4399953 - DNA, 12 bp, Homo sapiens
tttgggcccagg

SEQ ID NO: 4399954 - DNA, 19 bp, Homo sapiens
tttggtaaaaatgctgctc

SEQ ID NO: 4399955 - DNA, 17 bp, Homo sapiens
tttggtacacatgtgtt

SEQ ID NO: 4399956 - DNA, 14 bp, Homo sapiens
tttggtagatgaca

SEQ ID NO: 4399957 - DNA, 20 bp, Homo sapiens
tttggtagatgacaaatatt

SEQ ID NO: 4399958 - DNA, 13 bp, Homo sapiens
tttggtccctggg

SEQ ID NO: 4399959 - DNA, 23 bp, Homo sapiens
tttggtgaccccatacatttgtg

SEQ ID NO: 4399960 - DNA, 19 bp, Homo sapiens
tttggtgagagtcaaagct

SEQ ID NO: 4399961 - DNA, 18 bp, Homo sapiens
tttggtgcctttcctgtt

SEQ ID NO: 4399962 - DNA, 12 bp, Homo sapiens
tttggtgctttt

SEQ ID NO: 4399963 - DNA, 16 bp, Homo sapiens
tttggtggatgtaaat

SEQ ID NO: 4399964 - DNA, 15 bp, Homo sapiens
tttggttaagttggc

SEQ ID NO: 4399965 - DNA, 19 bp, Homo sapiens
tttggttaagttggcttct

SEQ ID NO: 4399966 - DNA, 22 bp, Homo sapiens
tttggttaagttggcttctgtt

SEQ ID NO: 4399967 - DNA, 19 bp, Homo sapiens
tttggttaatatgtctttt

SEQ ID NO: 4399968 - DNA, 20 bp, Homo sapiens
tttggttcattaattctata

SEQ ID NO: 4399969 - DNA, 19 bp, Homo sapiens
tttggtttcccaagagcta

SEQ ID NO: 4399970 - DNA, 14 bp, Homo sapiens
tttgtaaaaatgag

SEQ ID NO: 4399971 - DNA, 16 bp, Homo sapiens
tttgtaaataaaaaca

SEQ ID NO: 4399972 - DNA, 14 bp, Homo sapiens
tttgtaaataggat

SEQ ID NO: 4399973 - DNA, 23 bp, Homo sapiens
tttgtaaatgcatattaaataat

SEQ ID NO: 4399974 - DNA, 21 bp, Homo sapiens
tttgtaaatgcctcttaaatt

SEQ ID NO: 4399975 - DNA, 11 bp, Homo sapiens
tttgtaaattc

SEQ ID NO: 4399976 - DNA, 20 bp, Homo sapiens
tttgtaaccacaactttcac

SEQ ID NO: 4399977 - DNA, 13 bp, Homo sapiens
tttgtaacttcaa

SEQ ID NO: 4399978 - DNA, 15 bp, Homo sapiens
tttgtaacttcaaat

SEQ ID NO: 4399979 - DNA, 19 bp, Homo sapiens
tttgtaagcaacttgcttc

SEQ ID NO: 4399980 - DNA, 20 bp, Homo sapiens
tttgtaagcaacttgcttct

SEQ ID NO: 4399981 - DNA, 13 bp, Homo sapiens
tttgtaatacttt

SEQ ID NO: 4399982 - DNA, 22 bp, Homo sapiens
tttgtaatatggaaatctttta

SEQ ID NO: 4399983 - DNA, 17 bp, Homo sapiens
tttgtaatattctgttt

SEQ ID NO: 4399984 - DNA, 16 bp, Homo sapiens
tttgtaatattttcca

SEQ ID NO: 4399985 - DNA, 14 bp, Homo sapiens
tttgtaattaaaag

SEQ ID NO: 4399986 - DNA, 19 bp, Homo sapiens
tttgtacatatcaaataga

SEQ ID NO: 4399987 - DNA, 16 bp, Homo sapiens
tttgtaccaagtaaat

SEQ ID NO: 4399988 - DNA, 19 bp, Homo sapiens
tttgtaccagtgaattttt

SEQ ID NO: 4399989 - DNA, 22 bp, Homo sapiens
tttgtaccagtgaatttttgca

SEQ ID NO: 4399990 - DNA, 23 bp, Homo sapiens
tttgtaccagtgaatttttgcaa

SEQ ID NO: 4399991 - DNA, 19 bp, Homo sapiens
tttgtaccattttaaagtt

SEQ ID NO: 4399992 - DNA, 18 bp, Homo sapiens
tttgtagaataaatggtt

SEQ ID NO: 4399993 - DNA, 15 bp, Homo sapiens
tttgtaggtaaaatg

SEQ ID NO: 4399994 - DNA, 17 bp, Homo sapiens
tttgtaggtaaaatgta

SEQ ID NO: 4399995 - DNA, 15 bp, Homo sapiens
tttgtagtagcgttt

SEQ ID NO: 4399996 - DNA, 19 bp, Homo sapiens
tttgtagtagcgtttttta

SEQ ID NO: 4399997 - DNA, 13 bp, Homo sapiens
tttgtataattgg

SEQ ID NO: 4399998 - DNA, 21 bp, Homo sapiens
tttgtataattggatttccta

SEQ ID NO: 4399999 - DNA, 12 bp, Homo sapiens
tttgtatctttc

SEQ ID NO: 4400000 - DNA, 22 bp, Homo sapiens
tttgtatcttttatcctgggag

SEQ ID NO: 4400001 - DNA, 19 bp, Homo sapiens
tttgtatgaaatatatgtg

SEQ ID NO: 4400002 - DNA, 13 bp, Homo sapiens
tttgtattaccat

SEQ ID NO: 4400003 - DNA, 18 bp, Homo sapiens
tttgtattattacaaata

SEQ ID NO: 4400004 - DNA, 13 bp, Homo sapiens
tttgtattcaaaa

SEQ ID NO: 4400005 - DNA, 13 bp, Homo sapiens
tttgtattcttca

SEQ ID NO: 4400006 - DNA, 22 bp, Homo sapiens
tttgtattgcttcctgattacc

SEQ ID NO: 4400007 - DNA, 17 bp, Homo sapiens
tttgtattgtttctaca

SEQ ID NO: 4400008 - DNA, 14 bp, Homo sapiens
tttgtatttttagt

SEQ ID NO: 4400009 - DNA, 20 bp, Homo sapiens
tttgtatttttcatctttaa

SEQ ID NO: 4400010 - DNA, 23 bp, Homo sapiens
tttgtatttttcatctttaagaa

SEQ ID NO: 4400011 - DNA, 13 bp, Homo sapiens
tttgtatttttgt

SEQ ID NO: 4400012 - DNA, 14 bp, Homo sapiens
tttgtcaaactgta

SEQ ID NO: 4400013 - DNA, 16 bp, Homo sapiens
tttgtcaaactgtaga

SEQ ID NO: 4400014 - DNA, 23 bp, Homo sapiens
tttgtcaaactgtagaaatgatg

SEQ ID NO: 4400015 - DNA, 17 bp, Homo sapiens
tttgtcacttctgctgt

SEQ ID NO: 4400016 - DNA, 22 bp, Homo sapiens
tttgtcatgctgggatttccaa

SEQ ID NO: 4400017 - DNA, 16 bp, Homo sapiens
tttgtcccaagtgcca

SEQ ID NO: 4400018 - DNA, 11 bp, Homo sapiens
tttgtcccaga

SEQ ID NO: 4400019 - DNA, 18 bp, Homo sapiens
tttgtcctgcatcatctt

SEQ ID NO: 4400020 - DNA, 21 bp, Homo sapiens
tttgtcttgtgtttctttagt

SEQ ID NO: 4400021 - DNA, 15 bp, Homo sapiens
tttgtgaactggaag

SEQ ID NO: 4400022 - DNA, 12 bp, Homo sapiens
ttttaatagcac

SEQ ID NO: 4400023 - DNA, 15 bp, Homo sapiens
ttttaatatataatt

SEQ ID NO: 4400024 - DNA, 18 bp, Homo sapiens
ttttaatcattatttgag

SEQ ID NO: 4400025 - DNA, 16 bp, Homo sapiens
ttttaatctttgtgac

SEQ ID NO: 4400026 - DNA, 22 bp, Homo sapiens
ttttaatgaaaaggaatcacgt

SEQ ID NO: 4400027 - DNA, 20 bp, Homo sapiens
ttttaatgctatttgaacaa

SEQ ID NO: 4400028 - DNA, 12 bp, Homo sapiens
ttttaatgtgct

SEQ ID NO: 4400029 - DNA, 14 bp, Homo sapiens
ttttaatgtgctct

SEQ ID NO: 4400030 - DNA, 15 bp, Homo sapiens
ttttaattaaaaact

SEQ ID NO: 4400031 - DNA, 19 bp, Homo sapiens
ttttaattaaaaactttaa

SEQ ID NO: 4400032 - DNA, 14 bp, Homo sapiens
ttttaattcaagaa

SEQ ID NO: 4400033 - DNA, 15 bp, Homo sapiens
ttttaattcaagaaa

SEQ ID NO: 4400034 - DNA, 10 bp, Homo sapiens
ttttaattta

SEQ ID NO: 4400035 - DNA, 12 bp, Homo sapiens
ttttaatttagt

SEQ ID NO: 4400036 - DNA, 13 bp, Homo sapiens
ttttaatttcagg

SEQ ID NO: 4400037 - DNA, 15 bp, Homo sapiens
ttttaatttcaggaa

SEQ ID NO: 4400038 - DNA, 11 bp, Homo sapiens
ttttaatttga

SEQ ID NO: 4400039 - DNA, 19 bp, Homo sapiens
ttttaattttcaggtcaag

SEQ ID NO: 4400040 - DNA, 20 bp, Homo sapiens
ttttacaagtataacagttt

SEQ ID NO: 4400041 - DNA, 14 bp, Homo sapiens
ttttacacagagaa

SEQ ID NO: 4400042 - DNA, 23 bp, Homo sapiens
ttttacagagaggatacatttaa

SEQ ID NO: 4400043 - DNA, 16 bp, Homo sapiens
ttttacagctacttta

SEQ ID NO: 4400044 - DNA, 17 bp, Homo sapiens
ttttacagctactttaa

SEQ ID NO: 4400045 - DNA, 18 bp, Homo sapiens
ttttacagtatccaaaaa

SEQ ID NO: 4400046 - DNA, 12 bp, Homo sapiens
ttttacatttca

SEQ ID NO: 4400047 - DNA, 16 bp, Homo sapiens
ttttaccaaagcatca

SEQ ID NO: 4400048 - DNA, 17 bp, Homo sapiens
ttttaccaaagcatcaa

SEQ ID NO: 4400049 - DNA, 13 bp, Homo sapiens
ttttaccttgttt

SEQ ID NO: 4400050 - DNA, 17 bp, Homo sapiens
ttttactgaatgatcta

SEQ ID NO: 4400051 - DNA, 17 bp, Homo sapiens
ttttacttgaatcagat

SEQ ID NO: 4400052 - DNA, 18 bp, Homo sapiens
ttttacttgaatcagatg

SEQ ID NO: 4400053 - DNA, 11 bp, Homo sapiens
ttttactttgg

SEQ ID NO: 4400054 - DNA, 22 bp, Homo sapiens
ttttactttggtttagtctttt

SEQ ID NO: 4400055 - DNA, 18 bp, Homo sapiens
ttttacttttaaactgtg

SEQ ID NO: 4400056 - DNA, 20 bp, Homo sapiens
ttttacttttaaactgtgta

SEQ ID NO: 4400057 - DNA, 21 bp, Homo sapiens
ttttacttttctgccaaaata

SEQ ID NO: 4400058 - DNA, 22 bp, Homo sapiens
ttttagaaaaacatttaaactt

SEQ ID NO: 4400059 - DNA, 23 bp, Homo sapiens
ttttagaaaaggccaatatacct

SEQ ID NO: 4400060 - DNA, 16 bp, Homo sapiens
ttttagaattaaaatt

SEQ ID NO: 4400061 - DNA, 20 bp, Homo sapiens
ttttagcagttctgcaaata

SEQ ID NO: 4400062 - DNA, 13 bp, Homo sapiens
ttttaggcaaaga

SEQ ID NO: 4400063 - DNA, 16 bp, Homo sapiens
ttttagggttctaaat

SEQ ID NO: 4400064 - DNA, 14 bp, Homo sapiens
ttttagtaagttaa

SEQ ID NO: 4400065 - DNA, 18 bp, Homo sapiens
ttttagtaagttaatgta

SEQ ID NO: 4400066 - DNA, 14 bp, Homo sapiens
ttttagtaatttct

SEQ ID NO: 4400067 - DNA, 12 bp, Homo sapiens
ttttagtacatt

SEQ ID NO: 4400068 - DNA, 19 bp, Homo sapiens
ttttagtgtgtgcataata

SEQ ID NO: 4400069 - DNA, 13 bp, Homo sapiens
ttttataaatact

SEQ ID NO: 4400070 - DNA, 20 bp, Homo sapiens
ttttatacaagtaatttcct

SEQ ID NO: 4400071 - DNA, 13 bp, Homo sapiens
ttttatactcttt

SEQ ID NO: 4400072 - DNA, 18 bp, Homo sapiens
ttttatactctttctgta

SEQ ID NO: 4400073 - DNA, 15 bp, Homo sapiens
ttttatagtggaaaa

SEQ ID NO: 4400074 - DNA, 13 bp, Homo sapiens
ttttatagtgtgt

SEQ ID NO: 4400075 - DNA, 18 bp, Homo sapiens
ttttatagttattaaatg

SEQ ID NO: 4400076 - DNA, 22 bp, Homo sapiens
ttttatataataaagtattcca

SEQ ID NO: 4400077 - DNA, 22 bp, Homo sapiens
ttttatataatatctaaagtta

SEQ ID NO: 4400078 - DNA, 21 bp, Homo sapiens
ttttatatattatgtgaagaa

SEQ ID NO: 4400079 - DNA, 22 bp, Homo sapiens
ttttatatattatgtgaagaat

SEQ ID NO: 4400080 - DNA, 20 bp, Homo sapiens
ttttatatttattgttagaa

SEQ ID NO: 4400081 - DNA, 20 bp, Homo sapiens
ttttatatttcctttatgtg

SEQ ID NO: 4400082 - DNA, 23 bp, Homo sapiens
ttttatcccatttagtgtgaata

SEQ ID NO: 4400083 - DNA, 12 bp, Homo sapiens
ttttatcctgta

SEQ ID NO: 4400084 - DNA, 23 bp, Homo sapiens
ttttatctgaatttttaaacaag

SEQ ID NO: 4400085 - DNA, 18 bp, Homo sapiens
ttttatctggtgcctcct

SEQ ID NO: 4400086 - DNA, 16 bp, Homo sapiens
ttttatgaacattgta

SEQ ID NO: 4400087 - DNA, 22 bp, Homo sapiens
ttttatgatggagcaactgaaa

SEQ ID NO: 4400088 - DNA, 19 bp, Homo sapiens
ttttatggagacctctcct

SEQ ID NO: 4400089 - DNA, 12 bp, Homo sapiens
ttttatggatga

SEQ ID NO: 4400090 - DNA, 16 bp, Homo sapiens
ttttatggatgattaa

SEQ ID NO: 4400091 - DNA, 18 bp, Homo sapiens
ttttatggatgattaaat

SEQ ID NO: 4400092 - DNA, 19 bp, Homo sapiens
ttttatggatgattaaatt

SEQ ID NO: 4400093 - DNA, 16 bp, Homo sapiens
ttttatgggtgaaaat

SEQ ID NO: 4400094 - DNA, 23 bp, Homo sapiens
ttttatgtaatttctttaaatgt

SEQ ID NO: 4400095 - DNA, 18 bp, Homo sapiens
ttttatgtacaaccctga

SEQ ID NO: 4400096 - DNA, 19 bp, Homo sapiens
ttttatgtacaaccctgac

SEQ ID NO: 4400097 - DNA, 13 bp, Homo sapiens
ttttatgtgttct

SEQ ID NO: 4400098 - DNA, 18 bp, Homo sapiens
ttttatgttcttggcttt

SEQ ID NO: 4400099 - DNA, 22 bp, Homo sapiens
ttttattaatctactgtatcaa

SEQ ID NO: 4400100 - DNA, 19 bp, Homo sapiens
ttttattaatgcactttct

SEQ ID NO: 4400101 - DNA, 19 bp, Homo sapiens
ttttattaattttagtttt

SEQ ID NO: 4400102 - DNA, 13 bp, Homo sapiens
ttttattccctgc

SEQ ID NO: 4400103 - DNA, 15 bp, Homo sapiens
ttttattcctttcct

SEQ ID NO: 4400104 - DNA, 16 bp, Homo sapiens
ttttattcctttgaat

SEQ ID NO: 4400105 - DNA, 17 bp, Homo sapiens
ttttattcctttgaata

SEQ ID NO: 4400106 - DNA, 16 bp, Homo sapiens
ttttattgacacagaa

SEQ ID NO: 4400107 - DNA, 16 bp, Homo sapiens
ttttattgccttctca

SEQ ID NO: 4400108 - DNA, 21 bp, Homo sapiens
ttttattggggaattaaatag

SEQ ID NO: 4400109 - DNA, 23 bp, Homo sapiens
ttttattggggaattaaatagtg

SEQ ID NO: 4400110 - DNA, 13 bp, Homo sapiens
ttttatttctcgg

SEQ ID NO: 4400111 - DNA, 15 bp, Homo sapiens
ttttatttgcatgtg

SEQ ID NO: 4400112 - DNA, 16 bp, Homo sapiens
ttttattttatgttta

SEQ ID NO: 4400113 - DNA, 14 bp, Homo sapiens
ttttcaaaagataa

SEQ ID NO: 4400114 - DNA, 13 bp, Homo sapiens
ttttcaaagcaat

SEQ ID NO: 4400115 - DNA, 13 bp, Homo sapiens
ttttcaactttga

SEQ ID NO: 4400116 - DNA, 16 bp, Homo sapiens
ttttcaactttgaata

SEQ ID NO: 4400117 - DNA, 24 bp, Homo sapiens
ttttcaactttgaataaagaatac

SEQ ID NO: 4400118 - DNA, 14 bp, Homo sapiens
ttttcaagaaatga

SEQ ID NO: 4400119 - DNA, 18 bp, Homo sapiens
ttttcaatatattgaact

SEQ ID NO: 4400120 - DNA, 20 bp, Homo sapiens
ttttcaatatattgaacttt

SEQ ID NO: 4400121 - DNA, 16 bp, Homo sapiens
ttttcaatgtctaaaa

SEQ ID NO: 4400122 - DNA, 13 bp, Homo sapiens
ttttcaatttgga

SEQ ID NO: 4400123 - DNA, 18 bp, Homo sapiens
ttttcaccgagcagaggt

SEQ ID NO: 4400124 - DNA, 16 bp, Homo sapiens
ttttcactttctgtct

SEQ ID NO: 4400125 - DNA, 22 bp, Homo sapiens
ttttcagaacctcttccccaga

SEQ ID NO: 4400126 - DNA, 16 bp, Homo sapiens
ttttcagaatctgaat

SEQ ID NO: 4400127 - DNA, 17 bp, Homo sapiens
ttttcagaatctgaatg

SEQ ID NO: 4400128 - DNA, 16 bp, Homo sapiens
ttttcagacaaattac

SEQ ID NO: 4400129 - DNA, 21 bp, Homo sapiens
ttttcagatataaaagactga

SEQ ID NO: 4400130 - DNA, 22 bp, Homo sapiens
ttttcagatataaaagactgac

SEQ ID NO: 4400131 - DNA, 20 bp, Homo sapiens
ttttcagcagcaaaaccaaa

SEQ ID NO: 4400132 - DNA, 15 bp, Homo sapiens
ttttcagttgttctt

SEQ ID NO: 4400133 - DNA, 19 bp, Homo sapiens
ttttcatactgtacacatt

SEQ ID NO: 4400134 - DNA, 20 bp, Homo sapiens
ttttcatactgtacacattt

SEQ ID NO: 4400135 - DNA, 16 bp, Homo sapiens
ttttcatagatttgaa

SEQ ID NO: 4400136 - DNA, 18 bp, Homo sapiens
ttttcatcacagttgcct

SEQ ID NO: 4400137 - DNA, 16 bp, Homo sapiens
ttttcatcatttcagc

SEQ ID NO: 4400138 - DNA, 22 bp, Homo sapiens
ttttcatcccgtatcacagtgt

SEQ ID NO: 4400139 - DNA, 16 bp, Homo sapiens
ttttcattctgccaaa

SEQ ID NO: 4400140 - DNA, 20 bp, Homo sapiens
ttttcattgattatatgggt

SEQ ID NO: 4400141 - DNA, 15 bp, Homo sapiens
tttttggtggatgta

SEQ ID NO: 4400142 - DNA, 19 bp, Homo sapiens
tttttggtggatgtaaata

SEQ ID NO: 4400143 - DNA, 18 bp, Homo sapiens
tttttgtaacttcaaata

SEQ ID NO: 4400144 - DNA, 22 bp, Homo sapiens
tttttgtaataagcaatcaagg

SEQ ID NO: 4400145 - DNA, 14 bp, Homo sapiens
tttttgtaccattt

SEQ ID NO: 4400146 - DNA, 17 bp, Homo sapiens
tttttgtgtgtatttgc

SEQ ID NO: 4400147 - DNA, 13 bp, Homo sapiens
tttttgtttgatg

SEQ ID NO: 4400148 - DNA, 15 bp, Homo sapiens
tttttgtttgtttct

SEQ ID NO: 4400149 - DNA, 18 bp, Homo sapiens
tttttgttttgaaagttt

SEQ ID NO: 4400150 - DNA, 13 bp, Homo sapiens
ttttttaaaaaag

SEQ ID NO: 4400151 - DNA, 18 bp, Homo sapiens
ttttttaagttcttatga

SEQ ID NO: 4400152 - DNA, 23 bp, Homo sapiens
ttttttacaaagtttcaaaaact

SEQ ID NO: 4400153 - DNA, 13 bp, Homo sapiens
ttttttactcttt

SEQ ID NO: 4400154 - DNA, 12 bp, Homo sapiens
ttttttactttg

SEQ ID NO: 4400155 - DNA, 14 bp, Homo sapiens
ttttttacttttgt

SEQ ID NO: 4400156 - DNA, 17 bp, Homo sapiens
ttttttatgtacaaccc

SEQ ID NO: 4400157 - DNA, 14 bp, Homo sapiens
ttttttatgttcct

SEQ ID NO: 4400158 - DNA, 13 bp, Homo sapiens
ttttttcatttgt

SEQ ID NO: 4400159 - DNA, 13 bp, Homo sapiens
ttttttccatctt

SEQ ID NO: 4400160 - DNA, 15 bp, Homo sapiens
ttttttcccataaga

SEQ ID NO: 4400161 - DNA, 17 bp, Homo sapiens
ttttttctgtaatgtaa

SEQ ID NO: 4400162 - DNA, 13 bp, Homo sapiens
ttttttgagattt

SEQ ID NO: 4400163 - DNA, 13 bp, Homo sapiens
ttttttgagtcat

SEQ ID NO: 4400164 - DNA, 14 bp, Homo sapiens
ttttttgtaccatt

SEQ ID NO: 4400165 - DNA, 13 bp, Homo sapiens
ttttttgtatatt

SEQ ID NO: 4400166 - DNA, 13 bp, Homo sapiens
tttttttaaaatc

SEQ ID NO: 4400167 - DNA, 13 bp, Homo sapiens
tttttttccgtgt

SEQ ID NO: 4400168 - DNA, 14 bp, Homo sapiens
tttttttgtaactt

SEQ ID NO: 4400169 - DNA, 11 bp, Homo sapiens
ttttttttcca

SEQ ID NO: 4400170 - DNA, 13 bp, Homo sapiens
ttttttttgaaaa

SEQ ID NO: 4400171 - DNA, 19 bp, Homo sapiens
ttccgggaaaacagctatt

SEQ ID NO: 4400172 - DNA, 19 bp, Homo sapiens
ttcctaaaacacccttcag

SEQ ID NO: 4400173 - DNA, 13 bp, Homo sapiens
ttcctaaagaaaa

SEQ ID NO: 4400174 - DNA, 14 bp, Homo sapiens
ttcctaactgtgat

SEQ ID NO: 4400175 - DNA, 23 bp, Homo sapiens
ttcctaagacatttttcattcat

SEQ ID NO: 4400176 - DNA, 15 bp, Homo sapiens
ttcctaataaagttc

SEQ ID NO: 4400177 - DNA, 16 bp, Homo sapiens
ttcctaataaagttct

SEQ ID NO: 4400178 - DNA, 22 bp, Homo sapiens
ttcctacaagagcagcctgtgg

SEQ ID NO: 4400179 - DNA, 14 bp, Homo sapiens
ttcctacagcacta

SEQ ID NO: 4400180 - DNA, 17 bp, Homo sapiens
ttcctacagcactactg

SEQ ID NO: 4400181 - DNA, 22 bp, Homo sapiens
ttcctacagcactactgggtgt

SEQ ID NO: 4400182 - DNA, 23 bp, Homo sapiens
ttcctacagcactactgggtgtc

SEQ ID NO: 4400183 - DNA, 18 bp, Homo sapiens
ttcctacaggcagtctct

SEQ ID NO: 4400184 - DNA, 23 bp, Homo sapiens
ttcctacccacacctctgccaga

SEQ ID NO: 4400185 - DNA, 15 bp, Homo sapiens
ttcctaccctgcctc

SEQ ID NO: 4400186 - DNA, 21 bp, Homo sapiens
ttcctagattacatctgcctt

SEQ ID NO: 4400187 - DNA, 23 bp, Homo sapiens
ttcctagattacatctgccttaa

SEQ ID NO: 4400188 - DNA, 21 bp, Homo sapiens
ttcctagcactgccccacatg

SEQ ID NO: 4400189 - DNA, 22 bp, Homo sapiens
ttcctagcactgccccacatgc

SEQ ID NO: 4400190 - DNA, 13 bp, Homo sapiens
ttcctatacgcag

SEQ ID NO: 4400191 - DNA, 22 bp, Homo sapiens
ttcctatcacctcgagaagtaa

SEQ ID NO: 4400192 - DNA, 19 bp, Homo sapiens
ttcctattccaagcttcca

SEQ ID NO: 4400193 - DNA, 21 bp, Homo sapiens
ttcctattccaagcttccata

SEQ ID NO: 4400194 - DNA, 17 bp, Homo sapiens
ttcctcaaatacatgca

SEQ ID NO: 4400195 - DNA, 20 bp, Homo sapiens
ttcctcaaatcaaaaacagg

SEQ ID NO: 4400196 - DNA, 21 bp, Homo sapiens
ttcctcaaatcaaaaacaggc

SEQ ID NO: 4400197 - DNA, 20 bp, Homo sapiens
ttcctcaaattttttgactt

SEQ ID NO: 4400198 - DNA, 22 bp, Homo sapiens
ttcctcaaattttttgactttt

SEQ ID NO: 4400199 - DNA, 14 bp, Homo sapiens
ttcctcacagtccc

SEQ ID NO: 4400200 - DNA, 13 bp, Homo sapiens
ttcctcacatttg

SEQ ID NO: 4400201 - DNA, 15 bp, Homo sapiens
ttcctcagctctagg

SEQ ID NO: 4400202 - DNA, 20 bp, Homo sapiens
ttcctcatctatggttctaa

SEQ ID NO: 4400203 - DNA, 14 bp, Homo sapiens
ttcctccagagaca

SEQ ID NO: 4400204 - DNA, 22 bp, Homo sapiens
ttcctccagagacactgagcca

SEQ ID NO: 4400205 - DNA, 12 bp, Homo sapiens
ttcctccagcct

SEQ ID NO: 4400206 - DNA, 19 bp, Homo sapiens
ttcctccagcctcccctcc

SEQ ID NO: 4400207 - DNA, 21 bp, Homo sapiens
ttcctccagcctcccctcccc

SEQ ID NO: 4400208 - DNA, 15 bp, Homo sapiens
ttcctcccagcattg

SEQ ID NO: 4400209 - DNA, 23 bp, Homo sapiens
ttcctcccagtgagactgcccca

SEQ ID NO: 4400210 - DNA, 17 bp, Homo sapiens
ttcctccccctgcaact

SEQ ID NO: 4400211 - DNA, 10 bp, Homo sapiens
ttcctccctc

SEQ ID NO: 4400212 - DNA, 12 bp, Homo sapiens
ttcctcctcagg

SEQ ID NO: 4400213 - DNA, 23 bp, Homo sapiens
ttcctcctgcagacacctggact

SEQ ID NO: 4400214 - DNA, 11 bp, Homo sapiens
ttcctcctggg

SEQ ID NO: 4400215 - DNA, 15 bp, Homo sapiens
ttcctcctgggccct

SEQ ID NO: 4400216 - DNA, 11 bp, Homo sapiens
ttcctcctttc

SEQ ID NO: 4400217 - DNA, 15 bp, Homo sapiens
ttcctctagaagcca

SEQ ID NO: 4400218 - DNA, 21 bp, Homo sapiens
ttcctctattgatgtacagtc

SEQ ID NO: 4400219 - DNA, 11 bp, Homo sapiens
ttcctctgccc

SEQ ID NO: 4400220 - DNA, 12 bp, Homo sapiens
ttcctctgcctg

SEQ ID NO: 4400221 - DNA, 18 bp, Homo sapiens
ttcctctgggtttctaag

SEQ ID NO: 4400222 - DNA, 16 bp, Homo sapiens
ttcctctgtacagcaa

SEQ ID NO: 4400223 - DNA, 15 bp, Homo sapiens
ttcctctgtgaactg

SEQ ID NO: 4400224 - DNA, 21 bp, Homo sapiens
ttcctcttagaagaatattgt

SEQ ID NO: 4400225 - DNA, 22 bp, Homo sapiens
ttcctcttagaagaatattgta

SEQ ID NO: 4400226 - DNA, 12 bp, Homo sapiens
ttcctgaagctg

SEQ ID NO: 4400227 - DNA, 18 bp, Homo sapiens
ttcctgaatccaaactaa

SEQ ID NO: 4400228 - DNA, 13 bp, Homo sapiens
ttcctgagggcta

SEQ ID NO: 4400229 - DNA, 21 bp, Homo sapiens
ttcctgattaccagtctgatt

SEQ ID NO: 4400230 - DNA, 13 bp, Homo sapiens
ttcctgccctgtc

SEQ ID NO: 4400231 - DNA, 16 bp, Homo sapiens
ttcctgcccttccctc

SEQ ID NO: 4400232 - DNA, 11 bp, Homo sapiens
ttcctgcctgg

SEQ ID NO: 4400233 - DNA, 12 bp, Homo sapiens
ttcctgcctggt

SEQ ID NO: 4400234 - DNA, 13 bp, Homo sapiens
ttcctgcctttga

SEQ ID NO: 4400235 - DNA, 19 bp, Homo sapiens
ttcctgcgtcctcctcacc

SEQ ID NO: 4400236 - DNA, 19 bp, Homo sapiens
ttcctgcttaaacttgacc

SEQ ID NO: 4400237 - DNA, 17 bp, Homo sapiens
ttcctggccttctgaac

SEQ ID NO: 4400238 - DNA, 12 bp, Homo sapiens
ttcctgggagga

SEQ ID NO: 4400239 - DNA, 17 bp, Homo sapiens
ttcctgggccagaagta

SEQ ID NO: 4400240 - DNA, 15 bp, Homo sapiens
ttcctgtaatatatt

SEQ ID NO: 4400241 - DNA, 15 bp, Homo sapiens
ttcctgtctcactct

SEQ ID NO: 4400242 - DNA, 19 bp, Homo sapiens
ttcctgtctcactcttctg

SEQ ID NO: 4400243 - DNA, 20 bp, Homo sapiens
ttcctgtgggtgttctttcc

SEQ ID NO: 4400244 - DNA, 21 bp, Homo sapiens
ttcctgtgggtgttctttcct

SEQ ID NO: 4400245 - DNA, 23 bp, Homo sapiens
ttcctgtgtaacatctgccattt

SEQ ID NO: 4400246 - DNA, 20 bp, Homo sapiens
ttcctgttcttaagacgtga

SEQ ID NO: 4400247 - DNA, 19 bp, Homo sapiens
ttcctgtttttcacatttt

SEQ ID NO: 4400248 - DNA, 13 bp, Homo sapiens
ttccttacctttt

SEQ ID NO: 4400249 - DNA, 16 bp, Homo sapiens
ttccttactgcagaat

SEQ ID NO: 4400250 - DNA, 22 bp, Homo sapiens
ttccttagactcttttccttcc

SEQ ID NO: 4400251 - DNA, 22 bp, Homo sapiens
ttccttatcacagaaataaaat

SEQ ID NO: 4400252 - DNA, 18 bp, Homo sapiens
ttccttatccctctcttc

SEQ ID NO: 4400253 - DNA, 23 bp, Homo sapiens
ttccttatccctctcttcccctt

SEQ ID NO: 4400254 - DNA, 22 bp, Homo sapiens
ttccttatgtatcagtgtcctt

SEQ ID NO: 4400255 - DNA, 15 bp, Homo sapiens
ttccttatttgcctt

SEQ ID NO: 4400256 - DNA, 21 bp, Homo sapiens
ttccttcatttccaccaggcc

SEQ ID NO: 4400257 - DNA, 19 bp, Homo sapiens
ttccttccctccttttaaa

SEQ ID NO: 4400258 - DNA, 12 bp, Homo sapiens
ttccttccctgg

SEQ ID NO: 4400259 - DNA, 13 bp, Homo sapiens
ttccttccctggc

SEQ ID NO: 4400260 - DNA, 14 bp, Homo sapiens
ttccttccctggct

SEQ ID NO: 4400261 - DNA, 14 bp, Homo sapiens
ttccttcctccttt

SEQ ID NO: 4400262 - DNA, 14 bp, Homo sapiens
ttccttccttccct

SEQ ID NO: 4400263 - DNA, 13 bp, Homo sapiens
ttccttctcccat

SEQ ID NO: 4400264 - DNA, 15 bp, Homo sapiens
ttccttctcccatct

SEQ ID NO: 4400265 - DNA, 18 bp, Homo sapiens
ttccttctggttctaact

SEQ ID NO: 4400266 - DNA, 21 bp, Homo sapiens
ttccttgacctgcattgtaaa

SEQ ID NO: 4400267 - DNA, 13 bp, Homo sapiens
ttccttgtcccgt

SEQ ID NO: 4400268 - DNA, 17 bp, Homo sapiens
ttcatagttcagaattt

SEQ ID NO: 4400269 - DNA, 22 bp, Homo sapiens
ttcatatataagactgctgcag

SEQ ID NO: 4400270 - DNA, 15 bp, Homo sapiens
ttcatatctaacttt

SEQ ID NO: 4400271 - DNA, 21 bp, Homo sapiens
ttcatatgaaaggtgccatgg

SEQ ID NO: 4400272 - DNA, 23 bp, Homo sapiens
ttcatatgaaaggtgccatggaa

SEQ ID NO: 4400273 - DNA, 15 bp, Homo sapiens
ttcatatgtcacctt

SEQ ID NO: 4400274 - DNA, 18 bp, Homo sapiens
ttcatattattttagtgt

SEQ ID NO: 4400275 - DNA, 13 bp, Homo sapiens
ttcatatttaatt

SEQ ID NO: 4400276 - DNA, 20 bp, Homo sapiens
ttcatatttaatttgaaggt

SEQ ID NO: 4400277 - DNA, 16 bp, Homo sapiens
ttcatcaagagtttat

SEQ ID NO: 4400278 - DNA, 12 bp, Homo sapiens
ttcatcatttca

SEQ ID NO: 4400279 - DNA, 18 bp, Homo sapiens
ttcatcatttcagccaaa

SEQ ID NO: 4400280 - DNA, 23 bp, Homo sapiens
ttcatcatttcagccaaagtcct

SEQ ID NO: 4400281 - DNA, 23 bp, Homo sapiens
ttcatccactctgcctgcttaca

SEQ ID NO: 4400282 - DNA, 17 bp, Homo sapiens
ttcatcccgtatcacag

SEQ ID NO: 4400283 - DNA, 21 bp, Homo sapiens
ttcatcccgtatcacagtgtt

SEQ ID NO: 4400284 - DNA, 19 bp, Homo sapiens
ttcatccgttgtgactcta

SEQ ID NO: 4400285 - DNA, 13 bp, Homo sapiens
ttcatcctataag

SEQ ID NO: 4400286 - DNA, 18 bp, Homo sapiens
ttcatcctgactctgccc

SEQ ID NO: 4400287 - DNA, 18 bp, Homo sapiens
ttcatcgaatctactaat

SEQ ID NO: 4400288 - DNA, 23 bp, Homo sapiens
ttcatcgaatctactaattccac

SEQ ID NO: 4400289 - DNA, 22 bp, Homo sapiens
ttcatctaataaatcagtgaac

SEQ ID NO: 4400290 - DNA, 12 bp, Homo sapiens
ttcatctcattt

SEQ ID NO: 4400291 - DNA, 16 bp, Homo sapiens
ttcatctcatttaagg

SEQ ID NO: 4400292 - DNA, 19 bp, Homo sapiens
ttcatctggcaacatcttt

SEQ ID NO: 4400293 - DNA, 14 bp, Homo sapiens
ttcatcttaaacta

SEQ ID NO: 4400294 - DNA, 16 bp, Homo sapiens
ttcatcttttgaagag

SEQ ID NO: 4400295 - DNA, 14 bp, Homo sapiens
ttcatgaaatgtgt

SEQ ID NO: 4400296 - DNA, 15 bp, Homo sapiens
ttcatgaaatgtgtt

SEQ ID NO: 4400297 - DNA, 13 bp, Homo sapiens
ttcatgatgcagt

SEQ ID NO: 4400298 - DNA, 17 bp, Homo sapiens
ttcatgatgcagtctcc

SEQ ID NO: 4400299 - DNA, 15 bp, Homo sapiens
ttcatgattagaaat

SEQ ID NO: 4400300 - DNA, 14 bp, Homo sapiens
ttcatgcagctgtg

SEQ ID NO: 4400301 - DNA, 16 bp, Homo sapiens
ttcatgcccttctgat

SEQ ID NO: 4400302 - DNA, 15 bp, Homo sapiens
ttcatgctctgcaaa

SEQ ID NO: 4400303 - DNA, 14 bp, Homo sapiens
ttcatgcttgacat

SEQ ID NO: 4400304 - DNA, 18 bp, Homo sapiens
ttcatgcttgacatacct

SEQ ID NO: 4400305 - DNA, 17 bp, Homo sapiens
ttcatggcaatgaaaat

SEQ ID NO: 4400306 - DNA, 23 bp, Homo sapiens
ttcatggcaatgaaaattttaag

SEQ ID NO: 4400307 - DNA, 19 bp, Homo sapiens
ttcatggctacctcagaaa

SEQ ID NO: 4400308 - DNA, 15 bp, Homo sapiens
ttcatgggctgtgtg

SEQ ID NO: 4400309 - DNA, 18 bp, Homo sapiens
ttcatgtaataaacaggt

SEQ ID NO: 4400310 - DNA, 13 bp, Homo sapiens
ttcatgtaatttt

SEQ ID NO: 4400311 - DNA, 21 bp, Homo sapiens
ttcatgtaattttattttaaa

SEQ ID NO: 4400312 - DNA, 17 bp, Homo sapiens
ttcatgtagtaagattt

SEQ ID NO: 4400313 - DNA, 17 bp, Homo sapiens
ttcatgtatgtatataa

SEQ ID NO: 4400314 - DNA, 14 bp, Homo sapiens
ttcatgtcatcaaa

SEQ ID NO: 4400315 - DNA, 24 bp, Homo sapiens
ttcatgtggcagggagcagtacac

SEQ ID NO: 4400316 - DNA, 12 bp, Homo sapiens
ttcattaaataa

SEQ ID NO: 4400317 - DNA, 16 bp, Homo sapiens
ttcattaattcaggca

SEQ ID NO: 4400318 - DNA, 14 bp, Homo sapiens
ttcattagttttga

SEQ ID NO: 4400319 - DNA, 13 bp, Homo sapiens
ttcattatgcttt

SEQ ID NO: 4400320 - DNA, 21 bp, Homo sapiens
ttcattatttgtcaaattgtc

SEQ ID NO: 4400321 - DNA, 23 bp, Homo sapiens
ttcattcatgaatattttcaagt

SEQ ID NO: 4400322 - DNA, 15 bp, Homo sapiens
ttcattcattggtga

SEQ ID NO: 4400323 - DNA, 15 bp, Homo sapiens
ttcattccattgcct

SEQ ID NO: 4400324 - DNA, 16 bp, Homo sapiens
ttcattcctaaagaaa

SEQ ID NO: 4400325 - DNA, 14 bp, Homo sapiens
ttcattcctcacaa

SEQ ID NO: 4400326 - DNA, 20 bp, Homo sapiens
ttcattgggaagattctcta

SEQ ID NO: 4400327 - DNA, 18 bp, Homo sapiens
ttcattggtgaagtaaat

SEQ ID NO: 4400328 - DNA, 14 bp, Homo sapiens
ttcattgtgattta

SEQ ID NO: 4400329 - DNA, 13 bp, Homo sapiens
ttcatttaactct

SEQ ID NO: 4400330 - DNA, 17 bp, Homo sapiens
ttcatttaactctttga

SEQ ID NO: 4400331 - DNA, 13 bp, Homo sapiens
ttcatttctctgc

SEQ ID NO: 4400332 - DNA, 19 bp, Homo sapiens
ttcatttcttatcacataa

SEQ ID NO: 4400333 - DNA, 22 bp, Homo sapiens
ttcatttggttcattaattcta

SEQ ID NO: 4400334 - DNA, 17 bp, Homo sapiens
ttcatttgtatgtcaaa

SEQ ID NO: 4400335 - DNA, 18 bp, Homo sapiens
ttcatttgtatgtcaaag

SEQ ID NO: 4400336 - DNA, 12 bp, Homo sapiens
ttcattttactg

SEQ ID NO: 4400337 - DNA, 18 bp, Homo sapiens
ttcattttagtattttag

SEQ ID NO: 4400338 - DNA, 17 bp, Homo sapiens
ttcattttatatttaaa

SEQ ID NO: 4400339 - DNA, 19 bp, Homo sapiens
ttcattttctagatacaat

SEQ ID NO: 4400340 - DNA, 23 bp, Homo sapiens
ttcattttgaaaatatgtactgt

SEQ ID NO: 4400341 - DNA, 14 bp, Homo sapiens
ttcattttgtataa

SEQ ID NO: 4400342 - DNA, 20 bp, Homo sapiens
ttcattttgttttgctctga

SEQ ID NO: 4400343 - DNA, 21 bp, Homo sapiens
ttcatttttattaaacagtga

SEQ ID NO: 4400344 - DNA, 22 bp, Homo sapiens
ttcatttttgaaactgcatttg

SEQ ID NO: 4400345 - DNA, 17 bp, Homo sapiens
ttcatttttttccaggc

SEQ ID NO: 4400346 - DNA, 16 bp, Homo sapiens
ttccaaaacctaaaga

SEQ ID NO: 4400347 - DNA, 14 bp, Homo sapiens
ttccaaaatattat

SEQ ID NO: 4400348 - DNA, 12 bp, Homo sapiens
ttccaaagaaag

SEQ ID NO: 4400349 - DNA, 21 bp, Homo sapiens
ttccaaagagtagaattgcat

SEQ ID NO: 4400350 - DNA, 16 bp, Homo sapiens
ttccaaagctttatta

SEQ ID NO: 4400351 - DNA, 18 bp, Homo sapiens
ttccaaattcagtttcat

SEQ ID NO: 4400352 - DNA, 15 bp, Homo sapiens
ttccaacatttctca

SEQ ID NO: 4400353 - DNA, 14 bp, Homo sapiens
ttccaacttcctgt

SEQ ID NO: 4400354 - DNA, 15 bp, Homo sapiens
ttccaagaaaatatc

SEQ ID NO: 4400355 - DNA, 17 bp, Homo sapiens
ttccaagaaaatatcac

SEQ ID NO: 4400356 - DNA, 16 bp, Homo sapiens
ttccaagacatgtctg

SEQ ID NO: 4400357 - DNA, 16 bp, Homo sapiens
ttccaagagaactaaa

SEQ ID NO: 4400358 - DNA, 16 bp, Homo sapiens
ttccaagttgctaata

SEQ ID NO: 4400359 - DNA, 20 bp, Homo sapiens
ttccaatagaaagaaactaa

SEQ ID NO: 4400360 - DNA, 13 bp, Homo sapiens
ttcaccaccccct

SEQ ID NO: 4400361 - DNA, 18 bp, Homo sapiens
ttcaccaccccctgtccc

SEQ ID NO: 4400362 - DNA, 22 bp, Homo sapiens
ttcaccaccccctgtcccattc

SEQ ID NO: 4400363 - DNA, 15 bp, Homo sapiens
ttcaccagtgttcct

SEQ ID NO: 4400364 - DNA, 20 bp, Homo sapiens
ttcaccagtgttcctgaagc

SEQ ID NO: 4400365 - DNA, 22 bp, Homo sapiens
ttcaccagtgttcctgaagctg

SEQ ID NO: 4400366 - DNA, 19 bp, Homo sapiens
ttcaccatgttagccagga

SEQ ID NO: 4400367 - DNA, 21 bp, Homo sapiens
ttcacccaccaggccagctca

SEQ ID NO: 4400368 - DNA, 16 bp, Homo sapiens
ttcacccctccctttc

SEQ ID NO: 4400369 - DNA, 14 bp, Homo sapiens
ttcaccctgggcag

SEQ ID NO: 4400370 - DNA, 14 bp, Homo sapiens
ttcacctgtaaaac

SEQ ID NO: 4400371 - DNA, 16 bp, Homo sapiens
ttcacctgtaaacctg

SEQ ID NO: 4400372 - DNA, 16 bp, Homo sapiens
ttcacctgtatatttc

SEQ ID NO: 4400373 - DNA, 20 bp, Homo sapiens
ttcacctgtatatttctttt

SEQ ID NO: 4400374 - DNA, 23 bp, Homo sapiens
ttcacgattaactgtgaaatgta

SEQ ID NO: 4400375 - DNA, 20 bp, Homo sapiens
ttcacgccattctcctgcct

SEQ ID NO: 4400376 - DNA, 22 bp, Homo sapiens
ttcactagaagccgtgggaaga

SEQ ID NO: 4400377 - DNA, 16 bp, Homo sapiens
ttcactataatgtgaa

SEQ ID NO: 4400378 - DNA, 16 bp, Homo sapiens
ttcactcacatagcca

SEQ ID NO: 4400379 - DNA, 20 bp, Homo sapiens
ttcactcatgcaaactgctt

SEQ ID NO: 4400380 - DNA, 13 bp, Homo sapiens
ttcactgcaattt

SEQ ID NO: 4400381 - DNA, 13 bp, Homo sapiens
ttcactgtatata

SEQ ID NO: 4400382 - DNA, 14 bp, Homo sapiens
ttcactgtatataa

SEQ ID NO: 4400383 - DNA, 16 bp, Homo sapiens
ttcactgtatataaac

SEQ ID NO: 4400384 - DNA, 17 bp, Homo sapiens
ttcactgtatataaaca

SEQ ID NO: 4400385 - DNA, 19 bp, Homo sapiens
ttcactgtatataaacata

SEQ ID NO: 4400386 - DNA, 17 bp, Homo sapiens
ttcactgtcatcttcaa

SEQ ID NO: 4400387 - DNA, 16 bp, Homo sapiens
ttcactgtctttaatt

SEQ ID NO: 4400388 - DNA, 19 bp, Homo sapiens
ttcactgtctttaattctg

SEQ ID NO: 4400389 - DNA, 14 bp, Homo sapiens
ttcacttctcccaa

SEQ ID NO: 4400390 - DNA, 18 bp, Homo sapiens
ttcacttctcccaagact

SEQ ID NO: 4400391 - DNA, 14 bp, Homo sapiens
ttcactttgacact

SEQ ID NO: 4400392 - DNA, 17 bp, Homo sapiens
ttcacttttgacaaagg

SEQ ID NO: 4400393 - DNA, 12 bp, Homo sapiens
ttcagaacctct

SEQ ID NO: 4400394 - DNA, 17 bp, Homo sapiens
ttcagaacctcttcccc

SEQ ID NO: 4400395 - DNA, 19 bp, Homo sapiens
ttcagaactgcccttgctg

SEQ ID NO: 4400396 - DNA, 23 bp, Homo sapiens
ttcagaactgcccttgctgcccg

SEQ ID NO: 4400397 - DNA, 14 bp, Homo sapiens
ttcagaagaaaaag

SEQ ID NO: 4400398 - DNA, 17 bp, Homo sapiens
ttcagaagcaagccaga

SEQ ID NO: 4400399 - DNA, 21 bp, Homo sapiens
ttcagaatctgaatgtaattt

SEQ ID NO: 4400400 - DNA, 13 bp, Homo sapiens
ttcagaatttagt

SEQ ID NO: 4400401 - DNA, 21 bp, Homo sapiens
ttcagaatttagtgtatccat

SEQ ID NO: 4400402 - DNA, 20 bp, Homo sapiens
ttcagacatctgaggtttta

SEQ ID NO: 4400403 - DNA, 15 bp, Homo sapiens
ttcagaccccagcgg

SEQ ID NO: 4400404 - DNA, 16 bp, Homo sapiens
ttcagacccctgcctg

SEQ ID NO: 4400405 - DNA, 13 bp, Homo sapiens
ttcagactcagac

SEQ ID NO: 4400406 - DNA, 16 bp, Homo sapiens
ttcagagccagcctgg

SEQ ID NO: 4400407 - DNA, 22 bp, Homo sapiens
ttcagaggccctcgctgccagc

SEQ ID NO: 4400408 - DNA, 23 bp, Homo sapiens
ttcagagggtaagtaaacagatt

SEQ ID NO: 4400409 - DNA, 22 bp, Homo sapiens
ttcagatatcttggacaaatca

SEQ ID NO: 4400410 - DNA, 11 bp, Homo sapiens
ttcagatgagg

SEQ ID NO: 4400411 - DNA, 13 bp, Homo sapiens
ttcagatgtaatg

SEQ ID NO: 4400412 - DNA, 18 bp, Homo sapiens
ttcagatgtaatgttttc

SEQ ID NO: 4400413 - DNA, 22 bp, Homo sapiens
ttcagatgtttcatcaatgcag

SEQ ID NO: 4400414 - DNA, 20 bp, Homo sapiens
ttcagcaaactcttttccca

SEQ ID NO: 4400415 - DNA, 19 bp, Homo sapiens
ttcagcaaagtggttccct

SEQ ID NO: 4400416 - DNA, 14 bp, Homo sapiens
ttcagcaaccctac

SEQ ID NO: 4400417 - DNA, 17 bp, Homo sapiens
ttcagcagcaaattttc

SEQ ID NO: 4400418 - DNA, 19 bp, Homo sapiens
ttcagcatccgcaggtgct

SEQ ID NO: 4400419 - DNA, 22 bp, Homo sapiens
ttcagcattaagctgttcctgt

SEQ ID NO: 4400420 - DNA, 20 bp, Homo sapiens
ttcagcattcttagcctgtg

SEQ ID NO: 4400421 - DNA, 11 bp, Homo sapiens
ttcagcatttg

SEQ ID NO: 4400422 - DNA, 23 bp, Homo sapiens
ttcagccacatgccccaggctct

SEQ ID NO: 4400423 - DNA, 13 bp, Homo sapiens
ttcagcccatctc

SEQ ID NO: 4400424 - DNA, 13 bp, Homo sapiens
ttcagcccctcct

SEQ ID NO: 4400425 - DNA, 14 bp, Homo sapiens
ttcagcccctcctc

SEQ ID NO: 4400426 - DNA, 18 bp, Homo sapiens
ttcagctagaatttctgg

SEQ ID NO: 4400427 - DNA, 14 bp, Homo sapiens
ttcaggcactgaga

SEQ ID NO: 4400428 - DNA, 13 bp, Homo sapiens
ttcaggccagccc

SEQ ID NO: 4400429 - DNA, 15 bp, Homo sapiens
ttcaggccagcccag

SEQ ID NO: 4400430 - DNA, 13 bp, Homo sapiens
ttcaggcctgcta

SEQ ID NO: 4400431 - DNA, 16 bp, Homo sapiens
ttcaggctgcttggga

SEQ ID NO: 4400432 - DNA, 15 bp, Homo sapiens
ttcaggggaagagaa

SEQ ID NO: 4400433 - DNA, 16 bp, Homo sapiens
ttcaggggactcagcc

SEQ ID NO: 4400434 - DNA, 17 bp, Homo sapiens
ttcaggggactcagccc

SEQ ID NO: 4400435 - DNA, 18 bp, Homo sapiens
ttcaggtggagagcacta

SEQ ID NO: 4400436 - DNA, 20 bp, Homo sapiens
ttcaggtggagagcactaga

SEQ ID NO: 4400437 - DNA, 16 bp, Homo sapiens
ttcagtaatgttattt

SEQ ID NO: 4400438 - DNA, 13 bp, Homo sapiens
ttcagtattttcc

SEQ ID NO: 4400439 - DNA, 18 bp, Homo sapiens
ttcagtattttccagcct

SEQ ID NO: 4400440 - DNA, 13 bp, Homo sapiens
ttcagtcattaaa

SEQ ID NO: 4400441 - DNA, 16 bp, Homo sapiens
ttcagtcattaaatta

SEQ ID NO: 4400442 - DNA, 22 bp, Homo sapiens
ttcagtgagagacgccctattt

SEQ ID NO: 4400443 - DNA, 20 bp, Homo sapiens
ttcagtgagcccctccccag

SEQ ID NO: 4400444 - DNA, 23 bp, Homo sapiens
ttcagtgagcccctccccagcca

SEQ ID NO: 4400445 - DNA, 15 bp, Homo sapiens
ttcagtgatactcac

SEQ ID NO: 4400446 - DNA, 22 bp, Homo sapiens
ttcagtgatcttcactgtatat

SEQ ID NO: 4400447 - DNA, 19 bp, Homo sapiens
ttcagtggtgaaatcttgt

SEQ ID NO: 4400448 - DNA, 18 bp, Homo sapiens
tcagaggcctgctgccag

SEQ ID NO: 4400449 - DNA, 13 bp, Homo sapiens
tcagaggtccagg

SEQ ID NO: 4400450 - DNA, 16 bp, Homo sapiens
tcagaggtccaggccc

SEQ ID NO: 4400451 - DNA, 19 bp, Homo sapiens
tcagaggtgctaaattgtc

SEQ ID NO: 4400452 - DNA, 19 bp, Homo sapiens
tcagagtccagtgctctgc

SEQ ID NO: 4400453 - DNA, 16 bp, Homo sapiens
tcagagtgacagtcat

SEQ ID NO: 4400454 - DNA, 13 bp, Homo sapiens
tcagagtgccact

SEQ ID NO: 4400455 - DNA, 20 bp, Homo sapiens
tcagagttcccaagaaagga

SEQ ID NO: 4400456 - DNA, 18 bp, Homo sapiens
tcagagttctgaagaaaa

SEQ ID NO: 4400457 - DNA, 17 bp, Homo sapiens
tcagataatatgtttag

SEQ ID NO: 4400458 - DNA, 18 bp, Homo sapiens
tcagatataaaagactga

SEQ ID NO: 4400459 - DNA, 21 bp, Homo sapiens
tcagatatcttggacaaatca

SEQ ID NO: 4400460 - DNA, 13 bp, Homo sapiens
tcagatcagtgct

SEQ ID NO: 4400461 - DNA, 23 bp, Homo sapiens
tcagatcagtgtaccatttgcct

SEQ ID NO: 4400462 - DNA, 22 bp, Homo sapiens
tcagatcctgttacttgcttca

SEQ ID NO: 4400463 - DNA, 20 bp, Homo sapiens
tcagatcttaatataaattc

SEQ ID NO: 4400464 - DNA, 21 bp, Homo sapiens
tcagatcttaatataaattca

SEQ ID NO: 4400465 - DNA, 18 bp, Homo sapiens
tcagatctttctccttga

SEQ ID NO: 4400466 - DNA, 21 bp, Homo sapiens
tcagatgaggtcaacacaggt

SEQ ID NO: 4400467 - DNA, 17 bp, Homo sapiens
tcagatgatctctccac

SEQ ID NO: 4400468 - DNA, 21 bp, Homo sapiens
tcagatgatttcccccctccg

SEQ ID NO: 4400469 - DNA, 23 bp, Homo sapiens
tcagatgcaattgctcccatcag

SEQ ID NO: 4400470 - DNA, 16 bp, Homo sapiens
tcagatgcagtttgga

SEQ ID NO: 4400471 - DNA, 12 bp, Homo sapiens
tcagatggaaaa

SEQ ID NO: 4400472 - DNA, 17 bp, Homo sapiens
tcagatggtgtcattta

SEQ ID NO: 4400473 - DNA, 19 bp, Homo sapiens
tcagatggtgtcatttagt

SEQ ID NO: 4400474 - DNA, 22 bp, Homo sapiens
tcagatggtgtcatttagtaag

SEQ ID NO: 4400475 - DNA, 13 bp, Homo sapiens
tcagatgtaatgt

SEQ ID NO: 4400476 - DNA, 15 bp, Homo sapiens
tcagatgtaatgttt

SEQ ID NO: 4400477 - DNA, 16 bp, Homo sapiens
tcagatgtaatgtttt

SEQ ID NO: 4400478 - DNA, 17 bp, Homo sapiens
tcagatgtaatgttttc

SEQ ID NO: 4400479 - DNA, 13 bp, Homo sapiens
tcagatgtcttct

SEQ ID NO: 4400480 - DNA, 14 bp, Homo sapiens
tcagatgtcttctg

SEQ ID NO: 4400481 - DNA, 15 bp, Homo sapiens
tcagatgtcttctgc

SEQ ID NO: 4400482 - DNA, 16 bp, Homo sapiens
tcagatgtcttctgcc

SEQ ID NO: 4400483 - DNA, 17 bp, Homo sapiens
tcagatgtcttctgcct

SEQ ID NO: 4400484 - DNA, 21 bp, Homo sapiens
tcagatgtcttctgcctgtta

SEQ ID NO: 4400485 - DNA, 22 bp, Homo sapiens
tcagatgtcttctgcctgttat

SEQ ID NO: 4400486 - DNA, 15 bp, Homo sapiens
tcagatgtttcatca

SEQ ID NO: 4400487 - DNA, 17 bp, Homo sapiens
tcagatgtttcatcaat

SEQ ID NO: 4400488 - DNA, 18 bp, Homo sapiens
tcagatgtttcatcaatg

SEQ ID NO: 4400489 - DNA, 19 bp, Homo sapiens
tcagattgcttaaaagcat

SEQ ID NO: 4400490 - DNA, 21 bp, Homo sapiens
tcagattgcttaaaagcattt

SEQ ID NO: 4400491 - DNA, 22 bp, Homo sapiens
tcagattgcttaaaagcatttt

SEQ ID NO: 4400492 - DNA, 15 bp, Homo sapiens
tcagatttctgagga

SEQ ID NO: 4400493 - DNA, 17 bp, Homo sapiens
tcagatttgccttattg

SEQ ID NO: 4400494 - DNA, 22 bp, Homo sapiens
tcagatttgccttattggcagc

SEQ ID NO: 4400495 - DNA, 18 bp, Homo sapiens
tcagatttttatttatga

SEQ ID NO: 4400496 - DNA, 14 bp, Homo sapiens
tcagattttttaaa

SEQ ID NO: 4400497 - DNA, 20 bp, Homo sapiens
tcagcaaccctacagtatat

SEQ ID NO: 4400498 - DNA, 20 bp, Homo sapiens
tcagcaagctgcccagccct

SEQ ID NO: 4400499 - DNA, 23 bp, Homo sapiens
tcagcaagctgcccagccctggc

SEQ ID NO: 4400500 - DNA, 21 bp, Homo sapiens
tcagcacattcgggaccaata

SEQ ID NO: 4400501 - DNA, 13 bp, Homo sapiens
tcagcaccaccct

SEQ ID NO: 4400502 - DNA, 20 bp, Homo sapiens
tcagcacctacagtgtacag

SEQ ID NO: 4400503 - DNA, 18 bp, Homo sapiens
tcagcactctgtaaaacg

SEQ ID NO: 4400504 - DNA, 15 bp, Homo sapiens
tcagcagacactcca

SEQ ID NO: 4400505 - DNA, 20 bp, Homo sapiens
tcagcagacatttatctttg

SEQ ID NO: 4400506 - DNA, 22 bp, Homo sapiens
tcagcagcaaaaccaaactggg

SEQ ID NO: 4400507 - DNA, 15 bp, Homo sapiens
tcagcagcagctctg

SEQ ID NO: 4400508 - DNA, 12 bp, Homo sapiens
tcagcagccctc

SEQ ID NO: 4400509 - DNA, 17 bp, Homo sapiens
tcagcagccctcctcac

SEQ ID NO: 4400510 - DNA, 17 bp, Homo sapiens
tcagcagctctggctct

SEQ ID NO: 4400511 - DNA, 15 bp, Homo sapiens
tcagcagtattctat

SEQ ID NO: 4400512 - DNA, 13 bp, Homo sapiens
tcagcagtcatgc

SEQ ID NO: 4400513 - DNA, 11 bp, Homo sapiens
tcagcatatga

SEQ ID NO: 4400514 - DNA, 19 bp, Homo sapiens
tcagcatatgtgtaaagat

SEQ ID NO: 4400515 - DNA, 15 bp, Homo sapiens
tcagcatcactgatg

SEQ ID NO: 4400516 - DNA, 17 bp, Homo sapiens
tcagcatcactgatggg

SEQ ID NO: 4400517 - DNA, 18 bp, Homo sapiens
tcagcatcactgatggga

SEQ ID NO: 4400518 - DNA, 20 bp, Homo sapiens
tcagcatcactgatgggaat

SEQ ID NO: 4400519 - DNA, 15 bp, Homo sapiens
tcagcatgcaataca

SEQ ID NO: 4400520 - DNA, 16 bp, Homo sapiens
tcagcatgtctattca

SEQ ID NO: 4400521 - DNA, 19 bp, Homo sapiens
tcagcatgtctattcagct

SEQ ID NO: 4400522 - DNA, 11 bp, Homo sapiens
tcagcatttga

SEQ ID NO: 4400523 - DNA, 12 bp, Homo sapiens
tcagcatttgac

SEQ ID NO: 4400524 - DNA, 15 bp, Homo sapiens
tcagccaagtgcaga

SEQ ID NO: 4400525 - DNA, 19 bp, Homo sapiens
tcagccacaaagcccccca

SEQ ID NO: 4400526 - DNA, 22 bp, Homo sapiens
tcagccacatgccccaggctct

SEQ ID NO: 4400527 - DNA, 15 bp, Homo sapiens
tcagccagccgccct

SEQ ID NO: 4400528 - DNA, 18 bp, Homo sapiens
tcagccagccgccctggg

SEQ ID NO: 4400529 - DNA, 13 bp, Homo sapiens
tcagccagcctcc

SEQ ID NO: 4400530 - DNA, 16 bp, Homo sapiens
tcagccagcctccttg

SEQ ID NO: 4400531 - DNA, 12 bp, Homo sapiens
tcagccagctta

SEQ ID NO: 4400532 - DNA, 16 bp, Homo sapiens
tcagccagcttaaacc

SEQ ID NO: 4400533 - DNA, 18 bp, Homo sapiens
tcagccaggcgtggttac

SEQ ID NO: 4400534 - DNA, 16 bp, Homo sapiens
tcagccccagcccaga

SEQ ID NO: 4400535 - DNA, 14 bp, Homo sapiens
tcagccccaggcca

SEQ ID NO: 4400536 - DNA, 15 bp, Homo sapiens
tcagccccaggccag

SEQ ID NO: 4400537 - DNA, 16 bp, Homo sapiens
tcagccccaggccagc

SEQ ID NO: 4400538 - DNA, 19 bp, Homo sapiens
tcagccccaggccagctgc

SEQ ID NO: 4400539 - DNA, 18 bp, Homo sapiens
tcagcccccatcacccaa

SEQ ID NO: 4400540 - DNA, 17 bp, Homo sapiens
tcagccccgcctgtcac

SEQ ID NO: 4400541 - DNA, 22 bp, Homo sapiens
tcagcccctcctctgccacctc

SEQ ID NO: 4400542 - DNA, 23 bp, Homo sapiens
tcagcccctcctctgccacctcc

SEQ ID NO: 4400543 - DNA, 19 bp, Homo sapiens
tcagccctagggtggagag

SEQ ID NO: 4400544 - DNA, 19 bp, Homo sapiens
tcagccctcagttccttca

SEQ ID NO: 4400545 - DNA, 20 bp, Homo sapiens
ttattgccttctcaccagct

SEQ ID NO: 4400546 - DNA, 17 bp, Homo sapiens
ttattgcttagtaaaat

SEQ ID NO: 4400547 - DNA, 21 bp, Homo sapiens
ttattggatctattgatttga

SEQ ID NO: 4400548 - DNA, 22 bp, Homo sapiens
ttattggattagaccaattact

SEQ ID NO: 4400549 - DNA, 22 bp, Homo sapiens
ttattggctgagatatgaacat

SEQ ID NO: 4400550 - DNA, 19 bp, Homo sapiens
ttattggcttgataaacat

SEQ ID NO: 4400551 - DNA, 12 bp, Homo sapiens
ttattgtacttg

SEQ ID NO: 4400552 - DNA, 13 bp, Homo sapiens
ttattgtagtttg

SEQ ID NO: 4400553 - DNA, 21 bp, Homo sapiens
ttattgtctgtctacatttct

SEQ ID NO: 4400554 - DNA, 14 bp, Homo sapiens
ttattgttctttca

SEQ ID NO: 4400555 - DNA, 16 bp, Homo sapiens
ttattgtttgatgttt

SEQ ID NO: 4400556 - DNA, 15 bp, Homo sapiens
ttatttaaaactctg

SEQ ID NO: 4400557 - DNA, 16 bp, Homo sapiens
ttatttaaaactctgg

SEQ ID NO: 4400558 - DNA, 15 bp, Homo sapiens
ttatttaaaatagca

SEQ ID NO: 4400559 - DNA, 12 bp, Homo sapiens
ttatttaaatta

SEQ ID NO: 4400560 - DNA, 20 bp, Homo sapiens
ttatttaacaaaaaatgtaa

SEQ ID NO: 4400561 - DNA, 13 bp, Homo sapiens
ttatttaagcaat

SEQ ID NO: 4400562 - DNA, 12 bp, Homo sapiens
ttatttacaaaa

SEQ ID NO: 4400563 - DNA, 17 bp, Homo sapiens
ttatttacaagaagaac

SEQ ID NO: 4400564 - DNA, 17 bp, Homo sapiens
ttatttacccctcccct

SEQ ID NO: 4400565 - DNA, 14 bp, Homo sapiens
ttatttagacaaga

SEQ ID NO: 4400566 - DNA, 19 bp, Homo sapiens
ttatttatgacctgaaata

SEQ ID NO: 4400567 - DNA, 17 bp, Homo sapiens
ttatttattaaacttca

SEQ ID NO: 4400568 - DNA, 18 bp, Homo sapiens
ttatttcaatgtaattaa

SEQ ID NO: 4400569 - DNA, 24 bp, Homo sapiens
ttatttcaatgtaattaaactgtt

SEQ ID NO: 4400570 - DNA, 18 bp, Homo sapiens
ttatttcagattttgata

SEQ ID NO: 4400571 - DNA, 19 bp, Homo sapiens
ttatttcatgattagaaat

SEQ ID NO: 4400572 - DNA, 24 bp, Homo sapiens
ttatttcatgtggtgaatatgcaa

SEQ ID NO: 4400573 - DNA, 15 bp, Homo sapiens
ttatttccactaaaa

SEQ ID NO: 4400574 - DNA, 18 bp, Homo sapiens
ttatttccactaaaaata

SEQ ID NO: 4400575 - DNA, 19 bp, Homo sapiens
ttatttccactaaaaatat

SEQ ID NO: 4400576 - DNA, 13 bp, Homo sapiens
ttatttccccagc

SEQ ID NO: 4400577 - DNA, 17 bp, Homo sapiens
ttatttccccagccaca

SEQ ID NO: 4400578 - DNA, 18 bp, Homo sapiens
ttatttccccagccacag

SEQ ID NO: 4400579 - DNA, 19 bp, Homo sapiens
ttatttctagttctttcct

SEQ ID NO: 4400580 - DNA, 19 bp, Homo sapiens
ttatttctccatcccctcc

SEQ ID NO: 4400581 - DNA, 22 bp, Homo sapiens
ttatttctgatttcataattca

SEQ ID NO: 4400582 - DNA, 17 bp, Homo sapiens
ttatttctgctctggaa

SEQ ID NO: 4400583 - DNA, 19 bp, Homo sapiens
ttatttctgctctggaata

SEQ ID NO: 4400584 - DNA, 14 bp, Homo sapiens
ttatttctgtgaaa

SEQ ID NO: 4400585 - DNA, 20 bp, Homo sapiens
ttatttctgtgaaagaagta

SEQ ID NO: 4400586 - DNA, 11 bp, Homo sapiens
ttatttgcata

SEQ ID NO: 4400587 - DNA, 17 bp, Homo sapiens
ttatttgtaatagatgt

SEQ ID NO: 4400588 - DNA, 22 bp, Homo sapiens
ttatttgtcttaaaaaatgtga

SEQ ID NO: 4400589 - DNA, 16 bp, Homo sapiens
ttattttaaaatttca

SEQ ID NO: 4400590 - DNA, 12 bp, Homo sapiens
ttattttaaatt

SEQ ID NO: 4400591 - DNA, 15 bp, Homo sapiens
ttattttaaatttct

SEQ ID NO: 4400592 - DNA, 16 bp, Homo sapiens
ttattttaaatttctt

SEQ ID NO: 4400593 - DNA, 19 bp, Homo sapiens
ttattttagcaaatcagta

SEQ ID NO: 4400594 - DNA, 16 bp, Homo sapiens
ttattttagcagttct

SEQ ID NO: 4400595 - DNA, 20 bp, Homo sapiens
ttattttagcagttctgcaa

SEQ ID NO: 4400596 - DNA, 13 bp, Homo sapiens
ttattttagtata

SEQ ID NO: 4400597 - DNA, 17 bp, Homo sapiens
ttattttagtgtgtaaa

SEQ ID NO: 4400598 - DNA, 23 bp, Homo sapiens
ttattttagtgtgtaaaattaat

SEQ ID NO: 4400599 - DNA, 14 bp, Homo sapiens
ttattttatgttta

SEQ ID NO: 4400600 - DNA, 18 bp, Homo sapiens
ttattttattttagcagt

SEQ ID NO: 4400601 - DNA, 19 bp, Homo sapiens
ttattttcattctgccaaa

SEQ ID NO: 4400602 - DNA, 16 bp, Homo sapiens
ttattttcttccccaa

SEQ ID NO: 4400603 - DNA, 17 bp, Homo sapiens
ttattttgacataaagt

SEQ ID NO: 4400604 - DNA, 17 bp, Homo sapiens
ttatttttcctgtcctg

SEQ ID NO: 4400605 - DNA, 12 bp, Homo sapiens
ttatttttctga

SEQ ID NO: 4400606 - DNA, 16 bp, Homo sapiens
ttatttttgacagact

SEQ ID NO: 4400607 - DNA, 19 bp, Homo sapiens
ttattttttagtgatgaga

SEQ ID NO: 4400608 - DNA, 15 bp, Homo sapiens
ttcaaaaaaatctat

SEQ ID NO: 4400609 - DNA, 23 bp, Homo sapiens
ttcaaaaataaaaaatctgaaga

SEQ ID NO: 4400610 - DNA, 15 bp, Homo sapiens
ttcaaaagataatat

SEQ ID NO: 4400611 - DNA, 15 bp, Homo sapiens
ttcaaaatacttctt

SEQ ID NO: 4400612 - DNA, 19 bp, Homo sapiens
ttcaaaatagacaagtttt

SEQ ID NO: 4400613 - DNA, 13 bp, Homo sapiens
ttcaaaatattta

SEQ ID NO: 4400614 - DNA, 20 bp, Homo sapiens
ttcaaaatatttaaaaatgt

SEQ ID NO: 4400615 - DNA, 17 bp, Homo sapiens
ttcaaaatgctttttat

SEQ ID NO: 4400616 - DNA, 20 bp, Homo sapiens
ttcaaaatgctttttattat

SEQ ID NO: 4400617 - DNA, 18 bp, Homo sapiens
ttcaaacagtctcaggaa

SEQ ID NO: 4400618 - DNA, 17 bp, Homo sapiens
ttcaaacctaaaaatca

SEQ ID NO: 4400619 - DNA, 18 bp, Homo sapiens
ttcaaacttttgaaagat

SEQ ID NO: 4400620 - DNA, 17 bp, Homo sapiens
ttcaaagactcaaattt

SEQ ID NO: 4400621 - DNA, 18 bp, Homo sapiens
ttcaaagactcaaatttt

SEQ ID NO: 4400622 - DNA, 22 bp, Homo sapiens
ttcaaagaggtgaacattaaaa

SEQ ID NO: 4400623 - DNA, 16 bp, Homo sapiens
ttcaaagatgataatt

SEQ ID NO: 4400624 - DNA, 19 bp, Homo sapiens
ttcaaagcaattgaaatgc

SEQ ID NO: 4400625 - DNA, 22 bp, Homo sapiens
ttcaaagcaattgaaatgcatt

SEQ ID NO: 4400626 - DNA, 11 bp, Homo sapiens
ttcaaagtctc

SEQ ID NO: 4400627 - DNA, 19 bp, Homo sapiens
ttcaaagtctcaatgaaat

SEQ ID NO: 4400628 - DNA, 14 bp, Homo sapiens
ttcaaagtttaata

SEQ ID NO: 4400629 - DNA, 18 bp, Homo sapiens
ttcaaatagggtctaact

SEQ ID NO: 4400630 - DNA, 19 bp, Homo sapiens
ttcaaatagggtctaactc

SEQ ID NO: 4400631 - DNA, 16 bp, Homo sapiens
ttcaaatcctcttttg

SEQ ID NO: 4400632 - DNA, 13 bp, Homo sapiens
ttcaaatgcattt

SEQ ID NO: 4400633 - DNA, 11 bp, Homo sapiens
ttcaaatgtgc

SEQ ID NO: 4400634 - DNA, 16 bp, Homo sapiens
ttcaaatgttagatat

SEQ ID NO: 4400635 - DNA, 11 bp, Homo sapiens
ttcaaatttag

SEQ ID NO: 4400636 - DNA, 14 bp, Homo sapiens
ttcaaatttgtaat

SEQ ID NO: 4400637 - DNA, 21 bp, Homo sapiens
ttcaaatttgtaataaaacta

SEQ ID NO: 4400638 - DNA, 21 bp, Homo sapiens
ttcaacaaagaaacaaagatg

SEQ ID NO: 4400639 - DNA, 13 bp, Homo sapiens
ttcaacaattggt

SEQ ID NO: 4400640 - DNA, 21 bp, Homo sapiens
ttcaacaattggtgtcatttt

SEQ ID NO: 4400641 - DNA, 20 bp, Homo sapiens
ttcaacctcagccctgaaaa

SEQ ID NO: 4400642 - DNA, 19 bp, Homo sapiens
ttcaacctggtggcaccag

SEQ ID NO: 4400643 - DNA, 16 bp, Homo sapiens
ttcaacggaaagtgct

SEQ ID NO: 4400644 - DNA, 15 bp, Homo sapiens
ttcaactgtcttcct

SEQ ID NO: 4400645 - DNA, 15 bp, Homo sapiens
ttcaactttgaataa

SEQ ID NO: 4400646 - DNA, 12 bp, Homo sapiens
ttcaacttttct

SEQ ID NO: 4400647 - DNA, 13 bp, Homo sapiens
ttcaagaaaggaa

SEQ ID NO: 4400648 - DNA, 15 bp, Homo sapiens
ttcaagaagtaatca

SEQ ID NO: 4400649 - DNA, 18 bp, Homo sapiens
ttcaagaagtaatcagta

SEQ ID NO: 4400650 - DNA, 14 bp, Homo sapiens
ttcaagaccagcct

SEQ ID NO: 4400651 - DNA, 23 bp, Homo sapiens
ttcaagataaggagaaagaaagt

SEQ ID NO: 4400652 - DNA, 16 bp, Homo sapiens
ttcaagcagcatcttc

SEQ ID NO: 4400653 - DNA, 14 bp, Homo sapiens
ttcaagccattcca

SEQ ID NO: 4400654 - DNA, 20 bp, Homo sapiens
ttcaagcctgtgggagtaga

SEQ ID NO: 4400655 - DNA, 17 bp, Homo sapiens
ttcaaggactgtttcag

SEQ ID NO: 4400656 - DNA, 17 bp, Homo sapiens
ttcaaggaggcccactg

SEQ ID NO: 4400657 - DNA, 16 bp, Homo sapiens
ttcaaggcatttgtct

SEQ ID NO: 4400658 - DNA, 13 bp, Homo sapiens
ttcaaggctcaga

SEQ ID NO: 4400659 - DNA, 13 bp, Homo sapiens
ttcaaggctttaa

SEQ ID NO: 4400660 - DNA, 19 bp, Homo sapiens
ttcaaggctttaaaagtca

SEQ ID NO: 4400661 - DNA, 20 bp, Homo sapiens
ttcaagtgcttaaaaatact

SEQ ID NO: 4400662 - DNA, 19 bp, Homo sapiens
ttcaagtgtaaaatatttt

SEQ ID NO: 4400663 - DNA, 16 bp, Homo sapiens
ttcaagttttaaagtt

SEQ ID NO: 4400664 - DNA, 14 bp, Homo sapiens
ttcaagtttttcat

SEQ ID NO: 4400665 - DNA, 19 bp, Homo sapiens
ttcaagtttttcatactgt

SEQ ID NO: 4400666 - DNA, 15 bp, Homo sapiens
tgtgaggccagggca

SEQ ID NO: 4400667 - DNA, 17 bp, Homo sapiens
tgtgaggccagggcaga

SEQ ID NO: 4400668 - DNA, 15 bp, Homo sapiens
tgtgagggtgctgac

SEQ ID NO: 4400669 - DNA, 16 bp, Homo sapiens
tgtgagtcaatacata

SEQ ID NO: 4400670 - DNA, 21 bp, Homo sapiens
tgtgagtcaatacatagtgct

SEQ ID NO: 4400671 - DNA, 21 bp, Homo sapiens
tgtgagtggttctgagcaaat

SEQ ID NO: 4400672 - DNA, 17 bp, Homo sapiens
tgtgatatgtctgctga

SEQ ID NO: 4400673 - DNA, 16 bp, Homo sapiens
tgtgatattctgttgc

SEQ ID NO: 4400674 - DNA, 17 bp, Homo sapiens
tgtgatattctgttgct

SEQ ID NO: 4400675 - DNA, 22 bp, Homo sapiens
tgtgatcttaaaataattcata

SEQ ID NO: 4400676 - DNA, 11 bp, Homo sapiens
tgtgatgtgtc

SEQ ID NO: 4400677 - DNA, 22 bp, Homo sapiens
tgtgattactctttgctttgta

SEQ ID NO: 4400678 - DNA, 13 bp, Homo sapiens
tgtgattagatca

SEQ ID NO: 4400679 - DNA, 15 bp, Homo sapiens
tgtgattatttttct

SEQ ID NO: 4400680 - DNA, 15 bp, Homo sapiens
tgtgattcaatctgt

SEQ ID NO: 4400681 - DNA, 22 bp, Homo sapiens
tgtgattccactacacctggct

SEQ ID NO: 4400682 - DNA, 14 bp, Homo sapiens
tgtgattgtggaat

SEQ ID NO: 4400683 - DNA, 14 bp, Homo sapiens
tgtgatttatcttt

SEQ ID NO: 4400684 - DNA, 21 bp, Homo sapiens
tgtgatttctttaaaagaatg

SEQ ID NO: 4400685 - DNA, 22 bp, Homo sapiens
tgtgattttaagacaagctgta

SEQ ID NO: 4400686 - DNA, 16 bp, Homo sapiens
tgtgcaaacagtaacg

SEQ ID NO: 4400687 - DNA, 14 bp, Homo sapiens
tgtgcaacttttta

SEQ ID NO: 4400688 - DNA, 13 bp, Homo sapiens
tgtgcaatagaag

SEQ ID NO: 4400689 - DNA, 16 bp, Homo sapiens
tgtgcaatagaaggtg

SEQ ID NO: 4400690 - DNA, 17 bp, Homo sapiens
tgtgcaatgtaaatatt

SEQ ID NO: 4400691 - DNA, 18 bp, Homo sapiens
tgtgcaatgtaaatattt

SEQ ID NO: 4400692 - DNA, 18 bp, Homo sapiens
tgtgcaatttctgtacat

SEQ ID NO: 4400693 - DNA, 20 bp, Homo sapiens
tgtgcacatctgtgtcttgt

SEQ ID NO: 4400694 - DNA, 21 bp, Homo sapiens
tgtgcacatctgtgtcttgtt

SEQ ID NO: 4400695 - DNA, 18 bp, Homo sapiens
tgtgcacatgcctctgta

SEQ ID NO: 4400696 - DNA, 18 bp, Homo sapiens
tgtgcagaaaatatttaa

SEQ ID NO: 4400697 - DNA, 13 bp, Homo sapiens
tgtgcagatgaag

SEQ ID NO: 4400698 - DNA, 19 bp, Homo sapiens
tgtgcagccgctgagcgag

SEQ ID NO: 4400699 - DNA, 21 bp, Homo sapiens
tgtgcaggcctgtccctggga

SEQ ID NO: 4400700 - DNA, 21 bp, Homo sapiens
tgtgcaggctgcagtggctcc

SEQ ID NO: 4400701 - DNA, 19 bp, Homo sapiens
tgtgcagggatattgcctt

SEQ ID NO: 4400702 - DNA, 19 bp, Homo sapiens
tgtgcaggtgctattgtta

SEQ ID NO: 4400703 - DNA, 21 bp, Homo sapiens
tgtgcaggtgctattgttact

SEQ ID NO: 4400704 - DNA, 16 bp, Homo sapiens
tgtgcaggtggggaga

SEQ ID NO: 4400705 - DNA, 16 bp, Homo sapiens
tgtgcagtgtttttcc

SEQ ID NO: 4400706 - DNA, 16 bp, Homo sapiens
tgtgcagttgctgttt

SEQ ID NO: 4400707 - DNA, 13 bp, Homo sapiens
tgtgcataatgct

SEQ ID NO: 4400708 - DNA, 18 bp, Homo sapiens
tgtgcatatttgttactt

SEQ ID NO: 4400709 - DNA, 22 bp, Homo sapiens
tgtgcatgcataccacaagaca

SEQ ID NO: 4400710 - DNA, 13 bp, Homo sapiens
tgtgcatggaagt

SEQ ID NO: 4400711 - DNA, 19 bp, Homo sapiens
tgtgcattttgtggaattt

SEQ ID NO: 4400712 - DNA, 22 bp, Homo sapiens
tgtgccaactgccaggctgcct

SEQ ID NO: 4400713 - DNA, 23 bp, Homo sapiens
tgtgccaatcaatagcaccccta

SEQ ID NO: 4400714 - DNA, 20 bp, Homo sapiens
tgtgccacagaggccccacc

SEQ ID NO: 4400715 - DNA, 21 bp, Homo sapiens
tgtgccacagaggccccacct

SEQ ID NO: 4400716 - DNA, 14 bp, Homo sapiens
tgtgccacattttc

SEQ ID NO: 4400717 - DNA, 17 bp, Homo sapiens
tgtgccaccatgcctca

SEQ ID NO: 4400718 - DNA, 19 bp, Homo sapiens
tgtgccactgttcagcgga

SEQ ID NO: 4400719 - DNA, 21 bp, Homo sapiens
tgtgccactgttcagcggagc

SEQ ID NO: 4400720 - DNA, 21 bp, Homo sapiens
tgtgccagggcaatgatgaat

SEQ ID NO: 4400721 - DNA, 15 bp, Homo sapiens
tgtgccctccaaaga

SEQ ID NO: 4400722 - DNA, 16 bp, Homo sapiens
tgtgccctccaaagag

SEQ ID NO: 4400723 - DNA, 18 bp, Homo sapiens
tgtgccgctgccacccgc

SEQ ID NO: 4400724 - DNA, 16 bp, Homo sapiens
tgtgccgggaggcagc

SEQ ID NO: 4400725 - DNA, 16 bp, Homo sapiens
tgtgcctggccccagc

SEQ ID NO: 4400726 - DNA, 15 bp, Homo sapiens
tgtgcctggtagaaa

SEQ ID NO: 4400727 - DNA, 20 bp, Homo sapiens
tgtgcctggttaatattaat

SEQ ID NO: 4400728 - DNA, 19 bp, Homo sapiens
tgtgccttgtcacgccaga

SEQ ID NO: 4400729 - DNA, 20 bp, Homo sapiens
tgtgccttgtcacgccagac

SEQ ID NO: 4400730 - DNA, 10 bp, Homo sapiens
tgtgcctttc

SEQ ID NO: 4400731 - DNA, 17 bp, Homo sapiens
tgtgcctttcctatcac

SEQ ID NO: 4400732 - DNA, 16 bp, Homo sapiens
tgtgcctttctttgcc

SEQ ID NO: 4400733 - DNA, 20 bp, Homo sapiens
tgtgcctttctttgcctctg

SEQ ID NO: 4400734 - DNA, 21 bp, Homo sapiens
tgtgcctttctttgcctctgc

SEQ ID NO: 4400735 - DNA, 10 bp, Homo sapiens
tgtgcctttg

SEQ ID NO: 4400736 - DNA, 16 bp, Homo sapiens
tgtgcctttggcctgg

SEQ ID NO: 4400737 - DNA, 22 bp, Homo sapiens
tgtgctacaattcattgtgtta

SEQ ID NO: 4400738 - DNA, 20 bp, Homo sapiens
tgtgctatactgcatacttt

SEQ ID NO: 4400739 - DNA, 18 bp, Homo sapiens
tgtgctatagtatttgat

SEQ ID NO: 4400740 - DNA, 16 bp, Homo sapiens
tgtgctattaatattt

SEQ ID NO: 4400741 - DNA, 18 bp, Homo sapiens
tgtgctattaatatttgt

SEQ ID NO: 4400742 - DNA, 13 bp, Homo sapiens
tgtgctcagccaa

SEQ ID NO: 4400743 - DNA, 15 bp, Homo sapiens
tgtgctctattacca

SEQ ID NO: 4400744 - DNA, 13 bp, Homo sapiens
tgtgctctggagg

SEQ ID NO: 4400745 - DNA, 23 bp, Homo sapiens
tgtgctgaagcaaagtgcccatg

SEQ ID NO: 4400746 - DNA, 23 bp, Homo sapiens
tgtgttactaaaaaaaagatgaa

SEQ ID NO: 4400747 - DNA, 13 bp, Homo sapiens
tgtgttcaatatc

SEQ ID NO: 4400748 - DNA, 15 bp, Homo sapiens
tgtgttcatttcatt

SEQ ID NO: 4400749 - DNA, 18 bp, Homo sapiens
tgtgttccctttgtcttt

SEQ ID NO: 4400750 - DNA, 13 bp, Homo sapiens
tgtgttctatcca

SEQ ID NO: 4400751 - DNA, 22 bp, Homo sapiens
tgtgttctgggctggggccacc

SEQ ID NO: 4400752 - DNA, 23 bp, Homo sapiens
tgtgttctgggctggggccacct

SEQ ID NO: 4400753 - DNA, 17 bp, Homo sapiens
tgtgttctttaaataaa

SEQ ID NO: 4400754 - DNA, 14 bp, Homo sapiens
tgtgttcttttctc

SEQ ID NO: 4400755 - DNA, 15 bp, Homo sapiens
tgtgttgaaggaact

SEQ ID NO: 4400756 - DNA, 23 bp, Homo sapiens
tgtgttgatgactcactcataaa

SEQ ID NO: 4400757 - DNA, 17 bp, Homo sapiens
tgtgttgcactgaacag

SEQ ID NO: 4400758 - DNA, 22 bp, Homo sapiens
tgtgttgccacagtagaactgt

SEQ ID NO: 4400759 - DNA, 15 bp, Homo sapiens
tgtgtttatatggaa

SEQ ID NO: 4400760 - DNA, 19 bp, Homo sapiens
tgtgtttcattacttgaat

SEQ ID NO: 4400761 - DNA, 23 bp, Homo sapiens
tgtgtttgtttttcaagaaatga

SEQ ID NO: 4400762 - DNA, 16 bp, Homo sapiens
tgtgttttcagactgc

SEQ ID NO: 4400763 - DNA, 14 bp, Homo sapiens
tgtgttttcatcat

SEQ ID NO: 4400764 - DNA, 17 bp, Homo sapiens
tgtgttttcatcatttc

SEQ ID NO: 4400765 - DNA, 13 bp, Homo sapiens
tgtgttttctgta

SEQ ID NO: 4400766 - DNA, 15 bp, Homo sapiens
tgtgttttgtctttt

SEQ ID NO: 4400767 - DNA, 16 bp, Homo sapiens
tgtgtttttaaatttt

SEQ ID NO: 4400768 - DNA, 15 bp, Homo sapiens
tgtgtttttaacatg

SEQ ID NO: 4400769 - DNA, 18 bp, Homo sapiens
tgtgtttttctttttcca

SEQ ID NO: 4400770 - DNA, 15 bp, Homo sapiens
tgtgttttttaagat

SEQ ID NO: 4400771 - DNA, 16 bp, Homo sapiens
tgtgttttttaagata

SEQ ID NO: 4400772 - DNA, 17 bp, Homo sapiens
tgtgttttttaagatag

SEQ ID NO: 4400773 - DNA, 14 bp, Homo sapiens
tgttaaaaatgtca

SEQ ID NO: 4400774 - DNA, 21 bp, Homo sapiens
tgttaaaagatgaaaatattt

SEQ ID NO: 4400775 - DNA, 16 bp, Homo sapiens
tgttaaaattaatata

SEQ ID NO: 4400776 - DNA, 12 bp, Homo sapiens
tgttaaacacta

SEQ ID NO: 4400777 - DNA, 17 bp, Homo sapiens
tgttaacctttctaacc

SEQ ID NO: 4400778 - DNA, 19 bp, Homo sapiens
tgttaactgttcttggaaa

SEQ ID NO: 4400779 - DNA, 14 bp, Homo sapiens
tgttaacttattca

SEQ ID NO: 4400780 - DNA, 15 bp, Homo sapiens
tgttaacttattcaa

SEQ ID NO: 4400781 - DNA, 13 bp, Homo sapiens
tgttaataaaagt

SEQ ID NO: 4400782 - DNA, 18 bp, Homo sapiens
tgttaatacatcacatct

SEQ ID NO: 4400783 - DNA, 15 bp, Homo sapiens
tgttaatactgtatt

SEQ ID NO: 4400784 - DNA, 21 bp, Homo sapiens
tgttaatatcactcattaatt

SEQ ID NO: 4400785 - DNA, 13 bp, Homo sapiens
tgttaatatttta

SEQ ID NO: 4400786 - DNA, 17 bp, Homo sapiens
tgttaatcttaatgtat

SEQ ID NO: 4400787 - DNA, 18 bp, Homo sapiens
tgttaatgactctttctg

SEQ ID NO: 4400788 - DNA, 22 bp, Homo sapiens
tgttaatgcattgttgtaaagt

SEQ ID NO: 4400789 - DNA, 18 bp, Homo sapiens
tgttaatttataatgtat

SEQ ID NO: 4400790 - DNA, 23 bp, Homo sapiens
tgttaatttataggcgttttttg

SEQ ID NO: 4400791 - DNA, 13 bp, Homo sapiens
tgttaatttttga

SEQ ID NO: 4400792 - DNA, 16 bp, Homo sapiens
tgttaatttttgatac

SEQ ID NO: 4400793 - DNA, 19 bp, Homo sapiens
tgttaattttttggtacaa

SEQ ID NO: 4400794 - DNA, 20 bp, Homo sapiens
tgttacaaattttttaattt

SEQ ID NO: 4400795 - DNA, 22 bp, Homo sapiens
tgttacacaatggtttttaaat

SEQ ID NO: 4400796 - DNA, 19 bp, Homo sapiens
tgttaccaaaaataaatat

SEQ ID NO: 4400797 - DNA, 23 bp, Homo sapiens
tgttaccaaaaataaatatatct

SEQ ID NO: 4400798 - DNA, 14 bp, Homo sapiens
tgttacctgtagat

SEQ ID NO: 4400799 - DNA, 19 bp, Homo sapiens
tgttacgtttgaagtctga

SEQ ID NO: 4400800 - DNA, 18 bp, Homo sapiens
tgttactgacttggatcc

SEQ ID NO: 4400801 - DNA, 12 bp, Homo sapiens
tgttactgcctt

SEQ ID NO: 4400802 - DNA, 22 bp, Homo sapiens
tgttactgctgattcttgtaaa

SEQ ID NO: 4400803 - DNA, 12 bp, Homo sapiens
tgttactgcttc

SEQ ID NO: 4400804 - DNA, 21 bp, Homo sapiens
tgttactgcttctctttgtgc

SEQ ID NO: 4400805 - DNA, 14 bp, Homo sapiens
tgttacttccttat

SEQ ID NO: 4400806 - DNA, 22 bp, Homo sapiens
tgttagaaaatgacttatttct

SEQ ID NO: 4400807 - DNA, 23 bp, Homo sapiens
tgttagacttgctccctctccaa

SEQ ID NO: 4400808 - DNA, 13 bp, Homo sapiens
tgttagacttgtg

SEQ ID NO: 4400809 - DNA, 17 bp, Homo sapiens
tgttagacttgtgtgca

SEQ ID NO: 4400810 - DNA, 17 bp, Homo sapiens
tgttagagagaaagaga

SEQ ID NO: 4400811 - DNA, 13 bp, Homo sapiens
tgttagatattgc

SEQ ID NO: 4400812 - DNA, 14 bp, Homo sapiens
tgttagatattgct

SEQ ID NO: 4400813 - DNA, 17 bp, Homo sapiens
tgttagatgtttgttga

SEQ ID NO: 4400814 - DNA, 12 bp, Homo sapiens
tgttagcaaaga

SEQ ID NO: 4400815 - DNA, 23 bp, Homo sapiens
tgttagcaaatgacagatttctg

SEQ ID NO: 4400816 - DNA, 19 bp, Homo sapiens
tgttaggagatgtcatcaa

SEQ ID NO: 4400817 - DNA, 21 bp, Homo sapiens
tgttagggtataagttgctgt

SEQ ID NO: 4400818 - DNA, 23 bp, Homo sapiens
tgttagggtataagttgctgtaa

SEQ ID NO: 4400819 - DNA, 14 bp, Homo sapiens
tgttgcgttccttt

SEQ ID NO: 4400820 - DNA, 18 bp, Homo sapiens
tgttgctgctactgtctt

SEQ ID NO: 4400821 - DNA, 14 bp, Homo sapiens
tgttgcttcaaatt

SEQ ID NO: 4400822 - DNA, 19 bp, Homo sapiens
tgttgctttaatatgagct

SEQ ID NO: 4400823 - DNA, 16 bp, Homo sapiens
tgttgctttacagtta

SEQ ID NO: 4400824 - DNA, 14 bp, Homo sapiens
tgttggaaaaaatt

SEQ ID NO: 4400825 - DNA, 21 bp, Homo sapiens
tgttggataaggaattataga

SEQ ID NO: 4400826 - DNA, 17 bp, Homo sapiens
tgttggattccatgcta

SEQ ID NO: 4400827 - DNA, 20 bp, Homo sapiens
tgttggatttttgtcttgtg

SEQ ID NO: 4400828 - DNA, 13 bp, Homo sapiens
tgttggcaggccc

SEQ ID NO: 4400829 - DNA, 15 bp, Homo sapiens
tgttggcaggcccac

SEQ ID NO: 4400830 - DNA, 17 bp, Homo sapiens
tgttggcctcttcaggc

SEQ ID NO: 4400831 - DNA, 23 bp, Homo sapiens
tgttggcgtggggcctttgtcag

SEQ ID NO: 4400832 - DNA, 15 bp, Homo sapiens
tgttggctttttgaa

SEQ ID NO: 4400833 - DNA, 14 bp, Homo sapiens
tgttgggactgcta

SEQ ID NO: 4400834 - DNA, 18 bp, Homo sapiens
tgttgggagtgaggatgt

SEQ ID NO: 4400835 - DNA, 18 bp, Homo sapiens
tgttgggatcgcattgca

SEQ ID NO: 4400836 - DNA, 14 bp, Homo sapiens
tgttggtcatttta

SEQ ID NO: 4400837 - DNA, 15 bp, Homo sapiens
tgttggtctgtagca

SEQ ID NO: 4400838 - DNA, 17 bp, Homo sapiens
tgttgtaaaacaaaatt

SEQ ID NO: 4400839 - DNA, 23 bp, Homo sapiens
tgttgtccctactttctctctct

SEQ ID NO: 4400840 - DNA, 18 bp, Homo sapiens
tgttgtcgtaaagatttg

SEQ ID NO: 4400841 - DNA, 14 bp, Homo sapiens
tgttgtctccactt

SEQ ID NO: 4400842 - DNA, 17 bp, Homo sapiens
tgttgtgtgtatatgta

SEQ ID NO: 4400843 - DNA, 16 bp, Homo sapiens
tgttgtgtgtgggagt

SEQ ID NO: 4400844 - DNA, 16 bp, Homo sapiens
tgttgtttcttaaata

SEQ ID NO: 4400845 - DNA, 11 bp, Homo sapiens
tgttgtttgcc

SEQ ID NO: 4400846 - DNA, 12 bp, Homo sapiens
tgttgtttgtaa

SEQ ID NO: 4400847 - DNA, 12 bp, Homo sapiens
tgtttaaaataa

SEQ ID NO: 4400848 - DNA, 13 bp, Homo sapiens
tgtttaaaatcat

SEQ ID NO: 4400849 - DNA, 21 bp, Homo sapiens
tgtttaaacccaagtgctgca

SEQ ID NO: 4400850 - DNA, 14 bp, Homo sapiens
tgtttaaacctttt

SEQ ID NO: 4400851 - DNA, 22 bp, Homo sapiens
tgtttaaagtgtacttataaac

SEQ ID NO: 4400852 - DNA, 12 bp, Homo sapiens
tgtttaaagttc

SEQ ID NO: 4400853 - DNA, 23 bp, Homo sapiens
tgtttaaagttcaacatgttatt

SEQ ID NO: 4400854 - DNA, 20 bp, Homo sapiens
tgtttaagatatatttccaa

SEQ ID NO: 4400855 - DNA, 21 bp, Homo sapiens
tgtttacaaaaatttctgtaa

SEQ ID NO: 4400856 - DNA, 21 bp, Homo sapiens
tgtttacagcactactctgtg

SEQ ID NO: 4400857 - DNA, 23 bp, Homo sapiens
tgtttacagcactactctgtgcc

SEQ ID NO: 4400858 - DNA, 22 bp, Homo sapiens
tgtttacatcaaagcttcttca

SEQ ID NO: 4400859 - DNA, 17 bp, Homo sapiens
tgtttacatttgatgca

SEQ ID NO: 4400860 - DNA, 14 bp, Homo sapiens
tgtttaccattttt

SEQ ID NO: 4400861 - DNA, 13 bp, Homo sapiens
tgtttactaggga

SEQ ID NO: 4400862 - DNA, 19 bp, Homo sapiens
tgtttactagggatccctc

SEQ ID NO: 4400863 - DNA, 14 bp, Homo sapiens
tgtttactgtatca

SEQ ID NO: 4400864 - DNA, 22 bp, Homo sapiens
tgtttactgtatcaatttctaa

SEQ ID NO: 4400865 - DNA, 22 bp, Homo sapiens
tgtttacttgaatagtattgtg

SEQ ID NO: 4400866 - DNA, 19 bp, Homo sapiens
tgtttagaagaagtgtgtc

SEQ ID NO: 4400867 - DNA, 15 bp, Homo sapiens
tgtttagatgaatgt

SEQ ID NO: 4400868 - DNA, 11 bp, Homo sapiens
tgtttagatgt

SEQ ID NO: 4400869 - DNA, 13 bp, Homo sapiens
tgtttagtggaaa

SEQ ID NO: 4400870 - DNA, 23 bp, Homo sapiens
tgtttataaatagcatttggaaa

SEQ ID NO: 4400871 - DNA, 19 bp, Homo sapiens
tgtttataaatcttatgct

SEQ ID NO: 4400872 - DNA, 21 bp, Homo sapiens
tgtttataaatgttctggtat

SEQ ID NO: 4400873 - DNA, 14 bp, Homo sapiens
tgtttatagcaaaa

SEQ ID NO: 4400874 - DNA, 21 bp, Homo sapiens
tgtttatatacagtacacaga

SEQ ID NO: 4400875 - DNA, 16 bp, Homo sapiens
tgtttatatcactgtc

SEQ ID NO: 4400876 - DNA, 19 bp, Homo sapiens
tgtttatgatatttcttgc

SEQ ID NO: 4400877 - DNA, 22 bp, Homo sapiens
tgtttatggaaatattaagaac

SEQ ID NO: 4400878 - DNA, 14 bp, Homo sapiens
tgtttatggcctca

SEQ ID NO: 4400879 - DNA, 13 bp, Homo sapiens
tgtttatggtaaa

SEQ ID NO: 4400880 - DNA, 16 bp, Homo sapiens
tgtttatggtaaaaaa

SEQ ID NO: 4400881 - DNA, 14 bp, Homo sapiens
tgtttatgtaatag

SEQ ID NO: 4400882 - DNA, 22 bp, Homo sapiens
tgtttatgtgctattaatattt

SEQ ID NO: 4400883 - DNA, 14 bp, Homo sapiens
tgtttatgttttta

SEQ ID NO: 4400884 - DNA, 17 bp, Homo sapiens
tgtttattccttctgta

SEQ ID NO: 4400885 - DNA, 14 bp, Homo sapiens
tgtttattgttttt

SEQ ID NO: 4400886 - DNA, 12 bp, Homo sapiens
tgtttattttga

SEQ ID NO: 4400887 - DNA, 12 bp, Homo sapiens
tgtttatttttc

SEQ ID NO: 4400888 - DNA, 21 bp, Homo sapiens
tgtttattttttattattttt

SEQ ID NO: 4400889 - DNA, 21 bp, Homo sapiens
tgtttcaaaatagacaagttt

SEQ ID NO: 4400890 - DNA, 18 bp, Homo sapiens
tgtttcaaactgtaaaaa

SEQ ID NO: 4400891 - DNA, 15 bp, Homo sapiens
tgtttcagaaaacat

SEQ ID NO: 4400892 - DNA, 14 bp, Homo sapiens
tgtttcagagcata

SEQ ID NO: 4400893 - DNA, 13 bp, Homo sapiens
tgtttcatcaatg

SEQ ID NO: 4400894 - DNA, 18 bp, Homo sapiens
tgtttcattacttgaatg

SEQ ID NO: 4400895 - DNA, 20 bp, Homo sapiens
tgtttccatgttatgtttct

SEQ ID NO: 4400896 - DNA, 20 bp, Homo sapiens
tgtttccattttaaggatat

SEQ ID NO: 4400897 - DNA, 12 bp, Homo sapiens
tgtttcctgaca

SEQ ID NO: 4400898 - DNA, 13 bp, Homo sapiens
tgtttctacaata

SEQ ID NO: 4400899 - DNA, 16 bp, Homo sapiens
tgtttctagttgagga

SEQ ID NO: 4400900 - DNA, 13 bp, Homo sapiens
tgtttctctgctg

SEQ ID NO: 4400901 - DNA, 19 bp, Homo sapiens
tgtttctgactctgagcta

SEQ ID NO: 4400902 - DNA, 12 bp, Homo sapiens
tgtttctgattt

SEQ ID NO: 4400903 - DNA, 18 bp, Homo sapiens
tgtttctggcttagaaca

SEQ ID NO: 4400904 - DNA, 13 bp, Homo sapiens
tgtttctgtcaag

SEQ ID NO: 4400905 - DNA, 16 bp, Homo sapiens
tgtttctgttccaaat

SEQ ID NO: 4400906 - DNA, 15 bp, Homo sapiens
tgtttctttcttcct

SEQ ID NO: 4400907 - DNA, 13 bp, Homo sapiens
tgtttgactgtaa

SEQ ID NO: 4400908 - DNA, 12 bp, Homo sapiens
tgtttgatgcag

SEQ ID NO: 4400909 - DNA, 16 bp, Homo sapiens
tgtttgcccattttca

SEQ ID NO: 4400910 - DNA, 14 bp, Homo sapiens
tgtttgcttaaaat

SEQ ID NO: 4400911 - DNA, 22 bp, Homo sapiens
tgtttgcttcttgccatcactg

SEQ ID NO: 4400912 - DNA, 23 bp, Homo sapiens
tgtttgcttcttgccatcactgg

SEQ ID NO: 4400913 - DNA, 16 bp, Homo sapiens
tgtttggaaaagacag

SEQ ID NO: 4400914 - DNA, 21 bp, Homo sapiens
tgtttggtataaattaatttg

SEQ ID NO: 4400915 - DNA, 17 bp, Homo sapiens
tgtttgtaaatgcctct

SEQ ID NO: 4400916 - DNA, 20 bp, Homo sapiens
tgtttgtacacaacaatcct

SEQ ID NO: 4400917 - DNA, 14 bp, Homo sapiens
tgtttgtgctgtgg

SEQ ID NO: 4400918 - DNA, 15 bp, Homo sapiens
tgtttgtgctgtggt

SEQ ID NO: 4400919 - DNA, 12 bp, Homo sapiens
tgtttgtgtatt

SEQ ID NO: 4400920 - DNA, 16 bp, Homo sapiens
tgtttgtgtgcatgaa

SEQ ID NO: 4400921 - DNA, 20 bp, Homo sapiens
tgtttgtgtgcatgaaagag

SEQ ID NO: 4400922 - DNA, 19 bp, Homo sapiens
tgtttgtgttcaatatcag

SEQ ID NO: 4400923 - DNA, 21 bp, Homo sapiens
tgtttgtttatatcactgtct

SEQ ID NO: 4400924 - DNA, 13 bp, Homo sapiens
tgtttgtttcttt

SEQ ID NO: 4400925 - DNA, 12 bp, Homo sapiens
tgttttaaagaa

SEQ ID NO: 4400926 - DNA, 22 bp, Homo sapiens
tgttttaaagaatatgactttt

SEQ ID NO: 4400927 - DNA, 22 bp, Homo sapiens
tgttttacaatagttctgtggg

SEQ ID NO: 4400928 - DNA, 15 bp, Homo sapiens
tgttttactgtcaga

SEQ ID NO: 4400929 - DNA, 22 bp, Homo sapiens
tgttttactgtcagattaaatt

SEQ ID NO: 4400930 - DNA, 14 bp, Homo sapiens
tgttttatatatta

SEQ ID NO: 4400931 - DNA, 21 bp, Homo sapiens
tgttttatatattatgtgaag

SEQ ID NO: 4400932 - DNA, 23 bp, Homo sapiens
tgttttatatattatgtgaagaa

SEQ ID NO: 4400933 - DNA, 14 bp, Homo sapiens
tgttttcaaatgtt

SEQ ID NO: 4400934 - DNA, 14 bp, Homo sapiens
tgttttcatcattt

SEQ ID NO: 4400935 - DNA, 17 bp, Homo sapiens
tgttttcatcatttcag

SEQ ID NO: 4400936 - DNA, 18 bp, Homo sapiens
tgttttcatcatttcagc

SEQ ID NO: 4400937 - DNA, 22 bp, Homo sapiens
tgttttcatcatttcagccaaa

SEQ ID NO: 4400938 - DNA, 15 bp, Homo sapiens
ttaaacttgtgaatg

SEQ ID NO: 4400939 - DNA, 19 bp, Homo sapiens
ttaaactttgtcacttctg

SEQ ID NO: 4400940 - DNA, 14 bp, Homo sapiens
ttaaactttttaaa

SEQ ID NO: 4400941 - DNA, 17 bp, Homo sapiens
ttaaactttttaaaata

SEQ ID NO: 4400942 - DNA, 20 bp, Homo sapiens
ttaaactttttaaaatactt

SEQ ID NO: 4400943 - DNA, 15 bp, Homo sapiens
ttaaacttttttaac

SEQ ID NO: 4400944 - DNA, 17 bp, Homo sapiens
ttaaagaaaggaaaaga

SEQ ID NO: 4400945 - DNA, 17 bp, Homo sapiens
ttaaagaaagtgtattt

SEQ ID NO: 4400946 - DNA, 16 bp, Homo sapiens
ttaaagactacaataa

SEQ ID NO: 4400947 - DNA, 17 bp, Homo sapiens
ttaaagagatagcttct

SEQ ID NO: 4400948 - DNA, 22 bp, Homo sapiens
ttaaagataagtctacattaaa

SEQ ID NO: 4400949 - DNA, 18 bp, Homo sapiens
ttaaagccattctgatta

SEQ ID NO: 4400950 - DNA, 13 bp, Homo sapiens
ttaaagctaaact

SEQ ID NO: 4400951 - DNA, 16 bp, Homo sapiens
ttaaaggcagcatttg

SEQ ID NO: 4400952 - DNA, 20 bp, Homo sapiens
ttaaaggcagcatttgatga

SEQ ID NO: 4400953 - DNA, 15 bp, Homo sapiens
ttaaaggtgtcttcc

SEQ ID NO: 4400954 - DNA, 14 bp, Homo sapiens
ttaaagtaaacttg

SEQ ID NO: 4400955 - DNA, 20 bp, Homo sapiens
ttaaagtaaacttgtgtatt

SEQ ID NO: 4400956 - DNA, 23 bp, Homo sapiens
ttaaagtatgcattattaaattg

SEQ ID NO: 4400957 - DNA, 13 bp, Homo sapiens
ttaaagtattctt

SEQ ID NO: 4400958 - DNA, 11 bp, Homo sapiens
ttaaagttctg

SEQ ID NO: 4400959 - DNA, 15 bp, Homo sapiens
ttaaagttctgtgta

SEQ ID NO: 4400960 - DNA, 18 bp, Homo sapiens
ttaaagttctgtgtattt

SEQ ID NO: 4400961 - DNA, 20 bp, Homo sapiens
ttaaagttcttattttagta

SEQ ID NO: 4400962 - DNA, 13 bp, Homo sapiens
ttaaagtttaatg

SEQ ID NO: 4400963 - DNA, 17 bp, Homo sapiens
ttaaataaatagaaaga

SEQ ID NO: 4400964 - DNA, 13 bp, Homo sapiens
ttaaataaattaa

SEQ ID NO: 4400965 - DNA, 16 bp, Homo sapiens
ttaaataatttaacta

SEQ ID NO: 4400966 - DNA, 21 bp, Homo sapiens
ttaaataatttaactaccctt

SEQ ID NO: 4400967 - DNA, 10 bp, Homo sapiens
ttaaatacag

SEQ ID NO: 4400968 - DNA, 15 bp, Homo sapiens
ttaaatacaggaaac

SEQ ID NO: 4400969 - DNA, 20 bp, Homo sapiens
ttaaatacaggaaacagttg

SEQ ID NO: 4400970 - DNA, 14 bp, Homo sapiens
ttaaatagggaata

SEQ ID NO: 4400971 - DNA, 16 bp, Homo sapiens
ttaaatatatattttg

SEQ ID NO: 4400972 - DNA, 16 bp, Homo sapiens
ttaaatatatgtatgt

SEQ ID NO: 4400973 - DNA, 20 bp, Homo sapiens
ttaaatatatgtatgtaaaa

SEQ ID NO: 4400974 - DNA, 21 bp, Homo sapiens
ttaaatatctgaacatttact

SEQ ID NO: 4400975 - DNA, 16 bp, Homo sapiens
ttaaatattataatgt

SEQ ID NO: 4400976 - DNA, 13 bp, Homo sapiens
ttaaatatttagt

SEQ ID NO: 4400977 - DNA, 19 bp, Homo sapiens
ttaaatcattttaacttct

SEQ ID NO: 4400978 - DNA, 20 bp, Homo sapiens
ttaaatcattttaggaaagg

SEQ ID NO: 4400979 - DNA, 21 bp, Homo sapiens
ttaaatcattttaggaaagga

SEQ ID NO: 4400980 - DNA, 15 bp, Homo sapiens
ttaaatcatttttat

SEQ ID NO: 4400981 - DNA, 14 bp, Homo sapiens
ttaaatccaataaa

SEQ ID NO: 4400982 - DNA, 12 bp, Homo sapiens
ttaaatctagac

SEQ ID NO: 4400983 - DNA, 15 bp, Homo sapiens
ttaaatgagttactt

SEQ ID NO: 4400984 - DNA, 11 bp, Homo sapiens
ttaaatgattg

SEQ ID NO: 4400985 - DNA, 16 bp, Homo sapiens
ttaaatgatttaaatt

SEQ ID NO: 4400986 - DNA, 13 bp, Homo sapiens
ttaaatgtaaaga

SEQ ID NO: 4400987 - DNA, 17 bp, Homo sapiens
ttaaatgtaaagatatt

SEQ ID NO: 4400988 - DNA, 19 bp, Homo sapiens
ttaaatgtacagacatatt

SEQ ID NO: 4400989 - DNA, 12 bp, Homo sapiens
ttaaatgtatac

SEQ ID NO: 4400990 - DNA, 19 bp, Homo sapiens
ttaaatgtatactatagta

SEQ ID NO: 4400991 - DNA, 18 bp, Homo sapiens
ttaaatgtattttacata

SEQ ID NO: 4400992 - DNA, 16 bp, Homo sapiens
ttaaatgtgtatttct

SEQ ID NO: 4400993 - DNA, 12 bp, Homo sapiens
ttaaatgtttca

SEQ ID NO: 4400994 - DNA, 16 bp, Homo sapiens
ttaaattacaatttta

SEQ ID NO: 4400995 - DNA, 18 bp, Homo sapiens
ttaaattacaattttatc

SEQ ID NO: 4400996 - DNA, 15 bp, Homo sapiens
ttaaattacagcttt

SEQ ID NO: 4400997 - DNA, 19 bp, Homo sapiens
ttaaattacagcttttatg

SEQ ID NO: 4400998 - DNA, 17 bp, Homo sapiens
ttaaattagaaaatatt

SEQ ID NO: 4400999 - DNA, 17 bp, Homo sapiens
ttaaattagtttgtgaa

SEQ ID NO: 4401000 - DNA, 14 bp, Homo sapiens
ttaaattataagga

SEQ ID NO: 4401001 - DNA, 17 bp, Homo sapiens
ttaaattataaggactg

SEQ ID NO: 4401002 - DNA, 22 bp, Homo sapiens
ttaaattatatgatatgcatgt

SEQ ID NO: 4401003 - DNA, 13 bp, Homo sapiens
ttaaattatgaag

SEQ ID NO: 4401004 - DNA, 19 bp, Homo sapiens
ttaaattatgaagctcata

SEQ ID NO: 4401005 - DNA, 12 bp, Homo sapiens
ttaaattattat

SEQ ID NO: 4401006 - DNA, 20 bp, Homo sapiens
ttaaattattatcttcttaa

SEQ ID NO: 4401007 - DNA, 21 bp, Homo sapiens
ttaaattattatcttcttaac

SEQ ID NO: 4401008 - DNA, 14 bp, Homo sapiens
ttaaattcagtaat

SEQ ID NO: 4401009 - DNA, 19 bp, Homo sapiens
ttaaattcccgttttgtca

SEQ ID NO: 4401010 - DNA, 15 bp, Homo sapiens
ttaaattgctttcta

SEQ ID NO: 4401011 - DNA, 21 bp, Homo sapiens
ttaaattgctttctatatctt

SEQ ID NO: 4401012 - DNA, 16 bp, Homo sapiens
ttaaattggaaagcag

SEQ ID NO: 4401013 - DNA, 14 bp, Homo sapiens
ttaaattgggttca

SEQ ID NO: 4401014 - DNA, 22 bp, Homo sapiens
ttaaattgggttcatgatgcag

SEQ ID NO: 4401015 - DNA, 21 bp, Homo sapiens
ttaaatttatcacattgaata

SEQ ID NO: 4401016 - DNA, 18 bp, Homo sapiens
ttaaattttagtacattt

SEQ ID NO: 4401017 - DNA, 20 bp, Homo sapiens
ttaaattttagtacattttc

SEQ ID NO: 4401018 - DNA, 16 bp, Homo sapiens
ttaaattttcttcagt

SEQ ID NO: 4401019 - DNA, 14 bp, Homo sapiens
ttaaattttgtgtc

SEQ ID NO: 4401020 - DNA, 17 bp, Homo sapiens
ttaaattttttttacat

SEQ ID NO: 4401021 - DNA, 18 bp, Homo sapiens
ttaaattttttttacatt

SEQ ID NO: 4401022 - DNA, 16 bp, Homo sapiens
ttaacaaaaaatgtaa

SEQ ID NO: 4401023 - DNA, 21 bp, Homo sapiens
ttaacaaacgtaatttgttat

SEQ ID NO: 4401024 - DNA, 16 bp, Homo sapiens
ttaacaagatgtttca

SEQ ID NO: 4401025 - DNA, 15 bp, Homo sapiens
ttaacaatctaacaa

SEQ ID NO: 4401026 - DNA, 13 bp, Homo sapiens
ttaacacttccta

SEQ ID NO: 4401027 - DNA, 13 bp, Homo sapiens
ttaacagaaattg

SEQ ID NO: 4401028 - DNA, 18 bp, Homo sapiens
ttaacagtatttctcttt

SEQ ID NO: 4401029 - DNA, 22 bp, Homo sapiens
ttaacatagtaagttcagcact

SEQ ID NO: 4401030 - DNA, 15 bp, Homo sapiens
ttaacatgaactctt

SEQ ID NO: 4401031 - DNA, 21 bp, Homo sapiens
ttaacattctttttctgttga

SEQ ID NO: 4401032 - DNA, 16 bp, Homo sapiens
ttaacattgtttttgt

SEQ ID NO: 4401033 - DNA, 17 bp, Homo sapiens
ttaacatttcattgtac

SEQ ID NO: 4401034 - DNA, 19 bp, Homo sapiens
ttaacatttcattgtacaa

SEQ ID NO: 4401035 - DNA, 19 bp, Homo sapiens
ttaaccaaaaagaccagac

SEQ ID NO: 4401036 - DNA, 17 bp, Homo sapiens
ttaaccagtacttctaa

SEQ ID NO: 4401037 - DNA, 21 bp, Homo sapiens
ttaaccccttggtactgaaaa

SEQ ID NO: 4401038 - DNA, 20 bp, Homo sapiens
ttaacctatgatattttctg

SEQ ID NO: 4401039 - DNA, 15 bp, Homo sapiens
ttaacctctgctttt

SEQ ID NO: 4401040 - DNA, 23 bp, Homo sapiens
ttaaccttaaaattaagatttcc

SEQ ID NO: 4401041 - DNA, 15 bp, Homo sapiens
ttaaccttaaaattg

SEQ ID NO: 4401042 - DNA, 21 bp, Homo sapiens
ttaacctttgctatgtaaggg

SEQ ID NO: 4401043 - DNA, 19 bp, Homo sapiens
ttaacgacccactctgctt

SEQ ID NO: 4401044 - DNA, 13 bp, Homo sapiens
ttaacgctgccta

SEQ ID NO: 4401045 - DNA, 14 bp, Homo sapiens
ttaacggtgctaaa

SEQ ID NO: 4401046 - DNA, 14 bp, Homo sapiens
ttaactaaatgctc

SEQ ID NO: 4401047 - DNA, 18 bp, Homo sapiens
ttaactaaattttaaagc

SEQ ID NO: 4401048 - DNA, 20 bp, Homo sapiens
ttaactaaattttaaagcca

SEQ ID NO: 4401049 - DNA, 17 bp, Homo sapiens
ttaactacatctgcctc

SEQ ID NO: 4401050 - DNA, 21 bp, Homo sapiens
ttaactacccttaattactta

SEQ ID NO: 4401051 - DNA, 19 bp, Homo sapiens
ttaactacttatctctaaa

SEQ ID NO: 4401052 - DNA, 14 bp, Homo sapiens
ttaactattgcatt

SEQ ID NO: 4401053 - DNA, 21 bp, Homo sapiens
ttaactattgcatttatatgt

SEQ ID NO: 4401054 - DNA, 12 bp, Homo sapiens
ttaactcagtct

SEQ ID NO: 4401055 - DNA, 20 bp, Homo sapiens
ttaactccactgcttaccta

SEQ ID NO: 4401056 - DNA, 14 bp, Homo sapiens
ttaactccctgtaa

SEQ ID NO: 4401057 - DNA, 15 bp, Homo sapiens
ttaactctctttatg

SEQ ID NO: 4401058 - DNA, 12 bp, Homo sapiens
ttaactctgcat

SEQ ID NO: 4401059 - DNA, 18 bp, Homo sapiens
ttaactctttgaaactgt

SEQ ID NO: 4401060 - DNA, 13 bp, Homo sapiens
ttaactgacatgg

SEQ ID NO: 4401061 - DNA, 19 bp, Homo sapiens
ttaactgccgtaatttaac

SEQ ID NO: 4401062 - DNA, 21 bp, Homo sapiens
ttaactgggtaatgaaacaaa

SEQ ID NO: 4401063 - DNA, 23 bp, Homo sapiens
ttaactggtgcactttgtaaatt

SEQ ID NO: 4401064 - DNA, 11 bp, Homo sapiens
ttaactgtttt

SEQ ID NO: 4401065 - DNA, 15 bp, Homo sapiens
ttaacttaaatagta

SEQ ID NO: 4401066 - DNA, 17 bp, Homo sapiens
ttaacttccactgttaa

SEQ ID NO: 4401067 - DNA, 16 bp, Homo sapiens
ttaacttggtcagagc

SEQ ID NO: 4401068 - DNA, 18 bp, Homo sapiens
ttaagaaaaaaagcaaaa

SEQ ID NO: 4401069 - DNA, 22 bp, Homo sapiens
ttaagaaaaacaataaagatac

SEQ ID NO: 4401070 - DNA, 13 bp, Homo sapiens
ttaagaaaacaag

SEQ ID NO: 4401071 - DNA, 15 bp, Homo sapiens
ttaagaaaactatta

SEQ ID NO: 4401072 - DNA, 18 bp, Homo sapiens
ttaagaaggcaaaaatgt

SEQ ID NO: 4401073 - DNA, 18 bp, Homo sapiens
ttaagacatgatttcctt

SEQ ID NO: 4401074 - DNA, 16 bp, Homo sapiens
ttaagacgtgaatgtc

SEQ ID NO: 4401075 - DNA, 19 bp, Homo sapiens
ttaagaggctttggcccaa

SEQ ID NO: 4401076 - DNA, 13 bp, Homo sapiens
ttaagatattgaa

SEQ ID NO: 4401077 - DNA, 18 bp, Homo sapiens
ttaagatccagaaatact

SEQ ID NO: 4401078 - DNA, 15 bp, Homo sapiens
ttaagatcctaaact

SEQ ID NO: 4401079 - DNA, 20 bp, Homo sapiens
ttaagatcctaaactctcta

SEQ ID NO: 4401080 - DNA, 17 bp, Homo sapiens
ttaagatgtacatttaa

SEQ ID NO: 4401081 - DNA, 18 bp, Homo sapiens
ttaagattctctgcccag

SEQ ID NO: 4401082 - DNA, 17 bp, Homo sapiens
ttaagatttctttatgt

SEQ ID NO: 4401083 - DNA, 14 bp, Homo sapiens
ttaagcaaatactt

SEQ ID NO: 4401084 - DNA, 16 bp, Homo sapiens
ttaagcaggtttgttt

SEQ ID NO: 4401085 - DNA, 18 bp, Homo sapiens
ttaagcattaccactcag

SEQ ID NO: 4401086 - DNA, 21 bp, Homo sapiens
ttaagccacttaaaatgttca

SEQ ID NO: 4401087 - DNA, 13 bp, Homo sapiens
ttaagccctgagg

SEQ ID NO: 4401088 - DNA, 21 bp, Homo sapiens
ttaagctgttcctgttcagta

SEQ ID NO: 4401089 - DNA, 17 bp, Homo sapiens
ttaagctttaaatgaca

SEQ ID NO: 4401090 - DNA, 20 bp, Homo sapiens
ttaagctttaaatgacagta

SEQ ID NO: 4401091 - DNA, 13 bp, Homo sapiens
ttaagcttttatt

SEQ ID NO: 4401092 - DNA, 14 bp, Homo sapiens
ttaagctttttgga

SEQ ID NO: 4401093 - DNA, 17 bp, Homo sapiens
ttaaggacttctgcagc

SEQ ID NO: 4401094 - DNA, 23 bp, Homo sapiens
ttaaggatggggttatgaaccct

SEQ ID NO: 4401095 - DNA, 14 bp, Homo sapiens
ttaaggcagtagtt

SEQ ID NO: 4401096 - DNA, 15 bp, Homo sapiens
ttaagggaaaaatat

SEQ ID NO: 4401097 - DNA, 20 bp, Homo sapiens
ttaagggaggtttaaaaaaa

SEQ ID NO: 4401098 - DNA, 13 bp, Homo sapiens
ttaaggtacactg

SEQ ID NO: 4401099 - DNA, 22 bp, Homo sapiens
ttaaggtacactgtttccatgt

SEQ ID NO: 4401100 - DNA, 15 bp, Homo sapiens
ttaaggtacatcatt

SEQ ID NO: 4401101 - DNA, 18 bp, Homo sapiens
ttaaggtacatcattatt

SEQ ID NO: 4401102 - DNA, 19 bp, Homo sapiens
ttaaggtgagcataaatca

SEQ ID NO: 4401103 - DNA, 20 bp, Homo sapiens
ttaaggtgagcataaatcaa

SEQ ID NO: 4401104 - DNA, 23 bp, Homo sapiens
ttaaggtgtgcagtgtttttcct

SEQ ID NO: 4401105 - DNA, 14 bp, Homo sapiens
ttaagtaaaagtct

SEQ ID NO: 4401106 - DNA, 15 bp, Homo sapiens
ttaagtaaaagtcta

SEQ ID NO: 4401107 - DNA, 15 bp, Homo sapiens
ttaagtaacgtgctc

SEQ ID NO: 4401108 - DNA, 19 bp, Homo sapiens
ttaagtcattttttacttg

SEQ ID NO: 4401109 - DNA, 21 bp, Homo sapiens
ttaagtcattttttacttgaa

SEQ ID NO: 4401110 - DNA, 19 bp, Homo sapiens
ttaagtccctgtcacctct

SEQ ID NO: 4401111 - DNA, 17 bp, Homo sapiens
ttaagtgtaaatgaagt

SEQ ID NO: 4401112 - DNA, 13 bp, Homo sapiens
ttaagtgtgtata

SEQ ID NO: 4401113 - DNA, 22 bp, Homo sapiens
ttaagttacacatttttcagat

SEQ ID NO: 4401114 - DNA, 22 bp, Homo sapiens
ttaagttggcttctgtttctag

SEQ ID NO: 4401115 - DNA, 23 bp, Homo sapiens
ttaagttggcttctgtttctagt

SEQ ID NO: 4401116 - DNA, 16 bp, Homo sapiens
ttaagttgtcaaagaa

SEQ ID NO: 4401117 - DNA, 13 bp, Homo sapiens
ttaataaaaagac

SEQ ID NO: 4401118 - DNA, 21 bp, Homo sapiens
ttaataaaactcactcactgt

SEQ ID NO: 4401119 - DNA, 16 bp, Homo sapiens
tgtcatgtgttccctt

SEQ ID NO: 4401120 - DNA, 12 bp, Homo sapiens
tgtcattatatt

SEQ ID NO: 4401121 - DNA, 15 bp, Homo sapiens
tgtcattatattcta

SEQ ID NO: 4401122 - DNA, 20 bp, Homo sapiens
tgtcattatattctaattaa

SEQ ID NO: 4401123 - DNA, 22 bp, Homo sapiens
tgtcattatattctaattaaaa

SEQ ID NO: 4401124 - DNA, 17 bp, Homo sapiens
tgtcattggaagccatc

SEQ ID NO: 4401125 - DNA, 16 bp, Homo sapiens
tgtcatttcattccat

SEQ ID NO: 4401126 - DNA, 13 bp, Homo sapiens
tgtcatttcttca

SEQ ID NO: 4401127 - DNA, 19 bp, Homo sapiens
tgtccaaaagcgccctcac

SEQ ID NO: 4401128 - DNA, 16 bp, Homo sapiens
tgtccaaaatatttgt

SEQ ID NO: 4401129 - DNA, 17 bp, Homo sapiens
tgtccaaagaggctgcc

SEQ ID NO: 4401130 - DNA, 19 bp, Homo sapiens
tgtccaaaggaggctggca

SEQ ID NO: 4401131 - DNA, 14 bp, Homo sapiens
tgtccaacatggtg

SEQ ID NO: 4401132 - DNA, 21 bp, Homo sapiens
tgtccaacctaacccctttcc

SEQ ID NO: 4401133 - DNA, 22 bp, Homo sapiens
tgtccaacctaacccctttcct

SEQ ID NO: 4401134 - DNA, 12 bp, Homo sapiens
tgtccaagacag

SEQ ID NO: 4401135 - DNA, 23 bp, Homo sapiens
tgtccaagacaggggcctaagga

SEQ ID NO: 4401136 - DNA, 14 bp, Homo sapiens
tgtccaatcctatg

SEQ ID NO: 4401137 - DNA, 11 bp, Homo sapiens
tgtccacctgg

SEQ ID NO: 4401138 - DNA, 12 bp, Homo sapiens
tgtccacctggc

SEQ ID NO: 4401139 - DNA, 13 bp, Homo sapiens
tgtccacctggcc

SEQ ID NO: 4401140 - DNA, 14 bp, Homo sapiens
tgtccacctggccc

SEQ ID NO: 4401141 - DNA, 17 bp, Homo sapiens
tgtccacgactgtctcc

SEQ ID NO: 4401142 - DNA, 19 bp, Homo sapiens
tgtccacgactgtctccat

SEQ ID NO: 4401143 - DNA, 22 bp, Homo sapiens
tgtccacgtacttaatttactt

SEQ ID NO: 4401144 - DNA, 23 bp, Homo sapiens
tgtccactaaaccccatacctgg

SEQ ID NO: 4401145 - DNA, 14 bp, Homo sapiens
tgtccagacagcct

SEQ ID NO: 4401146 - DNA, 20 bp, Homo sapiens
tgtccagagtgagcaaggat

SEQ ID NO: 4401147 - DNA, 15 bp, Homo sapiens
tgtccagataattgg

SEQ ID NO: 4401148 - DNA, 23 bp, Homo sapiens
tgtccagctggggccagaggctg

SEQ ID NO: 4401149 - DNA, 19 bp, Homo sapiens
tgtccagggaaacagcctc

SEQ ID NO: 4401150 - DNA, 19 bp, Homo sapiens
tgtccagtggagggctcat

SEQ ID NO: 4401151 - DNA, 15 bp, Homo sapiens
tgtccatgcttctca

SEQ ID NO: 4401152 - DNA, 13 bp, Homo sapiens
tgtcccaagtgcc

SEQ ID NO: 4401153 - DNA, 12 bp, Homo sapiens
tgtcccacccac

SEQ ID NO: 4401154 - DNA, 21 bp, Homo sapiens
tgtcccagctaccaagtcaga

SEQ ID NO: 4401155 - DNA, 17 bp, Homo sapiens
tgtcccaggccggccca

SEQ ID NO: 4401156 - DNA, 24 bp, Homo sapiens
tgtccccaaaggacgcctgcagga

SEQ ID NO: 4401157 - DNA, 19 bp, Homo sapiens
tgtccccaacgtcccctcc

SEQ ID NO: 4401158 - DNA, 13 bp, Homo sapiens
tgtccccactgcc

SEQ ID NO: 4401159 - DNA, 14 bp, Homo sapiens
tgtccccagagaca

SEQ ID NO: 4401160 - DNA, 18 bp, Homo sapiens
tgtccccagcctacctct

SEQ ID NO: 4401161 - DNA, 15 bp, Homo sapiens
tgtcccccaggctgg

SEQ ID NO: 4401162 - DNA, 16 bp, Homo sapiens
tgtcccccaggctgga

SEQ ID NO: 4401163 - DNA, 16 bp, Homo sapiens
tgtcccctcactctgt

SEQ ID NO: 4401164 - DNA, 18 bp, Homo sapiens
tgtcccctcactctgtca

SEQ ID NO: 4401165 - DNA, 22 bp, Homo sapiens
tgtccccttctctcatctctta

SEQ ID NO: 4401166 - DNA, 17 bp, Homo sapiens
tgtcccggtaccttcca

SEQ ID NO: 4401167 - DNA, 15 bp, Homo sapiens
tgtccctactttctc

SEQ ID NO: 4401168 - DNA, 17 bp, Homo sapiens
tgtccctatgcatatca

SEQ ID NO: 4401169 - DNA, 22 bp, Homo sapiens
tgtccctgtccttccctgttct

SEQ ID NO: 4401170 - DNA, 16 bp, Homo sapiens
tgtcccttaaacaaaa

SEQ ID NO: 4401171 - DNA, 12 bp, Homo sapiens
tgtcccttgcct

SEQ ID NO: 4401172 - DNA, 16 bp, Homo sapiens
tgtcccttttccctta

SEQ ID NO: 4401173 - DNA, 14 bp, Homo sapiens
tgtccgcaaggggt

SEQ ID NO: 4401174 - DNA, 18 bp, Homo sapiens
tgtccggcccagtgccac

SEQ ID NO: 4401175 - DNA, 15 bp, Homo sapiens
tgtcctacgtccaag

SEQ ID NO: 4401176 - DNA, 12 bp, Homo sapiens
tgtcctatgcaa

SEQ ID NO: 4401177 - DNA, 22 bp, Homo sapiens
tgtcctattactgatgtgtgca

SEQ ID NO: 4401178 - DNA, 21 bp, Homo sapiens
tgtcctcagccccgcgtggaa

SEQ ID NO: 4401179 - DNA, 21 bp, Homo sapiens
tgtcctcctcggatcaccgag

SEQ ID NO: 4401180 - DNA, 21 bp, Homo sapiens
tgtcctcctggtgggtccagg

SEQ ID NO: 4401181 - DNA, 13 bp, Homo sapiens
tgtcctctcgagc

SEQ ID NO: 4401182 - DNA, 14 bp, Homo sapiens
tgtcctcttctgct

SEQ ID NO: 4401183 - DNA, 18 bp, Homo sapiens
tgtcctcttctgctcttt

SEQ ID NO: 4401184 - DNA, 19 bp, Homo sapiens
tgtcctgcacaccctgggc

SEQ ID NO: 4401185 - DNA, 18 bp, Homo sapiens
tgtcctgcaccggggcct

SEQ ID NO: 4401186 - DNA, 24 bp, Homo sapiens
tgtcctgcctattatctgtcagct

SEQ ID NO: 4401187 - DNA, 17 bp, Homo sapiens
tgtcctgggcctgcccc

SEQ ID NO: 4401188 - DNA, 20 bp, Homo sapiens
tgtcctgtaactgttacagt

SEQ ID NO: 4401189 - DNA, 20 bp, Homo sapiens
tgtcctgtgagatgtgtatc

SEQ ID NO: 4401190 - DNA, 12 bp, Homo sapiens
tgtcctgtgatg

SEQ ID NO: 4401191 - DNA, 18 bp, Homo sapiens
tgtcctgttaatttatag

SEQ ID NO: 4401192 - DNA, 16 bp, Homo sapiens
tgtccttaacccacct

SEQ ID NO: 4401193 - DNA, 21 bp, Homo sapiens
tgtccttaacccacctctcct

SEQ ID NO: 4401194 - DNA, 19 bp, Homo sapiens
tgtccttccattttcattc

SEQ ID NO: 4401195 - DNA, 17 bp, Homo sapiens
tgtccttccctcaaaga

SEQ ID NO: 4401196 - DNA, 17 bp, Homo sapiens
tgtccttgaatgccata

SEQ ID NO: 4401197 - DNA, 16 bp, Homo sapiens
tgtcctttctcagagg

SEQ ID NO: 4401198 - DNA, 14 bp, Homo sapiens
tgtccttttctccc

SEQ ID NO: 4401199 - DNA, 21 bp, Homo sapiens
tgtccttttctcccatttctt

SEQ ID NO: 4401200 - DNA, 16 bp, Homo sapiens
tgtcgccccaggccct

SEQ ID NO: 4401201 - DNA, 17 bp, Homo sapiens
tgtcgccccaggccctc

SEQ ID NO: 4401202 - DNA, 14 bp, Homo sapiens
tgtcggcacattca

SEQ ID NO: 4401203 - DNA, 21 bp, Homo sapiens
tgtcggccccaccagtgcctc

SEQ ID NO: 4401204 - DNA, 22 bp, Homo sapiens
tgtcggccccaccagtgcctct

SEQ ID NO: 4401205 - DNA, 21 bp, Homo sapiens
tgtcggcctctaaccccaggc

SEQ ID NO: 4401206 - DNA, 22 bp, Homo sapiens
tgtcggcctctaaccccaggcc

SEQ ID NO: 4401207 - DNA, 23 bp, Homo sapiens
tgtcggcctctaaccccaggccc

SEQ ID NO: 4401208 - DNA, 20 bp, Homo sapiens
tgtctacatatgatctgtct

SEQ ID NO: 4401209 - DNA, 15 bp, Homo sapiens
tgtctagctgtttca

SEQ ID NO: 4401210 - DNA, 17 bp, Homo sapiens
tgtctaggttaaagcta

SEQ ID NO: 4401211 - DNA, 19 bp, Homo sapiens
tgtctaggttaaagctaaa

SEQ ID NO: 4401212 - DNA, 19 bp, Homo sapiens
tgtctatgtagctgaaaat

SEQ ID NO: 4401213 - DNA, 18 bp, Homo sapiens
tgtctattgtccaaagtt

SEQ ID NO: 4401214 - DNA, 20 bp, Homo sapiens
tgtctatttttaatgtttgt

SEQ ID NO: 4401215 - DNA, 18 bp, Homo sapiens
tgtctcaacgcctccccc

SEQ ID NO: 4401216 - DNA, 16 bp, Homo sapiens
tgtctcacctggactt

SEQ ID NO: 4401217 - DNA, 18 bp, Homo sapiens
tgtctcactcttctgtct

SEQ ID NO: 4401218 - DNA, 20 bp, Homo sapiens
tgtctcagcgaggtgtaaag

SEQ ID NO: 4401219 - DNA, 16 bp, Homo sapiens
tgtctcaggctcaagt

SEQ ID NO: 4401220 - DNA, 19 bp, Homo sapiens
tgtctcaggctcaagtttt

SEQ ID NO: 4401221 - DNA, 21 bp, Homo sapiens
tgtctcagtccatgaagatgt

SEQ ID NO: 4401222 - DNA, 11 bp, Homo sapiens
tgtctcatcca

SEQ ID NO: 4401223 - DNA, 21 bp, Homo sapiens
tgtctcatccatcatcatgtg

SEQ ID NO: 4401224 - DNA, 16 bp, Homo sapiens
tgtctcatccccaggg

SEQ ID NO: 4401225 - DNA, 21 bp, Homo sapiens
tgtctccaaccccccagcact

SEQ ID NO: 4401226 - DNA, 12 bp, Homo sapiens
tgtctccagctt

SEQ ID NO: 4401227 - DNA, 19 bp, Homo sapiens
tgtctccagggcccccacc

SEQ ID NO: 4401228 - DNA, 18 bp, Homo sapiens
tgtctcctatatatttct

SEQ ID NO: 4401229 - DNA, 19 bp, Homo sapiens
tgtctcgtggtaggactgt

SEQ ID NO: 4401230 - DNA, 20 bp, Homo sapiens
tgtctcgtggtaggactgta

SEQ ID NO: 4401231 - DNA, 15 bp, Homo sapiens
tgtctctaaaaagaa

SEQ ID NO: 4401232 - DNA, 13 bp, Homo sapiens
tgtctctcagaat

SEQ ID NO: 4401233 - DNA, 19 bp, Homo sapiens
tgtctctcttcagactctc

SEQ ID NO: 4401234 - DNA, 20 bp, Homo sapiens
tgtctcttcatctaatatga

SEQ ID NO: 4401235 - DNA, 23 bp, Homo sapiens
tgtctctttggcgacctcctttc

SEQ ID NO: 4401236 - DNA, 13 bp, Homo sapiens
tgtctgaaacatt

SEQ ID NO: 4401237 - DNA, 15 bp, Homo sapiens
tgtctgaaatggaac

SEQ ID NO: 4401238 - DNA, 20 bp, Homo sapiens
tgtctgaccttccaaagact

SEQ ID NO: 4401239 - DNA, 17 bp, Homo sapiens
tgtctgacttttgttaa

SEQ ID NO: 4401240 - DNA, 17 bp, Homo sapiens
tgtctgagtagtggcca

SEQ ID NO: 4401241 - DNA, 20 bp, Homo sapiens
tgtctgatctgtgctttcca

SEQ ID NO: 4401242 - DNA, 15 bp, Homo sapiens
tgtctgccaaaatgc

SEQ ID NO: 4401243 - DNA, 19 bp, Homo sapiens
tgtctgccaacctaaaact

SEQ ID NO: 4401244 - DNA, 15 bp, Homo sapiens
tgtctgccttcacaa

SEQ ID NO: 4401245 - DNA, 17 bp, Homo sapiens
tgtctgccttcacaaat

SEQ ID NO: 4401246 - DNA, 21 bp, Homo sapiens
tgtctgctaggcgctggggag

SEQ ID NO: 4401247 - DNA, 23 bp, Homo sapiens
tgtctgctaggcgctggggagac

SEQ ID NO: 4401248 - DNA, 18 bp, Homo sapiens
tgtctgctgagttggcct

SEQ ID NO: 4401249 - DNA, 23 bp, Homo sapiens
tgtctgctgagttggcctggcca

SEQ ID NO: 4401250 - DNA, 21 bp, Homo sapiens
tgtctgcttgcatctgcacat

SEQ ID NO: 4401251 - DNA, 17 bp, Homo sapiens
tgtctggaagacgtggc

SEQ ID NO: 4401252 - DNA, 20 bp, Homo sapiens
tgtctggaagacgtggctct

SEQ ID NO: 4401253 - DNA, 14 bp, Homo sapiens
tgtctggatcagta

SEQ ID NO: 4401254 - DNA, 21 bp, Homo sapiens
tgtctggatcagtaaaattat

SEQ ID NO: 4401255 - DNA, 19 bp, Homo sapiens
tgtctggcgttctcaagaa

SEQ ID NO: 4401256 - DNA, 20 bp, Homo sapiens
tgtctggcgttctcaagaat

SEQ ID NO: 4401257 - DNA, 21 bp, Homo sapiens
tgtctggctcggacccacccc

SEQ ID NO: 4401258 - DNA, 17 bp, Homo sapiens
tgtctggctttggcact

SEQ ID NO: 4401259 - DNA, 14 bp, Homo sapiens
tgtctggggcagaa

SEQ ID NO: 4401260 - DNA, 19 bp, Homo sapiens
tgtctgtagagggccctgg

SEQ ID NO: 4401261 - DNA, 21 bp, Homo sapiens
tgtctgtagagggccctggtg

SEQ ID NO: 4401262 - DNA, 23 bp, Homo sapiens
tgtctgtagagggccctggtgtt

SEQ ID NO: 4401263 - DNA, 11 bp, Homo sapiens
tgtctgtcacc

SEQ ID NO: 4401264 - DNA, 14 bp, Homo sapiens
tgtctgtctacatt

SEQ ID NO: 4401265 - DNA, 19 bp, Homo sapiens
tgtctgtgaacagagagac

SEQ ID NO: 4401266 - DNA, 16 bp, Homo sapiens
tgtctgtgatctctgc

SEQ ID NO: 4401267 - DNA, 16 bp, Homo sapiens
tgtctgtgcacatgcc

SEQ ID NO: 4401268 - DNA, 19 bp, Homo sapiens
tgtctgtgcacatgcctct

SEQ ID NO: 4401269 - DNA, 20 bp, Homo sapiens
tgtctgtgcacatgcctctg

SEQ ID NO: 4401270 - DNA, 14 bp, Homo sapiens
tgtctgtgttgctt

SEQ ID NO: 4401271 - DNA, 20 bp, Homo sapiens
tgtctgtgttttgaaagaat

SEQ ID NO: 4401272 - DNA, 17 bp, Homo sapiens
tgtctgttcccagcccc

SEQ ID NO: 4401273 - DNA, 21 bp, Homo sapiens
tgtctgttcccagcccctgca

SEQ ID NO: 4401274 - DNA, 20 bp, Homo sapiens
tgtcttaaactaaatgtgca

SEQ ID NO: 4401275 - DNA, 22 bp, Homo sapiens
tgtcttaagatggaaatacagt

SEQ ID NO: 4401276 - DNA, 16 bp, Homo sapiens
tgtcttatttttagat

SEQ ID NO: 4401277 - DNA, 22 bp, Homo sapiens
tgtcttcattttttaatgtgct

SEQ ID NO: 4401278 - DNA, 13 bp, Homo sapiens
tgtcttcccaggg

SEQ ID NO: 4401279 - DNA, 14 bp, Homo sapiens
tgtcttcccagggt

SEQ ID NO: 4401280 - DNA, 15 bp, Homo sapiens
tgtcttccctgggct

SEQ ID NO: 4401281 - DNA, 16 bp, Homo sapiens
tgtcttccctgggctg

SEQ ID NO: 4401282 - DNA, 23 bp, Homo sapiens
tgtcttccctgggctgccaccag

SEQ ID NO: 4401283 - DNA, 16 bp, Homo sapiens
tgtcttcctcaaaata

SEQ ID NO: 4401284 - DNA, 13 bp, Homo sapiens
tgtcttctgcctg

SEQ ID NO: 4401285 - DNA, 17 bp, Homo sapiens
tgtcttctgcctgttat

SEQ ID NO: 4401286 - DNA, 18 bp, Homo sapiens
tgtcttctgcctgttata

SEQ ID NO: 4401287 - DNA, 18 bp, Homo sapiens
tgtcttcttcatgtcatc

SEQ ID NO: 4401288 - DNA, 22 bp, Homo sapiens
tgtcttgatgcatgcactgttc

SEQ ID NO: 4401289 - DNA, 21 bp, Homo sapiens
tgtcttgatgttttttctgta

SEQ ID NO: 4401290 - DNA, 17 bp, Homo sapiens
tgtcttgccttcatttc

SEQ ID NO: 4401291 - DNA, 16 bp, Homo sapiens
tgtcttgtatttaaaa

SEQ ID NO: 4401292 - DNA, 16 bp, Homo sapiens
tgtcttgttcctgtgc

SEQ ID NO: 4401293 - DNA, 14 bp, Homo sapiens
tgtctttaaaaact

SEQ ID NO: 4401294 - DNA, 13 bp, Homo sapiens
tgtctttctttgg

SEQ ID NO: 4401295 - DNA, 15 bp, Homo sapiens
tgtctttgtttaaaa

SEQ ID NO: 4401296 - DNA, 22 bp, Homo sapiens
tgtcttttcagaagcaagccag

SEQ ID NO: 4401297 - DNA, 15 bp, Homo sapiens
tgtctttttgttgta

SEQ ID NO: 4401298 - DNA, 12 bp, Homo sapiens
tgtcttttttct

SEQ ID NO: 4401299 - DNA, 21 bp, Homo sapiens
tgtgaaaatagtgtaagaact

SEQ ID NO: 4401300 - DNA, 18 bp, Homo sapiens
tgtgaaaatatacttgac

SEQ ID NO: 4401301 - DNA, 21 bp, Homo sapiens
tgtgaaaatatacttgactct

SEQ ID NO: 4401302 - DNA, 23 bp, Homo sapiens
tgtgaaagaagtatttaaacttt

SEQ ID NO: 4401303 - DNA, 14 bp, Homo sapiens
tgtgaaatgtaact

SEQ ID NO: 4401304 - DNA, 15 bp, Homo sapiens
tgtgaacagagagac

SEQ ID NO: 4401305 - DNA, 16 bp, Homo sapiens
tgtgaaccaaccccca

SEQ ID NO: 4401306 - DNA, 17 bp, Homo sapiens
tgtgaaccactgtgccc

SEQ ID NO: 4401307 - DNA, 15 bp, Homo sapiens
tgtgaacctacctgc

SEQ ID NO: 4401308 - DNA, 22 bp, Homo sapiens
tgtgaacctacctgccttggag

SEQ ID NO: 4401309 - DNA, 19 bp, Homo sapiens
tgtgaacctgggcactccg

SEQ ID NO: 4401310 - DNA, 17 bp, Homo sapiens
tgtgaacgcatgtggta

SEQ ID NO: 4401311 - DNA, 19 bp, Homo sapiens
tgtgaactggaagaaagca

SEQ ID NO: 4401312 - DNA, 12 bp, Homo sapiens
tgtgaactgtgt

SEQ ID NO: 4401313 - DNA, 13 bp, Homo sapiens
tgtgaactgtgtg

SEQ ID NO: 4401314 - DNA, 10 bp, Homo sapiens
tgtgaagaat

SEQ ID NO: 4401315 - DNA, 20 bp, Homo sapiens
tgtgaagaatttagatctta

SEQ ID NO: 4401316 - DNA, 20 bp, Homo sapiens
tgtgaagcaaactctaaaat

SEQ ID NO: 4401317 - DNA, 22 bp, Homo sapiens
tgtgaaggattatggaaaaata

SEQ ID NO: 4401318 - DNA, 17 bp, Homo sapiens
tgtgaaggtgatttaag

SEQ ID NO: 4401319 - DNA, 15 bp, Homo sapiens
tgtgaatagcctggc

SEQ ID NO: 4401320 - DNA, 19 bp, Homo sapiens
tgtgaataggttatatgca

SEQ ID NO: 4401321 - DNA, 17 bp, Homo sapiens
tgtgaatataaatgtgt

SEQ ID NO: 4401322 - DNA, 14 bp, Homo sapiens
tgtgaatattcctt

SEQ ID NO: 4401323 - DNA, 15 bp, Homo sapiens
tgtgaatcagaccct

SEQ ID NO: 4401324 - DNA, 22 bp, Homo sapiens
tgtgaattaggctgtaactact

SEQ ID NO: 4401325 - DNA, 24 bp, Homo sapiens
tgtgaattaggctgtaactacttt

SEQ ID NO: 4401326 - DNA, 15 bp, Homo sapiens
tgtgaattattgaca

SEQ ID NO: 4401327 - DNA, 19 bp, Homo sapiens
tgtgaattattgacactga

SEQ ID NO: 4401328 - DNA, 21 bp, Homo sapiens
tgtgaattattgacactgaac

SEQ ID NO: 4401329 - DNA, 15 bp, Homo sapiens
tgtgaatttttaagc

SEQ ID NO: 4401330 - DNA, 22 bp, Homo sapiens
tgtgacaatagggctaaatgtt

SEQ ID NO: 4401331 - DNA, 23 bp, Homo sapiens
tgtgacaggaaagccctccccct

SEQ ID NO: 4401332 - DNA, 18 bp, Homo sapiens
tgtgacagtcactgcatt

SEQ ID NO: 4401333 - DNA, 16 bp, Homo sapiens
tgtgacatggtgcctg

SEQ ID NO: 4401334 - DNA, 22 bp, Homo sapiens
tgtgacatggtgcctgagaggc

SEQ ID NO: 4401335 - DNA, 13 bp, Homo sapiens
tgtgacattcctt

SEQ ID NO: 4401336 - DNA, 15 bp, Homo sapiens
tgtgacattttacat

SEQ ID NO: 4401337 - DNA, 19 bp, Homo sapiens
tgtgaccaagtataaactt

SEQ ID NO: 4401338 - DNA, 16 bp, Homo sapiens
tgtgaccaatgtcttg

SEQ ID NO: 4401339 - DNA, 14 bp, Homo sapiens
tgtgaccctgggca

SEQ ID NO: 4401340 - DNA, 13 bp, Homo sapiens
tgtgacctgaggg

SEQ ID NO: 4401341 - DNA, 16 bp, Homo sapiens
tgtgactctagcaagg

SEQ ID NO: 4401342 - DNA, 19 bp, Homo sapiens
tgtgactcttactccttag

SEQ ID NO: 4401343 - DNA, 14 bp, Homo sapiens
tgtgactctttcca

SEQ ID NO: 4401344 - DNA, 17 bp, Homo sapiens
tgtgactggctaaagct

SEQ ID NO: 4401345 - DNA, 18 bp, Homo sapiens
tgtgactggctaaagctc

SEQ ID NO: 4401346 - DNA, 23 bp, Homo sapiens
tgtgacttctattttaaagacaa

SEQ ID NO: 4401347 - DNA, 16 bp, Homo sapiens
tgtgagacccccacac

SEQ ID NO: 4401348 - DNA, 19 bp, Homo sapiens
tgtgagacccccacacctc

SEQ ID NO: 4401349 - DNA, 19 bp, Homo sapiens
tgtgagactcgagaacttt

SEQ ID NO: 4401350 - DNA, 15 bp, Homo sapiens
tgtgagaggtttgac

SEQ ID NO: 4401351 - DNA, 19 bp, Homo sapiens
tgtgagatagttttcattt

SEQ ID NO: 4401352 - DNA, 17 bp, Homo sapiens
tgtgagcatggggccag

SEQ ID NO: 4401353 - DNA, 15 bp, Homo sapiens
tgtgagcgagcaagc

SEQ ID NO: 4401354 - DNA, 14 bp, Homo sapiens
tgtgagctctggtt

SEQ ID NO: 4401355 - DNA, 20 bp, Homo sapiens
tgtgagctctggttattttt

SEQ ID NO: 4401356 - DNA, 15 bp, Homo sapiens
tgtgagctcttccct

SEQ ID NO: 4401357 - DNA, 16 bp, Homo sapiens
tgtgagctcttccctt

SEQ ID NO: 4401358 - DNA, 14 bp, Homo sapiens
tgtgaggcaataag

SEQ ID NO: 4401359 - DNA, 19 bp, Homo sapiens
tgtatctgtgcttctaata

SEQ ID NO: 4401360 - DNA, 14 bp, Homo sapiens
tgtatctgtgcttt

SEQ ID NO: 4401361 - DNA, 14 bp, Homo sapiens
tgtatctttattaa

SEQ ID NO: 4401362 - DNA, 19 bp, Homo sapiens
tgtatctttattaaaacaa

SEQ ID NO: 4401363 - DNA, 22 bp, Homo sapiens
tgtatctttattaaaacaaaag

SEQ ID NO: 4401364 - DNA, 12 bp, Homo sapiens
tgtatctttctt

SEQ ID NO: 4401365 - DNA, 18 bp, Homo sapiens
tgtatctttctttctcta

SEQ ID NO: 4401366 - DNA, 19 bp, Homo sapiens
tgtatctttctttctctaa

SEQ ID NO: 4401367 - DNA, 19 bp, Homo sapiens
tgtatcttttttaaactgt

SEQ ID NO: 4401368 - DNA, 20 bp, Homo sapiens
tgtatgaaaaattggggagg

SEQ ID NO: 4401369 - DNA, 22 bp, Homo sapiens
tgtatgattactggcctttttc

SEQ ID NO: 4401370 - DNA, 16 bp, Homo sapiens
tgtatgccaagtgaga

SEQ ID NO: 4401371 - DNA, 22 bp, Homo sapiens
tgtatgccaatcttaaagacaa

SEQ ID NO: 4401372 - DNA, 20 bp, Homo sapiens
tgtatgcttttataggcctg

SEQ ID NO: 4401373 - DNA, 23 bp, Homo sapiens
tgtatggatatatttgaaatagt

SEQ ID NO: 4401374 - DNA, 12 bp, Homo sapiens
tgtatgtaaaaa

SEQ ID NO: 4401375 - DNA, 15 bp, Homo sapiens
tgtatgtaaataggt

SEQ ID NO: 4401376 - DNA, 13 bp, Homo sapiens
tgtatgtacaata

SEQ ID NO: 4401377 - DNA, 14 bp, Homo sapiens
tgtatgtacaatac

SEQ ID NO: 4401378 - DNA, 21 bp, Homo sapiens
tgtatgtgggggtctgtgtgt

SEQ ID NO: 4401379 - DNA, 15 bp, Homo sapiens
tgtatgtttttactg

SEQ ID NO: 4401380 - DNA, 16 bp, Homo sapiens
tgtatgtttttactga

SEQ ID NO: 4401381 - DNA, 17 bp, Homo sapiens
tgtatgtttttactgaa

SEQ ID NO: 4401382 - DNA, 16 bp, Homo sapiens
tgtattaagaaaggaa

SEQ ID NO: 4401383 - DNA, 13 bp, Homo sapiens
tgtattagatatc

SEQ ID NO: 4401384 - DNA, 18 bp, Homo sapiens
tgtattagatatcaatgt

SEQ ID NO: 4401385 - DNA, 15 bp, Homo sapiens
tgtattattacaaat

SEQ ID NO: 4401386 - DNA, 14 bp, Homo sapiens
tgtattcctttaaa

SEQ ID NO: 4401387 - DNA, 19 bp, Homo sapiens
tgtattcctttaaaatatt

SEQ ID NO: 4401388 - DNA, 13 bp, Homo sapiens
tgtattcttcatg

SEQ ID NO: 4401389 - DNA, 14 bp, Homo sapiens
tgtattcttcatga

SEQ ID NO: 4401390 - DNA, 15 bp, Homo sapiens
tgtattcttcatgaa

SEQ ID NO: 4401391 - DNA, 15 bp, Homo sapiens
tgtattcttgtttga

SEQ ID NO: 4401392 - DNA, 14 bp, Homo sapiens
tgtattctttataa

SEQ ID NO: 4401393 - DNA, 15 bp, Homo sapiens
tgtattgcttcctga

SEQ ID NO: 4401394 - DNA, 16 bp, Homo sapiens
tgtattgtaaatgtgg

SEQ ID NO: 4401395 - DNA, 21 bp, Homo sapiens
tgtattgtatattacaatgat

SEQ ID NO: 4401396 - DNA, 23 bp, Homo sapiens
tgtattgttgaaaaagtttgttt

SEQ ID NO: 4401397 - DNA, 15 bp, Homo sapiens
tgtattgtttctaca

SEQ ID NO: 4401398 - DNA, 19 bp, Homo sapiens
tgtattgtttctacaataa

SEQ ID NO: 4401399 - DNA, 14 bp, Homo sapiens
tgtatttaacagaa

SEQ ID NO: 4401400 - DNA, 21 bp, Homo sapiens
tgtatttaacagaaattgtat

SEQ ID NO: 4401401 - DNA, 18 bp, Homo sapiens
tgtatttaagatgtacat

SEQ ID NO: 4401402 - DNA, 21 bp, Homo sapiens
tgtatttaagatgtacattta

SEQ ID NO: 4401403 - DNA, 23 bp, Homo sapiens
tgtatttaagatgtacatttaat

SEQ ID NO: 4401404 - DNA, 20 bp, Homo sapiens
tgtatttaagcaaatactta

SEQ ID NO: 4401405 - DNA, 17 bp, Homo sapiens
tgtatttaattgtaaac

SEQ ID NO: 4401406 - DNA, 18 bp, Homo sapiens
tgtatttaattgtaaact

SEQ ID NO: 4401407 - DNA, 22 bp, Homo sapiens
tgtatttaattgtaaactgtac

SEQ ID NO: 4401408 - DNA, 17 bp, Homo sapiens
tgtatttatgtgtgagg

SEQ ID NO: 4401409 - DNA, 17 bp, Homo sapiens
tgtatttatttaaaact

SEQ ID NO: 4401410 - DNA, 15 bp, Homo sapiens
tgtatttcaaatatc

SEQ ID NO: 4401411 - DNA, 14 bp, Homo sapiens
tgtatttcagtatt

SEQ ID NO: 4401412 - DNA, 22 bp, Homo sapiens
tgtatttccaaacctggttcat

SEQ ID NO: 4401413 - DNA, 13 bp, Homo sapiens
tgtatttgctaat

SEQ ID NO: 4401414 - DNA, 17 bp, Homo sapiens
tgtatttgtagtgttat

SEQ ID NO: 4401415 - DNA, 17 bp, Homo sapiens
tgtatttgttatatata

SEQ ID NO: 4401416 - DNA, 19 bp, Homo sapiens
tgtatttgttatatataat

SEQ ID NO: 4401417 - DNA, 13 bp, Homo sapiens
tgtattttacata

SEQ ID NO: 4401418 - DNA, 19 bp, Homo sapiens
tgtattttatttagacaag

SEQ ID NO: 4401419 - DNA, 22 bp, Homo sapiens
tgtatttttacagctactttaa

SEQ ID NO: 4401420 - DNA, 20 bp, Homo sapiens
tgtcaaaaattttgaatgta

SEQ ID NO: 4401421 - DNA, 16 bp, Homo sapiens
tgtcaaactgtagaaa

SEQ ID NO: 4401422 - DNA, 14 bp, Homo sapiens
tgtcaaagaagctt

SEQ ID NO: 4401423 - DNA, 15 bp, Homo sapiens
tgtcaaataaacact

SEQ ID NO: 4401424 - DNA, 18 bp, Homo sapiens
tgtcaaataaacactgtg

SEQ ID NO: 4401425 - DNA, 22 bp, Homo sapiens
tgtcaacttcagttgaaaagag

SEQ ID NO: 4401426 - DNA, 20 bp, Homo sapiens
tgtcaacttcccatctggct

SEQ ID NO: 4401427 - DNA, 14 bp, Homo sapiens
tgtcaagacatttc

SEQ ID NO: 4401428 - DNA, 16 bp, Homo sapiens
tgtcaagcctgtgcaa

SEQ ID NO: 4401429 - DNA, 18 bp, Homo sapiens
tgtcaagctggtgctact

SEQ ID NO: 4401430 - DNA, 16 bp, Homo sapiens
tgtcaagtgcctgcac

SEQ ID NO: 4401431 - DNA, 18 bp, Homo sapiens
tgtcaagtgcctgcacca

SEQ ID NO: 4401432 - DNA, 18 bp, Homo sapiens
tgtcaagttcctttgggt

SEQ ID NO: 4401433 - DNA, 18 bp, Homo sapiens
tgtcaatagtattaacta

SEQ ID NO: 4401434 - DNA, 21 bp, Homo sapiens
tgtcacaacaattaaatatac

SEQ ID NO: 4401435 - DNA, 22 bp, Homo sapiens
tgtcacaacatggtgctacttc

SEQ ID NO: 4401436 - DNA, 17 bp, Homo sapiens
tgtcacaataaagttta

SEQ ID NO: 4401437 - DNA, 18 bp, Homo sapiens
tgtcacaataaagtttat

SEQ ID NO: 4401438 - DNA, 13 bp, Homo sapiens
tgtcacaccagcc

SEQ ID NO: 4401439 - DNA, 15 bp, Homo sapiens
tgtcacacccatggc

SEQ ID NO: 4401440 - DNA, 11 bp, Homo sapiens
tgtcacaggca

SEQ ID NO: 4401441 - DNA, 12 bp, Homo sapiens
tgtcacagttct

SEQ ID NO: 4401442 - DNA, 17 bp, Homo sapiens
tgtcacatacaactttt

SEQ ID NO: 4401443 - DNA, 19 bp, Homo sapiens
tgtcaccaccttcccagct

SEQ ID NO: 4401444 - DNA, 22 bp, Homo sapiens
tgtcacccttaggccagcacca

SEQ ID NO: 4401445 - DNA, 18 bp, Homo sapiens
tgtcaccggtcagtgcct

SEQ ID NO: 4401446 - DNA, 23 bp, Homo sapiens
tgtcacctcttccgactctttct

SEQ ID NO: 4401447 - DNA, 17 bp, Homo sapiens
tgtcacgagcccattct

SEQ ID NO: 4401448 - DNA, 18 bp, Homo sapiens
tgtcacggggttccctcc

SEQ ID NO: 4401449 - DNA, 14 bp, Homo sapiens
tgtcactatatctt

SEQ ID NO: 4401450 - DNA, 14 bp, Homo sapiens
tgtcacttgccaca

SEQ ID NO: 4401451 - DNA, 16 bp, Homo sapiens
tgtcacttgccacatg

SEQ ID NO: 4401452 - DNA, 15 bp, Homo sapiens
tgtcagaagcctcca

SEQ ID NO: 4401453 - DNA, 18 bp, Homo sapiens
tgtcagaagcctccaagc

SEQ ID NO: 4401454 - DNA, 19 bp, Homo sapiens
tgtcagattaaattacagc

SEQ ID NO: 4401455 - DNA, 22 bp, Homo sapiens
tgtcagcattcctattaatgtc

SEQ ID NO: 4401456 - DNA, 19 bp, Homo sapiens
tgtcagccatcgtcctggg

SEQ ID NO: 4401457 - DNA, 20 bp, Homo sapiens
tgtcagccatcgtcctggga

SEQ ID NO: 4401458 - DNA, 15 bp, Homo sapiens
tgtcagcggtgcagc

SEQ ID NO: 4401459 - DNA, 20 bp, Homo sapiens
tgtcagctcccctcggagaa

SEQ ID NO: 4401460 - DNA, 22 bp, Homo sapiens
tgtcagctgcaaggtactctgg

SEQ ID NO: 4401461 - DNA, 15 bp, Homo sapiens
tgtcagcttatccta

SEQ ID NO: 4401462 - DNA, 23 bp, Homo sapiens
tgtcaggctgctggcgcctctgc

SEQ ID NO: 4401463 - DNA, 24 bp, Homo sapiens
tgtcaggctgctggcgcctctgca

SEQ ID NO: 4401464 - DNA, 15 bp, Homo sapiens
tgtcagtgaggactc

SEQ ID NO: 4401465 - DNA, 20 bp, Homo sapiens
tgtcagtgttaaagattttg

SEQ ID NO: 4401466 - DNA, 22 bp, Homo sapiens
tgtcagttgttatttattgaaa

SEQ ID NO: 4401467 - DNA, 17 bp, Homo sapiens
tgtcagtttatcttaag

SEQ ID NO: 4401468 - DNA, 15 bp, Homo sapiens
tgtcataaactttct

SEQ ID NO: 4401469 - DNA, 22 bp, Homo sapiens
tgtcataaagtgagaaaactgt

SEQ ID NO: 4401470 - DNA, 20 bp, Homo sapiens
tgtcatagtcttgaaatgaa

SEQ ID NO: 4401471 - DNA, 19 bp, Homo sapiens
tgtcatcctcaaagaaagt

SEQ ID NO: 4401472 - DNA, 20 bp, Homo sapiens
tgtcatcctcaaagaaagtg

SEQ ID NO: 4401473 - DNA, 22 bp, Homo sapiens
tgtcatcctcaaagaaagtgta

SEQ ID NO: 4401474 - DNA, 14 bp, Homo sapiens
tgtcatctctctgg

SEQ ID NO: 4401475 - DNA, 16 bp, Homo sapiens
tgtcatctctctgggg

SEQ ID NO: 4401476 - DNA, 14 bp, Homo sapiens
tgtcatcttttcaa

SEQ ID NO: 4401477 - DNA, 20 bp, Homo sapiens
tgtcatggtcctttctggaa

SEQ ID NO: 4401478 - DNA, 21 bp, Homo sapiens
tgtcatgtactgacaactgtt

SEQ ID NO: 4401479 - DNA, 17 bp, Homo sapiens
tcagccttaagaaccat

SEQ ID NO: 4401480 - DNA, 16 bp, Homo sapiens
tcagccttcctcctca

SEQ ID NO: 4401481 - DNA, 13 bp, Homo sapiens
tcagcgctctgta

SEQ ID NO: 4401482 - DNA, 14 bp, Homo sapiens
tcagcggagctgac

SEQ ID NO: 4401483 - DNA, 15 bp, Homo sapiens
tcagcggagctgact

SEQ ID NO: 4401484 - DNA, 15 bp, Homo sapiens
tcagctaatgtcaca

SEQ ID NO: 4401485 - DNA, 22 bp, Homo sapiens
tcagctagttggggagctaagg

SEQ ID NO: 4401486 - DNA, 17 bp, Homo sapiens
tcagctcccctcggaga

SEQ ID NO: 4401487 - DNA, 15 bp, Homo sapiens
tcagctccttcctgg

SEQ ID NO: 4401488 - DNA, 16 bp, Homo sapiens
tcagctccttcctgga

SEQ ID NO: 4401489 - DNA, 18 bp, Homo sapiens
tcagctctctgggacctc

SEQ ID NO: 4401490 - DNA, 13 bp, Homo sapiens
tcagctctggggc

SEQ ID NO: 4401491 - DNA, 20 bp, Homo sapiens
tcagctgcaaggtactctgg

SEQ ID NO: 4401492 - DNA, 21 bp, Homo sapiens
tcagctgcaatccatttattt

SEQ ID NO: 4401493 - DNA, 12 bp, Homo sapiens
tcagctgcctca

SEQ ID NO: 4401494 - DNA, 21 bp, Homo sapiens
tcagctgcctcctgcgccctg

SEQ ID NO: 4401495 - DNA, 16 bp, Homo sapiens
tcagctgctgaaacaa

SEQ ID NO: 4401496 - DNA, 16 bp, Homo sapiens
tcagctgctggatgac

SEQ ID NO: 4401497 - DNA, 15 bp, Homo sapiens
tcagcttcctaccca

SEQ ID NO: 4401498 - DNA, 19 bp, Homo sapiens
tcagcttcgtttattttca

SEQ ID NO: 4401499 - DNA, 21 bp, Homo sapiens
tcagcttcgtttattttcaag

SEQ ID NO: 4401500 - DNA, 12 bp, Homo sapiens
tcagcttctccc

SEQ ID NO: 4401501 - DNA, 21 bp, Homo sapiens
tcagcttgcttagatgttcca

SEQ ID NO: 4401502 - DNA, 18 bp, Homo sapiens
tcagcttttgttctagac

SEQ ID NO: 4401503 - DNA, 19 bp, Homo sapiens
tcaggaaaaggttgaataa

SEQ ID NO: 4401504 - DNA, 18 bp, Homo sapiens
tcaggaaaattgaatgca

SEQ ID NO: 4401505 - DNA, 12 bp, Homo sapiens
tcaggaaagaat

SEQ ID NO: 4401506 - DNA, 14 bp, Homo sapiens
tcaggaaagaatag

SEQ ID NO: 4401507 - DNA, 22 bp, Homo sapiens
tcaggaaaggaatcatttctat

SEQ ID NO: 4401508 - DNA, 22 bp, Homo sapiens
tcaggaaatcaaatatgcaaag

SEQ ID NO: 4401509 - DNA, 16 bp, Homo sapiens
tcaggaattcttggag

SEQ ID NO: 4401510 - DNA, 20 bp, Homo sapiens
tcaggacagcatcccttccc

SEQ ID NO: 4401511 - DNA, 15 bp, Homo sapiens
tcaggacccagagga

SEQ ID NO: 4401512 - DNA, 19 bp, Homo sapiens
tcaggacccagaggaaggg

SEQ ID NO: 4401513 - DNA, 17 bp, Homo sapiens
tcaggacggctcctcag

SEQ ID NO: 4401514 - DNA, 22 bp, Homo sapiens
tcaggacggctcctcagagcgc

SEQ ID NO: 4401515 - DNA, 21 bp, Homo sapiens
tcaggactctgcgggaggctg

SEQ ID NO: 4401516 - DNA, 21 bp, Homo sapiens
tcaggagcttgggcagtgccc

SEQ ID NO: 4401517 - DNA, 17 bp, Homo sapiens
tcaggaggcgaataaat

SEQ ID NO: 4401518 - DNA, 20 bp, Homo sapiens
tcaggaggcgaataaatgtt

SEQ ID NO: 4401519 - DNA, 18 bp, Homo sapiens
tcaggaggctgaggcaga

SEQ ID NO: 4401520 - DNA, 15 bp, Homo sapiens
tcaggagtctgccac

SEQ ID NO: 4401521 - DNA, 21 bp, Homo sapiens
tcaggagttcaagaccagcct

SEQ ID NO: 4401522 - DNA, 14 bp, Homo sapiens
tcaggagtttgaga

SEQ ID NO: 4401523 - DNA, 23 bp, Homo sapiens
tcaggagtttgagaccaggctgg

SEQ ID NO: 4401524 - DNA, 22 bp, Homo sapiens
tcaggatatggcttaggaatga

SEQ ID NO: 4401525 - DNA, 15 bp, Homo sapiens
tcaggatccagtctg

SEQ ID NO: 4401526 - DNA, 21 bp, Homo sapiens
tcaggatgtaggggttaactt

SEQ ID NO: 4401527 - DNA, 16 bp, Homo sapiens
tcaggccagcccagcc

SEQ ID NO: 4401528 - DNA, 19 bp, Homo sapiens
tcaggccagcccagccagg

SEQ ID NO: 4401529 - DNA, 15 bp, Homo sapiens
tcaggcccaggagtc

SEQ ID NO: 4401530 - DNA, 19 bp, Homo sapiens
tcaggcccaggagtccagg

SEQ ID NO: 4401531 - DNA, 22 bp, Homo sapiens
tcaggccccgccccatgggccc

SEQ ID NO: 4401532 - DNA, 16 bp, Homo sapiens
tcaggcccggcagggc

SEQ ID NO: 4401533 - DNA, 21 bp, Homo sapiens
tcaggcccggcagggcgggca

SEQ ID NO: 4401534 - DNA, 16 bp, Homo sapiens
tcaggccctgactcct

SEQ ID NO: 4401535 - DNA, 19 bp, Homo sapiens
tcaggccctgactcctctg

SEQ ID NO: 4401536 - DNA, 22 bp, Homo sapiens
tcaggccctgactcctctggct

SEQ ID NO: 4401537 - DNA, 15 bp, Homo sapiens
tcaggccgagagcct

SEQ ID NO: 4401538 - DNA, 17 bp, Homo sapiens
tcaggcctccctctctc

SEQ ID NO: 4401539 - DNA, 14 bp, Homo sapiens
tcaggcctggcctc

SEQ ID NO: 4401540 - DNA, 16 bp, Homo sapiens
tcaggcggagctgctg

SEQ ID NO: 4401541 - DNA, 22 bp, Homo sapiens
tcaggctatcatatatactgta

SEQ ID NO: 4401542 - DNA, 12 bp, Homo sapiens
tcaggctcaacc

SEQ ID NO: 4401543 - DNA, 15 bp, Homo sapiens
tcaggctcaagtttt

SEQ ID NO: 4401544 - DNA, 16 bp, Homo sapiens
tcaggctcaagttttt

SEQ ID NO: 4401545 - DNA, 11 bp, Homo sapiens
tcaggctccta

SEQ ID NO: 4401546 - DNA, 17 bp, Homo sapiens
tcaggctgcagaggcac

SEQ ID NO: 4401547 - DNA, 13 bp, Homo sapiens
tcaggctgctggc

SEQ ID NO: 4401548 - DNA, 18 bp, Homo sapiens
tcagggacagagacacct

SEQ ID NO: 4401549 - DNA, 22 bp, Homo sapiens
tcagggaccggtgctgcaggag

SEQ ID NO: 4401550 - DNA, 13 bp, Homo sapiens
tcagggagcctcc

SEQ ID NO: 4401551 - DNA, 19 bp, Homo sapiens
tcagggcggcctcccaggt

SEQ ID NO: 4401552 - DNA, 20 bp, Homo sapiens
tcagggcggcctcccaggtc

SEQ ID NO: 4401553 - DNA, 21 bp, Homo sapiens
tcagggcggcctcccaggtcc

SEQ ID NO: 4401554 - DNA, 14 bp, Homo sapiens
tcagggctcccagg

SEQ ID NO: 4401555 - DNA, 14 bp, Homo sapiens
tcagggctgtccca

SEQ ID NO: 4401556 - DNA, 16 bp, Homo sapiens
tcaggggactcagccc

SEQ ID NO: 4401557 - DNA, 13 bp, Homo sapiens
tcaggggctccat

SEQ ID NO: 4401558 - DNA, 15 bp, Homo sapiens
tcaggggctccatgc

SEQ ID NO: 4401559 - DNA, 19 bp, Homo sapiens
tcagggtgggaagaaagaa

SEQ ID NO: 4401560 - DNA, 15 bp, Homo sapiens
tcaggtaatacaaac

SEQ ID NO: 4401561 - DNA, 18 bp, Homo sapiens
tcaggtaatcattttaat

SEQ ID NO: 4401562 - DNA, 18 bp, Homo sapiens
tcaggtgaggcatcttta

SEQ ID NO: 4401563 - DNA, 13 bp, Homo sapiens
tcaggttccagaa

SEQ ID NO: 4401564 - DNA, 15 bp, Homo sapiens
tcagtaaagtacctt

SEQ ID NO: 4401565 - DNA, 16 bp, Homo sapiens
tcagtaagctgtgtgg

SEQ ID NO: 4401566 - DNA, 18 bp, Homo sapiens
tcagtaatttagaaatca

SEQ ID NO: 4401567 - DNA, 23 bp, Homo sapiens
tcagtacttttttaaatattttc

SEQ ID NO: 4401568 - DNA, 13 bp, Homo sapiens
tcagtagaaagct

SEQ ID NO: 4401569 - DNA, 20 bp, Homo sapiens
tcagtagccatatcttccaa

SEQ ID NO: 4401570 - DNA, 20 bp, Homo sapiens
tcagtagtcacaaactgatc

SEQ ID NO: 4401571 - DNA, 17 bp, Homo sapiens
tcagtatattttctgta

SEQ ID NO: 4401572 - DNA, 18 bp, Homo sapiens
tcagtatattttctgtat

SEQ ID NO: 4401573 - DNA, 13 bp, Homo sapiens
tcagtatccaggc

SEQ ID NO: 4401574 - DNA, 14 bp, Homo sapiens
tcagtattctgaca

SEQ ID NO: 4401575 - DNA, 15 bp, Homo sapiens
tcagtattctgacat

SEQ ID NO: 4401576 - DNA, 13 bp, Homo sapiens
tcagtcattaaat

SEQ ID NO: 4401577 - DNA, 15 bp, Homo sapiens
tcagtcattttgggt

SEQ ID NO: 4401578 - DNA, 14 bp, Homo sapiens
tcagtctaaggtct

SEQ ID NO: 4401579 - DNA, 18 bp, Homo sapiens
tcagtctcagaatgtcat

SEQ ID NO: 4401580 - DNA, 13 bp, Homo sapiens
tcagtctctgagc

SEQ ID NO: 4401581 - DNA, 17 bp, Homo sapiens
tcagtctctgagcagtg

SEQ ID NO: 4401582 - DNA, 20 bp, Homo sapiens
tcagtctctgagcagtgaat

SEQ ID NO: 4401583 - DNA, 15 bp, Homo sapiens
tcagtctgctttctc

SEQ ID NO: 4401584 - DNA, 17 bp, Homo sapiens
tcagtctgctttctcta

SEQ ID NO: 4401585 - DNA, 16 bp, Homo sapiens
tcagtctggtgggagg

SEQ ID NO: 4401586 - DNA, 20 bp, Homo sapiens
tcagtgaagtctagaatcat

SEQ ID NO: 4401587 - DNA, 16 bp, Homo sapiens
tcagtgagcccctccc

SEQ ID NO: 4401588 - DNA, 18 bp, Homo sapiens
tcagtgagcccctcccca

SEQ ID NO: 4401589 - DNA, 21 bp, Homo sapiens
tcagtgagcctcctgtgcctg

SEQ ID NO: 4401590 - DNA, 14 bp, Homo sapiens
tcagtgatcttcac

SEQ ID NO: 4401591 - DNA, 17 bp, Homo sapiens
tcagtgcagcagaggac

SEQ ID NO: 4401592 - DNA, 14 bp, Homo sapiens
tcagtgcatttgtg

SEQ ID NO: 4401593 - DNA, 22 bp, Homo sapiens
tcagtgcccaccaacatcccat

SEQ ID NO: 4401594 - DNA, 12 bp, Homo sapiens
tcagtgctccct

SEQ ID NO: 4401595 - DNA, 13 bp, Homo sapiens
tcagtgcttgggc

SEQ ID NO: 4401596 - DNA, 16 bp, Homo sapiens
tcagtgcttgggctcc

SEQ ID NO: 4401597 - DNA, 19 bp, Homo sapiens
tcagtgcttgggctccacg

SEQ ID NO: 4401598 - DNA, 19 bp, Homo sapiens
tggtgctgccgagggctgg

SEQ ID NO: 4401599 - DNA, 22 bp, Homo sapiens
tggtgctgccgagggctggccg

SEQ ID NO: 4401600 - DNA, 23 bp, Homo sapiens
tggtgctgtcttttgttctctga

SEQ ID NO: 4401601 - DNA, 21 bp, Homo sapiens
tggtgctgtttaaagtcacat

SEQ ID NO: 4401602 - DNA, 23 bp, Homo sapiens
tggtgcttctcagatttctgagg

SEQ ID NO: 4401603 - DNA, 20 bp, Homo sapiens
tggtggaggaagggctgggc

SEQ ID NO: 4401604 - DNA, 23 bp, Homo sapiens
tggtggaggaagggctgggccac

SEQ ID NO: 4401605 - DNA, 15 bp, Homo sapiens
tggtggatgtaaata

SEQ ID NO: 4401606 - DNA, 21 bp, Homo sapiens
tggtggcaccagatgcaacct

SEQ ID NO: 4401607 - DNA, 18 bp, Homo sapiens
tggtggcatcacagaccc

SEQ ID NO: 4401608 - DNA, 20 bp, Homo sapiens
tggtggcctatttcagctgc

SEQ ID NO: 4401609 - DNA, 17 bp, Homo sapiens
tggtggcgcaagcctgt

SEQ ID NO: 4401610 - DNA, 23 bp, Homo sapiens
tggtggcggcgaagaagagaaag

SEQ ID NO: 4401611 - DNA, 14 bp, Homo sapiens
tggtgggatccacg

SEQ ID NO: 4401612 - DNA, 15 bp, Homo sapiens
tggtggggggcaggg

SEQ ID NO: 4401613 - DNA, 12 bp, Homo sapiens
tggtggtgcagc

SEQ ID NO: 4401614 - DNA, 17 bp, Homo sapiens
tggtggtttacgcctat

SEQ ID NO: 4401615 - DNA, 23 bp, Homo sapiens
tggtgtagtgtgtcagctctgtt

SEQ ID NO: 4401616 - DNA, 21 bp, Homo sapiens
tggtgtatatggtccactggt

SEQ ID NO: 4401617 - DNA, 18 bp, Homo sapiens
tggtgtcagtatccaggc

SEQ ID NO: 4401618 - DNA, 13 bp, Homo sapiens
tggtgtccacctg

SEQ ID NO: 4401619 - DNA, 14 bp, Homo sapiens
tggtgtccacctgg

SEQ ID NO: 4401620 - DNA, 18 bp, Homo sapiens
tggtgtccacctggcccc

SEQ ID NO: 4401621 - DNA, 13 bp, Homo sapiens
tggtgtccccttc

SEQ ID NO: 4401622 - DNA, 21 bp, Homo sapiens
tggtgtccccttcccctgctg

SEQ ID NO: 4401623 - DNA, 22 bp, Homo sapiens
tggtgtccccttcccctgctga

SEQ ID NO: 4401624 - DNA, 23 bp, Homo sapiens
tggtgtccccttcccctgctgac

SEQ ID NO: 4401625 - DNA, 23 bp, Homo sapiens
tggtgtcctgaggcctccaagga

SEQ ID NO: 4401626 - DNA, 23 bp, Homo sapiens
tggtgtgaccactgcagaagaca

SEQ ID NO: 4401627 - DNA, 17 bp, Homo sapiens
tggtgtgacctgagggc

SEQ ID NO: 4401628 - DNA, 21 bp, Homo sapiens
tggtgttacacagcccaagag

SEQ ID NO: 4401629 - DNA, 20 bp, Homo sapiens
tggtgttagggggatgagca

SEQ ID NO: 4401630 - DNA, 20 bp, Homo sapiens
tggtgttcgtttccatcatg

SEQ ID NO: 4401631 - DNA, 13 bp, Homo sapiens
tggtgtttgactg

SEQ ID NO: 4401632 - DNA, 17 bp, Homo sapiens
tggtgtttgactgtaat

SEQ ID NO: 4401633 - DNA, 15 bp, Homo sapiens
tggtgtttgtctgtg

SEQ ID NO: 4401634 - DNA, 13 bp, Homo sapiens
tggtgttttgtca

SEQ ID NO: 4401635 - DNA, 15 bp, Homo sapiens
tggttaaaatgtgat

SEQ ID NO: 4401636 - DNA, 18 bp, Homo sapiens
tggttaaaatgtgatttt

SEQ ID NO: 4401637 - DNA, 21 bp, Homo sapiens
tggttaacagagctaagaaat

SEQ ID NO: 4401638 - DNA, 21 bp, Homo sapiens
tggttaagttggcttctgttt

SEQ ID NO: 4401639 - DNA, 13 bp, Homo sapiens
tggttacactgtt

SEQ ID NO: 4401640 - DNA, 13 bp, Homo sapiens
tggttactttcaa

SEQ ID NO: 4401641 - DNA, 17 bp, Homo sapiens
tggttagtatttaacta

SEQ ID NO: 4401642 - DNA, 15 bp, Homo sapiens
tggttatagccctgc

SEQ ID NO: 4401643 - DNA, 13 bp, Homo sapiens
tggttatttttct

SEQ ID NO: 4401644 - DNA, 21 bp, Homo sapiens
tggttatttttctcttgtacc

SEQ ID NO: 4401645 - DNA, 23 bp, Homo sapiens
tggttatttttctcttgtaccat

SEQ ID NO: 4401646 - DNA, 19 bp, Homo sapiens
tggttccagatacttcagc

SEQ ID NO: 4401647 - DNA, 13 bp, Homo sapiens
tggttctcatctt

SEQ ID NO: 4401648 - DNA, 15 bp, Homo sapiens
tggttctcatctttc

SEQ ID NO: 4401649 - DNA, 17 bp, Homo sapiens
tggttctggctgtttga

SEQ ID NO: 4401650 - DNA, 12 bp, Homo sapiens
tggttctgtgac

SEQ ID NO: 4401651 - DNA, 13 bp, Homo sapiens
tggttctgtgacc

SEQ ID NO: 4401652 - DNA, 23 bp, Homo sapiens
tggttgaactctggtggcacagg

SEQ ID NO: 4401653 - DNA, 23 bp, Homo sapiens
tggttgacccaaaaatgttccct

SEQ ID NO: 4401654 - DNA, 12 bp, Homo sapiens
tggttgaggaaa

SEQ ID NO: 4401655 - DNA, 18 bp, Homo sapiens
tggttgatgccaaaaaaa

SEQ ID NO: 4401656 - DNA, 17 bp, Homo sapiens
tggttgcctcccccgcc

SEQ ID NO: 4401657 - DNA, 19 bp, Homo sapiens
tggttgggtggcaattcca

SEQ ID NO: 4401658 - DNA, 24 bp, Homo sapiens
tggttggttttgacttcagattga

SEQ ID NO: 4401659 - DNA, 15 bp, Homo sapiens
tggtttaaagaaagt

SEQ ID NO: 4401660 - DNA, 14 bp, Homo sapiens
tggtttagtctttt

SEQ ID NO: 4401661 - DNA, 19 bp, Homo sapiens
tggtttatcagcaaaaaag

SEQ ID NO: 4401662 - DNA, 15 bp, Homo sapiens
tggtttcaagaatat

SEQ ID NO: 4401663 - DNA, 12 bp, Homo sapiens
tggtttcatgtt

SEQ ID NO: 4401664 - DNA, 15 bp, Homo sapiens
tggtttcatgttagt

SEQ ID NO: 4401665 - DNA, 15 bp, Homo sapiens
tggtttccaaagaat

SEQ ID NO: 4401666 - DNA, 14 bp, Homo sapiens
tggtttccaatgtg

SEQ ID NO: 4401667 - DNA, 16 bp, Homo sapiens
tggtttccaatgtgtt

SEQ ID NO: 4401668 - DNA, 13 bp, Homo sapiens
tggtttcccaaga

SEQ ID NO: 4401669 - DNA, 17 bp, Homo sapiens
tggtttctcatgagctg

SEQ ID NO: 4401670 - DNA, 15 bp, Homo sapiens
tggtttctcctggta

SEQ ID NO: 4401671 - DNA, 13 bp, Homo sapiens
tggtttgagattg

SEQ ID NO: 4401672 - DNA, 17 bp, Homo sapiens
tggtttggaatattaaa

SEQ ID NO: 4401673 - DNA, 23 bp, Homo sapiens
tggtttgtgaatccatcttgctt

SEQ ID NO: 4401674 - DNA, 13 bp, Homo sapiens
tggttttacacag

SEQ ID NO: 4401675 - DNA, 17 bp, Homo sapiens
tggttttacacagagaa

SEQ ID NO: 4401676 - DNA, 17 bp, Homo sapiens
tggttttattacaaatg

SEQ ID NO: 4401677 - DNA, 13 bp, Homo sapiens
tggttttccatga

SEQ ID NO: 4401678 - DNA, 19 bp, Homo sapiens
tggttttctccaagagcta

SEQ ID NO: 4401679 - DNA, 20 bp, Homo sapiens
tggttttctccaagagctac

SEQ ID NO: 4401680 - DNA, 13 bp, Homo sapiens
tggttttctgcca

SEQ ID NO: 4401681 - DNA, 18 bp, Homo sapiens
tggttttctgccaatgac

SEQ ID NO: 4401682 - DNA, 12 bp, Homo sapiens
tggttttgaaat

SEQ ID NO: 4401683 - DNA, 16 bp, Homo sapiens
tggttttgttcccctc

SEQ ID NO: 4401684 - DNA, 15 bp, Homo sapiens
tggtttttaaatttt

SEQ ID NO: 4401685 - DNA, 21 bp, Homo sapiens
tggtttttcctcattgagaat

SEQ ID NO: 4401686 - DNA, 12 bp, Homo sapiens
tgtaaaaaagaa

SEQ ID NO: 4401687 - DNA, 18 bp, Homo sapiens
tgtaaaaaagaaaaaact

SEQ ID NO: 4401688 - DNA, 11 bp, Homo sapiens
tgtaaaaatga

SEQ ID NO: 4401689 - DNA, 14 bp, Homo sapiens
tgtaaaaatgcttc

SEQ ID NO: 4401690 - DNA, 22 bp, Homo sapiens
tgtaaaacaggtagaattatct

SEQ ID NO: 4401691 - DNA, 12 bp, Homo sapiens
tgtaaaacttta

SEQ ID NO: 4401692 - DNA, 12 bp, Homo sapiens
tgtaaaagaaat

SEQ ID NO: 4401693 - DNA, 16 bp, Homo sapiens
tgtaaaagtgtacaga

SEQ ID NO: 4401694 - DNA, 19 bp, Homo sapiens
tgtaaaagtgtacagactc

SEQ ID NO: 4401695 - DNA, 20 bp, Homo sapiens
tgtaaaagtgtacagactct

SEQ ID NO: 4401696 - DNA, 21 bp, Homo sapiens
tgtaaaatattttgaatcaat

SEQ ID NO: 4401697 - DNA, 22 bp, Homo sapiens
tgtaaaatgaattgaaaaacaa

SEQ ID NO: 4401698 - DNA, 20 bp, Homo sapiens
tgtaaaatgcacccatcagt

SEQ ID NO: 4401699 - DNA, 12 bp, Homo sapiens
tgtaaaatggtg

SEQ ID NO: 4401700 - DNA, 11 bp, Homo sapiens
tgtaaaattaa

SEQ ID NO: 4401701 - DNA, 14 bp, Homo sapiens
tgtaaaattaatgt

SEQ ID NO: 4401702 - DNA, 21 bp, Homo sapiens
tgtaaaattaatgtaataaag

SEQ ID NO: 4401703 - DNA, 19 bp, Homo sapiens
tgtaaacctgagtcgtaca

SEQ ID NO: 4401704 - DNA, 18 bp, Homo sapiens
tgtaaactgtactagtct

SEQ ID NO: 4401705 - DNA, 23 bp, Homo sapiens
tgtaaactgtactagtctgtgtg

SEQ ID NO: 4401706 - DNA, 15 bp, Homo sapiens
tgtaaactgtgcacc

SEQ ID NO: 4401707 - DNA, 18 bp, Homo sapiens
tgtaaactgtgtattcca

SEQ ID NO: 4401708 - DNA, 22 bp, Homo sapiens
tgtaaagactgagcagaactga

SEQ ID NO: 4401709 - DNA, 19 bp, Homo sapiens
tgtaaaggagtcaaaacta

SEQ ID NO: 4401710 - DNA, 12 bp, Homo sapiens
tgtaaagtattt

SEQ ID NO: 4401711 - DNA, 22 bp, Homo sapiens
tgtaaagtatttgatgtacatt

SEQ ID NO: 4401712 - DNA, 20 bp, Homo sapiens
tgtaaagtgtgtgattgaag

SEQ ID NO: 4401713 - DNA, 19 bp, Homo sapiens
tgtaaagttggttggataa

SEQ ID NO: 4401714 - DNA, 23 bp, Homo sapiens
tgtaaataaccccattctttgct

SEQ ID NO: 4401715 - DNA, 18 bp, Homo sapiens
tgtaaataggatttttag

SEQ ID NO: 4401716 - DNA, 13 bp, Homo sapiens
tgtaaatatccct

SEQ ID NO: 4401717 - DNA, 16 bp, Homo sapiens
tgtaaatatccctccc

SEQ ID NO: 4401718 - DNA, 19 bp, Homo sapiens
tgtaaatatccctcccctc

SEQ ID NO: 4401719 - DNA, 20 bp, Homo sapiens
tgtaaatattttaaagaatt

SEQ ID NO: 4401720 - DNA, 22 bp, Homo sapiens
tgtaaatattttaaagaattgt

SEQ ID NO: 4401721 - DNA, 21 bp, Homo sapiens
tgtaaatcatgttgatcatgt

SEQ ID NO: 4401722 - DNA, 13 bp, Homo sapiens
tgtaaatcctgtg

SEQ ID NO: 4401723 - DNA, 13 bp, Homo sapiens
tgtaaatccttgt

SEQ ID NO: 4401724 - DNA, 22 bp, Homo sapiens
tgtaaatctttttgcttctact

SEQ ID NO: 4401725 - DNA, 18 bp, Homo sapiens
tgtaaatgcctcttaaat

SEQ ID NO: 4401726 - DNA, 22 bp, Homo sapiens
tgtaaatgtgttagcactgata

SEQ ID NO: 4401727 - DNA, 15 bp, Homo sapiens
tgtaaattatatttg

SEQ ID NO: 4401728 - DNA, 18 bp, Homo sapiens
tgtaaattattttaaatt

SEQ ID NO: 4401729 - DNA, 22 bp, Homo sapiens
tgtaaattgactgtactaggcc

SEQ ID NO: 4401730 - DNA, 20 bp, Homo sapiens
tgtaaattgcagaattcaaa

SEQ ID NO: 4401731 - DNA, 16 bp, Homo sapiens
tgtaaatttatgtgat

SEQ ID NO: 4401732 - DNA, 17 bp, Homo sapiens
tgtaaatttatgtgatg

SEQ ID NO: 4401733 - DNA, 21 bp, Homo sapiens
tgtaacaagttccattatgaa

SEQ ID NO: 4401734 - DNA, 22 bp, Homo sapiens
tgtaacaagttccattatgaaa

SEQ ID NO: 4401735 - DNA, 16 bp, Homo sapiens
tgtaacacaggataaa

SEQ ID NO: 4401736 - DNA, 11 bp, Homo sapiens
tgtaacatgta

SEQ ID NO: 4401737 - DNA, 18 bp, Homo sapiens
tgtaactactttataact

SEQ ID NO: 4401738 - DNA, 13 bp, Homo sapiens
tgtaactccacca

SEQ ID NO: 4401739 - DNA, 21 bp, Homo sapiens
tgtaactgaggactgtttgca

SEQ ID NO: 4401740 - DNA, 18 bp, Homo sapiens
tgtaactgttacagtaat

SEQ ID NO: 4401741 - DNA, 13 bp, Homo sapiens
tgtaacttcaaat

SEQ ID NO: 4401742 - DNA, 16 bp, Homo sapiens
tgtaacttgcttaaat

SEQ ID NO: 4401743 - DNA, 18 bp, Homo sapiens
tgtaactttcataccact

SEQ ID NO: 4401744 - DNA, 20 bp, Homo sapiens
tgtaagaacacattttaaat

SEQ ID NO: 4401745 - DNA, 13 bp, Homo sapiens
tgtaagaactgta

SEQ ID NO: 4401746 - DNA, 14 bp, Homo sapiens
tgtaagaaggcaat

SEQ ID NO: 4401747 - DNA, 17 bp, Homo sapiens
tgtaagcactctggatg

SEQ ID NO: 4401748 - DNA, 20 bp, Homo sapiens
tgtaagccaaagaaatgaac

SEQ ID NO: 4401749 - DNA, 12 bp, Homo sapiens
tgtaaggggaag

SEQ ID NO: 4401750 - DNA, 17 bp, Homo sapiens
tgtaaggtgcttgctcc

SEQ ID NO: 4401751 - DNA, 11 bp, Homo sapiens
tgtaataaagt

SEQ ID NO: 4401752 - DNA, 13 bp, Homo sapiens
tgtaataaagtga

SEQ ID NO: 4401753 - DNA, 14 bp, Homo sapiens
tgtaataaagtgaa

SEQ ID NO: 4401754 - DNA, 16 bp, Homo sapiens
tgtaataaagtgtttt

SEQ ID NO: 4401755 - DNA, 17 bp, Homo sapiens
tgtaataaagtgttttc

SEQ ID NO: 4401756 - DNA, 18 bp, Homo sapiens
tgtaataatcattttaga

SEQ ID NO: 4401757 - DNA, 14 bp, Homo sapiens
tgtaataatgtaca

SEQ ID NO: 4401758 - DNA, 15 bp, Homo sapiens
tgtaataatgtacag

SEQ ID NO: 4401759 - DNA, 14 bp, Homo sapiens
tgtaatacttcttt

SEQ ID NO: 4401760 - DNA, 23 bp, Homo sapiens
tgtaatacttctttgttattata

SEQ ID NO: 4401761 - DNA, 18 bp, Homo sapiens
tgtaatagatgtttgata

SEQ ID NO: 4401762 - DNA, 23 bp, Homo sapiens
tgtaatagttctatccttttgcc

SEQ ID NO: 4401763 - DNA, 19 bp, Homo sapiens
tgtaatatttacaatgtat

SEQ ID NO: 4401764 - DNA, 21 bp, Homo sapiens
tgtaatatttacaatgtatta

SEQ ID NO: 4401765 - DNA, 17 bp, Homo sapiens
tgtaatatttcttcaaa

SEQ ID NO: 4401766 - DNA, 20 bp, Homo sapiens
tgtaatcaaaaggaggaatt

SEQ ID NO: 4401767 - DNA, 14 bp, Homo sapiens
tgtaatcacagcta

SEQ ID NO: 4401768 - DNA, 23 bp, Homo sapiens
tgtaatcattatctcactttgta

SEQ ID NO: 4401769 - DNA, 19 bp, Homo sapiens
tgtaatcatttgtttacat

SEQ ID NO: 4401770 - DNA, 15 bp, Homo sapiens
tgtaatcccagcact

SEQ ID NO: 4401771 - DNA, 20 bp, Homo sapiens
tgtaatcccagctactcagg

SEQ ID NO: 4401772 - DNA, 21 bp, Homo sapiens
tgtaatcccagctactcagga

SEQ ID NO: 4401773 - DNA, 21 bp, Homo sapiens
tgtaatctaagtatatgtgag

SEQ ID NO: 4401774 - DNA, 20 bp, Homo sapiens
tgtaatcttatttaggaagt

SEQ ID NO: 4401775 - DNA, 14 bp, Homo sapiens
tgtaatcttcccca

SEQ ID NO: 4401776 - DNA, 19 bp, Homo sapiens
tgtaatcttgttgataaaa

SEQ ID NO: 4401777 - DNA, 13 bp, Homo sapiens
tgtaatgtcacca

SEQ ID NO: 4401778 - DNA, 16 bp, Homo sapiens
tgtaatgtcaccacct

SEQ ID NO: 4401779 - DNA, 13 bp, Homo sapiens
tgtaatgttttct

SEQ ID NO: 4401780 - DNA, 18 bp, Homo sapiens
tgtaatgttttctttgca

SEQ ID NO: 4401781 - DNA, 21 bp, Homo sapiens
tgtaatgttttctttgcaaag

SEQ ID NO: 4401782 - DNA, 16 bp, Homo sapiens
tgtaattaaaagcaaa

SEQ ID NO: 4401783 - DNA, 15 bp, Homo sapiens
tgtaattaaactagt

SEQ ID NO: 4401784 - DNA, 23 bp, Homo sapiens
tgtaattagtgccacttaatgta

SEQ ID NO: 4401785 - DNA, 17 bp, Homo sapiens
tgtaattgtaattccaa

SEQ ID NO: 4401786 - DNA, 17 bp, Homo sapiens
tgtaatttaaaattgtg

SEQ ID NO: 4401787 - DNA, 19 bp, Homo sapiens
tgtaatttcagctagttaa

SEQ ID NO: 4401788 - DNA, 21 bp, Homo sapiens
tgtaatttcgccttaaactct

SEQ ID NO: 4401789 - DNA, 22 bp, Homo sapiens
tgtaatttcgccttaaactctg

SEQ ID NO: 4401790 - DNA, 18 bp, Homo sapiens
tgtaatttctttaaatgt

SEQ ID NO: 4401791 - DNA, 15 bp, Homo sapiens
tgtaatttgtgtaat

SEQ ID NO: 4401792 - DNA, 13 bp, Homo sapiens
tgtacaaacatgt

SEQ ID NO: 4401793 - DNA, 15 bp, Homo sapiens
tgtacaaccctgacc

SEQ ID NO: 4401794 - DNA, 18 bp, Homo sapiens
tgtacaaccctgaccgtg

SEQ ID NO: 4401795 - DNA, 13 bp, Homo sapiens
tgtacaacttttt

SEQ ID NO: 4401796 - DNA, 18 bp, Homo sapiens
tgtacaactttttaaata

SEQ ID NO: 4401797 - DNA, 16 bp, Homo sapiens
tgtacaagatgaagga

SEQ ID NO: 4401798 - DNA, 12 bp, Homo sapiens
tgtacaataaaa

SEQ ID NO: 4401799 - DNA, 16 bp, Homo sapiens
tgtacaattaaaaacc

SEQ ID NO: 4401800 - DNA, 15 bp, Homo sapiens
tgtacaattttaaag

SEQ ID NO: 4401801 - DNA, 18 bp, Homo sapiens
tgtacaattttaaagttc

SEQ ID NO: 4401802 - DNA, 21 bp, Homo sapiens
tgtacacagtgggaagatttt

SEQ ID NO: 4401803 - DNA, 14 bp, Homo sapiens
tgtacacatttctt

SEQ ID NO: 4401804 - DNA, 20 bp, Homo sapiens
tgtacacatttcttaaaaca

SEQ ID NO: 4401805 - DNA, 19 bp, Homo sapiens
tgtacagacatatttaact

SEQ ID NO: 4401806 - DNA, 22 bp, Homo sapiens
tgtacagacatatttaactggt

SEQ ID NO: 4401807 - DNA, 18 bp, Homo sapiens
tgtacagaggaagctgtt

SEQ ID NO: 4401808 - DNA, 18 bp, Homo sapiens
tgtacagtctgtcatgaa

SEQ ID NO: 4401809 - DNA, 12 bp, Homo sapiens
tgtacagtcttg

SEQ ID NO: 4401810 - DNA, 14 bp, Homo sapiens
tgtacagtcttgta

SEQ ID NO: 4401811 - DNA, 15 bp, Homo sapiens
tgtacagtcttgtat

SEQ ID NO: 4401812 - DNA, 21 bp, Homo sapiens
tgtacagtcttgtattaagtt

SEQ ID NO: 4401813 - DNA, 15 bp, Homo sapiens
tgtacataactgaaa

SEQ ID NO: 4401814 - DNA, 18 bp, Homo sapiens
tgtacataactgaaaatg

SEQ ID NO: 4401815 - DNA, 18 bp, Homo sapiens
tgtacataattgcatgaa

SEQ ID NO: 4401816 - DNA, 19 bp, Homo sapiens
tgtacataattgcatgaaa

SEQ ID NO: 4401817 - DNA, 20 bp, Homo sapiens
tgtacataattgcatgaaaa

SEQ ID NO: 4401818 - DNA, 22 bp, Homo sapiens
tgtacataattgcatgaaaata

SEQ ID NO: 4401819 - DNA, 22 bp, Homo sapiens
tgtacatagttatttttctctt

SEQ ID NO: 4401820 - DNA, 22 bp, Homo sapiens
tgtacatatcaaatagatattt

SEQ ID NO: 4401821 - DNA, 18 bp, Homo sapiens
tgtacatctattttggat

SEQ ID NO: 4401822 - DNA, 23 bp, Homo sapiens
tgtacatctattttggattgtat

SEQ ID NO: 4401823 - DNA, 11 bp, Homo sapiens
tgtacatgata

SEQ ID NO: 4401824 - DNA, 19 bp, Homo sapiens
tgtacatgataagacattt

SEQ ID NO: 4401825 - DNA, 23 bp, Homo sapiens
tgtacatgataagacattttgtt

SEQ ID NO: 4401826 - DNA, 14 bp, Homo sapiens
tgtacattcttcca

SEQ ID NO: 4401827 - DNA, 15 bp, Homo sapiens
tgtacattcttccat

SEQ ID NO: 4401828 - DNA, 18 bp, Homo sapiens
tgtacattcttccatcat

SEQ ID NO: 4401829 - DNA, 23 bp, Homo sapiens
tgtacattcttccatcatcactg

SEQ ID NO: 4401830 - DNA, 17 bp, Homo sapiens
tgtacattgtgagctct

SEQ ID NO: 4401831 - DNA, 20 bp, Homo sapiens
tgtacattttgtaaaatatt

SEQ ID NO: 4401832 - DNA, 20 bp, Homo sapiens
tgtacatttttcagcagcaa

SEQ ID NO: 4401833 - DNA, 13 bp, Homo sapiens
tgtaccaaaattt

SEQ ID NO: 4401834 - DNA, 20 bp, Homo sapiens
tgtaccaagtgcttcctaca

SEQ ID NO: 4401835 - DNA, 21 bp, Homo sapiens
tgtaccaagtgcttcctacaa

SEQ ID NO: 4401836 - DNA, 22 bp, Homo sapiens
tgtaccagtgaatttttgcaat

SEQ ID NO: 4401837 - DNA, 11 bp, Homo sapiens
tgtaccagtta

SEQ ID NO: 4401838 - DNA, 18 bp, Homo sapiens
tgtaccatagaaaaatgt

SEQ ID NO: 4401839 - DNA, 19 bp, Homo sapiens
tgtaccatagaaaaatgta

SEQ ID NO: 4401840 - DNA, 18 bp, Homo sapiens
tgtaccattttaaagtta

SEQ ID NO: 4401841 - DNA, 16 bp, Homo sapiens
tgtacccgagcacata

SEQ ID NO: 4401842 - DNA, 15 bp, Homo sapiens
tgtacctcactgtcc

SEQ ID NO: 4401843 - DNA, 18 bp, Homo sapiens
tgtacctgcccccaatcc

SEQ ID NO: 4401844 - DNA, 15 bp, Homo sapiens
tgtacctgtggctgt

SEQ ID NO: 4401845 - DNA, 18 bp, Homo sapiens
tgtacctgtggctgtgtg

SEQ ID NO: 4401846 - DNA, 20 bp, Homo sapiens
tgtaccttaagatattgaag

SEQ ID NO: 4401847 - DNA, 16 bp, Homo sapiens
tgtactaactagcatt

SEQ ID NO: 4401848 - DNA, 22 bp, Homo sapiens
tgtactacagctatatttgatt

SEQ ID NO: 4401849 - DNA, 21 bp, Homo sapiens
tgtactacgtgccagctctag

SEQ ID NO: 4401850 - DNA, 14 bp, Homo sapiens
tgtactatgtctga

SEQ ID NO: 4401851 - DNA, 20 bp, Homo sapiens
tgtactccagcctgggcaac

SEQ ID NO: 4401852 - DNA, 22 bp, Homo sapiens
tgtactcttctgactgccccct

SEQ ID NO: 4401853 - DNA, 14 bp, Homo sapiens
tgtactgaattttt

SEQ ID NO: 4401854 - DNA, 23 bp, Homo sapiens
tgtactgaatttttttgtaataa

SEQ ID NO: 4401855 - DNA, 17 bp, Homo sapiens
tgtactgatttcagtaa

SEQ ID NO: 4401856 - DNA, 15 bp, Homo sapiens
tgtactggttcattg

SEQ ID NO: 4401857 - DNA, 14 bp, Homo sapiens
tgtacttaaatgag

SEQ ID NO: 4401858 - DNA, 11 bp, Homo sapiens
tgtacttcctg

SEQ ID NO: 4401859 - DNA, 12 bp, Homo sapiens
tgtacttcctga

SEQ ID NO: 4401860 - DNA, 22 bp, Homo sapiens
tgtacttcttcatccatagaca

SEQ ID NO: 4401861 - DNA, 16 bp, Homo sapiens
tgtacttcttgaatat

SEQ ID NO: 4401862 - DNA, 21 bp, Homo sapiens
tgtacttgaaaaatgttttta

SEQ ID NO: 4401863 - DNA, 14 bp, Homo sapiens
tgtacttgtttgaa

SEQ ID NO: 4401864 - DNA, 19 bp, Homo sapiens
tgtactttatcatgaatgc

SEQ ID NO: 4401865 - DNA, 21 bp, Homo sapiens
tgtactttatcatgaatgctt

SEQ ID NO: 4401866 - DNA, 20 bp, Homo sapiens
tgtactttttagtaatttct

SEQ ID NO: 4401867 - DNA, 21 bp, Homo sapiens
tgtagaaaagggaactgaaca

SEQ ID NO: 4401868 - DNA, 15 bp, Homo sapiens
tgtagaataaatggt

SEQ ID NO: 4401869 - DNA, 15 bp, Homo sapiens
tgtagaatattcaga

SEQ ID NO: 4401870 - DNA, 20 bp, Homo sapiens
tgtagaatctcttcatgctt

SEQ ID NO: 4401871 - DNA, 14 bp, Homo sapiens
tgtagaattgaaaa

SEQ ID NO: 4401872 - DNA, 16 bp, Homo sapiens
tgtagactgtttcaca

SEQ ID NO: 4401873 - DNA, 16 bp, Homo sapiens
tgtagaggagaaactg

SEQ ID NO: 4401874 - DNA, 22 bp, Homo sapiens
tgtagagtaacacataacattg

SEQ ID NO: 4401875 - DNA, 15 bp, Homo sapiens
tgtagatatttgaaa

SEQ ID NO: 4401876 - DNA, 18 bp, Homo sapiens
tgtagattgattgtattg

SEQ ID NO: 4401877 - DNA, 12 bp, Homo sapiens
tgtagatttctg

SEQ ID NO: 4401878 - DNA, 18 bp, Homo sapiens
tgtagatttgaaaattgt

SEQ ID NO: 4401879 - DNA, 21 bp, Homo sapiens
tgtagcaaatttgtttaatct

SEQ ID NO: 4401880 - DNA, 16 bp, Homo sapiens
tgtagcaatggccaga

SEQ ID NO: 4401881 - DNA, 19 bp, Homo sapiens
tgtagcaatggccagagcc

SEQ ID NO: 4401882 - DNA, 20 bp, Homo sapiens
tgtagcacttacgtaaaaca

SEQ ID NO: 4401883 - DNA, 13 bp, Homo sapiens
tgtagcatataaa

SEQ ID NO: 4401884 - DNA, 18 bp, Homo sapiens
tgtagccagctgtgcact

SEQ ID NO: 4401885 - DNA, 15 bp, Homo sapiens
tgtagccttcacaca

SEQ ID NO: 4401886 - DNA, 15 bp, Homo sapiens
tgtagctaaaaataa

SEQ ID NO: 4401887 - DNA, 14 bp, Homo sapiens
tgtagctctgcctc

SEQ ID NO: 4401888 - DNA, 17 bp, Homo sapiens
tgtagcttatctgcccc

SEQ ID NO: 4401889 - DNA, 20 bp, Homo sapiens
tgtagcttatctgcccctcc

SEQ ID NO: 4401890 - DNA, 16 bp, Homo sapiens
tgtagcttcagtcatt

SEQ ID NO: 4401891 - DNA, 17 bp, Homo sapiens
tgtaggcacttttattt

SEQ ID NO: 4401892 - DNA, 23 bp, Homo sapiens
tgtaggtggtctggagctgtccg

SEQ ID NO: 4401893 - DNA, 16 bp, Homo sapiens
tgtaggtgtctgcctt

SEQ ID NO: 4401894 - DNA, 14 bp, Homo sapiens
tgtagtaacactaa

SEQ ID NO: 4401895 - DNA, 19 bp, Homo sapiens
tgtagtaatctgcattatt

SEQ ID NO: 4401896 - DNA, 14 bp, Homo sapiens
tgtagtaattgaca

SEQ ID NO: 4401897 - DNA, 13 bp, Homo sapiens
tgtagtaatttat

SEQ ID NO: 4401898 - DNA, 16 bp, Homo sapiens
tgtagtagcgtttttt

SEQ ID NO: 4401899 - DNA, 14 bp, Homo sapiens
tgtagtatggtata

SEQ ID NO: 4401900 - DNA, 18 bp, Homo sapiens
tgtagtattttttgtata

SEQ ID NO: 4401901 - DNA, 19 bp, Homo sapiens
tgtagtattttttgtataa

SEQ ID NO: 4401902 - DNA, 13 bp, Homo sapiens
tgtagtcccagct

SEQ ID NO: 4401903 - DNA, 23 bp, Homo sapiens
tgtagtcccagctacttgggagg

SEQ ID NO: 4401904 - DNA, 20 bp, Homo sapiens
tgtagtcctagctactcagg

SEQ ID NO: 4401905 - DNA, 22 bp, Homo sapiens
tgtagtgaatcacgtaaagcta

SEQ ID NO: 4401906 - DNA, 13 bp, Homo sapiens
tgtagtgagccaa

SEQ ID NO: 4401907 - DNA, 19 bp, Homo sapiens
tgtagtgcatttttaaact

SEQ ID NO: 4401908 - DNA, 20 bp, Homo sapiens
tgtagtgcatttttaaactt

SEQ ID NO: 4401909 - DNA, 22 bp, Homo sapiens
tgtagtgtattaatctctgtgt

SEQ ID NO: 4401910 - DNA, 16 bp, Homo sapiens
tgtagttgaataaaaa

SEQ ID NO: 4401911 - DNA, 14 bp, Homo sapiens
tgtagtttgaaagt

SEQ ID NO: 4401912 - DNA, 22 bp, Homo sapiens
tgtagtttgaaagttgtacatg

SEQ ID NO: 4401913 - DNA, 17 bp, Homo sapiens
tgtagttttattttatg

SEQ ID NO: 4401914 - DNA, 22 bp, Homo sapiens
tgtagttttccctgcactgtgt

SEQ ID NO: 4401915 - DNA, 14 bp, Homo sapiens
tgtagttttgtata

SEQ ID NO: 4401916 - DNA, 15 bp, Homo sapiens
tgtataaaaaagaaa

SEQ ID NO: 4401917 - DNA, 21 bp, Homo sapiens
tgtataaaaaagaaaacttgt

SEQ ID NO: 4401918 - DNA, 18 bp, Homo sapiens
tgtataaaaattatcaaa

SEQ ID NO: 4401919 - DNA, 13 bp, Homo sapiens
tgtataaaagtgt

SEQ ID NO: 4401920 - DNA, 13 bp, Homo sapiens
tgtataaagcatg

SEQ ID NO: 4401921 - DNA, 13 bp, Homo sapiens
tgtataaattact

SEQ ID NO: 4401922 - DNA, 20 bp, Homo sapiens
tgtataacattaagaaaata

SEQ ID NO: 4401923 - DNA, 14 bp, Homo sapiens
tgtataatattgaa

SEQ ID NO: 4401924 - DNA, 21 bp, Homo sapiens
tgtataatattgaaaattgaa

SEQ ID NO: 4401925 - DNA, 18 bp, Homo sapiens
tgtatacaagtactggta

SEQ ID NO: 4401926 - DNA, 13 bp, Homo sapiens
tgtatacagtgca

SEQ ID NO: 4401927 - DNA, 23 bp, Homo sapiens
tgtataccaatgtgttttctgta

SEQ ID NO: 4401928 - DNA, 21 bp, Homo sapiens
tgtataccagcctactgtact

SEQ ID NO: 4401929 - DNA, 14 bp, Homo sapiens
tgtatactatagta

SEQ ID NO: 4401930 - DNA, 15 bp, Homo sapiens
tgtatactatagtac

SEQ ID NO: 4401931 - DNA, 19 bp, Homo sapiens
tgtatactatagtaccagt

SEQ ID NO: 4401932 - DNA, 15 bp, Homo sapiens
tgtatagctgcttcc

SEQ ID NO: 4401933 - DNA, 21 bp, Homo sapiens
tgtatagtgttcacaaactgt

SEQ ID NO: 4401934 - DNA, 22 bp, Homo sapiens
tgtatagtgttcacaaactgtg

SEQ ID NO: 4401935 - DNA, 12 bp, Homo sapiens
tgtatataaaaa

SEQ ID NO: 4401936 - DNA, 16 bp, Homo sapiens
tgtatataaacatatt

SEQ ID NO: 4401937 - DNA, 12 bp, Homo sapiens
tgtatataaata

SEQ ID NO: 4401938 - DNA, 20 bp, Homo sapiens
tgtatataaatatattttct

SEQ ID NO: 4401939 - DNA, 21 bp, Homo sapiens
tgtatataatcatgctcatgt

SEQ ID NO: 4401940 - DNA, 20 bp, Homo sapiens
tgtatatatattcatataca

SEQ ID NO: 4401941 - DNA, 18 bp, Homo sapiens
tgtatatatcttataact

SEQ ID NO: 4401942 - DNA, 19 bp, Homo sapiens
tgtatatcgttatcactgt

SEQ ID NO: 4401943 - DNA, 17 bp, Homo sapiens
tgtatatctcttggaaa

SEQ ID NO: 4401944 - DNA, 19 bp, Homo sapiens
tgtatatctcttggaaaat

SEQ ID NO: 4401945 - DNA, 16 bp, Homo sapiens
tgtatatgtaaattac

SEQ ID NO: 4401946 - DNA, 12 bp, Homo sapiens
tgtatatgtatt

SEQ ID NO: 4401947 - DNA, 14 bp, Homo sapiens
tgtatatgtattta

SEQ ID NO: 4401948 - DNA, 22 bp, Homo sapiens
tgtatattgggtgtagatttct

SEQ ID NO: 4401949 - DNA, 17 bp, Homo sapiens
tgtatattgtaatttaa

SEQ ID NO: 4401950 - DNA, 20 bp, Homo sapiens
tgtatattgtgtttgtgtat

SEQ ID NO: 4401951 - DNA, 13 bp, Homo sapiens
tgtatatttgtat

SEQ ID NO: 4401952 - DNA, 18 bp, Homo sapiens
tgtatattttaatgtttt

SEQ ID NO: 4401953 - DNA, 15 bp, Homo sapiens
tgtatattttatata

SEQ ID NO: 4401954 - DNA, 17 bp, Homo sapiens
tgtatattttatataaa

SEQ ID NO: 4401955 - DNA, 19 bp, Homo sapiens
tgtatcaataaaattctgt

SEQ ID NO: 4401956 - DNA, 15 bp, Homo sapiens
tgtatcacaaatctt

SEQ ID NO: 4401957 - DNA, 19 bp, Homo sapiens
tgtatcgtaaccagccaga

SEQ ID NO: 4401958 - DNA, 21 bp, Homo sapiens
tgtatctgacccactttgtaa

SEQ ID NO: 4401959 - DNA, 18 bp, Homo sapiens
tgggacggaccagcatct

SEQ ID NO: 4401960 - DNA, 20 bp, Homo sapiens
tgggactaggacctgagcct

SEQ ID NO: 4401961 - DNA, 14 bp, Homo sapiens
tgggactgtacaca

SEQ ID NO: 4401962 - DNA, 22 bp, Homo sapiens
tgggactgtacacactttattt

SEQ ID NO: 4401963 - DNA, 16 bp, Homo sapiens
tgggacttctacccag

SEQ ID NO: 4401964 - DNA, 20 bp, Homo sapiens
tgggacttctacccagatgg

SEQ ID NO: 4401965 - DNA, 18 bp, Homo sapiens
tgggagaaggactatcaa

SEQ ID NO: 4401966 - DNA, 20 bp, Homo sapiens
tgggagaatgtcagtatgtg

SEQ ID NO: 4401967 - DNA, 22 bp, Homo sapiens
tgggagacaaaggaggaattta

SEQ ID NO: 4401968 - DNA, 17 bp, Homo sapiens
tgggagcagtccatgca

SEQ ID NO: 4401969 - DNA, 13 bp, Homo sapiens
tgggagccccagg

SEQ ID NO: 4401970 - DNA, 14 bp, Homo sapiens
tgggagccccaggg

SEQ ID NO: 4401971 - DNA, 16 bp, Homo sapiens
tgggagccccagggtc

SEQ ID NO: 4401972 - DNA, 15 bp, Homo sapiens
tgggagccgcagagc

SEQ ID NO: 4401973 - DNA, 16 bp, Homo sapiens
tgggagccgcagagcc

SEQ ID NO: 4401974 - DNA, 17 bp, Homo sapiens
tgggagccgcagagcct

SEQ ID NO: 4401975 - DNA, 18 bp, Homo sapiens
tgggagccgggtctgcct

SEQ ID NO: 4401976 - DNA, 23 bp, Homo sapiens
tgggagccgggtctgcctcttct

SEQ ID NO: 4401977 - DNA, 16 bp, Homo sapiens
tgggagcctaaggaag

SEQ ID NO: 4401978 - DNA, 12 bp, Homo sapiens
tgggagcctagc

SEQ ID NO: 4401979 - DNA, 18 bp, Homo sapiens
tgggagcctagctcctgc

SEQ ID NO: 4401980 - DNA, 13 bp, Homo sapiens
tgggagctcctct

SEQ ID NO: 4401981 - DNA, 16 bp, Homo sapiens
tgggagctcctctcct

SEQ ID NO: 4401982 - DNA, 17 bp, Homo sapiens
tgggagctcctctcctg

SEQ ID NO: 4401983 - DNA, 15 bp, Homo sapiens
tgggaggagatgaaa

SEQ ID NO: 4401984 - DNA, 14 bp, Homo sapiens
tgggaggagggcag

SEQ ID NO: 4401985 - DNA, 17 bp, Homo sapiens
tgggaggagggcaggca

SEQ ID NO: 4401986 - DNA, 12 bp, Homo sapiens
tgggaggcaggg

SEQ ID NO: 4401987 - DNA, 20 bp, Homo sapiens
tgggaggcagggctctcccg

SEQ ID NO: 4401988 - DNA, 14 bp, Homo sapiens
tgggaggccaaggc

SEQ ID NO: 4401989 - DNA, 19 bp, Homo sapiens
tgggaggctgagatgggag

SEQ ID NO: 4401990 - DNA, 15 bp, Homo sapiens
tgggaggctgaggca

SEQ ID NO: 4401991 - DNA, 12 bp, Homo sapiens
tgggagggagga

SEQ ID NO: 4401992 - DNA, 15 bp, Homo sapiens
tgggagggaggaggg

SEQ ID NO: 4401993 - DNA, 13 bp, Homo sapiens
tgggagggatcag

SEQ ID NO: 4401994 - DNA, 20 bp, Homo sapiens
tgggagggatcagccccgcc

SEQ ID NO: 4401995 - DNA, 22 bp, Homo sapiens
tgggagggggagatgggtggga

SEQ ID NO: 4401996 - DNA, 22 bp, Homo sapiens
tgggaggtggaagcagaggccc

SEQ ID NO: 4401997 - DNA, 16 bp, Homo sapiens
tgggagtaacagggca

SEQ ID NO: 4401998 - DNA, 23 bp, Homo sapiens
tgggagtcacacagtgttggagg

SEQ ID NO: 4401999 - DNA, 16 bp, Homo sapiens
tgggagtccaaggtgg

SEQ ID NO: 4402000 - DNA, 24 bp, Homo sapiens
tgggagtggggcctttgccagcag

SEQ ID NO: 4402001 - DNA, 11 bp, Homo sapiens
tgggagtgtgt

SEQ ID NO: 4402002 - DNA, 22 bp, Homo sapiens
tgggagttgatcgcctttccca

SEQ ID NO: 4402003 - DNA, 20 bp, Homo sapiens
tgggagtttttatgagaaac

SEQ ID NO: 4402004 - DNA, 20 bp, Homo sapiens
tgggataactgatttctatg

SEQ ID NO: 4402005 - DNA, 12 bp, Homo sapiens
tgggatagagaa

SEQ ID NO: 4402006 - DNA, 22 bp, Homo sapiens
tgggatatatggaggattcttt

SEQ ID NO: 4402007 - DNA, 19 bp, Homo sapiens
tgggatatggctgcccagg

SEQ ID NO: 4402008 - DNA, 14 bp, Homo sapiens
tgggatcctccctc

SEQ ID NO: 4402009 - DNA, 23 bp, Homo sapiens
tgggatgacaggcgcctgccatc

SEQ ID NO: 4402010 - DNA, 17 bp, Homo sapiens
tgggatgctgaaggaga

SEQ ID NO: 4402011 - DNA, 13 bp, Homo sapiens
tgggatggaggag

SEQ ID NO: 4402012 - DNA, 20 bp, Homo sapiens
tgggatggtcggatctcaca

SEQ ID NO: 4402013 - DNA, 17 bp, Homo sapiens
tgggatggtgactcctg

SEQ ID NO: 4402014 - DNA, 15 bp, Homo sapiens
tgggatgtcttattt

SEQ ID NO: 4402015 - DNA, 17 bp, Homo sapiens
tgggatgtgctgttttc

SEQ ID NO: 4402016 - DNA, 17 bp, Homo sapiens
tgggattaagaaacctt

SEQ ID NO: 4402017 - DNA, 23 bp, Homo sapiens
tgggattaagaaaccttgctctc

SEQ ID NO: 4402018 - DNA, 14 bp, Homo sapiens
tgggatttgctgtg

SEQ ID NO: 4402019 - DNA, 18 bp, Homo sapiens
tgggcaaaccctggtgct

SEQ ID NO: 4402020 - DNA, 15 bp, Homo sapiens
tgggcaatttagaaa

SEQ ID NO: 4402021 - DNA, 18 bp, Homo sapiens
tgggcaccacaaaatata

SEQ ID NO: 4402022 - DNA, 24 bp, Homo sapiens
tgggcactccgcgccgatgccacc

SEQ ID NO: 4402023 - DNA, 18 bp, Homo sapiens
tgggcactggggcctcag

SEQ ID NO: 4402024 - DNA, 13 bp, Homo sapiens
tgggcagcaccct

SEQ ID NO: 4402025 - DNA, 13 bp, Homo sapiens
tgggcagccagac

SEQ ID NO: 4402026 - DNA, 16 bp, Homo sapiens
tgggcagcccaacagc

SEQ ID NO: 4402027 - DNA, 19 bp, Homo sapiens
tgggcagcccaacagcact

SEQ ID NO: 4402028 - DNA, 15 bp, Homo sapiens
tgggcaggagggagg

SEQ ID NO: 4402029 - DNA, 15 bp, Homo sapiens
tgggcagtgccccag

SEQ ID NO: 4402030 - DNA, 18 bp, Homo sapiens
tgggcagtgccccaggga

SEQ ID NO: 4402031 - DNA, 18 bp, Homo sapiens
tgggcatcagaaaacagg

SEQ ID NO: 4402032 - DNA, 21 bp, Homo sapiens
tgggcatcagaaaacagggtc

SEQ ID NO: 4402033 - DNA, 17 bp, Homo sapiens
tgggcatcttctggctt

SEQ ID NO: 4402034 - DNA, 18 bp, Homo sapiens
tgggcatcttttgtatta

SEQ ID NO: 4402035 - DNA, 19 bp, Homo sapiens
tgggccacacccaggaagg

SEQ ID NO: 4402036 - DNA, 20 bp, Homo sapiens
tgggccacgccggccacacc

SEQ ID NO: 4402037 - DNA, 17 bp, Homo sapiens
tgggccatgtccaaaga

SEQ ID NO: 4402038 - DNA, 13 bp, Homo sapiens
tgggcccagggac

SEQ ID NO: 4402039 - DNA, 19 bp, Homo sapiens
tgggcccagggacaccagc

SEQ ID NO: 4402040 - DNA, 15 bp, Homo sapiens
tgggcccaggggctg

SEQ ID NO: 4402041 - DNA, 17 bp, Homo sapiens
tgggccccacatggctt

SEQ ID NO: 4402042 - DNA, 18 bp, Homo sapiens
tgggccccaccacctagg

SEQ ID NO: 4402043 - DNA, 17 bp, Homo sapiens
tgggccccagcccaccc

SEQ ID NO: 4402044 - DNA, 18 bp, Homo sapiens
tgggccccagcccaccct

SEQ ID NO: 4402045 - DNA, 16 bp, Homo sapiens
tgggcccctccctacc

SEQ ID NO: 4402046 - DNA, 16 bp, Homo sapiens
tgggccctctctgctc

SEQ ID NO: 4402047 - DNA, 11 bp, Homo sapiens
tgggccctgcc

SEQ ID NO: 4402048 - DNA, 12 bp, Homo sapiens
tgggccctgcct

SEQ ID NO: 4402049 - DNA, 22 bp, Homo sapiens
tgggccctgcctgcagccaggg

SEQ ID NO: 4402050 - DNA, 23 bp, Homo sapiens
tgggccctgcctgcagccagggc

SEQ ID NO: 4402051 - DNA, 12 bp, Homo sapiens
tgggccctgggc

SEQ ID NO: 4402052 - DNA, 18 bp, Homo sapiens
tgggccctgggctggcac

SEQ ID NO: 4402053 - DNA, 16 bp, Homo sapiens
tgggccctgtcgcccc

SEQ ID NO: 4402054 - DNA, 13 bp, Homo sapiens
tgggcctggccct

SEQ ID NO: 4402055 - DNA, 16 bp, Homo sapiens
tgggcctggccctgct

SEQ ID NO: 4402056 - DNA, 23 bp, Homo sapiens
tgggcgctcggtctccaccccag

SEQ ID NO: 4402057 - DNA, 13 bp, Homo sapiens
tgggcggctcctg

SEQ ID NO: 4402058 - DNA, 17 bp, Homo sapiens
tgggcggctcctggtgc

SEQ ID NO: 4402059 - DNA, 14 bp, Homo sapiens
tgggcggggccttg

SEQ ID NO: 4402060 - DNA, 23 bp, Homo sapiens
tgggctaaggaagtatcagcact

SEQ ID NO: 4402061 - DNA, 23 bp, Homo sapiens
tgggctaccccccctcctgctgc

SEQ ID NO: 4402062 - DNA, 22 bp, Homo sapiens
tgggctcaaatgatcctcccac

SEQ ID NO: 4402063 - DNA, 22 bp, Homo sapiens
tgggctcaagcaatcctcctgc

SEQ ID NO: 4402064 - DNA, 11 bp, Homo sapiens
tgggctccctg

SEQ ID NO: 4402065 - DNA, 15 bp, Homo sapiens
tgggctccctgactg

SEQ ID NO: 4402066 - DNA, 14 bp, Homo sapiens
tgggctctccacct

SEQ ID NO: 4402067 - DNA, 23 bp, Homo sapiens
tgggctctccacctcagccttgg

SEQ ID NO: 4402068 - DNA, 18 bp, Homo sapiens
tgggctgaatgtatgtaa

SEQ ID NO: 4402069 - DNA, 16 bp, Homo sapiens
tgggctgagggagcct

SEQ ID NO: 4402070 - DNA, 13 bp, Homo sapiens
tgggctgatgctg

SEQ ID NO: 4402071 - DNA, 15 bp, Homo sapiens
tgggctgatgctggg

SEQ ID NO: 4402072 - DNA, 19 bp, Homo sapiens
tgggctgatgctgggaccc

SEQ ID NO: 4402073 - DNA, 16 bp, Homo sapiens
tgggctgccaccagcc

SEQ ID NO: 4402074 - DNA, 16 bp, Homo sapiens
tgggctggagctcctc

SEQ ID NO: 4402075 - DNA, 19 bp, Homo sapiens
tgggctggcgcttggatct

SEQ ID NO: 4402076 - DNA, 19 bp, Homo sapiens
tgggctgggtgctgggaag

SEQ ID NO: 4402077 - DNA, 12 bp, Homo sapiens
tgggctgtctgt

SEQ ID NO: 4402078 - DNA, 19 bp, Homo sapiens
tgggctgtctgtcaccagc

SEQ ID NO: 4402079 - DNA, 14 bp, Homo sapiens
tgggcttaaagcag

SEQ ID NO: 4402080 - DNA, 22 bp, Homo sapiens
tgggcttatatctggcctctgc

SEQ ID NO: 4402081 - DNA, 18 bp, Homo sapiens
tgggcttcctgcccttcc

SEQ ID NO: 4402082 - DNA, 19 bp, Homo sapiens
tgggcttcctgcccttccc

SEQ ID NO: 4402083 - DNA, 18 bp, Homo sapiens
tgggcttggcctgctgtg

SEQ ID NO: 4402084 - DNA, 21 bp, Homo sapiens
tgggctttcccccaactcagg

SEQ ID NO: 4402085 - DNA, 17 bp, Homo sapiens
tggggaaaaaaatcatc

SEQ ID NO: 4402086 - DNA, 15 bp, Homo sapiens
tggggaacggaggag

SEQ ID NO: 4402087 - DNA, 19 bp, Homo sapiens
tggggaacggaggaggaca

SEQ ID NO: 4402088 - DNA, 18 bp, Homo sapiens
tggggaagaacagccccg

SEQ ID NO: 4402089 - DNA, 17 bp, Homo sapiens
tggggaagaggttttat

SEQ ID NO: 4402090 - DNA, 20 bp, Homo sapiens
tggggaagaggttttattta

SEQ ID NO: 4402091 - DNA, 23 bp, Homo sapiens
tggggaagaggttttatttacat

SEQ ID NO: 4402092 - DNA, 17 bp, Homo sapiens
tggggaatgctcccagc

SEQ ID NO: 4402093 - DNA, 21 bp, Homo sapiens
tggggacacacattctgcctt

SEQ ID NO: 4402094 - DNA, 19 bp, Homo sapiens
tggggacggggggccccag

SEQ ID NO: 4402095 - DNA, 20 bp, Homo sapiens
tggggacggggggccccagt

SEQ ID NO: 4402096 - DNA, 14 bp, Homo sapiens
tggggactcaggga

SEQ ID NO: 4402097 - DNA, 22 bp, Homo sapiens
tggggactccggctgtgctggg

SEQ ID NO: 4402098 - DNA, 19 bp, Homo sapiens
tggggactcgggggctggt

SEQ ID NO: 4402099 - DNA, 17 bp, Homo sapiens
tggggacttcaactgcc

SEQ ID NO: 4402100 - DNA, 22 bp, Homo sapiens
tggggacttcaactgcccagca

SEQ ID NO: 4402101 - DNA, 21 bp, Homo sapiens
tggggagactgggctgaggga

SEQ ID NO: 4402102 - DNA, 13 bp, Homo sapiens
tggggagagacgg

SEQ ID NO: 4402103 - DNA, 12 bp, Homo sapiens
tggggagctgtt

SEQ ID NO: 4402104 - DNA, 22 bp, Homo sapiens
tggggaggcggacgttccagcc

SEQ ID NO: 4402105 - DNA, 23 bp, Homo sapiens
tggggaggcggacgttccagccg

SEQ ID NO: 4402106 - DNA, 16 bp, Homo sapiens
tggggaggttgtgggg

SEQ ID NO: 4402107 - DNA, 23 bp, Homo sapiens
tggggagtaaacggcccaggcca

SEQ ID NO: 4402108 - DNA, 19 bp, Homo sapiens
tggggagtttagggtgggg

SEQ ID NO: 4402109 - DNA, 14 bp, Homo sapiens
tggggatcgatgtg

SEQ ID NO: 4402110 - DNA, 10 bp, Homo sapiens
tggggcagag

SEQ ID NO: 4402111 - DNA, 13 bp, Homo sapiens
tggggcagagcct

SEQ ID NO: 4402112 - DNA, 14 bp, Homo sapiens
tggggcagagcctc

SEQ ID NO: 4402113 - DNA, 17 bp, Homo sapiens
tggggcaggctgggcca

SEQ ID NO: 4402114 - DNA, 16 bp, Homo sapiens
tggggcaggggccggg

SEQ ID NO: 4402115 - DNA, 22 bp, Homo sapiens
tggggccacttggtagtgtccc

SEQ ID NO: 4402116 - DNA, 20 bp, Homo sapiens
tggggccagaggctgggagt

SEQ ID NO: 4402117 - DNA, 17 bp, Homo sapiens
tggggccctgggcctca

SEQ ID NO: 4402118 - DNA, 21 bp, Homo sapiens
tggggccggttttcctcagct

SEQ ID NO: 4402119 - DNA, 15 bp, Homo sapiens
tggggcctcaggctc

SEQ ID NO: 4402120 - DNA, 20 bp, Homo sapiens
tggggcctggggagcccact

SEQ ID NO: 4402121 - DNA, 21 bp, Homo sapiens
tggggcctggggagcccactg

SEQ ID NO: 4402122 - DNA, 20 bp, Homo sapiens
tggggccttcgggaccctgg

SEQ ID NO: 4402123 - DNA, 24 bp, Homo sapiens
tggggcctttgccagcagagccag

SEQ ID NO: 4402124 - DNA, 15 bp, Homo sapiens
tggggctaaatgaag

SEQ ID NO: 4402125 - DNA, 16 bp, Homo sapiens
tggggctaaatgaagt

SEQ ID NO: 4402126 - DNA, 17 bp, Homo sapiens
tggggctaggtcttgcc

SEQ ID NO: 4402127 - DNA, 15 bp, Homo sapiens
tggggctcagagtgg

SEQ ID NO: 4402128 - DNA, 13 bp, Homo sapiens
tggggctcccagc

SEQ ID NO: 4402129 - DNA, 14 bp, Homo sapiens
tggggctcctggga

SEQ ID NO: 4402130 - DNA, 16 bp, Homo sapiens
tggggctcctgggagg

SEQ ID NO: 4402131 - DNA, 18 bp, Homo sapiens
tggggctcctgggaggga

SEQ ID NO: 4402132 - DNA, 22 bp, Homo sapiens
tggggctcctgggagggagact

SEQ ID NO: 4402133 - DNA, 16 bp, Homo sapiens
tggggctgacacccag

SEQ ID NO: 4402134 - DNA, 17 bp, Homo sapiens
tggggctgacacccagg

SEQ ID NO: 4402135 - DNA, 24 bp, Homo sapiens
tggggctgagccctcctgagggcc

SEQ ID NO: 4402136 - DNA, 14 bp, Homo sapiens
tggggctgctcctc

SEQ ID NO: 4402137 - DNA, 16 bp, Homo sapiens
tggggctgctcctcca

SEQ ID NO: 4402138 - DNA, 21 bp, Homo sapiens
tggggctgctcctccagggcc

SEQ ID NO: 4402139 - DNA, 15 bp, Homo sapiens
tgggggaagccctgg

SEQ ID NO: 4402140 - DNA, 18 bp, Homo sapiens
tgggggaatgcacctccc

SEQ ID NO: 4402141 - DNA, 16 bp, Homo sapiens
tgggggagggctgcga

SEQ ID NO: 4402142 - DNA, 18 bp, Homo sapiens
tgggggatagaggggctg

SEQ ID NO: 4402143 - DNA, 21 bp, Homo sapiens
tgggggatgggccagggttta

SEQ ID NO: 4402144 - DNA, 18 bp, Homo sapiens
tgggggcagagggcagag

SEQ ID NO: 4402145 - DNA, 22 bp, Homo sapiens
tgggggcaggagggccctacct

SEQ ID NO: 4402146 - DNA, 17 bp, Homo sapiens
tgggggcagtctcccct

SEQ ID NO: 4402147 - DNA, 20 bp, Homo sapiens
tgggggcagtctccccttcc

SEQ ID NO: 4402148 - DNA, 15 bp, Homo sapiens
tggggggacagagac

SEQ ID NO: 4402149 - DNA, 15 bp, Homo sapiens
tgggggtctgtgtgt

SEQ ID NO: 4402150 - DNA, 13 bp, Homo sapiens
tgggggtggagga

SEQ ID NO: 4402151 - DNA, 21 bp, Homo sapiens
tgggggtggaggaccgaggct

SEQ ID NO: 4402152 - DNA, 19 bp, Homo sapiens
tgggggtggaggcttcctg

SEQ ID NO: 4402153 - DNA, 15 bp, Homo sapiens
tgggggtggcaggca

SEQ ID NO: 4402154 - DNA, 21 bp, Homo sapiens
tgggggtggccatccctgggc

SEQ ID NO: 4402155 - DNA, 10 bp, Homo sapiens
tgggggtggg

SEQ ID NO: 4402156 - DNA, 11 bp, Homo sapiens
tgggggtgggt

SEQ ID NO: 4402157 - DNA, 22 bp, Homo sapiens
tgggggtgtggctctgccctgg

SEQ ID NO: 4402158 - DNA, 15 bp, Homo sapiens
tggggtaagccagag

SEQ ID NO: 4402159 - DNA, 16 bp, Homo sapiens
tggggtagggctgact

SEQ ID NO: 4402160 - DNA, 15 bp, Homo sapiens
tggggtaggttggga

SEQ ID NO: 4402161 - DNA, 15 bp, Homo sapiens
tggggtccctccacc

SEQ ID NO: 4402162 - DNA, 21 bp, Homo sapiens
tggggtcctagcccagtgctt

SEQ ID NO: 4402163 - DNA, 22 bp, Homo sapiens
tggggtgcgggatacagctgag

SEQ ID NO: 4402164 - DNA, 14 bp, Homo sapiens
tggggtgctgccct

SEQ ID NO: 4402165 - DNA, 13 bp, Homo sapiens
tggggtgctggga

SEQ ID NO: 4402166 - DNA, 23 bp, Homo sapiens
tggggttcaagaagtaatcagta

SEQ ID NO: 4402167 - DNA, 19 bp, Homo sapiens
tggggttcagcccctcctc

SEQ ID NO: 4402168 - DNA, 21 bp, Homo sapiens
tggggttcagcccctcctctg

SEQ ID NO: 4402169 - DNA, 14 bp, Homo sapiens
tggggttgccagag

SEQ ID NO: 4402170 - DNA, 17 bp, Homo sapiens
tggggttgccagaggcc

SEQ ID NO: 4402171 - DNA, 18 bp, Homo sapiens
tggggttgccagaggccc

SEQ ID NO: 4402172 - DNA, 19 bp, Homo sapiens
tggggttgccagaggccct

SEQ ID NO: 4402173 - DNA, 14 bp, Homo sapiens
tgggtaagggaggg

SEQ ID NO: 4402174 - DNA, 13 bp, Homo sapiens
tgggtacatcaag

SEQ ID NO: 4402175 - DNA, 22 bp, Homo sapiens
tgggtacatcaagtccatctga

SEQ ID NO: 4402176 - DNA, 13 bp, Homo sapiens
tgggtagaagcct

SEQ ID NO: 4402177 - DNA, 20 bp, Homo sapiens
tgggtagaatataaaataaa

SEQ ID NO: 4402178 - DNA, 9 bp, Homo sapiens
tgggtcaga

SEQ ID NO: 4402179 - DNA, 15 bp, Homo sapiens
tgggtcagtggccag

SEQ ID NO: 4402180 - DNA, 20 bp, Homo sapiens
tgggtccaggggtctgtctg

SEQ ID NO: 4402181 - DNA, 14 bp, Homo sapiens
tgggtccatgggca

SEQ ID NO: 4402182 - DNA, 18 bp, Homo sapiens
tgggtcccgcactctgcc

SEQ ID NO: 4402183 - DNA, 17 bp, Homo sapiens
tgggtcctagcccttcc

SEQ ID NO: 4402184 - DNA, 23 bp, Homo sapiens
tgggtctaaggggttggttgagg

SEQ ID NO: 4402185 - DNA, 21 bp, Homo sapiens
tgggtctaggacacagttcct

SEQ ID NO: 4402186 - DNA, 20 bp, Homo sapiens
tgggtctgaggcccctgcct

SEQ ID NO: 4402187 - DNA, 18 bp, Homo sapiens
tgggtctgcacagattct

SEQ ID NO: 4402188 - DNA, 21 bp, Homo sapiens
tgggtctgggagtcacacagt

SEQ ID NO: 4402189 - DNA, 12 bp, Homo sapiens
tgggtctgtgtg

SEQ ID NO: 4402190 - DNA, 12 bp, Homo sapiens
tgggtcttcagc

SEQ ID NO: 4402191 - DNA, 16 bp, Homo sapiens
tgggtcttcagcttta

SEQ ID NO: 4402192 - DNA, 13 bp, Homo sapiens
tgggtcttttata

SEQ ID NO: 4402193 - DNA, 12 bp, Homo sapiens
tgggtgagagag

SEQ ID NO: 4402194 - DNA, 13 bp, Homo sapiens
tgggtgagagagg

SEQ ID NO: 4402195 - DNA, 21 bp, Homo sapiens
tgggtgagctctcaggccgag

SEQ ID NO: 4402196 - DNA, 22 bp, Homo sapiens
tgggtgatggaaactgccaaac

SEQ ID NO: 4402197 - DNA, 13 bp, Homo sapiens
tgggtgctggtcc

SEQ ID NO: 4402198 - DNA, 18 bp, Homo sapiens
tgggtgggaggagatgaa

SEQ ID NO: 4402199 - DNA, 18 bp, Homo sapiens
tgggtgggattttgcaaa

SEQ ID NO: 4402200 - DNA, 15 bp, Homo sapiens
tgggtgggctctgtg

SEQ ID NO: 4402201 - DNA, 14 bp, Homo sapiens
tgggtggggctcct

SEQ ID NO: 4402202 - DNA, 21 bp, Homo sapiens
tgggtggggctgctcctccag

SEQ ID NO: 4402203 - DNA, 15 bp, Homo sapiens
tgggtgtatgtatgt

SEQ ID NO: 4402204 - DNA, 20 bp, Homo sapiens
tgggtgtcaagtgcctgcac

SEQ ID NO: 4402205 - DNA, 14 bp, Homo sapiens
tgggtgttctttcc

SEQ ID NO: 4402206 - DNA, 17 bp, Homo sapiens
tgggtgttctttcctgc

SEQ ID NO: 4402207 - DNA, 14 bp, Homo sapiens
tgggttaagtatta

SEQ ID NO: 4402208 - DNA, 15 bp, Homo sapiens
tgggttattctggag

SEQ ID NO: 4402209 - DNA, 19 bp, Homo sapiens
tgggttcatgatgcagtct

SEQ ID NO: 4402210 - DNA, 22 bp, Homo sapiens
tgggtttattttcattctgcca

SEQ ID NO: 4402211 - DNA, 18 bp, Homo sapiens
tgggtttctcattaaagt

SEQ ID NO: 4402212 - DNA, 17 bp, Homo sapiens
tgggtttggatctccaa

SEQ ID NO: 4402213 - DNA, 14 bp, Homo sapiens
tgggttttcttccc

SEQ ID NO: 4402214 - DNA, 17 bp, Homo sapiens
tggtaaaaatgctgctc

SEQ ID NO: 4402215 - DNA, 18 bp, Homo sapiens
tggtaaaacagtttcatc

SEQ ID NO: 4402216 - DNA, 20 bp, Homo sapiens
tggtaaaacagtttcatcta

SEQ ID NO: 4402217 - DNA, 18 bp, Homo sapiens
tggtaaaacattacttat

SEQ ID NO: 4402218 - DNA, 15 bp, Homo sapiens
tggtaaaactcactg

SEQ ID NO: 4402219 - DNA, 20 bp, Homo sapiens
tggtaaaactcactgtgatc

SEQ ID NO: 4402220 - DNA, 18 bp, Homo sapiens
tggtaaacattcctccag

SEQ ID NO: 4402221 - DNA, 17 bp, Homo sapiens
tggtaaatactgtgaaa

SEQ ID NO: 4402222 - DNA, 18 bp, Homo sapiens
tggtaaatactgtgaaat

SEQ ID NO: 4402223 - DNA, 20 bp, Homo sapiens
tggtaaatactgtgaaatac

SEQ ID NO: 4402224 - DNA, 21 bp, Homo sapiens
tggtaactgattacctgccaa

SEQ ID NO: 4402225 - DNA, 22 bp, Homo sapiens
tggtaactgattacctgccaat

SEQ ID NO: 4402226 - DNA, 14 bp, Homo sapiens
tggtaacttttgtg

SEQ ID NO: 4402227 - DNA, 16 bp, Homo sapiens
tggtaacttttgtgaa

SEQ ID NO: 4402228 - DNA, 16 bp, Homo sapiens
tggtaagactgctggt

SEQ ID NO: 4402229 - DNA, 12 bp, Homo sapiens
tggtaagagaaa

SEQ ID NO: 4402230 - DNA, 13 bp, Homo sapiens
tggtaagagaaaa

SEQ ID NO: 4402231 - DNA, 13 bp, Homo sapiens
tggtaagcagagg

SEQ ID NO: 4402232 - DNA, 22 bp, Homo sapiens
tggtaaggtgtgtactcagggc

SEQ ID NO: 4402233 - DNA, 13 bp, Homo sapiens
tggtaatatacaa

SEQ ID NO: 4402234 - DNA, 18 bp, Homo sapiens
tggtaatcctcttctaaa

SEQ ID NO: 4402235 - DNA, 14 bp, Homo sapiens
tggtacaaaaataa

SEQ ID NO: 4402236 - DNA, 15 bp, Homo sapiens
tggtacaaaaataaa

SEQ ID NO: 4402237 - DNA, 18 bp, Homo sapiens
tggtacaaaaataaattt

SEQ ID NO: 4402238 - DNA, 14 bp, Homo sapiens
tggtacacatgtgt

SEQ ID NO: 4402239 - DNA, 23 bp, Homo sapiens
tggtacataggcttctattacct

SEQ ID NO: 4402240 - DNA, 18 bp, Homo sapiens
tggtacatggtgtttgtg

SEQ ID NO: 4402241 - DNA, 16 bp, Homo sapiens
tggtactaccccagcc

SEQ ID NO: 4402242 - DNA, 20 bp, Homo sapiens
tggtactataaaagctttct

SEQ ID NO: 4402243 - DNA, 13 bp, Homo sapiens
tggtacttcctct

SEQ ID NO: 4402244 - DNA, 17 bp, Homo sapiens
tggtacttcctctgtga

SEQ ID NO: 4402245 - DNA, 17 bp, Homo sapiens
tggtactttgcagctgc

SEQ ID NO: 4402246 - DNA, 16 bp, Homo sapiens
tggtagagacccccag

SEQ ID NO: 4402247 - DNA, 18 bp, Homo sapiens
tggtagatgacaaatatt

SEQ ID NO: 4402248 - DNA, 16 bp, Homo sapiens
tggtagatgcttgatt

SEQ ID NO: 4402249 - DNA, 17 bp, Homo sapiens
tggtagcagcaggctca

SEQ ID NO: 4402250 - DNA, 18 bp, Homo sapiens
tggtaggactgtagaaaa

SEQ ID NO: 4402251 - DNA, 14 bp, Homo sapiens
tggtagttctgtgc

SEQ ID NO: 4402252 - DNA, 14 bp, Homo sapiens
tggtataaattaat

SEQ ID NO: 4402253 - DNA, 22 bp, Homo sapiens
tggtatagaaatgctggttttt

SEQ ID NO: 4402254 - DNA, 18 bp, Homo sapiens
tggtatattattgcttca

SEQ ID NO: 4402255 - DNA, 17 bp, Homo sapiens
tggtatatttgaaataa

SEQ ID NO: 4402256 - DNA, 14 bp, Homo sapiens
tggtatcaaaatta

SEQ ID NO: 4402257 - DNA, 19 bp, Homo sapiens
tggtatctgggtaagaaga

SEQ ID NO: 4402258 - DNA, 16 bp, Homo sapiens
tggtatgccaacttaa

SEQ ID NO: 4402259 - DNA, 15 bp, Homo sapiens
tggtatgctggccag

SEQ ID NO: 4402260 - DNA, 19 bp, Homo sapiens
tggtatgctggccagcacc

SEQ ID NO: 4402261 - DNA, 21 bp, Homo sapiens
tggtatggagctgtgccgagg

SEQ ID NO: 4402262 - DNA, 18 bp, Homo sapiens
tggtatggggctgagccc

SEQ ID NO: 4402263 - DNA, 15 bp, Homo sapiens
tggtattaaatgcca

SEQ ID NO: 4402264 - DNA, 14 bp, Homo sapiens
tggtcaacatagtg

SEQ ID NO: 4402265 - DNA, 14 bp, Homo sapiens
tggtcaacatttct

SEQ ID NO: 4402266 - DNA, 20 bp, Homo sapiens
tggtcacagccatgaagtca

SEQ ID NO: 4402267 - DNA, 14 bp, Homo sapiens
tggtcacagctgta

SEQ ID NO: 4402268 - DNA, 17 bp, Homo sapiens
tggtcacaggaagtaga

SEQ ID NO: 4402269 - DNA, 24 bp, Homo sapiens
tggtcaccgagactcagcctctgc

SEQ ID NO: 4402270 - DNA, 15 bp, Homo sapiens
tggtcagagccactc

SEQ ID NO: 4402271 - DNA, 14 bp, Homo sapiens
tggtcagagtgcca

SEQ ID NO: 4402272 - DNA, 15 bp, Homo sapiens
tggtcagagtgccac

SEQ ID NO: 4402273 - DNA, 22 bp, Homo sapiens
tggtcagccctagggtggagag

SEQ ID NO: 4402274 - DNA, 21 bp, Homo sapiens
tggtcaggctggtctcaaact

SEQ ID NO: 4402275 - DNA, 17 bp, Homo sapiens
tggtcatatacatattg

SEQ ID NO: 4402276 - DNA, 21 bp, Homo sapiens
tggtccaaaagattgctgaaa

SEQ ID NO: 4402277 - DNA, 16 bp, Homo sapiens
tggtccaaaggacaaa

SEQ ID NO: 4402278 - DNA, 21 bp, Homo sapiens
tggtccaggtcttcagtttcc

SEQ ID NO: 4402279 - DNA, 15 bp, Homo sapiens
tggtccggtgtcctt

SEQ ID NO: 4402280 - DNA, 17 bp, Homo sapiens
tggtcctaaaagcaaaa

SEQ ID NO: 4402281 - DNA, 12 bp, Homo sapiens
tggtcctagaca

SEQ ID NO: 4402282 - DNA, 11 bp, Homo sapiens
tggtcctggtg

SEQ ID NO: 4402283 - DNA, 15 bp, Homo sapiens
tggtcctggtgctgc

SEQ ID NO: 4402284 - DNA, 17 bp, Homo sapiens
tggtcctttctggaagt

SEQ ID NO: 4402285 - DNA, 12 bp, Homo sapiens
tggtcctttggg

SEQ ID NO: 4402286 - DNA, 23 bp, Homo sapiens
tggtcgagaaagaggcaccagga

SEQ ID NO: 4402287 - DNA, 22 bp, Homo sapiens
tggtcgtcaactttcctcaaat

SEQ ID NO: 4402288 - DNA, 20 bp, Homo sapiens
tggtctaatgattcaaatgt

SEQ ID NO: 4402289 - DNA, 23 bp, Homo sapiens
tggtctataagatgaaacatcat

SEQ ID NO: 4402290 - DNA, 19 bp, Homo sapiens
tggtctcagcagcgaccac

SEQ ID NO: 4402291 - DNA, 22 bp, Homo sapiens
tggtctcagcagcgaccacccc

SEQ ID NO: 4402292 - DNA, 20 bp, Homo sapiens
tggtctcagcgggagccagt

SEQ ID NO: 4402293 - DNA, 17 bp, Homo sapiens
tggtctctgcacccagt

SEQ ID NO: 4402294 - DNA, 11 bp, Homo sapiens
tggtctgctgt

SEQ ID NO: 4402295 - DNA, 15 bp, Homo sapiens
tggtctgtgaagagc

SEQ ID NO: 4402296 - DNA, 22 bp, Homo sapiens
tggtcttatagtgtttggacag

SEQ ID NO: 4402297 - DNA, 14 bp, Homo sapiens
tggtcttccttttt

SEQ ID NO: 4402298 - DNA, 19 bp, Homo sapiens
tggtgaaacccccatctct

SEQ ID NO: 4402299 - DNA, 11 bp, Homo sapiens
tggtgaacagt

SEQ ID NO: 4402300 - DNA, 17 bp, Homo sapiens
tggtgacaaaattcatt

SEQ ID NO: 4402301 - DNA, 18 bp, Homo sapiens
tggtgacacctccccctt

SEQ ID NO: 4402302 - DNA, 19 bp, Homo sapiens
tggtgaccccatacatttg

SEQ ID NO: 4402303 - DNA, 21 bp, Homo sapiens
tggtgacgtggtagtcacttg

SEQ ID NO: 4402304 - DNA, 15 bp, Homo sapiens
tggtgactcacttca

SEQ ID NO: 4402305 - DNA, 18 bp, Homo sapiens
tggtgagagtcaaagctg

SEQ ID NO: 4402306 - DNA, 14 bp, Homo sapiens
tggtgatgtaaaaa

SEQ ID NO: 4402307 - DNA, 17 bp, Homo sapiens
tggtgatgtaaaaatgc

SEQ ID NO: 4402308 - DNA, 20 bp, Homo sapiens
tggtgatgtaaaaatgcttc

SEQ ID NO: 4402309 - DNA, 18 bp, Homo sapiens
tggtgcaaattcagaact

SEQ ID NO: 4402310 - DNA, 19 bp, Homo sapiens
tggtgcagccttcccctcc

SEQ ID NO: 4402311 - DNA, 15 bp, Homo sapiens
tggtgcaggtctcca

SEQ ID NO: 4402312 - DNA, 13 bp, Homo sapiens
tggtgcatgggct

SEQ ID NO: 4402313 - DNA, 21 bp, Homo sapiens
tggtgccatttctgaactgtt

SEQ ID NO: 4402314 - DNA, 17 bp, Homo sapiens
tggtgcccctgctcact

SEQ ID NO: 4402315 - DNA, 19 bp, Homo sapiens
tggtgcccctgctcactgg

SEQ ID NO: 4402316 - DNA, 17 bp, Homo sapiens
tggtgcccgtgcccgca

SEQ ID NO: 4402317 - DNA, 14 bp, Homo sapiens
tggtgcctgagagg

SEQ ID NO: 4402318 - DNA, 21 bp, Homo sapiens
tggtgctcaccatgcttccag

SEQ ID NO: 4402319 - DNA, 18 bp, Homo sapiens
tggtgctgcccaggcctc

SEQ ID NO: 4402320 - DNA, 17 bp, Homo sapiens
tggtgctgccgagggct

SEQ ID NO: 4402321 - DNA, 18 bp, Homo sapiens
tccagaagcctctggcta

SEQ ID NO: 4402322 - DNA, 19 bp, Homo sapiens
tccagaagcctctggctag

SEQ ID NO: 4402323 - DNA, 15 bp, Homo sapiens
tccagaagtgtgact

SEQ ID NO: 4402324 - DNA, 13 bp, Homo sapiens
tccagaatgctgt

SEQ ID NO: 4402325 - DNA, 15 bp, Homo sapiens
tccagaatgctgtac

SEQ ID NO: 4402326 - DNA, 16 bp, Homo sapiens
tggagtgaaattattt

SEQ ID NO: 4402327 - DNA, 17 bp, Homo sapiens
tggagtgtggctgagga

SEQ ID NO: 4402328 - DNA, 20 bp, Homo sapiens
tggagtgttttagttcttgg

SEQ ID NO: 4402329 - DNA, 15 bp, Homo sapiens
tggagttaaaatgca

SEQ ID NO: 4402330 - DNA, 19 bp, Homo sapiens
tggagttcttagctatcct

SEQ ID NO: 4402331 - DNA, 14 bp, Homo sapiens
tggagtttgggctg

SEQ ID NO: 4402332 - DNA, 16 bp, Homo sapiens
tggagtttgggctgga

SEQ ID NO: 4402333 - DNA, 21 bp, Homo sapiens
tggagtttgggctggagctcc

SEQ ID NO: 4402334 - DNA, 21 bp, Homo sapiens
tggagttttcaggctatcata

SEQ ID NO: 4402335 - DNA, 15 bp, Homo sapiens
tggataaattgttta

SEQ ID NO: 4402336 - DNA, 23 bp, Homo sapiens
tggataagctatccgtgttgcag

SEQ ID NO: 4402337 - DNA, 20 bp, Homo sapiens
tggataagtggctgtttcat

SEQ ID NO: 4402338 - DNA, 18 bp, Homo sapiens
tggataatgctgttgcct

SEQ ID NO: 4402339 - DNA, 13 bp, Homo sapiens
tggatacataaag

SEQ ID NO: 4402340 - DNA, 14 bp, Homo sapiens
tggatacataaaga

SEQ ID NO: 4402341 - DNA, 14 bp, Homo sapiens
tggatacttggatt

SEQ ID NO: 4402342 - DNA, 17 bp, Homo sapiens
tggatatagaaaatctt

SEQ ID NO: 4402343 - DNA, 16 bp, Homo sapiens
tggatatagttttact

SEQ ID NO: 4402344 - DNA, 17 bp, Homo sapiens
tggatatagttttactt

SEQ ID NO: 4402345 - DNA, 15 bp, Homo sapiens
tggatatatttgaaa

SEQ ID NO: 4402346 - DNA, 18 bp, Homo sapiens
tggatatatttgaaatag

SEQ ID NO: 4402347 - DNA, 19 bp, Homo sapiens
tggatatatttgaaatagt

SEQ ID NO: 4402348 - DNA, 22 bp, Homo sapiens
tggatatatttgaaatagtata

SEQ ID NO: 4402349 - DNA, 16 bp, Homo sapiens
tggatatgtaaaacat

SEQ ID NO: 4402350 - DNA, 21 bp, Homo sapiens
tggatatgtaaaacatttatt

SEQ ID NO: 4402351 - DNA, 15 bp, Homo sapiens
tggatcacaaagtgg

SEQ ID NO: 4402352 - DNA, 16 bp, Homo sapiens
tggatcaccattatat

SEQ ID NO: 4402353 - DNA, 17 bp, Homo sapiens
tggatcaccattatatt

SEQ ID NO: 4402354 - DNA, 19 bp, Homo sapiens
tggatcacctgaggtcagg

SEQ ID NO: 4402355 - DNA, 19 bp, Homo sapiens
tggatcataagacaatgga

SEQ ID NO: 4402356 - DNA, 23 bp, Homo sapiens
tggatccatcttgagccacagtc

SEQ ID NO: 4402357 - DNA, 18 bp, Homo sapiens
tggatcccaaagcaagga

SEQ ID NO: 4402358 - DNA, 13 bp, Homo sapiens
tggatcctgctgc

SEQ ID NO: 4402359 - DNA, 22 bp, Homo sapiens
tggatcgctgcacatggcctga

SEQ ID NO: 4402360 - DNA, 23 bp, Homo sapiens
tggatcgctgcacatggcctgag

SEQ ID NO: 4402361 - DNA, 23 bp, Homo sapiens
tggatctgaggaggctttggtaa

SEQ ID NO: 4402362 - DNA, 21 bp, Homo sapiens
tggatctgggaccctttcctt

SEQ ID NO: 4402363 - DNA, 15 bp, Homo sapiens
tggatctggggactg

SEQ ID NO: 4402364 - DNA, 19 bp, Homo sapiens
tggatcttcagaactgccc

SEQ ID NO: 4402365 - DNA, 19 bp, Homo sapiens
tggatgatattttttatca

SEQ ID NO: 4402366 - DNA, 15 bp, Homo sapiens
tggatgatcaatcct

SEQ ID NO: 4402367 - DNA, 14 bp, Homo sapiens
tggatgattaaatt

SEQ ID NO: 4402368 - DNA, 13 bp, Homo sapiens
tggatgcaaagta

SEQ ID NO: 4402369 - DNA, 15 bp, Homo sapiens
tggatgcatttcaaa

SEQ ID NO: 4402370 - DNA, 16 bp, Homo sapiens
tggatgcatttcaaat

SEQ ID NO: 4402371 - DNA, 20 bp, Homo sapiens
tggatgccacagcccagctt

SEQ ID NO: 4402372 - DNA, 15 bp, Homo sapiens
tggatggaaggagac

SEQ ID NO: 4402373 - DNA, 18 bp, Homo sapiens
tggatggctcaagtctgc

SEQ ID NO: 4402374 - DNA, 18 bp, Homo sapiens
tggatggtccagtgtcat

SEQ ID NO: 4402375 - DNA, 13 bp, Homo sapiens
tggatggtggcca

SEQ ID NO: 4402376 - DNA, 14 bp, Homo sapiens
tggatgtctgtagc

SEQ ID NO: 4402377 - DNA, 16 bp, Homo sapiens
tggatgtgctggaggg

SEQ ID NO: 4402378 - DNA, 14 bp, Homo sapiens
tggattaaaccttt

SEQ ID NO: 4402379 - DNA, 21 bp, Homo sapiens
tggattaaattagtttgtgaa

SEQ ID NO: 4402380 - DNA, 16 bp, Homo sapiens
tggattagcttttcct

SEQ ID NO: 4402381 - DNA, 16 bp, Homo sapiens
tggattataatcagaa

SEQ ID NO: 4402382 - DNA, 17 bp, Homo sapiens
tggattcatatttaatt

SEQ ID NO: 4402383 - DNA, 20 bp, Homo sapiens
tggattctgaggccctgccc

SEQ ID NO: 4402384 - DNA, 21 bp, Homo sapiens
tggattgggggggccaaaagg

SEQ ID NO: 4402385 - DNA, 18 bp, Homo sapiens
tggattgttaatttcagt

SEQ ID NO: 4402386 - DNA, 21 bp, Homo sapiens
tggattgttaatttcagtcct

SEQ ID NO: 4402387 - DNA, 16 bp, Homo sapiens
tggatttaaaagcctg

SEQ ID NO: 4402388 - DNA, 16 bp, Homo sapiens
tggatttagtttcagt

SEQ ID NO: 4402389 - DNA, 20 bp, Homo sapiens
tggatttcgtgtgccgctgc

SEQ ID NO: 4402390 - DNA, 14 bp, Homo sapiens
tggatttctgtgaa

SEQ ID NO: 4402391 - DNA, 15 bp, Homo sapiens
tggatttctgtgaag

SEQ ID NO: 4402392 - DNA, 15 bp, Homo sapiens
tggatttttctttaa

SEQ ID NO: 4402393 - DNA, 17 bp, Homo sapiens
tggatttttgtcttgtg

SEQ ID NO: 4402394 - DNA, 22 bp, Homo sapiens
tggattttttatgtacaaccct

SEQ ID NO: 4402395 - DNA, 23 bp, Homo sapiens
tggattttttccttcaaagttta

SEQ ID NO: 4402396 - DNA, 18 bp, Homo sapiens
tggcaaaactcaggcaga

SEQ ID NO: 4402397 - DNA, 15 bp, Homo sapiens
tggcaaacagggcct

SEQ ID NO: 4402398 - DNA, 18 bp, Homo sapiens
tggcaaacagggcctctg

SEQ ID NO: 4402399 - DNA, 15 bp, Homo sapiens
tggcaaacttttctt

SEQ ID NO: 4402400 - DNA, 20 bp, Homo sapiens
tggcaacattggacagaaaa

SEQ ID NO: 4402401 - DNA, 23 bp, Homo sapiens
tggcaacattggacagaaaatgc

SEQ ID NO: 4402402 - DNA, 21 bp, Homo sapiens
tggcaagctagaacctggagg

SEQ ID NO: 4402403 - DNA, 20 bp, Homo sapiens
tggcaaggactttgtacatt

SEQ ID NO: 4402404 - DNA, 14 bp, Homo sapiens
tggcaatgaaaatt

SEQ ID NO: 4402405 - DNA, 19 bp, Homo sapiens
tggcaattccaatatttct

SEQ ID NO: 4402406 - DNA, 18 bp, Homo sapiens
tggcaatttcctggccct

SEQ ID NO: 4402407 - DNA, 19 bp, Homo sapiens
tggcaatttcctggccctc

SEQ ID NO: 4402408 - DNA, 21 bp, Homo sapiens
tggcaatttcctggccctcca

SEQ ID NO: 4402409 - DNA, 12 bp, Homo sapiens
tggcacagcccc

SEQ ID NO: 4402410 - DNA, 14 bp, Homo sapiens
tggcacagcccctg

SEQ ID NO: 4402411 - DNA, 23 bp, Homo sapiens
tggcacattgcccctctgccttg

SEQ ID NO: 4402412 - DNA, 14 bp, Homo sapiens
tggcaccagatgca

SEQ ID NO: 4402413 - DNA, 19 bp, Homo sapiens
tggcaccatgttggcctct

SEQ ID NO: 4402414 - DNA, 20 bp, Homo sapiens
tggcacccccatgctgcctt

SEQ ID NO: 4402415 - DNA, 13 bp, Homo sapiens
tggcacctgcagc

SEQ ID NO: 4402416 - DNA, 22 bp, Homo sapiens
tggcaccttcagactttgcttc

SEQ ID NO: 4402417 - DNA, 15 bp, Homo sapiens
tggcacgttgaccca

SEQ ID NO: 4402418 - DNA, 13 bp, Homo sapiens
tggcactggcaaa

SEQ ID NO: 4402419 - DNA, 17 bp, Homo sapiens
tggcactgggaggcagg

SEQ ID NO: 4402420 - DNA, 22 bp, Homo sapiens
tggcactgtaaggtgcttgctc

SEQ ID NO: 4402421 - DNA, 22 bp, Homo sapiens
tggcacttgccattccaaaata

SEQ ID NO: 4402422 - DNA, 16 bp, Homo sapiens
tggcacttgggggact

SEQ ID NO: 4402423 - DNA, 21 bp, Homo sapiens
tggcagaagggaattgctcag

SEQ ID NO: 4402424 - DNA, 12 bp, Homo sapiens
tggcagagttac

SEQ ID NO: 4402425 - DNA, 19 bp, Homo sapiens
tggcagatgtcttccctgg

SEQ ID NO: 4402426 - DNA, 22 bp, Homo sapiens
tggcagatgtcttccctgggct

SEQ ID NO: 4402427 - DNA, 22 bp, Homo sapiens
tggcagatttagtgaaagctag

SEQ ID NO: 4402428 - DNA, 21 bp, Homo sapiens
tggcagccgggttagcatgtg

SEQ ID NO: 4402429 - DNA, 16 bp, Homo sapiens
tggcagctagtgcctt

SEQ ID NO: 4402430 - DNA, 17 bp, Homo sapiens
tggcagctgagagccct

SEQ ID NO: 4402431 - DNA, 22 bp, Homo sapiens
tggcaggcacacagcagccccc

SEQ ID NO: 4402432 - DNA, 16 bp, Homo sapiens
tggcaggcccactccc

SEQ ID NO: 4402433 - DNA, 19 bp, Homo sapiens
tggcaggcccactccccag

SEQ ID NO: 4402434 - DNA, 14 bp, Homo sapiens
tggcagggccaggc

SEQ ID NO: 4402435 - DNA, 21 bp, Homo sapiens
tggcagggggccccgccaggg

SEQ ID NO: 4402436 - DNA, 17 bp, Homo sapiens
tggcagggtgggatgga

SEQ ID NO: 4402437 - DNA, 23 bp, Homo sapiens
tggcagtggactcagaaagccaa

SEQ ID NO: 4402438 - DNA, 13 bp, Homo sapiens
tggcagttgcagt

SEQ ID NO: 4402439 - DNA, 11 bp, Homo sapiens
tggcatacaaa

SEQ ID NO: 4402440 - DNA, 13 bp, Homo sapiens
tggcatacaaaat

SEQ ID NO: 4402441 - DNA, 14 bp, Homo sapiens
tggcatagctctgg

SEQ ID NO: 4402442 - DNA, 16 bp, Homo sapiens
tggcatagctctgggg

SEQ ID NO: 4402443 - DNA, 23 bp, Homo sapiens
tggcatatatgtgatctgggcat

SEQ ID NO: 4402444 - DNA, 22 bp, Homo sapiens
tggcatcaagaggtgggagggc

SEQ ID NO: 4402445 - DNA, 23 bp, Homo sapiens
tggcatcaagaggtgggagggcc

SEQ ID NO: 4402446 - DNA, 21 bp, Homo sapiens
tggcatcacagaccccagctg

SEQ ID NO: 4402447 - DNA, 21 bp, Homo sapiens
tggcatccagagtccctgcct

SEQ ID NO: 4402448 - DNA, 20 bp, Homo sapiens
tggcatgatcatagctcact

SEQ ID NO: 4402449 - DNA, 21 bp, Homo sapiens
tggcatgatcatagctcactg

SEQ ID NO: 4402450 - DNA, 22 bp, Homo sapiens
tggcatgatcatagctcactgc

SEQ ID NO: 4402451 - DNA, 17 bp, Homo sapiens
tggcatgcttaaatttt

SEQ ID NO: 4402452 - DNA, 18 bp, Homo sapiens
tggcatgcttaaatttta

SEQ ID NO: 4402453 - DNA, 21 bp, Homo sapiens
tggcatgtcatttgcacacaa

SEQ ID NO: 4402454 - DNA, 16 bp, Homo sapiens
tggcatgtggagacac

SEQ ID NO: 4402455 - DNA, 12 bp, Homo sapiens
tggcattattag

SEQ ID NO: 4402456 - DNA, 14 bp, Homo sapiens
tggccacacaggca

SEQ ID NO: 4402457 - DNA, 19 bp, Homo sapiens
tggccacacaggcagggcc

SEQ ID NO: 4402458 - DNA, 22 bp, Homo sapiens
tggccacacaggcagggcctgg

SEQ ID NO: 4402459 - DNA, 16 bp, Homo sapiens
tggccacactggggct

SEQ ID NO: 4402460 - DNA, 11 bp, Homo sapiens
tggccacagca

SEQ ID NO: 4402461 - DNA, 23 bp, Homo sapiens
tggccacagcaagtacagcggct

SEQ ID NO: 4402462 - DNA, 11 bp, Homo sapiens
tggccaccagt

SEQ ID NO: 4402463 - DNA, 14 bp, Homo sapiens
tggccacccctccc

SEQ ID NO: 4402464 - DNA, 15 bp, Homo sapiens
tggccacccctcccc

SEQ ID NO: 4402465 - DNA, 16 bp, Homo sapiens
tggccactggatcctg

SEQ ID NO: 4402466 - DNA, 21 bp, Homo sapiens
tggccactggggtgccttcac

SEQ ID NO: 4402467 - DNA, 14 bp, Homo sapiens
tggccagagcctct

SEQ ID NO: 4402468 - DNA, 15 bp, Homo sapiens
tggccagagcctctg

SEQ ID NO: 4402469 - DNA, 17 bp, Homo sapiens
tggccagagcctctggc

SEQ ID NO: 4402470 - DNA, 18 bp, Homo sapiens
tggccagagcctctggcc

SEQ ID NO: 4402471 - DNA, 14 bp, Homo sapiens
tggccagcaccctc

SEQ ID NO: 4402472 - DNA, 23 bp, Homo sapiens
tggccagcccctggggcccagcc

SEQ ID NO: 4402473 - DNA, 20 bp, Homo sapiens
tggccagggccacgctccag

SEQ ID NO: 4402474 - DNA, 19 bp, Homo sapiens
tggccaggggtgctcctgt

SEQ ID NO: 4402475 - DNA, 12 bp, Homo sapiens
tggccaggtgcc

SEQ ID NO: 4402476 - DNA, 23 bp, Homo sapiens
tggccatatatgctgtatttctt

SEQ ID NO: 4402477 - DNA, 15 bp, Homo sapiens
tggccatccctgggc

SEQ ID NO: 4402478 - DNA, 17 bp, Homo sapiens
tggccatccctgggccc

SEQ ID NO: 4402479 - DNA, 19 bp, Homo sapiens
tggccatccctgggcccct

SEQ ID NO: 4402480 - DNA, 21 bp, Homo sapiens
tggccatccctgggcccctcc

SEQ ID NO: 4402481 - DNA, 14 bp, Homo sapiens
tggccatccctgtg

SEQ ID NO: 4402482 - DNA, 17 bp, Homo sapiens
tggccatccctgtgagg

SEQ ID NO: 4402483 - DNA, 16 bp, Homo sapiens
tggccatctccctccc

SEQ ID NO: 4402484 - DNA, 18 bp, Homo sapiens
tggccatgctcaaccccc

SEQ ID NO: 4402485 - DNA, 14 bp, Homo sapiens
tggcccagagccat

SEQ ID NO: 4402486 - DNA, 19 bp, Homo sapiens
tggcccagagccatactgc

SEQ ID NO: 4402487 - DNA, 12 bp, Homo sapiens
tggcccagccct

SEQ ID NO: 4402488 - DNA, 19 bp, Homo sapiens
tggcccagccctgctggcc

SEQ ID NO: 4402489 - DNA, 13 bp, Homo sapiens
tggcccagggcat

SEQ ID NO: 4402490 - DNA, 14 bp, Homo sapiens
tggcccagggcatc

SEQ ID NO: 4402491 - DNA, 19 bp, Homo sapiens
tggcccagggcatctggga

SEQ ID NO: 4402492 - DNA, 21 bp, Homo sapiens
tggccccaagaggggcgggct

SEQ ID NO: 4402493 - DNA, 15 bp, Homo sapiens
tggccccagcctggg

SEQ ID NO: 4402494 - DNA, 12 bp, Homo sapiens
tggccccaggcc

SEQ ID NO: 4402495 - DNA, 22 bp, Homo sapiens
tggccccaggcccacagcgtgg

SEQ ID NO: 4402496 - DNA, 18 bp, Homo sapiens
tggccccatccaaccact

SEQ ID NO: 4402497 - DNA, 23 bp, Homo sapiens
tggccccatgtctctcagaattc

SEQ ID NO: 4402498 - DNA, 13 bp, Homo sapiens
tggcccccaataa

SEQ ID NO: 4402499 - DNA, 17 bp, Homo sapiens
tggcccccaataaaggc

SEQ ID NO: 4402500 - DNA, 21 bp, Homo sapiens
tggcccccaataaaggcagct

SEQ ID NO: 4402501 - DNA, 15 bp, Homo sapiens
tggcccccatcagcc

SEQ ID NO: 4402502 - DNA, 18 bp, Homo sapiens
tggccccgcccctgcccc

SEQ ID NO: 4402503 - DNA, 19 bp, Homo sapiens
tggccccgcccctgccccc

SEQ ID NO: 4402504 - DNA, 23 bp, Homo sapiens
tggcccctcacccaccatggacc

SEQ ID NO: 4402505 - DNA, 21 bp, Homo sapiens
tggcccctcgaccctgtgcag

SEQ ID NO: 4402506 - DNA, 21 bp, Homo sapiens
tggccctacttccaggatgga

SEQ ID NO: 4402507 - DNA, 16 bp, Homo sapiens
tggccctgccttcttc

SEQ ID NO: 4402508 - DNA, 16 bp, Homo sapiens
tggccctggcctgctg

SEQ ID NO: 4402509 - DNA, 18 bp, Homo sapiens
tggccctggcctgctggg

SEQ ID NO: 4402510 - DNA, 13 bp, Homo sapiens
tggccctggggat

SEQ ID NO: 4402511 - DNA, 19 bp, Homo sapiens
tggccctggggatcttccc

SEQ ID NO: 4402512 - DNA, 18 bp, Homo sapiens
tggccctgtcccaggccg

SEQ ID NO: 4402513 - DNA, 15 bp, Homo sapiens
tggccgagctcctgg

SEQ ID NO: 4402514 - DNA, 21 bp, Homo sapiens
tggccgagctcctggggagct

SEQ ID NO: 4402515 - DNA, 12 bp, Homo sapiens
tggccggcctcc

SEQ ID NO: 4402516 - DNA, 13 bp, Homo sapiens
tggccgggcacag

SEQ ID NO: 4402517 - DNA, 16 bp, Homo sapiens
tggccgggcacagtgg

SEQ ID NO: 4402518 - DNA, 15 bp, Homo sapiens
tggccggtgccagct

SEQ ID NO: 4402519 - DNA, 16 bp, Homo sapiens
tggccggtgccagctg

SEQ ID NO: 4402520 - DNA, 17 bp, Homo sapiens
tggccggtgccagctgc

SEQ ID NO: 4402521 - DNA, 23 bp, Homo sapiens
tggcctaacctgccgagagtcca

SEQ ID NO: 4402522 - DNA, 17 bp, Homo sapiens
tggcctaagtgcctctt

SEQ ID NO: 4402523 - DNA, 19 bp, Homo sapiens
tggcctaagtgcctcttct

SEQ ID NO: 4402524 - DNA, 19 bp, Homo sapiens
tggcctacaaatcagtaat

SEQ ID NO: 4402525 - DNA, 16 bp, Homo sapiens
tggcctaggacccctc

SEQ ID NO: 4402526 - DNA, 18 bp, Homo sapiens
tggcctatccgctgccag

SEQ ID NO: 4402527 - DNA, 17 bp, Homo sapiens
tggcctatttcagctgc

SEQ ID NO: 4402528 - DNA, 18 bp, Homo sapiens
tggcctatttcagctgct

SEQ ID NO: 4402529 - DNA, 15 bp, Homo sapiens
tggcctcacccaccc

SEQ ID NO: 4402530 - DNA, 22 bp, Homo sapiens
tggcctcacccacccctgcaca

SEQ ID NO: 4402531 - DNA, 12 bp, Homo sapiens
tggcctcagccc

SEQ ID NO: 4402532 - DNA, 14 bp, Homo sapiens
tggcctcagccctc

SEQ ID NO: 4402533 - DNA, 16 bp, Homo sapiens
tggcctcagccctcag

SEQ ID NO: 4402534 - DNA, 22 bp, Homo sapiens
tggcctcagccctgctccctgc

SEQ ID NO: 4402535 - DNA, 18 bp, Homo sapiens
tggcctcagctgcctcac

SEQ ID NO: 4402536 - DNA, 19 bp, Homo sapiens
tggcctcagctgcctcact

SEQ ID NO: 4402537 - DNA, 13 bp, Homo sapiens
tggcctcccaaag

SEQ ID NO: 4402538 - DNA, 20 bp, Homo sapiens
tggcctcccaaagtgctgag

SEQ ID NO: 4402539 - DNA, 15 bp, Homo sapiens
tggcctccctgctgt

SEQ ID NO: 4402540 - DNA, 13 bp, Homo sapiens
tggcctctcccca

SEQ ID NO: 4402541 - DNA, 15 bp, Homo sapiens
tggcctcttcaggcc

SEQ ID NO: 4402542 - DNA, 16 bp, Homo sapiens
tggcctgaactgagga

SEQ ID NO: 4402543 - DNA, 14 bp, Homo sapiens
tggcctgaagaagc

SEQ ID NO: 4402544 - DNA, 22 bp, Homo sapiens
tggcctgatctctgctccctgc

SEQ ID NO: 4402545 - DNA, 12 bp, Homo sapiens
tggcctgctcat

SEQ ID NO: 4402546 - DNA, 21 bp, Homo sapiens
tggcctgctgggctctccacc

SEQ ID NO: 4402547 - DNA, 17 bp, Homo sapiens
tggcctggccaggagct

SEQ ID NO: 4402548 - DNA, 19 bp, Homo sapiens
tggcctggccatttccaag

SEQ ID NO: 4402549 - DNA, 12 bp, Homo sapiens
tggcctgtctca

SEQ ID NO: 4402550 - DNA, 24 bp, Homo sapiens
tggcctgtctcatccccaggggtc

SEQ ID NO: 4402551 - DNA, 20 bp, Homo sapiens
tggccttaagaactgtgtct

SEQ ID NO: 4402552 - DNA, 12 bp, Homo sapiens
tggcctttcctt

SEQ ID NO: 4402553 - DNA, 15 bp, Homo sapiens
tggcctttccttccc

SEQ ID NO: 4402554 - DNA, 14 bp, Homo sapiens
tggcctttggaccc

SEQ ID NO: 4402555 - DNA, 24 bp, Homo sapiens
tggcctttgtgctgcgcctgcagg

SEQ ID NO: 4402556 - DNA, 22 bp, Homo sapiens
tggcctttttcatttatctata

SEQ ID NO: 4402557 - DNA, 18 bp, Homo sapiens
tggcgaatctcaaaatta

SEQ ID NO: 4402558 - DNA, 14 bp, Homo sapiens
tggcgagccatttg

SEQ ID NO: 4402559 - DNA, 22 bp, Homo sapiens
tggcgagccatttgtcccaagt

SEQ ID NO: 4402560 - DNA, 23 bp, Homo sapiens
tggcgagccatttgtcccaagtg

SEQ ID NO: 4402561 - DNA, 22 bp, Homo sapiens
tggcgcatagtgtgctcggaca

SEQ ID NO: 4402562 - DNA, 22 bp, Homo sapiens
tggcgcccctgcctgtgcccgc

SEQ ID NO: 4402563 - DNA, 13 bp, Homo sapiens
tggcgctcagcag

SEQ ID NO: 4402564 - DNA, 18 bp, Homo sapiens
tggcgctcagcagcccta

SEQ ID NO: 4402565 - DNA, 20 bp, Homo sapiens
tggcgctcagcagccctagc

SEQ ID NO: 4402566 - DNA, 17 bp, Homo sapiens
tggcgcttggatctggg

SEQ ID NO: 4402567 - DNA, 21 bp, Homo sapiens
tggcggctactcagcagccct

SEQ ID NO: 4402568 - DNA, 22 bp, Homo sapiens
tggcggctactcagcagccctc

SEQ ID NO: 4402569 - DNA, 13 bp, Homo sapiens
tggcgggcccact

SEQ ID NO: 4402570 - DNA, 17 bp, Homo sapiens
tggcgggcctttttcct

SEQ ID NO: 4402571 - DNA, 21 bp, Homo sapiens
tggcgtgctcagacccaacag

SEQ ID NO: 4402572 - DNA, 14 bp, Homo sapiens
tggctaaccaagag

SEQ ID NO: 4402573 - DNA, 21 bp, Homo sapiens
tggctagaggccagccccacc

SEQ ID NO: 4402574 - DNA, 16 bp, Homo sapiens
tggctagagtcctcac

SEQ ID NO: 4402575 - DNA, 17 bp, Homo sapiens
tggctataagtgctcaa

SEQ ID NO: 4402576 - DNA, 15 bp, Homo sapiens
tggctataggtgcta

SEQ ID NO: 4402577 - DNA, 21 bp, Homo sapiens
tggctatctatacctgccttt

SEQ ID NO: 4402578 - DNA, 19 bp, Homo sapiens
tggctatgaaaatgagccc

SEQ ID NO: 4402579 - DNA, 12 bp, Homo sapiens
tggctattttat

SEQ ID NO: 4402580 - DNA, 15 bp, Homo sapiens
tggctatttttgaag

SEQ ID NO: 4402581 - DNA, 14 bp, Homo sapiens
tggctcacacctgt

SEQ ID NO: 4402582 - DNA, 12 bp, Homo sapiens
tggctcacactg

SEQ ID NO: 4402583 - DNA, 13 bp, Homo sapiens
tggctcacgcctg

SEQ ID NO: 4402584 - DNA, 14 bp, Homo sapiens
tggctcacgcctgt

SEQ ID NO: 4402585 - DNA, 17 bp, Homo sapiens
tggctcacgcctgtaat

SEQ ID NO: 4402586 - DNA, 21 bp, Homo sapiens
tggctcagacccctcagcccc

SEQ ID NO: 4402587 - DNA, 22 bp, Homo sapiens
tggctcagacccctcagcccca

SEQ ID NO: 4402588 - DNA, 19 bp, Homo sapiens
tggctccagtctcatcctc

SEQ ID NO: 4402589 - DNA, 23 bp, Homo sapiens
tggctcccatgaccatactgagg

SEQ ID NO: 4402590 - DNA, 17 bp, Homo sapiens
tggctccccctccccag

SEQ ID NO: 4402591 - DNA, 21 bp, Homo sapiens
tggctccccctccccaggctg

SEQ ID NO: 4402592 - DNA, 22 bp, Homo sapiens
tggctccccctccccaggctgg

SEQ ID NO: 4402593 - DNA, 23 bp, Homo sapiens
tggctccccctccccaggctgga

SEQ ID NO: 4402594 - DNA, 13 bp, Homo sapiens
tggctcccctgcc

SEQ ID NO: 4402595 - DNA, 21 bp, Homo sapiens
tggctcctgaggggcatctgc

SEQ ID NO: 4402596 - DNA, 15 bp, Homo sapiens
tggctcctgtctggc

SEQ ID NO: 4402597 - DNA, 17 bp, Homo sapiens
tggctcctgtctggctc

SEQ ID NO: 4402598 - DNA, 18 bp, Homo sapiens
tggctcggacccacccca

SEQ ID NO: 4402599 - DNA, 16 bp, Homo sapiens
tggctctgccccctcc

SEQ ID NO: 4402600 - DNA, 18 bp, Homo sapiens
tggctctgccccctcccc

SEQ ID NO: 4402601 - DNA, 15 bp, Homo sapiens
tggctctgccctgga

SEQ ID NO: 4402602 - DNA, 13 bp, Homo sapiens
tggctctgcctca

SEQ ID NO: 4402603 - DNA, 14 bp, Homo sapiens
tggctctgcctcag

SEQ ID NO: 4402604 - DNA, 15 bp, Homo sapiens
tggctcttctgccca

SEQ ID NO: 4402605 - DNA, 18 bp, Homo sapiens
tggctgaagaggaccaga

SEQ ID NO: 4402606 - DNA, 19 bp, Homo sapiens
tggctgaagaggaccagag

SEQ ID NO: 4402607 - DNA, 21 bp, Homo sapiens
tggctgaagaggaccagagga

SEQ ID NO: 4402608 - DNA, 21 bp, Homo sapiens
tggctgacccagtccctgggg

SEQ ID NO: 4402609 - DNA, 20 bp, Homo sapiens
tggctgacttacatcatgtg

SEQ ID NO: 4402610 - DNA, 17 bp, Homo sapiens
tggctgaggaggcctcc

SEQ ID NO: 4402611 - DNA, 20 bp, Homo sapiens
tggctgaggttcctctgcct

SEQ ID NO: 4402612 - DNA, 21 bp, Homo sapiens
tggctgaggttcctctgcctg

SEQ ID NO: 4402613 - DNA, 14 bp, Homo sapiens
tggctgataatttt

SEQ ID NO: 4402614 - DNA, 19 bp, Homo sapiens
tggctgataattttaaatt

SEQ ID NO: 4402615 - DNA, 12 bp, Homo sapiens
tggctgccacac

SEQ ID NO: 4402616 - DNA, 22 bp, Homo sapiens
tggctgccacacccaggggaag

SEQ ID NO: 4402617 - DNA, 16 bp, Homo sapiens
tggctgcgctaacccc

SEQ ID NO: 4402618 - DNA, 15 bp, Homo sapiens
tggctgctgccccca

SEQ ID NO: 4402619 - DNA, 16 bp, Homo sapiens
tggctggaatagtaaa

SEQ ID NO: 4402620 - DNA, 22 bp, Homo sapiens
tggctggctaactggaagcatg

SEQ ID NO: 4402621 - DNA, 14 bp, Homo sapiens
tggctggctcctag

SEQ ID NO: 4402622 - DNA, 16 bp, Homo sapiens
tggctgggggcaggag

SEQ ID NO: 4402623 - DNA, 14 bp, Homo sapiens
tggctggggtgtca

SEQ ID NO: 4402624 - DNA, 19 bp, Homo sapiens
tggctggggtgtcaataaa

SEQ ID NO: 4402625 - DNA, 17 bp, Homo sapiens
tggctggtagcagcagg

SEQ ID NO: 4402626 - DNA, 16 bp, Homo sapiens
tggctgtaatcatttg

SEQ ID NO: 4402627 - DNA, 22 bp, Homo sapiens
tggctgtgaatgccaaagccat

SEQ ID NO: 4402628 - DNA, 17 bp, Homo sapiens
tggctgtggcatccaga

SEQ ID NO: 4402629 - DNA, 20 bp, Homo sapiens
tggctgtggcctaacctgcc

SEQ ID NO: 4402630 - DNA, 15 bp, Homo sapiens
tggctgtttcatcag

SEQ ID NO: 4402631 - DNA, 18 bp, Homo sapiens
tggcttaagcctgtgtat

SEQ ID NO: 4402632 - DNA, 21 bp, Homo sapiens
tggcttaggaatgacttactt

SEQ ID NO: 4402633 - DNA, 14 bp, Homo sapiens
tggcttccagattt

SEQ ID NO: 4402634 - DNA, 18 bp, Homo sapiens
tggcttcggacaaaatat

SEQ ID NO: 4402635 - DNA, 20 bp, Homo sapiens
tggcttcggacaaaatatct

SEQ ID NO: 4402636 - DNA, 13 bp, Homo sapiens
tggcttctccagg

SEQ ID NO: 4402637 - DNA, 23 bp, Homo sapiens
tggcttctcgctgcgcagcctcc

SEQ ID NO: 4402638 - DNA, 20 bp, Homo sapiens
tggcttctgtggggcccctc

SEQ ID NO: 4402639 - DNA, 15 bp, Homo sapiens
tggcttctgtttcta

SEQ ID NO: 4402640 - DNA, 16 bp, Homo sapiens
tggcttctgtttctag

SEQ ID NO: 4402641 - DNA, 15 bp, Homo sapiens
tggcttgagaaatat

SEQ ID NO: 4402642 - DNA, 13 bp, Homo sapiens
tggctttaaataa

SEQ ID NO: 4402643 - DNA, 21 bp, Homo sapiens
tggctttaaataaattaagat

SEQ ID NO: 4402644 - DNA, 12 bp, Homo sapiens
tggctttcaaag

SEQ ID NO: 4402645 - DNA, 21 bp, Homo sapiens
tggctttccaggcaccctcag

SEQ ID NO: 4402646 - DNA, 17 bp, Homo sapiens
tggctttgaaacctcag

SEQ ID NO: 4402647 - DNA, 19 bp, Homo sapiens
tggctttgaaacctcaggg

SEQ ID NO: 4402648 - DNA, 21 bp, Homo sapiens
tggctttgcagctgctgtctg

SEQ ID NO: 4402649 - DNA, 14 bp, Homo sapiens
tggctttgcctctt

SEQ ID NO: 4402650 - DNA, 20 bp, Homo sapiens
tggctttgcctcttctttgt

SEQ ID NO: 4402651 - DNA, 12 bp, Homo sapiens
tggctttgctgt

SEQ ID NO: 4402652 - DNA, 22 bp, Homo sapiens
tggcttttattaatgcactttc

SEQ ID NO: 4402653 - DNA, 20 bp, Homo sapiens
tggcttttgcggttcaggaa

SEQ ID NO: 4402654 - DNA, 13 bp, Homo sapiens
tggctttttgaaa

SEQ ID NO: 4402655 - DNA, 17 bp, Homo sapiens
tggctttttgttcagaa

SEQ ID NO: 4402656 - DNA, 18 bp, Homo sapiens
tggctttttgttcagaat

SEQ ID NO: 4402657 - DNA, 19 bp, Homo sapiens
tgggaaatagcggccctgg

SEQ ID NO: 4402658 - DNA, 14 bp, Homo sapiens
tgggaacaaggaag

SEQ ID NO: 4402659 - DNA, 15 bp, Homo sapiens
tgggaacaaggaagg

SEQ ID NO: 4402660 - DNA, 16 bp, Homo sapiens
tgggaactatgaggag

SEQ ID NO: 4402661 - DNA, 17 bp, Homo sapiens
tgggaactatgaggagc

SEQ ID NO: 4402662 - DNA, 17 bp, Homo sapiens
tgggaacttgcgagtcc

SEQ ID NO: 4402663 - DNA, 18 bp, Homo sapiens
tgggaagaacagaattgc

SEQ ID NO: 4402664 - DNA, 13 bp, Homo sapiens
tgggaagaagaag

SEQ ID NO: 4402665 - DNA, 17 bp, Homo sapiens
tgggaagacgaggccct

SEQ ID NO: 4402666 - DNA, 22 bp, Homo sapiens
tgggaagactcaggagtctgcc

SEQ ID NO: 4402667 - DNA, 23 bp, Homo sapiens
tgggaagagaagagggcccagcc

SEQ ID NO: 4402668 - DNA, 19 bp, Homo sapiens
tgggaagcccatcctgacc

SEQ ID NO: 4402669 - DNA, 22 bp, Homo sapiens
tgggaagcccatcctgaccagc

SEQ ID NO: 4402670 - DNA, 15 bp, Homo sapiens
tgggaagctgagggc

SEQ ID NO: 4402671 - DNA, 21 bp, Homo sapiens
tgggaaggcgagtctggggac

SEQ ID NO: 4402672 - DNA, 17 bp, Homo sapiens
tgggaagtcgaggctgc

SEQ ID NO: 4402673 - DNA, 13 bp, Homo sapiens
tgggaagtgtgtt

SEQ ID NO: 4402674 - DNA, 15 bp, Homo sapiens
tgggaataaaagtat

SEQ ID NO: 4402675 - DNA, 16 bp, Homo sapiens
tgggaataattgcttt

SEQ ID NO: 4402676 - DNA, 17 bp, Homo sapiens
tgggaatgaggtgggag

SEQ ID NO: 4402677 - DNA, 19 bp, Homo sapiens
tgggaattcttgctgttaa

SEQ ID NO: 4402678 - DNA, 18 bp, Homo sapiens
tgggaattgcgctcaggg

SEQ ID NO: 4402679 - DNA, 17 bp, Homo sapiens
tgggacacagacccagg

SEQ ID NO: 4402680 - DNA, 22 bp, Homo sapiens
tgggacagaggagcaaggttta

SEQ ID NO: 4402681 - DNA, 17 bp, Homo sapiens
tgggacatggaaaagaa

SEQ ID NO: 4402682 - DNA, 21 bp, Homo sapiens
tgggaccctcagcagctctgg

SEQ ID NO: 4402683 - DNA, 23 bp, Homo sapiens
tgggaccctccagtgctggattt

SEQ ID NO: 4402684 - DNA, 19 bp, Homo sapiens
tgggacctgccaggcaggg

SEQ ID NO: 4402685 - DNA, 13 bp, Homo sapiens
tgggacggaccag

SEQ ID NO: 4402686 - DNA, 23 bp, Homo sapiens
ccccaactgtggtagctccagcg

SEQ ID NO: 4402687 - DNA, 17 bp, Homo sapiens
ccccaagactcccatga

SEQ ID NO: 4402688 - DNA, 20 bp, Homo sapiens
ccccaagaggaagttcagat

SEQ ID NO: 4402689 - DNA, 19 bp, Homo sapiens
ccccaagatgagctgcagc

SEQ ID NO: 4402690 - DNA, 21 bp, Homo sapiens
ccccaagatgagctgcagccc

SEQ ID NO: 4402691 - DNA, 15 bp, Homo sapiens
ccccaataaaccagt

SEQ ID NO: 4402692 - DNA, 19 bp, Homo sapiens
ccccaataaaccagtgtga

SEQ ID NO: 4402693 - DNA, 22 bp, Homo sapiens
ccccaataaaccagtgtgaacc

SEQ ID NO: 4402694 - DNA, 12 bp, Homo sapiens
ccccaataaagg

SEQ ID NO: 4402695 - DNA, 19 bp, Homo sapiens
ccccaataaaggcagctgc

SEQ ID NO: 4402696 - DNA, 23 bp, Homo sapiens
ccccaataaaggcagctgcctct

SEQ ID NO: 4402697 - DNA, 24 bp, Homo sapiens
ccccaataaaggcagctgcctctg

SEQ ID NO: 4402698 - DNA, 19 bp, Homo sapiens
ccccaatcgggtccagaga

SEQ ID NO: 4402699 - DNA, 20 bp, Homo sapiens
ccccaatcgggtccagagac

SEQ ID NO: 4402700 - DNA, 13 bp, Homo sapiens
ccccaattctccc

SEQ ID NO: 4402701 - DNA, 15 bp, Homo sapiens
ccccaattctcccct

SEQ ID NO: 4402702 - DNA, 22 bp, Homo sapiens
ccccacagaaccttcaacccag

SEQ ID NO: 4402703 - DNA, 12 bp, Homo sapiens
ccccacagctgg

SEQ ID NO: 4402704 - DNA, 13 bp, Homo sapiens
ccccaccagtgcc

SEQ ID NO: 4402705 - DNA, 18 bp, Homo sapiens
ccccaccagtgcctctcc

SEQ ID NO: 4402706 - DNA, 23 bp, Homo sapiens
ccccacccaactccacagggctg

SEQ ID NO: 4402707 - DNA, 16 bp, Homo sapiens
ccccaccccacacttg

SEQ ID NO: 4402708 - DNA, 17 bp, Homo sapiens
ccccaccccctccccag

SEQ ID NO: 4402709 - DNA, 17 bp, Homo sapiens
ccccacccccttcagtg

SEQ ID NO: 4402710 - DNA, 19 bp, Homo sapiens
ccccaccccggggaccctg

SEQ ID NO: 4402711 - DNA, 22 bp, Homo sapiens
ccccaccccggggaccctgtga

SEQ ID NO: 4402712 - DNA, 23 bp, Homo sapiens
ccccaccccggggaccctgtgac

SEQ ID NO: 4402713 - DNA, 13 bp, Homo sapiens
ccccacccctgcc

SEQ ID NO: 4402714 - DNA, 16 bp, Homo sapiens
ccccaccctccctgga

SEQ ID NO: 4402715 - DNA, 18 bp, Homo sapiens
ccccaccctccctggagt

SEQ ID NO: 4402716 - DNA, 12 bp, Homo sapiens
ccccacctgaag

SEQ ID NO: 4402717 - DNA, 14 bp, Homo sapiens
ccccacctgaaggg

SEQ ID NO: 4402718 - DNA, 16 bp, Homo sapiens
ccccacgagggctggc

SEQ ID NO: 4402719 - DNA, 18 bp, Homo sapiens
ccccacgagggctggctg

SEQ ID NO: 4402720 - DNA, 19 bp, Homo sapiens
ccccacggagacagaggaa

SEQ ID NO: 4402721 - DNA, 15 bp, Homo sapiens
ccccactctcattcc

SEQ ID NO: 4402722 - DNA, 15 bp, Homo sapiens
ccccactctccccac

SEQ ID NO: 4402723 - DNA, 12 bp, Homo sapiens
ccccactgcagg

SEQ ID NO: 4402724 - DNA, 16 bp, Homo sapiens
ccccactgcaggcccc

SEQ ID NO: 4402725 - DNA, 22 bp, Homo sapiens
ccccactttcaagacagatgag

SEQ ID NO: 4402726 - DNA, 14 bp, Homo sapiens
ccccagaaagcctc

SEQ ID NO: 4402727 - DNA, 21 bp, Homo sapiens
ccccagacccagaggtccagg

SEQ ID NO: 4402728 - DNA, 14 bp, Homo sapiens
ccccagaccccgcc

SEQ ID NO: 4402729 - DNA, 18 bp, Homo sapiens
ccccagactagatgtagt

SEQ ID NO: 4402730 - DNA, 15 bp, Homo sapiens
ccccagagcatctgc

SEQ ID NO: 4402731 - DNA, 19 bp, Homo sapiens
ccccagagcatctgcccca

SEQ ID NO: 4402732 - DNA, 20 bp, Homo sapiens
ccccagagcatctgccccag

SEQ ID NO: 4402733 - DNA, 14 bp, Homo sapiens
ccccagagctcccc

SEQ ID NO: 4402734 - DNA, 11 bp, Homo sapiens
ccccagagctg

SEQ ID NO: 4402735 - DNA, 12 bp, Homo sapiens
ccccagagctgt

SEQ ID NO: 4402736 - DNA, 22 bp, Homo sapiens
ccccagagctgtttatggcctc

SEQ ID NO: 4402737 - DNA, 17 bp, Homo sapiens
ccccagaggctcccaat

SEQ ID NO: 4402738 - DNA, 20 bp, Homo sapiens
ccccagaggctcccaatcag

SEQ ID NO: 4402739 - DNA, 22 bp, Homo sapiens
ccccagcaagcgggagcccgtg

SEQ ID NO: 4402740 - DNA, 16 bp, Homo sapiens
ccccagcactgaggaa

SEQ ID NO: 4402741 - DNA, 11 bp, Homo sapiens
ccccagcactt

SEQ ID NO: 4402742 - DNA, 14 bp, Homo sapiens
ccccagcattccag

SEQ ID NO: 4402743 - DNA, 23 bp, Homo sapiens
ccccagccagatggactccagcc

SEQ ID NO: 4402744 - DNA, 16 bp, Homo sapiens
ccccagccagcccttc

SEQ ID NO: 4402745 - DNA, 17 bp, Homo sapiens
ccccagccatccagggg

SEQ ID NO: 4402746 - DNA, 13 bp, Homo sapiens
ccccagcccacag

SEQ ID NO: 4402747 - DNA, 23 bp, Homo sapiens
ccccagccccctttgggcccagg

SEQ ID NO: 4402748 - DNA, 14 bp, Homo sapiens
ccccagcccctcct

SEQ ID NO: 4402749 - DNA, 15 bp, Homo sapiens
ccccagcccctcctc

SEQ ID NO: 4402750 - DNA, 16 bp, Homo sapiens
ccccagcccctcctcc

SEQ ID NO: 4402751 - DNA, 21 bp, Homo sapiens
ccccagcccctcctccctcag

SEQ ID NO: 4402752 - DNA, 20 bp, Homo sapiens
ccccagcctcattccccatt

SEQ ID NO: 4402753 - DNA, 14 bp, Homo sapiens
ccccagcctgggcc

SEQ ID NO: 4402754 - DNA, 11 bp, Homo sapiens
ccccagctccc

SEQ ID NO: 4402755 - DNA, 19 bp, Homo sapiens
ccccaggaagtggctcaga

SEQ ID NO: 4402756 - DNA, 12 bp, Homo sapiens
ccccaggacgcc

SEQ ID NO: 4402757 - DNA, 15 bp, Homo sapiens
ccccaggccagctgc

SEQ ID NO: 4402758 - DNA, 18 bp, Homo sapiens
ccccaggccccagacagg

SEQ ID NO: 4402759 - DNA, 15 bp, Homo sapiens
ccccaggccctccct

SEQ ID NO: 4402760 - DNA, 21 bp, Homo sapiens
ccccaggcctgtccaccctgc

SEQ ID NO: 4402761 - DNA, 15 bp, Homo sapiens
ccccaggctcgtgga

SEQ ID NO: 4402762 - DNA, 20 bp, Homo sapiens
ccccaggggagaaagaggag

SEQ ID NO: 4402763 - DNA, 23 bp, Homo sapiens
ccccagggggcggggtgcagaag

SEQ ID NO: 4402764 - DNA, 19 bp, Homo sapiens
ccccagggtcttccctacc

SEQ ID NO: 4402765 - DNA, 16 bp, Homo sapiens
ccccaggtacacctcc

SEQ ID NO: 4402766 - DNA, 23 bp, Homo sapiens
ccccagtcagcctctctcccagt

SEQ ID NO: 4402767 - DNA, 14 bp, Homo sapiens
ccccagtctcacct

SEQ ID NO: 4402768 - DNA, 15 bp, Homo sapiens
ccccagtgcctgcca

SEQ ID NO: 4402769 - DNA, 24 bp, Homo sapiens
ccccagtgcctgccactctctggg

SEQ ID NO: 4402770 - DNA, 17 bp, Homo sapiens
ccccagttccacagcag

SEQ ID NO: 4402771 - DNA, 23 bp, Homo sapiens
ccccagtttgcagaaaagcacct

SEQ ID NO: 4402772 - DNA, 17 bp, Homo sapiens
ccccatatataaattat

SEQ ID NO: 4402773 - DNA, 18 bp, Homo sapiens
ccccatcacccaagccac

SEQ ID NO: 4402774 - DNA, 16 bp, Homo sapiens
ccccatcagccctgct

SEQ ID NO: 4402775 - DNA, 14 bp, Homo sapiens
ccccatcagtgctc

SEQ ID NO: 4402776 - DNA, 19 bp, Homo sapiens
ccccatccagacctggctc

SEQ ID NO: 4402777 - DNA, 14 bp, Homo sapiens
ccccatccctgctt

SEQ ID NO: 4402778 - DNA, 16 bp, Homo sapiens
ccccatcctcatccct

SEQ ID NO: 4402779 - DNA, 18 bp, Homo sapiens
ccccatcctcatccctga

SEQ ID NO: 4402780 - DNA, 19 bp, Homo sapiens
ccccatctccctgcctggc

SEQ ID NO: 4402781 - DNA, 21 bp, Homo sapiens
ccccatctgtccagctggggc

SEQ ID NO: 4402782 - DNA, 22 bp, Homo sapiens
ccccatgccaaagctagggtgg

SEQ ID NO: 4402783 - DNA, 12 bp, Homo sapiens
ccccatgcctgt

SEQ ID NO: 4402784 - DNA, 15 bp, Homo sapiens
ccccatgcctgtcca

SEQ ID NO: 4402785 - DNA, 18 bp, Homo sapiens
ccccatgcctgtccagcc

SEQ ID NO: 4402786 - DNA, 24 bp, Homo sapiens
ccccatgcctgtccagcctgggca

SEQ ID NO: 4402787 - DNA, 18 bp, Homo sapiens
ccccatggccccaggccc

SEQ ID NO: 4402788 - DNA, 12 bp, Homo sapiens
ccccatgggctg

SEQ ID NO: 4402789 - DNA, 12 bp, Homo sapiens
ccccattccctc

SEQ ID NO: 4402790 - DNA, 20 bp, Homo sapiens
ccccattccttgcgcctcag

SEQ ID NO: 4402791 - DNA, 20 bp, Homo sapiens
ccccattctgtgtcccatgt

SEQ ID NO: 4402792 - DNA, 16 bp, Homo sapiens
ccccatttcccatctg

SEQ ID NO: 4402793 - DNA, 13 bp, Homo sapiens
ccccatttcctca

SEQ ID NO: 4402794 - DNA, 19 bp, Homo sapiens
ccccatttctgcctcgctc

SEQ ID NO: 4402795 - DNA, 14 bp, Homo sapiens
ccccatttgtccca

SEQ ID NO: 4402796 - DNA, 21 bp, Homo sapiens
cccccaaacatctggcatggc

SEQ ID NO: 4402797 - DNA, 23 bp, Homo sapiens
cccccaacccctcctccctcaga

SEQ ID NO: 4402798 - DNA, 15 bp, Homo sapiens
cccccaacctttccc

SEQ ID NO: 4402799 - DNA, 16 bp, Homo sapiens
cccccaactccaggaa

SEQ ID NO: 4402800 - DNA, 21 bp, Homo sapiens
cccccaacttcaccaccccct

SEQ ID NO: 4402801 - DNA, 21 bp, Homo sapiens
cccccaataaaccagtgtgaa

SEQ ID NO: 4402802 - DNA, 13 bp, Homo sapiens
cccccaataaagg

SEQ ID NO: 4402803 - DNA, 22 bp, Homo sapiens
cccccaataaaggcagctgcct

SEQ ID NO: 4402804 - DNA, 14 bp, Homo sapiens
ttcattaaataaat

SEQ ID NO: 4402805 - DNA, 16 bp, Homo sapiens
ttcattaacaaaatgt

SEQ ID NO: 4402806 - DNA, 12 bp, Homo sapiens
ttcattacttga

SEQ ID NO: 4402807 - DNA, 15 bp, Homo sapiens
ttcattacttgaatg

SEQ ID NO: 4402808 - DNA, 16 bp, Homo sapiens
ttcattatgctttgaa

SEQ ID NO: 4402809 - DNA, 17 bp, Homo sapiens
ttcattcacttctctta

SEQ ID NO: 4402810 - DNA, 22 bp, Homo sapiens
ttcattcctcacaatgaggcta

SEQ ID NO: 4402811 - DNA, 19 bp, Homo sapiens
ttcattcggtgtgaacttt

SEQ ID NO: 4402812 - DNA, 18 bp, Homo sapiens
ttcattctcataattcct

SEQ ID NO: 4402813 - DNA, 18 bp, Homo sapiens
ttcattctccctttcact

SEQ ID NO: 4402814 - DNA, 21 bp, Homo sapiens
ttcattctcgtgagtcattta

SEQ ID NO: 4402815 - DNA, 13 bp, Homo sapiens
ttcattcttgtat

SEQ ID NO: 4402816 - DNA, 14 bp, Homo sapiens
ttcattgctaagac

SEQ ID NO: 4402817 - DNA, 18 bp, Homo sapiens
ttcatttcagggtcttgg

SEQ ID NO: 4402818 - DNA, 11 bp, Homo sapiens
ttcatttcatt

SEQ ID NO: 4402819 - DNA, 12 bp, Homo sapiens
ttcatttccagc

SEQ ID NO: 4402820 - DNA, 13 bp, Homo sapiens
ttcatttctagac

SEQ ID NO: 4402821 - DNA, 15 bp, Homo sapiens
ttcatttctagactc

SEQ ID NO: 4402822 - DNA, 11 bp, Homo sapiens
ttcatttctta

SEQ ID NO: 4402823 - DNA, 18 bp, Homo sapiens
ttcatttgtaaaaatgag

SEQ ID NO: 4402824 - DNA, 18 bp, Homo sapiens
ttcattttaactggcatg

SEQ ID NO: 4402825 - DNA, 18 bp, Homo sapiens
ttcattttactgtatatt

SEQ ID NO: 4402826 - DNA, 12 bp, Homo sapiens
ttcattttagat

SEQ ID NO: 4402827 - DNA, 20 bp, Homo sapiens
ttcattttctagatacaata

SEQ ID NO: 4402828 - DNA, 21 bp, Homo sapiens
ttcattttctagatacaataa

SEQ ID NO: 4402829 - DNA, 18 bp, Homo sapiens
ttcattttgttttgctct

SEQ ID NO: 4402830 - DNA, 17 bp, Homo sapiens
ttcattttttaatgtgc

SEQ ID NO: 4402831 - DNA, 14 bp, Homo sapiens
ttcatttttttcca

SEQ ID NO: 4402832 - DNA, 20 bp, Homo sapiens
ttccaaaataatctatatta

SEQ ID NO: 4402833 - DNA, 23 bp, Homo sapiens
ttccaaaataatctatattaaat

SEQ ID NO: 4402834 - DNA, 18 bp, Homo sapiens
ttccaaaatctcccattt

SEQ ID NO: 4402835 - DNA, 19 bp, Homo sapiens
ttccaaagaatattttgat

SEQ ID NO: 4402836 - DNA, 12 bp, Homo sapiens
ttccaaagcaaa

SEQ ID NO: 4402837 - DNA, 17 bp, Homo sapiens
ttccaaataaaatgttc

SEQ ID NO: 4402838 - DNA, 20 bp, Homo sapiens
ttccaaataaaatgttccct

SEQ ID NO: 4402839 - DNA, 13 bp, Homo sapiens
ttccaaattattt

SEQ ID NO: 4402840 - DNA, 16 bp, Homo sapiens
ttccaaattatttctt

SEQ ID NO: 4402841 - DNA, 20 bp, Homo sapiens
ttccaaattcagtttcataa

SEQ ID NO: 4402842 - DNA, 14 bp, Homo sapiens
ttccaagaacctat

SEQ ID NO: 4402843 - DNA, 14 bp, Homo sapiens
ttccaagaggctgt

SEQ ID NO: 4402844 - DNA, 15 bp, Homo sapiens
ttccaagaggctgta

SEQ ID NO: 4402845 - DNA, 23 bp, Homo sapiens
ttccaagcttccatagctgctgc

SEQ ID NO: 4402846 - DNA, 17 bp, Homo sapiens
ttccaagtcatttttgt

SEQ ID NO: 4402847 - DNA, 18 bp, Homo sapiens
ttccaatagaaagaaact

SEQ ID NO: 4402848 - DNA, 24 bp, Homo sapiens
ttccaatatttctgctttctttga

SEQ ID NO: 4402849 - DNA, 12 bp, Homo sapiens
ttccacaaaatt

SEQ ID NO: 4402850 - DNA, 22 bp, Homo sapiens
ttccacaccttttattgacaca

SEQ ID NO: 4402851 - DNA, 13 bp, Homo sapiens
ttccacagcagtg

SEQ ID NO: 4402852 - DNA, 23 bp, Homo sapiens
ttccacagtggcgggcccactca

SEQ ID NO: 4402853 - DNA, 16 bp, Homo sapiens
ttccaccttaaattaa

SEQ ID NO: 4402854 - DNA, 17 bp, Homo sapiens
ttccaccttaaattaaa

SEQ ID NO: 4402855 - DNA, 18 bp, Homo sapiens
ttccaccttaaattaaac

SEQ ID NO: 4402856 - DNA, 17 bp, Homo sapiens
ttccactacacctggct

SEQ ID NO: 4402857 - DNA, 19 bp, Homo sapiens
ttccactacacctggctga

SEQ ID NO: 4402858 - DNA, 22 bp, Homo sapiens
ttccactacacctggctgaggt

SEQ ID NO: 4402859 - DNA, 14 bp, Homo sapiens
ttccactgaaaatt

SEQ ID NO: 4402860 - DNA, 18 bp, Homo sapiens
ttccactgaaaatttaac

SEQ ID NO: 4402861 - DNA, 13 bp, Homo sapiens
ttccactgtgcta

SEQ ID NO: 4402862 - DNA, 15 bp, Homo sapiens
ttccagaacagccct

SEQ ID NO: 4402863 - DNA, 19 bp, Homo sapiens
ttccagaacagccctcggc

SEQ ID NO: 4402864 - DNA, 22 bp, Homo sapiens
ttccagacattctcgcttccct

SEQ ID NO: 4402865 - DNA, 19 bp, Homo sapiens
ttccagactcaggttccag

SEQ ID NO: 4402866 - DNA, 14 bp, Homo sapiens
ttccagacttcaaa

SEQ ID NO: 4402867 - DNA, 16 bp, Homo sapiens
ttccagagcagagcct

SEQ ID NO: 4402868 - DNA, 19 bp, Homo sapiens
ttccagagttgttgtttgc

SEQ ID NO: 4402869 - DNA, 20 bp, Homo sapiens
ttccagagttgttgtttgcc

SEQ ID NO: 4402870 - DNA, 22 bp, Homo sapiens
ttccagatcccaggcccctgga

SEQ ID NO: 4402871 - DNA, 15 bp, Homo sapiens
ttccagatcctctct

SEQ ID NO: 4402872 - DNA, 22 bp, Homo sapiens
ttccagcaattctcctgcctca

SEQ ID NO: 4402873 - DNA, 24 bp, Homo sapiens
ttccagcatgaggtatctaaggat

SEQ ID NO: 4402874 - DNA, 15 bp, Homo sapiens
ttccagcatttttat

SEQ ID NO: 4402875 - DNA, 17 bp, Homo sapiens
ttccagccaaagcatgc

SEQ ID NO: 4402876 - DNA, 20 bp, Homo sapiens
ttccagccacattgagactt

SEQ ID NO: 4402877 - DNA, 21 bp, Homo sapiens
ttccagccacattgagacttt

SEQ ID NO: 4402878 - DNA, 16 bp, Homo sapiens
ttccagccttatgtgt

SEQ ID NO: 4402879 - DNA, 23 bp, Homo sapiens
ttccagctcaccccccacactca

SEQ ID NO: 4402880 - DNA, 13 bp, Homo sapiens
ttccagctctgcc

SEQ ID NO: 4402881 - DNA, 14 bp, Homo sapiens
ttccagctctgccc

SEQ ID NO: 4402882 - DNA, 16 bp, Homo sapiens
ttccagctctgccccc

SEQ ID NO: 4402883 - DNA, 23 bp, Homo sapiens
ttccaggaaactccacatctgcc

SEQ ID NO: 4402884 - DNA, 23 bp, Homo sapiens
ttccaggcttccctgacttgctt

SEQ ID NO: 4402885 - DNA, 17 bp, Homo sapiens
ttccaggggaacctgcc

SEQ ID NO: 4402886 - DNA, 21 bp, Homo sapiens
ttccaggtacccttctcgctt

SEQ ID NO: 4402887 - DNA, 18 bp, Homo sapiens
ttccaggtattaaaggtt

SEQ ID NO: 4402888 - DNA, 16 bp, Homo sapiens
ttccaggtctgcctgg

SEQ ID NO: 4402889 - DNA, 21 bp, Homo sapiens
ttccagtcctaactttctgaa

SEQ ID NO: 4402890 - DNA, 20 bp, Homo sapiens
ttccagtcttcctgacactt

SEQ ID NO: 4402891 - DNA, 19 bp, Homo sapiens
ttccagtgacttgcaatcc

SEQ ID NO: 4402892 - DNA, 22 bp, Homo sapiens
ttccagttttgtggattaaacc

SEQ ID NO: 4402893 - DNA, 16 bp, Homo sapiens
ttccatagctgctgcc

SEQ ID NO: 4402894 - DNA, 17 bp, Homo sapiens
ttccatagctgctgccc

SEQ ID NO: 4402895 - DNA, 18 bp, Homo sapiens
ttccatcatcactgtaaa

SEQ ID NO: 4402896 - DNA, 20 bp, Homo sapiens
ttccatcatcactgtaaaga

SEQ ID NO: 4402897 - DNA, 18 bp, Homo sapiens
ttccatcatgtctgtata

SEQ ID NO: 4402898 - DNA, 19 bp, Homo sapiens
ttccatctcccttggttgt

SEQ ID NO: 4402899 - DNA, 18 bp, Homo sapiens
ttccatctttacaaaact

SEQ ID NO: 4402900 - DNA, 17 bp, Homo sapiens
ttccatgattctattta

SEQ ID NO: 4402901 - DNA, 13 bp, Homo sapiens
ttccatgtgcctt

SEQ ID NO: 4402902 - DNA, 19 bp, Homo sapiens
ttccatgtgcctttctttg

SEQ ID NO: 4402903 - DNA, 23 bp, Homo sapiens
ttccatgtgcctttctttgcctc

SEQ ID NO: 4402904 - DNA, 15 bp, Homo sapiens
ttccatttggcacta

SEQ ID NO: 4402905 - DNA, 14 bp, Homo sapiens
ttccattttaagtg

SEQ ID NO: 4402906 - DNA, 23 bp, Homo sapiens
ttccatttttttctttacttatc

SEQ ID NO: 4402907 - DNA, 19 bp, Homo sapiens
ttcccaaaacaatctattt

SEQ ID NO: 4402908 - DNA, 18 bp, Homo sapiens
ttcccaaagtgaactctc

SEQ ID NO: 4402909 - DNA, 16 bp, Homo sapiens
ttcccaacatttctta

SEQ ID NO: 4402910 - DNA, 16 bp, Homo sapiens
ttcccaacctgctcat

SEQ ID NO: 4402911 - DNA, 20 bp, Homo sapiens
ttcccaacttctcttgcttt

SEQ ID NO: 4402912 - DNA, 18 bp, Homo sapiens
ttcccaatctgaaattca

SEQ ID NO: 4402913 - DNA, 15 bp, Homo sapiens
ttcccacatgcctgc

SEQ ID NO: 4402914 - DNA, 18 bp, Homo sapiens
ttcccacctctctcccca

SEQ ID NO: 4402915 - DNA, 20 bp, Homo sapiens
ttcccactgcactccagcct

SEQ ID NO: 4402916 - DNA, 20 bp, Homo sapiens
ttcccacttaaaaattaaat

SEQ ID NO: 4402917 - DNA, 22 bp, Homo sapiens
ttcccagagacaggaaaatcct

SEQ ID NO: 4402918 - DNA, 23 bp, Homo sapiens
ttcccagcccctcctccctcagg

SEQ ID NO: 4402919 - DNA, 21 bp, Homo sapiens
ttcccagcccctgcagattct

SEQ ID NO: 4402920 - DNA, 14 bp, Homo sapiens
ttcccagctctccc

SEQ ID NO: 4402921 - DNA, 20 bp, Homo sapiens
ttcccagctctccctctggc

SEQ ID NO: 4402922 - DNA, 15 bp, Homo sapiens
ttctctccccagccc

SEQ ID NO: 4402923 - DNA, 17 bp, Homo sapiens
ttctctccccagccccc

SEQ ID NO: 4402924 - DNA, 22 bp, Homo sapiens
ttctctcctgtcctccctcacc

SEQ ID NO: 4402925 - DNA, 14 bp, Homo sapiens
ttctctccttgccc

SEQ ID NO: 4402926 - DNA, 19 bp, Homo sapiens
ttctctctcctctctgctt

SEQ ID NO: 4402927 - DNA, 17 bp, Homo sapiens
ttctctctgttacacac

SEQ ID NO: 4402928 - DNA, 13 bp, Homo sapiens
ttctctcttttaa

SEQ ID NO: 4402929 - DNA, 17 bp, Homo sapiens
ttctctcttttaaagta

SEQ ID NO: 4402930 - DNA, 18 bp, Homo sapiens
ttctctgagctgtgcagg

SEQ ID NO: 4402931 - DNA, 23 bp, Homo sapiens
ttctctgatttgtaatgagcacc

SEQ ID NO: 4402932 - DNA, 19 bp, Homo sapiens
ttctctgcaattttactgt

SEQ ID NO: 4402933 - DNA, 11 bp, Homo sapiens
ttctctgcagt

SEQ ID NO: 4402934 - DNA, 12 bp, Homo sapiens
ttctctgcagta

SEQ ID NO: 4402935 - DNA, 16 bp, Homo sapiens
ttctctgcccagccgg

SEQ ID NO: 4402936 - DNA, 17 bp, Homo sapiens
ttctctggcaaactttt

SEQ ID NO: 4402937 - DNA, 18 bp, Homo sapiens
ttctctgtacttttcatt

SEQ ID NO: 4402938 - DNA, 12 bp, Homo sapiens
ttctctgtctca

SEQ ID NO: 4402939 - DNA, 13 bp, Homo sapiens
ttctctgtctcat

SEQ ID NO: 4402940 - DNA, 22 bp, Homo sapiens
ttctctgtgaaagctttggaaa

SEQ ID NO: 4402941 - DNA, 20 bp, Homo sapiens
ttctctgttgtcgtaaagat

SEQ ID NO: 4402942 - DNA, 22 bp, Homo sapiens
ttctctgttgtcgtaaagattt

SEQ ID NO: 4402943 - DNA, 23 bp, Homo sapiens
ttctctgttgtcgtaaagatttg

SEQ ID NO: 4402944 - DNA, 17 bp, Homo sapiens
ttctcttgacagtctga

SEQ ID NO: 4402945 - DNA, 20 bp, Homo sapiens
ttctcttgacagtctgaagc

SEQ ID NO: 4402946 - DNA, 15 bp, Homo sapiens
ttctcttgtaccata

SEQ ID NO: 4402947 - DNA, 20 bp, Homo sapiens
ttctctttaattttaactga

SEQ ID NO: 4402948 - DNA, 17 bp, Homo sapiens
ttctcttttctttctgt

SEQ ID NO: 4402949 - DNA, 14 bp, Homo sapiens
ttctgaaatacttt

SEQ ID NO: 4402950 - DNA, 16 bp, Homo sapiens
ttctgaaatacttttg

SEQ ID NO: 4402951 - DNA, 13 bp, Homo sapiens
ttctgaactaaag

SEQ ID NO: 4402952 - DNA, 18 bp, Homo sapiens
ttctgaagaaaaattact

SEQ ID NO: 4402953 - DNA, 17 bp, Homo sapiens
ttctgaagtgcttgtat

SEQ ID NO: 4402954 - DNA, 18 bp, Homo sapiens
ttctgaagtgcttgtata

SEQ ID NO: 4402955 - DNA, 12 bp, Homo sapiens
ttctgaagtttt

SEQ ID NO: 4402956 - DNA, 20 bp, Homo sapiens
ttctgaagttttattttaaa

SEQ ID NO: 4402957 - DNA, 21 bp, Homo sapiens
ttctgaagttttattttaaat

SEQ ID NO: 4402958 - DNA, 22 bp, Homo sapiens
ttctgaatcaccaattaaaaac

SEQ ID NO: 4402959 - DNA, 23 bp, Homo sapiens
ttctgaattggctaaaagacatg

SEQ ID NO: 4402960 - DNA, 14 bp, Homo sapiens
ttctgaatttgcaa

SEQ ID NO: 4402961 - DNA, 17 bp, Homo sapiens
ttctgaatttgcaaagt

SEQ ID NO: 4402962 - DNA, 21 bp, Homo sapiens
ttctgaatttgcaaagtactg

SEQ ID NO: 4402963 - DNA, 13 bp, Homo sapiens
ttctgacaattaa

SEQ ID NO: 4402964 - DNA, 15 bp, Homo sapiens
ttctgacaattaaca

SEQ ID NO: 4402965 - DNA, 19 bp, Homo sapiens
ttctgacatcaaaacttgg

SEQ ID NO: 4402966 - DNA, 23 bp, Homo sapiens
ttctgacatgtaagaaaatgtta

SEQ ID NO: 4402967 - DNA, 13 bp, Homo sapiens
ttctgactgcccc

SEQ ID NO: 4402968 - DNA, 15 bp, Homo sapiens
ttctgactgtccagg

SEQ ID NO: 4402969 - DNA, 13 bp, Homo sapiens
ttctgacttttac

SEQ ID NO: 4402970 - DNA, 16 bp, Homo sapiens
ttctgagaaagactat

SEQ ID NO: 4402971 - DNA, 21 bp, Homo sapiens
ttctgagattcaatattgaat

SEQ ID NO: 4402972 - DNA, 15 bp, Homo sapiens
ttctgagcaaaggcc

SEQ ID NO: 4402973 - DNA, 18 bp, Homo sapiens
ttctgagcaaaggccctg

SEQ ID NO: 4402974 - DNA, 14 bp, Homo sapiens
ttctgagttttgtg

SEQ ID NO: 4402975 - DNA, 22 bp, Homo sapiens
ttctgagttttgtgtttgttgt

SEQ ID NO: 4402976 - DNA, 14 bp, Homo sapiens
ttctgatactttag

SEQ ID NO: 4402977 - DNA, 17 bp, Homo sapiens
ttctgatatgtgaattt

SEQ ID NO: 4402978 - DNA, 16 bp, Homo sapiens
ttctgatctgtacttt

SEQ ID NO: 4402979 - DNA, 14 bp, Homo sapiens
ttctgatgaaatgt

SEQ ID NO: 4402980 - DNA, 11 bp, Homo sapiens
ttctgatttct

SEQ ID NO: 4402981 - DNA, 13 bp, Homo sapiens
ttctgatttctga

SEQ ID NO: 4402982 - DNA, 17 bp, Homo sapiens
ttctgcaaatagaaaac

SEQ ID NO: 4402983 - DNA, 19 bp, Homo sapiens
ttctgcaaatagaaaacag

SEQ ID NO: 4402984 - DNA, 23 bp, Homo sapiens
ttctgcaaatagaaaacaggaaa

SEQ ID NO: 4402985 - DNA, 18 bp, Homo sapiens
ttctgcaccacacctggc

SEQ ID NO: 4402986 - DNA, 20 bp, Homo sapiens
ttctgcagatcttccgtggt

SEQ ID NO: 4402987 - DNA, 14 bp, Homo sapiens
ttctgcagcaactc

SEQ ID NO: 4402988 - DNA, 15 bp, Homo sapiens
ttctgcagtaaatct

SEQ ID NO: 4402989 - DNA, 18 bp, Homo sapiens
ttctgcagtaaatctttt

SEQ ID NO: 4402990 - DNA, 21 bp, Homo sapiens
ttctgcatatgttgaatactt

SEQ ID NO: 4402991 - DNA, 22 bp, Homo sapiens
ttctgcatatgttgaatacttt

SEQ ID NO: 4402992 - DNA, 17 bp, Homo sapiens
ttctgccacccctaaac

SEQ ID NO: 4402993 - DNA, 13 bp, Homo sapiens
ttctgccctggct

SEQ ID NO: 4402994 - DNA, 14 bp, Homo sapiens
ttctgccctggctg

SEQ ID NO: 4402995 - DNA, 14 bp, Homo sapiens
ttctgcctcctggc

SEQ ID NO: 4402996 - DNA, 13 bp, Homo sapiens
ttctgcctccttt

SEQ ID NO: 4402997 - DNA, 17 bp, Homo sapiens
ttctgcctcctttagta

SEQ ID NO: 4402998 - DNA, 13 bp, Homo sapiens
ttctgcctctaag

SEQ ID NO: 4402999 - DNA, 12 bp, Homo sapiens
ttctgcctctcc

SEQ ID NO: 4403000 - DNA, 21 bp, Homo sapiens
ttctgcctgttataactctgc

SEQ ID NO: 4403001 - DNA, 24 bp, Homo sapiens
ttctgcctgttataactctgcact

SEQ ID NO: 4403002 - DNA, 18 bp, Homo sapiens
ttctgccttggattccta

SEQ ID NO: 4403003 - DNA, 15 bp, Homo sapiens
ttctgctaaatatca

SEQ ID NO: 4403004 - DNA, 21 bp, Homo sapiens
ttctgctactttgctgctatg

SEQ ID NO: 4403005 - DNA, 14 bp, Homo sapiens
ttctgctatgtgtg

SEQ ID NO: 4403006 - DNA, 9 bp, Homo sapiens
ttctgctcc

SEQ ID NO: 4403007 - DNA, 15 bp, Homo sapiens
ttctgctccaccctt

SEQ ID NO: 4403008 - DNA, 16 bp, Homo sapiens
ttctgctccacccttg

SEQ ID NO: 4403009 - DNA, 18 bp, Homo sapiens
ttctgctccacccttggc

SEQ ID NO: 4403010 - DNA, 22 bp, Homo sapiens
ttctgctctggttgtttctgtt

SEQ ID NO: 4403011 - DNA, 16 bp, Homo sapiens
ttctgctcttttcctg

SEQ ID NO: 4403012 - DNA, 17 bp, Homo sapiens
ttctgctcttttcctgg

SEQ ID NO: 4403013 - DNA, 17 bp, Homo sapiens
ttctgctggcatcaaga

SEQ ID NO: 4403014 - DNA, 17 bp, Homo sapiens
ttctgctgtctgggact

SEQ ID NO: 4403015 - DNA, 16 bp, Homo sapiens
ttctgcttttaagttt

SEQ ID NO: 4403016 - DNA, 19 bp, Homo sapiens
ttctggaagactgctcccg

SEQ ID NO: 4403017 - DNA, 18 bp, Homo sapiens
ttctggactctgccccaa

SEQ ID NO: 4403018 - DNA, 14 bp, Homo sapiens
ttctggagctggga

SEQ ID NO: 4403019 - DNA, 20 bp, Homo sapiens
ttctggagctgggagacaaa

SEQ ID NO: 4403020 - DNA, 17 bp, Homo sapiens
ttctggccagtgtttaa

SEQ ID NO: 4403021 - DNA, 19 bp, Homo sapiens
ttctggcgcccctgcctgt

SEQ ID NO: 4403022 - DNA, 22 bp, Homo sapiens
ttctggcgcccctgcctgtgcc

SEQ ID NO: 4403023 - DNA, 17 bp, Homo sapiens
ttctggctacctgtttg

SEQ ID NO: 4403024 - DNA, 19 bp, Homo sapiens
ttctggctgtgatcttaaa

SEQ ID NO: 4403025 - DNA, 15 bp, Homo sapiens
ttctggctgtttgag

SEQ ID NO: 4403026 - DNA, 14 bp, Homo sapiens
ttctgggaagggag

SEQ ID NO: 4403027 - DNA, 21 bp, Homo sapiens
ttctgggaagggagagttctt

SEQ ID NO: 4403028 - DNA, 23 bp, Homo sapiens
ttctgggatatatggaggattct

SEQ ID NO: 4403029 - DNA, 14 bp, Homo sapiens
ttctgggctggggc

SEQ ID NO: 4403030 - DNA, 16 bp, Homo sapiens
ttctggggctgtgtta

SEQ ID NO: 4403031 - DNA, 20 bp, Homo sapiens
ttctggtgctactccatgca

SEQ ID NO: 4403032 - DNA, 19 bp, Homo sapiens
ttctggtgttgactggact

SEQ ID NO: 4403033 - DNA, 14 bp, Homo sapiens
ttctggttctaact

SEQ ID NO: 4403034 - DNA, 21 bp, Homo sapiens
ttctggttctaactgctgtta

SEQ ID NO: 4403035 - DNA, 20 bp, Homo sapiens
ttctgtaatatttacaatgt

SEQ ID NO: 4403036 - DNA, 21 bp, Homo sapiens
ttctgtaatatttacaatgta

SEQ ID NO: 4403037 - DNA, 16 bp, Homo sapiens
ttctgtaatgtaaata

SEQ ID NO: 4403038 - DNA, 14 bp, Homo sapiens
ttctgtaatttgaa

SEQ ID NO: 4403039 - DNA, 19 bp, Homo sapiens
ttctgtacatttgcaatta

SEQ ID NO: 4403040 - DNA, 11 bp, Homo sapiens
ttctgtaccag

SEQ ID NO: 4403041 - DNA, 15 bp, Homo sapiens
aagtcaaaatatgta

SEQ ID NO: 4403042 - DNA, 22 bp, Homo sapiens
cactgtaaatatccctcccctc

SEQ ID NO: 4403043 - DNA, 17 bp, Homo sapiens
cactgtatataaacata

SEQ ID NO: 4403044 - DNA, 14 bp, Homo sapiens
cactgtatccaggt

SEQ ID NO: 4403045 - DNA, 21 bp, Homo sapiens
cactgtccaatatgaaaaccg

SEQ ID NO: 4403046 - DNA, 17 bp, Homo sapiens
cactgtctagagcaact

SEQ ID NO: 4403047 - DNA, 13 bp, Homo sapiens
cactgtgcaggtg

SEQ ID NO: 4403048 - DNA, 17 bp, Homo sapiens
cactgtgggaaggccag

SEQ ID NO: 4403049 - DNA, 18 bp, Homo sapiens
cactgtggtcgtcaactt

SEQ ID NO: 4403050 - DNA, 23 bp, Homo sapiens
cactgtggtcgtcaactttcctc

SEQ ID NO: 4403051 - DNA, 21 bp, Homo sapiens
cactgtgtactggagcctgca

SEQ ID NO: 4403052 - DNA, 15 bp, Homo sapiens
cactgttaaaataaa

SEQ ID NO: 4403053 - DNA, 17 bp, Homo sapiens
cactgttaaaataaagc

SEQ ID NO: 4403054 - DNA, 15 bp, Homo sapiens
cactgttagaacact

SEQ ID NO: 4403055 - DNA, 16 bp, Homo sapiens
cactgttagaacacta

SEQ ID NO: 4403056 - DNA, 21 bp, Homo sapiens
cactgttagaacactattttc

SEQ ID NO: 4403057 - DNA, 16 bp, Homo sapiens
cactgttctgttctca

SEQ ID NO: 4403058 - DNA, 21 bp, Homo sapiens
cactgtttaagtactgtttac

SEQ ID NO: 4403059 - DNA, 14 bp, Homo sapiens
cacttaaactttgt

SEQ ID NO: 4403060 - DNA, 17 bp, Homo sapiens
cacttaaactttgtcac

SEQ ID NO: 4403061 - DNA, 21 bp, Homo sapiens
cacttaaactttgtcacttct

SEQ ID NO: 4403062 - DNA, 21 bp, Homo sapiens
cacttaaagggtcttatgaaa

SEQ ID NO: 4403063 - DNA, 21 bp, Homo sapiens
cacttaagactgtgtattcta

SEQ ID NO: 4403064 - DNA, 13 bp, Homo sapiens
cacttaatagcaa

SEQ ID NO: 4403065 - DNA, 16 bp, Homo sapiens
cacttaatagcaacag

SEQ ID NO: 4403066 - DNA, 14 bp, Homo sapiens
cacttaatcatttt

SEQ ID NO: 4403067 - DNA, 14 bp, Homo sapiens
cacttaatgtatgt

SEQ ID NO: 4403068 - DNA, 17 bp, Homo sapiens
cacttacaagaaaggcc

SEQ ID NO: 4403069 - DNA, 15 bp, Homo sapiens
cacttacgtaaaaca

SEQ ID NO: 4403070 - DNA, 17 bp, Homo sapiens
cacttacgtaaaacatt

SEQ ID NO: 4403071 - DNA, 18 bp, Homo sapiens
cacttacgtaaaacattt

SEQ ID NO: 4403072 - DNA, 16 bp, Homo sapiens
cacttagacctgccag

SEQ ID NO: 4403073 - DNA, 18 bp, Homo sapiens
cacttagacctgccagcc

SEQ ID NO: 4403074 - DNA, 14 bp, Homo sapiens
cacttagatttaaa

SEQ ID NO: 4403075 - DNA, 16 bp, Homo sapiens
cacttagcccaagagg

SEQ ID NO: 4403076 - DNA, 23 bp, Homo sapiens
cacttagcccaagaggtctgagc

SEQ ID NO: 4403077 - DNA, 16 bp, Homo sapiens
cacttatctgatactt

SEQ ID NO: 4403078 - DNA, 14 bp, Homo sapiens
cacttatcttctgg

SEQ ID NO: 4403079 - DNA, 22 bp, Homo sapiens
cacttcaatgtgtcatttccgg

SEQ ID NO: 4403080 - DNA, 13 bp, Homo sapiens
cacttcaccccca

SEQ ID NO: 4403081 - DNA, 14 bp, Homo sapiens
cacttcacccccaa

SEQ ID NO: 4403082 - DNA, 15 bp, Homo sapiens
cacttcacccccaac

SEQ ID NO: 4403083 - DNA, 18 bp, Homo sapiens
cacttcacccccaacttc

SEQ ID NO: 4403084 - DNA, 14 bp, Homo sapiens
cacttcataatcca

SEQ ID NO: 4403085 - DNA, 14 bp, Homo sapiens
cacttccaggggaa

SEQ ID NO: 4403086 - DNA, 17 bp, Homo sapiens
cacttccaggggaacct

SEQ ID NO: 4403087 - DNA, 12 bp, Homo sapiens
cacttccaggtc

SEQ ID NO: 4403088 - DNA, 18 bp, Homo sapiens
cacttccaggtctgcctg

SEQ ID NO: 4403089 - DNA, 20 bp, Homo sapiens
cacttccaggtctgcctggt

SEQ ID NO: 4403090 - DNA, 16 bp, Homo sapiens
cacttccagtctggag

SEQ ID NO: 4403091 - DNA, 18 bp, Homo sapiens
cacttccagtctggagag

SEQ ID NO: 4403092 - DNA, 13 bp, Homo sapiens
cacttcgcacaca

SEQ ID NO: 4403093 - DNA, 11 bp, Homo sapiens
cacttctaaac

SEQ ID NO: 4403094 - DNA, 12 bp, Homo sapiens
cacttctaaatt

SEQ ID NO: 4403095 - DNA, 20 bp, Homo sapiens
cacttctaaattaatggtaa

SEQ ID NO: 4403096 - DNA, 12 bp, Homo sapiens
cacttctagaat

SEQ ID NO: 4403097 - DNA, 18 bp, Homo sapiens
gaactgttgcctaattgg

SEQ ID NO: 4403098 - DNA, 20 bp, Homo sapiens
gaacttactgtagcctcaga

SEQ ID NO: 4403099 - DNA, 22 bp, Homo sapiens
gaacttcaggtgtgactctagc

SEQ ID NO: 4403100 - DNA, 23 bp, Homo sapiens
gaacttccaggtgttactgtaat

SEQ ID NO: 4403101 - DNA, 15 bp, Homo sapiens
gaacttgaaagtttt

SEQ ID NO: 4403102 - DNA, 15 bp, Homo sapiens
gaacttgtctcttca

SEQ ID NO: 4403103 - DNA, 18 bp, Homo sapiens
gaacttgtctggctttgg

SEQ ID NO: 4403104 - DNA, 23 bp, Homo sapiens
gaacttgtctggctttggcactc

SEQ ID NO: 4403105 - DNA, 12 bp, Homo sapiens
gaactttcattt

SEQ ID NO: 4403106 - DNA, 13 bp, Homo sapiens
gaagaaaaagaag

SEQ ID NO: 4403107 - DNA, 21 bp, Homo sapiens
gaagaaaactatcctgcgggt

SEQ ID NO: 4403108 - DNA, 22 bp, Homo sapiens
gaagaaaactatcctgcgggtt

SEQ ID NO: 4403109 - DNA, 18 bp, Homo sapiens
gaagaaactttctggtgc

SEQ ID NO: 4403110 - DNA, 12 bp, Homo sapiens
gaagaaagatgt

SEQ ID NO: 4403111 - DNA, 15 bp, Homo sapiens
gaagaaagatttaaa

SEQ ID NO: 4403112 - DNA, 15 bp, Homo sapiens
gaagaaagtggaaaa

SEQ ID NO: 4403113 - DNA, 18 bp, Homo sapiens
gaagaacaacaaagacat

SEQ ID NO: 4403114 - DNA, 16 bp, Homo sapiens
gaagaacaagaaatgg

SEQ ID NO: 4403115 - DNA, 18 bp, Homo sapiens
gaagaacagccccggggc

SEQ ID NO: 4403116 - DNA, 19 bp, Homo sapiens
gaagaacatgattttacaa

SEQ ID NO: 4403117 - DNA, 15 bp, Homo sapiens
gaagaacattattca

SEQ ID NO: 4403118 - DNA, 16 bp, Homo sapiens
gaagaaccaaatacct

SEQ ID NO: 4403119 - DNA, 17 bp, Homo sapiens
gaagaaccaaatacctc

SEQ ID NO: 4403120 - DNA, 20 bp, Homo sapiens
gaagaaccaaatacctcaat

SEQ ID NO: 4403121 - DNA, 13 bp, Homo sapiens
gaagaacggggct

SEQ ID NO: 4403122 - DNA, 20 bp, Homo sapiens
gaagaacggggctcttctca

SEQ ID NO: 4403123 - DNA, 22 bp, Homo sapiens
gaagaaggaaggcctgagcccc

SEQ ID NO: 4403124 - DNA, 14 bp, Homo sapiens
gaagaagggagaag

SEQ ID NO: 4403125 - DNA, 15 bp, Homo sapiens
gaagaagggagaaga

SEQ ID NO: 4403126 - DNA, 19 bp, Homo sapiens
gaagaagggagaagaaagg

SEQ ID NO: 4403127 - DNA, 15 bp, Homo sapiens
gaagaatattgtatt

SEQ ID NO: 4403128 - DNA, 17 bp, Homo sapiens
gaagaatccagtattat

SEQ ID NO: 4403129 - DNA, 24 bp, Homo sapiens
gaagaatgcttaatcagatagata

SEQ ID NO: 4403130 - DNA, 23 bp, Homo sapiens
gaagaattgaacccaggaggtgg

SEQ ID NO: 4403131 - DNA, 20 bp, Homo sapiens
gaagaatttaagttctattc

SEQ ID NO: 4403132 - DNA, 18 bp, Homo sapiens
gaagaatttagatcttat

SEQ ID NO: 4403133 - DNA, 15 bp, Homo sapiens
gaagaattttcagac

SEQ ID NO: 4403134 - DNA, 20 bp, Homo sapiens
gaagaattttcagaccccag

SEQ ID NO: 4403135 - DNA, 13 bp, Homo sapiens
gaagacaacagaa

SEQ ID NO: 4403136 - DNA, 16 bp, Homo sapiens
gaagacattttgttac

SEQ ID NO: 4403137 - DNA, 18 bp, Homo sapiens
gaagacattttgttacat

SEQ ID NO: 4403138 - DNA, 15 bp, Homo sapiens
gaagacccacgtgct

SEQ ID NO: 4403139 - DNA, 14 bp, Homo sapiens
gaagacgaggccct

SEQ ID NO: 4403140 - DNA, 22 bp, Homo sapiens
gaagacgaggccctcgggccca

SEQ ID NO: 4403141 - DNA, 19 bp, Homo sapiens
gaagactcaggagtctgcc

SEQ ID NO: 4403142 - DNA, 22 bp, Homo sapiens
gaagactcaggagtctgccact

SEQ ID NO: 4403143 - DNA, 16 bp, Homo sapiens
gaagactgctcccggc

SEQ ID NO: 4403144 - DNA, 23 bp, Homo sapiens
gaagactgctcccggcccgcctg

SEQ ID NO: 4403145 - DNA, 17 bp, Homo sapiens
gaagactggaagctaat

SEQ ID NO: 4403146 - DNA, 13 bp, Homo sapiens
gaagacttcaaaa

SEQ ID NO: 4403147 - DNA, 13 bp, Homo sapiens
gaagagaaaagac

SEQ ID NO: 4403148 - DNA, 24 bp, Homo sapiens
gaagagaagtgaccgagagaacct

SEQ ID NO: 4403149 - DNA, 19 bp, Homo sapiens
gaagagacaaagatttctt

SEQ ID NO: 4403150 - DNA, 23 bp, Homo sapiens
gaagagacagagacaagtaattt

SEQ ID NO: 4403151 - DNA, 14 bp, Homo sapiens
gaagagcaaaagct

SEQ ID NO: 4403152 - DNA, 11 bp, Homo sapiens
gaagagccacc

SEQ ID NO: 4403153 - DNA, 14 bp, Homo sapiens
gaagagccacctgc

SEQ ID NO: 4403154 - DNA, 16 bp, Homo sapiens
gaagagccacctgcaa

SEQ ID NO: 4403155 - DNA, 12 bp, Homo sapiens
gaagagctcttg

SEQ ID NO: 4403156 - DNA, 13 bp, Homo sapiens
gaagagctcttgg

SEQ ID NO: 4403157 - DNA, 22 bp, Homo sapiens
gaagagctcttggcccggcagg

SEQ ID NO: 4403158 - DNA, 20 bp, Homo sapiens
gaagagctgttcacagccag

SEQ ID NO: 4403159 - DNA, 21 bp, Homo sapiens
gaatatttttagactatttct

SEQ ID NO: 4403160 - DNA, 22 bp, Homo sapiens
gaatatttttatatttccttta

SEQ ID NO: 4403161 - DNA, 22 bp, Homo sapiens
gaatattttttgaaggtttcag

SEQ ID NO: 4403162 - DNA, 17 bp, Homo sapiens
gaatcaacatttctcaa

SEQ ID NO: 4403163 - DNA, 17 bp, Homo sapiens
gaatcaagagctgccct

SEQ ID NO: 4403164 - DNA, 18 bp, Homo sapiens
gaatcaagagctgccctc

SEQ ID NO: 4403165 - DNA, 11 bp, Homo sapiens
gaatcaataat

SEQ ID NO: 4403166 - DNA, 23 bp, Homo sapiens
gaatcaatctggcttctgcatta

SEQ ID NO: 4403167 - DNA, 21 bp, Homo sapiens
gaatcaccaattaaaaacctt

SEQ ID NO: 4403168 - DNA, 18 bp, Homo sapiens
gaatcacccctctgcccc

SEQ ID NO: 4403169 - DNA, 14 bp, Homo sapiens
gaatcactgctcca

SEQ ID NO: 4403170 - DNA, 17 bp, Homo sapiens
gaatcactgctccaggc

SEQ ID NO: 4403171 - DNA, 20 bp, Homo sapiens
gaatcactgttgctttgaaa

SEQ ID NO: 4403172 - DNA, 16 bp, Homo sapiens
gaatcagaagaaaggc

SEQ ID NO: 4403173 - DNA, 22 bp, Homo sapiens
gaatcagaccctaccccaccac

SEQ ID NO: 4403174 - DNA, 23 bp, Homo sapiens
gaatcagaccctaccccaccacg

SEQ ID NO: 4403175 - DNA, 20 bp, Homo sapiens
gaatcagtattgggagccgg

SEQ ID NO: 4403176 - DNA, 18 bp, Homo sapiens
gaatcatacttaacattt

SEQ ID NO: 4403177 - DNA, 17 bp, Homo sapiens
gaatcattatttattaa

SEQ ID NO: 4403178 - DNA, 21 bp, Homo sapiens
gaatcattatttattaaattt

SEQ ID NO: 4403179 - DNA, 21 bp, Homo sapiens
gaatccaagggttgagagcca

SEQ ID NO: 4403180 - DNA, 20 bp, Homo sapiens
gaatccattgaactggaaga

SEQ ID NO: 4403181 - DNA, 19 bp, Homo sapiens
gaatccccaacatgcactg

SEQ ID NO: 4403182 - DNA, 14 bp, Homo sapiens
gaatcccccttgcc

SEQ ID NO: 4403183 - DNA, 23 bp, Homo sapiens
gaatcccccttgccaccccaccc

SEQ ID NO: 4403184 - DNA, 18 bp, Homo sapiens
gaatcccggcggaaagcc

SEQ ID NO: 4403185 - DNA, 21 bp, Homo sapiens
gaatcccttaacagttgtatt

SEQ ID NO: 4403186 - DNA, 15 bp, Homo sapiens
gaatctacaagccaa

SEQ ID NO: 4403187 - DNA, 18 bp, Homo sapiens
gaatctacccccagatcc

SEQ ID NO: 4403188 - DNA, 14 bp, Homo sapiens
gaatctacttaacc

SEQ ID NO: 4403189 - DNA, 15 bp, Homo sapiens
gaatctagaagatgt

SEQ ID NO: 4403190 - DNA, 17 bp, Homo sapiens
gaatctatggctttaaa

SEQ ID NO: 4403191 - DNA, 15 bp, Homo sapiens
gaatctcaaaattag

SEQ ID NO: 4403192 - DNA, 19 bp, Homo sapiens
gaatctcgcagtgtttctg

SEQ ID NO: 4403193 - DNA, 13 bp, Homo sapiens
gaatctctgcccc

SEQ ID NO: 4403194 - DNA, 13 bp, Homo sapiens
gaatctctttccc

SEQ ID NO: 4403195 - DNA, 13 bp, Homo sapiens
gaatctgaatgta

SEQ ID NO: 4403196 - DNA, 23 bp, Homo sapiens
gaatctgcttttcctctgccttc

SEQ ID NO: 4403197 - DNA, 21 bp, Homo sapiens
gaatctgggactgtgcctggc

SEQ ID NO: 4403198 - DNA, 20 bp, Homo sapiens
gaatctgtgtgcatatttgt

SEQ ID NO: 4403199 - DNA, 13 bp, Homo sapiens
gaatctgtttctc

SEQ ID NO: 4403200 - DNA, 14 bp, Homo sapiens
gaatctgtttctct

SEQ ID NO: 4403201 - DNA, 15 bp, Homo sapiens
gaatcttatttttcc

SEQ ID NO: 4403202 - DNA, 18 bp, Homo sapiens
gaatcttatttttcctgt

SEQ ID NO: 4403203 - DNA, 22 bp, Homo sapiens
gaatcttatttttcctgtcctg

SEQ ID NO: 4403204 - DNA, 16 bp, Homo sapiens
gaatcttgttttgaaa

SEQ ID NO: 4403205 - DNA, 19 bp, Homo sapiens
gaatctttgtaccaaaatt

SEQ ID NO: 4403206 - DNA, 20 bp, Homo sapiens
gaatgaaaagacaagaaaat

SEQ ID NO: 4403207 - DNA, 13 bp, Homo sapiens
gaatgaaaataac

SEQ ID NO: 4403208 - DNA, 15 bp, Homo sapiens
gaatgaaatgaatga

SEQ ID NO: 4403209 - DNA, 11 bp, Homo sapiens
gaagtttcatc

SEQ ID NO: 4403210 - DNA, 18 bp, Homo sapiens
gaagtttttaaaaataaa

SEQ ID NO: 4403211 - DNA, 14 bp, Homo sapiens
gaagttttttactt

SEQ ID NO: 4403212 - DNA, 16 bp, Homo sapiens
gaagttttttactttg

SEQ ID NO: 4403213 - DNA, 19 bp, Homo sapiens
gaataaaaaggttggcctt

SEQ ID NO: 4403214 - DNA, 19 bp, Homo sapiens
gaataaaaatagaaacctg

SEQ ID NO: 4403215 - DNA, 13 bp, Homo sapiens
gaataaagaatac

SEQ ID NO: 4403216 - DNA, 17 bp, Homo sapiens
gaataaagaatacttga

SEQ ID NO: 4403217 - DNA, 18 bp, Homo sapiens
gaataaagaatacttgaa

SEQ ID NO: 4403218 - DNA, 19 bp, Homo sapiens
gaataaagaatacttgaac

SEQ ID NO: 4403219 - DNA, 17 bp, Homo sapiens
gaataaagaatgaatgg

SEQ ID NO: 4403220 - DNA, 18 bp, Homo sapiens
gaataaagcctttgtatc

SEQ ID NO: 4403221 - DNA, 15 bp, Homo sapiens
gaataaagttgcaga

SEQ ID NO: 4403222 - DNA, 14 bp, Homo sapiens
gaataaagttgtat

SEQ ID NO: 4403223 - DNA, 11 bp, Homo sapiens
gaataaatgtt

SEQ ID NO: 4403224 - DNA, 17 bp, Homo sapiens
gaataaattatggcatt

SEQ ID NO: 4403225 - DNA, 14 bp, Homo sapiens
gaataaatttggga

SEQ ID NO: 4403226 - DNA, 16 bp, Homo sapiens
gaataacatttaaatt

SEQ ID NO: 4403227 - DNA, 22 bp, Homo sapiens
gaataagcagaacatactgttc

SEQ ID NO: 4403228 - DNA, 12 bp, Homo sapiens
gaataagttatt

SEQ ID NO: 4403229 - DNA, 13 bp, Homo sapiens
gaataatgaaaat

SEQ ID NO: 4403230 - DNA, 18 bp, Homo sapiens
gaataatgaaaataaaac

SEQ ID NO: 4403231 - DNA, 21 bp, Homo sapiens
gaataattgctttttcacagt

SEQ ID NO: 4403232 - DNA, 21 bp, Homo sapiens
gaataatttatagtaatgagt

SEQ ID NO: 4403233 - DNA, 22 bp, Homo sapiens
gaataatttatagtaatgagtt

SEQ ID NO: 4403234 - DNA, 20 bp, Homo sapiens
gaatacattaacggtgctaa

SEQ ID NO: 4403235 - DNA, 17 bp, Homo sapiens
gaatacattttattctg

SEQ ID NO: 4403236 - DNA, 18 bp, Homo sapiens
gaatacattttattctgt

SEQ ID NO: 4403237 - DNA, 21 bp, Homo sapiens
gaatactgcatttacagtgta

SEQ ID NO: 4403238 - DNA, 14 bp, Homo sapiens
gaatactgtctgta

SEQ ID NO: 4403239 - DNA, 17 bp, Homo sapiens
gaatactgtctgtatct

SEQ ID NO: 4403240 - DNA, 19 bp, Homo sapiens
gaatactgtctgtatcttt

SEQ ID NO: 4403241 - DNA, 19 bp, Homo sapiens
gaatacttttgccctttga

SEQ ID NO: 4403242 - DNA, 12 bp, Homo sapiens
gaatagaaagaa

SEQ ID NO: 4403243 - DNA, 13 bp, Homo sapiens
gaatagaaagaaa

SEQ ID NO: 4403244 - DNA, 13 bp, Homo sapiens
gaatagaggaaga

SEQ ID NO: 4403245 - DNA, 19 bp, Homo sapiens
gaatagatatgaaagctga

SEQ ID NO: 4403246 - DNA, 18 bp, Homo sapiens
gaatagccacatttggaa

SEQ ID NO: 4403247 - DNA, 23 bp, Homo sapiens
gaatagccacatttggaatactt

SEQ ID NO: 4403248 - DNA, 14 bp, Homo sapiens
gaatagcctggcca

SEQ ID NO: 4403249 - DNA, 17 bp, Homo sapiens
gaataggaaataaaatt

SEQ ID NO: 4403250 - DNA, 22 bp, Homo sapiens
gaataggcagggggccctgccc

SEQ ID NO: 4403251 - DNA, 20 bp, Homo sapiens
gaataggctgatgggcaaaa

SEQ ID NO: 4403252 - DNA, 22 bp, Homo sapiens
gaatagggggatataatacata

SEQ ID NO: 4403253 - DNA, 14 bp, Homo sapiens
gaatagtattgtgt

SEQ ID NO: 4403254 - DNA, 22 bp, Homo sapiens
gaatagtggttaacagagctaa

SEQ ID NO: 4403255 - DNA, 23 bp, Homo sapiens
gaatagtggttaacagagctaag

SEQ ID NO: 4403256 - DNA, 21 bp, Homo sapiens
gaatagttaaaaattaaatat

SEQ ID NO: 4403257 - DNA, 22 bp, Homo sapiens
gaatagttaaaaattaaatatt

SEQ ID NO: 4403258 - DNA, 19 bp, Homo sapiens
gaatagttcaggagacttt

SEQ ID NO: 4403259 - DNA, 16 bp, Homo sapiens
gaatagtttatttctg

SEQ ID NO: 4403260 - DNA, 23 bp, Homo sapiens
gaatagtttatttctgtgaaaga

SEQ ID NO: 4403261 - DNA, 13 bp, Homo sapiens
gaatataagaaaa

SEQ ID NO: 4403262 - DNA, 15 bp, Homo sapiens
gaatataagaaaagt

SEQ ID NO: 4403263 - DNA, 20 bp, Homo sapiens
gaatataattgttttatctg

SEQ ID NO: 4403264 - DNA, 14 bp, Homo sapiens
gaatatacatagtc

SEQ ID NO: 4403265 - DNA, 18 bp, Homo sapiens
gaatataccttatttatt

SEQ ID NO: 4403266 - DNA, 15 bp, Homo sapiens
gaatatagacagtgc

SEQ ID NO: 4403267 - DNA, 20 bp, Homo sapiens
gaatatatctctatttgaga

SEQ ID NO: 4403268 - DNA, 19 bp, Homo sapiens
gaatatctgttcccagccc

SEQ ID NO: 4403269 - DNA, 14 bp, Homo sapiens
gaatatgacagctg

SEQ ID NO: 4403270 - DNA, 13 bp, Homo sapiens
gaatattatatat

SEQ ID NO: 4403271 - DNA, 16 bp, Homo sapiens
gaatattcatattgga

SEQ ID NO: 4403272 - DNA, 23 bp, Homo sapiens
gaatattgtattgttagatgttt

SEQ ID NO: 4403273 - DNA, 13 bp, Homo sapiens
gaatattgtccat

SEQ ID NO: 4403274 - DNA, 12 bp, Homo sapiens
gaatatttagca

SEQ ID NO: 4403275 - DNA, 14 bp, Homo sapiens
gaatatttgtttta

SEQ ID NO: 4403276 - DNA, 14 bp, Homo sapiens
gaatattttatcct

SEQ ID NO: 4403277 - DNA, 19 bp, Homo sapiens
gaatattttgatgcagata

SEQ ID NO: 4403278 - DNA, 16 bp, Homo sapiens
caccctggcctgaact

SEQ ID NO: 4403279 - DNA, 22 bp, Homo sapiens
caccctgggcagtgagtgccat

SEQ ID NO: 4403280 - DNA, 22 bp, Homo sapiens
caccctgtcctgcacaccctgg

SEQ ID NO: 4403281 - DNA, 15 bp, Homo sapiens
cacccttcagcaatg

SEQ ID NO: 4403282 - DNA, 21 bp, Homo sapiens
cacccttccacagctggcctg

SEQ ID NO: 4403283 - DNA, 11 bp, Homo sapiens
cacccttcccg

SEQ ID NO: 4403284 - DNA, 12 bp, Homo sapiens
cacccttggcct

SEQ ID NO: 4403285 - DNA, 15 bp, Homo sapiens
cacccttggcctgtc

SEQ ID NO: 4403286 - DNA, 18 bp, Homo sapiens
cacccttggcctgtctca

SEQ ID NO: 4403287 - DNA, 21 bp, Homo sapiens
cacccttggcctgtctcatcc

SEQ ID NO: 4403288 - DNA, 23 bp, Homo sapiens
caccgaagtggactggcccctgg

SEQ ID NO: 4403289 - DNA, 15 bp, Homo sapiens
caccgactgaaaata

SEQ ID NO: 4403290 - DNA, 21 bp, Homo sapiens
caccgagagtagccgagagcc

SEQ ID NO: 4403291 - DNA, 13 bp, Homo sapiens
caccgagcagagg

SEQ ID NO: 4403292 - DNA, 19 bp, Homo sapiens
caccgaggttcccagggct

SEQ ID NO: 4403293 - DNA, 17 bp, Homo sapiens
caccgccttgcccagcc

SEQ ID NO: 4403294 - DNA, 16 bp, Homo sapiens
caccgcgtcccagctc

SEQ ID NO: 4403295 - DNA, 13 bp, Homo sapiens
caccgctgcctaa

SEQ ID NO: 4403296 - DNA, 12 bp, Homo sapiens
caccgctggccc

SEQ ID NO: 4403297 - DNA, 15 bp, Homo sapiens
caccggaactgggct

SEQ ID NO: 4403298 - DNA, 17 bp, Homo sapiens
caccggaggtcactcca

SEQ ID NO: 4403299 - DNA, 15 bp, Homo sapiens
caccgggagcctccc

SEQ ID NO: 4403300 - DNA, 19 bp, Homo sapiens
caccgggagcctccccctc

SEQ ID NO: 4403301 - DNA, 14 bp, Homo sapiens
caccggggcctggg

SEQ ID NO: 4403302 - DNA, 18 bp, Homo sapiens
caccggtcagtgcctttt

SEQ ID NO: 4403303 - DNA, 17 bp, Homo sapiens
caccgtgatggagagga

SEQ ID NO: 4403304 - DNA, 13 bp, Homo sapiens
caccgtgcctggc

SEQ ID NO: 4403305 - DNA, 16 bp, Homo sapiens
caccgtgcctggccag

SEQ ID NO: 4403306 - DNA, 18 bp, Homo sapiens
caccgtgcctggccagat

SEQ ID NO: 4403307 - DNA, 14 bp, Homo sapiens
caccgtgcctggct

SEQ ID NO: 4403308 - DNA, 17 bp, Homo sapiens
caccgtgggctccctga

SEQ ID NO: 4403309 - DNA, 13 bp, Homo sapiens
caccgttcagtca

SEQ ID NO: 4403310 - DNA, 16 bp, Homo sapiens
cacctaaccccagggc

SEQ ID NO: 4403311 - DNA, 20 bp, Homo sapiens
cacctaagcacttctagaat

SEQ ID NO: 4403312 - DNA, 20 bp, Homo sapiens
cacctacagtgtacagtctt

SEQ ID NO: 4403313 - DNA, 23 bp, Homo sapiens
cacctacagtgtacagtcttgta

SEQ ID NO: 4403314 - DNA, 21 bp, Homo sapiens
cacctacatgaggtactgaga

SEQ ID NO: 4403315 - DNA, 23 bp, Homo sapiens
cacctagaacgtgcatccttgta

SEQ ID NO: 4403316 - DNA, 21 bp, Homo sapiens
cacctagcatgtgtaattttt

SEQ ID NO: 4403317 - DNA, 12 bp, Homo sapiens
cacctagccagc

SEQ ID NO: 4403318 - DNA, 18 bp, Homo sapiens
cacctaggctagggtggg

SEQ ID NO: 4403319 - DNA, 15 bp, Homo sapiens
cacctatctcagcca

SEQ ID NO: 4403320 - DNA, 16 bp, Homo sapiens
cacctatctcagccat

SEQ ID NO: 4403321 - DNA, 17 bp, Homo sapiens
cacctatctcagccata

SEQ ID NO: 4403322 - DNA, 19 bp, Homo sapiens
cacctatctcagccatagg

SEQ ID NO: 4403323 - DNA, 17 bp, Homo sapiens
cacctatgagatggcca

SEQ ID NO: 4403324 - DNA, 22 bp, Homo sapiens
cacctatgagatggccatgctc

SEQ ID NO: 4403325 - DNA, 23 bp, Homo sapiens
cacctatgagatggccatgctca

SEQ ID NO: 4403326 - DNA, 12 bp, Homo sapiens
cacctatgtgcc

SEQ ID NO: 4403327 - DNA, 15 bp, Homo sapiens
cacctattgaattac

SEQ ID NO: 4403328 - DNA, 15 bp, Homo sapiens
cacctatttaatgtt

SEQ ID NO: 4403329 - DNA, 13 bp, Homo sapiens
cacctatttccat

SEQ ID NO: 4403330 - DNA, 16 bp, Homo sapiens
cacctcagcctcctga

SEQ ID NO: 4403331 - DNA, 20 bp, Homo sapiens
cacctcagttcccttggcct

SEQ ID NO: 4403332 - DNA, 13 bp, Homo sapiens
cacctcatgagtc

SEQ ID NO: 4403333 - DNA, 16 bp, Homo sapiens
cacctcatgcccaccc

SEQ ID NO: 4403334 - DNA, 19 bp, Homo sapiens
cacctcatgcccaccccct

SEQ ID NO: 4403335 - DNA, 18 bp, Homo sapiens
cacctccaagcatttcat

SEQ ID NO: 4403336 - DNA, 15 bp, Homo sapiens
cacctccccccactg

SEQ ID NO: 4403337 - DNA, 17 bp, Homo sapiens
cacctccccccactgca

SEQ ID NO: 4403338 - DNA, 22 bp, Homo sapiens
cacctccccctttcacactgga

SEQ ID NO: 4403339 - DNA, 23 bp, Homo sapiens
cacctccccctttcacactggat

SEQ ID NO: 4403340 - DNA, 14 bp, Homo sapiens
cacctccctcccca

SEQ ID NO: 4403341 - DNA, 20 bp, Homo sapiens
cacctcctcccgaaaaatgt

SEQ ID NO: 4403342 - DNA, 15 bp, Homo sapiens
cacctcgagaagtaa

SEQ ID NO: 4403343 - DNA, 18 bp, Homo sapiens
aaggaggaatttactttc

SEQ ID NO: 4403344 - DNA, 21 bp, Homo sapiens
aaggagggatgcgtgttccag

SEQ ID NO: 4403345 - DNA, 18 bp, Homo sapiens
aaggaggggaaaaaaatg

SEQ ID NO: 4403346 - DNA, 21 bp, Homo sapiens
aaggaggggaaaaaaatgttg

SEQ ID NO: 4403347 - DNA, 17 bp, Homo sapiens
aaggagtcaaaactaca

SEQ ID NO: 4403348 - DNA, 16 bp, Homo sapiens
aaggagttacagggaa

SEQ ID NO: 4403349 - DNA, 20 bp, Homo sapiens
aaggagttagaaccacagca

SEQ ID NO: 4403350 - DNA, 21 bp, Homo sapiens
aaggagttagaaccacagcag

SEQ ID NO: 4403351 - DNA, 20 bp, Homo sapiens
gaattcctttacaactaaat

SEQ ID NO: 4403352 - DNA, 22 bp, Homo sapiens
gaattcctttacaactaaataa

SEQ ID NO: 4403353 - DNA, 16 bp, Homo sapiens
gaattctactggaaaa

SEQ ID NO: 4403354 - DNA, 13 bp, Homo sapiens
gaattcttctgca

SEQ ID NO: 4403355 - DNA, 17 bp, Homo sapiens
gaattcttgataaatga

SEQ ID NO: 4403356 - DNA, 19 bp, Homo sapiens
gaattcttggttgaggaaa

SEQ ID NO: 4403357 - DNA, 20 bp, Homo sapiens
gaattcttggttgaggaaac

SEQ ID NO: 4403358 - DNA, 11 bp, Homo sapiens
gaattgaaaaa

SEQ ID NO: 4403359 - DNA, 13 bp, Homo sapiens
gaattgaaaaaca

SEQ ID NO: 4403360 - DNA, 12 bp, Homo sapiens
gaattgatttgc

SEQ ID NO: 4403361 - DNA, 12 bp, Homo sapiens
gaattgcattga

SEQ ID NO: 4403362 - DNA, 20 bp, Homo sapiens
gaattggagtcgtgttgtca

SEQ ID NO: 4403363 - DNA, 17 bp, Homo sapiens
gaattggcataatttgt

SEQ ID NO: 4403364 - DNA, 20 bp, Homo sapiens
gaattggcttccagatttta

SEQ ID NO: 4403365 - DNA, 14 bp, Homo sapiens
gaattgggtttctg

SEQ ID NO: 4403366 - DNA, 14 bp, Homo sapiens
gaattgtccccagt

SEQ ID NO: 4403367 - DNA, 18 bp, Homo sapiens
gaatttaagaatttgttt

SEQ ID NO: 4403368 - DNA, 16 bp, Homo sapiens
gaatttatctttacca

SEQ ID NO: 4403369 - DNA, 17 bp, Homo sapiens
gaatttcacctgtaaac

SEQ ID NO: 4403370 - DNA, 16 bp, Homo sapiens
gaatttcactgtcttt

SEQ ID NO: 4403371 - DNA, 15 bp, Homo sapiens
gaatttctaaagtaa

SEQ ID NO: 4403372 - DNA, 19 bp, Homo sapiens
gaatttctaaagtaaaatt

SEQ ID NO: 4403373 - DNA, 13 bp, Homo sapiens
gaatttcttaact

SEQ ID NO: 4403374 - DNA, 15 bp, Homo sapiens
gaatttcttaacttc

SEQ ID NO: 4403375 - DNA, 17 bp, Homo sapiens
gaatttgagtgctctga

SEQ ID NO: 4403376 - DNA, 11 bp, Homo sapiens
gaatttgcaaa

SEQ ID NO: 4403377 - DNA, 14 bp, Homo sapiens
gaatttgcaaagta

SEQ ID NO: 4403378 - DNA, 19 bp, Homo sapiens
gaatttggtacacatgtgt

SEQ ID NO: 4403379 - DNA, 21 bp, Homo sapiens
gaatttggtacacatgtgtta

SEQ ID NO: 4403380 - DNA, 21 bp, Homo sapiens
gaatttgtgttgaaggaactt

SEQ ID NO: 4403381 - DNA, 12 bp, Homo sapiens
gaattttaaagt

SEQ ID NO: 4403382 - DNA, 15 bp, Homo sapiens
gaattttaaagtatg

SEQ ID NO: 4403383 - DNA, 23 bp, Homo sapiens
gaattttcagaccccagcggctg

SEQ ID NO: 4403384 - DNA, 21 bp, Homo sapiens
gaattttcatcccgtatcaca

SEQ ID NO: 4403385 - DNA, 16 bp, Homo sapiens
gaattttctaaaagct

SEQ ID NO: 4403386 - DNA, 18 bp, Homo sapiens
gaatttttaaacaagtat

SEQ ID NO: 4403387 - DNA, 14 bp, Homo sapiens
gaatttttcctatg

SEQ ID NO: 4403388 - DNA, 16 bp, Homo sapiens
gaatttttgcaataat

SEQ ID NO: 4403389 - DNA, 14 bp, Homo sapiens
gaatttttttgtaa

SEQ ID NO: 4403390 - DNA, 18 bp, Homo sapiens
gacaaaaaatgttttaaa

SEQ ID NO: 4403391 - DNA, 17 bp, Homo sapiens
gacaaaagtctgtcttt

SEQ ID NO: 4403392 - DNA, 14 bp, Homo sapiens
gacaaaatgactgg

SEQ ID NO: 4403393 - DNA, 19 bp, Homo sapiens
gacaaaatgactggctcct

SEQ ID NO: 4403394 - DNA, 24 bp, Homo sapiens
gacaaaatgactggctcctgactt

SEQ ID NO: 4403395 - DNA, 21 bp, Homo sapiens
gacaaaatggggcagaagaga

SEQ ID NO: 4403396 - DNA, 19 bp, Homo sapiens
gtagtattttttgtataat

SEQ ID NO: 4403397 - DNA, 20 bp, Homo sapiens
gtagtcaaaaacaaagctga

SEQ ID NO: 4403398 - DNA, 18 bp, Homo sapiens
gtagtcagactgacacta

SEQ ID NO: 4403399 - DNA, 19 bp, Homo sapiens
gtagtctcactgcttgaac

SEQ ID NO: 4403400 - DNA, 20 bp, Homo sapiens
gtagtctcactgcttgaact

SEQ ID NO: 4403401 - DNA, 22 bp, Homo sapiens
gtagtgaaataatagaatgagc

SEQ ID NO: 4403402 - DNA, 22 bp, Homo sapiens
gtagtgagccaagatcgcacca

SEQ ID NO: 4403403 - DNA, 22 bp, Homo sapiens
gtagtgatggagttccttctgg

SEQ ID NO: 4403404 - DNA, 19 bp, Homo sapiens
gtagtgatttttatgccac

SEQ ID NO: 4403405 - DNA, 15 bp, Homo sapiens
gtagtggccactggg

SEQ ID NO: 4403406 - DNA, 12 bp, Homo sapiens
gtagtgtcccca

SEQ ID NO: 4403407 - DNA, 22 bp, Homo sapiens
gtagtgtccccagcctacctct

SEQ ID NO: 4403408 - DNA, 19 bp, Homo sapiens
gtagtgtgtcagctctgtt

SEQ ID NO: 4403409 - DNA, 17 bp, Homo sapiens
gtagttatataattgtt

SEQ ID NO: 4403410 - DNA, 13 bp, Homo sapiens
gtagttccctgaa

SEQ ID NO: 4403411 - DNA, 17 bp, Homo sapiens
gtagttccctgaaaacc

SEQ ID NO: 4403412 - DNA, 17 bp, Homo sapiens
gtagttctgtgcctccc

SEQ ID NO: 4403413 - DNA, 23 bp, Homo sapiens
gtagttgtcacagtcttgtgaac

SEQ ID NO: 4403414 - DNA, 20 bp, Homo sapiens
gtagtttgaaagttgtacat

SEQ ID NO: 4403415 - DNA, 18 bp, Homo sapiens
gtagtttttaattaaaaa

SEQ ID NO: 4403416 - DNA, 17 bp, Homo sapiens
gtataaaaaagaaaact

SEQ ID NO: 4403417 - DNA, 19 bp, Homo sapiens
gtataaaaattatcaaaaa

SEQ ID NO: 4403418 - DNA, 14 bp, Homo sapiens
gtataaatgtacat

SEQ ID NO: 4403419 - DNA, 15 bp, Homo sapiens
gtataaatgtacatc

SEQ ID NO: 4403420 - DNA, 22 bp, Homo sapiens
gtataaattgtctttaaaaact

SEQ ID NO: 4403421 - DNA, 18 bp, Homo sapiens
gtataacattaagaaaat

SEQ ID NO: 4403422 - DNA, 16 bp, Homo sapiens
gtataaggagattctg

SEQ ID NO: 4403423 - DNA, 19 bp, Homo sapiens
gtataagttgctgtaaaat

SEQ ID NO: 4403424 - DNA, 18 bp, Homo sapiens
gtataagttgtgtttgat

SEQ ID NO: 4403425 - DNA, 22 bp, Homo sapiens
gtataatactttgtatacaagt

SEQ ID NO: 4403426 - DNA, 13 bp, Homo sapiens
gtataatattgaa

SEQ ID NO: 4403427 - DNA, 15 bp, Homo sapiens
gtataatattgaaaa

SEQ ID NO: 4403428 - DNA, 18 bp, Homo sapiens
gtataatgtgcagaaaat

SEQ ID NO: 4403429 - DNA, 21 bp, Homo sapiens
gtataatgtgtctgtgttgct

SEQ ID NO: 4403430 - DNA, 20 bp, Homo sapiens
gtataatgtttattaaatgc

SEQ ID NO: 4403431 - DNA, 18 bp, Homo sapiens
gtataattaattgtcatt

SEQ ID NO: 4403432 - DNA, 19 bp, Homo sapiens
gtataattggatttcctaa

SEQ ID NO: 4403433 - DNA, 16 bp, Homo sapiens
gtatacattgtcttga

SEQ ID NO: 4403434 - DNA, 13 bp, Homo sapiens
gtataccatgaga

SEQ ID NO: 4403435 - DNA, 21 bp, Homo sapiens
gtatacttccttacttttaag

SEQ ID NO: 4403436 - DNA, 20 bp, Homo sapiens
gtatactttaaataatttaa

SEQ ID NO: 4403437 - DNA, 15 bp, Homo sapiens
gtatagaaatgctgg

SEQ ID NO: 4403438 - DNA, 16 bp, Homo sapiens
gtataggaatttgtat

SEQ ID NO: 4403439 - DNA, 14 bp, Homo sapiens
gtatagtagaaaga

SEQ ID NO: 4403440 - DNA, 16 bp, Homo sapiens
gtatagtgttcacaaa

SEQ ID NO: 4403441 - DNA, 20 bp, Homo sapiens
gtatagtgttcacaaactgt

SEQ ID NO: 4403442 - DNA, 13 bp, Homo sapiens
gtatagttgcttt

SEQ ID NO: 4403443 - DNA, 14 bp, Homo sapiens
gtatataaaaatgg

SEQ ID NO: 4403444 - DNA, 11 bp, Homo sapiens
gtatatatctt

SEQ ID NO: 4403445 - DNA, 19 bp, Homo sapiens
gtatatatcttataactgt

SEQ ID NO: 4403446 - DNA, 12 bp, Homo sapiens
gtatatcgttat

SEQ ID NO: 4403447 - DNA, 17 bp, Homo sapiens
gtatatctcttggaaaa

SEQ ID NO: 4403448 - DNA, 13 bp, Homo sapiens
gtatatgtattta

SEQ ID NO: 4403449 - DNA, 24 bp, Homo sapiens
gtatatgtatttaagatgtacatt

SEQ ID NO: 4403450 - DNA, 15 bp, Homo sapiens
gtatattacaatgat

SEQ ID NO: 4403451 - DNA, 17 bp, Homo sapiens
gtatattacaatgatca

SEQ ID NO: 4403452 - DNA, 14 bp, Homo sapiens
gtatattacaccaa

SEQ ID NO: 4403453 - DNA, 19 bp, Homo sapiens
gtatattatgtttatttca

SEQ ID NO: 4403454 - DNA, 16 bp, Homo sapiens
gtatattattgcttca

SEQ ID NO: 4403455 - DNA, 12 bp, Homo sapiens
gtatattcagga

SEQ ID NO: 4403456 - DNA, 17 bp, Homo sapiens
gtatattgtgttgcaaa

SEQ ID NO: 4403457 - DNA, 18 bp, Homo sapiens
gtatatttagttacgtat

SEQ ID NO: 4403458 - DNA, 15 bp, Homo sapiens
gtatatttcttttaa

SEQ ID NO: 4403459 - DNA, 16 bp, Homo sapiens
gtaacactaatatatt

SEQ ID NO: 4403460 - DNA, 19 bp, Homo sapiens
gtaacactaatatatttaa

SEQ ID NO: 4403461 - DNA, 20 bp, Homo sapiens
gtaacactaatatatttaaa

SEQ ID NO: 4403462 - DNA, 22 bp, Homo sapiens
gtaacactaatatatttaaaaa

SEQ ID NO: 4403463 - DNA, 20 bp, Homo sapiens
gtaacagatatcagtgtctc

SEQ ID NO: 4403464 - DNA, 15 bp, Homo sapiens
gtaacagggcagaaa

SEQ ID NO: 4403465 - DNA, 20 bp, Homo sapiens
gtaaccagccagatcctctt

SEQ ID NO: 4403466 - DNA, 15 bp, Homo sapiens
gtaacctttaaaaat

SEQ ID NO: 4403467 - DNA, 12 bp, Homo sapiens
gtaactacttta

SEQ ID NO: 4403468 - DNA, 14 bp, Homo sapiens
gtaactactttata

SEQ ID NO: 4403469 - DNA, 17 bp, Homo sapiens
gtaactaggctcagaga

SEQ ID NO: 4403470 - DNA, 23 bp, Homo sapiens
gtaactggttaaaaaacaaatgt

SEQ ID NO: 4403471 - DNA, 13 bp, Homo sapiens
gtaactgttcttg

SEQ ID NO: 4403472 - DNA, 11 bp, Homo sapiens
gtaacttcaaa

SEQ ID NO: 4403473 - DNA, 18 bp, Homo sapiens
gtaacttcttatggaatt

SEQ ID NO: 4403474 - DNA, 20 bp, Homo sapiens
gtaacttgcttaaatttctt

SEQ ID NO: 4403475 - DNA, 21 bp, Homo sapiens
gtaagaaaagctggtctggag

SEQ ID NO: 4403476 - DNA, 19 bp, Homo sapiens
gtaagaaagccaccttgtt

SEQ ID NO: 4403477 - DNA, 18 bp, Homo sapiens
gtaagaacacattttaaa

SEQ ID NO: 4403478 - DNA, 13 bp, Homo sapiens
gtaagaactgtac

SEQ ID NO: 4403479 - DNA, 19 bp, Homo sapiens
gtaagaactgtacattgtg

SEQ ID NO: 4403480 - DNA, 13 bp, Homo sapiens
gtaagaaggcaat

SEQ ID NO: 4403481 - DNA, 13 bp, Homo sapiens
gtaagaagggtgg

SEQ ID NO: 4403482 - DNA, 17 bp, Homo sapiens
gtaagccaaagaaatga

SEQ ID NO: 4403483 - DNA, 12 bp, Homo sapiens
gtaagccagagc

SEQ ID NO: 4403484 - DNA, 15 bp, Homo sapiens
gtaagccagagcctg

SEQ ID NO: 4403485 - DNA, 13 bp, Homo sapiens
gtaagcctcatca

SEQ ID NO: 4403486 - DNA, 12 bp, Homo sapiens
gtaagctgtgtg

SEQ ID NO: 4403487 - DNA, 15 bp, Homo sapiens
gtaagtaaacagatt

SEQ ID NO: 4403488 - DNA, 20 bp, Homo sapiens
gtaagtaatatcaaagcatt

SEQ ID NO: 4403489 - DNA, 15 bp, Homo sapiens
gtaagtaattatgca

SEQ ID NO: 4403490 - DNA, 18 bp, Homo sapiens
gtaagtaattatgcacta

SEQ ID NO: 4403491 - DNA, 16 bp, Homo sapiens
gtaagtatgtttttta

SEQ ID NO: 4403492 - DNA, 13 bp, Homo sapiens
gtaagtgccttcc

SEQ ID NO: 4403493 - DNA, 18 bp, Homo sapiens
gtaagttaatgtatataa

SEQ ID NO: 4403494 - DNA, 21 bp, Homo sapiens
gtaataaaaagagatgaaata

SEQ ID NO: 4403495 - DNA, 11 bp, Homo sapiens
gtaataaagtg

SEQ ID NO: 4403496 - DNA, 12 bp, Homo sapiens
gtaataaagtgt

SEQ ID NO: 4403497 - DNA, 16 bp, Homo sapiens
gtaataaagtgttttc

SEQ ID NO: 4403498 - DNA, 13 bp, Homo sapiens
gtaataatgtaca

SEQ ID NO: 4403499 - DNA, 15 bp, Homo sapiens
gtaataatgtacaga

SEQ ID NO: 4403500 - DNA, 13 bp, Homo sapiens
gtaatacttcttt

SEQ ID NO: 4403501 - DNA, 14 bp, Homo sapiens
gtaataggaaaatg

SEQ ID NO: 4403502 - DNA, 13 bp, Homo sapiens
gtaataggcattt

SEQ ID NO: 4403503 - DNA, 16 bp, Homo sapiens
gtaataggcattttaa

SEQ ID NO: 4403504 - DNA, 12 bp, Homo sapiens
gtaatataaaag

SEQ ID NO: 4403505 - DNA, 14 bp, Homo sapiens
gtaatataaaagat

SEQ ID NO: 4403506 - DNA, 21 bp, Homo sapiens
gtaatatacaagcaagcaaaa

SEQ ID NO: 4403507 - DNA, 20 bp, Homo sapiens
gtaatatggaaatcttttac

SEQ ID NO: 4403508 - DNA, 15 bp, Homo sapiens
gtaatattctgtttt

SEQ ID NO: 4403509 - DNA, 21 bp, Homo sapiens
gtaatattggtgctatttaac

SEQ ID NO: 4403510 - DNA, 19 bp, Homo sapiens
gtaatcattatctcacttt

SEQ ID NO: 4403511 - DNA, 15 bp, Homo sapiens
gtaatcatttgttta

SEQ ID NO: 4403512 - DNA, 15 bp, Homo sapiens
gtaatcccagcactt

SEQ ID NO: 4403513 - DNA, 20 bp, Homo sapiens
gtaatcccagcactttggga

SEQ ID NO: 4403514 - DNA, 15 bp, Homo sapiens
gtaatcccagctact

SEQ ID NO: 4403515 - DNA, 17 bp, Homo sapiens
gtaatcctcttctaaaa

SEQ ID NO: 4403516 - DNA, 22 bp, Homo sapiens
gtaatctgtataatactttgta

SEQ ID NO: 4403517 - DNA, 20 bp, Homo sapiens
gtaatctttacctgtataca

SEQ ID NO: 4403518 - DNA, 15 bp, Homo sapiens
gtaatgaagaatcac

SEQ ID NO: 4403519 - DNA, 18 bp, Homo sapiens
gtaatgacttagaaactg

SEQ ID NO: 4403520 - DNA, 20 bp, Homo sapiens
gtaatgagtcagtgaagtct

SEQ ID NO: 4403521 - DNA, 20 bp, Homo sapiens
gtaatgagtttaaaaatcaa

SEQ ID NO: 4403522 - DNA, 22 bp, Homo sapiens
gtaatgatactgattatgaaat

SEQ ID NO: 4403523 - DNA, 22 bp, Homo sapiens
gtaatgcagtttttaaaaacct

SEQ ID NO: 4403524 - DNA, 16 bp, Homo sapiens
gtaatgccagcgcttt

SEQ ID NO: 4403525 - DNA, 15 bp, Homo sapiens
gtaatgctgtacagc

SEQ ID NO: 4403526 - DNA, 14 bp, Homo sapiens
gtaatggagcatca

SEQ ID NO: 4403527 - DNA, 17 bp, Homo sapiens
gtaatgggtatattgat

SEQ ID NO: 4403528 - DNA, 14 bp, Homo sapiens
gtaatgtaaataaa

SEQ ID NO: 4403529 - DNA, 18 bp, Homo sapiens
gtaatgtaaataaactat

SEQ ID NO: 4403530 - DNA, 15 bp, Homo sapiens
gattttaccaaagca

SEQ ID NO: 4403531 - DNA, 16 bp, Homo sapiens
gattttaccaaagcat

SEQ ID NO: 4403532 - DNA, 17 bp, Homo sapiens
gattttcaaaagataat

SEQ ID NO: 4403533 - DNA, 14 bp, Homo sapiens
gattttcagttact

SEQ ID NO: 4403534 - DNA, 20 bp, Homo sapiens
gattttctgctactttgctg

SEQ ID NO: 4403535 - DNA, 15 bp, Homo sapiens
gattttcttttgcct

SEQ ID NO: 4403536 - DNA, 12 bp, Homo sapiens
gattttgcacaa

SEQ ID NO: 4403537 - DNA, 16 bp, Homo sapiens
gattttgctgtagaag

SEQ ID NO: 4403538 - DNA, 16 bp, Homo sapiens
gattttggaaactcaa

SEQ ID NO: 4403539 - DNA, 20 bp, Homo sapiens
gattttggaactgtgtttca

SEQ ID NO: 4403540 - DNA, 12 bp, Homo sapiens
gattttgtaaat

SEQ ID NO: 4403541 - DNA, 17 bp, Homo sapiens
gattttgtaagaagttt

SEQ ID NO: 4403542 - DNA, 21 bp, Homo sapiens
gatttttaaaaaatattttct

SEQ ID NO: 4403543 - DNA, 14 bp, Homo sapiens
gatttttaaaatga

SEQ ID NO: 4403544 - DNA, 15 bp, Homo sapiens
gatttttatttgcat

SEQ ID NO: 4403545 - DNA, 23 bp, Homo sapiens
gatttttcttcaggtaacactac

SEQ ID NO: 4403546 - DNA, 13 bp, Homo sapiens
gatttttctttaa

SEQ ID NO: 4403547 - DNA, 17 bp, Homo sapiens
gattttttaataattta

SEQ ID NO: 4403548 - DNA, 22 bp, Homo sapiens
gattttttatgtacaaccctga

SEQ ID NO: 4403549 - DNA, 13 bp, Homo sapiens
gattttttccaaa

SEQ ID NO: 4403550 - DNA, 21 bp, Homo sapiens
gattttttttgtaacttcaaa

SEQ ID NO: 4403551 - DNA, 13 bp, Homo sapiens
gcaaaaaagaaaa

SEQ ID NO: 4403552 - DNA, 15 bp, Homo sapiens
gcaaaaaataatgac

SEQ ID NO: 4403553 - DNA, 12 bp, Homo sapiens
gcaaaaaatact

SEQ ID NO: 4403554 - DNA, 20 bp, Homo sapiens
gcaaaaaatactttttctaa

SEQ ID NO: 4403555 - DNA, 17 bp, Homo sapiens
gcaaaaaatgtttttgg

SEQ ID NO: 4403556 - DNA, 13 bp, Homo sapiens
gcaaaaataatca

SEQ ID NO: 4403557 - DNA, 14 bp, Homo sapiens
gcaaaaatgttttc

SEQ ID NO: 4403558 - DNA, 22 bp, Homo sapiens
gcaaaacaaaaccctcagcact

SEQ ID NO: 4403559 - DNA, 12 bp, Homo sapiens
gcaaaaccaaac

SEQ ID NO: 4403560 - DNA, 12 bp, Homo sapiens
gcaaaaggagag

SEQ ID NO: 4403561 - DNA, 13 bp, Homo sapiens
gcaaaaggcctct

SEQ ID NO: 4403562 - DNA, 16 bp, Homo sapiens
gcaaaaggcctcttgt

SEQ ID NO: 4403563 - DNA, 13 bp, Homo sapiens
gcaaaagtggggc

SEQ ID NO: 4403564 - DNA, 21 bp, Homo sapiens
gcaaaagtggggctaaatgaa

SEQ ID NO: 4403565 - DNA, 15 bp, Homo sapiens
gcaaaatgtgtttca

SEQ ID NO: 4403566 - DNA, 19 bp, Homo sapiens
gcaaacctgacccctgctc

SEQ ID NO: 4403567 - DNA, 14 bp, Homo sapiens
gcaaaccttcctgg

SEQ ID NO: 4403568 - DNA, 15 bp, Homo sapiens
gcaaaccttcctggg

SEQ ID NO: 4403569 - DNA, 22 bp, Homo sapiens
gcaaacggcaacgtagcctggg

SEQ ID NO: 4403570 - DNA, 13 bp, Homo sapiens
gcaaactgcttta

SEQ ID NO: 4403571 - DNA, 16 bp, Homo sapiens
gcaaagaaaggagata

SEQ ID NO: 4403572 - DNA, 21 bp, Homo sapiens
gcaaagataatttatttcaat

SEQ ID NO: 4403573 - DNA, 22 bp, Homo sapiens
gcaaagataatttatttcaata

SEQ ID NO: 4403574 - DNA, 16 bp, Homo sapiens
gcaaagatttaatctg

SEQ ID NO: 4403575 - DNA, 17 bp, Homo sapiens
gcaaagcaatcttttat

SEQ ID NO: 4403576 - DNA, 21 bp, Homo sapiens
gcaaagcacccatttcaatgt

SEQ ID NO: 4403577 - DNA, 20 bp, Homo sapiens
gcaaaggaggggaaacaatg

SEQ ID NO: 4403578 - DNA, 22 bp, Homo sapiens
gcaaaggaggggaaacaatgaa

SEQ ID NO: 4403579 - DNA, 13 bp, Homo sapiens
gcaaaggccctgg

SEQ ID NO: 4403580 - DNA, 19 bp, Homo sapiens
gcaaagtacaatgtgtttt

SEQ ID NO: 4403581 - DNA, 14 bp, Homo sapiens
gcaaagtactgtaa

SEQ ID NO: 4403582 - DNA, 14 bp, Homo sapiens
gcaaagtagtactt

SEQ ID NO: 4403583 - DNA, 23 bp, Homo sapiens
gcaaagtagtacttcttctgtaa

SEQ ID NO: 4403584 - DNA, 15 bp, Homo sapiens
gcaaagtattgtaaa

SEQ ID NO: 4403585 - DNA, 17 bp, Homo sapiens
gcaaagtattgtaaatt

SEQ ID NO: 4403586 - DNA, 20 bp, Homo sapiens
gcaaagtattgtaaattata

SEQ ID NO: 4403587 - DNA, 15 bp, Homo sapiens
gcaaagtggttccct

SEQ ID NO: 4403588 - DNA, 17 bp, Homo sapiens
gcaaagtgttttgtacc

SEQ ID NO: 4403589 - DNA, 17 bp, Homo sapiens
gcaaagtttaaatgtat

SEQ ID NO: 4403590 - DNA, 19 bp, Homo sapiens
gcaaagtttacagatgttt

SEQ ID NO: 4403591 - DNA, 14 bp, Homo sapiens
gcaaataaagcagt

SEQ ID NO: 4403592 - DNA, 21 bp, Homo sapiens
gcaaatagaaaacaggaaaaa

SEQ ID NO: 4403593 - DNA, 12 bp, Homo sapiens
gcaaatatatga

SEQ ID NO: 4403594 - DNA, 17 bp, Homo sapiens
gcaaatattagcaaaga

SEQ ID NO: 4403595 - DNA, 15 bp, Homo sapiens
gcaaatattgaagtt

SEQ ID NO: 4403596 - DNA, 18 bp, Homo sapiens
gcaaatattgaagttgtt

SEQ ID NO: 4403597 - DNA, 20 bp, Homo sapiens
gcaaatattgaagttgttta

SEQ ID NO: 4403598 - DNA, 17 bp, Homo sapiens
gcaaatcacaacattct

SEQ ID NO: 4403599 - DNA, 22 bp, Homo sapiens
gcaaatcagaaacttgtgaagt

SEQ ID NO: 4403600 - DNA, 17 bp, Homo sapiens
gcaaatcagtatatttt

SEQ ID NO: 4403601 - DNA, 14 bp, Homo sapiens
gcaaatcatttgtt

SEQ ID NO: 4403602 - DNA, 12 bp, Homo sapiens
gcaaatcttgaa

SEQ ID NO: 4403603 - DNA, 14 bp, Homo sapiens
gcaaatggagataa

SEQ ID NO: 4403604 - DNA, 20 bp, Homo sapiens
gcaaatgggagctgagcagc

SEQ ID NO: 4403605 - DNA, 12 bp, Homo sapiens
gcaaatgtttac

SEQ ID NO: 4403606 - DNA, 16 bp, Homo sapiens
gcaaattcagaactga

SEQ ID NO: 4403607 - DNA, 13 bp, Homo sapiens
gcaaattgtgaaa

SEQ ID NO: 4403608 - DNA, 14 bp, Homo sapiens
gcaaattgtgaaat

SEQ ID NO: 4403609 - DNA, 17 bp, Homo sapiens
gcaaatttctataaatt

SEQ ID NO: 4403610 - DNA, 15 bp, Homo sapiens
gcaacaacaattggt

SEQ ID NO: 4403611 - DNA, 14 bp, Homo sapiens
gcaacaatttatga

SEQ ID NO: 4403612 - DNA, 15 bp, Homo sapiens
gcaacagactctcac

SEQ ID NO: 4403613 - DNA, 13 bp, Homo sapiens
gcaacagagcact

SEQ ID NO: 4403614 - DNA, 23 bp, Homo sapiens
gcaacagcctacaaagagatgct

SEQ ID NO: 4403615 - DNA, 19 bp, Homo sapiens
gcaacaggccattgtgaac

SEQ ID NO: 4403616 - DNA, 14 bp, Homo sapiens
gcaacattggacag

SEQ ID NO: 4403617 - DNA, 20 bp, Homo sapiens
gcaacattggacagaaaatg

SEQ ID NO: 4403618 - DNA, 17 bp, Homo sapiens
gcaaccaactgccccag

SEQ ID NO: 4403619 - DNA, 15 bp, Homo sapiens
gcaaccaggaacagc

SEQ ID NO: 4403620 - DNA, 15 bp, Homo sapiens
gcaacccaaggaacc

SEQ ID NO: 4403621 - DNA, 22 bp, Homo sapiens
gcaaccctacagtatataagct

SEQ ID NO: 4403622 - DNA, 21 bp, Homo sapiens
gcaacccttaccccttagcct

SEQ ID NO: 4403623 - DNA, 23 bp, Homo sapiens
gcaaccgtctgttatgctgtgac

SEQ ID NO: 4403624 - DNA, 14 bp, Homo sapiens
gcaacctacccagc

SEQ ID NO: 4403625 - DNA, 18 bp, Homo sapiens
gcaacctacccagcgtgg

SEQ ID NO: 4403626 - DNA, 15 bp, Homo sapiens
gcaacctcactatgg

SEQ ID NO: 4403627 - DNA, 19 bp, Homo sapiens
gcaacctcagtaatttaga

SEQ ID NO: 4403628 - DNA, 15 bp, Homo sapiens
gcaacgtagcctggg

SEQ ID NO: 4403629 - DNA, 16 bp, Homo sapiens
gcaactacaacttctc

SEQ ID NO: 4403630 - DNA, 17 bp, Homo sapiens
gcaactcccacgactgt

SEQ ID NO: 4403631 - DNA, 20 bp, Homo sapiens
gcaactcttatttctttcct

SEQ ID NO: 4403632 - DNA, 21 bp, Homo sapiens
gcaactcttatttctttcctt

SEQ ID NO: 4403633 - DNA, 15 bp, Homo sapiens
gcaactcttgattat

SEQ ID NO: 4403634 - DNA, 14 bp, Homo sapiens
gcaactcttggaag

SEQ ID NO: 4403635 - DNA, 17 bp, Homo sapiens
gcaactcttttaagtgc

SEQ ID NO: 4403636 - DNA, 18 bp, Homo sapiens
gcaactgagtctgcggga

SEQ ID NO: 4403637 - DNA, 22 bp, Homo sapiens
gcaacttagatctctcctgcaa

SEQ ID NO: 4403638 - DNA, 14 bp, Homo sapiens
gcaagaaaaccaca

SEQ ID NO: 4403639 - DNA, 21 bp, Homo sapiens
gcaagaaggcaaaaatagttt

SEQ ID NO: 4403640 - DNA, 23 bp, Homo sapiens
gcaagaaggcaaaaatagtttgg

SEQ ID NO: 4403641 - DNA, 21 bp, Homo sapiens
gcaagaatcagagaaggaaca

SEQ ID NO: 4403642 - DNA, 12 bp, Homo sapiens
gcaagaccacgg

SEQ ID NO: 4403643 - DNA, 18 bp, Homo sapiens
gcaagaccacggagggag

SEQ ID NO: 4403644 - DNA, 19 bp, Homo sapiens
gcaagagactgggagccac

SEQ ID NO: 4403645 - DNA, 23 bp, Homo sapiens
gcaagagccttggtgtccacctg

SEQ ID NO: 4403646 - DNA, 19 bp, Homo sapiens
gcaagagtctgtctcaaaa

SEQ ID NO: 4403647 - DNA, 15 bp, Homo sapiens
gcaagatgagctgtg

SEQ ID NO: 4403648 - DNA, 14 bp, Homo sapiens
gcaagatgtgaatt

SEQ ID NO: 4403649 - DNA, 17 bp, Homo sapiens
aaaagctttatgatttt

SEQ ID NO: 4403650 - DNA, 22 bp, Homo sapiens
aaaagctttatgattttcataa

SEQ ID NO: 4403651 - DNA, 14 bp, Homo sapiens
aaaaggaaaaagct

SEQ ID NO: 4403652 - DNA, 15 bp, Homo sapiens
aaaaggaaaaagctc

SEQ ID NO: 4403653 - DNA, 19 bp, Homo sapiens
aaaaggaaagtttgccagg

SEQ ID NO: 4403654 - DNA, 18 bp, Homo sapiens
aaaaggaaggaagggaca

SEQ ID NO: 4403655 - DNA, 21 bp, Homo sapiens
aaaaggaagtttccagaaaag

SEQ ID NO: 4403656 - DNA, 19 bp, Homo sapiens
aaaaggacatcagcaaaca

SEQ ID NO: 4403657 - DNA, 22 bp, Homo sapiens
aaaaggagagactcccatgaag

SEQ ID NO: 4403658 - DNA, 16 bp, Homo sapiens
aaaaggcaaatattga

SEQ ID NO: 4403659 - DNA, 17 bp, Homo sapiens
aaaaggccaatatacct

SEQ ID NO: 4403660 - DNA, 17 bp, Homo sapiens
aaaaggctaagaaaaag

SEQ ID NO: 4403661 - DNA, 12 bp, Homo sapiens
aaaagggaagta

SEQ ID NO: 4403662 - DNA, 15 bp, Homo sapiens
aaaagggcactctga

SEQ ID NO: 4403663 - DNA, 10 bp, Homo sapiens
aaaagggtca

SEQ ID NO: 4403664 - DNA, 21 bp, Homo sapiens
aaaaggtgataggtaaatttt

SEQ ID NO: 4403665 - DNA, 19 bp, Homo sapiens
aaaaggtggagtttctctg

SEQ ID NO: 4403666 - DNA, 14 bp, Homo sapiens
aaaaggtttatgaa

SEQ ID NO: 4403667 - DNA, 20 bp, Homo sapiens
aaaaggtttatgaaaaagaa

SEQ ID NO: 4403668 - DNA, 23 bp, Homo sapiens
aaaaggtttatgaaaaagaagaa

SEQ ID NO: 4403669 - DNA, 24 bp, Homo sapiens
aaaagtaatgaagaatcacgattt

SEQ ID NO: 4403670 - DNA, 21 bp, Homo sapiens
aaaagtaatgacttagaaact

SEQ ID NO: 4403671 - DNA, 20 bp, Homo sapiens
aaaagtactaatagaacttg

SEQ ID NO: 4403672 - DNA, 22 bp, Homo sapiens
aaaagtagtttgaatgttttgt

SEQ ID NO: 4403673 - DNA, 15 bp, Homo sapiens
aaaagtcagatgttt

SEQ ID NO: 4403674 - DNA, 20 bp, Homo sapiens
aaaagtccataccttatata

SEQ ID NO: 4403675 - DNA, 19 bp, Homo sapiens
aaaagtcgttttccaaact

SEQ ID NO: 4403676 - DNA, 22 bp, Homo sapiens
aaaagtcgttttccaaactgac

SEQ ID NO: 4403677 - DNA, 23 bp, Homo sapiens
aaaagtcgttttccaaactgact

SEQ ID NO: 4403678 - DNA, 16 bp, Homo sapiens
aaaagtctacctgtgt

SEQ ID NO: 4403679 - DNA, 17 bp, Homo sapiens
aaaagtctccaaaacat

SEQ ID NO: 4403680 - DNA, 13 bp, Homo sapiens
aaaagtctctatt

SEQ ID NO: 4403681 - DNA, 15 bp, Homo sapiens
aaaagtctctattta

SEQ ID NO: 4403682 - DNA, 21 bp, Homo sapiens
aaaagtctctatttaaattct

SEQ ID NO: 4403683 - DNA, 14 bp, Homo sapiens
aaaagtctgtcttt

SEQ ID NO: 4403684 - DNA, 16 bp, Homo sapiens
aaaagtgatgtatttt

SEQ ID NO: 4403685 - DNA, 20 bp, Homo sapiens
aaaagtgattatctctttga

SEQ ID NO: 4403686 - DNA, 16 bp, Homo sapiens
aaaagtgattgtgaag

SEQ ID NO: 4403687 - DNA, 21 bp, Homo sapiens
aaaagtgattgtgaaggattt

SEQ ID NO: 4403688 - DNA, 14 bp, Homo sapiens
aaaagtgcaatgcg

SEQ ID NO: 4403689 - DNA, 18 bp, Homo sapiens
aaaagtggggcagagcct

SEQ ID NO: 4403690 - DNA, 20 bp, Homo sapiens
aaaagtggggctaaatgaag

SEQ ID NO: 4403691 - DNA, 19 bp, Homo sapiens
aaaagtgtctttgtttaaa

SEQ ID NO: 4403692 - DNA, 15 bp, Homo sapiens
aaaagtgttttgaat

SEQ ID NO: 4403693 - DNA, 18 bp, Homo sapiens
aaaagttctgcagataaa

SEQ ID NO: 4403694 - DNA, 14 bp, Homo sapiens
aaaagttgaaccat

SEQ ID NO: 4403695 - DNA, 22 bp, Homo sapiens
aaaagtttattgtttgatgttt

SEQ ID NO: 4403696 - DNA, 17 bp, Homo sapiens
aaaagtttgaaaagcaa

SEQ ID NO: 4403697 - DNA, 23 bp, Homo sapiens
aaaagtttgaaaagcaatattgt

SEQ ID NO: 4403698 - DNA, 19 bp, Homo sapiens
aaaagtttttaatttgatg

SEQ ID NO: 4403699 - DNA, 20 bp, Homo sapiens
aaaagttttttattatgcat

SEQ ID NO: 4403700 - DNA, 20 bp, Homo sapiens
aaaataaaaaatctgaagag

SEQ ID NO: 4403701 - DNA, 14 bp, Homo sapiens
aaaataaaacacac

SEQ ID NO: 4403702 - DNA, 23 bp, Homo sapiens
aaaataaaacatcacctatttaa

SEQ ID NO: 4403703 - DNA, 11 bp, Homo sapiens
aaaataaaata

SEQ ID NO: 4403704 - DNA, 21 bp, Homo sapiens
aaaataaaatgaaaattgtat

SEQ ID NO: 4403705 - DNA, 20 bp, Homo sapiens
aaaataaagacaaccatatt

SEQ ID NO: 4403706 - DNA, 14 bp, Homo sapiens
aaaataaagcaaat

SEQ ID NO: 4403707 - DNA, 19 bp, Homo sapiens
aaaataaatcttagtgttc

SEQ ID NO: 4403708 - DNA, 20 bp, Homo sapiens
aaaataaatcttagtgttca

SEQ ID NO: 4403709 - DNA, 18 bp, Homo sapiens
aaaataacctaattaata

SEQ ID NO: 4403710 - DNA, 20 bp, Homo sapiens
aaaataagacaatagtattt

SEQ ID NO: 4403711 - DNA, 22 bp, Homo sapiens
aaaataagtggattttgtattt

SEQ ID NO: 4403712 - DNA, 13 bp, Homo sapiens
aaaataataataa

SEQ ID NO: 4403713 - DNA, 15 bp, Homo sapiens
aaaataataatagta

SEQ ID NO: 4403714 - DNA, 20 bp, Homo sapiens
aaaataattatataactgta

SEQ ID NO: 4403715 - DNA, 14 bp, Homo sapiens
aaaataattattta

SEQ ID NO: 4403716 - DNA, 17 bp, Homo sapiens
aaaataattcatatcta

SEQ ID NO: 4403717 - DNA, 17 bp, Homo sapiens
aaaatacaaaaaaatta

SEQ ID NO: 4403718 - DNA, 14 bp, Homo sapiens
aaaatacaaaaagc

SEQ ID NO: 4403719 - DNA, 15 bp, Homo sapiens
aaaatacaattttta

SEQ ID NO: 4403720 - DNA, 17 bp, Homo sapiens
aaaatacacgtttatct

SEQ ID NO: 4403721 - DNA, 14 bp, Homo sapiens
aaaatacatagcat

SEQ ID NO: 4403722 - DNA, 23 bp, Homo sapiens
aaaataccagagccttcaagtgc

SEQ ID NO: 4403723 - DNA, 22 bp, Homo sapiens
aaaatactgactccaaccattc

SEQ ID NO: 4403724 - DNA, 11 bp, Homo sapiens
aaaatacttct

SEQ ID NO: 4403725 - DNA, 13 bp, Homo sapiens
aaaatacttctat

SEQ ID NO: 4403726 - DNA, 19 bp, Homo sapiens
aaaatacttctttttcatt

SEQ ID NO: 4403727 - DNA, 20 bp, Homo sapiens
aaaatagagcaaaatcaaca

SEQ ID NO: 4403728 - DNA, 21 bp, Homo sapiens
aaaatagagcaaaatcaacat

SEQ ID NO: 4403729 - DNA, 22 bp, Homo sapiens
aaaatagataagagtagaaact

SEQ ID NO: 4403730 - DNA, 17 bp, Homo sapiens
aaaatagatgtctttta

SEQ ID NO: 4403731 - DNA, 20 bp, Homo sapiens
aaaatagctatttttttcct

SEQ ID NO: 4403732 - DNA, 15 bp, Homo sapiens
aaaataggcttttta

SEQ ID NO: 4403733 - DNA, 20 bp, Homo sapiens
aaaataggtgcaataatgat

SEQ ID NO: 4403734 - DNA, 12 bp, Homo sapiens
aaaatagtgtaa

SEQ ID NO: 4403735 - DNA, 17 bp, Homo sapiens
aaaatagtgtaagaact

SEQ ID NO: 4403736 - DNA, 22 bp, Homo sapiens
aaaatagtttggatatgtaaaa

SEQ ID NO: 4403737 - DNA, 10 bp, Homo sapiens
aaaatataaa

SEQ ID NO: 4403738 - DNA, 13 bp, Homo sapiens
aaaatataaattg

SEQ ID NO: 4403739 - DNA, 22 bp, Homo sapiens
aaaatataaggactttttgatg

SEQ ID NO: 4403740 - DNA, 18 bp, Homo sapiens
aaaatataagtaaagtga

SEQ ID NO: 4403741 - DNA, 19 bp, Homo sapiens
aaaatatagagacaggaca

SEQ ID NO: 4403742 - DNA, 13 bp, Homo sapiens
aaaatatatatct

SEQ ID NO: 4403743 - DNA, 15 bp, Homo sapiens
aaaatatatgtattt

SEQ ID NO: 4403744 - DNA, 16 bp, Homo sapiens
aaaatatatgtatttt

SEQ ID NO: 4403745 - DNA, 13 bp, Homo sapiens
aaaatatctacat

SEQ ID NO: 4403746 - DNA, 22 bp, Homo sapiens
aaaatatctacattaatatact

SEQ ID NO: 4403747 - DNA, 21 bp, Homo sapiens
aaaatattgagcagaattcat

SEQ ID NO: 4403748 - DNA, 15 bp, Homo sapiens
aaaatattgtttctg

SEQ ID NO: 4403749 - DNA, 14 bp, Homo sapiens
aaaatatttaatat

SEQ ID NO: 4403750 - DNA, 20 bp, Homo sapiens
aaaatatttttttaagaaaa

SEQ ID NO: 4403751 - DNA, 12 bp, Homo sapiens
aaaatcaacttt

SEQ ID NO: 4403752 - DNA, 20 bp, Homo sapiens
aaaatcaactttttattgcc

SEQ ID NO: 4403753 - DNA, 14 bp, Homo sapiens
aaaatcacgttaaa

SEQ ID NO: 4403754 - DNA, 15 bp, Homo sapiens
aaaatcactttcata

SEQ ID NO: 4403755 - DNA, 18 bp, Homo sapiens
aaaatcagctattttgtg

SEQ ID NO: 4403756 - DNA, 18 bp, Homo sapiens
aaaatcatctattttgat

SEQ ID NO: 4403757 - DNA, 19 bp, Homo sapiens
aaaatcatctattttgatg

SEQ ID NO: 4403758 - DNA, 14 bp, Homo sapiens
aaaatcatgtgaca

SEQ ID NO: 4403759 - DNA, 12 bp, Homo sapiens
aaaatcatgttt

SEQ ID NO: 4403760 - DNA, 12 bp, Homo sapiens
aaaatcatttct

SEQ ID NO: 4403761 - DNA, 17 bp, Homo sapiens
aaaatccaaaaagctct

SEQ ID NO: 4403762 - DNA, 21 bp, Homo sapiens
aaaatccaaaaagctctgaaa

SEQ ID NO: 4403763 - DNA, 18 bp, Homo sapiens
aaaatccagactttcttt

SEQ ID NO: 4403764 - DNA, 20 bp, Homo sapiens
aaaatccagactttcttttt

SEQ ID NO: 4403765 - DNA, 18 bp, Homo sapiens
aaaatcccaccttcccac

SEQ ID NO: 4403766 - DNA, 23 bp, Homo sapiens
aaaatcctgaactttctccctca

SEQ ID NO: 4403767 - DNA, 19 bp, Homo sapiens
aaacgagtcaatcccctca

SEQ ID NO: 4403768 - DNA, 12 bp, Homo sapiens
aaacggcagcct

SEQ ID NO: 4403769 - DNA, 12 bp, Homo sapiens
aaacggcccagg

SEQ ID NO: 4403770 - DNA, 13 bp, Homo sapiens
aaacggcccaggc

SEQ ID NO: 4403771 - DNA, 18 bp, Homo sapiens
aaacgggcagtctgctct

SEQ ID NO: 4403772 - DNA, 22 bp, Homo sapiens
aaacgtgttgtatctacagtaa

SEQ ID NO: 4403773 - DNA, 14 bp, Homo sapiens
aaacgtttgacaaa

SEQ ID NO: 4403774 - DNA, 20 bp, Homo sapiens
aaactaaccttgaataaggc

SEQ ID NO: 4403775 - DNA, 16 bp, Homo sapiens
aaactaagattctttt

SEQ ID NO: 4403776 - DNA, 19 bp, Homo sapiens
aaactaaggcttttatttc

SEQ ID NO: 4403777 - DNA, 16 bp, Homo sapiens
aaactaatattttatg

SEQ ID NO: 4403778 - DNA, 17 bp, Homo sapiens
aaactactatttttctt

SEQ ID NO: 4403779 - DNA, 21 bp, Homo sapiens
aaactactatttttctttcca

SEQ ID NO: 4403780 - DNA, 17 bp, Homo sapiens
aaactactctttgattt

SEQ ID NO: 4403781 - DNA, 20 bp, Homo sapiens
aaactactgaatgaagcagt

SEQ ID NO: 4403782 - DNA, 15 bp, Homo sapiens
aaactataaacttaa

SEQ ID NO: 4403783 - DNA, 16 bp, Homo sapiens
aaactatgtgtttttc

SEQ ID NO: 4403784 - DNA, 17 bp, Homo sapiens
aaactatgtgtttttct

SEQ ID NO: 4403785 - DNA, 19 bp, Homo sapiens
aaactatgtgtttttctca

SEQ ID NO: 4403786 - DNA, 18 bp, Homo sapiens
aaactatttatatcacac

SEQ ID NO: 4403787 - DNA, 19 bp, Homo sapiens
aaactatttatatcacaca

SEQ ID NO: 4403788 - DNA, 14 bp, Homo sapiens
aaactatttgtata

SEQ ID NO: 4403789 - DNA, 16 bp, Homo sapiens
aaactatttttttctt

SEQ ID NO: 4403790 - DNA, 22 bp, Homo sapiens
aaactcactgtgatcaatattt

SEQ ID NO: 4403791 - DNA, 21 bp, Homo sapiens
aaactcagcctgggacagttt

SEQ ID NO: 4403792 - DNA, 13 bp, Homo sapiens
aaactcaggcaga

SEQ ID NO: 4403793 - DNA, 16 bp, Homo sapiens
aaactcatcacataaa

SEQ ID NO: 4403794 - DNA, 19 bp, Homo sapiens
aaactcatcacataaagaa

SEQ ID NO: 4403795 - DNA, 22 bp, Homo sapiens
aaactcatcacataaagaaatt

SEQ ID NO: 4403796 - DNA, 16 bp, Homo sapiens
aaactccacatctgcc

SEQ ID NO: 4403797 - DNA, 19 bp, Homo sapiens
aaactccacatctgcctta

SEQ ID NO: 4403798 - DNA, 22 bp, Homo sapiens
aaactccgagtgaactggtctt

SEQ ID NO: 4403799 - DNA, 17 bp, Homo sapiens
aaactcctatttcaatg

SEQ ID NO: 4403800 - DNA, 18 bp, Homo sapiens
aaactcctatttcaatga

SEQ ID NO: 4403801 - DNA, 14 bp, Homo sapiens
aaactctctcccag

SEQ ID NO: 4403802 - DNA, 16 bp, Homo sapiens
aaactctctcccagga

SEQ ID NO: 4403803 - DNA, 17 bp, Homo sapiens
aaactctctcccaggac

SEQ ID NO: 4403804 - DNA, 22 bp, Homo sapiens
aaactctggacactctatatgt

SEQ ID NO: 4403805 - DNA, 23 bp, Homo sapiens
aaactctggtgataaaaataaag

SEQ ID NO: 4403806 - DNA, 19 bp, Homo sapiens
aaactgaacttgaagctaa

SEQ ID NO: 4403807 - DNA, 21 bp, Homo sapiens
aaactgagatgtgaacacatc

SEQ ID NO: 4403808 - DNA, 19 bp, Homo sapiens
aaactgaggaatttcacct

SEQ ID NO: 4403809 - DNA, 15 bp, Homo sapiens
aaactgagtcactca

SEQ ID NO: 4403810 - DNA, 16 bp, Homo sapiens
aaactgagtcactcac

SEQ ID NO: 4403811 - DNA, 17 bp, Homo sapiens
aaactgagtcactcaca

SEQ ID NO: 4403812 - DNA, 22 bp, Homo sapiens
aaactgcatcccacgttctgtt

SEQ ID NO: 4403813 - DNA, 17 bp, Homo sapiens
aaactgccaaacctcct

SEQ ID NO: 4403814 - DNA, 21 bp, Homo sapiens
aaactgcgaggacatcaaagt

SEQ ID NO: 4403815 - DNA, 11 bp, Homo sapiens
aaactgctcag

SEQ ID NO: 4403816 - DNA, 16 bp, Homo sapiens
aaactgctgcagatta

SEQ ID NO: 4403817 - DNA, 14 bp, Homo sapiens
aaactggcttcccc

SEQ ID NO: 4403818 - DNA, 17 bp, Homo sapiens
aaactgggaaactgggt

SEQ ID NO: 4403819 - DNA, 15 bp, Homo sapiens
aaactgggataactg

SEQ ID NO: 4403820 - DNA, 18 bp, Homo sapiens
aaactgggtcttcagctt

SEQ ID NO: 4403821 - DNA, 11 bp, Homo sapiens
aaactggttcc

SEQ ID NO: 4403822 - DNA, 15 bp, Homo sapiens
aaactggttcctaca

SEQ ID NO: 4403823 - DNA, 18 bp, Homo sapiens
aaactgtagaaatgatga

SEQ ID NO: 4403824 - DNA, 16 bp, Homo sapiens
aaactgtgaaaatagt

SEQ ID NO: 4403825 - DNA, 22 bp, Homo sapiens
aaactgtgaaaatagtgtaaga

SEQ ID NO: 4403826 - DNA, 17 bp, Homo sapiens
aaactgtgcaacttttt

SEQ ID NO: 4403827 - DNA, 22 bp, Homo sapiens
aaactgtgcaactttttaaagt

SEQ ID NO: 4403828 - DNA, 21 bp, Homo sapiens
aaactgtgtacataactgaaa

SEQ ID NO: 4403829 - DNA, 16 bp, Homo sapiens
aaactgtgtattccaa

SEQ ID NO: 4403830 - DNA, 18 bp, Homo sapiens
aaactgtgtattccaaga

SEQ ID NO: 4403831 - DNA, 17 bp, Homo sapiens
aaactgtgttgccacag

SEQ ID NO: 4403832 - DNA, 17 bp, Homo sapiens
aaactgtttcaagccct

SEQ ID NO: 4403833 - DNA, 14 bp, Homo sapiens
aaacttaaaaacaa

SEQ ID NO: 4403834 - DNA, 15 bp, Homo sapiens
aaacttagcttttga

SEQ ID NO: 4403835 - DNA, 11 bp, Homo sapiens
aaacttcagca

SEQ ID NO: 4403836 - DNA, 16 bp, Homo sapiens
aaacttcagcaaccct

SEQ ID NO: 4403837 - DNA, 20 bp, Homo sapiens
aaacttcatgtaattttatt

SEQ ID NO: 4403838 - DNA, 17 bp, Homo sapiens
aaacttcattctcgtga

SEQ ID NO: 4403839 - DNA, 13 bp, Homo sapiens
aaacttgacccag

SEQ ID NO: 4403840 - DNA, 15 bp, Homo sapiens
aaacttgagtggctg

SEQ ID NO: 4403841 - DNA, 18 bp, Homo sapiens
aaacttggaatcaaggta

SEQ ID NO: 4403842 - DNA, 19 bp, Homo sapiens
aaacttggatacttggatt

SEQ ID NO: 4403843 - DNA, 24 bp, Homo sapiens
aaacttgtggcctcaagcaatcca

SEQ ID NO: 4403844 - DNA, 14 bp, Homo sapiens
aaactttaaacctg

SEQ ID NO: 4403845 - DNA, 19 bp, Homo sapiens
aaactttatgctaagtgaa

SEQ ID NO: 4403846 - DNA, 14 bp, Homo sapiens
aaactttattttat

SEQ ID NO: 4403847 - DNA, 23 bp, Homo sapiens
aaactttattttatataataaag

SEQ ID NO: 4403848 - DNA, 19 bp, Homo sapiens
aaactttcaatattttaac

SEQ ID NO: 4403849 - DNA, 20 bp, Homo sapiens
aaactttcattccttcagat

SEQ ID NO: 4403850 - DNA, 15 bp, Homo sapiens
aaactttgtcacttc

SEQ ID NO: 4403851 - DNA, 20 bp, Homo sapiens
aaacttttctttcttttctt

SEQ ID NO: 4403852 - DNA, 15 bp, Homo sapiens
aaactttttaattgt

SEQ ID NO: 4403853 - DNA, 12 bp, Homo sapiens
aaacttttttat

SEQ ID NO: 4403854 - DNA, 17 bp, Homo sapiens
aaacttttttatttaaa

SEQ ID NO: 4403855 - DNA, 19 bp, Homo sapiens
aaactttttttctgtacca

SEQ ID NO: 4403856 - DNA, 22 bp, Homo sapiens
aaagaaaaaaaaaaaagccagc

SEQ ID NO: 4403857 - DNA, 16 bp, Homo sapiens
aaagaaaaaattttat

SEQ ID NO: 4403858 - DNA, 20 bp, Homo sapiens
aaagaaaaatctcattattt

SEQ ID NO: 4403859 - DNA, 19 bp, Homo sapiens
aaagaaaaattaattagga

SEQ ID NO: 4403860 - DNA, 16 bp, Homo sapiens
aaagaaaataaagaca

SEQ ID NO: 4403861 - DNA, 16 bp, Homo sapiens
aaagaaaattcctata

SEQ ID NO: 4403862 - DNA, 12 bp, Homo sapiens
aaagaaaatttt

SEQ ID NO: 4403863 - DNA, 19 bp, Homo sapiens
aaagaaaatttttgtagta

SEQ ID NO: 4403864 - DNA, 16 bp, Homo sapiens
aaagaaagtgtatttg

SEQ ID NO: 4403865 - DNA, 15 bp, Homo sapiens
aaagaaatgaacatt

SEQ ID NO: 4403866 - DNA, 14 bp, Homo sapiens
aaagaaattcaaga

SEQ ID NO: 4403867 - DNA, 15 bp, Homo sapiens
aaagaacatacatga

SEQ ID NO: 4403868 - DNA, 16 bp, Homo sapiens
aaagaacatacatgat

SEQ ID NO: 4403869 - DNA, 23 bp, Homo sapiens
aaagaaccaacaacctcaactgc

SEQ ID NO: 4403870 - DNA, 13 bp, Homo sapiens
aaagaaccacttg

SEQ ID NO: 4403871 - DNA, 19 bp, Homo sapiens
aaagaactcattcatagga

SEQ ID NO: 4403872 - DNA, 13 bp, Homo sapiens
aaagaactcattt

SEQ ID NO: 4403873 - DNA, 11 bp, Homo sapiens
aaagaagaaac

SEQ ID NO: 4403874 - DNA, 16 bp, Homo sapiens
aaagaagcagaccatt

SEQ ID NO: 4403875 - DNA, 13 bp, Homo sapiens
aaagaagcttcat

SEQ ID NO: 4403876 - DNA, 15 bp, Homo sapiens
aaagaaggacccaga

SEQ ID NO: 4403877 - DNA, 22 bp, Homo sapiens
aaagaagggatattaagaatct

SEQ ID NO: 4403878 - DNA, 21 bp, Homo sapiens
aaagaagggctggtattgttc

SEQ ID NO: 4403879 - DNA, 13 bp, Homo sapiens
aaagaaggtgctg

SEQ ID NO: 4403880 - DNA, 16 bp, Homo sapiens
aaagaaggtgctgatc

SEQ ID NO: 4403881 - DNA, 19 bp, Homo sapiens
aaagaaggtgctgatccta

SEQ ID NO: 4403882 - DNA, 15 bp, Homo sapiens
aaagaagtaaaagca

SEQ ID NO: 4403883 - DNA, 18 bp, Homo sapiens
aaagaagtatttaaactt

SEQ ID NO: 4403884 - DNA, 18 bp, Homo sapiens
aaagaagttattttccag

SEQ ID NO: 4403885 - DNA, 14 bp, Homo sapiens
aaagaataaaatgt

SEQ ID NO: 4403886 - DNA, 17 bp, Homo sapiens
aaagtggtatagaaatg

SEQ ID NO: 4403887 - DNA, 19 bp, Homo sapiens
aaagtggttctctgccttt

SEQ ID NO: 4403888 - DNA, 17 bp, Homo sapiens
aaagtggttttgtttgt

SEQ ID NO: 4403889 - DNA, 10 bp, Homo sapiens
aaagtgtatt

SEQ ID NO: 4403890 - DNA, 23 bp, Homo sapiens
aaagtgtatttggaaataaagtc

SEQ ID NO: 4403891 - DNA, 21 bp, Homo sapiens
aaagtgtctttgtttaaaatt

SEQ ID NO: 4403892 - DNA, 19 bp, Homo sapiens
aaagtgtgagctcttccct

SEQ ID NO: 4403893 - DNA, 14 bp, Homo sapiens
aaagtgttttcaga

SEQ ID NO: 4403894 - DNA, 15 bp, Homo sapiens
aaagtgttttgtacc

SEQ ID NO: 4403895 - DNA, 16 bp, Homo sapiens
aaagtgttttgtacca

SEQ ID NO: 4403896 - DNA, 22 bp, Homo sapiens
aaagttaaacattgaagtaatg

SEQ ID NO: 4403897 - DNA, 18 bp, Homo sapiens
aaagttaatgggatggtc

SEQ ID NO: 4403898 - DNA, 14 bp, Homo sapiens
aaagttatgtattt

SEQ ID NO: 4403899 - DNA, 23 bp, Homo sapiens
aaagttattcttgtcattttgaa

SEQ ID NO: 4403900 - DNA, 17 bp, Homo sapiens
aaagttcaattgtgaaa

SEQ ID NO: 4403901 - DNA, 22 bp, Homo sapiens
aaagttcataacagtgccattg

SEQ ID NO: 4403902 - DNA, 13 bp, Homo sapiens
aaagttcatgttg

SEQ ID NO: 4403903 - DNA, 23 bp, Homo sapiens
aaagttccacttccaggtctgcc

SEQ ID NO: 4403904 - DNA, 23 bp, Homo sapiens
aaagttctgcagataaacagtag

SEQ ID NO: 4403905 - DNA, 16 bp, Homo sapiens
aaagttctgtgtattt

SEQ ID NO: 4403906 - DNA, 20 bp, Homo sapiens
aaagttctgtgtatttaatt

SEQ ID NO: 4403907 - DNA, 18 bp, Homo sapiens
aaagttgataaagatttt

SEQ ID NO: 4403908 - DNA, 20 bp, Homo sapiens
aaagttgataaagatttttt

SEQ ID NO: 4403909 - DNA, 15 bp, Homo sapiens
aaagttgcttttatt

SEQ ID NO: 4403910 - DNA, 17 bp, Homo sapiens
aaagttggtattaataa

SEQ ID NO: 4403911 - DNA, 16 bp, Homo sapiens
aaagttggttggataa

SEQ ID NO: 4403912 - DNA, 22 bp, Homo sapiens
aaagttgtaaaatagaaaaagt

SEQ ID NO: 4403913 - DNA, 13 bp, Homo sapiens
aaagttgtacatg

SEQ ID NO: 4403914 - DNA, 12 bp, Homo sapiens
aaagttgtattt

SEQ ID NO: 4403915 - DNA, 12 bp, Homo sapiens
aaagtttaaatg

SEQ ID NO: 4403916 - DNA, 15 bp, Homo sapiens
aaagtttacagatgt

SEQ ID NO: 4403917 - DNA, 17 bp, Homo sapiens
aaagttttaatacctaa

SEQ ID NO: 4403918 - DNA, 16 bp, Homo sapiens
aaagttttgtaaaaga

SEQ ID NO: 4403919 - DNA, 19 bp, Homo sapiens
aaagtttttaatttgatgc

SEQ ID NO: 4403920 - DNA, 22 bp, Homo sapiens
aaagttttttattatgcattat

SEQ ID NO: 4403921 - DNA, 21 bp, Homo sapiens
aaataaaaaagctcttttaat

SEQ ID NO: 4403922 - DNA, 18 bp, Homo sapiens
aaataaaaaatctgaaga

SEQ ID NO: 4403923 - DNA, 20 bp, Homo sapiens
aaataaaaagaaaggctgtt

SEQ ID NO: 4403924 - DNA, 12 bp, Homo sapiens
aaataaaacaca

SEQ ID NO: 4403925 - DNA, 12 bp, Homo sapiens
aaataaaactgt

SEQ ID NO: 4403926 - DNA, 18 bp, Homo sapiens
aaataaaatactttttat

SEQ ID NO: 4403927 - DNA, 14 bp, Homo sapiens
aaataaaatgaaaa

SEQ ID NO: 4403928 - DNA, 21 bp, Homo sapiens
aaataaaatgaaaattgtatt

SEQ ID NO: 4403929 - DNA, 14 bp, Homo sapiens
aaataaaatgcctc

SEQ ID NO: 4403930 - DNA, 19 bp, Homo sapiens
aaataaacacatagattca

SEQ ID NO: 4403931 - DNA, 23 bp, Homo sapiens
aaataaacacatagattcacctg

SEQ ID NO: 4403932 - DNA, 14 bp, Homo sapiens
aaataaaccactgt

SEQ ID NO: 4403933 - DNA, 14 bp, Homo sapiens
aaataaaccttaat

SEQ ID NO: 4403934 - DNA, 19 bp, Homo sapiens
aaataaactatttatatca

SEQ ID NO: 4403935 - DNA, 14 bp, Homo sapiens
aaataaagaagtat

SEQ ID NO: 4403936 - DNA, 18 bp, Homo sapiens
aaataaagcttacatagt

SEQ ID NO: 4403937 - DNA, 19 bp, Homo sapiens
aaataaaggaaaacaaaaa

SEQ ID NO: 4403938 - DNA, 19 bp, Homo sapiens
aaataacaactatttttgt

SEQ ID NO: 4403939 - DNA, 14 bp, Homo sapiens
aaataagaagaatg

SEQ ID NO: 4403940 - DNA, 20 bp, Homo sapiens
aaataagaagaatgcttaat

SEQ ID NO: 4403941 - DNA, 13 bp, Homo sapiens
aaataagacaata

SEQ ID NO: 4403942 - DNA, 12 bp, Homo sapiens
aaataaggctaa

SEQ ID NO: 4403943 - DNA, 14 bp, Homo sapiens
aaataagtaaatgt

SEQ ID NO: 4403944 - DNA, 16 bp, Homo sapiens
aaataagtaatatctt

SEQ ID NO: 4403945 - DNA, 21 bp, Homo sapiens
aaataagtcaacagtaaacca

SEQ ID NO: 4403946 - DNA, 13 bp, Homo sapiens
aaataagtttttg

SEQ ID NO: 4403947 - DNA, 19 bp, Homo sapiens
aaataataatagtactatt

SEQ ID NO: 4403948 - DNA, 14 bp, Homo sapiens
aaataatcaaaagc

SEQ ID NO: 4403949 - DNA, 13 bp, Homo sapiens
aaataatgtctct

SEQ ID NO: 4403950 - DNA, 12 bp, Homo sapiens
aaataattattt

SEQ ID NO: 4403951 - DNA, 19 bp, Homo sapiens
aaataatttaactaccctt

SEQ ID NO: 4403952 - DNA, 22 bp, Homo sapiens
aaatacaaaaagcaaaacaaaa

SEQ ID NO: 4403953 - DNA, 19 bp, Homo sapiens
aaatacaacttaaataata

SEQ ID NO: 4403954 - DNA, 22 bp, Homo sapiens
aaatacagtcttccatttgcaa

SEQ ID NO: 4403955 - DNA, 23 bp, Homo sapiens
aaatacagtcttccatttgcaag

SEQ ID NO: 4403956 - DNA, 14 bp, Homo sapiens
aaatacagttattt

SEQ ID NO: 4403957 - DNA, 13 bp, Homo sapiens
aaatacatgacat

SEQ ID NO: 4403958 - DNA, 22 bp, Homo sapiens
aaatacattataacaactattt

SEQ ID NO: 4403959 - DNA, 15 bp, Homo sapiens
aaataccacaagcct

SEQ ID NO: 4403960 - DNA, 22 bp, Homo sapiens
aaataccacaagcctgagaact

SEQ ID NO: 4403961 - DNA, 16 bp, Homo sapiens
aaatacctcaattttt

SEQ ID NO: 4403962 - DNA, 17 bp, Homo sapiens
aaatacctcaatttttg

SEQ ID NO: 4403963 - DNA, 14 bp, Homo sapiens
aaatacctcaggaa

SEQ ID NO: 4403964 - DNA, 18 bp, Homo sapiens
aaatacctcaggaaagaa

SEQ ID NO: 4403965 - DNA, 15 bp, Homo sapiens
aaatactatgcagta

SEQ ID NO: 4403966 - DNA, 14 bp, Homo sapiens
aaatactcagtgat

SEQ ID NO: 4403967 - DNA, 15 bp, Homo sapiens
aaatactgcaaatca

SEQ ID NO: 4403968 - DNA, 18 bp, Homo sapiens
aaatagaaaagtagacaa

SEQ ID NO: 4403969 - DNA, 17 bp, Homo sapiens
aaatagaaaagttatta

SEQ ID NO: 4403970 - DNA, 12 bp, Homo sapiens
aaatagaaattt

SEQ ID NO: 4403971 - DNA, 14 bp, Homo sapiens
aaatagaaattttg

SEQ ID NO: 4403972 - DNA, 14 bp, Homo sapiens
aaatagacaaaaag

SEQ ID NO: 4403973 - DNA, 21 bp, Homo sapiens
aaatagagcaaaatcaacatg

SEQ ID NO: 4403974 - DNA, 21 bp, Homo sapiens
aaatagataagagtagaaact

SEQ ID NO: 4403975 - DNA, 13 bp, Homo sapiens
aaatagataattt

SEQ ID NO: 4403976 - DNA, 21 bp, Homo sapiens
aaatagatgtcttttatagtg

SEQ ID NO: 4403977 - DNA, 16 bp, Homo sapiens
aaatagcaaaagaaga

SEQ ID NO: 4403978 - DNA, 21 bp, Homo sapiens
aaatagccgggcatggtggcg

SEQ ID NO: 4403979 - DNA, 18 bp, Homo sapiens
aaatagctatttttttcc

SEQ ID NO: 4403980 - DNA, 17 bp, Homo sapiens
aaataggatgtactgtt

SEQ ID NO: 4403981 - DNA, 20 bp, Homo sapiens
aaataggattttgaacccaa

SEQ ID NO: 4403982 - DNA, 15 bp, Homo sapiens
aaatagggaatatga

SEQ ID NO: 4403983 - DNA, 16 bp, Homo sapiens
aaatagggaatatgat

SEQ ID NO: 4403984 - DNA, 14 bp, Homo sapiens
aaatagtatacatt

SEQ ID NO: 4403985 - DNA, 12 bp, Homo sapiens
aaatagtatttc

SEQ ID NO: 4403986 - DNA, 14 bp, Homo sapiens
aaatagtattttgt

SEQ ID NO: 4403987 - DNA, 12 bp, Homo sapiens
aaatagtgtaag

SEQ ID NO: 4403988 - DNA, 15 bp, Homo sapiens
aaatagtgtaagaac

SEQ ID NO: 4403989 - DNA, 20 bp, Homo sapiens
aaatagtgtaagaactgtac

SEQ ID NO: 4403990 - DNA, 20 bp, Homo sapiens
aaatagttagatctttgtaa

SEQ ID NO: 4403991 - DNA, 21 bp, Homo sapiens
aaatagtttggatatgtaaaa

SEQ ID NO: 4403992 - DNA, 17 bp, Homo sapiens
aaatataaattgtacat

SEQ ID NO: 4403993 - DNA, 20 bp, Homo sapiens
aaatataaggactttttgat

SEQ ID NO: 4403994 - DNA, 12 bp, Homo sapiens
aaatatacagtt

SEQ ID NO: 4403995 - DNA, 13 bp, Homo sapiens
aaatatacagttt

SEQ ID NO: 4403996 - DNA, 20 bp, Homo sapiens
aaatataccactctttacct

SEQ ID NO: 4403997 - DNA, 20 bp, Homo sapiens
aaatatagagatatttttgt

SEQ ID NO: 4403998 - DNA, 13 bp, Homo sapiens
aaatatataatat

SEQ ID NO: 4403999 - DNA, 21 bp, Homo sapiens
aaatatatataaagaatatat

SEQ ID NO: 4404000 - DNA, 12 bp, Homo sapiens
aaatatatgtat

SEQ ID NO: 4404001 - DNA, 15 bp, Homo sapiens
aaatatatgtatgta

SEQ ID NO: 4404002 - DNA, 18 bp, Homo sapiens
aaatatattacttaactg

SEQ ID NO: 4404003 - DNA, 19 bp, Homo sapiens
aaatatattacttaactgt

SEQ ID NO: 4404004 - DNA, 17 bp, Homo sapiens
aaatatcaatggtgctg

SEQ ID NO: 4404005 - DNA, 23 bp, Homo sapiens
aaatgttatcttatactgtacaa

SEQ ID NO: 4404006 - DNA, 22 bp, Homo sapiens
aaatgttatgactatgtaaact

SEQ ID NO: 4404007 - DNA, 15 bp, Homo sapiens
aaatgttctgtttgc

SEQ ID NO: 4404008 - DNA, 22 bp, Homo sapiens
aaatgttgctctaatcagattg

SEQ ID NO: 4404009 - DNA, 17 bp, Homo sapiens
aaatgttggtcatttta

SEQ ID NO: 4404010 - DNA, 22 bp, Homo sapiens
aaatgttgttctcttctttaaa

SEQ ID NO: 4404011 - DNA, 14 bp, Homo sapiens
aaatgtttactgta

SEQ ID NO: 4404012 - DNA, 15 bp, Homo sapiens
aaatgtttactgtat

SEQ ID NO: 4404013 - DNA, 20 bp, Homo sapiens
aaatgtttatattgttttta

SEQ ID NO: 4404014 - DNA, 19 bp, Homo sapiens
aaatgtttggatggtttgt

SEQ ID NO: 4404015 - DNA, 13 bp, Homo sapiens
aaatgttttatga

SEQ ID NO: 4404016 - DNA, 19 bp, Homo sapiens
aaatgttttatgacatttt

SEQ ID NO: 4404017 - DNA, 16 bp, Homo sapiens
aaatgttttcatttta

SEQ ID NO: 4404018 - DNA, 16 bp, Homo sapiens
aaatgttttccaatat

SEQ ID NO: 4404019 - DNA, 17 bp, Homo sapiens
aaatgtttttatttttg

SEQ ID NO: 4404020 - DNA, 14 bp, Homo sapiens
aaatgtttttggtc

SEQ ID NO: 4404021 - DNA, 21 bp, Homo sapiens
aaatgttttttaaaatggtta

SEQ ID NO: 4404022 - DNA, 12 bp, Homo sapiens
aaattaaaaaaa

SEQ ID NO: 4404023 - DNA, 15 bp, Homo sapiens
aaattaaaaaaaaat

SEQ ID NO: 4404024 - DNA, 17 bp, Homo sapiens
aaattaaaaaaaaattg

SEQ ID NO: 4404025 - DNA, 23 bp, Homo sapiens
aaattaaaagaaatatacagttt

SEQ ID NO: 4404026 - DNA, 12 bp, Homo sapiens
aaattaaacaat

SEQ ID NO: 4404027 - DNA, 15 bp, Homo sapiens
aaattaaacaattta

SEQ ID NO: 4404028 - DNA, 19 bp, Homo sapiens
aaattaaacttatttacaa

SEQ ID NO: 4404029 - DNA, 19 bp, Homo sapiens
aaattaaatatatgtatgt

SEQ ID NO: 4404030 - DNA, 20 bp, Homo sapiens
aaattaaatatatgtatgta

SEQ ID NO: 4404031 - DNA, 12 bp, Homo sapiens
aaattaaatatt

SEQ ID NO: 4404032 - DNA, 20 bp, Homo sapiens
aaattaaatctagacattct

SEQ ID NO: 4404033 - DNA, 22 bp, Homo sapiens
aaattaaatctagacattcttt

SEQ ID NO: 4404034 - DNA, 19 bp, Homo sapiens
aaattaacacaaaggaagt

SEQ ID NO: 4404035 - DNA, 20 bp, Homo sapiens
aaattaaccgagacacttta

SEQ ID NO: 4404036 - DNA, 16 bp, Homo sapiens
aaattaacttagtttt

SEQ ID NO: 4404037 - DNA, 13 bp, Homo sapiens
aaattaagatcct

SEQ ID NO: 4404038 - DNA, 12 bp, Homo sapiens
aaattaagattt

SEQ ID NO: 4404039 - DNA, 11 bp, Homo sapiens
aaattaatatc

SEQ ID NO: 4404040 - DNA, 14 bp, Homo sapiens
aaattaatatcttt

SEQ ID NO: 4404041 - DNA, 17 bp, Homo sapiens
aaattaatatctttctg

SEQ ID NO: 4404042 - DNA, 12 bp, Homo sapiens
aaattaatgtaa

SEQ ID NO: 4404043 - DNA, 13 bp, Homo sapiens
aaattaatgtaat

SEQ ID NO: 4404044 - DNA, 14 bp, Homo sapiens
aaattaatgtaata

SEQ ID NO: 4404045 - DNA, 17 bp, Homo sapiens
aaattaatgtaataaag

SEQ ID NO: 4404046 - DNA, 13 bp, Homo sapiens
aaattacaatttt

SEQ ID NO: 4404047 - DNA, 17 bp, Homo sapiens
aaattacactataatat

SEQ ID NO: 4404048 - DNA, 18 bp, Homo sapiens
aaattacatgttttttca

SEQ ID NO: 4404049 - DNA, 15 bp, Homo sapiens
aaattactgataaaa

SEQ ID NO: 4404050 - DNA, 13 bp, Homo sapiens
aaattactgttta

SEQ ID NO: 4404051 - DNA, 14 bp, Homo sapiens
aaattactttgtga

SEQ ID NO: 4404052 - DNA, 17 bp, Homo sapiens
aaattactttgtgaata

SEQ ID NO: 4404053 - DNA, 15 bp, Homo sapiens
aaattagaaaatatt

SEQ ID NO: 4404054 - DNA, 20 bp, Homo sapiens
aaattagaaacaccattcat

SEQ ID NO: 4404055 - DNA, 19 bp, Homo sapiens
aaattagaaaggacaacag

SEQ ID NO: 4404056 - DNA, 23 bp, Homo sapiens
aaattagaaaggacaacagttct

SEQ ID NO: 4404057 - DNA, 20 bp, Homo sapiens
aaattagaatgaatttatct

SEQ ID NO: 4404058 - DNA, 20 bp, Homo sapiens
aaattagactgtgattcaga

SEQ ID NO: 4404059 - DNA, 20 bp, Homo sapiens
aaattagatcctaagatgtg

SEQ ID NO: 4404060 - DNA, 14 bp, Homo sapiens
aaattaggaataaa

SEQ ID NO: 4404061 - DNA, 12 bp, Homo sapiens
aaattaggcagt

SEQ ID NO: 4404062 - DNA, 18 bp, Homo sapiens
aaattataaggactgcat

SEQ ID NO: 4404063 - DNA, 23 bp, Homo sapiens
aaattataaggactgcatggtaa

SEQ ID NO: 4404064 - DNA, 13 bp, Homo sapiens
aaattatcaaaaa

SEQ ID NO: 4404065 - DNA, 16 bp, Homo sapiens
aaattatctatagcta

SEQ ID NO: 4404066 - DNA, 17 bp, Homo sapiens
aaattatgaagctcata

SEQ ID NO: 4404067 - DNA, 21 bp, Homo sapiens
aaattatggaatatcatctgt

SEQ ID NO: 4404068 - DNA, 21 bp, Homo sapiens
aaattatgtgaccataatgta

SEQ ID NO: 4404069 - DNA, 18 bp, Homo sapiens
aaattattactttaaatt

SEQ ID NO: 4404070 - DNA, 12 bp, Homo sapiens
aaattatttaaa

SEQ ID NO: 4404071 - DNA, 13 bp, Homo sapiens
aaattatttaaac

SEQ ID NO: 4404072 - DNA, 12 bp, Homo sapiens
aaattatttctt

SEQ ID NO: 4404073 - DNA, 13 bp, Homo sapiens
aaattatttctta

SEQ ID NO: 4404074 - DNA, 15 bp, Homo sapiens
aaattatttcttaat

SEQ ID NO: 4404075 - DNA, 22 bp, Homo sapiens
aaattatttcttaattattata

SEQ ID NO: 4404076 - DNA, 16 bp, Homo sapiens
aaattatttgtaagat

SEQ ID NO: 4404077 - DNA, 21 bp, Homo sapiens
aaattatttgtaagatatttg

SEQ ID NO: 4404078 - DNA, 16 bp, Homo sapiens
aaattattttaaatta

SEQ ID NO: 4404079 - DNA, 13 bp, Homo sapiens
aaattattttgac

SEQ ID NO: 4404080 - DNA, 15 bp, Homo sapiens
aaattcaaaatgctc

SEQ ID NO: 4404081 - DNA, 21 bp, Homo sapiens
aaattcaaagcatggacattt

SEQ ID NO: 4404082 - DNA, 17 bp, Homo sapiens
aaattcaataaaaacct

SEQ ID NO: 4404083 - DNA, 17 bp, Homo sapiens
aaattcacaaactttta

SEQ ID NO: 4404084 - DNA, 18 bp, Homo sapiens
aaattcacaaacttttat

SEQ ID NO: 4404085 - DNA, 13 bp, Homo sapiens
aaattcagctctg

SEQ ID NO: 4404086 - DNA, 12 bp, Homo sapiens
aaattcaggaag

SEQ ID NO: 4404087 - DNA, 15 bp, Homo sapiens
aaattcagtctctga

SEQ ID NO: 4404088 - DNA, 13 bp, Homo sapiens
aaattcagtttca

SEQ ID NO: 4404089 - DNA, 13 bp, Homo sapiens
aaattcatttttt

SEQ ID NO: 4404090 - DNA, 15 bp, Homo sapiens
aaattccactgaaaa

SEQ ID NO: 4404091 - DNA, 19 bp, Homo sapiens
aaattcccaacctgctcat

SEQ ID NO: 4404092 - DNA, 19 bp, Homo sapiens
aaattcctcaacagtgttt

SEQ ID NO: 4404093 - DNA, 15 bp, Homo sapiens
aaattcgtgtgtttt

SEQ ID NO: 4404094 - DNA, 14 bp, Homo sapiens
aaattctagattac

SEQ ID NO: 4404095 - DNA, 16 bp, Homo sapiens
aaattctgaatttgca

SEQ ID NO: 4404096 - DNA, 13 bp, Homo sapiens
aaattctgtaatt

SEQ ID NO: 4404097 - DNA, 23 bp, Homo sapiens
aaattgaatagtttatttctgtg

SEQ ID NO: 4404098 - DNA, 13 bp, Homo sapiens
aaattgaatgcaa

SEQ ID NO: 4404099 - DNA, 15 bp, Homo sapiens
aaattgaatgcaaac

SEQ ID NO: 4404100 - DNA, 20 bp, Homo sapiens
aaattgaatgtggctgaagt

SEQ ID NO: 4404101 - DNA, 19 bp, Homo sapiens
aaattgacacttaaaaatg

SEQ ID NO: 4404102 - DNA, 13 bp, Homo sapiens
aaattgactgtac

SEQ ID NO: 4404103 - DNA, 14 bp, Homo sapiens
aaattgactgtact

SEQ ID NO: 4404104 - DNA, 12 bp, Homo sapiens
aaattgcttttt

SEQ ID NO: 4404105 - DNA, 19 bp, Homo sapiens
aaattgggttcatgatgca

SEQ ID NO: 4404106 - DNA, 15 bp, Homo sapiens
aaattggtctgaaag

SEQ ID NO: 4404107 - DNA, 18 bp, Homo sapiens
aaattgtaaatcctgtgt

SEQ ID NO: 4404108 - DNA, 19 bp, Homo sapiens
aaattgtatattgtaattt

SEQ ID NO: 4404109 - DNA, 18 bp, Homo sapiens
aaattgtatctcattact

SEQ ID NO: 4404110 - DNA, 21 bp, Homo sapiens
aaattgtcccttaaacaaaaa

SEQ ID NO: 4404111 - DNA, 18 bp, Homo sapiens
aaattgtctaaaatgtca

SEQ ID NO: 4404112 - DNA, 14 bp, Homo sapiens
aaattgtctttaaa

SEQ ID NO: 4404113 - DNA, 12 bp, Homo sapiens
aaattgtgatgt

SEQ ID NO: 4404114 - DNA, 15 bp, Homo sapiens
aaattgtgatgtgtc

SEQ ID NO: 4404115 - DNA, 12 bp, Homo sapiens
aaattgtgcata

SEQ ID NO: 4404116 - DNA, 14 bp, Homo sapiens
aaattgtgcataat

SEQ ID NO: 4404117 - DNA, 15 bp, Homo sapiens
aaattgtgcataatg

SEQ ID NO: 4404118 - DNA, 21 bp, Homo sapiens
aaattgtgcttctccccagaa

SEQ ID NO: 4404119 - DNA, 20 bp, Homo sapiens
aaattgtgtatatatcttat

SEQ ID NO: 4404120 - DNA, 18 bp, Homo sapiens
aaatttaaaagtaaaatg

SEQ ID NO: 4404121 - DNA, 19 bp, Homo sapiens
aaatttaaactataagcaa

SEQ ID NO: 4404122 - DNA, 18 bp, Homo sapiens
aaatttacacagtgagac

SEQ ID NO: 4404123 - DNA, 13 bp, Homo sapiens
aaatttagtttgt

SEQ ID NO: 4404124 - DNA, 19 bp, Homo sapiens
aaatttagtttgttaaagc

SEQ ID NO: 4404125 - DNA, 17 bp, Homo sapiens
aaccaaaaatagaaatt

SEQ ID NO: 4404126 - DNA, 18 bp, Homo sapiens
aaccaaaaatagaaatta

SEQ ID NO: 4404127 - DNA, 20 bp, Homo sapiens
aaccaaaatgacatcttttt

SEQ ID NO: 4404128 - DNA, 21 bp, Homo sapiens
aaccaaaatgacatcttttta

SEQ ID NO: 4404129 - DNA, 18 bp, Homo sapiens
aaccaaactcctatttca

SEQ ID NO: 4404130 - DNA, 16 bp, Homo sapiens
aaccaaagggtgctag

SEQ ID NO: 4404131 - DNA, 13 bp, Homo sapiens
aaccaactctaat

SEQ ID NO: 4404132 - DNA, 15 bp, Homo sapiens
aaccaactgccccag

SEQ ID NO: 4404133 - DNA, 16 bp, Homo sapiens
aaccaagattatgtga

SEQ ID NO: 4404134 - DNA, 23 bp, Homo sapiens
aaccaagttaagtcccattcagt

SEQ ID NO: 4404135 - DNA, 10 bp, Homo sapiens
aaccaagttc

SEQ ID NO: 4404136 - DNA, 13 bp, Homo sapiens
aaccaatcctgga

SEQ ID NO: 4404137 - DNA, 22 bp, Homo sapiens
aaccacaaaaaaatacctcagg

SEQ ID NO: 4404138 - DNA, 11 bp, Homo sapiens
aaccacagcag

SEQ ID NO: 4404139 - DNA, 13 bp, Homo sapiens
aaccacagcagac

SEQ ID NO: 4404140 - DNA, 15 bp, Homo sapiens
aaccacagcagacac

SEQ ID NO: 4404141 - DNA, 18 bp, Homo sapiens
aaccacatttagaaatgt

SEQ ID NO: 4404142 - DNA, 20 bp, Homo sapiens
aaccacatttagaaatgttt

SEQ ID NO: 4404143 - DNA, 16 bp, Homo sapiens
aaccacctatttttga

SEQ ID NO: 4404144 - DNA, 15 bp, Homo sapiens
aaccactgaaaaaat

SEQ ID NO: 4404145 - DNA, 19 bp, Homo sapiens
aaccactgcaatatcttcg

SEQ ID NO: 4404146 - DNA, 17 bp, Homo sapiens
aaccactgtctagagca

SEQ ID NO: 4404147 - DNA, 18 bp, Homo sapiens
aaccacttcgcacacacc

SEQ ID NO: 4404148 - DNA, 22 bp, Homo sapiens
aaccagaaaagcaatactgttt

SEQ ID NO: 4404149 - DNA, 23 bp, Homo sapiens
aaccagagggtgtggctttccag

SEQ ID NO: 4404150 - DNA, 11 bp, Homo sapiens
aaccagccctg

SEQ ID NO: 4404151 - DNA, 20 bp, Homo sapiens
aaccagccgtattttacatg

SEQ ID NO: 4404152 - DNA, 23 bp, Homo sapiens
aaccagcttgcgaataacagtcc

SEQ ID NO: 4404153 - DNA, 22 bp, Homo sapiens
aaccaggccagagcaaacagaa

SEQ ID NO: 4404154 - DNA, 15 bp, Homo sapiens
aaccagtacttctaa

SEQ ID NO: 4404155 - DNA, 16 bp, Homo sapiens
aaccagtacttctaag

SEQ ID NO: 4404156 - DNA, 17 bp, Homo sapiens
aaccagtacttctaaga

SEQ ID NO: 4404157 - DNA, 23 bp, Homo sapiens
aaccagtagcttcccaaaaacag

SEQ ID NO: 4404158 - DNA, 17 bp, Homo sapiens
aaccagtatttaagctt

SEQ ID NO: 4404159 - DNA, 21 bp, Homo sapiens
aaccagtatttttgctgcttc

SEQ ID NO: 4404160 - DNA, 14 bp, Homo sapiens
aaccagtctcctca

SEQ ID NO: 4404161 - DNA, 22 bp, Homo sapiens
aaccatagcacaggctaatttt

SEQ ID NO: 4404162 - DNA, 20 bp, Homo sapiens
aaccatgcaaattgtgaaat

SEQ ID NO: 4404163 - DNA, 22 bp, Homo sapiens
aaccatgctcttgttctgttcc

SEQ ID NO: 4404164 - DNA, 17 bp, Homo sapiens
aaccatgtagaaaattt

SEQ ID NO: 4404165 - DNA, 19 bp, Homo sapiens
aaccattatactttatatc

SEQ ID NO: 4404166 - DNA, 11 bp, Homo sapiens
aaccatttata

SEQ ID NO: 4404167 - DNA, 13 bp, Homo sapiens
aacccaaatgttc

SEQ ID NO: 4404168 - DNA, 18 bp, Homo sapiens
aacccaagtccaagcata

SEQ ID NO: 4404169 - DNA, 14 bp, Homo sapiens
aacccacctctcct

SEQ ID NO: 4404170 - DNA, 19 bp, Homo sapiens
aacccacctctcctgccct

SEQ ID NO: 4404171 - DNA, 14 bp, Homo sapiens
aacccacctgctga

SEQ ID NO: 4404172 - DNA, 19 bp, Homo sapiens
aacccactttaaaatatct

SEQ ID NO: 4404173 - DNA, 16 bp, Homo sapiens
aacccatacaatgtat

SEQ ID NO: 4404174 - DNA, 22 bp, Homo sapiens
aacccatacaatgtatgtacaa

SEQ ID NO: 4404175 - DNA, 20 bp, Homo sapiens
aacccatatttgtacaccaa

SEQ ID NO: 4404176 - DNA, 14 bp, Homo sapiens
aacccatattttaa

SEQ ID NO: 4404177 - DNA, 20 bp, Homo sapiens
aacccatcaacaaaaattgt

SEQ ID NO: 4404178 - DNA, 19 bp, Homo sapiens
aacccatcagaaggagaag

SEQ ID NO: 4404179 - DNA, 15 bp, Homo sapiens
aacccccaaatttaa

SEQ ID NO: 4404180 - DNA, 15 bp, Homo sapiens
aacccccaccccaca

SEQ ID NO: 4404181 - DNA, 19 bp, Homo sapiens
aacccccagcccacagagc

SEQ ID NO: 4404182 - DNA, 13 bp, Homo sapiens
aacccccttttcc

SEQ ID NO: 4404183 - DNA, 15 bp, Homo sapiens
aacccctccactgct

SEQ ID NO: 4404184 - DNA, 12 bp, Homo sapiens
aacccctcctcc

SEQ ID NO: 4404185 - DNA, 16 bp, Homo sapiens
aacccctcctccctca

SEQ ID NO: 4404186 - DNA, 18 bp, Homo sapiens
aacccctcctccctcaga

SEQ ID NO: 4404187 - DNA, 18 bp, Homo sapiens
aacccctccttccccaga

SEQ ID NO: 4404188 - DNA, 20 bp, Homo sapiens
aacccctccttccccagacc

SEQ ID NO: 4404189 - DNA, 22 bp, Homo sapiens
aacccctccttccccagaccca

SEQ ID NO: 4404190 - DNA, 23 bp, Homo sapiens
aacccctccttccccagacccag

SEQ ID NO: 4404191 - DNA, 16 bp, Homo sapiens
aacccgggggacagag

SEQ ID NO: 4404192 - DNA, 16 bp, Homo sapiens
aacccgtgcagaacca

SEQ ID NO: 4404193 - DNA, 17 bp, Homo sapiens
aaccctatacaagttgt

SEQ ID NO: 4404194 - DNA, 12 bp, Homo sapiens
aaccctccttgg

SEQ ID NO: 4404195 - DNA, 17 bp, Homo sapiens
aaccctccttggtgcct

SEQ ID NO: 4404196 - DNA, 20 bp, Homo sapiens
aaccctccttggtgcctctg

SEQ ID NO: 4404197 - DNA, 15 bp, Homo sapiens
aacccttaactgaca

SEQ ID NO: 4404198 - DNA, 20 bp, Homo sapiens
aacccttgctttcctgggcc

SEQ ID NO: 4404199 - DNA, 19 bp, Homo sapiens
aaccgagggggctgctccc

SEQ ID NO: 4404200 - DNA, 21 bp, Homo sapiens
aaccgagggggctgctcccac

SEQ ID NO: 4404201 - DNA, 13 bp, Homo sapiens
aaccgtcctcttt

SEQ ID NO: 4404202 - DNA, 18 bp, Homo sapiens
aaccgtctgttatgctgt

SEQ ID NO: 4404203 - DNA, 17 bp, Homo sapiens
aaccgttttgaagctac

SEQ ID NO: 4404204 - DNA, 18 bp, Homo sapiens
aacctaaagaggaaaagt

SEQ ID NO: 4404205 - DNA, 14 bp, Homo sapiens
aacctaatgcactc

SEQ ID NO: 4404206 - DNA, 17 bp, Homo sapiens
aacctagtactgccccc

SEQ ID NO: 4404207 - DNA, 18 bp, Homo sapiens
aacctagtccgctgaaga

SEQ ID NO: 4404208 - DNA, 21 bp, Homo sapiens
aacctagttaaagaaaggaaa

SEQ ID NO: 4404209 - DNA, 22 bp, Homo sapiens
aacctagttaaagaaaggaaaa

SEQ ID NO: 4404210 - DNA, 18 bp, Homo sapiens
aacctatgataattattt

SEQ ID NO: 4404211 - DNA, 22 bp, Homo sapiens
aacctatgatattttctgtgcc

SEQ ID NO: 4404212 - DNA, 18 bp, Homo sapiens
aacctcagattcttcatt

SEQ ID NO: 4404213 - DNA, 19 bp, Homo sapiens
aacctcagggctcccaggg

SEQ ID NO: 4404214 - DNA, 13 bp, Homo sapiens
aacctcagggctg

SEQ ID NO: 4404215 - DNA, 13 bp, Homo sapiens
aacctccaaatgg

SEQ ID NO: 4404216 - DNA, 22 bp, Homo sapiens
aacctccacatcccatgttgaa

SEQ ID NO: 4404217 - DNA, 22 bp, Homo sapiens
aacctcccttaagcagcaacag

SEQ ID NO: 4404218 - DNA, 19 bp, Homo sapiens
aacctcgctggactctcag

SEQ ID NO: 4404219 - DNA, 14 bp, Homo sapiens
aacctctcctgacc

SEQ ID NO: 4404220 - DNA, 15 bp, Homo sapiens
aacctctcctgaccc

SEQ ID NO: 4404221 - DNA, 14 bp, Homo sapiens
aacctcttccccag

SEQ ID NO: 4404222 - DNA, 19 bp, Homo sapiens
aacctcttcctaggccacg

SEQ ID NO: 4404223 - DNA, 23 bp, Homo sapiens
aacctctttttcctcctggacac

SEQ ID NO: 4404224 - DNA, 20 bp, Homo sapiens
aacctgagccccaaaaggta

SEQ ID NO: 4404225 - DNA, 22 bp, Homo sapiens
aacctgagctattttcctctgg

SEQ ID NO: 4404226 - DNA, 15 bp, Homo sapiens
aacctgattggccac

SEQ ID NO: 4404227 - DNA, 16 bp, Homo sapiens
aacctgcagtttttaa

SEQ ID NO: 4404228 - DNA, 14 bp, Homo sapiens
aacctgcgcagtca

SEQ ID NO: 4404229 - DNA, 17 bp, Homo sapiens
aacctgcggaaggaggt

SEQ ID NO: 4404230 - DNA, 18 bp, Homo sapiens
aacctgctctgtccccaa

SEQ ID NO: 4404231 - DNA, 10 bp, Homo sapiens
aacctggaga

SEQ ID NO: 4404232 - DNA, 19 bp, Homo sapiens
aacctggagggctagaacc

SEQ ID NO: 4404233 - DNA, 20 bp, Homo sapiens
aacctggaggggctagaacc

SEQ ID NO: 4404234 - DNA, 16 bp, Homo sapiens
aacctggatccagcac

SEQ ID NO: 4404235 - DNA, 17 bp, Homo sapiens
aacctggtggcaccaga

SEQ ID NO: 4404236 - DNA, 15 bp, Homo sapiens
aacctggttcatatt

SEQ ID NO: 4404237 - DNA, 20 bp, Homo sapiens
aacctgtaaattattttaaa

SEQ ID NO: 4404238 - DNA, 21 bp, Homo sapiens
aacctgttacctactttgact

SEQ ID NO: 4404239 - DNA, 24 bp, Homo sapiens
aacctgttacctactttgactttt

SEQ ID NO: 4404240 - DNA, 16 bp, Homo sapiens
aacctgttatttctat

SEQ ID NO: 4404241 - DNA, 23 bp, Homo sapiens
aaccttaaaggccgtcatttcat

SEQ ID NO: 4404242 - DNA, 17 bp, Homo sapiens
aaccttatcctgcattg

SEQ ID NO: 4404243 - DNA, 16 bp, Homo sapiens
aacttgaaaagaaaac

SEQ ID NO: 4404244 - DNA, 22 bp, Homo sapiens
aacttgagtataagataaaata

SEQ ID NO: 4404245 - DNA, 15 bp, Homo sapiens
aacttgatcacatgc

SEQ ID NO: 4404246 - DNA, 23 bp, Homo sapiens
aacttgatgttccacctgccaca

SEQ ID NO: 4404247 - DNA, 18 bp, Homo sapiens
aacttgcctcttttacct

SEQ ID NO: 4404248 - DNA, 12 bp, Homo sapiens
aacttgctctca

SEQ ID NO: 4404249 - DNA, 13 bp, Homo sapiens
aacttgcttctaa

SEQ ID NO: 4404250 - DNA, 19 bp, Homo sapiens
aacttggaatcaaggtaag

SEQ ID NO: 4404251 - DNA, 16 bp, Homo sapiens
aacttggacccttgga

SEQ ID NO: 4404252 - DNA, 17 bp, Homo sapiens
aacttggatacttggat

SEQ ID NO: 4404253 - DNA, 13 bp, Homo sapiens
aacttggggaggc

SEQ ID NO: 4404254 - DNA, 15 bp, Homo sapiens
aacttggggaggcaa

SEQ ID NO: 4404255 - DNA, 17 bp, Homo sapiens
aacttggtcagagccac

SEQ ID NO: 4404256 - DNA, 23 bp, Homo sapiens
aacttggtcagagccactctatg

SEQ ID NO: 4404257 - DNA, 21 bp, Homo sapiens
aacttggttttgctacataat

SEQ ID NO: 4404258 - DNA, 18 bp, Homo sapiens
aacttgtaatcttcccca

SEQ ID NO: 4404259 - DNA, 18 bp, Homo sapiens
aacttgtgagcatcagag

SEQ ID NO: 4404260 - DNA, 17 bp, Homo sapiens
aacttgtttgctgtgaa

SEQ ID NO: 4404261 - DNA, 11 bp, Homo sapiens
aactttaatac

SEQ ID NO: 4404262 - DNA, 12 bp, Homo sapiens
aactttaccatg

SEQ ID NO: 4404263 - DNA, 20 bp, Homo sapiens
aactttagtttgcctgcagt

SEQ ID NO: 4404264 - DNA, 23 bp, Homo sapiens
aactttagtttgcctgcagtttc

SEQ ID NO: 4404265 - DNA, 17 bp, Homo sapiens
aactttcaaaagcaaac

SEQ ID NO: 4404266 - DNA, 19 bp, Homo sapiens
aactttcattccttcagat

SEQ ID NO: 4404267 - DNA, 14 bp, Homo sapiens
aactttcatttttt

SEQ ID NO: 4404268 - DNA, 22 bp, Homo sapiens
aactttcgaccgactttcccca

SEQ ID NO: 4404269 - DNA, 14 bp, Homo sapiens
aactttctccctca

SEQ ID NO: 4404270 - DNA, 23 bp, Homo sapiens
aactttctgttggattccatgct

SEQ ID NO: 4404271 - DNA, 12 bp, Homo sapiens
aactttgaataa

SEQ ID NO: 4404272 - DNA, 14 bp, Homo sapiens
aactttgaataaag

SEQ ID NO: 4404273 - DNA, 21 bp, Homo sapiens
aactttgcgggatatttaggg

SEQ ID NO: 4404274 - DNA, 11 bp, Homo sapiens
aactttgtcac

SEQ ID NO: 4404275 - DNA, 19 bp, Homo sapiens
aacttttataaattaaata

SEQ ID NO: 4404276 - DNA, 19 bp, Homo sapiens
aacttttctaacagaaagc

SEQ ID NO: 4404277 - DNA, 13 bp, Homo sapiens
aacttttctcttt

SEQ ID NO: 4404278 - DNA, 17 bp, Homo sapiens
aacttttgaaagatgta

SEQ ID NO: 4404279 - DNA, 19 bp, Homo sapiens
aacttttgtactgaatttt

SEQ ID NO: 4404280 - DNA, 14 bp, Homo sapiens
aacttttgtttttt

SEQ ID NO: 4404281 - DNA, 16 bp, Homo sapiens
aactttttattgcctt

SEQ ID NO: 4404282 - DNA, 20 bp, Homo sapiens
aactttttattgccttctca

SEQ ID NO: 4404283 - DNA, 21 bp, Homo sapiens
aactttttgaccagtttcttt

SEQ ID NO: 4404284 - DNA, 13 bp, Homo sapiens
aactttttgttca

SEQ ID NO: 4404285 - DNA, 15 bp, Homo sapiens
aacttttttcccttg

SEQ ID NO: 4404286 - DNA, 18 bp, Homo sapiens
aacttttttttctctctt

SEQ ID NO: 4404287 - DNA, 19 bp, Homo sapiens
aacttttttttctctcttt

SEQ ID NO: 4404288 - DNA, 16 bp, Homo sapiens
aagaaaaaaagcaaaa

SEQ ID NO: 4404289 - DNA, 18 bp, Homo sapiens
aagaaaaaaagcacaaag

SEQ ID NO: 4404290 - DNA, 21 bp, Homo sapiens
aagaaaaaaagcacaaagttc

SEQ ID NO: 4404291 - DNA, 14 bp, Homo sapiens
aagaaaaaagaaaa

SEQ ID NO: 4404292 - DNA, 17 bp, Homo sapiens
aagaaaaacaataaaga

SEQ ID NO: 4404293 - DNA, 13 bp, Homo sapiens
aagaaaaatcaaa

SEQ ID NO: 4404294 - DNA, 21 bp, Homo sapiens
aagaaaaatctcattatttca

SEQ ID NO: 4404295 - DNA, 16 bp, Homo sapiens
aagaaaaattaattag

SEQ ID NO: 4404296 - DNA, 21 bp, Homo sapiens
aagaaaaattaattaggaatt

SEQ ID NO: 4404297 - DNA, 15 bp, Homo sapiens
aagaaaacaagtata

SEQ ID NO: 4404298 - DNA, 11 bp, Homo sapiens
aagaaaatatc

SEQ ID NO: 4404299 - DNA, 13 bp, Homo sapiens
aagaaaatattta

SEQ ID NO: 4404300 - DNA, 12 bp, Homo sapiens
aagaaaatgtct

SEQ ID NO: 4404301 - DNA, 14 bp, Homo sapiens
aagaaacaaaaatc

SEQ ID NO: 4404302 - DNA, 15 bp, Homo sapiens
aagaaacttgtaaat

SEQ ID NO: 4404303 - DNA, 14 bp, Homo sapiens
aagaaactttttta

SEQ ID NO: 4404304 - DNA, 20 bp, Homo sapiens
aagaaagaatgttactgcct

SEQ ID NO: 4404305 - DNA, 12 bp, Homo sapiens
aagaaagcactt

SEQ ID NO: 4404306 - DNA, 16 bp, Homo sapiens
aagaaaggaaaagaaa

SEQ ID NO: 4404307 - DNA, 12 bp, Homo sapiens
aagaaaggaagt

SEQ ID NO: 4404308 - DNA, 15 bp, Homo sapiens
aagaaaggagataca

SEQ ID NO: 4404309 - DNA, 14 bp, Homo sapiens
aagaaagtacccag

SEQ ID NO: 4404310 - DNA, 12 bp, Homo sapiens
aagaaagtgtat

SEQ ID NO: 4404311 - DNA, 15 bp, Homo sapiens
aagaaagtgtatttg

SEQ ID NO: 4404312 - DNA, 16 bp, Homo sapiens
aagaaagttctacagt

SEQ ID NO: 4404313 - DNA, 22 bp, Homo sapiens
aagaaatatacagtttgacttt

SEQ ID NO: 4404314 - DNA, 15 bp, Homo sapiens
aagaaatatctgtga

SEQ ID NO: 4404315 - DNA, 17 bp, Homo sapiens
aagaaatatctgtgaaa

SEQ ID NO: 4404316 - DNA, 16 bp, Homo sapiens
aagaaatgaacattcc

SEQ ID NO: 4404317 - DNA, 11 bp, Homo sapiens
aagaaatgatt

SEQ ID NO: 4404318 - DNA, 21 bp, Homo sapiens
aagaaatgattcaaattgctg

SEQ ID NO: 4404319 - DNA, 23 bp, Homo sapiens
aagaaatgattcaaattgctgct

SEQ ID NO: 4404320 - DNA, 18 bp, Homo sapiens
aagaaatggctatgaaca

SEQ ID NO: 4404321 - DNA, 12 bp, Homo sapiens
aagaaatgtacc

SEQ ID NO: 4404322 - DNA, 19 bp, Homo sapiens
aagaacatgcagtttgaaa

SEQ ID NO: 4404323 - DNA, 23 bp, Homo sapiens
aagaacattattcatctctcctc

SEQ ID NO: 4404324 - DNA, 15 bp, Homo sapiens
aagaaccaaatacct

SEQ ID NO: 4404325 - DNA, 17 bp, Homo sapiens
aagaaccaaatacctca

SEQ ID NO: 4404326 - DNA, 15 bp, Homo sapiens
aagaaccactgtcta

SEQ ID NO: 4404327 - DNA, 21 bp, Homo sapiens
aagaacccctcgttagccttc

SEQ ID NO: 4404328 - DNA, 17 bp, Homo sapiens
aagaacccctctgcttt

SEQ ID NO: 4404329 - DNA, 18 bp, Homo sapiens
aagaacctatatcttaca

SEQ ID NO: 4404330 - DNA, 15 bp, Homo sapiens
aagaacgaggtttat

SEQ ID NO: 4404331 - DNA, 21 bp, Homo sapiens
aagaacgaggtttatattttc

SEQ ID NO: 4404332 - DNA, 20 bp, Homo sapiens
aagaacgcgacttccacaaa

SEQ ID NO: 4404333 - DNA, 22 bp, Homo sapiens
aagaacggggctcttctcattt

SEQ ID NO: 4404334 - DNA, 20 bp, Homo sapiens
aagaactacaaacaaaattt

SEQ ID NO: 4404335 - DNA, 14 bp, Homo sapiens
aagaactctctgga

SEQ ID NO: 4404336 - DNA, 18 bp, Homo sapiens
aagaactgttgcctaatt

SEQ ID NO: 4404337 - DNA, 16 bp, Homo sapiens
aagaagaaagatttaa

SEQ ID NO: 4404338 - DNA, 16 bp, Homo sapiens
aagaagaaagcaaaag

SEQ ID NO: 4404339 - DNA, 21 bp, Homo sapiens
aagaagaactcaccagggttt

SEQ ID NO: 4404340 - DNA, 15 bp, Homo sapiens
aagaagaagaagaag

SEQ ID NO: 4404341 - DNA, 11 bp, Homo sapiens
aagaagacatt

SEQ ID NO: 4404342 - DNA, 12 bp, Homo sapiens
aagaagacattt

SEQ ID NO: 4404343 - DNA, 16 bp, Homo sapiens
aagaagacattttgtt

SEQ ID NO: 4404344 - DNA, 23 bp, Homo sapiens
aagaagagcgagagatcaaagat

SEQ ID NO: 4404345 - DNA, 22 bp, Homo sapiens
aagaagattctcgccccttccc

SEQ ID NO: 4404346 - DNA, 16 bp, Homo sapiens
aagaagcaataactat

SEQ ID NO: 4404347 - DNA, 17 bp, Homo sapiens
aagaagcaatctttgaa

SEQ ID NO: 4404348 - DNA, 23 bp, Homo sapiens
aagaagctactattttggaaaat

SEQ ID NO: 4404349 - DNA, 16 bp, Homo sapiens
aagaagcttccacaaa

SEQ ID NO: 4404350 - DNA, 14 bp, Homo sapiens
aagaaggaaagatg

SEQ ID NO: 4404351 - DNA, 19 bp, Homo sapiens
aagaaggaaggcctgagcc

SEQ ID NO: 4404352 - DNA, 14 bp, Homo sapiens
aagaaggagagcaa

SEQ ID NO: 4404353 - DNA, 14 bp, Homo sapiens
aagaaggcaaaaat

SEQ ID NO: 4404354 - DNA, 20 bp, Homo sapiens
aagaaggcaattttagtgta

SEQ ID NO: 4404355 - DNA, 14 bp, Homo sapiens
aagaagggagaaga

SEQ ID NO: 4404356 - DNA, 16 bp, Homo sapiens
aagaagggctggtatt

SEQ ID NO: 4404357 - DNA, 20 bp, Homo sapiens
aagaagtatttttttaattt

SEQ ID NO: 4404358 - DNA, 21 bp, Homo sapiens
aagaagtatttttttaatttc

SEQ ID NO: 4404359 - DNA, 22 bp, Homo sapiens
aagaagttaaaaaacagctgca

SEQ ID NO: 4404360 - DNA, 15 bp, Homo sapiens
aagaagttaattctt

SEQ ID NO: 4404361 - DNA, 20 bp, Homo sapiens
aagaagttaattcttaaaac

SEQ ID NO: 4404362 - DNA, 12 bp, Homo sapiens
aagcaattctga

SEQ ID NO: 4404363 - DNA, 15 bp, Homo sapiens
aagcaattctgactg

SEQ ID NO: 4404364 - DNA, 22 bp, Homo sapiens
aagcaattctgactgtccagga

SEQ ID NO: 4404365 - DNA, 15 bp, Homo sapiens
aagcaattgaaaagg

SEQ ID NO: 4404366 - DNA, 22 bp, Homo sapiens
aagcacaaagttctcagagctc

SEQ ID NO: 4404367 - DNA, 14 bp, Homo sapiens
aagcacaactccct

SEQ ID NO: 4404368 - DNA, 14 bp, Homo sapiens
aagcacaagacaca

SEQ ID NO: 4404369 - DNA, 14 bp, Homo sapiens
aagcacactggaat

SEQ ID NO: 4404370 - DNA, 21 bp, Homo sapiens
aagcacactggaatataaaac

SEQ ID NO: 4404371 - DNA, 12 bp, Homo sapiens
aagcacagagcc

SEQ ID NO: 4404372 - DNA, 21 bp, Homo sapiens
aagcacatattagtgcagcca

SEQ ID NO: 4404373 - DNA, 23 bp, Homo sapiens
aagcacatattagtgcagccaag

SEQ ID NO: 4404374 - DNA, 20 bp, Homo sapiens
aagcacctgccgacctcgtc

SEQ ID NO: 4404375 - DNA, 14 bp, Homo sapiens
aagcacgttgccca

SEQ ID NO: 4404376 - DNA, 19 bp, Homo sapiens
aagcactatgcccttttat

SEQ ID NO: 4404377 - DNA, 19 bp, Homo sapiens
aagcactcggggtccctgg

SEQ ID NO: 4404378 - DNA, 13 bp, Homo sapiens
aagcacttctaga

SEQ ID NO: 4404379 - DNA, 20 bp, Homo sapiens
aagcacttgctcaaaatctg

SEQ ID NO: 4404380 - DNA, 18 bp, Homo sapiens
aagcagaacatactgttc

SEQ ID NO: 4404381 - DNA, 17 bp, Homo sapiens
aagcagacagccctggc

SEQ ID NO: 4404382 - DNA, 22 bp, Homo sapiens
aagcagaccattggggctccca

SEQ ID NO: 4404383 - DNA, 12 bp, Homo sapiens
aagcagaggccc

SEQ ID NO: 4404384 - DNA, 15 bp, Homo sapiens
aagcagaggccctgc

SEQ ID NO: 4404385 - DNA, 22 bp, Homo sapiens
aagcaggaaatgaaaatgtctt

SEQ ID NO: 4404386 - DNA, 13 bp, Homo sapiens
aagcaggacccag

SEQ ID NO: 4404387 - DNA, 14 bp, Homo sapiens
aagcaggctggttt

SEQ ID NO: 4404388 - DNA, 21 bp, Homo sapiens
aagcaggcttgcccagtacat

SEQ ID NO: 4404389 - DNA, 15 bp, Homo sapiens
aagcagggacttgaa

SEQ ID NO: 4404390 - DNA, 19 bp, Homo sapiens
aagcagtaatctgtcagtg

SEQ ID NO: 4404391 - DNA, 23 bp, Homo sapiens
aagcataaaagatgaaagagcag

SEQ ID NO: 4404392 - DNA, 14 bp, Homo sapiens
aagcataaagctca

SEQ ID NO: 4404393 - DNA, 19 bp, Homo sapiens
aagcataagcttaagcatt

SEQ ID NO: 4404394 - DNA, 16 bp, Homo sapiens
aagcataatctgaaaa

SEQ ID NO: 4404395 - DNA, 17 bp, Homo sapiens
aagcatactttgtaaat

SEQ ID NO: 4404396 - DNA, 15 bp, Homo sapiens
aagcatagctacaat

SEQ ID NO: 4404397 - DNA, 21 bp, Homo sapiens
aagcatagctacaatttgttt

SEQ ID NO: 4404398 - DNA, 13 bp, Homo sapiens
aagcatattgact

SEQ ID NO: 4404399 - DNA, 23 bp, Homo sapiens
aagcatcctttagggttctgcct

SEQ ID NO: 4404400 - DNA, 17 bp, Homo sapiens
aagcatgaataaaatta

SEQ ID NO: 4404401 - DNA, 14 bp, Homo sapiens
aagcatgcataaat

SEQ ID NO: 4404402 - DNA, 17 bp, Homo sapiens
aagcatgcataaatcaa

SEQ ID NO: 4404403 - DNA, 16 bp, Homo sapiens
aagcatgcattgaaaa

SEQ ID NO: 4404404 - DNA, 14 bp, Homo sapiens
aagcatggacattt

SEQ ID NO: 4404405 - DNA, 19 bp, Homo sapiens
aagcatggacatttagaag

SEQ ID NO: 4404406 - DNA, 16 bp, Homo sapiens
aagcatggattttccc

SEQ ID NO: 4404407 - DNA, 20 bp, Homo sapiens
aagcatgtagactgtgccag

SEQ ID NO: 4404408 - DNA, 16 bp, Homo sapiens
aagcatgtcaattcat

SEQ ID NO: 4404409 - DNA, 23 bp, Homo sapiens
aagcatgtggtcttatagtgttt

SEQ ID NO: 4404410 - DNA, 13 bp, Homo sapiens
aagcattcacaac

SEQ ID NO: 4404411 - DNA, 15 bp, Homo sapiens
aagcattcagaagaa

SEQ ID NO: 4404412 - DNA, 13 bp, Homo sapiens
aagcattgaatgg

SEQ ID NO: 4404413 - DNA, 16 bp, Homo sapiens
aagcatttcaggccag

SEQ ID NO: 4404414 - DNA, 11 bp, Homo sapiens
aagcatttcat

SEQ ID NO: 4404415 - DNA, 16 bp, Homo sapiens
aagcattttataaatg

SEQ ID NO: 4404416 - DNA, 19 bp, Homo sapiens
aagcattttgtaagttgaa

SEQ ID NO: 4404417 - DNA, 23 bp, Homo sapiens
aagcattttgtaagttgaagcaa

SEQ ID NO: 4404418 - DNA, 19 bp, Homo sapiens
aagcatttttcaatatatt

SEQ ID NO: 4404419 - DNA, 12 bp, Homo sapiens
aagccaaaacaa

SEQ ID NO: 4404420 - DNA, 15 bp, Homo sapiens
aagccaaagaaaaat

SEQ ID NO: 4404421 - DNA, 15 bp, Homo sapiens
aagccaagacctcac

SEQ ID NO: 4404422 - DNA, 14 bp, Homo sapiens
aagccaagggaaag

SEQ ID NO: 4404423 - DNA, 12 bp, Homo sapiens
aagccacagaaa

SEQ ID NO: 4404424 - DNA, 23 bp, Homo sapiens
aagccacaggcctgagatttcat

SEQ ID NO: 4404425 - DNA, 19 bp, Homo sapiens
aagccacgccctccctgct

SEQ ID NO: 4404426 - DNA, 18 bp, Homo sapiens
aagccacttaaaatgttc

SEQ ID NO: 4404427 - DNA, 14 bp, Homo sapiens
aagccacttgtctt

SEQ ID NO: 4404428 - DNA, 14 bp, Homo sapiens
aagccagagcctgg

SEQ ID NO: 4404429 - DNA, 14 bp, Homo sapiens
aagccagcgtcctc

SEQ ID NO: 4404430 - DNA, 17 bp, Homo sapiens
aagccaggagcagccct

SEQ ID NO: 4404431 - DNA, 19 bp, Homo sapiens
aagccaggagcagccctgg

SEQ ID NO: 4404432 - DNA, 15 bp, Homo sapiens
aagccaggcctggct

SEQ ID NO: 4404433 - DNA, 23 bp, Homo sapiens
aagccatagaccctgaggccctg

SEQ ID NO: 4404434 - DNA, 14 bp, Homo sapiens
aagccatcatcctc

SEQ ID NO: 4404435 - DNA, 18 bp, Homo sapiens
aagccatcatcctccatt

SEQ ID NO: 4404436 - DNA, 22 bp, Homo sapiens
aagccatgagttccagaaagta

SEQ ID NO: 4404437 - DNA, 18 bp, Homo sapiens
aagccattaaatgaatat

SEQ ID NO: 4404438 - DNA, 14 bp, Homo sapiens
aagccattccaaag

SEQ ID NO: 4404439 - DNA, 14 bp, Homo sapiens
aagccattttccag

SEQ ID NO: 4404440 - DNA, 16 bp, Homo sapiens
aagccccatttcctca

SEQ ID NO: 4404441 - DNA, 14 bp, Homo sapiens
aagcccctctttct

SEQ ID NO: 4404442 - DNA, 14 bp, Homo sapiens
aagcccgcttgctc

SEQ ID NO: 4404443 - DNA, 22 bp, Homo sapiens
aagcccgcttgctcgcttgctg

SEQ ID NO: 4404444 - DNA, 9 bp, Homo sapiens
aagccctcc

SEQ ID NO: 4404445 - DNA, 11 bp, Homo sapiens
aagccctcctt

SEQ ID NO: 4404446 - DNA, 14 bp, Homo sapiens
aagccctccttcca

SEQ ID NO: 4404447 - DNA, 15 bp, Homo sapiens
aagccctccttccac

SEQ ID NO: 4404448 - DNA, 14 bp, Homo sapiens
aagccctgcccaca

SEQ ID NO: 4404449 - DNA, 13 bp, Homo sapiens
aagccctggcccc

SEQ ID NO: 4404450 - DNA, 17 bp, Homo sapiens
aagccctggcccccaca

SEQ ID NO: 4404451 - DNA, 22 bp, Homo sapiens
aagccctggcccccacagcgct

SEQ ID NO: 4404452 - DNA, 14 bp, Homo sapiens
aagcctacctgctc

SEQ ID NO: 4404453 - DNA, 19 bp, Homo sapiens
aagcctacctgctctccaa

SEQ ID NO: 4404454 - DNA, 23 bp, Homo sapiens
aagcctcaaaacctgattggcca

SEQ ID NO: 4404455 - DNA, 16 bp, Homo sapiens
aagcctcatgccaacc

SEQ ID NO: 4404456 - DNA, 19 bp, Homo sapiens
aagcctccaagcctgcctc

SEQ ID NO: 4404457 - DNA, 16 bp, Homo sapiens
aagcctcctgccccct

SEQ ID NO: 4404458 - DNA, 14 bp, Homo sapiens
aagcctcctgtacc

SEQ ID NO: 4404459 - DNA, 15 bp, Homo sapiens
aagcctctaaacaga

SEQ ID NO: 4404460 - DNA, 15 bp, Homo sapiens
aagcctgcctcccaa

SEQ ID NO: 4404461 - DNA, 12 bp, Homo sapiens
aagcctgctggc

SEQ ID NO: 4404462 - DNA, 15 bp, Homo sapiens
aagcctgctggctgc

SEQ ID NO: 4404463 - DNA, 19 bp, Homo sapiens
aagcctgctggctgcggcc

SEQ ID NO: 4404464 - DNA, 21 bp, Homo sapiens
aagcctggcctacatggttga

SEQ ID NO: 4404465 - DNA, 16 bp, Homo sapiens
aagcctgtgcaaaaaa

SEQ ID NO: 4404466 - DNA, 14 bp, Homo sapiens
aagccttagggaag

SEQ ID NO: 4404467 - DNA, 19 bp, Homo sapiens
aagccttggaaccagcccc

SEQ ID NO: 4404468 - DNA, 15 bp, Homo sapiens
aagcgaaaaaatcag

SEQ ID NO: 4404469 - DNA, 22 bp, Homo sapiens
aagcgaagtctttgccttctct

SEQ ID NO: 4404470 - DNA, 12 bp, Homo sapiens
aagcgccctcac

SEQ ID NO: 4404471 - DNA, 15 bp, Homo sapiens
aagcgcgttgtgtat

SEQ ID NO: 4404472 - DNA, 15 bp, Homo sapiens
aagcggcatagcacc

SEQ ID NO: 4404473 - DNA, 12 bp, Homo sapiens
aagcgggcagcc

SEQ ID NO: 4404474 - DNA, 15 bp, Homo sapiens
aagctaaaaatatta

SEQ ID NO: 4404475 - DNA, 21 bp, Homo sapiens
aagctaaaatatataatatac

SEQ ID NO: 4404476 - DNA, 22 bp, Homo sapiens
aagctaaaatatataatatact

SEQ ID NO: 4404477 - DNA, 22 bp, Homo sapiens
aagctaatttgcattaaattca

SEQ ID NO: 4404478 - DNA, 22 bp, Homo sapiens
aagctactgccatcctggccca

SEQ ID NO: 4404479 - DNA, 19 bp, Homo sapiens
aagctactgtgtgtgtgaa

SEQ ID NO: 4404480 - DNA, 17 bp, Homo sapiens
aagctagacacatgaag

SEQ ID NO: 4404481 - DNA, 16 bp, Homo sapiens
aaggtgcttgctcccc

SEQ ID NO: 4404482 - DNA, 20 bp, Homo sapiens
aaggtggacagcagacaaga

SEQ ID NO: 4404483 - DNA, 14 bp, Homo sapiens
aaggtggccacagc

SEQ ID NO: 4404484 - DNA, 15 bp, Homo sapiens
aaggtggccacagca

SEQ ID NO: 4404485 - DNA, 17 bp, Homo sapiens
aaggtggggagaagctg

SEQ ID NO: 4404486 - DNA, 15 bp, Homo sapiens
aaggtgtcttcctcc

SEQ ID NO: 4404487 - DNA, 20 bp, Homo sapiens
aaggtgtcttcctcccaagt

SEQ ID NO: 4404488 - DNA, 22 bp, Homo sapiens
aaggtgtgctctgagccacaga

SEQ ID NO: 4404489 - DNA, 16 bp, Homo sapiens
aaggttcagaaaatta

SEQ ID NO: 4404490 - DNA, 15 bp, Homo sapiens
aaggttcccttgtgg

SEQ ID NO: 4404491 - DNA, 18 bp, Homo sapiens
aaggttcttgctttctct

SEQ ID NO: 4404492 - DNA, 14 bp, Homo sapiens
aaggttgcacagca

SEQ ID NO: 4404493 - DNA, 17 bp, Homo sapiens
aaggttttttttcagtt

SEQ ID NO: 4404494 - DNA, 16 bp, Homo sapiens
aagtaaaacaatacat

SEQ ID NO: 4404495 - DNA, 18 bp, Homo sapiens
aagtaaaacaatacatca

SEQ ID NO: 4404496 - DNA, 13 bp, Homo sapiens
aagtaaaacagtc

SEQ ID NO: 4404497 - DNA, 17 bp, Homo sapiens
aagtaaaacagtcatct

SEQ ID NO: 4404498 - DNA, 17 bp, Homo sapiens
aagtaaaaccacagcag

SEQ ID NO: 4404499 - DNA, 13 bp, Homo sapiens
aagtaaaagcaaa

SEQ ID NO: 4404500 - DNA, 14 bp, Homo sapiens
aagtaaaatgtctt

SEQ ID NO: 4404501 - DNA, 13 bp, Homo sapiens
aagtaaaatgttt

SEQ ID NO: 4404502 - DNA, 16 bp, Homo sapiens
aagtaaacttgtgtat

SEQ ID NO: 4404503 - DNA, 21 bp, Homo sapiens
aagtaacatgacttccttatt

SEQ ID NO: 4404504 - DNA, 15 bp, Homo sapiens
aagtaacttatttga

SEQ ID NO: 4404505 - DNA, 22 bp, Homo sapiens
aagtaactttgcgggatattta

SEQ ID NO: 4404506 - DNA, 20 bp, Homo sapiens
aagtaagaaagtgaagcaaa

SEQ ID NO: 4404507 - DNA, 13 bp, Homo sapiens
aagtaattatgca

SEQ ID NO: 4404508 - DNA, 16 bp, Homo sapiens
aagtaattatgcacta

SEQ ID NO: 4404509 - DNA, 15 bp, Homo sapiens
aagtaattcttctgc

SEQ ID NO: 4404510 - DNA, 16 bp, Homo sapiens
aagtaattgtgaaaaa

SEQ ID NO: 4404511 - DNA, 23 bp, Homo sapiens
aagtaatttcagtgtaaagtgtg

SEQ ID NO: 4404512 - DNA, 13 bp, Homo sapiens
aagtaatttcctg

SEQ ID NO: 4404513 - DNA, 19 bp, Homo sapiens
aagtacagaatttgaatta

SEQ ID NO: 4404514 - DNA, 14 bp, Homo sapiens
aagtacattgctta

SEQ ID NO: 4404515 - DNA, 12 bp, Homo sapiens
aagtacccagca

SEQ ID NO: 4404516 - DNA, 23 bp, Homo sapiens
aagtactggtaagattgttatta

SEQ ID NO: 4404517 - DNA, 19 bp, Homo sapiens
aagtactgtttaccatttt

SEQ ID NO: 4404518 - DNA, 21 bp, Homo sapiens
aagtagacaatcattgttttg

SEQ ID NO: 4404519 - DNA, 14 bp, Homo sapiens
aagtagcaaatgtt

SEQ ID NO: 4404520 - DNA, 18 bp, Homo sapiens
aagtagctgggattacag

SEQ ID NO: 4404521 - DNA, 21 bp, Homo sapiens
aagtaggatgaatcatattca

SEQ ID NO: 4404522 - DNA, 16 bp, Homo sapiens
aagtaggcatatatca

SEQ ID NO: 4404523 - DNA, 18 bp, Homo sapiens
aagtagtacttcttctgt

SEQ ID NO: 4404524 - DNA, 23 bp, Homo sapiens
aagtagtgtctggatcagtaaaa

SEQ ID NO: 4404525 - DNA, 17 bp, Homo sapiens
aagtagttattttatag

SEQ ID NO: 4404526 - DNA, 14 bp, Homo sapiens
aagtataaacctta

SEQ ID NO: 4404527 - DNA, 23 bp, Homo sapiens
aagtatacaggaggatgtgaata

SEQ ID NO: 4404528 - DNA, 12 bp, Homo sapiens
aagtatagagag

SEQ ID NO: 4404529 - DNA, 17 bp, Homo sapiens
aagtatagagagaagtt

SEQ ID NO: 4404530 - DNA, 12 bp, Homo sapiens
aagtatattaaa

SEQ ID NO: 4404531 - DNA, 18 bp, Homo sapiens
aagtatatttatttctag

SEQ ID NO: 4404532 - DNA, 19 bp, Homo sapiens
aagtatcttgtgcttcttc

SEQ ID NO: 4404533 - DNA, 21 bp, Homo sapiens
aagtatgtattatttacattt

SEQ ID NO: 4404534 - DNA, 17 bp, Homo sapiens
aagtattactaaattga

SEQ ID NO: 4404535 - DNA, 12 bp, Homo sapiens
aagtattattag

SEQ ID NO: 4404536 - DNA, 19 bp, Homo sapiens
aagtattccaccttaaatt

SEQ ID NO: 4404537 - DNA, 12 bp, Homo sapiens
aagtattgtaaa

SEQ ID NO: 4404538 - DNA, 21 bp, Homo sapiens
aagtattgtaaattatatttg

SEQ ID NO: 4404539 - DNA, 15 bp, Homo sapiens
aagtatttaaacttt

SEQ ID NO: 4404540 - DNA, 16 bp, Homo sapiens
aagtatttataaaaat

SEQ ID NO: 4404541 - DNA, 21 bp, Homo sapiens
aagtatttataaaaatataaa

SEQ ID NO: 4404542 - DNA, 12 bp, Homo sapiens
aagtatttccat

SEQ ID NO: 4404543 - DNA, 14 bp, Homo sapiens
aagtatttgatgta

SEQ ID NO: 4404544 - DNA, 16 bp, Homo sapiens
aagtatttgatgtaca

SEQ ID NO: 4404545 - DNA, 12 bp, Homo sapiens
aagtattttaat

SEQ ID NO: 4404546 - DNA, 14 bp, Homo sapiens
aagtattttttcaa

SEQ ID NO: 4404547 - DNA, 19 bp, Homo sapiens
aagtcaaaaggtgcctgtg

SEQ ID NO: 4404548 - DNA, 20 bp, Homo sapiens
aagtcaaagcaaggaaacta

SEQ ID NO: 4404549 - DNA, 13 bp, Homo sapiens
aagtcaacagtaa

SEQ ID NO: 4404550 - DNA, 15 bp, Homo sapiens
aagtcaacagtaaac

SEQ ID NO: 4404551 - DNA, 21 bp, Homo sapiens
aagtcaacagtaaaccactga

SEQ ID NO: 4404552 - DNA, 22 bp, Homo sapiens
aagtcaaccaatgtagaaagct

SEQ ID NO: 4404553 - DNA, 18 bp, Homo sapiens
aagtcacagccgtttgaa

SEQ ID NO: 4404554 - DNA, 22 bp, Homo sapiens
aagtcacagtcgtatctctaga

SEQ ID NO: 4404555 - DNA, 14 bp, Homo sapiens
aagtcacatccctg

SEQ ID NO: 4404556 - DNA, 16 bp, Homo sapiens
aagtcaccaaatagtg

SEQ ID NO: 4404557 - DNA, 16 bp, Homo sapiens
aagtcacccctttctg

SEQ ID NO: 4404558 - DNA, 22 bp, Homo sapiens
aagtcacccctttctgtcccac

SEQ ID NO: 4404559 - DNA, 18 bp, Homo sapiens
aagtcacgtcatttgttt

SEQ ID NO: 4404560 - DNA, 13 bp, Homo sapiens
aagtcagaagttt

SEQ ID NO: 4404561 - DNA, 23 bp, Homo sapiens
aagtcagaatcagaagatagtct

SEQ ID NO: 4404562 - DNA, 20 bp, Homo sapiens
aagtcagatggaaaattcat

SEQ ID NO: 4404563 - DNA, 18 bp, Homo sapiens
aagtcagtcaacatttac

SEQ ID NO: 4404564 - DNA, 17 bp, Homo sapiens
aagtcatagccataaat

SEQ ID NO: 4404565 - DNA, 23 bp, Homo sapiens
aagtcatcttgctaccagtattt

SEQ ID NO: 4404566 - DNA, 16 bp, Homo sapiens
aagtcatggtcacagt

SEQ ID NO: 4404567 - DNA, 17 bp, Homo sapiens
aagtcatttttgtattt

SEQ ID NO: 4404568 - DNA, 19 bp, Homo sapiens
aagtcattttttacttgaa

SEQ ID NO: 4404569 - DNA, 20 bp, Homo sapiens
aagtcattttttacttgaat

SEQ ID NO: 4404570 - DNA, 12 bp, Homo sapiens
aagtccaatgtg

SEQ ID NO: 4404571 - DNA, 17 bp, Homo sapiens
aagtccacagacatctt

SEQ ID NO: 4404572 - DNA, 21 bp, Homo sapiens
aagtccagaagcctcctgttg

SEQ ID NO: 4404573 - DNA, 17 bp, Homo sapiens
aagtccatctgacaaaa

SEQ ID NO: 4404574 - DNA, 22 bp, Homo sapiens
aagtccccctcctcagccagcc

SEQ ID NO: 4404575 - DNA, 20 bp, Homo sapiens
aagtccctccctgcctgagg

SEQ ID NO: 4404576 - DNA, 14 bp, Homo sapiens
aagtcctccctgac

SEQ ID NO: 4404577 - DNA, 21 bp, Homo sapiens
aagtcctccctgacttttctg

SEQ ID NO: 4404578 - DNA, 14 bp, Homo sapiens
aagtcgaggctgca

SEQ ID NO: 4404579 - DNA, 17 bp, Homo sapiens
aagtcgttttccaaact

SEQ ID NO: 4404580 - DNA, 18 bp, Homo sapiens
aagtctatctggtattaa

SEQ ID NO: 4404581 - DNA, 15 bp, Homo sapiens
aagtctctatttaaa

SEQ ID NO: 4404582 - DNA, 18 bp, Homo sapiens
aagtctctatttaaattc

SEQ ID NO: 4404583 - DNA, 13 bp, Homo sapiens
aagtctctgctgc

SEQ ID NO: 4404584 - DNA, 22 bp, Homo sapiens
aagtctgtctttcctgaaccat

SEQ ID NO: 4404585 - DNA, 18 bp, Homo sapiens
aagtcttttgttcgcatg

SEQ ID NO: 4404586 - DNA, 14 bp, Homo sapiens
aagtgaaaatggtc

SEQ ID NO: 4404587 - DNA, 13 bp, Homo sapiens
aagtgaaatttct

SEQ ID NO: 4404588 - DNA, 15 bp, Homo sapiens
aagtgaagagtcaga

SEQ ID NO: 4404589 - DNA, 17 bp, Homo sapiens
aagtgaagagtcagaac

SEQ ID NO: 4404590 - DNA, 15 bp, Homo sapiens
aagtgaattgaagtt

SEQ ID NO: 4404591 - DNA, 16 bp, Homo sapiens
aagtgaatttatgaga

SEQ ID NO: 4404592 - DNA, 13 bp, Homo sapiens
aagtgacaaataa

SEQ ID NO: 4404593 - DNA, 22 bp, Homo sapiens
aagtgacagtatcttttttcct

SEQ ID NO: 4404594 - DNA, 12 bp, Homo sapiens
aagtgacataat

SEQ ID NO: 4404595 - DNA, 18 bp, Homo sapiens
aagtgacttctggagaaa

SEQ ID NO: 4404596 - DNA, 14 bp, Homo sapiens
aagtgagaaaactg

SEQ ID NO: 4404597 - DNA, 15 bp, Homo sapiens
aagtgagaagatggt

SEQ ID NO: 4404598 - DNA, 14 bp, Homo sapiens
aagtgatgacatat

SEQ ID NO: 4404599 - DNA, 19 bp, Homo sapiens
aagtgatgtattttcatag

SEQ ID NO: 4404600 - DNA, 14 bp, Homo sapiens
aatacagttatttc

SEQ ID NO: 4404601 - DNA, 16 bp, Homo sapiens
aatacagttctgctct

SEQ ID NO: 4404602 - DNA, 17 bp, Homo sapiens
aatacagttctgctctg

SEQ ID NO: 4404603 - DNA, 22 bp, Homo sapiens
aatacataccacgctagggctg

SEQ ID NO: 4404604 - DNA, 11 bp, Homo sapiens
aatacatcaca

SEQ ID NO: 4404605 - DNA, 13 bp, Homo sapiens
aatacatgcacag

SEQ ID NO: 4404606 - DNA, 14 bp, Homo sapiens
aatacatgcacagt

SEQ ID NO: 4404607 - DNA, 16 bp, Homo sapiens
aatacatgcacagtca

SEQ ID NO: 4404608 - DNA, 17 bp, Homo sapiens
aatacatgcacagtcat

SEQ ID NO: 4404609 - DNA, 21 bp, Homo sapiens
aatacatgctaagagaagtag

SEQ ID NO: 4404610 - DNA, 15 bp, Homo sapiens
aataccaaaaattag

SEQ ID NO: 4404611 - DNA, 18 bp, Homo sapiens
aatacgtgccagatataa

SEQ ID NO: 4404612 - DNA, 20 bp, Homo sapiens
aatacgtgccagatataact

SEQ ID NO: 4404613 - DNA, 21 bp, Homo sapiens
aatactaccttgaaaataaga

SEQ ID NO: 4404614 - DNA, 23 bp, Homo sapiens
aatactgactccaaccattcaaa

SEQ ID NO: 4404615 - DNA, 17 bp, Homo sapiens
aatactgtcaaacaata

SEQ ID NO: 4404616 - DNA, 14 bp, Homo sapiens
aatactgtctgtat

SEQ ID NO: 4404617 - DNA, 13 bp, Homo sapiens
aatactgttttaa

SEQ ID NO: 4404618 - DNA, 15 bp, Homo sapiens
aatactgttttaaaa

SEQ ID NO: 4404619 - DNA, 21 bp, Homo sapiens
aatacttattaaaaaatttgt

SEQ ID NO: 4404620 - DNA, 22 bp, Homo sapiens
aatacttctcattttttaaaaa

SEQ ID NO: 4404621 - DNA, 20 bp, Homo sapiens
aatacttctttgttattata

SEQ ID NO: 4404622 - DNA, 23 bp, Homo sapiens
aatacttctttgttattataaca

SEQ ID NO: 4404623 - DNA, 13 bp, Homo sapiens
aatacttgaactt

SEQ ID NO: 4404624 - DNA, 15 bp, Homo sapiens
aatacttgaacttgt

SEQ ID NO: 4404625 - DNA, 12 bp, Homo sapiens
aatactttgtat

SEQ ID NO: 4404626 - DNA, 20 bp, Homo sapiens
aatactttttaaattacctt

SEQ ID NO: 4404627 - DNA, 15 bp, Homo sapiens
aatactttttacaat

SEQ ID NO: 4404628 - DNA, 12 bp, Homo sapiens
aatagaaaagta

SEQ ID NO: 4404629 - DNA, 18 bp, Homo sapiens
aatagaaaagtagacaat

SEQ ID NO: 4404630 - DNA, 14 bp, Homo sapiens
aatagaaagaaagt

SEQ ID NO: 4404631 - DNA, 15 bp, Homo sapiens
aatagaaattttgta

SEQ ID NO: 4404632 - DNA, 18 bp, Homo sapiens
aatagaaattttgtaaga

SEQ ID NO: 4404633 - DNA, 20 bp, Homo sapiens
aatagaaccatgttggttgc

SEQ ID NO: 4404634 - DNA, 13 bp, Homo sapiens
aatagaacttgtt

SEQ ID NO: 4404635 - DNA, 14 bp, Homo sapiens
aatagaaggtgatg

SEQ ID NO: 4404636 - DNA, 14 bp, Homo sapiens
aatagacaagtttt

SEQ ID NO: 4404637 - DNA, 13 bp, Homo sapiens
aatagagataaaa

SEQ ID NO: 4404638 - DNA, 14 bp, Homo sapiens
aatagagataagtc

SEQ ID NO: 4404639 - DNA, 12 bp, Homo sapiens
aatagaggaaga

SEQ ID NO: 4404640 - DNA, 22 bp, Homo sapiens
aatagaggtgatgctgctaaag

SEQ ID NO: 4404641 - DNA, 20 bp, Homo sapiens
aatagataagagtagaaact

SEQ ID NO: 4404642 - DNA, 14 bp, Homo sapiens
aatagatgtctttt

SEQ ID NO: 4404643 - DNA, 16 bp, Homo sapiens
aatagatgtcttttat

SEQ ID NO: 4404644 - DNA, 19 bp, Homo sapiens
aatagattactgatgtgat

SEQ ID NO: 4404645 - DNA, 18 bp, Homo sapiens
aatagatttaggagcaga

SEQ ID NO: 4404646 - DNA, 14 bp, Homo sapiens
aatagcaaagaatt

SEQ ID NO: 4404647 - DNA, 20 bp, Homo sapiens
aatagcactttcattgccag

SEQ ID NO: 4404648 - DNA, 14 bp, Homo sapiens
aatagcactttttg

SEQ ID NO: 4404649 - DNA, 20 bp, Homo sapiens
aatagcagttataacagatg

SEQ ID NO: 4404650 - DNA, 22 bp, Homo sapiens
aatagccacatttggaatactt

SEQ ID NO: 4404651 - DNA, 23 bp, Homo sapiens
aatagccacatttggaatacttt

SEQ ID NO: 4404652 - DNA, 13 bp, Homo sapiens
aatagcctggcca

SEQ ID NO: 4404653 - DNA, 17 bp, Homo sapiens
aatagctgccttcaagg

SEQ ID NO: 4404654 - DNA, 19 bp, Homo sapiens
aataggagggaaacctttg

SEQ ID NO: 4404655 - DNA, 17 bp, Homo sapiens
aataggagtatttttgg

SEQ ID NO: 4404656 - DNA, 11 bp, Homo sapiens
aataggagtct

SEQ ID NO: 4404657 - DNA, 16 bp, Homo sapiens
aataggatttttagaa

SEQ ID NO: 4404658 - DNA, 21 bp, Homo sapiens
aataggcagggggccctgccc

SEQ ID NO: 4404659 - DNA, 14 bp, Homo sapiens
aataggcattttaa

SEQ ID NO: 4404660 - DNA, 14 bp, Homo sapiens
aataggcctattta

SEQ ID NO: 4404661 - DNA, 20 bp, Homo sapiens
aataggctattaaaaaagtc

SEQ ID NO: 4404662 - DNA, 15 bp, Homo sapiens
aatagggaatatgat

SEQ ID NO: 4404663 - DNA, 21 bp, Homo sapiens
aatagggctgagctctctgtg

SEQ ID NO: 4404664 - DNA, 17 bp, Homo sapiens
aataggtctttctctca

SEQ ID NO: 4404665 - DNA, 16 bp, Homo sapiens
aataggttcttcttgt

SEQ ID NO: 4404666 - DNA, 14 bp, Homo sapiens
aatagtaaactaaa

SEQ ID NO: 4404667 - DNA, 17 bp, Homo sapiens
aatagtaaactaaagta

SEQ ID NO: 4404668 - DNA, 15 bp, Homo sapiens
aatagtaatttgtaa

SEQ ID NO: 4404669 - DNA, 15 bp, Homo sapiens
aatagtatacatttt

SEQ ID NO: 4404670 - DNA, 16 bp, Homo sapiens
aatagtatacatttta

SEQ ID NO: 4404671 - DNA, 19 bp, Homo sapiens
aatagtatacattttataa

SEQ ID NO: 4404672 - DNA, 22 bp, Homo sapiens
aatagtatacattttataatga

SEQ ID NO: 4404673 - DNA, 21 bp, Homo sapiens
aatagtcaaaaattaaatata

SEQ ID NO: 4404674 - DNA, 16 bp, Homo sapiens
aatagtctttgccagt

SEQ ID NO: 4404675 - DNA, 16 bp, Homo sapiens
aatagtgtaagaactg

SEQ ID NO: 4404676 - DNA, 23 bp, Homo sapiens
aatagtgtcatcctcacagtgaa

SEQ ID NO: 4404677 - DNA, 14 bp, Homo sapiens
aatagtgtcctatg

SEQ ID NO: 4404678 - DNA, 19 bp, Homo sapiens
aatagtgtcctatgcaata

SEQ ID NO: 4404679 - DNA, 23 bp, Homo sapiens
aatagtgtcctatgcaataaaat

SEQ ID NO: 4404680 - DNA, 17 bp, Homo sapiens
aatagtgtgaaatatat

SEQ ID NO: 4404681 - DNA, 15 bp, Homo sapiens
aatagtgttctctgt

SEQ ID NO: 4404682 - DNA, 20 bp, Homo sapiens
aatagttaaaaattaaatat

SEQ ID NO: 4404683 - DNA, 21 bp, Homo sapiens
aatagttaagacatgatttcc

SEQ ID NO: 4404684 - DNA, 19 bp, Homo sapiens
aatagttagatctttgtaa

SEQ ID NO: 4404685 - DNA, 14 bp, Homo sapiens
aatagttctatcct

SEQ ID NO: 4404686 - DNA, 15 bp, Homo sapiens
aatagttctatcctt

SEQ ID NO: 4404687 - DNA, 22 bp, Homo sapiens
aatagttctatccttttgcctg

SEQ ID NO: 4404688 - DNA, 12 bp, Homo sapiens
aatagttgaatt

SEQ ID NO: 4404689 - DNA, 14 bp, Homo sapiens
aatagtttatctta

SEQ ID NO: 4404690 - DNA, 20 bp, Homo sapiens
aatagtttatttctgtgaaa

SEQ ID NO: 4404691 - DNA, 13 bp, Homo sapiens
aatataaatgtgt

SEQ ID NO: 4404692 - DNA, 15 bp, Homo sapiens
aatataaattgtaca

SEQ ID NO: 4404693 - DNA, 16 bp, Homo sapiens
aatataaattgtacat

SEQ ID NO: 4404694 - DNA, 18 bp, Homo sapiens
aatataaggaaagcaata

SEQ ID NO: 4404695 - DNA, 19 bp, Homo sapiens
aatataaggaaagcaataa

SEQ ID NO: 4404696 - DNA, 14 bp, Homo sapiens
aatataatgtattt

SEQ ID NO: 4404697 - DNA, 17 bp, Homo sapiens
aatataatgtattttct

SEQ ID NO: 4404698 - DNA, 23 bp, Homo sapiens
aatataatgtattttctttttat

SEQ ID NO: 4404699 - DNA, 14 bp, Homo sapiens
aatatacaaaactt

SEQ ID NO: 4404700 - DNA, 19 bp, Homo sapiens
aatatacaagcaagcaaaa

SEQ ID NO: 4404701 - DNA, 22 bp, Homo sapiens
aatatacatagtctttgtttac

SEQ ID NO: 4404702 - DNA, 18 bp, Homo sapiens
aatatacattcaaactta

SEQ ID NO: 4404703 - DNA, 19 bp, Homo sapiens
aatatacattcaaacttaa

SEQ ID NO: 4404704 - DNA, 15 bp, Homo sapiens
aatataccccaaatt

SEQ ID NO: 4404705 - DNA, 16 bp, Homo sapiens
aatataccttatttat

SEQ ID NO: 4404706 - DNA, 18 bp, Homo sapiens
aatatacttgactctaat

SEQ ID NO: 4404707 - DNA, 16 bp, Homo sapiens
aatatactttttttgt

SEQ ID NO: 4404708 - DNA, 22 bp, Homo sapiens
aatatactttttttgttataga

SEQ ID NO: 4404709 - DNA, 15 bp, Homo sapiens
aatatagctgagact

SEQ ID NO: 4404710 - DNA, 12 bp, Homo sapiens
aatatataatat

SEQ ID NO: 4404711 - DNA, 16 bp, Homo sapiens
aatatataatttaatg

SEQ ID NO: 4404712 - DNA, 18 bp, Homo sapiens
aatatataatttaatgta

SEQ ID NO: 4404713 - DNA, 21 bp, Homo sapiens
aatatatacacatagttctgt

SEQ ID NO: 4404714 - DNA, 16 bp, Homo sapiens
aatatatagcttgaaa

SEQ ID NO: 4404715 - DNA, 16 bp, Homo sapiens
aatatatagtgaaaaa

SEQ ID NO: 4404716 - DNA, 10 bp, Homo sapiens
aatatatata

SEQ ID NO: 4404717 - DNA, 16 bp, Homo sapiens
aatatatataaagaat

SEQ ID NO: 4404718 - DNA, 20 bp, Homo sapiens
aatatatatctatctatttg

SEQ ID NO: 4404719 - DNA, 21 bp, Homo sapiens
aatcctcagccgagaaattgg

SEQ ID NO: 4404720 - DNA, 20 bp, Homo sapiens
aatcctcctgcctcagcctt

SEQ ID NO: 4404721 - DNA, 20 bp, Homo sapiens
aatcctgaactttctccctc

SEQ ID NO: 4404722 - DNA, 17 bp, Homo sapiens
aatcctgcccaaaatgt

SEQ ID NO: 4404723 - DNA, 22 bp, Homo sapiens
aatcctgcccaaaatgtgaagc

SEQ ID NO: 4404724 - DNA, 18 bp, Homo sapiens
aatcctggaaggacacag

SEQ ID NO: 4404725 - DNA, 21 bp, Homo sapiens
aatcctggaaggacacagtga

SEQ ID NO: 4404726 - DNA, 22 bp, Homo sapiens
aatcctgttttacagctgcctt

SEQ ID NO: 4404727 - DNA, 20 bp, Homo sapiens
aatccttcaaaataaaaagt

SEQ ID NO: 4404728 - DNA, 13 bp, Homo sapiens
aatccttctttgt

SEQ ID NO: 4404729 - DNA, 19 bp, Homo sapiens
aatccttgataatatattg

SEQ ID NO: 4404730 - DNA, 17 bp, Homo sapiens
aatccttgggagtcatt

SEQ ID NO: 4404731 - DNA, 20 bp, Homo sapiens
aatccttgtgacttacaatt

SEQ ID NO: 4404732 - DNA, 13 bp, Homo sapiens
aatccttttcctt

SEQ ID NO: 4404733 - DNA, 22 bp, Homo sapiens
aatcggcccacagctcccaccc

SEQ ID NO: 4404734 - DNA, 13 bp, Homo sapiens
aatcgttctgctg

SEQ ID NO: 4404735 - DNA, 19 bp, Homo sapiens
aatcgtttttgttttaagg

SEQ ID NO: 4404736 - DNA, 19 bp, Homo sapiens
aatctaaaatgttttatga

SEQ ID NO: 4404737 - DNA, 17 bp, Homo sapiens
aatctaacaataatatt

SEQ ID NO: 4404738 - DNA, 20 bp, Homo sapiens
aatctaacaataatatttca

SEQ ID NO: 4404739 - DNA, 23 bp, Homo sapiens
aatctaacaataatatttcaagt

SEQ ID NO: 4404740 - DNA, 14 bp, Homo sapiens
aatctaatctgaac

SEQ ID NO: 4404741 - DNA, 15 bp, Homo sapiens
aatctaatctgaact

SEQ ID NO: 4404742 - DNA, 16 bp, Homo sapiens
aatctacacacggtgc

SEQ ID NO: 4404743 - DNA, 16 bp, Homo sapiens
aatctacaccaatgaa

SEQ ID NO: 4404744 - DNA, 19 bp, Homo sapiens
aatctacactccagtgaga

SEQ ID NO: 4404745 - DNA, 22 bp, Homo sapiens
aatctacattataataaaattt

SEQ ID NO: 4404746 - DNA, 17 bp, Homo sapiens
aatctactaattccaca

SEQ ID NO: 4404747 - DNA, 12 bp, Homo sapiens
aatctacttaac

SEQ ID NO: 4404748 - DNA, 21 bp, Homo sapiens
aatctacttaaccctgacaaa

SEQ ID NO: 4404749 - DNA, 22 bp, Homo sapiens
aatctagaagatgtgtaaacag

SEQ ID NO: 4404750 - DNA, 16 bp, Homo sapiens
aatctagacattcttt

SEQ ID NO: 4404751 - DNA, 16 bp, Homo sapiens
aatctaggatgtgatg

SEQ ID NO: 4404752 - DNA, 17 bp, Homo sapiens
aatctaggatgtgatga

SEQ ID NO: 4404753 - DNA, 16 bp, Homo sapiens
aatctatattaaatga

SEQ ID NO: 4404754 - DNA, 17 bp, Homo sapiens
aatctattagattttag

SEQ ID NO: 4404755 - DNA, 18 bp, Homo sapiens
aatctattagattttaga

SEQ ID NO: 4404756 - DNA, 23 bp, Homo sapiens
aatctatttaaaaaactgtataa

SEQ ID NO: 4404757 - DNA, 16 bp, Homo sapiens
aatctcaaataggcta

SEQ ID NO: 4404758 - DNA, 22 bp, Homo sapiens
aatctcaaataggctattaaaa

SEQ ID NO: 4404759 - DNA, 16 bp, Homo sapiens
aatctcagtgctttcc

SEQ ID NO: 4404760 - DNA, 15 bp, Homo sapiens
aatctcattatttca

SEQ ID NO: 4404761 - DNA, 16 bp, Homo sapiens
aatctcattatttcaa

SEQ ID NO: 4404762 - DNA, 21 bp, Homo sapiens
aatctcattatttcaaaatga

SEQ ID NO: 4404763 - DNA, 12 bp, Homo sapiens
aatctcattccc

SEQ ID NO: 4404764 - DNA, 16 bp, Homo sapiens
aatctcccattttgga

SEQ ID NO: 4404765 - DNA, 22 bp, Homo sapiens
aatctcctattccttcacacag

SEQ ID NO: 4404766 - DNA, 17 bp, Homo sapiens
aatctcctctgctcatt

SEQ ID NO: 4404767 - DNA, 17 bp, Homo sapiens
aatctcggctcactgca

SEQ ID NO: 4404768 - DNA, 15 bp, Homo sapiens
aatctgaatgtaatt

SEQ ID NO: 4404769 - DNA, 17 bp, Homo sapiens
aatctgatggccttaat

SEQ ID NO: 4404770 - DNA, 22 bp, Homo sapiens
aatctgatggccttaatttcct

SEQ ID NO: 4404771 - DNA, 20 bp, Homo sapiens
aatctgcaaaatgtagaaat

SEQ ID NO: 4404772 - DNA, 10 bp, Homo sapiens
aatctgcctg

SEQ ID NO: 4404773 - DNA, 12 bp, Homo sapiens
aatctgcctggg

SEQ ID NO: 4404774 - DNA, 17 bp, Homo sapiens
aatctgctgagaggcac

SEQ ID NO: 4404775 - DNA, 12 bp, Homo sapiens
aatctgcttttc

SEQ ID NO: 4404776 - DNA, 21 bp, Homo sapiens
aatctggatgcctcattatgt

SEQ ID NO: 4404777 - DNA, 19 bp, Homo sapiens
aatctggattcatatttaa

SEQ ID NO: 4404778 - DNA, 15 bp, Homo sapiens
aatctggctgtcctt

SEQ ID NO: 4404779 - DNA, 18 bp, Homo sapiens
aatctggcttagtgccac

SEQ ID NO: 4404780 - DNA, 20 bp, Homo sapiens
aatctgggactgtgcctggc

SEQ ID NO: 4404781 - DNA, 21 bp, Homo sapiens
aatctgggactgtgcctggct

SEQ ID NO: 4404782 - DNA, 19 bp, Homo sapiens
aatctggggaagaggtttt

SEQ ID NO: 4404783 - DNA, 12 bp, Homo sapiens
aatctgtaaact

SEQ ID NO: 4404784 - DNA, 14 bp, Homo sapiens
aatctgtaaactgt

SEQ ID NO: 4404785 - DNA, 15 bp, Homo sapiens
aatctgtaaactgtg

SEQ ID NO: 4404786 - DNA, 13 bp, Homo sapiens
aatctgtcaagag

SEQ ID NO: 4404787 - DNA, 20 bp, Homo sapiens
aatctgtcaagagtagttat

SEQ ID NO: 4404788 - DNA, 19 bp, Homo sapiens
aatctgtgggtctgggagt

SEQ ID NO: 4404789 - DNA, 23 bp, Homo sapiens
aatctgtgtgaaactttcattcc

SEQ ID NO: 4404790 - DNA, 14 bp, Homo sapiens
aatctgtttctctg

SEQ ID NO: 4404791 - DNA, 18 bp, Homo sapiens
aatcttagtatagtagaa

SEQ ID NO: 4404792 - DNA, 22 bp, Homo sapiens
aatcttagtatagtagaaagac

SEQ ID NO: 4404793 - DNA, 14 bp, Homo sapiens
aatcttataattgt

SEQ ID NO: 4404794 - DNA, 17 bp, Homo sapiens
aatcttataattgttct

SEQ ID NO: 4404795 - DNA, 18 bp, Homo sapiens
aatcttatttttcctgtc

SEQ ID NO: 4404796 - DNA, 14 bp, Homo sapiens
aatcttcctgttta

SEQ ID NO: 4404797 - DNA, 19 bp, Homo sapiens
aatcttctacttttaacta

SEQ ID NO: 4404798 - DNA, 22 bp, Homo sapiens
aatcttgactacagtcaggaaa

SEQ ID NO: 4404799 - DNA, 13 bp, Homo sapiens
aatcttgttactg

SEQ ID NO: 4404800 - DNA, 15 bp, Homo sapiens
aatcttgttactgct

SEQ ID NO: 4404801 - DNA, 15 bp, Homo sapiens
aatcttgtttatagc

SEQ ID NO: 4404802 - DNA, 16 bp, Homo sapiens
aatcttgtttatagca

SEQ ID NO: 4404803 - DNA, 18 bp, Homo sapiens
aatcttgtttgttactgt

SEQ ID NO: 4404804 - DNA, 20 bp, Homo sapiens
aatcttgtttgttactgtca

SEQ ID NO: 4404805 - DNA, 15 bp, Homo sapiens
aatctttacctgtat

SEQ ID NO: 4404806 - DNA, 18 bp, Homo sapiens
aatctttacctgtataca

SEQ ID NO: 4404807 - DNA, 22 bp, Homo sapiens
aatctttgtgacaggaaagccc

SEQ ID NO: 4404808 - DNA, 15 bp, Homo sapiens
aatcttttcttattt

SEQ ID NO: 4404809 - DNA, 22 bp, Homo sapiens
aatctttttgcttctactttca

SEQ ID NO: 4404810 - DNA, 14 bp, Homo sapiens
aatgaaaaaatgta

SEQ ID NO: 4404811 - DNA, 21 bp, Homo sapiens
aatgaaaaatctcaattgaaa

SEQ ID NO: 4404812 - DNA, 19 bp, Homo sapiens
aatgaaaaattccactcaa

SEQ ID NO: 4404813 - DNA, 19 bp, Homo sapiens
aatgaaaagtcgttttcca

SEQ ID NO: 4404814 - DNA, 20 bp, Homo sapiens
aatgaaaagtcgttttccaa

SEQ ID NO: 4404815 - DNA, 21 bp, Homo sapiens
aatgaaaataaaacacacctc

SEQ ID NO: 4404816 - DNA, 14 bp, Homo sapiens
aatgaaaataagaa

SEQ ID NO: 4404817 - DNA, 15 bp, Homo sapiens
aatgaaaatgtcttg

SEQ ID NO: 4404818 - DNA, 18 bp, Homo sapiens
aatgaaagctactcatag

SEQ ID NO: 4404819 - DNA, 15 bp, Homo sapiens
aatgaaagggaaact

SEQ ID NO: 4404820 - DNA, 22 bp, Homo sapiens
aatgaaagggaaactgggaaac

SEQ ID NO: 4404821 - DNA, 16 bp, Homo sapiens
aatgaaagtgttaatt

SEQ ID NO: 4404822 - DNA, 14 bp, Homo sapiens
aatgaaatgaatga

SEQ ID NO: 4404823 - DNA, 17 bp, Homo sapiens
aatgaaatgataaagac

SEQ ID NO: 4404824 - DNA, 19 bp, Homo sapiens
aatgaaatgataaagactt

SEQ ID NO: 4404825 - DNA, 22 bp, Homo sapiens
aatgaaattaacacaaaggaag

SEQ ID NO: 4404826 - DNA, 14 bp, Homo sapiens
aatgaacaaaatta

SEQ ID NO: 4404827 - DNA, 16 bp, Homo sapiens
aatgaacatctcatgt

SEQ ID NO: 4404828 - DNA, 18 bp, Homo sapiens
aatgaacatctcatgtgt

SEQ ID NO: 4404829 - DNA, 18 bp, Homo sapiens
aatgaacctgcaagcctt

SEQ ID NO: 4404830 - DNA, 16 bp, Homo sapiens
aatgaagcagtatttt

SEQ ID NO: 4404831 - DNA, 18 bp, Homo sapiens
aatgaagtattacatgat

SEQ ID NO: 4404832 - DNA, 10 bp, Homo sapiens
aatgaataat

SEQ ID NO: 4404833 - DNA, 19 bp, Homo sapiens
aatgaataatgcctttgta

SEQ ID NO: 4404834 - DNA, 17 bp, Homo sapiens
aatgaataatggaaaat

SEQ ID NO: 4404835 - DNA, 16 bp, Homo sapiens
aatgaatatcatgcaa

SEQ ID NO: 4404836 - DNA, 17 bp, Homo sapiens
aatgaatattttgataa

SEQ ID NO: 4404837 - DNA, 16 bp, Homo sapiens
aatgtgctgaagcaaa

SEQ ID NO: 4404838 - DNA, 16 bp, Homo sapiens
aatgtggctgtaaaac

SEQ ID NO: 4404839 - DNA, 18 bp, Homo sapiens
aatgtggttgcttaattc

SEQ ID NO: 4404840 - DNA, 21 bp, Homo sapiens
aatgtgtaagaacaactacct

SEQ ID NO: 4404841 - DNA, 22 bp, Homo sapiens
aatgtgtatttcttaagaattc

SEQ ID NO: 4404842 - DNA, 14 bp, Homo sapiens
aatgtgtcattgga

SEQ ID NO: 4404843 - DNA, 22 bp, Homo sapiens
aatgtgtctcaggctcaagttt

SEQ ID NO: 4404844 - DNA, 15 bp, Homo sapiens
aatgtgtctttctaa

SEQ ID NO: 4404845 - DNA, 16 bp, Homo sapiens
aatgtgtgtatgtgtg

SEQ ID NO: 4404846 - DNA, 14 bp, Homo sapiens
aatgtgtttttccc

SEQ ID NO: 4404847 - DNA, 14 bp, Homo sapiens
aatgttaaagtcag

SEQ ID NO: 4404848 - DNA, 21 bp, Homo sapiens
aatgttaattttttggtacaa

SEQ ID NO: 4404849 - DNA, 22 bp, Homo sapiens
aatgttaattttttggtacaaa

SEQ ID NO: 4404850 - DNA, 21 bp, Homo sapiens
aatgttacatagtaaatggta

SEQ ID NO: 4404851 - DNA, 20 bp, Homo sapiens
aatgttacggcatcacactt

SEQ ID NO: 4404852 - DNA, 23 bp, Homo sapiens
aatgttacggcatcacacttata

SEQ ID NO: 4404853 - DNA, 19 bp, Homo sapiens
aatgttatcttatactgta

SEQ ID NO: 4404854 - DNA, 22 bp, Homo sapiens
aatgttatcttatactgtacaa

SEQ ID NO: 4404855 - DNA, 19 bp, Homo sapiens
aatgttatgactatgtaaa

SEQ ID NO: 4404856 - DNA, 14 bp, Homo sapiens
aatgttcaatgcca

SEQ ID NO: 4404857 - DNA, 23 bp, Homo sapiens
aatgttcatatttattgattaaa

SEQ ID NO: 4404858 - DNA, 15 bp, Homo sapiens
aatgttcattttgaa

SEQ ID NO: 4404859 - DNA, 16 bp, Homo sapiens
aatgttcattttgaaa

SEQ ID NO: 4404860 - DNA, 17 bp, Homo sapiens
aatgttcattttgaaaa

SEQ ID NO: 4404861 - DNA, 18 bp, Homo sapiens
aatgttcattttgaaaat

SEQ ID NO: 4404862 - DNA, 12 bp, Homo sapiens
aatgttccagac

SEQ ID NO: 4404863 - DNA, 17 bp, Homo sapiens
aatgttccagacattct

SEQ ID NO: 4404864 - DNA, 17 bp, Homo sapiens
aatgttcccaaaccaga

SEQ ID NO: 4404865 - DNA, 19 bp, Homo sapiens
aatgttcttgaattatatc

SEQ ID NO: 4404866 - DNA, 21 bp, Homo sapiens
aatgttctttggaaagtacac

SEQ ID NO: 4404867 - DNA, 15 bp, Homo sapiens
aatgttgaaatatga

SEQ ID NO: 4404868 - DNA, 18 bp, Homo sapiens
aatgttgagaatcccaaa

SEQ ID NO: 4404869 - DNA, 13 bp, Homo sapiens
aatgttggataag

SEQ ID NO: 4404870 - DNA, 13 bp, Homo sapiens
aatgttgggactg

SEQ ID NO: 4404871 - DNA, 21 bp, Homo sapiens
aatgttgggactgctaaataa

SEQ ID NO: 4404872 - DNA, 22 bp, Homo sapiens
aatgttgggactgctaaataaa

SEQ ID NO: 4404873 - DNA, 23 bp, Homo sapiens
aatgttggtcattttatgttaag

SEQ ID NO: 4404874 - DNA, 19 bp, Homo sapiens
aatgttgttgtctatttgt

SEQ ID NO: 4404875 - DNA, 20 bp, Homo sapiens
aatgtttactgtatcaattt

SEQ ID NO: 4404876 - DNA, 16 bp, Homo sapiens
aatgtttattaaatgc

SEQ ID NO: 4404877 - DNA, 12 bp, Homo sapiens
aatgtttctctc

SEQ ID NO: 4404878 - DNA, 21 bp, Homo sapiens
aatgtttcttcatttctctgc

SEQ ID NO: 4404879 - DNA, 23 bp, Homo sapiens
aatgtttgtttatatcactgtct

SEQ ID NO: 4404880 - DNA, 15 bp, Homo sapiens
aatgttttaaatgta

SEQ ID NO: 4404881 - DNA, 14 bp, Homo sapiens
aatgttttatgaca

SEQ ID NO: 4404882 - DNA, 17 bp, Homo sapiens
aatgtttttatttttgt

SEQ ID NO: 4404883 - DNA, 20 bp, Homo sapiens
aatgtttttccctccccaga

SEQ ID NO: 4404884 - DNA, 15 bp, Homo sapiens
aatgtttttctgcca

SEQ ID NO: 4404885 - DNA, 21 bp, Homo sapiens
aatgtttttctgccagggagc

SEQ ID NO: 4404886 - DNA, 21 bp, Homo sapiens
aattaaaaaaaaagatctgtt

SEQ ID NO: 4404887 - DNA, 15 bp, Homo sapiens
aattaaaaactttaa

SEQ ID NO: 4404888 - DNA, 16 bp, Homo sapiens
aattaaaagcaaatca

SEQ ID NO: 4404889 - DNA, 20 bp, Homo sapiens
aattaaaaggatagtatttt

SEQ ID NO: 4404890 - DNA, 13 bp, Homo sapiens
aattaaaatacta

SEQ ID NO: 4404891 - DNA, 21 bp, Homo sapiens
aattaaaatggatgccttgaa

SEQ ID NO: 4404892 - DNA, 17 bp, Homo sapiens
aattaaaattgtgcata

SEQ ID NO: 4404893 - DNA, 22 bp, Homo sapiens
aattaaaattgtgcataatgct

SEQ ID NO: 4404894 - DNA, 13 bp, Homo sapiens
aattaaaatttat

SEQ ID NO: 4404895 - DNA, 16 bp, Homo sapiens
aattaaacttccaaag

SEQ ID NO: 4404896 - DNA, 16 bp, Homo sapiens
aattaaatatatgtat

SEQ ID NO: 4404897 - DNA, 22 bp, Homo sapiens
aattaactgggtaatgaaacaa

SEQ ID NO: 4404898 - DNA, 15 bp, Homo sapiens
aattaactgtaaact

SEQ ID NO: 4404899 - DNA, 23 bp, Homo sapiens
aattaactgtaaacttggaatca

SEQ ID NO: 4404900 - DNA, 19 bp, Homo sapiens
aattaagatcctaaactct

SEQ ID NO: 4404901 - DNA, 16 bp, Homo sapiens
aattaaggtacatcat

SEQ ID NO: 4404902 - DNA, 17 bp, Homo sapiens
aattaaggtacatcatt

SEQ ID NO: 4404903 - DNA, 17 bp, Homo sapiens
aattaatatattaaaat

SEQ ID NO: 4404904 - DNA, 23 bp, Homo sapiens
aattaatatggtgtatttttcca

SEQ ID NO: 4404905 - DNA, 13 bp, Homo sapiens
aattaatgtaata

SEQ ID NO: 4404906 - DNA, 16 bp, Homo sapiens
aattaatgtaataaag

SEQ ID NO: 4404907 - DNA, 20 bp, Homo sapiens
aattaatgtaataaagtgaa

SEQ ID NO: 4404908 - DNA, 15 bp, Homo sapiens
aattaattgtcatta

SEQ ID NO: 4404909 - DNA, 13 bp, Homo sapiens
aattaatttggag

SEQ ID NO: 4404910 - DNA, 16 bp, Homo sapiens
aattaatttgttaatt

SEQ ID NO: 4404911 - DNA, 19 bp, Homo sapiens
aattacaattttatctgtt

SEQ ID NO: 4404912 - DNA, 16 bp, Homo sapiens
aattacagactctgat

SEQ ID NO: 4404913 - DNA, 17 bp, Homo sapiens
aattacagactctgatt

SEQ ID NO: 4404914 - DNA, 15 bp, Homo sapiens
aattaccatttgtta

SEQ ID NO: 4404915 - DNA, 23 bp, Homo sapiens
aattaccatttgttaatatcact

SEQ ID NO: 4404916 - DNA, 14 bp, Homo sapiens
aattacctgtggat

SEQ ID NO: 4404917 - DNA, 20 bp, Homo sapiens
aattacctttacatatatag

SEQ ID NO: 4404918 - DNA, 14 bp, Homo sapiens
aattacgtgctctg

SEQ ID NO: 4404919 - DNA, 22 bp, Homo sapiens
aattacgttcttacaagcttaa

SEQ ID NO: 4404920 - DNA, 13 bp, Homo sapiens
aattactaatgat

SEQ ID NO: 4404921 - DNA, 23 bp, Homo sapiens
aattactgcactcttaaacagca

SEQ ID NO: 4404922 - DNA, 12 bp, Homo sapiens
aattactggaat

SEQ ID NO: 4404923 - DNA, 22 bp, Homo sapiens
aattacttgaagtatccacaga

SEQ ID NO: 4404924 - DNA, 16 bp, Homo sapiens
aattagaaaatattct

SEQ ID NO: 4404925 - DNA, 18 bp, Homo sapiens
aattagaaaatattctct

SEQ ID NO: 4404926 - DNA, 12 bp, Homo sapiens
aattagaaaatt

SEQ ID NO: 4404927 - DNA, 18 bp, Homo sapiens
aattagaaatattaaaga

SEQ ID NO: 4404928 - DNA, 17 bp, Homo sapiens
aattagaatgaatttat

SEQ ID NO: 4404929 - DNA, 18 bp, Homo sapiens
aattagaatgaatttatc

SEQ ID NO: 4404930 - DNA, 21 bp, Homo sapiens
aattagactgtgattcagaaa

SEQ ID NO: 4404931 - DNA, 22 bp, Homo sapiens
aattagatctaaacagttattt

SEQ ID NO: 4404932 - DNA, 12 bp, Homo sapiens
aattagatttgt

SEQ ID NO: 4404933 - DNA, 21 bp, Homo sapiens
aattagatttgtgcaaacatg

SEQ ID NO: 4404934 - DNA, 11 bp, Homo sapiens
aattaggaatt

SEQ ID NO: 4404935 - DNA, 12 bp, Homo sapiens
aattaggaatta

SEQ ID NO: 4404936 - DNA, 15 bp, Homo sapiens
aattaggctgtaact

SEQ ID NO: 4404937 - DNA, 18 bp, Homo sapiens
aattagtcttttgtaata

SEQ ID NO: 4404938 - DNA, 17 bp, Homo sapiens
aattagtgaccattatt

SEQ ID NO: 4404939 - DNA, 19 bp, Homo sapiens
aattagtgaccattattca

SEQ ID NO: 4404940 - DNA, 15 bp, Homo sapiens
aattataaaaaatta

SEQ ID NO: 4404941 - DNA, 14 bp, Homo sapiens
aattataaggactg

SEQ ID NO: 4404942 - DNA, 16 bp, Homo sapiens
aattatactgtgtgtg

SEQ ID NO: 4404943 - DNA, 19 bp, Homo sapiens
aattatataactgtatttg

SEQ ID NO: 4404944 - DNA, 13 bp, Homo sapiens
aattatatgatat

SEQ ID NO: 4404945 - DNA, 15 bp, Homo sapiens
aattatatgatatgc

SEQ ID NO: 4404946 - DNA, 20 bp, Homo sapiens
aattatatgatatgcatgta

SEQ ID NO: 4404947 - DNA, 22 bp, Homo sapiens
aattatatttgtgctatagtat

SEQ ID NO: 4404948 - DNA, 15 bp, Homo sapiens
aattatcaaaaagct

SEQ ID NO: 4404949 - DNA, 19 bp, Homo sapiens
aattatcagcaaagaaaaa

SEQ ID NO: 4404950 - DNA, 15 bp, Homo sapiens
aattatctaatttat

SEQ ID NO: 4404951 - DNA, 18 bp, Homo sapiens
aattatctaatttataaa

SEQ ID NO: 4404952 - DNA, 15 bp, Homo sapiens
aattatctatagcta

SEQ ID NO: 4404953 - DNA, 20 bp, Homo sapiens
aattatgagaggctgtcata

SEQ ID NO: 4404954 - DNA, 22 bp, Homo sapiens
aattatgagctatcctttcaaa

SEQ ID NO: 4404955 - DNA, 14 bp, Homo sapiens
aatttctcctccct

SEQ ID NO: 4404956 - DNA, 20 bp, Homo sapiens
aatttctcctcccttccttt

SEQ ID NO: 4404957 - DNA, 21 bp, Homo sapiens
aatttctcctttcctacagtt

SEQ ID NO: 4404958 - DNA, 18 bp, Homo sapiens
aatttctgccatttcatg

SEQ ID NO: 4404959 - DNA, 20 bp, Homo sapiens
aatttctgccatttcatgtc

SEQ ID NO: 4404960 - DNA, 18 bp, Homo sapiens
aatttctgctaaatatca

SEQ ID NO: 4404961 - DNA, 21 bp, Homo sapiens
aatttctgtacatttgcaatt

SEQ ID NO: 4404962 - DNA, 12 bp, Homo sapiens
aatttcttaact

SEQ ID NO: 4404963 - DNA, 16 bp, Homo sapiens
aatttcttaacttctt

SEQ ID NO: 4404964 - DNA, 19 bp, Homo sapiens
aatttctttaaatgtgtat

SEQ ID NO: 4404965 - DNA, 20 bp, Homo sapiens
aatttcttttattaatactt

SEQ ID NO: 4404966 - DNA, 22 bp, Homo sapiens
aatttctttttttcctttttaa

SEQ ID NO: 4404967 - DNA, 14 bp, Homo sapiens
aatttgaagtaact

SEQ ID NO: 4404968 - DNA, 22 bp, Homo sapiens
aatttgaattatcagcaaagaa

SEQ ID NO: 4404969 - DNA, 17 bp, Homo sapiens
aatttgatgatgttaaa

SEQ ID NO: 4404970 - DNA, 13 bp, Homo sapiens
aatttgattgatt

SEQ ID NO: 4404971 - DNA, 10 bp, Homo sapiens
aatttgcaaa

SEQ ID NO: 4404972 - DNA, 11 bp, Homo sapiens
aatttgcaaag

SEQ ID NO: 4404973 - DNA, 12 bp, Homo sapiens
aatttgcaaagt

SEQ ID NO: 4404974 - DNA, 17 bp, Homo sapiens
aatttgcaaagtactgt

SEQ ID NO: 4404975 - DNA, 21 bp, Homo sapiens
aatttgcattaaattcacaaa

SEQ ID NO: 4404976 - DNA, 13 bp, Homo sapiens
aatttgcctgctg

SEQ ID NO: 4404977 - DNA, 19 bp, Homo sapiens
aatttggagcacaaaattc

SEQ ID NO: 4404978 - DNA, 15 bp, Homo sapiens
aatttggagcattaa

SEQ ID NO: 4404979 - DNA, 22 bp, Homo sapiens
aatttggaggctggagtaatca

SEQ ID NO: 4404980 - DNA, 14 bp, Homo sapiens
aatttggccttaag

SEQ ID NO: 4404981 - DNA, 21 bp, Homo sapiens
aatttggccttaagaactgtg

SEQ ID NO: 4404982 - DNA, 23 bp, Homo sapiens
aatttggccttaagaactgtgtc

SEQ ID NO: 4404983 - DNA, 23 bp, Homo sapiens
aatttggcttcatactctttctt

SEQ ID NO: 4404984 - DNA, 14 bp, Homo sapiens
aatttgggatgctg

SEQ ID NO: 4404985 - DNA, 14 bp, Homo sapiens
aatttggggaaaat

SEQ ID NO: 4404986 - DNA, 15 bp, Homo sapiens
aatttggtacacatg

SEQ ID NO: 4404987 - DNA, 16 bp, Homo sapiens
aatttggtacacatgt

SEQ ID NO: 4404988 - DNA, 19 bp, Homo sapiens
aatttggtacacatgtgtt

SEQ ID NO: 4404989 - DNA, 23 bp, Homo sapiens
aatttggtacacatgtgttatct

SEQ ID NO: 4404990 - DNA, 17 bp, Homo sapiens
aatttggtagatgacaa

SEQ ID NO: 4404991 - DNA, 22 bp, Homo sapiens
aatttggtagatgacaaatatt

SEQ ID NO: 4404992 - DNA, 22 bp, Homo sapiens
aatttgtaagcaacttgcttct

SEQ ID NO: 4404993 - DNA, 13 bp, Homo sapiens
aatttgtaataaa

SEQ ID NO: 4404994 - DNA, 20 bp, Homo sapiens
aatttgtctgaaacatttca

SEQ ID NO: 4404995 - DNA, 23 bp, Homo sapiens
aatttgtgtgtttttagctgtga

SEQ ID NO: 4404996 - DNA, 15 bp, Homo sapiens
aatttgttcttgtat

SEQ ID NO: 4404997 - DNA, 21 bp, Homo sapiens
aatttgttcttgtatttattg

SEQ ID NO: 4404998 - DNA, 15 bp, Homo sapiens
aatttgttgtttgtt

SEQ ID NO: 4404999 - DNA, 18 bp, Homo sapiens
aatttgtttcatctattt

SEQ ID NO: 4405000 - DNA, 22 bp, Homo sapiens
aatttgtttcatctattttatt

SEQ ID NO: 4405001 - DNA, 20 bp, Homo sapiens
aatttgtttttgcatttttg

SEQ ID NO: 4405002 - DNA, 23 bp, Homo sapiens
aattttaaaaaagggagtttttg

SEQ ID NO: 4405003 - DNA, 13 bp, Homo sapiens
aattttaaaattg

SEQ ID NO: 4405004 - DNA, 15 bp, Homo sapiens
aattttaaagccatt

SEQ ID NO: 4405005 - DNA, 18 bp, Homo sapiens
aattttaaagtatgcatt

SEQ ID NO: 4405006 - DNA, 12 bp, Homo sapiens
aattttaaattg

SEQ ID NO: 4405007 - DNA, 11 bp, Homo sapiens
aattttaagaa

SEQ ID NO: 4405008 - DNA, 13 bp, Homo sapiens
aattttactgtga

SEQ ID NO: 4405009 - DNA, 15 bp, Homo sapiens
aattttactgtgaaa

SEQ ID NO: 4405010 - DNA, 23 bp, Homo sapiens
aattttactgtgaaaaaaaattt

SEQ ID NO: 4405011 - DNA, 15 bp, Homo sapiens
aattttagaaatatt

SEQ ID NO: 4405012 - DNA, 16 bp, Homo sapiens
aattttagaaatattc

SEQ ID NO: 4405013 - DNA, 15 bp, Homo sapiens
aattttagtacattt

SEQ ID NO: 4405014 - DNA, 18 bp, Homo sapiens
aattttagtagttactaa

SEQ ID NO: 4405015 - DNA, 15 bp, Homo sapiens
aattttagtgtatta

SEQ ID NO: 4405016 - DNA, 14 bp, Homo sapiens
aattttagtttttc

SEQ ID NO: 4405017 - DNA, 15 bp, Homo sapiens
aattttagtttttca

SEQ ID NO: 4405018 - DNA, 15 bp, Homo sapiens
aattttataatctgc

SEQ ID NO: 4405019 - DNA, 19 bp, Homo sapiens
aattttatctgtttcctga

SEQ ID NO: 4405020 - DNA, 22 bp, Homo sapiens
aattttatgtcatagaaatatt

SEQ ID NO: 4405021 - DNA, 14 bp, Homo sapiens
aattttattttaaa

SEQ ID NO: 4405022 - DNA, 13 bp, Homo sapiens
aattttcaaatcc

SEQ ID NO: 4405023 - DNA, 15 bp, Homo sapiens
aattttcaagtaatt

SEQ ID NO: 4405024 - DNA, 15 bp, Homo sapiens
aattttccaaccttt

SEQ ID NO: 4405025 - DNA, 16 bp, Homo sapiens
aattttccaacctttg

SEQ ID NO: 4405026 - DNA, 19 bp, Homo sapiens
aattttcctaataaagttc

SEQ ID NO: 4405027 - DNA, 21 bp, Homo sapiens
aattttctaaaagctttcatg

SEQ ID NO: 4405028 - DNA, 18 bp, Homo sapiens
aattttctggcctttcat

SEQ ID NO: 4405029 - DNA, 14 bp, Homo sapiens
aattttgaagtgct

SEQ ID NO: 4405030 - DNA, 20 bp, Homo sapiens
aattttgaagtgctgtttat

SEQ ID NO: 4405031 - DNA, 12 bp, Homo sapiens
aattttgacact

SEQ ID NO: 4405032 - DNA, 13 bp, Homo sapiens
aattttgagaaaa

SEQ ID NO: 4405033 - DNA, 19 bp, Homo sapiens
aattttgagaaaaatagag

SEQ ID NO: 4405034 - DNA, 16 bp, Homo sapiens
aattttgagattaaga

SEQ ID NO: 4405035 - DNA, 14 bp, Homo sapiens
aattttgcaaatta

SEQ ID NO: 4405036 - DNA, 18 bp, Homo sapiens
aattttggaatatttgct

SEQ ID NO: 4405037 - DNA, 13 bp, Homo sapiens
aattttggatgag

SEQ ID NO: 4405038 - DNA, 13 bp, Homo sapiens
aattttgtaagaa

SEQ ID NO: 4405039 - DNA, 13 bp, Homo sapiens
aattttgtacaaa

SEQ ID NO: 4405040 - DNA, 11 bp, Homo sapiens
aatttttaagc

SEQ ID NO: 4405041 - DNA, 15 bp, Homo sapiens
aatttttaagcaaat

SEQ ID NO: 4405042 - DNA, 16 bp, Homo sapiens
aatttttaggcaaaga

SEQ ID NO: 4405043 - DNA, 13 bp, Homo sapiens
aatttttcataga

SEQ ID NO: 4405044 - DNA, 16 bp, Homo sapiens
aatttttcattctcag

SEQ ID NO: 4405045 - DNA, 13 bp, Homo sapiens
aatttttcctatg

SEQ ID NO: 4405046 - DNA, 21 bp, Homo sapiens
aatttttcttatttcatttct

SEQ ID NO: 4405047 - DNA, 15 bp, Homo sapiens
aatttttgcaataat

SEQ ID NO: 4405048 - DNA, 19 bp, Homo sapiens
aatttttgcaataatgcag

SEQ ID NO: 4405049 - DNA, 13 bp, Homo sapiens
aatttttgctgaa

SEQ ID NO: 4405050 - DNA, 19 bp, Homo sapiens
aatttttgcttttagaaaa

SEQ ID NO: 4405051 - DNA, 17 bp, Homo sapiens
aatttttgtattatttt

SEQ ID NO: 4405052 - DNA, 13 bp, Homo sapiens
aatttttgtattt

SEQ ID NO: 4405053 - DNA, 14 bp, Homo sapiens
aatttttgtatttt

SEQ ID NO: 4405054 - DNA, 19 bp, Homo sapiens
aatttttgtttttgagtac

SEQ ID NO: 4405055 - DNA, 14 bp, Homo sapiens
aattttttaatttc

SEQ ID NO: 4405056 - DNA, 18 bp, Homo sapiens
aattttttatcatgcatg

SEQ ID NO: 4405057 - DNA, 21 bp, Homo sapiens
aattttttggtacaaaaataa

SEQ ID NO: 4405058 - DNA, 13 bp, Homo sapiens
aatttttttcacc

SEQ ID NO: 4405059 - DNA, 15 bp, Homo sapiens
aatttttttgtaata

SEQ ID NO: 4405060 - DNA, 18 bp, Homo sapiens
aattttttttcaaatgtg

SEQ ID NO: 4405061 - DNA, 22 bp, Homo sapiens
acaaaaaaatgttcattgtaga

SEQ ID NO: 4405062 - DNA, 15 bp, Homo sapiens
acaaaaaatgtaatt

SEQ ID NO: 4405063 - DNA, 14 bp, Homo sapiens
acaaaaagaaaaga

SEQ ID NO: 4405064 - DNA, 20 bp, Homo sapiens
acaaaaagccacaatgaaca

SEQ ID NO: 4405065 - DNA, 22 bp, Homo sapiens
acaaaaaggcaaatattgaagt

SEQ ID NO: 4405066 - DNA, 23 bp, Homo sapiens
acaaaaagtgcttcattctttgc

SEQ ID NO: 4405067 - DNA, 12 bp, Homo sapiens
acaaaaataaat

SEQ ID NO: 4405068 - DNA, 20 bp, Homo sapiens
acaaaaataaatttatatga

SEQ ID NO: 4405069 - DNA, 14 bp, Homo sapiens
acaaaaattaaaat

SEQ ID NO: 4405070 - DNA, 12 bp, Homo sapiens
acaaaacaaaac

SEQ ID NO: 4405071 - DNA, 19 bp, Homo sapiens
acaaaaccctcagcactgt

SEQ ID NO: 4405072 - DNA, 15 bp, Homo sapiens
acaaaacgagtcttt

SEQ ID NO: 4405073 - DNA, 18 bp, Homo sapiens
acaaaacgagtctttcat

SEQ ID NO: 4405074 - DNA, 19 bp, Homo sapiens
acaaggtgctaacatagat

SEQ ID NO: 4405075 - DNA, 13 bp, Homo sapiens
acaagtatataat

SEQ ID NO: 4405076 - DNA, 20 bp, Homo sapiens
acaagtatttgttaatttag

SEQ ID NO: 4405077 - DNA, 22 bp, Homo sapiens
acaagtatttgttaatttagaa

SEQ ID NO: 4405078 - DNA, 20 bp, Homo sapiens
acaagtcatggtcacagtaa

SEQ ID NO: 4405079 - DNA, 15 bp, Homo sapiens
acaagtctataatgt

SEQ ID NO: 4405080 - DNA, 19 bp, Homo sapiens
acaagtctgcatttcatat

SEQ ID NO: 4405081 - DNA, 11 bp, Homo sapiens
acaagttgcct

SEQ ID NO: 4405082 - DNA, 19 bp, Homo sapiens
acaagttttagttaaaact

SEQ ID NO: 4405083 - DNA, 21 bp, Homo sapiens
acaagttttagttaaaactca

SEQ ID NO: 4405084 - DNA, 13 bp, Homo sapiens
acaagttttgttt

SEQ ID NO: 4405085 - DNA, 16 bp, Homo sapiens
acaataaaaatgttta

SEQ ID NO: 4405086 - DNA, 14 bp, Homo sapiens
acaataaaacaaat

SEQ ID NO: 4405087 - DNA, 13 bp, Homo sapiens
acaataaaagctt

SEQ ID NO: 4405088 - DNA, 17 bp, Homo sapiens
acaataaagatacatga

SEQ ID NO: 4405089 - DNA, 18 bp, Homo sapiens
acaataaagatacatgat

SEQ ID NO: 4405090 - DNA, 16 bp, Homo sapiens
acaataagcaaaaaca

SEQ ID NO: 4405091 - DNA, 15 bp, Homo sapiens
acaataataaaaagt

SEQ ID NO: 4405092 - DNA, 13 bp, Homo sapiens
acaataatatttc

SEQ ID NO: 4405093 - DNA, 20 bp, Homo sapiens
acaataatatttcaagtgcc

SEQ ID NO: 4405094 - DNA, 12 bp, Homo sapiens
acaataatgcaa

SEQ ID NO: 4405095 - DNA, 18 bp, Homo sapiens
acaataatgcaattagaa

SEQ ID NO: 4405096 - DNA, 22 bp, Homo sapiens
acaatacaatgtacaattatgt

SEQ ID NO: 4405097 - DNA, 22 bp, Homo sapiens
acaatacagtattatagacaaa

SEQ ID NO: 4405098 - DNA, 18 bp, Homo sapiens
acaatagggctaaatgtt

SEQ ID NO: 4405099 - DNA, 18 bp, Homo sapiens
acaataggtctttctctc

SEQ ID NO: 4405100 - DNA, 24 bp, Homo sapiens
acaatagtatttctcctttgcaat

SEQ ID NO: 4405101 - DNA, 20 bp, Homo sapiens
acaatagtgacaccagtaat

SEQ ID NO: 4405102 - DNA, 23 bp, Homo sapiens
acaatatatagctggcaagaatg

SEQ ID NO: 4405103 - DNA, 20 bp, Homo sapiens
acaatattactttgtctttt

SEQ ID NO: 4405104 - DNA, 23 bp, Homo sapiens
acaatattcagtggtgaaatctt

SEQ ID NO: 4405105 - DNA, 12 bp, Homo sapiens
acaatatttctt

SEQ ID NO: 4405106 - DNA, 21 bp, Homo sapiens
acaatcattgttttgaatatt

SEQ ID NO: 4405107 - DNA, 12 bp, Homo sapiens
acaatctaacaa

SEQ ID NO: 4405108 - DNA, 22 bp, Homo sapiens
acaatctaacaataatatttca

SEQ ID NO: 4405109 - DNA, 19 bp, Homo sapiens
acaatctatttaaaaaact

SEQ ID NO: 4405110 - DNA, 14 bp, Homo sapiens
acaatctcttaaat

SEQ ID NO: 4405111 - DNA, 20 bp, Homo sapiens
acaatctggcttagtgccac

SEQ ID NO: 4405112 - DNA, 19 bp, Homo sapiens
acaatcttggagctgcttg

SEQ ID NO: 4405113 - DNA, 13 bp, Homo sapiens
acaatctttcatg

SEQ ID NO: 4405114 - DNA, 14 bp, Homo sapiens
acaatctttcatgt

SEQ ID NO: 4405115 - DNA, 19 bp, Homo sapiens
acaatgaaaacaaataaaa

SEQ ID NO: 4405116 - DNA, 21 bp, Homo sapiens
acaatgaaaactctttgctgc

SEQ ID NO: 4405117 - DNA, 13 bp, Homo sapiens
acaatgaagggaa

SEQ ID NO: 4405118 - DNA, 14 bp, Homo sapiens
acaatgcactttta

SEQ ID NO: 4405119 - DNA, 17 bp, Homo sapiens
acaatgcagatcttagg

SEQ ID NO: 4405120 - DNA, 16 bp, Homo sapiens
acaatgcctattgtaa

SEQ ID NO: 4405121 - DNA, 22 bp, Homo sapiens
acaatgccttgttgtattcctg

SEQ ID NO: 4405122 - DNA, 18 bp, Homo sapiens
acaatggaccctttttgt

SEQ ID NO: 4405123 - DNA, 14 bp, Homo sapiens
acaatggtaacatt

SEQ ID NO: 4405124 - DNA, 16 bp, Homo sapiens
acaatggtttttaaat

SEQ ID NO: 4405125 - DNA, 13 bp, Homo sapiens
acaatgtacaatt

SEQ ID NO: 4405126 - DNA, 14 bp, Homo sapiens
acaatgtatgtaca

SEQ ID NO: 4405127 - DNA, 20 bp, Homo sapiens
acaatgtatgtacaatacaa

SEQ ID NO: 4405128 - DNA, 18 bp, Homo sapiens
acaatgtgtttttctcca

SEQ ID NO: 4405129 - DNA, 17 bp, Homo sapiens
acaattatgtctcttga

SEQ ID NO: 4405130 - DNA, 22 bp, Homo sapiens
acaattattccaaaccaaattt

SEQ ID NO: 4405131 - DNA, 17 bp, Homo sapiens
acaattattggcaaagt

SEQ ID NO: 4405132 - DNA, 18 bp, Homo sapiens
acaattattggcaaagtt

SEQ ID NO: 4405133 - DNA, 19 bp, Homo sapiens
acaattattggcaaagttt

SEQ ID NO: 4405134 - DNA, 23 bp, Homo sapiens
acaattcctccagagacactgag

SEQ ID NO: 4405135 - DNA, 22 bp, Homo sapiens
acaattcctctactaacaatca

SEQ ID NO: 4405136 - DNA, 23 bp, Homo sapiens
acaattcctctactaacaatcag

SEQ ID NO: 4405137 - DNA, 23 bp, Homo sapiens
acaattctaaaatgattgtagta

SEQ ID NO: 4405138 - DNA, 20 bp, Homo sapiens
acaattgggagctgccaaga

SEQ ID NO: 4405139 - DNA, 11 bp, Homo sapiens
acaatttcaac

SEQ ID NO: 4405140 - DNA, 17 bp, Homo sapiens
acaatttcatttccagc

SEQ ID NO: 4405141 - DNA, 22 bp, Homo sapiens
acaatttcatttccagcatttt

SEQ ID NO: 4405142 - DNA, 18 bp, Homo sapiens
acaattttaaagttctta

SEQ ID NO: 4405143 - DNA, 23 bp, Homo sapiens
acaattttcctgtggaataaaga

SEQ ID NO: 4405144 - DNA, 12 bp, Homo sapiens
acaattttgtac

SEQ ID NO: 4405145 - DNA, 14 bp, Homo sapiens
acaatttttaatgg

SEQ ID NO: 4405146 - DNA, 19 bp, Homo sapiens
acaattttttttcaaatgt

SEQ ID NO: 4405147 - DNA, 22 bp, Homo sapiens
acacaaaatccattccaggtag

SEQ ID NO: 4405148 - DNA, 15 bp, Homo sapiens
acacaaactgtaaat

SEQ ID NO: 4405149 - DNA, 15 bp, Homo sapiens
acacaaggtgatttc

SEQ ID NO: 4405150 - DNA, 17 bp, Homo sapiens
acacaaggtgatttcag

SEQ ID NO: 4405151 - DNA, 15 bp, Homo sapiens
acacaataggtcttt

SEQ ID NO: 4405152 - DNA, 16 bp, Homo sapiens
acacaatggtttttaa

SEQ ID NO: 4405153 - DNA, 21 bp, Homo sapiens
acacaatttaattcctctttt

SEQ ID NO: 4405154 - DNA, 19 bp, Homo sapiens
acacaatttcatttccagc

SEQ ID NO: 4405155 - DNA, 12 bp, Homo sapiens
acacacagcctg

SEQ ID NO: 4405156 - DNA, 13 bp, Homo sapiens
acacacagcctgt

SEQ ID NO: 4405157 - DNA, 16 bp, Homo sapiens
acacacattctgcctt

SEQ ID NO: 4405158 - DNA, 23 bp, Homo sapiens
acacacattgctgtgaacaggaa

SEQ ID NO: 4405159 - DNA, 21 bp, Homo sapiens
acacaccaatcagcgctctgt

SEQ ID NO: 4405160 - DNA, 14 bp, Homo sapiens
acacaccaggcgct

SEQ ID NO: 4405161 - DNA, 17 bp, Homo sapiens
acacaccaggcgctaat

SEQ ID NO: 4405162 - DNA, 23 bp, Homo sapiens
acacacggtgcctttatttccac

SEQ ID NO: 4405163 - DNA, 14 bp, Homo sapiens
acacactaacatca

SEQ ID NO: 4405164 - DNA, 19 bp, Homo sapiens
acacactgagttgcacata

SEQ ID NO: 4405165 - DNA, 13 bp, Homo sapiens
acacactgatgct

SEQ ID NO: 4405166 - DNA, 16 bp, Homo sapiens
acacactggtacttag

SEQ ID NO: 4405167 - DNA, 17 bp, Homo sapiens
acacactggtacttaga

SEQ ID NO: 4405168 - DNA, 11 bp, Homo sapiens
acacactgtgc

SEQ ID NO: 4405169 - DNA, 17 bp, Homo sapiens
acacactgtgctttcta

SEQ ID NO: 4405170 - DNA, 22 bp, Homo sapiens
acacactgtgctttctattgta

SEQ ID NO: 4405171 - DNA, 19 bp, Homo sapiens
acacagaaaatgttgagaa

SEQ ID NO: 4405172 - DNA, 19 bp, Homo sapiens
acacagaaacctttttaaa

SEQ ID NO: 4405173 - DNA, 19 bp, Homo sapiens
acacagaatagtttacaca

SEQ ID NO: 4405174 - DNA, 13 bp, Homo sapiens
acacagacctcga

SEQ ID NO: 4405175 - DNA, 14 bp, Homo sapiens
acacagactatttt

SEQ ID NO: 4405176 - DNA, 20 bp, Homo sapiens
acacagcattgtatatgtga

SEQ ID NO: 4405177 - DNA, 21 bp, Homo sapiens
acacagccaaggggatattta

SEQ ID NO: 4405178 - DNA, 20 bp, Homo sapiens
acacagccaggtgccttgga

SEQ ID NO: 4405179 - DNA, 20 bp, Homo sapiens
acacagcccctatagcactg

SEQ ID NO: 4405180 - DNA, 23 bp, Homo sapiens
acacagctactctccccacgagg

SEQ ID NO: 4405181 - DNA, 11 bp, Homo sapiens
acacaggcagg

SEQ ID NO: 4405182 - DNA, 13 bp, Homo sapiens
acacaggcagggc

SEQ ID NO: 4405183 - DNA, 18 bp, Homo sapiens
acacaggcagggcctggc

SEQ ID NO: 4405184 - DNA, 13 bp, Homo sapiens
acacaggggcctt

SEQ ID NO: 4405185 - DNA, 20 bp, Homo sapiens
acacaggtctcattgcttct

SEQ ID NO: 4405186 - DNA, 15 bp, Homo sapiens
acacagtaattgtga

SEQ ID NO: 4405187 - DNA, 17 bp, Homo sapiens
acacagtattgacttct

SEQ ID NO: 4405188 - DNA, 18 bp, Homo sapiens
acacagtgagactgtaca

SEQ ID NO: 4405189 - DNA, 22 bp, Homo sapiens
acacagtgagactgtacataat

SEQ ID NO: 4405190 - DNA, 23 bp, Homo sapiens
acacagtgagactgtacataatt

SEQ ID NO: 4405191 - DNA, 22 bp, Homo sapiens
acacagtgttagtgctggtcag

SEQ ID NO: 4405192 - DNA, 22 bp, Homo sapiens
acagcatgtacggattttcagt

SEQ ID NO: 4405193 - DNA, 14 bp, Homo sapiens
acagcatgtgttaa

SEQ ID NO: 4405194 - DNA, 15 bp, Homo sapiens
acagccaaatttaaa

SEQ ID NO: 4405195 - DNA, 17 bp, Homo sapiens
acagccaacgagacaca

SEQ ID NO: 4405196 - DNA, 17 bp, Homo sapiens
acagccaactagcccct

SEQ ID NO: 4405197 - DNA, 19 bp, Homo sapiens
acagccaactagcccctgg

SEQ ID NO: 4405198 - DNA, 20 bp, Homo sapiens
acagccaactagcccctggg

SEQ ID NO: 4405199 - DNA, 11 bp, Homo sapiens
acagccacccg

SEQ ID NO: 4405200 - DNA, 19 bp, Homo sapiens
acagccagaggagggcaga

SEQ ID NO: 4405201 - DNA, 17 bp, Homo sapiens
acagccaggtgccttgg

SEQ ID NO: 4405202 - DNA, 21 bp, Homo sapiens
acagccagtgggagatgttag

SEQ ID NO: 4405203 - DNA, 19 bp, Homo sapiens
acagcccaagaggactgag

SEQ ID NO: 4405204 - DNA, 18 bp, Homo sapiens
acagccccggggccccct

SEQ ID NO: 4405205 - DNA, 21 bp, Homo sapiens
acagccccggggccccctggt

SEQ ID NO: 4405206 - DNA, 24 bp, Homo sapiens
acagccccggggccccctggtcac

SEQ ID NO: 4405207 - DNA, 13 bp, Homo sapiens
acagcccctggag

SEQ ID NO: 4405208 - DNA, 15 bp, Homo sapiens
acagcccctggagcc

SEQ ID NO: 4405209 - DNA, 14 bp, Homo sapiens
acagcctcacagaa

SEQ ID NO: 4405210 - DNA, 17 bp, Homo sapiens
acagcctcacagaagaa

SEQ ID NO: 4405211 - DNA, 19 bp, Homo sapiens
acagcctcccctgccaggg

SEQ ID NO: 4405212 - DNA, 23 bp, Homo sapiens
acagcctcctctgtctgcccttc

SEQ ID NO: 4405213 - DNA, 21 bp, Homo sapiens
acagcctgacaacatttctat

SEQ ID NO: 4405214 - DNA, 22 bp, Homo sapiens
acagcctgtggcggtgcctggg

SEQ ID NO: 4405215 - DNA, 19 bp, Homo sapiens
acagcctgtttctatcctg

SEQ ID NO: 4405216 - DNA, 22 bp, Homo sapiens
acagccttgcagcggctcctgc

SEQ ID NO: 4405217 - DNA, 17 bp, Homo sapiens
acagcgtccctggcgca

SEQ ID NO: 4405218 - DNA, 14 bp, Homo sapiens
acagctactttaac

SEQ ID NO: 4405219 - DNA, 15 bp, Homo sapiens
acagctatatttgat

SEQ ID NO: 4405220 - DNA, 16 bp, Homo sapiens
acagctatgggagccc

SEQ ID NO: 4405221 - DNA, 14 bp, Homo sapiens
acagctcattaaac

SEQ ID NO: 4405222 - DNA, 17 bp, Homo sapiens
acagctcattaaacttt

SEQ ID NO: 4405223 - DNA, 16 bp, Homo sapiens
acagctccacacgccc

SEQ ID NO: 4405224 - DNA, 19 bp, Homo sapiens
acagctcccaaacggaaga

SEQ ID NO: 4405225 - DNA, 14 bp, Homo sapiens
acagctcccacccc

SEQ ID NO: 4405226 - DNA, 21 bp, Homo sapiens
acagctcctggaccaggccca

SEQ ID NO: 4405227 - DNA, 20 bp, Homo sapiens
acagctctgcatactcatta

SEQ ID NO: 4405228 - DNA, 22 bp, Homo sapiens
acagctgaagtcaaaatatgta

SEQ ID NO: 4405229 - DNA, 20 bp, Homo sapiens
acagctgccttagcttcagg

SEQ ID NO: 4405230 - DNA, 14 bp, Homo sapiens
acagctgctggaga

SEQ ID NO: 4405231 - DNA, 13 bp, Homo sapiens
acagctgctgttc

SEQ ID NO: 4405232 - DNA, 16 bp, Homo sapiens
acagctgtatttatat

SEQ ID NO: 4405233 - DNA, 16 bp, Homo sapiens
acagctgtccctgtca

SEQ ID NO: 4405234 - DNA, 17 bp, Homo sapiens
acagcttagatttcata

SEQ ID NO: 4405235 - DNA, 13 bp, Homo sapiens
acagcttcagcta

SEQ ID NO: 4405236 - DNA, 12 bp, Homo sapiens
acagcttctctg

SEQ ID NO: 4405237 - DNA, 15 bp, Homo sapiens
acagcttctctgcag

SEQ ID NO: 4405238 - DNA, 16 bp, Homo sapiens
acagcttctctgcagt

SEQ ID NO: 4405239 - DNA, 16 bp, Homo sapiens
acagcttgagccgggc

SEQ ID NO: 4405240 - DNA, 22 bp, Homo sapiens
acagcttgagccgggcccctgg

SEQ ID NO: 4405241 - DNA, 14 bp, Homo sapiens
acagcttgccaggg

SEQ ID NO: 4405242 - DNA, 16 bp, Homo sapiens
acagcttgccagggat

SEQ ID NO: 4405243 - DNA, 19 bp, Homo sapiens
acagctttcctcaaaaagc

SEQ ID NO: 4405244 - DNA, 20 bp, Homo sapiens
acagctttgtatgtttatga

SEQ ID NO: 4405245 - DNA, 17 bp, Homo sapiens
acagcttttatggatga

SEQ ID NO: 4405246 - DNA, 18 bp, Homo sapiens
acagcttttatggatgat

SEQ ID NO: 4405247 - DNA, 20 bp, Homo sapiens
acagcttttcccaggagacc

SEQ ID NO: 4405248 - DNA, 14 bp, Homo sapiens
acaggaaaaaaact

SEQ ID NO: 4405249 - DNA, 16 bp, Homo sapiens
acaggaaaaaaacttt

SEQ ID NO: 4405250 - DNA, 23 bp, Homo sapiens
acaggaaaatcctctggctggct

SEQ ID NO: 4405251 - DNA, 15 bp, Homo sapiens
acaggaaagccctcc

SEQ ID NO: 4405252 - DNA, 17 bp, Homo sapiens
acaggaaagccctcccc

SEQ ID NO: 4405253 - DNA, 15 bp, Homo sapiens
acaggaagcacccca

SEQ ID NO: 4405254 - DNA, 19 bp, Homo sapiens
acaggaatcaagagctgcc

SEQ ID NO: 4405255 - DNA, 14 bp, Homo sapiens
acaggaatgaagaa

SEQ ID NO: 4405256 - DNA, 18 bp, Homo sapiens
acaggaatgaagaactgt

SEQ ID NO: 4405257 - DNA, 15 bp, Homo sapiens
acaggaattttaaaa

SEQ ID NO: 4405258 - DNA, 14 bp, Homo sapiens
acaggaccagattt

SEQ ID NO: 4405259 - DNA, 12 bp, Homo sapiens
acaggagctttt

SEQ ID NO: 4405260 - DNA, 14 bp, Homo sapiens
acaggagggccagc

SEQ ID NO: 4405261 - DNA, 21 bp, Homo sapiens
acaggagtgtcctcttccctc

SEQ ID NO: 4405262 - DNA, 23 bp, Homo sapiens
acaggagtgtcctcttccctctc

SEQ ID NO: 4405263 - DNA, 19 bp, Homo sapiens
acaggatcagttaactatt

SEQ ID NO: 4405264 - DNA, 15 bp, Homo sapiens
acaggatgaggacag

SEQ ID NO: 4405265 - DNA, 11 bp, Homo sapiens
acaggcagccc

SEQ ID NO: 4405266 - DNA, 13 bp, Homo sapiens
acaggcagggcct

SEQ ID NO: 4405267 - DNA, 17 bp, Homo sapiens
acaggcagggcctggct

SEQ ID NO: 4405268 - DNA, 14 bp, Homo sapiens
acaggcaggtacag

SEQ ID NO: 4405269 - DNA, 22 bp, Homo sapiens
acaggcagtctctctcttcctc

SEQ ID NO: 4405270 - DNA, 22 bp, Homo sapiens
acaggcccggcgcggtggctca

SEQ ID NO: 4405271 - DNA, 14 bp, Homo sapiens
acaggcctgaagat

SEQ ID NO: 4405272 - DNA, 22 bp, Homo sapiens
acaggctctcctggctgtccta

SEQ ID NO: 4405273 - DNA, 15 bp, Homo sapiens
acaggctgagaactc

SEQ ID NO: 4405274 - DNA, 21 bp, Homo sapiens
acaggctggaagatagctgtg

SEQ ID NO: 4405275 - DNA, 16 bp, Homo sapiens
acaggctgggtcctgc

SEQ ID NO: 4405276 - DNA, 17 bp, Homo sapiens
acaggctgggtcctgcc

SEQ ID NO: 4405277 - DNA, 23 bp, Homo sapiens
acaggctgggtcctgccagctgg

SEQ ID NO: 4405278 - DNA, 14 bp, Homo sapiens
acaggctgtcctta

SEQ ID NO: 4405279 - DNA, 23 bp, Homo sapiens
acaggctgtccttaacccacctc

SEQ ID NO: 4405280 - DNA, 17 bp, Homo sapiens
acagggaaaatgaagct

SEQ ID NO: 4405281 - DNA, 14 bp, Homo sapiens
acagggaggctccc

SEQ ID NO: 4405282 - DNA, 22 bp, Homo sapiens
acagggaggctcccggggcctg

SEQ ID NO: 4405283 - DNA, 15 bp, Homo sapiens
acagggattctcaca

SEQ ID NO: 4405284 - DNA, 16 bp, Homo sapiens
acagggattctcacaa

SEQ ID NO: 4405285 - DNA, 15 bp, Homo sapiens
acagggccacataga

SEQ ID NO: 4405286 - DNA, 18 bp, Homo sapiens
acagggcccggccacacc

SEQ ID NO: 4405287 - DNA, 12 bp, Homo sapiens
acagggcctctg

SEQ ID NO: 4405288 - DNA, 22 bp, Homo sapiens
acagggctaagagctagcgctg

SEQ ID NO: 4405289 - DNA, 17 bp, Homo sapiens
acagggctggcccagcc

SEQ ID NO: 4405290 - DNA, 22 bp, Homo sapiens
acagggctggcccagccctgct

SEQ ID NO: 4405291 - DNA, 24 bp, Homo sapiens
acagggctggcccagccctgctgg

SEQ ID NO: 4405292 - DNA, 22 bp, Homo sapiens
acaggggttgtgggggcagagg

SEQ ID NO: 4405293 - DNA, 13 bp, Homo sapiens
acagggtgggctt

SEQ ID NO: 4405294 - DNA, 14 bp, Homo sapiens
acaggtaaaacagg

SEQ ID NO: 4405295 - DNA, 22 bp, Homo sapiens
acaggtaaaacagggccacata

SEQ ID NO: 4405296 - DNA, 14 bp, Homo sapiens
acaggtagcacaga

SEQ ID NO: 4405297 - DNA, 16 bp, Homo sapiens
acaggtatttttttaa

SEQ ID NO: 4405298 - DNA, 21 bp, Homo sapiens
acaggtatttttttaaatcaa

SEQ ID NO: 4405299 - DNA, 15 bp, Homo sapiens
acaggtcttttcaaa

SEQ ID NO: 4405300 - DNA, 19 bp, Homo sapiens
acaggtgacagtggctgct

SEQ ID NO: 4405301 - DNA, 16 bp, Homo sapiens
acaggtgttccgtggg

SEQ ID NO: 4405302 - DNA, 17 bp, Homo sapiens
acaggtgttccgtggga

SEQ ID NO: 4405303 - DNA, 15 bp, Homo sapiens
acaggttagctgctc

SEQ ID NO: 4405304 - DNA, 21 bp, Homo sapiens
acaggtttttagtttgttctt

SEQ ID NO: 4405305 - DNA, 12 bp, Homo sapiens
acagtaaaatta

SEQ ID NO: 4405306 - DNA, 15 bp, Homo sapiens
acagtaaagagtaca

SEQ ID NO: 4405307 - DNA, 23 bp, Homo sapiens
acagtaaagagtacactcagcca

SEQ ID NO: 4405308 - DNA, 12 bp, Homo sapiens
acagtaaatgtt

SEQ ID NO: 4405309 - DNA, 13 bp, Homo sapiens
acagtaattgtga

SEQ ID NO: 4405310 - DNA, 15 bp, Homo sapiens
acatgcagtttgaaa

SEQ ID NO: 4405311 - DNA, 22 bp, Homo sapiens
acatgcagtttgaaattctgaa

SEQ ID NO: 4405312 - DNA, 20 bp, Homo sapiens
acatgcataaactaaaaact

SEQ ID NO: 4405313 - DNA, 15 bp, Homo sapiens
acatgcatacttaca

SEQ ID NO: 4405314 - DNA, 14 bp, Homo sapiens
acatgcatgtctgc

SEQ ID NO: 4405315 - DNA, 15 bp, Homo sapiens
acatgcatgtctgcc

SEQ ID NO: 4405316 - DNA, 22 bp, Homo sapiens
acatgccaacacttaatcattt

SEQ ID NO: 4405317 - DNA, 14 bp, Homo sapiens
acatgccatgccta

SEQ ID NO: 4405318 - DNA, 14 bp, Homo sapiens
acatgccccaggct

SEQ ID NO: 4405319 - DNA, 16 bp, Homo sapiens
acatgccctgtgtggc

SEQ ID NO: 4405320 - DNA, 17 bp, Homo sapiens
acatgccctgtgtggct

SEQ ID NO: 4405321 - DNA, 15 bp, Homo sapiens
acatgcctgcgcctg

SEQ ID NO: 4405322 - DNA, 22 bp, Homo sapiens
acatgcctgcgcctgctgcctg

SEQ ID NO: 4405323 - DNA, 24 bp, Homo sapiens
acatgctaagagaagtagaaatca

SEQ ID NO: 4405324 - DNA, 14 bp, Homo sapiens
acatgctgtctggc

SEQ ID NO: 4405325 - DNA, 18 bp, Homo sapiens
acatgctgtctggccctg

SEQ ID NO: 4405326 - DNA, 17 bp, Homo sapiens
acatgcttataacatta

SEQ ID NO: 4405327 - DNA, 21 bp, Homo sapiens
acatggaatcgaagtgtttat

SEQ ID NO: 4405328 - DNA, 17 bp, Homo sapiens
acatggacaaggagctg

SEQ ID NO: 4405329 - DNA, 17 bp, Homo sapiens
acatggagatgtaaaat

SEQ ID NO: 4405330 - DNA, 23 bp, Homo sapiens
acatggaggatggtgtcctgagg

SEQ ID NO: 4405331 - DNA, 15 bp, Homo sapiens
acatggccagcaaat

SEQ ID NO: 4405332 - DNA, 21 bp, Homo sapiens
acatggcccctccccctgcca

SEQ ID NO: 4405333 - DNA, 22 bp, Homo sapiens
acatggcccctccccctgccag

SEQ ID NO: 4405334 - DNA, 20 bp, Homo sapiens
acatgggagcagtccatgca

SEQ ID NO: 4405335 - DNA, 23 bp, Homo sapiens
acatgggagccgggtctgcctct

SEQ ID NO: 4405336 - DNA, 21 bp, Homo sapiens
acatgggagcttattgctaat

SEQ ID NO: 4405337 - DNA, 12 bp, Homo sapiens
acatgggaggga

SEQ ID NO: 4405338 - DNA, 19 bp, Homo sapiens
acatgggagggatcagccc

SEQ ID NO: 4405339 - DNA, 18 bp, Homo sapiens
acatggggaaaaaaatca

SEQ ID NO: 4405340 - DNA, 16 bp, Homo sapiens
acatggtgcctgagag

SEQ ID NO: 4405341 - DNA, 18 bp, Homo sapiens
acatggtgcctgagaggc

SEQ ID NO: 4405342 - DNA, 19 bp, Homo sapiens
acatggtgggtccatgggc

SEQ ID NO: 4405343 - DNA, 16 bp, Homo sapiens
acatggtgtctcccaa

SEQ ID NO: 4405344 - DNA, 14 bp, Homo sapiens
acatggtttaaaag

SEQ ID NO: 4405345 - DNA, 18 bp, Homo sapiens
acatgtaagaaaatgtta

SEQ ID NO: 4405346 - DNA, 13 bp, Homo sapiens
acatgtaatttga

SEQ ID NO: 4405347 - DNA, 14 bp, Homo sapiens
acatgtactacagc

SEQ ID NO: 4405348 - DNA, 17 bp, Homo sapiens
acatgtactacagctat

SEQ ID NO: 4405349 - DNA, 19 bp, Homo sapiens
acatgtactacagctatat

SEQ ID NO: 4405350 - DNA, 22 bp, Homo sapiens
acatgtactacagctatatttg

SEQ ID NO: 4405351 - DNA, 19 bp, Homo sapiens
acatgtatgtgtgcttgag

SEQ ID NO: 4405352 - DNA, 13 bp, Homo sapiens
acatgtatttatg

SEQ ID NO: 4405353 - DNA, 12 bp, Homo sapiens
acatgtcaatct

SEQ ID NO: 4405354 - DNA, 15 bp, Homo sapiens
acatgtcaatctgtc

SEQ ID NO: 4405355 - DNA, 13 bp, Homo sapiens
acatgtgcttcat

SEQ ID NO: 4405356 - DNA, 17 bp, Homo sapiens
acatgtgcttcatctgt

SEQ ID NO: 4405357 - DNA, 19 bp, Homo sapiens
acatgtggctcctcccagc

SEQ ID NO: 4405358 - DNA, 20 bp, Homo sapiens
acatgtgttaagtattttca

SEQ ID NO: 4405359 - DNA, 16 bp, Homo sapiens
acatgtgttatctacc

SEQ ID NO: 4405360 - DNA, 17 bp, Homo sapiens
acatgtgttatctacct

SEQ ID NO: 4405361 - DNA, 22 bp, Homo sapiens
acatgtgttttcatcatttcag

SEQ ID NO: 4405362 - DNA, 22 bp, Homo sapiens
acatgttactggataaattgtt

SEQ ID NO: 4405363 - DNA, 14 bp, Homo sapiens
acatgttatttgta

SEQ ID NO: 4405364 - DNA, 19 bp, Homo sapiens
acatgttggaaatgtgttt

SEQ ID NO: 4405365 - DNA, 22 bp, Homo sapiens
acatgtttctgttttgttgttt

SEQ ID NO: 4405366 - DNA, 18 bp, Homo sapiens
acatgtttttatttcctc

SEQ ID NO: 4405367 - DNA, 22 bp, Homo sapiens
acatgttttttcatttgtaaaa

SEQ ID NO: 4405368 - DNA, 22 bp, Homo sapiens
acattaaattttttttacattt

SEQ ID NO: 4405369 - DNA, 16 bp, Homo sapiens
acattaacggtgctaa

SEQ ID NO: 4405370 - DNA, 18 bp, Homo sapiens
acattaacggtgctaaaa

SEQ ID NO: 4405371 - DNA, 18 bp, Homo sapiens
acattaatatacttgaat

SEQ ID NO: 4405372 - DNA, 14 bp, Homo sapiens
acattacttattta

SEQ ID NO: 4405373 - DNA, 13 bp, Homo sapiens
acattaggctgtt

SEQ ID NO: 4405374 - DNA, 16 bp, Homo sapiens
acattataataaaatt

SEQ ID NO: 4405375 - DNA, 21 bp, Homo sapiens
acattatataacaaaaaaggt

SEQ ID NO: 4405376 - DNA, 15 bp, Homo sapiens
acattatattgcaat

SEQ ID NO: 4405377 - DNA, 17 bp, Homo sapiens
acattatattgcaatga

SEQ ID NO: 4405378 - DNA, 21 bp, Homo sapiens
acattatctcacttagtcctt

SEQ ID NO: 4405379 - DNA, 14 bp, Homo sapiens
acattatcttctgg

SEQ ID NO: 4405380 - DNA, 20 bp, Homo sapiens
acattatctttgatatgtga

SEQ ID NO: 4405381 - DNA, 12 bp, Homo sapiens
acattattctgg

SEQ ID NO: 4405382 - DNA, 18 bp, Homo sapiens
acattcaacagagactga

SEQ ID NO: 4405383 - DNA, 22 bp, Homo sapiens
acattcacctgtatatttcttt

SEQ ID NO: 4405384 - DNA, 13 bp, Homo sapiens
acattcactgagt

SEQ ID NO: 4405385 - DNA, 13 bp, Homo sapiens
acattcacttttg

SEQ ID NO: 4405386 - DNA, 23 bp, Homo sapiens
acattcccctccccactcctctc

SEQ ID NO: 4405387 - DNA, 22 bp, Homo sapiens
acattcccttgatggtctcaag

SEQ ID NO: 4405388 - DNA, 14 bp, Homo sapiens
acattcctaaaatg

SEQ ID NO: 4405389 - DNA, 12 bp, Homo sapiens
acattcctccag

SEQ ID NO: 4405390 - DNA, 17 bp, Homo sapiens
acattcctccagcctcc

SEQ ID NO: 4405391 - DNA, 20 bp, Homo sapiens
acattcctccagcctcccct

SEQ ID NO: 4405392 - DNA, 23 bp, Homo sapiens
acattccttctcccatctcttcc

SEQ ID NO: 4405393 - DNA, 19 bp, Homo sapiens
acattcgaatctctgcccc

SEQ ID NO: 4405394 - DNA, 16 bp, Homo sapiens
acattcgggaccaata

SEQ ID NO: 4405395 - DNA, 15 bp, Homo sapiens
acattcgtgagctgg

SEQ ID NO: 4405396 - DNA, 13 bp, Homo sapiens
acattctcacata

SEQ ID NO: 4405397 - DNA, 18 bp, Homo sapiens
acattctcacataagccc

SEQ ID NO: 4405398 - DNA, 19 bp, Homo sapiens
acattctcgcttccctgaa

SEQ ID NO: 4405399 - DNA, 20 bp, Homo sapiens
acattctggggaaacaacat

SEQ ID NO: 4405400 - DNA, 23 bp, Homo sapiens
acattctggggaaacaacattta

SEQ ID NO: 4405401 - DNA, 22 bp, Homo sapiens
acattcttagctgtaacttaac

SEQ ID NO: 4405402 - DNA, 20 bp, Homo sapiens
acattcttggcttaatcatt

SEQ ID NO: 4405403 - DNA, 23 bp, Homo sapiens
acattcttggcttaatcattttc

SEQ ID NO: 4405404 - DNA, 22 bp, Homo sapiens
acattcttggttgttaatttag

SEQ ID NO: 4405405 - DNA, 23 bp, Homo sapiens
acattcttggttgttaatttaga

SEQ ID NO: 4405406 - DNA, 14 bp, Homo sapiens
acattgagtagaca

SEQ ID NO: 4405407 - DNA, 19 bp, Homo sapiens
acattgatctgttttacag

SEQ ID NO: 4405408 - DNA, 18 bp, Homo sapiens
acattgcactcatcatat

SEQ ID NO: 4405409 - DNA, 23 bp, Homo sapiens
acattgccaaaaaggatacataa

SEQ ID NO: 4405410 - DNA, 19 bp, Homo sapiens
acattgccgtggcatctta

SEQ ID NO: 4405411 - DNA, 15 bp, Homo sapiens
acattgggtggggct

SEQ ID NO: 4405412 - DNA, 22 bp, Homo sapiens
acattgggtggggctcctggga

SEQ ID NO: 4405413 - DNA, 23 bp, Homo sapiens
acattgggtggggctcctgggag

SEQ ID NO: 4405414 - DNA, 19 bp, Homo sapiens
acattgtctcctatatatt

SEQ ID NO: 4405415 - DNA, 14 bp, Homo sapiens
acattgtgagctct

SEQ ID NO: 4405416 - DNA, 21 bp, Homo sapiens
acattgttcaactcccttctc

SEQ ID NO: 4405417 - DNA, 17 bp, Homo sapiens
acattgttgagctattg

SEQ ID NO: 4405418 - DNA, 15 bp, Homo sapiens
acatttaaattccac

SEQ ID NO: 4405419 - DNA, 17 bp, Homo sapiens
acatttaaattccacag

SEQ ID NO: 4405420 - DNA, 20 bp, Homo sapiens
acatttagaaaagtgaattg

SEQ ID NO: 4405421 - DNA, 22 bp, Homo sapiens
acatttagaaaagtgaattgaa

SEQ ID NO: 4405422 - DNA, 15 bp, Homo sapiens
acatttagaaatgtt

SEQ ID NO: 4405423 - DNA, 21 bp, Homo sapiens
acatttagaaatgtttattga

SEQ ID NO: 4405424 - DNA, 15 bp, Homo sapiens
acatttagaagaaag

SEQ ID NO: 4405425 - DNA, 22 bp, Homo sapiens
acatttatgttccttttaaaga

SEQ ID NO: 4405426 - DNA, 18 bp, Homo sapiens
acatttattgagatctaa

SEQ ID NO: 4405427 - DNA, 18 bp, Homo sapiens
accattggggctcccagc

SEQ ID NO: 4405428 - DNA, 12 bp, Homo sapiens
accatttaattt

SEQ ID NO: 4405429 - DNA, 15 bp, Homo sapiens
accatttaatttcat

SEQ ID NO: 4405430 - DNA, 15 bp, Homo sapiens
accatttgtgttttg

SEQ ID NO: 4405431 - DNA, 15 bp, Homo sapiens
accattttcaatttg

SEQ ID NO: 4405432 - DNA, 13 bp, Homo sapiens
acccaaaaggcag

SEQ ID NO: 4405433 - DNA, 15 bp, Homo sapiens
acccaaaaggcagaa

SEQ ID NO: 4405434 - DNA, 12 bp, Homo sapiens
acccaaaatata

SEQ ID NO: 4405435 - DNA, 14 bp, Homo sapiens
acccaaaatatata

SEQ ID NO: 4405436 - DNA, 15 bp, Homo sapiens
acccaaaatatatac

SEQ ID NO: 4405437 - DNA, 20 bp, Homo sapiens
acccaaagcggtccctgtcc

SEQ ID NO: 4405438 - DNA, 14 bp, Homo sapiens
acccaacctcaccc

SEQ ID NO: 4405439 - DNA, 16 bp, Homo sapiens
acccaactgacctgcc

SEQ ID NO: 4405440 - DNA, 15 bp, Homo sapiens
acccaagcctgctgg

SEQ ID NO: 4405441 - DNA, 20 bp, Homo sapiens
acccaagcctgctggctgcg

SEQ ID NO: 4405442 - DNA, 17 bp, Homo sapiens
acccaaggactgaggga

SEQ ID NO: 4405443 - DNA, 15 bp, Homo sapiens
acccaaggaggaaaa

SEQ ID NO: 4405444 - DNA, 23 bp, Homo sapiens
acccaaggggatttttatgtctg

SEQ ID NO: 4405445 - DNA, 18 bp, Homo sapiens
acccacattactttttat

SEQ ID NO: 4405446 - DNA, 12 bp, Homo sapiens
acccaccaggcc

SEQ ID NO: 4405447 - DNA, 16 bp, Homo sapiens
acccaccaggccagct

SEQ ID NO: 4405448 - DNA, 18 bp, Homo sapiens
acccaccaggccagctca

SEQ ID NO: 4405449 - DNA, 19 bp, Homo sapiens
acccaccaggccagctcag

SEQ ID NO: 4405450 - DNA, 13 bp, Homo sapiens
acccaccccaact

SEQ ID NO: 4405451 - DNA, 19 bp, Homo sapiens
acccaccccaactctcccc

SEQ ID NO: 4405452 - DNA, 11 bp, Homo sapiens
acccacctgct

SEQ ID NO: 4405453 - DNA, 21 bp, Homo sapiens
acccacctgctagtgtgaatt

SEQ ID NO: 4405454 - DNA, 22 bp, Homo sapiens
acccacctgctgagagacccaa

SEQ ID NO: 4405455 - DNA, 21 bp, Homo sapiens
acccacctttgccacaaagct

SEQ ID NO: 4405456 - DNA, 20 bp, Homo sapiens
acccactttgtaatttttgc

SEQ ID NO: 4405457 - DNA, 21 bp, Homo sapiens
acccagaatggagcctgctct

SEQ ID NO: 4405458 - DNA, 17 bp, Homo sapiens
acccagaatgtaaaaaa

SEQ ID NO: 4405459 - DNA, 22 bp, Homo sapiens
acccagagaagccccttcccca

SEQ ID NO: 4405460 - DNA, 22 bp, Homo sapiens
acccagaggaaggggccagagg

SEQ ID NO: 4405461 - DNA, 23 bp, Homo sapiens
acccagaggtctcatctcccagg

SEQ ID NO: 4405462 - DNA, 19 bp, Homo sapiens
acccagagtggagtctgag

SEQ ID NO: 4405463 - DNA, 17 bp, Homo sapiens
acccagcaaatgggcat

SEQ ID NO: 4405464 - DNA, 21 bp, Homo sapiens
acccagccctggtctcagcag

SEQ ID NO: 4405465 - DNA, 21 bp, Homo sapiens
acccaggaagggaaagcgggc

SEQ ID NO: 4405466 - DNA, 20 bp, Homo sapiens
acccaggaggtggaggttgc

SEQ ID NO: 4405467 - DNA, 23 bp, Homo sapiens
acccaggaggtggaggttgcagt

SEQ ID NO: 4405468 - DNA, 14 bp, Homo sapiens
acccaggagtccag

SEQ ID NO: 4405469 - DNA, 16 bp, Homo sapiens
acccaggagtccagac

SEQ ID NO: 4405470 - DNA, 17 bp, Homo sapiens
acccaggagtccagacc

SEQ ID NO: 4405471 - DNA, 17 bp, Homo sapiens
acccaggagtccagccc

SEQ ID NO: 4405472 - DNA, 13 bp, Homo sapiens
acccaggcgctgc

SEQ ID NO: 4405473 - DNA, 21 bp, Homo sapiens
acccaggcgctgcatacaggg

SEQ ID NO: 4405474 - DNA, 20 bp, Homo sapiens
acccaggctggagtgcagtg

SEQ ID NO: 4405475 - DNA, 17 bp, Homo sapiens
acccagggcctgacttg

SEQ ID NO: 4405476 - DNA, 18 bp, Homo sapiens
acccaggggaaggccctg

SEQ ID NO: 4405477 - DNA, 16 bp, Homo sapiens
acccaggggacagctg

SEQ ID NO: 4405478 - DNA, 14 bp, Homo sapiens
acccaggggtccag

SEQ ID NO: 4405479 - DNA, 16 bp, Homo sapiens
acccaggtgggtcccg

SEQ ID NO: 4405480 - DNA, 23 bp, Homo sapiens
acccaggttcatgaatatggtgt

SEQ ID NO: 4405481 - DNA, 15 bp, Homo sapiens
acccagtagcccaga

SEQ ID NO: 4405482 - DNA, 20 bp, Homo sapiens
acccagtagctgcccttcct

SEQ ID NO: 4405483 - DNA, 14 bp, Homo sapiens
acccagtgaacaca

SEQ ID NO: 4405484 - DNA, 15 bp, Homo sapiens
acccagtggtcagca

SEQ ID NO: 4405485 - DNA, 19 bp, Homo sapiens
acccagtggtcagcaggtg

SEQ ID NO: 4405486 - DNA, 13 bp, Homo sapiens
acccatacaatgt

SEQ ID NO: 4405487 - DNA, 14 bp, Homo sapiens
acccatacaatgta

SEQ ID NO: 4405488 - DNA, 22 bp, Homo sapiens
acccatacaatgtatgtacaat

SEQ ID NO: 4405489 - DNA, 14 bp, Homo sapiens
acccatcagaagga

SEQ ID NO: 4405490 - DNA, 19 bp, Homo sapiens
acccatcagaaggagaagg

SEQ ID NO: 4405491 - DNA, 18 bp, Homo sapiens
acccatcagttccagcct

SEQ ID NO: 4405492 - DNA, 20 bp, Homo sapiens
acccatctgtagtaatttat

SEQ ID NO: 4405493 - DNA, 22 bp, Homo sapiens
acccatggcctcagccctgctc

SEQ ID NO: 4405494 - DNA, 16 bp, Homo sapiens
acccatgggctctgac

SEQ ID NO: 4405495 - DNA, 17 bp, Homo sapiens
acccatgtaaccactgc

SEQ ID NO: 4405496 - DNA, 18 bp, Homo sapiens
acccattcactacaggtg

SEQ ID NO: 4405497 - DNA, 13 bp, Homo sapiens
acccattcagaga

SEQ ID NO: 4405498 - DNA, 19 bp, Homo sapiens
acccattctacacagagca

SEQ ID NO: 4405499 - DNA, 23 bp, Homo sapiens
acccatttaaatttttttcctta

SEQ ID NO: 4405500 - DNA, 18 bp, Homo sapiens
accccaaaccccagcccc

SEQ ID NO: 4405501 - DNA, 20 bp, Homo sapiens
accccaaaccccagccccaa

SEQ ID NO: 4405502 - DNA, 18 bp, Homo sapiens
accccaagactcccatga

SEQ ID NO: 4405503 - DNA, 13 bp, Homo sapiens
accccaaggccag

SEQ ID NO: 4405504 - DNA, 21 bp, Homo sapiens
accccaatttcggattttttc

SEQ ID NO: 4405505 - DNA, 11 bp, Homo sapiens
accccacactt

SEQ ID NO: 4405506 - DNA, 20 bp, Homo sapiens
accccacagaaccttcaacc

SEQ ID NO: 4405507 - DNA, 11 bp, Homo sapiens
accccacagct

SEQ ID NO: 4405508 - DNA, 18 bp, Homo sapiens
accccacagctggggccg

SEQ ID NO: 4405509 - DNA, 21 bp, Homo sapiens
accccacccccttcagtgccc

SEQ ID NO: 4405510 - DNA, 16 bp, Homo sapiens
accccaccctccctgg

SEQ ID NO: 4405511 - DNA, 17 bp, Homo sapiens
accccaccctccctgga

SEQ ID NO: 4405512 - DNA, 16 bp, Homo sapiens
accccagcattccagc

SEQ ID NO: 4405513 - DNA, 19 bp, Homo sapiens
accccagcattccagctct

SEQ ID NO: 4405514 - DNA, 11 bp, Homo sapiens
accccaggacg

SEQ ID NO: 4405515 - DNA, 17 bp, Homo sapiens
accccaggacgccactc

SEQ ID NO: 4405516 - DNA, 12 bp, Homo sapiens
accccaggcccc

SEQ ID NO: 4405517 - DNA, 16 bp, Homo sapiens
accccagggcactgcc

SEQ ID NO: 4405518 - DNA, 20 bp, Homo sapiens
accccagggcactgccagcc

SEQ ID NO: 4405519 - DNA, 15 bp, Homo sapiens
accccagggtcataa

SEQ ID NO: 4405520 - DNA, 19 bp, Homo sapiens
accccagtggccactcagc

SEQ ID NO: 4405521 - DNA, 23 bp, Homo sapiens
accccatagggtcggaggtgctg

SEQ ID NO: 4405522 - DNA, 13 bp, Homo sapiens
accccattctttg

SEQ ID NO: 4405523 - DNA, 16 bp, Homo sapiens
acccccaccccacact

SEQ ID NO: 4405524 - DNA, 17 bp, Homo sapiens
acccccactctcattcc

SEQ ID NO: 4405525 - DNA, 21 bp, Homo sapiens
acccccactctcattccccag

SEQ ID NO: 4405526 - DNA, 22 bp, Homo sapiens
acccccactctcattccccagg

SEQ ID NO: 4405527 - DNA, 16 bp, Homo sapiens
acccccagcccacaga

SEQ ID NO: 4405528 - DNA, 14 bp, Homo sapiens
acccccagccccga

SEQ ID NO: 4405529 - DNA, 23 bp, Homo sapiens
acccccagccccgactccagcca

SEQ ID NO: 4405530 - DNA, 13 bp, Homo sapiens
acccccaggcaga

SEQ ID NO: 4405531 - DNA, 17 bp, Homo sapiens
acccccatctccctagc

SEQ ID NO: 4405532 - DNA, 13 bp, Homo sapiens
accccccagcact

SEQ ID NO: 4405533 - DNA, 14 bp, Homo sapiens
accccccagcactg

SEQ ID NO: 4405534 - DNA, 19 bp, Homo sapiens
accccccagcactgaggaa

SEQ ID NO: 4405535 - DNA, 21 bp, Homo sapiens
accccccagtataaatttctg

SEQ ID NO: 4405536 - DNA, 13 bp, Homo sapiens
acccccctcccag

SEQ ID NO: 4405537 - DNA, 14 bp, Homo sapiens
acccccctcccaga

SEQ ID NO: 4405538 - DNA, 18 bp, Homo sapiens
acccccctcccagacagg

SEQ ID NO: 4405539 - DNA, 17 bp, Homo sapiens
acccccctccccaactc

SEQ ID NO: 4405540 - DNA, 19 bp, Homo sapiens
accccctcccacccccagc

SEQ ID NO: 4405541 - DNA, 13 bp, Homo sapiens
accccctccccag

SEQ ID NO: 4405542 - DNA, 16 bp, Homo sapiens
accccctccccagggg

SEQ ID NO: 4405543 - DNA, 11 bp, Homo sapiens
accccctcctc

SEQ ID NO: 4405544 - DNA, 20 bp, Homo sapiens
acccccttcagtgcccacca

SEQ ID NO: 4405545 - DNA, 18 bp, Homo sapiens
acccccttctctgctcca

SEQ ID NO: 4405546 - DNA, 21 bp, Homo sapiens
accgcggaggaggctggtgac

SEQ ID NO: 4405547 - DNA, 15 bp, Homo sapiens
accgcgtcccagctc

SEQ ID NO: 4405548 - DNA, 18 bp, Homo sapiens
accgcgtcccagctcccc

SEQ ID NO: 4405549 - DNA, 13 bp, Homo sapiens
accgctaaaagaa

SEQ ID NO: 4405550 - DNA, 19 bp, Homo sapiens
accgctgcctaagtggctg

SEQ ID NO: 4405551 - DNA, 20 bp, Homo sapiens
accgctgcctaagtggctgc

SEQ ID NO: 4405552 - DNA, 12 bp, Homo sapiens
accgctgcctcg

SEQ ID NO: 4405553 - DNA, 17 bp, Homo sapiens
accgctgcctcgtagag

SEQ ID NO: 4405554 - DNA, 18 bp, Homo sapiens
accggagtactagccagc

SEQ ID NO: 4405555 - DNA, 18 bp, Homo sapiens
accggcctgtgggtctct

SEQ ID NO: 4405556 - DNA, 16 bp, Homo sapiens
accgtaaaggtttatt

SEQ ID NO: 4405557 - DNA, 15 bp, Homo sapiens
accgtcctctttttc

SEQ ID NO: 4405558 - DNA, 14 bp, Homo sapiens
accgtgatggagag

SEQ ID NO: 4405559 - DNA, 11 bp, Homo sapiens
accgtgcctgg

SEQ ID NO: 4405560 - DNA, 15 bp, Homo sapiens
accgtgcctggccag

SEQ ID NO: 4405561 - DNA, 16 bp, Homo sapiens
accgtgcctggccaga

SEQ ID NO: 4405562 - DNA, 15 bp, Homo sapiens
accgtgggcggggcc

SEQ ID NO: 4405563 - DNA, 19 bp, Homo sapiens
accgtgggcggggccttgc

SEQ ID NO: 4405564 - DNA, 20 bp, Homo sapiens
accgtgggcggggccttgcg

SEQ ID NO: 4405565 - DNA, 18 bp, Homo sapiens
accgtttgtccacttcat

SEQ ID NO: 4405566 - DNA, 13 bp, Homo sapiens
acctaaaaatcaa

SEQ ID NO: 4405567 - DNA, 19 bp, Homo sapiens
acctaaaggactattatgt

SEQ ID NO: 4405568 - DNA, 12 bp, Homo sapiens
acctaaatactg

SEQ ID NO: 4405569 - DNA, 23 bp, Homo sapiens
acctaaccccagggcactgccag

SEQ ID NO: 4405570 - DNA, 15 bp, Homo sapiens
acctaacccctttcc

SEQ ID NO: 4405571 - DNA, 16 bp, Homo sapiens
acctaagcacttctag

SEQ ID NO: 4405572 - DNA, 15 bp, Homo sapiens
acctaatttcatttt

SEQ ID NO: 4405573 - DNA, 17 bp, Homo sapiens
acctacagactccatct

SEQ ID NO: 4405574 - DNA, 19 bp, Homo sapiens
acctacagactccatctct

SEQ ID NO: 4405575 - DNA, 22 bp, Homo sapiens
acctacagactccatctcttct

SEQ ID NO: 4405576 - DNA, 11 bp, Homo sapiens
acctacagttt

SEQ ID NO: 4405577 - DNA, 16 bp, Homo sapiens
acctacagttttaact

SEQ ID NO: 4405578 - DNA, 18 bp, Homo sapiens
acctacagttttaactgt

SEQ ID NO: 4405579 - DNA, 21 bp, Homo sapiens
acctacatgctgaaaaatata

SEQ ID NO: 4405580 - DNA, 17 bp, Homo sapiens
acctaccagttggccat

SEQ ID NO: 4405581 - DNA, 16 bp, Homo sapiens
acctacctgccttgga

SEQ ID NO: 4405582 - DNA, 21 bp, Homo sapiens
acctactttgactttttgcat

SEQ ID NO: 4405583 - DNA, 22 bp, Homo sapiens
acctagaacgtgcatccttgta

SEQ ID NO: 4405584 - DNA, 20 bp, Homo sapiens
acctagacaaccagaggctg

SEQ ID NO: 4405585 - DNA, 14 bp, Homo sapiens
acctagcaggctgt

SEQ ID NO: 4405586 - DNA, 21 bp, Homo sapiens
acctagcaggctgttccatgt

SEQ ID NO: 4405587 - DNA, 13 bp, Homo sapiens
acctagccagctg

SEQ ID NO: 4405588 - DNA, 15 bp, Homo sapiens
acctagctacactga

SEQ ID NO: 4405589 - DNA, 17 bp, Homo sapiens
acctagctgcatctata

SEQ ID NO: 4405590 - DNA, 17 bp, Homo sapiens
acctaggccactcctcc

SEQ ID NO: 4405591 - DNA, 23 bp, Homo sapiens
acctaggggtttctgttggataa

SEQ ID NO: 4405592 - DNA, 22 bp, Homo sapiens
acctagttaaagaaaggaaaag

SEQ ID NO: 4405593 - DNA, 14 bp, Homo sapiens
acctagttttccat

SEQ ID NO: 4405594 - DNA, 17 bp, Homo sapiens
acctatctcagccatag

SEQ ID NO: 4405595 - DNA, 12 bp, Homo sapiens
acctatgcctgt

SEQ ID NO: 4405596 - DNA, 13 bp, Homo sapiens
acctatgcctgtg

SEQ ID NO: 4405597 - DNA, 15 bp, Homo sapiens
acctatgcctgtggt

SEQ ID NO: 4405598 - DNA, 21 bp, Homo sapiens
acctatgcctgtggtgaagtg

SEQ ID NO: 4405599 - DNA, 17 bp, Homo sapiens
acctattaggtggaaat

SEQ ID NO: 4405600 - DNA, 18 bp, Homo sapiens
acctattaggtggaaatt

SEQ ID NO: 4405601 - DNA, 23 bp, Homo sapiens
acctcaaacttccagtcaggtag

SEQ ID NO: 4405602 - DNA, 18 bp, Homo sapiens
acctcaacctgtaaatta

SEQ ID NO: 4405603 - DNA, 15 bp, Homo sapiens
acctcaactaaccct

SEQ ID NO: 4405604 - DNA, 17 bp, Homo sapiens
acctcaactaaccctta

SEQ ID NO: 4405605 - DNA, 22 bp, Homo sapiens
acctcaactaacccttaaaaat

SEQ ID NO: 4405606 - DNA, 19 bp, Homo sapiens
acctcaatcagtctcagaa

SEQ ID NO: 4405607 - DNA, 15 bp, Homo sapiens
acctcaattgacatt

SEQ ID NO: 4405608 - DNA, 14 bp, Homo sapiens
acctcaatttttgt

SEQ ID NO: 4405609 - DNA, 20 bp, Homo sapiens
acctcaatttttgtttttga

SEQ ID NO: 4405610 - DNA, 17 bp, Homo sapiens
acctcacacctcactct

SEQ ID NO: 4405611 - DNA, 15 bp, Homo sapiens
acctcaccttcctgt

SEQ ID NO: 4405612 - DNA, 23 bp, Homo sapiens
acctcactgtccaatatgaaaac

SEQ ID NO: 4405613 - DNA, 19 bp, Homo sapiens
acctcagattcttcattga

SEQ ID NO: 4405614 - DNA, 15 bp, Homo sapiens
acctcagcaagctgc

SEQ ID NO: 4405615 - DNA, 12 bp, Homo sapiens
acctcaggaaag

SEQ ID NO: 4405616 - DNA, 13 bp, Homo sapiens
acctcaggctcct

SEQ ID NO: 4405617 - DNA, 22 bp, Homo sapiens
acctcaggctcctaaagagaca

SEQ ID NO: 4405618 - DNA, 16 bp, Homo sapiens
acctcagggagtgcag

SEQ ID NO: 4405619 - DNA, 18 bp, Homo sapiens
acctcaggtgccaaccca

SEQ ID NO: 4405620 - DNA, 23 bp, Homo sapiens
acctcagtgccttcctgtttttc

SEQ ID NO: 4405621 - DNA, 21 bp, Homo sapiens
acctcagtggatcttcagaac

SEQ ID NO: 4405622 - DNA, 19 bp, Homo sapiens
acctcagttcccttggcct

SEQ ID NO: 4405623 - DNA, 13 bp, Homo sapiens
acctcagttttat

SEQ ID NO: 4405624 - DNA, 14 bp, Homo sapiens
acctcatcctgctc

SEQ ID NO: 4405625 - DNA, 13 bp, Homo sapiens
acctcatgcccac

SEQ ID NO: 4405626 - DNA, 22 bp, Homo sapiens
acctcatgcccaccccctgccc

SEQ ID NO: 4405627 - DNA, 12 bp, Homo sapiens
acctccaagcat

SEQ ID NO: 4405628 - DNA, 18 bp, Homo sapiens
acctccaagcatttcatg

SEQ ID NO: 4405629 - DNA, 21 bp, Homo sapiens
acctccaataaagtgccttct

SEQ ID NO: 4405630 - DNA, 11 bp, Homo sapiens
acctccccaaa

SEQ ID NO: 4405631 - DNA, 13 bp, Homo sapiens
acctccccccact

SEQ ID NO: 4405632 - DNA, 17 bp, Homo sapiens
acctccccctgcgcccc

SEQ ID NO: 4405633 - DNA, 22 bp, Homo sapiens
acctccccctttcacactggat

SEQ ID NO: 4405634 - DNA, 15 bp, Homo sapiens
acctccccgctggga

SEQ ID NO: 4405635 - DNA, 18 bp, Homo sapiens
acctcccctatccaccca

SEQ ID NO: 4405636 - DNA, 19 bp, Homo sapiens
acctcccctatccacccag

SEQ ID NO: 4405637 - DNA, 22 bp, Homo sapiens
acctcccttaagcagcaacagc

SEQ ID NO: 4405638 - DNA, 23 bp, Homo sapiens
acctccgcccctgcccccgctcc

SEQ ID NO: 4405639 - DNA, 16 bp, Homo sapiens
acctcctaccctccca

SEQ ID NO: 4405640 - DNA, 23 bp, Homo sapiens
acctcctcccccctcctctgaaa

SEQ ID NO: 4405641 - DNA, 12 bp, Homo sapiens
acctcctctggg

SEQ ID NO: 4405642 - DNA, 14 bp, Homo sapiens
acctcctctgggcc

SEQ ID NO: 4405643 - DNA, 21 bp, Homo sapiens
acctcctctgtgatttctttc

SEQ ID NO: 4405644 - DNA, 14 bp, Homo sapiens
acctcctgcccagg

SEQ ID NO: 4405645 - DNA, 20 bp, Homo sapiens
acctcctgcccaggagagcc

SEQ ID NO: 4405646 - DNA, 16 bp, Homo sapiens
acctcctgtcagtgag

SEQ ID NO: 4405647 - DNA, 18 bp, Homo sapiens
acctccttagccctgtct

SEQ ID NO: 4405648 - DNA, 23 bp, Homo sapiens
acctcgagatgggtgctggtcct

SEQ ID NO: 4405649 - DNA, 14 bp, Homo sapiens
acctcgctggactc

SEQ ID NO: 4405650 - DNA, 19 bp, Homo sapiens
acctcggacagagcccccc

SEQ ID NO: 4405651 - DNA, 18 bp, Homo sapiens
acctcggtgaccactctt

SEQ ID NO: 4405652 - DNA, 18 bp, Homo sapiens
acctcgtcctccccctgc

SEQ ID NO: 4405653 - DNA, 21 bp, Homo sapiens
acctcgtcctccccctgccag

SEQ ID NO: 4405654 - DNA, 17 bp, Homo sapiens
acctcgtgatgggcccg

SEQ ID NO: 4405655 - DNA, 14 bp, Homo sapiens
acctctcagctgct

SEQ ID NO: 4405656 - DNA, 18 bp, Homo sapiens
acctctccacacaggtgt

SEQ ID NO: 4405657 - DNA, 14 bp, Homo sapiens
acctctcctgaccc

SEQ ID NO: 4405658 - DNA, 13 bp, Homo sapiens
acctctcctgccc

SEQ ID NO: 4405659 - DNA, 15 bp, Homo sapiens
acctctcctgccctg

SEQ ID NO: 4405660 - DNA, 14 bp, Homo sapiens
acctctctgtagtt

SEQ ID NO: 4405661 - DNA, 19 bp, Homo sapiens
acctctctgtagtttatgg

SEQ ID NO: 4405662 - DNA, 18 bp, Homo sapiens
acctctgatttattttgt

SEQ ID NO: 4405663 - DNA, 23 bp, Homo sapiens
acctctgatttattttgtatgaa

SEQ ID NO: 4405664 - DNA, 15 bp, Homo sapiens
accttgccttgaaat

SEQ ID NO: 4405665 - DNA, 16 bp, Homo sapiens
accttgctctcctcat

SEQ ID NO: 4405666 - DNA, 20 bp, Homo sapiens
accttgctctcctcatctcc

SEQ ID NO: 4405667 - DNA, 15 bp, Homo sapiens
accttgcttttgctt

SEQ ID NO: 4405668 - DNA, 18 bp, Homo sapiens
accttgcttttgcttcta

SEQ ID NO: 4405669 - DNA, 15 bp, Homo sapiens
accttgtggccgcct

SEQ ID NO: 4405670 - DNA, 20 bp, Homo sapiens
accttgtttattaaattgca

SEQ ID NO: 4405671 - DNA, 19 bp, Homo sapiens
acctttaaaaatgtataat

SEQ ID NO: 4405672 - DNA, 14 bp, Homo sapiens
acctttacagttag

SEQ ID NO: 4405673 - DNA, 13 bp, Homo sapiens
acctttacatata

SEQ ID NO: 4405674 - DNA, 22 bp, Homo sapiens
acctttaggtcaaactccctag

SEQ ID NO: 4405675 - DNA, 16 bp, Homo sapiens
acctttatctttcacc

SEQ ID NO: 4405676 - DNA, 22 bp, Homo sapiens
acctttatttattaaacttcag

SEQ ID NO: 4405677 - DNA, 23 bp, Homo sapiens
acctttatttattaaacttcagc

SEQ ID NO: 4405678 - DNA, 17 bp, Homo sapiens
acctttattttagaatt

SEQ ID NO: 4405679 - DNA, 19 bp, Homo sapiens
acctttcaccctcatgaaa

SEQ ID NO: 4405680 - DNA, 19 bp, Homo sapiens
acctttcagtgcagtttct

SEQ ID NO: 4405681 - DNA, 17 bp, Homo sapiens
acctttccctcaccccc

SEQ ID NO: 4405682 - DNA, 19 bp, Homo sapiens
acctttccctcaccccctc

SEQ ID NO: 4405683 - DNA, 14 bp, Homo sapiens
acctttgctatgta

SEQ ID NO: 4405684 - DNA, 13 bp, Homo sapiens
acctttggctggt

SEQ ID NO: 4405685 - DNA, 20 bp, Homo sapiens
accttttaccagcttttaac

SEQ ID NO: 4405686 - DNA, 11 bp, Homo sapiens
accttttcagg

SEQ ID NO: 4405687 - DNA, 13 bp, Homo sapiens
accttttcaggaa

SEQ ID NO: 4405688 - DNA, 16 bp, Homo sapiens
accttttcaggaaaat

SEQ ID NO: 4405689 - DNA, 17 bp, Homo sapiens
accttttcttgtatctg

SEQ ID NO: 4405690 - DNA, 14 bp, Homo sapiens
accttttgttttct

SEQ ID NO: 4405691 - DNA, 19 bp, Homo sapiens
accttttttttttttccaa

SEQ ID NO: 4405692 - DNA, 19 bp, Homo sapiens
acgaaaaagtgattgtgaa

SEQ ID NO: 4405693 - DNA, 20 bp, Homo sapiens
acgaaaaagtgattgtgaag

SEQ ID NO: 4405694 - DNA, 21 bp, Homo sapiens
acgaaaaagtgattgtgaagg

SEQ ID NO: 4405695 - DNA, 21 bp, Homo sapiens
acgaaatacgttaggaggaca

SEQ ID NO: 4405696 - DNA, 21 bp, Homo sapiens
acgaaggtaaaaagtattttt

SEQ ID NO: 4405697 - DNA, 14 bp, Homo sapiens
acgaatacttttgc

SEQ ID NO: 4405698 - DNA, 18 bp, Homo sapiens
acgaatcttatttttcct

SEQ ID NO: 4405699 - DNA, 15 bp, Homo sapiens
acgacaaagctgcta

SEQ ID NO: 4405700 - DNA, 12 bp, Homo sapiens
acgacagaggag

SEQ ID NO: 4405701 - DNA, 14 bp, Homo sapiens
acgactgtatattg

SEQ ID NO: 4405702 - DNA, 20 bp, Homo sapiens
acgagacaacagcacacagg

SEQ ID NO: 4405703 - DNA, 19 bp, Homo sapiens
acgagccacaagctgcact

SEQ ID NO: 4405704 - DNA, 20 bp, Homo sapiens
acgagccacaagctgcactg

SEQ ID NO: 4405705 - DNA, 22 bp, Homo sapiens
acgagccacaagctgcactgtg

SEQ ID NO: 4405706 - DNA, 18 bp, Homo sapiens
acgaggccctcgggccca

SEQ ID NO: 4405707 - DNA, 19 bp, Homo sapiens
acgagggaggaacacctga

SEQ ID NO: 4405708 - DNA, 11 bp, Homo sapiens
acgagggctgg

SEQ ID NO: 4405709 - DNA, 20 bp, Homo sapiens
acgaggtcaggagatcgaga

SEQ ID NO: 4405710 - DNA, 16 bp, Homo sapiens
acgatcaggaggaagt

SEQ ID NO: 4405711 - DNA, 19 bp, Homo sapiens
acgatgtggccctggcctg

SEQ ID NO: 4405712 - DNA, 22 bp, Homo sapiens
acgatgtggccctggcctgctg

SEQ ID NO: 4405713 - DNA, 20 bp, Homo sapiens
acgattcatttttgaaactg

SEQ ID NO: 4405714 - DNA, 22 bp, Homo sapiens
acgattcttaccctttcttttg

SEQ ID NO: 4405715 - DNA, 18 bp, Homo sapiens
acgcaccccactgggaga

SEQ ID NO: 4405716 - DNA, 16 bp, Homo sapiens
acgcaccgcctgaagg

SEQ ID NO: 4405717 - DNA, 16 bp, Homo sapiens
acgcactggacagcat

SEQ ID NO: 4405718 - DNA, 22 bp, Homo sapiens
acgcactggacagcatcagaaa

SEQ ID NO: 4405719 - DNA, 18 bp, Homo sapiens
acgcagccctagagcctg

SEQ ID NO: 4405720 - DNA, 22 bp, Homo sapiens
acgcagccctagagcctgcctg

SEQ ID NO: 4405721 - DNA, 23 bp, Homo sapiens
acgcagccctagagcctgcctgg

SEQ ID NO: 4405722 - DNA, 24 bp, Homo sapiens
acgcagccctagagcctgcctgga

SEQ ID NO: 4405723 - DNA, 20 bp, Homo sapiens
acgcagttgctcgcttttcc

SEQ ID NO: 4405724 - DNA, 19 bp, Homo sapiens
acgcagttgtgtggcccag

SEQ ID NO: 4405725 - DNA, 20 bp, Homo sapiens
acgcagttgtgtggcccagc

SEQ ID NO: 4405726 - DNA, 20 bp, Homo sapiens
acgcattttggtttttcctc

SEQ ID NO: 4405727 - DNA, 21 bp, Homo sapiens
acgccaatgttatgccagctc

SEQ ID NO: 4405728 - DNA, 23 bp, Homo sapiens
acgccaatgttatgccagctcca

SEQ ID NO: 4405729 - DNA, 16 bp, Homo sapiens
acgccattctcctgcc

SEQ ID NO: 4405730 - DNA, 17 bp, Homo sapiens
acgccattctcctgcct

SEQ ID NO: 4405731 - DNA, 18 bp, Homo sapiens
acgccattgtactccagc

SEQ ID NO: 4405732 - DNA, 22 bp, Homo sapiens
acgccattgtactccagcctgg

SEQ ID NO: 4405733 - DNA, 17 bp, Homo sapiens
acgcccaccagccttgc

SEQ ID NO: 4405734 - DNA, 22 bp, Homo sapiens
acgccccgaacctcacctgacc

SEQ ID NO: 4405735 - DNA, 21 bp, Homo sapiens
acgccccggtcccccagagca

SEQ ID NO: 4405736 - DNA, 14 bp, Homo sapiens
acgccctatttcta

SEQ ID NO: 4405737 - DNA, 16 bp, Homo sapiens
acgccctccctgctag

SEQ ID NO: 4405738 - DNA, 18 bp, Homo sapiens
acgccctttcctcctcag

SEQ ID NO: 4405739 - DNA, 21 bp, Homo sapiens
acgccctttcctcctcaggca

SEQ ID NO: 4405740 - DNA, 22 bp, Homo sapiens
acgccggggacagaggcctgcc

SEQ ID NO: 4405741 - DNA, 13 bp, Homo sapiens
acgcctcctggcc

SEQ ID NO: 4405742 - DNA, 16 bp, Homo sapiens
acgcctcttgaccagg

SEQ ID NO: 4405743 - DNA, 21 bp, Homo sapiens
acgcctgaggaacccttacag

SEQ ID NO: 4405744 - DNA, 22 bp, Homo sapiens
acgcctgcaggagagagcagca

SEQ ID NO: 4405745 - DNA, 20 bp, Homo sapiens
acgcctgtaatcccagcact

SEQ ID NO: 4405746 - DNA, 17 bp, Homo sapiens
acgctaaagagcccttg

SEQ ID NO: 4405747 - DNA, 14 bp, Homo sapiens
acgctcagccccag

SEQ ID NO: 4405748 - DNA, 23 bp, Homo sapiens
acgctcagccccaggccagctgc

SEQ ID NO: 4405749 - DNA, 11 bp, Homo sapiens
acgctccagct

SEQ ID NO: 4405750 - DNA, 14 bp, Homo sapiens
acgctccagctgcc

SEQ ID NO: 4405751 - DNA, 19 bp, Homo sapiens
acgctccagctgccccggc

SEQ ID NO: 4405752 - DNA, 17 bp, Homo sapiens
acgctccctccccctgc

SEQ ID NO: 4405753 - DNA, 23 bp, Homo sapiens
acgctgaccatgcgtcaggggcc

SEQ ID NO: 4405754 - DNA, 18 bp, Homo sapiens
acgctggcaacacagagg

SEQ ID NO: 4405755 - DNA, 11 bp, Homo sapiens
acgctttgatt

SEQ ID NO: 4405756 - DNA, 13 bp, Homo sapiens
acgctttgattca

SEQ ID NO: 4405757 - DNA, 20 bp, Homo sapiens
acgcttttaatgaaaaggaa

SEQ ID NO: 4405758 - DNA, 16 bp, Homo sapiens
acggaaaatgcttaaa

SEQ ID NO: 4405759 - DNA, 19 bp, Homo sapiens
acggaaaatgcttaaaaaa

SEQ ID NO: 4405760 - DNA, 14 bp, Homo sapiens
acggaagtggaagg

SEQ ID NO: 4405761 - DNA, 19 bp, Homo sapiens
acggagccactcctctgac

SEQ ID NO: 4405762 - DNA, 17 bp, Homo sapiens
acggagtggggggacag

SEQ ID NO: 4405763 - DNA, 23 bp, Homo sapiens
acggagtggggggacagagactc

SEQ ID NO: 4405764 - DNA, 14 bp, Homo sapiens
acggatctgctggg

SEQ ID NO: 4405765 - DNA, 19 bp, Homo sapiens
acggatgcccattcctgcc

SEQ ID NO: 4405766 - DNA, 16 bp, Homo sapiens
acggatttgtccaaat

SEQ ID NO: 4405767 - DNA, 22 bp, Homo sapiens
acggcaacgtagcctgggctca

SEQ ID NO: 4405768 - DNA, 20 bp, Homo sapiens
acggcaggagtgtcctggct

SEQ ID NO: 4405769 - DNA, 18 bp, Homo sapiens
acggcaggctcactgcca

SEQ ID NO: 4405770 - DNA, 22 bp, Homo sapiens
acggcaggctcactgccaggcc

SEQ ID NO: 4405771 - DNA, 22 bp, Homo sapiens
acggcatcacacttatatttta

SEQ ID NO: 4405772 - DNA, 10 bp, Homo sapiens
acggcccagg

SEQ ID NO: 4405773 - DNA, 18 bp, Homo sapiens
acggctcctcagagcgcc

SEQ ID NO: 4405774 - DNA, 22 bp, Homo sapiens
acggctcctcagagcgccagga

SEQ ID NO: 4405775 - DNA, 22 bp, Homo sapiens
acggctctgggggtgggaagtg

SEQ ID NO: 4405776 - DNA, 22 bp, Homo sapiens
acggctgggtgtttcagtttga

SEQ ID NO: 4405777 - DNA, 20 bp, Homo sapiens
acggcttctcacgctttgtt

SEQ ID NO: 4405778 - DNA, 16 bp, Homo sapiens
acggcttgctttcctg

SEQ ID NO: 4405779 - DNA, 20 bp, Homo sapiens
acggcttgtgggcactgtgc

SEQ ID NO: 4405780 - DNA, 23 bp, Homo sapiens
acgggaccctgcccagagctgag

SEQ ID NO: 4405781 - DNA, 17 bp, Homo sapiens
actcagatgatgccagc

SEQ ID NO: 4405782 - DNA, 15 bp, Homo sapiens
actcagcagcagaga

SEQ ID NO: 4405783 - DNA, 21 bp, Homo sapiens
actcagcagcagagagccctg

SEQ ID NO: 4405784 - DNA, 22 bp, Homo sapiens
actcagccacaaagccccccag

SEQ ID NO: 4405785 - DNA, 16 bp, Homo sapiens
actcagccactgtcac

SEQ ID NO: 4405786 - DNA, 11 bp, Homo sapiens
actcagccctg

SEQ ID NO: 4405787 - DNA, 12 bp, Homo sapiens
actcagccctgg

SEQ ID NO: 4405788 - DNA, 13 bp, Homo sapiens
actcagccctggg

SEQ ID NO: 4405789 - DNA, 14 bp, Homo sapiens
actcagccctgggc

SEQ ID NO: 4405790 - DNA, 15 bp, Homo sapiens
actcagccctgggcc

SEQ ID NO: 4405791 - DNA, 22 bp, Homo sapiens
actcagccctgggccccaccac

SEQ ID NO: 4405792 - DNA, 13 bp, Homo sapiens
actcaggaggctg

SEQ ID NO: 4405793 - DNA, 14 bp, Homo sapiens
actcaggaggctga

SEQ ID NO: 4405794 - DNA, 20 bp, Homo sapiens
actcaggaggctgaggcaga

SEQ ID NO: 4405795 - DNA, 17 bp, Homo sapiens
actcaggagtctgccac

SEQ ID NO: 4405796 - DNA, 18 bp, Homo sapiens
actcaggagtctgccact

SEQ ID NO: 4405797 - DNA, 23 bp, Homo sapiens
actcaggcgggacagtgctgcag

SEQ ID NO: 4405798 - DNA, 22 bp, Homo sapiens
actcagggaccggtgctgcagg

SEQ ID NO: 4405799 - DNA, 16 bp, Homo sapiens
actcagggctcctggg

SEQ ID NO: 4405800 - DNA, 19 bp, Homo sapiens
actcagtctctcttctctc

SEQ ID NO: 4405801 - DNA, 19 bp, Homo sapiens
actcagtgaccagtgcctg

SEQ ID NO: 4405802 - DNA, 21 bp, Homo sapiens
actcagtgagcctcctgtgcc

SEQ ID NO: 4405803 - DNA, 17 bp, Homo sapiens
actcatagattgcaaat

SEQ ID NO: 4405804 - DNA, 18 bp, Homo sapiens
actcatcacataaagaaa

SEQ ID NO: 4405805 - DNA, 13 bp, Homo sapiens
actcatcccttgt

SEQ ID NO: 4405806 - DNA, 17 bp, Homo sapiens
actcatcctgattttta

SEQ ID NO: 4405807 - DNA, 21 bp, Homo sapiens
actcatgatcaagatatatgt

SEQ ID NO: 4405808 - DNA, 18 bp, Homo sapiens
actcatgcaaactgcttt

SEQ ID NO: 4405809 - DNA, 19 bp, Homo sapiens
actcatgcaaactgcttta

SEQ ID NO: 4405810 - DNA, 20 bp, Homo sapiens
actcatgcaaactgctttat

SEQ ID NO: 4405811 - DNA, 17 bp, Homo sapiens
actcatgtgactctttc

SEQ ID NO: 4405812 - DNA, 19 bp, Homo sapiens
actcatgtgactctttcca

SEQ ID NO: 4405813 - DNA, 19 bp, Homo sapiens
actcattccagatcccagg

SEQ ID NO: 4405814 - DNA, 15 bp, Homo sapiens
actcattctgaagga

SEQ ID NO: 4405815 - DNA, 15 bp, Homo sapiens
actcattgcagcaga

SEQ ID NO: 4405816 - DNA, 22 bp, Homo sapiens
actcattgcagcagataacttt

SEQ ID NO: 4405817 - DNA, 23 bp, Homo sapiens
actcattgcagcagataactttt

SEQ ID NO: 4405818 - DNA, 14 bp, Homo sapiens
actcatttcatctc

SEQ ID NO: 4405819 - DNA, 15 bp, Homo sapiens
actcatttcatctca

SEQ ID NO: 4405820 - DNA, 17 bp, Homo sapiens
actcatttcatctcatt

SEQ ID NO: 4405821 - DNA, 19 bp, Homo sapiens
actcatttttcatgataat

SEQ ID NO: 4405822 - DNA, 22 bp, Homo sapiens
actccaaaatgttggtcatttt

SEQ ID NO: 4405823 - DNA, 18 bp, Homo sapiens
actccaaagaaatgtaag

SEQ ID NO: 4405824 - DNA, 11 bp, Homo sapiens
actccacaggg

SEQ ID NO: 4405825 - DNA, 13 bp, Homo sapiens
actccacatctgc

SEQ ID NO: 4405826 - DNA, 15 bp, Homo sapiens
actccaccaacccat

SEQ ID NO: 4405827 - DNA, 13 bp, Homo sapiens
actccaccaccca

SEQ ID NO: 4405828 - DNA, 19 bp, Homo sapiens
actccactactttactgtt

SEQ ID NO: 4405829 - DNA, 11 bp, Homo sapiens
actccagcatt

SEQ ID NO: 4405830 - DNA, 12 bp, Homo sapiens
actccagccagc

SEQ ID NO: 4405831 - DNA, 16 bp, Homo sapiens
actccagccagcgcct

SEQ ID NO: 4405832 - DNA, 23 bp, Homo sapiens
actccagccagcgcctccctcca

SEQ ID NO: 4405833 - DNA, 21 bp, Homo sapiens
actccagccagggcaagagag

SEQ ID NO: 4405834 - DNA, 11 bp, Homo sapiens
actccagcctg

SEQ ID NO: 4405835 - DNA, 16 bp, Homo sapiens
actccagcctgggcaa

SEQ ID NO: 4405836 - DNA, 14 bp, Homo sapiens
actccaggaaagag

SEQ ID NO: 4405837 - DNA, 22 bp, Homo sapiens
actccaggaaagagcagtcaga

SEQ ID NO: 4405838 - DNA, 16 bp, Homo sapiens
actccaggcccaaggc

SEQ ID NO: 4405839 - DNA, 21 bp, Homo sapiens
actccaggcccaaggctcccg

SEQ ID NO: 4405840 - DNA, 15 bp, Homo sapiens
actccatacagcctc

SEQ ID NO: 4405841 - DNA, 16 bp, Homo sapiens
actccatacagcctct

SEQ ID NO: 4405842 - DNA, 17 bp, Homo sapiens
actccatcagaaaacca

SEQ ID NO: 4405843 - DNA, 12 bp, Homo sapiens
actccattgtcg

SEQ ID NO: 4405844 - DNA, 15 bp, Homo sapiens
actcccaacttcttc

SEQ ID NO: 4405845 - DNA, 18 bp, Homo sapiens
actcccaacttcttcctg

SEQ ID NO: 4405846 - DNA, 16 bp, Homo sapiens
actcccaatacaaaga

SEQ ID NO: 4405847 - DNA, 14 bp, Homo sapiens
actcccacctgaca

SEQ ID NO: 4405848 - DNA, 22 bp, Homo sapiens
actcccagtccaaatgtcctcc

SEQ ID NO: 4405849 - DNA, 22 bp, Homo sapiens
actcccatgaagccttttgaaa

SEQ ID NO: 4405850 - DNA, 24 bp, Homo sapiens
actccccacttcactttcttcaaa

SEQ ID NO: 4405851 - DNA, 14 bp, Homo sapiens
actccccgaagtct

SEQ ID NO: 4405852 - DNA, 17 bp, Homo sapiens
actccccgaagtctttt

SEQ ID NO: 4405853 - DNA, 13 bp, Homo sapiens
actcccctctcct

SEQ ID NO: 4405854 - DNA, 23 bp, Homo sapiens
actcccctctcctccccttcctg

SEQ ID NO: 4405855 - DNA, 21 bp, Homo sapiens
actccctaatttatgtgctat

SEQ ID NO: 4405856 - DNA, 13 bp, Homo sapiens
actccctcctcac

SEQ ID NO: 4405857 - DNA, 22 bp, Homo sapiens
actccctcctcacctctggact

SEQ ID NO: 4405858 - DNA, 21 bp, Homo sapiens
actccctcgtcgagctggatg

SEQ ID NO: 4405859 - DNA, 22 bp, Homo sapiens
actcccttaaggtctccaaacc

SEQ ID NO: 4405860 - DNA, 17 bp, Homo sapiens
actcccttctacctgcc

SEQ ID NO: 4405861 - DNA, 19 bp, Homo sapiens
actcccttctacctgccac

SEQ ID NO: 4405862 - DNA, 14 bp, Homo sapiens
actccgaagaaaag

SEQ ID NO: 4405863 - DNA, 19 bp, Homo sapiens
actccgcgccgatgccacc

SEQ ID NO: 4405864 - DNA, 21 bp, Homo sapiens
actccgcgccgatgccaccgg

SEQ ID NO: 4405865 - DNA, 20 bp, Homo sapiens
actccggaggactgagcccc

SEQ ID NO: 4405866 - DNA, 21 bp, Homo sapiens
actccggaggactgagccccc

SEQ ID NO: 4405867 - DNA, 15 bp, Homo sapiens
actccggcctgggtg

SEQ ID NO: 4405868 - DNA, 16 bp, Homo sapiens
actccggctgtgctgg

SEQ ID NO: 4405869 - DNA, 17 bp, Homo sapiens
actccggctgtgctggg

SEQ ID NO: 4405870 - DNA, 19 bp, Homo sapiens
actccgtaacagattttgt

SEQ ID NO: 4405871 - DNA, 13 bp, Homo sapiens
actcctagaagaa

SEQ ID NO: 4405872 - DNA, 17 bp, Homo sapiens
actcctataaggagagt

SEQ ID NO: 4405873 - DNA, 11 bp, Homo sapiens
actcctcccat

SEQ ID NO: 4405874 - DNA, 15 bp, Homo sapiens
actcctccgtgagca

SEQ ID NO: 4405875 - DNA, 20 bp, Homo sapiens
actcctccgtgagcaccacc

SEQ ID NO: 4405876 - DNA, 23 bp, Homo sapiens
actcctccgtgagcaccaccagg

SEQ ID NO: 4405877 - DNA, 22 bp, Homo sapiens
actcctcctccaaaggccccct

SEQ ID NO: 4405878 - DNA, 17 bp, Homo sapiens
actcctctatcatgcaa

SEQ ID NO: 4405879 - DNA, 14 bp, Homo sapiens
actcctctgactca

SEQ ID NO: 4405880 - DNA, 12 bp, Homo sapiens
actcctctgcag

SEQ ID NO: 4405881 - DNA, 17 bp, Homo sapiens
actcctctgcagtgcct

SEQ ID NO: 4405882 - DNA, 19 bp, Homo sapiens
actcctctggctttcccag

SEQ ID NO: 4405883 - DNA, 21 bp, Homo sapiens
actcctctggctttcccagga

SEQ ID NO: 4405884 - DNA, 19 bp, Homo sapiens
actcctgaaacctcttcct

SEQ ID NO: 4405885 - DNA, 21 bp, Homo sapiens
actcctgagacccctggcctc

SEQ ID NO: 4405886 - DNA, 21 bp, Homo sapiens
actcctgccattcttctggtg

SEQ ID NO: 4405887 - DNA, 14 bp, Homo sapiens
actcctgcctcatg

SEQ ID NO: 4405888 - DNA, 16 bp, Homo sapiens
actcctggaagctgtg

SEQ ID NO: 4405889 - DNA, 19 bp, Homo sapiens
actcctggactccggagga

SEQ ID NO: 4405890 - DNA, 21 bp, Homo sapiens
actcctggactccggaggact

SEQ ID NO: 4405891 - DNA, 23 bp, Homo sapiens
actcctggactccggaggactga

SEQ ID NO: 4405892 - DNA, 23 bp, Homo sapiens
actcctgggcacccttaatcttc

SEQ ID NO: 4405893 - DNA, 15 bp, Homo sapiens
actcctgggctcaag

SEQ ID NO: 4405894 - DNA, 13 bp, Homo sapiens
actcctggtctgt

SEQ ID NO: 4405895 - DNA, 22 bp, Homo sapiens
actcctgtgctctggaggctgc

SEQ ID NO: 4405896 - DNA, 19 bp, Homo sapiens
actccttccatctcttcct

SEQ ID NO: 4405897 - DNA, 22 bp, Homo sapiens
actccttccttcaggactctgc

SEQ ID NO: 4405898 - DNA, 16 bp, Homo sapiens
actcctttatctgtaa

SEQ ID NO: 4405899 - DNA, 22 bp, Homo sapiens
actgctccagcctctgccgctg

SEQ ID NO: 4405900 - DNA, 16 bp, Homo sapiens
actgctcgccttattc

SEQ ID NO: 4405901 - DNA, 22 bp, Homo sapiens
actgctcgtggactgtgctggt

SEQ ID NO: 4405902 - DNA, 18 bp, Homo sapiens
actgctctaacagccctc

SEQ ID NO: 4405903 - DNA, 17 bp, Homo sapiens
actgctgattcttgtaa

SEQ ID NO: 4405904 - DNA, 19 bp, Homo sapiens
actgctgattcttgtaaat

SEQ ID NO: 4405905 - DNA, 19 bp, Homo sapiens
actgctgcagattagttct

SEQ ID NO: 4405906 - DNA, 15 bp, Homo sapiens
actgctgctctccca

SEQ ID NO: 4405907 - DNA, 19 bp, Homo sapiens
actgctgctctcccaaggg

SEQ ID NO: 4405908 - DNA, 23 bp, Homo sapiens
actgctgctgctgctgccgccgc

SEQ ID NO: 4405909 - DNA, 13 bp, Homo sapiens
actgctgctggga

SEQ ID NO: 4405910 - DNA, 20 bp, Homo sapiens
actgctgggggtgagctgta

SEQ ID NO: 4405911 - DNA, 19 bp, Homo sapiens
actgctggttgacatcaga

SEQ ID NO: 4405912 - DNA, 15 bp, Homo sapiens
actgcttctctttgt

SEQ ID NO: 4405913 - DNA, 17 bp, Homo sapiens
actgcttctctttgtgc

SEQ ID NO: 4405914 - DNA, 21 bp, Homo sapiens
actgcttctctttgtgcagtg

SEQ ID NO: 4405915 - DNA, 18 bp, Homo sapiens
actgcttcttatggtggt

SEQ ID NO: 4405916 - DNA, 14 bp, Homo sapiens
actgcttgaggaaa

SEQ ID NO: 4405917 - DNA, 14 bp, Homo sapiens
actgctttctgttc

SEQ ID NO: 4405918 - DNA, 18 bp, Homo sapiens
actgctttctgttccaaa

SEQ ID NO: 4405919 - DNA, 19 bp, Homo sapiens
actgctttctgttccaaat

SEQ ID NO: 4405920 - DNA, 21 bp, Homo sapiens
actgcttttaaaagtgcacat

SEQ ID NO: 4405921 - DNA, 21 bp, Homo sapiens
actggaaacaaaacagaaggg

SEQ ID NO: 4405922 - DNA, 17 bp, Homo sapiens
actggaaaggggagagc

SEQ ID NO: 4405923 - DNA, 12 bp, Homo sapiens
actggaactctc

SEQ ID NO: 4405924 - DNA, 19 bp, Homo sapiens
actggaagcatgtaggaga

SEQ ID NO: 4405925 - DNA, 20 bp, Homo sapiens
actggacacaataggtcttt

SEQ ID NO: 4405926 - DNA, 17 bp, Homo sapiens
actggacagcatcagaa

SEQ ID NO: 4405927 - DNA, 12 bp, Homo sapiens
actggaggaggc

SEQ ID NO: 4405928 - DNA, 16 bp, Homo sapiens
actggaggaggcctgt

SEQ ID NO: 4405929 - DNA, 21 bp, Homo sapiens
actggaggaggcctgtcccaa

SEQ ID NO: 4405930 - DNA, 15 bp, Homo sapiens
actggagttccttat

SEQ ID NO: 4405931 - DNA, 14 bp, Homo sapiens
actggatcctgctg

SEQ ID NO: 4405932 - DNA, 16 bp, Homo sapiens
actggatcctgctgct

SEQ ID NO: 4405933 - DNA, 16 bp, Homo sapiens
actggatggtccagtg

SEQ ID NO: 4405934 - DNA, 14 bp, Homo sapiens
actggattcttatt

SEQ ID NO: 4405935 - DNA, 16 bp, Homo sapiens
actggcacacacccct

SEQ ID NO: 4405936 - DNA, 13 bp, Homo sapiens
actggcacagttt

SEQ ID NO: 4405937 - DNA, 22 bp, Homo sapiens
actggcagagaggtaaagggtg

SEQ ID NO: 4405938 - DNA, 14 bp, Homo sapiens
actggcatgtcatt

SEQ ID NO: 4405939 - DNA, 17 bp, Homo sapiens
actggcccctgggtcag

SEQ ID NO: 4405940 - DNA, 14 bp, Homo sapiens
actggccgctgagc

SEQ ID NO: 4405941 - DNA, 19 bp, Homo sapiens
actggccttctgatgaaat

SEQ ID NO: 4405942 - DNA, 23 bp, Homo sapiens
actggccttctgatgaaatgtta

SEQ ID NO: 4405943 - DNA, 21 bp, Homo sapiens
actggcgttcacctccctgct

SEQ ID NO: 4405944 - DNA, 13 bp, Homo sapiens
actggcttcagca

SEQ ID NO: 4405945 - DNA, 18 bp, Homo sapiens
actggcttttattaatgc

SEQ ID NO: 4405946 - DNA, 17 bp, Homo sapiens
actggcttttgcctgta

SEQ ID NO: 4405947 - DNA, 18 bp, Homo sapiens
actggcttttgcctgtaa

SEQ ID NO: 4405948 - DNA, 13 bp, Homo sapiens
actgggataactg

SEQ ID NO: 4405949 - DNA, 16 bp, Homo sapiens
actgggataactgatt

SEQ ID NO: 4405950 - DNA, 19 bp, Homo sapiens
actgggataactgatttct

SEQ ID NO: 4405951 - DNA, 13 bp, Homo sapiens
actgggctgaggg

SEQ ID NO: 4405952 - DNA, 14 bp, Homo sapiens
actgggctgaggga

SEQ ID NO: 4405953 - DNA, 17 bp, Homo sapiens
actgggctgagggagcc

SEQ ID NO: 4405954 - DNA, 23 bp, Homo sapiens
actgggctggcgcttggatctgg

SEQ ID NO: 4405955 - DNA, 23 bp, Homo sapiens
actgggctgggcctcgtgcgccc

SEQ ID NO: 4405956 - DNA, 23 bp, Homo sapiens
actggggactttatttatttcta

SEQ ID NO: 4405957 - DNA, 19 bp, Homo sapiens
actggggaggaatcctgga

SEQ ID NO: 4405958 - DNA, 15 bp, Homo sapiens
actggggagtctttg

SEQ ID NO: 4405959 - DNA, 16 bp, Homo sapiens
actggggcagacaata

SEQ ID NO: 4405960 - DNA, 14 bp, Homo sapiens
actggggcaggggc

SEQ ID NO: 4405961 - DNA, 19 bp, Homo sapiens
actggggtgccgcctgccc

SEQ ID NO: 4405962 - DNA, 22 bp, Homo sapiens
actgggtcttcagctttatccc

SEQ ID NO: 4405963 - DNA, 22 bp, Homo sapiens
actgggtggtggcctggtccct

SEQ ID NO: 4405964 - DNA, 20 bp, Homo sapiens
actgggtgtcatttcattcc

SEQ ID NO: 4405965 - DNA, 22 bp, Homo sapiens
actgggtgtcatttcattccat

SEQ ID NO: 4405966 - DNA, 23 bp, Homo sapiens
actgggtttggcaaaactcaggc

SEQ ID NO: 4405967 - DNA, 18 bp, Homo sapiens
actggtaagattgttatt

SEQ ID NO: 4405968 - DNA, 17 bp, Homo sapiens
actggtacttagagttt

SEQ ID NO: 4405969 - DNA, 15 bp, Homo sapiens
actggtgaatataaa

SEQ ID NO: 4405970 - DNA, 21 bp, Homo sapiens
actggtgagacaatgaaacaa

SEQ ID NO: 4405971 - DNA, 17 bp, Homo sapiens
actggtggtttttgctc

SEQ ID NO: 4405972 - DNA, 14 bp, Homo sapiens
actggttcacctga

SEQ ID NO: 4405973 - DNA, 18 bp, Homo sapiens
actggtttcaagaatatg

SEQ ID NO: 4405974 - DNA, 14 bp, Homo sapiens
actggtttgtttct

SEQ ID NO: 4405975 - DNA, 19 bp, Homo sapiens
actggttttacacagagaa

SEQ ID NO: 4405976 - DNA, 14 bp, Homo sapiens
actggttttctgcc

SEQ ID NO: 4405977 - DNA, 15 bp, Homo sapiens
actggttttctgcca

SEQ ID NO: 4405978 - DNA, 15 bp, Homo sapiens
actgtaaaaataaca

SEQ ID NO: 4405979 - DNA, 20 bp, Homo sapiens
actgtaaaagtgtacagact

SEQ ID NO: 4405980 - DNA, 21 bp, Homo sapiens
actgtaaacttggaatcaagg

SEQ ID NO: 4405981 - DNA, 21 bp, Homo sapiens
actgtaaagacaaataaatga

SEQ ID NO: 4405982 - DNA, 13 bp, Homo sapiens
actgtaaatatcc

SEQ ID NO: 4405983 - DNA, 14 bp, Homo sapiens
actgtaaatatccc

SEQ ID NO: 4405984 - DNA, 15 bp, Homo sapiens
actgtaaatatccct

SEQ ID NO: 4405985 - DNA, 19 bp, Homo sapiens
actgtaagaataatttata

SEQ ID NO: 4405986 - DNA, 12 bp, Homo sapiens
actgtacacatt

SEQ ID NO: 4405987 - DNA, 15 bp, Homo sapiens
actgtacacatttct

SEQ ID NO: 4405988 - DNA, 23 bp, Homo sapiens
actgtacacatttcttaaaacac

SEQ ID NO: 4405989 - DNA, 20 bp, Homo sapiens
actgtactatcctgtaaata

SEQ ID NO: 4405990 - DNA, 15 bp, Homo sapiens
actgtagaaatgatg

SEQ ID NO: 4405991 - DNA, 22 bp, Homo sapiens
actgtagaagaagcccatatca

SEQ ID NO: 4405992 - DNA, 19 bp, Homo sapiens
actgtataaggagattctg

SEQ ID NO: 4405993 - DNA, 16 bp, Homo sapiens
actgtatataaacata

SEQ ID NO: 4405994 - DNA, 14 bp, Homo sapiens
actgtatattgcta

SEQ ID NO: 4405995 - DNA, 14 bp, Homo sapiens
actgtatatttgta

SEQ ID NO: 4405996 - DNA, 17 bp, Homo sapiens
actgtatatttgtatga

SEQ ID NO: 4405997 - DNA, 16 bp, Homo sapiens
actgtatcaataaaat

SEQ ID NO: 4405998 - DNA, 17 bp, Homo sapiens
actgtatcaataaaatt

SEQ ID NO: 4405999 - DNA, 18 bp, Homo sapiens
actgtatcaataaaattc

SEQ ID NO: 4406000 - DNA, 23 bp, Homo sapiens
actgtatcaataaaattctgtaa

SEQ ID NO: 4406001 - DNA, 18 bp, Homo sapiens
actgtatcatctttgcca

SEQ ID NO: 4406002 - DNA, 17 bp, Homo sapiens
actgtatctaggcattt

SEQ ID NO: 4406003 - DNA, 15 bp, Homo sapiens
actgtatctattctt

SEQ ID NO: 4406004 - DNA, 19 bp, Homo sapiens
actgtatgtttttactgaa

SEQ ID NO: 4406005 - DNA, 15 bp, Homo sapiens
actgtatttcagtat

SEQ ID NO: 4406006 - DNA, 22 bp, Homo sapiens
actgtattttgaaccaaaacat

SEQ ID NO: 4406007 - DNA, 21 bp, Homo sapiens
actgtattttgtattgtttca

SEQ ID NO: 4406008 - DNA, 22 bp, Homo sapiens
actgtcacggggttccctccta

SEQ ID NO: 4406009 - DNA, 22 bp, Homo sapiens
actgtcagattaaattacagct

SEQ ID NO: 4406010 - DNA, 23 bp, Homo sapiens
actgtcagctcccctcggagaag

SEQ ID NO: 4406011 - DNA, 14 bp, Homo sapiens
actgtcagtggggc

SEQ ID NO: 4406012 - DNA, 23 bp, Homo sapiens
actgtcagtggggcagcctctcc

SEQ ID NO: 4406013 - DNA, 22 bp, Homo sapiens
actgtccagggaaacagcctct

SEQ ID NO: 4406014 - DNA, 17 bp, Homo sapiens
actgtcctgttgattaa

SEQ ID NO: 4406015 - DNA, 21 bp, Homo sapiens
actgtcttacgtttttctggt

SEQ ID NO: 4406016 - DNA, 15 bp, Homo sapiens
acttgtctcatttta

SEQ ID NO: 4406017 - DNA, 16 bp, Homo sapiens
acttgtctcattttaa

SEQ ID NO: 4406018 - DNA, 19 bp, Homo sapiens
acttgtctcattttaatgt

SEQ ID NO: 4406019 - DNA, 14 bp, Homo sapiens
acttgtctggcttt

SEQ ID NO: 4406020 - DNA, 16 bp, Homo sapiens
acttgtctggctttgg

SEQ ID NO: 4406021 - DNA, 20 bp, Homo sapiens
acttgtctggctttggcact

SEQ ID NO: 4406022 - DNA, 15 bp, Homo sapiens
acttgtgagcatcag

SEQ ID NO: 4406023 - DNA, 15 bp, Homo sapiens
acttgtggcctcaag

SEQ ID NO: 4406024 - DNA, 17 bp, Homo sapiens
acttgtggggctaaggc

SEQ ID NO: 4406025 - DNA, 18 bp, Homo sapiens
acttgttaacctttctaa

SEQ ID NO: 4406026 - DNA, 20 bp, Homo sapiens
acttgttaacctttctaacc

SEQ ID NO: 4406027 - DNA, 12 bp, Homo sapiens
acttgtttgaat

SEQ ID NO: 4406028 - DNA, 12 bp, Homo sapiens
actttaaagcgt

SEQ ID NO: 4406029 - DNA, 13 bp, Homo sapiens
actttaaatggaa

SEQ ID NO: 4406030 - DNA, 14 bp, Homo sapiens
actttaaattatat

SEQ ID NO: 4406031 - DNA, 16 bp, Homo sapiens
actttaaattatatga

SEQ ID NO: 4406032 - DNA, 18 bp, Homo sapiens
actttaaattatatgata

SEQ ID NO: 4406033 - DNA, 13 bp, Homo sapiens
actttaatacagc

SEQ ID NO: 4406034 - DNA, 13 bp, Homo sapiens
actttaattatat

SEQ ID NO: 4406035 - DNA, 21 bp, Homo sapiens
actttaattatatattttcat

SEQ ID NO: 4406036 - DNA, 19 bp, Homo sapiens
actttacaaacctttgttt

SEQ ID NO: 4406037 - DNA, 23 bp, Homo sapiens
actttacaaacctttgtttcaac

SEQ ID NO: 4406038 - DNA, 17 bp, Homo sapiens
actttaccaaatgaaat

SEQ ID NO: 4406039 - DNA, 14 bp, Homo sapiens
actttactttcaag

SEQ ID NO: 4406040 - DNA, 16 bp, Homo sapiens
actttactttcaagta

SEQ ID NO: 4406041 - DNA, 13 bp, Homo sapiens
actttacttttgc

SEQ ID NO: 4406042 - DNA, 14 bp, Homo sapiens
actttacttttgct

SEQ ID NO: 4406043 - DNA, 21 bp, Homo sapiens
actttacttttgctgtttata

SEQ ID NO: 4406044 - DNA, 22 bp, Homo sapiens
actttactttttccatttggca

SEQ ID NO: 4406045 - DNA, 17 bp, Homo sapiens
actttagaaagctgaca

SEQ ID NO: 4406046 - DNA, 15 bp, Homo sapiens
actttagaagcctgc

SEQ ID NO: 4406047 - DNA, 19 bp, Homo sapiens
actttagggggtgggattc

SEQ ID NO: 4406048 - DNA, 19 bp, Homo sapiens
actttagtacaatttcaac

SEQ ID NO: 4406049 - DNA, 13 bp, Homo sapiens
actttataaattt

SEQ ID NO: 4406050 - DNA, 18 bp, Homo sapiens
actttataactaacatgt

SEQ ID NO: 4406051 - DNA, 12 bp, Homo sapiens
actttatatctg

SEQ ID NO: 4406052 - DNA, 13 bp, Homo sapiens
actttatatctgt

SEQ ID NO: 4406053 - DNA, 14 bp, Homo sapiens
actttatatcttgt

SEQ ID NO: 4406054 - DNA, 17 bp, Homo sapiens
actttatatcttgttta

SEQ ID NO: 4406055 - DNA, 19 bp, Homo sapiens
actttatcaatgtgtcttt

SEQ ID NO: 4406056 - DNA, 15 bp, Homo sapiens
actttattataaaat

SEQ ID NO: 4406057 - DNA, 16 bp, Homo sapiens
actttattataaaatg

SEQ ID NO: 4406058 - DNA, 21 bp, Homo sapiens
actttattgccttttaatttt

SEQ ID NO: 4406059 - DNA, 21 bp, Homo sapiens
actttattttatataataaag

SEQ ID NO: 4406060 - DNA, 20 bp, Homo sapiens
actttatttttctatgtgtt

SEQ ID NO: 4406061 - DNA, 23 bp, Homo sapiens
actttcaatattttaactttttg

SEQ ID NO: 4406062 - DNA, 20 bp, Homo sapiens
actttcactataatgtgaaa

SEQ ID NO: 4406063 - DNA, 24 bp, Homo sapiens
actttcaggctactgttcttgaca

SEQ ID NO: 4406064 - DNA, 21 bp, Homo sapiens
actttcatcctgactctgccc

SEQ ID NO: 4406065 - DNA, 23 bp, Homo sapiens
actttcatcctgactctgccccc

SEQ ID NO: 4406066 - DNA, 15 bp, Homo sapiens
actttcattccttca

SEQ ID NO: 4406067 - DNA, 20 bp, Homo sapiens
actttcattccttcagattt

SEQ ID NO: 4406068 - DNA, 17 bp, Homo sapiens
actttcattgccagtgt

SEQ ID NO: 4406069 - DNA, 20 bp, Homo sapiens
actttcattgccagtgtctt

SEQ ID NO: 4406070 - DNA, 21 bp, Homo sapiens
actttcatttttttccaggct

SEQ ID NO: 4406071 - DNA, 18 bp, Homo sapiens
actttccaatgccacaga

SEQ ID NO: 4406072 - DNA, 19 bp, Homo sapiens
actttcctcctgaggcttt

SEQ ID NO: 4406073 - DNA, 15 bp, Homo sapiens
actttctatgtgaca

SEQ ID NO: 4406074 - DNA, 16 bp, Homo sapiens
actttctatgtgacat

SEQ ID NO: 4406075 - DNA, 22 bp, Homo sapiens
actttctatgtgacatttctct

SEQ ID NO: 4406076 - DNA, 15 bp, Homo sapiens
actttctctgtgaaa

SEQ ID NO: 4406077 - DNA, 12 bp, Homo sapiens
actttcttcaaa

SEQ ID NO: 4406078 - DNA, 16 bp, Homo sapiens
actttctttttctaca

SEQ ID NO: 4406079 - DNA, 17 bp, Homo sapiens
actttctttttctacat

SEQ ID NO: 4406080 - DNA, 20 bp, Homo sapiens
actttctttttctacatgtg

SEQ ID NO: 4406081 - DNA, 12 bp, Homo sapiens
actttgaaggac

SEQ ID NO: 4406082 - DNA, 14 bp, Homo sapiens
actttgaagttagc

SEQ ID NO: 4406083 - DNA, 17 bp, Homo sapiens
actttgaagttagcttt

SEQ ID NO: 4406084 - DNA, 14 bp, Homo sapiens
actttgaataaaga

SEQ ID NO: 4406085 - DNA, 22 bp, Homo sapiens
actttgacctaaattatttact

SEQ ID NO: 4406086 - DNA, 20 bp, Homo sapiens
actttgactttttgcattta

SEQ ID NO: 4406087 - DNA, 17 bp, Homo sapiens
actttgagttaagtcta

SEQ ID NO: 4406088 - DNA, 14 bp, Homo sapiens
actttgatgtcatg

SEQ ID NO: 4406089 - DNA, 16 bp, Homo sapiens
actttgcattgtctgt

SEQ ID NO: 4406090 - DNA, 15 bp, Homo sapiens
actttgcctcctgtg

SEQ ID NO: 4406091 - DNA, 17 bp, Homo sapiens
actttgctaaagacatg

SEQ ID NO: 4406092 - DNA, 13 bp, Homo sapiens
actttgctcctca

SEQ ID NO: 4406093 - DNA, 15 bp, Homo sapiens
actttgctcctcaca

SEQ ID NO: 4406094 - DNA, 18 bp, Homo sapiens
actttggcaatttcctgg

SEQ ID NO: 4406095 - DNA, 22 bp, Homo sapiens
actttggccattacccccagct

SEQ ID NO: 4406096 - DNA, 12 bp, Homo sapiens
actttgggaggc

SEQ ID NO: 4406097 - DNA, 16 bp, Homo sapiens
actttgggaggcaggg

SEQ ID NO: 4406098 - DNA, 17 bp, Homo sapiens
actttggggctaattta

SEQ ID NO: 4406099 - DNA, 23 bp, Homo sapiens
actttggtagctgggaaagcata

SEQ ID NO: 4406100 - DNA, 12 bp, Homo sapiens
actttgtaaata

SEQ ID NO: 4406101 - DNA, 13 bp, Homo sapiens
actttgtaaatag

SEQ ID NO: 4406102 - DNA, 23 bp, Homo sapiens
actttgtaaataggatttttaga

SEQ ID NO: 4406103 - DNA, 17 bp, Homo sapiens
actttgtaaccagaatt

SEQ ID NO: 4406104 - DNA, 22 bp, Homo sapiens
actttgtaaccagaattataca

SEQ ID NO: 4406105 - DNA, 17 bp, Homo sapiens
actttgtaatttttgct

SEQ ID NO: 4406106 - DNA, 16 bp, Homo sapiens
actttgtatacaagta

SEQ ID NO: 4406107 - DNA, 20 bp, Homo sapiens
actttgtcgcccaggctgga

SEQ ID NO: 4406108 - DNA, 17 bp, Homo sapiens
actttgtggaccaatta

SEQ ID NO: 4406109 - DNA, 15 bp, Homo sapiens
actttgtttagaaaa

SEQ ID NO: 4406110 - DNA, 16 bp, Homo sapiens
actttgttttcaagat

SEQ ID NO: 4406111 - DNA, 22 bp, Homo sapiens
acttttaaataaattatgaata

SEQ ID NO: 4406112 - DNA, 18 bp, Homo sapiens
acttttaactatgtaata

SEQ ID NO: 4406113 - DNA, 16 bp, Homo sapiens
acttttatgaagtttt

SEQ ID NO: 4406114 - DNA, 22 bp, Homo sapiens
acttttatgcagcaaatatatg

SEQ ID NO: 4406115 - DNA, 17 bp, Homo sapiens
acttttatgtgagattt

SEQ ID NO: 4406116 - DNA, 22 bp, Homo sapiens
acttttatgtgagatttcctta

SEQ ID NO: 4406117 - DNA, 16 bp, Homo sapiens
acttttattttcattg

SEQ ID NO: 4406118 - DNA, 19 bp, Homo sapiens
acttttcaatgtctaaaaa

SEQ ID NO: 4406119 - DNA, 17 bp, Homo sapiens
acttttcaatgtgattc

SEQ ID NO: 4406120 - DNA, 18 bp, Homo sapiens
acttttcatatcatttct

SEQ ID NO: 4406121 - DNA, 13 bp, Homo sapiens
acttttcctctta

SEQ ID NO: 4406122 - DNA, 12 bp, Homo sapiens
acttttctaaaa

SEQ ID NO: 4406123 - DNA, 18 bp, Homo sapiens
acttttctctttaatttt

SEQ ID NO: 4406124 - DNA, 23 bp, Homo sapiens
acttttctctttaattttaactg

SEQ ID NO: 4406125 - DNA, 20 bp, Homo sapiens
acttttctgtaattcaggtt

SEQ ID NO: 4406126 - DNA, 13 bp, Homo sapiens
acttttctgttta

SEQ ID NO: 4406127 - DNA, 24 bp, Homo sapiens
acttttcttaaaccttcagttatg

SEQ ID NO: 4406128 - DNA, 16 bp, Homo sapiens
acttttctttcttttc

SEQ ID NO: 4406129 - DNA, 19 bp, Homo sapiens
acttttgaaagatgtatgg

SEQ ID NO: 4406130 - DNA, 19 bp, Homo sapiens
acttttgatgaaataaaat

SEQ ID NO: 4406131 - DNA, 16 bp, Homo sapiens
acttttgtactgaatt

SEQ ID NO: 4406132 - DNA, 17 bp, Homo sapiens
acttttgtactgaattt

SEQ ID NO: 4406133 - DNA, 17 bp, Homo sapiens
acttttgttaaattcag

SEQ ID NO: 4406134 - DNA, 21 bp, Homo sapiens
agaaatgctggtttttcagtt

SEQ ID NO: 4406135 - DNA, 16 bp, Homo sapiens
agaaatggaaattttg

SEQ ID NO: 4406136 - DNA, 17 bp, Homo sapiens
agaaatggctatgaaca

SEQ ID NO: 4406137 - DNA, 19 bp, Homo sapiens
agaaatggctatgaacaga

SEQ ID NO: 4406138 - DNA, 18 bp, Homo sapiens
agaaatgttggcatttag

SEQ ID NO: 4406139 - DNA, 15 bp, Homo sapiens
agaaattaaatctgt

SEQ ID NO: 4406140 - DNA, 18 bp, Homo sapiens
agaaattcgtgtgttttt

SEQ ID NO: 4406141 - DNA, 12 bp, Homo sapiens
agaaattcttgt

SEQ ID NO: 4406142 - DNA, 20 bp, Homo sapiens
agaaatttaaactataagca

SEQ ID NO: 4406143 - DNA, 11 bp, Homo sapiens
agaaattttca

SEQ ID NO: 4406144 - DNA, 13 bp, Homo sapiens
agaaattttcaag

SEQ ID NO: 4406145 - DNA, 13 bp, Homo sapiens
agaaattttgtaa

SEQ ID NO: 4406146 - DNA, 16 bp, Homo sapiens
agaaattttgtaagaa

SEQ ID NO: 4406147 - DNA, 20 bp, Homo sapiens
agaacaaaggggcttaatta

SEQ ID NO: 4406148 - DNA, 12 bp, Homo sapiens
agaacaaatatt

SEQ ID NO: 4406149 - DNA, 24 bp, Homo sapiens
agaacaaatattcagaatattcat

SEQ ID NO: 4406150 - DNA, 16 bp, Homo sapiens
agaacaacaaagacat

SEQ ID NO: 4406151 - DNA, 14 bp, Homo sapiens
agaacactaacctg

SEQ ID NO: 4406152 - DNA, 21 bp, Homo sapiens
agaacactattttcagaatct

SEQ ID NO: 4406153 - DNA, 23 bp, Homo sapiens
agaacactattttcagaatctga

SEQ ID NO: 4406154 - DNA, 18 bp, Homo sapiens
agaacagccctcggcctc

SEQ ID NO: 4406155 - DNA, 23 bp, Homo sapiens
agaacaggttcttaaaaaggaac

SEQ ID NO: 4406156 - DNA, 12 bp, Homo sapiens
agaacaggtttt

SEQ ID NO: 4406157 - DNA, 17 bp, Homo sapiens
agaacaggtttttttgt

SEQ ID NO: 4406158 - DNA, 14 bp, Homo sapiens
agaacagtatgaat

SEQ ID NO: 4406159 - DNA, 17 bp, Homo sapiens
agaacagtatgaatttg

SEQ ID NO: 4406160 - DNA, 22 bp, Homo sapiens
agaacagtattgggcaggagga

SEQ ID NO: 4406161 - DNA, 22 bp, Homo sapiens
agaacagtgattaccagggact

SEQ ID NO: 4406162 - DNA, 22 bp, Homo sapiens
agaacagtggaaactatgtgtt

SEQ ID NO: 4406163 - DNA, 12 bp, Homo sapiens
agaacagtgggc

SEQ ID NO: 4406164 - DNA, 17 bp, Homo sapiens
agaacatacatgataca

SEQ ID NO: 4406165 - DNA, 14 bp, Homo sapiens
agaacatactgttc

SEQ ID NO: 4406166 - DNA, 17 bp, Homo sapiens
agaacatactgttctca

SEQ ID NO: 4406167 - DNA, 13 bp, Homo sapiens
agaacatgcagtt

SEQ ID NO: 4406168 - DNA, 16 bp, Homo sapiens
agaacatgcagtttga

SEQ ID NO: 4406169 - DNA, 20 bp, Homo sapiens
agaacatgcagtttgaaatt

SEQ ID NO: 4406170 - DNA, 13 bp, Homo sapiens
agaacatgtgaga

SEQ ID NO: 4406171 - DNA, 22 bp, Homo sapiens
agaacattcacttttgttaaca

SEQ ID NO: 4406172 - DNA, 22 bp, Homo sapiens
agaacattcgaatctctgcccc

SEQ ID NO: 4406173 - DNA, 15 bp, Homo sapiens
agaacattctctcat

SEQ ID NO: 4406174 - DNA, 16 bp, Homo sapiens
agaacattgatctgtt

SEQ ID NO: 4406175 - DNA, 22 bp, Homo sapiens
agaaccaaagcaaccacaaatg

SEQ ID NO: 4406176 - DNA, 17 bp, Homo sapiens
agaaccaaatacctcaa

SEQ ID NO: 4406177 - DNA, 13 bp, Homo sapiens
agaaccacagcag

SEQ ID NO: 4406178 - DNA, 15 bp, Homo sapiens
agaaccacagcagac

SEQ ID NO: 4406179 - DNA, 18 bp, Homo sapiens
agaaccacagcagacacc

SEQ ID NO: 4406180 - DNA, 19 bp, Homo sapiens
agaaccacagcagacacca

SEQ ID NO: 4406181 - DNA, 14 bp, Homo sapiens
agaacccacagtag

SEQ ID NO: 4406182 - DNA, 23 bp, Homo sapiens
agaaccctgccatggaactgttt

SEQ ID NO: 4406183 - DNA, 20 bp, Homo sapiens
agaacctaatagcaccaata

SEQ ID NO: 4406184 - DNA, 16 bp, Homo sapiens
agaacctagaagggct

SEQ ID NO: 4406185 - DNA, 21 bp, Homo sapiens
agaacctgagctattttcctc

SEQ ID NO: 4406186 - DNA, 12 bp, Homo sapiens
agaacctggagg

SEQ ID NO: 4406187 - DNA, 20 bp, Homo sapiens
agaaccttaatgacaacact

SEQ ID NO: 4406188 - DNA, 13 bp, Homo sapiens
agaacgcacccca

SEQ ID NO: 4406189 - DNA, 14 bp, Homo sapiens
agaacggcttgctt

SEQ ID NO: 4406190 - DNA, 17 bp, Homo sapiens
agaacggggctcttctc

SEQ ID NO: 4406191 - DNA, 21 bp, Homo sapiens
agaacggggctcttctcattt

SEQ ID NO: 4406192 - DNA, 16 bp, Homo sapiens
agaacgtgcatccttg

SEQ ID NO: 4406193 - DNA, 16 bp, Homo sapiens
agaacgttttttcctc

SEQ ID NO: 4406194 - DNA, 17 bp, Homo sapiens
agaactaaaatgttcta

SEQ ID NO: 4406195 - DNA, 19 bp, Homo sapiens
agaactaaactagtttttc

SEQ ID NO: 4406196 - DNA, 21 bp, Homo sapiens
agaactaaatttttcatagaa

SEQ ID NO: 4406197 - DNA, 22 bp, Homo sapiens
agaactacaaacaaaatttcta

SEQ ID NO: 4406198 - DNA, 14 bp, Homo sapiens
agaactatcatttt

SEQ ID NO: 4406199 - DNA, 15 bp, Homo sapiens
agaactatcattttt

SEQ ID NO: 4406200 - DNA, 13 bp, Homo sapiens
agaactcatttga

SEQ ID NO: 4406201 - DNA, 15 bp, Homo sapiens
agaactgaatgagaa

SEQ ID NO: 4406202 - DNA, 12 bp, Homo sapiens
agaactgtacat

SEQ ID NO: 4406203 - DNA, 22 bp, Homo sapiens
agaactgtacattgtgagctct

SEQ ID NO: 4406204 - DNA, 14 bp, Homo sapiens
agaactgtctgtga

SEQ ID NO: 4406205 - DNA, 18 bp, Homo sapiens
agaacttggatgtacctg

SEQ ID NO: 4406206 - DNA, 13 bp, Homo sapiens
agaactttctgtc

SEQ ID NO: 4406207 - DNA, 21 bp, Homo sapiens
agaacttttctgtcttacaag

SEQ ID NO: 4406208 - DNA, 13 bp, Homo sapiens
agaagaaaaagaa

SEQ ID NO: 4406209 - DNA, 15 bp, Homo sapiens
agaagaaaaagaagc

SEQ ID NO: 4406210 - DNA, 12 bp, Homo sapiens
agaagaaaattc

SEQ ID NO: 4406211 - DNA, 17 bp, Homo sapiens
agaagaaaattctcctg

SEQ ID NO: 4406212 - DNA, 21 bp, Homo sapiens
agaagaaacaaggttttcagt

SEQ ID NO: 4406213 - DNA, 15 bp, Homo sapiens
agaagaaagatgttt

SEQ ID NO: 4406214 - DNA, 12 bp, Homo sapiens
agaagaaagcaa

SEQ ID NO: 4406215 - DNA, 13 bp, Homo sapiens
agaagaaagcaaa

SEQ ID NO: 4406216 - DNA, 20 bp, Homo sapiens
agaagaaaggccaaggtgct

SEQ ID NO: 4406217 - DNA, 17 bp, Homo sapiens
agaagaaccaaatacct

SEQ ID NO: 4406218 - DNA, 12 bp, Homo sapiens
agaagaaggaga

SEQ ID NO: 4406219 - DNA, 19 bp, Homo sapiens
agaagaagtggctgccaca

SEQ ID NO: 4406220 - DNA, 17 bp, Homo sapiens
agaagaattgaacccag

SEQ ID NO: 4406221 - DNA, 12 bp, Homo sapiens
agaagacatttt

SEQ ID NO: 4406222 - DNA, 13 bp, Homo sapiens
agaagagaagtga

SEQ ID NO: 4406223 - DNA, 21 bp, Homo sapiens
agaagagccatcttggcaggg

SEQ ID NO: 4406224 - DNA, 22 bp, Homo sapiens
agaagagccatcttggcagggt

SEQ ID NO: 4406225 - DNA, 21 bp, Homo sapiens
agaagagctgttcacagccag

SEQ ID NO: 4406226 - DNA, 22 bp, Homo sapiens
agaagagctgttcacagccaga

SEQ ID NO: 4406227 - DNA, 20 bp, Homo sapiens
agaagagcttgcacagccaa

SEQ ID NO: 4406228 - DNA, 16 bp, Homo sapiens
agaagagggcccagcc

SEQ ID NO: 4406229 - DNA, 18 bp, Homo sapiens
agaagagggcccagccca

SEQ ID NO: 4406230 - DNA, 20 bp, Homo sapiens
agaagagggcccagcccaga

SEQ ID NO: 4406231 - DNA, 17 bp, Homo sapiens
agaagatagtcttggaa

SEQ ID NO: 4406232 - DNA, 13 bp, Homo sapiens
agaagatcccctc

SEQ ID NO: 4406233 - DNA, 14 bp, Homo sapiens
agaagatcccctca

SEQ ID NO: 4406234 - DNA, 12 bp, Homo sapiens
agaagatgtgta

SEQ ID NO: 4406235 - DNA, 16 bp, Homo sapiens
agaagattctcgcccc

SEQ ID NO: 4406236 - DNA, 23 bp, Homo sapiens
agaagattctcgccccttccctc

SEQ ID NO: 4406237 - DNA, 15 bp, Homo sapiens
agaagcaagccagac

SEQ ID NO: 4406238 - DNA, 14 bp, Homo sapiens
agaagcagtgagcc

SEQ ID NO: 4406239 - DNA, 15 bp, Homo sapiens
agaagccaagggaaa

SEQ ID NO: 4406240 - DNA, 19 bp, Homo sapiens
agaagccaagggaaagggg

SEQ ID NO: 4406241 - DNA, 12 bp, Homo sapiens
agaagccacaga

SEQ ID NO: 4406242 - DNA, 21 bp, Homo sapiens
agaagccatatatgaccagaa

SEQ ID NO: 4406243 - DNA, 15 bp, Homo sapiens
agaagccccttcccc

SEQ ID NO: 4406244 - DNA, 13 bp, Homo sapiens
agaagccctgatg

SEQ ID NO: 4406245 - DNA, 21 bp, Homo sapiens
agaagcctccaagcctgcctc

SEQ ID NO: 4406246 - DNA, 18 bp, Homo sapiens
agaagctaaaacctgagc

SEQ ID NO: 4406247 - DNA, 19 bp, Homo sapiens
agaagcttccacaaaatta

SEQ ID NO: 4406248 - DNA, 22 bp, Homo sapiens
agaagcttccacaaaattagaa

SEQ ID NO: 4406249 - DNA, 15 bp, Homo sapiens
agaagctttatttct

SEQ ID NO: 4406250 - DNA, 19 bp, Homo sapiens
agaaggaaagatggttaaa

SEQ ID NO: 4406251 - DNA, 20 bp, Homo sapiens
agaaggaaggcctgagcccc

SEQ ID NO: 4406252 - DNA, 15 bp, Homo sapiens
agaaggagaaggaag

SEQ ID NO: 4406253 - DNA, 18 bp, Homo sapiens
agacctcagtgccttcct

SEQ ID NO: 4406254 - DNA, 17 bp, Homo sapiens
agacctcatctctacta

SEQ ID NO: 4406255 - DNA, 16 bp, Homo sapiens
agacctccaataaagt

SEQ ID NO: 4406256 - DNA, 18 bp, Homo sapiens
agacctgaccagtcagat

SEQ ID NO: 4406257 - DNA, 14 bp, Homo sapiens
agacctgccagcca

SEQ ID NO: 4406258 - DNA, 23 bp, Homo sapiens
agacctgccagccactgtcaccg

SEQ ID NO: 4406259 - DNA, 12 bp, Homo sapiens
agacctgctcag

SEQ ID NO: 4406260 - DNA, 14 bp, Homo sapiens
agacctgctcaggc

SEQ ID NO: 4406261 - DNA, 15 bp, Homo sapiens
agacctgtcctcctg

SEQ ID NO: 4406262 - DNA, 13 bp, Homo sapiens
agacctttatcca

SEQ ID NO: 4406263 - DNA, 14 bp, Homo sapiens
agaccttttttagg

SEQ ID NO: 4406264 - DNA, 20 bp, Homo sapiens
agaccttttttttttttcca

SEQ ID NO: 4406265 - DNA, 21 bp, Homo sapiens
agacgagacaacagcacacag

SEQ ID NO: 4406266 - DNA, 20 bp, Homo sapiens
agacgaggccctcgggccca

SEQ ID NO: 4406267 - DNA, 22 bp, Homo sapiens
agacgaggccctcgggcccagc

SEQ ID NO: 4406268 - DNA, 23 bp, Homo sapiens
agacgaggccctcgggcccagcc

SEQ ID NO: 4406269 - DNA, 19 bp, Homo sapiens
agacgcactgatctttgca

SEQ ID NO: 4406270 - DNA, 13 bp, Homo sapiens
agacgcccctccc

SEQ ID NO: 4406271 - DNA, 22 bp, Homo sapiens
agacgccggcttcctccttcca

SEQ ID NO: 4406272 - DNA, 20 bp, Homo sapiens
agacgccggggacagaggcc

SEQ ID NO: 4406273 - DNA, 15 bp, Homo sapiens
agacgcctgaggaac

SEQ ID NO: 4406274 - DNA, 17 bp, Homo sapiens
agacgctaataaaaatt

SEQ ID NO: 4406275 - DNA, 21 bp, Homo sapiens
agacgctaataaaaatttatt

SEQ ID NO: 4406276 - DNA, 22 bp, Homo sapiens
agacggagccctggcatgtcaa

SEQ ID NO: 4406277 - DNA, 17 bp, Homo sapiens
agacggatactggggag

SEQ ID NO: 4406278 - DNA, 14 bp, Homo sapiens
agacgggccctggt

SEQ ID NO: 4406279 - DNA, 16 bp, Homo sapiens
agacgggctgagagga

SEQ ID NO: 4406280 - DNA, 16 bp, Homo sapiens
agacggtctgtgtgct

SEQ ID NO: 4406281 - DNA, 16 bp, Homo sapiens
agacggtgttttgcca

SEQ ID NO: 4406282 - DNA, 22 bp, Homo sapiens
agacgtctgtcaggggcttgga

SEQ ID NO: 4406283 - DNA, 17 bp, Homo sapiens
agacgtgaatgtctcag

SEQ ID NO: 4406284 - DNA, 18 bp, Homo sapiens
agacgtgaatgtctcagc

SEQ ID NO: 4406285 - DNA, 14 bp, Homo sapiens
agacgttgcctgag

SEQ ID NO: 4406286 - DNA, 21 bp, Homo sapiens
agacgtttttgtgctgtgggc

SEQ ID NO: 4406287 - DNA, 15 bp, Homo sapiens
agactaaaggatcca

SEQ ID NO: 4406288 - DNA, 19 bp, Homo sapiens
agactaccggacactcgtc

SEQ ID NO: 4406289 - DNA, 15 bp, Homo sapiens
agactagagaaaccg

SEQ ID NO: 4406290 - DNA, 20 bp, Homo sapiens
agactagagcaaaataatgc

SEQ ID NO: 4406291 - DNA, 19 bp, Homo sapiens
agactagatgtagtatttt

SEQ ID NO: 4406292 - DNA, 23 bp, Homo sapiens
agactagcaatctcttcattatt

SEQ ID NO: 4406293 - DNA, 14 bp, Homo sapiens
agactatctacaaa

SEQ ID NO: 4406294 - DNA, 20 bp, Homo sapiens
agactatcttactatttcac

SEQ ID NO: 4406295 - DNA, 16 bp, Homo sapiens
agactattcaaacagt

SEQ ID NO: 4406296 - DNA, 18 bp, Homo sapiens
agactattcaaacagtct

SEQ ID NO: 4406297 - DNA, 20 bp, Homo sapiens
agactattcaaacagtctca

SEQ ID NO: 4406298 - DNA, 21 bp, Homo sapiens
agactattcaaacagtctcag

SEQ ID NO: 4406299 - DNA, 12 bp, Homo sapiens
agactatttctt

SEQ ID NO: 4406300 - DNA, 14 bp, Homo sapiens
agactatttttaga

SEQ ID NO: 4406301 - DNA, 21 bp, Homo sapiens
agactcaagagaatttatgtg

SEQ ID NO: 4406302 - DNA, 15 bp, Homo sapiens
agactcacctctgcc

SEQ ID NO: 4406303 - DNA, 19 bp, Homo sapiens
agactcacctctgcctcaa

SEQ ID NO: 4406304 - DNA, 16 bp, Homo sapiens
agactcagaggtccag

SEQ ID NO: 4406305 - DNA, 13 bp, Homo sapiens
agactcagatgat

SEQ ID NO: 4406306 - DNA, 20 bp, Homo sapiens
agactcagatgatgccagct

SEQ ID NO: 4406307 - DNA, 13 bp, Homo sapiens
agactcagcctct

SEQ ID NO: 4406308 - DNA, 15 bp, Homo sapiens
agactcagcctctgc

SEQ ID NO: 4406309 - DNA, 23 bp, Homo sapiens
agactcaggccaagaaacgtctt

SEQ ID NO: 4406310 - DNA, 13 bp, Homo sapiens
agactccatctct

SEQ ID NO: 4406311 - DNA, 21 bp, Homo sapiens
agactccatctctttaaaaac

SEQ ID NO: 4406312 - DNA, 23 bp, Homo sapiens
agactccatctctttaaaaacaa

SEQ ID NO: 4406313 - DNA, 23 bp, Homo sapiens
agactcccatgaagccttttgaa

SEQ ID NO: 4406314 - DNA, 21 bp, Homo sapiens
agactccttcaacaattctaa

SEQ ID NO: 4406315 - DNA, 21 bp, Homo sapiens
agactcgcggcaggttctctt

SEQ ID NO: 4406316 - DNA, 16 bp, Homo sapiens
agactctcagcccaga

SEQ ID NO: 4406317 - DNA, 17 bp, Homo sapiens
agactctcagcccagaa

SEQ ID NO: 4406318 - DNA, 11 bp, Homo sapiens
agactctcagg

SEQ ID NO: 4406319 - DNA, 15 bp, Homo sapiens
agactctcaggtgga

SEQ ID NO: 4406320 - DNA, 18 bp, Homo sapiens
agactctgtctcagtcca

SEQ ID NO: 4406321 - DNA, 13 bp, Homo sapiens
agactctgtgtgg

SEQ ID NO: 4406322 - DNA, 20 bp, Homo sapiens
agactctgtgtggctgtgca

SEQ ID NO: 4406323 - DNA, 18 bp, Homo sapiens
agactcttttccttccct

SEQ ID NO: 4406324 - DNA, 21 bp, Homo sapiens
agactgaatagatatgaaagc

SEQ ID NO: 4406325 - DNA, 14 bp, Homo sapiens
agactgacactact

SEQ ID NO: 4406326 - DNA, 12 bp, Homo sapiens
agactgaccaat

SEQ ID NO: 4406327 - DNA, 14 bp, Homo sapiens
agactgatgagcac

SEQ ID NO: 4406328 - DNA, 22 bp, Homo sapiens
agactgattggaattctttctg

SEQ ID NO: 4406329 - DNA, 13 bp, Homo sapiens
agactgcctgtct

SEQ ID NO: 4406330 - DNA, 12 bp, Homo sapiens
agactgctcccg

SEQ ID NO: 4406331 - DNA, 21 bp, Homo sapiens
agactgctcccggcccgcctg

SEQ ID NO: 4406332 - DNA, 14 bp, Homo sapiens
agactggaagctaa

SEQ ID NO: 4406333 - DNA, 19 bp, Homo sapiens
agactggaagctaatttgc

SEQ ID NO: 4406334 - DNA, 11 bp, Homo sapiens
agactggcttt

SEQ ID NO: 4406335 - DNA, 22 bp, Homo sapiens
agactggcttttattaatgcac

SEQ ID NO: 4406336 - DNA, 22 bp, Homo sapiens
agactgggaaggcttgggattt

SEQ ID NO: 4406337 - DNA, 22 bp, Homo sapiens
agactgggagccacttctcccc

SEQ ID NO: 4406338 - DNA, 12 bp, Homo sapiens
agactgggctga

SEQ ID NO: 4406339 - DNA, 16 bp, Homo sapiens
agactgggctgaggga

SEQ ID NO: 4406340 - DNA, 18 bp, Homo sapiens
agactggttttctgccaa

SEQ ID NO: 4406341 - DNA, 12 bp, Homo sapiens
agactgtacata

SEQ ID NO: 4406342 - DNA, 19 bp, Homo sapiens
agactgtacataattgcat

SEQ ID NO: 4406343 - DNA, 13 bp, Homo sapiens
agactgtccaggg

SEQ ID NO: 4406344 - DNA, 20 bp, Homo sapiens
agactgtgccagaggccaga

SEQ ID NO: 4406345 - DNA, 17 bp, Homo sapiens
agacttcaaaaataaaa

SEQ ID NO: 4406346 - DNA, 22 bp, Homo sapiens
agacttcaagcatggctatttt

SEQ ID NO: 4406347 - DNA, 17 bp, Homo sapiens
agacttcccactgttct

SEQ ID NO: 4406348 - DNA, 18 bp, Homo sapiens
agacttcccactgttctg

SEQ ID NO: 4406349 - DNA, 14 bp, Homo sapiens
agacttcccagcta

SEQ ID NO: 4406350 - DNA, 14 bp, Homo sapiens
agacttccccatcc

SEQ ID NO: 4406351 - DNA, 15 bp, Homo sapiens
agacttgaagcacag

SEQ ID NO: 4406352 - DNA, 14 bp, Homo sapiens
agacttgccaggct

SEQ ID NO: 4406353 - DNA, 18 bp, Homo sapiens
agacttgctccctctcca

SEQ ID NO: 4406354 - DNA, 21 bp, Homo sapiens
agacttgctccctctccaaga

SEQ ID NO: 4406355 - DNA, 17 bp, Homo sapiens
agacttgtgctcaagga

SEQ ID NO: 4406356 - DNA, 15 bp, Homo sapiens
agactttcttctagt

SEQ ID NO: 4406357 - DNA, 13 bp, Homo sapiens
agactttgctgtt

SEQ ID NO: 4406358 - DNA, 20 bp, Homo sapiens
agactttgctgttactgctt

SEQ ID NO: 4406359 - DNA, 21 bp, Homo sapiens
agactttgtgttcatttcatt

SEQ ID NO: 4406360 - DNA, 18 bp, Homo sapiens
agacttttatgtgagatt

SEQ ID NO: 4406361 - DNA, 23 bp, Homo sapiens
agacttttatgtgagatttcctt

SEQ ID NO: 4406362 - DNA, 23 bp, Homo sapiens
agacttttgaaaaaaaagttttt

SEQ ID NO: 4406363 - DNA, 12 bp, Homo sapiens
agactttttggt

SEQ ID NO: 4406364 - DNA, 23 bp, Homo sapiens
agactttttggtggatgtaaata

SEQ ID NO: 4406365 - DNA, 20 bp, Homo sapiens
agagaaaaagcagaggccaa

SEQ ID NO: 4406366 - DNA, 18 bp, Homo sapiens
agagaaaagaaaaatcaa

SEQ ID NO: 4406367 - DNA, 19 bp, Homo sapiens
agagaaaatatatgtattt

SEQ ID NO: 4406368 - DNA, 14 bp, Homo sapiens
agagaaagaggcca

SEQ ID NO: 4406369 - DNA, 13 bp, Homo sapiens
agagaaccaggct

SEQ ID NO: 4406370 - DNA, 13 bp, Homo sapiens
agagaactgcctt

SEQ ID NO: 4406371 - DNA, 22 bp, Homo sapiens
agaggtttgactagatgatgga

SEQ ID NO: 4406372 - DNA, 13 bp, Homo sapiens
agagtaacaggat

SEQ ID NO: 4406373 - DNA, 16 bp, Homo sapiens
agagtacactcagcca

SEQ ID NO: 4406374 - DNA, 19 bp, Homo sapiens
agagtactttggtttctga

SEQ ID NO: 4406375 - DNA, 17 bp, Homo sapiens
agagtagaattgcattg

SEQ ID NO: 4406376 - DNA, 17 bp, Homo sapiens
agagtagccgagagcct

SEQ ID NO: 4406377 - DNA, 23 bp, Homo sapiens
agagtagttatataattgttgaa

SEQ ID NO: 4406378 - DNA, 19 bp, Homo sapiens
agagtatgtggcaaaacat

SEQ ID NO: 4406379 - DNA, 22 bp, Homo sapiens
agagtcaactacacaaagcagg

SEQ ID NO: 4406380 - DNA, 16 bp, Homo sapiens
agagtcaccttttctg

SEQ ID NO: 4406381 - DNA, 21 bp, Homo sapiens
agagtcagaactaactttggt

SEQ ID NO: 4406382 - DNA, 13 bp, Homo sapiens
agagtcagaggag

SEQ ID NO: 4406383 - DNA, 20 bp, Homo sapiens
agagtccagtgctctgcctc

SEQ ID NO: 4406384 - DNA, 14 bp, Homo sapiens
agagtccctgcctg

SEQ ID NO: 4406385 - DNA, 13 bp, Homo sapiens
agagtcctcactc

SEQ ID NO: 4406386 - DNA, 13 bp, Homo sapiens
agagtctctgata

SEQ ID NO: 4406387 - DNA, 20 bp, Homo sapiens
agagtgacctcggacagagc

SEQ ID NO: 4406388 - DNA, 21 bp, Homo sapiens
agagtgagaccatgtttcaaa

SEQ ID NO: 4406389 - DNA, 14 bp, Homo sapiens
agagtgagaccctg

SEQ ID NO: 4406390 - DNA, 12 bp, Homo sapiens
agagtgagactc

SEQ ID NO: 4406391 - DNA, 18 bp, Homo sapiens
agagtgagactcagtctt

SEQ ID NO: 4406392 - DNA, 13 bp, Homo sapiens
agagtgcacatgc

SEQ ID NO: 4406393 - DNA, 14 bp, Homo sapiens
agagtgccactgcg

SEQ ID NO: 4406394 - DNA, 18 bp, Homo sapiens
agagtgccactgcgggag

SEQ ID NO: 4406395 - DNA, 14 bp, Homo sapiens
agagtgctggactg

SEQ ID NO: 4406396 - DNA, 16 bp, Homo sapiens
agagtggacctgtgct

SEQ ID NO: 4406397 - DNA, 20 bp, Homo sapiens
agagtggactgaatgtgcct

SEQ ID NO: 4406398 - DNA, 12 bp, Homo sapiens
agagtggcctcc

SEQ ID NO: 4406399 - DNA, 16 bp, Homo sapiens
agagtggcctccctgc

SEQ ID NO: 4406400 - DNA, 17 bp, Homo sapiens
agagtggcctccctgct

SEQ ID NO: 4406401 - DNA, 12 bp, Homo sapiens
agagtggcctgg

SEQ ID NO: 4406402 - DNA, 14 bp, Homo sapiens
agagtggcctggcc

SEQ ID NO: 4406403 - DNA, 17 bp, Homo sapiens
agagtggcctggccagg

SEQ ID NO: 4406404 - DNA, 14 bp, Homo sapiens
agagtgtctttcca

SEQ ID NO: 4406405 - DNA, 19 bp, Homo sapiens
agagtgtgaaatagacatt

SEQ ID NO: 4406406 - DNA, 20 bp, Homo sapiens
agagtgtgggaagggagagc

SEQ ID NO: 4406407 - DNA, 22 bp, Homo sapiens
agagttacagttctgtggtttc

SEQ ID NO: 4406408 - DNA, 16 bp, Homo sapiens
agagttattcaaatga

SEQ ID NO: 4406409 - DNA, 22 bp, Homo sapiens
agagttattcaaatgaaggtgg

SEQ ID NO: 4406410 - DNA, 14 bp, Homo sapiens
agagttcaagaaat

SEQ ID NO: 4406411 - DNA, 14 bp, Homo sapiens
agagttctttgctg

SEQ ID NO: 4406412 - DNA, 15 bp, Homo sapiens
agagttctttgctgc

SEQ ID NO: 4406413 - DNA, 18 bp, Homo sapiens
agagttctttgctgcccc

SEQ ID NO: 4406414 - DNA, 22 bp, Homo sapiens
agagttctttgctgcccctgtc

SEQ ID NO: 4406415 - DNA, 19 bp, Homo sapiens
agagttgaggaactgtaca

SEQ ID NO: 4406416 - DNA, 21 bp, Homo sapiens
agagtttattattgtacttta

SEQ ID NO: 4406417 - DNA, 19 bp, Homo sapiens
agagtttctgcagttccat

SEQ ID NO: 4406418 - DNA, 14 bp, Homo sapiens
agagtttctgtttg

SEQ ID NO: 4406419 - DNA, 22 bp, Homo sapiens
agagtttctgtttgattctttt

SEQ ID NO: 4406420 - DNA, 23 bp, Homo sapiens
agagtttggaattattgtagaca

SEQ ID NO: 4406421 - DNA, 17 bp, Homo sapiens
agagtttttaatagaac

SEQ ID NO: 4406422 - DNA, 22 bp, Homo sapiens
agataaaagcaattctgactgt

SEQ ID NO: 4406423 - DNA, 19 bp, Homo sapiens
agataaagaccagaaattc

SEQ ID NO: 4406424 - DNA, 14 bp, Homo sapiens
agataaagcttagg

SEQ ID NO: 4406425 - DNA, 18 bp, Homo sapiens
agataacccttattccat

SEQ ID NO: 4406426 - DNA, 14 bp, Homo sapiens
agataaccttgttt

SEQ ID NO: 4406427 - DNA, 18 bp, Homo sapiens
agataactgaaaattatt

SEQ ID NO: 4406428 - DNA, 17 bp, Homo sapiens
agataacttcttgaaaa

SEQ ID NO: 4406429 - DNA, 21 bp, Homo sapiens
agataacttcttgaaaaagat

SEQ ID NO: 4406430 - DNA, 20 bp, Homo sapiens
agataacttttttgagtcat

SEQ ID NO: 4406431 - DNA, 21 bp, Homo sapiens
agataacttttttgagtcatt

SEQ ID NO: 4406432 - DNA, 12 bp, Homo sapiens
agataaggagaa

SEQ ID NO: 4406433 - DNA, 15 bp, Homo sapiens
agataaggagaaaga

SEQ ID NO: 4406434 - DNA, 12 bp, Homo sapiens
agataatgtgaa

SEQ ID NO: 4406435 - DNA, 20 bp, Homo sapiens
agataatttacaagatatta

SEQ ID NO: 4406436 - DNA, 17 bp, Homo sapiens
agatacaaggcccagaa

SEQ ID NO: 4406437 - DNA, 23 bp, Homo sapiens
agatacaaggcccagaagcctga

SEQ ID NO: 4406438 - DNA, 18 bp, Homo sapiens
agatacactgcactttgt

SEQ ID NO: 4406439 - DNA, 19 bp, Homo sapiens
agatacactgcactttgtt

SEQ ID NO: 4406440 - DNA, 18 bp, Homo sapiens
agatacagaactctttca

SEQ ID NO: 4406441 - DNA, 14 bp, Homo sapiens
agataccagcgagg

SEQ ID NO: 4406442 - DNA, 23 bp, Homo sapiens
agataccagcgaggaggctccag

SEQ ID NO: 4406443 - DNA, 22 bp, Homo sapiens
agataccctacgctgtccagaa

SEQ ID NO: 4406444 - DNA, 23 bp, Homo sapiens
agataccctacgctgtccagaaa

SEQ ID NO: 4406445 - DNA, 17 bp, Homo sapiens
agatacttatttttctg

SEQ ID NO: 4406446 - DNA, 18 bp, Homo sapiens
agatagggctgggcaagg

SEQ ID NO: 4406447 - DNA, 22 bp, Homo sapiens
agatagggctgggcaaggaaaa

SEQ ID NO: 4406448 - DNA, 21 bp, Homo sapiens
agatagtcttggaagctgttt

SEQ ID NO: 4406449 - DNA, 20 bp, Homo sapiens
agatagttacaaaatacaaa

SEQ ID NO: 4406450 - DNA, 11 bp, Homo sapiens
agatagttttc

SEQ ID NO: 4406451 - DNA, 15 bp, Homo sapiens
agatagttttcattt

SEQ ID NO: 4406452 - DNA, 16 bp, Homo sapiens
agatataactgtcttg

SEQ ID NO: 4406453 - DNA, 15 bp, Homo sapiens
agatatacaaaaaca

SEQ ID NO: 4406454 - DNA, 18 bp, Homo sapiens
agatatcctctccccctc

SEQ ID NO: 4406455 - DNA, 20 bp, Homo sapiens
agatatcctctccccctcct

SEQ ID NO: 4406456 - DNA, 21 bp, Homo sapiens
agatatcctctccccctcctc

SEQ ID NO: 4406457 - DNA, 15 bp, Homo sapiens
agatatgagttgttt

SEQ ID NO: 4406458 - DNA, 20 bp, Homo sapiens
agatatgcttactaaatctt

SEQ ID NO: 4406459 - DNA, 17 bp, Homo sapiens
agatatggcagcgaaag

SEQ ID NO: 4406460 - DNA, 20 bp, Homo sapiens
agatatgttaagcatggatt

SEQ ID NO: 4406461 - DNA, 16 bp, Homo sapiens
agatattatttgtctt

SEQ ID NO: 4406462 - DNA, 20 bp, Homo sapiens
agatattattttaaatttct

SEQ ID NO: 4406463 - DNA, 18 bp, Homo sapiens
agatattcctattgtgca

SEQ ID NO: 4406464 - DNA, 18 bp, Homo sapiens
agatatttgcagtttttc

SEQ ID NO: 4406465 - DNA, 13 bp, Homo sapiens
agatattttgtaa

SEQ ID NO: 4406466 - DNA, 20 bp, Homo sapiens
agatattttgtaaaatgtat

SEQ ID NO: 4406467 - DNA, 21 bp, Homo sapiens
agatattttgtaaaatgtatt

SEQ ID NO: 4406468 - DNA, 20 bp, Homo sapiens
agatatttttatctttatat

SEQ ID NO: 4406469 - DNA, 14 bp, Homo sapiens
agatatttttgtac

SEQ ID NO: 4406470 - DNA, 19 bp, Homo sapiens
agatcacatcttaaattca

SEQ ID NO: 4406471 - DNA, 23 bp, Homo sapiens
agatcacgccattgtactccagc

SEQ ID NO: 4406472 - DNA, 11 bp, Homo sapiens
agatcactttc

SEQ ID NO: 4406473 - DNA, 23 bp, Homo sapiens
agatcactttctcagttttcata

SEQ ID NO: 4406474 - DNA, 20 bp, Homo sapiens
agatcaggaattctaaataa

SEQ ID NO: 4406475 - DNA, 21 bp, Homo sapiens
agatcaggctagccctgccct

SEQ ID NO: 4406476 - DNA, 15 bp, Homo sapiens
agatcagtgtaccat

SEQ ID NO: 4406477 - DNA, 21 bp, Homo sapiens
agatcagtgtaccatttgcct

SEQ ID NO: 4406478 - DNA, 21 bp, Homo sapiens
agatcatttataatactgttt

SEQ ID NO: 4406479 - DNA, 18 bp, Homo sapiens
agatcccaacactgccag

SEQ ID NO: 4406480 - DNA, 17 bp, Homo sapiens
agatccccagcccctcc

SEQ ID NO: 4406481 - DNA, 21 bp, Homo sapiens
agatccccagcccctcctccc

SEQ ID NO: 4406482 - DNA, 23 bp, Homo sapiens
agatccccagcccctcctccctc

SEQ ID NO: 4406483 - DNA, 17 bp, Homo sapiens
agatccctgcagaaccc

SEQ ID NO: 4406484 - DNA, 13 bp, Homo sapiens
agatcctaaactc

SEQ ID NO: 4406485 - DNA, 14 bp, Homo sapiens
agatcctaagatgt

SEQ ID NO: 4406486 - DNA, 13 bp, Homo sapiens
agatcctgcaccc

SEQ ID NO: 4406487 - DNA, 16 bp, Homo sapiens
agatcgagaccatcct

SEQ ID NO: 4406488 - DNA, 17 bp, Homo sapiens
agatcgagaccatcctg

SEQ ID NO: 4406489 - DNA, 13 bp, Homo sapiens
agattaagctttt

SEQ ID NO: 4406490 - DNA, 14 bp, Homo sapiens
agattaagcttttc

SEQ ID NO: 4406491 - DNA, 15 bp, Homo sapiens
agattaataagattt

SEQ ID NO: 4406492 - DNA, 20 bp, Homo sapiens
agattaatactctattttta

SEQ ID NO: 4406493 - DNA, 11 bp, Homo sapiens
agattaatttt

SEQ ID NO: 4406494 - DNA, 21 bp, Homo sapiens
agattagaatggctaccccat

SEQ ID NO: 4406495 - DNA, 17 bp, Homo sapiens
agattagggaaaatgga

SEQ ID NO: 4406496 - DNA, 19 bp, Homo sapiens
agattagttctttttgcca

SEQ ID NO: 4406497 - DNA, 14 bp, Homo sapiens
agattatgtgactt

SEQ ID NO: 4406498 - DNA, 17 bp, Homo sapiens
agattattataaactat

SEQ ID NO: 4406499 - DNA, 18 bp, Homo sapiens
agattattataaactata

SEQ ID NO: 4406500 - DNA, 19 bp, Homo sapiens
agattattgtgacttcact

SEQ ID NO: 4406501 - DNA, 23 bp, Homo sapiens
agattattgtgacttcactgtat

SEQ ID NO: 4406502 - DNA, 14 bp, Homo sapiens
agattatttacaag

SEQ ID NO: 4406503 - DNA, 19 bp, Homo sapiens
agattatttacaagaagaa

SEQ ID NO: 4406504 - DNA, 14 bp, Homo sapiens
agattcaaacccag

SEQ ID NO: 4406505 - DNA, 14 bp, Homo sapiens
agattcaaggcccc

SEQ ID NO: 4406506 - DNA, 16 bp, Homo sapiens
agattcacctgtaaaa

SEQ ID NO: 4406507 - DNA, 20 bp, Homo sapiens
agattcaggtaatacaaact

SEQ ID NO: 4406508 - DNA, 14 bp, Homo sapiens
agattcccagagac

SEQ ID NO: 4406509 - DNA, 16 bp, Homo sapiens
agattcctttcccttt

SEQ ID NO: 4406510 - DNA, 13 bp, Homo sapiens
agattctcaaagg

SEQ ID NO: 4406511 - DNA, 15 bp, Homo sapiens
agattctcgcccctt

SEQ ID NO: 4406512 - DNA, 22 bp, Homo sapiens
agattctgagcaaaggccctgg

SEQ ID NO: 4406513 - DNA, 12 bp, Homo sapiens
agattctgcctc

SEQ ID NO: 4406514 - DNA, 13 bp, Homo sapiens
agattctgtgtat

SEQ ID NO: 4406515 - DNA, 23 bp, Homo sapiens
agattctgtgtattaacatgcaa

SEQ ID NO: 4406516 - DNA, 22 bp, Homo sapiens
agattcttcactggtgagacaa

SEQ ID NO: 4406517 - DNA, 12 bp, Homo sapiens
agattgagaaat

SEQ ID NO: 4406518 - DNA, 15 bp, Homo sapiens
agattgagaagccat

SEQ ID NO: 4406519 - DNA, 22 bp, Homo sapiens
agattgagtaagatttacccag

SEQ ID NO: 4406520 - DNA, 15 bp, Homo sapiens
agattgattgtattg

SEQ ID NO: 4406521 - DNA, 16 bp, Homo sapiens
agattgattgtattgt

SEQ ID NO: 4406522 - DNA, 21 bp, Homo sapiens
agattgcagaaaattctgtgc

SEQ ID NO: 4406523 - DNA, 21 bp, Homo sapiens
agattgcttaaaagcattttt

SEQ ID NO: 4406524 - DNA, 15 bp, Homo sapiens
agattggatcaagta

SEQ ID NO: 4406525 - DNA, 22 bp, Homo sapiens
agattggatcaagtattactaa

SEQ ID NO: 4406526 - DNA, 16 bp, Homo sapiens
agattggatttgctgt

SEQ ID NO: 4406527 - DNA, 14 bp, Homo sapiens
agattggctcacac

SEQ ID NO: 4406528 - DNA, 18 bp, Homo sapiens
agattgggttggaatgct

SEQ ID NO: 4406529 - DNA, 16 bp, Homo sapiens
agattggttgcctctg

SEQ ID NO: 4406530 - DNA, 17 bp, Homo sapiens
agattgtccttttctcc

SEQ ID NO: 4406531 - DNA, 21 bp, Homo sapiens
agattgtgcccctgcactcca

SEQ ID NO: 4406532 - DNA, 21 bp, Homo sapiens
agattgtggaatgttggataa

SEQ ID NO: 4406533 - DNA, 16 bp, Homo sapiens
agattgttattaaatg

SEQ ID NO: 4406534 - DNA, 13 bp, Homo sapiens
agatttaaagtat

SEQ ID NO: 4406535 - DNA, 19 bp, Homo sapiens
agatttaaagtattttaat

SEQ ID NO: 4406536 - DNA, 14 bp, Homo sapiens
agatttaacctgtt

SEQ ID NO: 4406537 - DNA, 21 bp, Homo sapiens
agatttacccagaatgtcaga

SEQ ID NO: 4406538 - DNA, 15 bp, Homo sapiens
agatttcacatcagc

SEQ ID NO: 4406539 - DNA, 19 bp, Homo sapiens
agatttcagctatgcagaa

SEQ ID NO: 4406540 - DNA, 23 bp, Homo sapiens
agatttcatatctaactttgtaa

SEQ ID NO: 4406541 - DNA, 13 bp, Homo sapiens
agatttcatctgc

SEQ ID NO: 4406542 - DNA, 23 bp, Homo sapiens
agatttcatctgctctccttcct

SEQ ID NO: 4406543 - DNA, 15 bp, Homo sapiens
agatttctgaggaaa

SEQ ID NO: 4406544 - DNA, 17 bp, Homo sapiens
agatttgaaaaactttt

SEQ ID NO: 4406545 - DNA, 13 bp, Homo sapiens
agatttgaaaatt

SEQ ID NO: 4406546 - DNA, 21 bp, Homo sapiens
agatttgattgtgaggcttct

SEQ ID NO: 4406547 - DNA, 22 bp, Homo sapiens
agatttgcccatttacactttt

SEQ ID NO: 4406548 - DNA, 17 bp, Homo sapiens
agattttattttgacag

SEQ ID NO: 4406549 - DNA, 23 bp, Homo sapiens
agattttccacaagattcccaga

SEQ ID NO: 4406550 - DNA, 17 bp, Homo sapiens
agattttcctcttgtga

SEQ ID NO: 4406551 - DNA, 19 bp, Homo sapiens
agatttttaaaaaatattt

SEQ ID NO: 4406552 - DNA, 16 bp, Homo sapiens
agatttttatcttaat

SEQ ID NO: 4406553 - DNA, 18 bp, Homo sapiens
agatttttatttatgagt

SEQ ID NO: 4406554 - DNA, 16 bp, Homo sapiens
agattttttaaaattt

SEQ ID NO: 4406555 - DNA, 14 bp, Homo sapiens
agattttttaataa

SEQ ID NO: 4406556 - DNA, 15 bp, Homo sapiens
agatttttttgtaag

SEQ ID NO: 4406557 - DNA, 14 bp, Homo sapiens
agattttttttccg

SEQ ID NO: 4406558 - DNA, 16 bp, Homo sapiens
agattttttttccgtg

SEQ ID NO: 4406559 - DNA, 19 bp, Homo sapiens
agattttttttgtaacttc

SEQ ID NO: 4406560 - DNA, 18 bp, Homo sapiens
agattttttttttaagtg

SEQ ID NO: 4406561 - DNA, 22 bp, Homo sapiens
agcaaaaaagtccaattttaat

SEQ ID NO: 4406562 - DNA, 16 bp, Homo sapiens
agcaaaaaataatgac

SEQ ID NO: 4406563 - DNA, 12 bp, Homo sapiens
agcaaaaagtgg

SEQ ID NO: 4406564 - DNA, 13 bp, Homo sapiens
agcaaaaatctcc

SEQ ID NO: 4406565 - DNA, 12 bp, Homo sapiens
agcaaaactccg

SEQ ID NO: 4406566 - DNA, 15 bp, Homo sapiens
agcaaaaggctgaga

SEQ ID NO: 4406567 - DNA, 15 bp, Homo sapiens
agcaaaataaaaact

SEQ ID NO: 4406568 - DNA, 14 bp, Homo sapiens
agcaaaatctaaaa

SEQ ID NO: 4406569 - DNA, 16 bp, Homo sapiens
agcaaacagaaaaaga

SEQ ID NO: 4406570 - DNA, 19 bp, Homo sapiens
agcaaacctaacaggagaa

SEQ ID NO: 4406571 - DNA, 19 bp, Homo sapiens
agcaaactaacttgacttt

SEQ ID NO: 4406572 - DNA, 23 bp, Homo sapiens
agcaaagattaaatgtgtcattg

SEQ ID NO: 4406573 - DNA, 20 bp, Homo sapiens
agcaaagcacccatttcaat

SEQ ID NO: 4406574 - DNA, 13 bp, Homo sapiens
agcaaaggagaaa

SEQ ID NO: 4406575 - DNA, 13 bp, Homo sapiens
agcaaaggccctg

SEQ ID NO: 4406576 - DNA, 22 bp, Homo sapiens
agcaaagtagtacttcttctgt

SEQ ID NO: 4406577 - DNA, 19 bp, Homo sapiens
agcaaataaagcagtcatg

SEQ ID NO: 4406578 - DNA, 21 bp, Homo sapiens
agcaaataagtcatctgatga

SEQ ID NO: 4406579 - DNA, 22 bp, Homo sapiens
agcaaatacttagcaaaaagtg

SEQ ID NO: 4406580 - DNA, 24 bp, Homo sapiens
agcaaatataggtcctgtgttaaa

SEQ ID NO: 4406581 - DNA, 17 bp, Homo sapiens
agcaaatgtttactgta

SEQ ID NO: 4406582 - DNA, 20 bp, Homo sapiens
agcaaatgtttactgtatca

SEQ ID NO: 4406583 - DNA, 23 bp, Homo sapiens
agcaacaacaattggtaaaactc

SEQ ID NO: 4406584 - DNA, 20 bp, Homo sapiens
agcaacaaccttaaaggccg

SEQ ID NO: 4406585 - DNA, 15 bp, Homo sapiens
agcaacaatttatga

SEQ ID NO: 4406586 - DNA, 18 bp, Homo sapiens
agcaacagactctcacag

SEQ ID NO: 4406587 - DNA, 22 bp, Homo sapiens
agcaacaggaatcaagagctgc

SEQ ID NO: 4406588 - DNA, 15 bp, Homo sapiens
agcaacattcatagt

SEQ ID NO: 4406589 - DNA, 16 bp, Homo sapiens
agcaaccacatttaga

SEQ ID NO: 4406590 - DNA, 22 bp, Homo sapiens
agcaaccacatttagaaatgtt

SEQ ID NO: 4406591 - DNA, 20 bp, Homo sapiens
agcaaccctacagtatataa

SEQ ID NO: 4406592 - DNA, 21 bp, Homo sapiens
agcaacccttcctgctgctgc

SEQ ID NO: 4406593 - DNA, 19 bp, Homo sapiens
agcaactcattggtggtag

SEQ ID NO: 4406594 - DNA, 12 bp, Homo sapiens
agcaactcccac

SEQ ID NO: 4406595 - DNA, 14 bp, Homo sapiens
agcaactcccacga

SEQ ID NO: 4406596 - DNA, 22 bp, Homo sapiens
agcaactcttatttctttcctt

SEQ ID NO: 4406597 - DNA, 14 bp, Homo sapiens
agcaactcttgatt

SEQ ID NO: 4406598 - DNA, 16 bp, Homo sapiens
agcaactcttgattat

SEQ ID NO: 4406599 - DNA, 14 bp, Homo sapiens
agcaacttgcttct

SEQ ID NO: 4406600 - DNA, 22 bp, Homo sapiens
agcaagaaggaaagatttgtga

SEQ ID NO: 4406601 - DNA, 22 bp, Homo sapiens
agcaagaatgcagtacagaatt

SEQ ID NO: 4406602 - DNA, 13 bp, Homo sapiens
agcaagacctcat

SEQ ID NO: 4406603 - DNA, 19 bp, Homo sapiens
agcaagacgtaaagaattt

SEQ ID NO: 4406604 - DNA, 14 bp, Homo sapiens
agcaagactgggcc

SEQ ID NO: 4406605 - DNA, 21 bp, Homo sapiens
agcaagatgtttcttgccttt

SEQ ID NO: 4406606 - DNA, 22 bp, Homo sapiens
agcaagatgtttcttgcctttt

SEQ ID NO: 4406607 - DNA, 20 bp, Homo sapiens
agcatggcatattttaatca

SEQ ID NO: 4406608 - DNA, 17 bp, Homo sapiens
agcatggctattttata

SEQ ID NO: 4406609 - DNA, 17 bp, Homo sapiens
agcatggctgtgaggat

SEQ ID NO: 4406610 - DNA, 19 bp, Homo sapiens
agcatgtaacttatattaa

SEQ ID NO: 4406611 - DNA, 19 bp, Homo sapiens
agcatgtagactgtgccag

SEQ ID NO: 4406612 - DNA, 17 bp, Homo sapiens
agcatgtatagttgctt

SEQ ID NO: 4406613 - DNA, 13 bp, Homo sapiens
agcatgtggtctt

SEQ ID NO: 4406614 - DNA, 19 bp, Homo sapiens
agcatgtgtgactttcagg

SEQ ID NO: 4406615 - DNA, 15 bp, Homo sapiens
agcattaactaaatg

SEQ ID NO: 4406616 - DNA, 19 bp, Homo sapiens
agcattaactaaatgctca

SEQ ID NO: 4406617 - DNA, 13 bp, Homo sapiens
agcattacattat

SEQ ID NO: 4406618 - DNA, 21 bp, Homo sapiens
agcattacattattaaacgat

SEQ ID NO: 4406619 - DNA, 17 bp, Homo sapiens
agcattcagaagaaaaa

SEQ ID NO: 4406620 - DNA, 19 bp, Homo sapiens
agcattcagaagaaaaaga

SEQ ID NO: 4406621 - DNA, 21 bp, Homo sapiens
agcattcagaagaaaaagaag

SEQ ID NO: 4406622 - DNA, 15 bp, Homo sapiens
agcattccagacttc

SEQ ID NO: 4406623 - DNA, 16 bp, Homo sapiens
agcattccagacttca

SEQ ID NO: 4406624 - DNA, 13 bp, Homo sapiens
agcattccagctc

SEQ ID NO: 4406625 - DNA, 22 bp, Homo sapiens
agcattctttggagttaaaatg

SEQ ID NO: 4406626 - DNA, 18 bp, Homo sapiens
agcattgtaaatgtgctt

SEQ ID NO: 4406627 - DNA, 15 bp, Homo sapiens
agcatttgatctgtt

SEQ ID NO: 4406628 - DNA, 12 bp, Homo sapiens
agcatttggaaa

SEQ ID NO: 4406629 - DNA, 15 bp, Homo sapiens
agcatttttataaac

SEQ ID NO: 4406630 - DNA, 17 bp, Homo sapiens
agcatttttatttcaga

SEQ ID NO: 4406631 - DNA, 13 bp, Homo sapiens
agcatttttcaat

SEQ ID NO: 4406632 - DNA, 17 bp, Homo sapiens
agccaaaagtccctccc

SEQ ID NO: 4406633 - DNA, 19 bp, Homo sapiens
agccaaaagtccctccctg

SEQ ID NO: 4406634 - DNA, 23 bp, Homo sapiens
agccaaaagtccctccctgcctg

SEQ ID NO: 4406635 - DNA, 12 bp, Homo sapiens
agccaaaatcat

SEQ ID NO: 4406636 - DNA, 19 bp, Homo sapiens
agccaaaccaacaccccat

SEQ ID NO: 4406637 - DNA, 19 bp, Homo sapiens
agccaaaccagcagggagt

SEQ ID NO: 4406638 - DNA, 13 bp, Homo sapiens
agccaaagaaaaa

SEQ ID NO: 4406639 - DNA, 22 bp, Homo sapiens
agccaaatgcagggaggggagg

SEQ ID NO: 4406640 - DNA, 13 bp, Homo sapiens
agccaaatgtaaa

SEQ ID NO: 4406641 - DNA, 22 bp, Homo sapiens
agccaacgagacacattgcctt

SEQ ID NO: 4406642 - DNA, 16 bp, Homo sapiens
agccaactagcccctg

SEQ ID NO: 4406643 - DNA, 16 bp, Homo sapiens
agccaagaaagatgta

SEQ ID NO: 4406644 - DNA, 18 bp, Homo sapiens
agccaagatcgcaccact

SEQ ID NO: 4406645 - DNA, 22 bp, Homo sapiens
agccaagattttcctcttgtga

SEQ ID NO: 4406646 - DNA, 15 bp, Homo sapiens
agccaagctttaaat

SEQ ID NO: 4406647 - DNA, 22 bp, Homo sapiens
agccaagctttaaattatgtga

SEQ ID NO: 4406648 - DNA, 13 bp, Homo sapiens
agccaaggaaaaa

SEQ ID NO: 4406649 - DNA, 12 bp, Homo sapiens
agccaaggaggc

SEQ ID NO: 4406650 - DNA, 16 bp, Homo sapiens
agccaaggaggcctgg

SEQ ID NO: 4406651 - DNA, 22 bp, Homo sapiens
agccaaggatagaagctgcagt

SEQ ID NO: 4406652 - DNA, 23 bp, Homo sapiens
agccaagggaaaggggtgctttt

SEQ ID NO: 4406653 - DNA, 16 bp, Homo sapiens
agccacaaagcccccc

SEQ ID NO: 4406654 - DNA, 21 bp, Homo sapiens
agccacaaagccccccagctc

SEQ ID NO: 4406655 - DNA, 17 bp, Homo sapiens
agccacaagctgcactg

SEQ ID NO: 4406656 - DNA, 22 bp, Homo sapiens
agccacaagctgcactgtgaac

SEQ ID NO: 4406657 - DNA, 19 bp, Homo sapiens
agccacagctgctgttctc

SEQ ID NO: 4406658 - DNA, 23 bp, Homo sapiens
agccacagctgctgttctcagga

SEQ ID NO: 4406659 - DNA, 12 bp, Homo sapiens
agccacaggcca

SEQ ID NO: 4406660 - DNA, 16 bp, Homo sapiens
agccacagggaagctc

SEQ ID NO: 4406661 - DNA, 16 bp, Homo sapiens
agccacagtcactgga

SEQ ID NO: 4406662 - DNA, 22 bp, Homo sapiens
agccacatgccccaggctctcg

SEQ ID NO: 4406663 - DNA, 22 bp, Homo sapiens
agccacattgagactttcttct

SEQ ID NO: 4406664 - DNA, 14 bp, Homo sapiens
agccaccagttctc

SEQ ID NO: 4406665 - DNA, 14 bp, Homo sapiens
agccacccaagcct

SEQ ID NO: 4406666 - DNA, 21 bp, Homo sapiens
agccacccaagcctgctggct

SEQ ID NO: 4406667 - DNA, 14 bp, Homo sapiens
agccaccccgggct

SEQ ID NO: 4406668 - DNA, 23 bp, Homo sapiens
agccacccgtggggtgctgccct

SEQ ID NO: 4406669 - DNA, 21 bp, Homo sapiens
agccaccgtgcccggccaagt

SEQ ID NO: 4406670 - DNA, 16 bp, Homo sapiens
agccaccgtgcctggc

SEQ ID NO: 4406671 - DNA, 19 bp, Homo sapiens
agccaccgtgcctggccag

SEQ ID NO: 4406672 - DNA, 22 bp, Homo sapiens
agccaccgtgcctggccagatt

SEQ ID NO: 4406673 - DNA, 11 bp, Homo sapiens
agccacctgca

SEQ ID NO: 4406674 - DNA, 13 bp, Homo sapiens
agccacctgcaag

SEQ ID NO: 4406675 - DNA, 19 bp, Homo sapiens
agccacctgcaagatggac

SEQ ID NO: 4406676 - DNA, 18 bp, Homo sapiens
agccacgccctccctgct

SEQ ID NO: 4406677 - DNA, 21 bp, Homo sapiens
agccacgccctccctgctagc

SEQ ID NO: 4406678 - DNA, 22 bp, Homo sapiens
agccacgccctccctgctagca

SEQ ID NO: 4406679 - DNA, 18 bp, Homo sapiens
agccacgctgtcctctcg

SEQ ID NO: 4406680 - DNA, 23 bp, Homo sapiens
agccacgttccttactgcagaat

SEQ ID NO: 4406681 - DNA, 22 bp, Homo sapiens
agccactaagaacccctctgct

SEQ ID NO: 4406682 - DNA, 12 bp, Homo sapiens
agccactcctct

SEQ ID NO: 4406683 - DNA, 13 bp, Homo sapiens
agccactcctctg

SEQ ID NO: 4406684 - DNA, 14 bp, Homo sapiens
agccactcctctga

SEQ ID NO: 4406685 - DNA, 14 bp, Homo sapiens
agccactctatgag

SEQ ID NO: 4406686 - DNA, 18 bp, Homo sapiens
agccactgtcacaggcat

SEQ ID NO: 4406687 - DNA, 13 bp, Homo sapiens
agccacttctccc

SEQ ID NO: 4406688 - DNA, 14 bp, Homo sapiens
agccagaacctgga

SEQ ID NO: 4406689 - DNA, 19 bp, Homo sapiens
agccagacctagcaggctg

SEQ ID NO: 4406690 - DNA, 19 bp, Homo sapiens
agccagactggcacagttt

SEQ ID NO: 4406691 - DNA, 17 bp, Homo sapiens
agccagactgtccaggg

SEQ ID NO: 4406692 - DNA, 22 bp, Homo sapiens
agccagactgtccagggaaaca

SEQ ID NO: 4406693 - DNA, 14 bp, Homo sapiens
agccagagacagag

SEQ ID NO: 4406694 - DNA, 17 bp, Homo sapiens
agccagagacagaggat

SEQ ID NO: 4406695 - DNA, 20 bp, Homo sapiens
agccagagacagaggatgtg

SEQ ID NO: 4406696 - DNA, 12 bp, Homo sapiens
agccagagcccc

SEQ ID NO: 4406697 - DNA, 15 bp, Homo sapiens
agccagagccccaag

SEQ ID NO: 4406698 - DNA, 21 bp, Homo sapiens
agccagaggagggcagaggga

SEQ ID NO: 4406699 - DNA, 13 bp, Homo sapiens
agccagaggtctg

SEQ ID NO: 4406700 - DNA, 12 bp, Homo sapiens
agccagatcctc

SEQ ID NO: 4406701 - DNA, 14 bp, Homo sapiens
agccagatcctctt

SEQ ID NO: 4406702 - DNA, 16 bp, Homo sapiens
agccagatcctcttgg

SEQ ID NO: 4406703 - DNA, 11 bp, Homo sapiens
agccagcaggg

SEQ ID NO: 4406704 - DNA, 24 bp, Homo sapiens
agccagccaagctttaaattatgt

SEQ ID NO: 4406705 - DNA, 12 bp, Homo sapiens
agccagcccagc

SEQ ID NO: 4406706 - DNA, 15 bp, Homo sapiens
agccagcccagccca

SEQ ID NO: 4406707 - DNA, 19 bp, Homo sapiens
agccagcccatggccccca

SEQ ID NO: 4406708 - DNA, 20 bp, Homo sapiens
agccagcccatggcccccaa

SEQ ID NO: 4406709 - DNA, 23 bp, Homo sapiens
agccagcccatggcccccaataa

SEQ ID NO: 4406710 - DNA, 12 bp, Homo sapiens
agccagccctcc

SEQ ID NO: 4406711 - DNA, 15 bp, Homo sapiens
agccagccctccctg

SEQ ID NO: 4406712 - DNA, 23 bp, Homo sapiens
agccagccctccctgtcctcctc

SEQ ID NO: 4406713 - DNA, 14 bp, Homo sapiens
agccagcccttccc

SEQ ID NO: 4406714 - DNA, 19 bp, Homo sapiens
agccagcccttccctggcc

SEQ ID NO: 4406715 - DNA, 14 bp, Homo sapiens
agccagccgccctg

SEQ ID NO: 4406716 - DNA, 22 bp, Homo sapiens
agccagccgccctgggctgtct

SEQ ID NO: 4406717 - DNA, 22 bp, Homo sapiens
agccagcctcagaaggccccag

SEQ ID NO: 4406718 - DNA, 12 bp, Homo sapiens
agccagcctggc

SEQ ID NO: 4406719 - DNA, 14 bp, Homo sapiens
agccagcgcctccc

SEQ ID NO: 4406720 - DNA, 18 bp, Homo sapiens
agccagcgcctccctcca

SEQ ID NO: 4406721 - DNA, 22 bp, Homo sapiens
agccagcgcctccctccacccc

SEQ ID NO: 4406722 - DNA, 23 bp, Homo sapiens
agccagcgcctccctccacccca

SEQ ID NO: 4406723 - DNA, 15 bp, Homo sapiens
agccagcggctccaa

SEQ ID NO: 4406724 - DNA, 17 bp, Homo sapiens
agccagcgtcctcctct

SEQ ID NO: 4406725 - DNA, 17 bp, Homo sapiens
tctcctgcctactcacg

SEQ ID NO: 4406726 - DNA, 15 bp, Homo sapiens
tctcctgcctcagcc

SEQ ID NO: 4406727 - DNA, 15 bp, Homo sapiens
tctcctgcctgccct

SEQ ID NO: 4406728 - DNA, 21 bp, Homo sapiens
tctcctgcctgccctgcctca

SEQ ID NO: 4406729 - DNA, 18 bp, Homo sapiens
tctcctgccttcctcctg

SEQ ID NO: 4406730 - DNA, 12 bp, Homo sapiens
tctcctggagga

SEQ ID NO: 4406731 - DNA, 17 bp, Homo sapiens
tctcctggaggattgca

SEQ ID NO: 4406732 - DNA, 19 bp, Homo sapiens
tctcctggcctatccgctg

SEQ ID NO: 4406733 - DNA, 23 bp, Homo sapiens
tctcctggcctatccgctgccag

SEQ ID NO: 4406734 - DNA, 21 bp, Homo sapiens
tctcctggcctggccatctcc

SEQ ID NO: 4406735 - DNA, 16 bp, Homo sapiens
tctcctggctgtccta

SEQ ID NO: 4406736 - DNA, 18 bp, Homo sapiens
tctcctgggggtggcagg

SEQ ID NO: 4406737 - DNA, 21 bp, Homo sapiens
tctcctggtagaggggccggc

SEQ ID NO: 4406738 - DNA, 19 bp, Homo sapiens
tctcctgtaagccaaagaa

SEQ ID NO: 4406739 - DNA, 15 bp, Homo sapiens
tctcctgtcctccct

SEQ ID NO: 4406740 - DNA, 23 bp, Homo sapiens
tctcctgtgaatggaggcagaga

SEQ ID NO: 4406741 - DNA, 14 bp, Homo sapiens
tctccttatcttta

SEQ ID NO: 4406742 - DNA, 17 bp, Homo sapiens
tctccttcactctgaca

SEQ ID NO: 4406743 - DNA, 21 bp, Homo sapiens
tctccttcatgacagcctcca

SEQ ID NO: 4406744 - DNA, 14 bp, Homo sapiens
tctccttcccctac

SEQ ID NO: 4406745 - DNA, 13 bp, Homo sapiens
tctccttggaagg

SEQ ID NO: 4406746 - DNA, 14 bp, Homo sapiens
tctccttggaaggt

SEQ ID NO: 4406747 - DNA, 20 bp, Homo sapiens
tctccttggccacagactga

SEQ ID NO: 4406748 - DNA, 15 bp, Homo sapiens
tctcctttaattgta

SEQ ID NO: 4406749 - DNA, 22 bp, Homo sapiens
tctcctttaattgtaaagtaaa

SEQ ID NO: 4406750 - DNA, 20 bp, Homo sapiens
tctcctttctttttcttctt

SEQ ID NO: 4406751 - DNA, 13 bp, Homo sapiens
tctcgccaagcag

SEQ ID NO: 4406752 - DNA, 16 bp, Homo sapiens
tctcgccccttccctc

SEQ ID NO: 4406753 - DNA, 15 bp, Homo sapiens
tctcgcttccctgaa

SEQ ID NO: 4406754 - DNA, 18 bp, Homo sapiens
tctcggatgacaccctgg

SEQ ID NO: 4406755 - DNA, 19 bp, Homo sapiens
tctcggatgacaccctggc

SEQ ID NO: 4406756 - DNA, 22 bp, Homo sapiens
tctcggcatagtccccagagct

SEQ ID NO: 4406757 - DNA, 13 bp, Homo sapiens
tctcggcccctgt

SEQ ID NO: 4406758 - DNA, 15 bp, Homo sapiens
tctcggcccctgtct

SEQ ID NO: 4406759 - DNA, 21 bp, Homo sapiens
tctcgggtgcatttgagagaa

SEQ ID NO: 4406760 - DNA, 20 bp, Homo sapiens
tctcgtgagtcatttaaatg

SEQ ID NO: 4406761 - DNA, 13 bp, Homo sapiens
tctctaacatatg

SEQ ID NO: 4406762 - DNA, 17 bp, Homo sapiens
tctctaactcctgccat

SEQ ID NO: 4406763 - DNA, 20 bp, Homo sapiens
tctctaccaaaaaaaggaag

SEQ ID NO: 4406764 - DNA, 19 bp, Homo sapiens
tctctaccttttaaaattg

SEQ ID NO: 4406765 - DNA, 24 bp, Homo sapiens
tctctagcttaagtgtaaatgaag

SEQ ID NO: 4406766 - DNA, 13 bp, Homo sapiens
tctctagggaccc

SEQ ID NO: 4406767 - DNA, 14 bp, Homo sapiens
tctctagggacccc

SEQ ID NO: 4406768 - DNA, 21 bp, Homo sapiens
tctctagggacccctcgcccc

SEQ ID NO: 4406769 - DNA, 13 bp, Homo sapiens
tctctataaaaaa

SEQ ID NO: 4406770 - DNA, 20 bp, Homo sapiens
tctctataaagggtcaggcc

SEQ ID NO: 4406771 - DNA, 20 bp, Homo sapiens
tctctatgaaaagcacaagg

SEQ ID NO: 4406772 - DNA, 18 bp, Homo sapiens
tctctatttgaattattt

SEQ ID NO: 4406773 - DNA, 13 bp, Homo sapiens
tctctatttgaga

SEQ ID NO: 4406774 - DNA, 20 bp, Homo sapiens
tctctcaaaacaatattact

SEQ ID NO: 4406775 - DNA, 16 bp, Homo sapiens
tctctcacctgctccc

SEQ ID NO: 4406776 - DNA, 16 bp, Homo sapiens
tctctcatagaacatt

SEQ ID NO: 4406777 - DNA, 13 bp, Homo sapiens
tctctcatattcg

SEQ ID NO: 4406778 - DNA, 14 bp, Homo sapiens
tctctcatctctta

SEQ ID NO: 4406779 - DNA, 19 bp, Homo sapiens
tctctcatctcttagctcc

SEQ ID NO: 4406780 - DNA, 23 bp, Homo sapiens
tctctcatctcttagctcccctc

SEQ ID NO: 4406781 - DNA, 15 bp, Homo sapiens
tctctccagctgact

SEQ ID NO: 4406782 - DNA, 14 bp, Homo sapiens
tctctccattcccg

SEQ ID NO: 4406783 - DNA, 19 bp, Homo sapiens
tctctcccagtctacccag

SEQ ID NO: 4406784 - DNA, 20 bp, Homo sapiens
tctctcccatggagccccag

SEQ ID NO: 4406785 - DNA, 15 bp, Homo sapiens
tctctccccagcccc

SEQ ID NO: 4406786 - DNA, 18 bp, Homo sapiens
tctctccccatatataaa

SEQ ID NO: 4406787 - DNA, 12 bp, Homo sapiens
tctctccctgcc

SEQ ID NO: 4406788 - DNA, 13 bp, Homo sapiens
tctctccctgcct

SEQ ID NO: 4406789 - DNA, 12 bp, Homo sapiens
tctctcctctct

SEQ ID NO: 4406790 - DNA, 21 bp, Homo sapiens
tctctcctctctgcttcataa

SEQ ID NO: 4406791 - DNA, 12 bp, Homo sapiens
tctctcctggcc

SEQ ID NO: 4406792 - DNA, 22 bp, Homo sapiens
tctctcctttctttttcttctt

SEQ ID NO: 4406793 - DNA, 23 bp, Homo sapiens
tctctctcccatggagccccagc

SEQ ID NO: 4406794 - DNA, 12 bp, Homo sapiens
tctctctcctgt

SEQ ID NO: 4406795 - DNA, 15 bp, Homo sapiens
tctctctgcccactc

SEQ ID NO: 4406796 - DNA, 14 bp, Homo sapiens
tctctctgccctct

SEQ ID NO: 4406797 - DNA, 11 bp, Homo sapiens
tctctctgggc

SEQ ID NO: 4406798 - DNA, 21 bp, Homo sapiens
tctctctggggccctgggcct

SEQ ID NO: 4406799 - DNA, 11 bp, Homo sapiens
tctctctgtgg

SEQ ID NO: 4406800 - DNA, 13 bp, Homo sapiens
tctctctgttaca

SEQ ID NO: 4406801 - DNA, 16 bp, Homo sapiens
tctctcttcagactct

SEQ ID NO: 4406802 - DNA, 12 bp, Homo sapiens
tctctcttctct

SEQ ID NO: 4406803 - DNA, 19 bp, Homo sapiens
tctctcttctgctccaccc

SEQ ID NO: 4406804 - DNA, 16 bp, Homo sapiens
tctctcttgtcctctt

SEQ ID NO: 4406805 - DNA, 19 bp, Homo sapiens
tctctcttgtcctcttctg

SEQ ID NO: 4406806 - DNA, 18 bp, Homo sapiens
tctctctttaaccctccc

SEQ ID NO: 4406807 - DNA, 12 bp, Homo sapiens
tctctgaactgg

SEQ ID NO: 4406808 - DNA, 22 bp, Homo sapiens
tctctgaactggtagaaaaaca

SEQ ID NO: 4406809 - DNA, 16 bp, Homo sapiens
tctctgaatacacagt

SEQ ID NO: 4406810 - DNA, 13 bp, Homo sapiens
tctctgagaagca

SEQ ID NO: 4406811 - DNA, 14 bp, Homo sapiens
tctctgagcagtga

SEQ ID NO: 4406812 - DNA, 22 bp, Homo sapiens
tctctgagttctgtgtattttc

SEQ ID NO: 4406813 - DNA, 16 bp, Homo sapiens
tctctgatacacagta

SEQ ID NO: 4406814 - DNA, 14 bp, Homo sapiens
tctctgcaatttta

SEQ ID NO: 4406815 - DNA, 20 bp, Homo sapiens
tctctgcaattttactgtga

SEQ ID NO: 4406816 - DNA, 21 bp, Homo sapiens
tctctgcaattttactgtgaa

SEQ ID NO: 4406817 - DNA, 23 bp, Homo sapiens
tctctgcaattttactgtgaaaa

SEQ ID NO: 4406818 - DNA, 15 bp, Homo sapiens
tctctgcagccagcc

SEQ ID NO: 4406819 - DNA, 17 bp, Homo sapiens
tctctgcagccagccca

SEQ ID NO: 4406820 - DNA, 18 bp, Homo sapiens
tctctgcagccagcccag

SEQ ID NO: 4406821 - DNA, 18 bp, Homo sapiens
tctctgccattctgtgca

SEQ ID NO: 4406822 - DNA, 11 bp, Homo sapiens
tctctgccttt

SEQ ID NO: 4406823 - DNA, 13 bp, Homo sapiens
tctctgctatata

SEQ ID NO: 4406824 - DNA, 14 bp, Homo sapiens
tctctgctccacca

SEQ ID NO: 4406825 - DNA, 17 bp, Homo sapiens
tctctgctccaccacat

SEQ ID NO: 4406826 - DNA, 14 bp, Homo sapiens
tctctgctccctgc

SEQ ID NO: 4406827 - DNA, 14 bp, Homo sapiens
tctctggaaagagg

SEQ ID NO: 4406828 - DNA, 19 bp, Homo sapiens
tctctggaagcccctgggc

SEQ ID NO: 4406829 - DNA, 15 bp, Homo sapiens
tctctggcaccacac

SEQ ID NO: 4406830 - DNA, 17 bp, Homo sapiens
tctctggcaccacacta

SEQ ID NO: 4406831 - DNA, 19 bp, Homo sapiens
tctctgggactctcctcct

SEQ ID NO: 4406832 - DNA, 18 bp, Homo sapiens
tctctgggctgtcagctt

SEQ ID NO: 4406833 - DNA, 20 bp, Homo sapiens
tctctggggcaggctgcttc

SEQ ID NO: 4406834 - DNA, 23 bp, Homo sapiens
tctctggggccctgggcctcagt

SEQ ID NO: 4406835 - DNA, 16 bp, Homo sapiens
tctctgtacttttcat

SEQ ID NO: 4406836 - DNA, 21 bp, Homo sapiens
tctctgtacttttcattctct

SEQ ID NO: 4406837 - DNA, 14 bp, Homo sapiens
tctctgtccctgta

SEQ ID NO: 4406838 - DNA, 21 bp, Homo sapiens
tctctgtctcatccatcatca

SEQ ID NO: 4406839 - DNA, 16 bp, Homo sapiens
tctctgtgaaagcttt

SEQ ID NO: 4406840 - DNA, 21 bp, Homo sapiens
tctctgtgaagcctctctcct

SEQ ID NO: 4406841 - DNA, 14 bp, Homo sapiens
tctctgtgagactc

SEQ ID NO: 4406842 - DNA, 22 bp, Homo sapiens
tctctgtgagactcgagaactt

SEQ ID NO: 4406843 - DNA, 13 bp, Homo sapiens
tctctgttgtcgt

SEQ ID NO: 4406844 - DNA, 18 bp, Homo sapiens
tctcttaaatataacact

SEQ ID NO: 4406845 - DNA, 17 bp, Homo sapiens
tctcttagctcccctcc

SEQ ID NO: 4406846 - DNA, 19 bp, Homo sapiens
tctcttagctcccctccaa

SEQ ID NO: 4406847 - DNA, 14 bp, Homo sapiens
tctcttcaataaac

SEQ ID NO: 4406848 - DNA, 15 bp, Homo sapiens
tctcttcaataaacc

SEQ ID NO: 4406849 - DNA, 16 bp, Homo sapiens
tctcttcaataaacca

SEQ ID NO: 4406850 - DNA, 17 bp, Homo sapiens
tctcttcaataaaccac

SEQ ID NO: 4406851 - DNA, 17 bp, Homo sapiens
tctcttcagactctcag

SEQ ID NO: 4406852 - DNA, 22 bp, Homo sapiens
tctcttcagactctcagcccag

SEQ ID NO: 4406853 - DNA, 19 bp, Homo sapiens
tctcttcatgcttgacata

SEQ ID NO: 4406854 - DNA, 19 bp, Homo sapiens
tctcttccccttagaaaca

SEQ ID NO: 4406855 - DNA, 16 bp, Homo sapiens
tctcttccccttccct

SEQ ID NO: 4406856 - DNA, 21 bp, Homo sapiens
tctcttccctttgtgtatctt

SEQ ID NO: 4406857 - DNA, 20 bp, Homo sapiens
tctcttctgaataaagcaat

SEQ ID NO: 4406858 - DNA, 19 bp, Homo sapiens
tctcttctgctccaccctt

SEQ ID NO: 4406859 - DNA, 22 bp, Homo sapiens
tctcttcttccctgtcagcctg

SEQ ID NO: 4406860 - DNA, 15 bp, Homo sapiens
tctcttgagcatcaa

SEQ ID NO: 4406861 - DNA, 16 bp, Homo sapiens
tctcttgagcatcaat

SEQ ID NO: 4406862 - DNA, 22 bp, Homo sapiens
tctcttgagcatcaatcttgtt

SEQ ID NO: 4406863 - DNA, 21 bp, Homo sapiens
tctcttgccatttgtagcttt

SEQ ID NO: 4406864 - DNA, 16 bp, Homo sapiens
tctcttgcctcagcct

SEQ ID NO: 4406865 - DNA, 13 bp, Homo sapiens
tctcttgctttct

SEQ ID NO: 4406866 - DNA, 19 bp, Homo sapiens
tctcttggaaaataagaca

SEQ ID NO: 4406867 - DNA, 14 bp, Homo sapiens
tctcttgtaccata

SEQ ID NO: 4406868 - DNA, 13 bp, Homo sapiens
tctcttgtcctct

SEQ ID NO: 4406869 - DNA, 20 bp, Homo sapiens
tctcttgtcctcttctgctc

SEQ ID NO: 4406870 - DNA, 19 bp, Homo sapiens
tctctttatgtctgtggat

SEQ ID NO: 4406871 - DNA, 13 bp, Homo sapiens
tctctttcacaca

SEQ ID NO: 4406872 - DNA, 15 bp, Homo sapiens
tctctttcacacaat

SEQ ID NO: 4406873 - DNA, 13 bp, Homo sapiens
tctctttctcacc

SEQ ID NO: 4406874 - DNA, 13 bp, Homo sapiens
tctctttctctgg

SEQ ID NO: 4406875 - DNA, 14 bp, Homo sapiens
tctctttctctggt

SEQ ID NO: 4406876 - DNA, 17 bp, Homo sapiens
tctcttttattctgtta

SEQ ID NO: 4406877 - DNA, 12 bp, Homo sapiens
tctcttttccac

SEQ ID NO: 4406878 - DNA, 22 bp, Homo sapiens
tctcttttctacacactcagcc

SEQ ID NO: 4406879 - DNA, 21 bp, Homo sapiens
tctcttttctttctgtcttgt

SEQ ID NO: 4406880 - DNA, 12 bp, Homo sapiens
tctgaaaacaag

SEQ ID NO: 4406881 - DNA, 11 bp, Homo sapiens
tctgaaaacat

SEQ ID NO: 4406882 - DNA, 10 bp, Homo sapiens
tctgaaacag

SEQ ID NO: 4406883 - DNA, 15 bp, Homo sapiens
tctgaaacagctgcc

SEQ ID NO: 4406884 - DNA, 18 bp, Homo sapiens
tctgaaacagctgcctta

SEQ ID NO: 4406885 - DNA, 14 bp, Homo sapiens
tctgaaagccacgt

SEQ ID NO: 4406886 - DNA, 21 bp, Homo sapiens
tctgaaaggagacattgctct

SEQ ID NO: 4406887 - DNA, 23 bp, Homo sapiens
tctgaaaggagacattgctctat

SEQ ID NO: 4406888 - DNA, 21 bp, Homo sapiens
tctgaaaggctatcctgctga

SEQ ID NO: 4406889 - DNA, 22 bp, Homo sapiens
tctgaacaattgtggtctctct

SEQ ID NO: 4406890 - DNA, 13 bp, Homo sapiens
tctgaactaaagt

SEQ ID NO: 4406891 - DNA, 12 bp, Homo sapiens
tctgaactcaaa

SEQ ID NO: 4406892 - DNA, 18 bp, Homo sapiens
tctgaactgttacaactt

SEQ ID NO: 4406893 - DNA, 15 bp, Homo sapiens
tctgaagaaaaatta

SEQ ID NO: 4406894 - DNA, 21 bp, Homo sapiens
tctgaagaaggaaggcctgag

SEQ ID NO: 4406895 - DNA, 19 bp, Homo sapiens
tctgaagaggcttctcctg

SEQ ID NO: 4406896 - DNA, 16 bp, Homo sapiens
tctgaagcctctggga

SEQ ID NO: 4406897 - DNA, 14 bp, Homo sapiens
tctgaaggaagaga

SEQ ID NO: 4406898 - DNA, 15 bp, Homo sapiens
tctgaaggaagagaa

SEQ ID NO: 4406899 - DNA, 16 bp, Homo sapiens
tctgaaggaagagaag

SEQ ID NO: 4406900 - DNA, 19 bp, Homo sapiens
tctgaaggaagagaagaca

SEQ ID NO: 4406901 - DNA, 21 bp, Homo sapiens
tctgaaggagccccattcctg

SEQ ID NO: 4406902 - DNA, 19 bp, Homo sapiens
tctgaaggggcaaattctt

SEQ ID NO: 4406903 - DNA, 21 bp, Homo sapiens
tctgaagtacaaacatgaaaa

SEQ ID NO: 4406904 - DNA, 14 bp, Homo sapiens
tctgaataaagcaa

SEQ ID NO: 4406905 - DNA, 15 bp, Homo sapiens
tctgaatcaccaatt

SEQ ID NO: 4406906 - DNA, 18 bp, Homo sapiens
tctgaatctagagaacag

SEQ ID NO: 4406907 - DNA, 12 bp, Homo sapiens
tctgaatgtaat

SEQ ID NO: 4406908 - DNA, 20 bp, Homo sapiens
tctgaatgtaatttgtgtaa

SEQ ID NO: 4406909 - DNA, 21 bp, Homo sapiens
tctgaatgtaatttgtgtaat

SEQ ID NO: 4406910 - DNA, 23 bp, Homo sapiens
tctgaatgtaatttgtgtaataa

SEQ ID NO: 4406911 - DNA, 20 bp, Homo sapiens
tctgaattatttttaaagat

SEQ ID NO: 4406912 - DNA, 21 bp, Homo sapiens
tctgaatttgcaaagtactgt

SEQ ID NO: 4406913 - DNA, 21 bp, Homo sapiens
tctgacaattaacatacatca

SEQ ID NO: 4406914 - DNA, 18 bp, Homo sapiens
tctgacaggtgaattgga

SEQ ID NO: 4406915 - DNA, 19 bp, Homo sapiens
tctgacagtattaacatca

SEQ ID NO: 4406916 - DNA, 18 bp, Homo sapiens
tctgacagtccacagggg

SEQ ID NO: 4406917 - DNA, 20 bp, Homo sapiens
tctgacagtccacaggggcc

SEQ ID NO: 4406918 - DNA, 16 bp, Homo sapiens
tctgacatcaaaactt

SEQ ID NO: 4406919 - DNA, 23 bp, Homo sapiens
tctgacatgtaagaaaatgttac

SEQ ID NO: 4406920 - DNA, 15 bp, Homo sapiens
tctgaccgattcctt

SEQ ID NO: 4406921 - DNA, 17 bp, Homo sapiens
tctgaccgattccttta

SEQ ID NO: 4406922 - DNA, 18 bp, Homo sapiens
tctgaccttccagagccc

SEQ ID NO: 4406923 - DNA, 13 bp, Homo sapiens
tctgactcagggc

SEQ ID NO: 4406924 - DNA, 15 bp, Homo sapiens
tctgactcagggctc

SEQ ID NO: 4406925 - DNA, 17 bp, Homo sapiens
tctgactgccccctcct

SEQ ID NO: 4406926 - DNA, 15 bp, Homo sapiens
tctgacttcctctga

SEQ ID NO: 4406927 - DNA, 15 bp, Homo sapiens
tctgagaaagactat

SEQ ID NO: 4406928 - DNA, 19 bp, Homo sapiens
tctgagaaagactattcaa

SEQ ID NO: 4406929 - DNA, 20 bp, Homo sapiens
tctgagaaagactattcaaa

SEQ ID NO: 4406930 - DNA, 11 bp, Homo sapiens
tctgagaagac

SEQ ID NO: 4406931 - DNA, 16 bp, Homo sapiens
tctgagaagctctgaa

SEQ ID NO: 4406932 - DNA, 20 bp, Homo sapiens
tctgagagaggccattcttt

SEQ ID NO: 4406933 - DNA, 15 bp, Homo sapiens
tctgagagtcattca

SEQ ID NO: 4406934 - DNA, 17 bp, Homo sapiens
tctgagcaaaggccctg

SEQ ID NO: 4406935 - DNA, 22 bp, Homo sapiens
tctgagcaaggagtttaaatga

SEQ ID NO: 4406936 - DNA, 22 bp, Homo sapiens
tctgagcaccgaatattgagca

SEQ ID NO: 4406937 - DNA, 19 bp, Homo sapiens
tctgagcagtgaatgattc

SEQ ID NO: 4406938 - DNA, 12 bp, Homo sapiens
tctgagccacag

SEQ ID NO: 4406939 - DNA, 15 bp, Homo sapiens
tctgagccacagcag

SEQ ID NO: 4406940 - DNA, 19 bp, Homo sapiens
tctgagccacagcagcatt

SEQ ID NO: 4406941 - DNA, 18 bp, Homo sapiens
tctgagccagattacagg

SEQ ID NO: 4406942 - DNA, 17 bp, Homo sapiens
tctgagctatttcatct

SEQ ID NO: 4406943 - DNA, 20 bp, Homo sapiens
tctgagctatttcatctatt

SEQ ID NO: 4406944 - DNA, 22 bp, Homo sapiens
tctgagctatttcatctatttt

SEQ ID NO: 4406945 - DNA, 16 bp, Homo sapiens
tctgaggagtaaaaag

SEQ ID NO: 4406946 - DNA, 13 bp, Homo sapiens
tctgaggcccctg

SEQ ID NO: 4406947 - DNA, 14 bp, Homo sapiens
tctgaggccctgcc

SEQ ID NO: 4406948 - DNA, 17 bp, Homo sapiens
tctgagtagtggccact

SEQ ID NO: 4406949 - DNA, 20 bp, Homo sapiens
tctgagtagtggccactggg

SEQ ID NO: 4406950 - DNA, 15 bp, Homo sapiens
tctgagtccagctcc

SEQ ID NO: 4406951 - DNA, 12 bp, Homo sapiens
tctgagtcctgt

SEQ ID NO: 4406952 - DNA, 16 bp, Homo sapiens
tctgagtcctgtctct

SEQ ID NO: 4406953 - DNA, 18 bp, Homo sapiens
tctgagtcctgtctctgc

SEQ ID NO: 4406954 - DNA, 21 bp, Homo sapiens
tctgagtcctgtctctgcctg

SEQ ID NO: 4406955 - DNA, 17 bp, Homo sapiens
tctgagtctgagtcctg

SEQ ID NO: 4406956 - DNA, 13 bp, Homo sapiens
tctgagtgagttt

SEQ ID NO: 4406957 - DNA, 22 bp, Homo sapiens
tctgagtgccttctgtggggac

SEQ ID NO: 4406958 - DNA, 13 bp, Homo sapiens
tctgatacacagt

SEQ ID NO: 4406959 - DNA, 20 bp, Homo sapiens
tctgatgaaatgttaacaat

SEQ ID NO: 4406960 - DNA, 20 bp, Homo sapiens
tctgatggaactgtgtattt

SEQ ID NO: 4406961 - DNA, 22 bp, Homo sapiens
tctgatggaactgtgtatttat

SEQ ID NO: 4406962 - DNA, 23 bp, Homo sapiens
tctgatggccttaatttcctttt

SEQ ID NO: 4406963 - DNA, 19 bp, Homo sapiens
tctgatgttctttccatga

SEQ ID NO: 4406964 - DNA, 15 bp, Homo sapiens
tctgattaagcattc

SEQ ID NO: 4406965 - DNA, 15 bp, Homo sapiens
tctgattaatccatt

SEQ ID NO: 4406966 - DNA, 22 bp, Homo sapiens
tctgattataccatgtgtgcta

SEQ ID NO: 4406967 - DNA, 19 bp, Homo sapiens
tctgatttcataattcaga

SEQ ID NO: 4406968 - DNA, 12 bp, Homo sapiens
tctgatttctga

SEQ ID NO: 4406969 - DNA, 18 bp, Homo sapiens
tctgatttctgcccttgt

SEQ ID NO: 4406970 - DNA, 20 bp, Homo sapiens
tctgatttttaagatttcct

SEQ ID NO: 4406971 - DNA, 15 bp, Homo sapiens
tctgcaactccatcc

SEQ ID NO: 4406972 - DNA, 16 bp, Homo sapiens
tctgcaattttactgt

SEQ ID NO: 4406973 - DNA, 14 bp, Homo sapiens
tctgcacacaaata

SEQ ID NO: 4406974 - DNA, 16 bp, Homo sapiens
tctgcacacaaatatt

SEQ ID NO: 4406975 - DNA, 23 bp, Homo sapiens
tctgcacaccttgaatctgcctg

SEQ ID NO: 4406976 - DNA, 14 bp, Homo sapiens
tctgcacagtcaga

SEQ ID NO: 4406977 - DNA, 19 bp, Homo sapiens
tctgcacagtcagaaggac

SEQ ID NO: 4406978 - DNA, 22 bp, Homo sapiens
tctgcacatctgtaaatctaca

SEQ ID NO: 4406979 - DNA, 14 bp, Homo sapiens
tctgcacccagaac

SEQ ID NO: 4406980 - DNA, 23 bp, Homo sapiens
tctgcactactcctctgcagtgc

SEQ ID NO: 4406981 - DNA, 15 bp, Homo sapiens
tctgcactcagaaaa

SEQ ID NO: 4406982 - DNA, 16 bp, Homo sapiens
tctgcactcagaaaat

SEQ ID NO: 4406983 - DNA, 15 bp, Homo sapiens
tctgcagacctggtt

SEQ ID NO: 4406984 - DNA, 19 bp, Homo sapiens
tctgcagacttcccagcta

SEQ ID NO: 4406985 - DNA, 16 bp, Homo sapiens
tctgcagcaactccca

SEQ ID NO: 4406986 - DNA, 17 bp, Homo sapiens
tctgcagcaactcccac

SEQ ID NO: 4406987 - DNA, 15 bp, Homo sapiens
tctgcagccagccca

SEQ ID NO: 4406988 - DNA, 19 bp, Homo sapiens
tctgcagccagcccagccc

SEQ ID NO: 4406989 - DNA, 18 bp, Homo sapiens
tctgcaggctggggaggt

SEQ ID NO: 4406990 - DNA, 15 bp, Homo sapiens
tctgcagtaaatctt

SEQ ID NO: 4406991 - DNA, 16 bp, Homo sapiens
tctgcagtaaatcttt

SEQ ID NO: 4406992 - DNA, 13 bp, Homo sapiens
tctgcagtgcctt

SEQ ID NO: 4406993 - DNA, 15 bp, Homo sapiens
tctgcatagacaaag

SEQ ID NO: 4406994 - DNA, 16 bp, Homo sapiens
tctgcatatgttgaat

SEQ ID NO: 4406995 - DNA, 18 bp, Homo sapiens
tctgcatatgttgaatac

SEQ ID NO: 4406996 - DNA, 19 bp, Homo sapiens
tctgcatatgttgaatact

SEQ ID NO: 4406997 - DNA, 17 bp, Homo sapiens
tctgcatgcggcccagc

SEQ ID NO: 4406998 - DNA, 19 bp, Homo sapiens
tctgcatgcggcccagccc

SEQ ID NO: 4406999 - DNA, 16 bp, Homo sapiens
tctgcattcattttta

SEQ ID NO: 4407000 - DNA, 14 bp, Homo sapiens
tctgccaaaataaa

SEQ ID NO: 4407001 - DNA, 18 bp, Homo sapiens
tctgccaaaatgcaacat

SEQ ID NO: 4407002 - DNA, 16 bp, Homo sapiens
tctgccaagtcagttc

SEQ ID NO: 4407003 - DNA, 15 bp, Homo sapiens
tctgccaccagcccc

SEQ ID NO: 4407004 - DNA, 20 bp, Homo sapiens
tctgccaccagcccctcccc

SEQ ID NO: 4407005 - DNA, 16 bp, Homo sapiens
tctgccacttgtcaaa

SEQ ID NO: 4407006 - DNA, 21 bp, Homo sapiens
tctgccagaagatcccctcag

SEQ ID NO: 4407007 - DNA, 14 bp, Homo sapiens
tctgccagggagct

SEQ ID NO: 4407008 - DNA, 23 bp, Homo sapiens
tctgccattgggaccctccagtg

SEQ ID NO: 4407009 - DNA, 24 bp, Homo sapiens
tctgccattgggaccctccagtgc

SEQ ID NO: 4407010 - DNA, 23 bp, Homo sapiens
tctgccccaatcgggtccagaga

SEQ ID NO: 4407011 - DNA, 11 bp, Homo sapiens
tctgccccagg

SEQ ID NO: 4407012 - DNA, 21 bp, Homo sapiens
tctgccccaggtacacctccc

SEQ ID NO: 4407013 - DNA, 21 bp, Homo sapiens
tctgcccccgcgggttctaga

SEQ ID NO: 4407014 - DNA, 23 bp, Homo sapiens
tctgcccccgcgggttctagacg

SEQ ID NO: 4407015 - DNA, 15 bp, Homo sapiens
tctgccccctccccc

SEQ ID NO: 4407016 - DNA, 23 bp, Homo sapiens
tctgccccctcccccatgggctg

SEQ ID NO: 4407017 - DNA, 14 bp, Homo sapiens
tctgccccctgctg

SEQ ID NO: 4407018 - DNA, 15 bp, Homo sapiens
tctgcccctccccca

SEQ ID NO: 4407019 - DNA, 22 bp, Homo sapiens
tctgcccctcccccaaccccca

SEQ ID NO: 4407020 - DNA, 13 bp, Homo sapiens
tctgcccctgcag

SEQ ID NO: 4407021 - DNA, 14 bp, Homo sapiens
tctgcccctgcagc

SEQ ID NO: 4407022 - DNA, 19 bp, Homo sapiens
tctgcccctggacctggga

SEQ ID NO: 4407023 - DNA, 10 bp, Homo sapiens
tctgcccggg

SEQ ID NO: 4407024 - DNA, 16 bp, Homo sapiens
tctgccctctccctgt

SEQ ID NO: 4407025 - DNA, 12 bp, Homo sapiens
tctgccctggat

SEQ ID NO: 4407026 - DNA, 13 bp, Homo sapiens
tctgccctggctg

SEQ ID NO: 4407027 - DNA, 16 bp, Homo sapiens
tctgccctggctgctg

SEQ ID NO: 4407028 - DNA, 16 bp, Homo sapiens
tctgcccttcacccca

SEQ ID NO: 4407029 - DNA, 16 bp, Homo sapiens
tctgccgattttgtaa

SEQ ID NO: 4407030 - DNA, 20 bp, Homo sapiens
tctgccgattttgtaaatgt

SEQ ID NO: 4407031 - DNA, 15 bp, Homo sapiens
tctgcctatgcactg

SEQ ID NO: 4407032 - DNA, 20 bp, Homo sapiens
tctgcctatgcactgaagag

SEQ ID NO: 4407033 - DNA, 18 bp, Homo sapiens
tctgcctctaagctgctc

SEQ ID NO: 4407034 - DNA, 19 bp, Homo sapiens
tctgcctcttctgggaggg

SEQ ID NO: 4407035 - DNA, 17 bp, Homo sapiens
tctgcctggttttattt

SEQ ID NO: 4407036 - DNA, 19 bp, Homo sapiens
tctgcctgttataactctg

SEQ ID NO: 4407037 - DNA, 20 bp, Homo sapiens
tctgccttcacaaatgtcat

SEQ ID NO: 4407038 - DNA, 13 bp, Homo sapiens
tctgccttgccct

SEQ ID NO: 4407039 - DNA, 17 bp, Homo sapiens
tctgccttgccctcctg

SEQ ID NO: 4407040 - DNA, 19 bp, Homo sapiens
tctgccttgccctcctggg

SEQ ID NO: 4407041 - DNA, 20 bp, Homo sapiens
tctgccttgccctcctgggc

SEQ ID NO: 4407042 - DNA, 19 bp, Homo sapiens
tctgccttggattcctaga

SEQ ID NO: 4407043 - DNA, 15 bp, Homo sapiens
tctgccttggcatcc

SEQ ID NO: 4407044 - DNA, 22 bp, Homo sapiens
tctgcctttggggacttttctt

SEQ ID NO: 4407045 - DNA, 14 bp, Homo sapiens
tctgcggagcacac

SEQ ID NO: 4407046 - DNA, 20 bp, Homo sapiens
tctgcgggaggctggggccc

SEQ ID NO: 4407047 - DNA, 22 bp, Homo sapiens
tctgcggggggtgtcttccctg

SEQ ID NO: 4407048 - DNA, 18 bp, Homo sapiens
tctgctacttcactgtca

SEQ ID NO: 4407049 - DNA, 21 bp, Homo sapiens
tctgctcaccgcccatcaggg

SEQ ID NO: 4407050 - DNA, 12 bp, Homo sapiens
tctgctcatcat

SEQ ID NO: 4407051 - DNA, 14 bp, Homo sapiens
tctgctcatcattc

SEQ ID NO: 4407052 - DNA, 15 bp, Homo sapiens
tctgctcatcattct

SEQ ID NO: 4407053 - DNA, 10 bp, Homo sapiens
tctgctccac

SEQ ID NO: 4407054 - DNA, 17 bp, Homo sapiens
tctgctccacccttggc

SEQ ID NO: 4407055 - DNA, 19 bp, Homo sapiens
tctgctccacccttggcct

SEQ ID NO: 4407056 - DNA, 14 bp, Homo sapiens
tctgctctccttcc

SEQ ID NO: 4407057 - DNA, 15 bp, Homo sapiens
tctgctctccttcct

SEQ ID NO: 4407058 - DNA, 20 bp, Homo sapiens
tctgctctccttcctggagc

SEQ ID NO: 4407059 - DNA, 13 bp, Homo sapiens
tctgctctggaat

SEQ ID NO: 4407060 - DNA, 23 bp, Homo sapiens
tctgctgcatcgctgttctgggc

SEQ ID NO: 4407061 - DNA, 13 bp, Homo sapiens
tctgctgcttttg

SEQ ID NO: 4407062 - DNA, 20 bp, Homo sapiens
tctgctgcttttggggaatg

SEQ ID NO: 4407063 - DNA, 21 bp, Homo sapiens
tctgctggagaaagccacgcc

SEQ ID NO: 4407064 - DNA, 14 bp, Homo sapiens
tctgctggctcagg

SEQ ID NO: 4407065 - DNA, 16 bp, Homo sapiens
tctgctgtacagatat

SEQ ID NO: 4407066 - DNA, 12 bp, Homo sapiens
tctgctgtagaa

SEQ ID NO: 4407067 - DNA, 13 bp, Homo sapiens
tctgctgttaact

SEQ ID NO: 4407068 - DNA, 16 bp, Homo sapiens
tctgctgttccagtgg

SEQ ID NO: 4407069 - DNA, 19 bp, Homo sapiens
tctgcttgttattagagat

SEQ ID NO: 4407070 - DNA, 13 bp, Homo sapiens
tctgctttctcta

SEQ ID NO: 4407071 - DNA, 20 bp, Homo sapiens
tctgctttgctcttcaagaa

SEQ ID NO: 4407072 - DNA, 17 bp, Homo sapiens
tctgcttttaagttttt

SEQ ID NO: 4407073 - DNA, 13 bp, Homo sapiens
tctgcttttatct

SEQ ID NO: 4407074 - DNA, 16 bp, Homo sapiens
tctgcttttcctctgc

SEQ ID NO: 4407075 - DNA, 15 bp, Homo sapiens
tctgcttttctgccc

SEQ ID NO: 4407076 - DNA, 20 bp, Homo sapiens
tctgcttttctgccctggct

SEQ ID NO: 4407077 - DNA, 21 bp, Homo sapiens
tctgcttttctgccctggctg

SEQ ID NO: 4407078 - DNA, 15 bp, Homo sapiens
tctgctttttctgta

SEQ ID NO: 4407079 - DNA, 15 bp, Homo sapiens
tctggaaagaggctc

SEQ ID NO: 4407080 - DNA, 15 bp, Homo sapiens
tctggaagacgtggc

SEQ ID NO: 4407081 - DNA, 14 bp, Homo sapiens
tctggaagcaaatg

SEQ ID NO: 4407082 - DNA, 17 bp, Homo sapiens
tctggaagcccctgggc

SEQ ID NO: 4407083 - DNA, 16 bp, Homo sapiens
tctggaagtttctggt

SEQ ID NO: 4407084 - DNA, 18 bp, Homo sapiens
tctggaataaagttgcag

SEQ ID NO: 4407085 - DNA, 14 bp, Homo sapiens
tctggacacactgt

SEQ ID NO: 4407086 - DNA, 13 bp, Homo sapiens
tctggacagccag

SEQ ID NO: 4407087 - DNA, 17 bp, Homo sapiens
tctggacagccagtgac

SEQ ID NO: 4407088 - DNA, 15 bp, Homo sapiens
tctggacagtacctg

SEQ ID NO: 4407089 - DNA, 23 bp, Homo sapiens
tctggacagtacctgattgtatt

SEQ ID NO: 4407090 - DNA, 15 bp, Homo sapiens
tctggacggcaggct

SEQ ID NO: 4407091 - DNA, 23 bp, Homo sapiens
tctggacggcaggctcactgcca

SEQ ID NO: 4407092 - DNA, 16 bp, Homo sapiens
tctggactctgcccca

SEQ ID NO: 4407093 - DNA, 17 bp, Homo sapiens
tctggactctgccccaa

SEQ ID NO: 4407094 - DNA, 11 bp, Homo sapiens
tctggagaagc

SEQ ID NO: 4407095 - DNA, 16 bp, Homo sapiens
tctggagaagcagtga

SEQ ID NO: 4407096 - DNA, 24 bp, Homo sapiens
tctggagtttttgtttggagagca

SEQ ID NO: 4407097 - DNA, 13 bp, Homo sapiens
tctggatcagtaa

SEQ ID NO: 4407098 - DNA, 14 bp, Homo sapiens
tctggatctgggac

SEQ ID NO: 4407099 - DNA, 13 bp, Homo sapiens
tctggattcaaat

SEQ ID NO: 4407100 - DNA, 16 bp, Homo sapiens
tctggattcatattta

SEQ ID NO: 4407101 - DNA, 19 bp, Homo sapiens
tctggcaaaaaggagcctt

SEQ ID NO: 4407102 - DNA, 18 bp, Homo sapiens
tctggcaaacttttcttt

SEQ ID NO: 4407103 - DNA, 22 bp, Homo sapiens
tctggcacagcctggctgtggc

SEQ ID NO: 4407104 - DNA, 20 bp, Homo sapiens
tctggcagggtgggatggag

SEQ ID NO: 4407105 - DNA, 22 bp, Homo sapiens
tctggcaggtcctcccctctct

SEQ ID NO: 4407106 - DNA, 16 bp, Homo sapiens
tctggcatggctccct

SEQ ID NO: 4407107 - DNA, 13 bp, Homo sapiens
tctggcccctcac

SEQ ID NO: 4407108 - DNA, 15 bp, Homo sapiens
tctggcctttcatgg

SEQ ID NO: 4407109 - DNA, 17 bp, Homo sapiens
tctggctagaggccagc

SEQ ID NO: 4407110 - DNA, 15 bp, Homo sapiens
tctggctctaattca

SEQ ID NO: 4407111 - DNA, 20 bp, Homo sapiens
tctggctctaattcacagtg

SEQ ID NO: 4407112 - DNA, 22 bp, Homo sapiens
tctggctctaattcacagtgct

SEQ ID NO: 4407113 - DNA, 17 bp, Homo sapiens
tctggctggaatagtaa

SEQ ID NO: 4407114 - DNA, 13 bp, Homo sapiens
tctggcttagtgc

SEQ ID NO: 4407115 - DNA, 13 bp, Homo sapiens
tctggcttctgca

SEQ ID NO: 4407116 - DNA, 14 bp, Homo sapiens
tctggcttgactgg

SEQ ID NO: 4407117 - DNA, 16 bp, Homo sapiens
tctggctttggcactc

SEQ ID NO: 4407118 - DNA, 20 bp, Homo sapiens
tctggctttggcactctctg

SEQ ID NO: 4407119 - DNA, 23 bp, Homo sapiens
tctggcttttcgcttgcttctgc

SEQ ID NO: 4407120 - DNA, 12 bp, Homo sapiens
tctgggaaggga

SEQ ID NO: 4407121 - DNA, 13 bp, Homo sapiens
tctgggaagggag

SEQ ID NO: 4407122 - DNA, 19 bp, Homo sapiens
tctgggaccctttccttcc

SEQ ID NO: 4407123 - DNA, 22 bp, Homo sapiens
tctgggacctgccaggcagggg

SEQ ID NO: 4407124 - DNA, 17 bp, Homo sapiens
tctgggactctcctcct

SEQ ID NO: 4407125 - DNA, 19 bp, Homo sapiens
tctgggactgtgcctggct

SEQ ID NO: 4407126 - DNA, 20 bp, Homo sapiens
tctgggactgtgcctggctc

SEQ ID NO: 4407127 - DNA, 18 bp, Homo sapiens
tctgggagaccctgaact

SEQ ID NO: 4407128 - DNA, 23 bp, Homo sapiens
tctgggagtaatactttttaaat

SEQ ID NO: 4407129 - DNA, 17 bp, Homo sapiens
tctgggagtcacacagt

SEQ ID NO: 4407130 - DNA, 18 bp, Homo sapiens
tctgggagtcacacagtg

SEQ ID NO: 4407131 - DNA, 18 bp, Homo sapiens
tctgggcaccacaaaata

SEQ ID NO: 4407132 - DNA, 21 bp, Homo sapiens
tctgggcacgcctgctggccg

SEQ ID NO: 4407133 - DNA, 20 bp, Homo sapiens
tctgggcagcacctctggtc

SEQ ID NO: 4407134 - DNA, 21 bp, Homo sapiens
tctgggcagcacctctggtca

SEQ ID NO: 4407135 - DNA, 20 bp, Homo sapiens
tctgggcatggcagggccag

SEQ ID NO: 4407136 - DNA, 17 bp, Homo sapiens
tctgggcattttcctcc

SEQ ID NO: 4407137 - DNA, 20 bp, Homo sapiens
tctgggccctgtcgcccctc

SEQ ID NO: 4407138 - DNA, 13 bp, Homo sapiens
tctgggctggggc

SEQ ID NO: 4407139 - DNA, 14 bp, Homo sapiens
tctgggctgtgggc

SEQ ID NO: 4407140 - DNA, 20 bp, Homo sapiens
tctggggacctggtttgaat

SEQ ID NO: 4407141 - DNA, 23 bp, Homo sapiens
tctggggcagcaccctataaatc

SEQ ID NO: 4407142 - DNA, 20 bp, Homo sapiens
tctggggcaggctgggccat

SEQ ID NO: 4407143 - DNA, 21 bp, Homo sapiens
tctggggttcagcccctcctc

SEQ ID NO: 4407144 - DNA, 22 bp, Homo sapiens
tctggggttcagcccctcctct

SEQ ID NO: 4407145 - DNA, 14 bp, Homo sapiens
tctgggtctggcca

SEQ ID NO: 4407146 - DNA, 23 bp, Homo sapiens
tctgggtgatggaaactgccaaa

SEQ ID NO: 4407147 - DNA, 20 bp, Homo sapiens
tctgggtgttgaccactcca

SEQ ID NO: 4407148 - DNA, 14 bp, Homo sapiens
tctgggtttctaag

SEQ ID NO: 4407149 - DNA, 14 bp, Homo sapiens
tctgggtttctaga

SEQ ID NO: 4407150 - DNA, 14 bp, Homo sapiens
tctggtcccttgca

SEQ ID NO: 4407151 - DNA, 18 bp, Homo sapiens
tctggtccggacactcct

SEQ ID NO: 4407152 - DNA, 17 bp, Homo sapiens
tctggtgagtcaccact

SEQ ID NO: 4407153 - DNA, 16 bp, Homo sapiens
tctggtgcctcctcaa

SEQ ID NO: 4407154 - DNA, 17 bp, Homo sapiens
tctggtgctcctgcatc

SEQ ID NO: 4407155 - DNA, 15 bp, Homo sapiens
tctggtggtcttcct

SEQ ID NO: 4407156 - DNA, 13 bp, Homo sapiens
tctggtgttgact

SEQ ID NO: 4407157 - DNA, 20 bp, Homo sapiens
tctggttatttttctcttgt

SEQ ID NO: 4407158 - DNA, 12 bp, Homo sapiens
tctggttgcctc

SEQ ID NO: 4407159 - DNA, 16 bp, Homo sapiens
tctggttgtttctgtt

SEQ ID NO: 4407160 - DNA, 17 bp, Homo sapiens
tctggttgtttctgttc

SEQ ID NO: 4407161 - DNA, 14 bp, Homo sapiens
tctgtaaaaaatgg

SEQ ID NO: 4407162 - DNA, 19 bp, Homo sapiens
tctgtaaaaaatggagctc

SEQ ID NO: 4407163 - DNA, 20 bp, Homo sapiens
tctgtaaaaaatggagctca

SEQ ID NO: 4407164 - DNA, 15 bp, Homo sapiens
tctgtaaactgtgta

SEQ ID NO: 4407165 - DNA, 16 bp, Homo sapiens
tctgtaaactgtgtat

SEQ ID NO: 4407166 - DNA, 10 bp, Homo sapiens
tctgtaaatt

SEQ ID NO: 4407167 - DNA, 17 bp, Homo sapiens
tctgtaaattcatattt

SEQ ID NO: 4407168 - DNA, 14 bp, Homo sapiens
tctgtaataaaact

SEQ ID NO: 4407169 - DNA, 18 bp, Homo sapiens
tctgtaatatttacaatg

SEQ ID NO: 4407170 - DNA, 16 bp, Homo sapiens
tctgtaattcaggttt

SEQ ID NO: 4407171 - DNA, 13 bp, Homo sapiens
tctgtaattgtgt

SEQ ID NO: 4407172 - DNA, 13 bp, Homo sapiens
tctgtaatttgaa

SEQ ID NO: 4407173 - DNA, 14 bp, Homo sapiens
tctgtaatttgaat

SEQ ID NO: 4407174 - DNA, 13 bp, Homo sapiens
tctgtaattttac

SEQ ID NO: 4407175 - DNA, 20 bp, Homo sapiens
tctgtacaaataatagcaat

SEQ ID NO: 4407176 - DNA, 13 bp, Homo sapiens
tctgtacagcaag

SEQ ID NO: 4407177 - DNA, 14 bp, Homo sapiens
tctgtacatttgca

SEQ ID NO: 4407178 - DNA, 14 bp, Homo sapiens
tctgtacttttcat

SEQ ID NO: 4407179 - DNA, 19 bp, Homo sapiens
tctgtagcttatctgcccc

SEQ ID NO: 4407180 - DNA, 16 bp, Homo sapiens
tctgtagtaatttatt

SEQ ID NO: 4407181 - DNA, 23 bp, Homo sapiens
tctgtagtgtattaatctctgtg

SEQ ID NO: 4407182 - DNA, 17 bp, Homo sapiens
tctgtataatctattta

SEQ ID NO: 4407183 - DNA, 15 bp, Homo sapiens
tctgtatactcctgt

SEQ ID NO: 4407184 - DNA, 16 bp, Homo sapiens
tctgtatactcctgtc

SEQ ID NO: 4407185 - DNA, 15 bp, Homo sapiens
tctgtatatactttt

SEQ ID NO: 4407186 - DNA, 19 bp, Homo sapiens
tctgtattaaatattttca

SEQ ID NO: 4407187 - DNA, 20 bp, Homo sapiens
tctgtcacataaaagtctgt

SEQ ID NO: 4407188 - DNA, 22 bp, Homo sapiens
tctgtcagccagccgccctggg

SEQ ID NO: 4407189 - DNA, 13 bp, Homo sapiens
tctgtcagctgca

SEQ ID NO: 4407190 - DNA, 19 bp, Homo sapiens
tctgtcaggggcttggatt

SEQ ID NO: 4407191 - DNA, 15 bp, Homo sapiens
tctgtcagtaaaact

SEQ ID NO: 4407192 - DNA, 20 bp, Homo sapiens
tctgtcagtaaaactctcaa

SEQ ID NO: 4407193 - DNA, 13 bp, Homo sapiens
tctgtcatctctc

SEQ ID NO: 4407194 - DNA, 16 bp, Homo sapiens
tctgtcatctctctgg

SEQ ID NO: 4407195 - DNA, 21 bp, Homo sapiens
tctgtcatctctctggggccc

SEQ ID NO: 4407196 - DNA, 16 bp, Homo sapiens
tctgtccaaaggaggc

SEQ ID NO: 4407197 - DNA, 17 bp, Homo sapiens
tctgtccaaaggaggct

SEQ ID NO: 4407198 - DNA, 16 bp, Homo sapiens
tctgtcccccaggctg

SEQ ID NO: 4407199 - DNA, 15 bp, Homo sapiens
tctgtccccttctct

SEQ ID NO: 4407200 - DNA, 19 bp, Homo sapiens
tctgtccccttctctcatc

SEQ ID NO: 4407201 - DNA, 20 bp, Homo sapiens
tctgtccccttctctcatct

SEQ ID NO: 4407202 - DNA, 22 bp, Homo sapiens
tctgtccccttctctcatctct

SEQ ID NO: 4407203 - DNA, 22 bp, Homo sapiens
tctgtccctattatttgcccta

SEQ ID NO: 4407204 - DNA, 15 bp, Homo sapiens
tctgtcgcccaggct

SEQ ID NO: 4407205 - DNA, 14 bp, Homo sapiens
tctgtctacatttc

SEQ ID NO: 4407206 - DNA, 20 bp, Homo sapiens
tctgtctaggttaaagctaa

SEQ ID NO: 4407207 - DNA, 14 bp, Homo sapiens
tctgtctcaaaaaa

SEQ ID NO: 4407208 - DNA, 23 bp, Homo sapiens
tctgtctcaaaaaaaaaaagaaa

SEQ ID NO: 4407209 - DNA, 13 bp, Homo sapiens
tctgtctcatcca

SEQ ID NO: 4407210 - DNA, 21 bp, Homo sapiens
tctgtctcatccatcatcatg

SEQ ID NO: 4407211 - DNA, 17 bp, Homo sapiens
tctgtctccaagacctt

SEQ ID NO: 4407212 - DNA, 14 bp, Homo sapiens
tctgtctgctttgg

SEQ ID NO: 4407213 - DNA, 12 bp, Homo sapiens
tctgtctgtgca

SEQ ID NO: 4407214 - DNA, 18 bp, Homo sapiens
tctgtctgtgcacatgcc

SEQ ID NO: 4407215 - DNA, 18 bp, Homo sapiens
tctgtcttgttaatgctt

SEQ ID NO: 4407216 - DNA, 14 bp, Homo sapiens
tctgtctttcctga

SEQ ID NO: 4407217 - DNA, 17 bp, Homo sapiens
tctgtgaacagagagac

SEQ ID NO: 4407218 - DNA, 18 bp, Homo sapiens
tctgtgaagcctttatct

SEQ ID NO: 4407219 - DNA, 21 bp, Homo sapiens
tctgtgaagttgaataaacat

SEQ ID NO: 4407220 - DNA, 19 bp, Homo sapiens
tctgtgaccaatgtcttga

SEQ ID NO: 4407221 - DNA, 21 bp, Homo sapiens
tctgtgagggtgctgactggc

SEQ ID NO: 4407222 - DNA, 22 bp, Homo sapiens
tctgtgatttttttttttaatt

SEQ ID NO: 4407223 - DNA, 23 bp, Homo sapiens
tctgtgcacatgcctctgtagag

SEQ ID NO: 4407224 - DNA, 15 bp, Homo sapiens
tctgtgcaggctgca

SEQ ID NO: 4407225 - DNA, 15 bp, Homo sapiens
tctgtgccccatgcc

SEQ ID NO: 4407226 - DNA, 18 bp, Homo sapiens
tctgtgccctccaaagag

SEQ ID NO: 4407227 - DNA, 17 bp, Homo sapiens
tctgtgcctgaatattt

SEQ ID NO: 4407228 - DNA, 17 bp, Homo sapiens
tctgtgccttgtttttt

SEQ ID NO: 4407229 - DNA, 14 bp, Homo sapiens
tctgtgctcctcct

SEQ ID NO: 4407230 - DNA, 15 bp, Homo sapiens
tctgtggctggctct

SEQ ID NO: 4407231 - DNA, 14 bp, Homo sapiens
tctgtgtcatttct

SEQ ID NO: 4407232 - DNA, 16 bp, Homo sapiens
tctgtgtcatttcttc

SEQ ID NO: 4407233 - DNA, 19 bp, Homo sapiens
tctgtgtgaaactttcatt

SEQ ID NO: 4407234 - DNA, 21 bp, Homo sapiens
tctgtgtgaaactttcattcc

SEQ ID NO: 4407235 - DNA, 21 bp, Homo sapiens
tctgtgtgggactgtacacac

SEQ ID NO: 4407236 - DNA, 18 bp, Homo sapiens
tctgtgtgtgtgtatgtg

SEQ ID NO: 4407237 - DNA, 19 bp, Homo sapiens
tctgtgtgtgtgtatgtgg

SEQ ID NO: 4407238 - DNA, 16 bp, Homo sapiens
tctgtgtgtttatgtg

SEQ ID NO: 4407239 - DNA, 18 bp, Homo sapiens
tctgtgttttgaaagaat

SEQ ID NO: 4407240 - DNA, 20 bp, Homo sapiens
tctgttacacactaacatca

SEQ ID NO: 4407241 - DNA, 21 bp, Homo sapiens
tctgttaggggccaataaaat

SEQ ID NO: 4407242 - DNA, 18 bp, Homo sapiens
tctgttatctcaggtgag

SEQ ID NO: 4407243 - DNA, 17 bp, Homo sapiens
tctgttatgctgtgaca

SEQ ID NO: 4407244 - DNA, 12 bp, Homo sapiens
tctgttatttat

SEQ ID NO: 4407245 - DNA, 23 bp, Homo sapiens
tctgttccaaattcagtttcata

SEQ ID NO: 4407246 - DNA, 20 bp, Homo sapiens
tctgttcccagcccctcctc

SEQ ID NO: 4407247 - DNA, 18 bp, Homo sapiens
tctgttcccccaccctcc

SEQ ID NO: 4407248 - DNA, 13 bp, Homo sapiens
tctgttctagttt

SEQ ID NO: 4407249 - DNA, 16 bp, Homo sapiens
tctgttgaaaagcaca

SEQ ID NO: 4407250 - DNA, 17 bp, Homo sapiens
tctgttgccttatttct

SEQ ID NO: 4407251 - DNA, 20 bp, Homo sapiens
tctgttgccttatttctcat

SEQ ID NO: 4407252 - DNA, 17 bp, Homo sapiens
tctgttggagttccctc

SEQ ID NO: 4407253 - DNA, 12 bp, Homo sapiens
tctgttggccta

SEQ ID NO: 4407254 - DNA, 21 bp, Homo sapiens
tctgttggcctaagtgcctct

SEQ ID NO: 4407255 - DNA, 20 bp, Homo sapiens
tctgttgtttggttcaggga

SEQ ID NO: 4407256 - DNA, 13 bp, Homo sapiens
tctgtttaaagtg

SEQ ID NO: 4407257 - DNA, 16 bp, Homo sapiens
tctgtttcctgacatt

SEQ ID NO: 4407258 - DNA, 13 bp, Homo sapiens
tctgtttctctgc

SEQ ID NO: 4407259 - DNA, 18 bp, Homo sapiens
tctgtttctctgctgtca

SEQ ID NO: 4407260 - DNA, 13 bp, Homo sapiens
tctgtttgaaact

SEQ ID NO: 4407261 - DNA, 13 bp, Homo sapiens
tctgtttgattct

SEQ ID NO: 4407262 - DNA, 14 bp, Homo sapiens
tctgtttgattctt

SEQ ID NO: 4407263 - DNA, 13 bp, Homo sapiens
tctgtttgctgtg

SEQ ID NO: 4407264 - DNA, 16 bp, Homo sapiens
tctgtttgtgggactg

SEQ ID NO: 4407265 - DNA, 13 bp, Homo sapiens
tcttaaaaaatgt

SEQ ID NO: 4407266 - DNA, 18 bp, Homo sapiens
tcttaaaaaatgtgaaat

SEQ ID NO: 4407267 - DNA, 22 bp, Homo sapiens
tcttaaaaaatgtgaaatgctt

SEQ ID NO: 4407268 - DNA, 13 bp, Homo sapiens
tcttaaaaaattt

SEQ ID NO: 4407269 - DNA, 20 bp, Homo sapiens
tcttaaaaaatttatactta

SEQ ID NO: 4407270 - DNA, 16 bp, Homo sapiens
tcttaaaacacatgat

SEQ ID NO: 4407271 - DNA, 17 bp, Homo sapiens
tcttaaaacacatgata

SEQ ID NO: 4407272 - DNA, 24 bp, Homo sapiens
tcttaaaagctatcttcatgtaaa

SEQ ID NO: 4407273 - DNA, 14 bp, Homo sapiens
tcttaaaatgcaat

SEQ ID NO: 4407274 - DNA, 12 bp, Homo sapiens
tcttaaactaaa

SEQ ID NO: 4407275 - DNA, 14 bp, Homo sapiens
tcttaaagcatttc

SEQ ID NO: 4407276 - DNA, 14 bp, Homo sapiens
tcttaaattcattt

SEQ ID NO: 4407277 - DNA, 23 bp, Homo sapiens
tcttaaattgggttcatgatgca

SEQ ID NO: 4407278 - DNA, 13 bp, Homo sapiens
tcttaacctcagg

SEQ ID NO: 4407279 - DNA, 16 bp, Homo sapiens
tcttaacctttgctat

SEQ ID NO: 4407280 - DNA, 12 bp, Homo sapiens
tcttaacttctt

SEQ ID NO: 4407281 - DNA, 16 bp, Homo sapiens
tcttaacttcttgctt

SEQ ID NO: 4407282 - DNA, 19 bp, Homo sapiens
tcttaagatggaaatacag

SEQ ID NO: 4407283 - DNA, 20 bp, Homo sapiens
tcttaagatggaaatacagt

SEQ ID NO: 4407284 - DNA, 16 bp, Homo sapiens
tcttaagcaggtttgt

SEQ ID NO: 4407285 - DNA, 21 bp, Homo sapiens
tcttaagcaggtttgttttca

SEQ ID NO: 4407286 - DNA, 18 bp, Homo sapiens
tcttaagcagtaatctgt

SEQ ID NO: 4407287 - DNA, 21 bp, Homo sapiens
tcttaagggtcactggcctct

SEQ ID NO: 4407288 - DNA, 15 bp, Homo sapiens
tcttaatataaattc

SEQ ID NO: 4407289 - DNA, 20 bp, Homo sapiens
tcttaatataaattcacttt

SEQ ID NO: 4407290 - DNA, 18 bp, Homo sapiens
tcttaattattataaaaa

SEQ ID NO: 4407291 - DNA, 13 bp, Homo sapiens
tcttaattgtgtt

SEQ ID NO: 4407292 - DNA, 17 bp, Homo sapiens
tcttaattgtgtttatt

SEQ ID NO: 4407293 - DNA, 23 bp, Homo sapiens
tcttaattgtgtttattttttaa

SEQ ID NO: 4407294 - DNA, 23 bp, Homo sapiens
tcttaatttatttcttaaccttt

SEQ ID NO: 4407295 - DNA, 19 bp, Homo sapiens
tcttacaagcttaaagctt

SEQ ID NO: 4407296 - DNA, 13 bp, Homo sapiens
tcttacagcaggc

SEQ ID NO: 4407297 - DNA, 16 bp, Homo sapiens
tcttacataaaccatt

SEQ ID NO: 4407298 - DNA, 19 bp, Homo sapiens
tcttacataaaccattttt

SEQ ID NO: 4407299 - DNA, 14 bp, Homo sapiens
tcttacatctcctt

SEQ ID NO: 4407300 - DNA, 22 bp, Homo sapiens
tcttacatctccttgatcatgt

SEQ ID NO: 4407301 - DNA, 18 bp, Homo sapiens
tcttaccattaacatttt

SEQ ID NO: 4407302 - DNA, 19 bp, Homo sapiens
tcttaccattaacattttt

SEQ ID NO: 4407303 - DNA, 13 bp, Homo sapiens
tcttaccctttct

SEQ ID NO: 4407304 - DNA, 14 bp, Homo sapiens
tcttaccctttctt

SEQ ID NO: 4407305 - DNA, 15 bp, Homo sapiens
tcttacgaatatttt

SEQ ID NO: 4407306 - DNA, 20 bp, Homo sapiens
tcttacttttattattttaa

SEQ ID NO: 4407307 - DNA, 21 bp, Homo sapiens
tcttagaacagtggaaactat

SEQ ID NO: 4407308 - DNA, 19 bp, Homo sapiens
tcttagaagtggaccagga

SEQ ID NO: 4407309 - DNA, 14 bp, Homo sapiens
tcttagaatttgtt

SEQ ID NO: 4407310 - DNA, 20 bp, Homo sapiens
tcttagagccaagtgtcttt

SEQ ID NO: 4407311 - DNA, 17 bp, Homo sapiens
tcttagagccttagcag

SEQ ID NO: 4407312 - DNA, 15 bp, Homo sapiens
tcttagagttttatt

SEQ ID NO: 4407313 - DNA, 17 bp, Homo sapiens
tcttagagttttattcc

SEQ ID NO: 4407314 - DNA, 19 bp, Homo sapiens
tcttagagttttattcctt

SEQ ID NO: 4407315 - DNA, 17 bp, Homo sapiens
tcttagataacttcttg

SEQ ID NO: 4407316 - DNA, 22 bp, Homo sapiens
tcttagataacttcttgaaaaa

SEQ ID NO: 4407317 - DNA, 18 bp, Homo sapiens
tcttagctatccttggct

SEQ ID NO: 4407318 - DNA, 17 bp, Homo sapiens
tcttagctcccctccaa

SEQ ID NO: 4407319 - DNA, 16 bp, Homo sapiens
tcttataactgtttta

SEQ ID NO: 4407320 - DNA, 23 bp, Homo sapiens
tcttataactgttttagaaattg

SEQ ID NO: 4407321 - DNA, 16 bp, Homo sapiens
tcttatactgtacaat

SEQ ID NO: 4407322 - DNA, 18 bp, Homo sapiens
tcttatagaagcttcagc

SEQ ID NO: 4407323 - DNA, 19 bp, Homo sapiens
tcttatagaagcttcagca

SEQ ID NO: 4407324 - DNA, 16 bp, Homo sapiens
tcttatgaggagggga

SEQ ID NO: 4407325 - DNA, 18 bp, Homo sapiens
tcttatggaattgatttg

SEQ ID NO: 4407326 - DNA, 21 bp, Homo sapiens
tcttatggaattgatttgcat

SEQ ID NO: 4407327 - DNA, 14 bp, Homo sapiens
tcttatggggtgag

SEQ ID NO: 4407328 - DNA, 14 bp, Homo sapiens
tcttatgtgtgcct

SEQ ID NO: 4407329 - DNA, 22 bp, Homo sapiens
tcttattagttccccaaataca

SEQ ID NO: 4407330 - DNA, 16 bp, Homo sapiens
tcttattgttctttca

SEQ ID NO: 4407331 - DNA, 20 bp, Homo sapiens
tcttattgttctttcatatg

SEQ ID NO: 4407332 - DNA, 14 bp, Homo sapiens
tcttatttaccctt

SEQ ID NO: 4407333 - DNA, 15 bp, Homo sapiens
tcttatttacccttt

SEQ ID NO: 4407334 - DNA, 19 bp, Homo sapiens
tcttatttattttagcaaa

SEQ ID NO: 4407335 - DNA, 16 bp, Homo sapiens
tcttatttcatttctt

SEQ ID NO: 4407336 - DNA, 20 bp, Homo sapiens
tcttatttctttcctttaaa

SEQ ID NO: 4407337 - DNA, 13 bp, Homo sapiens
tcttatttttcct

SEQ ID NO: 4407338 - DNA, 14 bp, Homo sapiens
tcttatttttcctg

SEQ ID NO: 4407339 - DNA, 18 bp, Homo sapiens
tcttatttttcctgtcct

SEQ ID NO: 4407340 - DNA, 19 bp, Homo sapiens
tcttatttttcctgtcctg

SEQ ID NO: 4407341 - DNA, 21 bp, Homo sapiens
tcttcaaaaggtaaatacaat

SEQ ID NO: 4407342 - DNA, 15 bp, Homo sapiens
tcttcaaagccacat

SEQ ID NO: 4407343 - DNA, 14 bp, Homo sapiens
tcttcaacatgaca

SEQ ID NO: 4407344 - DNA, 14 bp, Homo sapiens
tcttcaagaaatct

SEQ ID NO: 4407345 - DNA, 12 bp, Homo sapiens
tcttcaataaac

SEQ ID NO: 4407346 - DNA, 14 bp, Homo sapiens
tcttcaataaacca

SEQ ID NO: 4407347 - DNA, 21 bp, Homo sapiens
tcttcaataaaccacaagcat

SEQ ID NO: 4407348 - DNA, 16 bp, Homo sapiens
tcttcactcaaatttt

SEQ ID NO: 4407349 - DNA, 20 bp, Homo sapiens
tcttcactcaggtctcagct

SEQ ID NO: 4407350 - DNA, 15 bp, Homo sapiens
tcttcactgcaattt

SEQ ID NO: 4407351 - DNA, 22 bp, Homo sapiens
tcttcagaactgcccttgctgc

SEQ ID NO: 4407352 - DNA, 20 bp, Homo sapiens
tcttcagactctcagcccag

SEQ ID NO: 4407353 - DNA, 23 bp, Homo sapiens
tcttcagactctcagcccagaag

SEQ ID NO: 4407354 - DNA, 13 bp, Homo sapiens
tcttcaggcctcc

SEQ ID NO: 4407355 - DNA, 14 bp, Homo sapiens
tcttcaggcctccc

SEQ ID NO: 4407356 - DNA, 12 bp, Homo sapiens
tcttcaggcctg

SEQ ID NO: 4407357 - DNA, 21 bp, Homo sapiens
tcttcaggcctgctagtcact

SEQ ID NO: 4407358 - DNA, 22 bp, Homo sapiens
tcttcaggcctgctagtcactg

SEQ ID NO: 4407359 - DNA, 15 bp, Homo sapiens
tcttcaggtaacact

SEQ ID NO: 4407360 - DNA, 15 bp, Homo sapiens
tcttcatccatagac

SEQ ID NO: 4407361 - DNA, 14 bp, Homo sapiens
tcttcatgaaatgt

SEQ ID NO: 4407362 - DNA, 15 bp, Homo sapiens
tcttcatgcttgaca

SEQ ID NO: 4407363 - DNA, 20 bp, Homo sapiens
tcttcatgggggtaagaaaa

SEQ ID NO: 4407364 - DNA, 16 bp, Homo sapiens
tcttcattgtaatctg

SEQ ID NO: 4407365 - DNA, 15 bp, Homo sapiens
tcttcatttctctgc

SEQ ID NO: 4407366 - DNA, 19 bp, Homo sapiens
tcttcattttttaatgtgc

SEQ ID NO: 4407367 - DNA, 18 bp, Homo sapiens
tcttccacaaagaaaatt

SEQ ID NO: 4407368 - DNA, 12 bp, Homo sapiens
tcttccagccac

SEQ ID NO: 4407369 - DNA, 18 bp, Homo sapiens
tcttccagtcttcctgac

SEQ ID NO: 4407370 - DNA, 17 bp, Homo sapiens
tcttccatcatcactgt

SEQ ID NO: 4407371 - DNA, 18 bp, Homo sapiens
tcttccatcatcactgta

SEQ ID NO: 4407372 - DNA, 19 bp, Homo sapiens
tcttccatcatcactgtaa

SEQ ID NO: 4407373 - DNA, 21 bp, Homo sapiens
tcttccatcatcactgtaaag

SEQ ID NO: 4407374 - DNA, 14 bp, Homo sapiens
tcttcccacaggag

SEQ ID NO: 4407375 - DNA, 21 bp, Homo sapiens
tcttcccactttcatctacct

SEQ ID NO: 4407376 - DNA, 12 bp, Homo sapiens
tcttcccagggt

SEQ ID NO: 4407377 - DNA, 22 bp, Homo sapiens
tcttcccatgtcccaccctccc

SEQ ID NO: 4407378 - DNA, 13 bp, Homo sapiens
tcttccccaagct

SEQ ID NO: 4407379 - DNA, 14 bp, Homo sapiens
tcttccccttccct

SEQ ID NO: 4407380 - DNA, 15 bp, Homo sapiens
tcttccccttccctt

SEQ ID NO: 4407381 - DNA, 13 bp, Homo sapiens
tcttccctgcttt

SEQ ID NO: 4407382 - DNA, 16 bp, Homo sapiens
tcttccctgctttgca

SEQ ID NO: 4407383 - DNA, 17 bp, Homo sapiens
tcttcccttagcctctc

SEQ ID NO: 4407384 - DNA, 18 bp, Homo sapiens
tcttcccttagcctctcc

SEQ ID NO: 4407385 - DNA, 20 bp, Homo sapiens
tcttcccttagcctctccca

SEQ ID NO: 4407386 - DNA, 22 bp, Homo sapiens
tcttccgtcaagtacacaaagt

SEQ ID NO: 4407387 - DNA, 21 bp, Homo sapiens
tcttcctaccaagtcaaactt

SEQ ID NO: 4407388 - DNA, 14 bp, Homo sapiens
tcttcctaggccac

SEQ ID NO: 4407389 - DNA, 13 bp, Homo sapiens
tcttcctcccaag

SEQ ID NO: 4407390 - DNA, 17 bp, Homo sapiens
tcttcctccgaggccag

SEQ ID NO: 4407391 - DNA, 13 bp, Homo sapiens
tcttcctgacact

SEQ ID NO: 4407392 - DNA, 15 bp, Homo sapiens
tcttcctgcgtagaa

SEQ ID NO: 4407393 - DNA, 14 bp, Homo sapiens
tcttcctgtaatct

SEQ ID NO: 4407394 - DNA, 14 bp, Homo sapiens
tcttcctgttgtga

SEQ ID NO: 4407395 - DNA, 22 bp, Homo sapiens
tcttccttctttattgcccctt

SEQ ID NO: 4407396 - DNA, 14 bp, Homo sapiens
tcttcctttgaaag

SEQ ID NO: 4407397 - DNA, 16 bp, Homo sapiens
tcttccttttttaaaa

SEQ ID NO: 4407398 - DNA, 22 bp, Homo sapiens
tcttccttttttaaaataaaat

SEQ ID NO: 4407399 - DNA, 23 bp, Homo sapiens
tcttccttttttaaaataaaata

SEQ ID NO: 4407400 - DNA, 13 bp, Homo sapiens
tcttcgaggtgga

SEQ ID NO: 4407401 - DNA, 18 bp, Homo sapiens
tcttcgctggactattgt

SEQ ID NO: 4407402 - DNA, 19 bp, Homo sapiens
tcttcgttctttttaagtt

SEQ ID NO: 4407403 - DNA, 17 bp, Homo sapiens
tcttctaagaagacatt

SEQ ID NO: 4407404 - DNA, 18 bp, Homo sapiens
tcttctaagaagacattt

SEQ ID NO: 4407405 - DNA, 12 bp, Homo sapiens
tcttctacttgt

SEQ ID NO: 4407406 - DNA, 21 bp, Homo sapiens
tcttctacttgtaaaatgctt

SEQ ID NO: 4407407 - DNA, 22 bp, Homo sapiens
tcttctagatgattttttgaaa

SEQ ID NO: 4407408 - DNA, 23 bp, Homo sapiens
tcttctagatgattttttgaaag

SEQ ID NO: 4407409 - DNA, 22 bp, Homo sapiens
tcttctagatggaccccagcat

SEQ ID NO: 4407410 - DNA, 19 bp, Homo sapiens
tcttctagtgcttttcagt

SEQ ID NO: 4407411 - DNA, 20 bp, Homo sapiens
tcttctattaatcaagagaa

SEQ ID NO: 4407412 - DNA, 22 bp, Homo sapiens
tcttctatttatttatttattc

SEQ ID NO: 4407413 - DNA, 22 bp, Homo sapiens
tcttctcaacttttttcccttg

SEQ ID NO: 4407414 - DNA, 18 bp, Homo sapiens
tcttctcatttcacccct

SEQ ID NO: 4407415 - DNA, 19 bp, Homo sapiens
tcttctcatttcacccctc

SEQ ID NO: 4407416 - DNA, 20 bp, Homo sapiens
tcttctcatttcacccctcc

SEQ ID NO: 4407417 - DNA, 12 bp, Homo sapiens
tcttctccatct

SEQ ID NO: 4407418 - DNA, 14 bp, Homo sapiens
tcttctctccagct

SEQ ID NO: 4407419 - DNA, 16 bp, Homo sapiens
tcttctctccccagcc

SEQ ID NO: 4407420 - DNA, 13 bp, Homo sapiens
tcttctctgttgt

SEQ ID NO: 4407421 - DNA, 18 bp, Homo sapiens
tcttctcttgacagtctg

SEQ ID NO: 4407422 - DNA, 19 bp, Homo sapiens
tcttctcttgacagtctga

SEQ ID NO: 4407423 - DNA, 18 bp, Homo sapiens
tcttctgaataaagcaat

SEQ ID NO: 4407424 - DNA, 20 bp, Homo sapiens
tcttctgactgccccctcct

SEQ ID NO: 4407425 - DNA, 21 bp, Homo sapiens
tcttctgcaacatttgacaaa

SEQ ID NO: 4407426 - DNA, 17 bp, Homo sapiens
tcttctgcaagcctcat

SEQ ID NO: 4407427 - DNA, 20 bp, Homo sapiens
tcttctgcccaattggagga

SEQ ID NO: 4407428 - DNA, 13 bp, Homo sapiens
tcttctgccccac

SEQ ID NO: 4407429 - DNA, 11 bp, Homo sapiens
tcttctgctcc

SEQ ID NO: 4407430 - DNA, 15 bp, Homo sapiens
tcttctgctccaccc

SEQ ID NO: 4407431 - DNA, 17 bp, Homo sapiens
tcttctgctccaccctt

SEQ ID NO: 4407432 - DNA, 11 bp, Homo sapiens
tcttctggctt

SEQ ID NO: 4407433 - DNA, 18 bp, Homo sapiens
tcttctggggcaggctgg

SEQ ID NO: 4407434 - DNA, 21 bp, Homo sapiens
tcttctggggcaggctgggcc

SEQ ID NO: 4407435 - DNA, 21 bp, Homo sapiens
tcttctggtgctactccatgc

SEQ ID NO: 4407436 - DNA, 22 bp, Homo sapiens
tcttctgttaggggccaataaa

SEQ ID NO: 4407437 - DNA, 14 bp, Homo sapiens
tcttcttctaagaa

SEQ ID NO: 4407438 - DNA, 18 bp, Homo sapiens
tcttcttctaagaagaca

SEQ ID NO: 4407439 - DNA, 13 bp, Homo sapiens
tcttcttgaaatt

SEQ ID NO: 4407440 - DNA, 16 bp, Homo sapiens
tcttcttggtctcagt

SEQ ID NO: 4407441 - DNA, 17 bp, Homo sapiens
tcttcttgttctgagat

SEQ ID NO: 4407442 - DNA, 16 bp, Homo sapiens
tcttctttaagccata

SEQ ID NO: 4407443 - DNA, 13 bp, Homo sapiens
tcttctttctgaa

SEQ ID NO: 4407444 - DNA, 12 bp, Homo sapiens
tcttctttgtgc

SEQ ID NO: 4407445 - DNA, 15 bp, Homo sapiens
tcttctttgtgcctt

SEQ ID NO: 4407446 - DNA, 17 bp, Homo sapiens
tcttctttgtgcctttg

SEQ ID NO: 4407447 - DNA, 22 bp, Homo sapiens
tcttctttgtgcctttggcctg

SEQ ID NO: 4407448 - DNA, 23 bp, Homo sapiens
tcttctttttgttaacagcaacg

SEQ ID NO: 4407449 - DNA, 14 bp, Homo sapiens
tcttgaaaactgtg

SEQ ID NO: 4407450 - DNA, 21 bp, Homo sapiens
tcttgaaaactgtgcaacttt

SEQ ID NO: 4407451 - DNA, 15 bp, Homo sapiens
tcttgaaatgaaagg

SEQ ID NO: 4407452 - DNA, 19 bp, Homo sapiens
tcttgaaatgaaagggaaa

SEQ ID NO: 4407453 - DNA, 21 bp, Homo sapiens
tcttgaaattaagaaggcaaa

SEQ ID NO: 4407454 - DNA, 18 bp, Homo sapiens
tcttgaatactctgccct

SEQ ID NO: 4407455 - DNA, 20 bp, Homo sapiens
tcttgaatactctgccctct

SEQ ID NO: 4407456 - DNA, 13 bp, Homo sapiens
tcttgaattatat

SEQ ID NO: 4407457 - DNA, 17 bp, Homo sapiens
tcttgactttgtatctt

SEQ ID NO: 4407458 - DNA, 14 bp, Homo sapiens
tcttgagcatcaat

SEQ ID NO: 4407459 - DNA, 14 bp, Homo sapiens
tcttgagggacaat

SEQ ID NO: 4407460 - DNA, 20 bp, Homo sapiens
tcttgataaatgactgtttt

SEQ ID NO: 4407461 - DNA, 17 bp, Homo sapiens
tcttgatcaacatcttt

SEQ ID NO: 4407462 - DNA, 20 bp, Homo sapiens
tcttgatcaacatcttttct

SEQ ID NO: 4407463 - DNA, 14 bp, Homo sapiens
tcttgatctctctt

SEQ ID NO: 4407464 - DNA, 18 bp, Homo sapiens
tcttgatctttgagccca

SEQ ID NO: 4407465 - DNA, 12 bp, Homo sapiens
tcttgatgacca

SEQ ID NO: 4407466 - DNA, 23 bp, Homo sapiens
tcttgattatccatattgagtca

SEQ ID NO: 4407467 - DNA, 20 bp, Homo sapiens
tcttgatttcacatttctac

SEQ ID NO: 4407468 - DNA, 22 bp, Homo sapiens
tcttgcaagggaagagccttta

SEQ ID NO: 4407469 - DNA, 23 bp, Homo sapiens
tcttgcaggaaggactatgaaaa

SEQ ID NO: 4407470 - DNA, 19 bp, Homo sapiens
tcttgcatggtttggagct

SEQ ID NO: 4407471 - DNA, 12 bp, Homo sapiens
tcttgcccactg

SEQ ID NO: 4407472 - DNA, 22 bp, Homo sapiens
tcttgccttttgttaatgcatt

SEQ ID NO: 4407473 - DNA, 14 bp, Homo sapiens
tcttgctaccagta

SEQ ID NO: 4407474 - DNA, 14 bp, Homo sapiens
tcttgctgttgaca

SEQ ID NO: 4407475 - DNA, 20 bp, Homo sapiens
tcttgcttggggaacttgtg

SEQ ID NO: 4407476 - DNA, 13 bp, Homo sapiens
tcttgctttctct

SEQ ID NO: 4407477 - DNA, 14 bp, Homo sapiens
tcttggaaaaacag

SEQ ID NO: 4407478 - DNA, 19 bp, Homo sapiens
tcttggaaaataagacaat

SEQ ID NO: 4407479 - DNA, 22 bp, Homo sapiens
tcttggaaacagacggcggcac

SEQ ID NO: 4407480 - DNA, 15 bp, Homo sapiens
tcttggacaaatcac

SEQ ID NO: 4407481 - DNA, 19 bp, Homo sapiens
tcttggagctttggaatat

SEQ ID NO: 4407482 - DNA, 15 bp, Homo sapiens
tcttggcttaatcat

SEQ ID NO: 4407483 - DNA, 21 bp, Homo sapiens
tcttggcttaatcattttcat

SEQ ID NO: 4407484 - DNA, 22 bp, Homo sapiens
tcttggggactcgggggctggt

SEQ ID NO: 4407485 - DNA, 22 bp, Homo sapiens
tcttggggagtttagggtgggg

SEQ ID NO: 4407486 - DNA, 23 bp, Homo sapiens
tcttggggagtttagggtggggg

SEQ ID NO: 4407487 - DNA, 20 bp, Homo sapiens
tcttgggggacagggctggc

SEQ ID NO: 4407488 - DNA, 22 bp, Homo sapiens
tcttgggggacagggctggccc

SEQ ID NO: 4407489 - DNA, 18 bp, Homo sapiens
tcttgggggaggccaccc

SEQ ID NO: 4407490 - DNA, 19 bp, Homo sapiens
tcttgggggaggccacccc

SEQ ID NO: 4407491 - DNA, 14 bp, Homo sapiens
tcttgggggtcagg

SEQ ID NO: 4407492 - DNA, 21 bp, Homo sapiens
tcttgggggtcaggggggaga

SEQ ID NO: 4407493 - DNA, 22 bp, Homo sapiens
tcttggtagttctgtgcctccc

SEQ ID NO: 4407494 - DNA, 14 bp, Homo sapiens
tcttggtgtaattt

SEQ ID NO: 4407495 - DNA, 19 bp, Homo sapiens
tcttggttgaaaataaaaa

SEQ ID NO: 4407496 - DNA, 23 bp, Homo sapiens
tcttggttgaaaataaaaagatc

SEQ ID NO: 4407497 - DNA, 14 bp, Homo sapiens
tcttgtaaagactg

SEQ ID NO: 4407498 - DNA, 15 bp, Homo sapiens
tcttgtaaagactgg

SEQ ID NO: 4407499 - DNA, 17 bp, Homo sapiens
tcttgtaaagactggtt

SEQ ID NO: 4407500 - DNA, 23 bp, Homo sapiens
tcttgtaaagactggttttctgc

SEQ ID NO: 4407501 - DNA, 19 bp, Homo sapiens
tcttgtacaaactttgttt

SEQ ID NO: 4407502 - DNA, 20 bp, Homo sapiens
tcttgtatctggattcaaat

SEQ ID NO: 4407503 - DNA, 16 bp, Homo sapiens
tcttgtattaagttgt

SEQ ID NO: 4407504 - DNA, 22 bp, Homo sapiens
tcttgtattaagttgttaataa

SEQ ID NO: 4407505 - DNA, 17 bp, Homo sapiens
tcttgtatttaaaaaca

SEQ ID NO: 4407506 - DNA, 22 bp, Homo sapiens
tcttgtatttattggttttgca

SEQ ID NO: 4407507 - DNA, 18 bp, Homo sapiens
tcttgtcccaattaaaat

SEQ ID NO: 4407508 - DNA, 16 bp, Homo sapiens
tcttgtcctcttctgc

SEQ ID NO: 4407509 - DNA, 12 bp, Homo sapiens
tcttgtctttat

SEQ ID NO: 4407510 - DNA, 13 bp, Homo sapiens
tcttgtgaaagtg

SEQ ID NO: 4407511 - DNA, 21 bp, Homo sapiens
tcttgtgtagatttgaaaatt

SEQ ID NO: 4407512 - DNA, 18 bp, Homo sapiens
tcttgttactgctgattc

SEQ ID NO: 4407513 - DNA, 19 bp, Homo sapiens
tcttgttatggtagaaaaa

SEQ ID NO: 4407514 - DNA, 16 bp, Homo sapiens
tcttgttgataaaaat

SEQ ID NO: 4407515 - DNA, 21 bp, Homo sapiens
tcttgttgctcaaaaaatgag

SEQ ID NO: 4407516 - DNA, 14 bp, Homo sapiens
tcttgtttcagtga

SEQ ID NO: 4407517 - DNA, 16 bp, Homo sapiens
tcttgtttgttactgt

SEQ ID NO: 4407518 - DNA, 16 bp, Homo sapiens
tcttgttttgaaaata

SEQ ID NO: 4407519 - DNA, 12 bp, Homo sapiens
tctttaaaaact

SEQ ID NO: 4407520 - DNA, 14 bp, Homo sapiens
tctttaaaaactgt

SEQ ID NO: 4407521 - DNA, 15 bp, Homo sapiens
tctttaaaaactgtt

SEQ ID NO: 4407522 - DNA, 16 bp, Homo sapiens
tctttaaaacaaaaca

SEQ ID NO: 4407523 - DNA, 15 bp, Homo sapiens
tctttaaatgtgtat

SEQ ID NO: 4407524 - DNA, 18 bp, Homo sapiens
tctttaaccaggaatatt

SEQ ID NO: 4407525 - DNA, 11 bp, Homo sapiens
tctttaactgc

SEQ ID NO: 4407526 - DNA, 20 bp, Homo sapiens
tctttaactgccgtaattta

SEQ ID NO: 4407527 - DNA, 13 bp, Homo sapiens
tctttaagccata

SEQ ID NO: 4407528 - DNA, 23 bp, Homo sapiens
tctttaagccatagaccctgagg

SEQ ID NO: 4407529 - DNA, 13 bp, Homo sapiens
tctttaattctgt

SEQ ID NO: 4407530 - DNA, 19 bp, Homo sapiens
tctttaccaaaaaccatgt

SEQ ID NO: 4407531 - DNA, 20 bp, Homo sapiens
tctttaccaaaaaccatgtt

SEQ ID NO: 4407532 - DNA, 19 bp, Homo sapiens
tctttacctgtatacagtg

SEQ ID NO: 4407533 - DNA, 22 bp, Homo sapiens
tctttactttctcccagtatgt

SEQ ID NO: 4407534 - DNA, 15 bp, Homo sapiens
tctttagaccctcgg

SEQ ID NO: 4407535 - DNA, 14 bp, Homo sapiens
tctttagatgcaag

SEQ ID NO: 4407536 - DNA, 18 bp, Homo sapiens
tctttatagtgaagtgtt

SEQ ID NO: 4407537 - DNA, 22 bp, Homo sapiens
tctttatagtgaagtgttaata

SEQ ID NO: 4407538 - DNA, 16 bp, Homo sapiens
tctttatatgaacata

SEQ ID NO: 4407539 - DNA, 23 bp, Homo sapiens
tctttatcaagcaacattcttgt

SEQ ID NO: 4407540 - DNA, 12 bp, Homo sapiens
tctttattgaaa

SEQ ID NO: 4407541 - DNA, 14 bp, Homo sapiens
tctttattgaaatt

SEQ ID NO: 4407542 - DNA, 18 bp, Homo sapiens
tctttattgccccttctt

SEQ ID NO: 4407543 - DNA, 14 bp, Homo sapiens
tctttattgtccac

SEQ ID NO: 4407544 - DNA, 16 bp, Homo sapiens
tctttattgtctgtaa

SEQ ID NO: 4407545 - DNA, 21 bp, Homo sapiens
tctttcaacttgcaatttgca

SEQ ID NO: 4407546 - DNA, 17 bp, Homo sapiens
tctttcacaggtagcct

SEQ ID NO: 4407547 - DNA, 22 bp, Homo sapiens
tctttcaggaatacttggacct

SEQ ID NO: 4407548 - DNA, 17 bp, Homo sapiens
tctttcatgtcttgtca

SEQ ID NO: 4407549 - DNA, 18 bp, Homo sapiens
tctttccaaattatttct

SEQ ID NO: 4407550 - DNA, 20 bp, Homo sapiens
tctttccaaattatttctta

SEQ ID NO: 4407551 - DNA, 19 bp, Homo sapiens
tctttccacggagccactc

SEQ ID NO: 4407552 - DNA, 13 bp, Homo sapiens
tctttccaggctt

SEQ ID NO: 4407553 - DNA, 15 bp, Homo sapiens
tctttcccatgtatt

SEQ ID NO: 4407554 - DNA, 12 bp, Homo sapiens
tctttccccaga

SEQ ID NO: 4407555 - DNA, 16 bp, Homo sapiens
tctttccgactgccca

SEQ ID NO: 4407556 - DNA, 14 bp, Homo sapiens
tctttcctcctttc

SEQ ID NO: 4407557 - DNA, 16 bp, Homo sapiens
tctttcctgaaccatg

SEQ ID NO: 4407558 - DNA, 14 bp, Homo sapiens
tctttcctgccctg

SEQ ID NO: 4407559 - DNA, 14 bp, Homo sapiens
tctttctaagaaat

SEQ ID NO: 4407560 - DNA, 11 bp, Homo sapiens
tctttctctca

SEQ ID NO: 4407561 - DNA, 17 bp, Homo sapiens
tctttctctctttccat

SEQ ID NO: 4407562 - DNA, 10 bp, Homo sapiens
tctttctctg

SEQ ID NO: 4407563 - DNA, 16 bp, Homo sapiens
tctttctgaagatcaa

SEQ ID NO: 4407564 - DNA, 14 bp, Homo sapiens
tctttctgaaggaa

SEQ ID NO: 4407565 - DNA, 22 bp, Homo sapiens
tctttctgagtgccttctgtgg

SEQ ID NO: 4407566 - DNA, 20 bp, Homo sapiens
tctttctgcacacaaatatt

SEQ ID NO: 4407567 - DNA, 23 bp, Homo sapiens
tctttctgcccggctacatcagc

SEQ ID NO: 4407568 - DNA, 12 bp, Homo sapiens
tctttctggact

SEQ ID NO: 4407569 - DNA, 10 bp, Homo sapiens
tctttctgta

SEQ ID NO: 4407570 - DNA, 16 bp, Homo sapiens
tctttctgtcccctct

SEQ ID NO: 4407571 - DNA, 16 bp, Homo sapiens
tctttcttcctcttct

SEQ ID NO: 4407572 - DNA, 21 bp, Homo sapiens
tctttctttggtgcctttcct

SEQ ID NO: 4407573 - DNA, 24 bp, Homo sapiens
tctttcttttcttttttaaagtaa

SEQ ID NO: 4407574 - DNA, 15 bp, Homo sapiens
tctttgaaataaaaa

SEQ ID NO: 4407575 - DNA, 21 bp, Homo sapiens
tctttgaaatagtctgtgtga

SEQ ID NO: 4407576 - DNA, 23 bp, Homo sapiens
tctttgactgaaaaaaaaaaaga

SEQ ID NO: 4407577 - DNA, 15 bp, Homo sapiens
tctttgagaccatcc

SEQ ID NO: 4407578 - DNA, 15 bp, Homo sapiens
tctttgagcccattc

SEQ ID NO: 4407579 - DNA, 15 bp, Homo sapiens
tctttgattctcctt

SEQ ID NO: 4407580 - DNA, 16 bp, Homo sapiens
tctttgattctccttc

SEQ ID NO: 4407581 - DNA, 20 bp, Homo sapiens
tctttgattctccttttatg

SEQ ID NO: 4407582 - DNA, 21 bp, Homo sapiens
tctttgcaaagtattgtaaat

SEQ ID NO: 4407583 - DNA, 22 bp, Homo sapiens
tctttgcaaagtattgtaaatt

SEQ ID NO: 4407584 - DNA, 16 bp, Homo sapiens
tctttgcaccaaagac

SEQ ID NO: 4407585 - DNA, 18 bp, Homo sapiens
tctttgcaccaaagacat

SEQ ID NO: 4407586 - DNA, 19 bp, Homo sapiens
tctttgcaccaaagacatc

SEQ ID NO: 4407587 - DNA, 22 bp, Homo sapiens
tctttgccaagtaagagtggtg

SEQ ID NO: 4407588 - DNA, 11 bp, Homo sapiens
tctttgcctct

SEQ ID NO: 4407589 - DNA, 15 bp, Homo sapiens
tctttgcctctgcag

SEQ ID NO: 4407590 - DNA, 17 bp, Homo sapiens
tctttgcctctgcagtc

SEQ ID NO: 4407591 - DNA, 20 bp, Homo sapiens
tctttgcctctgcagtctca

SEQ ID NO: 4407592 - DNA, 21 bp, Homo sapiens
tctttgccttgggctgctcct

SEQ ID NO: 4407593 - DNA, 13 bp, Homo sapiens
tctttgctgcccc

SEQ ID NO: 4407594 - DNA, 21 bp, Homo sapiens
tctttgcttgaacacagtatt

SEQ ID NO: 4407595 - DNA, 22 bp, Homo sapiens
tctttggagaaatgcttagaaa

SEQ ID NO: 4407596 - DNA, 14 bp, Homo sapiens
tctttggagttaaa

SEQ ID NO: 4407597 - DNA, 18 bp, Homo sapiens
tctttggtgcctttcctg

SEQ ID NO: 4407598 - DNA, 19 bp, Homo sapiens
tctttgtaccaaaatttta

SEQ ID NO: 4407599 - DNA, 21 bp, Homo sapiens
tctttgtaccaaaattttaaa

SEQ ID NO: 4407600 - DNA, 21 bp, Homo sapiens
tctttgtatataggcttctca

SEQ ID NO: 4407601 - DNA, 22 bp, Homo sapiens
tctttgtgacaggaaagccctc

SEQ ID NO: 4407602 - DNA, 15 bp, Homo sapiens
tctttgtgcagtgtt

SEQ ID NO: 4407603 - DNA, 13 bp, Homo sapiens
tctttgtgccttt

SEQ ID NO: 4407604 - DNA, 19 bp, Homo sapiens
tctttgtgcctttggcctg

SEQ ID NO: 4407605 - DNA, 17 bp, Homo sapiens
tctttgtttaaatgcca

SEQ ID NO: 4407606 - DNA, 15 bp, Homo sapiens
tctttgtttacatga

SEQ ID NO: 4407607 - DNA, 15 bp, Homo sapiens
tctttgtttatgcac

SEQ ID NO: 4407608 - DNA, 21 bp, Homo sapiens
tcttttaaagtatttataaaa

SEQ ID NO: 4407609 - DNA, 21 bp, Homo sapiens
tcttttaaattagaaaatatt

SEQ ID NO: 4407610 - DNA, 12 bp, Homo sapiens
tcttttaactgc

SEQ ID NO: 4407611 - DNA, 14 bp, Homo sapiens
tcttttataggatt

SEQ ID NO: 4407612 - DNA, 14 bp, Homo sapiens
tcttttatcctggg

SEQ ID NO: 4407613 - DNA, 19 bp, Homo sapiens
tcttttattctgttatata

SEQ ID NO: 4407614 - DNA, 21 bp, Homo sapiens
tcttttattctgttatatagt

SEQ ID NO: 4407615 - DNA, 17 bp, Homo sapiens
tcttttcaaataatgct

SEQ ID NO: 4407616 - DNA, 19 bp, Homo sapiens
tcttttcccactgtttaag

SEQ ID NO: 4407617 - DNA, 17 bp, Homo sapiens
tcttttcctggcagctg

SEQ ID NO: 4407618 - DNA, 12 bp, Homo sapiens
tcttttctagag

SEQ ID NO: 4407619 - DNA, 14 bp, Homo sapiens
tcttttctagtttg

SEQ ID NO: 4407620 - DNA, 18 bp, Homo sapiens
tcttttctgtacttcctg

SEQ ID NO: 4407621 - DNA, 12 bp, Homo sapiens
tcttttctttct

SEQ ID NO: 4407622 - DNA, 16 bp, Homo sapiens
tcttttctttctgtct

SEQ ID NO: 4407623 - DNA, 17 bp, Homo sapiens
tcttttctttgtatcat

SEQ ID NO: 4407624 - DNA, 23 bp, Homo sapiens
tcttttgaatcaatctggcttct

SEQ ID NO: 4407625 - DNA, 14 bp, Homo sapiens
tcttttgaattgtt

SEQ ID NO: 4407626 - DNA, 13 bp, Homo sapiens
tcttttgagggct

SEQ ID NO: 4407627 - DNA, 23 bp, Homo sapiens
tcttttgccttttgcaaccagga

SEQ ID NO: 4407628 - DNA, 19 bp, Homo sapiens
tcttttgtaaggtttttgt

SEQ ID NO: 4407629 - DNA, 16 bp, Homo sapiens
tcttttgtatatctaa

SEQ ID NO: 4407630 - DNA, 21 bp, Homo sapiens
tcttttgtcctgcatcatctt

SEQ ID NO: 4407631 - DNA, 14 bp, Homo sapiens
tcttttgtgatgaa

SEQ ID NO: 4407632 - DNA, 23 bp, Homo sapiens
tcttttgttctctgaattttcag

SEQ ID NO: 4407633 - DNA, 15 bp, Homo sapiens
tctttttaagttaat

SEQ ID NO: 4407634 - DNA, 11 bp, Homo sapiens
tctttttcatc

SEQ ID NO: 4407635 - DNA, 13 bp, Homo sapiens
tctttttccagtg

SEQ ID NO: 4407636 - DNA, 15 bp, Homo sapiens
tctttttcctcctgg

SEQ ID NO: 4407637 - DNA, 12 bp, Homo sapiens
tctttttcttct

SEQ ID NO: 4407638 - DNA, 17 bp, Homo sapiens
tctttttcttcttccct

SEQ ID NO: 4407639 - DNA, 13 bp, Homo sapiens
tctttttgcttct

SEQ ID NO: 4407640 - DNA, 14 bp, Homo sapiens
tctttttgcttcta

SEQ ID NO: 4407641 - DNA, 16 bp, Homo sapiens
tctttttgttgtaaaa

SEQ ID NO: 4407642 - DNA, 20 bp, Homo sapiens
tcttttttaaagtaaacttg

SEQ ID NO: 4407643 - DNA, 19 bp, Homo sapiens
tcttttttaataaactact

SEQ ID NO: 4407644 - DNA, 12 bp, Homo sapiens
tcttttttcagt

SEQ ID NO: 4407645 - DNA, 13 bp, Homo sapiens
tcttttttcgttt

SEQ ID NO: 4407646 - DNA, 15 bp, Homo sapiens
tcttttttgctttct

SEQ ID NO: 4407647 - DNA, 15 bp, Homo sapiens
tctttttttttaagt

SEQ ID NO: 4407648 - DNA, 18 bp, Homo sapiens
tctttttttttaagttct

SEQ ID NO: 4407649 - DNA, 17 bp, Homo sapiens
tcttttttttttcgtct

SEQ ID NO: 4407650 - DNA, 18 bp, Homo sapiens
tgaaaaaaaaaaagaaga

SEQ ID NO: 4407651 - DNA, 18 bp, Homo sapiens
tgaaaaaaagggaaaaca

SEQ ID NO: 4407652 - DNA, 14 bp, Homo sapiens
tgaaaaaaagtgct

SEQ ID NO: 4407653 - DNA, 21 bp, Homo sapiens
tgaaaaaaattgaaataaata

SEQ ID NO: 4407654 - DNA, 12 bp, Homo sapiens
tgaaaaaatata

SEQ ID NO: 4407655 - DNA, 13 bp, Homo sapiens
tgaaaaaatatat

SEQ ID NO: 4407656 - DNA, 18 bp, Homo sapiens
tgaaaaaatgtatatgca

SEQ ID NO: 4407657 - DNA, 20 bp, Homo sapiens
tgaaaaaatttaaaagtaaa

SEQ ID NO: 4407658 - DNA, 14 bp, Homo sapiens
tgaaaaacaaacaa

SEQ ID NO: 4407659 - DNA, 14 bp, Homo sapiens
tgaaaaagatggct

SEQ ID NO: 4407660 - DNA, 20 bp, Homo sapiens
tgaaaaatgtttttattttt

SEQ ID NO: 4407661 - DNA, 15 bp, Homo sapiens
tgaaaacctaccagc

SEQ ID NO: 4407662 - DNA, 18 bp, Homo sapiens
tgaaaacctaccagccag

SEQ ID NO: 4407663 - DNA, 17 bp, Homo sapiens
tgaaaactctttgctgc

SEQ ID NO: 4407664 - DNA, 21 bp, Homo sapiens
tgaaaactgtgcaacttttta

SEQ ID NO: 4407665 - DNA, 13 bp, Homo sapiens
tgaaaagaatttg

SEQ ID NO: 4407666 - DNA, 19 bp, Homo sapiens
tgaaaagactccaaagaaa

SEQ ID NO: 4407667 - DNA, 22 bp, Homo sapiens
tgaaaagactccaaagaaatgt

SEQ ID NO: 4407668 - DNA, 16 bp, Homo sapiens
tgaaaagagaatgatg

SEQ ID NO: 4407669 - DNA, 21 bp, Homo sapiens
tgaaaagagaatgatgctcaa

SEQ ID NO: 4407670 - DNA, 14 bp, Homo sapiens
tgaaaagcaatatt

SEQ ID NO: 4407671 - DNA, 16 bp, Homo sapiens
tgaaaagcaatattgt

SEQ ID NO: 4407672 - DNA, 13 bp, Homo sapiens
tgaaaagcacaca

SEQ ID NO: 4407673 - DNA, 13 bp, Homo sapiens
tgaaaagcacaga

SEQ ID NO: 4407674 - DNA, 19 bp, Homo sapiens
tgaaaagctccatcaatga

SEQ ID NO: 4407675 - DNA, 18 bp, Homo sapiens
tgaaaaggaacttgccct

SEQ ID NO: 4407676 - DNA, 17 bp, Homo sapiens
tgaaaaggttgcctgaa

SEQ ID NO: 4407677 - DNA, 19 bp, Homo sapiens
tgaaaaggtttatgaaaaa

SEQ ID NO: 4407678 - DNA, 21 bp, Homo sapiens
tgaaaaggtttatgaaaaaga

SEQ ID NO: 4407679 - DNA, 12 bp, Homo sapiens
tgaaaagtcgtt

SEQ ID NO: 4407680 - DNA, 20 bp, Homo sapiens
tgaaaataaaacacacctcg

SEQ ID NO: 4407681 - DNA, 21 bp, Homo sapiens
tgaaaataactgaatttggag

SEQ ID NO: 4407682 - DNA, 16 bp, Homo sapiens
tgaaaataagaataga

SEQ ID NO: 4407683 - DNA, 19 bp, Homo sapiens
tgaaaatacaacttaaata

SEQ ID NO: 4407684 - DNA, 16 bp, Homo sapiens
tgaaaatagtgtaaga

SEQ ID NO: 4407685 - DNA, 21 bp, Homo sapiens
tgaaaatagtgtaagaactgt

SEQ ID NO: 4407686 - DNA, 21 bp, Homo sapiens
tgaaaatatagacattctcac

SEQ ID NO: 4407687 - DNA, 22 bp, Homo sapiens
tgaaaatatagacattctcaca

SEQ ID NO: 4407688 - DNA, 18 bp, Homo sapiens
tgaaaatatctgctcaaa

SEQ ID NO: 4407689 - DNA, 23 bp, Homo sapiens
tgaaaatatctgctcaaaacttt

SEQ ID NO: 4407690 - DNA, 17 bp, Homo sapiens
tgaaaatatgtactgta

SEQ ID NO: 4407691 - DNA, 20 bp, Homo sapiens
tgaaaatattgttttacaat

SEQ ID NO: 4407692 - DNA, 23 bp, Homo sapiens
tgaaaatattgttttacaatagt

SEQ ID NO: 4407693 - DNA, 21 bp, Homo sapiens
tgaaaatatttgtatcacaaa

SEQ ID NO: 4407694 - DNA, 16 bp, Homo sapiens
tgaaaatgggctcaac

SEQ ID NO: 4407695 - DNA, 21 bp, Homo sapiens
tgaaaatgtattcctttaaaa

SEQ ID NO: 4407696 - DNA, 13 bp, Homo sapiens
tgaaaatgtcttg

SEQ ID NO: 4407697 - DNA, 17 bp, Homo sapiens
tgaaaatgtgctatact

SEQ ID NO: 4407698 - DNA, 20 bp, Homo sapiens
tgaaaatgtgctatactgca

SEQ ID NO: 4407699 - DNA, 13 bp, Homo sapiens
tgaaaatgttttt

SEQ ID NO: 4407700 - DNA, 13 bp, Homo sapiens
tgaaaattattta

SEQ ID NO: 4407701 - DNA, 19 bp, Homo sapiens
tgaaaattgtataaattac

SEQ ID NO: 4407702 - DNA, 22 bp, Homo sapiens
tgaaacaacaaataggaattgt

SEQ ID NO: 4407703 - DNA, 20 bp, Homo sapiens
tgaaacactttgcctcctgt

SEQ ID NO: 4407704 - DNA, 22 bp, Homo sapiens
tgaaacagctgccttagcttca

SEQ ID NO: 4407705 - DNA, 23 bp, Homo sapiens
tgaaacagctgccttagcttcag

SEQ ID NO: 4407706 - DNA, 18 bp, Homo sapiens
tgaaacagggaaaatgaa

SEQ ID NO: 4407707 - DNA, 13 bp, Homo sapiens
tgaaaccagtatt

SEQ ID NO: 4407708 - DNA, 17 bp, Homo sapiens
tgaaacccgccctcagg

SEQ ID NO: 4407709 - DNA, 21 bp, Homo sapiens
tgaaacctcagggctgtccca

SEQ ID NO: 4407710 - DNA, 23 bp, Homo sapiens
tgaaactcgcgagtgtaactttc

SEQ ID NO: 4407711 - DNA, 18 bp, Homo sapiens
tgaaactggttcctacat

SEQ ID NO: 4407712 - DNA, 20 bp, Homo sapiens
tgaaagaatagaacacagtt

SEQ ID NO: 4407713 - DNA, 15 bp, Homo sapiens
tgaaagactgaagaa

SEQ ID NO: 4407714 - DNA, 16 bp, Homo sapiens
tgaaagactgaagaaa

SEQ ID NO: 4407715 - DNA, 22 bp, Homo sapiens
tgaaagactgaagaaagtgtag

SEQ ID NO: 4407716 - DNA, 18 bp, Homo sapiens
tgaaagagaaagactgat

SEQ ID NO: 4407717 - DNA, 18 bp, Homo sapiens
tgaaagaggaatgaagta

SEQ ID NO: 4407718 - DNA, 18 bp, Homo sapiens
tgaaagaggcagcttgaa

SEQ ID NO: 4407719 - DNA, 12 bp, Homo sapiens
tgaaagatgtat

SEQ ID NO: 4407720 - DNA, 17 bp, Homo sapiens
tgaaagccttagggaag

SEQ ID NO: 4407721 - DNA, 18 bp, Homo sapiens
tgaaagcttcaaagttta

SEQ ID NO: 4407722 - DNA, 15 bp, Homo sapiens
tgaaagctttaatgt

SEQ ID NO: 4407723 - DNA, 12 bp, Homo sapiens
tgaaagggaaac

SEQ ID NO: 4407724 - DNA, 21 bp, Homo sapiens
tgaaaggggacacctgtacat

SEQ ID NO: 4407725 - DNA, 19 bp, Homo sapiens
tgaaaggttagagaataaa

SEQ ID NO: 4407726 - DNA, 15 bp, Homo sapiens
tgaaagtagggggct

SEQ ID NO: 4407727 - DNA, 16 bp, Homo sapiens
tgaaagtgatgacata

SEQ ID NO: 4407728 - DNA, 15 bp, Homo sapiens
tgaaagttaatccac

SEQ ID NO: 4407729 - DNA, 14 bp, Homo sapiens
tgaaagttgctttt

SEQ ID NO: 4407730 - DNA, 17 bp, Homo sapiens
tgaaagttgcttttatt

SEQ ID NO: 4407731 - DNA, 18 bp, Homo sapiens
tgaaagttgcttttattg

SEQ ID NO: 4407732 - DNA, 16 bp, Homo sapiens
tgaaagttgtacatga

SEQ ID NO: 4407733 - DNA, 22 bp, Homo sapiens
tgaaagttttgtaaaagaaatc

SEQ ID NO: 4407734 - DNA, 21 bp, Homo sapiens
tgaaataaagacccaggggga

SEQ ID NO: 4407735 - DNA, 18 bp, Homo sapiens
tgaaataaccgtaaaggt

SEQ ID NO: 4407736 - DNA, 14 bp, Homo sapiens
tgaaataactggaa

SEQ ID NO: 4407737 - DNA, 12 bp, Homo sapiens
tgaaataataga

SEQ ID NO: 4407738 - DNA, 11 bp, Homo sapiens
tgaaataattt

SEQ ID NO: 4407739 - DNA, 23 bp, Homo sapiens
tgaaataccttttctcacaaaaa

SEQ ID NO: 4407740 - DNA, 18 bp, Homo sapiens
tgaaatacttttgagtat

SEQ ID NO: 4407741 - DNA, 22 bp, Homo sapiens
tgaaataggagggaaacctttg

SEQ ID NO: 4407742 - DNA, 14 bp, Homo sapiens
tgaaatagtataca

SEQ ID NO: 4407743 - DNA, 16 bp, Homo sapiens
tgaaatagtatacatt

SEQ ID NO: 4407744 - DNA, 22 bp, Homo sapiens
tgaaatagtatacattgtcttg

SEQ ID NO: 4407745 - DNA, 13 bp, Homo sapiens
tgaaatagtctgt

SEQ ID NO: 4407746 - DNA, 18 bp, Homo sapiens
tgaaatagtctgtgtgaa

SEQ ID NO: 4407747 - DNA, 19 bp, Homo sapiens
tgaaatatatgtgaaagga

SEQ ID NO: 4407748 - DNA, 14 bp, Homo sapiens
tgaaatatcatgtt

SEQ ID NO: 4407749 - DNA, 20 bp, Homo sapiens
tgaaatatcccgggggtggg

SEQ ID NO: 4407750 - DNA, 20 bp, Homo sapiens
tgaaatatgatgttaaaaaa

SEQ ID NO: 4407751 - DNA, 14 bp, Homo sapiens
tgaaatattcagaa

SEQ ID NO: 4407752 - DNA, 15 bp, Homo sapiens
tgaaatattcagaaa

SEQ ID NO: 4407753 - DNA, 17 bp, Homo sapiens
tgaaatattcagaaatt

SEQ ID NO: 4407754 - DNA, 19 bp, Homo sapiens
tgaaatcccatctctacaa

SEQ ID NO: 4407755 - DNA, 13 bp, Homo sapiens
tgaaatcttgttt

SEQ ID NO: 4407756 - DNA, 21 bp, Homo sapiens
tgaaatcttgtttgttactgt

SEQ ID NO: 4407757 - DNA, 22 bp, Homo sapiens
tgaaatcttgtttgttactgtc

SEQ ID NO: 4407758 - DNA, 12 bp, Homo sapiens
tgaaatgaaagg

SEQ ID NO: 4407759 - DNA, 16 bp, Homo sapiens
tgaaatgaaagggaaa

SEQ ID NO: 4407760 - DNA, 15 bp, Homo sapiens
tgaaatgacatttca

SEQ ID NO: 4407761 - DNA, 16 bp, Homo sapiens
tgaaatgacatttcac

SEQ ID NO: 4407762 - DNA, 17 bp, Homo sapiens
tgaaatgacatttcact

SEQ ID NO: 4407763 - DNA, 16 bp, Homo sapiens
tgaaatgataaagact

SEQ ID NO: 4407764 - DNA, 17 bp, Homo sapiens
tgaaatgataaagactt

SEQ ID NO: 4407765 - DNA, 18 bp, Homo sapiens
tgaaatgataaagacttt

SEQ ID NO: 4407766 - DNA, 13 bp, Homo sapiens
tgaaatgctgtat

SEQ ID NO: 4407767 - DNA, 17 bp, Homo sapiens
tgaaatgctgttagtaa

SEQ ID NO: 4407768 - DNA, 13 bp, Homo sapiens
tgaaatgtcaacc

SEQ ID NO: 4407769 - DNA, 21 bp, Homo sapiens
tgaaatgtcccctcaaactca

SEQ ID NO: 4407770 - DNA, 23 bp, Homo sapiens
tgaaatgtcccctcaaactcatt

SEQ ID NO: 4407771 - DNA, 20 bp, Homo sapiens
tgaaatgtgttttgtctttt

SEQ ID NO: 4407772 - DNA, 21 bp, Homo sapiens
tgaaatgttaacaatgcctat

SEQ ID NO: 4407773 - DNA, 13 bp, Homo sapiens
tgaaatgtttcct

SEQ ID NO: 4407774 - DNA, 21 bp, Homo sapiens
tgaaattaacacaaaggaagt

SEQ ID NO: 4407775 - DNA, 22 bp, Homo sapiens
tgaaattaactgggtaatgaaa

SEQ ID NO: 4407776 - DNA, 13 bp, Homo sapiens
tgaaattctattt

SEQ ID NO: 4407777 - DNA, 12 bp, Homo sapiens
tgaaattctgaa

SEQ ID NO: 4407778 - DNA, 15 bp, Homo sapiens
tgaaattctgaattt

SEQ ID NO: 4407779 - DNA, 18 bp, Homo sapiens
tgaaattctgaatttgca

SEQ ID NO: 4407780 - DNA, 20 bp, Homo sapiens
tgaaattctgaatttgcaaa

SEQ ID NO: 4407781 - DNA, 21 bp, Homo sapiens
tgaaattctgaatttgcaaag

SEQ ID NO: 4407782 - DNA, 22 bp, Homo sapiens
tgaaattctgaatttgcaaagt

SEQ ID NO: 4407783 - DNA, 19 bp, Homo sapiens
tgaaattgtatctcagtct

SEQ ID NO: 4407784 - DNA, 16 bp, Homo sapiens
tgaaatttacacagtg

SEQ ID NO: 4407785 - DNA, 23 bp, Homo sapiens
tgaaatttacacagtgagactgt

SEQ ID NO: 4407786 - DNA, 14 bp, Homo sapiens
tgaaatttctagcc

SEQ ID NO: 4407787 - DNA, 15 bp, Homo sapiens
tgaaatttctagcct

SEQ ID NO: 4407788 - DNA, 16 bp, Homo sapiens
tgaaatttctagcctg

SEQ ID NO: 4407789 - DNA, 21 bp, Homo sapiens
tgaaatttctagcctgcactt

SEQ ID NO: 4407790 - DNA, 22 bp, Homo sapiens
tgaaattttaacctatgatatt

SEQ ID NO: 4407791 - DNA, 18 bp, Homo sapiens
tgaaattttagaaatatt

SEQ ID NO: 4407792 - DNA, 22 bp, Homo sapiens
tgaaattttatatgcttactga

SEQ ID NO: 4407793 - DNA, 20 bp, Homo sapiens
tgaaattttcttgatttgag

SEQ ID NO: 4407794 - DNA, 21 bp, Homo sapiens
tgaaattttttagtatgttca

SEQ ID NO: 4407795 - DNA, 13 bp, Homo sapiens
tgaacaaatttac

SEQ ID NO: 4407796 - DNA, 23 bp, Homo sapiens
tgaacaagtgggccattagccag

SEQ ID NO: 4407797 - DNA, 21 bp, Homo sapiens
tgaacaatgtatacaatgcac

SEQ ID NO: 4407798 - DNA, 23 bp, Homo sapiens
tgaacagaaactacatttctact

SEQ ID NO: 4407799 - DNA, 18 bp, Homo sapiens
tgaacagcttgccaggga

SEQ ID NO: 4407800 - DNA, 22 bp, Homo sapiens
tgaacagctttgtatgtttatg

SEQ ID NO: 4407801 - DNA, 17 bp, Homo sapiens
tgaacaggaaactcctg

SEQ ID NO: 4407802 - DNA, 12 bp, Homo sapiens
tgaacatattca

SEQ ID NO: 4407803 - DNA, 16 bp, Homo sapiens
tgaacatccaagtctt

SEQ ID NO: 4407804 - DNA, 22 bp, Homo sapiens
tgaacatccaagtctttcttct

SEQ ID NO: 4407805 - DNA, 16 bp, Homo sapiens
tgaacattaaaatata

SEQ ID NO: 4407806 - DNA, 22 bp, Homo sapiens
tgaacattaatccacatgtttc

SEQ ID NO: 4407807 - DNA, 19 bp, Homo sapiens
tgaacattctcctgtggaa

SEQ ID NO: 4407808 - DNA, 22 bp, Homo sapiens
tgaacatttactacagttttta

SEQ ID NO: 4407809 - DNA, 19 bp, Homo sapiens
tgaaccaaaaatagaaatt

SEQ ID NO: 4407810 - DNA, 20 bp, Homo sapiens
tgaaccaaaaatagaaatta

SEQ ID NO: 4407811 - DNA, 14 bp, Homo sapiens
tgaaccaatgcaag

SEQ ID NO: 4407812 - DNA, 20 bp, Homo sapiens
tgaaccagagggtgtggctt

SEQ ID NO: 4407813 - DNA, 22 bp, Homo sapiens
tgaaccagagggtgtggctttc

SEQ ID NO: 4407814 - DNA, 14 bp, Homo sapiens
tgaaccaggccaga

SEQ ID NO: 4407815 - DNA, 12 bp, Homo sapiens
tgaacccaggag

SEQ ID NO: 4407816 - DNA, 14 bp, Homo sapiens
tgaacccaggaggt

SEQ ID NO: 4407817 - DNA, 21 bp, Homo sapiens
tgaacccttcctgagctttat

SEQ ID NO: 4407818 - DNA, 13 bp, Homo sapiens
tgaaccctttgtt

SEQ ID NO: 4407819 - DNA, 15 bp, Homo sapiens
tgaacctccaaatgg

SEQ ID NO: 4407820 - DNA, 13 bp, Homo sapiens
tgaacctggatcc

SEQ ID NO: 4407821 - DNA, 14 bp, Homo sapiens
tgaacgccaaggaa

SEQ ID NO: 4407822 - DNA, 15 bp, Homo sapiens
tgaacggggagaaaa

SEQ ID NO: 4407823 - DNA, 15 bp, Homo sapiens
tgaactaatatatga

SEQ ID NO: 4407824 - DNA, 20 bp, Homo sapiens
tgaactaccttggttccccc

SEQ ID NO: 4407825 - DNA, 18 bp, Homo sapiens
tgaactattttaaataaa

SEQ ID NO: 4407826 - DNA, 19 bp, Homo sapiens
tgaactattttaaataaaa

SEQ ID NO: 4407827 - DNA, 20 bp, Homo sapiens
tgaactattttaaataaaat

SEQ ID NO: 4407828 - DNA, 16 bp, Homo sapiens
tgaactcaaactgagg

SEQ ID NO: 4407829 - DNA, 15 bp, Homo sapiens
tgaactcaccctggg

SEQ ID NO: 4407830 - DNA, 21 bp, Homo sapiens
tgaactcaccctgggagccag

SEQ ID NO: 4407831 - DNA, 18 bp, Homo sapiens
tgaactcagatctgtctg

SEQ ID NO: 4407832 - DNA, 16 bp, Homo sapiens
tgaactcatcattttt

SEQ ID NO: 4407833 - DNA, 12 bp, Homo sapiens
tgaactccagag

SEQ ID NO: 4407834 - DNA, 13 bp, Homo sapiens
tgaactccagagg

SEQ ID NO: 4407835 - DNA, 14 bp, Homo sapiens
tgaactccatacag

SEQ ID NO: 4407836 - DNA, 19 bp, Homo sapiens
tgaactccatacagcctct

SEQ ID NO: 4407837 - DNA, 13 bp, Homo sapiens
tgaactctcaaat

SEQ ID NO: 4407838 - DNA, 20 bp, Homo sapiens
tgaactctggtgctcctgca

SEQ ID NO: 4407839 - DNA, 12 bp, Homo sapiens
tgaactgaacac

SEQ ID NO: 4407840 - DNA, 20 bp, Homo sapiens
tgaactgaaggcagcatgta

SEQ ID NO: 4407841 - DNA, 17 bp, Homo sapiens
tgaactgacaatgaagg

SEQ ID NO: 4407842 - DNA, 18 bp, Homo sapiens
tgaactgcagcaatcaca

SEQ ID NO: 4407843 - DNA, 19 bp, Homo sapiens
tgaactgcagcaatcacaa

SEQ ID NO: 4407844 - DNA, 16 bp, Homo sapiens
tgaactggaagaaagc

SEQ ID NO: 4407845 - DNA, 12 bp, Homo sapiens
tgaactgtgtgt

SEQ ID NO: 4407846 - DNA, 22 bp, Homo sapiens
tgaactgttacaacttgtattt

SEQ ID NO: 4407847 - DNA, 16 bp, Homo sapiens
tgaacttataatgatt

SEQ ID NO: 4407848 - DNA, 23 bp, Homo sapiens
tgaagaagcacttctgctgcatc

SEQ ID NO: 4407849 - DNA, 23 bp, Homo sapiens
tgaagaaggaaggcctgagcccc

SEQ ID NO: 4407850 - DNA, 13 bp, Homo sapiens
tgaagaagttaat

SEQ ID NO: 4407851 - DNA, 11 bp, Homo sapiens
tgaagaatcac

SEQ ID NO: 4407852 - DNA, 17 bp, Homo sapiens
tgaagaatttagatctt

SEQ ID NO: 4407853 - DNA, 14 bp, Homo sapiens
tgaagacaataatt

SEQ ID NO: 4407854 - DNA, 23 bp, Homo sapiens
tgaagagacagagacaagtaatt

SEQ ID NO: 4407855 - DNA, 12 bp, Homo sapiens
tgaagagctctt

SEQ ID NO: 4407856 - DNA, 19 bp, Homo sapiens
tgaagaggaccagaggagc

SEQ ID NO: 4407857 - DNA, 23 bp, Homo sapiens
tgaagagtaagtcaacctgcctg

SEQ ID NO: 4407858 - DNA, 13 bp, Homo sapiens
tgaagagtcagaa

SEQ ID NO: 4407859 - DNA, 12 bp, Homo sapiens
tgaagatgaaat

SEQ ID NO: 4407860 - DNA, 21 bp, Homo sapiens
tgaagattctatgttaatatt

SEQ ID NO: 4407861 - DNA, 14 bp, Homo sapiens
tgaagcaaatcaga

SEQ ID NO: 4407862 - DNA, 15 bp, Homo sapiens
tgaagcaaatcagaa

SEQ ID NO: 4407863 - DNA, 18 bp, Homo sapiens
tgaagcaaatcagaaact

SEQ ID NO: 4407864 - DNA, 20 bp, Homo sapiens
tgaagcaactacaacttctc

SEQ ID NO: 4407865 - DNA, 21 bp, Homo sapiens
tgaagcaattagtctgaaact

SEQ ID NO: 4407866 - DNA, 12 bp, Homo sapiens
tgaagcagcact

SEQ ID NO: 4407867 - DNA, 13 bp, Homo sapiens
tgaagcagcactg

SEQ ID NO: 4407868 - DNA, 17 bp, Homo sapiens
tgaagcagggtttcttt

SEQ ID NO: 4407869 - DNA, 21 bp, Homo sapiens
tgaagcagggtttcttttctt

SEQ ID NO: 4407870 - DNA, 15 bp, Homo sapiens
tgaagcagtattttg

SEQ ID NO: 4407871 - DNA, 17 bp, Homo sapiens
tgaagcagtcttgctct

SEQ ID NO: 4407872 - DNA, 20 bp, Homo sapiens
tgaagcagtcttgctctgtt

SEQ ID NO: 4407873 - DNA, 23 bp, Homo sapiens
tgaagcatagctacaatttgttt

SEQ ID NO: 4407874 - DNA, 14 bp, Homo sapiens
tgaagccaaagaaa

SEQ ID NO: 4407875 - DNA, 23 bp, Homo sapiens
tgaagccaagtggggtgctggga

SEQ ID NO: 4407876 - DNA, 21 bp, Homo sapiens
tgaagccagctggacttcctg

SEQ ID NO: 4407877 - DNA, 14 bp, Homo sapiens
tgaagcctctggga

SEQ ID NO: 4407878 - DNA, 13 bp, Homo sapiens
tgaagcctttatc

SEQ ID NO: 4407879 - DNA, 16 bp, Homo sapiens
tgaagctcacttctgg

SEQ ID NO: 4407880 - DNA, 19 bp, Homo sapiens
tgaagctcgcatccagaca

SEQ ID NO: 4407881 - DNA, 20 bp, Homo sapiens
tgaagctcgcatccagacag

SEQ ID NO: 4407882 - DNA, 12 bp, Homo sapiens
tgaagctgcaca

SEQ ID NO: 4407883 - DNA, 12 bp, Homo sapiens
tgaagctgctgt

SEQ ID NO: 4407884 - DNA, 14 bp, Homo sapiens
tgaagctgctgtgt

SEQ ID NO: 4407885 - DNA, 18 bp, Homo sapiens
tgaagctgctgtgtcctc

SEQ ID NO: 4407886 - DNA, 14 bp, Homo sapiens
tgaaggaagagaag

SEQ ID NO: 4407887 - DNA, 15 bp, Homo sapiens
tgaaggaattacatt

SEQ ID NO: 4407888 - DNA, 23 bp, Homo sapiens
tgaaggagaaaatagataattta

SEQ ID NO: 4407889 - DNA, 21 bp, Homo sapiens
tgaaggattatggaaaaataa

SEQ ID NO: 4407890 - DNA, 14 bp, Homo sapiens
tgaaggcaaaattg

SEQ ID NO: 4407891 - DNA, 17 bp, Homo sapiens
tgaagggcattctttcc

SEQ ID NO: 4407892 - DNA, 11 bp, Homo sapiens
tgaagggccag

SEQ ID NO: 4407893 - DNA, 23 bp, Homo sapiens
tgaaggggcaaattcttttgaat

SEQ ID NO: 4407894 - DNA, 19 bp, Homo sapiens
tgaaggtctcctaaaactg

SEQ ID NO: 4407895 - DNA, 18 bp, Homo sapiens
tgaaggtgataagggaaa

SEQ ID NO: 4407896 - DNA, 18 bp, Homo sapiens
tgaaggtttcagatgagg

SEQ ID NO: 4407897 - DNA, 14 bp, Homo sapiens
tgaagtaatgaatt

SEQ ID NO: 4407898 - DNA, 20 bp, Homo sapiens
tgaagtacaaacatgaaaaa

SEQ ID NO: 4407899 - DNA, 19 bp, Homo sapiens
tgaagtattacatgattta

SEQ ID NO: 4407900 - DNA, 20 bp, Homo sapiens
tgaagtattttgctggaata

SEQ ID NO: 4407901 - DNA, 14 bp, Homo sapiens
tgaagtcaaaatat

SEQ ID NO: 4407902 - DNA, 18 bp, Homo sapiens
tgaagtcaaaatatgtaa

SEQ ID NO: 4407903 - DNA, 13 bp, Homo sapiens
tgaagtccttcag

SEQ ID NO: 4407904 - DNA, 22 bp, Homo sapiens
tgaagtccttcagtgagcccct

SEQ ID NO: 4407905 - DNA, 16 bp, Homo sapiens
tgaagtcgttgtgagg

SEQ ID NO: 4407906 - DNA, 15 bp, Homo sapiens
tgaagtctagaatca

SEQ ID NO: 4407907 - DNA, 22 bp, Homo sapiens
tgaagtgctgtttattaatctt

SEQ ID NO: 4407908 - DNA, 14 bp, Homo sapiens
tgaagtgcttgcag

SEQ ID NO: 4407909 - DNA, 16 bp, Homo sapiens
tgaagtgtggctggtg

SEQ ID NO: 4407910 - DNA, 18 bp, Homo sapiens
tgaagtgtggctggtgtc

SEQ ID NO: 4407911 - DNA, 16 bp, Homo sapiens
tgaagtgttaatacat

SEQ ID NO: 4407912 - DNA, 15 bp, Homo sapiens
tgaagttagtggaaa

SEQ ID NO: 4407913 - DNA, 21 bp, Homo sapiens
tgaagttagtggaaatctgaa

SEQ ID NO: 4407914 - DNA, 18 bp, Homo sapiens
tgaagttttattttaaat

SEQ ID NO: 4407915 - DNA, 19 bp, Homo sapiens
tgaagttttccttgctatt

SEQ ID NO: 4407916 - DNA, 17 bp, Homo sapiens
tgaagttttgatttatt

SEQ ID NO: 4407917 - DNA, 19 bp, Homo sapiens
tgaagtttttaaaaataaa

SEQ ID NO: 4407918 - DNA, 20 bp, Homo sapiens
tgaagtttttaaaaataaag

SEQ ID NO: 4407919 - DNA, 15 bp, Homo sapiens
tgaataaagaatact

SEQ ID NO: 4407920 - DNA, 20 bp, Homo sapiens
tgaataaattttcaaatcct

SEQ ID NO: 4407921 - DNA, 21 bp, Homo sapiens
tgaataaattttcaaatcctt

SEQ ID NO: 4407922 - DNA, 15 bp, Homo sapiens
tgaataacatttaaa

SEQ ID NO: 4407923 - DNA, 16 bp, Homo sapiens
tgaataataagcagga

SEQ ID NO: 4407924 - DNA, 20 bp, Homo sapiens
tgaataataagcaggatgtt

SEQ ID NO: 4407925 - DNA, 22 bp, Homo sapiens
tgaataatgaaaataaaacaca

SEQ ID NO: 4407926 - DNA, 17 bp, Homo sapiens
tgaataatgcctttgta

SEQ ID NO: 4407927 - DNA, 14 bp, Homo sapiens
tgaataccccaaga

SEQ ID NO: 4407928 - DNA, 14 bp, Homo sapiens
tgaatacctgctca

SEQ ID NO: 4407929 - DNA, 20 bp, Homo sapiens
tgaatactctgccctctaga

SEQ ID NO: 4407930 - DNA, 19 bp, Homo sapiens
tgaatactgtctgtatctt

SEQ ID NO: 4407931 - DNA, 19 bp, Homo sapiens
tgaataggaaataaaatta

SEQ ID NO: 4407932 - DNA, 21 bp, Homo sapiens
tgaatagttaaaaattaaata

SEQ ID NO: 4407933 - DNA, 21 bp, Homo sapiens
tgaatagtttatttctgtgaa

SEQ ID NO: 4407934 - DNA, 14 bp, Homo sapiens
tgaatataaatgtg

SEQ ID NO: 4407935 - DNA, 20 bp, Homo sapiens
tgaatatatggcatttgcag

SEQ ID NO: 4407936 - DNA, 22 bp, Homo sapiens
tgaatatgatccctaatgtgtt

SEQ ID NO: 4407937 - DNA, 14 bp, Homo sapiens
tgaatatggtgtct

SEQ ID NO: 4407938 - DNA, 14 bp, Homo sapiens
tgaatatttgtaaa

SEQ ID NO: 4407939 - DNA, 19 bp, Homo sapiens
tgaatatttgttttaatac

SEQ ID NO: 4407940 - DNA, 22 bp, Homo sapiens
tgaatattttcaagtttttcat

SEQ ID NO: 4407941 - DNA, 15 bp, Homo sapiens
tgaatattttgataa

SEQ ID NO: 4407942 - DNA, 16 bp, Homo sapiens
tgaatattttgataat

SEQ ID NO: 4407943 - DNA, 18 bp, Homo sapiens
tgaatcaagcaatatgga

SEQ ID NO: 4407944 - DNA, 15 bp, Homo sapiens
tgaatcaataatata

SEQ ID NO: 4407945 - DNA, 16 bp, Homo sapiens
tgaatcaataatatat

SEQ ID NO: 4407946 - DNA, 17 bp, Homo sapiens
tgaatcaatctggcttc

SEQ ID NO: 4407947 - DNA, 18 bp, Homo sapiens
tgaatcaccaattaaaaa

SEQ ID NO: 4407948 - DNA, 22 bp, Homo sapiens
tgaatcagaccctaccccacca

SEQ ID NO: 4407949 - DNA, 18 bp, Homo sapiens
tgaatccaactgcttaaa

SEQ ID NO: 4407950 - DNA, 23 bp, Homo sapiens
tgaatctatggctttaaataaat

SEQ ID NO: 4407951 - DNA, 12 bp, Homo sapiens
tgaatctcaaag

SEQ ID NO: 4407952 - DNA, 19 bp, Homo sapiens
tgaatctgagagatgctgt

SEQ ID NO: 4407953 - DNA, 21 bp, Homo sapiens
tgaatctgtgcaaacagtaac

SEQ ID NO: 4407954 - DNA, 17 bp, Homo sapiens
tgaatgaaaatgtccat

SEQ ID NO: 4407955 - DNA, 15 bp, Homo sapiens
tgaatgaacactctt

SEQ ID NO: 4407956 - DNA, 16 bp, Homo sapiens
tgaatgagtttttaat

SEQ ID NO: 4407957 - DNA, 17 bp, Homo sapiens
tgaatgatttttcattg

SEQ ID NO: 4407958 - DNA, 16 bp, Homo sapiens
tgaatgcataatgttt

SEQ ID NO: 4407959 - DNA, 14 bp, Homo sapiens
tgaatgccaaagcc

SEQ ID NO: 4407960 - DNA, 20 bp, Homo sapiens
tgaatgctatgttctgggaa

SEQ ID NO: 4407961 - DNA, 14 bp, Homo sapiens
tgaatgctgagacc

SEQ ID NO: 4407962 - DNA, 18 bp, Homo sapiens
tgaatgtagaataggcag

SEQ ID NO: 4407963 - DNA, 19 bp, Homo sapiens
tgaatgtagaataggcagg

SEQ ID NO: 4407964 - DNA, 13 bp, Homo sapiens
tgaatgtatgtaa

SEQ ID NO: 4407965 - DNA, 15 bp, Homo sapiens
tgaatgtcagttgtt

SEQ ID NO: 4407966 - DNA, 21 bp, Homo sapiens
tgaatgtcttgttcctgtgca

SEQ ID NO: 4407967 - DNA, 13 bp, Homo sapiens
tgaatgtgaaaca

SEQ ID NO: 4407968 - DNA, 14 bp, Homo sapiens
tgaatgtgaaacat

SEQ ID NO: 4407969 - DNA, 16 bp, Homo sapiens
tgaatgtggcagttta

SEQ ID NO: 4407970 - DNA, 18 bp, Homo sapiens
tgaatgtggctgaagttg

SEQ ID NO: 4407971 - DNA, 20 bp, Homo sapiens
tgaatgtggctgaagttgaa

SEQ ID NO: 4407972 - DNA, 18 bp, Homo sapiens
tgaatgttagatgcttag

SEQ ID NO: 4407973 - DNA, 20 bp, Homo sapiens
tgaatgttgcaatgtgaaaa

SEQ ID NO: 4407974 - DNA, 16 bp, Homo sapiens
tgaattaaattaggaa

SEQ ID NO: 4407975 - DNA, 16 bp, Homo sapiens
tgaattagaaaattag

SEQ ID NO: 4407976 - DNA, 17 bp, Homo sapiens
tgaattaggctgtaact

SEQ ID NO: 4407977 - DNA, 15 bp, Homo sapiens
tgaattatcagcaaa

SEQ ID NO: 4407978 - DNA, 17 bp, Homo sapiens
tgaattatcagcaaaga

SEQ ID NO: 4407979 - DNA, 19 bp, Homo sapiens
tgaattatcagcaaagaaa

SEQ ID NO: 4407980 - DNA, 21 bp, Homo sapiens
tgaattatcttggttgaaaat

SEQ ID NO: 4407981 - DNA, 17 bp, Homo sapiens
tgaattattgacactga

SEQ ID NO: 4407982 - DNA, 18 bp, Homo sapiens
tgaattattgacactgaa

SEQ ID NO: 4407983 - DNA, 21 bp, Homo sapiens
tgaattattgacactgaactt

SEQ ID NO: 4407984 - DNA, 17 bp, Homo sapiens
tgaattcaagaaaggaa

SEQ ID NO: 4407985 - DNA, 16 bp, Homo sapiens
tgaattcctagaatta

SEQ ID NO: 4407986 - DNA, 15 bp, Homo sapiens
tgaattcctctcaaa

SEQ ID NO: 4407987 - DNA, 23 bp, Homo sapiens
tgaattcctctcaaattcagctc

SEQ ID NO: 4407988 - DNA, 21 bp, Homo sapiens
tgaattcttggttgaggaaac

SEQ ID NO: 4407989 - DNA, 23 bp, Homo sapiens
tgaattctttgtttatgcacttt

SEQ ID NO: 4407990 - DNA, 13 bp, Homo sapiens
tgaattgagaata

SEQ ID NO: 4407991 - DNA, 23 bp, Homo sapiens
tgaattggctaaaagacatgcat

SEQ ID NO: 4407992 - DNA, 16 bp, Homo sapiens
tgaattggcttccaga

SEQ ID NO: 4407993 - DNA, 16 bp, Homo sapiens
tgaattgtatcaattt

SEQ ID NO: 4407994 - DNA, 17 bp, Homo sapiens
tgaatttaattctttca

SEQ ID NO: 4407995 - DNA, 14 bp, Homo sapiens
tgaatttatcttta

SEQ ID NO: 4407996 - DNA, 18 bp, Homo sapiens
tgaatttattgatattta

SEQ ID NO: 4407997 - DNA, 13 bp, Homo sapiens
tgaatttcactgt

SEQ ID NO: 4407998 - DNA, 14 bp, Homo sapiens
tgaatttcagtcct

SEQ ID NO: 4407999 - DNA, 11 bp, Homo sapiens
tgaatttgcaa

SEQ ID NO: 4408000 - DNA, 19 bp, Homo sapiens
tgaatttgcaaagtactgt

SEQ ID NO: 4408001 - DNA, 20 bp, Homo sapiens
tgaatttgcaaagtactgta

SEQ ID NO: 4408002 - DNA, 21 bp, Homo sapiens
tgaatttgcaaagtactgtaa

SEQ ID NO: 4408003 - DNA, 21 bp, Homo sapiens
tgaatttgtaagcaacttgct

SEQ ID NO: 4408004 - DNA, 13 bp, Homo sapiens
tgaatttgtactt

SEQ ID NO: 4408005 - DNA, 21 bp, Homo sapiens
tgaatttgtgtggtatgtcac

SEQ ID NO: 4408006 - DNA, 15 bp, Homo sapiens
tgaatttgtttgtga

SEQ ID NO: 4408007 - DNA, 17 bp, Homo sapiens
tgaatttttaagcaaat

SEQ ID NO: 4408008 - DNA, 15 bp, Homo sapiens
tgaatttttgcaata

SEQ ID NO: 4408009 - DNA, 17 bp, Homo sapiens
tgaatttttgcaataat

SEQ ID NO: 4408010 - DNA, 15 bp, Homo sapiens
tgaatttttttgtaa

SEQ ID NO: 4408011 - DNA, 21 bp, Homo sapiens
tgacaaaaaatgttttaaaga

SEQ ID NO: 4408012 - DNA, 14 bp, Homo sapiens
tgacaaaagaaaat

SEQ ID NO: 4408013 - DNA, 18 bp, Homo sapiens
tgacaaaattcatttgct

SEQ ID NO: 4408014 - DNA, 20 bp, Homo sapiens
tgacaaacccggaagatcag

SEQ ID NO: 4408015 - DNA, 21 bp, Homo sapiens
tgacaaacccggaagatcaga

SEQ ID NO: 4408016 - DNA, 19 bp, Homo sapiens
tgacaaagaaacccaagtg

SEQ ID NO: 4408017 - DNA, 14 bp, Homo sapiens
tgacaaataagatt

SEQ ID NO: 4408018 - DNA, 16 bp, Homo sapiens
tgacaaataagattaa

SEQ ID NO: 4408019 - DNA, 22 bp, Homo sapiens
tgacaaataagattaataagat

SEQ ID NO: 4408020 - DNA, 16 bp, Homo sapiens
tgacaaccattaaagt

SEQ ID NO: 4408021 - DNA, 19 bp, Homo sapiens
tgacaaccattaaagtcag

SEQ ID NO: 4408022 - DNA, 20 bp, Homo sapiens
tgacaacctccattctattt

SEQ ID NO: 4408023 - DNA, 16 bp, Homo sapiens
tgacaagatgggacag

SEQ ID NO: 4408024 - DNA, 19 bp, Homo sapiens
tgacaatagggctaaatgt

SEQ ID NO: 4408025 - DNA, 20 bp, Homo sapiens
tgacaatagggctaaatgtt

SEQ ID NO: 4408026 - DNA, 14 bp, Homo sapiens
tgacaatgaaggga

SEQ ID NO: 4408027 - DNA, 19 bp, Homo sapiens
tgacaattaacatacatca

SEQ ID NO: 4408028 - DNA, 22 bp, Homo sapiens
tgacacaactgtgtgattaaaa

SEQ ID NO: 4408029 - DNA, 16 bp, Homo sapiens
tgacacaccaggcgct

SEQ ID NO: 4408030 - DNA, 23 bp, Homo sapiens
tgacacagaaaatgttgagaatc

SEQ ID NO: 4408031 - DNA, 16 bp, Homo sapiens
tgacacatggcccctc

SEQ ID NO: 4408032 - DNA, 21 bp, Homo sapiens
tgacaccatcttttattcttt

SEQ ID NO: 4408033 - DNA, 15 bp, Homo sapiens
tgacaccctggcctg

SEQ ID NO: 4408034 - DNA, 18 bp, Homo sapiens
tgacaccctggcctgaac

SEQ ID NO: 4408035 - DNA, 18 bp, Homo sapiens
tgacaccgtgggtcatta

SEQ ID NO: 4408036 - DNA, 20 bp, Homo sapiens
tgacacgcagttgctcgctt

SEQ ID NO: 4408037 - DNA, 19 bp, Homo sapiens
tgacactagcccaatgaaa

SEQ ID NO: 4408038 - DNA, 23 bp, Homo sapiens
tgacactcaataaacagtcactg

SEQ ID NO: 4408039 - DNA, 10 bp, Homo sapiens
tgacactgaa

SEQ ID NO: 4408040 - DNA, 20 bp, Homo sapiens
tgacactgaaagttttgtaa

SEQ ID NO: 4408041 - DNA, 21 bp, Homo sapiens
tgacactgctctaacagccct

SEQ ID NO: 4408042 - DNA, 22 bp, Homo sapiens
tgacactttaattaccaacctg

SEQ ID NO: 4408043 - DNA, 13 bp, Homo sapiens
tgacagaggctgc

SEQ ID NO: 4408044 - DNA, 22 bp, Homo sapiens
tgacagagtgagaccctgtctc

SEQ ID NO: 4408045 - DNA, 18 bp, Homo sapiens
tgacagatgcctggtgag

SEQ ID NO: 4408046 - DNA, 14 bp, Homo sapiens
tgacagctccggga

SEQ ID NO: 4408047 - DNA, 14 bp, Homo sapiens
tgacagctgtccct

SEQ ID NO: 4408048 - DNA, 16 bp, Homo sapiens
tgacagctgtccctgt

SEQ ID NO: 4408049 - DNA, 17 bp, Homo sapiens
tgacagctgtccctgtc

SEQ ID NO: 4408050 - DNA, 18 bp, Homo sapiens
tgacagcttgagaaggtc

SEQ ID NO: 4408051 - DNA, 18 bp, Homo sapiens
tgacagcttggaaaggga

SEQ ID NO: 4408052 - DNA, 17 bp, Homo sapiens
tgacaggaaagccctcc

SEQ ID NO: 4408053 - DNA, 18 bp, Homo sapiens
tgacaggaaagccctccc

SEQ ID NO: 4408054 - DNA, 19 bp, Homo sapiens
tgacagggacatgccctgt

SEQ ID NO: 4408055 - DNA, 14 bp, Homo sapiens
tgacaggtcagcag

SEQ ID NO: 4408056 - DNA, 16 bp, Homo sapiens
tgacaggtcttttcaa

SEQ ID NO: 4408057 - DNA, 16 bp, Homo sapiens
tgacagtcaaaagatc

SEQ ID NO: 4408058 - DNA, 22 bp, Homo sapiens
tgacagtcactgcatttgcctg

SEQ ID NO: 4408059 - DNA, 14 bp, Homo sapiens
tgacagtcataaat

SEQ ID NO: 4408060 - DNA, 19 bp, Homo sapiens
tgacagtgaagcagcactg

SEQ ID NO: 4408061 - DNA, 14 bp, Homo sapiens
tgacagtgccttct

SEQ ID NO: 4408062 - DNA, 13 bp, Homo sapiens
tgacagtggctgc

SEQ ID NO: 4408063 - DNA, 20 bp, Homo sapiens
tgacagtggctgctctggga

SEQ ID NO: 4408064 - DNA, 14 bp, Homo sapiens
tgacagtgttttta

SEQ ID NO: 4408065 - DNA, 16 bp, Homo sapiens
tgacataaagttgata

SEQ ID NO: 4408066 - DNA, 15 bp, Homo sapiens
tgacataattgtcca

SEQ ID NO: 4408067 - DNA, 13 bp, Homo sapiens
tgacatacatatt

SEQ ID NO: 4408068 - DNA, 12 bp, Homo sapiens
tgacatacctac

SEQ ID NO: 4408069 - DNA, 14 bp, Homo sapiens
tgacatatttaatg

SEQ ID NO: 4408070 - DNA, 21 bp, Homo sapiens
tgacatatttaatgttttaaa

SEQ ID NO: 4408071 - DNA, 15 bp, Homo sapiens
tgacatcaaaacttg

SEQ ID NO: 4408072 - DNA, 19 bp, Homo sapiens
tgacatcggaaaaataatc

SEQ ID NO: 4408073 - DNA, 15 bp, Homo sapiens
tgacatgaagctgtt

SEQ ID NO: 4408074 - DNA, 21 bp, Homo sapiens
tgacatgacgtggtaaaatgt

SEQ ID NO: 4408075 - DNA, 23 bp, Homo sapiens
tgacatgcctatatgagaagaat

SEQ ID NO: 4408076 - DNA, 16 bp, Homo sapiens
tgacatggaaatgaag

SEQ ID NO: 4408077 - DNA, 17 bp, Homo sapiens
tgacatggtgcctgaga

SEQ ID NO: 4408078 - DNA, 15 bp, Homo sapiens
tgacatggtgcctta

SEQ ID NO: 4408079 - DNA, 16 bp, Homo sapiens
tgacatgtaagaaaat

SEQ ID NO: 4408080 - DNA, 15 bp, Homo sapiens
tgacattcactgagt

SEQ ID NO: 4408081 - DNA, 19 bp, Homo sapiens
tgacattgcgtttgacctt

SEQ ID NO: 4408082 - DNA, 11 bp, Homo sapiens
tgacattgtct

SEQ ID NO: 4408083 - DNA, 12 bp, Homo sapiens
tgacattgtctc

SEQ ID NO: 4408084 - DNA, 15 bp, Homo sapiens
tgacatttcactaaa

SEQ ID NO: 4408085 - DNA, 21 bp, Homo sapiens
tgacatttggagtgttcccct

SEQ ID NO: 4408086 - DNA, 14 bp, Homo sapiens
tgacattttacatt

SEQ ID NO: 4408087 - DNA, 13 bp, Homo sapiens
tgacatttttctg

SEQ ID NO: 4408088 - DNA, 20 bp, Homo sapiens
tgaccacataagaaggcaat

SEQ ID NO: 4408089 - DNA, 16 bp, Homo sapiens
tgaccactccagagaa

SEQ ID NO: 4408090 - DNA, 18 bp, Homo sapiens
tgaccactgcagaagaca

SEQ ID NO: 4408091 - DNA, 18 bp, Homo sapiens
tgaccagaaacagggaca

SEQ ID NO: 4408092 - DNA, 11 bp, Homo sapiens
tgaccagaagc

SEQ ID NO: 4408093 - DNA, 15 bp, Homo sapiens
tgaccagaagccttg

SEQ ID NO: 4408094 - DNA, 19 bp, Homo sapiens
tgaccagggatgctgggct

SEQ ID NO: 4408095 - DNA, 20 bp, Homo sapiens
tgaccagggatgctgggctg

SEQ ID NO: 4408096 - DNA, 22 bp, Homo sapiens
tgaccagggatgctgggctggg

SEQ ID NO: 4408097 - DNA, 23 bp, Homo sapiens
tgaccagggatgctgggctgggc

SEQ ID NO: 4408098 - DNA, 13 bp, Homo sapiens
tgaccagtttctt

SEQ ID NO: 4408099 - DNA, 14 bp, Homo sapiens
tgaccagtttctta

SEQ ID NO: 4408100 - DNA, 20 bp, Homo sapiens
tgaccatacaatttcatcct

SEQ ID NO: 4408101 - DNA, 21 bp, Homo sapiens
tgaccatatagattttattat

SEQ ID NO: 4408102 - DNA, 19 bp, Homo sapiens
tgaccatcgtccttcctct

SEQ ID NO: 4408103 - DNA, 19 bp, Homo sapiens
tgaccatgcattttaccat

SEQ ID NO: 4408104 - DNA, 12 bp, Homo sapiens
tgaccatgtact

SEQ ID NO: 4408105 - DNA, 16 bp, Homo sapiens
tgaccattattcacag

SEQ ID NO: 4408106 - DNA, 17 bp, Homo sapiens
tgacccacaagaaatga

SEQ ID NO: 4408107 - DNA, 20 bp, Homo sapiens
tgacccagagtggagtctga

SEQ ID NO: 4408108 - DNA, 14 bp, Homo sapiens
tgacccctgcctgt

SEQ ID NO: 4408109 - DNA, 21 bp, Homo sapiens
tgaccctcatctttcttccaa

SEQ ID NO: 4408110 - DNA, 22 bp, Homo sapiens
tgaccctcctgttgcacccagc

SEQ ID NO: 4408111 - DNA, 21 bp, Homo sapiens
tgaccctgggcagttccttac

SEQ ID NO: 4408112 - DNA, 16 bp, Homo sapiens
tgacccttctctcact

SEQ ID NO: 4408113 - DNA, 12 bp, Homo sapiens
tgaccgagagaa

SEQ ID NO: 4408114 - DNA, 16 bp, Homo sapiens
tgaccgagagaacctc

SEQ ID NO: 4408115 - DNA, 19 bp, Homo sapiens
tgacctcaggtgatccgcc

SEQ ID NO: 4408116 - DNA, 18 bp, Homo sapiens
tgacctcatgatctgccc

SEQ ID NO: 4408117 - DNA, 19 bp, Homo sapiens
tgacctccgcccctgcccc

SEQ ID NO: 4408118 - DNA, 23 bp, Homo sapiens
tgacctccgcccctgcccccgct

SEQ ID NO: 4408119 - DNA, 12 bp, Homo sapiens
tgacctcctctg

SEQ ID NO: 4408120 - DNA, 13 bp, Homo sapiens
tgacctcctctgg

SEQ ID NO: 4408121 - DNA, 15 bp, Homo sapiens
tgacctcctctgggc

SEQ ID NO: 4408122 - DNA, 12 bp, Homo sapiens
tgacctcctgca

SEQ ID NO: 4408123 - DNA, 13 bp, Homo sapiens
tgacctcctgcag

SEQ ID NO: 4408124 - DNA, 18 bp, Homo sapiens
tgacctcggacagagccc

SEQ ID NO: 4408125 - DNA, 12 bp, Homo sapiens
tgacctcttgcc

SEQ ID NO: 4408126 - DNA, 16 bp, Homo sapiens
tgacctgcattgtaaa

SEQ ID NO: 4408127 - DNA, 16 bp, Homo sapiens
tgacctgccagccggt

SEQ ID NO: 4408128 - DNA, 16 bp, Homo sapiens
tgacctgtcagaataa

SEQ ID NO: 4408129 - DNA, 19 bp, Homo sapiens
tgaccttagcgttctggac

SEQ ID NO: 4408130 - DNA, 22 bp, Homo sapiens
tgaccttatgagaaactgcatg

SEQ ID NO: 4408131 - DNA, 13 bp, Homo sapiens
tgaccttggagga

SEQ ID NO: 4408132 - DNA, 16 bp, Homo sapiens
tgacctttaggtatta

SEQ ID NO: 4408133 - DNA, 14 bp, Homo sapiens
tgacctttatttat

SEQ ID NO: 4408134 - DNA, 18 bp, Homo sapiens
tgacctttatttattaaa

SEQ ID NO: 4408135 - DNA, 23 bp, Homo sapiens
tgaccttttatgtagtaattgac

SEQ ID NO: 4408136 - DNA, 14 bp, Homo sapiens
tgacgctcagcccc

SEQ ID NO: 4408137 - DNA, 16 bp, Homo sapiens
tgacgctcagccccag

SEQ ID NO: 4408138 - DNA, 19 bp, Homo sapiens
tgacgctcagccccaggcc

SEQ ID NO: 4408139 - DNA, 21 bp, Homo sapiens
tgacggctgggtgtttcagtt

SEQ ID NO: 4408140 - DNA, 15 bp, Homo sapiens
tgacgggatgctctt

SEQ ID NO: 4408141 - DNA, 17 bp, Homo sapiens
tgacgggatgctcttta

SEQ ID NO: 4408142 - DNA, 22 bp, Homo sapiens
tgacgtggtaaaatgtgaaaaa

SEQ ID NO: 4408143 - DNA, 19 bp, Homo sapiens
tgactaaactttttttctg

SEQ ID NO: 4408144 - DNA, 14 bp, Homo sapiens
tgactaagcctttg

SEQ ID NO: 4408145 - DNA, 21 bp, Homo sapiens
tgactaattttacatgtttat

SEQ ID NO: 4408146 - DNA, 23 bp, Homo sapiens
tgactagatgatggatgccaata

SEQ ID NO: 4408147 - DNA, 17 bp, Homo sapiens
tgactagggattcaggc

SEQ ID NO: 4408148 - DNA, 23 bp, Homo sapiens
tgactagggattcaggctgcttg

SEQ ID NO: 4408149 - DNA, 18 bp, Homo sapiens
tgactatataatttattt

SEQ ID NO: 4408150 - DNA, 13 bp, Homo sapiens
tgactattctgta

SEQ ID NO: 4408151 - DNA, 20 bp, Homo sapiens
tgactcaattatttgcatat

SEQ ID NO: 4408152 - DNA, 17 bp, Homo sapiens
tgactcacttcaatgtg

SEQ ID NO: 4408153 - DNA, 18 bp, Homo sapiens
tgactcagcatcacccac

SEQ ID NO: 4408154 - DNA, 15 bp, Homo sapiens
tgactcagctaatgt

SEQ ID NO: 4408155 - DNA, 20 bp, Homo sapiens
tgactcattctgaaggagcc

SEQ ID NO: 4408156 - DNA, 15 bp, Homo sapiens
tgactccaaccattc

SEQ ID NO: 4408157 - DNA, 22 bp, Homo sapiens
tgactccaaccattcaaaaatt

SEQ ID NO: 4408158 - DNA, 14 bp, Homo sapiens
tgactcctctggct

SEQ ID NO: 4408159 - DNA, 16 bp, Homo sapiens
tgactcctctggcttt

SEQ ID NO: 4408160 - DNA, 20 bp, Homo sapiens
tgactcctctggctttccca

SEQ ID NO: 4408161 - DNA, 15 bp, Homo sapiens
tgactcctggactcc

SEQ ID NO: 4408162 - DNA, 17 bp, Homo sapiens
tgactcctggactccgg

SEQ ID NO: 4408163 - DNA, 18 bp, Homo sapiens
tgactcctggactccgga

SEQ ID NO: 4408164 - DNA, 22 bp, Homo sapiens
tgactcgacaaaggccacaggc

SEQ ID NO: 4408165 - DNA, 19 bp, Homo sapiens
tgactctaggcttcaggtt

SEQ ID NO: 4408166 - DNA, 15 bp, Homo sapiens
tgactctataagcaa

SEQ ID NO: 4408167 - DNA, 14 bp, Homo sapiens
tgactctccagggg

SEQ ID NO: 4408168 - DNA, 19 bp, Homo sapiens
tgactctgccccctgctgg

SEQ ID NO: 4408169 - DNA, 11 bp, Homo sapiens
tgactctgggg

SEQ ID NO: 4408170 - DNA, 18 bp, Homo sapiens
tgactctggggtgcagct

SEQ ID NO: 4408171 - DNA, 21 bp, Homo sapiens
tgactctggggtgcagcttca

SEQ ID NO: 4408172 - DNA, 18 bp, Homo sapiens
tgactctttattgtctgt

SEQ ID NO: 4408173 - DNA, 22 bp, Homo sapiens
tgactgaaaaaaaaaaagaaga

SEQ ID NO: 4408174 - DNA, 23 bp, Homo sapiens
tgactgaaaaaaaaaaagaagaa

SEQ ID NO: 4408175 - DNA, 19 bp, Homo sapiens
tgactgaacgatccttcaa

SEQ ID NO: 4408176 - DNA, 19 bp, Homo sapiens
tgactgaagatgcagctca

SEQ ID NO: 4408177 - DNA, 15 bp, Homo sapiens
tgactgagcttccct

SEQ ID NO: 4408178 - DNA, 15 bp, Homo sapiens
tgactgccccaactc

SEQ ID NO: 4408179 - DNA, 19 bp, Homo sapiens
tgactgccccaactcctgg

SEQ ID NO: 4408180 - DNA, 20 bp, Homo sapiens
tgactgccccaactcctgga

SEQ ID NO: 4408181 - DNA, 22 bp, Homo sapiens
tgactgcccggcacagatgctc

SEQ ID NO: 4408182 - DNA, 23 bp, Homo sapiens
tgactggaggaggcctgtcccaa

SEQ ID NO: 4408183 - DNA, 18 bp, Homo sapiens
tgactggatggtccagtg

SEQ ID NO: 4408184 - DNA, 14 bp, Homo sapiens
tgactggctcctga

SEQ ID NO: 4408185 - DNA, 17 bp, Homo sapiens
tgactgggtgagaccca

SEQ ID NO: 4408186 - DNA, 15 bp, Homo sapiens
tgactgtagccacag

SEQ ID NO: 4408187 - DNA, 16 bp, Homo sapiens
tgactgtagccacagc

SEQ ID NO: 4408188 - DNA, 20 bp, Homo sapiens
tgactgtagccacagctgct

SEQ ID NO: 4408189 - DNA, 22 bp, Homo sapiens
tgactgtcccaccgggagcctc

SEQ ID NO: 4408190 - DNA, 14 bp, Homo sapiens
tgacttagaaactg

SEQ ID NO: 4408191 - DNA, 19 bp, Homo sapiens
tgacttagcgtcaagacat

SEQ ID NO: 4408192 - DNA, 21 bp, Homo sapiens
tgacttagcgtcaagacattt

SEQ ID NO: 4408193 - DNA, 23 bp, Homo sapiens
tgacttagcgtcaagacatttgc

SEQ ID NO: 4408194 - DNA, 20 bp, Homo sapiens
tgacttaggtaaaataaaag

SEQ ID NO: 4408195 - DNA, 15 bp, Homo sapiens
tgacttatagtacat

SEQ ID NO: 4408196 - DNA, 17 bp, Homo sapiens
tgacttatagtacatga

SEQ ID NO: 4408197 - DNA, 17 bp, Homo sapiens
tgacttatcccattttc

SEQ ID NO: 4408198 - DNA, 20 bp, Homo sapiens
tgacttatttatataaattt

SEQ ID NO: 4408199 - DNA, 14 bp, Homo sapiens
tgacttatttctgc

SEQ ID NO: 4408200 - DNA, 20 bp, Homo sapiens
tgacttatttctgctctgga

SEQ ID NO: 4408201 - DNA, 13 bp, Homo sapiens
tgacttcactgta

SEQ ID NO: 4408202 - DNA, 14 bp, Homo sapiens
tgacttcactgtat

SEQ ID NO: 4408203 - DNA, 15 bp, Homo sapiens
tgacttcactgtata

SEQ ID NO: 4408204 - DNA, 23 bp, Homo sapiens
tgacttcactgtatataaacata

SEQ ID NO: 4408205 - DNA, 20 bp, Homo sapiens
tgacttcaggtggagagcac

SEQ ID NO: 4408206 - DNA, 24 bp, Homo sapiens
tgacttcaggtggagagcactaga

SEQ ID NO: 4408207 - DNA, 16 bp, Homo sapiens
tgacttcattttatat

SEQ ID NO: 4408208 - DNA, 22 bp, Homo sapiens
tgacttctaagtaaaaccacag

SEQ ID NO: 4408209 - DNA, 15 bp, Homo sapiens
tgacttctcaagtaa

SEQ ID NO: 4408210 - DNA, 18 bp, Homo sapiens
tgacttctgctgctggcc

SEQ ID NO: 4408211 - DNA, 19 bp, Homo sapiens
tgacttgtacaaacagtat

SEQ ID NO: 4408212 - DNA, 17 bp, Homo sapiens
tgacttttgttaaattc

SEQ ID NO: 4408213 - DNA, 14 bp, Homo sapiens
tgactttttgcatt

SEQ ID NO: 4408214 - DNA, 19 bp, Homo sapiens
tgactttttggaattcagc

SEQ ID NO: 4408215 - DNA, 18 bp, Homo sapiens
tgactttttttgtatgtg

SEQ ID NO: 4408216 - DNA, 22 bp, Homo sapiens
tgagaaaaatagagcaaaatca

SEQ ID NO: 4408217 - DNA, 23 bp, Homo sapiens
tgagaaaaatagagcaaaatcaa

SEQ ID NO: 4408218 - DNA, 18 bp, Homo sapiens
tgagaaaaatatatacta

SEQ ID NO: 4408219 - DNA, 20 bp, Homo sapiens
tgagaaacaacaatttctac

SEQ ID NO: 4408220 - DNA, 16 bp, Homo sapiens
tgagaaactgctgcag

SEQ ID NO: 4408221 - DNA, 16 bp, Homo sapiens
tgagaaagactattca

SEQ ID NO: 4408222 - DNA, 17 bp, Homo sapiens
tgagaaagactattcaa

SEQ ID NO: 4408223 - DNA, 13 bp, Homo sapiens
tgagaaaggacag

SEQ ID NO: 4408224 - DNA, 16 bp, Homo sapiens
tgagaaaggacagagc

SEQ ID NO: 4408225 - DNA, 17 bp, Homo sapiens
tgagaaatatggacact

SEQ ID NO: 4408226 - DNA, 21 bp, Homo sapiens
tgagaaatatggacacttaat

SEQ ID NO: 4408227 - DNA, 16 bp, Homo sapiens
tgagaaatgaatgctg

SEQ ID NO: 4408228 - DNA, 13 bp, Homo sapiens
tgagaaatgatga

SEQ ID NO: 4408229 - DNA, 18 bp, Homo sapiens
tgagaaccagtctcctca

SEQ ID NO: 4408230 - DNA, 19 bp, Homo sapiens
tgagaagaagtggctgcca

SEQ ID NO: 4408231 - DNA, 12 bp, Homo sapiens
tgagaagaatag

SEQ ID NO: 4408232 - DNA, 18 bp, Homo sapiens
tgagaagagcttgcacag

SEQ ID NO: 4408233 - DNA, 19 bp, Homo sapiens
tgagaagagcttgcacagc

SEQ ID NO: 4408234 - DNA, 12 bp, Homo sapiens
tgagaagctctg

SEQ ID NO: 4408235 - DNA, 14 bp, Homo sapiens
tgagaagctgaggc

SEQ ID NO: 4408236 - DNA, 20 bp, Homo sapiens
tgagaaggcagccaccagcg

SEQ ID NO: 4408237 - DNA, 13 bp, Homo sapiens
tgagaagtgtctt

SEQ ID NO: 4408238 - DNA, 19 bp, Homo sapiens
tgagaatcatttagcatgt

SEQ ID NO: 4408239 - DNA, 19 bp, Homo sapiens
tgagaatccagtttctttc

SEQ ID NO: 4408240 - DNA, 18 bp, Homo sapiens
tgagaatctttgcatgca

SEQ ID NO: 4408241 - DNA, 19 bp, Homo sapiens
tgagaattcaaatcctctt

SEQ ID NO: 4408242 - DNA, 20 bp, Homo sapiens
tgagaatttgagtgctctga

SEQ ID NO: 4408243 - DNA, 23 bp, Homo sapiens
tgagacacacaacggcagtgaag

SEQ ID NO: 4408244 - DNA, 17 bp, Homo sapiens
tgagacagataagagaa

SEQ ID NO: 4408245 - DNA, 22 bp, Homo sapiens
tgagacaggctgggtcctgcca

SEQ ID NO: 4408246 - DNA, 19 bp, Homo sapiens
tgagacagggtcttgctct

SEQ ID NO: 4408247 - DNA, 14 bp, Homo sapiens
tgagacagtgaatt

SEQ ID NO: 4408248 - DNA, 16 bp, Homo sapiens
tgagacagtgaatttg

SEQ ID NO: 4408249 - DNA, 17 bp, Homo sapiens
tgagacagtgaatttgg

SEQ ID NO: 4408250 - DNA, 18 bp, Homo sapiens
tgagaccagggtggccac

SEQ ID NO: 4408251 - DNA, 19 bp, Homo sapiens
tgagaccagggtggccaca

SEQ ID NO: 4408252 - DNA, 17 bp, Homo sapiens
tgagaccatccattctc

SEQ ID NO: 4408253 - DNA, 20 bp, Homo sapiens
tgagaccatccattctcctc

SEQ ID NO: 4408254 - DNA, 23 bp, Homo sapiens
tgagaccatgtttcaaacaagaa

SEQ ID NO: 4408255 - DNA, 13 bp, Homo sapiens
tgagacccccaca

SEQ ID NO: 4408256 - DNA, 14 bp, Homo sapiens
tgagacccccacac

SEQ ID NO: 4408257 - DNA, 16 bp, Homo sapiens
tgagacccccacacct

SEQ ID NO: 4408258 - DNA, 21 bp, Homo sapiens
tgagacccccatctctacaaa

SEQ ID NO: 4408259 - DNA, 16 bp, Homo sapiens
tgagacctcagccatg

SEQ ID NO: 4408260 - DNA, 19 bp, Homo sapiens
tgagactaaattcaatcac

SEQ ID NO: 4408261 - DNA, 19 bp, Homo sapiens
tgagactacaagtgtgtgc

SEQ ID NO: 4408262 - DNA, 22 bp, Homo sapiens
tgagactctagggtccagtgga

SEQ ID NO: 4408263 - DNA, 19 bp, Homo sapiens
tgagactctcttaggagca

SEQ ID NO: 4408264 - DNA, 23 bp, Homo sapiens
tgagactctcttaggagcagagc

SEQ ID NO: 4408265 - DNA, 14 bp, Homo sapiens
tgagactgccccac

SEQ ID NO: 4408266 - DNA, 15 bp, Homo sapiens
tgagactgccccacg

SEQ ID NO: 4408267 - DNA, 13 bp, Homo sapiens
tgagactggcact

SEQ ID NO: 4408268 - DNA, 15 bp, Homo sapiens
tgagactgtacataa

SEQ ID NO: 4408269 - DNA, 17 bp, Homo sapiens
tgagactgtacataatt

SEQ ID NO: 4408270 - DNA, 21 bp, Homo sapiens
tgagactgtacataattgcat

SEQ ID NO: 4408271 - DNA, 23 bp, Homo sapiens
tgagactgtacataattgcatga

SEQ ID NO: 4408272 - DNA, 16 bp, Homo sapiens
tgagagaagccacgct

SEQ ID NO: 4408273 - DNA, 21 bp, Homo sapiens
tgagagaagccacgctgtcct

SEQ ID NO: 4408274 - DNA, 14 bp, Homo sapiens
tgagagacacgctg

SEQ ID NO: 4408275 - DNA, 16 bp, Homo sapiens
tgagagaccacacatt

SEQ ID NO: 4408276 - DNA, 15 bp, Homo sapiens
tgagagacctgctca

SEQ ID NO: 4408277 - DNA, 22 bp, Homo sapiens
tgagagacgccactccctggga

SEQ ID NO: 4408278 - DNA, 18 bp, Homo sapiens
tgagagacgccctatttc

SEQ ID NO: 4408279 - DNA, 19 bp, Homo sapiens
tgagagacgccctatttct

SEQ ID NO: 4408280 - DNA, 18 bp, Homo sapiens
tgagagagagtcttactc

SEQ ID NO: 4408281 - DNA, 17 bp, Homo sapiens
tgagagagatgggagct

SEQ ID NO: 4408282 - DNA, 22 bp, Homo sapiens
tgagagagatgggagctcctct

SEQ ID NO: 4408283 - DNA, 13 bp, Homo sapiens
tgagagaggccat

SEQ ID NO: 4408284 - DNA, 12 bp, Homo sapiens
tgagagccagtg

SEQ ID NO: 4408285 - DNA, 20 bp, Homo sapiens
tgagagccctgaggcctaga

SEQ ID NO: 4408286 - DNA, 17 bp, Homo sapiens
tgagagccctgctgtgg

SEQ ID NO: 4408287 - DNA, 20 bp, Homo sapiens
tgagagccctgctgtgggag

SEQ ID NO: 4408288 - DNA, 18 bp, Homo sapiens
tgagaggcaccagtccag

SEQ ID NO: 4408289 - DNA, 20 bp, Homo sapiens
tgagaggcaccagtccagca

SEQ ID NO: 4408290 - DNA, 14 bp, Homo sapiens
tgagaggcaggcat

SEQ ID NO: 4408291 - DNA, 12 bp, Homo sapiens
tgagaggggaag

SEQ ID NO: 4408292 - DNA, 16 bp, Homo sapiens
tgagaggggaagcggc

SEQ ID NO: 4408293 - DNA, 14 bp, Homo sapiens
tgagaggtttgact

SEQ ID NO: 4408294 - DNA, 22 bp, Homo sapiens
tgagaggtttgactagatgatg

SEQ ID NO: 4408295 - DNA, 12 bp, Homo sapiens
tgagagtaagca

SEQ ID NO: 4408296 - DNA, 14 bp, Homo sapiens
tgagagtcaggagt

SEQ ID NO: 4408297 - DNA, 21 bp, Homo sapiens
tgagataccagcgaggaggct

SEQ ID NO: 4408298 - DNA, 22 bp, Homo sapiens
tgagatactttgcattgtctgt

SEQ ID NO: 4408299 - DNA, 17 bp, Homo sapiens
tgagatagttttcattt

SEQ ID NO: 4408300 - DNA, 18 bp, Homo sapiens
tgagatagttttcatttt

SEQ ID NO: 4408301 - DNA, 19 bp, Homo sapiens
tgagatagttttcatttta

SEQ ID NO: 4408302 - DNA, 20 bp, Homo sapiens
tgagatcgtgctactgcact

SEQ ID NO: 4408303 - DNA, 21 bp, Homo sapiens
tgagatcgtgctactgcactc

SEQ ID NO: 4408304 - DNA, 14 bp, Homo sapiens
tgagatctgcacag

SEQ ID NO: 4408305 - DNA, 23 bp, Homo sapiens
tgagatctgcacagtcagaagga

SEQ ID NO: 4408306 - DNA, 21 bp, Homo sapiens
tgagatgaccaccaatcattt

SEQ ID NO: 4408307 - DNA, 17 bp, Homo sapiens
tgagattgaatttcact

SEQ ID NO: 4408308 - DNA, 18 bp, Homo sapiens
tgagatttaacccctcca

SEQ ID NO: 4408309 - DNA, 23 bp, Homo sapiens
tgagatttaacccctccactgct

SEQ ID NO: 4408310 - DNA, 16 bp, Homo sapiens
tgagatttactgctct

SEQ ID NO: 4408311 - DNA, 14 bp, Homo sapiens
tgagatttcatctg

SEQ ID NO: 4408312 - DNA, 21 bp, Homo sapiens
tgagatttcatctgctctcct

SEQ ID NO: 4408313 - DNA, 22 bp, Homo sapiens
tgagattttggaagaagttttt

SEQ ID NO: 4408314 - DNA, 18 bp, Homo sapiens
tgagcaaactaacttgac

SEQ ID NO: 4408315 - DNA, 15 bp, Homo sapiens
tgagcaaaggccctg

SEQ ID NO: 4408316 - DNA, 17 bp, Homo sapiens
tgagcaagcaagggact

SEQ ID NO: 4408317 - DNA, 20 bp, Homo sapiens
tgagcaccacacccagtggg

SEQ ID NO: 4408318 - DNA, 20 bp, Homo sapiens
tgagcactactctaccatgg

SEQ ID NO: 4408319 - DNA, 17 bp, Homo sapiens
tgagcactcctggtgca

SEQ ID NO: 4408320 - DNA, 21 bp, Homo sapiens
tgagcagaactgaaaaattac

SEQ ID NO: 4408321 - DNA, 15 bp, Homo sapiens
tgagcagaattcatt

SEQ ID NO: 4408322 - DNA, 20 bp, Homo sapiens
tgagcagagagcaaaggaga

SEQ ID NO: 4408323 - DNA, 21 bp, Homo sapiens
tgagcagcatccaccccaccc

SEQ ID NO: 4408324 - DNA, 16 bp, Homo sapiens
tgagcagccgccagct

SEQ ID NO: 4408325 - DNA, 15 bp, Homo sapiens
tgagcagcctctgga

SEQ ID NO: 4408326 - DNA, 23 bp, Homo sapiens
tgagcagcctctggacagccagt

SEQ ID NO: 4408327 - DNA, 12 bp, Homo sapiens
tgagcaggagct

SEQ ID NO: 4408328 - DNA, 17 bp, Homo sapiens
tgagcaggagcttgggt

SEQ ID NO: 4408329 - DNA, 20 bp, Homo sapiens
tgagcaggattttaatcttt

SEQ ID NO: 4408330 - DNA, 15 bp, Homo sapiens
tgagcaggggcccct

SEQ ID NO: 4408331 - DNA, 19 bp, Homo sapiens
tgagcaggggcccctgggg

SEQ ID NO: 4408332 - DNA, 17 bp, Homo sapiens
tgagcagtcgcctgcct

SEQ ID NO: 4408333 - DNA, 20 bp, Homo sapiens
tgagcagtcgcctgcctgca

SEQ ID NO: 4408334 - DNA, 22 bp, Homo sapiens
tgagcatattttcttactttta

SEQ ID NO: 4408335 - DNA, 18 bp, Homo sapiens
tgagcatcaatcttgtta

SEQ ID NO: 4408336 - DNA, 23 bp, Homo sapiens
tgagcatcgcttaggagaagtct

SEQ ID NO: 4408337 - DNA, 21 bp, Homo sapiens
tgagcatggagctgtcacctc

SEQ ID NO: 4408338 - DNA, 17 bp, Homo sapiens
tgagcatggcagctggt

SEQ ID NO: 4408339 - DNA, 18 bp, Homo sapiens
tgagcatggggccaggaa

SEQ ID NO: 4408340 - DNA, 14 bp, Homo sapiens
tgagcattcaggca

SEQ ID NO: 4408341 - DNA, 15 bp, Homo sapiens
tgagcattcaggcag

SEQ ID NO: 4408342 - DNA, 13 bp, Homo sapiens
tgagccaaaatca

SEQ ID NO: 4408343 - DNA, 22 bp, Homo sapiens
tgagccaaaccagcagggagtt

SEQ ID NO: 4408344 - DNA, 18 bp, Homo sapiens
tgagccaagatcgcacca

SEQ ID NO: 4408345 - DNA, 18 bp, Homo sapiens
tgagccaaggaggcctgg

SEQ ID NO: 4408346 - DNA, 17 bp, Homo sapiens
tgagccacagcagcatt

SEQ ID NO: 4408347 - DNA, 18 bp, Homo sapiens
tgagccacagcagcattt

SEQ ID NO: 4408348 - DNA, 17 bp, Homo sapiens
tgagccaccgtgcctgg

SEQ ID NO: 4408349 - DNA, 13 bp, Homo sapiens
tgagccacctgcc

SEQ ID NO: 4408350 - DNA, 22 bp, Homo sapiens
tgagccactgcgcccggcccaa

SEQ ID NO: 4408351 - DNA, 13 bp, Homo sapiens
tgagccagattac

SEQ ID NO: 4408352 - DNA, 13 bp, Homo sapiens
tgagccagcagct

SEQ ID NO: 4408353 - DNA, 17 bp, Homo sapiens
tgagccaggcttttctc

SEQ ID NO: 4408354 - DNA, 18 bp, Homo sapiens
tgagccaggcttttctca

SEQ ID NO: 4408355 - DNA, 18 bp, Homo sapiens
tgagcccattcttctggg

SEQ ID NO: 4408356 - DNA, 19 bp, Homo sapiens
tgagcccccaccggaactg

SEQ ID NO: 4408357 - DNA, 15 bp, Homo sapiens
tgagcccctccccag

SEQ ID NO: 4408358 - DNA, 10 bp, Homo sapiens
tgagccctgc

SEQ ID NO: 4408359 - DNA, 14 bp, Homo sapiens
tgagccctgctctt

SEQ ID NO: 4408360 - DNA, 13 bp, Homo sapiens
tgagccctggctg

SEQ ID NO: 4408361 - DNA, 23 bp, Homo sapiens
tgagccgcatcttctccatctgg

SEQ ID NO: 4408362 - DNA, 19 bp, Homo sapiens
tgagccgggcccctgggct

SEQ ID NO: 4408363 - DNA, 20 bp, Homo sapiens
tgagccgggcccctgggctt

SEQ ID NO: 4408364 - DNA, 12 bp, Homo sapiens
tgagcctcctgt

SEQ ID NO: 4408365 - DNA, 18 bp, Homo sapiens
tgagcctcctgtgcctgg

SEQ ID NO: 4408366 - DNA, 22 bp, Homo sapiens
tgagcctcctgtgcctggcccc

SEQ ID NO: 4408367 - DNA, 16 bp, Homo sapiens
tgagcgaaatccaaga

SEQ ID NO: 4408368 - DNA, 15 bp, Homo sapiens
tgagcgcccccgagc

SEQ ID NO: 4408369 - DNA, 18 bp, Homo sapiens
tgagcgcccccgagccct

SEQ ID NO: 4408370 - DNA, 22 bp, Homo sapiens
tgagcgcccccgagccctgact

SEQ ID NO: 4408371 - DNA, 23 bp, Homo sapiens
tgagcgcccccgagccctgactc

SEQ ID NO: 4408372 - DNA, 14 bp, Homo sapiens
tgagcgctcctgcc

SEQ ID NO: 4408373 - DNA, 16 bp, Homo sapiens
tgagctattttcctct

SEQ ID NO: 4408374 - DNA, 20 bp, Homo sapiens
tgagctattttcctctggcc

SEQ ID NO: 4408375 - DNA, 17 bp, Homo sapiens
tgagctcagacccccac

SEQ ID NO: 4408376 - DNA, 22 bp, Homo sapiens
tgagctcaggagtttgagacca

SEQ ID NO: 4408377 - DNA, 12 bp, Homo sapiens
tgagctcttccc

SEQ ID NO: 4408378 - DNA, 13 bp, Homo sapiens
tgagctcttccct

SEQ ID NO: 4408379 - DNA, 17 bp, Homo sapiens
tgagctgagatcgtgcc

SEQ ID NO: 4408380 - DNA, 19 bp, Homo sapiens
tgagctgagatcgtgccgt

SEQ ID NO: 4408381 - DNA, 20 bp, Homo sapiens
tgagctgcctgtaacttgag

SEQ ID NO: 4408382 - DNA, 19 bp, Homo sapiens
tgagctgccttccctagct

SEQ ID NO: 4408383 - DNA, 10 bp, Homo sapiens
tgagctgggg

SEQ ID NO: 4408384 - DNA, 22 bp, Homo sapiens
tgagctgtaatttcgccttaaa

SEQ ID NO: 4408385 - DNA, 15 bp, Homo sapiens
tgagctgtgacccag

SEQ ID NO: 4408386 - DNA, 17 bp, Homo sapiens
tgagctgtgacccagag

SEQ ID NO: 4408387 - DNA, 15 bp, Homo sapiens
tgagcttcaatataa

SEQ ID NO: 4408388 - DNA, 16 bp, Homo sapiens
tgagcttcaatataag

SEQ ID NO: 4408389 - DNA, 23 bp, Homo sapiens
tgagcttgggaagtcgaggctgc

SEQ ID NO: 4408390 - DNA, 21 bp, Homo sapiens
tgagctttagctctctctaga

SEQ ID NO: 4408391 - DNA, 23 bp, Homo sapiens
tgagctttgcatgttccactaac

SEQ ID NO: 4408392 - DNA, 20 bp, Homo sapiens
tgaggaaactgagtcactca

SEQ ID NO: 4408393 - DNA, 11 bp, Homo sapiens
tgaggaaatgt

SEQ ID NO: 4408394 - DNA, 12 bp, Homo sapiens
tgaggaaatgtg

SEQ ID NO: 4408395 - DNA, 17 bp, Homo sapiens
tgaggaagaacggggct

SEQ ID NO: 4408396 - DNA, 21 bp, Homo sapiens
tgaggaatttcacctgtaaac

SEQ ID NO: 4408397 - DNA, 14 bp, Homo sapiens
tgaggacagagtgg

SEQ ID NO: 4408398 - DNA, 15 bp, Homo sapiens
tgaggacctttatat

SEQ ID NO: 4408399 - DNA, 15 bp, Homo sapiens
tgaggacctttctga

SEQ ID NO: 4408400 - DNA, 18 bp, Homo sapiens
tgaggagcctctgatcaa

SEQ ID NO: 4408401 - DNA, 11 bp, Homo sapiens
tgaggagctgc

SEQ ID NO: 4408402 - DNA, 12 bp, Homo sapiens
tgaggagctgct

SEQ ID NO: 4408403 - DNA, 14 bp, Homo sapiens
tgaggaggcctcca

SEQ ID NO: 4408404 - DNA, 16 bp, Homo sapiens
tgaggaggcctccatc

SEQ ID NO: 4408405 - DNA, 22 bp, Homo sapiens
tgaggaggggagggtaaataaa

SEQ ID NO: 4408406 - DNA, 20 bp, Homo sapiens
tgaggagggtgggggaggga

SEQ ID NO: 4408407 - DNA, 15 bp, Homo sapiens
tgaggagtaaaattc

SEQ ID NO: 4408408 - DNA, 21 bp, Homo sapiens
tgaggcagcagtgtgaggcca

SEQ ID NO: 4408409 - DNA, 15 bp, Homo sapiens
tgaggcaggggcgga

SEQ ID NO: 4408410 - DNA, 23 bp, Homo sapiens
tgaggccaccagtaaaagacatt

SEQ ID NO: 4408411 - DNA, 14 bp, Homo sapiens
tgaggccagagtca

SEQ ID NO: 4408412 - DNA, 15 bp, Homo sapiens
tgaggccatctcagg

SEQ ID NO: 4408413 - DNA, 14 bp, Homo sapiens
tgaggccctgccca

SEQ ID NO: 4408414 - DNA, 15 bp, Homo sapiens
tgaggccctgggctg

SEQ ID NO: 4408415 - DNA, 21 bp, Homo sapiens
tgaggccctgggctgggtgct

SEQ ID NO: 4408416 - DNA, 16 bp, Homo sapiens
tgaggcggaggctgtg

SEQ ID NO: 4408417 - DNA, 22 bp, Homo sapiens
tgaggctgtaactgagagaaag

SEQ ID NO: 4408418 - DNA, 13 bp, Homo sapiens
tgaggctttggat

SEQ ID NO: 4408419 - DNA, 15 bp, Homo sapiens
tgagggaatccattg

SEQ ID NO: 4408420 - DNA, 17 bp, Homo sapiens
tgagggagaacaagacc

SEQ ID NO: 4408421 - DNA, 21 bp, Homo sapiens
tgagggctctgtttgtgggac

SEQ ID NO: 4408422 - DNA, 22 bp, Homo sapiens
tgaggggaagccattttccagt

SEQ ID NO: 4408423 - DNA, 14 bp, Homo sapiens
tgaggggtccctga

SEQ ID NO: 4408424 - DNA, 11 bp, Homo sapiens
tgaggggtctc

SEQ ID NO: 4408425 - DNA, 19 bp, Homo sapiens
tgagggtgtttcctctaaa

SEQ ID NO: 4408426 - DNA, 13 bp, Homo sapiens
tgaggtctgttcc

SEQ ID NO: 4408427 - DNA, 22 bp, Homo sapiens
tgaggtgagttgggggtatcta

SEQ ID NO: 4408428 - DNA, 16 bp, Homo sapiens
tgaggtggaagccctc

SEQ ID NO: 4408429 - DNA, 17 bp, Homo sapiens
tgaggtggaagccctcc

SEQ ID NO: 4408430 - DNA, 20 bp, Homo sapiens
tgaggtggaagccctccttc

SEQ ID NO: 4408431 - DNA, 21 bp, Homo sapiens
tgaggtggaagccctccttcc

SEQ ID NO: 4408432 - DNA, 13 bp, Homo sapiens
tgaggtgggaggt

SEQ ID NO: 4408433 - DNA, 18 bp, Homo sapiens
tgaggtgggaggtggaag

SEQ ID NO: 4408434 - DNA, 12 bp, Homo sapiens
tgaggtggtagg

SEQ ID NO: 4408435 - DNA, 15 bp, Homo sapiens
tgaggtgtccaactg

SEQ ID NO: 4408436 - DNA, 15 bp, Homo sapiens
tgaggtgtgtcacaa

SEQ ID NO: 4408437 - DNA, 20 bp, Homo sapiens
tgaggttcctctgcctgccc

SEQ ID NO: 4408438 - DNA, 14 bp, Homo sapiens
tgagtaaacataaa

SEQ ID NO: 4408439 - DNA, 23 bp, Homo sapiens
tgagtaattcaagcctctaaaca

SEQ ID NO: 4408440 - DNA, 15 bp, Homo sapiens
tgagtactgtactat

SEQ ID NO: 4408441 - DNA, 21 bp, Homo sapiens
tgagtataaaataaagcaaat

SEQ ID NO: 4408442 - DNA, 20 bp, Homo sapiens
tgagtcaatagcttgtcttc

SEQ ID NO: 4408443 - DNA, 15 bp, Homo sapiens
tgagtcactcacatt

SEQ ID NO: 4408444 - DNA, 14 bp, Homo sapiens
tgagtcagtgaagt

SEQ ID NO: 4408445 - DNA, 20 bp, Homo sapiens
tgagtcatgatctccctgcc

SEQ ID NO: 4408446 - DNA, 21 bp, Homo sapiens
tgagtcatgatctccctgccg

SEQ ID NO: 4408447 - DNA, 12 bp, Homo sapiens
tgagtcattgac

SEQ ID NO: 4408448 - DNA, 16 bp, Homo sapiens
tgagtcattgacttca

SEQ ID NO: 4408449 - DNA, 19 bp, Homo sapiens
tgagtccacgcccaccagc

SEQ ID NO: 4408450 - DNA, 20 bp, Homo sapiens
tgagtccacgcccaccagcc

SEQ ID NO: 4408451 - DNA, 21 bp, Homo sapiens
tgagtccacgcccaccagcct

SEQ ID NO: 4408452 - DNA, 20 bp, Homo sapiens
tgagtccattctcccaggta

SEQ ID NO: 4408453 - DNA, 15 bp, Homo sapiens
tgagtcctaggactt

SEQ ID NO: 4408454 - DNA, 16 bp, Homo sapiens
tgagtctacctgagca

SEQ ID NO: 4408455 - DNA, 14 bp, Homo sapiens
tgagtctccagggc

SEQ ID NO: 4408456 - DNA, 21 bp, Homo sapiens
tgagtctgagtcctgtctctg

SEQ ID NO: 4408457 - DNA, 13 bp, Homo sapiens
tgagtcttaactg

SEQ ID NO: 4408458 - DNA, 14 bp, Homo sapiens
tgagtcttaactgt

SEQ ID NO: 4408459 - DNA, 17 bp, Homo sapiens
tgagtcttaactgtatt

SEQ ID NO: 4408460 - DNA, 20 bp, Homo sapiens
tgagtcttaactgtatttca

SEQ ID NO: 4408461 - DNA, 14 bp, Homo sapiens
tgagtgccatgctt

SEQ ID NO: 4408462 - DNA, 21 bp, Homo sapiens
tgagtgcgggctgaggccaga

SEQ ID NO: 4408463 - DNA, 13 bp, Homo sapiens
tgagtgctctgat

SEQ ID NO: 4408464 - DNA, 19 bp, Homo sapiens
tgagtgctctgatccctct

SEQ ID NO: 4408465 - DNA, 12 bp, Homo sapiens
tgagtggcctgc

SEQ ID NO: 4408466 - DNA, 12 bp, Homo sapiens
tgagtgggaagc

SEQ ID NO: 4408467 - DNA, 21 bp, Homo sapiens
tgagtgggaggcgtgcccccc

SEQ ID NO: 4408468 - DNA, 18 bp, Homo sapiens
tgagtgtcttaattaaaa

SEQ ID NO: 4408469 - DNA, 18 bp, Homo sapiens
tgagttacttagaatgcc

SEQ ID NO: 4408470 - DNA, 12 bp, Homo sapiens
tgagttatcatg

SEQ ID NO: 4408471 - DNA, 20 bp, Homo sapiens
tgagttatcatgaattttaa

SEQ ID NO: 4408472 - DNA, 23 bp, Homo sapiens
tgagttatcatgaattttaaagt

SEQ ID NO: 4408473 - DNA, 18 bp, Homo sapiens
tgagttcataaatttatg

SEQ ID NO: 4408474 - DNA, 19 bp, Homo sapiens
tgagttccagttgaagtta

SEQ ID NO: 4408475 - DNA, 13 bp, Homo sapiens
tgagttcccggga

SEQ ID NO: 4408476 - DNA, 14 bp, Homo sapiens
tgagttctgctgaa

SEQ ID NO: 4408477 - DNA, 14 bp, Homo sapiens
tgagttctgggttt

SEQ ID NO: 4408478 - DNA, 12 bp, Homo sapiens
tgagttcttgtt

SEQ ID NO: 4408479 - DNA, 13 bp, Homo sapiens
tgagttcttgttt

SEQ ID NO: 4408480 - DNA, 16 bp, Homo sapiens
tgagttggctgggaat

SEQ ID NO: 4408481 - DNA, 18 bp, Homo sapiens
tgagttgggcagccagga

SEQ ID NO: 4408482 - DNA, 12 bp, Homo sapiens
tgagttgggggt

SEQ ID NO: 4408483 - DNA, 18 bp, Homo sapiens
tgagttgttgccctgggt

SEQ ID NO: 4408484 - DNA, 16 bp, Homo sapiens
tgagtttaaaaatcaa

SEQ ID NO: 4408485 - DNA, 18 bp, Homo sapiens
tgagtttaaaaatcaact

SEQ ID NO: 4408486 - DNA, 21 bp, Homo sapiens
tgagtttaacaataataaaaa

SEQ ID NO: 4408487 - DNA, 22 bp, Homo sapiens
tgagtttgtggtaaccagccct

SEQ ID NO: 4408488 - DNA, 15 bp, Homo sapiens
tgagtttttcctccc

SEQ ID NO: 4408489 - DNA, 17 bp, Homo sapiens
tgagtttttcctcccag

SEQ ID NO: 4408490 - DNA, 18 bp, Homo sapiens
tgagtttttcctcccagt

SEQ ID NO: 4408491 - DNA, 19 bp, Homo sapiens
tgagtttttcctcccagtg

SEQ ID NO: 4408492 - DNA, 11 bp, Homo sapiens
tgataaagact

SEQ ID NO: 4408493 - DNA, 14 bp, Homo sapiens
tgataaagactttt

SEQ ID NO: 4408494 - DNA, 21 bp, Homo sapiens
tgataaagaggcatcttttct

SEQ ID NO: 4408495 - DNA, 20 bp, Homo sapiens
tgataaagattttttaataa

SEQ ID NO: 4408496 - DNA, 15 bp, Homo sapiens
tgataaatttaatcc

SEQ ID NO: 4408497 - DNA, 17 bp, Homo sapiens
tgataacttggggaggc

SEQ ID NO: 4408498 - DNA, 19 bp, Homo sapiens
tgataacttggggaggcaa

SEQ ID NO: 4408499 - DNA, 16 bp, Homo sapiens
tgataataatattgtt

SEQ ID NO: 4408500 - DNA, 16 bp, Homo sapiens
tgataatgaacagaac

SEQ ID NO: 4408501 - DNA, 12 bp, Homo sapiens
tgatacacagta

SEQ ID NO: 4408502 - DNA, 20 bp, Homo sapiens
tgatacacagtaattgtgac

SEQ ID NO: 4408503 - DNA, 22 bp, Homo sapiens
tgatacagttttgagtaaaaag

SEQ ID NO: 4408504 - DNA, 18 bp, Homo sapiens
tgataccagcagcaactg

SEQ ID NO: 4408505 - DNA, 20 bp, Homo sapiens
tgatacccaacagtttattt

SEQ ID NO: 4408506 - DNA, 13 bp, Homo sapiens
tgatactgatgcc

SEQ ID NO: 4408507 - DNA, 16 bp, Homo sapiens
tgatactgattatgaa

SEQ ID NO: 4408508 - DNA, 17 bp, Homo sapiens
tgatactgattatgaaa

SEQ ID NO: 4408509 - DNA, 18 bp, Homo sapiens
tgatactgcaactttaaa

SEQ ID NO: 4408510 - DNA, 14 bp, Homo sapiens
tgatactttagcca

SEQ ID NO: 4408511 - DNA, 19 bp, Homo sapiens
tgatagaaagaataaaatg

SEQ ID NO: 4408512 - DNA, 14 bp, Homo sapiens
tgatagattttctg

SEQ ID NO: 4408513 - DNA, 21 bp, Homo sapiens
tgatagcagacattgttacaa

SEQ ID NO: 4408514 - DNA, 21 bp, Homo sapiens
tgatagctgtttcaaatgtgc

SEQ ID NO: 4408515 - DNA, 17 bp, Homo sapiens
tgataggaaggaaactg

SEQ ID NO: 4408516 - DNA, 22 bp, Homo sapiens
tgatagggagttttaaagaaat

SEQ ID NO: 4408517 - DNA, 14 bp, Homo sapiens
tgatataacacaaa

SEQ ID NO: 4408518 - DNA, 16 bp, Homo sapiens
tgatataactttagaa

SEQ ID NO: 4408519 - DNA, 17 bp, Homo sapiens
tgatataattgtactgt

SEQ ID NO: 4408520 - DNA, 15 bp, Homo sapiens
tgatatacacagtgg

SEQ ID NO: 4408521 - DNA, 16 bp, Homo sapiens
tgatatatattataaa

SEQ ID NO: 4408522 - DNA, 16 bp, Homo sapiens
tgatatcgtgaaatcc

SEQ ID NO: 4408523 - DNA, 19 bp, Homo sapiens
tgatatcgtgaaatcctca

SEQ ID NO: 4408524 - DNA, 16 bp, Homo sapiens
tgatatgcatgtagca

SEQ ID NO: 4408525 - DNA, 19 bp, Homo sapiens
tgatattatattaaacata

SEQ ID NO: 4408526 - DNA, 18 bp, Homo sapiens
tgatattcaaggctttaa

SEQ ID NO: 4408527 - DNA, 15 bp, Homo sapiens
tgatattgtttgctg

SEQ ID NO: 4408528 - DNA, 16 bp, Homo sapiens
tgatattgtttgctgt

SEQ ID NO: 4408529 - DNA, 17 bp, Homo sapiens
tgatatttcttgctttc

SEQ ID NO: 4408530 - DNA, 18 bp, Homo sapiens
tgatcaaaaataatgcat

SEQ ID NO: 4408531 - DNA, 17 bp, Homo sapiens
tgatcaaacatgtctct

SEQ ID NO: 4408532 - DNA, 22 bp, Homo sapiens
tgatcaaattggctacaatctt

SEQ ID NO: 4408533 - DNA, 17 bp, Homo sapiens
tgatcaacatcttttct

SEQ ID NO: 4408534 - DNA, 21 bp, Homo sapiens
tgatcaacatcttttcttgcc

SEQ ID NO: 4408535 - DNA, 23 bp, Homo sapiens
tgatcaagatatatgtgtataca

SEQ ID NO: 4408536 - DNA, 16 bp, Homo sapiens
tgatcaatatttttat

SEQ ID NO: 4408537 - DNA, 21 bp, Homo sapiens
tgatcaatatttttatatcat

SEQ ID NO: 4408538 - DNA, 14 bp, Homo sapiens
tgatcacacagtgt

SEQ ID NO: 4408539 - DNA, 15 bp, Homo sapiens
tgatcacacagtgtt

SEQ ID NO: 4408540 - DNA, 20 bp, Homo sapiens
tgatcacatctaaagcttta

SEQ ID NO: 4408541 - DNA, 17 bp, Homo sapiens
tgatcaccgactgaaaa

SEQ ID NO: 4408542 - DNA, 19 bp, Homo sapiens
tgatcaccgactgaaaata

SEQ ID NO: 4408543 - DNA, 21 bp, Homo sapiens
tgatcactgtgaaccaacccc

SEQ ID NO: 4408544 - DNA, 23 bp, Homo sapiens
tgatcagaagactttaattatat

SEQ ID NO: 4408545 - DNA, 22 bp, Homo sapiens
tgatcagagccgtggtcctttg

SEQ ID NO: 4408546 - DNA, 23 bp, Homo sapiens
tgatcagagccgtggtcctttgg

SEQ ID NO: 4408547 - DNA, 17 bp, Homo sapiens
tgatcagatgctgaatt

SEQ ID NO: 4408548 - DNA, 22 bp, Homo sapiens
tgatcatagctcactgcagcct

SEQ ID NO: 4408549 - DNA, 19 bp, Homo sapiens
tgatcatgtactttttagt

SEQ ID NO: 4408550 - DNA, 12 bp, Homo sapiens
tgatccagaaga

SEQ ID NO: 4408551 - DNA, 18 bp, Homo sapiens
tgatccagaagagcccat

SEQ ID NO: 4408552 - DNA, 19 bp, Homo sapiens
tgatccagtaacctcggag

SEQ ID NO: 4408553 - DNA, 13 bp, Homo sapiens
tgatcccaccccc

SEQ ID NO: 4408554 - DNA, 16 bp, Homo sapiens
tgatcccaccccctcc

SEQ ID NO: 4408555 - DNA, 19 bp, Homo sapiens
tgatcccaccccctcctcc

SEQ ID NO: 4408556 - DNA, 19 bp, Homo sapiens
tgatcccttctcctgccct

SEQ ID NO: 4408557 - DNA, 15 bp, Homo sapiens
tgatccggtttcttt

SEQ ID NO: 4408558 - DNA, 18 bp, Homo sapiens
tgatcctcatatggccca

SEQ ID NO: 4408559 - DNA, 16 bp, Homo sapiens
tgatcgaaaaaataat

SEQ ID NO: 4408560 - DNA, 17 bp, Homo sapiens
tgatcgcctttcccagg

SEQ ID NO: 4408561 - DNA, 17 bp, Homo sapiens
tgatctacttgcctcat

SEQ ID NO: 4408562 - DNA, 19 bp, Homo sapiens
tgatctacttgcctcattt

SEQ ID NO: 4408563 - DNA, 19 bp, Homo sapiens
tgatctatctacaaagaaa

SEQ ID NO: 4408564 - DNA, 14 bp, Homo sapiens
tgatctccctgccg

SEQ ID NO: 4408565 - DNA, 13 bp, Homo sapiens
tgatctctgctgg

SEQ ID NO: 4408566 - DNA, 14 bp, Homo sapiens
tgatctctgctggg

SEQ ID NO: 4408567 - DNA, 20 bp, Homo sapiens
tgatctgaggctaagacaca

SEQ ID NO: 4408568 - DNA, 20 bp, Homo sapiens
tgatctgggcattttcctcc

SEQ ID NO: 4408569 - DNA, 14 bp, Homo sapiens
tgatctgtactttg

SEQ ID NO: 4408570 - DNA, 16 bp, Homo sapiens
tgatctgtactttgtg

SEQ ID NO: 4408571 - DNA, 15 bp, Homo sapiens
tgatctgtcatccat

SEQ ID NO: 4408572 - DNA, 19 bp, Homo sapiens
tgatctgtctgtggcaaaa

SEQ ID NO: 4408573 - DNA, 19 bp, Homo sapiens
tgatctgtgctttccagct

SEQ ID NO: 4408574 - DNA, 18 bp, Homo sapiens
tgatctgttttacaggaa

SEQ ID NO: 4408575 - DNA, 18 bp, Homo sapiens
tgatcttaatatatttga

SEQ ID NO: 4408576 - DNA, 14 bp, Homo sapiens
tgatcttacagaaa

SEQ ID NO: 4408577 - DNA, 14 bp, Homo sapiens
tgatctttaaaata

SEQ ID NO: 4408578 - DNA, 17 bp, Homo sapiens
tgatctttaaaatacac

SEQ ID NO: 4408579 - DNA, 13 bp, Homo sapiens
tgatctttgagcc

SEQ ID NO: 4408580 - DNA, 16 bp, Homo sapiens
tgatctttgagcccat

SEQ ID NO: 4408581 - DNA, 13 bp, Homo sapiens
tgatctttgcaaa

SEQ ID NO: 4408582 - DNA, 19 bp, Homo sapiens
tgatctttgggcatcagaa

SEQ ID NO: 4408583 - DNA, 14 bp, Homo sapiens
tgatctttgtttaa

SEQ ID NO: 4408584 - DNA, 15 bp, Homo sapiens
tgatctttgtttaaa

SEQ ID NO: 4408585 - DNA, 20 bp, Homo sapiens
tgatgacgggatgctcttta

SEQ ID NO: 4408586 - DNA, 23 bp, Homo sapiens
tgatgacttagcgtcaagacatt

SEQ ID NO: 4408587 - DNA, 13 bp, Homo sapiens
tgatgaggtattt

SEQ ID NO: 4408588 - DNA, 22 bp, Homo sapiens
tgatgaggtattttttcctttt

SEQ ID NO: 4408589 - DNA, 21 bp, Homo sapiens
tgatgagtaaactgaggccca

SEQ ID NO: 4408590 - DNA, 19 bp, Homo sapiens
tgatgagttaactgtgaaa

SEQ ID NO: 4408591 - DNA, 20 bp, Homo sapiens
tgatgagttaactgtgaaat

SEQ ID NO: 4408592 - DNA, 14 bp, Homo sapiens
tgatgatctttaaa

SEQ ID NO: 4408593 - DNA, 17 bp, Homo sapiens
tgatgatctttaaaata

SEQ ID NO: 4408594 - DNA, 15 bp, Homo sapiens
tgatgatgatgaaaa

SEQ ID NO: 4408595 - DNA, 13 bp, Homo sapiens
tgatgattttcct

SEQ ID NO: 4408596 - DNA, 15 bp, Homo sapiens
tgatgattttccttt

SEQ ID NO: 4408597 - DNA, 18 bp, Homo sapiens
tgatgcagataaaatatt

SEQ ID NO: 4408598 - DNA, 12 bp, Homo sapiens
tgatgcagcatt

SEQ ID NO: 4408599 - DNA, 13 bp, Homo sapiens
tgatgcagcattt

SEQ ID NO: 4408600 - DNA, 14 bp, Homo sapiens
tgatgcagcatttg

SEQ ID NO: 4408601 - DNA, 19 bp, Homo sapiens
tgatgcagcatttgataat

SEQ ID NO: 4408602 - DNA, 21 bp, Homo sapiens
tgatgcagtctcctctttaaa

SEQ ID NO: 4408603 - DNA, 14 bp, Homo sapiens
tgatgccaaaaaaa

SEQ ID NO: 4408604 - DNA, 19 bp, Homo sapiens
tgatgccattacagaacca

SEQ ID NO: 4408605 - DNA, 21 bp, Homo sapiens
tgatgctccctcccctgccct

SEQ ID NO: 4408606 - DNA, 13 bp, Homo sapiens
tgatgctgggacc

SEQ ID NO: 4408607 - DNA, 20 bp, Homo sapiens
tgatgctgtgctatgaattt

SEQ ID NO: 4408608 - DNA, 13 bp, Homo sapiens
tgatgctgttaac

SEQ ID NO: 4408609 - DNA, 17 bp, Homo sapiens
tgatggaattaaatgtg

SEQ ID NO: 4408610 - DNA, 15 bp, Homo sapiens
tgatggagaggacag

SEQ ID NO: 4408611 - DNA, 17 bp, Homo sapiens
tgatggagaggacagag

SEQ ID NO: 4408612 - DNA, 20 bp, Homo sapiens
tgatggagttccttctggtg

SEQ ID NO: 4408613 - DNA, 15 bp, Homo sapiens
tgatggatcaccatt

SEQ ID NO: 4408614 - DNA, 18 bp, Homo sapiens
tgatggccttaatttcct

SEQ ID NO: 4408615 - DNA, 20 bp, Homo sapiens
tgatggccttaatttccttt

SEQ ID NO: 4408616 - DNA, 19 bp, Homo sapiens
tgatgggaaagcattgtaa

SEQ ID NO: 4408617 - DNA, 16 bp, Homo sapiens
tgatgtacagtctgtc

SEQ ID NO: 4408618 - DNA, 16 bp, Homo sapiens
tgatgtatgtaataca

SEQ ID NO: 4408619 - DNA, 14 bp, Homo sapiens
tgatgtcaaagtgt

SEQ ID NO: 4408620 - DNA, 13 bp, Homo sapiens
tgatgtcatgtgt

SEQ ID NO: 4408621 - DNA, 15 bp, Homo sapiens
tgatgtcatgtgttc

SEQ ID NO: 4408622 - DNA, 16 bp, Homo sapiens
tgatgtgatattctgt

SEQ ID NO: 4408623 - DNA, 22 bp, Homo sapiens
tgatgtgattatttttctttta

SEQ ID NO: 4408624 - DNA, 14 bp, Homo sapiens
tgatgtggaggaag

SEQ ID NO: 4408625 - DNA, 15 bp, Homo sapiens
tgatgtggaggaaga

SEQ ID NO: 4408626 - DNA, 16 bp, Homo sapiens
tgatgtggaggaagag

SEQ ID NO: 4408627 - DNA, 18 bp, Homo sapiens
tgatgtggaggaagagcc

SEQ ID NO: 4408628 - DNA, 18 bp, Homo sapiens
tgatgtgtcctgtacaca

SEQ ID NO: 4408629 - DNA, 23 bp, Homo sapiens
tgatgttaaaaaaataagaagaa

SEQ ID NO: 4408630 - DNA, 13 bp, Homo sapiens
tgatgttaagaac

SEQ ID NO: 4408631 - DNA, 16 bp, Homo sapiens
tgatgttccacctgcc

SEQ ID NO: 4408632 - DNA, 19 bp, Homo sapiens
tgatgttccacctgccaca

SEQ ID NO: 4408633 - DNA, 14 bp, Homo sapiens
tgatgttctttcca

SEQ ID NO: 4408634 - DNA, 17 bp, Homo sapiens
tgatgttctttccatga

SEQ ID NO: 4408635 - DNA, 13 bp, Homo sapiens
tgatgttttttct

SEQ ID NO: 4408636 - DNA, 18 bp, Homo sapiens
tgattaaaattcaggaag

SEQ ID NO: 4408637 - DNA, 14 bp, Homo sapiens
tgattaaaggcagc

SEQ ID NO: 4408638 - DNA, 22 bp, Homo sapiens
tgattaagggacatttctataa

SEQ ID NO: 4408639 - DNA, 16 bp, Homo sapiens
tgattactctttgctt

SEQ ID NO: 4408640 - DNA, 14 bp, Homo sapiens
tgattagataaaga

SEQ ID NO: 4408641 - DNA, 13 bp, Homo sapiens
tgattagatcaca

SEQ ID NO: 4408642 - DNA, 13 bp, Homo sapiens
tgattagcaagtt

SEQ ID NO: 4408643 - DNA, 16 bp, Homo sapiens
tgattatacaaaagag

SEQ ID NO: 4408644 - DNA, 15 bp, Homo sapiens
tgattataccatgtg

SEQ ID NO: 4408645 - DNA, 22 bp, Homo sapiens
tgattataccatgtgtgctaat

SEQ ID NO: 4408646 - DNA, 18 bp, Homo sapiens
tgattatggagccttaga

SEQ ID NO: 4408647 - DNA, 16 bp, Homo sapiens
tgattatgtaagcatt

SEQ ID NO: 4408648 - DNA, 16 bp, Homo sapiens
tgattattttagctaa

SEQ ID NO: 4408649 - DNA, 18 bp, Homo sapiens
tgattcaaattgctgctt

SEQ ID NO: 4408650 - DNA, 12 bp, Homo sapiens
tgattcaacagg

SEQ ID NO: 4408651 - DNA, 21 bp, Homo sapiens
tgattcaagccattccaaagt

SEQ ID NO: 4408652 - DNA, 16 bp, Homo sapiens
tgattcaaggctcaga

SEQ ID NO: 4408653 - DNA, 16 bp, Homo sapiens
tgattcaatctgtaaa

SEQ ID NO: 4408654 - DNA, 18 bp, Homo sapiens
tgattcatagtaacttct

SEQ ID NO: 4408655 - DNA, 22 bp, Homo sapiens
tgattccactacacctggctga

SEQ ID NO: 4408656 - DNA, 16 bp, Homo sapiens
tgattccattttaagt

SEQ ID NO: 4408657 - DNA, 15 bp, Homo sapiens
tgattccttgagttt

SEQ ID NO: 4408658 - DNA, 19 bp, Homo sapiens
tgattccttgagtttcata

SEQ ID NO: 4408659 - DNA, 22 bp, Homo sapiens
tgattctatttatatgtacatg

SEQ ID NO: 4408660 - DNA, 16 bp, Homo sapiens
tgattctccttcagcc

SEQ ID NO: 4408661 - DNA, 18 bp, Homo sapiens
tgattctccttcagccct

SEQ ID NO: 4408662 - DNA, 13 bp, Homo sapiens
tgattctgccttt

SEQ ID NO: 4408663 - DNA, 14 bp, Homo sapiens
tgattcttgtaaat

SEQ ID NO: 4408664 - DNA, 17 bp, Homo sapiens
tgattcttgtaaatctt

SEQ ID NO: 4408665 - DNA, 20 bp, Homo sapiens
tgattgaactggaataatat

SEQ ID NO: 4408666 - DNA, 21 bp, Homo sapiens
tgattgaatttttaagcaaat

SEQ ID NO: 4408667 - DNA, 19 bp, Homo sapiens
tgattgatcacacagtgtt

SEQ ID NO: 4408668 - DNA, 21 bp, Homo sapiens
tgattgatcacacagtgttag

SEQ ID NO: 4408669 - DNA, 20 bp, Homo sapiens
tgattgcagcttttggttaa

SEQ ID NO: 4408670 - DNA, 18 bp, Homo sapiens
tgattgcttgagctcagg

SEQ ID NO: 4408671 - DNA, 17 bp, Homo sapiens
tgattggtgcaaccctt

SEQ ID NO: 4408672 - DNA, 21 bp, Homo sapiens
tgattggtgcaacccttaccc

SEQ ID NO: 4408673 - DNA, 17 bp, Homo sapiens
tgattgtatgttgagga

SEQ ID NO: 4408674 - DNA, 16 bp, Homo sapiens
tgattgtattgttgaa

SEQ ID NO: 4408675 - DNA, 13 bp, Homo sapiens
tgattgtcttaat

SEQ ID NO: 4408676 - DNA, 18 bp, Homo sapiens
tgattgtcttaatattgt

SEQ ID NO: 4408677 - DNA, 11 bp, Homo sapiens
tgattgtgaag

SEQ ID NO: 4408678 - DNA, 12 bp, Homo sapiens
tgattgtgaagg

SEQ ID NO: 4408679 - DNA, 14 bp, Homo sapiens
tgattgtggaatgg

SEQ ID NO: 4408680 - DNA, 18 bp, Homo sapiens
tgattgtggaatggagat

SEQ ID NO: 4408681 - DNA, 21 bp, Homo sapiens
tgattgtggaatggagattca

SEQ ID NO: 4408682 - DNA, 13 bp, Homo sapiens
tgatttaatgttt

SEQ ID NO: 4408683 - DNA, 17 bp, Homo sapiens
tgatttatttgcttctt

SEQ ID NO: 4408684 - DNA, 16 bp, Homo sapiens
tgatttcagtaagtct

SEQ ID NO: 4408685 - DNA, 15 bp, Homo sapiens
tgatttcatattgat

SEQ ID NO: 4408686 - DNA, 14 bp, Homo sapiens
tgatttccaaagag

SEQ ID NO: 4408687 - DNA, 13 bp, Homo sapiens
tgatttccttgaa

SEQ ID NO: 4408688 - DNA, 15 bp, Homo sapiens
tgatttccttgaatg

SEQ ID NO: 4408689 - DNA, 17 bp, Homo sapiens
tgatttccttgaatgtg

SEQ ID NO: 4408690 - DNA, 17 bp, Homo sapiens
tgatttctatggctttc

SEQ ID NO: 4408691 - DNA, 19 bp, Homo sapiens
tgatttctatggctttcaa

SEQ ID NO: 4408692 - DNA, 21 bp, Homo sapiens
tgatttctatggctttcaaag

SEQ ID NO: 4408693 - DNA, 11 bp, Homo sapiens
tgatttctcac

SEQ ID NO: 4408694 - DNA, 22 bp, Homo sapiens
tgatttctgcccttgttccagc

SEQ ID NO: 4408695 - DNA, 20 bp, Homo sapiens
tgatttgaaaagaatttgtt

SEQ ID NO: 4408696 - DNA, 17 bp, Homo sapiens
tgatttgaagaacatgt

SEQ ID NO: 4408697 - DNA, 13 bp, Homo sapiens
tgatttgcattga

SEQ ID NO: 4408698 - DNA, 15 bp, Homo sapiens
tgatttgcattgaac

SEQ ID NO: 4408699 - DNA, 18 bp, Homo sapiens
tgatttgtcccagaattt

SEQ ID NO: 4408700 - DNA, 21 bp, Homo sapiens
tgatttgtcccagaattttct

SEQ ID NO: 4408701 - DNA, 18 bp, Homo sapiens
tgattttagctgcagaac

SEQ ID NO: 4408702 - DNA, 17 bp, Homo sapiens
tgattttgctgtagaag

SEQ ID NO: 4408703 - DNA, 19 bp, Homo sapiens
tgattttgctgtagaagat

SEQ ID NO: 4408704 - DNA, 23 bp, Homo sapiens
tgattttggaactgtgtttcaaa

SEQ ID NO: 4408705 - DNA, 18 bp, Homo sapiens
tgcaaaaaaattaaaatg

SEQ ID NO: 4408706 - DNA, 14 bp, Homo sapiens
tgcaaaaactgtaa

SEQ ID NO: 4408707 - DNA, 19 bp, Homo sapiens
tgcaaaaactgtaaaagtg

SEQ ID NO: 4408708 - DNA, 16 bp, Homo sapiens
tgcaaaagtggggcta

SEQ ID NO: 4408709 - DNA, 14 bp, Homo sapiens
tgcaaaagttctca

SEQ ID NO: 4408710 - DNA, 24 bp, Homo sapiens
tgcaaaatgtagaaataaattact

SEQ ID NO: 4408711 - DNA, 18 bp, Homo sapiens
tgcaaacatggagaaatc

SEQ ID NO: 4408712 - DNA, 23 bp, Homo sapiens
tgcaaacctgacccctgctcagt

SEQ ID NO: 4408713 - DNA, 19 bp, Homo sapiens
tgcaaacctgcagttttta

SEQ ID NO: 4408714 - DNA, 17 bp, Homo sapiens
tgcaaactgctttattt

SEQ ID NO: 4408715 - DNA, 15 bp, Homo sapiens
tgcaaagagacattt

SEQ ID NO: 4408716 - DNA, 18 bp, Homo sapiens
tgcaaagagacatttcaa

SEQ ID NO: 4408717 - DNA, 20 bp, Homo sapiens
tgcaaagagacatttcaaaa

SEQ ID NO: 4408718 - DNA, 22 bp, Homo sapiens
tgcaaagcactgacttctaagt

SEQ ID NO: 4408719 - DNA, 15 bp, Homo sapiens
tgcaaaggataaatt

SEQ ID NO: 4408720 - DNA, 16 bp, Homo sapiens
tgcaaaggataaattt

SEQ ID NO: 4408721 - DNA, 15 bp, Homo sapiens
tgcaaagtacaatgt

SEQ ID NO: 4408722 - DNA, 19 bp, Homo sapiens
tgcaaagtacaatgtgttt

SEQ ID NO: 4408723 - DNA, 13 bp, Homo sapiens
tgcaaagtactgt

SEQ ID NO: 4408724 - DNA, 15 bp, Homo sapiens
tgcaaagtattgtaa

SEQ ID NO: 4408725 - DNA, 18 bp, Homo sapiens
tgcaaataaattatgcaa

SEQ ID NO: 4408726 - DNA, 14 bp, Homo sapiens
tgcaaatagaaaac

SEQ ID NO: 4408727 - DNA, 19 bp, Homo sapiens
tgcaaatattagcaaagaa

SEQ ID NO: 4408728 - DNA, 19 bp, Homo sapiens
tgcaaatattggttagtat

SEQ ID NO: 4408729 - DNA, 22 bp, Homo sapiens
tgcaaatattggttagtattta

SEQ ID NO: 4408730 - DNA, 14 bp, Homo sapiens
tgcaaatcttgaaa

SEQ ID NO: 4408731 - DNA, 19 bp, Homo sapiens
tgcaaatggagataaaagc

SEQ ID NO: 4408732 - DNA, 14 bp, Homo sapiens
tgcaaatgggagct

SEQ ID NO: 4408733 - DNA, 22 bp, Homo sapiens
tgcaaatgggagctgagcagcc

SEQ ID NO: 4408734 - DNA, 15 bp, Homo sapiens
tgcaaattgtgaaat

SEQ ID NO: 4408735 - DNA, 16 bp, Homo sapiens
tgcaaatttagtttgt

SEQ ID NO: 4408736 - DNA, 22 bp, Homo sapiens
tgcaaatttctataaatttaag

SEQ ID NO: 4408737 - DNA, 21 bp, Homo sapiens
tgcaacaagctcatccctgga

SEQ ID NO: 4408738 - DNA, 22 bp, Homo sapiens
tgcaacactggtctgctgttcc

SEQ ID NO: 4408739 - DNA, 15 bp, Homo sapiens
tgcaaccactgcaat

SEQ ID NO: 4408740 - DNA, 15 bp, Homo sapiens
tgcaacccttacccc

SEQ ID NO: 4408741 - DNA, 20 bp, Homo sapiens
tgcaacctcgctggactctc

SEQ ID NO: 4408742 - DNA, 22 bp, Homo sapiens
tgcaacctcgctggactctcag

SEQ ID NO: 4408743 - DNA, 21 bp, Homo sapiens
tgcaacctctacctcctgggt

SEQ ID NO: 4408744 - DNA, 23 bp, Homo sapiens
tgcaactaactgactctgttatt

SEQ ID NO: 4408745 - DNA, 24 bp, Homo sapiens
tgcaactaactgactctgttattg

SEQ ID NO: 4408746 - DNA, 15 bp, Homo sapiens
tgcaactccatcctc

SEQ ID NO: 4408747 - DNA, 22 bp, Homo sapiens
tgcaacttagatctctcctgca

SEQ ID NO: 4408748 - DNA, 22 bp, Homo sapiens
tgcaagaatgaaatgaatgatt

SEQ ID NO: 4408749 - DNA, 18 bp, Homo sapiens
tgcaagaccacggaggga

SEQ ID NO: 4408750 - DNA, 23 bp, Homo sapiens
tgcaagagccttggtgtccacct

SEQ ID NO: 4408751 - DNA, 15 bp, Homo sapiens
tgcaagatgcttggt

SEQ ID NO: 4408752 - DNA, 19 bp, Homo sapiens
tgcaagatgcttggttgtg

SEQ ID NO: 4408753 - DNA, 21 bp, Homo sapiens
tgcaagatggacacgagccac

SEQ ID NO: 4408754 - DNA, 23 bp, Homo sapiens
tgcaagatggacacgagccacaa

SEQ ID NO: 4408755 - DNA, 23 bp, Homo sapiens
tgcaagcactcggggtccctgga

SEQ ID NO: 4408756 - DNA, 23 bp, Homo sapiens
tgcaagcagctttttattccctg

SEQ ID NO: 4408757 - DNA, 22 bp, Homo sapiens
tgcaagcatttttccatctgtg

SEQ ID NO: 4408758 - DNA, 19 bp, Homo sapiens
tgcaagcccctctttctgt

SEQ ID NO: 4408759 - DNA, 14 bp, Homo sapiens
tgcaagctccgcct

SEQ ID NO: 4408760 - DNA, 24 bp, Homo sapiens
tgcaaggccgctgttcacccacag

SEQ ID NO: 4408761 - DNA, 12 bp, Homo sapiens
tgcaagggaaga

SEQ ID NO: 4408762 - DNA, 13 bp, Homo sapiens
tgcaaggtggcct

SEQ ID NO: 4408763 - DNA, 15 bp, Homo sapiens
tgcaaggtggccttt

SEQ ID NO: 4408764 - DNA, 22 bp, Homo sapiens
tgcaaggtggcctttgtgctgc

SEQ ID NO: 4408765 - DNA, 13 bp, Homo sapiens
tgcaagtctgtgg

SEQ ID NO: 4408766 - DNA, 14 bp, Homo sapiens
tgcaataaagtata

SEQ ID NO: 4408767 - DNA, 15 bp, Homo sapiens
tgcaataaagtataa

SEQ ID NO: 4408768 - DNA, 20 bp, Homo sapiens
tgcaataagattggtgttcg

SEQ ID NO: 4408769 - DNA, 19 bp, Homo sapiens
tgcaataatgatcaaagtt

SEQ ID NO: 4408770 - DNA, 12 bp, Homo sapiens
tgcaataatgca

SEQ ID NO: 4408771 - DNA, 20 bp, Homo sapiens
tgcaatagattactgatgtg

SEQ ID NO: 4408772 - DNA, 22 bp, Homo sapiens
tgcaatagattactgatgtgat

SEQ ID NO: 4408773 - DNA, 16 bp, Homo sapiens
tgcaatagcagttata

SEQ ID NO: 4408774 - DNA, 21 bp, Homo sapiens
tgcaatatcttcgttagtaat

SEQ ID NO: 4408775 - DNA, 13 bp, Homo sapiens
tgcaatatttgta

SEQ ID NO: 4408776 - DNA, 21 bp, Homo sapiens
tgcaatccaggctgttctcag

SEQ ID NO: 4408777 - DNA, 22 bp, Homo sapiens
tgcaatccaggctgttctcagc

SEQ ID NO: 4408778 - DNA, 14 bp, Homo sapiens
tgcaatccatttat

SEQ ID NO: 4408779 - DNA, 19 bp, Homo sapiens
tgcaatcccatttgcagga

SEQ ID NO: 4408780 - DNA, 11 bp, Homo sapiens
tgcaatgaaca

SEQ ID NO: 4408781 - DNA, 15 bp, Homo sapiens
tgcaatgaaggaaat

SEQ ID NO: 4408782 - DNA, 21 bp, Homo sapiens
tgcaatgggtaagggagggaa

SEQ ID NO: 4408783 - DNA, 21 bp, Homo sapiens
tgcaatgtggtgacacctccc

SEQ ID NO: 4408784 - DNA, 22 bp, Homo sapiens
tgcaattaaacttccaaagaaa

SEQ ID NO: 4408785 - DNA, 17 bp, Homo sapiens
tgcaatttctgtacatt

SEQ ID NO: 4408786 - DNA, 22 bp, Homo sapiens
tgcaatttctgtacatttgcaa

SEQ ID NO: 4408787 - DNA, 18 bp, Homo sapiens
tgcaatttgtaaatattg

SEQ ID NO: 4408788 - DNA, 12 bp, Homo sapiens
tgcaattttact

SEQ ID NO: 4408789 - DNA, 14 bp, Homo sapiens
tgcaattttactgt

SEQ ID NO: 4408790 - DNA, 15 bp, Homo sapiens
tgcaattttactgtg

SEQ ID NO: 4408791 - DNA, 17 bp, Homo sapiens
tgcaattttactgtgaa

SEQ ID NO: 4408792 - DNA, 18 bp, Homo sapiens
tgcaattttactgtgaaa

SEQ ID NO: 4408793 - DNA, 15 bp, Homo sapiens
tgcacaaaagcagat

SEQ ID NO: 4408794 - DNA, 23 bp, Homo sapiens
tgcacaaaatgaatgaggtctgg

SEQ ID NO: 4408795 - DNA, 21 bp, Homo sapiens
tgcacaaccatctgtccctgc

SEQ ID NO: 4408796 - DNA, 17 bp, Homo sapiens
tgcacaaggattgaaaa

SEQ ID NO: 4408797 - DNA, 15 bp, Homo sapiens
tgcacaagttccctg

SEQ ID NO: 4408798 - DNA, 17 bp, Homo sapiens
tgcacaagttccctgga

SEQ ID NO: 4408799 - DNA, 18 bp, Homo sapiens
tgcacaagttccctggag

SEQ ID NO: 4408800 - DNA, 15 bp, Homo sapiens
tgcacaataaaaatg

SEQ ID NO: 4408801 - DNA, 15 bp, Homo sapiens
tgcacaatatttctt

SEQ ID NO: 4408802 - DNA, 19 bp, Homo sapiens
tgcacaatatttcttttgt

SEQ ID NO: 4408803 - DNA, 14 bp, Homo sapiens
tgcacacaaatatt

SEQ ID NO: 4408804 - DNA, 18 bp, Homo sapiens
tgcacacagagtgaggga

SEQ ID NO: 4408805 - DNA, 16 bp, Homo sapiens
tgcacaccagagacaa

SEQ ID NO: 4408806 - DNA, 23 bp, Homo sapiens
tgcacaccagagacaagcagagt

SEQ ID NO: 4408807 - DNA, 22 bp, Homo sapiens
tgcacacctactagtcaccaga

SEQ ID NO: 4408808 - DNA, 16 bp, Homo sapiens
tgcacactatttccct

SEQ ID NO: 4408809 - DNA, 21 bp, Homo sapiens
tgcacactgtcctattatatt

SEQ ID NO: 4408810 - DNA, 16 bp, Homo sapiens
tgcacactttggccca

SEQ ID NO: 4408811 - DNA, 17 bp, Homo sapiens
tgcacactttggcccag

SEQ ID NO: 4408812 - DNA, 20 bp, Homo sapiens
tgcacactttggcccagggt

SEQ ID NO: 4408813 - DNA, 18 bp, Homo sapiens
tgcacagagcaagtcctc

SEQ ID NO: 4408814 - DNA, 22 bp, Homo sapiens
tgcacagagcaagtcctcactc

SEQ ID NO: 4408815 - DNA, 18 bp, Homo sapiens
tgcacagccaacgagaca

SEQ ID NO: 4408816 - DNA, 17 bp, Homo sapiens
tgcacagcgtcctgtcc

SEQ ID NO: 4408817 - DNA, 12 bp, Homo sapiens
tgcacagggcag

SEQ ID NO: 4408818 - DNA, 19 bp, Homo sapiens
tgcacagggcagctgggcc

SEQ ID NO: 4408819 - DNA, 16 bp, Homo sapiens
tgcacagtatttgtaa

SEQ ID NO: 4408820 - DNA, 17 bp, Homo sapiens
tgcacagtatttgtaat

SEQ ID NO: 4408821 - DNA, 18 bp, Homo sapiens
tgcacagtatttgtaatt

SEQ ID NO: 4408822 - DNA, 23 bp, Homo sapiens
tgcacagtatttgtaattaaaag

SEQ ID NO: 4408823 - DNA, 14 bp, Homo sapiens
tgcacataggcagt

SEQ ID NO: 4408824 - DNA, 15 bp, Homo sapiens
tgcacatctacatgc

SEQ ID NO: 4408825 - DNA, 22 bp, Homo sapiens
tgcacatctgtaaatctacaca

SEQ ID NO: 4408826 - DNA, 16 bp, Homo sapiens
tgcacatctgtgtctt

SEQ ID NO: 4408827 - DNA, 14 bp, Homo sapiens
tgcacatgcccctt

SEQ ID NO: 4408828 - DNA, 23 bp, Homo sapiens
tgcacatgctgtctggccctggg

SEQ ID NO: 4408829 - DNA, 23 bp, Homo sapiens
tgcacatggcctgagcatccaga

SEQ ID NO: 4408830 - DNA, 11 bp, Homo sapiens
tgcaccaaaga

SEQ ID NO: 4408831 - DNA, 13 bp, Homo sapiens
tgcaccaaagaca

SEQ ID NO: 4408832 - DNA, 14 bp, Homo sapiens
tgcaccaagcagga

SEQ ID NO: 4408833 - DNA, 15 bp, Homo sapiens
tgcaccacacctggc

SEQ ID NO: 4408834 - DNA, 18 bp, Homo sapiens
tgcaccagaaatgtttat

SEQ ID NO: 4408835 - DNA, 16 bp, Homo sapiens
tgcaccaggggtgcac

SEQ ID NO: 4408836 - DNA, 23 bp, Homo sapiens
tgcaccagggttgaccccagagg

SEQ ID NO: 4408837 - DNA, 15 bp, Homo sapiens
tgcaccattttcaat

SEQ ID NO: 4408838 - DNA, 16 bp, Homo sapiens
tgcacccagccctggt

SEQ ID NO: 4408839 - DNA, 15 bp, Homo sapiens
tgcacccatgggctc

SEQ ID NO: 4408840 - DNA, 21 bp, Homo sapiens
tgcacccatgggctctgacag

SEQ ID NO: 4408841 - DNA, 23 bp, Homo sapiens
tgcaccccagcattccagctctg

SEQ ID NO: 4408842 - DNA, 22 bp, Homo sapiens
tgcacccctgagccagcagggc

SEQ ID NO: 4408843 - DNA, 22 bp, Homo sapiens
tgcacccctgagttgggcagcc

SEQ ID NO: 4408844 - DNA, 13 bp, Homo sapiens
tgcacccctgccc

SEQ ID NO: 4408845 - DNA, 19 bp, Homo sapiens
tgcaccccttctctcctcc

SEQ ID NO: 4408846 - DNA, 17 bp, Homo sapiens
tgcacccgcctcgacct

SEQ ID NO: 4408847 - DNA, 12 bp, Homo sapiens
tgcaccggggcc

SEQ ID NO: 4408848 - DNA, 13 bp, Homo sapiens
tgcacctaaagaa

SEQ ID NO: 4408849 - DNA, 19 bp, Homo sapiens
tgcacctaaagaaaaacaa

SEQ ID NO: 4408850 - DNA, 18 bp, Homo sapiens
tgcacctatctcagccat

SEQ ID NO: 4408851 - DNA, 18 bp, Homo sapiens
tgcacctccccccactgc

SEQ ID NO: 4408852 - DNA, 20 bp, Homo sapiens
tgcacctccccccactgcag

SEQ ID NO: 4408853 - DNA, 21 bp, Homo sapiens
tgcacctcctaccctcccacc

SEQ ID NO: 4408854 - DNA, 11 bp, Homo sapiens
tgcacctgcat

SEQ ID NO: 4408855 - DNA, 14 bp, Homo sapiens
tgcacctgccccgt

SEQ ID NO: 4408856 - DNA, 19 bp, Homo sapiens
tgcacgcgccctttctacc

SEQ ID NO: 4408857 - DNA, 18 bp, Homo sapiens
tgcacggtgggccttgct

SEQ ID NO: 4408858 - DNA, 15 bp, Homo sapiens
tgcacgtcatgggag

SEQ ID NO: 4408859 - DNA, 17 bp, Homo sapiens
tgcacgtggagagctgg

SEQ ID NO: 4408860 - DNA, 20 bp, Homo sapiens
tgcacgtggagagctggtgc

SEQ ID NO: 4408861 - DNA, 15 bp, Homo sapiens
tgcacgtggggccca

SEQ ID NO: 4408862 - DNA, 17 bp, Homo sapiens
tgcacgtgtctgggtat

SEQ ID NO: 4408863 - DNA, 13 bp, Homo sapiens
tgcactaagacaa

SEQ ID NO: 4408864 - DNA, 19 bp, Homo sapiens
tgcactactcctctgcagt

SEQ ID NO: 4408865 - DNA, 15 bp, Homo sapiens
tgcactcatcatatt

SEQ ID NO: 4408866 - DNA, 17 bp, Homo sapiens
tgcactcatcatatttt

SEQ ID NO: 4408867 - DNA, 17 bp, Homo sapiens
tgcactccagcctgagc

SEQ ID NO: 4408868 - DNA, 16 bp, Homo sapiens
tgcactccagcctggg

SEQ ID NO: 4408869 - DNA, 17 bp, Homo sapiens
tgcactccagcctgggg

SEQ ID NO: 4408870 - DNA, 14 bp, Homo sapiens
tgcactcccacctg

SEQ ID NO: 4408871 - DNA, 17 bp, Homo sapiens
tgcactcccacctgaca

SEQ ID NO: 4408872 - DNA, 19 bp, Homo sapiens
tgcactcccacctgacaca

SEQ ID NO: 4408873 - DNA, 16 bp, Homo sapiens
tgcactctaacactcg

SEQ ID NO: 4408874 - DNA, 15 bp, Homo sapiens
tgcactcttaaacag

SEQ ID NO: 4408875 - DNA, 14 bp, Homo sapiens
tgcactgaagagct

SEQ ID NO: 4408876 - DNA, 15 bp, Homo sapiens
tgcactgaagagctc

SEQ ID NO: 4408877 - DNA, 18 bp, Homo sapiens
tgcactgaagagctcttg

SEQ ID NO: 4408878 - DNA, 15 bp, Homo sapiens
tgcactgtaaatatc

SEQ ID NO: 4408879 - DNA, 19 bp, Homo sapiens
tgcactgtgtcatcttttc

SEQ ID NO: 4408880 - DNA, 13 bp, Homo sapiens
tgcactgttcccc

SEQ ID NO: 4408881 - DNA, 19 bp, Homo sapiens
tgcactgttccccctgtgc

SEQ ID NO: 4408882 - DNA, 21 bp, Homo sapiens
tgcactgttccccctgtgcag

SEQ ID NO: 4408883 - DNA, 14 bp, Homo sapiens
tgcactgttctgat

SEQ ID NO: 4408884 - DNA, 14 bp, Homo sapiens
tgcactgtttgcat

SEQ ID NO: 4408885 - DNA, 14 bp, Homo sapiens
tgcacttctattta

SEQ ID NO: 4408886 - DNA, 12 bp, Homo sapiens
tgcactttgtaa

SEQ ID NO: 4408887 - DNA, 15 bp, Homo sapiens
tgcactttgtttaga

SEQ ID NO: 4408888 - DNA, 19 bp, Homo sapiens
tgcactttgtttagaaaaa

SEQ ID NO: 4408889 - DNA, 21 bp, Homo sapiens
tgcacttttatgaagttttta

SEQ ID NO: 4408890 - DNA, 22 bp, Homo sapiens
tgcacttttatgaagtttttaa

SEQ ID NO: 4408891 - DNA, 20 bp, Homo sapiens
tgcactttttccttactgtg

SEQ ID NO: 4408892 - DNA, 21 bp, Homo sapiens
tgcactttttccttactgtgc

SEQ ID NO: 4408893 - DNA, 17 bp, Homo sapiens
tgcagaaaagcacctgc

SEQ ID NO: 4408894 - DNA, 20 bp, Homo sapiens
tgcagaaaagcacctgccga

SEQ ID NO: 4408895 - DNA, 21 bp, Homo sapiens
tgcagaaaagcacctgccgac

SEQ ID NO: 4408896 - DNA, 22 bp, Homo sapiens
tgcagaaaagcacctgccgacc

SEQ ID NO: 4408897 - DNA, 20 bp, Homo sapiens
tgcagaaatagacaaaaagt

SEQ ID NO: 4408898 - DNA, 21 bp, Homo sapiens
tgcagaaatagacaaaaagta

SEQ ID NO: 4408899 - DNA, 22 bp, Homo sapiens
tgcagaagacagtatggcagct

SEQ ID NO: 4408900 - DNA, 16 bp, Homo sapiens
tgcagacacctggact

SEQ ID NO: 4408901 - DNA, 16 bp, Homo sapiens
tgcagaccccaggttc

SEQ ID NO: 4408902 - DNA, 18 bp, Homo sapiens
tgcagacctcaagccatc

SEQ ID NO: 4408903 - DNA, 14 bp, Homo sapiens
tgcagacctgtcct

SEQ ID NO: 4408904 - DNA, 19 bp, Homo sapiens
tgcagacctgtcctcctgg

SEQ ID NO: 4408905 - DNA, 22 bp, Homo sapiens
tgcagacggatgcccattcctg

SEQ ID NO: 4408906 - DNA, 15 bp, Homo sapiens
tgcagacttcccagc

SEQ ID NO: 4408907 - DNA, 11 bp, Homo sapiens
tgcagagcctt

SEQ ID NO: 4408908 - DNA, 16 bp, Homo sapiens
tgcagagccttctcag

SEQ ID NO: 4408909 - DNA, 22 bp, Homo sapiens
tgcagagccttctcagaagcac

SEQ ID NO: 4408910 - DNA, 18 bp, Homo sapiens
tgcagagctgacccagag

SEQ ID NO: 4408911 - DNA, 18 bp, Homo sapiens
tgcagaggggaaagactt

SEQ ID NO: 4408912 - DNA, 15 bp, Homo sapiens
tgcagagttcagact

SEQ ID NO: 4408913 - DNA, 17 bp, Homo sapiens
tgcagataaacagtagt

SEQ ID NO: 4408914 - DNA, 16 bp, Homo sapiens
tgcagatgtgagccac

SEQ ID NO: 4408915 - DNA, 12 bp, Homo sapiens
tgcagcaactcc

SEQ ID NO: 4408916 - DNA, 15 bp, Homo sapiens
tgcagcaactcccac

SEQ ID NO: 4408917 - DNA, 19 bp, Homo sapiens
tgcagcaactcccacgact

SEQ ID NO: 4408918 - DNA, 23 bp, Homo sapiens
tgcagcagaggacagtctggaga

SEQ ID NO: 4408919 - DNA, 10 bp, Homo sapiens
tgcagcaggc

SEQ ID NO: 4408920 - DNA, 14 bp, Homo sapiens
tgcagcagggaagg

SEQ ID NO: 4408921 - DNA, 23 bp, Homo sapiens
tgcagcagtcgcccaagcagaca

SEQ ID NO: 4408922 - DNA, 22 bp, Homo sapiens
tgcagcatttgataatgataaa

SEQ ID NO: 4408923 - DNA, 17 bp, Homo sapiens
tgcagccagcccagccc

SEQ ID NO: 4408924 - DNA, 13 bp, Homo sapiens
tgcagccagggct

SEQ ID NO: 4408925 - DNA, 15 bp, Homo sapiens
tgcagccagggctgg

SEQ ID NO: 4408926 - DNA, 16 bp, Homo sapiens
tgcagccagggctggg

SEQ ID NO: 4408927 - DNA, 18 bp, Homo sapiens
tgcagccagggctggggt

SEQ ID NO: 4408928 - DNA, 23 bp, Homo sapiens
tgcagccagggctggggttgcca

SEQ ID NO: 4408929 - DNA, 14 bp, Homo sapiens
tgcagcccatgccc

SEQ ID NO: 4408930 - DNA, 21 bp, Homo sapiens
tgcagcccatgcccacctgcc

SEQ ID NO: 4408931 - DNA, 23 bp, Homo sapiens
tgcagcccatgcccacctgccca

SEQ ID NO: 4408932 - DNA, 14 bp, Homo sapiens
tgcagccgctgagc

SEQ ID NO: 4408933 - DNA, 22 bp, Homo sapiens
tgcagcctaaagtacagcctgg

SEQ ID NO: 4408934 - DNA, 20 bp, Homo sapiens
tgcagcctcatactcctggg

SEQ ID NO: 4408935 - DNA, 23 bp, Homo sapiens
tgcagcctcatactcctgggctc

SEQ ID NO: 4408936 - DNA, 12 bp, Homo sapiens
tgcagccttccc

SEQ ID NO: 4408937 - DNA, 13 bp, Homo sapiens
tgcagccttctcc

SEQ ID NO: 4408938 - DNA, 15 bp, Homo sapiens
tgcagctactggaat

SEQ ID NO: 4408939 - DNA, 20 bp, Homo sapiens
tgcagctatgcgcaatgtgg

SEQ ID NO: 4408940 - DNA, 14 bp, Homo sapiens
tgcagctccctggc

SEQ ID NO: 4408941 - DNA, 20 bp, Homo sapiens
tgcagctccctggcttctgt

SEQ ID NO: 4408942 - DNA, 15 bp, Homo sapiens
tgcagctgagcctga

SEQ ID NO: 4408943 - DNA, 21 bp, Homo sapiens
tgcagctggaatgtgccacag

SEQ ID NO: 4408944 - DNA, 20 bp, Homo sapiens
tgcagcttcacccaccaggc

SEQ ID NO: 4408945 - DNA, 21 bp, Homo sapiens
tgcagcttcacccaccaggcc

SEQ ID NO: 4408946 - DNA, 16 bp, Homo sapiens
tgcagcttcgaggaca

SEQ ID NO: 4408947 - DNA, 19 bp, Homo sapiens
tgcagcttcgaggacagga

SEQ ID NO: 4408948 - DNA, 21 bp, Homo sapiens
tgcagcttttggttaatatgt

SEQ ID NO: 4408949 - DNA, 21 bp, Homo sapiens
tgcaggaaaaggctaagaaaa

SEQ ID NO: 4408950 - DNA, 23 bp, Homo sapiens
tgcaggaaaaggctaagaaaaag

SEQ ID NO: 4408951 - DNA, 14 bp, Homo sapiens
tgcaggagctagtt

SEQ ID NO: 4408952 - DNA, 20 bp, Homo sapiens
tgcaggatctgtctgtgcac

SEQ ID NO: 4408953 - DNA, 20 bp, Homo sapiens
tgcaggcacttattgtaaat

SEQ ID NO: 4408954 - DNA, 21 bp, Homo sapiens
tgcaggcctgctcagggactg

SEQ ID NO: 4408955 - DNA, 17 bp, Homo sapiens
tgcaggcctgtccctgg

SEQ ID NO: 4408956 - DNA, 19 bp, Homo sapiens
tgcaggctggggaggtgct

SEQ ID NO: 4408957 - DNA, 21 bp, Homo sapiens
tgcagggaaaattatttgcat

SEQ ID NO: 4408958 - DNA, 22 bp, Homo sapiens
tgcagggaaaattatttgcata

SEQ ID NO: 4408959 - DNA, 21 bp, Homo sapiens
tgcagggagccttctgccacc

SEQ ID NO: 4408960 - DNA, 18 bp, Homo sapiens
tgcagggaggggaggcag

SEQ ID NO: 4408961 - DNA, 17 bp, Homo sapiens
tgcagggccactggaag

SEQ ID NO: 4408962 - DNA, 23 bp, Homo sapiens
tgcagggccactggaaggaacat

SEQ ID NO: 4408963 - DNA, 15 bp, Homo sapiens
tgcagggcttctcct

SEQ ID NO: 4408964 - DNA, 15 bp, Homo sapiens
tgcagggtcctcttc

SEQ ID NO: 4408965 - DNA, 19 bp, Homo sapiens
tgcaggtcagttgtaataa

SEQ ID NO: 4408966 - DNA, 15 bp, Homo sapiens
tgcaggtctttaaat

SEQ ID NO: 4408967 - DNA, 21 bp, Homo sapiens
tgcaggtgctattgttactct

SEQ ID NO: 4408968 - DNA, 22 bp, Homo sapiens
tgcaggtgctattgttactctt

SEQ ID NO: 4408969 - DNA, 17 bp, Homo sapiens
tgcaggtggcagagtga

SEQ ID NO: 4408970 - DNA, 16 bp, Homo sapiens
tgcaggtgtcctgagc

SEQ ID NO: 4408971 - DNA, 15 bp, Homo sapiens
tgcagtaaaacacat

SEQ ID NO: 4408972 - DNA, 15 bp, Homo sapiens
tgcagtaaatctttt

SEQ ID NO: 4408973 - DNA, 21 bp, Homo sapiens
tgcagtaaatcttttacaact

SEQ ID NO: 4408974 - DNA, 11 bp, Homo sapiens
tgcagtacaga

SEQ ID NO: 4408975 - DNA, 18 bp, Homo sapiens
tgcagtagagagcaaaga

SEQ ID NO: 4408976 - DNA, 13 bp, Homo sapiens
tgcagtatatttc

SEQ ID NO: 4408977 - DNA, 18 bp, Homo sapiens
tgcagtatctcttacatc

SEQ ID NO: 4408978 - DNA, 17 bp, Homo sapiens
tgcagtatggtacattt

SEQ ID NO: 4408979 - DNA, 18 bp, Homo sapiens
tgcagtcacatcacaata

SEQ ID NO: 4408980 - DNA, 13 bp, Homo sapiens
tgcagtcacctct

SEQ ID NO: 4408981 - DNA, 14 bp, Homo sapiens
tgcagtcacctctt

SEQ ID NO: 4408982 - DNA, 17 bp, Homo sapiens
tgcagtcacctcttcta

SEQ ID NO: 4408983 - DNA, 17 bp, Homo sapiens
tgcagtccatttcctaa

SEQ ID NO: 4408984 - DNA, 14 bp, Homo sapiens
tgcagtctcatttc

SEQ ID NO: 4408985 - DNA, 13 bp, Homo sapiens
tgcagtctcctct

SEQ ID NO: 4408986 - DNA, 15 bp, Homo sapiens
tgcagtctcctcttt

SEQ ID NO: 4408987 - DNA, 20 bp, Homo sapiens
tgcagtgagccaaaatcatg

SEQ ID NO: 4408988 - DNA, 21 bp, Homo sapiens
tgcagtggcgcattctaggct

SEQ ID NO: 4408989 - DNA, 14 bp, Homo sapiens
tgcagtgtagattt

SEQ ID NO: 4408990 - DNA, 18 bp, Homo sapiens
tgcagttcagcaccaccc

SEQ ID NO: 4408991 - DNA, 10 bp, Homo sapiens
tgcagtttat

SEQ ID NO: 4408992 - DNA, 16 bp, Homo sapiens
tgcagtttatcattca

SEQ ID NO: 4408993 - DNA, 19 bp, Homo sapiens
tgcagtttcatgtatgtat

SEQ ID NO: 4408994 - DNA, 18 bp, Homo sapiens
tgcagtttcttgtgtaga

SEQ ID NO: 4408995 - DNA, 16 bp, Homo sapiens
tgcagtttcttttcac

SEQ ID NO: 4408996 - DNA, 17 bp, Homo sapiens
tgcagtttcttttcaca

SEQ ID NO: 4408997 - DNA, 18 bp, Homo sapiens
tgcagtttcttttcacat

SEQ ID NO: 4408998 - DNA, 17 bp, Homo sapiens
tgcagtttgaaattctg

SEQ ID NO: 4408999 - DNA, 19 bp, Homo sapiens
tgcagtttgaaattctgaa

SEQ ID NO: 4409000 - DNA, 20 bp, Homo sapiens
tgcagtttgaaattctgaat

SEQ ID NO: 4409001 - DNA, 13 bp, Homo sapiens
tgcataaatcaat

SEQ ID NO: 4409002 - DNA, 17 bp, Homo sapiens
tgcataatgtttctgga

SEQ ID NO: 4409003 - DNA, 15 bp, Homo sapiens
tgcataatttatggt

SEQ ID NO: 4409004 - DNA, 19 bp, Homo sapiens
tgcataccacaagacattt

SEQ ID NO: 4409005 - DNA, 13 bp, Homo sapiens
tgcatactcatta

SEQ ID NO: 4409006 - DNA, 18 bp, Homo sapiens
tgcatactttttaaatgt

SEQ ID NO: 4409007 - DNA, 19 bp, Homo sapiens
tgcatagacaaaggcctta

SEQ ID NO: 4409008 - DNA, 18 bp, Homo sapiens
tgcatatcattaaacaaa

SEQ ID NO: 4409009 - DNA, 22 bp, Homo sapiens
tgcatattctctattttacttt

SEQ ID NO: 4409010 - DNA, 15 bp, Homo sapiens
tgcatatttagctgt

SEQ ID NO: 4409011 - DNA, 20 bp, Homo sapiens
tgcatattttgagaaactgc

SEQ ID NO: 4409012 - DNA, 21 bp, Homo sapiens
tgcatcacactcaaggacagg

SEQ ID NO: 4409013 - DNA, 22 bp, Homo sapiens
tgcatcagctgctgaaacaaca

SEQ ID NO: 4409014 - DNA, 14 bp, Homo sapiens
tgcatcatctgttt

SEQ ID NO: 4409015 - DNA, 19 bp, Homo sapiens
tgcatcatcttgaacatta

SEQ ID NO: 4409016 - DNA, 20 bp, Homo sapiens
tgcatccagcagcagcactt

SEQ ID NO: 4409017 - DNA, 20 bp, Homo sapiens
tgcatccattgttgtgtctg

SEQ ID NO: 4409018 - DNA, 17 bp, Homo sapiens
tgcatcccccctgctca

SEQ ID NO: 4409019 - DNA, 17 bp, Homo sapiens
tgcatcctggcttgaaa

SEQ ID NO: 4409020 - DNA, 13 bp, Homo sapiens
tgcatccttgtaa

SEQ ID NO: 4409021 - DNA, 15 bp, Homo sapiens
tgcatccttgtaata

SEQ ID NO: 4409022 - DNA, 16 bp, Homo sapiens
tgcatccttgtaatac

SEQ ID NO: 4409023 - DNA, 17 bp, Homo sapiens
tgcatcgctgttctggg

SEQ ID NO: 4409024 - DNA, 14 bp, Homo sapiens
tgcatcgggaaaga

SEQ ID NO: 4409025 - DNA, 19 bp, Homo sapiens
tgcatcgggaaagaagaaa

SEQ ID NO: 4409026 - DNA, 20 bp, Homo sapiens
tgcatcgggaaagaagaaac

SEQ ID NO: 4409027 - DNA, 23 bp, Homo sapiens
tgcatctcagatgcctcagtagg

SEQ ID NO: 4409028 - DNA, 13 bp, Homo sapiens
tgcatctcccaga

SEQ ID NO: 4409029 - DNA, 14 bp, Homo sapiens
tgcatctgcacata

SEQ ID NO: 4409030 - DNA, 20 bp, Homo sapiens
tgcatgaaaatagctatttt

SEQ ID NO: 4409031 - DNA, 21 bp, Homo sapiens
tgcatgaaattgtatctcagt

SEQ ID NO: 4409032 - DNA, 18 bp, Homo sapiens
tgcatgacacttccaaag

SEQ ID NO: 4409033 - DNA, 20 bp, Homo sapiens
tgcatgacctaccaggacag

SEQ ID NO: 4409034 - DNA, 19 bp, Homo sapiens
tgcatgatttactcttaga

SEQ ID NO: 4409035 - DNA, 13 bp, Homo sapiens
tgcatgcaactaa

SEQ ID NO: 4409036 - DNA, 14 bp, Homo sapiens
tgcatgcaactaat

SEQ ID NO: 4409037 - DNA, 14 bp, Homo sapiens
tgcatgcataccac

SEQ ID NO: 4409038 - DNA, 15 bp, Homo sapiens
tgcatgcggcccagc

SEQ ID NO: 4409039 - DNA, 16 bp, Homo sapiens
tgcatgcggcccagcc

SEQ ID NO: 4409040 - DNA, 17 bp, Homo sapiens
tgcatgctctctgcagc

SEQ ID NO: 4409041 - DNA, 18 bp, Homo sapiens
tgcatgctctctgcagcc

SEQ ID NO: 4409042 - DNA, 16 bp, Homo sapiens
tgcatggcatcagact

SEQ ID NO: 4409043 - DNA, 16 bp, Homo sapiens
tgcatggctcctgtct

SEQ ID NO: 4409044 - DNA, 21 bp, Homo sapiens
tgcatggctcctgtctggctc

SEQ ID NO: 4409045 - DNA, 22 bp, Homo sapiens
tgcatgggaaatagcggccctg

SEQ ID NO: 4409046 - DNA, 14 bp, Homo sapiens
tgcatgggaggggg

SEQ ID NO: 4409047 - DNA, 11 bp, Homo sapiens
tgcatgggctc

SEQ ID NO: 4409048 - DNA, 19 bp, Homo sapiens
tgcatggtaatttatagtt

SEQ ID NO: 4409049 - DNA, 18 bp, Homo sapiens
tgcatgtagcatataaat

SEQ ID NO: 4409050 - DNA, 14 bp, Homo sapiens
tgcatgtagtaaca

SEQ ID NO: 4409051 - DNA, 17 bp, Homo sapiens
tgcatgtctgcctatgc

SEQ ID NO: 4409052 - DNA, 16 bp, Homo sapiens
tgcatgtttgaaatga

SEQ ID NO: 4409053 - DNA, 15 bp, Homo sapiens
tgcatgtttttgaaa

SEQ ID NO: 4409054 - DNA, 14 bp, Homo sapiens
tgcattaaattcac

SEQ ID NO: 4409055 - DNA, 15 bp, Homo sapiens
tgcattaaattcaca

SEQ ID NO: 4409056 - DNA, 20 bp, Homo sapiens
tgcattaaattcacaaactt

SEQ ID NO: 4409057 - DNA, 11 bp, Homo sapiens
tgcattcattt

SEQ ID NO: 4409058 - DNA, 14 bp, Homo sapiens
tgcattcattttta

SEQ ID NO: 4409059 - DNA, 20 bp, Homo sapiens
tgcattccagaacaaattgt

SEQ ID NO: 4409060 - DNA, 15 bp, Homo sapiens
tgcattcctgtgccc

SEQ ID NO: 4409061 - DNA, 19 bp, Homo sapiens
tgcattcctgtgccctaga

SEQ ID NO: 4409062 - DNA, 17 bp, Homo sapiens
tgcattctttatagtga

SEQ ID NO: 4409063 - DNA, 14 bp, Homo sapiens
tgcattgaacacaa

SEQ ID NO: 4409064 - DNA, 15 bp, Homo sapiens
tgcattgaacacaaa

SEQ ID NO: 4409065 - DNA, 18 bp, Homo sapiens
tgcattgaacacaaactg

SEQ ID NO: 4409066 - DNA, 11 bp, Homo sapiens
tgcattgctgg

SEQ ID NO: 4409067 - DNA, 16 bp, Homo sapiens
tgcattgctggtagag

SEQ ID NO: 4409068 - DNA, 18 bp, Homo sapiens
tgcattggggttcctctg

SEQ ID NO: 4409069 - DNA, 21 bp, Homo sapiens
tgcattggtggcatcacagac

SEQ ID NO: 4409070 - DNA, 12 bp, Homo sapiens
tgcattgtctgt

SEQ ID NO: 4409071 - DNA, 14 bp, Homo sapiens
tgcattgttgtaaa

SEQ ID NO: 4409072 - DNA, 22 bp, Homo sapiens
tgcatttaaaacagacactggc

SEQ ID NO: 4409073 - DNA, 13 bp, Homo sapiens
tgcatttatatgt

SEQ ID NO: 4409074 - DNA, 16 bp, Homo sapiens
tgcatttatatgtacc

SEQ ID NO: 4409075 - DNA, 12 bp, Homo sapiens
tgcatttcaaat

SEQ ID NO: 4409076 - DNA, 18 bp, Homo sapiens
tgcatttgtgctagaaat

SEQ ID NO: 4409077 - DNA, 15 bp, Homo sapiens
tgcatttgtggtaat

SEQ ID NO: 4409078 - DNA, 23 bp, Homo sapiens
tgcatttgtggtaatctacacca

SEQ ID NO: 4409079 - DNA, 16 bp, Homo sapiens
tgcatttttaaacttg

SEQ ID NO: 4409080 - DNA, 17 bp, Homo sapiens
tgcatttttaaacttga

SEQ ID NO: 4409081 - DNA, 19 bp, Homo sapiens
tgcatttttaaacttgaaa

SEQ ID NO: 4409082 - DNA, 22 bp, Homo sapiens
tgcatttttttagtttgttttt

SEQ ID NO: 4409083 - DNA, 13 bp, Homo sapiens
tgccaaaatgcaa

SEQ ID NO: 4409084 - DNA, 19 bp, Homo sapiens
tgccaaaattcatttctaa

SEQ ID NO: 4409085 - DNA, 16 bp, Homo sapiens
tgccaaagccattctc

SEQ ID NO: 4409086 - DNA, 18 bp, Homo sapiens
tgccaacacttaatcatt

SEQ ID NO: 4409087 - DNA, 20 bp, Homo sapiens
tgccaacagttgtatgtttg

SEQ ID NO: 4409088 - DNA, 15 bp, Homo sapiens
tgccaaccctgggct

SEQ ID NO: 4409089 - DNA, 16 bp, Homo sapiens
tgccaaccctgggcta

SEQ ID NO: 4409090 - DNA, 16 bp, Homo sapiens
tgccaagaaaatgaag

SEQ ID NO: 4409091 - DNA, 22 bp, Homo sapiens
tgccaaggccagagtggcctgg

SEQ ID NO: 4409092 - DNA, 14 bp, Homo sapiens
tgccaaggctctcc

SEQ ID NO: 4409093 - DNA, 15 bp, Homo sapiens
tgccaagtctcagaa

SEQ ID NO: 4409094 - DNA, 18 bp, Homo sapiens
tgccaatattaaatctgc

SEQ ID NO: 4409095 - DNA, 19 bp, Homo sapiens
tgccaatattaaatctgct

SEQ ID NO: 4409096 - DNA, 21 bp, Homo sapiens
tgccaatattaaatctgctgg

SEQ ID NO: 4409097 - DNA, 17 bp, Homo sapiens
tgccaatgagtctgtaa

SEQ ID NO: 4409098 - DNA, 22 bp, Homo sapiens
tgccaatgagtctgtaatttta

SEQ ID NO: 4409099 - DNA, 15 bp, Homo sapiens
tgccaatgtatattg

SEQ ID NO: 4409100 - DNA, 18 bp, Homo sapiens
tgccacacattgtgcttg

SEQ ID NO: 4409101 - DNA, 18 bp, Homo sapiens
tgccacacggaagcaagc

SEQ ID NO: 4409102 - DNA, 17 bp, Homo sapiens
tgccacagacaactcac

SEQ ID NO: 4409103 - DNA, 17 bp, Homo sapiens
tgccacagccagaggag

SEQ ID NO: 4409104 - DNA, 21 bp, Homo sapiens
tgccacagcctcccctgccag

SEQ ID NO: 4409105 - DNA, 22 bp, Homo sapiens
tgccacagcctcccctgccagg

SEQ ID NO: 4409106 - DNA, 22 bp, Homo sapiens
tgccacagtagaactgtctgtg

SEQ ID NO: 4409107 - DNA, 13 bp, Homo sapiens
tgccacatcccta

SEQ ID NO: 4409108 - DNA, 12 bp, Homo sapiens
tgccacattttc

SEQ ID NO: 4409109 - DNA, 19 bp, Homo sapiens
tgccaccaacttacaaaaa

SEQ ID NO: 4409110 - DNA, 23 bp, Homo sapiens
tgccaccagcccccgccccagag

SEQ ID NO: 4409111 - DNA, 14 bp, Homo sapiens
tgccaccccaccct

SEQ ID NO: 4409112 - DNA, 22 bp, Homo sapiens
tgccaccccaccctccctggag

SEQ ID NO: 4409113 - DNA, 17 bp, Homo sapiens
tgccacccgcccacccg

SEQ ID NO: 4409114 - DNA, 21 bp, Homo sapiens
tgccaccggaggtcactccac

SEQ ID NO: 4409115 - DNA, 15 bp, Homo sapiens
tgccaccggcctgtg

SEQ ID NO: 4409116 - DNA, 12 bp, Homo sapiens
tgccacctagac

SEQ ID NO: 4409117 - DNA, 16 bp, Homo sapiens
tgccacctatgcctgt

SEQ ID NO: 4409118 - DNA, 13 bp, Homo sapiens
tgccacctcccct

SEQ ID NO: 4409119 - DNA, 17 bp, Homo sapiens
tgccaccttgtggccgc

SEQ ID NO: 4409120 - DNA, 18 bp, Homo sapiens
tgccacgtgctgctgaca

SEQ ID NO: 4409121 - DNA, 15 bp, Homo sapiens
tgccactctctggga

SEQ ID NO: 4409122 - DNA, 16 bp, Homo sapiens
tgccactctctgggac

SEQ ID NO: 4409123 - DNA, 23 bp, Homo sapiens
tgccactgcgggagctctgtatg

SEQ ID NO: 4409124 - DNA, 17 bp, Homo sapiens
tgccacttaatgtatgt

SEQ ID NO: 4409125 - DNA, 18 bp, Homo sapiens
tgccagaagatcccctca

SEQ ID NO: 4409126 - DNA, 11 bp, Homo sapiens
tgccagagagg

SEQ ID NO: 4409127 - DNA, 13 bp, Homo sapiens
tgccagaggccct

SEQ ID NO: 4409128 - DNA, 17 bp, Homo sapiens
tgccagattctgcctct

SEQ ID NO: 4409129 - DNA, 12 bp, Homo sapiens
tgccagcagagc

SEQ ID NO: 4409130 - DNA, 15 bp, Homo sapiens
tgccagcagagccag

SEQ ID NO: 4409131 - DNA, 21 bp, Homo sapiens
tgccagcagagccagggcagg

SEQ ID NO: 4409132 - DNA, 22 bp, Homo sapiens
tgccagcagagccagggcaggg

SEQ ID NO: 4409133 - DNA, 17 bp, Homo sapiens
tgccagccactgtgata

SEQ ID NO: 4409134 - DNA, 17 bp, Homo sapiens
tgccagccttgagccct

SEQ ID NO: 4409135 - DNA, 19 bp, Homo sapiens
tgccagccttgagccctgg

SEQ ID NO: 4409136 - DNA, 23 bp, Homo sapiens
tgccagccttgagccctggctgt

SEQ ID NO: 4409137 - DNA, 23 bp, Homo sapiens
tgccagctctgtatcaggaccca

SEQ ID NO: 4409138 - DNA, 11 bp, Homo sapiens
tgccagctgcc

SEQ ID NO: 4409139 - DNA, 18 bp, Homo sapiens
tgccagctggatcgctgc

SEQ ID NO: 4409140 - DNA, 16 bp, Homo sapiens
tgccagctgtctccca

SEQ ID NO: 4409141 - DNA, 21 bp, Homo sapiens
tgccaggaacctgtcctaagg

SEQ ID NO: 4409142 - DNA, 17 bp, Homo sapiens
tgccaggcaggggtggg

SEQ ID NO: 4409143 - DNA, 18 bp, Homo sapiens
tgccaggcaggggtgggg

SEQ ID NO: 4409144 - DNA, 15 bp, Homo sapiens
tgccaggccagcctc

SEQ ID NO: 4409145 - DNA, 14 bp, Homo sapiens
tgccaggctgcctc

SEQ ID NO: 4409146 - DNA, 17 bp, Homo sapiens
tgccaggctgcctcctg

SEQ ID NO: 4409147 - DNA, 19 bp, Homo sapiens
tgccaggctgcctcctgcc

SEQ ID NO: 4409148 - DNA, 17 bp, Homo sapiens
tgccagggcaatgatga

SEQ ID NO: 4409149 - DNA, 22 bp, Homo sapiens
tgccagggcaatgatgaatgag

SEQ ID NO: 4409150 - DNA, 22 bp, Homo sapiens
tgccagtgaagtccttcagtga

SEQ ID NO: 4409151 - DNA, 14 bp, Homo sapiens
tgccagtgcactcc

SEQ ID NO: 4409152 - DNA, 17 bp, Homo sapiens
tgccagtgcactccggc

SEQ ID NO: 4409153 - DNA, 20 bp, Homo sapiens
tgccagtgcactccggcctg

SEQ ID NO: 4409154 - DNA, 11 bp, Homo sapiens
tgccagtgcct

SEQ ID NO: 4409155 - DNA, 12 bp, Homo sapiens
tgccagtgcctg

SEQ ID NO: 4409156 - DNA, 20 bp, Homo sapiens
tgccagtgccttacctcctg

SEQ ID NO: 4409157 - DNA, 23 bp, Homo sapiens
tgccagtgccttacctcctgccc

SEQ ID NO: 4409158 - DNA, 14 bp, Homo sapiens
tgccagtgccttat

SEQ ID NO: 4409159 - DNA, 13 bp, Homo sapiens
tgccagtgtcttt

SEQ ID NO: 4409160 - DNA, 16 bp, Homo sapiens
tgccagttttccctgg

SEQ ID NO: 4409161 - DNA, 17 bp, Homo sapiens
tgccatagtcaaagaga

SEQ ID NO: 4409162 - DNA, 18 bp, Homo sapiens
tgccatagtcaaagagag

SEQ ID NO: 4409163 - DNA, 13 bp, Homo sapiens
tgccatattttca

SEQ ID NO: 4409164 - DNA, 15 bp, Homo sapiens
tgccatcaaatgaat

SEQ ID NO: 4409165 - DNA, 23 bp, Homo sapiens
tgccatcaccacggctcactgca

SEQ ID NO: 4409166 - DNA, 19 bp, Homo sapiens
tgccatcatgcccagctaa

SEQ ID NO: 4409167 - DNA, 16 bp, Homo sapiens
tgccatcatgcctgac

SEQ ID NO: 4409168 - DNA, 15 bp, Homo sapiens
tgccatcctggccca

SEQ ID NO: 4409169 - DNA, 18 bp, Homo sapiens
tgccatgagccgcccaag

SEQ ID NO: 4409170 - DNA, 19 bp, Homo sapiens
tgccatgagccgcccaagg

SEQ ID NO: 4409171 - DNA, 18 bp, Homo sapiens
tgccatggaactgtttcc

SEQ ID NO: 4409172 - DNA, 22 bp, Homo sapiens
tgccatggaagaggctacaggg

SEQ ID NO: 4409173 - DNA, 17 bp, Homo sapiens
tgccattacccagtgcc

SEQ ID NO: 4409174 - DNA, 15 bp, Homo sapiens
tgccattctgtgcag

SEQ ID NO: 4409175 - DNA, 21 bp, Homo sapiens
tgccattcttctggtgctact

SEQ ID NO: 4409176 - DNA, 13 bp, Homo sapiens
tgccattgtcttt

SEQ ID NO: 4409177 - DNA, 18 bp, Homo sapiens
tgccattgtctttatatg

SEQ ID NO: 4409178 - DNA, 15 bp, Homo sapiens
tgcccaaaatgtgaa

SEQ ID NO: 4409179 - DNA, 19 bp, Homo sapiens
tgcccaaggttgcacagca

SEQ ID NO: 4409180 - DNA, 20 bp, Homo sapiens
tgcccaaggttgcacagcaa

SEQ ID NO: 4409181 - DNA, 15 bp, Homo sapiens
tgcccaatgaataat

SEQ ID NO: 4409182 - DNA, 21 bp, Homo sapiens
tgcccaatgagactctagggt

SEQ ID NO: 4409183 - DNA, 15 bp, Homo sapiens
tgcccaattggagga

SEQ ID NO: 4409184 - DNA, 21 bp, Homo sapiens
tgcccaattggaggaaagcaa

SEQ ID NO: 4409185 - DNA, 23 bp, Homo sapiens
tgcccaccaacatcccattgccc

SEQ ID NO: 4409186 - DNA, 13 bp, Homo sapiens
tgcccaccccctg

SEQ ID NO: 4409187 - DNA, 19 bp, Homo sapiens
tgcccacctgcccatcaca

SEQ ID NO: 4409188 - DNA, 16 bp, Homo sapiens
tgcccactctgcaaga

SEQ ID NO: 4409189 - DNA, 15 bp, Homo sapiens
tgcccactggccgct

SEQ ID NO: 4409190 - DNA, 17 bp, Homo sapiens
tgcccactggccgctga

SEQ ID NO: 4409191 - DNA, 17 bp, Homo sapiens
tgcccagagatgcctcc

SEQ ID NO: 4409192 - DNA, 19 bp, Homo sapiens
tgcccagagatgcctccac

SEQ ID NO: 4409193 - DNA, 20 bp, Homo sapiens
tgcccagagatgcctccacc

SEQ ID NO: 4409194 - DNA, 21 bp, Homo sapiens
tgcccagagatgcctccaccg

SEQ ID NO: 4409195 - DNA, 14 bp, Homo sapiens
tgcccagagctgag

SEQ ID NO: 4409196 - DNA, 20 bp, Homo sapiens
tgcccagcagcccctgagag

SEQ ID NO: 4409197 - DNA, 14 bp, Homo sapiens
tgcccagccctggc

SEQ ID NO: 4409198 - DNA, 16 bp, Homo sapiens
tgcccagccgggcaca

SEQ ID NO: 4409199 - DNA, 15 bp, Homo sapiens
tgcccagcctgctct

SEQ ID NO: 4409200 - DNA, 18 bp, Homo sapiens
tgcccagcctgctctccc

SEQ ID NO: 4409201 - DNA, 20 bp, Homo sapiens
tgcccagcctggatgccatc

SEQ ID NO: 4409202 - DNA, 15 bp, Homo sapiens
tgcccagctaatttt

SEQ ID NO: 4409203 - DNA, 23 bp, Homo sapiens
tgcccagctaatttttgtatttt

SEQ ID NO: 4409204 - DNA, 22 bp, Homo sapiens
tgcccaggaaaggacggctgag

SEQ ID NO: 4409205 - DNA, 18 bp, Homo sapiens
tgcccaggagagccagcc

SEQ ID NO: 4409206 - DNA, 13 bp, Homo sapiens
tgcccaggccaca

SEQ ID NO: 4409207 - DNA, 19 bp, Homo sapiens
tgcccaggccacagagaac

SEQ ID NO: 4409208 - DNA, 19 bp, Homo sapiens
tgcccaggcctatctggaa

SEQ ID NO: 4409209 - DNA, 13 bp, Homo sapiens
tgcccaggcctct

SEQ ID NO: 4409210 - DNA, 20 bp, Homo sapiens
tgcccaggttggagtgcagt

SEQ ID NO: 4409211 - DNA, 15 bp, Homo sapiens
tgcccagtgagccct

SEQ ID NO: 4409212 - DNA, 20 bp, Homo sapiens
tgcccagtgagccctgctct

SEQ ID NO: 4409213 - DNA, 13 bp, Homo sapiens
tgcccagttcact

SEQ ID NO: 4409214 - DNA, 15 bp, Homo sapiens
tgcccatcctgactg

SEQ ID NO: 4409215 - DNA, 14 bp, Homo sapiens
tgcccatcctgcca

SEQ ID NO: 4409216 - DNA, 15 bp, Homo sapiens
tgcccatgtttcaaa

SEQ ID NO: 4409217 - DNA, 19 bp, Homo sapiens
tgcccattcctgcctggtc

SEQ ID NO: 4409218 - DNA, 21 bp, Homo sapiens
tgcccatttcgaagatataca

SEQ ID NO: 4409219 - DNA, 16 bp, Homo sapiens
tgccccaactcctgga

SEQ ID NO: 4409220 - DNA, 13 bp, Homo sapiens
tgccccacatgca

SEQ ID NO: 4409221 - DNA, 19 bp, Homo sapiens
tgccccaccccatccagcc

SEQ ID NO: 4409222 - DNA, 19 bp, Homo sapiens
tgccccacgttgtccctga

SEQ ID NO: 4409223 - DNA, 23 bp, Homo sapiens
tgccccagagctgtttatggcct

SEQ ID NO: 4409224 - DNA, 12 bp, Homo sapiens
tgccccaggggg

SEQ ID NO: 4409225 - DNA, 16 bp, Homo sapiens
tgccccatcagtgctc

SEQ ID NO: 4409226 - DNA, 20 bp, Homo sapiens
tgccccatcagtgctccctc

SEQ ID NO: 4409227 - DNA, 15 bp, Homo sapiens
tgccccattccttgc

SEQ ID NO: 4409228 - DNA, 22 bp, Homo sapiens
tgcccccaccccggggaccctg

SEQ ID NO: 4409229 - DNA, 17 bp, Homo sapiens
tgcccccaccccttcct

SEQ ID NO: 4409230 - DNA, 18 bp, Homo sapiens
tgcccccaccccttcctg

SEQ ID NO: 4409231 - DNA, 13 bp, Homo sapiens
tgcccccagaaag

SEQ ID NO: 4409232 - DNA, 20 bp, Homo sapiens
tgcccccagagcgtccttgg

SEQ ID NO: 4409233 - DNA, 20 bp, Homo sapiens
tgcccccagccccggggtga

SEQ ID NO: 4409234 - DNA, 16 bp, Homo sapiens
tgcccccaggactggg

SEQ ID NO: 4409235 - DNA, 17 bp, Homo sapiens
tgcccccaggactgggc

SEQ ID NO: 4409236 - DNA, 15 bp, Homo sapiens
tgcccccctcctcca

SEQ ID NO: 4409237 - DNA, 13 bp, Homo sapiens
tgcccccgcctgc

SEQ ID NO: 4409238 - DNA, 16 bp, Homo sapiens
tgcccccgcctgccac

SEQ ID NO: 4409239 - DNA, 18 bp, Homo sapiens
tgcccccgcgggttctag

SEQ ID NO: 4409240 - DNA, 21 bp, Homo sapiens
tgcccccgctcccgctcccag

SEQ ID NO: 4409241 - DNA, 14 bp, Homo sapiens
tgcccccggccccc

SEQ ID NO: 4409242 - DNA, 15 bp, Homo sapiens
tgcccccggccccct

SEQ ID NO: 4409243 - DNA, 15 bp, Homo sapiens
tgccccctctcactt

SEQ ID NO: 4409244 - DNA, 11 bp, Homo sapiens
tgccccctgcc

SEQ ID NO: 4409245 - DNA, 13 bp, Homo sapiens
tgccccctgccag

SEQ ID NO: 4409246 - DNA, 16 bp, Homo sapiens
tgccccctgctggctc

SEQ ID NO: 4409247 - DNA, 13 bp, Homo sapiens
tgccccctgtgga

SEQ ID NO: 4409248 - DNA, 19 bp, Homo sapiens
tgccccctgtggatgctgc

SEQ ID NO: 4409249 - DNA, 16 bp, Homo sapiens
tgccccgactgtggga

SEQ ID NO: 4409250 - DNA, 17 bp, Homo sapiens
tgccccggcccctcccc

SEQ ID NO: 4409251 - DNA, 19 bp, Homo sapiens
tgccccgggatattataga

SEQ ID NO: 4409252 - DNA, 20 bp, Homo sapiens
tgccccgtgtgtgtggccgg

SEQ ID NO: 4409253 - DNA, 17 bp, Homo sapiens
tgcccctaccctggact

SEQ ID NO: 4409254 - DNA, 16 bp, Homo sapiens
tgcccctcccccactt

SEQ ID NO: 4409255 - DNA, 12 bp, Homo sapiens
tgcccctctcac

SEQ ID NO: 4409256 - DNA, 14 bp, Homo sapiens
tgcccctctcacca

SEQ ID NO: 4409257 - DNA, 15 bp, Homo sapiens
tgcccctctcaccaa

SEQ ID NO: 4409258 - DNA, 13 bp, Homo sapiens
tgcccctctgcct

SEQ ID NO: 4409259 - DNA, 16 bp, Homo sapiens
tgcccctctgccttgc

SEQ ID NO: 4409260 - DNA, 13 bp, Homo sapiens
tgcccctgcagct

SEQ ID NO: 4409261 - DNA, 18 bp, Homo sapiens
tgcccctgctgtgctgct

SEQ ID NO: 4409262 - DNA, 19 bp, Homo sapiens
tgcccctggctttgcctct

SEQ ID NO: 4409263 - DNA, 14 bp, Homo sapiens
tgccccttctacac

SEQ ID NO: 4409264 - DNA, 18 bp, Homo sapiens
tgcccgactgactggagg

SEQ ID NO: 4409265 - DNA, 21 bp, Homo sapiens
tgcccgcatgtgtgcctggcc

SEQ ID NO: 4409266 - DNA, 19 bp, Homo sapiens
tgcccgctcccacagcttc

SEQ ID NO: 4409267 - DNA, 16 bp, Homo sapiens
tgcccggcgccgggca

SEQ ID NO: 4409268 - DNA, 20 bp, Homo sapiens
tgcccggctaatttttgtaa

SEQ ID NO: 4409269 - DNA, 21 bp, Homo sapiens
tgcccgggaaggtcaccagca

SEQ ID NO: 4409270 - DNA, 22 bp, Homo sapiens
tgcccgggcgcggccagccccg

SEQ ID NO: 4409271 - DNA, 17 bp, Homo sapiens
tgcccgtctctctccca

SEQ ID NO: 4409272 - DNA, 19 bp, Homo sapiens
tgcccgtctctctcccatg

SEQ ID NO: 4409273 - DNA, 21 bp, Homo sapiens
tgcccgtctctctcccatgga

SEQ ID NO: 4409274 - DNA, 23 bp, Homo sapiens
tgcccgtctctctcccatggagc

SEQ ID NO: 4409275 - DNA, 15 bp, Homo sapiens
tgcccgtgcccgcag

SEQ ID NO: 4409276 - DNA, 13 bp, Homo sapiens
tgccctaagggac

SEQ ID NO: 4409277 - DNA, 19 bp, Homo sapiens
tgccctatatacctcacta

SEQ ID NO: 4409278 - DNA, 12 bp, Homo sapiens
tgccctcccaag

SEQ ID NO: 4409279 - DNA, 20 bp, Homo sapiens
tgccctcctgggccctgggc

SEQ ID NO: 4409280 - DNA, 19 bp, Homo sapiens
tgccctccttgtccaccca

SEQ ID NO: 4409281 - DNA, 22 bp, Homo sapiens
tgccctccttgtccacccacct

SEQ ID NO: 4409282 - DNA, 22 bp, Homo sapiens
tgccctctccctgtgttctggg

SEQ ID NO: 4409283 - DNA, 23 bp, Homo sapiens
tgccctctccctgtgttctgggc

SEQ ID NO: 4409284 - DNA, 18 bp, Homo sapiens
tgccctgaccatgcattt

SEQ ID NO: 4409285 - DNA, 18 bp, Homo sapiens
tgccctgagcactcctgg

SEQ ID NO: 4409286 - DNA, 19 bp, Homo sapiens
tgccctgagcactcctggt

SEQ ID NO: 4409287 - DNA, 17 bp, Homo sapiens
tgccctgcctcagccag

SEQ ID NO: 4409288 - DNA, 18 bp, Homo sapiens
tgccctgcctcagccagg

SEQ ID NO: 4409289 - DNA, 12 bp, Homo sapiens
tgccctggctcc

SEQ ID NO: 4409290 - DNA, 12 bp, Homo sapiens
tgccctggctgc

SEQ ID NO: 4409291 - DNA, 16 bp, Homo sapiens
tgccctggctgctgcc

SEQ ID NO: 4409292 - DNA, 18 bp, Homo sapiens
tgccctggctgctgcccc

SEQ ID NO: 4409293 - DNA, 16 bp, Homo sapiens
tgccctgtggacagga

SEQ ID NO: 4409294 - DNA, 14 bp, Homo sapiens
tgccctgtgtggct

SEQ ID NO: 4409295 - DNA, 20 bp, Homo sapiens
tgcccttcaccccagtggcc

SEQ ID NO: 4409296 - DNA, 19 bp, Homo sapiens
tgcccttccctctgggcac

SEQ ID NO: 4409297 - DNA, 12 bp, Homo sapiens
tgcccttctgat

SEQ ID NO: 4409298 - DNA, 22 bp, Homo sapiens
tgcccttctgattcccctccac

SEQ ID NO: 4409299 - DNA, 12 bp, Homo sapiens
tgcccttgcagg

SEQ ID NO: 4409300 - DNA, 13 bp, Homo sapiens
tgcccttgcaggg

SEQ ID NO: 4409301 - DNA, 16 bp, Homo sapiens
tgcccttgcagggtgg

SEQ ID NO: 4409302 - DNA, 14 bp, Homo sapiens
tgcccttgctgccc

SEQ ID NO: 4409303 - DNA, 14 bp, Homo sapiens
tgccctttggggtc

SEQ ID NO: 4409304 - DNA, 15 bp, Homo sapiens
tgccgacactgagct

SEQ ID NO: 4409305 - DNA, 18 bp, Homo sapiens
tgccgatttctgtaaact

SEQ ID NO: 4409306 - DNA, 16 bp, Homo sapiens
tgccgattttgtaaat

SEQ ID NO: 4409307 - DNA, 20 bp, Homo sapiens
tgccgattttgtaaatgttc

SEQ ID NO: 4409308 - DNA, 14 bp, Homo sapiens
tgccgcagagctgg

SEQ ID NO: 4409309 - DNA, 20 bp, Homo sapiens
tgccgccctgtgggagccgc

SEQ ID NO: 4409310 - DNA, 21 bp, Homo sapiens
tgccgccctgtgggagccgca

SEQ ID NO: 4409311 - DNA, 16 bp, Homo sapiens
tgccgcctcaatgtgg

SEQ ID NO: 4409312 - DNA, 17 bp, Homo sapiens
tgccgctgcaccacggc

SEQ ID NO: 4409313 - DNA, 14 bp, Homo sapiens
tgccgctgccaccc

SEQ ID NO: 4409314 - DNA, 16 bp, Homo sapiens
tgccgctgccatgctt

SEQ ID NO: 4409315 - DNA, 22 bp, Homo sapiens
tgccggcggcagccccacttca

SEQ ID NO: 4409316 - DNA, 19 bp, Homo sapiens
tgccggtcgggcagccagc

SEQ ID NO: 4409317 - DNA, 16 bp, Homo sapiens
tgccggtgggaccctg

SEQ ID NO: 4409318 - DNA, 14 bp, Homo sapiens
tgccgtaatttaac

SEQ ID NO: 4409319 - DNA, 18 bp, Homo sapiens
tgccgtgagcatgcacac

SEQ ID NO: 4409320 - DNA, 22 bp, Homo sapiens
tgccgttactctccaacctgga

SEQ ID NO: 4409321 - DNA, 20 bp, Homo sapiens
tgcctaaaacaatctaaaac

SEQ ID NO: 4409322 - DNA, 18 bp, Homo sapiens
tgcctaaatccactctgc

SEQ ID NO: 4409323 - DNA, 22 bp, Homo sapiens
tgcctaagcattgcctggcctt

SEQ ID NO: 4409324 - DNA, 17 bp, Homo sapiens
tgcctaagtggctgctg

SEQ ID NO: 4409325 - DNA, 23 bp, Homo sapiens
tgcctaattggaaagtgccagca

SEQ ID NO: 4409326 - DNA, 13 bp, Homo sapiens
tgcctacagccag

SEQ ID NO: 4409327 - DNA, 15 bp, Homo sapiens
tgcctacagccaggt

SEQ ID NO: 4409328 - DNA, 15 bp, Homo sapiens
tgcctagactgttac

SEQ ID NO: 4409329 - DNA, 16 bp, Homo sapiens
tgcctagactgttact

SEQ ID NO: 4409330 - DNA, 20 bp, Homo sapiens
tgcctataaaatgcccattt

SEQ ID NO: 4409331 - DNA, 21 bp, Homo sapiens
tgcctatatgagaagaatagc

SEQ ID NO: 4409332 - DNA, 21 bp, Homo sapiens
tgcctatgcactgaagagctc

SEQ ID NO: 4409333 - DNA, 16 bp, Homo sapiens
tgcctatgtctcctct

SEQ ID NO: 4409334 - DNA, 19 bp, Homo sapiens
tgcctatgtctcctctatg

SEQ ID NO: 4409335 - DNA, 15 bp, Homo sapiens
tgcctcactaatttt

SEQ ID NO: 4409336 - DNA, 22 bp, Homo sapiens
tgcctcactaatttttgtatta

SEQ ID NO: 4409337 - DNA, 14 bp, Homo sapiens
tgcctcagccttcc

SEQ ID NO: 4409338 - DNA, 22 bp, Homo sapiens
tgcctcaggaggtcacctgccg

SEQ ID NO: 4409339 - DNA, 20 bp, Homo sapiens
tgcctcatctataacatgca

SEQ ID NO: 4409340 - DNA, 13 bp, Homo sapiens
tgcctccaccctc

SEQ ID NO: 4409341 - DNA, 17 bp, Homo sapiens
tgcctccaccctctgag

SEQ ID NO: 4409342 - DNA, 13 bp, Homo sapiens
tgcctccaccgct

SEQ ID NO: 4409343 - DNA, 15 bp, Homo sapiens
tgcctccagggctgg

SEQ ID NO: 4409344 - DNA, 17 bp, Homo sapiens
tgcctccagggctggac

SEQ ID NO: 4409345 - DNA, 19 bp, Homo sapiens
tgcctccagggctggactg

SEQ ID NO: 4409346 - DNA, 21 bp, Homo sapiens
tgcctccagggctggactgag

SEQ ID NO: 4409347 - DNA, 22 bp, Homo sapiens
tgcctcccaaggtcctctcagt

SEQ ID NO: 4409348 - DNA, 20 bp, Homo sapiens
tgcctccccatttcccatct

SEQ ID NO: 4409349 - DNA, 23 bp, Homo sapiens
tgcctccccatttcccatctgca

SEQ ID NO: 4409350 - DNA, 21 bp, Homo sapiens
tgcctccccccagaccccgcc

SEQ ID NO: 4409351 - DNA, 14 bp, Homo sapiens
tgcctccctctcca

SEQ ID NO: 4409352 - DNA, 19 bp, Homo sapiens
tgcctcctcaaacccagtc

SEQ ID NO: 4409353 - DNA, 21 bp, Homo sapiens
tgcctcctcaaacccagtctc

SEQ ID NO: 4409354 - DNA, 17 bp, Homo sapiens
tgcctcctgaggctgtt

SEQ ID NO: 4409355 - DNA, 14 bp, Homo sapiens
tgcctcctgccctt

SEQ ID NO: 4409356 - DNA, 12 bp, Homo sapiens
tgcctcctgcct

SEQ ID NO: 4409357 - DNA, 17 bp, Homo sapiens
tgcctcctgtgtactgt

SEQ ID NO: 4409358 - DNA, 18 bp, Homo sapiens
tgcctcctgtgtactgtg

SEQ ID NO: 4409359 - DNA, 17 bp, Homo sapiens
tgcctcgctcaccgctg

SEQ ID NO: 4409360 - DNA, 20 bp, Homo sapiens
tgcctctccctgctgctcct

SEQ ID NO: 4409361 - DNA, 16 bp, Homo sapiens
tgcctctctggaaaga

SEQ ID NO: 4409362 - DNA, 23 bp, Homo sapiens
tgcctctctggaaagaggctctg

SEQ ID NO: 4409363 - DNA, 11 bp, Homo sapiens
tgcctctgacc

SEQ ID NO: 4409364 - DNA, 13 bp, Homo sapiens
tgcctctgcagtc

SEQ ID NO: 4409365 - DNA, 13 bp, Homo sapiens
tgcctctgccctg

SEQ ID NO: 4409366 - DNA, 11 bp, Homo sapiens
tgcctctgctc

SEQ ID NO: 4409367 - DNA, 16 bp, Homo sapiens
tgcctctgtccccttc

SEQ ID NO: 4409368 - DNA, 17 bp, Homo sapiens
tgcctctgtccccttct

SEQ ID NO: 4409369 - DNA, 21 bp, Homo sapiens
tgcctctgtccccttctctca

SEQ ID NO: 4409370 - DNA, 19 bp, Homo sapiens
tgcctcttaaattatatat

SEQ ID NO: 4409371 - DNA, 21 bp, Homo sapiens
tgcctcttctcttgacagtct

SEQ ID NO: 4409372 - DNA, 20 bp, Homo sapiens
tgcctcttctgggagggcag

SEQ ID NO: 4409373 - DNA, 21 bp, Homo sapiens
tgcctcttctgggagggcagc

SEQ ID NO: 4409374 - DNA, 11 bp, Homo sapiens
tgcctcttctt

SEQ ID NO: 4409375 - DNA, 14 bp, Homo sapiens
tgcctcttctttgt

SEQ ID NO: 4409376 - DNA, 19 bp, Homo sapiens
tgcctcttctttgtgcctt

SEQ ID NO: 4409377 - DNA, 14 bp, Homo sapiens
tgcctgaactccag

SEQ ID NO: 4409378 - DNA, 22 bp, Homo sapiens
tgcctgagaagaagtggctgcc

SEQ ID NO: 4409379 - DNA, 20 bp, Homo sapiens
tccccagttccacagcagtg

SEQ ID NO: 4409380 - DNA, 17 bp, Homo sapiens
tccccatatataaatta

SEQ ID NO: 4409381 - DNA, 16 bp, Homo sapiens
tccccatctgtccagc

SEQ ID NO: 4409382 - DNA, 19 bp, Homo sapiens
tccccatttcccatctgca

SEQ ID NO: 4409383 - DNA, 17 bp, Homo sapiens
tccccatttctgcctcg

SEQ ID NO: 4409384 - DNA, 15 bp, Homo sapiens
tcccccaacccccac

SEQ ID NO: 4409385 - DNA, 17 bp, Homo sapiens
tcccccaacccccaccc

SEQ ID NO: 4409386 - DNA, 19 bp, Homo sapiens
tcccccaccccctccccag

SEQ ID NO: 4409387 - DNA, 20 bp, Homo sapiens
tcccccaccccctccccagg

SEQ ID NO: 4409388 - DNA, 21 bp, Homo sapiens
tcccccaccccctccccaggg

SEQ ID NO: 4409389 - DNA, 19 bp, Homo sapiens
tcccccactttcaagacag

SEQ ID NO: 4409390 - DNA, 20 bp, Homo sapiens
tcccccagagcatctgcccc

SEQ ID NO: 4409391 - DNA, 14 bp, Homo sapiens
tcccccatgggctg

SEQ ID NO: 4409392 - DNA, 21 bp, Homo sapiens
tccccccactctccccacact

SEQ ID NO: 4409393 - DNA, 18 bp, Homo sapiens
tccccccactgcaggccc

SEQ ID NO: 4409394 - DNA, 23 bp, Homo sapiens
tccccccactgcaggccccgctt

SEQ ID NO: 4409395 - DNA, 12 bp, Homo sapiens
tccccccagacc

SEQ ID NO: 4409396 - DNA, 15 bp, Homo sapiens
tcccccctcctctga

SEQ ID NO: 4409397 - DNA, 17 bp, Homo sapiens
tcccccctcctctgaaa

SEQ ID NO: 4409398 - DNA, 19 bp, Homo sapiens
tcccccctcctctgaaaca

SEQ ID NO: 4409399 - DNA, 22 bp, Homo sapiens
tcccccctcctctgaaacagct

SEQ ID NO: 4409400 - DNA, 15 bp, Homo sapiens
tcccccgtggtgcct

SEQ ID NO: 4409401 - DNA, 21 bp, Homo sapiens
tcccccgtggtgcctgcacac

SEQ ID NO: 4409402 - DNA, 19 bp, Homo sapiens
tcccccgtttctccttttc

SEQ ID NO: 4409403 - DNA, 22 bp, Homo sapiens
tccccctcagatgatctctcca

SEQ ID NO: 4409404 - DNA, 13 bp, Homo sapiens
tccccctccccag

SEQ ID NO: 4409405 - DNA, 15 bp, Homo sapiens
tccccctccttgtgc

SEQ ID NO: 4409406 - DNA, 18 bp, Homo sapiens
tccccctccttgtgcctt

SEQ ID NO: 4409407 - DNA, 16 bp, Homo sapiens
tccccctggttgggtg

SEQ ID NO: 4409408 - DNA, 12 bp, Homo sapiens
tcccccttgcca

SEQ ID NO: 4409409 - DNA, 13 bp, Homo sapiens
tcccccttgccac

SEQ ID NO: 4409410 - DNA, 14 bp, Homo sapiens
tcccccttgccacc

SEQ ID NO: 4409411 - DNA, 19 bp, Homo sapiens
tccccctttcacactggat

SEQ ID NO: 4409412 - DNA, 19 bp, Homo sapiens
tccccgcagcccgcctgcc

SEQ ID NO: 4409413 - DNA, 13 bp, Homo sapiens
tccccgccctttt

SEQ ID NO: 4409414 - DNA, 15 bp, Homo sapiens
tccccgccctttttt

SEQ ID NO: 4409415 - DNA, 16 bp, Homo sapiens
tccccgcctccactct

SEQ ID NO: 4409416 - DNA, 14 bp, Homo sapiens
tcccctagatccag

SEQ ID NO: 4409417 - DNA, 20 bp, Homo sapiens
tcccctagtaagtgccttcc

SEQ ID NO: 4409418 - DNA, 22 bp, Homo sapiens
tcccctccaacctggggggcag

SEQ ID NO: 4409419 - DNA, 13 bp, Homo sapiens
tcccctccctggc

SEQ ID NO: 4409420 - DNA, 12 bp, Homo sapiens
tcccctcctcca

SEQ ID NO: 4409421 - DNA, 23 bp, Homo sapiens
tcccctctcgccccatccctgct

SEQ ID NO: 4409422 - DNA, 23 bp, Homo sapiens
tcccctcttcctaccctgcctcc

SEQ ID NO: 4409423 - DNA, 23 bp, Homo sapiens
tcccctgcagacggatgcccatt

SEQ ID NO: 4409424 - DNA, 12 bp, Homo sapiens
tcccctgccagg

SEQ ID NO: 4409425 - DNA, 15 bp, Homo sapiens
tcccctgcccccagg

SEQ ID NO: 4409426 - DNA, 16 bp, Homo sapiens
tcccctgcccccagga

SEQ ID NO: 4409427 - DNA, 19 bp, Homo sapiens
tcccctgcccccaggactg

SEQ ID NO: 4409428 - DNA, 20 bp, Homo sapiens
tcccctgcccccaggactgg

SEQ ID NO: 4409429 - DNA, 14 bp, Homo sapiens
tcccctgctgacct

SEQ ID NO: 4409430 - DNA, 20 bp, Homo sapiens
tcccctggctggctcctagg

SEQ ID NO: 4409431 - DNA, 22 bp, Homo sapiens
tcccctgggcatcttctggctt

SEQ ID NO: 4409432 - DNA, 14 bp, Homo sapiens
tcccctggggacgc

SEQ ID NO: 4409433 - DNA, 13 bp, Homo sapiens
tccccttcctggc

SEQ ID NO: 4409434 - DNA, 16 bp, Homo sapiens
tccccttcctggcaca

SEQ ID NO: 4409435 - DNA, 13 bp, Homo sapiens
tccccttctctca

SEQ ID NO: 4409436 - DNA, 13 bp, Homo sapiens
tcccgaaaaatgt

SEQ ID NO: 4409437 - DNA, 17 bp, Homo sapiens
tcccgcactctgccccc

SEQ ID NO: 4409438 - DNA, 14 bp, Homo sapiens
tcccgccccgcccc

SEQ ID NO: 4409439 - DNA, 22 bp, Homo sapiens
tcccgcccttccatgtgccttt

SEQ ID NO: 4409440 - DNA, 15 bp, Homo sapiens
tcccgcctccctagt

SEQ ID NO: 4409441 - DNA, 13 bp, Homo sapiens
tcccgctcccagg

SEQ ID NO: 4409442 - DNA, 14 bp, Homo sapiens
tcccgctgctgtgc

SEQ ID NO: 4409443 - DNA, 21 bp, Homo sapiens
tcccggcccccggccaaggac

SEQ ID NO: 4409444 - DNA, 17 bp, Homo sapiens
tcccggcccgcctgccc

SEQ ID NO: 4409445 - DNA, 15 bp, Homo sapiens
tcccggctctgtggg

SEQ ID NO: 4409446 - DNA, 23 bp, Homo sapiens
tcccgggagctgggccctgcctg

SEQ ID NO: 4409447 - DNA, 18 bp, Homo sapiens
tcccggggcctggacagg

SEQ ID NO: 4409448 - DNA, 20 bp, Homo sapiens
tcccggggcctggacaggcg

SEQ ID NO: 4409449 - DNA, 21 bp, Homo sapiens
tcccggttcagacccctgcct

SEQ ID NO: 4409450 - DNA, 18 bp, Homo sapiens
tcccgtctggacctgggg

SEQ ID NO: 4409451 - DNA, 22 bp, Homo sapiens
tcccgtgcatcccccctgctca

SEQ ID NO: 4409452 - DNA, 16 bp, Homo sapiens
tcccgtgcctgggaga

SEQ ID NO: 4409453 - DNA, 16 bp, Homo sapiens
tcccgtggaacgtttt

SEQ ID NO: 4409454 - DNA, 22 bp, Homo sapiens
tcccgtggaacgtttttcctgt

SEQ ID NO: 4409455 - DNA, 19 bp, Homo sapiens
tcccgttccccgctccaca

SEQ ID NO: 4409456 - DNA, 23 bp, Homo sapiens
tccctaaaatggcgaacatgtgt

SEQ ID NO: 4409457 - DNA, 16 bp, Homo sapiens
tccctaaactttggcc

SEQ ID NO: 4409458 - DNA, 18 bp, Homo sapiens
tccctaaactttggcctt

SEQ ID NO: 4409459 - DNA, 22 bp, Homo sapiens
tccctaagcatgtgtcccagga

SEQ ID NO: 4409460 - DNA, 19 bp, Homo sapiens
tccctaatttatgtgctat

SEQ ID NO: 4409461 - DNA, 20 bp, Homo sapiens
tccctacctcaacctgtaaa

SEQ ID NO: 4409462 - DNA, 19 bp, Homo sapiens
tccctagctttagaccctg

SEQ ID NO: 4409463 - DNA, 22 bp, Homo sapiens
tccctagctttagaccctgggt

SEQ ID NO: 4409464 - DNA, 20 bp, Homo sapiens
tccctagtagctgggattac

SEQ ID NO: 4409465 - DNA, 21 bp, Homo sapiens
tccctagtagctgggattaca

SEQ ID NO: 4409466 - DNA, 17 bp, Homo sapiens
tccctagtctccacctg

SEQ ID NO: 4409467 - DNA, 16 bp, Homo sapiens
tccctatgtttatttt

SEQ ID NO: 4409468 - DNA, 12 bp, Homo sapiens
tccctcaccccc

SEQ ID NO: 4409469 - DNA, 10 bp, Homo sapiens
tccctcagac

SEQ ID NO: 4409470 - DNA, 15 bp, Homo sapiens
tccctcagacccagg

SEQ ID NO: 4409471 - DNA, 23 bp, Homo sapiens
tccctcagacccaggagtccaga

SEQ ID NO: 4409472 - DNA, 11 bp, Homo sapiens
tccctcagact

SEQ ID NO: 4409473 - DNA, 14 bp, Homo sapiens
tccctcagactcag

SEQ ID NO: 4409474 - DNA, 15 bp, Homo sapiens
tccctcagactcaga

SEQ ID NO: 4409475 - DNA, 22 bp, Homo sapiens
tccctcagactcagaggtccag

SEQ ID NO: 4409476 - DNA, 18 bp, Homo sapiens
tccctcagctctctggga

SEQ ID NO: 4409477 - DNA, 16 bp, Homo sapiens
tccctcaggcccagga

SEQ ID NO: 4409478 - DNA, 11 bp, Homo sapiens
tccctccaccc

SEQ ID NO: 4409479 - DNA, 14 bp, Homo sapiens
tccctccaccccag

SEQ ID NO: 4409480 - DNA, 20 bp, Homo sapiens
tccctccacctcaagacccc

SEQ ID NO: 4409481 - DNA, 13 bp, Homo sapiens
tccctccagctgc

SEQ ID NO: 4409482 - DNA, 19 bp, Homo sapiens
tccctccatttttctccca

SEQ ID NO: 4409483 - DNA, 13 bp, Homo sapiens
tccctccccagaa

SEQ ID NO: 4409484 - DNA, 16 bp, Homo sapiens
tccctccccctccttg

SEQ ID NO: 4409485 - DNA, 13 bp, Homo sapiens
tccctcccctctc

SEQ ID NO: 4409486 - DNA, 14 bp, Homo sapiens
tccctccctgcctg

SEQ ID NO: 4409487 - DNA, 15 bp, Homo sapiens
tccctccgggacctg

SEQ ID NO: 4409488 - DNA, 12 bp, Homo sapiens
tccctcctagct

SEQ ID NO: 4409489 - DNA, 15 bp, Homo sapiens
tccctcctagctctc

SEQ ID NO: 4409490 - DNA, 16 bp, Homo sapiens
tccctcctagctctcc

SEQ ID NO: 4409491 - DNA, 14 bp, Homo sapiens
tccctccttttaaa

SEQ ID NO: 4409492 - DNA, 19 bp, Homo sapiens
tccctctaacccagtggct

SEQ ID NO: 4409493 - DNA, 21 bp, Homo sapiens
tccctctacagagcttccctg

SEQ ID NO: 4409494 - DNA, 19 bp, Homo sapiens
tccctctactgagtaaacc

SEQ ID NO: 4409495 - DNA, 12 bp, Homo sapiens
tccctctccaag

SEQ ID NO: 4409496 - DNA, 15 bp, Homo sapiens
tccctctccaagaca

SEQ ID NO: 4409497 - DNA, 20 bp, Homo sapiens
tccctctccaagacagcagc

SEQ ID NO: 4409498 - DNA, 13 bp, Homo sapiens
tccctctcctgcc

SEQ ID NO: 4409499 - DNA, 16 bp, Homo sapiens
tccctctctcataccc

SEQ ID NO: 4409500 - DNA, 18 bp, Homo sapiens
tccctctctccctgcctc

SEQ ID NO: 4409501 - DNA, 19 bp, Homo sapiens
tccctctctccctgcctca

SEQ ID NO: 4409502 - DNA, 18 bp, Homo sapiens
tccctctctcttctgctc

SEQ ID NO: 4409503 - DNA, 19 bp, Homo sapiens
tccctctctcttctgctcc

SEQ ID NO: 4409504 - DNA, 21 bp, Homo sapiens
tccctctctcttctgctccac

SEQ ID NO: 4409505 - DNA, 23 bp, Homo sapiens
tccctctctcttctgctccaccc

SEQ ID NO: 4409506 - DNA, 15 bp, Homo sapiens
tccctctctgtgcat

SEQ ID NO: 4409507 - DNA, 15 bp, Homo sapiens
tccctctcttcccct

SEQ ID NO: 4409508 - DNA, 19 bp, Homo sapiens
tccctctggccctgccttc

SEQ ID NO: 4409509 - DNA, 15 bp, Homo sapiens
tccctgaaaacccag

SEQ ID NO: 4409510 - DNA, 16 bp, Homo sapiens
tccctgaccctgctcc

SEQ ID NO: 4409511 - DNA, 11 bp, Homo sapiens
tccctgagcag

SEQ ID NO: 4409512 - DNA, 21 bp, Homo sapiens
tccctgataacaacctggaga

SEQ ID NO: 4409513 - DNA, 21 bp, Homo sapiens
tccctgatggcctttggaccc

SEQ ID NO: 4409514 - DNA, 14 bp, Homo sapiens
tccctgatggggga

SEQ ID NO: 4409515 - DNA, 20 bp, Homo sapiens
tccctgcaaaactccaggca

SEQ ID NO: 4409516 - DNA, 21 bp, Homo sapiens
tccctgcaaaactccaggcag

SEQ ID NO: 4409517 - DNA, 22 bp, Homo sapiens
tccctgcaagctccgcctcccg

SEQ ID NO: 4409518 - DNA, 18 bp, Homo sapiens
tccctgcacacacatgca

SEQ ID NO: 4409519 - DNA, 13 bp, Homo sapiens
tccctgcactgtg

SEQ ID NO: 4409520 - DNA, 20 bp, Homo sapiens
tccctgcagacctcaagcca

SEQ ID NO: 4409521 - DNA, 11 bp, Homo sapiens
tccctgcccaa

SEQ ID NO: 4409522 - DNA, 16 bp, Homo sapiens
tccctgcccaaaccct

SEQ ID NO: 4409523 - DNA, 18 bp, Homo sapiens
tccctgcccaaaccctta

SEQ ID NO: 4409524 - DNA, 14 bp, Homo sapiens
tccctgccgcctca

SEQ ID NO: 4409525 - DNA, 16 bp, Homo sapiens
tccctgcctcaggcca

SEQ ID NO: 4409526 - DNA, 16 bp, Homo sapiens
tccctgcctcctgcct

SEQ ID NO: 4409527 - DNA, 19 bp, Homo sapiens
tccctgcctcctgcctatg

SEQ ID NO: 4409528 - DNA, 12 bp, Homo sapiens
tccctgcctggc

SEQ ID NO: 4409529 - DNA, 18 bp, Homo sapiens
tccctgcctgtggcccct

SEQ ID NO: 4409530 - DNA, 20 bp, Homo sapiens
tccctgctagcacagaggcc

SEQ ID NO: 4409531 - DNA, 22 bp, Homo sapiens
tccctgctcagtgcttgggctc

SEQ ID NO: 4409532 - DNA, 20 bp, Homo sapiens
tccctgctgtgccatgctgg

SEQ ID NO: 4409533 - DNA, 20 bp, Homo sapiens
tccctgcttcacgattctta

SEQ ID NO: 4409534 - DNA, 19 bp, Homo sapiens
tccctgctttttgtgtttt

SEQ ID NO: 4409535 - DNA, 20 bp, Homo sapiens
tccctggaaaccttccaccc

SEQ ID NO: 4409536 - DNA, 17 bp, Homo sapiens
tccctggaaccttctag

SEQ ID NO: 4409537 - DNA, 20 bp, Homo sapiens
tccctggaactcctggcctt

SEQ ID NO: 4409538 - DNA, 23 bp, Homo sapiens
tccctggagaaaaaaattgctct

SEQ ID NO: 4409539 - DNA, 21 bp, Homo sapiens
tccctggagggcaagccctgc

SEQ ID NO: 4409540 - DNA, 21 bp, Homo sapiens
tccctggagtgtggctgagga

SEQ ID NO: 4409541 - DNA, 14 bp, Homo sapiens
tccctggcactgaa

SEQ ID NO: 4409542 - DNA, 18 bp, Homo sapiens
tccctggctaacagtcta

SEQ ID NO: 4409543 - DNA, 12 bp, Homo sapiens
tccctggctccc

SEQ ID NO: 4409544 - DNA, 14 bp, Homo sapiens
tccctggctcccat

SEQ ID NO: 4409545 - DNA, 15 bp, Homo sapiens
tccctggcttctgtg

SEQ ID NO: 4409546 - DNA, 19 bp, Homo sapiens
tccctgggacacagaccca

SEQ ID NO: 4409547 - DNA, 21 bp, Homo sapiens
tccctggggccaacggcaaca

SEQ ID NO: 4409548 - DNA, 17 bp, Homo sapiens
tccctgggggccttggg

SEQ ID NO: 4409549 - DNA, 16 bp, Homo sapiens
tccctggggttctcta

SEQ ID NO: 4409550 - DNA, 20 bp, Homo sapiens
tccctgtaaaagagaggggc

SEQ ID NO: 4409551 - DNA, 22 bp, Homo sapiens
tccctgtaaattgcagaattca

SEQ ID NO: 4409552 - DNA, 14 bp, Homo sapiens
tccctgtaacctct

SEQ ID NO: 4409553 - DNA, 14 bp, Homo sapiens
tccctgtagctctg

SEQ ID NO: 4409554 - DNA, 14 bp, Homo sapiens
tccctgtcacctct

SEQ ID NO: 4409555 - DNA, 15 bp, Homo sapiens
tccctgtcagcctga

SEQ ID NO: 4409556 - DNA, 14 bp, Homo sapiens
tccctgtcctcctc

SEQ ID NO: 4409557 - DNA, 17 bp, Homo sapiens
tccctgtccttccctgt

SEQ ID NO: 4409558 - DNA, 14 bp, Homo sapiens
tccctgtctccagg

SEQ ID NO: 4409559 - DNA, 21 bp, Homo sapiens
tccctgtctccagggccccca

SEQ ID NO: 4409560 - DNA, 23 bp, Homo sapiens
tccctgtctccagggcccccacc

SEQ ID NO: 4409561 - DNA, 11 bp, Homo sapiens
tccctgtgggg

SEQ ID NO: 4409562 - DNA, 12 bp, Homo sapiens
tccctgtggggg

SEQ ID NO: 4409563 - DNA, 16 bp, Homo sapiens
tccctgtgttctgggc

SEQ ID NO: 4409564 - DNA, 18 bp, Homo sapiens
tccctgtgttctgggctg

SEQ ID NO: 4409565 - DNA, 19 bp, Homo sapiens
tccctgtgttctgggctgg

SEQ ID NO: 4409566 - DNA, 22 bp, Homo sapiens
tccctgtgttctgggctggggc

SEQ ID NO: 4409567 - DNA, 14 bp, Homo sapiens
tccctgttctccct

SEQ ID NO: 4409568 - DNA, 19 bp, Homo sapiens
tccctgttctccctttctc

SEQ ID NO: 4409569 - DNA, 23 bp, Homo sapiens
tccctgttctccctttctctctc

SEQ ID NO: 4409570 - DNA, 15 bp, Homo sapiens
tcccttaaacaaaaa

SEQ ID NO: 4409571 - DNA, 20 bp, Homo sapiens
tcccttaacagttgtattta

SEQ ID NO: 4409572 - DNA, 18 bp, Homo sapiens
tcccttaataaaatattc

SEQ ID NO: 4409573 - DNA, 10 bp, Homo sapiens
tcccttaccc

SEQ ID NO: 4409574 - DNA, 21 bp, Homo sapiens
tcccttactttacctctctgt

SEQ ID NO: 4409575 - DNA, 18 bp, Homo sapiens
tcccttatccaaaatgct

SEQ ID NO: 4409576 - DNA, 20 bp, Homo sapiens
tcccttcccctccctggctc

SEQ ID NO: 4409577 - DNA, 21 bp, Homo sapiens
tcccttcccctccctggctcc

SEQ ID NO: 4409578 - DNA, 16 bp, Homo sapiens
tcccttccttcctctc

SEQ ID NO: 4409579 - DNA, 15 bp, Homo sapiens
tcccttctacctgcc

SEQ ID NO: 4409580 - DNA, 20 bp, Homo sapiens
tcccttctacctgccactca

SEQ ID NO: 4409581 - DNA, 15 bp, Homo sapiens
tcccttctcctgccc

SEQ ID NO: 4409582 - DNA, 18 bp, Homo sapiens
tcccttctcgtgtttgct

SEQ ID NO: 4409583 - DNA, 20 bp, Homo sapiens
tcccttgactttgctcctca

SEQ ID NO: 4409584 - DNA, 16 bp, Homo sapiens
tcccttgagacctcag

SEQ ID NO: 4409585 - DNA, 13 bp, Homo sapiens
tcccttgcctctg

SEQ ID NO: 4409586 - DNA, 19 bp, Homo sapiens
tcccttgcctctgccctgg

SEQ ID NO: 4409587 - DNA, 15 bp, Homo sapiens
tcccttggcccagag

SEQ ID NO: 4409588 - DNA, 16 bp, Homo sapiens
tcccttggcccagaga

SEQ ID NO: 4409589 - DNA, 15 bp, Homo sapiens
tcccttgtgtcaaga

SEQ ID NO: 4409590 - DNA, 19 bp, Homo sapiens
tccctttccttccatccct

SEQ ID NO: 4409591 - DNA, 18 bp, Homo sapiens
tccctttctcccctgccc

SEQ ID NO: 4409592 - DNA, 14 bp, Homo sapiens
tccctttctctctc

SEQ ID NO: 4409593 - DNA, 20 bp, Homo sapiens
tcccttttcaccttttcagg

SEQ ID NO: 4409594 - DNA, 14 bp, Homo sapiens
tcccttttccctta

SEQ ID NO: 4409595 - DNA, 13 bp, Homo sapiens
tcccttttctgtt

SEQ ID NO: 4409596 - DNA, 14 bp, Homo sapiens
tccgaagaaaagaa

SEQ ID NO: 4409597 - DNA, 16 bp, Homo sapiens
tccgaagaaaagaatt

SEQ ID NO: 4409598 - DNA, 19 bp, Homo sapiens
tccgaatctctttcccttc

SEQ ID NO: 4409599 - DNA, 15 bp, Homo sapiens
tccgacaggagcact

SEQ ID NO: 4409600 - DNA, 17 bp, Homo sapiens
tccgacatcccagacca

SEQ ID NO: 4409601 - DNA, 19 bp, Homo sapiens
tccgactctttctgagtgc

SEQ ID NO: 4409602 - DNA, 13 bp, Homo sapiens
tccgactgcccag

SEQ ID NO: 4409603 - DNA, 19 bp, Homo sapiens
tccgactgcccctgctgtg

SEQ ID NO: 4409604 - DNA, 19 bp, Homo sapiens
tccgaggctccccgcctcc

SEQ ID NO: 4409605 - DNA, 17 bp, Homo sapiens
tccgatggtatctgggt

SEQ ID NO: 4409606 - DNA, 14 bp, Homo sapiens
tccgccagcctcct

SEQ ID NO: 4409607 - DNA, 18 bp, Homo sapiens
tccgccagcctcctctgg

SEQ ID NO: 4409608 - DNA, 15 bp, Homo sapiens
tccgccatggtgtcc

SEQ ID NO: 4409609 - DNA, 20 bp, Homo sapiens
tccgccatggtgtcccggta

SEQ ID NO: 4409610 - DNA, 13 bp, Homo sapiens
tccgcctccagga

SEQ ID NO: 4409611 - DNA, 15 bp, Homo sapiens
tccgcctgaaagtgt

SEQ ID NO: 4409612 - DNA, 23 bp, Homo sapiens
tccgcctgggtcatgggcctgtg

SEQ ID NO: 4409613 - DNA, 16 bp, Homo sapiens
tccgccttctcccaca

SEQ ID NO: 4409614 - DNA, 17 bp, Homo sapiens
tccgcctttacaaggga

SEQ ID NO: 4409615 - DNA, 21 bp, Homo sapiens
tccgcctttacaagggagaag

SEQ ID NO: 4409616 - DNA, 20 bp, Homo sapiens
tccgccttttagttttggtt

SEQ ID NO: 4409617 - DNA, 16 bp, Homo sapiens
tccgcgccgatgccac

SEQ ID NO: 4409618 - DNA, 18 bp, Homo sapiens
tccgcgccgatgccaccg

SEQ ID NO: 4409619 - DNA, 17 bp, Homo sapiens
tccggaggactgagccc

SEQ ID NO: 4409620 - DNA, 19 bp, Homo sapiens
tccggaggactgagccccc

SEQ ID NO: 4409621 - DNA, 16 bp, Homo sapiens
tccggccatactgcct

SEQ ID NO: 4409622 - DNA, 23 bp, Homo sapiens
tccggccccgtctctcttggacc

SEQ ID NO: 4409623 - DNA, 18 bp, Homo sapiens
tccggccctccagagccc

SEQ ID NO: 4409624 - DNA, 22 bp, Homo sapiens
tccggcctgggtgacagagtga

SEQ ID NO: 4409625 - DNA, 19 bp, Homo sapiens
tccggcggcgagctctggc

SEQ ID NO: 4409626 - DNA, 17 bp, Homo sapiens
tccggcgtcagcctcca

SEQ ID NO: 4409627 - DNA, 18 bp, Homo sapiens
tccggcgtcagcctccag

SEQ ID NO: 4409628 - DNA, 21 bp, Homo sapiens
tccggcgtcagcctccagcct

SEQ ID NO: 4409629 - DNA, 19 bp, Homo sapiens
tccggctgtgctgggagaa

SEQ ID NO: 4409630 - DNA, 18 bp, Homo sapiens
tccgggaacagtgcatgt

SEQ ID NO: 4409631 - DNA, 20 bp, Homo sapiens
tccgggaacagtgcatgtgc

SEQ ID NO: 4409632 - DNA, 18 bp, Homo sapiens
tccgggcgtgtgaagaac

SEQ ID NO: 4409633 - DNA, 15 bp, Homo sapiens
tccgggtgtggcctc

SEQ ID NO: 4409634 - DNA, 22 bp, Homo sapiens
tccgggtgtggcctcagccctc

SEQ ID NO: 4409635 - DNA, 14 bp, Homo sapiens
tccggtcagccaag

SEQ ID NO: 4409636 - DNA, 18 bp, Homo sapiens
tccggtttctttttgctc

SEQ ID NO: 4409637 - DNA, 18 bp, Homo sapiens
tccgtaacagtgtaaagt

SEQ ID NO: 4409638 - DNA, 18 bp, Homo sapiens
tccgtagctcccctggct

SEQ ID NO: 4409639 - DNA, 19 bp, Homo sapiens
tccgtagctcccctggctg

SEQ ID NO: 4409640 - DNA, 15 bp, Homo sapiens
tccgtagttccctga

SEQ ID NO: 4409641 - DNA, 15 bp, Homo sapiens
tccgtattgaatttg

SEQ ID NO: 4409642 - DNA, 22 bp, Homo sapiens
tccgtgaactctggtgctcctg

SEQ ID NO: 4409643 - DNA, 14 bp, Homo sapiens
tccgtgagacacaa

SEQ ID NO: 4409644 - DNA, 21 bp, Homo sapiens
tccgtgagcaccaccagggct

SEQ ID NO: 4409645 - DNA, 18 bp, Homo sapiens
tccgtgggaccctcagca

SEQ ID NO: 4409646 - DNA, 19 bp, Homo sapiens
tccgtgggaccctcagcag

SEQ ID NO: 4409647 - DNA, 21 bp, Homo sapiens
tccgtgggaccctcagcagct

SEQ ID NO: 4409648 - DNA, 19 bp, Homo sapiens
tccgtggtcagagtgccac

SEQ ID NO: 4409649 - DNA, 21 bp, Homo sapiens
tccgtggtcagagtgccactg

SEQ ID NO: 4409650 - DNA, 18 bp, Homo sapiens
tccgtggtttctcatgag

SEQ ID NO: 4409651 - DNA, 14 bp, Homo sapiens
tccgtgtggagcac

SEQ ID NO: 4409652 - DNA, 16 bp, Homo sapiens
tcctaaaacacccttc

SEQ ID NO: 4409653 - DNA, 23 bp, Homo sapiens
tcctaaaacacccttcagcaatg

SEQ ID NO: 4409654 - DNA, 21 bp, Homo sapiens
tcctaaaactgggattaagaa

SEQ ID NO: 4409655 - DNA, 22 bp, Homo sapiens
tcctaaaactgggattaagaaa

SEQ ID NO: 4409656 - DNA, 16 bp, Homo sapiens
tcctaaaagcaaaata

SEQ ID NO: 4409657 - DNA, 22 bp, Homo sapiens
tcctaaaagcaaaataaaaact

SEQ ID NO: 4409658 - DNA, 15 bp, Homo sapiens
tcctaaactctctag

SEQ ID NO: 4409659 - DNA, 14 bp, Homo sapiens
tcctaaagctgaat

SEQ ID NO: 4409660 - DNA, 12 bp, Homo sapiens
tcctaagaatgt

SEQ ID NO: 4409661 - DNA, 13 bp, Homo sapiens
tcctaagacattt

SEQ ID NO: 4409662 - DNA, 19 bp, Homo sapiens
tcctaagacatttttcatt

SEQ ID NO: 4409663 - DNA, 20 bp, Homo sapiens
tcctaagacatttttcattc

SEQ ID NO: 4409664 - DNA, 21 bp, Homo sapiens
tcctaagacatttttcattca

SEQ ID NO: 4409665 - DNA, 20 bp, Homo sapiens
tcctaagatgtgttcttatt

SEQ ID NO: 4409666 - DNA, 23 bp, Homo sapiens
tcctaagatgtgttcttattttt

SEQ ID NO: 4409667 - DNA, 23 bp, Homo sapiens
tcctaaggttcttgctttctctc

SEQ ID NO: 4409668 - DNA, 14 bp, Homo sapiens
tcctaatcatacac

SEQ ID NO: 4409669 - DNA, 15 bp, Homo sapiens
tcctaatttctcctc

SEQ ID NO: 4409670 - DNA, 16 bp, Homo sapiens
tcctaatttctcctcc

SEQ ID NO: 4409671 - DNA, 20 bp, Homo sapiens
tcctacaagagcagcctgtg

SEQ ID NO: 4409672 - DNA, 20 bp, Homo sapiens
tcctacagcactactgggtg

SEQ ID NO: 4409673 - DNA, 18 bp, Homo sapiens
tcctaccatcagctctgc

SEQ ID NO: 4409674 - DNA, 20 bp, Homo sapiens
tcctacccacacctctgcca

SEQ ID NO: 4409675 - DNA, 21 bp, Homo sapiens
tcctacccacacctctgccag

SEQ ID NO: 4409676 - DNA, 22 bp, Homo sapiens
tcctacccacacctctgccaga

SEQ ID NO: 4409677 - DNA, 13 bp, Homo sapiens
tcctaccccctgt

SEQ ID NO: 4409678 - DNA, 17 bp, Homo sapiens
tcctaccccctgtgcct

SEQ ID NO: 4409679 - DNA, 21 bp, Homo sapiens
tcctaccctcccaccagaacg

SEQ ID NO: 4409680 - DNA, 15 bp, Homo sapiens
tcctacgtccaaggt

SEQ ID NO: 4409681 - DNA, 21 bp, Homo sapiens
tcctagaagaaccaaatacct

SEQ ID NO: 4409682 - DNA, 18 bp, Homo sapiens
tcctagaatgtttcattt

SEQ ID NO: 4409683 - DNA, 13 bp, Homo sapiens
tcctagagtctta

SEQ ID NO: 4409684 - DNA, 12 bp, Homo sapiens
tcctagcactgc

SEQ ID NO: 4409685 - DNA, 16 bp, Homo sapiens
tcctagcactgcccca

SEQ ID NO: 4409686 - DNA, 20 bp, Homo sapiens
tcctagcactgccccacatg

SEQ ID NO: 4409687 - DNA, 21 bp, Homo sapiens
tcctagcactgccccacatgc

SEQ ID NO: 4409688 - DNA, 14 bp, Homo sapiens
tcctagcccttccc

SEQ ID NO: 4409689 - DNA, 17 bp, Homo sapiens
tcctagcccttccctga

SEQ ID NO: 4409690 - DNA, 13 bp, Homo sapiens
tcctagctctccc

SEQ ID NO: 4409691 - DNA, 14 bp, Homo sapiens
tcctagctcttaca

SEQ ID NO: 4409692 - DNA, 14 bp, Homo sapiens
tcctagctgcacag

SEQ ID NO: 4409693 - DNA, 17 bp, Homo sapiens
tcctagctgttctaatt

SEQ ID NO: 4409694 - DNA, 20 bp, Homo sapiens
tcctaggacccgtctccagc

SEQ ID NO: 4409695 - DNA, 17 bp, Homo sapiens
tcctaggcctcaactcc

SEQ ID NO: 4409696 - DNA, 22 bp, Homo sapiens
tcctaggcctcaactcctccca

SEQ ID NO: 4409697 - DNA, 21 bp, Homo sapiens
tcctaggtcatgcctcctccc

SEQ ID NO: 4409698 - DNA, 15 bp, Homo sapiens
tcctatatatttcta

SEQ ID NO: 4409699 - DNA, 17 bp, Homo sapiens
tcctatatatttctatt

SEQ ID NO: 4409700 - DNA, 13 bp, Homo sapiens
tcctatgcaataa

SEQ ID NO: 4409701 - DNA, 17 bp, Homo sapiens
tcctattccttcacaca

SEQ ID NO: 4409702 - DNA, 21 bp, Homo sapiens
tcctattgtgcaatgtaaata

SEQ ID NO: 4409703 - DNA, 14 bp, Homo sapiens
tcctatttaaagac

SEQ ID NO: 4409704 - DNA, 17 bp, Homo sapiens
tcctatttcaatgagtt

SEQ ID NO: 4409705 - DNA, 20 bp, Homo sapiens
tcctatttcaatgagttatt

SEQ ID NO: 4409706 - DNA, 17 bp, Homo sapiens
tcctcaaaactggagtc

SEQ ID NO: 4409707 - DNA, 20 bp, Homo sapiens
tcctcaaacgacagaggagc

SEQ ID NO: 4409708 - DNA, 18 bp, Homo sapiens
tcctcaaatacatgcaca

SEQ ID NO: 4409709 - DNA, 22 bp, Homo sapiens
tcctcaaatacatgcacagtca

SEQ ID NO: 4409710 - DNA, 23 bp, Homo sapiens
tcctcaaatacatgcacagtcat

SEQ ID NO: 4409711 - DNA, 16 bp, Homo sapiens
tcctcaaatcaaaaac

SEQ ID NO: 4409712 - DNA, 12 bp, Homo sapiens
tcctcaatccag

SEQ ID NO: 4409713 - DNA, 14 bp, Homo sapiens
tcctcaatccagct

SEQ ID NO: 4409714 - DNA, 19 bp, Homo sapiens
tcctcaatgggctttcccc

SEQ ID NO: 4409715 - DNA, 14 bp, Homo sapiens
tcctcacagtccca

SEQ ID NO: 4409716 - DNA, 23 bp, Homo sapiens
tcctcacccctcgccacctttca

SEQ ID NO: 4409717 - DNA, 20 bp, Homo sapiens
tcctcacctctggactggct

SEQ ID NO: 4409718 - DNA, 13 bp, Homo sapiens
tcctcacctggtt

SEQ ID NO: 4409719 - DNA, 17 bp, Homo sapiens
tcctcactcccagtcca

SEQ ID NO: 4409720 - DNA, 12 bp, Homo sapiens
tcctcactccct

SEQ ID NO: 4409721 - DNA, 14 bp, Homo sapiens
tcctcactcccttc

SEQ ID NO: 4409722 - DNA, 21 bp, Homo sapiens
tcctcactctgtccctgtcct

SEQ ID NO: 4409723 - DNA, 21 bp, Homo sapiens
tcctcactcttcaaggaggcc

SEQ ID NO: 4409724 - DNA, 14 bp, Homo sapiens
tcctcactgtatcc

SEQ ID NO: 4409725 - DNA, 18 bp, Homo sapiens
tcctcagagcgccaggaa

SEQ ID NO: 4409726 - DNA, 21 bp, Homo sapiens
tcctcagagcgccaggaagcc

SEQ ID NO: 4409727 - DNA, 23 bp, Homo sapiens
tcctcagagcgccaggaagccag

SEQ ID NO: 4409728 - DNA, 14 bp, Homo sapiens
tcctcagccagcct

SEQ ID NO: 4409729 - DNA, 14 bp, Homo sapiens
tcctcagctctagg

SEQ ID NO: 4409730 - DNA, 22 bp, Homo sapiens
tcctcagcttcttcacaggcac

SEQ ID NO: 4409731 - DNA, 13 bp, Homo sapiens
tcctcaggcccag

SEQ ID NO: 4409732 - DNA, 20 bp, Homo sapiens
tcctcaggcccagctgctcc

SEQ ID NO: 4409733 - DNA, 22 bp, Homo sapiens
tcctcaggcccagctgctcccc

SEQ ID NO: 4409734 - DNA, 18 bp, Homo sapiens
tcctcagggacagagaca

SEQ ID NO: 4409735 - DNA, 13 bp, Homo sapiens
tcctcagggtggg

SEQ ID NO: 4409736 - DNA, 16 bp, Homo sapiens
tcctcagggtgggggg

SEQ ID NO: 4409737 - DNA, 17 bp, Homo sapiens
tcctcagggtggggggt

SEQ ID NO: 4409738 - DNA, 15 bp, Homo sapiens
tcctcagtggcttct

SEQ ID NO: 4409739 - DNA, 18 bp, Homo sapiens
tcctcagtggcttctcca

SEQ ID NO: 4409740 - DNA, 20 bp, Homo sapiens
tcctcagtggcttctccagg

SEQ ID NO: 4409741 - DNA, 18 bp, Homo sapiens
tcctcatctccaaggcag

SEQ ID NO: 4409742 - DNA, 19 bp, Homo sapiens
tcctcatgttgctgaattt

SEQ ID NO: 4409743 - DNA, 19 bp, Homo sapiens
tcctcattgatgttaagaa

SEQ ID NO: 4409744 - DNA, 17 bp, Homo sapiens
tcctccacctcaactcc

SEQ ID NO: 4409745 - DNA, 16 bp, Homo sapiens
tcctccactctccccc

SEQ ID NO: 4409746 - DNA, 19 bp, Homo sapiens
tcctccactctcccccacc

SEQ ID NO: 4409747 - DNA, 23 bp, Homo sapiens
tcctccactctcccccaccccct

SEQ ID NO: 4409748 - DNA, 20 bp, Homo sapiens
tcctccagaagcctctggct

SEQ ID NO: 4409749 - DNA, 21 bp, Homo sapiens
tcctccagaagcctctggcta

SEQ ID NO: 4409750 - DNA, 22 bp, Homo sapiens
tcctccagaagcctctggctag

SEQ ID NO: 4409751 - DNA, 15 bp, Homo sapiens
tcctccagagacact

SEQ ID NO: 4409752 - DNA, 16 bp, Homo sapiens
tcctccagagacactg

SEQ ID NO: 4409753 - DNA, 17 bp, Homo sapiens
tcctccagcctcccctc

SEQ ID NO: 4409754 - DNA, 19 bp, Homo sapiens
tcctccagcctcccctccc

SEQ ID NO: 4409755 - DNA, 22 bp, Homo sapiens
tcctccagcctcccctcccctg

SEQ ID NO: 4409756 - DNA, 13 bp, Homo sapiens
tcctccaggcctg

SEQ ID NO: 4409757 - DNA, 21 bp, Homo sapiens
tcctccagtacgtcccgctgc

SEQ ID NO: 4409758 - DNA, 23 bp, Homo sapiens
tcctcccaggaagcccaggagcc

SEQ ID NO: 4409759 - DNA, 15 bp, Homo sapiens
tcctcccattgccca

SEQ ID NO: 4409760 - DNA, 18 bp, Homo sapiens
tcctcccattgcccagtg

SEQ ID NO: 4409761 - DNA, 16 bp, Homo sapiens
tcctccccaaatcaat

SEQ ID NO: 4409762 - DNA, 20 bp, Homo sapiens
tcctcccccctcctctgaaa

SEQ ID NO: 4409763 - DNA, 13 bp, Homo sapiens
tcctccccctgcc

SEQ ID NO: 4409764 - DNA, 24 bp, Homo sapiens
tcctccccctgccagtgccttacc

SEQ ID NO: 4409765 - DNA, 13 bp, Homo sapiens
tcctcccctcctc

SEQ ID NO: 4409766 - DNA, 17 bp, Homo sapiens
tcctcccctctcttgtc

SEQ ID NO: 4409767 - DNA, 14 bp, Homo sapiens
tcctccccttcctg

SEQ ID NO: 4409768 - DNA, 19 bp, Homo sapiens
tcctcccgccccgcccctc

SEQ ID NO: 4409769 - DNA, 13 bp, Homo sapiens
tcctccctatcaa

SEQ ID NO: 4409770 - DNA, 13 bp, Homo sapiens
tcctccctcaaac

SEQ ID NO: 4409771 - DNA, 13 bp, Homo sapiens
tcctccctcagac

SEQ ID NO: 4409772 - DNA, 16 bp, Homo sapiens
tcctccctcagaccca

SEQ ID NO: 4409773 - DNA, 17 bp, Homo sapiens
tcctccctcagacccag

SEQ ID NO: 4409774 - DNA, 19 bp, Homo sapiens
tcctccctcagacccagga

SEQ ID NO: 4409775 - DNA, 12 bp, Homo sapiens
tcctccctcagg

SEQ ID NO: 4409776 - DNA, 13 bp, Homo sapiens
tcctccctcaggc

SEQ ID NO: 4409777 - DNA, 14 bp, Homo sapiens
tcctccctccagct

SEQ ID NO: 4409778 - DNA, 16 bp, Homo sapiens
tcctccctgaccctgc

SEQ ID NO: 4409779 - DNA, 18 bp, Homo sapiens
tcctccctgacttttctg

SEQ ID NO: 4409780 - DNA, 20 bp, Homo sapiens
tcctccctgacttttctgtg

SEQ ID NO: 4409781 - DNA, 19 bp, Homo sapiens
tcctcccttccttttccct

SEQ ID NO: 4409782 - DNA, 14 bp, Homo sapiens
tcctccgtccagcc

SEQ ID NO: 4409783 - DNA, 16 bp, Homo sapiens
tcctccgtccagccgc

SEQ ID NO: 4409784 - DNA, 19 bp, Homo sapiens
tcctccgtgagcaccacca

SEQ ID NO: 4409785 - DNA, 18 bp, Homo sapiens
tcctcctcacccttcccg

SEQ ID NO: 4409786 - DNA, 18 bp, Homo sapiens
tcctcctcacctcatgcc

SEQ ID NO: 4409787 - DNA, 18 bp, Homo sapiens
tcctcctcatcctccctg

SEQ ID NO: 4409788 - DNA, 14 bp, Homo sapiens
tcctcctcccctcc

SEQ ID NO: 4409789 - DNA, 14 bp, Homo sapiens
tcctcctctgactt

SEQ ID NO: 4409790 - DNA, 12 bp, Homo sapiens
tcctcctctgtg

SEQ ID NO: 4409791 - DNA, 20 bp, Homo sapiens
tcctcctgcctcagccttcc

SEQ ID NO: 4409792 - DNA, 21 bp, Homo sapiens
tcctcctgcctcagccttcca

SEQ ID NO: 4409793 - DNA, 20 bp, Homo sapiens
tcctcctgggccctctctgc

SEQ ID NO: 4409794 - DNA, 17 bp, Homo sapiens
tcctccttccagatgcc

SEQ ID NO: 4409795 - DNA, 17 bp, Homo sapiens
tcctcctttcctcctct

SEQ ID NO: 4409796 - DNA, 19 bp, Homo sapiens
tcctcggagagcagcagca

SEQ ID NO: 4409797 - DNA, 14 bp, Homo sapiens
tcctcggtcgcccc

SEQ ID NO: 4409798 - DNA, 18 bp, Homo sapiens
tcctctactaacaatcag

SEQ ID NO: 4409799 - DNA, 14 bp, Homo sapiens
tcctctagaagcca

SEQ ID NO: 4409800 - DNA, 18 bp, Homo sapiens
tcctctagaagccaaggg

SEQ ID NO: 4409801 - DNA, 22 bp, Homo sapiens
tcctctagaagccaagggaaag

SEQ ID NO: 4409802 - DNA, 19 bp, Homo sapiens
tcctctattgatgtacagt

SEQ ID NO: 4409803 - DNA, 13 bp, Homo sapiens
tcctctcagagtg

SEQ ID NO: 4409804 - DNA, 15 bp, Homo sapiens
tcctctcaggctctt

SEQ ID NO: 4409805 - DNA, 22 bp, Homo sapiens
tcctctcccacagagtgctgga

SEQ ID NO: 4409806 - DNA, 20 bp, Homo sapiens
tcctctccccctcctccagg

SEQ ID NO: 4409807 - DNA, 21 bp, Homo sapiens
tcctctccccctcctccaggg

SEQ ID NO: 4409808 - DNA, 22 bp, Homo sapiens
tcctctcccctttgtggattct

SEQ ID NO: 4409809 - DNA, 15 bp, Homo sapiens
tcctctccctgccaa

SEQ ID NO: 4409810 - DNA, 13 bp, Homo sapiens
tcctctcctgtct

SEQ ID NO: 4409811 - DNA, 16 bp, Homo sapiens
tcctctcgagcccaga

SEQ ID NO: 4409812 - DNA, 13 bp, Homo sapiens
tcctctctcttgg

SEQ ID NO: 4409813 - DNA, 18 bp, Homo sapiens
tcctctcttccacagtgg

SEQ ID NO: 4409814 - DNA, 11 bp, Homo sapiens
tcctctgaaac

SEQ ID NO: 4409815 - DNA, 18 bp, Homo sapiens
tcctctgaaacagctgcc

SEQ ID NO: 4409816 - DNA, 21 bp, Homo sapiens
tcctctgaaacagctgcctta

SEQ ID NO: 4409817 - DNA, 15 bp, Homo sapiens
tcctctgactcaggg

SEQ ID NO: 4409818 - DNA, 16 bp, Homo sapiens
tcctctgactcagggc

SEQ ID NO: 4409819 - DNA, 18 bp, Homo sapiens
tcctctgactcagggctc

SEQ ID NO: 4409820 - DNA, 21 bp, Homo sapiens
tcctctgatagctgtttcaaa

SEQ ID NO: 4409821 - DNA, 12 bp, Homo sapiens
tcctctgcactc

SEQ ID NO: 4409822 - DNA, 18 bp, Homo sapiens
tcctctgcagtgccttgg

SEQ ID NO: 4409823 - DNA, 23 bp, Homo sapiens
tcctctgccacctcccctatcca

SEQ ID NO: 4409824 - DNA, 14 bp, Homo sapiens
tcctctgcctacag

SEQ ID NO: 4409825 - DNA, 16 bp, Homo sapiens
tcctctgcctacagcc

SEQ ID NO: 4409826 - DNA, 18 bp, Homo sapiens
tcctctgcctacagccag

SEQ ID NO: 4409827 - DNA, 19 bp, Homo sapiens
tcctctgcctacagccagg

SEQ ID NO: 4409828 - DNA, 20 bp, Homo sapiens
tcctctgctcaccgcccatc

SEQ ID NO: 4409829 - DNA, 15 bp, Homo sapiens
tcctctggacggcag

SEQ ID NO: 4409830 - DNA, 22 bp, Homo sapiens
tcctctggacggcaggctcact

SEQ ID NO: 4409831 - DNA, 12 bp, Homo sapiens
tcctctggcttt

SEQ ID NO: 4409832 - DNA, 18 bp, Homo sapiens
tcctctggctttcccagg

SEQ ID NO: 4409833 - DNA, 20 bp, Homo sapiens
tcctctggctttcccaggag

SEQ ID NO: 4409834 - DNA, 22 bp, Homo sapiens
tcctctgggtttctaagcagtt

SEQ ID NO: 4409835 - DNA, 24 bp, Homo sapiens
tcctctggtaaacattcctccagc

SEQ ID NO: 4409836 - DNA, 15 bp, Homo sapiens
tcctctgtacagcaa

SEQ ID NO: 4409837 - DNA, 18 bp, Homo sapiens
tcctctgtctgcccttca

SEQ ID NO: 4409838 - DNA, 19 bp, Homo sapiens
tcctctgtgaccaatgtct

SEQ ID NO: 4409839 - DNA, 15 bp, Homo sapiens
tcctcttagaagaat

SEQ ID NO: 4409840 - DNA, 18 bp, Homo sapiens
tcctcttccctctctgca

SEQ ID NO: 4409841 - DNA, 22 bp, Homo sapiens
tcctcttctaaaatagcaataa

SEQ ID NO: 4409842 - DNA, 15 bp, Homo sapiens
tcctctttaaaacaa

SEQ ID NO: 4409843 - DNA, 19 bp, Homo sapiens
tcctctttaaaacaaaaca

SEQ ID NO: 4409844 - DNA, 21 bp, Homo sapiens
tcctcttttgtattgtttcta

SEQ ID NO: 4409845 - DNA, 21 bp, Homo sapiens
tcctcttttgtgctgcttctc

SEQ ID NO: 4409846 - DNA, 21 bp, Homo sapiens
tcctgaaaaggtttatgaaaa

SEQ ID NO: 4409847 - DNA, 18 bp, Homo sapiens
tcctgaaacctcttccta

SEQ ID NO: 4409848 - DNA, 17 bp, Homo sapiens
tcctgaaagtcatttaa

SEQ ID NO: 4409849 - DNA, 15 bp, Homo sapiens
tcctgaactttctcc

SEQ ID NO: 4409850 - DNA, 19 bp, Homo sapiens
tcctgaactttctccctca

SEQ ID NO: 4409851 - DNA, 13 bp, Homo sapiens
tcctgaagctgct

SEQ ID NO: 4409852 - DNA, 13 bp, Homo sapiens
tcctgacagatgc

SEQ ID NO: 4409853 - DNA, 19 bp, Homo sapiens
tcctgacagatgcctggtg

SEQ ID NO: 4409854 - DNA, 14 bp, Homo sapiens
tcctgacattgtct

SEQ ID NO: 4409855 - DNA, 15 bp, Homo sapiens
tcctgacattgtctc

SEQ ID NO: 4409856 - DNA, 11 bp, Homo sapiens
tcctgaccagc

SEQ ID NO: 4409857 - DNA, 16 bp, Homo sapiens
tcctgacccctgcctg

SEQ ID NO: 4409858 - DNA, 16 bp, Homo sapiens
tcctgacctcaggtga

SEQ ID NO: 4409859 - DNA, 21 bp, Homo sapiens
tcctgactaagcctttgactt

SEQ ID NO: 4409860 - DNA, 17 bp, Homo sapiens
tcctgactctgccccct

SEQ ID NO: 4409861 - DNA, 20 bp, Homo sapiens
tcctgactgaaagtaggggg

SEQ ID NO: 4409862 - DNA, 13 bp, Homo sapiens
tcctgactgcccg

SEQ ID NO: 4409863 - DNA, 17 bp, Homo sapiens
tcctgagacccctggcc

SEQ ID NO: 4409864 - DNA, 18 bp, Homo sapiens
tcctgagacccctggcct

SEQ ID NO: 4409865 - DNA, 20 bp, Homo sapiens
tcctgagacccctggcctcc

SEQ ID NO: 4409866 - DNA, 12 bp, Homo sapiens
tcctgagggcta

SEQ ID NO: 4409867 - DNA, 15 bp, Homo sapiens
tcctgaggggcatct

SEQ ID NO: 4409868 - DNA, 18 bp, Homo sapiens
tcctgattaccagtctga

SEQ ID NO: 4409869 - DNA, 17 bp, Homo sapiens
tcctgcaaatttagttt

SEQ ID NO: 4409870 - DNA, 15 bp, Homo sapiens
tcctgcacaccctgg

SEQ ID NO: 4409871 - DNA, 16 bp, Homo sapiens
tcctgcacaccctggg

SEQ ID NO: 4409872 - DNA, 18 bp, Homo sapiens
tcctgcaccccagcattc

SEQ ID NO: 4409873 - DNA, 20 bp, Homo sapiens
tcctgcaccccagcattcca

SEQ ID NO: 4409874 - DNA, 21 bp, Homo sapiens
tcctgcaccccagcattccag

SEQ ID NO: 4409875 - DNA, 23 bp, Homo sapiens
tcctgcaccccagcattccagct

SEQ ID NO: 4409876 - DNA, 19 bp, Homo sapiens
tcctgcaccggggcctggg

SEQ ID NO: 4409877 - DNA, 15 bp, Homo sapiens
tcctgcactgtttaa

SEQ ID NO: 4409878 - DNA, 18 bp, Homo sapiens
tcctgcagggagccttct

SEQ ID NO: 4409879 - DNA, 22 bp, Homo sapiens
tcctgcagggagccttctgcca

SEQ ID NO: 4409880 - DNA, 15 bp, Homo sapiens
tcctgcagggcttct

SEQ ID NO: 4409881 - DNA, 21 bp, Homo sapiens
tcctgccagctggatcgctgc

SEQ ID NO: 4409882 - DNA, 22 bp, Homo sapiens
tcctgccaggcacacacagccc

SEQ ID NO: 4409883 - DNA, 14 bp, Homo sapiens
tcctgccatcctca

SEQ ID NO: 4409884 - DNA, 15 bp, Homo sapiens
tcctgcccaaaatgt

SEQ ID NO: 4409885 - DNA, 18 bp, Homo sapiens
tcctgcccaaaatgtgaa

SEQ ID NO: 4409886 - DNA, 19 bp, Homo sapiens
tcctgcccaaaatgtgaag

SEQ ID NO: 4409887 - DNA, 18 bp, Homo sapiens
tcctgcccaggagagcca

SEQ ID NO: 4409888 - DNA, 15 bp, Homo sapiens
tcctgcccaggccac

SEQ ID NO: 4409889 - DNA, 16 bp, Homo sapiens
tcctgcccaggccaca

SEQ ID NO: 4409890 - DNA, 20 bp, Homo sapiens
tcctgcccaggccacagaga

SEQ ID NO: 4409891 - DNA, 16 bp, Homo sapiens
tcctgcccatgtgtcc

SEQ ID NO: 4409892 - DNA, 20 bp, Homo sapiens
tcctgcccatgtgtcccctc

SEQ ID NO: 4409893 - DNA, 15 bp, Homo sapiens
tcctgccccctgcca

SEQ ID NO: 4409894 - DNA, 17 bp, Homo sapiens
tcctgcccctgagccca

SEQ ID NO: 4409895 - DNA, 18 bp, Homo sapiens
tcctgcccttccctctgg

SEQ ID NO: 4409896 - DNA, 18 bp, Homo sapiens
tcctgcctatgtctcctc

SEQ ID NO: 4409897 - DNA, 19 bp, Homo sapiens
tcctgcctattatctgtca

SEQ ID NO: 4409898 - DNA, 22 bp, Homo sapiens
tcctgcctcagcctcccatagc

SEQ ID NO: 4409899 - DNA, 19 bp, Homo sapiens
tcctgcctgaacagccctc

SEQ ID NO: 4409900 - DNA, 17 bp, Homo sapiens
tcctgccttagagccag

SEQ ID NO: 4409901 - DNA, 18 bp, Homo sapiens
tcctgccttagagccagg

SEQ ID NO: 4409902 - DNA, 14 bp, Homo sapiens
tcctgccttcctcc

SEQ ID NO: 4409903 - DNA, 22 bp, Homo sapiens
tcctgccttcctcctgggccct

SEQ ID NO: 4409904 - DNA, 18 bp, Homo sapiens
tcctgcgccctgtgcccg

SEQ ID NO: 4409905 - DNA, 12 bp, Homo sapiens
tcctgcgggctt

SEQ ID NO: 4409906 - DNA, 15 bp, Homo sapiens
tcctgcgtcctcctc

SEQ ID NO: 4409907 - DNA, 18 bp, Homo sapiens
tcctgcgtcctcctcacc

SEQ ID NO: 4409908 - DNA, 16 bp, Homo sapiens
tcctgctcatattgtg

SEQ ID NO: 4409909 - DNA, 21 bp, Homo sapiens
tcctgctgaaagtcctgcttt

SEQ ID NO: 4409910 - DNA, 15 bp, Homo sapiens
tcctgctgcctaata

SEQ ID NO: 4409911 - DNA, 20 bp, Homo sapiens
tcctgctgcctaataaagag

SEQ ID NO: 4409912 - DNA, 20 bp, Homo sapiens
tcctgctgctttgggctggg

SEQ ID NO: 4409913 - DNA, 16 bp, Homo sapiens
tcctggaaggacacag

SEQ ID NO: 4409914 - DNA, 22 bp, Homo sapiens
tcctggacatgaagattctttc

SEQ ID NO: 4409915 - DNA, 15 bp, Homo sapiens
tcctggactccggag

SEQ ID NO: 4409916 - DNA, 20 bp, Homo sapiens
tcctggactccggaggactg

SEQ ID NO: 4409917 - DNA, 11 bp, Homo sapiens
tcctggagggg

SEQ ID NO: 4409918 - DNA, 13 bp, Homo sapiens
tcctggcagctgc

SEQ ID NO: 4409919 - DNA, 17 bp, Homo sapiens
tcctggcagctgctgtg

SEQ ID NO: 4409920 - DNA, 18 bp, Homo sapiens
tcctggcagctgctgtgg

SEQ ID NO: 4409921 - DNA, 18 bp, Homo sapiens
tcctggccagacgctgcc

SEQ ID NO: 4409922 - DNA, 16 bp, Homo sapiens
tcctggcccagggcat

SEQ ID NO: 4409923 - DNA, 19 bp, Homo sapiens
tcctggccctccactcctc

SEQ ID NO: 4409924 - DNA, 16 bp, Homo sapiens
tcctggccttttgtgg

SEQ ID NO: 4409925 - DNA, 12 bp, Homo sapiens
tcctggcgcctg

SEQ ID NO: 4409926 - DNA, 13 bp, Homo sapiens
tcctggctcctga

SEQ ID NO: 4409927 - DNA, 24 bp, Homo sapiens
tcctggctgctgccatgtctcaga

SEQ ID NO: 4409928 - DNA, 14 bp, Homo sapiens
tcctggctgtccta

SEQ ID NO: 4409929 - DNA, 23 bp, Homo sapiens
tcctggctgtcctaccatcagct

SEQ ID NO: 4409930 - DNA, 16 bp, Homo sapiens
tcctgggaaatattcc

SEQ ID NO: 4409931 - DNA, 22 bp, Homo sapiens
tcctgggagggagactcagcct

SEQ ID NO: 4409932 - DNA, 16 bp, Homo sapiens
tcctgggccctctctg

SEQ ID NO: 4409933 - DNA, 21 bp, Homo sapiens
tcctgggccctctctgctctg

SEQ ID NO: 4409934 - DNA, 16 bp, Homo sapiens
tcctgggccctgggct

SEQ ID NO: 4409935 - DNA, 17 bp, Homo sapiens
tcctgggccctgggctg

SEQ ID NO: 4409936 - DNA, 19 bp, Homo sapiens
tcctgggcttggtaagtga

SEQ ID NO: 4409937 - DNA, 20 bp, Homo sapiens
tcctggggagctcctgggac

SEQ ID NO: 4409938 - DNA, 13 bp, Homo sapiens
tcctgggggtggc

SEQ ID NO: 4409939 - DNA, 15 bp, Homo sapiens
tcctgggggtggcag

SEQ ID NO: 4409940 - DNA, 16 bp, Homo sapiens
tcctgggggtggcagg

SEQ ID NO: 4409941 - DNA, 18 bp, Homo sapiens
tcctgggtgttagaacct

SEQ ID NO: 4409942 - DNA, 14 bp, Homo sapiens
tcctggtctgtgaa

SEQ ID NO: 4409943 - DNA, 21 bp, Homo sapiens
tcctggtgccaatttcaagtt

SEQ ID NO: 4409944 - DNA, 23 bp, Homo sapiens
tcctggtgctgccgagggctggc

SEQ ID NO: 4409945 - DNA, 22 bp, Homo sapiens
tcctggtgggtccaggggcccc

SEQ ID NO: 4409946 - DNA, 19 bp, Homo sapiens
tcctgtaaaggttacaagc

SEQ ID NO: 4409947 - DNA, 15 bp, Homo sapiens
tcctgtaaatatatc

SEQ ID NO: 4409948 - DNA, 21 bp, Homo sapiens
tcctgtaactgttacagtaat

SEQ ID NO: 4409949 - DNA, 13 bp, Homo sapiens
tcctgtaagaagc

SEQ ID NO: 4409950 - DNA, 16 bp, Homo sapiens
tcctgtaagccaaaga

SEQ ID NO: 4409951 - DNA, 17 bp, Homo sapiens
tcctgtaagccaaagaa

SEQ ID NO: 4409952 - DNA, 23 bp, Homo sapiens
tcctgtaagccaaagaaatgaac

SEQ ID NO: 4409953 - DNA, 23 bp, Homo sapiens
tcctgtaatatatttatatactt

SEQ ID NO: 4409954 - DNA, 16 bp, Homo sapiens
tcctgtacctcagtgg

SEQ ID NO: 4409955 - DNA, 18 bp, Homo sapiens
tcctgtattcttgtttga

SEQ ID NO: 4409956 - DNA, 22 bp, Homo sapiens
tcctgtcacctagaacgtgcat

SEQ ID NO: 4409957 - DNA, 15 bp, Homo sapiens
tcctgtcagtgagga

SEQ ID NO: 4409958 - DNA, 20 bp, Homo sapiens
tcctgtccaacctaacccct

SEQ ID NO: 4409959 - DNA, 17 bp, Homo sapiens
tcctgtccacacccagc

SEQ ID NO: 4409960 - DNA, 15 bp, Homo sapiens
tcctgtccctgaggt

SEQ ID NO: 4409961 - DNA, 16 bp, Homo sapiens
tcctgtccctgaggtt

SEQ ID NO: 4409962 - DNA, 14 bp, Homo sapiens
tcctgtcccttttc

SEQ ID NO: 4409963 - DNA, 18 bp, Homo sapiens
tcctgtcccttttccctt

SEQ ID NO: 4409964 - DNA, 13 bp, Homo sapiens
tcctgtcctgccc

SEQ ID NO: 4409965 - DNA, 13 bp, Homo sapiens
tcctgtctcactc

SEQ ID NO: 4409966 - DNA, 18 bp, Homo sapiens
tcctgtctctaaaaagaa

SEQ ID NO: 4409967 - DNA, 23 bp, Homo sapiens
tcctgtctggctcggacccaccc

SEQ ID NO: 4409968 - DNA, 13 bp, Homo sapiens
tcctgtctgttta

SEQ ID NO: 4409969 - DNA, 19 bp, Homo sapiens
tcctgtgaatggaggcaga

SEQ ID NO: 4409970 - DNA, 24 bp, Homo sapiens
tcctgtgaatggaggcagagacct

SEQ ID NO: 4409971 - DNA, 12 bp, Homo sapiens
tcctgtgatgtc

SEQ ID NO: 4409972 - DNA, 22 bp, Homo sapiens
tcctgtgcattggtggcatcac

SEQ ID NO: 4409973 - DNA, 15 bp, Homo sapiens
tcctgtgcctggccc

SEQ ID NO: 4409974 - DNA, 17 bp, Homo sapiens
tcctgtgctcaccctct

SEQ ID NO: 4409975 - DNA, 21 bp, Homo sapiens
tcctgtggaaggcagagaaat

SEQ ID NO: 4409976 - DNA, 11 bp, Homo sapiens
tcctgtggaat

SEQ ID NO: 4409977 - DNA, 16 bp, Homo sapiens
tcctgtggcctgctca

SEQ ID NO: 4409978 - DNA, 14 bp, Homo sapiens
tcctgtgtaaatta

SEQ ID NO: 4409979 - DNA, 20 bp, Homo sapiens
tcctgtgtacctcactgtcc

SEQ ID NO: 4409980 - DNA, 16 bp, Homo sapiens
tcctgtgtactgtgtc

SEQ ID NO: 4409981 - DNA, 13 bp, Homo sapiens
tcctgtgtttcat

SEQ ID NO: 4409982 - DNA, 17 bp, Homo sapiens
tcctgtgtttcattact

SEQ ID NO: 4409983 - DNA, 15 bp, Homo sapiens
tcctgttcacaccag

SEQ ID NO: 4409984 - DNA, 14 bp, Homo sapiens
tcctgttcagcatt

SEQ ID NO: 4409985 - DNA, 15 bp, Homo sapiens
tcctgttcagcattc

SEQ ID NO: 4409986 - DNA, 13 bp, Homo sapiens
tcctgttccctac

SEQ ID NO: 4409987 - DNA, 17 bp, Homo sapiens
tcctgttggtttcattt

SEQ ID NO: 4409988 - DNA, 16 bp, Homo sapiens
tcctgtttctgtcaag

SEQ ID NO: 4409989 - DNA, 13 bp, Homo sapiens
tcctgtttgtcta

SEQ ID NO: 4409990 - DNA, 20 bp, Homo sapiens
tcctgttttatatattatgt

SEQ ID NO: 4409991 - DNA, 14 bp, Homo sapiens
tcctgtttttcaca

SEQ ID NO: 4409992 - DNA, 20 bp, Homo sapiens
tccttaacccacctctcctg

SEQ ID NO: 4409993 - DNA, 19 bp, Homo sapiens
tccttaacctccagcagac

SEQ ID NO: 4409994 - DNA, 13 bp, Homo sapiens
tccttaagagatt

SEQ ID NO: 4409995 - DNA, 16 bp, Homo sapiens
tccttaaggctctttt

SEQ ID NO: 4409996 - DNA, 17 bp, Homo sapiens
tccttaatttaattgct

SEQ ID NO: 4409997 - DNA, 22 bp, Homo sapiens
tccttaatttaattgctttgaa

SEQ ID NO: 4409998 - DNA, 14 bp, Homo sapiens
tccttactgtgcat

SEQ ID NO: 4409999 - DNA, 15 bp, Homo sapiens
tccttacttttaagg

SEQ ID NO: 4410000 - DNA, 17 bp, Homo sapiens
tccttaggcctctgaga

SEQ ID NO: 4410001 - DNA, 21 bp, Homo sapiens
tccttataggcctgtcccttg

SEQ ID NO: 4410002 - DNA, 15 bp, Homo sapiens
tccttatccctctct

SEQ ID NO: 4410003 - DNA, 17 bp, Homo sapiens
tccttatccctctcttc

SEQ ID NO: 4410004 - DNA, 15 bp, Homo sapiens
tccttatttgccttc

SEQ ID NO: 4410005 - DNA, 21 bp, Homo sapiens
tccttcaaagtttaataaatt

SEQ ID NO: 4410006 - DNA, 13 bp, Homo sapiens
tccttcactctga

SEQ ID NO: 4410007 - DNA, 15 bp, Homo sapiens
tccttcactctgaca

SEQ ID NO: 4410008 - DNA, 19 bp, Homo sapiens
tccttcactctgacagtat

SEQ ID NO: 4410009 - DNA, 15 bp, Homo sapiens
tccttcactgtttca

SEQ ID NO: 4410010 - DNA, 13 bp, Homo sapiens
tccttcagcctga

SEQ ID NO: 4410011 - DNA, 14 bp, Homo sapiens
tccttcaggactct

SEQ ID NO: 4410012 - DNA, 15 bp, Homo sapiens
tccttcaggactctg

SEQ ID NO: 4410013 - DNA, 17 bp, Homo sapiens
tccttcagtgagcccct

SEQ ID NO: 4410014 - DNA, 18 bp, Homo sapiens
tccttcagtgagcccctc

SEQ ID NO: 4410015 - DNA, 19 bp, Homo sapiens
tccttcatttccaccaggc

SEQ ID NO: 4410016 - DNA, 15 bp, Homo sapiens
tccttccatcaaata

SEQ ID NO: 4410017 - DNA, 17 bp, Homo sapiens
tccttccatccctaccc

SEQ ID NO: 4410018 - DNA, 15 bp, Homo sapiens
tccttccccagaccc

SEQ ID NO: 4410019 - DNA, 22 bp, Homo sapiens
tccttccccagacccagaggtc

SEQ ID NO: 4410020 - DNA, 15 bp, Homo sapiens
tccttccctcctttt

SEQ ID NO: 4410021 - DNA, 15 bp, Homo sapiens
tccttccctctctga

SEQ ID NO: 4410022 - DNA, 15 bp, Homo sapiens
tccttccctgatggc

SEQ ID NO: 4410023 - DNA, 14 bp, Homo sapiens
tccttccctgttct

SEQ ID NO: 4410024 - DNA, 16 bp, Homo sapiens
tccttcctcctttcct

SEQ ID NO: 4410025 - DNA, 18 bp, Homo sapiens
tccttccttcaggactct

SEQ ID NO: 4410026 - DNA, 23 bp, Homo sapiens
tccttctaagacattctgttgga

SEQ ID NO: 4410027 - DNA, 17 bp, Homo sapiens
tccttctaccccaaggc

SEQ ID NO: 4410028 - DNA, 23 bp, Homo sapiens
tccttctaccccaaggccagtag

SEQ ID NO: 4410029 - DNA, 15 bp, Homo sapiens
tccttctattctagc

SEQ ID NO: 4410030 - DNA, 13 bp, Homo sapiens
tccttctgtagtg

SEQ ID NO: 4410031 - DNA, 21 bp, Homo sapiens
tccttctttgggatagagaat

SEQ ID NO: 4410032 - DNA, 16 bp, Homo sapiens
tccttgccccccgccc

SEQ ID NO: 4410033 - DNA, 22 bp, Homo sapiens
tccttgcctgtgacttggactt

SEQ ID NO: 4410034 - DNA, 13 bp, Homo sapiens
tccttggcacccc

SEQ ID NO: 4410035 - DNA, 18 bp, Homo sapiens
tccttggcacccccatgc

SEQ ID NO: 4410036 - DNA, 23 bp, Homo sapiens
tccttggcacccccatgctgcct

SEQ ID NO: 4410037 - DNA, 16 bp, Homo sapiens
tccttggccatgcaga

SEQ ID NO: 4410038 - DNA, 18 bp, Homo sapiens
tccttggctttcagagcc

SEQ ID NO: 4410039 - DNA, 22 bp, Homo sapiens
tccttgggccataattatgaaa

SEQ ID NO: 4410040 - DNA, 13 bp, Homo sapiens
tccttgggccctt

SEQ ID NO: 4410041 - DNA, 16 bp, Homo sapiens
tccttgggccctttga

SEQ ID NO: 4410042 - DNA, 13 bp, Homo sapiens
tccttggtgcctc

SEQ ID NO: 4410043 - DNA, 15 bp, Homo sapiens
tccttggtgcctctg

SEQ ID NO: 4410044 - DNA, 16 bp, Homo sapiens
tccttggttatatttt

SEQ ID NO: 4410045 - DNA, 16 bp, Homo sapiens
tccttgtccacccacc

SEQ ID NO: 4410046 - DNA, 20 bp, Homo sapiens
tccttgtcccgtctggacct

SEQ ID NO: 4410047 - DNA, 22 bp, Homo sapiens
tccttgtgacttacaatttgca

SEQ ID NO: 4410048 - DNA, 12 bp, Homo sapiens
tccttgtgcaaa

SEQ ID NO: 4410049 - DNA, 20 bp, Homo sapiens
tcctttaacataggttttta

SEQ ID NO: 4410050 - DNA, 15 bp, Homo sapiens
tcctttacctttcag

SEQ ID NO: 4410051 - DNA, 17 bp, Homo sapiens
tcctttacctttcagtg

SEQ ID NO: 4410052 - DNA, 15 bp, Homo sapiens
tcctttatctgtaat

SEQ ID NO: 4410053 - DNA, 23 bp, Homo sapiens
tcctttatgtgaatttttaagct

SEQ ID NO: 4410054 - DNA, 19 bp, Homo sapiens
tcctttctcctgtgaatgg

SEQ ID NO: 4410055 - DNA, 12 bp, Homo sapiens
tcctttcttttc

SEQ ID NO: 4410056 - DNA, 13 bp, Homo sapiens
tcctttcttttcc

SEQ ID NO: 4410057 - DNA, 20 bp, Homo sapiens
tcctttctttttcttcttcc

SEQ ID NO: 4410058 - DNA, 14 bp, Homo sapiens
tcctttgaaagact

SEQ ID NO: 4410059 - DNA, 15 bp, Homo sapiens
tcctttgaaagactg

SEQ ID NO: 4410060 - DNA, 18 bp, Homo sapiens
tcctttggtcctggtgct

SEQ ID NO: 4410061 - DNA, 17 bp, Homo sapiens
tcctttgtggttttatg

SEQ ID NO: 4410062 - DNA, 14 bp, Homo sapiens
tccttttaaagaaa

SEQ ID NO: 4410063 - DNA, 17 bp, Homo sapiens
tccttttaattttcctg

SEQ ID NO: 4410064 - DNA, 15 bp, Homo sapiens
tccttttccctgctt

SEQ ID NO: 4410065 - DNA, 16 bp, Homo sapiens
tccttttcctatcctt

SEQ ID NO: 4410066 - DNA, 11 bp, Homo sapiens
tccttttcctt

SEQ ID NO: 4410067 - DNA, 23 bp, Homo sapiens
tccttttccttatttgccttcta

SEQ ID NO: 4410068 - DNA, 17 bp, Homo sapiens
tccttttgcctgcaggt

SEQ ID NO: 4410069 - DNA, 21 bp, Homo sapiens
tccttttggcctgggggaggt

SEQ ID NO: 4410070 - DNA, 19 bp, Homo sapiens
tccttttgtccacttgtaa

SEQ ID NO: 4410071 - DNA, 13 bp, Homo sapiens
tcctttttattca

SEQ ID NO: 4410072 - DNA, 20 bp, Homo sapiens
tcctttttattccttttaaa

SEQ ID NO: 4410073 - DNA, 22 bp, Homo sapiens
tcctttttattccttttaaaat

SEQ ID NO: 4410074 - DNA, 20 bp, Homo sapiens
tcctttttccaatgttttat

SEQ ID NO: 4410075 - DNA, 13 bp, Homo sapiens
tcctttttctatg

SEQ ID NO: 4410076 - DNA, 19 bp, Homo sapiens
tccttttttgagatttttt

SEQ ID NO: 4410077 - DNA, 14 bp, Homo sapiens
tcctttttttgtac

SEQ ID NO: 4410078 - DNA, 12 bp, Homo sapiens
tcgaaaaaataa

SEQ ID NO: 4410079 - DNA, 14 bp, Homo sapiens
tcgaagcaaaagta

SEQ ID NO: 4410080 - DNA, 17 bp, Homo sapiens
tcgaagtgtttatgtaa

SEQ ID NO: 4410081 - DNA, 19 bp, Homo sapiens
tcgaatatatctgtaaaga

SEQ ID NO: 4410082 - DNA, 20 bp, Homo sapiens
tcgaatctactaattccaca

SEQ ID NO: 4410083 - DNA, 15 bp, Homo sapiens
tcgaatctctgcccc

SEQ ID NO: 4410084 - DNA, 12 bp, Homo sapiens
tcgaatgaaatt

SEQ ID NO: 4410085 - DNA, 17 bp, Homo sapiens
tcgaatgaaattaactg

SEQ ID NO: 4410086 - DNA, 21 bp, Homo sapiens
tcgacagggcctggagcccca

SEQ ID NO: 4410087 - DNA, 20 bp, Homo sapiens
tcgacccagaatggagcctg

SEQ ID NO: 4410088 - DNA, 13 bp, Homo sapiens
tcgaccctggggc

SEQ ID NO: 4410089 - DNA, 18 bp, Homo sapiens
tcgacgccccgaacctca

SEQ ID NO: 4410090 - DNA, 15 bp, Homo sapiens
tcgactctgctgctc

SEQ ID NO: 4410091 - DNA, 19 bp, Homo sapiens
tcgagaaagaggcaccagg

SEQ ID NO: 4410092 - DNA, 19 bp, Homo sapiens
tcgagaccatcctggctaa

SEQ ID NO: 4410093 - DNA, 14 bp, Homo sapiens
tcgagactgcaatg

SEQ ID NO: 4410094 - DNA, 11 bp, Homo sapiens
tcgagaggcac

SEQ ID NO: 4410095 - DNA, 22 bp, Homo sapiens
tcgagatcccaacactgccagc

SEQ ID NO: 4410096 - DNA, 19 bp, Homo sapiens
tcgagattgcactgctgca

SEQ ID NO: 4410097 - DNA, 16 bp, Homo sapiens
tcgagcccagatggaa

SEQ ID NO: 4410098 - DNA, 14 bp, Homo sapiens
tcgaggcctgcaaa

SEQ ID NO: 4410099 - DNA, 14 bp, Homo sapiens
tcgatccaaattgt

SEQ ID NO: 4410100 - DNA, 21 bp, Homo sapiens
tcgatccaaattgtgcttctc

SEQ ID NO: 4410101 - DNA, 14 bp, Homo sapiens
tcgatgcaatgaac

SEQ ID NO: 4410102 - DNA, 16 bp, Homo sapiens
tcgatggacctcagca

SEQ ID NO: 4410103 - DNA, 14 bp, Homo sapiens
tcgcaagttaactt

SEQ ID NO: 4410104 - DNA, 19 bp, Homo sapiens
tcgcaagttaacttggaaa

SEQ ID NO: 4410105 - DNA, 17 bp, Homo sapiens
tcgcaccactgcactcc

SEQ ID NO: 4410106 - DNA, 19 bp, Homo sapiens
tcgcagaccagagctgtct

SEQ ID NO: 4410107 - DNA, 19 bp, Homo sapiens
tcgcagagcttttcagatt

SEQ ID NO: 4410108 - DNA, 19 bp, Homo sapiens
tcgcattgctgtccttggg

SEQ ID NO: 4410109 - DNA, 22 bp, Homo sapiens
tcgcccacaagccttactcacc

SEQ ID NO: 4410110 - DNA, 18 bp, Homo sapiens
tcgcccagacaccatgtg

SEQ ID NO: 4410111 - DNA, 11 bp, Homo sapiens
tcgcccagcag

SEQ ID NO: 4410112 - DNA, 15 bp, Homo sapiens
tcgcccagcaggaga

SEQ ID NO: 4410113 - DNA, 12 bp, Homo sapiens
tcgcccaggctg

SEQ ID NO: 4410114 - DNA, 17 bp, Homo sapiens
tcgcccaggctggactg

SEQ ID NO: 4410115 - DNA, 20 bp, Homo sapiens
tcgcccaggctggactgcag

SEQ ID NO: 4410116 - DNA, 12 bp, Homo sapiens
tcgccccagcct

SEQ ID NO: 4410117 - DNA, 20 bp, Homo sapiens
tcgccccaggccctccctga

SEQ ID NO: 4410118 - DNA, 16 bp, Homo sapiens
tcgccccgtgtttgcg

SEQ ID NO: 4410119 - DNA, 12 bp, Homo sapiens
tcgcctgcctgc

SEQ ID NO: 4410120 - DNA, 18 bp, Homo sapiens
tcgccttcttagagtttt

SEQ ID NO: 4410121 - DNA, 20 bp, Homo sapiens
tcgccttcttagagttttat

SEQ ID NO: 4410122 - DNA, 17 bp, Homo sapiens
tcgcgagtgtaactttc

SEQ ID NO: 4410123 - DNA, 14 bp, Homo sapiens
tcgcggtcttgggc

SEQ ID NO: 4410124 - DNA, 14 bp, Homo sapiens
tcgctagtgtttaa

SEQ ID NO: 4410125 - DNA, 16 bp, Homo sapiens
tcgctcaccgctggcc

SEQ ID NO: 4410126 - DNA, 14 bp, Homo sapiens
tcgctcagtctgtt

SEQ ID NO: 4410127 - DNA, 22 bp, Homo sapiens
tcgctccctgtagctctgcctc

SEQ ID NO: 4410128 - DNA, 17 bp, Homo sapiens
tcgctctgtcgcccagg

SEQ ID NO: 4410129 - DNA, 18 bp, Homo sapiens
tcgctctgtcgcccaggc

SEQ ID NO: 4410130 - DNA, 20 bp, Homo sapiens
tcgctctgtcgcccaggctg

SEQ ID NO: 4410131 - DNA, 22 bp, Homo sapiens
tcgctgccctgtggacaggatg

SEQ ID NO: 4410132 - DNA, 16 bp, Homo sapiens
tcgctgtgattttaag

SEQ ID NO: 4410133 - DNA, 15 bp, Homo sapiens
tcgctgttctgggca

SEQ ID NO: 4410134 - DNA, 19 bp, Homo sapiens
tcgctgttctgggcatggc

SEQ ID NO: 4410135 - DNA, 22 bp, Homo sapiens
tcgcttcttagaacagtggaaa

SEQ ID NO: 4410136 - DNA, 14 bp, Homo sapiens
tcgcttgcttctgc

SEQ ID NO: 4410137 - DNA, 13 bp, Homo sapiens
tcggaaaaataat

SEQ ID NO: 4410138 - DNA, 18 bp, Homo sapiens
tcggacccaccccaactc

SEQ ID NO: 4410139 - DNA, 20 bp, Homo sapiens
tcggacccaccccaactctc

SEQ ID NO: 4410140 - DNA, 11 bp, Homo sapiens
tcggactgcca

SEQ ID NO: 4410141 - DNA, 17 bp, Homo sapiens
tcggagactatggcctc

SEQ ID NO: 4410142 - DNA, 22 bp, Homo sapiens
tcggagactatggcctcgcctc

SEQ ID NO: 4410143 - DNA, 19 bp, Homo sapiens
tcggaggctgggcccctgg

SEQ ID NO: 4410144 - DNA, 13 bp, Homo sapiens
tcggatctcacag

SEQ ID NO: 4410145 - DNA, 19 bp, Homo sapiens
tcggatgaccatactcaga

SEQ ID NO: 4410146 - DNA, 16 bp, Homo sapiens
tcggatggaccaacct

SEQ ID NO: 4410147 - DNA, 20 bp, Homo sapiens
tcggatggaccaacctgctc

SEQ ID NO: 4410148 - DNA, 21 bp, Homo sapiens
tcggatggaccaacctgctct

SEQ ID NO: 4410149 - DNA, 22 bp, Homo sapiens
tcggatggaccaacctgctctg

SEQ ID NO: 4410150 - DNA, 16 bp, Homo sapiens
tcggattttttccaaa

SEQ ID NO: 4410151 - DNA, 14 bp, Homo sapiens
tcggcaccttcccc

SEQ ID NO: 4410152 - DNA, 16 bp, Homo sapiens
tcggcatagtccccag

SEQ ID NO: 4410153 - DNA, 23 bp, Homo sapiens
tcggcccacagctcccaccccac

SEQ ID NO: 4410154 - DNA, 15 bp, Homo sapiens
tcggccccaccagtg

SEQ ID NO: 4410155 - DNA, 18 bp, Homo sapiens
tcggccccaccagtgcct

SEQ ID NO: 4410156 - DNA, 23 bp, Homo sapiens
tcggcccctgtctgttcccagcc

SEQ ID NO: 4410157 - DNA, 17 bp, Homo sapiens
tcggcctccgaggctcc

SEQ ID NO: 4410158 - DNA, 17 bp, Homo sapiens
tcggcctctaaccccag

SEQ ID NO: 4410159 - DNA, 18 bp, Homo sapiens
tcggcctctaaccccagg

SEQ ID NO: 4410160 - DNA, 20 bp, Homo sapiens
tcggcctctaaccccaggcc

SEQ ID NO: 4410161 - DNA, 21 bp, Homo sapiens
tcggcctctaaccccaggccc

SEQ ID NO: 4410162 - DNA, 19 bp, Homo sapiens
tcggctggggactgctacc

SEQ ID NO: 4410163 - DNA, 20 bp, Homo sapiens
tcggctggggactgctacct

SEQ ID NO: 4410164 - DNA, 13 bp, Homo sapiens
tcgggacagctgt

SEQ ID NO: 4410165 - DNA, 16 bp, Homo sapiens
tcgggacagctgtgcc

SEQ ID NO: 4410166 - DNA, 16 bp, Homo sapiens
tcgggagcacccagag

SEQ ID NO: 4410167 - DNA, 18 bp, Homo sapiens
tcgggagcacccagagca

SEQ ID NO: 4410168 - DNA, 16 bp, Homo sapiens
tcgggcagccagcaga

SEQ ID NO: 4410169 - DNA, 14 bp, Homo sapiens
tcgggcttccctgg

SEQ ID NO: 4410170 - DNA, 18 bp, Homo sapiens
tcgggcttccctggcctc

SEQ ID NO: 4410171 - DNA, 15 bp, Homo sapiens
tcggggaactcctgg

SEQ ID NO: 4410172 - DNA, 15 bp, Homo sapiens
tcggtgtgctgccaa

SEQ ID NO: 4410173 - DNA, 16 bp, Homo sapiens
tcgtacagaaagctgc

SEQ ID NO: 4410174 - DNA, 18 bp, Homo sapiens
tcgtagtccatcaccatt

SEQ ID NO: 4410175 - DNA, 16 bp, Homo sapiens
tcgtcaactttcctca

SEQ ID NO: 4410176 - DNA, 14 bp, Homo sapiens
tcgtcaccccagcc

SEQ ID NO: 4410177 - DNA, 14 bp, Homo sapiens
tcgtcctccccctg

SEQ ID NO: 4410178 - DNA, 16 bp, Homo sapiens
tcgtcctccccctgcc

SEQ ID NO: 4410179 - DNA, 12 bp, Homo sapiens
tcgtgaaatcct

SEQ ID NO: 4410180 - DNA, 15 bp, Homo sapiens
tcgtgagctggggac

SEQ ID NO: 4410181 - DNA, 19 bp, Homo sapiens
tcgtgagtcatttaaatgt

SEQ ID NO: 4410182 - DNA, 11 bp, Homo sapiens
tcgtgatgtgg

SEQ ID NO: 4410183 - DNA, 20 bp, Homo sapiens
tcgtgatgtggaggaagagc

SEQ ID NO: 4410184 - DNA, 17 bp, Homo sapiens
tcgtgcctgagaccagg

SEQ ID NO: 4410185 - DNA, 22 bp, Homo sapiens
tcgtgctactgcactccagcct

SEQ ID NO: 4410186 - DNA, 22 bp, Homo sapiens
tcgtggacacacacagactatt

SEQ ID NO: 4410187 - DNA, 19 bp, Homo sapiens
tcgtggcacgtattgctgt

SEQ ID NO: 4410188 - DNA, 20 bp, Homo sapiens
tcgtggtaggactgtagaaa

SEQ ID NO: 4410189 - DNA, 21 bp, Homo sapiens
tcgtgtgtttctattttttga

SEQ ID NO: 4410190 - DNA, 18 bp, Homo sapiens
tcgtgtttgcttaaaata

SEQ ID NO: 4410191 - DNA, 23 bp, Homo sapiens
tcgtgtttgcttaaaatatgtga

SEQ ID NO: 4410192 - DNA, 20 bp, Homo sapiens
tcgttggtgaccagtttctt

SEQ ID NO: 4410193 - DNA, 21 bp, Homo sapiens
tcgttgtcacacccatggcct

SEQ ID NO: 4410194 - DNA, 22 bp, Homo sapiens
tcgtttaccttcaaactttagg

SEQ ID NO: 4410195 - DNA, 18 bp, Homo sapiens
tcgtttagaatcagaata

SEQ ID NO: 4410196 - DNA, 14 bp, Homo sapiens
tcgttttttacaaa

SEQ ID NO: 4410197 - DNA, 18 bp, Homo sapiens
tctaaaaagatgtaataa

SEQ ID NO: 4410198 - DNA, 13 bp, Homo sapiens
tctaaaatgtttt

SEQ ID NO: 4410199 - DNA, 22 bp, Homo sapiens
tctaaaatttcataattctgaa

SEQ ID NO: 4410200 - DNA, 21 bp, Homo sapiens
tctaaacagaaattattttct

SEQ ID NO: 4410201 - DNA, 22 bp, Homo sapiens
tctaaacagacaggaatttaga

SEQ ID NO: 4410202 - DNA, 19 bp, Homo sapiens
tctaaacccaatccaaatg

SEQ ID NO: 4410203 - DNA, 19 bp, Homo sapiens
tctaaagctggtttaatgt

SEQ ID NO: 4410204 - DNA, 21 bp, Homo sapiens
tctaaagctggtttaatgttt

SEQ ID NO: 4410205 - DNA, 18 bp, Homo sapiens
tctaaagcttctataaaa

SEQ ID NO: 4410206 - DNA, 23 bp, Homo sapiens
tctaaagctttatctttgtgtaa

SEQ ID NO: 4410207 - DNA, 12 bp, Homo sapiens
tctaaagttata

SEQ ID NO: 4410208 - DNA, 14 bp, Homo sapiens
tctaaagttatatt

SEQ ID NO: 4410209 - DNA, 17 bp, Homo sapiens
tctaaagttatatttca

SEQ ID NO: 4410210 - DNA, 22 bp, Homo sapiens
tctaaatatcccttggacattt

SEQ ID NO: 4410211 - DNA, 17 bp, Homo sapiens
tctaaatcatatataat

SEQ ID NO: 4410212 - DNA, 11 bp, Homo sapiens
tctaaatgcaa

SEQ ID NO: 4410213 - DNA, 16 bp, Homo sapiens
tctaaatgcaataaga

SEQ ID NO: 4410214 - DNA, 23 bp, Homo sapiens
tctaacactcgactctgctgctc

SEQ ID NO: 4410215 - DNA, 12 bp, Homo sapiens
tctaacagccct

SEQ ID NO: 4410216 - DNA, 22 bp, Homo sapiens
tctaacagccctcctctgcact

SEQ ID NO: 4410217 - DNA, 18 bp, Homo sapiens
tctaacatatgatactga

SEQ ID NO: 4410218 - DNA, 24 bp, Homo sapiens
tctaacatatgatactgatgccat

SEQ ID NO: 4410219 - DNA, 13 bp, Homo sapiens
tctaacattttct

SEQ ID NO: 4410220 - DNA, 14 bp, Homo sapiens
tctaacattttcta

SEQ ID NO: 4410221 - DNA, 19 bp, Homo sapiens
tctaaccacttaaggacct

SEQ ID NO: 4410222 - DNA, 18 bp, Homo sapiens
tctaacccagtggctgga

SEQ ID NO: 4410223 - DNA, 15 bp, Homo sapiens
tctaactcctgccat

SEQ ID NO: 4410224 - DNA, 16 bp, Homo sapiens
tctaagaaatatctgt

SEQ ID NO: 4410225 - DNA, 23 bp, Homo sapiens
tctaagaaatatctgtgaaatat

SEQ ID NO: 4410226 - DNA, 19 bp, Homo sapiens
tctaagaagacattttgtt

SEQ ID NO: 4410227 - DNA, 20 bp, Homo sapiens
tctaagaatttctgctaaat

SEQ ID NO: 4410228 - DNA, 21 bp, Homo sapiens
tctaagactactaaggccttt

SEQ ID NO: 4410229 - DNA, 15 bp, Homo sapiens
tctaagactctgtgt

SEQ ID NO: 4410230 - DNA, 18 bp, Homo sapiens
tctaagatacactgcact

SEQ ID NO: 4410231 - DNA, 17 bp, Homo sapiens
tctaagcaagtgaactc

SEQ ID NO: 4410232 - DNA, 17 bp, Homo sapiens
tctaagcataaaagatg

SEQ ID NO: 4410233 - DNA, 15 bp, Homo sapiens
tctaagtatatgtga

SEQ ID NO: 4410234 - DNA, 18 bp, Homo sapiens
tctaagtgcctcacattt

SEQ ID NO: 4410235 - DNA, 19 bp, Homo sapiens
tctaataaagtagttatta

SEQ ID NO: 4410236 - DNA, 14 bp, Homo sapiens
tctaataaatcagt

SEQ ID NO: 4410237 - DNA, 21 bp, Homo sapiens
tctaataaatcagtgaactgt

SEQ ID NO: 4410238 - DNA, 22 bp, Homo sapiens
tctaataaatcagtgaactgtt

SEQ ID NO: 4410239 - DNA, 15 bp, Homo sapiens
tctaatagtttttca

SEQ ID NO: 4410240 - DNA, 20 bp, Homo sapiens
tctaatatccccaaattagg

SEQ ID NO: 4410241 - DNA, 12 bp, Homo sapiens
tctaatattgct

SEQ ID NO: 4410242 - DNA, 17 bp, Homo sapiens
tctaatcagattgctta

SEQ ID NO: 4410243 - DNA, 23 bp, Homo sapiens
tctaatcagattgcttaaaagca

SEQ ID NO: 4410244 - DNA, 17 bp, Homo sapiens
tctaatccttttcctta

SEQ ID NO: 4410245 - DNA, 12 bp, Homo sapiens
tctaatctgaac

SEQ ID NO: 4410246 - DNA, 13 bp, Homo sapiens
tctaatctgaact

SEQ ID NO: 4410247 - DNA, 15 bp, Homo sapiens
tctaatctgaactga

SEQ ID NO: 4410248 - DNA, 19 bp, Homo sapiens
tctaatgattcaaatgttt

SEQ ID NO: 4410249 - DNA, 14 bp, Homo sapiens
tctaatgcttgttt

SEQ ID NO: 4410250 - DNA, 21 bp, Homo sapiens
tctaatggattataatcagaa

SEQ ID NO: 4410251 - DNA, 15 bp, Homo sapiens
tctaattaaaattgt

SEQ ID NO: 4410252 - DNA, 18 bp, Homo sapiens
tctaattaaccttactaa

SEQ ID NO: 4410253 - DNA, 13 bp, Homo sapiens
tctacaaagcact

SEQ ID NO: 4410254 - DNA, 13 bp, Homo sapiens
tctacaagccaaa

SEQ ID NO: 4410255 - DNA, 23 bp, Homo sapiens
tctacaagccaaaagtccctccc

SEQ ID NO: 4410256 - DNA, 19 bp, Homo sapiens
tctacacactcagccacaa

SEQ ID NO: 4410257 - DNA, 18 bp, Homo sapiens
tctacaccaatgaaaaca

SEQ ID NO: 4410258 - DNA, 19 bp, Homo sapiens
tctacaccaatgaaaacat

SEQ ID NO: 4410259 - DNA, 21 bp, Homo sapiens
tctacaccaatgaaaacatgt

SEQ ID NO: 4410260 - DNA, 21 bp, Homo sapiens
tctacacctcctttaagattt

SEQ ID NO: 4410261 - DNA, 12 bp, Homo sapiens
tctacactctcc

SEQ ID NO: 4410262 - DNA, 16 bp, Homo sapiens
tctacactctcctggg

SEQ ID NO: 4410263 - DNA, 21 bp, Homo sapiens
tctacactgggtgctgatcct

SEQ ID NO: 4410264 - DNA, 18 bp, Homo sapiens
tctacagagcttccctga

SEQ ID NO: 4410265 - DNA, 22 bp, Homo sapiens
tctacaggcctcttcctgttgt

SEQ ID NO: 4410266 - DNA, 15 bp, Homo sapiens
tctacagtaatgaaa

SEQ ID NO: 4410267 - DNA, 16 bp, Homo sapiens
tctacagtaatgaaat

SEQ ID NO: 4410268 - DNA, 15 bp, Homo sapiens
tctacattcttggtt

SEQ ID NO: 4410269 - DNA, 12 bp, Homo sapiens
tctacatttcac

SEQ ID NO: 4410270 - DNA, 22 bp, Homo sapiens
tctacatttcacattattctgg

SEQ ID NO: 4410271 - DNA, 17 bp, Homo sapiens
tctaccacacacagcct

SEQ ID NO: 4410272 - DNA, 18 bp, Homo sapiens
tctaccacacacagcctg

SEQ ID NO: 4410273 - DNA, 23 bp, Homo sapiens
tctaccagattctgcctatgtaa

SEQ ID NO: 4410274 - DNA, 16 bp, Homo sapiens
tctaccatggttctgc

SEQ ID NO: 4410275 - DNA, 23 bp, Homo sapiens
tctaccatggttctgcctcctgg

SEQ ID NO: 4410276 - DNA, 16 bp, Homo sapiens
tctaccccaaggccag

SEQ ID NO: 4410277 - DNA, 18 bp, Homo sapiens
tctaccccagactagatg

SEQ ID NO: 4410278 - DNA, 16 bp, Homo sapiens
tctacctacatatttg

SEQ ID NO: 4410279 - DNA, 17 bp, Homo sapiens
tctacctacatatttgt

SEQ ID NO: 4410280 - DNA, 13 bp, Homo sapiens
tctacctgagcat

SEQ ID NO: 4410281 - DNA, 14 bp, Homo sapiens
tctacctgagcatt

SEQ ID NO: 4410282 - DNA, 22 bp, Homo sapiens
tctacctgagcattcaggcagc

SEQ ID NO: 4410283 - DNA, 15 bp, Homo sapiens
tctacctgccactca

SEQ ID NO: 4410284 - DNA, 18 bp, Homo sapiens
tctacctgccctcaaggg

SEQ ID NO: 4410285 - DNA, 12 bp, Homo sapiens
tctaccttcctg

SEQ ID NO: 4410286 - DNA, 17 bp, Homo sapiens
tctaccttcctgtccct

SEQ ID NO: 4410287 - DNA, 22 bp, Homo sapiens
tctactaaaaatacaaaaaaat

SEQ ID NO: 4410288 - DNA, 21 bp, Homo sapiens
tctactaaaattcaaaaacaa

SEQ ID NO: 4410289 - DNA, 20 bp, Homo sapiens
tctactatgatcagaagaac

SEQ ID NO: 4410290 - DNA, 19 bp, Homo sapiens
tctactcctagaagaacca

SEQ ID NO: 4410291 - DNA, 14 bp, Homo sapiens
tctactcctgcctc

SEQ ID NO: 4410292 - DNA, 22 bp, Homo sapiens
tctactgaattggcttccagat

SEQ ID NO: 4410293 - DNA, 20 bp, Homo sapiens
tctactggaaatgtagcact

SEQ ID NO: 4410294 - DNA, 22 bp, Homo sapiens
tctactttagaatgagagtgtg

SEQ ID NO: 4410295 - DNA, 19 bp, Homo sapiens
tctactttcatcttaaact

SEQ ID NO: 4410296 - DNA, 15 bp, Homo sapiens
tctacttttaactaa

SEQ ID NO: 4410297 - DNA, 17 bp, Homo sapiens
tctagaactatcatttt

SEQ ID NO: 4410298 - DNA, 19 bp, Homo sapiens
tctagaactatcattttta

SEQ ID NO: 4410299 - DNA, 18 bp, Homo sapiens
tctagaagagtctattgt

SEQ ID NO: 4410300 - DNA, 19 bp, Homo sapiens
tctagaagagtctattgtc

SEQ ID NO: 4410301 - DNA, 20 bp, Homo sapiens
tctagaagccaagggaaagg

SEQ ID NO: 4410302 - DNA, 18 bp, Homo sapiens
tctagaatgtaaagttat

SEQ ID NO: 4410303 - DNA, 17 bp, Homo sapiens
tctagaatttagtgata

SEQ ID NO: 4410304 - DNA, 14 bp, Homo sapiens
tctagacgcccctc

SEQ ID NO: 4410305 - DNA, 13 bp, Homo sapiens
tctagacttcccc

SEQ ID NO: 4410306 - DNA, 14 bp, Homo sapiens
tctagacttcccca

SEQ ID NO: 4410307 - DNA, 17 bp, Homo sapiens
tctagagcttagcatat

SEQ ID NO: 4410308 - DNA, 20 bp, Homo sapiens
tctagatacaataaattgct

SEQ ID NO: 4410309 - DNA, 14 bp, Homo sapiens
tctagatctcagcc

SEQ ID NO: 4410310 - DNA, 20 bp, Homo sapiens
tctagatgaagttttacatt

SEQ ID NO: 4410311 - DNA, 22 bp, Homo sapiens
tctagatgattttttgaaagtt

SEQ ID NO: 4410312 - DNA, 14 bp, Homo sapiens
tctagcactggcct

SEQ ID NO: 4410313 - DNA, 17 bp, Homo sapiens
tctagcactggcctgca

SEQ ID NO: 4410314 - DNA, 18 bp, Homo sapiens
tctagcatttatttctct

SEQ ID NO: 4410315 - DNA, 11 bp, Homo sapiens
tctagcctgca

SEQ ID NO: 4410316 - DNA, 21 bp, Homo sapiens
tctaggacacagttcctggga

SEQ ID NO: 4410317 - DNA, 18 bp, Homo sapiens
tctaggagctgggaggaa

SEQ ID NO: 4410318 - DNA, 20 bp, Homo sapiens
tctaggagtcaactggctgg

SEQ ID NO: 4410319 - DNA, 15 bp, Homo sapiens
tctaggatgaacaat

SEQ ID NO: 4410320 - DNA, 20 bp, Homo sapiens
tctaggattgggcctcccat

SEQ ID NO: 4410321 - DNA, 21 bp, Homo sapiens
tctaggcttcaggttgcattg

SEQ ID NO: 4410322 - DNA, 23 bp, Homo sapiens
tctaggcttcaggttgcattggg

SEQ ID NO: 4410323 - DNA, 22 bp, Homo sapiens
tctagggacatgaaatttacaa

SEQ ID NO: 4410324 - DNA, 17 bp, Homo sapiens
tctaggggctgtacagt

SEQ ID NO: 4410325 - DNA, 16 bp, Homo sapiens
tctaggtctcctcagg

SEQ ID NO: 4410326 - DNA, 20 bp, Homo sapiens
tctaggttaaagctaaactg

SEQ ID NO: 4410327 - DNA, 21 bp, Homo sapiens
tctaggttaaagctaaactga

SEQ ID NO: 4410328 - DNA, 19 bp, Homo sapiens
tctagtagctgaaatgcaa

SEQ ID NO: 4410329 - DNA, 17 bp, Homo sapiens
tctagtattttatctgg

SEQ ID NO: 4410330 - DNA, 22 bp, Homo sapiens
tctagtattttatctggaacaa

SEQ ID NO: 4410331 - DNA, 15 bp, Homo sapiens
tctagttctgccagg

SEQ ID NO: 4410332 - DNA, 16 bp, Homo sapiens
tctagttctttcctcc

SEQ ID NO: 4410333 - DNA, 21 bp, Homo sapiens
tctagttctttcctccccctg

SEQ ID NO: 4410334 - DNA, 19 bp, Homo sapiens
tctagttgaggagtttcct

SEQ ID NO: 4410335 - DNA, 20 bp, Homo sapiens
tctagttgaggagtttccta

SEQ ID NO: 4410336 - DNA, 21 bp, Homo sapiens
tctagttgaggagtttcctaa

SEQ ID NO: 4410337 - DNA, 12 bp, Homo sapiens
tctagtttgttt

SEQ ID NO: 4410338 - DNA, 21 bp, Homo sapiens
tctagtttttggaaaaacctt

SEQ ID NO: 4410339 - DNA, 13 bp, Homo sapiens
tctataaagggtc

SEQ ID NO: 4410340 - DNA, 14 bp, Homo sapiens
tctataaagggtca

SEQ ID NO: 4410341 - DNA, 21 bp, Homo sapiens
tctataaatttaagaaaacaa

SEQ ID NO: 4410342 - DNA, 14 bp, Homo sapiens
tctataacaaatgc

SEQ ID NO: 4410343 - DNA, 13 bp, Homo sapiens
tctataaggccat

SEQ ID NO: 4410344 - DNA, 16 bp, Homo sapiens
tctataatttacctaa

SEQ ID NO: 4410345 - DNA, 15 bp, Homo sapiens
tctatacccacccag

SEQ ID NO: 4410346 - DNA, 15 bp, Homo sapiens
tctatactaatgctt

SEQ ID NO: 4410347 - DNA, 19 bp, Homo sapiens
tctatagccaaaaatagct

SEQ ID NO: 4410348 - DNA, 18 bp, Homo sapiens
tctataggaacatatgaa

SEQ ID NO: 4410349 - DNA, 15 bp, Homo sapiens
tctatataaaataac

SEQ ID NO: 4410350 - DNA, 16 bp, Homo sapiens
tctatatcttcttata

SEQ ID NO: 4410351 - DNA, 14 bp, Homo sapiens
tctatattaaatga

SEQ ID NO: 4410352 - DNA, 22 bp, Homo sapiens
tctatattattgcccatgatat

SEQ ID NO: 4410353 - DNA, 19 bp, Homo sapiens
tctatcatttttgagcaac

SEQ ID NO: 4410354 - DNA, 22 bp, Homo sapiens
tctatccaaacatgtatttatg

SEQ ID NO: 4410355 - DNA, 14 bp, Homo sapiens
tctatctaatgaca

SEQ ID NO: 4410356 - DNA, 16 bp, Homo sapiens
tctatctaatgacatg

SEQ ID NO: 4410357 - DNA, 12 bp, Homo sapiens
tctatctcatct

SEQ ID NO: 4410358 - DNA, 14 bp, Homo sapiens
tctatctggtatta

SEQ ID NO: 4410359 - DNA, 21 bp, Homo sapiens
tctatctggtattaaatgcca

SEQ ID NO: 4410360 - DNA, 22 bp, Homo sapiens
tctatgagggtgtttcctctaa

SEQ ID NO: 4410361 - DNA, 13 bp, Homo sapiens
tctatgcaggcag

SEQ ID NO: 4410362 - DNA, 19 bp, Homo sapiens
tctatggagactttgctgt

SEQ ID NO: 4410363 - DNA, 20 bp, Homo sapiens
tctatggagactttgctgtt

SEQ ID NO: 4410364 - DNA, 15 bp, Homo sapiens
tctatggattcactt

SEQ ID NO: 4410365 - DNA, 17 bp, Homo sapiens
tctatggctttaaataa

SEQ ID NO: 4410366 - DNA, 15 bp, Homo sapiens
tctatggctttcaaa

SEQ ID NO: 4410367 - DNA, 13 bp, Homo sapiens
tctatgggaagat

SEQ ID NO: 4410368 - DNA, 19 bp, Homo sapiens
tctatgtatgttaatttat

SEQ ID NO: 4410369 - DNA, 20 bp, Homo sapiens
tctatgtatgttaatttatt

SEQ ID NO: 4410370 - DNA, 23 bp, Homo sapiens
tctatgtatgttaatttatttag

SEQ ID NO: 4410371 - DNA, 21 bp, Homo sapiens
tctatgtcatttttaatgtat

SEQ ID NO: 4410372 - DNA, 22 bp, Homo sapiens
tctatgtcatttttaatgtatc

SEQ ID NO: 4410373 - DNA, 16 bp, Homo sapiens
tctatgtctgccttcg

SEQ ID NO: 4410374 - DNA, 13 bp, Homo sapiens
tctattagatttt

SEQ ID NO: 4410375 - DNA, 12 bp, Homo sapiens
tctattcagctt

SEQ ID NO: 4410376 - DNA, 13 bp, Homo sapiens
tctattctgtcag

SEQ ID NO: 4410377 - DNA, 16 bp, Homo sapiens
tctattgatgtacagt

SEQ ID NO: 4410378 - DNA, 15 bp, Homo sapiens
tctattgatttgaaa

SEQ ID NO: 4410379 - DNA, 16 bp, Homo sapiens
tctattgatttgaaaa

SEQ ID NO: 4410380 - DNA, 21 bp, Homo sapiens
tctattgtgtggatgaccaca

SEQ ID NO: 4410381 - DNA, 17 bp, Homo sapiens
tctatttaaaaaactgt

SEQ ID NO: 4410382 - DNA, 16 bp, Homo sapiens
tctatttaagtgcaat

SEQ ID NO: 4410383 - DNA, 13 bp, Homo sapiens
tctatttaatttt

SEQ ID NO: 4410384 - DNA, 23 bp, Homo sapiens
tctatttaattttgacactgaaa

SEQ ID NO: 4410385 - DNA, 22 bp, Homo sapiens
tctatttagccagcgtttattg

SEQ ID NO: 4410386 - DNA, 13 bp, Homo sapiens
tctatttatttat

SEQ ID NO: 4410387 - DNA, 14 bp, Homo sapiens
tctatttctcctcc

SEQ ID NO: 4410388 - DNA, 16 bp, Homo sapiens
tctatttctcctccat

SEQ ID NO: 4410389 - DNA, 18 bp, Homo sapiens
tctatttgaataaattat

SEQ ID NO: 4410390 - DNA, 12 bp, Homo sapiens
tctatttgtaca

SEQ ID NO: 4410391 - DNA, 14 bp, Homo sapiens
tctatttgtacaat

SEQ ID NO: 4410392 - DNA, 14 bp, Homo sapiens
tctattttaaagac

SEQ ID NO: 4410393 - DNA, 23 bp, Homo sapiens
tctattttacttttctgccaaaa

SEQ ID NO: 4410394 - DNA, 18 bp, Homo sapiens
tctattttattttattga

SEQ ID NO: 4410395 - DNA, 13 bp, Homo sapiens
tctattttgatgc

SEQ ID NO: 4410396 - DNA, 23 bp, Homo sapiens
tctattttgatgcagcatttgat

SEQ ID NO: 4410397 - DNA, 13 bp, Homo sapiens
tctatttttaatg

SEQ ID NO: 4410398 - DNA, 13 bp, Homo sapiens
tctatttttacat

SEQ ID NO: 4410399 - DNA, 22 bp, Homo sapiens
tctcaaaaaaaagaaaatgtct

SEQ ID NO: 4410400 - DNA, 15 bp, Homo sapiens
tctcaaattcagctc

SEQ ID NO: 4410401 - DNA, 18 bp, Homo sapiens
tctcaacatactgtaatc

SEQ ID NO: 4410402 - DNA, 12 bp, Homo sapiens
tctcaagaatct

SEQ ID NO: 4410403 - DNA, 15 bp, Homo sapiens
tctcaagaatctaga

SEQ ID NO: 4410404 - DNA, 17 bp, Homo sapiens
tctcaagctagccagag

SEQ ID NO: 4410405 - DNA, 22 bp, Homo sapiens
tctcaagctatgatcagaagac

SEQ ID NO: 4410406 - DNA, 22 bp, Homo sapiens
tctcaatcctaatttctcctcc

SEQ ID NO: 4410407 - DNA, 17 bp, Homo sapiens
tctcaattgaaagcttt

SEQ ID NO: 4410408 - DNA, 24 bp, Homo sapiens
tctcacacgtttaatcccagcact

SEQ ID NO: 4410409 - DNA, 19 bp, Homo sapiens
tctcacaggctgagaactc

SEQ ID NO: 4410410 - DNA, 14 bp, Homo sapiens
tctcacccaggcaa

SEQ ID NO: 4410411 - DNA, 12 bp, Homo sapiens
tctcacctcagc

SEQ ID NO: 4410412 - DNA, 18 bp, Homo sapiens
tctcacctttcccacctc

SEQ ID NO: 4410413 - DNA, 20 bp, Homo sapiens
tctcacctttcccacctctc

SEQ ID NO: 4410414 - DNA, 14 bp, Homo sapiens
tctcacgctttgtt

SEQ ID NO: 4410415 - DNA, 17 bp, Homo sapiens
tctcacgctttgtttac

SEQ ID NO: 4410416 - DNA, 18 bp, Homo sapiens
tctcacgctttgtttact

SEQ ID NO: 4410417 - DNA, 20 bp, Homo sapiens
tctcacgggcagtagctgtg

SEQ ID NO: 4410418 - DNA, 17 bp, Homo sapiens
tctcactatatatattt

SEQ ID NO: 4410419 - DNA, 15 bp, Homo sapiens
tctcactccaccacc

SEQ ID NO: 4410420 - DNA, 16 bp, Homo sapiens
tctcactcccctctcc

SEQ ID NO: 4410421 - DNA, 15 bp, Homo sapiens
tctcactgtttgttt

SEQ ID NO: 4410422 - DNA, 15 bp, Homo sapiens
tctcacttagtcctt

SEQ ID NO: 4410423 - DNA, 13 bp, Homo sapiens
tctcacttctaaa

SEQ ID NO: 4410424 - DNA, 17 bp, Homo sapiens
tctcactttgtaaataa

SEQ ID NO: 4410425 - DNA, 12 bp, Homo sapiens
tctcagaatccc

SEQ ID NO: 4410426 - DNA, 18 bp, Homo sapiens
tctcagaatgtcattttg

SEQ ID NO: 4410427 - DNA, 21 bp, Homo sapiens
tctcagacactaaatgcagac

SEQ ID NO: 4410428 - DNA, 16 bp, Homo sapiens
tctcagagctctcgag

SEQ ID NO: 4410429 - DNA, 20 bp, Homo sapiens
tctcagatgttaaaataaat

SEQ ID NO: 4410430 - DNA, 18 bp, Homo sapiens
tctcagattcttcactgg

SEQ ID NO: 4410431 - DNA, 18 bp, Homo sapiens
tctcagcagcgaccaccc

SEQ ID NO: 4410432 - DNA, 19 bp, Homo sapiens
tctcagccataggtgcagt

SEQ ID NO: 4410433 - DNA, 18 bp, Homo sapiens
tctcagcccagaagaaaa

SEQ ID NO: 4410434 - DNA, 13 bp, Homo sapiens
tctcagcctccca

SEQ ID NO: 4410435 - DNA, 14 bp, Homo sapiens
tctcagcctcccac

SEQ ID NO: 4410436 - DNA, 19 bp, Homo sapiens
tctcagcctctgccagcgc

SEQ ID NO: 4410437 - DNA, 22 bp, Homo sapiens
tctcagcgaggtgtaaagttgt

SEQ ID NO: 4410438 - DNA, 15 bp, Homo sapiens
tctcagctataattc

SEQ ID NO: 4410439 - DNA, 20 bp, Homo sapiens
tctcagctgctggatgactt

SEQ ID NO: 4410440 - DNA, 14 bp, Homo sapiens
tctcaggaaatcaa

SEQ ID NO: 4410441 - DNA, 21 bp, Homo sapiens
tctcaggaaatcaaatatgca

SEQ ID NO: 4410442 - DNA, 16 bp, Homo sapiens
tctcaggagatggagg

SEQ ID NO: 4410443 - DNA, 17 bp, Homo sapiens
tctcaggagcttcaatg

SEQ ID NO: 4410444 - DNA, 15 bp, Homo sapiens
tctcaggctcaagtt

SEQ ID NO: 4410445 - DNA, 20 bp, Homo sapiens
tctcaggtttgttttgtgaa

SEQ ID NO: 4410446 - DNA, 24 bp, Homo sapiens
tctcagtctaaggtctcatgctgt

SEQ ID NO: 4410447 - DNA, 15 bp, Homo sapiens
tctcagttttcataa

SEQ ID NO: 4410448 - DNA, 21 bp, Homo sapiens
tctcataagtagcattcatgt

SEQ ID NO: 4410449 - DNA, 15 bp, Homo sapiens
tctcatagaacattg

SEQ ID NO: 4410450 - DNA, 21 bp, Homo sapiens
tctcatagaacattgatctgt

SEQ ID NO: 4410451 - DNA, 20 bp, Homo sapiens
tctcatagcaggaaatgtag

SEQ ID NO: 4410452 - DNA, 16 bp, Homo sapiens
tctcataggttaaaaa

SEQ ID NO: 4410453 - DNA, 17 bp, Homo sapiens
tctcataggttaaaaaa

SEQ ID NO: 4410454 - DNA, 22 bp, Homo sapiens
tctcatattcgctagtgtttaa

SEQ ID NO: 4410455 - DNA, 15 bp, Homo sapiens
tctcatcaactgaat

SEQ ID NO: 4410456 - DNA, 19 bp, Homo sapiens
tctcatcctcccattgccc

SEQ ID NO: 4410457 - DNA, 16 bp, Homo sapiens
tctcatccttttggat

SEQ ID NO: 4410458 - DNA, 19 bp, Homo sapiens
tctcatctcagtgaagaat

SEQ ID NO: 4410459 - DNA, 20 bp, Homo sapiens
tctcatctcagtgaagaata

SEQ ID NO: 4410460 - DNA, 15 bp, Homo sapiens
tctcatctcccaggc

SEQ ID NO: 4410461 - DNA, 16 bp, Homo sapiens
tctcatctcccaggcc

SEQ ID NO: 4410462 - DNA, 21 bp, Homo sapiens
tctcatctccccacgcccgtc

SEQ ID NO: 4410463 - DNA, 14 bp, Homo sapiens
tctcatcttgtgaa

SEQ ID NO: 4410464 - DNA, 12 bp, Homo sapiens
tctcatctttct

SEQ ID NO: 4410465 - DNA, 19 bp, Homo sapiens
tctcatgccagtgccttat

SEQ ID NO: 4410466 - DNA, 15 bp, Homo sapiens
tctcatgctccttaa

SEQ ID NO: 4410467 - DNA, 12 bp, Homo sapiens
tctcattaaagt

SEQ ID NO: 4410468 - DNA, 12 bp, Homo sapiens
tctcattatttc

SEQ ID NO: 4410469 - DNA, 16 bp, Homo sapiens
tctcattatttcaaaa

SEQ ID NO: 4410470 - DNA, 13 bp, Homo sapiens
tctcattccccag

SEQ ID NO: 4410471 - DNA, 20 bp, Homo sapiens
tctcattggacccttccatg

SEQ ID NO: 4410472 - DNA, 16 bp, Homo sapiens
tctcatttaagggaaa

SEQ ID NO: 4410473 - DNA, 18 bp, Homo sapiens
tctcatttaagggaaaaa

SEQ ID NO: 4410474 - DNA, 19 bp, Homo sapiens
tctcatttcacccctccct

SEQ ID NO: 4410475 - DNA, 22 bp, Homo sapiens
tctcatttcacccctccctttc

SEQ ID NO: 4410476 - DNA, 19 bp, Homo sapiens
tctcattttaatgtaaaga

SEQ ID NO: 4410477 - DNA, 21 bp, Homo sapiens
tctccaaaaaaaaaaaaaata

SEQ ID NO: 4410478 - DNA, 21 bp, Homo sapiens
tctccaaaaatctgcctgggt

SEQ ID NO: 4410479 - DNA, 19 bp, Homo sapiens
tctccaaaacatttctaag

SEQ ID NO: 4410480 - DNA, 17 bp, Homo sapiens
tctccaacaagttgcct

SEQ ID NO: 4410481 - DNA, 15 bp, Homo sapiens
tctccaacctggaca

SEQ ID NO: 4410482 - DNA, 15 bp, Homo sapiens
tctccaagacagcag

SEQ ID NO: 4410483 - DNA, 17 bp, Homo sapiens
tctccaagacagcagca

SEQ ID NO: 4410484 - DNA, 17 bp, Homo sapiens
tctccaagtctcagtgg

SEQ ID NO: 4410485 - DNA, 20 bp, Homo sapiens
tctccaatggaaagcttttc

SEQ ID NO: 4410486 - DNA, 15 bp, Homo sapiens
tctccaattctgaaa

SEQ ID NO: 4410487 - DNA, 20 bp, Homo sapiens
tctccaattctgaaatactt

SEQ ID NO: 4410488 - DNA, 14 bp, Homo sapiens
tctccacctcagcc

SEQ ID NO: 4410489 - DNA, 15 bp, Homo sapiens
tctccacctcagcct

SEQ ID NO: 4410490 - DNA, 16 bp, Homo sapiens
tctccacctcagcctt

SEQ ID NO: 4410491 - DNA, 12 bp, Homo sapiens
tctccacctgca

SEQ ID NO: 4410492 - DNA, 16 bp, Homo sapiens
tctccacctgcacatt

SEQ ID NO: 4410493 - DNA, 13 bp, Homo sapiens
tctccagcttccc

SEQ ID NO: 4410494 - DNA, 17 bp, Homo sapiens
tctccagggaattctta

SEQ ID NO: 4410495 - DNA, 17 bp, Homo sapiens
tctccagggcccccacc

SEQ ID NO: 4410496 - DNA, 18 bp, Homo sapiens
tctccagggcccccaccg

SEQ ID NO: 4410497 - DNA, 16 bp, Homo sapiens
tctccaggggtttaca

SEQ ID NO: 4410498 - DNA, 21 bp, Homo sapiens
tctccagtgctgtccatgctt

SEQ ID NO: 4410499 - DNA, 19 bp, Homo sapiens
tctccatatctccatggcc

SEQ ID NO: 4410500 - DNA, 13 bp, Homo sapiens
tctccatccacat

SEQ ID NO: 4410501 - DNA, 15 bp, Homo sapiens
tctccatcccctccc

SEQ ID NO: 4410502 - DNA, 22 bp, Homo sapiens
tctccatcccctccctgcctgc

SEQ ID NO: 4410503 - DNA, 13 bp, Homo sapiens
tctccatggccct

SEQ ID NO: 4410504 - DNA, 19 bp, Homo sapiens
tctccatggccctgtccca

SEQ ID NO: 4410505 - DNA, 12 bp, Homo sapiens
tctcccaacatg

SEQ ID NO: 4410506 - DNA, 21 bp, Homo sapiens
tctcccacagagtgctggact

SEQ ID NO: 4410507 - DNA, 22 bp, Homo sapiens
tctcccacagagtgctggactg

SEQ ID NO: 4410508 - DNA, 16 bp, Homo sapiens
tctcccacccggccac

SEQ ID NO: 4410509 - DNA, 19 bp, Homo sapiens
tctcccaggccccagggga

SEQ ID NO: 4410510 - DNA, 17 bp, Homo sapiens
tctcccaggtaccagct

SEQ ID NO: 4410511 - DNA, 18 bp, Homo sapiens
tctcccaggtaccagctg

SEQ ID NO: 4410512 - DNA, 19 bp, Homo sapiens
tctcccaggtaccagctgc

SEQ ID NO: 4410513 - DNA, 16 bp, Homo sapiens
tctcccagtatgtttt

SEQ ID NO: 4410514 - DNA, 18 bp, Homo sapiens
tctcccagtctacccaga

SEQ ID NO: 4410515 - DNA, 20 bp, Homo sapiens
tctcccagtgaactcctgcc

SEQ ID NO: 4410516 - DNA, 15 bp, Homo sapiens
tctcccatggagccc

SEQ ID NO: 4410517 - DNA, 22 bp, Homo sapiens
tctcccatggagccccagcccc

SEQ ID NO: 4410518 - DNA, 18 bp, Homo sapiens
tctccccaatccatgctt

SEQ ID NO: 4410519 - DNA, 21 bp, Homo sapiens
tctccccaatccatgcttcac

SEQ ID NO: 4410520 - DNA, 22 bp, Homo sapiens
tctccccaatccatgcttcact

SEQ ID NO: 4410521 - DNA, 12 bp, Homo sapiens
tctccccagaat

SEQ ID NO: 4410522 - DNA, 15 bp, Homo sapiens
tctccccagccccct

SEQ ID NO: 4410523 - DNA, 18 bp, Homo sapiens
tctccccagtgcctgcca

SEQ ID NO: 4410524 - DNA, 17 bp, Homo sapiens
tctccccatatataaat

SEQ ID NO: 4410525 - DNA, 21 bp, Homo sapiens
tctccccatatataaattatt

SEQ ID NO: 4410526 - DNA, 15 bp, Homo sapiens
tctcccccaccccct

SEQ ID NO: 4410527 - DNA, 19 bp, Homo sapiens
tctcccccaccccctcccc

SEQ ID NO: 4410528 - DNA, 15 bp, Homo sapiens
tctccccctcctcca

SEQ ID NO: 4410529 - DNA, 12 bp, Homo sapiens
tctccccgctct

SEQ ID NO: 4410530 - DNA, 12 bp, Homo sapiens
tctcccctctcg

SEQ ID NO: 4410531 - DNA, 20 bp, Homo sapiens
tctcccctctcgccccatcc

SEQ ID NO: 4410532 - DNA, 15 bp, Homo sapiens
tctcccctgccccca

SEQ ID NO: 4410533 - DNA, 16 bp, Homo sapiens
tctcccctgcccccag

SEQ ID NO: 4410534 - DNA, 16 bp, Homo sapiens
tctccccttcctggca

SEQ ID NO: 4410535 - DNA, 17 bp, Homo sapiens
tctccccttcctggcac

SEQ ID NO: 4410536 - DNA, 16 bp, Homo sapiens
tctccctagcccaccc

SEQ ID NO: 4410537 - DNA, 17 bp, Homo sapiens
tctccctctcctgccta

SEQ ID NO: 4410538 - DNA, 14 bp, Homo sapiens
tctccctctggccc

SEQ ID NO: 4410539 - DNA, 16 bp, Homo sapiens
tctccctctggccctg

SEQ ID NO: 4410540 - DNA, 18 bp, Homo sapiens
tctccctctggccctgcc

SEQ ID NO: 4410541 - DNA, 13 bp, Homo sapiens
tctccctgacctt

SEQ ID NO: 4410542 - DNA, 14 bp, Homo sapiens
tctccctgccaagt

SEQ ID NO: 4410543 - DNA, 20 bp, Homo sapiens
tctccctgccaagtctcaga

SEQ ID NO: 4410544 - DNA, 23 bp, Homo sapiens
tctccctgccaagtctcagaaga

SEQ ID NO: 4410545 - DNA, 12 bp, Homo sapiens
tctccctgccgc

SEQ ID NO: 4410546 - DNA, 13 bp, Homo sapiens
tctccctgcctca

SEQ ID NO: 4410547 - DNA, 13 bp, Homo sapiens
tctccctgcctgt

SEQ ID NO: 4410548 - DNA, 20 bp, Homo sapiens
tctccctgctgctcctagga

SEQ ID NO: 4410549 - DNA, 23 bp, Homo sapiens
tctccctggctccctcctccagg

SEQ ID NO: 4410550 - DNA, 19 bp, Homo sapiens
tctccctgtgttctgggct

SEQ ID NO: 4410551 - DNA, 12 bp, Homo sapiens
tctcccttaccc

SEQ ID NO: 4410552 - DNA, 19 bp, Homo sapiens
tctcccttcctctctcctt

SEQ ID NO: 4410553 - DNA, 13 bp, Homo sapiens
tctcccttggccc

SEQ ID NO: 4410554 - DNA, 14 bp, Homo sapiens
tctccctttctctc

SEQ ID NO: 4410555 - DNA, 22 bp, Homo sapiens
tctccctttctctctcctctct

SEQ ID NO: 4410556 - DNA, 13 bp, Homo sapiens
tctccgccagcct

SEQ ID NO: 4410557 - DNA, 15 bp, Homo sapiens
tctccgccagcctcc

SEQ ID NO: 4410558 - DNA, 18 bp, Homo sapiens
tctccgccagcctcctct

SEQ ID NO: 4410559 - DNA, 13 bp, Homo sapiens
tctccgcgcctac

SEQ ID NO: 4410560 - DNA, 19 bp, Homo sapiens
tctccgggtgtggcctcag

SEQ ID NO: 4410561 - DNA, 21 bp, Homo sapiens
tctccgggtgtggcctcagcc

SEQ ID NO: 4410562 - DNA, 18 bp, Homo sapiens
tctcctatatatttctat

SEQ ID NO: 4410563 - DNA, 19 bp, Homo sapiens
tctcctatatatttctatt

SEQ ID NO: 4410564 - DNA, 15 bp, Homo sapiens
tctcctcactgtatc

SEQ ID NO: 4410565 - DNA, 17 bp, Homo sapiens
tctcctcagggtggggg

SEQ ID NO: 4410566 - DNA, 18 bp, Homo sapiens
tctcctcagggtgggggg

SEQ ID NO: 4410567 - DNA, 20 bp, Homo sapiens
tctcctcagtggcttctcca

SEQ ID NO: 4410568 - DNA, 14 bp, Homo sapiens
tctcctcatctcca

SEQ ID NO: 4410569 - DNA, 14 bp, Homo sapiens
tctcctccccttcc

SEQ ID NO: 4410570 - DNA, 19 bp, Homo sapiens
tctcctcccgccccgcccc

SEQ ID NO: 4410571 - DNA, 22 bp, Homo sapiens
tctcctcccgcccttccatgtg

SEQ ID NO: 4410572 - DNA, 13 bp, Homo sapiens
tctcctccctcag

SEQ ID NO: 4410573 - DNA, 16 bp, Homo sapiens
tctcctcctcccctcc

SEQ ID NO: 4410574 - DNA, 18 bp, Homo sapiens
tctcctcctcccctcctc

SEQ ID NO: 4410575 - DNA, 23 bp, Homo sapiens
tctcctctcagagtgacagtcat

SEQ ID NO: 4410576 - DNA, 17 bp, Homo sapiens
tctcctctcccctttgt

SEQ ID NO: 4410577 - DNA, 13 bp, Homo sapiens
tctcctctctgct

SEQ ID NO: 4410578 - DNA, 21 bp, Homo sapiens
tctcctctgctcattaaactg

SEQ ID NO: 4410579 - DNA, 13 bp, Homo sapiens
tctcctctttaaa

SEQ ID NO: 4410580 - DNA, 19 bp, Homo sapiens
tctcctctttaaaacaaaa

SEQ ID NO: 4410581 - DNA, 15 bp, Homo sapiens
tctcctgaatatttt

SEQ ID NO: 4410582 - DNA, 15 bp, Homo sapiens
tctcctgacccctgc

SEQ ID NO: 4410583 - DNA, 17 bp, Homo sapiens
tctcctgacccctgcct

SEQ ID NO: 4410584 - DNA, 19 bp, Homo sapiens
tctcctgaccttgtgatcc

SEQ ID NO: 4410585 - DNA, 13 bp, Homo sapiens
tgcctgagaccag

SEQ ID NO: 4410586 - DNA, 16 bp, Homo sapiens
tgcctgagaccagggt

SEQ ID NO: 4410587 - DNA, 18 bp, Homo sapiens
tgcctgagaccagggtgg

SEQ ID NO: 4410588 - DNA, 19 bp, Homo sapiens
tgcctgagaggcaggcata

SEQ ID NO: 4410589 - DNA, 14 bp, Homo sapiens
tgcctgattatttt

SEQ ID NO: 4410590 - DNA, 16 bp, Homo sapiens
tgcctgcagccagggc

SEQ ID NO: 4410591 - DNA, 19 bp, Homo sapiens
tgcctgcagccagggctgg

SEQ ID NO: 4410592 - DNA, 20 bp, Homo sapiens
tgcctgcagccagggctggg

SEQ ID NO: 4410593 - DNA, 13 bp, Homo sapiens
tgcctgccactct

SEQ ID NO: 4410594 - DNA, 17 bp, Homo sapiens
tgcctgccactctctgg

SEQ ID NO: 4410595 - DNA, 21 bp, Homo sapiens
tgcctgccactctctgggact

SEQ ID NO: 4410596 - DNA, 17 bp, Homo sapiens
tgcctgccccgccccca

SEQ ID NO: 4410597 - DNA, 22 bp, Homo sapiens
tgcctgcccctaccctggactt

SEQ ID NO: 4410598 - DNA, 18 bp, Homo sapiens
tgttattttctgttgaag

SEQ ID NO: 4410599 - DNA, 22 bp, Homo sapiens
tgttcaaaacaaaatgaaacaa

SEQ ID NO: 4410600 - DNA, 15 bp, Homo sapiens
tgttcaaatgcattt

SEQ ID NO: 4410601 - DNA, 20 bp, Homo sapiens
tgttcaatgaaataaaagca

SEQ ID NO: 4410602 - DNA, 17 bp, Homo sapiens
tgttcacaaactgtgaa

SEQ ID NO: 4410603 - DNA, 16 bp, Homo sapiens
tgttcaccatcggcag

SEQ ID NO: 4410604 - DNA, 17 bp, Homo sapiens
tgttcacttttgacaaa

SEQ ID NO: 4410605 - DNA, 13 bp, Homo sapiens
tgttcagaaaatg

SEQ ID NO: 4410606 - DNA, 17 bp, Homo sapiens
tgttcagcggagctgac

SEQ ID NO: 4410607 - DNA, 23 bp, Homo sapiens
tgttcattttaagtaacgtgctc

SEQ ID NO: 4410608 - DNA, 16 bp, Homo sapiens
tgttccacctgccaca

SEQ ID NO: 4410609 - DNA, 23 bp, Homo sapiens
tgttccacctggaaactgctcag

SEQ ID NO: 4410610 - DNA, 11 bp, Homo sapiens
tgttccagact

SEQ ID NO: 4410611 - DNA, 22 bp, Homo sapiens
tgttccataggaaggctgtgat

SEQ ID NO: 4410612 - DNA, 14 bp, Homo sapiens
tgttcccagcccct

SEQ ID NO: 4410613 - DNA, 19 bp, Homo sapiens
tgttcccagcccctcctcc

SEQ ID NO: 4410614 - DNA, 16 bp, Homo sapiens
tgttcccatttcagct

SEQ ID NO: 4410615 - DNA, 16 bp, Homo sapiens
tgttccccctgtgcag

SEQ ID NO: 4410616 - DNA, 13 bp, Homo sapiens
tgttcccctcctc

SEQ ID NO: 4410617 - DNA, 15 bp, Homo sapiens
tgttcccctcctcca

SEQ ID NO: 4410618 - DNA, 21 bp, Homo sapiens
tgttccccttccactgagggc

SEQ ID NO: 4410619 - DNA, 21 bp, Homo sapiens
tgttccgtgggaccctcagca

SEQ ID NO: 4410620 - DNA, 21 bp, Homo sapiens
tgttcctatattccaggttta

SEQ ID NO: 4410621 - DNA, 16 bp, Homo sapiens
tgttcctatctgcagg

SEQ ID NO: 4410622 - DNA, 23 bp, Homo sapiens
tgttcctcaaatcagtgataatt

SEQ ID NO: 4410623 - DNA, 15 bp, Homo sapiens
tgttcctgaagctgc

SEQ ID NO: 4410624 - DNA, 18 bp, Homo sapiens
tgttcctgaagctgctgt

SEQ ID NO: 4410625 - DNA, 23 bp, Homo sapiens
tgttcctggaggtcagcatttga

SEQ ID NO: 4410626 - DNA, 13 bp, Homo sapiens
tgttcctgtgcat

SEQ ID NO: 4410627 - DNA, 13 bp, Homo sapiens
tgttccttttgta

SEQ ID NO: 4410628 - DNA, 22 bp, Homo sapiens
tgttcgcatggtcacacactga

SEQ ID NO: 4410629 - DNA, 14 bp, Homo sapiens
tgttcgttctgata

SEQ ID NO: 4410630 - DNA, 21 bp, Homo sapiens
tgttcgtttccatcatgtctg

SEQ ID NO: 4410631 - DNA, 23 bp, Homo sapiens
tgttcgtttccatcatgtctgta

SEQ ID NO: 4410632 - DNA, 16 bp, Homo sapiens
tgttctaagactctgt

SEQ ID NO: 4410633 - DNA, 17 bp, Homo sapiens
tgttctaagtctttcca

SEQ ID NO: 4410634 - DNA, 11 bp, Homo sapiens
tgttctagact

SEQ ID NO: 4410635 - DNA, 17 bp, Homo sapiens
tgttctagacttcccca

SEQ ID NO: 4410636 - DNA, 19 bp, Homo sapiens
tgttctagacttccccatc

SEQ ID NO: 4410637 - DNA, 22 bp, Homo sapiens
tgttctagtaacaatacatgag

SEQ ID NO: 4410638 - DNA, 21 bp, Homo sapiens
tgttctagttttttacttttg

SEQ ID NO: 4410639 - DNA, 14 bp, Homo sapiens
tgttctatccaaac

SEQ ID NO: 4410640 - DNA, 18 bp, Homo sapiens
tgttctatccaaacatgt

SEQ ID NO: 4410641 - DNA, 19 bp, Homo sapiens
tgttctatccaaacatgta

SEQ ID NO: 4410642 - DNA, 21 bp, Homo sapiens
tgttctattaatcacctctct

SEQ ID NO: 4410643 - DNA, 24 bp, Homo sapiens
tgttctcaacatactgtaatcaaa

SEQ ID NO: 4410644 - DNA, 22 bp, Homo sapiens
tgttctcacactggtctgctgt

SEQ ID NO: 4410645 - DNA, 22 bp, Homo sapiens
tgttctcagaatcccttaacag

SEQ ID NO: 4410646 - DNA, 10 bp, Homo sapiens
tgttctcagc

SEQ ID NO: 4410647 - DNA, 15 bp, Homo sapiens
tgttctcagcacata

SEQ ID NO: 4410648 - DNA, 16 bp, Homo sapiens
tgttctcaggacagca

SEQ ID NO: 4410649 - DNA, 22 bp, Homo sapiens
tgttctccgggtgtggcctcag

SEQ ID NO: 4410650 - DNA, 16 bp, Homo sapiens
tgttctccgtccctgc

SEQ ID NO: 4410651 - DNA, 23 bp, Homo sapiens
tgttctgagcacatttgactcca

SEQ ID NO: 4410652 - DNA, 17 bp, Homo sapiens
tgttctgctccatacct

SEQ ID NO: 4410653 - DNA, 22 bp, Homo sapiens
tgttctgggctggggccacctt

SEQ ID NO: 4410654 - DNA, 16 bp, Homo sapiens
tgttctgtttgaaact

SEQ ID NO: 4410655 - DNA, 16 bp, Homo sapiens
tgttcttaagacgtga

SEQ ID NO: 4410656 - DNA, 13 bp, Homo sapiens
tgttcttgaattt

SEQ ID NO: 4410657 - DNA, 23 bp, Homo sapiens
tgttcttgaatttaataatctgt

SEQ ID NO: 4410658 - DNA, 23 bp, Homo sapiens
tgttcttgacaatcatctccaat

SEQ ID NO: 4410659 - DNA, 14 bp, Homo sapiens
tgttctttccatga

SEQ ID NO: 4410660 - DNA, 17 bp, Homo sapiens
tgttcttttcccgcctc

SEQ ID NO: 4410661 - DNA, 20 bp, Homo sapiens
tgttcttttctcctttacca

SEQ ID NO: 4410662 - DNA, 12 bp, Homo sapiens
tgttgaaaaaat

SEQ ID NO: 4410663 - DNA, 21 bp, Homo sapiens
tgttgaaaaaatttaaaagta

SEQ ID NO: 4410664 - DNA, 18 bp, Homo sapiens
tgttgaaaaccaaaatga

SEQ ID NO: 4410665 - DNA, 23 bp, Homo sapiens
tgttgaaaggttttttttcagtt

SEQ ID NO: 4410666 - DNA, 17 bp, Homo sapiens
tgttgaactaatatatg

SEQ ID NO: 4410667 - DNA, 18 bp, Homo sapiens
tgttgaatactttttaca

SEQ ID NO: 4410668 - DNA, 20 bp, Homo sapiens
tgttgacaaatgacagatct

SEQ ID NO: 4410669 - DNA, 19 bp, Homo sapiens
tgttgacatatttaatgtt

SEQ ID NO: 4410670 - DNA, 21 bp, Homo sapiens
tgttgacatatttaatgtttt

SEQ ID NO: 4410671 - DNA, 23 bp, Homo sapiens
tgttgacatatttaatgttttaa

SEQ ID NO: 4410672 - DNA, 18 bp, Homo sapiens
tgttgaccactccagaga

SEQ ID NO: 4410673 - DNA, 11 bp, Homo sapiens
tgttgactgtg

SEQ ID NO: 4410674 - DNA, 23 bp, Homo sapiens
tgttgagaatcccaaatttgatt

SEQ ID NO: 4410675 - DNA, 13 bp, Homo sapiens
tgttgagacagag

SEQ ID NO: 4410676 - DNA, 19 bp, Homo sapiens
tgttgataaaaatactgac

SEQ ID NO: 4410677 - DNA, 18 bp, Homo sapiens
tgttgatattgtttgctg

SEQ ID NO: 4410678 - DNA, 19 bp, Homo sapiens
tgttgatcatgtacttttt

SEQ ID NO: 4410679 - DNA, 22 bp, Homo sapiens
tgttgatcatgtactttttagt

SEQ ID NO: 4410680 - DNA, 23 bp, Homo sapiens
tgttgatcatgtactttttagta

SEQ ID NO: 4410681 - DNA, 13 bp, Homo sapiens
tgttgatctttca

SEQ ID NO: 4410682 - DNA, 17 bp, Homo sapiens
tgttgatctttcactat

SEQ ID NO: 4410683 - DNA, 11 bp, Homo sapiens
tgttgattatt

SEQ ID NO: 4410684 - DNA, 16 bp, Homo sapiens
tgttgattattagcca

SEQ ID NO: 4410685 - DNA, 15 bp, Homo sapiens
tgttgcaagatgtga

SEQ ID NO: 4410686 - DNA, 21 bp, Homo sapiens
tgttgcaatgtgaaaaatctg

SEQ ID NO: 4410687 - DNA, 19 bp, Homo sapiens
tgttgcacccagccctggt

SEQ ID NO: 4410688 - DNA, 17 bp, Homo sapiens
tgttgcaggttcatgga

SEQ ID NO: 4410689 - DNA, 21 bp, Homo sapiens
tgttgcattaattgtgctgtt

SEQ ID NO: 4410690 - DNA, 21 bp, Homo sapiens
tgttgcctaattggaaagtgc

SEQ ID NO: 4410691 - DNA, 23 bp, Homo sapiens
tgttgcctacctagctgcatcta

SEQ ID NO: 4410692 - DNA, 16 bp, Homo sapiens
tgttgcgttcaaagag

SEQ ID NO: 4410693 - DNA, 20 bp, Homo sapiens
tgttgctatacatgttggaa

SEQ ID NO: 4410694 - DNA, 17 bp, Homo sapiens
tgttgctatgtgcctta

SEQ ID NO: 4410695 - DNA, 19 bp, Homo sapiens
tgttgctcaaaaaatgagc

SEQ ID NO: 4410696 - DNA, 22 bp, Homo sapiens
tgttgctgctactgtcttacta

SEQ ID NO: 4410697 - DNA, 16 bp, Homo sapiens
tgttgctggatcagga

SEQ ID NO: 4410698 - DNA, 14 bp, Homo sapiens
tgttgctttacagt

SEQ ID NO: 4410699 - DNA, 18 bp, Homo sapiens
tgttgctttcttacctac

SEQ ID NO: 4410700 - DNA, 15 bp, Homo sapiens
tgttggaaaaaattt

SEQ ID NO: 4410701 - DNA, 15 bp, Homo sapiens
tgttggaaatgtgtt

SEQ ID NO: 4410702 - DNA, 14 bp, Homo sapiens
tgttggacatgaga

SEQ ID NO: 4410703 - DNA, 17 bp, Homo sapiens
tgttggcatagctctgg

SEQ ID NO: 4410704 - DNA, 16 bp, Homo sapiens
tgttggcctcttcagg

SEQ ID NO: 4410705 - DNA, 20 bp, Homo sapiens
tgttgggtcagtggccaggt

SEQ ID NO: 4410706 - DNA, 16 bp, Homo sapiens
tgttggtctgtagcaa

SEQ ID NO: 4410707 - DNA, 13 bp, Homo sapiens
tgttggtggcaaa

SEQ ID NO: 4410708 - DNA, 17 bp, Homo sapiens
tgttggttcaaactttt

SEQ ID NO: 4410709 - DNA, 15 bp, Homo sapiens
tgttggttgcacttt

SEQ ID NO: 4410710 - DNA, 13 bp, Homo sapiens
tgttgtacaagct

SEQ ID NO: 4410711 - DNA, 15 bp, Homo sapiens
tgttgtacaagctca

SEQ ID NO: 4410712 - DNA, 22 bp, Homo sapiens
tgttgtacatacagaggtaact

SEQ ID NO: 4410713 - DNA, 21 bp, Homo sapiens
tgttgtagattgattgtattg

SEQ ID NO: 4410714 - DNA, 22 bp, Homo sapiens
tgttgtagattgattgtattgt

SEQ ID NO: 4410715 - DNA, 15 bp, Homo sapiens
tgttttcagactcag

SEQ ID NO: 4410716 - DNA, 13 bp, Homo sapiens
tgttttcagcact

SEQ ID NO: 4410717 - DNA, 16 bp, Homo sapiens
tgttttcatcatttca

SEQ ID NO: 4410718 - DNA, 19 bp, Homo sapiens
tgttttcattatctcaaaa

SEQ ID NO: 4410719 - DNA, 18 bp, Homo sapiens
tgttttccacataaattt

SEQ ID NO: 4410720 - DNA, 19 bp, Homo sapiens
tgttttccctctgctgctt

SEQ ID NO: 4410721 - DNA, 21 bp, Homo sapiens
tgttttccctggctaacagtc

SEQ ID NO: 4410722 - DNA, 15 bp, Homo sapiens
tgttttctgtaaatt

SEQ ID NO: 4410723 - DNA, 17 bp, Homo sapiens
tgttttcttttggtaaa

SEQ ID NO: 4410724 - DNA, 11 bp, Homo sapiens
tgttttgaaag

SEQ ID NO: 4410725 - DNA, 19 bp, Homo sapiens
tgttttgaaagtttaacaa

SEQ ID NO: 4410726 - DNA, 23 bp, Homo sapiens
tgttttgaaagtttaacaaatga

SEQ ID NO: 4410727 - DNA, 12 bp, Homo sapiens
tgttttgtacca

SEQ ID NO: 4410728 - DNA, 14 bp, Homo sapiens
tgttttgtaccagt

SEQ ID NO: 4410729 - DNA, 17 bp, Homo sapiens
tgttttgtgaattttct

SEQ ID NO: 4410730 - DNA, 19 bp, Homo sapiens
tgtttttaacatgtcaatc

SEQ ID NO: 4410731 - DNA, 13 bp, Homo sapiens
tgtttttaatgct

SEQ ID NO: 4410732 - DNA, 19 bp, Homo sapiens
tgtttttaatgctatttga

SEQ ID NO: 4410733 - DNA, 11 bp, Homo sapiens
tgtttttactg

SEQ ID NO: 4410734 - DNA, 22 bp, Homo sapiens
tgtttttatatattataagttg

SEQ ID NO: 4410735 - DNA, 21 bp, Homo sapiens
tgtttttatatttctgttaaa

SEQ ID NO: 4410736 - DNA, 16 bp, Homo sapiens
tgtttttattctgtat

SEQ ID NO: 4410737 - DNA, 13 bp, Homo sapiens
tgtttttcacatt

SEQ ID NO: 4410738 - DNA, 22 bp, Homo sapiens
tgtttttcagcgttaatgtaaa

SEQ ID NO: 4410739 - DNA, 14 bp, Homo sapiens
tgtttttcttcagc

SEQ ID NO: 4410740 - DNA, 19 bp, Homo sapiens
tgtttttctttttccacaa

SEQ ID NO: 4410741 - DNA, 18 bp, Homo sapiens
tgtttttgcatgaaattg

SEQ ID NO: 4410742 - DNA, 23 bp, Homo sapiens
tgtttttgggaagaagaagacct

SEQ ID NO: 4410743 - DNA, 14 bp, Homo sapiens
tgtttttgggatgt

SEQ ID NO: 4410744 - DNA, 17 bp, Homo sapiens
tgtttttgggatgtctt

SEQ ID NO: 4410745 - DNA, 14 bp, Homo sapiens
tgtttttggtttct

SEQ ID NO: 4410746 - DNA, 23 bp, Homo sapiens
tgtttttgtatattgggtgtaga

SEQ ID NO: 4410747 - DNA, 14 bp, Homo sapiens
tgttttttaaaatg

SEQ ID NO: 4410748 - DNA, 14 bp, Homo sapiens
tgttttttaagata

SEQ ID NO: 4410749 - DNA, 21 bp, Homo sapiens
tgttttttaagatagtgtaac

SEQ ID NO: 4410750 - DNA, 18 bp, Homo sapiens
tgttttttcatttgtaaa

SEQ ID NO: 4410751 - DNA, 19 bp, Homo sapiens
tgttttttcatttgtaaaa

SEQ ID NO: 4410752 - DNA, 14 bp, Homo sapiens
tgttttttctgtaa

SEQ ID NO: 4410753 - DNA, 12 bp, Homo sapiens
tgttttttgcaa

SEQ ID NO: 4410754 - DNA, 15 bp, Homo sapiens
tgtttttttctaaaa

SEQ ID NO: 4410755 - DNA, 17 bp, Homo sapiens
tgtttttttctaaaaag

SEQ ID NO: 4410756 - DNA, 18 bp, Homo sapiens
tgtttttttgttattaaa

SEQ ID NO: 4410757 - DNA, 20 bp, Homo sapiens
tgtttttttttttgagatgg

SEQ ID NO: 4410758 - DNA, 20 bp, Homo sapiens
ttaaaaaaaaaaaaaagctt

SEQ ID NO: 4410759 - DNA, 16 bp, Homo sapiens
ttaaaaaaaaattgta

SEQ ID NO: 4410760 - DNA, 12 bp, Homo sapiens
ttaaaaaaataa

SEQ ID NO: 4410761 - DNA, 12 bp, Homo sapiens
ttaaaaaacagc

SEQ ID NO: 4410762 - DNA, 16 bp, Homo sapiens
ttaaaaaactgtataa

SEQ ID NO: 4410763 - DNA, 19 bp, Homo sapiens
ttaaaaaagcttaaaactt

SEQ ID NO: 4410764 - DNA, 21 bp, Homo sapiens
ttaaaaaagcttaaaactttg

SEQ ID NO: 4410765 - DNA, 19 bp, Homo sapiens
ttaaaaaataatacaacaa

SEQ ID NO: 4410766 - DNA, 13 bp, Homo sapiens
ttaaaaaatgtga

SEQ ID NO: 4410767 - DNA, 21 bp, Homo sapiens
ttaaaaaatgtgaaatgcttt

SEQ ID NO: 4410768 - DNA, 12 bp, Homo sapiens
ttaaaaaattta

SEQ ID NO: 4410769 - DNA, 18 bp, Homo sapiens
ttaaaaacaaatgagttt

SEQ ID NO: 4410770 - DNA, 23 bp, Homo sapiens
ttaaaaacattttttatacattt

SEQ ID NO: 4410771 - DNA, 12 bp, Homo sapiens
ttaaaaaggaac

SEQ ID NO: 4410772 - DNA, 12 bp, Homo sapiens
ttaaaaataaag

SEQ ID NO: 4410773 - DNA, 21 bp, Homo sapiens
ttaaaaataagtcaacagtaa

SEQ ID NO: 4410774 - DNA, 22 bp, Homo sapiens
ttaaaaataagtcaacagtaaa

SEQ ID NO: 4410775 - DNA, 18 bp, Homo sapiens
ttaaaaataccttctatg

SEQ ID NO: 4410776 - DNA, 17 bp, Homo sapiens
ttaaaaatacttctatg

SEQ ID NO: 4410777 - DNA, 23 bp, Homo sapiens
ttaaaaatggtatcaaaattaca

SEQ ID NO: 4410778 - DNA, 24 bp, Homo sapiens
ttaaaaatggtatcaaaattacat

SEQ ID NO: 4410779 - DNA, 12 bp, Homo sapiens
ttaaaaatgtat

SEQ ID NO: 4410780 - DNA, 12 bp, Homo sapiens
ttaaaaatgtgg

SEQ ID NO: 4410781 - DNA, 19 bp, Homo sapiens
ttaaaaattaaatatttat

SEQ ID NO: 4410782 - DNA, 23 bp, Homo sapiens
ttaaaaattaatatggtgtattt

SEQ ID NO: 4410783 - DNA, 17 bp, Homo sapiens
ttaaaaattcagcaaag

SEQ ID NO: 4410784 - DNA, 12 bp, Homo sapiens
ttaaaacaaaac

SEQ ID NO: 4410785 - DNA, 15 bp, Homo sapiens
ttaaaacaaaagggt

SEQ ID NO: 4410786 - DNA, 20 bp, Homo sapiens
ttaaaacaaaagggtgtata

SEQ ID NO: 4410787 - DNA, 13 bp, Homo sapiens
ttaaaacacatga

SEQ ID NO: 4410788 - DNA, 14 bp, Homo sapiens
ttaaaacacatgat

SEQ ID NO: 4410789 - DNA, 21 bp, Homo sapiens
ttaaaacagacactggcatgg

SEQ ID NO: 4410790 - DNA, 15 bp, Homo sapiens
ttaaaacaggcaaag

SEQ ID NO: 4410791 - DNA, 15 bp, Homo sapiens
ttaaaactataacat

SEQ ID NO: 4410792 - DNA, 14 bp, Homo sapiens
ttaaaactcagcct

SEQ ID NO: 4410793 - DNA, 19 bp, Homo sapiens
ttaaaactcagcctgggac

SEQ ID NO: 4410794 - DNA, 14 bp, Homo sapiens
ttaaaagaaaaaat

SEQ ID NO: 4410795 - DNA, 16 bp, Homo sapiens
ttaaaagaaaaaatga

SEQ ID NO: 4410796 - DNA, 18 bp, Homo sapiens
ttaaaagaaaaaatgaca

SEQ ID NO: 4410797 - DNA, 21 bp, Homo sapiens
ttaaaagaaatatacagtttg

SEQ ID NO: 4410798 - DNA, 12 bp, Homo sapiens
ttaaaagaatat

SEQ ID NO: 4410799 - DNA, 21 bp, Homo sapiens
ttaaaagccttccagttttgt

SEQ ID NO: 4410800 - DNA, 23 bp, Homo sapiens
ttaaaagctatcttcatgtaaat

SEQ ID NO: 4410801 - DNA, 15 bp, Homo sapiens
ttaaaaggatagtat

SEQ ID NO: 4410802 - DNA, 12 bp, Homo sapiens
ttaaaataaaat

SEQ ID NO: 4410803 - DNA, 22 bp, Homo sapiens
ttaaaataaaataagttcttaa

SEQ ID NO: 4410804 - DNA, 15 bp, Homo sapiens
ttaaaataaaatgaa

SEQ ID NO: 4410805 - DNA, 21 bp, Homo sapiens
ttaaaataaaatgaaaattgt

SEQ ID NO: 4410806 - DNA, 20 bp, Homo sapiens
ttaaaatagaaattttgtaa

SEQ ID NO: 4410807 - DNA, 21 bp, Homo sapiens
ttaaaatagaaattttgtaag

SEQ ID NO: 4410808 - DNA, 21 bp, Homo sapiens
ttaaaatagcaaaagaagaag

SEQ ID NO: 4410809 - DNA, 20 bp, Homo sapiens
ttaaaatatgtgaagttttc

SEQ ID NO: 4410810 - DNA, 14 bp, Homo sapiens
ttaaaatcatttct

SEQ ID NO: 4410811 - DNA, 23 bp, Homo sapiens
ttaaaatgcaatatttgtaaggc

SEQ ID NO: 4410812 - DNA, 19 bp, Homo sapiens
ttaaaatgtgaggcaataa

SEQ ID NO: 4410813 - DNA, 20 bp, Homo sapiens
ttaaaatgtgaggcaataag

SEQ ID NO: 4410814 - DNA, 12 bp, Homo sapiens
ttaaaatgtgat

SEQ ID NO: 4410815 - DNA, 22 bp, Homo sapiens
ttaaaatgtgatttttcttcag

SEQ ID NO: 4410816 - DNA, 13 bp, Homo sapiens
ttaaaatgttcac

SEQ ID NO: 4410817 - DNA, 19 bp, Homo sapiens
ttaaaattatatagctgct

SEQ ID NO: 4410818 - DNA, 12 bp, Homo sapiens
ttaaaatttatt

SEQ ID NO: 4410819 - DNA, 14 bp, Homo sapiens
ttaaaatttattct

SEQ ID NO: 4410820 - DNA, 13 bp, Homo sapiens
ttaaaatttcata

SEQ ID NO: 4410821 - DNA, 12 bp, Homo sapiens
ttaaaatttgtt

SEQ ID NO: 4410822 - DNA, 15 bp, Homo sapiens
ttaaacaaaatttca

SEQ ID NO: 4410823 - DNA, 18 bp, Homo sapiens
ttaaacaaaatttcacag

SEQ ID NO: 4410824 - DNA, 21 bp, Homo sapiens
ttaaacaaaatttcacagttc

SEQ ID NO: 4410825 - DNA, 14 bp, Homo sapiens
ttaaacaaagtttc

SEQ ID NO: 4410826 - DNA, 22 bp, Homo sapiens
ttaaacaatctttcatgtcttg

SEQ ID NO: 4410827 - DNA, 21 bp, Homo sapiens
ttaaacacaggctgtccttaa

SEQ ID NO: 4410828 - DNA, 14 bp, Homo sapiens
ttaaacactacaca

SEQ ID NO: 4410829 - DNA, 23 bp, Homo sapiens
ttaaacagcaccaccatttaatt

SEQ ID NO: 4410830 - DNA, 22 bp, Homo sapiens
ttaaacagtgaacttgtctggc

SEQ ID NO: 4410831 - DNA, 14 bp, Homo sapiens
ttaaacatgcagaa

SEQ ID NO: 4410832 - DNA, 15 bp, Homo sapiens
ttaaacattgaagta

SEQ ID NO: 4410833 - DNA, 12 bp, Homo sapiens
ttaaaccagaac

SEQ ID NO: 4410834 - DNA, 12 bp, Homo sapiens
ttaactgtggat

SEQ ID NO: 4410835 - DNA, 17 bp, Homo sapiens
ttaactgttcttggaaa

SEQ ID NO: 4410836 - DNA, 18 bp, Homo sapiens
ttaactgttcttggaaaa

SEQ ID NO: 4410837 - DNA, 15 bp, Homo sapiens
ttaactgttttaggt

SEQ ID NO: 4410838 - DNA, 16 bp, Homo sapiens
ttaacttattacctca

SEQ ID NO: 4410839 - DNA, 14 bp, Homo sapiens
ttaacttcttgctt

SEQ ID NO: 4410840 - DNA, 17 bp, Homo sapiens
ttaacttcttgcttctt

SEQ ID NO: 4410841 - DNA, 21 bp, Homo sapiens
ttaacttcttgcttctttcta

SEQ ID NO: 4410842 - DNA, 16 bp, Homo sapiens
ttaactttaatacagc

SEQ ID NO: 4410843 - DNA, 18 bp, Homo sapiens
ttaagaaattttgccttt

SEQ ID NO: 4410844 - DNA, 19 bp, Homo sapiens
ttaagaactaaaatgttct

SEQ ID NO: 4410845 - DNA, 12 bp, Homo sapiens
ttaagaactgtg

SEQ ID NO: 4410846 - DNA, 16 bp, Homo sapiens
ttaagaatcttagata

SEQ ID NO: 4410847 - DNA, 22 bp, Homo sapiens
ttaagaattcaaatttgtaata

SEQ ID NO: 4410848 - DNA, 14 bp, Homo sapiens
ttaagacagagtct

SEQ ID NO: 4410849 - DNA, 15 bp, Homo sapiens
ttaagacgtgaatgt

SEQ ID NO: 4410850 - DNA, 18 bp, Homo sapiens
ttaagagctattttagaa

SEQ ID NO: 4410851 - DNA, 23 bp, Homo sapiens
ttaagagctattttagaaagcta

SEQ ID NO: 4410852 - DNA, 21 bp, Homo sapiens
ttaagaggttgattataaagt

SEQ ID NO: 4410853 - DNA, 15 bp, Homo sapiens
ttaagcaagttaagt

SEQ ID NO: 4410854 - DNA, 21 bp, Homo sapiens
ttaagcagactggaaaagtga

SEQ ID NO: 4410855 - DNA, 18 bp, Homo sapiens
ttaagcatgtcaattcat

SEQ ID NO: 4410856 - DNA, 13 bp, Homo sapiens
ttaagcattacca

SEQ ID NO: 4410857 - DNA, 16 bp, Homo sapiens
ttaagctttaaatgac

SEQ ID NO: 4410858 - DNA, 23 bp, Homo sapiens
ttaagctttaaatgacagtaata

SEQ ID NO: 4410859 - DNA, 18 bp, Homo sapiens
ttaaggaaaaaagatttt

SEQ ID NO: 4410860 - DNA, 22 bp, Homo sapiens
ttaaggataaatcataaagtca

SEQ ID NO: 4410861 - DNA, 23 bp, Homo sapiens
ttaaggataaatcataaagtcag

SEQ ID NO: 4410862 - DNA, 19 bp, Homo sapiens
ttaaggccaggcatggtgg

SEQ ID NO: 4410863 - DNA, 16 bp, Homo sapiens
ttaagggaaaaatata

SEQ ID NO: 4410864 - DNA, 15 bp, Homo sapiens
ttaagggcattttaa

SEQ ID NO: 4410865 - DNA, 13 bp, Homo sapiens
ttaagggtatgat

SEQ ID NO: 4410866 - DNA, 22 bp, Homo sapiens
ttaagtaacgtgctcactgtgt

SEQ ID NO: 4410867 - DNA, 12 bp, Homo sapiens
ttaagtaagttt

SEQ ID NO: 4410868 - DNA, 14 bp, Homo sapiens
ttaagtcagatttt

SEQ ID NO: 4410869 - DNA, 22 bp, Homo sapiens
ttaagtccagctcatttcagtt

SEQ ID NO: 4410870 - DNA, 19 bp, Homo sapiens
ttaagtgaaggagaagtct

SEQ ID NO: 4410871 - DNA, 16 bp, Homo sapiens
ttaagtgcaattaaca

SEQ ID NO: 4410872 - DNA, 13 bp, Homo sapiens
ttaagtgttcatt

SEQ ID NO: 4410873 - DNA, 16 bp, Homo sapiens
ttaagtgttcatttta

SEQ ID NO: 4410874 - DNA, 14 bp, Homo sapiens
ttaagtttgaagag

SEQ ID NO: 4410875 - DNA, 23 bp, Homo sapiens
ttaataaaactcactcactgttt

SEQ ID NO: 4410876 - DNA, 23 bp, Homo sapiens
ttaataaaactgcgaggacatca

SEQ ID NO: 4410877 - DNA, 21 bp, Homo sapiens
ttaataaaatattcgaaattc

SEQ ID NO: 4410878 - DNA, 19 bp, Homo sapiens
ttaataaactactctttga

SEQ ID NO: 4410879 - DNA, 15 bp, Homo sapiens
ttaataaagtagtta

SEQ ID NO: 4410880 - DNA, 18 bp, Homo sapiens
ttaataactttctctgtg

SEQ ID NO: 4410881 - DNA, 19 bp, Homo sapiens
ttaataactttctctgtga

SEQ ID NO: 4410882 - DNA, 21 bp, Homo sapiens
ttaataactttctctgtgaaa

SEQ ID NO: 4410883 - DNA, 13 bp, Homo sapiens
ttaataagatttt

SEQ ID NO: 4410884 - DNA, 18 bp, Homo sapiens
ttaataagatttttcaaa

SEQ ID NO: 4410885 - DNA, 12 bp, Homo sapiens
ttaataataatg

SEQ ID NO: 4410886 - DNA, 14 bp, Homo sapiens
ttaataataatgcc

SEQ ID NO: 4410887 - DNA, 23 bp, Homo sapiens
ttaataataatgccaatgaacat

SEQ ID NO: 4410888 - DNA, 17 bp, Homo sapiens
ttaatacaggaaattga

SEQ ID NO: 4410889 - DNA, 15 bp, Homo sapiens
ttaatacatcacatc

SEQ ID NO: 4410890 - DNA, 20 bp, Homo sapiens
ttaatagcaaagaattgact

SEQ ID NO: 4410891 - DNA, 17 bp, Homo sapiens
ttaatagtaatttgtaa

SEQ ID NO: 4410892 - DNA, 13 bp, Homo sapiens
ttaatatacccca

SEQ ID NO: 4410893 - DNA, 16 bp, Homo sapiens
ttaatatcactcatta

SEQ ID NO: 4410894 - DNA, 20 bp, Homo sapiens
ttaatatcactcattaatta

SEQ ID NO: 4410895 - DNA, 21 bp, Homo sapiens
ttaatattacctaatgaaagt

SEQ ID NO: 4410896 - DNA, 12 bp, Homo sapiens
ttaatatttctt

SEQ ID NO: 4410897 - DNA, 14 bp, Homo sapiens
ttaatatttcttca

SEQ ID NO: 4410898 - DNA, 16 bp, Homo sapiens
ttaatatttgtttagt

SEQ ID NO: 4410899 - DNA, 12 bp, Homo sapiens
ttaatcaagaga

SEQ ID NO: 4410900 - DNA, 17 bp, Homo sapiens
ttaatcaagagaaactt

SEQ ID NO: 4410901 - DNA, 20 bp, Homo sapiens
ttaatcaagatttttttcct

SEQ ID NO: 4410902 - DNA, 21 bp, Homo sapiens
ttaatcaagatttttttcctg

SEQ ID NO: 4410903 - DNA, 19 bp, Homo sapiens
ttaatcaatatttaagaga

SEQ ID NO: 4410904 - DNA, 15 bp, Homo sapiens
ttaatcacttaacat

SEQ ID NO: 4410905 - DNA, 14 bp, Homo sapiens
ttaatcatagatta

SEQ ID NO: 4410906 - DNA, 16 bp, Homo sapiens
ttaatcatagattatt

SEQ ID NO: 4410907 - DNA, 21 bp, Homo sapiens
ttaatcatagattattataaa

SEQ ID NO: 4410908 - DNA, 13 bp, Homo sapiens
ttaatcattttca

SEQ ID NO: 4410909 - DNA, 20 bp, Homo sapiens
ttaatcgtttttgttttaag

SEQ ID NO: 4410910 - DNA, 23 bp, Homo sapiens
ttaatctctgtgtgttttctttg

SEQ ID NO: 4410911 - DNA, 19 bp, Homo sapiens
ttaatcttagtgtatgatt

SEQ ID NO: 4410912 - DNA, 18 bp, Homo sapiens
ttaatctttgtgacagga

SEQ ID NO: 4410913 - DNA, 19 bp, Homo sapiens
ttaatgaaatgataaagac

SEQ ID NO: 4410914 - DNA, 14 bp, Homo sapiens
ttaatgaagaaagt

SEQ ID NO: 4410915 - DNA, 23 bp, Homo sapiens
ttaatgaatcacatttttttatg

SEQ ID NO: 4410916 - DNA, 19 bp, Homo sapiens
ttaatgacaacacttaata

SEQ ID NO: 4410917 - DNA, 22 bp, Homo sapiens
ttaatgaccatgttatattgct

SEQ ID NO: 4410918 - DNA, 11 bp, Homo sapiens
ttaatgactta

SEQ ID NO: 4410919 - DNA, 18 bp, Homo sapiens
ttaatgatgatcttcaga

SEQ ID NO: 4410920 - DNA, 14 bp, Homo sapiens
ttaatgcactttct

SEQ ID NO: 4410921 - DNA, 12 bp, Homo sapiens
ttaatgcattgt

SEQ ID NO: 4410922 - DNA, 20 bp, Homo sapiens
ttaatgcattgttgtaaagt

SEQ ID NO: 4410923 - DNA, 19 bp, Homo sapiens
ttaatgccattatccctga

SEQ ID NO: 4410924 - DNA, 16 bp, Homo sapiens
ttaatgctatttgaac

SEQ ID NO: 4410925 - DNA, 21 bp, Homo sapiens
ttaatgctatttgaacaagtg

SEQ ID NO: 4410926 - DNA, 14 bp, Homo sapiens
ttaatggattgtta

SEQ ID NO: 4410927 - DNA, 16 bp, Homo sapiens
ttaatggattgttaat

SEQ ID NO: 4410928 - DNA, 20 bp, Homo sapiens
ttaatggattgttaatttca

SEQ ID NO: 4410929 - DNA, 21 bp, Homo sapiens
ttaatggattgttaatttcag

SEQ ID NO: 4410930 - DNA, 18 bp, Homo sapiens
ttaatggctgataatttt

SEQ ID NO: 4410931 - DNA, 13 bp, Homo sapiens
ttaatgtaaataa

SEQ ID NO: 4410932 - DNA, 16 bp, Homo sapiens
ttaatgtatctatttg

SEQ ID NO: 4410933 - DNA, 15 bp, Homo sapiens
ttaatgtatgttacc

SEQ ID NO: 4410934 - DNA, 18 bp, Homo sapiens
ttaatgtatgttaccaaa

SEQ ID NO: 4410935 - DNA, 18 bp, Homo sapiens
ttaatgtttctgatttct

SEQ ID NO: 4410936 - DNA, 16 bp, Homo sapiens
ttaatgttttaaatgt

SEQ ID NO: 4410937 - DNA, 18 bp, Homo sapiens
ttaatgttttaaatgtac

SEQ ID NO: 4410938 - DNA, 16 bp, Homo sapiens
ttaattaccaacctgt

SEQ ID NO: 4410939 - DNA, 22 bp, Homo sapiens
ttaattactggaattcttctgc

SEQ ID NO: 4410940 - DNA, 19 bp, Homo sapiens
ttaattaggaattacttta

SEQ ID NO: 4410941 - DNA, 20 bp, Homo sapiens
ttaattaggaattactttat

SEQ ID NO: 4410942 - DNA, 12 bp, Homo sapiens
ttaattataaaa

SEQ ID NO: 4410943 - DNA, 15 bp, Homo sapiens
ttaattcatgaggag

SEQ ID NO: 4410944 - DNA, 16 bp, Homo sapiens
ttaattcttaaaacta

SEQ ID NO: 4410945 - DNA, 17 bp, Homo sapiens
ttaattgctaacaattg

SEQ ID NO: 4410946 - DNA, 14 bp, Homo sapiens
ttaattgctttgaa

SEQ ID NO: 4410947 - DNA, 15 bp, Homo sapiens
ttaattgtaaagtaa

SEQ ID NO: 4410948 - DNA, 15 bp, Homo sapiens
ttaattgtcttgcac

SEQ ID NO: 4410949 - DNA, 21 bp, Homo sapiens
ttaattgttctgctttttctg

SEQ ID NO: 4410950 - DNA, 13 bp, Homo sapiens
ttaatttaaatga

SEQ ID NO: 4410951 - DNA, 16 bp, Homo sapiens
ttaatttaaatgattt

SEQ ID NO: 4410952 - DNA, 16 bp, Homo sapiens
ttactattaactctgc

SEQ ID NO: 4410953 - DNA, 17 bp, Homo sapiens
ttactattaactctgca

SEQ ID NO: 4410954 - DNA, 12 bp, Homo sapiens
ttactcagccct

SEQ ID NO: 4410955 - DNA, 16 bp, Homo sapiens
ttactctccaacctgg

SEQ ID NO: 4410956 - DNA, 12 bp, Homo sapiens
ttactctcttca

SEQ ID NO: 4410957 - DNA, 18 bp, Homo sapiens
ttactctgggagtaatac

SEQ ID NO: 4410958 - DNA, 13 bp, Homo sapiens
ttactctttgaaa

SEQ ID NO: 4410959 - DNA, 13 bp, Homo sapiens
ttactgaatgatc

SEQ ID NO: 4410960 - DNA, 14 bp, Homo sapiens
ttactgaattgtat

SEQ ID NO: 4410961 - DNA, 14 bp, Homo sapiens
ttactgatatattt

SEQ ID NO: 4410962 - DNA, 18 bp, Homo sapiens
ttactgatgtgatattct

SEQ ID NO: 4410963 - DNA, 19 bp, Homo sapiens
ttactgctgattcttgtaa

SEQ ID NO: 4410964 - DNA, 18 bp, Homo sapiens
ttactggaattcttctgc

SEQ ID NO: 4410965 - DNA, 17 bp, Homo sapiens
ttactggacaaagaatt

SEQ ID NO: 4410966 - DNA, 22 bp, Homo sapiens
ttactggatctcttaagacagc

SEQ ID NO: 4410967 - DNA, 18 bp, Homo sapiens
ttactggcctttttcatt

SEQ ID NO: 4410968 - DNA, 20 bp, Homo sapiens
ttactggcctttttcattta

SEQ ID NO: 4410969 - DNA, 21 bp, Homo sapiens
ttactgtagcctcagatgatt

SEQ ID NO: 4410970 - DNA, 21 bp, Homo sapiens
ttactgtatcaatttctaatg

SEQ ID NO: 4410971 - DNA, 15 bp, Homo sapiens
ttactgtatgttttt

SEQ ID NO: 4410972 - DNA, 19 bp, Homo sapiens
ttactgtatgtttttactg

SEQ ID NO: 4410973 - DNA, 21 bp, Homo sapiens
ttactgtatgtttttactgaa

SEQ ID NO: 4410974 - DNA, 12 bp, Homo sapiens
ttactgtatttt

SEQ ID NO: 4410975 - DNA, 15 bp, Homo sapiens
ttactgtcagattaa

SEQ ID NO: 4410976 - DNA, 15 bp, Homo sapiens
ttactgtcattccca

SEQ ID NO: 4410977 - DNA, 13 bp, Homo sapiens
ttactgtgtaatt

SEQ ID NO: 4410978 - DNA, 14 bp, Homo sapiens
ttactgttcttatt

SEQ ID NO: 4410979 - DNA, 16 bp, Homo sapiens
ttactgttcttattgt

SEQ ID NO: 4410980 - DNA, 14 bp, Homo sapiens
ttacttaagtgttc

SEQ ID NO: 4410981 - DNA, 14 bp, Homo sapiens
ttacttaatgacca

SEQ ID NO: 4410982 - DNA, 14 bp, Homo sapiens
ttacttataaagag

SEQ ID NO: 4410983 - DNA, 15 bp, Homo sapiens
ttacttctctataaa

SEQ ID NO: 4410984 - DNA, 12 bp, Homo sapiens
ttacttgaactt

SEQ ID NO: 4410985 - DNA, 17 bp, Homo sapiens
ttacttgaactttccaa

SEQ ID NO: 4410986 - DNA, 14 bp, Homo sapiens
ttactttcaaaatg

SEQ ID NO: 4410987 - DNA, 17 bp, Homo sapiens
ttactttcaagtaatat

SEQ ID NO: 4410988 - DNA, 22 bp, Homo sapiens
ttactttctcccagtatgtttt

SEQ ID NO: 4410989 - DNA, 13 bp, Homo sapiens
ttactttgtgaat

SEQ ID NO: 4410990 - DNA, 14 bp, Homo sapiens
ttacttttaaactg

SEQ ID NO: 4410991 - DNA, 15 bp, Homo sapiens
ttacttttaaactgt

SEQ ID NO: 4410992 - DNA, 15 bp, Homo sapiens
ttactttttaaaaat

SEQ ID NO: 4410993 - DNA, 11 bp, Homo sapiens
ttagaaaaaaa

SEQ ID NO: 4410994 - DNA, 15 bp, Homo sapiens
ttagaaaaaaatgaa

SEQ ID NO: 4410995 - DNA, 16 bp, Homo sapiens
ttagaaaaaaatgaaa

SEQ ID NO: 4410996 - DNA, 21 bp, Homo sapiens
ttagaaaaacatttaaacttt

SEQ ID NO: 4410997 - DNA, 14 bp, Homo sapiens
ttagaaaactttaa

SEQ ID NO: 4410998 - DNA, 19 bp, Homo sapiens
ttagaaaatgacttatttc

SEQ ID NO: 4410999 - DNA, 22 bp, Homo sapiens
ttagaaaggacaacagttctga

SEQ ID NO: 4411000 - DNA, 19 bp, Homo sapiens
ttagaaatattcacatctt

SEQ ID NO: 4411001 - DNA, 18 bp, Homo sapiens
ttagaaatgtttattgac

SEQ ID NO: 4411002 - DNA, 17 bp, Homo sapiens
ttagaaattaaatctgt

SEQ ID NO: 4411003 - DNA, 23 bp, Homo sapiens
ttagaaattacctgtggatattt

SEQ ID NO: 4411004 - DNA, 12 bp, Homo sapiens
ttagaaattggt

SEQ ID NO: 4411005 - DNA, 12 bp, Homo sapiens
ttagaacactat

SEQ ID NO: 4411006 - DNA, 13 bp, Homo sapiens
ttagaacactatt

SEQ ID NO: 4411007 - DNA, 14 bp, Homo sapiens
ttagaacactattt

SEQ ID NO: 4411008 - DNA, 19 bp, Homo sapiens
ttagaacactattttcaga

SEQ ID NO: 4411009 - DNA, 20 bp, Homo sapiens
ttagaacactattttcagaa

SEQ ID NO: 4411010 - DNA, 19 bp, Homo sapiens
ttagaaccacagcagacac

SEQ ID NO: 4411011 - DNA, 21 bp, Homo sapiens
ttagaaccacagcagacacca

SEQ ID NO: 4411012 - DNA, 14 bp, Homo sapiens
ttagaagaagtgtg

SEQ ID NO: 4411013 - DNA, 22 bp, Homo sapiens
ttagaagcaaggagaaaatata

SEQ ID NO: 4411014 - DNA, 13 bp, Homo sapiens
ttagaagcctgca

SEQ ID NO: 4411015 - DNA, 13 bp, Homo sapiens
ttagaataaattc

SEQ ID NO: 4411016 - DNA, 14 bp, Homo sapiens
ttagaatgaattta

SEQ ID NO: 4411017 - DNA, 17 bp, Homo sapiens
ttagaatgaatttatct

SEQ ID NO: 4411018 - DNA, 22 bp, Homo sapiens
ttagaatgaatttatctttacc

SEQ ID NO: 4411019 - DNA, 21 bp, Homo sapiens
ttagaatggaggaagaacaac

SEQ ID NO: 4411020 - DNA, 17 bp, Homo sapiens
ttagaattaaaaaagca

SEQ ID NO: 4411021 - DNA, 17 bp, Homo sapiens
ttagaattaccatttgt

SEQ ID NO: 4411022 - DNA, 16 bp, Homo sapiens
ttagaatttgtttcat

SEQ ID NO: 4411023 - DNA, 13 bp, Homo sapiens
ttagacactttgg

SEQ ID NO: 4411024 - DNA, 19 bp, Homo sapiens
ttagaccagaggtctagat

SEQ ID NO: 4411025 - DNA, 18 bp, Homo sapiens
ttagaccgctctcttttc

SEQ ID NO: 4411026 - DNA, 22 bp, Homo sapiens
ttagaccgctctcttttctgta

SEQ ID NO: 4411027 - DNA, 13 bp, Homo sapiens
ttagagaactaaa

SEQ ID NO: 4411028 - DNA, 15 bp, Homo sapiens
ttagagagaaagaga

SEQ ID NO: 4411029 - DNA, 22 bp, Homo sapiens
ttagagccaggcacacactgtg

SEQ ID NO: 4411030 - DNA, 22 bp, Homo sapiens
ttagagtcaactacacaaagca

SEQ ID NO: 4411031 - DNA, 23 bp, Homo sapiens
ttagagttttattcctttccttt

SEQ ID NO: 4411032 - DNA, 22 bp, Homo sapiens
ttagatatttcgaccctggggc

SEQ ID NO: 4411033 - DNA, 18 bp, Homo sapiens
ttagatccaagccaagtt

SEQ ID NO: 4411034 - DNA, 15 bp, Homo sapiens
ttagatccattaatt

SEQ ID NO: 4411035 - DNA, 17 bp, Homo sapiens
ttagatcttatattggt

SEQ ID NO: 4411036 - DNA, 18 bp, Homo sapiens
ttagatggttacactgtt

SEQ ID NO: 4411037 - DNA, 15 bp, Homo sapiens
ttagatgtatttttg

SEQ ID NO: 4411038 - DNA, 21 bp, Homo sapiens
ttagatgttccagtaatctaa

SEQ ID NO: 4411039 - DNA, 19 bp, Homo sapiens
ttagattgagaaatgtgta

SEQ ID NO: 4411040 - DNA, 21 bp, Homo sapiens
ttagatttctcacactctaac

SEQ ID NO: 4411041 - DNA, 15 bp, Homo sapiens
ttagcagacctaaag

SEQ ID NO: 4411042 - DNA, 19 bp, Homo sapiens
ttagcaggccaaggtctga

SEQ ID NO: 4411043 - DNA, 22 bp, Homo sapiens
ttagcaggttgggctagagaaa

SEQ ID NO: 4411044 - DNA, 13 bp, Homo sapiens
ttagcagtattgt

SEQ ID NO: 4411045 - DNA, 14 bp, Homo sapiens
ttagcatccaggct

SEQ ID NO: 4411046 - DNA, 20 bp, Homo sapiens
ttagcatgttcctccttttc

SEQ ID NO: 4411047 - DNA, 18 bp, Homo sapiens
ttagccagcgtttattgt

SEQ ID NO: 4411048 - DNA, 19 bp, Homo sapiens
ttagccaggtaatgtgaat

SEQ ID NO: 4411049 - DNA, 18 bp, Homo sapiens
ttagccatttttcaaagc

SEQ ID NO: 4411050 - DNA, 21 bp, Homo sapiens
ttagcccaagaggtctgagcc

SEQ ID NO: 4411051 - DNA, 21 bp, Homo sapiens
ttagccctcacattagatcta

SEQ ID NO: 4411052 - DNA, 13 bp, Homo sapiens
ttagcctctccca

SEQ ID NO: 4411053 - DNA, 17 bp, Homo sapiens
ttagcctctcccacccg

SEQ ID NO: 4411054 - DNA, 22 bp, Homo sapiens
ttagcctgtggcagtaaagaga

SEQ ID NO: 4411055 - DNA, 16 bp, Homo sapiens
ttagcctttgtcccag

SEQ ID NO: 4411056 - DNA, 17 bp, Homo sapiens
ttagcgtcaagacattt

SEQ ID NO: 4411057 - DNA, 13 bp, Homo sapiens
ttagcttcaggaa

SEQ ID NO: 4411058 - DNA, 20 bp, Homo sapiens
ttaggaaaataaacagacaa

SEQ ID NO: 4411059 - DNA, 23 bp, Homo sapiens
ttaggaagttgacttatagtaca

SEQ ID NO: 4411060 - DNA, 20 bp, Homo sapiens
ttaggaatatacatagtctt

SEQ ID NO: 4411061 - DNA, 18 bp, Homo sapiens
ttaggaggacaaaaggaa

SEQ ID NO: 4411062 - DNA, 19 bp, Homo sapiens
ttaggaggacaaaaggaat

SEQ ID NO: 4411063 - DNA, 14 bp, Homo sapiens
ttaggatccatgca

SEQ ID NO: 4411064 - DNA, 21 bp, Homo sapiens
ttaggatccatgcagcttttt

SEQ ID NO: 4411065 - DNA, 20 bp, Homo sapiens
ttaggggaagtaaaacagtc

SEQ ID NO: 4411066 - DNA, 21 bp, Homo sapiens
ttaggggaagtaaaacagtca

SEQ ID NO: 4411067 - DNA, 15 bp, Homo sapiens
ttagggtgggtaaga

SEQ ID NO: 4411068 - DNA, 18 bp, Homo sapiens
ttagggttctaaatgcaa

SEQ ID NO: 4411069 - DNA, 16 bp, Homo sapiens
ttagggttctgcctct

SEQ ID NO: 4411070 - DNA, 22 bp, Homo sapiens
ttaggtcccttggtctgtacaa

SEQ ID NO: 4411071 - DNA, 16 bp, Homo sapiens
ttatatgatatgcatg

SEQ ID NO: 4411072 - DNA, 13 bp, Homo sapiens
ttatatgcttact

SEQ ID NO: 4411073 - DNA, 19 bp, Homo sapiens
ttatatgcttactgatata

SEQ ID NO: 4411074 - DNA, 15 bp, Homo sapiens
ttatatggaagaaag

SEQ ID NO: 4411075 - DNA, 18 bp, Homo sapiens
ttatatggaagaaagtaa

SEQ ID NO: 4411076 - DNA, 16 bp, Homo sapiens
ttatatgtacatgaga

SEQ ID NO: 4411077 - DNA, 16 bp, Homo sapiens
ttatatgtaccgtagg

SEQ ID NO: 4411078 - DNA, 20 bp, Homo sapiens
ttatattaatagtaatttgt

SEQ ID NO: 4411079 - DNA, 14 bp, Homo sapiens
ttatattctaatag

SEQ ID NO: 4411080 - DNA, 13 bp, Homo sapiens
ttatatttaactc

SEQ ID NO: 4411081 - DNA, 11 bp, Homo sapiens
ttatatttcag

SEQ ID NO: 4411082 - DNA, 22 bp, Homo sapiens
ttatatttcagatgtaatgttt

SEQ ID NO: 4411083 - DNA, 22 bp, Homo sapiens
ttatatttcctttatgtgaatt

SEQ ID NO: 4411084 - DNA, 21 bp, Homo sapiens
ttatattttaaattagttttt

SEQ ID NO: 4411085 - DNA, 17 bp, Homo sapiens
ttatattttatgaacat

SEQ ID NO: 4411086 - DNA, 23 bp, Homo sapiens
ttatattttatgaacattgtact

SEQ ID NO: 4411087 - DNA, 21 bp, Homo sapiens
ttatcaccgtgggctccctga

SEQ ID NO: 4411088 - DNA, 23 bp, Homo sapiens
ttatcacctaagcacttctagaa

SEQ ID NO: 4411089 - DNA, 14 bp, Homo sapiens
ttatcagtcaatat

SEQ ID NO: 4411090 - DNA, 15 bp, Homo sapiens
ttatcagtcaatatt

SEQ ID NO: 4411091 - DNA, 17 bp, Homo sapiens
ttatcatatccttgccc

SEQ ID NO: 4411092 - DNA, 13 bp, Homo sapiens
ttatcatgaagcc

SEQ ID NO: 4411093 - DNA, 14 bp, Homo sapiens
ttatcatgaagcct

SEQ ID NO: 4411094 - DNA, 16 bp, Homo sapiens
ttatcatgaagcctgt

SEQ ID NO: 4411095 - DNA, 14 bp, Homo sapiens
ttatcatgaatttt

SEQ ID NO: 4411096 - DNA, 19 bp, Homo sapiens
ttatcatgaattttaaagt

SEQ ID NO: 4411097 - DNA, 11 bp, Homo sapiens
ttatcatggaa

SEQ ID NO: 4411098 - DNA, 16 bp, Homo sapiens
ttatcatggaagaaaa

SEQ ID NO: 4411099 - DNA, 17 bp, Homo sapiens
ttatccatattgagtca

SEQ ID NO: 4411100 - DNA, 19 bp, Homo sapiens
ttatccatattgagtcaaa

SEQ ID NO: 4411101 - DNA, 17 bp, Homo sapiens
ttatccccgtttcttgc

SEQ ID NO: 4411102 - DNA, 20 bp, Homo sapiens
ttatccctattttgctgatg

SEQ ID NO: 4411103 - DNA, 16 bp, Homo sapiens
ttatccctctcttccc

SEQ ID NO: 4411104 - DNA, 19 bp, Homo sapiens
ttatccctctcttcccctt

SEQ ID NO: 4411105 - DNA, 23 bp, Homo sapiens
ttatccctctcttccccttccct

SEQ ID NO: 4411106 - DNA, 11 bp, Homo sapiens
ttatcctctgt

SEQ ID NO: 4411107 - DNA, 16 bp, Homo sapiens
ttatcctgcattgtta

SEQ ID NO: 4411108 - DNA, 16 bp, Homo sapiens
ttatcctgtattcttg

SEQ ID NO: 4411109 - DNA, 15 bp, Homo sapiens
ttatccttttatctc

SEQ ID NO: 4411110 - DNA, 17 bp, Homo sapiens
ttatctataatttacct

SEQ ID NO: 4411111 - DNA, 14 bp, Homo sapiens
ttatctatagcaac

SEQ ID NO: 4411112 - DNA, 13 bp, Homo sapiens
ttatctatataaa

SEQ ID NO: 4411113 - DNA, 11 bp, Homo sapiens
ttatctcaaaa

SEQ ID NO: 4411114 - DNA, 13 bp, Homo sapiens
ttatctcacaaat

SEQ ID NO: 4411115 - DNA, 16 bp, Homo sapiens
ttatctcagatgttaa

SEQ ID NO: 4411116 - DNA, 17 bp, Homo sapiens
ttatctgaatttttaaa

SEQ ID NO: 4411117 - DNA, 18 bp, Homo sapiens
ttatctgaatttttaaac

SEQ ID NO: 4411118 - DNA, 20 bp, Homo sapiens
ttatctgaatttttaaacaa

SEQ ID NO: 4411119 - DNA, 14 bp, Homo sapiens
ttatctgatactta

SEQ ID NO: 4411120 - DNA, 15 bp, Homo sapiens
ttatctgcggcttta

SEQ ID NO: 4411121 - DNA, 18 bp, Homo sapiens
ttatctgcggctttaaac

SEQ ID NO: 4411122 - DNA, 19 bp, Homo sapiens
ttatctggaacaacttgta

SEQ ID NO: 4411123 - DNA, 22 bp, Homo sapiens
ttatctggaacaacttgtagca

SEQ ID NO: 4411124 - DNA, 23 bp, Homo sapiens
ttatctgggattatggttttgtg

SEQ ID NO: 4411125 - DNA, 21 bp, Homo sapiens
ttatctgtaattgtaattcca

SEQ ID NO: 4411126 - DNA, 18 bp, Homo sapiens
ttatcttatactgtacaa

SEQ ID NO: 4411127 - DNA, 19 bp, Homo sapiens
ttatcttcaccctcatcct

SEQ ID NO: 4411128 - DNA, 14 bp, Homo sapiens
ttatcttctggatt

SEQ ID NO: 4411129 - DNA, 12 bp, Homo sapiens
ttatctttatat

SEQ ID NO: 4411130 - DNA, 23 bp, Homo sapiens
ttatctttgtattcttcatgaaa

SEQ ID NO: 4411131 - DNA, 17 bp, Homo sapiens
ttatgaaaaagaagaat

SEQ ID NO: 4411132 - DNA, 19 bp, Homo sapiens
ttatgaaaaagaagaatct

SEQ ID NO: 4411133 - DNA, 12 bp, Homo sapiens
ttatgaaaactc

SEQ ID NO: 4411134 - DNA, 15 bp, Homo sapiens
ttatgaaaatcttat

SEQ ID NO: 4411135 - DNA, 15 bp, Homo sapiens
ttatgaacattgtac

SEQ ID NO: 4411136 - DNA, 21 bp, Homo sapiens
ttatgaacattgtactgttgc

SEQ ID NO: 4411137 - DNA, 22 bp, Homo sapiens
ttatgaacattgtactgttgct

SEQ ID NO: 4411138 - DNA, 13 bp, Homo sapiens
ttatgaagagcta

SEQ ID NO: 4411139 - DNA, 15 bp, Homo sapiens
ttatgaagctcatat

SEQ ID NO: 4411140 - DNA, 13 bp, Homo sapiens
ttatgaagttttt

SEQ ID NO: 4411141 - DNA, 14 bp, Homo sapiens
ttatgaatattaaa

SEQ ID NO: 4411142 - DNA, 19 bp, Homo sapiens
ttatgaattataaatgtgt

SEQ ID NO: 4411143 - DNA, 22 bp, Homo sapiens
ttatgacctgaaataatatatt

SEQ ID NO: 4411144 - DNA, 15 bp, Homo sapiens
ttatgactatgtaaa

SEQ ID NO: 4411145 - DNA, 13 bp, Homo sapiens
ttatgagaaactt

SEQ ID NO: 4411146 - DNA, 16 bp, Homo sapiens
ttatgagaggctgtca

SEQ ID NO: 4411147 - DNA, 18 bp, Homo sapiens
ttatgagaggctgtcata

SEQ ID NO: 4411148 - DNA, 19 bp, Homo sapiens
ttatgagaggctgtcatat

SEQ ID NO: 4411149 - DNA, 16 bp, Homo sapiens
ttatgagatactttgc

SEQ ID NO: 4411150 - DNA, 19 bp, Homo sapiens
ttatgaggatataatgtgt

SEQ ID NO: 4411151 - DNA, 19 bp, Homo sapiens
ttatgatttttttttcata

SEQ ID NO: 4411152 - DNA, 22 bp, Homo sapiens
ttatgcactaaatatgaaccct

SEQ ID NO: 4411153 - DNA, 14 bp, Homo sapiens
ttatgcatagataa

SEQ ID NO: 4411154 - DNA, 16 bp, Homo sapiens
ttatgcggttaatttt

SEQ ID NO: 4411155 - DNA, 19 bp, Homo sapiens
ttatgctctcactgtttgt

SEQ ID NO: 4411156 - DNA, 13 bp, Homo sapiens
ttatgctttgaac

SEQ ID NO: 4411157 - DNA, 15 bp, Homo sapiens
ttatgctttgaactt

SEQ ID NO: 4411158 - DNA, 15 bp, Homo sapiens
ttatggaaaaataaa

SEQ ID NO: 4411159 - DNA, 17 bp, Homo sapiens
ttatggaaaaataaaac

SEQ ID NO: 4411160 - DNA, 13 bp, Homo sapiens
ttatggaaaactg

SEQ ID NO: 4411161 - DNA, 20 bp, Homo sapiens
ttatggaattgatttgcatt

SEQ ID NO: 4411162 - DNA, 21 bp, Homo sapiens
ttatggaattgatttgcattg

SEQ ID NO: 4411163 - DNA, 16 bp, Homo sapiens
ttatggatgattaaat

SEQ ID NO: 4411164 - DNA, 16 bp, Homo sapiens
ttatggcagaagggaa

SEQ ID NO: 4411165 - DNA, 18 bp, Homo sapiens
ttatggcctcagctgcct

SEQ ID NO: 4411166 - DNA, 17 bp, Homo sapiens
ttatggctataggtgct

SEQ ID NO: 4411167 - DNA, 19 bp, Homo sapiens
ttatgggaataattgcttt

SEQ ID NO: 4411168 - DNA, 12 bp, Homo sapiens
ttatgggagaat

SEQ ID NO: 4411169 - DNA, 19 bp, Homo sapiens
ttatggtagaaaaatttca

SEQ ID NO: 4411170 - DNA, 21 bp, Homo sapiens
ttatggtcctaaaagcaaaat

SEQ ID NO: 4411171 - DNA, 20 bp, Homo sapiens
ttatggttacttcttctctt

SEQ ID NO: 4411172 - DNA, 20 bp, Homo sapiens
ttatgtaagcatttgtacat

SEQ ID NO: 4411173 - DNA, 21 bp, Homo sapiens
ttatgtaatttctttaaatgt

SEQ ID NO: 4411174 - DNA, 16 bp, Homo sapiens
ttatgtacaaccctga

SEQ ID NO: 4411175 - DNA, 14 bp, Homo sapiens
ttatgtacagaaaa

SEQ ID NO: 4411176 - DNA, 16 bp, Homo sapiens
ttatgtagtaattgac

SEQ ID NO: 4411177 - DNA, 19 bp, Homo sapiens
ttatgtagtaattgacatg

SEQ ID NO: 4411178 - DNA, 20 bp, Homo sapiens
ttatgtatggatatatttga

SEQ ID NO: 4411179 - DNA, 22 bp, Homo sapiens
ttatgtatggatatatttgaaa

SEQ ID NO: 4411180 - DNA, 19 bp, Homo sapiens
ttatgtatttcctggatgt

SEQ ID NO: 4411181 - DNA, 22 bp, Homo sapiens
ttatgtcagcacacacttacag

SEQ ID NO: 4411182 - DNA, 15 bp, Homo sapiens
ttatgtcatagaaat

SEQ ID NO: 4411183 - DNA, 20 bp, Homo sapiens
ttatgtcctgtgagatgtgt

SEQ ID NO: 4411184 - DNA, 13 bp, Homo sapiens
ttatgtctcttga

SEQ ID NO: 4411185 - DNA, 19 bp, Homo sapiens
ttatgtctcttgagcatca

SEQ ID NO: 4411186 - DNA, 24 bp, Homo sapiens
ttatgtctcttgagcatcaatctt

SEQ ID NO: 4411187 - DNA, 17 bp, Homo sapiens
ttatgtctgtggatttt

SEQ ID NO: 4411188 - DNA, 18 bp, Homo sapiens
ttatgtgaaatgctttct

SEQ ID NO: 4411189 - DNA, 13 bp, Homo sapiens
ttatgtgaagaat

SEQ ID NO: 4411190 - DNA, 20 bp, Homo sapiens
ttattttttttttttgaaaa

SEQ ID NO: 4411191 - DNA, 21 bp, Homo sapiens
ttcaaaaataaaaaatctgaa

SEQ ID NO: 4411192 - DNA, 13 bp, Homo sapiens
ttcaaaaatttca

SEQ ID NO: 4411193 - DNA, 16 bp, Homo sapiens
ttcaaaataaaaagta

SEQ ID NO: 4411194 - DNA, 20 bp, Homo sapiens
ttcaaaatagacaagttttg

SEQ ID NO: 4411195 - DNA, 23 bp, Homo sapiens
ttcaaaatattgagcagaattca

SEQ ID NO: 4411196 - DNA, 19 bp, Homo sapiens
ttcaaaatgatagacatat

SEQ ID NO: 4411197 - DNA, 15 bp, Homo sapiens
ttcaaagagaaaaca

SEQ ID NO: 4411198 - DNA, 18 bp, Homo sapiens
ttcaaagaggtgaacatt

SEQ ID NO: 4411199 - DNA, 12 bp, Homo sapiens
ttcaaagcaatt

SEQ ID NO: 4411200 - DNA, 16 bp, Homo sapiens
ttcaaagccaagacct

SEQ ID NO: 4411201 - DNA, 13 bp, Homo sapiens
ttcaaagccagcg

SEQ ID NO: 4411202 - DNA, 23 bp, Homo sapiens
ttcaaagccagcgtcctcctctg

SEQ ID NO: 4411203 - DNA, 16 bp, Homo sapiens
ttcaaagctaaaatat

SEQ ID NO: 4411204 - DNA, 20 bp, Homo sapiens
ttcaaagctgtgtgtttgga

SEQ ID NO: 4411205 - DNA, 17 bp, Homo sapiens
ttcaaatccttattgtt

SEQ ID NO: 4411206 - DNA, 12 bp, Homo sapiens
ttcaaatgaagg

SEQ ID NO: 4411207 - DNA, 19 bp, Homo sapiens
ttcaaatgtgcaatttgta

SEQ ID NO: 4411208 - DNA, 17 bp, Homo sapiens
ttcaaatgttttaaagt

SEQ ID NO: 4411209 - DNA, 17 bp, Homo sapiens
ttcaaattggtctgaaa

SEQ ID NO: 4411210 - DNA, 12 bp, Homo sapiens
ttcaaatttgat

SEQ ID NO: 4411211 - DNA, 14 bp, Homo sapiens
ttcaaatttgatga

SEQ ID NO: 4411212 - DNA, 19 bp, Homo sapiens
ttcaaatttgtaataaaac

SEQ ID NO: 4411213 - DNA, 22 bp, Homo sapiens
ttcaacaaagaaacaaagatgt

SEQ ID NO: 4411214 - DNA, 14 bp, Homo sapiens
ttcaacaattctaa

SEQ ID NO: 4411215 - DNA, 15 bp, Homo sapiens
ttcaacaattctaaa

SEQ ID NO: 4411216 - DNA, 15 bp, Homo sapiens
ttcaacacattttta

SEQ ID NO: 4411217 - DNA, 15 bp, Homo sapiens
ttcaacataaagagc

SEQ ID NO: 4411218 - DNA, 21 bp, Homo sapiens
ttcaacatgttatttgtaata

SEQ ID NO: 4411219 - DNA, 20 bp, Homo sapiens
ttcaacatttttttttctcc

SEQ ID NO: 4411220 - DNA, 23 bp, Homo sapiens
ttcaactaatacatggtttaaag

SEQ ID NO: 4411221 - DNA, 13 bp, Homo sapiens
ttcaactattctt

SEQ ID NO: 4411222 - DNA, 17 bp, Homo sapiens
ttcaactattcttcatt

SEQ ID NO: 4411223 - DNA, 13 bp, Homo sapiens
ttcaactgtttca

SEQ ID NO: 4411224 - DNA, 19 bp, Homo sapiens
ttcaactttgaataaagaa

SEQ ID NO: 4411225 - DNA, 20 bp, Homo sapiens
ttcaactttgaataaagaat

SEQ ID NO: 4411226 - DNA, 14 bp, Homo sapiens
ttcaagaaatgaca

SEQ ID NO: 4411227 - DNA, 23 bp, Homo sapiens
ttcaagaataatcacgctttcct

SEQ ID NO: 4411228 - DNA, 15 bp, Homo sapiens
ttcaagaccagcctg

SEQ ID NO: 4411229 - DNA, 21 bp, Homo sapiens
ttcaagacttgagcggagccc

SEQ ID NO: 4411230 - DNA, 21 bp, Homo sapiens
ttcaagatctaaatcatatat

SEQ ID NO: 4411231 - DNA, 23 bp, Homo sapiens
ttcaagatctaaatcatatataa

SEQ ID NO: 4411232 - DNA, 18 bp, Homo sapiens
ttcaagcctctaaacaga

SEQ ID NO: 4411233 - DNA, 14 bp, Homo sapiens
ttcaagcctgtggg

SEQ ID NO: 4411234 - DNA, 14 bp, Homo sapiens
ttcaagtgccaaac

SEQ ID NO: 4411235 - DNA, 15 bp, Homo sapiens
ttcaagtgcctagac

SEQ ID NO: 4411236 - DNA, 20 bp, Homo sapiens
ttcaagtttttcatactgta

SEQ ID NO: 4411237 - DNA, 22 bp, Homo sapiens
ttcaataaaccacaagcatctc

SEQ ID NO: 4411238 - DNA, 13 bp, Homo sapiens
ttcaatacaaaca

SEQ ID NO: 4411239 - DNA, 23 bp, Homo sapiens
ttcaatacaaacaatctcttaaa

SEQ ID NO: 4411240 - DNA, 21 bp, Homo sapiens
ttcaatagtggcataccaaat

SEQ ID NO: 4411241 - DNA, 23 bp, Homo sapiens
ttcaatagtggcataccaaatgg

SEQ ID NO: 4411242 - DNA, 16 bp, Homo sapiens
ttcaatataagaagca

SEQ ID NO: 4411243 - DNA, 20 bp, Homo sapiens
ttcaatatcagctttgataa

SEQ ID NO: 4411244 - DNA, 16 bp, Homo sapiens
ttcaatattgaatttt

SEQ ID NO: 4411245 - DNA, 14 bp, Homo sapiens
ttcaatctgtaaac

SEQ ID NO: 4411246 - DNA, 21 bp, Homo sapiens
ttcaatgccaatgagtctgta

SEQ ID NO: 4411247 - DNA, 14 bp, Homo sapiens
ttcaatgtgtataa

SEQ ID NO: 4411248 - DNA, 19 bp, Homo sapiens
ttcaatgtgtataaattgt

SEQ ID NO: 4411249 - DNA, 17 bp, Homo sapiens
ttcaattgtgaaaatga

SEQ ID NO: 4411250 - DNA, 18 bp, Homo sapiens
ttcaatttatacctagca

SEQ ID NO: 4411251 - DNA, 20 bp, Homo sapiens
ttcaatttatacctagcact

SEQ ID NO: 4411252 - DNA, 14 bp, Homo sapiens
ttcaatttcaaact

SEQ ID NO: 4411253 - DNA, 20 bp, Homo sapiens
ttcacaaaatgcacttctat

SEQ ID NO: 4411254 - DNA, 16 bp, Homo sapiens
ttcacaaactgtgaaa

SEQ ID NO: 4411255 - DNA, 21 bp, Homo sapiens
ttcacaaactgtgaaaatagt

SEQ ID NO: 4411256 - DNA, 22 bp, Homo sapiens
ttcacaacagcctgacaacatt

SEQ ID NO: 4411257 - DNA, 20 bp, Homo sapiens
ttcacaagcctcctgtacct

SEQ ID NO: 4411258 - DNA, 16 bp, Homo sapiens
ttcacaattattccaa

SEQ ID NO: 4411259 - DNA, 21 bp, Homo sapiens
ttcacactgcaagagccttgg

SEQ ID NO: 4411260 - DNA, 13 bp, Homo sapiens
ttcacaggcactc

SEQ ID NO: 4411261 - DNA, 22 bp, Homo sapiens
ttcacaggttttatgtgttctt

SEQ ID NO: 4411262 - DNA, 19 bp, Homo sapiens
ttcacagtacccaaactgc

SEQ ID NO: 4411263 - DNA, 16 bp, Homo sapiens
ttcacagtcactgatg

SEQ ID NO: 4411264 - DNA, 17 bp, Homo sapiens
ttcacatcccattggga

SEQ ID NO: 4411265 - DNA, 20 bp, Homo sapiens
ttcacatctaacctcatctt

SEQ ID NO: 4411266 - DNA, 14 bp, Homo sapiens
ttcacattattctg

SEQ ID NO: 4411267 - DNA, 14 bp, Homo sapiens
ttcacatttagaaa

SEQ ID NO: 4411268 - DNA, 14 bp, Homo sapiens
ttcacattttctca

SEQ ID NO: 4411269 - DNA, 16 bp, Homo sapiens
ttcacatttttgtaat

SEQ ID NO: 4411270 - DNA, 14 bp, Homo sapiens
ttcaccagtgttcc

SEQ ID NO: 4411271 - DNA, 16 bp, Homo sapiens
ttcaccagtgttcctg

SEQ ID NO: 4411272 - DNA, 18 bp, Homo sapiens
ttcaccagtgttcctgaa

SEQ ID NO: 4411273 - DNA, 21 bp, Homo sapiens
ttcaccccagtggccactcag

SEQ ID NO: 4411274 - DNA, 23 bp, Homo sapiens
ttcaccccatccctccttaagag

SEQ ID NO: 4411275 - DNA, 12 bp, Homo sapiens
ttcacccctccc

SEQ ID NO: 4411276 - DNA, 18 bp, Homo sapiens
ttcacccctccctttctc

SEQ ID NO: 4411277 - DNA, 17 bp, Homo sapiens
ttcacctgtaaaacttt

SEQ ID NO: 4411278 - DNA, 18 bp, Homo sapiens
ttcacctgtaaacctgag

SEQ ID NO: 4411279 - DNA, 19 bp, Homo sapiens
ttcacctgtatatttcttt

SEQ ID NO: 4411280 - DNA, 15 bp, Homo sapiens
ttcaccttagtgcaa

SEQ ID NO: 4411281 - DNA, 15 bp, Homo sapiens
ttcacgattcatttt

SEQ ID NO: 4411282 - DNA, 22 bp, Homo sapiens
ttcacgccattctcctgcctca

SEQ ID NO: 4411283 - DNA, 22 bp, Homo sapiens
ttcactgagttttgtttcactt

SEQ ID NO: 4411284 - DNA, 14 bp, Homo sapiens
ttcactgggccagt

SEQ ID NO: 4411285 - DNA, 19 bp, Homo sapiens
ttcactggggcatgagatt

SEQ ID NO: 4411286 - DNA, 21 bp, Homo sapiens
ttcactggggcatgagatttt

SEQ ID NO: 4411287 - DNA, 16 bp, Homo sapiens
ttcactggttttacac

SEQ ID NO: 4411288 - DNA, 15 bp, Homo sapiens
ttcactgtatataaa

SEQ ID NO: 4411289 - DNA, 19 bp, Homo sapiens
ttcactgtttcatctaagt

SEQ ID NO: 4411290 - DNA, 23 bp, Homo sapiens
ttcactgtttcatctaagtgcct

SEQ ID NO: 4411291 - DNA, 16 bp, Homo sapiens
ttcacttaaactttgt

SEQ ID NO: 4411292 - DNA, 18 bp, Homo sapiens
ttcacttaaactttgtca

SEQ ID NO: 4411293 - DNA, 19 bp, Homo sapiens
ttcacttaaactttgtcac

SEQ ID NO: 4411294 - DNA, 22 bp, Homo sapiens
ttcacttacaagaaaggcctga

SEQ ID NO: 4411295 - DNA, 20 bp, Homo sapiens
ttcacttgtgtgtgtacctg

SEQ ID NO: 4411296 - DNA, 14 bp, Homo sapiens
ttcactttcttcaa

SEQ ID NO: 4411297 - DNA, 16 bp, Homo sapiens
ttcactttcttcaaag

SEQ ID NO: 4411298 - DNA, 21 bp, Homo sapiens
ttcactttggggccaattact

SEQ ID NO: 4411299 - DNA, 15 bp, Homo sapiens
ttcagaacctcttcc

SEQ ID NO: 4411300 - DNA, 19 bp, Homo sapiens
ttcagaacctcttccccag

SEQ ID NO: 4411301 - DNA, 21 bp, Homo sapiens
ttcagaactaaatttttcata

SEQ ID NO: 4411302 - DNA, 22 bp, Homo sapiens
ttcagaactgagggctctgttt

SEQ ID NO: 4411303 - DNA, 16 bp, Homo sapiens
ttcagaagcaagccag

SEQ ID NO: 4411304 - DNA, 18 bp, Homo sapiens
ttcagaagcaagccagac

SEQ ID NO: 4411305 - DNA, 17 bp, Homo sapiens
ttcagaatctgaatgta

SEQ ID NO: 4411306 - DNA, 18 bp, Homo sapiens
ttcagaatctgaatgtaa

SEQ ID NO: 4411307 - DNA, 22 bp, Homo sapiens
ttgcagctcccattctatgtgt

SEQ ID NO: 4411308 - DNA, 20 bp, Homo sapiens
ttgcaggatctgtctgtgca

SEQ ID NO: 4411309 - DNA, 21 bp, Homo sapiens
ttgcaggatctgtctgtgcac

SEQ ID NO: 4411310 - DNA, 17 bp, Homo sapiens
ttgcaggctgagtccct

SEQ ID NO: 4411311 - DNA, 19 bp, Homo sapiens
ttgcaggtggaactcagtc

SEQ ID NO: 4411312 - DNA, 19 bp, Homo sapiens
ttgcagttggactctcagg

SEQ ID NO: 4411313 - DNA, 19 bp, Homo sapiens
ttgcagtttatcattcaag

SEQ ID NO: 4411314 - DNA, 21 bp, Homo sapiens
ttgcagtttcatgtatgtata

SEQ ID NO: 4411315 - DNA, 16 bp, Homo sapiens
ttgcatattttgagaa

SEQ ID NO: 4411316 - DNA, 22 bp, Homo sapiens
ttgcatattttgagaaactgct

SEQ ID NO: 4411317 - DNA, 13 bp, Homo sapiens
ttgcatcaatttt

SEQ ID NO: 4411318 - DNA, 14 bp, Homo sapiens
ttgcatccattgtt

SEQ ID NO: 4411319 - DNA, 20 bp, Homo sapiens
ttgcatccattgttgtgtct

SEQ ID NO: 4411320 - DNA, 21 bp, Homo sapiens
ttgcatccattgttgtgtctg

SEQ ID NO: 4411321 - DNA, 23 bp, Homo sapiens
ttgcatcccaaaccacgcctctt

SEQ ID NO: 4411322 - DNA, 20 bp, Homo sapiens
ttgcatctcccagataatgt

SEQ ID NO: 4411323 - DNA, 11 bp, Homo sapiens
ttgcatgaaat

SEQ ID NO: 4411324 - DNA, 15 bp, Homo sapiens
ttgcatgcaatttga

SEQ ID NO: 4411325 - DNA, 19 bp, Homo sapiens
ttgcatggtttggagctga

SEQ ID NO: 4411326 - DNA, 17 bp, Homo sapiens
ttgcatgtagtaacact

SEQ ID NO: 4411327 - DNA, 15 bp, Homo sapiens
ttgcatgtggatcaa

SEQ ID NO: 4411328 - DNA, 13 bp, Homo sapiens
ttgcattaaattc

SEQ ID NO: 4411329 - DNA, 21 bp, Homo sapiens
ttgcattaaattcacaaactt

SEQ ID NO: 4411330 - DNA, 21 bp, Homo sapiens
ttgcattgaccgcgactaatt

SEQ ID NO: 4411331 - DNA, 15 bp, Homo sapiens
ttgcattgccaagtg

SEQ ID NO: 4411332 - DNA, 19 bp, Homo sapiens
ttgcattggggttcctctg

SEQ ID NO: 4411333 - DNA, 20 bp, Homo sapiens
ttgcattggggttcctctgt

SEQ ID NO: 4411334 - DNA, 15 bp, Homo sapiens
ttgcattgtatgaaa

SEQ ID NO: 4411335 - DNA, 13 bp, Homo sapiens
ttgcattgtctgt

SEQ ID NO: 4411336 - DNA, 20 bp, Homo sapiens
ttgcatttaaaacagacact

SEQ ID NO: 4411337 - DNA, 20 bp, Homo sapiens
ttgcatttatatgtaccgta

SEQ ID NO: 4411338 - DNA, 21 bp, Homo sapiens
ttgcatttttgttttgaaagt

SEQ ID NO: 4411339 - DNA, 15 bp, Homo sapiens
ttgccaaaaaggata

SEQ ID NO: 4411340 - DNA, 16 bp, Homo sapiens
ttgccaaaataccaga

SEQ ID NO: 4411341 - DNA, 20 bp, Homo sapiens
ttgccaaaataccagagcct

SEQ ID NO: 4411342 - DNA, 15 bp, Homo sapiens
ttgccaacagttgta

SEQ ID NO: 4411343 - DNA, 15 bp, Homo sapiens
ttgccaactccatct

SEQ ID NO: 4411344 - DNA, 22 bp, Homo sapiens
ttgccaagaaaatgaagggatt

SEQ ID NO: 4411345 - DNA, 21 bp, Homo sapiens
ttgccaagctaatctgcctgg

SEQ ID NO: 4411346 - DNA, 17 bp, Homo sapiens
ttgccaaggctctcccc

SEQ ID NO: 4411347 - DNA, 20 bp, Homo sapiens
ttgccacagtagaactgtct

SEQ ID NO: 4411348 - DNA, 18 bp, Homo sapiens
ttgccaccccaccctccc

SEQ ID NO: 4411349 - DNA, 19 bp, Homo sapiens
ttgccaccccaccctccct

SEQ ID NO: 4411350 - DNA, 23 bp, Homo sapiens
ttgccaccccaccctccctggag

SEQ ID NO: 4411351 - DNA, 12 bp, Homo sapiens
ttgccagcagag

SEQ ID NO: 4411352 - DNA, 15 bp, Homo sapiens
ttgccagcagagcca

SEQ ID NO: 4411353 - DNA, 18 bp, Homo sapiens
ttgccagcagagccaggg

SEQ ID NO: 4411354 - DNA, 21 bp, Homo sapiens
ttgccagcagagccagggcag

SEQ ID NO: 4411355 - DNA, 22 bp, Homo sapiens
ttgccaggaaaggagagtactt

SEQ ID NO: 4411356 - DNA, 12 bp, Homo sapiens
ttgccaggagga

SEQ ID NO: 4411357 - DNA, 16 bp, Homo sapiens
ttgccaggcttaagga

SEQ ID NO: 4411358 - DNA, 22 bp, Homo sapiens
ttgccagggatgggcagcccaa

SEQ ID NO: 4411359 - DNA, 16 bp, Homo sapiens
ttgccagtgtctttct

SEQ ID NO: 4411360 - DNA, 17 bp, Homo sapiens
ttgccagtgtctttctt

SEQ ID NO: 4411361 - DNA, 15 bp, Homo sapiens
ttgcccagcctggat

SEQ ID NO: 4411362 - DNA, 20 bp, Homo sapiens
ttgcccagtacatttaaatt

SEQ ID NO: 4411363 - DNA, 18 bp, Homo sapiens
ttgcccagtgagccctgc

SEQ ID NO: 4411364 - DNA, 19 bp, Homo sapiens
ttgcccagtgagccctgct

SEQ ID NO: 4411365 - DNA, 13 bp, Homo sapiens
ttgcccatcctga

SEQ ID NO: 4411366 - DNA, 14 bp, Homo sapiens
ttgcccatcctgac

SEQ ID NO: 4411367 - DNA, 16 bp, Homo sapiens
ttgcccatcctgactg

SEQ ID NO: 4411368 - DNA, 15 bp, Homo sapiens
ttgcccatttacact

SEQ ID NO: 4411369 - DNA, 16 bp, Homo sapiens
ttgccccccgccctca

SEQ ID NO: 4411370 - DNA, 16 bp, Homo sapiens
ttgccccctctcactt

SEQ ID NO: 4411371 - DNA, 12 bp, Homo sapiens
ttgcccctggct

SEQ ID NO: 4411372 - DNA, 17 bp, Homo sapiens
ttgcccctggctttgcc

SEQ ID NO: 4411373 - DNA, 19 bp, Homo sapiens
ttgcccgaaactaagccag

SEQ ID NO: 4411374 - DNA, 22 bp, Homo sapiens
ttgcccgctcccacagcttcct

SEQ ID NO: 4411375 - DNA, 13 bp, Homo sapiens
ttgccctccaaat

SEQ ID NO: 4411376 - DNA, 19 bp, Homo sapiens
ttgccctcccctgcccctc

SEQ ID NO: 4411377 - DNA, 12 bp, Homo sapiens
ttgccctcctgg

SEQ ID NO: 4411378 - DNA, 10 bp, Homo sapiens
ttgccctggt

SEQ ID NO: 4411379 - DNA, 19 bp, Homo sapiens
ttgcctaagcattgcctgg

SEQ ID NO: 4411380 - DNA, 20 bp, Homo sapiens
ttgcctaagcattgcctggc

SEQ ID NO: 4411381 - DNA, 20 bp, Homo sapiens
ttgcctatgcccagggaata

SEQ ID NO: 4411382 - DNA, 21 bp, Homo sapiens
ttgcctccccatttcccatct

SEQ ID NO: 4411383 - DNA, 16 bp, Homo sapiens
ttgcctctgccctgga

SEQ ID NO: 4411384 - DNA, 20 bp, Homo sapiens
ttgcctctgtccccttctct

SEQ ID NO: 4411385 - DNA, 17 bp, Homo sapiens
ttgcctcttccagtctt

SEQ ID NO: 4411386 - DNA, 13 bp, Homo sapiens
ttgcctgtcaagt

SEQ ID NO: 4411387 - DNA, 22 bp, Homo sapiens
ttgccttatttctcattgcctc

SEQ ID NO: 4411388 - DNA, 17 bp, Homo sapiens
ttgccttctcaccagct

SEQ ID NO: 4411389 - DNA, 23 bp, Homo sapiens
ttgccttctcaccagctgcaaag

SEQ ID NO: 4411390 - DNA, 19 bp, Homo sapiens
ttgccttctggtttcttcc

SEQ ID NO: 4411391 - DNA, 20 bp, Homo sapiens
ttgccttgggctgctcctca

SEQ ID NO: 4411392 - DNA, 22 bp, Homo sapiens
ttgcctttaatattttgtaata

SEQ ID NO: 4411393 - DNA, 17 bp, Homo sapiens
ttgcctttgttttgatg

SEQ ID NO: 4411394 - DNA, 15 bp, Homo sapiens
ttgccttttaatttt

SEQ ID NO: 4411395 - DNA, 19 bp, Homo sapiens
ttgccttttgcaaccagga

SEQ ID NO: 4411396 - DNA, 12 bp, Homo sapiens
ttgccttttgtt

SEQ ID NO: 4411397 - DNA, 22 bp, Homo sapiens
ttgccttttttctatatcaaaa

SEQ ID NO: 4411398 - DNA, 20 bp, Homo sapiens
ttgcgctcaggggctccatg

SEQ ID NO: 4411399 - DNA, 17 bp, Homo sapiens
ttgcggcaaaaggaaag

SEQ ID NO: 4411400 - DNA, 14 bp, Homo sapiens
ttgcgttcaaagag

SEQ ID NO: 4411401 - DNA, 20 bp, Homo sapiens
ttgctaagaatgtctatttc

SEQ ID NO: 4411402 - DNA, 13 bp, Homo sapiens
ttgctaaggcagc

SEQ ID NO: 4411403 - DNA, 13 bp, Homo sapiens
ttgctacataatt

SEQ ID NO: 4411404 - DNA, 22 bp, Homo sapiens
ttgctaccagtatttagaagcc

SEQ ID NO: 4411405 - DNA, 21 bp, Homo sapiens
ttgctacctcagtgctcctgg

SEQ ID NO: 4411406 - DNA, 22 bp, Homo sapiens
ttgctatattcctttttctatg

SEQ ID NO: 4411407 - DNA, 20 bp, Homo sapiens
ttgctatgagctggggatgt

SEQ ID NO: 4411408 - DNA, 14 bp, Homo sapiens
ttgctatgtaaggg

SEQ ID NO: 4411409 - DNA, 17 bp, Homo sapiens
ttgctatgtaagggtct

SEQ ID NO: 4411410 - DNA, 12 bp, Homo sapiens
ttgctatttcaa

SEQ ID NO: 4411411 - DNA, 17 bp, Homo sapiens
ttgctatttcaataaca

SEQ ID NO: 4411412 - DNA, 23 bp, Homo sapiens
ttgctcagagaaggaaaagactg

SEQ ID NO: 4411413 - DNA, 21 bp, Homo sapiens
ttgctcccggggactcaagag

SEQ ID NO: 4411414 - DNA, 14 bp, Homo sapiens
ttgctccctctcca

SEQ ID NO: 4411415 - DNA, 20 bp, Homo sapiens
ttgctcgcccagacaccatg

SEQ ID NO: 4411416 - DNA, 22 bp, Homo sapiens
ttgctcgcttgctggaacacag

SEQ ID NO: 4411417 - DNA, 18 bp, Homo sapiens
ttgctctcttcaataaac

SEQ ID NO: 4411418 - DNA, 18 bp, Homo sapiens
ttgctctgacctcctctg

SEQ ID NO: 4411419 - DNA, 19 bp, Homo sapiens
ttgctctgacctcctctgg

SEQ ID NO: 4411420 - DNA, 13 bp, Homo sapiens
ttgctctgtcacc

SEQ ID NO: 4411421 - DNA, 21 bp, Homo sapiens
ttgctctgtcccccaggctgg

SEQ ID NO: 4411422 - DNA, 20 bp, Homo sapiens
ttgctctgttacccaggctg

SEQ ID NO: 4411423 - DNA, 20 bp, Homo sapiens
ttgctctgtttgtggggtga

SEQ ID NO: 4411424 - DNA, 16 bp, Homo sapiens
ttggctgttccagact

SEQ ID NO: 4411425 - DNA, 21 bp, Homo sapiens
ttggctgttttccctctgctg

SEQ ID NO: 4411426 - DNA, 13 bp, Homo sapiens
ttggcttgctgtt

SEQ ID NO: 4411427 - DNA, 19 bp, Homo sapiens
ttggctttcagagccagcc

SEQ ID NO: 4411428 - DNA, 18 bp, Homo sapiens
ttgggaactgaactcact

SEQ ID NO: 4411429 - DNA, 10 bp, Homo sapiens
ttgggaagaa

SEQ ID NO: 4411430 - DNA, 19 bp, Homo sapiens
ttgggagaagcaaatatag

SEQ ID NO: 4411431 - DNA, 16 bp, Homo sapiens
ttgggaggccgaggcg

SEQ ID NO: 4411432 - DNA, 13 bp, Homo sapiens
ttgggagttttta

SEQ ID NO: 4411433 - DNA, 14 bp, Homo sapiens
ttgggatactgtaa

SEQ ID NO: 4411434 - DNA, 15 bp, Homo sapiens
ttgggatatctcctg

SEQ ID NO: 4411435 - DNA, 23 bp, Homo sapiens
ttgggatgtcttatttttagatg

SEQ ID NO: 4411436 - DNA, 22 bp, Homo sapiens
ttgggatgttccttttttcaat

SEQ ID NO: 4411437 - DNA, 13 bp, Homo sapiens
ttgggcagccagg

SEQ ID NO: 4411438 - DNA, 11 bp, Homo sapiens
ttgggcccagg

SEQ ID NO: 4411439 - DNA, 13 bp, Homo sapiens
ttgggctggagct

SEQ ID NO: 4411440 - DNA, 16 bp, Homo sapiens
ttgggcttccatgcct

SEQ ID NO: 4411441 - DNA, 12 bp, Homo sapiens
ttggggaggcaa

SEQ ID NO: 4411442 - DNA, 15 bp, Homo sapiens
ttggggctcccagcc

SEQ ID NO: 4411443 - DNA, 15 bp, Homo sapiens
ttggggcttcacagc

SEQ ID NO: 4411444 - DNA, 21 bp, Homo sapiens
ttggggctttacatactttat

SEQ ID NO: 4411445 - DNA, 23 bp, Homo sapiens
ttgggggacagggctggcccagc

SEQ ID NO: 4411446 - DNA, 22 bp, Homo sapiens
ttggggggagggggtgtctgca

SEQ ID NO: 4411447 - DNA, 16 bp, Homo sapiens
ttggggtacaattgta

SEQ ID NO: 4411448 - DNA, 21 bp, Homo sapiens
ttgggtagggtaggggaagga

SEQ ID NO: 4411449 - DNA, 23 bp, Homo sapiens
ttgggtcagagaaaatgagaaag

SEQ ID NO: 4411450 - DNA, 18 bp, Homo sapiens
ttgggtctctctcggccc

SEQ ID NO: 4411451 - DNA, 15 bp, Homo sapiens
ttgggtgtagatttc

SEQ ID NO: 4411452 - DNA, 21 bp, Homo sapiens
ttgggttcatgatgcagtctc

SEQ ID NO: 4411453 - DNA, 17 bp, Homo sapiens
ttgggtttttgctgttt

SEQ ID NO: 4411454 - DNA, 15 bp, Homo sapiens
ttgggtttttttcct

SEQ ID NO: 4411455 - DNA, 20 bp, Homo sapiens
ttggtaaaaatgctgctctc

SEQ ID NO: 4411456 - DNA, 21 bp, Homo sapiens
ttggtaaaacagtttcatcta

SEQ ID NO: 4411457 - DNA, 15 bp, Homo sapiens
ttggtaacttttgtg

SEQ ID NO: 4411458 - DNA, 13 bp, Homo sapiens
ttggtacaaaaat

SEQ ID NO: 4411459 - DNA, 15 bp, Homo sapiens
ttggtacaaaaataa

SEQ ID NO: 4411460 - DNA, 14 bp, Homo sapiens
ttggtacacatgtg

SEQ ID NO: 4411461 - DNA, 15 bp, Homo sapiens
ttggtagcaaagtaa

SEQ ID NO: 4411462 - DNA, 21 bp, Homo sapiens
ttggtattatataattcaagg

SEQ ID NO: 4411463 - DNA, 23 bp, Homo sapiens
ttggtcccaagcctgatacttta

SEQ ID NO: 4411464 - DNA, 13 bp, Homo sapiens
ttggtccctgggg

SEQ ID NO: 4411465 - DNA, 17 bp, Homo sapiens
ttggtcctggtgctgcc

SEQ ID NO: 4411466 - DNA, 19 bp, Homo sapiens
ttggtcctggtgctgccga

SEQ ID NO: 4411467 - DNA, 22 bp, Homo sapiens
ttggtctcccttctctacactc

SEQ ID NO: 4411468 - DNA, 20 bp, Homo sapiens
ttggtgccgatgttgaactt

SEQ ID NO: 4411469 - DNA, 17 bp, Homo sapiens
ttggtgcctttcctgtt

SEQ ID NO: 4411470 - DNA, 18 bp, Homo sapiens
ttggtggcatcacagacc

SEQ ID NO: 4411471 - DNA, 15 bp, Homo sapiens
ttggtgtaatttgaa

SEQ ID NO: 4411472 - DNA, 20 bp, Homo sapiens
ttggtgtaatttgaagattg

SEQ ID NO: 4411473 - DNA, 14 bp, Homo sapiens
ttggtgtctgcggg

SEQ ID NO: 4411474 - DNA, 21 bp, Homo sapiens
ttggtgttacacagcccaaga

SEQ ID NO: 4411475 - DNA, 22 bp, Homo sapiens
ttggtgttacacagcccaagag

SEQ ID NO: 4411476 - DNA, 13 bp, Homo sapiens
ttggtgttggctg

SEQ ID NO: 4411477 - DNA, 18 bp, Homo sapiens
ttggtgtttgactgtaat

SEQ ID NO: 4411478 - DNA, 14 bp, Homo sapiens
ttggttcattaatt

SEQ ID NO: 4411479 - DNA, 13 bp, Homo sapiens
ttggttttatggt

SEQ ID NO: 4411480 - DNA, 12 bp, Homo sapiens
ttggttttcttg

SEQ ID NO: 4411481 - DNA, 21 bp, Homo sapiens
ttggttttgctacataattat

SEQ ID NO: 4411482 - DNA, 23 bp, Homo sapiens
ttggtttttacttaactgtttca

SEQ ID NO: 4411483 - DNA, 12 bp, Homo sapiens
ttgtaaaaatga

SEQ ID NO: 4411484 - DNA, 14 bp, Homo sapiens
ttgtaaaacaggta

SEQ ID NO: 4411485 - DNA, 15 bp, Homo sapiens
ttgtaaaagaaatca

SEQ ID NO: 4411486 - DNA, 22 bp, Homo sapiens
ttgtaaaagaaatcatgtccat

SEQ ID NO: 4411487 - DNA, 17 bp, Homo sapiens
ttgtaaaatagaaaaag

SEQ ID NO: 4411488 - DNA, 22 bp, Homo sapiens
ttgtaaaatgcttttcactttc

SEQ ID NO: 4411489 - DNA, 12 bp, Homo sapiens
ttgtaaagactg

SEQ ID NO: 4411490 - DNA, 21 bp, Homo sapiens
ttgtaaagttggttggataag

SEQ ID NO: 4411491 - DNA, 22 bp, Homo sapiens
ttgtaaatattgctaaaagcat

SEQ ID NO: 4411492 - DNA, 14 bp, Homo sapiens
ttgtaaatcttttt

SEQ ID NO: 4411493 - DNA, 18 bp, Homo sapiens
ttgtaaatgtgcttttaa

SEQ ID NO: 4411494 - DNA, 19 bp, Homo sapiens
ttgtaaatttatgtgatgg

SEQ ID NO: 4411495 - DNA, 21 bp, Homo sapiens
ttgtaaccagaattatacagt

SEQ ID NO: 4411496 - DNA, 21 bp, Homo sapiens
ttgtaactgtttagatgaatg

SEQ ID NO: 4411497 - DNA, 22 bp, Homo sapiens
ttgtaactgtttagatgaatgt

SEQ ID NO: 4411498 - DNA, 13 bp, Homo sapiens
ttgtaacttcaaa

SEQ ID NO: 4411499 - DNA, 15 bp, Homo sapiens
ttgtaacttcaaata

SEQ ID NO: 4411500 - DNA, 15 bp, Homo sapiens
ttgtaagaaggcaat

SEQ ID NO: 4411501 - DNA, 19 bp, Homo sapiens
ttgtaagaaggcaatatta

SEQ ID NO: 4411502 - DNA, 21 bp, Homo sapiens
ttgtaaggatgattttaatat

SEQ ID NO: 4411503 - DNA, 13 bp, Homo sapiens
ttgtaataaaact

SEQ ID NO: 4411504 - DNA, 21 bp, Homo sapiens
ttgtaataaaactatttgtat

SEQ ID NO: 4411505 - DNA, 20 bp, Homo sapiens
ttgtaataagcaatcaaggt

SEQ ID NO: 4411506 - DNA, 22 bp, Homo sapiens
ttgtaatactttctatgtgaca

SEQ ID NO: 4411507 - DNA, 22 bp, Homo sapiens
ttgtaatgaattcctagaatta

SEQ ID NO: 4411508 - DNA, 23 bp, Homo sapiens
ttgtaattccaaaatccaaaaag

SEQ ID NO: 4411509 - DNA, 16 bp, Homo sapiens
ttgtaatttaaaataa

SEQ ID NO: 4411510 - DNA, 13 bp, Homo sapiens
ttgtacaaacttt

SEQ ID NO: 4411511 - DNA, 16 bp, Homo sapiens
ttgtacagtttttatt

SEQ ID NO: 4411512 - DNA, 16 bp, Homo sapiens
ttgtacatatcaaata

SEQ ID NO: 4411513 - DNA, 17 bp, Homo sapiens
ttgtacatatcaaatag

SEQ ID NO: 4411514 - DNA, 22 bp, Homo sapiens
ttgtacatatcctttggtcctg

SEQ ID NO: 4411515 - DNA, 21 bp, Homo sapiens
ttgtacattttgtaaaatatt

SEQ ID NO: 4411516 - DNA, 12 bp, Homo sapiens
ttgtaccagtga

SEQ ID NO: 4411517 - DNA, 19 bp, Homo sapiens
ttgtaccatagaaaaatgt

SEQ ID NO: 4411518 - DNA, 16 bp, Homo sapiens
ttgtaccgcaatgtga

SEQ ID NO: 4411519 - DNA, 20 bp, Homo sapiens
ttgtacgttatatattgtat

SEQ ID NO: 4411520 - DNA, 13 bp, Homo sapiens
ttgtactccagcc

SEQ ID NO: 4411521 - DNA, 22 bp, Homo sapiens
ttgtactgaatttttttgtaat

SEQ ID NO: 4411522 - DNA, 17 bp, Homo sapiens
ttgtactgttgctttaa

SEQ ID NO: 4411523 - DNA, 22 bp, Homo sapiens
ttgtagaataaatggtttctca

SEQ ID NO: 4411524 - DNA, 23 bp, Homo sapiens
ttgtagagaacacgcgtatttac

SEQ ID NO: 4411525 - DNA, 15 bp, Homo sapiens
ttgtagattgattgt

SEQ ID NO: 4411526 - DNA, 23 bp, Homo sapiens
ttgtagcagctatatatttcccc

SEQ ID NO: 4411527 - DNA, 21 bp, Homo sapiens
ttgtagctaaaaataaaacat

SEQ ID NO: 4411528 - DNA, 19 bp, Homo sapiens
ttgtagtaaactattctta

SEQ ID NO: 4411529 - DNA, 19 bp, Homo sapiens
ttgtagtgccactgttgtt

SEQ ID NO: 4411530 - DNA, 15 bp, Homo sapiens
ttgtagttaatataa

SEQ ID NO: 4411531 - DNA, 18 bp, Homo sapiens
ttgtagtttgaaagttgt

SEQ ID NO: 4411532 - DNA, 23 bp, Homo sapiens
ttgtagtttgaaagttgtacatg

SEQ ID NO: 4411533 - DNA, 11 bp, Homo sapiens
ttgtataaatt

SEQ ID NO: 4411534 - DNA, 21 bp, Homo sapiens
ttgtataattggatttcctaa

SEQ ID NO: 4411535 - DNA, 15 bp, Homo sapiens
ttgtatactttaaat

SEQ ID NO: 4411536 - DNA, 20 bp, Homo sapiens
ttgtatactttaaataattt

SEQ ID NO: 4411537 - DNA, 13 bp, Homo sapiens
ttgtatattacaa

SEQ ID NO: 4411538 - DNA, 22 bp, Homo sapiens
ttgtatattacaacatttatgt

SEQ ID NO: 4411539 - DNA, 14 bp, Homo sapiens
ttgtatattacaat

SEQ ID NO: 4411540 - DNA, 19 bp, Homo sapiens
ttgtatattgtgtttgtgt

SEQ ID NO: 4411541 - DNA, 16 bp, Homo sapiens
ttgtatcacaaatctt

SEQ ID NO: 4411542 - DNA, 21 bp, Homo sapiens
ttgttaatgcattgttgtaaa

SEQ ID NO: 4411543 - DNA, 15 bp, Homo sapiens
ttgttaattaaatat

SEQ ID NO: 4411544 - DNA, 22 bp, Homo sapiens
ttgttaatttagaaaactttaa

SEQ ID NO: 4411545 - DNA, 13 bp, Homo sapiens
ttgttagagagaa

SEQ ID NO: 4411546 - DNA, 12 bp, Homo sapiens
ttgttagatgtt

SEQ ID NO: 4411547 - DNA, 23 bp, Homo sapiens
ttgttagcaaactatttcagtga

SEQ ID NO: 4411548 - DNA, 14 bp, Homo sapiens
ttgttatgttcaat

SEQ ID NO: 4411549 - DNA, 15 bp, Homo sapiens
ttgttattaaacaaa

SEQ ID NO: 4411550 - DNA, 13 bp, Homo sapiens
ttgttattaaatg

SEQ ID NO: 4411551 - DNA, 15 bp, Homo sapiens
ttgttattaaatgta

SEQ ID NO: 4411552 - DNA, 18 bp, Homo sapiens
ttgttattaatgtttctt

SEQ ID NO: 4411553 - DNA, 11 bp, Homo sapiens
ttgttcaactc

SEQ ID NO: 4411554 - DNA, 15 bp, Homo sapiens
ttgttcagcatgcaa

SEQ ID NO: 4411555 - DNA, 12 bp, Homo sapiens
ttgttcatttgg

SEQ ID NO: 4411556 - DNA, 16 bp, Homo sapiens
ttgttcccctcctcca

SEQ ID NO: 4411557 - DNA, 18 bp, Homo sapiens
ttgttcccctcctccact

SEQ ID NO: 4411558 - DNA, 20 bp, Homo sapiens
ttgttcccctcctccactct

SEQ ID NO: 4411559 - DNA, 22 bp, Homo sapiens
ttgttcgccgcgtggaatgtga

SEQ ID NO: 4411560 - DNA, 15 bp, Homo sapiens
ttgttctagacttcc

SEQ ID NO: 4411561 - DNA, 18 bp, Homo sapiens
ttgttctagacttcccca

SEQ ID NO: 4411562 - DNA, 16 bp, Homo sapiens
ttgttctcagaatccc

SEQ ID NO: 4411563 - DNA, 17 bp, Homo sapiens
ttgttgcaagatgtgaa

SEQ ID NO: 4411564 - DNA, 18 bp, Homo sapiens
ttgttgcaagatgtgaat

SEQ ID NO: 4411565 - DNA, 17 bp, Homo sapiens
ttgttgcatgtttgaaa

SEQ ID NO: 4411566 - DNA, 14 bp, Homo sapiens
ttgttgctatacat

SEQ ID NO: 4411567 - DNA, 23 bp, Homo sapiens
ttgttggagtcaaaaagaaccac

SEQ ID NO: 4411568 - DNA, 16 bp, Homo sapiens
ttgttggcatagctct

SEQ ID NO: 4411569 - DNA, 22 bp, Homo sapiens
ttgttgtgtgtatatgtattta

SEQ ID NO: 4411570 - DNA, 18 bp, Homo sapiens
ttgtttaaaatcatttct

SEQ ID NO: 4411571 - DNA, 12 bp, Homo sapiens
ttgtttaatggt

SEQ ID NO: 4411572 - DNA, 12 bp, Homo sapiens
ttgtttacaata

SEQ ID NO: 4411573 - DNA, 18 bp, Homo sapiens
ttgtttatgatatttctt

SEQ ID NO: 4411574 - DNA, 24 bp, Homo sapiens
ttgtttattgagtttgtaggtaaa

SEQ ID NO: 4411575 - DNA, 15 bp, Homo sapiens
ttgtttcaactttct

SEQ ID NO: 4411576 - DNA, 23 bp, Homo sapiens
ttgtttcctcccctatctgtatt

SEQ ID NO: 4411577 - DNA, 23 bp, Homo sapiens
ttgtttcttaaataagaaacttt

SEQ ID NO: 4411578 - DNA, 19 bp, Homo sapiens
ttgtttggacctgcatatt

SEQ ID NO: 4411579 - DNA, 22 bp, Homo sapiens
ttgtttgtaaatgcctcttaaa

SEQ ID NO: 4411580 - DNA, 19 bp, Homo sapiens
ttgtttgtactggttcatt

SEQ ID NO: 4411581 - DNA, 20 bp, Homo sapiens
ttgtttgtctgtttttactc

SEQ ID NO: 4411582 - DNA, 13 bp, Homo sapiens
ttgtttgtttctt

SEQ ID NO: 4411583 - DNA, 22 bp, Homo sapiens
ttgttttaaccagtacttctaa

SEQ ID NO: 4411584 - DNA, 15 bp, Homo sapiens
ttgttttaaggaaaa

SEQ ID NO: 4411585 - DNA, 13 bp, Homo sapiens
ttgttttacaata

SEQ ID NO: 4411586 - DNA, 17 bp, Homo sapiens
ttgttttcaacaattgg

SEQ ID NO: 4411587 - DNA, 14 bp, Homo sapiens
ttgttttcattatc

SEQ ID NO: 4411588 - DNA, 15 bp, Homo sapiens
ttgttttgaaagttt

SEQ ID NO: 4411589 - DNA, 17 bp, Homo sapiens
ttgttttgaaagtttaa

SEQ ID NO: 4411590 - DNA, 19 bp, Homo sapiens
ttgttttgctgagagcata

SEQ ID NO: 4411591 - DNA, 18 bp, Homo sapiens
ttgttttggactctctgt

SEQ ID NO: 4411592 - DNA, 13 bp, Homo sapiens
ttgtttttactgt

SEQ ID NO: 4411593 - DNA, 22 bp, Homo sapiens
ttgtttttatatattataagtt

SEQ ID NO: 4411594 - DNA, 15 bp, Homo sapiens
ttgtttttatttctt

SEQ ID NO: 4411595 - DNA, 14 bp, Homo sapiens
ttgtttttctttct

SEQ ID NO: 4411596 - DNA, 17 bp, Homo sapiens
ttgtttttgcatttttg

SEQ ID NO: 4411597 - DNA, 13 bp, Homo sapiens
ttgttttttgttc

SEQ ID NO: 4411598 - DNA, 20 bp, Homo sapiens
tttaaaaaaacaaatgttag

SEQ ID NO: 4411599 - DNA, 14 bp, Homo sapiens
tttaaaaaactaaa

SEQ ID NO: 4411600 - DNA, 20 bp, Homo sapiens
tttaaaaaagcattatcctt

SEQ ID NO: 4411601 - DNA, 20 bp, Homo sapiens
tttaaaaaagcttaaaactt

SEQ ID NO: 4411602 - DNA, 21 bp, Homo sapiens
tttaaaaaataacttcattgt

SEQ ID NO: 4411603 - DNA, 22 bp, Homo sapiens
tttaaaaaataacttcattgtt

SEQ ID NO: 4411604 - DNA, 16 bp, Homo sapiens
tttaaaaaatattttc

SEQ ID NO: 4411605 - DNA, 12 bp, Homo sapiens
tttaaaaaatta

SEQ ID NO: 4411606 - DNA, 23 bp, Homo sapiens
tttaaaaacattttttatacatt

SEQ ID NO: 4411607 - DNA, 13 bp, Homo sapiens
tttaaaaagtgtt

SEQ ID NO: 4411608 - DNA, 18 bp, Homo sapiens
tttaaaaataagtcaaca

SEQ ID NO: 4411609 - DNA, 22 bp, Homo sapiens
tttaaaaataagtcaacagtaa

SEQ ID NO: 4411610 - DNA, 20 bp, Homo sapiens
tttaaaaatggtatcaaaat

SEQ ID NO: 4411611 - DNA, 14 bp, Homo sapiens
tttaaaaatgtata

SEQ ID NO: 4411612 - DNA, 13 bp, Homo sapiens
tttaaaaatgtct

SEQ ID NO: 4411613 - DNA, 14 bp, Homo sapiens
tttaaaacaaaaga

SEQ ID NO: 4411614 - DNA, 14 bp, Homo sapiens
tttaaaacccattt

SEQ ID NO: 4411615 - DNA, 13 bp, Homo sapiens
tttaaaagaatga

SEQ ID NO: 4411616 - DNA, 14 bp, Homo sapiens
tttaaaagagacaa

SEQ ID NO: 4411617 - DNA, 13 bp, Homo sapiens
tttaaaagcctgc

SEQ ID NO: 4411618 - DNA, 13 bp, Homo sapiens
tttaaaagttttg

SEQ ID NO: 4411619 - DNA, 19 bp, Homo sapiens
tttaaaataaaatgaaaat

SEQ ID NO: 4411620 - DNA, 22 bp, Homo sapiens
tttaaaataaaatgaaaattgt

SEQ ID NO: 4411621 - DNA, 19 bp, Homo sapiens
tttaaaataaaatttacct

SEQ ID NO: 4411622 - DNA, 22 bp, Homo sapiens
tttaaaatagaaattttgtaag

SEQ ID NO: 4411623 - DNA, 20 bp, Homo sapiens
tttaaaatattgttttccta

SEQ ID NO: 4411624 - DNA, 13 bp, Homo sapiens
tttaaaatcacta

SEQ ID NO: 4411625 - DNA, 22 bp, Homo sapiens
tttaaaatcagctattttgtga

SEQ ID NO: 4411626 - DNA, 16 bp, Homo sapiens
tttaaaattgtgatgt

SEQ ID NO: 4411627 - DNA, 17 bp, Homo sapiens
tttaaaatttatttgca

SEQ ID NO: 4411628 - DNA, 21 bp, Homo sapiens
tttaaaattttggaatatttg

SEQ ID NO: 4411629 - DNA, 20 bp, Homo sapiens
tttaaacactaatcacaaac

SEQ ID NO: 4411630 - DNA, 21 bp, Homo sapiens
tttaaacacttatcttctgga

SEQ ID NO: 4411631 - DNA, 21 bp, Homo sapiens
tttaaaccgctaaaagaaact

SEQ ID NO: 4411632 - DNA, 18 bp, Homo sapiens
tttaaaccttttattata

SEQ ID NO: 4411633 - DNA, 15 bp, Homo sapiens
tttaaactgtgtaca

SEQ ID NO: 4411634 - DNA, 14 bp, Homo sapiens
tttaaacttgaaat

SEQ ID NO: 4411635 - DNA, 16 bp, Homo sapiens
tttaaagaaagtgtat

SEQ ID NO: 4411636 - DNA, 18 bp, Homo sapiens
tttaaagaatatgacttt

SEQ ID NO: 4411637 - DNA, 18 bp, Homo sapiens
tttaaagacaatgttaaa

SEQ ID NO: 4411638 - DNA, 18 bp, Homo sapiens
tttaaagacctgacagct

SEQ ID NO: 4411639 - DNA, 22 bp, Homo sapiens
tttaaagagtgtgttataaaat

SEQ ID NO: 4411640 - DNA, 13 bp, Homo sapiens
tttaaagtaaact

SEQ ID NO: 4411641 - DNA, 15 bp, Homo sapiens
tttaaagtaaacttg

SEQ ID NO: 4411642 - DNA, 18 bp, Homo sapiens
tttaaagtaaattattaa

SEQ ID NO: 4411643 - DNA, 21 bp, Homo sapiens
tttaaagtatgcattattaaa

SEQ ID NO: 4411644 - DNA, 18 bp, Homo sapiens
tttaaagtctcagtttct

SEQ ID NO: 4411645 - DNA, 18 bp, Homo sapiens
tttaaagtggcaatctca

SEQ ID NO: 4411646 - DNA, 22 bp, Homo sapiens
tttaaagttagtatcttttgat

SEQ ID NO: 4411647 - DNA, 15 bp, Homo sapiens
tttaaagttctgtgt

SEQ ID NO: 4411648 - DNA, 13 bp, Homo sapiens
tttaaagttctta

SEQ ID NO: 4411649 - DNA, 15 bp, Homo sapiens
tttaaagttcttatt

SEQ ID NO: 4411650 - DNA, 16 bp, Homo sapiens
tttaaagttcttattt

SEQ ID NO: 4411651 - DNA, 20 bp, Homo sapiens
tttaaagttcttattttagt

SEQ ID NO: 4411652 - DNA, 21 bp, Homo sapiens
tttaaagttcttattttagta

SEQ ID NO: 4411653 - DNA, 17 bp, Homo sapiens
tttaaagtttaatgcct

SEQ ID NO: 4411654 - DNA, 16 bp, Homo sapiens
tttaaataaattaaga

SEQ ID NO: 4411655 - DNA, 19 bp, Homo sapiens
tttaaataaattatgaata

SEQ ID NO: 4411656 - DNA, 13 bp, Homo sapiens
tttaaatattttc

SEQ ID NO: 4411657 - DNA, 13 bp, Homo sapiens
tttaaatcaagga

SEQ ID NO: 4411658 - DNA, 18 bp, Homo sapiens
tttaaatgacagtaatat

SEQ ID NO: 4411659 - DNA, 19 bp, Homo sapiens
tttaaatgacagtaatatt

SEQ ID NO: 4411660 - DNA, 23 bp, Homo sapiens
tttactagggatccctcatctgt

SEQ ID NO: 4411661 - DNA, 19 bp, Homo sapiens
tttactatcacacatgaat

SEQ ID NO: 4411662 - DNA, 17 bp, Homo sapiens
tttactctcttcatccg

SEQ ID NO: 4411663 - DNA, 23 bp, Homo sapiens
tttactctgggagtaatactttt

SEQ ID NO: 4411664 - DNA, 18 bp, Homo sapiens
tttactgaatgttagaag

SEQ ID NO: 4411665 - DNA, 12 bp, Homo sapiens
tttactgtatca

SEQ ID NO: 4411666 - DNA, 15 bp, Homo sapiens
tttactgtatgtttt

SEQ ID NO: 4411667 - DNA, 18 bp, Homo sapiens
tttactgtcagattaaat

SEQ ID NO: 4411668 - DNA, 19 bp, Homo sapiens
tttactgtcagattaaatt

SEQ ID NO: 4411669 - DNA, 19 bp, Homo sapiens
tttactgtgaaaaaaaatt

SEQ ID NO: 4411670 - DNA, 21 bp, Homo sapiens
tttactgtgaaaaaaaatttg

SEQ ID NO: 4411671 - DNA, 18 bp, Homo sapiens
tttacttgaatagtattg

SEQ ID NO: 4411672 - DNA, 12 bp, Homo sapiens
tttacttgaatc

SEQ ID NO: 4411673 - DNA, 17 bp, Homo sapiens
tttactttcttcaccaa

SEQ ID NO: 4411674 - DNA, 15 bp, Homo sapiens
tttacttttaaactg

SEQ ID NO: 4411675 - DNA, 22 bp, Homo sapiens
tttacttttctgccaaaataaa

SEQ ID NO: 4411676 - DNA, 21 bp, Homo sapiens
tttagaaaaagaacatgcagt

SEQ ID NO: 4411677 - DNA, 18 bp, Homo sapiens
tttagaaaacccaagttt

SEQ ID NO: 4411678 - DNA, 13 bp, Homo sapiens
tttagaaaacttt

SEQ ID NO: 4411679 - DNA, 18 bp, Homo sapiens
tttagaaaatttactaat

SEQ ID NO: 4411680 - DNA, 17 bp, Homo sapiens
tttagaaagctaaatga

SEQ ID NO: 4411681 - DNA, 16 bp, Homo sapiens
tttagaaagctgacat

SEQ ID NO: 4411682 - DNA, 11 bp, Homo sapiens
tttagaaatat

SEQ ID NO: 4411683 - DNA, 18 bp, Homo sapiens
tttagaaatcattttgca

SEQ ID NO: 4411684 - DNA, 19 bp, Homo sapiens
tttagaagaagtgtgtcac

SEQ ID NO: 4411685 - DNA, 19 bp, Homo sapiens
tttagaagatattatttgt

SEQ ID NO: 4411686 - DNA, 14 bp, Homo sapiens
tttagaagcctgca

SEQ ID NO: 4411687 - DNA, 17 bp, Homo sapiens
tttagaatcagaataaa

SEQ ID NO: 4411688 - DNA, 22 bp, Homo sapiens
tttagaatggaggaagaacaac

SEQ ID NO: 4411689 - DNA, 15 bp, Homo sapiens
tttagaccatttatc

SEQ ID NO: 4411690 - DNA, 19 bp, Homo sapiens
tttagagcgtttggttaaa

SEQ ID NO: 4411691 - DNA, 18 bp, Homo sapiens
tttagatcttatattggt

SEQ ID NO: 4411692 - DNA, 18 bp, Homo sapiens
tttagatgaatgtcagtt

SEQ ID NO: 4411693 - DNA, 17 bp, Homo sapiens
tttagattaagcttttc

SEQ ID NO: 4411694 - DNA, 18 bp, Homo sapiens
tttagcacgtttaaagtt

SEQ ID NO: 4411695 - DNA, 21 bp, Homo sapiens
tttagcacgtttaaagttctg

SEQ ID NO: 4411696 - DNA, 18 bp, Homo sapiens
tttagccagcgtttattg

SEQ ID NO: 4411697 - DNA, 20 bp, Homo sapiens
tttagccagcgtttattgta

SEQ ID NO: 4411698 - DNA, 13 bp, Homo sapiens
tttaggaaaatgc

SEQ ID NO: 4411699 - DNA, 21 bp, Homo sapiens
tttaggaaatgggcagtgaag

SEQ ID NO: 4411700 - DNA, 22 bp, Homo sapiens
tttaggaagttgacttatagta

SEQ ID NO: 4411701 - DNA, 18 bp, Homo sapiens
tttagggtgggtaagaaa

SEQ ID NO: 4411702 - DNA, 20 bp, Homo sapiens
tttagggttctaaatgcaat

SEQ ID NO: 4411703 - DNA, 15 bp, Homo sapiens
tttaggttgttacca

SEQ ID NO: 4411704 - DNA, 16 bp, Homo sapiens
tttagtaaatgttatc

SEQ ID NO: 4411705 - DNA, 18 bp, Homo sapiens
tttagtaatattttactt

SEQ ID NO: 4411706 - DNA, 14 bp, Homo sapiens
tttagtgtgaatat

SEQ ID NO: 4411707 - DNA, 15 bp, Homo sapiens
tttagtgtgaatatt

SEQ ID NO: 4411708 - DNA, 14 bp, Homo sapiens
tttagtgtgtaaaa

SEQ ID NO: 4411709 - DNA, 17 bp, Homo sapiens
tttagtgtgtaaaatta

SEQ ID NO: 4411710 - DNA, 14 bp, Homo sapiens
tttagttaaaactc

SEQ ID NO: 4411711 - DNA, 19 bp, Homo sapiens
tttagttacgtataatgct

SEQ ID NO: 4411712 - DNA, 17 bp, Homo sapiens
tttagtttgatcagaca

SEQ ID NO: 4411713 - DNA, 11 bp, Homo sapiens
tttagtttgtt

SEQ ID NO: 4411714 - DNA, 21 bp, Homo sapiens
tttagtttgttaaagcctgtt

SEQ ID NO: 4411715 - DNA, 16 bp, Homo sapiens
tttagtttttcattaa

SEQ ID NO: 4411716 - DNA, 19 bp, Homo sapiens
tttataaaaataaatagaa

SEQ ID NO: 4411717 - DNA, 17 bp, Homo sapiens
tttataaatactgcaaa

SEQ ID NO: 4411718 - DNA, 20 bp, Homo sapiens
tttataaatactgcaaatca

SEQ ID NO: 4411719 - DNA, 14 bp, Homo sapiens
tttataaatgttct

SEQ ID NO: 4411720 - DNA, 15 bp, Homo sapiens
tttataaattaaata

SEQ ID NO: 4411721 - DNA, 17 bp, Homo sapiens
tttataacatctttatt

SEQ ID NO: 4411722 - DNA, 20 bp, Homo sapiens
tttataacatctttattgaa

SEQ ID NO: 4411723 - DNA, 17 bp, Homo sapiens
tttataatgtatttgaa

SEQ ID NO: 4411724 - DNA, 23 bp, Homo sapiens
tttatacaatggaataaattatg

SEQ ID NO: 4411725 - DNA, 12 bp, Homo sapiens
tttatacaattg

SEQ ID NO: 4411726 - DNA, 14 bp, Homo sapiens
tttataccagctta

SEQ ID NO: 4411727 - DNA, 16 bp, Homo sapiens
tttatactctttctgt

SEQ ID NO: 4411728 - DNA, 14 bp, Homo sapiens
tttatacttaaaaa

SEQ ID NO: 4411729 - DNA, 19 bp, Homo sapiens
tttatactttaaagtattt

SEQ ID NO: 4411730 - DNA, 19 bp, Homo sapiens
tttatagtgcacaaaatga

SEQ ID NO: 4411731 - DNA, 18 bp, Homo sapiens
tttatagtttatacagtt

SEQ ID NO: 4411732 - DNA, 15 bp, Homo sapiens
tttatataagtctgt

SEQ ID NO: 4411733 - DNA, 22 bp, Homo sapiens
tttatataagtctgttatttat

SEQ ID NO: 4411734 - DNA, 17 bp, Homo sapiens
tttatataataaagtat

SEQ ID NO: 4411735 - DNA, 20 bp, Homo sapiens
tttatataataaagtattcc

SEQ ID NO: 4411736 - DNA, 21 bp, Homo sapiens
tttatataataaagtattcca

SEQ ID NO: 4411737 - DNA, 14 bp, Homo sapiens
tttatataatatct

SEQ ID NO: 4411738 - DNA, 14 bp, Homo sapiens
tttatatataaggt

SEQ ID NO: 4411739 - DNA, 20 bp, Homo sapiens
tttatatattatgtgaagaa

SEQ ID NO: 4411740 - DNA, 21 bp, Homo sapiens
tttatatattatgtgaagaat

SEQ ID NO: 4411741 - DNA, 22 bp, Homo sapiens
tttatatattatgtgaagaatt

SEQ ID NO: 4411742 - DNA, 18 bp, Homo sapiens
tttatatcacacaatata

SEQ ID NO: 4411743 - DNA, 16 bp, Homo sapiens
tttatatcatgcaaaa

SEQ ID NO: 4411744 - DNA, 16 bp, Homo sapiens
tttatatctggaatga

SEQ ID NO: 4411745 - DNA, 23 bp, Homo sapiens
tttatatctggaatgagcctgtt

SEQ ID NO: 4411746 - DNA, 13 bp, Homo sapiens
tttatatcttgtt

SEQ ID NO: 4411747 - DNA, 18 bp, Homo sapiens
tttatatcttgtttacaa

SEQ ID NO: 4411748 - DNA, 14 bp, Homo sapiens
tttatatgaacata

SEQ ID NO: 4411749 - DNA, 13 bp, Homo sapiens
tttatatgtacat

SEQ ID NO: 4411750 - DNA, 21 bp, Homo sapiens
tttatatgtgttgaaaaccaa

SEQ ID NO: 4411751 - DNA, 19 bp, Homo sapiens
tttatattagttgctttgt

SEQ ID NO: 4411752 - DNA, 19 bp, Homo sapiens
tttatatttattgttagaa

SEQ ID NO: 4411753 - DNA, 20 bp, Homo sapiens
tttatatttattgttagaaa

SEQ ID NO: 4411754 - DNA, 14 bp, Homo sapiens
tttatatttccttt

SEQ ID NO: 4411755 - DNA, 15 bp, Homo sapiens
tttatatttccttta

SEQ ID NO: 4411756 - DNA, 22 bp, Homo sapiens
tttatatttcctttatgtgaat

SEQ ID NO: 4411757 - DNA, 16 bp, Homo sapiens
tttatcaatgtgtctt

SEQ ID NO: 4411758 - DNA, 18 bp, Homo sapiens
tttatcacacttctgtga

SEQ ID NO: 4411759 - DNA, 15 bp, Homo sapiens
tttatcagcaaaaaa

SEQ ID NO: 4411760 - DNA, 17 bp, Homo sapiens
tttatcatgaatgcttt

SEQ ID NO: 4411761 - DNA, 22 bp, Homo sapiens
tttatcatgcatgtcctgtaaa

SEQ ID NO: 4411762 - DNA, 15 bp, Homo sapiens
tttatcattcaagtg

SEQ ID NO: 4411763 - DNA, 17 bp, Homo sapiens
tttatcattcaagtgta

SEQ ID NO: 4411764 - DNA, 15 bp, Homo sapiens
tttatcccatttagt

SEQ ID NO: 4411765 - DNA, 19 bp, Homo sapiens
tttatccccgtttcttgca

SEQ ID NO: 4411766 - DNA, 21 bp, Homo sapiens
tttatcctggccttgtacttg

SEQ ID NO: 4411767 - DNA, 12 bp, Homo sapiens
tttatctatata

SEQ ID NO: 4411768 - DNA, 18 bp, Homo sapiens
tttatctcagatgttaaa

SEQ ID NO: 4411769 - DNA, 19 bp, Homo sapiens
tttatctcagatgttaaaa

SEQ ID NO: 4411770 - DNA, 16 bp, Homo sapiens
tttatctgaattttta

SEQ ID NO: 4411771 - DNA, 17 bp, Homo sapiens
tttatcttaattgcaag

SEQ ID NO: 4411772 - DNA, 18 bp, Homo sapiens
tttatcttggtagtacat

SEQ ID NO: 4411773 - DNA, 18 bp, Homo sapiens
tttatctttaccaaaaac

SEQ ID NO: 4411774 - DNA, 20 bp, Homo sapiens
tttatctttaccaaaaacca

SEQ ID NO: 4411775 - DNA, 12 bp, Homo sapiens
tttatctttata

SEQ ID NO: 4411776 - DNA, 18 bp, Homo sapiens
tttatctttatatgaaga

SEQ ID NO: 4411777 - DNA, 18 bp, Homo sapiens
tttatctttgattctcct

SEQ ID NO: 4411778 - DNA, 16 bp, Homo sapiens
tttccctgcctctcat

SEQ ID NO: 4411779 - DNA, 14 bp, Homo sapiens
tttccctggaactc

SEQ ID NO: 4411780 - DNA, 22 bp, Homo sapiens
tttccctggaactcctggcctt

SEQ ID NO: 4411781 - DNA, 16 bp, Homo sapiens
tttccgactgcccaga

SEQ ID NO: 4411782 - DNA, 15 bp, Homo sapiens
tttccgtgtgtttat

SEQ ID NO: 4411783 - DNA, 17 bp, Homo sapiens
tttccgtgtgtttattt

SEQ ID NO: 4411784 - DNA, 14 bp, Homo sapiens
tttcctaagacatt

SEQ ID NO: 4411785 - DNA, 18 bp, Homo sapiens
tttcctaagacatttttc

SEQ ID NO: 4411786 - DNA, 21 bp, Homo sapiens
tttcctaataaagttctgtac

SEQ ID NO: 4411787 - DNA, 23 bp, Homo sapiens
tttcctaataaagttctgtactc

SEQ ID NO: 4411788 - DNA, 13 bp, Homo sapiens
tttcctaatttat

SEQ ID NO: 4411789 - DNA, 20 bp, Homo sapiens
tttcctagctgttctaatta

SEQ ID NO: 4411790 - DNA, 14 bp, Homo sapiens
tttcctatccttat

SEQ ID NO: 4411791 - DNA, 17 bp, Homo sapiens
tttcctatcttccttcc

SEQ ID NO: 4411792 - DNA, 16 bp, Homo sapiens
tttcctatgactaatt

SEQ ID NO: 4411793 - DNA, 14 bp, Homo sapiens
tttcctcaccagtc

SEQ ID NO: 4411794 - DNA, 21 bp, Homo sapiens
tttcctcaccagtcccatgct

SEQ ID NO: 4411795 - DNA, 20 bp, Homo sapiens
tttcctcagctgtacaaatc

SEQ ID NO: 4411796 - DNA, 21 bp, Homo sapiens
tttcctcctgaggctttggat

SEQ ID NO: 4411797 - DNA, 19 bp, Homo sapiens
tttcctctattgatgtaca

SEQ ID NO: 4411798 - DNA, 18 bp, Homo sapiens
tttcctgggcctttgcaa

SEQ ID NO: 4411799 - DNA, 14 bp, Homo sapiens
tttcctggtgccaa

SEQ ID NO: 4411800 - DNA, 16 bp, Homo sapiens
tttcctggtgccaatt

SEQ ID NO: 4411801 - DNA, 22 bp, Homo sapiens
tttcctggtgccaatttcaagt

SEQ ID NO: 4411802 - DNA, 12 bp, Homo sapiens
tttcctgtaata

SEQ ID NO: 4411803 - DNA, 16 bp, Homo sapiens
tttcctgtcctgcccg

SEQ ID NO: 4411804 - DNA, 18 bp, Homo sapiens
tttcctgttggtttcatt

SEQ ID NO: 4411805 - DNA, 14 bp, Homo sapiens
tttccttccctttt

SEQ ID NO: 4411806 - DNA, 16 bp, Homo sapiens
tttccttccttccctg

SEQ ID NO: 4411807 - DNA, 18 bp, Homo sapiens
tttccttccttccctggc

SEQ ID NO: 4411808 - DNA, 16 bp, Homo sapiens
tttccttctaacatgt

SEQ ID NO: 4411809 - DNA, 13 bp, Homo sapiens
tttccttgtcccg

SEQ ID NO: 4411810 - DNA, 15 bp, Homo sapiens
tttccttgtgcaaaa

SEQ ID NO: 4411811 - DNA, 13 bp, Homo sapiens
tttcctttatgtg

SEQ ID NO: 4411812 - DNA, 19 bp, Homo sapiens
tttcctttatgtgaatttt

SEQ ID NO: 4411813 - DNA, 21 bp, Homo sapiens
tttcctttatgtgaattttta

SEQ ID NO: 4411814 - DNA, 23 bp, Homo sapiens
tttcctttatgtgaatttttaag

SEQ ID NO: 4411815 - DNA, 17 bp, Homo sapiens
tttcctttttgacactg

SEQ ID NO: 4411816 - DNA, 20 bp, Homo sapiens
tttcgacgcttaacctttcc

SEQ ID NO: 4411817 - DNA, 17 bp, Homo sapiens
tttcgcttgcttctgca

SEQ ID NO: 4411818 - DNA, 16 bp, Homo sapiens
tttcgtaacacagcat

SEQ ID NO: 4411819 - DNA, 13 bp, Homo sapiens
tttcgtgatctta

SEQ ID NO: 4411820 - DNA, 14 bp, Homo sapiens
tttcgtttgtttgt

SEQ ID NO: 4411821 - DNA, 15 bp, Homo sapiens
tttctaaaaaggctg

SEQ ID NO: 4411822 - DNA, 17 bp, Homo sapiens
tttctaaaaagtcagat

SEQ ID NO: 4411823 - DNA, 20 bp, Homo sapiens
tttctaaaacattcccctcc

SEQ ID NO: 4411824 - DNA, 13 bp, Homo sapiens
tttctaaagtaaa

SEQ ID NO: 4411825 - DNA, 22 bp, Homo sapiens
tttctaaccacggttatttaag

SEQ ID NO: 4411826 - DNA, 13 bp, Homo sapiens
tttctaagagaag

SEQ ID NO: 4411827 - DNA, 20 bp, Homo sapiens
tttctaagcataaaagatga

SEQ ID NO: 4411828 - DNA, 17 bp, Homo sapiens
tttctaatccttttcct

SEQ ID NO: 4411829 - DNA, 20 bp, Homo sapiens
tttctaatccttttccttat

SEQ ID NO: 4411830 - DNA, 15 bp, Homo sapiens
tttctaatgtttact

SEQ ID NO: 4411831 - DNA, 17 bp, Homo sapiens
tttctaatgtttactat

SEQ ID NO: 4411832 - DNA, 22 bp, Homo sapiens
tttctacacattgctacctcag

SEQ ID NO: 4411833 - DNA, 22 bp, Homo sapiens
tttctactatgatcagaagaac

SEQ ID NO: 4411834 - DNA, 18 bp, Homo sapiens
tttctactctagatggca

SEQ ID NO: 4411835 - DNA, 18 bp, Homo sapiens
tttctactttgaagtcat

SEQ ID NO: 4411836 - DNA, 13 bp, Homo sapiens
tttctagaaagag

SEQ ID NO: 4411837 - DNA, 15 bp, Homo sapiens
tttctagatacaata

SEQ ID NO: 4411838 - DNA, 18 bp, Homo sapiens
tttctagctttttaatta

SEQ ID NO: 4411839 - DNA, 22 bp, Homo sapiens
tttctaggaagcacgggggagt

SEQ ID NO: 4411840 - DNA, 16 bp, Homo sapiens
tttctagttgaggagt

SEQ ID NO: 4411841 - DNA, 19 bp, Homo sapiens
tttctagtttgctcatact

SEQ ID NO: 4411842 - DNA, 13 bp, Homo sapiens
tttctataaattt

SEQ ID NO: 4411843 - DNA, 19 bp, Homo sapiens
tttctataaatttaagaaa

SEQ ID NO: 4411844 - DNA, 22 bp, Homo sapiens
tttctatagccaaaaatagcta

SEQ ID NO: 4411845 - DNA, 22 bp, Homo sapiens
tttctattaaattaaattttgt

SEQ ID NO: 4411846 - DNA, 22 bp, Homo sapiens
tttctattctgtcagtgttaaa

SEQ ID NO: 4411847 - DNA, 13 bp, Homo sapiens
tttctattgtaca

SEQ ID NO: 4411848 - DNA, 23 bp, Homo sapiens
tttctcacaaaaaggcaaatatt

SEQ ID NO: 4411849 - DNA, 17 bp, Homo sapiens
tttctcacccaggcaat

SEQ ID NO: 4411850 - DNA, 13 bp, Homo sapiens
tttctcactgaaa

SEQ ID NO: 4411851 - DNA, 20 bp, Homo sapiens
tttctcagaagtccctgttt

SEQ ID NO: 4411852 - DNA, 16 bp, Homo sapiens
tttctcagttttcata

SEQ ID NO: 4411853 - DNA, 22 bp, Homo sapiens
tttctcatagcaggaaatgtag

SEQ ID NO: 4411854 - DNA, 13 bp, Homo sapiens
tttctcattaaac

SEQ ID NO: 4411855 - DNA, 15 bp, Homo sapiens
tttctccaagagcta

SEQ ID NO: 4411856 - DNA, 17 bp, Homo sapiens
tttctccatcccctccc

SEQ ID NO: 4411857 - DNA, 23 bp, Homo sapiens
tttctcccagtatgttttaacaa

SEQ ID NO: 4411858 - DNA, 14 bp, Homo sapiens
tttctcccctgccc

SEQ ID NO: 4411859 - DNA, 16 bp, Homo sapiens
tttctcccctgccccc

SEQ ID NO: 4411860 - DNA, 22 bp, Homo sapiens
tttctcccctgcccccaggact

SEQ ID NO: 4411861 - DNA, 23 bp, Homo sapiens
tttctcccctgcccccaggactg

SEQ ID NO: 4411862 - DNA, 16 bp, Homo sapiens
tttctcctcccttcct

SEQ ID NO: 4411863 - DNA, 13 bp, Homo sapiens
tttctcctctccc

SEQ ID NO: 4411864 - DNA, 23 bp, Homo sapiens
tttctccttgaatatctttcgat

SEQ ID NO: 4411865 - DNA, 22 bp, Homo sapiens
tttctcctttaattgtaaagta

SEQ ID NO: 4411866 - DNA, 14 bp, Homo sapiens
tttctcctttgcaa

SEQ ID NO: 4411867 - DNA, 14 bp, Homo sapiens
tttctccttttcct

SEQ ID NO: 4411868 - DNA, 19 bp, Homo sapiens
tttctccttttcctatcct

SEQ ID NO: 4411869 - DNA, 16 bp, Homo sapiens
tttctctcctgtcctc

SEQ ID NO: 4411870 - DNA, 14 bp, Homo sapiens
tttctctctcctct

SEQ ID NO: 4411871 - DNA, 16 bp, Homo sapiens
tttctctggcaaactt

SEQ ID NO: 4411872 - DNA, 19 bp, Homo sapiens
tttctctggtggtcttcct

SEQ ID NO: 4411873 - DNA, 15 bp, Homo sapiens
tttctctgtactttt

SEQ ID NO: 4411874 - DNA, 12 bp, Homo sapiens
tttctcttgtac

SEQ ID NO: 4411875 - DNA, 17 bp, Homo sapiens
tttctctttccatgaca

SEQ ID NO: 4411876 - DNA, 16 bp, Homo sapiens
tttctctttctctcct

SEQ ID NO: 4411877 - DNA, 19 bp, Homo sapiens
tttctcttttattctgtta

SEQ ID NO: 4411878 - DNA, 15 bp, Homo sapiens
tttctcttttctagt

SEQ ID NO: 4411879 - DNA, 15 bp, Homo sapiens
tttctgaactgttac

SEQ ID NO: 4411880 - DNA, 17 bp, Homo sapiens
tttctgaactgttacaa

SEQ ID NO: 4411881 - DNA, 19 bp, Homo sapiens
tttctgaaggtagcattct

SEQ ID NO: 4411882 - DNA, 19 bp, Homo sapiens
tttctgaatctagagaaca

SEQ ID NO: 4411883 - DNA, 15 bp, Homo sapiens
tttctgagaaagact

SEQ ID NO: 4411884 - DNA, 16 bp, Homo sapiens
tttctgaggtccttat

SEQ ID NO: 4411885 - DNA, 17 bp, Homo sapiens
tttctgagtgccttctg

SEQ ID NO: 4411886 - DNA, 11 bp, Homo sapiens
tttctgatctg

SEQ ID NO: 4411887 - DNA, 10 bp, Homo sapiens
tttctgattc

SEQ ID NO: 4411888 - DNA, 15 bp, Homo sapiens
tttctgcaatccaat

SEQ ID NO: 4411889 - DNA, 14 bp, Homo sapiens
tttctgcatcagct

SEQ ID NO: 4411890 - DNA, 12 bp, Homo sapiens
tttctgccctgg

SEQ ID NO: 4411891 - DNA, 13 bp, Homo sapiens
tttctgccctggc

SEQ ID NO: 4411892 - DNA, 22 bp, Homo sapiens
tttctgctctggaataaagttg

SEQ ID NO: 4411893 - DNA, 15 bp, Homo sapiens
tttctggatttcata

SEQ ID NO: 4411894 - DNA, 21 bp, Homo sapiens
tttctggcaggtcctcccctc

SEQ ID NO: 4411895 - DNA, 11 bp, Homo sapiens
tttctggccag

SEQ ID NO: 4411896 - DNA, 19 bp, Homo sapiens
tttctggccagtgtttaaa

SEQ ID NO: 4411897 - DNA, 14 bp, Homo sapiens
tttgataatgataa

SEQ ID NO: 4411898 - DNA, 14 bp, Homo sapiens
tttgatacattttt

SEQ ID NO: 4411899 - DNA, 18 bp, Homo sapiens
tttgatactaagcattga

SEQ ID NO: 4411900 - DNA, 20 bp, Homo sapiens
tttgatatgcatatttgttt

SEQ ID NO: 4411901 - DNA, 17 bp, Homo sapiens
tttgatcagacagcttg

SEQ ID NO: 4411902 - DNA, 20 bp, Homo sapiens
tttgatctttgtttaaatgc

SEQ ID NO: 4411903 - DNA, 16 bp, Homo sapiens
tttgatgcatgtcttt

SEQ ID NO: 4411904 - DNA, 22 bp, Homo sapiens
tttgatgcatgtcttttaaaat

SEQ ID NO: 4411905 - DNA, 12 bp, Homo sapiens
tttgatgtacat

SEQ ID NO: 4411906 - DNA, 15 bp, Homo sapiens
tttgatgtcatgtgt

SEQ ID NO: 4411907 - DNA, 17 bp, Homo sapiens
tttgatgtttgtggcct

SEQ ID NO: 4411908 - DNA, 15 bp, Homo sapiens
tttgattcatagtaa

SEQ ID NO: 4411909 - DNA, 14 bp, Homo sapiens
tttgattctccttc

SEQ ID NO: 4411910 - DNA, 17 bp, Homo sapiens
tttgatttagattgagt

SEQ ID NO: 4411911 - DNA, 17 bp, Homo sapiens
tttgatttataaaactt

SEQ ID NO: 4411912 - DNA, 20 bp, Homo sapiens
tttgcaaaaaatgtttttgg

SEQ ID NO: 4411913 - DNA, 21 bp, Homo sapiens
tttgcaaaggagacttaattt

SEQ ID NO: 4411914 - DNA, 13 bp, Homo sapiens
tttgcaaagtact

SEQ ID NO: 4411915 - DNA, 17 bp, Homo sapiens
tttgcaaagtactgtaa

SEQ ID NO: 4411916 - DNA, 23 bp, Homo sapiens
tttgcaaagtactgtaagaataa

SEQ ID NO: 4411917 - DNA, 14 bp, Homo sapiens
tttgcaacatatga

SEQ ID NO: 4411918 - DNA, 13 bp, Homo sapiens
tttgcaacattta

SEQ ID NO: 4411919 - DNA, 23 bp, Homo sapiens
tttgcaaccaggaacagcaaatg

SEQ ID NO: 4411920 - DNA, 21 bp, Homo sapiens
tttgcaagggaaaagtctctt

SEQ ID NO: 4411921 - DNA, 14 bp, Homo sapiens
tttgcaataatgca

SEQ ID NO: 4411922 - DNA, 16 bp, Homo sapiens
tttgcaataatgcagt

SEQ ID NO: 4411923 - DNA, 18 bp, Homo sapiens
tttgcacaatatttcttt

SEQ ID NO: 4411924 - DNA, 13 bp, Homo sapiens
tttgcaccaaaga

SEQ ID NO: 4411925 - DNA, 14 bp, Homo sapiens
tttgcaccaaagac

SEQ ID NO: 4411926 - DNA, 17 bp, Homo sapiens
tttgcaccaaagacatc

SEQ ID NO: 4411927 - DNA, 19 bp, Homo sapiens
tttgcagaaaagcacctgc

SEQ ID NO: 4411928 - DNA, 20 bp, Homo sapiens
tttgcagaaaagcacctgcc

SEQ ID NO: 4411929 - DNA, 22 bp, Homo sapiens
tttgcagaaaagcacctgccga

SEQ ID NO: 4411930 - DNA, 18 bp, Homo sapiens
tttgcagctgctgtctga

SEQ ID NO: 4411931 - DNA, 21 bp, Homo sapiens
tttgcatattttgagaaactg

SEQ ID NO: 4411932 - DNA, 13 bp, Homo sapiens
tttgcatctttgt

SEQ ID NO: 4411933 - DNA, 17 bp, Homo sapiens
tttgcattaaattcaca

SEQ ID NO: 4411934 - DNA, 19 bp, Homo sapiens
tttgcattgaacacaaact

SEQ ID NO: 4411935 - DNA, 19 bp, Homo sapiens
tttgcatttaaaacagaca

SEQ ID NO: 4411936 - DNA, 22 bp, Homo sapiens
tttgcatttttgttttgaaagt

SEQ ID NO: 4411937 - DNA, 20 bp, Homo sapiens
tttgccaagctaatctgcct

SEQ ID NO: 4411938 - DNA, 18 bp, Homo sapiens
tttgccaaggctctcccc

SEQ ID NO: 4411939 - DNA, 20 bp, Homo sapiens
tttgccaaggctctcccctc

SEQ ID NO: 4411940 - DNA, 23 bp, Homo sapiens
tttgccccgggatattatagaaa

SEQ ID NO: 4411941 - DNA, 21 bp, Homo sapiens
tttgcctcctgtgtactgtgt

SEQ ID NO: 4411942 - DNA, 16 bp, Homo sapiens
tttgcctcttctttgt

SEQ ID NO: 4411943 - DNA, 21 bp, Homo sapiens
tttgcctcttctttgtgcctt

SEQ ID NO: 4411944 - DNA, 23 bp, Homo sapiens
tttgcctgcagtttcttgtgtag

SEQ ID NO: 4411945 - DNA, 18 bp, Homo sapiens
tttgcctgcttctttcca

SEQ ID NO: 4411946 - DNA, 15 bp, Homo sapiens
tttgccttctactcc

SEQ ID NO: 4411947 - DNA, 21 bp, Homo sapiens
tttgctctgaccgattccttt

SEQ ID NO: 4411948 - DNA, 19 bp, Homo sapiens
tttgctgaattcctttaca

SEQ ID NO: 4411949 - DNA, 15 bp, Homo sapiens
tttgctgccaaatgc

SEQ ID NO: 4411950 - DNA, 13 bp, Homo sapiens
tttgctgcccctg

SEQ ID NO: 4411951 - DNA, 16 bp, Homo sapiens
tttgctgttactgctt

SEQ ID NO: 4411952 - DNA, 15 bp, Homo sapiens
tttgctgttgggttt

SEQ ID NO: 4411953 - DNA, 12 bp, Homo sapiens
tttgcttaaaat

SEQ ID NO: 4411954 - DNA, 11 bp, Homo sapiens
tttgcttcccc

SEQ ID NO: 4411955 - DNA, 19 bp, Homo sapiens
tttgcttgaacacagtatt

SEQ ID NO: 4411956 - DNA, 15 bp, Homo sapiens
tttgcttgatccaga

SEQ ID NO: 4411957 - DNA, 21 bp, Homo sapiens
tttggaaaaatgggtctttta

SEQ ID NO: 4411958 - DNA, 22 bp, Homo sapiens
tttggaaaaatgggtcttttat

SEQ ID NO: 4411959 - DNA, 23 bp, Homo sapiens
tttggaaaatgacattttactat

SEQ ID NO: 4411960 - DNA, 21 bp, Homo sapiens
tttggaaagtacactctgctg

SEQ ID NO: 4411961 - DNA, 18 bp, Homo sapiens
tttggaagaagtttttta

SEQ ID NO: 4411962 - DNA, 13 bp, Homo sapiens
tttggaatacttt

SEQ ID NO: 4411963 - DNA, 19 bp, Homo sapiens
tttggaattattgtagaca

SEQ ID NO: 4411964 - DNA, 12 bp, Homo sapiens
tttggaattcag

SEQ ID NO: 4411965 - DNA, 13 bp, Homo sapiens
tttggacagctga

SEQ ID NO: 4411966 - DNA, 16 bp, Homo sapiens
tttggacccagggcct

SEQ ID NO: 4411967 - DNA, 22 bp, Homo sapiens
tttggacccagggcctgacttg

SEQ ID NO: 4411968 - DNA, 18 bp, Homo sapiens
tttggactctctgtggtc

SEQ ID NO: 4411969 - DNA, 21 bp, Homo sapiens
tttggactttgtatactttaa

SEQ ID NO: 4411970 - DNA, 20 bp, Homo sapiens
tttggagcacaaaattcaaa

SEQ ID NO: 4411971 - DNA, 22 bp, Homo sapiens
tttggaggctggagtaatcaga

SEQ ID NO: 4411972 - DNA, 21 bp, Homo sapiens
tttggatcatttttaactgat

SEQ ID NO: 4411973 - DNA, 14 bp, Homo sapiens
tttggattaaatta

SEQ ID NO: 4411974 - DNA, 14 bp, Homo sapiens
tttggattgtatat

SEQ ID NO: 4411975 - DNA, 14 bp, Homo sapiens
tttggatttgacat

SEQ ID NO: 4411976 - DNA, 19 bp, Homo sapiens
tttggcaaacgctaaagag

SEQ ID NO: 4411977 - DNA, 17 bp, Homo sapiens
tttggcaatgccatcat

SEQ ID NO: 4411978 - DNA, 20 bp, Homo sapiens
tttggcaatttcctggccct

SEQ ID NO: 4411979 - DNA, 15 bp, Homo sapiens
tttggcactctctgc

SEQ ID NO: 4411980 - DNA, 22 bp, Homo sapiens
tttggcattatctctttctctc

SEQ ID NO: 4411981 - DNA, 14 bp, Homo sapiens
tttggcctggggga

SEQ ID NO: 4411982 - DNA, 15 bp, Homo sapiens
tttggcctgggggag

SEQ ID NO: 4411983 - DNA, 16 bp, Homo sapiens
tttggccttaagaact

SEQ ID NO: 4411984 - DNA, 19 bp, Homo sapiens
tttggctggtagcagcagg

SEQ ID NO: 4411985 - DNA, 20 bp, Homo sapiens
tttgggaagtgaagactgga

SEQ ID NO: 4411986 - DNA, 14 bp, Homo sapiens
tttgggacttctac

SEQ ID NO: 4411987 - DNA, 15 bp, Homo sapiens
tttgggagtttttat

SEQ ID NO: 4411988 - DNA, 12 bp, Homo sapiens
tttgggatgtct

SEQ ID NO: 4411989 - DNA, 15 bp, Homo sapiens
tttgggatgtcttat

SEQ ID NO: 4411990 - DNA, 14 bp, Homo sapiens
tttgggctggagct

SEQ ID NO: 4411991 - DNA, 20 bp, Homo sapiens
tttggggattttcaaaagat

SEQ ID NO: 4411992 - DNA, 18 bp, Homo sapiens
tttggggcagaaaggact

SEQ ID NO: 4411993 - DNA, 18 bp, Homo sapiens
tttgggtttttttccttt

SEQ ID NO: 4411994 - DNA, 15 bp, Homo sapiens
tttggtaaaacagtt

SEQ ID NO: 4411995 - DNA, 19 bp, Homo sapiens
tttggtaaacggtttttat

SEQ ID NO: 4411996 - DNA, 13 bp, Homo sapiens
tttggtacaaaaa

SEQ ID NO: 4411997 - DNA, 16 bp, Homo sapiens
tttggtacaaaaataa

SEQ ID NO: 4411998 - DNA, 15 bp, Homo sapiens
tttggtagatgacaa

SEQ ID NO: 4411999 - DNA, 21 bp, Homo sapiens
tttggtagctgggaaagcata

SEQ ID NO: 4412000 - DNA, 16 bp, Homo sapiens
tttggtgaacagtttt

SEQ ID NO: 4412001 - DNA, 15 bp, Homo sapiens
tttggtgcaaagtat

SEQ ID NO: 4412002 - DNA, 15 bp, Homo sapiens
tttggttttgttccc

SEQ ID NO: 4412003 - DNA, 19 bp, Homo sapiens
tttggttttgttcccctcc

SEQ ID NO: 4412004 - DNA, 14 bp, Homo sapiens
tttggtttttcctc

SEQ ID NO: 4412005 - DNA, 16 bp, Homo sapiens
tttggtttttcctcat

SEQ ID NO: 4412006 - DNA, 21 bp, Homo sapiens
tttgtaaaaatgagtcatttg

SEQ ID NO: 4412007 - DNA, 18 bp, Homo sapiens
tttgtaaaatattatgtt

SEQ ID NO: 4412008 - DNA, 13 bp, Homo sapiens
tttgtaaaatgta

SEQ ID NO: 4412009 - DNA, 15 bp, Homo sapiens
tttgtaaaatgtatt

SEQ ID NO: 4412010 - DNA, 16 bp, Homo sapiens
tttgtaaaatgtatta

SEQ ID NO: 4412011 - DNA, 21 bp, Homo sapiens
tttgtaaagttggttggataa

SEQ ID NO: 4412012 - DNA, 22 bp, Homo sapiens
tttgtaaagttggttggataag

SEQ ID NO: 4412013 - DNA, 20 bp, Homo sapiens
tttgtaaataggatttttag

SEQ ID NO: 4412014 - DNA, 19 bp, Homo sapiens
tttgtaaatgttcttggtg

SEQ ID NO: 4412015 - DNA, 14 bp, Homo sapiens
ttttaatgtatcta

SEQ ID NO: 4412016 - DNA, 16 bp, Homo sapiens
ttttaatgtgctctgt

SEQ ID NO: 4412017 - DNA, 17 bp, Homo sapiens
ttttaatgtgctctgta

SEQ ID NO: 4412018 - DNA, 16 bp, Homo sapiens
ttttaattaagcagaa

SEQ ID NO: 4412019 - DNA, 21 bp, Homo sapiens
ttttaatttatttcatccagt

SEQ ID NO: 4412020 - DNA, 21 bp, Homo sapiens
ttttaatttcaggaaaatgta

SEQ ID NO: 4412021 - DNA, 12 bp, Homo sapiens
ttttaatttcca

SEQ ID NO: 4412022 - DNA, 13 bp, Homo sapiens
ttttaatttctga

SEQ ID NO: 4412023 - DNA, 20 bp, Homo sapiens
ttttaatttggtagatgaca

SEQ ID NO: 4412024 - DNA, 12 bp, Homo sapiens
ttttacaaagcc

SEQ ID NO: 4412025 - DNA, 14 bp, Homo sapiens
ttttacaagaagta

SEQ ID NO: 4412026 - DNA, 21 bp, Homo sapiens
ttttacaagaagtacgaatct

SEQ ID NO: 4412027 - DNA, 21 bp, Homo sapiens
ttttacaagtggttaaaacat

SEQ ID NO: 4412028 - DNA, 15 bp, Homo sapiens
ttttacagcagcaat

SEQ ID NO: 4412029 - DNA, 13 bp, Homo sapiens
ttttacattaaat

SEQ ID NO: 4412030 - DNA, 16 bp, Homo sapiens
ttttacatttcataca

SEQ ID NO: 4412031 - DNA, 11 bp, Homo sapiens
ttttaccaaag

SEQ ID NO: 4412032 - DNA, 14 bp, Homo sapiens
ttttaccaaagcat

SEQ ID NO: 4412033 - DNA, 16 bp, Homo sapiens
ttttaccagcttttaa

SEQ ID NO: 4412034 - DNA, 23 bp, Homo sapiens
ttttaccatcacacatgttcaga

SEQ ID NO: 4412035 - DNA, 17 bp, Homo sapiens
ttttacccctgcacagt

SEQ ID NO: 4412036 - DNA, 15 bp, Homo sapiens
ttttacctgctgctt

SEQ ID NO: 4412037 - DNA, 20 bp, Homo sapiens
ttttactctgggagtaatac

SEQ ID NO: 4412038 - DNA, 15 bp, Homo sapiens
ttttactgaatgatc

SEQ ID NO: 4412039 - DNA, 18 bp, Homo sapiens
ttttactgaatgatctat

SEQ ID NO: 4412040 - DNA, 20 bp, Homo sapiens
ttttactgtatgtttttact

SEQ ID NO: 4412041 - DNA, 13 bp, Homo sapiens
ttttactgtcaga

SEQ ID NO: 4412042 - DNA, 13 bp, Homo sapiens
ttttactgtgaaa

SEQ ID NO: 4412043 - DNA, 12 bp, Homo sapiens
ttttacttgaat

SEQ ID NO: 4412044 - DNA, 16 bp, Homo sapiens
ttttacttgaatcaga

SEQ ID NO: 4412045 - DNA, 12 bp, Homo sapiens
ttttactttggt

SEQ ID NO: 4412046 - DNA, 17 bp, Homo sapiens
ttttacttttaaactgt

SEQ ID NO: 4412047 - DNA, 19 bp, Homo sapiens
ttttacttttctgccaaaa

SEQ ID NO: 4412048 - DNA, 13 bp, Homo sapiens
ttttagaaagcta

SEQ ID NO: 4412049 - DNA, 13 bp, Homo sapiens
ttttagaaattgg

SEQ ID NO: 4412050 - DNA, 14 bp, Homo sapiens
ttttagaaattggt

SEQ ID NO: 4412051 - DNA, 20 bp, Homo sapiens
ttttagattgagaaatgtgt

SEQ ID NO: 4412052 - DNA, 21 bp, Homo sapiens
ttttagcaaatcagtatattt

SEQ ID NO: 4412053 - DNA, 18 bp, Homo sapiens
ttttaggaaggattttct

SEQ ID NO: 4412054 - DNA, 21 bp, Homo sapiens
ttttaggcaaagataatttat

SEQ ID NO: 4412055 - DNA, 19 bp, Homo sapiens
ttttagggttctaaatgca

SEQ ID NO: 4412056 - DNA, 20 bp, Homo sapiens
ttttagggttctaaatgcaa

SEQ ID NO: 4412057 - DNA, 20 bp, Homo sapiens
ttttaggtgctgttatgttt

SEQ ID NO: 4412058 - DNA, 15 bp, Homo sapiens
ttttaggttgttacc

SEQ ID NO: 4412059 - DNA, 13 bp, Homo sapiens
ttttagtgtatta

SEQ ID NO: 4412060 - DNA, 14 bp, Homo sapiens
ttttagtgtgtaaa

SEQ ID NO: 4412061 - DNA, 17 bp, Homo sapiens
ttttagtgtgtaaaatt

SEQ ID NO: 4412062 - DNA, 18 bp, Homo sapiens
ttttagtgtgtgcataat

SEQ ID NO: 4412063 - DNA, 16 bp, Homo sapiens
ttttagtttttcatta

SEQ ID NO: 4412064 - DNA, 14 bp, Homo sapiens
ttttataaaaagat

SEQ ID NO: 4412065 - DNA, 16 bp, Homo sapiens
ttttataaaaataaat

SEQ ID NO: 4412066 - DNA, 18 bp, Homo sapiens
ttttataaatgatatcaa

SEQ ID NO: 4412067 - DNA, 15 bp, Homo sapiens
ttttataaggaaact

SEQ ID NO: 4412068 - DNA, 18 bp, Homo sapiens
ttttataatgatgaactt

SEQ ID NO: 4412069 - DNA, 13 bp, Homo sapiens
ttttataatgtta

SEQ ID NO: 4412070 - DNA, 18 bp, Homo sapiens
ttttataatgttattcat

SEQ ID NO: 4412071 - DNA, 13 bp, Homo sapiens
ttttatagtggaa

SEQ ID NO: 4412072 - DNA, 17 bp, Homo sapiens
ttttatataataaagta

SEQ ID NO: 4412073 - DNA, 20 bp, Homo sapiens
ttttatatcaatttaaaaaa

SEQ ID NO: 4412074 - DNA, 14 bp, Homo sapiens
ttttatatcataca

SEQ ID NO: 4412075 - DNA, 14 bp, Homo sapiens
ttttatatttcctt

SEQ ID NO: 4412076 - DNA, 22 bp, Homo sapiens
ttttatatttcctttatgtgaa

SEQ ID NO: 4412077 - DNA, 23 bp, Homo sapiens
ttttatatttcctttatgtgaat

SEQ ID NO: 4412078 - DNA, 19 bp, Homo sapiens
ttttatcccatttagtgtg

SEQ ID NO: 4412079 - DNA, 20 bp, Homo sapiens
ttttatcctggccttgtact

SEQ ID NO: 4412080 - DNA, 19 bp, Homo sapiens
ttttatgaacattgtactg

SEQ ID NO: 4412081 - DNA, 15 bp, Homo sapiens
ttttatgctcttgaa

SEQ ID NO: 4412082 - DNA, 22 bp, Homo sapiens
ttttatgtaatttctttaaatg

SEQ ID NO: 4412083 - DNA, 18 bp, Homo sapiens
ttttatgtcatagaaata

SEQ ID NO: 4412084 - DNA, 20 bp, Homo sapiens
ttttatgttttctttctcac

SEQ ID NO: 4412085 - DNA, 13 bp, Homo sapiens
ttttattaaagat

SEQ ID NO: 4412086 - DNA, 13 bp, Homo sapiens
ttttattaataat

SEQ ID NO: 4412087 - DNA, 14 bp, Homo sapiens
ttttattaatatat

SEQ ID NO: 4412088 - DNA, 19 bp, Homo sapiens
ttttattaatctactgtat

SEQ ID NO: 4412089 - DNA, 13 bp, Homo sapiens
ttttattaatgca

SEQ ID NO: 4412090 - DNA, 14 bp, Homo sapiens
ttttattatgcatt

SEQ ID NO: 4412091 - DNA, 14 bp, Homo sapiens
ttttattgccttct

SEQ ID NO: 4412092 - DNA, 22 bp, Homo sapiens
ttttattgctcgcccagacacc

SEQ ID NO: 4412093 - DNA, 15 bp, Homo sapiens
ttttattttgtaata

SEQ ID NO: 4412094 - DNA, 18 bp, Homo sapiens
ttttcaaaagataatatt

SEQ ID NO: 4412095 - DNA, 10 bp, Homo sapiens
ttttcaaaat

SEQ ID NO: 4412096 - DNA, 18 bp, Homo sapiens
ttttcaaaatacttcttt

SEQ ID NO: 4412097 - DNA, 20 bp, Homo sapiens
ttttcaaaatagaaaagtta

SEQ ID NO: 4412098 - DNA, 18 bp, Homo sapiens
ttttcaactttgaataaa

SEQ ID NO: 4412099 - DNA, 21 bp, Homo sapiens
ttttcaactttgaataaagaa

SEQ ID NO: 4412100 - DNA, 22 bp, Homo sapiens
ttttcaagcagcatcttctggt

SEQ ID NO: 4412101 - DNA, 14 bp, Homo sapiens
ttttcaagtttttc

SEQ ID NO: 4412102 - DNA, 19 bp, Homo sapiens
ttttcaagtttttcatact

SEQ ID NO: 4412103 - DNA, 21 bp, Homo sapiens
ttttcaatatattgaactttt

SEQ ID NO: 4412104 - DNA, 22 bp, Homo sapiens
ttttcaatatgcaagcagcttt

SEQ ID NO: 4412105 - DNA, 13 bp, Homo sapiens
ttttcaatcttct

SEQ ID NO: 4412106 - DNA, 20 bp, Homo sapiens
ttttcaatgtctaaaaacat

SEQ ID NO: 4412107 - DNA, 12 bp, Homo sapiens
ttttcacatttt

SEQ ID NO: 4412108 - DNA, 17 bp, Homo sapiens
ttttcagaacctcttcc

SEQ ID NO: 4412109 - DNA, 18 bp, Homo sapiens
ttttcagaacctcttccc

SEQ ID NO: 4412110 - DNA, 20 bp, Homo sapiens
ttttcagaagaaataaatat

SEQ ID NO: 4412111 - DNA, 13 bp, Homo sapiens
ttttcagaatctg

SEQ ID NO: 4412112 - DNA, 21 bp, Homo sapiens
ttttcagaatctgaatgtaat

SEQ ID NO: 4412113 - DNA, 23 bp, Homo sapiens
ttttcagaatctgaatgtaattt

SEQ ID NO: 4412114 - DNA, 16 bp, Homo sapiens
ttttcagacttgtcaa

SEQ ID NO: 4412115 - DNA, 17 bp, Homo sapiens
ttttcagatataaaaga

SEQ ID NO: 4412116 - DNA, 18 bp, Homo sapiens
ttttcagcaaactctttt

SEQ ID NO: 4412117 - DNA, 13 bp, Homo sapiens
ttttcagttactt

SEQ ID NO: 4412118 - DNA, 15 bp, Homo sapiens
ttttcataacttatt

SEQ ID NO: 4412119 - DNA, 21 bp, Homo sapiens
ttttcataacttattgctgat

SEQ ID NO: 4412120 - DNA, 18 bp, Homo sapiens
ttttcatactgtacacat

SEQ ID NO: 4412121 - DNA, 23 bp, Homo sapiens
ttttcatactgtacacatttctt

SEQ ID NO: 4412122 - DNA, 16 bp, Homo sapiens
ttttcataggaagaca

SEQ ID NO: 4412123 - DNA, 10 bp, Homo sapiens
ttttcatagt

SEQ ID NO: 4412124 - DNA, 23 bp, Homo sapiens
ttttcatagtgacctgtgtttca

SEQ ID NO: 4412125 - DNA, 13 bp, Homo sapiens
ttttcatatcatt

SEQ ID NO: 4412126 - DNA, 17 bp, Homo sapiens
ttttcatcatttcagcc

SEQ ID NO: 4412127 - DNA, 14 bp, Homo sapiens
ttttcattaaataa

SEQ ID NO: 4412128 - DNA, 20 bp, Homo sapiens
ttttcattaaataaatttga

SEQ ID NO: 4412129 - DNA, 14 bp, Homo sapiens
ttttcattcatgaa

SEQ ID NO: 4412130 - DNA, 17 bp, Homo sapiens
ttttcattcatgaatat

SEQ ID NO: 4412131 - DNA, 15 bp, Homo sapiens
ttttcattctgccaa

SEQ ID NO: 4412132 - DNA, 17 bp, Homo sapiens
ttttcattctgccaaag

SEQ ID NO: 4412133 - DNA, 13 bp, Homo sapiens
ttttcatttatct

SEQ ID NO: 4412134 - DNA, 18 bp, Homo sapiens
ttttgttatcagtcaata

SEQ ID NO: 4412135 - DNA, 15 bp, Homo sapiens
ttttgttatgttcaa

SEQ ID NO: 4412136 - DNA, 16 bp, Homo sapiens
ttttgttcaaagccag

SEQ ID NO: 4412137 - DNA, 15 bp, Homo sapiens
ttttgttcccctcct

SEQ ID NO: 4412138 - DNA, 14 bp, Homo sapiens
ttttgttgctttct

SEQ ID NO: 4412139 - DNA, 12 bp, Homo sapiens
ttttgtttcata

SEQ ID NO: 4412140 - DNA, 16 bp, Homo sapiens
ttttgtttccaggaaa

SEQ ID NO: 4412141 - DNA, 15 bp, Homo sapiens
ttttgtttgaatgtt

SEQ ID NO: 4412142 - DNA, 16 bp, Homo sapiens
ttttgtttggttatat

SEQ ID NO: 4412143 - DNA, 16 bp, Homo sapiens
ttttgtttgtttcttt

SEQ ID NO: 4412144 - DNA, 22 bp, Homo sapiens
ttttgtttttactgtatgtttt

SEQ ID NO: 4412145 - DNA, 23 bp, Homo sapiens
ttttgttttttaagttttgcact

SEQ ID NO: 4412146 - DNA, 19 bp, Homo sapiens
ttttgttttttcaaaatag

SEQ ID NO: 4412147 - DNA, 15 bp, Homo sapiens
tttttaaaaaagctt

SEQ ID NO: 4412148 - DNA, 13 bp, Homo sapiens
tttttaaaaacct

SEQ ID NO: 4412149 - DNA, 14 bp, Homo sapiens
tttttaaaaagtgt

SEQ ID NO: 4412150 - DNA, 17 bp, Homo sapiens
tttttaaaacaaaagag

SEQ ID NO: 4412151 - DNA, 21 bp, Homo sapiens
tttttaaaagccttccagttt

SEQ ID NO: 4412152 - DNA, 21 bp, Homo sapiens
tttttaaaatccagactttct

SEQ ID NO: 4412153 - DNA, 23 bp, Homo sapiens
tttttaaaatgaatcttatgcaa

SEQ ID NO: 4412154 - DNA, 21 bp, Homo sapiens
tttttaaaatttatttgcaaa

SEQ ID NO: 4412155 - DNA, 18 bp, Homo sapiens
tttttaaataaaagcaca

SEQ ID NO: 4412156 - DNA, 16 bp, Homo sapiens
tttttaaatattttct

SEQ ID NO: 4412157 - DNA, 14 bp, Homo sapiens
tttttaaattttct

SEQ ID NO: 4412158 - DNA, 16 bp, Homo sapiens
tttttaactgattctt

SEQ ID NO: 4412159 - DNA, 22 bp, Homo sapiens
tttttaactttaccaaatgaaa

SEQ ID NO: 4412160 - DNA, 21 bp, Homo sapiens
tttttaagaaaaaaagcaaaa

SEQ ID NO: 4412161 - DNA, 14 bp, Homo sapiens
tttttaagaatatt

SEQ ID NO: 4412162 - DNA, 15 bp, Homo sapiens
tttttaagatagtgt

SEQ ID NO: 4412163 - DNA, 16 bp, Homo sapiens
tttttaagatagtgta

SEQ ID NO: 4412164 - DNA, 13 bp, Homo sapiens
tttttaagcaaat

SEQ ID NO: 4412165 - DNA, 14 bp, Homo sapiens
tttttaataattta

SEQ ID NO: 4412166 - DNA, 21 bp, Homo sapiens
tttttaatagcactaaccaat

SEQ ID NO: 4412167 - DNA, 13 bp, Homo sapiens
tttttaatgctat

SEQ ID NO: 4412168 - DNA, 22 bp, Homo sapiens
tttttaatggcagcagaaaact

SEQ ID NO: 4412169 - DNA, 12 bp, Homo sapiens
tttttaatgtat

SEQ ID NO: 4412170 - DNA, 13 bp, Homo sapiens
tttttaattaaaa

SEQ ID NO: 4412171 - DNA, 12 bp, Homo sapiens
tttttaatttgg

SEQ ID NO: 4412172 - DNA, 12 bp, Homo sapiens
tttttacatttt

SEQ ID NO: 4412173 - DNA, 16 bp, Homo sapiens
tttttagactatttct

SEQ ID NO: 4412174 - DNA, 20 bp, Homo sapiens
tttttagatggttacactgt

SEQ ID NO: 4412175 - DNA, 14 bp, Homo sapiens
tttttagatgtatt

SEQ ID NO: 4412176 - DNA, 19 bp, Homo sapiens
tttttagattgagaaatgt

SEQ ID NO: 4412177 - DNA, 20 bp, Homo sapiens
tttttaggaagcaagcttaa

SEQ ID NO: 4412178 - DNA, 14 bp, Homo sapiens
tttttaggcaaaga

SEQ ID NO: 4412179 - DNA, 23 bp, Homo sapiens
tttttagttgccaacagttgtat

SEQ ID NO: 4412180 - DNA, 12 bp, Homo sapiens
tttttataaaaa

SEQ ID NO: 4412181 - DNA, 18 bp, Homo sapiens
tttttataatgttattca

SEQ ID NO: 4412182 - DNA, 19 bp, Homo sapiens
tttttatagttattaaatg

SEQ ID NO: 4412183 - DNA, 23 bp, Homo sapiens
tttttatatctggaatgagcctg

SEQ ID NO: 4412184 - DNA, 17 bp, Homo sapiens
tttttatattagttgct

SEQ ID NO: 4412185 - DNA, 18 bp, Homo sapiens
tttttatattagttgctt

SEQ ID NO: 4412186 - DNA, 17 bp, Homo sapiens
tttttatcatgcatgtc

SEQ ID NO: 4412187 - DNA, 22 bp, Homo sapiens
tttttatctatataaaataact

SEQ ID NO: 4412188 - DNA, 23 bp, Homo sapiens
tttttatgggtgaaaataagaca

SEQ ID NO: 4412189 - DNA, 16 bp, Homo sapiens
tttttatgttttgaaa

SEQ ID NO: 4412190 - DNA, 20 bp, Homo sapiens
tttttattaatctactgtat

SEQ ID NO: 4412191 - DNA, 13 bp, Homo sapiens
tttttattgtaaa

SEQ ID NO: 4412192 - DNA, 20 bp, Homo sapiens
tttttcaaaatagaaaagtt

SEQ ID NO: 4412193 - DNA, 17 bp, Homo sapiens
tttttcaagttgtaaat

SEQ ID NO: 4412194 - DNA, 21 bp, Homo sapiens
tttttcaagttgtaaataatt

SEQ ID NO: 4412195 - DNA, 12 bp, Homo sapiens
tttttcaatata

SEQ ID NO: 4412196 - DNA, 17 bp, Homo sapiens
tttttcaatatattgaa

SEQ ID NO: 4412197 - DNA, 22 bp, Homo sapiens
tttttcacttctacctacatat

SEQ ID NO: 4412198 - DNA, 15 bp, Homo sapiens
tttttcagtgatctt

SEQ ID NO: 4412199 - DNA, 11 bp, Homo sapiens
tttttcagttg

SEQ ID NO: 4412200 - DNA, 12 bp, Homo sapiens
tttttcagtttt

SEQ ID NO: 4412201 - DNA, 13 bp, Homo sapiens
tttttcatactgt

SEQ ID NO: 4412202 - DNA, 19 bp, Homo sapiens
tttttcatactgtacacat

SEQ ID NO: 4412203 - DNA, 11 bp, Homo sapiens
tttttcataga

SEQ ID NO: 4412204 - DNA, 13 bp, Homo sapiens
tttttcattcatg

SEQ ID NO: 4412205 - DNA, 16 bp, Homo sapiens
tttttcattcatgaat

SEQ ID NO: 4412206 - DNA, 23 bp, Homo sapiens
tttttccaactactaatagaata

SEQ ID NO: 4412207 - DNA, 14 bp, Homo sapiens
tttttccagattca

SEQ ID NO: 4412208 - DNA, 13 bp, Homo sapiens
tttttccatctgt

SEQ ID NO: 4412209 - DNA, 20 bp, Homo sapiens
tttttcccacgtctaactgg

SEQ ID NO: 4412210 - DNA, 16 bp, Homo sapiens
tttttcctaagacatt

SEQ ID NO: 4412211 - DNA, 13 bp, Homo sapiens
tttttcctcccag

SEQ ID NO: 4412212 - DNA, 14 bp, Homo sapiens
tttttcctgtcctg

SEQ ID NO: 4412213 - DNA, 16 bp, Homo sapiens
tttttcgtttgtttgt

SEQ ID NO: 4412214 - DNA, 11 bp, Homo sapiens
tttttctaaaa

SEQ ID NO: 4412215 - DNA, 15 bp, Homo sapiens
tttttctaaaacatt

SEQ ID NO: 4412216 - DNA, 16 bp, Homo sapiens
tttttctaagagaagt

SEQ ID NO: 4412217 - DNA, 13 bp, Homo sapiens
tttttctgataaa

SEQ ID NO: 4412218 - DNA, 12 bp, Homo sapiens
tttttctgcctc

SEQ ID NO: 4412219 - DNA, 13 bp, Homo sapiens
tttttctgcctcc

SEQ ID NO: 4412220 - DNA, 14 bp, Homo sapiens
tttttctgcctcct

SEQ ID NO: 4412221 - DNA, 18 bp, Homo sapiens
tttttctgtaatgtaaat

SEQ ID NO: 4412222 - DNA, 22 bp, Homo sapiens
tttttctgtaatgtaaataaac

SEQ ID NO: 4412223 - DNA, 13 bp, Homo sapiens
tttttcttccctt

SEQ ID NO: 4412224 - DNA, 14 bp, Homo sapiens
tttttcttcgctgg

SEQ ID NO: 4412225 - DNA, 23 bp, Homo sapiens
tttttcttctattaatcaagaga

SEQ ID NO: 4412226 - DNA, 12 bp, Homo sapiens
tttttctttact

SEQ ID NO: 4412227 - DNA, 11 bp, Homo sapiens
tttttctttcc

SEQ ID NO: 4412228 - DNA, 19 bp, Homo sapiens
tttttctttttccagtgtt

SEQ ID NO: 4412229 - DNA, 10 bp, Homo sapiens
tttttgaaaa

SEQ ID NO: 4412230 - DNA, 17 bp, Homo sapiens
tttttgaaaaaagctca

SEQ ID NO: 4412231 - DNA, 17 bp, Homo sapiens
tttttgaaaaagcgaaa

SEQ ID NO: 4412232 - DNA, 20 bp, Homo sapiens
tttttgaaaagcagacattt

SEQ ID NO: 4412233 - DNA, 15 bp, Homo sapiens
tttttgacactgaaa

SEQ ID NO: 4412234 - DNA, 16 bp, Homo sapiens
tttttgagtcaaagac

SEQ ID NO: 4412235 - DNA, 15 bp, Homo sapiens
tttttgatactaagc

SEQ ID NO: 4412236 - DNA, 12 bp, Homo sapiens
tttttgatatat

SEQ ID NO: 4412237 - DNA, 14 bp, Homo sapiens
tttttgatgtatat

SEQ ID NO: 4412238 - DNA, 22 bp, Homo sapiens
tttttgcaataatgcagtatgg

SEQ ID NO: 4412239 - DNA, 18 bp, Homo sapiens
tttttgccagttttccct

SEQ ID NO: 4412240 - DNA, 12 bp, Homo sapiens
tttttgctaatt

SEQ ID NO: 4412241 - DNA, 18 bp, Homo sapiens
tttttgcttctactttca

SEQ ID NO: 4412242 - DNA, 15 bp, Homo sapiens
tttttggaaagtcag

SEQ ID NO: 4412243 - DNA, 22 bp, Homo sapiens
tttttggaccaccgttcagtca

SEQ ID NO: 4412244 - DNA, 24 bp, Homo sapiens
tttttggaccaccgttcagtcatt

SEQ ID NO: 4412245 - DNA, 19 bp, Homo sapiens
tttttggagtgttatgtat

SEQ ID NO: 4412246 - DNA, 21 bp, Homo sapiens
tttttggatggcttaagcctg

SEQ ID NO: 4412247 - DNA, 15 bp, Homo sapiens
tttttggcattatct

SEQ ID NO: 4412248 - DNA, 20 bp, Homo sapiens
tttttggcgtggctgactta

SEQ ID NO: 4412249 - DNA, 21 bp, Homo sapiens
tttttggggggttttcttgcc

SEQ ID NO: 4412250 - DNA, 22 bp, Homo sapiens
tttttggggggttttcttgcct

SEQ ID NO: 4412251 - DNA, 17 bp, Homo sapiens
tttttggtggatgtaaa

SEQ ID NO: 4412252 - DNA, 14 bp, Homo sapiens
tttttggtttctta

SEQ ID NO: 4412253 - DNA, 15 bp, Homo sapiens
tttttgtaaactgga

SEQ ID NO: 4412254 - DNA, 12 bp, Homo sapiens
agcccgcttgct

SEQ ID NO: 4412255 - DNA, 15 bp, Homo sapiens
agcccgcttgctcgc

SEQ ID NO: 4412256 - DNA, 21 bp, Homo sapiens
agcccgcttgctcgcttgctg

SEQ ID NO: 4412257 - DNA, 19 bp, Homo sapiens
agccctaagtggctgcctt

SEQ ID NO: 4412258 - DNA, 22 bp, Homo sapiens
agccctagcggctgctccttca

SEQ ID NO: 4412259 - DNA, 23 bp, Homo sapiens
agccctcacccctggttctcatc

SEQ ID NO: 4412260 - DNA, 16 bp, Homo sapiens
agccctcagttccttc

SEQ ID NO: 4412261 - DNA, 15 bp, Homo sapiens
agccctccctgtcct

SEQ ID NO: 4412262 - DNA, 19 bp, Homo sapiens
agccctccctgtcctcctc

SEQ ID NO: 4412263 - DNA, 21 bp, Homo sapiens
agccctccctgtcctcctcgg

SEQ ID NO: 4412264 - DNA, 19 bp, Homo sapiens
agccctcctccccagagct

SEQ ID NO: 4412265 - DNA, 13 bp, Homo sapiens
agccctccttcca

SEQ ID NO: 4412266 - DNA, 21 bp, Homo sapiens
agccctgaggtgaaagggagc

SEQ ID NO: 4412267 - DNA, 23 bp, Homo sapiens
agccctgatgtgtcctcagggag

SEQ ID NO: 4412268 - DNA, 15 bp, Homo sapiens
agccctgcccacaga

SEQ ID NO: 4412269 - DNA, 12 bp, Homo sapiens
agccctgccctc

SEQ ID NO: 4412270 - DNA, 16 bp, Homo sapiens
agccctgccctcccaa

SEQ ID NO: 4412271 - DNA, 11 bp, Homo sapiens
agccctgctag

SEQ ID NO: 4412272 - DNA, 14 bp, Homo sapiens
agccctgctccctg

SEQ ID NO: 4412273 - DNA, 20 bp, Homo sapiens
agccctgctcttctctcccc

SEQ ID NO: 4412274 - DNA, 12 bp, Homo sapiens
agccctgctggc

SEQ ID NO: 4412275 - DNA, 17 bp, Homo sapiens
agccctgctggccgcct

SEQ ID NO: 4412276 - DNA, 21 bp, Homo sapiens
agccctgctggccgcctcacc

SEQ ID NO: 4412277 - DNA, 15 bp, Homo sapiens
agccctgctgtggga

SEQ ID NO: 4412278 - DNA, 15 bp, Homo sapiens
agccctggatggtgg

SEQ ID NO: 4412279 - DNA, 17 bp, Homo sapiens
agccctggcccaggtgc

SEQ ID NO: 4412280 - DNA, 19 bp, Homo sapiens
agccctggcccccacagcg

SEQ ID NO: 4412281 - DNA, 21 bp, Homo sapiens
agccctggcccccacagcgct

SEQ ID NO: 4412282 - DNA, 22 bp, Homo sapiens
agccctggcccccacagcgctc

SEQ ID NO: 4412283 - DNA, 15 bp, Homo sapiens
agccctggctcccac

SEQ ID NO: 4412284 - DNA, 16 bp, Homo sapiens
agccctggctcccacc

SEQ ID NO: 4412285 - DNA, 12 bp, Homo sapiens
agccctggctgt

SEQ ID NO: 4412286 - DNA, 17 bp, Homo sapiens
agccctgggccccacca

SEQ ID NO: 4412287 - DNA, 23 bp, Homo sapiens
agccctgggccccaccacctagg

SEQ ID NO: 4412288 - DNA, 16 bp, Homo sapiens
agccctggtctcagca

SEQ ID NO: 4412289 - DNA, 17 bp, Homo sapiens
agccctggtctcagcag

SEQ ID NO: 4412290 - DNA, 21 bp, Homo sapiens
agcccttatgcggttaatttt

SEQ ID NO: 4412291 - DNA, 16 bp, Homo sapiens
agcccttcatgggtgg

SEQ ID NO: 4412292 - DNA, 15 bp, Homo sapiens
agcccttcccagggc

SEQ ID NO: 4412293 - DNA, 21 bp, Homo sapiens
agcccttcccagggcacccag

SEQ ID NO: 4412294 - DNA, 13 bp, Homo sapiens
agcccttccctga

SEQ ID NO: 4412295 - DNA, 14 bp, Homo sapiens
agcccttccctgag

SEQ ID NO: 4412296 - DNA, 20 bp, Homo sapiens
agcccttctatacccaccca

SEQ ID NO: 4412297 - DNA, 14 bp, Homo sapiens
agcccttgcctccc

SEQ ID NO: 4412298 - DNA, 15 bp, Homo sapiens
agccgaccttccctc

SEQ ID NO: 4412299 - DNA, 15 bp, Homo sapiens
agccgagcgtagtga

SEQ ID NO: 4412300 - DNA, 16 bp, Homo sapiens
agccgcatcttctcca

SEQ ID NO: 4412301 - DNA, 14 bp, Homo sapiens
agccgccagctggg

SEQ ID NO: 4412302 - DNA, 17 bp, Homo sapiens
agccgccattgccacca

SEQ ID NO: 4412303 - DNA, 12 bp, Homo sapiens
agccgccctggg

SEQ ID NO: 4412304 - DNA, 13 bp, Homo sapiens
agccgccctgggc

SEQ ID NO: 4412305 - DNA, 16 bp, Homo sapiens
agccgcgggccaggag

SEQ ID NO: 4412306 - DNA, 18 bp, Homo sapiens
agccgcgggccaggaggc

SEQ ID NO: 4412307 - DNA, 19 bp, Homo sapiens
agccgcggggaagctggct

SEQ ID NO: 4412308 - DNA, 15 bp, Homo sapiens
agccgctgagcgagg

SEQ ID NO: 4412309 - DNA, 16 bp, Homo sapiens
agccggcatggctggg

SEQ ID NO: 4412310 - DNA, 16 bp, Homo sapiens
agccggccgtggaagg

SEQ ID NO: 4412311 - DNA, 16 bp, Homo sapiens
agccggcttgatttcc

SEQ ID NO: 4412312 - DNA, 21 bp, Homo sapiens
agccgggcgtggtggtgagtg

SEQ ID NO: 4412313 - DNA, 12 bp, Homo sapiens
agccgggtccgg

SEQ ID NO: 4412314 - DNA, 15 bp, Homo sapiens
agccgtattttacat

SEQ ID NO: 4412315 - DNA, 20 bp, Homo sapiens
agccgtcccgcgttcaagac

SEQ ID NO: 4412316 - DNA, 16 bp, Homo sapiens
agccgtggtcctttgg

SEQ ID NO: 4412317 - DNA, 23 bp, Homo sapiens
agccgtttgaatatattttatct

SEQ ID NO: 4412318 - DNA, 13 bp, Homo sapiens
agcctaaatttgt

SEQ ID NO: 4412319 - DNA, 21 bp, Homo sapiens
agcctaaatttgtgcttttta

SEQ ID NO: 4412320 - DNA, 19 bp, Homo sapiens
agcctaaggctcctgtttt

SEQ ID NO: 4412321 - DNA, 12 bp, Homo sapiens
agcctaagggat

SEQ ID NO: 4412322 - DNA, 16 bp, Homo sapiens
agcctaagggatcctg

SEQ ID NO: 4412323 - DNA, 21 bp, Homo sapiens
agcctaagggatcctgcctgc

SEQ ID NO: 4412324 - DNA, 13 bp, Homo sapiens
agcctagcggagc

SEQ ID NO: 4412325 - DNA, 18 bp, Homo sapiens
agcctagcggagcccagc

SEQ ID NO: 4412326 - DNA, 19 bp, Homo sapiens
agcctagcggagcccagcc

SEQ ID NO: 4412327 - DNA, 23 bp, Homo sapiens
agcctagcggagcccagcctggg

SEQ ID NO: 4412328 - DNA, 17 bp, Homo sapiens
agcctagctcctgccac

SEQ ID NO: 4412329 - DNA, 21 bp, Homo sapiens
agcctagctcctgccacatgg

SEQ ID NO: 4412330 - DNA, 14 bp, Homo sapiens
agcctagtgaaggc

SEQ ID NO: 4412331 - DNA, 23 bp, Homo sapiens
agcctatagcagaagcacatttt

SEQ ID NO: 4412332 - DNA, 17 bp, Homo sapiens
agcctatttttttagat

SEQ ID NO: 4412333 - DNA, 21 bp, Homo sapiens
agcctcacggggttggctgtt

SEQ ID NO: 4412334 - DNA, 23 bp, Homo sapiens
agcctcactattacttgaacttt

SEQ ID NO: 4412335 - DNA, 15 bp, Homo sapiens
agcctcagaaggccc

SEQ ID NO: 4412336 - DNA, 20 bp, Homo sapiens
agcctcagagatctcccttc

SEQ ID NO: 4412337 - DNA, 21 bp, Homo sapiens
agcctcagagatctcccttct

SEQ ID NO: 4412338 - DNA, 18 bp, Homo sapiens
aaaatggtatcaaaatta

SEQ ID NO: 4412339 - DNA, 21 bp, Homo sapiens
aaaatgtataatgacttttaa

SEQ ID NO: 4412340 - DNA, 21 bp, Homo sapiens
aaaatgtatctgcatatgttt

SEQ ID NO: 4412341 - DNA, 15 bp, Homo sapiens
aaaatgtatgtctgg

SEQ ID NO: 4412342 - DNA, 16 bp, Homo sapiens
aaaatgtattgattca

SEQ ID NO: 4412343 - DNA, 13 bp, Homo sapiens
aaaatgtattttt

SEQ ID NO: 4412344 - DNA, 16 bp, Homo sapiens
aaaatgtatttttcta

SEQ ID NO: 4412345 - DNA, 18 bp, Homo sapiens
aaaatgtgaaaaactaat

SEQ ID NO: 4412346 - DNA, 14 bp, Homo sapiens
aaaatgtgaaatgc

SEQ ID NO: 4412347 - DNA, 23 bp, Homo sapiens
aaaatgtgtgtattcttaaaatg

SEQ ID NO: 4412348 - DNA, 13 bp, Homo sapiens
aaaatgtgtttca

SEQ ID NO: 4412349 - DNA, 21 bp, Homo sapiens
aaaatgttacggcatcacact

SEQ ID NO: 4412350 - DNA, 23 bp, Homo sapiens
aaaatgttacggcatcacactta

SEQ ID NO: 4412351 - DNA, 15 bp, Homo sapiens
aaaatgttctttgga

SEQ ID NO: 4412352 - DNA, 14 bp, Homo sapiens
aaaatgttgagaat

SEQ ID NO: 4412353 - DNA, 11 bp, Homo sapiens
aaaatgtttaa

SEQ ID NO: 4412354 - DNA, 12 bp, Homo sapiens
aaaatgttttaa

SEQ ID NO: 4412355 - DNA, 13 bp, Homo sapiens
aaaattaaaagaa

SEQ ID NO: 4412356 - DNA, 16 bp, Homo sapiens
aaaattaatgtaataa

SEQ ID NO: 4412357 - DNA, 23 bp, Homo sapiens
aaaattaattaggaattacttta

SEQ ID NO: 4412358 - DNA, 14 bp, Homo sapiens
aaaattacatgttt

SEQ ID NO: 4412359 - DNA, 22 bp, Homo sapiens
aaaattacgttcttacaagctt

SEQ ID NO: 4412360 - DNA, 17 bp, Homo sapiens
aaaattagtcttttgta

SEQ ID NO: 4412361 - DNA, 18 bp, Homo sapiens
aaaattatactgtgtgtg

SEQ ID NO: 4412362 - DNA, 16 bp, Homo sapiens
aaaattatcaaaaagc

SEQ ID NO: 4412363 - DNA, 17 bp, Homo sapiens
aaaattatcaaaaagct

SEQ ID NO: 4412364 - DNA, 18 bp, Homo sapiens
aaaattatggaatatcat

SEQ ID NO: 4412365 - DNA, 14 bp, Homo sapiens
aaaattattagaac

SEQ ID NO: 4412366 - DNA, 13 bp, Homo sapiens
aaaattatttgca

SEQ ID NO: 4412367 - DNA, 14 bp, Homo sapiens
aaaattatttgcat

SEQ ID NO: 4412368 - DNA, 15 bp, Homo sapiens
aaaattcaaagcatg

SEQ ID NO: 4412369 - DNA, 21 bp, Homo sapiens
aaaattcaaagcatggacatt

SEQ ID NO: 4412370 - DNA, 22 bp, Homo sapiens
aaaattcaaagcatggacattt

SEQ ID NO: 4412371 - DNA, 14 bp, Homo sapiens
aaaattcagcaaag

SEQ ID NO: 4412372 - DNA, 14 bp, Homo sapiens
aaaattcatttcta

SEQ ID NO: 4412373 - DNA, 13 bp, Homo sapiens
aaaattcattttt

SEQ ID NO: 4412374 - DNA, 15 bp, Homo sapiens
aaaattctgaatttt

SEQ ID NO: 4412375 - DNA, 19 bp, Homo sapiens
aaaattctgtaatttgaat

SEQ ID NO: 4412376 - DNA, 22 bp, Homo sapiens
aaaattgaactaatttatactt

SEQ ID NO: 4412377 - DNA, 23 bp, Homo sapiens
aaaattgaactaatttatacttt

SEQ ID NO: 4412378 - DNA, 12 bp, Homo sapiens
aaaattgaatag

SEQ ID NO: 4412379 - DNA, 13 bp, Homo sapiens
aaaattgatattt

SEQ ID NO: 4412380 - DNA, 21 bp, Homo sapiens
aaaattgctctgtgtatatct

SEQ ID NO: 4412381 - DNA, 22 bp, Homo sapiens
aaaattgctctgtgtatatctc

SEQ ID NO: 4412382 - DNA, 16 bp, Homo sapiens
aaaattgtataaatta

SEQ ID NO: 4412383 - DNA, 21 bp, Homo sapiens
aaaattgtataccaatgtgtt

SEQ ID NO: 4412384 - DNA, 15 bp, Homo sapiens
aaaatttacacatct

SEQ ID NO: 4412385 - DNA, 19 bp, Homo sapiens
aaaatttacacatcttaaa

SEQ ID NO: 4412386 - DNA, 20 bp, Homo sapiens
aaaatttacctttaaaataa

SEQ ID NO: 4412387 - DNA, 15 bp, Homo sapiens
aaaatttactaatct

SEQ ID NO: 4412388 - DNA, 12 bp, Homo sapiens
aaaatttataac

SEQ ID NO: 4412389 - DNA, 18 bp, Homo sapiens
aaaatttataagccaaag

SEQ ID NO: 4412390 - DNA, 23 bp, Homo sapiens
aaaatttattatatatttacaga

SEQ ID NO: 4412391 - DNA, 13 bp, Homo sapiens
aaaatttattatt

SEQ ID NO: 4412392 - DNA, 20 bp, Homo sapiens
aaaatttattctacttttaa

SEQ ID NO: 4412393 - DNA, 14 bp, Homo sapiens
aaaatttcacagtt

SEQ ID NO: 4412394 - DNA, 16 bp, Homo sapiens
aaaatttgtgtaaatt

SEQ ID NO: 4412395 - DNA, 20 bp, Homo sapiens
aaaatttgtgtaaatttgta

SEQ ID NO: 4412396 - DNA, 16 bp, Homo sapiens
aaaatttgttcttgta

SEQ ID NO: 4412397 - DNA, 18 bp, Homo sapiens
aaaatttgttttcaacaa

SEQ ID NO: 4412398 - DNA, 20 bp, Homo sapiens
aaaatttgttttcaacaatt

SEQ ID NO: 4412399 - DNA, 21 bp, Homo sapiens
aaaatttgttttcaacaattg

SEQ ID NO: 4412400 - DNA, 15 bp, Homo sapiens
aaaattttaacacta

SEQ ID NO: 4412401 - DNA, 12 bp, Homo sapiens
aaaattttaaga

SEQ ID NO: 4412402 - DNA, 19 bp, Homo sapiens
aaaattttaagaagaaaga

SEQ ID NO: 4412403 - DNA, 15 bp, Homo sapiens
aaaattttagatgta

SEQ ID NO: 4412404 - DNA, 12 bp, Homo sapiens
aaaattttattt

SEQ ID NO: 4412405 - DNA, 18 bp, Homo sapiens
aaaattttattttaaatt

SEQ ID NO: 4412406 - DNA, 11 bp, Homo sapiens
aaaattttgga

SEQ ID NO: 4412407 - DNA, 17 bp, Homo sapiens
aaaattttggaatattt

SEQ ID NO: 4412408 - DNA, 13 bp, Homo sapiens
aaacaaaaaactt

SEQ ID NO: 4412409 - DNA, 9 bp, Homo sapiens
aaacaaaac

SEQ ID NO: 4412410 - DNA, 14 bp, Homo sapiens
aaacaaaacaaaac

SEQ ID NO: 4412411 - DNA, 17 bp, Homo sapiens
aaacaaaacaaaactat

SEQ ID NO: 4412412 - DNA, 12 bp, Homo sapiens
aaacaaaactat

SEQ ID NO: 4412413 - DNA, 18 bp, Homo sapiens
aaacaaaactatacttga

SEQ ID NO: 4412414 - DNA, 16 bp, Homo sapiens
aaacaaaatcctcagg

SEQ ID NO: 4412415 - DNA, 12 bp, Homo sapiens
aaacaaaatgaa

SEQ ID NO: 4412416 - DNA, 13 bp, Homo sapiens
aaacaaaatttca

SEQ ID NO: 4412417 - DNA, 17 bp, Homo sapiens
aaacaaaatttcacagt

SEQ ID NO: 4412418 - DNA, 23 bp, Homo sapiens
aaacaaaatttcacagttctgta

SEQ ID NO: 4412419 - DNA, 12 bp, Homo sapiens
aaacaaaatttg

SEQ ID NO: 4412420 - DNA, 15 bp, Homo sapiens
aaacaaaatttgact

SEQ ID NO: 4412421 - DNA, 18 bp, Homo sapiens
aaacaaaccttgccttga

SEQ ID NO: 4412422 - DNA, 13 bp, Homo sapiens
aaacaaataaaat

SEQ ID NO: 4412423 - DNA, 14 bp, Homo sapiens
aaacaaataaatat

SEQ ID NO: 4412424 - DNA, 17 bp, Homo sapiens
aaacaaccatgtcattt

SEQ ID NO: 4412425 - DNA, 13 bp, Homo sapiens
aaacaataatgca

SEQ ID NO: 4412426 - DNA, 13 bp, Homo sapiens
aaacaatctattt

SEQ ID NO: 4412427 - DNA, 13 bp, Homo sapiens
aaacaatgaaaac

SEQ ID NO: 4412428 - DNA, 23 bp, Homo sapiens
aaacaattcccttctttttcatc

SEQ ID NO: 4412429 - DNA, 12 bp, Homo sapiens
aaacaatttatt

SEQ ID NO: 4412430 - DNA, 20 bp, Homo sapiens
aaacacaacaagaaactgtc

SEQ ID NO: 4412431 - DNA, 15 bp, Homo sapiens
aaataaaaaaaaaac

SEQ ID NO: 4412432 - DNA, 18 bp, Homo sapiens
aaataaaaaagtctctat

SEQ ID NO: 4412433 - DNA, 15 bp, Homo sapiens
aaataaaaaatattg

SEQ ID NO: 4412434 - DNA, 22 bp, Homo sapiens
aaataaaaacacaccttaaaac

SEQ ID NO: 4412435 - DNA, 14 bp, Homo sapiens
aaataaaaataaat

SEQ ID NO: 4412436 - DNA, 13 bp, Homo sapiens
aaataaaaattct

SEQ ID NO: 4412437 - DNA, 14 bp, Homo sapiens
aaataaaagcacaa

SEQ ID NO: 4412438 - DNA, 16 bp, Homo sapiens
aaataaaagcacaagt

SEQ ID NO: 4412439 - DNA, 13 bp, Homo sapiens
aaataaaatttac

SEQ ID NO: 4412440 - DNA, 17 bp, Homo sapiens
aaataaaatttgttgca

SEQ ID NO: 4412441 - DNA, 19 bp, Homo sapiens
aaataaaatttgttgcata

SEQ ID NO: 4412442 - DNA, 13 bp, Homo sapiens
aaataaacacgat

SEQ ID NO: 4412443 - DNA, 13 bp, Homo sapiens
aaataaactattt

SEQ ID NO: 4412444 - DNA, 11 bp, Homo sapiens
aaataaagaag

SEQ ID NO: 4412445 - DNA, 13 bp, Homo sapiens
aaataaagcagtc

SEQ ID NO: 4412446 - DNA, 13 bp, Homo sapiens
aaataaagttgaa

SEQ ID NO: 4412447 - DNA, 19 bp, Homo sapiens
aaataaatgattatattca

SEQ ID NO: 4412448 - DNA, 23 bp, Homo sapiens
aaataaatgattatattcacaga

SEQ ID NO: 4412449 - DNA, 22 bp, Homo sapiens
aaataaatttcccagttaaaga

SEQ ID NO: 4412450 - DNA, 14 bp, Homo sapiens
aaataaatttgact

SEQ ID NO: 4412451 - DNA, 18 bp, Homo sapiens
aaataacacagatattgt

SEQ ID NO: 4412452 - DNA, 20 bp, Homo sapiens
aaataacagaattctgaagt

SEQ ID NO: 4412453 - DNA, 14 bp, Homo sapiens
aaataactgaattt

SEQ ID NO: 4412454 - DNA, 18 bp, Homo sapiens
aaataactgaatttggag

SEQ ID NO: 4412455 - DNA, 20 bp, Homo sapiens
aaataactggaacaaattat

SEQ ID NO: 4412456 - DNA, 24 bp, Homo sapiens
aaataagaaacaactctttgagaa

SEQ ID NO: 4412457 - DNA, 17 bp, Homo sapiens
aaataagaatagaaata

SEQ ID NO: 4412458 - DNA, 21 bp, Homo sapiens
aaataagacaatagtatttct

SEQ ID NO: 4412459 - DNA, 19 bp, Homo sapiens
aaataaggcacccatctgt

SEQ ID NO: 4412460 - DNA, 15 bp, Homo sapiens
aaataagtcaacagt

SEQ ID NO: 4412461 - DNA, 17 bp, Homo sapiens
aaataagtggattttgt

SEQ ID NO: 4412462 - DNA, 17 bp, Homo sapiens
aaataatatatttcttc

SEQ ID NO: 4412463 - DNA, 15 bp, Homo sapiens
aaataatcaaaagct

SEQ ID NO: 4412464 - DNA, 22 bp, Homo sapiens
aaataatgtactgaattcttta

SEQ ID NO: 4412465 - DNA, 12 bp, Homo sapiens
aaataatgtctc

SEQ ID NO: 4412466 - DNA, 21 bp, Homo sapiens
aaataattatataactgtatt

SEQ ID NO: 4412467 - DNA, 23 bp, Homo sapiens
aaataattatataactgtatttg

SEQ ID NO: 4412468 - DNA, 23 bp, Homo sapiens
aaataattgatcagatgctgaat

SEQ ID NO: 4412469 - DNA, 18 bp, Homo sapiens
aaataatttaactaccct

SEQ ID NO: 4412470 - DNA, 13 bp, Homo sapiens
aaatacaaagtta

SEQ ID NO: 4412471 - DNA, 19 bp, Homo sapiens
aaatacacactcaaatcaa

SEQ ID NO: 4412472 - DNA, 18 bp, Homo sapiens
aaatacacatagcatgta

SEQ ID NO: 4412473 - DNA, 20 bp, Homo sapiens
aaatacacgtttatcttaca

SEQ ID NO: 4412474 - DNA, 14 bp, Homo sapiens
aaatacatagcatt

SEQ ID NO: 4412475 - DNA, 17 bp, Homo sapiens
aaatacatgcacagtca

SEQ ID NO: 4412476 - DNA, 17 bp, Homo sapiens
aaaaggcaaatattgaa

SEQ ID NO: 4412477 - DNA, 15 bp, Homo sapiens
aaaaggccaatatac

SEQ ID NO: 4412478 - DNA, 15 bp, Homo sapiens
aaaaggctgagaagg

SEQ ID NO: 4412479 - DNA, 21 bp, Homo sapiens
aaaaggctgctcacaagttct

SEQ ID NO: 4412480 - DNA, 13 bp, Homo sapiens
aaaaggcttccag

SEQ ID NO: 4412481 - DNA, 18 bp, Homo sapiens
aaaagggaagtagtcctt

SEQ ID NO: 4412482 - DNA, 14 bp, Homo sapiens
aaaagggaggggga

SEQ ID NO: 4412483 - DNA, 14 bp, Homo sapiens
aaaagggagttttt

SEQ ID NO: 4412484 - DNA, 21 bp, Homo sapiens
aaaagggtcaatgctattttt

SEQ ID NO: 4412485 - DNA, 12 bp, Homo sapiens
aaaagggtcaga

SEQ ID NO: 4412486 - DNA, 13 bp, Homo sapiens
aaaagggtcagag

SEQ ID NO: 4412487 - DNA, 22 bp, Homo sapiens
aaaagggtgtatagtgttcaca

SEQ ID NO: 4412488 - DNA, 20 bp, Homo sapiens
aaaaggtgcctgtgaggcag

SEQ ID NO: 4412489 - DNA, 13 bp, Homo sapiens
aaaaggttgaata

SEQ ID NO: 4412490 - DNA, 20 bp, Homo sapiens
aaaaggttgcctgaaaaatg

SEQ ID NO: 4412491 - DNA, 19 bp, Homo sapiens
aaaaggtttcccaaaacaa

SEQ ID NO: 4412492 - DNA, 12 bp, Homo sapiens
aaaagtaaaatg

SEQ ID NO: 4412493 - DNA, 13 bp, Homo sapiens
aaaagtaaaatgt

SEQ ID NO: 4412494 - DNA, 22 bp, Homo sapiens
aaaagtaatgacttagaaactg

SEQ ID NO: 4412495 - DNA, 14 bp, Homo sapiens
aaaagtacattgct

SEQ ID NO: 4412496 - DNA, 15 bp, Homo sapiens
aaaagtcaaaaggtg

SEQ ID NO: 4412497 - DNA, 22 bp, Homo sapiens
aaacagttggtaacttttgtga

SEQ ID NO: 4412498 - DNA, 14 bp, Homo sapiens
aaacataaaaactg

SEQ ID NO: 4412499 - DNA, 20 bp, Homo sapiens
aaacataatcttctgccttc

SEQ ID NO: 4412500 - DNA, 13 bp, Homo sapiens
aaacatacataat

SEQ ID NO: 4412501 - DNA, 14 bp, Homo sapiens
aaacatatttttat

SEQ ID NO: 4412502 - DNA, 20 bp, Homo sapiens
aaacatatttttatacttta

SEQ ID NO: 4412503 - DNA, 19 bp, Homo sapiens
aaacatgactctttattgt

SEQ ID NO: 4412504 - DNA, 20 bp, Homo sapiens
aaacatgactctttattgtc

SEQ ID NO: 4412505 - DNA, 21 bp, Homo sapiens
aaacattcaattccagagaac

SEQ ID NO: 4412506 - DNA, 15 bp, Homo sapiens
aaacattcctccagc

SEQ ID NO: 4412507 - DNA, 17 bp, Homo sapiens
aaacattcctccagcct

SEQ ID NO: 4412508 - DNA, 20 bp, Homo sapiens
aaacattcctccagcctccc

SEQ ID NO: 4412509 - DNA, 23 bp, Homo sapiens
aaacattcctccagcctcccctc

SEQ ID NO: 4412510 - DNA, 21 bp, Homo sapiens
aaacattctatctactgattt

SEQ ID NO: 4412511 - DNA, 14 bp, Homo sapiens
aaacatttaaactt

SEQ ID NO: 4412512 - DNA, 16 bp, Homo sapiens
aaacatttaaactttt

SEQ ID NO: 4412513 - DNA, 14 bp, Homo sapiens
aaacatttattttg

SEQ ID NO: 4412514 - DNA, 20 bp, Homo sapiens
aaacatttattttgacataa

SEQ ID NO: 4412515 - DNA, 16 bp, Homo sapiens
aaacatttcataattt

SEQ ID NO: 4412516 - DNA, 23 bp, Homo sapiens
aaacatttcataatttgtttcca

SEQ ID NO: 4412517 - DNA, 12 bp, Homo sapiens
aaacattttctg

SEQ ID NO: 4412518 - DNA, 15 bp, Homo sapiens
aaacattttgaagtg

SEQ ID NO: 4412519 - DNA, 17 bp, Homo sapiens
aaacattttgaagtgtg

SEQ ID NO: 4412520 - DNA, 18 bp, Homo sapiens
aaacattttttcttctga

SEQ ID NO: 4412521 - DNA, 22 bp, Homo sapiens
aaacattttttcttctgaagat

SEQ ID NO: 4412522 - DNA, 13 bp, Homo sapiens
aaaccaaaaatta

SEQ ID NO: 4412523 - DNA, 20 bp, Homo sapiens
aaaccaaaatgacatctttt

SEQ ID NO: 4412524 - DNA, 22 bp, Homo sapiens
aaaccaaaatgacatcttttta

SEQ ID NO: 4412525 - DNA, 20 bp, Homo sapiens
aaaccaaacacccagaggtc

SEQ ID NO: 4412526 - DNA, 20 bp, Homo sapiens
aaaccaaagagggcttcctc

SEQ ID NO: 4412527 - DNA, 16 bp, Homo sapiens
aaaccacaagcatctc

SEQ ID NO: 4412528 - DNA, 19 bp, Homo sapiens
aaaccaccgtgaaccagag

SEQ ID NO: 4412529 - DNA, 16 bp, Homo sapiens
aaaccagaaaagcaat

SEQ ID NO: 4412530 - DNA, 13 bp, Homo sapiens
aaaccagtgtgaa

SEQ ID NO: 4412531 - DNA, 14 bp, Homo sapiens
aaaccagtgtgaac

SEQ ID NO: 4412532 - DNA, 13 bp, Homo sapiens
aaaccatgtagaa

SEQ ID NO: 4412533 - DNA, 13 bp, Homo sapiens
aaacccaaaatat

SEQ ID NO: 4412534 - DNA, 15 bp, Homo sapiens
aaacccaagttttta

SEQ ID NO: 4412535 - DNA, 16 bp, Homo sapiens
aaacccatacaatgta

SEQ ID NO: 4412536 - DNA, 15 bp, Homo sapiens
aaaccccagccccaa

SEQ ID NO: 4412537 - DNA, 18 bp, Homo sapiens
aaaccccagccccaactc

SEQ ID NO: 4412538 - DNA, 15 bp, Homo sapiens
aaacccccttttccc

SEQ ID NO: 4412539 - DNA, 17 bp, Homo sapiens
aaaccctgctccaatct

SEQ ID NO: 4412540 - DNA, 20 bp, Homo sapiens
aaaccctgctccaatctgtc

SEQ ID NO: 4412541 - DNA, 14 bp, Homo sapiens
aaaccctggtgctt

SEQ ID NO: 4412542 - DNA, 17 bp, Homo sapiens
aaaccctttagtgcttt

SEQ ID NO: 4412543 - DNA, 18 bp, Homo sapiens
aaaccgctaaaagaaact

SEQ ID NO: 4412544 - DNA, 15 bp, Homo sapiens
aaaccgtcctctttt

SEQ ID NO: 4412545 - DNA, 23 bp, Homo sapiens
aaacctattctctttttaacaaa

SEQ ID NO: 4412546 - DNA, 19 bp, Homo sapiens
aaacctcagggctgtccca

SEQ ID NO: 4412547 - DNA, 19 bp, Homo sapiens
aaacctgatatatacacat

SEQ ID NO: 4412548 - DNA, 21 bp, Homo sapiens
aaacctggaatctacaagcca

SEQ ID NO: 4412549 - DNA, 12 bp, Homo sapiens
aaaccttcctgg

SEQ ID NO: 4412550 - DNA, 16 bp, Homo sapiens
aaaccttgctctcctc

SEQ ID NO: 4412551 - DNA, 22 bp, Homo sapiens
aaaccttgctctcctcatctcc

SEQ ID NO: 4412552 - DNA, 12 bp, Homo sapiens
aaaccttttatt

SEQ ID NO: 4412553 - DNA, 13 bp, Homo sapiens
aaaccttttgaaa

SEQ ID NO: 4412554 - DNA, 15 bp, Homo sapiens
aaacgaaggcataat

SEQ ID NO: 4412555 - DNA, 21 bp, Homo sapiens
aaacgcaccaatcagcactct

SEQ ID NO: 4412556 - DNA, 21 bp, Homo sapiens
aaacgcagttgtgtggcccag

SEQ ID NO: 4412557 - DNA, 22 bp, Homo sapiens
aaacgggcagtctgctctgctg

SEQ ID NO: 4412558 - DNA, 13 bp, Homo sapiens
aaacgtagcatgt

SEQ ID NO: 4412559 - DNA, 22 bp, Homo sapiens
aaacgttggagtttgggctgga

SEQ ID NO: 4412560 - DNA, 14 bp, Homo sapiens
aaactaaaaactag

SEQ ID NO: 4412561 - DNA, 14 bp, Homo sapiens
aaactaaacagaaa

SEQ ID NO: 4412562 - DNA, 17 bp, Homo sapiens
aaactaaccttgaataa

SEQ ID NO: 4412563 - DNA, 17 bp, Homo sapiens
aaactaaggatttttca

SEQ ID NO: 4412564 - DNA, 12 bp, Homo sapiens
aaactaatgtgt

SEQ ID NO: 4412565 - DNA, 21 bp, Homo sapiens
aaactacaaacgtttgacaaa

SEQ ID NO: 4412566 - DNA, 23 bp, Homo sapiens
aaactacagaatattaaatatta

SEQ ID NO: 4412567 - DNA, 12 bp, Homo sapiens
aaactactcttt

SEQ ID NO: 4412568 - DNA, 20 bp, Homo sapiens
aaactactgattgaatgtta

SEQ ID NO: 4412569 - DNA, 16 bp, Homo sapiens
aaactacttttctaaa

SEQ ID NO: 4412570 - DNA, 22 bp, Homo sapiens
aaactagaggtgagaaatttaa

SEQ ID NO: 4412571 - DNA, 14 bp, Homo sapiens
aaactagcaactct

SEQ ID NO: 4412572 - DNA, 18 bp, Homo sapiens
aaactagggccaagccca

SEQ ID NO: 4412573 - DNA, 14 bp, Homo sapiens
aaactagtttttcc

SEQ ID NO: 4412574 - DNA, 21 bp, Homo sapiens
aaactataacattatataaca

SEQ ID NO: 4412575 - DNA, 20 bp, Homo sapiens
aaactatgtgtttttctcat

SEQ ID NO: 4412576 - DNA, 13 bp, Homo sapiens
aaactcactgtga

SEQ ID NO: 4412577 - DNA, 17 bp, Homo sapiens
aaactcatcacataaag

SEQ ID NO: 4412578 - DNA, 17 bp, Homo sapiens
aaactcatgatcaagat

SEQ ID NO: 4412579 - DNA, 12 bp, Homo sapiens
aaactcattgca

SEQ ID NO: 4412580 - DNA, 17 bp, Homo sapiens
aaactccacatctgcct

SEQ ID NO: 4412581 - DNA, 17 bp, Homo sapiens
aaactcccaatacaaag

SEQ ID NO: 4412582 - DNA, 19 bp, Homo sapiens
aaactccgtcttagaagtg

SEQ ID NO: 4412583 - DNA, 12 bp, Homo sapiens
aaactcctattt

SEQ ID NO: 4412584 - DNA, 19 bp, Homo sapiens
aaaggattttaccaaagca

SEQ ID NO: 4412585 - DNA, 16 bp, Homo sapiens
aaaggcaaaaccttac

SEQ ID NO: 4412586 - DNA, 17 bp, Homo sapiens
aaaggcaaatattgaag

SEQ ID NO: 4412587 - DNA, 14 bp, Homo sapiens
aaaggcagaagcaa

SEQ ID NO: 4412588 - DNA, 13 bp, Homo sapiens
aaaggcagctgcc

SEQ ID NO: 4412589 - DNA, 21 bp, Homo sapiens
aaaggcagctgcctctgctcc

SEQ ID NO: 4412590 - DNA, 22 bp, Homo sapiens
aaaggcagctgcctctgctccc

SEQ ID NO: 4412591 - DNA, 23 bp, Homo sapiens
aaaggcagctgcctctgctccct

SEQ ID NO: 4412592 - DNA, 23 bp, Homo sapiens
aaaggcagggtagcctgaattgc

SEQ ID NO: 4412593 - DNA, 20 bp, Homo sapiens
aaaggcaggtttcatttctt

SEQ ID NO: 4412594 - DNA, 18 bp, Homo sapiens
aaaggccagtggaagaaa

SEQ ID NO: 4412595 - DNA, 12 bp, Homo sapiens
aaaggcccccta

SEQ ID NO: 4412596 - DNA, 19 bp, Homo sapiens
aaaggctaagaatagtggg

SEQ ID NO: 4412597 - DNA, 14 bp, Homo sapiens
aaaggctcatttaa

SEQ ID NO: 4412598 - DNA, 15 bp, Homo sapiens
aaaggctcatttaaa

SEQ ID NO: 4412599 - DNA, 16 bp, Homo sapiens
aaaggctcatttaaaa

SEQ ID NO: 4412600 - DNA, 17 bp, Homo sapiens
aaaggctcatttaaaac

SEQ ID NO: 4412601 - DNA, 18 bp, Homo sapiens
aaaggctcatttaaaaca

SEQ ID NO: 4412602 - DNA, 18 bp, Homo sapiens
aaaggctgacattcactg

SEQ ID NO: 4412603 - DNA, 14 bp, Homo sapiens
aaaggctgagaagg

SEQ ID NO: 4412604 - DNA, 15 bp, Homo sapiens
aaagggaaactggct

SEQ ID NO: 4412605 - DNA, 11 bp, Homo sapiens
aaagggaagta

SEQ ID NO: 4412606 - DNA, 16 bp, Homo sapiens
aaagggagaaatgcca

SEQ ID NO: 4412607 - DNA, 19 bp, Homo sapiens
aaagggcccaatgaattat

SEQ ID NO: 4412608 - DNA, 14 bp, Homo sapiens
aaagggtgtatagt

SEQ ID NO: 4412609 - DNA, 17 bp, Homo sapiens
aaagggtgtatagtgtt

SEQ ID NO: 4412610 - DNA, 18 bp, Homo sapiens
aaagggtgtatagtgttc

SEQ ID NO: 4412611 - DNA, 20 bp, Homo sapiens
aaagggtttgtaatacttta

SEQ ID NO: 4412612 - DNA, 15 bp, Homo sapiens
aaaggtagactttta

SEQ ID NO: 4412613 - DNA, 15 bp, Homo sapiens
aaaggtgattgtcac

SEQ ID NO: 4412614 - DNA, 18 bp, Homo sapiens
aaaggtggagtttctctg

SEQ ID NO: 4412615 - DNA, 19 bp, Homo sapiens
aaaggtggagtttctctgt

SEQ ID NO: 4412616 - DNA, 18 bp, Homo sapiens
aaaggtgtcttcctccca

SEQ ID NO: 4412617 - DNA, 13 bp, Homo sapiens
aaaggtgtgaaca

SEQ ID NO: 4412618 - DNA, 17 bp, Homo sapiens
aaaggttgaataatata

SEQ ID NO: 4412619 - DNA, 19 bp, Homo sapiens
aaaggttgaataatatatg

SEQ ID NO: 4412620 - DNA, 18 bp, Homo sapiens
aaaggtttatgaaaaaga

SEQ ID NO: 4412621 - DNA, 16 bp, Homo sapiens
aaaggtttatttttct

SEQ ID NO: 4412622 - DNA, 19 bp, Homo sapiens
aaaggtttcccaaaacaat

SEQ ID NO: 4412623 - DNA, 11 bp, Homo sapiens
aaagtaaaatt

SEQ ID NO: 4412624 - DNA, 21 bp, Homo sapiens
aaagtaatgaagaatcacgat

SEQ ID NO: 4412625 - DNA, 21 bp, Homo sapiens
aaagtaatgacttagaaactg

SEQ ID NO: 4412626 - DNA, 22 bp, Homo sapiens
aagctagacacatgaaggtaaa

SEQ ID NO: 4412627 - DNA, 14 bp, Homo sapiens
aagctagagatatg

SEQ ID NO: 4412628 - DNA, 18 bp, Homo sapiens
aagctagccagagggtgg

SEQ ID NO: 4412629 - DNA, 19 bp, Homo sapiens
aagctagggtggcccttgc

SEQ ID NO: 4412630 - DNA, 21 bp, Homo sapiens
aagctaggtgctatttgtcat

SEQ ID NO: 4412631 - DNA, 23 bp, Homo sapiens
aagctaggtgctatttgtcatct

SEQ ID NO: 4412632 - DNA, 13 bp, Homo sapiens
aagctataaagca

SEQ ID NO: 4412633 - DNA, 15 bp, Homo sapiens
aagctattgtctgta

SEQ ID NO: 4412634 - DNA, 13 bp, Homo sapiens
aagctatttaaag

SEQ ID NO: 4412635 - DNA, 20 bp, Homo sapiens
aagctcacagttcctcgccc

SEQ ID NO: 4412636 - DNA, 22 bp, Homo sapiens
aagctcacagttcctcgccctg

SEQ ID NO: 4412637 - DNA, 14 bp, Homo sapiens
aagctcacttctgg

SEQ ID NO: 4412638 - DNA, 17 bp, Homo sapiens
aagctcaggatatggct

SEQ ID NO: 4412639 - DNA, 17 bp, Homo sapiens
aagctcaggtcctgctg

SEQ ID NO: 4412640 - DNA, 23 bp, Homo sapiens
aagctcatggctgtgtccactgc

SEQ ID NO: 4412641 - DNA, 18 bp, Homo sapiens
aagctccatgtgcctctt

SEQ ID NO: 4412642 - DNA, 14 bp, Homo sapiens
aagctccttccaga

SEQ ID NO: 4412643 - DNA, 13 bp, Homo sapiens
aagctcgcatcca

SEQ ID NO: 4412644 - DNA, 15 bp, Homo sapiens
aagctctgaaaacaa

SEQ ID NO: 4412645 - DNA, 23 bp, Homo sapiens
aagctctgttccatgcaactgga

SEQ ID NO: 4412646 - DNA, 11 bp, Homo sapiens
aagctgaaatt

SEQ ID NO: 4412647 - DNA, 12 bp, Homo sapiens
aagctgaaattt

SEQ ID NO: 4412648 - DNA, 22 bp, Homo sapiens
aagctgaaattttagaaatatt

SEQ ID NO: 4412649 - DNA, 17 bp, Homo sapiens
aagctgaagatccccaa

SEQ ID NO: 4412650 - DNA, 12 bp, Homo sapiens
aagctgaggtgg

SEQ ID NO: 4412651 - DNA, 18 bp, Homo sapiens
aagctgattttttttaat

SEQ ID NO: 4412652 - DNA, 22 bp, Homo sapiens
aagctgcccagccctggcccag

SEQ ID NO: 4412653 - DNA, 15 bp, Homo sapiens
aagctgctgaggccc

SEQ ID NO: 4412654 - DNA, 13 bp, Homo sapiens
aagctgctgtgtc

SEQ ID NO: 4412655 - DNA, 14 bp, Homo sapiens
aagctgctgtgtcc

SEQ ID NO: 4412656 - DNA, 19 bp, Homo sapiens
aagctgctgtgtcctctag

SEQ ID NO: 4412657 - DNA, 14 bp, Homo sapiens
aagctggcctgaga

SEQ ID NO: 4412658 - DNA, 22 bp, Homo sapiens
aagctggctttgaaacctcagg

SEQ ID NO: 4412659 - DNA, 24 bp, Homo sapiens
aagctggtctggagttgctgaatg

SEQ ID NO: 4412660 - DNA, 23 bp, Homo sapiens
aagctgtctactggacaatctta

SEQ ID NO: 4412661 - DNA, 20 bp, Homo sapiens
aagctgtgtccttgcacctg

SEQ ID NO: 4412662 - DNA, 21 bp, Homo sapiens
aagctgtgtctgcccaatgaa

SEQ ID NO: 4412663 - DNA, 13 bp, Homo sapiens
aagctgttcctgt

SEQ ID NO: 4412664 - DNA, 21 bp, Homo sapiens
aagctgtttggaaaagacagt

SEQ ID NO: 4412665 - DNA, 14 bp, Homo sapiens
aagcttaacatttc

SEQ ID NO: 4412666 - DNA, 19 bp, Homo sapiens
aagcttaatggctgataat

SEQ ID NO: 4412667 - DNA, 22 bp, Homo sapiens
aagcttatccataaaaaaaaat

SEQ ID NO: 4412668 - DNA, 16 bp, Homo sapiens
aagcttcatccacagc

SEQ ID NO: 4412669 - DNA, 20 bp, Homo sapiens
aagcttccacaaaattagaa

SEQ ID NO: 4412670 - DNA, 18 bp, Homo sapiens
aagcttccatagctgctg

SEQ ID NO: 4412671 - DNA, 22 bp, Homo sapiens
aagctttaaatgacagtaatat

SEQ ID NO: 4412672 - DNA, 14 bp, Homo sapiens
aagctttaaattat

SEQ ID NO: 4412673 - DNA, 17 bp, Homo sapiens
aagctttatctgtcttg

SEQ ID NO: 4412674 - DNA, 16 bp, Homo sapiens
aagctttatctttgtg

SEQ ID NO: 4412675 - DNA, 18 bp, Homo sapiens
aagctttatgattttcat

SEQ ID NO: 4412676 - DNA, 21 bp, Homo sapiens
aagctttcatgtcccagaact

SEQ ID NO: 4412677 - DNA, 18 bp, Homo sapiens
aagctttcttttctaact

SEQ ID NO: 4412678 - DNA, 11 bp, Homo sapiens
aagcttttatt

SEQ ID NO: 4412679 - DNA, 13 bp, Homo sapiens
aagcttttatttc

SEQ ID NO: 4412680 - DNA, 20 bp, Homo sapiens
aagcttttcattttaatata

SEQ ID NO: 4412681 - DNA, 23 bp, Homo sapiens
aagcttttgcttgatccagaaga

SEQ ID NO: 4412682 - DNA, 18 bp, Homo sapiens
aagctttttggaatcttt

SEQ ID NO: 4412683 - DNA, 19 bp, Homo sapiens
aaggaaaaacacaagcaaa

SEQ ID NO: 4412684 - DNA, 15 bp, Homo sapiens
aaggaaaaagctcca

SEQ ID NO: 4412685 - DNA, 19 bp, Homo sapiens
aaggaaaacaaaaaacttt

SEQ ID NO: 4412686 - DNA, 17 bp, Homo sapiens
aaggaaaagttctttca

SEQ ID NO: 4412687 - DNA, 17 bp, Homo sapiens
aaggaaaatagtaatgt

SEQ ID NO: 4412688 - DNA, 18 bp, Homo sapiens
aaggaaaccttttcttgt

SEQ ID NO: 4412689 - DNA, 19 bp, Homo sapiens
aaggaaaccttttcttgta

SEQ ID NO: 4412690 - DNA, 15 bp, Homo sapiens
aaggaaactttttaa

SEQ ID NO: 4412691 - DNA, 20 bp, Homo sapiens
aaggaaagcaataaatgaat

SEQ ID NO: 4412692 - DNA, 20 bp, Homo sapiens
aaggaaagcactaagaaaca

SEQ ID NO: 4412693 - DNA, 18 bp, Homo sapiens
aaggaaagctgtgtttat

SEQ ID NO: 4412694 - DNA, 19 bp, Homo sapiens
aaggaaagtttgccaggag

SEQ ID NO: 4412695 - DNA, 21 bp, Homo sapiens
aaggaacatggagctgtcatc

SEQ ID NO: 4412696 - DNA, 13 bp, Homo sapiens
aaggaaccaacaa

SEQ ID NO: 4412697 - DNA, 17 bp, Homo sapiens
aaggaaccaacaatctt

SEQ ID NO: 4412698 - DNA, 13 bp, Homo sapiens
aaggaaccttcct

SEQ ID NO: 4412699 - DNA, 23 bp, Homo sapiens
aaggaaccttccttcctgcttga

SEQ ID NO: 4412700 - DNA, 13 bp, Homo sapiens
aaggaacttgtct

SEQ ID NO: 4412701 - DNA, 16 bp, Homo sapiens
aaggaagacagttcta

SEQ ID NO: 4412702 - DNA, 15 bp, Homo sapiens
aaggaagagaagaca

SEQ ID NO: 4412703 - DNA, 18 bp, Homo sapiens
aaggaagtatcagcacta

SEQ ID NO: 4412704 - DNA, 13 bp, Homo sapiens
aaggaataaatga

SEQ ID NO: 4412705 - DNA, 14 bp, Homo sapiens
aaggaatgatatat

SEQ ID NO: 4412706 - DNA, 24 bp, Homo sapiens
aaggaatgtacgttgagaatcact

SEQ ID NO: 4412707 - DNA, 23 bp, Homo sapiens
aaggaattacattttatatgtga

SEQ ID NO: 4412708 - DNA, 16 bp, Homo sapiens
aaggaatttcttaact

SEQ ID NO: 4412709 - DNA, 20 bp, Homo sapiens
aaggaatttcttaacttctt

SEQ ID NO: 4412710 - DNA, 23 bp, Homo sapiens
aaggaatttcttaacttcttgct

SEQ ID NO: 4412711 - DNA, 17 bp, Homo sapiens
aaggacaaataaaacat

SEQ ID NO: 4412712 - DNA, 20 bp, Homo sapiens
aaggacaaataaaacatggc

SEQ ID NO: 4412713 - DNA, 23 bp, Homo sapiens
aaggacaaatctaaaatgcaaag

SEQ ID NO: 4412714 - DNA, 14 bp, Homo sapiens
aaggacagagccag

SEQ ID NO: 4412715 - DNA, 15 bp, Homo sapiens
aaggacagagccagc

SEQ ID NO: 4412716 - DNA, 15 bp, Homo sapiens
aaggacatcagcaaa

SEQ ID NO: 4412717 - DNA, 13 bp, Homo sapiens
aaggaccagcttt

SEQ ID NO: 4412718 - DNA, 13 bp, Homo sapiens
aaggaccaggact

SEQ ID NO: 4412719 - DNA, 12 bp, Homo sapiens
aaggacccaggc

SEQ ID NO: 4412720 - DNA, 13 bp, Homo sapiens
aaggacccaggcg

SEQ ID NO: 4412721 - DNA, 16 bp, Homo sapiens
aaggacccaggcgctg

SEQ ID NO: 4412722 - DNA, 18 bp, Homo sapiens
aaggacccaggcgctgca

SEQ ID NO: 4412723 - DNA, 21 bp, Homo sapiens
aaggacccaggcgctgcatac

SEQ ID NO: 4412724 - DNA, 23 bp, Homo sapiens
aaggacggctgagcatgtggagc

SEQ ID NO: 4412725 - DNA, 20 bp, Homo sapiens
aaggacggtccccacccctc

SEQ ID NO: 4412726 - DNA, 15 bp, Homo sapiens
aaggactccaatgtc

SEQ ID NO: 4412727 - DNA, 22 bp, Homo sapiens
aaggactgcatggtaatttata

SEQ ID NO: 4412728 - DNA, 14 bp, Homo sapiens
aaggactgtaatct

SEQ ID NO: 4412729 - DNA, 13 bp, Homo sapiens
aaggacttctgca

SEQ ID NO: 4412730 - DNA, 16 bp, Homo sapiens
aaggacttctgcagct

SEQ ID NO: 4412731 - DNA, 14 bp, Homo sapiens
aaggactttgtaca

SEQ ID NO: 4412732 - DNA, 15 bp, Homo sapiens
aaggactttgtacat

SEQ ID NO: 4412733 - DNA, 17 bp, Homo sapiens
aaggagaaagaaagtac

SEQ ID NO: 4412734 - DNA, 14 bp, Homo sapiens
aaggagaacaaata

SEQ ID NO: 4412735 - DNA, 16 bp, Homo sapiens
aaggagactcacctct

SEQ ID NO: 4412736 - DNA, 18 bp, Homo sapiens
aaggagacttaatttcaa

SEQ ID NO: 4412737 - DNA, 21 bp, Homo sapiens
aaggagagactcccatgaagc

SEQ ID NO: 4412738 - DNA, 22 bp, Homo sapiens
aaggagagttcaagcctgtggg

SEQ ID NO: 4412739 - DNA, 17 bp, Homo sapiens
aaggagccccattcctg

SEQ ID NO: 4412740 - DNA, 18 bp, Homo sapiens
aaggaggaaatgtggaaa

SEQ ID NO: 4412741 - DNA, 14 bp, Homo sapiens
aaggaggcccactg

SEQ ID NO: 4412742 - DNA, 17 bp, Homo sapiens
aaggaggcctccactcc

SEQ ID NO: 4412743 - DNA, 14 bp, Homo sapiens
aaggaggctggcag

SEQ ID NO: 4412744 - DNA, 20 bp, Homo sapiens
aaggagggatgcgtgttcca

SEQ ID NO: 4412745 - DNA, 19 bp, Homo sapiens
aaggaggggaaaaaaatgt

SEQ ID NO: 4412746 - DNA, 20 bp, Homo sapiens
aagaggaacagcactgggga

SEQ ID NO: 4412747 - DNA, 22 bp, Homo sapiens
aagaggaacagcactggggagt

SEQ ID NO: 4412748 - DNA, 17 bp, Homo sapiens
aagaggaccagaggagc

SEQ ID NO: 4412749 - DNA, 21 bp, Homo sapiens
aagaggatgatttcagaagga

SEQ ID NO: 4412750 - DNA, 15 bp, Homo sapiens
aagaggcaccaggaa

SEQ ID NO: 4412751 - DNA, 18 bp, Homo sapiens
aagaggcaccaggaagcc

SEQ ID NO: 4412752 - DNA, 23 bp, Homo sapiens
aagaggccacttagggaaagatg

SEQ ID NO: 4412753 - DNA, 23 bp, Homo sapiens
aagaggctgcccctctcaccaaa

SEQ ID NO: 4412754 - DNA, 17 bp, Homo sapiens
aagagggcccaaagaat

SEQ ID NO: 4412755 - DNA, 17 bp, Homo sapiens
aagagggcccagcccag

SEQ ID NO: 4412756 - DNA, 23 bp, Homo sapiens
aagagggcccagcccagagccac

SEQ ID NO: 4412757 - DNA, 18 bp, Homo sapiens
aagaggggcgggctcaga

SEQ ID NO: 4412758 - DNA, 13 bp, Homo sapiens
aagagggggtgga

SEQ ID NO: 4412759 - DNA, 14 bp, Homo sapiens
aagaggtggattca

SEQ ID NO: 4412760 - DNA, 17 bp, Homo sapiens
aagaggtgggagggccc

SEQ ID NO: 4412761 - DNA, 22 bp, Homo sapiens
aagaggttgggcttccatgcct

SEQ ID NO: 4412762 - DNA, 15 bp, Homo sapiens
aagagtagaattgca

SEQ ID NO: 4412763 - DNA, 20 bp, Homo sapiens
aagagtatgtggcaaaacat

SEQ ID NO: 4412764 - DNA, 15 bp, Homo sapiens
aagagtctattgtct

SEQ ID NO: 4412765 - DNA, 16 bp, Homo sapiens
aagagtctattgtctc

SEQ ID NO: 4412766 - DNA, 18 bp, Homo sapiens
aagagtgactctccaggg

SEQ ID NO: 4412767 - DNA, 19 bp, Homo sapiens
aagagtgactctccagggg

SEQ ID NO: 4412768 - DNA, 18 bp, Homo sapiens
aagagtgtgttataaaat

SEQ ID NO: 4412769 - DNA, 19 bp, Homo sapiens
aagagttggggacagaact

SEQ ID NO: 4412770 - DNA, 15 bp, Homo sapiens
aagagtttaaaatca

SEQ ID NO: 4412771 - DNA, 16 bp, Homo sapiens
aagataaacacaaaat

SEQ ID NO: 4412772 - DNA, 18 bp, Homo sapiens
aagataacccttattcca

SEQ ID NO: 4412773 - DNA, 19 bp, Homo sapiens
aagataagaaatgatcttt

SEQ ID NO: 4412774 - DNA, 16 bp, Homo sapiens
aagataagtctacatt

SEQ ID NO: 4412775 - DNA, 22 bp, Homo sapiens
aagataatctcagtgctttcct

SEQ ID NO: 4412776 - DNA, 16 bp, Homo sapiens
aagataatttatttca

SEQ ID NO: 4412777 - DNA, 17 bp, Homo sapiens
aactcatcccttgttta

SEQ ID NO: 4412778 - DNA, 14 bp, Homo sapiens
aactcattgcagca

SEQ ID NO: 4412779 - DNA, 22 bp, Homo sapiens
aactcattgcagcagataactt

SEQ ID NO: 4412780 - DNA, 17 bp, Homo sapiens
aactcatttgaatgctt

SEQ ID NO: 4412781 - DNA, 24 bp, Homo sapiens
aactcatttttgttttcattatct

SEQ ID NO: 4412782 - DNA, 15 bp, Homo sapiens
aactccaccaaccca

SEQ ID NO: 4412783 - DNA, 12 bp, Homo sapiens
aactccagcatt

SEQ ID NO: 4412784 - DNA, 21 bp, Homo sapiens
aactccaggaaagagcagtca

SEQ ID NO: 4412785 - DNA, 17 bp, Homo sapiens
aactccaggggcaccta

SEQ ID NO: 4412786 - DNA, 17 bp, Homo sapiens
aactccatacagcctct

SEQ ID NO: 4412787 - DNA, 18 bp, Homo sapiens
aactcccaacttcttcct

SEQ ID NO: 4412788 - DNA, 17 bp, Homo sapiens
aactccgcccagcctct

SEQ ID NO: 4412789 - DNA, 15 bp, Homo sapiens
aactcctatttcaat

SEQ ID NO: 4412790 - DNA, 12 bp, Homo sapiens
aactcctcccat

SEQ ID NO: 4412791 - DNA, 17 bp, Homo sapiens
aactcctttcagccaca

SEQ ID NO: 4412792 - DNA, 15 bp, Homo sapiens
aactcgttttttaca

SEQ ID NO: 4412793 - DNA, 23 bp, Homo sapiens
aactctaatattgcttcttgtgt

SEQ ID NO: 4412794 - DNA, 22 bp, Homo sapiens
aactctatattgttcagcatgc

SEQ ID NO: 4412795 - DNA, 11 bp, Homo sapiens
aactctcccca

SEQ ID NO: 4412796 - DNA, 20 bp, Homo sapiens
aactctccccagtgcctgcc

SEQ ID NO: 4412797 - DNA, 16 bp, Homo sapiens
aactctctcccaggac

SEQ ID NO: 4412798 - DNA, 19 bp, Homo sapiens
aactctgatccctgggcct

SEQ ID NO: 4412799 - DNA, 12 bp, Homo sapiens
aactctgcatag

SEQ ID NO: 4412800 - DNA, 19 bp, Homo sapiens
aactctggacactctatat

SEQ ID NO: 4412801 - DNA, 11 bp, Homo sapiens
aactctggtgc

SEQ ID NO: 4412802 - DNA, 18 bp, Homo sapiens
aactctggtgctcctgca

SEQ ID NO: 4412803 - DNA, 13 bp, Homo sapiens
aactctggtggca

SEQ ID NO: 4412804 - DNA, 18 bp, Homo sapiens
aactctgtataatagaga

SEQ ID NO: 4412805 - DNA, 23 bp, Homo sapiens
aactctgtataatagagataagt

SEQ ID NO: 4412806 - DNA, 21 bp, Homo sapiens
aactcttatttctttccttta

SEQ ID NO: 4412807 - DNA, 17 bp, Homo sapiens
aactcttgattatccat

SEQ ID NO: 4412808 - DNA, 14 bp, Homo sapiens
aactctttgagaaa

SEQ ID NO: 4412809 - DNA, 13 bp, Homo sapiens
aactctttgctgc

SEQ ID NO: 4412810 - DNA, 15 bp, Homo sapiens
aactctttgttattt

SEQ ID NO: 4412811 - DNA, 12 bp, Homo sapiens
aactgaaaatga

SEQ ID NO: 4412812 - DNA, 12 bp, Homo sapiens
aactgaaaatgt

SEQ ID NO: 4412813 - DNA, 13 bp, Homo sapiens
aactgaaaattat

SEQ ID NO: 4412814 - DNA, 21 bp, Homo sapiens
aactgaacaccattgaaggct

SEQ ID NO: 4412815 - DNA, 13 bp, Homo sapiens
aactgaactgtaa

SEQ ID NO: 4412816 - DNA, 13 bp, Homo sapiens
aactgaaggagaa

SEQ ID NO: 4412817 - DNA, 22 bp, Homo sapiens
aactgaaggagatcaatggttt

SEQ ID NO: 4412818 - DNA, 16 bp, Homo sapiens
aactgaatttgtactt

SEQ ID NO: 4412819 - DNA, 15 bp, Homo sapiens
aactgagatattatt

SEQ ID NO: 4412820 - DNA, 13 bp, Homo sapiens
aactgagccccag

SEQ ID NO: 4412821 - DNA, 11 bp, Homo sapiens
aacttttgtac

SEQ ID NO: 4412822 - DNA, 20 bp, Homo sapiens
aacttttgtactgaattttt

SEQ ID NO: 4412823 - DNA, 23 bp, Homo sapiens
aacttttgtttttttttgtttgt

SEQ ID NO: 4412824 - DNA, 23 bp, Homo sapiens
aactttttattgccttctcacca

SEQ ID NO: 4412825 - DNA, 20 bp, Homo sapiens
aactttttgtttttatttct

SEQ ID NO: 4412826 - DNA, 12 bp, Homo sapiens
aacttttttccc

SEQ ID NO: 4412827 - DNA, 13 bp, Homo sapiens
aacttttttccct

SEQ ID NO: 4412828 - DNA, 20 bp, Homo sapiens
aacttttttgagtcattgac

SEQ ID NO: 4412829 - DNA, 14 bp, Homo sapiens
aactttttttaagg

SEQ ID NO: 4412830 - DNA, 21 bp, Homo sapiens
aactttttttctgtaccagtt

SEQ ID NO: 4412831 - DNA, 22 bp, Homo sapiens
aactttttttctgtaccagtta

SEQ ID NO: 4412832 - DNA, 20 bp, Homo sapiens
aacttttttttaagttacac

SEQ ID NO: 4412833 - DNA, 15 bp, Homo sapiens
aagaaaaaaaaaaga

SEQ ID NO: 4412834 - DNA, 14 bp, Homo sapiens
aagaaaaaaagcaa

SEQ ID NO: 4412835 - DNA, 23 bp, Homo sapiens
aagaaaaatctcattatttcaaa

SEQ ID NO: 4412836 - DNA, 18 bp, Homo sapiens
aagaaaaattaattagga

SEQ ID NO: 4412837 - DNA, 15 bp, Homo sapiens
aagaaaacagtacag

SEQ ID NO: 4412838 - DNA, 22 bp, Homo sapiens
aagaaaacagtacagaaggcaa

SEQ ID NO: 4412839 - DNA, 15 bp, Homo sapiens
aagaaaataaattac

SEQ ID NO: 4412840 - DNA, 11 bp, Homo sapiens
aagaaaatatt

SEQ ID NO: 4412841 - DNA, 12 bp, Homo sapiens
aagaaaatgaag

SEQ ID NO: 4412842 - DNA, 22 bp, Homo sapiens
aagaaaatgtaaaggtttttgt

SEQ ID NO: 4412843 - DNA, 15 bp, Homo sapiens
aagaaaattcctata

SEQ ID NO: 4412844 - DNA, 19 bp, Homo sapiens
aagaaacaactctttgaga

SEQ ID NO: 4412845 - DNA, 11 bp, Homo sapiens
aagaaacccaa

SEQ ID NO: 4412846 - DNA, 15 bp, Homo sapiens
aagaaaccttgctct

SEQ ID NO: 4412847 - DNA, 21 bp, Homo sapiens
aagaaactagtaagaaacaat

SEQ ID NO: 4412848 - DNA, 19 bp, Homo sapiens
aagaaacttgtaaatatct

SEQ ID NO: 4412849 - DNA, 11 bp, Homo sapiens
aagaaactttc

SEQ ID NO: 4412850 - DNA, 23 bp, Homo sapiens
aagaaactttctttctcactaaa

SEQ ID NO: 4412851 - DNA, 14 bp, Homo sapiens
aagaaagaaaatca

SEQ ID NO: 4412852 - DNA, 12 bp, Homo sapiens
aagaaagaatgt

SEQ ID NO: 4412853 - DNA, 17 bp, Homo sapiens
aagaaagagaaggagcc

SEQ ID NO: 4412854 - DNA, 17 bp, Homo sapiens
aagaaagatgtatatag

SEQ ID NO: 4412855 - DNA, 16 bp, Homo sapiens
aagaaagcaaaagcaa

SEQ ID NO: 4412856 - DNA, 19 bp, Homo sapiens
aagaaagccaccttgttac

SEQ ID NO: 4412857 - DNA, 23 bp, Homo sapiens
aagaaaggaagcattgtaaaata

SEQ ID NO: 4412858 - DNA, 18 bp, Homo sapiens
aagaaagtgtatttggaa

SEQ ID NO: 4412859 - DNA, 12 bp, Homo sapiens
aagaaatagaat

SEQ ID NO: 4412860 - DNA, 18 bp, Homo sapiens
aagaaatatctgtgaaat

SEQ ID NO: 4412861 - DNA, 19 bp, Homo sapiens
aagaaatatctgtgaaata

SEQ ID NO: 4412862 - DNA, 12 bp, Homo sapiens
aagaaatgaaca

SEQ ID NO: 4412863 - DNA, 19 bp, Homo sapiens
aagaaattcaagaagtatt

SEQ ID NO: 4412864 - DNA, 14 bp, Homo sapiens
aagaaattttagta

SEQ ID NO: 4412865 - DNA, 14 bp, Homo sapiens
aagaacaagaaatg

SEQ ID NO: 4412866 - DNA, 13 bp, Homo sapiens
aagaacacatttt

SEQ ID NO: 4412867 - DNA, 18 bp, Homo sapiens
aagaacagaattgctcct

SEQ ID NO: 4412868 - DNA, 13 bp, Homo sapiens
aagaacagccccg

SEQ ID NO: 4412869 - DNA, 16 bp, Homo sapiens
aagaacatgcagtttg

SEQ ID NO: 4412870 - DNA, 22 bp, Homo sapiens
aagaacatgcagtttgaaattc

SEQ ID NO: 4412871 - DNA, 21 bp, Homo sapiens
aagaaccaaactcctatttca

SEQ ID NO: 4412872 - DNA, 13 bp, Homo sapiens
aagaacccctctg

SEQ ID NO: 4412873 - DNA, 15 bp, Homo sapiens
aagaacccctctgct

SEQ ID NO: 4412874 - DNA, 22 bp, Homo sapiens
aagaacctacagactccatctc

SEQ ID NO: 4412875 - DNA, 15 bp, Homo sapiens
aagaacctatatctt

SEQ ID NO: 4412876 - DNA, 17 bp, Homo sapiens
aagaacggggctcttct

SEQ ID NO: 4412877 - DNA, 18 bp, Homo sapiens
aagaacggggctcttctc

SEQ ID NO: 4412878 - DNA, 13 bp, Homo sapiens
aagaactctctgg

SEQ ID NO: 4412879 - DNA, 20 bp, Homo sapiens
aagaactgtacattgtgagc

SEQ ID NO: 4412880 - DNA, 14 bp, Homo sapiens
aagaactgtgtctg

SEQ ID NO: 4412881 - DNA, 17 bp, Homo sapiens
aagaactttaaattgtg

SEQ ID NO: 4412882 - DNA, 13 bp, Homo sapiens
aagaagacatttt

SEQ ID NO: 4412883 - DNA, 21 bp, Homo sapiens
aagaagcaacctcagtaattt

SEQ ID NO: 4412884 - DNA, 17 bp, Homo sapiens
aagaagcaataactatt

SEQ ID NO: 4412885 - DNA, 18 bp, Homo sapiens
aagaagcaatctttgaaa

SEQ ID NO: 4412886 - DNA, 20 bp, Homo sapiens
aagaagcaatctttgaaata

SEQ ID NO: 4412887 - DNA, 22 bp, Homo sapiens
aagaagcattttgtaagttgaa

SEQ ID NO: 4412888 - DNA, 18 bp, Homo sapiens
aagaagcttccacaaaat

SEQ ID NO: 4412889 - DNA, 21 bp, Homo sapiens
aagaaggaaggcctgagcccc

SEQ ID NO: 4412890 - DNA, 16 bp, Homo sapiens
aagaaggcaaaaatgt

SEQ ID NO: 4412891 - DNA, 13 bp, Homo sapiens
aagaaggcaattt

SEQ ID NO: 4412892 - DNA, 23 bp, Homo sapiens
aagaaggcaattttagtgtatta

SEQ ID NO: 4412893 - DNA, 15 bp, Homo sapiens
aagaagggagaagaa

SEQ ID NO: 4412894 - DNA, 17 bp, Homo sapiens
aagaagggagaagaaag

SEQ ID NO: 4412895 - DNA, 20 bp, Homo sapiens
aagaagggtgggagtggggc

SEQ ID NO: 4412896 - DNA, 18 bp, Homo sapiens
aagaagtcggaatgtcat

SEQ ID NO: 4412897 - DNA, 16 bp, Homo sapiens
aagaagtgaaaatcta

SEQ ID NO: 4412898 - DNA, 13 bp, Homo sapiens
aagaagttaattc

SEQ ID NO: 4412899 - DNA, 14 bp, Homo sapiens
aagaagttaattct

SEQ ID NO: 4412900 - DNA, 12 bp, Homo sapiens
aagaataaattc

SEQ ID NO: 4412901 - DNA, 13 bp, Homo sapiens
aagaataaattct

SEQ ID NO: 4412902 - DNA, 20 bp, Homo sapiens
aacctttaaaaatgtataat

SEQ ID NO: 4412903 - DNA, 15 bp, Homo sapiens
aacctttccatttta

SEQ ID NO: 4412904 - DNA, 11 bp, Homo sapiens
aacctttccct

SEQ ID NO: 4412905 - DNA, 14 bp, Homo sapiens
aacctttccctcac

SEQ ID NO: 4412906 - DNA, 20 bp, Homo sapiens
aacctttccctcaccccctc

SEQ ID NO: 4412907 - DNA, 19 bp, Homo sapiens
aacctttgctatgtaaggg

SEQ ID NO: 4412908 - DNA, 19 bp, Homo sapiens
aacgactgtatattgctaa

SEQ ID NO: 4412909 - DNA, 14 bp, Homo sapiens
aacgagaagtgctt

SEQ ID NO: 4412910 - DNA, 15 bp, Homo sapiens
aacgagaagtgcttt

SEQ ID NO: 4412911 - DNA, 12 bp, Homo sapiens
aacgagacacat

SEQ ID NO: 4412912 - DNA, 13 bp, Homo sapiens
aacgcagccctag

SEQ ID NO: 4412913 - DNA, 23 bp, Homo sapiens
aacgcagccctagagcctgcctg

SEQ ID NO: 4412914 - DNA, 20 bp, Homo sapiens
aacgcaggaggagaaaagaa

SEQ ID NO: 4412915 - DNA, 16 bp, Homo sapiens
aacgccgagtgcactg

SEQ ID NO: 4412916 - DNA, 21 bp, Homo sapiens
aacgctaaagagcccttgcct

SEQ ID NO: 4412917 - DNA, 14 bp, Homo sapiens
aacggcaacagcat

SEQ ID NO: 4412918 - DNA, 14 bp, Homo sapiens
aacggcccaggcca

SEQ ID NO: 4412919 - DNA, 22 bp, Homo sapiens
aacggcttgctttcctgcatct

SEQ ID NO: 4412920 - DNA, 16 bp, Homo sapiens
aacggggggctcctgc

SEQ ID NO: 4412921 - DNA, 18 bp, Homo sapiens
aacggtgcccatcctgcc

SEQ ID NO: 4412922 - DNA, 14 bp, Homo sapiens
aacggtgctaaaaa

SEQ ID NO: 4412923 - DNA, 23 bp, Homo sapiens
aacgtgctcactgtgtataggaa

SEQ ID NO: 4412924 - DNA, 23 bp, Homo sapiens
aacgtggtttgcctgaggctgta

SEQ ID NO: 4412925 - DNA, 17 bp, Homo sapiens
aacgtgttcaatatttt

SEQ ID NO: 4412926 - DNA, 21 bp, Homo sapiens
aacgttagaatagtggttaac

SEQ ID NO: 4412927 - DNA, 21 bp, Homo sapiens
aacgttggagtttgggctgga

SEQ ID NO: 4412928 - DNA, 19 bp, Homo sapiens
aactaaactagtttttcct

SEQ ID NO: 4412929 - DNA, 18 bp, Homo sapiens
aactaaactcttaccata

SEQ ID NO: 4412930 - DNA, 18 bp, Homo sapiens
aactaaattttaaagcca

SEQ ID NO: 4412931 - DNA, 18 bp, Homo sapiens
aactaaatttttcataga

SEQ ID NO: 4412932 - DNA, 22 bp, Homo sapiens
aactaagattcttttaaattag

SEQ ID NO: 4412933 - DNA, 12 bp, Homo sapiens
aactaagccagg

SEQ ID NO: 4412934 - DNA, 21 bp, Homo sapiens
aactaaggcttttatttctgt

SEQ ID NO: 4412935 - DNA, 14 bp, Homo sapiens
aactaataaaataa

SEQ ID NO: 4412936 - DNA, 15 bp, Homo sapiens
aactaatatatgaaa

SEQ ID NO: 4412937 - DNA, 15 bp, Homo sapiens
aactacaaacaaaat

SEQ ID NO: 4412938 - DNA, 14 bp, Homo sapiens
aactacaacttctc

SEQ ID NO: 4412939 - DNA, 17 bp, Homo sapiens
aactacagaatattaaa

SEQ ID NO: 4412940 - DNA, 18 bp, Homo sapiens
aactacagaatattaaat

SEQ ID NO: 4412941 - DNA, 21 bp, Homo sapiens
aactacagaatattaaatatt

SEQ ID NO: 4412942 - DNA, 13 bp, Homo sapiens
aactacatgagaa

SEQ ID NO: 4412943 - DNA, 19 bp, Homo sapiens
aactactgcctttagaaaa

SEQ ID NO: 4412944 - DNA, 20 bp, Homo sapiens
aactactgcctttagaaaat

SEQ ID NO: 4412945 - DNA, 13 bp, Homo sapiens
aactactttataa

SEQ ID NO: 4412946 - DNA, 15 bp, Homo sapiens
aactagaatttgatt

SEQ ID NO: 4412947 - DNA, 16 bp, Homo sapiens
aactagcccctggggt

SEQ ID NO: 4412948 - DNA, 15 bp, Homo sapiens
aactagctgggacta

SEQ ID NO: 4412949 - DNA, 22 bp, Homo sapiens
aactagctgggactacaggtgc

SEQ ID NO: 4412950 - DNA, 13 bp, Homo sapiens
aactagcttaagg

SEQ ID NO: 4412951 - DNA, 16 bp, Homo sapiens
aactatacttgaacaa

SEQ ID NO: 4412952 - DNA, 18 bp, Homo sapiens
aactatatgtgaaacatt

SEQ ID NO: 4412953 - DNA, 17 bp, Homo sapiens
aactatcaatatttaag

SEQ ID NO: 4412954 - DNA, 19 bp, Homo sapiens
aactatcaatatttaagtt

SEQ ID NO: 4412955 - DNA, 22 bp, Homo sapiens
aactatcaatatttaagtttgt

SEQ ID NO: 4412956 - DNA, 18 bp, Homo sapiens
aactatcatttttacact

SEQ ID NO: 4412957 - DNA, 23 bp, Homo sapiens
aactatctcatgccagtgcctta

SEQ ID NO: 4412958 - DNA, 18 bp, Homo sapiens
aactatgaggagcctctg

SEQ ID NO: 4412959 - DNA, 16 bp, Homo sapiens
aactatgattattaac

SEQ ID NO: 4412960 - DNA, 20 bp, Homo sapiens
aactatgatttattttggtg

SEQ ID NO: 4412961 - DNA, 22 bp, Homo sapiens
aactatgtgtttttctcatatt

SEQ ID NO: 4412962 - DNA, 17 bp, Homo sapiens
aactattcgaatgaaaa

SEQ ID NO: 4412963 - DNA, 15 bp, Homo sapiens
aactattgcatttat

SEQ ID NO: 4412964 - DNA, 21 bp, Homo sapiens
aactatttatatcacacaata

SEQ ID NO: 4412965 - DNA, 16 bp, Homo sapiens
aactatttgtataaaa

SEQ ID NO: 4412966 - DNA, 17 bp, Homo sapiens
aactattttaaataaaa

SEQ ID NO: 4412967 - DNA, 19 bp, Homo sapiens
aactattttgagcattaga

SEQ ID NO: 4412968 - DNA, 20 bp, Homo sapiens
aactcaaggaaaagttcttt

SEQ ID NO: 4412969 - DNA, 23 bp, Homo sapiens
aactcaaggaaaagttctttcaa

SEQ ID NO: 4412970 - DNA, 17 bp, Homo sapiens
aactcaccaggttgctt

SEQ ID NO: 4412971 - DNA, 22 bp, Homo sapiens
aactcactaacagggagaagta

SEQ ID NO: 4412972 - DNA, 17 bp, Homo sapiens
aactcactcactgttta

SEQ ID NO: 4412973 - DNA, 13 bp, Homo sapiens
aactcagatctgt

SEQ ID NO: 4412974 - DNA, 17 bp, Homo sapiens
aactcagatctgtctga

SEQ ID NO: 4412975 - DNA, 21 bp, Homo sapiens
aaatttcatttcacatttttg

SEQ ID NO: 4412976 - DNA, 17 bp, Homo sapiens
aaatttcccaattttct

SEQ ID NO: 4412977 - DNA, 15 bp, Homo sapiens
aaatttcctgtttga

SEQ ID NO: 4412978 - DNA, 20 bp, Homo sapiens
aaatttcgcttcttagaaca

SEQ ID NO: 4412979 - DNA, 17 bp, Homo sapiens
aaatttcttttattaat

SEQ ID NO: 4412980 - DNA, 21 bp, Homo sapiens
aaatttcttttattaatactt

SEQ ID NO: 4412981 - DNA, 16 bp, Homo sapiens
aaatttgactaatttt

SEQ ID NO: 4412982 - DNA, 20 bp, Homo sapiens
aaatttgatggactaattat

SEQ ID NO: 4412983 - DNA, 16 bp, Homo sapiens
aaatttgatggttgaa

SEQ ID NO: 4412984 - DNA, 15 bp, Homo sapiens
aaatttgattgattt

SEQ ID NO: 4412985 - DNA, 19 bp, Homo sapiens
aaatttggccttaagaact

SEQ ID NO: 4412986 - DNA, 21 bp, Homo sapiens
aaatttggccttaagaactgt

SEQ ID NO: 4412987 - DNA, 23 bp, Homo sapiens
aaatttggccttaagaactgtgt

SEQ ID NO: 4412988 - DNA, 19 bp, Homo sapiens
aaatttgtaataaaactat

SEQ ID NO: 4412989 - DNA, 11 bp, Homo sapiens
aaatttgtaga

SEQ ID NO: 4412990 - DNA, 16 bp, Homo sapiens
aaatttgtctgaaaca

SEQ ID NO: 4412991 - DNA, 18 bp, Homo sapiens
aaatttgtctgaaacatt

SEQ ID NO: 4412992 - DNA, 19 bp, Homo sapiens
aaatttgttattttgcaac

SEQ ID NO: 4412993 - DNA, 19 bp, Homo sapiens
aaatttgttttcaacaatt

SEQ ID NO: 4412994 - DNA, 22 bp, Homo sapiens
aaatttgttttcaacaattggt

SEQ ID NO: 4412995 - DNA, 10 bp, Homo sapiens
aaattttaaa

SEQ ID NO: 4412996 - DNA, 15 bp, Homo sapiens
aaattttaactaaat

SEQ ID NO: 4412997 - DNA, 12 bp, Homo sapiens
aaattttaactg

SEQ ID NO: 4412998 - DNA, 21 bp, Homo sapiens
aaattttaagaagaaagattt

SEQ ID NO: 4412999 - DNA, 18 bp, Homo sapiens
aaattttatatgtaaatg

SEQ ID NO: 4413000 - DNA, 22 bp, Homo sapiens
aaattttatatgtaaatgtgtt

SEQ ID NO: 4413001 - DNA, 12 bp, Homo sapiens
aaattttattga

SEQ ID NO: 4413002 - DNA, 17 bp, Homo sapiens
aaattttcttcagttgg

SEQ ID NO: 4413003 - DNA, 21 bp, Homo sapiens
aaattttcttcctttgaagct

SEQ ID NO: 4413004 - DNA, 14 bp, Homo sapiens
aaattttgaatgta

SEQ ID NO: 4413005 - DNA, 15 bp, Homo sapiens
aaattttgaatgtac

SEQ ID NO: 4413006 - DNA, 12 bp, Homo sapiens
aaattttgtaat

SEQ ID NO: 4413007 - DNA, 14 bp, Homo sapiens
aaattttgtaatga

SEQ ID NO: 4413008 - DNA, 18 bp, Homo sapiens
aaattttgtgttcctttt

SEQ ID NO: 4413009 - DNA, 20 bp, Homo sapiens
aaatttttgtagtagcgttt

SEQ ID NO: 4413010 - DNA, 18 bp, Homo sapiens
aaattttttaaaagagac

SEQ ID NO: 4413011 - DNA, 16 bp, Homo sapiens
aaattttttagtatgt

SEQ ID NO: 4413012 - DNA, 17 bp, Homo sapiens
aaattttttttgtttca

SEQ ID NO: 4413013 - DNA, 18 bp, Homo sapiens
aaattttttttgtttcat

SEQ ID NO: 4413014 - DNA, 16 bp, Homo sapiens
aacaaaaaaaaaatga

SEQ ID NO: 4413015 - DNA, 13 bp, Homo sapiens
aacaaaaaaggtt

SEQ ID NO: 4413016 - DNA, 13 bp, Homo sapiens
aacaaaaaataca

SEQ ID NO: 4413017 - DNA, 13 bp, Homo sapiens
aacaaaaattgtc

SEQ ID NO: 4413018 - DNA, 14 bp, Homo sapiens
aacaaaacgaaact

SEQ ID NO: 4413019 - DNA, 17 bp, Homo sapiens
aacaaaactatacttga

SEQ ID NO: 4413020 - DNA, 12 bp, Homo sapiens
aacaaaagggtc

SEQ ID NO: 4413021 - DNA, 16 bp, Homo sapiens
aacaaaagtacattgc

SEQ ID NO: 4413022 - DNA, 15 bp, Homo sapiens
aacaaaatgaaacaa

SEQ ID NO: 4413023 - DNA, 17 bp, Homo sapiens
aacaaaatgtatgtctg

SEQ ID NO: 4413024 - DNA, 20 bp, Homo sapiens
aacaaaatttgactaatttt

SEQ ID NO: 4413025 - DNA, 19 bp, Homo sapiens
aacaaacgtaatttgttat

SEQ ID NO: 4413026 - DNA, 12 bp, Homo sapiens
aacaaagacatg

SEQ ID NO: 4413027 - DNA, 13 bp, Homo sapiens
aacaaagacattt

SEQ ID NO: 4413028 - DNA, 18 bp, Homo sapiens
aacaaagacatttatatg

SEQ ID NO: 4413029 - DNA, 14 bp, Homo sapiens
aacaaagattgaga

SEQ ID NO: 4413030 - DNA, 12 bp, Homo sapiens
aacaaagtgctt

SEQ ID NO: 4413031 - DNA, 13 bp, Homo sapiens
aacaaagtgcttt

SEQ ID NO: 4413032 - DNA, 19 bp, Homo sapiens
aacaaataaaaaagctctt

SEQ ID NO: 4413033 - DNA, 14 bp, Homo sapiens
aacaaataaaagtt

SEQ ID NO: 4413034 - DNA, 16 bp, Homo sapiens
aacaaataaaagttga

SEQ ID NO: 4413035 - DNA, 14 bp, Homo sapiens
aacaacaattggta

SEQ ID NO: 4413036 - DNA, 20 bp, Homo sapiens
aacaacagtcttcatttttt

SEQ ID NO: 4413037 - DNA, 16 bp, Homo sapiens
aacaactgtttgtctt

SEQ ID NO: 4413038 - DNA, 22 bp, Homo sapiens
aacaacttgaaacccattttaa

SEQ ID NO: 4413039 - DNA, 17 bp, Homo sapiens
aacaacttgtagcagct

SEQ ID NO: 4413040 - DNA, 14 bp, Homo sapiens
aacaagaaactgtc

SEQ ID NO: 4413041 - DNA, 19 bp, Homo sapiens
aacaagaaatggatgtaag

SEQ ID NO: 4413042 - DNA, 14 bp, Homo sapiens
aacaagaagaattt

SEQ ID NO: 4413043 - DNA, 22 bp, Homo sapiens
aacaagacctcagtgccttcct

SEQ ID NO: 4413044 - DNA, 22 bp, Homo sapiens
aacaagagaaaagaaaaatcaa

SEQ ID NO: 4413045 - DNA, 19 bp, Homo sapiens
aacaagagcactacattca

SEQ ID NO: 4413046 - DNA, 19 bp, Homo sapiens
aacaagcaaggatatcaga

SEQ ID NO: 4413047 - DNA, 22 bp, Homo sapiens
aacaagccaaagagcctcccac

SEQ ID NO: 4413048 - DNA, 14 bp, Homo sapiens
aacaagctcatccc

SEQ ID NO: 4413049 - DNA, 18 bp, Homo sapiens
aacaagctcatccctgga

SEQ ID NO: 4413050 - DNA, 11 bp, Homo sapiens
aacaaggaagg

SEQ ID NO: 4413051 - DNA, 14 bp, Homo sapiens
aacaaggcattcag

SEQ ID NO: 4413052 - DNA, 23 bp, Homo sapiens
aacaaggcattcagcagtttctg

SEQ ID NO: 4413053 - DNA, 18 bp, Homo sapiens
aacaagtcatttttgtat

SEQ ID NO: 4413054 - DNA, 21 bp, Homo sapiens
aacaagtcatttttgtatttt

SEQ ID NO: 4413055 - DNA, 19 bp, Homo sapiens
aacaagttccattatgaaa

SEQ ID NO: 4413056 - DNA, 14 bp, Homo sapiens
aacaataaaatttt

SEQ ID NO: 4413057 - DNA, 19 bp, Homo sapiens
aacaataaagatacatgat

SEQ ID NO: 4413058 - DNA, 19 bp, Homo sapiens
aacaataaatgttggcttg

SEQ ID NO: 4413059 - DNA, 15 bp, Homo sapiens
aacaatccattcaca

SEQ ID NO: 4413060 - DNA, 19 bp, Homo sapiens
aacaatctaacaataatat

SEQ ID NO: 4413061 - DNA, 18 bp, Homo sapiens
aacaatctttcatgtctt

SEQ ID NO: 4413062 - DNA, 18 bp, Homo sapiens
aacaatgaaaactctttg

SEQ ID NO: 4413063 - DNA, 17 bp, Homo sapiens
aacaatgcctattgtaa

SEQ ID NO: 4413064 - DNA, 23 bp, Homo sapiens
aacaatgcctattgtaatataga

SEQ ID NO: 4413065 - DNA, 23 bp, Homo sapiens
aacaatgccttgttgtattcctg

SEQ ID NO: 4413066 - DNA, 17 bp, Homo sapiens
aacaatggaagatttgc

SEQ ID NO: 4413067 - DNA, 13 bp, Homo sapiens
aacaatggtaaca

SEQ ID NO: 4413068 - DNA, 15 bp, Homo sapiens
aacaattactaatga

SEQ ID NO: 4413069 - DNA, 18 bp, Homo sapiens
aacaattcccttcttttt

SEQ ID NO: 4413070 - DNA, 22 bp, Homo sapiens
aacaattcccttctttttcatc

SEQ ID NO: 4413071 - DNA, 24 bp, Homo sapiens
aacaattggtaaaactcactgtga

SEQ ID NO: 4413072 - DNA, 13 bp, Homo sapiens
aacaatttatgaa

SEQ ID NO: 4413073 - DNA, 19 bp, Homo sapiens
aacacaaactgtaaataaa

SEQ ID NO: 4413074 - DNA, 14 bp, Homo sapiens
aacacaaaggaagt

SEQ ID NO: 4413075 - DNA, 12 bp, Homo sapiens
aacacaattcta

SEQ ID NO: 4413076 - DNA, 19 bp, Homo sapiens
aacacagaaacctttttaa

SEQ ID NO: 4413077 - DNA, 14 bp, Homo sapiens
aacacagatattgt

SEQ ID NO: 4413078 - DNA, 17 bp, Homo sapiens
aacacaggataaagtta

SEQ ID NO: 4413079 - DNA, 18 bp, Homo sapiens
aacacaggtagcacagat

SEQ ID NO: 4413080 - DNA, 14 bp, Homo sapiens
aacacagtattttc

SEQ ID NO: 4413081 - DNA, 18 bp, Homo sapiens
aacacatagattcacctg

SEQ ID NO: 4413082 - DNA, 20 bp, Homo sapiens
aacacatagattcacctgta

SEQ ID NO: 4413083 - DNA, 22 bp, Homo sapiens
aacacatagattcacctgtaaa

SEQ ID NO: 4413084 - DNA, 16 bp, Homo sapiens
aacacatcagcttgcc

SEQ ID NO: 4413085 - DNA, 13 bp, Homo sapiens
aacacatgatacc

SEQ ID NO: 4413086 - DNA, 18 bp, Homo sapiens
aacacatggggaaaaaaa

SEQ ID NO: 4413087 - DNA, 21 bp, Homo sapiens
aacacatggggaaaaaaatca

SEQ ID NO: 4413088 - DNA, 22 bp, Homo sapiens
aacacatggggaaaaaaatcat

SEQ ID NO: 4413089 - DNA, 21 bp, Homo sapiens
aacacatgtttttatttcctc

SEQ ID NO: 4413090 - DNA, 14 bp, Homo sapiens
aacacatttttaag

SEQ ID NO: 4413091 - DNA, 17 bp, Homo sapiens
aacaccattgaaggctt

SEQ ID NO: 4413092 - DNA, 17 bp, Homo sapiens
aacacccttcagcaatg

SEQ ID NO: 4413093 - DNA, 21 bp, Homo sapiens
aacacctcacacctcactctt

SEQ ID NO: 4413094 - DNA, 22 bp, Homo sapiens
aacacctcctcccgaaaaatgt

SEQ ID NO: 4413095 - DNA, 11 bp, Homo sapiens
aacacctgcct

SEQ ID NO: 4413096 - DNA, 17 bp, Homo sapiens
aaatgttcatcaatgaa

SEQ ID NO: 4413097 - DNA, 20 bp, Homo sapiens
aaatgttcatcaatgaatga

SEQ ID NO: 4413098 - DNA, 14 bp, Homo sapiens
aaatgttcattgta

SEQ ID NO: 4413099 - DNA, 20 bp, Homo sapiens
aaatgttcccttgaccattg

SEQ ID NO: 4413100 - DNA, 22 bp, Homo sapiens
aaatgttctggtatgcattctt

SEQ ID NO: 4413101 - DNA, 23 bp, Homo sapiens
aaatgttgaaatatgatgttaaa

SEQ ID NO: 4413102 - DNA, 16 bp, Homo sapiens
aaatgttgtcctgtta

SEQ ID NO: 4413103 - DNA, 13 bp, Homo sapiens
aaatgtttaaaga

SEQ ID NO: 4413104 - DNA, 22 bp, Homo sapiens
aaatgtttctctctctctacct

SEQ ID NO: 4413105 - DNA, 16 bp, Homo sapiens
aaatgtttgtttatat

SEQ ID NO: 4413106 - DNA, 20 bp, Homo sapiens
aaatgttttaaagtttaatg

SEQ ID NO: 4413107 - DNA, 23 bp, Homo sapiens
aaatgttttaaagtttaatgcct

SEQ ID NO: 4413108 - DNA, 22 bp, Homo sapiens
aaatgttttcattttactggta

SEQ ID NO: 4413109 - DNA, 18 bp, Homo sapiens
aaatgtttttatttttgt

SEQ ID NO: 4413110 - DNA, 16 bp, Homo sapiens
aaatgtttttctgcca

SEQ ID NO: 4413111 - DNA, 21 bp, Homo sapiens
aaatgtttttctgccagggag

SEQ ID NO: 4413112 - DNA, 22 bp, Homo sapiens
aaattaaaaaaaaattgtatct

SEQ ID NO: 4413113 - DNA, 16 bp, Homo sapiens
aaattaaatatatgta

SEQ ID NO: 4413114 - DNA, 13 bp, Homo sapiens
aaattaaatctag

SEQ ID NO: 4413115 - DNA, 15 bp, Homo sapiens
aaattaagaaggcaa

SEQ ID NO: 4413116 - DNA, 18 bp, Homo sapiens
aaattaagatcctaaact

SEQ ID NO: 4413117 - DNA, 21 bp, Homo sapiens
aaattaagatcctaaactctc

SEQ ID NO: 4413118 - DNA, 17 bp, Homo sapiens
aaattaagatgttcaga

SEQ ID NO: 4413119 - DNA, 16 bp, Homo sapiens
aaattaagatttcctt

SEQ ID NO: 4413120 - DNA, 21 bp, Homo sapiens
aaattaatatggtgtattttt

SEQ ID NO: 4413121 - DNA, 15 bp, Homo sapiens
aaattaatgtaataa

SEQ ID NO: 4413122 - DNA, 20 bp, Homo sapiens
aaattaattaggaattactt

SEQ ID NO: 4413123 - DNA, 23 bp, Homo sapiens
aaattaatttgttaattaaatat

SEQ ID NO: 4413124 - DNA, 15 bp, Homo sapiens
aaattacagctttta

SEQ ID NO: 4413125 - DNA, 22 bp, Homo sapiens
aaattacagcttttatggatga

SEQ ID NO: 4413126 - DNA, 13 bp, Homo sapiens
aaattacatgttt

SEQ ID NO: 4413127 - DNA, 14 bp, Homo sapiens
aaattacatgtttt

SEQ ID NO: 4413128 - DNA, 15 bp, Homo sapiens
aaattacctgtggat

SEQ ID NO: 4413129 - DNA, 21 bp, Homo sapiens
aaattacctttacatatatag

SEQ ID NO: 4413130 - DNA, 13 bp, Homo sapiens
aaattactaatga

SEQ ID NO: 4413131 - DNA, 11 bp, Homo sapiens
aaattagaaaa

SEQ ID NO: 4413132 - DNA, 14 bp, Homo sapiens
aaattagaaaggac

SEQ ID NO: 4413133 - DNA, 16 bp, Homo sapiens
aaattagaaaggacaa

SEQ ID NO: 4413134 - DNA, 16 bp, Homo sapiens
aaattaggaataaata

SEQ ID NO: 4413135 - DNA, 13 bp, Homo sapiens
aaattaggttaaa

SEQ ID NO: 4413136 - DNA, 21 bp, Homo sapiens
aaattagtgaccattattcac

SEQ ID NO: 4413137 - DNA, 23 bp, Homo sapiens
aaattagtgtacctattaaaagt

SEQ ID NO: 4413138 - DNA, 15 bp, Homo sapiens
aaattataaggactg

SEQ ID NO: 4413139 - DNA, 15 bp, Homo sapiens
aaattatatatttat

SEQ ID NO: 4413140 - DNA, 18 bp, Homo sapiens
aaattatatttgtgctat

SEQ ID NO: 4413141 - DNA, 19 bp, Homo sapiens
aaattatcaaaaagctaat

SEQ ID NO: 4413142 - DNA, 13 bp, Homo sapiens
aaattatgaagct

SEQ ID NO: 4413143 - DNA, 22 bp, Homo sapiens
aaattatgaagctcatatcctt

SEQ ID NO: 4413144 - DNA, 17 bp, Homo sapiens
aaattatgtgacatttt

SEQ ID NO: 4413145 - DNA, 20 bp, Homo sapiens
aaattatgtgacattttaca

SEQ ID NO: 4413146 - DNA, 22 bp, Homo sapiens
aaattatgtgacattttacatt

SEQ ID NO: 4413147 - DNA, 22 bp, Homo sapiens
aaattatgttactgtatttttc

SEQ ID NO: 4413148 - DNA, 14 bp, Homo sapiens
aaattattaatgaa

SEQ ID NO: 4413149 - DNA, 13 bp, Homo sapiens
aaattattacttt

SEQ ID NO: 4413150 - DNA, 21 bp, Homo sapiens
aaattattatcttcttaacag

SEQ ID NO: 4413151 - DNA, 20 bp, Homo sapiens
aaattatttcttaattatta

SEQ ID NO: 4413152 - DNA, 14 bp, Homo sapiens
aaattatttgcagg

SEQ ID NO: 4413153 - DNA, 15 bp, Homo sapiens
aaattattttaaatt

SEQ ID NO: 4413154 - DNA, 20 bp, Homo sapiens
aaattattttaaattataag

SEQ ID NO: 4413155 - DNA, 22 bp, Homo sapiens
aaattattttaaattataagga

SEQ ID NO: 4413156 - DNA, 23 bp, Homo sapiens
aaattattttttgcatcatttaa

SEQ ID NO: 4413157 - DNA, 11 bp, Homo sapiens
aaattcaaata

SEQ ID NO: 4413158 - DNA, 16 bp, Homo sapiens
aaattcaagaagtatt

SEQ ID NO: 4413159 - DNA, 14 bp, Homo sapiens
aaattcacaaactt

SEQ ID NO: 4413160 - DNA, 15 bp, Homo sapiens
aaattcactttcatt

SEQ ID NO: 4413161 - DNA, 12 bp, Homo sapiens
aaattcagcaaa

SEQ ID NO: 4413162 - DNA, 14 bp, Homo sapiens
aaattcagctctga

SEQ ID NO: 4413163 - DNA, 13 bp, Homo sapiens
aaattcagtctct

SEQ ID NO: 4413164 - DNA, 21 bp, Homo sapiens
aaattcatggcatgcttaaat

SEQ ID NO: 4413165 - DNA, 19 bp, Homo sapiens
aaattcattttttaaattc

SEQ ID NO: 4413166 - DNA, 17 bp, Homo sapiens
aaattcccgttttgtca

SEQ ID NO: 4413167 - DNA, 19 bp, Homo sapiens
aaattccgattagaccttt

SEQ ID NO: 4413168 - DNA, 19 bp, Homo sapiens
aaattcgcccgagctgttt

SEQ ID NO: 4413169 - DNA, 18 bp, Homo sapiens
aaattctgaatttgcaaa

SEQ ID NO: 4413170 - DNA, 16 bp, Homo sapiens
aaattctgtgccttgt

SEQ ID NO: 4413171 - DNA, 14 bp, Homo sapiens
aaattcttcacatg

SEQ ID NO: 4413172 - DNA, 23 bp, Homo sapiens
aaattcttctgaactcaaactga

SEQ ID NO: 4413173 - DNA, 23 bp, Homo sapiens
aaattcttttttaaattttcttc

SEQ ID NO: 4413174 - DNA, 18 bp, Homo sapiens
aaattgaagcaactacaa

SEQ ID NO: 4413175 - DNA, 23 bp, Homo sapiens
aaattgaagcaactacaacttct

SEQ ID NO: 4413176 - DNA, 22 bp, Homo sapiens
aaattgaatagtttatttctgt

SEQ ID NO: 4413177 - DNA, 22 bp, Homo sapiens
aaattgacacttaaaaatggtt

SEQ ID NO: 4413178 - DNA, 23 bp, Homo sapiens
aaattgactgatgattttccttt

SEQ ID NO: 4413179 - DNA, 20 bp, Homo sapiens
aaattgaggacttaatttac

SEQ ID NO: 4413180 - DNA, 14 bp, Homo sapiens
aaattgcaaatctt

SEQ ID NO: 4413181 - DNA, 19 bp, Homo sapiens
aaattgcaaatcttgaaat

SEQ ID NO: 4413182 - DNA, 15 bp, Homo sapiens
aaattgcagaattca

SEQ ID NO: 4413183 - DNA, 19 bp, Homo sapiens
aaattgcagtttcatgtat

SEQ ID NO: 4413184 - DNA, 22 bp, Homo sapiens
aaattgcagtttcatgtatgta

SEQ ID NO: 4413185 - DNA, 14 bp, Homo sapiens
aaattgctctgtgt

SEQ ID NO: 4413186 - DNA, 16 bp, Homo sapiens
aaattgctctgtgtat

SEQ ID NO: 4413187 - DNA, 18 bp, Homo sapiens
aaattgctctgtgtatat

SEQ ID NO: 4413188 - DNA, 16 bp, Homo sapiens
aaattggaaagcaggt

SEQ ID NO: 4413189 - DNA, 19 bp, Homo sapiens
aaattggggaggagggggc

SEQ ID NO: 4413190 - DNA, 15 bp, Homo sapiens
aaattgggttcatga

SEQ ID NO: 4413191 - DNA, 15 bp, Homo sapiens
aaattgtatattgta

SEQ ID NO: 4413192 - DNA, 15 bp, Homo sapiens
aaattgtctgccatt

SEQ ID NO: 4413193 - DNA, 23 bp, Homo sapiens
aaattgtctgccattacaccaga

SEQ ID NO: 4413194 - DNA, 20 bp, Homo sapiens
aaattgtctttaaaaactgt

SEQ ID NO: 4413195 - DNA, 22 bp, Homo sapiens
aaattgtctttaaaaactgttt

SEQ ID NO: 4413196 - DNA, 23 bp, Homo sapiens
aaattgtgcagtactttgtgcat

SEQ ID NO: 4413197 - DNA, 11 bp, Homo sapiens
aaattgtgtta

SEQ ID NO: 4413198 - DNA, 13 bp, Homo sapiens
aaattgtttagtg

SEQ ID NO: 4413199 - DNA, 21 bp, Homo sapiens
aaattgtttatgtgttatgaa

SEQ ID NO: 4413200 - DNA, 23 bp, Homo sapiens
aaattgtttatgtgttatgaaca

SEQ ID NO: 4413201 - DNA, 13 bp, Homo sapiens
aaatttaagaaaa

SEQ ID NO: 4413202 - DNA, 15 bp, Homo sapiens
aaatttaagaaaaca

SEQ ID NO: 4413203 - DNA, 16 bp, Homo sapiens
aaatttaagaaaacaa

SEQ ID NO: 4413204 - DNA, 18 bp, Homo sapiens
aaatttaagaaaacaagt

SEQ ID NO: 4413205 - DNA, 15 bp, Homo sapiens
aaatttacacagtga

SEQ ID NO: 4413206 - DNA, 13 bp, Homo sapiens
aaatttagaaact

SEQ ID NO: 4413207 - DNA, 16 bp, Homo sapiens
aaatttagatcaaatt

SEQ ID NO: 4413208 - DNA, 16 bp, Homo sapiens
aaatttagccgggcgc

SEQ ID NO: 4413209 - DNA, 17 bp, Homo sapiens
aaatttagtttgttaaa

SEQ ID NO: 4413210 - DNA, 10 bp, Homo sapiens
aaatttataa

SEQ ID NO: 4413211 - DNA, 15 bp, Homo sapiens
aaatttatgtgatgg

SEQ ID NO: 4413212 - DNA, 20 bp, Homo sapiens
aaatttattatatatttaca

SEQ ID NO: 4413213 - DNA, 13 bp, Homo sapiens
aaatttatttgca

SEQ ID NO: 4413214 - DNA, 17 bp, Homo sapiens
aaatttcacgattcatt

SEQ ID NO: 4413215 - DNA, 16 bp, Homo sapiens
aaatttcatttcacat

SEQ ID NO: 4413216 - DNA, 11 bp, Homo sapiens
aaatcctctgg

SEQ ID NO: 4413217 - DNA, 22 bp, Homo sapiens
aaatcctggaaggacacagtga

SEQ ID NO: 4413218 - DNA, 16 bp, Homo sapiens
aaatccttattgttca

SEQ ID NO: 4413219 - DNA, 13 bp, Homo sapiens
aaatcgaatgaaa

SEQ ID NO: 4413220 - DNA, 21 bp, Homo sapiens
aaatcgctgctcaaaaatgat

SEQ ID NO: 4413221 - DNA, 21 bp, Homo sapiens
aaatcgtggcacgtattgctg

SEQ ID NO: 4413222 - DNA, 15 bp, Homo sapiens
aaatctaaaatgttt

SEQ ID NO: 4413223 - DNA, 14 bp, Homo sapiens
aaatctagaattta

SEQ ID NO: 4413224 - DNA, 19 bp, Homo sapiens
aaatctagaatttagtgat

SEQ ID NO: 4413225 - DNA, 20 bp, Homo sapiens
aaatctagacattcttttaa

SEQ ID NO: 4413226 - DNA, 14 bp, Homo sapiens
aaatctcaattgaa

SEQ ID NO: 4413227 - DNA, 12 bp, Homo sapiens
aaatctcattat

SEQ ID NO: 4413228 - DNA, 16 bp, Homo sapiens
aaatctccaatccaca

SEQ ID NO: 4413229 - DNA, 16 bp, Homo sapiens
aaatctgaacattctc

SEQ ID NO: 4413230 - DNA, 22 bp, Homo sapiens
aaatctgctggagtttcatgta

SEQ ID NO: 4413231 - DNA, 15 bp, Homo sapiens
aaatctgctgttaac

SEQ ID NO: 4413232 - DNA, 22 bp, Homo sapiens
aaatctggctgtccttccattt

SEQ ID NO: 4413233 - DNA, 18 bp, Homo sapiens
aaatctggggaagaggtt

SEQ ID NO: 4413234 - DNA, 19 bp, Homo sapiens
aaatctgggtatctttcca

SEQ ID NO: 4413235 - DNA, 20 bp, Homo sapiens
aaatcttagtatagtagaaa

SEQ ID NO: 4413236 - DNA, 23 bp, Homo sapiens
aaatcttagtatagtagaaagac

SEQ ID NO: 4413237 - DNA, 13 bp, Homo sapiens
aaatctttcaaaa

SEQ ID NO: 4413238 - DNA, 16 bp, Homo sapiens
aaatctttttgcttct

SEQ ID NO: 4413239 - DNA, 16 bp, Homo sapiens
aaatgaaaatgtcttg

SEQ ID NO: 4413240 - DNA, 11 bp, Homo sapiens
aaatgaaaatt

SEQ ID NO: 4413241 - DNA, 19 bp, Homo sapiens
aaatgaaaattacgttctt

SEQ ID NO: 4413242 - DNA, 12 bp, Homo sapiens
aaatgaaaattg

SEQ ID NO: 4413243 - DNA, 15 bp, Homo sapiens
aaatgaaacaacaaa

SEQ ID NO: 4413244 - DNA, 14 bp, Homo sapiens
aaatgaaagctact

SEQ ID NO: 4413245 - DNA, 18 bp, Homo sapiens
aaatgaaagtattggcat

SEQ ID NO: 4413246 - DNA, 18 bp, Homo sapiens
aaatgaacctgctactta

SEQ ID NO: 4413247 - DNA, 23 bp, Homo sapiens
aaatgaagctttggttctctgat

SEQ ID NO: 4413248 - DNA, 14 bp, Homo sapiens
aaatgaatattttg

SEQ ID NO: 4413249 - DNA, 16 bp, Homo sapiens
aaatgaatattttgat

SEQ ID NO: 4413250 - DNA, 14 bp, Homo sapiens
aaatgaatgattaa

SEQ ID NO: 4413251 - DNA, 18 bp, Homo sapiens
aaatgaatgattaaatta

SEQ ID NO: 4413252 - DNA, 15 bp, Homo sapiens
aaatgaatgattcta

SEQ ID NO: 4413253 - DNA, 20 bp, Homo sapiens
aaatgaatgattctacagct

SEQ ID NO: 4413254 - DNA, 18 bp, Homo sapiens
aaatgaatttcatgtgaa

SEQ ID NO: 4413255 - DNA, 19 bp, Homo sapiens
aaatgaatttcatgtgaat

SEQ ID NO: 4413256 - DNA, 16 bp, Homo sapiens
aaatgacagatttctg

SEQ ID NO: 4413257 - DNA, 16 bp, Homo sapiens
aaatgacatcttttta

SEQ ID NO: 4413258 - DNA, 17 bp, Homo sapiens
aaatgacatctttttaa

SEQ ID NO: 4413259 - DNA, 20 bp, Homo sapiens
aaatgacatctttttaaagc

SEQ ID NO: 4413260 - DNA, 17 bp, Homo sapiens
aaatgacatttcactaa

SEQ ID NO: 4413261 - DNA, 13 bp, Homo sapiens
aaatgacttattt

SEQ ID NO: 4413262 - DNA, 19 bp, Homo sapiens
aaatgagatttttgttttc

SEQ ID NO: 4413263 - DNA, 21 bp, Homo sapiens
aaatgaggtctgtttaaagtg

SEQ ID NO: 4413264 - DNA, 17 bp, Homo sapiens
aaatgagtcatttgttt

SEQ ID NO: 4413265 - DNA, 22 bp, Homo sapiens
aaatgagtttttatggggctga

SEQ ID NO: 4413266 - DNA, 19 bp, Homo sapiens
aaatgatgatgtggaagaa

SEQ ID NO: 4413267 - DNA, 19 bp, Homo sapiens
aaatgattatattcacaga

SEQ ID NO: 4413268 - DNA, 18 bp, Homo sapiens
aaatgattcaaattgctg

SEQ ID NO: 4413269 - DNA, 11 bp, Homo sapiens
aaatgatttca

SEQ ID NO: 4413270 - DNA, 21 bp, Homo sapiens
aaatgcaaatttctataaatt

SEQ ID NO: 4413271 - DNA, 11 bp, Homo sapiens
aaatgcaataa

SEQ ID NO: 4413272 - DNA, 11 bp, Homo sapiens
aaatgcaatat

SEQ ID NO: 4413273 - DNA, 22 bp, Homo sapiens
aaatgcagggaggggaggcaga

SEQ ID NO: 4413274 - DNA, 16 bp, Homo sapiens
aaatgcatccattcct

SEQ ID NO: 4413275 - DNA, 21 bp, Homo sapiens
aaatgccaaaggaagttttaa

SEQ ID NO: 4413276 - DNA, 15 bp, Homo sapiens
aaatgcccagttcac

SEQ ID NO: 4413277 - DNA, 15 bp, Homo sapiens
aaatgcccatttcga

SEQ ID NO: 4413278 - DNA, 17 bp, Homo sapiens
aaatgctcaatttcagc

SEQ ID NO: 4413279 - DNA, 22 bp, Homo sapiens
aaatgctcctagaagtcttaat

SEQ ID NO: 4413280 - DNA, 23 bp, Homo sapiens
aaatgctcctagaagtcttaatt

SEQ ID NO: 4413281 - DNA, 18 bp, Homo sapiens
aaatgctgtatttttaca

SEQ ID NO: 4413282 - DNA, 19 bp, Homo sapiens
aaatgcttaaaaaataata

SEQ ID NO: 4413283 - DNA, 19 bp, Homo sapiens
aaatgcttagaaattcagc

SEQ ID NO: 4413284 - DNA, 15 bp, Homo sapiens
aaatgcttcattgaa

SEQ ID NO: 4413285 - DNA, 23 bp, Homo sapiens
aaatgcttcatttgtatgtcaaa

SEQ ID NO: 4413286 - DNA, 24 bp, Homo sapiens
aaatgcttgggaccagaagtgttt

SEQ ID NO: 4413287 - DNA, 18 bp, Homo sapiens
aaatgctttatgcaaacc

SEQ ID NO: 4413288 - DNA, 14 bp, Homo sapiens
aaatggaataacat

SEQ ID NO: 4413289 - DNA, 19 bp, Homo sapiens
aaatggactggtttgagat

SEQ ID NO: 4413290 - DNA, 17 bp, Homo sapiens
aaatggatgccttgaat

SEQ ID NO: 4413291 - DNA, 21 bp, Homo sapiens
aaatggatgccttgaataata

SEQ ID NO: 4413292 - DNA, 22 bp, Homo sapiens
aaatggatgccttgaataataa

SEQ ID NO: 4413293 - DNA, 20 bp, Homo sapiens
aaatggcaaaaccagtagct

SEQ ID NO: 4413294 - DNA, 19 bp, Homo sapiens
aaatggctgtaatcatttg

SEQ ID NO: 4413295 - DNA, 21 bp, Homo sapiens
aaatggcttcggacaaaatat

SEQ ID NO: 4413296 - DNA, 23 bp, Homo sapiens
aaatggcttcggacaaaatatct

SEQ ID NO: 4413297 - DNA, 16 bp, Homo sapiens
aaatgggaaaaaactt

SEQ ID NO: 4413298 - DNA, 17 bp, Homo sapiens
aaatgggagacagcctc

SEQ ID NO: 4413299 - DNA, 23 bp, Homo sapiens
aaatgggcattttacaagaagta

SEQ ID NO: 4413300 - DNA, 17 bp, Homo sapiens
aaatggtatcaaaatta

SEQ ID NO: 4413301 - DNA, 16 bp, Homo sapiens
aaatggttatgtgcat

SEQ ID NO: 4413302 - DNA, 19 bp, Homo sapiens
aaatgtaaaaatgaaggaa

SEQ ID NO: 4413303 - DNA, 13 bp, Homo sapiens
aaatgtaaggcaa

SEQ ID NO: 4413304 - DNA, 11 bp, Homo sapiens
aaatgtacact

SEQ ID NO: 4413305 - DNA, 17 bp, Homo sapiens
aaatgtacagacatatt

SEQ ID NO: 4413306 - DNA, 19 bp, Homo sapiens
aaatgtagcttcagtcatt

SEQ ID NO: 4413307 - DNA, 21 bp, Homo sapiens
aaatgtagcttcagtcattaa

SEQ ID NO: 4413308 - DNA, 22 bp, Homo sapiens
aaatgtagcttcagtcattaaa

SEQ ID NO: 4413309 - DNA, 19 bp, Homo sapiens
aaatgtaggatcaaaaggc

SEQ ID NO: 4413310 - DNA, 17 bp, Homo sapiens
aaatgtagttttgtata

SEQ ID NO: 4413311 - DNA, 14 bp, Homo sapiens
aaatgtatatgcac

SEQ ID NO: 4413312 - DNA, 15 bp, Homo sapiens
aaatgtatatgcact

SEQ ID NO: 4413313 - DNA, 16 bp, Homo sapiens
aaatgtatctgcatat

SEQ ID NO: 4413314 - DNA, 13 bp, Homo sapiens
aaatgtatgcatt

SEQ ID NO: 4413315 - DNA, 23 bp, Homo sapiens
aaatgtattatgtcctgtgagat

SEQ ID NO: 4413316 - DNA, 16 bp, Homo sapiens
aaatgtattgattcaa

SEQ ID NO: 4413317 - DNA, 14 bp, Homo sapiens
aaatgtatttttct

SEQ ID NO: 4413318 - DNA, 17 bp, Homo sapiens
aaatgtcctttctcaga

SEQ ID NO: 4413319 - DNA, 12 bp, Homo sapiens
aaatgtcttgct

SEQ ID NO: 4413320 - DNA, 21 bp, Homo sapiens
aaatgtctttccaaattattt

SEQ ID NO: 4413321 - DNA, 16 bp, Homo sapiens
aaatgtgaaaaactaa

SEQ ID NO: 4413322 - DNA, 21 bp, Homo sapiens
aaatgtgactggttcagaaat

SEQ ID NO: 4413323 - DNA, 15 bp, Homo sapiens
aaatgtgaggcaata

SEQ ID NO: 4413324 - DNA, 15 bp, Homo sapiens
aaatgtgcattttgt

SEQ ID NO: 4413325 - DNA, 22 bp, Homo sapiens
aaatgtgctcaaattactaatg

SEQ ID NO: 4413326 - DNA, 15 bp, Homo sapiens
aaatgtgcttttaaa

SEQ ID NO: 4413327 - DNA, 14 bp, Homo sapiens
aaatgtggccaagc

SEQ ID NO: 4413328 - DNA, 18 bp, Homo sapiens
aaatgtgttttgtctttt

SEQ ID NO: 4413329 - DNA, 23 bp, Homo sapiens
aaatgttaacaatgcctattgta

SEQ ID NO: 4413330 - DNA, 17 bp, Homo sapiens
aaatgttagatattgct

SEQ ID NO: 4413331 - DNA, 21 bp, Homo sapiens
aaatgttatcttatactgtac

SEQ ID NO: 4413332 - DNA, 16 bp, Homo sapiens
aaatgttattatctgg

SEQ ID NO: 4413333 - DNA, 15 bp, Homo sapiens
aaatgttcaaactgt

SEQ ID NO: 4413334 - DNA, 13 bp, Homo sapiens
aaatgttcacttt

SEQ ID NO: 4413335 - DNA, 16 bp, Homo sapiens
aaatgttcacttttga

SEQ ID NO: 4413336 - DNA, 18 bp, Homo sapiens
aaatacatgctaagagaa

SEQ ID NO: 4413337 - DNA, 22 bp, Homo sapiens
aaataccagagccttcaagtgc

SEQ ID NO: 4413338 - DNA, 11 bp, Homo sapiens
aaatacctcaa

SEQ ID NO: 4413339 - DNA, 18 bp, Homo sapiens
aaatacctcaatttttgt

SEQ ID NO: 4413340 - DNA, 21 bp, Homo sapiens
aaatacctcaggaaagaatag

SEQ ID NO: 4413341 - DNA, 15 bp, Homo sapiens
aaataccttttctca

SEQ ID NO: 4413342 - DNA, 17 bp, Homo sapiens
aaatactacaatagttt

SEQ ID NO: 4413343 - DNA, 19 bp, Homo sapiens
aaatactgtcaaacaataa

SEQ ID NO: 4413344 - DNA, 14 bp, Homo sapiens
aaatactgtgaaat

SEQ ID NO: 4413345 - DNA, 16 bp, Homo sapiens
aaatactgtgaaatac

SEQ ID NO: 4413346 - DNA, 18 bp, Homo sapiens
aaatagaaaacaggaaaa

SEQ ID NO: 4413347 - DNA, 16 bp, Homo sapiens
aaatagaaccactatg

SEQ ID NO: 4413348 - DNA, 18 bp, Homo sapiens
aaatagacaaaaagtata

SEQ ID NO: 4413349 - DNA, 16 bp, Homo sapiens
aaatagagataaaaat

SEQ ID NO: 4413350 - DNA, 19 bp, Homo sapiens
aaatagataaccaattttc

SEQ ID NO: 4413351 - DNA, 15 bp, Homo sapiens
aaatagattttttca

SEQ ID NO: 4413352 - DNA, 17 bp, Homo sapiens
aaatagcaaaagaagaa

SEQ ID NO: 4413353 - DNA, 13 bp, Homo sapiens
aaatagcaataac

SEQ ID NO: 4413354 - DNA, 18 bp, Homo sapiens
aaatagcaataactgaaa

SEQ ID NO: 4413355 - DNA, 18 bp, Homo sapiens
aaatagcggccctggagg

SEQ ID NO: 4413356 - DNA, 18 bp, Homo sapiens
aaataggagggaaacctt

SEQ ID NO: 4413357 - DNA, 19 bp, Homo sapiens
aaataggattttgaaccca

SEQ ID NO: 4413358 - DNA, 14 bp, Homo sapiens
aaataggcttttta

SEQ ID NO: 4413359 - DNA, 17 bp, Homo sapiens
aaatagggaatatgata

SEQ ID NO: 4413360 - DNA, 16 bp, Homo sapiens
aaatagtgtaagaact

SEQ ID NO: 4413361 - DNA, 21 bp, Homo sapiens
aaatagtgtaagaactgtaca

SEQ ID NO: 4413362 - DNA, 22 bp, Homo sapiens
aaatagtgtaagaactgtacat

SEQ ID NO: 4413363 - DNA, 18 bp, Homo sapiens
aaatagtgtgaaatatat

SEQ ID NO: 4413364 - DNA, 22 bp, Homo sapiens
aaatagttgcatagcagtatat

SEQ ID NO: 4413365 - DNA, 16 bp, Homo sapiens
aaatataaattgtaca

SEQ ID NO: 4413366 - DNA, 19 bp, Homo sapiens
aaatataaattgtacattt

SEQ ID NO: 4413367 - DNA, 20 bp, Homo sapiens
aaatataagtctatactaat

SEQ ID NO: 4413368 - DNA, 15 bp, Homo sapiens
aaatatacaaaactt

SEQ ID NO: 4413369 - DNA, 15 bp, Homo sapiens
aaatatacagtttga

SEQ ID NO: 4413370 - DNA, 16 bp, Homo sapiens
aaatataccactcttt

SEQ ID NO: 4413371 - DNA, 20 bp, Homo sapiens
aaatatacttgactctaata

SEQ ID NO: 4413372 - DNA, 12 bp, Homo sapiens
aaatatataata

SEQ ID NO: 4413373 - DNA, 14 bp, Homo sapiens
aaatatataatatt

SEQ ID NO: 4413374 - DNA, 16 bp, Homo sapiens
aaatatatactaaaca

SEQ ID NO: 4413375 - DNA, 17 bp, Homo sapiens
aaatatatagcttgaaa

SEQ ID NO: 4413376 - DNA, 18 bp, Homo sapiens
aaatatatattatatatt

SEQ ID NO: 4413377 - DNA, 13 bp, Homo sapiens
aaatatatattgt

SEQ ID NO: 4413378 - DNA, 15 bp, Homo sapiens
aaatatatattgtaa

SEQ ID NO: 4413379 - DNA, 15 bp, Homo sapiens
aaatatatattttgt

SEQ ID NO: 4413380 - DNA, 11 bp, Homo sapiens
aaatatatgta

SEQ ID NO: 4413381 - DNA, 16 bp, Homo sapiens
aaatatatgtatgtaa

SEQ ID NO: 4413382 - DNA, 19 bp, Homo sapiens
aaatatatgtatgtaaaaa

SEQ ID NO: 4413383 - DNA, 14 bp, Homo sapiens
aaatatatgtattt

SEQ ID NO: 4413384 - DNA, 19 bp, Homo sapiens
aaatatcaatattttctgc

SEQ ID NO: 4413385 - DNA, 12 bp, Homo sapiens
aaatatcatgtt

SEQ ID NO: 4413386 - DNA, 22 bp, Homo sapiens
aaatatcccttggacattttat

SEQ ID NO: 4413387 - DNA, 23 bp, Homo sapiens
aaatatcccttggacattttatg

SEQ ID NO: 4413388 - DNA, 16 bp, Homo sapiens
aaatatctatttgaat

SEQ ID NO: 4413389 - DNA, 22 bp, Homo sapiens
aaatatctatttgaataaatta

SEQ ID NO: 4413390 - DNA, 14 bp, Homo sapiens
aaatatctgttatt

SEQ ID NO: 4413391 - DNA, 18 bp, Homo sapiens
aaatatgaaccctttgtt

SEQ ID NO: 4413392 - DNA, 17 bp, Homo sapiens
aaatatgaagaactgag

SEQ ID NO: 4413393 - DNA, 15 bp, Homo sapiens
aaatatgatgttaaa

SEQ ID NO: 4413394 - DNA, 13 bp, Homo sapiens
aaatatgcaaagc

SEQ ID NO: 4413395 - DNA, 17 bp, Homo sapiens
aaatatgcaaagcactg

SEQ ID NO: 4413396 - DNA, 15 bp, Homo sapiens
aaatatggacactta

SEQ ID NO: 4413397 - DNA, 15 bp, Homo sapiens
aaatatgtcagatgt

SEQ ID NO: 4413398 - DNA, 17 bp, Homo sapiens
aaatattaaaatttatt

SEQ ID NO: 4413399 - DNA, 16 bp, Homo sapiens
aaatattaacattctt

SEQ ID NO: 4413400 - DNA, 19 bp, Homo sapiens
aaatattaagaacatttta

SEQ ID NO: 4413401 - DNA, 12 bp, Homo sapiens
aaatattaagac

SEQ ID NO: 4413402 - DNA, 19 bp, Homo sapiens
aaatattataatgtgccca

SEQ ID NO: 4413403 - DNA, 21 bp, Homo sapiens
aaatattataatgtgcccaaa

SEQ ID NO: 4413404 - DNA, 13 bp, Homo sapiens
aaatattattgaa

SEQ ID NO: 4413405 - DNA, 16 bp, Homo sapiens
aaatattcacatcttc

SEQ ID NO: 4413406 - DNA, 18 bp, Homo sapiens
aaatattccctagaaact

SEQ ID NO: 4413407 - DNA, 16 bp, Homo sapiens
aaatattctgaatcac

SEQ ID NO: 4413408 - DNA, 18 bp, Homo sapiens
aaatattctgaatcacca

SEQ ID NO: 4413409 - DNA, 19 bp, Homo sapiens
aaatattgaaatgctgtat

SEQ ID NO: 4413410 - DNA, 16 bp, Homo sapiens
aaatattgaagttgtt

SEQ ID NO: 4413411 - DNA, 19 bp, Homo sapiens
aaatattgaagttgtttat

SEQ ID NO: 4413412 - DNA, 22 bp, Homo sapiens
aaatattgctaaaagcatgtat

SEQ ID NO: 4413413 - DNA, 21 bp, Homo sapiens
aaatattgcttcaatttcaaa

SEQ ID NO: 4413414 - DNA, 14 bp, Homo sapiens
aaatattgtcatct

SEQ ID NO: 4413415 - DNA, 15 bp, Homo sapiens
aaatattgtttctgc

SEQ ID NO: 4413416 - DNA, 22 bp, Homo sapiens
aaatattgttttacaatagttc

SEQ ID NO: 4413417 - DNA, 21 bp, Homo sapiens
aaatatttaagtgaaggagaa

SEQ ID NO: 4413418 - DNA, 13 bp, Homo sapiens
aaatatttcttaa

SEQ ID NO: 4413419 - DNA, 19 bp, Homo sapiens
aaatattttaaaatcagct

SEQ ID NO: 4413420 - DNA, 16 bp, Homo sapiens
aaatattttaaagaat

SEQ ID NO: 4413421 - DNA, 17 bp, Homo sapiens
aaatattttaaagaatt

SEQ ID NO: 4413422 - DNA, 17 bp, Homo sapiens
aaatattttctatttta

SEQ ID NO: 4413423 - DNA, 21 bp, Homo sapiens
aaatattttctctgtactttt

SEQ ID NO: 4413424 - DNA, 21 bp, Homo sapiens
aaatattttgaatcaataata

SEQ ID NO: 4413425 - DNA, 15 bp, Homo sapiens
aaatcaaaagaatct

SEQ ID NO: 4413426 - DNA, 13 bp, Homo sapiens
aaatcaaactgct

SEQ ID NO: 4413427 - DNA, 14 bp, Homo sapiens
aaatcaaatatgca

SEQ ID NO: 4413428 - DNA, 15 bp, Homo sapiens
aaatcaaatatgcaa

SEQ ID NO: 4413429 - DNA, 18 bp, Homo sapiens
aaatcaaatatgcaaagc

SEQ ID NO: 4413430 - DNA, 15 bp, Homo sapiens
aaatcaaatgaatga

SEQ ID NO: 4413431 - DNA, 22 bp, Homo sapiens
aaatcaactttttattgccttc

SEQ ID NO: 4413432 - DNA, 12 bp, Homo sapiens
aaatcaaggaaa

SEQ ID NO: 4413433 - DNA, 13 bp, Homo sapiens
aaatcaaggaaag

SEQ ID NO: 4413434 - DNA, 23 bp, Homo sapiens
aaatcaaggaaaggctcatttaa

SEQ ID NO: 4413435 - DNA, 18 bp, Homo sapiens
aaatcaagtatttgggaa

SEQ ID NO: 4413436 - DNA, 15 bp, Homo sapiens
aaatcaatacactag

SEQ ID NO: 4413437 - DNA, 17 bp, Homo sapiens
aaatcaatacactagtt

SEQ ID NO: 4413438 - DNA, 14 bp, Homo sapiens
aaatcactttcata

SEQ ID NO: 4413439 - DNA, 18 bp, Homo sapiens
aaatcagaagtcatcttg

SEQ ID NO: 4413440 - DNA, 18 bp, Homo sapiens
aaatcagctattttgtga

SEQ ID NO: 4413441 - DNA, 19 bp, Homo sapiens
aaatcagctattttgtgaa

SEQ ID NO: 4413442 - DNA, 22 bp, Homo sapiens
aaatcaggcttttgtttccttt

SEQ ID NO: 4413443 - DNA, 23 bp, Homo sapiens
aaatcaggcttttgtttcctttt

SEQ ID NO: 4413444 - DNA, 16 bp, Homo sapiens
aaatcagtagaaagct

SEQ ID NO: 4413445 - DNA, 23 bp, Homo sapiens
aaatcataataaagtttccatta

SEQ ID NO: 4413446 - DNA, 18 bp, Homo sapiens
aaatcatgccagtatttt

SEQ ID NO: 4413447 - DNA, 16 bp, Homo sapiens
aaatcattttaacttc

SEQ ID NO: 4413448 - DNA, 18 bp, Homo sapiens
aaatccaagatgctggca

SEQ ID NO: 4413449 - DNA, 16 bp, Homo sapiens
aaatccaaggaaacat

SEQ ID NO: 4413450 - DNA, 13 bp, Homo sapiens
aaatccaataaaa

SEQ ID NO: 4413451 - DNA, 17 bp, Homo sapiens
aaatccagactttcttt

SEQ ID NO: 4413452 - DNA, 20 bp, Homo sapiens
aaatccaggctttatgtaca

SEQ ID NO: 4413453 - DNA, 16 bp, Homo sapiens
aaatcccaccttccca

SEQ ID NO: 4413454 - DNA, 17 bp, Homo sapiens
aaatccctgcctcaggc

SEQ ID NO: 4413455 - DNA, 20 bp, Homo sapiens
aaatccggtcagccaagtgc

SEQ ID NO: 4413456 - DNA, 15 bp, Homo sapiens
aaatcctcaggaaat

SEQ ID NO: 4413457 - DNA, 22 bp, Homo sapiens
agcgccaggaagccagagcccc

SEQ ID NO: 4413458 - DNA, 22 bp, Homo sapiens
agcgccctcactattcttggac

SEQ ID NO: 4413459 - DNA, 22 bp, Homo sapiens
agcgcctagtggggtctccctc

SEQ ID NO: 4413460 - DNA, 15 bp, Homo sapiens
agcgcctccctccac

SEQ ID NO: 4413461 - DNA, 19 bp, Homo sapiens
agcgcctccctccacccca

SEQ ID NO: 4413462 - DNA, 21 bp, Homo sapiens
agcgcctgcgttcccagacca

SEQ ID NO: 4413463 - DNA, 23 bp, Homo sapiens
agcgcggacccttctgggtccag

SEQ ID NO: 4413464 - DNA, 19 bp, Homo sapiens
agcgctttgggaggcggag

SEQ ID NO: 4413465 - DNA, 17 bp, Homo sapiens
agcggaacatgtgcttc

SEQ ID NO: 4413466 - DNA, 13 bp, Homo sapiens
agcggagcccagc

SEQ ID NO: 4413467 - DNA, 17 bp, Homo sapiens
agcggagcccagcctgg

SEQ ID NO: 4413468 - DNA, 23 bp, Homo sapiens
agcggagcccgatattctccctg

SEQ ID NO: 4413469 - DNA, 22 bp, Homo sapiens
agcggaggttgcagtgagctga

SEQ ID NO: 4413470 - DNA, 20 bp, Homo sapiens
agcggccccccgcacagcca

SEQ ID NO: 4413471 - DNA, 23 bp, Homo sapiens
agcggccccccgcacagccaccc

SEQ ID NO: 4413472 - DNA, 14 bp, Homo sapiens
agcggctcccctct

SEQ ID NO: 4413473 - DNA, 17 bp, Homo sapiens
agcggctcccctctgct

SEQ ID NO: 4413474 - DNA, 14 bp, Homo sapiens
agcgggagcccgtg

SEQ ID NO: 4413475 - DNA, 11 bp, Homo sapiens
agcgggcagcc

SEQ ID NO: 4413476 - DNA, 14 bp, Homo sapiens
agcgggcagccccg

SEQ ID NO: 4413477 - DNA, 13 bp, Homo sapiens
agcggggctgctc

SEQ ID NO: 4413478 - DNA, 16 bp, Homo sapiens
agcgggtgcaagcact

SEQ ID NO: 4413479 - DNA, 13 bp, Homo sapiens
agcgtccctggcg

SEQ ID NO: 4413480 - DNA, 19 bp, Homo sapiens
agcgtcctcctctgtgacc

SEQ ID NO: 4413481 - DNA, 20 bp, Homo sapiens
agcgtctgggaacttgcgag

SEQ ID NO: 4413482 - DNA, 13 bp, Homo sapiens
agcgtgcgcactg

SEQ ID NO: 4413483 - DNA, 15 bp, Homo sapiens
agcgtgttctcagca

SEQ ID NO: 4413484 - DNA, 13 bp, Homo sapiens
agcgttctggact

SEQ ID NO: 4413485 - DNA, 18 bp, Homo sapiens
agcgttctggactctgcc

SEQ ID NO: 4413486 - DNA, 21 bp, Homo sapiens
agcgttctggactctgcccca

SEQ ID NO: 4413487 - DNA, 11 bp, Homo sapiens
agcgtttttta

SEQ ID NO: 4413488 - DNA, 20 bp, Homo sapiens
agcgttttttaaatgtatac

SEQ ID NO: 4413489 - DNA, 14 bp, Homo sapiens
agctaaaaatatta

SEQ ID NO: 4413490 - DNA, 16 bp, Homo sapiens
agctaaaaatattact

SEQ ID NO: 4413491 - DNA, 14 bp, Homo sapiens
agctaaaaatgaac

SEQ ID NO: 4413492 - DNA, 15 bp, Homo sapiens
agctaaccttatcct

SEQ ID NO: 4413493 - DNA, 21 bp, Homo sapiens
agctaattctactcacagtgc

SEQ ID NO: 4413494 - DNA, 13 bp, Homo sapiens
agctaatttactg

SEQ ID NO: 4413495 - DNA, 14 bp, Homo sapiens
agctaatttttgta

SEQ ID NO: 4413496 - DNA, 17 bp, Homo sapiens
agctaatttttgtattt

SEQ ID NO: 4413497 - DNA, 15 bp, Homo sapiens
agctacaaactttta

SEQ ID NO: 4413498 - DNA, 19 bp, Homo sapiens
agctacaatattctctctt

SEQ ID NO: 4413499 - DNA, 19 bp, Homo sapiens
agctacaatttgtttttgc

SEQ ID NO: 4413500 - DNA, 14 bp, Homo sapiens
agctacactgagca

SEQ ID NO: 4413501 - DNA, 15 bp, Homo sapiens
agctacactgagcag

SEQ ID NO: 4413502 - DNA, 22 bp, Homo sapiens
agctacaggaagcaccccatgc

SEQ ID NO: 4413503 - DNA, 15 bp, Homo sapiens
agctacataatttag

SEQ ID NO: 4413504 - DNA, 16 bp, Homo sapiens
agctacctcaaacttc

SEQ ID NO: 4413505 - DNA, 22 bp, Homo sapiens
agctgaagatccccaactgctc

SEQ ID NO: 4413506 - DNA, 17 bp, Homo sapiens
agctgaatgttcttgaa

SEQ ID NO: 4413507 - DNA, 14 bp, Homo sapiens
agctgaattatatt

SEQ ID NO: 4413508 - DNA, 17 bp, Homo sapiens
agctgaccattgaacta

SEQ ID NO: 4413509 - DNA, 17 bp, Homo sapiens
agctgacccagagtgga

SEQ ID NO: 4413510 - DNA, 23 bp, Homo sapiens
agctgactaaactttttttctgt

SEQ ID NO: 4413511 - DNA, 20 bp, Homo sapiens
agctgactggtttctcctgg

SEQ ID NO: 4413512 - DNA, 13 bp, Homo sapiens
agctgactgttct

SEQ ID NO: 4413513 - DNA, 18 bp, Homo sapiens
agctgagagccctgctgt

SEQ ID NO: 4413514 - DNA, 22 bp, Homo sapiens
agctgagagccctgctgtggga

SEQ ID NO: 4413515 - DNA, 21 bp, Homo sapiens
agctgagcacttagcaggcac

SEQ ID NO: 4413516 - DNA, 15 bp, Homo sapiens
agctgagcagcctct

SEQ ID NO: 4413517 - DNA, 13 bp, Homo sapiens
agctgagcttttg

SEQ ID NO: 4413518 - DNA, 15 bp, Homo sapiens
agctgaggcagcagt

SEQ ID NO: 4413519 - DNA, 20 bp, Homo sapiens
agctgatcgcttctccccca

SEQ ID NO: 4413520 - DNA, 23 bp, Homo sapiens
agctgatttaacttgtattttgt

SEQ ID NO: 4413521 - DNA, 16 bp, Homo sapiens
agctgcaaaaataatc

SEQ ID NO: 4413522 - DNA, 18 bp, Homo sapiens
agctgcaaaaataatcat

SEQ ID NO: 4413523 - DNA, 11 bp, Homo sapiens
agctgcaaagt

SEQ ID NO: 4413524 - DNA, 15 bp, Homo sapiens
agctgcaaagtgttt

SEQ ID NO: 4413525 - DNA, 20 bp, Homo sapiens
agctgcaaagtgttttgtac

SEQ ID NO: 4413526 - DNA, 19 bp, Homo sapiens
agctgcacagggcagctgg

SEQ ID NO: 4413527 - DNA, 20 bp, Homo sapiens
agctgcacagggcagctggg

SEQ ID NO: 4413528 - DNA, 22 bp, Homo sapiens
agctgcacagggcagctgggcc

SEQ ID NO: 4413529 - DNA, 24 bp, Homo sapiens
agctgcacagggcagctgggccca

SEQ ID NO: 4413530 - DNA, 14 bp, Homo sapiens
agctgcactgtgaa

SEQ ID NO: 4413531 - DNA, 17 bp, Homo sapiens
agctgcagctgagcctg

SEQ ID NO: 4413532 - DNA, 17 bp, Homo sapiens
agctgcatctgttactt

SEQ ID NO: 4413533 - DNA, 14 bp, Homo sapiens
agctgccaagagtg

SEQ ID NO: 4413534 - DNA, 23 bp, Homo sapiens
agctgccacctctccatcctgct

SEQ ID NO: 4413535 - DNA, 21 bp, Homo sapiens
agctgcccagccctggcccag

SEQ ID NO: 4413536 - DNA, 14 bp, Homo sapiens
agctgccccagcca

SEQ ID NO: 4413537 - DNA, 16 bp, Homo sapiens
agctgccccggcccct

SEQ ID NO: 4413538 - DNA, 19 bp, Homo sapiens
agctgcccttgcagggtgg

SEQ ID NO: 4413539 - DNA, 15 bp, Homo sapiens
agctgccctttctca

SEQ ID NO: 4413540 - DNA, 16 bp, Homo sapiens
agctgccctttctcag

SEQ ID NO: 4413541 - DNA, 15 bp, Homo sapiens
agctgcctctgctcc

SEQ ID NO: 4413542 - DNA, 20 bp, Homo sapiens
agctgcctctgctccctctg

SEQ ID NO: 4413543 - DNA, 15 bp, Homo sapiens
agctgcctggtatat

SEQ ID NO: 4413544 - DNA, 17 bp, Homo sapiens
agctgccttagcttcag

SEQ ID NO: 4413545 - DNA, 10 bp, Homo sapiens
agctgccttc

SEQ ID NO: 4413546 - DNA, 13 bp, Homo sapiens
agctgcggccagg

SEQ ID NO: 4413547 - DNA, 18 bp, Homo sapiens
agctgcggccaggcctgc

SEQ ID NO: 4413548 - DNA, 21 bp, Homo sapiens
agctgcggccaggcctgcggg

SEQ ID NO: 4413549 - DNA, 15 bp, Homo sapiens
agctgctaaatctcc

SEQ ID NO: 4413550 - DNA, 22 bp, Homo sapiens
agctgctccgaggacccaggaa

SEQ ID NO: 4413551 - DNA, 16 bp, Homo sapiens
agctgctgaaacaaca

SEQ ID NO: 4413552 - DNA, 21 bp, Homo sapiens
agctgctgagatcctggactg

SEQ ID NO: 4413553 - DNA, 14 bp, Homo sapiens
agctgctggatgac

SEQ ID NO: 4413554 - DNA, 20 bp, Homo sapiens
agctgctgttctcaggacag

SEQ ID NO: 4413555 - DNA, 23 bp, Homo sapiens
agctgctttgacaaaatgactgg

SEQ ID NO: 4413556 - DNA, 16 bp, Homo sapiens
agctggaatgtgccac

SEQ ID NO: 4413557 - DNA, 17 bp, Homo sapiens
agctggaatgtgccaca

SEQ ID NO: 4413558 - DNA, 21 bp, Homo sapiens
agctggagcccagcgtcagaa

SEQ ID NO: 4413559 - DNA, 24 bp, Homo sapiens
agctggagcccagcgtcagaagtc

SEQ ID NO: 4413560 - DNA, 14 bp, Homo sapiens
agctggagccccca

SEQ ID NO: 4413561 - DNA, 15 bp, Homo sapiens
agctggagcccccag

SEQ ID NO: 4413562 - DNA, 23 bp, Homo sapiens
agctggagcccccagcagaggca

SEQ ID NO: 4413563 - DNA, 21 bp, Homo sapiens
agctggaggaatacattttat

SEQ ID NO: 4413564 - DNA, 13 bp, Homo sapiens
agctggaggacta

SEQ ID NO: 4413565 - DNA, 14 bp, Homo sapiens
agctggatgagaat

SEQ ID NO: 4413566 - DNA, 21 bp, Homo sapiens
agctggccgagggtcctggct

SEQ ID NO: 4413567 - DNA, 23 bp, Homo sapiens
agctggccgagggtcctggctcc

SEQ ID NO: 4413568 - DNA, 22 bp, Homo sapiens
agctggccgcgccaaataatgt

SEQ ID NO: 4413569 - DNA, 13 bp, Homo sapiens
agctggcctggtt

SEQ ID NO: 4413570 - DNA, 18 bp, Homo sapiens
agctggcctggtttcctc

SEQ ID NO: 4413571 - DNA, 18 bp, Homo sapiens
agctggctctgtgagggt

SEQ ID NO: 4413572 - DNA, 20 bp, Homo sapiens
agctggctctgtgagggtgc

SEQ ID NO: 4413573 - DNA, 21 bp, Homo sapiens
agctggctttgaaacctcagg

SEQ ID NO: 4413574 - DNA, 18 bp, Homo sapiens
agctgggactacaggtgc

SEQ ID NO: 4413575 - DNA, 14 bp, Homo sapiens
agctgggaggaaaa

SEQ ID NO: 4413576 - DNA, 15 bp, Homo sapiens
agctgggaggaaaag

SEQ ID NO: 4413577 - DNA, 16 bp, Homo sapiens
agctgggccagccgcc

SEQ ID NO: 4413578 - DNA, 12 bp, Homo sapiens
agctgggcccaa

SEQ ID NO: 4413579 - DNA, 16 bp, Homo sapiens
agctgggccccagccc

SEQ ID NO: 4413580 - DNA, 13 bp, Homo sapiens
agctgggccctgc

SEQ ID NO: 4413581 - DNA, 15 bp, Homo sapiens
agctggggatgtctc

SEQ ID NO: 4413582 - DNA, 15 bp, Homo sapiens
agctggggccagagg

SEQ ID NO: 4413583 - DNA, 15 bp, Homo sapiens
agctggtgggaagcg

SEQ ID NO: 4413584 - DNA, 15 bp, Homo sapiens
agctgtaatttcgcc

SEQ ID NO: 4413585 - DNA, 21 bp, Homo sapiens
agctgtaatttcgccttaaac

SEQ ID NO: 4413586 - DNA, 13 bp, Homo sapiens
agctgtacaaatc

SEQ ID NO: 4413587 - DNA, 19 bp, Homo sapiens
agctgtagttttccctgca

SEQ ID NO: 4413588 - DNA, 21 bp, Homo sapiens
agctgtataattaattgtcat

SEQ ID NO: 4413589 - DNA, 18 bp, Homo sapiens
agctgtcacctctcagct

SEQ ID NO: 4413590 - DNA, 20 bp, Homo sapiens
agctgtccctgtcaccaagc

SEQ ID NO: 4413591 - DNA, 13 bp, Homo sapiens
agctgtctactgg

SEQ ID NO: 4413592 - DNA, 14 bp, Homo sapiens
agctgtgacccaga

SEQ ID NO: 4413593 - DNA, 16 bp, Homo sapiens
agctgtgacccagagg

SEQ ID NO: 4413594 - DNA, 19 bp, Homo sapiens
agctgtgcaggtggggaga

SEQ ID NO: 4413595 - DNA, 21 bp, Homo sapiens
agctgtgtccttgcacctgca

SEQ ID NO: 4413596 - DNA, 21 bp, Homo sapiens
agctgtgtgaatacctgctca

SEQ ID NO: 4413597 - DNA, 16 bp, Homo sapiens
agctgttcctgttcag

SEQ ID NO: 4413598 - DNA, 18 bp, Homo sapiens
agctgttcctgttcagta

SEQ ID NO: 4413599 - DNA, 19 bp, Homo sapiens
agctgttcctgttcagtaa

SEQ ID NO: 4413600 - DNA, 17 bp, Homo sapiens
agctgttcttgaaagcc

SEQ ID NO: 4413601 - DNA, 13 bp, Homo sapiens
agctgttggtgtt

SEQ ID NO: 4413602 - DNA, 12 bp, Homo sapiens
agctgtttatgt

SEQ ID NO: 4413603 - DNA, 18 bp, Homo sapiens
agctgtttatgtttttat

SEQ ID NO: 4413604 - DNA, 13 bp, Homo sapiens
agctgtttggaaa

SEQ ID NO: 4413605 - DNA, 12 bp, Homo sapiens
agcttaaaacac

SEQ ID NO: 4413606 - DNA, 13 bp, Homo sapiens
agcttaaaacttt

SEQ ID NO: 4413607 - DNA, 14 bp, Homo sapiens
agcttaaaactttg

SEQ ID NO: 4413608 - DNA, 22 bp, Homo sapiens
agcttaaacccatacaatgtat

SEQ ID NO: 4413609 - DNA, 15 bp, Homo sapiens
agcttaaagcttgat

SEQ ID NO: 4413610 - DNA, 20 bp, Homo sapiens
agcttaacatttcatgtagt

SEQ ID NO: 4413611 - DNA, 20 bp, Homo sapiens
agcttaagtgtaaatgaagt

SEQ ID NO: 4413612 - DNA, 12 bp, Homo sapiens
agcttaatagct

SEQ ID NO: 4413613 - DNA, 14 bp, Homo sapiens
agcttaatatattc

SEQ ID NO: 4413614 - DNA, 22 bp, Homo sapiens
agcttaatggctgataatttta

SEQ ID NO: 4413615 - DNA, 18 bp, Homo sapiens
agcttaatttttaaaaac

SEQ ID NO: 4413616 - DNA, 13 bp, Homo sapiens
agcttagatttca

SEQ ID NO: 4413617 - DNA, 19 bp, Homo sapiens
agcttagctttagaaacag

SEQ ID NO: 4413618 - DNA, 16 bp, Homo sapiens
agcttatctgcccctc

SEQ ID NO: 4413619 - DNA, 19 bp, Homo sapiens
agcttatctgcccctcccc

SEQ ID NO: 4413620 - DNA, 20 bp, Homo sapiens
agcttattaaaactcatttt

SEQ ID NO: 4413621 - DNA, 16 bp, Homo sapiens
agcttattgtttttat

SEQ ID NO: 4413622 - DNA, 15 bp, Homo sapiens
agcttcaacttttct

SEQ ID NO: 4413623 - DNA, 23 bp, Homo sapiens
agccctggcaaatgcctgactca

SEQ ID NO: 4413624 - DNA, 22 bp, Homo sapiens
agccctggcatgtcaacagcgt

SEQ ID NO: 4413625 - DNA, 14 bp, Homo sapiens
agccctggccccca

SEQ ID NO: 4413626 - DNA, 18 bp, Homo sapiens
agccctggcccccacagc

SEQ ID NO: 4413627 - DNA, 12 bp, Homo sapiens
agccctggctcc

SEQ ID NO: 4413628 - DNA, 19 bp, Homo sapiens
agccctgggccccaccacc

SEQ ID NO: 4413629 - DNA, 21 bp, Homo sapiens
agccctgggccccaccaccta

SEQ ID NO: 4413630 - DNA, 14 bp, Homo sapiens
agccctggtctcag

SEQ ID NO: 4413631 - DNA, 13 bp, Homo sapiens
agcccttcccagg

SEQ ID NO: 4413632 - DNA, 17 bp, Homo sapiens
agcccttcccagggcac

SEQ ID NO: 4413633 - DNA, 15 bp, Homo sapiens
agcccttccctgagt

SEQ ID NO: 4413634 - DNA, 14 bp, Homo sapiens
agcccttgcactcc

SEQ ID NO: 4413635 - DNA, 23 bp, Homo sapiens
agcccttgcctccccatttccca

SEQ ID NO: 4413636 - DNA, 17 bp, Homo sapiens
agccgcatcttctccat

SEQ ID NO: 4413637 - DNA, 21 bp, Homo sapiens
agccgcatcttctccatctgg

SEQ ID NO: 4413638 - DNA, 18 bp, Homo sapiens
agccgccagtacttgtca

SEQ ID NO: 4413639 - DNA, 20 bp, Homo sapiens
agccgccattgccaccagga

SEQ ID NO: 4413640 - DNA, 21 bp, Homo sapiens
agccgccattgccaccaggag

SEQ ID NO: 4413641 - DNA, 22 bp, Homo sapiens
agccgccattgccaccaggaga

SEQ ID NO: 4413642 - DNA, 20 bp, Homo sapiens
agccgcggggaagctggctt

SEQ ID NO: 4413643 - DNA, 20 bp, Homo sapiens
agccggcaagcgagcacagt

SEQ ID NO: 4413644 - DNA, 18 bp, Homo sapiens
agccggccgtggaaggag

SEQ ID NO: 4413645 - DNA, 14 bp, Homo sapiens
agccgggcatggtg

SEQ ID NO: 4413646 - DNA, 14 bp, Homo sapiens
agccgggcccctgg

SEQ ID NO: 4413647 - DNA, 17 bp, Homo sapiens
agccgggcccctgggct

SEQ ID NO: 4413648 - DNA, 16 bp, Homo sapiens
agccgggtctgcctct

SEQ ID NO: 4413649 - DNA, 21 bp, Homo sapiens
agccgggtctgcctcttctgg

SEQ ID NO: 4413650 - DNA, 13 bp, Homo sapiens
agccggtggtgcc

SEQ ID NO: 4413651 - DNA, 15 bp, Homo sapiens
agccggtggtgcccg

SEQ ID NO: 4413652 - DNA, 18 bp, Homo sapiens
agccgtattttacatgaa

SEQ ID NO: 4413653 - DNA, 22 bp, Homo sapiens
agccgtcccgcgttcaagactt

SEQ ID NO: 4413654 - DNA, 12 bp, Homo sapiens
agccgtcctggc

SEQ ID NO: 4413655 - DNA, 20 bp, Homo sapiens
agccgtttgaatatatttta

SEQ ID NO: 4413656 - DNA, 19 bp, Homo sapiens
agcctaaatttgtgctttt

SEQ ID NO: 4413657 - DNA, 19 bp, Homo sapiens
agcctaatgagagtgcact

SEQ ID NO: 4413658 - DNA, 23 bp, Homo sapiens
agcctactgtactatttaaaatg

SEQ ID NO: 4413659 - DNA, 19 bp, Homo sapiens
agcctagatatgaatatat

SEQ ID NO: 4413660 - DNA, 20 bp, Homo sapiens
agcctagtgaaggcttctct

SEQ ID NO: 4413661 - DNA, 23 bp, Homo sapiens
agcctagtgaaggcttctctctg

SEQ ID NO: 4413662 - DNA, 20 bp, Homo sapiens
agcctatatatatagtcaaa

SEQ ID NO: 4413663 - DNA, 15 bp, Homo sapiens
agcctcacagaagaa

SEQ ID NO: 4413664 - DNA, 18 bp, Homo sapiens
agcctcactattacttga

SEQ ID NO: 4413665 - DNA, 23 bp, Homo sapiens
agcctcagaaggccccagagaga

SEQ ID NO: 4413666 - DNA, 15 bp, Homo sapiens
agcctcatcatcaga

SEQ ID NO: 4413667 - DNA, 17 bp, Homo sapiens
agcctcatcatcagagc

SEQ ID NO: 4413668 - DNA, 17 bp, Homo sapiens
agcctcatccagcctca

SEQ ID NO: 4413669 - DNA, 22 bp, Homo sapiens
agcctcatgccaaccctgggct

SEQ ID NO: 4413670 - DNA, 22 bp, Homo sapiens
agcctccaagcacagagcctgg

SEQ ID NO: 4413671 - DNA, 15 bp, Homo sapiens
agcctccagcctctg

SEQ ID NO: 4413672 - DNA, 22 bp, Homo sapiens
agcctccagtccaaagccggct

SEQ ID NO: 4413673 - DNA, 23 bp, Homo sapiens
agcctccagtccaaagccggctt

SEQ ID NO: 4413674 - DNA, 11 bp, Homo sapiens
agcctcccaca

SEQ ID NO: 4413675 - DNA, 17 bp, Homo sapiens
agcctcccctgccaggg

SEQ ID NO: 4413676 - DNA, 11 bp, Homo sapiens
agcctccctga

SEQ ID NO: 4413677 - DNA, 16 bp, Homo sapiens
agcctcctcctgggct

SEQ ID NO: 4413678 - DNA, 11 bp, Homo sapiens
agcctcctctg

SEQ ID NO: 4413679 - DNA, 14 bp, Homo sapiens
agcctcctctggac

SEQ ID NO: 4413680 - DNA, 18 bp, Homo sapiens
agcctcctctgtctgccc

SEQ ID NO: 4413681 - DNA, 23 bp, Homo sapiens
agcctcctgaagttgctgctgtg

SEQ ID NO: 4413682 - DNA, 16 bp, Homo sapiens
agcctcctgtgcctgg

SEQ ID NO: 4413683 - DNA, 17 bp, Homo sapiens
agcctcctgtgcctggc

SEQ ID NO: 4413684 - DNA, 18 bp, Homo sapiens
agcctcctgtgcctggcc

SEQ ID NO: 4413685 - DNA, 23 bp, Homo sapiens
agcctctacagccgtcccgcgtt

SEQ ID NO: 4413686 - DNA, 21 bp, Homo sapiens
agcccactgaggggccaggga

SEQ ID NO: 4413687 - DNA, 16 bp, Homo sapiens
agcccagagccacctg

SEQ ID NO: 4413688 - DNA, 16 bp, Homo sapiens
agcccagaggagggca

SEQ ID NO: 4413689 - DNA, 15 bp, Homo sapiens
agcccagcactgctt

SEQ ID NO: 4413690 - DNA, 16 bp, Homo sapiens
agcccagcagtgtgga

SEQ ID NO: 4413691 - DNA, 12 bp, Homo sapiens
agcccagccagg

SEQ ID NO: 4413692 - DNA, 15 bp, Homo sapiens
agcccagccaggcca

SEQ ID NO: 4413693 - DNA, 20 bp, Homo sapiens
agcccagccaggccaacagc

SEQ ID NO: 4413694 - DNA, 15 bp, Homo sapiens
agcccagcccagctg

SEQ ID NO: 4413695 - DNA, 16 bp, Homo sapiens
agcccagcccagctgg

SEQ ID NO: 4413696 - DNA, 15 bp, Homo sapiens
agcccagcccaggag

SEQ ID NO: 4413697 - DNA, 13 bp, Homo sapiens
agcccagcctggg

SEQ ID NO: 4413698 - DNA, 20 bp, Homo sapiens
agcccagcgtcagaagtcta

SEQ ID NO: 4413699 - DNA, 12 bp, Homo sapiens
agcccaggagcc

SEQ ID NO: 4413700 - DNA, 19 bp, Homo sapiens
agcccaggatactggcaca

SEQ ID NO: 4413701 - DNA, 23 bp, Homo sapiens
agcccaggatactggcacagagg

SEQ ID NO: 4413702 - DNA, 14 bp, Homo sapiens
agcccagtgaagcc

SEQ ID NO: 4413703 - DNA, 15 bp, Homo sapiens
agcccagtgaagcct

SEQ ID NO: 4413704 - DNA, 15 bp, Homo sapiens
agcccagtgcttctc

SEQ ID NO: 4413705 - DNA, 19 bp, Homo sapiens
agcccataggccaccccct

SEQ ID NO: 4413706 - DNA, 14 bp, Homo sapiens
agcccatcctgacc

SEQ ID NO: 4413707 - DNA, 16 bp, Homo sapiens
agcccatgcccacctg

SEQ ID NO: 4413708 - DNA, 17 bp, Homo sapiens
agcccatggcccccaat

SEQ ID NO: 4413709 - DNA, 19 bp, Homo sapiens
agcccatggcccccaataa

SEQ ID NO: 4413710 - DNA, 12 bp, Homo sapiens
agcccattctca

SEQ ID NO: 4413711 - DNA, 17 bp, Homo sapiens
agcccattctcatgttt

SEQ ID NO: 4413712 - DNA, 16 bp, Homo sapiens
agcccattggccgagc

SEQ ID NO: 4413713 - DNA, 13 bp, Homo sapiens
agccccacagccc

SEQ ID NO: 4413714 - DNA, 22 bp, Homo sapiens
agccccacagcctggcacgaag

SEQ ID NO: 4413715 - DNA, 13 bp, Homo sapiens
agccccagcccag

SEQ ID NO: 4413716 - DNA, 13 bp, Homo sapiens
agccccagcccct

SEQ ID NO: 4413717 - DNA, 12 bp, Homo sapiens
agccccaggcca

SEQ ID NO: 4413718 - DNA, 16 bp, Homo sapiens
agccccaggccagctg

SEQ ID NO: 4413719 - DNA, 19 bp, Homo sapiens
agccccaggccagctgcgg

SEQ ID NO: 4413720 - DNA, 18 bp, Homo sapiens
agccccagggtcttccct

SEQ ID NO: 4413721 - DNA, 17 bp, Homo sapiens
agccccatcggccaaga

SEQ ID NO: 4413722 - DNA, 15 bp, Homo sapiens
agccccatttcctca

SEQ ID NO: 4413723 - DNA, 16 bp, Homo sapiens
agcccccacagtgctg

SEQ ID NO: 4413724 - DNA, 19 bp, Homo sapiens
agcccccaccggaactggg

SEQ ID NO: 4413725 - DNA, 21 bp, Homo sapiens
agcccccaccggaactgggct

SEQ ID NO: 4413726 - DNA, 18 bp, Homo sapiens
agcccccatcacccaagc

SEQ ID NO: 4413727 - DNA, 22 bp, Homo sapiens
agccccccagagagagctctgc

SEQ ID NO: 4413728 - DNA, 12 bp, Homo sapiens
agccccccagct

SEQ ID NO: 4413729 - DNA, 16 bp, Homo sapiens
agccccccagctccca

SEQ ID NO: 4413730 - DNA, 19 bp, Homo sapiens
agccccccagctcccacac

SEQ ID NO: 4413731 - DNA, 21 bp, Homo sapiens
agcccccctagcaatacaggg

SEQ ID NO: 4413732 - DNA, 15 bp, Homo sapiens
agcccccctgctgct

SEQ ID NO: 4413733 - DNA, 20 bp, Homo sapiens
agcccccctgctgctgcccg

SEQ ID NO: 4413734 - DNA, 15 bp, Homo sapiens
agcccccgccccaga

SEQ ID NO: 4413735 - DNA, 17 bp, Homo sapiens
agcccccgccccagagt

SEQ ID NO: 4413736 - DNA, 20 bp, Homo sapiens
agcccccgggccgctggctg

SEQ ID NO: 4413737 - DNA, 19 bp, Homo sapiens
agccccctttgggcccagg

SEQ ID NO: 4413738 - DNA, 14 bp, Homo sapiens
agccccgactccag

SEQ ID NO: 4413739 - DNA, 18 bp, Homo sapiens
agccccgactccagccag

SEQ ID NO: 4413740 - DNA, 21 bp, Homo sapiens
agccccgactccagccagcgc

SEQ ID NO: 4413741 - DNA, 16 bp, Homo sapiens
agccccgcctgtcaca

SEQ ID NO: 4413742 - DNA, 23 bp, Homo sapiens
agccccgcgtggaactcgtgtct

SEQ ID NO: 4413743 - DNA, 22 bp, Homo sapiens
agccccggcaagccacaggaag

SEQ ID NO: 4413744 - DNA, 21 bp, Homo sapiens
agccccggccctgggctcgga

SEQ ID NO: 4413745 - DNA, 19 bp, Homo sapiens
agcacttgcttacatcctc

SEQ ID NO: 4413746 - DNA, 19 bp, Homo sapiens
agcacttgtctcattttaa

SEQ ID NO: 4413747 - DNA, 22 bp, Homo sapiens
agcacttgtctcattttaatgt

SEQ ID NO: 4413748 - DNA, 17 bp, Homo sapiens
agcactttgggaggcag

SEQ ID NO: 4413749 - DNA, 20 bp, Homo sapiens
agcactttgggaggccgagg

SEQ ID NO: 4413750 - DNA, 21 bp, Homo sapiens
agcactttgggaggccgaggc

SEQ ID NO: 4413751 - DNA, 11 bp, Homo sapiens
agcagaaatgc

SEQ ID NO: 4413752 - DNA, 16 bp, Homo sapiens
agcagaacatactgtt

SEQ ID NO: 4413753 - DNA, 17 bp, Homo sapiens
agcagaacatactgttc

SEQ ID NO: 4413754 - DNA, 19 bp, Homo sapiens
agcagaagccccacagcct

SEQ ID NO: 4413755 - DNA, 12 bp, Homo sapiens
agcagaaggggg

SEQ ID NO: 4413756 - DNA, 16 bp, Homo sapiens
agcagaattcattcat

SEQ ID NO: 4413757 - DNA, 22 bp, Homo sapiens
agcagacactccagtttgccca

SEQ ID NO: 4413758 - DNA, 14 bp, Homo sapiens
agcagacaggcctg

SEQ ID NO: 4413759 - DNA, 20 bp, Homo sapiens
agcagacctaaagcaagcct

SEQ ID NO: 4413760 - DNA, 22 bp, Homo sapiens
agcagacctaaagcaagcctga

SEQ ID NO: 4413761 - DNA, 15 bp, Homo sapiens
agcagactcctgctc

SEQ ID NO: 4413762 - DNA, 23 bp, Homo sapiens
agcagagagcaaaggagaaatct

SEQ ID NO: 4413763 - DNA, 15 bp, Homo sapiens
agcagagagccctgg

SEQ ID NO: 4413764 - DNA, 19 bp, Homo sapiens
agcagagagccctgggtga

SEQ ID NO: 4413765 - DNA, 12 bp, Homo sapiens
agcagagccagg

SEQ ID NO: 4413766 - DNA, 16 bp, Homo sapiens
agcagagccagggcag

SEQ ID NO: 4413767 - DNA, 19 bp, Homo sapiens
agcagagccagggcagggc

SEQ ID NO: 4413768 - DNA, 22 bp, Homo sapiens
agcagaggacagtctggagaag

SEQ ID NO: 4413769 - DNA, 15 bp, Homo sapiens
agcagaggcaggctg

SEQ ID NO: 4413770 - DNA, 17 bp, Homo sapiens
agcagaggcaggctggg

SEQ ID NO: 4413771 - DNA, 19 bp, Homo sapiens
agcagaggcaggctgggac

SEQ ID NO: 4413772 - DNA, 13 bp, Homo sapiens
agcagaggtctcc

SEQ ID NO: 4413773 - DNA, 16 bp, Homo sapiens
agcagataactttttt

SEQ ID NO: 4413774 - DNA, 18 bp, Homo sapiens
agcagatacctcaccctg

SEQ ID NO: 4413775 - DNA, 19 bp, Homo sapiens
agcagatacctcaccctgc

SEQ ID NO: 4413776 - DNA, 15 bp, Homo sapiens
agcagcaaaaccaaa

SEQ ID NO: 4413777 - DNA, 16 bp, Homo sapiens
agcagcaacctgttca

SEQ ID NO: 4413778 - DNA, 20 bp, Homo sapiens
agcagcaagttcatacaaca

SEQ ID NO: 4413779 - DNA, 15 bp, Homo sapiens
agcagcaatattttg

SEQ ID NO: 4413780 - DNA, 16 bp, Homo sapiens
agcagcaatattttgt

SEQ ID NO: 4413781 - DNA, 18 bp, Homo sapiens
agcagcaggcctctggtt

SEQ ID NO: 4413782 - DNA, 13 bp, Homo sapiens
agcagcaggctca

SEQ ID NO: 4413783 - DNA, 15 bp, Homo sapiens
agcagcagtgtccag

SEQ ID NO: 4413784 - DNA, 15 bp, Homo sapiens
agcagcatcttctgg

SEQ ID NO: 4413785 - DNA, 15 bp, Homo sapiens
agcagccccaggaga

SEQ ID NO: 4413786 - DNA, 17 bp, Homo sapiens
agcagccccccagcact

SEQ ID NO: 4413787 - DNA, 18 bp, Homo sapiens
agcagccccccagcacta

SEQ ID NO: 4413788 - DNA, 14 bp, Homo sapiens
agcagcccctgaga

SEQ ID NO: 4413789 - DNA, 17 bp, Homo sapiens
agcagccctagcggctg

SEQ ID NO: 4413790 - DNA, 18 bp, Homo sapiens
agcagccctcctcacccc

SEQ ID NO: 4413791 - DNA, 12 bp, Homo sapiens
agcagcctctgg

SEQ ID NO: 4413792 - DNA, 16 bp, Homo sapiens
agcagcctctggacag

SEQ ID NO: 4413793 - DNA, 21 bp, Homo sapiens
agcagcctctggacagccagt

SEQ ID NO: 4413794 - DNA, 12 bp, Homo sapiens
agcagcctgcac

SEQ ID NO: 4413795 - DNA, 15 bp, Homo sapiens
agcagcgctcgctga

SEQ ID NO: 4413796 - DNA, 14 bp, Homo sapiens
agcagctctgagcc

SEQ ID NO: 4413797 - DNA, 23 bp, Homo sapiens
agcagctctgctatgagtgtgtg

SEQ ID NO: 4413798 - DNA, 15 bp, Homo sapiens
agcagctctggctct

SEQ ID NO: 4413799 - DNA, 20 bp, Homo sapiens
agcagctttttattccctgc

SEQ ID NO: 4413800 - DNA, 21 bp, Homo sapiens
agcagctttttattccctgcc

SEQ ID NO: 4413801 - DNA, 15 bp, Homo sapiens
agcaggaaaaaagga

SEQ ID NO: 4413802 - DNA, 23 bp, Homo sapiens
agcaggaaatgaaaatgtcttgt

SEQ ID NO: 4413803 - DNA, 14 bp, Homo sapiens
agcaggaaatgtag

SEQ ID NO: 4413804 - DNA, 24 bp, Homo sapiens
agcaggaaggaacaaagacaggca

SEQ ID NO: 4413805 - DNA, 21 bp, Homo sapiens
agcaggacctactaggagagg

SEQ ID NO: 4413806 - DNA, 14 bp, Homo sapiens
agcaggactccagg

SEQ ID NO: 4413807 - DNA, 18 bp, Homo sapiens
agcaggactccaggccca

SEQ ID NO: 4413808 - DNA, 21 bp, Homo sapiens
agcaggagagactgagcagcc

SEQ ID NO: 4413809 - DNA, 16 bp, Homo sapiens
agcaggcaccgccacg

SEQ ID NO: 4413810 - DNA, 22 bp, Homo sapiens
agcaggccaaggtctgagccac

SEQ ID NO: 4413811 - DNA, 15 bp, Homo sapiens
agcaggcctctggtt

SEQ ID NO: 4413812 - DNA, 20 bp, Homo sapiens
agcaggcctctggttgcctc

SEQ ID NO: 4413813 - DNA, 21 bp, Homo sapiens
agcaggcctctggttgcctcc

SEQ ID NO: 4413814 - DNA, 19 bp, Homo sapiens
agccaaagaaatgaacatt

SEQ ID NO: 4413815 - DNA, 20 bp, Homo sapiens
agccaaatgcagggagggga

SEQ ID NO: 4413816 - DNA, 13 bp, Homo sapiens
agccaaatttcct

SEQ ID NO: 4413817 - DNA, 15 bp, Homo sapiens
agccaacgagacaca

SEQ ID NO: 4413818 - DNA, 17 bp, Homo sapiens
agccaactagcccctgg

SEQ ID NO: 4413819 - DNA, 20 bp, Homo sapiens
agccaactatgattattaac

SEQ ID NO: 4413820 - DNA, 14 bp, Homo sapiens
agccaactctccca

SEQ ID NO: 4413821 - DNA, 19 bp, Homo sapiens
agccaactctcccaaaggg

SEQ ID NO: 4413822 - DNA, 17 bp, Homo sapiens
agccaagaaagatgtat

SEQ ID NO: 4413823 - DNA, 22 bp, Homo sapiens
agccaagatcgcaccactgcac

SEQ ID NO: 4413824 - DNA, 20 bp, Homo sapiens
agccaagctttaaattatgt

SEQ ID NO: 4413825 - DNA, 16 bp, Homo sapiens
agccaagggaaagggg

SEQ ID NO: 4413826 - DNA, 20 bp, Homo sapiens
agccaagggaaaggggtgct

SEQ ID NO: 4413827 - DNA, 20 bp, Homo sapiens
agccaagtagcctctcctgt

SEQ ID NO: 4413828 - DNA, 16 bp, Homo sapiens
agccaagtggggtgct

SEQ ID NO: 4413829 - DNA, 20 bp, Homo sapiens
agccaagtggggtgctggga

SEQ ID NO: 4413830 - DNA, 15 bp, Homo sapiens
agccaagtgtctttt

SEQ ID NO: 4413831 - DNA, 19 bp, Homo sapiens
agccaagtgtcttttaaac

SEQ ID NO: 4413832 - DNA, 12 bp, Homo sapiens
agccaatataac

SEQ ID NO: 4413833 - DNA, 15 bp, Homo sapiens
agccacaaagccccc

SEQ ID NO: 4413834 - DNA, 17 bp, Homo sapiens
agccacaaagcccccca

SEQ ID NO: 4413835 - DNA, 19 bp, Homo sapiens
agccacaaagccccccagc

SEQ ID NO: 4413836 - DNA, 20 bp, Homo sapiens
agccacaaagccccccagct

SEQ ID NO: 4413837 - DNA, 22 bp, Homo sapiens
agccacaaagccccccagctcc

SEQ ID NO: 4413838 - DNA, 23 bp, Homo sapiens
agccacaaagccccccagctccc

SEQ ID NO: 4413839 - DNA, 12 bp, Homo sapiens
agccacaagctg

SEQ ID NO: 4413840 - DNA, 16 bp, Homo sapiens
agccacagcagcattt

SEQ ID NO: 4413841 - DNA, 15 bp, Homo sapiens
agccacagccgtgct

SEQ ID NO: 4413842 - DNA, 22 bp, Homo sapiens
agccacagctgctgttctcagg

SEQ ID NO: 4413843 - DNA, 13 bp, Homo sapiens
agccacaggcctg

SEQ ID NO: 4413844 - DNA, 23 bp, Homo sapiens
agccacaggcctgagatttcatc

SEQ ID NO: 4413845 - DNA, 18 bp, Homo sapiens
agccacatactttacagt

SEQ ID NO: 4413846 - DNA, 17 bp, Homo sapiens
agccacatattgagatg

SEQ ID NO: 4413847 - DNA, 20 bp, Homo sapiens
agccacatgccccaggctct

SEQ ID NO: 4413848 - DNA, 15 bp, Homo sapiens
agccacatttggaat

SEQ ID NO: 4413849 - DNA, 23 bp, Homo sapiens
agccacatttggaatactttttg

SEQ ID NO: 4413850 - DNA, 20 bp, Homo sapiens
agccaccccgggctctctgc

SEQ ID NO: 4413851 - DNA, 19 bp, Homo sapiens
agccacccgtggggtgctg

SEQ ID NO: 4413852 - DNA, 18 bp, Homo sapiens
agccaccgtgcccggcca

SEQ ID NO: 4413853 - DNA, 18 bp, Homo sapiens
agccaccgtgcctggcca

SEQ ID NO: 4413854 - DNA, 17 bp, Homo sapiens
agccacgccctccctgc

SEQ ID NO: 4413855 - DNA, 14 bp, Homo sapiens
agccacgctgtcct

SEQ ID NO: 4413856 - DNA, 15 bp, Homo sapiens
agccacgctgtcctc

SEQ ID NO: 4413857 - DNA, 20 bp, Homo sapiens
agccacgctgtcctctcgag

SEQ ID NO: 4413858 - DNA, 15 bp, Homo sapiens
agccactcctctgac

SEQ ID NO: 4413859 - DNA, 21 bp, Homo sapiens
agccactccttccttcaggac

SEQ ID NO: 4413860 - DNA, 21 bp, Homo sapiens
agccactctatgagttggact

SEQ ID NO: 4413861 - DNA, 20 bp, Homo sapiens
agccactgcgcccggcccaa

SEQ ID NO: 4413862 - DNA, 13 bp, Homo sapiens
agccactgtcaca

SEQ ID NO: 4413863 - DNA, 17 bp, Homo sapiens
agccactgtcacaggca

SEQ ID NO: 4413864 - DNA, 17 bp, Homo sapiens
agccacttctccccaga

SEQ ID NO: 4413865 - DNA, 22 bp, Homo sapiens
agccacttgcctgtgctacaat

SEQ ID NO: 4413866 - DNA, 23 bp, Homo sapiens
agccagactgtccagggaaacag

SEQ ID NO: 4413867 - DNA, 20 bp, Homo sapiens
agccagagccccaagcagga

SEQ ID NO: 4413868 - DNA, 18 bp, Homo sapiens
agcaacatggaggatggt

SEQ ID NO: 4413869 - DNA, 17 bp, Homo sapiens
agcaaccctacagtata

SEQ ID NO: 4413870 - DNA, 19 bp, Homo sapiens
agcaaccctacagtatata

SEQ ID NO: 4413871 - DNA, 21 bp, Homo sapiens
agcaaccctacagtatataag

SEQ ID NO: 4413872 - DNA, 19 bp, Homo sapiens
agcaacccttcctgctgct

SEQ ID NO: 4413873 - DNA, 15 bp, Homo sapiens
agcaacctacccagc

SEQ ID NO: 4413874 - DNA, 14 bp, Homo sapiens
agcaacgcaggccc

SEQ ID NO: 4413875 - DNA, 16 bp, Homo sapiens
agcaactacaacttct

SEQ ID NO: 4413876 - DNA, 16 bp, Homo sapiens
agcaactcttatttct

SEQ ID NO: 4413877 - DNA, 15 bp, Homo sapiens
agcaactgaaaatga

SEQ ID NO: 4413878 - DNA, 15 bp, Homo sapiens
agcaactgttagctg

SEQ ID NO: 4413879 - DNA, 15 bp, Homo sapiens
agcaagactgggccc

SEQ ID NO: 4413880 - DNA, 11 bp, Homo sapiens
agcaagcaaaa

SEQ ID NO: 4413881 - DNA, 21 bp, Homo sapiens
agcaagcattcagaagaaaaa

SEQ ID NO: 4413882 - DNA, 11 bp, Homo sapiens
agcaagccaga

SEQ ID NO: 4413883 - DNA, 12 bp, Homo sapiens
agcaagccagac

SEQ ID NO: 4413884 - DNA, 14 bp, Homo sapiens
agcaagccatcatc

SEQ ID NO: 4413885 - DNA, 14 bp, Homo sapiens
agcaagctgcccag

SEQ ID NO: 4413886 - DNA, 16 bp, Homo sapiens
agcaagctgcccagcc

SEQ ID NO: 4413887 - DNA, 22 bp, Homo sapiens
agcaagctgcccagccctggcc

SEQ ID NO: 4413888 - DNA, 14 bp, Homo sapiens
agcaagctttggtt

SEQ ID NO: 4413889 - DNA, 23 bp, Homo sapiens
agcaaggcataatgtaatttagc

SEQ ID NO: 4413890 - DNA, 21 bp, Homo sapiens
agcaagggttggaggcaatgt

SEQ ID NO: 4413891 - DNA, 12 bp, Homo sapiens
agcaagtgaact

SEQ ID NO: 4413892 - DNA, 21 bp, Homo sapiens
agcaagtgaactcatcccttg

SEQ ID NO: 4413893 - DNA, 17 bp, Homo sapiens
agcaagtgagagagatg

SEQ ID NO: 4413894 - DNA, 18 bp, Homo sapiens
agcaagtgagagagatgg

SEQ ID NO: 4413895 - DNA, 15 bp, Homo sapiens
agcaagttcgtctgt

SEQ ID NO: 4413896 - DNA, 13 bp, Homo sapiens
agcaataaatgaa

SEQ ID NO: 4413897 - DNA, 14 bp, Homo sapiens
agcaataaatgaat

SEQ ID NO: 4413898 - DNA, 15 bp, Homo sapiens
agcaataaatgaatg

SEQ ID NO: 4413899 - DNA, 14 bp, Homo sapiens
agcaataactgaaa

SEQ ID NO: 4413900 - DNA, 17 bp, Homo sapiens
agcaataactgaaaatg

SEQ ID NO: 4413901 - DNA, 20 bp, Homo sapiens
agcaatactgtttccatttt

SEQ ID NO: 4413902 - DNA, 12 bp, Homo sapiens
agcaatatgcat

SEQ ID NO: 4413903 - DNA, 12 bp, Homo sapiens
agcaatattttg

SEQ ID NO: 4413904 - DNA, 14 bp, Homo sapiens
agcaatcctcctgc

SEQ ID NO: 4413905 - DNA, 16 bp, Homo sapiens
agcaatcctcctgcct

SEQ ID NO: 4413906 - DNA, 19 bp, Homo sapiens
agcaatcctcctgcctcag

SEQ ID NO: 4413907 - DNA, 23 bp, Homo sapiens
agcaatctcttcattattctctg

SEQ ID NO: 4413908 - DNA, 17 bp, Homo sapiens
agcaatctttgaaataa

SEQ ID NO: 4413909 - DNA, 22 bp, Homo sapiens
agcaatggccagagcctctggc

SEQ ID NO: 4413910 - DNA, 23 bp, Homo sapiens
agcaattagtctgaaactggctt

SEQ ID NO: 4413911 - DNA, 16 bp, Homo sapiens
agcaattcagacccct

SEQ ID NO: 4413912 - DNA, 17 bp, Homo sapiens
agcaattcccaggtcat

SEQ ID NO: 4413913 - DNA, 24 bp, Homo sapiens
agcaatttccccctaaaccaactg

SEQ ID NO: 4413914 - DNA, 12 bp, Homo sapiens
agcacaaaattc

SEQ ID NO: 4413915 - DNA, 14 bp, Homo sapiens
agcacaaaattcaa

SEQ ID NO: 4413916 - DNA, 15 bp, Homo sapiens
agcacaaaattcaaa

SEQ ID NO: 4413917 - DNA, 19 bp, Homo sapiens
agcacaaagttctcagagc

SEQ ID NO: 4413918 - DNA, 13 bp, Homo sapiens
agcacaactccct

SEQ ID NO: 4413919 - DNA, 15 bp, Homo sapiens
agcacaagacacaga

SEQ ID NO: 4413920 - DNA, 18 bp, Homo sapiens
agcacacaggcagccagc

SEQ ID NO: 4413921 - DNA, 18 bp, Homo sapiens
agcacacgagttccagac

SEQ ID NO: 4413922 - DNA, 20 bp, Homo sapiens
agcacactggctcacccagt

SEQ ID NO: 4413923 - DNA, 17 bp, Homo sapiens
agcacagagcctggccc

SEQ ID NO: 4413924 - DNA, 12 bp, Homo sapiens
agcacagaggcc

SEQ ID NO: 4413925 - DNA, 14 bp, Homo sapiens
agcacagaggcctg

SEQ ID NO: 4413926 - DNA, 18 bp, Homo sapiens
agcacagaggcctgactg

SEQ ID NO: 4413927 - DNA, 16 bp, Homo sapiens
agcacagattttgaat

SEQ ID NO: 4413928 - DNA, 17 bp, Homo sapiens
agcacagattttgaatc

SEQ ID NO: 4413929 - DNA, 12 bp, Homo sapiens
agcacagccctt

SEQ ID NO: 4413930 - DNA, 18 bp, Homo sapiens
agcacagcttagatttca

SEQ ID NO: 4413931 - DNA, 17 bp, Homo sapiens
agcacatagagcttttt

SEQ ID NO: 4413932 - DNA, 18 bp, Homo sapiens
agcacatagagcttttta

SEQ ID NO: 4413933 - DNA, 21 bp, Homo sapiens
agcacatcagtacttttctct

SEQ ID NO: 4413934 - DNA, 16 bp, Homo sapiens
agcacatctctctgcc

SEQ ID NO: 4413935 - DNA, 19 bp, Homo sapiens
agcacattcgggaccaata

SEQ ID NO: 4413936 - DNA, 17 bp, Homo sapiens
agcaccaccatttaatt

SEQ ID NO: 4413937 - DNA, 18 bp, Homo sapiens
agcaccaccatttaattt

SEQ ID NO: 4413938 - DNA, 20 bp, Homo sapiens
agcaccaccatttaatttca

SEQ ID NO: 4413939 - DNA, 23 bp, Homo sapiens
agcaccaccctagtcccttcccc

SEQ ID NO: 4413940 - DNA, 20 bp, Homo sapiens
agcaccattttaagtccctg

SEQ ID NO: 4413941 - DNA, 14 bp, Homo sapiens
agcacccagagcac

SEQ ID NO: 4413942 - DNA, 21 bp, Homo sapiens
actttcttttattaatatatg

SEQ ID NO: 4413943 - DNA, 21 bp, Homo sapiens
actttctttttctacatgtga

SEQ ID NO: 4413944 - DNA, 19 bp, Homo sapiens
actttgaataaagaatact

SEQ ID NO: 4413945 - DNA, 21 bp, Homo sapiens
actttgaataaagaatacttg

SEQ ID NO: 4413946 - DNA, 23 bp, Homo sapiens
actttgaataaagaatacttgaa

SEQ ID NO: 4413947 - DNA, 20 bp, Homo sapiens
actttgacctaaattattta

SEQ ID NO: 4413948 - DNA, 21 bp, Homo sapiens
actttgactttttgcatttaa

SEQ ID NO: 4413949 - DNA, 15 bp, Homo sapiens
actttgagaggctga

SEQ ID NO: 4413950 - DNA, 17 bp, Homo sapiens
actttgagaggctgagg

SEQ ID NO: 4413951 - DNA, 18 bp, Homo sapiens
actttgagaggctgaggt

SEQ ID NO: 4413952 - DNA, 15 bp, Homo sapiens
actttgatgtcatgt

SEQ ID NO: 4413953 - DNA, 21 bp, Homo sapiens
actttgatgtcatgtgttccc

SEQ ID NO: 4413954 - DNA, 21 bp, Homo sapiens
actttgctaaagacatgaagc

SEQ ID NO: 4413955 - DNA, 21 bp, Homo sapiens
actttgctgttactgcttctc

SEQ ID NO: 4413956 - DNA, 16 bp, Homo sapiens
actttggaatgttgaa

SEQ ID NO: 4413957 - DNA, 19 bp, Homo sapiens
actttggcaatttcctggc

SEQ ID NO: 4413958 - DNA, 21 bp, Homo sapiens
actttgggaggccgaggcggg

SEQ ID NO: 4413959 - DNA, 22 bp, Homo sapiens
actttggggccaattacttgaa

SEQ ID NO: 4413960 - DNA, 20 bp, Homo sapiens
actttggtctcagcgggagc

SEQ ID NO: 4413961 - DNA, 13 bp, Homo sapiens
actttgtaaattc

SEQ ID NO: 4413962 - DNA, 18 bp, Homo sapiens
actttgtagactgtttca

SEQ ID NO: 4413963 - DNA, 15 bp, Homo sapiens
actttgtagtgtttg

SEQ ID NO: 4413964 - DNA, 16 bp, Homo sapiens
actttgtatactttaa

SEQ ID NO: 4413965 - DNA, 18 bp, Homo sapiens
actttgtatactttaaat

SEQ ID NO: 4413966 - DNA, 21 bp, Homo sapiens
actttgtatactttaaataat

SEQ ID NO: 4413967 - DNA, 18 bp, Homo sapiens
actttgtgcattctggat

SEQ ID NO: 4413968 - DNA, 14 bp, Homo sapiens
actttgtgctacat

SEQ ID NO: 4413969 - DNA, 18 bp, Homo sapiens
actttgtggaccaattat

SEQ ID NO: 4413970 - DNA, 23 bp, Homo sapiens
actttgtggagagaatgtgtgtg

SEQ ID NO: 4413971 - DNA, 20 bp, Homo sapiens
actttgtgtattaaatggtt

SEQ ID NO: 4413972 - DNA, 18 bp, Homo sapiens
actttgtgttcatttcat

SEQ ID NO: 4413973 - DNA, 23 bp, Homo sapiens
actttgttattgcaaattgagga

SEQ ID NO: 4413974 - DNA, 20 bp, Homo sapiens
actttgttgcaagatgtgaa

SEQ ID NO: 4413975 - DNA, 16 bp, Homo sapiens
actttgtttagaaaaa

SEQ ID NO: 4413976 - DNA, 23 bp, Homo sapiens
actttgtttagaaaaaaaactga

SEQ ID NO: 4413977 - DNA, 13 bp, Homo sapiens
acttttaaactgt

SEQ ID NO: 4413978 - DNA, 19 bp, Homo sapiens
acttttaactatgtaataa

SEQ ID NO: 4413979 - DNA, 15 bp, Homo sapiens
acttttaagatttct

SEQ ID NO: 4413980 - DNA, 18 bp, Homo sapiens
acttttaaggataaatca

SEQ ID NO: 4413981 - DNA, 20 bp, Homo sapiens
acttttaaggataaatcata

SEQ ID NO: 4413982 - DNA, 18 bp, Homo sapiens
acttttaggttgttacca

SEQ ID NO: 4413983 - DNA, 15 bp, Homo sapiens
acttttataaattaa

SEQ ID NO: 4413984 - DNA, 20 bp, Homo sapiens
acttttatgcagcaaatata

SEQ ID NO: 4413985 - DNA, 15 bp, Homo sapiens
acttttatgtgagat

SEQ ID NO: 4413986 - DNA, 13 bp, Homo sapiens
acttttatgtttt

SEQ ID NO: 4413987 - DNA, 17 bp, Homo sapiens
acttttcaataaatcag

SEQ ID NO: 4413988 - DNA, 13 bp, Homo sapiens
acttttctgccaa

SEQ ID NO: 4413989 - DNA, 14 bp, Homo sapiens
acttttctgccaaa

SEQ ID NO: 4413990 - DNA, 15 bp, Homo sapiens
acttttctgccaaaa

SEQ ID NO: 4413991 - DNA, 18 bp, Homo sapiens
acttttctgccaaaataa

SEQ ID NO: 4413992 - DNA, 17 bp, Homo sapiens
acttttctgtaattcag

SEQ ID NO: 4413993 - DNA, 16 bp, Homo sapiens
acttttcttaaacctt

SEQ ID NO: 4413994 - DNA, 12 bp, Homo sapiens
acttttcttccc

SEQ ID NO: 4413995 - DNA, 12 bp, Homo sapiens
acttttgacaaa

SEQ ID NO: 4413996 - DNA, 15 bp, Homo sapiens
acttttgccctttga

SEQ ID NO: 4413997 - DNA, 16 bp, Homo sapiens
acttttggattttatg

SEQ ID NO: 4413998 - DNA, 17 bp, Homo sapiens
acttttggattttatgg

SEQ ID NO: 4413999 - DNA, 12 bp, Homo sapiens
acttttgttaaa

SEQ ID NO: 4414000 - DNA, 15 bp, Homo sapiens
acttttgttaacagt

SEQ ID NO: 4414001 - DNA, 15 bp, Homo sapiens
actttttaaaaataa

SEQ ID NO: 4414002 - DNA, 18 bp, Homo sapiens
actttttaaaaataactg

SEQ ID NO: 4414003 - DNA, 18 bp, Homo sapiens
actttttaaagtaaatta

SEQ ID NO: 4414004 - DNA, 18 bp, Homo sapiens
actttttaaatgtaaaga

SEQ ID NO: 4414005 - DNA, 16 bp, Homo sapiens
actttttagattattc

SEQ ID NO: 4414006 - DNA, 13 bp, Homo sapiens
actttttattgcc

SEQ ID NO: 4414007 - DNA, 16 bp, Homo sapiens
actttttattgccttc

SEQ ID NO: 4414008 - DNA, 17 bp, Homo sapiens
actttttattgccttct

SEQ ID NO: 4414009 - DNA, 18 bp, Homo sapiens
actttttattgccttctc

SEQ ID NO: 4414010 - DNA, 16 bp, Homo sapiens
actttttcatgaaaat

SEQ ID NO: 4414011 - DNA, 17 bp, Homo sapiens
actttttccatttggca

SEQ ID NO: 4414012 - DNA, 19 bp, Homo sapiens
actttttccttactgtgca

SEQ ID NO: 4414013 - DNA, 12 bp, Homo sapiens
actttttctgat

SEQ ID NO: 4414014 - DNA, 13 bp, Homo sapiens
actttttgcattt

SEQ ID NO: 4414015 - DNA, 23 bp, Homo sapiens
actttttgctgttagttataaaa

SEQ ID NO: 4414016 - DNA, 14 bp, Homo sapiens
actttttggtggat

SEQ ID NO: 4414017 - DNA, 13 bp, Homo sapiens
actttttgtgaat

SEQ ID NO: 4414018 - DNA, 18 bp, Homo sapiens
actttttgtttttatttc

SEQ ID NO: 4414019 - DNA, 21 bp, Homo sapiens
actttttgtttttatttcttt

SEQ ID NO: 4414020 - DNA, 12 bp, Homo sapiens
acttttttataa

SEQ ID NO: 4414021 - DNA, 15 bp, Homo sapiens
acttttttatttaaa

SEQ ID NO: 4414022 - DNA, 18 bp, Homo sapiens
acttttttgagtcattga

SEQ ID NO: 4414023 - DNA, 19 bp, Homo sapiens
acttttttgtttgaatgtt

SEQ ID NO: 4414024 - DNA, 23 bp, Homo sapiens
actttttttctgtaccagttaat

SEQ ID NO: 4414025 - DNA, 18 bp, Homo sapiens
agaaaaaaaactgaagat

SEQ ID NO: 4414026 - DNA, 22 bp, Homo sapiens
agaaaaaaacattctatctact

SEQ ID NO: 4414027 - DNA, 14 bp, Homo sapiens
agaaaaaaagcaaa

SEQ ID NO: 4414028 - DNA, 12 bp, Homo sapiens
agaaaaaaattg

SEQ ID NO: 4414029 - DNA, 19 bp, Homo sapiens
agaaaaaagaaaaatctca

SEQ ID NO: 4414030 - DNA, 23 bp, Homo sapiens
agaaaaacaaactcgttttttac

SEQ ID NO: 4414031 - DNA, 22 bp, Homo sapiens
agaaaaacaatggtaacatttt

SEQ ID NO: 4414032 - DNA, 12 bp, Homo sapiens
agaaaaacattt

SEQ ID NO: 4414033 - DNA, 12 bp, Homo sapiens
agaaaaagaaca

SEQ ID NO: 4414034 - DNA, 14 bp, Homo sapiens
agaaaaagggtcaa

SEQ ID NO: 4414035 - DNA, 21 bp, Homo sapiens
agaaaaatctcattatttcaa

SEQ ID NO: 4414036 - DNA, 14 bp, Homo sapiens
agaaaaatgtataa

SEQ ID NO: 4414037 - DNA, 15 bp, Homo sapiens
agaaaaattaattag

SEQ ID NO: 4414038 - DNA, 20 bp, Homo sapiens
agaaaaattaattaggaatt

SEQ ID NO: 4414039 - DNA, 23 bp, Homo sapiens
agaaaacataatcttctgccttc

SEQ ID NO: 4414040 - DNA, 13 bp, Homo sapiens
agaaaacatgttt

SEQ ID NO: 4414041 - DNA, 19 bp, Homo sapiens
agaaaactcccaatacaaa

SEQ ID NO: 4414042 - DNA, 13 bp, Homo sapiens
agaaaagaaaaat

SEQ ID NO: 4414043 - DNA, 23 bp, Homo sapiens
agaaaagacagggtgggagggag

SEQ ID NO: 4414044 - DNA, 18 bp, Homo sapiens
agaaaagcaatactgttt

SEQ ID NO: 4414045 - DNA, 15 bp, Homo sapiens
agaaaagcacctgcc

SEQ ID NO: 4414046 - DNA, 22 bp, Homo sapiens
agaaaaggattttggaaactca

SEQ ID NO: 4414047 - DNA, 20 bp, Homo sapiens
agaaaagggaactgaacatt

SEQ ID NO: 4414048 - DNA, 19 bp, Homo sapiens
agaaaagtagacaatcatt

SEQ ID NO: 4414049 - DNA, 12 bp, Homo sapiens
agaaaagtgaat

SEQ ID NO: 4414050 - DNA, 13 bp, Homo sapiens
agaaaagttatta

SEQ ID NO: 4414051 - DNA, 14 bp, Homo sapiens
agaaaatatatgta

SEQ ID NO: 4414052 - DNA, 15 bp, Homo sapiens
agaaaatatatgtat

SEQ ID NO: 4414053 - DNA, 15 bp, Homo sapiens
agaaaatatcactgt

SEQ ID NO: 4414054 - DNA, 11 bp, Homo sapiens
agaaaatattc

SEQ ID NO: 4414055 - DNA, 11 bp, Homo sapiens
agaaaatgaag

SEQ ID NO: 4414056 - DNA, 23 bp, Homo sapiens
agaaaatgacttatttctgctct

SEQ ID NO: 4414057 - DNA, 16 bp, Homo sapiens
agaaaatgtaaggcaa

SEQ ID NO: 4414058 - DNA, 18 bp, Homo sapiens
agaaaattaaactacaga

SEQ ID NO: 4414059 - DNA, 15 bp, Homo sapiens
agatgtgttcttatt

SEQ ID NO: 4414060 - DNA, 14 bp, Homo sapiens
agatgttaaaataa

SEQ ID NO: 4414061 - DNA, 17 bp, Homo sapiens
agatgttaaaataaatg

SEQ ID NO: 4414062 - DNA, 15 bp, Homo sapiens
agatgttagactcat

SEQ ID NO: 4414063 - DNA, 22 bp, Homo sapiens
agatgttagggtataagttgct

SEQ ID NO: 4414064 - DNA, 17 bp, Homo sapiens
agatgttccaaatttag

SEQ ID NO: 4414065 - DNA, 20 bp, Homo sapiens
agatgttcgctcgtgcagta

SEQ ID NO: 4414066 - DNA, 21 bp, Homo sapiens
agatgttctaagtctttccat

SEQ ID NO: 4414067 - DNA, 15 bp, Homo sapiens
agatgtttatttcag

SEQ ID NO: 4414068 - DNA, 12 bp, Homo sapiens
agatgtttcttg

SEQ ID NO: 4414069 - DNA, 22 bp, Homo sapiens
agatgtttcttgccttttgtta

SEQ ID NO: 4414070 - DNA, 19 bp, Homo sapiens
agatgtttgatagattttc

SEQ ID NO: 4414071 - DNA, 18 bp, Homo sapiens
agatgtttgttttcaaaa

SEQ ID NO: 4414072 - DNA, 21 bp, Homo sapiens
agatgtttttaattctagtat

SEQ ID NO: 4414073 - DNA, 23 bp, Homo sapiens
agattaaaattatatagctgctc

SEQ ID NO: 4414074 - DNA, 20 bp, Homo sapiens
agattaaattacagctttta

SEQ ID NO: 4414075 - DNA, 12 bp, Homo sapiens
agattaagcttt

SEQ ID NO: 4414076 - DNA, 20 bp, Homo sapiens
agattacaaatcagaagtca

SEQ ID NO: 4414077 - DNA, 18 bp, Homo sapiens
agattacaggaatgaaga

SEQ ID NO: 4414078 - DNA, 21 bp, Homo sapiens
agattacaggattaatatatt

SEQ ID NO: 4414079 - DNA, 17 bp, Homo sapiens
agattacatctgcctta

SEQ ID NO: 4414080 - DNA, 14 bp, Homo sapiens
agattactgatgtg

SEQ ID NO: 4414081 - DNA, 17 bp, Homo sapiens
agattaggtcgttttcc

SEQ ID NO: 4414082 - DNA, 20 bp, Homo sapiens
agattaggtcgttttccaaa

SEQ ID NO: 4414083 - DNA, 18 bp, Homo sapiens
agattagttctttttgcc

SEQ ID NO: 4414084 - DNA, 16 bp, Homo sapiens
agattattaaaactga

SEQ ID NO: 4414085 - DNA, 19 bp, Homo sapiens
agattattataaactataa

SEQ ID NO: 4414086 - DNA, 12 bp, Homo sapiens
agattatttaca

SEQ ID NO: 4414087 - DNA, 15 bp, Homo sapiens
agattcacctgtaaa

SEQ ID NO: 4414088 - DNA, 20 bp, Homo sapiens
agattcacctgtaaaacttt

SEQ ID NO: 4414089 - DNA, 17 bp, Homo sapiens
agattcactttgacact

SEQ ID NO: 4414090 - DNA, 23 bp, Homo sapiens
agattcactttgacacttttcat

SEQ ID NO: 4414091 - DNA, 21 bp, Homo sapiens
agattcaggccagcccagcca

SEQ ID NO: 4414092 - DNA, 17 bp, Homo sapiens
agattcagggagaatgt

SEQ ID NO: 4414093 - DNA, 18 bp, Homo sapiens
agattcaggtaatacaaa

SEQ ID NO: 4414094 - DNA, 17 bp, Homo sapiens
agattcatgaaaatgta

SEQ ID NO: 4414095 - DNA, 16 bp, Homo sapiens
agattcattttctaga

SEQ ID NO: 4414096 - DNA, 17 bp, Homo sapiens
agattcattttctagat

SEQ ID NO: 4414097 - DNA, 12 bp, Homo sapiens
agattcccagag

SEQ ID NO: 4414098 - DNA, 18 bp, Homo sapiens
agattctatgttaatatt

SEQ ID NO: 4414099 - DNA, 15 bp, Homo sapiens
agattctctgcccag

SEQ ID NO: 4414100 - DNA, 14 bp, Homo sapiens
agattctgattcag

SEQ ID NO: 4414101 - DNA, 21 bp, Homo sapiens
agattctgcctatgtaaaatg

SEQ ID NO: 4414102 - DNA, 14 bp, Homo sapiens
agattctgcctctc

SEQ ID NO: 4414103 - DNA, 18 bp, Homo sapiens
agattctgtgtattaaca

SEQ ID NO: 4414104 - DNA, 13 bp, Homo sapiens
agattctgtgtca

SEQ ID NO: 4414105 - DNA, 19 bp, Homo sapiens
agattctgtgtcagagccc

SEQ ID NO: 4414106 - DNA, 13 bp, Homo sapiens
agattcttaattc

SEQ ID NO: 4414107 - DNA, 12 bp, Homo sapiens
agattctttccc

SEQ ID NO: 4414108 - DNA, 11 bp, Homo sapiens
agattctttta

SEQ ID NO: 4414109 - DNA, 13 bp, Homo sapiens
agattgagaaatg

SEQ ID NO: 4414110 - DNA, 14 bp, Homo sapiens
agattgagaaatgt

SEQ ID NO: 4414111 - DNA, 17 bp, Homo sapiens
agattgagaaatgtgta

SEQ ID NO: 4414112 - DNA, 19 bp, Homo sapiens
agattgatagggagtttta

SEQ ID NO: 4414113 - DNA, 14 bp, Homo sapiens
agattgattgtatt

SEQ ID NO: 4414114 - DNA, 12 bp, Homo sapiens
agattgcactgc

SEQ ID NO: 4414115 - DNA, 16 bp, Homo sapiens
agattgcagaaaattc

SEQ ID NO: 4414116 - DNA, 16 bp, Homo sapiens
agattgccccaggtct

SEQ ID NO: 4414117 - DNA, 15 bp, Homo sapiens
agattgcgcctgaga

SEQ ID NO: 4414118 - DNA, 17 bp, Homo sapiens
agattggatcaagtatt

SEQ ID NO: 4414119 - DNA, 22 bp, Homo sapiens
agattggctcacactgagaatg

SEQ ID NO: 4414120 - DNA, 23 bp, Homo sapiens
agattgggatactgtaatacttc

SEQ ID NO: 4414121 - DNA, 22 bp, Homo sapiens
agattgtccttttctcccattt

SEQ ID NO: 4414122 - DNA, 16 bp, Homo sapiens
agattgtgcccctgca

SEQ ID NO: 4414123 - DNA, 22 bp, Homo sapiens
agattgtggaatgttggataag

SEQ ID NO: 4414124 - DNA, 19 bp, Homo sapiens
agattgtggtggtgctaaa

SEQ ID NO: 4414125 - DNA, 13 bp, Homo sapiens
agatttaacccct

SEQ ID NO: 4414126 - DNA, 22 bp, Homo sapiens
agatttaagtgaatacattaac

SEQ ID NO: 4414127 - DNA, 21 bp, Homo sapiens
agatttactgctctagaaagt

SEQ ID NO: 4414128 - DNA, 14 bp, Homo sapiens
agatttatacagtt

SEQ ID NO: 4414129 - DNA, 20 bp, Homo sapiens
agatttcagctatgcagaaa

SEQ ID NO: 4414130 - DNA, 12 bp, Homo sapiens
agatttcatagt

SEQ ID NO: 4414131 - DNA, 15 bp, Homo sapiens
agatttcatctgctc

SEQ ID NO: 4414132 - DNA, 18 bp, Homo sapiens
agatttcatctgctctcc

SEQ ID NO: 4414133 - DNA, 19 bp, Homo sapiens
agatttcatctgctctcct

SEQ ID NO: 4414134 - DNA, 11 bp, Homo sapiens
agatttctgac

SEQ ID NO: 4414135 - DNA, 11 bp, Homo sapiens
agatttgaaaa

SEQ ID NO: 4414136 - DNA, 16 bp, Homo sapiens
agatttgaaaattgta

SEQ ID NO: 4414137 - DNA, 18 bp, Homo sapiens
agatattgttataaataa

SEQ ID NO: 4414138 - DNA, 20 bp, Homo sapiens
agatatttcgaccctggggc

SEQ ID NO: 4414139 - DNA, 21 bp, Homo sapiens
agatatttcgaccctggggcg

SEQ ID NO: 4414140 - DNA, 12 bp, Homo sapiens
agatatttgaaa

SEQ ID NO: 4414141 - DNA, 15 bp, Homo sapiens
agatattttgtaaaa

SEQ ID NO: 4414142 - DNA, 22 bp, Homo sapiens
agatattttgtaaaatgtatta

SEQ ID NO: 4414143 - DNA, 13 bp, Homo sapiens
agatcaaagatga

SEQ ID NO: 4414144 - DNA, 14 bp, Homo sapiens
agatcaatttctcc

SEQ ID NO: 4414145 - DNA, 18 bp, Homo sapiens
agatcacatcttaaattc

SEQ ID NO: 4414146 - DNA, 18 bp, Homo sapiens
agatcactttctcagttt

SEQ ID NO: 4414147 - DNA, 21 bp, Homo sapiens
agatcaggaattctaaataaa

SEQ ID NO: 4414148 - DNA, 15 bp, Homo sapiens
agatcagtaaagaac

SEQ ID NO: 4414149 - DNA, 13 bp, Homo sapiens
agatccactggga

SEQ ID NO: 4414150 - DNA, 15 bp, Homo sapiens
agatccattaattta

SEQ ID NO: 4414151 - DNA, 18 bp, Homo sapiens
agatccattaatttaaat

SEQ ID NO: 4414152 - DNA, 19 bp, Homo sapiens
agatcccaacactgccagc

SEQ ID NO: 4414153 - DNA, 20 bp, Homo sapiens
agatcccaacactgccagca

SEQ ID NO: 4414154 - DNA, 16 bp, Homo sapiens
agatcccaggcccctg

SEQ ID NO: 4414155 - DNA, 20 bp, Homo sapiens
agatcccaggcccctggagg

SEQ ID NO: 4414156 - DNA, 15 bp, Homo sapiens
agatccccaactgct

SEQ ID NO: 4414157 - DNA, 18 bp, Homo sapiens
agatccccaactgctcca

SEQ ID NO: 4414158 - DNA, 16 bp, Homo sapiens
agatccccagcccctc

SEQ ID NO: 4414159 - DNA, 15 bp, Homo sapiens
agatcccctcaggac

SEQ ID NO: 4414160 - DNA, 16 bp, Homo sapiens
agatcctaaactctct

SEQ ID NO: 4414161 - DNA, 13 bp, Homo sapiens
agatcctctctgg

SEQ ID NO: 4414162 - DNA, 20 bp, Homo sapiens
agatcgcaccactgcactcc

SEQ ID NO: 4414163 - DNA, 21 bp, Homo sapiens
agatcgtgccgttactctcca

SEQ ID NO: 4414164 - DNA, 16 bp, Homo sapiens
agatctaaacagttat

SEQ ID NO: 4414165 - DNA, 14 bp, Homo sapiens
agatctcccttctc

SEQ ID NO: 4414166 - DNA, 14 bp, Homo sapiens
agatctctttctaa

SEQ ID NO: 4414167 - DNA, 15 bp, Homo sapiens
agatctgtctccaag

SEQ ID NO: 4414168 - DNA, 16 bp, Homo sapiens
agatctgtgccccatg

SEQ ID NO: 4414169 - DNA, 18 bp, Homo sapiens
agatctgttttgaaggca

SEQ ID NO: 4414170 - DNA, 21 bp, Homo sapiens
agatctgttttgaaggcaaaa

SEQ ID NO: 4414171 - DNA, 23 bp, Homo sapiens
agatctgttttgtggtttggaat

SEQ ID NO: 4414172 - DNA, 15 bp, Homo sapiens
agatcttaatataaa

SEQ ID NO: 4414173 - DNA, 13 bp, Homo sapiens
agatcttatattg

SEQ ID NO: 4414174 - DNA, 15 bp, Homo sapiens
agatcttatattggt

SEQ ID NO: 4414175 - DNA, 21 bp, Homo sapiens
agatcttatattggtttgcac

SEQ ID NO: 4414176 - DNA, 20 bp, Homo sapiens
agatctttctttccaaaaca

SEQ ID NO: 4414177 - DNA, 21 bp, Homo sapiens
agatctttctttccaaaacat

SEQ ID NO: 4414178 - DNA, 17 bp, Homo sapiens
agatcttttttttttcc

SEQ ID NO: 4414179 - DNA, 18 bp, Homo sapiens
agatgaaacatcatttca

SEQ ID NO: 4414180 - DNA, 19 bp, Homo sapiens
agatgaaactggttcctac

SEQ ID NO: 4414181 - DNA, 15 bp, Homo sapiens
agatgaatgtcagtt

SEQ ID NO: 4414182 - DNA, 19 bp, Homo sapiens
agatgaccagggatgctgg

SEQ ID NO: 4414183 - DNA, 13 bp, Homo sapiens
agatgagaattag

SEQ ID NO: 4414184 - DNA, 11 bp, Homo sapiens
agatgagccca

SEQ ID NO: 4414185 - DNA, 18 bp, Homo sapiens
agatgaggagtaaaattc

SEQ ID NO: 4414186 - DNA, 18 bp, Homo sapiens
agatgataaagagacagt

SEQ ID NO: 4414187 - DNA, 22 bp, Homo sapiens
agatgatctctccacggtagca

SEQ ID NO: 4414188 - DNA, 19 bp, Homo sapiens
agatgatgatgatctttaa

SEQ ID NO: 4414189 - DNA, 16 bp, Homo sapiens
agatgatttcccccct

SEQ ID NO: 4414190 - DNA, 15 bp, Homo sapiens
agatgattttttgaa

SEQ ID NO: 4414191 - DNA, 17 bp, Homo sapiens
agatgattttttgaaag

SEQ ID NO: 4414192 - DNA, 22 bp, Homo sapiens
agatgcacgtggggcccactgc

SEQ ID NO: 4414193 - DNA, 17 bp, Homo sapiens
agatgcaggtgatgcca

SEQ ID NO: 4414194 - DNA, 15 bp, Homo sapiens
agatgcagtttggag

SEQ ID NO: 4414195 - DNA, 17 bp, Homo sapiens
agatgcatcgggaaaga

SEQ ID NO: 4414196 - DNA, 18 bp, Homo sapiens
agatgcatcgggaaagaa

SEQ ID NO: 4414197 - DNA, 19 bp, Homo sapiens
agatgcatcgggaaagaag

SEQ ID NO: 4414198 - DNA, 20 bp, Homo sapiens
agatgcatcgggaaagaaga

SEQ ID NO: 4414199 - DNA, 23 bp, Homo sapiens
agatgcatcgggaaagaagaaac

SEQ ID NO: 4414200 - DNA, 19 bp, Homo sapiens
agatgccatcctctttctc

SEQ ID NO: 4414201 - DNA, 14 bp, Homo sapiens
agatgccccattcc

SEQ ID NO: 4414202 - DNA, 15 bp, Homo sapiens
agatgccccattcct

SEQ ID NO: 4414203 - DNA, 11 bp, Homo sapiens
agatgccctga

SEQ ID NO: 4414204 - DNA, 12 bp, Homo sapiens
agatgcctccac

SEQ ID NO: 4414205 - DNA, 15 bp, Homo sapiens
agatgcctccaccgc

SEQ ID NO: 4414206 - DNA, 16 bp, Homo sapiens
agatgcctccaccgct

SEQ ID NO: 4414207 - DNA, 21 bp, Homo sapiens
agatgcctccaccgctgccta

SEQ ID NO: 4414208 - DNA, 17 bp, Homo sapiens
agatgcgtgcccagctc

SEQ ID NO: 4414209 - DNA, 16 bp, Homo sapiens
agatgctagaaaaatg

SEQ ID NO: 4414210 - DNA, 20 bp, Homo sapiens
agatgctccttgggcccttt

SEQ ID NO: 4414211 - DNA, 20 bp, Homo sapiens
agatgctgatggagccttcc

SEQ ID NO: 4414212 - DNA, 13 bp, Homo sapiens
agatgctggtgga

SEQ ID NO: 4414213 - DNA, 16 bp, Homo sapiens
agatgcttctctcctt

SEQ ID NO: 4414214 - DNA, 19 bp, Homo sapiens
agatgcttctctccttgcc

SEQ ID NO: 4414215 - DNA, 20 bp, Homo sapiens
agatgcttctctccttgccc

SEQ ID NO: 4414216 - DNA, 14 bp, Homo sapiens
agatgcttggagca

SEQ ID NO: 4414217 - DNA, 21 bp, Homo sapiens
agatgcttggttgtgttgagg

SEQ ID NO: 4414218 - DNA, 16 bp, Homo sapiens
agatggaaaaataaca

SEQ ID NO: 4414219 - DNA, 17 bp, Homo sapiens
agatggaaaaataacaa

SEQ ID NO: 4414220 - DNA, 17 bp, Homo sapiens
agatggacacgagccac

SEQ ID NO: 4414221 - DNA, 16 bp, Homo sapiens
agatggagggcttggc

SEQ ID NO: 4414222 - DNA, 18 bp, Homo sapiens
agatggagggcttggccc

SEQ ID NO: 4414223 - DNA, 22 bp, Homo sapiens
agatggagggcttggcccagcg

SEQ ID NO: 4414224 - DNA, 18 bp, Homo sapiens
agatggagggggctgggg

SEQ ID NO: 4414225 - DNA, 21 bp, Homo sapiens
agatggcataacctgtctcac

SEQ ID NO: 4414226 - DNA, 17 bp, Homo sapiens
agatggcccctccactg

SEQ ID NO: 4414227 - DNA, 18 bp, Homo sapiens
agatgggaatgaggtggg

SEQ ID NO: 4414228 - DNA, 17 bp, Homo sapiens
agatgggacagcaacaa

SEQ ID NO: 4414229 - DNA, 22 bp, Homo sapiens
agatgggaggtggaagcagagg

SEQ ID NO: 4414230 - DNA, 20 bp, Homo sapiens
agatgggcatcttttgtatt

SEQ ID NO: 4414231 - DNA, 21 bp, Homo sapiens
agatgggcatcttttgtatta

SEQ ID NO: 4414232 - DNA, 23 bp, Homo sapiens
agatggggtctcgctctgtcacc

SEQ ID NO: 4414233 - DNA, 16 bp, Homo sapiens
agatgggtccaggggt

SEQ ID NO: 4414234 - DNA, 17 bp, Homo sapiens
agatggtagttgagggt

SEQ ID NO: 4414235 - DNA, 19 bp, Homo sapiens
agatggtatatttggtact

SEQ ID NO: 4414236 - DNA, 17 bp, Homo sapiens
agatggtgctgctaatt

SEQ ID NO: 4414237 - DNA, 18 bp, Homo sapiens
agatggttacactgttag

SEQ ID NO: 4414238 - DNA, 19 bp, Homo sapiens
agatggttacactgttaga

SEQ ID NO: 4414239 - DNA, 14 bp, Homo sapiens
agatgtaatgtttt

SEQ ID NO: 4414240 - DNA, 17 bp, Homo sapiens
agatgtaatgttttctt

SEQ ID NO: 4414241 - DNA, 14 bp, Homo sapiens
agatgtagaggaga

SEQ ID NO: 4414242 - DNA, 17 bp, Homo sapiens
agatgtattctttataa

SEQ ID NO: 4414243 - DNA, 21 bp, Homo sapiens
agatgtatttttgatgtatat

SEQ ID NO: 4414244 - DNA, 23 bp, Homo sapiens
agatgtatttttgatgtatatat

SEQ ID NO: 4414245 - DNA, 18 bp, Homo sapiens
agatgtcatttccaccag

SEQ ID NO: 4414246 - DNA, 21 bp, Homo sapiens
agatgtccatttttacaagtt

SEQ ID NO: 4414247 - DNA, 21 bp, Homo sapiens
agatgtctatgtagctgaaaa

SEQ ID NO: 4414248 - DNA, 12 bp, Homo sapiens
agatgtctattc

SEQ ID NO: 4414249 - DNA, 18 bp, Homo sapiens
agatgtcttaacctcagg

SEQ ID NO: 4414250 - DNA, 14 bp, Homo sapiens
agatgtcttccctg

SEQ ID NO: 4414251 - DNA, 15 bp, Homo sapiens
agatgtcttccctgg

SEQ ID NO: 4414252 - DNA, 16 bp, Homo sapiens
agatgtcttccctggg

SEQ ID NO: 4414253 - DNA, 22 bp, Homo sapiens
agatgtcttccctgggctgcca

SEQ ID NO: 4414254 - DNA, 17 bp, Homo sapiens
agatgtgaacacatcag

SEQ ID NO: 4414255 - DNA, 20 bp, Homo sapiens
agatgtgaattattgacact

SEQ ID NO: 4414256 - DNA, 15 bp, Homo sapiens
agatgtgagccaccg

SEQ ID NO: 4414257 - DNA, 17 bp, Homo sapiens
agagaagccccttcccc

SEQ ID NO: 4414258 - DNA, 13 bp, Homo sapiens
agagaaggagcca

SEQ ID NO: 4414259 - DNA, 12 bp, Homo sapiens
agagaaggcagg

SEQ ID NO: 4414260 - DNA, 16 bp, Homo sapiens
agagaagtagaaatca

SEQ ID NO: 4414261 - DNA, 23 bp, Homo sapiens
agagaagttgctgcttgtgatct

SEQ ID NO: 4414262 - DNA, 14 bp, Homo sapiens
agagaatagaacaa

SEQ ID NO: 4414263 - DNA, 15 bp, Homo sapiens
agagaatgctttgaa

SEQ ID NO: 4414264 - DNA, 19 bp, Homo sapiens
agagaatttctaaagtaaa

SEQ ID NO: 4414265 - DNA, 22 bp, Homo sapiens
agagaatttctaaagtaaaatt

SEQ ID NO: 4414266 - DNA, 20 bp, Homo sapiens
agagacaaactgtaaaaaat

SEQ ID NO: 4414267 - DNA, 14 bp, Homo sapiens
agagacaagtaatt

SEQ ID NO: 4414268 - DNA, 19 bp, Homo sapiens
agagacaagtaatttcagt

SEQ ID NO: 4414269 - DNA, 13 bp, Homo sapiens
agagacacctgca

SEQ ID NO: 4414270 - DNA, 16 bp, Homo sapiens
agagacacctgcacct

SEQ ID NO: 4414271 - DNA, 15 bp, Homo sapiens
agagacactgagcca

SEQ ID NO: 4414272 - DNA, 18 bp, Homo sapiens
agagacactgagccagtc

SEQ ID NO: 4414273 - DNA, 12 bp, Homo sapiens
agagacagatgc

SEQ ID NO: 4414274 - DNA, 15 bp, Homo sapiens
agagacagatgctgg

SEQ ID NO: 4414275 - DNA, 14 bp, Homo sapiens
agagacagcccagg

SEQ ID NO: 4414276 - DNA, 15 bp, Homo sapiens
agagacagcccagga

SEQ ID NO: 4414277 - DNA, 21 bp, Homo sapiens
agagacaggaaaatcctctgg

SEQ ID NO: 4414278 - DNA, 23 bp, Homo sapiens
agagacaggaaaatcctctggct

SEQ ID NO: 4414279 - DNA, 13 bp, Homo sapiens
agagacaggcagc

SEQ ID NO: 4414280 - DNA, 15 bp, Homo sapiens
agagacaggcagccc

SEQ ID NO: 4414281 - DNA, 17 bp, Homo sapiens
agagacaggcagcccag

SEQ ID NO: 4414282 - DNA, 21 bp, Homo sapiens
agagacaggcagcccagcagt

SEQ ID NO: 4414283 - DNA, 15 bp, Homo sapiens
agagacagttctctg

SEQ ID NO: 4414284 - DNA, 16 bp, Homo sapiens
agagacagttctctgt

SEQ ID NO: 4414285 - DNA, 24 bp, Homo sapiens
agagacatctttgggcctgtccct

SEQ ID NO: 4414286 - DNA, 13 bp, Homo sapiens
agagaccacacca

SEQ ID NO: 4414287 - DNA, 12 bp, Homo sapiens
agagacccaagg

SEQ ID NO: 4414288 - DNA, 14 bp, Homo sapiens
agagacccaaggag

SEQ ID NO: 4414289 - DNA, 21 bp, Homo sapiens
agagacccaaggaggaaaaac

SEQ ID NO: 4414290 - DNA, 14 bp, Homo sapiens
agagacccccaggc

SEQ ID NO: 4414291 - DNA, 18 bp, Homo sapiens
agagacgccctatttcta

SEQ ID NO: 4414292 - DNA, 21 bp, Homo sapiens
agagacgccctatttctatgt

SEQ ID NO: 4414293 - DNA, 18 bp, Homo sapiens
agagactcccatgaagcc

SEQ ID NO: 4414294 - DNA, 19 bp, Homo sapiens
agagactcccatgaagcct

SEQ ID NO: 4414295 - DNA, 15 bp, Homo sapiens
agagactgagcagcc

SEQ ID NO: 4414296 - DNA, 16 bp, Homo sapiens
agagactgagcagccg

SEQ ID NO: 4414297 - DNA, 15 bp, Homo sapiens
agagagaaagcatat

SEQ ID NO: 4414298 - DNA, 13 bp, Homo sapiens
agagagagagagg

SEQ ID NO: 4414299 - DNA, 17 bp, Homo sapiens
agagagatgggagctcc

SEQ ID NO: 4414300 - DNA, 18 bp, Homo sapiens
agagagatgggagctcct

SEQ ID NO: 4414301 - DNA, 20 bp, Homo sapiens
agagagcaaagatggcttcc

SEQ ID NO: 4414302 - DNA, 20 bp, Homo sapiens
agagagcaaaggagaaatct

SEQ ID NO: 4414303 - DNA, 16 bp, Homo sapiens
agagagcccttcccag

SEQ ID NO: 4414304 - DNA, 20 bp, Homo sapiens
agagagcccttcccagggca

SEQ ID NO: 4414305 - DNA, 20 bp, Homo sapiens
agagaggatacatttaataa

SEQ ID NO: 4414306 - DNA, 22 bp, Homo sapiens
agagaggatacatttaataaaa

SEQ ID NO: 4414307 - DNA, 12 bp, Homo sapiens
agagaggccatt

SEQ ID NO: 4414308 - DNA, 14 bp, Homo sapiens
agagaggtaaaggg

SEQ ID NO: 4414309 - DNA, 16 bp, Homo sapiens
agagaggtggatcctg

SEQ ID NO: 4414310 - DNA, 21 bp, Homo sapiens
agagaggtggggatcctgcct

SEQ ID NO: 4414311 - DNA, 20 bp, Homo sapiens
agagagtgtgtgtttgtgtg

SEQ ID NO: 4414312 - DNA, 21 bp, Homo sapiens
agagataaagcttaggtcaaa

SEQ ID NO: 4414313 - DNA, 17 bp, Homo sapiens
agagatagcttctcttc

SEQ ID NO: 4414314 - DNA, 16 bp, Homo sapiens
agagataggaaactga

SEQ ID NO: 4414315 - DNA, 22 bp, Homo sapiens
agagatatttaggaaaatgctt

SEQ ID NO: 4414316 - DNA, 13 bp, Homo sapiens
agagatattttgt

SEQ ID NO: 4414317 - DNA, 15 bp, Homo sapiens
agagatattttgtaa

SEQ ID NO: 4414318 - DNA, 19 bp, Homo sapiens
agagatccctgcagaaccc

SEQ ID NO: 4414319 - DNA, 14 bp, Homo sapiens
agagatctacacat

SEQ ID NO: 4414320 - DNA, 18 bp, Homo sapiens
agagatctacacatgttg

SEQ ID NO: 4414321 - DNA, 15 bp, Homo sapiens
agagatgaaataatt

SEQ ID NO: 4414322 - DNA, 12 bp, Homo sapiens
agagatgcctcc

SEQ ID NO: 4414323 - DNA, 21 bp, Homo sapiens
agagatgcctccaccgctgcc

SEQ ID NO: 4414324 - DNA, 14 bp, Homo sapiens
agagatggaaaaaa

SEQ ID NO: 4414325 - DNA, 19 bp, Homo sapiens
agagatgggagctcctctc

SEQ ID NO: 4414326 - DNA, 21 bp, Homo sapiens
agagatgggagctcctctcct

SEQ ID NO: 4414327 - DNA, 17 bp, Homo sapiens
agagatgtgcacccatg

SEQ ID NO: 4414328 - DNA, 19 bp, Homo sapiens
agagattacctcctgagaa

SEQ ID NO: 4414329 - DNA, 20 bp, Homo sapiens
agagattacctcctgagaaa

SEQ ID NO: 4414330 - DNA, 15 bp, Homo sapiens
agagattcattttct

SEQ ID NO: 4414331 - DNA, 18 bp, Homo sapiens
agagattcattttctaga

SEQ ID NO: 4414332 - DNA, 17 bp, Homo sapiens
agagattggatcaagta

SEQ ID NO: 4414333 - DNA, 21 bp, Homo sapiens
agagattggatcaagtattac

SEQ ID NO: 4414334 - DNA, 16 bp, Homo sapiens
agagattgtggtggtg

SEQ ID NO: 4414335 - DNA, 12 bp, Homo sapiens
agagcaagaagg

SEQ ID NO: 4414336 - DNA, 22 bp, Homo sapiens
agagcactttaaaaacaggcca

SEQ ID NO: 4414337 - DNA, 12 bp, Homo sapiens
agagcagacagg

SEQ ID NO: 4414338 - DNA, 16 bp, Homo sapiens
agagcagagcctacag

SEQ ID NO: 4414339 - DNA, 21 bp, Homo sapiens
agagcagcattcccagggacc

SEQ ID NO: 4414340 - DNA, 22 bp, Homo sapiens
agagcagcattcccagggacct

SEQ ID NO: 4414341 - DNA, 17 bp, Homo sapiens
agagcagcctgtggcat

SEQ ID NO: 4414342 - DNA, 19 bp, Homo sapiens
agagcagcctgtggcatct

SEQ ID NO: 4414343 - DNA, 19 bp, Homo sapiens
agagcagctccctttctca

SEQ ID NO: 4414344 - DNA, 22 bp, Homo sapiens
agagcagctccctttctcagga

SEQ ID NO: 4414345 - DNA, 15 bp, Homo sapiens
agagcaggactccag

SEQ ID NO: 4414346 - DNA, 22 bp, Homo sapiens
agagcaggactccaggcccaag

SEQ ID NO: 4414347 - DNA, 15 bp, Homo sapiens
agagcaggggctcca

SEQ ID NO: 4414348 - DNA, 17 bp, Homo sapiens
agaatagccacatttgg

SEQ ID NO: 4414349 - DNA, 20 bp, Homo sapiens
agaataggcagggggccctg

SEQ ID NO: 4414350 - DNA, 18 bp, Homo sapiens
agaataggggagccaagg

SEQ ID NO: 4414351 - DNA, 21 bp, Homo sapiens
agaataggggagccaaggagg

SEQ ID NO: 4414352 - DNA, 13 bp, Homo sapiens
agaatagtttaca

SEQ ID NO: 4414353 - DNA, 12 bp, Homo sapiens
agaatatatata

SEQ ID NO: 4414354 - DNA, 23 bp, Homo sapiens
agaatattcagacaaaatggata

SEQ ID NO: 4414355 - DNA, 15 bp, Homo sapiens
agaatattgtattgt

SEQ ID NO: 4414356 - DNA, 16 bp, Homo sapiens
agaatattgtattgtt

SEQ ID NO: 4414357 - DNA, 21 bp, Homo sapiens
agaatatttttatatttcctt

SEQ ID NO: 4414358 - DNA, 23 bp, Homo sapiens
agaatcaacatttctcaataatt

SEQ ID NO: 4414359 - DNA, 16 bp, Homo sapiens
agaatcaatttaagtg

SEQ ID NO: 4414360 - DNA, 18 bp, Homo sapiens
agaatcactgctccaggc

SEQ ID NO: 4414361 - DNA, 14 bp, Homo sapiens
agaatcacttgaac

SEQ ID NO: 4414362 - DNA, 11 bp, Homo sapiens
agaatcagaat

SEQ ID NO: 4414363 - DNA, 12 bp, Homo sapiens
agaatcagaata

SEQ ID NO: 4414364 - DNA, 13 bp, Homo sapiens
agaatcagaataa

SEQ ID NO: 4414365 - DNA, 23 bp, Homo sapiens
agaatcagagaaggaacataccc

SEQ ID NO: 4414366 - DNA, 22 bp, Homo sapiens
agaatcatacttaacatttcat

SEQ ID NO: 4414367 - DNA, 14 bp, Homo sapiens
agaatcattattta

SEQ ID NO: 4414368 - DNA, 22 bp, Homo sapiens
agaatcattatttattaaattt

SEQ ID NO: 4414369 - DNA, 15 bp, Homo sapiens
agaatcccaaatttg

SEQ ID NO: 4414370 - DNA, 18 bp, Homo sapiens
agaatcccaaatttgatt

SEQ ID NO: 4414371 - DNA, 16 bp, Homo sapiens
agaatccgtattgaat

SEQ ID NO: 4414372 - DNA, 17 bp, Homo sapiens
agaatccgtattgaatt

SEQ ID NO: 4414373 - DNA, 22 bp, Homo sapiens
agaatccgtattgaatttgtgt

SEQ ID NO: 4414374 - DNA, 17 bp, Homo sapiens
agaatctagaagatgtg

SEQ ID NO: 4414375 - DNA, 18 bp, Homo sapiens
agaatctagaagatgtgt

SEQ ID NO: 4414376 - DNA, 23 bp, Homo sapiens
agaatctcttcatgcttgacata

SEQ ID NO: 4414377 - DNA, 19 bp, Homo sapiens
agaatcttgttttgaaaat

SEQ ID NO: 4414378 - DNA, 21 bp, Homo sapiens
agaatgaatttatctttacca

SEQ ID NO: 4414379 - DNA, 21 bp, Homo sapiens
agaatgactatataatttatt

SEQ ID NO: 4414380 - DNA, 14 bp, Homo sapiens
agaatgagacatcc

SEQ ID NO: 4414381 - DNA, 16 bp, Homo sapiens
agaatgagcacccatt

SEQ ID NO: 4414382 - DNA, 13 bp, Homo sapiens
agaatgatgctca

SEQ ID NO: 4414383 - DNA, 13 bp, Homo sapiens
agaatgctgtaca

SEQ ID NO: 4414384 - DNA, 14 bp, Homo sapiens
agaatgcttaatca

SEQ ID NO: 4414385 - DNA, 18 bp, Homo sapiens
agaatggaagagagaaag

SEQ ID NO: 4414386 - DNA, 19 bp, Homo sapiens
agaatggtgtgaacccggg

SEQ ID NO: 4414387 - DNA, 19 bp, Homo sapiens
agaatgtaaagttatgtat

SEQ ID NO: 4414388 - DNA, 15 bp, Homo sapiens
agaatgtaagaacta

SEQ ID NO: 4414389 - DNA, 22 bp, Homo sapiens
agaatgtacagttgagctcagg

SEQ ID NO: 4414390 - DNA, 16 bp, Homo sapiens
agaatgtatttgctga

SEQ ID NO: 4414391 - DNA, 18 bp, Homo sapiens
agaatgtcagattccttt

SEQ ID NO: 4414392 - DNA, 21 bp, Homo sapiens
agaatgtcagattcctttccc

SEQ ID NO: 4414393 - DNA, 20 bp, Homo sapiens
agaatgtcaggaatttaaga

SEQ ID NO: 4414394 - DNA, 15 bp, Homo sapiens
agaatgtcagtatgt

SEQ ID NO: 4414395 - DNA, 17 bp, Homo sapiens
agaatgtcagtatgtgg

SEQ ID NO: 4414396 - DNA, 23 bp, Homo sapiens
agaatgtcattttggtactttgg

SEQ ID NO: 4414397 - DNA, 21 bp, Homo sapiens
agaatgtctgaagtacaaaca

SEQ ID NO: 4414398 - DNA, 16 bp, Homo sapiens
agaatgtgaaaaagga

SEQ ID NO: 4414399 - DNA, 19 bp, Homo sapiens
agaatgtgaaaaaggaata

SEQ ID NO: 4414400 - DNA, 17 bp, Homo sapiens
agaatgtgttcttttct

SEQ ID NO: 4414401 - DNA, 20 bp, Homo sapiens
agaatgtgttcttttctcct

SEQ ID NO: 4414402 - DNA, 13 bp, Homo sapiens
agaatgtttcatt

SEQ ID NO: 4414403 - DNA, 12 bp, Homo sapiens
agaatgttttca

SEQ ID NO: 4414404 - DNA, 16 bp, Homo sapiens
agaattaaaatttatt

SEQ ID NO: 4414405 - DNA, 18 bp, Homo sapiens
agaattaccatttgttaa

SEQ ID NO: 4414406 - DNA, 19 bp, Homo sapiens
agaattaccatttgttaat

SEQ ID NO: 4414407 - DNA, 18 bp, Homo sapiens
agaattatctaatttata

SEQ ID NO: 4414408 - DNA, 21 bp, Homo sapiens
agaattcaaaagtgattatct

SEQ ID NO: 4414409 - DNA, 20 bp, Homo sapiens
agaattcaaatcctcttttg

SEQ ID NO: 4414410 - DNA, 12 bp, Homo sapiens
agaattcaaatt

SEQ ID NO: 4414411 - DNA, 16 bp, Homo sapiens
agaattccaaagcaaa

SEQ ID NO: 4414412 - DNA, 16 bp, Homo sapiens
agaattcggtgtgctg

SEQ ID NO: 4414413 - DNA, 22 bp, Homo sapiens
agaattcggtgtgctgccaact

SEQ ID NO: 4414414 - DNA, 17 bp, Homo sapiens
agaattgagtgtttaaa

SEQ ID NO: 4414415 - DNA, 19 bp, Homo sapiens
agaattgcacacagatgtg

SEQ ID NO: 4414416 - DNA, 20 bp, Homo sapiens
agaattgtgtcagactgttt

SEQ ID NO: 4414417 - DNA, 23 bp, Homo sapiens
agaattgtgtcagactgtttagt

SEQ ID NO: 4414418 - DNA, 20 bp, Homo sapiens
agaatttagatcttatattg

SEQ ID NO: 4414419 - DNA, 20 bp, Homo sapiens
agaatttcctgtaatatatt

SEQ ID NO: 4414420 - DNA, 14 bp, Homo sapiens
agaatttctaaagt

SEQ ID NO: 4414421 - DNA, 19 bp, Homo sapiens
agaatttgaagacttcaaa

SEQ ID NO: 4414422 - DNA, 19 bp, Homo sapiens
agaatttgtttcatctatt

SEQ ID NO: 4414423 - DNA, 20 bp, Homo sapiens
agaatttgtttcatctattt

SEQ ID NO: 4414424 - DNA, 22 bp, Homo sapiens
agaattttcatcccgtatcaca

SEQ ID NO: 4414425 - DNA, 23 bp, Homo sapiens
agaatttttttttaaattttatt

SEQ ID NO: 4414426 - DNA, 12 bp, Homo sapiens
agacaaaaacaa

SEQ ID NO: 4414427 - DNA, 23 bp, Homo sapiens
agacaaaaacaagtaaatatata

SEQ ID NO: 4414428 - DNA, 12 bp, Homo sapiens
agacaaaaagta

SEQ ID NO: 4414429 - DNA, 14 bp, Homo sapiens
agacaaaatgaaag

SEQ ID NO: 4414430 - DNA, 14 bp, Homo sapiens
agacaaagatttct

SEQ ID NO: 4414431 - DNA, 23 bp, Homo sapiens
agacaaattactgataaaaatga

SEQ ID NO: 4414432 - DNA, 17 bp, Homo sapiens
agacaacagcacacagg

SEQ ID NO: 4414433 - DNA, 19 bp, Homo sapiens
agacaaccagatcaggaga

SEQ ID NO: 4414434 - DNA, 21 bp, Homo sapiens
agacaaccagatcaggagagc

SEQ ID NO: 4414435 - DNA, 21 bp, Homo sapiens
agacaagaacattctctcata

SEQ ID NO: 4414436 - DNA, 19 bp, Homo sapiens
agacaagagatctacacat

SEQ ID NO: 4414437 - DNA, 15 bp, Homo sapiens
agacaagagatggga

SEQ ID NO: 4414438 - DNA, 15 bp, Homo sapiens
agacaaggtgctaac

SEQ ID NO: 4414439 - DNA, 15 bp, Homo sapiens
agacaagtaatttca

SEQ ID NO: 4414440 - DNA, 22 bp, Homo sapiens
agacaagtaatttcagtgtaaa

SEQ ID NO: 4414441 - DNA, 12 bp, Homo sapiens
agacaataaacc

SEQ ID NO: 4414442 - DNA, 17 bp, Homo sapiens
agacaataaaccctcag

SEQ ID NO: 4414443 - DNA, 14 bp, Homo sapiens
agacaatagtattt

SEQ ID NO: 4414444 - DNA, 17 bp, Homo sapiens
agacaatagtatttctc

SEQ ID NO: 4414445 - DNA, 15 bp, Homo sapiens
agacaatcattgttt

SEQ ID NO: 4414446 - DNA, 23 bp, Homo sapiens
agacaatcattgttttgaatatt

SEQ ID NO: 4414447 - DNA, 21 bp, Homo sapiens
agacaattcctccagagacac

SEQ ID NO: 4414448 - DNA, 24 bp, Homo sapiens
agacaattttcataacttgataaa

SEQ ID NO: 4414449 - DNA, 18 bp, Homo sapiens
agaccctgtctcaataaa

SEQ ID NO: 4414450 - DNA, 14 bp, Homo sapiens
agaccgatccttcc

SEQ ID NO: 4414451 - DNA, 17 bp, Homo sapiens
agaccgctctcttttct

SEQ ID NO: 4414452 - DNA, 18 bp, Homo sapiens
agacctagcaggctgttc

SEQ ID NO: 4414453 - DNA, 20 bp, Homo sapiens
agacctagcaggctgttcca

SEQ ID NO: 4414454 - DNA, 18 bp, Homo sapiens
agacctcagccatgagga

SEQ ID NO: 4414455 - DNA, 15 bp, Homo sapiens
agacctctccttcct

SEQ ID NO: 4414456 - DNA, 19 bp, Homo sapiens
agacctgacccttctctca

SEQ ID NO: 4414457 - DNA, 12 bp, Homo sapiens
agacctgccagc

SEQ ID NO: 4414458 - DNA, 17 bp, Homo sapiens
agacctgccagccactg

SEQ ID NO: 4414459 - DNA, 17 bp, Homo sapiens
agacctgtcctcctggt

SEQ ID NO: 4414460 - DNA, 18 bp, Homo sapiens
agacctttctagacatca

SEQ ID NO: 4414461 - DNA, 22 bp, Homo sapiens
agaccttttttttttttccaat

SEQ ID NO: 4414462 - DNA, 16 bp, Homo sapiens
agacgagacaacagca

SEQ ID NO: 4414463 - DNA, 17 bp, Homo sapiens
agacgaggccctcgggc

SEQ ID NO: 4414464 - DNA, 17 bp, Homo sapiens
agacgccactccctggg

SEQ ID NO: 4414465 - DNA, 18 bp, Homo sapiens
agacgccactccctggga

SEQ ID NO: 4414466 - DNA, 14 bp, Homo sapiens
agacgcccctccca

SEQ ID NO: 4414467 - DNA, 16 bp, Homo sapiens
agacgccctatttcta

SEQ ID NO: 4414468 - DNA, 13 bp, Homo sapiens
agacgcctgagga

SEQ ID NO: 4414469 - DNA, 20 bp, Homo sapiens
agacgccttcatctgggaca

SEQ ID NO: 4414470 - DNA, 21 bp, Homo sapiens
agacgccttcatctgggacaa

SEQ ID NO: 4414471 - DNA, 16 bp, Homo sapiens
agacgctgccgctgcc

SEQ ID NO: 4414472 - DNA, 13 bp, Homo sapiens
agaaacaaagatg

SEQ ID NO: 4414473 - DNA, 15 bp, Homo sapiens
agaaacaccattcat

SEQ ID NO: 4414474 - DNA, 15 bp, Homo sapiens
agaaacactgaaaag

SEQ ID NO: 4414475 - DNA, 17 bp, Homo sapiens
agaaacactgaaaagaa

SEQ ID NO: 4414476 - DNA, 21 bp, Homo sapiens
agaaacagggacaaagaaatc

SEQ ID NO: 4414477 - DNA, 18 bp, Homo sapiens
agaaacagttggtaactt

SEQ ID NO: 4414478 - DNA, 21 bp, Homo sapiens
agaaaccaaactaggagatga

SEQ ID NO: 4414479 - DNA, 15 bp, Homo sapiens
agaaaccagaaaagc

SEQ ID NO: 4414480 - DNA, 13 bp, Homo sapiens
agaaaccctgtct

SEQ ID NO: 4414481 - DNA, 15 bp, Homo sapiens
agaaaccttgctctc

SEQ ID NO: 4414482 - DNA, 16 bp, Homo sapiens
agaaacgtaaactatg

SEQ ID NO: 4414483 - DNA, 16 bp, Homo sapiens
agaaacgtcttctaaa

SEQ ID NO: 4414484 - DNA, 16 bp, Homo sapiens
agaaactaaacagaaa

SEQ ID NO: 4414485 - DNA, 20 bp, Homo sapiens
agaaactccgaagaaaagaa

SEQ ID NO: 4414486 - DNA, 13 bp, Homo sapiens
agaaactggaact

SEQ ID NO: 4414487 - DNA, 15 bp, Homo sapiens
agaaactggaactct

SEQ ID NO: 4414488 - DNA, 13 bp, Homo sapiens
agaaactgtccaa

SEQ ID NO: 4414489 - DNA, 20 bp, Homo sapiens
agaaacttaaatgttattat

SEQ ID NO: 4414490 - DNA, 12 bp, Homo sapiens
agaaacttgcag

SEQ ID NO: 4414491 - DNA, 18 bp, Homo sapiens
agaaacttgtaaatatct

SEQ ID NO: 4414492 - DNA, 18 bp, Homo sapiens
agaaactttctggtgctg

SEQ ID NO: 4414493 - DNA, 15 bp, Homo sapiens
agaaactttctttct

SEQ ID NO: 4414494 - DNA, 14 bp, Homo sapiens
agaaagaaaatcag

SEQ ID NO: 4414495 - DNA, 15 bp, Homo sapiens
agaaagaaagggaaa

SEQ ID NO: 4414496 - DNA, 22 bp, Homo sapiens
agaaagaaagtacccagcaaat

SEQ ID NO: 4414497 - DNA, 12 bp, Homo sapiens
agaaagaagcca

SEQ ID NO: 4414498 - DNA, 11 bp, Homo sapiens
agaaagaatgc

SEQ ID NO: 4414499 - DNA, 17 bp, Homo sapiens
agaaagagaaacagttg

SEQ ID NO: 4414500 - DNA, 20 bp, Homo sapiens
agaaagatgtatataggtgt

SEQ ID NO: 4414501 - DNA, 16 bp, Homo sapiens
agaaagatttgatggg

SEQ ID NO: 4414502 - DNA, 16 bp, Homo sapiens
agaaagatttgatgta

SEQ ID NO: 4414503 - DNA, 11 bp, Homo sapiens
agaaagcactt

SEQ ID NO: 4414504 - DNA, 22 bp, Homo sapiens
agaaagcatccctcacccatcc

SEQ ID NO: 4414505 - DNA, 12 bp, Homo sapiens
agaaagccacgc

SEQ ID NO: 4414506 - DNA, 14 bp, Homo sapiens
agaaagccacgccc

SEQ ID NO: 4414507 - DNA, 18 bp, Homo sapiens
agaaagccacgccctccc

SEQ ID NO: 4414508 - DNA, 19 bp, Homo sapiens
agaaagccacgccctccct

SEQ ID NO: 4414509 - DNA, 18 bp, Homo sapiens
agaaagcctgttgtttaa

SEQ ID NO: 4414510 - DNA, 12 bp, Homo sapiens
agaaagctaaat

SEQ ID NO: 4414511 - DNA, 18 bp, Homo sapiens
agaaagctccttccagac

SEQ ID NO: 4414512 - DNA, 14 bp, Homo sapiens
agaaagctgacatt

SEQ ID NO: 4414513 - DNA, 15 bp, Homo sapiens
agaaaggaagcattg

SEQ ID NO: 4414514 - DNA, 18 bp, Homo sapiens
agaaaggaagcattgtaa

SEQ ID NO: 4414515 - DNA, 21 bp, Homo sapiens
agaaaggaagcattgtaaaat

SEQ ID NO: 4414516 - DNA, 18 bp, Homo sapiens
agaaaggacagagccagc

SEQ ID NO: 4414517 - DNA, 15 bp, Homo sapiens
agaaagggaggccca

SEQ ID NO: 4414518 - DNA, 17 bp, Homo sapiens
agaaagggaggcccagc

SEQ ID NO: 4414519 - DNA, 16 bp, Homo sapiens
agaaaggggagaatgt

SEQ ID NO: 4414520 - DNA, 22 bp, Homo sapiens
agaaagtaaggtgcttggagtt

SEQ ID NO: 4414521 - DNA, 23 bp, Homo sapiens
agaaagtacccagcaaatgggca

SEQ ID NO: 4414522 - DNA, 23 bp, Homo sapiens
agaaagtgaagcaaatcagaaac

SEQ ID NO: 4414523 - DNA, 17 bp, Homo sapiens
agaaagtgggggtggag

SEQ ID NO: 4414524 - DNA, 17 bp, Homo sapiens
agaaagtgtatttggaa

SEQ ID NO: 4414525 - DNA, 16 bp, Homo sapiens
agaaagtgtgagcaaa

SEQ ID NO: 4414526 - DNA, 17 bp, Homo sapiens
agaaagtgtgagcaaac

SEQ ID NO: 4414527 - DNA, 14 bp, Homo sapiens
agaaataaatatac

SEQ ID NO: 4414528 - DNA, 18 bp, Homo sapiens
agaaataatgcctccaat

SEQ ID NO: 4414529 - DNA, 12 bp, Homo sapiens
agaaatacagtc

SEQ ID NO: 4414530 - DNA, 16 bp, Homo sapiens
agaaatagaattataa

SEQ ID NO: 4414531 - DNA, 17 bp, Homo sapiens
agaaatagacaaaaagt

SEQ ID NO: 4414532 - DNA, 18 bp, Homo sapiens
agaaatagacaaaaagta

SEQ ID NO: 4414533 - DNA, 15 bp, Homo sapiens
agaaatagtcggtga

SEQ ID NO: 4414534 - DNA, 15 bp, Homo sapiens
agaaatatacagttt

SEQ ID NO: 4414535 - DNA, 21 bp, Homo sapiens
agaaatatacagtttgacttt

SEQ ID NO: 4414536 - DNA, 17 bp, Homo sapiens
agaaatatctgtgaaat

SEQ ID NO: 4414537 - DNA, 14 bp, Homo sapiens
agaaatcaaaagaa

SEQ ID NO: 4414538 - DNA, 23 bp, Homo sapiens
agaaatcaacaggagggcagccc

SEQ ID NO: 4414539 - DNA, 13 bp, Homo sapiens
agaaatcagaatt

SEQ ID NO: 4414540 - DNA, 14 bp, Homo sapiens
agaaatcatagctg

SEQ ID NO: 4414541 - DNA, 16 bp, Homo sapiens
agaaatcatgtccata

SEQ ID NO: 4414542 - DNA, 20 bp, Homo sapiens
agaaatccccccttcagaac

SEQ ID NO: 4414543 - DNA, 15 bp, Homo sapiens
agaaatctaagctgt

SEQ ID NO: 4414544 - DNA, 14 bp, Homo sapiens
agaaatgaaagcag

SEQ ID NO: 4414545 - DNA, 16 bp, Homo sapiens
agaaatgaacaaggca

SEQ ID NO: 4414546 - DNA, 13 bp, Homo sapiens
agaaatgaacatt

SEQ ID NO: 4414547 - DNA, 21 bp, Homo sapiens
agaaatgcaataactctggga

SEQ ID NO: 4414548 - DNA, 21 bp, Homo sapiens
agaaatgtttatggaaatatt

SEQ ID NO: 4414549 - DNA, 14 bp, Homo sapiens
agaaattaaatctg

SEQ ID NO: 4414550 - DNA, 19 bp, Homo sapiens
agaaattacctgtggatat

SEQ ID NO: 4414551 - DNA, 20 bp, Homo sapiens
agaaattacctgtggatatt

SEQ ID NO: 4414552 - DNA, 20 bp, Homo sapiens
agaaattactaattttactt

SEQ ID NO: 4414553 - DNA, 16 bp, Homo sapiens
agaaattagatttgtg

SEQ ID NO: 4414554 - DNA, 14 bp, Homo sapiens
agaaattattttct

SEQ ID NO: 4414555 - DNA, 13 bp, Homo sapiens
agaaattcaagaa

SEQ ID NO: 4414556 - DNA, 19 bp, Homo sapiens
agaaattcaagaagtattt

SEQ ID NO: 4414557 - DNA, 22 bp, Homo sapiens
agaaattcaatttggatttaaa

SEQ ID NO: 4414558 - DNA, 23 bp, Homo sapiens
agaaattcgtgtgtttttttatg

SEQ ID NO: 4414559 - DNA, 16 bp, Homo sapiens
agaaattggtacatag

SEQ ID NO: 4414560 - DNA, 14 bp, Homo sapiens
agaaattgtatatt

SEQ ID NO: 4414561 - DNA, 20 bp, Homo sapiens
agaaattgtatattgtaatt

SEQ ID NO: 4414562 - DNA, 13 bp, Homo sapiens
agaaatttaaact

SEQ ID NO: 4414563 - DNA, 13 bp, Homo sapiens
agaaattttagta

SEQ ID NO: 4414564 - DNA, 14 bp, Homo sapiens
agaacaagaaatgg

SEQ ID NO: 4414565 - DNA, 14 bp, Homo sapiens
agaacacgcgtatt

SEQ ID NO: 4414566 - DNA, 13 bp, Homo sapiens
agaacactaacct

SEQ ID NO: 4414567 - DNA, 17 bp, Homo sapiens
agaacactattttcaga

SEQ ID NO: 4414568 - DNA, 18 bp, Homo sapiens
agaacagtggaaactatg

SEQ ID NO: 4414569 - DNA, 18 bp, Homo sapiens
agaacatctgtcctgtga

SEQ ID NO: 4414570 - DNA, 19 bp, Homo sapiens
agaacatgcagtttgaaat

SEQ ID NO: 4414571 - DNA, 22 bp, Homo sapiens
agaacatgtgagaggtttgact

SEQ ID NO: 4414572 - DNA, 19 bp, Homo sapiens
agaacattcacttttgtta

SEQ ID NO: 4414573 - DNA, 21 bp, Homo sapiens
agaacattcgaatctctgccc

SEQ ID NO: 4414574 - DNA, 15 bp, Homo sapiens
agaacattgatctgt

SEQ ID NO: 4414575 - DNA, 18 bp, Homo sapiens
agaacattgatctgtttt

SEQ ID NO: 4414576 - DNA, 20 bp, Homo sapiens
agaaccaaactcctatttca

SEQ ID NO: 4414577 - DNA, 16 bp, Homo sapiens
agaaccaaatacctca

SEQ ID NO: 4414578 - DNA, 18 bp, Homo sapiens
agaaccaactgcattggt

SEQ ID NO: 4414579 - DNA, 18 bp, Homo sapiens
agaaccagccgtatttta

SEQ ID NO: 4414580 - DNA, 19 bp, Homo sapiens
agaaccagccgtattttac

SEQ ID NO: 4414581 - DNA, 16 bp, Homo sapiens
agaaccaggctacaag

SEQ ID NO: 4414582 - DNA, 16 bp, Homo sapiens
agaaccagtctcctca

SEQ ID NO: 4414583 - DNA, 14 bp, Homo sapiens
agaaccatttcacc

SEQ ID NO: 4414584 - DNA, 21 bp, Homo sapiens
agaacccatggaaaaatgcca

SEQ ID NO: 4414585 - DNA, 20 bp, Homo sapiens
agaataaaatgtttctctct

SEQ ID NO: 4414586 - DNA, 20 bp, Homo sapiens
agaataaaattgcctctctc

SEQ ID NO: 4414587 - DNA, 18 bp, Homo sapiens
agaataaaggcagttttc

SEQ ID NO: 4414588 - DNA, 20 bp, Homo sapiens
agaataaaggcagttttcta

SEQ ID NO: 4414589 - DNA, 14 bp, Homo sapiens
agaataaatccttg

SEQ ID NO: 4414590 - DNA, 15 bp, Homo sapiens
agaataaattgattt

SEQ ID NO: 4414591 - DNA, 23 bp, Homo sapiens
agaataagacaagagatctacac

SEQ ID NO: 4414592 - DNA, 15 bp, Homo sapiens
agaataaggcttttt

SEQ ID NO: 4414593 - DNA, 14 bp, Homo sapiens
agaataagttattg

SEQ ID NO: 4414594 - DNA, 16 bp, Homo sapiens
agaataagttattgca

SEQ ID NO: 4414595 - DNA, 17 bp, Homo sapiens
agaataagttattgcag

SEQ ID NO: 4414596 - DNA, 19 bp, Homo sapiens
agaataagttattgcagtt

SEQ ID NO: 4414597 - DNA, 13 bp, Homo sapiens
agaataatttata

SEQ ID NO: 4414598 - DNA, 17 bp, Homo sapiens
agaatagaacacagttt

SEQ ID NO: 4414599 - DNA, 12 bp, Homo sapiens
actctgtaattg

SEQ ID NO: 4414600 - DNA, 17 bp, Homo sapiens
actctgtccctgtcctt

SEQ ID NO: 4414601 - DNA, 21 bp, Homo sapiens
actctgtccctgtccttccct

SEQ ID NO: 4414602 - DNA, 17 bp, Homo sapiens
actctgtctcagtccat

SEQ ID NO: 4414603 - DNA, 23 bp, Homo sapiens
actctgtgtggctgtgcaatttc

SEQ ID NO: 4414604 - DNA, 15 bp, Homo sapiens
actcttaagcaatgg

SEQ ID NO: 4414605 - DNA, 22 bp, Homo sapiens
actcttacgaatattttcagta

SEQ ID NO: 4414606 - DNA, 14 bp, Homo sapiens
actcttactcctta

SEQ ID NO: 4414607 - DNA, 17 bp, Homo sapiens
actcttatttctttcct

SEQ ID NO: 4414608 - DNA, 16 bp, Homo sapiens
actcttcccttcccct

SEQ ID NO: 4414609 - DNA, 15 bp, Homo sapiens
actcttctgactgcc

SEQ ID NO: 4414610 - DNA, 13 bp, Homo sapiens
actcttctgtctt

SEQ ID NO: 4414611 - DNA, 13 bp, Homo sapiens
actcttgatctct

SEQ ID NO: 4414612 - DNA, 20 bp, Homo sapiens
actcttgatttcacatttct

SEQ ID NO: 4414613 - DNA, 21 bp, Homo sapiens
actcttgatttcacatttcta

SEQ ID NO: 4414614 - DNA, 18 bp, Homo sapiens
actctttatagtgcacaa

SEQ ID NO: 4414615 - DNA, 20 bp, Homo sapiens
actctttatcaagcaacatt

SEQ ID NO: 4414616 - DNA, 23 bp, Homo sapiens
actctttcggtaggtggaagcta

SEQ ID NO: 4414617 - DNA, 21 bp, Homo sapiens
actctttctctcccctcctct

SEQ ID NO: 4414618 - DNA, 18 bp, Homo sapiens
actctttctgaaggaaga

SEQ ID NO: 4414619 - DNA, 21 bp, Homo sapiens
actctttctgaaggaagagaa

SEQ ID NO: 4414620 - DNA, 17 bp, Homo sapiens
acttcttcatccataga

SEQ ID NO: 4414621 - DNA, 16 bp, Homo sapiens
acttcttctgtaatat

SEQ ID NO: 4414622 - DNA, 12 bp, Homo sapiens
acttcttgaaaa

SEQ ID NO: 4414623 - DNA, 19 bp, Homo sapiens
acttcttgaaaaagatggc

SEQ ID NO: 4414624 - DNA, 23 bp, Homo sapiens
acttcttgaatataaaaaatcat

SEQ ID NO: 4414625 - DNA, 11 bp, Homo sapiens
acttcttgctt

SEQ ID NO: 4414626 - DNA, 20 bp, Homo sapiens
acttctttgttattataaca

SEQ ID NO: 4414627 - DNA, 21 bp, Homo sapiens
acttgaacaaaagggtcagag

SEQ ID NO: 4414628 - DNA, 14 bp, Homo sapiens
acttgaacaaagac

SEQ ID NO: 4414629 - DNA, 22 bp, Homo sapiens
acttgaacccgggggacagagg

SEQ ID NO: 4414630 - DNA, 14 bp, Homo sapiens
acttgaacttgcct

SEQ ID NO: 4414631 - DNA, 15 bp, Homo sapiens
acttgaacttgcctc

SEQ ID NO: 4414632 - DNA, 12 bp, Homo sapiens
acttgaacttgt

SEQ ID NO: 4414633 - DNA, 15 bp, Homo sapiens
acttgaactttccaa

SEQ ID NO: 4414634 - DNA, 21 bp, Homo sapiens
acttgaagcctaaatttgtgc

SEQ ID NO: 4414635 - DNA, 16 bp, Homo sapiens
acttgaatagtattgt

SEQ ID NO: 4414636 - DNA, 18 bp, Homo sapiens
acttgaatagtattgtgt

SEQ ID NO: 4414637 - DNA, 12 bp, Homo sapiens
acttgaatcaga

SEQ ID NO: 4414638 - DNA, 22 bp, Homo sapiens
acttgaatcagatggtgtcatt

SEQ ID NO: 4414639 - DNA, 23 bp, Homo sapiens
acttgaatcagatggtgtcattt

SEQ ID NO: 4414640 - DNA, 24 bp, Homo sapiens
acttgaatcagatggtgtcattta

SEQ ID NO: 4414641 - DNA, 20 bp, Homo sapiens
acttgaatgaaaatgtccat

SEQ ID NO: 4414642 - DNA, 14 bp, Homo sapiens
acttgactctaata

SEQ ID NO: 4414643 - DNA, 18 bp, Homo sapiens
acttgactctaatatgat

SEQ ID NO: 4414644 - DNA, 13 bp, Homo sapiens
acttgagatgaaa

SEQ ID NO: 4414645 - DNA, 15 bp, Homo sapiens
acttgagatgaaaaa

SEQ ID NO: 4414646 - DNA, 10 bp, Homo sapiens
acttgagcca

SEQ ID NO: 4414647 - DNA, 22 bp, Homo sapiens
acttgaggaggagctggcctgc

SEQ ID NO: 4414648 - DNA, 17 bp, Homo sapiens
acttgatcacatgcttg

SEQ ID NO: 4414649 - DNA, 23 bp, Homo sapiens
acttgcaatccaggctgttctca

SEQ ID NO: 4414650 - DNA, 20 bp, Homo sapiens
acttgcagctttaacctgct

SEQ ID NO: 4414651 - DNA, 21 bp, Homo sapiens
acttgccattccaaaatatta

SEQ ID NO: 4414652 - DNA, 15 bp, Homo sapiens
acttgccctgagcac

SEQ ID NO: 4414653 - DNA, 22 bp, Homo sapiens
acttgccctgagcactcctggt

SEQ ID NO: 4414654 - DNA, 13 bp, Homo sapiens
acttgcctctgca

SEQ ID NO: 4414655 - DNA, 13 bp, Homo sapiens
acttgcctctttt

SEQ ID NO: 4414656 - DNA, 21 bp, Homo sapiens
acttgcctcttttacctgctg

SEQ ID NO: 4414657 - DNA, 22 bp, Homo sapiens
acttgcctcttttacctgctgc

SEQ ID NO: 4414658 - DNA, 17 bp, Homo sapiens
acttgcgagaaattcgt

SEQ ID NO: 4414659 - DNA, 13 bp, Homo sapiens
acttgctccctct

SEQ ID NO: 4414660 - DNA, 18 bp, Homo sapiens
acttgcttctaaatgccc

SEQ ID NO: 4414661 - DNA, 23 bp, Homo sapiens
acttgcttgtattgtaaatgtgg

SEQ ID NO: 4414662 - DNA, 18 bp, Homo sapiens
acttggacccttggaaaa

SEQ ID NO: 4414663 - DNA, 16 bp, Homo sapiens
acttggagactcctgg

SEQ ID NO: 4414664 - DNA, 15 bp, Homo sapiens
acttggaggacctgg

SEQ ID NO: 4414665 - DNA, 14 bp, Homo sapiens
acttggcatacaaa

SEQ ID NO: 4414666 - DNA, 11 bp, Homo sapiens
acttgggatgt

SEQ ID NO: 4414667 - DNA, 20 bp, Homo sapiens
acttgggggttcaggcccgg

SEQ ID NO: 4414668 - DNA, 16 bp, Homo sapiens
acttggtcagagccac

SEQ ID NO: 4414669 - DNA, 22 bp, Homo sapiens
acttggtgcttattgatattct

SEQ ID NO: 4414670 - DNA, 13 bp, Homo sapiens
acttggttttatg

SEQ ID NO: 4414671 - DNA, 17 bp, Homo sapiens
acttggttttatggtta

SEQ ID NO: 4414672 - DNA, 14 bp, Homo sapiens
acttgtaaaatgct

SEQ ID NO: 4414673 - DNA, 14 bp, Homo sapiens
acttgtaagttgct

SEQ ID NO: 4414674 - DNA, 22 bp, Homo sapiens
acttgtacaaacagtatttctg

SEQ ID NO: 4414675 - DNA, 22 bp, Homo sapiens
acttgtatttccaaacctggtt

SEQ ID NO: 4414676 - DNA, 16 bp, Homo sapiens
acttgtcaaagaaggt

SEQ ID NO: 4414677 - DNA, 20 bp, Homo sapiens
acttgtcaagcctgtgcaaa

SEQ ID NO: 4414678 - DNA, 23 bp, Homo sapiens
acttgtcccgggacacctaggct

SEQ ID NO: 4414679 - DNA, 17 bp, Homo sapiens
acttgtctcattttaat

SEQ ID NO: 4414680 - DNA, 20 bp, Homo sapiens
acttgtctcattttaatgta

SEQ ID NO: 4414681 - DNA, 20 bp, Homo sapiens
acttgtctcttcatctaata

SEQ ID NO: 4414682 - DNA, 13 bp, Homo sapiens
acttgtggcctca

SEQ ID NO: 4414683 - DNA, 17 bp, Homo sapiens
acttgtgtattagatat

SEQ ID NO: 4414684 - DNA, 22 bp, Homo sapiens
acttgtgtccctaatgtgttta

SEQ ID NO: 4414685 - DNA, 11 bp, Homo sapiens
acttgtgtctg

SEQ ID NO: 4414686 - DNA, 12 bp, Homo sapiens
acttgtgtgcat

SEQ ID NO: 4414687 - DNA, 13 bp, Homo sapiens
acttgtgtgcatg

SEQ ID NO: 4414688 - DNA, 15 bp, Homo sapiens
acttgtgttcaatct

SEQ ID NO: 4414689 - DNA, 16 bp, Homo sapiens
acttgtgttcaatctg

SEQ ID NO: 4414690 - DNA, 15 bp, Homo sapiens
acttgttccagctct

SEQ ID NO: 4414691 - DNA, 16 bp, Homo sapiens
acttgttccagctctt

SEQ ID NO: 4414692 - DNA, 22 bp, Homo sapiens
acttgtttactcattgaagcag

SEQ ID NO: 4414693 - DNA, 13 bp, Homo sapiens
actttaaattgtg

SEQ ID NO: 4414694 - DNA, 17 bp, Homo sapiens
actttaaggatttgaac

SEQ ID NO: 4414695 - DNA, 19 bp, Homo sapiens
actttaattaccaacctgt

SEQ ID NO: 4414696 - DNA, 19 bp, Homo sapiens
actttagacttcccactgt

SEQ ID NO: 4414697 - DNA, 16 bp, Homo sapiens
actttataactaacat

SEQ ID NO: 4414698 - DNA, 19 bp, Homo sapiens
actttatatctgtaatgat

SEQ ID NO: 4414699 - DNA, 18 bp, Homo sapiens
actttatatcttgtttac

SEQ ID NO: 4414700 - DNA, 16 bp, Homo sapiens
actttatcatgaatgc

SEQ ID NO: 4414701 - DNA, 18 bp, Homo sapiens
actttattataaaatgct

SEQ ID NO: 4414702 - DNA, 16 bp, Homo sapiens
actttatttatttcta

SEQ ID NO: 4414703 - DNA, 23 bp, Homo sapiens
actttattttatataataaagta

SEQ ID NO: 4414704 - DNA, 16 bp, Homo sapiens
actttcaaaatgaatt

SEQ ID NO: 4414705 - DNA, 20 bp, Homo sapiens
actttcaaaatgaattttta

SEQ ID NO: 4414706 - DNA, 20 bp, Homo sapiens
actttcaatattttaacttt

SEQ ID NO: 4414707 - DNA, 16 bp, Homo sapiens
actttcactataatgt

SEQ ID NO: 4414708 - DNA, 19 bp, Homo sapiens
actttcataccacttgaat

SEQ ID NO: 4414709 - DNA, 15 bp, Homo sapiens
actttcatctacctt

SEQ ID NO: 4414710 - DNA, 20 bp, Homo sapiens
actttcatctaccttttctg

SEQ ID NO: 4414711 - DNA, 13 bp, Homo sapiens
actttcatcttaa

SEQ ID NO: 4414712 - DNA, 14 bp, Homo sapiens
actttcatcttaaa

SEQ ID NO: 4414713 - DNA, 15 bp, Homo sapiens
actttcatcttaaac

SEQ ID NO: 4414714 - DNA, 17 bp, Homo sapiens
actttcatcttaaacta

SEQ ID NO: 4414715 - DNA, 18 bp, Homo sapiens
actttcattccttcagat

SEQ ID NO: 4414716 - DNA, 21 bp, Homo sapiens
actttcattgccagtgtcttt

SEQ ID NO: 4414717 - DNA, 20 bp, Homo sapiens
actttcatttttttccaggc

SEQ ID NO: 4414718 - DNA, 16 bp, Homo sapiens
actttccaatgccaca

SEQ ID NO: 4414719 - DNA, 19 bp, Homo sapiens
actttccaatgccacagac

SEQ ID NO: 4414720 - DNA, 15 bp, Homo sapiens
actttcctgtggttt

SEQ ID NO: 4414721 - DNA, 18 bp, Homo sapiens
actttctcagttttcata

SEQ ID NO: 4414722 - DNA, 21 bp, Homo sapiens
actttctccatttaagacaca

SEQ ID NO: 4414723 - DNA, 15 bp, Homo sapiens
actttctctctcttt

SEQ ID NO: 4414724 - DNA, 14 bp, Homo sapiens
actttctctgtgaa

SEQ ID NO: 4414725 - DNA, 17 bp, Homo sapiens
actttctctgtgaaagc

SEQ ID NO: 4414726 - DNA, 18 bp, Homo sapiens
actttctctgtgaaagct

SEQ ID NO: 4414727 - DNA, 17 bp, Homo sapiens
actttctggtgctgtct

SEQ ID NO: 4414728 - DNA, 22 bp, Homo sapiens
actttctgttggattccatgct

SEQ ID NO: 4414729 - DNA, 23 bp, Homo sapiens
actttctgttggattccatgcta

SEQ ID NO: 4414730 - DNA, 16 bp, Homo sapiens
actttcttattttgct

SEQ ID NO: 4414731 - DNA, 20 bp, Homo sapiens
actttcttcaccaagtgcaa

SEQ ID NO: 4414732 - DNA, 14 bp, Homo sapiens
actttcttcaggta

SEQ ID NO: 4414733 - DNA, 13 bp, Homo sapiens
actttctttctca

SEQ ID NO: 4414734 - DNA, 22 bp, Homo sapiens
actttctttctcactaaatctt

SEQ ID NO: 4414735 - DNA, 17 bp, Homo sapiens
actttctttctgtaggt

SEQ ID NO: 4414736 - DNA, 18 bp, Homo sapiens
actttcttttattaatat

SEQ ID NO: 4414737 - DNA, 15 bp, Homo sapiens
acctgcttggtcttt

SEQ ID NO: 4414738 - DNA, 21 bp, Homo sapiens
acctggaatctacaagccaaa

SEQ ID NO: 4414739 - DNA, 16 bp, Homo sapiens
acctggactgaccctg

SEQ ID NO: 4414740 - DNA, 14 bp, Homo sapiens
acctggactgagcc

SEQ ID NO: 4414741 - DNA, 23 bp, Homo sapiens
acctggagagccagaacctggag

SEQ ID NO: 4414742 - DNA, 17 bp, Homo sapiens
acctggagatgcagcta

SEQ ID NO: 4414743 - DNA, 19 bp, Homo sapiens
acctggagcgccacacact

SEQ ID NO: 4414744 - DNA, 17 bp, Homo sapiens
acctggatccagcactg

SEQ ID NO: 4414745 - DNA, 14 bp, Homo sapiens
acctggcatggtgc

SEQ ID NO: 4414746 - DNA, 15 bp, Homo sapiens
acctggcgtgctcag

SEQ ID NO: 4414747 - DNA, 22 bp, Homo sapiens
acctggctgaggttcctctgcc

SEQ ID NO: 4414748 - DNA, 23 bp, Homo sapiens
acctggctgaggttcctctgcct

SEQ ID NO: 4414749 - DNA, 20 bp, Homo sapiens
acctggcttcatacagaagg

SEQ ID NO: 4414750 - DNA, 20 bp, Homo sapiens
acctgggaacgactggactg

SEQ ID NO: 4414751 - DNA, 16 bp, Homo sapiens
acctgggaatttatat

SEQ ID NO: 4414752 - DNA, 17 bp, Homo sapiens
acctgggttccctttcc

SEQ ID NO: 4414753 - DNA, 14 bp, Homo sapiens
acctggtgcccctg

SEQ ID NO: 4414754 - DNA, 15 bp, Homo sapiens
acctggttcatattt

SEQ ID NO: 4414755 - DNA, 16 bp, Homo sapiens
acctgtaaaactttat

SEQ ID NO: 4414756 - DNA, 15 bp, Homo sapiens
acctgtaacttttgt

SEQ ID NO: 4414757 - DNA, 16 bp, Homo sapiens
acctgtagtcccagct

SEQ ID NO: 4414758 - DNA, 14 bp, Homo sapiens
acctgtatactctt

SEQ ID NO: 4414759 - DNA, 21 bp, Homo sapiens
acctgtcagaataaaaatgtg

SEQ ID NO: 4414760 - DNA, 23 bp, Homo sapiens
acctgtctaggtctcctcagggt

SEQ ID NO: 4414761 - DNA, 17 bp, Homo sapiens
acctgtctatactacag

SEQ ID NO: 4414762 - DNA, 14 bp, Homo sapiens
acctgtgctgtgag

SEQ ID NO: 4414763 - DNA, 19 bp, Homo sapiens
acctgtgcttcgggccctt

SEQ ID NO: 4414764 - DNA, 23 bp, Homo sapiens
acctgtgcttcgggcccttccca

SEQ ID NO: 4414765 - DNA, 13 bp, Homo sapiens
acctgtggatatt

SEQ ID NO: 4414766 - DNA, 14 bp, Homo sapiens
acctgtggatattt

SEQ ID NO: 4414767 - DNA, 17 bp, Homo sapiens
acctgtggccaagttct

SEQ ID NO: 4414768 - DNA, 15 bp, Homo sapiens
acctgtggggcctgg

SEQ ID NO: 4414769 - DNA, 14 bp, Homo sapiens
acctgttatttcta

SEQ ID NO: 4414770 - DNA, 19 bp, Homo sapiens
accttaaattaaacaattt

SEQ ID NO: 4414771 - DNA, 16 bp, Homo sapiens
accttaaccttaaaat

SEQ ID NO: 4414772 - DNA, 14 bp, Homo sapiens
accttaatatttct

SEQ ID NO: 4414773 - DNA, 15 bp, Homo sapiens
accttaatatttctt

SEQ ID NO: 4414774 - DNA, 16 bp, Homo sapiens
accttagcgttctgga

SEQ ID NO: 4414775 - DNA, 18 bp, Homo sapiens
accttagcgttctggact

SEQ ID NO: 4414776 - DNA, 22 bp, Homo sapiens
accttagtcatcagatatgctt

SEQ ID NO: 4414777 - DNA, 14 bp, Homo sapiens
accttatagttact

SEQ ID NO: 4414778 - DNA, 20 bp, Homo sapiens
accttatagttactgtgtaa

SEQ ID NO: 4414779 - DNA, 18 bp, Homo sapiens
accttatcctgcattgtt

SEQ ID NO: 4414780 - DNA, 16 bp, Homo sapiens
accttatttatttttg

SEQ ID NO: 4414781 - DNA, 23 bp, Homo sapiens
accttcacgattaactgtgaaat

SEQ ID NO: 4414782 - DNA, 20 bp, Homo sapiens
accttcaggccccgccccat

SEQ ID NO: 4414783 - DNA, 20 bp, Homo sapiens
accttcatttaactctttga

SEQ ID NO: 4414784 - DNA, 21 bp, Homo sapiens
accttcatttaactctttgaa

SEQ ID NO: 4414785 - DNA, 17 bp, Homo sapiens
accttccaacttcctgt

SEQ ID NO: 4414786 - DNA, 19 bp, Homo sapiens
accttcccagctctccctc

SEQ ID NO: 4414787 - DNA, 13 bp, Homo sapiens
accttccctccaa

SEQ ID NO: 4414788 - DNA, 14 bp, Homo sapiens
accttcctcctgca

SEQ ID NO: 4414789 - DNA, 17 bp, Homo sapiens
accttcctcctgcagac

SEQ ID NO: 4414790 - DNA, 20 bp, Homo sapiens
accttcctgggaggacaggc

SEQ ID NO: 4414791 - DNA, 15 bp, Homo sapiens
accttcctgtccctg

SEQ ID NO: 4414792 - DNA, 22 bp, Homo sapiens
accttctggtggttctgctgtt

SEQ ID NO: 4414793 - DNA, 18 bp, Homo sapiens
accttcttatttaatctt

SEQ ID NO: 4414794 - DNA, 18 bp, Homo sapiens
accttgaaaaaaaacagt

SEQ ID NO: 4414795 - DNA, 19 bp, Homo sapiens
accttgaaaactttatgct

SEQ ID NO: 4414796 - DNA, 14 bp, Homo sapiens
accttgaaatggaa

SEQ ID NO: 4414797 - DNA, 20 bp, Homo sapiens
accttgaataaggcccactg

SEQ ID NO: 4414798 - DNA, 21 bp, Homo sapiens
accttgcaacctcaccttcct

SEQ ID NO: 4414799 - DNA, 15 bp, Homo sapiens
accttgctctcctca

SEQ ID NO: 4414800 - DNA, 14 bp, Homo sapiens
acctttaaaataat

SEQ ID NO: 4414801 - DNA, 14 bp, Homo sapiens
acctttatctttca

SEQ ID NO: 4414802 - DNA, 14 bp, Homo sapiens
acctttatttatta

SEQ ID NO: 4414803 - DNA, 19 bp, Homo sapiens
acctttatttattaaactt

SEQ ID NO: 4414804 - DNA, 20 bp, Homo sapiens
acctttcaccctcatgaaaa

SEQ ID NO: 4414805 - DNA, 23 bp, Homo sapiens
acctttcagtgcagtttcttttc

SEQ ID NO: 4414806 - DNA, 20 bp, Homo sapiens
acctttcccacctctctccc

SEQ ID NO: 4414807 - DNA, 22 bp, Homo sapiens
acctttccctcaccccctccca

SEQ ID NO: 4414808 - DNA, 20 bp, Homo sapiens
acctttcttcaccaaatctt

SEQ ID NO: 4414809 - DNA, 15 bp, Homo sapiens
acctttgctatgtaa

SEQ ID NO: 4414810 - DNA, 15 bp, Homo sapiens
accttttatgtagta

SEQ ID NO: 4414811 - DNA, 22 bp, Homo sapiens
accttttcaggaaaataactta

SEQ ID NO: 4414812 - DNA, 22 bp, Homo sapiens
accttttccaggagttctgaag

SEQ ID NO: 4414813 - DNA, 13 bp, Homo sapiens
accttttctcttt

SEQ ID NO: 4414814 - DNA, 15 bp, Homo sapiens
accttttctgtggct

SEQ ID NO: 4414815 - DNA, 21 bp, Homo sapiens
accttttctgtggctggctct

SEQ ID NO: 4414816 - DNA, 22 bp, Homo sapiens
acctttttataaagatcattta

SEQ ID NO: 4414817 - DNA, 20 bp, Homo sapiens
accttttttgttttttcaaa

SEQ ID NO: 4414818 - DNA, 14 bp, Homo sapiens
acgaaagaaatgta

SEQ ID NO: 4414819 - DNA, 18 bp, Homo sapiens
acgaaatatgaagagcaa

SEQ ID NO: 4414820 - DNA, 16 bp, Homo sapiens
acgaacccacctgctg

SEQ ID NO: 4414821 - DNA, 19 bp, Homo sapiens
acgaaccctagaaatatat

SEQ ID NO: 4414822 - DNA, 19 bp, Homo sapiens
acgaacctacagttttaac

SEQ ID NO: 4414823 - DNA, 12 bp, Homo sapiens
acgacccctgaa

SEQ ID NO: 4414824 - DNA, 14 bp, Homo sapiens
acgagaagtgcttt

SEQ ID NO: 4414825 - DNA, 16 bp, Homo sapiens
acgagaagtgctttat

SEQ ID NO: 4414826 - DNA, 19 bp, Homo sapiens
acgagacaacagcacacag

SEQ ID NO: 4414827 - DNA, 17 bp, Homo sapiens
acgagacacattgcctt

SEQ ID NO: 4414828 - DNA, 18 bp, Homo sapiens
acgagacacattgccttc

SEQ ID NO: 4414829 - DNA, 19 bp, Homo sapiens
acgagacacattgccttct

SEQ ID NO: 4414830 - DNA, 19 bp, Homo sapiens
acgagcaggctactgtcag

SEQ ID NO: 4414831 - DNA, 12 bp, Homo sapiens
acgagccacaag

SEQ ID NO: 4414832 - DNA, 11 bp, Homo sapiens
acgaggccctc

SEQ ID NO: 4414833 - DNA, 13 bp, Homo sapiens
acgaggccctcgg

SEQ ID NO: 4414834 - DNA, 16 bp, Homo sapiens
acgaggccctcgggcc

SEQ ID NO: 4414835 - DNA, 19 bp, Homo sapiens
acgaggccctcgggcccag

SEQ ID NO: 4414836 - DNA, 12 bp, Homo sapiens
acgagggctggc

SEQ ID NO: 4414837 - DNA, 14 bp, Homo sapiens
acgagggctggctg

SEQ ID NO: 4414838 - DNA, 20 bp, Homo sapiens
acgagggctggctggcctca

SEQ ID NO: 4414839 - DNA, 17 bp, Homo sapiens
acgagtaagtgaatcct

SEQ ID NO: 4414840 - DNA, 17 bp, Homo sapiens
acgagtcaatcccctca

SEQ ID NO: 4414841 - DNA, 18 bp, Homo sapiens
acgatcaggaggaagtga

SEQ ID NO: 4414842 - DNA, 14 bp, Homo sapiens
acgatccttcaaag

SEQ ID NO: 4414843 - DNA, 12 bp, Homo sapiens
acgatgtaaatt

SEQ ID NO: 4414844 - DNA, 19 bp, Homo sapiens
acgattcatttttgaaact

SEQ ID NO: 4414845 - DNA, 14 bp, Homo sapiens
acgattttgcacaa

SEQ ID NO: 4414846 - DNA, 17 bp, Homo sapiens
acgcacagccaaggact

SEQ ID NO: 4414847 - DNA, 14 bp, Homo sapiens
acgcaccaatcagc

SEQ ID NO: 4414848 - DNA, 17 bp, Homo sapiens
acgcaccaatcagcact

SEQ ID NO: 4414849 - DNA, 14 bp, Homo sapiens
acgcagccctagag

SEQ ID NO: 4414850 - DNA, 21 bp, Homo sapiens
acgcagccctagagcctgcct

SEQ ID NO: 4414851 - DNA, 18 bp, Homo sapiens
acgcatgatggagctgat

SEQ ID NO: 4414852 - DNA, 18 bp, Homo sapiens
acgcattttggtttttcc

SEQ ID NO: 4414853 - DNA, 20 bp, Homo sapiens
acgccactcatttcatctca

SEQ ID NO: 4414854 - DNA, 14 bp, Homo sapiens
acgccagtgtgttt

SEQ ID NO: 4414855 - DNA, 16 bp, Homo sapiens
actattgtgccaactg

SEQ ID NO: 4414856 - DNA, 19 bp, Homo sapiens
actatttatatcacacaat

SEQ ID NO: 4414857 - DNA, 12 bp, Homo sapiens
actattttcaga

SEQ ID NO: 4414858 - DNA, 14 bp, Homo sapiens
actatttttcctca

SEQ ID NO: 4414859 - DNA, 16 bp, Homo sapiens
actatttttttcaaag

SEQ ID NO: 4414860 - DNA, 13 bp, Homo sapiens
actcaaaacctgg

SEQ ID NO: 4414861 - DNA, 17 bp, Homo sapiens
actcaaaacctggagat

SEQ ID NO: 4414862 - DNA, 16 bp, Homo sapiens
actcaaaccatatttt

SEQ ID NO: 4414863 - DNA, 14 bp, Homo sapiens
actcaaatcaagaa

SEQ ID NO: 4414864 - DNA, 20 bp, Homo sapiens
actcaactgggctctgtccc

SEQ ID NO: 4414865 - DNA, 15 bp, Homo sapiens
actcaagaggaatct

SEQ ID NO: 4414866 - DNA, 20 bp, Homo sapiens
actcaaggacaggagcctgg

SEQ ID NO: 4414867 - DNA, 20 bp, Homo sapiens
actcaaggtttaaccttaaa

SEQ ID NO: 4414868 - DNA, 21 bp, Homo sapiens
actcacacctgaactgaacac

SEQ ID NO: 4414869 - DNA, 21 bp, Homo sapiens
actcacatagccaactctccc

SEQ ID NO: 4414870 - DNA, 18 bp, Homo sapiens
actcaccctgggagccag

SEQ ID NO: 4414871 - DNA, 15 bp, Homo sapiens
actcacctctgcctc

SEQ ID NO: 4414872 - DNA, 17 bp, Homo sapiens
actcacctctgcctcaa

SEQ ID NO: 4414873 - DNA, 22 bp, Homo sapiens
actcacctgcactaacagagtg

SEQ ID NO: 4414874 - DNA, 14 bp, Homo sapiens
actcacgtttgctt

SEQ ID NO: 4414875 - DNA, 13 bp, Homo sapiens
actcactcctgag

SEQ ID NO: 4414876 - DNA, 15 bp, Homo sapiens
actcactttcccttg

SEQ ID NO: 4414877 - DNA, 23 bp, Homo sapiens
actcactttcccttgtgtcaaga

SEQ ID NO: 4414878 - DNA, 14 bp, Homo sapiens
actcagaaagccaa

SEQ ID NO: 4414879 - DNA, 15 bp, Homo sapiens
actcagaaagccaac

SEQ ID NO: 4414880 - DNA, 13 bp, Homo sapiens
actcagaaattca

SEQ ID NO: 4414881 - DNA, 14 bp, Homo sapiens
actcagaggtccag

SEQ ID NO: 4414882 - DNA, 16 bp, Homo sapiens
actcagatgaggacag

SEQ ID NO: 4414883 - DNA, 17 bp, Homo sapiens
actcagcagacatttat

SEQ ID NO: 4414884 - DNA, 21 bp, Homo sapiens
actcagcagacatttatcttt

SEQ ID NO: 4414885 - DNA, 14 bp, Homo sapiens
actcagcagcagag

SEQ ID NO: 4414886 - DNA, 18 bp, Homo sapiens
actcagcagccctcctca

SEQ ID NO: 4414887 - DNA, 20 bp, Homo sapiens
actcagcagccctcctcacc

SEQ ID NO: 4414888 - DNA, 21 bp, Homo sapiens
actcagcagccctcctcaccc

SEQ ID NO: 4414889 - DNA, 22 bp, Homo sapiens
actcagcagccctcctcacccc

SEQ ID NO: 4414890 - DNA, 23 bp, Homo sapiens
actcagcagccctcctcaccccg

SEQ ID NO: 4414891 - DNA, 15 bp, Homo sapiens
actcagcatcaccca

SEQ ID NO: 4414892 - DNA, 15 bp, Homo sapiens
actcagccactgtca

SEQ ID NO: 4414893 - DNA, 21 bp, Homo sapiens
actcagccctgggccccacca

SEQ ID NO: 4414894 - DNA, 15 bp, Homo sapiens
actcagcctctgctg

SEQ ID NO: 4414895 - DNA, 19 bp, Homo sapiens
actcagcctctgctggaga

SEQ ID NO: 4414896 - DNA, 16 bp, Homo sapiens
actcagcctgggacag

SEQ ID NO: 4414897 - DNA, 14 bp, Homo sapiens
actcagctaatgtc

SEQ ID NO: 4414898 - DNA, 19 bp, Homo sapiens
actcagctctcctgctgca

SEQ ID NO: 4414899 - DNA, 20 bp, Homo sapiens
actcagctctcctgctgcag

SEQ ID NO: 4414900 - DNA, 17 bp, Homo sapiens
actcagcttcctaccca

SEQ ID NO: 4414901 - DNA, 18 bp, Homo sapiens
actcaggaggctgagaca

SEQ ID NO: 4414902 - DNA, 23 bp, Homo sapiens
actcagggaccggtgctgcagga

SEQ ID NO: 4414903 - DNA, 15 bp, Homo sapiens
actcagggcattctg

SEQ ID NO: 4414904 - DNA, 16 bp, Homo sapiens
actcagggcattctgt

SEQ ID NO: 4414905 - DNA, 14 bp, Homo sapiens
actcaggttccaga

SEQ ID NO: 4414906 - DNA, 22 bp, Homo sapiens
actcaggttccagaacagccct

SEQ ID NO: 4414907 - DNA, 23 bp, Homo sapiens
actcaggttccagaacagccctc

SEQ ID NO: 4414908 - DNA, 23 bp, Homo sapiens
actcagtctctcttctctccagc

SEQ ID NO: 4414909 - DNA, 24 bp, Homo sapiens
actcagtgaccagtgcctgtgagc

SEQ ID NO: 4414910 - DNA, 20 bp, Homo sapiens
actcagtgtctgcctttaaa

SEQ ID NO: 4414911 - DNA, 14 bp, Homo sapiens
actcagttgttctg

SEQ ID NO: 4414912 - DNA, 16 bp, Homo sapiens
actcatcacataaaga

SEQ ID NO: 4414913 - DNA, 16 bp, Homo sapiens
actcatgtgactcttt

SEQ ID NO: 4414914 - DNA, 18 bp, Homo sapiens
actcatgtgactctttcc

SEQ ID NO: 4414915 - DNA, 12 bp, Homo sapiens
actcattaatta

SEQ ID NO: 4414916 - DNA, 19 bp, Homo sapiens
actcattctgaaggagccc

SEQ ID NO: 4414917 - DNA, 15 bp, Homo sapiens
actcattgaaatgta

SEQ ID NO: 4414918 - DNA, 17 bp, Homo sapiens
actcattgaaatgtaat

SEQ ID NO: 4414919 - DNA, 12 bp, Homo sapiens
actcatttcatc

SEQ ID NO: 4414920 - DNA, 14 bp, Homo sapiens
actcatttgaatgc

SEQ ID NO: 4414921 - DNA, 23 bp, Homo sapiens
actcatttgaatgcttaattcaa

SEQ ID NO: 4414922 - DNA, 13 bp, Homo sapiens
actccaaaatgtt

SEQ ID NO: 4414923 - DNA, 14 bp, Homo sapiens
actccaaagaaatg

SEQ ID NO: 4414924 - DNA, 15 bp, Homo sapiens
actccacatctgcct

SEQ ID NO: 4414925 - DNA, 20 bp, Homo sapiens
actccacattcttcagtttt

SEQ ID NO: 4414926 - DNA, 20 bp, Homo sapiens
actccaccaacccatcagaa

SEQ ID NO: 4414927 - DNA, 21 bp, Homo sapiens
actccaccatccccaccccac

SEQ ID NO: 4414928 - DNA, 12 bp, Homo sapiens
actccagagaag

SEQ ID NO: 4414929 - DNA, 11 bp, Homo sapiens
actccagccag

SEQ ID NO: 4414930 - DNA, 13 bp, Homo sapiens
actccagccagcg

SEQ ID NO: 4414931 - DNA, 14 bp, Homo sapiens
actccagccagcgc

SEQ ID NO: 4414932 - DNA, 17 bp, Homo sapiens
actccagccagcgcctc

SEQ ID NO: 4414933 - DNA, 18 bp, Homo sapiens
actccagccagcgcctcc

SEQ ID NO: 4414934 - DNA, 18 bp, Homo sapiens
actccagccagggcaaga

SEQ ID NO: 4414935 - DNA, 18 bp, Homo sapiens
actccagcctgagtgaca

SEQ ID NO: 4414936 - DNA, 18 bp, Homo sapiens
actccagcctgggcaaca

SEQ ID NO: 4414937 - DNA, 16 bp, Homo sapiens
actccagcctgggtca

SEQ ID NO: 4414938 - DNA, 19 bp, Homo sapiens
actccagcctgggtcacag

SEQ ID NO: 4414939 - DNA, 18 bp, Homo sapiens
actccaggaaagagcagt

SEQ ID NO: 4414940 - DNA, 13 bp, Homo sapiens
actccaggcccaa

SEQ ID NO: 4414941 - DNA, 14 bp, Homo sapiens
actccaggcccaag

SEQ ID NO: 4414942 - DNA, 17 bp, Homo sapiens
actccaggcccaaggct

SEQ ID NO: 4414943 - DNA, 14 bp, Homo sapiens
actccaggggcacc

SEQ ID NO: 4414944 - DNA, 15 bp, Homo sapiens
actccaggggcacct

SEQ ID NO: 4414945 - DNA, 19 bp, Homo sapiens
actccagtgagacagctct

SEQ ID NO: 4414946 - DNA, 18 bp, Homo sapiens
actccagttaaaaaaaat

SEQ ID NO: 4414947 - DNA, 10 bp, Homo sapiens
acccagaccc

SEQ ID NO: 4414948 - DNA, 22 bp, Homo sapiens
acccagaggggacgctgaggaa

SEQ ID NO: 4414949 - DNA, 14 bp, Homo sapiens
acccagaggtccag

SEQ ID NO: 4414950 - DNA, 17 bp, Homo sapiens
acccagaggtccaggtc

SEQ ID NO: 4414951 - DNA, 18 bp, Homo sapiens
acccagaggtccaggtcc

SEQ ID NO: 4414952 - DNA, 11 bp, Homo sapiens
acccagcccat

SEQ ID NO: 4414953 - DNA, 23 bp, Homo sapiens
acccagcccattctctctcctgt

SEQ ID NO: 4414954 - DNA, 15 bp, Homo sapiens
acccagccctcatcc

SEQ ID NO: 4414955 - DNA, 17 bp, Homo sapiens
acccagcggccccccgc

SEQ ID NO: 4414956 - DNA, 15 bp, Homo sapiens
acccagcgtggcctc

SEQ ID NO: 4414957 - DNA, 17 bp, Homo sapiens
acccagctgccacctct

SEQ ID NO: 4414958 - DNA, 11 bp, Homo sapiens
acccaggaggt

SEQ ID NO: 4414959 - DNA, 20 bp, Homo sapiens
acccaggcaatcttgccttc

SEQ ID NO: 4414960 - DNA, 19 bp, Homo sapiens
acccaggctggagtgcagt

SEQ ID NO: 4414961 - DNA, 15 bp, Homo sapiens
acccagggcctgact

SEQ ID NO: 4414962 - DNA, 16 bp, Homo sapiens
acccagggcctgactt

SEQ ID NO: 4414963 - DNA, 23 bp, Homo sapiens
acccagggcctgacttgagccac

SEQ ID NO: 4414964 - DNA, 15 bp, Homo sapiens
acccaggggtccagg

SEQ ID NO: 4414965 - DNA, 16 bp, Homo sapiens
acccaggggtccaggc

SEQ ID NO: 4414966 - DNA, 17 bp, Homo sapiens
acccaggggtccaggcc

SEQ ID NO: 4414967 - DNA, 18 bp, Homo sapiens
acccagtccatgctccag

SEQ ID NO: 4414968 - DNA, 13 bp, Homo sapiens
acccagtccctgg

SEQ ID NO: 4414969 - DNA, 15 bp, Homo sapiens
acccagtccctgggg

SEQ ID NO: 4414970 - DNA, 20 bp, Homo sapiens
acccagtctaggagctcctt

SEQ ID NO: 4414971 - DNA, 14 bp, Homo sapiens
acccagtgctgaat

SEQ ID NO: 4414972 - DNA, 12 bp, Homo sapiens
acccagtggctg

SEQ ID NO: 4414973 - DNA, 17 bp, Homo sapiens
acccagttgcctccagg

SEQ ID NO: 4414974 - DNA, 19 bp, Homo sapiens
acccagttgcctccagggc

SEQ ID NO: 4414975 - DNA, 15 bp, Homo sapiens
acccatacaatgtat

SEQ ID NO: 4414976 - DNA, 23 bp, Homo sapiens
acccatacaatgtatgtacaata

SEQ ID NO: 4414977 - DNA, 19 bp, Homo sapiens
acccatcagttccagcctt

SEQ ID NO: 4414978 - DNA, 23 bp, Homo sapiens
acccatgaaggctggaaggcagc

SEQ ID NO: 4414979 - DNA, 18 bp, Homo sapiens
acccatggaaaaatgcca

SEQ ID NO: 4414980 - DNA, 15 bp, Homo sapiens
acccatggcctcagc

SEQ ID NO: 4414981 - DNA, 20 bp, Homo sapiens
acccatggcctcagccctgc

SEQ ID NO: 4414982 - DNA, 17 bp, Homo sapiens
acccatgggctctgaca

SEQ ID NO: 4414983 - DNA, 19 bp, Homo sapiens
acccatggtcatctctgtt

SEQ ID NO: 4414984 - DNA, 12 bp, Homo sapiens
acccatgtcacc

SEQ ID NO: 4414985 - DNA, 16 bp, Homo sapiens
acccattcactacagg

SEQ ID NO: 4414986 - DNA, 21 bp, Homo sapiens
acccattcagagactgtccct

SEQ ID NO: 4414987 - DNA, 20 bp, Homo sapiens
acccatttaaatttttttcc

SEQ ID NO: 4414988 - DNA, 16 bp, Homo sapiens
accccaaaccccagcc

SEQ ID NO: 4414989 - DNA, 15 bp, Homo sapiens
accccaactctcccc

SEQ ID NO: 4414990 - DNA, 16 bp, Homo sapiens
accccaactctcccca

SEQ ID NO: 4414991 - DNA, 17 bp, Homo sapiens
accccaactctccccag

SEQ ID NO: 4414992 - DNA, 21 bp, Homo sapiens
accccacacttgttccagctc

SEQ ID NO: 4414993 - DNA, 14 bp, Homo sapiens
accccacagaacct

SEQ ID NO: 4414994 - DNA, 12 bp, Homo sapiens
accccacagctg

SEQ ID NO: 4414995 - DNA, 16 bp, Homo sapiens
accccacagctggggc

SEQ ID NO: 4414996 - DNA, 18 bp, Homo sapiens
accccacccccgccatgc

SEQ ID NO: 4414997 - DNA, 12 bp, Homo sapiens
accccaccccct

SEQ ID NO: 4414998 - DNA, 18 bp, Homo sapiens
accccaccctccctggag

SEQ ID NO: 4414999 - DNA, 13 bp, Homo sapiens
accctgctcctag

SEQ ID NO: 4415000 - DNA, 21 bp, Homo sapiens
accctgctcctagcaccctgg

SEQ ID NO: 4415001 - DNA, 14 bp, Homo sapiens
accctgggagagaa

SEQ ID NO: 4415002 - DNA, 15 bp, Homo sapiens
accctgggccacgcc

SEQ ID NO: 4415003 - DNA, 21 bp, Homo sapiens
accctgggccacgccggccac

SEQ ID NO: 4415004 - DNA, 11 bp, Homo sapiens
accctggggcg

SEQ ID NO: 4415005 - DNA, 19 bp, Homo sapiens
accctgggtgggctctgtg

SEQ ID NO: 4415006 - DNA, 16 bp, Homo sapiens
accctggtgctttcct

SEQ ID NO: 4415007 - DNA, 15 bp, Homo sapiens
accctgtccggccca

SEQ ID NO: 4415008 - DNA, 19 bp, Homo sapiens
accctgtccggcccagtgc

SEQ ID NO: 4415009 - DNA, 16 bp, Homo sapiens
accctgtcctgcacac

SEQ ID NO: 4415010 - DNA, 19 bp, Homo sapiens
accctgtcctgcacaccct

SEQ ID NO: 4415011 - DNA, 13 bp, Homo sapiens
acccttacagtag

SEQ ID NO: 4415012 - DNA, 22 bp, Homo sapiens
acccttcccgcctccctctcag

SEQ ID NO: 4415013 - DNA, 14 bp, Homo sapiens
acccttcctgctgc

SEQ ID NO: 4415014 - DNA, 15 bp, Homo sapiens
acccttcctgctgct

SEQ ID NO: 4415015 - DNA, 19 bp, Homo sapiens
acccttctgggtccaggga

SEQ ID NO: 4415016 - DNA, 22 bp, Homo sapiens
acccttgattttgccccctgag

SEQ ID NO: 4415017 - DNA, 14 bp, Homo sapiens
acccttgctttcct

SEQ ID NO: 4415018 - DNA, 19 bp, Homo sapiens
acccttgctttcctgggcc

SEQ ID NO: 4415019 - DNA, 15 bp, Homo sapiens
acccttggaaaacaa

SEQ ID NO: 4415020 - DNA, 11 bp, Homo sapiens
acccttggcct

SEQ ID NO: 4415021 - DNA, 13 bp, Homo sapiens
acccttggcctgt

SEQ ID NO: 4415022 - DNA, 17 bp, Homo sapiens
acccttggcctgtctca

SEQ ID NO: 4415023 - DNA, 18 bp, Homo sapiens
acccttgtgagagcccat

SEQ ID NO: 4415024 - DNA, 21 bp, Homo sapiens
accctttagtgctttgtgata

SEQ ID NO: 4415025 - DNA, 17 bp, Homo sapiens
accctttccttccttcc

SEQ ID NO: 4415026 - DNA, 22 bp, Homo sapiens
accctttctgtttggacccatg

SEQ ID NO: 4415027 - DNA, 23 bp, Homo sapiens
accctttggttatttcagccccc

SEQ ID NO: 4415028 - DNA, 21 bp, Homo sapiens
accctttggtttttttcttct

SEQ ID NO: 4415029 - DNA, 23 bp, Homo sapiens
accctttggtttttttcttctgt

SEQ ID NO: 4415030 - DNA, 17 bp, Homo sapiens
accctttgtttcttgtt

SEQ ID NO: 4415031 - DNA, 14 bp, Homo sapiens
acccttttccccct

SEQ ID NO: 4415032 - DNA, 21 bp, Homo sapiens
accgaagtggactggcccctg

SEQ ID NO: 4415033 - DNA, 17 bp, Homo sapiens
accgagagtagccgaga

SEQ ID NO: 4415034 - DNA, 13 bp, Homo sapiens
accgaggcaggga

SEQ ID NO: 4415035 - DNA, 18 bp, Homo sapiens
accgaggctacagctcca

SEQ ID NO: 4415036 - DNA, 19 bp, Homo sapiens
accgagggggctgctccca

SEQ ID NO: 4415037 - DNA, 14 bp, Homo sapiens
accgcaggagggca

SEQ ID NO: 4415038 - DNA, 16 bp, Homo sapiens
accgccacgtcccagc

SEQ ID NO: 4415039 - DNA, 17 bp, Homo sapiens
accgccacgtcccagca

SEQ ID NO: 4415040 - DNA, 19 bp, Homo sapiens
accgcctgaaggcacagct

SEQ ID NO: 4415041 - DNA, 20 bp, Homo sapiens
accgcgactaatttcaaaat

SEQ ID NO: 4415042 - DNA, 16 bp, Homo sapiens
accgcgtcccagctcc

SEQ ID NO: 4415043 - DNA, 19 bp, Homo sapiens
accgcgtcccagctcccct

SEQ ID NO: 4415044 - DNA, 20 bp, Homo sapiens
accgcgtcccagctcccctc

SEQ ID NO: 4415045 - DNA, 20 bp, Homo sapiens
accgctctcttttctgtact

SEQ ID NO: 4415046 - DNA, 13 bp, Homo sapiens
accgctggccctt

SEQ ID NO: 4415047 - DNA, 15 bp, Homo sapiens
accgctggcccttag

SEQ ID NO: 4415048 - DNA, 20 bp, Homo sapiens
accggaactgggctggcgct

SEQ ID NO: 4415049 - DNA, 13 bp, Homo sapiens
accggagagagaa

SEQ ID NO: 4415050 - DNA, 14 bp, Homo sapiens
accggattctctct

SEQ ID NO: 4415051 - DNA, 22 bp, Homo sapiens
accggcctgtgggtctctgaag

SEQ ID NO: 4415052 - DNA, 15 bp, Homo sapiens
accgggagcctcccc

SEQ ID NO: 4415053 - DNA, 19 bp, Homo sapiens
accgggagcctccccctca

SEQ ID NO: 4415054 - DNA, 19 bp, Homo sapiens
accgggatgaacctatcct

SEQ ID NO: 4415055 - DNA, 13 bp, Homo sapiens
accggggcctggg

SEQ ID NO: 4415056 - DNA, 19 bp, Homo sapiens
accggggcctgggcaggag

SEQ ID NO: 4415057 - DNA, 13 bp, Homo sapiens
accggtacagaaa

SEQ ID NO: 4415058 - DNA, 13 bp, Homo sapiens
accggtcagtgcc

SEQ ID NO: 4415059 - DNA, 14 bp, Homo sapiens
accggtcagtgcct

SEQ ID NO: 4415060 - DNA, 22 bp, Homo sapiens
accggtcagtgccttttggaac

SEQ ID NO: 4415061 - DNA, 22 bp, Homo sapiens
accgtaaaggtttatttttctg

SEQ ID NO: 4415062 - DNA, 15 bp, Homo sapiens
accgtaaagtgcctt

SEQ ID NO: 4415063 - DNA, 15 bp, Homo sapiens
accgtggaggaggaa

SEQ ID NO: 4415064 - DNA, 22 bp, Homo sapiens
accgtggaggaggaaggcaaga

SEQ ID NO: 4415065 - DNA, 17 bp, Homo sapiens
accgtgggcggggcctt

SEQ ID NO: 4415066 - DNA, 13 bp, Homo sapiens
acctaaagaaaaa

SEQ ID NO: 4415067 - DNA, 18 bp, Homo sapiens
acctaacaggagaaagga

SEQ ID NO: 4415068 - DNA, 22 bp, Homo sapiens
acctaaccccagggcactgcca

SEQ ID NO: 4415069 - DNA, 18 bp, Homo sapiens
acctaacccctttcctgc

SEQ ID NO: 4415070 - DNA, 18 bp, Homo sapiens
acctaagcacttctagaa

SEQ ID NO: 4415071 - DNA, 15 bp, Homo sapiens
acctaattaatatat

SEQ ID NO: 4415072 - DNA, 14 bp, Homo sapiens
acctaatttcattt

SEQ ID NO: 4415073 - DNA, 19 bp, Homo sapiens
acattcttgcttgtgtgtc

SEQ ID NO: 4415074 - DNA, 22 bp, Homo sapiens
acattcttggcttaatcatttt

SEQ ID NO: 4415075 - DNA, 19 bp, Homo sapiens
acattcttggttgttaatt

SEQ ID NO: 4415076 - DNA, 14 bp, Homo sapiens
acattcttttaatg

SEQ ID NO: 4415077 - DNA, 16 bp, Homo sapiens
acattgatctgtttta

SEQ ID NO: 4415078 - DNA, 16 bp, Homo sapiens
acattgcctttgaatg

SEQ ID NO: 4415079 - DNA, 17 bp, Homo sapiens
acattgcctttgaatgt

SEQ ID NO: 4415080 - DNA, 18 bp, Homo sapiens
acattgcctttgaatgtt

SEQ ID NO: 4415081 - DNA, 18 bp, Homo sapiens
acattgctctatgtctgc

SEQ ID NO: 4415082 - DNA, 22 bp, Homo sapiens
acattgcttaaaatatatagtg

SEQ ID NO: 4415083 - DNA, 17 bp, Homo sapiens
acattggaatgccttgg

SEQ ID NO: 4415084 - DNA, 23 bp, Homo sapiens
acattggagtctcatttgggcta

SEQ ID NO: 4415085 - DNA, 20 bp, Homo sapiens
acattgggtggggctcctgg

SEQ ID NO: 4415086 - DNA, 15 bp, Homo sapiens
acattgtactgttgc

SEQ ID NO: 4415087 - DNA, 23 bp, Homo sapiens
acattgtccccaatgaatatact

SEQ ID NO: 4415088 - DNA, 22 bp, Homo sapiens
acattgtctcctatatatttct

SEQ ID NO: 4415089 - DNA, 16 bp, Homo sapiens
acattgtgcttggccc

SEQ ID NO: 4415090 - DNA, 17 bp, Homo sapiens
acattgttcaactccct

SEQ ID NO: 4415091 - DNA, 16 bp, Homo sapiens
acattgtttttgtata

SEQ ID NO: 4415092 - DNA, 14 bp, Homo sapiens
acatttaaaccttt

SEQ ID NO: 4415093 - DNA, 17 bp, Homo sapiens
acatttaaactttttaa

SEQ ID NO: 4415094 - DNA, 12 bp, Homo sapiens
acatttaaattc

SEQ ID NO: 4415095 - DNA, 17 bp, Homo sapiens
acatttagaaaagtgaa

SEQ ID NO: 4415096 - DNA, 13 bp, Homo sapiens
acatttatatatt

SEQ ID NO: 4415097 - DNA, 23 bp, Homo sapiens
acatttatctttgtattcttcat

SEQ ID NO: 4415098 - DNA, 19 bp, Homo sapiens
acatttatgtgaggtaatt

SEQ ID NO: 4415099 - DNA, 13 bp, Homo sapiens
acatttatttcct

SEQ ID NO: 4415100 - DNA, 15 bp, Homo sapiens
acatttcattgtaca

SEQ ID NO: 4415101 - DNA, 22 bp, Homo sapiens
acatttctaagactactaaggc

SEQ ID NO: 4415102 - DNA, 23 bp, Homo sapiens
acatttctactatgatcagaaga

SEQ ID NO: 4415103 - DNA, 22 bp, Homo sapiens
acatttctctaactcctgccat

SEQ ID NO: 4415104 - DNA, 23 bp, Homo sapiens
acatttctctaactcctgccatt

SEQ ID NO: 4415105 - DNA, 23 bp, Homo sapiens
acatttctctaagagaacaatgt

SEQ ID NO: 4415106 - DNA, 20 bp, Homo sapiens
acatttctcttccccttaga

SEQ ID NO: 4415107 - DNA, 17 bp, Homo sapiens
acatttcttaaaacaca

SEQ ID NO: 4415108 - DNA, 21 bp, Homo sapiens
acatttcttaaaacacatgat

SEQ ID NO: 4415109 - DNA, 22 bp, Homo sapiens
acatttcttaaaacacatgata

SEQ ID NO: 4415110 - DNA, 17 bp, Homo sapiens
acatttcttaaattatt

SEQ ID NO: 4415111 - DNA, 22 bp, Homo sapiens
acatttcttaaattattttata

SEQ ID NO: 4415112 - DNA, 19 bp, Homo sapiens
acatttgagccatgtcaca

SEQ ID NO: 4415113 - DNA, 22 bp, Homo sapiens
acatttgatgcatgtcttttaa

SEQ ID NO: 4415114 - DNA, 19 bp, Homo sapiens
acatttgattaataaaata

SEQ ID NO: 4415115 - DNA, 21 bp, Homo sapiens
acatttgattaataaaatatc

SEQ ID NO: 4415116 - DNA, 12 bp, Homo sapiens
acatttgctgaa

SEQ ID NO: 4415117 - DNA, 21 bp, Homo sapiens
acatttgctgaactcagcaca

SEQ ID NO: 4415118 - DNA, 12 bp, Homo sapiens
acatttggaata

SEQ ID NO: 4415119 - DNA, 15 bp, Homo sapiens
acatttggaatactt

SEQ ID NO: 4415120 - DNA, 17 bp, Homo sapiens
acatttggaatactttt

SEQ ID NO: 4415121 - DNA, 22 bp, Homo sapiens
acatttggaggcaatcctacct

SEQ ID NO: 4415122 - DNA, 23 bp, Homo sapiens
acattttaaaatgtttaaattct

SEQ ID NO: 4415123 - DNA, 12 bp, Homo sapiens
acattttacagt

SEQ ID NO: 4415124 - DNA, 14 bp, Homo sapiens
acattttacattaa

SEQ ID NO: 4415125 - DNA, 18 bp, Homo sapiens
acattttacattaaattt

SEQ ID NO: 4415126 - DNA, 18 bp, Homo sapiens
acattttataaagttatg

SEQ ID NO: 4415127 - DNA, 13 bp, Homo sapiens
acattttatgtct

SEQ ID NO: 4415128 - DNA, 13 bp, Homo sapiens
acattttgtaaaa

SEQ ID NO: 4415129 - DNA, 18 bp, Homo sapiens
acatccagagatgactat

SEQ ID NO: 4415130 - DNA, 20 bp, Homo sapiens
acatcccagtttctcagaag

SEQ ID NO: 4415131 - DNA, 18 bp, Homo sapiens
acatcccattgccctggt

SEQ ID NO: 4415132 - DNA, 17 bp, Homo sapiens
acatcctccgtccagcc

SEQ ID NO: 4415133 - DNA, 14 bp, Homo sapiens
acatcggaaaaata

SEQ ID NO: 4415134 - DNA, 16 bp, Homo sapiens
acatctaaagctttat

SEQ ID NO: 4415135 - DNA, 17 bp, Homo sapiens
acatctaaagctttatc

SEQ ID NO: 4415136 - DNA, 19 bp, Homo sapiens
acatctagcccaaaggtaa

SEQ ID NO: 4415137 - DNA, 16 bp, Homo sapiens
acatctatagagataa

SEQ ID NO: 4415138 - DNA, 19 bp, Homo sapiens
acatctattttggattgta

SEQ ID NO: 4415139 - DNA, 19 bp, Homo sapiens
acatctccttgatcatgtc

SEQ ID NO: 4415140 - DNA, 18 bp, Homo sapiens
acatctctctgccctctc

SEQ ID NO: 4415141 - DNA, 21 bp, Homo sapiens
acatctctctgccctctccct

SEQ ID NO: 4415142 - DNA, 22 bp, Homo sapiens
acatctctctgccctctccctg

SEQ ID NO: 4415143 - DNA, 23 bp, Homo sapiens
acatctctctgccctctccctgt

SEQ ID NO: 4415144 - DNA, 13 bp, Homo sapiens
acatctcttcctc

SEQ ID NO: 4415145 - DNA, 13 bp, Homo sapiens
acatctgaaagcc

SEQ ID NO: 4415146 - DNA, 12 bp, Homo sapiens
acatctgcaccc

SEQ ID NO: 4415147 - DNA, 22 bp, Homo sapiens
acatctgcctgtaattaaacta

SEQ ID NO: 4415148 - DNA, 12 bp, Homo sapiens
acatctgcctta

SEQ ID NO: 4415149 - DNA, 15 bp, Homo sapiens
acatctgtcctgtga

SEQ ID NO: 4415150 - DNA, 22 bp, Homo sapiens
acatctgttatcaaactgctgt

SEQ ID NO: 4415151 - DNA, 13 bp, Homo sapiens
acatcttctttgg

SEQ ID NO: 4415152 - DNA, 14 bp, Homo sapiens
acatcttctttgga

SEQ ID NO: 4415153 - DNA, 20 bp, Homo sapiens
acatcttgaatactctgccc

SEQ ID NO: 4415154 - DNA, 18 bp, Homo sapiens
acatctttttaaagctta

SEQ ID NO: 4415155 - DNA, 19 bp, Homo sapiens
acatctttttaaagcttat

SEQ ID NO: 4415156 - DNA, 18 bp, Homo sapiens
acatgaagattctttccc

SEQ ID NO: 4415157 - DNA, 22 bp, Homo sapiens
acatgaagcaattagtctgaaa

SEQ ID NO: 4415158 - DNA, 13 bp, Homo sapiens
acatgaagctgtt

SEQ ID NO: 4415159 - DNA, 22 bp, Homo sapiens
acatgaaggtaaataaaaagaa

SEQ ID NO: 4415160 - DNA, 16 bp, Homo sapiens
acatgaccttaatgga

SEQ ID NO: 4415161 - DNA, 18 bp, Homo sapiens
acatgacgacaaagctgc

SEQ ID NO: 4415162 - DNA, 19 bp, Homo sapiens
acatgacgacaaagctgct

SEQ ID NO: 4415163 - DNA, 19 bp, Homo sapiens
acatgactctttattgtct

SEQ ID NO: 4415164 - DNA, 21 bp, Homo sapiens
acatgactctttattgtctgt

SEQ ID NO: 4415165 - DNA, 23 bp, Homo sapiens
acatgactctttattgtctgtaa

SEQ ID NO: 4415166 - DNA, 22 bp, Homo sapiens
acatgacttccttatttctgaa

SEQ ID NO: 4415167 - DNA, 13 bp, Homo sapiens
acatgagaaagat

SEQ ID NO: 4415168 - DNA, 18 bp, Homo sapiens
acatgaggaagtagctgt

SEQ ID NO: 4415169 - DNA, 13 bp, Homo sapiens
acatgaggccact

SEQ ID NO: 4415170 - DNA, 15 bp, Homo sapiens
acatgaggccactgg

SEQ ID NO: 4415171 - DNA, 16 bp, Homo sapiens
acatgaggtactgaga

SEQ ID NO: 4415172 - DNA, 18 bp, Homo sapiens
acatgagttcaaatactt

SEQ ID NO: 4415173 - DNA, 13 bp, Homo sapiens
acatgataagaca

SEQ ID NO: 4415174 - DNA, 18 bp, Homo sapiens
acatgataagacattttg

SEQ ID NO: 4415175 - DNA, 14 bp, Homo sapiens
acatgatacatttt

SEQ ID NO: 4415176 - DNA, 19 bp, Homo sapiens
acatgatcctgcaattcca

SEQ ID NO: 4415177 - DNA, 12 bp, Homo sapiens
acatgatttaaa

SEQ ID NO: 4415178 - DNA, 16 bp, Homo sapiens
acatgatttccttgaa

SEQ ID NO: 4415179 - DNA, 13 bp, Homo sapiens
acatgcaataaca

SEQ ID NO: 4415180 - DNA, 15 bp, Homo sapiens
acatgcacagtcata

SEQ ID NO: 4415181 - DNA, 18 bp, Homo sapiens
acatgcacagtcatacaa

SEQ ID NO: 4415182 - DNA, 16 bp, Homo sapiens
acagtccacaggggcc

SEQ ID NO: 4415183 - DNA, 15 bp, Homo sapiens
acagtcccactgtgc

SEQ ID NO: 4415184 - DNA, 18 bp, Homo sapiens
acagtccctatggaaaga

SEQ ID NO: 4415185 - DNA, 12 bp, Homo sapiens
acagtctaaagc

SEQ ID NO: 4415186 - DNA, 14 bp, Homo sapiens
acagtctcactctg

SEQ ID NO: 4415187 - DNA, 13 bp, Homo sapiens
acagtctcaggaa

SEQ ID NO: 4415188 - DNA, 17 bp, Homo sapiens
acagtctcaggaaatca

SEQ ID NO: 4415189 - DNA, 19 bp, Homo sapiens
acagtctctactgttatta

SEQ ID NO: 4415190 - DNA, 21 bp, Homo sapiens
acagtcttccacaaagaaaat

SEQ ID NO: 4415191 - DNA, 14 bp, Homo sapiens
acagtcttgtatta

SEQ ID NO: 4415192 - DNA, 22 bp, Homo sapiens
acagtcttgtattaagttgtta

SEQ ID NO: 4415193 - DNA, 21 bp, Homo sapiens
acagtgaagcagcactgtgag

SEQ ID NO: 4415194 - DNA, 18 bp, Homo sapiens
acagtgagactctgtctc

SEQ ID NO: 4415195 - DNA, 17 bp, Homo sapiens
acagtgagactgtacat

SEQ ID NO: 4415196 - DNA, 18 bp, Homo sapiens
acagtgagactgtacata

SEQ ID NO: 4415197 - DNA, 20 bp, Homo sapiens
acagtgagactgtacataat

SEQ ID NO: 4415198 - DNA, 13 bp, Homo sapiens
acagtgcatgtgc

SEQ ID NO: 4415199 - DNA, 14 bp, Homo sapiens
acagtgcatgtgca

SEQ ID NO: 4415200 - DNA, 18 bp, Homo sapiens
acagtgcatgtgcatgca

SEQ ID NO: 4415201 - DNA, 15 bp, Homo sapiens
acagtgccctgagac

SEQ ID NO: 4415202 - DNA, 14 bp, Homo sapiens
acagtgccttctct

SEQ ID NO: 4415203 - DNA, 21 bp, Homo sapiens
acagtgctgcagctccctggc

SEQ ID NO: 4415204 - DNA, 17 bp, Homo sapiens
acagtggatcacaaagt

SEQ ID NO: 4415205 - DNA, 21 bp, Homo sapiens
acagtggctcacgcctgtaat

SEQ ID NO: 4415206 - DNA, 20 bp, Homo sapiens
acagtggctgctctgggaag

SEQ ID NO: 4415207 - DNA, 22 bp, Homo sapiens
acagtgggcgttgggagcctag

SEQ ID NO: 4415208 - DNA, 15 bp, Homo sapiens
acagtggggaagagt

SEQ ID NO: 4415209 - DNA, 16 bp, Homo sapiens
acagtgtaaagttaat

SEQ ID NO: 4415210 - DNA, 19 bp, Homo sapiens
acagtgtaaagttaatcag

SEQ ID NO: 4415211 - DNA, 17 bp, Homo sapiens
acagtgtacagtcttgt

SEQ ID NO: 4415212 - DNA, 19 bp, Homo sapiens
acagtgtgcctggttaata

SEQ ID NO: 4415213 - DNA, 22 bp, Homo sapiens
acagtgtgtggtcaacatttct

SEQ ID NO: 4415214 - DNA, 18 bp, Homo sapiens
acagtgttaaaagaaaat

SEQ ID NO: 4415215 - DNA, 17 bp, Homo sapiens
acagtgttagtgctggt

SEQ ID NO: 4415216 - DNA, 21 bp, Homo sapiens
acagtgttagtgctggtcaga

SEQ ID NO: 4415217 - DNA, 17 bp, Homo sapiens
acagttagcagggatgt

SEQ ID NO: 4415218 - DNA, 22 bp, Homo sapiens
acagttagcagggatgttcctt

SEQ ID NO: 4415219 - DNA, 19 bp, Homo sapiens
acagttatttcatctttta

SEQ ID NO: 4415220 - DNA, 14 bp, Homo sapiens
acagttcatttaat

SEQ ID NO: 4415221 - DNA, 18 bp, Homo sapiens
acagttctacagaaaaac

SEQ ID NO: 4415222 - DNA, 21 bp, Homo sapiens
acagttctgagctgtaatttc

SEQ ID NO: 4415223 - DNA, 13 bp, Homo sapiens
acagttctgtaat

SEQ ID NO: 4415224 - DNA, 12 bp, Homo sapiens
acagttctgtgg

SEQ ID NO: 4415225 - DNA, 22 bp, Homo sapiens
acagttctgtggtttcatgtta

SEQ ID NO: 4415226 - DNA, 16 bp, Homo sapiens
acagttgagctcaggt

SEQ ID NO: 4415227 - DNA, 13 bp, Homo sapiens
acagttgtattta

SEQ ID NO: 4415228 - DNA, 16 bp, Homo sapiens
acagtttatcatgaag

SEQ ID NO: 4415229 - DNA, 20 bp, Homo sapiens
acagtttatcatgaagcctg

SEQ ID NO: 4415230 - DNA, 22 bp, Homo sapiens
acagtttatcatgaagcctgtg

SEQ ID NO: 4415231 - DNA, 12 bp, Homo sapiens
aaggcaaaattg

SEQ ID NO: 4415232 - DNA, 19 bp, Homo sapiens
aaggcaaaattgcaaatct

SEQ ID NO: 4415233 - DNA, 22 bp, Homo sapiens
aaggcaacataattcttccttc

SEQ ID NO: 4415234 - DNA, 13 bp, Homo sapiens
aaggcaagagggg

SEQ ID NO: 4415235 - DNA, 18 bp, Homo sapiens
aaggcaagcacttgtggg

SEQ ID NO: 4415236 - DNA, 14 bp, Homo sapiens
aaggcaagcatgaa

SEQ ID NO: 4415237 - DNA, 15 bp, Homo sapiens
aaggcaagcatgaat

SEQ ID NO: 4415238 - DNA, 16 bp, Homo sapiens
aaggcaagcatgaata

SEQ ID NO: 4415239 - DNA, 12 bp, Homo sapiens
aaggcacagcta

SEQ ID NO: 4415240 - DNA, 21 bp, Homo sapiens
aaggcagcatgtatagttgct

SEQ ID NO: 4415241 - DNA, 14 bp, Homo sapiens
aaggcagccaccag

SEQ ID NO: 4415242 - DNA, 12 bp, Homo sapiens
aaggcagctgcc

SEQ ID NO: 4415243 - DNA, 18 bp, Homo sapiens
aaggcagctgcctctgct

SEQ ID NO: 4415244 - DNA, 19 bp, Homo sapiens
aaggcagctgcctctgctc

SEQ ID NO: 4415245 - DNA, 23 bp, Homo sapiens
aaggcagctgcctctgctccctc

SEQ ID NO: 4415246 - DNA, 19 bp, Homo sapiens
aaggcaggaatgtgtggca

SEQ ID NO: 4415247 - DNA, 17 bp, Homo sapiens
aaggcaggaggatcact

SEQ ID NO: 4415248 - DNA, 12 bp, Homo sapiens
aaggcagggacc

SEQ ID NO: 4415249 - DNA, 18 bp, Homo sapiens
aaggcaggggaatgtatg

SEQ ID NO: 4415250 - DNA, 17 bp, Homo sapiens
aaggcatacgagagcag

SEQ ID NO: 4415251 - DNA, 22 bp, Homo sapiens
aaggcatcgtcatgcacagtat

SEQ ID NO: 4415252 - DNA, 12 bp, Homo sapiens
aaggcattcagc

SEQ ID NO: 4415253 - DNA, 18 bp, Homo sapiens
aaggccacaggcagtcca

SEQ ID NO: 4415254 - DNA, 17 bp, Homo sapiens
aaggccagagtggcctg

SEQ ID NO: 4415255 - DNA, 22 bp, Homo sapiens
aaggccagagtggcctggccag

SEQ ID NO: 4415256 - DNA, 15 bp, Homo sapiens
aaggccagcaacatt

SEQ ID NO: 4415257 - DNA, 22 bp, Homo sapiens
aaggccagtccccatttctgcc

SEQ ID NO: 4415258 - DNA, 17 bp, Homo sapiens
aaggccagtggaagaaa

SEQ ID NO: 4415259 - DNA, 15 bp, Homo sapiens
aaggcccctgcaatg

SEQ ID NO: 4415260 - DNA, 22 bp, Homo sapiens
aaggcctaccccagttcctagc

SEQ ID NO: 4415261 - DNA, 14 bp, Homo sapiens
aaggcctcttctca

SEQ ID NO: 4415262 - DNA, 16 bp, Homo sapiens
aaggcctcttggagac

SEQ ID NO: 4415263 - DNA, 23 bp, Homo sapiens
aaggcctcttggagaccttaccc

SEQ ID NO: 4415264 - DNA, 11 bp, Homo sapiens
aaggcctgagc

SEQ ID NO: 4415265 - DNA, 18 bp, Homo sapiens
aaggccttttatgtaatt

SEQ ID NO: 4415266 - DNA, 15 bp, Homo sapiens
aaggcgggctgagga

SEQ ID NO: 4415267 - DNA, 17 bp, Homo sapiens
aaggctaaaaagcaaca

SEQ ID NO: 4415268 - DNA, 16 bp, Homo sapiens
aaggctaaaacttaac

SEQ ID NO: 4415269 - DNA, 17 bp, Homo sapiens
aaggctaagaaaaagga

SEQ ID NO: 4415270 - DNA, 21 bp, Homo sapiens
aaggctcagaaggaatggtgc

SEQ ID NO: 4415271 - DNA, 22 bp, Homo sapiens
aaggctcagcttggatttgtgt

SEQ ID NO: 4415272 - DNA, 19 bp, Homo sapiens
aaggctctcacccccatcc

SEQ ID NO: 4415273 - DNA, 12 bp, Homo sapiens
aaggctctcccc

SEQ ID NO: 4415274 - DNA, 14 bp, Homo sapiens
aaggctcttttgta

SEQ ID NO: 4415275 - DNA, 15 bp, Homo sapiens
aaggctgacattcac

SEQ ID NO: 4415276 - DNA, 18 bp, Homo sapiens
aaggctggtaagagaagt

SEQ ID NO: 4415277 - DNA, 24 bp, Homo sapiens
aaggctgtccacgtacttaattta

SEQ ID NO: 4415278 - DNA, 12 bp, Homo sapiens
aaggctgtgata

SEQ ID NO: 4415279 - DNA, 22 bp, Homo sapiens
aaggctgtgtgtcttctgcccc

SEQ ID NO: 4415280 - DNA, 22 bp, Homo sapiens
aaggctgttaaatacaggaaac

SEQ ID NO: 4415281 - DNA, 19 bp, Homo sapiens
aaggcttccaggctgagag

SEQ ID NO: 4415282 - DNA, 16 bp, Homo sapiens
aagggaaactgccagc

SEQ ID NO: 4415283 - DNA, 23 bp, Homo sapiens
aagggaaactgccagcaacgcag

SEQ ID NO: 4415284 - DNA, 19 bp, Homo sapiens
aagggaatttaatactttt

SEQ ID NO: 4415285 - DNA, 18 bp, Homo sapiens
aagggacttaacttgttt

SEQ ID NO: 4415286 - DNA, 16 bp, Homo sapiens
aagggagaagaaaggt

SEQ ID NO: 4415287 - DNA, 17 bp, Homo sapiens
aagggagagcggggcag

SEQ ID NO: 4415288 - DNA, 22 bp, Homo sapiens
aagggagagttctttgctgccc

SEQ ID NO: 4415289 - DNA, 19 bp, Homo sapiens
aagggaggcccagccgcag

SEQ ID NO: 4415290 - DNA, 20 bp, Homo sapiens
aagggaggcccagccgcagg

SEQ ID NO: 4415291 - DNA, 15 bp, Homo sapiens
aagggagtttttgat

SEQ ID NO: 4415292 - DNA, 14 bp, Homo sapiens
aagggccagtcctg

SEQ ID NO: 4415293 - DNA, 12 bp, Homo sapiens
aagggctggctc

SEQ ID NO: 4415294 - DNA, 11 bp, Homo sapiens
aagggctgggc

SEQ ID NO: 4415295 - DNA, 23 bp, Homo sapiens
aagggcttcggccacaggcaggt

SEQ ID NO: 4415296 - DNA, 21 bp, Homo sapiens
aagggcttgtttttcttcagc

SEQ ID NO: 4415297 - DNA, 17 bp, Homo sapiens
aaggggacacctgtaca

SEQ ID NO: 4415298 - DNA, 18 bp, Homo sapiens
aaggggagagcctgctgg

SEQ ID NO: 4415299 - DNA, 14 bp, Homo sapiens
aaggggtgctttta

SEQ ID NO: 4415300 - DNA, 20 bp, Homo sapiens
aaggggttggttgaggtgga

SEQ ID NO: 4415301 - DNA, 19 bp, Homo sapiens
aagggtagccccctcatct

SEQ ID NO: 4415302 - DNA, 23 bp, Homo sapiens
aagggtagccccctcatctgcag

SEQ ID NO: 4415303 - DNA, 19 bp, Homo sapiens
aagggtccgtggaccagga

SEQ ID NO: 4415304 - DNA, 17 bp, Homo sapiens
aagggtctagggagaga

SEQ ID NO: 4415305 - DNA, 18 bp, Homo sapiens
aagggtctagggagagac

SEQ ID NO: 4415306 - DNA, 20 bp, Homo sapiens
aagggtctagggagagaccc

SEQ ID NO: 4415307 - DNA, 21 bp, Homo sapiens
aagggtgatgggaaagcattg

SEQ ID NO: 4415308 - DNA, 12 bp, Homo sapiens
aagggtgtatag

SEQ ID NO: 4415309 - DNA, 15 bp, Homo sapiens
aagggtgtatagtgt

SEQ ID NO: 4415310 - DNA, 21 bp, Homo sapiens
aagggtttcagagaaaggact

SEQ ID NO: 4415311 - DNA, 16 bp, Homo sapiens
aaggtaaataaaaaga

SEQ ID NO: 4415312 - DNA, 13 bp, Homo sapiens
aaggtacatcatt

SEQ ID NO: 4415313 - DNA, 13 bp, Homo sapiens
aaggtagaatgtt

SEQ ID NO: 4415314 - DNA, 20 bp, Homo sapiens
aaggtagcattctttggagt

SEQ ID NO: 4415315 - DNA, 17 bp, Homo sapiens
aaggtcgggacagctgt

SEQ ID NO: 4415316 - DNA, 23 bp, Homo sapiens
aaggtctcatgctgttgctgcta

SEQ ID NO: 4415317 - DNA, 21 bp, Homo sapiens
aaggtctcctaaaactgggat

SEQ ID NO: 4415318 - DNA, 14 bp, Homo sapiens
aaggtctgagccac

SEQ ID NO: 4415319 - DNA, 19 bp, Homo sapiens
aaggtctgcactcctttat

SEQ ID NO: 4415320 - DNA, 19 bp, Homo sapiens
aaggtctttcagtactttt

SEQ ID NO: 4415321 - DNA, 20 bp, Homo sapiens
aaggtgagtttgagctgcct

SEQ ID NO: 4415322 - DNA, 22 bp, Homo sapiens
aaggtgagtttgagctgccttc

SEQ ID NO: 4415323 - DNA, 17 bp, Homo sapiens
aaggtgccatggaagag

SEQ ID NO: 4415324 - DNA, 18 bp, Homo sapiens
aaggtgcctgtgaggcag

SEQ ID NO: 4415325 - DNA, 19 bp, Homo sapiens
aaggtgctctctttctgtc

SEQ ID NO: 4415326 - DNA, 16 bp, Homo sapiens
aaggtgcttggagttt

SEQ ID NO: 4415327 - DNA, 18 bp, Homo sapiens
aaggtggagtttctctgt

SEQ ID NO: 4415328 - DNA, 21 bp, Homo sapiens
aaggtggcagatgtcttccct

SEQ ID NO: 4415329 - DNA, 21 bp, Homo sapiens
aaggtggggtctttgtgagag

SEQ ID NO: 4415330 - DNA, 23 bp, Homo sapiens
aaggtgttgggtcagtggccagg

SEQ ID NO: 4415331 - DNA, 22 bp, Homo sapiens
gctggcgctcagcagccctagc

SEQ ID NO: 4415332 - DNA, 15 bp, Homo sapiens
gctggcgcttggatc

SEQ ID NO: 4415333 - DNA, 19 bp, Homo sapiens
gctggcgcttggatctggg

SEQ ID NO: 4415334 - DNA, 20 bp, Homo sapiens
gctggcggctactcagcagc

SEQ ID NO: 4415335 - DNA, 17 bp, Homo sapiens
gctggctccccctcccc

SEQ ID NO: 4415336 - DNA, 22 bp, Homo sapiens
gctggctccccctccccaggct

SEQ ID NO: 4415337 - DNA, 22 bp, Homo sapiens
gctggctgaagaggaccagagg

SEQ ID NO: 4415338 - DNA, 21 bp, Homo sapiens
gctggctttgaaacctcaggg

SEQ ID NO: 4415339 - DNA, 19 bp, Homo sapiens
gctgggaactgcagacctg

SEQ ID NO: 4415340 - DNA, 20 bp, Homo sapiens
gctgggaagagaagagggcc

SEQ ID NO: 4415341 - DNA, 23 bp, Homo sapiens
gctgggaagagaagagggcccag

SEQ ID NO: 4415342 - DNA, 16 bp, Homo sapiens
gctgggaagggagggt

SEQ ID NO: 4415343 - DNA, 20 bp, Homo sapiens
gctgggaataagtgccagga

SEQ ID NO: 4415344 - DNA, 14 bp, Homo sapiens
gctgggactacagg

SEQ ID NO: 4415345 - DNA, 21 bp, Homo sapiens
gctgggacttgaacaaagaca

SEQ ID NO: 4415346 - DNA, 23 bp, Homo sapiens
gctgggacttgaacaaagacatt

SEQ ID NO: 4415347 - DNA, 22 bp, Homo sapiens
gctgggaggagggagagggagg

SEQ ID NO: 4415348 - DNA, 19 bp, Homo sapiens
gctgggaggagggcaggca

SEQ ID NO: 4415349 - DNA, 15 bp, Homo sapiens
gctgggcaaggaaaa

SEQ ID NO: 4415350 - DNA, 14 bp, Homo sapiens
gctgggcagaggga

SEQ ID NO: 4415351 - DNA, 14 bp, Homo sapiens
gctgggccaccagg

SEQ ID NO: 4415352 - DNA, 18 bp, Homo sapiens
gctgggccactggggact

SEQ ID NO: 4415353 - DNA, 17 bp, Homo sapiens
gctgggccatgtccaaa

SEQ ID NO: 4415354 - DNA, 20 bp, Homo sapiens
gctgggcccaaccctgtctg

SEQ ID NO: 4415355 - DNA, 14 bp, Homo sapiens
gctgggccccagcc

SEQ ID NO: 4415356 - DNA, 16 bp, Homo sapiens
gctgggccccagccca

SEQ ID NO: 4415357 - DNA, 19 bp, Homo sapiens
gctgggccccagcccaccc

SEQ ID NO: 4415358 - DNA, 21 bp, Homo sapiens
gctgggccccagcccaccctc

SEQ ID NO: 4415359 - DNA, 15 bp, Homo sapiens
gctgggcccctgcac

SEQ ID NO: 4415360 - DNA, 20 bp, Homo sapiens
gctgggcccctgcacaggca

SEQ ID NO: 4415361 - DNA, 13 bp, Homo sapiens
gctgggcccctgg

SEQ ID NO: 4415362 - DNA, 22 bp, Homo sapiens
gctgggccctgcctgcagccag

SEQ ID NO: 4415363 - DNA, 14 bp, Homo sapiens
gctgggctctccac

SEQ ID NO: 4415364 - DNA, 15 bp, Homo sapiens
gctgggctctccacc

SEQ ID NO: 4415365 - DNA, 19 bp, Homo sapiens
gctgggctctccacctcag

SEQ ID NO: 4415366 - DNA, 15 bp, Homo sapiens
gctgggctctgcctt

SEQ ID NO: 4415367 - DNA, 22 bp, Homo sapiens
gctgggcttggcagcccgggtc

SEQ ID NO: 4415368 - DNA, 17 bp, Homo sapiens
gctggggactcagggac

SEQ ID NO: 4415369 - DNA, 13 bp, Homo sapiens
gctggggccagag

SEQ ID NO: 4415370 - DNA, 18 bp, Homo sapiens
gctggggccagaggctgg

SEQ ID NO: 4415371 - DNA, 14 bp, Homo sapiens
gctggggccccatc

SEQ ID NO: 4415372 - DNA, 22 bp, Homo sapiens
gctgggggctgccgagccacca

SEQ ID NO: 4415373 - DNA, 15 bp, Homo sapiens
gctggggttgccaga

SEQ ID NO: 4415374 - DNA, 16 bp, Homo sapiens
gctggggttgccagag

SEQ ID NO: 4415375 - DNA, 23 bp, Homo sapiens
gctgggtccatatcacacacatt

SEQ ID NO: 4415376 - DNA, 17 bp, Homo sapiens
gctgggtcctgccagct

SEQ ID NO: 4415377 - DNA, 19 bp, Homo sapiens
gctggtagagacccccagg

SEQ ID NO: 4415378 - DNA, 16 bp, Homo sapiens
gctggtagaggggaga

SEQ ID NO: 4415379 - DNA, 18 bp, Homo sapiens
gctggtagcagcaggctc

SEQ ID NO: 4415380 - DNA, 15 bp, Homo sapiens
gctggtcacagcctc

SEQ ID NO: 4415381 - DNA, 17 bp, Homo sapiens
gctggtcacagcctcct

SEQ ID NO: 4415382 - DNA, 22 bp, Homo sapiens
gctggtcacagcctcctctgtc

SEQ ID NO: 4415383 - DNA, 16 bp, Homo sapiens
gctggtcagagagacc

SEQ ID NO: 4415384 - DNA, 20 bp, Homo sapiens
gctggtcagagagacctcat

SEQ ID NO: 4415385 - DNA, 12 bp, Homo sapiens
gctggtccttat

SEQ ID NO: 4415386 - DNA, 12 bp, Homo sapiens
gctggtctggag

SEQ ID NO: 4415387 - DNA, 15 bp, Homo sapiens
gctggtgctactgtt

SEQ ID NO: 4415388 - DNA, 12 bp, Homo sapiens
gctggtggagga

SEQ ID NO: 4415389 - DNA, 23 bp, Homo sapiens
gctggtggaggaagggctgggcc

SEQ ID NO: 4415390 - DNA, 12 bp, Homo sapiens
gctggtgtcccc

SEQ ID NO: 4415391 - DNA, 13 bp, Homo sapiens
gctggtgtcccct

SEQ ID NO: 4415392 - DNA, 15 bp, Homo sapiens
gctggtgtccccttc

SEQ ID NO: 4415393 - DNA, 16 bp, Homo sapiens
gctggtgtccccttcc

SEQ ID NO: 4415394 - DNA, 18 bp, Homo sapiens
gctggttggagagctaga

SEQ ID NO: 4415395 - DNA, 15 bp, Homo sapiens
gctgtaaaacttatt

SEQ ID NO: 4415396 - DNA, 14 bp, Homo sapiens
gctgtaaaatttgt

SEQ ID NO: 4415397 - DNA, 23 bp, Homo sapiens
gctgtaaaatttgtgtaaatttg

SEQ ID NO: 4415398 - DNA, 18 bp, Homo sapiens
gctgtaactgagagaaag

SEQ ID NO: 4415399 - DNA, 16 bp, Homo sapiens
gctgtacatctatttt

SEQ ID NO: 4415400 - DNA, 23 bp, Homo sapiens
gctgtacatctattttggattgt

SEQ ID NO: 4415401 - DNA, 15 bp, Homo sapiens
gctgtatagctgctt

SEQ ID NO: 4415402 - DNA, 16 bp, Homo sapiens
gctgtatttacagaca

SEQ ID NO: 4415403 - DNA, 18 bp, Homo sapiens
gctgtcaagttcctttgg

SEQ ID NO: 4415404 - DNA, 19 bp, Homo sapiens
gctgtcacatacaactttt

SEQ ID NO: 4415405 - DNA, 14 bp, Homo sapiens
gctgtcacctctca

SEQ ID NO: 4415406 - DNA, 16 bp, Homo sapiens
gctgtcacctctcagc

SEQ ID NO: 4415407 - DNA, 22 bp, Homo sapiens
gctgtcacctctcagctgctgg

SEQ ID NO: 4415408 - DNA, 11 bp, Homo sapiens
gctgtcccagc

SEQ ID NO: 4415409 - DNA, 15 bp, Homo sapiens
gctgtccccactgcc

SEQ ID NO: 4415410 - DNA, 14 bp, Homo sapiens
gctgtccctgtcac

SEQ ID NO: 4415411 - DNA, 18 bp, Homo sapiens
gctgtcctaccatcagct

SEQ ID NO: 4415412 - DNA, 22 bp, Homo sapiens
gctgtcctaccatcagctctgc

SEQ ID NO: 4415413 - DNA, 17 bp, Homo sapiens
gctgtcctctcgagccc

SEQ ID NO: 4415414 - DNA, 19 bp, Homo sapiens
gctgtcctctcgagcccag

SEQ ID NO: 4415415 - DNA, 20 bp, Homo sapiens
gctgtcctctcgagcccaga

SEQ ID NO: 4415416 - DNA, 20 bp, Homo sapiens
gctgtccttaacccacctct

SEQ ID NO: 4415417 - DNA, 18 bp, Homo sapiens
gctgtccttgaatgccat

SEQ ID NO: 4415418 - DNA, 14 bp, Homo sapiens
gctgtcgccccagg

SEQ ID NO: 4415419 - DNA, 17 bp, Homo sapiens
gctgtcgccccaggccc

SEQ ID NO: 4415420 - DNA, 19 bp, Homo sapiens
gctgtcgccccaggccctc

SEQ ID NO: 4415421 - DNA, 22 bp, Homo sapiens
gctgtctgatctgtgctttcca

SEQ ID NO: 4415422 - DNA, 13 bp, Homo sapiens
gctgtctgggact

SEQ ID NO: 4415423 - DNA, 20 bp, Homo sapiens
gctgtgaatttgtgtaagga

SEQ ID NO: 4415424 - DNA, 14 bp, Homo sapiens
gctgtgagggaggg

SEQ ID NO: 4415425 - DNA, 23 bp, Homo sapiens
gctgtgagggaggggaaaagcat

SEQ ID NO: 4415426 - DNA, 15 bp, Homo sapiens
gctgtgatcttaaaa

SEQ ID NO: 4415427 - DNA, 19 bp, Homo sapiens
gctgtgattttaagacaag

SEQ ID NO: 4415428 - DNA, 14 bp, Homo sapiens
gctgtgctatgaat

SEQ ID NO: 4415429 - DNA, 15 bp, Homo sapiens
gctgtgctatgaatt

SEQ ID NO: 4415430 - DNA, 14 bp, Homo sapiens
gctgtgctgctcaa

SEQ ID NO: 4415431 - DNA, 20 bp, Homo sapiens
gctgtggccgtctcctccct

SEQ ID NO: 4415432 - DNA, 18 bp, Homo sapiens
gctgtgtgctttttttgt

SEQ ID NO: 4415433 - DNA, 22 bp, Homo sapiens
gctgtgtggacttcatctcaag

SEQ ID NO: 4415434 - DNA, 12 bp, Homo sapiens
gctgtgtgtgag

SEQ ID NO: 4415435 - DNA, 13 bp, Homo sapiens
gctgttactgctt

SEQ ID NO: 4415436 - DNA, 17 bp, Homo sapiens
gctgttactgcttctct

SEQ ID NO: 4415437 - DNA, 13 bp, Homo sapiens
gctgttaggacag

SEQ ID NO: 4415438 - DNA, 20 bp, Homo sapiens
gctgttagttataaaactat

SEQ ID NO: 4415439 - DNA, 13 bp, Homo sapiens
gctgttcatcttg

SEQ ID NO: 4415440 - DNA, 16 bp, Homo sapiens
gctgttcatcttgtac

SEQ ID NO: 4415441 - DNA, 12 bp, Homo sapiens
gctgttccagac

SEQ ID NO: 4415442 - DNA, 13 bp, Homo sapiens
gctgttccagact

SEQ ID NO: 4415443 - DNA, 21 bp, Homo sapiens
gctgttccagactcaggttcc

SEQ ID NO: 4415444 - DNA, 13 bp, Homo sapiens
gctgttctcagga

SEQ ID NO: 4415445 - DNA, 12 bp, Homo sapiens
gctgttctgtgg

SEQ ID NO: 4415446 - DNA, 17 bp, Homo sapiens
gctgttgacatatttaa

SEQ ID NO: 4415447 - DNA, 18 bp, Homo sapiens
gctgttgatctttcacta

SEQ ID NO: 4415448 - DNA, 13 bp, Homo sapiens
gctgttgcctcat

SEQ ID NO: 4415449 - DNA, 15 bp, Homo sapiens
gctgttgcctcatct

SEQ ID NO: 4415450 - DNA, 17 bp, Homo sapiens
gctgtttaaagtcacat

SEQ ID NO: 4415451 - DNA, 22 bp, Homo sapiens
gctgtttacttgaatagtattg

SEQ ID NO: 4415452 - DNA, 16 bp, Homo sapiens
gctgtttattaatctt

SEQ ID NO: 4415453 - DNA, 23 bp, Homo sapiens
gctgtttcaaaaaaatctattga

SEQ ID NO: 4415454 - DNA, 14 bp, Homo sapiens
gctgtttcaaatgt

SEQ ID NO: 4415455 - DNA, 22 bp, Homo sapiens
gctgtttcctgacagatgcctg

SEQ ID NO: 4415456 - DNA, 14 bp, Homo sapiens
gctgtttggaaaag

SEQ ID NO: 4415457 - DNA, 13 bp, Homo sapiens
gctgttttggaac

SEQ ID NO: 4415458 - DNA, 16 bp, Homo sapiens
gctgtttttggctgtt

SEQ ID NO: 4415459 - DNA, 13 bp, Homo sapiens
gctgtttttttgt

SEQ ID NO: 4415460 - DNA, 19 bp, Homo sapiens
gcttaaaagcatttttatt

SEQ ID NO: 4415461 - DNA, 11 bp, Homo sapiens
gcttaaaatat

SEQ ID NO: 4415462 - DNA, 23 bp, Homo sapiens
gcttaaaatatgtgaagttttcc

SEQ ID NO: 4415463 - DNA, 18 bp, Homo sapiens
gcttaaacccatacaatg

SEQ ID NO: 4415464 - DNA, 20 bp, Homo sapiens
gcttaaacccatacaatgta

SEQ ID NO: 4415465 - DNA, 22 bp, Homo sapiens
gcttaaacccatattgtaaaac

SEQ ID NO: 4415466 - DNA, 16 bp, Homo sapiens
gcttaaaggtgtcttc

SEQ ID NO: 4415467 - DNA, 20 bp, Homo sapiens
gcttaaaggtgtcttcctcc

SEQ ID NO: 4415468 - DNA, 21 bp, Homo sapiens
gcttaaagttggtattaataa

SEQ ID NO: 4415469 - DNA, 17 bp, Homo sapiens
gcttaaataggaaagtt

SEQ ID NO: 4415470 - DNA, 14 bp, Homo sapiens
gcttaagcctgtgt

SEQ ID NO: 4415471 - DNA, 21 bp, Homo sapiens
gcttaaggagaggagaaactg

SEQ ID NO: 4415472 - DNA, 23 bp, Homo sapiens
gcttaaggagaggagaaactgag

SEQ ID NO: 4415473 - DNA, 21 bp, Homo sapiens
gcttaatccaatattttgcct

SEQ ID NO: 4415474 - DNA, 19 bp, Homo sapiens
gcttagagaggcttgaagg

SEQ ID NO: 4415475 - DNA, 15 bp, Homo sapiens
gcttagatgttccaa

SEQ ID NO: 4415476 - DNA, 15 bp, Homo sapiens
gcttagatttcatag

SEQ ID NO: 4415477 - DNA, 19 bp, Homo sapiens
gcttagtaaaatttatttc

SEQ ID NO: 4415478 - DNA, 14 bp, Homo sapiens
gcttagtgtgaagt

SEQ ID NO: 4415479 - DNA, 18 bp, Homo sapiens
gcttataacctagttaaa

SEQ ID NO: 4415480 - DNA, 18 bp, Homo sapiens
gcttatatgtacttttat

SEQ ID NO: 4415481 - DNA, 18 bp, Homo sapiens
gcttatcaactaatgatt

SEQ ID NO: 4415482 - DNA, 15 bp, Homo sapiens
gcttatccataaaaa

SEQ ID NO: 4415483 - DNA, 13 bp, Homo sapiens
gcttatctgcccc

SEQ ID NO: 4415484 - DNA, 14 bp, Homo sapiens
gcttattcttaact

SEQ ID NO: 4415485 - DNA, 17 bp, Homo sapiens
gcttatttaatatgctt

SEQ ID NO: 4415486 - DNA, 16 bp, Homo sapiens
gcttcaatataagaag

SEQ ID NO: 4415487 - DNA, 16 bp, Homo sapiens
gcttcaatttcaaact

SEQ ID NO: 4415488 - DNA, 18 bp, Homo sapiens
gcttcacccaccaggcca

SEQ ID NO: 4415489 - DNA, 23 bp, Homo sapiens
gcttcacccaccaggccagctca

SEQ ID NO: 4415490 - DNA, 16 bp, Homo sapiens
gcttcactcatgcaaa

SEQ ID NO: 4415491 - DNA, 21 bp, Homo sapiens
gcttcactcatgcaaactgct

SEQ ID NO: 4415492 - DNA, 22 bp, Homo sapiens
gcttcactcatgcaaactgctt

SEQ ID NO: 4415493 - DNA, 22 bp, Homo sapiens
gcttcaggaacctcgagtactg

SEQ ID NO: 4415494 - DNA, 13 bp, Homo sapiens
gcttcatctgtca

SEQ ID NO: 4415495 - DNA, 17 bp, Homo sapiens
gcttcattctttgcagg

SEQ ID NO: 4415496 - DNA, 23 bp, Homo sapiens
gcttcattttatttttgacgtca

SEQ ID NO: 4415497 - DNA, 23 bp, Homo sapiens
gcttccacccgtctctctgccca

SEQ ID NO: 4415498 - DNA, 16 bp, Homo sapiens
gcttccatagctgctg

SEQ ID NO: 4415499 - DNA, 18 bp, Homo sapiens
gcttccatgattctattt

SEQ ID NO: 4415500 - DNA, 22 bp, Homo sapiens
gcttccattttcctacaggcag

SEQ ID NO: 4415501 - DNA, 23 bp, Homo sapiens
gcttcccatgccggtacacagcc

SEQ ID NO: 4415502 - DNA, 14 bp, Homo sapiens
gcttccccactccc

SEQ ID NO: 4415503 - DNA, 17 bp, Homo sapiens
gcttccctgaaagactg

SEQ ID NO: 4415504 - DNA, 14 bp, Homo sapiens
gcttccctggcctc

SEQ ID NO: 4415505 - DNA, 21 bp, Homo sapiens
gcttcctcaaatacatgcaca

SEQ ID NO: 4415506 - DNA, 16 bp, Homo sapiens
gcttcctgggtcctgt

SEQ ID NO: 4415507 - DNA, 19 bp, Homo sapiens
gcttcctgtgtaacatctg

SEQ ID NO: 4415508 - DNA, 15 bp, Homo sapiens
gcttcgaggacagga

SEQ ID NO: 4415509 - DNA, 20 bp, Homo sapiens
gcttcgaggacaggaaaggc

SEQ ID NO: 4415510 - DNA, 20 bp, Homo sapiens
gcttcggagtgaatgtggca

SEQ ID NO: 4415511 - DNA, 19 bp, Homo sapiens
gcttcggccacaggcaggt

SEQ ID NO: 4415512 - DNA, 22 bp, Homo sapiens
gcttcggccacaggcaggtcac

SEQ ID NO: 4415513 - DNA, 19 bp, Homo sapiens
gcttcggccgcgccacccg

SEQ ID NO: 4415514 - DNA, 18 bp, Homo sapiens
gcttcgggcccttcccac

SEQ ID NO: 4415515 - DNA, 16 bp, Homo sapiens
gcttctaaatgcccag

SEQ ID NO: 4415516 - DNA, 15 bp, Homo sapiens
gcttctacatgatgc

SEQ ID NO: 4415517 - DNA, 15 bp, Homo sapiens
gcttctaggagtcaa

SEQ ID NO: 4415518 - DNA, 16 bp, Homo sapiens
gcttctagttctgcca

SEQ ID NO: 4415519 - DNA, 19 bp, Homo sapiens
gcttctagttctgccagga

SEQ ID NO: 4415520 - DNA, 23 bp, Homo sapiens
gcttctattacctattaggtgga

SEQ ID NO: 4415521 - DNA, 13 bp, Homo sapiens
gcttctcacgctt

SEQ ID NO: 4415522 - DNA, 16 bp, Homo sapiens
gcttctcacgctttgt

SEQ ID NO: 4415523 - DNA, 22 bp, Homo sapiens
gcttctcagatttctgaggaaa

SEQ ID NO: 4415524 - DNA, 22 bp, Homo sapiens
gcttctccaaaaatctgcctgg

SEQ ID NO: 4415525 - DNA, 16 bp, Homo sapiens
gcttctccgccagcct

SEQ ID NO: 4415526 - DNA, 19 bp, Homo sapiens
gcttctccgccagcctcct

SEQ ID NO: 4415527 - DNA, 21 bp, Homo sapiens
gcttctccgccagcctcctct

SEQ ID NO: 4415528 - DNA, 11 bp, Homo sapiens
gcttctcctgt

SEQ ID NO: 4415529 - DNA, 23 bp, Homo sapiens
gcttctcgctgcgcagcctccag

SEQ ID NO: 4415530 - DNA, 20 bp, Homo sapiens
gcttctgcagcaactcccac

SEQ ID NO: 4415531 - DNA, 21 bp, Homo sapiens
gcttctgcagcaactcccacg

SEQ ID NO: 4415532 - DNA, 16 bp, Homo sapiens
gcttctgcttttctgc

SEQ ID NO: 4415533 - DNA, 21 bp, Homo sapiens
gcttcttattaatcatacaaa

SEQ ID NO: 4415534 - DNA, 19 bp, Homo sapiens
gcttcttggagctttggaa

SEQ ID NO: 4415535 - DNA, 12 bp, Homo sapiens
gcttctttctag

SEQ ID NO: 4415536 - DNA, 15 bp, Homo sapiens
gcttctttctagaaa

SEQ ID NO: 4415537 - DNA, 17 bp, Homo sapiens
gcttcttttctttgtat

SEQ ID NO: 4415538 - DNA, 11 bp, Homo sapiens
gcttgaacaca

SEQ ID NO: 4415539 - DNA, 23 bp, Homo sapiens
gcttgaacacagtattttcccaa

SEQ ID NO: 4415540 - DNA, 20 bp, Homo sapiens
gcttgaactaggctgagcaa

SEQ ID NO: 4415541 - DNA, 15 bp, Homo sapiens
gcttgaagccaaaga

SEQ ID NO: 4415542 - DNA, 16 bp, Homo sapiens
gcttgaagccaaagaa

SEQ ID NO: 4415543 - DNA, 18 bp, Homo sapiens
gcttgaagccaaagaaaa

SEQ ID NO: 4415544 - DNA, 13 bp, Homo sapiens
gcttgaaggccag

SEQ ID NO: 4415545 - DNA, 13 bp, Homo sapiens
gcttgacatacct

SEQ ID NO: 4415546 - DNA, 20 bp, Homo sapiens
gcttgaccatgttgcactgt

SEQ ID NO: 4415547 - DNA, 20 bp, Homo sapiens
gcttgagaaatatggacact

SEQ ID NO: 4415548 - DNA, 18 bp, Homo sapiens
gcttgagccgggcccctg

SEQ ID NO: 4415549 - DNA, 13 bp, Homo sapiens
gcttgagctcagg

SEQ ID NO: 4415550 - DNA, 14 bp, Homo sapiens
gcttgatttttgcc

SEQ ID NO: 4415551 - DNA, 15 bp, Homo sapiens
gcttgcacagccaac

SEQ ID NO: 4415552 - DNA, 16 bp, Homo sapiens
gcttgcccgctcccac

SEQ ID NO: 4415553 - DNA, 14 bp, Homo sapiens
gcttgcctgaagct

SEQ ID NO: 4415554 - DNA, 18 bp, Homo sapiens
gcttgctcgcttgctgga

SEQ ID NO: 4415555 - DNA, 17 bp, Homo sapiens
gcttgctggaacacagg

SEQ ID NO: 4415556 - DNA, 19 bp, Homo sapiens
gcttgctggaacacagggg

SEQ ID NO: 4415557 - DNA, 20 bp, Homo sapiens
gcttgctggaacacaggggc

SEQ ID NO: 4415558 - DNA, 13 bp, Homo sapiens
gcttgcttctgca

SEQ ID NO: 4415559 - DNA, 15 bp, Homo sapiens
gcttgcttctgcagc

SEQ ID NO: 4415560 - DNA, 12 bp, Homo sapiens
gcttgcttttct

SEQ ID NO: 4415561 - DNA, 11 bp, Homo sapiens
gcttggagcaa

SEQ ID NO: 4415562 - DNA, 23 bp, Homo sapiens
gcttggatttcgtgtgccgctgc

SEQ ID NO: 4415563 - DNA, 21 bp, Homo sapiens
gcttggcagttgcagtgctgc

SEQ ID NO: 4415564 - DNA, 20 bp, Homo sapiens
gcttgggagcctgtggccag

SEQ ID NO: 4415565 - DNA, 23 bp, Homo sapiens
gcttgggagcctgtggccagcag

SEQ ID NO: 4415566 - DNA, 15 bp, Homo sapiens
gcttgggcagtgccc

SEQ ID NO: 4415567 - DNA, 21 bp, Homo sapiens
gcttgggcagtgccccaggga

SEQ ID NO: 4415568 - DNA, 15 bp, Homo sapiens
gcttgggctccacgg

SEQ ID NO: 4415569 - DNA, 17 bp, Homo sapiens
gcttgggtctctctcgg

SEQ ID NO: 4415570 - DNA, 20 bp, Homo sapiens
gcttggtgacaaaattcatt

SEQ ID NO: 4415571 - DNA, 22 bp, Homo sapiens
gcttgtaactccaccaacccat

SEQ ID NO: 4415572 - DNA, 18 bp, Homo sapiens
gcttgtattgtaaatgtg

SEQ ID NO: 4415573 - DNA, 15 bp, Homo sapiens
gcttgtccagcgcct

SEQ ID NO: 4415574 - DNA, 22 bp, Homo sapiens
gcttgtcttcgtccatctgttg

SEQ ID NO: 4415575 - DNA, 12 bp, Homo sapiens
gcttgtgttctg

SEQ ID NO: 4415576 - DNA, 15 bp, Homo sapiens
gcttgttagagagaa

SEQ ID NO: 4415577 - DNA, 20 bp, Homo sapiens
gcttgtttacagcactactc

SEQ ID NO: 4415578 - DNA, 17 bp, Homo sapiens
gcttgtttttcttcagc

SEQ ID NO: 4415579 - DNA, 14 bp, Homo sapiens
gctttaaactgaca

SEQ ID NO: 4415580 - DNA, 16 bp, Homo sapiens
gctttaaatgacagta

SEQ ID NO: 4415581 - DNA, 18 bp, Homo sapiens
gctttaacctgctgggaa

SEQ ID NO: 4415582 - DNA, 19 bp, Homo sapiens
gctttaacctgctgggaat

SEQ ID NO: 4415583 - DNA, 13 bp, Homo sapiens
gctttatctttgt

SEQ ID NO: 4415584 - DNA, 14 bp, Homo sapiens
gctttatctttgtg

SEQ ID NO: 4415585 - DNA, 12 bp, Homo sapiens
gctttatgattt

SEQ ID NO: 4415586 - DNA, 16 bp, Homo sapiens
gctttatgattttcat

SEQ ID NO: 4415587 - DNA, 22 bp, Homo sapiens
gctttatggtcctaaaagcaaa

SEQ ID NO: 4415588 - DNA, 22 bp, Homo sapiens
gctttcaaagctaaaatatata

SEQ ID NO: 4415589 - DNA, 23 bp, Homo sapiens
gctttcagagccagcctggctct

SEQ ID NO: 4415590 - DNA, 20 bp, Homo sapiens
gctttccaggcaccctcagg

SEQ ID NO: 4415591 - DNA, 22 bp, Homo sapiens
gctttccatttttttctttact

SEQ ID NO: 4415592 - DNA, 12 bp, Homo sapiens
gctttcccagga

SEQ ID NO: 4415593 - DNA, 19 bp, Homo sapiens
gctttcctaaagtctctgc

SEQ ID NO: 4415594 - DNA, 24 bp, Homo sapiens
gctttcctcaaaaagcagaaggag

SEQ ID NO: 4415595 - DNA, 19 bp, Homo sapiens
gctttcctcatcaggccat

SEQ ID NO: 4415596 - DNA, 22 bp, Homo sapiens
gctttcctgaatccaaactaat

SEQ ID NO: 4415597 - DNA, 14 bp, Homo sapiens
gctttccttcatct

SEQ ID NO: 4415598 - DNA, 13 bp, Homo sapiens
gctttctaccaca

SEQ ID NO: 4415599 - DNA, 19 bp, Homo sapiens
gctttctcctttaattgta

SEQ ID NO: 4415600 - DNA, 21 bp, Homo sapiens
gctttctctctagtagttaga

SEQ ID NO: 4415601 - DNA, 23 bp, Homo sapiens
gctttctggggcctagcgatctc

SEQ ID NO: 4415602 - DNA, 12 bp, Homo sapiens
gctttctgttcc

SEQ ID NO: 4415603 - DNA, 15 bp, Homo sapiens
gctttctgttccaaa

SEQ ID NO: 4415604 - DNA, 16 bp, Homo sapiens
gctttgaaacctcagg

SEQ ID NO: 4415605 - DNA, 16 bp, Homo sapiens
gctttgaatctgggac

SEQ ID NO: 4415606 - DNA, 13 bp, Homo sapiens
gctttgactccct

SEQ ID NO: 4415607 - DNA, 21 bp, Homo sapiens
gctttgagtccacgcccacca

SEQ ID NO: 4415608 - DNA, 16 bp, Homo sapiens
gctttgcagctgctgt

SEQ ID NO: 4415609 - DNA, 17 bp, Homo sapiens
gctttgcagctgctgtc

SEQ ID NO: 4415610 - DNA, 18 bp, Homo sapiens
gctttgcatgttccacta

SEQ ID NO: 4415611 - DNA, 20 bp, Homo sapiens
gctttgcatgttccactaac

SEQ ID NO: 4415612 - DNA, 17 bp, Homo sapiens
gctttgccaaaatacca

SEQ ID NO: 4415613 - DNA, 22 bp, Homo sapiens
gctttgcctcttctttgtgcct

SEQ ID NO: 4415614 - DNA, 13 bp, Homo sapiens
gctttgctttgta

SEQ ID NO: 4415615 - DNA, 17 bp, Homo sapiens
gctttggaaaaatgggt

SEQ ID NO: 4415616 - DNA, 12 bp, Homo sapiens
gctttgggctgg

SEQ ID NO: 4415617 - DNA, 15 bp, Homo sapiens
gctttgggctgggat

SEQ ID NO: 4415618 - DNA, 20 bp, Homo sapiens
gctttggggtcctagcccag

SEQ ID NO: 4415619 - DNA, 23 bp, Homo sapiens
gctttggttaagggctccctaaa

SEQ ID NO: 4415620 - DNA, 15 bp, Homo sapiens
gctttggttctctga

SEQ ID NO: 4415621 - DNA, 15 bp, Homo sapiens
gctttgtacttgtga

SEQ ID NO: 4415622 - DNA, 20 bp, Homo sapiens
gctttgtcacttgccacatg

SEQ ID NO: 4415623 - DNA, 18 bp, Homo sapiens
gctttgtttactctcttc

SEQ ID NO: 4415624 - DNA, 17 bp, Homo sapiens
gcttttaaaaaaaaata

SEQ ID NO: 4415625 - DNA, 17 bp, Homo sapiens
gcttttaaccatctgat

SEQ ID NO: 4415626 - DNA, 13 bp, Homo sapiens
gcttttagaaaag

SEQ ID NO: 4415627 - DNA, 12 bp, Homo sapiens
gcttttatggat

SEQ ID NO: 4415628 - DNA, 13 bp, Homo sapiens
gcttttatggatg

SEQ ID NO: 4415629 - DNA, 18 bp, Homo sapiens
gcttttattaatgcactt

SEQ ID NO: 4415630 - DNA, 16 bp, Homo sapiens
gcttttcagtgttccc

SEQ ID NO: 4415631 - DNA, 22 bp, Homo sapiens
gcttttcctcaaagggagagag

SEQ ID NO: 4415632 - DNA, 20 bp, Homo sapiens
gcttttcctggacagctaga

SEQ ID NO: 4415633 - DNA, 20 bp, Homo sapiens
gcttttcgcttgcttctgca

SEQ ID NO: 4415634 - DNA, 19 bp, Homo sapiens
gcttttctgccctggctgc

SEQ ID NO: 4415635 - DNA, 16 bp, Homo sapiens
gcttttgatgtctcca

SEQ ID NO: 4415636 - DNA, 13 bp, Homo sapiens
gcttttgcttcta

SEQ ID NO: 4415637 - DNA, 12 bp, Homo sapiens
gcttttgtgtgc

SEQ ID NO: 4415638 - DNA, 16 bp, Homo sapiens
gcttttgttctagact

SEQ ID NO: 4415639 - DNA, 23 bp, Homo sapiens
gcttttgtttcctttttcagata

SEQ ID NO: 4415640 - DNA, 17 bp, Homo sapiens
gctttttaatagcacta

SEQ ID NO: 4415641 - DNA, 14 bp, Homo sapiens
gctttttattattt

SEQ ID NO: 4415642 - DNA, 13 bp, Homo sapiens
gctttttcacagt

SEQ ID NO: 4415643 - DNA, 23 bp, Homo sapiens
gctttttccccattggaactagt

SEQ ID NO: 4415644 - DNA, 12 bp, Homo sapiens
gctttttggaat

SEQ ID NO: 4415645 - DNA, 16 bp, Homo sapiens
gctttttgttcagaat

SEQ ID NO: 4415646 - DNA, 17 bp, Homo sapiens
gcttttttccaaaacaa

SEQ ID NO: 4415647 - DNA, 21 bp, Homo sapiens
gctttttttgtgtgtatttgc

SEQ ID NO: 4415648 - DNA, 17 bp, Homo sapiens
ggaaaaaagatttttaa

SEQ ID NO: 4415649 - DNA, 14 bp, Homo sapiens
ggaaaaagaaaata

SEQ ID NO: 4415650 - DNA, 14 bp, Homo sapiens
ggaaaacagaaaac

SEQ ID NO: 4415651 - DNA, 16 bp, Homo sapiens
ggaaaactgacagagg

SEQ ID NO: 4415652 - DNA, 14 bp, Homo sapiens
ggaaaactgtgttg

SEQ ID NO: 4415653 - DNA, 15 bp, Homo sapiens
ggaaaaggcccctgc

SEQ ID NO: 4415654 - DNA, 20 bp, Homo sapiens
ggaaaatgcttaaaaaataa

SEQ ID NO: 4415655 - DNA, 19 bp, Homo sapiens
ggaaaatgtattgattcaa

SEQ ID NO: 4415656 - DNA, 15 bp, Homo sapiens
ggaaaattcattttt

SEQ ID NO: 4415657 - DNA, 15 bp, Homo sapiens
ggaaacaaaagattc

SEQ ID NO: 4415658 - DNA, 15 bp, Homo sapiens
ggaaacaacatttat

SEQ ID NO: 4415659 - DNA, 13 bp, Homo sapiens
ggaaacagcctct

SEQ ID NO: 4415660 - DNA, 15 bp, Homo sapiens
ggaaacagcctctct

SEQ ID NO: 4415661 - DNA, 17 bp, Homo sapiens
ggaaactaagattcttt

SEQ ID NO: 4415662 - DNA, 19 bp, Homo sapiens
ggaaactaagattctttta

SEQ ID NO: 4415663 - DNA, 18 bp, Homo sapiens
ggaaactccacatctgcc

SEQ ID NO: 4415664 - DNA, 21 bp, Homo sapiens
ggaaactccacatctgcctta

SEQ ID NO: 4415665 - DNA, 16 bp, Homo sapiens
ggaaactcctgtgacc

SEQ ID NO: 4415666 - DNA, 14 bp, Homo sapiens
ggaaactgggaaac

SEQ ID NO: 4415667 - DNA, 21 bp, Homo sapiens
ggaaacttagcttttgatgtc

SEQ ID NO: 4415668 - DNA, 12 bp, Homo sapiens
ggaaagaagaaa

SEQ ID NO: 4415669 - DNA, 21 bp, Homo sapiens
ggaaagcaagaatcagagaag

SEQ ID NO: 4415670 - DNA, 16 bp, Homo sapiens
ggaaagccctccccct

SEQ ID NO: 4415671 - DNA, 19 bp, Homo sapiens
ggaaagcttttcagtgttc

SEQ ID NO: 4415672 - DNA, 17 bp, Homo sapiens
ggaaaggctcatttaaa

SEQ ID NO: 4415673 - DNA, 15 bp, Homo sapiens
ggaaagggctggctc

SEQ ID NO: 4415674 - DNA, 18 bp, Homo sapiens
ggaaaggggagagcctgc

SEQ ID NO: 4415675 - DNA, 11 bp, Homo sapiens
ggaaagtcaga

SEQ ID NO: 4415676 - DNA, 18 bp, Homo sapiens
ggaaagtcagaatcagaa

SEQ ID NO: 4415677 - DNA, 22 bp, Homo sapiens
ggaaagtgccagcattccagac

SEQ ID NO: 4415678 - DNA, 19 bp, Homo sapiens
ggaaagtgctgtcttaaac

SEQ ID NO: 4415679 - DNA, 18 bp, Homo sapiens
ggaaagtttgccaggagg

SEQ ID NO: 4415680 - DNA, 15 bp, Homo sapiens
ggaaagttttctcca

SEQ ID NO: 4415681 - DNA, 22 bp, Homo sapiens
ggaaataaacattacggtacag

SEQ ID NO: 4415682 - DNA, 16 bp, Homo sapiens
ggaaataatatcattt

SEQ ID NO: 4415683 - DNA, 18 bp, Homo sapiens
ggaaatacagttctgctc

SEQ ID NO: 4415684 - DNA, 18 bp, Homo sapiens
ggaaatagaaagaagcca

SEQ ID NO: 4415685 - DNA, 20 bp, Homo sapiens
ggaaatagaaagaagccata

SEQ ID NO: 4415686 - DNA, 18 bp, Homo sapiens
ggaaatagcggccctgga

SEQ ID NO: 4415687 - DNA, 22 bp, Homo sapiens
ggaaatatcagttactcagccc

SEQ ID NO: 4415688 - DNA, 20 bp, Homo sapiens
ggaaatattaagaacatttt

SEQ ID NO: 4415689 - DNA, 16 bp, Homo sapiens
ggaaatcaaatatgca

SEQ ID NO: 4415690 - DNA, 17 bp, Homo sapiens
ggaaatcaaatatgcaa

SEQ ID NO: 4415691 - DNA, 19 bp, Homo sapiens
ggaaatcttttacattttt

SEQ ID NO: 4415692 - DNA, 22 bp, Homo sapiens
ggaaatcttttacatttttcct

SEQ ID NO: 4415693 - DNA, 18 bp, Homo sapiens
gcgagcacagtattattt

SEQ ID NO: 4415694 - DNA, 18 bp, Homo sapiens
gcgagcatgtcgtggaca

SEQ ID NO: 4415695 - DNA, 15 bp, Homo sapiens
gcgaggaggctccag

SEQ ID NO: 4415696 - DNA, 17 bp, Homo sapiens
gcgaggaggctccagag

SEQ ID NO: 4415697 - DNA, 19 bp, Homo sapiens
gcgaggtcaacagagaagg

SEQ ID NO: 4415698 - DNA, 14 bp, Homo sapiens
gcgagtccaaggcc

SEQ ID NO: 4415699 - DNA, 16 bp, Homo sapiens
gcgagtccaaggccag

SEQ ID NO: 4415700 - DNA, 13 bp, Homo sapiens
gcgcaagcctgta

SEQ ID NO: 4415701 - DNA, 13 bp, Homo sapiens
gcgcaccccacag

SEQ ID NO: 4415702 - DNA, 12 bp, Homo sapiens
gcgcactgcatg

SEQ ID NO: 4415703 - DNA, 15 bp, Homo sapiens
gcgcactgcatggga

SEQ ID NO: 4415704 - DNA, 18 bp, Homo sapiens
gcgcagcctccagggccc

SEQ ID NO: 4415705 - DNA, 20 bp, Homo sapiens
gcgcatagtgtgctcggaca

SEQ ID NO: 4415706 - DNA, 22 bp, Homo sapiens
gcgcatagtgtgctcggacaca

SEQ ID NO: 4415707 - DNA, 21 bp, Homo sapiens
gcgccaaaacaagccaaagag

SEQ ID NO: 4415708 - DNA, 22 bp, Homo sapiens
gcgccaaaacaagccaaagagc

SEQ ID NO: 4415709 - DNA, 20 bp, Homo sapiens
gcgccacccaccatcaaagg

SEQ ID NO: 4415710 - DNA, 18 bp, Homo sapiens
gcgccaccgtgcctggct

SEQ ID NO: 4415711 - DNA, 21 bp, Homo sapiens
gcgccaggaagccagagcccc

SEQ ID NO: 4415712 - DNA, 12 bp, Homo sapiens
gcgcccacccgg

SEQ ID NO: 4415713 - DNA, 18 bp, Homo sapiens
gcgcccacccggcccggc

SEQ ID NO: 4415714 - DNA, 22 bp, Homo sapiens
gcgcccccgagccctgactcct

SEQ ID NO: 4415715 - DNA, 21 bp, Homo sapiens
gcgccccgcacgactgcggga

SEQ ID NO: 4415716 - DNA, 14 bp, Homo sapiens
gcgcccggcccaag

SEQ ID NO: 4415717 - DNA, 20 bp, Homo sapiens
gcgcctagtggggtctccct

SEQ ID NO: 4415718 - DNA, 17 bp, Homo sapiens
gcgcctcagccctcagt

SEQ ID NO: 4415719 - DNA, 16 bp, Homo sapiens
gcgcctccctccaccc

SEQ ID NO: 4415720 - DNA, 21 bp, Homo sapiens
gcgcctgagatacaaggccca

SEQ ID NO: 4415721 - DNA, 11 bp, Homo sapiens
gcgcctgctgc

SEQ ID NO: 4415722 - DNA, 22 bp, Homo sapiens
gcgcctgctgcctgctgagatg

SEQ ID NO: 4415723 - DNA, 16 bp, Homo sapiens
gcgccttcgtgcctga

SEQ ID NO: 4415724 - DNA, 23 bp, Homo sapiens
gcgccttcgtgcctgagaccagg

SEQ ID NO: 4415725 - DNA, 12 bp, Homo sapiens
gcgcgatctcag

SEQ ID NO: 4415726 - DNA, 18 bp, Homo sapiens
gcgcgccaccgtgcctgg

SEQ ID NO: 4415727 - DNA, 13 bp, Homo sapiens
gcgcggccagccc

SEQ ID NO: 4415728 - DNA, 12 bp, Homo sapiens
gcgcggctggga

SEQ ID NO: 4415729 - DNA, 17 bp, Homo sapiens
gcgcgggcagccaccca

SEQ ID NO: 4415730 - DNA, 20 bp, Homo sapiens
gcgcggtggcgggcacctgt

SEQ ID NO: 4415731 - DNA, 13 bp, Homo sapiens
gcgcggtggctca

SEQ ID NO: 4415732 - DNA, 22 bp, Homo sapiens
gcgctaattcaaggaatttctt

SEQ ID NO: 4415733 - DNA, 15 bp, Homo sapiens
gcgctatccacagaa

SEQ ID NO: 4415734 - DNA, 10 bp, Homo sapiens
gcgctcaggg

SEQ ID NO: 4415735 - DNA, 21 bp, Homo sapiens
gcgctcctgccgcagagctgg

SEQ ID NO: 4415736 - DNA, 16 bp, Homo sapiens
gcgctcgcccagcagg

SEQ ID NO: 4415737 - DNA, 23 bp, Homo sapiens
gcgctgcatacaggggaggggcg

SEQ ID NO: 4415738 - DNA, 17 bp, Homo sapiens
gcgctgccgcaccccag

SEQ ID NO: 4415739 - DNA, 18 bp, Homo sapiens
gcggagaccctgagtccg

SEQ ID NO: 4415740 - DNA, 13 bp, Homo sapiens
gcctgcctggagc

SEQ ID NO: 4415741 - DNA, 13 bp, Homo sapiens
gcctgcctggcag

SEQ ID NO: 4415742 - DNA, 16 bp, Homo sapiens
gcctgcctggcaggct

SEQ ID NO: 4415743 - DNA, 15 bp, Homo sapiens
gcctgcgcctgctgc

SEQ ID NO: 4415744 - DNA, 21 bp, Homo sapiens
gcctgcggcccagaagtttcc

SEQ ID NO: 4415745 - DNA, 19 bp, Homo sapiens
gcctgcgggcccctggtga

SEQ ID NO: 4415746 - DNA, 13 bp, Homo sapiens
gcctgctccccca

SEQ ID NO: 4415747 - DNA, 14 bp, Homo sapiens
gcctgctccttggc

SEQ ID NO: 4415748 - DNA, 23 bp, Homo sapiens
gcctgctgaatgatttccaaaga

SEQ ID NO: 4415749 - DNA, 11 bp, Homo sapiens
gcctgctgcat

SEQ ID NO: 4415750 - DNA, 18 bp, Homo sapiens
gcctgctgcatggggtgg

SEQ ID NO: 4415751 - DNA, 16 bp, Homo sapiens
gcctgctgccagtgca

SEQ ID NO: 4415752 - DNA, 18 bp, Homo sapiens
gcctgctgccagtgcagc

SEQ ID NO: 4415753 - DNA, 19 bp, Homo sapiens
gcctgctgccagtgcagcc

SEQ ID NO: 4415754 - DNA, 21 bp, Homo sapiens
gcctgctgccagtgcagccac

SEQ ID NO: 4415755 - DNA, 13 bp, Homo sapiens
gcctgctgcctgc

SEQ ID NO: 4415756 - DNA, 10 bp, Homo sapiens
gcctgctggc

SEQ ID NO: 4415757 - DNA, 21 bp, Homo sapiens
gcctgctggccgacccactga

SEQ ID NO: 4415758 - DNA, 18 bp, Homo sapiens
gcctgctggctgcggccc

SEQ ID NO: 4415759 - DNA, 23 bp, Homo sapiens
gcctgctgggctctccacctcag

SEQ ID NO: 4415760 - DNA, 22 bp, Homo sapiens
gcctgctggtcacagcctcctc

SEQ ID NO: 4415761 - DNA, 17 bp, Homo sapiens
gcctggaccagcctctc

SEQ ID NO: 4415762 - DNA, 18 bp, Homo sapiens
gcctggcacgaaggcccc

SEQ ID NO: 4415763 - DNA, 20 bp, Homo sapiens
gcctggcagtccgtgggacg

SEQ ID NO: 4415764 - DNA, 14 bp, Homo sapiens
gcctggccaccagc

SEQ ID NO: 4415765 - DNA, 16 bp, Homo sapiens
gcctggccaccagcca

SEQ ID NO: 4415766 - DNA, 18 bp, Homo sapiens
gcctggccaccagccatc

SEQ ID NO: 4415767 - DNA, 14 bp, Homo sapiens
gcctggccaggagc

SEQ ID NO: 4415768 - DNA, 14 bp, Homo sapiens
gcctggccaggcag

SEQ ID NO: 4415769 - DNA, 16 bp, Homo sapiens
gcctggccatttccaa

SEQ ID NO: 4415770 - DNA, 15 bp, Homo sapiens
gcctggccccagcct

SEQ ID NO: 4415771 - DNA, 18 bp, Homo sapiens
gcctggccccagcctggg

SEQ ID NO: 4415772 - DNA, 15 bp, Homo sapiens
gcctggccccaggcc

SEQ ID NO: 4415773 - DNA, 23 bp, Homo sapiens
gcctggccccaggccccagacag

SEQ ID NO: 4415774 - DNA, 12 bp, Homo sapiens
gcctggccctgc

SEQ ID NO: 4415775 - DNA, 15 bp, Homo sapiens
gcctggccgcagggc

SEQ ID NO: 4415776 - DNA, 14 bp, Homo sapiens
gcctggcctcatct

SEQ ID NO: 4415777 - DNA, 16 bp, Homo sapiens
gcctggctccagtctc

SEQ ID NO: 4415778 - DNA, 14 bp, Homo sapiens
gcctggctccctga

SEQ ID NO: 4415779 - DNA, 14 bp, Homo sapiens
gcctggctctgccc

SEQ ID NO: 4415780 - DNA, 16 bp, Homo sapiens
gcctggctctgccccc

SEQ ID NO: 4415781 - DNA, 22 bp, Homo sapiens
gcctggctctgccccctccccc

SEQ ID NO: 4415782 - DNA, 10 bp, Homo sapiens
gcctgggaga

SEQ ID NO: 4415783 - DNA, 17 bp, Homo sapiens
gcctgggagcccagagg

SEQ ID NO: 4415784 - DNA, 20 bp, Homo sapiens
gcctgggcaacagagcaaga

SEQ ID NO: 4415785 - DNA, 17 bp, Homo sapiens
gcctgggcagccaggct

SEQ ID NO: 4415786 - DNA, 16 bp, Homo sapiens
gcctgggcaggaggga

SEQ ID NO: 4415787 - DNA, 12 bp, Homo sapiens
gcctgggctcac

SEQ ID NO: 4415788 - DNA, 15 bp, Homo sapiens
gcctgggctcactgt

SEQ ID NO: 4415789 - DNA, 14 bp, Homo sapiens
gcctggggagccca

SEQ ID NO: 4415790 - DNA, 19 bp, Homo sapiens
gcctggggtgcatctcctc

SEQ ID NO: 4415791 - DNA, 17 bp, Homo sapiens
gcctgggtcatgggcct

SEQ ID NO: 4415792 - DNA, 18 bp, Homo sapiens
gcctgggtcatgggcctg

SEQ ID NO: 4415793 - DNA, 18 bp, Homo sapiens
gcctgggtgacagagtga

SEQ ID NO: 4415794 - DNA, 20 bp, Homo sapiens
gcctgggtgacagagtgaga

SEQ ID NO: 4415795 - DNA, 15 bp, Homo sapiens
gcctgggtggggctg

SEQ ID NO: 4415796 - DNA, 18 bp, Homo sapiens
gcctgggtggggctgctc

SEQ ID NO: 4415797 - DNA, 22 bp, Homo sapiens
gcctgggttttgttccctattt

SEQ ID NO: 4415798 - DNA, 22 bp, Homo sapiens
gcctgtaagaaaaaaaatgtac

SEQ ID NO: 4415799 - DNA, 15 bp, Homo sapiens
gcctgtaatcccagc

SEQ ID NO: 4415800 - DNA, 19 bp, Homo sapiens
gcctgtaatcccagcactt

SEQ ID NO: 4415801 - DNA, 20 bp, Homo sapiens
gcctgtaatcccagcacttt

SEQ ID NO: 4415802 - DNA, 17 bp, Homo sapiens
gcctgtaatcccagcag

SEQ ID NO: 4415803 - DNA, 16 bp, Homo sapiens
gcctgtaatcccagct

SEQ ID NO: 4415804 - DNA, 19 bp, Homo sapiens
gcctgtaatcccagctact

SEQ ID NO: 4415805 - DNA, 12 bp, Homo sapiens
gcccgcctgcca

SEQ ID NO: 4415806 - DNA, 16 bp, Homo sapiens
gcccgcctgccagtcc

SEQ ID NO: 4415807 - DNA, 21 bp, Homo sapiens
gcccgcttgctcgcttgctgg

SEQ ID NO: 4415808 - DNA, 21 bp, Homo sapiens
gcccggagattggacggcctg

SEQ ID NO: 4415809 - DNA, 15 bp, Homo sapiens
gcccggcagggcggg

SEQ ID NO: 4415810 - DNA, 18 bp, Homo sapiens
gcccggctaatttttgta

SEQ ID NO: 4415811 - DNA, 13 bp, Homo sapiens
gcccggctgagcc

SEQ ID NO: 4415812 - DNA, 14 bp, Homo sapiens
gcccggctgagccc

SEQ ID NO: 4415813 - DNA, 15 bp, Homo sapiens
gcccggctgagccct

SEQ ID NO: 4415814 - DNA, 15 bp, Homo sapiens
gcccgggagctcagg

SEQ ID NO: 4415815 - DNA, 19 bp, Homo sapiens
gcccgggagctcaggaacc

SEQ ID NO: 4415816 - DNA, 18 bp, Homo sapiens
gcccggtccacaggtcca

SEQ ID NO: 4415817 - DNA, 16 bp, Homo sapiens
gcccgtcagcatcact

SEQ ID NO: 4415818 - DNA, 16 bp, Homo sapiens
gcccgtctctctccca

SEQ ID NO: 4415819 - DNA, 19 bp, Homo sapiens
gcccgtgcccgcaggaact

SEQ ID NO: 4415820 - DNA, 23 bp, Homo sapiens
gcccgtggggtctgcgcttggtc

SEQ ID NO: 4415821 - DNA, 22 bp, Homo sapiens
gcccgtggtggcggtggctgcc

SEQ ID NO: 4415822 - DNA, 18 bp, Homo sapiens
gccctaaatagcagaaag

SEQ ID NO: 4415823 - DNA, 21 bp, Homo sapiens
gccctaagtggctgccttctt

SEQ ID NO: 4415824 - DNA, 23 bp, Homo sapiens
gccctacttccaggatggatgca

SEQ ID NO: 4415825 - DNA, 14 bp, Homo sapiens
gccctagcggctgc

SEQ ID NO: 4415826 - DNA, 13 bp, Homo sapiens
gccctatatacct

SEQ ID NO: 4415827 - DNA, 15 bp, Homo sapiens
gccctatatacctca

SEQ ID NO: 4415828 - DNA, 20 bp, Homo sapiens
gccctcaatccaccttcagg

SEQ ID NO: 4415829 - DNA, 20 bp, Homo sapiens
gccctcaggggcctctctcc

SEQ ID NO: 4415830 - DNA, 17 bp, Homo sapiens
gccctcagttccttcat

SEQ ID NO: 4415831 - DNA, 12 bp, Homo sapiens
gccctcatcccg

SEQ ID NO: 4415832 - DNA, 12 bp, Homo sapiens
gccctccaaaga

SEQ ID NO: 4415833 - DNA, 12 bp, Homo sapiens
gccctccccaca

SEQ ID NO: 4415834 - DNA, 14 bp, Homo sapiens
gccctccctgctag

SEQ ID NO: 4415835 - DNA, 20 bp, Homo sapiens
gccctccctgtctccagggc

SEQ ID NO: 4415836 - DNA, 22 bp, Homo sapiens
gccctccctgtctccagggccc

SEQ ID NO: 4415837 - DNA, 13 bp, Homo sapiens
gccctcctcaccc

SEQ ID NO: 4415838 - DNA, 14 bp, Homo sapiens
gccctcctcacccc

SEQ ID NO: 4415839 - DNA, 17 bp, Homo sapiens
gccctcctgggccctgg

SEQ ID NO: 4415840 - DNA, 19 bp, Homo sapiens
gccctctatcatggtgaaa

SEQ ID NO: 4415841 - DNA, 15 bp, Homo sapiens
gccctctccctgtgt

SEQ ID NO: 4415842 - DNA, 22 bp, Homo sapiens
gccctctccctgtgttctgggc

SEQ ID NO: 4415843 - DNA, 22 bp, Homo sapiens
gccctctcccttaccctgggaa

SEQ ID NO: 4415844 - DNA, 14 bp, Homo sapiens
gccctctctctcac

SEQ ID NO: 4415845 - DNA, 15 bp, Homo sapiens
gccctctctctcact

SEQ ID NO: 4415846 - DNA, 15 bp, Homo sapiens
gccctctctctgggc

SEQ ID NO: 4415847 - DNA, 14 bp, Homo sapiens
gccctctttccctg

SEQ ID NO: 4415848 - DNA, 17 bp, Homo sapiens
gccctctttccctgcga

SEQ ID NO: 4415849 - DNA, 21 bp, Homo sapiens
gccctgactcctctggctttc

SEQ ID NO: 4415850 - DNA, 16 bp, Homo sapiens
gccctgactcctggac

SEQ ID NO: 4415851 - DNA, 20 bp, Homo sapiens
gccctgactcctggactccg

SEQ ID NO: 4415852 - DNA, 22 bp, Homo sapiens
gccctgaggcggaggctgtgct

SEQ ID NO: 4415853 - DNA, 22 bp, Homo sapiens
gccctgaggtgaaagggagcta

SEQ ID NO: 4415854 - DNA, 14 bp, Homo sapiens
gccctgcaaaagga

SEQ ID NO: 4415855 - DNA, 15 bp, Homo sapiens
gccctgcccacagaa

SEQ ID NO: 4415856 - DNA, 16 bp, Homo sapiens
gccctgccccacccca

SEQ ID NO: 4415857 - DNA, 15 bp, Homo sapiens
gccctgcccccaccc

SEQ ID NO: 4415858 - DNA, 17 bp, Homo sapiens
gccctgcccccacccct

SEQ ID NO: 4415859 - DNA, 12 bp, Homo sapiens
gccctgcctgca

SEQ ID NO: 4415860 - DNA, 13 bp, Homo sapiens
gccctgcctgcag

SEQ ID NO: 4415861 - DNA, 15 bp, Homo sapiens
gccctgcctgcagcc

SEQ ID NO: 4415862 - DNA, 17 bp, Homo sapiens
gccctgcctgcagccag

SEQ ID NO: 4415863 - DNA, 21 bp, Homo sapiens
gccctgcctgcagccagggct

SEQ ID NO: 4415864 - DNA, 23 bp, Homo sapiens
gccctgcctgcagccagggctgg

SEQ ID NO: 4415865 - DNA, 15 bp, Homo sapiens
gccctgctccctgcc

SEQ ID NO: 4415866 - DNA, 17 bp, Homo sapiens
gccctgctccctgcctc

SEQ ID NO: 4415867 - DNA, 23 bp, Homo sapiens
gccctgctccctgcctcctgcct

SEQ ID NO: 4415868 - DNA, 19 bp, Homo sapiens
gccctgctcttctctcccc

SEQ ID NO: 4415869 - DNA, 13 bp, Homo sapiens
gccctggcccagg

SEQ ID NO: 4415870 - DNA, 14 bp, Homo sapiens
gccctggcccaggt

SEQ ID NO: 4415871 - DNA, 17 bp, Homo sapiens
gccctggcccccacagc

SEQ ID NO: 4415872 - DNA, 19 bp, Homo sapiens
gccctggcccccatcagcc

SEQ ID NO: 4415873 - DNA, 22 bp, Homo sapiens
gccctggcccccatcagccctg

SEQ ID NO: 4415874 - DNA, 12 bp, Homo sapiens
gccgagggctgg

SEQ ID NO: 4415875 - DNA, 15 bp, Homo sapiens
gccgagggctggccg

SEQ ID NO: 4415876 - DNA, 17 bp, Homo sapiens
gccgagggctggccggg

SEQ ID NO: 4415877 - DNA, 20 bp, Homo sapiens
gccgagggtcctggctcctg

SEQ ID NO: 4415878 - DNA, 22 bp, Homo sapiens
gccgatatactctagatgaagt

SEQ ID NO: 4415879 - DNA, 15 bp, Homo sapiens
gccgatgccaccggc

SEQ ID NO: 4415880 - DNA, 16 bp, Homo sapiens
gccgatgccaccggcc

SEQ ID NO: 4415881 - DNA, 12 bp, Homo sapiens
gccgcagagcct

SEQ ID NO: 4415882 - DNA, 15 bp, Homo sapiens
gccgcaggaaggcag

SEQ ID NO: 4415883 - DNA, 15 bp, Homo sapiens
gccgcatcttctcca

SEQ ID NO: 4415884 - DNA, 18 bp, Homo sapiens
gccgcatcttctccatct

SEQ ID NO: 4415885 - DNA, 15 bp, Homo sapiens
gccgcattccctgag

SEQ ID NO: 4415886 - DNA, 16 bp, Homo sapiens
gccgcattccctgagt

SEQ ID NO: 4415887 - DNA, 14 bp, Homo sapiens
gccgccactaggtg

SEQ ID NO: 4415888 - DNA, 20 bp, Homo sapiens
gccgccactaggtgtcccca

SEQ ID NO: 4415889 - DNA, 17 bp, Homo sapiens
gccgccagtacttgtca

SEQ ID NO: 4415890 - DNA, 17 bp, Homo sapiens
gccgccattgccaccag

SEQ ID NO: 4415891 - DNA, 18 bp, Homo sapiens
gccgccattgccaccagg

SEQ ID NO: 4415892 - DNA, 14 bp, Homo sapiens
gccgcccaaggcct

SEQ ID NO: 4415893 - DNA, 23 bp, Homo sapiens
gccgcccaaggccttcccctggc

SEQ ID NO: 4415894 - DNA, 23 bp, Homo sapiens
gccgcccacccccacccccagtg

SEQ ID NO: 4415895 - DNA, 13 bp, Homo sapiens
gccgccctgggct

SEQ ID NO: 4415896 - DNA, 24 bp, Homo sapiens
gccgccctgggctgtctgtcacca

SEQ ID NO: 4415897 - DNA, 13 bp, Homo sapiens
gccgccctgtggg

SEQ ID NO: 4415898 - DNA, 13 bp, Homo sapiens
gccgcctcccacg

SEQ ID NO: 4415899 - DNA, 12 bp, Homo sapiens
gccgctgccatg

SEQ ID NO: 4415900 - DNA, 15 bp, Homo sapiens
gccgctgccgctgca

SEQ ID NO: 4415901 - DNA, 19 bp, Homo sapiens
gccgctgtataaagcatgt

SEQ ID NO: 4415902 - DNA, 15 bp, Homo sapiens
gccggcatggctggg

SEQ ID NO: 4415903 - DNA, 12 bp, Homo sapiens
gccggcccagat

SEQ ID NO: 4415904 - DNA, 13 bp, Homo sapiens
gccggcccagatg

SEQ ID NO: 4415905 - DNA, 22 bp, Homo sapiens
gccggcccagatgtgtcccccc

SEQ ID NO: 4415906 - DNA, 19 bp, Homo sapiens
gccggcctcctcctcaccc

SEQ ID NO: 4415907 - DNA, 23 bp, Homo sapiens
gccggcctcctcctcacccttcc

SEQ ID NO: 4415908 - DNA, 19 bp, Homo sapiens
gccggcggcagccccactt

SEQ ID NO: 4415909 - DNA, 11 bp, Homo sapiens
gccggctggtt

SEQ ID NO: 4415910 - DNA, 15 bp, Homo sapiens
gccggctgtttcctg

SEQ ID NO: 4415911 - DNA, 24 bp, Homo sapiens
gccggcttcctccttccagatgcc

SEQ ID NO: 4415912 - DNA, 22 bp, Homo sapiens
gccgggaccaccctgagccggc

SEQ ID NO: 4415913 - DNA, 18 bp, Homo sapiens
gccgggactgctgctctc

SEQ ID NO: 4415914 - DNA, 23 bp, Homo sapiens
gccgggactgctgctctcccaag

SEQ ID NO: 4415915 - DNA, 14 bp, Homo sapiens
gccgggagcctgac

SEQ ID NO: 4415916 - DNA, 17 bp, Homo sapiens
gccgggaggcagccaca

SEQ ID NO: 4415917 - DNA, 18 bp, Homo sapiens
gccgggaggcagccacag

SEQ ID NO: 4415918 - DNA, 20 bp, Homo sapiens
gccgggatggttcttctcca

SEQ ID NO: 4415919 - DNA, 20 bp, Homo sapiens
gccgggcacagtggctcacg

SEQ ID NO: 4415920 - DNA, 19 bp, Homo sapiens
gccgggcaggtcctgccca

SEQ ID NO: 4415921 - DNA, 15 bp, Homo sapiens
gccgggcatgatggt

SEQ ID NO: 4415922 - DNA, 17 bp, Homo sapiens
gccgggcatggtggcag

SEQ ID NO: 4415923 - DNA, 14 bp, Homo sapiens
gccgggcccctggg

SEQ ID NO: 4415924 - DNA, 19 bp, Homo sapiens
gccgggcccctgggcttgg

SEQ ID NO: 4415925 - DNA, 14 bp, Homo sapiens
gccgggcgcggtgg

SEQ ID NO: 4415926 - DNA, 16 bp, Homo sapiens
gccgggcgcggtggct

SEQ ID NO: 4415927 - DNA, 22 bp, Homo sapiens
gccgggcgcggtggctcacgcc

SEQ ID NO: 4415928 - DNA, 14 bp, Homo sapiens
gccgggtctgcctc

SEQ ID NO: 4415929 - DNA, 15 bp, Homo sapiens
gccggtcgggcagcc

SEQ ID NO: 4415930 - DNA, 19 bp, Homo sapiens
gccggtcgggcagccagca

SEQ ID NO: 4415931 - DNA, 20 bp, Homo sapiens
gccggtgccagctgcccttg

SEQ ID NO: 4415932 - DNA, 18 bp, Homo sapiens
gccggtgggaccctgtcc

SEQ ID NO: 4415933 - DNA, 20 bp, Homo sapiens
gccggtgggaccctgtccgg

SEQ ID NO: 4415934 - DNA, 22 bp, Homo sapiens
gccggttttcctcagctctagg

SEQ ID NO: 4415935 - DNA, 13 bp, Homo sapiens
gccgtaatttaac

SEQ ID NO: 4415936 - DNA, 23 bp, Homo sapiens
gccgtattttacatgaagctgta

SEQ ID NO: 4415937 - DNA, 22 bp, Homo sapiens
gccgtctcccttggcccagaga

SEQ ID NO: 4415938 - DNA, 13 bp, Homo sapiens
gccgtctcctccc

SEQ ID NO: 4415939 - DNA, 14 bp, Homo sapiens
gccgtctcctccct

SEQ ID NO: 4415940 - DNA, 22 bp, Homo sapiens
gccgtgcatggctcctgtctgg

SEQ ID NO: 4415941 - DNA, 16 bp, Homo sapiens
gccgtggtcctttggg

SEQ ID NO: 4415942 - DNA, 14 bp, Homo sapiens
gccgttactctcca

SEQ ID NO: 4415943 - DNA, 20 bp, Homo sapiens
gccgttactctccaacctgg

SEQ ID NO: 4415944 - DNA, 22 bp, Homo sapiens
gccgtttgaatatattttatct

SEQ ID NO: 4415945 - DNA, 23 bp, Homo sapiens
gcctaaaagtgggcttgattctg

SEQ ID NO: 4415946 - DNA, 24 bp, Homo sapiens
gcctaaaattttagatgtagatat

SEQ ID NO: 4415947 - DNA, 15 bp, Homo sapiens
gcctaaacctcagtt

SEQ ID NO: 4415948 - DNA, 19 bp, Homo sapiens
gcctaaagtacagcctgga

SEQ ID NO: 4415949 - DNA, 23 bp, Homo sapiens
gcctaagggatcctgcctgcccc

SEQ ID NO: 4415950 - DNA, 14 bp, Homo sapiens
gcctaagtgcctct

SEQ ID NO: 4415951 - DNA, 16 bp, Homo sapiens
gcctaagtggctgctg

SEQ ID NO: 4415952 - DNA, 14 bp, Homo sapiens
gcctaattggaaag

SEQ ID NO: 4415953 - DNA, 20 bp, Homo sapiens
gcctaattggaaagtgccag

SEQ ID NO: 4415954 - DNA, 16 bp, Homo sapiens
gcctacaaatcagtaa

SEQ ID NO: 4415955 - DNA, 21 bp, Homo sapiens
gcctacagaagggcagtgact

SEQ ID NO: 4415956 - DNA, 15 bp, Homo sapiens
gcctacctctccaca

SEQ ID NO: 4415957 - DNA, 13 bp, Homo sapiens
gcctagactctgt

SEQ ID NO: 4415958 - DNA, 22 bp, Homo sapiens
gcctagcgatctctcctggcct

SEQ ID NO: 4415959 - DNA, 17 bp, Homo sapiens
gcctagcggagcccagc

SEQ ID NO: 4415960 - DNA, 19 bp, Homo sapiens
gcctagcggagcccagcct

SEQ ID NO: 4415961 - DNA, 22 bp, Homo sapiens
gcctagcggagcccagcctggg

SEQ ID NO: 4415962 - DNA, 23 bp, Homo sapiens
gcctagctcctgccacatggagc

SEQ ID NO: 4415963 - DNA, 18 bp, Homo sapiens
gcctagtaaatgttaact

SEQ ID NO: 4415964 - DNA, 23 bp, Homo sapiens
gcctagtgaaggcttctctctgt

SEQ ID NO: 4415965 - DNA, 15 bp, Homo sapiens
gcctataatcccagc

SEQ ID NO: 4415966 - DNA, 18 bp, Homo sapiens
gcctataatcccagcatt

SEQ ID NO: 4415967 - DNA, 15 bp, Homo sapiens
gcctatagtcccact

SEQ ID NO: 4415968 - DNA, 22 bp, Homo sapiens
gcctatattttttgttaaatga

SEQ ID NO: 4415969 - DNA, 13 bp, Homo sapiens
gcctatccgctgc

SEQ ID NO: 4415970 - DNA, 21 bp, Homo sapiens
gcctattatctgtcagctgca

SEQ ID NO: 4415971 - DNA, 13 bp, Homo sapiens
gcctattgtaata

SEQ ID NO: 4415972 - DNA, 16 bp, Homo sapiens
gcctatttaacaagat

SEQ ID NO: 4415973 - DNA, 21 bp, Homo sapiens
gcctatttaacaagatgtttc

SEQ ID NO: 4415974 - DNA, 16 bp, Homo sapiens
gcctatttcagctgct

SEQ ID NO: 4415975 - DNA, 22 bp, Homo sapiens
gcctcaaaacctgattggccac

SEQ ID NO: 4415976 - DNA, 20 bp, Homo sapiens
gcctcaagcaatccacctgc

SEQ ID NO: 4415977 - DNA, 21 bp, Homo sapiens
gcctcaatgtgaatcagaccc

SEQ ID NO: 4415978 - DNA, 22 bp, Homo sapiens
gcctcaatgtgaatcagaccct

SEQ ID NO: 4415979 - DNA, 16 bp, Homo sapiens
gcctcacagaagaata

SEQ ID NO: 4415980 - DNA, 18 bp, Homo sapiens
gcctcacccacccctgca

SEQ ID NO: 4415981 - DNA, 22 bp, Homo sapiens
gcctcaccccctcgggtctcct

SEQ ID NO: 4415982 - DNA, 13 bp, Homo sapiens
gcctcactggggc

SEQ ID NO: 4415983 - DNA, 14 bp, Homo sapiens
gcctcactggggca

SEQ ID NO: 4415984 - DNA, 18 bp, Homo sapiens
gcctcagaaatctgtttg

SEQ ID NO: 4415985 - DNA, 17 bp, Homo sapiens
gcctcagaaggccccag

SEQ ID NO: 4415986 - DNA, 21 bp, Homo sapiens
gcctcagaaggccccagagag

SEQ ID NO: 4415987 - DNA, 22 bp, Homo sapiens
gcctcagagatctcccttctca

SEQ ID NO: 4415988 - DNA, 17 bp, Homo sapiens
gcctcagccctcagttc

SEQ ID NO: 4415989 - DNA, 23 bp, Homo sapiens
gcctcagccctcagttccttcat

SEQ ID NO: 4415990 - DNA, 15 bp, Homo sapiens
gcctcagccctgctc

SEQ ID NO: 4415991 - DNA, 20 bp, Homo sapiens
gcctcagccctgctccctgc

SEQ ID NO: 4415992 - DNA, 23 bp, Homo sapiens
gcctcagccctgctccctgcctc

SEQ ID NO: 4415993 - DNA, 16 bp, Homo sapiens
gcctcagcctcccaag

SEQ ID NO: 4415994 - DNA, 23 bp, Homo sapiens
gccccagtcagcctctctcccag

SEQ ID NO: 4415995 - DNA, 17 bp, Homo sapiens
gccccagtcggccccat

SEQ ID NO: 4415996 - DNA, 22 bp, Homo sapiens
gccccatccaaccactgtacac

SEQ ID NO: 4415997 - DNA, 20 bp, Homo sapiens
gccccatccagacctggctc

SEQ ID NO: 4415998 - DNA, 19 bp, Homo sapiens
gccccatccctgcttgccc

SEQ ID NO: 4415999 - DNA, 18 bp, Homo sapiens
gccccatcctcatccctg

SEQ ID NO: 4416000 - DNA, 17 bp, Homo sapiens
gccccatgcctgtccag

SEQ ID NO: 4416001 - DNA, 12 bp, Homo sapiens
gccccattcctg

SEQ ID NO: 4416002 - DNA, 20 bp, Homo sapiens
gccccattgagatcttcctg

SEQ ID NO: 4416003 - DNA, 23 bp, Homo sapiens
gcccccaactccgcccagcctct

SEQ ID NO: 4416004 - DNA, 12 bp, Homo sapiens
gcccccaataaa

SEQ ID NO: 4416005 - DNA, 21 bp, Homo sapiens
gcccccaataaaccagtgtga

SEQ ID NO: 4416006 - DNA, 23 bp, Homo sapiens
gcccccaataaaggcagctgcct

SEQ ID NO: 4416007 - DNA, 16 bp, Homo sapiens
gcccccacagcgctcg

SEQ ID NO: 4416008 - DNA, 19 bp, Homo sapiens
gcccccaccacaaacacag

SEQ ID NO: 4416009 - DNA, 22 bp, Homo sapiens
gcccccaccccttcctgtctca

SEQ ID NO: 4416010 - DNA, 17 bp, Homo sapiens
gcccccaccggaactgg

SEQ ID NO: 4416011 - DNA, 22 bp, Homo sapiens
gcccccagaaagcctcctgccc

SEQ ID NO: 4416012 - DNA, 20 bp, Homo sapiens
gcccccagccccggggtgag

SEQ ID NO: 4416013 - DNA, 14 bp, Homo sapiens
gcccccagcccctc

SEQ ID NO: 4416014 - DNA, 15 bp, Homo sapiens
gcccccagcccctcc

SEQ ID NO: 4416015 - DNA, 16 bp, Homo sapiens
gcccccaggactgggc

SEQ ID NO: 4416016 - DNA, 17 bp, Homo sapiens
gcccccagtccccaccc

SEQ ID NO: 4416017 - DNA, 18 bp, Homo sapiens
gcccccatcagccctgct

SEQ ID NO: 4416018 - DNA, 11 bp, Homo sapiens
gccccccagct

SEQ ID NO: 4416019 - DNA, 17 bp, Homo sapiens
gccccccagctcccaca

SEQ ID NO: 4416020 - DNA, 19 bp, Homo sapiens
gccccccagctcccacacc

SEQ ID NO: 4416021 - DNA, 19 bp, Homo sapiens
gccccccgcacagccaccc

SEQ ID NO: 4416022 - DNA, 14 bp, Homo sapiens
gccccccgccctca

SEQ ID NO: 4416023 - DNA, 15 bp, Homo sapiens
gccccccgccctcat

SEQ ID NO: 4416024 - DNA, 19 bp, Homo sapiens
gccccccgcgcgcccaccc

SEQ ID NO: 4416025 - DNA, 23 bp, Homo sapiens
gcccccctgacgttaggaccagg

SEQ ID NO: 4416026 - DNA, 22 bp, Homo sapiens
gcccccgagccctgactcctgg

SEQ ID NO: 4416027 - DNA, 23 bp, Homo sapiens
gcccccgagccctgactcctgga

SEQ ID NO: 4416028 - DNA, 22 bp, Homo sapiens
gcccccgccccagagtggccca

SEQ ID NO: 4416029 - DNA, 20 bp, Homo sapiens
gcccccgcgggttctagacg

SEQ ID NO: 4416030 - DNA, 15 bp, Homo sapiens
gcccccggccaagga

SEQ ID NO: 4416031 - DNA, 20 bp, Homo sapiens
gcccccgggccgctggctgg

SEQ ID NO: 4416032 - DNA, 13 bp, Homo sapiens
gccccctcccacc

SEQ ID NO: 4416033 - DNA, 14 bp, Homo sapiens
gccccctcccaccg

SEQ ID NO: 4416034 - DNA, 16 bp, Homo sapiens
gccccctcccaccgct

SEQ ID NO: 4416035 - DNA, 17 bp, Homo sapiens
gccccctcccaccgctg

SEQ ID NO: 4416036 - DNA, 14 bp, Homo sapiens
gccccctgccagtg

SEQ ID NO: 4416037 - DNA, 13 bp, Homo sapiens
gccccctgctggc

SEQ ID NO: 4416038 - DNA, 13 bp, Homo sapiens
gccccctggtctc

SEQ ID NO: 4416039 - DNA, 19 bp, Homo sapiens
gccccctttgggcccaggg

SEQ ID NO: 4416040 - DNA, 21 bp, Homo sapiens
gccccctttgggcccagggac

SEQ ID NO: 4416041 - DNA, 14 bp, Homo sapiens
gccccgactccagc

SEQ ID NO: 4416042 - DNA, 17 bp, Homo sapiens
gccccgaggacccagac

SEQ ID NO: 4416043 - DNA, 18 bp, Homo sapiens
gccccgaggacccagacc

SEQ ID NO: 4416044 - DNA, 18 bp, Homo sapiens
gccccgcacgactgcggg

SEQ ID NO: 4416045 - DNA, 19 bp, Homo sapiens
gccccgcacgactgcggga

SEQ ID NO: 4416046 - DNA, 14 bp, Homo sapiens
gccccgccagggct

SEQ ID NO: 4416047 - DNA, 18 bp, Homo sapiens
gccccgcccctcccacgc

SEQ ID NO: 4416048 - DNA, 20 bp, Homo sapiens
gccccgcctgtcacaataaa

SEQ ID NO: 4416049 - DNA, 23 bp, Homo sapiens
gccccgcctgtcacaataaagtt

SEQ ID NO: 4416050 - DNA, 14 bp, Homo sapiens
gccccgcttgtcca

SEQ ID NO: 4416051 - DNA, 18 bp, Homo sapiens
gccccgcttgtccagcgc

SEQ ID NO: 4416052 - DNA, 20 bp, Homo sapiens
gccccgcttgtccagcgcct

SEQ ID NO: 4416053 - DNA, 17 bp, Homo sapiens
gccccggcaagccacag

SEQ ID NO: 4416054 - DNA, 22 bp, Homo sapiens
gccccggcaagccacaggaagg

SEQ ID NO: 4416055 - DNA, 15 bp, Homo sapiens
gccccggccctgggc

SEQ ID NO: 4416056 - DNA, 17 bp, Homo sapiens
gccccggccctgggctc

SEQ ID NO: 4416057 - DNA, 14 bp, Homo sapiens
gccccggcctcctc

SEQ ID NO: 4416058 - DNA, 15 bp, Homo sapiens
gccccggggccccct

SEQ ID NO: 4416059 - DNA, 19 bp, Homo sapiens
gccccggggccccctggtc

SEQ ID NO: 4416060 - DNA, 19 bp, Homo sapiens
gccccggggtgagtccatt

SEQ ID NO: 4416061 - DNA, 15 bp, Homo sapiens
gccccgttttgggga

SEQ ID NO: 4416062 - DNA, 14 bp, Homo sapiens
gcccctcaccgctg

SEQ ID NO: 4416063 - DNA, 14 bp, Homo sapiens
gcccctcacctact

SEQ ID NO: 4416064 - DNA, 12 bp, Homo sapiens
gcccctccactg

SEQ ID NO: 4416065 - DNA, 12 bp, Homo sapiens
gcccctccagct

SEQ ID NO: 4416066 - DNA, 16 bp, Homo sapiens
gcccctccatccaccc

SEQ ID NO: 4416067 - DNA, 17 bp, Homo sapiens
gccaggcccggggctgg

SEQ ID NO: 4416068 - DNA, 13 bp, Homo sapiens
gccaggcctctgc

SEQ ID NO: 4416069 - DNA, 17 bp, Homo sapiens
gccaggcctctgctggc

SEQ ID NO: 4416070 - DNA, 20 bp, Homo sapiens
gccaggcctctgctggctca

SEQ ID NO: 4416071 - DNA, 22 bp, Homo sapiens
gccaggcggacaaagttcagtg

SEQ ID NO: 4416072 - DNA, 23 bp, Homo sapiens
gccaggcggacaaagttcagtgt

SEQ ID NO: 4416073 - DNA, 20 bp, Homo sapiens
gccaggctctgtgctgaccc

SEQ ID NO: 4416074 - DNA, 21 bp, Homo sapiens
gccaggctctgtgctgaccct

SEQ ID NO: 4416075 - DNA, 14 bp, Homo sapiens
gccaggctgccaag

SEQ ID NO: 4416076 - DNA, 14 bp, Homo sapiens
gccaggcttttctc

SEQ ID NO: 4416077 - DNA, 22 bp, Homo sapiens
gccaggcttttctcaggagctt

SEQ ID NO: 4416078 - DNA, 20 bp, Homo sapiens
gccagggcaatgatgaatga

SEQ ID NO: 4416079 - DNA, 15 bp, Homo sapiens
gccagggccacgctc

SEQ ID NO: 4416080 - DNA, 22 bp, Homo sapiens
gccagggccacgctccagctgc

SEQ ID NO: 4416081 - DNA, 15 bp, Homo sapiens
gccagggctggggac

SEQ ID NO: 4416082 - DNA, 17 bp, Homo sapiens
gccaggggtgctcctgt

SEQ ID NO: 4416083 - DNA, 20 bp, Homo sapiens
gccaggggtgctcctgtgct

SEQ ID NO: 4416084 - DNA, 21 bp, Homo sapiens
gccaggggtgctcctgtgctc

SEQ ID NO: 4416085 - DNA, 22 bp, Homo sapiens
gccaggggtgctcctgtgctca

SEQ ID NO: 4416086 - DNA, 15 bp, Homo sapiens
gccaggtgcccagga

SEQ ID NO: 4416087 - DNA, 22 bp, Homo sapiens
gccaggtgccgacactgagctg

SEQ ID NO: 4416088 - DNA, 13 bp, Homo sapiens
gccaggtgccttg

SEQ ID NO: 4416089 - DNA, 14 bp, Homo sapiens
gccaggtgccttgg

SEQ ID NO: 4416090 - DNA, 16 bp, Homo sapiens
gccaggtgccttggag

SEQ ID NO: 4416091 - DNA, 16 bp, Homo sapiens
gccaggtggcacctgc

SEQ ID NO: 4416092 - DNA, 13 bp, Homo sapiens
gccaggtggctca

SEQ ID NO: 4416093 - DNA, 22 bp, Homo sapiens
gccaggtggctcagtgccacct

SEQ ID NO: 4416094 - DNA, 23 bp, Homo sapiens
gccagtagttttgacacttccca

SEQ ID NO: 4416095 - DNA, 21 bp, Homo sapiens
gccagtcaacggggggctcct

SEQ ID NO: 4416096 - DNA, 22 bp, Homo sapiens
gccagtcaacggggggctcctg

SEQ ID NO: 4416097 - DNA, 16 bp, Homo sapiens
gccagtccccatttct

SEQ ID NO: 4416098 - DNA, 16 bp, Homo sapiens
gccagtcctagctgca

SEQ ID NO: 4416099 - DNA, 19 bp, Homo sapiens
gccagtcctagctgcacag

SEQ ID NO: 4416100 - DNA, 20 bp, Homo sapiens
gccagtcctgcctggccagg

SEQ ID NO: 4416101 - DNA, 16 bp, Homo sapiens
gccagtgaagtccttc

SEQ ID NO: 4416102 - DNA, 16 bp, Homo sapiens
gccagtgcagccactg

SEQ ID NO: 4416103 - DNA, 17 bp, Homo sapiens
gccagtggaagaaacac

SEQ ID NO: 4416104 - DNA, 20 bp, Homo sapiens
gccagtggtgatgtaaaaat

SEQ ID NO: 4416105 - DNA, 12 bp, Homo sapiens
gccagtgtcttt

SEQ ID NO: 4416106 - DNA, 13 bp, Homo sapiens
gccagtgtctttc

SEQ ID NO: 4416107 - DNA, 18 bp, Homo sapiens
gccagtgtctttctttgg

SEQ ID NO: 4416108 - DNA, 18 bp, Homo sapiens
gccagttttaccagcgca

SEQ ID NO: 4416109 - DNA, 22 bp, Homo sapiens
gccataaaacaggtaatataaa

SEQ ID NO: 4416110 - DNA, 16 bp, Homo sapiens
gccataattatgaaaa

SEQ ID NO: 4416111 - DNA, 19 bp, Homo sapiens
gccatagaccctgaggccc

SEQ ID NO: 4416112 - DNA, 23 bp, Homo sapiens
gccatagtcaaagagagttttta

SEQ ID NO: 4416113 - DNA, 22 bp, Homo sapiens
gccatattgtcacctcagcact

SEQ ID NO: 4416114 - DNA, 18 bp, Homo sapiens
gccatcaaaatgcttttt

SEQ ID NO: 4416115 - DNA, 14 bp, Homo sapiens
gccatcaagcactt

SEQ ID NO: 4416116 - DNA, 18 bp, Homo sapiens
gccatcacttctccccgc

SEQ ID NO: 4416117 - DNA, 19 bp, Homo sapiens
gccatccctgggcccctcc

SEQ ID NO: 4416118 - DNA, 13 bp, Homo sapiens
gccatccctgtga

SEQ ID NO: 4416119 - DNA, 23 bp, Homo sapiens
gccatccctttttttacatttca

SEQ ID NO: 4416120 - DNA, 12 bp, Homo sapiens
gccatcctccct

SEQ ID NO: 4416121 - DNA, 14 bp, Homo sapiens
gccatcctggccca

SEQ ID NO: 4416122 - DNA, 19 bp, Homo sapiens
gccatcctggcccagggca

SEQ ID NO: 4416123 - DNA, 14 bp, Homo sapiens
gccatcgtcctggg

SEQ ID NO: 4416124 - DNA, 18 bp, Homo sapiens
gccatcgtcctgggactc

SEQ ID NO: 4416125 - DNA, 13 bp, Homo sapiens
gccatctcaggag

SEQ ID NO: 4416126 - DNA, 23 bp, Homo sapiens
gccatctccctccccagaaacag

SEQ ID NO: 4416127 - DNA, 20 bp, Homo sapiens
gccatgaagtcaccgggatg

SEQ ID NO: 4416128 - DNA, 11 bp, Homo sapiens
gccatgaatta

SEQ ID NO: 4416129 - DNA, 14 bp, Homo sapiens
gccatgacagaggc

SEQ ID NO: 4416130 - DNA, 16 bp, Homo sapiens
gccatgacagaggctg

SEQ ID NO: 4416131 - DNA, 19 bp, Homo sapiens
gccatgagccgcccaaggc

SEQ ID NO: 4416132 - DNA, 17 bp, Homo sapiens
gccatgatttcccactg

SEQ ID NO: 4416133 - DNA, 23 bp, Homo sapiens
gccatgatttcccactgcactcc

SEQ ID NO: 4416134 - DNA, 14 bp, Homo sapiens
gccatgcctatggg

SEQ ID NO: 4416135 - DNA, 15 bp, Homo sapiens
gccatgctacagtta

SEQ ID NO: 4416136 - DNA, 16 bp, Homo sapiens
gccatgctacagttag

SEQ ID NO: 4416137 - DNA, 16 bp, Homo sapiens
gccatgctgggccact

SEQ ID NO: 4416138 - DNA, 17 bp, Homo sapiens
gccatgctgggccactg

SEQ ID NO: 4416139 - DNA, 22 bp, Homo sapiens
gccatgctgggccactggggac

SEQ ID NO: 4416140 - DNA, 22 bp, Homo sapiens
gccatgctttgagtccacgccc

SEQ ID NO: 4416141 - DNA, 19 bp, Homo sapiens
gccatggatttccactgct

SEQ ID NO: 4416142 - DNA, 19 bp, Homo sapiens
gccatggggtccatcccct

SEQ ID NO: 4416143 - DNA, 19 bp, Homo sapiens
gccatgtactcaagtacca

SEQ ID NO: 4416144 - DNA, 20 bp, Homo sapiens
gccattagccagatttgtct

SEQ ID NO: 4416145 - DNA, 18 bp, Homo sapiens
gccattatgcaaatggag

SEQ ID NO: 4416146 - DNA, 15 bp, Homo sapiens
gccattctcctgcct

SEQ ID NO: 4416147 - DNA, 20 bp, Homo sapiens
gccattctcctgcctcagcc

SEQ ID NO: 4416148 - DNA, 21 bp, Homo sapiens
gccattctcctgcctcagcct

SEQ ID NO: 4416149 - DNA, 22 bp, Homo sapiens
gccattctcctgcctcagcctc

SEQ ID NO: 4416150 - DNA, 13 bp, Homo sapiens
gccattctgtgca

SEQ ID NO: 4416151 - DNA, 16 bp, Homo sapiens
gccattctgtgcaggc

SEQ ID NO: 4416152 - DNA, 20 bp, Homo sapiens
gccattcttctggtgctact

SEQ ID NO: 4416153 - DNA, 18 bp, Homo sapiens
gccattgccaccaggaga

SEQ ID NO: 4416154 - DNA, 19 bp, Homo sapiens
gccattgccaccaggagaa

SEQ ID NO: 4416155 - DNA, 16 bp, Homo sapiens
gccattgggaccctcc

SEQ ID NO: 4416156 - DNA, 15 bp, Homo sapiens
gccattgtactccag

SEQ ID NO: 4416157 - DNA, 13 bp, Homo sapiens
gccattgtcttta

SEQ ID NO: 4416158 - DNA, 18 bp, Homo sapiens
gccattgtctttatatga

SEQ ID NO: 4416159 - DNA, 17 bp, Homo sapiens
gccattgtgaaccaatg

SEQ ID NO: 4416160 - DNA, 22 bp, Homo sapiens
gccatttaaagcttattaaaac

SEQ ID NO: 4416161 - DNA, 23 bp, Homo sapiens
gccatttattttttaaaaagtgt

SEQ ID NO: 4416162 - DNA, 20 bp, Homo sapiens
gccatttccaagaggctgta

SEQ ID NO: 4416163 - DNA, 16 bp, Homo sapiens
gccatttgtcccaagt

SEQ ID NO: 4416164 - DNA, 13 bp, Homo sapiens
gccattttccagt

SEQ ID NO: 4416165 - DNA, 15 bp, Homo sapiens
gcccaaaatgtgaag

SEQ ID NO: 4416166 - DNA, 14 bp, Homo sapiens
gcccaaacccttaa

SEQ ID NO: 4416167 - DNA, 20 bp, Homo sapiens
gcccaaacccttaactgaca

SEQ ID NO: 4416168 - DNA, 10 bp, Homo sapiens
gcccaaatga

SEQ ID NO: 4416169 - DNA, 13 bp, Homo sapiens
gcccaaccagaac

SEQ ID NO: 4416170 - DNA, 17 bp, Homo sapiens
gcccaactggttcaggc

SEQ ID NO: 4416171 - DNA, 21 bp, Homo sapiens
gcccaagacagatgccccaga

SEQ ID NO: 4416172 - DNA, 23 bp, Homo sapiens
gcccaagacagatgccccagagc

SEQ ID NO: 4416173 - DNA, 17 bp, Homo sapiens
gcccaagaggactgaga

SEQ ID NO: 4416174 - DNA, 18 bp, Homo sapiens
gcccaaggcctaccccag

SEQ ID NO: 4416175 - DNA, 13 bp, Homo sapiens
gcccaaggccttc

SEQ ID NO: 4416176 - DNA, 15 bp, Homo sapiens
gcccaaggctcccgg

SEQ ID NO: 4416177 - DNA, 17 bp, Homo sapiens
gcccaaggttgcacagc

SEQ ID NO: 4416178 - DNA, 19 bp, Homo sapiens
gcccaagttcatgcagctg

SEQ ID NO: 4416179 - DNA, 14 bp, Homo sapiens
gcccaatgaataat

SEQ ID NO: 4416180 - DNA, 20 bp, Homo sapiens
gcccaatgagactctagggt

SEQ ID NO: 4416181 - DNA, 23 bp, Homo sapiens
gcccacaagccttactcacctct

SEQ ID NO: 4416182 - DNA, 21 bp, Homo sapiens
gcccacagaaagccaggagca

SEQ ID NO: 4416183 - DNA, 14 bp, Homo sapiens
gcccaccagacgtc

SEQ ID NO: 4416184 - DNA, 18 bp, Homo sapiens
gcccaccagccttgctct

SEQ ID NO: 4416185 - DNA, 20 bp, Homo sapiens
gcccaccagccttgctctct

SEQ ID NO: 4416186 - DNA, 22 bp, Homo sapiens
gcccaccagccttgctctcttc

SEQ ID NO: 4416187 - DNA, 18 bp, Homo sapiens
gcagggtgggtgagctct

SEQ ID NO: 4416188 - DNA, 14 bp, Homo sapiens
gcagggtttctttt

SEQ ID NO: 4416189 - DNA, 21 bp, Homo sapiens
gcaggtacaggtagtgggctc

SEQ ID NO: 4416190 - DNA, 17 bp, Homo sapiens
gcaggtagcctgctggt

SEQ ID NO: 4416191 - DNA, 16 bp, Homo sapiens
gcaggtctccacctgc

SEQ ID NO: 4416192 - DNA, 17 bp, Homo sapiens
gcaggtgctggtcccgg

SEQ ID NO: 4416193 - DNA, 21 bp, Homo sapiens
gcaggtggacgctgcagaccc

SEQ ID NO: 4416194 - DNA, 16 bp, Homo sapiens
gcaggttagaacctag

SEQ ID NO: 4416195 - DNA, 23 bp, Homo sapiens
gcaggttcccacttaaaaattaa

SEQ ID NO: 4416196 - DNA, 14 bp, Homo sapiens
gcaggttctctttg

SEQ ID NO: 4416197 - DNA, 16 bp, Homo sapiens
gcagtaaactttctct

SEQ ID NO: 4416198 - DNA, 18 bp, Homo sapiens
gcagtaaactttctctgc

SEQ ID NO: 4416199 - DNA, 13 bp, Homo sapiens
gcagtaataaaaa

SEQ ID NO: 4416200 - DNA, 17 bp, Homo sapiens
gcagtagcctcctcctg

SEQ ID NO: 4416201 - DNA, 22 bp, Homo sapiens
gcagtagcctcctcctgggctc

SEQ ID NO: 4416202 - DNA, 12 bp, Homo sapiens
gcagtccatgca

SEQ ID NO: 4416203 - DNA, 16 bp, Homo sapiens
gcagtccatgcatgac

SEQ ID NO: 4416204 - DNA, 17 bp, Homo sapiens
gcagtcgcctgcctgca

SEQ ID NO: 4416205 - DNA, 18 bp, Homo sapiens
gcagtctcctctttaaaa

SEQ ID NO: 4416206 - DNA, 20 bp, Homo sapiens
gcagtctcctctttaaaaca

SEQ ID NO: 4416207 - DNA, 19 bp, Homo sapiens
gcagtctcttagaatttgt

SEQ ID NO: 4416208 - DNA, 13 bp, Homo sapiens
gcagtctgctctg

SEQ ID NO: 4416209 - DNA, 23 bp, Homo sapiens
gcagtctgctctgctgctctgac

SEQ ID NO: 4416210 - DNA, 14 bp, Homo sapiens
gcagtgagtgccat

SEQ ID NO: 4416211 - DNA, 13 bp, Homo sapiens
gcagtgatgtcac

SEQ ID NO: 4416212 - DNA, 15 bp, Homo sapiens
gcagtgccccaggga

SEQ ID NO: 4416213 - DNA, 16 bp, Homo sapiens
gcagtgccccagggag

SEQ ID NO: 4416214 - DNA, 23 bp, Homo sapiens
gcagtgccttggggaatttcctc

SEQ ID NO: 4416215 - DNA, 22 bp, Homo sapiens
gcagtgcgcgtgcacgtggaga

SEQ ID NO: 4416216 - DNA, 17 bp, Homo sapiens
gcagtggcctgatctct

SEQ ID NO: 4416217 - DNA, 15 bp, Homo sapiens
gcagtgtccagagac

SEQ ID NO: 4416218 - DNA, 16 bp, Homo sapiens
gcagtgtccagagacc

SEQ ID NO: 4416219 - DNA, 20 bp, Homo sapiens
gcagtgtccagagacccctc

SEQ ID NO: 4416220 - DNA, 22 bp, Homo sapiens
gcagtgtggagaccctgccaca

SEQ ID NO: 4416221 - DNA, 17 bp, Homo sapiens
gcagttataacagatgt

SEQ ID NO: 4416222 - DNA, 20 bp, Homo sapiens
gcagttatggtgatgactta

SEQ ID NO: 4416223 - DNA, 15 bp, Homo sapiens
gcagttctgcaaata

SEQ ID NO: 4416224 - DNA, 18 bp, Homo sapiens
gcagttctgcaaatagaa

SEQ ID NO: 4416225 - DNA, 17 bp, Homo sapiens
gcagttggactctcagg

SEQ ID NO: 4416226 - DNA, 23 bp, Homo sapiens
gcagtttaaaaaataacttcatt

SEQ ID NO: 4416227 - DNA, 16 bp, Homo sapiens
gcagtttatcattcaa

SEQ ID NO: 4416228 - DNA, 22 bp, Homo sapiens
gcagtttcatgtatgtatataa

SEQ ID NO: 4416229 - DNA, 17 bp, Homo sapiens
gcagtttcttgtgtaga

SEQ ID NO: 4416230 - DNA, 18 bp, Homo sapiens
gcagtttcttgtgtagat

SEQ ID NO: 4416231 - DNA, 17 bp, Homo sapiens
gcagtttcttttcacat

SEQ ID NO: 4416232 - DNA, 19 bp, Homo sapiens
gcagtttgaaattctgaat

SEQ ID NO: 4416233 - DNA, 12 bp, Homo sapiens
gcagtttgcaaa

SEQ ID NO: 4416234 - DNA, 12 bp, Homo sapiens
gcagttttttga

SEQ ID NO: 4416235 - DNA, 17 bp, Homo sapiens
gcataaaacctaaaggt

SEQ ID NO: 4416236 - DNA, 20 bp, Homo sapiens
gcataaagaattaatgactt

SEQ ID NO: 4416237 - DNA, 17 bp, Homo sapiens
gcataacaattcctcta

SEQ ID NO: 4416238 - DNA, 19 bp, Homo sapiens
gcataacctgtctcacctg

SEQ ID NO: 4416239 - DNA, 16 bp, Homo sapiens
gcataatagtcaattt

SEQ ID NO: 4416240 - DNA, 12 bp, Homo sapiens
gcataatgcttt

SEQ ID NO: 4416241 - DNA, 12 bp, Homo sapiens
gcatacaaaata

SEQ ID NO: 4416242 - DNA, 15 bp, Homo sapiens
gcatacaaaatattt

SEQ ID NO: 4416243 - DNA, 21 bp, Homo sapiens
gcatacaaaatatttaagtga

SEQ ID NO: 4416244 - DNA, 16 bp, Homo sapiens
gcatacacacagcagt

SEQ ID NO: 4416245 - DNA, 16 bp, Homo sapiens
gcataccacaagacat

SEQ ID NO: 4416246 - DNA, 22 bp, Homo sapiens
gcatactgccttgtttaatggt

SEQ ID NO: 4416247 - DNA, 14 bp, Homo sapiens
gcatacttggatat

SEQ ID NO: 4416248 - DNA, 15 bp, Homo sapiens
gcatactttgtaaat

SEQ ID NO: 4416249 - DNA, 18 bp, Homo sapiens
gcatagaaaaaagtagca

SEQ ID NO: 4416250 - DNA, 16 bp, Homo sapiens
gcatagaggcttctcc

SEQ ID NO: 4416251 - DNA, 22 bp, Homo sapiens
gcatagaggcttctccgccagc

SEQ ID NO: 4416252 - DNA, 18 bp, Homo sapiens
gcatagattccctgagca

SEQ ID NO: 4416253 - DNA, 15 bp, Homo sapiens
gcatagctacaattt

SEQ ID NO: 4416254 - DNA, 19 bp, Homo sapiens
gcatagggtcactttgcca

SEQ ID NO: 4416255 - DNA, 17 bp, Homo sapiens
gcatagtcactgtctca

SEQ ID NO: 4416256 - DNA, 22 bp, Homo sapiens
gcatagtccccagagctccccc

SEQ ID NO: 4416257 - DNA, 22 bp, Homo sapiens
gcatagtgtgctcggacacagt

SEQ ID NO: 4416258 - DNA, 11 bp, Homo sapiens
gcatataaatg

SEQ ID NO: 4416259 - DNA, 14 bp, Homo sapiens
gcatataaatgttt

SEQ ID NO: 4416260 - DNA, 17 bp, Homo sapiens
gcatatcattaaacaaa

SEQ ID NO: 4416261 - DNA, 20 bp, Homo sapiens
gcatatcattaaacaaataa

SEQ ID NO: 4416262 - DNA, 23 bp, Homo sapiens
gcatatgggtgggattttgcaaa

SEQ ID NO: 4416263 - DNA, 18 bp, Homo sapiens
gcatatggtcctagacaa

SEQ ID NO: 4416264 - DNA, 14 bp, Homo sapiens
gcatatgttgaata

SEQ ID NO: 4416265 - DNA, 17 bp, Homo sapiens
gcatatgttgaatactt

SEQ ID NO: 4416266 - DNA, 19 bp, Homo sapiens
gcatatgttgaatactttt

SEQ ID NO: 4416267 - DNA, 21 bp, Homo sapiens
gcatatgttttccacataaat

SEQ ID NO: 4416268 - DNA, 16 bp, Homo sapiens
gcatattcaatgtatt

SEQ ID NO: 4416269 - DNA, 21 bp, Homo sapiens
gcatattcaatgtattgagaa

SEQ ID NO: 4416270 - DNA, 17 bp, Homo sapiens
gcatattccctgcacac

SEQ ID NO: 4416271 - DNA, 18 bp, Homo sapiens
gcatattctctattttac

SEQ ID NO: 4416272 - DNA, 19 bp, Homo sapiens
gcatatttgttactttact

SEQ ID NO: 4416273 - DNA, 15 bp, Homo sapiens
gcatattttgagaaa

SEQ ID NO: 4416274 - DNA, 20 bp, Homo sapiens
gcatattttgagaaactgct

SEQ ID NO: 4416275 - DNA, 12 bp, Homo sapiens
gcatcaagccac

SEQ ID NO: 4416276 - DNA, 19 bp, Homo sapiens
gcatcaatacaaccagccc

SEQ ID NO: 4416277 - DNA, 17 bp, Homo sapiens
gcatcacactcaaggac

SEQ ID NO: 4416278 - DNA, 22 bp, Homo sapiens
gcatcacactcaaggacaggag

SEQ ID NO: 4416279 - DNA, 19 bp, Homo sapiens
gcatcacacttatatttta

SEQ ID NO: 4416280 - DNA, 17 bp, Homo sapiens
gcatcacagaccccagc

SEQ ID NO: 4416281 - DNA, 23 bp, Homo sapiens
gcatcacggatggtgcatgggct

SEQ ID NO: 4416282 - DNA, 12 bp, Homo sapiens
gagtggcctggc

SEQ ID NO: 4416283 - DNA, 17 bp, Homo sapiens
gagtgggaaccggaaac

SEQ ID NO: 4416284 - DNA, 11 bp, Homo sapiens
gagtgggaagc

SEQ ID NO: 4416285 - DNA, 21 bp, Homo sapiens
gagtgggcttcggagtgaatg

SEQ ID NO: 4416286 - DNA, 15 bp, Homo sapiens
gagtggggcctttgc

SEQ ID NO: 4416287 - DNA, 21 bp, Homo sapiens
gagtggggcctttgccagcag

SEQ ID NO: 4416288 - DNA, 24 bp, Homo sapiens
gagtggggcctttgccagcagagc

SEQ ID NO: 4416289 - DNA, 15 bp, Homo sapiens
gagtgtaggtgactt

SEQ ID NO: 4416290 - DNA, 15 bp, Homo sapiens
gcacacagctgagca

SEQ ID NO: 4416291 - DNA, 11 bp, Homo sapiens
gcacacaggca

SEQ ID NO: 4416292 - DNA, 18 bp, Homo sapiens
gcacacaggcagccagcc

SEQ ID NO: 4416293 - DNA, 13 bp, Homo sapiens
gcacacccctggg

SEQ ID NO: 4416294 - DNA, 15 bp, Homo sapiens
gcacacccctggggc

SEQ ID NO: 4416295 - DNA, 17 bp, Homo sapiens
gcacactatttccctct

SEQ ID NO: 4416296 - DNA, 17 bp, Homo sapiens
gcacactgagaatgcta

SEQ ID NO: 4416297 - DNA, 13 bp, Homo sapiens
gcacactggaata

SEQ ID NO: 4416298 - DNA, 13 bp, Homo sapiens
gcacactttgcca

SEQ ID NO: 4416299 - DNA, 16 bp, Homo sapiens
gcacactttggcccag

SEQ ID NO: 4416300 - DNA, 12 bp, Homo sapiens
gcacagaatatg

SEQ ID NO: 4416301 - DNA, 14 bp, Homo sapiens
gcacagaatatttt

SEQ ID NO: 4416302 - DNA, 15 bp, Homo sapiens
gcacagagcctggcc

SEQ ID NO: 4416303 - DNA, 20 bp, Homo sapiens
gcacagagcctggccccagg

SEQ ID NO: 4416304 - DNA, 16 bp, Homo sapiens
gcacagaggatttctt

SEQ ID NO: 4416305 - DNA, 17 bp, Homo sapiens
gcacagaggcctgactg

SEQ ID NO: 4416306 - DNA, 18 bp, Homo sapiens
gcacagaggcctgactga

SEQ ID NO: 4416307 - DNA, 20 bp, Homo sapiens
gcacagaggcctgactgact

SEQ ID NO: 4416308 - DNA, 13 bp, Homo sapiens
gcacagcaagaaa

SEQ ID NO: 4416309 - DNA, 22 bp, Homo sapiens
gcacagcaggctgccagtgcct

SEQ ID NO: 4416310 - DNA, 17 bp, Homo sapiens
gcacagccaaatttaaa

SEQ ID NO: 4416311 - DNA, 18 bp, Homo sapiens
gcacagccaacgagacac

SEQ ID NO: 4416312 - DNA, 23 bp, Homo sapiens
gcacagcccctggagcctcagaa

SEQ ID NO: 4416313 - DNA, 21 bp, Homo sapiens
gcacagccgcgggccaggagg

SEQ ID NO: 4416314 - DNA, 23 bp, Homo sapiens
gcacagcctagggtcttgggggt

SEQ ID NO: 4416315 - DNA, 16 bp, Homo sapiens
gcacagcttagatttc

SEQ ID NO: 4416316 - DNA, 15 bp, Homo sapiens
gcacagtatttgtaa

SEQ ID NO: 4416317 - DNA, 22 bp, Homo sapiens
gcacagtggcgcatgcctgtaa

SEQ ID NO: 4416318 - DNA, 21 bp, Homo sapiens
gcacagttgaagggaggggct

SEQ ID NO: 4416319 - DNA, 23 bp, Homo sapiens
gcacatacacctcgtcaagagca

SEQ ID NO: 4416320 - DNA, 21 bp, Homo sapiens
gcacataggcagtagcctcct

SEQ ID NO: 4416321 - DNA, 21 bp, Homo sapiens
gcacatatttgcatgggaggg

SEQ ID NO: 4416322 - DNA, 14 bp, Homo sapiens
gcacatctctctgc

SEQ ID NO: 4416323 - DNA, 15 bp, Homo sapiens
gcacatctctctgcc

SEQ ID NO: 4416324 - DNA, 16 bp, Homo sapiens
gcacattgcccctctg

SEQ ID NO: 4416325 - DNA, 18 bp, Homo sapiens
gcacattgcccctctgcc

SEQ ID NO: 4416326 - DNA, 15 bp, Homo sapiens
gcaccaaaagaagta

SEQ ID NO: 4416327 - DNA, 22 bp, Homo sapiens
gcaccaaagacatcagtctcca

SEQ ID NO: 4416328 - DNA, 17 bp, Homo sapiens
gcaccaatcagcactct

SEQ ID NO: 4416329 - DNA, 20 bp, Homo sapiens
gcaccaatcttgtttatagc

SEQ ID NO: 4416330 - DNA, 14 bp, Homo sapiens
gcaccaccagggct

SEQ ID NO: 4416331 - DNA, 19 bp, Homo sapiens
gcaccaccatttaatttca

SEQ ID NO: 4416332 - DNA, 11 bp, Homo sapiens
gcaccacccta

SEQ ID NO: 4416333 - DNA, 23 bp, Homo sapiens
gcaccaccctagtcccttcccct

SEQ ID NO: 4416334 - DNA, 19 bp, Homo sapiens
gcaccactgcactccagcc

SEQ ID NO: 4416335 - DNA, 20 bp, Homo sapiens
gcaccagatgcaacctcact

SEQ ID NO: 4416336 - DNA, 13 bp, Homo sapiens
gcaccaggaagcc

SEQ ID NO: 4416337 - DNA, 14 bp, Homo sapiens
gcaccaggggccaa

SEQ ID NO: 4416338 - DNA, 22 bp, Homo sapiens
gcaccaggggccaacctcaggc

SEQ ID NO: 4416339 - DNA, 18 bp, Homo sapiens
gcaccaggggtgcacaat

SEQ ID NO: 4416340 - DNA, 21 bp, Homo sapiens
gcaccaggggtgcacaataaa

SEQ ID NO: 4416341 - DNA, 14 bp, Homo sapiens
gcacccagaacagt

SEQ ID NO: 4416342 - DNA, 12 bp, Homo sapiens
gcacccagagca

SEQ ID NO: 4416343 - DNA, 11 bp, Homo sapiens
gcacccagccc

SEQ ID NO: 4416344 - DNA, 13 bp, Homo sapiens
gcacccagccctg

SEQ ID NO: 4416345 - DNA, 15 bp, Homo sapiens
gcacccagccctggt

SEQ ID NO: 4416346 - DNA, 23 bp, Homo sapiens
gcacccaggcaggtgcagggaag

SEQ ID NO: 4416347 - DNA, 21 bp, Homo sapiens
gcacccatctgtctgccaacc

SEQ ID NO: 4416348 - DNA, 11 bp, Homo sapiens
gcaccccacag

SEQ ID NO: 4416349 - DNA, 17 bp, Homo sapiens
gcaccccacagctgggg

SEQ ID NO: 4416350 - DNA, 13 bp, Homo sapiens
gcacccccatgct

SEQ ID NO: 4416351 - DNA, 14 bp, Homo sapiens
gcacccccatgctg

SEQ ID NO: 4416352 - DNA, 21 bp, Homo sapiens
gcaccccctgctccaccagca

SEQ ID NO: 4416353 - DNA, 16 bp, Homo sapiens
gcacccctactcacat

SEQ ID NO: 4416354 - DNA, 21 bp, Homo sapiens
gcacccctgagttgggcagcc

SEQ ID NO: 4416355 - DNA, 13 bp, Homo sapiens
gcacccctgcccc

SEQ ID NO: 4416356 - DNA, 13 bp, Homo sapiens
gcacccctgggcc

SEQ ID NO: 4416357 - DNA, 14 bp, Homo sapiens
gcacccctgggcca

SEQ ID NO: 4416358 - DNA, 18 bp, Homo sapiens
gcaccccttctctcctcc

SEQ ID NO: 4416359 - DNA, 20 bp, Homo sapiens
gcaccccttctctcctcccc

SEQ ID NO: 4416360 - DNA, 21 bp, Homo sapiens
gcaccccttctctcctcccca

SEQ ID NO: 4416361 - DNA, 18 bp, Homo sapiens
gcacccgtggtgcatggt

SEQ ID NO: 4416362 - DNA, 13 bp, Homo sapiens
gcaccctataaat

SEQ ID NO: 4416363 - DNA, 12 bp, Homo sapiens
gcaccctcaggg

SEQ ID NO: 4416364 - DNA, 13 bp, Homo sapiens
gcaccctcaggga

SEQ ID NO: 4416365 - DNA, 22 bp, Homo sapiens
gcaccctcagggagcctcccca

SEQ ID NO: 4416366 - DNA, 20 bp, Homo sapiens
gcaccctggagagtgcacat

SEQ ID NO: 4416367 - DNA, 15 bp, Homo sapiens
gcaccgaatattgag

SEQ ID NO: 4416368 - DNA, 20 bp, Homo sapiens
gcaccgaggttgcattctag

SEQ ID NO: 4416369 - DNA, 18 bp, Homo sapiens
gcaccgccacgtcccagc

SEQ ID NO: 4416370 - DNA, 19 bp, Homo sapiens
gcaccgcctgaaggcacag

SEQ ID NO: 4416371 - DNA, 21 bp, Homo sapiens
gcaccgcctgaaggcacagct

SEQ ID NO: 4416372 - DNA, 14 bp, Homo sapiens
gcaccggggcctgg

SEQ ID NO: 4416373 - DNA, 21 bp, Homo sapiens
gcacctacagtgtacagtctt

SEQ ID NO: 4416374 - DNA, 22 bp, Homo sapiens
gcacctatgagatggccatgct

SEQ ID NO: 4416375 - DNA, 14 bp, Homo sapiens
gcacctattgaatt

SEQ ID NO: 4416376 - DNA, 13 bp, Homo sapiens
gcacctcccccca

SEQ ID NO: 4416377 - DNA, 18 bp, Homo sapiens
gcacctccccccactgca

SEQ ID NO: 4416378 - DNA, 19 bp, Homo sapiens
gcacctccccccactgcag

SEQ ID NO: 4416379 - DNA, 23 bp, Homo sapiens
gcacctccccccactgcaggccc

SEQ ID NO: 4416380 - DNA, 14 bp, Homo sapiens
gcacctccccgctg

SEQ ID NO: 4416381 - DNA, 15 bp, Homo sapiens
gcacctccccgctgg

SEQ ID NO: 4416382 - DNA, 22 bp, Homo sapiens
gcacctcctaccctcccaccag

SEQ ID NO: 4416383 - DNA, 22 bp, Homo sapiens
gcacctgcatccgtagttccct

SEQ ID NO: 4416384 - DNA, 19 bp, Homo sapiens
gcacctgccgacctcgtcc

SEQ ID NO: 4416385 - DNA, 21 bp, Homo sapiens
gcacctgccgacctcgtcctc

SEQ ID NO: 4416386 - DNA, 22 bp, Homo sapiens
gcacctgcgcggaggacgcgac

SEQ ID NO: 4416387 - DNA, 17 bp, Homo sapiens
gcacctgtagtcccagc

SEQ ID NO: 4416388 - DNA, 14 bp, Homo sapiens
gcaccttcagactt

SEQ ID NO: 4416389 - DNA, 20 bp, Homo sapiens
gcaccttcagggctgagttc

SEQ ID NO: 4416390 - DNA, 15 bp, Homo sapiens
gcacgaacccacctg

SEQ ID NO: 4416391 - DNA, 16 bp, Homo sapiens
gcacgaacccacctgc

SEQ ID NO: 4416392 - DNA, 23 bp, Homo sapiens
gcacgaacccacctgctgagaga

SEQ ID NO: 4416393 - DNA, 16 bp, Homo sapiens
gcacgagcctgggcga

SEQ ID NO: 4416394 - DNA, 14 bp, Homo sapiens
gcacgcctgctggc

SEQ ID NO: 4416395 - DNA, 15 bp, Homo sapiens
gcacgcctgctggcc

SEQ ID NO: 4416396 - DNA, 17 bp, Homo sapiens
gcagcaatttaaatgtt

SEQ ID NO: 4416397 - DNA, 19 bp, Homo sapiens
gcagcaccctataaatcaa

SEQ ID NO: 4416398 - DNA, 12 bp, Homo sapiens
gcagcaccctcc

SEQ ID NO: 4416399 - DNA, 15 bp, Homo sapiens
gcagcaccctccccc

SEQ ID NO: 4416400 - DNA, 14 bp, Homo sapiens
gcagcacctttcta

SEQ ID NO: 4416401 - DNA, 19 bp, Homo sapiens
gcagcacttagacctgcca

SEQ ID NO: 4416402 - DNA, 20 bp, Homo sapiens
gcagcacttagacctgccag

SEQ ID NO: 4416403 - DNA, 14 bp, Homo sapiens
gcagcagaaaactt

SEQ ID NO: 4416404 - DNA, 16 bp, Homo sapiens
gcagcagagagccctg

SEQ ID NO: 4416405 - DNA, 14 bp, Homo sapiens
gcagcagataactt

SEQ ID NO: 4416406 - DNA, 12 bp, Homo sapiens
gcagcagcactt

SEQ ID NO: 4416407 - DNA, 16 bp, Homo sapiens
gcagcagcctgcacct

SEQ ID NO: 4416408 - DNA, 18 bp, Homo sapiens
gcagcagcctgcacctgc

SEQ ID NO: 4416409 - DNA, 20 bp, Homo sapiens
gcagcagcctgcacctgccc

SEQ ID NO: 4416410 - DNA, 21 bp, Homo sapiens
gcagcagcctgcacctgcccc

SEQ ID NO: 4416411 - DNA, 20 bp, Homo sapiens
gcagcagctctgagccagat

SEQ ID NO: 4416412 - DNA, 16 bp, Homo sapiens
gcagcagcttggggag

SEQ ID NO: 4416413 - DNA, 12 bp, Homo sapiens
gcagcaggcatt

SEQ ID NO: 4416414 - DNA, 14 bp, Homo sapiens
gcagcaggctcagg

SEQ ID NO: 4416415 - DNA, 17 bp, Homo sapiens
gcagcaggctcaggcac

SEQ ID NO: 4416416 - DNA, 19 bp, Homo sapiens
gcagcaggtagcctgctgg

SEQ ID NO: 4416417 - DNA, 15 bp, Homo sapiens
gcagcagtgtgaggc

SEQ ID NO: 4416418 - DNA, 18 bp, Homo sapiens
gcagcatccaccccaccc

SEQ ID NO: 4416419 - DNA, 14 bp, Homo sapiens
gcagcatcttctgg

SEQ ID NO: 4416420 - DNA, 14 bp, Homo sapiens
gcagcatggcatag

SEQ ID NO: 4416421 - DNA, 18 bp, Homo sapiens
gcagcattcccagggacc

SEQ ID NO: 4416422 - DNA, 15 bp, Homo sapiens
gcagccacagggaag

SEQ ID NO: 4416423 - DNA, 13 bp, Homo sapiens
gcagccagcccag

SEQ ID NO: 4416424 - DNA, 23 bp, Homo sapiens
gcagccagcccagcccagctggt

SEQ ID NO: 4416425 - DNA, 12 bp, Homo sapiens
gcagccagggct

SEQ ID NO: 4416426 - DNA, 13 bp, Homo sapiens
gcagccagggctg

SEQ ID NO: 4416427 - DNA, 14 bp, Homo sapiens
gcagccagggctgg

SEQ ID NO: 4416428 - DNA, 18 bp, Homo sapiens
gcagcccaccagacgtca

SEQ ID NO: 4416429 - DNA, 17 bp, Homo sapiens
gcagcccatgcccacct

SEQ ID NO: 4416430 - DNA, 20 bp, Homo sapiens
gcagcccatgcccacctgcc

SEQ ID NO: 4416431 - DNA, 22 bp, Homo sapiens
gcagccccacttcacccccaac

SEQ ID NO: 4416432 - DNA, 13 bp, Homo sapiens
gcagccccccaga

SEQ ID NO: 4416433 - DNA, 15 bp, Homo sapiens
gcagccccccagcac

SEQ ID NO: 4416434 - DNA, 18 bp, Homo sapiens
gcagccccgttttgggga

SEQ ID NO: 4416435 - DNA, 21 bp, Homo sapiens
gcagccccgttttggggacgt

SEQ ID NO: 4416436 - DNA, 13 bp, Homo sapiens
gcagcccctgaga

SEQ ID NO: 4416437 - DNA, 18 bp, Homo sapiens
gcagcccctgagagcctg

SEQ ID NO: 4416438 - DNA, 18 bp, Homo sapiens
gcagccctagagcctgcc

SEQ ID NO: 4416439 - DNA, 17 bp, Homo sapiens
gcagccctagcggctgc

SEQ ID NO: 4416440 - DNA, 20 bp, Homo sapiens
gcagccctggatggtggcca

SEQ ID NO: 4416441 - DNA, 16 bp, Homo sapiens
gcagccctggccccca

SEQ ID NO: 4416442 - DNA, 22 bp, Homo sapiens
gcagccctggcccccatcagcc

SEQ ID NO: 4416443 - DNA, 21 bp, Homo sapiens
gcagcctaaagtacagcctgg

SEQ ID NO: 4416444 - DNA, 22 bp, Homo sapiens
gcagcctcgcggtcttgggcac

SEQ ID NO: 4416445 - DNA, 22 bp, Homo sapiens
gcagcctctggacagccagtga

SEQ ID NO: 4416446 - DNA, 19 bp, Homo sapiens
gcagcctgcacctgccccg

SEQ ID NO: 4416447 - DNA, 16 bp, Homo sapiens
gcagcctgtggcatct

SEQ ID NO: 4416448 - DNA, 22 bp, Homo sapiens
gcagcgaccacccctgcctcca

SEQ ID NO: 4416449 - DNA, 23 bp, Homo sapiens
gcagcgccccaccacgtcgggct

SEQ ID NO: 4416450 - DNA, 14 bp, Homo sapiens
gcagcggctcctgc

SEQ ID NO: 4416451 - DNA, 18 bp, Homo sapiens
gcagcgtgtgggtcccgc

SEQ ID NO: 4416452 - DNA, 15 bp, Homo sapiens
gcagctactggaatg

SEQ ID NO: 4416453 - DNA, 17 bp, Homo sapiens
gcagctatatatttccc

SEQ ID NO: 4416454 - DNA, 15 bp, Homo sapiens
gcagctctgagccag

SEQ ID NO: 4416455 - DNA, 16 bp, Homo sapiens
gcagctctgagccaga

SEQ ID NO: 4416456 - DNA, 16 bp, Homo sapiens
gcagctctggctctgc

SEQ ID NO: 4416457 - DNA, 17 bp, Homo sapiens
gcagctctggctctgcc

SEQ ID NO: 4416458 - DNA, 17 bp, Homo sapiens
gcagctgagagccctgc

SEQ ID NO: 4416459 - DNA, 17 bp, Homo sapiens
gcagctgagcctgagcc

SEQ ID NO: 4416460 - DNA, 16 bp, Homo sapiens
gcagctgatccaggca

SEQ ID NO: 4416461 - DNA, 10 bp, Homo sapiens
gcagctgcct

SEQ ID NO: 4416462 - DNA, 11 bp, Homo sapiens
gcagctgcctc

SEQ ID NO: 4416463 - DNA, 12 bp, Homo sapiens
gcagctgcctct

SEQ ID NO: 4416464 - DNA, 9 bp, Homo sapiens
gcagctgct

SEQ ID NO: 4416465 - DNA, 23 bp, Homo sapiens
gcagctgctatccccatctccct

SEQ ID NO: 4416466 - DNA, 17 bp, Homo sapiens
gcagctggaatgtgcca

SEQ ID NO: 4416467 - DNA, 15 bp, Homo sapiens
gcagctgtcctgtga

SEQ ID NO: 4416468 - DNA, 21 bp, Homo sapiens
gcagctgtcctgtgatgtcag

SEQ ID NO: 4416469 - DNA, 17 bp, Homo sapiens
gcagcttaagtccagct

SEQ ID NO: 4416470 - DNA, 19 bp, Homo sapiens
gcagcttcacccaccaggc

SEQ ID NO: 4416471 - DNA, 15 bp, Homo sapiens
gcagcttcgaggaca

SEQ ID NO: 4416472 - DNA, 21 bp, Homo sapiens
gcagcttctactcctgcctca

SEQ ID NO: 4416473 - DNA, 22 bp, Homo sapiens
gcagctttttattccctgccca

SEQ ID NO: 4416474 - DNA, 11 bp, Homo sapiens
gcaggaaaaaa

SEQ ID NO: 4416475 - DNA, 14 bp, Homo sapiens
gcaggaaaaggcta

SEQ ID NO: 4416476 - DNA, 12 bp, Homo sapiens
gcaggaaggaga

SEQ ID NO: 4416477 - DNA, 20 bp, Homo sapiens
gcaggacagctcctggacca

SEQ ID NO: 4416478 - DNA, 14 bp, Homo sapiens
gcaggacccagtgg

SEQ ID NO: 4416479 - DNA, 20 bp, Homo sapiens
gcaggacctactaggagagg

SEQ ID NO: 4416480 - DNA, 22 bp, Homo sapiens
gcaggactccaggcccaaggct

SEQ ID NO: 4416481 - DNA, 23 bp, Homo sapiens
gcaggactccaggcccaaggctc

SEQ ID NO: 4416482 - DNA, 22 bp, Homo sapiens
gcaggagctagttctcagcttg

SEQ ID NO: 4416483 - DNA, 14 bp, Homo sapiens
gcaggagcttgggt

SEQ ID NO: 4416484 - DNA, 20 bp, Homo sapiens
gcaggagcttgggtctctct

SEQ ID NO: 4416485 - DNA, 14 bp, Homo sapiens
gcaggatggaacta

SEQ ID NO: 4416486 - DNA, 14 bp, Homo sapiens
gcaggattgaaaat

SEQ ID NO: 4416487 - DNA, 18 bp, Homo sapiens
gcaggcacacagcagccc

SEQ ID NO: 4416488 - DNA, 22 bp, Homo sapiens
gcaggcaggaacaaacagggct

SEQ ID NO: 4416489 - DNA, 21 bp, Homo sapiens
gcaggcatcggggagccggga

SEQ ID NO: 4416490 - DNA, 22 bp, Homo sapiens
gcaggccaaggtctgagccaca

SEQ ID NO: 4416491 - DNA, 17 bp, Homo sapiens
gcaggccagatggcccc

SEQ ID NO: 4416492 - DNA, 20 bp, Homo sapiens
gcaggcccactccccagccc

SEQ ID NO: 4416493 - DNA, 22 bp, Homo sapiens
gcaggcccactccccagcccca

SEQ ID NO: 4416494 - DNA, 22 bp, Homo sapiens
gcaggcctctggttgcctcccc

SEQ ID NO: 4416495 - DNA, 23 bp, Homo sapiens
gcaggcctctggttgcctccccc

SEQ ID NO: 4416496 - DNA, 15 bp, Homo sapiens
gcaggcctgtccctg

SEQ ID NO: 4416497 - DNA, 16 bp, Homo sapiens
gcaggcctgtccctgg

SEQ ID NO: 4416498 - DNA, 21 bp, Homo sapiens
gcaggcgcctataatcccagc

SEQ ID NO: 4416499 - DNA, 18 bp, Homo sapiens
gcaggctcactgccaggc

SEQ ID NO: 4416500 - DNA, 21 bp, Homo sapiens
gcaggctcactgccaggccag

SEQ ID NO: 4416501 - DNA, 16 bp, Homo sapiens
gcaggctgcagtggct

SEQ ID NO: 4416502 - DNA, 17 bp, Homo sapiens
gcaggctgccagtgcct

SEQ ID NO: 4416503 - DNA, 18 bp, Homo sapiens
gcaggctgccagtgcctg

SEQ ID NO: 4416504 - DNA, 17 bp, Homo sapiens
gcaggctggcctatgtg

SEQ ID NO: 4416505 - DNA, 13 bp, Homo sapiens
gcaggctgggcca

SEQ ID NO: 4416506 - DNA, 15 bp, Homo sapiens
gcaggctgggccatg

SEQ ID NO: 4416507 - DNA, 12 bp, Homo sapiens
gcaggctgttcc

SEQ ID NO: 4416508 - DNA, 14 bp, Homo sapiens
gcagggaaggcctg

SEQ ID NO: 4416509 - DNA, 19 bp, Homo sapiens
gcagggaagtgcagagctt

SEQ ID NO: 4416510 - DNA, 17 bp, Homo sapiens
gcagggaatgcagcagg

SEQ ID NO: 4416511 - DNA, 18 bp, Homo sapiens
gcagggaatgcagcagga

SEQ ID NO: 4416512 - DNA, 20 bp, Homo sapiens
gcagggagacatctgcaccc

SEQ ID NO: 4416513 - DNA, 19 bp, Homo sapiens
gcagggagccttctgccac

SEQ ID NO: 4416514 - DNA, 18 bp, Homo sapiens
gatgtcttatttttagat

SEQ ID NO: 4416515 - DNA, 17 bp, Homo sapiens
gatgtcttccctgggct

SEQ ID NO: 4416516 - DNA, 13 bp, Homo sapiens
gatgtcttctgcc

SEQ ID NO: 4416517 - DNA, 16 bp, Homo sapiens
gatgtcttctgcctgt

SEQ ID NO: 4416518 - DNA, 18 bp, Homo sapiens
gatgtgaattattgacac

SEQ ID NO: 4416519 - DNA, 23 bp, Homo sapiens
gatgtgagccaccgtgcctggcc

SEQ ID NO: 4416520 - DNA, 13 bp, Homo sapiens
gatgtgattattt

SEQ ID NO: 4416521 - DNA, 16 bp, Homo sapiens
gatgtgattgtggaat

SEQ ID NO: 4416522 - DNA, 15 bp, Homo sapiens
gatgtgctggagggg

SEQ ID NO: 4416523 - DNA, 21 bp, Homo sapiens
gatgtgctgttttctgtaaat

SEQ ID NO: 4416524 - DNA, 17 bp, Homo sapiens
gatgtggaggaagagcc

SEQ ID NO: 4416525 - DNA, 14 bp, Homo sapiens
gatgtggccctggc

SEQ ID NO: 4416526 - DNA, 13 bp, Homo sapiens
gatgtgtcctcag

SEQ ID NO: 4416527 - DNA, 17 bp, Homo sapiens
gatgtgtgcaatgtggc

SEQ ID NO: 4416528 - DNA, 19 bp, Homo sapiens
gatgttcatgatagaaaga

SEQ ID NO: 4416529 - DNA, 13 bp, Homo sapiens
gattaaaaatacc

SEQ ID NO: 4416530 - DNA, 20 bp, Homo sapiens
gattaaaattcaggaagcag

SEQ ID NO: 4416531 - DNA, 17 bp, Homo sapiens
gattaaaggcagcattt

SEQ ID NO: 4416532 - DNA, 18 bp, Homo sapiens
gattaaaggcagcatttg

SEQ ID NO: 4416533 - DNA, 10 bp, Homo sapiens
gattaaattt

SEQ ID NO: 4416534 - DNA, 22 bp, Homo sapiens
gattaacctgaaagaacataca

SEQ ID NO: 4416535 - DNA, 16 bp, Homo sapiens
gattaactttcaaaag

SEQ ID NO: 4416536 - DNA, 15 bp, Homo sapiens
gattaataaaatatc

SEQ ID NO: 4416537 - DNA, 20 bp, Homo sapiens
gattaataagatttttcaaa

SEQ ID NO: 4416538 - DNA, 21 bp, Homo sapiens
gattaatttctgccatttcat

SEQ ID NO: 4416539 - DNA, 17 bp, Homo sapiens
gattacaaatcagaagt

SEQ ID NO: 4416540 - DNA, 23 bp, Homo sapiens
gattacaaatcagaagtcatctt

SEQ ID NO: 4416541 - DNA, 22 bp, Homo sapiens
gattacatccgtaggacaagtt

SEQ ID NO: 4416542 - DNA, 15 bp, Homo sapiens
gattacatctgcctt

SEQ ID NO: 4416543 - DNA, 23 bp, Homo sapiens
gattaccagggactatctttgct

SEQ ID NO: 4416544 - DNA, 20 bp, Homo sapiens
gattacccaaatataaccat

SEQ ID NO: 4416545 - DNA, 17 bp, Homo sapiens
gattacctcctgagaaa

SEQ ID NO: 4416546 - DNA, 18 bp, Homo sapiens
gattacgatgtaaatttt

SEQ ID NO: 4416547 - DNA, 12 bp, Homo sapiens
gattagaaacta

SEQ ID NO: 4416548 - DNA, 15 bp, Homo sapiens
gattagaaattacct

SEQ ID NO: 4416549 - DNA, 20 bp, Homo sapiens
gattagaaattacctgtgga

SEQ ID NO: 4416550 - DNA, 22 bp, Homo sapiens
gattagaaattacctgtggata

SEQ ID NO: 4416551 - DNA, 18 bp, Homo sapiens
gattagacctttatccag

SEQ ID NO: 4416552 - DNA, 13 bp, Homo sapiens
gattagataaaga

SEQ ID NO: 4416553 - DNA, 15 bp, Homo sapiens
gattagtaagatctc

SEQ ID NO: 4416554 - DNA, 23 bp, Homo sapiens
gattatagtaactataagataca

SEQ ID NO: 4416555 - DNA, 13 bp, Homo sapiens
gattatatgggta

SEQ ID NO: 4416556 - DNA, 13 bp, Homo sapiens
gattatattcaca

SEQ ID NO: 4416557 - DNA, 18 bp, Homo sapiens
gattatggaaaaataaaa

SEQ ID NO: 4416558 - DNA, 16 bp, Homo sapiens
gattatggttttgtga

SEQ ID NO: 4416559 - DNA, 17 bp, Homo sapiens
gattatggttttgtgat

SEQ ID NO: 4416560 - DNA, 22 bp, Homo sapiens
gattatgtatggatatatttga

SEQ ID NO: 4416561 - DNA, 13 bp, Homo sapiens
gattatgtgactt

SEQ ID NO: 4416562 - DNA, 14 bp, Homo sapiens
gattattcagtgtc

SEQ ID NO: 4416563 - DNA, 21 bp, Homo sapiens
gattattgagttccagttgaa

SEQ ID NO: 4416564 - DNA, 22 bp, Homo sapiens
gattattgtgacttcactgtat

SEQ ID NO: 4416565 - DNA, 16 bp, Homo sapiens
gattatttatgacctg

SEQ ID NO: 4416566 - DNA, 21 bp, Homo sapiens
gattatttgggagggaaaagg

SEQ ID NO: 4416567 - DNA, 14 bp, Homo sapiens
gattcaaaatattt

SEQ ID NO: 4416568 - DNA, 16 bp, Homo sapiens
gattcaaaatatttaa

SEQ ID NO: 4416569 - DNA, 15 bp, Homo sapiens
gattcaaatgtttta

SEQ ID NO: 4416570 - DNA, 16 bp, Homo sapiens
gattcaatctgtaaac

SEQ ID NO: 4416571 - DNA, 23 bp, Homo sapiens
gattcagaaaatgttctgtttgc

SEQ ID NO: 4416572 - DNA, 15 bp, Homo sapiens
gattcaggccagccc

SEQ ID NO: 4416573 - DNA, 18 bp, Homo sapiens
gattcaggccagcccagc

SEQ ID NO: 4416574 - DNA, 12 bp, Homo sapiens
gattcaggctgc

SEQ ID NO: 4416575 - DNA, 22 bp, Homo sapiens
gattcagttttcatttggttca

SEQ ID NO: 4416576 - DNA, 19 bp, Homo sapiens
gattcatagtaacttctta

SEQ ID NO: 4416577 - DNA, 12 bp, Homo sapiens
gattcatattta

SEQ ID NO: 4416578 - DNA, 13 bp, Homo sapiens
gattccaaaccag

SEQ ID NO: 4416579 - DNA, 16 bp, Homo sapiens
gattccaaaccaggac

SEQ ID NO: 4416580 - DNA, 19 bp, Homo sapiens
gattccaaagagtagaatt

SEQ ID NO: 4416581 - DNA, 14 bp, Homo sapiens
gattcccaactcct

SEQ ID NO: 4416582 - DNA, 19 bp, Homo sapiens
gattcccagagacaggaaa

SEQ ID NO: 4416583 - DNA, 13 bp, Homo sapiens
gattcccctccac

SEQ ID NO: 4416584 - DNA, 15 bp, Homo sapiens
gattctatttatatg

SEQ ID NO: 4416585 - DNA, 21 bp, Homo sapiens
gattctatttatatgtacatg

SEQ ID NO: 4416586 - DNA, 13 bp, Homo sapiens
gattctcgcccct

SEQ ID NO: 4416587 - DNA, 17 bp, Homo sapiens
gattctcgccccttccc

SEQ ID NO: 4416588 - DNA, 23 bp, Homo sapiens
gattctcgccccttccctctctc

SEQ ID NO: 4416589 - DNA, 15 bp, Homo sapiens
gattctctattggct

SEQ ID NO: 4416590 - DNA, 15 bp, Homo sapiens
gattctgaagtttta

SEQ ID NO: 4416591 - DNA, 17 bp, Homo sapiens
gattctgagcaaaggcc

SEQ ID NO: 4416592 - DNA, 21 bp, Homo sapiens
gattctgagcaaaggccctgg

SEQ ID NO: 4416593 - DNA, 23 bp, Homo sapiens
gattctgagcaaaggccctgggt

SEQ ID NO: 4416594 - DNA, 14 bp, Homo sapiens
gattctgcctctct

SEQ ID NO: 4416595 - DNA, 15 bp, Homo sapiens
gattctggggctgtg

SEQ ID NO: 4416596 - DNA, 12 bp, Homo sapiens
gattctgtacat

SEQ ID NO: 4416597 - DNA, 16 bp, Homo sapiens
gattctgtgtattaac

SEQ ID NO: 4416598 - DNA, 15 bp, Homo sapiens
gattcttgtaaatct

SEQ ID NO: 4416599 - DNA, 18 bp, Homo sapiens
gattcttgtaaatctttt

SEQ ID NO: 4416600 - DNA, 19 bp, Homo sapiens
gattcttgtaaatcttttt

SEQ ID NO: 4416601 - DNA, 20 bp, Homo sapiens
gattctttcccaattcacat

SEQ ID NO: 4416602 - DNA, 13 bp, Homo sapiens
gattctttcccca

SEQ ID NO: 4416603 - DNA, 23 bp, Homo sapiens
gattctttccccagaggctccca

SEQ ID NO: 4416604 - DNA, 19 bp, Homo sapiens
gattgaaaatgtccaggaa

SEQ ID NO: 4416605 - DNA, 19 bp, Homo sapiens
gattgaactggaataatat

SEQ ID NO: 4416606 - DNA, 23 bp, Homo sapiens
gattgaagtattttgctggaata

SEQ ID NO: 4416607 - DNA, 17 bp, Homo sapiens
gattgaggggccctggc

SEQ ID NO: 4416608 - DNA, 15 bp, Homo sapiens
gattgatttgaagaa

SEQ ID NO: 4416609 - DNA, 17 bp, Homo sapiens
gattgatttgaagaaca

SEQ ID NO: 4416610 - DNA, 19 bp, Homo sapiens
gattgcagaaaattctgtg

SEQ ID NO: 4416611 - DNA, 23 bp, Homo sapiens
gattgcaggagtccctgccatca

SEQ ID NO: 4416612 - DNA, 19 bp, Homo sapiens
gattgcaggtggaactcag

SEQ ID NO: 4416613 - DNA, 19 bp, Homo sapiens
gattgcccctggctttgcc

SEQ ID NO: 4416614 - DNA, 20 bp, Homo sapiens
gattgcccctggctttgcct

SEQ ID NO: 4416615 - DNA, 22 bp, Homo sapiens
gattgcccctggctttgcctct

SEQ ID NO: 4416616 - DNA, 15 bp, Homo sapiens
gattgcctttaatat

SEQ ID NO: 4416617 - DNA, 16 bp, Homo sapiens
gattgctgccccatca

SEQ ID NO: 4416618 - DNA, 20 bp, Homo sapiens
gattgctgccccatcagtgc

SEQ ID NO: 4416619 - DNA, 21 bp, Homo sapiens
gattggccactggatcctgct

SEQ ID NO: 4416620 - DNA, 17 bp, Homo sapiens
gattggctcacactgag

SEQ ID NO: 4416621 - DNA, 23 bp, Homo sapiens
gattgggggggccaaaaggaaaa

SEQ ID NO: 4416622 - DNA, 15 bp, Homo sapiens
gattggttaaaatgt

SEQ ID NO: 4416623 - DNA, 12 bp, Homo sapiens
gattgtaaaatg

SEQ ID NO: 4416624 - DNA, 15 bp, Homo sapiens
gattgtattgctgtc

SEQ ID NO: 4416625 - DNA, 15 bp, Homo sapiens
gattgtattgttgaa

SEQ ID NO: 4416626 - DNA, 15 bp, Homo sapiens
gattgtgaggcttct

SEQ ID NO: 4416627 - DNA, 17 bp, Homo sapiens
gattgttttggtctcaa

SEQ ID NO: 4416628 - DNA, 22 bp, Homo sapiens
gattgttttttaaaaatggata

SEQ ID NO: 4416629 - DNA, 19 bp, Homo sapiens
gatttaaagtattttaatt

SEQ ID NO: 4416630 - DNA, 13 bp, Homo sapiens
gatttaacacttt

SEQ ID NO: 4416631 - DNA, 20 bp, Homo sapiens
gatttaacctgttatttcta

SEQ ID NO: 4416632 - DNA, 12 bp, Homo sapiens
gatttacattca

SEQ ID NO: 4416633 - DNA, 20 bp, Homo sapiens
gatttacccagaatgtcaga

SEQ ID NO: 4416634 - DNA, 21 bp, Homo sapiens
gatttacccagaatgtcagat

SEQ ID NO: 4416635 - DNA, 21 bp, Homo sapiens
gatttattttgtatgaaatat

SEQ ID NO: 4416636 - DNA, 16 bp, Homo sapiens
gatttcacatttctac

SEQ ID NO: 4416637 - DNA, 21 bp, Homo sapiens
gatttcagaaagagcaagtct

SEQ ID NO: 4416638 - DNA, 21 bp, Homo sapiens
gatttcagtcatagcaagctt

SEQ ID NO: 4416639 - DNA, 17 bp, Homo sapiens
gatttcatattgatctt

SEQ ID NO: 4416640 - DNA, 16 bp, Homo sapiens
gatttcatccttgaat

SEQ ID NO: 4416641 - DNA, 12 bp, Homo sapiens
gatttcatctgc

SEQ ID NO: 4416642 - DNA, 22 bp, Homo sapiens
gatttcatctgctctccttcct

SEQ ID NO: 4416643 - DNA, 20 bp, Homo sapiens
gatttcccactgcactccag

SEQ ID NO: 4416644 - DNA, 21 bp, Homo sapiens
gatttcccactgcactccagc

SEQ ID NO: 4416645 - DNA, 21 bp, Homo sapiens
gatttcccccctccgcctcca

SEQ ID NO: 4416646 - DNA, 17 bp, Homo sapiens
gatttccttgaatgtgg

SEQ ID NO: 4416647 - DNA, 14 bp, Homo sapiens
gatttctatggctt

SEQ ID NO: 4416648 - DNA, 15 bp, Homo sapiens
gatttctatggcttt

SEQ ID NO: 4416649 - DNA, 17 bp, Homo sapiens
gatttctatggctttca

SEQ ID NO: 4416650 - DNA, 18 bp, Homo sapiens
gatttctatggctttcaa

SEQ ID NO: 4416651 - DNA, 23 bp, Homo sapiens
gatttctcactatatatatttct

SEQ ID NO: 4416652 - DNA, 16 bp, Homo sapiens
gatttctgaagtgctt

SEQ ID NO: 4416653 - DNA, 14 bp, Homo sapiens
gatttctgaggaaa

SEQ ID NO: 4416654 - DNA, 17 bp, Homo sapiens
gatttctgtaaactctg

SEQ ID NO: 4416655 - DNA, 17 bp, Homo sapiens
gatttctttagtgtcat

SEQ ID NO: 4416656 - DNA, 14 bp, Homo sapiens
gatttgaaaaactt

SEQ ID NO: 4416657 - DNA, 16 bp, Homo sapiens
gatttgaaaagaattt

SEQ ID NO: 4416658 - DNA, 19 bp, Homo sapiens
gatttgaaaagaatttgtt

SEQ ID NO: 4416659 - DNA, 19 bp, Homo sapiens
gatttgaagaacatgtgag

SEQ ID NO: 4416660 - DNA, 20 bp, Homo sapiens
gatttgaagaacatgtgaga

SEQ ID NO: 4416661 - DNA, 13 bp, Homo sapiens
gatttgacattgc

SEQ ID NO: 4416662 - DNA, 23 bp, Homo sapiens
gatttgatgagttaactgtgaaa

SEQ ID NO: 4416663 - DNA, 15 bp, Homo sapiens
gatttgcattgaaca

SEQ ID NO: 4416664 - DNA, 17 bp, Homo sapiens
gatttgcattgaacaca

SEQ ID NO: 4416665 - DNA, 22 bp, Homo sapiens
gatttgctgttaccaaatctca

SEQ ID NO: 4416666 - DNA, 19 bp, Homo sapiens
gatttggagaccgaagact

SEQ ID NO: 4416667 - DNA, 16 bp, Homo sapiens
gatttggcatgggaca

SEQ ID NO: 4416668 - DNA, 20 bp, Homo sapiens
gatttggcatgggacagacg

SEQ ID NO: 4416669 - DNA, 20 bp, Homo sapiens
gatttggggctcagagtggg

SEQ ID NO: 4416670 - DNA, 13 bp, Homo sapiens
gatttggggtgga

SEQ ID NO: 4416671 - DNA, 14 bp, Homo sapiens
gatttgtgaactgg

SEQ ID NO: 4416672 - DNA, 21 bp, Homo sapiens
gatttgtgcaaacatggagaa

SEQ ID NO: 4416673 - DNA, 22 bp, Homo sapiens
gattttaatagggaatatatct

SEQ ID NO: 4416674 - DNA, 20 bp, Homo sapiens
gattttaatggattgttaat

SEQ ID NO: 4416675 - DNA, 12 bp, Homo sapiens
gattttaccaaa

SEQ ID NO: 4416676 - DNA, 18 bp, Homo sapiens
gattttccattaactatt

SEQ ID NO: 4416677 - DNA, 17 bp, Homo sapiens
gattttgaggtaaagat

SEQ ID NO: 4416678 - DNA, 11 bp, Homo sapiens
gattttgcaca

SEQ ID NO: 4416679 - DNA, 14 bp, Homo sapiens
gattttgtaaatgt

SEQ ID NO: 4416680 - DNA, 15 bp, Homo sapiens
gatttttatgtctgg

SEQ ID NO: 4416681 - DNA, 14 bp, Homo sapiens
gatttttcttattt

SEQ ID NO: 4416682 - DNA, 21 bp, Homo sapiens
gatttttcttcaggtaacact

SEQ ID NO: 4416683 - DNA, 13 bp, Homo sapiens
gatttttgcctct

SEQ ID NO: 4416684 - DNA, 14 bp, Homo sapiens
gattttttaaaatt

SEQ ID NO: 4416685 - DNA, 17 bp, Homo sapiens
gattttttatgtacaac

SEQ ID NO: 4416686 - DNA, 23 bp, Homo sapiens
gattttttatgtacaaccctgac

SEQ ID NO: 4416687 - DNA, 21 bp, Homo sapiens
gattttttcagacttgtcaag

SEQ ID NO: 4416688 - DNA, 12 bp, Homo sapiens
gattttttccaa

SEQ ID NO: 4416689 - DNA, 21 bp, Homo sapiens
gattttttccttcaaagttta

SEQ ID NO: 4416690 - DNA, 21 bp, Homo sapiens
gatttttttcccaattgagaa

SEQ ID NO: 4416691 - DNA, 16 bp, Homo sapiens
gatttttttgtaaggg

SEQ ID NO: 4416692 - DNA, 21 bp, Homo sapiens
gattttttttttaagtgacat

SEQ ID NO: 4416693 - DNA, 21 bp, Homo sapiens
gatttttttttttttttcctt

SEQ ID NO: 4416694 - DNA, 12 bp, Homo sapiens
gcaaaaaaatta

SEQ ID NO: 4416695 - DNA, 15 bp, Homo sapiens
gcaaaaaagaaaacc

SEQ ID NO: 4416696 - DNA, 18 bp, Homo sapiens
gcaaaaaatactttttct

SEQ ID NO: 4416697 - DNA, 15 bp, Homo sapiens
gcaaaaacaaaaaga

SEQ ID NO: 4416698 - DNA, 20 bp, Homo sapiens
gcaaaaacaaaaagaaaaga

SEQ ID NO: 4416699 - DNA, 12 bp, Homo sapiens
gcaaaaccagaa

SEQ ID NO: 4416700 - DNA, 17 bp, Homo sapiens
gcaaaactcaggcagaa

SEQ ID NO: 4416701 - DNA, 11 bp, Homo sapiens
gcaaaagaaga

SEQ ID NO: 4416702 - DNA, 20 bp, Homo sapiens
gcaaaagcaagggaccttca

SEQ ID NO: 4416703 - DNA, 11 bp, Homo sapiens
gcaaaaggaaa

SEQ ID NO: 4416704 - DNA, 21 bp, Homo sapiens
gcaaaaggagagactcccatg

SEQ ID NO: 4416705 - DNA, 15 bp, Homo sapiens
gcaaaaggctgagaa

SEQ ID NO: 4416706 - DNA, 19 bp, Homo sapiens
gcaaaagtaatcacttaaa

SEQ ID NO: 4416707 - DNA, 19 bp, Homo sapiens
gcaaaatacacgtttatct

SEQ ID NO: 4416708 - DNA, 18 bp, Homo sapiens
gcaaaatctaaaatgttt

SEQ ID NO: 4416709 - DNA, 15 bp, Homo sapiens
gcaaaatgtagaaat

SEQ ID NO: 4416710 - DNA, 13 bp, Homo sapiens
gcaaaattgcaaa

SEQ ID NO: 4416711 - DNA, 17 bp, Homo sapiens
gcaaaattgcaaatctt

SEQ ID NO: 4416712 - DNA, 14 bp, Homo sapiens
gcaaacagaaaaag

SEQ ID NO: 4416713 - DNA, 21 bp, Homo sapiens
gcaaacaggatcagttaacta

SEQ ID NO: 4416714 - DNA, 17 bp, Homo sapiens
gcaaacagggcctctgc

SEQ ID NO: 4416715 - DNA, 13 bp, Homo sapiens
gcaaacatggaga

SEQ ID NO: 4416716 - DNA, 19 bp, Homo sapiens
gcaaacatggagaaatcta

SEQ ID NO: 4416717 - DNA, 19 bp, Homo sapiens
gcaaacccatcaacaaaaa

SEQ ID NO: 4416718 - DNA, 21 bp, Homo sapiens
gcaaacctgacccctgctcag

SEQ ID NO: 4416719 - DNA, 22 bp, Homo sapiens
gcaaacctgcagtttttaattt

SEQ ID NO: 4416720 - DNA, 13 bp, Homo sapiens
gcaaaccttcctg

SEQ ID NO: 4416721 - DNA, 14 bp, Homo sapiens
gcaaactatgattt

SEQ ID NO: 4416722 - DNA, 22 bp, Homo sapiens
gcaaacttacaggtcctgctga

SEQ ID NO: 4416723 - DNA, 23 bp, Homo sapiens
gcaaagaaaaaaaaaaaagccag

SEQ ID NO: 4416724 - DNA, 17 bp, Homo sapiens
gcaaagagacatttcaa

SEQ ID NO: 4416725 - DNA, 19 bp, Homo sapiens
gcaaaggacccttgagtaa

SEQ ID NO: 4416726 - DNA, 16 bp, Homo sapiens
gcaaaggagaaatctg

SEQ ID NO: 4416727 - DNA, 18 bp, Homo sapiens
gcaaaggagaaatctggc

SEQ ID NO: 4416728 - DNA, 16 bp, Homo sapiens
gcaaagggaaatcaag

SEQ ID NO: 4416729 - DNA, 16 bp, Homo sapiens
gcaaagtacaatgtgt

SEQ ID NO: 4416730 - DNA, 13 bp, Homo sapiens
gcaaagtactgta

SEQ ID NO: 4416731 - DNA, 22 bp, Homo sapiens
gcaaagtactgtaagaataatt

SEQ ID NO: 4416732 - DNA, 13 bp, Homo sapiens
gcaaagtagtact

SEQ ID NO: 4416733 - DNA, 19 bp, Homo sapiens
gcaaagtgcccatggtggc

SEQ ID NO: 4416734 - DNA, 18 bp, Homo sapiens
gcaaagtgttttgtacca

SEQ ID NO: 4416735 - DNA, 15 bp, Homo sapiens
gcaaagtttaaatgt

SEQ ID NO: 4416736 - DNA, 20 bp, Homo sapiens
gcaaagttttacagagagga

SEQ ID NO: 4416737 - DNA, 18 bp, Homo sapiens
gcaaatacttagcaaaaa

SEQ ID NO: 4416738 - DNA, 22 bp, Homo sapiens
gcaaatacttagcaaaaagtgg

SEQ ID NO: 4416739 - DNA, 17 bp, Homo sapiens
gcaaatagaaaacagga

SEQ ID NO: 4416740 - DNA, 13 bp, Homo sapiens
gcaaatatatgat

SEQ ID NO: 4416741 - DNA, 15 bp, Homo sapiens
gcaaatcagaaactt

SEQ ID NO: 4416742 - DNA, 19 bp, Homo sapiens
gcaaatcagtatattttct

SEQ ID NO: 4416743 - DNA, 20 bp, Homo sapiens
gcaaatcagtatattttctg

SEQ ID NO: 4416744 - DNA, 18 bp, Homo sapiens
gcaaatcatttgtttaaa

SEQ ID NO: 4416745 - DNA, 22 bp, Homo sapiens
gcaaatcgaatgaaattaactg

SEQ ID NO: 4416746 - DNA, 16 bp, Homo sapiens
gcaaatgacagatttc

SEQ ID NO: 4416747 - DNA, 12 bp, Homo sapiens
gcaaatgggagc

SEQ ID NO: 4416748 - DNA, 21 bp, Homo sapiens
gcaaatgggagctgagcagcc

SEQ ID NO: 4416749 - DNA, 13 bp, Homo sapiens
gcaaatgtttact

SEQ ID NO: 4416750 - DNA, 16 bp, Homo sapiens
gcaaattcttttgaat

SEQ ID NO: 4416751 - DNA, 13 bp, Homo sapiens
gcaaatttagttt

SEQ ID NO: 4416752 - DNA, 14 bp, Homo sapiens
gcaaattttaactg

SEQ ID NO: 4416753 - DNA, 17 bp, Homo sapiens
gcaacaaagattgagaa

SEQ ID NO: 4416754 - DNA, 21 bp, Homo sapiens
gcaacaacaattggtaaaact

SEQ ID NO: 4416755 - DNA, 15 bp, Homo sapiens
gcaacaagctcatcc

SEQ ID NO: 4416756 - DNA, 14 bp, Homo sapiens
gcaacagagcactt

SEQ ID NO: 4416757 - DNA, 15 bp, Homo sapiens
gcaacagatcagtaa

SEQ ID NO: 4416758 - DNA, 21 bp, Homo sapiens
gcaacaggggcacaagcccag

SEQ ID NO: 4416759 - DNA, 14 bp, Homo sapiens
gcaacattcattgc

SEQ ID NO: 4416760 - DNA, 18 bp, Homo sapiens
gcaacattggacagaaaa

SEQ ID NO: 4416761 - DNA, 15 bp, Homo sapiens
gcaacatttgacaaa

SEQ ID NO: 4416762 - DNA, 14 bp, Homo sapiens
gcaaccagcaaatt

SEQ ID NO: 4416763 - DNA, 11 bp, Homo sapiens
gcaaccaggaa

SEQ ID NO: 4416764 - DNA, 20 bp, Homo sapiens
gcaaccaggaacagcaaatg

SEQ ID NO: 4416765 - DNA, 20 bp, Homo sapiens
gcaacccttcctgctgctgc

SEQ ID NO: 4416766 - DNA, 23 bp, Homo sapiens
gcaacctctgcctcccaggttcc

SEQ ID NO: 4416767 - DNA, 22 bp, Homo sapiens
gcaacgggattgaagggtcctg

SEQ ID NO: 4416768 - DNA, 16 bp, Homo sapiens
gcaactccatcctcct

SEQ ID NO: 4416769 - DNA, 18 bp, Homo sapiens
gcaactgaaaatgaatgc

SEQ ID NO: 4416770 - DNA, 21 bp, Homo sapiens
gcaactgttagctgggaagaa

SEQ ID NO: 4416771 - DNA, 18 bp, Homo sapiens
gcaacttccgctgagggg

SEQ ID NO: 4416772 - DNA, 14 bp, Homo sapiens
gcaagaaggaaaga

SEQ ID NO: 4416773 - DNA, 15 bp, Homo sapiens
gcaagaaggaaagat

SEQ ID NO: 4416774 - DNA, 21 bp, Homo sapiens
gcaagaatggtggcttctttt

SEQ ID NO: 4416775 - DNA, 13 bp, Homo sapiens
gcaagagccttgg

SEQ ID NO: 4416776 - DNA, 22 bp, Homo sapiens
gcaagagccttggtgtccacct

SEQ ID NO: 4416777 - DNA, 22 bp, Homo sapiens
gcaagagggggtggaggggtgt

SEQ ID NO: 4416778 - DNA, 23 bp, Homo sapiens
gcaagagggggtggaggggtgtg

SEQ ID NO: 4416779 - DNA, 13 bp, Homo sapiens
gcaagatgagctg

SEQ ID NO: 4416780 - DNA, 15 bp, Homo sapiens
gcaagatgtgaatta

SEQ ID NO: 4416781 - DNA, 17 bp, Homo sapiens
gcaagatgtgaattatt

SEQ ID NO: 4416782 - DNA, 16 bp, Homo sapiens
gcaagatgtgggcagt

SEQ ID NO: 4416783 - DNA, 14 bp, Homo sapiens
gcaagatgtttctt

SEQ ID NO: 4416784 - DNA, 18 bp, Homo sapiens
gcaagatgtttcttgcct

SEQ ID NO: 4416785 - DNA, 15 bp, Homo sapiens
gcaagcacagccctt

SEQ ID NO: 4416786 - DNA, 11 bp, Homo sapiens
gcaagcagctt

SEQ ID NO: 4416787 - DNA, 22 bp, Homo sapiens
gcaagcatgaataaaattaggt

SEQ ID NO: 4416788 - DNA, 18 bp, Homo sapiens
gcaagcattcagaagaaa

SEQ ID NO: 4416789 - DNA, 13 bp, Homo sapiens
gcaagccacagga

SEQ ID NO: 4416790 - DNA, 11 bp, Homo sapiens
gcaagccagac

SEQ ID NO: 4416791 - DNA, 13 bp, Homo sapiens
gcaagccctgccc

SEQ ID NO: 4416792 - DNA, 15 bp, Homo sapiens
gcaagccctgcccac

SEQ ID NO: 4416793 - DNA, 20 bp, Homo sapiens
gcaagccctgcccacagaaa

SEQ ID NO: 4416794 - DNA, 19 bp, Homo sapiens
gcaagcctaagggatcctg

SEQ ID NO: 4416795 - DNA, 20 bp, Homo sapiens
gcaagcctctagtgtaccaa

SEQ ID NO: 4416796 - DNA, 22 bp, Homo sapiens
gcaagccttctaaatgagtcac

SEQ ID NO: 4416797 - DNA, 17 bp, Homo sapiens
gcaagcgagcacagtat

SEQ ID NO: 4416798 - DNA, 13 bp, Homo sapiens
gcaagcgggagcc

SEQ ID NO: 4416799 - DNA, 15 bp, Homo sapiens
gcaagctaaccttat

SEQ ID NO: 4416800 - DNA, 20 bp, Homo sapiens
gcaagctccgcctcccgggt

SEQ ID NO: 4416801 - DNA, 17 bp, Homo sapiens
gcaagctgaaattttag

SEQ ID NO: 4416802 - DNA, 14 bp, Homo sapiens
gcaagctgcccagc

SEQ ID NO: 4416803 - DNA, 17 bp, Homo sapiens
gcaagctgcccagccct

SEQ ID NO: 4416804 - DNA, 23 bp, Homo sapiens
gcaagctgcccagccctggccca

SEQ ID NO: 4416805 - DNA, 17 bp, Homo sapiens
gcaaggaaaaagaaaat

SEQ ID NO: 4416806 - DNA, 15 bp, Homo sapiens
gcaaggaccaggact

SEQ ID NO: 4416807 - DNA, 20 bp, Homo sapiens
gcaaggaccaggactccctc

SEQ ID NO: 4416808 - DNA, 22 bp, Homo sapiens
gcaaggagtttattacaatgta

SEQ ID NO: 4416809 - DNA, 23 bp, Homo sapiens
gcaaggagtttattacaatgtat

SEQ ID NO: 4416810 - DNA, 19 bp, Homo sapiens
gcaaggatatcagagctgg

SEQ ID NO: 4416811 - DNA, 21 bp, Homo sapiens
gcaaggattacacatttcact

SEQ ID NO: 4416812 - DNA, 21 bp, Homo sapiens
gcaaggccgctgttcacccac

SEQ ID NO: 4416813 - DNA, 13 bp, Homo sapiens
gcaagggaccttc

SEQ ID NO: 4416814 - DNA, 21 bp, Homo sapiens
gcaaggggctgcatgacctac

SEQ ID NO: 4416815 - DNA, 14 bp, Homo sapiens
gcaagggtgatggg

SEQ ID NO: 4416816 - DNA, 19 bp, Homo sapiens
gcaaggtcctcttgaaatg

SEQ ID NO: 4416817 - DNA, 19 bp, Homo sapiens
gcaaggtgtgctctgagcc

SEQ ID NO: 4416818 - DNA, 18 bp, Homo sapiens
gcaagtaagaatggccaa

SEQ ID NO: 4416819 - DNA, 14 bp, Homo sapiens
gcaagtatatttat

SEQ ID NO: 4416820 - DNA, 22 bp, Homo sapiens
gcaagtgtggggggtccttctc

SEQ ID NO: 4416821 - DNA, 23 bp, Homo sapiens
gcaagttttaaacccaaaatata

SEQ ID NO: 4416822 - DNA, 18 bp, Homo sapiens
gcaataaaattatttgca

SEQ ID NO: 4416823 - DNA, 12 bp, Homo sapiens
gcaataaatgaa

SEQ ID NO: 4416824 - DNA, 21 bp, Homo sapiens
gcaataacgtttaagccaaaa

SEQ ID NO: 4416825 - DNA, 12 bp, Homo sapiens
gcaataactatt

SEQ ID NO: 4416826 - DNA, 14 bp, Homo sapiens
gcaataatgcagta

SEQ ID NO: 4416827 - DNA, 19 bp, Homo sapiens
gcaataatgcagtatggta

SEQ ID NO: 4416828 - DNA, 14 bp, Homo sapiens
gcaatacagggagg

SEQ ID NO: 4416829 - DNA, 21 bp, Homo sapiens
gcaatagttttttacttctct

SEQ ID NO: 4416830 - DNA, 22 bp, Homo sapiens
gcaatattgtatatttttatct

SEQ ID NO: 4416831 - DNA, 15 bp, Homo sapiens
gcaatattttgtata

SEQ ID NO: 4416832 - DNA, 16 bp, Homo sapiens
gcaatcattttatgct

SEQ ID NO: 4416833 - DNA, 20 bp, Homo sapiens
gcaatcattttatgctgttt

SEQ ID NO: 4416834 - DNA, 14 bp, Homo sapiens
gcaatcctcctgcc

SEQ ID NO: 4416835 - DNA, 15 bp, Homo sapiens
gcaatcctcctgcct

SEQ ID NO: 4416836 - DNA, 15 bp, Homo sapiens
gcaatcgttctgctg

SEQ ID NO: 4416837 - DNA, 15 bp, Homo sapiens
gcaatgaaaatttta

SEQ ID NO: 4416838 - DNA, 17 bp, Homo sapiens
gcaatgaaaattttaag

SEQ ID NO: 4416839 - DNA, 14 bp, Homo sapiens
gcaatgaacactta

SEQ ID NO: 4416840 - DNA, 22 bp, Homo sapiens
gcaatgataatgagcagatgag

SEQ ID NO: 4416841 - DNA, 17 bp, Homo sapiens
gcaatgatgaatgagaa

SEQ ID NO: 4416842 - DNA, 15 bp, Homo sapiens
gcaatgccatcatct

SEQ ID NO: 4416843 - DNA, 18 bp, Homo sapiens
gcaatgcgtgttgtacat

SEQ ID NO: 4416844 - DNA, 15 bp, Homo sapiens
gcaatgggtaaggga

SEQ ID NO: 4416845 - DNA, 22 bp, Homo sapiens
gcaatgggtaagggagggaagg

SEQ ID NO: 4416846 - DNA, 13 bp, Homo sapiens
gcaatgtaaatat

SEQ ID NO: 4416847 - DNA, 18 bp, Homo sapiens
gcaattagtctgaaactg

SEQ ID NO: 4416848 - DNA, 22 bp, Homo sapiens
gcaattagtctgaaactggctt

SEQ ID NO: 4416849 - DNA, 14 bp, Homo sapiens
gcaattatattgtc

SEQ ID NO: 4416850 - DNA, 18 bp, Homo sapiens
gcaattccaagaaaatat

SEQ ID NO: 4416851 - DNA, 19 bp, Homo sapiens
gcaattccaagaaaatatc

SEQ ID NO: 4416852 - DNA, 11 bp, Homo sapiens
gcaattccaat

SEQ ID NO: 4416853 - DNA, 15 bp, Homo sapiens
gcaattgaaatgcat

SEQ ID NO: 4416854 - DNA, 14 bp, Homo sapiens
gcaattgctcccat

SEQ ID NO: 4416855 - DNA, 20 bp, Homo sapiens
gcaatttcctggccctccac

SEQ ID NO: 4416856 - DNA, 14 bp, Homo sapiens
gcaatttgtaaata

SEQ ID NO: 4416857 - DNA, 11 bp, Homo sapiens
gcaattttact

SEQ ID NO: 4416858 - DNA, 16 bp, Homo sapiens
gcaattttactgtgaa

SEQ ID NO: 4416859 - DNA, 18 bp, Homo sapiens
gcaattttactgtgaaaa

SEQ ID NO: 4416860 - DNA, 19 bp, Homo sapiens
gcaattttagtgtattaat

SEQ ID NO: 4416861 - DNA, 16 bp, Homo sapiens
gcacaaagttctcaga

SEQ ID NO: 4416862 - DNA, 18 bp, Homo sapiens
gcacaaagttctcagagc

SEQ ID NO: 4416863 - DNA, 20 bp, Homo sapiens
gcacaaagttctcagagctc

SEQ ID NO: 4416864 - DNA, 11 bp, Homo sapiens
gcacaagccca

SEQ ID NO: 4416865 - DNA, 14 bp, Homo sapiens
gcacaagttccctg

SEQ ID NO: 4416866 - DNA, 14 bp, Homo sapiens
gcacaatatttctt

SEQ ID NO: 4416867 - DNA, 15 bp, Homo sapiens
gcacaatatttcttt

SEQ ID NO: 4416868 - DNA, 12 bp, Homo sapiens
gcacacaaaaat

SEQ ID NO: 4416869 - DNA, 15 bp, Homo sapiens
gcacacacagcccct

SEQ ID NO: 4416870 - DNA, 13 bp, Homo sapiens
gcacacacatgca

SEQ ID NO: 4416871 - DNA, 11 bp, Homo sapiens
gcacacaccca

SEQ ID NO: 4416872 - DNA, 22 bp, Homo sapiens
gcacacagagtgagggaggagg

SEQ ID NO: 4416873 - DNA, 16 bp, Homo sapiens
gcacacagcagccccc

SEQ ID NO: 4416874 - DNA, 17 bp, Homo sapiens
gcacacagcagcccccc

SEQ ID NO: 4416875 - DNA, 21 bp, Homo sapiens
gcacacagcagccccccagca

SEQ ID NO: 4416876 - DNA, 18 bp, Homo sapiens
gcacacagctactctccc

SEQ ID NO: 4416877 - DNA, 23 bp, Homo sapiens
gatatattttacaattttttatc

SEQ ID NO: 4416878 - DNA, 14 bp, Homo sapiens
gatatcctctcccc

SEQ ID NO: 4416879 - DNA, 20 bp, Homo sapiens
gatatcctctccccctcctc

SEQ ID NO: 4416880 - DNA, 17 bp, Homo sapiens
gatatgaatatatggca

SEQ ID NO: 4416881 - DNA, 18 bp, Homo sapiens
gatgacaggctctcctgg

SEQ ID NO: 4416882 - DNA, 14 bp, Homo sapiens
gatgaccagggatg

SEQ ID NO: 4416883 - DNA, 18 bp, Homo sapiens
gatgaccagggatgctgg

SEQ ID NO: 4416884 - DNA, 23 bp, Homo sapiens
gatgaccagggatgctgggctgg

SEQ ID NO: 4416885 - DNA, 16 bp, Homo sapiens
gatgaccatactcaga

SEQ ID NO: 4416886 - DNA, 17 bp, Homo sapiens
gatgacgggatgctctt

SEQ ID NO: 4416887 - DNA, 21 bp, Homo sapiens
gatgacgggatgctctttaaa

SEQ ID NO: 4416888 - DNA, 22 bp, Homo sapiens
gatgacttagcgtcaagacatt

SEQ ID NO: 4416889 - DNA, 16 bp, Homo sapiens
gatgacttgagatgaa

SEQ ID NO: 4416890 - DNA, 13 bp, Homo sapiens
gatgagaaagctt

SEQ ID NO: 4416891 - DNA, 23 bp, Homo sapiens
gatgagaaagcttttattccttt

SEQ ID NO: 4416892 - DNA, 18 bp, Homo sapiens
gatgagcaaccacattta

SEQ ID NO: 4416893 - DNA, 12 bp, Homo sapiens
gatgagcccacc

SEQ ID NO: 4416894 - DNA, 15 bp, Homo sapiens
gatgagcccaccctg

SEQ ID NO: 4416895 - DNA, 20 bp, Homo sapiens
gatgaggacagagggcacat

SEQ ID NO: 4416896 - DNA, 23 bp, Homo sapiens
gatgaggggcttcctgggtcctg

SEQ ID NO: 4416897 - DNA, 14 bp, Homo sapiens
gatgagttaactgt

SEQ ID NO: 4416898 - DNA, 19 bp, Homo sapiens
gatgataaagagacagtga

SEQ ID NO: 4416899 - DNA, 13 bp, Homo sapiens
gatgatctctcca

SEQ ID NO: 4416900 - DNA, 16 bp, Homo sapiens
gatgatgaaaactaag

SEQ ID NO: 4416901 - DNA, 15 bp, Homo sapiens
gatgatgccagctgt

SEQ ID NO: 4416902 - DNA, 14 bp, Homo sapiens
gatgattaaatttt

SEQ ID NO: 4416903 - DNA, 14 bp, Homo sapiens
gatgatttccaagc

SEQ ID NO: 4416904 - DNA, 18 bp, Homo sapiens
gatgcaacctcactatgg

SEQ ID NO: 4416905 - DNA, 19 bp, Homo sapiens
gatgcaaggaccaggactc

SEQ ID NO: 4416906 - DNA, 23 bp, Homo sapiens
gatgcacgtggggcccactgctc

SEQ ID NO: 4416907 - DNA, 15 bp, Homo sapiens
gatgcacttcaaatt

SEQ ID NO: 4416908 - DNA, 22 bp, Homo sapiens
gatgcacttcaaattcaaataa

SEQ ID NO: 4416909 - DNA, 13 bp, Homo sapiens
gatgcagcatttg

SEQ ID NO: 4416910 - DNA, 15 bp, Homo sapiens
gatgcagctactgga

SEQ ID NO: 4416911 - DNA, 21 bp, Homo sapiens
gatgcaggcacttattgtaaa

SEQ ID NO: 4416912 - DNA, 13 bp, Homo sapiens
gatgcagtctcct

SEQ ID NO: 4416913 - DNA, 17 bp, Homo sapiens
gatgcagtctcctcttt

SEQ ID NO: 4416914 - DNA, 19 bp, Homo sapiens
gatgcagtctcctctttaa

SEQ ID NO: 4416915 - DNA, 20 bp, Homo sapiens
gatgcatcacactcaaggac

SEQ ID NO: 4416916 - DNA, 22 bp, Homo sapiens
gatgcatcacactcaaggacag

SEQ ID NO: 4416917 - DNA, 23 bp, Homo sapiens
gatgcatcacactcaaggacagg

SEQ ID NO: 4416918 - DNA, 18 bp, Homo sapiens
gatgcatcgggaaagaag

SEQ ID NO: 4416919 - DNA, 23 bp, Homo sapiens
gatgcatcgggaaagaagaaact

SEQ ID NO: 4416920 - DNA, 15 bp, Homo sapiens
gatgccagctgtctc

SEQ ID NO: 4416921 - DNA, 17 bp, Homo sapiens
gatgccagctgtctccc

SEQ ID NO: 4416922 - DNA, 20 bp, Homo sapiens
gatgcccattcctgcctggt

SEQ ID NO: 4416923 - DNA, 13 bp, Homo sapiens
gatgcctccaccg

SEQ ID NO: 4416924 - DNA, 17 bp, Homo sapiens
gatgcctccaccgctgc

SEQ ID NO: 4416925 - DNA, 20 bp, Homo sapiens
gatgcctccaccgctgccta

SEQ ID NO: 4416926 - DNA, 14 bp, Homo sapiens
gatgcctgttaatt

SEQ ID NO: 4416927 - DNA, 20 bp, Homo sapiens
gatgctagaaaaatgttctt

SEQ ID NO: 4416928 - DNA, 20 bp, Homo sapiens
gatgctcaaaatctttccaa

SEQ ID NO: 4416929 - DNA, 13 bp, Homo sapiens
gatgctccctccc

SEQ ID NO: 4416930 - DNA, 19 bp, Homo sapiens
gatgctctttaaataataa

SEQ ID NO: 4416931 - DNA, 23 bp, Homo sapiens
gatgctgccagggcgccatcgcc

SEQ ID NO: 4416932 - DNA, 13 bp, Homo sapiens
gatgctgggctgg

SEQ ID NO: 4416933 - DNA, 21 bp, Homo sapiens
gatgctggtggaggaagggct

SEQ ID NO: 4416934 - DNA, 16 bp, Homo sapiens
gatgcttctctccttg

SEQ ID NO: 4416935 - DNA, 16 bp, Homo sapiens
gatggaaactgccaaa

SEQ ID NO: 4416936 - DNA, 20 bp, Homo sapiens
gatggaaatacagttatttc

SEQ ID NO: 4416937 - DNA, 17 bp, Homo sapiens
gatggaactgtgtattt

SEQ ID NO: 4416938 - DNA, 15 bp, Homo sapiens
gatggacacgagcca

SEQ ID NO: 4416939 - DNA, 18 bp, Homo sapiens
gatggacacgagccacaa

SEQ ID NO: 4416940 - DNA, 18 bp, Homo sapiens
gatggaccaacctgctct

SEQ ID NO: 4416941 - DNA, 19 bp, Homo sapiens
gatggaccaacctgctctg

SEQ ID NO: 4416942 - DNA, 19 bp, Homo sapiens
gatggacctcagcaagctg

SEQ ID NO: 4416943 - DNA, 13 bp, Homo sapiens
gatggaggagaag

SEQ ID NO: 4416944 - DNA, 18 bp, Homo sapiens
gatggagggggctggggt

SEQ ID NO: 4416945 - DNA, 19 bp, Homo sapiens
gatggagggggctggggtc

SEQ ID NO: 4416946 - DNA, 14 bp, Homo sapiens
gatggatcaccatt

SEQ ID NO: 4416947 - DNA, 20 bp, Homo sapiens
gatggcaaagaaggagagca

SEQ ID NO: 4416948 - DNA, 22 bp, Homo sapiens
gatggccagcccctggggccca

SEQ ID NO: 4416949 - DNA, 14 bp, Homo sapiens
gatggcccctccac

SEQ ID NO: 4416950 - DNA, 16 bp, Homo sapiens
gatggcccctccactg

SEQ ID NO: 4416951 - DNA, 17 bp, Homo sapiens
gatggccggctggttgt

SEQ ID NO: 4416952 - DNA, 17 bp, Homo sapiens
gatggccttaatttcct

SEQ ID NO: 4416953 - DNA, 18 bp, Homo sapiens
gatggccttaatttcctt

SEQ ID NO: 4416954 - DNA, 14 bp, Homo sapiens
gatggcctttcctt

SEQ ID NO: 4416955 - DNA, 17 bp, Homo sapiens
gatggcctttccttccc

SEQ ID NO: 4416956 - DNA, 19 bp, Homo sapiens
gatggcctttggacccagg

SEQ ID NO: 4416957 - DNA, 21 bp, Homo sapiens
gatggctagtatcaaaagaaa

SEQ ID NO: 4416958 - DNA, 22 bp, Homo sapiens
gatggcttccgtgagacacaag

SEQ ID NO: 4416959 - DNA, 16 bp, Homo sapiens
gatgggaaagcattgt

SEQ ID NO: 4416960 - DNA, 23 bp, Homo sapiens
gatgggaatgaggtgggaggtgg

SEQ ID NO: 4416961 - DNA, 22 bp, Homo sapiens
gatgggagctcctctcctggag

SEQ ID NO: 4416962 - DNA, 13 bp, Homo sapiens
gatgggaggtgga

SEQ ID NO: 4416963 - DNA, 15 bp, Homo sapiens
gatgggaggtggaag

SEQ ID NO: 4416964 - DNA, 19 bp, Homo sapiens
gatgggatggtggagggcc

SEQ ID NO: 4416965 - DNA, 20 bp, Homo sapiens
gatgggatggtggagggcca

SEQ ID NO: 4416966 - DNA, 22 bp, Homo sapiens
gatgggcaaaccctggtgcttt

SEQ ID NO: 4416967 - DNA, 18 bp, Homo sapiens
gatggggcggcggtagca

SEQ ID NO: 4416968 - DNA, 17 bp, Homo sapiens
gatgggggatgggccag

SEQ ID NO: 4416969 - DNA, 15 bp, Homo sapiens
gatgggtccaggggt

SEQ ID NO: 4416970 - DNA, 19 bp, Homo sapiens
gatgggtgctggtcctgtt

SEQ ID NO: 4416971 - DNA, 14 bp, Homo sapiens
gatgggttcttagc

SEQ ID NO: 4416972 - DNA, 22 bp, Homo sapiens
gatggtaagagaaaagagagaa

SEQ ID NO: 4416973 - DNA, 22 bp, Homo sapiens
gatggtatctgggtaagaagaa

SEQ ID NO: 4416974 - DNA, 13 bp, Homo sapiens
gatggtctcgatc

SEQ ID NO: 4416975 - DNA, 21 bp, Homo sapiens
gatggtgctgcccaggcctct

SEQ ID NO: 4416976 - DNA, 19 bp, Homo sapiens
gatggtgtcctgaggcctc

SEQ ID NO: 4416977 - DNA, 15 bp, Homo sapiens
gatggtgtgccttcc

SEQ ID NO: 4416978 - DNA, 15 bp, Homo sapiens
gatggttacactgtt

SEQ ID NO: 4416979 - DNA, 14 bp, Homo sapiens
gatggttctgtgac

SEQ ID NO: 4416980 - DNA, 17 bp, Homo sapiens
gatggtttaataggtaa

SEQ ID NO: 4416981 - DNA, 17 bp, Homo sapiens
gatggtttgaaattttt

SEQ ID NO: 4416982 - DNA, 24 bp, Homo sapiens
gatgtaaaatgagtttgtattatt

SEQ ID NO: 4416983 - DNA, 16 bp, Homo sapiens
gatgtacaattaaaaa

SEQ ID NO: 4416984 - DNA, 13 bp, Homo sapiens
gatgtacattaca

SEQ ID NO: 4416985 - DNA, 15 bp, Homo sapiens
gatgtacattacaga

SEQ ID NO: 4416986 - DNA, 16 bp, Homo sapiens
gatgtacattacagat

SEQ ID NO: 4416987 - DNA, 22 bp, Homo sapiens
gatgtactgttgaaaaagataa

SEQ ID NO: 4416988 - DNA, 17 bp, Homo sapiens
gatgtagaggagaaact

SEQ ID NO: 4416989 - DNA, 21 bp, Homo sapiens
gatgtagggtaaggtgccttc

SEQ ID NO: 4416990 - DNA, 13 bp, Homo sapiens
gatgtagtatttt

SEQ ID NO: 4416991 - DNA, 16 bp, Homo sapiens
gatgtattttcatagt

SEQ ID NO: 4416992 - DNA, 21 bp, Homo sapiens
gatgtcaaagtgtaacagata

SEQ ID NO: 4416993 - DNA, 17 bp, Homo sapiens
gatgtcatcaagctcca

SEQ ID NO: 4416994 - DNA, 14 bp, Homo sapiens
gatgtcatgtgttc

SEQ ID NO: 4416995 - DNA, 16 bp, Homo sapiens
gatgtcatgtgttccc

SEQ ID NO: 4416996 - DNA, 14 bp, Homo sapiens
gatgtcatttccac

SEQ ID NO: 4416997 - DNA, 16 bp, Homo sapiens
gatgtcatttgagcag

SEQ ID NO: 4416998 - DNA, 11 bp, Homo sapiens
gatgtcccagt

SEQ ID NO: 4416999 - DNA, 13 bp, Homo sapiens
gaggcagctcagg

SEQ ID NO: 4417000 - DNA, 16 bp, Homo sapiens
gaggcagctcaggata

SEQ ID NO: 4417001 - DNA, 20 bp, Homo sapiens
gaggcaggagaatcacttga

SEQ ID NO: 4417002 - DNA, 17 bp, Homo sapiens
gaggcagggctctcccg

SEQ ID NO: 4417003 - DNA, 18 bp, Homo sapiens
gaggccacttgcttgctg

SEQ ID NO: 4417004 - DNA, 22 bp, Homo sapiens
gaggccagagtcaccttttctg

SEQ ID NO: 4417005 - DNA, 13 bp, Homo sapiens
gaggccagcccca

SEQ ID NO: 4417006 - DNA, 14 bp, Homo sapiens
gaggccagccccac

SEQ ID NO: 4417007 - DNA, 15 bp, Homo sapiens
gaggccagggcagag

SEQ ID NO: 4417008 - DNA, 17 bp, Homo sapiens
gaggccagtacctttcc

SEQ ID NO: 4417009 - DNA, 21 bp, Homo sapiens
gaggcccactgtgtctaggca

SEQ ID NO: 4417010 - DNA, 15 bp, Homo sapiens
gaggcccagccgcag

SEQ ID NO: 4417011 - DNA, 16 bp, Homo sapiens
gaggcccagccgcagg

SEQ ID NO: 4417012 - DNA, 13 bp, Homo sapiens
gaggcccaggctg

SEQ ID NO: 4417013 - DNA, 17 bp, Homo sapiens
gagcagagagcaaagga

SEQ ID NO: 4417014 - DNA, 11 bp, Homo sapiens
gagcagagcct

SEQ ID NO: 4417015 - DNA, 19 bp, Homo sapiens
gagcagaggaggggaaagt

SEQ ID NO: 4417016 - DNA, 19 bp, Homo sapiens
gagcagcaagttcatacaa

SEQ ID NO: 4417017 - DNA, 22 bp, Homo sapiens
gagcagcagcaccaaccacagc

SEQ ID NO: 4417018 - DNA, 21 bp, Homo sapiens
gagcagcaggtagcctgctgg

SEQ ID NO: 4417019 - DNA, 12 bp, Homo sapiens
gagcagccctgg

SEQ ID NO: 4417020 - DNA, 16 bp, Homo sapiens
gagcagccctggcccc

SEQ ID NO: 4417021 - DNA, 23 bp, Homo sapiens
gagcagccctggcccccatcagc

SEQ ID NO: 4417022 - DNA, 15 bp, Homo sapiens
gagcagccgccagct

SEQ ID NO: 4417023 - DNA, 13 bp, Homo sapiens
gagcagcctctgg

SEQ ID NO: 4417024 - DNA, 14 bp, Homo sapiens
gagcagcctctgga

SEQ ID NO: 4417025 - DNA, 24 bp, Homo sapiens
gagcagcctctggacagccagtga

SEQ ID NO: 4417026 - DNA, 15 bp, Homo sapiens
gagcagcctgtggca

SEQ ID NO: 4417027 - DNA, 16 bp, Homo sapiens
gagcagcctgtggcat

SEQ ID NO: 4417028 - DNA, 19 bp, Homo sapiens
gagcaggactccaggccca

SEQ ID NO: 4417029 - DNA, 16 bp, Homo sapiens
gagcaggagcttgggt

SEQ ID NO: 4417030 - DNA, 15 bp, Homo sapiens
gagcaggggcccctg

SEQ ID NO: 4417031 - DNA, 13 bp, Homo sapiens
gagcaggggctcc

SEQ ID NO: 4417032 - DNA, 15 bp, Homo sapiens
gagcaggggctccag

SEQ ID NO: 4417033 - DNA, 15 bp, Homo sapiens
gagcagtcagagtcc

SEQ ID NO: 4417034 - DNA, 20 bp, Homo sapiens
gagcagtcagggtgggaaga

SEQ ID NO: 4417035 - DNA, 19 bp, Homo sapiens
gagctcccccgtggtgcct

SEQ ID NO: 4417036 - DNA, 16 bp, Homo sapiens
gagctcctccctccag

SEQ ID NO: 4417037 - DNA, 19 bp, Homo sapiens
gagctcctccctccagctg

SEQ ID NO: 4417038 - DNA, 17 bp, Homo sapiens
gagctcctctcctggag

SEQ ID NO: 4417039 - DNA, 18 bp, Homo sapiens
gagctcctggggagctcc

SEQ ID NO: 4417040 - DNA, 20 bp, Homo sapiens
gagctcctggggagctcctg

SEQ ID NO: 4417041 - DNA, 17 bp, Homo sapiens
gagctctcaggccgaga

SEQ ID NO: 4417042 - DNA, 19 bp, Homo sapiens
gagctctcgaggaaagtgg

SEQ ID NO: 4417043 - DNA, 19 bp, Homo sapiens
gagctctggttatttttct

SEQ ID NO: 4417044 - DNA, 16 bp, Homo sapiens
gagctcttcaggcctc

SEQ ID NO: 4417045 - DNA, 17 bp, Homo sapiens
gagctcttgggtcagag

SEQ ID NO: 4417046 - DNA, 19 bp, Homo sapiens
gagctcttgggtcagagaa

SEQ ID NO: 4417047 - DNA, 18 bp, Homo sapiens
gagctgaaccacagaaat

SEQ ID NO: 4417048 - DNA, 17 bp, Homo sapiens
gagctgagcagcctctg

SEQ ID NO: 4417049 - DNA, 12 bp, Homo sapiens
gagctgccaaga

SEQ ID NO: 4417050 - DNA, 21 bp, Homo sapiens
gagctgccctccttgtccacc

SEQ ID NO: 4417051 - DNA, 11 bp, Homo sapiens
gagctgccttc

SEQ ID NO: 4417052 - DNA, 13 bp, Homo sapiens
gagctgctgagtg

SEQ ID NO: 4417053 - DNA, 13 bp, Homo sapiens
gagctggagcccc

SEQ ID NO: 4417054 - DNA, 18 bp, Homo sapiens
gagctggagcccccagca

SEQ ID NO: 4417055 - DNA, 15 bp, Homo sapiens
gagctggcctgcggt

SEQ ID NO: 4417056 - DNA, 13 bp, Homo sapiens
gagctgggagaca

SEQ ID NO: 4417057 - DNA, 16 bp, Homo sapiens
gagctgggaggaaaag

SEQ ID NO: 4417058 - DNA, 13 bp, Homo sapiens
gagctgggcccct

SEQ ID NO: 4417059 - DNA, 22 bp, Homo sapiens
gagctgggcccctgcacaggca

SEQ ID NO: 4417060 - DNA, 12 bp, Homo sapiens
gagctgggccct

SEQ ID NO: 4417061 - DNA, 16 bp, Homo sapiens
gagctgggccctgcct

SEQ ID NO: 4417062 - DNA, 18 bp, Homo sapiens
gagctgggccctgcctgc

SEQ ID NO: 4417063 - DNA, 19 bp, Homo sapiens
gagctgggccctgcctgca

SEQ ID NO: 4417064 - DNA, 22 bp, Homo sapiens
gagctgggccctgcctgcagcc

SEQ ID NO: 4417065 - DNA, 23 bp, Homo sapiens
gagctgggccctgcctgcagcca

SEQ ID NO: 4417066 - DNA, 19 bp, Homo sapiens
gagctggggactcagggac

SEQ ID NO: 4417067 - DNA, 19 bp, Homo sapiens
gagctgtcacctctcagct

SEQ ID NO: 4417068 - DNA, 17 bp, Homo sapiens
gagctgtgacccagagg

SEQ ID NO: 4417069 - DNA, 16 bp, Homo sapiens
gagctgttaccattca

SEQ ID NO: 4417070 - DNA, 19 bp, Homo sapiens
gagctgtttatggcctcag

SEQ ID NO: 4417071 - DNA, 22 bp, Homo sapiens
gagctgtttatggcctcagctg

SEQ ID NO: 4417072 - DNA, 17 bp, Homo sapiens
gagctgtttatgttttt

SEQ ID NO: 4417073 - DNA, 20 bp, Homo sapiens
gagcttgggaagtcgaggct

SEQ ID NO: 4417074 - DNA, 22 bp, Homo sapiens
gagcttgggcagtgccccaggg

SEQ ID NO: 4417075 - DNA, 23 bp, Homo sapiens
gagcttgttgtctccacttgtat

SEQ ID NO: 4417076 - DNA, 21 bp, Homo sapiens
gagctttgcatgttccactaa

SEQ ID NO: 4417077 - DNA, 16 bp, Homo sapiens
gagctttgtcacttgc

SEQ ID NO: 4417078 - DNA, 20 bp, Homo sapiens
gagctttgtcacttgccaca

SEQ ID NO: 4417079 - DNA, 20 bp, Homo sapiens
gagcttttgagtgttcccaa

SEQ ID NO: 4417080 - DNA, 18 bp, Homo sapiens
gaggaaactactgccttt

SEQ ID NO: 4417081 - DNA, 22 bp, Homo sapiens
gaggaaaggattttaccaaagc

SEQ ID NO: 4417082 - DNA, 14 bp, Homo sapiens
gaggaaatccggtc

SEQ ID NO: 4417083 - DNA, 16 bp, Homo sapiens
gaggaagagccacctg

SEQ ID NO: 4417084 - DNA, 19 bp, Homo sapiens
gaggaaggaacagcaatgg

SEQ ID NO: 4417085 - DNA, 13 bp, Homo sapiens
gaggaaggcaaga

SEQ ID NO: 4417086 - DNA, 14 bp, Homo sapiens
gaggaagggctggg

SEQ ID NO: 4417087 - DNA, 18 bp, Homo sapiens
gaggaagggctgggccac

SEQ ID NO: 4417088 - DNA, 13 bp, Homo sapiens
gaggaagttcaga

SEQ ID NO: 4417089 - DNA, 14 bp, Homo sapiens
gaggaagttcagat

SEQ ID NO: 4417090 - DNA, 15 bp, Homo sapiens
gaggaatacatttta

SEQ ID NO: 4417091 - DNA, 16 bp, Homo sapiens
gaggaatcacttttaa

SEQ ID NO: 4417092 - DNA, 20 bp, Homo sapiens
gaggaatctgtgggtctggg

SEQ ID NO: 4417093 - DNA, 15 bp, Homo sapiens
gaggacaaaaggaat

SEQ ID NO: 4417094 - DNA, 22 bp, Homo sapiens
gaggacagagggagacagggct

SEQ ID NO: 4417095 - DNA, 22 bp, Homo sapiens
gaggaccagaggagcagaccag

SEQ ID NO: 4417096 - DNA, 13 bp, Homo sapiens
gaggacccagacc

SEQ ID NO: 4417097 - DNA, 12 bp, Homo sapiens
gaggacccagga

SEQ ID NO: 4417098 - DNA, 20 bp, Homo sapiens
gaggacctgtatttaagcaa

SEQ ID NO: 4417099 - DNA, 22 bp, Homo sapiens
gaggacctgtatttaagcaaat

SEQ ID NO: 4417100 - DNA, 23 bp, Homo sapiens
gaggactctttccgactgcccag

SEQ ID NO: 4417101 - DNA, 15 bp, Homo sapiens
gaggactgagactgg

SEQ ID NO: 4417102 - DNA, 14 bp, Homo sapiens
gaggactgagcccc

SEQ ID NO: 4417103 - DNA, 20 bp, Homo sapiens
gaggagaagaattttcagac

SEQ ID NO: 4417104 - DNA, 18 bp, Homo sapiens
gaggagatgaccagggat

SEQ ID NO: 4417105 - DNA, 12 bp, Homo sapiens
gaggagcctctg

SEQ ID NO: 4417106 - DNA, 13 bp, Homo sapiens
gaggagctgctgg

SEQ ID NO: 4417107 - DNA, 14 bp, Homo sapiens
gaggagctggcctg

SEQ ID NO: 4417108 - DNA, 13 bp, Homo sapiens
gaggagctgggcc

SEQ ID NO: 4417109 - DNA, 14 bp, Homo sapiens
gaggagctgggccc

SEQ ID NO: 4417110 - DNA, 16 bp, Homo sapiens
gaggagctgggcccct

SEQ ID NO: 4417111 - DNA, 13 bp, Homo sapiens
gaggaggaaggca

SEQ ID NO: 4417112 - DNA, 13 bp, Homo sapiens
gaggaggcctcca

SEQ ID NO: 4417113 - DNA, 18 bp, Homo sapiens
gaggaggctccagagggc

SEQ ID NO: 4417114 - DNA, 17 bp, Homo sapiens
gaggaggctggtgacag

SEQ ID NO: 4417115 - DNA, 17 bp, Homo sapiens
gaggagggagagggagg

SEQ ID NO: 4417116 - DNA, 15 bp, Homo sapiens
gaggagggagtgctg

SEQ ID NO: 4417117 - DNA, 13 bp, Homo sapiens
gaggagtccagca

SEQ ID NO: 4417118 - DNA, 17 bp, Homo sapiens
gaggatacagaggagat

SEQ ID NO: 4417119 - DNA, 15 bp, Homo sapiens
gaggatacatttaat

SEQ ID NO: 4417120 - DNA, 17 bp, Homo sapiens
gaggatgaacatctttt

SEQ ID NO: 4417121 - DNA, 15 bp, Homo sapiens
gaggatggtgtcctg

SEQ ID NO: 4417122 - DNA, 21 bp, Homo sapiens
gaggatggtgtcctgaggcct

SEQ ID NO: 4417123 - DNA, 16 bp, Homo sapiens
gaggatgttagacttg

SEQ ID NO: 4417124 - DNA, 17 bp, Homo sapiens
gaggatgttagacttgc

SEQ ID NO: 4417125 - DNA, 22 bp, Homo sapiens
gaggatgttagacttgctccct

SEQ ID NO: 4417126 - DNA, 17 bp, Homo sapiens
gaggattctttccccag

SEQ ID NO: 4417127 - DNA, 18 bp, Homo sapiens
gaggattctttccccaga

SEQ ID NO: 4417128 - DNA, 17 bp, Homo sapiens
gaggcaataaataaatg

SEQ ID NO: 4417129 - DNA, 19 bp, Homo sapiens
gaggcaataaataaatgtt

SEQ ID NO: 4417130 - DNA, 13 bp, Homo sapiens
gaggcaccaggaa

SEQ ID NO: 4417131 - DNA, 19 bp, Homo sapiens
gaggcaccagtccagcaaa

SEQ ID NO: 4417132 - DNA, 17 bp, Homo sapiens
gaggcactcagtgagcc

SEQ ID NO: 4417133 - DNA, 21 bp, Homo sapiens
gaggcactcagtgagcctcct

SEQ ID NO: 4417134 - DNA, 13 bp, Homo sapiens
gaggcagcagtgt

SEQ ID NO: 4417135 - DNA, 14 bp, Homo sapiens
gaggcagccacagg

SEQ ID NO: 4417136 - DNA, 12 bp, Homo sapiens
gaggcagcccgc

SEQ ID NO: 4417137 - DNA, 17 bp, Homo sapiens
gaggcagcgccccacca

SEQ ID NO: 4417138 - DNA, 16 bp, Homo sapiens
gaatttggtacacatg

SEQ ID NO: 4417139 - DNA, 17 bp, Homo sapiens
gaatttggtacacatgt

SEQ ID NO: 4417140 - DNA, 18 bp, Homo sapiens
gaatttggtacacatgtg

SEQ ID NO: 4417141 - DNA, 13 bp, Homo sapiens
gaatttgtaagca

SEQ ID NO: 4417142 - DNA, 20 bp, Homo sapiens
gaatttgtaagcaacttgct

SEQ ID NO: 4417143 - DNA, 13 bp, Homo sapiens
gaatttgtatttt

SEQ ID NO: 4417144 - DNA, 14 bp, Homo sapiens
gaatttgtttcatc

SEQ ID NO: 4417145 - DNA, 15 bp, Homo sapiens
gaatttgtttcatct

SEQ ID NO: 4417146 - DNA, 18 bp, Homo sapiens
gaatttgtttcatctatt

SEQ ID NO: 4417147 - DNA, 19 bp, Homo sapiens
gaatttgtttcatctattt

SEQ ID NO: 4417148 - DNA, 20 bp, Homo sapiens
gaatttgtttcatctatttt

SEQ ID NO: 4417149 - DNA, 14 bp, Homo sapiens
gaattttcagaccc

SEQ ID NO: 4417150 - DNA, 22 bp, Homo sapiens
gaattttgcaaagatttaatct

SEQ ID NO: 4417151 - DNA, 17 bp, Homo sapiens
gaatttttaaacaagta

SEQ ID NO: 4417152 - DNA, 21 bp, Homo sapiens
gaatttttgcaataatgcagt

SEQ ID NO: 4417153 - DNA, 17 bp, Homo sapiens
gacaaaaacagcctcac

SEQ ID NO: 4417154 - DNA, 16 bp, Homo sapiens
gacaaaaagtatatta

SEQ ID NO: 4417155 - DNA, 19 bp, Homo sapiens
gacaaaaataatagtttta

SEQ ID NO: 4417156 - DNA, 15 bp, Homo sapiens
gacaaacacaattct

SEQ ID NO: 4417157 - DNA, 14 bp, Homo sapiens
gacaaactgtaaaa

SEQ ID NO: 4417158 - DNA, 19 bp, Homo sapiens
gacaaagaattccaaagca

SEQ ID NO: 4417159 - DNA, 16 bp, Homo sapiens
gacaaagctgctaaat

SEQ ID NO: 4417160 - DNA, 20 bp, Homo sapiens
gacaaagctgctaaatctcc

SEQ ID NO: 4417161 - DNA, 16 bp, Homo sapiens
gacaaaggccacaggc

SEQ ID NO: 4417162 - DNA, 22 bp, Homo sapiens
gacaaataaatgattatattca

SEQ ID NO: 4417163 - DNA, 21 bp, Homo sapiens
gacaaatctaaaatgcaaaga

SEQ ID NO: 4417164 - DNA, 15 bp, Homo sapiens
gacaacaccttcctc

SEQ ID NO: 4417165 - DNA, 20 bp, Homo sapiens
gacaacaccttcctcctgca

SEQ ID NO: 4417166 - DNA, 13 bp, Homo sapiens
gacaacagcacac

SEQ ID NO: 4417167 - DNA, 15 bp, Homo sapiens
gacaacagcacacag

SEQ ID NO: 4417168 - DNA, 20 bp, Homo sapiens
gacaacagttctgagctgta

SEQ ID NO: 4417169 - DNA, 20 bp, Homo sapiens
gacaacatgtttaataaata

SEQ ID NO: 4417170 - DNA, 19 bp, Homo sapiens
gacaaccatatttagcagt

SEQ ID NO: 4417171 - DNA, 15 bp, Homo sapiens
gacaaccattaaagt

SEQ ID NO: 4417172 - DNA, 19 bp, Homo sapiens
gacaaccattaaagtcaga

SEQ ID NO: 4417173 - DNA, 14 bp, Homo sapiens
gacaagacaggcag

SEQ ID NO: 4417174 - DNA, 18 bp, Homo sapiens
gacaagagatctacacat

SEQ ID NO: 4417175 - DNA, 14 bp, Homo sapiens
gacaagagatggga

SEQ ID NO: 4417176 - DNA, 19 bp, Homo sapiens
gacaagagggcaagcctct

SEQ ID NO: 4417177 - DNA, 22 bp, Homo sapiens
gacaagagttggggacagaact

SEQ ID NO: 4417178 - DNA, 13 bp, Homo sapiens
gacaaggtgctaa

SEQ ID NO: 4417179 - DNA, 15 bp, Homo sapiens
gacaataaaatatta

SEQ ID NO: 4417180 - DNA, 15 bp, Homo sapiens
gacaatactgctgcc

SEQ ID NO: 4417181 - DNA, 21 bp, Homo sapiens
gacaatagggctaaatgttta

SEQ ID NO: 4417182 - DNA, 17 bp, Homo sapiens
gacaatcattgttttga

SEQ ID NO: 4417183 - DNA, 19 bp, Homo sapiens
gacaatgaaacaacagaga

SEQ ID NO: 4417184 - DNA, 16 bp, Homo sapiens
gacaatgccaataggt

SEQ ID NO: 4417185 - DNA, 22 bp, Homo sapiens
gaagctgaagatccccaactgc

SEQ ID NO: 4417186 - DNA, 16 bp, Homo sapiens
gaagctgctgaggccc

SEQ ID NO: 4417187 - DNA, 17 bp, Homo sapiens
gaagctgctgaggcccc

SEQ ID NO: 4417188 - DNA, 11 bp, Homo sapiens
gaagctgctgt

SEQ ID NO: 4417189 - DNA, 15 bp, Homo sapiens
gaagctggcctgaga

SEQ ID NO: 4417190 - DNA, 16 bp, Homo sapiens
gaagctgttggtgttc

SEQ ID NO: 4417191 - DNA, 16 bp, Homo sapiens
gaagctgttgtgtgag

SEQ ID NO: 4417192 - DNA, 12 bp, Homo sapiens
gaagcttcagca

SEQ ID NO: 4417193 - DNA, 18 bp, Homo sapiens
gaagcttcagcaggaggc

SEQ ID NO: 4417194 - DNA, 22 bp, Homo sapiens
gaagcttcagcaggaggcaagc

SEQ ID NO: 4417195 - DNA, 22 bp, Homo sapiens
gaagcttccacaaaattagaaa

SEQ ID NO: 4417196 - DNA, 23 bp, Homo sapiens
gaagcttctgtctccagcttccc

SEQ ID NO: 4417197 - DNA, 23 bp, Homo sapiens
gaaggaaagatttgtgaactgga

SEQ ID NO: 4417198 - DNA, 14 bp, Homo sapiens
gaaggaacaaagac

SEQ ID NO: 4417199 - DNA, 13 bp, Homo sapiens
gaaggaagagaag

SEQ ID NO: 4417200 - DNA, 14 bp, Homo sapiens
gaaggaagagaaga

SEQ ID NO: 4417201 - DNA, 19 bp, Homo sapiens
gaaggaaggcctgagcccc

SEQ ID NO: 4417202 - DNA, 21 bp, Homo sapiens
gaaggaaggcctgagcccctt

SEQ ID NO: 4417203 - DNA, 13 bp, Homo sapiens
gaaggacacagtg

SEQ ID NO: 4417204 - DNA, 14 bp, Homo sapiens
gaaggacacagtga

SEQ ID NO: 4417205 - DNA, 13 bp, Homo sapiens
gaaggacatagag

SEQ ID NO: 4417206 - DNA, 16 bp, Homo sapiens
gaaggagaaggaagga

SEQ ID NO: 4417207 - DNA, 13 bp, Homo sapiens
gaaggagagcctg

SEQ ID NO: 4417208 - DNA, 14 bp, Homo sapiens
gaaggagcagaaag

SEQ ID NO: 4417209 - DNA, 19 bp, Homo sapiens
gaaggatcccatgagctcc

SEQ ID NO: 4417210 - DNA, 21 bp, Homo sapiens
gaaggatcccatgagctcctt

SEQ ID NO: 4417211 - DNA, 18 bp, Homo sapiens
gaaggatggcatctccat

SEQ ID NO: 4417212 - DNA, 17 bp, Homo sapiens
gaaggattatggaaaaa

SEQ ID NO: 4417213 - DNA, 16 bp, Homo sapiens
gaaggcaagagggggt

SEQ ID NO: 4417214 - DNA, 15 bp, Homo sapiens
gaaggcacagctaac

SEQ ID NO: 4417215 - DNA, 23 bp, Homo sapiens
gaaggcatttgcagggtcctctt

SEQ ID NO: 4417216 - DNA, 23 bp, Homo sapiens
gaaggcccaactggttcaggctc

SEQ ID NO: 4417217 - DNA, 17 bp, Homo sapiens
gaaggccccagagagac

SEQ ID NO: 4417218 - DNA, 18 bp, Homo sapiens
gaaggccccagagagacc

SEQ ID NO: 4417219 - DNA, 12 bp, Homo sapiens
gaaggcctcttg

SEQ ID NO: 4417220 - DNA, 14 bp, Homo sapiens
gaaggctaaaaagc

SEQ ID NO: 4417221 - DNA, 15 bp, Homo sapiens
gaaggctatggggat

SEQ ID NO: 4417222 - DNA, 17 bp, Homo sapiens
gaaggctctcaccccca

SEQ ID NO: 4417223 - DNA, 19 bp, Homo sapiens
gaaggctggaaggcagcag

SEQ ID NO: 4417224 - DNA, 16 bp, Homo sapiens
gaaggcttctctctgt

SEQ ID NO: 4417225 - DNA, 15 bp, Homo sapiens
gaaggcttgggattt

SEQ ID NO: 4417226 - DNA, 16 bp, Homo sapiens
gaaggcttgggatttg

SEQ ID NO: 4417227 - DNA, 17 bp, Homo sapiens
gaaggcttgggatttgc

SEQ ID NO: 4417228 - DNA, 16 bp, Homo sapiens
gaagggaaagcgggca

SEQ ID NO: 4417229 - DNA, 21 bp, Homo sapiens
gaagggaacccccaaatttaa

SEQ ID NO: 4417230 - DNA, 22 bp, Homo sapiens
gaagggaacccccaaatttaat

SEQ ID NO: 4417231 - DNA, 22 bp, Homo sapiens
gaagggaataaggtacaagaag

SEQ ID NO: 4417232 - DNA, 18 bp, Homo sapiens
gaagggccagtcctgcct

SEQ ID NO: 4417233 - DNA, 22 bp, Homo sapiens
gaagggccagtcctgcctggcc

SEQ ID NO: 4417234 - DNA, 19 bp, Homo sapiens
gaagggctagaacctggag

SEQ ID NO: 4417235 - DNA, 20 bp, Homo sapiens
gaagggctagaacctggagg

SEQ ID NO: 4417236 - DNA, 11 bp, Homo sapiens
gaagggctggg

SEQ ID NO: 4417237 - DNA, 13 bp, Homo sapiens
gaagggctgggcc

SEQ ID NO: 4417238 - DNA, 14 bp, Homo sapiens
gaagggctgggcca

SEQ ID NO: 4417239 - DNA, 23 bp, Homo sapiens
gaaggggcaaattcttttgaatt

SEQ ID NO: 4417240 - DNA, 14 bp, Homo sapiens
gaaggggccagagg

SEQ ID NO: 4417241 - DNA, 19 bp, Homo sapiens
gaagggtggatgtgctgga

SEQ ID NO: 4417242 - DNA, 23 bp, Homo sapiens
gaagggtggatgtgctggagggg

SEQ ID NO: 4417243 - DNA, 15 bp, Homo sapiens
gaagggtgggagtgg

SEQ ID NO: 4417244 - DNA, 15 bp, Homo sapiens
gaagggtttgtggct

SEQ ID NO: 4417245 - DNA, 16 bp, Homo sapiens
gaaggtagaatgtttt

SEQ ID NO: 4417246 - DNA, 17 bp, Homo sapiens
gaaggtattagcaaagc

SEQ ID NO: 4417247 - DNA, 19 bp, Homo sapiens
gaaggtcttttgagggcta

SEQ ID NO: 4417248 - DNA, 16 bp, Homo sapiens
gaaggtgatttattct

SEQ ID NO: 4417249 - DNA, 19 bp, Homo sapiens
gaataatcacgctttcctg

SEQ ID NO: 4417250 - DNA, 21 bp, Homo sapiens
gaataatcacgctttcctgaa

SEQ ID NO: 4417251 - DNA, 15 bp, Homo sapiens
gaataatgaaaataa

SEQ ID NO: 4417252 - DNA, 20 bp, Homo sapiens
gaataatgaaaataaaacac

SEQ ID NO: 4417253 - DNA, 19 bp, Homo sapiens
gaatacacagtattcagag

SEQ ID NO: 4417254 - DNA, 14 bp, Homo sapiens
gaatacattttatt

SEQ ID NO: 4417255 - DNA, 20 bp, Homo sapiens
gaatacgctaataagtgaca

SEQ ID NO: 4417256 - DNA, 18 bp, Homo sapiens
gaatactgtctgtatctt

SEQ ID NO: 4417257 - DNA, 14 bp, Homo sapiens
gaatacttgaactt

SEQ ID NO: 4417258 - DNA, 16 bp, Homo sapiens
gaatacttgaacttgt

SEQ ID NO: 4417259 - DNA, 14 bp, Homo sapiens
gaatacttgaagaa

SEQ ID NO: 4417260 - DNA, 20 bp, Homo sapiens
gaatactttttacaattaaa

SEQ ID NO: 4417261 - DNA, 15 bp, Homo sapiens
gaatagaggaagaaa

SEQ ID NO: 4417262 - DNA, 17 bp, Homo sapiens
gaatagcctagatatga

SEQ ID NO: 4417263 - DNA, 12 bp, Homo sapiens
gaatagcctggc

SEQ ID NO: 4417264 - DNA, 14 bp, Homo sapiens
gaataggaaataaa

SEQ ID NO: 4417265 - DNA, 19 bp, Homo sapiens
gaataggagaaagcttaat

SEQ ID NO: 4417266 - DNA, 14 bp, Homo sapiens
gaataggggagcca

SEQ ID NO: 4417267 - DNA, 18 bp, Homo sapiens
gaatagtcgcgcaagcat

SEQ ID NO: 4417268 - DNA, 14 bp, Homo sapiens
gaatagtttatttc

SEQ ID NO: 4417269 - DNA, 13 bp, Homo sapiens
gaatataaaaaat

SEQ ID NO: 4417270 - DNA, 14 bp, Homo sapiens
gaatataaaacagt

SEQ ID NO: 4417271 - DNA, 21 bp, Homo sapiens
gaatatacatagtctttgttt

SEQ ID NO: 4417272 - DNA, 16 bp, Homo sapiens
gaatataccttattta

SEQ ID NO: 4417273 - DNA, 17 bp, Homo sapiens
gaatatagacagtgccc

SEQ ID NO: 4417274 - DNA, 19 bp, Homo sapiens
gaatatcatctgtcattat

SEQ ID NO: 4417275 - DNA, 20 bp, Homo sapiens
gaatatcatctgtcattata

SEQ ID NO: 4417276 - DNA, 16 bp, Homo sapiens
gaatatccatgaccta

SEQ ID NO: 4417277 - DNA, 14 bp, Homo sapiens
gaatatctttcgat

SEQ ID NO: 4417278 - DNA, 20 bp, Homo sapiens
gaatatgatccctaatgtgt

SEQ ID NO: 4417279 - DNA, 22 bp, Homo sapiens
gaatatgcaaggcggtacacta

SEQ ID NO: 4417280 - DNA, 16 bp, Homo sapiens
gaatatggaggctgga

SEQ ID NO: 4417281 - DNA, 13 bp, Homo sapiens
gaatattaaatat

SEQ ID NO: 4417282 - DNA, 14 bp, Homo sapiens
gaatattaaatatt

SEQ ID NO: 4417283 - DNA, 16 bp, Homo sapiens
gaatattaaatattat

SEQ ID NO: 4417284 - DNA, 12 bp, Homo sapiens
gaatattgagca

SEQ ID NO: 4417285 - DNA, 13 bp, Homo sapiens
gaatatttgcttt

SEQ ID NO: 4417286 - DNA, 16 bp, Homo sapiens
gaatattttatcctgt

SEQ ID NO: 4417287 - DNA, 19 bp, Homo sapiens
gaatatttttatatttcct

SEQ ID NO: 4417288 - DNA, 21 bp, Homo sapiens
gaatatttttatatttccttt

SEQ ID NO: 4417289 - DNA, 18 bp, Homo sapiens
gaatattttttgaaggtt

SEQ ID NO: 4417290 - DNA, 21 bp, Homo sapiens
gaatattttttgaaggtttca

SEQ ID NO: 4417291 - DNA, 17 bp, Homo sapiens
gaatcaaataaaaattc

SEQ ID NO: 4417292 - DNA, 15 bp, Homo sapiens
gaatcaagagctgcc

SEQ ID NO: 4417293 - DNA, 21 bp, Homo sapiens
gaatcaataatatattttctg

SEQ ID NO: 4417294 - DNA, 17 bp, Homo sapiens
gaatcaccaattaaaaa

SEQ ID NO: 4417295 - DNA, 20 bp, Homo sapiens
gaatcaccaattaaaaacct

SEQ ID NO: 4417296 - DNA, 23 bp, Homo sapiens
gaatcacccctctgcccctgcag

SEQ ID NO: 4417297 - DNA, 22 bp, Homo sapiens
gaatcacctgaaccccagaggc

SEQ ID NO: 4417298 - DNA, 21 bp, Homo sapiens
gaatcacgttagaggaaaaat

SEQ ID NO: 4417299 - DNA, 21 bp, Homo sapiens
gaatcacttttaactgtttta

SEQ ID NO: 4417300 - DNA, 22 bp, Homo sapiens
gaatcagaagatagtcttggaa

SEQ ID NO: 4417301 - DNA, 12 bp, Homo sapiens
gaatcagaataa

SEQ ID NO: 4417302 - DNA, 20 bp, Homo sapiens
gaatcagatggtgtcattta

SEQ ID NO: 4417303 - DNA, 22 bp, Homo sapiens
gaatcagatggtgtcatttagt

SEQ ID NO: 4417304 - DNA, 23 bp, Homo sapiens
gaatcattaatttcaaaatttaa

SEQ ID NO: 4417305 - DNA, 20 bp, Homo sapiens
gaatcattgtatgtggtcat

SEQ ID NO: 4417306 - DNA, 17 bp, Homo sapiens
gaatcattgtggtggtt

SEQ ID NO: 4417307 - DNA, 22 bp, Homo sapiens
gaatcatttctatttctcctcc

SEQ ID NO: 4417308 - DNA, 15 bp, Homo sapiens
gaatccaagattggt

SEQ ID NO: 4417309 - DNA, 16 bp, Homo sapiens
gaatccaagcgaggtc

SEQ ID NO: 4417310 - DNA, 17 bp, Homo sapiens
gaatccagtttctttcc

SEQ ID NO: 4417311 - DNA, 19 bp, Homo sapiens
gaatcccaaatttgattga

SEQ ID NO: 4417312 - DNA, 16 bp, Homo sapiens
gaatcccttaacagtt

SEQ ID NO: 4417313 - DNA, 14 bp, Homo sapiens
gaatcggctgggga

SEQ ID NO: 4417314 - DNA, 22 bp, Homo sapiens
gaatctacccccagatccaagc

SEQ ID NO: 4417315 - DNA, 15 bp, Homo sapiens
gaatctctgcccctc

SEQ ID NO: 4417316 - DNA, 18 bp, Homo sapiens
gaatctcttcatgcttga

SEQ ID NO: 4417317 - DNA, 21 bp, Homo sapiens
gaatctcttcatgcttgacat

SEQ ID NO: 4417318 - DNA, 14 bp, Homo sapiens
gaatctgaatgtaa

SEQ ID NO: 4417319 - DNA, 12 bp, Homo sapiens
gaatctgggact

SEQ ID NO: 4417320 - DNA, 20 bp, Homo sapiens
gaatctgggactgtgcctgg

SEQ ID NO: 4417321 - DNA, 16 bp, Homo sapiens
gaatctgtgcaaacag

SEQ ID NO: 4417322 - DNA, 19 bp, Homo sapiens
gaatctgtgggtctgggag

SEQ ID NO: 4417323 - DNA, 20 bp, Homo sapiens
gaatctgtgggtctgggagt

SEQ ID NO: 4417324 - DNA, 22 bp, Homo sapiens
gaatctgtgtgcatatttgtta

SEQ ID NO: 4417325 - DNA, 16 bp, Homo sapiens
gaatcttaatttatta

SEQ ID NO: 4417326 - DNA, 20 bp, Homo sapiens
gaatcttatttttcctgtcc

SEQ ID NO: 4417327 - DNA, 15 bp, Homo sapiens
gaatcttcactagaa

SEQ ID NO: 4417328 - DNA, 23 bp, Homo sapiens
gaatcttttggattttaagcagt

SEQ ID NO: 4417329 - DNA, 16 bp, Homo sapiens
gaatgaagggccaggc

SEQ ID NO: 4417330 - DNA, 17 bp, Homo sapiens
gaatgaatttatcttta

SEQ ID NO: 4417331 - DNA, 21 bp, Homo sapiens
gaatgatagtaataggataca

SEQ ID NO: 4417332 - DNA, 11 bp, Homo sapiens
gaatgatctat

SEQ ID NO: 4417333 - DNA, 15 bp, Homo sapiens
gaatgattcagtgtt

SEQ ID NO: 4417334 - DNA, 23 bp, Homo sapiens
gaatgattggttaaaatgtgatt

SEQ ID NO: 4417335 - DNA, 18 bp, Homo sapiens
gaatgatttttcattggc

SEQ ID NO: 4417336 - DNA, 12 bp, Homo sapiens
gaatgcaagagt

SEQ ID NO: 4417337 - DNA, 15 bp, Homo sapiens
gaatgcacagatata

SEQ ID NO: 4417338 - DNA, 13 bp, Homo sapiens
gaatgcacctccc

SEQ ID NO: 4417339 - DNA, 14 bp, Homo sapiens
gaatgccataaaat

SEQ ID NO: 4417340 - DNA, 23 bp, Homo sapiens
gaatgccatagtcaaagagagtt

SEQ ID NO: 4417341 - DNA, 13 bp, Homo sapiens
gaatgccatttct

SEQ ID NO: 4417342 - DNA, 15 bp, Homo sapiens
gaatgccatttctca

SEQ ID NO: 4417343 - DNA, 17 bp, Homo sapiens
gaatgccatttctcacg

SEQ ID NO: 4417344 - DNA, 22 bp, Homo sapiens
gaatgccgaatttggtacacat

SEQ ID NO: 4417345 - DNA, 22 bp, Homo sapiens
gaatgccttggaaatagaaaga

SEQ ID NO: 4417346 - DNA, 13 bp, Homo sapiens
gaatgctcccagc

SEQ ID NO: 4417347 - DNA, 12 bp, Homo sapiens
gaatgcttctca

SEQ ID NO: 4417348 - DNA, 17 bp, Homo sapiens
gaatggaggaagaacaa

SEQ ID NO: 4417349 - DNA, 21 bp, Homo sapiens
gaatggatttttctttaactg

SEQ ID NO: 4417350 - DNA, 17 bp, Homo sapiens
gaatggctatgttttta

SEQ ID NO: 4417351 - DNA, 11 bp, Homo sapiens
gaatggtgctt

SEQ ID NO: 4417352 - DNA, 20 bp, Homo sapiens
gaatggtgttttgtcagact

SEQ ID NO: 4417353 - DNA, 22 bp, Homo sapiens
gaatggtgttttgtcagacttc

SEQ ID NO: 4417354 - DNA, 18 bp, Homo sapiens
gaatgtaagaactacaaa

SEQ ID NO: 4417355 - DNA, 23 bp, Homo sapiens
gaatgtaatttgtgtaataaagt

SEQ ID NO: 4417356 - DNA, 13 bp, Homo sapiens
gaatgtactatgt

SEQ ID NO: 4417357 - DNA, 20 bp, Homo sapiens
gaatgtactatgtctgaaca

SEQ ID NO: 4417358 - DNA, 18 bp, Homo sapiens
gaatgtcagtatgtggaa

SEQ ID NO: 4417359 - DNA, 19 bp, Homo sapiens
gaatgtcagtatgtggaag

SEQ ID NO: 4417360 - DNA, 11 bp, Homo sapiens
gaatgtctcag

SEQ ID NO: 4417361 - DNA, 12 bp, Homo sapiens
gaatgtctcagc

SEQ ID NO: 4417362 - DNA, 21 bp, Homo sapiens
gaatgtctgaagtacaaacat

SEQ ID NO: 4417363 - DNA, 20 bp, Homo sapiens
gaatgtcttgttcctgtgca

SEQ ID NO: 4417364 - DNA, 22 bp, Homo sapiens
gaatgtgagtgtgtttgtgtgc

SEQ ID NO: 4417365 - DNA, 15 bp, Homo sapiens
gaatgtgccacagag

SEQ ID NO: 4417366 - DNA, 17 bp, Homo sapiens
gaatgtgccacagaggc

SEQ ID NO: 4417367 - DNA, 15 bp, Homo sapiens
cttctccccgcagcc

SEQ ID NO: 4417368 - DNA, 18 bp, Homo sapiens
cttctccctattccctct

SEQ ID NO: 4417369 - DNA, 13 bp, Homo sapiens
cttctccgccagc

SEQ ID NO: 4417370 - DNA, 18 bp, Homo sapiens
cttctccgccagcctcct

SEQ ID NO: 4417371 - DNA, 19 bp, Homo sapiens
cttctccgccagcctcctc

SEQ ID NO: 4417372 - DNA, 21 bp, Homo sapiens
cttctccgccagcctcctctg

SEQ ID NO: 4417373 - DNA, 24 bp, Homo sapiens
cttctccgccagcctcctctggac

SEQ ID NO: 4417374 - DNA, 17 bp, Homo sapiens
cttctcgtgtttgctta

SEQ ID NO: 4417375 - DNA, 12 bp, Homo sapiens
cttctctataaa

SEQ ID NO: 4417376 - DNA, 13 bp, Homo sapiens
cttctctataaaa

SEQ ID NO: 4417377 - DNA, 15 bp, Homo sapiens
cttctctataaaaaa

SEQ ID NO: 4417378 - DNA, 16 bp, Homo sapiens
cttctctcacttctaa

SEQ ID NO: 4417379 - DNA, 20 bp, Homo sapiens
cttctctccccagccccctc

SEQ ID NO: 4417380 - DNA, 15 bp, Homo sapiens
cttctctcctcccca

SEQ ID NO: 4417381 - DNA, 13 bp, Homo sapiens
cttctctccttgc

SEQ ID NO: 4417382 - DNA, 16 bp, Homo sapiens
cttctctctgtgggat

SEQ ID NO: 4417383 - DNA, 22 bp, Homo sapiens
cttctctgcagtaaaacacatt

SEQ ID NO: 4417384 - DNA, 12 bp, Homo sapiens
cttctctgctcc

SEQ ID NO: 4417385 - DNA, 16 bp, Homo sapiens
cttctcttaaacttgt

SEQ ID NO: 4417386 - DNA, 13 bp, Homo sapiens
cttctcttagatt

SEQ ID NO: 4417387 - DNA, 18 bp, Homo sapiens
cttctcttctttctgaag

SEQ ID NO: 4417388 - DNA, 16 bp, Homo sapiens
cttctcttgctttcta

SEQ ID NO: 4417389 - DNA, 15 bp, Homo sapiens
cttctctttctctct

SEQ ID NO: 4417390 - DNA, 18 bp, Homo sapiens
cttctgaactcaaactga

SEQ ID NO: 4417391 - DNA, 16 bp, Homo sapiens
cttctgaactccatac

SEQ ID NO: 4417392 - DNA, 12 bp, Homo sapiens
cttctgaagatt

SEQ ID NO: 4417393 - DNA, 19 bp, Homo sapiens
cttctgactagattattat

SEQ ID NO: 4417394 - DNA, 21 bp, Homo sapiens
cttctgactgccccctcctgt

SEQ ID NO: 4417395 - DNA, 22 bp, Homo sapiens
cttctgactgccccctcctgtg

SEQ ID NO: 4417396 - DNA, 14 bp, Homo sapiens
cttctgatacttta

SEQ ID NO: 4417397 - DNA, 18 bp, Homo sapiens
cttctgattcccctccac

SEQ ID NO: 4417398 - DNA, 16 bp, Homo sapiens
cttctgcaagcctcat

SEQ ID NO: 4417399 - DNA, 14 bp, Homo sapiens
cttctgcagcaact

SEQ ID NO: 4417400 - DNA, 15 bp, Homo sapiens
cttctgcagcaactc

SEQ ID NO: 4417401 - DNA, 20 bp, Homo sapiens
cttctgcattactattaact

SEQ ID NO: 4417402 - DNA, 14 bp, Homo sapiens
cttctgccaccagc

SEQ ID NO: 4417403 - DNA, 21 bp, Homo sapiens
cttctgcctctaagctgctct

SEQ ID NO: 4417404 - DNA, 14 bp, Homo sapiens
cttctgccttctca

SEQ ID NO: 4417405 - DNA, 14 bp, Homo sapiens
cttctgcggggctg

SEQ ID NO: 4417406 - DNA, 10 bp, Homo sapiens
cttctgctcc

SEQ ID NO: 4417407 - DNA, 14 bp, Homo sapiens
cttctgctccaccc

SEQ ID NO: 4417408 - DNA, 23 bp, Homo sapiens
cttctgctccacccttggcctgt

SEQ ID NO: 4417409 - DNA, 16 bp, Homo sapiens
cttctgctcttttcct

SEQ ID NO: 4417410 - DNA, 12 bp, Homo sapiens
cttctgctgcat

SEQ ID NO: 4417411 - DNA, 18 bp, Homo sapiens
cttctgctgcatcgctgt

SEQ ID NO: 4417412 - DNA, 13 bp, Homo sapiens
cttctgctgtaca

SEQ ID NO: 4417413 - DNA, 18 bp, Homo sapiens
cttctgcttttctgccct

SEQ ID NO: 4417414 - DNA, 20 bp, Homo sapiens
cttctgcttttctgccctgg

SEQ ID NO: 4417415 - DNA, 23 bp, Homo sapiens
cttctgcttttctgccctggctg

SEQ ID NO: 4417416 - DNA, 15 bp, Homo sapiens
cttctggagctggga

SEQ ID NO: 4417417 - DNA, 15 bp, Homo sapiens
cttctgggagggcag

SEQ ID NO: 4417418 - DNA, 19 bp, Homo sapiens
cttctggggcaggctgggc

SEQ ID NO: 4417419 - DNA, 22 bp, Homo sapiens
cttctggggcaggctgggccat

SEQ ID NO: 4417420 - DNA, 16 bp, Homo sapiens
cttctgggtccaggga

SEQ ID NO: 4417421 - DNA, 15 bp, Homo sapiens
cttctgggtggggca

SEQ ID NO: 4417422 - DNA, 15 bp, Homo sapiens
cttctggtgctactc

SEQ ID NO: 4417423 - DNA, 16 bp, Homo sapiens
cttctggtttcttcca

SEQ ID NO: 4417424 - DNA, 16 bp, Homo sapiens
cttctgtagtttttaa

SEQ ID NO: 4417425 - DNA, 19 bp, Homo sapiens
cttctgtcttgtccccacc

SEQ ID NO: 4417426 - DNA, 20 bp, Homo sapiens
cttctgtgagacccccacac

SEQ ID NO: 4417427 - DNA, 20 bp, Homo sapiens
cttctgtggggcccctcacc

SEQ ID NO: 4417428 - DNA, 13 bp, Homo sapiens
cttctgtgtcaca

SEQ ID NO: 4417429 - DNA, 18 bp, Homo sapiens
cttcttaaaagaaatctt

SEQ ID NO: 4417430 - DNA, 19 bp, Homo sapiens
cttcttaaagtattcttct

SEQ ID NO: 4417431 - DNA, 17 bp, Homo sapiens
cttcttagagttttatt

SEQ ID NO: 4417432 - DNA, 16 bp, Homo sapiens
cttcttataacttgta

SEQ ID NO: 4417433 - DNA, 20 bp, Homo sapiens
cttcttataacttgtaagtc

SEQ ID NO: 4417434 - DNA, 21 bp, Homo sapiens
cttcttatttatgtgaacaac

SEQ ID NO: 4417435 - DNA, 18 bp, Homo sapiens
cttcttcagatcagtgct

SEQ ID NO: 4417436 - DNA, 13 bp, Homo sapiens
cttcttcagctga

SEQ ID NO: 4417437 - DNA, 18 bp, Homo sapiens
cttcttccctgtcagcct

SEQ ID NO: 4417438 - DNA, 17 bp, Homo sapiens
cttcttcggggaactcc

SEQ ID NO: 4417439 - DNA, 15 bp, Homo sapiens
cttcttctaagaaga

SEQ ID NO: 4417440 - DNA, 16 bp, Homo sapiens
cttcttctaagaagac

SEQ ID NO: 4417441 - DNA, 18 bp, Homo sapiens
cttcttctaagaagacat

SEQ ID NO: 4417442 - DNA, 22 bp, Homo sapiens
cttcttctaagaagacattttg

SEQ ID NO: 4417443 - DNA, 18 bp, Homo sapiens
cttcttctgtaatattta

SEQ ID NO: 4417444 - DNA, 17 bp, Homo sapiens
cttcttgaaaataaaaa

SEQ ID NO: 4417445 - DNA, 16 bp, Homo sapiens
cttcttgaatataaaa

SEQ ID NO: 4417446 - DNA, 19 bp, Homo sapiens
cttcttgaatataaaaaat

SEQ ID NO: 4417447 - DNA, 21 bp, Homo sapiens
cttcttgcttctttctagaaa

SEQ ID NO: 4417448 - DNA, 22 bp, Homo sapiens
cttcttgggcccggtccacagg

SEQ ID NO: 4417449 - DNA, 15 bp, Homo sapiens
cttctttaagccata

SEQ ID NO: 4417450 - DNA, 19 bp, Homo sapiens
cttctttagaccctcgggc

SEQ ID NO: 4417451 - DNA, 21 bp, Homo sapiens
cttctttagaccctcgggccc

SEQ ID NO: 4417452 - DNA, 15 bp, Homo sapiens
cttctttattgcccc

SEQ ID NO: 4417453 - DNA, 17 bp, Homo sapiens
cttctttccagaaacca

SEQ ID NO: 4417454 - DNA, 16 bp, Homo sapiens
cttctttctagaaaga

SEQ ID NO: 4417455 - DNA, 13 bp, Homo sapiens
cttctttctggac

SEQ ID NO: 4417456 - DNA, 18 bp, Homo sapiens
cttctttgtgcctttggc

SEQ ID NO: 4417457 - DNA, 22 bp, Homo sapiens
cttctttgtgcctttggcctgg

SEQ ID NO: 4417458 - DNA, 23 bp, Homo sapiens
cttctttgttattataacataaa

SEQ ID NO: 4417459 - DNA, 15 bp, Homo sapiens
cttcttttctttgta

SEQ ID NO: 4417460 - DNA, 13 bp, Homo sapiens
cttctttttcatc

SEQ ID NO: 4417461 - DNA, 17 bp, Homo sapiens
cttcttttttaagttgt

SEQ ID NO: 4417462 - DNA, 20 bp, Homo sapiens
cttgaaaaagatggcttatg

SEQ ID NO: 4417463 - DNA, 16 bp, Homo sapiens
cttgaaaataagaata

SEQ ID NO: 4417464 - DNA, 22 bp, Homo sapiens
cttgaaaataagaatagaaata

SEQ ID NO: 4417465 - DNA, 23 bp, Homo sapiens
cttgaaacagattcaggccagcc

SEQ ID NO: 4417466 - DNA, 17 bp, Homo sapiens
cttgaaaccagtattta

SEQ ID NO: 4417467 - DNA, 13 bp, Homo sapiens
cttgaaagaaatg

SEQ ID NO: 4417468 - DNA, 15 bp, Homo sapiens
cttgaaagttttcta

SEQ ID NO: 4417469 - DNA, 16 bp, Homo sapiens
cttgaaatatataata

SEQ ID NO: 4417470 - DNA, 17 bp, Homo sapiens
cttgaaatatataatat

SEQ ID NO: 4417471 - DNA, 22 bp, Homo sapiens
cttgaaatatataatattcagc

SEQ ID NO: 4417472 - DNA, 18 bp, Homo sapiens
cttgaaatattcagaaat

SEQ ID NO: 4417473 - DNA, 13 bp, Homo sapiens
cttgaaatgaaag

SEQ ID NO: 4417474 - DNA, 20 bp, Homo sapiens
cttgaaatgaaagggaaact

SEQ ID NO: 4417475 - DNA, 21 bp, Homo sapiens
cttgaaatgaaagggaaactg

SEQ ID NO: 4417476 - DNA, 22 bp, Homo sapiens
cttgaaatggaaagtcatgcaa

SEQ ID NO: 4417477 - DNA, 14 bp, Homo sapiens
cttgaaatttacac

SEQ ID NO: 4417478 - DNA, 17 bp, Homo sapiens
cttgaaatttacacagt

SEQ ID NO: 4417479 - DNA, 19 bp, Homo sapiens
cttgaacaaaagggtcaga

SEQ ID NO: 4417480 - DNA, 17 bp, Homo sapiens
cttgaacaaagacattt

SEQ ID NO: 4417481 - DNA, 17 bp, Homo sapiens
cttgaacacagtatttt

SEQ ID NO: 4417482 - DNA, 23 bp, Homo sapiens
cttgaacattaatccacatgttt

SEQ ID NO: 4417483 - DNA, 14 bp, Homo sapiens
cttgaacccgggag

SEQ ID NO: 4417484 - DNA, 19 bp, Homo sapiens
cttgaacccgggaggcaga

SEQ ID NO: 4417485 - DNA, 18 bp, Homo sapiens
cttgaacccgggggacag

SEQ ID NO: 4417486 - DNA, 13 bp, Homo sapiens
cttgaactttcca

SEQ ID NO: 4417487 - DNA, 14 bp, Homo sapiens
cttgaactttccaa

SEQ ID NO: 4417488 - DNA, 13 bp, Homo sapiens
ctttgctatgtaa

SEQ ID NO: 4417489 - DNA, 17 bp, Homo sapiens
ctttgctcttcaagaaa

SEQ ID NO: 4417490 - DNA, 22 bp, Homo sapiens
ctttgctgcagagatcaagggt

SEQ ID NO: 4417491 - DNA, 15 bp, Homo sapiens
ctttgcttcccattg

SEQ ID NO: 4417492 - DNA, 20 bp, Homo sapiens
ctttgcttgaacacagtatt

SEQ ID NO: 4417493 - DNA, 22 bp, Homo sapiens
ctttgcttgaacacagtatttt

SEQ ID NO: 4417494 - DNA, 23 bp, Homo sapiens
ctttgcttgaacacagtattttc

SEQ ID NO: 4417495 - DNA, 14 bp, Homo sapiens
ctttgctttgtagt

SEQ ID NO: 4417496 - DNA, 17 bp, Homo sapiens
ctttgctttgtagtttg

SEQ ID NO: 4417497 - DNA, 23 bp, Homo sapiens
ctttggaaaaatgggtcttttat

SEQ ID NO: 4417498 - DNA, 24 bp, Homo sapiens
ctttggaaagtacactctgctgtt

SEQ ID NO: 4417499 - DNA, 16 bp, Homo sapiens
ctttggaaataaaaga

SEQ ID NO: 4417500 - DNA, 19 bp, Homo sapiens
ctttggaatattttatcct

SEQ ID NO: 4417501 - DNA, 20 bp, Homo sapiens
ctttggaatattttatcctg

SEQ ID NO: 4417502 - DNA, 17 bp, Homo sapiens
ctttggacccagggcct

SEQ ID NO: 4417503 - DNA, 17 bp, Homo sapiens
ctttggacctaatccaa

SEQ ID NO: 4417504 - DNA, 13 bp, Homo sapiens
ctttggatttgac

SEQ ID NO: 4417505 - DNA, 16 bp, Homo sapiens
ctttggatttgacatt

SEQ ID NO: 4417506 - DNA, 16 bp, Homo sapiens
ctttggcaatttcctg

SEQ ID NO: 4417507 - DNA, 17 bp, Homo sapiens
ctttggcaatttcctgg

SEQ ID NO: 4417508 - DNA, 14 bp, Homo sapiens
ctttggcactctct

SEQ ID NO: 4417509 - DNA, 13 bp, Homo sapiens
ctttggcccaggg

SEQ ID NO: 4417510 - DNA, 14 bp, Homo sapiens
ctttggcccagggt

SEQ ID NO: 4417511 - DNA, 21 bp, Homo sapiens
ctttggcctggggtgcatctc

SEQ ID NO: 4417512 - DNA, 16 bp, Homo sapiens
ctttggcgttggagac

SEQ ID NO: 4417513 - DNA, 21 bp, Homo sapiens
ctttggctggtagcagcaggc

SEQ ID NO: 4417514 - DNA, 16 bp, Homo sapiens
ctttgggaactgtgtt

SEQ ID NO: 4417515 - DNA, 12 bp, Homo sapiens
ctttgggagtcc

SEQ ID NO: 4417516 - DNA, 13 bp, Homo sapiens
ctttgggcccagg

SEQ ID NO: 4417517 - DNA, 22 bp, Homo sapiens
ctttgggtacttatactaaatt

SEQ ID NO: 4417518 - DNA, 19 bp, Homo sapiens
ctttggtaaaacagtttca

SEQ ID NO: 4417519 - DNA, 13 bp, Homo sapiens
ctttggtcctggt

SEQ ID NO: 4417520 - DNA, 15 bp, Homo sapiens
ctttggttctctgat

SEQ ID NO: 4417521 - DNA, 16 bp, Homo sapiens
ctttggttttcttgtt

SEQ ID NO: 4417522 - DNA, 19 bp, Homo sapiens
ctttggtttttttcttctg

SEQ ID NO: 4417523 - DNA, 23 bp, Homo sapiens
ctttgtaaatgcatattaaataa

SEQ ID NO: 4417524 - DNA, 21 bp, Homo sapiens
ctttgtaatgtcaccaccttc

SEQ ID NO: 4417525 - DNA, 21 bp, Homo sapiens
ctttgtactaatacagggagc

SEQ ID NO: 4417526 - DNA, 22 bp, Homo sapiens
ctttgtactcctgctgtctacc

SEQ ID NO: 4417527 - DNA, 14 bp, Homo sapiens
ctttgtagaataaa

SEQ ID NO: 4417528 - DNA, 17 bp, Homo sapiens
ctttgtagactgtttca

SEQ ID NO: 4417529 - DNA, 15 bp, Homo sapiens
ctttgtataatccca

SEQ ID NO: 4417530 - DNA, 17 bp, Homo sapiens
ctttgtatacaagtact

SEQ ID NO: 4417531 - DNA, 16 bp, Homo sapiens
ctttgtatactttaaa

SEQ ID NO: 4417532 - DNA, 19 bp, Homo sapiens
ctttgtatataggcttctc

SEQ ID NO: 4417533 - DNA, 20 bp, Homo sapiens
ctttgtatgacagtgaagca

SEQ ID NO: 4417534 - DNA, 20 bp, Homo sapiens
ctttgtattcttcatgaaat

SEQ ID NO: 4417535 - DNA, 22 bp, Homo sapiens
ctttgtattgtatattacaatg

SEQ ID NO: 4417536 - DNA, 12 bp, Homo sapiens
ctttgtcacttg

SEQ ID NO: 4417537 - DNA, 13 bp, Homo sapiens
ctttgtgaccaga

SEQ ID NO: 4417538 - DNA, 22 bp, Homo sapiens
ctttgtgattcaatctgtaaac

SEQ ID NO: 4417539 - DNA, 23 bp, Homo sapiens
ctttgtgattcaatctgtaaact

SEQ ID NO: 4417540 - DNA, 18 bp, Homo sapiens
ctttgtgcacatttattt

SEQ ID NO: 4417541 - DNA, 18 bp, Homo sapiens
ctttgtgcctttggcctg

SEQ ID NO: 4417542 - DNA, 20 bp, Homo sapiens
ctttgtgctacatgacgaca

SEQ ID NO: 4417543 - DNA, 20 bp, Homo sapiens
ctttgtggattctgaggccc

SEQ ID NO: 4417544 - DNA, 14 bp, Homo sapiens
ctttgtggcactgg

SEQ ID NO: 4417545 - DNA, 15 bp, Homo sapiens
ctttgtggtttagtt

SEQ ID NO: 4417546 - DNA, 16 bp, Homo sapiens
ctttgtggttttatgg

SEQ ID NO: 4417547 - DNA, 13 bp, Homo sapiens
ctttgtgtaatct

SEQ ID NO: 4417548 - DNA, 14 bp, Homo sapiens
ctttgttaaaaaaa

SEQ ID NO: 4417549 - DNA, 18 bp, Homo sapiens
ctttgttgcaagatgtga

SEQ ID NO: 4417550 - DNA, 15 bp, Homo sapiens
ctttgtttaaatgcc

SEQ ID NO: 4417551 - DNA, 23 bp, Homo sapiens
ctttgtttacatgagttcaaata

SEQ ID NO: 4417552 - DNA, 19 bp, Homo sapiens
ctttgttttgatgtttgtg

SEQ ID NO: 4417553 - DNA, 24 bp, Homo sapiens
ctttgttttgatgtttgtggcctc

SEQ ID NO: 4417554 - DNA, 23 bp, Homo sapiens
ctttgttttgcacactttgccat

SEQ ID NO: 4417555 - DNA, 12 bp, Homo sapiens
ctttgttttttt

SEQ ID NO: 4417556 - DNA, 19 bp, Homo sapiens
cttttaaaatgcaatgtaa

SEQ ID NO: 4417557 - DNA, 12 bp, Homo sapiens
cttttaaagtat

SEQ ID NO: 4417558 - DNA, 17 bp, Homo sapiens
cttttaaattagaaaat

SEQ ID NO: 4417559 - DNA, 16 bp, Homo sapiens
cttttaaccatctgat

SEQ ID NO: 4417560 - DNA, 17 bp, Homo sapiens
cttttaaccatctgata

SEQ ID NO: 4417561 - DNA, 14 bp, Homo sapiens
cttttaagatttct

SEQ ID NO: 4417562 - DNA, 18 bp, Homo sapiens
cttttaagtttttctctt

SEQ ID NO: 4417563 - DNA, 16 bp, Homo sapiens
cttttaatgaaaagga

SEQ ID NO: 4417564 - DNA, 15 bp, Homo sapiens
cttttaccagctttt

SEQ ID NO: 4417565 - DNA, 13 bp, Homo sapiens
gaaaggttttttt

SEQ ID NO: 4417566 - DNA, 20 bp, Homo sapiens
gaaagtaagcatttccagcc

SEQ ID NO: 4417567 - DNA, 18 bp, Homo sapiens
gaaagtacactctgctgt

SEQ ID NO: 4417568 - DNA, 20 bp, Homo sapiens
gaaagtacactctgctgttt

SEQ ID NO: 4417569 - DNA, 22 bp, Homo sapiens
gaaagtacactctgctgtttga

SEQ ID NO: 4417570 - DNA, 22 bp, Homo sapiens
gaaagtacccagcaaatgggca

SEQ ID NO: 4417571 - DNA, 19 bp, Homo sapiens
gaaagtatagatggccaaa

SEQ ID NO: 4417572 - DNA, 16 bp, Homo sapiens
gaaagtcctgctttcc

SEQ ID NO: 4417573 - DNA, 12 bp, Homo sapiens
gaaagtgccagc

SEQ ID NO: 4417574 - DNA, 14 bp, Homo sapiens
gaaagtgccagcat

SEQ ID NO: 4417575 - DNA, 23 bp, Homo sapiens
gaaagtgccagcattccagactt

SEQ ID NO: 4417576 - DNA, 17 bp, Homo sapiens
gaaagtgggggtggagg

SEQ ID NO: 4417577 - DNA, 19 bp, Homo sapiens
gaaagtgggggtggaggac

SEQ ID NO: 4417578 - DNA, 19 bp, Homo sapiens
gaaagtgtgagctcttccc

SEQ ID NO: 4417579 - DNA, 21 bp, Homo sapiens
gaaagtgtgagctcttccctt

SEQ ID NO: 4417580 - DNA, 18 bp, Homo sapiens
gaaagtgttaattttacc

SEQ ID NO: 4417581 - DNA, 13 bp, Homo sapiens
gaaagttgctttt

SEQ ID NO: 4417582 - DNA, 22 bp, Homo sapiens
gaaagttgtaaaatagaaaaag

SEQ ID NO: 4417583 - DNA, 14 bp, Homo sapiens
gaaagtttgccagg

SEQ ID NO: 4417584 - DNA, 18 bp, Homo sapiens
gaaagtttgccaggagga

SEQ ID NO: 4417585 - DNA, 22 bp, Homo sapiens
gaaagttttcagaacctcttcc

SEQ ID NO: 4417586 - DNA, 13 bp, Homo sapiens
gaaagttttgtaa

SEQ ID NO: 4417587 - DNA, 15 bp, Homo sapiens
gaaagttttgtaaaa

SEQ ID NO: 4417588 - DNA, 13 bp, Homo sapiens
gaaataaacatta

SEQ ID NO: 4417589 - DNA, 20 bp, Homo sapiens
gaaataaaggatgtgattgt

SEQ ID NO: 4417590 - DNA, 21 bp, Homo sapiens
gaaataagtttttgtttcaca

SEQ ID NO: 4417591 - DNA, 16 bp, Homo sapiens
gaaataatatatttct

SEQ ID NO: 4417592 - DNA, 19 bp, Homo sapiens
gaaataatatatttcttct

SEQ ID NO: 4417593 - DNA, 16 bp, Homo sapiens
gaaataccacaagcct

SEQ ID NO: 4417594 - DNA, 22 bp, Homo sapiens
gaaatacgttaggaggacaaaa

SEQ ID NO: 4417595 - DNA, 17 bp, Homo sapiens
gaaatagaaagaagcca

SEQ ID NO: 4417596 - DNA, 22 bp, Homo sapiens
gaaatagaggtgatgctgctaa

SEQ ID NO: 4417597 - DNA, 15 bp, Homo sapiens
gaaatagcggccctg

SEQ ID NO: 4417598 - DNA, 16 bp, Homo sapiens
gaaatagtatacattg

SEQ ID NO: 4417599 - DNA, 13 bp, Homo sapiens
gaaatatacagtt

SEQ ID NO: 4417600 - DNA, 20 bp, Homo sapiens
gaaatatatattgtaaagaa

SEQ ID NO: 4417601 - DNA, 16 bp, Homo sapiens
gaaatatatcctgtgt

SEQ ID NO: 4417602 - DNA, 13 bp, Homo sapiens
gaaatatatgtga

SEQ ID NO: 4417603 - DNA, 14 bp, Homo sapiens
gaaatatatgtgaa

SEQ ID NO: 4417604 - DNA, 15 bp, Homo sapiens
gaaatatcatcacgt

SEQ ID NO: 4417605 - DNA, 21 bp, Homo sapiens
gaaatatcatcacgtatgtta

SEQ ID NO: 4417606 - DNA, 20 bp, Homo sapiens
gaaatatcccgggggtgggg

SEQ ID NO: 4417607 - DNA, 15 bp, Homo sapiens
gaaatatctgtgaaa

SEQ ID NO: 4417608 - DNA, 16 bp, Homo sapiens
gaaatatctgtgaaat

SEQ ID NO: 4417609 - DNA, 18 bp, Homo sapiens
gaaatatctgtgaaatat

SEQ ID NO: 4417610 - DNA, 18 bp, Homo sapiens
gaaatatttcttttaaaa

SEQ ID NO: 4417611 - DNA, 13 bp, Homo sapiens
gaaatattttaaa

SEQ ID NO: 4417612 - DNA, 20 bp, Homo sapiens
gaaatattttaaaatcagct

SEQ ID NO: 4417613 - DNA, 17 bp, Homo sapiens
gaaatcaaatatgcaaa

SEQ ID NO: 4417614 - DNA, 17 bp, Homo sapiens
gaaatcatgtccataca

SEQ ID NO: 4417615 - DNA, 22 bp, Homo sapiens
gaaatccccccttcagaacaga

SEQ ID NO: 4417616 - DNA, 14 bp, Homo sapiens
gaaatcctctgtta

SEQ ID NO: 4417617 - DNA, 22 bp, Homo sapiens
gaaatctactgaattggcttcc

SEQ ID NO: 4417618 - DNA, 21 bp, Homo sapiens
gaaatctataaaactttctgt

SEQ ID NO: 4417619 - DNA, 19 bp, Homo sapiens
gaaatctcagattcttcac

SEQ ID NO: 4417620 - DNA, 21 bp, Homo sapiens
gaaatcttgcttcagaccatc

SEQ ID NO: 4417621 - DNA, 12 bp, Homo sapiens
gaaatgaaaggg

SEQ ID NO: 4417622 - DNA, 15 bp, Homo sapiens
gaaatgaacattcca

SEQ ID NO: 4417623 - DNA, 19 bp, Homo sapiens
gaaatgacagtcaaaagat

SEQ ID NO: 4417624 - DNA, 15 bp, Homo sapiens
gaaatgacatttcac

SEQ ID NO: 4417625 - DNA, 17 bp, Homo sapiens
gaaatgagaaggcagcc

SEQ ID NO: 4417626 - DNA, 19 bp, Homo sapiens
gaaatgagaaggcagccac

SEQ ID NO: 4417627 - DNA, 17 bp, Homo sapiens
gaaatgaggtctgttta

SEQ ID NO: 4417628 - DNA, 23 bp, Homo sapiens
gaaatgaggtctgtttaaagtgg

SEQ ID NO: 4417629 - DNA, 21 bp, Homo sapiens
gaaatgattaaaatgtttgag

SEQ ID NO: 4417630 - DNA, 21 bp, Homo sapiens
gaaatgattcaaattgctgct

SEQ ID NO: 4417631 - DNA, 23 bp, Homo sapiens
gaaatgattcaaattgctgcttg

SEQ ID NO: 4417632 - DNA, 22 bp, Homo sapiens
gaaatgcattgctctggatctg

SEQ ID NO: 4417633 - DNA, 17 bp, Homo sapiens
gaaatgctcaagaatgt

SEQ ID NO: 4417634 - DNA, 15 bp, Homo sapiens
gaaatgctgtatttt

SEQ ID NO: 4417635 - DNA, 15 bp, Homo sapiens
gaaatgcttttatat

SEQ ID NO: 4417636 - DNA, 21 bp, Homo sapiens
gaaatgcttttatattctaat

SEQ ID NO: 4417637 - DNA, 14 bp, Homo sapiens
gaaatggaaatttt

SEQ ID NO: 4417638 - DNA, 13 bp, Homo sapiens
gaaatgtacactt

SEQ ID NO: 4417639 - DNA, 14 bp, Homo sapiens
gaaatgtagcactt

SEQ ID NO: 4417640 - DNA, 23 bp, Homo sapiens
gaaatgtcccctcaaactcattg

SEQ ID NO: 4417641 - DNA, 18 bp, Homo sapiens
gaaatgtgttttgtcttt

SEQ ID NO: 4417642 - DNA, 20 bp, Homo sapiens
gaaatgtttatggaaatatt

SEQ ID NO: 4417643 - DNA, 19 bp, Homo sapiens
gaaattaacacaaaggaag

SEQ ID NO: 4417644 - DNA, 19 bp, Homo sapiens
gaaattactaattttactt

SEQ ID NO: 4417645 - DNA, 11 bp, Homo sapiens
gaaattatttt

SEQ ID NO: 4417646 - DNA, 17 bp, Homo sapiens
gaaattcgtgtgttttt

SEQ ID NO: 4417647 - DNA, 14 bp, Homo sapiens
gaaattctgaattt

SEQ ID NO: 4417648 - DNA, 19 bp, Homo sapiens
gaaattgcagtaacaaaag

SEQ ID NO: 4417649 - DNA, 18 bp, Homo sapiens
gaaattgctttgtattgt

SEQ ID NO: 4417650 - DNA, 19 bp, Homo sapiens
gaaattgtaaatcctgtgt

SEQ ID NO: 4417651 - DNA, 19 bp, Homo sapiens
gaaattgtatattgtaatt

SEQ ID NO: 4417652 - DNA, 16 bp, Homo sapiens
gaaattgtttatgtgt

SEQ ID NO: 4417653 - DNA, 20 bp, Homo sapiens
gaaatttaaactataagcaa

SEQ ID NO: 4417654 - DNA, 23 bp, Homo sapiens
gaaatttaaactataagcaagaa

SEQ ID NO: 4417655 - DNA, 19 bp, Homo sapiens
gaaatttacacagtgagac

SEQ ID NO: 4417656 - DNA, 14 bp, Homo sapiens
gaaatttataatat

SEQ ID NO: 4417657 - DNA, 14 bp, Homo sapiens
gaaattttagaaat

SEQ ID NO: 4417658 - DNA, 21 bp, Homo sapiens
gaaattttcaagagtctaata

SEQ ID NO: 4417659 - DNA, 19 bp, Homo sapiens
gaaattttgtaagaaggca

SEQ ID NO: 4417660 - DNA, 20 bp, Homo sapiens
gaaattttttagtatgttca

SEQ ID NO: 4417661 - DNA, 23 bp, Homo sapiens
gaacaaatttacagagacagaaa

SEQ ID NO: 4417662 - DNA, 20 bp, Homo sapiens
gaacaattgctatttaaata

SEQ ID NO: 4417663 - DNA, 17 bp, Homo sapiens
gaacacaaactgtaaat

SEQ ID NO: 4417664 - DNA, 13 bp, Homo sapiens
gaacacaggggcc

SEQ ID NO: 4417665 - DNA, 20 bp, Homo sapiens
gaacaccattgaaggcttaa

SEQ ID NO: 4417666 - DNA, 16 bp, Homo sapiens
gaacacgcgtatttac

SEQ ID NO: 4417667 - DNA, 16 bp, Homo sapiens
gaacactaacctgacc

SEQ ID NO: 4417668 - DNA, 13 bp, Homo sapiens
gaacactcttagc

SEQ ID NO: 4417669 - DNA, 14 bp, Homo sapiens
gaacagaggcattt

SEQ ID NO: 4417670 - DNA, 17 bp, Homo sapiens
gaacagaggcatttaaa

SEQ ID NO: 4417671 - DNA, 14 bp, Homo sapiens
gaacagatttcaaa

SEQ ID NO: 4417672 - DNA, 17 bp, Homo sapiens
gaacagccccggggccc

SEQ ID NO: 4417673 - DNA, 21 bp, Homo sapiens
gaacagccccggggccccctg

SEQ ID NO: 4417674 - DNA, 13 bp, Homo sapiens
gaacagccctctc

SEQ ID NO: 4417675 - DNA, 22 bp, Homo sapiens
gaacagccctctctctcactcc

SEQ ID NO: 4417676 - DNA, 17 bp, Homo sapiens
gaacagcttgccaggga

SEQ ID NO: 4417677 - DNA, 23 bp, Homo sapiens
gaacagggaacattggagctgac

SEQ ID NO: 4417678 - DNA, 21 bp, Homo sapiens
gaacaggttcttaaaaaggaa

SEQ ID NO: 4417679 - DNA, 22 bp, Homo sapiens
gaacagtactggttactttcaa

SEQ ID NO: 4417680 - DNA, 16 bp, Homo sapiens
gaacagtattgggcag

SEQ ID NO: 4417681 - DNA, 20 bp, Homo sapiens
gaacagtattgggcaggagg

SEQ ID NO: 4417682 - DNA, 20 bp, Homo sapiens
gaacagtgattaccagggac

SEQ ID NO: 4417683 - DNA, 18 bp, Homo sapiens
gaacagtgcatgtgcatg

SEQ ID NO: 4417684 - DNA, 15 bp, Homo sapiens
gaacataaaatacaa

SEQ ID NO: 4417685 - DNA, 23 bp, Homo sapiens
gaacatacatgatacatttttat

SEQ ID NO: 4417686 - DNA, 15 bp, Homo sapiens
gaacatactgttctc

SEQ ID NO: 4417687 - DNA, 19 bp, Homo sapiens
gaacatagactagagaaac

SEQ ID NO: 4417688 - DNA, 21 bp, Homo sapiens
gaacatagactagagaaaccg

SEQ ID NO: 4417689 - DNA, 17 bp, Homo sapiens
gaacatcacattcctct

SEQ ID NO: 4417690 - DNA, 17 bp, Homo sapiens
gaacatctgtcctgtga

SEQ ID NO: 4417691 - DNA, 13 bp, Homo sapiens
gaacatgcagttt

SEQ ID NO: 4417692 - DNA, 16 bp, Homo sapiens
gaacatgcagtttgaa

SEQ ID NO: 4417693 - DNA, 20 bp, Homo sapiens
gaacatgcagtttgaaattc

SEQ ID NO: 4417694 - DNA, 13 bp, Homo sapiens
gaacatgtgcttc

SEQ ID NO: 4417695 - DNA, 14 bp, Homo sapiens
gaacatgtgcttca

SEQ ID NO: 4417696 - DNA, 21 bp, Homo sapiens
gaacatgtgttttcatcattt

SEQ ID NO: 4417697 - DNA, 23 bp, Homo sapiens
gaacatgtgttttcatcatttca

SEQ ID NO: 4417698 - DNA, 12 bp, Homo sapiens
gaacattattca

SEQ ID NO: 4417699 - DNA, 20 bp, Homo sapiens
gaacattattcatctctcct

SEQ ID NO: 4417700 - DNA, 16 bp, Homo sapiens
gaacattcacttttgt

SEQ ID NO: 4417701 - DNA, 20 bp, Homo sapiens
gaacattccaaggagttgga

SEQ ID NO: 4417702 - DNA, 19 bp, Homo sapiens
gaacattcgaatctctgcc

SEQ ID NO: 4417703 - DNA, 22 bp, Homo sapiens
gaacattcgaatctctgcccct

SEQ ID NO: 4417704 - DNA, 13 bp, Homo sapiens
gaacattgatctg

SEQ ID NO: 4417705 - DNA, 20 bp, Homo sapiens
gaacattgatctgttttaca

SEQ ID NO: 4417706 - DNA, 19 bp, Homo sapiens
gaaccaaactcctatttca

SEQ ID NO: 4417707 - DNA, 19 bp, Homo sapiens
gaaccaaatacctcaattt

SEQ ID NO: 4417708 - DNA, 22 bp, Homo sapiens
gaaccaaatacctcaatttttg

SEQ ID NO: 4417709 - DNA, 24 bp, Homo sapiens
gaaccaacaacctcaactgcctac

SEQ ID NO: 4417710 - DNA, 15 bp, Homo sapiens
gaaccacagcagaca

SEQ ID NO: 4417711 - DNA, 16 bp, Homo sapiens
gaaccacagcagacac

SEQ ID NO: 4417712 - DNA, 23 bp, Homo sapiens
gaaccactgtctagagcaacttt

SEQ ID NO: 4417713 - DNA, 20 bp, Homo sapiens
gaaccagccccatcagaacc

SEQ ID NO: 4417714 - DNA, 20 bp, Homo sapiens
gaaccagtctcctcactctg

SEQ ID NO: 4417715 - DNA, 19 bp, Homo sapiens
gaaccattatactttatat

SEQ ID NO: 4417716 - DNA, 17 bp, Homo sapiens
gaacccaccaaccagaa

SEQ ID NO: 4417717 - DNA, 13 bp, Homo sapiens
gaacccacctgct

SEQ ID NO: 4417718 - DNA, 19 bp, Homo sapiens
gaacccacctgctgagaga

SEQ ID NO: 4417719 - DNA, 16 bp, Homo sapiens
gaacccaggaggtgga

SEQ ID NO: 4417720 - DNA, 20 bp, Homo sapiens
gaacccatggaaaaatgcca

SEQ ID NO: 4417721 - DNA, 17 bp, Homo sapiens
gaaccccagaggcagag

SEQ ID NO: 4417722 - DNA, 20 bp, Homo sapiens
gaacccgggagcggaggttg

SEQ ID NO: 4417723 - DNA, 15 bp, Homo sapiens
gaacccgggggacag

SEQ ID NO: 4417724 - DNA, 22 bp, Homo sapiens
gaaccctgccatggaactgttt

SEQ ID NO: 4417725 - DNA, 16 bp, Homo sapiens
gaaccctgcctcttgt

SEQ ID NO: 4417726 - DNA, 17 bp, Homo sapiens
gaaccgttttgaagcta

SEQ ID NO: 4417727 - DNA, 20 bp, Homo sapiens
gaacctacagactccatctc

SEQ ID NO: 4417728 - DNA, 21 bp, Homo sapiens
gaacctacagttttaactgtg

SEQ ID NO: 4417729 - DNA, 23 bp, Homo sapiens
gaacctacagttttaactgtgga

SEQ ID NO: 4417730 - DNA, 20 bp, Homo sapiens
gaacctaccagttggccatg

SEQ ID NO: 4417731 - DNA, 14 bp, Homo sapiens
gaacctagaagggc

SEQ ID NO: 4417732 - DNA, 17 bp, Homo sapiens
gaacctagaagggctag

SEQ ID NO: 4417733 - DNA, 14 bp, Homo sapiens
gaacctctgattta

SEQ ID NO: 4417734 - DNA, 13 bp, Homo sapiens
gaacctcttcccc

SEQ ID NO: 4417735 - DNA, 14 bp, Homo sapiens
gaacctcttcccca

SEQ ID NO: 4417736 - DNA, 17 bp, Homo sapiens
gaacctcttccccagaa

SEQ ID NO: 4417737 - DNA, 22 bp, Homo sapiens
gaacctgagctattttcctctg

SEQ ID NO: 4417738 - DNA, 17 bp, Homo sapiens
gaacctgctacttaaaa

SEQ ID NO: 4417739 - DNA, 20 bp, Homo sapiens
gaacctggaagatcatggac

SEQ ID NO: 4417740 - DNA, 15 bp, Homo sapiens
gaacctggagagcta

SEQ ID NO: 4417741 - DNA, 16 bp, Homo sapiens
gaacctggagggctag

SEQ ID NO: 4417742 - DNA, 21 bp, Homo sapiens
gaacctggagggctggaatct

SEQ ID NO: 4417743 - DNA, 13 bp, Homo sapiens
gaacctggagggg

SEQ ID NO: 4417744 - DNA, 16 bp, Homo sapiens
gaacctggaggggcta

SEQ ID NO: 4417745 - DNA, 11 bp, Homo sapiens
gaacctggatc

SEQ ID NO: 4417746 - DNA, 16 bp, Homo sapiens
gaacctgtcctaagga

SEQ ID NO: 4417747 - DNA, 19 bp, Homo sapiens
gaaccttaatgacaacact

SEQ ID NO: 4417748 - DNA, 15 bp, Homo sapiens
gaaccttccctccaa

SEQ ID NO: 4417749 - DNA, 19 bp, Homo sapiens
gaaccttccttcctgcttg

SEQ ID NO: 4417750 - DNA, 12 bp, Homo sapiens
gaacctttgtca

SEQ ID NO: 4417751 - DNA, 12 bp, Homo sapiens
gaacgcagccct

SEQ ID NO: 4417752 - DNA, 21 bp, Homo sapiens
gaacgcagccctagagcctgc

SEQ ID NO: 4417753 - DNA, 23 bp, Homo sapiens
gaacgcagccctagagcctgcct

SEQ ID NO: 4417754 - DNA, 14 bp, Homo sapiens
gaacgcagttgatt

SEQ ID NO: 4417755 - DNA, 19 bp, Homo sapiens
gaacgccctcatgctcagc

SEQ ID NO: 4417756 - DNA, 17 bp, Homo sapiens
gaacgggcagcctgggc

SEQ ID NO: 4417757 - DNA, 22 bp, Homo sapiens
gaacgggcagcctgggcctggg

SEQ ID NO: 4417758 - DNA, 14 bp, Homo sapiens
gaacggggagaaaa

SEQ ID NO: 4417759 - DNA, 14 bp, Homo sapiens
gaacgtgactgccc

SEQ ID NO: 4417760 - DNA, 13 bp, Homo sapiens
gaacgtggtttgc

SEQ ID NO: 4417761 - DNA, 15 bp, Homo sapiens
gaacgtttttcctgt

SEQ ID NO: 4417762 - DNA, 19 bp, Homo sapiens
gaactaaactagtttttcc

SEQ ID NO: 4417763 - DNA, 15 bp, Homo sapiens
gaactaaatttttca

SEQ ID NO: 4417764 - DNA, 17 bp, Homo sapiens
gaactaaatttttcata

SEQ ID NO: 4417765 - DNA, 12 bp, Homo sapiens
gaactaatatat

SEQ ID NO: 4417766 - DNA, 14 bp, Homo sapiens
gaactaatatatga

SEQ ID NO: 4417767 - DNA, 15 bp, Homo sapiens
gaactaatttatact

SEQ ID NO: 4417768 - DNA, 20 bp, Homo sapiens
gaactaccttggttccccca

SEQ ID NO: 4417769 - DNA, 16 bp, Homo sapiens
gaactactaaggaaaa

SEQ ID NO: 4417770 - DNA, 17 bp, Homo sapiens
gaactaggctgagcaat

SEQ ID NO: 4417771 - DNA, 19 bp, Homo sapiens
gaactatgaggagcctctg

SEQ ID NO: 4417772 - DNA, 17 bp, Homo sapiens
gaactattttaaataaa

SEQ ID NO: 4417773 - DNA, 22 bp, Homo sapiens
gaactcaagggttttccaggtg

SEQ ID NO: 4417774 - DNA, 18 bp, Homo sapiens
gaactcagatctgtctga

SEQ ID NO: 4417775 - DNA, 18 bp, Homo sapiens
gaactcctgccaggcaca

SEQ ID NO: 4417776 - DNA, 15 bp, Homo sapiens
gaactccttgcacac

SEQ ID NO: 4417777 - DNA, 15 bp, Homo sapiens
gaactcttctttgct

SEQ ID NO: 4417778 - DNA, 23 bp, Homo sapiens
gaactgaacaccattgaaggctt

SEQ ID NO: 4417779 - DNA, 16 bp, Homo sapiens
gaactgagccccagcg

SEQ ID NO: 4417780 - DNA, 17 bp, Homo sapiens
gaactgagctgggcagg

SEQ ID NO: 4417781 - DNA, 11 bp, Homo sapiens
gaactgaggag

SEQ ID NO: 4417782 - DNA, 21 bp, Homo sapiens
gaactgaggagatgaccaggg

SEQ ID NO: 4417783 - DNA, 23 bp, Homo sapiens
gaactgaggagatgaccagggat

SEQ ID NO: 4417784 - DNA, 16 bp, Homo sapiens
gaactgcagacctgtc

SEQ ID NO: 4417785 - DNA, 17 bp, Homo sapiens
gaactgcagacctgtcc

SEQ ID NO: 4417786 - DNA, 17 bp, Homo sapiens
gaactgctgggcttggc

SEQ ID NO: 4417787 - DNA, 20 bp, Homo sapiens
gaactgctgggcttggcagc

SEQ ID NO: 4417788 - DNA, 11 bp, Homo sapiens
gaactgggctg

SEQ ID NO: 4417789 - DNA, 13 bp, Homo sapiens
gaactgggctggc

SEQ ID NO: 4417790 - DNA, 17 bp, Homo sapiens
gaactgggctgggcctc

SEQ ID NO: 4417791 - DNA, 15 bp, Homo sapiens
gaactggtagaaaaa

SEQ ID NO: 4417792 - DNA, 14 bp, Homo sapiens
gaactggtcttcct

SEQ ID NO: 4417793 - DNA, 15 bp, Homo sapiens
gaactgtcccagcta

SEQ ID NO: 4417794 - DNA, 20 bp, Homo sapiens
gaactgtgtatttatttaaa

SEQ ID NO: 4417795 - DNA, 21 bp, Homo sapiens
gaactgttacaacttgtattt

SEQ ID NO: 4417796 - DNA, 22 bp, Homo sapiens
gaactgttgcctaattggaaag

SEQ ID NO: 4417797 - DNA, 18 bp, Homo sapiens
gaacttacttgcatacca

SEQ ID NO: 4417798 - DNA, 13 bp, Homo sapiens
gaacttatgtaca

SEQ ID NO: 4417799 - DNA, 15 bp, Homo sapiens
gaacttgaagctaac

SEQ ID NO: 4417800 - DNA, 12 bp, Homo sapiens
gaacttgcctct

SEQ ID NO: 4417801 - DNA, 24 bp, Homo sapiens
gaacttgcgagaaattcgtgtgtt

SEQ ID NO: 4417802 - DNA, 20 bp, Homo sapiens
gaacttgtgtccctaatgtg

SEQ ID NO: 4417803 - DNA, 21 bp, Homo sapiens
gaacttgttaacctttctaac

SEQ ID NO: 4417804 - DNA, 22 bp, Homo sapiens
gaactttagtttgcctgcagtt

SEQ ID NO: 4417805 - DNA, 19 bp, Homo sapiens
gaactttcatagcactgca

SEQ ID NO: 4417806 - DNA, 14 bp, Homo sapiens
gaactttcattttt

SEQ ID NO: 4417807 - DNA, 23 bp, Homo sapiens
gaactttcatttttttccaggct

SEQ ID NO: 4417808 - DNA, 15 bp, Homo sapiens
gaactttttttaagg

SEQ ID NO: 4417809 - DNA, 14 bp, Homo sapiens
gaagaaaaagaagc

SEQ ID NO: 4417810 - DNA, 14 bp, Homo sapiens
gaagaaaactatcc

SEQ ID NO: 4417811 - DNA, 20 bp, Homo sapiens
gaagaaacaaggttttcagt

SEQ ID NO: 4417812 - DNA, 20 bp, Homo sapiens
gaagaaactccgaagaaaag

SEQ ID NO: 4417813 - DNA, 17 bp, Homo sapiens
gaagaaagagaaggagc

SEQ ID NO: 4417814 - DNA, 22 bp, Homo sapiens
gaagaaagatttaaagtatttt

SEQ ID NO: 4417815 - DNA, 21 bp, Homo sapiens
gaagaaatggctatgaacaga

SEQ ID NO: 4417816 - DNA, 16 bp, Homo sapiens
gaagaacagccccggg

SEQ ID NO: 4417817 - DNA, 23 bp, Homo sapiens
gaagaacggggctcttctcattt

SEQ ID NO: 4417818 - DNA, 14 bp, Homo sapiens
gaagaactgttgcc

SEQ ID NO: 4417819 - DNA, 20 bp, Homo sapiens
gaagaagacctctaggagga

SEQ ID NO: 4417820 - DNA, 16 bp, Homo sapiens
gaagaagggagaagaa

SEQ ID NO: 4417821 - DNA, 16 bp, Homo sapiens
gaagaagttaattctt

SEQ ID NO: 4417822 - DNA, 12 bp, Homo sapiens
gaagaagttttt

SEQ ID NO: 4417823 - DNA, 16 bp, Homo sapiens
gaagaataaattctac

SEQ ID NO: 4417824 - DNA, 15 bp, Homo sapiens
gaagaatcacgattt

SEQ ID NO: 4417825 - DNA, 20 bp, Homo sapiens
gaagaattgaacccaggagg

SEQ ID NO: 4417826 - DNA, 14 bp, Homo sapiens
gaagaatttgaaga

SEQ ID NO: 4417827 - DNA, 16 bp, Homo sapiens
gaagacaacagaaaga

SEQ ID NO: 4417828 - DNA, 17 bp, Homo sapiens
gaagacaacagaaagag

SEQ ID NO: 4417829 - DNA, 15 bp, Homo sapiens
gaagacagcttccca

SEQ ID NO: 4417830 - DNA, 12 bp, Homo sapiens
gaagacattttg

SEQ ID NO: 4417831 - DNA, 23 bp, Homo sapiens
gaagactatcttactatttcaca

SEQ ID NO: 4417832 - DNA, 19 bp, Homo sapiens
gaagagaagagggcccagc

SEQ ID NO: 4417833 - DNA, 22 bp, Homo sapiens
gaagagcacggtcccccaggag

SEQ ID NO: 4417834 - DNA, 23 bp, Homo sapiens
gaagagcacggtcccccaggagg

SEQ ID NO: 4417835 - DNA, 10 bp, Homo sapiens
gaagagccac

SEQ ID NO: 4417836 - DNA, 23 bp, Homo sapiens
gaagagccacctgcaagatggac

SEQ ID NO: 4417837 - DNA, 16 bp, Homo sapiens
gaagagccggtggtgc

SEQ ID NO: 4417838 - DNA, 14 bp, Homo sapiens
gaagagctcttggc

SEQ ID NO: 4417839 - DNA, 13 bp, Homo sapiens
gaagagctgttca

SEQ ID NO: 4417840 - DNA, 23 bp, Homo sapiens
gaagagctgttcacagccagact

SEQ ID NO: 4417841 - DNA, 17 bp, Homo sapiens
gaagagcttgcacagcc

SEQ ID NO: 4417842 - DNA, 14 bp, Homo sapiens
gaagaggaccagag

SEQ ID NO: 4417843 - DNA, 18 bp, Homo sapiens
gaagagggaaaacagaaa

SEQ ID NO: 4417844 - DNA, 17 bp, Homo sapiens
gaagagggcccagccca

SEQ ID NO: 4417845 - DNA, 18 bp, Homo sapiens
gaagagggcccagcccag

SEQ ID NO: 4417846 - DNA, 22 bp, Homo sapiens
gaagagggcccagcccagagcc

SEQ ID NO: 4417847 - DNA, 23 bp, Homo sapiens
gaagaggggtggtggggggcagg

SEQ ID NO: 4417848 - DNA, 22 bp, Homo sapiens
gaagaggttgggcttccatgcc

SEQ ID NO: 4417849 - DNA, 23 bp, Homo sapiens
gaagagtaagtcaacctgcctga

SEQ ID NO: 4417850 - DNA, 13 bp, Homo sapiens
gaagagtcatttt

SEQ ID NO: 4417851 - DNA, 14 bp, Homo sapiens
gaagatcagatgca

SEQ ID NO: 4417852 - DNA, 15 bp, Homo sapiens
gaagatcatggacct

SEQ ID NO: 4417853 - DNA, 16 bp, Homo sapiens
gaagatcccctcagga

SEQ ID NO: 4417854 - DNA, 20 bp, Homo sapiens
gaagatgaaatatatattgt

SEQ ID NO: 4417855 - DNA, 16 bp, Homo sapiens
gaagatgcctgttaat

SEQ ID NO: 4417856 - DNA, 15 bp, Homo sapiens
gaagatggagggggc

SEQ ID NO: 4417857 - DNA, 20 bp, Homo sapiens
gaagatggagggggctgggg

SEQ ID NO: 4417858 - DNA, 17 bp, Homo sapiens
cttgctttcctgggcct

SEQ ID NO: 4417859 - DNA, 18 bp, Homo sapiens
cttgctttcctgggcctt

SEQ ID NO: 4417860 - DNA, 14 bp, Homo sapiens
cttgcttttttcca

SEQ ID NO: 4417861 - DNA, 18 bp, Homo sapiens
cttggaaaaacagcgtct

SEQ ID NO: 4417862 - DNA, 12 bp, Homo sapiens
cttggaaaataa

SEQ ID NO: 4417863 - DNA, 14 bp, Homo sapiens
cttggaaaataaga

SEQ ID NO: 4417864 - DNA, 19 bp, Homo sapiens
cttggaaaataagacaata

SEQ ID NO: 4417865 - DNA, 17 bp, Homo sapiens
cttggaaatagaaagaa

SEQ ID NO: 4417866 - DNA, 21 bp, Homo sapiens
cttggaaatagaaagaagcca

SEQ ID NO: 4417867 - DNA, 15 bp, Homo sapiens
cttggaaccagcccc

SEQ ID NO: 4417868 - DNA, 19 bp, Homo sapiens
cttggaagctgtttggaaa

SEQ ID NO: 4417869 - DNA, 22 bp, Homo sapiens
cttggaaggtcttttgagggct

SEQ ID NO: 4417870 - DNA, 14 bp, Homo sapiens
cttggacaaatcac

SEQ ID NO: 4417871 - DNA, 16 bp, Homo sapiens
cttggaccagatctaa

SEQ ID NO: 4417872 - DNA, 18 bp, Homo sapiens
cttggaccatgccagatt

SEQ ID NO: 4417873 - DNA, 16 bp, Homo sapiens
cttggactcattttaa

SEQ ID NO: 4417874 - DNA, 20 bp, Homo sapiens
cttggagactcctggtctgt

SEQ ID NO: 4417875 - DNA, 18 bp, Homo sapiens
cttggagagggcccaggt

SEQ ID NO: 4417876 - DNA, 13 bp, Homo sapiens
cttggagctgctt

SEQ ID NO: 4417877 - DNA, 18 bp, Homo sapiens
cttggaggaaatgtgctc

SEQ ID NO: 4417878 - DNA, 16 bp, Homo sapiens
cttggaggaatgacaa

SEQ ID NO: 4417879 - DNA, 23 bp, Homo sapiens
cttggagggatggagaggcggcc

SEQ ID NO: 4417880 - DNA, 15 bp, Homo sapiens
cttggagtcccaggg

SEQ ID NO: 4417881 - DNA, 18 bp, Homo sapiens
cttggataatgctgttgc

SEQ ID NO: 4417882 - DNA, 16 bp, Homo sapiens
cttggatacttggatt

SEQ ID NO: 4417883 - DNA, 21 bp, Homo sapiens
cttggatagctaataatgagc

SEQ ID NO: 4417884 - DNA, 14 bp, Homo sapiens
cttggatcccaaag

SEQ ID NO: 4417885 - DNA, 14 bp, Homo sapiens
cttggatctggggt

SEQ ID NO: 4417886 - DNA, 18 bp, Homo sapiens
cttggatgtacctgcccc

SEQ ID NO: 4417887 - DNA, 14 bp, Homo sapiens
cttggcacccccat

SEQ ID NO: 4417888 - DNA, 21 bp, Homo sapiens
cttggcacccccatgctgcct

SEQ ID NO: 4417889 - DNA, 22 bp, Homo sapiens
cttggcacccccatgctgcctt

SEQ ID NO: 4417890 - DNA, 15 bp, Homo sapiens
cttggcatagacatg

SEQ ID NO: 4417891 - DNA, 15 bp, Homo sapiens
cttggcattggaatt

SEQ ID NO: 4417892 - DNA, 16 bp, Homo sapiens
cttggcattggaattc

SEQ ID NO: 4417893 - DNA, 18 bp, Homo sapiens
cttggccatgcagaaagc

SEQ ID NO: 4417894 - DNA, 15 bp, Homo sapiens
cttggccctttcctt

SEQ ID NO: 4417895 - DNA, 23 bp, Homo sapiens
cttggcctcagaattcacaaaat

SEQ ID NO: 4417896 - DNA, 16 bp, Homo sapiens
cttggcctgctgtgat

SEQ ID NO: 4417897 - DNA, 17 bp, Homo sapiens
cttggcctgtctcatcc

SEQ ID NO: 4417898 - DNA, 20 bp, Homo sapiens
cttggctgccgtctggccgg

SEQ ID NO: 4417899 - DNA, 16 bp, Homo sapiens
cttgggaggaaacctg

SEQ ID NO: 4417900 - DNA, 21 bp, Homo sapiens
cttgggcagtgccccagggag

SEQ ID NO: 4417901 - DNA, 20 bp, Homo sapiens
cttgggcccggtccacaggt

SEQ ID NO: 4417902 - DNA, 13 bp, Homo sapiens
cttgggctccctg

SEQ ID NO: 4417903 - DNA, 21 bp, Homo sapiens
cttgggctccctgtaacctct

SEQ ID NO: 4417904 - DNA, 14 bp, Homo sapiens
cttgggctgctcct

SEQ ID NO: 4417905 - DNA, 16 bp, Homo sapiens
cttggggaatttcctc

SEQ ID NO: 4417906 - DNA, 13 bp, Homo sapiens
cttggggaggcaa

SEQ ID NO: 4417907 - DNA, 20 bp, Homo sapiens
cttggggagtttagggtggg

SEQ ID NO: 4417908 - DNA, 21 bp, Homo sapiens
cttgggggacagggctggccc

SEQ ID NO: 4417909 - DNA, 18 bp, Homo sapiens
cttgggggaggccacccc

SEQ ID NO: 4417910 - DNA, 17 bp, Homo sapiens
cttggggtaagccagag

SEQ ID NO: 4417911 - DNA, 18 bp, Homo sapiens
cttggggtgtggggtggg

SEQ ID NO: 4417912 - DNA, 19 bp, Homo sapiens
cttggggtgtggggtgggg

SEQ ID NO: 4417913 - DNA, 22 bp, Homo sapiens
cttgggtctctctcggcccctg

SEQ ID NO: 4417914 - DNA, 16 bp, Homo sapiens
cttgggtttaacaagc

SEQ ID NO: 4417915 - DNA, 19 bp, Homo sapiens
cttggtaagtgaatttatg

SEQ ID NO: 4417916 - DNA, 14 bp, Homo sapiens
cttggtactgaaaa

SEQ ID NO: 4417917 - DNA, 15 bp, Homo sapiens
cttggtcagagccac

SEQ ID NO: 4417918 - DNA, 17 bp, Homo sapiens
cttggtcctggcagggc

SEQ ID NO: 4417919 - DNA, 23 bp, Homo sapiens
cttggtctcagtgtcaatgcagc

SEQ ID NO: 4417920 - DNA, 17 bp, Homo sapiens
cttggtgacaaaattca

SEQ ID NO: 4417921 - DNA, 16 bp, Homo sapiens
cttggtgactgtccca

SEQ ID NO: 4417922 - DNA, 12 bp, Homo sapiens
cttggtgtaatt

SEQ ID NO: 4417923 - DNA, 15 bp, Homo sapiens
cttggtgtttgactg

SEQ ID NO: 4417924 - DNA, 19 bp, Homo sapiens
cttggttcccccactgatc

SEQ ID NO: 4417925 - DNA, 15 bp, Homo sapiens
cttggttgttaattt

SEQ ID NO: 4417926 - DNA, 19 bp, Homo sapiens
cttggttgttcctttttct

SEQ ID NO: 4417927 - DNA, 16 bp, Homo sapiens
cttgtaaaatgctttt

SEQ ID NO: 4417928 - DNA, 20 bp, Homo sapiens
cttgtaaaatgcttttcact

SEQ ID NO: 4417929 - DNA, 12 bp, Homo sapiens
cttgtaaagact

SEQ ID NO: 4417930 - DNA, 13 bp, Homo sapiens
cttgtaaagactg

SEQ ID NO: 4417931 - DNA, 14 bp, Homo sapiens
cttgtaaagactgg

SEQ ID NO: 4417932 - DNA, 12 bp, Homo sapiens
cttgtaaatatc

SEQ ID NO: 4417933 - DNA, 19 bp, Homo sapiens
cttgtaaatatcttttttc

SEQ ID NO: 4417934 - DNA, 17 bp, Homo sapiens
cttgtaactccaccaac

SEQ ID NO: 4417935 - DNA, 14 bp, Homo sapiens
cttgtacaaacttt

SEQ ID NO: 4417936 - DNA, 18 bp, Homo sapiens
cttgtacaaactttgttt

SEQ ID NO: 4417937 - DNA, 19 bp, Homo sapiens
cttgtacaaactttgtttt

SEQ ID NO: 4417938 - DNA, 16 bp, Homo sapiens
cttgtattgtaaatgt

SEQ ID NO: 4417939 - DNA, 15 bp, Homo sapiens
cttgtatttaaaaac

SEQ ID NO: 4417940 - DNA, 23 bp, Homo sapiens
cttgtcacgccagacttcccacg

SEQ ID NO: 4417941 - DNA, 19 bp, Homo sapiens
cttgtcatatcactaaata

SEQ ID NO: 4417942 - DNA, 19 bp, Homo sapiens
cttgtcccaattaaaatac

SEQ ID NO: 4417943 - DNA, 13 bp, Homo sapiens
ctttattgtctgt

SEQ ID NO: 4417944 - DNA, 14 bp, Homo sapiens
ctttatttatttct

SEQ ID NO: 4417945 - DNA, 11 bp, Homo sapiens
ctttatttctg

SEQ ID NO: 4417946 - DNA, 23 bp, Homo sapiens
ctttattttaaaaaacactgata

SEQ ID NO: 4417947 - DNA, 22 bp, Homo sapiens
ctttattttatataataaagta

SEQ ID NO: 4417948 - DNA, 17 bp, Homo sapiens
ctttcaaacagctattg

SEQ ID NO: 4417949 - DNA, 20 bp, Homo sapiens
ctttcaaagctaaaatatat

SEQ ID NO: 4417950 - DNA, 14 bp, Homo sapiens
ctttcaaatttaga

SEQ ID NO: 4417951 - DNA, 15 bp, Homo sapiens
ctttcaactgtttca

SEQ ID NO: 4417952 - DNA, 17 bp, Homo sapiens
ctttcaagatctaaatc

SEQ ID NO: 4417953 - DNA, 19 bp, Homo sapiens
ctttcaattgtcacttttt

SEQ ID NO: 4417954 - DNA, 13 bp, Homo sapiens
ctttcacaagcaa

SEQ ID NO: 4417955 - DNA, 15 bp, Homo sapiens
ctttcactataatgt

SEQ ID NO: 4417956 - DNA, 12 bp, Homo sapiens
ctttcagatgtc

SEQ ID NO: 4417957 - DNA, 15 bp, Homo sapiens
ctttcagatgtcttc

SEQ ID NO: 4417958 - DNA, 21 bp, Homo sapiens
ctttcagatgtcttctgcctg

SEQ ID NO: 4417959 - DNA, 19 bp, Homo sapiens
ctttcagccacatgcccca

SEQ ID NO: 4417960 - DNA, 20 bp, Homo sapiens
ctttcagccacatgccccag

SEQ ID NO: 4417961 - DNA, 19 bp, Homo sapiens
ctttcaggctactgttctt

SEQ ID NO: 4417962 - DNA, 21 bp, Homo sapiens
ctttcagtacttttttaaata

SEQ ID NO: 4417963 - DNA, 16 bp, Homo sapiens
ctttcatcacactggg

SEQ ID NO: 4417964 - DNA, 18 bp, Homo sapiens
ctttcatcacactgggtg

SEQ ID NO: 4417965 - DNA, 18 bp, Homo sapiens
ctttcatcctgactctgc

SEQ ID NO: 4417966 - DNA, 16 bp, Homo sapiens
ctttcatctacctttt

SEQ ID NO: 4417967 - DNA, 16 bp, Homo sapiens
ctttcatcttaaacta

SEQ ID NO: 4417968 - DNA, 19 bp, Homo sapiens
ctttcatgtaaactgtgca

SEQ ID NO: 4417969 - DNA, 17 bp, Homo sapiens
ctttcatgtcttgtcat

SEQ ID NO: 4417970 - DNA, 19 bp, Homo sapiens
ctttcattcggtgtgaact

SEQ ID NO: 4417971 - DNA, 15 bp, Homo sapiens
ctttcatttttgata

SEQ ID NO: 4417972 - DNA, 17 bp, Homo sapiens
ctttccaaaacatttct

SEQ ID NO: 4417973 - DNA, 22 bp, Homo sapiens
ctttccaaaacctaaagaggaa

SEQ ID NO: 4417974 - DNA, 14 bp, Homo sapiens
ctttccaatagaaa

SEQ ID NO: 4417975 - DNA, 15 bp, Homo sapiens
ctttccaatagaaag

SEQ ID NO: 4417976 - DNA, 23 bp, Homo sapiens
ctttccagagcaaccagaaggag

SEQ ID NO: 4417977 - DNA, 21 bp, Homo sapiens
ctttccagctcaccccccaca

SEQ ID NO: 4417978 - DNA, 11 bp, Homo sapiens
ctttccaggca

SEQ ID NO: 4417979 - DNA, 12 bp, Homo sapiens
ctttccaggcac

SEQ ID NO: 4417980 - DNA, 19 bp, Homo sapiens
ctttccaggcaccctcagg

SEQ ID NO: 4417981 - DNA, 21 bp, Homo sapiens
ctttccaggcttccctgactt

SEQ ID NO: 4417982 - DNA, 17 bp, Homo sapiens
ctttcccacctctctcc

SEQ ID NO: 4417983 - DNA, 18 bp, Homo sapiens
ctttcccatgtatttgtt

SEQ ID NO: 4417984 - DNA, 13 bp, Homo sapiens
ctttccccagagg

SEQ ID NO: 4417985 - DNA, 11 bp, Homo sapiens
ctttccctcac

SEQ ID NO: 4417986 - DNA, 14 bp, Homo sapiens
ctttccctcacccc

SEQ ID NO: 4417987 - DNA, 22 bp, Homo sapiens
ctttccctcctaaagctgaatc

SEQ ID NO: 4417988 - DNA, 10 bp, Homo sapiens
ctttcccttc

SEQ ID NO: 4417989 - DNA, 21 bp, Homo sapiens
ctttcccttcccctgtggtct

SEQ ID NO: 4417990 - DNA, 18 bp, Homo sapiens
ctttcccttgtgtcaaga

SEQ ID NO: 4417991 - DNA, 18 bp, Homo sapiens
ctttcctaaagtctctgc

SEQ ID NO: 4417992 - DNA, 13 bp, Homo sapiens
ctttcctatcacc

SEQ ID NO: 4417993 - DNA, 19 bp, Homo sapiens
ctttcctccttcactgttt

SEQ ID NO: 4417994 - DNA, 12 bp, Homo sapiens
ctttcctccttt

SEQ ID NO: 4417995 - DNA, 13 bp, Homo sapiens
ctttcctcctttc

SEQ ID NO: 4417996 - DNA, 17 bp, Homo sapiens
ctttcctctaatccagc

SEQ ID NO: 4417997 - DNA, 19 bp, Homo sapiens
ctttcctgcatctctgtga

SEQ ID NO: 4417998 - DNA, 11 bp, Homo sapiens
ctttcctgccc

SEQ ID NO: 4417999 - DNA, 18 bp, Homo sapiens
ctttcctgccctgtccaa

SEQ ID NO: 4418000 - DNA, 14 bp, Homo sapiens
ctttcctgttcagc

SEQ ID NO: 4418001 - DNA, 14 bp, Homo sapiens
ctttccttccctct

SEQ ID NO: 4418002 - DNA, 17 bp, Homo sapiens
ctttccttccctctctg

SEQ ID NO: 4418003 - DNA, 18 bp, Homo sapiens
ctttccttccctctctga

SEQ ID NO: 4418004 - DNA, 13 bp, Homo sapiens
ctttcctttaaaa

SEQ ID NO: 4418005 - DNA, 14 bp, Homo sapiens
ctttcctttaaaaa

SEQ ID NO: 4418006 - DNA, 13 bp, Homo sapiens
ctttctaagaaat

SEQ ID NO: 4418007 - DNA, 14 bp, Homo sapiens
ctttctaagaaatc

SEQ ID NO: 4418008 - DNA, 20 bp, Homo sapiens
ctttctaccacacacagcct

SEQ ID NO: 4418009 - DNA, 21 bp, Homo sapiens
ctttctaccacacacagcctg

SEQ ID NO: 4418010 - DNA, 22 bp, Homo sapiens
ctttctaccacacacagcctgt

SEQ ID NO: 4418011 - DNA, 23 bp, Homo sapiens
ctttctagacatcattgtcagcc

SEQ ID NO: 4418012 - DNA, 18 bp, Homo sapiens
ctttctagggacatgaaa

SEQ ID NO: 4418013 - DNA, 16 bp, Homo sapiens
ctttctatcctctgta

SEQ ID NO: 4418014 - DNA, 17 bp, Homo sapiens
ctttctatcctctgtaa

SEQ ID NO: 4418015 - DNA, 15 bp, Homo sapiens
ctttctattgtacag

SEQ ID NO: 4418016 - DNA, 17 bp, Homo sapiens
ctttctattgtacagaa

SEQ ID NO: 4418017 - DNA, 15 bp, Homo sapiens
ctttctcagttttca

SEQ ID NO: 4418018 - DNA, 20 bp, Homo sapiens
ctttctcagttttcataagt

SEQ ID NO: 4418019 - DNA, 16 bp, Homo sapiens
ctttctcccagtatgt

SEQ ID NO: 4418020 - DNA, 19 bp, Homo sapiens
ctttctcccagtatgtttt

SEQ ID NO: 4418021 - DNA, 14 bp, Homo sapiens
ctttctcccctgcc

SEQ ID NO: 4418022 - DNA, 18 bp, Homo sapiens
ctttctcccctgccccca

SEQ ID NO: 4418023 - DNA, 22 bp, Homo sapiens
ctttctcccctgcccccaggac

SEQ ID NO: 4418024 - DNA, 22 bp, Homo sapiens
ctttctcctgtgaatggaggca

SEQ ID NO: 4418025 - DNA, 15 bp, Homo sapiens
ctttctccttgaata

SEQ ID NO: 4418026 - DNA, 18 bp, Homo sapiens
ctttctcctttaattgta

SEQ ID NO: 4418027 - DNA, 17 bp, Homo sapiens
ctttctctcactgtcta

SEQ ID NO: 4418028 - DNA, 14 bp, Homo sapiens
ctttctctcagtga

SEQ ID NO: 4418029 - DNA, 19 bp, Homo sapiens
ctttctctcccctcctctg

SEQ ID NO: 4418030 - DNA, 16 bp, Homo sapiens
ctttctctcctttctt

SEQ ID NO: 4418031 - DNA, 17 bp, Homo sapiens
ctttctctcctttcttt

SEQ ID NO: 4418032 - DNA, 20 bp, Homo sapiens
ctttctctctcctctctgct

SEQ ID NO: 4418033 - DNA, 20 bp, Homo sapiens
ctttctgagtgagttttact

SEQ ID NO: 4418034 - DNA, 13 bp, Homo sapiens
ctttctgcccggc

SEQ ID NO: 4418035 - DNA, 19 bp, Homo sapiens
ctttctgctatgtgtggta

SEQ ID NO: 4418036 - DNA, 18 bp, Homo sapiens
ctttctggcaggtcctcc

SEQ ID NO: 4418037 - DNA, 13 bp, Homo sapiens
ctttctgtatata

SEQ ID NO: 4418038 - DNA, 23 bp, Homo sapiens
ctttctgtctaggttaaagctaa

SEQ ID NO: 4418039 - DNA, 13 bp, Homo sapiens
ctttctgtcttgt

SEQ ID NO: 4418040 - DNA, 13 bp, Homo sapiens
ctttctgttccaa

SEQ ID NO: 4418041 - DNA, 20 bp, Homo sapiens
ctttctgttccaaattcagt

SEQ ID NO: 4418042 - DNA, 22 bp, Homo sapiens
ctttctgttccaaattcagttt

SEQ ID NO: 4418043 - DNA, 13 bp, Homo sapiens
ctttcttccaaac

SEQ ID NO: 4418044 - DNA, 19 bp, Homo sapiens
ctttcttccaaacaggctc

SEQ ID NO: 4418045 - DNA, 21 bp, Homo sapiens
ctttcttggagtgccaagttt

SEQ ID NO: 4418046 - DNA, 12 bp, Homo sapiens
ctttctttgatt

SEQ ID NO: 4418047 - DNA, 12 bp, Homo sapiens
ctttctttgcct

SEQ ID NO: 4418048 - DNA, 14 bp, Homo sapiens
ctttctttgcctct

SEQ ID NO: 4418049 - DNA, 17 bp, Homo sapiens
ctttctttgcctctgca

SEQ ID NO: 4418050 - DNA, 18 bp, Homo sapiens
ctttctttgcctctgcag

SEQ ID NO: 4418051 - DNA, 21 bp, Homo sapiens
ctttctttgcctctgcagtct

SEQ ID NO: 4418052 - DNA, 18 bp, Homo sapiens
ctttctttggtgcctttc

SEQ ID NO: 4418053 - DNA, 23 bp, Homo sapiens
ctttctttggtgcctttcctgtt

SEQ ID NO: 4418054 - DNA, 19 bp, Homo sapiens
ctttctttgtttctttctt

SEQ ID NO: 4418055 - DNA, 22 bp, Homo sapiens
ctttctttgtttctttcttcct

SEQ ID NO: 4418056 - DNA, 22 bp, Homo sapiens
ctttctttttcttttttgcttt

SEQ ID NO: 4418057 - DNA, 13 bp, Homo sapiens
ctttgaaaaagcc

SEQ ID NO: 4418058 - DNA, 20 bp, Homo sapiens
ctttgaaacctcagggctgt

SEQ ID NO: 4418059 - DNA, 19 bp, Homo sapiens
ctttgaaatagtctgtgtg

SEQ ID NO: 4418060 - DNA, 21 bp, Homo sapiens
ctttgaaatagtctgtgtgaa

SEQ ID NO: 4418061 - DNA, 17 bp, Homo sapiens
ctttgaactttagtttg

SEQ ID NO: 4418062 - DNA, 20 bp, Homo sapiens
cttcaaggactgtttcagtg

SEQ ID NO: 4418063 - DNA, 21 bp, Homo sapiens
cttcaaggactgtttcagtgt

SEQ ID NO: 4418064 - DNA, 19 bp, Homo sapiens
cttcaagtgccaaacagag

SEQ ID NO: 4418065 - DNA, 13 bp, Homo sapiens
cttcaataaacca

SEQ ID NO: 4418066 - DNA, 17 bp, Homo sapiens
cttcaatataagaagca

SEQ ID NO: 4418067 - DNA, 14 bp, Homo sapiens
cttcaatcccagcc

SEQ ID NO: 4418068 - DNA, 19 bp, Homo sapiens
cttcaatgtgtcatttccg

SEQ ID NO: 4418069 - DNA, 22 bp, Homo sapiens
cttcaatttcaaacttttgaaa

SEQ ID NO: 4418070 - DNA, 15 bp, Homo sapiens
cttcacaaaatgcac

SEQ ID NO: 4418071 - DNA, 12 bp, Homo sapiens
cttcacaaatgt

SEQ ID NO: 4418072 - DNA, 14 bp, Homo sapiens
cttcacaaatgtca

SEQ ID NO: 4418073 - DNA, 20 bp, Homo sapiens
cttcacaaatgtcattgtct

SEQ ID NO: 4418074 - DNA, 22 bp, Homo sapiens
cttcacaaatgtcattgtctac

SEQ ID NO: 4418075 - DNA, 23 bp, Homo sapiens
cttcacaaatgtcattgtctact

SEQ ID NO: 4418076 - DNA, 14 bp, Homo sapiens
cttcacaacagatt

SEQ ID NO: 4418077 - DNA, 20 bp, Homo sapiens
cttcacactgcaagagcctt

SEQ ID NO: 4418078 - DNA, 21 bp, Homo sapiens
cttcacactgcaagagccttg

SEQ ID NO: 4418079 - DNA, 14 bp, Homo sapiens
cttcaccaccccct

SEQ ID NO: 4418080 - DNA, 18 bp, Homo sapiens
cttcaccatctacctgct

SEQ ID NO: 4418081 - DNA, 14 bp, Homo sapiens
cttcacccaccagg

SEQ ID NO: 4418082 - DNA, 16 bp, Homo sapiens
cttcacccaccaggcc

SEQ ID NO: 4418083 - DNA, 17 bp, Homo sapiens
cttcacccaccaggcca

SEQ ID NO: 4418084 - DNA, 21 bp, Homo sapiens
cttcacccaccaggccagctc

SEQ ID NO: 4418085 - DNA, 14 bp, Homo sapiens
cttcaccccagtgg

SEQ ID NO: 4418086 - DNA, 14 bp, Homo sapiens
cttcacccccaact

SEQ ID NO: 4418087 - DNA, 22 bp, Homo sapiens
cttcacccgagttcctctgggt

SEQ ID NO: 4418088 - DNA, 21 bp, Homo sapiens
cttcactcatgcaaactgctt

SEQ ID NO: 4418089 - DNA, 19 bp, Homo sapiens
cttcactgcaattttgtgt

SEQ ID NO: 4418090 - DNA, 12 bp, Homo sapiens
cttcactgtata

SEQ ID NO: 4418091 - DNA, 16 bp, Homo sapiens
cttcacttcaagctgt

SEQ ID NO: 4418092 - DNA, 16 bp, Homo sapiens
cttcactttcttcaaa

SEQ ID NO: 4418093 - DNA, 15 bp, Homo sapiens
cttcagaacagaggc

SEQ ID NO: 4418094 - DNA, 16 bp, Homo sapiens
cttcagaacagaggca

SEQ ID NO: 4418095 - DNA, 18 bp, Homo sapiens
cttcagagagaatgagca

SEQ ID NO: 4418096 - DNA, 23 bp, Homo sapiens
cttcagcaaccctacagtatata

SEQ ID NO: 4418097 - DNA, 13 bp, Homo sapiens
cttcagccttaat

SEQ ID NO: 4418098 - DNA, 22 bp, Homo sapiens
cttcagctctggggcagaggaa

SEQ ID NO: 4418099 - DNA, 13 bp, Homo sapiens
cttcaggactctg

SEQ ID NO: 4418100 - DNA, 15 bp, Homo sapiens
cttcaggcctccctc

SEQ ID NO: 4418101 - DNA, 23 bp, Homo sapiens
cttcagggctgagttctgggttt

SEQ ID NO: 4418102 - DNA, 21 bp, Homo sapiens
cttcaggtggagagcactaga

SEQ ID NO: 4418103 - DNA, 20 bp, Homo sapiens
cttcaggtgtgactctagca

SEQ ID NO: 4418104 - DNA, 16 bp, Homo sapiens
cttcaggttgcattgg

SEQ ID NO: 4418105 - DNA, 19 bp, Homo sapiens
cttcagtgagcccctcccc

SEQ ID NO: 4418106 - DNA, 11 bp, Homo sapiens
cttcagtgccc

SEQ ID NO: 4418107 - DNA, 13 bp, Homo sapiens
cttcagtgcccac

SEQ ID NO: 4418108 - DNA, 17 bp, Homo sapiens
cttcagttggtgtgttt

SEQ ID NO: 4418109 - DNA, 20 bp, Homo sapiens
cttcagttggtgtgtttttg

SEQ ID NO: 4418110 - DNA, 16 bp, Homo sapiens
cttcagtttttcactt

SEQ ID NO: 4418111 - DNA, 18 bp, Homo sapiens
cttcatatcatccacaca

SEQ ID NO: 4418112 - DNA, 22 bp, Homo sapiens
cttcatatgaaaggtgccatgg

SEQ ID NO: 4418113 - DNA, 22 bp, Homo sapiens
cttcatccatagacacagtatt

SEQ ID NO: 4418114 - DNA, 18 bp, Homo sapiens
cttcatccgttgtgactc

SEQ ID NO: 4418115 - DNA, 15 bp, Homo sapiens
cttcatcgaatctac

SEQ ID NO: 4418116 - DNA, 19 bp, Homo sapiens
cttcatctggcaacatctt

SEQ ID NO: 4418117 - DNA, 12 bp, Homo sapiens
cttcatgaaatg

SEQ ID NO: 4418118 - DNA, 16 bp, Homo sapiens
cttcatgaaatgtgtt

SEQ ID NO: 4418119 - DNA, 12 bp, Homo sapiens
cttcatgctttt

SEQ ID NO: 4418120 - DNA, 13 bp, Homo sapiens
cttcatggatcag

SEQ ID NO: 4418121 - DNA, 14 bp, Homo sapiens
cttcattattctct

SEQ ID NO: 4418122 - DNA, 15 bp, Homo sapiens
cttcattattctctg

SEQ ID NO: 4418123 - DNA, 22 bp, Homo sapiens
cttcattctcgtgagtcattta

SEQ ID NO: 4418124 - DNA, 18 bp, Homo sapiens
cttcattctgagaccaaa

SEQ ID NO: 4418125 - DNA, 13 bp, Homo sapiens
cttcattgaaagc

SEQ ID NO: 4418126 - DNA, 15 bp, Homo sapiens
cttcattgtttggac

SEQ ID NO: 4418127 - DNA, 22 bp, Homo sapiens
cttcatttaactctttgaaact

SEQ ID NO: 4418128 - DNA, 16 bp, Homo sapiens
cttcatttccaccagg

SEQ ID NO: 4418129 - DNA, 20 bp, Homo sapiens
cttcatttccaccaggccgt

SEQ ID NO: 4418130 - DNA, 11 bp, Homo sapiens
cttcatttgta

SEQ ID NO: 4418131 - DNA, 14 bp, Homo sapiens
cttcattttatatt

SEQ ID NO: 4418132 - DNA, 19 bp, Homo sapiens
cttcattttttttaattga

SEQ ID NO: 4418133 - DNA, 16 bp, Homo sapiens
cttccaaatcccctaa

SEQ ID NO: 4418134 - DNA, 14 bp, Homo sapiens
cttccaacttcctg

SEQ ID NO: 4418135 - DNA, 16 bp, Homo sapiens
cttccaatgctgtggg

SEQ ID NO: 4418136 - DNA, 16 bp, Homo sapiens
cttccacaaaattaga

SEQ ID NO: 4418137 - DNA, 13 bp, Homo sapiens
cttccacagtggc

SEQ ID NO: 4418138 - DNA, 23 bp, Homo sapiens
cttccacagtggcgggcccactc

SEQ ID NO: 4418139 - DNA, 18 bp, Homo sapiens
cttccacccgtctctctg

SEQ ID NO: 4418140 - DNA, 14 bp, Homo sapiens
cttccactgagggc

SEQ ID NO: 4418141 - DNA, 12 bp, Homo sapiens
cttccagatcct

SEQ ID NO: 4418142 - DNA, 19 bp, Homo sapiens
cttccagatcctctctggg

SEQ ID NO: 4418143 - DNA, 21 bp, Homo sapiens
cttccagatcctctctggggc

SEQ ID NO: 4418144 - DNA, 22 bp, Homo sapiens
cttccagatcctctctggggct

SEQ ID NO: 4418145 - DNA, 22 bp, Homo sapiens
cttccagccacattgagacttt

SEQ ID NO: 4418146 - DNA, 21 bp, Homo sapiens
cttccaggaaactccacatct

SEQ ID NO: 4418147 - DNA, 23 bp, Homo sapiens
cttccaggaaactccacatctgc

SEQ ID NO: 4418148 - DNA, 17 bp, Homo sapiens
cttccaggctgagagcc

SEQ ID NO: 4418149 - DNA, 20 bp, Homo sapiens
cttccagggctcttccagat

SEQ ID NO: 4418150 - DNA, 16 bp, Homo sapiens
cttccaggtctgcctg

SEQ ID NO: 4418151 - DNA, 19 bp, Homo sapiens
cttccaggtctgcctggtt

SEQ ID NO: 4418152 - DNA, 20 bp, Homo sapiens
cttccagtcttcctgacact

SEQ ID NO: 4418153 - DNA, 17 bp, Homo sapiens
cttccatagctgctgcc

SEQ ID NO: 4418154 - DNA, 19 bp, Homo sapiens
cttccatcatcactgtaaa

SEQ ID NO: 4418155 - DNA, 12 bp, Homo sapiens
cttccatctctt

SEQ ID NO: 4418156 - DNA, 14 bp, Homo sapiens
cttccatctcttcc

SEQ ID NO: 4418157 - DNA, 18 bp, Homo sapiens
cttccatctcttccttca

SEQ ID NO: 4418158 - DNA, 17 bp, Homo sapiens
cttccatgattctattt

SEQ ID NO: 4418159 - DNA, 22 bp, Homo sapiens
cttccatggtactgtagcaggg

SEQ ID NO: 4418160 - DNA, 13 bp, Homo sapiens
cttccatgtgcct

SEQ ID NO: 4418161 - DNA, 16 bp, Homo sapiens
cttccatgtgcctttc

SEQ ID NO: 4418162 - DNA, 15 bp, Homo sapiens
cttccatgttctggg

SEQ ID NO: 4418163 - DNA, 19 bp, Homo sapiens
ctgtagggtttggacagac

SEQ ID NO: 4418164 - DNA, 19 bp, Homo sapiens
ctgtagtaatttattgtct

SEQ ID NO: 4418165 - DNA, 20 bp, Homo sapiens
ctggagggctagaacctgga

SEQ ID NO: 4418166 - DNA, 22 bp, Homo sapiens
ctggagggctagaacctggaga

SEQ ID NO: 4418167 - DNA, 21 bp, Homo sapiens
ctggagggctagaactggaga

SEQ ID NO: 4418168 - DNA, 17 bp, Homo sapiens
ctggaggggtggcccag

SEQ ID NO: 4418169 - DNA, 19 bp, Homo sapiens
ctggaggggtggcccagag

SEQ ID NO: 4418170 - DNA, 20 bp, Homo sapiens
ctggaggggtggcccagagc

SEQ ID NO: 4418171 - DNA, 16 bp, Homo sapiens
ctggaggttgaagcca

SEQ ID NO: 4418172 - DNA, 12 bp, Homo sapiens
ctggaggtttgt

SEQ ID NO: 4418173 - DNA, 19 bp, Homo sapiens
ctggagtgggtagaagcct

SEQ ID NO: 4418174 - DNA, 18 bp, Homo sapiens
ctggagtgtggctgagga

SEQ ID NO: 4418175 - DNA, 21 bp, Homo sapiens
ctggagtgtggctgaggaggc

SEQ ID NO: 4418176 - DNA, 14 bp, Homo sapiens
ctggagttgctgaa

SEQ ID NO: 4418177 - DNA, 18 bp, Homo sapiens
ctggagtttcatgtacaa

SEQ ID NO: 4418178 - DNA, 22 bp, Homo sapiens
ctggagtttttgtttggagagc

SEQ ID NO: 4418179 - DNA, 23 bp, Homo sapiens
ctggagtttttgtttggagagca

SEQ ID NO: 4418180 - DNA, 13 bp, Homo sapiens
ctgtgtactgtgt

SEQ ID NO: 4418181 - DNA, 13 bp, Homo sapiens
ctgtgtactgttc

SEQ ID NO: 4418182 - DNA, 15 bp, Homo sapiens
ctgtgtataggaatt

SEQ ID NO: 4418183 - DNA, 16 bp, Homo sapiens
ctgtgtataggaattt

SEQ ID NO: 4418184 - DNA, 20 bp, Homo sapiens
ctgtgtatatctcttggaaa

SEQ ID NO: 4418185 - DNA, 17 bp, Homo sapiens
ctgtgtattaacatgca

SEQ ID NO: 4418186 - DNA, 21 bp, Homo sapiens
ctgtgtattaacatgcaataa

SEQ ID NO: 4418187 - DNA, 11 bp, Homo sapiens
ctgtgtattta

SEQ ID NO: 4418188 - DNA, 13 bp, Homo sapiens
ctgtgtatttaat

SEQ ID NO: 4418189 - DNA, 17 bp, Homo sapiens
ctgtgtatttatttaaa

SEQ ID NO: 4418190 - DNA, 23 bp, Homo sapiens
ctgtgtatttatttaaaactctg

SEQ ID NO: 4418191 - DNA, 16 bp, Homo sapiens
ctgtgtattttcagtc

SEQ ID NO: 4418192 - DNA, 14 bp, Homo sapiens
ctgtgtcactgaat

SEQ ID NO: 4418193 - DNA, 19 bp, Homo sapiens
ctgtgtcccatgtcccgtg

SEQ ID NO: 4418194 - DNA, 16 bp, Homo sapiens
ctgtgtccttgcacct

SEQ ID NO: 4418195 - DNA, 18 bp, Homo sapiens
ctgtgtccttgcacctgc

SEQ ID NO: 4418196 - DNA, 22 bp, Homo sapiens
ctgtgtccttgcacctgcatcc

SEQ ID NO: 4418197 - DNA, 19 bp, Homo sapiens
ctgtgtctaggcaggcaag

SEQ ID NO: 4418198 - DNA, 13 bp, Homo sapiens
ctgtgtgcttttt

SEQ ID NO: 4418199 - DNA, 20 bp, Homo sapiens
ctgtgtgctttttttgtgtg

SEQ ID NO: 4418200 - DNA, 17 bp, Homo sapiens
ctgtgtgggactgtaca

SEQ ID NO: 4418201 - DNA, 19 bp, Homo sapiens
ctgtgtgggactgtacaca

SEQ ID NO: 4418202 - DNA, 21 bp, Homo sapiens
ctgtgtgggactgtacacact

SEQ ID NO: 4418203 - DNA, 22 bp, Homo sapiens
ctgtgtgggactgtacacactt

SEQ ID NO: 4418204 - DNA, 18 bp, Homo sapiens
ctgtgtgtgagtgtgaat

SEQ ID NO: 4418205 - DNA, 12 bp, Homo sapiens
ctgtgtgtgtga

SEQ ID NO: 4418206 - DNA, 17 bp, Homo sapiens
ctgtgtgtgtgaatgaa

SEQ ID NO: 4418207 - DNA, 18 bp, Homo sapiens
ctgtgtgtgtgaatgaac

SEQ ID NO: 4418208 - DNA, 15 bp, Homo sapiens
ctgtgtgtgtgtatg

SEQ ID NO: 4418209 - DNA, 16 bp, Homo sapiens
ctgtgtgtttatgtgt

SEQ ID NO: 4418210 - DNA, 23 bp, Homo sapiens
ctgtgttactaaaaaaaagatga

SEQ ID NO: 4418211 - DNA, 15 bp, Homo sapiens
ctgtgttatgaaaat

SEQ ID NO: 4418212 - DNA, 18 bp, Homo sapiens
ctgtgttcacagacctca

SEQ ID NO: 4418213 - DNA, 12 bp, Homo sapiens
ctgtgttctggg

SEQ ID NO: 4418214 - DNA, 13 bp, Homo sapiens
ctgtgttgccaca

SEQ ID NO: 4418215 - DNA, 14 bp, Homo sapiens
ctgtgtttcactta

SEQ ID NO: 4418216 - DNA, 18 bp, Homo sapiens
ctgtgttttcagactgcc

SEQ ID NO: 4418217 - DNA, 21 bp, Homo sapiens
ctgtgttttcagactgcctgt

SEQ ID NO: 4418218 - DNA, 17 bp, Homo sapiens
ctgtgttttgaaagaat

SEQ ID NO: 4418219 - DNA, 22 bp, Homo sapiens
ctgtgttttgaatggtgttgta

SEQ ID NO: 4418220 - DNA, 16 bp, Homo sapiens
ctgttaaaagatgaaa

SEQ ID NO: 4418221 - DNA, 23 bp, Homo sapiens
ctgttaaaagatgaaaatatttg

SEQ ID NO: 4418222 - DNA, 11 bp, Homo sapiens
ctgttaaatac

SEQ ID NO: 4418223 - DNA, 15 bp, Homo sapiens
ctgttaaatacagga

SEQ ID NO: 4418224 - DNA, 19 bp, Homo sapiens
ctgttaaatacaggaaaca

SEQ ID NO: 4418225 - DNA, 21 bp, Homo sapiens
ctgttaatagtactattaaca

SEQ ID NO: 4418226 - DNA, 13 bp, Homo sapiens
ctgttaatgtgga

SEQ ID NO: 4418227 - DNA, 17 bp, Homo sapiens
ctgttaatttataatgt

SEQ ID NO: 4418228 - DNA, 21 bp, Homo sapiens
ctgttaatttataatgtattt

SEQ ID NO: 4418229 - DNA, 18 bp, Homo sapiens
ctgttaatttttatactg

SEQ ID NO: 4418230 - DNA, 22 bp, Homo sapiens
ctgttacaacttgtatttccaa

SEQ ID NO: 4418231 - DNA, 18 bp, Homo sapiens
ctgttacagactgaaagg

SEQ ID NO: 4418232 - DNA, 15 bp, Homo sapiens
ctgttaccattcaca

SEQ ID NO: 4418233 - DNA, 21 bp, Homo sapiens
ctgttacctcaacaagaagaa

SEQ ID NO: 4418234 - DNA, 16 bp, Homo sapiens
ctgttacttgcttcag

SEQ ID NO: 4418235 - DNA, 18 bp, Homo sapiens
ctgttacttgcttcagtg

SEQ ID NO: 4418236 - DNA, 14 bp, Homo sapiens
ctgttagaacacta

SEQ ID NO: 4418237 - DNA, 12 bp, Homo sapiens
ctgttagtaaat

SEQ ID NO: 4418238 - DNA, 14 bp, Homo sapiens
ctgttataactctg

SEQ ID NO: 4418239 - DNA, 19 bp, Homo sapiens
ctgttatgctgtgacacat

SEQ ID NO: 4418240 - DNA, 14 bp, Homo sapiens
ctgttatttcttcc

SEQ ID NO: 4418241 - DNA, 16 bp, Homo sapiens
ctgttatttcttccct

SEQ ID NO: 4418242 - DNA, 18 bp, Homo sapiens
ctgttatttcttccctgc

SEQ ID NO: 4418243 - DNA, 21 bp, Homo sapiens
ctgttatttcttccctgcttt

SEQ ID NO: 4418244 - DNA, 19 bp, Homo sapiens
ctgttcacagccagactgg

SEQ ID NO: 4418245 - DNA, 22 bp, Homo sapiens
ctgttcacagccagactggcac

SEQ ID NO: 4418246 - DNA, 16 bp, Homo sapiens
ctgttcactgcattca

SEQ ID NO: 4418247 - DNA, 12 bp, Homo sapiens
ctgttcagcatt

SEQ ID NO: 4418248 - DNA, 13 bp, Homo sapiens
ctgttcagcattc

SEQ ID NO: 4418249 - DNA, 14 bp, Homo sapiens
ctgttccaaattca

SEQ ID NO: 4418250 - DNA, 17 bp, Homo sapiens
ctgttccaaattcagtt

SEQ ID NO: 4418251 - DNA, 20 bp, Homo sapiens
ctgttccaaattcagtttca

SEQ ID NO: 4418252 - DNA, 22 bp, Homo sapiens
ctgttccaaattcagtttcata

SEQ ID NO: 4418253 - DNA, 11 bp, Homo sapiens
ctgttccagac

SEQ ID NO: 4418254 - DNA, 15 bp, Homo sapiens
ctgttccagactcag

SEQ ID NO: 4418255 - DNA, 22 bp, Homo sapiens
ctgttccagactcaggttccag

SEQ ID NO: 4418256 - DNA, 21 bp, Homo sapiens
ctgttccaggccctccagtgg

SEQ ID NO: 4418257 - DNA, 20 bp, Homo sapiens
ctgttccataggaaggctgt

SEQ ID NO: 4418258 - DNA, 17 bp, Homo sapiens
ctgttcccagcccctgc

SEQ ID NO: 4418259 - DNA, 14 bp, Homo sapiens
ctgttcccccaccc

SEQ ID NO: 4418260 - DNA, 12 bp, Homo sapiens
ctgttccccctg

SEQ ID NO: 4418261 - DNA, 17 bp, Homo sapiens
ctgttccccctgtgcag

SEQ ID NO: 4418262 - DNA, 23 bp, Homo sapiens
ctgttcccctagtaagtgccttc

SEQ ID NO: 4418263 - DNA, 19 bp, Homo sapiens
ctgttcctcccctgtaggg

SEQ ID NO: 4418264 - DNA, 12 bp, Homo sapiens
ctgttcctttta

SEQ ID NO: 4418265 - DNA, 22 bp, Homo sapiens
ctgttcggaaggggttcctcaa

SEQ ID NO: 4418266 - DNA, 20 bp, Homo sapiens
ctgttctacatagatgctta

SEQ ID NO: 4418267 - DNA, 16 bp, Homo sapiens
ctgttctcagcgtttt

SEQ ID NO: 4418268 - DNA, 21 bp, Homo sapiens
ctgttctgtagcttatctgcc

SEQ ID NO: 4418269 - DNA, 23 bp, Homo sapiens
ctgttctgtagcttatctgcccc

SEQ ID NO: 4418270 - DNA, 23 bp, Homo sapiens
ctgttgacatatttaatgtttta

SEQ ID NO: 4418271 - DNA, 14 bp, Homo sapiens
ctgttgatcccagt

SEQ ID NO: 4418272 - DNA, 17 bp, Homo sapiens
ctgttgatctttcacta

SEQ ID NO: 4418273 - DNA, 13 bp, Homo sapiens
ctgttgattaatt

SEQ ID NO: 4418274 - DNA, 19 bp, Homo sapiens
ctgttgattaatttctgcc

SEQ ID NO: 4418275 - DNA, 13 bp, Homo sapiens
ctgttgcacccag

SEQ ID NO: 4418276 - DNA, 17 bp, Homo sapiens
ctgttgcacccagccct

SEQ ID NO: 4418277 - DNA, 19 bp, Homo sapiens
ctgttgcacccagccctgg

SEQ ID NO: 4418278 - DNA, 19 bp, Homo sapiens
ctgttgcctaattggaaag

SEQ ID NO: 4418279 - DNA, 14 bp, Homo sapiens
ctgttgcctcatct

SEQ ID NO: 4418280 - DNA, 19 bp, Homo sapiens
ctgttgctttaatatgagc

SEQ ID NO: 4418281 - DNA, 23 bp, Homo sapiens
ctgttggaatggatttttcttta

SEQ ID NO: 4418282 - DNA, 17 bp, Homo sapiens
ctgttggattccatgct

SEQ ID NO: 4418283 - DNA, 19 bp, Homo sapiens
ctgttggattccatgctaa

SEQ ID NO: 4418284 - DNA, 16 bp, Homo sapiens
ctgttggcaggcccac

SEQ ID NO: 4418285 - DNA, 23 bp, Homo sapiens
ctgttggcaggcccactccccag

SEQ ID NO: 4418286 - DNA, 21 bp, Homo sapiens
ctgttggcctaagtgcctctt

SEQ ID NO: 4418287 - DNA, 19 bp, Homo sapiens
ctgttgggtttttgctgtt

SEQ ID NO: 4418288 - DNA, 22 bp, Homo sapiens
ctgttggtgttctaagactctg

SEQ ID NO: 4418289 - DNA, 19 bp, Homo sapiens
cttaatttacttaagtgtt

SEQ ID NO: 4418290 - DNA, 21 bp, Homo sapiens
cttaatttacttaagtgttca

SEQ ID NO: 4418291 - DNA, 20 bp, Homo sapiens
cttaatttcctttttgacac

SEQ ID NO: 4418292 - DNA, 21 bp, Homo sapiens
cttaatttcctttttgacact

SEQ ID NO: 4418293 - DNA, 22 bp, Homo sapiens
cttaatttcctttttgacactg

SEQ ID NO: 4418294 - DNA, 14 bp, Homo sapiens
cttacaaaaacact

SEQ ID NO: 4418295 - DNA, 20 bp, Homo sapiens
cttacaagaggattgtaaaa

SEQ ID NO: 4418296 - DNA, 19 bp, Homo sapiens
cttacaagcttaaagcttg

SEQ ID NO: 4418297 - DNA, 14 bp, Homo sapiens
cttacaatttgcac

SEQ ID NO: 4418298 - DNA, 12 bp, Homo sapiens
cttacagcaggc

SEQ ID NO: 4418299 - DNA, 19 bp, Homo sapiens
cttacccctggctgtttgg

SEQ ID NO: 4418300 - DNA, 22 bp, Homo sapiens
cttacccctggctgtttggact

SEQ ID NO: 4418301 - DNA, 14 bp, Homo sapiens
cttacgtaaaacat

SEQ ID NO: 4418302 - DNA, 15 bp, Homo sapiens
cttacgtttaagctt

SEQ ID NO: 4418303 - DNA, 19 bp, Homo sapiens
cttactagtttcccttgca

SEQ ID NO: 4418304 - DNA, 19 bp, Homo sapiens
cttactcacctctctctaa

SEQ ID NO: 4418305 - DNA, 19 bp, Homo sapiens
cttactcttcttgaaattt

SEQ ID NO: 4418306 - DNA, 21 bp, Homo sapiens
cttactgatatattttacaat

SEQ ID NO: 4418307 - DNA, 15 bp, Homo sapiens
cttactgtagcctca

SEQ ID NO: 4418308 - DNA, 17 bp, Homo sapiens
cttactgtagcctcaga

SEQ ID NO: 4418309 - DNA, 21 bp, Homo sapiens
cttactttaattactggaatt

SEQ ID NO: 4418310 - DNA, 21 bp, Homo sapiens
cttacttttaaggataaatca

SEQ ID NO: 4418311 - DNA, 12 bp, Homo sapiens
cttagaaaaaaa

SEQ ID NO: 4418312 - DNA, 18 bp, Homo sapiens
cttagaagtggaccagga

SEQ ID NO: 4418313 - DNA, 14 bp, Homo sapiens
cttagacctgccag

SEQ ID NO: 4418314 - DNA, 18 bp, Homo sapiens
cttagacctgccagccac

SEQ ID NO: 4418315 - DNA, 21 bp, Homo sapiens
cttagactctagtatttatgg

SEQ ID NO: 4418316 - DNA, 12 bp, Homo sapiens
cttagagccagg

SEQ ID NO: 4418317 - DNA, 18 bp, Homo sapiens
cttagagtttctgtttga

SEQ ID NO: 4418318 - DNA, 20 bp, Homo sapiens
cttagagttttattcctttc

SEQ ID NO: 4418319 - DNA, 18 bp, Homo sapiens
cttagatctctcctgcaa

SEQ ID NO: 4418320 - DNA, 22 bp, Homo sapiens
cttagatgggacgcataatcat

SEQ ID NO: 4418321 - DNA, 18 bp, Homo sapiens
cttagatgttccaaattt

SEQ ID NO: 4418322 - DNA, 14 bp, Homo sapiens
cttagatgttctaa

SEQ ID NO: 4418323 - DNA, 14 bp, Homo sapiens
cttagatttcatag

SEQ ID NO: 4418324 - DNA, 14 bp, Homo sapiens
cttagcagccctgg

SEQ ID NO: 4418325 - DNA, 15 bp, Homo sapiens
cttagcagccctgga

SEQ ID NO: 4418326 - DNA, 15 bp, Homo sapiens
cttagcccaagaggt

SEQ ID NO: 4418327 - DNA, 23 bp, Homo sapiens
cttagcccaagaggtctgagccc

SEQ ID NO: 4418328 - DNA, 14 bp, Homo sapiens
cttagcctccctga

SEQ ID NO: 4418329 - DNA, 17 bp, Homo sapiens
cttagcgtcaagacatt

SEQ ID NO: 4418330 - DNA, 18 bp, Homo sapiens
cttagcgtcaagacattt

SEQ ID NO: 4418331 - DNA, 18 bp, Homo sapiens
cttagcgttctggactct

SEQ ID NO: 4418332 - DNA, 20 bp, Homo sapiens
cttagctatccttggctttc

SEQ ID NO: 4418333 - DNA, 14 bp, Homo sapiens
cttagctcccctcc

SEQ ID NO: 4418334 - DNA, 17 bp, Homo sapiens
cttagctcccctccaac

SEQ ID NO: 4418335 - DNA, 19 bp, Homo sapiens
cttagctcggttctcccaa

SEQ ID NO: 4418336 - DNA, 13 bp, Homo sapiens
cttagcttcagga

SEQ ID NO: 4418337 - DNA, 21 bp, Homo sapiens
cttaggaatgacttgggttta

SEQ ID NO: 4418338 - DNA, 21 bp, Homo sapiens
cttaggatggggctcccagct

SEQ ID NO: 4418339 - DNA, 15 bp, Homo sapiens
cttaggccagcacca

SEQ ID NO: 4418340 - DNA, 16 bp, Homo sapiens
cttaggctttgtatga

SEQ ID NO: 4418341 - DNA, 13 bp, Homo sapiens
cttagggaagctg

SEQ ID NO: 4418342 - DNA, 19 bp, Homo sapiens
cttagtaaaatttatttca

SEQ ID NO: 4418343 - DNA, 22 bp, Homo sapiens
cttagtagtcaaaaacaaagct

SEQ ID NO: 4418344 - DNA, 18 bp, Homo sapiens
cttagtgccacccacctt

SEQ ID NO: 4418345 - DNA, 12 bp, Homo sapiens
cttagttaaaaa

SEQ ID NO: 4418346 - DNA, 15 bp, Homo sapiens
cttagttgatattca

SEQ ID NO: 4418347 - DNA, 21 bp, Homo sapiens
cttagtttttaaaatttattt

SEQ ID NO: 4418348 - DNA, 22 bp, Homo sapiens
cttagtttttaaaatttatttg

SEQ ID NO: 4418349 - DNA, 22 bp, Homo sapiens
cttataaactatttttttctta

SEQ ID NO: 4418350 - DNA, 13 bp, Homo sapiens
cttataactgttt

SEQ ID NO: 4418351 - DNA, 17 bp, Homo sapiens
cttataactgttttaga

SEQ ID NO: 4418352 - DNA, 19 bp, Homo sapiens
cttatagaagcttcagcag

SEQ ID NO: 4418353 - DNA, 19 bp, Homo sapiens
cttatagacacttgctccc

SEQ ID NO: 4418354 - DNA, 17 bp, Homo sapiens
cttataggcctgtccct

SEQ ID NO: 4418355 - DNA, 13 bp, Homo sapiens
cttatagtacatg

SEQ ID NO: 4418356 - DNA, 19 bp, Homo sapiens
cttatagtacatgataaat

SEQ ID NO: 4418357 - DNA, 17 bp, Homo sapiens
cttatataaaatagact

SEQ ID NO: 4418358 - DNA, 16 bp, Homo sapiens
cttatatctggcctct

SEQ ID NO: 4418359 - DNA, 21 bp, Homo sapiens
cttatatctggcctctgcttt

SEQ ID NO: 4418360 - DNA, 22 bp, Homo sapiens
cttatatctggcctctgctttc

SEQ ID NO: 4418361 - DNA, 18 bp, Homo sapiens
cttatattggtttgcaca

SEQ ID NO: 4418362 - DNA, 23 bp, Homo sapiens
cttatcacataagagagatgaga

SEQ ID NO: 4418363 - DNA, 16 bp, Homo sapiens
cttatccaaaatgctt

SEQ ID NO: 4418364 - DNA, 15 bp, Homo sapiens
cttatccataaaaaa

SEQ ID NO: 4418365 - DNA, 12 bp, Homo sapiens
cttatccctctc

SEQ ID NO: 4418366 - DNA, 13 bp, Homo sapiens
cttatccctctct

SEQ ID NO: 4418367 - DNA, 14 bp, Homo sapiens
cttatccctctctt

SEQ ID NO: 4418368 - DNA, 16 bp, Homo sapiens
cttatccctctcttcc

SEQ ID NO: 4418369 - DNA, 17 bp, Homo sapiens
cttatccctctcttccc

SEQ ID NO: 4418370 - DNA, 18 bp, Homo sapiens
cttatccctctcttcccc

SEQ ID NO: 4418371 - DNA, 14 bp, Homo sapiens
cttatcctgcattg

SEQ ID NO: 4418372 - DNA, 22 bp, Homo sapiens
cttatccttgggccataattat

SEQ ID NO: 4418373 - DNA, 17 bp, Homo sapiens
cttatctctcaaaacaa

SEQ ID NO: 4418374 - DNA, 12 bp, Homo sapiens
cttatctctctg

SEQ ID NO: 4418375 - DNA, 14 bp, Homo sapiens
cttatctctctgtg

SEQ ID NO: 4418376 - DNA, 15 bp, Homo sapiens
cttatctgcccctcc

SEQ ID NO: 4418377 - DNA, 20 bp, Homo sapiens
cttatctgcccctcccccac

SEQ ID NO: 4418378 - DNA, 13 bp, Homo sapiens
cttatcttctgga

SEQ ID NO: 4418379 - DNA, 20 bp, Homo sapiens
cttatgaaaagtactaatag

SEQ ID NO: 4418380 - DNA, 13 bp, Homo sapiens
cttatgaaaatta

SEQ ID NO: 4418381 - DNA, 13 bp, Homo sapiens
cttatgagaaact

SEQ ID NO: 4418382 - DNA, 16 bp, Homo sapiens
cttatgcaaaactttt

SEQ ID NO: 4418383 - DNA, 22 bp, Homo sapiens
cttatgccacgggaagtttaga

SEQ ID NO: 4418384 - DNA, 16 bp, Homo sapiens
cttatgcggttaattt

SEQ ID NO: 4418385 - DNA, 16 bp, Homo sapiens
cttatggaattgattt

SEQ ID NO: 4418386 - DNA, 21 bp, Homo sapiens
cttatggtatgtagccagctg

SEQ ID NO: 4418387 - DNA, 19 bp, Homo sapiens
cttatgtatcagtgtcctt

SEQ ID NO: 4418388 - DNA, 13 bp, Homo sapiens
cttatgtgacatt

SEQ ID NO: 4418389 - DNA, 13 bp, Homo sapiens
cttatgtgttaca

SEQ ID NO: 4418390 - DNA, 14 bp, Homo sapiens
cttatgttgaaaaa

SEQ ID NO: 4418391 - DNA, 16 bp, Homo sapiens
cttatgttgaaaaaat

SEQ ID NO: 4418392 - DNA, 20 bp, Homo sapiens
cttattagaaaaatattata

SEQ ID NO: 4418393 - DNA, 21 bp, Homo sapiens
cttattagagtgtctttccac

SEQ ID NO: 4418394 - DNA, 17 bp, Homo sapiens
cttattcaaagagaaaa

SEQ ID NO: 4418395 - DNA, 18 bp, Homo sapiens
cttattcccccaaacttt

SEQ ID NO: 4418396 - DNA, 15 bp, Homo sapiens
cttattcctttttat

SEQ ID NO: 4418397 - DNA, 19 bp, Homo sapiens
cttatttacccttttcccc

SEQ ID NO: 4418398 - DNA, 14 bp, Homo sapiens
cttatttcatttct

SEQ ID NO: 4418399 - DNA, 20 bp, Homo sapiens
cttatttctcattgcctctt

SEQ ID NO: 4418400 - DNA, 14 bp, Homo sapiens
cttatttctgaaca

SEQ ID NO: 4418401 - DNA, 17 bp, Homo sapiens
cttatttctgctctgga

SEQ ID NO: 4418402 - DNA, 18 bp, Homo sapiens
cttatttctgctctggaa

SEQ ID NO: 4418403 - DNA, 19 bp, Homo sapiens
cttatttctgctctggaat

SEQ ID NO: 4418404 - DNA, 19 bp, Homo sapiens
cttatttctttcctttaaa

SEQ ID NO: 4418405 - DNA, 19 bp, Homo sapiens
cttatttgccttctactcc

SEQ ID NO: 4418406 - DNA, 21 bp, Homo sapiens
cttatttgtctgtaaaaaatg

SEQ ID NO: 4418407 - DNA, 20 bp, Homo sapiens
ctggaaaccttccacccagt

SEQ ID NO: 4418408 - DNA, 12 bp, Homo sapiens
ctggaaactgct

SEQ ID NO: 4418409 - DNA, 15 bp, Homo sapiens
ctggaaacttagctt

SEQ ID NO: 4418410 - DNA, 22 bp, Homo sapiens
ctggaaacttagcttttgatgt

SEQ ID NO: 4418411 - DNA, 19 bp, Homo sapiens
ctggaaagaggctctggac

SEQ ID NO: 4418412 - DNA, 15 bp, Homo sapiens
ctggaaaggggagag

SEQ ID NO: 4418413 - DNA, 20 bp, Homo sapiens
ctggaaattgaggtccatgg

SEQ ID NO: 4418414 - DNA, 16 bp, Homo sapiens
ctggaacaaattattt

SEQ ID NO: 4418415 - DNA, 18 bp, Homo sapiens
ctggaacaacttgtagca

SEQ ID NO: 4418416 - DNA, 15 bp, Homo sapiens
ctggaacacaggggc

SEQ ID NO: 4418417 - DNA, 15 bp, Homo sapiens
ctggaacctgcaaaa

SEQ ID NO: 4418418 - DNA, 18 bp, Homo sapiens
ctggaacctgcaaaaaat

SEQ ID NO: 4418419 - DNA, 16 bp, Homo sapiens
ctggaactcctggcct

SEQ ID NO: 4418420 - DNA, 13 bp, Homo sapiens
ctggaagaaagca

SEQ ID NO: 4418421 - DNA, 14 bp, Homo sapiens
ctggaagaaccact

SEQ ID NO: 4418422 - DNA, 19 bp, Homo sapiens
ctggaagacgtggctctgg

SEQ ID NO: 4418423 - DNA, 21 bp, Homo sapiens
ctggaagacgtggctctgggt

SEQ ID NO: 4418424 - DNA, 12 bp, Homo sapiens
ctggaagactgc

SEQ ID NO: 4418425 - DNA, 18 bp, Homo sapiens
ctggaagactgctcccgg

SEQ ID NO: 4418426 - DNA, 16 bp, Homo sapiens
ctggaagatagctgtg

SEQ ID NO: 4418427 - DNA, 13 bp, Homo sapiens
ctggaagcaaatg

SEQ ID NO: 4418428 - DNA, 20 bp, Homo sapiens
ctggaagcccctgggcccag

SEQ ID NO: 4418429 - DNA, 18 bp, Homo sapiens
ctggaagctaatttgcat

SEQ ID NO: 4418430 - DNA, 19 bp, Homo sapiens
ctggaagctaatttgcatt

SEQ ID NO: 4418431 - DNA, 16 bp, Homo sapiens
ctggaagctgtgtcct

SEQ ID NO: 4418432 - DNA, 13 bp, Homo sapiens
ctggaaggacaca

SEQ ID NO: 4418433 - DNA, 15 bp, Homo sapiens
ctggaaggacacagt

SEQ ID NO: 4418434 - DNA, 15 bp, Homo sapiens
ctggaagggctagaa

SEQ ID NO: 4418435 - DNA, 16 bp, Homo sapiens
ctggaagtccaatgtg

SEQ ID NO: 4418436 - DNA, 19 bp, Homo sapiens
ctggaagtccaatgtggca

SEQ ID NO: 4418437 - DNA, 18 bp, Homo sapiens
ctggaataaagttgcaga

SEQ ID NO: 4418438 - DNA, 23 bp, Homo sapiens
ctggaataaagttgcagatgatt

SEQ ID NO: 4418439 - DNA, 17 bp, Homo sapiens
ctggaatagtaaactaa

SEQ ID NO: 4418440 - DNA, 18 bp, Homo sapiens
ctggaatctacaagccaa

SEQ ID NO: 4418441 - DNA, 19 bp, Homo sapiens
ctggaatctggagagctag

SEQ ID NO: 4418442 - DNA, 20 bp, Homo sapiens
ctggaatctggagagctaga

SEQ ID NO: 4418443 - DNA, 19 bp, Homo sapiens
ctggaatgtgccacagagg

SEQ ID NO: 4418444 - DNA, 16 bp, Homo sapiens
ctggaatgtttttccc

SEQ ID NO: 4418445 - DNA, 17 bp, Homo sapiens
ctggaattcttctgcaa

SEQ ID NO: 4418446 - DNA, 23 bp, Homo sapiens
ctggaattggagtcgtgttgtca

SEQ ID NO: 4418447 - DNA, 12 bp, Homo sapiens
ctggacagacag

SEQ ID NO: 4418448 - DNA, 13 bp, Homo sapiens
ctggacagacaga

SEQ ID NO: 4418449 - DNA, 22 bp, Homo sapiens
ctggacagatcaggctagccct

SEQ ID NO: 4418450 - DNA, 17 bp, Homo sapiens
ctggacagcagaagcct

SEQ ID NO: 4418451 - DNA, 16 bp, Homo sapiens
ctggacagcatcagaa

SEQ ID NO: 4418452 - DNA, 12 bp, Homo sapiens
ctggacagccag

SEQ ID NO: 4418453 - DNA, 14 bp, Homo sapiens
ctggacagccagtg

SEQ ID NO: 4418454 - DNA, 18 bp, Homo sapiens
ctggacagtacctgattg

SEQ ID NO: 4418455 - DNA, 20 bp, Homo sapiens
ctggacagtacctgattgta

SEQ ID NO: 4418456 - DNA, 23 bp, Homo sapiens
ctggacatgaagattctttccca

SEQ ID NO: 4418457 - DNA, 19 bp, Homo sapiens
ctggaccccgtttcatttt

SEQ ID NO: 4418458 - DNA, 12 bp, Homo sapiens
ctggacctggga

SEQ ID NO: 4418459 - DNA, 19 bp, Homo sapiens
ctggactattgtgccaact

SEQ ID NO: 4418460 - DNA, 12 bp, Homo sapiens
ctggactccgga

SEQ ID NO: 4418461 - DNA, 14 bp, Homo sapiens
ctggactccggagg

SEQ ID NO: 4418462 - DNA, 19 bp, Homo sapiens
ctggactccggaggactga

SEQ ID NO: 4418463 - DNA, 14 bp, Homo sapiens
ctggactctcagtc

SEQ ID NO: 4418464 - DNA, 17 bp, Homo sapiens
ctggactctcagtctct

SEQ ID NO: 4418465 - DNA, 20 bp, Homo sapiens
ctggactctcagtctctgag

SEQ ID NO: 4418466 - DNA, 23 bp, Homo sapiens
ctggactctcagtctctgagcag

SEQ ID NO: 4418467 - DNA, 14 bp, Homo sapiens
ctggactctgcccc

SEQ ID NO: 4418468 - DNA, 19 bp, Homo sapiens
ctggactgaccctgcaggt

SEQ ID NO: 4418469 - DNA, 21 bp, Homo sapiens
ctggactgaccctgcaggttg

SEQ ID NO: 4418470 - DNA, 20 bp, Homo sapiens
ctggactgagccaaggaggc

SEQ ID NO: 4418471 - DNA, 12 bp, Homo sapiens
ctggactgaggc

SEQ ID NO: 4418472 - DNA, 18 bp, Homo sapiens
ctggactgagggggcctg

SEQ ID NO: 4418473 - DNA, 14 bp, Homo sapiens
ctggactggcgttc

SEQ ID NO: 4418474 - DNA, 20 bp, Homo sapiens
ctggactggcgttcacctcc

SEQ ID NO: 4418475 - DNA, 23 bp, Homo sapiens
ctggactggcgttcacctccctg

SEQ ID NO: 4418476 - DNA, 14 bp, Homo sapiens
ctggactgttccag

SEQ ID NO: 4418477 - DNA, 16 bp, Homo sapiens
ctggactgttccaggc

SEQ ID NO: 4418478 - DNA, 19 bp, Homo sapiens
ctggactgttccaggccct

SEQ ID NO: 4418479 - DNA, 20 bp, Homo sapiens
ctggactgttccaggccctc

SEQ ID NO: 4418480 - DNA, 22 bp, Homo sapiens
ctggacttaagcatctggctct

SEQ ID NO: 4418481 - DNA, 18 bp, Homo sapiens
ctggacttctacctgccc

SEQ ID NO: 4418482 - DNA, 23 bp, Homo sapiens
ctggacttctacctgccctcaag

SEQ ID NO: 4418483 - DNA, 16 bp, Homo sapiens
ctggacttgcctctgc

SEQ ID NO: 4418484 - DNA, 17 bp, Homo sapiens
ctggagaaaaaaattgc

SEQ ID NO: 4418485 - DNA, 22 bp, Homo sapiens
ctggagaaagccacgccctccc

SEQ ID NO: 4418486 - DNA, 22 bp, Homo sapiens
ctggagaactagaacctggagg

SEQ ID NO: 4418487 - DNA, 17 bp, Homo sapiens
ctggagacaaggtgcta

SEQ ID NO: 4418488 - DNA, 12 bp, Homo sapiens
ctggagaccccc

SEQ ID NO: 4418489 - DNA, 20 bp, Homo sapiens
ctggagacccccccccaact

SEQ ID NO: 4418490 - DNA, 14 bp, Homo sapiens
ctggagagaacagg

SEQ ID NO: 4418491 - DNA, 19 bp, Homo sapiens
ctggagagccagaacctgg

SEQ ID NO: 4418492 - DNA, 19 bp, Homo sapiens
ctggagagctagaacctgg

SEQ ID NO: 4418493 - DNA, 22 bp, Homo sapiens
ctggagagctagaacctggagg

SEQ ID NO: 4418494 - DNA, 23 bp, Homo sapiens
ctggagagctagaacctggaggg

SEQ ID NO: 4418495 - DNA, 20 bp, Homo sapiens
ctggagagctgtgtctattt

SEQ ID NO: 4418496 - DNA, 19 bp, Homo sapiens
ctggagagtgcacatgccc

SEQ ID NO: 4418497 - DNA, 13 bp, Homo sapiens
ctggagatatgaa

SEQ ID NO: 4418498 - DNA, 21 bp, Homo sapiens
ctggagatgcagctactggaa

SEQ ID NO: 4418499 - DNA, 15 bp, Homo sapiens
ctggagcaccaggca

SEQ ID NO: 4418500 - DNA, 22 bp, Homo sapiens
ctggagcagaggaggggaaagt

SEQ ID NO: 4418501 - DNA, 17 bp, Homo sapiens
ctggagcccagaggagg

SEQ ID NO: 4418502 - DNA, 12 bp, Homo sapiens
ctggagccccca

SEQ ID NO: 4418503 - DNA, 15 bp, Homo sapiens
ctggagcccccagca

SEQ ID NO: 4418504 - DNA, 20 bp, Homo sapiens
ctggagcccccagcagaggc

SEQ ID NO: 4418505 - DNA, 18 bp, Homo sapiens
ctggagcgccacacactg

SEQ ID NO: 4418506 - DNA, 20 bp, Homo sapiens
ctggagctcatctgcaaaag

SEQ ID NO: 4418507 - DNA, 21 bp, Homo sapiens
ctggagctcatctgcaaaagg

SEQ ID NO: 4418508 - DNA, 12 bp, Homo sapiens
ctggagctcctc

SEQ ID NO: 4418509 - DNA, 16 bp, Homo sapiens
ctggagctcctccctc

SEQ ID NO: 4418510 - DNA, 22 bp, Homo sapiens
ctggagctcctccctccagctg

SEQ ID NO: 4418511 - DNA, 13 bp, Homo sapiens
ctggagctctgcc

SEQ ID NO: 4418512 - DNA, 14 bp, Homo sapiens
ctggagctgggaga

SEQ ID NO: 4418513 - DNA, 17 bp, Homo sapiens
ctggagctgggagacaa

SEQ ID NO: 4418514 - DNA, 22 bp, Homo sapiens
ctggaggaatacattttattct

SEQ ID NO: 4418515 - DNA, 15 bp, Homo sapiens
ctggaggaggcctgt

SEQ ID NO: 4418516 - DNA, 20 bp, Homo sapiens
ctggaggaggcctgtcccaa

SEQ ID NO: 4418517 - DNA, 19 bp, Homo sapiens
ctggaggcagggccttgcc

SEQ ID NO: 4418518 - DNA, 22 bp, Homo sapiens
ctggaggcagggccttgcccag

SEQ ID NO: 4418519 - DNA, 12 bp, Homo sapiens
ctggaggcccag

SEQ ID NO: 4418520 - DNA, 14 bp, Homo sapiens
ctggaggcccaggc

SEQ ID NO: 4418521 - DNA, 23 bp, Homo sapiens
ctggaggctgcagagctgaccca

SEQ ID NO: 4418522 - DNA, 23 bp, Homo sapiens
ctggagggaaggacagtccctgc

SEQ ID NO: 4418523 - DNA, 18 bp, Homo sapiens
ctggagggcaagccctgc

SEQ ID NO: 4418524 - DNA, 19 bp, Homo sapiens
ctggagggcaagccctgcc

SEQ ID NO: 4418525 - DNA, 20 bp, Homo sapiens
ctggagggcaagccctgccc

SEQ ID NO: 4418526 - DNA, 19 bp, Homo sapiens
ctggagggctagaacctgg

SEQ ID NO: 4418527 - DNA, 17 bp, Homo sapiens
ctgctagagcagacagg

SEQ ID NO: 4418528 - DNA, 18 bp, Homo sapiens
ctgctagcacagaggcct

SEQ ID NO: 4418529 - DNA, 12 bp, Homo sapiens
ctgctagtcact

SEQ ID NO: 4418530 - DNA, 17 bp, Homo sapiens
ctgctagtcactggaaa

SEQ ID NO: 4418531 - DNA, 18 bp, Homo sapiens
ctgctatatataaaacgg

SEQ ID NO: 4418532 - DNA, 20 bp, Homo sapiens
ctgctatccccatctccctg

SEQ ID NO: 4418533 - DNA, 18 bp, Homo sapiens
ctgctcacccacctcttg

SEQ ID NO: 4418534 - DNA, 19 bp, Homo sapiens
ctgctcagtaaagcacttg

SEQ ID NO: 4418535 - DNA, 18 bp, Homo sapiens
ctgctcagtgcttgggct

SEQ ID NO: 4418536 - DNA, 22 bp, Homo sapiens
ctgctcagtgcttgggctccac

SEQ ID NO: 4418537 - DNA, 16 bp, Homo sapiens
ctgctcatcattctct

SEQ ID NO: 4418538 - DNA, 20 bp, Homo sapiens
ctgctcattaaactgattcc

SEQ ID NO: 4418539 - DNA, 14 bp, Homo sapiens
ctgctccaacagaa

SEQ ID NO: 4418540 - DNA, 20 bp, Homo sapiens
ctgctccaatgactgagcag

SEQ ID NO: 4418541 - DNA, 13 bp, Homo sapiens
ctgctccaccaca

SEQ ID NO: 4418542 - DNA, 13 bp, Homo sapiens
ctgctccaccagc

SEQ ID NO: 4418543 - DNA, 18 bp, Homo sapiens
ctgctccaccagcagcat

SEQ ID NO: 4418544 - DNA, 20 bp, Homo sapiens
ctgctccaccagcagcatgg

SEQ ID NO: 4418545 - DNA, 14 bp, Homo sapiens
ctgctccacccttg

SEQ ID NO: 4418546 - DNA, 15 bp, Homo sapiens
ctgctccagcctctg

SEQ ID NO: 4418547 - DNA, 16 bp, Homo sapiens
ctgctcccacctggct

SEQ ID NO: 4418548 - DNA, 19 bp, Homo sapiens
ctgctcccagtcctgcctg

SEQ ID NO: 4418549 - DNA, 18 bp, Homo sapiens
ctgctcccattcctccct

SEQ ID NO: 4418550 - DNA, 15 bp, Homo sapiens
ctgctccctgcaagc

SEQ ID NO: 4418551 - DNA, 16 bp, Homo sapiens
ctgccatgctttgagt

SEQ ID NO: 4418552 - DNA, 17 bp, Homo sapiens
ctgccatggaactgttt

SEQ ID NO: 4418553 - DNA, 22 bp, Homo sapiens
ctgccatggaactgtttccttc

SEQ ID NO: 4418554 - DNA, 16 bp, Homo sapiens
ctgccattacccagtg

SEQ ID NO: 4418555 - DNA, 17 bp, Homo sapiens
ctgccattacccagtgc

SEQ ID NO: 4418556 - DNA, 19 bp, Homo sapiens
ctgccattctgtgcaggct

SEQ ID NO: 4418557 - DNA, 22 bp, Homo sapiens
ctgccattcttctggtgctact

SEQ ID NO: 4418558 - DNA, 21 bp, Homo sapiens
ctgccattgggaccctccagt

SEQ ID NO: 4418559 - DNA, 16 bp, Homo sapiens
ctgccatttatttcct

SEQ ID NO: 4418560 - DNA, 13 bp, Homo sapiens
ctgccatttcatg

SEQ ID NO: 4418561 - DNA, 13 bp, Homo sapiens
ctgcccaaaatgt

SEQ ID NO: 4418562 - DNA, 18 bp, Homo sapiens
ctgcccaaacccttaact

SEQ ID NO: 4418563 - DNA, 21 bp, Homo sapiens
ctgcccaattttgcagggagc

SEQ ID NO: 4418564 - DNA, 17 bp, Homo sapiens
ctgcccactcgggtctg

SEQ ID NO: 4418565 - DNA, 22 bp, Homo sapiens
ctgcccagaaagtgggggtgga

SEQ ID NO: 4418566 - DNA, 21 bp, Homo sapiens
ctgcccagactgatgagcaca

SEQ ID NO: 4418567 - DNA, 15 bp, Homo sapiens
ctgcccagagctgag

SEQ ID NO: 4418568 - DNA, 16 bp, Homo sapiens
ctgcccagagctgagt

SEQ ID NO: 4418569 - DNA, 11 bp, Homo sapiens
ctgcccagcaa

SEQ ID NO: 4418570 - DNA, 13 bp, Homo sapiens
ctgcccagcagcc

SEQ ID NO: 4418571 - DNA, 19 bp, Homo sapiens
ctgcccagcagcccctgag

SEQ ID NO: 4418572 - DNA, 20 bp, Homo sapiens
ctgcccagcagcccctgaga

SEQ ID NO: 4418573 - DNA, 13 bp, Homo sapiens
ctgcccagccctg

SEQ ID NO: 4418574 - DNA, 14 bp, Homo sapiens
ctgcccagccctgg

SEQ ID NO: 4418575 - DNA, 16 bp, Homo sapiens
ctgcccagccctggcc

SEQ ID NO: 4418576 - DNA, 17 bp, Homo sapiens
ctgcccagccctggccc

SEQ ID NO: 4418577 - DNA, 11 bp, Homo sapiens
ctgcccaggag

SEQ ID NO: 4418578 - DNA, 12 bp, Homo sapiens
ctgcccaggaga

SEQ ID NO: 4418579 - DNA, 19 bp, Homo sapiens
ctgcccaggagacagacca

SEQ ID NO: 4418580 - DNA, 17 bp, Homo sapiens
ctgcccaggagagccag

SEQ ID NO: 4418581 - DNA, 19 bp, Homo sapiens
ctgcccaggagagccagcc

SEQ ID NO: 4418582 - DNA, 21 bp, Homo sapiens
ctgcccaggagagccagccct

SEQ ID NO: 4418583 - DNA, 15 bp, Homo sapiens
ctgcccaggccacag

SEQ ID NO: 4418584 - DNA, 24 bp, Homo sapiens
ctgcactccagcctgagtgacaga

SEQ ID NO: 4418585 - DNA, 16 bp, Homo sapiens
ctgcactcccacctga

SEQ ID NO: 4418586 - DNA, 16 bp, Homo sapiens
ctgcactctgtagcaa

SEQ ID NO: 4418587 - DNA, 20 bp, Homo sapiens
ctgcactgtgaacctgggca

SEQ ID NO: 4418588 - DNA, 21 bp, Homo sapiens
ctgcactttccaatgccacag

SEQ ID NO: 4418589 - DNA, 21 bp, Homo sapiens
ctgcactttgatgtcatgtgt

SEQ ID NO: 4418590 - DNA, 13 bp, Homo sapiens
ctgcactttgttt

SEQ ID NO: 4418591 - DNA, 15 bp, Homo sapiens
ctgcagacctgtcct

SEQ ID NO: 4418592 - DNA, 18 bp, Homo sapiens
ctgcagacctgtcctcct

SEQ ID NO: 4418593 - DNA, 14 bp, Homo sapiens
ctgcagacttccca

SEQ ID NO: 4418594 - DNA, 15 bp, Homo sapiens
ctgcagacttcccag

SEQ ID NO: 4418595 - DNA, 11 bp, Homo sapiens
ctgcagagggg

SEQ ID NO: 4418596 - DNA, 22 bp, Homo sapiens
ctgcagaggggaaagacttcca

SEQ ID NO: 4418597 - DNA, 16 bp, Homo sapiens
ctgcagatcttccgtg

SEQ ID NO: 4418598 - DNA, 18 bp, Homo sapiens
ctgcagatcttccgtggt

SEQ ID NO: 4418599 - DNA, 20 bp, Homo sapiens
ctgcagattctgagcaaagg

SEQ ID NO: 4418600 - DNA, 20 bp, Homo sapiens
ctgcagcaatcacaaaggct

SEQ ID NO: 4418601 - DNA, 12 bp, Homo sapiens
ctgcagccagcc

SEQ ID NO: 4418602 - DNA, 14 bp, Homo sapiens
ctgcagccagccca

SEQ ID NO: 4418603 - DNA, 18 bp, Homo sapiens
ctgcagccagggctgggg

SEQ ID NO: 4418604 - DNA, 16 bp, Homo sapiens
ctgcagcccaccagac

SEQ ID NO: 4418605 - DNA, 19 bp, Homo sapiens
ctgcagcccaccagacgtc

SEQ ID NO: 4418606 - DNA, 17 bp, Homo sapiens
ctgcagcctcatactcc

SEQ ID NO: 4418607 - DNA, 22 bp, Homo sapiens
ctgcagctatgcgcaatgtggc

SEQ ID NO: 4418608 - DNA, 18 bp, Homo sapiens
ctgcagctccctggcttc

SEQ ID NO: 4418609 - DNA, 23 bp, Homo sapiens
ctgcagctccctggcttctgtgg

SEQ ID NO: 4418610 - DNA, 17 bp, Homo sapiens
ctgcaggaatcacccct

SEQ ID NO: 4418611 - DNA, 19 bp, Homo sapiens
ctgcaggaatcacccctct

SEQ ID NO: 4418612 - DNA, 23 bp, Homo sapiens
ctgcaggaatcacccctctgccc

SEQ ID NO: 4418613 - DNA, 14 bp, Homo sapiens
ctgcaggacagagg

SEQ ID NO: 4418614 - DNA, 21 bp, Homo sapiens
ctgcaggacagagggaagcca

SEQ ID NO: 4418615 - DNA, 22 bp, Homo sapiens
ctgcaggacagagggaagccag

SEQ ID NO: 4418616 - DNA, 23 bp, Homo sapiens
ctgcaggacagagggaagccagt

SEQ ID NO: 4418617 - DNA, 20 bp, Homo sapiens
ctgcaggagagagcagcact

SEQ ID NO: 4418618 - DNA, 22 bp, Homo sapiens
ctgcaggcaggaacaaacaggg

SEQ ID NO: 4418619 - DNA, 20 bp, Homo sapiens
ctgcaggccccgcttgtcca

SEQ ID NO: 4418620 - DNA, 17 bp, Homo sapiens
ctgcaggctggggaggt

SEQ ID NO: 4418621 - DNA, 14 bp, Homo sapiens
ccctgcctggactt

SEQ ID NO: 4418622 - DNA, 13 bp, Homo sapiens
ccctgcctggccc

SEQ ID NO: 4418623 - DNA, 18 bp, Homo sapiens
ccctgcctgttggcaggc

SEQ ID NO: 4418624 - DNA, 15 bp, Homo sapiens
ccctgcgccccgcac

SEQ ID NO: 4418625 - DNA, 16 bp, Homo sapiens
ccctgctagcacagag

SEQ ID NO: 4418626 - DNA, 20 bp, Homo sapiens
ccctgctagcacagaggcct

SEQ ID NO: 4418627 - DNA, 22 bp, Homo sapiens
ccctgctcagtgcttgggctcc

SEQ ID NO: 4418628 - DNA, 17 bp, Homo sapiens
ccctgctccaccagcag

SEQ ID NO: 4418629 - DNA, 14 bp, Homo sapiens
ccctgctcccattc

SEQ ID NO: 4418630 - DNA, 20 bp, Homo sapiens
ccctgctccctgcctcctgc

SEQ ID NO: 4418631 - DNA, 21 bp, Homo sapiens
ccctgctcttctctccccagc

SEQ ID NO: 4418632 - DNA, 12 bp, Homo sapiens
ccctgctgctcc

SEQ ID NO: 4418633 - DNA, 14 bp, Homo sapiens
ccctgctgctccta

SEQ ID NO: 4418634 - DNA, 13 bp, Homo sapiens
ccctgctggccgc

SEQ ID NO: 4418635 - DNA, 18 bp, Homo sapiens
ccctgctggccgcctcac

SEQ ID NO: 4418636 - DNA, 20 bp, Homo sapiens
ccctgctggctcttctgccc

SEQ ID NO: 4418637 - DNA, 15 bp, Homo sapiens
ccctgctggggaaga

SEQ ID NO: 4418638 - DNA, 14 bp, Homo sapiens
ccctgctgtgctgc

SEQ ID NO: 4418639 - DNA, 13 bp, Homo sapiens
ccctgctgtggga

SEQ ID NO: 4418640 - DNA, 21 bp, Homo sapiens
ccctggaaaccttccacccag

SEQ ID NO: 4418641 - DNA, 22 bp, Homo sapiens
ccctggaaaccttccacccagt

SEQ ID NO: 4418642 - DNA, 16 bp, Homo sapiens
ccctggaaagggggtg

SEQ ID NO: 4418643 - DNA, 21 bp, Homo sapiens
ccctggaaagggggtgacctc

SEQ ID NO: 4418644 - DNA, 18 bp, Homo sapiens
ccctggaactcctggcct

SEQ ID NO: 4418645 - DNA, 13 bp, Homo sapiens
ccctggacctggg

SEQ ID NO: 4418646 - DNA, 14 bp, Homo sapiens
ccctggacctggga

SEQ ID NO: 4418647 - DNA, 17 bp, Homo sapiens
ccctggacttctgggag

SEQ ID NO: 4418648 - DNA, 19 bp, Homo sapiens
ccctggagaaaaaaattgc

SEQ ID NO: 4418649 - DNA, 18 bp, Homo sapiens
ccctggaggacagaggga

SEQ ID NO: 4418650 - DNA, 18 bp, Homo sapiens
ccctggaggctgcctccc

SEQ ID NO: 4418651 - DNA, 12 bp, Homo sapiens
ccctggagggca

SEQ ID NO: 4418652 - DNA, 22 bp, Homo sapiens
ccctggcatcgtgtattccata

SEQ ID NO: 4418653 - DNA, 15 bp, Homo sapiens
ccctggcccaggtgc

SEQ ID NO: 4418654 - DNA, 14 bp, Homo sapiens
ccctggcccccatc

SEQ ID NO: 4418655 - DNA, 18 bp, Homo sapiens
ccctggcctgaactgagg

SEQ ID NO: 4418656 - DNA, 14 bp, Homo sapiens
ccctggcctgctgg

SEQ ID NO: 4418657 - DNA, 14 bp, Homo sapiens
ccctggctcccacc

SEQ ID NO: 4418658 - DNA, 13 bp, Homo sapiens
ccctggctcccat

SEQ ID NO: 4418659 - DNA, 23 bp, Homo sapiens
ccctggctcccatgaccatactg

SEQ ID NO: 4418660 - DNA, 15 bp, Homo sapiens
ccctggctccctcct

SEQ ID NO: 4418661 - DNA, 13 bp, Homo sapiens
ccctggctgctgc

SEQ ID NO: 4418662 - DNA, 14 bp, Homo sapiens
ccctggctggctcc

SEQ ID NO: 4418663 - DNA, 17 bp, Homo sapiens
ccctggcttctgtgggg

SEQ ID NO: 4418664 - DNA, 23 bp, Homo sapiens
ccctggcttgtaactccaccaac

SEQ ID NO: 4418665 - DNA, 13 bp, Homo sapiens
ccctggctttgcc

SEQ ID NO: 4418666 - DNA, 14 bp, Homo sapiens
ccctggctttgcct

SEQ ID NO: 4418667 - DNA, 16 bp, Homo sapiens
ccctggctttgcctct

SEQ ID NO: 4418668 - DNA, 20 bp, Homo sapiens
ccctggctttgcctcttctt

SEQ ID NO: 4418669 - DNA, 15 bp, Homo sapiens
ccctgggaaggcctc

SEQ ID NO: 4418670 - DNA, 20 bp, Homo sapiens
ccctgggatgggaccaggga

SEQ ID NO: 4418671 - DNA, 16 bp, Homo sapiens
ccctgggcagtgagtg

SEQ ID NO: 4418672 - DNA, 21 bp, Homo sapiens
ccctgggcatcttctggcttg

SEQ ID NO: 4418673 - DNA, 14 bp, Homo sapiens
ccctgggccccacc

SEQ ID NO: 4418674 - DNA, 15 bp, Homo sapiens
ccctgggcccctcca

SEQ ID NO: 4418675 - DNA, 13 bp, Homo sapiens
ccctgggcctcag

SEQ ID NO: 4418676 - DNA, 14 bp, Homo sapiens
ccctgggcctcagt

SEQ ID NO: 4418677 - DNA, 17 bp, Homo sapiens
ccctgggctcggaggct

SEQ ID NO: 4418678 - DNA, 14 bp, Homo sapiens
ccctgggctggcac

SEQ ID NO: 4418679 - DNA, 19 bp, Homo sapiens
ccctgggctggcacagccc

SEQ ID NO: 4418680 - DNA, 20 bp, Homo sapiens
ccctgggctggcacagcccc

SEQ ID NO: 4418681 - DNA, 18 bp, Homo sapiens
ccctgggctgggtgctgg

SEQ ID NO: 4418682 - DNA, 20 bp, Homo sapiens
ccctgggctgggtgctggga

SEQ ID NO: 4418683 - DNA, 16 bp, Homo sapiens
ccctgggctgtctgtc

SEQ ID NO: 4418684 - DNA, 19 bp, Homo sapiens
ccctgggcttggcctgctg

SEQ ID NO: 4418685 - DNA, 21 bp, Homo sapiens
ctgatctgtactttgtgttta

SEQ ID NO: 4418686 - DNA, 13 bp, Homo sapiens
ctgatctgtgctt

SEQ ID NO: 4418687 - DNA, 17 bp, Homo sapiens
ctgatctgtgctttcca

SEQ ID NO: 4418688 - DNA, 18 bp, Homo sapiens
ctgatctgtgctttccag

SEQ ID NO: 4418689 - DNA, 16 bp, Homo sapiens
ctgatcttatgtgtta

SEQ ID NO: 4418690 - DNA, 12 bp, Homo sapiens
ctgatcttggaa

SEQ ID NO: 4418691 - DNA, 17 bp, Homo sapiens
ctgatgagaacaagcta

SEQ ID NO: 4418692 - DNA, 23 bp, Homo sapiens
ctgatgagcacatctctctgccc

SEQ ID NO: 4418693 - DNA, 19 bp, Homo sapiens
ctgatgattttcctttttc

SEQ ID NO: 4418694 - DNA, 21 bp, Homo sapiens
ctgatgctccctcccctgccc

SEQ ID NO: 4418695 - DNA, 24 bp, Homo sapiens
ctgatgctccctcccctgccctgg

SEQ ID NO: 4418696 - DNA, 16 bp, Homo sapiens
ctgatggaaaatacca

SEQ ID NO: 4418697 - DNA, 21 bp, Homo sapiens
ctgatggattccaaaccagga

SEQ ID NO: 4418698 - DNA, 19 bp, Homo sapiens
ctgatggccttaatttcct

SEQ ID NO: 4418699 - DNA, 20 bp, Homo sapiens
ctgatggccttaatttcctt

SEQ ID NO: 4418700 - DNA, 21 bp, Homo sapiens
ctgatggccttaatttccttt

SEQ ID NO: 4418701 - DNA, 18 bp, Homo sapiens
ctgatggcctttggaccc

SEQ ID NO: 4418702 - DNA, 20 bp, Homo sapiens
ctgatggcctttggacccag

SEQ ID NO: 4418703 - DNA, 22 bp, Homo sapiens
ctgatgggaataaaagtattaa

SEQ ID NO: 4418704 - DNA, 15 bp, Homo sapiens
ctgatgggttcttag

SEQ ID NO: 4418705 - DNA, 24 bp, Homo sapiens
ctgatggtataaacaggagacagg

SEQ ID NO: 4418706 - DNA, 14 bp, Homo sapiens
ctgatgtcccagtg

SEQ ID NO: 4418707 - DNA, 15 bp, Homo sapiens
ctgatgtgatattct

SEQ ID NO: 4418708 - DNA, 16 bp, Homo sapiens
ctgatgtgatattctg

SEQ ID NO: 4418709 - DNA, 21 bp, Homo sapiens
ctgatgttcctagtgaaagag

SEQ ID NO: 4418710 - DNA, 18 bp, Homo sapiens
ctgatgttctttccatga

SEQ ID NO: 4418711 - DNA, 12 bp, Homo sapiens
ctgatgttgtgt

SEQ ID NO: 4418712 - DNA, 20 bp, Homo sapiens
ctgattaaaaataccttcta

SEQ ID NO: 4418713 - DNA, 18 bp, Homo sapiens
ctgattagtattcaggca

SEQ ID NO: 4418714 - DNA, 14 bp, Homo sapiens
ctgattatgaaatg

SEQ ID NO: 4418715 - DNA, 15 bp, Homo sapiens
ctgattattttagct

SEQ ID NO: 4418716 - DNA, 15 bp, Homo sapiens
ctgattcccctccac

SEQ ID NO: 4418717 - DNA, 13 bp, Homo sapiens
ctgattcttgtaa

SEQ ID NO: 4418718 - DNA, 20 bp, Homo sapiens
ctgattcttgtaaatctttt

SEQ ID NO: 4418719 - DNA, 21 bp, Homo sapiens
ctgattcttgtaaatcttttt

SEQ ID NO: 4418720 - DNA, 17 bp, Homo sapiens
ctgattgatcacacagt

SEQ ID NO: 4418721 - DNA, 17 bp, Homo sapiens
ctgattggtgcaaccct

SEQ ID NO: 4418722 - DNA, 19 bp, Homo sapiens
ctgattgtgccagtgcact

SEQ ID NO: 4418723 - DNA, 22 bp, Homo sapiens
ctgattgtgccagtgcactccg

SEQ ID NO: 4418724 - DNA, 12 bp, Homo sapiens
ctgatttcataa

SEQ ID NO: 4418725 - DNA, 18 bp, Homo sapiens
ctgatttctatggctttc

SEQ ID NO: 4418726 - DNA, 12 bp, Homo sapiens
ctgatttctgaa

SEQ ID NO: 4418727 - DNA, 20 bp, Homo sapiens
ctcttttcctggcagctgct

SEQ ID NO: 4418728 - DNA, 22 bp, Homo sapiens
ctcttttcctggtgctcttttt

SEQ ID NO: 4418729 - DNA, 15 bp, Homo sapiens
ctcttttctgtactt

SEQ ID NO: 4418730 - DNA, 14 bp, Homo sapiens
ctcttttctttctg

SEQ ID NO: 4418731 - DNA, 21 bp, Homo sapiens
ctcttttgcttgccaaagtac

SEQ ID NO: 4418732 - DNA, 21 bp, Homo sapiens
ctcttttgctttattccagaa

SEQ ID NO: 4418733 - DNA, 14 bp, Homo sapiens
ctcttttgtaagta

SEQ ID NO: 4418734 - DNA, 12 bp, Homo sapiens
ctcttttgtatt

SEQ ID NO: 4418735 - DNA, 21 bp, Homo sapiens
ctcttttgtattgtttctaca

SEQ ID NO: 4418736 - DNA, 19 bp, Homo sapiens
ctcttttgtgatgaacata

SEQ ID NO: 4418737 - DNA, 24 bp, Homo sapiens
ctcttttgtgatgaacatattcat

SEQ ID NO: 4418738 - DNA, 19 bp, Homo sapiens
ctgaaaaaaaaaaagaaga

SEQ ID NO: 4418739 - DNA, 20 bp, Homo sapiens
ctgaaaaaaaaaaagaagaa

SEQ ID NO: 4418740 - DNA, 18 bp, Homo sapiens
ctgaaaagaaggaaagat

SEQ ID NO: 4418741 - DNA, 17 bp, Homo sapiens
ctgaaaaggtttatgaa

SEQ ID NO: 4418742 - DNA, 17 bp, Homo sapiens
ctgaaaatattgtttta

SEQ ID NO: 4418743 - DNA, 10 bp, Homo sapiens
ctgaaacagc

SEQ ID NO: 4418744 - DNA, 15 bp, Homo sapiens
ctgaaacagctgcct

SEQ ID NO: 4418745 - DNA, 18 bp, Homo sapiens
ctgaaacagctgccttag

SEQ ID NO: 4418746 - DNA, 22 bp, Homo sapiens
ctgaaacagctgccttagcttc

SEQ ID NO: 4418747 - DNA, 23 bp, Homo sapiens
ctgaaacagctgccttagcttca

SEQ ID NO: 4418748 - DNA, 18 bp, Homo sapiens
ctgaaacccgccctcagg

SEQ ID NO: 4418749 - DNA, 16 bp, Homo sapiens
ctgaaacctcttccta

SEQ ID NO: 4418750 - DNA, 22 bp, Homo sapiens
ctgaaactgcccactctgcaag

SEQ ID NO: 4418751 - DNA, 14 bp, Homo sapiens
ctgaaactggcttc

SEQ ID NO: 4418752 - DNA, 20 bp, Homo sapiens
ctgaaactggcttccccact

SEQ ID NO: 4418753 - DNA, 14 bp, Homo sapiens
ctgaaagacttgaa

SEQ ID NO: 4418754 - DNA, 20 bp, Homo sapiens
ctgaaagccttagggaagct

SEQ ID NO: 4418755 - DNA, 13 bp, Homo sapiens
ctgaaaggagaca

SEQ ID NO: 4418756 - DNA, 24 bp, Homo sapiens
ctgaaaggagacattgctctatgt

SEQ ID NO: 4418757 - DNA, 15 bp, Homo sapiens
ctgaaaggcaacata

SEQ ID NO: 4418758 - DNA, 21 bp, Homo sapiens
ctgaaagggggcatgtatgca

SEQ ID NO: 4418759 - DNA, 23 bp, Homo sapiens
ctgaaaggtgattgcagcttttg

SEQ ID NO: 4418760 - DNA, 18 bp, Homo sapiens
ctgaaagtcctgctttcc

SEQ ID NO: 4418761 - DNA, 14 bp, Homo sapiens
ctgaaagtgttttg

SEQ ID NO: 4418762 - DNA, 15 bp, Homo sapiens
ctgaaagttttgtaa

SEQ ID NO: 4418763 - DNA, 16 bp, Homo sapiens
ctgaaagttttgtaaa

SEQ ID NO: 4418764 - DNA, 17 bp, Homo sapiens
ctgaaagttttgtaaaa

SEQ ID NO: 4418765 - DNA, 20 bp, Homo sapiens
ctgaaagttttgtaaaagaa

SEQ ID NO: 4418766 - DNA, 22 bp, Homo sapiens
ctgaaagttttgtaaaagaaat

SEQ ID NO: 4418767 - DNA, 23 bp, Homo sapiens
ctgaaagttttgtaaaagaaatc

SEQ ID NO: 4418768 - DNA, 18 bp, Homo sapiens
ctgaaataatatatttct

SEQ ID NO: 4418769 - DNA, 17 bp, Homo sapiens
ctgaaatgacatttcac

SEQ ID NO: 4418770 - DNA, 20 bp, Homo sapiens
ctgaaatgacatttcactaa

SEQ ID NO: 4418771 - DNA, 19 bp, Homo sapiens
ctgaacaccattgaaggct

SEQ ID NO: 4418772 - DNA, 14 bp, Homo sapiens
ctgaacagccctct

SEQ ID NO: 4418773 - DNA, 17 bp, Homo sapiens
ctgaacagccctctctc

SEQ ID NO: 4418774 - DNA, 14 bp, Homo sapiens
ctgaaccaggccag

SEQ ID NO: 4418775 - DNA, 19 bp, Homo sapiens
ctgaaccccagaggcagag

SEQ ID NO: 4418776 - DNA, 19 bp, Homo sapiens
ctgaacgatccttcaaagt

SEQ ID NO: 4418777 - DNA, 20 bp, Homo sapiens
ctgaacgatccttcaaagtc

SEQ ID NO: 4418778 - DNA, 13 bp, Homo sapiens
ctgaactcacttt

SEQ ID NO: 4418779 - DNA, 13 bp, Homo sapiens
ctgacccctgctc

SEQ ID NO: 4418780 - DNA, 17 bp, Homo sapiens
ctgaccctatgggtcta

SEQ ID NO: 4418781 - DNA, 22 bp, Homo sapiens
ctgaccctcctgttgcacccag

SEQ ID NO: 4418782 - DNA, 16 bp, Homo sapiens
ctgaccgtatgatgag

SEQ ID NO: 4418783 - DNA, 22 bp, Homo sapiens
ctgaccgtgggcggggccttgc

SEQ ID NO: 4418784 - DNA, 17 bp, Homo sapiens
ctgacctcctctgggcc

SEQ ID NO: 4418785 - DNA, 17 bp, Homo sapiens
ctgacctgccagccggt

SEQ ID NO: 4418786 - DNA, 21 bp, Homo sapiens
ctgaccttagcgttctggact

SEQ ID NO: 4418787 - DNA, 22 bp, Homo sapiens
ctgaccttggaggaatgacaat

SEQ ID NO: 4418788 - DNA, 18 bp, Homo sapiens
ctgacgcaatgaaaagtc

SEQ ID NO: 4418789 - DNA, 14 bp, Homo sapiens
ctgactaaactttt

SEQ ID NO: 4418790 - DNA, 22 bp, Homo sapiens
ctgactaaactttttttctgta

SEQ ID NO: 4418791 - DNA, 18 bp, Homo sapiens
ctgactcaattatttgca

SEQ ID NO: 4418792 - DNA, 15 bp, Homo sapiens
ctgactcagggctcc

SEQ ID NO: 4418793 - DNA, 18 bp, Homo sapiens
ctgactcagggctcctgg

SEQ ID NO: 4418794 - DNA, 19 bp, Homo sapiens
ctgactcagggctcctggg

SEQ ID NO: 4418795 - DNA, 14 bp, Homo sapiens
ctgactcagtgacc

SEQ ID NO: 4418796 - DNA, 15 bp, Homo sapiens
ctgactccctgtggg

SEQ ID NO: 4418797 - DNA, 17 bp, Homo sapiens
ctgactccctgtggggg

SEQ ID NO: 4418798 - DNA, 21 bp, Homo sapiens
ctgactcctctggctttccca

SEQ ID NO: 4418799 - DNA, 19 bp, Homo sapiens
ctgactctgccccctgctg

SEQ ID NO: 4418800 - DNA, 21 bp, Homo sapiens
ctgactgaaagtagggggctt

SEQ ID NO: 4418801 - DNA, 17 bp, Homo sapiens
ctgactgccccctcctg

SEQ ID NO: 4418802 - DNA, 23 bp, Homo sapiens
ctgactggaggaggcctgtccca

SEQ ID NO: 4418803 - DNA, 12 bp, Homo sapiens
ctgactgggagt

SEQ ID NO: 4418804 - DNA, 18 bp, Homo sapiens
ctgactggtttctcctgg

SEQ ID NO: 4418805 - DNA, 14 bp, Homo sapiens
ctgactgtccagga

SEQ ID NO: 4418806 - DNA, 15 bp, Homo sapiens
ctgactgttcttggt

SEQ ID NO: 4418807 - DNA, 20 bp, Homo sapiens
ctgacttagcctcctcccaa

SEQ ID NO: 4418808 - DNA, 15 bp, Homo sapiens
ctgacttcacatctg

SEQ ID NO: 4418809 - DNA, 13 bp, Homo sapiens
ctgacttctaagt

SEQ ID NO: 4418810 - DNA, 20 bp, Homo sapiens
ctgacttggatcccaaagca

SEQ ID NO: 4418811 - DNA, 23 bp, Homo sapiens
ctgacttggatcccaaagcaagg

SEQ ID NO: 4418812 - DNA, 12 bp, Homo sapiens
ctgacttgggga

SEQ ID NO: 4418813 - DNA, 13 bp, Homo sapiens
ctgagaaagacta

SEQ ID NO: 4418814 - DNA, 20 bp, Homo sapiens
ctgagaagaagtggctgcca

SEQ ID NO: 4418815 - DNA, 21 bp, Homo sapiens
ctgagaaggaacagggaacat

SEQ ID NO: 4418816 - DNA, 19 bp, Homo sapiens
ctgagaatgtaagaactac

SEQ ID NO: 4418817 - DNA, 16 bp, Homo sapiens
ctgagacagtgaattt

SEQ ID NO: 4418818 - DNA, 18 bp, Homo sapiens
ctgagaccagggtggcca

SEQ ID NO: 4418819 - DNA, 16 bp, Homo sapiens
ctgagacccctggcct

SEQ ID NO: 4418820 - DNA, 20 bp, Homo sapiens
ctgagacccctggcctccgg

SEQ ID NO: 4418821 - DNA, 21 bp, Homo sapiens
ctgagacccctggcctccggc

SEQ ID NO: 4418822 - DNA, 17 bp, Homo sapiens
ctgagactctcttagga

SEQ ID NO: 4418823 - DNA, 22 bp, Homo sapiens
ctgagagaggccattctttccc

SEQ ID NO: 4418824 - DNA, 12 bp, Homo sapiens
ctgagagccctg

SEQ ID NO: 4418825 - DNA, 15 bp, Homo sapiens
ctgagagcctgtgga

SEQ ID NO: 4418826 - DNA, 15 bp, Homo sapiens
ctgagaggcaggcat

SEQ ID NO: 4418827 - DNA, 17 bp, Homo sapiens
ctgagaggcaggcatag

SEQ ID NO: 4418828 - DNA, 12 bp, Homo sapiens
ctgagaggccac

SEQ ID NO: 4418829 - DNA, 17 bp, Homo sapiens
ctgagatacaaggccca

SEQ ID NO: 4418830 - DNA, 22 bp, Homo sapiens
ctgagatacaaggcccagaagc

SEQ ID NO: 4418831 - DNA, 18 bp, Homo sapiens
ctgagataccagcgagga

SEQ ID NO: 4418832 - DNA, 12 bp, Homo sapiens
ctgagatatgaa

SEQ ID NO: 4418833 - DNA, 15 bp, Homo sapiens
ctgagatatgaacat

SEQ ID NO: 4418834 - DNA, 16 bp, Homo sapiens
ctgagatatgaacata

SEQ ID NO: 4418835 - DNA, 14 bp, Homo sapiens
ctgagatcgtgccg

SEQ ID NO: 4418836 - DNA, 20 bp, Homo sapiens
ctgagatctgcacagtcaga

SEQ ID NO: 4418837 - DNA, 16 bp, Homo sapiens
ctgagatgcaggtgat

SEQ ID NO: 4418838 - DNA, 21 bp, Homo sapiens
ctgagatgtgaacacatcagc

SEQ ID NO: 4418839 - DNA, 17 bp, Homo sapiens
ctgagattgcagatgtg

SEQ ID NO: 4418840 - DNA, 22 bp, Homo sapiens
ctgagatttaacccctccactg

SEQ ID NO: 4418841 - DNA, 20 bp, Homo sapiens
ctgagatttcatctgctctc

SEQ ID NO: 4418842 - DNA, 20 bp, Homo sapiens
ctgagcacccagctctgtct

SEQ ID NO: 4418843 - DNA, 20 bp, Homo sapiens
ctgagcacttagcaggcacc

SEQ ID NO: 4418844 - DNA, 11 bp, Homo sapiens
ctgagcagccg

SEQ ID NO: 4418845 - DNA, 14 bp, Homo sapiens
ctgagcagccgcca

SEQ ID NO: 4418846 - DNA, 15 bp, Homo sapiens
ctgagcagccgccag

SEQ ID NO: 4418847 - DNA, 17 bp, Homo sapiens
ctgagcagccgccagct

SEQ ID NO: 4418848 - DNA, 22 bp, Homo sapiens
ctgagcagccgccagctgggag

SEQ ID NO: 4418849 - DNA, 14 bp, Homo sapiens
cctggccatttcca

SEQ ID NO: 4418850 - DNA, 15 bp, Homo sapiens
cctggccccagcctg

SEQ ID NO: 4418851 - DNA, 18 bp, Homo sapiens
cctggccccagcctgggc

SEQ ID NO: 4418852 - DNA, 21 bp, Homo sapiens
cctggccccaggccccagaca

SEQ ID NO: 4418853 - DNA, 12 bp, Homo sapiens
cctggccccatg

SEQ ID NO: 4418854 - DNA, 16 bp, Homo sapiens
cctggcccccaacctc

SEQ ID NO: 4418855 - DNA, 17 bp, Homo sapiens
cctggcccccacagcgc

SEQ ID NO: 4418856 - DNA, 19 bp, Homo sapiens
cctggcccccatcagccct

SEQ ID NO: 4418857 - DNA, 22 bp, Homo sapiens
cctggcccccatcagccctgct

SEQ ID NO: 4418858 - DNA, 16 bp, Homo sapiens
cctggccctccccaca

SEQ ID NO: 4418859 - DNA, 23 bp, Homo sapiens
cctggcctatccgctgccagcct

SEQ ID NO: 4418860 - DNA, 15 bp, Homo sapiens
cctggcctcccgcca

SEQ ID NO: 4418861 - DNA, 13 bp, Homo sapiens
cctggcctccggc

SEQ ID NO: 4418862 - DNA, 21 bp, Homo sapiens
cctggcctccggcgtcagcct

SEQ ID NO: 4418863 - DNA, 24 bp, Homo sapiens
cctggcctccggcgtcagcctcca

SEQ ID NO: 4418864 - DNA, 12 bp, Homo sapiens
cctggcctgctg

SEQ ID NO: 4418865 - DNA, 13 bp, Homo sapiens
cctggcctgctgg

SEQ ID NO: 4418866 - DNA, 15 bp, Homo sapiens
cctggccttcctgtc

SEQ ID NO: 4418867 - DNA, 13 bp, Homo sapiens
cctggccttctga

SEQ ID NO: 4418868 - DNA, 20 bp, Homo sapiens
cctggcgactgcccctgcct

SEQ ID NO: 4418869 - DNA, 19 bp, Homo sapiens
cctggcgcaggtgggctgg

SEQ ID NO: 4418870 - DNA, 22 bp, Homo sapiens
cctggcgcaggtgggctggact

SEQ ID NO: 4418871 - DNA, 23 bp, Homo sapiens
cctggcgcaggtgggctggactt

SEQ ID NO: 4418872 - DNA, 17 bp, Homo sapiens
cctctcagttctctccc

SEQ ID NO: 4418873 - DNA, 22 bp, Homo sapiens
cctctcagttctctcccttcct

SEQ ID NO: 4418874 - DNA, 18 bp, Homo sapiens
cctctccactcatgtgac

SEQ ID NO: 4418875 - DNA, 17 bp, Homo sapiens
cctctccatatctcctt

SEQ ID NO: 4418876 - DNA, 22 bp, Homo sapiens
cctctcccacagagtgctggac

SEQ ID NO: 4418877 - DNA, 20 bp, Homo sapiens
cctctccccaatccatgctt

SEQ ID NO: 4418878 - DNA, 20 bp, Homo sapiens
cctctccccctcctccaggg

SEQ ID NO: 4418879 - DNA, 14 bp, Homo sapiens
cctctccctgccaa

SEQ ID NO: 4418880 - DNA, 16 bp, Homo sapiens
cctctccctgcctgtg

SEQ ID NO: 4418881 - DNA, 23 bp, Homo sapiens
cctctccctgctgctcctaggac

SEQ ID NO: 4418882 - DNA, 20 bp, Homo sapiens
cctctccctgtgttctgggc

SEQ ID NO: 4418883 - DNA, 17 bp, Homo sapiens
cctctcccttaccctgg

SEQ ID NO: 4418884 - DNA, 23 bp, Homo sapiens
cctctccgactctgcacccgcct

SEQ ID NO: 4418885 - DNA, 16 bp, Homo sapiens
cctctcctccccttcc

SEQ ID NO: 4418886 - DNA, 11 bp, Homo sapiens
cctctcctgcc

SEQ ID NO: 4418887 - DNA, 15 bp, Homo sapiens
cctctcctgccctgt

SEQ ID NO: 4418888 - DNA, 17 bp, Homo sapiens
cctctcctgccctgtga

SEQ ID NO: 4418889 - DNA, 15 bp, Homo sapiens
cctctcctgcctact

SEQ ID NO: 4418890 - DNA, 14 bp, Homo sapiens
cctctcctgggggt

SEQ ID NO: 4418891 - DNA, 14 bp, Homo sapiens
cctctcgagcccag

SEQ ID NO: 4418892 - DNA, 15 bp, Homo sapiens
cctctcgagcccaga

SEQ ID NO: 4418893 - DNA, 16 bp, Homo sapiens
cctctcgagcccagat

SEQ ID NO: 4418894 - DNA, 19 bp, Homo sapiens
cctctcgccccatccctgc

SEQ ID NO: 4418895 - DNA, 22 bp, Homo sapiens
cctctcgccccatccctgcttg

SEQ ID NO: 4418896 - DNA, 15 bp, Homo sapiens
cctctcggtgctcca

SEQ ID NO: 4418897 - DNA, 18 bp, Homo sapiens
cctctctagggacccctc

SEQ ID NO: 4418898 - DNA, 13 bp, Homo sapiens
cctctctccctgc

SEQ ID NO: 4418899 - DNA, 23 bp, Homo sapiens
cctctctccttggccacagactg

SEQ ID NO: 4418900 - DNA, 15 bp, Homo sapiens
cctctctctcactcc

SEQ ID NO: 4418901 - DNA, 17 bp, Homo sapiens
cctctctctcactcccc

SEQ ID NO: 4418902 - DNA, 12 bp, Homo sapiens
cctctctctggg

SEQ ID NO: 4418903 - DNA, 18 bp, Homo sapiens
cctctctcttctgctcca

SEQ ID NO: 4418904 - DNA, 20 bp, Homo sapiens
cctctctcttctgctccacc

SEQ ID NO: 4418905 - DNA, 19 bp, Homo sapiens
cctctctgatgtcccagtg

SEQ ID NO: 4418906 - DNA, 22 bp, Homo sapiens
cctctctgcagacttcccagct

SEQ ID NO: 4418907 - DNA, 23 bp, Homo sapiens
cctctctgcagacttcccagcta

SEQ ID NO: 4418908 - DNA, 21 bp, Homo sapiens
cctgaattctatttgctgggc

SEQ ID NO: 4418909 - DNA, 13 bp, Homo sapiens
cctgacactccct

SEQ ID NO: 4418910 - DNA, 23 bp, Homo sapiens
cctgaccaaacagccaactagcc

SEQ ID NO: 4418911 - DNA, 19 bp, Homo sapiens
cctgaccaacatggagaaa

SEQ ID NO: 4418912 - DNA, 13 bp, Homo sapiens
cctgacccctgcc

SEQ ID NO: 4418913 - DNA, 15 bp, Homo sapiens
cctgacccctgctca

SEQ ID NO: 4418914 - DNA, 21 bp, Homo sapiens
cctgacccttctctcacttct

SEQ ID NO: 4418915 - DNA, 18 bp, Homo sapiens
cctgaccttagcgttctg

SEQ ID NO: 4418916 - DNA, 20 bp, Homo sapiens
cctgaccttagcgttctgga

SEQ ID NO: 4418917 - DNA, 16 bp, Homo sapiens
cctgactaagcctttg

SEQ ID NO: 4418918 - DNA, 17 bp, Homo sapiens
cctgactcctggactcc

SEQ ID NO: 4418919 - DNA, 14 bp, Homo sapiens
cctgactctgcccc

SEQ ID NO: 4418920 - DNA, 16 bp, Homo sapiens
cctgacttcacatctg

SEQ ID NO: 4418921 - DNA, 17 bp, Homo sapiens
cctgacttgagccactc

SEQ ID NO: 4418922 - DNA, 20 bp, Homo sapiens
cctgacttgagccactcctt

SEQ ID NO: 4418923 - DNA, 18 bp, Homo sapiens
cctgacttttctgtggat

SEQ ID NO: 4418924 - DNA, 23 bp, Homo sapiens
cctgagaactgaattttgggact

SEQ ID NO: 4418925 - DNA, 20 bp, Homo sapiens
cctgagaagaagtggctgcc

SEQ ID NO: 4418926 - DNA, 21 bp, Homo sapiens
cctgagaagaagtggctgcca

SEQ ID NO: 4418927 - DNA, 22 bp, Homo sapiens
cctgagaccagggtggccacac

SEQ ID NO: 4418928 - DNA, 24 bp, Homo sapiens
cctgagaccagggtggccacacag

SEQ ID NO: 4418929 - DNA, 20 bp, Homo sapiens
cctgagacccctggcctccg

SEQ ID NO: 4418930 - DNA, 18 bp, Homo sapiens
cctgagaggcaggcatag

SEQ ID NO: 4418931 - DNA, 21 bp, Homo sapiens
cctgagatctgcacagtcaga

SEQ ID NO: 4418932 - DNA, 20 bp, Homo sapiens
cctgagatgcaggtgatgcc

SEQ ID NO: 4418933 - DNA, 22 bp, Homo sapiens
cctgagatttcatctgctctcc

SEQ ID NO: 4418934 - DNA, 23 bp, Homo sapiens
cctgagatttcatctgctctcct

SEQ ID NO: 4418935 - DNA, 23 bp, Homo sapiens
cctgagcaactcttgattatcca

SEQ ID NO: 4418936 - DNA, 16 bp, Homo sapiens
cctgagcactcctggt

SEQ ID NO: 4418937 - DNA, 13 bp, Homo sapiens
cctgagcatccag

SEQ ID NO: 4418938 - DNA, 23 bp, Homo sapiens
cctgagcattcaggcagcactga

SEQ ID NO: 4418939 - DNA, 14 bp, Homo sapiens
cctgagccaatggg

SEQ ID NO: 4418940 - DNA, 11 bp, Homo sapiens
cctgagcccca

SEQ ID NO: 4418941 - DNA, 20 bp, Homo sapiens
cctgagcccctttgcctgtc

SEQ ID NO: 4418942 - DNA, 12 bp, Homo sapiens
cctgagcgctcc

SEQ ID NO: 4418943 - DNA, 18 bp, Homo sapiens
cctgagctagaagctgga

SEQ ID NO: 4418944 - DNA, 21 bp, Homo sapiens
cctgagctattttcctctggc

SEQ ID NO: 4418945 - DNA, 22 bp, Homo sapiens
cctgagctattttcctctggcc

SEQ ID NO: 4418946 - DNA, 18 bp, Homo sapiens
cctgagctcggggacagg

SEQ ID NO: 4418947 - DNA, 15 bp, Homo sapiens
cctgagctgaggcag

SEQ ID NO: 4418948 - DNA, 18 bp, Homo sapiens
cctgaggaacccttacag

SEQ ID NO: 4418949 - DNA, 19 bp, Homo sapiens
cctgaggaagagggactgt

SEQ ID NO: 4418950 - DNA, 18 bp, Homo sapiens
cctgaggcctagactctg

SEQ ID NO: 4418951 - DNA, 15 bp, Homo sapiens
cctgaggcctccaag

SEQ ID NO: 4418952 - DNA, 15 bp, Homo sapiens
cctgaggcggaggct

SEQ ID NO: 4418953 - DNA, 20 bp, Homo sapiens
cctgaggcggaggctgtgct

SEQ ID NO: 4418954 - DNA, 22 bp, Homo sapiens
cctgaggcggaggctgtgctcc

SEQ ID NO: 4418955 - DNA, 22 bp, Homo sapiens
cctgaggctttggatttgacat

SEQ ID NO: 4418956 - DNA, 18 bp, Homo sapiens
cctgaggggcatctgccc

SEQ ID NO: 4418957 - DNA, 22 bp, Homo sapiens
cctgaggggcatctgcccctcc

SEQ ID NO: 4418958 - DNA, 23 bp, Homo sapiens
cctgaggggcatctgcccctccc

SEQ ID NO: 4418959 - DNA, 22 bp, Homo sapiens
cctgaggtcaggagttcaagac

SEQ ID NO: 4418960 - DNA, 21 bp, Homo sapiens
cctgaggttaaacggtgccca

SEQ ID NO: 4418961 - DNA, 23 bp, Homo sapiens
cctgaggttaaacggtgcccatc

SEQ ID NO: 4418962 - DNA, 13 bp, Homo sapiens
cctgagtcaccag

SEQ ID NO: 4418963 - DNA, 15 bp, Homo sapiens
cctgagtccagaatg

SEQ ID NO: 4418964 - DNA, 13 bp, Homo sapiens
cctgagtgacaga

SEQ ID NO: 4418965 - DNA, 19 bp, Homo sapiens
cctgagtgacggcaacctg

SEQ ID NO: 4418966 - DNA, 21 bp, Homo sapiens
cctgagtgcgggctgaggcca

SEQ ID NO: 4418967 - DNA, 22 bp, Homo sapiens
cctgagtgcgggctgaggccag

SEQ ID NO: 4418968 - DNA, 17 bp, Homo sapiens
cctgataacaacctgga

SEQ ID NO: 4418969 - DNA, 18 bp, Homo sapiens
cctgataacaacctggag

SEQ ID NO: 4418970 - DNA, 16 bp, Homo sapiens
cctgatactttagcca

SEQ ID NO: 4418971 - DNA, 13 bp, Homo sapiens
cctgatcagagcc

SEQ ID NO: 4418972 - DNA, 23 bp, Homo sapiens
cctgatctcgtttactccatgtt

SEQ ID NO: 4418973 - DNA, 13 bp, Homo sapiens
cctgatctctgct

SEQ ID NO: 4418974 - DNA, 17 bp, Homo sapiens
cctgatcttacagaaaa

SEQ ID NO: 4418975 - DNA, 22 bp, Homo sapiens
cctgatctttgggcatcagaaa

SEQ ID NO: 4418976 - DNA, 23 bp, Homo sapiens
cctgatgctccctcccctgccct

SEQ ID NO: 4418977 - DNA, 18 bp, Homo sapiens
cctgatggcctttggacc

SEQ ID NO: 4418978 - DNA, 17 bp, Homo sapiens
cctgatgggggacagga

SEQ ID NO: 4418979 - DNA, 14 bp, Homo sapiens
cctgattattttag

SEQ ID NO: 4418980 - DNA, 18 bp, Homo sapiens
cctgattattttagctaa

SEQ ID NO: 4418981 - DNA, 14 bp, Homo sapiens
cctgattggccact

SEQ ID NO: 4418982 - DNA, 23 bp, Homo sapiens
cctgattggccactggatcctgc

SEQ ID NO: 4418983 - DNA, 15 bp, Homo sapiens
cctgattgtattttt

SEQ ID NO: 4418984 - DNA, 17 bp, Homo sapiens
cctgattgtgccagtgc

SEQ ID NO: 4418985 - DNA, 16 bp, Homo sapiens
cctgattttttttcct

SEQ ID NO: 4418986 - DNA, 22 bp, Homo sapiens
cctgattttttttccttttaat

SEQ ID NO: 4418987 - DNA, 16 bp, Homo sapiens
cctgcaactcagcccc

SEQ ID NO: 4418988 - DNA, 18 bp, Homo sapiens
cctgcaacttccgctgag

SEQ ID NO: 4418989 - DNA, 20 bp, Homo sapiens
cctgcaacttccgctgaggg

SEQ ID NO: 4418990 - DNA, 15 bp, Homo sapiens
cctgcaagatggaca

SEQ ID NO: 4418991 - DNA, 22 bp, Homo sapiens
cctgcaagctccgcctcccggg

SEQ ID NO: 4418992 - DNA, 18 bp, Homo sapiens
cctgcaagttgctctgac

SEQ ID NO: 4418993 - DNA, 22 bp, Homo sapiens
cctgcaatgtggtgacacctcc

SEQ ID NO: 4418994 - DNA, 19 bp, Homo sapiens
cctgcacaataaaaatgtt

SEQ ID NO: 4418995 - DNA, 20 bp, Homo sapiens
cctgcacaataaaaatgttt

SEQ ID NO: 4418996 - DNA, 15 bp, Homo sapiens
cctgcacaccctggg

SEQ ID NO: 4418997 - DNA, 19 bp, Homo sapiens
cctgcacaccctgggccac

SEQ ID NO: 4418998 - DNA, 20 bp, Homo sapiens
cctgcacaccctgggccacg

SEQ ID NO: 4418999 - DNA, 13 bp, Homo sapiens
cctgcaccccagc

SEQ ID NO: 4419000 - DNA, 22 bp, Homo sapiens
cctgcaccccagcattccagct

SEQ ID NO: 4419001 - DNA, 15 bp, Homo sapiens
cctgcaccggggcct

SEQ ID NO: 4419002 - DNA, 17 bp, Homo sapiens
cctgcaccggggcctgg

SEQ ID NO: 4419003 - DNA, 16 bp, Homo sapiens
cctgcacctgccccgt

SEQ ID NO: 4419004 - DNA, 18 bp, Homo sapiens
cctgcacggtgggccttg

SEQ ID NO: 4419005 - DNA, 22 bp, Homo sapiens
cctgcacggtgggccttgctgg

SEQ ID NO: 4419006 - DNA, 23 bp, Homo sapiens
cctgcacgtcatgggagggggct

SEQ ID NO: 4419007 - DNA, 22 bp, Homo sapiens
cctgcactttgatgtcatgtgt

SEQ ID NO: 4419008 - DNA, 18 bp, Homo sapiens
cctgcagacacctggact

SEQ ID NO: 4419009 - DNA, 23 bp, Homo sapiens
cctgcagacacctggactgagcc

SEQ ID NO: 4419010 - DNA, 15 bp, Homo sapiens
cctgcagacctcaag

SEQ ID NO: 4419011 - DNA, 20 bp, Homo sapiens
cctgcagacctcaagccatc

SEQ ID NO: 4419012 - DNA, 23 bp, Homo sapiens
cctgcagattctgagcaaaggcc

SEQ ID NO: 4419013 - DNA, 12 bp, Homo sapiens
cctgcagcaggc

SEQ ID NO: 4419014 - DNA, 14 bp, Homo sapiens
cctgcagcaggcag

SEQ ID NO: 4419015 - DNA, 22 bp, Homo sapiens
cctgcagcagtcgcccaagcag

SEQ ID NO: 4419016 - DNA, 15 bp, Homo sapiens
cctgcagccagggct

SEQ ID NO: 4419017 - DNA, 17 bp, Homo sapiens
cctgcagccagggctgg

SEQ ID NO: 4419018 - DNA, 13 bp, Homo sapiens
cctgcagcccacc

SEQ ID NO: 4419019 - DNA, 18 bp, Homo sapiens
cctgcagcccaccagacg

SEQ ID NO: 4419020 - DNA, 22 bp, Homo sapiens
cctgcagcggctgccctctggg

SEQ ID NO: 4419021 - DNA, 20 bp, Homo sapiens
cctgcagctggaatgtgcca

SEQ ID NO: 4419022 - DNA, 23 bp, Homo sapiens
cctgcagctggaatgtgccacag

SEQ ID NO: 4419023 - DNA, 20 bp, Homo sapiens
cctgcaggagagagcagcac

SEQ ID NO: 4419024 - DNA, 15 bp, Homo sapiens
cctgcaggcagagct

SEQ ID NO: 4419025 - DNA, 22 bp, Homo sapiens
cctgcaggcaggaacaaacagg

SEQ ID NO: 4419026 - DNA, 22 bp, Homo sapiens
cctgcagggagccttctgccac

SEQ ID NO: 4419027 - DNA, 15 bp, Homo sapiens
cctgcagggcttctc

SEQ ID NO: 4419028 - DNA, 22 bp, Homo sapiens
cctgcataatgtttctggattt

SEQ ID NO: 4419029 - DNA, 13 bp, Homo sapiens
cctgcatatttag

SEQ ID NO: 4419030 - DNA, 14 bp, Homo sapiens
cctgcatcatcttg

SEQ ID NO: 4419031 - DNA, 19 bp, Homo sapiens
cctgcatccgtagttccct

SEQ ID NO: 4419032 - DNA, 15 bp, Homo sapiens
cctgcatctctgtga

SEQ ID NO: 4419033 - DNA, 21 bp, Homo sapiens
cctgcatctctgtgaagcctc

SEQ ID NO: 4419034 - DNA, 15 bp, Homo sapiens
cctgcatgcaactaa

SEQ ID NO: 4419035 - DNA, 18 bp, Homo sapiens
cctgcatgcaactaattc

SEQ ID NO: 4419036 - DNA, 22 bp, Homo sapiens
cctgcattatgcacgtgtctgg

SEQ ID NO: 4419037 - DNA, 15 bp, Homo sapiens
cctgccaagactcct

SEQ ID NO: 4419038 - DNA, 18 bp, Homo sapiens
cctgccaagactcctcag

SEQ ID NO: 4419039 - DNA, 20 bp, Homo sapiens
cctgccaagtctcagaagag

SEQ ID NO: 4419040 - DNA, 13 bp, Homo sapiens
cctgccaattgct

SEQ ID NO: 4419041 - DNA, 14 bp, Homo sapiens
cctgccactcacac

SEQ ID NO: 4419042 - DNA, 21 bp, Homo sapiens
cctgccactcacacagccagg

SEQ ID NO: 4419043 - DNA, 17 bp, Homo sapiens
cctgccactctctggga

SEQ ID NO: 4419044 - DNA, 19 bp, Homo sapiens
cctgccactctctgggact

SEQ ID NO: 4419045 - DNA, 21 bp, Homo sapiens
cctgccactctctgggactct

SEQ ID NO: 4419046 - DNA, 13 bp, Homo sapiens
cctgccagccggt

SEQ ID NO: 4419047 - DNA, 22 bp, Homo sapiens
cctgccaggcaggggtgggggt

SEQ ID NO: 4419048 - DNA, 22 bp, Homo sapiens
cctgccagtgccttacctcctg

SEQ ID NO: 4419049 - DNA, 19 bp, Homo sapiens
cctgccatgccaggaacct

SEQ ID NO: 4419050 - DNA, 17 bp, Homo sapiens
cctgccattcttctggt

SEQ ID NO: 4419051 - DNA, 22 bp, Homo sapiens
cctgcccaaacagctgtattta

SEQ ID NO: 4419052 - DNA, 15 bp, Homo sapiens
cctgcccaaaccctt

SEQ ID NO: 4419053 - DNA, 23 bp, Homo sapiens
cctgcccaatgagactctagggt

SEQ ID NO: 4419054 - DNA, 13 bp, Homo sapiens
cctgcccacagaa

SEQ ID NO: 4419055 - DNA, 13 bp, Homo sapiens
cctgcccagcctg

SEQ ID NO: 4419056 - DNA, 15 bp, Homo sapiens
cctgcccagcctgct

SEQ ID NO: 4419057 - DNA, 23 bp, Homo sapiens
cctgcccaggagagccagccctc

SEQ ID NO: 4419058 - DNA, 12 bp, Homo sapiens
cctgcccaggcc

SEQ ID NO: 4419059 - DNA, 15 bp, Homo sapiens
cctgcccaggccaca

SEQ ID NO: 4419060 - DNA, 16 bp, Homo sapiens
cctgcccaggccacag

SEQ ID NO: 4419061 - DNA, 19 bp, Homo sapiens
cctgcccaggccacagaga

SEQ ID NO: 4419062 - DNA, 22 bp, Homo sapiens
cctgcccatgtgtcccctcact

SEQ ID NO: 4419063 - DNA, 24 bp, Homo sapiens
cctgccccacccaactccacaggg

SEQ ID NO: 4419064 - DNA, 15 bp, Homo sapiens
cctgcccccacccct

SEQ ID NO: 4419065 - DNA, 17 bp, Homo sapiens
cctgcccccagccccgg

SEQ ID NO: 4419066 - DNA, 18 bp, Homo sapiens
cctgcccccagccccggg

SEQ ID NO: 4419067 - DNA, 20 bp, Homo sapiens
cctgcccccaggactgggcc

SEQ ID NO: 4419068 - DNA, 22 bp, Homo sapiens
cctgcccccaggactgggccac

SEQ ID NO: 4419069 - DNA, 16 bp, Homo sapiens
cctgccccctgccagt

SEQ ID NO: 4419070 - DNA, 18 bp, Homo sapiens
cctgccccctgccagtga

SEQ ID NO: 4419071 - DNA, 18 bp, Homo sapiens
cctgccccgcccccagtc

SEQ ID NO: 4419072 - DNA, 23 bp, Homo sapiens
cctgccccgtcggactgccccca

SEQ ID NO: 4419073 - DNA, 12 bp, Homo sapiens
cctgcccgtctc

SEQ ID NO: 4419074 - DNA, 13 bp, Homo sapiens
cctgcccgtctct

SEQ ID NO: 4419075 - DNA, 20 bp, Homo sapiens
cctgcccgtctctctcccat

SEQ ID NO: 4419076 - DNA, 23 bp, Homo sapiens
cctgcccgtgagggtggggggga

SEQ ID NO: 4419077 - DNA, 18 bp, Homo sapiens
cctgccctcaagggtgtg

SEQ ID NO: 4419078 - DNA, 13 bp, Homo sapiens
cctgccctggagg

SEQ ID NO: 4419079 - DNA, 12 bp, Homo sapiens
cctgccctggtc

SEQ ID NO: 4419080 - DNA, 15 bp, Homo sapiens
cctgccctggtccag

SEQ ID NO: 4419081 - DNA, 13 bp, Homo sapiens
cctgcccttccct

SEQ ID NO: 4419082 - DNA, 14 bp, Homo sapiens
cctgcccttccctc

SEQ ID NO: 4419083 - DNA, 15 bp, Homo sapiens
cctgcccttccctct

SEQ ID NO: 4419084 - DNA, 18 bp, Homo sapiens
cctgccgacctcgtcctc

SEQ ID NO: 4419085 - DNA, 14 bp, Homo sapiens
cctgccgagagtcc

SEQ ID NO: 4419086 - DNA, 23 bp, Homo sapiens
cctgccgagagtccatcagcctc

SEQ ID NO: 4419087 - DNA, 13 bp, Homo sapiens
cctgccgcagagc

SEQ ID NO: 4419088 - DNA, 16 bp, Homo sapiens
cctgccgcagagctgg

SEQ ID NO: 4419089 - DNA, 17 bp, Homo sapiens
cctgccgcagagctggc

SEQ ID NO: 4419090 - DNA, 14 bp, Homo sapiens
cctgccgccctgtg

SEQ ID NO: 4419091 - DNA, 15 bp, Homo sapiens
cctgccgccctgtgg

SEQ ID NO: 4419092 - DNA, 16 bp, Homo sapiens
cctgccggtgggaccc

SEQ ID NO: 4419093 - DNA, 18 bp, Homo sapiens
cctgcctaaggttgtcta

SEQ ID NO: 4419094 - DNA, 19 bp, Homo sapiens
cctgcctattatctgtcag

SEQ ID NO: 4419095 - DNA, 14 bp, Homo sapiens
cctgcctcagccag

SEQ ID NO: 4419096 - DNA, 17 bp, Homo sapiens
cctgcctcagccttcca

SEQ ID NO: 4419097 - DNA, 13 bp, Homo sapiens
cctgcctccaccc

SEQ ID NO: 4419098 - DNA, 17 bp, Homo sapiens
cctgcctccagggctgg

SEQ ID NO: 4419099 - DNA, 23 bp, Homo sapiens
cctgcctccagggctggactgag

SEQ ID NO: 4419100 - DNA, 12 bp, Homo sapiens
cctgcctcctgc

SEQ ID NO: 4419101 - DNA, 16 bp, Homo sapiens
cctgcctcctgcctat

SEQ ID NO: 4419102 - DNA, 13 bp, Homo sapiens
cctgcctctgacc

SEQ ID NO: 4419103 - DNA, 19 bp, Homo sapiens
cctgcctgcagccagggct

SEQ ID NO: 4419104 - DNA, 12 bp, Homo sapiens
cctgcctggacc

SEQ ID NO: 4419105 - DNA, 13 bp, Homo sapiens
cctgcctggagcg

SEQ ID NO: 4419106 - DNA, 14 bp, Homo sapiens
cctgcctggccagg

SEQ ID NO: 4419107 - DNA, 11 bp, Homo sapiens
cctgcctgtgc

SEQ ID NO: 4419108 - DNA, 23 bp, Homo sapiens
cctgcctgtggcccctcccctgc

SEQ ID NO: 4419109 - DNA, 21 bp, Homo sapiens
cctgccttagagccaggcaca

SEQ ID NO: 4419110 - DNA, 18 bp, Homo sapiens
cctgccttcttcggggaa

SEQ ID NO: 4419111 - DNA, 17 bp, Homo sapiens
cctgccttggagagggc

SEQ ID NO: 4419112 - DNA, 15 bp, Homo sapiens
cctgccttggcctcc

SEQ ID NO: 4419113 - DNA, 23 bp, Homo sapiens
cctgccttggcctcccaaagtgc

SEQ ID NO: 4419114 - DNA, 13 bp, Homo sapiens
cctgcctttgatg

SEQ ID NO: 4419115 - DNA, 20 bp, Homo sapiens
cctgcgagacgcacacagct

SEQ ID NO: 4419116 - DNA, 21 bp, Homo sapiens
cctgcgagacgcacacagctg

SEQ ID NO: 4419117 - DNA, 19 bp, Homo sapiens
cctgcgcccaccccgctct

SEQ ID NO: 4419118 - DNA, 16 bp, Homo sapiens
cctgcgcctgctgcct

SEQ ID NO: 4419119 - DNA, 17 bp, Homo sapiens
cctgcgggcccctggtg

SEQ ID NO: 4419120 - DNA, 18 bp, Homo sapiens
cctgcgggcccctggtga

SEQ ID NO: 4419121 - DNA, 17 bp, Homo sapiens
cctgcgggcgcgggcag

SEQ ID NO: 4419122 - DNA, 13 bp, Homo sapiens
cctgcggtggagg

SEQ ID NO: 4419123 - DNA, 15 bp, Homo sapiens
cctgcgtcccagcct

SEQ ID NO: 4419124 - DNA, 16 bp, Homo sapiens
cctgcgtcccagcctg

SEQ ID NO: 4419125 - DNA, 13 bp, Homo sapiens
cctgcgtcctcct

SEQ ID NO: 4419126 - DNA, 18 bp, Homo sapiens
cctgctaaggctcctcct

SEQ ID NO: 4419127 - DNA, 19 bp, Homo sapiens
cctgctaaggctcctcctt

SEQ ID NO: 4419128 - DNA, 16 bp, Homo sapiens
cctgctactcctgtgc

SEQ ID NO: 4419129 - DNA, 14 bp, Homo sapiens
cctgctagcacaga

SEQ ID NO: 4419130 - DNA, 15 bp, Homo sapiens
cctgctagcacagag

SEQ ID NO: 4419131 - DNA, 17 bp, Homo sapiens
cctgctagcacagaggc

SEQ ID NO: 4419132 - DNA, 22 bp, Homo sapiens
cctgctagcacagaggcctgac

SEQ ID NO: 4419133 - DNA, 22 bp, Homo sapiens
cctgctcaactctacccctgct

SEQ ID NO: 4419134 - DNA, 23 bp, Homo sapiens
cctgctcaactctacccctgctc

SEQ ID NO: 4419135 - DNA, 19 bp, Homo sapiens
cctgctcacgtcaaatgca

SEQ ID NO: 4419136 - DNA, 20 bp, Homo sapiens
cctgctcatcacccttccga

SEQ ID NO: 4419137 - DNA, 19 bp, Homo sapiens
cctgctcccagtcctgcct

SEQ ID NO: 4419138 - DNA, 16 bp, Homo sapiens
cctgctcccccacccc

SEQ ID NO: 4419139 - DNA, 12 bp, Homo sapiens
cctgctccctgc

SEQ ID NO: 4419140 - DNA, 13 bp, Homo sapiens
cctgctccctgcc

SEQ ID NO: 4419141 - DNA, 21 bp, Homo sapiens
cctgctccctgcctcctgcct

SEQ ID NO: 4419142 - DNA, 22 bp, Homo sapiens
cctgctcctagcaccctggaga

SEQ ID NO: 4419143 - DNA, 18 bp, Homo sapiens
cctgctccttcccaggag

SEQ ID NO: 4419144 - DNA, 23 bp, Homo sapiens
cctgctccttggcacccccatgc

SEQ ID NO: 4419145 - DNA, 23 bp, Homo sapiens
cctgctctccaagtctcagtggc

SEQ ID NO: 4419146 - DNA, 16 bp, Homo sapiens
cctgctcttctctccc

SEQ ID NO: 4419147 - DNA, 18 bp, Homo sapiens
cctgctcttctctcccca

SEQ ID NO: 4419148 - DNA, 19 bp, Homo sapiens
cctgctcttctctccccag

SEQ ID NO: 4419149 - DNA, 22 bp, Homo sapiens
cctgctcttctctccccagccc

SEQ ID NO: 4419150 - DNA, 18 bp, Homo sapiens
cctgctcttttgtgatga

SEQ ID NO: 4419151 - DNA, 21 bp, Homo sapiens
cctgctgaaagtcctgctttc

SEQ ID NO: 4419152 - DNA, 23 bp, Homo sapiens
cctgctgaatgatttccaaagag

SEQ ID NO: 4419153 - DNA, 21 bp, Homo sapiens
cctgctgagagacccaaggag

SEQ ID NO: 4419154 - DNA, 23 bp, Homo sapiens
cctgctgagatgaggaggggagc

SEQ ID NO: 4419155 - DNA, 10 bp, Homo sapiens
cctgctgcat

SEQ ID NO: 4419156 - DNA, 21 bp, Homo sapiens
cctgctgccagtgcagccact

SEQ ID NO: 4419157 - DNA, 22 bp, Homo sapiens
cctgctgccagtgcagccactg

SEQ ID NO: 4419158 - DNA, 15 bp, Homo sapiens
cctgctgcctaataa

SEQ ID NO: 4419159 - DNA, 22 bp, Homo sapiens
cctgctgcctaataaagagact

SEQ ID NO: 4419160 - DNA, 22 bp, Homo sapiens
cctgctgcctccctttcataca

SEQ ID NO: 4419161 - DNA, 14 bp, Homo sapiens
cctgctgcctgctg

SEQ ID NO: 4419162 - DNA, 15 bp, Homo sapiens
cctgctgctcctagg

SEQ ID NO: 4419163 - DNA, 16 bp, Homo sapiens
cctgctgctcctagga

SEQ ID NO: 4419164 - DNA, 12 bp, Homo sapiens
cctgctgcttct

SEQ ID NO: 4419165 - DNA, 15 bp, Homo sapiens
cctgctgcttctcca

SEQ ID NO: 4419166 - DNA, 9 bp, Homo sapiens
cctgctggc

SEQ ID NO: 4419167 - DNA, 17 bp, Homo sapiens
cctgctggctcttctgc

SEQ ID NO: 4419168 - DNA, 12 bp, Homo sapiens
cctgctggctgc

SEQ ID NO: 4419169 - DNA, 13 bp, Homo sapiens
cctgctggctgcg

SEQ ID NO: 4419170 - DNA, 12 bp, Homo sapiens
cctgctgggctc

SEQ ID NO: 4419171 - DNA, 17 bp, Homo sapiens
cctgctgggctctccac

SEQ ID NO: 4419172 - DNA, 20 bp, Homo sapiens
cctgctgggctctccacctc

SEQ ID NO: 4419173 - DNA, 21 bp, Homo sapiens
cctgctgggctctccacctca

SEQ ID NO: 4419174 - DNA, 23 bp, Homo sapiens
cctgctgggctctccacctcagc

SEQ ID NO: 4419175 - DNA, 19 bp, Homo sapiens
cctgctggggaagaacagc

SEQ ID NO: 4419176 - DNA, 13 bp, Homo sapiens
cctgctggtttta

SEQ ID NO: 4419177 - DNA, 21 bp, Homo sapiens
cctgctgtgccatgctgggcc

SEQ ID NO: 4419178 - DNA, 17 bp, Homo sapiens
cctgctgtgctgctcaa

SEQ ID NO: 4419179 - DNA, 13 bp, Homo sapiens
cctgctgtgggag

SEQ ID NO: 4419180 - DNA, 16 bp, Homo sapiens
cctgcttctttccaga

SEQ ID NO: 4419181 - DNA, 17 bp, Homo sapiens
cctgcttctttccagaa

SEQ ID NO: 4419182 - DNA, 17 bp, Homo sapiens
cctgcttgcccgctccc

SEQ ID NO: 4419183 - DNA, 20 bp, Homo sapiens
cctgcttgcccgctcccaca

SEQ ID NO: 4419184 - DNA, 16 bp, Homo sapiens
cctgctttctacgcca

SEQ ID NO: 4419185 - DNA, 15 bp, Homo sapiens
cctgctttttggaaa

SEQ ID NO: 4419186 - DNA, 20 bp, Homo sapiens
cctgctttttggaaagtcag

SEQ ID NO: 4419187 - DNA, 14 bp, Homo sapiens
cctggaaagggggt

SEQ ID NO: 4419188 - DNA, 17 bp, Homo sapiens
cctggaagccagctttc

SEQ ID NO: 4419189 - DNA, 23 bp, Homo sapiens
cctggaagctgtgtccttgcacc

SEQ ID NO: 4419190 - DNA, 23 bp, Homo sapiens
cctggacatgaagattctttccc

SEQ ID NO: 4419191 - DNA, 24 bp, Homo sapiens
cctggacatgaagattctttccca

SEQ ID NO: 4419192 - DNA, 20 bp, Homo sapiens
cctggaccttttgttttctg

SEQ ID NO: 4419193 - DNA, 19 bp, Homo sapiens
cctggactccggaggactg

SEQ ID NO: 4419194 - DNA, 23 bp, Homo sapiens
cctggactccggaggactgagcc

SEQ ID NO: 4419195 - DNA, 18 bp, Homo sapiens
cctggactgaccctgcag

SEQ ID NO: 4419196 - DNA, 17 bp, Homo sapiens
cctggactgagccaagg

SEQ ID NO: 4419197 - DNA, 19 bp, Homo sapiens
cctggactgagccaaggag

SEQ ID NO: 4419198 - DNA, 23 bp, Homo sapiens
cctggactgagggggcctggatg

SEQ ID NO: 4419199 - DNA, 16 bp, Homo sapiens
cctggacttgcctctg

SEQ ID NO: 4419200 - DNA, 17 bp, Homo sapiens
cctggagacaaggtgct

SEQ ID NO: 4419201 - DNA, 20 bp, Homo sapiens
cctggagacaaggtgctaac

SEQ ID NO: 4419202 - DNA, 14 bp, Homo sapiens
cctggagagccaga

SEQ ID NO: 4419203 - DNA, 23 bp, Homo sapiens
cctggagagccagaacctggagg

SEQ ID NO: 4419204 - DNA, 22 bp, Homo sapiens
cctggagagctagaacctggag

SEQ ID NO: 4419205 - DNA, 22 bp, Homo sapiens
cctggagagtgcacatgcccct

SEQ ID NO: 4419206 - DNA, 14 bp, Homo sapiens
cctggagcccagag

SEQ ID NO: 4419207 - DNA, 17 bp, Homo sapiens
cctggagcccagaggag

SEQ ID NO: 4419208 - DNA, 16 bp, Homo sapiens
cctggaggctgcctcc

SEQ ID NO: 4419209 - DNA, 15 bp, Homo sapiens
cctggagggaaggac

SEQ ID NO: 4419210 - DNA, 24 bp, Homo sapiens
cctggagggaaggacagtccctgc

SEQ ID NO: 4419211 - DNA, 17 bp, Homo sapiens
cctggagggcaagccct

SEQ ID NO: 4419212 - DNA, 12 bp, Homo sapiens
cctggagggcta

SEQ ID NO: 4419213 - DNA, 21 bp, Homo sapiens
cctggagggctagaacctgga

SEQ ID NO: 4419214 - DNA, 19 bp, Homo sapiens
cctggaggggctggggact

SEQ ID NO: 4419215 - DNA, 14 bp, Homo sapiens
cctggaggtgggca

SEQ ID NO: 4419216 - DNA, 15 bp, Homo sapiens
cctggatccagcact

SEQ ID NO: 4419217 - DNA, 22 bp, Homo sapiens
cctggatctaccagcataaata

SEQ ID NO: 4419218 - DNA, 13 bp, Homo sapiens
cctggatgccatc

SEQ ID NO: 4419219 - DNA, 14 bp, Homo sapiens
cctggatgccccct

SEQ ID NO: 4419220 - DNA, 16 bp, Homo sapiens
cctggatgccccctgt

SEQ ID NO: 4419221 - DNA, 18 bp, Homo sapiens
cctggatgccccctgtgg

SEQ ID NO: 4419222 - DNA, 12 bp, Homo sapiens
cctggatgtttg

SEQ ID NO: 4419223 - DNA, 15 bp, Homo sapiens
cctggattaccaggg

SEQ ID NO: 4419224 - DNA, 21 bp, Homo sapiens
cctggattttttatgtacaac

SEQ ID NO: 4419225 - DNA, 21 bp, Homo sapiens
cctggcaagctagaacctgga

SEQ ID NO: 4419226 - DNA, 22 bp, Homo sapiens
cctggcacattgcccctctgcc

SEQ ID NO: 4419227 - DNA, 23 bp, Homo sapiens
cctggcacattgcccctctgcct

SEQ ID NO: 4419228 - DNA, 13 bp, Homo sapiens
cctggcactggga

SEQ ID NO: 4419229 - DNA, 22 bp, Homo sapiens
cctggcagctgctgtgggtggg

SEQ ID NO: 4419230 - DNA, 19 bp, Homo sapiens
cctggcaggttagaaccta

SEQ ID NO: 4419231 - DNA, 22 bp, Homo sapiens
cctggccaccagccatcctccc

SEQ ID NO: 4419232 - DNA, 12 bp, Homo sapiens
cctggccagatt

SEQ ID NO: 4419233 - DNA, 20 bp, Homo sapiens
cctggccaggagctcttcag

SEQ ID NO: 4419234 - DNA, 20 bp, Homo sapiens
cctccagaagcctctggcta

SEQ ID NO: 4419235 - DNA, 14 bp, Homo sapiens
cctccagagacact

SEQ ID NO: 4419236 - DNA, 16 bp, Homo sapiens
cctccagagacactga

SEQ ID NO: 4419237 - DNA, 18 bp, Homo sapiens
cctccagagacactgagc

SEQ ID NO: 4419238 - DNA, 12 bp, Homo sapiens
cctccagagccc

SEQ ID NO: 4419239 - DNA, 19 bp, Homo sapiens
cctccagagccccacagcc

SEQ ID NO: 4419240 - DNA, 15 bp, Homo sapiens
cctccagcctcccct

SEQ ID NO: 4419241 - DNA, 12 bp, Homo sapiens
cctccagcctct

SEQ ID NO: 4419242 - DNA, 19 bp, Homo sapiens
cctccagcttgtggagccc

SEQ ID NO: 4419243 - DNA, 21 bp, Homo sapiens
cctccagcttgtggagcccca

SEQ ID NO: 4419244 - DNA, 15 bp, Homo sapiens
cctccaggcctgcct

SEQ ID NO: 4419245 - DNA, 16 bp, Homo sapiens
cctccaggcctgcctc

SEQ ID NO: 4419246 - DNA, 21 bp, Homo sapiens
cctccaggcctgcctcccact

SEQ ID NO: 4419247 - DNA, 16 bp, Homo sapiens
cctccagggaaggtgg

SEQ ID NO: 4419248 - DNA, 20 bp, Homo sapiens
cctccagggccacgtgccag

SEQ ID NO: 4419249 - DNA, 21 bp, Homo sapiens
cctccagggccacgtgccagg

SEQ ID NO: 4419250 - DNA, 12 bp, Homo sapiens
cctccagggctg

SEQ ID NO: 4419251 - DNA, 16 bp, Homo sapiens
cctccagggctggact

SEQ ID NO: 4419252 - DNA, 17 bp, Homo sapiens
cctccagggctggactg

SEQ ID NO: 4419253 - DNA, 21 bp, Homo sapiens
cctccagggtcctctcttcca

SEQ ID NO: 4419254 - DNA, 22 bp, Homo sapiens
cctccagtacgtcccgctgctg

SEQ ID NO: 4419255 - DNA, 23 bp, Homo sapiens
cctccagtgggctgatgctggga

SEQ ID NO: 4419256 - DNA, 20 bp, Homo sapiens
cctccattctattttagaat

SEQ ID NO: 4419257 - DNA, 19 bp, Homo sapiens
cctcccaagcgttcctggc

SEQ ID NO: 4419258 - DNA, 24 bp, Homo sapiens
cctcccaagcgttcctggccttct

SEQ ID NO: 4419259 - DNA, 20 bp, Homo sapiens
cctcccaagtcccaccctct

SEQ ID NO: 4419260 - DNA, 13 bp, Homo sapiens
cctcccaccagag

SEQ ID NO: 4419261 - DNA, 14 bp, Homo sapiens
cctcccaccagagc

SEQ ID NO: 4419262 - DNA, 12 bp, Homo sapiens
cctcccaccccc

SEQ ID NO: 4419263 - DNA, 14 bp, Homo sapiens
cctcccacccccag

SEQ ID NO: 4419264 - DNA, 16 bp, Homo sapiens
cctcccacttcactgc

SEQ ID NO: 4419265 - DNA, 20 bp, Homo sapiens
cctcccagaggagccaccag

SEQ ID NO: 4419266 - DNA, 21 bp, Homo sapiens
cctcccagaggagccaccagt

SEQ ID NO: 4419267 - DNA, 16 bp, Homo sapiens
cctcccaggaagccca

SEQ ID NO: 4419268 - DNA, 18 bp, Homo sapiens
cctcccaggaagcccagg

SEQ ID NO: 4419269 - DNA, 21 bp, Homo sapiens
cctcccaggaagcccaggagc

SEQ ID NO: 4419270 - DNA, 18 bp, Homo sapiens
cctccccacacctcccta

SEQ ID NO: 4419271 - DNA, 15 bp, Homo sapiens
cctccccacccgctc

SEQ ID NO: 4419272 - DNA, 12 bp, Homo sapiens
cctccccagaat

SEQ ID NO: 4419273 - DNA, 12 bp, Homo sapiens
cctccccagcca

SEQ ID NO: 4419274 - DNA, 22 bp, Homo sapiens
cctccccaggggagagggtctg

SEQ ID NO: 4419275 - DNA, 19 bp, Homo sapiens
cctcccccaacccccaccc

SEQ ID NO: 4419276 - DNA, 15 bp, Homo sapiens
cctcccccatcccca

SEQ ID NO: 4419277 - DNA, 17 bp, Homo sapiens
cctcccccattccctcc

SEQ ID NO: 4419278 - DNA, 14 bp, Homo sapiens
cctccccccactgc

SEQ ID NO: 4419279 - DNA, 16 bp, Homo sapiens
cctccccccactgcag

SEQ ID NO: 4419280 - DNA, 17 bp, Homo sapiens
cctccccccactgcagg

SEQ ID NO: 4419281 - DNA, 12 bp, Homo sapiens
cctccccctgcc

SEQ ID NO: 4419282 - DNA, 13 bp, Homo sapiens
cctccccctgcca

SEQ ID NO: 4419283 - DNA, 15 bp, Homo sapiens
cctccccctgccagt

SEQ ID NO: 4419284 - DNA, 18 bp, Homo sapiens
cctccccctgccagtgcc

SEQ ID NO: 4419285 - DNA, 13 bp, Homo sapiens
cctccccctgcgc

SEQ ID NO: 4419286 - DNA, 14 bp, Homo sapiens
cctcccccttcccc

SEQ ID NO: 4419287 - DNA, 19 bp, Homo sapiens
cctccccctttcacactgg

SEQ ID NO: 4419288 - DNA, 18 bp, Homo sapiens
cctcccctatccacccag

SEQ ID NO: 4419289 - DNA, 16 bp, Homo sapiens
cctcccctcccctggg

SEQ ID NO: 4419290 - DNA, 12 bp, Homo sapiens
cctcccctgcca

SEQ ID NO: 4419291 - DNA, 18 bp, Homo sapiens
cctcccctgccagggcag

SEQ ID NO: 4419292 - DNA, 14 bp, Homo sapiens
cctcccctggggac

SEQ ID NO: 4419293 - DNA, 14 bp, Homo sapiens
cctccccttcctgt

SEQ ID NO: 4419294 - DNA, 17 bp, Homo sapiens
cctcccgccactcgcct

SEQ ID NO: 4419295 - DNA, 14 bp, Homo sapiens
cctcccgccccgcc

SEQ ID NO: 4419296 - DNA, 19 bp, Homo sapiens
cctcccgccccgcccctcc

SEQ ID NO: 4419297 - DNA, 16 bp, Homo sapiens
cctcccgcccttccat

SEQ ID NO: 4419298 - DNA, 13 bp, Homo sapiens
cctccctacctca

SEQ ID NO: 4419299 - DNA, 15 bp, Homo sapiens
cctccctacctcaac

SEQ ID NO: 4419300 - DNA, 16 bp, Homo sapiens
cctccctacctcaacc

SEQ ID NO: 4419301 - DNA, 12 bp, Homo sapiens
cctccctcagac

SEQ ID NO: 4419302 - DNA, 23 bp, Homo sapiens
cctccctcagactcagaggtcca

SEQ ID NO: 4419303 - DNA, 22 bp, Homo sapiens
cctccctcagctctctgggacc

SEQ ID NO: 4419304 - DNA, 12 bp, Homo sapiens
cctccctcaggc

SEQ ID NO: 4419305 - DNA, 15 bp, Homo sapiens
cctccctccagctgc

SEQ ID NO: 4419306 - DNA, 13 bp, Homo sapiens
cctccctccaggg

SEQ ID NO: 4419307 - DNA, 14 bp, Homo sapiens
cctccctccagggt

SEQ ID NO: 4419308 - DNA, 22 bp, Homo sapiens
cctccctctcagaggcctgctg

SEQ ID NO: 4419309 - DNA, 13 bp, Homo sapiens
cctccctctccat

SEQ ID NO: 4419310 - DNA, 22 bp, Homo sapiens
cctccctctctcttctgctcca

SEQ ID NO: 4419311 - DNA, 20 bp, Homo sapiens
cctccctgaaaatgtttttc

SEQ ID NO: 4419312 - DNA, 19 bp, Homo sapiens
cctccctgactccctgtgg

SEQ ID NO: 4419313 - DNA, 14 bp, Homo sapiens
cctccctgcctgct

SEQ ID NO: 4419314 - DNA, 20 bp, Homo sapiens
cctccctgcctgctccttgg

SEQ ID NO: 4419315 - DNA, 14 bp, Homo sapiens
cctccctgctagca

SEQ ID NO: 4419316 - DNA, 21 bp, Homo sapiens
cctccctgctagcacagaggc

SEQ ID NO: 4419317 - DNA, 17 bp, Homo sapiens
cctccctgctcagtgct

SEQ ID NO: 4419318 - DNA, 12 bp, Homo sapiens
cctccctggagt

SEQ ID NO: 4419319 - DNA, 13 bp, Homo sapiens
cctccctggagtg

SEQ ID NO: 4419320 - DNA, 14 bp, Homo sapiens
cctccctggcactg

SEQ ID NO: 4419321 - DNA, 12 bp, Homo sapiens
cctccctggctc

SEQ ID NO: 4419322 - DNA, 13 bp, Homo sapiens
cctccctggctcc

SEQ ID NO: 4419323 - DNA, 15 bp, Homo sapiens
cctccctggctccca

SEQ ID NO: 4419324 - DNA, 18 bp, Homo sapiens
cctccctggctcccatga

SEQ ID NO: 4419325 - DNA, 13 bp, Homo sapiens
cctccctgtctcc

SEQ ID NO: 4419326 - DNA, 13 bp, Homo sapiens
cctcccttccttt

SEQ ID NO: 4419327 - DNA, 20 bp, Homo sapiens
cctccgaccacttccagggg

SEQ ID NO: 4419328 - DNA, 13 bp, Homo sapiens
cctccgaggctcc

SEQ ID NO: 4419329 - DNA, 20 bp, Homo sapiens
cctccggcgggtgacagctc

SEQ ID NO: 4419330 - DNA, 22 bp, Homo sapiens
cctccggcgggtgacagctccg

SEQ ID NO: 4419331 - DNA, 18 bp, Homo sapiens
cctccggcgtcagcctcc

SEQ ID NO: 4419332 - DNA, 23 bp, Homo sapiens
cctccggcgtcagcctccagcct

SEQ ID NO: 4419333 - DNA, 22 bp, Homo sapiens
cctcctaaagctgaatcccggc

SEQ ID NO: 4419334 - DNA, 17 bp, Homo sapiens
cctcctagctctcccag

SEQ ID NO: 4419335 - DNA, 15 bp, Homo sapiens
cctcctcaccccgtc

SEQ ID NO: 4419336 - DNA, 16 bp, Homo sapiens
cctcctcacctcatgc

SEQ ID NO: 4419337 - DNA, 15 bp, Homo sapiens
cctcctcacctctgg

SEQ ID NO: 4419338 - DNA, 13 bp, Homo sapiens
cctcctcagccag

SEQ ID NO: 4419339 - DNA, 15 bp, Homo sapiens
cctcctcagccagcc

SEQ ID NO: 4419340 - DNA, 15 bp, Homo sapiens
cctcctcaggcccag

SEQ ID NO: 4419341 - DNA, 16 bp, Homo sapiens
cctcctccactctccc

SEQ ID NO: 4419342 - DNA, 12 bp, Homo sapiens
cctcctccagta

SEQ ID NO: 4419343 - DNA, 16 bp, Homo sapiens
cctcctccccagagct

SEQ ID NO: 4419344 - DNA, 17 bp, Homo sapiens
cctcctccccagagctg

SEQ ID NO: 4419345 - DNA, 15 bp, Homo sapiens
cctcctcccccagtg

SEQ ID NO: 4419346 - DNA, 14 bp, Homo sapiens
cctcctcccctcct

SEQ ID NO: 4419347 - DNA, 12 bp, Homo sapiens
cctcctccctca

SEQ ID NO: 4419348 - DNA, 14 bp, Homo sapiens
cctcctccctcaga

SEQ ID NO: 4419349 - DNA, 19 bp, Homo sapiens
cctcctccctcagacccag

SEQ ID NO: 4419350 - DNA, 16 bp, Homo sapiens
cctcctccctcagact

SEQ ID NO: 4419351 - DNA, 23 bp, Homo sapiens
cctcctccctcaggcccaggagt

SEQ ID NO: 4419352 - DNA, 13 bp, Homo sapiens
cctcctcctcacc

SEQ ID NO: 4419353 - DNA, 21 bp, Homo sapiens
cctcctcggagagcagcagca

SEQ ID NO: 4419354 - DNA, 20 bp, Homo sapiens
cctagtgcaaaaactgtaaa

SEQ ID NO: 4419355 - DNA, 17 bp, Homo sapiens
cctagtggggtctccct

SEQ ID NO: 4419356 - DNA, 15 bp, Homo sapiens
cctagttaaagaaag

SEQ ID NO: 4419357 - DNA, 16 bp, Homo sapiens
cctagttagcatccag

SEQ ID NO: 4419358 - DNA, 20 bp, Homo sapiens
cctagttagcatccaggctg

SEQ ID NO: 4419359 - DNA, 21 bp, Homo sapiens
cctagttagcatccaggctgg

SEQ ID NO: 4419360 - DNA, 12 bp, Homo sapiens
cctagttttcca

SEQ ID NO: 4419361 - DNA, 17 bp, Homo sapiens
cctataatcccagcatt

SEQ ID NO: 4419362 - DNA, 22 bp, Homo sapiens
cctatacgcagcgtgctttaaa

SEQ ID NO: 4419363 - DNA, 12 bp, Homo sapiens
cctatatacctc

SEQ ID NO: 4419364 - DNA, 15 bp, Homo sapiens
cctatatatttctat

SEQ ID NO: 4419365 - DNA, 15 bp, Homo sapiens
cctatatcttacaaa

SEQ ID NO: 4419366 - DNA, 22 bp, Homo sapiens
cctatatgagaagaatagccta

SEQ ID NO: 4419367 - DNA, 21 bp, Homo sapiens
cctatccacccagcccattct

SEQ ID NO: 4419368 - DNA, 15 bp, Homo sapiens
cctatccgctgccag

SEQ ID NO: 4419369 - DNA, 17 bp, Homo sapiens
cctatccgctgccagcc

SEQ ID NO: 4419370 - DNA, 14 bp, Homo sapiens
cctatcctctgagt

SEQ ID NO: 4419371 - DNA, 22 bp, Homo sapiens
cctatctagcatttatttctct

SEQ ID NO: 4419372 - DNA, 20 bp, Homo sapiens
cctatcttccttcctctctc

SEQ ID NO: 4419373 - DNA, 17 bp, Homo sapiens
cctatgagatggccatg

SEQ ID NO: 4419374 - DNA, 19 bp, Homo sapiens
cctatgagatggccatgct

SEQ ID NO: 4419375 - DNA, 21 bp, Homo sapiens
cctatgagatggccatgctca

SEQ ID NO: 4419376 - DNA, 14 bp, Homo sapiens
cctatgcaataaaa

SEQ ID NO: 4419377 - DNA, 23 bp, Homo sapiens
cctatgcactgaagagctcttgg

SEQ ID NO: 4419378 - DNA, 15 bp, Homo sapiens
cctatgcctgtggtg

SEQ ID NO: 4419379 - DNA, 19 bp, Homo sapiens
cctatgcctgtggtgaagt

SEQ ID NO: 4419380 - DNA, 20 bp, Homo sapiens
cctatgcctgtggtgaagtg

SEQ ID NO: 4419381 - DNA, 21 bp, Homo sapiens
cctatgctattgacaataaaa

SEQ ID NO: 4419382 - DNA, 20 bp, Homo sapiens
cctatggtcacagacttctg

SEQ ID NO: 4419383 - DNA, 17 bp, Homo sapiens
cctatgtattttcctaa

SEQ ID NO: 4419384 - DNA, 19 bp, Homo sapiens
cctattaaaagttgcaaag

SEQ ID NO: 4419385 - DNA, 22 bp, Homo sapiens
cctattaggtggaaattttata

SEQ ID NO: 4419386 - DNA, 17 bp, Homo sapiens
cctattccaagcttcca

SEQ ID NO: 4419387 - DNA, 13 bp, Homo sapiens
cctattgtaatat

SEQ ID NO: 4419388 - DNA, 17 bp, Homo sapiens
cctattgtgactcttct

SEQ ID NO: 4419389 - DNA, 14 bp, Homo sapiens
cctatttaacaaga

SEQ ID NO: 4419390 - DNA, 15 bp, Homo sapiens
cctatttaatacagc

SEQ ID NO: 4419391 - DNA, 22 bp, Homo sapiens
cctatttattaatattttacag

SEQ ID NO: 4419392 - DNA, 15 bp, Homo sapiens
cctatttctatgtca

SEQ ID NO: 4419393 - DNA, 22 bp, Homo sapiens
cctatttctatgtcatttttaa

SEQ ID NO: 4419394 - DNA, 23 bp, Homo sapiens
cctatttttttagattgagaaat

SEQ ID NO: 4419395 - DNA, 15 bp, Homo sapiens
cctcaaaactggagt

SEQ ID NO: 4419396 - DNA, 23 bp, Homo sapiens
cctcaaaatttaacagttacctg

SEQ ID NO: 4419397 - DNA, 20 bp, Homo sapiens
cctcaaaccaagggtacaga

SEQ ID NO: 4419398 - DNA, 20 bp, Homo sapiens
cctcaaacgacagaggagct

SEQ ID NO: 4419399 - DNA, 21 bp, Homo sapiens
cctcaaagcaagcattcagaa

SEQ ID NO: 4419400 - DNA, 15 bp, Homo sapiens
cctcaaatacatgca

SEQ ID NO: 4419401 - DNA, 17 bp, Homo sapiens
cctcaaatacatgcaca

SEQ ID NO: 4419402 - DNA, 18 bp, Homo sapiens
cctcaaatacatgcacag

SEQ ID NO: 4419403 - DNA, 20 bp, Homo sapiens
cctcaaatacatgcacagtc

SEQ ID NO: 4419404 - DNA, 23 bp, Homo sapiens
cctcaaatacatgcacagtcata

SEQ ID NO: 4419405 - DNA, 13 bp, Homo sapiens
cctcaagcaatcc

SEQ ID NO: 4419406 - DNA, 20 bp, Homo sapiens
cctcaagcaatccacctgcc

SEQ ID NO: 4419407 - DNA, 22 bp, Homo sapiens
cctcaatccaccttcaggcccc

SEQ ID NO: 4419408 - DNA, 16 bp, Homo sapiens
cctcaccccgtctggg

SEQ ID NO: 4419409 - DNA, 21 bp, Homo sapiens
cctcacccctggttctcatct

SEQ ID NO: 4419410 - DNA, 12 bp, Homo sapiens
cctcaccctcct

SEQ ID NO: 4419411 - DNA, 11 bp, Homo sapiens
cctcaccctgc

SEQ ID NO: 4419412 - DNA, 17 bp, Homo sapiens
cctcacctcatgcccac

SEQ ID NO: 4419413 - DNA, 22 bp, Homo sapiens
cctcacctcatgcccaccccct

SEQ ID NO: 4419414 - DNA, 12 bp, Homo sapiens
cctcacctctgg

SEQ ID NO: 4419415 - DNA, 12 bp, Homo sapiens
cctcaccttcct

SEQ ID NO: 4419416 - DNA, 13 bp, Homo sapiens
cctcaccttcctg

SEQ ID NO: 4419417 - DNA, 21 bp, Homo sapiens
cctcactagccatgctttatg

SEQ ID NO: 4419418 - DNA, 20 bp, Homo sapiens
cctcactcccttctacctgc

SEQ ID NO: 4419419 - DNA, 18 bp, Homo sapiens
cctcactcctccgtgagc

SEQ ID NO: 4419420 - DNA, 14 bp, Homo sapiens
cctcactctgtcag

SEQ ID NO: 4419421 - DNA, 15 bp, Homo sapiens
cctcactctgtcagc

SEQ ID NO: 4419422 - DNA, 16 bp, Homo sapiens
cctcactctgtcagcc

SEQ ID NO: 4419423 - DNA, 18 bp, Homo sapiens
cctcactctgtcagccag

SEQ ID NO: 4419424 - DNA, 19 bp, Homo sapiens
cctcactctgtcagccagc

SEQ ID NO: 4419425 - DNA, 16 bp, Homo sapiens
cctcacttgaggagga

SEQ ID NO: 4419426 - DNA, 18 bp, Homo sapiens
cctcagaaggccccagag

SEQ ID NO: 4419427 - DNA, 14 bp, Homo sapiens
cctcagacccagga

SEQ ID NO: 4419428 - DNA, 19 bp, Homo sapiens
cctcagacccaggagtcca

SEQ ID NO: 4419429 - DNA, 20 bp, Homo sapiens
cctcagacccaggagtccag

SEQ ID NO: 4419430 - DNA, 22 bp, Homo sapiens
cctcagacccaggagtccagac

SEQ ID NO: 4419431 - DNA, 23 bp, Homo sapiens
cctcagacccaggagtccagacc

SEQ ID NO: 4419432 - DNA, 18 bp, Homo sapiens
cctcagacgttgcctgag

SEQ ID NO: 4419433 - DNA, 20 bp, Homo sapiens
cctcagacgttgcctgagaa

SEQ ID NO: 4419434 - DNA, 12 bp, Homo sapiens
cctcagactcag

SEQ ID NO: 4419435 - DNA, 17 bp, Homo sapiens
cctcagactcagaggtc

SEQ ID NO: 4419436 - DNA, 22 bp, Homo sapiens
cctcagactcagaggtccaggc

SEQ ID NO: 4419437 - DNA, 23 bp, Homo sapiens
cctcagagcgccaggaagccaga

SEQ ID NO: 4419438 - DNA, 13 bp, Homo sapiens
cctcagcaagctg

SEQ ID NO: 4419439 - DNA, 16 bp, Homo sapiens
cctcagcaagctgccc

SEQ ID NO: 4419440 - DNA, 18 bp, Homo sapiens
cctcagcaagctgcccag

SEQ ID NO: 4419441 - DNA, 21 bp, Homo sapiens
cctcagcaagctgcccagccc

SEQ ID NO: 4419442 - DNA, 22 bp, Homo sapiens
cctcagcaagctgcccagccct

SEQ ID NO: 4419443 - DNA, 22 bp, Homo sapiens
cctcagcagctctggctctgcc

SEQ ID NO: 4419444 - DNA, 14 bp, Homo sapiens
cctcagcagggcat

SEQ ID NO: 4419445 - DNA, 15 bp, Homo sapiens
cctcagccaaggaaa

SEQ ID NO: 4419446 - DNA, 16 bp, Homo sapiens
cctcagccagcctcct

SEQ ID NO: 4419447 - DNA, 16 bp, Homo sapiens
cctcagccatgaggag

SEQ ID NO: 4419448 - DNA, 18 bp, Homo sapiens
cctcagccccagcccaga

SEQ ID NO: 4419449 - DNA, 19 bp, Homo sapiens
cctcagccccagcccagac

SEQ ID NO: 4419450 - DNA, 12 bp, Homo sapiens
cctcagccctca

SEQ ID NO: 4419451 - DNA, 19 bp, Homo sapiens
cctcagccgagaaattggg

SEQ ID NO: 4419452 - DNA, 13 bp, Homo sapiens
cctcagcctgctt

SEQ ID NO: 4419453 - DNA, 11 bp, Homo sapiens
cctcagctcta

SEQ ID NO: 4419454 - DNA, 14 bp, Homo sapiens
cctcagctctaggc

SEQ ID NO: 4419455 - DNA, 18 bp, Homo sapiens
cctcagctgcctcacttc

SEQ ID NO: 4419456 - DNA, 15 bp, Homo sapiens
cctcagctgtacaaa

SEQ ID NO: 4419457 - DNA, 18 bp, Homo sapiens
cctcaggaaagaatagaa

SEQ ID NO: 4419458 - DNA, 19 bp, Homo sapiens
cctcaggaggtcacctgcc

SEQ ID NO: 4419459 - DNA, 19 bp, Homo sapiens
cctcaggagtttctatagg

SEQ ID NO: 4419460 - DNA, 15 bp, Homo sapiens
cctcaggcacacagc

SEQ ID NO: 4419461 - DNA, 20 bp, Homo sapiens
cctcaggcacacagctactc

SEQ ID NO: 4419462 - DNA, 13 bp, Homo sapiens
cctcaggcacccg

SEQ ID NO: 4419463 - DNA, 22 bp, Homo sapiens
cctcaggcacccgtccccacac

SEQ ID NO: 4419464 - DNA, 15 bp, Homo sapiens
cctcaggcaggaagg

SEQ ID NO: 4419465 - DNA, 20 bp, Homo sapiens
cctcaggccaagggaccagg

SEQ ID NO: 4419466 - DNA, 18 bp, Homo sapiens
cctcaggcccaggagtcc

SEQ ID NO: 4419467 - DNA, 22 bp, Homo sapiens
cctcaggcccaggagtccaggc

SEQ ID NO: 4419468 - DNA, 20 bp, Homo sapiens
cctcagggacagagacacct

SEQ ID NO: 4419469 - DNA, 24 bp, Homo sapiens
cctcagggacagagacacctgcac

SEQ ID NO: 4419470 - DNA, 19 bp, Homo sapiens
cctcagggagcagggaagg

SEQ ID NO: 4419471 - DNA, 14 bp, Homo sapiens
cctcagggctccca

SEQ ID NO: 4419472 - DNA, 21 bp, Homo sapiens
cctcagggctgtcccagcccc

SEQ ID NO: 4419473 - DNA, 13 bp, Homo sapiens
cctcagggtgggg

SEQ ID NO: 4419474 - DNA, 18 bp, Homo sapiens
ccctcctccccagagctg

SEQ ID NO: 4419475 - DNA, 14 bp, Homo sapiens
ccctcctcccccag

SEQ ID NO: 4419476 - DNA, 16 bp, Homo sapiens
ccctcctcccccagtg

SEQ ID NO: 4419477 - DNA, 13 bp, Homo sapiens
ccctcctccctca

SEQ ID NO: 4419478 - DNA, 14 bp, Homo sapiens
ccctcctccctcaa

SEQ ID NO: 4419479 - DNA, 18 bp, Homo sapiens
ccctcctccctcagactc

SEQ ID NO: 4419480 - DNA, 15 bp, Homo sapiens
ccctcctccctcagg

SEQ ID NO: 4419481 - DNA, 10 bp, Homo sapiens
ccctcctctg

SEQ ID NO: 4419482 - DNA, 15 bp, Homo sapiens
ccctcctctgaaaca

SEQ ID NO: 4419483 - DNA, 11 bp, Homo sapiens
ccctcctctgc

SEQ ID NO: 4419484 - DNA, 13 bp, Homo sapiens
ccctcctctgcca

SEQ ID NO: 4419485 - DNA, 16 bp, Homo sapiens
ccctcctctgccacct

SEQ ID NO: 4419486 - DNA, 14 bp, Homo sapiens
ccctcctcttccct

SEQ ID NO: 4419487 - DNA, 16 bp, Homo sapiens
ccctcctgggccctgg

SEQ ID NO: 4419488 - DNA, 12 bp, Homo sapiens
ccctcctgtctt

SEQ ID NO: 4419489 - DNA, 14 bp, Homo sapiens
ccctcctgtcttcc

SEQ ID NO: 4419490 - DNA, 15 bp, Homo sapiens
ccctcctgtcttccc

SEQ ID NO: 4419491 - DNA, 18 bp, Homo sapiens
ccctcctgttgcacccag

SEQ ID NO: 4419492 - DNA, 19 bp, Homo sapiens
ccctcctgttgcacccagc

SEQ ID NO: 4419493 - DNA, 18 bp, Homo sapiens
ccctccttccccagaccc

SEQ ID NO: 4419494 - DNA, 15 bp, Homo sapiens
ccctccttctgctgt

SEQ ID NO: 4419495 - DNA, 18 bp, Homo sapiens
ccctccttgtccacccac

SEQ ID NO: 4419496 - DNA, 21 bp, Homo sapiens
ccctccttttggcctggggga

SEQ ID NO: 4419497 - DNA, 22 bp, Homo sapiens
ccctccttttggcctgggggag

SEQ ID NO: 4419498 - DNA, 15 bp, Homo sapiens
ccctcgaccctgtgc

SEQ ID NO: 4419499 - DNA, 13 bp, Homo sapiens
ccctcgccccagc

SEQ ID NO: 4419500 - DNA, 15 bp, Homo sapiens
ccctcgccccagcct

SEQ ID NO: 4419501 - DNA, 18 bp, Homo sapiens
ccctcgccttcaggagaa

SEQ ID NO: 4419502 - DNA, 22 bp, Homo sapiens
ccctcggcctccgaggctcccc

SEQ ID NO: 4419503 - DNA, 14 bp, Homo sapiens
ccctcgggcccagc

SEQ ID NO: 4419504 - DNA, 19 bp, Homo sapiens
ccctcgggccccatcctca

SEQ ID NO: 4419505 - DNA, 13 bp, Homo sapiens
ccctctaacccag

SEQ ID NO: 4419506 - DNA, 23 bp, Homo sapiens
ccctctcagaggcctgctgccag

SEQ ID NO: 4419507 - DNA, 23 bp, Homo sapiens
ccctctccaagacagcagcagcc

SEQ ID NO: 4419508 - DNA, 14 bp, Homo sapiens
ccctctccctgtgt

SEQ ID NO: 4419509 - DNA, 22 bp, Homo sapiens
ccctctccctgtgttctgggct

SEQ ID NO: 4419510 - DNA, 13 bp, Homo sapiens
ccctctcctgcct

SEQ ID NO: 4419511 - DNA, 13 bp, Homo sapiens
ccctctctaggga

SEQ ID NO: 4419512 - DNA, 14 bp, Homo sapiens
ccctctctagggac

SEQ ID NO: 4419513 - DNA, 14 bp, Homo sapiens
ccctctctccctgc

SEQ ID NO: 4419514 - DNA, 21 bp, Homo sapiens
ccctctctctctctctcctct

SEQ ID NO: 4419515 - DNA, 14 bp, Homo sapiens
ccctctctcttctg

SEQ ID NO: 4419516 - DNA, 17 bp, Homo sapiens
ccctctctcttctgctc

SEQ ID NO: 4419517 - DNA, 14 bp, Homo sapiens
ccctctgcccctgc

SEQ ID NO: 4419518 - DNA, 16 bp, Homo sapiens
ccctctgcccctgcag

SEQ ID NO: 4419519 - DNA, 17 bp, Homo sapiens
ccctctgcccctgcagc

SEQ ID NO: 4419520 - DNA, 18 bp, Homo sapiens
ccctctgcccctgcagct

SEQ ID NO: 4419521 - DNA, 14 bp, Homo sapiens
ccctctggccctgc

SEQ ID NO: 4419522 - DNA, 20 bp, Homo sapiens
ccctctgtccaggcactgag

SEQ ID NO: 4419523 - DNA, 15 bp, Homo sapiens
ccctcttgcccatcc

SEQ ID NO: 4419524 - DNA, 17 bp, Homo sapiens
ccctcttgcccatcctg

SEQ ID NO: 4419525 - DNA, 22 bp, Homo sapiens
ccctcttgcccatcctgactga

SEQ ID NO: 4419526 - DNA, 14 bp, Homo sapiens
ccctctttgggcag

SEQ ID NO: 4419527 - DNA, 17 bp, Homo sapiens
ccctgaaaacccagaga

SEQ ID NO: 4419528 - DNA, 22 bp, Homo sapiens
ccctgaaaatgtttttctgcca

SEQ ID NO: 4419529 - DNA, 13 bp, Homo sapiens
ccctgaactcaga

SEQ ID NO: 4419530 - DNA, 13 bp, Homo sapiens
ccctgaccctgct

SEQ ID NO: 4419531 - DNA, 14 bp, Homo sapiens
ccctgaccctgctc

SEQ ID NO: 4419532 - DNA, 21 bp, Homo sapiens
ccctgaccttagcgttctgga

SEQ ID NO: 4419533 - DNA, 15 bp, Homo sapiens
ccctgactcattctg

SEQ ID NO: 4419534 - DNA, 12 bp, Homo sapiens
ccctgactcctc

SEQ ID NO: 4419535 - DNA, 14 bp, Homo sapiens
ccctgactcctctg

SEQ ID NO: 4419536 - DNA, 19 bp, Homo sapiens
ccctgactcctctggcttt

SEQ ID NO: 4419537 - DNA, 23 bp, Homo sapiens
ccctgactcctctggctttccca

SEQ ID NO: 4419538 - DNA, 15 bp, Homo sapiens
ccctgactcctggac

SEQ ID NO: 4419539 - DNA, 18 bp, Homo sapiens
ccctgactcctggactcc

SEQ ID NO: 4419540 - DNA, 14 bp, Homo sapiens
ccctgacttttctg

SEQ ID NO: 4419541 - DNA, 16 bp, Homo sapiens
ccctgagctgaggcag

SEQ ID NO: 4419542 - DNA, 17 bp, Homo sapiens
cccctccttttggcctg

SEQ ID NO: 4419543 - DNA, 16 bp, Homo sapiens
cccctcgaccctgtgc

SEQ ID NO: 4419544 - DNA, 23 bp, Homo sapiens
cccctcgaccctgtgcaggagct

SEQ ID NO: 4419545 - DNA, 16 bp, Homo sapiens
cccctcgttagccttc

SEQ ID NO: 4419546 - DNA, 12 bp, Homo sapiens
cccctctcctcc

SEQ ID NO: 4419547 - DNA, 21 bp, Homo sapiens
cccctctcctccccttcctgt

SEQ ID NO: 4419548 - DNA, 12 bp, Homo sapiens
cccctctgcccc

SEQ ID NO: 4419549 - DNA, 16 bp, Homo sapiens
cccctctgcccctgca

SEQ ID NO: 4419550 - DNA, 22 bp, Homo sapiens
cccctctgccttgccctcctgg

SEQ ID NO: 4419551 - DNA, 22 bp, Homo sapiens
cccctgcaacttccgctgaggg

SEQ ID NO: 4419552 - DNA, 11 bp, Homo sapiens
cccctgcacag

SEQ ID NO: 4419553 - DNA, 15 bp, Homo sapiens
cccctgcacagcagg

SEQ ID NO: 4419554 - DNA, 16 bp, Homo sapiens
cccctgcacagcaggc

SEQ ID NO: 4419555 - DNA, 22 bp, Homo sapiens
cccctgcacagcaggctgccag

SEQ ID NO: 4419556 - DNA, 13 bp, Homo sapiens
cccctgcactcca

SEQ ID NO: 4419557 - DNA, 18 bp, Homo sapiens
cccctgcactccagcctg

SEQ ID NO: 4419558 - DNA, 19 bp, Homo sapiens
cccctgcagattctgagca

SEQ ID NO: 4419559 - DNA, 22 bp, Homo sapiens
cccctgcagattctgagcaaag

SEQ ID NO: 4419560 - DNA, 23 bp, Homo sapiens
cccctgcagctggaatgtgccac

SEQ ID NO: 4419561 - DNA, 23 bp, Homo sapiens
cccctgccagggcagggccccag

SEQ ID NO: 4419562 - DNA, 15 bp, Homo sapiens
cccctgccagtgcct

SEQ ID NO: 4419563 - DNA, 16 bp, Homo sapiens
cccctgcccccaggac

SEQ ID NO: 4419564 - DNA, 17 bp, Homo sapiens
cccctgcccccaggact

SEQ ID NO: 4419565 - DNA, 18 bp, Homo sapiens
cccctgcccccaggactg

SEQ ID NO: 4419566 - DNA, 23 bp, Homo sapiens
cccctgccccttctacactctcc

SEQ ID NO: 4419567 - DNA, 13 bp, Homo sapiens
cccctgccctgca

SEQ ID NO: 4419568 - DNA, 14 bp, Homo sapiens
cccctgccctgcac

SEQ ID NO: 4419569 - DNA, 18 bp, Homo sapiens
cccctgcctccaccctct

SEQ ID NO: 4419570 - DNA, 21 bp, Homo sapiens
cccctgcctccaccctctgag

SEQ ID NO: 4419571 - DNA, 22 bp, Homo sapiens
cccctgcctccaccctctgagc

SEQ ID NO: 4419572 - DNA, 12 bp, Homo sapiens
cccctgcgcccc

SEQ ID NO: 4419573 - DNA, 18 bp, Homo sapiens
cccctgctactcctgtgc

SEQ ID NO: 4419574 - DNA, 17 bp, Homo sapiens
cccctgctcactgggcc

SEQ ID NO: 4419575 - DNA, 18 bp, Homo sapiens
cccctgctcactgggccc

SEQ ID NO: 4419576 - DNA, 13 bp, Homo sapiens
cccctgctcagca

SEQ ID NO: 4419577 - DNA, 21 bp, Homo sapiens
cccctgctggctcttctgccc

SEQ ID NO: 4419578 - DNA, 15 bp, Homo sapiens
cccctggagcctcag

SEQ ID NO: 4419579 - DNA, 17 bp, Homo sapiens
cccctggaggctgcctc

SEQ ID NO: 4419580 - DNA, 17 bp, Homo sapiens
cccctggctgtttggac

SEQ ID NO: 4419581 - DNA, 21 bp, Homo sapiens
cccctggctttgcctcttctt

SEQ ID NO: 4419582 - DNA, 20 bp, Homo sapiens
cccctgggcatcttctggct

SEQ ID NO: 4419583 - DNA, 22 bp, Homo sapiens
cccctgggcatcttctggcttg

SEQ ID NO: 4419584 - DNA, 16 bp, Homo sapiens
cccctgggcttggcct

SEQ ID NO: 4419585 - DNA, 19 bp, Homo sapiens
cccctggggcccagcccct

SEQ ID NO: 4419586 - DNA, 13 bp, Homo sapiens
cccctggggtggc

SEQ ID NO: 4419587 - DNA, 21 bp, Homo sapiens
cccctggtcaccgagactcag

SEQ ID NO: 4419588 - DNA, 18 bp, Homo sapiens
cccctggttctcatcttt

SEQ ID NO: 4419589 - DNA, 21 bp, Homo sapiens
cccctgtagggtttggacaga

SEQ ID NO: 4419590 - DNA, 18 bp, Homo sapiens
cccctgtcccattctaga

SEQ ID NO: 4419591 - DNA, 16 bp, Homo sapiens
cccctgtctgttccca

SEQ ID NO: 4419592 - DNA, 22 bp, Homo sapiens
cccctgtctgttcccagcccct

SEQ ID NO: 4419593 - DNA, 19 bp, Homo sapiens
cccctgtggataccaaggt

SEQ ID NO: 4419594 - DNA, 22 bp, Homo sapiens
cccctgtggatgctgctgcccc

SEQ ID NO: 4419595 - DNA, 23 bp, Homo sapiens
ccccttaaacacaggctgtcctt

SEQ ID NO: 4419596 - DNA, 14 bp, Homo sapiens
ccccttccactgag

SEQ ID NO: 4419597 - DNA, 13 bp, Homo sapiens
ccccttcccctgc

SEQ ID NO: 4419598 - DNA, 16 bp, Homo sapiens
ccccttcccctgctga

SEQ ID NO: 4419599 - DNA, 16 bp, Homo sapiens
ccccttccccttctgt

SEQ ID NO: 4419600 - DNA, 10 bp, Homo sapiens
ccccttccct

SEQ ID NO: 4419601 - DNA, 18 bp, Homo sapiens
ccccttccctctctccct

SEQ ID NO: 4419602 - DNA, 19 bp, Homo sapiens
ccccttcgtgtgtccatgt

SEQ ID NO: 4419603 - DNA, 21 bp, Homo sapiens
ccccttctacactctcctggg

SEQ ID NO: 4419604 - DNA, 13 bp, Homo sapiens
ccccttctctcat

SEQ ID NO: 4419605 - DNA, 19 bp, Homo sapiens
cccctttactcgtgcatta

SEQ ID NO: 4419606 - DNA, 16 bp, Homo sapiens
cccctttgggcccagg

SEQ ID NO: 4419607 - DNA, 18 bp, Homo sapiens
cccctttgggcccaggga

SEQ ID NO: 4419608 - DNA, 20 bp, Homo sapiens
cccctttgggcccagggaca

SEQ ID NO: 4419609 - DNA, 21 bp, Homo sapiens
cccgaagccatcacttctccc

SEQ ID NO: 4419610 - DNA, 17 bp, Homo sapiens
cccgactccagccagcg

SEQ ID NO: 4419611 - DNA, 20 bp, Homo sapiens
cccgactgtgggactcagtt

SEQ ID NO: 4419612 - DNA, 11 bp, Homo sapiens
cccgagccctg

SEQ ID NO: 4419613 - DNA, 18 bp, Homo sapiens
cccgagccctgactcctg

SEQ ID NO: 4419614 - DNA, 15 bp, Homo sapiens
cccgaggacccagac

SEQ ID NO: 4419615 - DNA, 16 bp, Homo sapiens
cccgaggacccagacc

SEQ ID NO: 4419616 - DNA, 18 bp, Homo sapiens
cccgaggacccagaccca

SEQ ID NO: 4419617 - DNA, 19 bp, Homo sapiens
cccatgctgccttcaggga

SEQ ID NO: 4419618 - DNA, 15 bp, Homo sapiens
cccatggaacaaatg

SEQ ID NO: 4419619 - DNA, 14 bp, Homo sapiens
cccatggagcccca

SEQ ID NO: 4419620 - DNA, 17 bp, Homo sapiens
cccatggccccaggccc

SEQ ID NO: 4419621 - DNA, 13 bp, Homo sapiens
cccatggccccca

SEQ ID NO: 4419622 - DNA, 16 bp, Homo sapiens
cccatggcccccaata

SEQ ID NO: 4419623 - DNA, 21 bp, Homo sapiens
cccatggcccccaataaaggc

SEQ ID NO: 4419624 - DNA, 23 bp, Homo sapiens
cccatggcccccaataaaggcag

SEQ ID NO: 4419625 - DNA, 18 bp, Homo sapiens
cccatggcctcagccctg

SEQ ID NO: 4419626 - DNA, 19 bp, Homo sapiens
cccatggcctcagccctgc

SEQ ID NO: 4419627 - DNA, 14 bp, Homo sapiens
cccatgggctctga

SEQ ID NO: 4419628 - DNA, 13 bp, Homo sapiens
cccatgtaaatat

SEQ ID NO: 4419629 - DNA, 21 bp, Homo sapiens
cccatgtcaccggtcagtgcc

SEQ ID NO: 4419630 - DNA, 22 bp, Homo sapiens
cccatgtcaccggtcagtgcct

SEQ ID NO: 4419631 - DNA, 18 bp, Homo sapiens
cccattcagagactgtcc

SEQ ID NO: 4419632 - DNA, 18 bp, Homo sapiens
cccattccaaagctttat

SEQ ID NO: 4419633 - DNA, 13 bp, Homo sapiens
cccattcctccct

SEQ ID NO: 4419634 - DNA, 14 bp, Homo sapiens
cccattcctgcctg

SEQ ID NO: 4419635 - DNA, 19 bp, Homo sapiens
cccattctacacagagcag

SEQ ID NO: 4419636 - DNA, 12 bp, Homo sapiens
cccattctagat

SEQ ID NO: 4419637 - DNA, 21 bp, Homo sapiens
cccattctagatcctgcaccc

SEQ ID NO: 4419638 - DNA, 14 bp, Homo sapiens
cccattctgtgtcc

SEQ ID NO: 4419639 - DNA, 14 bp, Homo sapiens
cccattcttctggg

SEQ ID NO: 4419640 - DNA, 22 bp, Homo sapiens
cccattgagatcttcctgctga

SEQ ID NO: 4419641 - DNA, 18 bp, Homo sapiens
cccattgcccagtgagcc

SEQ ID NO: 4419642 - DNA, 20 bp, Homo sapiens
cccatttaaatttttttcct

SEQ ID NO: 4419643 - DNA, 18 bp, Homo sapiens
cccatttagtgtgaatat

SEQ ID NO: 4419644 - DNA, 13 bp, Homo sapiens
cccatttcagctg

SEQ ID NO: 4419645 - DNA, 17 bp, Homo sapiens
cccatttcccatctgca

SEQ ID NO: 4419646 - DNA, 19 bp, Homo sapiens
cccatttcccatctgcacc

SEQ ID NO: 4419647 - DNA, 18 bp, Homo sapiens
cccatttcctcacactaa

SEQ ID NO: 4419648 - DNA, 15 bp, Homo sapiens
cccatttctgcctcg

SEQ ID NO: 4419649 - DNA, 21 bp, Homo sapiens
cccatttgagaagctgaggct

SEQ ID NO: 4419650 - DNA, 15 bp, Homo sapiens
cccatttgtcccaga

SEQ ID NO: 4419651 - DNA, 15 bp, Homo sapiens
ccccaaaccccagcc

SEQ ID NO: 4419652 - DNA, 23 bp, Homo sapiens
ccccaaagcagcaggcctctggt

SEQ ID NO: 4419653 - DNA, 15 bp, Homo sapiens
ccccaaatcaataca

SEQ ID NO: 4419654 - DNA, 18 bp, Homo sapiens
ccccaacacctgcctctg

SEQ ID NO: 4419655 - DNA, 19 bp, Homo sapiens
ccccaacatgttcagaaaa

SEQ ID NO: 4419656 - DNA, 14 bp, Homo sapiens
ccccaacccctcct

SEQ ID NO: 4419657 - DNA, 21 bp, Homo sapiens
ccccaacccctcctccctcag

SEQ ID NO: 4419658 - DNA, 17 bp, Homo sapiens
ccccaacccctccttcc

SEQ ID NO: 4419659 - DNA, 23 bp, Homo sapiens
ccccaacccctccttccccagac

SEQ ID NO: 4419660 - DNA, 15 bp, Homo sapiens
ccccaacctttccct

SEQ ID NO: 4419661 - DNA, 21 bp, Homo sapiens
ccccaacctttccctcacccc

SEQ ID NO: 4419662 - DNA, 19 bp, Homo sapiens
ccccaacgtcccctccgcc

SEQ ID NO: 4419663 - DNA, 16 bp, Homo sapiens
ccccaactcaggacag

SEQ ID NO: 4419664 - DNA, 19 bp, Homo sapiens
ccccaactccctctctgtg

SEQ ID NO: 4419665 - DNA, 16 bp, Homo sapiens
ccccaactgctccagc

SEQ ID NO: 4419666 - DNA, 23 bp, Homo sapiens
ccccaactgctccagcctctgcc

SEQ ID NO: 4419667 - DNA, 20 bp, Homo sapiens
ccccaactgtggtagctcca

SEQ ID NO: 4419668 - DNA, 17 bp, Homo sapiens
ccccaacttcaccaccc

SEQ ID NO: 4419669 - DNA, 20 bp, Homo sapiens
ccccaacttcaccaccccct

SEQ ID NO: 4419670 - DNA, 20 bp, Homo sapiens
ccccaataaaccagtgtgaa

SEQ ID NO: 4419671 - DNA, 12 bp, Homo sapiens
ccccaataaagc

SEQ ID NO: 4419672 - DNA, 13 bp, Homo sapiens
ccccaataaaggc

SEQ ID NO: 4419673 - DNA, 16 bp, Homo sapiens
ccccaataaaggcagc

SEQ ID NO: 4419674 - DNA, 18 bp, Homo sapiens
ccccaataaaggcagctg

SEQ ID NO: 4419675 - DNA, 20 bp, Homo sapiens
ccccaataaaggcagctgcc

SEQ ID NO: 4419676 - DNA, 21 bp, Homo sapiens
ccccaataaaggcagctgcct

SEQ ID NO: 4419677 - DNA, 20 bp, Homo sapiens
ccccaatcggactgccaaat

SEQ ID NO: 4419678 - DNA, 18 bp, Homo sapiens
ccccaatcgggtccagag

SEQ ID NO: 4419679 - DNA, 21 bp, Homo sapiens
ccccaattacagggtgactca

SEQ ID NO: 4419680 - DNA, 15 bp, Homo sapiens
ccccacaatgccaga

SEQ ID NO: 4419681 - DNA, 14 bp, Homo sapiens
ccccacacctcagt

SEQ ID NO: 4419682 - DNA, 16 bp, Homo sapiens
ccccacacctcagttc

SEQ ID NO: 4419683 - DNA, 18 bp, Homo sapiens
ccccacactggggtgccg

SEQ ID NO: 4419684 - DNA, 23 bp, Homo sapiens
ccccacacttgttccagctcttt

SEQ ID NO: 4419685 - DNA, 19 bp, Homo sapiens
ccccacagctggggccggt

SEQ ID NO: 4419686 - DNA, 15 bp, Homo sapiens
ccccacagttttaat

SEQ ID NO: 4419687 - DNA, 23 bp, Homo sapiens
ccccaccacgatgtggccctggc

SEQ ID NO: 4419688 - DNA, 13 bp, Homo sapiens
ccccacccccagt

SEQ ID NO: 4419689 - DNA, 23 bp, Homo sapiens
ccccacccctgcccccagccccg

SEQ ID NO: 4419690 - DNA, 15 bp, Homo sapiens
ccccaccctcctctt

SEQ ID NO: 4419691 - DNA, 20 bp, Homo sapiens
ccccaccgaggttcccaggg

SEQ ID NO: 4419692 - DNA, 23 bp, Homo sapiens
ccccaccgaggttcccagggctg

SEQ ID NO: 4419693 - DNA, 18 bp, Homo sapiens
ccccaccggaactgggct

SEQ ID NO: 4419694 - DNA, 15 bp, Homo sapiens
ccccacgagggctgg

SEQ ID NO: 4419695 - DNA, 17 bp, Homo sapiens
ccccacgagggctggct

SEQ ID NO: 4419696 - DNA, 16 bp, Homo sapiens
ccccacgctgaccatg

SEQ ID NO: 4419697 - DNA, 16 bp, Homo sapiens
ccccactccggccctc

SEQ ID NO: 4419698 - DNA, 13 bp, Homo sapiens
ccccactgggaga

SEQ ID NO: 4419699 - DNA, 17 bp, Homo sapiens
ccccactgggagagctg

SEQ ID NO: 4419700 - DNA, 19 bp, Homo sapiens
ccccacttcactttcttca

SEQ ID NO: 4419701 - DNA, 15 bp, Homo sapiens
ccatattttaaattc

SEQ ID NO: 4419702 - DNA, 19 bp, Homo sapiens
ccatcaaaatgctttttat

SEQ ID NO: 4419703 - DNA, 20 bp, Homo sapiens
ccatcaactaaaacattata

SEQ ID NO: 4419704 - DNA, 21 bp, Homo sapiens
ccatcaactcccaacttcttc

SEQ ID NO: 4419705 - DNA, 22 bp, Homo sapiens
ccatcaagaacctacagactcc

SEQ ID NO: 4419706 - DNA, 13 bp, Homo sapiens
ccatcacagggtt

SEQ ID NO: 4419707 - DNA, 14 bp, Homo sapiens
ccatcactggagca

SEQ ID NO: 4419708 - DNA, 17 bp, Homo sapiens
ccatcacttctccccgc

SEQ ID NO: 4419709 - DNA, 13 bp, Homo sapiens
ccatcagccctgc

SEQ ID NO: 4419710 - DNA, 14 bp, Homo sapiens
ccatcagccctgct

SEQ ID NO: 4419711 - DNA, 14 bp, Homo sapiens
ccatcagctctgcc

SEQ ID NO: 4419712 - DNA, 16 bp, Homo sapiens
ccatcagctctgcctt

SEQ ID NO: 4419713 - DNA, 21 bp, Homo sapiens
cccactttcaagacagatgag

SEQ ID NO: 4419714 - DNA, 17 bp, Homo sapiens
cccactttcatctacct

SEQ ID NO: 4419715 - DNA, 12 bp, Homo sapiens
cccactttgtaa

SEQ ID NO: 4419716 - DNA, 20 bp, Homo sapiens
cccagaaagcctcctgcccc

SEQ ID NO: 4419717 - DNA, 22 bp, Homo sapiens
cccagaaagcctcctgccccct

SEQ ID NO: 4419718 - DNA, 17 bp, Homo sapiens
cccagaaagtgggggtg

SEQ ID NO: 4419719 - DNA, 19 bp, Homo sapiens
cccagaataagttattgca

SEQ ID NO: 4419720 - DNA, 18 bp, Homo sapiens
cccagaatgcctcctgca

SEQ ID NO: 4419721 - DNA, 20 bp, Homo sapiens
cccagaatggagcctgctct

SEQ ID NO: 4419722 - DNA, 18 bp, Homo sapiens
cccagaatgtcagattcc

SEQ ID NO: 4419723 - DNA, 21 bp, Homo sapiens
cccagaatgtcagattccttt

SEQ ID NO: 4419724 - DNA, 20 bp, Homo sapiens
cccagaatttaccatcatct

SEQ ID NO: 4419725 - DNA, 21 bp, Homo sapiens
cccagaatttaccatcatctc

SEQ ID NO: 4419726 - DNA, 15 bp, Homo sapiens
cccagacaccatgtg

SEQ ID NO: 4419727 - DNA, 14 bp, Homo sapiens
cccagacagcctgt

SEQ ID NO: 4419728 - DNA, 16 bp, Homo sapiens
cccagacccagaggtc

SEQ ID NO: 4419729 - DNA, 13 bp, Homo sapiens
cccagacccagtg

SEQ ID NO: 4419730 - DNA, 15 bp, Homo sapiens
cccagactacagggc

SEQ ID NO: 4419731 - DNA, 20 bp, Homo sapiens
cccagactagatgtagtatt

SEQ ID NO: 4419732 - DNA, 13 bp, Homo sapiens
cccagactgatga

SEQ ID NO: 4419733 - DNA, 17 bp, Homo sapiens
cccagactgatgagcac

SEQ ID NO: 4419734 - DNA, 16 bp, Homo sapiens
cccagagaagcccctt

SEQ ID NO: 4419735 - DNA, 21 bp, Homo sapiens
cccagagaagccccttcccca

SEQ ID NO: 4419736 - DNA, 13 bp, Homo sapiens
cccagagacagga

SEQ ID NO: 4419737 - DNA, 14 bp, Homo sapiens
cccagagacaggaa

SEQ ID NO: 4419738 - DNA, 22 bp, Homo sapiens
cccagagaggcactcagtgagc

SEQ ID NO: 4419739 - DNA, 16 bp, Homo sapiens
cccagagatgcctcca

SEQ ID NO: 4419740 - DNA, 17 bp, Homo sapiens
cccagagatgcctccac

SEQ ID NO: 4419741 - DNA, 18 bp, Homo sapiens
cccagagatgcctccacc

SEQ ID NO: 4419742 - DNA, 15 bp, Homo sapiens
cccagagcatctgcc

SEQ ID NO: 4419743 - DNA, 17 bp, Homo sapiens
cccagagcatctgcccc

SEQ ID NO: 4419744 - DNA, 19 bp, Homo sapiens
cccagagcatctgccccag

SEQ ID NO: 4419745 - DNA, 13 bp, Homo sapiens
cccagagctcccc

SEQ ID NO: 4419746 - DNA, 13 bp, Homo sapiens
cccagagctggcg

SEQ ID NO: 4419747 - DNA, 23 bp, Homo sapiens
cccagagctggcgctcagcagcc

SEQ ID NO: 4419748 - DNA, 11 bp, Homo sapiens
cccagagctgt

SEQ ID NO: 4419749 - DNA, 20 bp, Homo sapiens
cccagagctgtttatggcct

SEQ ID NO: 4419750 - DNA, 23 bp, Homo sapiens
cccagagctgtttatggcctcag

SEQ ID NO: 4419751 - DNA, 22 bp, Homo sapiens
cccagagctttcctccgccttt

SEQ ID NO: 4419752 - DNA, 23 bp, Homo sapiens
cccagaggaaggggccagaggct

SEQ ID NO: 4419753 - DNA, 24 bp, Homo sapiens
cccagaggaaggggccagaggctc

SEQ ID NO: 4419754 - DNA, 15 bp, Homo sapiens
cccagaggagggcag

SEQ ID NO: 4419755 - DNA, 14 bp, Homo sapiens
cccagaggtccagg

SEQ ID NO: 4419756 - DNA, 19 bp, Homo sapiens
cccagagtggagtctgagt

SEQ ID NO: 4419757 - DNA, 20 bp, Homo sapiens
cccagatctggtcccttgca

SEQ ID NO: 4419758 - DNA, 17 bp, Homo sapiens
cccagattggctcacac

SEQ ID NO: 4419759 - DNA, 19 bp, Homo sapiens
cccagattggctcacactg

SEQ ID NO: 4419760 - DNA, 14 bp, Homo sapiens
cccagcaaatgggc

SEQ ID NO: 4419761 - DNA, 15 bp, Homo sapiens
cccagcaagcgggag

SEQ ID NO: 4419762 - DNA, 13 bp, Homo sapiens
cccagcactgagg

SEQ ID NO: 4419763 - DNA, 17 bp, Homo sapiens
cccagcactttgagagg

SEQ ID NO: 4419764 - DNA, 20 bp, Homo sapiens
cccagcactttgagaggctg

SEQ ID NO: 4419765 - DNA, 15 bp, Homo sapiens
cccagcactttggga

SEQ ID NO: 4419766 - DNA, 17 bp, Homo sapiens
cccagcactttgggagg

SEQ ID NO: 4419767 - DNA, 18 bp, Homo sapiens
cccagcactttgggaggc

SEQ ID NO: 4419768 - DNA, 20 bp, Homo sapiens
cccagcactttgggaggcag

SEQ ID NO: 4419769 - DNA, 13 bp, Homo sapiens
cccagcagaggca

SEQ ID NO: 4419770 - DNA, 15 bp, Homo sapiens
cccagcagaggcagg

SEQ ID NO: 4419771 - DNA, 16 bp, Homo sapiens
cccagcagtttgggag

SEQ ID NO: 4419772 - DNA, 23 bp, Homo sapiens
cccagcatgacataacagtgcag

SEQ ID NO: 4419773 - DNA, 15 bp, Homo sapiens
cccagcattccagct

SEQ ID NO: 4419774 - DNA, 10 bp, Homo sapiens
cccagccaca

SEQ ID NO: 4419775 - DNA, 15 bp, Homo sapiens
cccagccacaggcca

SEQ ID NO: 4419776 - DNA, 12 bp, Homo sapiens
cccagccacccc

SEQ ID NO: 4419777 - DNA, 22 bp, Homo sapiens
cccagccagatggactccagcc

SEQ ID NO: 4419778 - DNA, 14 bp, Homo sapiens
cccagccatggggt

SEQ ID NO: 4419779 - DNA, 14 bp, Homo sapiens
cccagcccaagcac

SEQ ID NO: 4419780 - DNA, 14 bp, Homo sapiens
cccagcccacagag

SEQ ID NO: 4419781 - DNA, 13 bp, Homo sapiens
cccagcccaccct

SEQ ID NO: 4419782 - DNA, 13 bp, Homo sapiens
cccagcccagaca

SEQ ID NO: 4419783 - DNA, 21 bp, Homo sapiens
cccagcccagagccacctgga

SEQ ID NO: 4419784 - DNA, 21 bp, Homo sapiens
cccagcccattctctctcctg

SEQ ID NO: 4419785 - DNA, 19 bp, Homo sapiens
cccagccccctcccaccgc

SEQ ID NO: 4419786 - DNA, 20 bp, Homo sapiens
cccagccccgactccagcca

SEQ ID NO: 4419787 - DNA, 15 bp, Homo sapiens
cccagccccggggtg

SEQ ID NO: 4419788 - DNA, 14 bp, Homo sapiens
cccagcccctcctc

SEQ ID NO: 4419789 - DNA, 17 bp, Homo sapiens
cccagcccctcctccct

SEQ ID NO: 4419790 - DNA, 21 bp, Homo sapiens
cccagcccctcctccctcagg

SEQ ID NO: 4419791 - DNA, 14 bp, Homo sapiens
cccagcccctgcag

SEQ ID NO: 4419792 - DNA, 16 bp, Homo sapiens
cccagccctcatcccg

SEQ ID NO: 4419793 - DNA, 12 bp, Homo sapiens
cccagccctgct

SEQ ID NO: 4419794 - DNA, 15 bp, Homo sapiens
cccagccctgctggc

SEQ ID NO: 4419795 - DNA, 19 bp, Homo sapiens
cccagccctgctggccgcc

SEQ ID NO: 4419796 - DNA, 11 bp, Homo sapiens
cccagccctgg

SEQ ID NO: 4419797 - DNA, 14 bp, Homo sapiens
cccagccctggccc

SEQ ID NO: 4419798 - DNA, 19 bp, Homo sapiens
cccagccctggtctcagca

SEQ ID NO: 4419799 - DNA, 16 bp, Homo sapiens
cccagcctgctctccc

SEQ ID NO: 4419800 - DNA, 11 bp, Homo sapiens
cccagcctggg

SEQ ID NO: 4419801 - DNA, 16 bp, Homo sapiens
cccagccttgcccagc

SEQ ID NO: 4419802 - DNA, 21 bp, Homo sapiens
cccagctactcaggaggctga

SEQ ID NO: 4419803 - DNA, 16 bp, Homo sapiens
cccagctactggggag

SEQ ID NO: 4419804 - DNA, 20 bp, Homo sapiens
cccagctactggggaggctg

SEQ ID NO: 4419805 - DNA, 18 bp, Homo sapiens
cccagctacttgggaggc

SEQ ID NO: 4419806 - DNA, 13 bp, Homo sapiens
ccatgttgaagta

SEQ ID NO: 4419807 - DNA, 20 bp, Homo sapiens
ccatgttggccaggatggtc

SEQ ID NO: 4419808 - DNA, 19 bp, Homo sapiens
ccatgttggccaggctggt

SEQ ID NO: 4419809 - DNA, 13 bp, Homo sapiens
ccatgttggcctc

SEQ ID NO: 4419810 - DNA, 15 bp, Homo sapiens
ccatgttggcctctt

SEQ ID NO: 4419811 - DNA, 17 bp, Homo sapiens
ccatgttggcctcttca

SEQ ID NO: 4419812 - DNA, 23 bp, Homo sapiens
ccatgttggcctcttcaggcctg

SEQ ID NO: 4419813 - DNA, 13 bp, Homo sapiens
ccatgtttcaaat

SEQ ID NO: 4419814 - DNA, 23 bp, Homo sapiens
ccatgtttggtgtttgtctgtgt

SEQ ID NO: 4419815 - DNA, 13 bp, Homo sapiens
ccattaacatttt

SEQ ID NO: 4419816 - DNA, 14 bp, Homo sapiens
ccattaacattttt

SEQ ID NO: 4419817 - DNA, 17 bp, Homo sapiens
ccattaatcagttcatt

SEQ ID NO: 4419818 - DNA, 15 bp, Homo sapiens
ccattaatttaaatg

SEQ ID NO: 4419819 - DNA, 13 bp, Homo sapiens
ccattacccagtg

SEQ ID NO: 4419820 - DNA, 14 bp, Homo sapiens
ccattacccagtgc

SEQ ID NO: 4419821 - DNA, 18 bp, Homo sapiens
ccattacttgtataaata

SEQ ID NO: 4419822 - DNA, 18 bp, Homo sapiens
ccattatactttatatct

SEQ ID NO: 4419823 - DNA, 23 bp, Homo sapiens
ccattcacaagcctcctgtacct

SEQ ID NO: 4419824 - DNA, 19 bp, Homo sapiens
ccattcacaataaaagctt

SEQ ID NO: 4419825 - DNA, 18 bp, Homo sapiens
ccattcatctctaacata

SEQ ID NO: 4419826 - DNA, 11 bp, Homo sapiens
ccattccaaaa

SEQ ID NO: 4419827 - DNA, 21 bp, Homo sapiens
ccattccaaaatattatgccc

SEQ ID NO: 4419828 - DNA, 14 bp, Homo sapiens
ccattccaaagctt

SEQ ID NO: 4419829 - DNA, 15 bp, Homo sapiens
ccattccctccattt

SEQ ID NO: 4419830 - DNA, 18 bp, Homo sapiens
ccattccctccatttttc

SEQ ID NO: 4419831 - DNA, 19 bp, Homo sapiens
ccattccctccatttttct

SEQ ID NO: 4419832 - DNA, 16 bp, Homo sapiens
ccattcctcagggaca

SEQ ID NO: 4419833 - DNA, 12 bp, Homo sapiens
ccattcctgcct

SEQ ID NO: 4419834 - DNA, 13 bp, Homo sapiens
ccattcctgcctg

SEQ ID NO: 4419835 - DNA, 14 bp, Homo sapiens
ccattcctgcctgg

SEQ ID NO: 4419836 - DNA, 12 bp, Homo sapiens
ccattctagatc

SEQ ID NO: 4419837 - DNA, 22 bp, Homo sapiens
ccattctccaggggtttacagt

SEQ ID NO: 4419838 - DNA, 15 bp, Homo sapiens
ccattctcccaggta

SEQ ID NO: 4419839 - DNA, 13 bp, Homo sapiens
ccattctcctcag

SEQ ID NO: 4419840 - DNA, 16 bp, Homo sapiens
ccattctcctcagtgg

SEQ ID NO: 4419841 - DNA, 13 bp, Homo sapiens
ccattctcctgcc

SEQ ID NO: 4419842 - DNA, 16 bp, Homo sapiens
ccattctctctcctgt

SEQ ID NO: 4419843 - DNA, 19 bp, Homo sapiens
ccattctctctcctgtcca

SEQ ID NO: 4419844 - DNA, 13 bp, Homo sapiens
ccattctgcacca

SEQ ID NO: 4419845 - DNA, 13 bp, Homo sapiens
ccattctgtgcag

SEQ ID NO: 4419846 - DNA, 23 bp, Homo sapiens
ccattctgtgtcccatgtcccgt

SEQ ID NO: 4419847 - DNA, 15 bp, Homo sapiens
ccattcttctggtgc

SEQ ID NO: 4419848 - DNA, 15 bp, Homo sapiens
ccattctttgcttga

SEQ ID NO: 4419849 - DNA, 22 bp, Homo sapiens
ccattctttgcttgaacacagt

SEQ ID NO: 4419850 - DNA, 11 bp, Homo sapiens
ccattgaaggc

SEQ ID NO: 4419851 - DNA, 17 bp, Homo sapiens
ccattgaaggcttaaac

SEQ ID NO: 4419852 - DNA, 13 bp, Homo sapiens
ccattgaattctt

SEQ ID NO: 4419853 - DNA, 22 bp, Homo sapiens
ccattgaattcttggttgagga

SEQ ID NO: 4419854 - DNA, 21 bp, Homo sapiens
ccattgccaccaggagaacca

SEQ ID NO: 4419855 - DNA, 17 bp, Homo sapiens
ccattgcccagtgagcc

SEQ ID NO: 4419856 - DNA, 20 bp, Homo sapiens
ccattgcccagtgagccctg

SEQ ID NO: 4419857 - DNA, 23 bp, Homo sapiens
ccattggaactagtcattaaccc

SEQ ID NO: 4419858 - DNA, 21 bp, Homo sapiens
ccattggccgagctcctgggg

SEQ ID NO: 4419859 - DNA, 22 bp, Homo sapiens
ccattggctgcgctaaccccca

SEQ ID NO: 4419860 - DNA, 21 bp, Homo sapiens
ccattggggctcccagccagg

SEQ ID NO: 4419861 - DNA, 16 bp, Homo sapiens
ccattgtactccagcc

SEQ ID NO: 4419862 - DNA, 19 bp, Homo sapiens
ccattgtactccagcctgg

SEQ ID NO: 4419863 - DNA, 17 bp, Homo sapiens
ccattgtccaggaaaga

SEQ ID NO: 4419864 - DNA, 12 bp, Homo sapiens
ccattgtcttta

SEQ ID NO: 4419865 - DNA, 14 bp, Homo sapiens
ccattgtctttata

SEQ ID NO: 4419866 - DNA, 20 bp, Homo sapiens
ccattgtctttatatgaaca

SEQ ID NO: 4419867 - DNA, 22 bp, Homo sapiens
ccattgtctttatatgaacata

SEQ ID NO: 4419868 - DNA, 19 bp, Homo sapiens
ccattgtgaaccaatgcaa

SEQ ID NO: 4419869 - DNA, 22 bp, Homo sapiens
ccattgtggtcacaggaagtag

SEQ ID NO: 4419870 - DNA, 22 bp, Homo sapiens
ccatttaaagcttattaaaact

SEQ ID NO: 4419871 - DNA, 21 bp, Homo sapiens
ccatttaagtatcttgtgctt

SEQ ID NO: 4419872 - DNA, 20 bp, Homo sapiens
ccatttaatttcatgtatat

SEQ ID NO: 4419873 - DNA, 13 bp, Homo sapiens
ccatttacacttt

SEQ ID NO: 4419874 - DNA, 20 bp, Homo sapiens
ccatttacatgttttaaaga

SEQ ID NO: 4419875 - DNA, 19 bp, Homo sapiens
ccatttatttcctcagctg

SEQ ID NO: 4419876 - DNA, 15 bp, Homo sapiens
ccatttcccatctgc

SEQ ID NO: 4419877 - DNA, 17 bp, Homo sapiens
ccatttgtcccaagtgc

SEQ ID NO: 4419878 - DNA, 13 bp, Homo sapiens
ccatttgtcccag

SEQ ID NO: 4419879 - DNA, 21 bp, Homo sapiens
ccatttgtgtctctttattat

SEQ ID NO: 4419880 - DNA, 15 bp, Homo sapiens
ccatttgttaatatc

SEQ ID NO: 4419881 - DNA, 22 bp, Homo sapiens
ccattttaaagttagtatcttt

SEQ ID NO: 4419882 - DNA, 15 bp, Homo sapiens
ccattttaagtccct

SEQ ID NO: 4419883 - DNA, 19 bp, Homo sapiens
ccattttacgttttagaaa

SEQ ID NO: 4419884 - DNA, 22 bp, Homo sapiens
ccattttattaataatatttat

SEQ ID NO: 4419885 - DNA, 22 bp, Homo sapiens
ccattttcctacaggcagtctc

SEQ ID NO: 4419886 - DNA, 15 bp, Homo sapiens
ccattttggtgctta

SEQ ID NO: 4419887 - DNA, 13 bp, Homo sapiens
cccaaaaggcaga

SEQ ID NO: 4419888 - DNA, 23 bp, Homo sapiens
cccaaaagtcaaaaggtgcctgt

SEQ ID NO: 4419889 - DNA, 11 bp, Homo sapiens
cccaaaatata

SEQ ID NO: 4419890 - DNA, 19 bp, Homo sapiens
cccaaacacataatttctg

SEQ ID NO: 4419891 - DNA, 12 bp, Homo sapiens
cccaaaccccag

SEQ ID NO: 4419892 - DNA, 14 bp, Homo sapiens
cccaaaccccagcc

SEQ ID NO: 4419893 - DNA, 19 bp, Homo sapiens
cccaaacccttaactgaca

SEQ ID NO: 4419894 - DNA, 10 bp, Homo sapiens
cccaaacttt

SEQ ID NO: 4419895 - DNA, 22 bp, Homo sapiens
cccaaagcagcaggcctctggt

SEQ ID NO: 4419896 - DNA, 20 bp, Homo sapiens
cccaaagtgctgagattgca

SEQ ID NO: 4419897 - DNA, 10 bp, Homo sapiens
cccaaatgat

SEQ ID NO: 4419898 - DNA, 15 bp, Homo sapiens
cccaacacctgcctc

SEQ ID NO: 4419899 - DNA, 16 bp, Homo sapiens
cccaacacctgcctct

SEQ ID NO: 4419900 - DNA, 14 bp, Homo sapiens
cccaacactgccag

SEQ ID NO: 4419901 - DNA, 15 bp, Homo sapiens
cccaacactgccagc

SEQ ID NO: 4419902 - DNA, 21 bp, Homo sapiens
cccaacatgggagggatcagc

SEQ ID NO: 4419903 - DNA, 17 bp, Homo sapiens
cccaacatgttcagaaa

SEQ ID NO: 4419904 - DNA, 18 bp, Homo sapiens
cccaaccagaactttctg

SEQ ID NO: 4419905 - DNA, 13 bp, Homo sapiens
cccaacccccacc

SEQ ID NO: 4419906 - DNA, 14 bp, Homo sapiens
cccaacccccaccc

SEQ ID NO: 4419907 - DNA, 13 bp, Homo sapiens
cccacctgtgggg

SEQ ID NO: 4419908 - DNA, 22 bp, Homo sapiens
cccacctgtggggcctggggag

SEQ ID NO: 4419909 - DNA, 17 bp, Homo sapiens
cccacctgtttctggaa

SEQ ID NO: 4419910 - DNA, 20 bp, Homo sapiens
cccacgaaactgccctggct

SEQ ID NO: 4419911 - DNA, 20 bp, Homo sapiens
cccacgactgttgtacaagc

SEQ ID NO: 4419912 - DNA, 19 bp, Homo sapiens
cccacgctgaccatgcgtc

SEQ ID NO: 4419913 - DNA, 18 bp, Homo sapiens
cccacggaaggcgggctg

SEQ ID NO: 4419914 - DNA, 21 bp, Homo sapiens
cccacggaaggcgggctgagg

SEQ ID NO: 4419915 - DNA, 18 bp, Homo sapiens
cccacgttctgttaattt

SEQ ID NO: 4419916 - DNA, 13 bp, Homo sapiens
cccactccccagc

SEQ ID NO: 4419917 - DNA, 19 bp, Homo sapiens
cccactccggccctccaga

SEQ ID NO: 4419918 - DNA, 21 bp, Homo sapiens
cccactccggccctccagagc

SEQ ID NO: 4419919 - DNA, 17 bp, Homo sapiens
cccactcctctcccaca

SEQ ID NO: 4419920 - DNA, 13 bp, Homo sapiens
cccactcctggga

SEQ ID NO: 4419921 - DNA, 14 bp, Homo sapiens
cccactctccccac

SEQ ID NO: 4419922 - DNA, 15 bp, Homo sapiens
cccactctccccaca

SEQ ID NO: 4419923 - DNA, 19 bp, Homo sapiens
cccactgcaggccccgctt

SEQ ID NO: 4419924 - DNA, 23 bp, Homo sapiens
cccactgcaggccccgcttgtcc

SEQ ID NO: 4419925 - DNA, 16 bp, Homo sapiens
cccactggccgctgag

SEQ ID NO: 4419926 - DNA, 17 bp, Homo sapiens
cccactggccgctgagc

SEQ ID NO: 4419927 - DNA, 16 bp, Homo sapiens
cccactgtgcaggtgc

SEQ ID NO: 4419928 - DNA, 14 bp, Homo sapiens
cccacttcaccccc

SEQ ID NO: 4419929 - DNA, 18 bp, Homo sapiens
cccacttcactttcttca

SEQ ID NO: 4419930 - DNA, 20 bp, Homo sapiens
cccactttcaagacagatga

SEQ ID NO: 4419931 - DNA, 15 bp, Homo sapiens
ccagagcatctgccc

SEQ ID NO: 4419932 - DNA, 22 bp, Homo sapiens
ccagagcatctgccccaggtac

SEQ ID NO: 4419933 - DNA, 18 bp, Homo sapiens
ccagagccacctggatct

SEQ ID NO: 4419934 - DNA, 15 bp, Homo sapiens
ccagagccatactgc

SEQ ID NO: 4419935 - DNA, 15 bp, Homo sapiens
ccagagcccaaggtc

SEQ ID NO: 4419936 - DNA, 15 bp, Homo sapiens
ccagagccccaagca

SEQ ID NO: 4419937 - DNA, 17 bp, Homo sapiens
ccagagccccacagccc

SEQ ID NO: 4419938 - DNA, 19 bp, Homo sapiens
ccagagcctctggcccctc

SEQ ID NO: 4419939 - DNA, 19 bp, Homo sapiens
ccagagccttcaagtgcca

SEQ ID NO: 4419940 - DNA, 22 bp, Homo sapiens
ccagagccttcaagtgccaaac

SEQ ID NO: 4419941 - DNA, 11 bp, Homo sapiens
ccagagctgag

SEQ ID NO: 4419942 - DNA, 15 bp, Homo sapiens
ccagagctgccgact

SEQ ID NO: 4419943 - DNA, 23 bp, Homo sapiens
ccagagctgccgacttggagact

SEQ ID NO: 4419944 - DNA, 19 bp, Homo sapiens
ccagagctggcgctcagca

SEQ ID NO: 4419945 - DNA, 20 bp, Homo sapiens
ccagagctggcgctcagcag

SEQ ID NO: 4419946 - DNA, 22 bp, Homo sapiens
ccagagctggcgctcagcagcc

SEQ ID NO: 4419947 - DNA, 23 bp, Homo sapiens
ccagagctgtttatggcctcagc

SEQ ID NO: 4419948 - DNA, 16 bp, Homo sapiens
ccagaggagccaccag

SEQ ID NO: 4419949 - DNA, 13 bp, Homo sapiens
ccagaggagggca

SEQ ID NO: 4419950 - DNA, 21 bp, Homo sapiens
ccagaggagggcagagggaga

SEQ ID NO: 4419951 - DNA, 22 bp, Homo sapiens
ccagaggagggcagcagaaggg

SEQ ID NO: 4419952 - DNA, 12 bp, Homo sapiens
ccagaggcagag

SEQ ID NO: 4419953 - DNA, 14 bp, Homo sapiens
ccagaggccctgga

SEQ ID NO: 4419954 - DNA, 15 bp, Homo sapiens
ccagaggccctggag

SEQ ID NO: 4419955 - DNA, 17 bp, Homo sapiens
ccagaggccctggaggg

SEQ ID NO: 4419956 - DNA, 18 bp, Homo sapiens
ccagaggccctggaggga

SEQ ID NO: 4419957 - DNA, 18 bp, Homo sapiens
ccagaggctgggagtccc

SEQ ID NO: 4419958 - DNA, 17 bp, Homo sapiens
ccagagggcactcagaa

SEQ ID NO: 4419959 - DNA, 18 bp, Homo sapiens
ccagagggcactcagaag

SEQ ID NO: 4419960 - DNA, 23 bp, Homo sapiens
ccagagggcactcagaagttgtg

SEQ ID NO: 4419961 - DNA, 15 bp, Homo sapiens
ccagagggtgtggct

SEQ ID NO: 4419962 - DNA, 19 bp, Homo sapiens
ccagaggtctagattaata

SEQ ID NO: 4419963 - DNA, 21 bp, Homo sapiens
ccagaggtgggatcctccctc

SEQ ID NO: 4419964 - DNA, 21 bp, Homo sapiens
ccagagtcaccttttctgtgg

SEQ ID NO: 4419965 - DNA, 17 bp, Homo sapiens
ccagagtcagaggagaa

SEQ ID NO: 4419966 - DNA, 18 bp, Homo sapiens
ccagagtccctgcctgga

SEQ ID NO: 4419967 - DNA, 13 bp, Homo sapiens
ccagagtggccca

SEQ ID NO: 4419968 - DNA, 14 bp, Homo sapiens
ccagagtggcccac

SEQ ID NO: 4419969 - DNA, 13 bp, Homo sapiens
ccagagtggcctg

SEQ ID NO: 4419970 - DNA, 22 bp, Homo sapiens
ccagagtggcctggccaggagc

SEQ ID NO: 4419971 - DNA, 21 bp, Homo sapiens
ccagagtgtgggaagggagag

SEQ ID NO: 4419972 - DNA, 23 bp, Homo sapiens
ccagagttgtctttattgtccac

SEQ ID NO: 4419973 - DNA, 20 bp, Homo sapiens
ccagatataactgtcttgtt

SEQ ID NO: 4419974 - DNA, 22 bp, Homo sapiens
ccagatcccaggcccctggagg

SEQ ID NO: 4419975 - DNA, 16 bp, Homo sapiens
ccagatcctctctggg

SEQ ID NO: 4419976 - DNA, 14 bp, Homo sapiens
ccagatcctcttgg

SEQ ID NO: 4419977 - DNA, 15 bp, Homo sapiens
ccagatcctcttggt

SEQ ID NO: 4419978 - DNA, 12 bp, Homo sapiens
ccagatcctggg

SEQ ID NO: 4419979 - DNA, 18 bp, Homo sapiens
ccagatcgatcctggatt

SEQ ID NO: 4419980 - DNA, 13 bp, Homo sapiens
ccagatctggtcc

SEQ ID NO: 4419981 - DNA, 14 bp, Homo sapiens
ccagatgcaacctc

SEQ ID NO: 4419982 - DNA, 17 bp, Homo sapiens
ccagatggcccctccac

SEQ ID NO: 4419983 - DNA, 19 bp, Homo sapiens
ccagatggcccctccactg

SEQ ID NO: 4419984 - DNA, 22 bp, Homo sapiens
ccagatggctggaaggggtcca

SEQ ID NO: 4419985 - DNA, 12 bp, Homo sapiens
ccagatgtaaag

SEQ ID NO: 4419986 - DNA, 21 bp, Homo sapiens
ccagatgtgtcccccccaggc

SEQ ID NO: 4419987 - DNA, 23 bp, Homo sapiens
ccagatgtgtcccccccaggcct

SEQ ID NO: 4419988 - DNA, 11 bp, Homo sapiens
ccagattacaa

SEQ ID NO: 4419989 - DNA, 21 bp, Homo sapiens
ccagattacaggaatgaagaa

SEQ ID NO: 4419990 - DNA, 15 bp, Homo sapiens
ccagattctgcctct

SEQ ID NO: 4419991 - DNA, 17 bp, Homo sapiens
ccagattctgcctctct

SEQ ID NO: 4419992 - DNA, 23 bp, Homo sapiens
ccagatttgtctttttgttgtaa

SEQ ID NO: 4419993 - DNA, 10 bp, Homo sapiens
ccagcaacat

SEQ ID NO: 4419994 - DNA, 12 bp, Homo sapiens
ccagcaccctct

SEQ ID NO: 4419995 - DNA, 19 bp, Homo sapiens
ccagcaccctctcctgggg

SEQ ID NO: 4419996 - DNA, 17 bp, Homo sapiens
ccagcaccttctttctg

SEQ ID NO: 4419997 - DNA, 19 bp, Homo sapiens
ccagcaccttctttctgga

SEQ ID NO: 4419998 - DNA, 16 bp, Homo sapiens
ccagcactaaggtgga

SEQ ID NO: 4419999 - DNA, 14 bp, Homo sapiens
ccagcactgaggaa

SEQ ID NO: 4420000 - DNA, 12 bp, Homo sapiens
ccagcactgctt

SEQ ID NO: 4420001 - DNA, 18 bp, Homo sapiens
ccagcactgcttgaggaa

SEQ ID NO: 4420002 - DNA, 17 bp, Homo sapiens
ccagcacttccatggga

SEQ ID NO: 4420003 - DNA, 16 bp, Homo sapiens
ccagcagactcctgct

SEQ ID NO: 4420004 - DNA, 16 bp, Homo sapiens
ccagcagagccagggc

SEQ ID NO: 4420005 - DNA, 19 bp, Homo sapiens
ccagcagagccagggcagg

SEQ ID NO: 4420006 - DNA, 13 bp, Homo sapiens
ccagcagcagcac

SEQ ID NO: 4420007 - DNA, 15 bp, Homo sapiens
ccagcagcagcactt

SEQ ID NO: 4420008 - DNA, 16 bp, Homo sapiens
ccagcagcccctgaga

SEQ ID NO: 4420009 - DNA, 15 bp, Homo sapiens
ccagcagctgtcaga

SEQ ID NO: 4420010 - DNA, 23 bp, Homo sapiens
ccagcaggagagactgagcagcc

SEQ ID NO: 4420011 - DNA, 21 bp, Homo sapiens
ccagcagggagttagcactga

SEQ ID NO: 4420012 - DNA, 15 bp, Homo sapiens
ccagcagtttgggag

SEQ ID NO: 4420013 - DNA, 19 bp, Homo sapiens
ccagcatccctggagcagg

SEQ ID NO: 4420014 - DNA, 21 bp, Homo sapiens
ccagcatgacataacagtgca

SEQ ID NO: 4420015 - DNA, 12 bp, Homo sapiens
ccagcattccag

SEQ ID NO: 4420016 - DNA, 13 bp, Homo sapiens
ccagcattccagc

SEQ ID NO: 4420017 - DNA, 22 bp, Homo sapiens
ccagcattccagctctgccccc

SEQ ID NO: 4420018 - DNA, 16 bp, Homo sapiens
ccagccaaagcatgcc

SEQ ID NO: 4420019 - DNA, 15 bp, Homo sapiens
ccagccacaggccaa

SEQ ID NO: 4420020 - DNA, 19 bp, Homo sapiens
ccagccactgtcaccgagc

SEQ ID NO: 4420021 - DNA, 13 bp, Homo sapiens
ccagccagatcct

SEQ ID NO: 4420022 - DNA, 13 bp, Homo sapiens
ccagccagcgcct

SEQ ID NO: 4420023 - DNA, 20 bp, Homo sapiens
ccagccagcgcctccctcca

SEQ ID NO: 4420024 - DNA, 20 bp, Homo sapiens
ccagccaggccaacagcacc

SEQ ID NO: 4420025 - DNA, 17 bp, Homo sapiens
ccagccaggctctgtgc

SEQ ID NO: 4420026 - DNA, 14 bp, Homo sapiens
ccagcccacagagc

SEQ ID NO: 4420027 - DNA, 17 bp, Homo sapiens
ccagcccacagagcctg

SEQ ID NO: 4420028 - DNA, 13 bp, Homo sapiens
ccagcccaccctc

SEQ ID NO: 4420029 - DNA, 18 bp, Homo sapiens
ccagcccaccctcctgtc

SEQ ID NO: 4420030 - DNA, 22 bp, Homo sapiens
ccagcccaccctcctgtcttcc

SEQ ID NO: 4420031 - DNA, 12 bp, Homo sapiens
ccagcccagagc

SEQ ID NO: 4420032 - DNA, 13 bp, Homo sapiens
ccagcccagagcc

SEQ ID NO: 4420033 - DNA, 14 bp, Homo sapiens
ccagcccagccagg

SEQ ID NO: 4420034 - DNA, 15 bp, Homo sapiens
ccagcccagccaggc

SEQ ID NO: 4420035 - DNA, 16 bp, Homo sapiens
ccagcccagccaggcc

SEQ ID NO: 4420036 - DNA, 16 bp, Homo sapiens
ccagcccagcccagct

SEQ ID NO: 4420037 - DNA, 13 bp, Homo sapiens
ccagcccagctgg

SEQ ID NO: 4420038 - DNA, 22 bp, Homo sapiens
ccagcccaggagtttgaggctg

SEQ ID NO: 4420039 - DNA, 18 bp, Homo sapiens
ccagcccatggcccccaa

SEQ ID NO: 4420040 - DNA, 20 bp, Homo sapiens
ccagcccatggcccccaata

SEQ ID NO: 4420041 - DNA, 23 bp, Homo sapiens
ccagcccatggcccccaataaag

SEQ ID NO: 4420042 - DNA, 17 bp, Homo sapiens
ccagccccacccaggag

SEQ ID NO: 4420043 - DNA, 22 bp, Homo sapiens
ccagccccccgcgcgcccaccc

SEQ ID NO: 4420044 - DNA, 16 bp, Homo sapiens
ccagcccccgccccag

SEQ ID NO: 4420045 - DNA, 20 bp, Homo sapiens
ccagcccccgccccagagtg

SEQ ID NO: 4420046 - DNA, 19 bp, Homo sapiens
ccagccccctcccaccgct

SEQ ID NO: 4420047 - DNA, 14 bp, Homo sapiens
ccagccccgactcc

SEQ ID NO: 4420048 - DNA, 17 bp, Homo sapiens
ccagccccgactccagc

SEQ ID NO: 4420049 - DNA, 20 bp, Homo sapiens
ccagccccgactccagccag

SEQ ID NO: 4420050 - DNA, 18 bp, Homo sapiens
ccagccccggccctgggc

SEQ ID NO: 4420051 - DNA, 17 bp, Homo sapiens
ccagccccggggtgagt

SEQ ID NO: 4420052 - DNA, 23 bp, Homo sapiens
ccacgttctgctcatcattctct

SEQ ID NO: 4420053 - DNA, 17 bp, Homo sapiens
ccacgttgtccctgaga

SEQ ID NO: 4420054 - DNA, 14 bp, Homo sapiens
ccactaaaaatatt

SEQ ID NO: 4420055 - DNA, 21 bp, Homo sapiens
ccactaaaccccatacctgga

SEQ ID NO: 4420056 - DNA, 16 bp, Homo sapiens
ccactaaccatcccca

SEQ ID NO: 4420057 - DNA, 19 bp, Homo sapiens
ccactaaccatccccaact

SEQ ID NO: 4420058 - DNA, 21 bp, Homo sapiens
ccactaagaacccctctgctt

SEQ ID NO: 4420059 - DNA, 15 bp, Homo sapiens
ccactaataaagtgc

SEQ ID NO: 4420060 - DNA, 14 bp, Homo sapiens
ccactacacctggc

SEQ ID NO: 4420061 - DNA, 22 bp, Homo sapiens
ccactacatgcagcccatgccc

SEQ ID NO: 4420062 - DNA, 18 bp, Homo sapiens
ccactaccagccagcctc

SEQ ID NO: 4420063 - DNA, 20 bp, Homo sapiens
ccactaccagccagcctcag

SEQ ID NO: 4420064 - DNA, 18 bp, Homo sapiens
ccactaggcctgaaatga

SEQ ID NO: 4420065 - DNA, 16 bp, Homo sapiens
ccactaggtgtcccca

SEQ ID NO: 4420066 - DNA, 23 bp, Homo sapiens
ccactagtaagtaattatgcact

SEQ ID NO: 4420067 - DNA, 22 bp, Homo sapiens
ccactatctccgttccatctgg

SEQ ID NO: 4420068 - DNA, 16 bp, Homo sapiens
ccactcacacagccag

SEQ ID NO: 4420069 - DNA, 17 bp, Homo sapiens
ccactcacacagccagg

SEQ ID NO: 4420070 - DNA, 21 bp, Homo sapiens
ccactcacacagccaggtgcc

SEQ ID NO: 4420071 - DNA, 22 bp, Homo sapiens
ccactcacacagccaggtgcct

SEQ ID NO: 4420072 - DNA, 11 bp, Homo sapiens
ccactcacccc

SEQ ID NO: 4420073 - DNA, 13 bp, Homo sapiens
ccactcaccccgg

SEQ ID NO: 4420074 - DNA, 16 bp, Homo sapiens
ccactcctccaaagga

SEQ ID NO: 4420075 - DNA, 11 bp, Homo sapiens
ccactcctctc

SEQ ID NO: 4420076 - DNA, 13 bp, Homo sapiens
ccactcctctccc

SEQ ID NO: 4420077 - DNA, 17 bp, Homo sapiens
ccactcctctcccacag

SEQ ID NO: 4420078 - DNA, 12 bp, Homo sapiens
ccactcctctga

SEQ ID NO: 4420079 - DNA, 13 bp, Homo sapiens
ccactccttccat

SEQ ID NO: 4420080 - DNA, 23 bp, Homo sapiens
ccactcgacccagaatggagcct

SEQ ID NO: 4420081 - DNA, 17 bp, Homo sapiens
ccactcgaggcctgcaa

SEQ ID NO: 4420082 - DNA, 23 bp, Homo sapiens
ccactcggatggaccaacctgct

SEQ ID NO: 4420083 - DNA, 21 bp, Homo sapiens
ccactctaccctcccaccccc

SEQ ID NO: 4420084 - DNA, 19 bp, Homo sapiens
ccactctagttctagatga

SEQ ID NO: 4420085 - DNA, 13 bp, Homo sapiens
ccactctccccac

SEQ ID NO: 4420086 - DNA, 16 bp, Homo sapiens
ccactctccccacact

SEQ ID NO: 4420087 - DNA, 20 bp, Homo sapiens
ccactctcccccaccccctc

SEQ ID NO: 4420088 - DNA, 14 bp, Homo sapiens
ccactctctgggac

SEQ ID NO: 4420089 - DNA, 20 bp, Homo sapiens
ccactctctgggactctcct

SEQ ID NO: 4420090 - DNA, 22 bp, Homo sapiens
ccactctctgggactctcctcc

SEQ ID NO: 4420091 - DNA, 13 bp, Homo sapiens
ccactctgcaaga

SEQ ID NO: 4420092 - DNA, 17 bp, Homo sapiens
ccactcttgatctctct

SEQ ID NO: 4420093 - DNA, 18 bp, Homo sapiens
ccactcttgatctctctt

SEQ ID NO: 4420094 - DNA, 19 bp, Homo sapiens
ccactgaaaaaatatatgt

SEQ ID NO: 4420095 - DNA, 17 bp, Homo sapiens
ccactgcaagagggggg

SEQ ID NO: 4420096 - DNA, 16 bp, Homo sapiens
ccactgcaagtctgtg

SEQ ID NO: 4420097 - DNA, 16 bp, Homo sapiens
ccactgcactccagcc

SEQ ID NO: 4420098 - DNA, 18 bp, Homo sapiens
ccactgcactccagcctg

SEQ ID NO: 4420099 - DNA, 19 bp, Homo sapiens
ccactgcactccagcctgg

SEQ ID NO: 4420100 - DNA, 23 bp, Homo sapiens
ccactgcactccagcctgggtca

SEQ ID NO: 4420101 - DNA, 13 bp, Homo sapiens
ccactgcaggccc

SEQ ID NO: 4420102 - DNA, 14 bp, Homo sapiens
ccactgcaggcccc

SEQ ID NO: 4420103 - DNA, 21 bp, Homo sapiens
ccactgctcgtggactgtgct

SEQ ID NO: 4420104 - DNA, 22 bp, Homo sapiens
ccactgctgggggtgagctgta

SEQ ID NO: 4420105 - DNA, 19 bp, Homo sapiens
ccactggccgctgagcgcc

SEQ ID NO: 4420106 - DNA, 20 bp, Homo sapiens
ccactggccgctgagcgccc

SEQ ID NO: 4420107 - DNA, 20 bp, Homo sapiens
ccactggggaatgctcccag

SEQ ID NO: 4420108 - DNA, 15 bp, Homo sapiens
ccactgggtgagaga

SEQ ID NO: 4420109 - DNA, 19 bp, Homo sapiens
ccactgtggccccaagagg

SEQ ID NO: 4420110 - DNA, 23 bp, Homo sapiens
ccactgtgtactggagcctgcat

SEQ ID NO: 4420111 - DNA, 19 bp, Homo sapiens
ccactgttaaaataaagct

SEQ ID NO: 4420112 - DNA, 22 bp, Homo sapiens
ccactgttctgaaaggagacat

SEQ ID NO: 4420113 - DNA, 17 bp, Homo sapiens
ccacttaatgtatgtta

SEQ ID NO: 4420114 - DNA, 14 bp, Homo sapiens
ccacttcaccccca

SEQ ID NO: 4420115 - DNA, 17 bp, Homo sapiens
ccacttcactttcttca

SEQ ID NO: 4420116 - DNA, 18 bp, Homo sapiens
ccacttcactttcttcaa

SEQ ID NO: 4420117 - DNA, 19 bp, Homo sapiens
ccacttccaggggaacctg

SEQ ID NO: 4420118 - DNA, 14 bp, Homo sapiens
ccacttccaggtct

SEQ ID NO: 4420119 - DNA, 19 bp, Homo sapiens
ccacttccaggtctgcctg

SEQ ID NO: 4420120 - DNA, 21 bp, Homo sapiens
ccacttccaggtctgcctggt

SEQ ID NO: 4420121 - DNA, 12 bp, Homo sapiens
ccacttcccctc

SEQ ID NO: 4420122 - DNA, 13 bp, Homo sapiens
ccacttctcccca

SEQ ID NO: 4420123 - DNA, 15 bp, Homo sapiens
ccacttctgggtggg

SEQ ID NO: 4420124 - DNA, 19 bp, Homo sapiens
ccacttgtcaaagaaggtg

SEQ ID NO: 4420125 - DNA, 20 bp, Homo sapiens
ccacttgtcaaagaaggtgc

SEQ ID NO: 4420126 - DNA, 19 bp, Homo sapiens
ccactttcatctacctttt

SEQ ID NO: 4420127 - DNA, 13 bp, Homo sapiens
ccactttgtccat

SEQ ID NO: 4420128 - DNA, 23 bp, Homo sapiens
ccagaaaccaaactaggagatga

SEQ ID NO: 4420129 - DNA, 16 bp, Homo sapiens
ccagaaaggagactag

SEQ ID NO: 4420130 - DNA, 15 bp, Homo sapiens
ccagaaagtaaaggt

SEQ ID NO: 4420131 - DNA, 15 bp, Homo sapiens
ccagaaagtgggggt

SEQ ID NO: 4420132 - DNA, 18 bp, Homo sapiens
ccagaaataaagggacca

SEQ ID NO: 4420133 - DNA, 23 bp, Homo sapiens
ccagaaatgtttatggaaatatt

SEQ ID NO: 4420134 - DNA, 13 bp, Homo sapiens
ccagaacagtatg

SEQ ID NO: 4420135 - DNA, 17 bp, Homo sapiens
ccagaagacaaacaata

SEQ ID NO: 4420136 - DNA, 14 bp, Homo sapiens
ccagaagagcccat

SEQ ID NO: 4420137 - DNA, 14 bp, Homo sapiens
ccagaagtccacag

SEQ ID NO: 4420138 - DNA, 18 bp, Homo sapiens
ccagaagtgtgactggct

SEQ ID NO: 4420139 - DNA, 20 bp, Homo sapiens
ccagaagtttgtcaagtcaa

SEQ ID NO: 4420140 - DNA, 22 bp, Homo sapiens
ccagaataagttattgcagttt

SEQ ID NO: 4420141 - DNA, 17 bp, Homo sapiens
ccagaatgctgtacatc

SEQ ID NO: 4420142 - DNA, 15 bp, Homo sapiens
ccagaatggagcctg

SEQ ID NO: 4420143 - DNA, 21 bp, Homo sapiens
ccagaatttaccatcatctct

SEQ ID NO: 4420144 - DNA, 21 bp, Homo sapiens
ccagacaaagatgtcttaacc

SEQ ID NO: 4420145 - DNA, 16 bp, Homo sapiens
ccagacaccatgtgca

SEQ ID NO: 4420146 - DNA, 17 bp, Homo sapiens
ccagacaggccctccct

SEQ ID NO: 4420147 - DNA, 20 bp, Homo sapiens
ccagacagggtgggcttcct

SEQ ID NO: 4420148 - DNA, 15 bp, Homo sapiens
ccagaccccccagcc

SEQ ID NO: 4420149 - DNA, 12 bp, Homo sapiens
ccagaccccgcc

SEQ ID NO: 4420150 - DNA, 22 bp, Homo sapiens
ccagacctagcaggctgttcca

SEQ ID NO: 4420151 - DNA, 22 bp, Homo sapiens
ccagactaaaggatccagagag

SEQ ID NO: 4420152 - DNA, 23 bp, Homo sapiens
ccagactaacatgtcagttttat

SEQ ID NO: 4420153 - DNA, 22 bp, Homo sapiens
ccagactagatgtagtattttt

SEQ ID NO: 4420154 - DNA, 13 bp, Homo sapiens
ccagactctcagg

SEQ ID NO: 4420155 - DNA, 14 bp, Homo sapiens
ccagactctcaggt

SEQ ID NO: 4420156 - DNA, 12 bp, Homo sapiens
ccagactttctt

SEQ ID NO: 4420157 - DNA, 16 bp, Homo sapiens
ccagagaatgctttga

SEQ ID NO: 4420158 - DNA, 22 bp, Homo sapiens
ccagagacactgagccagtctt

SEQ ID NO: 4420159 - DNA, 13 bp, Homo sapiens
ccagagacaggaa

SEQ ID NO: 4420160 - DNA, 23 bp, Homo sapiens
ccagagacaggaaaatcctctgg

SEQ ID NO: 4420161 - DNA, 16 bp, Homo sapiens
ccagagaccacaccac

SEQ ID NO: 4420162 - DNA, 14 bp, Homo sapiens
ccagagactttagg

SEQ ID NO: 4420163 - DNA, 16 bp, Homo sapiens
ccagagagcagctccc

SEQ ID NO: 4420164 - DNA, 13 bp, Homo sapiens
ccagagaggcact

SEQ ID NO: 4420165 - DNA, 16 bp, Homo sapiens
ccagagaggcactcag

SEQ ID NO: 4420166 - DNA, 15 bp, Homo sapiens
ccagagataaatgtt

SEQ ID NO: 4420167 - DNA, 14 bp, Homo sapiens
ccagagatgcctcc

SEQ ID NO: 4420168 - DNA, 15 bp, Homo sapiens
ccagagatgcctcca

SEQ ID NO: 4420169 - DNA, 15 bp, Homo sapiens
ccagagattcatttt

SEQ ID NO: 4420170 - DNA, 23 bp, Homo sapiens
ccagagcaccccctgctccacca

SEQ ID NO: 4420171 - DNA, 13 bp, Homo sapiens
ccagagcatctgc

SEQ ID NO: 4420172 - DNA, 20 bp, Homo sapiens
ccaccacgatgtggccctgg

SEQ ID NO: 4420173 - DNA, 21 bp, Homo sapiens
ccaccacgatgtggccctggc

SEQ ID NO: 4420174 - DNA, 14 bp, Homo sapiens
ccaccagcacctta

SEQ ID NO: 4420175 - DNA, 11 bp, Homo sapiens
ccaccagcagc

SEQ ID NO: 4420176 - DNA, 12 bp, Homo sapiens
ccaccagccatc

SEQ ID NO: 4420177 - DNA, 13 bp, Homo sapiens
ccaccagccatcc

SEQ ID NO: 4420178 - DNA, 18 bp, Homo sapiens
ccaccagcccctccccag

SEQ ID NO: 4420179 - DNA, 12 bp, Homo sapiens
ccaccagccttg

SEQ ID NO: 4420180 - DNA, 20 bp, Homo sapiens
ccaccagccttgctctcttc

SEQ ID NO: 4420181 - DNA, 13 bp, Homo sapiens
ccaccaggagaac

SEQ ID NO: 4420182 - DNA, 14 bp, Homo sapiens
ccaccaggagaacc

SEQ ID NO: 4420183 - DNA, 19 bp, Homo sapiens
ccaccaggagaaccactac

SEQ ID NO: 4420184 - DNA, 18 bp, Homo sapiens
ccaccaggatcccagggg

SEQ ID NO: 4420185 - DNA, 15 bp, Homo sapiens
ccaccagggctccag

SEQ ID NO: 4420186 - DNA, 19 bp, Homo sapiens
ccaccaggtgcctttcaaa

SEQ ID NO: 4420187 - DNA, 20 bp, Homo sapiens
ccaccaggtgcctttcaaat

SEQ ID NO: 4420188 - DNA, 20 bp, Homo sapiens
ccaccagtgcctctccctgc

SEQ ID NO: 4420189 - DNA, 24 bp, Homo sapiens
ccaccagtgcctctccctgctgct

SEQ ID NO: 4420190 - DNA, 12 bp, Homo sapiens
ccaccagttctc

SEQ ID NO: 4420191 - DNA, 13 bp, Homo sapiens
ccaccatccccac

SEQ ID NO: 4420192 - DNA, 19 bp, Homo sapiens
ccaccatgcactgtaaata

SEQ ID NO: 4420193 - DNA, 19 bp, Homo sapiens
ccaccatgcttgcctgaag

SEQ ID NO: 4420194 - DNA, 14 bp, Homo sapiens
ccaccatggaccag

SEQ ID NO: 4420195 - DNA, 12 bp, Homo sapiens
ccacccaagcct

SEQ ID NO: 4420196 - DNA, 16 bp, Homo sapiens
ccacccagtagcccag

SEQ ID NO: 4420197 - DNA, 12 bp, Homo sapiens
ccacccagtcca

SEQ ID NO: 4420198 - DNA, 13 bp, Homo sapiens
ccaccccacactt

SEQ ID NO: 4420199 - DNA, 14 bp, Homo sapiens
ccaccccaccccct

SEQ ID NO: 4420200 - DNA, 12 bp, Homo sapiens
ccacccccagcc

SEQ ID NO: 4420201 - DNA, 16 bp, Homo sapiens
ccacccccagccccga

SEQ ID NO: 4420202 - DNA, 21 bp, Homo sapiens
ccacccccctctctttctctg

SEQ ID NO: 4420203 - DNA, 14 bp, Homo sapiens
ccacccccgccatg

SEQ ID NO: 4420204 - DNA, 16 bp, Homo sapiens
ccaccccctccccagg

SEQ ID NO: 4420205 - DNA, 17 bp, Homo sapiens
ccaccccctccccaggg

SEQ ID NO: 4420206 - DNA, 16 bp, Homo sapiens
ccaccccctgccctgc

SEQ ID NO: 4420207 - DNA, 15 bp, Homo sapiens
ccaccccctgtccca

SEQ ID NO: 4420208 - DNA, 20 bp, Homo sapiens
ccacccccttctctgctcca

SEQ ID NO: 4420209 - DNA, 23 bp, Homo sapiens
ccacccccttctctgctccacca

SEQ ID NO: 4420210 - DNA, 17 bp, Homo sapiens
ccaccccgggctctctg

SEQ ID NO: 4420211 - DNA, 18 bp, Homo sapiens
ccaccccggggaccctgt

SEQ ID NO: 4420212 - DNA, 19 bp, Homo sapiens
ccaccccggggaccctgtg

SEQ ID NO: 4420213 - DNA, 21 bp, Homo sapiens
ccaccccggggaccctgtgac

SEQ ID NO: 4420214 - DNA, 18 bp, Homo sapiens
ccacccctgcctccaccc

SEQ ID NO: 4420215 - DNA, 15 bp, Homo sapiens
ccacccgccttgtga

SEQ ID NO: 4420216 - DNA, 21 bp, Homo sapiens
ccacccggccacagctgctgg

SEQ ID NO: 4420217 - DNA, 15 bp, Homo sapiens
ccacccggcccggct

SEQ ID NO: 4420218 - DNA, 20 bp, Homo sapiens
ccacccggcccggctgagcc

SEQ ID NO: 4420219 - DNA, 18 bp, Homo sapiens
ccacccgggggagcccag

SEQ ID NO: 4420220 - DNA, 18 bp, Homo sapiens
ccacccgtggggtgctgc

SEQ ID NO: 4420221 - DNA, 13 bp, Homo sapiens
ccaccctccctgg

SEQ ID NO: 4420222 - DNA, 17 bp, Homo sapiens
ccaccctccctggagtg

SEQ ID NO: 4420223 - DNA, 16 bp, Homo sapiens
ccaccctcctcttgga

SEQ ID NO: 4420224 - DNA, 18 bp, Homo sapiens
ccaccctcctcttggaat

SEQ ID NO: 4420225 - DNA, 17 bp, Homo sapiens
ccaccctcctgtcttcc

SEQ ID NO: 4420226 - DNA, 19 bp, Homo sapiens
ccaccctcctgtcttccca

SEQ ID NO: 4420227 - DNA, 20 bp, Homo sapiens
ccaccctctgagctttgcat

SEQ ID NO: 4420228 - DNA, 23 bp, Homo sapiens
ccaccctctgagctttgcatgtt

SEQ ID NO: 4420229 - DNA, 22 bp, Homo sapiens
ccaccctgagctcggggacagg

SEQ ID NO: 4420230 - DNA, 12 bp, Homo sapiens
ccacccttggcc

SEQ ID NO: 4420231 - DNA, 14 bp, Homo sapiens
ccacccttggcctg

SEQ ID NO: 4420232 - DNA, 16 bp, Homo sapiens
ccaccgaggttcccag

SEQ ID NO: 4420233 - DNA, 22 bp, Homo sapiens
ccaccgaggttcccagggctgg

SEQ ID NO: 4420234 - DNA, 14 bp, Homo sapiens
ccaccgctgcctaa

SEQ ID NO: 4420235 - DNA, 15 bp, Homo sapiens
ccaccgctgcctaag

SEQ ID NO: 4420236 - DNA, 21 bp, Homo sapiens
ccaccgctgcctaagtggctg

SEQ ID NO: 4420237 - DNA, 14 bp, Homo sapiens
ccaccggcctgtgg

SEQ ID NO: 4420238 - DNA, 14 bp, Homo sapiens
ccaccgtgcctggc

SEQ ID NO: 4420239 - DNA, 19 bp, Homo sapiens
ccaccgtgcctggccagat

SEQ ID NO: 4420240 - DNA, 15 bp, Homo sapiens
ccaccgtgcctggct

SEQ ID NO: 4420241 - DNA, 14 bp, Homo sapiens
ccacctactctcag

SEQ ID NO: 4420242 - DNA, 22 bp, Homo sapiens
ccacctaggccactcctccaaa

SEQ ID NO: 4420243 - DNA, 13 bp, Homo sapiens
ccacctatgcctg

SEQ ID NO: 4420244 - DNA, 14 bp, Homo sapiens
ccacctatgcctgt

SEQ ID NO: 4420245 - DNA, 15 bp, Homo sapiens
ccacctatgcctgtg

SEQ ID NO: 4420246 - DNA, 18 bp, Homo sapiens
ccacctatgcctgtggtg

SEQ ID NO: 4420247 - DNA, 20 bp, Homo sapiens
ccacctatgcctgtggtgaa

SEQ ID NO: 4420248 - DNA, 21 bp, Homo sapiens
ccacctatgcctgtggtgaag

SEQ ID NO: 4420249 - DNA, 19 bp, Homo sapiens
ccacctcacctagcctgat

SEQ ID NO: 4420250 - DNA, 12 bp, Homo sapiens
ccacctcagcct

SEQ ID NO: 4420251 - DNA, 15 bp, Homo sapiens
ccacctcagcctcct

SEQ ID NO: 4420252 - DNA, 16 bp, Homo sapiens
ccacctctccatcctg

SEQ ID NO: 4420253 - DNA, 15 bp, Homo sapiens
ccacctctctcccca

SEQ ID NO: 4420254 - DNA, 16 bp, Homo sapiens
ccacctgaagggtgga

SEQ ID NO: 4420255 - DNA, 20 bp, Homo sapiens
ccacctgacacaccaggcgc

SEQ ID NO: 4420256 - DNA, 16 bp, Homo sapiens
ccacctgcccatcaca

SEQ ID NO: 4420257 - DNA, 18 bp, Homo sapiens
ccacctgcccttttttct

SEQ ID NO: 4420258 - DNA, 22 bp, Homo sapiens
ccacctgcccttttttctgcct

SEQ ID NO: 4420259 - DNA, 23 bp, Homo sapiens
ccacctgctgagagacccaagga

SEQ ID NO: 4420260 - DNA, 12 bp, Homo sapiens
ccacctggcccc

SEQ ID NO: 4420261 - DNA, 21 bp, Homo sapiens
ccacctggccccatgtctctc

SEQ ID NO: 4420262 - DNA, 18 bp, Homo sapiens
ccacctgtggggcctggg

SEQ ID NO: 4420263 - DNA, 20 bp, Homo sapiens
ccacctgtggggcctgggga

SEQ ID NO: 4420264 - DNA, 23 bp, Homo sapiens
ccacctgtttctggaagactgct

SEQ ID NO: 4420265 - DNA, 14 bp, Homo sapiens
ccaccttaaattaa

SEQ ID NO: 4420266 - DNA, 15 bp, Homo sapiens
ccaccttaaattaaa

SEQ ID NO: 4420267 - DNA, 18 bp, Homo sapiens
ccaccttaaattaaacaa

SEQ ID NO: 4420268 - DNA, 11 bp, Homo sapiens
ccaccttccca

SEQ ID NO: 4420269 - DNA, 12 bp, Homo sapiens
ccaccttcccag

SEQ ID NO: 4420270 - DNA, 17 bp, Homo sapiens
ccacgaaactgccctgg

SEQ ID NO: 4420271 - DNA, 15 bp, Homo sapiens
ccacgactgtctcca

SEQ ID NO: 4420272 - DNA, 18 bp, Homo sapiens
ccacgactgttgtacaag

SEQ ID NO: 4420273 - DNA, 19 bp, Homo sapiens
ccacgagggctggctggcc

SEQ ID NO: 4420274 - DNA, 16 bp, Homo sapiens
ccacgcccaccagcct

SEQ ID NO: 4420275 - DNA, 20 bp, Homo sapiens
ccacgcccaccagccttgct

SEQ ID NO: 4420276 - DNA, 21 bp, Homo sapiens
ccacgcctcaccagccccccg

SEQ ID NO: 4420277 - DNA, 14 bp, Homo sapiens
ccacgcctcctggc

SEQ ID NO: 4420278 - DNA, 15 bp, Homo sapiens
ccacgcctcctggcc

SEQ ID NO: 4420279 - DNA, 14 bp, Homo sapiens
ccacgctgggccta

SEQ ID NO: 4420280 - DNA, 11 bp, Homo sapiens
ccacgctgtcc

SEQ ID NO: 4420281 - DNA, 13 bp, Homo sapiens
ccacgctgtcctc

SEQ ID NO: 4420282 - DNA, 14 bp, Homo sapiens
ccacgctgtcctct

SEQ ID NO: 4420283 - DNA, 21 bp, Homo sapiens
ccacgctgtcctctcgagccc

SEQ ID NO: 4420284 - DNA, 23 bp, Homo sapiens
ccacggctcactgcagcctcagc

SEQ ID NO: 4420285 - DNA, 18 bp, Homo sapiens
ccacgggaagtttagaga

SEQ ID NO: 4420286 - DNA, 21 bp, Homo sapiens
ccacgtcagctgggacacccc

SEQ ID NO: 4420287 - DNA, 13 bp, Homo sapiens
ccacgtcccagca

SEQ ID NO: 4420288 - DNA, 21 bp, Homo sapiens
ccacgtcccagcatccctgga

SEQ ID NO: 4420289 - DNA, 18 bp, Homo sapiens
ccacgtcgtggggtaaca

SEQ ID NO: 4420290 - DNA, 14 bp, Homo sapiens
ccacgtgccaggcc

SEQ ID NO: 4420291 - DNA, 20 bp, Homo sapiens
ccacgttccttactgcagaa

SEQ ID NO: 4420292 - DNA, 21 bp, Homo sapiens
ccacgttccttactgcagaat

SEQ ID NO: 4420293 - DNA, 23 bp, Homo sapiens
ccaataaaggcagctgcctctgc

SEQ ID NO: 4420294 - DNA, 24 bp, Homo sapiens
ccaataaaggcagctgcctctgct

SEQ ID NO: 4420295 - DNA, 20 bp, Homo sapiens
ccaataaagtgccttctggg

SEQ ID NO: 4420296 - DNA, 22 bp, Homo sapiens
ccaataaagtgccttctgggct

SEQ ID NO: 4420297 - DNA, 16 bp, Homo sapiens
ccaataggcaaattaa

SEQ ID NO: 4420298 - DNA, 12 bp, Homo sapiens
ccaatataccta

SEQ ID NO: 4420299 - DNA, 13 bp, Homo sapiens
ccaatatattctg

SEQ ID NO: 4420300 - DNA, 19 bp, Homo sapiens
ccaatattttaataaagta

SEQ ID NO: 4420301 - DNA, 14 bp, Homo sapiens
ccaatattttgcct

SEQ ID NO: 4420302 - DNA, 12 bp, Homo sapiens
ccaatcagcact

SEQ ID NO: 4420303 - DNA, 14 bp, Homo sapiens
ccaatcagcttttg

SEQ ID NO: 4420304 - DNA, 19 bp, Homo sapiens
ccaatcagcttttgttcta

SEQ ID NO: 4420305 - DNA, 18 bp, Homo sapiens
catttaatttcatgtata

SEQ ID NO: 4420306 - DNA, 13 bp, Homo sapiens
catttacaacaat

SEQ ID NO: 4420307 - DNA, 16 bp, Homo sapiens
catttacatgttttaa

SEQ ID NO: 4420308 - DNA, 12 bp, Homo sapiens
catttaccactg

SEQ ID NO: 4420309 - DNA, 12 bp, Homo sapiens
catttagaaaag

SEQ ID NO: 4420310 - DNA, 13 bp, Homo sapiens
catttagaagaaa

SEQ ID NO: 4420311 - DNA, 16 bp, Homo sapiens
catttagaagaaagat

SEQ ID NO: 4420312 - DNA, 17 bp, Homo sapiens
catttagaagaaagatg

SEQ ID NO: 4420313 - DNA, 20 bp, Homo sapiens
catttagaagaaagatgttt

SEQ ID NO: 4420314 - DNA, 21 bp, Homo sapiens
catttagaagctgaagatccc

SEQ ID NO: 4420315 - DNA, 21 bp, Homo sapiens
catttagtaaggattttatga

SEQ ID NO: 4420316 - DNA, 17 bp, Homo sapiens
catttatataaaactta

SEQ ID NO: 4420317 - DNA, 15 bp, Homo sapiens
catttatatattgga

SEQ ID NO: 4420318 - DNA, 21 bp, Homo sapiens
catttatatgggtttattttc

SEQ ID NO: 4420319 - DNA, 16 bp, Homo sapiens
catttatctataattt

SEQ ID NO: 4420320 - DNA, 14 bp, Homo sapiens
catttcaaaatgct

SEQ ID NO: 4420321 - DNA, 18 bp, Homo sapiens
catttcacatttttgtaa

SEQ ID NO: 4420322 - DNA, 21 bp, Homo sapiens
catttcacccctccctttctc

SEQ ID NO: 4420323 - DNA, 23 bp, Homo sapiens
catttcacccctccctttctccc

SEQ ID NO: 4420324 - DNA, 15 bp, Homo sapiens
catttcagagggtaa

SEQ ID NO: 4420325 - DNA, 18 bp, Homo sapiens
catttcagagggtaagta

SEQ ID NO: 4420326 - DNA, 20 bp, Homo sapiens
catttcagagggtaagtaaa

SEQ ID NO: 4420327 - DNA, 12 bp, Homo sapiens
catttcagccaa

SEQ ID NO: 4420328 - DNA, 17 bp, Homo sapiens
catttcagccaaagtcc

SEQ ID NO: 4420329 - DNA, 19 bp, Homo sapiens
catttcagggtcttggctg

SEQ ID NO: 4420330 - DNA, 23 bp, Homo sapiens
catttcatacaacagaaaccaga

SEQ ID NO: 4420331 - DNA, 22 bp, Homo sapiens
catttcatattattttagtgtg

SEQ ID NO: 4420332 - DNA, 15 bp, Homo sapiens
catttcatctcattt

SEQ ID NO: 4420333 - DNA, 13 bp, Homo sapiens
catttcatgaaaa

SEQ ID NO: 4420334 - DNA, 15 bp, Homo sapiens
catttcatgaaaaag

SEQ ID NO: 4420335 - DNA, 14 bp, Homo sapiens
catttcatgctctg

SEQ ID NO: 4420336 - DNA, 14 bp, Homo sapiens
catttcccatctgc

SEQ ID NO: 4420337 - DNA, 17 bp, Homo sapiens
catttcccatctgcacc

SEQ ID NO: 4420338 - DNA, 23 bp, Homo sapiens
catttcccctctgcacccagaac

SEQ ID NO: 4420339 - DNA, 19 bp, Homo sapiens
catttccgtggtttctcat

SEQ ID NO: 4420340 - DNA, 18 bp, Homo sapiens
catttcctcacactaaga

SEQ ID NO: 4420341 - DNA, 22 bp, Homo sapiens
catttcctcacactaagagggc

SEQ ID NO: 4420342 - DNA, 13 bp, Homo sapiens
catttctaagact

SEQ ID NO: 4420343 - DNA, 19 bp, Homo sapiens
catttctactatgatcaga

SEQ ID NO: 4420344 - DNA, 23 bp, Homo sapiens
catttctatagccaaaaatagct

SEQ ID NO: 4420345 - DNA, 17 bp, Homo sapiens
catttctatgcaggcag

SEQ ID NO: 4420346 - DNA, 19 bp, Homo sapiens
catttctcataattttgca

SEQ ID NO: 4420347 - DNA, 19 bp, Homo sapiens
catttctctgagcagtcag

SEQ ID NO: 4420348 - DNA, 12 bp, Homo sapiens
catttctgcctc

SEQ ID NO: 4420349 - DNA, 19 bp, Homo sapiens
catttcttaaaacacatga

SEQ ID NO: 4420350 - DNA, 12 bp, Homo sapiens
catttcttccca

SEQ ID NO: 4420351 - DNA, 15 bp, Homo sapiens
catttgagagaagcc

SEQ ID NO: 4420352 - DNA, 16 bp, Homo sapiens
catttgagagaagcca

SEQ ID NO: 4420353 - DNA, 16 bp, Homo sapiens
catttgataatgataa

SEQ ID NO: 4420354 - DNA, 23 bp, Homo sapiens
catttgataatgataaaacacct

SEQ ID NO: 4420355 - DNA, 17 bp, Homo sapiens
catttgatctgttgcaa

SEQ ID NO: 4420356 - DNA, 16 bp, Homo sapiens
catttgatgcatgtct

SEQ ID NO: 4420357 - DNA, 17 bp, Homo sapiens
catttgatgcatgtctt

SEQ ID NO: 4420358 - DNA, 11 bp, Homo sapiens
catttgattaa

SEQ ID NO: 4420359 - DNA, 14 bp, Homo sapiens
catttgattaataa

SEQ ID NO: 4420360 - DNA, 17 bp, Homo sapiens
catttgattaataaaat

SEQ ID NO: 4420361 - DNA, 18 bp, Homo sapiens
catttgattaataaaata

SEQ ID NO: 4420362 - DNA, 22 bp, Homo sapiens
catttgcaagggaaaagtctct

SEQ ID NO: 4420363 - DNA, 22 bp, Homo sapiens
catttgcaggatctgtctgtgc

SEQ ID NO: 4420364 - DNA, 22 bp, Homo sapiens
catttgcagggtcctcttctgg

SEQ ID NO: 4420365 - DNA, 13 bp, Homo sapiens
catttgcctgctt

SEQ ID NO: 4420366 - DNA, 14 bp, Homo sapiens
catttgcctgcttc

SEQ ID NO: 4420367 - DNA, 16 bp, Homo sapiens
catttgcctgcttctt

SEQ ID NO: 4420368 - DNA, 16 bp, Homo sapiens
catttgctaaggcagc

SEQ ID NO: 4420369 - DNA, 19 bp, Homo sapiens
catttgctaaggcagctga

SEQ ID NO: 4420370 - DNA, 10 bp, Homo sapiens
catttggaaa

SEQ ID NO: 4420371 - DNA, 22 bp, Homo sapiens
catttggaaaccactaaagtag

SEQ ID NO: 4420372 - DNA, 23 bp, Homo sapiens
catttgggatgttccttttttca

SEQ ID NO: 4420373 - DNA, 21 bp, Homo sapiens
catttggtgagagtcaaagct

SEQ ID NO: 4420374 - DNA, 15 bp, Homo sapiens
catttgtaaaaatga

SEQ ID NO: 4420375 - DNA, 14 bp, Homo sapiens
catttgtcccaagt

SEQ ID NO: 4420376 - DNA, 21 bp, Homo sapiens
catttgtcccagactaaagga

SEQ ID NO: 4420377 - DNA, 20 bp, Homo sapiens
catttgtttacatttgatgc

SEQ ID NO: 4420378 - DNA, 16 bp, Homo sapiens
cattttaaaagcaatt

SEQ ID NO: 4420379 - DNA, 22 bp, Homo sapiens
cattttaaaagcaattatattg

SEQ ID NO: 4420380 - DNA, 23 bp, Homo sapiens
cattttaaaagcaattatattgt

SEQ ID NO: 4420381 - DNA, 14 bp, Homo sapiens
cattttaaatgaaa

SEQ ID NO: 4420382 - DNA, 23 bp, Homo sapiens
cattttaaattccactgaaaatt

SEQ ID NO: 4420383 - DNA, 16 bp, Homo sapiens
cattttaacgctgcct

SEQ ID NO: 4420384 - DNA, 16 bp, Homo sapiens
cattttaactggcatg

SEQ ID NO: 4420385 - DNA, 20 bp, Homo sapiens
cattttaactggcatgtcat

SEQ ID NO: 4420386 - DNA, 18 bp, Homo sapiens
cattttaagtaacgtgct

SEQ ID NO: 4420387 - DNA, 23 bp, Homo sapiens
cattttaatatataatttaatgt

SEQ ID NO: 4420388 - DNA, 14 bp, Homo sapiens
cattttaatgtaaa

SEQ ID NO: 4420389 - DNA, 14 bp, Homo sapiens
cattttacagtaaa

SEQ ID NO: 4420390 - DNA, 18 bp, Homo sapiens
cattttacattaaatttt

SEQ ID NO: 4420391 - DNA, 16 bp, Homo sapiens
cattttacgttttaga

SEQ ID NO: 4420392 - DNA, 15 bp, Homo sapiens
cattttactatttgc

SEQ ID NO: 4420393 - DNA, 16 bp, Homo sapiens
cattttactgtatatt

SEQ ID NO: 4420394 - DNA, 18 bp, Homo sapiens
cattttactgtatatttt

SEQ ID NO: 4420395 - DNA, 17 bp, Homo sapiens
cattttagaattaaaat

SEQ ID NO: 4420396 - DNA, 19 bp, Homo sapiens
cattttagattaagctttt

SEQ ID NO: 4420397 - DNA, 19 bp, Homo sapiens
cattttataaatgatatca

SEQ ID NO: 4420398 - DNA, 20 bp, Homo sapiens
cattttattaataatattta

SEQ ID NO: 4420399 - DNA, 16 bp, Homo sapiens
cattttattttgtaat

SEQ ID NO: 4420400 - DNA, 19 bp, Homo sapiens
cattttccagtgacttgca

SEQ ID NO: 4420401 - DNA, 16 bp, Homo sapiens
ccaacactgccagcat

SEQ ID NO: 4420402 - DNA, 22 bp, Homo sapiens
ccaacagcacttttcctcttct

SEQ ID NO: 4420403 - DNA, 17 bp, Homo sapiens
ccaacagttgtatgttt

SEQ ID NO: 4420404 - DNA, 13 bp, Homo sapiens
ccaacagtttatt

SEQ ID NO: 4420405 - DNA, 18 bp, Homo sapiens
ccaacatccagtcctgct

SEQ ID NO: 4420406 - DNA, 22 bp, Homo sapiens
ccaacatccagtcctgctgact

SEQ ID NO: 4420407 - DNA, 15 bp, Homo sapiens
ccaacatggagaaac

SEQ ID NO: 4420408 - DNA, 22 bp, Homo sapiens
ccaacatggagaaaccctgtct

SEQ ID NO: 4420409 - DNA, 14 bp, Homo sapiens
ccaacatgttcaga

SEQ ID NO: 4420410 - DNA, 21 bp, Homo sapiens
ccaacatgtttctgttttgtt

SEQ ID NO: 4420411 - DNA, 21 bp, Homo sapiens
ccaaccacagcatcgggagca

SEQ ID NO: 4420412 - DNA, 12 bp, Homo sapiens
ccaacccatcag

SEQ ID NO: 4420413 - DNA, 17 bp, Homo sapiens
ccaacccccaccccaca

SEQ ID NO: 4420414 - DNA, 20 bp, Homo sapiens
ccaacccccaccccacactt

SEQ ID NO: 4420415 - DNA, 13 bp, Homo sapiens
ccaaccccccagc

SEQ ID NO: 4420416 - DNA, 14 bp, Homo sapiens
catactaaactgat

SEQ ID NO: 4420417 - DNA, 15 bp, Homo sapiens
catactaatgaagta

SEQ ID NO: 4420418 - DNA, 20 bp, Homo sapiens
catactccccaatttagtct

SEQ ID NO: 4420419 - DNA, 14 bp, Homo sapiens
catactcttctaaa

SEQ ID NO: 4420420 - DNA, 15 bp, Homo sapiens
catactctttctttg

SEQ ID NO: 4420421 - DNA, 19 bp, Homo sapiens
catactgagggaccaactg

SEQ ID NO: 4420422 - DNA, 11 bp, Homo sapiens
catactgtaca

SEQ ID NO: 4420423 - DNA, 20 bp, Homo sapiens
catactgtacacatttctta

SEQ ID NO: 4420424 - DNA, 22 bp, Homo sapiens
catactgtttgcccattttcat

SEQ ID NO: 4420425 - DNA, 13 bp, Homo sapiens
catacttatctct

SEQ ID NO: 4420426 - DNA, 20 bp, Homo sapiens
catacttatctctctgtgct

SEQ ID NO: 4420427 - DNA, 16 bp, Homo sapiens
catacttcaaaaatgt

SEQ ID NO: 4420428 - DNA, 19 bp, Homo sapiens
catactttacagtaaaatt

SEQ ID NO: 4420429 - DNA, 17 bp, Homo sapiens
catactttatcaatgtg

SEQ ID NO: 4420430 - DNA, 21 bp, Homo sapiens
catactttcatcctgactctg

SEQ ID NO: 4420431 - DNA, 14 bp, Homo sapiens
catactttgtaaat

SEQ ID NO: 4420432 - DNA, 23 bp, Homo sapiens
catagaaaaatgtataaaaatta

SEQ ID NO: 4420433 - DNA, 18 bp, Homo sapiens
catagaactgaactgtaa

SEQ ID NO: 4420434 - DNA, 20 bp, Homo sapiens
catagaagggagggaataaa

SEQ ID NO: 4420435 - DNA, 16 bp, Homo sapiens
catagacaaaggcctt

SEQ ID NO: 4420436 - DNA, 15 bp, Homo sapiens
catagacagaagaaa

SEQ ID NO: 4420437 - DNA, 20 bp, Homo sapiens
catagacagaagaaacaagg

SEQ ID NO: 4420438 - DNA, 15 bp, Homo sapiens
catagaccctgaggc

SEQ ID NO: 4420439 - DNA, 17 bp, Homo sapiens
catagagatctattttt

SEQ ID NO: 4420440 - DNA, 16 bp, Homo sapiens
catagagatgagccca

SEQ ID NO: 4420441 - DNA, 15 bp, Homo sapiens
catagagctttttaa

SEQ ID NO: 4420442 - DNA, 14 bp, Homo sapiens
catagattcacctg

SEQ ID NO: 4420443 - DNA, 16 bp, Homo sapiens
catagattcacctgta

SEQ ID NO: 4420444 - DNA, 18 bp, Homo sapiens
catagattcacctgtaaa

SEQ ID NO: 4420445 - DNA, 23 bp, Homo sapiens
catagattcacctgtaaaacttt

SEQ ID NO: 4420446 - DNA, 20 bp, Homo sapiens
catagatttaagtgaataca

SEQ ID NO: 4420447 - DNA, 19 bp, Homo sapiens
catagcaagcttttgctca

SEQ ID NO: 4420448 - DNA, 22 bp, Homo sapiens
catagcacccgtggtgcatggt

SEQ ID NO: 4420449 - DNA, 14 bp, Homo sapiens
catagcagtatatg

SEQ ID NO: 4420450 - DNA, 17 bp, Homo sapiens
catagccaactctccca

SEQ ID NO: 4420451 - DNA, 18 bp, Homo sapiens
catagccaactctcccaa

SEQ ID NO: 4420452 - DNA, 13 bp, Homo sapiens
catagccataaat

SEQ ID NO: 4420453 - DNA, 19 bp, Homo sapiens
catagcccatgttaagtcc

SEQ ID NO: 4420454 - DNA, 12 bp, Homo sapiens
catagctctggg

SEQ ID NO: 4420455 - DNA, 13 bp, Homo sapiens
catagctctgggg

SEQ ID NO: 4420456 - DNA, 20 bp, Homo sapiens
catagctctggggtgggcag

SEQ ID NO: 4420457 - DNA, 15 bp, Homo sapiens
cataggcttctatta

SEQ ID NO: 4420458 - DNA, 19 bp, Homo sapiens
catagggtcggaggtgctg

SEQ ID NO: 4420459 - DNA, 23 bp, Homo sapiens
catagtcttgaaatgaaagggaa

SEQ ID NO: 4420460 - DNA, 22 bp, Homo sapiens
catagtctttgtttacatgagt

SEQ ID NO: 4420461 - DNA, 21 bp, Homo sapiens
catagtgacctgtgtttcact

SEQ ID NO: 4420462 - DNA, 14 bp, Homo sapiens
catagtgagacact

SEQ ID NO: 4420463 - DNA, 17 bp, Homo sapiens
catagtgagacactgtc

SEQ ID NO: 4420464 - DNA, 19 bp, Homo sapiens
catagtgtgctcggacaca

SEQ ID NO: 4420465 - DNA, 12 bp, Homo sapiens
catagttcagaa

SEQ ID NO: 4420466 - DNA, 19 bp, Homo sapiens
catagttcgtttaccttca

SEQ ID NO: 4420467 - DNA, 16 bp, Homo sapiens
catagtttttcagtct

SEQ ID NO: 4420468 - DNA, 11 bp, Homo sapiens
catataaatgt

SEQ ID NO: 4420469 - DNA, 21 bp, Homo sapiens
cattcttagcctgtggcagta

SEQ ID NO: 4420470 - DNA, 20 bp, Homo sapiens
cattcttccatcatcactgt

SEQ ID NO: 4420471 - DNA, 21 bp, Homo sapiens
cattcttccatcatcactgta

SEQ ID NO: 4420472 - DNA, 14 bp, Homo sapiens
cattcttctgggtg

SEQ ID NO: 4420473 - DNA, 18 bp, Homo sapiens
cattcttggttgttaatt

SEQ ID NO: 4420474 - DNA, 19 bp, Homo sapiens
cattcttggttgttaattt

SEQ ID NO: 4420475 - DNA, 16 bp, Homo sapiens
cattctttatagtgaa

SEQ ID NO: 4420476 - DNA, 22 bp, Homo sapiens
cattctttatagtgaagtgtta

SEQ ID NO: 4420477 - DNA, 13 bp, Homo sapiens
cattctttgcttg

SEQ ID NO: 4420478 - DNA, 21 bp, Homo sapiens
cattctttgcttgaacacagt

SEQ ID NO: 4420479 - DNA, 18 bp, Homo sapiens
cattcttttgccacatcc

SEQ ID NO: 4420480 - DNA, 23 bp, Homo sapiens
cattcttttgccacatccctata

SEQ ID NO: 4420481 - DNA, 19 bp, Homo sapiens
cattctttttctgttgaaa

SEQ ID NO: 4420482 - DNA, 13 bp, Homo sapiens
cattctttttgaa

SEQ ID NO: 4420483 - DNA, 14 bp, Homo sapiens
cattgaacacaaac

SEQ ID NO: 4420484 - DNA, 18 bp, Homo sapiens
cattgaagcagatttctg

SEQ ID NO: 4420485 - DNA, 19 bp, Homo sapiens
cattgaagtaatgaatttt

SEQ ID NO: 4420486 - DNA, 22 bp, Homo sapiens
cattgaatggctatgtttttaa

SEQ ID NO: 4420487 - DNA, 23 bp, Homo sapiens
cattgaattcttggttgaggaaa

SEQ ID NO: 4420488 - DNA, 23 bp, Homo sapiens
cattgactatggagtcttgtgaa

SEQ ID NO: 4420489 - DNA, 12 bp, Homo sapiens
cattgacttcat

SEQ ID NO: 4420490 - DNA, 17 bp, Homo sapiens
cattgacttcattttat

SEQ ID NO: 4420491 - DNA, 22 bp, Homo sapiens
cattgacttcattttatattta

SEQ ID NO: 4420492 - DNA, 16 bp, Homo sapiens
cattgagatcttcctg

SEQ ID NO: 4420493 - DNA, 19 bp, Homo sapiens
cattgagatcttcctgctg

SEQ ID NO: 4420494 - DNA, 19 bp, Homo sapiens
cattgagcttgcatgcttg

SEQ ID NO: 4420495 - DNA, 23 bp, Homo sapiens
cattgagtagacacatttaagga

SEQ ID NO: 4420496 - DNA, 18 bp, Homo sapiens
cattgatctgttttacag

SEQ ID NO: 4420497 - DNA, 15 bp, Homo sapiens
cattgccaagtgcca

SEQ ID NO: 4420498 - DNA, 13 bp, Homo sapiens
cattgccaccagg

SEQ ID NO: 4420499 - DNA, 14 bp, Homo sapiens
cattgccaccagga

SEQ ID NO: 4420500 - DNA, 15 bp, Homo sapiens
cattgccaccaggag

SEQ ID NO: 4420501 - DNA, 16 bp, Homo sapiens
cattgccaccaggaga

SEQ ID NO: 4420502 - DNA, 20 bp, Homo sapiens
cattgccaccaggagaacca

SEQ ID NO: 4420503 - DNA, 14 bp, Homo sapiens
cattgccagtgtct

SEQ ID NO: 4420504 - DNA, 16 bp, Homo sapiens
cattgccagtgtcttt

SEQ ID NO: 4420505 - DNA, 18 bp, Homo sapiens
cattgccagtgtctttct

SEQ ID NO: 4420506 - DNA, 23 bp, Homo sapiens
cattgcccagtgagccctgctct

SEQ ID NO: 4420507 - DNA, 16 bp, Homo sapiens
cattgcccctctgcct

SEQ ID NO: 4420508 - DNA, 19 bp, Homo sapiens
cattgcccctctgccttgc

SEQ ID NO: 4420509 - DNA, 12 bp, Homo sapiens
cattgccctggt

SEQ ID NO: 4420510 - DNA, 21 bp, Homo sapiens
cattgccgtggcatcttaaaa

SEQ ID NO: 4420511 - DNA, 16 bp, Homo sapiens
cattgcctagctcttt

SEQ ID NO: 4420512 - DNA, 17 bp, Homo sapiens
cattgcctggccttcct

SEQ ID NO: 4420513 - DNA, 17 bp, Homo sapiens
cattgccttctggagct

SEQ ID NO: 4420514 - DNA, 23 bp, Homo sapiens
cattgccttctggagctgggaga

SEQ ID NO: 4420515 - DNA, 21 bp, Homo sapiens
cattgctactgctcagcttct

SEQ ID NO: 4420516 - DNA, 17 bp, Homo sapiens
cattgctctatgtctgc

SEQ ID NO: 4420517 - DNA, 20 bp, Homo sapiens
cattgctctatgtctgcctt

SEQ ID NO: 4420518 - DNA, 20 bp, Homo sapiens
cattgctcttagtcccaagc

SEQ ID NO: 4420519 - DNA, 13 bp, Homo sapiens
cattggaagccat

SEQ ID NO: 4420520 - DNA, 20 bp, Homo sapiens
cattggacagaaaatgcaat

SEQ ID NO: 4420521 - DNA, 17 bp, Homo sapiens
cattggacccttccatg

SEQ ID NO: 4420522 - DNA, 16 bp, Homo sapiens
cattggagctgactgt

SEQ ID NO: 4420523 - DNA, 19 bp, Homo sapiens
cattggagctgactgttct

SEQ ID NO: 4420524 - DNA, 22 bp, Homo sapiens
cattggagctgactgttcttgg

SEQ ID NO: 4420525 - DNA, 18 bp, Homo sapiens
cattggatattttttact

SEQ ID NO: 4420526 - DNA, 17 bp, Homo sapiens
cattggccgagctcctg

SEQ ID NO: 4420527 - DNA, 21 bp, Homo sapiens
cattggccgagctcctgggga

SEQ ID NO: 4420528 - DNA, 19 bp, Homo sapiens
cattggctcagcccgctga

SEQ ID NO: 4420529 - DNA, 20 bp, Homo sapiens
cattgggaccctccagtgct

SEQ ID NO: 4420530 - DNA, 18 bp, Homo sapiens
cattgggcacagtccaga

SEQ ID NO: 4420531 - DNA, 16 bp, Homo sapiens
cattggggctcccagc

SEQ ID NO: 4420532 - DNA, 17 bp, Homo sapiens
cattggggctcccagcc

SEQ ID NO: 4420533 - DNA, 22 bp, Homo sapiens
cattggggctcccagccaggcc

SEQ ID NO: 4420534 - DNA, 15 bp, Homo sapiens
cattggggttcctct

SEQ ID NO: 4420535 - DNA, 21 bp, Homo sapiens
cattggggttcctctgtacag

SEQ ID NO: 4420536 - DNA, 19 bp, Homo sapiens
cattgggtggggctcctgg

SEQ ID NO: 4420537 - DNA, 22 bp, Homo sapiens
cattgggtggggctcctgggag

SEQ ID NO: 4420538 - DNA, 16 bp, Homo sapiens
cattggtaagattgca

SEQ ID NO: 4420539 - DNA, 16 bp, Homo sapiens
cattggttttccatga

SEQ ID NO: 4420540 - DNA, 16 bp, Homo sapiens
cattgtaaaataattc

SEQ ID NO: 4420541 - DNA, 21 bp, Homo sapiens
cattgtaaatgtgcttttaaa

SEQ ID NO: 4420542 - DNA, 14 bp, Homo sapiens
cattgtacaagtat

SEQ ID NO: 4420543 - DNA, 14 bp, Homo sapiens
cattgtactccagc

SEQ ID NO: 4420544 - DNA, 16 bp, Homo sapiens
cattgtactccagcct

SEQ ID NO: 4420545 - DNA, 22 bp, Homo sapiens
cattgtactccagcctgggcaa

SEQ ID NO: 4420546 - DNA, 13 bp, Homo sapiens
cattgtactgttg

SEQ ID NO: 4420547 - DNA, 18 bp, Homo sapiens
cattgtactgttgcttta

SEQ ID NO: 4420548 - DNA, 21 bp, Homo sapiens
cattgtactgttgctttaata

SEQ ID NO: 4420549 - DNA, 24 bp, Homo sapiens
cattgtatagatataatgaacaaa

SEQ ID NO: 4420550 - DNA, 14 bp, Homo sapiens
cattgtatatgtga

SEQ ID NO: 4420551 - DNA, 15 bp, Homo sapiens
cattgtcagccttgc

SEQ ID NO: 4420552 - DNA, 22 bp, Homo sapiens
cattgtctaatctgtagaagct

SEQ ID NO: 4420553 - DNA, 22 bp, Homo sapiens
cattgtctactcctagaagaac

SEQ ID NO: 4420554 - DNA, 19 bp, Homo sapiens
cattgtctcctatatattt

SEQ ID NO: 4420555 - DNA, 15 bp, Homo sapiens
cattgtctttatatg

SEQ ID NO: 4420556 - DNA, 16 bp, Homo sapiens
cattgtctttatatga

SEQ ID NO: 4420557 - DNA, 15 bp, Homo sapiens
cattgtgaaccaatg

SEQ ID NO: 4420558 - DNA, 13 bp, Homo sapiens
cattgtgagctct

SEQ ID NO: 4420559 - DNA, 17 bp, Homo sapiens
cattgtgagctctggtt

SEQ ID NO: 4420560 - DNA, 14 bp, Homo sapiens
cattgttagcacta

SEQ ID NO: 4420561 - DNA, 23 bp, Homo sapiens
cagttctggatggtgtgccttcc

SEQ ID NO: 4420562 - DNA, 18 bp, Homo sapiens
cagttgaaaacttgtaat

SEQ ID NO: 4420563 - DNA, 21 bp, Homo sapiens
cagttgaaaagactccaaaga

SEQ ID NO: 4420564 - DNA, 23 bp, Homo sapiens
cagttgaaaagactccaaagaaa

SEQ ID NO: 4420565 - DNA, 22 bp, Homo sapiens
cagttgaaaagaggtggattca

SEQ ID NO: 4420566 - DNA, 19 bp, Homo sapiens
cagttgaagggaggggctg

SEQ ID NO: 4420567 - DNA, 13 bp, Homo sapiens
cagttgagctcag

SEQ ID NO: 4420568 - DNA, 19 bp, Homo sapiens
cagttgcatgtagtaacac

SEQ ID NO: 4420569 - DNA, 12 bp, Homo sapiens
cagttgccacat

SEQ ID NO: 4420570 - DNA, 23 bp, Homo sapiens
cagttgctcaaaaagaaatcaat

SEQ ID NO: 4420571 - DNA, 16 bp, Homo sapiens
cagttggactctcagg

SEQ ID NO: 4420572 - DNA, 17 bp, Homo sapiens
cagttggcactgtaagg

SEQ ID NO: 4420573 - DNA, 17 bp, Homo sapiens
cagttggtaacttttgt

SEQ ID NO: 4420574 - DNA, 19 bp, Homo sapiens
cagttgtataaactgtatt

SEQ ID NO: 4420575 - DNA, 18 bp, Homo sapiens
cagttgtatttaacagaa

SEQ ID NO: 4420576 - DNA, 16 bp, Homo sapiens
cagttgtgtggcccag

SEQ ID NO: 4420577 - DNA, 15 bp, Homo sapiens
cagttgttcttttta

SEQ ID NO: 4420578 - DNA, 23 bp, Homo sapiens
cagtttaaggtacactgtttcca

SEQ ID NO: 4420579 - DNA, 21 bp, Homo sapiens
cagtttagaacagagggacca

SEQ ID NO: 4420580 - DNA, 14 bp, Homo sapiens
cagtttatatttaa

SEQ ID NO: 4420581 - DNA, 19 bp, Homo sapiens
cagtttatatttaactctc

SEQ ID NO: 4420582 - DNA, 17 bp, Homo sapiens
cagtttatcatgaagcc

SEQ ID NO: 4420583 - DNA, 19 bp, Homo sapiens
cagtttatcatgaagcctg

SEQ ID NO: 4420584 - DNA, 16 bp, Homo sapiens
cagtttatcattcaag

SEQ ID NO: 4420585 - DNA, 21 bp, Homo sapiens
cagtttcatcatttgcacaaa

SEQ ID NO: 4420586 - DNA, 20 bp, Homo sapiens
cagtttccgaatctctttcc

SEQ ID NO: 4420587 - DNA, 23 bp, Homo sapiens
cagtttcttttcacattaggctg

SEQ ID NO: 4420588 - DNA, 18 bp, Homo sapiens
cagtttgaaaatattttg

SEQ ID NO: 4420589 - DNA, 22 bp, Homo sapiens
cagtttgaaattctgaatttgc

SEQ ID NO: 4420590 - DNA, 23 bp, Homo sapiens
cagtttgaggaagtggctgtccc

SEQ ID NO: 4420591 - DNA, 21 bp, Homo sapiens
cagtttgcagaaaagcacctg

SEQ ID NO: 4420592 - DNA, 23 bp, Homo sapiens
cagtttgcagaaaagcacctgcc

SEQ ID NO: 4420593 - DNA, 14 bp, Homo sapiens
cagttttaactgtg

SEQ ID NO: 4420594 - DNA, 22 bp, Homo sapiens
cagttttaactgtggatattgt

SEQ ID NO: 4420595 - DNA, 17 bp, Homo sapiens
cagttttaataagaaca

SEQ ID NO: 4420596 - DNA, 14 bp, Homo sapiens
cagttttctgagaa

SEQ ID NO: 4420597 - DNA, 16 bp, Homo sapiens
cagttttgtcttcgta

SEQ ID NO: 4420598 - DNA, 15 bp, Homo sapiens
cagtttttaaaaacc

SEQ ID NO: 4420599 - DNA, 22 bp, Homo sapiens
cagtttttaaaaacctgtatct

SEQ ID NO: 4420600 - DNA, 20 bp, Homo sapiens
cagtttttattaatctactg

SEQ ID NO: 4420601 - DNA, 13 bp, Homo sapiens
cagtttttcttta

SEQ ID NO: 4420602 - DNA, 15 bp, Homo sapiens
cagtttttctttact

SEQ ID NO: 4420603 - DNA, 22 bp, Homo sapiens
cagtttttgtttttgcatgaaa

SEQ ID NO: 4420604 - DNA, 21 bp, Homo sapiens
cataaaaaggacatcagcaaa

SEQ ID NO: 4420605 - DNA, 22 bp, Homo sapiens
cataaaaaggacatcagcaaac

SEQ ID NO: 4420606 - DNA, 17 bp, Homo sapiens
cataaaattgcagtttc

SEQ ID NO: 4420607 - DNA, 23 bp, Homo sapiens
cataaaattgcagtttcatgtat

SEQ ID NO: 4420608 - DNA, 18 bp, Homo sapiens
cataaacaatgatgccct

SEQ ID NO: 4420609 - DNA, 22 bp, Homo sapiens
cataaactttctccatttaaga

SEQ ID NO: 4420610 - DNA, 15 bp, Homo sapiens
cataaagaaattcaa

SEQ ID NO: 4420611 - DNA, 21 bp, Homo sapiens
cataaagaagaaacttgtaaa

SEQ ID NO: 4420612 - DNA, 22 bp, Homo sapiens
cataaagaagaaacttgtaaat

SEQ ID NO: 4420613 - DNA, 23 bp, Homo sapiens
cataaagaagaaacttgtaaata

SEQ ID NO: 4420614 - DNA, 20 bp, Homo sapiens
cataaagaattaatgactta

SEQ ID NO: 4420615 - DNA, 20 bp, Homo sapiens
cataaagctcaaatgaaatg

SEQ ID NO: 4420616 - DNA, 21 bp, Homo sapiens
cataaagctcaaatgaaatgt

SEQ ID NO: 4420617 - DNA, 23 bp, Homo sapiens
cagtcattatgagaggcaatgat

SEQ ID NO: 4420618 - DNA, 19 bp, Homo sapiens
cagtcattatgttaatatt

SEQ ID NO: 4420619 - DNA, 17 bp, Homo sapiens
cagtccaaatgtcctcc

SEQ ID NO: 4420620 - DNA, 21 bp, Homo sapiens
cagtccaaatgtcctccagaa

SEQ ID NO: 4420621 - DNA, 22 bp, Homo sapiens
cagtccaaatgtcctccagaag

SEQ ID NO: 4420622 - DNA, 15 bp, Homo sapiens
cagtccacaggggcc

SEQ ID NO: 4420623 - DNA, 18 bp, Homo sapiens
cagtccacaggggccacc

SEQ ID NO: 4420624 - DNA, 16 bp, Homo sapiens
cagtccagacccaagt

SEQ ID NO: 4420625 - DNA, 20 bp, Homo sapiens
cagtccagtcaagaaaagaa

SEQ ID NO: 4420626 - DNA, 23 bp, Homo sapiens
cagtccatgcatgacagcctcta

SEQ ID NO: 4420627 - DNA, 19 bp, Homo sapiens
cagtccatgctccagggtc

SEQ ID NO: 4420628 - DNA, 13 bp, Homo sapiens
cagtcccactgtg

SEQ ID NO: 4420629 - DNA, 23 bp, Homo sapiens
cagtcccactgtgcaggtgctat

SEQ ID NO: 4420630 - DNA, 14 bp, Homo sapiens
cagtccccacccct

SEQ ID NO: 4420631 - DNA, 15 bp, Homo sapiens
cagtccccacccctg

SEQ ID NO: 4420632 - DNA, 16 bp, Homo sapiens
cagtccccacccctgc

SEQ ID NO: 4420633 - DNA, 19 bp, Homo sapiens
cagtccccacccctgcccc

SEQ ID NO: 4420634 - DNA, 20 bp, Homo sapiens
cagtccccacccctgccccc

SEQ ID NO: 4420635 - DNA, 19 bp, Homo sapiens
cagtccccatttctgcctc

SEQ ID NO: 4420636 - DNA, 22 bp, Homo sapiens
cagtccccgaggagctgggccc

SEQ ID NO: 4420637 - DNA, 23 bp, Homo sapiens
cagtccccgtggccatccctgtg

SEQ ID NO: 4420638 - DNA, 14 bp, Homo sapiens
cagtccctgctggg

SEQ ID NO: 4420639 - DNA, 21 bp, Homo sapiens
cagtccctgggggaagccctg

SEQ ID NO: 4420640 - DNA, 22 bp, Homo sapiens
cagtccctgggggaagccctgg

SEQ ID NO: 4420641 - DNA, 13 bp, Homo sapiens
cagtcctgcctga

SEQ ID NO: 4420642 - DNA, 21 bp, Homo sapiens
cagtcctgcctggccaggcag

SEQ ID NO: 4420643 - DNA, 18 bp, Homo sapiens
cagtcctggtccttccac

SEQ ID NO: 4420644 - DNA, 14 bp, Homo sapiens
cagtcctgtagttt

SEQ ID NO: 4420645 - DNA, 15 bp, Homo sapiens
cagtcgatagagctg

SEQ ID NO: 4420646 - DNA, 15 bp, Homo sapiens
cagtcgcctgcctgc

SEQ ID NO: 4420647 - DNA, 20 bp, Homo sapiens
cagtcgctcagtctgttcac

SEQ ID NO: 4420648 - DNA, 14 bp, Homo sapiens
cagtcggccccatc

SEQ ID NO: 4420649 - DNA, 22 bp, Homo sapiens
cagtctaggagctccttctggc

SEQ ID NO: 4420650 - DNA, 21 bp, Homo sapiens
cagtctcagaatgtcattttg

SEQ ID NO: 4420651 - DNA, 15 bp, Homo sapiens
cagtctccccttcct

SEQ ID NO: 4420652 - DNA, 16 bp, Homo sapiens
cagtctccccttcctg

SEQ ID NO: 4420653 - DNA, 14 bp, Homo sapiens
cagtctcctcactc

SEQ ID NO: 4420654 - DNA, 20 bp, Homo sapiens
cagtctcctcactctgtccc

SEQ ID NO: 4420655 - DNA, 17 bp, Homo sapiens
cagtctcctctttaaaa

SEQ ID NO: 4420656 - DNA, 19 bp, Homo sapiens
cagtctcctctttaaaaca

SEQ ID NO: 4420657 - DNA, 22 bp, Homo sapiens
cagtctcctctttaaaacaaaa

SEQ ID NO: 4420658 - DNA, 22 bp, Homo sapiens
cagtctcgggtggctagtcaga

SEQ ID NO: 4420659 - DNA, 15 bp, Homo sapiens
cagtctctctcttcc

SEQ ID NO: 4420660 - DNA, 17 bp, Homo sapiens
cagtctctcttctctcc

SEQ ID NO: 4420661 - DNA, 17 bp, Homo sapiens
cagtctgaagctcgcat

SEQ ID NO: 4420662 - DNA, 13 bp, Homo sapiens
cagtctgctctgc

SEQ ID NO: 4420663 - DNA, 16 bp, Homo sapiens
cagtctgctctgctgc

SEQ ID NO: 4420664 - DNA, 21 bp, Homo sapiens
cagtctgctctgctgctctga

SEQ ID NO: 4420665 - DNA, 16 bp, Homo sapiens
cagtctgctttctcta

SEQ ID NO: 4420666 - DNA, 16 bp, Homo sapiens
cagtctgttcactgca

SEQ ID NO: 4420667 - DNA, 20 bp, Homo sapiens
cagtctgttcactgcattca

SEQ ID NO: 4420668 - DNA, 19 bp, Homo sapiens
cagtcttccacaaagaaaa

SEQ ID NO: 4420669 - DNA, 15 bp, Homo sapiens
cagtcttccatttgc

SEQ ID NO: 4420670 - DNA, 18 bp, Homo sapiens
cagtcttcctgacacttt

SEQ ID NO: 4420671 - DNA, 13 bp, Homo sapiens
cagtcttgcctag

SEQ ID NO: 4420672 - DNA, 22 bp, Homo sapiens
cagcaccttctttctggactgg

SEQ ID NO: 4420673 - DNA, 15 bp, Homo sapiens
cagcacgagcctggg

SEQ ID NO: 4420674 - DNA, 16 bp, Homo sapiens
cagcacgagcctgggc

SEQ ID NO: 4420675 - DNA, 15 bp, Homo sapiens
cagcactaaggtgga

SEQ ID NO: 4420676 - DNA, 22 bp, Homo sapiens
cagcactaaggtggacagcaga

SEQ ID NO: 4420677 - DNA, 11 bp, Homo sapiens
cagcactactc

SEQ ID NO: 4420678 - DNA, 17 bp, Homo sapiens
cagcactccgcatcacc

SEQ ID NO: 4420679 - DNA, 15 bp, Homo sapiens
cagcactctgtaaaa

SEQ ID NO: 4420680 - DNA, 13 bp, Homo sapiens
cagcactgaggaa

SEQ ID NO: 4420681 - DNA, 19 bp, Homo sapiens
cagcactgcttgaggaaaa

SEQ ID NO: 4420682 - DNA, 19 bp, Homo sapiens
cagcacttagacctgccag

SEQ ID NO: 4420683 - DNA, 21 bp, Homo sapiens
cagcacttagacctgccagcc

SEQ ID NO: 4420684 - DNA, 12 bp, Homo sapiens
cagcacttccat

SEQ ID NO: 4420685 - DNA, 19 bp, Homo sapiens
cagcactttgagaggctga

SEQ ID NO: 4420686 - DNA, 22 bp, Homo sapiens
cagcactttgggaggctgaggc

SEQ ID NO: 4420687 - DNA, 20 bp, Homo sapiens
cagcagacaagagggcaagc

SEQ ID NO: 4420688 - DNA, 16 bp, Homo sapiens
cagcagagagccctgg

SEQ ID NO: 4420689 - DNA, 13 bp, Homo sapiens
cagcagagccagg

SEQ ID NO: 4420690 - DNA, 15 bp, Homo sapiens
cagcagagccagggc

SEQ ID NO: 4420691 - DNA, 21 bp, Homo sapiens
cagcagaggacagtctggaga

SEQ ID NO: 4420692 - DNA, 22 bp, Homo sapiens
cagcagcacttagacctgccag

SEQ ID NO: 4420693 - DNA, 15 bp, Homo sapiens
cagcagcagagagcc

SEQ ID NO: 4420694 - DNA, 18 bp, Homo sapiens
cagcagcagagagccctg

SEQ ID NO: 4420695 - DNA, 13 bp, Homo sapiens
cagcagcagcact

SEQ ID NO: 4420696 - DNA, 21 bp, Homo sapiens
cagcagcagcctgcacctgcc

SEQ ID NO: 4420697 - DNA, 13 bp, Homo sapiens
cagcagcattttt

SEQ ID NO: 4420698 - DNA, 15 bp, Homo sapiens
cagcagccccaggag

SEQ ID NO: 4420699 - DNA, 16 bp, Homo sapiens
cagcagccccaggaga

SEQ ID NO: 4420700 - DNA, 17 bp, Homo sapiens
cagcagccccaggagaa

SEQ ID NO: 4420701 - DNA, 18 bp, Homo sapiens
cagcagccccaggagaag

SEQ ID NO: 4420702 - DNA, 21 bp, Homo sapiens
cagcagcccccactgcacccc

SEQ ID NO: 4420703 - DNA, 14 bp, Homo sapiens
cagcagccccccag

SEQ ID NO: 4420704 - DNA, 16 bp, Homo sapiens
cagcagccccccagca

SEQ ID NO: 4420705 - DNA, 21 bp, Homo sapiens
cagcagccccccagcactaag

SEQ ID NO: 4420706 - DNA, 22 bp, Homo sapiens
cagcagccctagcggctgctcc

SEQ ID NO: 4420707 - DNA, 11 bp, Homo sapiens
cagcagccctc

SEQ ID NO: 4420708 - DNA, 12 bp, Homo sapiens
cagcagccctcc

SEQ ID NO: 4420709 - DNA, 18 bp, Homo sapiens
cagcagccctcctcaccc

SEQ ID NO: 4420710 - DNA, 15 bp, Homo sapiens
cagcagcctgcacct

SEQ ID NO: 4420711 - DNA, 14 bp, Homo sapiens
cagcagctctgagc

SEQ ID NO: 4420712 - DNA, 23 bp, Homo sapiens
cagcagctctgagccagattaca

SEQ ID NO: 4420713 - DNA, 23 bp, Homo sapiens
cagcagctctggctctgcctcag

SEQ ID NO: 4420714 - DNA, 11 bp, Homo sapiens
cagcaggagag

SEQ ID NO: 4420715 - DNA, 15 bp, Homo sapiens
cagcaggaggcaagc

SEQ ID NO: 4420716 - DNA, 19 bp, Homo sapiens
cagcaggatgctaatggaa

SEQ ID NO: 4420717 - DNA, 22 bp, Homo sapiens
cagcaggcatttgctaaggcag

SEQ ID NO: 4420718 - DNA, 19 bp, Homo sapiens
cagcaggccagggactcag

SEQ ID NO: 4420719 - DNA, 16 bp, Homo sapiens
cagcaggcctctggtt

SEQ ID NO: 4420720 - DNA, 11 bp, Homo sapiens
cagcaggctca

SEQ ID NO: 4420721 - DNA, 13 bp, Homo sapiens
cagcaggctcagg

SEQ ID NO: 4420722 - DNA, 13 bp, Homo sapiens
cagcaggctgcca

SEQ ID NO: 4420723 - DNA, 16 bp, Homo sapiens
cagcagggaaggccca

SEQ ID NO: 4420724 - DNA, 21 bp, Homo sapiens
cagcagggcatcttggaaaag

SEQ ID NO: 4420725 - DNA, 17 bp, Homo sapiens
cagcagggctgctgtga

SEQ ID NO: 4420726 - DNA, 18 bp, Homo sapiens
cagcagggctgctgtgaa

SEQ ID NO: 4420727 - DNA, 16 bp, Homo sapiens
cagcagtgcagccggg

SEQ ID NO: 4420728 - DNA, 16 bp, Homo sapiens
cagcagtgtcacagac

SEQ ID NO: 4420729 - DNA, 11 bp, Homo sapiens
cagcagtgtcc

SEQ ID NO: 4420730 - DNA, 14 bp, Homo sapiens
cagcagtgtccaga

SEQ ID NO: 4420731 - DNA, 21 bp, Homo sapiens
cagcagttcacaaaaaaatgt

SEQ ID NO: 4420732 - DNA, 17 bp, Homo sapiens
cagcagttgaaaagact

SEQ ID NO: 4420733 - DNA, 20 bp, Homo sapiens
cagcagttgaaaagactcca

SEQ ID NO: 4420734 - DNA, 21 bp, Homo sapiens
cagcatagggtcactttgcca

SEQ ID NO: 4420735 - DNA, 15 bp, Homo sapiens
cagcatcactgatgg

SEQ ID NO: 4420736 - DNA, 23 bp, Homo sapiens
cagcatcactgatgggaataaaa

SEQ ID NO: 4420737 - DNA, 14 bp, Homo sapiens
cagcatcagctcaa

SEQ ID NO: 4420738 - DNA, 17 bp, Homo sapiens
cagcatccaccccaccc

SEQ ID NO: 4420739 - DNA, 23 bp, Homo sapiens
cagcatcccttcccacatgcctg

SEQ ID NO: 4420740 - DNA, 12 bp, Homo sapiens
cagcatccgcag

SEQ ID NO: 4420741 - DNA, 17 bp, Homo sapiens
cagcatccgcaggtgct

SEQ ID NO: 4420742 - DNA, 20 bp, Homo sapiens
cagcatccgcaggtgctggt

SEQ ID NO: 4420743 - DNA, 23 bp, Homo sapiens
cagcatcgggagcacccagagca

SEQ ID NO: 4420744 - DNA, 24 bp, Homo sapiens
cagcatcgggagcacccagagcac

SEQ ID NO: 4420745 - DNA, 15 bp, Homo sapiens
cagcatcttctggtt

SEQ ID NO: 4420746 - DNA, 20 bp, Homo sapiens
cagcatgacataacagtgca

SEQ ID NO: 4420747 - DNA, 19 bp, Homo sapiens
cagcatggcatagccccgg

SEQ ID NO: 4420748 - DNA, 20 bp, Homo sapiens
cagcatgggcccaggaatgc

SEQ ID NO: 4420749 - DNA, 19 bp, Homo sapiens
cagcatgtatagttgcttt

SEQ ID NO: 4420750 - DNA, 17 bp, Homo sapiens
cagcattccagacttca

SEQ ID NO: 4420751 - DNA, 18 bp, Homo sapiens
cagcattccagacttcaa

SEQ ID NO: 4420752 - DNA, 19 bp, Homo sapiens
cagcattccagacttcaaa

SEQ ID NO: 4420753 - DNA, 14 bp, Homo sapiens
cagcattccagctc

SEQ ID NO: 4420754 - DNA, 18 bp, Homo sapiens
cagcattcttagcctgtg

SEQ ID NO: 4420755 - DNA, 21 bp, Homo sapiens
cagcatttccacaccaagcag

SEQ ID NO: 4420756 - DNA, 15 bp, Homo sapiens
cagcatttcccttcc

SEQ ID NO: 4420757 - DNA, 18 bp, Homo sapiens
cagcatttccttgtcccg

SEQ ID NO: 4420758 - DNA, 19 bp, Homo sapiens
cagcatttgatgatagcag

SEQ ID NO: 4420759 - DNA, 15 bp, Homo sapiens
cagccaaagcatgcc

SEQ ID NO: 4420760 - DNA, 17 bp, Homo sapiens
cagccaaagcatgccgt

SEQ ID NO: 4420761 - DNA, 17 bp, Homo sapiens
cagccaaatgcagggag

SEQ ID NO: 4420762 - DNA, 18 bp, Homo sapiens
cagccaaatgcagggagg

SEQ ID NO: 4420763 - DNA, 22 bp, Homo sapiens
cagccaaatttaaaactgttgg

SEQ ID NO: 4420764 - DNA, 16 bp, Homo sapiens
cagccaacgagacaca

SEQ ID NO: 4420765 - DNA, 23 bp, Homo sapiens
cagccaacgagacacattgcctt

SEQ ID NO: 4420766 - DNA, 18 bp, Homo sapiens
cagccaactagcccctgg

SEQ ID NO: 4420767 - DNA, 19 bp, Homo sapiens
cagccaactagcccctggg

SEQ ID NO: 4420768 - DNA, 22 bp, Homo sapiens
cagccaactagcccctggggtg

SEQ ID NO: 4420769 - DNA, 23 bp, Homo sapiens
cagccaagattttcctcttgtga

SEQ ID NO: 4420770 - DNA, 22 bp, Homo sapiens
cagccaagggtcctcacccctc

SEQ ID NO: 4420771 - DNA, 21 bp, Homo sapiens
cagccacaaagccccccagct

SEQ ID NO: 4420772 - DNA, 14 bp, Homo sapiens
cagccacacctgga

SEQ ID NO: 4420773 - DNA, 18 bp, Homo sapiens
cagccacacctggactga

SEQ ID NO: 4420774 - DNA, 21 bp, Homo sapiens
cagccacacctggactgaccc

SEQ ID NO: 4420775 - DNA, 12 bp, Homo sapiens
cagccacaggcc

SEQ ID NO: 4420776 - DNA, 22 bp, Homo sapiens
cagccacagggaagctcacaca

SEQ ID NO: 4420777 - DNA, 15 bp, Homo sapiens
cagccacatgcccca

SEQ ID NO: 4420778 - DNA, 15 bp, Homo sapiens
cagccaccacatccc

SEQ ID NO: 4420779 - DNA, 11 bp, Homo sapiens
cagccacccaa

SEQ ID NO: 4420780 - DNA, 15 bp, Homo sapiens
cagccacccaagcct

SEQ ID NO: 4420781 - DNA, 22 bp, Homo sapiens
cagccacccaagcctgctggct

SEQ ID NO: 4420782 - DNA, 21 bp, Homo sapiens
cagccacccgtggggtgctgc

SEQ ID NO: 4420783 - DNA, 15 bp, Homo sapiens
cagccactgtcaccg

SEQ ID NO: 4420784 - DNA, 14 bp, Homo sapiens
cagccagactggca

SEQ ID NO: 4420785 - DNA, 15 bp, Homo sapiens
cagccagactggcac

SEQ ID NO: 4420786 - DNA, 18 bp, Homo sapiens
cagccagactggcacagt

SEQ ID NO: 4420787 - DNA, 20 bp, Homo sapiens
cagccagactggcacagttt

SEQ ID NO: 4420788 - DNA, 17 bp, Homo sapiens
cagccagaggagggcag

SEQ ID NO: 4420789 - DNA, 19 bp, Homo sapiens
cagccagaggagggcagag

SEQ ID NO: 4420790 - DNA, 22 bp, Homo sapiens
cagccagaggagggcagaggga

SEQ ID NO: 4420791 - DNA, 14 bp, Homo sapiens
cagccagcagaggg

SEQ ID NO: 4420792 - DNA, 14 bp, Homo sapiens
cagagaaccaggct

SEQ ID NO: 4420793 - DNA, 22 bp, Homo sapiens
cagagaacctgagttcccggga

SEQ ID NO: 4420794 - DNA, 15 bp, Homo sapiens
cagagaagccccttc

SEQ ID NO: 4420795 - DNA, 18 bp, Homo sapiens
cagagaagccccttcccc

SEQ ID NO: 4420796 - DNA, 13 bp, Homo sapiens
cagagaaggcagg

SEQ ID NO: 4420797 - DNA, 14 bp, Homo sapiens
cagagaaggcagga

SEQ ID NO: 4420798 - DNA, 16 bp, Homo sapiens
cagagacaagcagagt

SEQ ID NO: 4420799 - DNA, 14 bp, Homo sapiens
cagagacacctgca

SEQ ID NO: 4420800 - DNA, 22 bp, Homo sapiens
cagagacacctgcacctccccc

SEQ ID NO: 4420801 - DNA, 13 bp, Homo sapiens
cagagacactgag

SEQ ID NO: 4420802 - DNA, 20 bp, Homo sapiens
cagagacactgagccagtct

SEQ ID NO: 4420803 - DNA, 15 bp, Homo sapiens
cagagacagaggatg

SEQ ID NO: 4420804 - DNA, 14 bp, Homo sapiens
cagagacaggaaaa

SEQ ID NO: 4420805 - DNA, 15 bp, Homo sapiens
cagagacaggaaaat

SEQ ID NO: 4420806 - DNA, 23 bp, Homo sapiens
cagagacaggaaaatcctctggc

SEQ ID NO: 4420807 - DNA, 17 bp, Homo sapiens
cagagacattcatttag

SEQ ID NO: 4420808 - DNA, 14 bp, Homo sapiens
cagagaccacacca

SEQ ID NO: 4420809 - DNA, 14 bp, Homo sapiens
cagagacccctcaa

SEQ ID NO: 4420810 - DNA, 15 bp, Homo sapiens
cagagacctccaata

SEQ ID NO: 4420811 - DNA, 22 bp, Homo sapiens
cagagactcagatgaggacaga

SEQ ID NO: 4420812 - DNA, 21 bp, Homo sapiens
cagagactgtccctgaaacct

SEQ ID NO: 4420813 - DNA, 17 bp, Homo sapiens
cagagactttagggggt

SEQ ID NO: 4420814 - DNA, 16 bp, Homo sapiens
cagagagaccctgcaa

SEQ ID NO: 4420815 - DNA, 16 bp, Homo sapiens
cagagagacccttgtg

SEQ ID NO: 4420816 - DNA, 17 bp, Homo sapiens
cagagagacctcatcct

SEQ ID NO: 4420817 - DNA, 12 bp, Homo sapiens
cagagagagtgt

SEQ ID NO: 4420818 - DNA, 13 bp, Homo sapiens
cagagagccctgg

SEQ ID NO: 4420819 - DNA, 17 bp, Homo sapiens
cagagaggaccaacatc

SEQ ID NO: 4420820 - DNA, 16 bp, Homo sapiens
cagagaggatacattt

SEQ ID NO: 4420821 - DNA, 18 bp, Homo sapiens
cagagaggcactcagtga

SEQ ID NO: 4420822 - DNA, 20 bp, Homo sapiens
cagagaggtggatcctgtag

SEQ ID NO: 4420823 - DNA, 20 bp, Homo sapiens
cagagataaaccaataaatc

SEQ ID NO: 4420824 - DNA, 23 bp, Homo sapiens
cagagataaagcttaggtcaaag

SEQ ID NO: 4420825 - DNA, 15 bp, Homo sapiens
cagagataaatgttt

SEQ ID NO: 4420826 - DNA, 13 bp, Homo sapiens
cagagatgcctcc

SEQ ID NO: 4420827 - DNA, 19 bp, Homo sapiens
cagagatgcctccaccgct

SEQ ID NO: 4420828 - DNA, 16 bp, Homo sapiens
cagagattctgaacta

SEQ ID NO: 4420829 - DNA, 14 bp, Homo sapiens
cagagcaaacagaa

SEQ ID NO: 4420830 - DNA, 17 bp, Homo sapiens
cagagcaaccagaagga

SEQ ID NO: 4420831 - DNA, 21 bp, Homo sapiens
cagagcaagtcctcactcttc

SEQ ID NO: 4420832 - DNA, 16 bp, Homo sapiens
cagagcaggggctcca

SEQ ID NO: 4420833 - DNA, 14 bp, Homo sapiens
cagagcatctgccc

SEQ ID NO: 4420834 - DNA, 17 bp, Homo sapiens
cagagcatctgccccag

SEQ ID NO: 4420835 - DNA, 14 bp, Homo sapiens
cagagccacctgga

SEQ ID NO: 4420836 - DNA, 16 bp, Homo sapiens
cagagccactctatga

SEQ ID NO: 4420837 - DNA, 15 bp, Homo sapiens
cagagccagcctggc

SEQ ID NO: 4420838 - DNA, 15 bp, Homo sapiens
cagagccagggcagg

SEQ ID NO: 4420839 - DNA, 19 bp, Homo sapiens
cagagccatactgcgtcca

SEQ ID NO: 4420840 - DNA, 14 bp, Homo sapiens
cagagcccagccca

SEQ ID NO: 4420841 - DNA, 22 bp, Homo sapiens
cagagccccacagccccatctg

SEQ ID NO: 4420842 - DNA, 22 bp, Homo sapiens
cagagccgggaggaaaaggccc

SEQ ID NO: 4420843 - DNA, 20 bp, Homo sapiens
cagagccgtggtcctttggg

SEQ ID NO: 4420844 - DNA, 21 bp, Homo sapiens
cagagcctacagaagggcagt

SEQ ID NO: 4420845 - DNA, 12 bp, Homo sapiens
cagagcctctgg

SEQ ID NO: 4420846 - DNA, 15 bp, Homo sapiens
cagagcctctggccc

SEQ ID NO: 4420847 - DNA, 18 bp, Homo sapiens
cagagcctctggcccctc

SEQ ID NO: 4420848 - DNA, 23 bp, Homo sapiens
cagagcctgacgctcagccccag

SEQ ID NO: 4420849 - DNA, 13 bp, Homo sapiens
cagagcctggccc

SEQ ID NO: 4420850 - DNA, 11 bp, Homo sapiens
cagagccttca

SEQ ID NO: 4420851 - DNA, 15 bp, Homo sapiens
cagagccttcaagtg

SEQ ID NO: 4420852 - DNA, 18 bp, Homo sapiens
cagagccttcaagtgcca

SEQ ID NO: 4420853 - DNA, 19 bp, Homo sapiens
cagagccttcaagtgccaa

SEQ ID NO: 4420854 - DNA, 13 bp, Homo sapiens
cagagccttctca

SEQ ID NO: 4420855 - DNA, 15 bp, Homo sapiens
cagagccttctcaga

SEQ ID NO: 4420856 - DNA, 20 bp, Homo sapiens
cagagccttttacccctgca

SEQ ID NO: 4420857 - DNA, 18 bp, Homo sapiens
cagagcgagactccatct

SEQ ID NO: 4420858 - DNA, 20 bp, Homo sapiens
cagagcgaggaaaggatttt

SEQ ID NO: 4420859 - DNA, 16 bp, Homo sapiens
cagagcgccaggaagc

SEQ ID NO: 4420860 - DNA, 19 bp, Homo sapiens
cagagcgccaggaagccag

SEQ ID NO: 4420861 - DNA, 19 bp, Homo sapiens
cagagcgggtaaagtgcaa

SEQ ID NO: 4420862 - DNA, 18 bp, Homo sapiens
cagagcggtatctctggc

SEQ ID NO: 4420863 - DNA, 22 bp, Homo sapiens
cagagctcccccgtggtgcctg

SEQ ID NO: 4420864 - DNA, 15 bp, Homo sapiens
cagagctctcgagga

SEQ ID NO: 4420865 - DNA, 17 bp, Homo sapiens
cagagctctcgaggaaa

SEQ ID NO: 4420866 - DNA, 13 bp, Homo sapiens
cagagctgaccca

SEQ ID NO: 4420867 - DNA, 18 bp, Homo sapiens
cagagctggagcccccag

SEQ ID NO: 4420868 - DNA, 19 bp, Homo sapiens
cagagctgtttatggcctc

SEQ ID NO: 4420869 - DNA, 14 bp, Homo sapiens
cagagcttccctga

SEQ ID NO: 4420870 - DNA, 12 bp, Homo sapiens
cagagctttgtc

SEQ ID NO: 4420871 - DNA, 14 bp, Homo sapiens
cagagctttgtcac

SEQ ID NO: 4420872 - DNA, 15 bp, Homo sapiens
cagagctttgtcact

SEQ ID NO: 4420873 - DNA, 20 bp, Homo sapiens
cagagctttgtcacttgcca

SEQ ID NO: 4420874 - DNA, 16 bp, Homo sapiens
cagaggaaggggccag

SEQ ID NO: 4420875 - DNA, 12 bp, Homo sapiens
cagaggagaaga

SEQ ID NO: 4420876 - DNA, 22 bp, Homo sapiens
cagaggagatgccacttctcac

SEQ ID NO: 4420877 - DNA, 21 bp, Homo sapiens
cagaggagcagaccagcactt

SEQ ID NO: 4420878 - DNA, 23 bp, Homo sapiens
cagaggagcagaccagcacttca

SEQ ID NO: 4420879 - DNA, 19 bp, Homo sapiens
cagaggagccaccagttct

SEQ ID NO: 4420880 - DNA, 14 bp, Homo sapiens
cagaggagggcagc

SEQ ID NO: 4420881 - DNA, 22 bp, Homo sapiens
cagaggagggcagcagaagggg

SEQ ID NO: 4420882 - DNA, 13 bp, Homo sapiens
cagaggcaggctg

SEQ ID NO: 4420883 - DNA, 13 bp, Homo sapiens
cagaggccccacc

SEQ ID NO: 4420884 - DNA, 23 bp, Homo sapiens
cagaggccccacctgaagggtgg

SEQ ID NO: 4420885 - DNA, 19 bp, Homo sapiens
cagaggccctcgctgccag

SEQ ID NO: 4420886 - DNA, 13 bp, Homo sapiens
cagaggccctgcc

SEQ ID NO: 4420887 - DNA, 17 bp, Homo sapiens
cagaggccctgccccca

SEQ ID NO: 4420888 - DNA, 15 bp, Homo sapiens
cagaggccctggagg

SEQ ID NO: 4420889 - DNA, 21 bp, Homo sapiens
cagaggcctgctgccagtgca

SEQ ID NO: 4420890 - DNA, 21 bp, Homo sapiens
cagaggctcgaggggctcagg

SEQ ID NO: 4420891 - DNA, 23 bp, Homo sapiens
cagaggctgcacccctgggccag

SEQ ID NO: 4420892 - DNA, 14 bp, Homo sapiens
cagaggctgggagt

SEQ ID NO: 4420893 - DNA, 20 bp, Homo sapiens
cagaggcttcttcagatcag

SEQ ID NO: 4420894 - DNA, 15 bp, Homo sapiens
cagagggagaatcca

SEQ ID NO: 4420895 - DNA, 14 bp, Homo sapiens
cagagggcactctg

SEQ ID NO: 4420896 - DNA, 16 bp, Homo sapiens
cagagggcagaggctg

SEQ ID NO: 4420897 - DNA, 10 bp, Homo sapiens
cagagggctg

SEQ ID NO: 4420898 - DNA, 13 bp, Homo sapiens
cagagggctgatg

SEQ ID NO: 4420899 - DNA, 18 bp, Homo sapiens
cagagggctggaggccca

SEQ ID NO: 4420900 - DNA, 13 bp, Homo sapiens
cagcaactcccac

SEQ ID NO: 4420901 - DNA, 14 bp, Homo sapiens
cagcaactcccacg

SEQ ID NO: 4420902 - DNA, 16 bp, Homo sapiens
cagcaactgaaaatga

SEQ ID NO: 4420903 - DNA, 19 bp, Homo sapiens
cagcaagctgcccagccct

SEQ ID NO: 4420904 - DNA, 19 bp, Homo sapiens
cagcaagggtgatgggaaa

SEQ ID NO: 4420905 - DNA, 17 bp, Homo sapiens
cagcaatcacaaaggct

SEQ ID NO: 4420906 - DNA, 23 bp, Homo sapiens
cagcaattactcactaaagggct

SEQ ID NO: 4420907 - DNA, 14 bp, Homo sapiens
cagcaatttaaatg

SEQ ID NO: 4420908 - DNA, 15 bp, Homo sapiens
cagcaatttaaatgt

SEQ ID NO: 4420909 - DNA, 20 bp, Homo sapiens
cagcacacacttacagagca

SEQ ID NO: 4420910 - DNA, 15 bp, Homo sapiens
cagcacacaggcagc

SEQ ID NO: 4420911 - DNA, 17 bp, Homo sapiens
cagcacagcttagattt

SEQ ID NO: 4420912 - DNA, 12 bp, Homo sapiens
cagcaccctccc

SEQ ID NO: 4420913 - DNA, 14 bp, Homo sapiens
cagcaccctccccc

SEQ ID NO: 4420914 - DNA, 16 bp, Homo sapiens
cagcaccctctcctgg

SEQ ID NO: 4420915 - DNA, 17 bp, Homo sapiens
cagcaccctctcctggg

SEQ ID NO: 4420916 - DNA, 23 bp, Homo sapiens
cagcaccctctcctgggggtggc

SEQ ID NO: 4420917 - DNA, 21 bp, Homo sapiens
cagcaccttctttctggactg

SEQ ID NO: 4420918 - DNA, 14 bp, Homo sapiens
cagaattaagcaga

SEQ ID NO: 4420919 - DNA, 15 bp, Homo sapiens
cagaattaagcagaa

SEQ ID NO: 4420920 - DNA, 23 bp, Homo sapiens
cagaattaagcagaacactgcag

SEQ ID NO: 4420921 - DNA, 21 bp, Homo sapiens
cagaattcggtgtgctgccaa

SEQ ID NO: 4420922 - DNA, 19 bp, Homo sapiens
cagaatttaccatcatctc

SEQ ID NO: 4420923 - DNA, 22 bp, Homo sapiens
cagaatttaccatcatctctga

SEQ ID NO: 4420924 - DNA, 18 bp, Homo sapiens
cagaatttagtgtatcca

SEQ ID NO: 4420925 - DNA, 13 bp, Homo sapiens
cagacaaaaacaa

SEQ ID NO: 4420926 - DNA, 19 bp, Homo sapiens
cagacaaaaacagcctcac

SEQ ID NO: 4420927 - DNA, 20 bp, Homo sapiens
cagacaaaaacagcctcaca

SEQ ID NO: 4420928 - DNA, 21 bp, Homo sapiens
cagacaaaaacagcctcacag

SEQ ID NO: 4420929 - DNA, 22 bp, Homo sapiens
cagacaaaaacagcctcacaga

SEQ ID NO: 4420930 - DNA, 15 bp, Homo sapiens
cagacaaaatgaaag

SEQ ID NO: 4420931 - DNA, 15 bp, Homo sapiens
cagacaaagatgtct

SEQ ID NO: 4420932 - DNA, 16 bp, Homo sapiens
cagacaacaccttcct

SEQ ID NO: 4420933 - DNA, 20 bp, Homo sapiens
cagacaacaccttcctcctg

SEQ ID NO: 4420934 - DNA, 23 bp, Homo sapiens
cagacaataaaccctcagagcct

SEQ ID NO: 4420935 - DNA, 15 bp, Homo sapiens
cagacaattccattc

SEQ ID NO: 4420936 - DNA, 20 bp, Homo sapiens
cagacacaacccaataggag

SEQ ID NO: 4420937 - DNA, 16 bp, Homo sapiens
cagacaccatgtgcaa

SEQ ID NO: 4420938 - DNA, 15 bp, Homo sapiens
cagacacctaacccc

SEQ ID NO: 4420939 - DNA, 14 bp, Homo sapiens
cagacacctggact

SEQ ID NO: 4420940 - DNA, 16 bp, Homo sapiens
cagacacgttctgatt

SEQ ID NO: 4420941 - DNA, 17 bp, Homo sapiens
cagacactaaatgcaga

SEQ ID NO: 4420942 - DNA, 21 bp, Homo sapiens
cagacactgaccatccactct

SEQ ID NO: 4420943 - DNA, 15 bp, Homo sapiens
cagacagccctggca

SEQ ID NO: 4420944 - DNA, 12 bp, Homo sapiens
cagacagcctgt

SEQ ID NO: 4420945 - DNA, 13 bp, Homo sapiens
cagacagcctgta

SEQ ID NO: 4420946 - DNA, 15 bp, Homo sapiens
cagacaggccctccc

SEQ ID NO: 4420947 - DNA, 18 bp, Homo sapiens
cagacaggccctccctgt

SEQ ID NO: 4420948 - DNA, 18 bp, Homo sapiens
cagacagtcgctcagtct

SEQ ID NO: 4420949 - DNA, 18 bp, Homo sapiens
cagacagtggatgagaca

SEQ ID NO: 4420950 - DNA, 15 bp, Homo sapiens
cagacatatttaact

SEQ ID NO: 4420951 - DNA, 17 bp, Homo sapiens
cagacatatttaactgg

SEQ ID NO: 4420952 - DNA, 17 bp, Homo sapiens
cagacatccaaactaaa

SEQ ID NO: 4420953 - DNA, 14 bp, Homo sapiens
cagacatggagatg

SEQ ID NO: 4420954 - DNA, 19 bp, Homo sapiens
cagacattcacctgtatat

SEQ ID NO: 4420955 - DNA, 14 bp, Homo sapiens
cagacattgttaca

SEQ ID NO: 4420956 - DNA, 13 bp, Homo sapiens
cagaccacttgcc

SEQ ID NO: 4420957 - DNA, 19 bp, Homo sapiens
cagaccacttgccacgctg

SEQ ID NO: 4420958 - DNA, 20 bp, Homo sapiens
cagaccatattacctggatt

SEQ ID NO: 4420959 - DNA, 22 bp, Homo sapiens
cagaccattggggctcccagcc

SEQ ID NO: 4420960 - DNA, 23 bp, Homo sapiens
cagaccattggggctcccagcca

SEQ ID NO: 4420961 - DNA, 17 bp, Homo sapiens
cagacccacccccagcc

SEQ ID NO: 4420962 - DNA, 19 bp, Homo sapiens
cagacccacgggctcatgc

SEQ ID NO: 4420963 - DNA, 17 bp, Homo sapiens
cagacccagaggtccag

SEQ ID NO: 4420964 - DNA, 18 bp, Homo sapiens
cagacccagaggtccagg

SEQ ID NO: 4420965 - DNA, 21 bp, Homo sapiens
cagacccagaggtccaggtcc

SEQ ID NO: 4420966 - DNA, 23 bp, Homo sapiens
cagacccagaggtccaggtccca

SEQ ID NO: 4420967 - DNA, 16 bp, Homo sapiens
cagacccaggagtcca

SEQ ID NO: 4420968 - DNA, 17 bp, Homo sapiens
cagacccaggagtccag

SEQ ID NO: 4420969 - DNA, 20 bp, Homo sapiens
cagacccaggggtccaggcc

SEQ ID NO: 4420970 - DNA, 21 bp, Homo sapiens
cagacccaggggtccaggccc

SEQ ID NO: 4420971 - DNA, 22 bp, Homo sapiens
cagacccaggggtccaggcccc

SEQ ID NO: 4420972 - DNA, 16 bp, Homo sapiens
cagaccccagcggctg

SEQ ID NO: 4420973 - DNA, 14 bp, Homo sapiens
cagaccccagctgg

SEQ ID NO: 4420974 - DNA, 15 bp, Homo sapiens
cagaccccagctggg

SEQ ID NO: 4420975 - DNA, 13 bp, Homo sapiens
cagacccccactc

SEQ ID NO: 4420976 - DNA, 14 bp, Homo sapiens
cagacccccactct

SEQ ID NO: 4420977 - DNA, 14 bp, Homo sapiens
cagaccccccagcc

SEQ ID NO: 4420978 - DNA, 15 bp, Homo sapiens
cagaccccccagccc

SEQ ID NO: 4420979 - DNA, 18 bp, Homo sapiens
cagaccccccagcccctc

SEQ ID NO: 4420980 - DNA, 22 bp, Homo sapiens
cagaccccccagcccctcctcc

SEQ ID NO: 4420981 - DNA, 23 bp, Homo sapiens
cagaccccccagcccctcctccc

SEQ ID NO: 4420982 - DNA, 13 bp, Homo sapiens
cagacccctcagc

SEQ ID NO: 4420983 - DNA, 14 bp, Homo sapiens
cagacccctcagcc

SEQ ID NO: 4420984 - DNA, 15 bp, Homo sapiens
cagacccctcagccc

SEQ ID NO: 4420985 - DNA, 17 bp, Homo sapiens
cagacccctcagcccca

SEQ ID NO: 4420986 - DNA, 19 bp, Homo sapiens
cagacccctgcctggactt

SEQ ID NO: 4420987 - DNA, 22 bp, Homo sapiens
cagacccctttgagagacgcca

SEQ ID NO: 4420988 - DNA, 17 bp, Homo sapiens
cagaccctgcttaggat

SEQ ID NO: 4420989 - DNA, 17 bp, Homo sapiens
cagaccgatccttccca

SEQ ID NO: 4420990 - DNA, 21 bp, Homo sapiens
cagacctaaagcaagcctgaa

SEQ ID NO: 4420991 - DNA, 17 bp, Homo sapiens
cagacctagcaggctgt

SEQ ID NO: 4420992 - DNA, 21 bp, Homo sapiens
cagacctagcaggctgttcca

SEQ ID NO: 4420993 - DNA, 17 bp, Homo sapiens
cagacctcgagtttctg

SEQ ID NO: 4420994 - DNA, 15 bp, Homo sapiens
cagacctgcattgaa

SEQ ID NO: 4420995 - DNA, 19 bp, Homo sapiens
cagacgagacaacagcaca

SEQ ID NO: 4420996 - DNA, 23 bp, Homo sapiens
cagacgagacaacagcacacagg

SEQ ID NO: 4420997 - DNA, 23 bp, Homo sapiens
cagacgccggggacagaggcctg

SEQ ID NO: 4420998 - DNA, 16 bp, Homo sapiens
cagacggtctgtgtgc

SEQ ID NO: 4420999 - DNA, 19 bp, Homo sapiens
cagacggtctgtgtgctgt

SEQ ID NO: 4421000 - DNA, 13 bp, Homo sapiens
cagacggtgacgc

SEQ ID NO: 4421001 - DNA, 16 bp, Homo sapiens
cagacgttgcctgaga

SEQ ID NO: 4421002 - DNA, 22 bp, Homo sapiens
cagactaaaggatccagagagc

SEQ ID NO: 4421003 - DNA, 14 bp, Homo sapiens
cagactagatgtag

SEQ ID NO: 4421004 - DNA, 15 bp, Homo sapiens
cagactagatgtagt

SEQ ID NO: 4421005 - DNA, 21 bp, Homo sapiens
cagactagatgtagtattttt

SEQ ID NO: 4421006 - DNA, 15 bp, Homo sapiens
cagactatttttaga

SEQ ID NO: 4421007 - DNA, 14 bp, Homo sapiens
cagactcagaggtc

SEQ ID NO: 4421008 - DNA, 20 bp, Homo sapiens
cagactcagaggtccaggcc

SEQ ID NO: 4421009 - DNA, 22 bp, Homo sapiens
cagactcagaggtccaggcccc

SEQ ID NO: 4421010 - DNA, 19 bp, Homo sapiens
cagactcaggttccagaac

SEQ ID NO: 4421011 - DNA, 19 bp, Homo sapiens
cagactccatctcttctgc

SEQ ID NO: 4421012 - DNA, 12 bp, Homo sapiens
cagactcctcca

SEQ ID NO: 4421013 - DNA, 23 bp, Homo sapiens
cagactccttcaacaattctaaa

SEQ ID NO: 4421014 - DNA, 21 bp, Homo sapiens
cagactctcagcccagaagaa

SEQ ID NO: 4421015 - DNA, 20 bp, Homo sapiens
cagactgaaaggtgtgaaca

SEQ ID NO: 4421016 - DNA, 17 bp, Homo sapiens
cagactgatgagcacat

SEQ ID NO: 4421017 - DNA, 18 bp, Homo sapiens
cagactgatgagcacatc

SEQ ID NO: 4421018 - DNA, 20 bp, Homo sapiens
cagactgcctgtctgcttgc

SEQ ID NO: 4421019 - DNA, 23 bp, Homo sapiens
cagactggaaaagtgatgtattt

SEQ ID NO: 4421020 - DNA, 17 bp, Homo sapiens
cagactggcacagtttt

SEQ ID NO: 4421021 - DNA, 18 bp, Homo sapiens
cagactggcacagttttc

SEQ ID NO: 4421022 - DNA, 16 bp, Homo sapiens
cagactgggcactggg

SEQ ID NO: 4421023 - DNA, 17 bp, Homo sapiens
cagactgtgaacttgac

SEQ ID NO: 4421024 - DNA, 21 bp, Homo sapiens
cagactgtgaacttgactggg

SEQ ID NO: 4421025 - DNA, 19 bp, Homo sapiens
cagacttaaagttgtcctc

SEQ ID NO: 4421026 - DNA, 14 bp, Homo sapiens
cagacttcacactg

SEQ ID NO: 4421027 - DNA, 15 bp, Homo sapiens
cagacttcacactgc

SEQ ID NO: 4421028 - DNA, 21 bp, Homo sapiens
caccactaggaatcccagagg

SEQ ID NO: 4421029 - DNA, 15 bp, Homo sapiens
caccactgcactcca

SEQ ID NO: 4421030 - DNA, 18 bp, Homo sapiens
caccactgcactccagcc

SEQ ID NO: 4421031 - DNA, 20 bp, Homo sapiens
caccactgcactccagcctg

SEQ ID NO: 4421032 - DNA, 18 bp, Homo sapiens
caccactgttctgttcat

SEQ ID NO: 4421033 - DNA, 20 bp, Homo sapiens
caccacttttggattttatg

SEQ ID NO: 4421034 - DNA, 19 bp, Homo sapiens
caccagaacgcaccccact

SEQ ID NO: 4421035 - DNA, 19 bp, Homo sapiens
caccagaaggatgcctctg

SEQ ID NO: 4421036 - DNA, 13 bp, Homo sapiens
caccagagccggg

SEQ ID NO: 4421037 - DNA, 23 bp, Homo sapiens
caccagatgcaacctcactatgg

SEQ ID NO: 4421038 - DNA, 14 bp, Homo sapiens
caccagccaggctc

SEQ ID NO: 4421039 - DNA, 15 bp, Homo sapiens
caccagccaggctct

SEQ ID NO: 4421040 - DNA, 20 bp, Homo sapiens
caccagccaggctctgtgct

SEQ ID NO: 4421041 - DNA, 13 bp, Homo sapiens
caccagccatcct

SEQ ID NO: 4421042 - DNA, 14 bp, Homo sapiens
caccagccccccgc

SEQ ID NO: 4421043 - DNA, 16 bp, Homo sapiens
caccagccccccgcgc

SEQ ID NO: 4421044 - DNA, 21 bp, Homo sapiens
caccagcccccgccccagagt

SEQ ID NO: 4421045 - DNA, 14 bp, Homo sapiens
caccagccctgcag

SEQ ID NO: 4421046 - DNA, 16 bp, Homo sapiens
caccagccctgcagcc

SEQ ID NO: 4421047 - DNA, 12 bp, Homo sapiens
caccagctgcaa

SEQ ID NO: 4421048 - DNA, 13 bp, Homo sapiens
caccagctgcaaa

SEQ ID NO: 4421049 - DNA, 14 bp, Homo sapiens
caccagctgcaaag

SEQ ID NO: 4421050 - DNA, 15 bp, Homo sapiens
caccagctgcaaagt

SEQ ID NO: 4421051 - DNA, 17 bp, Homo sapiens
caccagctgcaaagtgt

SEQ ID NO: 4421052 - DNA, 18 bp, Homo sapiens
caccagctgcaaagtgtt

SEQ ID NO: 4421053 - DNA, 14 bp, Homo sapiens
caccaggactgaaa

SEQ ID NO: 4421054 - DNA, 19 bp, Homo sapiens
caccaggagaaccactaca

SEQ ID NO: 4421055 - DNA, 19 bp, Homo sapiens
caccaggcacgaacccacc

SEQ ID NO: 4421056 - DNA, 20 bp, Homo sapiens
caccaggcacgaacccacct

SEQ ID NO: 4421057 - DNA, 18 bp, Homo sapiens
caccaggccgtgccttgt

SEQ ID NO: 4421058 - DNA, 17 bp, Homo sapiens
caccaggcgctaattca

SEQ ID NO: 4421059 - DNA, 15 bp, Homo sapiens
caccagggatcacag

SEQ ID NO: 4421060 - DNA, 16 bp, Homo sapiens
caccagggctccagga

SEQ ID NO: 4421061 - DNA, 19 bp, Homo sapiens
caccagggttgaccccaga

SEQ ID NO: 4421062 - DNA, 23 bp, Homo sapiens
caccagggtttagtttgcattta

SEQ ID NO: 4421063 - DNA, 16 bp, Homo sapiens
caccagtaattatgag

SEQ ID NO: 4421064 - DNA, 17 bp, Homo sapiens
caccagtcccatgctgg

SEQ ID NO: 4421065 - DNA, 19 bp, Homo sapiens
caccataagctactgccat

SEQ ID NO: 4421066 - DNA, 16 bp, Homo sapiens
caccataatgaacaat

SEQ ID NO: 4421067 - DNA, 14 bp, Homo sapiens
caccatggaccagc

SEQ ID NO: 4421068 - DNA, 23 bp, Homo sapiens
caccatggagacgtggtgggact

SEQ ID NO: 4421069 - DNA, 23 bp, Homo sapiens
caccatggtatcatatattaaaa

SEQ ID NO: 4421070 - DNA, 17 bp, Homo sapiens
caccatgttagccagga

SEQ ID NO: 4421071 - DNA, 17 bp, Homo sapiens
caccatgttggcctctt

SEQ ID NO: 4421072 - DNA, 20 bp, Homo sapiens
caccatgttggcctcttcag

SEQ ID NO: 4421073 - DNA, 19 bp, Homo sapiens
caccatgtttgagctcaga

SEQ ID NO: 4421074 - DNA, 22 bp, Homo sapiens
caccatgtttgagctcagaccc

SEQ ID NO: 4421075 - DNA, 13 bp, Homo sapiens
caccattctacct

SEQ ID NO: 4421076 - DNA, 15 bp, Homo sapiens
caccattgaaggctt

SEQ ID NO: 4421077 - DNA, 16 bp, Homo sapiens
caccattgaaggctta

SEQ ID NO: 4421078 - DNA, 13 bp, Homo sapiens
caccattgttcat

SEQ ID NO: 4421079 - DNA, 12 bp, Homo sapiens
caccatttaatt

SEQ ID NO: 4421080 - DNA, 17 bp, Homo sapiens
caccatttggcaatgcc

SEQ ID NO: 4421081 - DNA, 14 bp, Homo sapiens
cacccaaaagtcaa

SEQ ID NO: 4421082 - DNA, 14 bp, Homo sapiens
cacccaactccaca

SEQ ID NO: 4421083 - DNA, 14 bp, Homo sapiens
cacccaagcctgct

SEQ ID NO: 4421084 - DNA, 17 bp, Homo sapiens
cacccaagcctgctggc

SEQ ID NO: 4421085 - DNA, 20 bp, Homo sapiens
cacccaaggattctgttctg

SEQ ID NO: 4421086 - DNA, 13 bp, Homo sapiens
cacccaccaggcc

SEQ ID NO: 4421087 - DNA, 14 bp, Homo sapiens
cacccaccaggcca

SEQ ID NO: 4421088 - DNA, 13 bp, Homo sapiens
cacccaccgtgga

SEQ ID NO: 4421089 - DNA, 22 bp, Homo sapiens
cacccacctttgccacaaagct

SEQ ID NO: 4421090 - DNA, 21 bp, Homo sapiens
cacccagaagaagatggctgt

SEQ ID NO: 4421091 - DNA, 15 bp, Homo sapiens
cacccagagcacccc

SEQ ID NO: 4421092 - DNA, 17 bp, Homo sapiens
cacccagagcaccccct

SEQ ID NO: 4421093 - DNA, 21 bp, Homo sapiens
cacccagagcaccccctgctc

SEQ ID NO: 4421094 - DNA, 11 bp, Homo sapiens
cacccagaggt

SEQ ID NO: 4421095 - DNA, 10 bp, Homo sapiens
cacccagccc

SEQ ID NO: 4421096 - DNA, 13 bp, Homo sapiens
cacccagcccatt

SEQ ID NO: 4421097 - DNA, 23 bp, Homo sapiens
cacccagcccattctctctcctg

SEQ ID NO: 4421098 - DNA, 14 bp, Homo sapiens
cacccagccctggt

SEQ ID NO: 4421099 - DNA, 22 bp, Homo sapiens
cacccagccctggtctcagcag

SEQ ID NO: 4421100 - DNA, 15 bp, Homo sapiens
cacccagcggccccc

SEQ ID NO: 4421101 - DNA, 13 bp, Homo sapiens
cacccaggcccga

SEQ ID NO: 4421102 - DNA, 19 bp, Homo sapiens
cacccagtcctgcccgcca

SEQ ID NO: 4421103 - DNA, 14 bp, Homo sapiens
cacccagtgggaag

SEQ ID NO: 4421104 - DNA, 19 bp, Homo sapiens
cacccatagtgcttcacaa

SEQ ID NO: 4421105 - DNA, 23 bp, Homo sapiens
cacccatagtgcttcacaaaatg

SEQ ID NO: 4421106 - DNA, 14 bp, Homo sapiens
cacccatgccagag

SEQ ID NO: 4421107 - DNA, 16 bp, Homo sapiens
cacccatggcctcagc

SEQ ID NO: 4421108 - DNA, 21 bp, Homo sapiens
cacccatggcctcagccctgc

SEQ ID NO: 4421109 - DNA, 19 bp, Homo sapiens
cacccatgggctctgacag

SEQ ID NO: 4421110 - DNA, 19 bp, Homo sapiens
cacccatgtaaccactgca

SEQ ID NO: 4421111 - DNA, 11 bp, Homo sapiens
caccccacact

SEQ ID NO: 4421112 - DNA, 15 bp, Homo sapiens
caccccacagctggg

SEQ ID NO: 4421113 - DNA, 16 bp, Homo sapiens
caccccaccccacccc

SEQ ID NO: 4421114 - DNA, 13 bp, Homo sapiens
caccccaccccct

SEQ ID NO: 4421115 - DNA, 16 bp, Homo sapiens
caccccagcattccag

SEQ ID NO: 4421116 - DNA, 23 bp, Homo sapiens
caccccagcattccagctctgcc

SEQ ID NO: 4421117 - DNA, 18 bp, Homo sapiens
caccccaggacgccactc

SEQ ID NO: 4421118 - DNA, 11 bp, Homo sapiens
caccccagggt

SEQ ID NO: 4421119 - DNA, 12 bp, Homo sapiens
caccccatccag

SEQ ID NO: 4421120 - DNA, 15 bp, Homo sapiens
caccccatgccaaag

SEQ ID NO: 4421121 - DNA, 20 bp, Homo sapiens
cacccccaacttcaccaccc

SEQ ID NO: 4421122 - DNA, 21 bp, Homo sapiens
cacccccagccttgcccagct

SEQ ID NO: 4421123 - DNA, 18 bp, Homo sapiens
cacccccatgctgccttc

SEQ ID NO: 4421124 - DNA, 18 bp, Homo sapiens
caccccccacactcactc

SEQ ID NO: 4421125 - DNA, 16 bp, Homo sapiens
cacccccctctctttc

SEQ ID NO: 4421126 - DNA, 15 bp, Homo sapiens
caccccctcccaccc

SEQ ID NO: 4421127 - DNA, 15 bp, Homo sapiens
caccccctccccagg

SEQ ID NO: 4421128 - DNA, 13 bp, Homo sapiens
caccccctgccct

SEQ ID NO: 4421129 - DNA, 16 bp, Homo sapiens
caccccctgccctgca

SEQ ID NO: 4421130 - DNA, 22 bp, Homo sapiens
cacccccttctctgctccacca

SEQ ID NO: 4421131 - DNA, 19 bp, Homo sapiens
cacttctgggtggggcagt

SEQ ID NO: 4421132 - DNA, 21 bp, Homo sapiens
cacttctgtgagacccccaca

SEQ ID NO: 4421133 - DNA, 17 bp, Homo sapiens
cacttctttgcagagcc

SEQ ID NO: 4421134 - DNA, 23 bp, Homo sapiens
cacttgaacccgggaggcagagg

SEQ ID NO: 4421135 - DNA, 22 bp, Homo sapiens
cacttgagaaccagtctcctca

SEQ ID NO: 4421136 - DNA, 19 bp, Homo sapiens
cacttgagctcaggaggtc

SEQ ID NO: 4421137 - DNA, 16 bp, Homo sapiens
cacttgatatttatta

SEQ ID NO: 4421138 - DNA, 14 bp, Homo sapiens
cacttgccacatgg

SEQ ID NO: 4421139 - DNA, 17 bp, Homo sapiens
cacttgctcccaaccca

SEQ ID NO: 4421140 - DNA, 13 bp, Homo sapiens
cacttgcttgctg

SEQ ID NO: 4421141 - DNA, 17 bp, Homo sapiens
cacttggcatacaaaat

SEQ ID NO: 4421142 - DNA, 12 bp, Homo sapiens
cacttgtaaggg

SEQ ID NO: 4421143 - DNA, 16 bp, Homo sapiens
cacttgttccagctct

SEQ ID NO: 4421144 - DNA, 19 bp, Homo sapiens
cactttaaaaacaggccag

SEQ ID NO: 4421145 - DNA, 21 bp, Homo sapiens
cactttactttcaagtaatat

SEQ ID NO: 4421146 - DNA, 14 bp, Homo sapiens
cactttcattgcca

SEQ ID NO: 4421147 - DNA, 20 bp, Homo sapiens
cactttcattgccagtgtct

SEQ ID NO: 4421148 - DNA, 21 bp, Homo sapiens
cactttcattgccagtgtctt

SEQ ID NO: 4421149 - DNA, 22 bp, Homo sapiens
cactttcattgccagtgtcttt

SEQ ID NO: 4421150 - DNA, 12 bp, Homo sapiens
cactttcatttt

SEQ ID NO: 4421151 - DNA, 14 bp, Homo sapiens
cactttcatttttg

SEQ ID NO: 4421152 - DNA, 13 bp, Homo sapiens
cactttgatgtca

SEQ ID NO: 4421153 - DNA, 20 bp, Homo sapiens
cactttgatgtcatgtgttc

SEQ ID NO: 4421154 - DNA, 21 bp, Homo sapiens
cactttgccaaggctctcccc

SEQ ID NO: 4421155 - DNA, 13 bp, Homo sapiens
cactttgcctcct

SEQ ID NO: 4421156 - DNA, 17 bp, Homo sapiens
cactttgtaaataaaaa

SEQ ID NO: 4421157 - DNA, 15 bp, Homo sapiens
cactttgttgcaaga

SEQ ID NO: 4421158 - DNA, 18 bp, Homo sapiens
cactttgtttagaaaaaa

SEQ ID NO: 4421159 - DNA, 19 bp, Homo sapiens
cactttgtttagaaaaaaa

SEQ ID NO: 4421160 - DNA, 14 bp, Homo sapiens
cacttttattttca

SEQ ID NO: 4421161 - DNA, 15 bp, Homo sapiens
cacttttcatatcat

SEQ ID NO: 4421162 - DNA, 17 bp, Homo sapiens
cacttttcatatcattt

SEQ ID NO: 4421163 - DNA, 17 bp, Homo sapiens
cactttttacagcagca

SEQ ID NO: 4421164 - DNA, 19 bp, Homo sapiens
cactttttccttactgtgc

SEQ ID NO: 4421165 - DNA, 14 bp, Homo sapiens
cacttttttataaa

SEQ ID NO: 4421166 - DNA, 17 bp, Homo sapiens
cacttttttctgccttg

SEQ ID NO: 4421167 - DNA, 18 bp, Homo sapiens
cactttttttctttttct

SEQ ID NO: 4421168 - DNA, 22 bp, Homo sapiens
cagaaaacataatatagcttaa

SEQ ID NO: 4421169 - DNA, 16 bp, Homo sapiens
cagaaaacatgtttcc

SEQ ID NO: 4421170 - DNA, 16 bp, Homo sapiens
cagaaaatatttaata

SEQ ID NO: 4421171 - DNA, 20 bp, Homo sapiens
cagaaaatatttaatatcaa

SEQ ID NO: 4421172 - DNA, 13 bp, Homo sapiens
cagaaaattctgt

SEQ ID NO: 4421173 - DNA, 19 bp, Homo sapiens
cagaaacagggacaaagaa

SEQ ID NO: 4421174 - DNA, 13 bp, Homo sapiens
cagaaagagggac

SEQ ID NO: 4421175 - DNA, 22 bp, Homo sapiens
cagaaagcatccctcacccatc

SEQ ID NO: 4421176 - DNA, 13 bp, Homo sapiens
cagaaagccaaca

SEQ ID NO: 4421177 - DNA, 16 bp, Homo sapiens
cagaaagccaggagca

SEQ ID NO: 4421178 - DNA, 18 bp, Homo sapiens
cagaaagccaggagcagc

SEQ ID NO: 4421179 - DNA, 23 bp, Homo sapiens
cagaaagccaggagcagccctgg

SEQ ID NO: 4421180 - DNA, 17 bp, Homo sapiens
cagaaagcctcctgccc

SEQ ID NO: 4421181 - DNA, 13 bp, Homo sapiens
cagaaagcttcat

SEQ ID NO: 4421182 - DNA, 16 bp, Homo sapiens
cagaaaggaaaaacaa

SEQ ID NO: 4421183 - DNA, 19 bp, Homo sapiens
cagaaaggaaaaacaaact

SEQ ID NO: 4421184 - DNA, 20 bp, Homo sapiens
cagaaaggcaggtttcattt

SEQ ID NO: 4421185 - DNA, 18 bp, Homo sapiens
cagaaagtaagcatttcc

SEQ ID NO: 4421186 - DNA, 21 bp, Homo sapiens
cagaaatacagtcttccacaa

SEQ ID NO: 4421187 - DNA, 18 bp, Homo sapiens
cagaaatcggttgctgtt

SEQ ID NO: 4421188 - DNA, 16 bp, Homo sapiens
cagaaattcaatttgg

SEQ ID NO: 4421189 - DNA, 20 bp, Homo sapiens
cagaaattcaatttggattt

SEQ ID NO: 4421190 - DNA, 18 bp, Homo sapiens
cagaaattgtatattgta

SEQ ID NO: 4421191 - DNA, 21 bp, Homo sapiens
cagaaattgtatattgtaatt

SEQ ID NO: 4421192 - DNA, 16 bp, Homo sapiens
cagaacaacccaccat

SEQ ID NO: 4421193 - DNA, 18 bp, Homo sapiens
cagaacacgataaaccat

SEQ ID NO: 4421194 - DNA, 12 bp, Homo sapiens
cagaacactctt

SEQ ID NO: 4421195 - DNA, 13 bp, Homo sapiens
cagaacactgcag

SEQ ID NO: 4421196 - DNA, 11 bp, Homo sapiens
cagaacagagg

SEQ ID NO: 4421197 - DNA, 13 bp, Homo sapiens
cagaacagaggca

SEQ ID NO: 4421198 - DNA, 11 bp, Homo sapiens
cagaacagtga

SEQ ID NO: 4421199 - DNA, 12 bp, Homo sapiens
cagaacagtgat

SEQ ID NO: 4421200 - DNA, 23 bp, Homo sapiens
cagaacagtgattaccagggact

SEQ ID NO: 4421201 - DNA, 21 bp, Homo sapiens
cagaacatagacagaagaaac

SEQ ID NO: 4421202 - DNA, 16 bp, Homo sapiens
cagaaccatttcaccc

SEQ ID NO: 4421203 - DNA, 13 bp, Homo sapiens
cagaacccacagt

SEQ ID NO: 4421204 - DNA, 22 bp, Homo sapiens
cagaacctgagctattttcctc

SEQ ID NO: 4421205 - DNA, 12 bp, Homo sapiens
cagaacctggag

SEQ ID NO: 4421206 - DNA, 15 bp, Homo sapiens
cagaacctttgtcaa

SEQ ID NO: 4421207 - DNA, 16 bp, Homo sapiens
cagaactaaatttttc

SEQ ID NO: 4421208 - DNA, 15 bp, Homo sapiens
cagaactagaatttg

SEQ ID NO: 4421209 - DNA, 13 bp, Homo sapiens
cagaactgccctt

SEQ ID NO: 4421210 - DNA, 17 bp, Homo sapiens
cagaagaaaggccaagg

SEQ ID NO: 4421211 - DNA, 17 bp, Homo sapiens
cagaagaattgaaccca

SEQ ID NO: 4421212 - DNA, 22 bp, Homo sapiens
cagaagaggttgggcttccatg

SEQ ID NO: 4421213 - DNA, 19 bp, Homo sapiens
cagaagatcccctcaggac

SEQ ID NO: 4421214 - DNA, 20 bp, Homo sapiens
cagaagcaacccaaatgttc

SEQ ID NO: 4421215 - DNA, 21 bp, Homo sapiens
cagaagccccacagcctggca

SEQ ID NO: 4421216 - DNA, 23 bp, Homo sapiens
cagaagccctgatgtgtcctcag

SEQ ID NO: 4421217 - DNA, 22 bp, Homo sapiens
cagaagcctccaagcctgcctc

SEQ ID NO: 4421218 - DNA, 23 bp, Homo sapiens
cagaagcctgatctttgggcatc

SEQ ID NO: 4421219 - DNA, 21 bp, Homo sapiens
cagaagccttggaaccagccc

SEQ ID NO: 4421220 - DNA, 17 bp, Homo sapiens
cagaagctatttcattt

SEQ ID NO: 4421221 - DNA, 15 bp, Homo sapiens
cagaagctgtgagtt

SEQ ID NO: 4421222 - DNA, 13 bp, Homo sapiens
cagaaggaaggat

SEQ ID NO: 4421223 - DNA, 24 bp, Homo sapiens
cagaaggaaggatgccacttggga

SEQ ID NO: 4421224 - DNA, 14 bp, Homo sapiens
cagaaggagaagga

SEQ ID NO: 4421225 - DNA, 23 bp, Homo sapiens
cagaaggagaaggaaaaagaaag

SEQ ID NO: 4421226 - DNA, 14 bp, Homo sapiens
cagaaggagagtga

SEQ ID NO: 4421227 - DNA, 23 bp, Homo sapiens
cagaaggcaaagtttacagatgt

SEQ ID NO: 4421228 - DNA, 12 bp, Homo sapiens
cagaaggcccca

SEQ ID NO: 4421229 - DNA, 15 bp, Homo sapiens
cagaagggaattgct

SEQ ID NO: 4421230 - DNA, 17 bp, Homo sapiens
cagaagggggagaccaa

SEQ ID NO: 4421231 - DNA, 15 bp, Homo sapiens
cagaagtaagcctca

SEQ ID NO: 4421232 - DNA, 16 bp, Homo sapiens
cagaagttgtgctaaa

SEQ ID NO: 4421233 - DNA, 13 bp, Homo sapiens
cagaataaagttg

SEQ ID NO: 4421234 - DNA, 15 bp, Homo sapiens
cagaataaagttgta

SEQ ID NO: 4421235 - DNA, 18 bp, Homo sapiens
cagaataaagttgtattt

SEQ ID NO: 4421236 - DNA, 18 bp, Homo sapiens
cagaataagttattgcag

SEQ ID NO: 4421237 - DNA, 19 bp, Homo sapiens
cagaataagttattgcagt

SEQ ID NO: 4421238 - DNA, 17 bp, Homo sapiens
cagaataatcctgtttt

SEQ ID NO: 4421239 - DNA, 13 bp, Homo sapiens
cagaatagtttac

SEQ ID NO: 4421240 - DNA, 18 bp, Homo sapiens
cagaatagtttacacact

SEQ ID NO: 4421241 - DNA, 20 bp, Homo sapiens
cagaatatgttgctttgaaa

SEQ ID NO: 4421242 - DNA, 13 bp, Homo sapiens
cagaatattttta

SEQ ID NO: 4421243 - DNA, 18 bp, Homo sapiens
cagaatcccttaacagtt

SEQ ID NO: 4421244 - DNA, 17 bp, Homo sapiens
cagaatctcgcagtgtt

SEQ ID NO: 4421245 - DNA, 18 bp, Homo sapiens
cagaatctgaatgtaatt

SEQ ID NO: 4421246 - DNA, 18 bp, Homo sapiens
cacaataaaaatgtttaa

SEQ ID NO: 4421247 - DNA, 18 bp, Homo sapiens
cacaataggtctttctct

SEQ ID NO: 4421248 - DNA, 19 bp, Homo sapiens
cacaataggtctttctctc

SEQ ID NO: 4421249 - DNA, 16 bp, Homo sapiens
cacaatattcagtggt

SEQ ID NO: 4421250 - DNA, 23 bp, Homo sapiens
cacaatattcagtggtgaaatct

SEQ ID NO: 4421251 - DNA, 23 bp, Homo sapiens
cacaatgagattgaatttcactg

SEQ ID NO: 4421252 - DNA, 17 bp, Homo sapiens
cacaatgtttcttcatt

SEQ ID NO: 4421253 - DNA, 23 bp, Homo sapiens
cacaatgtttcttcatttctctg

SEQ ID NO: 4421254 - DNA, 16 bp, Homo sapiens
cacaattagatttctc

SEQ ID NO: 4421255 - DNA, 14 bp, Homo sapiens
cacaatttttaatg

SEQ ID NO: 4421256 - DNA, 21 bp, Homo sapiens
cacacaaaaataaagactaga

SEQ ID NO: 4421257 - DNA, 16 bp, Homo sapiens
cacacaagggaagtgg

SEQ ID NO: 4421258 - DNA, 16 bp, Homo sapiens
cacacaattagatttc

SEQ ID NO: 4421259 - DNA, 15 bp, Homo sapiens
cacacacagcctgtc

SEQ ID NO: 4421260 - DNA, 19 bp, Homo sapiens
cacacactgagttgcacat

SEQ ID NO: 4421261 - DNA, 20 bp, Homo sapiens
cacacactgagttgcacata

SEQ ID NO: 4421262 - DNA, 14 bp, Homo sapiens
cacacactgatgct

SEQ ID NO: 4421263 - DNA, 16 bp, Homo sapiens
cacacactgcacatct

SEQ ID NO: 4421264 - DNA, 22 bp, Homo sapiens
cacacactgtgctttctattgt

SEQ ID NO: 4421265 - DNA, 21 bp, Homo sapiens
cacacagcagccccccagcac

SEQ ID NO: 4421266 - DNA, 14 bp, Homo sapiens
cacacagccaggtg

SEQ ID NO: 4421267 - DNA, 15 bp, Homo sapiens
cacacagccaggtgc

SEQ ID NO: 4421268 - DNA, 19 bp, Homo sapiens
cacacagccaggtgccttg

SEQ ID NO: 4421269 - DNA, 13 bp, Homo sapiens
cacacagcccagt

SEQ ID NO: 4421270 - DNA, 14 bp, Homo sapiens
cacacagctgagca

SEQ ID NO: 4421271 - DNA, 15 bp, Homo sapiens
cacacagctgagcac

SEQ ID NO: 4421272 - DNA, 17 bp, Homo sapiens
cacacagctgagcactt

SEQ ID NO: 4421273 - DNA, 14 bp, Homo sapiens
cacacaggcagcca

SEQ ID NO: 4421274 - DNA, 16 bp, Homo sapiens
cacacaggcagccagc

SEQ ID NO: 4421275 - DNA, 18 bp, Homo sapiens
cacacaggcagccagccg

SEQ ID NO: 4421276 - DNA, 13 bp, Homo sapiens
cacacaggcaggg

SEQ ID NO: 4421277 - DNA, 14 bp, Homo sapiens
cacacaggcagggc

SEQ ID NO: 4421278 - DNA, 15 bp, Homo sapiens
cacacaggcagggcc

SEQ ID NO: 4421279 - DNA, 16 bp, Homo sapiens
cacacaggcagggcct

SEQ ID NO: 4421280 - DNA, 20 bp, Homo sapiens
cacacaggcagggcctggct

SEQ ID NO: 4421281 - DNA, 21 bp, Homo sapiens
cacacaggcagggcctggctc

SEQ ID NO: 4421282 - DNA, 23 bp, Homo sapiens
cacacatatatataacaaataat

SEQ ID NO: 4421283 - DNA, 15 bp, Homo sapiens
cacacatgaataaag

SEQ ID NO: 4421284 - DNA, 14 bp, Homo sapiens
cacacattcacgca

SEQ ID NO: 4421285 - DNA, 21 bp, Homo sapiens
cacaccactaaccatccccaa

SEQ ID NO: 4421286 - DNA, 20 bp, Homo sapiens
cacaccagagacaagcagag

SEQ ID NO: 4421287 - DNA, 18 bp, Homo sapiens
cacaccaggcgctaattc

SEQ ID NO: 4421288 - DNA, 16 bp, Homo sapiens
cacaccatatgtccac

SEQ ID NO: 4421289 - DNA, 15 bp, Homo sapiens
cacacccaggaaggg

SEQ ID NO: 4421290 - DNA, 19 bp, Homo sapiens
cacaccgcgtcccagctcc

SEQ ID NO: 4421291 - DNA, 15 bp, Homo sapiens
cacacctagccagct

SEQ ID NO: 4421292 - DNA, 14 bp, Homo sapiens
cacacctcactctt

SEQ ID NO: 4421293 - DNA, 18 bp, Homo sapiens
cacacctcactctttata

SEQ ID NO: 4421294 - DNA, 17 bp, Homo sapiens
cacacctcagttccctt

SEQ ID NO: 4421295 - DNA, 22 bp, Homo sapiens
cacacctcagttcccttggcct

SEQ ID NO: 4421296 - DNA, 12 bp, Homo sapiens
cacacctcgtgg

SEQ ID NO: 4421297 - DNA, 12 bp, Homo sapiens
cacacctctgcc

SEQ ID NO: 4421298 - DNA, 17 bp, Homo sapiens
cacacctgaacttgcct

SEQ ID NO: 4421299 - DNA, 14 bp, Homo sapiens
cacaccttaaaaca

SEQ ID NO: 4421300 - DNA, 15 bp, Homo sapiens
cacaccttaaaacat

SEQ ID NO: 4421301 - DNA, 20 bp, Homo sapiens
cacaccttttatgaatcaaa

SEQ ID NO: 4421302 - DNA, 23 bp, Homo sapiens
cacaccttttattgacacagaaa

SEQ ID NO: 4421303 - DNA, 17 bp, Homo sapiens
cacacgtttaatcccag

SEQ ID NO: 4421304 - DNA, 19 bp, Homo sapiens
cacacgtttaatcccagca

SEQ ID NO: 4421305 - DNA, 20 bp, Homo sapiens
cacacgtttaatcccagcac

SEQ ID NO: 4421306 - DNA, 23 bp, Homo sapiens
cacacgtttaatcccagcacttt

SEQ ID NO: 4421307 - DNA, 17 bp, Homo sapiens
cacactagggactatca

SEQ ID NO: 4421308 - DNA, 19 bp, Homo sapiens
cacactatcatagttaaca

SEQ ID NO: 4421309 - DNA, 19 bp, Homo sapiens
cacactcaaatcaagaaac

SEQ ID NO: 4421310 - DNA, 15 bp, Homo sapiens
cacactcagccacaa

SEQ ID NO: 4421311 - DNA, 18 bp, Homo sapiens
cacactccccacttcact

SEQ ID NO: 4421312 - DNA, 21 bp, Homo sapiens
cacactgcaagagccttggtg

SEQ ID NO: 4421313 - DNA, 12 bp, Homo sapiens
cacactggctca

SEQ ID NO: 4421314 - DNA, 15 bp, Homo sapiens
cacactggctcaccc

SEQ ID NO: 4421315 - DNA, 16 bp, Homo sapiens
cacactgtgctttcta

SEQ ID NO: 4421316 - DNA, 23 bp, Homo sapiens
cacactgttacacgtgcctgtag

SEQ ID NO: 4421317 - DNA, 18 bp, Homo sapiens
cacacttatattttatga

SEQ ID NO: 4421318 - DNA, 22 bp, Homo sapiens
cacacttctgtgagacccccac

SEQ ID NO: 4421319 - DNA, 15 bp, Homo sapiens
cacacttgttccagc

SEQ ID NO: 4421320 - DNA, 17 bp, Homo sapiens
cacacttgttccagctc

SEQ ID NO: 4421321 - DNA, 17 bp, Homo sapiens
cacagaaaataaggcac

SEQ ID NO: 4421322 - DNA, 12 bp, Homo sapiens
cacagaaaattt

SEQ ID NO: 4421323 - DNA, 12 bp, Homo sapiens
cacagaaacctt

SEQ ID NO: 4421324 - DNA, 16 bp, Homo sapiens
cacagaatagtttaca

SEQ ID NO: 4421325 - DNA, 18 bp, Homo sapiens
cacagaatagtttacaca

SEQ ID NO: 4421326 - DNA, 16 bp, Homo sapiens
cacagacatctttcaa

SEQ ID NO: 4421327 - DNA, 14 bp, Homo sapiens
cacagaccacagga

SEQ ID NO: 4421328 - DNA, 18 bp, Homo sapiens
cacagaccccagctgggg

SEQ ID NO: 4421329 - DNA, 13 bp, Homo sapiens
cacagactatttt

SEQ ID NO: 4421330 - DNA, 17 bp, Homo sapiens
cacagagaaatacaaaa

SEQ ID NO: 4421331 - DNA, 13 bp, Homo sapiens
cacagagaggagg

SEQ ID NO: 4421332 - DNA, 13 bp, Homo sapiens
cacagagcagcaa

SEQ ID NO: 4421333 - DNA, 23 bp, Homo sapiens
cacagagcctgaatttgtaagca

SEQ ID NO: 4421334 - DNA, 14 bp, Homo sapiens
cacagagcctggcc

SEQ ID NO: 4421335 - DNA, 19 bp, Homo sapiens
cacagagcctggccccagg

SEQ ID NO: 4421336 - DNA, 22 bp, Homo sapiens
cacagaggaagaacacagcgca

SEQ ID NO: 4421337 - DNA, 11 bp, Homo sapiens
cacagaggccc

SEQ ID NO: 4421338 - DNA, 17 bp, Homo sapiens
cacagagtgctggactg

SEQ ID NO: 4421339 - DNA, 20 bp, Homo sapiens
cacagatatactttgtggac

SEQ ID NO: 4421340 - DNA, 23 bp, Homo sapiens
cacagatatactttgtggaccaa

SEQ ID NO: 4421341 - DNA, 16 bp, Homo sapiens
cacagatgaggccccc

SEQ ID NO: 4421342 - DNA, 13 bp, Homo sapiens
cacagatgctcca

SEQ ID NO: 4421343 - DNA, 15 bp, Homo sapiens
cacagatgctccagg

SEQ ID NO: 4421344 - DNA, 13 bp, Homo sapiens
cacagatgggcaa

SEQ ID NO: 4421345 - DNA, 19 bp, Homo sapiens
cacagatttttatgttttc

SEQ ID NO: 4421346 - DNA, 21 bp, Homo sapiens
cacagatttttatgttttctt

SEQ ID NO: 4421347 - DNA, 15 bp, Homo sapiens
cacagcaagtacagc

SEQ ID NO: 4421348 - DNA, 21 bp, Homo sapiens
cacagcaagtacagcggctcc

SEQ ID NO: 4421349 - DNA, 15 bp, Homo sapiens
cacagcagacaccat

SEQ ID NO: 4421350 - DNA, 15 bp, Homo sapiens
cacagcagcattttt

SEQ ID NO: 4421351 - DNA, 11 bp, Homo sapiens
cacagcagccc

SEQ ID NO: 4421352 - DNA, 18 bp, Homo sapiens
cacagcagccccaggaga

SEQ ID NO: 4421353 - DNA, 21 bp, Homo sapiens
cacagcaggatgctaatggaa

SEQ ID NO: 4421354 - DNA, 15 bp, Homo sapiens
cacagcaggctgcca

SEQ ID NO: 4421355 - DNA, 16 bp, Homo sapiens
cacagcaggctgccag

SEQ ID NO: 4421356 - DNA, 19 bp, Homo sapiens
cacagcaggctgccagtgc

SEQ ID NO: 4421357 - DNA, 22 bp, Homo sapiens
cacagcagttgaaaagactcca

SEQ ID NO: 4421358 - DNA, 14 bp, Homo sapiens
cacagccacacctg

SEQ ID NO: 4421359 - DNA, 15 bp, Homo sapiens
cacagccaggtgcct

SEQ ID NO: 4421360 - DNA, 19 bp, Homo sapiens
cacagccaggtgccttgga

SEQ ID NO: 4421361 - DNA, 12 bp, Homo sapiens
cacagcccctgg

SEQ ID NO: 4421362 - DNA, 14 bp, Homo sapiens
cacagcccctggag

SEQ ID NO: 4421363 - DNA, 15 bp, Homo sapiens
cacagcccctggagc

SEQ ID NO: 4421364 - DNA, 17 bp, Homo sapiens
cacagcccctggagcct

SEQ ID NO: 4421365 - DNA, 21 bp, Homo sapiens
cacagccgcgggccaggaggc

SEQ ID NO: 4421366 - DNA, 23 bp, Homo sapiens
cacagccgtttgaatatatttta

SEQ ID NO: 4421367 - DNA, 22 bp, Homo sapiens
caatggtgttcaccatcggcag

SEQ ID NO: 4421368 - DNA, 16 bp, Homo sapiens
caatggtttttaaatt

SEQ ID NO: 4421369 - DNA, 12 bp, Homo sapiens
caatgtaaaaat

SEQ ID NO: 4421370 - DNA, 19 bp, Homo sapiens
caatgtaaatattttaaag

SEQ ID NO: 4421371 - DNA, 17 bp, Homo sapiens
caatgtaagcatacttt

SEQ ID NO: 4421372 - DNA, 12 bp, Homo sapiens
caatgtacaatt

SEQ ID NO: 4421373 - DNA, 14 bp, Homo sapiens
caatgtacaattat

SEQ ID NO: 4421374 - DNA, 17 bp, Homo sapiens
caatgtacaattatgtc

SEQ ID NO: 4421375 - DNA, 11 bp, Homo sapiens
caatgtatctt

SEQ ID NO: 4421376 - DNA, 20 bp, Homo sapiens
caatgtatctttattaaaac

SEQ ID NO: 4421377 - DNA, 17 bp, Homo sapiens
caatgtatgtacaatac

SEQ ID NO: 4421378 - DNA, 22 bp, Homo sapiens
caatgtatgtacaatacaatgt

SEQ ID NO: 4421379 - DNA, 17 bp, Homo sapiens
caatgtctaaaaacatt

SEQ ID NO: 4421380 - DNA, 23 bp, Homo sapiens
caatgtgactgaaacaaaatgtt

SEQ ID NO: 4421381 - DNA, 15 bp, Homo sapiens
caatgtgattcttct

SEQ ID NO: 4421382 - DNA, 23 bp, Homo sapiens
caatgtgccttgattgattagat

SEQ ID NO: 4421383 - DNA, 20 bp, Homo sapiens
caatgtggtgacacctcccc

SEQ ID NO: 4421384 - DNA, 17 bp, Homo sapiens
caatgtgtttttctcca

SEQ ID NO: 4421385 - DNA, 19 bp, Homo sapiens
caatgttatgccagctcca

SEQ ID NO: 4421386 - DNA, 23 bp, Homo sapiens
caatgttgcatttatgatgcagt

SEQ ID NO: 4421387 - DNA, 19 bp, Homo sapiens
caatgtttcttcatttctc

SEQ ID NO: 4421388 - DNA, 22 bp, Homo sapiens
caatgtttcttcatttctctgc

SEQ ID NO: 4421389 - DNA, 12 bp, Homo sapiens
caattaaaatac

SEQ ID NO: 4421390 - DNA, 13 bp, Homo sapiens
caattaacataca

SEQ ID NO: 4421391 - DNA, 13 bp, Homo sapiens
caattaatgcttt

SEQ ID NO: 4421392 - DNA, 12 bp, Homo sapiens
caattaattaaa

SEQ ID NO: 4421393 - DNA, 15 bp, Homo sapiens
caattaattaaaagt

SEQ ID NO: 4421394 - DNA, 17 bp, Homo sapiens
caattacagggtgactc

SEQ ID NO: 4421395 - DNA, 19 bp, Homo sapiens
caattacagggtgactcac

SEQ ID NO: 4421396 - DNA, 22 bp, Homo sapiens
caattacagggtgactcacagc

SEQ ID NO: 4421397 - DNA, 22 bp, Homo sapiens
caattatctgattaagcattct

SEQ ID NO: 4421398 - DNA, 14 bp, Homo sapiens
caattatgtctctt

SEQ ID NO: 4421399 - DNA, 17 bp, Homo sapiens
caattatgtctcttgag

SEQ ID NO: 4421400 - DNA, 20 bp, Homo sapiens
caattattgatatatattat

SEQ ID NO: 4421401 - DNA, 20 bp, Homo sapiens
caattatttgcatattttga

SEQ ID NO: 4421402 - DNA, 17 bp, Homo sapiens
caattcaatacaaacaa

SEQ ID NO: 4421403 - DNA, 13 bp, Homo sapiens
caattcataatat

SEQ ID NO: 4421404 - DNA, 20 bp, Homo sapiens
caattcccttctttttcatc

SEQ ID NO: 4421405 - DNA, 19 bp, Homo sapiens
caattctaggatgaacaat

SEQ ID NO: 4421406 - DNA, 21 bp, Homo sapiens
caattctcctgcctcagcctc

SEQ ID NO: 4421407 - DNA, 12 bp, Homo sapiens
caattctgactg

SEQ ID NO: 4421408 - DNA, 22 bp, Homo sapiens
caattctgcccgctccatggaa

SEQ ID NO: 4421409 - DNA, 23 bp, Homo sapiens
caattctgtttttaatgctattt

SEQ ID NO: 4421410 - DNA, 22 bp, Homo sapiens
caattgaaagtgggcaaaagct

SEQ ID NO: 4421411 - DNA, 14 bp, Homo sapiens
caattgaaatgcat

SEQ ID NO: 4421412 - DNA, 20 bp, Homo sapiens
caattgaaggatcatctgaa

SEQ ID NO: 4421413 - DNA, 18 bp, Homo sapiens
caattgatgtgattattt

SEQ ID NO: 4421414 - DNA, 18 bp, Homo sapiens
caattggaagtctaagaa

SEQ ID NO: 4421415 - DNA, 16 bp, Homo sapiens
caattgtcacttttta

SEQ ID NO: 4421416 - DNA, 18 bp, Homo sapiens
caattgtgaaaatgaata

SEQ ID NO: 4421417 - DNA, 14 bp, Homo sapiens
caatttaaatgtta

SEQ ID NO: 4421418 - DNA, 16 bp, Homo sapiens
caatttatacctagca

SEQ ID NO: 4421419 - DNA, 22 bp, Homo sapiens
caatttatggaagccagggctt

SEQ ID NO: 4421420 - DNA, 13 bp, Homo sapiens
caatttattttat

SEQ ID NO: 4421421 - DNA, 13 bp, Homo sapiens
caatttcaaactt

SEQ ID NO: 4421422 - DNA, 14 bp, Homo sapiens
caatttcaaacttt

SEQ ID NO: 4421423 - DNA, 17 bp, Homo sapiens
caatttcaaacttttga

SEQ ID NO: 4421424 - DNA, 18 bp, Homo sapiens
caatttcaaacttttgaa

SEQ ID NO: 4421425 - DNA, 11 bp, Homo sapiens
caatttcagca

SEQ ID NO: 4421426 - DNA, 21 bp, Homo sapiens
caatttcatttccagcatttt

SEQ ID NO: 4421427 - DNA, 15 bp, Homo sapiens
caatttccccctgtt

SEQ ID NO: 4421428 - DNA, 21 bp, Homo sapiens
caatttcggattttttccaaa

SEQ ID NO: 4421429 - DNA, 16 bp, Homo sapiens
caatttctaatgttta

SEQ ID NO: 4421430 - DNA, 18 bp, Homo sapiens
caatttctaatgtttact

SEQ ID NO: 4421431 - DNA, 20 bp, Homo sapiens
caatttctactttgaagtca

SEQ ID NO: 4421432 - DNA, 18 bp, Homo sapiens
caatttctgtacatttgc

SEQ ID NO: 4421433 - DNA, 14 bp, Homo sapiens
caatttgtaaatat

SEQ ID NO: 4421434 - DNA, 15 bp, Homo sapiens
caatttgtaaatatt

SEQ ID NO: 4421435 - DNA, 22 bp, Homo sapiens
caatttgtttgtgttcaatatc

SEQ ID NO: 4421436 - DNA, 16 bp, Homo sapiens
caatttgtttttgcat

SEQ ID NO: 4421437 - DNA, 19 bp, Homo sapiens
caattttaatttagtaaat

SEQ ID NO: 4421438 - DNA, 15 bp, Homo sapiens
caattttatctgttt

SEQ ID NO: 4421439 - DNA, 23 bp, Homo sapiens
caattttcctgtggaataaagat

SEQ ID NO: 4421440 - DNA, 14 bp, Homo sapiens
caattttggatgag

SEQ ID NO: 4421441 - DNA, 12 bp, Homo sapiens
caatttttaatg

SEQ ID NO: 4421442 - DNA, 18 bp, Homo sapiens
caattttttttcaaatgt

SEQ ID NO: 4421443 - DNA, 20 bp, Homo sapiens
caattttttttcaaatgtgc

SEQ ID NO: 4421444 - DNA, 22 bp, Homo sapiens
caattttttttcaaatgtgcaa

SEQ ID NO: 4421445 - DNA, 20 bp, Homo sapiens
cacaaaaaggcaaatattga

SEQ ID NO: 4421446 - DNA, 20 bp, Homo sapiens
cacaaaactacttttctaaa

SEQ ID NO: 4421447 - DNA, 13 bp, Homo sapiens
cacaaaagcagat

SEQ ID NO: 4421448 - DNA, 15 bp, Homo sapiens
cacaaaatatacaaa

SEQ ID NO: 4421449 - DNA, 15 bp, Homo sapiens
cacaaaatctgtcca

SEQ ID NO: 4421450 - DNA, 12 bp, Homo sapiens
cacaaaatgcac

SEQ ID NO: 4421451 - DNA, 16 bp, Homo sapiens
cacaaaatgcacttct

SEQ ID NO: 4421452 - DNA, 23 bp, Homo sapiens
cacaaactgtaaataaaaagaaa

SEQ ID NO: 4421453 - DNA, 17 bp, Homo sapiens
cacaaactgtgaaaata

SEQ ID NO: 4421454 - DNA, 21 bp, Homo sapiens
cacaaactgtgaaaatagtgt

SEQ ID NO: 4421455 - DNA, 20 bp, Homo sapiens
cacaaagaaaattcctataa

SEQ ID NO: 4421456 - DNA, 17 bp, Homo sapiens
cacaaagactccttcgt

SEQ ID NO: 4421457 - DNA, 20 bp, Homo sapiens
cacaaagccccccagctccc

SEQ ID NO: 4421458 - DNA, 13 bp, Homo sapiens
cacaaagctttct

SEQ ID NO: 4421459 - DNA, 11 bp, Homo sapiens
cacaaaggaag

SEQ ID NO: 4421460 - DNA, 15 bp, Homo sapiens
cacaaagttctcaga

SEQ ID NO: 4421461 - DNA, 17 bp, Homo sapiens
cacaaagttctcagagc

SEQ ID NO: 4421462 - DNA, 14 bp, Homo sapiens
cacaaatattattt

SEQ ID NO: 4421463 - DNA, 23 bp, Homo sapiens
cacaaatattatttgtgtttcct

SEQ ID NO: 4421464 - DNA, 16 bp, Homo sapiens
cacaaatccttcaaaa

SEQ ID NO: 4421465 - DNA, 18 bp, Homo sapiens
cacaaatgtcattgtcta

SEQ ID NO: 4421466 - DNA, 23 bp, Homo sapiens
cacaacagcctgacaacatttct

SEQ ID NO: 4421467 - DNA, 16 bp, Homo sapiens
cacaacatggtgctac

SEQ ID NO: 4421468 - DNA, 23 bp, Homo sapiens
cacaaccatctgtccctgcctca

SEQ ID NO: 4421469 - DNA, 18 bp, Homo sapiens
cacaacccaataggagtc

SEQ ID NO: 4421470 - DNA, 15 bp, Homo sapiens
cacaaccttttcctc

SEQ ID NO: 4421471 - DNA, 13 bp, Homo sapiens
cacaactaacaat

SEQ ID NO: 4421472 - DNA, 16 bp, Homo sapiens
cacaactaacaatgcc

SEQ ID NO: 4421473 - DNA, 23 bp, Homo sapiens
cacaagacacagaatagtttaca

SEQ ID NO: 4421474 - DNA, 21 bp, Homo sapiens
cacaagacatttctttctgtt

SEQ ID NO: 4421475 - DNA, 17 bp, Homo sapiens
cacaagattcccagaga

SEQ ID NO: 4421476 - DNA, 19 bp, Homo sapiens
cacaagattcccagagaca

SEQ ID NO: 4421477 - DNA, 14 bp, Homo sapiens
cacaagcctcctgt

SEQ ID NO: 4421478 - DNA, 16 bp, Homo sapiens
cacaagcctcctgtac

SEQ ID NO: 4421479 - DNA, 15 bp, Homo sapiens
cacaagcctgagaac

SEQ ID NO: 4421480 - DNA, 19 bp, Homo sapiens
cacaagccttactcacctc

SEQ ID NO: 4421481 - DNA, 22 bp, Homo sapiens
cacaagccttactcacctctct

SEQ ID NO: 4421482 - DNA, 12 bp, Homo sapiens
cacaagctgcac

SEQ ID NO: 4421483 - DNA, 14 bp, Homo sapiens
cacaagctgcactg

SEQ ID NO: 4421484 - DNA, 19 bp, Homo sapiens
cacaagctgcactgtgaac

SEQ ID NO: 4421485 - DNA, 23 bp, Homo sapiens
cacaaggggattttgctgatggg

SEQ ID NO: 4421486 - DNA, 20 bp, Homo sapiens
cacaagttccctggagaaaa

SEQ ID NO: 4421487 - DNA, 21 bp, Homo sapiens
caagggcagaatgaatctatg

SEQ ID NO: 4421488 - DNA, 16 bp, Homo sapiens
caaggggattttgctg

SEQ ID NO: 4421489 - DNA, 19 bp, Homo sapiens
caaggggtggccgggcaca

SEQ ID NO: 4421490 - DNA, 19 bp, Homo sapiens
caaggtcagaacaggtttt

SEQ ID NO: 4421491 - DNA, 14 bp, Homo sapiens
caaggtcagggagg

SEQ ID NO: 4421492 - DNA, 14 bp, Homo sapiens
caaggtcctgctca

SEQ ID NO: 4421493 - DNA, 15 bp, Homo sapiens
caaggtcctgctcaa

SEQ ID NO: 4421494 - DNA, 21 bp, Homo sapiens
caaggtctgagccacagcagc

SEQ ID NO: 4421495 - DNA, 11 bp, Homo sapiens
caaggtgctaa

SEQ ID NO: 4421496 - DNA, 12 bp, Homo sapiens
caaggtgctaac

SEQ ID NO: 4421497 - DNA, 15 bp, Homo sapiens
caaggtggcagatgt

SEQ ID NO: 4421498 - DNA, 19 bp, Homo sapiens
caaggtggggattgcccct

SEQ ID NO: 4421499 - DNA, 23 bp, Homo sapiens
caaggtggggattgcccctggct

SEQ ID NO: 4421500 - DNA, 15 bp, Homo sapiens
caaggtgtgctctga

SEQ ID NO: 4421501 - DNA, 22 bp, Homo sapiens
caaggttactcagcagcagaga

SEQ ID NO: 4421502 - DNA, 22 bp, Homo sapiens
caaggttataattttttttaaa

SEQ ID NO: 4421503 - DNA, 19 bp, Homo sapiens
caaggttgcacagcaagaa

SEQ ID NO: 4421504 - DNA, 19 bp, Homo sapiens
caaggtttatgccaccagg

SEQ ID NO: 4421505 - DNA, 13 bp, Homo sapiens
caagtaaatatat

SEQ ID NO: 4421506 - DNA, 20 bp, Homo sapiens
caagtaaccaggccccagcc

SEQ ID NO: 4421507 - DNA, 23 bp, Homo sapiens
caagtaaccaggccccagcctcc

SEQ ID NO: 4421508 - DNA, 15 bp, Homo sapiens
caagtaatacaaact

SEQ ID NO: 4421509 - DNA, 14 bp, Homo sapiens
caagtataaacttt

SEQ ID NO: 4421510 - DNA, 15 bp, Homo sapiens
caagtatataattta

SEQ ID NO: 4421511 - DNA, 20 bp, Homo sapiens
caagtatgaagtataaatct

SEQ ID NO: 4421512 - DNA, 21 bp, Homo sapiens
caagtatgaagtataaatctg

SEQ ID NO: 4421513 - DNA, 17 bp, Homo sapiens
caagtattactaaattg

SEQ ID NO: 4421514 - DNA, 24 bp, Homo sapiens
caagtattactaaattgaccttta

SEQ ID NO: 4421515 - DNA, 19 bp, Homo sapiens
caagtcaaccaatgtagaa

SEQ ID NO: 4421516 - DNA, 14 bp, Homo sapiens
caagtcagcatatg

SEQ ID NO: 4421517 - DNA, 18 bp, Homo sapiens
caagtcatagccataaat

SEQ ID NO: 4421518 - DNA, 20 bp, Homo sapiens
caagtcatagccataaatga

SEQ ID NO: 4421519 - DNA, 16 bp, Homo sapiens
caagtcatggtcacag

SEQ ID NO: 4421520 - DNA, 17 bp, Homo sapiens
caagtcatggtcacagt

SEQ ID NO: 4421521 - DNA, 19 bp, Homo sapiens
caagtcatggtcacagtaa

SEQ ID NO: 4421522 - DNA, 14 bp, Homo sapiens
caagtcatttttgt

SEQ ID NO: 4421523 - DNA, 16 bp, Homo sapiens
caagtcatttttgtat

SEQ ID NO: 4421524 - DNA, 21 bp, Homo sapiens
caatatcagctttgataattg

SEQ ID NO: 4421525 - DNA, 13 bp, Homo sapiens
caatatgcaagca

SEQ ID NO: 4421526 - DNA, 17 bp, Homo sapiens
caatatgcaagcagctt

SEQ ID NO: 4421527 - DNA, 14 bp, Homo sapiens
caatatgggaggaa

SEQ ID NO: 4421528 - DNA, 21 bp, Homo sapiens
caatatgggaggaacaaagac

SEQ ID NO: 4421529 - DNA, 18 bp, Homo sapiens
caatatgggggccttttg

SEQ ID NO: 4421530 - DNA, 24 bp, Homo sapiens
caatattaacctaatcaccatgta

SEQ ID NO: 4421531 - DNA, 15 bp, Homo sapiens
caatattactttgtc

SEQ ID NO: 4421532 - DNA, 22 bp, Homo sapiens
caatattcagtggtgaaatctt

SEQ ID NO: 4421533 - DNA, 12 bp, Homo sapiens
caatattgaatt

SEQ ID NO: 4421534 - DNA, 18 bp, Homo sapiens
caatattgaatttttcct

SEQ ID NO: 4421535 - DNA, 16 bp, Homo sapiens
caatattgtacagttt

SEQ ID NO: 4421536 - DNA, 19 bp, Homo sapiens
caatattgtatatttttat

SEQ ID NO: 4421537 - DNA, 20 bp, Homo sapiens
caatatttaagtttgttgct

SEQ ID NO: 4421538 - DNA, 22 bp, Homo sapiens
caatatttctgctttctttgat

SEQ ID NO: 4421539 - DNA, 23 bp, Homo sapiens
caatatttctgctttctttgatt

SEQ ID NO: 4421540 - DNA, 14 bp, Homo sapiens
caatatttcttttg

SEQ ID NO: 4421541 - DNA, 15 bp, Homo sapiens
caatattttaataaa

SEQ ID NO: 4421542 - DNA, 24 bp, Homo sapiens
caatattttaataaagtagttatt

SEQ ID NO: 4421543 - DNA, 17 bp, Homo sapiens
caatattttcttttccc

SEQ ID NO: 4421544 - DNA, 14 bp, Homo sapiens
caatattttgtata

SEQ ID NO: 4421545 - DNA, 23 bp, Homo sapiens
caatatttttatatcatgcaaaa

SEQ ID NO: 4421546 - DNA, 20 bp, Homo sapiens
caatcaaggttataattttt

SEQ ID NO: 4421547 - DNA, 11 bp, Homo sapiens
caatcaagttt

SEQ ID NO: 4421548 - DNA, 14 bp, Homo sapiens
caatcacaaaggct

SEQ ID NO: 4421549 - DNA, 16 bp, Homo sapiens
caatcacaaaggctga

SEQ ID NO: 4421550 - DNA, 15 bp, Homo sapiens
caatcagcactctgt

SEQ ID NO: 4421551 - DNA, 21 bp, Homo sapiens
caatcagcactctgtaaaatg

SEQ ID NO: 4421552 - DNA, 17 bp, Homo sapiens
caatcagcctcatgact

SEQ ID NO: 4421553 - DNA, 16 bp, Homo sapiens
caatcagctccttcct

SEQ ID NO: 4421554 - DNA, 19 bp, Homo sapiens
caatcagcttttgttctag

SEQ ID NO: 4421555 - DNA, 22 bp, Homo sapiens
caatcagcttttgttctagact

SEQ ID NO: 4421556 - DNA, 19 bp, Homo sapiens
caatcattgttttgaatat

SEQ ID NO: 4421557 - DNA, 18 bp, Homo sapiens
caatccacctgccttggc

SEQ ID NO: 4421558 - DNA, 15 bp, Homo sapiens
caatccaggctgttc

SEQ ID NO: 4421559 - DNA, 21 bp, Homo sapiens
caatccaggctgttctcagcg

SEQ ID NO: 4421560 - DNA, 15 bp, Homo sapiens
caatccatgcttcac

SEQ ID NO: 4421561 - DNA, 21 bp, Homo sapiens
caatcccctcattcaggaaaa

SEQ ID NO: 4421562 - DNA, 22 bp, Homo sapiens
caatcccttaatatcctaaaca

SEQ ID NO: 4421563 - DNA, 14 bp, Homo sapiens
caatcctatgtttt

SEQ ID NO: 4421564 - DNA, 20 bp, Homo sapiens
caatcctcctgcctcagcct

SEQ ID NO: 4421565 - DNA, 19 bp, Homo sapiens
caatcctggaagaagcagg

SEQ ID NO: 4421566 - DNA, 14 bp, Homo sapiens
caatctaacaataa

SEQ ID NO: 4421567 - DNA, 13 bp, Homo sapiens
caatctatttaaa

SEQ ID NO: 4421568 - DNA, 18 bp, Homo sapiens
caatctcttaaattgggt

SEQ ID NO: 4421569 - DNA, 21 bp, Homo sapiens
caatctcttaaattgggttca

SEQ ID NO: 4421570 - DNA, 18 bp, Homo sapiens
caatctcttggtggggag

SEQ ID NO: 4421571 - DNA, 18 bp, Homo sapiens
caatctgaaattcaaaat

SEQ ID NO: 4421572 - DNA, 20 bp, Homo sapiens
caatctggatgcctcattat

SEQ ID NO: 4421573 - DNA, 20 bp, Homo sapiens
caatctggcttagtgccacc

SEQ ID NO: 4421574 - DNA, 18 bp, Homo sapiens
caatctgtaaactgtgta

SEQ ID NO: 4421575 - DNA, 20 bp, Homo sapiens
caatctgttttggctttatg

SEQ ID NO: 4421576 - DNA, 20 bp, Homo sapiens
caatcttggagctgcttgga

SEQ ID NO: 4421577 - DNA, 14 bp, Homo sapiens
caatcttgtttata

SEQ ID NO: 4421578 - DNA, 16 bp, Homo sapiens
caatctttcatgtctt

SEQ ID NO: 4421579 - DNA, 12 bp, Homo sapiens
caatgaaaacat

SEQ ID NO: 4421580 - DNA, 12 bp, Homo sapiens
caatgaaaagtc

SEQ ID NO: 4421581 - DNA, 12 bp, Homo sapiens
caatgaaaattt

SEQ ID NO: 4421582 - DNA, 15 bp, Homo sapiens
caatgaaaattttaa

SEQ ID NO: 4421583 - DNA, 16 bp, Homo sapiens
caatgaaaattttaag

SEQ ID NO: 4421584 - DNA, 23 bp, Homo sapiens
caatgaaatgaattaaagtggac

SEQ ID NO: 4421585 - DNA, 17 bp, Homo sapiens
caatgaacatccctttt

SEQ ID NO: 4421586 - DNA, 19 bp, Homo sapiens
caatgaagggaaattgttt

SEQ ID NO: 4421587 - DNA, 13 bp, Homo sapiens
caatgaattatta

SEQ ID NO: 4421588 - DNA, 23 bp, Homo sapiens
caatgaattttataatctgcagc

SEQ ID NO: 4421589 - DNA, 15 bp, Homo sapiens
caatgagtctgtaat

SEQ ID NO: 4421590 - DNA, 21 bp, Homo sapiens
caatgagtctgtaattttacg

SEQ ID NO: 4421591 - DNA, 20 bp, Homo sapiens
caatgatacccaacagttta

SEQ ID NO: 4421592 - DNA, 22 bp, Homo sapiens
caatgatacccaacagtttatt

SEQ ID NO: 4421593 - DNA, 20 bp, Homo sapiens
caatgatcaccgactgaaaa

SEQ ID NO: 4421594 - DNA, 15 bp, Homo sapiens
caatgattgttaatt

SEQ ID NO: 4421595 - DNA, 18 bp, Homo sapiens
caatgcaagacgccctct

SEQ ID NO: 4421596 - DNA, 23 bp, Homo sapiens
caatgcacctaaagaaaaacaaa

SEQ ID NO: 4421597 - DNA, 22 bp, Homo sapiens
caatgcacttttatgaagtttt

SEQ ID NO: 4421598 - DNA, 17 bp, Homo sapiens
caatgccagaccgcaga

SEQ ID NO: 4421599 - DNA, 20 bp, Homo sapiens
caatgccgccgtgtttcctc

SEQ ID NO: 4421600 - DNA, 21 bp, Homo sapiens
caatgccgccgtgtttcctca

SEQ ID NO: 4421601 - DNA, 23 bp, Homo sapiens
caatgcctattgtaatatagaaa

SEQ ID NO: 4421602 - DNA, 16 bp, Homo sapiens
caatggaaagcttttc

SEQ ID NO: 4421603 - DNA, 13 bp, Homo sapiens
caatggaataaat

SEQ ID NO: 4421604 - DNA, 22 bp, Homo sapiens
caatggccagagcctctggccc

SEQ ID NO: 4421605 - DNA, 16 bp, Homo sapiens
caatgggaagactcag

SEQ ID NO: 4421606 - DNA, 20 bp, Homo sapiens
caatgggaagactcaggagt

SEQ ID NO: 4421607 - DNA, 16 bp, Homo sapiens
caatggggctggtttt

SEQ ID NO: 4421608 - DNA, 23 bp, Homo sapiens
caatggggctggttttgcttccc

SEQ ID NO: 4421609 - DNA, 19 bp, Homo sapiens
caatgggtaagggagggaa

SEQ ID NO: 4421610 - DNA, 23 bp, Homo sapiens
caagatattttaaaatctgtcac

SEQ ID NO: 4421611 - DNA, 18 bp, Homo sapiens
caagatcgcaccactgca

SEQ ID NO: 4421612 - DNA, 15 bp, Homo sapiens
caagatgagctgtgc

SEQ ID NO: 4421613 - DNA, 22 bp, Homo sapiens
caagatgcactcgctgtgattt

SEQ ID NO: 4421614 - DNA, 13 bp, Homo sapiens
caagatgtgaatt

SEQ ID NO: 4421615 - DNA, 18 bp, Homo sapiens
caagatgtgaattattga

SEQ ID NO: 4421616 - DNA, 15 bp, Homo sapiens
caagattcccagaga

SEQ ID NO: 4421617 - DNA, 19 bp, Homo sapiens
caagattcccagagacagg

SEQ ID NO: 4421618 - DNA, 18 bp, Homo sapiens
caagatttcacatcagct

SEQ ID NO: 4421619 - DNA, 13 bp, Homo sapiens
caagatttccttg

SEQ ID NO: 4421620 - DNA, 15 bp, Homo sapiens
caagatttttttcct

SEQ ID NO: 4421621 - DNA, 21 bp, Homo sapiens
caagattttttttgtaacttc

SEQ ID NO: 4421622 - DNA, 20 bp, Homo sapiens
caagcaaaatctaaaatgtt

SEQ ID NO: 4421623 - DNA, 16 bp, Homo sapiens
caagcaagatgagctg

SEQ ID NO: 4421624 - DNA, 13 bp, Homo sapiens
caagcaagcaaaa

SEQ ID NO: 4421625 - DNA, 15 bp, Homo sapiens
caagcaatcctcctg

SEQ ID NO: 4421626 - DNA, 16 bp, Homo sapiens
caagcaatcctcctgc

SEQ ID NO: 4421627 - DNA, 18 bp, Homo sapiens
caagcaatcctcctgcct

SEQ ID NO: 4421628 - DNA, 22 bp, Homo sapiens
caagcacactggaatataaaac

SEQ ID NO: 4421629 - DNA, 15 bp, Homo sapiens
caagcacccagagct

SEQ ID NO: 4421630 - DNA, 22 bp, Homo sapiens
caagcactatgcccttttatat

SEQ ID NO: 4421631 - DNA, 19 bp, Homo sapiens
caagcacttcccaggatct

SEQ ID NO: 4421632 - DNA, 18 bp, Homo sapiens
caagcagatctcatctca

SEQ ID NO: 4421633 - DNA, 22 bp, Homo sapiens
caagcagctttttattccctgc

SEQ ID NO: 4421634 - DNA, 17 bp, Homo sapiens
caagcaggacagtgctt

SEQ ID NO: 4421635 - DNA, 23 bp, Homo sapiens
caagcagtggatacgtgtcaatg

SEQ ID NO: 4421636 - DNA, 19 bp, Homo sapiens
caagcatgcataaatcaat

SEQ ID NO: 4421637 - DNA, 18 bp, Homo sapiens
caagcatggctattttat

SEQ ID NO: 4421638 - DNA, 17 bp, Homo sapiens
caagcattcagaagaaa

SEQ ID NO: 4421639 - DNA, 12 bp, Homo sapiens
caagcatttcat

SEQ ID NO: 4421640 - DNA, 16 bp, Homo sapiens
caagcatttcatgaaa

SEQ ID NO: 4421641 - DNA, 14 bp, Homo sapiens
caagcatttttcca

SEQ ID NO: 4421642 - DNA, 18 bp, Homo sapiens
caagcatttttccatctg

SEQ ID NO: 4421643 - DNA, 16 bp, Homo sapiens
caagccaaagagcctc

SEQ ID NO: 4421644 - DNA, 17 bp, Homo sapiens
caagccaagaaagatgt

SEQ ID NO: 4421645 - DNA, 15 bp, Homo sapiens
caagccacaggaagg

SEQ ID NO: 4421646 - DNA, 13 bp, Homo sapiens
caagccagaccta

SEQ ID NO: 4421647 - DNA, 20 bp, Homo sapiens
caagccatcttgagtggtca

SEQ ID NO: 4421648 - DNA, 22 bp, Homo sapiens
caagccctcctccccagagctg

SEQ ID NO: 4421649 - DNA, 12 bp, Homo sapiens
caagccctgccc

SEQ ID NO: 4421650 - DNA, 10 bp, Homo sapiens
caagccctgg

SEQ ID NO: 4421651 - DNA, 23 bp, Homo sapiens
caagcctctagtgtaccaagtgc

SEQ ID NO: 4421652 - DNA, 16 bp, Homo sapiens
attttcctcctctgcc

SEQ ID NO: 4421653 - DNA, 14 bp, Homo sapiens
attttcctcttgtg

SEQ ID NO: 4421654 - DNA, 15 bp, Homo sapiens
attttcctcttgtga

SEQ ID NO: 4421655 - DNA, 18 bp, Homo sapiens
attttcctggtgccaatt

SEQ ID NO: 4421656 - DNA, 22 bp, Homo sapiens
attttcctggtgccaatttcaa

SEQ ID NO: 4421657 - DNA, 12 bp, Homo sapiens
attttcctgtgg

SEQ ID NO: 4421658 - DNA, 14 bp, Homo sapiens
attttcctgtggaa

SEQ ID NO: 4421659 - DNA, 17 bp, Homo sapiens
attttcctttttcttcg

SEQ ID NO: 4421660 - DNA, 14 bp, Homo sapiens
attttctaaaagcc

SEQ ID NO: 4421661 - DNA, 15 bp, Homo sapiens
attttctaaaagctt

SEQ ID NO: 4421662 - DNA, 23 bp, Homo sapiens
attttctcccttaggaatataca

SEQ ID NO: 4421663 - DNA, 16 bp, Homo sapiens
attttctctgtacttt

SEQ ID NO: 4421664 - DNA, 15 bp, Homo sapiens
attttctgctacttt

SEQ ID NO: 4421665 - DNA, 18 bp, Homo sapiens
attttctgtgcctgaata

SEQ ID NO: 4421666 - DNA, 20 bp, Homo sapiens
attttctgtgcctgaatatt

SEQ ID NO: 4421667 - DNA, 21 bp, Homo sapiens
attttcttccccaagctttag

SEQ ID NO: 4421668 - DNA, 12 bp, Homo sapiens
attttcttctaa

SEQ ID NO: 4421669 - DNA, 14 bp, Homo sapiens
attttcttctaagt

SEQ ID NO: 4421670 - DNA, 16 bp, Homo sapiens
attttcttctaagtga

SEQ ID NO: 4421671 - DNA, 18 bp, Homo sapiens
attttgaaccaaaacata

SEQ ID NO: 4421672 - DNA, 18 bp, Homo sapiens
attttgaatcaataatat

SEQ ID NO: 4421673 - DNA, 21 bp, Homo sapiens
attttgaatgtacaccacatg

SEQ ID NO: 4421674 - DNA, 18 bp, Homo sapiens
attttgacactgaaataa

SEQ ID NO: 4421675 - DNA, 24 bp, Homo sapiens
attttgacataaagttgataaaga

SEQ ID NO: 4421676 - DNA, 19 bp, Homo sapiens
attttgaccatatagattt

SEQ ID NO: 4421677 - DNA, 17 bp, Homo sapiens
attttgacctactctca

SEQ ID NO: 4421678 - DNA, 14 bp, Homo sapiens
attttgagaaaaat

SEQ ID NO: 4421679 - DNA, 13 bp, Homo sapiens
attttgagaaact

SEQ ID NO: 4421680 - DNA, 13 bp, Homo sapiens
attttgagcatta

SEQ ID NO: 4421681 - DNA, 20 bp, Homo sapiens
attttgagtcctaggactta

SEQ ID NO: 4421682 - DNA, 21 bp, Homo sapiens
attttgataataatattgttt

SEQ ID NO: 4421683 - DNA, 10 bp, Homo sapiens
attttgatat

SEQ ID NO: 4421684 - DNA, 20 bp, Homo sapiens
attttgatataatctttcaa

SEQ ID NO: 4421685 - DNA, 16 bp, Homo sapiens
attttgatgcagataa

SEQ ID NO: 4421686 - DNA, 22 bp, Homo sapiens
attttgatgcagcatttgataa

SEQ ID NO: 4421687 - DNA, 23 bp, Homo sapiens
attttgatgcagcatttgataat

SEQ ID NO: 4421688 - DNA, 20 bp, Homo sapiens
attttgcaaaaatcctattc

SEQ ID NO: 4421689 - DNA, 21 bp, Homo sapiens
attttgcaaacactgtgatta

SEQ ID NO: 4421690 - DNA, 13 bp, Homo sapiens
attttgcaaagat

SEQ ID NO: 4421691 - DNA, 18 bp, Homo sapiens
attttgcactctgtaatt

SEQ ID NO: 4421692 - DNA, 16 bp, Homo sapiens
attttgcatattctct

SEQ ID NO: 4421693 - DNA, 20 bp, Homo sapiens
attttgctgcttgatgatga

SEQ ID NO: 4421694 - DNA, 17 bp, Homo sapiens
attttggaaaatgacat

SEQ ID NO: 4421695 - DNA, 22 bp, Homo sapiens
attttggaaactcaaggaaaag

SEQ ID NO: 4421696 - DNA, 18 bp, Homo sapiens
attttggaatatttgctt

SEQ ID NO: 4421697 - DNA, 20 bp, Homo sapiens
attttggaatatttgcttta

SEQ ID NO: 4421698 - DNA, 12 bp, Homo sapiens
attttggaattt

SEQ ID NO: 4421699 - DNA, 14 bp, Homo sapiens
attttggaatttgc

SEQ ID NO: 4421700 - DNA, 22 bp, Homo sapiens
attttggaggtgcttgatctat

SEQ ID NO: 4421701 - DNA, 22 bp, Homo sapiens
attttggttttgttcccctcct

SEQ ID NO: 4421702 - DNA, 23 bp, Homo sapiens
attttggttttgttcccctcctc

SEQ ID NO: 4421703 - DNA, 13 bp, Homo sapiens
attttgtaaaata

SEQ ID NO: 4421704 - DNA, 20 bp, Homo sapiens
attttgtaaatgttcttggt

SEQ ID NO: 4421705 - DNA, 15 bp, Homo sapiens
attttgtaatattct

SEQ ID NO: 4421706 - DNA, 19 bp, Homo sapiens
attttgtagttaatataaa

SEQ ID NO: 4421707 - DNA, 20 bp, Homo sapiens
attttgtagttaatataaat

SEQ ID NO: 4421708 - DNA, 14 bp, Homo sapiens
attttgtataatca

SEQ ID NO: 4421709 - DNA, 16 bp, Homo sapiens
attttgtatgaaatat

SEQ ID NO: 4421710 - DNA, 20 bp, Homo sapiens
attttgtatggagttaaata

SEQ ID NO: 4421711 - DNA, 12 bp, Homo sapiens
attttgtctacc

SEQ ID NO: 4421712 - DNA, 12 bp, Homo sapiens
attttgtttaca

SEQ ID NO: 4421713 - DNA, 17 bp, Homo sapiens
attttgttttgctctga

SEQ ID NO: 4421714 - DNA, 20 bp, Homo sapiens
attttgtttttactgtatgt

SEQ ID NO: 4421715 - DNA, 18 bp, Homo sapiens
atttttaaaaaatatttt

SEQ ID NO: 4421716 - DNA, 20 bp, Homo sapiens
atttttaaaaaatattttct

SEQ ID NO: 4421717 - DNA, 21 bp, Homo sapiens
atttttaaaactagcaactct

SEQ ID NO: 4421718 - DNA, 14 bp, Homo sapiens
atttttaaaatgaa

SEQ ID NO: 4421719 - DNA, 18 bp, Homo sapiens
atttttaaacttgaaata

SEQ ID NO: 4421720 - DNA, 13 bp, Homo sapiens
atttttaagattt

SEQ ID NO: 4421721 - DNA, 21 bp, Homo sapiens
atttttaagatttccttttgt

SEQ ID NO: 4421722 - DNA, 21 bp, Homo sapiens
atttttaatgcaccaatcttg

SEQ ID NO: 4421723 - DNA, 14 bp, Homo sapiens
atttttaatgtatc

SEQ ID NO: 4421724 - DNA, 15 bp, Homo sapiens
atttttaatgtatct

SEQ ID NO: 4421725 - DNA, 16 bp, Homo sapiens
atttttaatgtatcta

SEQ ID NO: 4421726 - DNA, 20 bp, Homo sapiens
atttttaatgtatctatttg

SEQ ID NO: 4421727 - DNA, 22 bp, Homo sapiens
atttttaatgtatctatttgta

SEQ ID NO: 4421728 - DNA, 16 bp, Homo sapiens
atttttacaagttata

SEQ ID NO: 4421729 - DNA, 16 bp, Homo sapiens
atttttacagctactt

SEQ ID NO: 4421730 - DNA, 16 bp, Homo sapiens
atttttacctgctttt

SEQ ID NO: 4421731 - DNA, 21 bp, Homo sapiens
atttttagaattaaaaaagca

SEQ ID NO: 4421732 - DNA, 18 bp, Homo sapiens
atttttagactatttctt

SEQ ID NO: 4421733 - DNA, 22 bp, Homo sapiens
atttttagatggttacactgtt

SEQ ID NO: 4421734 - DNA, 20 bp, Homo sapiens
atttttagccccaaatctct

SEQ ID NO: 4421735 - DNA, 19 bp, Homo sapiens
atttttatacaagtaattt

SEQ ID NO: 4421736 - DNA, 21 bp, Homo sapiens
atttttatataatatctaaag

SEQ ID NO: 4421737 - DNA, 23 bp, Homo sapiens
atttttatataatatctaaagtt

SEQ ID NO: 4421738 - DNA, 18 bp, Homo sapiens
atttttatattagttgct

SEQ ID NO: 4421739 - DNA, 17 bp, Homo sapiens
atttttatgccacctga

SEQ ID NO: 4421740 - DNA, 22 bp, Homo sapiens
atttttattaattttagttttt

SEQ ID NO: 4421741 - DNA, 14 bp, Homo sapiens
atttttatttatga

SEQ ID NO: 4421742 - DNA, 16 bp, Homo sapiens
atttttatttcagatt

SEQ ID NO: 4421743 - DNA, 20 bp, Homo sapiens
atttttatttcagattttga

SEQ ID NO: 4421744 - DNA, 12 bp, Homo sapiens
atttttatttct

SEQ ID NO: 4421745 - DNA, 14 bp, Homo sapiens
atttttatttcttt

SEQ ID NO: 4421746 - DNA, 14 bp, Homo sapiens
atttttcaaagcaa

SEQ ID NO: 4421747 - DNA, 17 bp, Homo sapiens
atttttcaactttgaat

SEQ ID NO: 4421748 - DNA, 20 bp, Homo sapiens
atttttcaatagcacatatg

SEQ ID NO: 4421749 - DNA, 16 bp, Homo sapiens
atttttcagatataaa

SEQ ID NO: 4421750 - DNA, 18 bp, Homo sapiens
atttttcatgataatgaa

SEQ ID NO: 4421751 - DNA, 13 bp, Homo sapiens
atttttcattcat

SEQ ID NO: 4421752 - DNA, 16 bp, Homo sapiens
atttttcattcatgaa

SEQ ID NO: 4421753 - DNA, 14 bp, Homo sapiens
atttttcctgtcct

SEQ ID NO: 4421754 - DNA, 22 bp, Homo sapiens
atttttctatatatttgtttca

SEQ ID NO: 4421755 - DNA, 12 bp, Homo sapiens
atttttctcatg

SEQ ID NO: 4421756 - DNA, 15 bp, Homo sapiens
atttttctcccaaga

SEQ ID NO: 4421757 - DNA, 18 bp, Homo sapiens
atttttctcccaagaaac

SEQ ID NO: 4421758 - DNA, 20 bp, Homo sapiens
atttttctcccaagaaacct

SEQ ID NO: 4421759 - DNA, 21 bp, Homo sapiens
atttttctcccaagaaacctg

SEQ ID NO: 4421760 - DNA, 15 bp, Homo sapiens
atttttctctcctgt

SEQ ID NO: 4421761 - DNA, 13 bp, Homo sapiens
atttttctcttgt

SEQ ID NO: 4421762 - DNA, 14 bp, Homo sapiens
atttttctcttgta

SEQ ID NO: 4421763 - DNA, 18 bp, Homo sapiens
atttttctcttgtaccat

SEQ ID NO: 4421764 - DNA, 22 bp, Homo sapiens
atttttctgacttttacagatt

SEQ ID NO: 4421765 - DNA, 15 bp, Homo sapiens
atttttcttatttca

SEQ ID NO: 4421766 - DNA, 22 bp, Homo sapiens
atttttcttttattcttctttc

SEQ ID NO: 4421767 - DNA, 18 bp, Homo sapiens
atttttgaaactgcattt

SEQ ID NO: 4421768 - DNA, 18 bp, Homo sapiens
atttttgacatggaaatg

SEQ ID NO: 4421769 - DNA, 21 bp, Homo sapiens
atttttgatactaagcattga

SEQ ID NO: 4421770 - DNA, 20 bp, Homo sapiens
atttttgatgtatatatcta

SEQ ID NO: 4421771 - DNA, 12 bp, Homo sapiens
atttttgcaata

SEQ ID NO: 4421772 - DNA, 18 bp, Homo sapiens
atttgtttcatctatttt

SEQ ID NO: 4421773 - DNA, 13 bp, Homo sapiens
atttgtttgtgtt

SEQ ID NO: 4421774 - DNA, 17 bp, Homo sapiens
atttgtttgtgtttatg

SEQ ID NO: 4421775 - DNA, 18 bp, Homo sapiens
attttaaaaaacactgat

SEQ ID NO: 4421776 - DNA, 20 bp, Homo sapiens
attttaaaagcaattatatt

SEQ ID NO: 4421777 - DNA, 14 bp, Homo sapiens
attttaaaatatat

SEQ ID NO: 4421778 - DNA, 17 bp, Homo sapiens
attttaaaatatatgaa

SEQ ID NO: 4421779 - DNA, 13 bp, Homo sapiens
attttaaaatcag

SEQ ID NO: 4421780 - DNA, 14 bp, Homo sapiens
attttaaaatgttt

SEQ ID NO: 4421781 - DNA, 15 bp, Homo sapiens
attttaaaattggta

SEQ ID NO: 4421782 - DNA, 16 bp, Homo sapiens
attttaaaatttcata

SEQ ID NO: 4421783 - DNA, 17 bp, Homo sapiens
attttaaaatttgttct

SEQ ID NO: 4421784 - DNA, 12 bp, Homo sapiens
attttaaagaat

SEQ ID NO: 4421785 - DNA, 12 bp, Homo sapiens
attttaaagaca

SEQ ID NO: 4421786 - DNA, 17 bp, Homo sapiens
attttaaagttcttatt

SEQ ID NO: 4421787 - DNA, 12 bp, Homo sapiens
attttaaatgaa

SEQ ID NO: 4421788 - DNA, 14 bp, Homo sapiens
attttaaatgaaag

SEQ ID NO: 4421789 - DNA, 14 bp, Homo sapiens
attttaaattataa

SEQ ID NO: 4421790 - DNA, 18 bp, Homo sapiens
attttaaattataaggac

SEQ ID NO: 4421791 - DNA, 20 bp, Homo sapiens
attttaaattataaggactg

SEQ ID NO: 4421792 - DNA, 19 bp, Homo sapiens
attttaaattccactgaaa

SEQ ID NO: 4421793 - DNA, 19 bp, Homo sapiens
attttaaattctcataagt

SEQ ID NO: 4421794 - DNA, 17 bp, Homo sapiens
attttaaatttctttta

SEQ ID NO: 4421795 - DNA, 16 bp, Homo sapiens
attttaaattttatgt

SEQ ID NO: 4421796 - DNA, 21 bp, Homo sapiens
attttaacctgtatactcttg

SEQ ID NO: 4421797 - DNA, 16 bp, Homo sapiens
attttaacgctgccta

SEQ ID NO: 4421798 - DNA, 16 bp, Homo sapiens
attttaactaaatttt

SEQ ID NO: 4421799 - DNA, 18 bp, Homo sapiens
attttaactaaattttaa

SEQ ID NO: 4421800 - DNA, 15 bp, Homo sapiens
attttaactggcatg

SEQ ID NO: 4421801 - DNA, 16 bp, Homo sapiens
attttaactggcatgt

SEQ ID NO: 4421802 - DNA, 21 bp, Homo sapiens
attttaactggcatgtcattt

SEQ ID NO: 4421803 - DNA, 17 bp, Homo sapiens
attttaagacgtgaatg

SEQ ID NO: 4421804 - DNA, 17 bp, Homo sapiens
attttaagatccagaaa

SEQ ID NO: 4421805 - DNA, 17 bp, Homo sapiens
attttaagtaacgtgct

SEQ ID NO: 4421806 - DNA, 20 bp, Homo sapiens
attttaagtccctgtcacct

SEQ ID NO: 4421807 - DNA, 13 bp, Homo sapiens
attttaataaagt

SEQ ID NO: 4421808 - DNA, 20 bp, Homo sapiens
attttaatagggaatatatc

SEQ ID NO: 4421809 - DNA, 16 bp, Homo sapiens
attttaatatataatt

SEQ ID NO: 4421810 - DNA, 14 bp, Homo sapiens
attttaatcattat

SEQ ID NO: 4421811 - DNA, 23 bp, Homo sapiens
attttaatggattgttaatttca

SEQ ID NO: 4421812 - DNA, 22 bp, Homo sapiens
attttaatggtatgtacaagtt

SEQ ID NO: 4421813 - DNA, 18 bp, Homo sapiens
attttaattcaagaaatg

SEQ ID NO: 4421814 - DNA, 20 bp, Homo sapiens
attttaattcaagaaatgac

SEQ ID NO: 4421815 - DNA, 15 bp, Homo sapiens
attttaatttagtaa

SEQ ID NO: 4421816 - DNA, 16 bp, Homo sapiens
attttaatttcaggaa

SEQ ID NO: 4421817 - DNA, 17 bp, Homo sapiens
attttaattttaaagag

SEQ ID NO: 4421818 - DNA, 21 bp, Homo sapiens
attttacaagtataacagttt

SEQ ID NO: 4421819 - DNA, 12 bp, Homo sapiens
attttacagtaa

SEQ ID NO: 4421820 - DNA, 18 bp, Homo sapiens
attttacagtaaatgtta

SEQ ID NO: 4421821 - DNA, 23 bp, Homo sapiens
attttacatgaagctgtataatt

SEQ ID NO: 4421822 - DNA, 12 bp, Homo sapiens
attttacattaa

SEQ ID NO: 4421823 - DNA, 15 bp, Homo sapiens
attttacattaaatt

SEQ ID NO: 4421824 - DNA, 13 bp, Homo sapiens
attttaccaaagc

SEQ ID NO: 4421825 - DNA, 22 bp, Homo sapiens
attttaccaaagcatcaataca

SEQ ID NO: 4421826 - DNA, 22 bp, Homo sapiens
attttacctgtttttgtttctt

SEQ ID NO: 4421827 - DNA, 18 bp, Homo sapiens
attttacttttctgccaa

SEQ ID NO: 4421828 - DNA, 20 bp, Homo sapiens
attttacttttctgccaaaa

SEQ ID NO: 4421829 - DNA, 21 bp, Homo sapiens
attttagaaacccctctgtag

SEQ ID NO: 4421830 - DNA, 15 bp, Homo sapiens
attttagaaagctaa

SEQ ID NO: 4421831 - DNA, 13 bp, Homo sapiens
attttagaaatat

SEQ ID NO: 4421832 - DNA, 15 bp, Homo sapiens
attttagatgtagat

SEQ ID NO: 4421833 - DNA, 19 bp, Homo sapiens
attttagcaaatcagtata

SEQ ID NO: 4421834 - DNA, 14 bp, Homo sapiens
attttagcagttct

SEQ ID NO: 4421835 - DNA, 16 bp, Homo sapiens
attttagctgcagaac

SEQ ID NO: 4421836 - DNA, 13 bp, Homo sapiens
attttaggaaagg

SEQ ID NO: 4421837 - DNA, 21 bp, Homo sapiens
attttagggttctaaatgcaa

SEQ ID NO: 4421838 - DNA, 16 bp, Homo sapiens
attttaggtgctgtta

SEQ ID NO: 4421839 - DNA, 18 bp, Homo sapiens
attttagtgtattaatca

SEQ ID NO: 4421840 - DNA, 20 bp, Homo sapiens
attttagtgtattaatcata

SEQ ID NO: 4421841 - DNA, 17 bp, Homo sapiens
attttagtgtgtaaaat

SEQ ID NO: 4421842 - DNA, 21 bp, Homo sapiens
attttagtgtgtaaaattaat

SEQ ID NO: 4421843 - DNA, 19 bp, Homo sapiens
attttagttcacacttagt

SEQ ID NO: 4421844 - DNA, 21 bp, Homo sapiens
attttataggggatacttgaa

SEQ ID NO: 4421845 - DNA, 22 bp, Homo sapiens
attttatataataaagtattcc

SEQ ID NO: 4421846 - DNA, 21 bp, Homo sapiens
attttatatcaatttaaaaaa

SEQ ID NO: 4421847 - DNA, 21 bp, Homo sapiens
attttatatcatacagttttc

SEQ ID NO: 4421848 - DNA, 18 bp, Homo sapiens
attttatatgcttactga

SEQ ID NO: 4421849 - DNA, 16 bp, Homo sapiens
attttatatgtaaatg

SEQ ID NO: 4421850 - DNA, 15 bp, Homo sapiens
attttatattacact

SEQ ID NO: 4421851 - DNA, 21 bp, Homo sapiens
attttatcatcctttcagttt

SEQ ID NO: 4421852 - DNA, 22 bp, Homo sapiens
attttatcctgtattcttgttt

SEQ ID NO: 4421853 - DNA, 22 bp, Homo sapiens
attttatctgtttcctgacatt

SEQ ID NO: 4421854 - DNA, 13 bp, Homo sapiens
attttatgaacat

SEQ ID NO: 4421855 - DNA, 22 bp, Homo sapiens
attttatgaacattgtactgtt

SEQ ID NO: 4421856 - DNA, 15 bp, Homo sapiens
attttatgagacagg

SEQ ID NO: 4421857 - DNA, 20 bp, Homo sapiens
attttatggcacctatttct

SEQ ID NO: 4421858 - DNA, 22 bp, Homo sapiens
attttatgttaagggaagaatt

SEQ ID NO: 4421859 - DNA, 16 bp, Homo sapiens
attttattaataatat

SEQ ID NO: 4421860 - DNA, 22 bp, Homo sapiens
attttattaataatatttatgt

SEQ ID NO: 4421861 - DNA, 15 bp, Homo sapiens
attttattacatatg

SEQ ID NO: 4421862 - DNA, 21 bp, Homo sapiens
attttattgaatactgtctgt

SEQ ID NO: 4421863 - DNA, 17 bp, Homo sapiens
attttatttagacaaga

SEQ ID NO: 4421864 - DNA, 22 bp, Homo sapiens
attttatttagacaagagatgg

SEQ ID NO: 4421865 - DNA, 18 bp, Homo sapiens
attttatttcaatgtaat

SEQ ID NO: 4421866 - DNA, 17 bp, Homo sapiens
attttattttattgaat

SEQ ID NO: 4421867 - DNA, 15 bp, Homo sapiens
attttattttgtaat

SEQ ID NO: 4421868 - DNA, 14 bp, Homo sapiens
attttcaaatcctt

SEQ ID NO: 4421869 - DNA, 15 bp, Homo sapiens
attttcaaatcctta

SEQ ID NO: 4421870 - DNA, 22 bp, Homo sapiens
attttcaaatgtaaactctctt

SEQ ID NO: 4421871 - DNA, 23 bp, Homo sapiens
attttcaagtttttcatactgta

SEQ ID NO: 4421872 - DNA, 15 bp, Homo sapiens
attttcacattcttg

SEQ ID NO: 4421873 - DNA, 19 bp, Homo sapiens
attttcacattcttggctt

SEQ ID NO: 4421874 - DNA, 14 bp, Homo sapiens
attttcacttttaa

SEQ ID NO: 4421875 - DNA, 20 bp, Homo sapiens
attttcagaatctgaatgta

SEQ ID NO: 4421876 - DNA, 17 bp, Homo sapiens
attttcagcaaactctt

SEQ ID NO: 4421877 - DNA, 23 bp, Homo sapiens
attttcagggttttaaacactaa

SEQ ID NO: 4421878 - DNA, 22 bp, Homo sapiens
attttcagtaatgttattttct

SEQ ID NO: 4421879 - DNA, 15 bp, Homo sapiens
attttcataacttat

SEQ ID NO: 4421880 - DNA, 21 bp, Homo sapiens
attttcataagtatttcaaat

SEQ ID NO: 4421881 - DNA, 22 bp, Homo sapiens
attttcataagtatttcaaatt

SEQ ID NO: 4421882 - DNA, 12 bp, Homo sapiens
attttcatcccg

SEQ ID NO: 4421883 - DNA, 18 bp, Homo sapiens
attttcattctgccaaag

SEQ ID NO: 4421884 - DNA, 13 bp, Homo sapiens
attttccagcctt

SEQ ID NO: 4421885 - DNA, 20 bp, Homo sapiens
attttccagccttatgtgtt

SEQ ID NO: 4421886 - DNA, 22 bp, Homo sapiens
attttccagccttatgtgttac

SEQ ID NO: 4421887 - DNA, 17 bp, Homo sapiens
attttccataaatttgg

SEQ ID NO: 4421888 - DNA, 13 bp, Homo sapiens
attttcccaatga

SEQ ID NO: 4421889 - DNA, 22 bp, Homo sapiens
attttcccactcattctgaatt

SEQ ID NO: 4421890 - DNA, 15 bp, Homo sapiens
attttccccccactc

SEQ ID NO: 4421891 - DNA, 15 bp, Homo sapiens
attttcctaatgtga

SEQ ID NO: 4421892 - DNA, 15 bp, Homo sapiens
atttcgcttcttaga

SEQ ID NO: 4421893 - DNA, 19 bp, Homo sapiens
atttcggattttttccaaa

SEQ ID NO: 4421894 - DNA, 12 bp, Homo sapiens
atttctaaagta

SEQ ID NO: 4421895 - DNA, 21 bp, Homo sapiens
atttctaaagtaaaattgaag

SEQ ID NO: 4421896 - DNA, 14 bp, Homo sapiens
atttctaaattaag

SEQ ID NO: 4421897 - DNA, 21 bp, Homo sapiens
atttctaatccttttccttat

SEQ ID NO: 4421898 - DNA, 14 bp, Homo sapiens
atttctaatgttta

SEQ ID NO: 4421899 - DNA, 16 bp, Homo sapiens
atttctaatgtttact

SEQ ID NO: 4421900 - DNA, 13 bp, Homo sapiens
atttctactatga

SEQ ID NO: 4421901 - DNA, 13 bp, Homo sapiens
atttctactctag

SEQ ID NO: 4421902 - DNA, 16 bp, Homo sapiens
atttctagcctgcact

SEQ ID NO: 4421903 - DNA, 16 bp, Homo sapiens
atttctagctttttaa

SEQ ID NO: 4421904 - DNA, 20 bp, Homo sapiens
atttctataaatttaagaaa

SEQ ID NO: 4421905 - DNA, 16 bp, Homo sapiens
atttctatggctttca

SEQ ID NO: 4421906 - DNA, 19 bp, Homo sapiens
atttctatggctttcaaag

SEQ ID NO: 4421907 - DNA, 15 bp, Homo sapiens
atttctatgtcattt

SEQ ID NO: 4421908 - DNA, 14 bp, Homo sapiens
atttctattattaa

SEQ ID NO: 4421909 - DNA, 15 bp, Homo sapiens
atttctccatacgca

SEQ ID NO: 4421910 - DNA, 16 bp, Homo sapiens
atttctccatcccctc

SEQ ID NO: 4421911 - DNA, 17 bp, Homo sapiens
atttctccatcccctcc

SEQ ID NO: 4421912 - DNA, 18 bp, Homo sapiens
atttctccatcccctccc

SEQ ID NO: 4421913 - DNA, 18 bp, Homo sapiens
atttctcgggtgcatttg

SEQ ID NO: 4421914 - DNA, 19 bp, Homo sapiens
atttctctggcaaactttt

SEQ ID NO: 4421915 - DNA, 16 bp, Homo sapiens
atttctgaactgttac

SEQ ID NO: 4421916 - DNA, 17 bp, Homo sapiens
atttctgaactgttaca

SEQ ID NO: 4421917 - DNA, 23 bp, Homo sapiens
atttctgaagaagttaattctta

SEQ ID NO: 4421918 - DNA, 22 bp, Homo sapiens
atttctgatttcataattcaga

SEQ ID NO: 4421919 - DNA, 13 bp, Homo sapiens
atttctgcatatg

SEQ ID NO: 4421920 - DNA, 23 bp, Homo sapiens
atttctgcatatgttgaatactt

SEQ ID NO: 4421921 - DNA, 20 bp, Homo sapiens
atttctgccaagtcagttct

SEQ ID NO: 4421922 - DNA, 21 bp, Homo sapiens
atttctgcccttgttccagct

SEQ ID NO: 4421923 - DNA, 15 bp, Homo sapiens
atttctgctctggaa

SEQ ID NO: 4421924 - DNA, 18 bp, Homo sapiens
atttctgctctggaataa

SEQ ID NO: 4421925 - DNA, 21 bp, Homo sapiens
atttctgctctggaataaagt

SEQ ID NO: 4421926 - DNA, 15 bp, Homo sapiens
atttctgtgaaagaa

SEQ ID NO: 4421927 - DNA, 17 bp, Homo sapiens
atttctgtgaaagaagt

SEQ ID NO: 4421928 - DNA, 19 bp, Homo sapiens
atttctgtgaagttgaata

SEQ ID NO: 4421929 - DNA, 23 bp, Homo sapiens
atttctgttatttttaagctttt

SEQ ID NO: 4421930 - DNA, 22 bp, Homo sapiens
atttctgtttcctatttaatac

SEQ ID NO: 4421931 - DNA, 23 bp, Homo sapiens
atttctgtttcctatttaataca

SEQ ID NO: 4421932 - DNA, 19 bp, Homo sapiens
atttcttaaattattttat

SEQ ID NO: 4421933 - DNA, 14 bp, Homo sapiens
atttcttaacttct

SEQ ID NO: 4421934 - DNA, 19 bp, Homo sapiens
atttcttaacttcttgctt

SEQ ID NO: 4421935 - DNA, 14 bp, Homo sapiens
atttcttaagaatt

SEQ ID NO: 4421936 - DNA, 12 bp, Homo sapiens
atttatgagatt

SEQ ID NO: 4421937 - DNA, 16 bp, Homo sapiens
atttatgggtggattt

SEQ ID NO: 4421938 - DNA, 15 bp, Homo sapiens
atttatggttgttaa

SEQ ID NO: 4421939 - DNA, 15 bp, Homo sapiens
atttatgtactctct

SEQ ID NO: 4421940 - DNA, 18 bp, Homo sapiens
atttatgtgaaatgcttt

SEQ ID NO: 4421941 - DNA, 13 bp, Homo sapiens
atttatgtgaaca

SEQ ID NO: 4421942 - DNA, 12 bp, Homo sapiens
atttatgtgcta

SEQ ID NO: 4421943 - DNA, 13 bp, Homo sapiens
atttattaaactt

SEQ ID NO: 4421944 - DNA, 19 bp, Homo sapiens
atttattaaacttcagcaa

SEQ ID NO: 4421945 - DNA, 12 bp, Homo sapiens
atttattacata

SEQ ID NO: 4421946 - DNA, 19 bp, Homo sapiens
atttattactaacctccct

SEQ ID NO: 4421947 - DNA, 21 bp, Homo sapiens
atttattattaatttattggg

SEQ ID NO: 4421948 - DNA, 21 bp, Homo sapiens
atttattattttttttatatt

SEQ ID NO: 4421949 - DNA, 22 bp, Homo sapiens
atttattcattatttgtcaaat

SEQ ID NO: 4421950 - DNA, 18 bp, Homo sapiens
atttattctacttttaaa

SEQ ID NO: 4421951 - DNA, 13 bp, Homo sapiens
atttattgaaatg

SEQ ID NO: 4421952 - DNA, 12 bp, Homo sapiens
atttattgatta

SEQ ID NO: 4421953 - DNA, 20 bp, Homo sapiens
atttattgattaaaaatgtg

SEQ ID NO: 4421954 - DNA, 14 bp, Homo sapiens
atttattgtctgtc

SEQ ID NO: 4421955 - DNA, 16 bp, Homo sapiens
atttattgtctgtcta

SEQ ID NO: 4421956 - DNA, 19 bp, Homo sapiens
atttattgtctgtctacat

SEQ ID NO: 4421957 - DNA, 18 bp, Homo sapiens
atttattgttagaaaatg

SEQ ID NO: 4421958 - DNA, 15 bp, Homo sapiens
atttatttaaaactc

SEQ ID NO: 4421959 - DNA, 14 bp, Homo sapiens
atttatttaaaata

SEQ ID NO: 4421960 - DNA, 16 bp, Homo sapiens
atttatttaaaatagc

SEQ ID NO: 4421961 - DNA, 15 bp, Homo sapiens
atttatttaatattt

SEQ ID NO: 4421962 - DNA, 18 bp, Homo sapiens
atttatttaatatttaat

SEQ ID NO: 4421963 - DNA, 16 bp, Homo sapiens
atttatttacactctt

SEQ ID NO: 4421964 - DNA, 15 bp, Homo sapiens
atttatttagctatt

SEQ ID NO: 4421965 - DNA, 15 bp, Homo sapiens
atttatttattatta

SEQ ID NO: 4421966 - DNA, 16 bp, Homo sapiens
atttatttatttattc

SEQ ID NO: 4421967 - DNA, 18 bp, Homo sapiens
atttatttccaatgtttc

SEQ ID NO: 4421968 - DNA, 22 bp, Homo sapiens
atttatttctagttctttcctc

SEQ ID NO: 4421969 - DNA, 12 bp, Homo sapiens
atttatttgcaa

SEQ ID NO: 4421970 - DNA, 19 bp, Homo sapiens
atttattttattctatgta

SEQ ID NO: 4421971 - DNA, 20 bp, Homo sapiens
atttattttattttagcagt

SEQ ID NO: 4421972 - DNA, 13 bp, Homo sapiens
atttattttgaca

SEQ ID NO: 4421973 - DNA, 15 bp, Homo sapiens
atttattttgtatga

SEQ ID NO: 4421974 - DNA, 22 bp, Homo sapiens
atttattttgtatgaaatatat

SEQ ID NO: 4421975 - DNA, 12 bp, Homo sapiens
atttatttttgt

SEQ ID NO: 4421976 - DNA, 22 bp, Homo sapiens
atttattttttcttttctttac

SEQ ID NO: 4421977 - DNA, 13 bp, Homo sapiens
atttaaatgattt

SEQ ID NO: 4421978 - DNA, 22 bp, Homo sapiens
atttaaattccacagattatca

SEQ ID NO: 4421979 - DNA, 14 bp, Homo sapiens
atttaaattctttt

SEQ ID NO: 4421980 - DNA, 16 bp, Homo sapiens
atttaaattctttttt

SEQ ID NO: 4421981 - DNA, 18 bp, Homo sapiens
atttaacaaaaaatgtaa

SEQ ID NO: 4421982 - DNA, 20 bp, Homo sapiens
atttaacaaaaagtgcttca

SEQ ID NO: 4421983 - DNA, 18 bp, Homo sapiens
atttaacagaaattgtat

SEQ ID NO: 4421984 - DNA, 20 bp, Homo sapiens
atttaacagaaattgtatat

SEQ ID NO: 4421985 - DNA, 14 bp, Homo sapiens
atttaacattgttt

SEQ ID NO: 4421986 - DNA, 12 bp, Homo sapiens
atttaacatttt

SEQ ID NO: 4421987 - DNA, 18 bp, Homo sapiens
atttaacctgttatttct

SEQ ID NO: 4421988 - DNA, 19 bp, Homo sapiens
atttaacctgttatttcta

SEQ ID NO: 4421989 - DNA, 18 bp, Homo sapiens
atttaactacccttaatt

SEQ ID NO: 4421990 - DNA, 22 bp, Homo sapiens
atttaactacccttaattactt

SEQ ID NO: 4421991 - DNA, 12 bp, Homo sapiens
atttaactcttt

SEQ ID NO: 4421992 - DNA, 18 bp, Homo sapiens
atttaactgattaaaaat

SEQ ID NO: 4421993 - DNA, 16 bp, Homo sapiens
atttaagaatttgttt

SEQ ID NO: 4421994 - DNA, 15 bp, Homo sapiens
atttaagatgtacat

SEQ ID NO: 4421995 - DNA, 18 bp, Homo sapiens
atttaagatgtacattta

SEQ ID NO: 4421996 - DNA, 19 bp, Homo sapiens
atttaagatgtacatttaa

SEQ ID NO: 4421997 - DNA, 22 bp, Homo sapiens
atttaagatgtacatttaataa

SEQ ID NO: 4421998 - DNA, 16 bp, Homo sapiens
atttaagcaaatactt

SEQ ID NO: 4421999 - DNA, 17 bp, Homo sapiens
atttaagcaaatactta

SEQ ID NO: 4422000 - DNA, 22 bp, Homo sapiens
atttaagcaaatacttagcaaa

SEQ ID NO: 4422001 - DNA, 19 bp, Homo sapiens
atttaagcataatctgaaa

SEQ ID NO: 4422002 - DNA, 17 bp, Homo sapiens
atttaagctttaaatga

SEQ ID NO: 4422003 - DNA, 19 bp, Homo sapiens
atttaagctttaaatgaca

SEQ ID NO: 4422004 - DNA, 13 bp, Homo sapiens
atttaagggaaaa

SEQ ID NO: 4422005 - DNA, 14 bp, Homo sapiens
atttaagtgaagga

SEQ ID NO: 4422006 - DNA, 18 bp, Homo sapiens
atttaagtgttggaaaaa

SEQ ID NO: 4422007 - DNA, 12 bp, Homo sapiens
atttaagtttgt

SEQ ID NO: 4422008 - DNA, 18 bp, Homo sapiens
atttaataaaaaggaata

SEQ ID NO: 4422009 - DNA, 14 bp, Homo sapiens
atttaataatatca

SEQ ID NO: 4422010 - DNA, 17 bp, Homo sapiens
atttaatagcaaagaat

SEQ ID NO: 4422011 - DNA, 18 bp, Homo sapiens
atttaatccttctttgta

SEQ ID NO: 4422012 - DNA, 23 bp, Homo sapiens
atttaatggaagtgtatttattt

SEQ ID NO: 4422013 - DNA, 13 bp, Homo sapiens
aggaaaagaaaag

SEQ ID NO: 4422014 - DNA, 17 bp, Homo sapiens
aggaaaaggcccctgca

SEQ ID NO: 4422015 - DNA, 20 bp, Homo sapiens
aggaaaaggctaagaaaaag

SEQ ID NO: 4422016 - DNA, 13 bp, Homo sapiens
aggaaaaggttaa

SEQ ID NO: 4422017 - DNA, 16 bp, Homo sapiens
aggaaaagtgcaatgc

SEQ ID NO: 4422018 - DNA, 14 bp, Homo sapiens
aggaaaatcctctg

SEQ ID NO: 4422019 - DNA, 15 bp, Homo sapiens
aggaaaatgtattga

SEQ ID NO: 4422020 - DNA, 17 bp, Homo sapiens
aggaaaccttttcttgt

SEQ ID NO: 4422021 - DNA, 19 bp, Homo sapiens
aggaaactccacatctgcc

SEQ ID NO: 4422022 - DNA, 22 bp, Homo sapiens
aggaaactccacatctgcctta

SEQ ID NO: 4422023 - DNA, 22 bp, Homo sapiens
aggaaactcctgtgaccacaac

SEQ ID NO: 4422024 - DNA, 13 bp, Homo sapiens
aggaaagcaagaa

SEQ ID NO: 4422025 - DNA, 22 bp, Homo sapiens
aggaaagcaataaatgaatggg

SEQ ID NO: 4422026 - DNA, 15 bp, Homo sapiens
aggaaagcatgcatt

SEQ ID NO: 4422027 - DNA, 21 bp, Homo sapiens
aggaaagcatgcattgaaaaa

SEQ ID NO: 4422028 - DNA, 13 bp, Homo sapiens
aggaaagccctcc

SEQ ID NO: 4422029 - DNA, 20 bp, Homo sapiens
aggaaaggagagtactttgg

SEQ ID NO: 4422030 - DNA, 15 bp, Homo sapiens
aggaaaggattttac

SEQ ID NO: 4422031 - DNA, 21 bp, Homo sapiens
aggaaaggattttaccaaagc

SEQ ID NO: 4422032 - DNA, 22 bp, Homo sapiens
aggaaaggattttaccaaagca

SEQ ID NO: 4422033 - DNA, 15 bp, Homo sapiens
aggaaaggctcattt

SEQ ID NO: 4422034 - DNA, 13 bp, Homo sapiens
aggaaagggctgg

SEQ ID NO: 4422035 - DNA, 18 bp, Homo sapiens
aggaaataaaaaagtctc

SEQ ID NO: 4422036 - DNA, 21 bp, Homo sapiens
aggaaatagtaccttcaatac

SEQ ID NO: 4422037 - DNA, 20 bp, Homo sapiens
aggaaatattaagagctatt

SEQ ID NO: 4422038 - DNA, 13 bp, Homo sapiens
aggaacaaacagg

SEQ ID NO: 4422039 - DNA, 14 bp, Homo sapiens
aggaacaaacaggg

SEQ ID NO: 4422040 - DNA, 14 bp, Homo sapiens
aggaacaaagacag

SEQ ID NO: 4422041 - DNA, 21 bp, Homo sapiens
aggaacagctatgggagcccc

SEQ ID NO: 4422042 - DNA, 13 bp, Homo sapiens
aggaaccaacaat

SEQ ID NO: 4422043 - DNA, 20 bp, Homo sapiens
aggaaccacaatgtttcttc

SEQ ID NO: 4422044 - DNA, 16 bp, Homo sapiens
aggaacctcgagtact

SEQ ID NO: 4422045 - DNA, 19 bp, Homo sapiens
aggaaccttccttcctgct

SEQ ID NO: 4422046 - DNA, 22 bp, Homo sapiens
aggaaccttccttcctgcttga

SEQ ID NO: 4422047 - DNA, 16 bp, Homo sapiens
aggaactctcctgtgg

SEQ ID NO: 4422048 - DNA, 15 bp, Homo sapiens
aggaactgtacagaa

SEQ ID NO: 4422049 - DNA, 14 bp, Homo sapiens
aggaacttccaggt

SEQ ID NO: 4422050 - DNA, 15 bp, Homo sapiens
aggaacttgccctga

SEQ ID NO: 4422051 - DNA, 22 bp, Homo sapiens
aggaagaacggggctcttctca

SEQ ID NO: 4422052 - DNA, 16 bp, Homo sapiens
aggaagaacgtttttt

SEQ ID NO: 4422053 - DNA, 22 bp, Homo sapiens
attctgagttttgtgtttgttg

SEQ ID NO: 4422054 - DNA, 23 bp, Homo sapiens
attctgagttttgtgtttgttgt

SEQ ID NO: 4422055 - DNA, 20 bp, Homo sapiens
attctgcagtaaatctttta

SEQ ID NO: 4422056 - DNA, 12 bp, Homo sapiens
attctgccaaag

SEQ ID NO: 4422057 - DNA, 13 bp, Homo sapiens
attctgccaaagt

SEQ ID NO: 4422058 - DNA, 16 bp, Homo sapiens
attctgccaaagtaaa

SEQ ID NO: 4422059 - DNA, 17 bp, Homo sapiens
attctgccaaagtaaaa

SEQ ID NO: 4422060 - DNA, 18 bp, Homo sapiens
attctgccaaagtaaaac

SEQ ID NO: 4422061 - DNA, 16 bp, Homo sapiens
attctgcctatgtaaa

SEQ ID NO: 4422062 - DNA, 24 bp, Homo sapiens
attctgctacttcactgtcatctt

SEQ ID NO: 4422063 - DNA, 22 bp, Homo sapiens
attctgggcaccacaaaatata

SEQ ID NO: 4422064 - DNA, 15 bp, Homo sapiens
attctgtaatttgaa

SEQ ID NO: 4422065 - DNA, 16 bp, Homo sapiens
attctgtaatttgaat

SEQ ID NO: 4422066 - DNA, 20 bp, Homo sapiens
attctgtatctttcatcctt

SEQ ID NO: 4422067 - DNA, 21 bp, Homo sapiens
attctgtgtattaacatgcaa

SEQ ID NO: 4422068 - DNA, 22 bp, Homo sapiens
attctgtgttttcagactgcct

SEQ ID NO: 4422069 - DNA, 23 bp, Homo sapiens
attctgtgttttcagactgcctg

SEQ ID NO: 4422070 - DNA, 13 bp, Homo sapiens
attctgttatatg

SEQ ID NO: 4422071 - DNA, 14 bp, Homo sapiens
attctgttgcttta

SEQ ID NO: 4422072 - DNA, 19 bp, Homo sapiens
attctgttttgttaatata

SEQ ID NO: 4422073 - DNA, 22 bp, Homo sapiens
attctgttttgttaatataccc

SEQ ID NO: 4422074 - DNA, 13 bp, Homo sapiens
attcttaaaacta

SEQ ID NO: 4422075 - DNA, 19 bp, Homo sapiens
attcttaaaactataacat

SEQ ID NO: 4422076 - DNA, 18 bp, Homo sapiens
attcttaaaatgcaatat

SEQ ID NO: 4422077 - DNA, 21 bp, Homo sapiens
attcttaacttattacctcag

SEQ ID NO: 4422078 - DNA, 17 bp, Homo sapiens
attcttaccctttcttt

SEQ ID NO: 4422079 - DNA, 12 bp, Homo sapiens
attcttcatgaa

SEQ ID NO: 4422080 - DNA, 15 bp, Homo sapiens
attcttccatcatca

SEQ ID NO: 4422081 - DNA, 15 bp, Homo sapiens
attcttctaaagcac

SEQ ID NO: 4422082 - DNA, 16 bp, Homo sapiens
attcttctctgttgtc

SEQ ID NO: 4422083 - DNA, 13 bp, Homo sapiens
attcttctgaact

SEQ ID NO: 4422084 - DNA, 13 bp, Homo sapiens
attcttctgcaac

SEQ ID NO: 4422085 - DNA, 13 bp, Homo sapiens
attcttctgggtg

SEQ ID NO: 4422086 - DNA, 21 bp, Homo sapiens
attcttgctgttaaaaataat

SEQ ID NO: 4422087 - DNA, 17 bp, Homo sapiens
attcttggttgaggaaa

SEQ ID NO: 4422088 - DNA, 21 bp, Homo sapiens
attcttgtaaatctttttgct

SEQ ID NO: 4422089 - DNA, 13 bp, Homo sapiens
attcttgtttgaa

SEQ ID NO: 4422090 - DNA, 20 bp, Homo sapiens
attctttatagtgaagtgtt

SEQ ID NO: 4422091 - DNA, 21 bp, Homo sapiens
attctttatagtgaagtgtta

SEQ ID NO: 4422092 - DNA, 20 bp, Homo sapiens
attctttcccagtctgtcga

SEQ ID NO: 4422093 - DNA, 13 bp, Homo sapiens
attctttccccag

SEQ ID NO: 4422094 - DNA, 15 bp, Homo sapiens
attctttccccagag

SEQ ID NO: 4422095 - DNA, 19 bp, Homo sapiens
attctttgacctgttggga

SEQ ID NO: 4422096 - DNA, 20 bp, Homo sapiens
attctttgcttgaacacagt

SEQ ID NO: 4422097 - DNA, 16 bp, Homo sapiens
attctttgtttatgca

SEQ ID NO: 4422098 - DNA, 23 bp, Homo sapiens
attcttttaaattagaaaatatt

SEQ ID NO: 4422099 - DNA, 20 bp, Homo sapiens
attcttttcccatcaccaga

SEQ ID NO: 4422100 - DNA, 13 bp, Homo sapiens
attgaaaaacaat

SEQ ID NO: 4422101 - DNA, 19 bp, Homo sapiens
attgaaaaacaattttctg

SEQ ID NO: 4422102 - DNA, 17 bp, Homo sapiens
attgaaaaatttctaac

SEQ ID NO: 4422103 - DNA, 20 bp, Homo sapiens
attgaaaagaagtagtgtct

SEQ ID NO: 4422104 - DNA, 14 bp, Homo sapiens
attgaaaatggctt

SEQ ID NO: 4422105 - DNA, 16 bp, Homo sapiens
attgaaaattgaaaag

SEQ ID NO: 4422106 - DNA, 23 bp, Homo sapiens
attgaaaggggacacctgtacat

SEQ ID NO: 4422107 - DNA, 17 bp, Homo sapiens
attgaaatgctgtattt

SEQ ID NO: 4422108 - DNA, 20 bp, Homo sapiens
attgaaatgctgtattttta

SEQ ID NO: 4422109 - DNA, 22 bp, Homo sapiens
attgaaatgctgtatttttaca

SEQ ID NO: 4422110 - DNA, 23 bp, Homo sapiens
attgaacaaaaatgtttccactg

SEQ ID NO: 4422111 - DNA, 18 bp, Homo sapiens
attgaacacaaactgtaa

SEQ ID NO: 4422112 - DNA, 20 bp, Homo sapiens
attgaacacaaactgtaaat

SEQ ID NO: 4422113 - DNA, 22 bp, Homo sapiens
attgaacgactgtatattgcta

SEQ ID NO: 4422114 - DNA, 21 bp, Homo sapiens
attgaactacagcttgagaac

SEQ ID NO: 4422115 - DNA, 18 bp, Homo sapiens
attgaactggaataatat

SEQ ID NO: 4422116 - DNA, 19 bp, Homo sapiens
attgaacttactgtagcct

SEQ ID NO: 4422117 - DNA, 20 bp, Homo sapiens
attgaacttttgtactgaat

SEQ ID NO: 4422118 - DNA, 20 bp, Homo sapiens
attgaagcaactacaacttc

SEQ ID NO: 4422119 - DNA, 18 bp, Homo sapiens
attgaaggatcatctgaa

SEQ ID NO: 4422120 - DNA, 14 bp, Homo sapiens
attgaagtaatgaa

SEQ ID NO: 4422121 - DNA, 15 bp, Homo sapiens
attgaagtaatgaat

SEQ ID NO: 4422122 - DNA, 19 bp, Homo sapiens
attgaagtattttgctgga

SEQ ID NO: 4422123 - DNA, 18 bp, Homo sapiens
attgaagttgtttatcaa

SEQ ID NO: 4422124 - DNA, 16 bp, Homo sapiens
attgaagtttcaagtt

SEQ ID NO: 4422125 - DNA, 20 bp, Homo sapiens
attgaagtttcaagttttaa

SEQ ID NO: 4422126 - DNA, 22 bp, Homo sapiens
attgaatagtggaacattttca

SEQ ID NO: 4422127 - DNA, 20 bp, Homo sapiens
attgaatagtttatttctgt

SEQ ID NO: 4422128 - DNA, 22 bp, Homo sapiens
attgaatagtttatttctgtga

SEQ ID NO: 4422129 - DNA, 23 bp, Homo sapiens
attgaatggctatgtttttaatg

SEQ ID NO: 4422130 - DNA, 15 bp, Homo sapiens
attgaatgtgaaaca

SEQ ID NO: 4422131 - DNA, 13 bp, Homo sapiens
attgaattagaaa

SEQ ID NO: 4422132 - DNA, 16 bp, Homo sapiens
attgaattagaaaatt

SEQ ID NO: 4422133 - DNA, 18 bp, Homo sapiens
attgaatttttaagcaaa

SEQ ID NO: 4422134 - DNA, 19 bp, Homo sapiens
attgaatttttaagcaaat

SEQ ID NO: 4422135 - DNA, 23 bp, Homo sapiens
attgaatttttcctatgctattg

SEQ ID NO: 4422136 - DNA, 15 bp, Homo sapiens
attgacaataaaata

SEQ ID NO: 4422137 - DNA, 14 bp, Homo sapiens
attgacactgaact

SEQ ID NO: 4422138 - DNA, 15 bp, Homo sapiens
attgacacttaaaaa

SEQ ID NO: 4422139 - DNA, 17 bp, Homo sapiens
attgacacttaaaaatg

SEQ ID NO: 4422140 - DNA, 18 bp, Homo sapiens
attgacaggtcttttcaa

SEQ ID NO: 4422141 - DNA, 20 bp, Homo sapiens
attgacaggtcttttcaaat

SEQ ID NO: 4422142 - DNA, 17 bp, Homo sapiens
attgacattcctttgaa

SEQ ID NO: 4422143 - DNA, 18 bp, Homo sapiens
attgacccacaagaaatg

SEQ ID NO: 4422144 - DNA, 15 bp, Homo sapiens
attgactcaaaccat

SEQ ID NO: 4422145 - DNA, 15 bp, Homo sapiens
attgactgatgattt

SEQ ID NO: 4422146 - DNA, 20 bp, Homo sapiens
attgactgatgattttcctt

SEQ ID NO: 4422147 - DNA, 15 bp, Homo sapiens
attgacttcatttta

SEQ ID NO: 4422148 - DNA, 18 bp, Homo sapiens
attgacttcattttatat

SEQ ID NO: 4422149 - DNA, 23 bp, Homo sapiens
attgacttcattttatatttaaa

SEQ ID NO: 4422150 - DNA, 20 bp, Homo sapiens
attgagaaaaatatatacta

SEQ ID NO: 4422151 - DNA, 14 bp, Homo sapiens
attgagattttcca

SEQ ID NO: 4422152 - DNA, 18 bp, Homo sapiens
attgagcagaattcattc

SEQ ID NO: 4422153 - DNA, 15 bp, Homo sapiens
attgagtcttaactg

SEQ ID NO: 4422154 - DNA, 20 bp, Homo sapiens
attgagttcttcctgtaatc

SEQ ID NO: 4422155 - DNA, 15 bp, Homo sapiens
attgagttttcagtg

SEQ ID NO: 4422156 - DNA, 13 bp, Homo sapiens
attgataaatttt

SEQ ID NO: 4422157 - DNA, 15 bp, Homo sapiens
attgataaattttaa

SEQ ID NO: 4422158 - DNA, 19 bp, Homo sapiens
attgataaccttgaaaaaa

SEQ ID NO: 4422159 - DNA, 14 bp, Homo sapiens
attgatacattttt

SEQ ID NO: 4422160 - DNA, 22 bp, Homo sapiens
attgatacatttttaaatgtaa

SEQ ID NO: 4422161 - DNA, 20 bp, Homo sapiens
attgatatctccatgatgat

SEQ ID NO: 4422162 - DNA, 22 bp, Homo sapiens
attgatattatattaaacatac

SEQ ID NO: 4422163 - DNA, 18 bp, Homo sapiens
attgatcattttcccccc

SEQ ID NO: 4422164 - DNA, 16 bp, Homo sapiens
attgatcccttctcct

SEQ ID NO: 4422165 - DNA, 18 bp, Homo sapiens
attgatctttttatcatg

SEQ ID NO: 4422166 - DNA, 22 bp, Homo sapiens
attgatgtacagtctgtcatga

SEQ ID NO: 4422167 - DNA, 15 bp, Homo sapiens
attgatgttaagaac

SEQ ID NO: 4422168 - DNA, 14 bp, Homo sapiens
attgatttgaagaa

SEQ ID NO: 4422169 - DNA, 13 bp, Homo sapiens
attgatttgcatt

SEQ ID NO: 4422170 - DNA, 15 bp, Homo sapiens
attgatttgcattga

SEQ ID NO: 4422171 - DNA, 20 bp, Homo sapiens
attgatttgcattgaacaca

SEQ ID NO: 4422172 - DNA, 12 bp, Homo sapiens
attgcaaatatt

SEQ ID NO: 4422173 - DNA, 16 bp, Homo sapiens
attccactacacctgg

SEQ ID NO: 4422174 - DNA, 22 bp, Homo sapiens
attccactacacctggctgagg

SEQ ID NO: 4422175 - DNA, 13 bp, Homo sapiens
attccactgaaaa

SEQ ID NO: 4422176 - DNA, 20 bp, Homo sapiens
attccacttataggaattga

SEQ ID NO: 4422177 - DNA, 15 bp, Homo sapiens
attccagaatgctgt

SEQ ID NO: 4422178 - DNA, 13 bp, Homo sapiens
attccagacttca

SEQ ID NO: 4422179 - DNA, 14 bp, Homo sapiens
attccagatcccag

SEQ ID NO: 4422180 - DNA, 17 bp, Homo sapiens
attccagccagggtgac

SEQ ID NO: 4422181 - DNA, 12 bp, Homo sapiens
attccagctctg

SEQ ID NO: 4422182 - DNA, 16 bp, Homo sapiens
attccagctctgcccc

SEQ ID NO: 4422183 - DNA, 18 bp, Homo sapiens
attccagctctgcccccg

SEQ ID NO: 4422184 - DNA, 23 bp, Homo sapiens
attccatgaccagaaacagggac

SEQ ID NO: 4422185 - DNA, 12 bp, Homo sapiens
attccatgctaa

SEQ ID NO: 4422186 - DNA, 22 bp, Homo sapiens
attcccaacatttcttaaatta

SEQ ID NO: 4422187 - DNA, 19 bp, Homo sapiens
attcccaagccgaccttcc

SEQ ID NO: 4422188 - DNA, 15 bp, Homo sapiens
attcccagagtcaga

SEQ ID NO: 4422189 - DNA, 21 bp, Homo sapiens
attcccctccccactcctctc

SEQ ID NO: 4422190 - DNA, 16 bp, Homo sapiens
attcccgttttgtcac

SEQ ID NO: 4422191 - DNA, 18 bp, Homo sapiens
attcccgttttgtcactt

SEQ ID NO: 4422192 - DNA, 21 bp, Homo sapiens
attcccgttttgtcacttttt

SEQ ID NO: 4422193 - DNA, 20 bp, Homo sapiens
attccctagaaacttccaaa

SEQ ID NO: 4422194 - DNA, 13 bp, Homo sapiens
attccctcagcct

SEQ ID NO: 4422195 - DNA, 14 bp, Homo sapiens
attccctcagccta

SEQ ID NO: 4422196 - DNA, 20 bp, Homo sapiens
attccctgagtcaccaggaa

SEQ ID NO: 4422197 - DNA, 21 bp, Homo sapiens
attccctgcacacacatgcat

SEQ ID NO: 4422198 - DNA, 18 bp, Homo sapiens
attccctgcccaaaccct

SEQ ID NO: 4422199 - DNA, 20 bp, Homo sapiens
attccctgcccaaaccctta

SEQ ID NO: 4422200 - DNA, 19 bp, Homo sapiens
attccgattagacctttat

SEQ ID NO: 4422201 - DNA, 12 bp, Homo sapiens
attccgtcacca

SEQ ID NO: 4422202 - DNA, 18 bp, Homo sapiens
attcctaaagaaaaatat

SEQ ID NO: 4422203 - DNA, 13 bp, Homo sapiens
attcctacagcac

SEQ ID NO: 4422204 - DNA, 16 bp, Homo sapiens
attcctacagcactac

SEQ ID NO: 4422205 - DNA, 23 bp, Homo sapiens
attcctacagcactactgggtgt

SEQ ID NO: 4422206 - DNA, 12 bp, Homo sapiens
attcctagaaat

SEQ ID NO: 4422207 - DNA, 21 bp, Homo sapiens
attcctagaattaaaccagat

SEQ ID NO: 4422208 - DNA, 14 bp, Homo sapiens
attcctattaatgt

SEQ ID NO: 4422209 - DNA, 22 bp, Homo sapiens
attcctattgtgcaatgtaaat

SEQ ID NO: 4422210 - DNA, 11 bp, Homo sapiens
attcctccctc

SEQ ID NO: 4422211 - DNA, 13 bp, Homo sapiens
attcctcctgctc

SEQ ID NO: 4422212 - DNA, 15 bp, Homo sapiens
attcctcctgctcat

SEQ ID NO: 4422213 - DNA, 16 bp, Homo sapiens
attcctcctgctcata

SEQ ID NO: 4422214 - DNA, 22 bp, Homo sapiens
attcctctcaaattcagctctg

SEQ ID NO: 4422215 - DNA, 14 bp, Homo sapiens
attcctggacatca

SEQ ID NO: 4422216 - DNA, 13 bp, Homo sapiens
attcctgtgccct

SEQ ID NO: 4422217 - DNA, 13 bp, Homo sapiens
attccttctgtag

SEQ ID NO: 4422218 - DNA, 16 bp, Homo sapiens
attccttctgtagtgt

SEQ ID NO: 4422219 - DNA, 17 bp, Homo sapiens
attccttgaggacagac

SEQ ID NO: 4422220 - DNA, 16 bp, Homo sapiens
attccttgagtttcat

SEQ ID NO: 4422221 - DNA, 21 bp, Homo sapiens
attccttgcgcctcagccctc

SEQ ID NO: 4422222 - DNA, 17 bp, Homo sapiens
attcctttaaaatattg

SEQ ID NO: 4422223 - DNA, 17 bp, Homo sapiens
attcctttccctttagc

SEQ ID NO: 4422224 - DNA, 22 bp, Homo sapiens
attcctttccttttttgagatt

SEQ ID NO: 4422225 - DNA, 23 bp, Homo sapiens
attcctttgaatattttttgaag

SEQ ID NO: 4422226 - DNA, 11 bp, Homo sapiens
attccttttaa

SEQ ID NO: 4422227 - DNA, 12 bp, Homo sapiens
attccttttaaa

SEQ ID NO: 4422228 - DNA, 15 bp, Homo sapiens
attccttttaaaatg

SEQ ID NO: 4422229 - DNA, 18 bp, Homo sapiens
attccttttgtcaattgc

SEQ ID NO: 4422230 - DNA, 12 bp, Homo sapiens
attcctttttct

SEQ ID NO: 4422231 - DNA, 14 bp, Homo sapiens
attcgaatctctgc

SEQ ID NO: 4422232 - DNA, 17 bp, Homo sapiens
attcgaatctctgcccc

SEQ ID NO: 4422233 - DNA, 16 bp, Homo sapiens
attcgaatgaaaagac

SEQ ID NO: 4422234 - DNA, 14 bp, Homo sapiens
attcgctagtgttt

SEQ ID NO: 4422235 - DNA, 14 bp, Homo sapiens
attcggaccactag

SEQ ID NO: 4422236 - DNA, 12 bp, Homo sapiens
attcggtgtgaa

SEQ ID NO: 4422237 - DNA, 19 bp, Homo sapiens
attcggtgtgaacttttct

SEQ ID NO: 4422238 - DNA, 14 bp, Homo sapiens
attcgtgagctggg

SEQ ID NO: 4422239 - DNA, 20 bp, Homo sapiens
attcgtgcatttttggatca

SEQ ID NO: 4422240 - DNA, 19 bp, Homo sapiens
attcgttgtgttttttaag

SEQ ID NO: 4422241 - DNA, 19 bp, Homo sapiens
attctaaaagtagacaatc

SEQ ID NO: 4422242 - DNA, 16 bp, Homo sapiens
attctaaaatgattgt

SEQ ID NO: 4422243 - DNA, 20 bp, Homo sapiens
attctaaaatgattgtagta

SEQ ID NO: 4422244 - DNA, 14 bp, Homo sapiens
attctaaaatgcct

SEQ ID NO: 4422245 - DNA, 19 bp, Homo sapiens
attctaacattaaatcaca

SEQ ID NO: 4422246 - DNA, 23 bp, Homo sapiens
attctaacttattaaatttatca

SEQ ID NO: 4422247 - DNA, 18 bp, Homo sapiens
attctacctccttgtgtt

SEQ ID NO: 4422248 - DNA, 17 bp, Homo sapiens
attctactaatgtgatg

SEQ ID NO: 4422249 - DNA, 20 bp, Homo sapiens
attctactggaaaaaaatac

SEQ ID NO: 4422250 - DNA, 16 bp, Homo sapiens
attctaggtgtttcaa

SEQ ID NO: 4422251 - DNA, 13 bp, Homo sapiens
attctagtatttt

SEQ ID NO: 4422252 - DNA, 14 bp, Homo sapiens
attctagtatttta

SEQ ID NO: 4422253 - DNA, 23 bp, Homo sapiens
attctagtgtctgacttttgtta

SEQ ID NO: 4422254 - DNA, 20 bp, Homo sapiens
attctatcttttgtttcctt

SEQ ID NO: 4422255 - DNA, 13 bp, Homo sapiens
attctatgtatgt

SEQ ID NO: 4422256 - DNA, 16 bp, Homo sapiens
attctatgtatgttaa

SEQ ID NO: 4422257 - DNA, 23 bp, Homo sapiens
attctatgtgtcatcaatagtgt

SEQ ID NO: 4422258 - DNA, 18 bp, Homo sapiens
attctattacattttcag

SEQ ID NO: 4422259 - DNA, 20 bp, Homo sapiens
attctattacattttcagtg

SEQ ID NO: 4422260 - DNA, 10 bp, Homo sapiens
attctcacat

SEQ ID NO: 4422261 - DNA, 15 bp, Homo sapiens
attctcactccacca

SEQ ID NO: 4422262 - DNA, 16 bp, Homo sapiens
attctcactccaccac

SEQ ID NO: 4422263 - DNA, 22 bp, Homo sapiens
attctcagaattcggtgtgctg

SEQ ID NO: 4422264 - DNA, 16 bp, Homo sapiens
attctcataattccta

SEQ ID NO: 4422265 - DNA, 17 bp, Homo sapiens
attctcataattcctac

SEQ ID NO: 4422266 - DNA, 21 bp, Homo sapiens
attctcccaggtaccagctgc

SEQ ID NO: 4422267 - DNA, 12 bp, Homo sapiens
attctcccctcc

SEQ ID NO: 4422268 - DNA, 15 bp, Homo sapiens
attctccctgacctt

SEQ ID NO: 4422269 - DNA, 19 bp, Homo sapiens
attctcctcagtggcttct

SEQ ID NO: 4422270 - DNA, 15 bp, Homo sapiens
attctcctgcctcag

SEQ ID NO: 4422271 - DNA, 20 bp, Homo sapiens
attctcctgcctcagcctcc

SEQ ID NO: 4422272 - DNA, 13 bp, Homo sapiens
attatgttgttca

SEQ ID NO: 4422273 - DNA, 14 bp, Homo sapiens
attatgtttaagat

SEQ ID NO: 4422274 - DNA, 13 bp, Homo sapiens
attattaaacgat

SEQ ID NO: 4422275 - DNA, 14 bp, Homo sapiens
attattaatgaaaa

SEQ ID NO: 4422276 - DNA, 22 bp, Homo sapiens
attattaatgaaaataagaatt

SEQ ID NO: 4422277 - DNA, 13 bp, Homo sapiens
attattaattgca

SEQ ID NO: 4422278 - DNA, 20 bp, Homo sapiens
attattaccttacagaagtt

SEQ ID NO: 4422279 - DNA, 22 bp, Homo sapiens
attattacttttcctcttagaa

SEQ ID NO: 4422280 - DNA, 14 bp, Homo sapiens
attattagaacatt

SEQ ID NO: 4422281 - DNA, 20 bp, Homo sapiens
attattagaacattcacttt

SEQ ID NO: 4422282 - DNA, 22 bp, Homo sapiens
attattagttttgatttaatgt

SEQ ID NO: 4422283 - DNA, 13 bp, Homo sapiens
attattataaact

SEQ ID NO: 4422284 - DNA, 20 bp, Homo sapiens
attattatcttcttaacagt

SEQ ID NO: 4422285 - DNA, 16 bp, Homo sapiens
attattgacactgaac

SEQ ID NO: 4422286 - DNA, 21 bp, Homo sapiens
attattgagttccagttgaag

SEQ ID NO: 4422287 - DNA, 13 bp, Homo sapiens
attattgatatat

SEQ ID NO: 4422288 - DNA, 21 bp, Homo sapiens
attattgtgacttcactgtat

SEQ ID NO: 4422289 - DNA, 14 bp, Homo sapiens
attatttatgacct

SEQ ID NO: 4422290 - DNA, 15 bp, Homo sapiens
attatttatgacctg

SEQ ID NO: 4422291 - DNA, 15 bp, Homo sapiens
attatttattaaatt

SEQ ID NO: 4422292 - DNA, 13 bp, Homo sapiens
attatttcaaaat

SEQ ID NO: 4422293 - DNA, 17 bp, Homo sapiens
attatttgtaagatatt

SEQ ID NO: 4422294 - DNA, 11 bp, Homo sapiens
attatttgtat

SEQ ID NO: 4422295 - DNA, 12 bp, Homo sapiens
attatttgtctt

SEQ ID NO: 4422296 - DNA, 17 bp, Homo sapiens
attattttaaaatatat

SEQ ID NO: 4422297 - DNA, 19 bp, Homo sapiens
attattttaaaatatatga

SEQ ID NO: 4422298 - DNA, 16 bp, Homo sapiens
attattttaaattata

SEQ ID NO: 4422299 - DNA, 17 bp, Homo sapiens
attattttaaatttctt

SEQ ID NO: 4422300 - DNA, 16 bp, Homo sapiens
attattttagtgtgta

SEQ ID NO: 4422301 - DNA, 19 bp, Homo sapiens
attattttagtgtgtaaaa

SEQ ID NO: 4422302 - DNA, 22 bp, Homo sapiens
attattttagtgtgtaaaatta

SEQ ID NO: 4422303 - DNA, 11 bp, Homo sapiens
attattttcaa

SEQ ID NO: 4422304 - DNA, 14 bp, Homo sapiens
attatttttgtaga

SEQ ID NO: 4422305 - DNA, 17 bp, Homo sapiens
attattttttatttctg

SEQ ID NO: 4422306 - DNA, 22 bp, Homo sapiens
attattttttttatatttattg

SEQ ID NO: 4422307 - DNA, 21 bp, Homo sapiens
attcaaaaaactctctcccag

SEQ ID NO: 4422308 - DNA, 23 bp, Homo sapiens
attcaaaaagacagcagacaaaa

SEQ ID NO: 4422309 - DNA, 22 bp, Homo sapiens
attcaaaagtgattatctcttt

SEQ ID NO: 4422310 - DNA, 16 bp, Homo sapiens
attcaaaatatttaaa

SEQ ID NO: 4422311 - DNA, 12 bp, Homo sapiens
attcaaagatga

SEQ ID NO: 4422312 - DNA, 20 bp, Homo sapiens
attcaaattatgtataaata

SEQ ID NO: 4422313 - DNA, 13 bp, Homo sapiens
attcaaatttatt

SEQ ID NO: 4422314 - DNA, 14 bp, Homo sapiens
attcaaatttgatg

SEQ ID NO: 4422315 - DNA, 23 bp, Homo sapiens
attcaaatttgtaataaaactat

SEQ ID NO: 4422316 - DNA, 16 bp, Homo sapiens
attcaacacattttta

SEQ ID NO: 4422317 - DNA, 14 bp, Homo sapiens
attcaactattctt

SEQ ID NO: 4422318 - DNA, 21 bp, Homo sapiens
attcaagccattccaaagttc

SEQ ID NO: 4422319 - DNA, 17 bp, Homo sapiens
attcaaggaatttctta

SEQ ID NO: 4422320 - DNA, 18 bp, Homo sapiens
attcaaggaatttcttaa

SEQ ID NO: 4422321 - DNA, 19 bp, Homo sapiens
attcaaggagaatatgata

SEQ ID NO: 4422322 - DNA, 13 bp, Homo sapiens
attcaaggctcag

SEQ ID NO: 4422323 - DNA, 18 bp, Homo sapiens
attcaaggctcagaagga

SEQ ID NO: 4422324 - DNA, 20 bp, Homo sapiens
attcaaggctttaaaagtca

SEQ ID NO: 4422325 - DNA, 21 bp, Homo sapiens
attcaatacaaacaatctctt

SEQ ID NO: 4422326 - DNA, 15 bp, Homo sapiens
attcaatcatttatt

SEQ ID NO: 4422327 - DNA, 15 bp, Homo sapiens
attcaatctgtaaac

SEQ ID NO: 4422328 - DNA, 18 bp, Homo sapiens
attcaatctgtaaactgt

SEQ ID NO: 4422329 - DNA, 16 bp, Homo sapiens
attcaattcaaagctg

SEQ ID NO: 4422330 - DNA, 17 bp, Homo sapiens
attcacaaacttttata

SEQ ID NO: 4422331 - DNA, 17 bp, Homo sapiens
attcacaagcctcctgt

SEQ ID NO: 4422332 - DNA, 18 bp, Homo sapiens
attcacaagcctcctgta

SEQ ID NO: 4422333 - DNA, 21 bp, Homo sapiens
attcacaagcctcctgtacct

SEQ ID NO: 4422334 - DNA, 14 bp, Homo sapiens
attcacaattattc

SEQ ID NO: 4422335 - DNA, 14 bp, Homo sapiens
attcacagactgat

SEQ ID NO: 4422336 - DNA, 18 bp, Homo sapiens
attcacctgtaaaacttt

SEQ ID NO: 4422337 - DNA, 20 bp, Homo sapiens
attcacgcatacttggatat

SEQ ID NO: 4422338 - DNA, 22 bp, Homo sapiens
attcactcactcactcattcct

SEQ ID NO: 4422339 - DNA, 23 bp, Homo sapiens
attcacttttgttaacagtattt

SEQ ID NO: 4422340 - DNA, 20 bp, Homo sapiens
attcagaaaatgttctgttt

SEQ ID NO: 4422341 - DNA, 14 bp, Homo sapiens
attcagaaatgtgg

SEQ ID NO: 4422342 - DNA, 20 bp, Homo sapiens
attcagaactaaatttttca

SEQ ID NO: 4422343 - DNA, 14 bp, Homo sapiens
attcagaagaaaaa

SEQ ID NO: 4422344 - DNA, 15 bp, Homo sapiens
attcagaatattcat

SEQ ID NO: 4422345 - DNA, 14 bp, Homo sapiens
attcagacaaaatg

SEQ ID NO: 4422346 - DNA, 23 bp, Homo sapiens
attcagacaaaatggatacataa

SEQ ID NO: 4422347 - DNA, 17 bp, Homo sapiens
attcagccagcttaaac

SEQ ID NO: 4422348 - DNA, 19 bp, Homo sapiens
attcagccagcttaaaccc

SEQ ID NO: 4422349 - DNA, 22 bp, Homo sapiens
attcagctagaactttgaagga

SEQ ID NO: 4422350 - DNA, 11 bp, Homo sapiens
attcagctctg

SEQ ID NO: 4422351 - DNA, 21 bp, Homo sapiens
attcagctctgatctgaggct

SEQ ID NO: 4422352 - DNA, 22 bp, Homo sapiens
attcaggaaaactgacagagga

SEQ ID NO: 4422353 - DNA, 13 bp, Homo sapiens
attcaggcactga

SEQ ID NO: 4422354 - DNA, 15 bp, Homo sapiens
attcaggcagcactg

SEQ ID NO: 4422355 - DNA, 16 bp, Homo sapiens
attcaggcagcactga

SEQ ID NO: 4422356 - DNA, 14 bp, Homo sapiens
attcaggccagccc

SEQ ID NO: 4422357 - DNA, 15 bp, Homo sapiens
attcaggtaatacaa

SEQ ID NO: 4422358 - DNA, 16 bp, Homo sapiens
attcaggtaatacaaa

SEQ ID NO: 4422359 - DNA, 17 bp, Homo sapiens
attcaggtaatacaaac

SEQ ID NO: 4422360 - DNA, 18 bp, Homo sapiens
attcaggtgacctcctgc

SEQ ID NO: 4422361 - DNA, 16 bp, Homo sapiens
attcaggtttttcctt

SEQ ID NO: 4422362 - DNA, 22 bp, Homo sapiens
attcagtaatgcagtttttaaa

SEQ ID NO: 4422363 - DNA, 16 bp, Homo sapiens
attcagtggtgaaatc

SEQ ID NO: 4422364 - DNA, 22 bp, Homo sapiens
attcagtggtgaaatcttgttt

SEQ ID NO: 4422365 - DNA, 19 bp, Homo sapiens
attcagtgttaaatgtgat

SEQ ID NO: 4422366 - DNA, 13 bp, Homo sapiens
attcagtttcata

SEQ ID NO: 4422367 - DNA, 13 bp, Homo sapiens
attcagtttctaa

SEQ ID NO: 4422368 - DNA, 13 bp, Homo sapiens
attcagttttcat

SEQ ID NO: 4422369 - DNA, 13 bp, Homo sapiens
attcataataaat

SEQ ID NO: 4422370 - DNA, 20 bp, Homo sapiens
attcatacttaaaaatttat

SEQ ID NO: 4422371 - DNA, 21 bp, Homo sapiens
attcatacttaaaaatttatt

SEQ ID NO: 4422372 - DNA, 19 bp, Homo sapiens
attcatagcagcttattca

SEQ ID NO: 4422373 - DNA, 22 bp, Homo sapiens
attcatagcagcttattcacaa

SEQ ID NO: 4422374 - DNA, 18 bp, Homo sapiens
attcatatctaaatagta

SEQ ID NO: 4422375 - DNA, 16 bp, Homo sapiens
attcatgaaaatgtat

SEQ ID NO: 4422376 - DNA, 14 bp, Homo sapiens
attcatgaatattt

SEQ ID NO: 4422377 - DNA, 17 bp, Homo sapiens
attcatgaatattttca

SEQ ID NO: 4422378 - DNA, 20 bp, Homo sapiens
attcatgaatattttcaagt

SEQ ID NO: 4422379 - DNA, 20 bp, Homo sapiens
attcatggcatgcttaaatt

SEQ ID NO: 4422380 - DNA, 17 bp, Homo sapiens
attcatggcctggggga

SEQ ID NO: 4422381 - DNA, 19 bp, Homo sapiens
attcatggctacctcagaa

SEQ ID NO: 4422382 - DNA, 17 bp, Homo sapiens
attcatgtaataaacag

SEQ ID NO: 4422383 - DNA, 14 bp, Homo sapiens
attcatgtccagag

SEQ ID NO: 4422384 - DNA, 15 bp, Homo sapiens
attcattagttttga

SEQ ID NO: 4422385 - DNA, 16 bp, Homo sapiens
attcattcatacttaa

SEQ ID NO: 4422386 - DNA, 12 bp, Homo sapiens
attcattctcat

SEQ ID NO: 4422387 - DNA, 15 bp, Homo sapiens
attcattctttttga

SEQ ID NO: 4422388 - DNA, 16 bp, Homo sapiens
attcattctttttgaa

SEQ ID NO: 4422389 - DNA, 11 bp, Homo sapiens
attcatttcta

SEQ ID NO: 4422390 - DNA, 16 bp, Homo sapiens
attccaaaccaggaca

SEQ ID NO: 4422391 - DNA, 23 bp, Homo sapiens
attccaaagctttattaccagtg

SEQ ID NO: 4422392 - DNA, 17 bp, Homo sapiens
attccaccttaaattaa

SEQ ID NO: 4422393 - DNA, 23 bp, Homo sapiens
atgtctccccagttccacagcag

SEQ ID NO: 4422394 - DNA, 17 bp, Homo sapiens
atgtctctcagaattct

SEQ ID NO: 4422395 - DNA, 21 bp, Homo sapiens
atgtctctgtgagactcgaga

SEQ ID NO: 4422396 - DNA, 17 bp, Homo sapiens
atgtctgccaaaatgca

SEQ ID NO: 4422397 - DNA, 20 bp, Homo sapiens
atgttaagggaagaattcca

SEQ ID NO: 4422398 - DNA, 13 bp, Homo sapiens
atgttaatatttc

SEQ ID NO: 4422399 - DNA, 17 bp, Homo sapiens
atgttaatttatttagt

SEQ ID NO: 4422400 - DNA, 21 bp, Homo sapiens
atgttacggcatcacacttat

SEQ ID NO: 4422401 - DNA, 24 bp, Homo sapiens
atgttagactcatggtgtgttaca

SEQ ID NO: 4422402 - DNA, 15 bp, Homo sapiens
atgttagacttgtgt

SEQ ID NO: 4422403 - DNA, 22 bp, Homo sapiens
atgttagggtataagttgctgt

SEQ ID NO: 4422404 - DNA, 22 bp, Homo sapiens
atgttatacaaccttcatttaa

SEQ ID NO: 4422405 - DNA, 14 bp, Homo sapiens
atgttatagaactt

SEQ ID NO: 4422406 - DNA, 21 bp, Homo sapiens
atgttatccaactattaagat

SEQ ID NO: 4422407 - DNA, 20 bp, Homo sapiens
atgttatcggattactgaat

SEQ ID NO: 4422408 - DNA, 17 bp, Homo sapiens
atgttatgccagctcca

SEQ ID NO: 4422409 - DNA, 13 bp, Homo sapiens
atgttatgtttct

SEQ ID NO: 4422410 - DNA, 20 bp, Homo sapiens
atgttcacttttgacaaagg

SEQ ID NO: 4422411 - DNA, 22 bp, Homo sapiens
atgttcacttttgacaaaggca

SEQ ID NO: 4422412 - DNA, 19 bp, Homo sapiens
atgttcatatttattgatt

SEQ ID NO: 4422413 - DNA, 15 bp, Homo sapiens
atgttcatgatagaa

SEQ ID NO: 4422414 - DNA, 19 bp, Homo sapiens
atgttcatgatagaaagaa

SEQ ID NO: 4422415 - DNA, 23 bp, Homo sapiens
atgttcattgtagattttgttat

SEQ ID NO: 4422416 - DNA, 17 bp, Homo sapiens
atgttccaataaaactt

SEQ ID NO: 4422417 - DNA, 19 bp, Homo sapiens
atgttccaataaaacttta

SEQ ID NO: 4422418 - DNA, 16 bp, Homo sapiens
atgttccacctgccac

SEQ ID NO: 4422419 - DNA, 12 bp, Homo sapiens
atgttccccagg

SEQ ID NO: 4422420 - DNA, 16 bp, Homo sapiens
atgttcctagtgaaag

SEQ ID NO: 4422421 - DNA, 23 bp, Homo sapiens
atgttcctccttttcttcaccct

SEQ ID NO: 4422422 - DNA, 16 bp, Homo sapiens
atgttccttttaaaga

SEQ ID NO: 4422423 - DNA, 18 bp, Homo sapiens
atgttccttttaaagaaa

SEQ ID NO: 4422424 - DNA, 13 bp, Homo sapiens
atgttcctttttt

SEQ ID NO: 4422425 - DNA, 22 bp, Homo sapiens
atgttccttttttcaatatgca

SEQ ID NO: 4422426 - DNA, 18 bp, Homo sapiens
atgttccttttttgtata

SEQ ID NO: 4422427 - DNA, 11 bp, Homo sapiens
atgttctatta

SEQ ID NO: 4422428 - DNA, 18 bp, Homo sapiens
atgttctattaatcacct

SEQ ID NO: 4422429 - DNA, 20 bp, Homo sapiens
atgttctattttttgttttg

SEQ ID NO: 4422430 - DNA, 17 bp, Homo sapiens
atgttctgtttgctgtg

SEQ ID NO: 4422431 - DNA, 14 bp, Homo sapiens
atgttcttggtgtt

SEQ ID NO: 4422432 - DNA, 17 bp, Homo sapiens
atgttcttggtgtttga

SEQ ID NO: 4422433 - DNA, 14 bp, Homo sapiens
atgttctttggaaa

SEQ ID NO: 4422434 - DNA, 14 bp, Homo sapiens
atgttgaatacttt

SEQ ID NO: 4422435 - DNA, 16 bp, Homo sapiens
atgttgagaatcccaa

SEQ ID NO: 4422436 - DNA, 22 bp, Homo sapiens
atgttgagaatcccaaatttga

SEQ ID NO: 4422437 - DNA, 14 bp, Homo sapiens
atgttgaggatcta

SEQ ID NO: 4422438 - DNA, 23 bp, Homo sapiens
atgttgataaaccaaaaacattt

SEQ ID NO: 4422439 - DNA, 17 bp, Homo sapiens
atgttgcactgtttgca

SEQ ID NO: 4422440 - DNA, 19 bp, Homo sapiens
atgttgctatgtgccttat

SEQ ID NO: 4422441 - DNA, 16 bp, Homo sapiens
atgttgctgaatttgt

SEQ ID NO: 4422442 - DNA, 17 bp, Homo sapiens
atgttgctgaatttgta

SEQ ID NO: 4422443 - DNA, 14 bp, Homo sapiens
atgttgcttctcag

SEQ ID NO: 4422444 - DNA, 24 bp, Homo sapiens
atgttgctttgaaaaagcctctaa

SEQ ID NO: 4422445 - DNA, 17 bp, Homo sapiens
atgttggccaggctggt

SEQ ID NO: 4422446 - DNA, 18 bp, Homo sapiens
atgttggtcattttatgt

SEQ ID NO: 4422447 - DNA, 14 bp, Homo sapiens
atgttgtaatattt

SEQ ID NO: 4422448 - DNA, 15 bp, Homo sapiens
atgttgtgtttttaa

SEQ ID NO: 4422449 - DNA, 17 bp, Homo sapiens
atgttgttgaactaata

SEQ ID NO: 4422450 - DNA, 18 bp, Homo sapiens
atgttgttgaactaatat

SEQ ID NO: 4422451 - DNA, 24 bp, Homo sapiens
atgttgttgtctatttgtctctta

SEQ ID NO: 4422452 - DNA, 21 bp, Homo sapiens
atgttgttgtgtgtatatgta

SEQ ID NO: 4422453 - DNA, 22 bp, Homo sapiens
atgttgttgtgtgtatatgtat

SEQ ID NO: 4422454 - DNA, 23 bp, Homo sapiens
atgttgtttcctaatatcaaatg

SEQ ID NO: 4422455 - DNA, 12 bp, Homo sapiens
atgtttaaaata

SEQ ID NO: 4422456 - DNA, 15 bp, Homo sapiens
atgtttaagatatat

SEQ ID NO: 4422457 - DNA, 14 bp, Homo sapiens
atgtttactgtatc

SEQ ID NO: 4422458 - DNA, 22 bp, Homo sapiens
atgtttactgtatcaatttcta

SEQ ID NO: 4422459 - DNA, 23 bp, Homo sapiens
atgtttactgtatcaatttctaa

SEQ ID NO: 4422460 - DNA, 21 bp, Homo sapiens
atgtttagatagggctgggca

SEQ ID NO: 4422461 - DNA, 20 bp, Homo sapiens
atgtttataaatcttatgct

SEQ ID NO: 4422462 - DNA, 14 bp, Homo sapiens
atgtttatgaaggg

SEQ ID NO: 4422463 - DNA, 18 bp, Homo sapiens
atgtttatggaaatatta

SEQ ID NO: 4422464 - DNA, 20 bp, Homo sapiens
atgtttattaaatgcttcat

SEQ ID NO: 4422465 - DNA, 17 bp, Homo sapiens
atgtttattccttctgt

SEQ ID NO: 4422466 - DNA, 16 bp, Homo sapiens
atgtttcaaaatagac

SEQ ID NO: 4422467 - DNA, 18 bp, Homo sapiens
atgtttcaaaatagacaa

SEQ ID NO: 4422468 - DNA, 13 bp, Homo sapiens
atgtttcatcaat

SEQ ID NO: 4422469 - DNA, 12 bp, Homo sapiens
atgtttccactg

SEQ ID NO: 4422470 - DNA, 19 bp, Homo sapiens
atgtttcctaactgtgatt

SEQ ID NO: 4422471 - DNA, 17 bp, Homo sapiens
atgtttctgatttctga

SEQ ID NO: 4422472 - DNA, 15 bp, Homo sapiens
atgtttcttctccaa

SEQ ID NO: 4422473 - DNA, 21 bp, Homo sapiens
atgtttcttgccttttgttaa

SEQ ID NO: 4422474 - DNA, 14 bp, Homo sapiens
atgtttggatggtt

SEQ ID NO: 4422475 - DNA, 23 bp, Homo sapiens
atgtttgtcctgaacacttttgt

SEQ ID NO: 4422476 - DNA, 16 bp, Homo sapiens
atgtttgtggcctcag

SEQ ID NO: 4422477 - DNA, 15 bp, Homo sapiens
atgttttaaaatcta

SEQ ID NO: 4422478 - DNA, 13 bp, Homo sapiens
atgttttaaagaa

SEQ ID NO: 4422479 - DNA, 22 bp, Homo sapiens
atgttttagggacccccaacct

SEQ ID NO: 4422480 - DNA, 12 bp, Homo sapiens
atgttttcaaat

SEQ ID NO: 4422481 - DNA, 18 bp, Homo sapiens
atgttttcaaatgttctc

SEQ ID NO: 4422482 - DNA, 21 bp, Homo sapiens
atgttttccaatattttaata

SEQ ID NO: 4422483 - DNA, 15 bp, Homo sapiens
atgttttccacataa

SEQ ID NO: 4422484 - DNA, 16 bp, Homo sapiens
atgttttctttgcaaa

SEQ ID NO: 4422485 - DNA, 18 bp, Homo sapiens
atgttttctttgcaaagt

SEQ ID NO: 4422486 - DNA, 21 bp, Homo sapiens
atgttttctttgcaaagtatt

SEQ ID NO: 4422487 - DNA, 16 bp, Homo sapiens
atgttttgaaagacag

SEQ ID NO: 4422488 - DNA, 23 bp, Homo sapiens
atgttttggccaatgcacctaaa

SEQ ID NO: 4422489 - DNA, 11 bp, Homo sapiens
atgtttttaaa

SEQ ID NO: 4422490 - DNA, 23 bp, Homo sapiens
atgtttttaaaaagagtaatttc

SEQ ID NO: 4422491 - DNA, 20 bp, Homo sapiens
atgtttttactgaatgatct

SEQ ID NO: 4422492 - DNA, 21 bp, Homo sapiens
atgtttttataaaaataaata

SEQ ID NO: 4422493 - DNA, 14 bp, Homo sapiens
atgtttttatttcc

SEQ ID NO: 4422494 - DNA, 14 bp, Homo sapiens
atgtttttccctcc

SEQ ID NO: 4422495 - DNA, 21 bp, Homo sapiens
atgtttttctgccagggagct

SEQ ID NO: 4422496 - DNA, 19 bp, Homo sapiens
atgtttttgttcaaagcca

SEQ ID NO: 4422497 - DNA, 20 bp, Homo sapiens
atgttttttctgtaatgtaa

SEQ ID NO: 4422498 - DNA, 15 bp, Homo sapiens
attaaaaaatttgta

SEQ ID NO: 4422499 - DNA, 23 bp, Homo sapiens
attaaaaataccttctatgtatt

SEQ ID NO: 4422500 - DNA, 21 bp, Homo sapiens
attaaaaatgagatttcttat

SEQ ID NO: 4422501 - DNA, 21 bp, Homo sapiens
attaaaacaaaagggtgtata

SEQ ID NO: 4422502 - DNA, 16 bp, Homo sapiens
attaaaacgggaatca

SEQ ID NO: 4422503 - DNA, 15 bp, Homo sapiens
attaaaactcagcct

SEQ ID NO: 4422504 - DNA, 20 bp, Homo sapiens
attaaaagaaatatacagtt

SEQ ID NO: 4422505 - DNA, 21 bp, Homo sapiens
attaaaagaaatatacagttt

SEQ ID NO: 4422506 - DNA, 16 bp, Homo sapiens
attaaaagaatatttt

SEQ ID NO: 4422507 - DNA, 22 bp, Homo sapiens
attaaaatactatgcagtatct

SEQ ID NO: 4422508 - DNA, 18 bp, Homo sapiens
attaaaatatagagacag

SEQ ID NO: 4422509 - DNA, 14 bp, Homo sapiens
attaaaattgtgca

SEQ ID NO: 4422510 - DNA, 17 bp, Homo sapiens
attaaaattgtgcataa

SEQ ID NO: 4422511 - DNA, 13 bp, Homo sapiens
attaaaatttttt

SEQ ID NO: 4422512 - DNA, 13 bp, Homo sapiens
attaaacaaataa

SEQ ID NO: 4422513 - DNA, 17 bp, Homo sapiens
attaaacaatttatttt

SEQ ID NO: 4422514 - DNA, 20 bp, Homo sapiens
attacatgttttttcatttg

SEQ ID NO: 4422515 - DNA, 15 bp, Homo sapiens
attacattattaaac

SEQ ID NO: 4422516 - DNA, 16 bp, Homo sapiens
attacattattaaacg

SEQ ID NO: 4422517 - DNA, 12 bp, Homo sapiens
attaccaaaata

SEQ ID NO: 4422518 - DNA, 16 bp, Homo sapiens
attaccaacctgttac

SEQ ID NO: 4422519 - DNA, 19 bp, Homo sapiens
attaccaataggcaaatta

SEQ ID NO: 4422520 - DNA, 22 bp, Homo sapiens
attaccactcaagaagacactt

SEQ ID NO: 4422521 - DNA, 19 bp, Homo sapiens
attaccatagagtaatgat

SEQ ID NO: 4422522 - DNA, 16 bp, Homo sapiens
tttgttcccctcctcc

SEQ ID NO: 4422523 - DNA, 19 bp, Homo sapiens
tttgttcccctcctccact

SEQ ID NO: 4422524 - DNA, 15 bp, Homo sapiens
tttgttccttttgta

SEQ ID NO: 4422525 - DNA, 20 bp, Homo sapiens
tttgttcgcatggtcacaca

SEQ ID NO: 4422526 - DNA, 12 bp, Homo sapiens
tttgttctagac

SEQ ID NO: 4422527 - DNA, 13 bp, Homo sapiens
tttgttcttcaga

SEQ ID NO: 4422528 - DNA, 13 bp, Homo sapiens
tttgttctttgtt

SEQ ID NO: 4422529 - DNA, 22 bp, Homo sapiens
tttgttgacagcttggaaaggg

SEQ ID NO: 4422530 - DNA, 16 bp, Homo sapiens
tttgttgcaagatgtg

SEQ ID NO: 4422531 - DNA, 18 bp, Homo sapiens
tttgttgcaagatgtgaa

SEQ ID NO: 4422532 - DNA, 19 bp, Homo sapiens
tttgttgcaagatgtgaat

SEQ ID NO: 4422533 - DNA, 15 bp, Homo sapiens
tttgttgctttctta

SEQ ID NO: 4422534 - DNA, 18 bp, Homo sapiens
tttgttgctttcttacct

SEQ ID NO: 4422535 - DNA, 15 bp, Homo sapiens
tttgttgtaaaacaa

SEQ ID NO: 4422536 - DNA, 21 bp, Homo sapiens
tttgtttaatttttatttctt

SEQ ID NO: 4422537 - DNA, 22 bp, Homo sapiens
tttgtttaatttttatttcttc

SEQ ID NO: 4422538 - DNA, 13 bp, Homo sapiens
tttgtttactctc

SEQ ID NO: 4422539 - DNA, 13 bp, Homo sapiens
tttgtttagaaaa

SEQ ID NO: 4422540 - DNA, 19 bp, Homo sapiens
tttgtttagaaaaaaaact

SEQ ID NO: 4422541 - DNA, 19 bp, Homo sapiens
tttgtttatatcactgtct

SEQ ID NO: 4422542 - DNA, 13 bp, Homo sapiens
tttgtttatgcac

SEQ ID NO: 4422543 - DNA, 21 bp, Homo sapiens
tttgtttatggtaaaaaattt

SEQ ID NO: 4422544 - DNA, 16 bp, Homo sapiens
tttgtttcaactttct

SEQ ID NO: 4422545 - DNA, 17 bp, Homo sapiens
tttgtttcaatgaggtg

SEQ ID NO: 4422546 - DNA, 12 bp, Homo sapiens
tttgtttcactt

SEQ ID NO: 4422547 - DNA, 14 bp, Homo sapiens
tttgtttgaatgtt

SEQ ID NO: 4422548 - DNA, 15 bp, Homo sapiens
tttgtttgaatgtta

SEQ ID NO: 4422549 - DNA, 18 bp, Homo sapiens
tttgtttggtataaatta

SEQ ID NO: 4422550 - DNA, 14 bp, Homo sapiens
tttgtttgtgttta

SEQ ID NO: 4422551 - DNA, 15 bp, Homo sapiens
tttgtttgtttaatt

SEQ ID NO: 4422552 - DNA, 14 bp, Homo sapiens
tttgttttcaagat

SEQ ID NO: 4422553 - DNA, 14 bp, Homo sapiens
tttgttttgaaagt

SEQ ID NO: 4422554 - DNA, 15 bp, Homo sapiens
tttgttttgctgaga

SEQ ID NO: 4422555 - DNA, 17 bp, Homo sapiens
tttgtttttgcattttt

SEQ ID NO: 4422556 - DNA, 15 bp, Homo sapiens
ttttaaaaaacactg

SEQ ID NO: 4422557 - DNA, 21 bp, Homo sapiens
ttttaaaaaagcttaaaactt

SEQ ID NO: 4422558 - DNA, 23 bp, Homo sapiens
ttttaaaaaagcttaaaactttg

SEQ ID NO: 4422559 - DNA, 21 bp, Homo sapiens
ttttaaaaaagggagtttttg

SEQ ID NO: 4422560 - DNA, 18 bp, Homo sapiens
ttttaaaaaatattttct

SEQ ID NO: 4422561 - DNA, 18 bp, Homo sapiens
ttttaaaaacctgtatct

SEQ ID NO: 4422562 - DNA, 19 bp, Homo sapiens
ttttaaaaacctgtatctg

SEQ ID NO: 4422563 - DNA, 15 bp, Homo sapiens
ttttaaaaataactg

SEQ ID NO: 4422564 - DNA, 17 bp, Homo sapiens
ttttaaaaatagacact

SEQ ID NO: 4422565 - DNA, 14 bp, Homo sapiens
ttttaaaactagca

SEQ ID NO: 4422566 - DNA, 21 bp, Homo sapiens
ttttaaaagcaattatattgt

SEQ ID NO: 4422567 - DNA, 23 bp, Homo sapiens
ttttaaaagttttgaaggaaacc

SEQ ID NO: 4422568 - DNA, 21 bp, Homo sapiens
ttttaaaatccagactttctt

SEQ ID NO: 4422569 - DNA, 16 bp, Homo sapiens
ttttaaaatgcaatgt

SEQ ID NO: 4422570 - DNA, 16 bp, Homo sapiens
ttttaaaatttatttg

SEQ ID NO: 4422571 - DNA, 18 bp, Homo sapiens
ttttaaaatttatttgca

SEQ ID NO: 4422572 - DNA, 15 bp, Homo sapiens
ttttaaaatttcata

SEQ ID NO: 4422573 - DNA, 15 bp, Homo sapiens
ttttaaaatttgttc

SEQ ID NO: 4422574 - DNA, 19 bp, Homo sapiens
ttttaaacaaaatttcaca

SEQ ID NO: 4422575 - DNA, 23 bp, Homo sapiens
ttttaaacaaaatttcacagttc

SEQ ID NO: 4422576 - DNA, 22 bp, Homo sapiens
ttttaaacccaaaatatataca

SEQ ID NO: 4422577 - DNA, 20 bp, Homo sapiens
ttttaaactgtgtacataac

SEQ ID NO: 4422578 - DNA, 23 bp, Homo sapiens
ttttaaactgtgtacataactga

SEQ ID NO: 4422579 - DNA, 12 bp, Homo sapiens
ttttaaagaatt

SEQ ID NO: 4422580 - DNA, 13 bp, Homo sapiens
ttttaaaggcatt

SEQ ID NO: 4422581 - DNA, 17 bp, Homo sapiens
ttttaaagtaaattatt

SEQ ID NO: 4422582 - DNA, 20 bp, Homo sapiens
ttttaaagtatttataaaaa

SEQ ID NO: 4422583 - DNA, 21 bp, Homo sapiens
ttttaaagttcttattttagt

SEQ ID NO: 4422584 - DNA, 21 bp, Homo sapiens
ttttaaataaaagcacaagta

SEQ ID NO: 4422585 - DNA, 14 bp, Homo sapiens
ttttaaatcaagga

SEQ ID NO: 4422586 - DNA, 15 bp, Homo sapiens
ttttaaatgtacaga

SEQ ID NO: 4422587 - DNA, 19 bp, Homo sapiens
ttttaaattagaaaatatt

SEQ ID NO: 4422588 - DNA, 11 bp, Homo sapiens
ttttaaatttg

SEQ ID NO: 4422589 - DNA, 16 bp, Homo sapiens
ttttaaattttgtaat

SEQ ID NO: 4422590 - DNA, 17 bp, Homo sapiens
ttttaaattttgtaatg

SEQ ID NO: 4422591 - DNA, 22 bp, Homo sapiens
ttttaaccagtacttctaagag

SEQ ID NO: 4422592 - DNA, 14 bp, Homo sapiens
ttttaactgtggat

SEQ ID NO: 4422593 - DNA, 16 bp, Homo sapiens
ttttaactttaataca

SEQ ID NO: 4422594 - DNA, 18 bp, Homo sapiens
ttttaactttaatacagc

SEQ ID NO: 4422595 - DNA, 20 bp, Homo sapiens
ttttaagaaaaaaagcaaaa

SEQ ID NO: 4422596 - DNA, 20 bp, Homo sapiens
ttttaagaaattttgccttt

SEQ ID NO: 4422597 - DNA, 13 bp, Homo sapiens
ttttaagacgtga

SEQ ID NO: 4422598 - DNA, 22 bp, Homo sapiens
ttttaagatgcatgtctgccaa

SEQ ID NO: 4422599 - DNA, 12 bp, Homo sapiens
ttttaagatttc

SEQ ID NO: 4422600 - DNA, 14 bp, Homo sapiens
ttttaagcttttat

SEQ ID NO: 4422601 - DNA, 17 bp, Homo sapiens
ttttaaggtctttcagt

SEQ ID NO: 4422602 - DNA, 23 bp, Homo sapiens
ttttaagtgacataattgtccag

SEQ ID NO: 4422603 - DNA, 23 bp, Homo sapiens
ttttaagtgccttggatgagaag

SEQ ID NO: 4422604 - DNA, 15 bp, Homo sapiens
ttttaagttgtcaaa

SEQ ID NO: 4422605 - DNA, 16 bp, Homo sapiens
ttttaagtttgaaact

SEQ ID NO: 4422606 - DNA, 13 bp, Homo sapiens
ttttaataaagta

SEQ ID NO: 4422607 - DNA, 15 bp, Homo sapiens
ttttaataagaacag

SEQ ID NO: 4422608 - DNA, 18 bp, Homo sapiens
ttttaataagaacagatc

SEQ ID NO: 4422609 - DNA, 16 bp, Homo sapiens
ttttggtacaaaaata

SEQ ID NO: 4422610 - DNA, 14 bp, Homo sapiens
ttttggtcattgta

SEQ ID NO: 4422611 - DNA, 17 bp, Homo sapiens
ttttggtgcacaaatac

SEQ ID NO: 4422612 - DNA, 14 bp, Homo sapiens
ttttggttaagttg

SEQ ID NO: 4422613 - DNA, 19 bp, Homo sapiens
ttttggttatggagtcttg

SEQ ID NO: 4422614 - DNA, 12 bp, Homo sapiens
ttttgtaaaata

SEQ ID NO: 4422615 - DNA, 15 bp, Homo sapiens
ttttgtaacttcaaa

SEQ ID NO: 4422616 - DNA, 17 bp, Homo sapiens
ttttgtaacttcaaata

SEQ ID NO: 4422617 - DNA, 11 bp, Homo sapiens
ttttgtaagaa

SEQ ID NO: 4422618 - DNA, 22 bp, Homo sapiens
ttttgtaataagcaatcaaggt

SEQ ID NO: 4422619 - DNA, 20 bp, Homo sapiens
ttttgtaatattctgttttg

SEQ ID NO: 4422620 - DNA, 17 bp, Homo sapiens
ttttgtaatgctgtaca

SEQ ID NO: 4422621 - DNA, 13 bp, Homo sapiens
ttttgtaccagtg

SEQ ID NO: 4422622 - DNA, 15 bp, Homo sapiens
ttttgtactgaattt

SEQ ID NO: 4422623 - DNA, 15 bp, Homo sapiens
ttttgtataatcaca

SEQ ID NO: 4422624 - DNA, 14 bp, Homo sapiens
ttttgtataattgg

SEQ ID NO: 4422625 - DNA, 23 bp, Homo sapiens
ttttgtatgaaatatatgtgaaa

SEQ ID NO: 4422626 - DNA, 14 bp, Homo sapiens
ttttgtatgtgtgt

SEQ ID NO: 4422627 - DNA, 17 bp, Homo sapiens
ttttgtattctctgagc

SEQ ID NO: 4422628 - DNA, 14 bp, Homo sapiens
ttttgtgaattagg

SEQ ID NO: 4422629 - DNA, 20 bp, Homo sapiens
ttttgtgtgtatttgctaat

SEQ ID NO: 4422630 - DNA, 17 bp, Homo sapiens
ttttgttaacagtattt

SEQ ID NO: 4422631 - DNA, 15 bp, Homo sapiens
ttttgttagcaaaga

SEQ ID NO: 4422632 - DNA, 14 bp, Homo sapiens
ttttgttcccctcc

SEQ ID NO: 4422633 - DNA, 13 bp, Homo sapiens
ttttgttggcata

SEQ ID NO: 4422634 - DNA, 22 bp, Homo sapiens
ttttgttgttgttgtttgtaaa

SEQ ID NO: 4422635 - DNA, 19 bp, Homo sapiens
ttttgttgtttcttaaata

SEQ ID NO: 4422636 - DNA, 18 bp, Homo sapiens
ttttgtttcaatgaggtg

SEQ ID NO: 4422637 - DNA, 13 bp, Homo sapiens
ttttgtttccttt

SEQ ID NO: 4422638 - DNA, 14 bp, Homo sapiens
ttttgtttgatgca

SEQ ID NO: 4422639 - DNA, 21 bp, Homo sapiens
ttttgttttaaggaaaaaaga

SEQ ID NO: 4422640 - DNA, 18 bp, Homo sapiens
ttttgttttgaaagttta

SEQ ID NO: 4422641 - DNA, 17 bp, Homo sapiens
ttttgtttttcattcag

SEQ ID NO: 4422642 - DNA, 16 bp, Homo sapiens
ttttgtttttgcatga

SEQ ID NO: 4422643 - DNA, 22 bp, Homo sapiens
ttttgttttttaagttttgcac

SEQ ID NO: 4422644 - DNA, 18 bp, Homo sapiens
ttttgttttttcaaaata

SEQ ID NO: 4422645 - DNA, 23 bp, Homo sapiens
ttttgttttttttttaaaaaaga

SEQ ID NO: 4422646 - DNA, 13 bp, Homo sapiens
tttttaaaaaaga

SEQ ID NO: 4422647 - DNA, 18 bp, Homo sapiens
tttttaaaaaatattttc

SEQ ID NO: 4422648 - DNA, 15 bp, Homo sapiens
tttttaaaacaaaag

SEQ ID NO: 4422649 - DNA, 23 bp, Homo sapiens
ttgtgatttctttaaaagaatga

SEQ ID NO: 4422650 - DNA, 15 bp, Homo sapiens
ttgtgcaaacatgga

SEQ ID NO: 4422651 - DNA, 15 bp, Homo sapiens
ttgtgcctaatgtgt

SEQ ID NO: 4422652 - DNA, 16 bp, Homo sapiens
ttgtgctagaaatttt

SEQ ID NO: 4422653 - DNA, 14 bp, Homo sapiens
ttgtgcttctcccc

SEQ ID NO: 4422654 - DNA, 13 bp, Homo sapiens
ttgtggaatgttg

SEQ ID NO: 4422655 - DNA, 17 bp, Homo sapiens
ttgtggaccaattattg

SEQ ID NO: 4422656 - DNA, 18 bp, Homo sapiens
ttgtggaccaattattga

SEQ ID NO: 4422657 - DNA, 14 bp, Homo sapiens
ttgtggagccccac

SEQ ID NO: 4422658 - DNA, 17 bp, Homo sapiens
ttgtggattaaaccttt

SEQ ID NO: 4422659 - DNA, 11 bp, Homo sapiens
ttgtggcctca

SEQ ID NO: 4422660 - DNA, 14 bp, Homo sapiens
ttgtggctgggggc

SEQ ID NO: 4422661 - DNA, 19 bp, Homo sapiens
ttgtgggcactggcggtca

SEQ ID NO: 4422662 - DNA, 20 bp, Homo sapiens
ttgtggtaaccagccctgca

SEQ ID NO: 4422663 - DNA, 15 bp, Homo sapiens
ttgtggtaatctaca

SEQ ID NO: 4422664 - DNA, 14 bp, Homo sapiens
ttgtggtttggaat

SEQ ID NO: 4422665 - DNA, 16 bp, Homo sapiens
ttgtggttttatggag

SEQ ID NO: 4422666 - DNA, 13 bp, Homo sapiens
ttgtgtaaatttg

SEQ ID NO: 4422667 - DNA, 16 bp, Homo sapiens
ttgtgtaataaagtgt

SEQ ID NO: 4422668 - DNA, 11 bp, Homo sapiens
ttgtgtagaaa

SEQ ID NO: 4422669 - DNA, 21 bp, Homo sapiens
ttgtgtagaagtccacagaca

SEQ ID NO: 4422670 - DNA, 17 bp, Homo sapiens
ttgtgtatatatcttat

SEQ ID NO: 4422671 - DNA, 21 bp, Homo sapiens
ttgtgtatatatcttataact

SEQ ID NO: 4422672 - DNA, 21 bp, Homo sapiens
ttgtgtatatattataaaaat

SEQ ID NO: 4422673 - DNA, 14 bp, Homo sapiens
ttgtgtatattaca

SEQ ID NO: 4422674 - DNA, 20 bp, Homo sapiens
ttgtgtatcgtaaccagcca

SEQ ID NO: 4422675 - DNA, 21 bp, Homo sapiens
ttgtgtatcgtaaccagccag

SEQ ID NO: 4422676 - DNA, 22 bp, Homo sapiens
ttgtgtatttacgctttgattc

SEQ ID NO: 4422677 - DNA, 18 bp, Homo sapiens
ttgtgtcaagacatttct

SEQ ID NO: 4422678 - DNA, 18 bp, Homo sapiens
ttgtgtcccttggtcctg

SEQ ID NO: 4422679 - DNA, 23 bp, Homo sapiens
ttgtgtctgtgccctccaaagag

SEQ ID NO: 4422680 - DNA, 13 bp, Homo sapiens
ttgtgtggattct

SEQ ID NO: 4422681 - DNA, 13 bp, Homo sapiens
ttgtgtggcccag

SEQ ID NO: 4422682 - DNA, 21 bp, Homo sapiens
ttgtgtggtatgtcactcaga

SEQ ID NO: 4422683 - DNA, 19 bp, Homo sapiens
ttgtgtgtatatgtattta

SEQ ID NO: 4422684 - DNA, 13 bp, Homo sapiens
ttgtgtgtgggag

SEQ ID NO: 4422685 - DNA, 19 bp, Homo sapiens
ttgtgttcctttttgcagc

SEQ ID NO: 4422686 - DNA, 22 bp, Homo sapiens
ttgtgttgactttataaatttc

SEQ ID NO: 4422687 - DNA, 18 bp, Homo sapiens
ttgtgttgcactgaacag

SEQ ID NO: 4422688 - DNA, 19 bp, Homo sapiens
ttgtgtttctttagttttt

SEQ ID NO: 4422689 - DNA, 14 bp, Homo sapiens
ttgttaataaaagt

SEQ ID NO: 4422690 - DNA, 21 bp, Homo sapiens
ttgttaataaaagtacatgtt

SEQ ID NO: 4422691 - DNA, 23 bp, Homo sapiens
ttgttaatataccccaaattgtg

SEQ ID NO: 4422692 - DNA, 15 bp, Homo sapiens
ttgttaatgcattgt

SEQ ID NO: 4422693 - DNA, 21 bp, Homo sapiens
ttgttaatttagaaaacttta

SEQ ID NO: 4422694 - DNA, 16 bp, Homo sapiens
ttgttacgtagcctaa

SEQ ID NO: 4422695 - DNA, 23 bp, Homo sapiens
ttgttaggatagatcttaagcag

SEQ ID NO: 4422696 - DNA, 17 bp, Homo sapiens
ttgttatagattgtctt

SEQ ID NO: 4422697 - DNA, 14 bp, Homo sapiens
ttgttatatataat

SEQ ID NO: 4422698 - DNA, 15 bp, Homo sapiens
ttgttatatataata

SEQ ID NO: 4422699 - DNA, 22 bp, Homo sapiens
ttgttatatataataaatactc

SEQ ID NO: 4422700 - DNA, 18 bp, Homo sapiens
ttgttatatcagcagaca

SEQ ID NO: 4422701 - DNA, 22 bp, Homo sapiens
ttgttatcagtcaatattttta

SEQ ID NO: 4422702 - DNA, 16 bp, Homo sapiens
ttgttattataacata

SEQ ID NO: 4422703 - DNA, 16 bp, Homo sapiens
ttgttccaatgccaca

SEQ ID NO: 4422704 - DNA, 13 bp, Homo sapiens
ttgttcccctcct

SEQ ID NO: 4422705 - DNA, 23 bp, Homo sapiens
ttgttccctatttttctctcctg

SEQ ID NO: 4422706 - DNA, 22 bp, Homo sapiens
ttgttctagacttccccatccc

SEQ ID NO: 4422707 - DNA, 23 bp, Homo sapiens
ttgttctcagaatcccttaacag

SEQ ID NO: 4422708 - DNA, 12 bp, Homo sapiens
ttgttcttcaga

SEQ ID NO: 4422709 - DNA, 14 bp, Homo sapiens
ttgttcttgtattt

SEQ ID NO: 4422710 - DNA, 16 bp, Homo sapiens
ttgttgaaaaagtttg

SEQ ID NO: 4422711 - DNA, 22 bp, Homo sapiens
ttgttgaaaaagtttgtttttg

SEQ ID NO: 4422712 - DNA, 24 bp, Homo sapiens
ttgttgactgtgattagatcacat

SEQ ID NO: 4422713 - DNA, 16 bp, Homo sapiens
ttgttgcaagatgtga

SEQ ID NO: 4422714 - DNA, 19 bp, Homo sapiens
ttgttgcaagatgtgaatt

SEQ ID NO: 4422715 - DNA, 23 bp, Homo sapiens
ttgttgcctacctagctgcatct

SEQ ID NO: 4422716 - DNA, 19 bp, Homo sapiens
ttgttggtgtgttttgctc

SEQ ID NO: 4422717 - DNA, 15 bp, Homo sapiens
ttgttgtaaagtatt

SEQ ID NO: 4422718 - DNA, 18 bp, Homo sapiens
ttgttgtgtgtatatgta

SEQ ID NO: 4422719 - DNA, 13 bp, Homo sapiens
ttgttgtttgtaa

SEQ ID NO: 4422720 - DNA, 14 bp, Homo sapiens
ttgtttaaaatcat

SEQ ID NO: 4422721 - DNA, 21 bp, Homo sapiens
ttgtttaaacccaagtgctgc

SEQ ID NO: 4422722 - DNA, 22 bp, Homo sapiens
ttgtttaaacccaagtgctgca

SEQ ID NO: 4422723 - DNA, 12 bp, Homo sapiens
ttgtttaatcta

SEQ ID NO: 4422724 - DNA, 23 bp, Homo sapiens
ttgtttaatggtagttttacagt

SEQ ID NO: 4422725 - DNA, 22 bp, Homo sapiens
ttgtttaatttttatttcttcc

SEQ ID NO: 4422726 - DNA, 22 bp, Homo sapiens
ttgtttacagcactactctgtg

SEQ ID NO: 4422727 - DNA, 9 bp, Homo sapiens
ttgtttata

SEQ ID NO: 4422728 - DNA, 17 bp, Homo sapiens
ttgtttatatcactgtc

SEQ ID NO: 4422729 - DNA, 18 bp, Homo sapiens
ttgtttatatcactgtct

SEQ ID NO: 4422730 - DNA, 19 bp, Homo sapiens
ttgtttattgagtttgtag

SEQ ID NO: 4422731 - DNA, 16 bp, Homo sapiens
ttgtttcaattgcatc

SEQ ID NO: 4422732 - DNA, 12 bp, Homo sapiens
ttgtttcatcta

SEQ ID NO: 4422733 - DNA, 17 bp, Homo sapiens
ttgtttccttttttccc

SEQ ID NO: 4422734 - DNA, 22 bp, Homo sapiens
ttgtttctagactataaatgtt

SEQ ID NO: 4422735 - DNA, 15 bp, Homo sapiens
ttgtttctgttccaa

SEQ ID NO: 4422736 - DNA, 14 bp, Homo sapiens
ttgtttcttaaata

SEQ ID NO: 4422737 - DNA, 15 bp, Homo sapiens
ttgtttcttaaataa

SEQ ID NO: 4422738 - DNA, 18 bp, Homo sapiens
ttgtttcttgtttattga

SEQ ID NO: 4422739 - DNA, 13 bp, Homo sapiens
ttgtttctttgtg

SEQ ID NO: 4422740 - DNA, 16 bp, Homo sapiens
ttgtttgaatatttgt

SEQ ID NO: 4422741 - DNA, 13 bp, Homo sapiens
ttgtttgaatgtt

SEQ ID NO: 4422742 - DNA, 17 bp, Homo sapiens
ttgtttgattcagcaaa

SEQ ID NO: 4422743 - DNA, 21 bp, Homo sapiens
ttgtttggacctgcatattta

SEQ ID NO: 4422744 - DNA, 13 bp, Homo sapiens
ttgtttggttata

SEQ ID NO: 4422745 - DNA, 18 bp, Homo sapiens
ttgtttgtactggttcat

SEQ ID NO: 4422746 - DNA, 16 bp, Homo sapiens
ttgttttagaaccagc

SEQ ID NO: 4422747 - DNA, 14 bp, Homo sapiens
ttgttttccactgt

SEQ ID NO: 4422748 - DNA, 18 bp, Homo sapiens
ttgttttccactgtgcta

SEQ ID NO: 4422749 - DNA, 15 bp, Homo sapiens
ttgttttgaaaataa

SEQ ID NO: 4422750 - DNA, 13 bp, Homo sapiens
ttgttttgaaagt

SEQ ID NO: 4422751 - DNA, 16 bp, Homo sapiens
ttgttttgaaagttta

SEQ ID NO: 4422752 - DNA, 15 bp, Homo sapiens
ttgtttttcttcagc

SEQ ID NO: 4422753 - DNA, 20 bp, Homo sapiens
ttgtttttcttcagcattta

SEQ ID NO: 4422754 - DNA, 22 bp, Homo sapiens
ttgtttttgagtactgtactat

SEQ ID NO: 4422755 - DNA, 16 bp, Homo sapiens
ttgtttttggtttctt

SEQ ID NO: 4422756 - DNA, 23 bp, Homo sapiens
ttgttttttaaaatccagacttt

SEQ ID NO: 4422757 - DNA, 23 bp, Homo sapiens
tttaaaaaaaaaaaatcatttag

SEQ ID NO: 4422758 - DNA, 23 bp, Homo sapiens
tttaaaaaaccacatggcacaga

SEQ ID NO: 4422759 - DNA, 17 bp, Homo sapiens
tttaaaaaagcttaaaa

SEQ ID NO: 4422760 - DNA, 14 bp, Homo sapiens
tttaataaatttat

SEQ ID NO: 4422761 - DNA, 13 bp, Homo sapiens
tttaataagaaca

SEQ ID NO: 4422762 - DNA, 20 bp, Homo sapiens
tttaatacagctcagtaaat

SEQ ID NO: 4422763 - DNA, 14 bp, Homo sapiens
tttaatacaggaaa

SEQ ID NO: 4422764 - DNA, 15 bp, Homo sapiens
tttaatacttttcca

SEQ ID NO: 4422765 - DNA, 18 bp, Homo sapiens
tttaatagcaaagaattg

SEQ ID NO: 4422766 - DNA, 23 bp, Homo sapiens
tttaatagtgttctctgtattgt

SEQ ID NO: 4422767 - DNA, 20 bp, Homo sapiens
tttaatatgagcttcaatat

SEQ ID NO: 4422768 - DNA, 12 bp, Homo sapiens
tttaatcagaaa

SEQ ID NO: 4422769 - DNA, 15 bp, Homo sapiens
tttaatcatgaatat

SEQ ID NO: 4422770 - DNA, 16 bp, Homo sapiens
tttaatgagaatagaa

SEQ ID NO: 4422771 - DNA, 21 bp, Homo sapiens
tttaatgtaatagggaaaatt

SEQ ID NO: 4422772 - DNA, 16 bp, Homo sapiens
tttaatgtatctattt

SEQ ID NO: 4422773 - DNA, 18 bp, Homo sapiens
tttaatgtatctatttgt

SEQ ID NO: 4422774 - DNA, 21 bp, Homo sapiens
tttaatgtatctatttgtaca

SEQ ID NO: 4422775 - DNA, 22 bp, Homo sapiens
tttaatgtatctatttgtacaa

SEQ ID NO: 4422776 - DNA, 21 bp, Homo sapiens
tttaatgtttctgatttctga

SEQ ID NO: 4422777 - DNA, 19 bp, Homo sapiens
tttaattaaaaactttaaa

SEQ ID NO: 4422778 - DNA, 23 bp, Homo sapiens
tttaattaaaaactttaaagata

SEQ ID NO: 4422779 - DNA, 22 bp, Homo sapiens
tttaattactggaattcttctg

SEQ ID NO: 4422780 - DNA, 16 bp, Homo sapiens
tttaattcaagaaatg

SEQ ID NO: 4422781 - DNA, 19 bp, Homo sapiens
tttaattcaagaaatgaca

SEQ ID NO: 4422782 - DNA, 14 bp, Homo sapiens
tttaattcagcaga

SEQ ID NO: 4422783 - DNA, 14 bp, Homo sapiens
tttaattctagtat

SEQ ID NO: 4422784 - DNA, 16 bp, Homo sapiens
tttaattgtaaactgt

SEQ ID NO: 4422785 - DNA, 19 bp, Homo sapiens
tttaattgtgcaaaggata

SEQ ID NO: 4422786 - DNA, 21 bp, Homo sapiens
tttaattgtgcaaaggataaa

SEQ ID NO: 4422787 - DNA, 19 bp, Homo sapiens
tttaatttagtaaatgtta

SEQ ID NO: 4422788 - DNA, 12 bp, Homo sapiens
tttaatttcagg

SEQ ID NO: 4422789 - DNA, 15 bp, Homo sapiens
tttaatttcaggaaa

SEQ ID NO: 4422790 - DNA, 16 bp, Homo sapiens
tttaatttcaggaaaa

SEQ ID NO: 4422791 - DNA, 21 bp, Homo sapiens
tttaatttccaaaataatcta

SEQ ID NO: 4422792 - DNA, 16 bp, Homo sapiens
tttaattttaaagagt

SEQ ID NO: 4422793 - DNA, 18 bp, Homo sapiens
tttaattttaactgattt

SEQ ID NO: 4422794 - DNA, 22 bp, Homo sapiens
tttaatttttgcttttagaaaa

SEQ ID NO: 4422795 - DNA, 21 bp, Homo sapiens
tttacaaaagatttattgtaa

SEQ ID NO: 4422796 - DNA, 11 bp, Homo sapiens
tttacaactca

SEQ ID NO: 4422797 - DNA, 22 bp, Homo sapiens
tttacaactcattccagatccc

SEQ ID NO: 4422798 - DNA, 17 bp, Homo sapiens
tttacaagaagtacgaa

SEQ ID NO: 4422799 - DNA, 13 bp, Homo sapiens
tttacaagatatt

SEQ ID NO: 4422800 - DNA, 23 bp, Homo sapiens
tttacacagagaaatacaaaata

SEQ ID NO: 4422801 - DNA, 22 bp, Homo sapiens
tttacacagtgagactgtacat

SEQ ID NO: 4422802 - DNA, 15 bp, Homo sapiens
tttacacatcttaaa

SEQ ID NO: 4422803 - DNA, 19 bp, Homo sapiens
tttacacttttgagacttt

SEQ ID NO: 4422804 - DNA, 13 bp, Homo sapiens
tttacagaaatgg

SEQ ID NO: 4422805 - DNA, 17 bp, Homo sapiens
tttacagaagaaaagca

SEQ ID NO: 4422806 - DNA, 21 bp, Homo sapiens
tttacagagaggatacattta

SEQ ID NO: 4422807 - DNA, 22 bp, Homo sapiens
tttacagagaggatacatttaa

SEQ ID NO: 4422808 - DNA, 20 bp, Homo sapiens
tttacagaggacagtatttg

SEQ ID NO: 4422809 - DNA, 18 bp, Homo sapiens
tttacagcactactctgt

SEQ ID NO: 4422810 - DNA, 15 bp, Homo sapiens
tttacagcagcaata

SEQ ID NO: 4422811 - DNA, 16 bp, Homo sapiens
tttacagcagcaatat

SEQ ID NO: 4422812 - DNA, 16 bp, Homo sapiens
tttacagctactttaa

SEQ ID NO: 4422813 - DNA, 21 bp, Homo sapiens
tttacagctcattaaactttt

SEQ ID NO: 4422814 - DNA, 16 bp, Homo sapiens
tttacagctgcctttc

SEQ ID NO: 4422815 - DNA, 20 bp, Homo sapiens
tttacagctttcatgattag

SEQ ID NO: 4422816 - DNA, 23 bp, Homo sapiens
tttacagctttcatgattagcaa

SEQ ID NO: 4422817 - DNA, 17 bp, Homo sapiens
tttacagtgaagaaagc

SEQ ID NO: 4422818 - DNA, 18 bp, Homo sapiens
tttacataagagaaagag

SEQ ID NO: 4422819 - DNA, 12 bp, Homo sapiens
tttaccaaagca

SEQ ID NO: 4422820 - DNA, 13 bp, Homo sapiens
tttaccatcatct

SEQ ID NO: 4422821 - DNA, 16 bp, Homo sapiens
tttaccatcatctctg

SEQ ID NO: 4422822 - DNA, 13 bp, Homo sapiens
tttaccatctgaa

SEQ ID NO: 4422823 - DNA, 15 bp, Homo sapiens
tttacccctgcacag

SEQ ID NO: 4422824 - DNA, 14 bp, Homo sapiens
tttacctgctgctt

SEQ ID NO: 4422825 - DNA, 14 bp, Homo sapiens
tttacctgcttttt

SEQ ID NO: 4422826 - DNA, 18 bp, Homo sapiens
tttaccttcaaactttag

SEQ ID NO: 4422827 - DNA, 13 bp, Homo sapiens
tttactacagttt

SEQ ID NO: 4422828 - DNA, 18 bp, Homo sapiens
tttactagggatccctca

SEQ ID NO: 4422829 - DNA, 20 bp, Homo sapiens
tttactatcacacatgaata

SEQ ID NO: 4422830 - DNA, 17 bp, Homo sapiens
tttactccgtaacagat

SEQ ID NO: 4422831 - DNA, 18 bp, Homo sapiens
tttactctcttcatccgt

SEQ ID NO: 4422832 - DNA, 13 bp, Homo sapiens
tttactctttgaa

SEQ ID NO: 4422833 - DNA, 12 bp, Homo sapiens
tttactgcctgt

SEQ ID NO: 4422834 - DNA, 19 bp, Homo sapiens
tttactggacaaagaattc

SEQ ID NO: 4422835 - DNA, 21 bp, Homo sapiens
tttactgtatcaatttctaat

SEQ ID NO: 4422836 - DNA, 14 bp, Homo sapiens
tttactgtatgttt

SEQ ID NO: 4422837 - DNA, 11 bp, Homo sapiens
tttactgtcag

SEQ ID NO: 4422838 - DNA, 13 bp, Homo sapiens
tttactgtgaaaa

SEQ ID NO: 4422839 - DNA, 22 bp, Homo sapiens
tttactgtttgatataccaaat

SEQ ID NO: 4422840 - DNA, 18 bp, Homo sapiens
tttacttaagtgttcatt

SEQ ID NO: 4422841 - DNA, 20 bp, Homo sapiens
tttacttaagtgttcatttt

SEQ ID NO: 4422842 - DNA, 21 bp, Homo sapiens
tttacttatctctcaaaacaa

SEQ ID NO: 4422843 - DNA, 16 bp, Homo sapiens
tttacttatcttatgc

SEQ ID NO: 4422844 - DNA, 20 bp, Homo sapiens
tttacttctaagtcattcat

SEQ ID NO: 4422845 - DNA, 18 bp, Homo sapiens
tttactttcaagtaatat

SEQ ID NO: 4422846 - DNA, 21 bp, Homo sapiens
tttactttctcccagtatgtt

SEQ ID NO: 4422847 - DNA, 21 bp, Homo sapiens
tttagaaaaacatttaaactt

SEQ ID NO: 4422848 - DNA, 23 bp, Homo sapiens
tttagaaaaacatttaaactttt

SEQ ID NO: 4422849 - DNA, 19 bp, Homo sapiens
tttagaaaacccaagtttt

SEQ ID NO: 4422850 - DNA, 20 bp, Homo sapiens
tttagaaaacccaagttttt

SEQ ID NO: 4422851 - DNA, 12 bp, Homo sapiens
tttagaaaactt

SEQ ID NO: 4422852 - DNA, 14 bp, Homo sapiens
tttagaaaacttta

SEQ ID NO: 4422853 - DNA, 15 bp, Homo sapiens
tttagaaagaatatt

SEQ ID NO: 4422854 - DNA, 20 bp, Homo sapiens
tttagaaataaaccttaata

SEQ ID NO: 4422855 - DNA, 13 bp, Homo sapiens
tttagaaatgttt

SEQ ID NO: 4422856 - DNA, 17 bp, Homo sapiens
tttagaagaagtgtgtc

SEQ ID NO: 4422857 - DNA, 23 bp, Homo sapiens
tttagaataaattcccaacttct

SEQ ID NO: 4422858 - DNA, 16 bp, Homo sapiens
tttagaatcagaataa

SEQ ID NO: 4422859 - DNA, 21 bp, Homo sapiens
tttagaatgttgaaaagtaat

SEQ ID NO: 4422860 - DNA, 22 bp, Homo sapiens
tttagacaagagatgggaatga

SEQ ID NO: 4422861 - DNA, 18 bp, Homo sapiens
tttagatggttacactgt

SEQ ID NO: 4422862 - DNA, 20 bp, Homo sapiens
tttagatggttacactgtta

SEQ ID NO: 4422863 - DNA, 14 bp, Homo sapiens
tttagattgagtaa

SEQ ID NO: 4422864 - DNA, 22 bp, Homo sapiens
tttagcaaatcagtatattttc

SEQ ID NO: 4422865 - DNA, 19 bp, Homo sapiens
tttagcacgtttaaagttc

SEQ ID NO: 4422866 - DNA, 14 bp, Homo sapiens
tttagcagttctgc

SEQ ID NO: 4422867 - DNA, 12 bp, Homo sapiens
tttagctacctt

SEQ ID NO: 4422868 - DNA, 19 bp, Homo sapiens
tttagctacctttttatat

SEQ ID NO: 4422869 - DNA, 13 bp, Homo sapiens
tttagctgtagat

SEQ ID NO: 4422870 - DNA, 18 bp, Homo sapiens
tttaggaagcaagcttaa

SEQ ID NO: 4422871 - DNA, 17 bp, Homo sapiens
tttaggtgctgttatgt

SEQ ID NO: 4422872 - DNA, 17 bp, Homo sapiens
tttagtaaatgttatct

SEQ ID NO: 4422873 - DNA, 13 bp, Homo sapiens
tttagtaatttct

SEQ ID NO: 4422874 - DNA, 21 bp, Homo sapiens
tttagtacaatagtatacatt

SEQ ID NO: 4422875 - DNA, 21 bp, Homo sapiens
tttagtagcagtgattgtctt

SEQ ID NO: 4422876 - DNA, 19 bp, Homo sapiens
tttagtatacgtataaata

SEQ ID NO: 4422877 - DNA, 22 bp, Homo sapiens
tttagtatacgtataaatatca

SEQ ID NO: 4422878 - DNA, 13 bp, Homo sapiens
tttatttctctgg

SEQ ID NO: 4422879 - DNA, 14 bp, Homo sapiens
tttatttgcttctt

SEQ ID NO: 4422880 - DNA, 17 bp, Homo sapiens
tttatttgttctttttc

SEQ ID NO: 4422881 - DNA, 14 bp, Homo sapiens
tttattttagcaaa

SEQ ID NO: 4422882 - DNA, 18 bp, Homo sapiens
tttattttattctatgta

SEQ ID NO: 4422883 - DNA, 15 bp, Homo sapiens
tttattttgtatgaa

SEQ ID NO: 4422884 - DNA, 21 bp, Homo sapiens
tttattttgtatgaaatatat

SEQ ID NO: 4422885 - DNA, 14 bp, Homo sapiens
tttatttttacctg

SEQ ID NO: 4422886 - DNA, 12 bp, Homo sapiens
tttatttttcat

SEQ ID NO: 4422887 - DNA, 14 bp, Homo sapiens
tttatttttgacag

SEQ ID NO: 4422888 - DNA, 16 bp, Homo sapiens
tttatttttgtacatt

SEQ ID NO: 4422889 - DNA, 23 bp, Homo sapiens
tttattttttaaaaaaacaaatg

SEQ ID NO: 4422890 - DNA, 13 bp, Homo sapiens
tttattttttggt

SEQ ID NO: 4422891 - DNA, 18 bp, Homo sapiens
tttcaaaaccttttgaaa

SEQ ID NO: 4422892 - DNA, 11 bp, Homo sapiens
tttcaaaatag

SEQ ID NO: 4422893 - DNA, 20 bp, Homo sapiens
tttcaaaatagaaaagttat

SEQ ID NO: 4422894 - DNA, 15 bp, Homo sapiens
tttcaaaatagacaa

SEQ ID NO: 4422895 - DNA, 15 bp, Homo sapiens
tttcaaaatgaattt

SEQ ID NO: 4422896 - DNA, 15 bp, Homo sapiens
tttcaaaatgctttt

SEQ ID NO: 4422897 - DNA, 23 bp, Homo sapiens
tttcaaacaagaaacatttcaga

SEQ ID NO: 4422898 - DNA, 21 bp, Homo sapiens
tttcaaattggagcttcatgg

SEQ ID NO: 4422899 - DNA, 18 bp, Homo sapiens
tttcaaatttagaaacta

SEQ ID NO: 4422900 - DNA, 20 bp, Homo sapiens
tttcaaatttagaaactaat

SEQ ID NO: 4422901 - DNA, 21 bp, Homo sapiens
tttcaaatttagaaactaatt

SEQ ID NO: 4422902 - DNA, 15 bp, Homo sapiens
tttcaacggaaagtg

SEQ ID NO: 4422903 - DNA, 22 bp, Homo sapiens
tttcaagagtctaatagtcttt

SEQ ID NO: 4422904 - DNA, 22 bp, Homo sapiens
tttcaagataaggagaaagaaa

SEQ ID NO: 4422905 - DNA, 22 bp, Homo sapiens
tttcaagatctaaatcatatat

SEQ ID NO: 4422906 - DNA, 12 bp, Homo sapiens
tttcaagccctc

SEQ ID NO: 4422907 - DNA, 12 bp, Homo sapiens
tttcaagtgcct

SEQ ID NO: 4422908 - DNA, 16 bp, Homo sapiens
tttcaagttgtaaata

SEQ ID NO: 4422909 - DNA, 18 bp, Homo sapiens
tttcaagttttaaagttc

SEQ ID NO: 4422910 - DNA, 15 bp, Homo sapiens
tttcaagtttttcat

SEQ ID NO: 4422911 - DNA, 23 bp, Homo sapiens
tttcaagtttttcatactgtaca

SEQ ID NO: 4422912 - DNA, 19 bp, Homo sapiens
tttcaataaatctttcaaa

SEQ ID NO: 4422913 - DNA, 14 bp, Homo sapiens
tttcaatatattga

SEQ ID NO: 4422914 - DNA, 18 bp, Homo sapiens
tttcaatatattgaactt

SEQ ID NO: 4422915 - DNA, 12 bp, Homo sapiens
tttcaatatgca

SEQ ID NO: 4422916 - DNA, 14 bp, Homo sapiens
tttcaatattttaa

SEQ ID NO: 4422917 - DNA, 18 bp, Homo sapiens
tttcaatattttaacttt

SEQ ID NO: 4422918 - DNA, 18 bp, Homo sapiens
tttcaatcgtaaaatttc

SEQ ID NO: 4422919 - DNA, 15 bp, Homo sapiens
tttcaatgtaattaa

SEQ ID NO: 4422920 - DNA, 22 bp, Homo sapiens
tttcaatgtctaaaaacatttg

SEQ ID NO: 4422921 - DNA, 18 bp, Homo sapiens
tttcaattgcatctccca

SEQ ID NO: 4422922 - DNA, 20 bp, Homo sapiens
tttcaattgcatctcccaga

SEQ ID NO: 4422923 - DNA, 12 bp, Homo sapiens
tttcacaagcaa

SEQ ID NO: 4422924 - DNA, 18 bp, Homo sapiens
tttcacaggtagcctatt

SEQ ID NO: 4422925 - DNA, 22 bp, Homo sapiens
tttcacagtgtgtggtcaacat

SEQ ID NO: 4422926 - DNA, 13 bp, Homo sapiens
tttcacattttcc

SEQ ID NO: 4422927 - DNA, 14 bp, Homo sapiens
tttcacattttcct

SEQ ID NO: 4422928 - DNA, 20 bp, Homo sapiens
tttcaccagaatttctaaga

SEQ ID NO: 4422929 - DNA, 15 bp, Homo sapiens
tttcacccctccctt

SEQ ID NO: 4422930 - DNA, 17 bp, Homo sapiens
tttcacccctccctttc

SEQ ID NO: 4422931 - DNA, 20 bp, Homo sapiens
tttcacccctccctttctcc

SEQ ID NO: 4422932 - DNA, 16 bp, Homo sapiens
tttcacctagattttt

SEQ ID NO: 4422933 - DNA, 18 bp, Homo sapiens
tttcaccttttcaggaaa

SEQ ID NO: 4422934 - DNA, 20 bp, Homo sapiens
tttcacgcctgaggcaatta

SEQ ID NO: 4422935 - DNA, 15 bp, Homo sapiens
tttcacgggagattt

SEQ ID NO: 4422936 - DNA, 20 bp, Homo sapiens
tttcactatacaggctggga

SEQ ID NO: 4422937 - DNA, 14 bp, Homo sapiens
tttcactttgacat

SEQ ID NO: 4422938 - DNA, 12 bp, Homo sapiens
tttcagaaatca

SEQ ID NO: 4422939 - DNA, 19 bp, Homo sapiens
tttcagaacctcttcccca

SEQ ID NO: 4422940 - DNA, 20 bp, Homo sapiens
tttcagaacctcttccccag

SEQ ID NO: 4422941 - DNA, 21 bp, Homo sapiens
tttcagaagaaataaatatac

SEQ ID NO: 4422942 - DNA, 15 bp, Homo sapiens
tttcagaagcaagcc

SEQ ID NO: 4422943 - DNA, 19 bp, Homo sapiens
tttcagaatctgaatgtaa

SEQ ID NO: 4422944 - DNA, 23 bp, Homo sapiens
tttcagaatgcaatgtttctaaa

SEQ ID NO: 4422945 - DNA, 15 bp, Homo sapiens
tttcagactgcagag

SEQ ID NO: 4422946 - DNA, 14 bp, Homo sapiens
tttcagatataaaa

SEQ ID NO: 4422947 - DNA, 19 bp, Homo sapiens
tttcagatgtaatgttttc

SEQ ID NO: 4422948 - DNA, 19 bp, Homo sapiens
tttcagatgtcttctgcct

SEQ ID NO: 4422949 - DNA, 21 bp, Homo sapiens
tttcagattgtggaatgttgg

SEQ ID NO: 4422950 - DNA, 18 bp, Homo sapiens
tttcagattttgataact

SEQ ID NO: 4422951 - DNA, 21 bp, Homo sapiens
tttcagattttttaaaatttt

SEQ ID NO: 4422952 - DNA, 15 bp, Homo sapiens
tttcagcactgatgg

SEQ ID NO: 4422953 - DNA, 19 bp, Homo sapiens
tttcagctagttaataatt

SEQ ID NO: 4422954 - DNA, 11 bp, Homo sapiens
tttcaggaaaa

SEQ ID NO: 4422955 - DNA, 21 bp, Homo sapiens
tttcaggaaaatgtattgatt

SEQ ID NO: 4422956 - DNA, 23 bp, Homo sapiens
tttcaggaaaatgtattgattca

SEQ ID NO: 4422957 - DNA, 19 bp, Homo sapiens
tttcagtacttttttaaat

SEQ ID NO: 4422958 - DNA, 15 bp, Homo sapiens
tttcagtattttcca

SEQ ID NO: 4422959 - DNA, 15 bp, Homo sapiens
tttcagtcaaaactt

SEQ ID NO: 4422960 - DNA, 18 bp, Homo sapiens
tttcagtccccacagata

SEQ ID NO: 4422961 - DNA, 17 bp, Homo sapiens
tttcagtcctgtagttt

SEQ ID NO: 4422962 - DNA, 19 bp, Homo sapiens
tttcagtgataatgttcat

SEQ ID NO: 4422963 - DNA, 21 bp, Homo sapiens
tttcagtgataatgttcattt

SEQ ID NO: 4422964 - DNA, 20 bp, Homo sapiens
tttcagtgatcttcactgta

SEQ ID NO: 4422965 - DNA, 21 bp, Homo sapiens
tttcagtgtcaaataaacact

SEQ ID NO: 4422966 - DNA, 23 bp, Homo sapiens
tttcagtgtcaaataaacactgt

SEQ ID NO: 4422967 - DNA, 12 bp, Homo sapiens
tttcataactta

SEQ ID NO: 4422968 - DNA, 17 bp, Homo sapiens
tttcataagtatttcaa

SEQ ID NO: 4422969 - DNA, 15 bp, Homo sapiens
tttcataattctgaa

SEQ ID NO: 4422970 - DNA, 17 bp, Homo sapiens
tttcataattctgaaac

SEQ ID NO: 4422971 - DNA, 13 bp, Homo sapiens
tttcataatttgt

SEQ ID NO: 4422972 - DNA, 13 bp, Homo sapiens
tttcatataaagt

SEQ ID NO: 4422973 - DNA, 12 bp, Homo sapiens
tttcatatcatt

SEQ ID NO: 4422974 - DNA, 15 bp, Homo sapiens
tttcatatcatttct

SEQ ID NO: 4422975 - DNA, 17 bp, Homo sapiens
tttcatattattttagt

SEQ ID NO: 4422976 - DNA, 15 bp, Homo sapiens
tttcatatttctacc

SEQ ID NO: 4422977 - DNA, 23 bp, Homo sapiens
tttcatcaagagtttattattgt

SEQ ID NO: 4422978 - DNA, 13 bp, Homo sapiens
tttcatcaatgca

SEQ ID NO: 4422979 - DNA, 13 bp, Homo sapiens
tttcatcatttca

SEQ ID NO: 4422980 - DNA, 22 bp, Homo sapiens
tttcatccagtttgttctccgg

SEQ ID NO: 4422981 - DNA, 14 bp, Homo sapiens
tttcatctaaatga

SEQ ID NO: 4422982 - DNA, 12 bp, Homo sapiens
tttcatctattt

SEQ ID NO: 4422983 - DNA, 15 bp, Homo sapiens
tttcatctattttat

SEQ ID NO: 4422984 - DNA, 17 bp, Homo sapiens
tttcatctattttattt

SEQ ID NO: 4422985 - DNA, 21 bp, Homo sapiens
tttcatctcagagtccactgt

SEQ ID NO: 4422986 - DNA, 22 bp, Homo sapiens
tttcatctcatttaagggaaaa

SEQ ID NO: 4422987 - DNA, 15 bp, Homo sapiens
tttcatcttaaacta

SEQ ID NO: 4422988 - DNA, 12 bp, Homo sapiens
tttcatgaaaaa

SEQ ID NO: 4422989 - DNA, 20 bp, Homo sapiens
tttcatgaaaaagctgcttc

SEQ ID NO: 4422990 - DNA, 22 bp, Homo sapiens
tttcatgataatgaacagaaca

SEQ ID NO: 4422991 - DNA, 16 bp, Homo sapiens
tttcatgattagaaat

SEQ ID NO: 4422992 - DNA, 17 bp, Homo sapiens
tttcatgctctgcaaaa

SEQ ID NO: 4422993 - DNA, 18 bp, Homo sapiens
tttcatgtcccagaactt

SEQ ID NO: 4422994 - DNA, 21 bp, Homo sapiens
tttcatgtggtgaatatgcaa

SEQ ID NO: 4422995 - DNA, 19 bp, Homo sapiens
tttcattaaataaatttga

SEQ ID NO: 4422996 - DNA, 16 bp, Homo sapiens
tttctaaaagctttca

SEQ ID NO: 4422997 - DNA, 12 bp, Homo sapiens
tttctaaaatct

SEQ ID NO: 4422998 - DNA, 15 bp, Homo sapiens
tttctaaaatctaaa

SEQ ID NO: 4422999 - DNA, 16 bp, Homo sapiens
tttctaaaatctaaaa

SEQ ID NO: 4423000 - DNA, 17 bp, Homo sapiens
tttctaaaatctaaaat

SEQ ID NO: 4423001 - DNA, 22 bp, Homo sapiens
tttctaaactcaataaggtaat

SEQ ID NO: 4423002 - DNA, 23 bp, Homo sapiens
tttctaaagtaaaattgaagcaa

SEQ ID NO: 4423003 - DNA, 12 bp, Homo sapiens
tttctaagacta

SEQ ID NO: 4423004 - DNA, 19 bp, Homo sapiens
tttctaagcataaaagatg

SEQ ID NO: 4423005 - DNA, 13 bp, Homo sapiens
tttctaatgttta

SEQ ID NO: 4423006 - DNA, 14 bp, Homo sapiens
tttctaatgtttac

SEQ ID NO: 4423007 - DNA, 19 bp, Homo sapiens
tttctaatgtttactatat

SEQ ID NO: 4423008 - DNA, 13 bp, Homo sapiens
tttctacatgtga

SEQ ID NO: 4423009 - DNA, 21 bp, Homo sapiens
tttctaccacacacagcctgt

SEQ ID NO: 4423010 - DNA, 16 bp, Homo sapiens
tttctactctagatgg

SEQ ID NO: 4423011 - DNA, 23 bp, Homo sapiens
tttctagatacaataaattgcta

SEQ ID NO: 4423012 - DNA, 16 bp, Homo sapiens
tttctagccataataa

SEQ ID NO: 4423013 - DNA, 16 bp, Homo sapiens
tttctagttctttcct

SEQ ID NO: 4423014 - DNA, 12 bp, Homo sapiens
tttctataaatt

SEQ ID NO: 4423015 - DNA, 15 bp, Homo sapiens
tttctatcctctgta

SEQ ID NO: 4423016 - DNA, 15 bp, Homo sapiens
tttctatcctgttta

SEQ ID NO: 4423017 - DNA, 16 bp, Homo sapiens
ttctttattgcccctt

SEQ ID NO: 4423018 - DNA, 16 bp, Homo sapiens
ttctttcccagtctgt

SEQ ID NO: 4423019 - DNA, 10 bp, Homo sapiens
ttctttcccc

SEQ ID NO: 4423020 - DNA, 16 bp, Homo sapiens
ttctttccccagaggc

SEQ ID NO: 4423021 - DNA, 19 bp, Homo sapiens
ttctttcctccccctgcaa

SEQ ID NO: 4423022 - DNA, 21 bp, Homo sapiens
ttctttcctccccctgcaact

SEQ ID NO: 4423023 - DNA, 12 bp, Homo sapiens
ttctttcctgcc

SEQ ID NO: 4423024 - DNA, 13 bp, Homo sapiens
ttctttcctgccc

SEQ ID NO: 4423025 - DNA, 14 bp, Homo sapiens
ttctttcctgccct

SEQ ID NO: 4423026 - DNA, 14 bp, Homo sapiens
ttctttcctttaaa

SEQ ID NO: 4423027 - DNA, 15 bp, Homo sapiens
ttctttcctttaaaa

SEQ ID NO: 4423028 - DNA, 12 bp, Homo sapiens
ttctttctagaa

SEQ ID NO: 4423029 - DNA, 15 bp, Homo sapiens
ttctttctcactaaa

SEQ ID NO: 4423030 - DNA, 13 bp, Homo sapiens
ttctttctggact

SEQ ID NO: 4423031 - DNA, 19 bp, Homo sapiens
ttctttgaccagcacatta

SEQ ID NO: 4423032 - DNA, 17 bp, Homo sapiens
ttctttgcaacagcagt

SEQ ID NO: 4423033 - DNA, 20 bp, Homo sapiens
ttctttgcaacagcagtgtt

SEQ ID NO: 4423034 - DNA, 22 bp, Homo sapiens
ttctttgcaccaaagacatcag

SEQ ID NO: 4423035 - DNA, 21 bp, Homo sapiens
ttctttgcttgaacacagtat

SEQ ID NO: 4423036 - DNA, 18 bp, Homo sapiens
ttctttggtgcctttcct

SEQ ID NO: 4423037 - DNA, 22 bp, Homo sapiens
ttctttggtttcccaagagcta

SEQ ID NO: 4423038 - DNA, 20 bp, Homo sapiens
ttctttgtagaataaatggt

SEQ ID NO: 4423039 - DNA, 12 bp, Homo sapiens
ttctttgtatca

SEQ ID NO: 4423040 - DNA, 18 bp, Homo sapiens
ttcttttaaagatttgtt

SEQ ID NO: 4423041 - DNA, 13 bp, Homo sapiens
ttcttttattaat

SEQ ID NO: 4423042 - DNA, 20 bp, Homo sapiens
ttcttttcttcactcaaatt

SEQ ID NO: 4423043 - DNA, 14 bp, Homo sapiens
ttcttttcttttgt

SEQ ID NO: 4423044 - DNA, 12 bp, Homo sapiens
ttctttttcatc

SEQ ID NO: 4423045 - DNA, 17 bp, Homo sapiens
ttctttttctacatgtg

SEQ ID NO: 4423046 - DNA, 15 bp, Homo sapiens
ttctttttctttctt

SEQ ID NO: 4423047 - DNA, 14 bp, Homo sapiens
ttctttttgaaatg

SEQ ID NO: 4423048 - DNA, 15 bp, Homo sapiens
ttctttttgaaatgt

SEQ ID NO: 4423049 - DNA, 17 bp, Homo sapiens
ttcttttttaaattaat

SEQ ID NO: 4423050 - DNA, 20 bp, Homo sapiens
ttctttttttttaagttctt

SEQ ID NO: 4423051 - DNA, 22 bp, Homo sapiens
ttcttttttttttttttgagac

SEQ ID NO: 4423052 - DNA, 15 bp, Homo sapiens
ttgaaaaaaacttca

SEQ ID NO: 4423053 - DNA, 21 bp, Homo sapiens
ttgaaaaaaagtgctgaaaat

SEQ ID NO: 4423054 - DNA, 13 bp, Homo sapiens
ttgaaaaaagctc

SEQ ID NO: 4423055 - DNA, 14 bp, Homo sapiens
ttgaaaaaagctca

SEQ ID NO: 4423056 - DNA, 21 bp, Homo sapiens
ttgaaaaaatttaaaagtaaa

SEQ ID NO: 4423057 - DNA, 11 bp, Homo sapiens
ttgaaaaacaa

SEQ ID NO: 4423058 - DNA, 11 bp, Homo sapiens
ttgaaaaagat

SEQ ID NO: 4423059 - DNA, 12 bp, Homo sapiens
ttgaaaaagata

SEQ ID NO: 4423060 - DNA, 14 bp, Homo sapiens
ttgaaaaagataaa

SEQ ID NO: 4423061 - DNA, 18 bp, Homo sapiens
ttgaaaaagataaagagt

SEQ ID NO: 4423062 - DNA, 18 bp, Homo sapiens
ttgaaaaccaaaatgaca

SEQ ID NO: 4423063 - DNA, 20 bp, Homo sapiens
ttgaaaaccaaaatgacatc

SEQ ID NO: 4423064 - DNA, 18 bp, Homo sapiens
ttgaaaactgtgcaactt

SEQ ID NO: 4423065 - DNA, 13 bp, Homo sapiens
ttgaaaagaattt

SEQ ID NO: 4423066 - DNA, 15 bp, Homo sapiens
ttgaaaagcagacat

SEQ ID NO: 4423067 - DNA, 20 bp, Homo sapiens
ttgaaaaggaacttgccctg

SEQ ID NO: 4423068 - DNA, 21 bp, Homo sapiens
ttgaaaataagaatagaaata

SEQ ID NO: 4423069 - DNA, 23 bp, Homo sapiens
ttgaaaatatatattatatacat

SEQ ID NO: 4423070 - DNA, 20 bp, Homo sapiens
ttgaaaatatgtactgtata

SEQ ID NO: 4423071 - DNA, 16 bp, Homo sapiens
ttgaaaattgtatacc

SEQ ID NO: 4423072 - DNA, 15 bp, Homo sapiens
ttgaaaccagtattt

SEQ ID NO: 4423073 - DNA, 17 bp, Homo sapiens
ttgaaactgcatttgtg

SEQ ID NO: 4423074 - DNA, 14 bp, Homo sapiens
ttgaaactttaaga

SEQ ID NO: 4423075 - DNA, 14 bp, Homo sapiens
ttgaaagaatagaa

SEQ ID NO: 4423076 - DNA, 17 bp, Homo sapiens
ttgaaagggatcatcat

SEQ ID NO: 4423077 - DNA, 22 bp, Homo sapiens
ttgaaaggttttttttcagttg

SEQ ID NO: 4423078 - DNA, 16 bp, Homo sapiens
ttgaaagttgtacatg

SEQ ID NO: 4423079 - DNA, 19 bp, Homo sapiens
ttgaaagttgtacatgata

SEQ ID NO: 4423080 - DNA, 19 bp, Homo sapiens
ttgaaagtttaacaaatga

SEQ ID NO: 4423081 - DNA, 17 bp, Homo sapiens
ttgaaagttttcagaac

SEQ ID NO: 4423082 - DNA, 21 bp, Homo sapiens
ttgaaataagaattcagacat

SEQ ID NO: 4423083 - DNA, 23 bp, Homo sapiens
ttgaaatagtatacattgtcttg

SEQ ID NO: 4423084 - DNA, 21 bp, Homo sapiens
ttgaaatgaggtctgtttaaa

SEQ ID NO: 4423085 - DNA, 16 bp, Homo sapiens
ttgaaatgctgtattt

SEQ ID NO: 4423086 - DNA, 23 bp, Homo sapiens
ttgaaatgctgtatttttacagc

SEQ ID NO: 4423087 - DNA, 14 bp, Homo sapiens
ttgaaatgtaattt

SEQ ID NO: 4423088 - DNA, 16 bp, Homo sapiens
ttgaaatgtaatttca

SEQ ID NO: 4423089 - DNA, 19 bp, Homo sapiens
ttgaaatgtaatttcagtt

SEQ ID NO: 4423090 - DNA, 13 bp, Homo sapiens
ttgaaattctatt

SEQ ID NO: 4423091 - DNA, 12 bp, Homo sapiens
ttgaaattctga

SEQ ID NO: 4423092 - DNA, 20 bp, Homo sapiens
ttgaaattctgaatttgcaa

SEQ ID NO: 4423093 - DNA, 15 bp, Homo sapiens
ttgaaatttacacag

SEQ ID NO: 4423094 - DNA, 17 bp, Homo sapiens
ttgaaatttacacagtg

SEQ ID NO: 4423095 - DNA, 18 bp, Homo sapiens
ttgaaatttacacagtga

SEQ ID NO: 4423096 - DNA, 16 bp, Homo sapiens
ttgaaatttactgtga

SEQ ID NO: 4423097 - DNA, 13 bp, Homo sapiens
ttgaaatttccta

SEQ ID NO: 4423098 - DNA, 14 bp, Homo sapiens
ttgaacacaaactg

SEQ ID NO: 4423099 - DNA, 21 bp, Homo sapiens
ttgaacacaaactgtaaataa

SEQ ID NO: 4423100 - DNA, 14 bp, Homo sapiens
ttgaacacagtatt

SEQ ID NO: 4423101 - DNA, 15 bp, Homo sapiens
ttgaaccaaaacata

SEQ ID NO: 4423102 - DNA, 17 bp, Homo sapiens
ttgaaccattatacttt

SEQ ID NO: 4423103 - DNA, 20 bp, Homo sapiens
ttgaaccattatactttata

SEQ ID NO: 4423104 - DNA, 22 bp, Homo sapiens
ttgaaccattatactttatatc

SEQ ID NO: 4423105 - DNA, 12 bp, Homo sapiens
ttgaacccagga

SEQ ID NO: 4423106 - DNA, 16 bp, Homo sapiens
ttgaacctccaaatgg

SEQ ID NO: 4423107 - DNA, 17 bp, Homo sapiens
ttgaacctccaaatgga

SEQ ID NO: 4423108 - DNA, 21 bp, Homo sapiens
ttgaacgactgtatattgcta

SEQ ID NO: 4423109 - DNA, 15 bp, Homo sapiens
ttgaactcagatctg

SEQ ID NO: 4423110 - DNA, 13 bp, Homo sapiens
ttgaactttagtt

SEQ ID NO: 4423111 - DNA, 23 bp, Homo sapiens
ttgaacttttgtactgaattttt

SEQ ID NO: 4423112 - DNA, 17 bp, Homo sapiens
ttgaagaaacagagtgg

SEQ ID NO: 4423113 - DNA, 17 bp, Homo sapiens
ttgaagaataaattcta

SEQ ID NO: 4423114 - DNA, 13 bp, Homo sapiens
ttgaagattctat

SEQ ID NO: 4423115 - DNA, 19 bp, Homo sapiens
ttgaagcatagctacaatt

SEQ ID NO: 4423116 - DNA, 11 bp, Homo sapiens
ttgaagccaaa

SEQ ID NO: 4423117 - DNA, 17 bp, Homo sapiens
ttgaagcctaaatttgt

SEQ ID NO: 4423118 - DNA, 17 bp, Homo sapiens
ttgaaggagaaaataga

SEQ ID NO: 4423119 - DNA, 15 bp, Homo sapiens
ttgaaggcaaaattg

SEQ ID NO: 4423120 - DNA, 12 bp, Homo sapiens
ttgaaggccagc

SEQ ID NO: 4423121 - DNA, 12 bp, Homo sapiens
ttgaaggcttaa

SEQ ID NO: 4423122 - DNA, 15 bp, Homo sapiens
ttgaagggaggggct

SEQ ID NO: 4423123 - DNA, 20 bp, Homo sapiens
ttgaagggaggggctgtgtt

SEQ ID NO: 4423124 - DNA, 19 bp, Homo sapiens
ttgaaggtagaatgttttc

SEQ ID NO: 4423125 - DNA, 20 bp, Homo sapiens
ttgaagtaacttatttgact

SEQ ID NO: 4423126 - DNA, 23 bp, Homo sapiens
ttgaagttagctttaacttaaat

SEQ ID NO: 4423127 - DNA, 19 bp, Homo sapiens
ttgaagtttcaagttttaa

SEQ ID NO: 4423128 - DNA, 22 bp, Homo sapiens
ttgaagtttcaagttttaaagt

SEQ ID NO: 4423129 - DNA, 17 bp, Homo sapiens
ttgaataaaaacctttt

SEQ ID NO: 4423130 - DNA, 18 bp, Homo sapiens
ttgaataaacataaaagc

SEQ ID NO: 4423131 - DNA, 18 bp, Homo sapiens
ttgaataaagaatacttg

SEQ ID NO: 4423132 - DNA, 22 bp, Homo sapiens
ttgaataaattttcaaatcctt

SEQ ID NO: 4423133 - DNA, 12 bp, Homo sapiens
ttgaataagcag

SEQ ID NO: 4423134 - DNA, 12 bp, Homo sapiens
ttgaatactgtc

SEQ ID NO: 4423135 - DNA, 17 bp, Homo sapiens
ttgaatactgtctgtat

SEQ ID NO: 4423136 - DNA, 19 bp, Homo sapiens
ttgcctatgcccagggaat

SEQ ID NO: 4423137 - DNA, 16 bp, Homo sapiens
ttgcctcatttcccta

SEQ ID NO: 4423138 - DNA, 20 bp, Homo sapiens
ttgcctccccatttcccatc

SEQ ID NO: 4423139 - DNA, 19 bp, Homo sapiens
ttgcctcttccagtcttcc

SEQ ID NO: 4423140 - DNA, 23 bp, Homo sapiens
ttgcctcttctacttgtaaaatg

SEQ ID NO: 4423141 - DNA, 12 bp, Homo sapiens
ttgcctcttctt

SEQ ID NO: 4423142 - DNA, 21 bp, Homo sapiens
ttgcctcttctttgtgccttt

SEQ ID NO: 4423143 - DNA, 13 bp, Homo sapiens
ttgcctctttctc

SEQ ID NO: 4423144 - DNA, 21 bp, Homo sapiens
ttgcctcttttacctgctgct

SEQ ID NO: 4423145 - DNA, 16 bp, Homo sapiens
ttgcctgaactccaga

SEQ ID NO: 4423146 - DNA, 17 bp, Homo sapiens
ttgcctgaactccagag

SEQ ID NO: 4423147 - DNA, 22 bp, Homo sapiens
ttgcctgagaagaagtggctgc

SEQ ID NO: 4423148 - DNA, 23 bp, Homo sapiens
ttgcctgcaggtcagttgtaata

SEQ ID NO: 4423149 - DNA, 22 bp, Homo sapiens
ttgcctgcagtttcttgtgtag

SEQ ID NO: 4423150 - DNA, 19 bp, Homo sapiens
ttgcctgcttctttccaga

SEQ ID NO: 4423151 - DNA, 12 bp, Homo sapiens
ttgcctggcctt

SEQ ID NO: 4423152 - DNA, 22 bp, Homo sapiens
ttgccttatttgtctgtaaaaa

SEQ ID NO: 4423153 - DNA, 20 bp, Homo sapiens
ttgccttccatttcccctct

SEQ ID NO: 4423154 - DNA, 21 bp, Homo sapiens
ttgccttctctgttcccttgc

SEQ ID NO: 4423155 - DNA, 23 bp, Homo sapiens
ttgcctttaatattttgtaatat

SEQ ID NO: 4423156 - DNA, 19 bp, Homo sapiens
ttgccttttaatttttaat

SEQ ID NO: 4423157 - DNA, 15 bp, Homo sapiens
ttgccttttgttaat

SEQ ID NO: 4423158 - DNA, 19 bp, Homo sapiens
ttgcgcctcagccctcagt

SEQ ID NO: 4423159 - DNA, 12 bp, Homo sapiens
ttgcgctcaggg

SEQ ID NO: 4423160 - DNA, 13 bp, Homo sapiens
ttgcgctcagggg

SEQ ID NO: 4423161 - DNA, 16 bp, Homo sapiens
ttgctaaaaaagcata

SEQ ID NO: 4423162 - DNA, 17 bp, Homo sapiens
ttgctaaaagcatgtat

SEQ ID NO: 4423163 - DNA, 13 bp, Homo sapiens
ttgctaaactgat

SEQ ID NO: 4423164 - DNA, 14 bp, Homo sapiens
ttgctaatgttgct

SEQ ID NO: 4423165 - DNA, 17 bp, Homo sapiens
ttgctaatttttattaa

SEQ ID NO: 4423166 - DNA, 20 bp, Homo sapiens
ttgctaccagtatttagaag

SEQ ID NO: 4423167 - DNA, 16 bp, Homo sapiens
ttgctacctcagtgct

SEQ ID NO: 4423168 - DNA, 17 bp, Homo sapiens
ttgctcaaaaaatgagc

SEQ ID NO: 4423169 - DNA, 18 bp, Homo sapiens
ttgctcaacagacaatta

SEQ ID NO: 4423170 - DNA, 17 bp, Homo sapiens
ttgctcccaacccattc

SEQ ID NO: 4423171 - DNA, 17 bp, Homo sapiens
ttgctctatatgtaata

SEQ ID NO: 4423172 - DNA, 20 bp, Homo sapiens
ttgctctatgtctgccttcg

SEQ ID NO: 4423173 - DNA, 19 bp, Homo sapiens
ttgctctcttcaataaacc

SEQ ID NO: 4423174 - DNA, 16 bp, Homo sapiens
ttgctctgtcccccag

SEQ ID NO: 4423175 - DNA, 24 bp, Homo sapiens
ttgctctgtgtatatctcttggaa

SEQ ID NO: 4423176 - DNA, 17 bp, Homo sapiens
ttgctcttagtcccaag

SEQ ID NO: 4423177 - DNA, 16 bp, Homo sapiens
ttgctctttagatgca

SEQ ID NO: 4423178 - DNA, 16 bp, Homo sapiens
ttgctgaaattttata

SEQ ID NO: 4423179 - DNA, 24 bp, Homo sapiens
ttgctgaactcagcacattcggga

SEQ ID NO: 4423180 - DNA, 21 bp, Homo sapiens
ttgctgaagggcattctttcc

SEQ ID NO: 4423181 - DNA, 19 bp, Homo sapiens
ttgctgagccagctgcaga

SEQ ID NO: 4423182 - DNA, 14 bp, Homo sapiens
ttgctgattttaat

SEQ ID NO: 4423183 - DNA, 19 bp, Homo sapiens
ttgctgcagtcatctactt

SEQ ID NO: 4423184 - DNA, 13 bp, Homo sapiens
ttgctgcccctgt

SEQ ID NO: 4423185 - DNA, 20 bp, Homo sapiens
ttgctgctgtgaatctgaaa

SEQ ID NO: 4423186 - DNA, 16 bp, Homo sapiens
ttgctggaacacaggg

SEQ ID NO: 4423187 - DNA, 17 bp, Homo sapiens
ttgctggaacacagggg

SEQ ID NO: 4423188 - DNA, 20 bp, Homo sapiens
ttgctggaacacaggggcct

SEQ ID NO: 4423189 - DNA, 23 bp, Homo sapiens
ttgctggggacggggggccccag

SEQ ID NO: 4423190 - DNA, 15 bp, Homo sapiens
ttgctgtaaaatttg

SEQ ID NO: 4423191 - DNA, 16 bp, Homo sapiens
ttgctgtaaaatttgt

SEQ ID NO: 4423192 - DNA, 21 bp, Homo sapiens
ttgctgttcatcttgtacaaa

SEQ ID NO: 4423193 - DNA, 16 bp, Homo sapiens
ttgcttaaaatatgtg

SEQ ID NO: 4423194 - DNA, 22 bp, Homo sapiens
ttgcttaaaatatgtgaagttt

SEQ ID NO: 4423195 - DNA, 13 bp, Homo sapiens
ttgcttagtaagt

SEQ ID NO: 4423196 - DNA, 15 bp, Homo sapiens
ttgcttcaaattggt

SEQ ID NO: 4423197 - DNA, 19 bp, Homo sapiens
ttgcttctaaatgcccagt

SEQ ID NO: 4423198 - DNA, 22 bp, Homo sapiens
ttgcttctgcagcaactcccac

SEQ ID NO: 4423199 - DNA, 24 bp, Homo sapiens
ttgcttctgcagcaactcccacga

SEQ ID NO: 4423200 - DNA, 16 bp, Homo sapiens
ttgcttgaacacagta

SEQ ID NO: 4423201 - DNA, 17 bp, Homo sapiens
ttgcttgaacacagtat

SEQ ID NO: 4423202 - DNA, 21 bp, Homo sapiens
ttgcttgaacacagtattttc

SEQ ID NO: 4423203 - DNA, 20 bp, Homo sapiens
ttgcttgtattgtaaatgtg

SEQ ID NO: 4423204 - DNA, 21 bp, Homo sapiens
ttgctttatactgagcttttg

SEQ ID NO: 4423205 - DNA, 10 bp, Homo sapiens
ttgctttcct

SEQ ID NO: 4423206 - DNA, 17 bp, Homo sapiens
ttgctttcctgggcctt

SEQ ID NO: 4423207 - DNA, 13 bp, Homo sapiens
ttgctttctatat

SEQ ID NO: 4423208 - DNA, 17 bp, Homo sapiens
ttgctttgaaaaatctc

SEQ ID NO: 4423209 - DNA, 14 bp, Homo sapiens
ttgctttgccaaaa

SEQ ID NO: 4423210 - DNA, 19 bp, Homo sapiens
ttgctttgccaaaatacca

SEQ ID NO: 4423211 - DNA, 12 bp, Homo sapiens
ttgctttgtagg

SEQ ID NO: 4423212 - DNA, 14 bp, Homo sapiens
ttgcttttagaaaa

SEQ ID NO: 4423213 - DNA, 15 bp, Homo sapiens
ttgcttttttccaaa

SEQ ID NO: 4423214 - DNA, 21 bp, Homo sapiens
ttggaaaatgacattttacta

SEQ ID NO: 4423215 - DNA, 13 bp, Homo sapiens
ttggaaagcaggt

SEQ ID NO: 4423216 - DNA, 14 bp, Homo sapiens
ttggaaagtcagaa

SEQ ID NO: 4423217 - DNA, 15 bp, Homo sapiens
ttggaaagtgccagc

SEQ ID NO: 4423218 - DNA, 20 bp, Homo sapiens
ttggaaatagaaagaagcca

SEQ ID NO: 4423219 - DNA, 22 bp, Homo sapiens
ttggaaatagaaagaagccata

SEQ ID NO: 4423220 - DNA, 13 bp, Homo sapiens
ttggaaatgtgtt

SEQ ID NO: 4423221 - DNA, 23 bp, Homo sapiens
ttggaagagacaaagatttcttc

SEQ ID NO: 4423222 - DNA, 18 bp, Homo sapiens
ttggaaggtcttttgagg

SEQ ID NO: 4423223 - DNA, 21 bp, Homo sapiens
ttggaaggtcttttgagggct

SEQ ID NO: 4423224 - DNA, 15 bp, Homo sapiens
ttggaatataattgt

SEQ ID NO: 4423225 - DNA, 23 bp, Homo sapiens
ttggaatattaaaaaacttcatg

SEQ ID NO: 4423226 - DNA, 19 bp, Homo sapiens
ttggaatattttatcctgt

SEQ ID NO: 4423227 - DNA, 17 bp, Homo sapiens
ttggaattcgctttcta

SEQ ID NO: 4423228 - DNA, 17 bp, Homo sapiens
ttggacagaaaatgcaa

SEQ ID NO: 4423229 - DNA, 23 bp, Homo sapiens
ttggacagacccacccccagcct

SEQ ID NO: 4423230 - DNA, 12 bp, Homo sapiens
ttggacagctga

SEQ ID NO: 4423231 - DNA, 16 bp, Homo sapiens
ttggacagctgataaa

SEQ ID NO: 4423232 - DNA, 16 bp, Homo sapiens
ttggacattttatgtc

SEQ ID NO: 4423233 - DNA, 17 bp, Homo sapiens
ttggacattttatgtct

SEQ ID NO: 4423234 - DNA, 18 bp, Homo sapiens
ttggacattttatgtctt

SEQ ID NO: 4423235 - DNA, 14 bp, Homo sapiens
ttggaccagatcta

SEQ ID NO: 4423236 - DNA, 14 bp, Homo sapiens
ttggacccagggcc

SEQ ID NO: 4423237 - DNA, 15 bp, Homo sapiens
ttggacccagggcct

SEQ ID NO: 4423238 - DNA, 17 bp, Homo sapiens
ttggacccttggaaaac

SEQ ID NO: 4423239 - DNA, 13 bp, Homo sapiens
ttggacggcctga

SEQ ID NO: 4423240 - DNA, 17 bp, Homo sapiens
ttggactacacaataca

SEQ ID NO: 4423241 - DNA, 13 bp, Homo sapiens
ttggactctcagg

SEQ ID NO: 4423242 - DNA, 13 bp, Homo sapiens
ttggactctctgt

SEQ ID NO: 4423243 - DNA, 16 bp, Homo sapiens
ttggactctctgtggt

SEQ ID NO: 4423244 - DNA, 22 bp, Homo sapiens
ttggagagctagaacctggaga

SEQ ID NO: 4423245 - DNA, 22 bp, Homo sapiens
ttggagagggcccaggtcccaa

SEQ ID NO: 4423246 - DNA, 14 bp, Homo sapiens
ttggagctgactgt

SEQ ID NO: 4423247 - DNA, 13 bp, Homo sapiens
ttggagctgcttg

SEQ ID NO: 4423248 - DNA, 14 bp, Homo sapiens
ttggagcttcatgg

SEQ ID NO: 4423249 - DNA, 16 bp, Homo sapiens
ttggagctttggaata

SEQ ID NO: 4423250 - DNA, 17 bp, Homo sapiens
ttggagctttggaatat

SEQ ID NO: 4423251 - DNA, 17 bp, Homo sapiens
ttggaggaaatgtgctc

SEQ ID NO: 4423252 - DNA, 21 bp, Homo sapiens
ttggaggcaatcctaccttgc

SEQ ID NO: 4423253 - DNA, 15 bp, Homo sapiens
ttggaggtgcttgat

SEQ ID NO: 4423254 - DNA, 17 bp, Homo sapiens
ttggaggtgcttgatct

SEQ ID NO: 4423255 - DNA, 19 bp, Homo sapiens
ttggaggtgcttgatctat

SEQ ID NO: 4423256 - DNA, 13 bp, Homo sapiens
ttggagttaaaat

SEQ ID NO: 4423257 - DNA, 21 bp, Homo sapiens
ttggataagtttctattctgt

SEQ ID NO: 4423258 - DNA, 15 bp, Homo sapiens
ttggatcaagtatta

SEQ ID NO: 4423259 - DNA, 22 bp, Homo sapiens
ttggatggcttaagcctgtgta

SEQ ID NO: 4423260 - DNA, 15 bp, Homo sapiens
ttggattaaattagt

SEQ ID NO: 4423261 - DNA, 14 bp, Homo sapiens
ttggattgtatatt

SEQ ID NO: 4423262 - DNA, 18 bp, Homo sapiens
ttggatttttgtcttgtg

SEQ ID NO: 4423263 - DNA, 17 bp, Homo sapiens
ttggcaatgccatcatc

SEQ ID NO: 4423264 - DNA, 16 bp, Homo sapiens
ttggcaatttcctggc

SEQ ID NO: 4423265 - DNA, 19 bp, Homo sapiens
ttggcacccccatgctgcc

SEQ ID NO: 4423266 - DNA, 13 bp, Homo sapiens
ttggcaggcccac

SEQ ID NO: 4423267 - DNA, 14 bp, Homo sapiens
ttggcaggcccact

SEQ ID NO: 4423268 - DNA, 20 bp, Homo sapiens
ttggcaggcccactccccag

SEQ ID NO: 4423269 - DNA, 15 bp, Homo sapiens
ttggcatacaaaata

SEQ ID NO: 4423270 - DNA, 22 bp, Homo sapiens
ttggcattggaattctactgga

SEQ ID NO: 4423271 - DNA, 23 bp, Homo sapiens
ttggccaatgcacctaaagaaaa

SEQ ID NO: 4423272 - DNA, 20 bp, Homo sapiens
ttggccaccaggtgcctttc

SEQ ID NO: 4423273 - DNA, 13 bp, Homo sapiens
ttggccatgcaga

SEQ ID NO: 4423274 - DNA, 19 bp, Homo sapiens
ttggccatgcagaaagcat

SEQ ID NO: 4423275 - DNA, 13 bp, Homo sapiens
ttggcccaatgcc

SEQ ID NO: 4423276 - DNA, 19 bp, Homo sapiens
ttggccctttccttccaga

SEQ ID NO: 4423277 - DNA, 16 bp, Homo sapiens
ttggcctctccttgga

SEQ ID NO: 4423278 - DNA, 13 bp, Homo sapiens
ttggcctgctgtg

SEQ ID NO: 4423279 - DNA, 14 bp, Homo sapiens
ttggcctgctgtga

SEQ ID NO: 4423280 - DNA, 22 bp, Homo sapiens
ttggcctggggtgcatctcctc

SEQ ID NO: 4423281 - DNA, 23 bp, Homo sapiens
ttggcctgtctcatccccagggg

SEQ ID NO: 4423282 - DNA, 14 bp, Homo sapiens
ttggccttaagaac

SEQ ID NO: 4423283 - DNA, 18 bp, Homo sapiens
ttggcgaatctcaaaatt

SEQ ID NO: 4423284 - DNA, 20 bp, Homo sapiens
ttggctatgaaaatgagccc

SEQ ID NO: 4423285 - DNA, 16 bp, Homo sapiens
ttggctcacactgaga

SEQ ID NO: 4423286 - DNA, 20 bp, Homo sapiens
ttggctgcgctaacccccag

SEQ ID NO: 4423287 - DNA, 16 bp, Homo sapiens
ttggcttaatcatttt

SEQ ID NO: 4423288 - DNA, 16 bp, Homo sapiens
ttggcttgataaacat

SEQ ID NO: 4423289 - DNA, 15 bp, Homo sapiens
ttggcttgctgttta

SEQ ID NO: 4423290 - DNA, 12 bp, Homo sapiens
ttggctttcaag

SEQ ID NO: 4423291 - DNA, 17 bp, Homo sapiens
ttggctttgcagctgct

SEQ ID NO: 4423292 - DNA, 16 bp, Homo sapiens
ttgggaagattctcta

SEQ ID NO: 4423293 - DNA, 17 bp, Homo sapiens
ttgggaccagaagtgtt

SEQ ID NO: 4423294 - DNA, 20 bp, Homo sapiens
ttgggaccagaagtgtttca

SEQ ID NO: 4423295 - DNA, 17 bp, Homo sapiens
ttgggaccctccagtgc

SEQ ID NO: 4423296 - DNA, 18 bp, Homo sapiens
ttgggaggaaacctgaga

SEQ ID NO: 4423297 - DNA, 12 bp, Homo sapiens
ttgggaggctga

SEQ ID NO: 4423298 - DNA, 19 bp, Homo sapiens
ttgggagggaaaagggaag

SEQ ID NO: 4423299 - DNA, 22 bp, Homo sapiens
ttgggaggttttattctgactt

SEQ ID NO: 4423300 - DNA, 13 bp, Homo sapiens
ttgggatgtctta

SEQ ID NO: 4423301 - DNA, 19 bp, Homo sapiens
ttgggatgtcttattttta

SEQ ID NO: 4423302 - DNA, 14 bp, Homo sapiens
ttgggatttgctgt

SEQ ID NO: 4423303 - DNA, 17 bp, Homo sapiens
ttgggcacagtccagac

SEQ ID NO: 4423304 - DNA, 16 bp, Homo sapiens
ttgggcagtgccccag

SEQ ID NO: 4423305 - DNA, 17 bp, Homo sapiens
ttgggcagtgccccagg

SEQ ID NO: 4423306 - DNA, 20 bp, Homo sapiens
ttgggcagtgccccagggag

SEQ ID NO: 4423307 - DNA, 19 bp, Homo sapiens
ttgggcatcagaaaacagg

SEQ ID NO: 4423308 - DNA, 21 bp, Homo sapiens
ttgggcgctcggtctccaccc

SEQ ID NO: 4423309 - DNA, 18 bp, Homo sapiens
ttgggctccacgggcagg

SEQ ID NO: 4423310 - DNA, 16 bp, Homo sapiens
ttgggctggagctcct

SEQ ID NO: 4423311 - DNA, 19 bp, Homo sapiens
ttgggctggagctcctccc

SEQ ID NO: 4423312 - DNA, 15 bp, Homo sapiens
ttggggaatttcctc

SEQ ID NO: 4423313 - DNA, 13 bp, Homo sapiens
ttggggctcccag

SEQ ID NO: 4423314 - DNA, 18 bp, Homo sapiens
ttggggctcccagccagg

SEQ ID NO: 4423315 - DNA, 20 bp, Homo sapiens
ttggggggccgggcaggtcc

SEQ ID NO: 4423316 - DNA, 20 bp, Homo sapiens
ttggggttcctctgtacagc

SEQ ID NO: 4423317 - DNA, 20 bp, Homo sapiens
ttgggtctctctcggcccct

SEQ ID NO: 4423318 - DNA, 21 bp, Homo sapiens
ttgggtctctctcggcccctg

SEQ ID NO: 4423319 - DNA, 20 bp, Homo sapiens
ttgggtgtagatttctgaca

SEQ ID NO: 4423320 - DNA, 12 bp, Homo sapiens
ttgggtgttcca

SEQ ID NO: 4423321 - DNA, 14 bp, Homo sapiens
ttggtaaaaatgct

SEQ ID NO: 4423322 - DNA, 19 bp, Homo sapiens
ttggtaaaaatgctgctct

SEQ ID NO: 4423323 - DNA, 18 bp, Homo sapiens
ttggtaaaactcactgtg

SEQ ID NO: 4423324 - DNA, 12 bp, Homo sapiens
ttggtacacatg

SEQ ID NO: 4423325 - DNA, 17 bp, Homo sapiens
ttggtactataaaagct

SEQ ID NO: 4423326 - DNA, 16 bp, Homo sapiens
ttggtagatgacaaat

SEQ ID NO: 4423327 - DNA, 20 bp, Homo sapiens
ttggtagttctgtgcctccc

SEQ ID NO: 4423328 - DNA, 21 bp, Homo sapiens
ttggtagttctgtgcctcccc

SEQ ID NO: 4423329 - DNA, 16 bp, Homo sapiens
ttggtattaataaaaa

SEQ ID NO: 4423330 - DNA, 18 bp, Homo sapiens
ttggtattaataaaaaga

SEQ ID NO: 4423331 - DNA, 16 bp, Homo sapiens
ttggtcccaagcctga

SEQ ID NO: 4423332 - DNA, 17 bp, Homo sapiens
ttggtctgtacaaataa

SEQ ID NO: 4423333 - DNA, 15 bp, Homo sapiens
ttggtgaacagtttt

SEQ ID NO: 4423334 - DNA, 22 bp, Homo sapiens
ttggtgaatcggttgttctttc

SEQ ID NO: 4423335 - DNA, 13 bp, Homo sapiens
ttggtgactcact

SEQ ID NO: 4423336 - DNA, 15 bp, Homo sapiens
ttggtgactgtccca

SEQ ID NO: 4423337 - DNA, 18 bp, Homo sapiens
ttggtgccgatgttgaac

SEQ ID NO: 4423338 - DNA, 21 bp, Homo sapiens
ttggtgccgatgttgaacttt

SEQ ID NO: 4423339 - DNA, 21 bp, Homo sapiens
ttggtgcctttcctgttcagc

SEQ ID NO: 4423340 - DNA, 17 bp, Homo sapiens
ttggtgctttttataaa

SEQ ID NO: 4423341 - DNA, 19 bp, Homo sapiens
ttggtgctttttataaaaa

SEQ ID NO: 4423342 - DNA, 14 bp, Homo sapiens
ttggtggatgtaaa

SEQ ID NO: 4423343 - DNA, 16 bp, Homo sapiens
ttggtggatgtaaata

SEQ ID NO: 4423344 - DNA, 20 bp, Homo sapiens
ttggtggtagccatcaagca

SEQ ID NO: 4423345 - DNA, 16 bp, Homo sapiens
ttggtggtgaaattga

SEQ ID NO: 4423346 - DNA, 22 bp, Homo sapiens
ttggtgttcgtttccatcatgt

SEQ ID NO: 4423347 - DNA, 21 bp, Homo sapiens
ttggtgttctaagactctgtg

SEQ ID NO: 4423348 - DNA, 16 bp, Homo sapiens
ttggttaaaatgtgat

SEQ ID NO: 4423349 - DNA, 12 bp, Homo sapiens
ttggttaatatg

SEQ ID NO: 4423350 - DNA, 22 bp, Homo sapiens
ttggttagaagggttacatggt

SEQ ID NO: 4423351 - DNA, 19 bp, Homo sapiens
ttggttatggagtcttgtg

SEQ ID NO: 4423352 - DNA, 19 bp, Homo sapiens
ttggttatggttatgttca

SEQ ID NO: 4423353 - DNA, 14 bp, Homo sapiens
ttggttcagttttt

SEQ ID NO: 4423354 - DNA, 20 bp, Homo sapiens
ttggttgaaaataaaaagat

SEQ ID NO: 4423355 - DNA, 12 bp, Homo sapiens
ttggtttcattt

SEQ ID NO: 4423356 - DNA, 20 bp, Homo sapiens
ttggttttaaaaaagcatta

SEQ ID NO: 4423357 - DNA, 18 bp, Homo sapiens
ttggtttttaaaacccag

SEQ ID NO: 4423358 - DNA, 23 bp, Homo sapiens
ttgtaaaaatgagtcatttgttt

SEQ ID NO: 4423359 - DNA, 18 bp, Homo sapiens
ttgtaaaagaaatcatgt

SEQ ID NO: 4423360 - DNA, 18 bp, Homo sapiens
ttgtaaaatagaaaaagt

SEQ ID NO: 4423361 - DNA, 18 bp, Homo sapiens
ttgtaaaatgcacccatc

SEQ ID NO: 4423362 - DNA, 15 bp, Homo sapiens
ttgtaaaatgtatta

SEQ ID NO: 4423363 - DNA, 14 bp, Homo sapiens
ttgtaaactgtact

SEQ ID NO: 4423364 - DNA, 13 bp, Homo sapiens
ttgtaaagactgg

SEQ ID NO: 4423365 - DNA, 14 bp, Homo sapiens
ttgtaaatacacat

SEQ ID NO: 4423366 - DNA, 18 bp, Homo sapiens
ttgtaaataggattttta

SEQ ID NO: 4423367 - DNA, 16 bp, Homo sapiens
ttgtaaatattgctaa

SEQ ID NO: 4423368 - DNA, 15 bp, Homo sapiens
ttgtaaatcctgtgt

SEQ ID NO: 4423369 - DNA, 13 bp, Homo sapiens
ttgtaaatgcctc

SEQ ID NO: 4423370 - DNA, 12 bp, Homo sapiens
ttgtaaattata

SEQ ID NO: 4423371 - DNA, 14 bp, Homo sapiens
ttgtaaattatatt

SEQ ID NO: 4423372 - DNA, 15 bp, Homo sapiens
ttgtaaattatattt

SEQ ID NO: 4423373 - DNA, 14 bp, Homo sapiens
ttgtaacttcaaat

SEQ ID NO: 4423374 - DNA, 24 bp, Homo sapiens
ttgtaagaaggcaatattaaccta

SEQ ID NO: 4423375 - DNA, 16 bp, Homo sapiens
ttgtaaggggaagagg

SEQ ID NO: 4423376 - DNA, 23 bp, Homo sapiens
ttgtaaggggaagagggaaatgt

SEQ ID NO: 4423377 - DNA, 12 bp, Homo sapiens
ttgtaataaaac

SEQ ID NO: 4423378 - DNA, 12 bp, Homo sapiens
ttgtaatattct

SEQ ID NO: 4423379 - DNA, 15 bp, Homo sapiens
ttgtaatattctgtt

SEQ ID NO: 4423380 - DNA, 18 bp, Homo sapiens
ttgtaatattctgttttg

SEQ ID NO: 4423381 - DNA, 16 bp, Homo sapiens
ttgtaatattgaggga

SEQ ID NO: 4423382 - DNA, 14 bp, Homo sapiens
ttgtaatcactgtt

SEQ ID NO: 4423383 - DNA, 18 bp, Homo sapiens
ttgtaatctgcaaaatgt

SEQ ID NO: 4423384 - DNA, 14 bp, Homo sapiens
ttgtaatgctgtac

SEQ ID NO: 4423385 - DNA, 14 bp, Homo sapiens
ttgtaatgtcacca

SEQ ID NO: 4423386 - DNA, 17 bp, Homo sapiens
ttgtaattaaaagcaaa

SEQ ID NO: 4423387 - DNA, 16 bp, Homo sapiens
ttgtacaaactttgtt

SEQ ID NO: 4423388 - DNA, 15 bp, Homo sapiens
ttgtacaagctcagg

SEQ ID NO: 4423389 - DNA, 13 bp, Homo sapiens
ttgtacaagtatt

SEQ ID NO: 4423390 - DNA, 18 bp, Homo sapiens
ttgtacacgctgatgaga

SEQ ID NO: 4423391 - DNA, 13 bp, Homo sapiens
ttgtacagttttt

SEQ ID NO: 4423392 - DNA, 13 bp, Homo sapiens
ttgtacatagcaa

SEQ ID NO: 4423393 - DNA, 22 bp, Homo sapiens
ttgtacatatcaaatagatatt

SEQ ID NO: 4423394 - DNA, 12 bp, Homo sapiens
ttgtacatgata

SEQ ID NO: 4423395 - DNA, 19 bp, Homo sapiens
ttgtacatgataagacatt

SEQ ID NO: 4423396 - DNA, 20 bp, Homo sapiens
ttgtacatgataagacattt

SEQ ID NO: 4423397 - DNA, 18 bp, Homo sapiens
ttgtacattttgtaaaat

SEQ ID NO: 4423398 - DNA, 15 bp, Homo sapiens
ttgtaccaaaatttt

SEQ ID NO: 4423399 - DNA, 18 bp, Homo sapiens
ttgtaccaaaattttaaa

SEQ ID NO: 4423400 - DNA, 23 bp, Homo sapiens
ttgtaccttttttgttttttcaa

SEQ ID NO: 4423401 - DNA, 16 bp, Homo sapiens
ttgtacgttatatatt

SEQ ID NO: 4423402 - DNA, 18 bp, Homo sapiens
ttgtacgttatatattgt

SEQ ID NO: 4423403 - DNA, 22 bp, Homo sapiens
ttgtactgttgctttaatatga

SEQ ID NO: 4423404 - DNA, 19 bp, Homo sapiens
ttgtactttatcatgaatg

SEQ ID NO: 4423405 - DNA, 18 bp, Homo sapiens
ttgtagattttgttatgt

SEQ ID NO: 4423406 - DNA, 18 bp, Homo sapiens
ttgtagcagctatatatt

SEQ ID NO: 4423407 - DNA, 13 bp, Homo sapiens
ttgtaggtaaaat

SEQ ID NO: 4423408 - DNA, 21 bp, Homo sapiens
ttgtagtagcgttttttaaat

SEQ ID NO: 4423409 - DNA, 23 bp, Homo sapiens
ttgtagtagcgttttttaaatgt

SEQ ID NO: 4423410 - DNA, 22 bp, Homo sapiens
ttgtagtttgaaagttgtacat

SEQ ID NO: 4423411 - DNA, 15 bp, Homo sapiens
ttgtataaactgtat

SEQ ID NO: 4423412 - DNA, 16 bp, Homo sapiens
ttgtataaactgtatt

SEQ ID NO: 4423413 - DNA, 15 bp, Homo sapiens
ttgtataaattactt

SEQ ID NO: 4423414 - DNA, 12 bp, Homo sapiens
ttgtataattgg

SEQ ID NO: 4423415 - DNA, 19 bp, Homo sapiens
ttgtatactttaaataatt

SEQ ID NO: 4423416 - DNA, 16 bp, Homo sapiens
ttgtatattacaatga

SEQ ID NO: 4423417 - DNA, 15 bp, Homo sapiens
ttgtatattgtgttt

SEQ ID NO: 4423418 - DNA, 18 bp, Homo sapiens
ttgtatctttctttctct

SEQ ID NO: 4423419 - DNA, 17 bp, Homo sapiens
ttgtatgaaatatatgt

SEQ ID NO: 4423420 - DNA, 22 bp, Homo sapiens
ttgtatgcctttaaatctgtga

SEQ ID NO: 4423421 - DNA, 16 bp, Homo sapiens
ttgtatgtcaaagctt

SEQ ID NO: 4423422 - DNA, 18 bp, Homo sapiens
ttgtatgtttttctgtat

SEQ ID NO: 4423423 - DNA, 20 bp, Homo sapiens
ttgtatgtttttctgtataa

SEQ ID NO: 4423424 - DNA, 15 bp, Homo sapiens
ttgtattattacaaa

SEQ ID NO: 4423425 - DNA, 17 bp, Homo sapiens
ttgtattattacaaata

SEQ ID NO: 4423426 - DNA, 21 bp, Homo sapiens
ttgtattattacaaatattgt

SEQ ID NO: 4423427 - DNA, 22 bp, Homo sapiens
ttgtattcaaaaattatctata

SEQ ID NO: 4423428 - DNA, 20 bp, Homo sapiens
ttgtattctctgagctgtgc

SEQ ID NO: 4423429 - DNA, 15 bp, Homo sapiens
ttgtattctctgcaa

SEQ ID NO: 4423430 - DNA, 22 bp, Homo sapiens
ttgtattctctgcaattttact

SEQ ID NO: 4423431 - DNA, 15 bp, Homo sapiens
ttgtattgcttcctg

SEQ ID NO: 4423432 - DNA, 18 bp, Homo sapiens
ttgtattgtatattacaa

SEQ ID NO: 4423433 - DNA, 15 bp, Homo sapiens
ttgtattgtttcaat

SEQ ID NO: 4423434 - DNA, 16 bp, Homo sapiens
ttgtattgtttctaca

SEQ ID NO: 4423435 - DNA, 16 bp, Homo sapiens
ttgtatttaaaaacat

SEQ ID NO: 4423436 - DNA, 14 bp, Homo sapiens
ttgtatttgtattc

SEQ ID NO: 4423437 - DNA, 14 bp, Homo sapiens
ttgtcaaagaagct

SEQ ID NO: 4423438 - DNA, 14 bp, Homo sapiens
ttgtcaacttcagt

SEQ ID NO: 4423439 - DNA, 23 bp, Homo sapiens
ttgtcaaggatggttttgggact

SEQ ID NO: 4423440 - DNA, 22 bp, Homo sapiens
ttgtcacaacaattaaatatac

SEQ ID NO: 4423441 - DNA, 18 bp, Homo sapiens
ttgtcacagtcttgtgaa

SEQ ID NO: 4423442 - DNA, 22 bp, Homo sapiens
ttgtcacagtcttgtgaacttt

SEQ ID NO: 4423443 - DNA, 16 bp, Homo sapiens
ttgtcacttctgctgt

SEQ ID NO: 4423444 - DNA, 20 bp, Homo sapiens
ttgtcacttctgctgtacag

SEQ ID NO: 4423445 - DNA, 20 bp, Homo sapiens
ttgtcacttgccacatggtg

SEQ ID NO: 4423446 - DNA, 16 bp, Homo sapiens
ttgtcactttttctga

SEQ ID NO: 4423447 - DNA, 18 bp, Homo sapiens
ttgtcagccatcgtcctg

SEQ ID NO: 4423448 - DNA, 15 bp, Homo sapiens
ttgtcagccttgcta

SEQ ID NO: 4423449 - DNA, 21 bp, Homo sapiens
ttgtcatatcactaaataaac

SEQ ID NO: 4423450 - DNA, 18 bp, Homo sapiens
ttgtcatctttttctaga

SEQ ID NO: 4423451 - DNA, 14 bp, Homo sapiens
ttgtccacccacct

SEQ ID NO: 4423452 - DNA, 20 bp, Homo sapiens
ttgtccacttcattttgtat

SEQ ID NO: 4423453 - DNA, 20 bp, Homo sapiens
ttgtccacttgtaagaatgt

SEQ ID NO: 4423454 - DNA, 15 bp, Homo sapiens
ttgtcccaagtgcca

SEQ ID NO: 4423455 - DNA, 11 bp, Homo sapiens
ttgtcccagac

SEQ ID NO: 4423456 - DNA, 15 bp, Homo sapiens
ttgtccctactttct

SEQ ID NO: 4423457 - DNA, 18 bp, Homo sapiens
ttgtccctgaagagaagg

SEQ ID NO: 4423458 - DNA, 17 bp, Homo sapiens
ttgtcctacgtccaagg

SEQ ID NO: 4423459 - DNA, 22 bp, Homo sapiens
ttgtcctcagccccgcgtggaa

SEQ ID NO: 4423460 - DNA, 15 bp, Homo sapiens
ttgtcctcttctgct

SEQ ID NO: 4423461 - DNA, 18 bp, Homo sapiens
ttgtcctcttctgctctt

SEQ ID NO: 4423462 - DNA, 20 bp, Homo sapiens
ttgtctatttgtctcttaca

SEQ ID NO: 4423463 - DNA, 20 bp, Homo sapiens
ttgtctcaacgcctccccct

SEQ ID NO: 4423464 - DNA, 15 bp, Homo sapiens
ttgtctccatgtgta

SEQ ID NO: 4423465 - DNA, 14 bp, Homo sapiens
ttgtctctcttcag

SEQ ID NO: 4423466 - DNA, 13 bp, Homo sapiens
ttgtctgaacttg

SEQ ID NO: 4423467 - DNA, 20 bp, Homo sapiens
ttgtctggcaaggactttgt

SEQ ID NO: 4423468 - DNA, 21 bp, Homo sapiens
ttgtctggcaaggactttgta

SEQ ID NO: 4423469 - DNA, 18 bp, Homo sapiens
ttgtctggctttggcact

SEQ ID NO: 4423470 - DNA, 15 bp, Homo sapiens
ttgtctgtaaaaaat

SEQ ID NO: 4423471 - DNA, 17 bp, Homo sapiens
ttgtctgtaaaaaatgg

SEQ ID NO: 4423472 - DNA, 17 bp, Homo sapiens
ttgtcttaatattgtgg

SEQ ID NO: 4423473 - DNA, 19 bp, Homo sapiens
ttgtctttatatgaacata

SEQ ID NO: 4423474 - DNA, 14 bp, Homo sapiens
ttgtctttgtaata

SEQ ID NO: 4423475 - DNA, 13 bp, Homo sapiens
ttgtcttttcaga

SEQ ID NO: 4423476 - DNA, 20 bp, Homo sapiens
ttgtcttttcagaagcaagc

SEQ ID NO: 4423477 - DNA, 13 bp, Homo sapiens
ttgtgaaagtgta

SEQ ID NO: 4423478 - DNA, 20 bp, Homo sapiens
ttgtgaaagtgtaatgtgcg

SEQ ID NO: 4423479 - DNA, 13 bp, Homo sapiens
ttgtgaaccaatg

SEQ ID NO: 4423480 - DNA, 17 bp, Homo sapiens
ttgtgaaccaatgcaag

SEQ ID NO: 4423481 - DNA, 18 bp, Homo sapiens
ttgtgaactggaagaaag

SEQ ID NO: 4423482 - DNA, 21 bp, Homo sapiens
ttgtgaactggaagaaagcaa

SEQ ID NO: 4423483 - DNA, 16 bp, Homo sapiens
ttgtgaatgcttctca

SEQ ID NO: 4423484 - DNA, 17 bp, Homo sapiens
ttgtgaattaatgaaat

SEQ ID NO: 4423485 - DNA, 22 bp, Homo sapiens
ttgtgacaggaaagccctcccc

SEQ ID NO: 4423486 - DNA, 19 bp, Homo sapiens
ttgtgacagtcactgcatt

SEQ ID NO: 4423487 - DNA, 21 bp, Homo sapiens
ttgtgaccagaaagcttcatc

SEQ ID NO: 4423488 - DNA, 19 bp, Homo sapiens
ttgtgactgccaggataaa

SEQ ID NO: 4423489 - DNA, 23 bp, Homo sapiens
ttgtgacttacaatttgcacaat

SEQ ID NO: 4423490 - DNA, 20 bp, Homo sapiens
ttgtgagacttctgtttgat

SEQ ID NO: 4423491 - DNA, 15 bp, Homo sapiens
ttccaatatttctgc

SEQ ID NO: 4423492 - DNA, 16 bp, Homo sapiens
ttccaatattttaata

SEQ ID NO: 4423493 - DNA, 21 bp, Homo sapiens
ttccaatattttaataaagta

SEQ ID NO: 4423494 - DNA, 17 bp, Homo sapiens
ttccaatgccacagaca

SEQ ID NO: 4423495 - DNA, 15 bp, Homo sapiens
ttccaatgctgtggg

SEQ ID NO: 4423496 - DNA, 13 bp, Homo sapiens
ttccaatgtttta

SEQ ID NO: 4423497 - DNA, 21 bp, Homo sapiens
ttccaatgttttattggggaa

SEQ ID NO: 4423498 - DNA, 19 bp, Homo sapiens
ttccaattctatcttttgt

SEQ ID NO: 4423499 - DNA, 11 bp, Homo sapiens
ttccacaaaat

SEQ ID NO: 4423500 - DNA, 18 bp, Homo sapiens
ttccacaaaatctgtcca

SEQ ID NO: 4423501 - DNA, 15 bp, Homo sapiens
ttccacaaaattaga

SEQ ID NO: 4423502 - DNA, 17 bp, Homo sapiens
ttccacaaaattagaaa

SEQ ID NO: 4423503 - DNA, 19 bp, Homo sapiens
ttccacaagattcccagag

SEQ ID NO: 4423504 - DNA, 20 bp, Homo sapiens
ttccacaagattcccagaga

SEQ ID NO: 4423505 - DNA, 21 bp, Homo sapiens
ttccacaagattcccagagac

SEQ ID NO: 4423506 - DNA, 19 bp, Homo sapiens
ttccacagtggcgggccca

SEQ ID NO: 4423507 - DNA, 21 bp, Homo sapiens
ttccacagtggcgggcccact

SEQ ID NO: 4423508 - DNA, 22 bp, Homo sapiens
ttccacataaattttaattcaa

SEQ ID NO: 4423509 - DNA, 23 bp, Homo sapiens
ttccacccagtgctgaatttccc

SEQ ID NO: 4423510 - DNA, 13 bp, Homo sapiens
ttccaccttaaat

SEQ ID NO: 4423511 - DNA, 14 bp, Homo sapiens
ttccaccttaaatt

SEQ ID NO: 4423512 - DNA, 20 bp, Homo sapiens
ttccaccttaaattaaacaa

SEQ ID NO: 4423513 - DNA, 21 bp, Homo sapiens
ttccacggagccactcctctg

SEQ ID NO: 4423514 - DNA, 22 bp, Homo sapiens
ttccacggagccactcctctga

SEQ ID NO: 4423515 - DNA, 21 bp, Homo sapiens
ttccactgaaaatttaacagt

SEQ ID NO: 4423516 - DNA, 20 bp, Homo sapiens
ttcgcagagcttttcagatt

SEQ ID NO: 4423517 - DNA, 17 bp, Homo sapiens
ttcgcatggtcacacac

SEQ ID NO: 4423518 - DNA, 23 bp, Homo sapiens
ttcgcatggtcacacactgatgc

SEQ ID NO: 4423519 - DNA, 16 bp, Homo sapiens
ttcgcttgcttctgca

SEQ ID NO: 4423520 - DNA, 20 bp, Homo sapiens
ttcggaaggggttcctcaaa

SEQ ID NO: 4423521 - DNA, 14 bp, Homo sapiens
ttcggagtgaatgt

SEQ ID NO: 4423522 - DNA, 17 bp, Homo sapiens
ttcggatttggggtgga

SEQ ID NO: 4423523 - DNA, 22 bp, Homo sapiens
ttcggcaccttcccctgaggac

SEQ ID NO: 4423524 - DNA, 18 bp, Homo sapiens
ttcggccccatgtatctc

SEQ ID NO: 4423525 - DNA, 22 bp, Homo sapiens
ttcggctgcttttatgtagttt

SEQ ID NO: 4423526 - DNA, 13 bp, Homo sapiens
ttcgtaacacagc

SEQ ID NO: 4423527 - DNA, 18 bp, Homo sapiens
ttcgtgagctggggactc

SEQ ID NO: 4423528 - DNA, 13 bp, Homo sapiens
ttcgtgcattttt

SEQ ID NO: 4423529 - DNA, 20 bp, Homo sapiens
ttcgttagtaatctgtataa

SEQ ID NO: 4423530 - DNA, 17 bp, Homo sapiens
ttcgttcgcagagcttt

SEQ ID NO: 4423531 - DNA, 19 bp, Homo sapiens
ttcgtttagaatcagaata

SEQ ID NO: 4423532 - DNA, 20 bp, Homo sapiens
ttcgtttagaatcagaataa

SEQ ID NO: 4423533 - DNA, 16 bp, Homo sapiens
ttcgtttccatcatgt

SEQ ID NO: 4423534 - DNA, 18 bp, Homo sapiens
ttctaaaatagcaataac

SEQ ID NO: 4423535 - DNA, 14 bp, Homo sapiens
ttctaaaatgcctt

SEQ ID NO: 4423536 - DNA, 18 bp, Homo sapiens
ttctaaacccaatccaaa

SEQ ID NO: 4423537 - DNA, 19 bp, Homo sapiens
ttctaaacccaatccaaat

SEQ ID NO: 4423538 - DNA, 13 bp, Homo sapiens
ttctaaagacagg

SEQ ID NO: 4423539 - DNA, 21 bp, Homo sapiens
ttctaaatattgcttcaattt

SEQ ID NO: 4423540 - DNA, 19 bp, Homo sapiens
ttctaaatgcaataagatt

SEQ ID NO: 4423541 - DNA, 21 bp, Homo sapiens
ttctaaattaatggtaaaata

SEQ ID NO: 4423542 - DNA, 14 bp, Homo sapiens
ttctaacctggagg

SEQ ID NO: 4423543 - DNA, 12 bp, Homo sapiens
ttctaacttatt

SEQ ID NO: 4423544 - DNA, 18 bp, Homo sapiens
ttctaagaaatatctgtg

SEQ ID NO: 4423545 - DNA, 14 bp, Homo sapiens
ttctaagaagacat

SEQ ID NO: 4423546 - DNA, 15 bp, Homo sapiens
ttctaagaagacatt

SEQ ID NO: 4423547 - DNA, 16 bp, Homo sapiens
ttctaagaagacattt

SEQ ID NO: 4423548 - DNA, 21 bp, Homo sapiens
ttctaagactactaaggcctt

SEQ ID NO: 4423549 - DNA, 12 bp, Homo sapiens
ttctaagagaag

SEQ ID NO: 4423550 - DNA, 15 bp, Homo sapiens
ttctaagtaaaacca

SEQ ID NO: 4423551 - DNA, 24 bp, Homo sapiens
ttctaagtaaaaccacagcagttg

SEQ ID NO: 4423552 - DNA, 14 bp, Homo sapiens
ttctaagtgggaga

SEQ ID NO: 4423553 - DNA, 13 bp, Homo sapiens
ttctaataaagta

SEQ ID NO: 4423554 - DNA, 15 bp, Homo sapiens
ttctaatccttttcc

SEQ ID NO: 4423555 - DNA, 23 bp, Homo sapiens
ttctaatgaggagagaaaatata

SEQ ID NO: 4423556 - DNA, 23 bp, Homo sapiens
ttctaattaaaattgtgcataat

SEQ ID NO: 4423557 - DNA, 14 bp, Homo sapiens
ttctacaaagcact

SEQ ID NO: 4423558 - DNA, 21 bp, Homo sapiens
ttctacaaagcactagagaat

SEQ ID NO: 4423559 - DNA, 18 bp, Homo sapiens
ttctacacactcagccac

SEQ ID NO: 4423560 - DNA, 20 bp, Homo sapiens
ttctacacactcagccacaa

SEQ ID NO: 4423561 - DNA, 15 bp, Homo sapiens
ttctacacagagcag

SEQ ID NO: 4423562 - DNA, 23 bp, Homo sapiens
ttctacactgggtgctgatcctt

SEQ ID NO: 4423563 - DNA, 17 bp, Homo sapiens
ttctacagaaaaacaat

SEQ ID NO: 4423564 - DNA, 18 bp, Homo sapiens
ttctacattattgcttat

SEQ ID NO: 4423565 - DNA, 16 bp, Homo sapiens
ttctacctacatattt

SEQ ID NO: 4423566 - DNA, 12 bp, Homo sapiens
ttctacctgcca

SEQ ID NO: 4423567 - DNA, 22 bp, Homo sapiens
ttctacgcaattgacaaacccg

SEQ ID NO: 4423568 - DNA, 13 bp, Homo sapiens
ttctactcctgcc

SEQ ID NO: 4423569 - DNA, 12 bp, Homo sapiens
ttctactggaaa

SEQ ID NO: 4423570 - DNA, 18 bp, Homo sapiens
ttctactggaaaaaaata

SEQ ID NO: 4423571 - DNA, 13 bp, Homo sapiens
ttctacttttaaa

SEQ ID NO: 4423572 - DNA, 22 bp, Homo sapiens
ttctacttttaactaataaaat

SEQ ID NO: 4423573 - DNA, 19 bp, Homo sapiens
ttctagaaagagaaacagt

SEQ ID NO: 4423574 - DNA, 21 bp, Homo sapiens
ttctagaacacctgccttcta

SEQ ID NO: 4423575 - DNA, 15 bp, Homo sapiens
ttctagaatttatca

SEQ ID NO: 4423576 - DNA, 21 bp, Homo sapiens
ttctagaatttatcacacttc

SEQ ID NO: 4423577 - DNA, 12 bp, Homo sapiens
ttctagacagag

SEQ ID NO: 4423578 - DNA, 17 bp, Homo sapiens
ttctagacgcccctccc

SEQ ID NO: 4423579 - DNA, 20 bp, Homo sapiens
ttctagacttccccatcccg

SEQ ID NO: 4423580 - DNA, 21 bp, Homo sapiens
ttctagatcctgcaccccagc

SEQ ID NO: 4423581 - DNA, 15 bp, Homo sapiens
ttctagcactggcct

SEQ ID NO: 4423582 - DNA, 15 bp, Homo sapiens
ttctagccataataa

SEQ ID NO: 4423583 - DNA, 19 bp, Homo sapiens
ttctaggagtcaactggct

SEQ ID NO: 4423584 - DNA, 15 bp, Homo sapiens
ttctaggatgaacaa

SEQ ID NO: 4423585 - DNA, 15 bp, Homo sapiens
ttctagtttgctcat

SEQ ID NO: 4423586 - DNA, 21 bp, Homo sapiens
ttctataaatttaagaaaaca

SEQ ID NO: 4423587 - DNA, 22 bp, Homo sapiens
ttctataaatttaagaaaacaa

SEQ ID NO: 4423588 - DNA, 13 bp, Homo sapiens
ttctataaggcca

SEQ ID NO: 4423589 - DNA, 19 bp, Homo sapiens
ttctatatatttgtttcaa

SEQ ID NO: 4423590 - DNA, 17 bp, Homo sapiens
ttctatccaaacatgta

SEQ ID NO: 4423591 - DNA, 20 bp, Homo sapiens
ttctatcttttgtttccttt

SEQ ID NO: 4423592 - DNA, 19 bp, Homo sapiens
ttctatggattcacttcta

SEQ ID NO: 4423593 - DNA, 20 bp, Homo sapiens
ttctatggattcacttctat

SEQ ID NO: 4423594 - DNA, 16 bp, Homo sapiens
ttctatggctttcaaa

SEQ ID NO: 4423595 - DNA, 17 bp, Homo sapiens
ttctatggctttcaaag

SEQ ID NO: 4423596 - DNA, 12 bp, Homo sapiens
ttctatgtatgt

SEQ ID NO: 4423597 - DNA, 22 bp, Homo sapiens
ttctatgtgacaattttgtaca

SEQ ID NO: 4423598 - DNA, 15 bp, Homo sapiens
ttctatgtgacattt

SEQ ID NO: 4423599 - DNA, 17 bp, Homo sapiens
ttctattaatcaagaga

SEQ ID NO: 4423600 - DNA, 22 bp, Homo sapiens
ttctattaatcaagagaaactt

SEQ ID NO: 4423601 - DNA, 20 bp, Homo sapiens
ttctattacattttcagtga

SEQ ID NO: 4423602 - DNA, 21 bp, Homo sapiens
ttctattacctattaggtgga

SEQ ID NO: 4423603 - DNA, 15 bp, Homo sapiens
ttctattatggaaaa

SEQ ID NO: 4423604 - DNA, 21 bp, Homo sapiens
ttctatttatttatttattca

SEQ ID NO: 4423605 - DNA, 14 bp, Homo sapiens
ttctatttcttgaa

SEQ ID NO: 4423606 - DNA, 15 bp, Homo sapiens
ttctatttgctgggc

SEQ ID NO: 4423607 - DNA, 17 bp, Homo sapiens
ttctatttgctgggctt

SEQ ID NO: 4423608 - DNA, 18 bp, Homo sapiens
ttctatttggttagaagg

SEQ ID NO: 4423609 - DNA, 12 bp, Homo sapiens
ttctcaagaatc

SEQ ID NO: 4423610 - DNA, 14 bp, Homo sapiens
ttctcaagaatcta

SEQ ID NO: 4423611 - DNA, 17 bp, Homo sapiens
ttctcaagaatctagaa

SEQ ID NO: 4423612 - DNA, 22 bp, Homo sapiens
ttctcacactctaactgtatat

SEQ ID NO: 4423613 - DNA, 12 bp, Homo sapiens
ttctcaccagct

SEQ ID NO: 4423614 - DNA, 18 bp, Homo sapiens
ttctcaccagctgcaaag

SEQ ID NO: 4423615 - DNA, 21 bp, Homo sapiens
ttctcaccagctgcaaagtgt

SEQ ID NO: 4423616 - DNA, 16 bp, Homo sapiens
ttctcacgctttgttt

SEQ ID NO: 4423617 - DNA, 14 bp, Homo sapiens
ttctcactcaccac

SEQ ID NO: 4423618 - DNA, 16 bp, Homo sapiens
ttctcactccaccacc

SEQ ID NO: 4423619 - DNA, 21 bp, Homo sapiens
ttctcagaagcacagaatatt

SEQ ID NO: 4423620 - DNA, 20 bp, Homo sapiens
ttctcagatttctgaggaaa

SEQ ID NO: 4423621 - DNA, 13 bp, Homo sapiens
ttctcagcgtttt

SEQ ID NO: 4423622 - DNA, 18 bp, Homo sapiens
ttctcataattcctacag

SEQ ID NO: 4423623 - DNA, 13 bp, Homo sapiens
ttctcatctcccc

SEQ ID NO: 4423624 - DNA, 18 bp, Homo sapiens
ttctcatcttgtgaaatg

SEQ ID NO: 4423625 - DNA, 18 bp, Homo sapiens
ttctcatgagctgtgttc

SEQ ID NO: 4423626 - DNA, 14 bp, Homo sapiens
ttctcattaaactc

SEQ ID NO: 4423627 - DNA, 23 bp, Homo sapiens
ttctcattaaagttgtttcccac

SEQ ID NO: 4423628 - DNA, 19 bp, Homo sapiens
ttctcatttcacccctccc

SEQ ID NO: 4423629 - DNA, 17 bp, Homo sapiens
ttctcattttttaaaaa

SEQ ID NO: 4423630 - DNA, 21 bp, Homo sapiens
ttctccaattctgaaatactt

SEQ ID NO: 4423631 - DNA, 17 bp, Homo sapiens
ttctccagtcattatgt

SEQ ID NO: 4423632 - DNA, 12 bp, Homo sapiens
ttctccatcccc

SEQ ID NO: 4423633 - DNA, 13 bp, Homo sapiens
ttctcccaaagat

SEQ ID NO: 4423634 - DNA, 21 bp, Homo sapiens
ttctggcaaaaaggagccttt

SEQ ID NO: 4423635 - DNA, 18 bp, Homo sapiens
ttctggccagtgtttaaa

SEQ ID NO: 4423636 - DNA, 17 bp, Homo sapiens
ttctggccttgtaagac

SEQ ID NO: 4423637 - DNA, 18 bp, Homo sapiens
ttctggcgcccctgcctg

SEQ ID NO: 4423638 - DNA, 20 bp, Homo sapiens
ttctgggcaccacaaaatat

SEQ ID NO: 4423639 - DNA, 21 bp, Homo sapiens
ttctgggcatggcagggccag

SEQ ID NO: 4423640 - DNA, 10 bp, Homo sapiens
ttctgggctg

SEQ ID NO: 4423641 - DNA, 19 bp, Homo sapiens
ttctgggcttggggtgtgg

SEQ ID NO: 4423642 - DNA, 20 bp, Homo sapiens
ttctgggtgataattttgaa

SEQ ID NO: 4423643 - DNA, 23 bp, Homo sapiens
ttctgggtgatggaaactgccaa

SEQ ID NO: 4423644 - DNA, 22 bp, Homo sapiens
ttctgggtgttgaccactccag

SEQ ID NO: 4423645 - DNA, 19 bp, Homo sapiens
ttctggtaagactgctggt

SEQ ID NO: 4423646 - DNA, 22 bp, Homo sapiens
ttctggtgctactccatgcagg

SEQ ID NO: 4423647 - DNA, 14 bp, Homo sapiens
ttctggtgtctgct

SEQ ID NO: 4423648 - DNA, 22 bp, Homo sapiens
ttctgtaaactctgcatccaga

SEQ ID NO: 4423649 - DNA, 14 bp, Homo sapiens
ttctgtaaattcat

SEQ ID NO: 4423650 - DNA, 23 bp, Homo sapiens
ttctgtaatatttacaatgtatt

SEQ ID NO: 4423651 - DNA, 17 bp, Homo sapiens
ttctgtaatgtaaataa

SEQ ID NO: 4423652 - DNA, 19 bp, Homo sapiens
ttctgtaatgtaaataaac

SEQ ID NO: 4423653 - DNA, 20 bp, Homo sapiens
ttctgtaatgtaaataaact

SEQ ID NO: 4423654 - DNA, 11 bp, Homo sapiens
ttctgtaattt

SEQ ID NO: 4423655 - DNA, 14 bp, Homo sapiens
ttctgtaccagtta

SEQ ID NO: 4423656 - DNA, 15 bp, Homo sapiens
ttctgtacttcctga

SEQ ID NO: 4423657 - DNA, 17 bp, Homo sapiens
ttctgtacttcctgagt

SEQ ID NO: 4423658 - DNA, 16 bp, Homo sapiens
ttctgtagacttttga

SEQ ID NO: 4423659 - DNA, 19 bp, Homo sapiens
ttctgtagacttttgaaaa

SEQ ID NO: 4423660 - DNA, 14 bp, Homo sapiens
ttctgtagttttta

SEQ ID NO: 4423661 - DNA, 17 bp, Homo sapiens
ttctgtatatacttttt

SEQ ID NO: 4423662 - DNA, 14 bp, Homo sapiens
ttctgtatttaatt

SEQ ID NO: 4423663 - DNA, 19 bp, Homo sapiens
ttctgtatttaattataaa

SEQ ID NO: 4423664 - DNA, 19 bp, Homo sapiens
ttctgtcacagtaaaaata

SEQ ID NO: 4423665 - DNA, 13 bp, Homo sapiens
ttctgtctccagc

SEQ ID NO: 4423666 - DNA, 18 bp, Homo sapiens
ttctgtctttctgctatg

SEQ ID NO: 4423667 - DNA, 11 bp, Homo sapiens
ttctgtgaaag

SEQ ID NO: 4423668 - DNA, 11 bp, Homo sapiens
ttctgtgcctc

SEQ ID NO: 4423669 - DNA, 19 bp, Homo sapiens
ttctgtgcctccccccaga

SEQ ID NO: 4423670 - DNA, 22 bp, Homo sapiens
ttctgtgcctccccccagaccc

SEQ ID NO: 4423671 - DNA, 13 bp, Homo sapiens
ttctgtgcctgaa

SEQ ID NO: 4423672 - DNA, 16 bp, Homo sapiens
ttctgtgcctgaatat

SEQ ID NO: 4423673 - DNA, 22 bp, Homo sapiens
ttctgtggatgccgatttctgt

SEQ ID NO: 4423674 - DNA, 22 bp, Homo sapiens
ttctgtggggcccctcacctac

SEQ ID NO: 4423675 - DNA, 23 bp, Homo sapiens
ttctgtggggcccctcacctact

SEQ ID NO: 4423676 - DNA, 21 bp, Homo sapiens
ttctgtggttcctctgctcac

SEQ ID NO: 4423677 - DNA, 22 bp, Homo sapiens
ttctgtgtcacagttcttggtg

SEQ ID NO: 4423678 - DNA, 19 bp, Homo sapiens
ttctgtgtcccatgtcccg

SEQ ID NO: 4423679 - DNA, 20 bp, Homo sapiens
ttctgttaggggccaataaa

SEQ ID NO: 4423680 - DNA, 23 bp, Homo sapiens
ttctgttatctcaggtgagctgg

SEQ ID NO: 4423681 - DNA, 17 bp, Homo sapiens
ttctgttccaaattcag

SEQ ID NO: 4423682 - DNA, 13 bp, Homo sapiens
ttctgttctagtt

SEQ ID NO: 4423683 - DNA, 22 bp, Homo sapiens
ttctgttggattccatgctaag

SEQ ID NO: 4423684 - DNA, 18 bp, Homo sapiens
ttctgtttcagagcataa

SEQ ID NO: 4423685 - DNA, 18 bp, Homo sapiens
ttctgtttcctatttaat

SEQ ID NO: 4423686 - DNA, 13 bp, Homo sapiens
ttctgttttgtta

SEQ ID NO: 4423687 - DNA, 20 bp, Homo sapiens
ttcttaaaaaatttatactt

SEQ ID NO: 4423688 - DNA, 14 bp, Homo sapiens
ttcttaaaacacat

SEQ ID NO: 4423689 - DNA, 12 bp, Homo sapiens
ttcttaaaacta

SEQ ID NO: 4423690 - DNA, 18 bp, Homo sapiens
ttcttaaaagaaatcttg

SEQ ID NO: 4423691 - DNA, 21 bp, Homo sapiens
ttcttaaaatgcaatatttgt

SEQ ID NO: 4423692 - DNA, 22 bp, Homo sapiens
ttcttaaaatgcaatatttgta

SEQ ID NO: 4423693 - DNA, 19 bp, Homo sapiens
ttcttaaactgaaagcttt

SEQ ID NO: 4423694 - DNA, 15 bp, Homo sapiens
ttcttaaagcaaact

SEQ ID NO: 4423695 - DNA, 13 bp, Homo sapiens
ttcttaacctttg

SEQ ID NO: 4423696 - DNA, 16 bp, Homo sapiens
ttcttaacttcttgct

SEQ ID NO: 4423697 - DNA, 21 bp, Homo sapiens
ttcttaagacgtgattttgct

SEQ ID NO: 4423698 - DNA, 18 bp, Homo sapiens
ttcttaattattataaaa

SEQ ID NO: 4423699 - DNA, 14 bp, Homo sapiens
ttcttacagccaag

SEQ ID NO: 4423700 - DNA, 22 bp, Homo sapiens
ttcttacctactattggcccta

SEQ ID NO: 4423701 - DNA, 17 bp, Homo sapiens
ttcttagcctgtggcag

SEQ ID NO: 4423702 - DNA, 15 bp, Homo sapiens
ttcttatggaattga

SEQ ID NO: 4423703 - DNA, 22 bp, Homo sapiens
ttcttatggaattgatttgcat

SEQ ID NO: 4423704 - DNA, 19 bp, Homo sapiens
ttcttattctcactccacc

SEQ ID NO: 4423705 - DNA, 17 bp, Homo sapiens
ttcttatttaccctttt

SEQ ID NO: 4423706 - DNA, 19 bp, Homo sapiens
ttcttcaaagccacatttt

SEQ ID NO: 4423707 - DNA, 18 bp, Homo sapiens
ttcttcacttacaagaaa

SEQ ID NO: 4423708 - DNA, 17 bp, Homo sapiens
ttcttcacttcaagctg

SEQ ID NO: 4423709 - DNA, 10 bp, Homo sapiens
ttcttcagca

SEQ ID NO: 4423710 - DNA, 17 bp, Homo sapiens
ttcttcagcatttactt

SEQ ID NO: 4423711 - DNA, 15 bp, Homo sapiens
ttcttcatgaaatgt

SEQ ID NO: 4423712 - DNA, 19 bp, Homo sapiens
ttcttccatcatcactgta

SEQ ID NO: 4423713 - DNA, 21 bp, Homo sapiens
ttcttccatcatcactgtaaa

SEQ ID NO: 4423714 - DNA, 22 bp, Homo sapiens
ttcttccatcatcactgtaaag

SEQ ID NO: 4423715 - DNA, 14 bp, Homo sapiens
ttcttccccaagct

SEQ ID NO: 4423716 - DNA, 20 bp, Homo sapiens
ttcttccccaggtccttcct

SEQ ID NO: 4423717 - DNA, 11 bp, Homo sapiens
ttcttcctgtg

SEQ ID NO: 4423718 - DNA, 23 bp, Homo sapiens
ttcttcgaggtggatcacagagg

SEQ ID NO: 4423719 - DNA, 15 bp, Homo sapiens
ttcttctaagaagac

SEQ ID NO: 4423720 - DNA, 21 bp, Homo sapiens
ttcttctaagaagacattttg

SEQ ID NO: 4423721 - DNA, 22 bp, Homo sapiens
ttcttctaagaagacattttgt

SEQ ID NO: 4423722 - DNA, 21 bp, Homo sapiens
ttcttctagaatgtaaagtta

SEQ ID NO: 4423723 - DNA, 13 bp, Homo sapiens
ttcttctgaactc

SEQ ID NO: 4423724 - DNA, 23 bp, Homo sapiens
ttcttctgaactcaaactgagga

SEQ ID NO: 4423725 - DNA, 15 bp, Homo sapiens
ttcttcttctaagaa

SEQ ID NO: 4423726 - DNA, 12 bp, Homo sapiens
ttcttctttaat

SEQ ID NO: 4423727 - DNA, 13 bp, Homo sapiens
ttcttgaaaaaga

SEQ ID NO: 4423728 - DNA, 21 bp, Homo sapiens
ttcttgaatttaataatctgt

SEQ ID NO: 4423729 - DNA, 14 bp, Homo sapiens
ttcttgccttttgt

SEQ ID NO: 4423730 - DNA, 19 bp, Homo sapiens
ttcttgcttctttctagaa

SEQ ID NO: 4423731 - DNA, 15 bp, Homo sapiens
ttcttgctttcaatt

SEQ ID NO: 4423732 - DNA, 21 bp, Homo sapiens
ttcttggaactgtcccagcta

SEQ ID NO: 4423733 - DNA, 20 bp, Homo sapiens
ttcttggagctttggaatat

SEQ ID NO: 4423734 - DNA, 19 bp, Homo sapiens
ttcttggagtgccaagttt

SEQ ID NO: 4423735 - DNA, 20 bp, Homo sapiens
ttcttggagtgccaagtttg

SEQ ID NO: 4423736 - DNA, 22 bp, Homo sapiens
ttcttggcttaatcattttcat

SEQ ID NO: 4423737 - DNA, 19 bp, Homo sapiens
ttcttggtaactgattacc

SEQ ID NO: 4423738 - DNA, 18 bp, Homo sapiens
ttcttggtgactgtccca

SEQ ID NO: 4423739 - DNA, 22 bp, Homo sapiens
ttcagtggtgaaatcttgtttg

SEQ ID NO: 4423740 - DNA, 16 bp, Homo sapiens
ttcagtgtaaagtgtg

SEQ ID NO: 4423741 - DNA, 23 bp, Homo sapiens
ttcagtgtcaaataaacactgtg

SEQ ID NO: 4423742 - DNA, 12 bp, Homo sapiens
ttcagtgttaaa

SEQ ID NO: 4423743 - DNA, 18 bp, Homo sapiens
ttcagtgttaaatgtgat

SEQ ID NO: 4423744 - DNA, 18 bp, Homo sapiens
ttcagttattaaatgata

SEQ ID NO: 4423745 - DNA, 17 bp, Homo sapiens
ttcagttcattcccaga

SEQ ID NO: 4423746 - DNA, 18 bp, Homo sapiens
ttcagttggtgtgttttt

SEQ ID NO: 4423747 - DNA, 17 bp, Homo sapiens
ttcagttgttcttttta

SEQ ID NO: 4423748 - DNA, 21 bp, Homo sapiens
ttcagtttgaaaatattttgt

SEQ ID NO: 4423749 - DNA, 13 bp, Homo sapiens
ttcagtttttcac

SEQ ID NO: 4423750 - DNA, 18 bp, Homo sapiens
ttcagtttttcacttcta

SEQ ID NO: 4423751 - DNA, 19 bp, Homo sapiens
ttcagtttttttttttcca

SEQ ID NO: 4423752 - DNA, 20 bp, Homo sapiens
ttcagtttttttttttccag

SEQ ID NO: 4423753 - DNA, 17 bp, Homo sapiens
ttcataacagtgccatt

SEQ ID NO: 4423754 - DNA, 21 bp, Homo sapiens
ttcataacagtgccattgtct

SEQ ID NO: 4423755 - DNA, 21 bp, Homo sapiens
ttcataacttattgctgattt

SEQ ID NO: 4423756 - DNA, 22 bp, Homo sapiens
ttcataacttattgctgatttt

SEQ ID NO: 4423757 - DNA, 15 bp, Homo sapiens
ttcataataaatttt

SEQ ID NO: 4423758 - DNA, 13 bp, Homo sapiens
ttcataattctga

SEQ ID NO: 4423759 - DNA, 15 bp, Homo sapiens
ttcataattctgaaa

SEQ ID NO: 4423760 - DNA, 16 bp, Homo sapiens
ttcatactaaactgat

SEQ ID NO: 4423761 - DNA, 15 bp, Homo sapiens
ttcatactgtacaca

SEQ ID NO: 4423762 - DNA, 22 bp, Homo sapiens
ttcatactgtacacatttctta

SEQ ID NO: 4423763 - DNA, 13 bp, Homo sapiens
ttcatagaagtgt

SEQ ID NO: 4423764 - DNA, 15 bp, Homo sapiens
ttcatagaagtgttg

SEQ ID NO: 4423765 - DNA, 11 bp, Homo sapiens
ttcatagagaa

SEQ ID NO: 4423766 - DNA, 18 bp, Homo sapiens
ttcatagagaatataaaa

SEQ ID NO: 4423767 - DNA, 20 bp, Homo sapiens
ttcatagagttcccatgaac

SEQ ID NO: 4423768 - DNA, 15 bp, Homo sapiens
tcagacttgtcaagc

SEQ ID NO: 4423769 - DNA, 13 bp, Homo sapiens
tcagactttgctt

SEQ ID NO: 4423770 - DNA, 22 bp, Homo sapiens
tcagactttgtgttcatttcat

SEQ ID NO: 4423771 - DNA, 20 bp, Homo sapiens
tcagagaaaatgagaaagga

SEQ ID NO: 4423772 - DNA, 14 bp, Homo sapiens
tcagagaaaggact

SEQ ID NO: 4423773 - DNA, 14 bp, Homo sapiens
tcagagagacctca

SEQ ID NO: 4423774 - DNA, 13 bp, Homo sapiens
tcagagataaagc

SEQ ID NO: 4423775 - DNA, 19 bp, Homo sapiens
tcagagatgtccattttta

SEQ ID NO: 4423776 - DNA, 23 bp, Homo sapiens
tcagagatgtccatttttacaag

SEQ ID NO: 4423777 - DNA, 16 bp, Homo sapiens
tcagagcactccctaa

SEQ ID NO: 4423778 - DNA, 22 bp, Homo sapiens
tcagagcactttaaaaacaggc

SEQ ID NO: 4423779 - DNA, 11 bp, Homo sapiens
tcagagccact

SEQ ID NO: 4423780 - DNA, 13 bp, Homo sapiens
tcagagccagcct

SEQ ID NO: 4423781 - DNA, 23 bp, Homo sapiens
tcagagccagcctggctctgccc

SEQ ID NO: 4423782 - DNA, 14 bp, Homo sapiens
tcagagcgcacagg

SEQ ID NO: 4423783 - DNA, 19 bp, Homo sapiens
tcagagcgccaggaagcca

SEQ ID NO: 4423784 - DNA, 15 bp, Homo sapiens
tcagagctctcgagg

SEQ ID NO: 4423785 - DNA, 20 bp, Homo sapiens
tcagagctctcgaggaaagt

SEQ ID NO: 4423786 - DNA, 10 bp, Homo sapiens
tcagagcttt

SEQ ID NO: 4423787 - DNA, 22 bp, Homo sapiens
tcagagctttgtcacttgccac

SEQ ID NO: 4423788 - DNA, 21 bp, Homo sapiens
tcagaggacctgtatttaagc

SEQ ID NO: 4423789 - DNA, 14 bp, Homo sapiens
tcagaggagaagag

SEQ ID NO: 4423790 - DNA, 18 bp, Homo sapiens
tcagaggccctcgctgcc

SEQ ID NO: 4423791 - DNA, 22 bp, Homo sapiens
tcagaggccctcgctgccagct

SEQ ID NO: 4423792 - DNA, 14 bp, Homo sapiens
ttatactgagcttt

SEQ ID NO: 4423793 - DNA, 24 bp, Homo sapiens
ttatactgggacaccattaccaaa

SEQ ID NO: 4423794 - DNA, 16 bp, Homo sapiens
ttatactttatatctg

SEQ ID NO: 4423795 - DNA, 21 bp, Homo sapiens
ttatagacaaaagaataagac

SEQ ID NO: 4423796 - DNA, 23 bp, Homo sapiens
ttatagcaaaaatgttttccaat

SEQ ID NO: 4423797 - DNA, 19 bp, Homo sapiens
ttataggaatagaggaaga

SEQ ID NO: 4423798 - DNA, 16 bp, Homo sapiens
ttataggcgttttttg

SEQ ID NO: 4423799 - DNA, 16 bp, Homo sapiens
ttatagtacatgataa

SEQ ID NO: 4423800 - DNA, 18 bp, Homo sapiens
ttatagtagaacaaggca

SEQ ID NO: 4423801 - DNA, 15 bp, Homo sapiens
ttatagtgaagtgtt

SEQ ID NO: 4423802 - DNA, 16 bp, Homo sapiens
ttatagtgaagtgtta

SEQ ID NO: 4423803 - DNA, 19 bp, Homo sapiens
ttatagtgaagtgttaata

SEQ ID NO: 4423804 - DNA, 22 bp, Homo sapiens
ttatagttaagcaaatttcatt

SEQ ID NO: 4423805 - DNA, 13 bp, Homo sapiens
ttatagttactgt

SEQ ID NO: 4423806 - DNA, 22 bp, Homo sapiens
ttatagttattaaatgtttcaa

SEQ ID NO: 4423807 - DNA, 18 bp, Homo sapiens
ttatataaagtattcttt

SEQ ID NO: 4423808 - DNA, 18 bp, Homo sapiens
ttatataacaaaaaaggt

SEQ ID NO: 4423809 - DNA, 15 bp, Homo sapiens
ttatatactttttca

SEQ ID NO: 4423810 - DNA, 12 bp, Homo sapiens
ttatatataata

SEQ ID NO: 4423811 - DNA, 13 bp, Homo sapiens
ttatatataataa

SEQ ID NO: 4423812 - DNA, 14 bp, Homo sapiens
ttatatataataaa

SEQ ID NO: 4423813 - DNA, 17 bp, Homo sapiens
ttatatataataaatac

SEQ ID NO: 4423814 - DNA, 15 bp, Homo sapiens
ttatatattataagt

SEQ ID NO: 4423815 - DNA, 20 bp, Homo sapiens
ttatatattatgtgaagaat

SEQ ID NO: 4423816 - DNA, 21 bp, Homo sapiens
ttatatattatgtgaagaatt

SEQ ID NO: 4423817 - DNA, 22 bp, Homo sapiens
ttatatattatgtgaagaattt

SEQ ID NO: 4423818 - DNA, 23 bp, Homo sapiens
ttatatattgaaagttgctttta

SEQ ID NO: 4423819 - DNA, 11 bp, Homo sapiens
ttatatattgt

SEQ ID NO: 4423820 - DNA, 13 bp, Homo sapiens
ttatatattgtat

SEQ ID NO: 4423821 - DNA, 20 bp, Homo sapiens
ttatatattttcatcctata

SEQ ID NO: 4423822 - DNA, 18 bp, Homo sapiens
ttatatcacacaatatag

SEQ ID NO: 4423823 - DNA, 15 bp, Homo sapiens
ttatatcagcttttc

SEQ ID NO: 4423824 - DNA, 15 bp, Homo sapiens
ttatatcatacagtt

SEQ ID NO: 4423825 - DNA, 19 bp, Homo sapiens
ttatatcatacagttttca

SEQ ID NO: 4423826 - DNA, 20 bp, Homo sapiens
ttatatctgtaatgatactg

SEQ ID NO: 4423827 - DNA, 21 bp, Homo sapiens
ttatatcttgtttacaataaa

SEQ ID NO: 4423828 - DNA, 18 bp, Homo sapiens
ttatatgatatgcatgta

SEQ ID NO: 4423829 - DNA, 22 bp, Homo sapiens
ttatatggccctgcacagacct

SEQ ID NO: 4423830 - DNA, 13 bp, Homo sapiens
ttatatgtaaatg

SEQ ID NO: 4423831 - DNA, 14 bp, Homo sapiens
ttatatgtaaatgt

SEQ ID NO: 4423832 - DNA, 16 bp, Homo sapiens
ttatatgtaaatgtgt

SEQ ID NO: 4423833 - DNA, 19 bp, Homo sapiens
ttatatgtgttgaaaacca

SEQ ID NO: 4423834 - DNA, 20 bp, Homo sapiens
ttatattctaatagtttttc

SEQ ID NO: 4423835 - DNA, 14 bp, Homo sapiens
ttatattctaatta

SEQ ID NO: 4423836 - DNA, 16 bp, Homo sapiens
ttatattctaattaaa

SEQ ID NO: 4423837 - DNA, 13 bp, Homo sapiens
ttatattgcaatg

SEQ ID NO: 4423838 - DNA, 23 bp, Homo sapiens
ttatattgcttcctgtgtaacat

SEQ ID NO: 4423839 - DNA, 18 bp, Homo sapiens
ttatattggtttgcacaa

SEQ ID NO: 4423840 - DNA, 21 bp, Homo sapiens
ttatattggtttgcacaagtt

SEQ ID NO: 4423841 - DNA, 12 bp, Homo sapiens
ttatattgtcct

SEQ ID NO: 4423842 - DNA, 20 bp, Homo sapiens
ttatattgtttttatatatt

SEQ ID NO: 4423843 - DNA, 18 bp, Homo sapiens
ttatatttaaaaaattat

SEQ ID NO: 4423844 - DNA, 13 bp, Homo sapiens
ttatatttattgt

SEQ ID NO: 4423845 - DNA, 21 bp, Homo sapiens
ttatatttcagatgtaatgtt

SEQ ID NO: 4423846 - DNA, 12 bp, Homo sapiens
ttatatttcctt

SEQ ID NO: 4423847 - DNA, 18 bp, Homo sapiens
ttatatttgtgctatagt

SEQ ID NO: 4423848 - DNA, 16 bp, Homo sapiens
ttatattttatgaaca

SEQ ID NO: 4423849 - DNA, 12 bp, Homo sapiens
ttatattttctt

SEQ ID NO: 4423850 - DNA, 17 bp, Homo sapiens
ttatattttgaaagaag

SEQ ID NO: 4423851 - DNA, 14 bp, Homo sapiens
ttatcaacatttgt

SEQ ID NO: 4423852 - DNA, 20 bp, Homo sapiens
ttatcaatgtgtctttctaa

SEQ ID NO: 4423853 - DNA, 14 bp, Homo sapiens
ttatcaattatatt

SEQ ID NO: 4423854 - DNA, 17 bp, Homo sapiens
ttatcaattatattatg

SEQ ID NO: 4423855 - DNA, 20 bp, Homo sapiens
ttatcaattatattatgttt

SEQ ID NO: 4423856 - DNA, 22 bp, Homo sapiens
ttatcacagaaataaaatatct

SEQ ID NO: 4423857 - DNA, 19 bp, Homo sapiens
ttatcagggaacttagtaa

SEQ ID NO: 4423858 - DNA, 23 bp, Homo sapiens
ttatcagtcaatatttttagata

SEQ ID NO: 4423859 - DNA, 20 bp, Homo sapiens
ttatcagtttgctaatgttt

SEQ ID NO: 4423860 - DNA, 18 bp, Homo sapiens
ttatcatcctttcagttt

SEQ ID NO: 4423861 - DNA, 12 bp, Homo sapiens
ttatcatgaagc

SEQ ID NO: 4423862 - DNA, 22 bp, Homo sapiens
ttatcatgaagcctgtggatga

SEQ ID NO: 4423863 - DNA, 21 bp, Homo sapiens
ttatcatggagaatacagaaa

SEQ ID NO: 4423864 - DNA, 14 bp, Homo sapiens
ttatccataaaaaa

SEQ ID NO: 4423865 - DNA, 14 bp, Homo sapiens
ttatcccatttagt

SEQ ID NO: 4423866 - DNA, 21 bp, Homo sapiens
ttatcccatttagtgtgaata

SEQ ID NO: 4423867 - DNA, 14 bp, Homo sapiens
ttatcccattttat

SEQ ID NO: 4423868 - DNA, 18 bp, Homo sapiens
ttatccccgtttcttgca

SEQ ID NO: 4423869 - DNA, 23 bp, Homo sapiens
ttatccctattttgctgatgagg

SEQ ID NO: 4423870 - DNA, 15 bp, Homo sapiens
ttatccctctcttcc

SEQ ID NO: 4423871 - DNA, 13 bp, Homo sapiens
ttatcctgcattg

SEQ ID NO: 4423872 - DNA, 16 bp, Homo sapiens
ttatccttttatctca

SEQ ID NO: 4423873 - DNA, 22 bp, Homo sapiens
ttatcggattactgaattgtat

SEQ ID NO: 4423874 - DNA, 16 bp, Homo sapiens
ttatctaatttataaa

SEQ ID NO: 4423875 - DNA, 17 bp, Homo sapiens
ttatctaatttataaaa

SEQ ID NO: 4423876 - DNA, 18 bp, Homo sapiens
ttatctatagctaagtac

SEQ ID NO: 4423877 - DNA, 15 bp, Homo sapiens
ttatctatataaaat

SEQ ID NO: 4423878 - DNA, 16 bp, Homo sapiens
ttatctatataaaata

SEQ ID NO: 4423879 - DNA, 19 bp, Homo sapiens
ttatctattagataatcaa

SEQ ID NO: 4423880 - DNA, 20 bp, Homo sapiens
ttatctcactttgtaaataa

SEQ ID NO: 4423881 - DNA, 16 bp, Homo sapiens
ttatctctttctctct

SEQ ID NO: 4423882 - DNA, 21 bp, Homo sapiens
ttatctgaatttttaaacaag

SEQ ID NO: 4423883 - DNA, 18 bp, Homo sapiens
ttatctgcaagtgaggtg

SEQ ID NO: 4423884 - DNA, 20 bp, Homo sapiens
ttatctgcggctttaaactg

SEQ ID NO: 4423885 - DNA, 19 bp, Homo sapiens
ttatctggaaataatatca

SEQ ID NO: 4423886 - DNA, 16 bp, Homo sapiens
ttatctggtgcctcct

SEQ ID NO: 4423887 - DNA, 22 bp, Homo sapiens
ttatctgtaattgtaattccaa

SEQ ID NO: 4423888 - DNA, 20 bp, Homo sapiens
ttatctgtcttgacttttta

SEQ ID NO: 4423889 - DNA, 16 bp, Homo sapiens
ttatctgttgccttat

SEQ ID NO: 4423890 - DNA, 12 bp, Homo sapiens
ttatctgtttcc

SEQ ID NO: 4423891 - DNA, 21 bp, Homo sapiens
ttatcttatactgtacaataa

SEQ ID NO: 4423892 - DNA, 12 bp, Homo sapiens
ttatcttcttaa

SEQ ID NO: 4423893 - DNA, 15 bp, Homo sapiens
ttatcttctttatta

SEQ ID NO: 4423894 - DNA, 20 bp, Homo sapiens
ttatctttgtattcttcatg

SEQ ID NO: 4423895 - DNA, 15 bp, Homo sapiens
ttatgaaaagtacta

SEQ ID NO: 4423896 - DNA, 21 bp, Homo sapiens
ttatgaaaagtactaatagaa

SEQ ID NO: 4423897 - DNA, 14 bp, Homo sapiens
ttatgaacattgta

SEQ ID NO: 4423898 - DNA, 18 bp, Homo sapiens
ttatgaacattgtactgt

SEQ ID NO: 4423899 - DNA, 20 bp, Homo sapiens
ttatgaagtttttaaaaata

SEQ ID NO: 4423900 - DNA, 22 bp, Homo sapiens
ttatgaagtttttaaaaataaa

SEQ ID NO: 4423901 - DNA, 13 bp, Homo sapiens
ttatgagaaactg

SEQ ID NO: 4423902 - DNA, 17 bp, Homo sapiens
ttatgagaggctgtcat

SEQ ID NO: 4423903 - DNA, 20 bp, Homo sapiens
ttatgagttcttgtttttta

SEQ ID NO: 4423904 - DNA, 16 bp, Homo sapiens
ttatgagtttgccctc

SEQ ID NO: 4423905 - DNA, 15 bp, Homo sapiens
ttatgatgatacagt

SEQ ID NO: 4423906 - DNA, 19 bp, Homo sapiens
ttatgatggagcaactgaa

SEQ ID NO: 4423907 - DNA, 20 bp, Homo sapiens
ttatgatggttttaaacttt

SEQ ID NO: 4423908 - DNA, 19 bp, Homo sapiens
ttatgattgcattgtatga

SEQ ID NO: 4423909 - DNA, 14 bp, Homo sapiens
ttatgattttcata

SEQ ID NO: 4423910 - DNA, 19 bp, Homo sapiens
ttaccagcttttaaccatc

SEQ ID NO: 4423911 - DNA, 16 bp, Homo sapiens
ttaccatcatctctga

SEQ ID NO: 4423912 - DNA, 14 bp, Homo sapiens
ttaccattcacaat

SEQ ID NO: 4423913 - DNA, 17 bp, Homo sapiens
ttaccattcacaataaa

SEQ ID NO: 4423914 - DNA, 16 bp, Homo sapiens
ttaccctttcttttga

SEQ ID NO: 4423915 - DNA, 16 bp, Homo sapiens
ttacccttttccccct

SEQ ID NO: 4423916 - DNA, 18 bp, Homo sapiens
ttacctaagattacaaat

SEQ ID NO: 4423917 - DNA, 17 bp, Homo sapiens
ttacctaatttcatttt

SEQ ID NO: 4423918 - DNA, 23 bp, Homo sapiens
ttacctagtgcaaaaactgtaaa

SEQ ID NO: 4423919 - DNA, 17 bp, Homo sapiens
ttacctcaacaagaaga

SEQ ID NO: 4423920 - DNA, 11 bp, Homo sapiens
ttacctcctga

SEQ ID NO: 4423921 - DNA, 19 bp, Homo sapiens
ttacctcctgagaaaaaag

SEQ ID NO: 4423922 - DNA, 14 bp, Homo sapiens
ttacctcctgccca

SEQ ID NO: 4423923 - DNA, 20 bp, Homo sapiens
ttacctgaaaacactgtgca

SEQ ID NO: 4423924 - DNA, 22 bp, Homo sapiens
ttacctgaaaacactgtgcaca

SEQ ID NO: 4423925 - DNA, 18 bp, Homo sapiens
ttacctgccaattgctac

SEQ ID NO: 4423926 - DNA, 12 bp, Homo sapiens
ttacctggatta

SEQ ID NO: 4423927 - DNA, 18 bp, Homo sapiens
ttacctgtatacagtgca

SEQ ID NO: 4423928 - DNA, 13 bp, Homo sapiens
ttacctgtggata

SEQ ID NO: 4423929 - DNA, 14 bp, Homo sapiens
ttaccttacagaag

SEQ ID NO: 4423930 - DNA, 15 bp, Homo sapiens
ttaccttgaaatgct

SEQ ID NO: 4423931 - DNA, 17 bp, Homo sapiens
ttacctttatctttcac

SEQ ID NO: 4423932 - DNA, 13 bp, Homo sapiens
ttacctttcatac

SEQ ID NO: 4423933 - DNA, 15 bp, Homo sapiens
ttacctttttatttg

SEQ ID NO: 4423934 - DNA, 17 bp, Homo sapiens
ttacgaatattttcagt

SEQ ID NO: 4423935 - DNA, 16 bp, Homo sapiens
ttacgctttgattcat

SEQ ID NO: 4423936 - DNA, 17 bp, Homo sapiens
ttacggcatcacactta

SEQ ID NO: 4423937 - DNA, 15 bp, Homo sapiens
ttacgtgctctgtgg

SEQ ID NO: 4423938 - DNA, 17 bp, Homo sapiens
ttacgtttgaagtctga

SEQ ID NO: 4423939 - DNA, 15 bp, Homo sapiens
ttactaaaatttaca

SEQ ID NO: 4423940 - DNA, 18 bp, Homo sapiens
ttactacagccttaatat

SEQ ID NO: 4423941 - DNA, 14 bp, Homo sapiens
ttactacagttttt

SEQ ID NO: 4423942 - DNA, 15 bp, Homo sapiens
ttactacagttttta

SEQ ID NO: 4423943 - DNA, 20 bp, Homo sapiens
ttactagggatccctcatct

SEQ ID NO: 4423944 - DNA, 22 bp, Homo sapiens
ttactagtgtttaagtcatttt

SEQ ID NO: 4423945 - DNA, 22 bp, Homo sapiens
ttactatatagaatttcctgta

SEQ ID NO: 4423946 - DNA, 21 bp, Homo sapiens
ttactattaactctgcataga

SEQ ID NO: 4423947 - DNA, 23 bp, Homo sapiens
ttactattaactctgcatagaca

SEQ ID NO: 4423948 - DNA, 21 bp, Homo sapiens
ttactcagcagcagagagccc

SEQ ID NO: 4423949 - DNA, 14 bp, Homo sapiens
ttactcagccctgg

SEQ ID NO: 4423950 - DNA, 22 bp, Homo sapiens
ttactccaggttattgcaataa

SEQ ID NO: 4423951 - DNA, 16 bp, Homo sapiens
ttactcccttctgtag

SEQ ID NO: 4423952 - DNA, 17 bp, Homo sapiens
ttactcccttctgtagt

SEQ ID NO: 4423953 - DNA, 22 bp, Homo sapiens
ttactcctatttttgtaaactg

SEQ ID NO: 4423954 - DNA, 21 bp, Homo sapiens
ttactccttaggtgcccagaa

SEQ ID NO: 4423955 - DNA, 16 bp, Homo sapiens
ttactctttgctttgt

SEQ ID NO: 4423956 - DNA, 18 bp, Homo sapiens
ttactgaatgatctattc

SEQ ID NO: 4423957 - DNA, 13 bp, Homo sapiens
ttactgaatgtta

SEQ ID NO: 4423958 - DNA, 18 bp, Homo sapiens
ttactgaatgttagaaga

SEQ ID NO: 4423959 - DNA, 22 bp, Homo sapiens
ttactgatgtgtgcaacctttt

SEQ ID NO: 4423960 - DNA, 12 bp, Homo sapiens
ttactgcctgta

SEQ ID NO: 4423961 - DNA, 17 bp, Homo sapiens
ttactgctctagaaagt

SEQ ID NO: 4423962 - DNA, 19 bp, Homo sapiens
ttactgctttaatcagaaa

SEQ ID NO: 4423963 - DNA, 12 bp, Homo sapiens
ttactgtatgtt

SEQ ID NO: 4423964 - DNA, 16 bp, Homo sapiens
ttactgtatgttttta

SEQ ID NO: 4423965 - DNA, 18 bp, Homo sapiens
ttactgtatttttcagaa

SEQ ID NO: 4423966 - DNA, 22 bp, Homo sapiens
ttactgtatttttcagaaatca

SEQ ID NO: 4423967 - DNA, 12 bp, Homo sapiens
ttactgtcattc

SEQ ID NO: 4423968 - DNA, 16 bp, Homo sapiens
ttacttaactgtttca

SEQ ID NO: 4423969 - DNA, 16 bp, Homo sapiens
ttacttaagtgttcat

SEQ ID NO: 4423970 - DNA, 17 bp, Homo sapiens
ttacttaagtgttcatt

SEQ ID NO: 4423971 - DNA, 22 bp, Homo sapiens
ttacttcaggggaagagaagac

SEQ ID NO: 4423972 - DNA, 13 bp, Homo sapiens
ttacttcttctct

SEQ ID NO: 4423973 - DNA, 18 bp, Homo sapiens
ttacttgaactttccaaa

SEQ ID NO: 4423974 - DNA, 13 bp, Homo sapiens
ttacttgaatgta

SEQ ID NO: 4423975 - DNA, 13 bp, Homo sapiens
ttacttgcttcag

SEQ ID NO: 4423976 - DNA, 14 bp, Homo sapiens
ttacttgcttcagt

SEQ ID NO: 4423977 - DNA, 17 bp, Homo sapiens
ttactttaattactgga

SEQ ID NO: 4423978 - DNA, 19 bp, Homo sapiens
ttactttaattactggaat

SEQ ID NO: 4423979 - DNA, 18 bp, Homo sapiens
ttactttagaagcctgca

SEQ ID NO: 4423980 - DNA, 16 bp, Homo sapiens
ttactttattataaaa

SEQ ID NO: 4423981 - DNA, 19 bp, Homo sapiens
ttactttggcaatttcctg

SEQ ID NO: 4423982 - DNA, 20 bp, Homo sapiens
ttactttggcaatttcctgg

SEQ ID NO: 4423983 - DNA, 21 bp, Homo sapiens
ttactttggggctaatttaac

SEQ ID NO: 4423984 - DNA, 13 bp, Homo sapiens
ttactttggttta

SEQ ID NO: 4423985 - DNA, 18 bp, Homo sapiens
ttactttggtttagtctt

SEQ ID NO: 4423986 - DNA, 16 bp, Homo sapiens
ttacttttaaactgtg

SEQ ID NO: 4423987 - DNA, 19 bp, Homo sapiens
ttacttttaaactgtgtac

SEQ ID NO: 4423988 - DNA, 19 bp, Homo sapiens
ttacttttctgccaaaata

SEQ ID NO: 4423989 - DNA, 21 bp, Homo sapiens
ttacttttctgccaaaataaa

SEQ ID NO: 4423990 - DNA, 13 bp, Homo sapiens
ttactttttatgg

SEQ ID NO: 4423991 - DNA, 22 bp, Homo sapiens
ttagaaaaaaaaagaaaaatca

SEQ ID NO: 4423992 - DNA, 23 bp, Homo sapiens
ttagaaaaaaaactgaagatgaa

SEQ ID NO: 4423993 - DNA, 15 bp, Homo sapiens
ttagaaaaacattta

SEQ ID NO: 4423994 - DNA, 20 bp, Homo sapiens
ttagaaaaagaacatgcagt

SEQ ID NO: 4423995 - DNA, 21 bp, Homo sapiens
ttagaaaaagaacatgcagtt

SEQ ID NO: 4423996 - DNA, 22 bp, Homo sapiens
ttagaaaaagaacatgcagttt

SEQ ID NO: 4423997 - DNA, 23 bp, Homo sapiens
ttagaaaagggagtttaaaaatg

SEQ ID NO: 4423998 - DNA, 22 bp, Homo sapiens
ttagaaaatgacttatttctgc

SEQ ID NO: 4423999 - DNA, 10 bp, Homo sapiens
ttagaaacta

SEQ ID NO: 4424000 - DNA, 13 bp, Homo sapiens
ttagaaaggacaa

SEQ ID NO: 4424001 - DNA, 11 bp, Homo sapiens
ttagaaatatt

SEQ ID NO: 4424002 - DNA, 13 bp, Homo sapiens
ttagaaatatttt

SEQ ID NO: 4424003 - DNA, 13 bp, Homo sapiens
ttagaaatcattt

SEQ ID NO: 4424004 - DNA, 20 bp, Homo sapiens
ttagaaattaaatctgtgtc

SEQ ID NO: 4424005 - DNA, 14 bp, Homo sapiens
ttagaacattcact

SEQ ID NO: 4424006 - DNA, 22 bp, Homo sapiens
ttagaaccacagcagacaccat

SEQ ID NO: 4424007 - DNA, 23 bp, Homo sapiens
ttagaagcctgcataatgtttct

SEQ ID NO: 4424008 - DNA, 17 bp, Homo sapiens
ttagaatagtgtcagtt

SEQ ID NO: 4424009 - DNA, 20 bp, Homo sapiens
ttagaatgaatttatcttta

SEQ ID NO: 4424010 - DNA, 12 bp, Homo sapiens
ttagaatgccat

SEQ ID NO: 4424011 - DNA, 21 bp, Homo sapiens
ttagaatgccataaaattgca

SEQ ID NO: 4424012 - DNA, 13 bp, Homo sapiens
ttagaatgttgaa

SEQ ID NO: 4424013 - DNA, 16 bp, Homo sapiens
ttagacaagagatggg

SEQ ID NO: 4424014 - DNA, 13 bp, Homo sapiens
ttagaccctgggt

SEQ ID NO: 4424015 - DNA, 14 bp, Homo sapiens
ttagacctgccagc

SEQ ID NO: 4424016 - DNA, 19 bp, Homo sapiens
ttagacctgccagccactg

SEQ ID NO: 4424017 - DNA, 16 bp, Homo sapiens
ttagacctgtgttact

SEQ ID NO: 4424018 - DNA, 14 bp, Homo sapiens
ttagactatttctt

SEQ ID NO: 4424019 - DNA, 19 bp, Homo sapiens
ttagactatttctttttat

SEQ ID NO: 4424020 - DNA, 13 bp, Homo sapiens
ttagactcctcct

SEQ ID NO: 4424021 - DNA, 23 bp, Homo sapiens
ttagacttcccactgttctgaaa

SEQ ID NO: 4424022 - DNA, 16 bp, Homo sapiens
ttagacttgtgtgcat

SEQ ID NO: 4424023 - DNA, 17 bp, Homo sapiens
ttagacttgtgtgcatg

SEQ ID NO: 4424024 - DNA, 21 bp, Homo sapiens
ttagacttgtgtgcatggaag

SEQ ID NO: 4424025 - DNA, 12 bp, Homo sapiens
ttagagaataaa

SEQ ID NO: 4424026 - DNA, 14 bp, Homo sapiens
ttagagatgattca

SEQ ID NO: 4424027 - DNA, 21 bp, Homo sapiens
ttagagccaagtgtcttttaa

SEQ ID NO: 4424028 - DNA, 16 bp, Homo sapiens
ttagagccaggcacac

SEQ ID NO: 4424029 - DNA, 21 bp, Homo sapiens
ttagagccaggcacacactgt

SEQ ID NO: 4424030 - DNA, 16 bp, Homo sapiens
ttagaggaaaaatatt

SEQ ID NO: 4424031 - DNA, 21 bp, Homo sapiens
ttagagggatgagacagacat

SEQ ID NO: 4424032 - DNA, 17 bp, Homo sapiens
ttagaggtaaaagtaca

SEQ ID NO: 4424033 - DNA, 16 bp, Homo sapiens
ttagagtgtctttcca

SEQ ID NO: 4424034 - DNA, 13 bp, Homo sapiens
ttagagtttctgt

SEQ ID NO: 4424035 - DNA, 16 bp, Homo sapiens
ttagagtttctgtttg

SEQ ID NO: 4424036 - DNA, 19 bp, Homo sapiens
ttagataaagatttctagt

SEQ ID NO: 4424037 - DNA, 22 bp, Homo sapiens
ttagatatgttaagcatggatt

SEQ ID NO: 4424038 - DNA, 20 bp, Homo sapiens
ttagatatttcgaccctggg

SEQ ID NO: 4424039 - DNA, 23 bp, Homo sapiens
ttagatccattaatttaaatgat

SEQ ID NO: 4424040 - DNA, 22 bp, Homo sapiens
ttagatctaaacagttatttct

SEQ ID NO: 4424041 - DNA, 16 bp, Homo sapiens
ttagatctctcctgca

SEQ ID NO: 4424042 - DNA, 14 bp, Homo sapiens
ttagatcttatatt

SEQ ID NO: 4424043 - DNA, 13 bp, Homo sapiens
ttagatggttaca

SEQ ID NO: 4424044 - DNA, 16 bp, Homo sapiens
ttagatggttacactg

SEQ ID NO: 4424045 - DNA, 13 bp, Homo sapiens
ttagatgttctaa

SEQ ID NO: 4424046 - DNA, 10 bp, Homo sapiens
ttagatttca

SEQ ID NO: 4424047 - DNA, 22 bp, Homo sapiens
ttagatttcatagttcagaatt

SEQ ID NO: 4424048 - DNA, 22 bp, Homo sapiens
ttagcaaagcaaaaggctgaga

SEQ ID NO: 4424049 - DNA, 18 bp, Homo sapiens
ttagcaaatcagtatatt

SEQ ID NO: 4424050 - DNA, 12 bp, Homo sapiens
ttagcaaggatt

SEQ ID NO: 4424051 - DNA, 22 bp, Homo sapiens
ttagcacgtttaaagttctgtg

SEQ ID NO: 4424052 - DNA, 16 bp, Homo sapiens
ttagcatccaggctgg

SEQ ID NO: 4424053 - DNA, 19 bp, Homo sapiens
ttagcatgttgttgaaagg

SEQ ID NO: 4424054 - DNA, 17 bp, Homo sapiens
ttagcccaagaggtctg

SEQ ID NO: 4424055 - DNA, 22 bp, Homo sapiens
ttagcccaagaggtctgagccc

SEQ ID NO: 4424056 - DNA, 19 bp, Homo sapiens
ttagccgggcatggtggca

SEQ ID NO: 4424057 - DNA, 17 bp, Homo sapiens
ttagcctcctcccaaag

SEQ ID NO: 4424058 - DNA, 14 bp, Homo sapiens
ttagccttgctcag

SEQ ID NO: 4424059 - DNA, 13 bp, Homo sapiens
ttagcgtcaagac

SEQ ID NO: 4424060 - DNA, 19 bp, Homo sapiens
ttagcgtcaagacatttgc

SEQ ID NO: 4424061 - DNA, 21 bp, Homo sapiens
ttagctaaacggattccaaag

SEQ ID NO: 4424062 - DNA, 18 bp, Homo sapiens
ttagctaaattcagggag

SEQ ID NO: 4424063 - DNA, 20 bp, Homo sapiens
ttagctacctttttatattt

SEQ ID NO: 4424064 - DNA, 18 bp, Homo sapiens
ttagctcccctccaacct

SEQ ID NO: 4424065 - DNA, 13 bp, Homo sapiens
ttagctgcagaac

SEQ ID NO: 4424066 - DNA, 20 bp, Homo sapiens
ttagcttggggacctgaact

SEQ ID NO: 4424067 - DNA, 18 bp, Homo sapiens
ttaggaaggcagcattcc

SEQ ID NO: 4424068 - DNA, 22 bp, Homo sapiens
ttaggaagttgacttatagtac

SEQ ID NO: 4424069 - DNA, 22 bp, Homo sapiens
ttaggatggggctcccagctcc

SEQ ID NO: 4424070 - DNA, 19 bp, Homo sapiens
ttaggcaaagataatttat

SEQ ID NO: 4424071 - DNA, 21 bp, Homo sapiens
ttaggcctggtgtgttcaaga

SEQ ID NO: 4424072 - DNA, 22 bp, Homo sapiens
ttaggcgcccatggtacaagga

SEQ ID NO: 4424073 - DNA, 17 bp, Homo sapiens
ttaggctgtaactactt

SEQ ID NO: 4424074 - DNA, 19 bp, Homo sapiens
ttaggctttgtatgacagt

SEQ ID NO: 4424075 - DNA, 22 bp, Homo sapiens
ttagggaaaatggatatagaaa

SEQ ID NO: 4424076 - DNA, 20 bp, Homo sapiens
ttaggggccaataaaatgta

SEQ ID NO: 4424077 - DNA, 19 bp, Homo sapiens
ttaggtcaaagttcataga

SEQ ID NO: 4424078 - DNA, 22 bp, Homo sapiens
ttaggtcaataacactgtattt

SEQ ID NO: 4424079 - DNA, 23 bp, Homo sapiens
ttaggtcaataacactgtatttt

SEQ ID NO: 4424080 - DNA, 13 bp, Homo sapiens
ttaggttgttacc

SEQ ID NO: 4424081 - DNA, 18 bp, Homo sapiens
ttagtaaatttctgtgat

SEQ ID NO: 4424082 - DNA, 23 bp, Homo sapiens
ttagtaacatgtgttaagtattt

SEQ ID NO: 4424083 - DNA, 22 bp, Homo sapiens
ttagtaacctttaaaaatgtat

SEQ ID NO: 4424084 - DNA, 14 bp, Homo sapiens
ttagtaatctgtat

SEQ ID NO: 4424085 - DNA, 12 bp, Homo sapiens
ttagtacaatag

SEQ ID NO: 4424086 - DNA, 22 bp, Homo sapiens
ttagtagaaatagtgataagtt

SEQ ID NO: 4424087 - DNA, 17 bp, Homo sapiens
ttagtagagacagagtt

SEQ ID NO: 4424088 - DNA, 15 bp, Homo sapiens
ttagtatagtagaaa

SEQ ID NO: 4424089 - DNA, 19 bp, Homo sapiens
ttagtatagtagaaagaca

SEQ ID NO: 4424090 - DNA, 13 bp, Homo sapiens
ttagtatcttttg

SEQ ID NO: 4424091 - DNA, 17 bp, Homo sapiens
ttagtccctcatgcaaa

SEQ ID NO: 4424092 - DNA, 23 bp, Homo sapiens
ttagtcctaaagggacaataact

SEQ ID NO: 4424093 - DNA, 21 bp, Homo sapiens
ttagtgaccattattcacagg

SEQ ID NO: 4424094 - DNA, 15 bp, Homo sapiens
ttagtgcaacttaga

SEQ ID NO: 4424095 - DNA, 15 bp, Homo sapiens
ttagtgtgtaaaatt

SEQ ID NO: 4424096 - DNA, 19 bp, Homo sapiens
ttagtgtgtaaaattaatg

SEQ ID NO: 4424097 - DNA, 13 bp, Homo sapiens
ttagttaccttat

SEQ ID NO: 4424098 - DNA, 19 bp, Homo sapiens
ttagttaccttatagttac

SEQ ID NO: 4424099 - DNA, 20 bp, Homo sapiens
ttagttccttactgtttaca

SEQ ID NO: 4424100 - DNA, 17 bp, Homo sapiens
ttagttcttgggggagg

SEQ ID NO: 4424101 - DNA, 23 bp, Homo sapiens
ttaaaaatcaactttttattgcc

SEQ ID NO: 4424102 - DNA, 16 bp, Homo sapiens
ttaaaaatgaaaatta

SEQ ID NO: 4424103 - DNA, 14 bp, Homo sapiens
ttaaaaatgtataa

SEQ ID NO: 4424104 - DNA, 18 bp, Homo sapiens
ttaaaacaaaacaaaaca

SEQ ID NO: 4424105 - DNA, 14 bp, Homo sapiens
ttaaaacagacact

SEQ ID NO: 4424106 - DNA, 15 bp, Homo sapiens
ttaaaactttgaagt

SEQ ID NO: 4424107 - DNA, 19 bp, Homo sapiens
ttaaaagaaatatacagtt

SEQ ID NO: 4424108 - DNA, 22 bp, Homo sapiens
ttaaaagaatattttaacttcc

SEQ ID NO: 4424109 - DNA, 13 bp, Homo sapiens
ttaaaagaatgac

SEQ ID NO: 4424110 - DNA, 18 bp, Homo sapiens
ttaaaagcatttttatta

SEQ ID NO: 4424111 - DNA, 19 bp, Homo sapiens
ttaaaagcatttttattat

SEQ ID NO: 4424112 - DNA, 13 bp, Homo sapiens
ttaaaagcctgct

SEQ ID NO: 4424113 - DNA, 21 bp, Homo sapiens
ttaaaagctatcttcatgtaa

SEQ ID NO: 4424114 - DNA, 15 bp, Homo sapiens
ttaaaagtaaaatgt

SEQ ID NO: 4424115 - DNA, 17 bp, Homo sapiens
ttaaaagtaaaatgtct

SEQ ID NO: 4424116 - DNA, 17 bp, Homo sapiens
ttaaaataaaatgaaaa

SEQ ID NO: 4424117 - DNA, 14 bp, Homo sapiens
ttaaaataaatggt

SEQ ID NO: 4424118 - DNA, 15 bp, Homo sapiens
ttaaaataattatat

SEQ ID NO: 4424119 - DNA, 15 bp, Homo sapiens
ttaaaataattcata

SEQ ID NO: 4424120 - DNA, 18 bp, Homo sapiens
ttaaaatacacactcaaa

SEQ ID NO: 4424121 - DNA, 19 bp, Homo sapiens
ttaaaatacacactcaaat

SEQ ID NO: 4424122 - DNA, 12 bp, Homo sapiens
ttaaaatagaaa

SEQ ID NO: 4424123 - DNA, 17 bp, Homo sapiens
ttaaaatagaaattttg

SEQ ID NO: 4424124 - DNA, 19 bp, Homo sapiens
ttaaaatagcaaaagaaga

SEQ ID NO: 4424125 - DNA, 16 bp, Homo sapiens
ttaaaatatatgaaga

SEQ ID NO: 4424126 - DNA, 20 bp, Homo sapiens
ttaaaatatatgaagacaat

SEQ ID NO: 4424127 - DNA, 17 bp, Homo sapiens
ttaaaatcactaacatt

SEQ ID NO: 4424128 - DNA, 20 bp, Homo sapiens
ttaaaatcactaacattata

SEQ ID NO: 4424129 - DNA, 22 bp, Homo sapiens
ttaaaatcatttctgcatcagc

SEQ ID NO: 4424130 - DNA, 15 bp, Homo sapiens
ttaaaatgaatctta

SEQ ID NO: 4424131 - DNA, 21 bp, Homo sapiens
ttaaaatggatgccttgaata

SEQ ID NO: 4424132 - DNA, 11 bp, Homo sapiens
ttaaaatgtga

SEQ ID NO: 4424133 - DNA, 18 bp, Homo sapiens
ttaaaattgtgatgtgtc

SEQ ID NO: 4424134 - DNA, 22 bp, Homo sapiens
ttaaaattgtgcataatgcttt

SEQ ID NO: 4424135 - DNA, 16 bp, Homo sapiens
ttaaaatttatttgca

SEQ ID NO: 4424136 - DNA, 17 bp, Homo sapiens
ttaaaatttatttgcaa

SEQ ID NO: 4424137 - DNA, 19 bp, Homo sapiens
ttaaaatttgttcttgtat

SEQ ID NO: 4424138 - DNA, 12 bp, Homo sapiens
ttaaaattttgg

SEQ ID NO: 4424139 - DNA, 23 bp, Homo sapiens
ttaaaattttggaatatttgctt

SEQ ID NO: 4424140 - DNA, 17 bp, Homo sapiens
ttaaacaaagtttcaga

SEQ ID NO: 4424141 - DNA, 12 bp, Homo sapiens
ttaaacaaataa

SEQ ID NO: 4424142 - DNA, 14 bp, Homo sapiens
ttaaacaatgatca

SEQ ID NO: 4424143 - DNA, 19 bp, Homo sapiens
ttaaacactacacatttga

SEQ ID NO: 4424144 - DNA, 18 bp, Homo sapiens
ttaaacatacataataca

SEQ ID NO: 4424145 - DNA, 12 bp, Homo sapiens
ttaaacattatt

SEQ ID NO: 4424146 - DNA, 13 bp, Homo sapiens
ttaaacattgaag

SEQ ID NO: 4424147 - DNA, 19 bp, Homo sapiens
ttaaaccagattggagcaa

SEQ ID NO: 4424148 - DNA, 16 bp, Homo sapiens
ttaaacccaaaatata

SEQ ID NO: 4424149 - DNA, 20 bp, Homo sapiens
ttaaacccatacaatgtatg

SEQ ID NO: 4424150 - DNA, 19 bp, Homo sapiens
ttaaaccctttagtgcttt

SEQ ID NO: 4424151 - DNA, 12 bp, Homo sapiens
ttaaaccttttt

SEQ ID NO: 4424152 - DNA, 22 bp, Homo sapiens
ttaaacggtgcccatcctgcca

SEQ ID NO: 4424153 - DNA, 14 bp, Homo sapiens
ttaaactagtttaa

SEQ ID NO: 4424154 - DNA, 16 bp, Homo sapiens
ttaaactagtttaagg

SEQ ID NO: 4424155 - DNA, 19 bp, Homo sapiens
ttaaactctggacactcta

SEQ ID NO: 4424156 - DNA, 20 bp, Homo sapiens
ttaaactctggacactctat

SEQ ID NO: 4424157 - DNA, 16 bp, Homo sapiens
ttaaactgaaagcttt

SEQ ID NO: 4424158 - DNA, 19 bp, Homo sapiens
ttaaactgtgtacataact

SEQ ID NO: 4424159 - DNA, 18 bp, Homo sapiens
ttaaacttccaaagaaag

SEQ ID NO: 4424160 - DNA, 20 bp, Homo sapiens
ttaaacttgaaatatataat

SEQ ID NO: 4424161 - DNA, 21 bp, Homo sapiens
ttaaacttgaaatatataata

SEQ ID NO: 4424162 - DNA, 14 bp, Homo sapiens
ttaaacttgtgaat

SEQ ID NO: 4424163 - DNA, 15 bp, Homo sapiens
ttaatgcattgttgt

SEQ ID NO: 4424164 - DNA, 19 bp, Homo sapiens
ttaatgcattgttgtaaag

SEQ ID NO: 4424165 - DNA, 22 bp, Homo sapiens
ttaatgcattgttgtaaagtat

SEQ ID NO: 4424166 - DNA, 19 bp, Homo sapiens
ttaatgcctgctttttgga

SEQ ID NO: 4424167 - DNA, 20 bp, Homo sapiens
ttaatgctatttgaacaagt

SEQ ID NO: 4424168 - DNA, 16 bp, Homo sapiens
ttaatggctgataatt

SEQ ID NO: 4424169 - DNA, 19 bp, Homo sapiens
ttaatggtagttttacagt

SEQ ID NO: 4424170 - DNA, 12 bp, Homo sapiens
ttaatggttttt

SEQ ID NO: 4424171 - DNA, 13 bp, Homo sapiens
ttaatgtaataaa

SEQ ID NO: 4424172 - DNA, 16 bp, Homo sapiens
ttaatgtaataaagtg

SEQ ID NO: 4424173 - DNA, 21 bp, Homo sapiens
ttaatgtaataaagtgaactt

SEQ ID NO: 4424174 - DNA, 19 bp, Homo sapiens
ttaatgtatagtaaatcac

SEQ ID NO: 4424175 - DNA, 17 bp, Homo sapiens
ttaatgtatataaaaat

SEQ ID NO: 4424176 - DNA, 18 bp, Homo sapiens
ttaatgtatctatttgta

SEQ ID NO: 4424177 - DNA, 20 bp, Homo sapiens
ttaatgtatctatttgtaca

SEQ ID NO: 4424178 - DNA, 22 bp, Homo sapiens
ttaatgtctcactttactttca

SEQ ID NO: 4424179 - DNA, 14 bp, Homo sapiens
ttaatgtgctctgt

SEQ ID NO: 4424180 - DNA, 20 bp, Homo sapiens
ttaatgtgctctgtacctgt

SEQ ID NO: 4424181 - DNA, 19 bp, Homo sapiens
ttaatgttgaatgctgctt

SEQ ID NO: 4424182 - DNA, 10 bp, Homo sapiens
ttaatgtttc

SEQ ID NO: 4424183 - DNA, 20 bp, Homo sapiens
ttaatgtttctgatttctga

SEQ ID NO: 4424184 - DNA, 12 bp, Homo sapiens
ttaatgttttta

SEQ ID NO: 4424185 - DNA, 14 bp, Homo sapiens
ttaattaaaaactt

SEQ ID NO: 4424186 - DNA, 12 bp, Homo sapiens
ttaattaaatat

SEQ ID NO: 4424187 - DNA, 14 bp, Homo sapiens
ttaattactggaat

SEQ ID NO: 4424188 - DNA, 22 bp, Homo sapiens
ttaattatgccttttttgatca

SEQ ID NO: 4424189 - DNA, 13 bp, Homo sapiens
ttaattcatttgg

SEQ ID NO: 4424190 - DNA, 15 bp, Homo sapiens
ttaattcttaaaact

SEQ ID NO: 4424191 - DNA, 12 bp, Homo sapiens
ttaattgtaaac

SEQ ID NO: 4424192 - DNA, 18 bp, Homo sapiens
ttaattgtaaactgtact

SEQ ID NO: 4424193 - DNA, 23 bp, Homo sapiens
ttaattgtgcaaaggataaattt

SEQ ID NO: 4424194 - DNA, 15 bp, Homo sapiens
ttaatttaattgctt

SEQ ID NO: 4424195 - DNA, 16 bp, Homo sapiens
ttaatttaattgcttt

SEQ ID NO: 4424196 - DNA, 15 bp, Homo sapiens
ttaatttagaaaact

SEQ ID NO: 4424197 - DNA, 16 bp, Homo sapiens
ttaatttagaaaactt

SEQ ID NO: 4424198 - DNA, 13 bp, Homo sapiens
ttaatttagtaaa

SEQ ID NO: 4424199 - DNA, 19 bp, Homo sapiens
ttaatttagtaaataaaca

SEQ ID NO: 4424200 - DNA, 16 bp, Homo sapiens
ttaatttataatgtat

SEQ ID NO: 4424201 - DNA, 20 bp, Homo sapiens
ttaatttataatgtatttga

SEQ ID NO: 4424202 - DNA, 22 bp, Homo sapiens
ttaatttataatgtatttgaaa

SEQ ID NO: 4424203 - DNA, 16 bp, Homo sapiens
ttaatttatcctctgt

SEQ ID NO: 4424204 - DNA, 12 bp, Homo sapiens
ttaatttcaaat

SEQ ID NO: 4424205 - DNA, 15 bp, Homo sapiens
ttaatttcaggaaaa

SEQ ID NO: 4424206 - DNA, 18 bp, Homo sapiens
ttaatttcaggaaaatgt

SEQ ID NO: 4424207 - DNA, 13 bp, Homo sapiens
ttaatttcagtcc

SEQ ID NO: 4424208 - DNA, 14 bp, Homo sapiens
ttaatttcagtcct

SEQ ID NO: 4424209 - DNA, 16 bp, Homo sapiens
ttaatttcatgtatat

SEQ ID NO: 4424210 - DNA, 11 bp, Homo sapiens
ttaatttcctt

SEQ ID NO: 4424211 - DNA, 13 bp, Homo sapiens
ttaatttcctttt

SEQ ID NO: 4424212 - DNA, 15 bp, Homo sapiens
ttaatttcctttttg

SEQ ID NO: 4424213 - DNA, 20 bp, Homo sapiens
ttaatttcctttttgacact

SEQ ID NO: 4424214 - DNA, 13 bp, Homo sapiens
ttaatttgtgtgt

SEQ ID NO: 4424215 - DNA, 17 bp, Homo sapiens
ttaattttattcaagaa

SEQ ID NO: 4424216 - DNA, 19 bp, Homo sapiens
ttaattttctctttgtatg

SEQ ID NO: 4424217 - DNA, 19 bp, Homo sapiens
ttaattttgaagtgctgtt

SEQ ID NO: 4424218 - DNA, 20 bp, Homo sapiens
ttaattttgacactgaaata

SEQ ID NO: 4424219 - DNA, 13 bp, Homo sapiens
ttaatttttccaa

SEQ ID NO: 4424220 - DNA, 18 bp, Homo sapiens
ttaatttttccaactact

SEQ ID NO: 4424221 - DNA, 12 bp, Homo sapiens
ttaatttttgat

SEQ ID NO: 4424222 - DNA, 13 bp, Homo sapiens
ttaatttttgata

SEQ ID NO: 4424223 - DNA, 15 bp, Homo sapiens
ttaatttttgctttt

SEQ ID NO: 4424224 - DNA, 20 bp, Homo sapiens
ttacaaaccattacctgtac

SEQ ID NO: 4424225 - DNA, 18 bp, Homo sapiens
ttacaaacctttgtttca

SEQ ID NO: 4424226 - DNA, 14 bp, Homo sapiens
ttacaaagcagtta

SEQ ID NO: 4424227 - DNA, 16 bp, Homo sapiens
ttacaaagcagttact

SEQ ID NO: 4424228 - DNA, 16 bp, Homo sapiens
ttacaaatattgtcat

SEQ ID NO: 4424229 - DNA, 22 bp, Homo sapiens
ttacaactgcctcgaaacacag

SEQ ID NO: 4424230 - DNA, 17 bp, Homo sapiens
tgttcccgtgcctggga

SEQ ID NO: 4424231 - DNA, 23 bp, Homo sapiens
tgttccctatttttctctcctgt

SEQ ID NO: 4424232 - DNA, 16 bp, Homo sapiens
tgttcccttgaccatt

SEQ ID NO: 4424233 - DNA, 17 bp, Homo sapiens
tgttccctttttcataa

SEQ ID NO: 4424234 - DNA, 15 bp, Homo sapiens
tgttcctcatgttgc

SEQ ID NO: 4424235 - DNA, 20 bp, Homo sapiens
tgttcctcatgttgctgaat

SEQ ID NO: 4424236 - DNA, 16 bp, Homo sapiens
tgttcctcccctgtag

SEQ ID NO: 4424237 - DNA, 12 bp, Homo sapiens
tgttcctgaagc

SEQ ID NO: 4424238 - DNA, 17 bp, Homo sapiens
tgttcctgaagctgctg

SEQ ID NO: 4424239 - DNA, 22 bp, Homo sapiens
tgttcctgaattctatttgctg

SEQ ID NO: 4424240 - DNA, 17 bp, Homo sapiens
tgttccttggcagtgga

SEQ ID NO: 4424241 - DNA, 20 bp, Homo sapiens
tgttcgcatggtcacacact

SEQ ID NO: 4424242 - DNA, 17 bp, Homo sapiens
tgttcgtttccatcatg

SEQ ID NO: 4424243 - DNA, 18 bp, Homo sapiens
tgttctaagactctgtgt

SEQ ID NO: 4424244 - DNA, 13 bp, Homo sapiens
tgttctaagtgcc

SEQ ID NO: 4424245 - DNA, 15 bp, Homo sapiens
tgttctaatggatta

SEQ ID NO: 4424246 - DNA, 16 bp, Homo sapiens
tgttctcaacatactg

SEQ ID NO: 4424247 - DNA, 23 bp, Homo sapiens
tgttctcaacatactgtaatcaa

SEQ ID NO: 4424248 - DNA, 17 bp, Homo sapiens
tgttctcatagaggaaa

SEQ ID NO: 4424249 - DNA, 21 bp, Homo sapiens
tgttctccagtcattatgtta

SEQ ID NO: 4424250 - DNA, 17 bp, Homo sapiens
tgttctccctttctctc

SEQ ID NO: 4424251 - DNA, 22 bp, Homo sapiens
tgttctccctttctctctcctc

SEQ ID NO: 4424252 - DNA, 21 bp, Homo sapiens
tgttctccgggtgtggcctca

SEQ ID NO: 4424253 - DNA, 23 bp, Homo sapiens
tgttctccgggtgtggcctcagc

SEQ ID NO: 4424254 - DNA, 12 bp, Homo sapiens
tgttctgagcac

SEQ ID NO: 4424255 - DNA, 22 bp, Homo sapiens
tgttctgctccataccttttct

SEQ ID NO: 4424256 - DNA, 18 bp, Homo sapiens
tgttctgggcatggcagg

SEQ ID NO: 4424257 - DNA, 13 bp, Homo sapiens
tgttctgggctgg

SEQ ID NO: 4424258 - DNA, 16 bp, Homo sapiens
tgttctgggtgatgga

SEQ ID NO: 4424259 - DNA, 23 bp, Homo sapiens
tgttctgtggttcctctgctcac

SEQ ID NO: 4424260 - DNA, 16 bp, Homo sapiens
tgttctgttcatttcc

SEQ ID NO: 4424261 - DNA, 22 bp, Homo sapiens
tgttctgttctcatagaggaaa

SEQ ID NO: 4424262 - DNA, 19 bp, Homo sapiens
tgttcttcgtaactttatg

SEQ ID NO: 4424263 - DNA, 16 bp, Homo sapiens
tgttcttgacaatcat

SEQ ID NO: 4424264 - DNA, 10 bp, Homo sapiens
tgttcttgta

SEQ ID NO: 4424265 - DNA, 14 bp, Homo sapiens
tgttcttgtattta

SEQ ID NO: 4424266 - DNA, 15 bp, Homo sapiens
tgttctttcctcaca

SEQ ID NO: 4424267 - DNA, 13 bp, Homo sapiens
tgttgaaaaaatt

SEQ ID NO: 4424268 - DNA, 18 bp, Homo sapiens
tgttgaaaaagataaaga

SEQ ID NO: 4424269 - DNA, 18 bp, Homo sapiens
tgttgaaaaagtttgttt

SEQ ID NO: 4424270 - DNA, 15 bp, Homo sapiens
tgttgaaaaccaaaa

SEQ ID NO: 4424271 - DNA, 24 bp, Homo sapiens
tgttgaaaggtaatttgagagaaa

SEQ ID NO: 4424272 - DNA, 18 bp, Homo sapiens
tgttgaaggaacttgtct

SEQ ID NO: 4424273 - DNA, 13 bp, Homo sapiens
tgttgaatacttt

SEQ ID NO: 4424274 - DNA, 16 bp, Homo sapiens
tgttgacatatttaat

SEQ ID NO: 4424275 - DNA, 18 bp, Homo sapiens
tgttgactggactgcttg

SEQ ID NO: 4424276 - DNA, 14 bp, Homo sapiens
tgttgactgtgatt

SEQ ID NO: 4424277 - DNA, 21 bp, Homo sapiens
tgttgataaaccaaaaacatt

SEQ ID NO: 4424278 - DNA, 22 bp, Homo sapiens
tgttgataaaccaaaaacattt

SEQ ID NO: 4424279 - DNA, 19 bp, Homo sapiens
tgttgatattgtttgctgt

SEQ ID NO: 4424280 - DNA, 17 bp, Homo sapiens
tgttgatcatgtacttt

SEQ ID NO: 4424281 - DNA, 20 bp, Homo sapiens
tgttgatcatgtacttttta

SEQ ID NO: 4424282 - DNA, 20 bp, Homo sapiens
tgttgattaatttctgccat

SEQ ID NO: 4424283 - DNA, 16 bp, Homo sapiens
tgttgcaagatgtgaa

SEQ ID NO: 4424284 - DNA, 17 bp, Homo sapiens
tgttgcaagatgtgaat

SEQ ID NO: 4424285 - DNA, 18 bp, Homo sapiens
tgttgcaagatgtgaatt

SEQ ID NO: 4424286 - DNA, 19 bp, Homo sapiens
tgttgcaagatgtgaatta

SEQ ID NO: 4424287 - DNA, 23 bp, Homo sapiens
tgttgcaagatgtgaattattga

SEQ ID NO: 4424288 - DNA, 17 bp, Homo sapiens
tgttgcaagtactgctg

SEQ ID NO: 4424289 - DNA, 19 bp, Homo sapiens
tgttgcaagtactgctgta

SEQ ID NO: 4424290 - DNA, 17 bp, Homo sapiens
tgttgcaccatctgctt

SEQ ID NO: 4424291 - DNA, 14 bp, Homo sapiens
tgttgcacccagcc

SEQ ID NO: 4424292 - DNA, 23 bp, Homo sapiens
tgttgcactgtttgcatgcgccc

SEQ ID NO: 4424293 - DNA, 14 bp, Homo sapiens
tgttgcatgtttga

SEQ ID NO: 4424294 - DNA, 18 bp, Homo sapiens
tgttgcattaattgtgct

SEQ ID NO: 4424295 - DNA, 17 bp, Homo sapiens
tgttgccaaagctggtc

SEQ ID NO: 4424296 - DNA, 12 bp, Homo sapiens
tgttgccctggg

SEQ ID NO: 4424297 - DNA, 17 bp, Homo sapiens
tgttgcctaattggaaa

SEQ ID NO: 4424298 - DNA, 17 bp, Homo sapiens
tgtgtcacagttcttgg

SEQ ID NO: 4424299 - DNA, 16 bp, Homo sapiens
tgtgtcagagcccagc

SEQ ID NO: 4424300 - DNA, 19 bp, Homo sapiens
tgtgtcagagcccagccca

SEQ ID NO: 4424301 - DNA, 23 bp, Homo sapiens
tgtgtcagcattcctattaatgt

SEQ ID NO: 4424302 - DNA, 23 bp, Homo sapiens
tgtgtcatactgtgcaggcctgt

SEQ ID NO: 4424303 - DNA, 17 bp, Homo sapiens
tgtgtccacgactgtct

SEQ ID NO: 4424304 - DNA, 22 bp, Homo sapiens
tgtgtcccccccaggccttgtc

SEQ ID NO: 4424305 - DNA, 18 bp, Homo sapiens
tgtgtccccctctgtcca

SEQ ID NO: 4424306 - DNA, 21 bp, Homo sapiens
tgtgtccccctctgtccaggc

SEQ ID NO: 4424307 - DNA, 14 bp, Homo sapiens
tgtgtcccctcact

SEQ ID NO: 4424308 - DNA, 17 bp, Homo sapiens
tgtgtcccctcactctg

SEQ ID NO: 4424309 - DNA, 17 bp, Homo sapiens
tgtgtcccttggtcctg

SEQ ID NO: 4424310 - DNA, 19 bp, Homo sapiens
tgtgtcctgtgtaaattag

SEQ ID NO: 4424311 - DNA, 20 bp, Homo sapiens
tgtgtccttgcacctgcatc

SEQ ID NO: 4424312 - DNA, 20 bp, Homo sapiens
tgtgtctaggcaggacctgt

SEQ ID NO: 4424313 - DNA, 15 bp, Homo sapiens
tgtgtctaggcaggc

SEQ ID NO: 4424314 - DNA, 21 bp, Homo sapiens
tgtgtctcaggctcaagtttt

SEQ ID NO: 4424315 - DNA, 22 bp, Homo sapiens
tgtgtctggcgttctcaagaat

SEQ ID NO: 4424316 - DNA, 22 bp, Homo sapiens
tgtgtctgtgccctccaaagag

SEQ ID NO: 4424317 - DNA, 15 bp, Homo sapiens
tgtgtctgtgttgct

SEQ ID NO: 4424318 - DNA, 12 bp, Homo sapiens
tgtgtgaatgaa

SEQ ID NO: 4424319 - DNA, 17 bp, Homo sapiens
tgtgtgaggagctgctg

SEQ ID NO: 4424320 - DNA, 20 bp, Homo sapiens
tgtgtgaggagctgctggct

SEQ ID NO: 4424321 - DNA, 16 bp, Homo sapiens
tgtgtgccaagagcta

SEQ ID NO: 4424322 - DNA, 12 bp, Homo sapiens
tgtgtgccctgg

SEQ ID NO: 4424323 - DNA, 13 bp, Homo sapiens
tgtgtgccctgga

SEQ ID NO: 4424324 - DNA, 20 bp, Homo sapiens
tgtgtgctttttttgtgtgt

SEQ ID NO: 4424325 - DNA, 15 bp, Homo sapiens
tgtgtggccggcctc

SEQ ID NO: 4424326 - DNA, 19 bp, Homo sapiens
tgtgtggccggcctcctcc

SEQ ID NO: 4424327 - DNA, 19 bp, Homo sapiens
tgtgtgggtgtatgtatgt

SEQ ID NO: 4424328 - DNA, 14 bp, Homo sapiens
tgtgtggtcaacat

SEQ ID NO: 4424329 - DNA, 20 bp, Homo sapiens
tgtgtgtatttgctaatttt

SEQ ID NO: 4424330 - DNA, 14 bp, Homo sapiens
tgtgtgtgtatgtg

SEQ ID NO: 4424331 - DNA, 14 bp, Homo sapiens
tgtgtgtgtgcaca

SEQ ID NO: 4424332 - DNA, 14 bp, Homo sapiens
tgtgtgtgtgttca

SEQ ID NO: 4424333 - DNA, 14 bp, Homo sapiens
tgtgtgtgtgtttg

SEQ ID NO: 4424334 - DNA, 22 bp, Homo sapiens
tgtgtgttggctttgcagctgc

SEQ ID NO: 4424335 - DNA, 23 bp, Homo sapiens
tgtgtgttggctttgcagctgct

SEQ ID NO: 4424336 - DNA, 19 bp, Homo sapiens
tgtgtgtttcaaggtcaga

SEQ ID NO: 4424337 - DNA, 15 bp, Homo sapiens
tgtgtgtttctgtcc

SEQ ID NO: 4424338 - DNA, 19 bp, Homo sapiens
tgtgttaatcttaatgtat

SEQ ID NO: 4424339 - DNA, 14 bp, Homo sapiens
tgtgttacattatt

SEQ ID NO: 4424340 - DNA, 15 bp, Homo sapiens
tgtgttacattattc

SEQ ID NO: 4424341 - DNA, 17 bp, Homo sapiens
tgctggggaagaacagc

SEQ ID NO: 4424342 - DNA, 21 bp, Homo sapiens
tgctggggaagaacagccccg

SEQ ID NO: 4424343 - DNA, 23 bp, Homo sapiens
tgctggggaagaacagccccggg

SEQ ID NO: 4424344 - DNA, 11 bp, Homo sapiens
tgctggggaca

SEQ ID NO: 4424345 - DNA, 14 bp, Homo sapiens
tgctggggacacag

SEQ ID NO: 4424346 - DNA, 23 bp, Homo sapiens
tgctggggacggggggccccagt

SEQ ID NO: 4424347 - DNA, 14 bp, Homo sapiens
tgctggtagagacc

SEQ ID NO: 4424348 - DNA, 14 bp, Homo sapiens
tgctggtcagagag

SEQ ID NO: 4424349 - DNA, 19 bp, Homo sapiens
tgctggtcccggggccagc

SEQ ID NO: 4424350 - DNA, 20 bp, Homo sapiens
tgctggttttatctgagtga

SEQ ID NO: 4424351 - DNA, 18 bp, Homo sapiens
tgctggtttttcagtttt

SEQ ID NO: 4424352 - DNA, 21 bp, Homo sapiens
tgctgtacatctattttggat

SEQ ID NO: 4424353 - DNA, 15 bp, Homo sapiens
tgctgtagacatttg

SEQ ID NO: 4424354 - DNA, 17 bp, Homo sapiens
tgctgtatttctttgta

SEQ ID NO: 4424355 - DNA, 19 bp, Homo sapiens
tgctgtattttgatataat

SEQ ID NO: 4424356 - DNA, 14 bp, Homo sapiens
tgctgtatttttac

SEQ ID NO: 4424357 - DNA, 15 bp, Homo sapiens
tgctgtatttttaca

SEQ ID NO: 4424358 - DNA, 16 bp, Homo sapiens
tgctgtcaacttccca

SEQ ID NO: 4424359 - DNA, 20 bp, Homo sapiens
tgctgtcaagttcctttggg

SEQ ID NO: 4424360 - DNA, 15 bp, Homo sapiens
tgctgtccagacagc

SEQ ID NO: 4424361 - DNA, 17 bp, Homo sapiens
tgctgtccccactgccc

SEQ ID NO: 4424362 - DNA, 18 bp, Homo sapiens
tgctgtccccactgcccc

SEQ ID NO: 4424363 - DNA, 22 bp, Homo sapiens
tgctgtcctgtttctgtcaagc

SEQ ID NO: 4424364 - DNA, 19 bp, Homo sapiens
tgctgtctgatctgtgctt

SEQ ID NO: 4424365 - DNA, 13 bp, Homo sapiens
tgctgtcttaaac

SEQ ID NO: 4424366 - DNA, 10 bp, Homo sapiens
tgctgtgggc

SEQ ID NO: 4424367 - DNA, 17 bp, Homo sapiens
tgctgtggtgtgtcccc

SEQ ID NO: 4424368 - DNA, 16 bp, Homo sapiens
tgctgtgtgtgagcag

SEQ ID NO: 4424369 - DNA, 20 bp, Homo sapiens
tgctgtgtgtgagcagtgga

SEQ ID NO: 4424370 - DNA, 21 bp, Homo sapiens
tgctgttacgtttgaagtctg

SEQ ID NO: 4424371 - DNA, 22 bp, Homo sapiens
tgctgttactgcttctctttgt

SEQ ID NO: 4424372 - DNA, 18 bp, Homo sapiens
tgctgttagttataaaac

SEQ ID NO: 4424373 - DNA, 20 bp, Homo sapiens
tgctgttcatcttgtacaaa

SEQ ID NO: 4424374 - DNA, 14 bp, Homo sapiens
tgctgttccagtgg

SEQ ID NO: 4424375 - DNA, 15 bp, Homo sapiens
tgctgttgacatatt

SEQ ID NO: 4424376 - DNA, 14 bp, Homo sapiens
tgctgttgcctcat

SEQ ID NO: 4424377 - DNA, 23 bp, Homo sapiens
tgctgtttaaagtcacatccctg

SEQ ID NO: 4424378 - DNA, 14 bp, Homo sapiens
tgctgtttattaat

SEQ ID NO: 4424379 - DNA, 14 bp, Homo sapiens
tgctgtttgaaaat

SEQ ID NO: 4424380 - DNA, 21 bp, Homo sapiens
tgctgtttgtagtgaaataat

SEQ ID NO: 4424381 - DNA, 14 bp, Homo sapiens
tgctgttttctgta

SEQ ID NO: 4424382 - DNA, 15 bp, Homo sapiens
tgctgttttctgtaa

SEQ ID NO: 4424383 - DNA, 18 bp, Homo sapiens
tgcttaaaaaataataca

SEQ ID NO: 4424384 - DNA, 20 bp, Homo sapiens
tgcttaaaaaataatacaac

SEQ ID NO: 4424385 - DNA, 22 bp, Homo sapiens
tgcttaaaagcatttttattat

SEQ ID NO: 4424386 - DNA, 23 bp, Homo sapiens
tgcttaaaatatgtgaagttttc

SEQ ID NO: 4424387 - DNA, 15 bp, Homo sapiens
tgcttaataaacatg

SEQ ID NO: 4424388 - DNA, 17 bp, Homo sapiens
tgcttacctaatttcat

SEQ ID NO: 4424389 - DNA, 19 bp, Homo sapiens
tgcttacctactttcttca

SEQ ID NO: 4424390 - DNA, 13 bp, Homo sapiens
tgcttagtaaaat

SEQ ID NO: 4424391 - DNA, 13 bp, Homo sapiens
tgcttattgatat

SEQ ID NO: 4424392 - DNA, 15 bp, Homo sapiens
tgcttattgtgtgtt

SEQ ID NO: 4424393 - DNA, 16 bp, Homo sapiens
tgcttcaatttcaaac

SEQ ID NO: 4424394 - DNA, 17 bp, Homo sapiens
tgcttcaatttcaaact

SEQ ID NO: 4424395 - DNA, 18 bp, Homo sapiens
tgcttcattctttgcagg

SEQ ID NO: 4424396 - DNA, 12 bp, Homo sapiens
tgcttccagtgt

SEQ ID NO: 4424397 - DNA, 17 bp, Homo sapiens
tgcttcccattgtggct

SEQ ID NO: 4424398 - DNA, 15 bp, Homo sapiens
tgcttccccgtgcat

SEQ ID NO: 4424399 - DNA, 13 bp, Homo sapiens
tgcttcctgatta

SEQ ID NO: 4424400 - DNA, 13 bp, Homo sapiens
tgcttcgggccct

SEQ ID NO: 4424401 - DNA, 18 bp, Homo sapiens
tgcttcgggcccttccca

SEQ ID NO: 4424402 - DNA, 18 bp, Homo sapiens
tgcttctaaatgcccagt

SEQ ID NO: 4424403 - DNA, 14 bp, Homo sapiens
tgcttctactttca

SEQ ID NO: 4424404 - DNA, 18 bp, Homo sapiens
tgcttctagttctgccag

SEQ ID NO: 4424405 - DNA, 21 bp, Homo sapiens
tgcttctcagatttctgagga

SEQ ID NO: 4424406 - DNA, 19 bp, Homo sapiens
tgcttctcatcttgtgaaa

SEQ ID NO: 4424407 - DNA, 22 bp, Homo sapiens
tgcttctccaaaaatctgcctg

SEQ ID NO: 4424408 - DNA, 15 bp, Homo sapiens
tgcttctccccagaa

SEQ ID NO: 4424409 - DNA, 14 bp, Homo sapiens
tgcttctctttgtg

SEQ ID NO: 4424410 - DNA, 13 bp, Homo sapiens
tgcttctgcagca

SEQ ID NO: 4424411 - DNA, 17 bp, Homo sapiens
tgcttctgcagcaactc

SEQ ID NO: 4424412 - DNA, 21 bp, Homo sapiens
tgcttctgcagcaactcccac

SEQ ID NO: 4424413 - DNA, 15 bp, Homo sapiens
tgcttcttcagctga

SEQ ID NO: 4424414 - DNA, 14 bp, Homo sapiens
tgcttcttggagct

SEQ ID NO: 4424415 - DNA, 14 bp, Homo sapiens
tgcttcttgtgttt

SEQ ID NO: 4424416 - DNA, 16 bp, Homo sapiens
tgcttcttgtgtttta

SEQ ID NO: 4424417 - DNA, 14 bp, Homo sapiens
tgcttctttccaga

SEQ ID NO: 4424418 - DNA, 14 bp, Homo sapiens
tgcttgaacacagt

SEQ ID NO: 4424419 - DNA, 15 bp, Homo sapiens
tgcttgacataccta

SEQ ID NO: 4424420 - DNA, 14 bp, Homo sapiens
tgcttgagctcagg

SEQ ID NO: 4424421 - DNA, 12 bp, Homo sapiens
tgcttgaggaaa

SEQ ID NO: 4424422 - DNA, 16 bp, Homo sapiens
tgcttgaggaaaacaa

SEQ ID NO: 4424423 - DNA, 15 bp, Homo sapiens
tgcttgatccagaag

SEQ ID NO: 4424424 - DNA, 12 bp, Homo sapiens
tgcttgatctat

SEQ ID NO: 4424425 - DNA, 14 bp, Homo sapiens
tgcttgatctatct

SEQ ID NO: 4424426 - DNA, 12 bp, Homo sapiens
tgcttgattttt

SEQ ID NO: 4424427 - DNA, 20 bp, Homo sapiens
tgcttgcaatctaatctgaa

SEQ ID NO: 4424428 - DNA, 17 bp, Homo sapiens
tgcttgcataagagctt

SEQ ID NO: 4424429 - DNA, 14 bp, Homo sapiens
tgcttgccaaagta

SEQ ID NO: 4424430 - DNA, 15 bp, Homo sapiens
tgcttgccaaagtac

SEQ ID NO: 4424431 - DNA, 15 bp, Homo sapiens
tgcttgccctccaaa

SEQ ID NO: 4424432 - DNA, 21 bp, Homo sapiens
tgcttgccctccaaatgtcct

SEQ ID NO: 4424433 - DNA, 12 bp, Homo sapiens
tgcttgcctgaa

SEQ ID NO: 4424434 - DNA, 14 bp, Homo sapiens
tgcttgcctgaagc

SEQ ID NO: 4424435 - DNA, 15 bp, Homo sapiens
tgcttgcctgaagct

SEQ ID NO: 4424436 - DNA, 17 bp, Homo sapiens
tgcttgcggcaaaagga

SEQ ID NO: 4424437 - DNA, 19 bp, Homo sapiens
tgcttgcggcaaaaggaaa

SEQ ID NO: 4424438 - DNA, 13 bp, Homo sapiens
tgcttgctcccca

SEQ ID NO: 4424439 - DNA, 15 bp, Homo sapiens
tgcttggagcaatca

SEQ ID NO: 4424440 - DNA, 17 bp, Homo sapiens
tgcttggagcaatcaga

SEQ ID NO: 4424441 - DNA, 17 bp, Homo sapiens
tgcttgggaccagaagt

SEQ ID NO: 4424442 - DNA, 15 bp, Homo sapiens
tgcttgggctccacg

SEQ ID NO: 4424443 - DNA, 18 bp, Homo sapiens
tgcttgtattgtaaatgt

SEQ ID NO: 4424444 - DNA, 14 bp, Homo sapiens
tgcttgttggattt

SEQ ID NO: 4424445 - DNA, 20 bp, Homo sapiens
tgcttgtttatgatatttct

SEQ ID NO: 4424446 - DNA, 12 bp, Homo sapiens
tgctttaatgag

SEQ ID NO: 4424447 - DNA, 14 bp, Homo sapiens
tgctttattccaga

SEQ ID NO: 4424448 - DNA, 18 bp, Homo sapiens
tgctttattgaattagaa

SEQ ID NO: 4424449 - DNA, 19 bp, Homo sapiens
tgctttcaattacaaagca

SEQ ID NO: 4424450 - DNA, 23 bp, Homo sapiens
tgctttcaccagaatttctaaga

SEQ ID NO: 4424451 - DNA, 22 bp, Homo sapiens
tgctttcctaaagtctctgctg

SEQ ID NO: 4424452 - DNA, 15 bp, Homo sapiens
tgctttcctgggcct

SEQ ID NO: 4424453 - DNA, 18 bp, Homo sapiens
tgctttctattgtacaga

SEQ ID NO: 4424454 - DNA, 22 bp, Homo sapiens
tgctttctcctttaattgtaaa

SEQ ID NO: 4424455 - DNA, 16 bp, Homo sapiens
tgctttctctctagta

SEQ ID NO: 4424456 - DNA, 13 bp, Homo sapiens
tgctttctctctc

SEQ ID NO: 4424457 - DNA, 14 bp, Homo sapiens
tgctttgaaaaatc

SEQ ID NO: 4424458 - DNA, 13 bp, Homo sapiens
tgctttgaacttt

SEQ ID NO: 4424459 - DNA, 16 bp, Homo sapiens
tgctttgcatctttgt

SEQ ID NO: 4424460 - DNA, 13 bp, Homo sapiens
tgctttgccaaaa

SEQ ID NO: 4424461 - DNA, 13 bp, Homo sapiens
tgctttgggaact

SEQ ID NO: 4424462 - DNA, 11 bp, Homo sapiens
tgctttgtagg

SEQ ID NO: 4424463 - DNA, 12 bp, Homo sapiens
tgctttgtattg

SEQ ID NO: 4424464 - DNA, 17 bp, Homo sapiens
tgcttttaactctagaa

SEQ ID NO: 4424465 - DNA, 19 bp, Homo sapiens
tgcttttagtgtgtgcata

SEQ ID NO: 4424466 - DNA, 23 bp, Homo sapiens
tgcttttcaccaaaatttctaca

SEQ ID NO: 4424467 - DNA, 17 bp, Homo sapiens
tgcttttcactttctgt

SEQ ID NO: 4424468 - DNA, 17 bp, Homo sapiens
tgcttttccctttgtga

SEQ ID NO: 4424469 - DNA, 15 bp, Homo sapiens
tgcttttcctctgcc

SEQ ID NO: 4424470 - DNA, 16 bp, Homo sapiens
tgcttttctgccctgg

SEQ ID NO: 4424471 - DNA, 17 bp, Homo sapiens
tgcttttctgtatttta

SEQ ID NO: 4424472 - DNA, 20 bp, Homo sapiens
tgcttttgaaggaatacaat

SEQ ID NO: 4424473 - DNA, 16 bp, Homo sapiens
tgcttttggggaatga

SEQ ID NO: 4424474 - DNA, 23 bp, Homo sapiens
tgctttttaaagagattatttgt

SEQ ID NO: 4424475 - DNA, 16 bp, Homo sapiens
tgctttttataaaaag

SEQ ID NO: 4424476 - DNA, 21 bp, Homo sapiens
tgctttttccaactcagaaat

SEQ ID NO: 4424477 - DNA, 21 bp, Homo sapiens
tgctttttccccattggaact

SEQ ID NO: 4424478 - DNA, 13 bp, Homo sapiens
tgctttttctgta

SEQ ID NO: 4424479 - DNA, 13 bp, Homo sapiens
tgctttttggtga

SEQ ID NO: 4424480 - DNA, 19 bp, Homo sapiens
tgcttttttccaaaacaaa

SEQ ID NO: 4424481 - DNA, 20 bp, Homo sapiens
tgcttttttccaaaacaaaa

SEQ ID NO: 4424482 - DNA, 13 bp, Homo sapiens
tggaaaaaatatt

SEQ ID NO: 4424483 - DNA, 13 bp, Homo sapiens
tggaaaaatcttt

SEQ ID NO: 4424484 - DNA, 16 bp, Homo sapiens
tggaaaacaaaagttt

SEQ ID NO: 4424485 - DNA, 15 bp, Homo sapiens
tggaaaactgtgttg

SEQ ID NO: 4424486 - DNA, 12 bp, Homo sapiens
tggaaaagacag

SEQ ID NO: 4424487 - DNA, 23 bp, Homo sapiens
tggaaaataagacaatagtattt

SEQ ID NO: 4424488 - DNA, 17 bp, Homo sapiens
tggaaacaaaacagaag

SEQ ID NO: 4424489 - DNA, 16 bp, Homo sapiens
tggaaaccttccaccc

SEQ ID NO: 4424490 - DNA, 18 bp, Homo sapiens
tggaaactatgtgttttt

SEQ ID NO: 4424491 - DNA, 14 bp, Homo sapiens
tggaaagaggctct

SEQ ID NO: 4424492 - DNA, 20 bp, Homo sapiens
tggaaagagtgttggtgttg

SEQ ID NO: 4424493 - DNA, 18 bp, Homo sapiens
tggaaaggcctcttctca

SEQ ID NO: 4424494 - DNA, 22 bp, Homo sapiens
tggaaaggggagagcctgctgg

SEQ ID NO: 4424495 - DNA, 13 bp, Homo sapiens
tggaaagtcagaa

SEQ ID NO: 4424496 - DNA, 14 bp, Homo sapiens
tggaaataaaagat

SEQ ID NO: 4424497 - DNA, 16 bp, Homo sapiens
tggaaataaaagataa

SEQ ID NO: 4424498 - DNA, 16 bp, Homo sapiens
tggaaataaactgtgc

SEQ ID NO: 4424499 - DNA, 17 bp, Homo sapiens
tggaaataaactgtgca

SEQ ID NO: 4424500 - DNA, 14 bp, Homo sapiens
tggaaataaagtca

SEQ ID NO: 4424501 - DNA, 16 bp, Homo sapiens
tggaaataaagtcaga

SEQ ID NO: 4424502 - DNA, 21 bp, Homo sapiens
tggaaatacagttatttcatc

SEQ ID NO: 4424503 - DNA, 21 bp, Homo sapiens
tggaaatagaaagaagccata

SEQ ID NO: 4424504 - DNA, 16 bp, Homo sapiens
tggaaatattaagaac

SEQ ID NO: 4424505 - DNA, 20 bp, Homo sapiens
tggaaatcctgccctggagg

SEQ ID NO: 4424506 - DNA, 15 bp, Homo sapiens
tggaaatcttttaca

SEQ ID NO: 4424507 - DNA, 16 bp, Homo sapiens
tggaaatgtagcactt

SEQ ID NO: 4424508 - DNA, 15 bp, Homo sapiens
tggaacaacttgtag

SEQ ID NO: 4424509 - DNA, 15 bp, Homo sapiens
tggaacacaggggcc

SEQ ID NO: 4424510 - DNA, 14 bp, Homo sapiens
tggaacaccttggg

SEQ ID NO: 4424511 - DNA, 13 bp, Homo sapiens
tggaaccagcccc

SEQ ID NO: 4424512 - DNA, 14 bp, Homo sapiens
tggaaccagcccca

SEQ ID NO: 4424513 - DNA, 14 bp, Homo sapiens
tggaacgcagttga

SEQ ID NO: 4424514 - DNA, 17 bp, Homo sapiens
tggaactcctggccttt

SEQ ID NO: 4424515 - DNA, 12 bp, Homo sapiens
tggaactgtccc

SEQ ID NO: 4424516 - DNA, 13 bp, Homo sapiens
tggaactgtccca

SEQ ID NO: 4424517 - DNA, 17 bp, Homo sapiens
tggaactgtcccagcta

SEQ ID NO: 4424518 - DNA, 14 bp, Homo sapiens
tggaacttagccat

SEQ ID NO: 4424519 - DNA, 21 bp, Homo sapiens
tggaagaaaaggattttggaa

SEQ ID NO: 4424520 - DNA, 12 bp, Homo sapiens
tggaagaaacac

SEQ ID NO: 4424521 - DNA, 14 bp, Homo sapiens
tggaagaaagtaag

SEQ ID NO: 4424522 - DNA, 12 bp, Homo sapiens
tggaagaaggga

SEQ ID NO: 4424523 - DNA, 19 bp, Homo sapiens
tggaagaagggagaagaaa

SEQ ID NO: 4424524 - DNA, 14 bp, Homo sapiens
tggaagatagctgt

SEQ ID NO: 4424525 - DNA, 16 bp, Homo sapiens
tggaagatagctgtga

SEQ ID NO: 4424526 - DNA, 16 bp, Homo sapiens
tggaagatcatggacc

SEQ ID NO: 4424527 - DNA, 15 bp, Homo sapiens
tggaagcagaggccc

SEQ ID NO: 4424528 - DNA, 19 bp, Homo sapiens
tggaagcatgtaggagaat

SEQ ID NO: 4424529 - DNA, 20 bp, Homo sapiens
tggaagccctcaaagaagtc

SEQ ID NO: 4424530 - DNA, 15 bp, Homo sapiens
tggaagccctccttc

SEQ ID NO: 4424531 - DNA, 14 bp, Homo sapiens
tggaagctcttctt

SEQ ID NO: 4424532 - DNA, 15 bp, Homo sapiens
tggaagctgtgtcct

SEQ ID NO: 4424533 - DNA, 16 bp, Homo sapiens
tggaagctgtgtcctt

SEQ ID NO: 4424534 - DNA, 18 bp, Homo sapiens
tggaagctgtttggaaaa

SEQ ID NO: 4424535 - DNA, 20 bp, Homo sapiens
tggaaggaacatggagctgt

SEQ ID NO: 4424536 - DNA, 14 bp, Homo sapiens
tggaaggagggatg

SEQ ID NO: 4424537 - DNA, 15 bp, Homo sapiens
tggaaggagggatgc

SEQ ID NO: 4424538 - DNA, 17 bp, Homo sapiens
tggaaggcagagaaatc

SEQ ID NO: 4424539 - DNA, 15 bp, Homo sapiens
tggaaggcagcaggc

SEQ ID NO: 4424540 - DNA, 23 bp, Homo sapiens
tggaagtaattaaggtacatcat

SEQ ID NO: 4424541 - DNA, 17 bp, Homo sapiens
tggaagtggattgtttt

SEQ ID NO: 4424542 - DNA, 13 bp, Homo sapiens
tggaagtgtgggt

SEQ ID NO: 4424543 - DNA, 20 bp, Homo sapiens
tggaagtgtgggtctgtgtg

SEQ ID NO: 4424544 - DNA, 13 bp, Homo sapiens
tggaataaagatg

SEQ ID NO: 4424545 - DNA, 16 bp, Homo sapiens
tggaataaagttgcag

SEQ ID NO: 4424546 - DNA, 23 bp, Homo sapiens
tggaataaattatggcatttcta

SEQ ID NO: 4424547 - DNA, 15 bp, Homo sapiens
tggaataagttcaaa

SEQ ID NO: 4424548 - DNA, 21 bp, Homo sapiens
tggaataatacatactaatga

SEQ ID NO: 4424549 - DNA, 13 bp, Homo sapiens
tggaatacttttt

SEQ ID NO: 4424550 - DNA, 14 bp, Homo sapiens
tggaatataaggaa

SEQ ID NO: 4424551 - DNA, 21 bp, Homo sapiens
tggaatataaggaaagcaata

SEQ ID NO: 4424552 - DNA, 22 bp, Homo sapiens
tggaatataattgttttatctg

SEQ ID NO: 4424553 - DNA, 22 bp, Homo sapiens
tggaatatcatctgtcattata

SEQ ID NO: 4424554 - DNA, 16 bp, Homo sapiens
tggaatattttatcct

SEQ ID NO: 4424555 - DNA, 18 bp, Homo sapiens
tggaatattttatcctgt

SEQ ID NO: 4424556 - DNA, 22 bp, Homo sapiens
tggaatcgaagtgtttatgtaa

SEQ ID NO: 4424557 - DNA, 16 bp, Homo sapiens
tggaatctacaagcca

SEQ ID NO: 4424558 - DNA, 15 bp, Homo sapiens
tggaatctggagagc

SEQ ID NO: 4424559 - DNA, 21 bp, Homo sapiens
tggaatgattggttaaaatgt

SEQ ID NO: 4424560 - DNA, 13 bp, Homo sapiens
tggaatgccttgg

SEQ ID NO: 4424561 - DNA, 19 bp, Homo sapiens
tggaatgtgccacagaggc

SEQ ID NO: 4424562 - DNA, 16 bp, Homo sapiens
tggaattcagcagttt

SEQ ID NO: 4424563 - DNA, 20 bp, Homo sapiens
tggaattctactggaaaaaa

SEQ ID NO: 4424564 - DNA, 15 bp, Homo sapiens
tggaattgatttgca

SEQ ID NO: 4424565 - DNA, 16 bp, Homo sapiens
tggaattgatttgcat

SEQ ID NO: 4424566 - DNA, 18 bp, Homo sapiens
tggaattttctaatataa

SEQ ID NO: 4424567 - DNA, 17 bp, Homo sapiens
tggaattttgagaaaaa

SEQ ID NO: 4424568 - DNA, 18 bp, Homo sapiens
tggaattttgagaaaaat

SEQ ID NO: 4424569 - DNA, 20 bp, Homo sapiens
tggacaaagaattccaaagc

SEQ ID NO: 4424570 - DNA, 13 bp, Homo sapiens
tggacaaggaggt

SEQ ID NO: 4424571 - DNA, 20 bp, Homo sapiens
tggacacgagccacaagctg

SEQ ID NO: 4424572 - DNA, 15 bp, Homo sapiens
tggacagaaaatgca

SEQ ID NO: 4424573 - DNA, 18 bp, Homo sapiens
tggacagaaaatgcaatg

SEQ ID NO: 4424574 - DNA, 18 bp, Homo sapiens
tggacagctgataaattt

SEQ ID NO: 4424575 - DNA, 20 bp, Homo sapiens
tggacaggatgaggacagag

SEQ ID NO: 4424576 - DNA, 21 bp, Homo sapiens
tggacaggatgaggacagagg

SEQ ID NO: 4424577 - DNA, 15 bp, Homo sapiens
tggacaggcgggctc

SEQ ID NO: 4424578 - DNA, 21 bp, Homo sapiens
tggacaggcgggctcggaggc

SEQ ID NO: 4424579 - DNA, 22 bp, Homo sapiens
tggacagtacctgattgtattt

SEQ ID NO: 4424580 - DNA, 17 bp, Homo sapiens
tggacatcaccagtcct

SEQ ID NO: 4424581 - DNA, 21 bp, Homo sapiens
tggacatgaagattctttccc

SEQ ID NO: 4424582 - DNA, 17 bp, Homo sapiens
tggacatttagaagaaa

SEQ ID NO: 4424583 - DNA, 16 bp, Homo sapiens
tggaccaacctgctct

SEQ ID NO: 4424584 - DNA, 18 bp, Homo sapiens
tggaccaacctgctctgt

SEQ ID NO: 4424585 - DNA, 19 bp, Homo sapiens
tggaccaattattgatata

SEQ ID NO: 4424586 - DNA, 20 bp, Homo sapiens
tggaccaattattgatatat

SEQ ID NO: 4424587 - DNA, 21 bp, Homo sapiens
tggaccaggaggattgccttt

SEQ ID NO: 4424588 - DNA, 23 bp, Homo sapiens
tggaccatgccagattctgcctc

SEQ ID NO: 4424589 - DNA, 22 bp, Homo sapiens
tggacccacctgtggggcctgg

SEQ ID NO: 4424590 - DNA, 13 bp, Homo sapiens
tggaccccagcat

SEQ ID NO: 4424591 - DNA, 12 bp, Homo sapiens
tggacctcagca

SEQ ID NO: 4424592 - DNA, 17 bp, Homo sapiens
tggacctcagcaagctg

SEQ ID NO: 4424593 - DNA, 21 bp, Homo sapiens
tggacctctatcatctgctaa

SEQ ID NO: 4424594 - DNA, 22 bp, Homo sapiens
tggacctttcctgaggaagagg

SEQ ID NO: 4424595 - DNA, 19 bp, Homo sapiens
tggacgctgcagaccccag

SEQ ID NO: 4424596 - DNA, 18 bp, Homo sapiens
tggacggcaggctcactg

SEQ ID NO: 4424597 - DNA, 15 bp, Homo sapiens
tggactacacaatac

SEQ ID NO: 4424598 - DNA, 22 bp, Homo sapiens
tggactacacaatacagtatta

SEQ ID NO: 4424599 - DNA, 22 bp, Homo sapiens
tggactccagcctgcctggcag

SEQ ID NO: 4424600 - DNA, 20 bp, Homo sapiens
tggactccggaggactgagc

SEQ ID NO: 4424601 - DNA, 22 bp, Homo sapiens
tggactccggaggactgagccc

SEQ ID NO: 4424602 - DNA, 23 bp, Homo sapiens
tggactccggaggactgagcccc

SEQ ID NO: 4424603 - DNA, 12 bp, Homo sapiens
tggactctcagg

SEQ ID NO: 4424604 - DNA, 12 bp, Homo sapiens
tggactctctgt

SEQ ID NO: 4424605 - DNA, 15 bp, Homo sapiens
tggactctctgtggt

SEQ ID NO: 4424606 - DNA, 13 bp, Homo sapiens
tggactctgcccc

SEQ ID NO: 4424607 - DNA, 22 bp, Homo sapiens
tggactgagccaaggaggcctg

SEQ ID NO: 4424608 - DNA, 22 bp, Homo sapiens
tggactgagggggcctggatgc

SEQ ID NO: 4424609 - DNA, 23 bp, Homo sapiens
tggactgagggggcctggatgcc

SEQ ID NO: 4424610 - DNA, 19 bp, Homo sapiens
tggactgagtgggaagccc

SEQ ID NO: 4424611 - DNA, 14 bp, Homo sapiens
tggactggcccctg

SEQ ID NO: 4424612 - DNA, 15 bp, Homo sapiens
tggactggcccctgg

SEQ ID NO: 4424613 - DNA, 17 bp, Homo sapiens
tggactggcccctgggt

SEQ ID NO: 4424614 - DNA, 22 bp, Homo sapiens
tggactggcgttcacctccctg

SEQ ID NO: 4424615 - DNA, 20 bp, Homo sapiens
tggactggctagagtcctca

SEQ ID NO: 4424616 - DNA, 15 bp, Homo sapiens
tggactgttccaggc

SEQ ID NO: 4424617 - DNA, 17 bp, Homo sapiens
tggacttctacctgccc

SEQ ID NO: 4424618 - DNA, 18 bp, Homo sapiens
tggacttctacctgccct

SEQ ID NO: 4424619 - DNA, 13 bp, Homo sapiens
tggacttctggga

SEQ ID NO: 4424620 - DNA, 13 bp, Homo sapiens
tggagaaaatggg

SEQ ID NO: 4424621 - DNA, 22 bp, Homo sapiens
tggagaaaatgggtttattcac

SEQ ID NO: 4424622 - DNA, 19 bp, Homo sapiens
tggagaaagccacgccctc

SEQ ID NO: 4424623 - DNA, 22 bp, Homo sapiens
tggagaaagccacgccctccct

SEQ ID NO: 4424624 - DNA, 20 bp, Homo sapiens
tggagaactagaacctggag

SEQ ID NO: 4424625 - DNA, 20 bp, Homo sapiens
tggagaagccacaggcctga

SEQ ID NO: 4424626 - DNA, 22 bp, Homo sapiens
tggagaagccacaggcctgaga

SEQ ID NO: 4424627 - DNA, 23 bp, Homo sapiens
tggagaagccacaggcctgagat

SEQ ID NO: 4424628 - DNA, 21 bp, Homo sapiens
tggagaaggtattagcaaagc

SEQ ID NO: 4424629 - DNA, 17 bp, Homo sapiens
tggagaattgctgaagg

SEQ ID NO: 4424630 - DNA, 23 bp, Homo sapiens
tggagaatttagaatcagaagtt

SEQ ID NO: 4424631 - DNA, 14 bp, Homo sapiens
tggagaccctgcca

SEQ ID NO: 4424632 - DNA, 16 bp, Homo sapiens
tggagaccctgccaca

SEQ ID NO: 4424633 - DNA, 17 bp, Homo sapiens
tggagactcctggtctg

SEQ ID NO: 4424634 - DNA, 13 bp, Homo sapiens
tggagagaagctg

SEQ ID NO: 4424635 - DNA, 11 bp, Homo sapiens
tggagagaata

SEQ ID NO: 4424636 - DNA, 22 bp, Homo sapiens
tggagagctagaacctggagag

SEQ ID NO: 4424637 - DNA, 21 bp, Homo sapiens
tggagagctagaacctggagg

SEQ ID NO: 4424638 - DNA, 14 bp, Homo sapiens
tggagaggcggcct

SEQ ID NO: 4424639 - DNA, 16 bp, Homo sapiens
tggagagtcagatctt

SEQ ID NO: 4424640 - DNA, 13 bp, Homo sapiens
tggagatagtgcc

SEQ ID NO: 4424641 - DNA, 19 bp, Homo sapiens
tggagatatttatgggggg

SEQ ID NO: 4424642 - DNA, 20 bp, Homo sapiens
tggagatgcagctactggaa

SEQ ID NO: 4424643 - DNA, 18 bp, Homo sapiens
tggagatgtaaaatgagt

SEQ ID NO: 4424644 - DNA, 20 bp, Homo sapiens
tggagatgtaaaatgagttt

SEQ ID NO: 4424645 - DNA, 13 bp, Homo sapiens
tggagcaatcaga

SEQ ID NO: 4424646 - DNA, 16 bp, Homo sapiens
tggagcacaaaattca

SEQ ID NO: 4424647 - DNA, 17 bp, Homo sapiens
tggagcacaaaattcaa

SEQ ID NO: 4424648 - DNA, 17 bp, Homo sapiens
tggagcaccaggcacga

SEQ ID NO: 4424649 - DNA, 19 bp, Homo sapiens
tggagcacgtggagatagt

SEQ ID NO: 4424650 - DNA, 22 bp, Homo sapiens
tggagcacgtggagatagtgcc

SEQ ID NO: 4424651 - DNA, 16 bp, Homo sapiens
tggagcagaggggctg

SEQ ID NO: 4424652 - DNA, 13 bp, Homo sapiens
tggagcaggagcc

SEQ ID NO: 4424653 - DNA, 20 bp, Homo sapiens
tggagcattaactaaatgct

SEQ ID NO: 4424654 - DNA, 17 bp, Homo sapiens
tggagcatttctcatca

SEQ ID NO: 4424655 - DNA, 19 bp, Homo sapiens
tggagcccagaggagggca

SEQ ID NO: 4424656 - DNA, 23 bp, Homo sapiens
tggagcccagaggagggcagcag

SEQ ID NO: 4424657 - DNA, 14 bp, Homo sapiens
tggagccccagccc

SEQ ID NO: 4424658 - DNA, 17 bp, Homo sapiens
tggagcccccagcagag

SEQ ID NO: 4424659 - DNA, 20 bp, Homo sapiens
tggagcgagagggaggcagg

SEQ ID NO: 4424660 - DNA, 13 bp, Homo sapiens
tggagctcctccc

SEQ ID NO: 4424661 - DNA, 18 bp, Homo sapiens
tggagctcctccctccag

SEQ ID NO: 4424662 - DNA, 21 bp, Homo sapiens
tggagctcctccctccagctg

SEQ ID NO: 4424663 - DNA, 14 bp, Homo sapiens
tggagctgtcatca

SEQ ID NO: 4424664 - DNA, 16 bp, Homo sapiens
tggagctttggaatat

SEQ ID NO: 4424665 - DNA, 14 bp, Homo sapiens
tggaggaaagcaac

SEQ ID NO: 4424666 - DNA, 14 bp, Homo sapiens
tggaggaagagcca

SEQ ID NO: 4424667 - DNA, 19 bp, Homo sapiens
tggaggaagagccacctgc

SEQ ID NO: 4424668 - DNA, 20 bp, Homo sapiens
tggaggaagagccacctgca

SEQ ID NO: 4424669 - DNA, 18 bp, Homo sapiens
tggaggaagggctgggcc

SEQ ID NO: 4424670 - DNA, 22 bp, Homo sapiens
tggaggaagggctgggccacca

SEQ ID NO: 4424671 - DNA, 17 bp, Homo sapiens
tggaggaatacatttta

SEQ ID NO: 4424672 - DNA, 19 bp, Homo sapiens
tggaggaccgaggctacag

SEQ ID NO: 4424673 - DNA, 21 bp, Homo sapiens
tggaggaccgaggctacagct

SEQ ID NO: 4424674 - DNA, 19 bp, Homo sapiens
tggaggactagaacctgga

SEQ ID NO: 4424675 - DNA, 14 bp, Homo sapiens
tggaggagaagaat

SEQ ID NO: 4424676 - DNA, 22 bp, Homo sapiens
tggaggagaggggtggaggctg

SEQ ID NO: 4424677 - DNA, 21 bp, Homo sapiens
tggaggaggaaggcaagaggg

SEQ ID NO: 4424678 - DNA, 23 bp, Homo sapiens
tggaggatgttagacttgctccc

SEQ ID NO: 4424679 - DNA, 18 bp, Homo sapiens
tggaggattctttcccca

SEQ ID NO: 4424680 - DNA, 23 bp, Homo sapiens
tggaggatttgccattgtccagg

SEQ ID NO: 4424681 - DNA, 20 bp, Homo sapiens
tggaggcaatcctaccttgc

SEQ ID NO: 4424682 - DNA, 16 bp, Homo sapiens
tggaggcagagacctc

SEQ ID NO: 4424683 - DNA, 21 bp, Homo sapiens
tggaggcagagacctccaata

SEQ ID NO: 4424684 - DNA, 20 bp, Homo sapiens
tggaggcattgatgcatgct

SEQ ID NO: 4424685 - DNA, 14 bp, Homo sapiens
tggaggcccaggct

SEQ ID NO: 4424686 - DNA, 17 bp, Homo sapiens
tggaggcttcctgcgtc

SEQ ID NO: 4424687 - DNA, 21 bp, Homo sapiens
tggagggctagaacctggaga

SEQ ID NO: 4424688 - DNA, 22 bp, Homo sapiens
tggagggctagaacctggagaa

SEQ ID NO: 4424689 - DNA, 23 bp, Homo sapiens
tggagggctagaatctggagagc

SEQ ID NO: 4424690 - DNA, 15 bp, Homo sapiens
tggagggggctgggg

SEQ ID NO: 4424691 - DNA, 17 bp, Homo sapiens
tggaggggtgtggcagt

SEQ ID NO: 4424692 - DNA, 18 bp, Homo sapiens
tggaggggtgtggcagtg

SEQ ID NO: 4424693 - DNA, 15 bp, Homo sapiens
tggagggtcccaagc

SEQ ID NO: 4424694 - DNA, 19 bp, Homo sapiens
tggagggtcccaagctggg

SEQ ID NO: 4424695 - DNA, 21 bp, Homo sapiens
tggaggtagttgggtagaaaa

SEQ ID NO: 4424696 - DNA, 15 bp, Homo sapiens
tggaggttgaagcca

SEQ ID NO: 4424697 - DNA, 20 bp, Homo sapiens
tggaggttgcagtgagctga

SEQ ID NO: 4424698 - DNA, 21 bp, Homo sapiens
tggagtaggtaccatttgtgt

SEQ ID NO: 4424699 - DNA, 18 bp, Homo sapiens
tggagtcccaggggcagc

SEQ ID NO: 4424700 - DNA, 21 bp, Homo sapiens
tggagtcccaggggcagccac

SEQ ID NO: 4424701 - DNA, 23 bp, Homo sapiens
tggagtcccaggggcagccacac

SEQ ID NO: 4424702 - DNA, 16 bp, Homo sapiens
tggagtcttgtgaaag

SEQ ID NO: 4424703 - DNA, 14 bp, Homo sapiens
tgcctgagggcagt

SEQ ID NO: 4424704 - DNA, 11 bp, Homo sapiens
tgcctgcagcc

SEQ ID NO: 4424705 - DNA, 13 bp, Homo sapiens
tgcctgcagccag

SEQ ID NO: 4424706 - DNA, 16 bp, Homo sapiens
tgcctgcagtttcttg

SEQ ID NO: 4424707 - DNA, 22 bp, Homo sapiens
tgcctgcagtttcttgtgtaga

SEQ ID NO: 4424708 - DNA, 11 bp, Homo sapiens
tgcctgccact

SEQ ID NO: 4424709 - DNA, 16 bp, Homo sapiens
tgcctgccactctctg

SEQ ID NO: 4424710 - DNA, 21 bp, Homo sapiens
tgcctgccctgcctcagccag

SEQ ID NO: 4424711 - DNA, 23 bp, Homo sapiens
tgcctgccctgcctcagccaggc

SEQ ID NO: 4424712 - DNA, 21 bp, Homo sapiens
tgcctgcgcccaccccgctct

SEQ ID NO: 4424713 - DNA, 14 bp, Homo sapiens
tgcctgcgcctgct

SEQ ID NO: 4424714 - DNA, 15 bp, Homo sapiens
tgcctgcgcctgctg

SEQ ID NO: 4424715 - DNA, 10 bp, Homo sapiens
tgcctgctga

SEQ ID NO: 4424716 - DNA, 15 bp, Homo sapiens
tgcctgctgagatga

SEQ ID NO: 4424717 - DNA, 19 bp, Homo sapiens
tgcctggagacaaggtgct

SEQ ID NO: 4424718 - DNA, 17 bp, Homo sapiens
tgcctggccccagcctg

SEQ ID NO: 4424719 - DNA, 20 bp, Homo sapiens
tgcctggccccagcctgggc

SEQ ID NO: 4424720 - DNA, 15 bp, Homo sapiens
tgcctggctccctga

SEQ ID NO: 4424721 - DNA, 19 bp, Homo sapiens
tgcctgggtggatgggcca

SEQ ID NO: 4424722 - DNA, 17 bp, Homo sapiens
tgcctgggtggggctgc

SEQ ID NO: 4424723 - DNA, 19 bp, Homo sapiens
tgcctgggtggggctgctc

SEQ ID NO: 4424724 - DNA, 23 bp, Homo sapiens
tgcctgggtggggctgctcctcc

SEQ ID NO: 4424725 - DNA, 15 bp, Homo sapiens
tgcctgtaattaaac

SEQ ID NO: 4424726 - DNA, 16 bp, Homo sapiens
tgcctgtagtctcagc

SEQ ID NO: 4424727 - DNA, 21 bp, Homo sapiens
tgcctgtctgcttgcatctgc

SEQ ID NO: 4424728 - DNA, 22 bp, Homo sapiens
tgcctgtcttgagtagacttgg

SEQ ID NO: 4424729 - DNA, 16 bp, Homo sapiens
tgcctgtgaggcaggg

SEQ ID NO: 4424730 - DNA, 17 bp, Homo sapiens
tgcctgtgaggcagggg

SEQ ID NO: 4424731 - DNA, 14 bp, Homo sapiens
tgcctgtgcccgca

SEQ ID NO: 4424732 - DNA, 21 bp, Homo sapiens
tgcctgtggtgaagtgtggct

SEQ ID NO: 4424733 - DNA, 23 bp, Homo sapiens
tgcctgtggtgaagtgtggctgg

SEQ ID NO: 4424734 - DNA, 15 bp, Homo sapiens
tgcctgttaatttat

SEQ ID NO: 4424735 - DNA, 23 bp, Homo sapiens
tgcctgttaatttataatgtatt

SEQ ID NO: 4424736 - DNA, 18 bp, Homo sapiens
tgcctgttggcaggccca

SEQ ID NO: 4424737 - DNA, 15 bp, Homo sapiens
tgccttaaaaccaaa

SEQ ID NO: 4424738 - DNA, 18 bp, Homo sapiens
tgccttaaaaccaaagag

SEQ ID NO: 4424739 - DNA, 20 bp, Homo sapiens
tgccttaaaaccaaagaggg

SEQ ID NO: 4424740 - DNA, 18 bp, Homo sapiens
tgccttacctcctgccca

SEQ ID NO: 4424741 - DNA, 19 bp, Homo sapiens
tgccttacctcctgcccag

SEQ ID NO: 4424742 - DNA, 23 bp, Homo sapiens
tgccttacctcctgcccaggaga

SEQ ID NO: 4424743 - DNA, 18 bp, Homo sapiens
tgccttagagccaggcac

SEQ ID NO: 4424744 - DNA, 21 bp, Homo sapiens
tgccttattagagtgtctttc

SEQ ID NO: 4424745 - DNA, 23 bp, Homo sapiens
tgccttattagagtgtctttcca

SEQ ID NO: 4424746 - DNA, 22 bp, Homo sapiens
tgccttatttctcattgcctct

SEQ ID NO: 4424747 - DNA, 12 bp, Homo sapiens
tgccttatttgt

SEQ ID NO: 4424748 - DNA, 14 bp, Homo sapiens
tgccttatttgtct

SEQ ID NO: 4424749 - DNA, 15 bp, Homo sapiens
tgccttcacaaatgt

SEQ ID NO: 4424750 - DNA, 16 bp, Homo sapiens
tgccttcactgggcca

SEQ ID NO: 4424751 - DNA, 14 bp, Homo sapiens
tgccttcagggaga

SEQ ID NO: 4424752 - DNA, 20 bp, Homo sapiens
tgccttcagtcttggtaaaa

SEQ ID NO: 4424753 - DNA, 18 bp, Homo sapiens
tgccttcatcttcactgc

SEQ ID NO: 4424754 - DNA, 17 bp, Homo sapiens
tgccttccagatcctct

SEQ ID NO: 4424755 - DNA, 21 bp, Homo sapiens
tgccttccatgtcggcctcta

SEQ ID NO: 4424756 - DNA, 17 bp, Homo sapiens
tgccttccctagcttta

SEQ ID NO: 4424757 - DNA, 14 bp, Homo sapiens
tgccttcctcctgg

SEQ ID NO: 4424758 - DNA, 15 bp, Homo sapiens
tgccttcctcctggg

SEQ ID NO: 4424759 - DNA, 16 bp, Homo sapiens
tgccttcctcctgggc

SEQ ID NO: 4424760 - DNA, 17 bp, Homo sapiens
tgccttcctcctgggcc

SEQ ID NO: 4424761 - DNA, 20 bp, Homo sapiens
tgccttcctcctgggccctc

SEQ ID NO: 4424762 - DNA, 17 bp, Homo sapiens
tgccttctaccctctgg

SEQ ID NO: 4424763 - DNA, 16 bp, Homo sapiens
tgccttctactcccct

SEQ ID NO: 4424764 - DNA, 15 bp, Homo sapiens
tgccttctggagctg

SEQ ID NO: 4424765 - DNA, 14 bp, Homo sapiens
tgccttctgggctt

SEQ ID NO: 4424766 - DNA, 11 bp, Homo sapiens
tgccttctgtg

SEQ ID NO: 4424767 - DNA, 21 bp, Homo sapiens
tgccttcttattctcactcca

SEQ ID NO: 4424768 - DNA, 20 bp, Homo sapiens
tgccttgaaatttacacagt

SEQ ID NO: 4424769 - DNA, 23 bp, Homo sapiens
tgccttgaaatttacacagtgag

SEQ ID NO: 4424770 - DNA, 15 bp, Homo sapiens
tgccttgaataataa

SEQ ID NO: 4424771 - DNA, 15 bp, Homo sapiens
tgccttgcactgtgg

SEQ ID NO: 4424772 - DNA, 16 bp, Homo sapiens
tgccttgcactgtggt

SEQ ID NO: 4424773 - DNA, 21 bp, Homo sapiens
tgccttggagggtcccaagct

SEQ ID NO: 4424774 - DNA, 18 bp, Homo sapiens
tgccttggcctcccaaag

SEQ ID NO: 4424775 - DNA, 20 bp, Homo sapiens
tgccttggggaatttcctct

SEQ ID NO: 4424776 - DNA, 21 bp, Homo sapiens
tgccttggggaatttcctcta

SEQ ID NO: 4424777 - DNA, 16 bp, Homo sapiens
tgccttggtgtgctgt

SEQ ID NO: 4424778 - DNA, 19 bp, Homo sapiens
tgccttgtgaaggaattat

SEQ ID NO: 4424779 - DNA, 23 bp, Homo sapiens
tgccttgttgtattcctgccttt

SEQ ID NO: 4424780 - DNA, 17 bp, Homo sapiens
tgccttgtttgagtttt

SEQ ID NO: 4424781 - DNA, 20 bp, Homo sapiens
tgccttgtttgagtttttcc

SEQ ID NO: 4424782 - DNA, 14 bp, Homo sapiens
tgcctttaaatctg

SEQ ID NO: 4424783 - DNA, 22 bp, Homo sapiens
tgcctttaatattttgtaatat

SEQ ID NO: 4424784 - DNA, 17 bp, Homo sapiens
tgcctttatttccactg

SEQ ID NO: 4424785 - DNA, 12 bp, Homo sapiens
tgcctttcaaat

SEQ ID NO: 4424786 - DNA, 10 bp, Homo sapiens
tgcctttcct

SEQ ID NO: 4424787 - DNA, 13 bp, Homo sapiens
tgcctttcctgtt

SEQ ID NO: 4424788 - DNA, 14 bp, Homo sapiens
tgcctttcctgttc

SEQ ID NO: 4424789 - DNA, 16 bp, Homo sapiens
tgcctttctttgcctc

SEQ ID NO: 4424790 - DNA, 19 bp, Homo sapiens
tgcctttctttgcctctgc

SEQ ID NO: 4424791 - DNA, 12 bp, Homo sapiens
tgcctttggcct

SEQ ID NO: 4424792 - DNA, 13 bp, Homo sapiens
tgccttttaagtt

SEQ ID NO: 4424793 - DNA, 20 bp, Homo sapiens
tgccttttaagtttgaaact

SEQ ID NO: 4424794 - DNA, 16 bp, Homo sapiens
tgccttttaattttta

SEQ ID NO: 4424795 - DNA, 13 bp, Homo sapiens
tgccttttgttaa

SEQ ID NO: 4424796 - DNA, 18 bp, Homo sapiens
tgccttttgttaatgcat

SEQ ID NO: 4424797 - DNA, 18 bp, Homo sapiens
tgccttttgtttccagga

SEQ ID NO: 4424798 - DNA, 13 bp, Homo sapiens
tgccttttttcta

SEQ ID NO: 4424799 - DNA, 22 bp, Homo sapiens
tgccttttttctatatcaaaaa

SEQ ID NO: 4424800 - DNA, 18 bp, Homo sapiens
tgcgaccttgcaacctca

SEQ ID NO: 4424801 - DNA, 22 bp, Homo sapiens
tgcgagacgcacacagctgagc

SEQ ID NO: 4424802 - DNA, 15 bp, Homo sapiens
tgcgaggacatcaaa

SEQ ID NO: 4424803 - DNA, 13 bp, Homo sapiens
tgcgcaatgtggc

SEQ ID NO: 4424804 - DNA, 18 bp, Homo sapiens
tgcgcagcctccagggcc

SEQ ID NO: 4424805 - DNA, 13 bp, Homo sapiens
tgcgcccaccccg

SEQ ID NO: 4424806 - DNA, 17 bp, Homo sapiens
tgcgcccaccccgctct

SEQ ID NO: 4424807 - DNA, 13 bp, Homo sapiens
tgcgcctcagccc

SEQ ID NO: 4424808 - DNA, 20 bp, Homo sapiens
tgcgcctgcaggcagagctg

SEQ ID NO: 4424809 - DNA, 17 bp, Homo sapiens
tgcgcctgctgcctgct

SEQ ID NO: 4424810 - DNA, 17 bp, Homo sapiens
tgcgccttcgtgcctga

SEQ ID NO: 4424811 - DNA, 21 bp, Homo sapiens
tgcgcgccaccgtgcctggct

SEQ ID NO: 4424812 - DNA, 22 bp, Homo sapiens
tgcgctaacccccagcccacag

SEQ ID NO: 4424813 - DNA, 19 bp, Homo sapiens
tgcgctcaggggctccatg

SEQ ID NO: 4424814 - DNA, 22 bp, Homo sapiens
tgcgctcaggggctccatgctg

SEQ ID NO: 4424815 - DNA, 21 bp, Homo sapiens
tgcgctgctctgcaggctggg

SEQ ID NO: 4424816 - DNA, 23 bp, Homo sapiens
tgcgctgctctgcaggctgggga

SEQ ID NO: 4424817 - DNA, 14 bp, Homo sapiens
tgcgcttgcttttc

SEQ ID NO: 4424818 - DNA, 13 bp, Homo sapiens
tgcggagcacact

SEQ ID NO: 4424819 - DNA, 15 bp, Homo sapiens
tgcggcaaaaggaaa

SEQ ID NO: 4424820 - DNA, 13 bp, Homo sapiens
tgcggcccagccc

SEQ ID NO: 4424821 - DNA, 14 bp, Homo sapiens
tgcggcccagcccg

SEQ ID NO: 4424822 - DNA, 15 bp, Homo sapiens
tgcggcccagcccgg

SEQ ID NO: 4424823 - DNA, 12 bp, Homo sapiens
tgcgggagccag

SEQ ID NO: 4424824 - DNA, 16 bp, Homo sapiens
tgcgggagccagactg

SEQ ID NO: 4424825 - DNA, 16 bp, Homo sapiens
tgcgggagctctgtat

SEQ ID NO: 4424826 - DNA, 14 bp, Homo sapiens
tgcgggatacagct

SEQ ID NO: 4424827 - DNA, 18 bp, Homo sapiens
tgcgggatacagctgagt

SEQ ID NO: 4424828 - DNA, 14 bp, Homo sapiens
tgcgggcccctggt

SEQ ID NO: 4424829 - DNA, 23 bp, Homo sapiens
tgcgggcgcgggcagccacccaa

SEQ ID NO: 4424830 - DNA, 23 bp, Homo sapiens
tgcggttcaggaaaattgaatgc

SEQ ID NO: 4424831 - DNA, 15 bp, Homo sapiens
tgcgtagaagatatg

SEQ ID NO: 4424832 - DNA, 18 bp, Homo sapiens
tgcgtccaccctgagctc

SEQ ID NO: 4424833 - DNA, 15 bp, Homo sapiens
tgcgtcccagcctgc

SEQ ID NO: 4424834 - DNA, 22 bp, Homo sapiens
tgcgtcctcctcacctcatgcc

SEQ ID NO: 4424835 - DNA, 15 bp, Homo sapiens
tgcgtcttggtgtaa

SEQ ID NO: 4424836 - DNA, 16 bp, Homo sapiens
tgcgtcttggtgtaat

SEQ ID NO: 4424837 - DNA, 22 bp, Homo sapiens
tgcgtcttggtgtaatttgaag

SEQ ID NO: 4424838 - DNA, 20 bp, Homo sapiens
tgcgtggcttccctgtccca

SEQ ID NO: 4424839 - DNA, 16 bp, Homo sapiens
tgcgtgggtcagaaga

SEQ ID NO: 4424840 - DNA, 23 bp, Homo sapiens
tgcgtgggtgtgtgcgtgtttgg

SEQ ID NO: 4424841 - DNA, 18 bp, Homo sapiens
tgcgtgtgtgtgtgtttg

SEQ ID NO: 4424842 - DNA, 23 bp, Homo sapiens
tgctaaaaaagcatatataacta

SEQ ID NO: 4424843 - DNA, 20 bp, Homo sapiens
tgctaaagggagaaatgcca

SEQ ID NO: 4424844 - DNA, 22 bp, Homo sapiens
tgctaacaaagacaaaagtctg

SEQ ID NO: 4424845 - DNA, 23 bp, Homo sapiens
tgctaacaaagacaaaagtctgt

SEQ ID NO: 4424846 - DNA, 16 bp, Homo sapiens
tgctaagagaagtaga

SEQ ID NO: 4424847 - DNA, 22 bp, Homo sapiens
tgctaagagaagtagaaatcat

SEQ ID NO: 4424848 - DNA, 14 bp, Homo sapiens
tgctaagagggccc

SEQ ID NO: 4424849 - DNA, 12 bp, Homo sapiens
tgctaaggcagc

SEQ ID NO: 4424850 - DNA, 23 bp, Homo sapiens
tgctaaggcagctgatccaggca

SEQ ID NO: 4424851 - DNA, 21 bp, Homo sapiens
tgctaagtaatttagaagata

SEQ ID NO: 4424852 - DNA, 23 bp, Homo sapiens
tgctaagtgcttattacatttta

SEQ ID NO: 4424853 - DNA, 22 bp, Homo sapiens
tgctaatatactttttttgtta

SEQ ID NO: 4424854 - DNA, 16 bp, Homo sapiens
tgctaatgtataatgt

SEQ ID NO: 4424855 - DNA, 18 bp, Homo sapiens
tgctacaaaaacacagca

SEQ ID NO: 4424856 - DNA, 19 bp, Homo sapiens
tgctacaaaaacacagcaa

SEQ ID NO: 4424857 - DNA, 22 bp, Homo sapiens
tgctaccagtatttagaagcca

SEQ ID NO: 4424858 - DNA, 16 bp, Homo sapiens
tgctacctcagtgctc

SEQ ID NO: 4424859 - DNA, 18 bp, Homo sapiens
tgctacctcagtgctcct

SEQ ID NO: 4424860 - DNA, 15 bp, Homo sapiens
tgctacctctgagaa

SEQ ID NO: 4424861 - DNA, 20 bp, Homo sapiens
tgctacctctgagaagacac

SEQ ID NO: 4424862 - DNA, 15 bp, Homo sapiens
tgctactcctgtgct

SEQ ID NO: 4424863 - DNA, 15 bp, Homo sapiens
tgctactgcactcca

SEQ ID NO: 4424864 - DNA, 16 bp, Homo sapiens
tgctactgtcttacta

SEQ ID NO: 4424865 - DNA, 20 bp, Homo sapiens
tgctagcacagaggcctgac

SEQ ID NO: 4424866 - DNA, 22 bp, Homo sapiens
tgctagcacagaggcctgactg

SEQ ID NO: 4424867 - DNA, 20 bp, Homo sapiens
tgctagggttaggaggtcct

SEQ ID NO: 4424868 - DNA, 17 bp, Homo sapiens
tgctataaagttaaagt

SEQ ID NO: 4424869 - DNA, 15 bp, Homo sapiens
tgctatagtatttga

SEQ ID NO: 4424870 - DNA, 21 bp, Homo sapiens
tgctatatataaaacggtgct

SEQ ID NO: 4424871 - DNA, 19 bp, Homo sapiens
tgctatcaacaataaaatt

SEQ ID NO: 4424872 - DNA, 20 bp, Homo sapiens
tgctatgagctggggatgtc

SEQ ID NO: 4424873 - DNA, 22 bp, Homo sapiens
tgctatgagctggggatgtctc

SEQ ID NO: 4424874 - DNA, 20 bp, Homo sapiens
tgctatgcgggttgattatt

SEQ ID NO: 4424875 - DNA, 13 bp, Homo sapiens
tgctatgtaaggg

SEQ ID NO: 4424876 - DNA, 17 bp, Homo sapiens
tgctatgtaagggtctt

SEQ ID NO: 4424877 - DNA, 12 bp, Homo sapiens
tgctattaatat

SEQ ID NO: 4424878 - DNA, 13 bp, Homo sapiens
tgctattaatatt

SEQ ID NO: 4424879 - DNA, 18 bp, Homo sapiens
tgctattgacaataaaat

SEQ ID NO: 4424880 - DNA, 20 bp, Homo sapiens
tgctattgttactcttacga

SEQ ID NO: 4424881 - DNA, 22 bp, Homo sapiens
tgctatttaacattttacagta

SEQ ID NO: 4424882 - DNA, 17 bp, Homo sapiens
tgctatttcaataacag

SEQ ID NO: 4424883 - DNA, 19 bp, Homo sapiens
tgctatttcaataacagat

SEQ ID NO: 4424884 - DNA, 19 bp, Homo sapiens
tgctatttttgtttttaga

SEQ ID NO: 4424885 - DNA, 16 bp, Homo sapiens
tgctcaaaatctgtga

SEQ ID NO: 4424886 - DNA, 19 bp, Homo sapiens
tgctcaaattactaatgat

SEQ ID NO: 4424887 - DNA, 14 bp, Homo sapiens
tgctcaacccccct

SEQ ID NO: 4424888 - DNA, 15 bp, Homo sapiens
tgctcaacccccctc

SEQ ID NO: 4424889 - DNA, 19 bp, Homo sapiens
tgctcaacccccctcccag

SEQ ID NO: 4424890 - DNA, 23 bp, Homo sapiens
tgctcaacccccctcccagacag

SEQ ID NO: 4424891 - DNA, 20 bp, Homo sapiens
tgctcaactctacccctgct

SEQ ID NO: 4424892 - DNA, 23 bp, Homo sapiens
tgctcaactctacccctgctccc

SEQ ID NO: 4424893 - DNA, 15 bp, Homo sapiens
tgctcaagaatgtag

SEQ ID NO: 4424894 - DNA, 13 bp, Homo sapiens
tgctcaagatatg

SEQ ID NO: 4424895 - DNA, 16 bp, Homo sapiens
tgctcaagatatggaa

SEQ ID NO: 4424896 - DNA, 14 bp, Homo sapiens
tgctcaatttcagc

SEQ ID NO: 4424897 - DNA, 16 bp, Homo sapiens
tgctcacaatgttctg

SEQ ID NO: 4424898 - DNA, 17 bp, Homo sapiens
tgctcaccatgcttcca

SEQ ID NO: 4424899 - DNA, 22 bp, Homo sapiens
tgctcacctcttctttaccaga

SEQ ID NO: 4424900 - DNA, 16 bp, Homo sapiens
tgctcacgttaccttg

SEQ ID NO: 4424901 - DNA, 13 bp, Homo sapiens
tgctcactgggcc

SEQ ID NO: 4424902 - DNA, 20 bp, Homo sapiens
tgctcactgtgtataggaat

SEQ ID NO: 4424903 - DNA, 17 bp, Homo sapiens
tgctcagacccaacagc

SEQ ID NO: 4424904 - DNA, 21 bp, Homo sapiens
tgctcagcaattcagacccct

SEQ ID NO: 4424905 - DNA, 19 bp, Homo sapiens
tgctcagccaaatttcctg

SEQ ID NO: 4424906 - DNA, 21 bp, Homo sapiens
tgctcagtgcttgggctccac

SEQ ID NO: 4424907 - DNA, 15 bp, Homo sapiens
tgctcatcattctct

SEQ ID NO: 4424908 - DNA, 21 bp, Homo sapiens
tgctcatcattctctgtctca

SEQ ID NO: 4424909 - DNA, 23 bp, Homo sapiens
tgctcatcattctctgtctcatc

SEQ ID NO: 4424910 - DNA, 14 bp, Homo sapiens
tgctccaccacatc

SEQ ID NO: 4424911 - DNA, 18 bp, Homo sapiens
tgctccaccagcagcatg

SEQ ID NO: 4424912 - DNA, 22 bp, Homo sapiens
tgctccacccttggcctgtctc

SEQ ID NO: 4424913 - DNA, 23 bp, Homo sapiens
tgctccacccttggcctgtctca

SEQ ID NO: 4424914 - DNA, 17 bp, Homo sapiens
tgctccagcctctgccg

SEQ ID NO: 4424915 - DNA, 19 bp, Homo sapiens
tgctccagcctctgccgct

SEQ ID NO: 4424916 - DNA, 19 bp, Homo sapiens
tgctccagggatgattcaa

SEQ ID NO: 4424917 - DNA, 19 bp, Homo sapiens
tgctccagggtcaggcgga

SEQ ID NO: 4424918 - DNA, 17 bp, Homo sapiens
tgctccatccccctgcc

SEQ ID NO: 4424919 - DNA, 22 bp, Homo sapiens
tgctccatccccctgcctccca

SEQ ID NO: 4424920 - DNA, 24 bp, Homo sapiens
tgctccatctccgcctccacactg

SEQ ID NO: 4424921 - DNA, 17 bp, Homo sapiens
tgctcccaaaacatttt

SEQ ID NO: 4424922 - DNA, 20 bp, Homo sapiens
tgctcccagctgtgctgtgg

SEQ ID NO: 4424923 - DNA, 18 bp, Homo sapiens
tgctcccattcctccctc

SEQ ID NO: 4424924 - DNA, 19 bp, Homo sapiens
tgctcccattcctccctcc

SEQ ID NO: 4424925 - DNA, 14 bp, Homo sapiens
tgctccccacagcg

SEQ ID NO: 4424926 - DNA, 19 bp, Homo sapiens
tgctccccacagcgtccct

SEQ ID NO: 4424927 - DNA, 20 bp, Homo sapiens
tgctccccacagcgtccctg

SEQ ID NO: 4424928 - DNA, 16 bp, Homo sapiens
tgctcccccaccccct

SEQ ID NO: 4424929 - DNA, 21 bp, Homo sapiens
tgctcccccaccccctcccca

SEQ ID NO: 4424930 - DNA, 23 bp, Homo sapiens
tgctcccccaccccctccccagg

SEQ ID NO: 4424931 - DNA, 16 bp, Homo sapiens
tgctcccggcccgcct

SEQ ID NO: 4424932 - DNA, 19 bp, Homo sapiens
tgctccctcccctgccctg

SEQ ID NO: 4424933 - DNA, 14 bp, Homo sapiens
tgctccctctccaa

SEQ ID NO: 4424934 - DNA, 22 bp, Homo sapiens
tgctccctctccaagacagcag

SEQ ID NO: 4424935 - DNA, 20 bp, Homo sapiens
tgctccctgcaagctccgcc

SEQ ID NO: 4424936 - DNA, 18 bp, Homo sapiens
tgctccctgcctcctgcc

SEQ ID NO: 4424937 - DNA, 16 bp, Homo sapiens
tgctcctccagggcca

SEQ ID NO: 4424938 - DNA, 22 bp, Homo sapiens
tgctcctccagggccacgtgcc

SEQ ID NO: 4424939 - DNA, 20 bp, Homo sapiens
tgctcctgtgctcaccctct

SEQ ID NO: 4424940 - DNA, 22 bp, Homo sapiens
tgctcctgtgctcaccctctct

SEQ ID NO: 4424941 - DNA, 17 bp, Homo sapiens
tgctccttgagaggaga

SEQ ID NO: 4424942 - DNA, 12 bp, Homo sapiens
tgctccttgggc

SEQ ID NO: 4424943 - DNA, 16 bp, Homo sapiens
tgctccttgggccctt

SEQ ID NO: 4424944 - DNA, 19 bp, Homo sapiens
tgctcgcccagacaccatg

SEQ ID NO: 4424945 - DNA, 23 bp, Homo sapiens
tgctcgcccctgttttttgtaga

SEQ ID NO: 4424946 - DNA, 17 bp, Homo sapiens
tgctcgcttgctggaac

SEQ ID NO: 4424947 - DNA, 18 bp, Homo sapiens
tgctcgtggactgtgctg

SEQ ID NO: 4424948 - DNA, 15 bp, Homo sapiens
tgctctaacagccct

SEQ ID NO: 4424949 - DNA, 16 bp, Homo sapiens
tgctctaacagccctc

SEQ ID NO: 4424950 - DNA, 18 bp, Homo sapiens
tgctctaatgagcatttc

SEQ ID NO: 4424951 - DNA, 19 bp, Homo sapiens
tgctctaatgagcatttcc

SEQ ID NO: 4424952 - DNA, 18 bp, Homo sapiens
tgctctcagcctcccaca

SEQ ID NO: 4424953 - DNA, 18 bp, Homo sapiens
tgctctccaagtctcagt

SEQ ID NO: 4424954 - DNA, 14 bp, Homo sapiens
tgctctcctcatct

SEQ ID NO: 4424955 - DNA, 14 bp, Homo sapiens
tgctctccttcact

SEQ ID NO: 4424956 - DNA, 21 bp, Homo sapiens
tgctctccttcactctgacag

SEQ ID NO: 4424957 - DNA, 17 bp, Homo sapiens
tgctctccttcctggag

SEQ ID NO: 4424958 - DNA, 18 bp, Homo sapiens
tgctctccttcctggagc

SEQ ID NO: 4424959 - DNA, 20 bp, Homo sapiens
tgctctctgcagccagccca

SEQ ID NO: 4424960 - DNA, 12 bp, Homo sapiens
tgctctcttcaa

SEQ ID NO: 4424961 - DNA, 18 bp, Homo sapiens
tgctctcttcaataaacc

SEQ ID NO: 4424962 - DNA, 15 bp, Homo sapiens
tgctctctttctgtc

SEQ ID NO: 4424963 - DNA, 13 bp, Homo sapiens
tgctctgacctcc

SEQ ID NO: 4424964 - DNA, 19 bp, Homo sapiens
tgctctgaccttccagagc

SEQ ID NO: 4424965 - DNA, 14 bp, Homo sapiens
tgctctgatccctc

SEQ ID NO: 4424966 - DNA, 23 bp, Homo sapiens
tgctctgcgtgtcacctgtgctt

SEQ ID NO: 4424967 - DNA, 19 bp, Homo sapiens
tgctctggggatttctggg

SEQ ID NO: 4424968 - DNA, 22 bp, Homo sapiens
tgctctgtcccccaggctggag

SEQ ID NO: 4424969 - DNA, 15 bp, Homo sapiens
tgctcttagtcccaa

SEQ ID NO: 4424970 - DNA, 18 bp, Homo sapiens
tgctcttcaaaataaaac

SEQ ID NO: 4424971 - DNA, 14 bp, Homo sapiens
tgctcttcaagaaa

SEQ ID NO: 4424972 - DNA, 17 bp, Homo sapiens
tgctcttctacactagg

SEQ ID NO: 4424973 - DNA, 15 bp, Homo sapiens
tgctcttctctcccc

SEQ ID NO: 4424974 - DNA, 17 bp, Homo sapiens
tgctcttgttctgttcc

SEQ ID NO: 4424975 - DNA, 18 bp, Homo sapiens
tgctcttgttctgttcct

SEQ ID NO: 4424976 - DNA, 18 bp, Homo sapiens
tgctctttaaataataaa

SEQ ID NO: 4424977 - DNA, 22 bp, Homo sapiens
tgctctttaatcaaactctggt

SEQ ID NO: 4424978 - DNA, 22 bp, Homo sapiens
tgctctttacatttcttttaaa

SEQ ID NO: 4424979 - DNA, 15 bp, Homo sapiens
tgctctttagatgca

SEQ ID NO: 4424980 - DNA, 17 bp, Homo sapiens
tgctctttattgcagaa

SEQ ID NO: 4424981 - DNA, 12 bp, Homo sapiens
tgctcttttgtg

SEQ ID NO: 4424982 - DNA, 16 bp, Homo sapiens
tgctgaaaaatatagc

SEQ ID NO: 4424983 - DNA, 21 bp, Homo sapiens
tgctgaaagtcctgctttcct

SEQ ID NO: 4424984 - DNA, 17 bp, Homo sapiens
tgctgaaattttatatg

SEQ ID NO: 4424985 - DNA, 16 bp, Homo sapiens
tgctgaagaatctact

SEQ ID NO: 4424986 - DNA, 13 bp, Homo sapiens
tgctgaaggagaa

SEQ ID NO: 4424987 - DNA, 20 bp, Homo sapiens
tgctgaatgttgggactgct

SEQ ID NO: 4424988 - DNA, 21 bp, Homo sapiens
tgctgaatttacagtagttaa

SEQ ID NO: 4424989 - DNA, 15 bp, Homo sapiens
tgctgacaaccgcaa

SEQ ID NO: 4424990 - DNA, 15 bp, Homo sapiens
tgctgaccctcctgt

SEQ ID NO: 4424991 - DNA, 22 bp, Homo sapiens
tgctgaccttggaggaatgaca

SEQ ID NO: 4424992 - DNA, 17 bp, Homo sapiens
tgctgagagacccaagg

SEQ ID NO: 4424993 - DNA, 20 bp, Homo sapiens
tgctgagaggcaccagtcca

SEQ ID NO: 4424994 - DNA, 14 bp, Homo sapiens
tgctgagatcctgg

SEQ ID NO: 4424995 - DNA, 18 bp, Homo sapiens
tgctgagatcctggactg

SEQ ID NO: 4424996 - DNA, 16 bp, Homo sapiens
tgctgagccagctgca

SEQ ID NO: 4424997 - DNA, 17 bp, Homo sapiens
tgctgagccagctgcag

SEQ ID NO: 4424998 - DNA, 16 bp, Homo sapiens
tgctgatcctaagaat

SEQ ID NO: 4424999 - DNA, 16 bp, Homo sapiens
tgctgatggagccttc

SEQ ID NO: 4425000 - DNA, 22 bp, Homo sapiens
tgctgatgtcaaagtgtaacag

SEQ ID NO: 4425001 - DNA, 14 bp, Homo sapiens
tgctgattcttgta

SEQ ID NO: 4425002 - DNA, 19 bp, Homo sapiens
tgctgattcttgtaaatct

SEQ ID NO: 4425003 - DNA, 12 bp, Homo sapiens
tgctgattttaa

SEQ ID NO: 4425004 - DNA, 19 bp, Homo sapiens
tgctgcaacaagctcatcc

SEQ ID NO: 4425005 - DNA, 21 bp, Homo sapiens
tgctgcaacaagctcatccct

SEQ ID NO: 4425006 - DNA, 19 bp, Homo sapiens
tgctgcaagcacagccctt

SEQ ID NO: 4425007 - DNA, 19 bp, Homo sapiens
tgctgcaatacattaaaat

SEQ ID NO: 4425008 - DNA, 14 bp, Homo sapiens
tgctgcaatgggaa

SEQ ID NO: 4425009 - DNA, 18 bp, Homo sapiens
tgctgcacaaaagcagat

SEQ ID NO: 4425010 - DNA, 14 bp, Homo sapiens
tgctgcactctgta

SEQ ID NO: 4425011 - DNA, 21 bp, Homo sapiens
tgctgcactctgtagcaaatt

SEQ ID NO: 4425012 - DNA, 14 bp, Homo sapiens
tgctgcagctccct

SEQ ID NO: 4425013 - DNA, 19 bp, Homo sapiens
tgctgcagctccctggctt

SEQ ID NO: 4425014 - DNA, 22 bp, Homo sapiens
tgctgcatcgctgttctgggca

SEQ ID NO: 4425015 - DNA, 12 bp, Homo sapiens
tgctgcattcca

SEQ ID NO: 4425016 - DNA, 17 bp, Homo sapiens
tgctgccagtgcagcca

SEQ ID NO: 4425017 - DNA, 23 bp, Homo sapiens
tgctgccatgacagaggctgcac

SEQ ID NO: 4425018 - DNA, 12 bp, Homo sapiens
tgctgcccaggc

SEQ ID NO: 4425019 - DNA, 13 bp, Homo sapiens
tgctgcccaggcc

SEQ ID NO: 4425020 - DNA, 19 bp, Homo sapiens
tgctgcccatgagcaagcc

SEQ ID NO: 4425021 - DNA, 17 bp, Homo sapiens
tgctgcccatgtttcaa

SEQ ID NO: 4425022 - DNA, 14 bp, Homo sapiens
tgctgcccccaccc

SEQ ID NO: 4425023 - DNA, 15 bp, Homo sapiens
tgctgcccccacccc

SEQ ID NO: 4425024 - DNA, 20 bp, Homo sapiens
tgctgcccctgcacagcagg

SEQ ID NO: 4425025 - DNA, 20 bp, Homo sapiens
tgctgcccgcgggagacagc

SEQ ID NO: 4425026 - DNA, 15 bp, Homo sapiens
tgctgccgagggctg

SEQ ID NO: 4425027 - DNA, 20 bp, Homo sapiens
tgctgccgagggctggccgg

SEQ ID NO: 4425028 - DNA, 16 bp, Homo sapiens
tgctgcctctctttca

SEQ ID NO: 4425029 - DNA, 16 bp, Homo sapiens
tgctgcctgctgagat

SEQ ID NO: 4425030 - DNA, 20 bp, Homo sapiens
tgctgcctgctgagatgagg

SEQ ID NO: 4425031 - DNA, 20 bp, Homo sapiens
tgctgcctggccctccccac

SEQ ID NO: 4425032 - DNA, 23 bp, Homo sapiens
tgctgctaaagggagaaatgcca

SEQ ID NO: 4425033 - DNA, 22 bp, Homo sapiens
tgctgctaattcccaacatttc

SEQ ID NO: 4425034 - DNA, 14 bp, Homo sapiens
tgctgctctcagcc

SEQ ID NO: 4425035 - DNA, 14 bp, Homo sapiens
tgctgctctcccaa

SEQ ID NO: 4425036 - DNA, 13 bp, Homo sapiens
tgctgctctgacc

SEQ ID NO: 4425037 - DNA, 16 bp, Homo sapiens
tgctgctgccgccgcc

SEQ ID NO: 4425038 - DNA, 19 bp, Homo sapiens
tgctgctgtgaatctgaaa

SEQ ID NO: 4425039 - DNA, 14 bp, Homo sapiens
tgctgctgtgtgct

SEQ ID NO: 4425040 - DNA, 19 bp, Homo sapiens
tgctgctttgggctgggat

SEQ ID NO: 4425041 - DNA, 16 bp, Homo sapiens
tgctggaacacagggg

SEQ ID NO: 4425042 - DNA, 17 bp, Homo sapiens
tgctggaataagttcaa

SEQ ID NO: 4425043 - DNA, 17 bp, Homo sapiens
tgctggactgttccagg

SEQ ID NO: 4425044 - DNA, 23 bp, Homo sapiens
tgctggactgttccaggccctcc

SEQ ID NO: 4425045 - DNA, 16 bp, Homo sapiens
tgctggaggggtggcc

SEQ ID NO: 4425046 - DNA, 18 bp, Homo sapiens
tgctggaggggtggccca

SEQ ID NO: 4425047 - DNA, 19 bp, Homo sapiens
tgctggaggggtggcccag

SEQ ID NO: 4425048 - DNA, 21 bp, Homo sapiens
tgctggaggggtggcccagag

SEQ ID NO: 4425049 - DNA, 11 bp, Homo sapiens
tgctggatgac

SEQ ID NO: 4425050 - DNA, 18 bp, Homo sapiens
tgctggcatcaagaggtg

SEQ ID NO: 4425051 - DNA, 20 bp, Homo sapiens
tgctggccagcaccctctcc

SEQ ID NO: 4425052 - DNA, 18 bp, Homo sapiens
tgctggccccgcccctgc

SEQ ID NO: 4425053 - DNA, 18 bp, Homo sapiens
tgctggccgacccactga

SEQ ID NO: 4425054 - DNA, 15 bp, Homo sapiens
tgctggccgcctcac

SEQ ID NO: 4425055 - DNA, 13 bp, Homo sapiens
tgctggctgaaga

SEQ ID NO: 4425056 - DNA, 22 bp, Homo sapiens
tgctgggacttgaacaaagaca

SEQ ID NO: 4425057 - DNA, 23 bp, Homo sapiens
tgctgggacttgaacaaagacat

SEQ ID NO: 4425058 - DNA, 17 bp, Homo sapiens
tgctgggcagagggagg

SEQ ID NO: 4425059 - DNA, 18 bp, Homo sapiens
tgctgggctctccacctc

SEQ ID NO: 4425060 - DNA, 23 bp, Homo sapiens
tgctgggctctccacctcagcct

SEQ ID NO: 4425061 - DNA, 16 bp, Homo sapiens
tgctgggctgggccct

SEQ ID NO: 4425062 - DNA, 16 bp, Homo sapiens
tgcattaaattcacaa

SEQ ID NO: 4425063 - DNA, 14 bp, Homo sapiens
tgcattattaaatt

SEQ ID NO: 4425064 - DNA, 17 bp, Homo sapiens
tgcattattaaattgta

SEQ ID NO: 4425065 - DNA, 20 bp, Homo sapiens
tgcattcaccttagtgcaac

SEQ ID NO: 4425066 - DNA, 20 bp, Homo sapiens
tgcattcatttttatagcaa

SEQ ID NO: 4425067 - DNA, 20 bp, Homo sapiens
tgcattcctttttcttcact

SEQ ID NO: 4425068 - DNA, 16 bp, Homo sapiens
tgcattctggatttta

SEQ ID NO: 4425069 - DNA, 16 bp, Homo sapiens
tgcattcttctctgtt

SEQ ID NO: 4425070 - DNA, 22 bp, Homo sapiens
tgcattctttatagtgaagtgt

SEQ ID NO: 4425071 - DNA, 19 bp, Homo sapiens
tgcattgaaaaatttctaa

SEQ ID NO: 4425072 - DNA, 19 bp, Homo sapiens
tgcattgaacacaaactgt

SEQ ID NO: 4425073 - DNA, 21 bp, Homo sapiens
tgcattgaacacaaactgtaa

SEQ ID NO: 4425074 - DNA, 22 bp, Homo sapiens
tgcattgaacacaaactgtaaa

SEQ ID NO: 4425075 - DNA, 23 bp, Homo sapiens
tgcattgaacacaaactgtaaat

SEQ ID NO: 4425076 - DNA, 20 bp, Homo sapiens
tgcattgaccgcgactaatt

SEQ ID NO: 4425077 - DNA, 22 bp, Homo sapiens
tgcattgaccgcgactaatttc

SEQ ID NO: 4425078 - DNA, 17 bp, Homo sapiens
tgcattgagcatatttt

SEQ ID NO: 4425079 - DNA, 19 bp, Homo sapiens
tgcattggggttcctctgt

SEQ ID NO: 4425080 - DNA, 22 bp, Homo sapiens
tgcattggggttcctctgtaca

SEQ ID NO: 4425081 - DNA, 15 bp, Homo sapiens
tgcattggttttcca

SEQ ID NO: 4425082 - DNA, 11 bp, Homo sapiens
tgcattgtctg

SEQ ID NO: 4425083 - DNA, 19 bp, Homo sapiens
tgcattgttagcactaggc

SEQ ID NO: 4425084 - DNA, 16 bp, Homo sapiens
tgcattgttgtaaagt

SEQ ID NO: 4425085 - DNA, 18 bp, Homo sapiens
tgcattgttgtaaagtat

SEQ ID NO: 4425086 - DNA, 19 bp, Homo sapiens
tgcattgttgtaaagtatt

SEQ ID NO: 4425087 - DNA, 15 bp, Homo sapiens
tgcatttaccactgt

SEQ ID NO: 4425088 - DNA, 13 bp, Homo sapiens
tgcatttcaaatg

SEQ ID NO: 4425089 - DNA, 14 bp, Homo sapiens
tgcatttcaaatgt

SEQ ID NO: 4425090 - DNA, 14 bp, Homo sapiens
tgcatttcatatta

SEQ ID NO: 4425091 - DNA, 19 bp, Homo sapiens
tgcatttcatattatttta

SEQ ID NO: 4425092 - DNA, 22 bp, Homo sapiens
tgcatttcatattattttagtg

SEQ ID NO: 4425093 - DNA, 21 bp, Homo sapiens
tgcatttgagagaagccacgc

SEQ ID NO: 4425094 - DNA, 22 bp, Homo sapiens
tgcatttgagagaagccacgct

SEQ ID NO: 4425095 - DNA, 18 bp, Homo sapiens
tgcatttgcctgcttctt

SEQ ID NO: 4425096 - DNA, 15 bp, Homo sapiens
tgcatttgtctattc

SEQ ID NO: 4425097 - DNA, 20 bp, Homo sapiens
tgcatttgtctattctccag

SEQ ID NO: 4425098 - DNA, 22 bp, Homo sapiens
tgcatttgtggtaatctacacc

SEQ ID NO: 4425099 - DNA, 19 bp, Homo sapiens
tgcatttgttccattaaaa

SEQ ID NO: 4425100 - DNA, 18 bp, Homo sapiens
tgcatttttgttttgaaa

SEQ ID NO: 4425101 - DNA, 21 bp, Homo sapiens
tgccaaaataaacctgttctt

SEQ ID NO: 4425102 - DNA, 19 bp, Homo sapiens
tgccaaagtacagaatttg

SEQ ID NO: 4425103 - DNA, 23 bp, Homo sapiens
tgccaacacttaatcattttatg

SEQ ID NO: 4425104 - DNA, 12 bp, Homo sapiens
tgccaacctaaa

SEQ ID NO: 4425105 - DNA, 18 bp, Homo sapiens
tgccaactgccaggctgc

SEQ ID NO: 4425106 - DNA, 16 bp, Homo sapiens
tgccaacttgatgttc

SEQ ID NO: 4425107 - DNA, 14 bp, Homo sapiens
tgccaagaaaatga

SEQ ID NO: 4425108 - DNA, 12 bp, Homo sapiens
tgccaagagcta

SEQ ID NO: 4425109 - DNA, 13 bp, Homo sapiens
tgccaagccctgg

SEQ ID NO: 4425110 - DNA, 14 bp, Homo sapiens
tgccaagccctggc

SEQ ID NO: 4425111 - DNA, 15 bp, Homo sapiens
tgccaagccctggcc

SEQ ID NO: 4425112 - DNA, 17 bp, Homo sapiens
tgccaagccctggcccc

SEQ ID NO: 4425113 - DNA, 16 bp, Homo sapiens
tgccaaggccagagtg

SEQ ID NO: 4425114 - DNA, 20 bp, Homo sapiens
tgccaaggccagagtggcct

SEQ ID NO: 4425115 - DNA, 23 bp, Homo sapiens
tgccaagtcatagccataaatga

SEQ ID NO: 4425116 - DNA, 18 bp, Homo sapiens
tgccaagtctcagaagag

SEQ ID NO: 4425117 - DNA, 21 bp, Homo sapiens
tgccacaaaccaccaggactg

SEQ ID NO: 4425118 - DNA, 12 bp, Homo sapiens
tgccacacccag

SEQ ID NO: 4425119 - DNA, 12 bp, Homo sapiens
tgccacagaggc

SEQ ID NO: 4425120 - DNA, 15 bp, Homo sapiens
tgccacagaggcccc

SEQ ID NO: 4425121 - DNA, 17 bp, Homo sapiens
tgccacagaggccccac

SEQ ID NO: 4425122 - DNA, 13 bp, Homo sapiens
tgccacagccaga

SEQ ID NO: 4425123 - DNA, 14 bp, Homo sapiens
tgccacagccagag

SEQ ID NO: 4425124 - DNA, 13 bp, Homo sapiens
tgccacagcctcc

SEQ ID NO: 4425125 - DNA, 21 bp, Homo sapiens
tgccacatctcagttatctaa

SEQ ID NO: 4425126 - DNA, 19 bp, Homo sapiens
tgccaccaaaggagacata

SEQ ID NO: 4425127 - DNA, 20 bp, Homo sapiens
tgccaccaaaggagacatat

SEQ ID NO: 4425128 - DNA, 15 bp, Homo sapiens
tgccaccagcccctc

SEQ ID NO: 4425129 - DNA, 13 bp, Homo sapiens
tgccaccaggaga

SEQ ID NO: 4425130 - DNA, 21 bp, Homo sapiens
tgccaccccaccctccctgga

SEQ ID NO: 4425131 - DNA, 21 bp, Homo sapiens
tgccacccctaaactccaggg

SEQ ID NO: 4425132 - DNA, 22 bp, Homo sapiens
tgccaccggcctgtgggtctct

SEQ ID NO: 4425133 - DNA, 22 bp, Homo sapiens
tgccacctagactctccctgta

SEQ ID NO: 4425134 - DNA, 15 bp, Homo sapiens
tgccacctatgcctg

SEQ ID NO: 4425135 - DNA, 21 bp, Homo sapiens
tgccacctatgcctgtggtga

SEQ ID NO: 4425136 - DNA, 21 bp, Homo sapiens
tgccacctcccctatccaccc

SEQ ID NO: 4425137 - DNA, 12 bp, Homo sapiens
tgccacctggca

SEQ ID NO: 4425138 - DNA, 13 bp, Homo sapiens
tgccacctggcaa

SEQ ID NO: 4425139 - DNA, 17 bp, Homo sapiens
tgccacgtgctgctgac

SEQ ID NO: 4425140 - DNA, 20 bp, Homo sapiens
tgccactaaattgacactta

SEQ ID NO: 4425141 - DNA, 11 bp, Homo sapiens
tgccactcaca

SEQ ID NO: 4425142 - DNA, 19 bp, Homo sapiens
tgccactcacacagccagg

SEQ ID NO: 4425143 - DNA, 21 bp, Homo sapiens
tgccactcacacagccaggtg

SEQ ID NO: 4425144 - DNA, 20 bp, Homo sapiens
tgccactctctgggactctc

SEQ ID NO: 4425145 - DNA, 14 bp, Homo sapiens
tgccactgcccccc

SEQ ID NO: 4425146 - DNA, 23 bp, Homo sapiens
tgccactgttcagcggagctgac

SEQ ID NO: 4425147 - DNA, 12 bp, Homo sapiens
tgccactgttgt

SEQ ID NO: 4425148 - DNA, 14 bp, Homo sapiens
tgccacttaatgta

SEQ ID NO: 4425149 - DNA, 23 bp, Homo sapiens
tgccacttaatgtatgttaccaa

SEQ ID NO: 4425150 - DNA, 21 bp, Homo sapiens
tgccagaccgcagagaggctc

SEQ ID NO: 4425151 - DNA, 18 bp, Homo sapiens
tgccagagaggtggggat

SEQ ID NO: 4425152 - DNA, 12 bp, Homo sapiens
tgccagaggccc

SEQ ID NO: 4425153 - DNA, 16 bp, Homo sapiens
tgccagaggccctgga

SEQ ID NO: 4425154 - DNA, 19 bp, Homo sapiens
tgccagaggccctggaggg

SEQ ID NO: 4425155 - DNA, 22 bp, Homo sapiens
tgccagaggctgatgtcaagca

SEQ ID NO: 4425156 - DNA, 22 bp, Homo sapiens
tgccagatataactgtcttgtt

SEQ ID NO: 4425157 - DNA, 19 bp, Homo sapiens
tgccagattctgcctctct

SEQ ID NO: 4425158 - DNA, 20 bp, Homo sapiens
tgccagattctgcctctctg

SEQ ID NO: 4425159 - DNA, 14 bp, Homo sapiens
tgccagcagagcca

SEQ ID NO: 4425160 - DNA, 16 bp, Homo sapiens
tgccagcagagccagg

SEQ ID NO: 4425161 - DNA, 20 bp, Homo sapiens
tgccagcagagccagggcag

SEQ ID NO: 4425162 - DNA, 15 bp, Homo sapiens
tgccagccactgtca

SEQ ID NO: 4425163 - DNA, 18 bp, Homo sapiens
tgccagctccatgttctc

SEQ ID NO: 4425164 - DNA, 20 bp, Homo sapiens
tgccagctgcccttgcaggg

SEQ ID NO: 4425165 - DNA, 23 bp, Homo sapiens
tgccagctgcccttgcagggtgg

SEQ ID NO: 4425166 - DNA, 14 bp, Homo sapiens
tgccagctgtctcc

SEQ ID NO: 4425167 - DNA, 19 bp, Homo sapiens
tgccagctgtctcccacgt

SEQ ID NO: 4425168 - DNA, 22 bp, Homo sapiens
tgccaggaaaggagagtacttt

SEQ ID NO: 4425169 - DNA, 14 bp, Homo sapiens
tgccaggaacctgt

SEQ ID NO: 4425170 - DNA, 20 bp, Homo sapiens
tgccaggaccagtcaacctg

SEQ ID NO: 4425171 - DNA, 17 bp, Homo sapiens
tgccaggaggaacaaag

SEQ ID NO: 4425172 - DNA, 20 bp, Homo sapiens
tgccaggaggaacaaagaga

SEQ ID NO: 4425173 - DNA, 18 bp, Homo sapiens
tgccaggatggaatgatg

SEQ ID NO: 4425174 - DNA, 20 bp, Homo sapiens
tgccaggcacacacagcccc

SEQ ID NO: 4425175 - DNA, 12 bp, Homo sapiens
tgccaggcaggg

SEQ ID NO: 4425176 - DNA, 16 bp, Homo sapiens
tgccaggcaggggtgg

SEQ ID NO: 4425177 - DNA, 14 bp, Homo sapiens
tgccaggccagcct

SEQ ID NO: 4425178 - DNA, 11 bp, Homo sapiens
tgccaggcccg

SEQ ID NO: 4425179 - DNA, 16 bp, Homo sapiens
tgccaggctgcctcct

SEQ ID NO: 4425180 - DNA, 20 bp, Homo sapiens
tgccaggctgcctcctgccc

SEQ ID NO: 4425181 - DNA, 11 bp, Homo sapiens
tgccagggagc

SEQ ID NO: 4425182 - DNA, 12 bp, Homo sapiens
tgccagggagct

SEQ ID NO: 4425183 - DNA, 18 bp, Homo sapiens
tgccagggatgggcagcc

SEQ ID NO: 4425184 - DNA, 21 bp, Homo sapiens
tgccagggatgggcagcccaa

SEQ ID NO: 4425185 - DNA, 16 bp, Homo sapiens
tgccagggcagggccc

SEQ ID NO: 4425186 - DNA, 14 bp, Homo sapiens
tgccaggtggctca

SEQ ID NO: 4425187 - DNA, 17 bp, Homo sapiens
tgccaggtggctcagtg

SEQ ID NO: 4425188 - DNA, 16 bp, Homo sapiens
tgccagtcctagctgc

SEQ ID NO: 4425189 - DNA, 17 bp, Homo sapiens
tgccagtcctagctgca

SEQ ID NO: 4425190 - DNA, 23 bp, Homo sapiens
tgccagtctcactgtgggaaggc

SEQ ID NO: 4425191 - DNA, 15 bp, Homo sapiens
tgccagtgaagtcct

SEQ ID NO: 4425192 - DNA, 15 bp, Homo sapiens
tgccagtgcagccac

SEQ ID NO: 4425193 - DNA, 16 bp, Homo sapiens
tgccagtgcagccact

SEQ ID NO: 4425194 - DNA, 15 bp, Homo sapiens
tgccagtgccttacc

SEQ ID NO: 4425195 - DNA, 12 bp, Homo sapiens
tgccagtgtctt

SEQ ID NO: 4425196 - DNA, 16 bp, Homo sapiens
tgccagtgtctttctt

SEQ ID NO: 4425197 - DNA, 17 bp, Homo sapiens
tgccagttatggctata

SEQ ID NO: 4425198 - DNA, 13 bp, Homo sapiens
tgccataattact

SEQ ID NO: 4425199 - DNA, 17 bp, Homo sapiens
tgccatattttcaccat

SEQ ID NO: 4425200 - DNA, 13 bp, Homo sapiens
tgccatcactggt

SEQ ID NO: 4425201 - DNA, 22 bp, Homo sapiens
tgccatcatgtttacagaggac

SEQ ID NO: 4425202 - DNA, 12 bp, Homo sapiens
tgccatccaagt

SEQ ID NO: 4425203 - DNA, 15 bp, Homo sapiens
tgccatcctctttct

SEQ ID NO: 4425204 - DNA, 18 bp, Homo sapiens
tgccatcctggcccaggg

SEQ ID NO: 4425205 - DNA, 21 bp, Homo sapiens
tgccatcctggcccagggcat

SEQ ID NO: 4425206 - DNA, 23 bp, Homo sapiens
tgccatgagccgcccaaggcctt

SEQ ID NO: 4425207 - DNA, 17 bp, Homo sapiens
tgccatgatctgtattt

SEQ ID NO: 4425208 - DNA, 22 bp, Homo sapiens
tgccatgctgggccactgggga

SEQ ID NO: 4425209 - DNA, 20 bp, Homo sapiens
tgccatgctttgagtccacg

SEQ ID NO: 4425210 - DNA, 13 bp, Homo sapiens
tgccatgcttttt

SEQ ID NO: 4425211 - DNA, 20 bp, Homo sapiens
tgccatggatttccactgct

SEQ ID NO: 4425212 - DNA, 23 bp, Homo sapiens
tgccatgtaaaggcctttaataa

SEQ ID NO: 4425213 - DNA, 15 bp, Homo sapiens
tgccatgttggccag

SEQ ID NO: 4425214 - DNA, 23 bp, Homo sapiens
tgccattatccctgaatccccct

SEQ ID NO: 4425215 - DNA, 20 bp, Homo sapiens
tgccattccaaaatattatg

SEQ ID NO: 4425216 - DNA, 13 bp, Homo sapiens
tgccattcttctg

SEQ ID NO: 4425217 - DNA, 13 bp, Homo sapiens
tgccattgggacc

SEQ ID NO: 4425218 - DNA, 22 bp, Homo sapiens
tgccatttaaagcttattaaaa

SEQ ID NO: 4425219 - DNA, 21 bp, Homo sapiens
tgccatttctgaactgttaca

SEQ ID NO: 4425220 - DNA, 22 bp, Homo sapiens
tgccatttctgaactgttacaa

SEQ ID NO: 4425221 - DNA, 17 bp, Homo sapiens
tgcccaaaatgtgaagc

SEQ ID NO: 4425222 - DNA, 18 bp, Homo sapiens
tgcccaaggttgcacagc

SEQ ID NO: 4425223 - DNA, 17 bp, Homo sapiens
tgcccaccaacatccca

SEQ ID NO: 4425224 - DNA, 14 bp, Homo sapiens
tgcccaccccctgc

SEQ ID NO: 4425225 - DNA, 16 bp, Homo sapiens
tgcccaccccctgccc

SEQ ID NO: 4425226 - DNA, 18 bp, Homo sapiens
tgcccaccccctgccctg

SEQ ID NO: 4425227 - DNA, 19 bp, Homo sapiens
tgcccaccccctgccctgc

SEQ ID NO: 4425228 - DNA, 14 bp, Homo sapiens
tgcccacctgccca

SEQ ID NO: 4425229 - DNA, 15 bp, Homo sapiens
tgcccacctgcccat

SEQ ID NO: 4425230 - DNA, 21 bp, Homo sapiens
tgcccactggccgctgagcgc

SEQ ID NO: 4425231 - DNA, 16 bp, Homo sapiens
tgcccagaaagtgggg

SEQ ID NO: 4425232 - DNA, 16 bp, Homo sapiens
tgcccagactgatgag

SEQ ID NO: 4425233 - DNA, 20 bp, Homo sapiens
tgcccagactgatgagcaca

SEQ ID NO: 4425234 - DNA, 18 bp, Homo sapiens
tgcccagagatgcctcca

SEQ ID NO: 4425235 - DNA, 13 bp, Homo sapiens
tgcccagagctga

SEQ ID NO: 4425236 - DNA, 15 bp, Homo sapiens
tgcccagagctgagt

SEQ ID NO: 4425237 - DNA, 15 bp, Homo sapiens
tgcccagccctggcc

SEQ ID NO: 4425238 - DNA, 20 bp, Homo sapiens
tgcccagccctggcccaggt

SEQ ID NO: 4425239 - DNA, 23 bp, Homo sapiens
tgcccagccctggcccaggtgcc

SEQ ID NO: 4425240 - DNA, 16 bp, Homo sapiens
tgcccagcctgctctc

SEQ ID NO: 4425241 - DNA, 17 bp, Homo sapiens
tgcccagcctgctctcc

SEQ ID NO: 4425242 - DNA, 17 bp, Homo sapiens
tgcccagcctggatgcc

SEQ ID NO: 4425243 - DNA, 21 bp, Homo sapiens
tgcccagcctggatgccatcc

SEQ ID NO: 4425244 - DNA, 19 bp, Homo sapiens
tgcccaggagagccagccc

SEQ ID NO: 4425245 - DNA, 20 bp, Homo sapiens
tgcccaggcctatctggaag

SEQ ID NO: 4425246 - DNA, 20 bp, Homo sapiens
tgcccaggcctctcggtgct

SEQ ID NO: 4425247 - DNA, 20 bp, Homo sapiens
tgcccaggctggagtgcagt

SEQ ID NO: 4425248 - DNA, 19 bp, Homo sapiens
tgcccagtacatttaaatt

SEQ ID NO: 4425249 - DNA, 17 bp, Homo sapiens
tgcccagtgagccctgc

SEQ ID NO: 4425250 - DNA, 19 bp, Homo sapiens
tgcccagtgagccctgctc

SEQ ID NO: 4425251 - DNA, 22 bp, Homo sapiens
tgcccagtgagccctgctcttc

SEQ ID NO: 4425252 - DNA, 13 bp, Homo sapiens
tgcccatcctgcc

SEQ ID NO: 4425253 - DNA, 14 bp, Homo sapiens
tgcccatgagcaag

SEQ ID NO: 4425254 - DNA, 14 bp, Homo sapiens
tgcccatgtgtccc

SEQ ID NO: 4425255 - DNA, 18 bp, Homo sapiens
tgcccatgtgtcccctca

SEQ ID NO: 4425256 - DNA, 19 bp, Homo sapiens
tgcccatgtgtcccctcac

SEQ ID NO: 4425257 - DNA, 15 bp, Homo sapiens
tgcccattcctgcct

SEQ ID NO: 4425258 - DNA, 17 bp, Homo sapiens
tgcccatttttgctaat

SEQ ID NO: 4425259 - DNA, 20 bp, Homo sapiens
tgccccaatcgggtccagag

SEQ ID NO: 4425260 - DNA, 12 bp, Homo sapiens
tgccccacatgc

SEQ ID NO: 4425261 - DNA, 20 bp, Homo sapiens
tgccccacccaactccacag

SEQ ID NO: 4425262 - DNA, 23 bp, Homo sapiens
tgccccacccaactccacagggc

SEQ ID NO: 4425263 - DNA, 12 bp, Homo sapiens
tgccccacccca

SEQ ID NO: 4425264 - DNA, 22 bp, Homo sapiens
tgccccaccccatccagccaga

SEQ ID NO: 4425265 - DNA, 19 bp, Homo sapiens
tgccccacggagacagagg

SEQ ID NO: 4425266 - DNA, 16 bp, Homo sapiens
tgccccacgttgtccc

SEQ ID NO: 4425267 - DNA, 12 bp, Homo sapiens
tgccccagccag

SEQ ID NO: 4425268 - DNA, 13 bp, Homo sapiens
tgccccagccaga

SEQ ID NO: 4425269 - DNA, 18 bp, Homo sapiens
tgccccagggagtccagg

SEQ ID NO: 4425270 - DNA, 20 bp, Homo sapiens
tgccccagggagtccagggt

SEQ ID NO: 4425271 - DNA, 21 bp, Homo sapiens
tgccccagtcggccccatctc

SEQ ID NO: 4425272 - DNA, 24 bp, Homo sapiens
tgccccagtcggccccatctctca

SEQ ID NO: 4425273 - DNA, 18 bp, Homo sapiens
tgccccatcagtgctccc

SEQ ID NO: 4425274 - DNA, 21 bp, Homo sapiens
tgccccatccagacctggctc

SEQ ID NO: 4425275 - DNA, 19 bp, Homo sapiens
tgcccccagaaagcctcct

SEQ ID NO: 4425276 - DNA, 20 bp, Homo sapiens
tgcccccagaaagcctcctg

SEQ ID NO: 4425277 - DNA, 16 bp, Homo sapiens
tgcccccagccccggg

SEQ ID NO: 4425278 - DNA, 11 bp, Homo sapiens
tgcccccagga

SEQ ID NO: 4425279 - DNA, 17 bp, Homo sapiens
tgccccccgaggctgct

SEQ ID NO: 4425280 - DNA, 17 bp, Homo sapiens
tgccccccgccctcatg

SEQ ID NO: 4425281 - DNA, 17 bp, Homo sapiens
tgcccccgcctgccacc

SEQ ID NO: 4425282 - DNA, 19 bp, Homo sapiens
tgcccccgcgggttctaga

SEQ ID NO: 4425283 - DNA, 21 bp, Homo sapiens
tgcccccgcgggttctagacg

SEQ ID NO: 4425284 - DNA, 17 bp, Homo sapiens
tgcccccggccccctgg

SEQ ID NO: 4425285 - DNA, 21 bp, Homo sapiens
tgcccccggccccctggtctc

SEQ ID NO: 4425286 - DNA, 14 bp, Homo sapiens
tgccccctccccca

SEQ ID NO: 4425287 - DNA, 13 bp, Homo sapiens
tgccccctgctgg

SEQ ID NO: 4425288 - DNA, 14 bp, Homo sapiens
tgccccctgctggc

SEQ ID NO: 4425289 - DNA, 21 bp, Homo sapiens
tgccccctgtggatgctgctg

SEQ ID NO: 4425290 - DNA, 16 bp, Homo sapiens
tgccccctttcagatg

SEQ ID NO: 4425291 - DNA, 18 bp, Homo sapiens
tgccccctttcagatgtc

SEQ ID NO: 4425292 - DNA, 21 bp, Homo sapiens
tgccccctttcagatgtcttc

SEQ ID NO: 4425293 - DNA, 23 bp, Homo sapiens
tgccccctttcagatgtcttctg

SEQ ID NO: 4425294 - DNA, 23 bp, Homo sapiens
tgccccgtcggactgcccccaga

SEQ ID NO: 4425295 - DNA, 22 bp, Homo sapiens
tgccccgtgtgtgtggccggcc

SEQ ID NO: 4425296 - DNA, 13 bp, Homo sapiens
tgcccctccccca

SEQ ID NO: 4425297 - DNA, 22 bp, Homo sapiens
tgcccctcccccaacccccacc

SEQ ID NO: 4425298 - DNA, 20 bp, Homo sapiens
tgcccctctgccttgccctc

SEQ ID NO: 4425299 - DNA, 19 bp, Homo sapiens
tgcccctgctcactgggcc

SEQ ID NO: 4425300 - DNA, 20 bp, Homo sapiens
tgcccctgctgtgctgctca

SEQ ID NO: 4425301 - DNA, 21 bp, Homo sapiens
tgcccctgctgtgctgctcaa

SEQ ID NO: 4425302 - DNA, 17 bp, Homo sapiens
tgcccctggacctggga

SEQ ID NO: 4425303 - DNA, 19 bp, Homo sapiens
tgcccctggacctgggaac

SEQ ID NO: 4425304 - DNA, 15 bp, Homo sapiens
tgcccctggctttgc

SEQ ID NO: 4425305 - DNA, 21 bp, Homo sapiens
tgcccctggctttgcctcttc

SEQ ID NO: 4425306 - DNA, 16 bp, Homo sapiens
tgcccctgtctggaag

SEQ ID NO: 4425307 - DNA, 22 bp, Homo sapiens
tgccccttaaacacaggctgtc

SEQ ID NO: 4425308 - DNA, 23 bp, Homo sapiens
tgccccttctacactctcctggg

SEQ ID NO: 4425309 - DNA, 12 bp, Homo sapiens
tgccccttctta

SEQ ID NO: 4425310 - DNA, 16 bp, Homo sapiens
tgccccttggtcctgg

SEQ ID NO: 4425311 - DNA, 19 bp, Homo sapiens
tgccccttggtcctggcag

SEQ ID NO: 4425312 - DNA, 16 bp, Homo sapiens
tgcccgagggagggga

SEQ ID NO: 4425313 - DNA, 16 bp, Homo sapiens
tgcccgcatgtgtgcc

SEQ ID NO: 4425314 - DNA, 23 bp, Homo sapiens
tgcccgcgggagacagcttctct

SEQ ID NO: 4425315 - DNA, 21 bp, Homo sapiens
tgcccggagattggacggcct

SEQ ID NO: 4425316 - DNA, 19 bp, Homo sapiens
tgcccgggcgcggccagcc

SEQ ID NO: 4425317 - DNA, 16 bp, Homo sapiens
tgcccgtaatcccagc

SEQ ID NO: 4425318 - DNA, 17 bp, Homo sapiens
tgcccgtaatcccagct

SEQ ID NO: 4425319 - DNA, 13 bp, Homo sapiens
tgccctaaaccct

SEQ ID NO: 4425320 - DNA, 18 bp, Homo sapiens
tgccctagttttctttcc

SEQ ID NO: 4425321 - DNA, 23 bp, Homo sapiens
tgccctagttttctttcctcctt

SEQ ID NO: 4425322 - DNA, 18 bp, Homo sapiens
tgccctccaaagagcctt

SEQ ID NO: 4425323 - DNA, 23 bp, Homo sapiens
tgccctccacccacacctgcccg

SEQ ID NO: 4425324 - DNA, 12 bp, Homo sapiens
tgccctcctggg

SEQ ID NO: 4425325 - DNA, 18 bp, Homo sapiens
tgccctcctgggccctgg

SEQ ID NO: 4425326 - DNA, 21 bp, Homo sapiens
tgccctcctgggccctgggct

SEQ ID NO: 4425327 - DNA, 13 bp, Homo sapiens
tgccctctccctg

SEQ ID NO: 4425328 - DNA, 15 bp, Homo sapiens
tgccctgagcactcc

SEQ ID NO: 4425329 - DNA, 17 bp, Homo sapiens
tgccctgagcactcctg

SEQ ID NO: 4425330 - DNA, 22 bp, Homo sapiens
tgccctgcacgtcatgggaggg

SEQ ID NO: 4425331 - DNA, 21 bp, Homo sapiens
tgccctggctccagtgaaact

SEQ ID NO: 4425332 - DNA, 14 bp, Homo sapiens
tgccctggctgctg

SEQ ID NO: 4425333 - DNA, 18 bp, Homo sapiens
tgccctggtccagggaag

SEQ ID NO: 4425334 - DNA, 21 bp, Homo sapiens
tgccctgtccaaaagcgccct

SEQ ID NO: 4425335 - DNA, 15 bp, Homo sapiens
tgccctgtgtggctg

SEQ ID NO: 4425336 - DNA, 20 bp, Homo sapiens
tgccctgttaaaagatgaaa

SEQ ID NO: 4425337 - DNA, 14 bp, Homo sapiens
tgcccttccctctg

SEQ ID NO: 4425338 - DNA, 15 bp, Homo sapiens
tgcccttccctctgg

SEQ ID NO: 4425339 - DNA, 11 bp, Homo sapiens
tgcccttgggg

SEQ ID NO: 4425340 - DNA, 22 bp, Homo sapiens
tgcccttggggtaagccagagc

SEQ ID NO: 4425341 - DNA, 17 bp, Homo sapiens
tgcccttttttctgcct

SEQ ID NO: 4425342 - DNA, 21 bp, Homo sapiens
tgcccttttttctgcctcctt

SEQ ID NO: 4425343 - DNA, 22 bp, Homo sapiens
tgccgaatttggtacacatgtg

SEQ ID NO: 4425344 - DNA, 14 bp, Homo sapiens
tgccgacacgctcc

SEQ ID NO: 4425345 - DNA, 18 bp, Homo sapiens
tgccgacactgagctgtg

SEQ ID NO: 4425346 - DNA, 14 bp, Homo sapiens
tgccgacctcgtcc

SEQ ID NO: 4425347 - DNA, 22 bp, Homo sapiens
tgccgagagtccatcagcctcc

SEQ ID NO: 4425348 - DNA, 17 bp, Homo sapiens
tgccgagggctggccgg

SEQ ID NO: 4425349 - DNA, 18 bp, Homo sapiens
tgccgagggctggccggg

SEQ ID NO: 4425350 - DNA, 21 bp, Homo sapiens
tgccgatatactctagatgaa

SEQ ID NO: 4425351 - DNA, 20 bp, Homo sapiens
tgccgatgttgaactttttt

SEQ ID NO: 4425352 - DNA, 19 bp, Homo sapiens
tgccgattttgtaaatgtt

SEQ ID NO: 4425353 - DNA, 12 bp, Homo sapiens
tgccgcacccca

SEQ ID NO: 4425354 - DNA, 15 bp, Homo sapiens
tgccgcaccccagag

SEQ ID NO: 4425355 - DNA, 13 bp, Homo sapiens
tgccgcagagctg

SEQ ID NO: 4425356 - DNA, 17 bp, Homo sapiens
tgccgcagagctggccg

SEQ ID NO: 4425357 - DNA, 17 bp, Homo sapiens
tgccgccgtgtttcctc

SEQ ID NO: 4425358 - DNA, 14 bp, Homo sapiens
tgccgctgcaccac

SEQ ID NO: 4425359 - DNA, 19 bp, Homo sapiens
tgccgctgccatgctttga

SEQ ID NO: 4425360 - DNA, 13 bp, Homo sapiens
tgccggtgggacc

SEQ ID NO: 4425361 - DNA, 17 bp, Homo sapiens
tgccggttaaattccat

SEQ ID NO: 4425362 - DNA, 16 bp, Homo sapiens
tgccgtgcatggctcc

SEQ ID NO: 4425363 - DNA, 19 bp, Homo sapiens
tgccgttactctccaacct

SEQ ID NO: 4425364 - DNA, 21 bp, Homo sapiens
tgcctaaaattttagatgtag

SEQ ID NO: 4425365 - DNA, 15 bp, Homo sapiens
tgcctaagtggctgc

SEQ ID NO: 4425366 - DNA, 15 bp, Homo sapiens
tgcctaataaagaga

SEQ ID NO: 4425367 - DNA, 19 bp, Homo sapiens
tgcctagactgttactttg

SEQ ID NO: 4425368 - DNA, 20 bp, Homo sapiens
tgcctagtgggagttaggac

SEQ ID NO: 4425369 - DNA, 20 bp, Homo sapiens
tgcctatatgagaagaatag

SEQ ID NO: 4425370 - DNA, 15 bp, Homo sapiens
tgcctattgtaatat

SEQ ID NO: 4425371 - DNA, 15 bp, Homo sapiens
tgcctcaccccttgc

SEQ ID NO: 4425372 - DNA, 16 bp, Homo sapiens
tgcctcactcctccgt

SEQ ID NO: 4425373 - DNA, 21 bp, Homo sapiens
tgcctcactcctccgtgagca

SEQ ID NO: 4425374 - DNA, 21 bp, Homo sapiens
tgcctcagacgttgcctgaga

SEQ ID NO: 4425375 - DNA, 23 bp, Homo sapiens
tgcctcagccacttgcctgtgct

SEQ ID NO: 4425376 - DNA, 14 bp, Homo sapiens
tgcctcagcctccc

SEQ ID NO: 4425377 - DNA, 16 bp, Homo sapiens
tgcctcagcctcccat

SEQ ID NO: 4425378 - DNA, 13 bp, Homo sapiens
tgcctcagctatg

SEQ ID NO: 4425379 - DNA, 16 bp, Homo sapiens
tgcctccaagttcaaa

SEQ ID NO: 4425380 - DNA, 15 bp, Homo sapiens
tgcctccaccctctg

SEQ ID NO: 4425381 - DNA, 16 bp, Homo sapiens
tgcctccaccctctga

SEQ ID NO: 4425382 - DNA, 11 bp, Homo sapiens
tgcctccaccg

SEQ ID NO: 4425383 - DNA, 18 bp, Homo sapiens
tgcctccaccgctgccta

SEQ ID NO: 4425384 - DNA, 20 bp, Homo sapiens
tgcctccaccgctgcctaag

SEQ ID NO: 4425385 - DNA, 16 bp, Homo sapiens
tgcctccagggctgga

SEQ ID NO: 4425386 - DNA, 23 bp, Homo sapiens
tgcctccagggctggactgaggc

SEQ ID NO: 4425387 - DNA, 16 bp, Homo sapiens
tgcctcccaggttcca

SEQ ID NO: 4425388 - DNA, 17 bp, Homo sapiens
tgcctcccattctgcac

SEQ ID NO: 4425389 - DNA, 22 bp, Homo sapiens
tgcctccccatttcccatctgc

SEQ ID NO: 4425390 - DNA, 12 bp, Homo sapiens
tgcctcccttga

SEQ ID NO: 4425391 - DNA, 19 bp, Homo sapiens
tgcctcccttgtggcagca

SEQ ID NO: 4425392 - DNA, 10 bp, Homo sapiens
tgcctcctgc

SEQ ID NO: 4425393 - DNA, 17 bp, Homo sapiens
tgcctcctgcgccctgt

SEQ ID NO: 4425394 - DNA, 13 bp, Homo sapiens
tgcctcctggcca

SEQ ID NO: 4425395 - DNA, 13 bp, Homo sapiens
tgcctcgaaacac

SEQ ID NO: 4425396 - DNA, 17 bp, Homo sapiens
tgcctcgaaacacagaa

SEQ ID NO: 4425397 - DNA, 19 bp, Homo sapiens
tgcctcgctcaccgctggc

SEQ ID NO: 4425398 - DNA, 16 bp, Homo sapiens
tgcctcggctcacaaa

SEQ ID NO: 4425399 - DNA, 20 bp, Homo sapiens
tgcctctaagctgctctaaa

SEQ ID NO: 4425400 - DNA, 17 bp, Homo sapiens
tgcctctacctgacact

SEQ ID NO: 4425401 - DNA, 19 bp, Homo sapiens
tgcctctgacagtccacag

SEQ ID NO: 4425402 - DNA, 16 bp, Homo sapiens
tgcctctgaccccagc

SEQ ID NO: 4425403 - DNA, 14 bp, Homo sapiens
tgcctctgcagtct

SEQ ID NO: 4425404 - DNA, 14 bp, Homo sapiens
tgcctctgccctgg

SEQ ID NO: 4425405 - DNA, 12 bp, Homo sapiens
tgcctctgctcc

SEQ ID NO: 4425406 - DNA, 15 bp, Homo sapiens
tgcctctgctccctc

SEQ ID NO: 4425407 - DNA, 14 bp, Homo sapiens
tgcctctgtcccct

SEQ ID NO: 4425408 - DNA, 21 bp, Homo sapiens
tgcctcttctttgtgcctttg

SEQ ID NO: 4425409 - DNA, 17 bp, Homo sapiens
tgcctcttgtgtccctg

SEQ ID NO: 4425410 - DNA, 18 bp, Homo sapiens
tgcctcttttacctgctg

SEQ ID NO: 4425411 - DNA, 15 bp, Homo sapiens
tgcctgaactccaga

SEQ ID NO: 4425412 - DNA, 16 bp, Homo sapiens
tgcctgaactccagag

SEQ ID NO: 4425413 - DNA, 18 bp, Homo sapiens
tgcctgacatttggagtg

SEQ ID NO: 4425414 - DNA, 16 bp, Homo sapiens
tgcctgactaattttt

SEQ ID NO: 4425415 - DNA, 14 bp, Homo sapiens
tgcctgagaagaag

SEQ ID NO: 4425416 - DNA, 23 bp, Homo sapiens
tgcctgagaagaagtggctgcca

SEQ ID NO: 4425417 - DNA, 17 bp, Homo sapiens
tgcctgagaccagggtg

SEQ ID NO: 4425418 - DNA, 19 bp, Homo sapiens
tgcctgagaccagggtggc

SEQ ID NO: 4425419 - DNA, 22 bp, Homo sapiens
tgcctgagaccagggtggccac

SEQ ID NO: 4425420 - DNA, 23 bp, Homo sapiens
tgcctgagaccagggtggccaca

SEQ ID NO: 4425421 - DNA, 14 bp, Homo sapiens
tgcctgagaggcag

SEQ ID NO: 4425422 - DNA, 17 bp, Homo sapiens
tgcctgagaggcaggca

SEQ ID NO: 4425423 - DNA, 23 bp, Homo sapiens
tgatttccttgaatgtggcttga

SEQ ID NO: 4425424 - DNA, 22 bp, Homo sapiens
tgatttgagttgattgagaaga

SEQ ID NO: 4425425 - DNA, 22 bp, Homo sapiens
tgatttgggaagttaggcaaat

SEQ ID NO: 4425426 - DNA, 12 bp, Homo sapiens
tgattttaatgg

SEQ ID NO: 4425427 - DNA, 13 bp, Homo sapiens
tgattttaattac

SEQ ID NO: 4425428 - DNA, 16 bp, Homo sapiens
tgatttttaagatttc

SEQ ID NO: 4425429 - DNA, 23 bp, Homo sapiens
tgatttttataaatactgcaaat

SEQ ID NO: 4425430 - DNA, 17 bp, Homo sapiens
tgattttttttaattac

SEQ ID NO: 4425431 - DNA, 14 bp, Homo sapiens
tgcaaaaataatca

SEQ ID NO: 4425432 - DNA, 20 bp, Homo sapiens
tgcaaaaattcagagtcctt

SEQ ID NO: 4425433 - DNA, 22 bp, Homo sapiens
tgcaaaaggactctcaggacca

SEQ ID NO: 4425434 - DNA, 15 bp, Homo sapiens
tgcaaaaggaggtga

SEQ ID NO: 4425435 - DNA, 22 bp, Homo sapiens
tgcaaaatctgttatagcttta

SEQ ID NO: 4425436 - DNA, 21 bp, Homo sapiens
tgcaaaattaaatctagacat

SEQ ID NO: 4425437 - DNA, 22 bp, Homo sapiens
tgcaaaattaaatctagacatt

SEQ ID NO: 4425438 - DNA, 13 bp, Homo sapiens
tgcaaacagtaac

SEQ ID NO: 4425439 - DNA, 22 bp, Homo sapiens
tgcaaacctgacccctgctcag

SEQ ID NO: 4425440 - DNA, 22 bp, Homo sapiens
tgcaaacctgcagtttttaatt

SEQ ID NO: 4425441 - DNA, 14 bp, Homo sapiens
tgcaaaccttcctg

SEQ ID NO: 4425442 - DNA, 15 bp, Homo sapiens
tgcaaaccttcctgg

SEQ ID NO: 4425443 - DNA, 17 bp, Homo sapiens
tgcaaaccttcctggga

SEQ ID NO: 4425444 - DNA, 17 bp, Homo sapiens
tgcaaacgttggagttt

SEQ ID NO: 4425445 - DNA, 16 bp, Homo sapiens
tgcaaactgctttatt

SEQ ID NO: 4425446 - DNA, 21 bp, Homo sapiens
tgcaaactgctttattttccc

SEQ ID NO: 4425447 - DNA, 17 bp, Homo sapiens
tgcaaagagacatttca

SEQ ID NO: 4425448 - DNA, 12 bp, Homo sapiens
tgcaaagtattg

SEQ ID NO: 4425449 - DNA, 19 bp, Homo sapiens
tgcaaagtggaattaaagg

SEQ ID NO: 4425450 - DNA, 23 bp, Homo sapiens
tgcaaatactgtatattcaggac

SEQ ID NO: 4425451 - DNA, 15 bp, Homo sapiens
tgcaaatagaaaaca

SEQ ID NO: 4425452 - DNA, 18 bp, Homo sapiens
tgcaaatatactttactt

SEQ ID NO: 4425453 - DNA, 21 bp, Homo sapiens
tgcaaatatactttacttttt

SEQ ID NO: 4425454 - DNA, 23 bp, Homo sapiens
tgcaaatattagcaaagaagctt

SEQ ID NO: 4425455 - DNA, 17 bp, Homo sapiens
tgcaaatggagataaaa

SEQ ID NO: 4425456 - DNA, 20 bp, Homo sapiens
tgcaaatgggagctgagcag

SEQ ID NO: 4425457 - DNA, 11 bp, Homo sapiens
tgcaaattgtg

SEQ ID NO: 4425458 - DNA, 15 bp, Homo sapiens
tgcaaatttagtttg

SEQ ID NO: 4425459 - DNA, 18 bp, Homo sapiens
tgcaaatttagtttgtta

SEQ ID NO: 4425460 - DNA, 14 bp, Homo sapiens
tgcaaatttctata

SEQ ID NO: 4425461 - DNA, 16 bp, Homo sapiens
tgcaaatttctataaa

SEQ ID NO: 4425462 - DNA, 19 bp, Homo sapiens
tgcaaatttctataaattt

SEQ ID NO: 4425463 - DNA, 14 bp, Homo sapiens
tgcaacaaaatgta

SEQ ID NO: 4425464 - DNA, 16 bp, Homo sapiens
tgcaacaaaatgtaga

SEQ ID NO: 4425465 - DNA, 17 bp, Homo sapiens
tgcaacaaaatgtagaa

SEQ ID NO: 4425466 - DNA, 22 bp, Homo sapiens
tgcaacaggaggctttttcagt

SEQ ID NO: 4425467 - DNA, 14 bp, Homo sapiens
tgcaacaggcttgt

SEQ ID NO: 4425468 - DNA, 17 bp, Homo sapiens
tgcaaccaggaacagca

SEQ ID NO: 4425469 - DNA, 16 bp, Homo sapiens
tgcaacccaaggactg

SEQ ID NO: 4425470 - DNA, 21 bp, Homo sapiens
tgcaacccaaggactgaggga

SEQ ID NO: 4425471 - DNA, 17 bp, Homo sapiens
tgcaacccttacccctt

SEQ ID NO: 4425472 - DNA, 16 bp, Homo sapiens
tgcaaccgtctgttat

SEQ ID NO: 4425473 - DNA, 13 bp, Homo sapiens
tgcaacctcacct

SEQ ID NO: 4425474 - DNA, 17 bp, Homo sapiens
tgcaacctcaccttcct

SEQ ID NO: 4425475 - DNA, 18 bp, Homo sapiens
tgcaacctcaccttcctg

SEQ ID NO: 4425476 - DNA, 19 bp, Homo sapiens
tgcaacctcaccttcctgt

SEQ ID NO: 4425477 - DNA, 14 bp, Homo sapiens
tgcaacctcgctgg

SEQ ID NO: 4425478 - DNA, 16 bp, Homo sapiens
tgcaacctctgcctcc

SEQ ID NO: 4425479 - DNA, 22 bp, Homo sapiens
tgcaacgcaggaggagaaaaga

SEQ ID NO: 4425480 - DNA, 19 bp, Homo sapiens
tgcaacgggattgaagggt

SEQ ID NO: 4425481 - DNA, 22 bp, Homo sapiens
tgcaactaactgactctgttat

SEQ ID NO: 4425482 - DNA, 21 bp, Homo sapiens
tgcaactcttttaagtgcctt

SEQ ID NO: 4425483 - DNA, 19 bp, Homo sapiens
tgcaactggagttccttat

SEQ ID NO: 4425484 - DNA, 16 bp, Homo sapiens
tgcaactttttaaagt

SEQ ID NO: 4425485 - DNA, 16 bp, Homo sapiens
tgcaagaatgaaatga

SEQ ID NO: 4425486 - DNA, 20 bp, Homo sapiens
tgcaagaatgaaatgaatga

SEQ ID NO: 4425487 - DNA, 14 bp, Homo sapiens
tgcaagagccttgg

SEQ ID NO: 4425488 - DNA, 13 bp, Homo sapiens
tgcaagagtggac

SEQ ID NO: 4425489 - DNA, 22 bp, Homo sapiens
tgcaagatggacacgagccaca

SEQ ID NO: 4425490 - DNA, 16 bp, Homo sapiens
tgcaagcactcggggt

SEQ ID NO: 4425491 - DNA, 18 bp, Homo sapiens
tgcaagccttctaaatga

SEQ ID NO: 4425492 - DNA, 19 bp, Homo sapiens
tgcaagctccgcctcccgg

SEQ ID NO: 4425493 - DNA, 23 bp, Homo sapiens
tgcaaggccgctgttcacccaca

SEQ ID NO: 4425494 - DNA, 17 bp, Homo sapiens
tgcaaggcggtacacta

SEQ ID NO: 4425495 - DNA, 11 bp, Homo sapiens
tgcaagggaaa

SEQ ID NO: 4425496 - DNA, 18 bp, Homo sapiens
tgcaagggaagagccttt

SEQ ID NO: 4425497 - DNA, 20 bp, Homo sapiens
tgcaagggcagaacactaac

SEQ ID NO: 4425498 - DNA, 21 bp, Homo sapiens
tgcaagggcagaacactaacc

SEQ ID NO: 4425499 - DNA, 17 bp, Homo sapiens
tgcaagtctgtggcccc

SEQ ID NO: 4425500 - DNA, 15 bp, Homo sapiens
tgcaataacaagcat

SEQ ID NO: 4425501 - DNA, 17 bp, Homo sapiens
tgcaataacaagcatgc

SEQ ID NO: 4425502 - DNA, 15 bp, Homo sapiens
tgcaataactctggg

SEQ ID NO: 4425503 - DNA, 16 bp, Homo sapiens
tgcaataactctggga

SEQ ID NO: 4425504 - DNA, 16 bp, Homo sapiens
tgcaataatgcagtat

SEQ ID NO: 4425505 - DNA, 18 bp, Homo sapiens
tgcaataatgcagtatgg

SEQ ID NO: 4425506 - DNA, 14 bp, Homo sapiens
tgcaatacatacca

SEQ ID NO: 4425507 - DNA, 16 bp, Homo sapiens
tgcaatagaaggtgat

SEQ ID NO: 4425508 - DNA, 18 bp, Homo sapiens
tgcaatagattactgatg

SEQ ID NO: 4425509 - DNA, 19 bp, Homo sapiens
tgcaatagcagttataaca

SEQ ID NO: 4425510 - DNA, 17 bp, Homo sapiens
tgcaatccaaataaaga

SEQ ID NO: 4425511 - DNA, 17 bp, Homo sapiens
tgcaatccaatgcactg

SEQ ID NO: 4425512 - DNA, 15 bp, Homo sapiens
tgcaatccaggctgt

SEQ ID NO: 4425513 - DNA, 16 bp, Homo sapiens
tgcaatccaggctgtt

SEQ ID NO: 4425514 - DNA, 22 bp, Homo sapiens
tgcaatccatttatttcattta

SEQ ID NO: 4425515 - DNA, 18 bp, Homo sapiens
tgcaatctaatctgaact

SEQ ID NO: 4425516 - DNA, 19 bp, Homo sapiens
tgcaatctaatctgaactg

SEQ ID NO: 4425517 - DNA, 12 bp, Homo sapiens
tgcaatctactg

SEQ ID NO: 4425518 - DNA, 13 bp, Homo sapiens
tgcaatctactgg

SEQ ID NO: 4425519 - DNA, 22 bp, Homo sapiens
tgcaatgtaaatattttaaaga

SEQ ID NO: 4425520 - DNA, 20 bp, Homo sapiens
tgcaattaaacttccaaaga

SEQ ID NO: 4425521 - DNA, 23 bp, Homo sapiens
tgcaattaaacttccaaagaaag

SEQ ID NO: 4425522 - DNA, 24 bp, Homo sapiens
tgcaattaaacttccaaagaaagt

SEQ ID NO: 4425523 - DNA, 17 bp, Homo sapiens
tgcaatttgtaaatatt

SEQ ID NO: 4425524 - DNA, 16 bp, Homo sapiens
tgcaattttactgtga

SEQ ID NO: 4425525 - DNA, 20 bp, Homo sapiens
tgcacaaacttgtgagcatc

SEQ ID NO: 4425526 - DNA, 12 bp, Homo sapiens
tgcacaaataca

SEQ ID NO: 4425527 - DNA, 18 bp, Homo sapiens
tgcacaaggattgaaaat

SEQ ID NO: 4425528 - DNA, 20 bp, Homo sapiens
tgcacaagttccctggagaa

SEQ ID NO: 4425529 - DNA, 21 bp, Homo sapiens
tgcacacaaaaataaagacta

SEQ ID NO: 4425530 - DNA, 13 bp, Homo sapiens
tgcacacagagtg

SEQ ID NO: 4425531 - DNA, 21 bp, Homo sapiens
tgcacacagatgtgaaatgaa

SEQ ID NO: 4425532 - DNA, 20 bp, Homo sapiens
tgcacaccctccagagacaa

SEQ ID NO: 4425533 - DNA, 13 bp, Homo sapiens
tgcacaccctggg

SEQ ID NO: 4425534 - DNA, 18 bp, Homo sapiens
tgcacactgagaatgcta

SEQ ID NO: 4425535 - DNA, 14 bp, Homo sapiens
tgcacactttgcca

SEQ ID NO: 4425536 - DNA, 13 bp, Homo sapiens
tgcacactttggc

SEQ ID NO: 4425537 - DNA, 21 bp, Homo sapiens
tgcacactttggcccagggtg

SEQ ID NO: 4425538 - DNA, 21 bp, Homo sapiens
tgcacagcaggctgccagtgc

SEQ ID NO: 4425539 - DNA, 21 bp, Homo sapiens
tgcacagccaacgagacacat

SEQ ID NO: 4425540 - DNA, 19 bp, Homo sapiens
tgcacaggcacacagggcc

SEQ ID NO: 4425541 - DNA, 19 bp, Homo sapiens
tgcacagggattctcacaa

SEQ ID NO: 4425542 - DNA, 15 bp, Homo sapiens
tgcacagggcagctg

SEQ ID NO: 4425543 - DNA, 20 bp, Homo sapiens
tgcacagtatttgtaattaa

SEQ ID NO: 4425544 - DNA, 12 bp, Homo sapiens
tgcacagtcaga

SEQ ID NO: 4425545 - DNA, 16 bp, Homo sapiens
tgcacagtcagaagga

SEQ ID NO: 4425546 - DNA, 18 bp, Homo sapiens
tgcacatattgagaacct

SEQ ID NO: 4425547 - DNA, 15 bp, Homo sapiens
tgcacatctgtgtct

SEQ ID NO: 4425548 - DNA, 19 bp, Homo sapiens
tgcacatctgtgtcttgtt

SEQ ID NO: 4425549 - DNA, 20 bp, Homo sapiens
tgcacatgccccttggtcct

SEQ ID NO: 4425550 - DNA, 16 bp, Homo sapiens
tgcacatgctgtctgg

SEQ ID NO: 4425551 - DNA, 19 bp, Homo sapiens
tgcacatgctgtctggccc

SEQ ID NO: 4425552 - DNA, 12 bp, Homo sapiens
tgcacatggcct

SEQ ID NO: 4425553 - DNA, 17 bp, Homo sapiens
tgcacatggcctgagca

SEQ ID NO: 4425554 - DNA, 13 bp, Homo sapiens
tgcacatttattt

SEQ ID NO: 4425555 - DNA, 22 bp, Homo sapiens
tgcacatttatttcctccctct

SEQ ID NO: 4425556 - DNA, 22 bp, Homo sapiens
tgcaccaagcaggaaatgaaaa

SEQ ID NO: 4425557 - DNA, 23 bp, Homo sapiens
tgcaccaatcttgtttatagcaa

SEQ ID NO: 4425558 - DNA, 14 bp, Homo sapiens
tgcaccacacctgg

SEQ ID NO: 4425559 - DNA, 19 bp, Homo sapiens
tgcaccacacctggcatgg

SEQ ID NO: 4425560 - DNA, 22 bp, Homo sapiens
tgcaccacggcgtttttttaca

SEQ ID NO: 4425561 - DNA, 20 bp, Homo sapiens
tgcaccaggggtgcacaata

SEQ ID NO: 4425562 - DNA, 14 bp, Homo sapiens
tgcacccagaacag

SEQ ID NO: 4425563 - DNA, 15 bp, Homo sapiens
tgcacccagaagaag

SEQ ID NO: 4425564 - DNA, 13 bp, Homo sapiens
tgcacccagccct

SEQ ID NO: 4425565 - DNA, 14 bp, Homo sapiens
tgcacccagccctg

SEQ ID NO: 4425566 - DNA, 17 bp, Homo sapiens
tgcacccagccctggtc

SEQ ID NO: 4425567 - DNA, 20 bp, Homo sapiens
tgcacccatcagcactctgt

SEQ ID NO: 4425568 - DNA, 18 bp, Homo sapiens
tgcacccatgggctctga

SEQ ID NO: 4425569 - DNA, 20 bp, Homo sapiens
tgcacccatgggctctgaca

SEQ ID NO: 4425570 - DNA, 12 bp, Homo sapiens
tgcaccccagca

SEQ ID NO: 4425571 - DNA, 22 bp, Homo sapiens
tgcaccccagcattccagctct

SEQ ID NO: 4425572 - DNA, 23 bp, Homo sapiens
tgcacccctgagttgggcagcca

SEQ ID NO: 4425573 - DNA, 20 bp, Homo sapiens
tgcaccccttctctcctccc

SEQ ID NO: 4425574 - DNA, 20 bp, Homo sapiens
tgcacccttccacagctggc

SEQ ID NO: 4425575 - DNA, 22 bp, Homo sapiens
tgcaccggggcctgggcaggag

SEQ ID NO: 4425576 - DNA, 21 bp, Homo sapiens
tgcacctaaagaaaaacaaac

SEQ ID NO: 4425577 - DNA, 20 bp, Homo sapiens
tgcacctatctcagccatag

SEQ ID NO: 4425578 - DNA, 13 bp, Homo sapiens
tgcacctccccaa

SEQ ID NO: 4425579 - DNA, 15 bp, Homo sapiens
tgcacctccccaaag

SEQ ID NO: 4425580 - DNA, 15 bp, Homo sapiens
tgcacctccccccac

SEQ ID NO: 4425581 - DNA, 19 bp, Homo sapiens
tgcacctccccccactgca

SEQ ID NO: 4425582 - DNA, 20 bp, Homo sapiens
tgcacctcctaccctcccac

SEQ ID NO: 4425583 - DNA, 18 bp, Homo sapiens
tgcacctgcatccgtagt

SEQ ID NO: 4425584 - DNA, 13 bp, Homo sapiens
tgcacctgccccg

SEQ ID NO: 4425585 - DNA, 13 bp, Homo sapiens
tgcaccttagaaa

SEQ ID NO: 4425586 - DNA, 20 bp, Homo sapiens
tgcaccttagaaaaaaaaag

SEQ ID NO: 4425587 - DNA, 13 bp, Homo sapiens
tgcacgcagatta

SEQ ID NO: 4425588 - DNA, 16 bp, Homo sapiens
tgcacgtggagagctg

SEQ ID NO: 4425589 - DNA, 21 bp, Homo sapiens
tgcacgtggagagctggtgcc

SEQ ID NO: 4425590 - DNA, 12 bp, Homo sapiens
tgcactccagcc

SEQ ID NO: 4425591 - DNA, 15 bp, Homo sapiens
tgcactcccacctga

SEQ ID NO: 4425592 - DNA, 21 bp, Homo sapiens
tgcactctgtagcaaatttgt

SEQ ID NO: 4425593 - DNA, 19 bp, Homo sapiens
tgcactgaagagagcattt

SEQ ID NO: 4425594 - DNA, 17 bp, Homo sapiens
tgcactgaagagctctt

SEQ ID NO: 4425595 - DNA, 19 bp, Homo sapiens
tgcactgaagagctcttgg

SEQ ID NO: 4425596 - DNA, 13 bp, Homo sapiens
tgcactgtaaata

SEQ ID NO: 4425597 - DNA, 14 bp, Homo sapiens
tgcactgtaaatat

SEQ ID NO: 4425598 - DNA, 16 bp, Homo sapiens
tgcactgtcaagatga

SEQ ID NO: 4425599 - DNA, 14 bp, Homo sapiens
tgcactgttccccc

SEQ ID NO: 4425600 - DNA, 13 bp, Homo sapiens
tgcactgtttgca

SEQ ID NO: 4425601 - DNA, 16 bp, Homo sapiens
tgcactttaaatggaa

SEQ ID NO: 4425602 - DNA, 20 bp, Homo sapiens
tgcactttccaatgccacag

SEQ ID NO: 4425603 - DNA, 20 bp, Homo sapiens
tgcactttctatcctctgta

SEQ ID NO: 4425604 - DNA, 19 bp, Homo sapiens
tgcactttgatgtcatgtg

SEQ ID NO: 4425605 - DNA, 20 bp, Homo sapiens
tgcactttgatgtcatgtgt

SEQ ID NO: 4425606 - DNA, 14 bp, Homo sapiens
tgcactttgtaaat

SEQ ID NO: 4425607 - DNA, 15 bp, Homo sapiens
tgcactttgtaaatt

SEQ ID NO: 4425608 - DNA, 17 bp, Homo sapiens
tgcactttgtaaattcc

SEQ ID NO: 4425609 - DNA, 13 bp, Homo sapiens
tgcactttgtagt

SEQ ID NO: 4425610 - DNA, 17 bp, Homo sapiens
tgcactttgtttagaaa

SEQ ID NO: 4425611 - DNA, 18 bp, Homo sapiens
tgcactttgtttagaaaa

SEQ ID NO: 4425612 - DNA, 20 bp, Homo sapiens
tgcacttttatgaagttttt

SEQ ID NO: 4425613 - DNA, 22 bp, Homo sapiens
tgcacttttttgtttgaatgtt

SEQ ID NO: 4425614 - DNA, 18 bp, Homo sapiens
tgcagaaaagcacctgcc

SEQ ID NO: 4425615 - DNA, 16 bp, Homo sapiens
tgcagaaaatatttaa

SEQ ID NO: 4425616 - DNA, 17 bp, Homo sapiens
tgcagaaaattctgtgc

SEQ ID NO: 4425617 - DNA, 18 bp, Homo sapiens
tgcagaaaattctgtgcc

SEQ ID NO: 4425618 - DNA, 20 bp, Homo sapiens
tgcagaaagcatccctcacc

SEQ ID NO: 4425619 - DNA, 19 bp, Homo sapiens
tgcagaacttaatctggac

SEQ ID NO: 4425620 - DNA, 17 bp, Homo sapiens
tgcagaagaaggcatcg

SEQ ID NO: 4425621 - DNA, 15 bp, Homo sapiens
tgcagaagacagtat

SEQ ID NO: 4425622 - DNA, 20 bp, Homo sapiens
tgcagaagttcttagtgttg

SEQ ID NO: 4425623 - DNA, 17 bp, Homo sapiens
tgcagacacctggactg

SEQ ID NO: 4425624 - DNA, 15 bp, Homo sapiens
tgcagacctcaagcc

SEQ ID NO: 4425625 - DNA, 17 bp, Homo sapiens
tgcagacctcaagccat

SEQ ID NO: 4425626 - DNA, 18 bp, Homo sapiens
tgcagacctgtcctcctg

SEQ ID NO: 4425627 - DNA, 21 bp, Homo sapiens
tgcagacctgtcctcctggtg

SEQ ID NO: 4425628 - DNA, 21 bp, Homo sapiens
tgcagacggatgcccattcct

SEQ ID NO: 4425629 - DNA, 16 bp, Homo sapiens
tgcagacttcccagct

SEQ ID NO: 4425630 - DNA, 22 bp, Homo sapiens
tgcagacttcccagctaggaag

SEQ ID NO: 4425631 - DNA, 15 bp, Homo sapiens
tgcagagaaagaaag

SEQ ID NO: 4425632 - DNA, 20 bp, Homo sapiens
tgcagagaaagaaagggaaa

SEQ ID NO: 4425633 - DNA, 17 bp, Homo sapiens
tgcagagccttctcaga

SEQ ID NO: 4425634 - DNA, 19 bp, Homo sapiens
tgcagagccttctcagaag

SEQ ID NO: 4425635 - DNA, 15 bp, Homo sapiens
tgcagataaaatatt

SEQ ID NO: 4425636 - DNA, 21 bp, Homo sapiens
tgcagatcttccgtggtcaga

SEQ ID NO: 4425637 - DNA, 15 bp, Homo sapiens
tgcagattacactga

SEQ ID NO: 4425638 - DNA, 18 bp, Homo sapiens
tgcagattctgagcaaag

SEQ ID NO: 4425639 - DNA, 23 bp, Homo sapiens
tgcagattctgagcaaaggccct

SEQ ID NO: 4425640 - DNA, 20 bp, Homo sapiens
tgcagcaaatatatgattct

SEQ ID NO: 4425641 - DNA, 20 bp, Homo sapiens
tgcagcaactcccacgactg

SEQ ID NO: 4425642 - DNA, 13 bp, Homo sapiens
tgcagcagaggac

SEQ ID NO: 4425643 - DNA, 14 bp, Homo sapiens
tgcagcagaggaca

SEQ ID NO: 4425644 - DNA, 15 bp, Homo sapiens
tgcagcagaggacag

SEQ ID NO: 4425645 - DNA, 22 bp, Homo sapiens
tgcagcagaggacagtctggag

SEQ ID NO: 4425646 - DNA, 12 bp, Homo sapiens
tgcagcagataa

SEQ ID NO: 4425647 - DNA, 16 bp, Homo sapiens
tgcagcagataacttt

SEQ ID NO: 4425648 - DNA, 19 bp, Homo sapiens
tgcagcagataactttttt

SEQ ID NO: 4425649 - DNA, 18 bp, Homo sapiens
tgcagcatttgataatga

SEQ ID NO: 4425650 - DNA, 13 bp, Homo sapiens
tgcagccagccca

SEQ ID NO: 4425651 - DNA, 14 bp, Homo sapiens
tgcagccagcccag

SEQ ID NO: 4425652 - DNA, 16 bp, Homo sapiens
tgcagccagcccagcc

SEQ ID NO: 4425653 - DNA, 19 bp, Homo sapiens
tgcagccagcccagcccag

SEQ ID NO: 4425654 - DNA, 21 bp, Homo sapiens
tgcagccagcccagcccagct

SEQ ID NO: 4425655 - DNA, 14 bp, Homo sapiens
tgcagccagggctg

SEQ ID NO: 4425656 - DNA, 16 bp, Homo sapiens
tgcagcccaccagacg

SEQ ID NO: 4425657 - DNA, 22 bp, Homo sapiens
tgcagcccaccagacgtcaggc

SEQ ID NO: 4425658 - DNA, 12 bp, Homo sapiens
tgcagcccatgc

SEQ ID NO: 4425659 - DNA, 13 bp, Homo sapiens
tgcagcccatgcc

SEQ ID NO: 4425660 - DNA, 18 bp, Homo sapiens
tgcagcccatgcccacct

SEQ ID NO: 4425661 - DNA, 23 bp, Homo sapiens
tgcagcctaaagtacagcctgga

SEQ ID NO: 4425662 - DNA, 16 bp, Homo sapiens
tgcagccttcccctcc

SEQ ID NO: 4425663 - DNA, 15 bp, Homo sapiens
tgcagcggctgccct

SEQ ID NO: 4425664 - DNA, 16 bp, Homo sapiens
tgcagcggctgccctc

SEQ ID NO: 4425665 - DNA, 22 bp, Homo sapiens
tgcagctgcttttgcagaaatc

SEQ ID NO: 4425666 - DNA, 18 bp, Homo sapiens
tgcagctggaatgtgcca

SEQ ID NO: 4425667 - DNA, 20 bp, Homo sapiens
tgcagctgtggcagagttac

SEQ ID NO: 4425668 - DNA, 22 bp, Homo sapiens
tgcagcttcacccaccaggcca

SEQ ID NO: 4425669 - DNA, 15 bp, Homo sapiens
tgcagcttcgaggac

SEQ ID NO: 4425670 - DNA, 18 bp, Homo sapiens
tgcagcttcgaggacagg

SEQ ID NO: 4425671 - DNA, 19 bp, Homo sapiens
tgcagcttttggttaatat

SEQ ID NO: 4425672 - DNA, 20 bp, Homo sapiens
tgcagcttttggttaatatg

SEQ ID NO: 4425673 - DNA, 21 bp, Homo sapiens
tgcaggagagagcagcactcc

SEQ ID NO: 4425674 - DNA, 15 bp, Homo sapiens
tgcaggagcccccct

SEQ ID NO: 4425675 - DNA, 18 bp, Homo sapiens
tgcaggatctgtctgtgc

SEQ ID NO: 4425676 - DNA, 14 bp, Homo sapiens
tgcaggcagagctg

SEQ ID NO: 4425677 - DNA, 19 bp, Homo sapiens
tgcaggcagagctggagcc

SEQ ID NO: 4425678 - DNA, 15 bp, Homo sapiens
tgcaggcagcacagc

SEQ ID NO: 4425679 - DNA, 19 bp, Homo sapiens
tgcaggcaggaacaaacag

SEQ ID NO: 4425680 - DNA, 20 bp, Homo sapiens
tgcaggcaggaacaaacagg

SEQ ID NO: 4425681 - DNA, 19 bp, Homo sapiens
tgcaggcctgtccctggga

SEQ ID NO: 4425682 - DNA, 21 bp, Homo sapiens
tgcaggcctgtccctgggagt

SEQ ID NO: 4425683 - DNA, 19 bp, Homo sapiens
tgcaggctgcagtggctcc

SEQ ID NO: 4425684 - DNA, 14 bp, Homo sapiens
tgcaggctggggag

SEQ ID NO: 4425685 - DNA, 21 bp, Homo sapiens
tgcagggagacatctgcaccc

SEQ ID NO: 4425686 - DNA, 19 bp, Homo sapiens
tgcagggagccttctgcca

SEQ ID NO: 4425687 - DNA, 16 bp, Homo sapiens
tgcagggaggggaggc

SEQ ID NO: 4425688 - DNA, 17 bp, Homo sapiens
tgcagggatattgcctt

SEQ ID NO: 4425689 - DNA, 18 bp, Homo sapiens
tgcagggatattgcctta

SEQ ID NO: 4425690 - DNA, 19 bp, Homo sapiens
tgcagggatattgccttat

SEQ ID NO: 4425691 - DNA, 22 bp, Homo sapiens
tgcagggcaaaatattcactgg

SEQ ID NO: 4425692 - DNA, 22 bp, Homo sapiens
tgcagggtcctcttctgggcct

SEQ ID NO: 4425693 - DNA, 18 bp, Homo sapiens
tgcaggtctccacctgca

SEQ ID NO: 4425694 - DNA, 19 bp, Homo sapiens
tgcaggtctccacctgcac

SEQ ID NO: 4425695 - DNA, 21 bp, Homo sapiens
tgcaggtctttaaatcatttt

SEQ ID NO: 4425696 - DNA, 22 bp, Homo sapiens
tgcaggtctttaaatcatttta

SEQ ID NO: 4425697 - DNA, 13 bp, Homo sapiens
tgcaggtggggag

SEQ ID NO: 4425698 - DNA, 12 bp, Homo sapiens
tgcaggttccca

SEQ ID NO: 4425699 - DNA, 18 bp, Homo sapiens
tgcaggtttgacacgcag

SEQ ID NO: 4425700 - DNA, 18 bp, Homo sapiens
tgcagtaaatcttttaca

SEQ ID NO: 4425701 - DNA, 14 bp, Homo sapiens
tgcagtacagaatt

SEQ ID NO: 4425702 - DNA, 18 bp, Homo sapiens
tgcagtactttgtgcatt

SEQ ID NO: 4425703 - DNA, 14 bp, Homo sapiens
tgcagtatatttct

SEQ ID NO: 4425704 - DNA, 15 bp, Homo sapiens
tgcagtcacctcttc

SEQ ID NO: 4425705 - DNA, 19 bp, Homo sapiens
tgcagtcctgatcagagcc

SEQ ID NO: 4425706 - DNA, 21 bp, Homo sapiens
tgcagtctcctctttaaaaca

SEQ ID NO: 4425707 - DNA, 23 bp, Homo sapiens
tgcagtctcctctttaaaacaaa

SEQ ID NO: 4425708 - DNA, 13 bp, Homo sapiens
tgcagtgagctga

SEQ ID NO: 4425709 - DNA, 23 bp, Homo sapiens
tgcagtgccttggggaatttcct

SEQ ID NO: 4425710 - DNA, 13 bp, Homo sapiens
tgcagtggcctga

SEQ ID NO: 4425711 - DNA, 20 bp, Homo sapiens
tgcagtggctcccctgccca

SEQ ID NO: 4425712 - DNA, 19 bp, Homo sapiens
tgcagtggtattaattttg

SEQ ID NO: 4425713 - DNA, 15 bp, Homo sapiens
tgcagtgtttttcct

SEQ ID NO: 4425714 - DNA, 12 bp, Homo sapiens
tgcagttgctgt

SEQ ID NO: 4425715 - DNA, 18 bp, Homo sapiens
tgcagttggactctcagg

SEQ ID NO: 4425716 - DNA, 17 bp, Homo sapiens
tgcagtttatcattcaa

SEQ ID NO: 4425717 - DNA, 14 bp, Homo sapiens
tgcagtttcttgtg

SEQ ID NO: 4425718 - DNA, 21 bp, Homo sapiens
tgcagtttcttgtgtagattt

SEQ ID NO: 4425719 - DNA, 12 bp, Homo sapiens
tgcagtttcttt

SEQ ID NO: 4425720 - DNA, 15 bp, Homo sapiens
tgcagtttcttttca

SEQ ID NO: 4425721 - DNA, 11 bp, Homo sapiens
tgcagtttgaa

SEQ ID NO: 4425722 - DNA, 12 bp, Homo sapiens
tgcagtttttaa

SEQ ID NO: 4425723 - DNA, 17 bp, Homo sapiens
tgcagtttttaaaaacc

SEQ ID NO: 4425724 - DNA, 17 bp, Homo sapiens
tgcataaatcaatggtt

SEQ ID NO: 4425725 - DNA, 16 bp, Homo sapiens
tgcataaatgcataat

SEQ ID NO: 4425726 - DNA, 17 bp, Homo sapiens
tgcataacaattcctct

SEQ ID NO: 4425727 - DNA, 18 bp, Homo sapiens
tgcataacaattcctcta

SEQ ID NO: 4425728 - DNA, 18 bp, Homo sapiens
tgcataatgctttggaaa

SEQ ID NO: 4425729 - DNA, 20 bp, Homo sapiens
tgcataatgctttggaaaaa

SEQ ID NO: 4425730 - DNA, 14 bp, Homo sapiens
tgcataatgtttaa

SEQ ID NO: 4425731 - DNA, 14 bp, Homo sapiens
tgcataatttatgg

SEQ ID NO: 4425732 - DNA, 22 bp, Homo sapiens
tgcatacactttttctctttcc

SEQ ID NO: 4425733 - DNA, 18 bp, Homo sapiens
tgcatacaggggaggggc

SEQ ID NO: 4425734 - DNA, 22 bp, Homo sapiens
tgcatactttttaaatgtaaag

SEQ ID NO: 4425735 - DNA, 13 bp, Homo sapiens
tgcatagacaaag

SEQ ID NO: 4425736 - DNA, 14 bp, Homo sapiens
tgcatagacaaagg

SEQ ID NO: 4425737 - DNA, 18 bp, Homo sapiens
tgcatagttgtagacaaa

SEQ ID NO: 4425738 - DNA, 16 bp, Homo sapiens
tgcatatgttacaatt

SEQ ID NO: 4425739 - DNA, 21 bp, Homo sapiens
tgcatatgttttccacataaa

SEQ ID NO: 4425740 - DNA, 22 bp, Homo sapiens
tgcatatgttttccacataaat

SEQ ID NO: 4425741 - DNA, 16 bp, Homo sapiens
tgcatatttagctgtt

SEQ ID NO: 4425742 - DNA, 16 bp, Homo sapiens
tgcatatttgttactt

SEQ ID NO: 4425743 - DNA, 17 bp, Homo sapiens
tgcatatttgttacttt

SEQ ID NO: 4425744 - DNA, 15 bp, Homo sapiens
tgcatatttgtttat

SEQ ID NO: 4425745 - DNA, 15 bp, Homo sapiens
tgcatattttgagaa

SEQ ID NO: 4425746 - DNA, 18 bp, Homo sapiens
tgcatattttgagaaact

SEQ ID NO: 4425747 - DNA, 22 bp, Homo sapiens
tgcatcaatttttcttatttca

SEQ ID NO: 4425748 - DNA, 17 bp, Homo sapiens
tgcatcacactcaagga

SEQ ID NO: 4425749 - DNA, 18 bp, Homo sapiens
tgcatcacactcaaggac

SEQ ID NO: 4425750 - DNA, 18 bp, Homo sapiens
tgcatcatagacgagaca

SEQ ID NO: 4425751 - DNA, 20 bp, Homo sapiens
tgcatcatctgtttgtaatc

SEQ ID NO: 4425752 - DNA, 21 bp, Homo sapiens
tgcatccagcctggggctgag

SEQ ID NO: 4425753 - DNA, 18 bp, Homo sapiens
tgcatccattcctcaggg

SEQ ID NO: 4425754 - DNA, 15 bp, Homo sapiens
tgcatccattgttgt

SEQ ID NO: 4425755 - DNA, 18 bp, Homo sapiens
tgcatcccccctgctcag

SEQ ID NO: 4425756 - DNA, 18 bp, Homo sapiens
tgcatccttgtaatacct

SEQ ID NO: 4425757 - DNA, 17 bp, Homo sapiens
tgcatcgggaaagaaga

SEQ ID NO: 4425758 - DNA, 18 bp, Homo sapiens
tgcatctcccagataatg

SEQ ID NO: 4425759 - DNA, 12 bp, Homo sapiens
tgcatctcctcc

SEQ ID NO: 4425760 - DNA, 12 bp, Homo sapiens
tgcatctctgtg

SEQ ID NO: 4425761 - DNA, 15 bp, Homo sapiens
tgcatgacagcctct

SEQ ID NO: 4425762 - DNA, 16 bp, Homo sapiens
tgcatgacctaccagg

SEQ ID NO: 4425763 - DNA, 16 bp, Homo sapiens
tgcatgcaatttgaag

SEQ ID NO: 4425764 - DNA, 13 bp, Homo sapiens
tgcatgcggccca

SEQ ID NO: 4425765 - DNA, 18 bp, Homo sapiens
tgcatgcggcccagcccg

SEQ ID NO: 4425766 - DNA, 21 bp, Homo sapiens
tgcatgctattcacaattatt

SEQ ID NO: 4425767 - DNA, 16 bp, Homo sapiens
tgcatgctctctgcag

SEQ ID NO: 4425768 - DNA, 15 bp, Homo sapiens
tgcatggctcctgtc

SEQ ID NO: 4425769 - DNA, 13 bp, Homo sapiens
tgcatgggctcgc

SEQ ID NO: 4425770 - DNA, 18 bp, Homo sapiens
tgcatggtaatttatagt

SEQ ID NO: 4425771 - DNA, 12 bp, Homo sapiens
tgcatgtagcat

SEQ ID NO: 4425772 - DNA, 15 bp, Homo sapiens
tgcatgtagcatata

SEQ ID NO: 4425773 - DNA, 12 bp, Homo sapiens
tgcatgtagtaa

SEQ ID NO: 4425774 - DNA, 15 bp, Homo sapiens
tgcatgtcagagcac

SEQ ID NO: 4425775 - DNA, 17 bp, Homo sapiens
tgcatgtctgccaaaat

SEQ ID NO: 4425776 - DNA, 23 bp, Homo sapiens
tgcatgtctgcctatgcactgaa

SEQ ID NO: 4425777 - DNA, 14 bp, Homo sapiens
tgcatgtcttttaa

SEQ ID NO: 4425778 - DNA, 15 bp, Homo sapiens
tgcatgtgcatgcat

SEQ ID NO: 4425779 - DNA, 17 bp, Homo sapiens
tgcatgtgcatgcatac

SEQ ID NO: 4425780 - DNA, 14 bp, Homo sapiens
tgcatgttccacta

SEQ ID NO: 4425781 - DNA, 17 bp, Homo sapiens
tgcatgttccactaacc

SEQ ID NO: 4425782 - DNA, 16 bp, Homo sapiens
tgcatgtttttgaaaa

SEQ ID NO: 4425783 - DNA, 19 bp, Homo sapiens
tgcattaaaatttcttatt

SEQ ID NO: 4425784 - DNA, 18 bp, Homo sapiens
tgagctattaaaactcag

SEQ ID NO: 4425785 - DNA, 18 bp, Homo sapiens
tgagctattttcctctgg

SEQ ID NO: 4425786 - DNA, 24 bp, Homo sapiens
tgagctattttcctctggccgcag

SEQ ID NO: 4425787 - DNA, 21 bp, Homo sapiens
tgagctcacatgggactggga

SEQ ID NO: 4425788 - DNA, 19 bp, Homo sapiens
tgagctcagacccccactc

SEQ ID NO: 4425789 - DNA, 22 bp, Homo sapiens
tgagctcagacccccactctca

SEQ ID NO: 4425790 - DNA, 19 bp, Homo sapiens
tgagctcaggaggtcaaga

SEQ ID NO: 4425791 - DNA, 23 bp, Homo sapiens
tgagctctcaggccgagagcctt

SEQ ID NO: 4425792 - DNA, 22 bp, Homo sapiens
tgagctctggttatttttctct

SEQ ID NO: 4425793 - DNA, 20 bp, Homo sapiens
tgagctcttcccttattcct

SEQ ID NO: 4425794 - DNA, 17 bp, Homo sapiens
tgagctgccttccctag

SEQ ID NO: 4425795 - DNA, 18 bp, Homo sapiens
tgagctggggactcaggg

SEQ ID NO: 4425796 - DNA, 16 bp, Homo sapiens
tgagctgtgcgctgct

SEQ ID NO: 4425797 - DNA, 17 bp, Homo sapiens
tgaggaactgtacagaa

SEQ ID NO: 4425798 - DNA, 23 bp, Homo sapiens
tgaggaagaacggggctcttctc

SEQ ID NO: 4425799 - DNA, 24 bp, Homo sapiens
tgaggaagaacggggctcttctca

SEQ ID NO: 4425800 - DNA, 15 bp, Homo sapiens
tgaggaagagtttat

SEQ ID NO: 4425801 - DNA, 15 bp, Homo sapiens
tgaggaatttcacct

SEQ ID NO: 4425802 - DNA, 18 bp, Homo sapiens
tgaggacctttatatctg

SEQ ID NO: 4425803 - DNA, 22 bp, Homo sapiens
tgaggactctttccgactgccc

SEQ ID NO: 4425804 - DNA, 17 bp, Homo sapiens
tgaggactgatttcaga

SEQ ID NO: 4425805 - DNA, 17 bp, Homo sapiens
tgaggagagaaaatata

SEQ ID NO: 4425806 - DNA, 23 bp, Homo sapiens
tgaggagagtctgaatattttca

SEQ ID NO: 4425807 - DNA, 15 bp, Homo sapiens
tgaggaggagctggc

SEQ ID NO: 4425808 - DNA, 12 bp, Homo sapiens
tgaggaggggag

SEQ ID NO: 4425809 - DNA, 20 bp, Homo sapiens
tgaggaggggagcgtctggg

SEQ ID NO: 4425810 - DNA, 13 bp, Homo sapiens
tgaggagggtggg

SEQ ID NO: 4425811 - DNA, 17 bp, Homo sapiens
tgaggagggtgggggag

SEQ ID NO: 4425812 - DNA, 16 bp, Homo sapiens
tgaggagtaaaattca

SEQ ID NO: 4425813 - DNA, 14 bp, Homo sapiens
tgaggagtttccta

SEQ ID NO: 4425814 - DNA, 19 bp, Homo sapiens
tgaggagtttcctaaaagt

SEQ ID NO: 4425815 - DNA, 13 bp, Homo sapiens
tgaggatgatgta

SEQ ID NO: 4425816 - DNA, 14 bp, Homo sapiens
tgaggatgatgtac

SEQ ID NO: 4425817 - DNA, 11 bp, Homo sapiens
tgaggcaataa

SEQ ID NO: 4425818 - DNA, 15 bp, Homo sapiens
tgaggcactggcgag

SEQ ID NO: 4425819 - DNA, 20 bp, Homo sapiens
tgaggcaggagaattgcttg

SEQ ID NO: 4425820 - DNA, 13 bp, Homo sapiens
tgaggccagagtc

SEQ ID NO: 4425821 - DNA, 13 bp, Homo sapiens
tgaggccagggca

SEQ ID NO: 4425822 - DNA, 16 bp, Homo sapiens
tgaggccatctcagga

SEQ ID NO: 4425823 - DNA, 17 bp, Homo sapiens
tgaggccatctcaggag

SEQ ID NO: 4425824 - DNA, 14 bp, Homo sapiens
tgaggccctgggct

SEQ ID NO: 4425825 - DNA, 13 bp, Homo sapiens
tgaggccggacag

SEQ ID NO: 4425826 - DNA, 14 bp, Homo sapiens
tgaggcggaggctg

SEQ ID NO: 4425827 - DNA, 18 bp, Homo sapiens
tgaggctttggatttgac

SEQ ID NO: 4425828 - DNA, 16 bp, Homo sapiens
tgagggaacagacagg

SEQ ID NO: 4425829 - DNA, 20 bp, Homo sapiens
tgagggaacagacaggagaa

SEQ ID NO: 4425830 - DNA, 13 bp, Homo sapiens
tgagggactctga

SEQ ID NO: 4425831 - DNA, 14 bp, Homo sapiens
tgagggagcctggc

SEQ ID NO: 4425832 - DNA, 14 bp, Homo sapiens
tgagggaggggaaa

SEQ ID NO: 4425833 - DNA, 23 bp, Homo sapiens
tgagggccggttctaaggctcag

SEQ ID NO: 4425834 - DNA, 22 bp, Homo sapiens
tgagggctaaaaaggtcctgta

SEQ ID NO: 4425835 - DNA, 20 bp, Homo sapiens
tgagggctaattctgggaag

SEQ ID NO: 4425836 - DNA, 17 bp, Homo sapiens
tgagggctctgtttgtg

SEQ ID NO: 4425837 - DNA, 17 bp, Homo sapiens
tgaggggccctggccag

SEQ ID NO: 4425838 - DNA, 19 bp, Homo sapiens
tgaggggccctggccagga

SEQ ID NO: 4425839 - DNA, 14 bp, Homo sapiens
tgagggtttctgat

SEQ ID NO: 4425840 - DNA, 14 bp, Homo sapiens
tgaggtaaagatat

SEQ ID NO: 4425841 - DNA, 15 bp, Homo sapiens
tgaggtaagtttttt

SEQ ID NO: 4425842 - DNA, 16 bp, Homo sapiens
tgaggtattttttcct

SEQ ID NO: 4425843 - DNA, 14 bp, Homo sapiens
tgaggtcataaaca

SEQ ID NO: 4425844 - DNA, 15 bp, Homo sapiens
tgaggtcataaacac

SEQ ID NO: 4425845 - DNA, 21 bp, Homo sapiens
tgaggtccttatgtcctgtca

SEQ ID NO: 4425846 - DNA, 14 bp, Homo sapiens
tgaggtctgtttaa

SEQ ID NO: 4425847 - DNA, 22 bp, Homo sapiens
tgaggtggaagccctccttcca

SEQ ID NO: 4425848 - DNA, 19 bp, Homo sapiens
tgaggttcctctgcctgcc

SEQ ID NO: 4425849 - DNA, 21 bp, Homo sapiens
tgaggttcctctgcctgcccc

SEQ ID NO: 4425850 - DNA, 16 bp, Homo sapiens
tgaggtttttaaatat

SEQ ID NO: 4425851 - DNA, 13 bp, Homo sapiens
tgagtaaacataa

SEQ ID NO: 4425852 - DNA, 18 bp, Homo sapiens
tgagtactctttctctcc

SEQ ID NO: 4425853 - DNA, 14 bp, Homo sapiens
tgagtagtctcatg

SEQ ID NO: 4425854 - DNA, 13 bp, Homo sapiens
tgagtagtggcca

SEQ ID NO: 4425855 - DNA, 15 bp, Homo sapiens
tgagtagtggccact

SEQ ID NO: 4425856 - DNA, 19 bp, Homo sapiens
tgagtagttactaaaattt

SEQ ID NO: 4425857 - DNA, 22 bp, Homo sapiens
tgagtcagaatgtgaaaaagga

SEQ ID NO: 4425858 - DNA, 22 bp, Homo sapiens
tgagtcatgatctccctgccgc

SEQ ID NO: 4425859 - DNA, 23 bp, Homo sapiens
tgagtcattgacttcattttata

SEQ ID NO: 4425860 - DNA, 13 bp, Homo sapiens
tgagtcatttaaa

SEQ ID NO: 4425861 - DNA, 16 bp, Homo sapiens
tgagtcatttaaatgt

SEQ ID NO: 4425862 - DNA, 23 bp, Homo sapiens
tgagtcatttaaatgtgtacaat

SEQ ID NO: 4425863 - DNA, 13 bp, Homo sapiens
tgagtccacgccc

SEQ ID NO: 4425864 - DNA, 14 bp, Homo sapiens
tgagtccacgccca

SEQ ID NO: 4425865 - DNA, 23 bp, Homo sapiens
tgagtccacgcccaccagccttg

SEQ ID NO: 4425866 - DNA, 14 bp, Homo sapiens
tgagtccagctccc

SEQ ID NO: 4425867 - DNA, 17 bp, Homo sapiens
tgagtcctaggacttaa

SEQ ID NO: 4425868 - DNA, 14 bp, Homo sapiens
tgagtcctgtctct

SEQ ID NO: 4425869 - DNA, 17 bp, Homo sapiens
tgagtctatttttaatg

SEQ ID NO: 4425870 - DNA, 15 bp, Homo sapiens
tgagtctccagggcc

SEQ ID NO: 4425871 - DNA, 15 bp, Homo sapiens
tgagtctgagtcctg

SEQ ID NO: 4425872 - DNA, 18 bp, Homo sapiens
tgagtctgagtcctgtct

SEQ ID NO: 4425873 - DNA, 23 bp, Homo sapiens
tgagtcttaactgtatttcagta

SEQ ID NO: 4425874 - DNA, 17 bp, Homo sapiens
tgagtgagaagagcttg

SEQ ID NO: 4425875 - DNA, 15 bp, Homo sapiens
tgagtgagttttact

SEQ ID NO: 4425876 - DNA, 13 bp, Homo sapiens
tgagtgccttctg

SEQ ID NO: 4425877 - DNA, 18 bp, Homo sapiens
tgagtgccttctgtgggg

SEQ ID NO: 4425878 - DNA, 19 bp, Homo sapiens
tgagtgcgggctgaggcca

SEQ ID NO: 4425879 - DNA, 14 bp, Homo sapiens
tgagtggccaggga

SEQ ID NO: 4425880 - DNA, 15 bp, Homo sapiens
tgagtggccagggaa

SEQ ID NO: 4425881 - DNA, 17 bp, Homo sapiens
tgagtgggaggcgtgcc

SEQ ID NO: 4425882 - DNA, 22 bp, Homo sapiens
tgagtgttcccaatctgaaatt

SEQ ID NO: 4425883 - DNA, 15 bp, Homo sapiens
tgagttaactgtgaa

SEQ ID NO: 4425884 - DNA, 14 bp, Homo sapiens
tgagttaagtctat

SEQ ID NO: 4425885 - DNA, 17 bp, Homo sapiens
tgagttacttagaatgc

SEQ ID NO: 4425886 - DNA, 19 bp, Homo sapiens
tgagttacttagaatgcca

SEQ ID NO: 4425887 - DNA, 23 bp, Homo sapiens
tgagttatcagggaacttagtaa

SEQ ID NO: 4425888 - DNA, 21 bp, Homo sapiens
tgagttatcatgaattttaaa

SEQ ID NO: 4425889 - DNA, 18 bp, Homo sapiens
tgagttcccgggagctgg

SEQ ID NO: 4425890 - DNA, 21 bp, Homo sapiens
tgagttcccgggagctgggcc

SEQ ID NO: 4425891 - DNA, 23 bp, Homo sapiens
tgagttcccgggagctgggccct

SEQ ID NO: 4425892 - DNA, 17 bp, Homo sapiens
tgagttggacttcagtc

SEQ ID NO: 4425893 - DNA, 14 bp, Homo sapiens
tgagttggctggga

SEQ ID NO: 4425894 - DNA, 17 bp, Homo sapiens
tgagttggctgggaata

SEQ ID NO: 4425895 - DNA, 23 bp, Homo sapiens
tgagttgttttcagactcagact

SEQ ID NO: 4425896 - DNA, 20 bp, Homo sapiens
tgagtttaaaaatcaacttt

SEQ ID NO: 4425897 - DNA, 21 bp, Homo sapiens
tgagtttcatatataagactg

SEQ ID NO: 4425898 - DNA, 19 bp, Homo sapiens
tgagtttgagctgccttcc

SEQ ID NO: 4425899 - DNA, 21 bp, Homo sapiens
tgagtttgagctgccttccct

SEQ ID NO: 4425900 - DNA, 22 bp, Homo sapiens
tgagtttggatgtctgtagcat

SEQ ID NO: 4425901 - DNA, 15 bp, Homo sapiens
tgagtttgtattatt

SEQ ID NO: 4425902 - DNA, 23 bp, Homo sapiens
tgagtttgtggtaaccagccctg

SEQ ID NO: 4425903 - DNA, 18 bp, Homo sapiens
tgagttttgtgtttgttg

SEQ ID NO: 4425904 - DNA, 19 bp, Homo sapiens
tgagtttttatggggctga

SEQ ID NO: 4425905 - DNA, 14 bp, Homo sapiens
tgagtttttcctcc

SEQ ID NO: 4425906 - DNA, 13 bp, Homo sapiens
tgataaaaatact

SEQ ID NO: 4425907 - DNA, 16 bp, Homo sapiens
tgataaaaccatgtag

SEQ ID NO: 4425908 - DNA, 21 bp, Homo sapiens
tgataaacataattatttcta

SEQ ID NO: 4425909 - DNA, 16 bp, Homo sapiens
tgataaagacttttat

SEQ ID NO: 4425910 - DNA, 18 bp, Homo sapiens
tgataaagattttttaat

SEQ ID NO: 4425911 - DNA, 17 bp, Homo sapiens
tgataaatcagtcaagc

SEQ ID NO: 4425912 - DNA, 18 bp, Homo sapiens
tgataaattttaaaattg

SEQ ID NO: 4425913 - DNA, 17 bp, Homo sapiens
tgataacaacctggaga

SEQ ID NO: 4425914 - DNA, 18 bp, Homo sapiens
tgataacaacctggagac

SEQ ID NO: 4425915 - DNA, 17 bp, Homo sapiens
tgataacaagcaaggat

SEQ ID NO: 4425916 - DNA, 19 bp, Homo sapiens
tgataaccagtaaggaaat

SEQ ID NO: 4425917 - DNA, 15 bp, Homo sapiens
tgataacttggggag

SEQ ID NO: 4425918 - DNA, 14 bp, Homo sapiens
tgataagacatttt

SEQ ID NO: 4425919 - DNA, 16 bp, Homo sapiens
tgataagggaaaagat

SEQ ID NO: 4425920 - DNA, 18 bp, Homo sapiens
tgataagggaaaagataa

SEQ ID NO: 4425921 - DNA, 17 bp, Homo sapiens
tgataataatattgttt

SEQ ID NO: 4425922 - DNA, 21 bp, Homo sapiens
tgataatgataaaacacctca

SEQ ID NO: 4425923 - DNA, 14 bp, Homo sapiens
tgataattatttac

SEQ ID NO: 4425924 - DNA, 13 bp, Homo sapiens
tgataattttaaa

SEQ ID NO: 4425925 - DNA, 18 bp, Homo sapiens
tgatacacagtaattgtg

SEQ ID NO: 4425926 - DNA, 18 bp, Homo sapiens
tgatacaccattatgttt

SEQ ID NO: 4425927 - DNA, 15 bp, Homo sapiens
tgatacagtgttaaa

SEQ ID NO: 4425928 - DNA, 23 bp, Homo sapiens
tgataccagcagcaactgaaaat

SEQ ID NO: 4425929 - DNA, 17 bp, Homo sapiens
tgatacccaacagttta

SEQ ID NO: 4425930 - DNA, 14 bp, Homo sapiens
tgatactgatgcca

SEQ ID NO: 4425931 - DNA, 19 bp, Homo sapiens
tgatactgatgccatgtaa

SEQ ID NO: 4425932 - DNA, 18 bp, Homo sapiens
tgatactggaggaacact

SEQ ID NO: 4425933 - DNA, 17 bp, Homo sapiens
tgatactggctcagaag

SEQ ID NO: 4425934 - DNA, 18 bp, Homo sapiens
tgatagaaagaataaaat

SEQ ID NO: 4425935 - DNA, 17 bp, Homo sapiens
tgatagacaattgaggt

SEQ ID NO: 4425936 - DNA, 18 bp, Homo sapiens
tgatagacaattgaggta

SEQ ID NO: 4425937 - DNA, 16 bp, Homo sapiens
tgatagcactggtttg

SEQ ID NO: 4425938 - DNA, 21 bp, Homo sapiens
tgatagcactggtttgtttct

SEQ ID NO: 4425939 - DNA, 23 bp, Homo sapiens
tgatagcactggtttgtttctca

SEQ ID NO: 4425940 - DNA, 20 bp, Homo sapiens
tgatagcagacattgttaca

SEQ ID NO: 4425941 - DNA, 15 bp, Homo sapiens
tgatagccagacacg

SEQ ID NO: 4425942 - DNA, 21 bp, Homo sapiens
tgataggaatgtgaaagcacg

SEQ ID NO: 4425943 - DNA, 21 bp, Homo sapiens
tgataggtacctgagtgacgg

SEQ ID NO: 4425944 - DNA, 12 bp, Homo sapiens
tgatagtccttt

SEQ ID NO: 4425945 - DNA, 18 bp, Homo sapiens
tgatataattgtactgtg

SEQ ID NO: 4425946 - DNA, 19 bp, Homo sapiens
tgatatacacagtggcaaa

SEQ ID NO: 4425947 - DNA, 16 bp, Homo sapiens
tgatataccaaattaa

SEQ ID NO: 4425948 - DNA, 20 bp, Homo sapiens
tgatataccaaattaaaaaa

SEQ ID NO: 4425949 - DNA, 15 bp, Homo sapiens
tgatatattttacaa

SEQ ID NO: 4425950 - DNA, 15 bp, Homo sapiens
tgatatcgtgaaatc

SEQ ID NO: 4425951 - DNA, 17 bp, Homo sapiens
tgatatcgtgaaatcct

SEQ ID NO: 4425952 - DNA, 12 bp, Homo sapiens
tgatatgcagcc

SEQ ID NO: 4425953 - DNA, 12 bp, Homo sapiens
tgatatgcatgt

SEQ ID NO: 4425954 - DNA, 17 bp, Homo sapiens
tgatatgcatgtagcat

SEQ ID NO: 4425955 - DNA, 20 bp, Homo sapiens
tgatatgtatccatcaggat

SEQ ID NO: 4425956 - DNA, 22 bp, Homo sapiens
tgatattctaagaaatatctgt

SEQ ID NO: 4425957 - DNA, 16 bp, Homo sapiens
tgatattctgttgctt

SEQ ID NO: 4425958 - DNA, 20 bp, Homo sapiens
tgatattctgttgctttaca

SEQ ID NO: 4425959 - DNA, 19 bp, Homo sapiens
tgatattgtttgctgttgg

SEQ ID NO: 4425960 - DNA, 21 bp, Homo sapiens
tgatattgtttgctgttgggt

SEQ ID NO: 4425961 - DNA, 16 bp, Homo sapiens
tgatatttcttgcttt

SEQ ID NO: 4425962 - DNA, 21 bp, Homo sapiens
tgatcaaaaactgccttcccc

SEQ ID NO: 4425963 - DNA, 16 bp, Homo sapiens
tgatcaaaaataatgc

SEQ ID NO: 4425964 - DNA, 18 bp, Homo sapiens
tgatcaacatcttttctt

SEQ ID NO: 4425965 - DNA, 13 bp, Homo sapiens
tgatcaagatata

SEQ ID NO: 4425966 - DNA, 12 bp, Homo sapiens
tgatcacacagt

SEQ ID NO: 4425967 - DNA, 22 bp, Homo sapiens
tgatcacacagtgttagtgctg

SEQ ID NO: 4425968 - DNA, 12 bp, Homo sapiens
tgatcagacagc

SEQ ID NO: 4425969 - DNA, 15 bp, Homo sapiens
tgatcagacagcttg

SEQ ID NO: 4425970 - DNA, 21 bp, Homo sapiens
tgatcagagccgtggtccttt

SEQ ID NO: 4425971 - DNA, 21 bp, Homo sapiens
tgatcatagctcactgcagcc

SEQ ID NO: 4425972 - DNA, 15 bp, Homo sapiens
tgatcatgtactttt

SEQ ID NO: 4425973 - DNA, 17 bp, Homo sapiens
tgatcatgtacttttta

SEQ ID NO: 4425974 - DNA, 19 bp, Homo sapiens
tgatcattttccccccact

SEQ ID NO: 4425975 - DNA, 22 bp, Homo sapiens
tgatcattttccccccactctc

SEQ ID NO: 4425976 - DNA, 18 bp, Homo sapiens
tgatccacgatcgtacca

SEQ ID NO: 4425977 - DNA, 13 bp, Homo sapiens
tgatccagaagag

SEQ ID NO: 4425978 - DNA, 22 bp, Homo sapiens
tgatccagaagagcccatatca

SEQ ID NO: 4425979 - DNA, 14 bp, Homo sapiens
tgatcccaccccct

SEQ ID NO: 4425980 - DNA, 17 bp, Homo sapiens
tgatcccaccccctcct

SEQ ID NO: 4425981 - DNA, 22 bp, Homo sapiens
tgatcccaccccctcctccccc

SEQ ID NO: 4425982 - DNA, 19 bp, Homo sapiens
tgatccgcctacctcagcc

SEQ ID NO: 4425983 - DNA, 18 bp, Homo sapiens
tgatcctaaatatgacag

SEQ ID NO: 4425984 - DNA, 14 bp, Homo sapiens
tgatcctctcacct

SEQ ID NO: 4425985 - DNA, 15 bp, Homo sapiens
tgatcgaaaaaataa

SEQ ID NO: 4425986 - DNA, 15 bp, Homo sapiens
tgatcgcctttccca

SEQ ID NO: 4425987 - DNA, 18 bp, Homo sapiens
tgatctacttctgtaatt

SEQ ID NO: 4425988 - DNA, 14 bp, Homo sapiens
tgatctacttgcct

SEQ ID NO: 4425989 - DNA, 18 bp, Homo sapiens
tgatctatctacaaagaa

SEQ ID NO: 4425990 - DNA, 15 bp, Homo sapiens
tgatctccctgccgc

SEQ ID NO: 4425991 - DNA, 21 bp, Homo sapiens
tgatctcgtttactccatgtt

SEQ ID NO: 4425992 - DNA, 14 bp, Homo sapiens
tgatctctccacgg

SEQ ID NO: 4425993 - DNA, 15 bp, Homo sapiens
tgatctctcttgtcc

SEQ ID NO: 4425994 - DNA, 17 bp, Homo sapiens
tgatctctcttgtcctc

SEQ ID NO: 4425995 - DNA, 18 bp, Homo sapiens
tgatctctcttgtcctct

SEQ ID NO: 4425996 - DNA, 24 bp, Homo sapiens
tgatctctcttgtcctcttctgct

SEQ ID NO: 4425997 - DNA, 20 bp, Homo sapiens
tgatctcttctggtgttgac

SEQ ID NO: 4425998 - DNA, 22 bp, Homo sapiens
tgatctcttctggtgttgactg

SEQ ID NO: 4425999 - DNA, 19 bp, Homo sapiens
tgatctgggcattttcctc

SEQ ID NO: 4426000 - DNA, 13 bp, Homo sapiens
tgatctgtacttt

SEQ ID NO: 4426001 - DNA, 20 bp, Homo sapiens
tgatctgtactttgtgttta

SEQ ID NO: 4426002 - DNA, 22 bp, Homo sapiens
tgatctgtatttaatggttttt

SEQ ID NO: 4426003 - DNA, 13 bp, Homo sapiens
tgatcttaaaata

SEQ ID NO: 4426004 - DNA, 17 bp, Homo sapiens
tgatcttaaaataattc

SEQ ID NO: 4426005 - DNA, 16 bp, Homo sapiens
tgatcttacagaaaat

SEQ ID NO: 4426006 - DNA, 14 bp, Homo sapiens
tgatcttattgctt

SEQ ID NO: 4426007 - DNA, 16 bp, Homo sapiens
tgatcttattgcttgc

SEQ ID NO: 4426008 - DNA, 18 bp, Homo sapiens
tgatcttgagaacctttt

SEQ ID NO: 4426009 - DNA, 17 bp, Homo sapiens
tgatctttgggcatcag

SEQ ID NO: 4426010 - DNA, 20 bp, Homo sapiens
tgatctttgtttaaatgcca

SEQ ID NO: 4426011 - DNA, 23 bp, Homo sapiens
tgatctttgtttaaatgccaaaa

SEQ ID NO: 4426012 - DNA, 15 bp, Homo sapiens
tgatctttttatcat

SEQ ID NO: 4426013 - DNA, 14 bp, Homo sapiens
tgatgaaataaaat

SEQ ID NO: 4426014 - DNA, 20 bp, Homo sapiens
tgatgaacatattcatgaaa

SEQ ID NO: 4426015 - DNA, 23 bp, Homo sapiens
tgatgaacatattcatgaaatgt

SEQ ID NO: 4426016 - DNA, 20 bp, Homo sapiens
tgatgacaaaaaatgtttta

SEQ ID NO: 4426017 - DNA, 14 bp, Homo sapiens
tgatgaccaaagtc

SEQ ID NO: 4426018 - DNA, 18 bp, Homo sapiens
tgatgacgggatgctctt

SEQ ID NO: 4426019 - DNA, 21 bp, Homo sapiens
tgatgacgggatgctctttaa

SEQ ID NO: 4426020 - DNA, 22 bp, Homo sapiens
tgatgacgggatgctctttaaa

SEQ ID NO: 4426021 - DNA, 14 bp, Homo sapiens
tgatgagattttta

SEQ ID NO: 4426022 - DNA, 14 bp, Homo sapiens
tgatgagcagactt

SEQ ID NO: 4426023 - DNA, 15 bp, Homo sapiens
tgatgagtaaactga

SEQ ID NO: 4426024 - DNA, 15 bp, Homo sapiens
tgatgatagcagaca

SEQ ID NO: 4426025 - DNA, 23 bp, Homo sapiens
tgatgatagcagacattgttaca

SEQ ID NO: 4426026 - DNA, 15 bp, Homo sapiens
tgatgcagcatttga

SEQ ID NO: 4426027 - DNA, 18 bp, Homo sapiens
tgatgcagcatttgataa

SEQ ID NO: 4426028 - DNA, 13 bp, Homo sapiens
tgatgcaggcact

SEQ ID NO: 4426029 - DNA, 22 bp, Homo sapiens
tgatgcagtgtgtctttataaa

SEQ ID NO: 4426030 - DNA, 18 bp, Homo sapiens
tgatgcatgcactgttcc

SEQ ID NO: 4426031 - DNA, 23 bp, Homo sapiens
tgatgcatgcactgttccccctg

SEQ ID NO: 4426032 - DNA, 13 bp, Homo sapiens
tgatgcatgtctt

SEQ ID NO: 4426033 - DNA, 18 bp, Homo sapiens
tgatgccaaaaaaaaata

SEQ ID NO: 4426034 - DNA, 15 bp, Homo sapiens
tgatgccattacaga

SEQ ID NO: 4426035 - DNA, 15 bp, Homo sapiens
tgatgcccaatatat

SEQ ID NO: 4426036 - DNA, 19 bp, Homo sapiens
tgatgccctgctccaggga

SEQ ID NO: 4426037 - DNA, 23 bp, Homo sapiens
tgatgcctttataaatctttctc

SEQ ID NO: 4426038 - DNA, 16 bp, Homo sapiens
tgatgctccctcccct

SEQ ID NO: 4426039 - DNA, 20 bp, Homo sapiens
tgatgctccctcccctgccc

SEQ ID NO: 4426040 - DNA, 23 bp, Homo sapiens
tgatgctccctcccctgccctgg

SEQ ID NO: 4426041 - DNA, 16 bp, Homo sapiens
tgatgctttgagaaca

SEQ ID NO: 4426042 - DNA, 15 bp, Homo sapiens
tgatggaaaatacca

SEQ ID NO: 4426043 - DNA, 21 bp, Homo sapiens
tgatggaaaataccagtgttg

SEQ ID NO: 4426044 - DNA, 13 bp, Homo sapiens
tgatggagctgat

SEQ ID NO: 4426045 - DNA, 20 bp, Homo sapiens
tgatggattccaaaccagga

SEQ ID NO: 4426046 - DNA, 15 bp, Homo sapiens
tgatggccagcccct

SEQ ID NO: 4426047 - DNA, 16 bp, Homo sapiens
tgatggcctttggacc

SEQ ID NO: 4426048 - DNA, 17 bp, Homo sapiens
tgatggcctttggaccc

SEQ ID NO: 4426049 - DNA, 23 bp, Homo sapiens
tgatggcctttggacccagggcc

SEQ ID NO: 4426050 - DNA, 16 bp, Homo sapiens
tgatgggaaaatagta

SEQ ID NO: 4426051 - DNA, 14 bp, Homo sapiens
tgatgggaaagcat

SEQ ID NO: 4426052 - DNA, 21 bp, Homo sapiens
tgatgggaagtccggccccag

SEQ ID NO: 4426053 - DNA, 11 bp, Homo sapiens
tgatgggaata

SEQ ID NO: 4426054 - DNA, 15 bp, Homo sapiens
tgatgggaataaaag

SEQ ID NO: 4426055 - DNA, 13 bp, Homo sapiens
tgatgggcccgcc

SEQ ID NO: 4426056 - DNA, 15 bp, Homo sapiens
tgatgggtcagttgt

SEQ ID NO: 4426057 - DNA, 13 bp, Homo sapiens
tgatgtaaaaatg

SEQ ID NO: 4426058 - DNA, 20 bp, Homo sapiens
tgatgtacataactcctgtc

SEQ ID NO: 4426059 - DNA, 17 bp, Homo sapiens
tgatgtattttcatagt

SEQ ID NO: 4426060 - DNA, 12 bp, Homo sapiens
tgatgtcactca

SEQ ID NO: 4426061 - DNA, 18 bp, Homo sapiens
tgatgtcactcacctaga

SEQ ID NO: 4426062 - DNA, 14 bp, Homo sapiens
tgatgtcccagtgc

SEQ ID NO: 4426063 - DNA, 19 bp, Homo sapiens
tgatgtgaagagtttcaca

SEQ ID NO: 4426064 - DNA, 21 bp, Homo sapiens
tgatgtgaagagtttcacaaa

SEQ ID NO: 4426065 - DNA, 15 bp, Homo sapiens
tgatgtgaattattt

SEQ ID NO: 4426066 - DNA, 21 bp, Homo sapiens
tgatgtggaggaagagccacc

SEQ ID NO: 4426067 - DNA, 12 bp, Homo sapiens
tgatgttaaaaa

SEQ ID NO: 4426068 - DNA, 18 bp, Homo sapiens
tgatgttccacctgccac

SEQ ID NO: 4426069 - DNA, 16 bp, Homo sapiens
tgatgtttgtggcctc

SEQ ID NO: 4426070 - DNA, 18 bp, Homo sapiens
tgatgtttgtggcctcag

SEQ ID NO: 4426071 - DNA, 18 bp, Homo sapiens
tgatgtttttaaaggttt

SEQ ID NO: 4426072 - DNA, 20 bp, Homo sapiens
tgatgttttttctgtaatgt

SEQ ID NO: 4426073 - DNA, 13 bp, Homo sapiens
tgattaaaaatgt

SEQ ID NO: 4426074 - DNA, 12 bp, Homo sapiens
tgattaaagtgc

SEQ ID NO: 4426075 - DNA, 13 bp, Homo sapiens
tgattaaattatg

SEQ ID NO: 4426076 - DNA, 15 bp, Homo sapiens
tgattaaattatgaa

SEQ ID NO: 4426077 - DNA, 14 bp, Homo sapiens
tgattaaattttag

SEQ ID NO: 4426078 - DNA, 13 bp, Homo sapiens
tgattaagaaagg

SEQ ID NO: 4426079 - DNA, 15 bp, Homo sapiens
tgattaagaaaggaa

SEQ ID NO: 4426080 - DNA, 17 bp, Homo sapiens
tgattaagaaaggaagt

SEQ ID NO: 4426081 - DNA, 17 bp, Homo sapiens
tgattaagggacatttc

SEQ ID NO: 4426082 - DNA, 19 bp, Homo sapiens
tgattaagggacatttcta

SEQ ID NO: 4426083 - DNA, 14 bp, Homo sapiens
tgattaataaaata

SEQ ID NO: 4426084 - DNA, 16 bp, Homo sapiens
tgattaataaaatatc

SEQ ID NO: 4426085 - DNA, 14 bp, Homo sapiens
tgattaatccattt

SEQ ID NO: 4426086 - DNA, 20 bp, Homo sapiens
tgattacctcctgtgtggaa

SEQ ID NO: 4426087 - DNA, 13 bp, Homo sapiens
tgattacctgcca

SEQ ID NO: 4426088 - DNA, 14 bp, Homo sapiens
tgattacctgccaa

SEQ ID NO: 4426089 - DNA, 21 bp, Homo sapiens
tgattactggcctttttcatt

SEQ ID NO: 4426090 - DNA, 23 bp, Homo sapiens
tgattactggcctttttcattta

SEQ ID NO: 4426091 - DNA, 23 bp, Homo sapiens
tgattagaaattacctgtggata

SEQ ID NO: 4426092 - DNA, 14 bp, Homo sapiens
tgattagatcacat

SEQ ID NO: 4426093 - DNA, 18 bp, Homo sapiens
tgattagcaagttacagt

SEQ ID NO: 4426094 - DNA, 20 bp, Homo sapiens
tgattatagttaagcaaatt

SEQ ID NO: 4426095 - DNA, 13 bp, Homo sapiens
tgattatgaaatg

SEQ ID NO: 4426096 - DNA, 17 bp, Homo sapiens
tgattatgtatggatat

SEQ ID NO: 4426097 - DNA, 16 bp, Homo sapiens
tgattattcagtgtca

SEQ ID NO: 4426098 - DNA, 15 bp, Homo sapiens
tgattattttagcta

SEQ ID NO: 4426099 - DNA, 13 bp, Homo sapiens
tgattcaaaatat

SEQ ID NO: 4426100 - DNA, 14 bp, Homo sapiens
tgattcaaaatatt

SEQ ID NO: 4426101 - DNA, 17 bp, Homo sapiens
tgattcaaaatatttaa

SEQ ID NO: 4426102 - DNA, 19 bp, Homo sapiens
tgattcaaaatatttaaaa

SEQ ID NO: 4426103 - DNA, 15 bp, Homo sapiens
tgattcaaatgtttt

SEQ ID NO: 4426104 - DNA, 19 bp, Homo sapiens
tgattcaaattgctgcttg

SEQ ID NO: 4426105 - DNA, 17 bp, Homo sapiens
tgattcaatctgtaaac

SEQ ID NO: 4426106 - DNA, 22 bp, Homo sapiens
tgattcaatctgtaaactgtgt

SEQ ID NO: 4426107 - DNA, 23 bp, Homo sapiens
tgattcaatctgtaaactgtgta

SEQ ID NO: 4426108 - DNA, 18 bp, Homo sapiens
tgattcagaaaatgttct

SEQ ID NO: 4426109 - DNA, 20 bp, Homo sapiens
tgattcagaaaatgttctgt

SEQ ID NO: 4426110 - DNA, 15 bp, Homo sapiens
tgattcagcaaaaat

SEQ ID NO: 4426111 - DNA, 12 bp, Homo sapiens
tgattcagtgtt

SEQ ID NO: 4426112 - DNA, 21 bp, Homo sapiens
tgattcagtgttaaatgtgat

SEQ ID NO: 4426113 - DNA, 21 bp, Homo sapiens
tgattccactacacctggctg

SEQ ID NO: 4426114 - DNA, 15 bp, Homo sapiens
tgattccagaacaaa

SEQ ID NO: 4426115 - DNA, 14 bp, Homo sapiens
tgattcccaactcc

SEQ ID NO: 4426116 - DNA, 18 bp, Homo sapiens
tgattccttgagtttcat

SEQ ID NO: 4426117 - DNA, 12 bp, Homo sapiens
tgattctccttc

SEQ ID NO: 4426118 - DNA, 13 bp, Homo sapiens
tgattctccttca

SEQ ID NO: 4426119 - DNA, 23 bp, Homo sapiens
tgattctccttcagccctcaccc

SEQ ID NO: 4426120 - DNA, 12 bp, Homo sapiens
tgattctgcctt

SEQ ID NO: 4426121 - DNA, 13 bp, Homo sapiens
tgattctgtttcc

SEQ ID NO: 4426122 - DNA, 12 bp, Homo sapiens
tgattcttgtaa

SEQ ID NO: 4426123 - DNA, 21 bp, Homo sapiens
tgattggatattctcctcgga

SEQ ID NO: 4426124 - DNA, 19 bp, Homo sapiens
tgattggtgcaacccttac

SEQ ID NO: 4426125 - DNA, 16 bp, Homo sapiens
tgattggttaaaatgt

SEQ ID NO: 4426126 - DNA, 20 bp, Homo sapiens
tgattgtagtaatctgcatt

SEQ ID NO: 4426127 - DNA, 14 bp, Homo sapiens
tgattgtatgttga

SEQ ID NO: 4426128 - DNA, 15 bp, Homo sapiens
tgattgtatgttgag

SEQ ID NO: 4426129 - DNA, 14 bp, Homo sapiens
tgattgtcttaata

SEQ ID NO: 4426130 - DNA, 15 bp, Homo sapiens
tgattgtgaaggatt

SEQ ID NO: 4426131 - DNA, 19 bp, Homo sapiens
tgattgttaatttacagct

SEQ ID NO: 4426132 - DNA, 20 bp, Homo sapiens
tgatttaaagactacaataa

SEQ ID NO: 4426133 - DNA, 16 bp, Homo sapiens
tgatttaatgttttca

SEQ ID NO: 4426134 - DNA, 14 bp, Homo sapiens
tgatttcacagtgt

SEQ ID NO: 4426135 - DNA, 16 bp, Homo sapiens
tgatttcacagtgtgt

SEQ ID NO: 4426136 - DNA, 17 bp, Homo sapiens
tgatttcacatttctac

SEQ ID NO: 4426137 - DNA, 20 bp, Homo sapiens
tgatttcagcacctacagtg

SEQ ID NO: 4426138 - DNA, 21 bp, Homo sapiens
tgatttcagcacctacagtgt

SEQ ID NO: 4426139 - DNA, 21 bp, Homo sapiens
tgatttcagtcatagcaagct

SEQ ID NO: 4426140 - DNA, 13 bp, Homo sapiens
tgatttcataatt

SEQ ID NO: 4426141 - DNA, 13 bp, Homo sapiens
tgatttcatattg

SEQ ID NO: 4426142 - DNA, 14 bp, Homo sapiens
tgatttcatattga

SEQ ID NO: 4426143 - DNA, 23 bp, Homo sapiens
tgatttcccactgcactccagcc

SEQ ID NO: 4426144 - DNA, 20 bp, Homo sapiens
tgatttcccccctccgcctc

SEQ ID NO: 4426145 - DNA, 16 bp, Homo sapiens
tgaatttttttgtaat

SEQ ID NO: 4426146 - DNA, 16 bp, Homo sapiens
tgacaaaatgactggc

SEQ ID NO: 4426147 - DNA, 22 bp, Homo sapiens
tgacaaaatgactggctcctga

SEQ ID NO: 4426148 - DNA, 22 bp, Homo sapiens
tgacaaaatggggcagaagaga

SEQ ID NO: 4426149 - DNA, 19 bp, Homo sapiens
tgacaaaattcatttgctt

SEQ ID NO: 4426150 - DNA, 15 bp, Homo sapiens
tgacaaagaaaccca

SEQ ID NO: 4426151 - DNA, 17 bp, Homo sapiens
tgacaaaggcaagcact

SEQ ID NO: 4426152 - DNA, 14 bp, Homo sapiens
tgacaaatattctg

SEQ ID NO: 4426153 - DNA, 17 bp, Homo sapiens
tgacaaattttaattat

SEQ ID NO: 4426154 - DNA, 12 bp, Homo sapiens
tgacaacactta

SEQ ID NO: 4426155 - DNA, 16 bp, Homo sapiens
tgacaacatttctata

SEQ ID NO: 4426156 - DNA, 23 bp, Homo sapiens
tgacaacatttctatagccaaaa

SEQ ID NO: 4426157 - DNA, 19 bp, Homo sapiens
tgacaactaaacaaggcat

SEQ ID NO: 4426158 - DNA, 18 bp, Homo sapiens
tgacaagatgggacagca

SEQ ID NO: 4426159 - DNA, 15 bp, Homo sapiens
tgacaataaaatatt

SEQ ID NO: 4426160 - DNA, 20 bp, Homo sapiens
tgacaataaaatattattga

SEQ ID NO: 4426161 - DNA, 22 bp, Homo sapiens
tgacaatactgctgccttaccc

SEQ ID NO: 4426162 - DNA, 21 bp, Homo sapiens
tgacaatatgacacttgtaaa

SEQ ID NO: 4426163 - DNA, 12 bp, Homo sapiens
tgacaatgaagg

SEQ ID NO: 4426164 - DNA, 16 bp, Homo sapiens
tgacaattctgttttt

SEQ ID NO: 4426165 - DNA, 14 bp, Homo sapiens
tgacaattgggagc

SEQ ID NO: 4426166 - DNA, 15 bp, Homo sapiens
tgacaatttatggaa

SEQ ID NO: 4426167 - DNA, 18 bp, Homo sapiens
tgacaattttgtacaaat

SEQ ID NO: 4426168 - DNA, 22 bp, Homo sapiens
tgacaattttgtacaaatttgt

SEQ ID NO: 4426169 - DNA, 22 bp, Homo sapiens
tgacacaccaggcgctaattca

SEQ ID NO: 4426170 - DNA, 14 bp, Homo sapiens
tgacacccaggctg

SEQ ID NO: 4426171 - DNA, 20 bp, Homo sapiens
tgacacccatgccagagagg

SEQ ID NO: 4426172 - DNA, 17 bp, Homo sapiens
tgacacctcttttttcg

SEQ ID NO: 4426173 - DNA, 14 bp, Homo sapiens
tgacacgcttctga

SEQ ID NO: 4426174 - DNA, 17 bp, Homo sapiens
tgacacgcttctgagca

SEQ ID NO: 4426175 - DNA, 19 bp, Homo sapiens
tgacacgcttctgagcagg

SEQ ID NO: 4426176 - DNA, 20 bp, Homo sapiens
tgacacgtctcgccaagcag

SEQ ID NO: 4426177 - DNA, 21 bp, Homo sapiens
tgacactagcccaatgaaatg

SEQ ID NO: 4426178 - DNA, 22 bp, Homo sapiens
tgacactagcccaatgaaatga

SEQ ID NO: 4426179 - DNA, 14 bp, Homo sapiens
tgacactcccttgg

SEQ ID NO: 4426180 - DNA, 22 bp, Homo sapiens
tgacactcccttgggctccctg

SEQ ID NO: 4426181 - DNA, 12 bp, Homo sapiens
tgacactgaaag

SEQ ID NO: 4426182 - DNA, 18 bp, Homo sapiens
tgacactgaaagttttgt

SEQ ID NO: 4426183 - DNA, 19 bp, Homo sapiens
tgacactgaaagttttgta

SEQ ID NO: 4426184 - DNA, 22 bp, Homo sapiens
tgacactgaaagttttgtaaaa

SEQ ID NO: 4426185 - DNA, 22 bp, Homo sapiens
tgacactgaacttaataactgt

SEQ ID NO: 4426186 - DNA, 15 bp, Homo sapiens
tgacactgctctaac

SEQ ID NO: 4426187 - DNA, 16 bp, Homo sapiens
tgacactgctctaaca

SEQ ID NO: 4426188 - DNA, 15 bp, Homo sapiens
tgacacttccaaaga

SEQ ID NO: 4426189 - DNA, 16 bp, Homo sapiens
tgacacttcccagtgg

SEQ ID NO: 4426190 - DNA, 19 bp, Homo sapiens
tgacacttttcatatcatt

SEQ ID NO: 4426191 - DNA, 16 bp, Homo sapiens
tgacagactatttgct

SEQ ID NO: 4426192 - DNA, 19 bp, Homo sapiens
tgacagactatttgctaat

SEQ ID NO: 4426193 - DNA, 17 bp, Homo sapiens
tgacagagcgagactcc

SEQ ID NO: 4426194 - DNA, 16 bp, Homo sapiens
tgacagatttctgtaa

SEQ ID NO: 4426195 - DNA, 17 bp, Homo sapiens
tgacagccttttttcct

SEQ ID NO: 4426196 - DNA, 12 bp, Homo sapiens
tgacagcttgga

SEQ ID NO: 4426197 - DNA, 20 bp, Homo sapiens
tgacaggctctcctggctgt

SEQ ID NO: 4426198 - DNA, 17 bp, Homo sapiens
tgacagggacatgccct

SEQ ID NO: 4426199 - DNA, 17 bp, Homo sapiens
tgacaggtcttttcaaa

SEQ ID NO: 4426200 - DNA, 13 bp, Homo sapiens
tgacagtaatatt

SEQ ID NO: 4426201 - DNA, 22 bp, Homo sapiens
tgacagtaatattggcatagaa

SEQ ID NO: 4426202 - DNA, 22 bp, Homo sapiens
tgacagtacccgactgtttatt

SEQ ID NO: 4426203 - DNA, 18 bp, Homo sapiens
tgacagtatcttttttcc

SEQ ID NO: 4426204 - DNA, 22 bp, Homo sapiens
tgacagtattatacgctggcaa

SEQ ID NO: 4426205 - DNA, 14 bp, Homo sapiens
tgacagtcactgca

SEQ ID NO: 4426206 - DNA, 19 bp, Homo sapiens
tgacagtcactgcatttgc

SEQ ID NO: 4426207 - DNA, 11 bp, Homo sapiens
tgacagtctga

SEQ ID NO: 4426208 - DNA, 22 bp, Homo sapiens
tgacagtgaagcagcactgtga

SEQ ID NO: 4426209 - DNA, 17 bp, Homo sapiens
tgacataacagtgcagg

SEQ ID NO: 4426210 - DNA, 19 bp, Homo sapiens
tgacatacctaccagtatt

SEQ ID NO: 4426211 - DNA, 13 bp, Homo sapiens
tgacatatttaat

SEQ ID NO: 4426212 - DNA, 15 bp, Homo sapiens
tgacatatttaatgt

SEQ ID NO: 4426213 - DNA, 16 bp, Homo sapiens
tgacatatttaatgtt

SEQ ID NO: 4426214 - DNA, 17 bp, Homo sapiens
tgacatatttaatgttt

SEQ ID NO: 4426215 - DNA, 19 bp, Homo sapiens
tgacatatttaatgtttta

SEQ ID NO: 4426216 - DNA, 21 bp, Homo sapiens
tgacatcggaaaaataatcaa

SEQ ID NO: 4426217 - DNA, 19 bp, Homo sapiens
tgacatctttttaaagctt

SEQ ID NO: 4426218 - DNA, 20 bp, Homo sapiens
tgacatctttttaaagctta

SEQ ID NO: 4426219 - DNA, 19 bp, Homo sapiens
tgacatgacgtggtaaaat

SEQ ID NO: 4426220 - DNA, 15 bp, Homo sapiens
tgacatgggccttta

SEQ ID NO: 4426221 - DNA, 22 bp, Homo sapiens
tgacatgggcctttaagaacct

SEQ ID NO: 4426222 - DNA, 16 bp, Homo sapiens
tgacatggtgcctgag

SEQ ID NO: 4426223 - DNA, 19 bp, Homo sapiens
tgacatgtaagaaaatgtt

SEQ ID NO: 4426224 - DNA, 20 bp, Homo sapiens
tgacatgtaagaaaatgtta

SEQ ID NO: 4426225 - DNA, 14 bp, Homo sapiens
tgacattaacaaat

SEQ ID NO: 4426226 - DNA, 16 bp, Homo sapiens
tgacattcctttgaat

SEQ ID NO: 4426227 - DNA, 19 bp, Homo sapiens
tgacatttgtattctcaga

SEQ ID NO: 4426228 - DNA, 12 bp, Homo sapiens
tgacatttgttt

SEQ ID NO: 4426229 - DNA, 15 bp, Homo sapiens
tgaccaacatggaga

SEQ ID NO: 4426230 - DNA, 16 bp, Homo sapiens
tgaccaacatggagaa

SEQ ID NO: 4426231 - DNA, 17 bp, Homo sapiens
tgaccaacatggagaaa

SEQ ID NO: 4426232 - DNA, 14 bp, Homo sapiens
tgaccaagtataaa

SEQ ID NO: 4426233 - DNA, 18 bp, Homo sapiens
tgaccaagtataaacttt

SEQ ID NO: 4426234 - DNA, 14 bp, Homo sapiens
tgaccaatgtcttg

SEQ ID NO: 4426235 - DNA, 15 bp, Homo sapiens
tgaccaatgtcttga

SEQ ID NO: 4426236 - DNA, 16 bp, Homo sapiens
tgaccactgcagaaga

SEQ ID NO: 4426237 - DNA, 20 bp, Homo sapiens
tgaccactgcagaagacagt

SEQ ID NO: 4426238 - DNA, 23 bp, Homo sapiens
tgaccagaaagcttcatccacag

SEQ ID NO: 4426239 - DNA, 16 bp, Homo sapiens
tgaccagggatgctgg

SEQ ID NO: 4426240 - DNA, 14 bp, Homo sapiens
tgaccagtgcctgt

SEQ ID NO: 4426241 - DNA, 15 bp, Homo sapiens
tgaccagtttcttaa

SEQ ID NO: 4426242 - DNA, 14 bp, Homo sapiens
tgaccagtttcttt

SEQ ID NO: 4426243 - DNA, 22 bp, Homo sapiens
tgaccatatagattttattatg

SEQ ID NO: 4426244 - DNA, 15 bp, Homo sapiens
tgaccatgcatttta

SEQ ID NO: 4426245 - DNA, 13 bp, Homo sapiens
tgaccattattca

SEQ ID NO: 4426246 - DNA, 18 bp, Homo sapiens
tgaccattggctgcgcta

SEQ ID NO: 4426247 - DNA, 20 bp, Homo sapiens
tgacccagtccctgggggaa

SEQ ID NO: 4426248 - DNA, 13 bp, Homo sapiens
tgacccccatgta

SEQ ID NO: 4426249 - DNA, 15 bp, Homo sapiens
tgacccccatgtaaa

SEQ ID NO: 4426250 - DNA, 15 bp, Homo sapiens
tgacccttgctgtga

SEQ ID NO: 4426251 - DNA, 19 bp, Homo sapiens
tgaccgcgactaatttcaa

SEQ ID NO: 4426252 - DNA, 14 bp, Homo sapiens
tgaccgtatgatga

SEQ ID NO: 4426253 - DNA, 20 bp, Homo sapiens
tgaccgtgggcggggccttg

SEQ ID NO: 4426254 - DNA, 17 bp, Homo sapiens
tgacctaaattatttac

SEQ ID NO: 4426255 - DNA, 18 bp, Homo sapiens
tgacctccgcccctgccc

SEQ ID NO: 4426256 - DNA, 23 bp, Homo sapiens
tgacctcctgcagggagccttct

SEQ ID NO: 4426257 - DNA, 21 bp, Homo sapiens
tgacctcgactggtttttcta

SEQ ID NO: 4426258 - DNA, 22 bp, Homo sapiens
tgacctcggacagagcccccct

SEQ ID NO: 4426259 - DNA, 18 bp, Homo sapiens
tgacctcgtgatccaccc

SEQ ID NO: 4426260 - DNA, 18 bp, Homo sapiens
tgacctcgtgatgggccc

SEQ ID NO: 4426261 - DNA, 17 bp, Homo sapiens
tgacctgcattgtaaat

SEQ ID NO: 4426262 - DNA, 13 bp, Homo sapiens
tgacctgccagcc

SEQ ID NO: 4426263 - DNA, 17 bp, Homo sapiens
tgacctgtcagaataaa

SEQ ID NO: 4426264 - DNA, 15 bp, Homo sapiens
tgaccttccagagcc

SEQ ID NO: 4426265 - DNA, 16 bp, Homo sapiens
tgacctttatttatta

SEQ ID NO: 4426266 - DNA, 14 bp, Homo sapiens
tgacctttgacctc

SEQ ID NO: 4426267 - DNA, 18 bp, Homo sapiens
tgacctttgacctcggtg

SEQ ID NO: 4426268 - DNA, 13 bp, Homo sapiens
tgacgaggctcaa

SEQ ID NO: 4426269 - DNA, 14 bp, Homo sapiens
tgacgcaatgaaaa

SEQ ID NO: 4426270 - DNA, 13 bp, Homo sapiens
tgacgctcagccc

SEQ ID NO: 4426271 - DNA, 22 bp, Homo sapiens
tgacgggatgctctttaaataa

SEQ ID NO: 4426272 - DNA, 23 bp, Homo sapiens
tgacgggatgctctttaaataat

SEQ ID NO: 4426273 - DNA, 19 bp, Homo sapiens
tgacgtctagctatgctgt

SEQ ID NO: 4426274 - DNA, 18 bp, Homo sapiens
tgactaaactttttttct

SEQ ID NO: 4426275 - DNA, 12 bp, Homo sapiens
tgactaagcctt

SEQ ID NO: 4426276 - DNA, 16 bp, Homo sapiens
tgactacagtcaggaa

SEQ ID NO: 4426277 - DNA, 17 bp, Homo sapiens
tgactacagtcaggaaa

SEQ ID NO: 4426278 - DNA, 19 bp, Homo sapiens
tgactagggattcaggctg

SEQ ID NO: 4426279 - DNA, 20 bp, Homo sapiens
tgactagggattcaggctgc

SEQ ID NO: 4426280 - DNA, 21 bp, Homo sapiens
tgactagggattcaggctgct

SEQ ID NO: 4426281 - DNA, 23 bp, Homo sapiens
tgactatataatttatttccact

SEQ ID NO: 4426282 - DNA, 22 bp, Homo sapiens
tgactatggagtcttgtgaaag

SEQ ID NO: 4426283 - DNA, 18 bp, Homo sapiens
tgactattctgtatcttt

SEQ ID NO: 4426284 - DNA, 16 bp, Homo sapiens
tgactcaattatttgc

SEQ ID NO: 4426285 - DNA, 19 bp, Homo sapiens
tgactcacacctgaactga

SEQ ID NO: 4426286 - DNA, 13 bp, Homo sapiens
tgactcacccaag

SEQ ID NO: 4426287 - DNA, 15 bp, Homo sapiens
tgactcacccaagca

SEQ ID NO: 4426288 - DNA, 23 bp, Homo sapiens
tgactcagtgtctgcctttaaat

SEQ ID NO: 4426289 - DNA, 13 bp, Homo sapiens
tgactccctgtgg

SEQ ID NO: 4426290 - DNA, 15 bp, Homo sapiens
tgactccctgtgggg

SEQ ID NO: 4426291 - DNA, 16 bp, Homo sapiens
tgactccgtcaagctg

SEQ ID NO: 4426292 - DNA, 13 bp, Homo sapiens
tgactcctctggc

SEQ ID NO: 4426293 - DNA, 19 bp, Homo sapiens
tgactcctctggctttccc

SEQ ID NO: 4426294 - DNA, 22 bp, Homo sapiens
tgactcctgaaacctcttccta

SEQ ID NO: 4426295 - DNA, 13 bp, Homo sapiens
tgactcctggact

SEQ ID NO: 4426296 - DNA, 20 bp, Homo sapiens
tgactcctggactccggagg

SEQ ID NO: 4426297 - DNA, 20 bp, Homo sapiens
tgactcctttccaatagaaa

SEQ ID NO: 4426298 - DNA, 22 bp, Homo sapiens
tgactcgatttaaactccagca

SEQ ID NO: 4426299 - DNA, 16 bp, Homo sapiens
tgactctataagcaaa

SEQ ID NO: 4426300 - DNA, 14 bp, Homo sapiens
tgactctgccccct

SEQ ID NO: 4426301 - DNA, 18 bp, Homo sapiens
tgactctgccccctgctg

SEQ ID NO: 4426302 - DNA, 13 bp, Homo sapiens
tgactctttccaa

SEQ ID NO: 4426303 - DNA, 19 bp, Homo sapiens
tgactctttccaaccggct

SEQ ID NO: 4426304 - DNA, 14 bp, Homo sapiens
tgactctttctgaa

SEQ ID NO: 4426305 - DNA, 22 bp, Homo sapiens
tgactctttctgaaggaagaga

SEQ ID NO: 4426306 - DNA, 23 bp, Homo sapiens
tgactctttctgaaggaagagaa

SEQ ID NO: 4426307 - DNA, 21 bp, Homo sapiens
tgactgaacgatccttcaaag

SEQ ID NO: 4426308 - DNA, 17 bp, Homo sapiens
tgactgatgattttcct

SEQ ID NO: 4426309 - DNA, 18 bp, Homo sapiens
tgactgatgattttcctt

SEQ ID NO: 4426310 - DNA, 19 bp, Homo sapiens
tgactgccaggataaagct

SEQ ID NO: 4426311 - DNA, 21 bp, Homo sapiens
tgactgccaggataaagcttc

SEQ ID NO: 4426312 - DNA, 21 bp, Homo sapiens
tgactgcccggcacagatgct

SEQ ID NO: 4426313 - DNA, 14 bp, Homo sapiens
tgactggaggaggc

SEQ ID NO: 4426314 - DNA, 20 bp, Homo sapiens
tgactggccaaacccttgct

SEQ ID NO: 4426315 - DNA, 15 bp, Homo sapiens
tgactggctaaagct

SEQ ID NO: 4426316 - DNA, 17 bp, Homo sapiens
tgactggcttcagcaag

SEQ ID NO: 4426317 - DNA, 17 bp, Homo sapiens
tgactggtttctcctgg

SEQ ID NO: 4426318 - DNA, 14 bp, Homo sapiens
tgactgtcagcaag

SEQ ID NO: 4426319 - DNA, 16 bp, Homo sapiens
tgactgtccaggagct

SEQ ID NO: 4426320 - DNA, 16 bp, Homo sapiens
tgactgtcccaccggg

SEQ ID NO: 4426321 - DNA, 21 bp, Homo sapiens
tgactgtgtaactttctctta

SEQ ID NO: 4426322 - DNA, 19 bp, Homo sapiens
tgacttaagggttgcttgc

SEQ ID NO: 4426323 - DNA, 19 bp, Homo sapiens
tgacttacaatttgcacaa

SEQ ID NO: 4426324 - DNA, 22 bp, Homo sapiens
tgacttagcctcctcccaaagt

SEQ ID NO: 4426325 - DNA, 21 bp, Homo sapiens
tgacttatttatataaatttt

SEQ ID NO: 4426326 - DNA, 12 bp, Homo sapiens
tgacttatttct

SEQ ID NO: 4426327 - DNA, 18 bp, Homo sapiens
tgacttatttctgctctg

SEQ ID NO: 4426328 - DNA, 21 bp, Homo sapiens
tgacttatttctgctctggaa

SEQ ID NO: 4426329 - DNA, 17 bp, Homo sapiens
tgacttcactgtatata

SEQ ID NO: 4426330 - DNA, 20 bp, Homo sapiens
tgacttcattttatatttaa

SEQ ID NO: 4426331 - DNA, 18 bp, Homo sapiens
tgacttccttatttctga

SEQ ID NO: 4426332 - DNA, 23 bp, Homo sapiens
tgacttctaagtaaaaccacagc

SEQ ID NO: 4426333 - DNA, 24 bp, Homo sapiens
tgacttctaagtaaaaccacagca

SEQ ID NO: 4426334 - DNA, 18 bp, Homo sapiens
tgacttctcaagtaacat

SEQ ID NO: 4426335 - DNA, 14 bp, Homo sapiens
tgacttctgctgct

SEQ ID NO: 4426336 - DNA, 17 bp, Homo sapiens
tgacttctttttggcat

SEQ ID NO: 4426337 - DNA, 15 bp, Homo sapiens
tgacttgagatgaaa

SEQ ID NO: 4426338 - DNA, 14 bp, Homo sapiens
tgacttgagccact

SEQ ID NO: 4426339 - DNA, 18 bp, Homo sapiens
tgacttgcaatccaggct

SEQ ID NO: 4426340 - DNA, 20 bp, Homo sapiens
tgacttgcaatccaggctgt

SEQ ID NO: 4426341 - DNA, 23 bp, Homo sapiens
tgacttgcacagggattctcaca

SEQ ID NO: 4426342 - DNA, 18 bp, Homo sapiens
tgacttgcgcttaatcca

SEQ ID NO: 4426343 - DNA, 15 bp, Homo sapiens
tgacttgctttagtt

SEQ ID NO: 4426344 - DNA, 20 bp, Homo sapiens
tgacttgtacaaacagtatt

SEQ ID NO: 4426345 - DNA, 20 bp, Homo sapiens
tgactttagaaagctgacat

SEQ ID NO: 4426346 - DNA, 12 bp, Homo sapiens
tgactttataaa

SEQ ID NO: 4426347 - DNA, 14 bp, Homo sapiens
tgactttataaatt

SEQ ID NO: 4426348 - DNA, 15 bp, Homo sapiens
tgactttataaattt

SEQ ID NO: 4426349 - DNA, 14 bp, Homo sapiens
tgactttttaaaaa

SEQ ID NO: 4426350 - DNA, 14 bp, Homo sapiens
tgactttttataaa

SEQ ID NO: 4426351 - DNA, 15 bp, Homo sapiens
tgactttttggaatt

SEQ ID NO: 4426352 - DNA, 20 bp, Homo sapiens
tgactttttggaattcagca

SEQ ID NO: 4426353 - DNA, 15 bp, Homo sapiens
tgactttttttgtat

SEQ ID NO: 4426354 - DNA, 14 bp, Homo sapiens
tgagaaaactgtga

SEQ ID NO: 4426355 - DNA, 15 bp, Homo sapiens
tgagaaactgctgca

SEQ ID NO: 4426356 - DNA, 18 bp, Homo sapiens
tgagaaacttaaatgtta

SEQ ID NO: 4426357 - DNA, 18 bp, Homo sapiens
tgagaaagactattcaaa

SEQ ID NO: 4426358 - DNA, 20 bp, Homo sapiens
tgagaaagactattcaaaca

SEQ ID NO: 4426359 - DNA, 16 bp, Homo sapiens
tgagaaagcttttatt

SEQ ID NO: 4426360 - DNA, 19 bp, Homo sapiens
tgagaaagcttttattcct

SEQ ID NO: 4426361 - DNA, 15 bp, Homo sapiens
tgagaaaggacagag

SEQ ID NO: 4426362 - DNA, 15 bp, Homo sapiens
tgagaaatatggaca

SEQ ID NO: 4426363 - DNA, 13 bp, Homo sapiens
tgagaaatttaaa

SEQ ID NO: 4426364 - DNA, 18 bp, Homo sapiens
tgagaaatttaaactata

SEQ ID NO: 4426365 - DNA, 17 bp, Homo sapiens
tgagaaccagtctcctc

SEQ ID NO: 4426366 - DNA, 16 bp, Homo sapiens
tgagaaccttttcaaa

SEQ ID NO: 4426367 - DNA, 17 bp, Homo sapiens
tgagaaccttttcaaac

SEQ ID NO: 4426368 - DNA, 21 bp, Homo sapiens
tgagaagagcttgcacagcca

SEQ ID NO: 4426369 - DNA, 22 bp, Homo sapiens
tgagaagccatgtactcaagta

SEQ ID NO: 4426370 - DNA, 16 bp, Homo sapiens
tgagaaggcagccacc

SEQ ID NO: 4426371 - DNA, 17 bp, Homo sapiens
tgagaaggcagccacca

SEQ ID NO: 4426372 - DNA, 18 bp, Homo sapiens
tgagaatataccttattt

SEQ ID NO: 4426373 - DNA, 21 bp, Homo sapiens
tgagaatataccttatttatt

SEQ ID NO: 4426374 - DNA, 18 bp, Homo sapiens
tgagaatcactgctccag

SEQ ID NO: 4426375 - DNA, 14 bp, Homo sapiens
tgagaatcatttag

SEQ ID NO: 4426376 - DNA, 20 bp, Homo sapiens
tgagaatccagtttctttcc

SEQ ID NO: 4426377 - DNA, 20 bp, Homo sapiens
tgagaatcccaaatttgatt

SEQ ID NO: 4426378 - DNA, 21 bp, Homo sapiens
tgagaatcccaaatttgattg

SEQ ID NO: 4426379 - DNA, 17 bp, Homo sapiens
tgagaatgacagccttt

SEQ ID NO: 4426380 - DNA, 13 bp, Homo sapiens
tgagacaatgaaa

SEQ ID NO: 4426381 - DNA, 15 bp, Homo sapiens
tgagacactgtctct

SEQ ID NO: 4426382 - DNA, 15 bp, Homo sapiens
tgagacagacattca

SEQ ID NO: 4426383 - DNA, 16 bp, Homo sapiens
tgagacagctctgcat

SEQ ID NO: 4426384 - DNA, 15 bp, Homo sapiens
tgagacaggctgggt

SEQ ID NO: 4426385 - DNA, 16 bp, Homo sapiens
tgagacaggctgggtc

SEQ ID NO: 4426386 - DNA, 23 bp, Homo sapiens
tgagacaggctgggtcctgccag

SEQ ID NO: 4426387 - DNA, 15 bp, Homo sapiens
tgagacagtgaattt

SEQ ID NO: 4426388 - DNA, 12 bp, Homo sapiens
tgagacatccag

SEQ ID NO: 4426389 - DNA, 13 bp, Homo sapiens
tgagaccaggctg

SEQ ID NO: 4426390 - DNA, 14 bp, Homo sapiens
tgagaccagggtgg

SEQ ID NO: 4426391 - DNA, 20 bp, Homo sapiens
tgagaccagggtggccacac

SEQ ID NO: 4426392 - DNA, 18 bp, Homo sapiens
tgagaccatccattctcc

SEQ ID NO: 4426393 - DNA, 21 bp, Homo sapiens
tgagaccatccattctcctca

SEQ ID NO: 4426394 - DNA, 16 bp, Homo sapiens
tgagaccatgtttcaa

SEQ ID NO: 4426395 - DNA, 18 bp, Homo sapiens
tgagacccagccctcatc

SEQ ID NO: 4426396 - DNA, 20 bp, Homo sapiens
tgagacccagccctcatccc

SEQ ID NO: 4426397 - DNA, 14 bp, Homo sapiens
tgagacccctggcc

SEQ ID NO: 4426398 - DNA, 15 bp, Homo sapiens
tgagacccctggcct

SEQ ID NO: 4426399 - DNA, 16 bp, Homo sapiens
tgagacccctggcctc

SEQ ID NO: 4426400 - DNA, 12 bp, Homo sapiens
tgagacctcagc

SEQ ID NO: 4426401 - DNA, 13 bp, Homo sapiens
tgagacctcagcc

SEQ ID NO: 4426402 - DNA, 19 bp, Homo sapiens
tgagacctcagccatgagg

SEQ ID NO: 4426403 - DNA, 13 bp, Homo sapiens
tgagactccatct

SEQ ID NO: 4426404 - DNA, 12 bp, Homo sapiens
tgagactcgaga

SEQ ID NO: 4426405 - DNA, 16 bp, Homo sapiens
tgagactcgagaactt

SEQ ID NO: 4426406 - DNA, 21 bp, Homo sapiens
tgagactctagggtccagtgg

SEQ ID NO: 4426407 - DNA, 22 bp, Homo sapiens
tgagactgccccacggagacag

SEQ ID NO: 4426408 - DNA, 16 bp, Homo sapiens
tgagactgtacataat

SEQ ID NO: 4426409 - DNA, 14 bp, Homo sapiens
tgagactgtcctgt

SEQ ID NO: 4426410 - DNA, 22 bp, Homo sapiens
tgagactgtcctgtgcctgatt

SEQ ID NO: 4426411 - DNA, 22 bp, Homo sapiens
tgagactttttggtggatgtaa

SEQ ID NO: 4426412 - DNA, 17 bp, Homo sapiens
tgagagaagccacgctg

SEQ ID NO: 4426413 - DNA, 22 bp, Homo sapiens
tgagagaagccacgctgtcctc

SEQ ID NO: 4426414 - DNA, 18 bp, Homo sapiens
tgagagaccacacatttt

SEQ ID NO: 4426415 - DNA, 14 bp, Homo sapiens
tgagagacctgctc

SEQ ID NO: 4426416 - DNA, 10 bp, Homo sapiens
tgagagagac

SEQ ID NO: 4426417 - DNA, 14 bp, Homo sapiens
tgagagatgctgta

SEQ ID NO: 4426418 - DNA, 14 bp, Homo sapiens
tgagagccagtggc

SEQ ID NO: 4426419 - DNA, 19 bp, Homo sapiens
tgagagccctgctgtggga

SEQ ID NO: 4426420 - DNA, 22 bp, Homo sapiens
tgagagccctgctgtgggagag

SEQ ID NO: 4426421 - DNA, 11 bp, Homo sapiens
tgagagcctgt

SEQ ID NO: 4426422 - DNA, 18 bp, Homo sapiens
tgagaggagaaatgcaat

SEQ ID NO: 4426423 - DNA, 23 bp, Homo sapiens
tgagaggagaaatgcaataactc

SEQ ID NO: 4426424 - DNA, 20 bp, Homo sapiens
tgagaggcaatgattgttaa

SEQ ID NO: 4426425 - DNA, 16 bp, Homo sapiens
tgagaggctgtcatat

SEQ ID NO: 4426426 - DNA, 16 bp, Homo sapiens
tgagagtgaacaaatt

SEQ ID NO: 4426427 - DNA, 13 bp, Homo sapiens
tgagagtggcttt

SEQ ID NO: 4426428 - DNA, 19 bp, Homo sapiens
tgagatacaaggcccagaa

SEQ ID NO: 4426429 - DNA, 14 bp, Homo sapiens
tgagatactgaaat

SEQ ID NO: 4426430 - DNA, 15 bp, Homo sapiens
tgagatactttgcat

SEQ ID NO: 4426431 - DNA, 15 bp, Homo sapiens
tgagatagttttcat

SEQ ID NO: 4426432 - DNA, 22 bp, Homo sapiens
tgagatagttttcattttaact

SEQ ID NO: 4426433 - DNA, 20 bp, Homo sapiens
tgagatattattttaaattt

SEQ ID NO: 4426434 - DNA, 18 bp, Homo sapiens
tgagatcttcctgctgag

SEQ ID NO: 4426435 - DNA, 16 bp, Homo sapiens
tgagatggccatgctc

SEQ ID NO: 4426436 - DNA, 18 bp, Homo sapiens
tgagatgtgaacacatca

SEQ ID NO: 4426437 - DNA, 20 bp, Homo sapiens
tgagatgtgtatcagtgttt

SEQ ID NO: 4426438 - DNA, 19 bp, Homo sapiens
tgagattcaaacccaggct

SEQ ID NO: 4426439 - DNA, 20 bp, Homo sapiens
tgagatttaacccctccact

SEQ ID NO: 4426440 - DNA, 21 bp, Homo sapiens
tgagatttactgctctagaaa

SEQ ID NO: 4426441 - DNA, 13 bp, Homo sapiens
tgagatttcatct

SEQ ID NO: 4426442 - DNA, 22 bp, Homo sapiens
tgagatttcatctgctctcctt

SEQ ID NO: 4426443 - DNA, 21 bp, Homo sapiens
tgagattttttagatcttcct

SEQ ID NO: 4426444 - DNA, 16 bp, Homo sapiens
tgagattttttttccg

SEQ ID NO: 4426445 - DNA, 17 bp, Homo sapiens
tgagattttttttccgt

SEQ ID NO: 4426446 - DNA, 18 bp, Homo sapiens
tgagattttttttccgtg

SEQ ID NO: 4426447 - DNA, 16 bp, Homo sapiens
tgagcaaaggccctgg

SEQ ID NO: 4426448 - DNA, 20 bp, Homo sapiens
tgagcaaccacatttagaaa

SEQ ID NO: 4426449 - DNA, 16 bp, Homo sapiens
tgagcaactcttgatt

SEQ ID NO: 4426450 - DNA, 21 bp, Homo sapiens
tgagcacatctctctgccctc

SEQ ID NO: 4426451 - DNA, 23 bp, Homo sapiens
tgagcacatctctctgccctctc

SEQ ID NO: 4426452 - DNA, 18 bp, Homo sapiens
tgagcaccaccagggctc

SEQ ID NO: 4426453 - DNA, 20 bp, Homo sapiens
tgagcaccaccagggctcca

SEQ ID NO: 4426454 - DNA, 21 bp, Homo sapiens
tgagcaccaccagggctccag

SEQ ID NO: 4426455 - DNA, 18 bp, Homo sapiens
tgagcactcctggtgcag

SEQ ID NO: 4426456 - DNA, 13 bp, Homo sapiens
tgagcagaactga

SEQ ID NO: 4426457 - DNA, 23 bp, Homo sapiens
tgagcagccgccagctgggagca

SEQ ID NO: 4426458 - DNA, 13 bp, Homo sapiens
tgagcaggagctt

SEQ ID NO: 4426459 - DNA, 15 bp, Homo sapiens
tgagcaggagcttgg

SEQ ID NO: 4426460 - DNA, 22 bp, Homo sapiens
tgagcagtcgcctgcctgcagc

SEQ ID NO: 4426461 - DNA, 22 bp, Homo sapiens
tgagcatacatcttaaatcttt

SEQ ID NO: 4426462 - DNA, 15 bp, Homo sapiens
tgagcatattttctt

SEQ ID NO: 4426463 - DNA, 19 bp, Homo sapiens
tgagcatcaatcttgttac

SEQ ID NO: 4426464 - DNA, 15 bp, Homo sapiens
tgagcatcagagggc

SEQ ID NO: 4426465 - DNA, 13 bp, Homo sapiens
tgagcatggagct

SEQ ID NO: 4426466 - DNA, 23 bp, Homo sapiens
tgagcatggagctgtcacctctc

SEQ ID NO: 4426467 - DNA, 12 bp, Homo sapiens
tgagccaaacca

SEQ ID NO: 4426468 - DNA, 13 bp, Homo sapiens
tgagccaaaccag

SEQ ID NO: 4426469 - DNA, 20 bp, Homo sapiens
tgagccacagaaagctcctt

SEQ ID NO: 4426470 - DNA, 19 bp, Homo sapiens
tgagccacagcagcatttt

SEQ ID NO: 4426471 - DNA, 20 bp, Homo sapiens
tgagccaccgtgcctggcca

SEQ ID NO: 4426472 - DNA, 21 bp, Homo sapiens
tgagccaccgtgcctggccag

SEQ ID NO: 4426473 - DNA, 18 bp, Homo sapiens
tgagccacctgccctttt

SEQ ID NO: 4426474 - DNA, 16 bp, Homo sapiens
tgagccactccttcct

SEQ ID NO: 4426475 - DNA, 14 bp, Homo sapiens
tgagccagcagggc

SEQ ID NO: 4426476 - DNA, 13 bp, Homo sapiens
tgagccagctgca

SEQ ID NO: 4426477 - DNA, 17 bp, Homo sapiens
tgagccagctgcagaag

SEQ ID NO: 4426478 - DNA, 21 bp, Homo sapiens
tgagccatgatttcccactgc

SEQ ID NO: 4426479 - DNA, 22 bp, Homo sapiens
tgagccatgatttcccactgca

SEQ ID NO: 4426480 - DNA, 16 bp, Homo sapiens
tgagcccattcttctg

SEQ ID NO: 4426481 - DNA, 19 bp, Homo sapiens
tgagcccattcttctgggt

SEQ ID NO: 4426482 - DNA, 12 bp, Homo sapiens
tgagccccagcg

SEQ ID NO: 4426483 - DNA, 23 bp, Homo sapiens
tgagcccccaccggaactgggct

SEQ ID NO: 4426484 - DNA, 16 bp, Homo sapiens
tgagcccctccccagc

SEQ ID NO: 4426485 - DNA, 19 bp, Homo sapiens
tgagcccctccccagccag

SEQ ID NO: 4426486 - DNA, 20 bp, Homo sapiens
tgagcccctttgcctgtcaa

SEQ ID NO: 4426487 - DNA, 20 bp, Homo sapiens
tgagccctggctcccacctg

SEQ ID NO: 4426488 - DNA, 17 bp, Homo sapiens
tgagccgcatcttctcc

SEQ ID NO: 4426489 - DNA, 20 bp, Homo sapiens
tgagccgcatcttctccatc

SEQ ID NO: 4426490 - DNA, 21 bp, Homo sapiens
tgagccgcatcttctccatct

SEQ ID NO: 4426491 - DNA, 15 bp, Homo sapiens
tgagccgcggggaag

SEQ ID NO: 4426492 - DNA, 23 bp, Homo sapiens
tgagccgcggggaagctggcttt

SEQ ID NO: 4426493 - DNA, 15 bp, Homo sapiens
tgagccgggcccctg

SEQ ID NO: 4426494 - DNA, 16 bp, Homo sapiens
tgagcctcctgtgcct

SEQ ID NO: 4426495 - DNA, 17 bp, Homo sapiens
tgagcctcctgtgcctg

SEQ ID NO: 4426496 - DNA, 15 bp, Homo sapiens
tgagcctggtcctgg

SEQ ID NO: 4426497 - DNA, 13 bp, Homo sapiens
tgagcgacagtga

SEQ ID NO: 4426498 - DNA, 14 bp, Homo sapiens
tgagcgacagtgag

SEQ ID NO: 4426499 - DNA, 16 bp, Homo sapiens
tgagcgacagtgagac

SEQ ID NO: 4426500 - DNA, 22 bp, Homo sapiens
tgagcgaggagatgctccttgg

SEQ ID NO: 4426501 - DNA, 21 bp, Homo sapiens
tgagctaaataaagatattgt

SEQ ID NO: 4426502 - DNA, 18 bp, Homo sapiens
tgagctactggattctta

SEQ ID NO: 4426503 - DNA, 19 bp, Homo sapiens
tgagctagaagctggagga

SEQ ID NO: 4426504 - DNA, 22 bp, Homo sapiens
tgagctagaagctggaggacta

SEQ ID NO: 4426505 - DNA, 20 bp, Homo sapiens
tgaaaaatctgctgttaact

SEQ ID NO: 4426506 - DNA, 15 bp, Homo sapiens
tgaaaaatgtcacta

SEQ ID NO: 4426507 - DNA, 17 bp, Homo sapiens
tgaaaaccaaaatgaca

SEQ ID NO: 4426508 - DNA, 14 bp, Homo sapiens
tgaaaacccagaga

SEQ ID NO: 4426509 - DNA, 16 bp, Homo sapiens
tgaaaacccagagagg

SEQ ID NO: 4426510 - DNA, 20 bp, Homo sapiens
tgaaaaccgtaaagtgcctt

SEQ ID NO: 4426511 - DNA, 16 bp, Homo sapiens
tgaaaactaaggattt

SEQ ID NO: 4426512 - DNA, 22 bp, Homo sapiens
tgaaaactagcattacattatt

SEQ ID NO: 4426513 - DNA, 19 bp, Homo sapiens
tgaaaactttatgctaagt

SEQ ID NO: 4426514 - DNA, 16 bp, Homo sapiens
tgaaaagaaggaaaga

SEQ ID NO: 4426515 - DNA, 19 bp, Homo sapiens
tgaaaagacaagaaaatca

SEQ ID NO: 4426516 - DNA, 18 bp, Homo sapiens
tgaaaagacgctaataaa

SEQ ID NO: 4426517 - DNA, 15 bp, Homo sapiens
tgaaaagactccaaa

SEQ ID NO: 4426518 - DNA, 16 bp, Homo sapiens
tgaaaagactccaaag

SEQ ID NO: 4426519 - DNA, 17 bp, Homo sapiens
tgaaaagactccaaaga

SEQ ID NO: 4426520 - DNA, 23 bp, Homo sapiens
tgaaaagcacaaggggccaaggt

SEQ ID NO: 4426521 - DNA, 16 bp, Homo sapiens
tgaaaagcagacattt

SEQ ID NO: 4426522 - DNA, 23 bp, Homo sapiens
tgaaaagcctccgcctgctgtgt

SEQ ID NO: 4426523 - DNA, 15 bp, Homo sapiens
tgaaaagctaccctg

SEQ ID NO: 4426524 - DNA, 19 bp, Homo sapiens
tgaaaagctaccctgaaac

SEQ ID NO: 4426525 - DNA, 17 bp, Homo sapiens
tgaaaagctagaattga

SEQ ID NO: 4426526 - DNA, 22 bp, Homo sapiens
tgaaaagtcgttttccaaactg

SEQ ID NO: 4426527 - DNA, 20 bp, Homo sapiens
tgaaaataaaaagatcactt

SEQ ID NO: 4426528 - DNA, 15 bp, Homo sapiens
tgaaaataaaacaca

SEQ ID NO: 4426529 - DNA, 16 bp, Homo sapiens
tgaaaataactgaatt

SEQ ID NO: 4426530 - DNA, 12 bp, Homo sapiens
tgaaaatacaac

SEQ ID NO: 4426531 - DNA, 22 bp, Homo sapiens
tgaaaatagctatttttttcct

SEQ ID NO: 4426532 - DNA, 17 bp, Homo sapiens
tgaaaatagtgtaagaa

SEQ ID NO: 4426533 - DNA, 20 bp, Homo sapiens
tgaaaatatacttgactcta

SEQ ID NO: 4426534 - DNA, 23 bp, Homo sapiens
tgaaaatatacttgactctaata

SEQ ID NO: 4426535 - DNA, 15 bp, Homo sapiens
tgaaaatatagacat

SEQ ID NO: 4426536 - DNA, 16 bp, Homo sapiens
tgaaaatatgtactgt

SEQ ID NO: 4426537 - DNA, 22 bp, Homo sapiens
tgaaaatatttgtatcacaaat

SEQ ID NO: 4426538 - DNA, 20 bp, Homo sapiens
tgaaaatgggatgaattctt

SEQ ID NO: 4426539 - DNA, 20 bp, Homo sapiens
tgaaaatgtattcctttaaa

SEQ ID NO: 4426540 - DNA, 15 bp, Homo sapiens
tgaaaatgtcttgtg

SEQ ID NO: 4426541 - DNA, 16 bp, Homo sapiens
tgaaaatgtcttgtgt

SEQ ID NO: 4426542 - DNA, 19 bp, Homo sapiens
tgaaaatgtgctatactgc

SEQ ID NO: 4426543 - DNA, 22 bp, Homo sapiens
tgaaaatgtgctatactgcata

SEQ ID NO: 4426544 - DNA, 14 bp, Homo sapiens
tgaaaattatttaa

SEQ ID NO: 4426545 - DNA, 21 bp, Homo sapiens
tgaaaattcgcccgagctgtt

SEQ ID NO: 4426546 - DNA, 16 bp, Homo sapiens
tgaaaattgtatacca

SEQ ID NO: 4426547 - DNA, 13 bp, Homo sapiens
tgaaaattgtatt

SEQ ID NO: 4426548 - DNA, 13 bp, Homo sapiens
tgaaaatttaaca

SEQ ID NO: 4426549 - DNA, 16 bp, Homo sapiens
tgaaaattttaagaag

SEQ ID NO: 4426550 - DNA, 23 bp, Homo sapiens
tgaaacaaagagttcaagaaata

SEQ ID NO: 4426551 - DNA, 15 bp, Homo sapiens
tgaaacactttgcct

SEQ ID NO: 4426552 - DNA, 23 bp, Homo sapiens
tgaaacagattcaggccagccca

SEQ ID NO: 4426553 - DNA, 9 bp, Homo sapiens
tgaaacagc

SEQ ID NO: 4426554 - DNA, 17 bp, Homo sapiens
tgaaacagctgccttag

SEQ ID NO: 4426555 - DNA, 19 bp, Homo sapiens
tgaaacagctgccttagct

SEQ ID NO: 4426556 - DNA, 15 bp, Homo sapiens
tgaaacattttttct

SEQ ID NO: 4426557 - DNA, 21 bp, Homo sapiens
tgaaaccaccgtgaaccagag

SEQ ID NO: 4426558 - DNA, 17 bp, Homo sapiens
tgaaaccagtatttaag

SEQ ID NO: 4426559 - DNA, 19 bp, Homo sapiens
tgaaaccagtatttaagct

SEQ ID NO: 4426560 - DNA, 20 bp, Homo sapiens
tgaaaccagtgttagggaag

SEQ ID NO: 4426561 - DNA, 19 bp, Homo sapiens
tgaaacctagtactgcccc

SEQ ID NO: 4426562 - DNA, 15 bp, Homo sapiens
tgaaacctcttccta

SEQ ID NO: 4426563 - DNA, 16 bp, Homo sapiens
tgaaacctcttcctag

SEQ ID NO: 4426564 - DNA, 17 bp, Homo sapiens
tgaaacctcttcctagg

SEQ ID NO: 4426565 - DNA, 15 bp, Homo sapiens
tgaaactgcatttgt

SEQ ID NO: 4426566 - DNA, 16 bp, Homo sapiens
tgaaactgcatttgtg

SEQ ID NO: 4426567 - DNA, 14 bp, Homo sapiens
tgaaagaacataca

SEQ ID NO: 4426568 - DNA, 20 bp, Homo sapiens
tgaaagaagaaaacagtaca

SEQ ID NO: 4426569 - DNA, 18 bp, Homo sapiens
tgaaagcagggacttgaa

SEQ ID NO: 4426570 - DNA, 22 bp, Homo sapiens
tgaaagccttagggaagctggc

SEQ ID NO: 4426571 - DNA, 15 bp, Homo sapiens
tgaaagctactcata

SEQ ID NO: 4426572 - DNA, 13 bp, Homo sapiens
tgaaagctagaga

SEQ ID NO: 4426573 - DNA, 22 bp, Homo sapiens
tgaaaggaagagctaataaatc

SEQ ID NO: 4426574 - DNA, 13 bp, Homo sapiens
tgaaagggaaact

SEQ ID NO: 4426575 - DNA, 14 bp, Homo sapiens
tgaaagggaaactg

SEQ ID NO: 4426576 - DNA, 20 bp, Homo sapiens
tgaaagggagctatcaggaa

SEQ ID NO: 4426577 - DNA, 19 bp, Homo sapiens
tgaaaggggacacctgtac

SEQ ID NO: 4426578 - DNA, 22 bp, Homo sapiens
tgaaaggggacacctgtacatt

SEQ ID NO: 4426579 - DNA, 18 bp, Homo sapiens
tgaaaggtagacttttat

SEQ ID NO: 4426580 - DNA, 17 bp, Homo sapiens
tgaaaggttttttttca

SEQ ID NO: 4426581 - DNA, 18 bp, Homo sapiens
tgaaaggttttttttcag

SEQ ID NO: 4426582 - DNA, 21 bp, Homo sapiens
tgaaagtagattcatgaaaat

SEQ ID NO: 4426583 - DNA, 17 bp, Homo sapiens
tgaaagtcctgctttcc

SEQ ID NO: 4426584 - DNA, 15 bp, Homo sapiens
tgaaagtgatgacat

SEQ ID NO: 4426585 - DNA, 19 bp, Homo sapiens
tgaaagtgggcaaaagctt

SEQ ID NO: 4426586 - DNA, 13 bp, Homo sapiens
tgaaagttgtaca

SEQ ID NO: 4426587 - DNA, 15 bp, Homo sapiens
tgaaagttgtacatg

SEQ ID NO: 4426588 - DNA, 15 bp, Homo sapiens
tgaaagtttaacaaa

SEQ ID NO: 4426589 - DNA, 22 bp, Homo sapiens
tgaaagtttaacaaatgactgt

SEQ ID NO: 4426590 - DNA, 18 bp, Homo sapiens
tgaaagttttcagaacct

SEQ ID NO: 4426591 - DNA, 20 bp, Homo sapiens
tgaaagttttcagaacctct

SEQ ID NO: 4426592 - DNA, 14 bp, Homo sapiens
tgaaagttttgtaa

SEQ ID NO: 4426593 - DNA, 18 bp, Homo sapiens
tgaaataaaatatcaata

SEQ ID NO: 4426594 - DNA, 14 bp, Homo sapiens
tgaaataaagttga

SEQ ID NO: 4426595 - DNA, 23 bp, Homo sapiens
tgaaataaccgtaaaggtttatt

SEQ ID NO: 4426596 - DNA, 20 bp, Homo sapiens
tgaaataagaattcagacat

SEQ ID NO: 4426597 - DNA, 18 bp, Homo sapiens
tgaaataagccagacatc

SEQ ID NO: 4426598 - DNA, 23 bp, Homo sapiens
tgaaataagccagacatcaacag

SEQ ID NO: 4426599 - DNA, 13 bp, Homo sapiens
tgaaataagtaaa

SEQ ID NO: 4426600 - DNA, 17 bp, Homo sapiens
tgaaataagtaaatgta

SEQ ID NO: 4426601 - DNA, 14 bp, Homo sapiens
tgaaataatatatt

SEQ ID NO: 4426602 - DNA, 18 bp, Homo sapiens
tgaaatacttattatttt

SEQ ID NO: 4426603 - DNA, 20 bp, Homo sapiens
tgaaatagtcctgaagttct

SEQ ID NO: 4426604 - DNA, 13 bp, Homo sapiens
tgaaatatataat

SEQ ID NO: 4426605 - DNA, 16 bp, Homo sapiens
tgaaatatatgtgaaa

SEQ ID NO: 4426606 - DNA, 23 bp, Homo sapiens
tgaaatatcatcacgtatgttat

SEQ ID NO: 4426607 - DNA, 13 bp, Homo sapiens
tgaaatatcatgt

SEQ ID NO: 4426608 - DNA, 16 bp, Homo sapiens
tgaaatattcagaaat

SEQ ID NO: 4426609 - DNA, 14 bp, Homo sapiens
tgaaatccaggaat

SEQ ID NO: 4426610 - DNA, 12 bp, Homo sapiens
tgaaatccctgc

SEQ ID NO: 4426611 - DNA, 23 bp, Homo sapiens
tgaaatcctcagccgagaaattg

SEQ ID NO: 4426612 - DNA, 15 bp, Homo sapiens
tgaaatctgtcaaga

SEQ ID NO: 4426613 - DNA, 14 bp, Homo sapiens
tgaaatgaaaggga

SEQ ID NO: 4426614 - DNA, 15 bp, Homo sapiens
tgaaatgaaagggaa

SEQ ID NO: 4426615 - DNA, 17 bp, Homo sapiens
tgaaatgaaagggaaac

SEQ ID NO: 4426616 - DNA, 18 bp, Homo sapiens
tgaaatgaggtctgttta

SEQ ID NO: 4426617 - DNA, 19 bp, Homo sapiens
tgaaatgaggtctgtttaa

SEQ ID NO: 4426618 - DNA, 23 bp, Homo sapiens
tgaaatgaggtctgtttaaagtg

SEQ ID NO: 4426619 - DNA, 15 bp, Homo sapiens
tgaaatgccaaagga

SEQ ID NO: 4426620 - DNA, 23 bp, Homo sapiens
tgaaatgctgtatttttacagct

SEQ ID NO: 4426621 - DNA, 18 bp, Homo sapiens
tgaaatgcttttatattc

SEQ ID NO: 4426622 - DNA, 14 bp, Homo sapiens
tgaaatgtaatttc

SEQ ID NO: 4426623 - DNA, 17 bp, Homo sapiens
tgaaatgtaatttcagt

SEQ ID NO: 4426624 - DNA, 22 bp, Homo sapiens
tgaaatgtacgtcatttgtgca

SEQ ID NO: 4426625 - DNA, 15 bp, Homo sapiens
tgaaatgttaacaat

SEQ ID NO: 4426626 - DNA, 13 bp, Homo sapiens
tgaaattaacaca

SEQ ID NO: 4426627 - DNA, 20 bp, Homo sapiens
tgaaattaacacaaaggaag

SEQ ID NO: 4426628 - DNA, 14 bp, Homo sapiens
tgaaattaacctct

SEQ ID NO: 4426629 - DNA, 17 bp, Homo sapiens
tgaaattaacctctcac

SEQ ID NO: 4426630 - DNA, 22 bp, Homo sapiens
tgaaattatgtgacattttaca

SEQ ID NO: 4426631 - DNA, 13 bp, Homo sapiens
tgaaatttacaca

SEQ ID NO: 4426632 - DNA, 17 bp, Homo sapiens
tgaaatttacacagtga

SEQ ID NO: 4426633 - DNA, 20 bp, Homo sapiens
tgaaattttaacctatgata

SEQ ID NO: 4426634 - DNA, 15 bp, Homo sapiens
tgaacaaaagggtca

SEQ ID NO: 4426635 - DNA, 14 bp, Homo sapiens
tgaacaaagacatt

SEQ ID NO: 4426636 - DNA, 15 bp, Homo sapiens
tgaacaaagacattt

SEQ ID NO: 4426637 - DNA, 19 bp, Homo sapiens
tgaacaaatttacagagac

SEQ ID NO: 4426638 - DNA, 16 bp, Homo sapiens
tgaacaaattttctgg

SEQ ID NO: 4426639 - DNA, 23 bp, Homo sapiens
tgaacaagatgtgggccttgcaa

SEQ ID NO: 4426640 - DNA, 16 bp, Homo sapiens
tgaacaatattttctc

SEQ ID NO: 4426641 - DNA, 18 bp, Homo sapiens
tgaacaattgctatttaa

SEQ ID NO: 4426642 - DNA, 20 bp, Homo sapiens
tgaacaattgctatttaaat

SEQ ID NO: 4426643 - DNA, 21 bp, Homo sapiens
tgaacaattgtcgaaaagagt

SEQ ID NO: 4426644 - DNA, 12 bp, Homo sapiens
tgaacacagtat

SEQ ID NO: 4426645 - DNA, 13 bp, Homo sapiens
tgaacacagtatt

SEQ ID NO: 4426646 - DNA, 15 bp, Homo sapiens
tgaacacagtatttt

SEQ ID NO: 4426647 - DNA, 20 bp, Homo sapiens
tgaacaccattgaaggctta

SEQ ID NO: 4426648 - DNA, 22 bp, Homo sapiens
tgaacacgaaagaaatgtacct

SEQ ID NO: 4426649 - DNA, 21 bp, Homo sapiens
tgaacagccctctctctcact

SEQ ID NO: 4426650 - DNA, 21 bp, Homo sapiens
tgaacagctttgtatgtttat

SEQ ID NO: 4426651 - DNA, 20 bp, Homo sapiens
tgaacagtactggttacttt

SEQ ID NO: 4426652 - DNA, 20 bp, Homo sapiens
tgaacatagactagagaaac

SEQ ID NO: 4426653 - DNA, 20 bp, Homo sapiens
tgaacatctcatgtgtgctc

SEQ ID NO: 4426654 - DNA, 18 bp, Homo sapiens
tgaacatcttttaactgc

SEQ ID NO: 4426655 - DNA, 11 bp, Homo sapiens
tgaacattcca

SEQ ID NO: 4426656 - DNA, 20 bp, Homo sapiens
tgaacatttactacagtttt

SEQ ID NO: 4426657 - DNA, 15 bp, Homo sapiens
tgaaccaatctggat

SEQ ID NO: 4426658 - DNA, 13 bp, Homo sapiens
tgaaccaatgcaa

SEQ ID NO: 4426659 - DNA, 15 bp, Homo sapiens
tgaaccactgtgccc

SEQ ID NO: 4426660 - DNA, 21 bp, Homo sapiens
tgaaccaggccagagcaaaca

SEQ ID NO: 4426661 - DNA, 21 bp, Homo sapiens
tgaaccattatactttatatc

SEQ ID NO: 4426662 - DNA, 22 bp, Homo sapiens
tgaacccatattttaaattctc

SEQ ID NO: 4426663 - DNA, 18 bp, Homo sapiens
tgaacccgggaggcagag

SEQ ID NO: 4426664 - DNA, 16 bp, Homo sapiens
tgaacgactgtatatt

SEQ ID NO: 4426665 - DNA, 21 bp, Homo sapiens
tgaacgactgtatattgctaa

SEQ ID NO: 4426666 - DNA, 13 bp, Homo sapiens
tgaacggggagaa

SEQ ID NO: 4426667 - DNA, 17 bp, Homo sapiens
tgaacgttttaataatt

SEQ ID NO: 4426668 - DNA, 19 bp, Homo sapiens
tgaactaaagtgctgcact

SEQ ID NO: 4426669 - DNA, 17 bp, Homo sapiens
tgaactaggctgagcaa

SEQ ID NO: 4426670 - DNA, 18 bp, Homo sapiens
tgaactaggctgagcaat

SEQ ID NO: 4426671 - DNA, 14 bp, Homo sapiens
tgaactcaaactga

SEQ ID NO: 4426672 - DNA, 17 bp, Homo sapiens
tgaactcaaactgagga

SEQ ID NO: 4426673 - DNA, 18 bp, Homo sapiens
tgaactcaaactgaggaa

SEQ ID NO: 4426674 - DNA, 18 bp, Homo sapiens
tgaactcactttcctcct

SEQ ID NO: 4426675 - DNA, 22 bp, Homo sapiens
tgaactcagatctgtctgatag

SEQ ID NO: 4426676 - DNA, 13 bp, Homo sapiens
tgaactcatccct

SEQ ID NO: 4426677 - DNA, 20 bp, Homo sapiens
tgaactcatcccttgtttat

SEQ ID NO: 4426678 - DNA, 12 bp, Homo sapiens
tgaactccattt

SEQ ID NO: 4426679 - DNA, 19 bp, Homo sapiens
tgaactctggtgctcctgc

SEQ ID NO: 4426680 - DNA, 19 bp, Homo sapiens
tgaactctgttcccccacc

SEQ ID NO: 4426681 - DNA, 21 bp, Homo sapiens
tgaactctgttcccccaccct

SEQ ID NO: 4426682 - DNA, 22 bp, Homo sapiens
tgaactgaacaccattgaaggc

SEQ ID NO: 4426683 - DNA, 14 bp, Homo sapiens
tgaactgacaatga

SEQ ID NO: 4426684 - DNA, 15 bp, Homo sapiens
tgaactgacaatgaa

SEQ ID NO: 4426685 - DNA, 20 bp, Homo sapiens
tgaactgacaatgaagggaa

SEQ ID NO: 4426686 - DNA, 14 bp, Homo sapiens
tgaactgagcccca

SEQ ID NO: 4426687 - DNA, 15 bp, Homo sapiens
tgaactgagccccag

SEQ ID NO: 4426688 - DNA, 17 bp, Homo sapiens
tgaactgagccccagcg

SEQ ID NO: 4426689 - DNA, 23 bp, Homo sapiens
tgaactgcttttaaaagtgcaca

SEQ ID NO: 4426690 - DNA, 14 bp, Homo sapiens
tgaactggaagaaa

SEQ ID NO: 4426691 - DNA, 15 bp, Homo sapiens
tgaactggaagaaag

SEQ ID NO: 4426692 - DNA, 20 bp, Homo sapiens
tgaactggtagaaaaacatc

SEQ ID NO: 4426693 - DNA, 15 bp, Homo sapiens
tgaactggtcttcct

SEQ ID NO: 4426694 - DNA, 20 bp, Homo sapiens
tgaacttactgtagcctcag

SEQ ID NO: 4426695 - DNA, 22 bp, Homo sapiens
tgaacttgaagctaacgttaga

SEQ ID NO: 4426696 - DNA, 17 bp, Homo sapiens
tgaacttgactgggtga

SEQ ID NO: 4426697 - DNA, 16 bp, Homo sapiens
tgaacttgcctctttt

SEQ ID NO: 4426698 - DNA, 14 bp, Homo sapiens
tgaactttccaaaa

SEQ ID NO: 4426699 - DNA, 17 bp, Homo sapiens
tgaactttccaaaacct

SEQ ID NO: 4426700 - DNA, 18 bp, Homo sapiens
tgaactttgaatgaaatt

SEQ ID NO: 4426701 - DNA, 11 bp, Homo sapiens
tgaacttttct

SEQ ID NO: 4426702 - DNA, 12 bp, Homo sapiens
tgaacttttgta

SEQ ID NO: 4426703 - DNA, 13 bp, Homo sapiens
tgaacttttgtac

SEQ ID NO: 4426704 - DNA, 15 bp, Homo sapiens
tgaacttttgtactg

SEQ ID NO: 4426705 - DNA, 21 bp, Homo sapiens
tgaagaaaatcacttaggaaa

SEQ ID NO: 4426706 - DNA, 20 bp, Homo sapiens
tgaagaaagggaggcccagc

SEQ ID NO: 4426707 - DNA, 19 bp, Homo sapiens
tgaagaactgaggaggaaa

SEQ ID NO: 4426708 - DNA, 17 bp, Homo sapiens
tgaagaagttaattctt

SEQ ID NO: 4426709 - DNA, 16 bp, Homo sapiens
tgaagaatacttctca

SEQ ID NO: 4426710 - DNA, 20 bp, Homo sapiens
tgaagaatctacttaaccct

SEQ ID NO: 4426711 - DNA, 13 bp, Homo sapiens
tgaagacagcttc

SEQ ID NO: 4426712 - DNA, 15 bp, Homo sapiens
tgaagactggaagct

SEQ ID NO: 4426713 - DNA, 17 bp, Homo sapiens
tgaagagatccttccat

SEQ ID NO: 4426714 - DNA, 22 bp, Homo sapiens
tgaagagccggtggtgcccgtg

SEQ ID NO: 4426715 - DNA, 15 bp, Homo sapiens
tgaagagctagagaa

SEQ ID NO: 4426716 - DNA, 15 bp, Homo sapiens
tgaagagctcttggc

SEQ ID NO: 4426717 - DNA, 17 bp, Homo sapiens
tgaagagctcttggccc

SEQ ID NO: 4426718 - DNA, 14 bp, Homo sapiens
tgaagagtcagaac

SEQ ID NO: 4426719 - DNA, 15 bp, Homo sapiens
tgaagagtttcacaa

SEQ ID NO: 4426720 - DNA, 16 bp, Homo sapiens
tgaagatcaatttctc

SEQ ID NO: 4426721 - DNA, 20 bp, Homo sapiens
tgaagatgaaatatatattg

SEQ ID NO: 4426722 - DNA, 22 bp, Homo sapiens
tgaagattcttaaaaattgaat

SEQ ID NO: 4426723 - DNA, 20 bp, Homo sapiens
tgaagcaaatcgaatgaaat

SEQ ID NO: 4426724 - DNA, 17 bp, Homo sapiens
tgaagcaattagtctga

SEQ ID NO: 4426725 - DNA, 23 bp, Homo sapiens
tgaagcaattagtctgaaactgg

SEQ ID NO: 4426726 - DNA, 17 bp, Homo sapiens
tgaagcagcactgtgag

SEQ ID NO: 4426727 - DNA, 14 bp, Homo sapiens
tgaagcagtatttt

SEQ ID NO: 4426728 - DNA, 15 bp, Homo sapiens
tgaagcataaagtta

SEQ ID NO: 4426729 - DNA, 18 bp, Homo sapiens
tgaagcataaagttacct

SEQ ID NO: 4426730 - DNA, 18 bp, Homo sapiens
tgaagcattatggtctaa

SEQ ID NO: 4426731 - DNA, 11 bp, Homo sapiens
tgaagccaaag

SEQ ID NO: 4426732 - DNA, 14 bp, Homo sapiens
tgaagccaagtggg

SEQ ID NO: 4426733 - DNA, 22 bp, Homo sapiens
tgaagccaagtggggtgctggg

SEQ ID NO: 4426734 - DNA, 16 bp, Homo sapiens
tgaagcccaagaagtt

SEQ ID NO: 4426735 - DNA, 19 bp, Homo sapiens
tgaagcctctctccttggc

SEQ ID NO: 4426736 - DNA, 13 bp, Homo sapiens
tgaagcctctggg

SEQ ID NO: 4426737 - DNA, 13 bp, Homo sapiens
tgaagcctgtgga

SEQ ID NO: 4426738 - DNA, 15 bp, Homo sapiens
tgaagccttttgaaa

SEQ ID NO: 4426739 - DNA, 21 bp, Homo sapiens
tgaagctcgcatccagacagt

SEQ ID NO: 4426740 - DNA, 13 bp, Homo sapiens
tgaagctgacagc

SEQ ID NO: 4426741 - DNA, 23 bp, Homo sapiens
tgaaggaaaaacacaagcaaaaa

SEQ ID NO: 4426742 - DNA, 21 bp, Homo sapiens
tgaaggaaataaaaaagtctc

SEQ ID NO: 4426743 - DNA, 15 bp, Homo sapiens
tgaaggaacttgtct

SEQ ID NO: 4426744 - DNA, 23 bp, Homo sapiens
tgaaggagccccattcctgggaa

SEQ ID NO: 4426745 - DNA, 17 bp, Homo sapiens
tgaaggcaaaattgcaa

SEQ ID NO: 4426746 - DNA, 18 bp, Homo sapiens
tgaaggctaaaaagcaac

SEQ ID NO: 4426747 - DNA, 23 bp, Homo sapiens
tgaaggtctcctaaaactgggat

SEQ ID NO: 4426748 - DNA, 15 bp, Homo sapiens
tgaaggtggggagaa

SEQ ID NO: 4426749 - DNA, 17 bp, Homo sapiens
tgaagtaacttatttga

SEQ ID NO: 4426750 - DNA, 20 bp, Homo sapiens
tgaagtaatgaatttttatg

SEQ ID NO: 4426751 - DNA, 17 bp, Homo sapiens
tgaagtacaaacatgaa

SEQ ID NO: 4426752 - DNA, 17 bp, Homo sapiens
tgaagtactcatacatg

SEQ ID NO: 4426753 - DNA, 13 bp, Homo sapiens
tgaagtataaatc

SEQ ID NO: 4426754 - DNA, 15 bp, Homo sapiens
tgaagtattacatga

SEQ ID NO: 4426755 - DNA, 16 bp, Homo sapiens
tgaagtattacatgat

SEQ ID NO: 4426756 - DNA, 23 bp, Homo sapiens
tgaagtcacccctttctgtccca

SEQ ID NO: 4426757 - DNA, 23 bp, Homo sapiens
tgaagtgagctgagattgcacca

SEQ ID NO: 4426758 - DNA, 19 bp, Homo sapiens
tgaagtgtggctggtgtcc

SEQ ID NO: 4426759 - DNA, 21 bp, Homo sapiens
tgaagtgttaatacatcacat

SEQ ID NO: 4426760 - DNA, 18 bp, Homo sapiens
tgaagttagctttaactt

SEQ ID NO: 4426761 - DNA, 18 bp, Homo sapiens
tgaagtttaattgtctca

SEQ ID NO: 4426762 - DNA, 13 bp, Homo sapiens
tgaagtttcaagt

SEQ ID NO: 4426763 - DNA, 21 bp, Homo sapiens
tgaagtttcaagttttaaagt

SEQ ID NO: 4426764 - DNA, 23 bp, Homo sapiens
tgaagtttcaagttttaaagttc

SEQ ID NO: 4426765 - DNA, 17 bp, Homo sapiens
tgaagttttacattgtt

SEQ ID NO: 4426766 - DNA, 23 bp, Homo sapiens
tgaagttttccttgctatttcaa

SEQ ID NO: 4426767 - DNA, 16 bp, Homo sapiens
tgaataaagaatactt

SEQ ID NO: 4426768 - DNA, 17 bp, Homo sapiens
tgaataaagaatacttg

SEQ ID NO: 4426769 - DNA, 18 bp, Homo sapiens
tgaataaagaatacttga

SEQ ID NO: 4426770 - DNA, 16 bp, Homo sapiens
tgaataaagaatgcca

SEQ ID NO: 4426771 - DNA, 20 bp, Homo sapiens
tgaataaagcctttgtatct

SEQ ID NO: 4426772 - DNA, 15 bp, Homo sapiens
tgaataaattttcaa

SEQ ID NO: 4426773 - DNA, 19 bp, Homo sapiens
tgaataaattttcaaatcc

SEQ ID NO: 4426774 - DNA, 18 bp, Homo sapiens
tgaataacatttaaattc

SEQ ID NO: 4426775 - DNA, 19 bp, Homo sapiens
tgaataatggaaaatgcca

SEQ ID NO: 4426776 - DNA, 17 bp, Homo sapiens
tgaatacacttacagtt

SEQ ID NO: 4426777 - DNA, 22 bp, Homo sapiens
tgaataccccaagactcccatg

SEQ ID NO: 4426778 - DNA, 16 bp, Homo sapiens
tgaatactgtattttg

SEQ ID NO: 4426779 - DNA, 18 bp, Homo sapiens
tgaatagatatgaaagct

SEQ ID NO: 4426780 - DNA, 21 bp, Homo sapiens
tgaatagatatgaaagctgat

SEQ ID NO: 4426781 - DNA, 22 bp, Homo sapiens
tgaatagatgtgcccttttata

SEQ ID NO: 4426782 - DNA, 15 bp, Homo sapiens
tgaatagcctggcca

SEQ ID NO: 4426783 - DNA, 17 bp, Homo sapiens
tgaataggttatatgca

SEQ ID NO: 4426784 - DNA, 15 bp, Homo sapiens
tgaatagtattgtgt

SEQ ID NO: 4426785 - DNA, 19 bp, Homo sapiens
tgaatagtggaacattttc

SEQ ID NO: 4426786 - DNA, 23 bp, Homo sapiens
tgaatagttaaaaattaaatatt

SEQ ID NO: 4426787 - DNA, 19 bp, Homo sapiens
tgaatagtttatttctgtg

SEQ ID NO: 4426788 - DNA, 12 bp, Homo sapiens
tgaatataaaaa

SEQ ID NO: 4426789 - DNA, 13 bp, Homo sapiens
tgaatataaaaaa

SEQ ID NO: 4426790 - DNA, 13 bp, Homo sapiens
tgaatataaatgt

SEQ ID NO: 4426791 - DNA, 19 bp, Homo sapiens
tgaatataaatgtgtgtat

SEQ ID NO: 4426792 - DNA, 15 bp, Homo sapiens
tgaatatactcatta

SEQ ID NO: 4426793 - DNA, 16 bp, Homo sapiens
tgaatatattttatct

SEQ ID NO: 4426794 - DNA, 23 bp, Homo sapiens
tgaatatcaactctgaaagagca

SEQ ID NO: 4426795 - DNA, 22 bp, Homo sapiens
tgaatattactcctatttttgt

SEQ ID NO: 4426796 - DNA, 18 bp, Homo sapiens
tgaatatttgttttaata

SEQ ID NO: 4426797 - DNA, 15 bp, Homo sapiens
tgaatattttcaagt

SEQ ID NO: 4426798 - DNA, 17 bp, Homo sapiens
tgaatcaataatatatt

SEQ ID NO: 4426799 - DNA, 17 bp, Homo sapiens
tgaatcacgtaaagcta

SEQ ID NO: 4426800 - DNA, 17 bp, Homo sapiens
tgaatcagacagtggat

SEQ ID NO: 4426801 - DNA, 16 bp, Homo sapiens
tgaatcagaccctacc

SEQ ID NO: 4426802 - DNA, 18 bp, Homo sapiens
tgaatcagaccctacccc

SEQ ID NO: 4426803 - DNA, 19 bp, Homo sapiens
tgaatcagatggtgtcatt

SEQ ID NO: 4426804 - DNA, 15 bp, Homo sapiens
tgaatccaaactaat

SEQ ID NO: 4426805 - DNA, 17 bp, Homo sapiens
tgaatcgcaagttaact

SEQ ID NO: 4426806 - DNA, 20 bp, Homo sapiens
tgaatctgcttttcctctgc

SEQ ID NO: 4426807 - DNA, 23 bp, Homo sapiens
tgaatctgcttttcctctgcctt

SEQ ID NO: 4426808 - DNA, 18 bp, Homo sapiens
tgaatctgtgcaaacagt

SEQ ID NO: 4426809 - DNA, 16 bp, Homo sapiens
tgaatcttatgcaaaa

SEQ ID NO: 4426810 - DNA, 20 bp, Homo sapiens
tgaatctttttatcccattt

SEQ ID NO: 4426811 - DNA, 20 bp, Homo sapiens
tgaatgaaattccactttgt

SEQ ID NO: 4426812 - DNA, 12 bp, Homo sapiens
tgaatgaacact

SEQ ID NO: 4426813 - DNA, 16 bp, Homo sapiens
tgaatgaagcagtatt

SEQ ID NO: 4426814 - DNA, 14 bp, Homo sapiens
tgaatgagaatcta

SEQ ID NO: 4426815 - DNA, 22 bp, Homo sapiens
tgaatgaggtcagcatgtctat

SEQ ID NO: 4426816 - DNA, 16 bp, Homo sapiens
tgaatgatcctgtctc

SEQ ID NO: 4426817 - DNA, 13 bp, Homo sapiens
tgaatgatctatt

SEQ ID NO: 4426818 - DNA, 15 bp, Homo sapiens
tgaatgcaaaccata

SEQ ID NO: 4426819 - DNA, 19 bp, Homo sapiens
tgaatgcaaaccatagcac

SEQ ID NO: 4426820 - DNA, 15 bp, Homo sapiens
tgaatgccaaagcca

SEQ ID NO: 4426821 - DNA, 21 bp, Homo sapiens
tgaatgccatagtcaaagaga

SEQ ID NO: 4426822 - DNA, 17 bp, Homo sapiens
tgaatgccgaatttggt

SEQ ID NO: 4426823 - DNA, 20 bp, Homo sapiens
tgaatgccgaatttggtaca

SEQ ID NO: 4426824 - DNA, 21 bp, Homo sapiens
tgaatgccgcgatgggtcagg

SEQ ID NO: 4426825 - DNA, 19 bp, Homo sapiens
tgaatgcctatggtggatc

SEQ ID NO: 4426826 - DNA, 20 bp, Homo sapiens
tgaatggctatgtttttaat

SEQ ID NO: 4426827 - DNA, 18 bp, Homo sapiens
tgaatgggacagagttga

SEQ ID NO: 4426828 - DNA, 20 bp, Homo sapiens
tgaatggtgttgtatgcctt

SEQ ID NO: 4426829 - DNA, 21 bp, Homo sapiens
tgaatggtgttgtatgccttt

SEQ ID NO: 4426830 - DNA, 14 bp, Homo sapiens
tgaatgtaatttgt

SEQ ID NO: 4426831 - DNA, 14 bp, Homo sapiens
tgaatgtactatgt

SEQ ID NO: 4426832 - DNA, 14 bp, Homo sapiens
tgaatgtatgtaaa

SEQ ID NO: 4426833 - DNA, 19 bp, Homo sapiens
tgaatgtgctgaagcaaag

SEQ ID NO: 4426834 - DNA, 14 bp, Homo sapiens
tgaatgtggcagtt

SEQ ID NO: 4426835 - DNA, 18 bp, Homo sapiens
tgaatgtggcttgagaaa

SEQ ID NO: 4426836 - DNA, 14 bp, Homo sapiens
tgaatgttcttgaa

SEQ ID NO: 4426837 - DNA, 21 bp, Homo sapiens
tgaatgttttgtgtgtaagga

SEQ ID NO: 4426838 - DNA, 18 bp, Homo sapiens
tgaattaagcccaattaa

SEQ ID NO: 4426839 - DNA, 23 bp, Homo sapiens
tgaattaccatagagtaatgatg

SEQ ID NO: 4426840 - DNA, 14 bp, Homo sapiens
tgaattagaaaatt

SEQ ID NO: 4426841 - DNA, 13 bp, Homo sapiens
tgaattattgaca

SEQ ID NO: 4426842 - DNA, 15 bp, Homo sapiens
tgaattattgacact

SEQ ID NO: 4426843 - DNA, 18 bp, Homo sapiens
tgaattcctagaattaaa

SEQ ID NO: 4426844 - DNA, 22 bp, Homo sapiens
tgaattcctctcaaattcagct

SEQ ID NO: 4426845 - DNA, 22 bp, Homo sapiens
tgaattcttggttgaggaaaca

SEQ ID NO: 4426846 - DNA, 16 bp, Homo sapiens
tgaattgaaaaacaat

SEQ ID NO: 4426847 - DNA, 17 bp, Homo sapiens
tgaattgaagtttcaag

SEQ ID NO: 4426848 - DNA, 18 bp, Homo sapiens
tgaattgatgatgcagtt

SEQ ID NO: 4426849 - DNA, 18 bp, Homo sapiens
tgaattgccttgctttta

SEQ ID NO: 4426850 - DNA, 17 bp, Homo sapiens
tgaattgctttctgctc

SEQ ID NO: 4426851 - DNA, 17 bp, Homo sapiens
tgaattgtatcaatttg

SEQ ID NO: 4426852 - DNA, 13 bp, Homo sapiens
tgaattgttacat

SEQ ID NO: 4426853 - DNA, 19 bp, Homo sapiens
tgaatttaataatctgtag

SEQ ID NO: 4426854 - DNA, 17 bp, Homo sapiens
tgaatttatctttacca

SEQ ID NO: 4426855 - DNA, 15 bp, Homo sapiens
tgaatttatgagatt

SEQ ID NO: 4426856 - DNA, 20 bp, Homo sapiens
tgaatttatgagatttactg

SEQ ID NO: 4426857 - DNA, 12 bp, Homo sapiens
tgaatttgcaaa

SEQ ID NO: 4426858 - DNA, 14 bp, Homo sapiens
tgaatttgtagttg

SEQ ID NO: 4426859 - DNA, 16 bp, Homo sapiens
tgaattttaaagtatg

SEQ ID NO: 4426860 - DNA, 11 bp, Homo sapiens
tgaattttcta

SEQ ID NO: 4426861 - DNA, 21 bp, Homo sapiens
tgaattttggggattttcaaa

SEQ ID NO: 4426862 - DNA, 22 bp, Homo sapiens
tgaatttttaaaacccatttaa

SEQ ID NO: 4426863 - DNA, 17 bp, Homo sapiens
tgaatttttaaacaagt

SEQ ID NO: 4426864 - DNA, 19 bp, Homo sapiens
tgaatttttaaacaagtat

SEQ ID NO: 4426865 - DNA, 15 bp, Homo sapiens
tgaatttttcctatg

SEQ ID NO: 4426866 - DNA, 19 bp, Homo sapiens
tctgtttttaatgctattt

SEQ ID NO: 4426867 - DNA, 21 bp, Homo sapiens
tcttaaaaaatgtgaaatgct

SEQ ID NO: 4426868 - DNA, 19 bp, Homo sapiens
tcttaaaactataacatta

SEQ ID NO: 4426869 - DNA, 19 bp, Homo sapiens
tcttaaaagctatcttcat

SEQ ID NO: 4426870 - DNA, 15 bp, Homo sapiens
tcttaaaatgcaata

SEQ ID NO: 4426871 - DNA, 21 bp, Homo sapiens
tcttaaaatgcaatatttgta

SEQ ID NO: 4426872 - DNA, 16 bp, Homo sapiens
tcttaaaccttcagtt

SEQ ID NO: 4426873 - DNA, 16 bp, Homo sapiens
tcttaaacttgtgaat

SEQ ID NO: 4426874 - DNA, 16 bp, Homo sapiens
tcttaaataagaaact

SEQ ID NO: 4426875 - DNA, 15 bp, Homo sapiens
tcttaaatcatttgg

SEQ ID NO: 4426876 - DNA, 18 bp, Homo sapiens
tcttaaatcatttggtta

SEQ ID NO: 4426877 - DNA, 19 bp, Homo sapiens
tcttaaattcatttctaga

SEQ ID NO: 4426878 - DNA, 15 bp, Homo sapiens
tcttaaattttcttc

SEQ ID NO: 4426879 - DNA, 15 bp, Homo sapiens
tcttaacctcaggga

SEQ ID NO: 4426880 - DNA, 18 bp, Homo sapiens
tcttaactgtatttcagt

SEQ ID NO: 4426881 - DNA, 23 bp, Homo sapiens
tcttaactgtatttcagtatttt

SEQ ID NO: 4426882 - DNA, 23 bp, Homo sapiens
tcttaacttcttgcttctttcta

SEQ ID NO: 4426883 - DNA, 23 bp, Homo sapiens
tcttaagaattcaaatttgtaat

SEQ ID NO: 4426884 - DNA, 24 bp, Homo sapiens
tcttaagacagcatgtgttaatct

SEQ ID NO: 4426885 - DNA, 18 bp, Homo sapiens
tcttaagatggaaataca

SEQ ID NO: 4426886 - DNA, 16 bp, Homo sapiens
tcttaagcagtaatct

SEQ ID NO: 4426887 - DNA, 16 bp, Homo sapiens
tcttaagtcagatttt

SEQ ID NO: 4426888 - DNA, 22 bp, Homo sapiens
tcttaataaaactcactcactg

SEQ ID NO: 4426889 - DNA, 17 bp, Homo sapiens
tcttaattattataaaa

SEQ ID NO: 4426890 - DNA, 19 bp, Homo sapiens
tcttaattattataaaaat

SEQ ID NO: 4426891 - DNA, 20 bp, Homo sapiens
tcttaattattataaaaata

SEQ ID NO: 4426892 - DNA, 19 bp, Homo sapiens
tcttaattgtgtttatttt

SEQ ID NO: 4426893 - DNA, 16 bp, Homo sapiens
tcttacaaaatacaca

SEQ ID NO: 4426894 - DNA, 12 bp, Homo sapiens
tcttacatctcc

SEQ ID NO: 4426895 - DNA, 22 bp, Homo sapiens
tcttaccagatgctttcctgtt

SEQ ID NO: 4426896 - DNA, 21 bp, Homo sapiens
tcttacctactattggcccta

SEQ ID NO: 4426897 - DNA, 18 bp, Homo sapiens
tcttagaagaatattgta

SEQ ID NO: 4426898 - DNA, 19 bp, Homo sapiens
tcttagaagaatattgtat

SEQ ID NO: 4426899 - DNA, 20 bp, Homo sapiens
tcttagaatttgtttcatct

SEQ ID NO: 4426900 - DNA, 21 bp, Homo sapiens
tcttagaatttgtttcatcta

SEQ ID NO: 4426901 - DNA, 22 bp, Homo sapiens
tcttagagccttagcagccctg

SEQ ID NO: 4426902 - DNA, 12 bp, Homo sapiens
tcttagataact

SEQ ID NO: 4426903 - DNA, 13 bp, Homo sapiens
tcttagataactt

SEQ ID NO: 4426904 - DNA, 20 bp, Homo sapiens
tcttagataacttcttgaaa

SEQ ID NO: 4426905 - DNA, 23 bp, Homo sapiens
tcttagataacttcttgaaaaag

SEQ ID NO: 4426906 - DNA, 13 bp, Homo sapiens
tcttagattctta

SEQ ID NO: 4426907 - DNA, 14 bp, Homo sapiens
tcttagattcttaa

SEQ ID NO: 4426908 - DNA, 15 bp, Homo sapiens
tcttagcctgtggca

SEQ ID NO: 4426909 - DNA, 17 bp, Homo sapiens
tcttagcctgtggcagt

SEQ ID NO: 4426910 - DNA, 22 bp, Homo sapiens
tcttagcctgtggcagtaaaga

SEQ ID NO: 4426911 - DNA, 22 bp, Homo sapiens
tcttagctatccttggctttca

SEQ ID NO: 4426912 - DNA, 14 bp, Homo sapiens
tcttagctcccctc

SEQ ID NO: 4426913 - DNA, 22 bp, Homo sapiens
tcttagcttgtctgtgatctct

SEQ ID NO: 4426914 - DNA, 19 bp, Homo sapiens
tcttaggagcagagctctg

SEQ ID NO: 4426915 - DNA, 23 bp, Homo sapiens
tcttagggcacatgaaaaatttt

SEQ ID NO: 4426916 - DNA, 19 bp, Homo sapiens
tcttagtatagtagaaaga

SEQ ID NO: 4426917 - DNA, 12 bp, Homo sapiens
tcttagtcccaa

SEQ ID NO: 4426918 - DNA, 21 bp, Homo sapiens
tcttagttctgtatataaata

SEQ ID NO: 4426919 - DNA, 19 bp, Homo sapiens
tcttataacttgtaagtct

SEQ ID NO: 4426920 - DNA, 14 bp, Homo sapiens
tcttatactgtaca

SEQ ID NO: 4426921 - DNA, 18 bp, Homo sapiens
tcttatactgtacaataa

SEQ ID NO: 4426922 - DNA, 20 bp, Homo sapiens
tcttatattggtttgcacaa

SEQ ID NO: 4426923 - DNA, 23 bp, Homo sapiens
tcttatcacataagagagatgag

SEQ ID NO: 4426924 - DNA, 21 bp, Homo sapiens
tcttatgtgacattaacaaat

SEQ ID NO: 4426925 - DNA, 16 bp, Homo sapiens
tcttattcaaagatga

SEQ ID NO: 4426926 - DNA, 16 bp, Homo sapiens
tcttattgaataaaga

SEQ ID NO: 4426927 - DNA, 19 bp, Homo sapiens
tcttattgttctttcatat

SEQ ID NO: 4426928 - DNA, 12 bp, Homo sapiens
tcttatttattt

SEQ ID NO: 4426929 - DNA, 21 bp, Homo sapiens
tcttatttattttagcaaatc

SEQ ID NO: 4426930 - DNA, 18 bp, Homo sapiens
tcttatttctttccttta

SEQ ID NO: 4426931 - DNA, 19 bp, Homo sapiens
tcttatttctttcctttaa

SEQ ID NO: 4426932 - DNA, 13 bp, Homo sapiens
tcttattttagta

SEQ ID NO: 4426933 - DNA, 15 bp, Homo sapiens
tcttattttagtata

SEQ ID NO: 4426934 - DNA, 15 bp, Homo sapiens
tcttatttttcctgt

SEQ ID NO: 4426935 - DNA, 17 bp, Homo sapiens
tcttatttttcctgtcc

SEQ ID NO: 4426936 - DNA, 13 bp, Homo sapiens
tcttcaacatgac

SEQ ID NO: 4426937 - DNA, 17 bp, Homo sapiens
tcttcaaccaaggccac

SEQ ID NO: 4426938 - DNA, 13 bp, Homo sapiens
tcttcaataaacc

SEQ ID NO: 4426939 - DNA, 20 bp, Homo sapiens
tcttcaataaaccacaagca

SEQ ID NO: 4426940 - DNA, 22 bp, Homo sapiens
tcttcaataaaccacaagcatc

SEQ ID NO: 4426941 - DNA, 18 bp, Homo sapiens
tcttcaatttattactga

SEQ ID NO: 4426942 - DNA, 19 bp, Homo sapiens
tcttcacagatttttatct

SEQ ID NO: 4426943 - DNA, 16 bp, Homo sapiens
tcttcaccaaatcttg

SEQ ID NO: 4426944 - DNA, 16 bp, Homo sapiens
tcttcaccctcccctt

SEQ ID NO: 4426945 - DNA, 20 bp, Homo sapiens
tcttcactgcaattttgtgt

SEQ ID NO: 4426946 - DNA, 21 bp, Homo sapiens
tcttcactggtgagacaatga

SEQ ID NO: 4426947 - DNA, 17 bp, Homo sapiens
tcttcagaactgccctt

SEQ ID NO: 4426948 - DNA, 23 bp, Homo sapiens
tcttcagaactgcccttgctgcc

SEQ ID NO: 4426949 - DNA, 14 bp, Homo sapiens
tcttcagaggccct

SEQ ID NO: 4426950 - DNA, 13 bp, Homo sapiens
tcttcagctttat

SEQ ID NO: 4426951 - DNA, 18 bp, Homo sapiens
tcttcaggtaacactaca

SEQ ID NO: 4426952 - DNA, 16 bp, Homo sapiens
tcttcaggtggaaaaa

SEQ ID NO: 4426953 - DNA, 18 bp, Homo sapiens
tcttcagttggtgtgttt

SEQ ID NO: 4426954 - DNA, 20 bp, Homo sapiens
tcttcagttggtgtgttttt

SEQ ID NO: 4426955 - DNA, 15 bp, Homo sapiens
tcttcagtttttcac

SEQ ID NO: 4426956 - DNA, 16 bp, Homo sapiens
tcttcatccatagaca

SEQ ID NO: 4426957 - DNA, 18 bp, Homo sapiens
tcttcatccatagacaca

SEQ ID NO: 4426958 - DNA, 12 bp, Homo sapiens
tcttcatgaaat

SEQ ID NO: 4426959 - DNA, 20 bp, Homo sapiens
tcttcatgagtagtgggcta

SEQ ID NO: 4426960 - DNA, 20 bp, Homo sapiens
tcttcatgtaaattgactgt

SEQ ID NO: 4426961 - DNA, 23 bp, Homo sapiens
tcttcatgtaaattgactgtact

SEQ ID NO: 4426962 - DNA, 22 bp, Homo sapiens
tcttcattacctcagtgagaag

SEQ ID NO: 4426963 - DNA, 10 bp, Homo sapiens
tcttcattgt

SEQ ID NO: 4426964 - DNA, 12 bp, Homo sapiens
tcttcattgtaa

SEQ ID NO: 4426965 - DNA, 13 bp, Homo sapiens
tcttcatttacaa

SEQ ID NO: 4426966 - DNA, 22 bp, Homo sapiens
tcttcattttttaatgtgctct

SEQ ID NO: 4426967 - DNA, 17 bp, Homo sapiens
tcttccacaaagaaaat

SEQ ID NO: 4426968 - DNA, 13 bp, Homo sapiens
tcttccacagtgg

SEQ ID NO: 4426969 - DNA, 14 bp, Homo sapiens
tcttccacagtggc

SEQ ID NO: 4426970 - DNA, 13 bp, Homo sapiens
tcttcccacagga

SEQ ID NO: 4426971 - DNA, 23 bp, Homo sapiens
tcttcccagcactatgctttcct

SEQ ID NO: 4426972 - DNA, 21 bp, Homo sapiens
tcttccctacctcaggcagga

SEQ ID NO: 4426973 - DNA, 12 bp, Homo sapiens
tcttccctgcct

SEQ ID NO: 4426974 - DNA, 14 bp, Homo sapiens
tcttccctgcctgt

SEQ ID NO: 4426975 - DNA, 12 bp, Homo sapiens
tcttccctgctt

SEQ ID NO: 4426976 - DNA, 13 bp, Homo sapiens
tcttccctgcttc

SEQ ID NO: 4426977 - DNA, 22 bp, Homo sapiens
tcttccctgctttgcatctttg

SEQ ID NO: 4426978 - DNA, 14 bp, Homo sapiens
tcttcccttagcct

SEQ ID NO: 4426979 - DNA, 16 bp, Homo sapiens
tcttcccttagcctct

SEQ ID NO: 4426980 - DNA, 18 bp, Homo sapiens
tcttcccttattcctaat

SEQ ID NO: 4426981 - DNA, 21 bp, Homo sapiens
tcttcccttattcctaatggc

SEQ ID NO: 4426982 - DNA, 20 bp, Homo sapiens
tcttcctaccaagtcaaact

SEQ ID NO: 4426983 - DNA, 22 bp, Homo sapiens
tcttcctcacagtcccactgtg

SEQ ID NO: 4426984 - DNA, 15 bp, Homo sapiens
tcttcctgacacttt

SEQ ID NO: 4426985 - DNA, 21 bp, Homo sapiens
tcttcctgccccccttggcat

SEQ ID NO: 4426986 - DNA, 23 bp, Homo sapiens
tcttcctgtgaagtttaattgtc

SEQ ID NO: 4426987 - DNA, 13 bp, Homo sapiens
tcttcctttgaaa

SEQ ID NO: 4426988 - DNA, 15 bp, Homo sapiens
tcttcgtaacttcat

SEQ ID NO: 4426989 - DNA, 22 bp, Homo sapiens
tcttcgtaacttcatattaata

SEQ ID NO: 4426990 - DNA, 17 bp, Homo sapiens
tcttctaaaacttgagt

SEQ ID NO: 4426991 - DNA, 20 bp, Homo sapiens
tcttctaaaatagcaataac

SEQ ID NO: 4426992 - DNA, 22 bp, Homo sapiens
tcttctaaacttccccatcttc

SEQ ID NO: 4426993 - DNA, 15 bp, Homo sapiens
tcttctaagaagaca

SEQ ID NO: 4426994 - DNA, 16 bp, Homo sapiens
tcttctaagaagacat

SEQ ID NO: 4426995 - DNA, 14 bp, Homo sapiens
tcttctacactagg

SEQ ID NO: 4426996 - DNA, 10 bp, Homo sapiens
tcttctatta

SEQ ID NO: 4426997 - DNA, 22 bp, Homo sapiens
tcttctcatttcacccctccct

SEQ ID NO: 4426998 - DNA, 15 bp, Homo sapiens
tcttctctccccagc

SEQ ID NO: 4426999 - DNA, 18 bp, Homo sapiens
tcttctctccccagcccc

SEQ ID NO: 4427000 - DNA, 19 bp, Homo sapiens
tcttctcttccttttatca

SEQ ID NO: 4427001 - DNA, 21 bp, Homo sapiens
tcttctcttccttttatcagt

SEQ ID NO: 4427002 - DNA, 19 bp, Homo sapiens
tcttctgaactcaaactga

SEQ ID NO: 4427003 - DNA, 17 bp, Homo sapiens
tcttctgcaacatttga

SEQ ID NO: 4427004 - DNA, 12 bp, Homo sapiens
tcttctgcctgt

SEQ ID NO: 4427005 - DNA, 19 bp, Homo sapiens
tcttctgctccacccttgg

SEQ ID NO: 4427006 - DNA, 17 bp, Homo sapiens
tcttctgctcttttcct

SEQ ID NO: 4427007 - DNA, 17 bp, Homo sapiens
tcttctgggtgtgcttt

SEQ ID NO: 4427008 - DNA, 19 bp, Homo sapiens
tcttctggtgttgactgga

SEQ ID NO: 4427009 - DNA, 22 bp, Homo sapiens
tcttctgtatttttttttctaa

SEQ ID NO: 4427010 - DNA, 12 bp, Homo sapiens
tcttcttctaag

SEQ ID NO: 4427011 - DNA, 14 bp, Homo sapiens
tcttcttgtttctc

SEQ ID NO: 4427012 - DNA, 14 bp, Homo sapiens
tcttctttaccaga

SEQ ID NO: 4427013 - DNA, 17 bp, Homo sapiens
tcttctttattattcct

SEQ ID NO: 4427014 - DNA, 22 bp, Homo sapiens
tcttctttctgaagatcaattt

SEQ ID NO: 4427015 - DNA, 20 bp, Homo sapiens
tcttctttggaaataaaaga

SEQ ID NO: 4427016 - DNA, 21 bp, Homo sapiens
tcttctttgtgcctttggcct

SEQ ID NO: 4427017 - DNA, 23 bp, Homo sapiens
tcttctttgtgcctttggcctgg

SEQ ID NO: 4427018 - DNA, 22 bp, Homo sapiens
tcttcttttttaagttgtcaaa

SEQ ID NO: 4427019 - DNA, 17 bp, Homo sapiens
tcttgaaaataaaaaat

SEQ ID NO: 4427020 - DNA, 20 bp, Homo sapiens
tcttgaaaataaaaaatatt

SEQ ID NO: 4427021 - DNA, 17 bp, Homo sapiens
tcttgaaatgaaaggga

SEQ ID NO: 4427022 - DNA, 22 bp, Homo sapiens
tcttgaaatgaaagggaaactg

SEQ ID NO: 4427023 - DNA, 20 bp, Homo sapiens
tcttgaaattaagaaggcaa

SEQ ID NO: 4427024 - DNA, 22 bp, Homo sapiens
tcttgaaattaagaaggcaaaa

SEQ ID NO: 4427025 - DNA, 18 bp, Homo sapiens
tcttgaagaataaattct

SEQ ID NO: 4427026 - DNA, 19 bp, Homo sapiens
tcttgaagaataaattcta

SEQ ID NO: 4427027 - DNA, 15 bp, Homo sapiens
tcttgaatataaaaa

SEQ ID NO: 4427028 - DNA, 14 bp, Homo sapiens
tcttgaattcctct

SEQ ID NO: 4427029 - DNA, 20 bp, Homo sapiens
tcttgaattcctctcaaatt

SEQ ID NO: 4427030 - DNA, 13 bp, Homo sapiens
tcttgaatttaat

SEQ ID NO: 4427031 - DNA, 23 bp, Homo sapiens
tcttgaatttaataatctgtagg

SEQ ID NO: 4427032 - DNA, 16 bp, Homo sapiens
tcttgacaatcatctc

SEQ ID NO: 4427033 - DNA, 14 bp, Homo sapiens
tcttgacagtctga

SEQ ID NO: 4427034 - DNA, 16 bp, Homo sapiens
tcttgacatttatcac

SEQ ID NO: 4427035 - DNA, 22 bp, Homo sapiens
tcttgactccactactttactg

SEQ ID NO: 4427036 - DNA, 15 bp, Homo sapiens
tcttgactttttaaa

SEQ ID NO: 4427037 - DNA, 12 bp, Homo sapiens
tcttgagccaca

SEQ ID NO: 4427038 - DNA, 18 bp, Homo sapiens
tcttgatcaacatctttt

SEQ ID NO: 4427039 - DNA, 19 bp, Homo sapiens
tcttgatctctcttgtcct

SEQ ID NO: 4427040 - DNA, 17 bp, Homo sapiens
tcttgatctttgagccc

SEQ ID NO: 4427041 - DNA, 19 bp, Homo sapiens
tcttgatttcacatttcta

SEQ ID NO: 4427042 - DNA, 13 bp, Homo sapiens
tcttgcaggctga

SEQ ID NO: 4427043 - DNA, 15 bp, Homo sapiens
tcttgcatggtttgg

SEQ ID NO: 4427044 - DNA, 14 bp, Homo sapiens
tcttgccatcactg

SEQ ID NO: 4427045 - DNA, 11 bp, Homo sapiens
tcttgcccact

SEQ ID NO: 4427046 - DNA, 13 bp, Homo sapiens
tcttgcccatcct

SEQ ID NO: 4427047 - DNA, 22 bp, Homo sapiens
tcttgcctctgtccccttctct

SEQ ID NO: 4427048 - DNA, 20 bp, Homo sapiens
tcttgctaccagtatttaga

SEQ ID NO: 4427049 - DNA, 12 bp, Homo sapiens
tcttgcttcaga

SEQ ID NO: 4427050 - DNA, 13 bp, Homo sapiens
tcttgctttctat

SEQ ID NO: 4427051 - DNA, 14 bp, Homo sapiens
tcttgctttctctc

SEQ ID NO: 4427052 - DNA, 17 bp, Homo sapiens
tcttgctttctctctca

SEQ ID NO: 4427053 - DNA, 16 bp, Homo sapiens
tcttggaactgtccca

SEQ ID NO: 4427054 - DNA, 20 bp, Homo sapiens
tcttggaactgtcccagcta

SEQ ID NO: 4427055 - DNA, 19 bp, Homo sapiens
tcttggaagctgtttggaa

SEQ ID NO: 4427056 - DNA, 20 bp, Homo sapiens
tcttggaccatgccagattc

SEQ ID NO: 4427057 - DNA, 15 bp, Homo sapiens
tcttggacccacctg

SEQ ID NO: 4427058 - DNA, 21 bp, Homo sapiens
tcttggacccacctgtggggc

SEQ ID NO: 4427059 - DNA, 14 bp, Homo sapiens
tcttggagctgctt

SEQ ID NO: 4427060 - DNA, 16 bp, Homo sapiens
tcttggagctgcttgg

SEQ ID NO: 4427061 - DNA, 13 bp, Homo sapiens
tcttggcagtcac

SEQ ID NO: 4427062 - DNA, 19 bp, Homo sapiens
tcttggcattggaattcta

SEQ ID NO: 4427063 - DNA, 19 bp, Homo sapiens
tcttggctgcctgtgggct

SEQ ID NO: 4427064 - DNA, 14 bp, Homo sapiens
tcttgggaactgaa

SEQ ID NO: 4427065 - DNA, 21 bp, Homo sapiens
tcttgggggacagggctggcc

SEQ ID NO: 4427066 - DNA, 23 bp, Homo sapiens
tcttgggggacagggctggccca

SEQ ID NO: 4427067 - DNA, 11 bp, Homo sapiens
tcttgggggtc

SEQ ID NO: 4427068 - DNA, 22 bp, Homo sapiens
tcttggtaaaacattacttatt

SEQ ID NO: 4427069 - DNA, 13 bp, Homo sapiens
tcttggtgcccag

SEQ ID NO: 4427070 - DNA, 21 bp, Homo sapiens
tcttggttcgatacctggagc

SEQ ID NO: 4427071 - DNA, 13 bp, Homo sapiens
tcttggttgagga

SEQ ID NO: 4427072 - DNA, 11 bp, Homo sapiens
tcttgtaccat

SEQ ID NO: 4427073 - DNA, 19 bp, Homo sapiens
tcttgtatttaaaaacatt

SEQ ID NO: 4427074 - DNA, 15 bp, Homo sapiens
tcttgtatttattgg

SEQ ID NO: 4427075 - DNA, 14 bp, Homo sapiens
tcttgtcatacaaa

SEQ ID NO: 4427076 - DNA, 20 bp, Homo sapiens
tcttgtgcaaggtggccttt

SEQ ID NO: 4427077 - DNA, 17 bp, Homo sapiens
tcttgtgtagatttgaa

SEQ ID NO: 4427078 - DNA, 19 bp, Homo sapiens
tcttgtgtagatttgaaaa

SEQ ID NO: 4427079 - DNA, 13 bp, Homo sapiens
tcttgttactgct

SEQ ID NO: 4427080 - DNA, 14 bp, Homo sapiens
tcttgttcctgtgc

SEQ ID NO: 4427081 - DNA, 22 bp, Homo sapiens
tcttgttgctcaaaaaatgagc

SEQ ID NO: 4427082 - DNA, 13 bp, Homo sapiens
tcttgttttgaaa

SEQ ID NO: 4427083 - DNA, 15 bp, Homo sapiens
tctttaaaacaaaac

SEQ ID NO: 4427084 - DNA, 17 bp, Homo sapiens
tctttaaaagaatgact

SEQ ID NO: 4427085 - DNA, 15 bp, Homo sapiens
tctttaaataataaa

SEQ ID NO: 4427086 - DNA, 16 bp, Homo sapiens
tctttaaatcatttta

SEQ ID NO: 4427087 - DNA, 22 bp, Homo sapiens
tctttaactgccgtaatttaac

SEQ ID NO: 4427088 - DNA, 21 bp, Homo sapiens
tctttaagaatgcttaaaaaa

SEQ ID NO: 4427089 - DNA, 14 bp, Homo sapiens
tctttaatcactta

SEQ ID NO: 4427090 - DNA, 16 bp, Homo sapiens
tctttaattttaactg

SEQ ID NO: 4427091 - DNA, 18 bp, Homo sapiens
tctttacctttattgata

SEQ ID NO: 4427092 - DNA, 12 bp, Homo sapiens
tctttacttatc

SEQ ID NO: 4427093 - DNA, 17 bp, Homo sapiens
tctttacttatctctca

SEQ ID NO: 4427094 - DNA, 14 bp, Homo sapiens
tctttactttctcc

SEQ ID NO: 4427095 - DNA, 19 bp, Homo sapiens
tctttataattgaattggt

SEQ ID NO: 4427096 - DNA, 15 bp, Homo sapiens
tctttatagtgcaca

SEQ ID NO: 4427097 - DNA, 17 bp, Homo sapiens
tctttatagtgcacaaa

SEQ ID NO: 4427098 - DNA, 12 bp, Homo sapiens
tctttatatgaa

SEQ ID NO: 4427099 - DNA, 18 bp, Homo sapiens
tctttatattgtcattgt

SEQ ID NO: 4427100 - DNA, 17 bp, Homo sapiens
tctttatcccattttat

SEQ ID NO: 4427101 - DNA, 21 bp, Homo sapiens
tctttattattcctagtcttt

SEQ ID NO: 4427102 - DNA, 15 bp, Homo sapiens
tctttattgaaattc

SEQ ID NO: 4427103 - DNA, 12 bp, Homo sapiens
tctttattgtct

SEQ ID NO: 4427104 - DNA, 17 bp, Homo sapiens
tctttattgtctgtaaa

SEQ ID NO: 4427105 - DNA, 23 bp, Homo sapiens
tctttattttaacctttgataga

SEQ ID NO: 4427106 - DNA, 11 bp, Homo sapiens
tctttcaaaac

SEQ ID NO: 4427107 - DNA, 23 bp, Homo sapiens
tctttcaaaaccttttgaaatta

SEQ ID NO: 4427108 - DNA, 12 bp, Homo sapiens
tctttcaaactc

SEQ ID NO: 4427109 - DNA, 12 bp, Homo sapiens
tctttcaccttt

SEQ ID NO: 4427110 - DNA, 14 bp, Homo sapiens
tctttcacctttct

SEQ ID NO: 4427111 - DNA, 20 bp, Homo sapiens
tctttcagctgaattatatt

SEQ ID NO: 4427112 - DNA, 23 bp, Homo sapiens
tctttcattctaatccttgctat

SEQ ID NO: 4427113 - DNA, 15 bp, Homo sapiens
tctttccaaaacatt

SEQ ID NO: 4427114 - DNA, 22 bp, Homo sapiens
tctttccaggcttccctgactt

SEQ ID NO: 4427115 - DNA, 15 bp, Homo sapiens
tctttccagtcaaca

SEQ ID NO: 4427116 - DNA, 20 bp, Homo sapiens
tctttccatcaactcccaac

SEQ ID NO: 4427117 - DNA, 13 bp, Homo sapiens
tctttccccagag

SEQ ID NO: 4427118 - DNA, 14 bp, Homo sapiens
tctttccccagagg

SEQ ID NO: 4427119 - DNA, 20 bp, Homo sapiens
tctttccccagaggctccca

SEQ ID NO: 4427120 - DNA, 23 bp, Homo sapiens
tctttcccctcaggagtttctat

SEQ ID NO: 4427121 - DNA, 12 bp, Homo sapiens
tctttccctgcg

SEQ ID NO: 4427122 - DNA, 15 bp, Homo sapiens
tctttccgactgccc

SEQ ID NO: 4427123 - DNA, 14 bp, Homo sapiens
tctttcctttaaaa

SEQ ID NO: 4427124 - DNA, 13 bp, Homo sapiens
tctttctagtttg

SEQ ID NO: 4427125 - DNA, 18 bp, Homo sapiens
tctttctcacccaggcaa

SEQ ID NO: 4427126 - DNA, 17 bp, Homo sapiens
tctttctcactaaatct

SEQ ID NO: 4427127 - DNA, 24 bp, Homo sapiens
tctttctccttgaatatctttcga

SEQ ID NO: 4427128 - DNA, 15 bp, Homo sapiens
tctttctctcagtga

SEQ ID NO: 4427129 - DNA, 16 bp, Homo sapiens
tctttctctcagtgaa

SEQ ID NO: 4427130 - DNA, 20 bp, Homo sapiens
tctttctctctttccatctc

SEQ ID NO: 4427131 - DNA, 12 bp, Homo sapiens
tctttctctttt

SEQ ID NO: 4427132 - DNA, 14 bp, Homo sapiens
tctttctggactgg

SEQ ID NO: 4427133 - DNA, 17 bp, Homo sapiens
tctttctgttgaaaagc

SEQ ID NO: 4427134 - DNA, 14 bp, Homo sapiens
tctttcttcctctt

SEQ ID NO: 4427135 - DNA, 15 bp, Homo sapiens
tctttcttcctcttc

SEQ ID NO: 4427136 - DNA, 15 bp, Homo sapiens
tctttctttctctaa

SEQ ID NO: 4427137 - DNA, 18 bp, Homo sapiens
tctttctttgcaccaaag

SEQ ID NO: 4427138 - DNA, 19 bp, Homo sapiens
tctttctttggtgcctttc

SEQ ID NO: 4427139 - DNA, 16 bp, Homo sapiens
tctttgaaataaaaaa

SEQ ID NO: 4427140 - DNA, 22 bp, Homo sapiens
tctttgaaatagtctgtgtgaa

SEQ ID NO: 4427141 - DNA, 21 bp, Homo sapiens
tctttgacaattgggagctgc

SEQ ID NO: 4427142 - DNA, 13 bp, Homo sapiens
tctttgactgaaa

SEQ ID NO: 4427143 - DNA, 17 bp, Homo sapiens
tctttgactgtcagcaa

SEQ ID NO: 4427144 - DNA, 12 bp, Homo sapiens
tctttgagaggg

SEQ ID NO: 4427145 - DNA, 12 bp, Homo sapiens
tctttgagccca

SEQ ID NO: 4427146 - DNA, 19 bp, Homo sapiens
tctttgattctccttcagc

SEQ ID NO: 4427147 - DNA, 20 bp, Homo sapiens
tctttgattctccttcagcc

SEQ ID NO: 4427148 - DNA, 21 bp, Homo sapiens
tctttgattctccttttatgt

SEQ ID NO: 4427149 - DNA, 12 bp, Homo sapiens
tctttgcaaagt

SEQ ID NO: 4427150 - DNA, 13 bp, Homo sapiens
tctttgcagagcc

SEQ ID NO: 4427151 - DNA, 22 bp, Homo sapiens
tctttgcaggaggcccaacctc

SEQ ID NO: 4427152 - DNA, 21 bp, Homo sapiens
tctttgccagtcattcagcag

SEQ ID NO: 4427153 - DNA, 14 bp, Homo sapiens
tctttgccttgggc

SEQ ID NO: 4427154 - DNA, 20 bp, Homo sapiens
tctttgccttgggctgctcc

SEQ ID NO: 4427155 - DNA, 22 bp, Homo sapiens
tctttgctgcagtcatctactt

SEQ ID NO: 4427156 - DNA, 16 bp, Homo sapiens
tctttgctgcattcct

SEQ ID NO: 4427157 - DNA, 19 bp, Homo sapiens
tctttgctgcccctgtctg

SEQ ID NO: 4427158 - DNA, 21 bp, Homo sapiens
tctttgctttgtagtttgctt

SEQ ID NO: 4427159 - DNA, 19 bp, Homo sapiens
tctttggaaagtacactct

SEQ ID NO: 4427160 - DNA, 18 bp, Homo sapiens
tctttggaaataaaagat

SEQ ID NO: 4427161 - DNA, 20 bp, Homo sapiens
tctttggagttaaaatgcac

SEQ ID NO: 4427162 - DNA, 17 bp, Homo sapiens
tctttggtgcctttcct

SEQ ID NO: 4427163 - DNA, 23 bp, Homo sapiens
tctttgtaatgtcaccaccttcc

SEQ ID NO: 4427164 - DNA, 16 bp, Homo sapiens
tctttgtagaataaat

SEQ ID NO: 4427165 - DNA, 17 bp, Homo sapiens
tctttgtcccctgggtc

SEQ ID NO: 4427166 - DNA, 14 bp, Homo sapiens
tctttgtgacagga

SEQ ID NO: 4427167 - DNA, 16 bp, Homo sapiens
tctttgtgacaggaaa

SEQ ID NO: 4427168 - DNA, 19 bp, Homo sapiens
tctttgtggtctgtgtcac

SEQ ID NO: 4427169 - DNA, 17 bp, Homo sapiens
tctttgttacttcctta

SEQ ID NO: 4427170 - DNA, 14 bp, Homo sapiens
tctttgttcaagat

SEQ ID NO: 4427171 - DNA, 16 bp, Homo sapiens
tctttgttcaagatga

SEQ ID NO: 4427172 - DNA, 20 bp, Homo sapiens
tcttttaaagtatttataaa

SEQ ID NO: 4427173 - DNA, 19 bp, Homo sapiens
tcttttaaattagaaaata

SEQ ID NO: 4427174 - DNA, 15 bp, Homo sapiens
tcttttacctgctgc

SEQ ID NO: 4427175 - DNA, 13 bp, Homo sapiens
tcttttataattc

SEQ ID NO: 4427176 - DNA, 11 bp, Homo sapiens
tcttttatagg

SEQ ID NO: 4427177 - DNA, 15 bp, Homo sapiens
tcttttataggaaaa

SEQ ID NO: 4427178 - DNA, 16 bp, Homo sapiens
tcttttattaatactt

SEQ ID NO: 4427179 - DNA, 19 bp, Homo sapiens
tcttttattcttctttctt

SEQ ID NO: 4427180 - DNA, 16 bp, Homo sapiens
tcttttatttaacaaa

SEQ ID NO: 4427181 - DNA, 13 bp, Homo sapiens
tcttttcacatta

SEQ ID NO: 4427182 - DNA, 22 bp, Homo sapiens
tcttttcagaagcaagccagac

SEQ ID NO: 4427183 - DNA, 24 bp, Homo sapiens
tcttttccccctttgtgcacattt

SEQ ID NO: 4427184 - DNA, 13 bp, Homo sapiens
tcttttcctggtg

SEQ ID NO: 4427185 - DNA, 17 bp, Homo sapiens
tcttttctcctttacca

SEQ ID NO: 4427186 - DNA, 16 bp, Homo sapiens
tcttttcttgcctctg

SEQ ID NO: 4427187 - DNA, 20 bp, Homo sapiens
tcttttcttgcctctgtccc

SEQ ID NO: 4427188 - DNA, 12 bp, Homo sapiens
tcttttctttac

SEQ ID NO: 4427189 - DNA, 13 bp, Homo sapiens
tcttttctttata

SEQ ID NO: 4427190 - DNA, 20 bp, Homo sapiens
tcttttctttgtatcattca

SEQ ID NO: 4427191 - DNA, 17 bp, Homo sapiens
tcttttgaattgttaca

SEQ ID NO: 4427192 - DNA, 20 bp, Homo sapiens
tcttttgcttgccaaagtac

SEQ ID NO: 4427193 - DNA, 22 bp, Homo sapiens
tcttttggtaaagactggcttt

SEQ ID NO: 4427194 - DNA, 12 bp, Homo sapiens
tcttttgtatta

SEQ ID NO: 4427195 - DNA, 20 bp, Homo sapiens
tcttttgtattgtttctaca

SEQ ID NO: 4427196 - DNA, 20 bp, Homo sapiens
tcttttgttcgcatggtcac

SEQ ID NO: 4427197 - DNA, 15 bp, Homo sapiens
tcttttgttctctga

SEQ ID NO: 4427198 - DNA, 14 bp, Homo sapiens
tctttttaaagctt

SEQ ID NO: 4427199 - DNA, 15 bp, Homo sapiens
tctttttatcatgat

SEQ ID NO: 4427200 - DNA, 12 bp, Homo sapiens
tctttttatctc

SEQ ID NO: 4427201 - DNA, 16 bp, Homo sapiens
tctttttctttctttg

SEQ ID NO: 4427202 - DNA, 22 bp, Homo sapiens
tctttttgccagttttccctgg

SEQ ID NO: 4427203 - DNA, 15 bp, Homo sapiens
tctttttggaaactg

SEQ ID NO: 4427204 - DNA, 19 bp, Homo sapiens
tctttttgttaacagcaac

SEQ ID NO: 4427205 - DNA, 13 bp, Homo sapiens
tcttttttaaagt

SEQ ID NO: 4427206 - DNA, 23 bp, Homo sapiens
tcttttttgtttgtttctttgtg

SEQ ID NO: 4427207 - DNA, 20 bp, Homo sapiens
tctttttttctgtcagtaaa

SEQ ID NO: 4427208 - DNA, 20 bp, Homo sapiens
tcttttttttaatgtttctg

SEQ ID NO: 4427209 - DNA, 16 bp, Homo sapiens
tctttttttttaagtt

SEQ ID NO: 4427210 - DNA, 21 bp, Homo sapiens
tctttttttttcttcattgta

SEQ ID NO: 4427211 - DNA, 17 bp, Homo sapiens
tcttttttttttattat

SEQ ID NO: 4427212 - DNA, 20 bp, Homo sapiens
tcttttttttttattatggt

SEQ ID NO: 4427213 - DNA, 23 bp, Homo sapiens
tcttttttttttttttacagtat

SEQ ID NO: 4427214 - DNA, 21 bp, Homo sapiens
tgaaaaaaaaaaagaagaaga

SEQ ID NO: 4427215 - DNA, 16 bp, Homo sapiens
tgaaaaaaaacagtgg

SEQ ID NO: 4427216 - DNA, 14 bp, Homo sapiens
tgaaaaaaaatttg

SEQ ID NO: 4427217 - DNA, 20 bp, Homo sapiens
tgaaaaaaagggcactctga

SEQ ID NO: 4427218 - DNA, 20 bp, Homo sapiens
tgaaaaaaagtgctgaaaat

SEQ ID NO: 4427219 - DNA, 13 bp, Homo sapiens
tgaaaaaagctca

SEQ ID NO: 4427220 - DNA, 12 bp, Homo sapiens
tgaaaaactttt

SEQ ID NO: 4427221 - DNA, 13 bp, Homo sapiens
tgaaaaagaagaa

SEQ ID NO: 4427222 - DNA, 13 bp, Homo sapiens
tgaaaaagatggc

SEQ ID NO: 4427223 - DNA, 21 bp, Homo sapiens
tgaaaaagatggcttatgtca

SEQ ID NO: 4427224 - DNA, 22 bp, Homo sapiens
tgaaaaagttctgcagataaac

SEQ ID NO: 4427225 - DNA, 15 bp, Homo sapiens
tgaaaaagtttgttt

SEQ ID NO: 4427226 - DNA, 19 bp, Homo sapiens
tgaaaaatctcaattgaaa

SEQ ID NO: 4427227 - DNA, 19 bp, Homo sapiens
tgaaaaatctcattatttc

SEQ ID NO: 4427228 - DNA, 17 bp, Homo sapiens
tctgaagaggcttctcc

SEQ ID NO: 4427229 - DNA, 19 bp, Homo sapiens
tctgaagtacaaacatgaa

SEQ ID NO: 4427230 - DNA, 19 bp, Homo sapiens
tctgaagtgcttgtatagc

SEQ ID NO: 4427231 - DNA, 15 bp, Homo sapiens
tctgaagttttattt

SEQ ID NO: 4427232 - DNA, 18 bp, Homo sapiens
tctgaagttttattttaa

SEQ ID NO: 4427233 - DNA, 17 bp, Homo sapiens
tctgaataaagcaatta

SEQ ID NO: 4427234 - DNA, 14 bp, Homo sapiens
tctgaatgtaattt

SEQ ID NO: 4427235 - DNA, 16 bp, Homo sapiens
tctgaatgtaatttgt

SEQ ID NO: 4427236 - DNA, 20 bp, Homo sapiens
tctgaattggctaaaagaca

SEQ ID NO: 4427237 - DNA, 13 bp, Homo sapiens
tctgaatttgcaa

SEQ ID NO: 4427238 - DNA, 14 bp, Homo sapiens
tctgaatttgcaaa

SEQ ID NO: 4427239 - DNA, 15 bp, Homo sapiens
tctgaatttgcaaag

SEQ ID NO: 4427240 - DNA, 19 bp, Homo sapiens
tctgaatttgcaaagtact

SEQ ID NO: 4427241 - DNA, 15 bp, Homo sapiens
tctgaatttttaaac

SEQ ID NO: 4427242 - DNA, 17 bp, Homo sapiens
tctgaatttttaaacaa

SEQ ID NO: 4427243 - DNA, 20 bp, Homo sapiens
tctgacaaaatggggcagaa

SEQ ID NO: 4427244 - DNA, 23 bp, Homo sapiens
tctgacaaaatggggcagaagag

SEQ ID NO: 4427245 - DNA, 17 bp, Homo sapiens
tctgacaggtgaattgg

SEQ ID NO: 4427246 - DNA, 12 bp, Homo sapiens
tctgacatgtaa

SEQ ID NO: 4427247 - DNA, 18 bp, Homo sapiens
tctgacatgtaagaaaat

SEQ ID NO: 4427248 - DNA, 20 bp, Homo sapiens
tctgacatgtaagaaaatgt

SEQ ID NO: 4427249 - DNA, 22 bp, Homo sapiens
tctgacatgtaagaaaatgtta

SEQ ID NO: 4427250 - DNA, 17 bp, Homo sapiens
tctgacccactttgtaa

SEQ ID NO: 4427251 - DNA, 16 bp, Homo sapiens
tctgacctcctctggg

SEQ ID NO: 4427252 - DNA, 17 bp, Homo sapiens
tctgacctcctctgggc

SEQ ID NO: 4427253 - DNA, 19 bp, Homo sapiens
tctgacctcctctgggccc

SEQ ID NO: 4427254 - DNA, 21 bp, Homo sapiens
tctgaccttccagagcccaag

SEQ ID NO: 4427255 - DNA, 23 bp, Homo sapiens
tctgactagattattatttgggg

SEQ ID NO: 4427256 - DNA, 13 bp, Homo sapiens
tctgacttttaca

SEQ ID NO: 4427257 - DNA, 22 bp, Homo sapiens
tctgagaaagactattcaaaca

SEQ ID NO: 4427258 - DNA, 18 bp, Homo sapiens
tctgagaagacacaaggt

SEQ ID NO: 4427259 - DNA, 24 bp, Homo sapiens
tctgagaagctctgaagaactctc

SEQ ID NO: 4427260 - DNA, 11 bp, Homo sapiens
tctgagatcag

SEQ ID NO: 4427261 - DNA, 18 bp, Homo sapiens
tctgagattcaatattga

SEQ ID NO: 4427262 - DNA, 15 bp, Homo sapiens
tctgagcaaaggccc

SEQ ID NO: 4427263 - DNA, 12 bp, Homo sapiens
tctgagcaaata

SEQ ID NO: 4427264 - DNA, 23 bp, Homo sapiens
tctgagcaggggcccctggggac

SEQ ID NO: 4427265 - DNA, 20 bp, Homo sapiens
tctgagccacagcagcattt

SEQ ID NO: 4427266 - DNA, 14 bp, Homo sapiens
tctgagccagatta

SEQ ID NO: 4427267 - DNA, 17 bp, Homo sapiens
tctgagccagattacag

SEQ ID NO: 4427268 - DNA, 15 bp, Homo sapiens
tctgagccctggtgt

SEQ ID NO: 4427269 - DNA, 23 bp, Homo sapiens
tctgaggagtaaaaagactactg

SEQ ID NO: 4427270 - DNA, 16 bp, Homo sapiens
tctgaggcccctgcct

SEQ ID NO: 4427271 - DNA, 19 bp, Homo sapiens
tctgaggggcaactgagtc

SEQ ID NO: 4427272 - DNA, 18 bp, Homo sapiens
tctgagtagtggccactg

SEQ ID NO: 4427273 - DNA, 23 bp, Homo sapiens
tctgagtagtggccactggggtg

SEQ ID NO: 4427274 - DNA, 14 bp, Homo sapiens
tctgataatttaaa

SEQ ID NO: 4427275 - DNA, 14 bp, Homo sapiens
tctgatacacagta

SEQ ID NO: 4427276 - DNA, 20 bp, Homo sapiens
tctgatacacagtaattgtg

SEQ ID NO: 4427277 - DNA, 21 bp, Homo sapiens
tctgatacacagtaattgtga

SEQ ID NO: 4427278 - DNA, 15 bp, Homo sapiens
tctgatactttagta

SEQ ID NO: 4427279 - DNA, 19 bp, Homo sapiens
tctgatactttagtacaat

SEQ ID NO: 4427280 - DNA, 23 bp, Homo sapiens
tctgataggaatgtgaaagcacg

SEQ ID NO: 4427281 - DNA, 14 bp, Homo sapiens
tctgatctgaggct

SEQ ID NO: 4427282 - DNA, 22 bp, Homo sapiens
tctgatctgtactttgtgttta

SEQ ID NO: 4427283 - DNA, 14 bp, Homo sapiens
tctgatctgtgctt

SEQ ID NO: 4427284 - DNA, 18 bp, Homo sapiens
tctgatctgtgctttcca

SEQ ID NO: 4427285 - DNA, 23 bp, Homo sapiens
tctgatctgtgctttccagctca

SEQ ID NO: 4427286 - DNA, 21 bp, Homo sapiens
tctgatcttggaaaaacagcg

SEQ ID NO: 4427287 - DNA, 13 bp, Homo sapiens
tctgatgaaatgt

SEQ ID NO: 4427288 - DNA, 15 bp, Homo sapiens
tctgatgaaatgtta

SEQ ID NO: 4427289 - DNA, 13 bp, Homo sapiens
tctgatgaatctc

SEQ ID NO: 4427290 - DNA, 22 bp, Homo sapiens
tctgatggccttaatttccttt

SEQ ID NO: 4427291 - DNA, 13 bp, Homo sapiens
tctgatgtcccag

SEQ ID NO: 4427292 - DNA, 12 bp, Homo sapiens
tctgatgtttat

SEQ ID NO: 4427293 - DNA, 23 bp, Homo sapiens
tctgatttattttgtatgaaata

SEQ ID NO: 4427294 - DNA, 14 bp, Homo sapiens
tctgatttctgaag

SEQ ID NO: 4427295 - DNA, 20 bp, Homo sapiens
tctgatttgtccctatgcat

SEQ ID NO: 4427296 - DNA, 17 bp, Homo sapiens
tctgatttttaagattt

SEQ ID NO: 4427297 - DNA, 14 bp, Homo sapiens
tctgcaaaatacac

SEQ ID NO: 4427298 - DNA, 14 bp, Homo sapiens
tctgcaattttact

SEQ ID NO: 4427299 - DNA, 19 bp, Homo sapiens
tctgcaattttactgtgaa

SEQ ID NO: 4427300 - DNA, 22 bp, Homo sapiens
tctgcacaccctccagagacaa

SEQ ID NO: 4427301 - DNA, 18 bp, Homo sapiens
tctgcaccacacctggca

SEQ ID NO: 4427302 - DNA, 15 bp, Homo sapiens
tctgcacccagaaca

SEQ ID NO: 4427303 - DNA, 12 bp, Homo sapiens
tctgcacccagt

SEQ ID NO: 4427304 - DNA, 21 bp, Homo sapiens
tctgcacccagtgaacacatt

SEQ ID NO: 4427305 - DNA, 20 bp, Homo sapiens
tctgcaccccttctctcctc

SEQ ID NO: 4427306 - DNA, 22 bp, Homo sapiens
tctgcaccccttctctcctccc

SEQ ID NO: 4427307 - DNA, 14 bp, Homo sapiens
tctgcacccgcctc

SEQ ID NO: 4427308 - DNA, 18 bp, Homo sapiens
tctgcacccgcctcgacc

SEQ ID NO: 4427309 - DNA, 14 bp, Homo sapiens
tctgcactactcct

SEQ ID NO: 4427310 - DNA, 19 bp, Homo sapiens
tctgcactactcctctgca

SEQ ID NO: 4427311 - DNA, 20 bp, Homo sapiens
tctgcactactcctctgcag

SEQ ID NO: 4427312 - DNA, 18 bp, Homo sapiens
tctgcactcccacctgac

SEQ ID NO: 4427313 - DNA, 22 bp, Homo sapiens
tctgcagacgtctgccttggca

SEQ ID NO: 4427314 - DNA, 15 bp, Homo sapiens
tctgcagataaacag

SEQ ID NO: 4427315 - DNA, 18 bp, Homo sapiens
tctgcagataaacagtag

SEQ ID NO: 4427316 - DNA, 14 bp, Homo sapiens
tctgcagcaactcc

SEQ ID NO: 4427317 - DNA, 15 bp, Homo sapiens
tctgcagcaactccc

SEQ ID NO: 4427318 - DNA, 21 bp, Homo sapiens
tctgcagcaactcccacgact

SEQ ID NO: 4427319 - DNA, 16 bp, Homo sapiens
tctgcagccagcccag

SEQ ID NO: 4427320 - DNA, 22 bp, Homo sapiens
tctgcagctatgcgcaatgtgg

SEQ ID NO: 4427321 - DNA, 19 bp, Homo sapiens
tctgcaggaaataggccca

SEQ ID NO: 4427322 - DNA, 23 bp, Homo sapiens
tctgcagtaaaacacatttggga

SEQ ID NO: 4427323 - DNA, 16 bp, Homo sapiens
tctgcatagacaaagg

SEQ ID NO: 4427324 - DNA, 15 bp, Homo sapiens
tctgcatttcatatt

SEQ ID NO: 4427325 - DNA, 12 bp, Homo sapiens
tctgccaaagta

SEQ ID NO: 4427326 - DNA, 18 bp, Homo sapiens
tctgccaaagtaaaacaa

SEQ ID NO: 4427327 - DNA, 14 bp, Homo sapiens
tctgccaccagccc

SEQ ID NO: 4427328 - DNA, 17 bp, Homo sapiens
tctgccaccagcccctc

SEQ ID NO: 4427329 - DNA, 14 bp, Homo sapiens
tctgccacctcccc

SEQ ID NO: 4427330 - DNA, 15 bp, Homo sapiens
tctgccacctcccct

SEQ ID NO: 4427331 - DNA, 23 bp, Homo sapiens
tctgccagaagatcccctcagga

SEQ ID NO: 4427332 - DNA, 12 bp, Homo sapiens
tctgccagcgcc

SEQ ID NO: 4427333 - DNA, 17 bp, Homo sapiens
tctgccattctgtgcag

SEQ ID NO: 4427334 - DNA, 17 bp, Homo sapiens
tctgccatttatttcct

SEQ ID NO: 4427335 - DNA, 14 bp, Homo sapiens
tctgccatttcatg

SEQ ID NO: 4427336 - DNA, 13 bp, Homo sapiens
tctgcccactcgg

SEQ ID NO: 4427337 - DNA, 20 bp, Homo sapiens
tctgcccatcctgcccctga

SEQ ID NO: 4427338 - DNA, 13 bp, Homo sapiens
tctgccccaggta

SEQ ID NO: 4427339 - DNA, 16 bp, Homo sapiens
tctgccccctccccca

SEQ ID NO: 4427340 - DNA, 13 bp, Homo sapiens
tctgcccctcccc

SEQ ID NO: 4427341 - DNA, 15 bp, Homo sapiens
tctgcccctgcagct

SEQ ID NO: 4427342 - DNA, 12 bp, Homo sapiens
tctgccctggaa

SEQ ID NO: 4427343 - DNA, 23 bp, Homo sapiens
tctgccctggattggttggcaaa

SEQ ID NO: 4427344 - DNA, 15 bp, Homo sapiens
tctgccctggctgct

SEQ ID NO: 4427345 - DNA, 21 bp, Homo sapiens
tctgccctggctgctgccccc

SEQ ID NO: 4427346 - DNA, 14 bp, Homo sapiens
tctgccgctgccat

SEQ ID NO: 4427347 - DNA, 20 bp, Homo sapiens
tctgccgctgccatgctttg

SEQ ID NO: 4427348 - DNA, 23 bp, Homo sapiens
tctgccgctgccatgctttgagt

SEQ ID NO: 4427349 - DNA, 21 bp, Homo sapiens
tctgccggtcgggcagccagc

SEQ ID NO: 4427350 - DNA, 16 bp, Homo sapiens
tctgcctcaatgtgaa

SEQ ID NO: 4427351 - DNA, 23 bp, Homo sapiens
tctgcctcaggaggtcacctgcc

SEQ ID NO: 4427352 - DNA, 13 bp, Homo sapiens
tctgcctccttta

SEQ ID NO: 4427353 - DNA, 12 bp, Homo sapiens
tctgcctctctg

SEQ ID NO: 4427354 - DNA, 23 bp, Homo sapiens
tctgcctggttccctccccaagg

SEQ ID NO: 4427355 - DNA, 23 bp, Homo sapiens
tctgccttaaacacacattgcag

SEQ ID NO: 4427356 - DNA, 20 bp, Homo sapiens
tctgccttctcatgatccaa

SEQ ID NO: 4427357 - DNA, 13 bp, Homo sapiens
tctgccttgcact

SEQ ID NO: 4427358 - DNA, 14 bp, Homo sapiens
tctgccttgccctc

SEQ ID NO: 4427359 - DNA, 21 bp, Homo sapiens
tctgccttgccctcctgggcc

SEQ ID NO: 4427360 - DNA, 15 bp, Homo sapiens
tctgcgggaggctgg

SEQ ID NO: 4427361 - DNA, 15 bp, Homo sapiens
tctgcgtgtcacctg

SEQ ID NO: 4427362 - DNA, 20 bp, Homo sapiens
tctgcgtgtcacctgtgctt

SEQ ID NO: 4427363 - DNA, 23 bp, Homo sapiens
tctgctaagattccttttgtcaa

SEQ ID NO: 4427364 - DNA, 23 bp, Homo sapiens
tctgctaagtaatttagaagata

SEQ ID NO: 4427365 - DNA, 20 bp, Homo sapiens
tctgctaggcgctggggaga

SEQ ID NO: 4427366 - DNA, 21 bp, Homo sapiens
tctgctaggcgctggggagac

SEQ ID NO: 4427367 - DNA, 14 bp, Homo sapiens
tctgctatatataa

SEQ ID NO: 4427368 - DNA, 15 bp, Homo sapiens
tctgctcaccgccca

SEQ ID NO: 4427369 - DNA, 22 bp, Homo sapiens
tctgctcatcattctctgtctc

SEQ ID NO: 4427370 - DNA, 12 bp, Homo sapiens
tctgctccacca

SEQ ID NO: 4427371 - DNA, 20 bp, Homo sapiens
tctgctccacccttggcctg

SEQ ID NO: 4427372 - DNA, 23 bp, Homo sapiens
tctgctccacccttggcctgtct

SEQ ID NO: 4427373 - DNA, 13 bp, Homo sapiens
tctgctccctctg

SEQ ID NO: 4427374 - DNA, 23 bp, Homo sapiens
tctgctccctgcaagctccgcct

SEQ ID NO: 4427375 - DNA, 12 bp, Homo sapiens
tctgctctcctt

SEQ ID NO: 4427376 - DNA, 13 bp, Homo sapiens
tctgctctccttc

SEQ ID NO: 4427377 - DNA, 19 bp, Homo sapiens
tctgctctccttcctggag

SEQ ID NO: 4427378 - DNA, 16 bp, Homo sapiens
tctgctctgcgtgtca

SEQ ID NO: 4427379 - DNA, 18 bp, Homo sapiens
tctgctctgctgctctga

SEQ ID NO: 4427380 - DNA, 21 bp, Homo sapiens
tctgctctggttgtttctgtt

SEQ ID NO: 4427381 - DNA, 18 bp, Homo sapiens
tctgctgagttggcctgg

SEQ ID NO: 4427382 - DNA, 22 bp, Homo sapiens
tctgctgagttggcctggccat

SEQ ID NO: 4427383 - DNA, 23 bp, Homo sapiens
tctgctggagaaagccacgccct

SEQ ID NO: 4427384 - DNA, 16 bp, Homo sapiens
tctgctggctcaggag

SEQ ID NO: 4427385 - DNA, 13 bp, Homo sapiens
tctgctgtagaaa

SEQ ID NO: 4427386 - DNA, 17 bp, Homo sapiens
tctgctgtccagacagc

SEQ ID NO: 4427387 - DNA, 16 bp, Homo sapiens
tctgctgtccttgcct

SEQ ID NO: 4427388 - DNA, 14 bp, Homo sapiens
tctgctgttccagt

SEQ ID NO: 4427389 - DNA, 13 bp, Homo sapiens
tctgcttctcatc

SEQ ID NO: 4427390 - DNA, 16 bp, Homo sapiens
tctgcttgcttggccc

SEQ ID NO: 4427391 - DNA, 19 bp, Homo sapiens
tctgctttctttgattctc

SEQ ID NO: 4427392 - DNA, 22 bp, Homo sapiens
tctgctttctttgattctcctt

SEQ ID NO: 4427393 - DNA, 22 bp, Homo sapiens
tctgcttttatctcagatgtta

SEQ ID NO: 4427394 - DNA, 14 bp, Homo sapiens
tctgcttttcctct

SEQ ID NO: 4427395 - DNA, 19 bp, Homo sapiens
tctgcttttctgccctggc

SEQ ID NO: 4427396 - DNA, 22 bp, Homo sapiens
tctgcttttctgccctggctgc

SEQ ID NO: 4427397 - DNA, 16 bp, Homo sapiens
tctggaaataatatca

SEQ ID NO: 4427398 - DNA, 19 bp, Homo sapiens
tctggaagacgtggctctg

SEQ ID NO: 4427399 - DNA, 18 bp, Homo sapiens
tctggaatgtttttccct

SEQ ID NO: 4427400 - DNA, 23 bp, Homo sapiens
tctggaatgtttttccctcccca

SEQ ID NO: 4427401 - DNA, 14 bp, Homo sapiens
tctggacagcagaa

SEQ ID NO: 4427402 - DNA, 19 bp, Homo sapiens
tctggacggcaggctcact

SEQ ID NO: 4427403 - DNA, 14 bp, Homo sapiens
tctggagagctaga

SEQ ID NO: 4427404 - DNA, 12 bp, Homo sapiens
tctggagagctg

SEQ ID NO: 4427405 - DNA, 22 bp, Homo sapiens
tctggagtttttgtttggagag

SEQ ID NO: 4427406 - DNA, 14 bp, Homo sapiens
tctggataggagcc

SEQ ID NO: 4427407 - DNA, 16 bp, Homo sapiens
tctggataggagcctg

SEQ ID NO: 4427408 - DNA, 20 bp, Homo sapiens
tctggataggagcctgctgg

SEQ ID NO: 4427409 - DNA, 15 bp, Homo sapiens
tctggatcagtaaaa

SEQ ID NO: 4427410 - DNA, 15 bp, Homo sapiens
tctggatcctgcact

SEQ ID NO: 4427411 - DNA, 21 bp, Homo sapiens
tctggatggtgtgccttccag

SEQ ID NO: 4427412 - DNA, 22 bp, Homo sapiens
tctggatggtgtgccttccaga

SEQ ID NO: 4427413 - DNA, 19 bp, Homo sapiens
tctggattcatatttaatt

SEQ ID NO: 4427414 - DNA, 15 bp, Homo sapiens
tctggcaacatcttt

SEQ ID NO: 4427415 - DNA, 12 bp, Homo sapiens
tctggcaaggac

SEQ ID NO: 4427416 - DNA, 22 bp, Homo sapiens
tctggcacacagtaggtgctca

SEQ ID NO: 4427417 - DNA, 13 bp, Homo sapiens
tctggcaccatgt

SEQ ID NO: 4427418 - DNA, 19 bp, Homo sapiens
tctggcagggtgggatgga

SEQ ID NO: 4427419 - DNA, 18 bp, Homo sapiens
tctggcaggtcctcccct

SEQ ID NO: 4427420 - DNA, 21 bp, Homo sapiens
tctggccagtgtttaaaactt

SEQ ID NO: 4427421 - DNA, 14 bp, Homo sapiens
tctggcccaccagg

SEQ ID NO: 4427422 - DNA, 16 bp, Homo sapiens
tctggcccaccagggt

SEQ ID NO: 4427423 - DNA, 11 bp, Homo sapiens
tctggccctat

SEQ ID NO: 4427424 - DNA, 13 bp, Homo sapiens
tctggccctgcct

SEQ ID NO: 4427425 - DNA, 14 bp, Homo sapiens
tctggccctgcctt

SEQ ID NO: 4427426 - DNA, 16 bp, Homo sapiens
tctggccctgccttct

SEQ ID NO: 4427427 - DNA, 12 bp, Homo sapiens
tctggccctggg

SEQ ID NO: 4427428 - DNA, 23 bp, Homo sapiens
tctggcctaggacccctcgcctt

SEQ ID NO: 4427429 - DNA, 21 bp, Homo sapiens
tctggcgcccctgcctgtgcc

SEQ ID NO: 4427430 - DNA, 18 bp, Homo sapiens
tctggcgttctcaagaat

SEQ ID NO: 4427431 - DNA, 20 bp, Homo sapiens
tctggctacctgtttgaagg

SEQ ID NO: 4427432 - DNA, 21 bp, Homo sapiens
tctggctagaggccagcccca

SEQ ID NO: 4427433 - DNA, 22 bp, Homo sapiens
tctggctagaggccagccccac

SEQ ID NO: 4427434 - DNA, 12 bp, Homo sapiens
tctggctctaat

SEQ ID NO: 4427435 - DNA, 17 bp, Homo sapiens
tctggcttagtgccacc

SEQ ID NO: 4427436 - DNA, 15 bp, Homo sapiens
tctggcttctgcatt

SEQ ID NO: 4427437 - DNA, 21 bp, Homo sapiens
tctggctttcccaggagatgg

SEQ ID NO: 4427438 - DNA, 15 bp, Homo sapiens
tctggctttggcact

SEQ ID NO: 4427439 - DNA, 18 bp, Homo sapiens
tctggctttggcactctc

SEQ ID NO: 4427440 - DNA, 21 bp, Homo sapiens
tctggctttggcactctctgc

SEQ ID NO: 4427441 - DNA, 19 bp, Homo sapiens
tctgggaaatgaggttttt

SEQ ID NO: 4427442 - DNA, 20 bp, Homo sapiens
tctgggaagggagagttctt

SEQ ID NO: 4427443 - DNA, 14 bp, Homo sapiens
tctgggaaggggct

SEQ ID NO: 4427444 - DNA, 18 bp, Homo sapiens
tctgggaatgggagaggg

SEQ ID NO: 4427445 - DNA, 20 bp, Homo sapiens
tctgggacctgccaggcagg

SEQ ID NO: 4427446 - DNA, 21 bp, Homo sapiens
tctgggactctcctcctcccc

SEQ ID NO: 4427447 - DNA, 15 bp, Homo sapiens
tctgggactgtgcct

SEQ ID NO: 4427448 - DNA, 21 bp, Homo sapiens
tctgggagggcagcagggcta

SEQ ID NO: 4427449 - DNA, 15 bp, Homo sapiens
tctgggagtcacaca

SEQ ID NO: 4427450 - DNA, 16 bp, Homo sapiens
tctgggagtcacacag

SEQ ID NO: 4427451 - DNA, 21 bp, Homo sapiens
tctgggcaccacaaaatatac

SEQ ID NO: 4427452 - DNA, 14 bp, Homo sapiens
tctgggcagcacct

SEQ ID NO: 4427453 - DNA, 18 bp, Homo sapiens
tctgggcagcacctctgg

SEQ ID NO: 4427454 - DNA, 21 bp, Homo sapiens
tctgggcattttcctcctctg

SEQ ID NO: 4427455 - DNA, 22 bp, Homo sapiens
tctgggcattttcctcctctgc

SEQ ID NO: 4427456 - DNA, 21 bp, Homo sapiens
tctgggcttatatctggcctc

SEQ ID NO: 4427457 - DNA, 17 bp, Homo sapiens
tctggggatttctggga

SEQ ID NO: 4427458 - DNA, 18 bp, Homo sapiens
tctggggatttctgggat

SEQ ID NO: 4427459 - DNA, 19 bp, Homo sapiens
tctggggcaggctgggcca

SEQ ID NO: 4427460 - DNA, 21 bp, Homo sapiens
tctggggcaggctgggccatg

SEQ ID NO: 4427461 - DNA, 16 bp, Homo sapiens
tctggggccctgggcc

SEQ ID NO: 4427462 - DNA, 18 bp, Homo sapiens
tctggggccctgggcctc

SEQ ID NO: 4427463 - DNA, 23 bp, Homo sapiens
tctggggctgtgttatgaaaata

SEQ ID NO: 4427464 - DNA, 17 bp, Homo sapiens
tctgggggtgggaagtg

SEQ ID NO: 4427465 - DNA, 14 bp, Homo sapiens
tctggggtgcagct

SEQ ID NO: 4427466 - DNA, 14 bp, Homo sapiens
tctgggtccaggga

SEQ ID NO: 4427467 - DNA, 14 bp, Homo sapiens
tctgggtgaggtag

SEQ ID NO: 4427468 - DNA, 21 bp, Homo sapiens
tctgggtgtgctttttgggac

SEQ ID NO: 4427469 - DNA, 15 bp, Homo sapiens
tctgggttgccttta

SEQ ID NO: 4427470 - DNA, 18 bp, Homo sapiens
tctgggttttgttggctt

SEQ ID NO: 4427471 - DNA, 15 bp, Homo sapiens
tctggtattaaatgc

SEQ ID NO: 4427472 - DNA, 13 bp, Homo sapiens
tctggtcccttgc

SEQ ID NO: 4427473 - DNA, 21 bp, Homo sapiens
tctggtccctttaaagagcaa

SEQ ID NO: 4427474 - DNA, 17 bp, Homo sapiens
tctggtgaagctcactt

SEQ ID NO: 4427475 - DNA, 20 bp, Homo sapiens
tctggtgagtcaccacttca

SEQ ID NO: 4427476 - DNA, 17 bp, Homo sapiens
tctggtgccatttctga

SEQ ID NO: 4427477 - DNA, 16 bp, Homo sapiens
tctggtgctactccat

SEQ ID NO: 4427478 - DNA, 19 bp, Homo sapiens
tctggtgctactccatgca

SEQ ID NO: 4427479 - DNA, 16 bp, Homo sapiens
tctggtggtcttcctt

SEQ ID NO: 4427480 - DNA, 21 bp, Homo sapiens
tctggttgttgcaccatctgc

SEQ ID NO: 4427481 - DNA, 18 bp, Homo sapiens
tctgtaaaaaatggagct

SEQ ID NO: 4427482 - DNA, 19 bp, Homo sapiens
tctgtaaactgtgtattcc

SEQ ID NO: 4427483 - DNA, 22 bp, Homo sapiens
tctgtaaactgtgtattccaag

SEQ ID NO: 4427484 - DNA, 12 bp, Homo sapiens
tctgtaaattca

SEQ ID NO: 4427485 - DNA, 13 bp, Homo sapiens
tctgtaaattcat

SEQ ID NO: 4427486 - DNA, 17 bp, Homo sapiens
tctgtaatatttacaat

SEQ ID NO: 4427487 - DNA, 23 bp, Homo sapiens
tctgtaatgatactgattatgaa

SEQ ID NO: 4427488 - DNA, 13 bp, Homo sapiens
tctgtaatgtaaa

SEQ ID NO: 4427489 - DNA, 21 bp, Homo sapiens
tctgtaatgtaaataaactat

SEQ ID NO: 4427490 - DNA, 12 bp, Homo sapiens
tctgtaccagtt

SEQ ID NO: 4427491 - DNA, 13 bp, Homo sapiens
tctgtaccagtta

SEQ ID NO: 4427492 - DNA, 18 bp, Homo sapiens
tctgtagacttttgaaaa

SEQ ID NO: 4427493 - DNA, 16 bp, Homo sapiens
tctgtagcaaatttgt

SEQ ID NO: 4427494 - DNA, 15 bp, Homo sapiens
tctgtagccactagt

SEQ ID NO: 4427495 - DNA, 18 bp, Homo sapiens
tctgtagcttatctgccc

SEQ ID NO: 4427496 - DNA, 22 bp, Homo sapiens
tctgtagcttatctgcccctcc

SEQ ID NO: 4427497 - DNA, 23 bp, Homo sapiens
tctgtagtaaaatgttttcattt

SEQ ID NO: 4427498 - DNA, 22 bp, Homo sapiens
tctgtagtaatttattgtctgt

SEQ ID NO: 4427499 - DNA, 24 bp, Homo sapiens
tctgtagtgtattaatctctgtgt

SEQ ID NO: 4427500 - DNA, 19 bp, Homo sapiens
tctgtataatactttgtat

SEQ ID NO: 4427501 - DNA, 16 bp, Homo sapiens
tctgtataatagagat

SEQ ID NO: 4427502 - DNA, 22 bp, Homo sapiens
tctgtatataaatatattttct

SEQ ID NO: 4427503 - DNA, 20 bp, Homo sapiens
tctgtatcaggacccagagg

SEQ ID NO: 4427504 - DNA, 13 bp, Homo sapiens
tctgtatggtcag

SEQ ID NO: 4427505 - DNA, 18 bp, Homo sapiens
tctgtattgaaaatggct

SEQ ID NO: 4427506 - DNA, 18 bp, Homo sapiens
tctgtatttaatggtttt

SEQ ID NO: 4427507 - DNA, 20 bp, Homo sapiens
tctgtatttaatggttttta

SEQ ID NO: 4427508 - DNA, 18 bp, Homo sapiens
tctgtcacagtaaaaata

SEQ ID NO: 4427509 - DNA, 21 bp, Homo sapiens
tctgtcagccagccgccctgg

SEQ ID NO: 4427510 - DNA, 16 bp, Homo sapiens
tctgtcaggggcttgg

SEQ ID NO: 4427511 - DNA, 17 bp, Homo sapiens
tctgtcaggggcttgga

SEQ ID NO: 4427512 - DNA, 18 bp, Homo sapiens
tctgtcaggggcttggat

SEQ ID NO: 4427513 - DNA, 13 bp, Homo sapiens
tctgtcagtgttt

SEQ ID NO: 4427514 - DNA, 20 bp, Homo sapiens
tctgtcagtgtttgtatttg

SEQ ID NO: 4427515 - DNA, 22 bp, Homo sapiens
tctgtcatctctctggggccct

SEQ ID NO: 4427516 - DNA, 14 bp, Homo sapiens
tctgtcattatatt

SEQ ID NO: 4427517 - DNA, 15 bp, Homo sapiens
tctgtccaaaggagg

SEQ ID NO: 4427518 - DNA, 19 bp, Homo sapiens
tctgtccaaaggaggctgg

SEQ ID NO: 4427519 - DNA, 22 bp, Homo sapiens
tctgtccaaaggaggctggcag

SEQ ID NO: 4427520 - DNA, 23 bp, Homo sapiens
tctgtcccactacatctgggact

SEQ ID NO: 4427521 - DNA, 15 bp, Homo sapiens
tctgtcccccaggct

SEQ ID NO: 4427522 - DNA, 17 bp, Homo sapiens
tctgtcccccaggctgg

SEQ ID NO: 4427523 - DNA, 21 bp, Homo sapiens
tctgtccccttctctcatctc

SEQ ID NO: 4427524 - DNA, 22 bp, Homo sapiens
tctgtccgcctttacaagggag

SEQ ID NO: 4427525 - DNA, 22 bp, Homo sapiens
tctgtctcaaaaaaaaaaagaa

SEQ ID NO: 4427526 - DNA, 18 bp, Homo sapiens
tctgtctgaatgatcttg

SEQ ID NO: 4427527 - DNA, 21 bp, Homo sapiens
tctgtctgaatgatcttgtgt

SEQ ID NO: 4427528 - DNA, 18 bp, Homo sapiens
tctgtctgccaacctaaa

SEQ ID NO: 4427529 - DNA, 13 bp, Homo sapiens
tctgtctgccctt

SEQ ID NO: 4427530 - DNA, 12 bp, Homo sapiens
tctgtctgcttt

SEQ ID NO: 4427531 - DNA, 13 bp, Homo sapiens
tctgtctgtgcac

SEQ ID NO: 4427532 - DNA, 11 bp, Homo sapiens
tctgtctttcc

SEQ ID NO: 4427533 - DNA, 19 bp, Homo sapiens
tctgtcttttggagaacca

SEQ ID NO: 4427534 - DNA, 14 bp, Homo sapiens
tctgtgaaagcttt

SEQ ID NO: 4427535 - DNA, 19 bp, Homo sapiens
tctgtgaaagctttggaaa

SEQ ID NO: 4427536 - DNA, 15 bp, Homo sapiens
tctgtgaaatatcat

SEQ ID NO: 4427537 - DNA, 14 bp, Homo sapiens
tctgtgatctctgc

SEQ ID NO: 4427538 - DNA, 16 bp, Homo sapiens
tctgtgatctctgctg

SEQ ID NO: 4427539 - DNA, 12 bp, Homo sapiens
tctgtgcacatg

SEQ ID NO: 4427540 - DNA, 14 bp, Homo sapiens
tctgtgcacatgcc

SEQ ID NO: 4427541 - DNA, 21 bp, Homo sapiens
tctgtgcaggctgcagtggct

SEQ ID NO: 4427542 - DNA, 22 bp, Homo sapiens
tctgtgccccatgcctgtccag

SEQ ID NO: 4427543 - DNA, 17 bp, Homo sapiens
tctgtgccctccaaaga

SEQ ID NO: 4427544 - DNA, 13 bp, Homo sapiens
tctgtgcctcccc

SEQ ID NO: 4427545 - DNA, 19 bp, Homo sapiens
tctgtgcctccccccagac

SEQ ID NO: 4427546 - DNA, 21 bp, Homo sapiens
tctgtgcctccccccagaccc

SEQ ID NO: 4427547 - DNA, 19 bp, Homo sapiens
tctgtgctgaccctcctgt

SEQ ID NO: 4427548 - DNA, 23 bp, Homo sapiens
tctgtgctgaccctcctgttgca

SEQ ID NO: 4427549 - DNA, 16 bp, Homo sapiens
tctgtgctttccagct

SEQ ID NO: 4427550 - DNA, 21 bp, Homo sapiens
tctgtgctttccagctcaccc

SEQ ID NO: 4427551 - DNA, 19 bp, Homo sapiens
tctgtggaggtggaaaagc

SEQ ID NO: 4427552 - DNA, 19 bp, Homo sapiens
tctgtggctggctctacct

SEQ ID NO: 4427553 - DNA, 14 bp, Homo sapiens
tctgtggggactcc

SEQ ID NO: 4427554 - DNA, 12 bp, Homo sapiens
tctgtggggccc

SEQ ID NO: 4427555 - DNA, 16 bp, Homo sapiens
tctgtggttcctctgc

SEQ ID NO: 4427556 - DNA, 17 bp, Homo sapiens
tctgtggttcctctgct

SEQ ID NO: 4427557 - DNA, 14 bp, Homo sapiens
tctgtgtatatctc

SEQ ID NO: 4427558 - DNA, 20 bp, Homo sapiens
tctgtgtatatctcttggaa

SEQ ID NO: 4427559 - DNA, 13 bp, Homo sapiens
tctgtgtattaac

SEQ ID NO: 4427560 - DNA, 15 bp, Homo sapiens
tctgtgtcagcattc

SEQ ID NO: 4427561 - DNA, 15 bp, Homo sapiens
tctgtgtcatttctt

SEQ ID NO: 4427562 - DNA, 13 bp, Homo sapiens
tctgtgtgtgtgt

SEQ ID NO: 4427563 - DNA, 15 bp, Homo sapiens
tctgtgtgtttatgt

SEQ ID NO: 4427564 - DNA, 20 bp, Homo sapiens
tctgtgtgtttatgtgtgtg

SEQ ID NO: 4427565 - DNA, 13 bp, Homo sapiens
tctgtgttttcag

SEQ ID NO: 4427566 - DNA, 14 bp, Homo sapiens
tctgtgttttcaga

SEQ ID NO: 4427567 - DNA, 21 bp, Homo sapiens
tctgtgttttcagactgcctg

SEQ ID NO: 4427568 - DNA, 14 bp, Homo sapiens
tctgtgttttgaat

SEQ ID NO: 4427569 - DNA, 21 bp, Homo sapiens
tctgttcagttcattcccaga

SEQ ID NO: 4427570 - DNA, 17 bp, Homo sapiens
tctgttccaaattcagt

SEQ ID NO: 4427571 - DNA, 19 bp, Homo sapiens
tctgttccatgcaactgga

SEQ ID NO: 4427572 - DNA, 14 bp, Homo sapiens
tctgttcccagccc

SEQ ID NO: 4427573 - DNA, 15 bp, Homo sapiens
tctgttcccagcccc

SEQ ID NO: 4427574 - DNA, 22 bp, Homo sapiens
tctgttcccagcccctcctccc

SEQ ID NO: 4427575 - DNA, 18 bp, Homo sapiens
tctgttcccagcccctgc

SEQ ID NO: 4427576 - DNA, 20 bp, Homo sapiens
tctgttctacatagatgctt

SEQ ID NO: 4427577 - DNA, 15 bp, Homo sapiens
tctgttctagttttt

SEQ ID NO: 4427578 - DNA, 12 bp, Homo sapiens
tctgttgaagtt

SEQ ID NO: 4427579 - DNA, 19 bp, Homo sapiens
tctgttgccttatttctca

SEQ ID NO: 4427580 - DNA, 16 bp, Homo sapiens
tctgttggattccatg

SEQ ID NO: 4427581 - DNA, 18 bp, Homo sapiens
tctgttggattccatgct

SEQ ID NO: 4427582 - DNA, 23 bp, Homo sapiens
tctgttgtcgtaaagatttgggt

SEQ ID NO: 4427583 - DNA, 14 bp, Homo sapiens
tctgtttaaagtgg

SEQ ID NO: 4427584 - DNA, 20 bp, Homo sapiens
tctgtttcctgacattgtct

SEQ ID NO: 4427585 - DNA, 18 bp, Homo sapiens
tctgtttgctgtggaact

SEQ ID NO: 4427586 - DNA, 15 bp, Homo sapiens
tctgtttgtgggact

SEQ ID NO: 4427587 - DNA, 17 bp, Homo sapiens
tctgttttcctaatgtt

SEQ ID NO: 4427588 - DNA, 17 bp, Homo sapiens
tctgttttgaaggcaaa

SEQ ID NO: 4427589 - DNA, 13 bp, Homo sapiens
tctattgtacaga

SEQ ID NO: 4427590 - DNA, 15 bp, Homo sapiens
tctattgtccaaagt

SEQ ID NO: 4427591 - DNA, 16 bp, Homo sapiens
tctattgttaagtatt

SEQ ID NO: 4427592 - DNA, 14 bp, Homo sapiens
tctatttaaaaaac

SEQ ID NO: 4427593 - DNA, 21 bp, Homo sapiens
tctatttagccagcgtttatt

SEQ ID NO: 4427594 - DNA, 14 bp, Homo sapiens
tctatttataatac

SEQ ID NO: 4427595 - DNA, 18 bp, Homo sapiens
tctatttatatgtacatg

SEQ ID NO: 4427596 - DNA, 14 bp, Homo sapiens
tctatttatttatt

SEQ ID NO: 4427597 - DNA, 18 bp, Homo sapiens
tctatttgtacaatttta

SEQ ID NO: 4427598 - DNA, 13 bp, Homo sapiens
tctatttgtctct

SEQ ID NO: 4427599 - DNA, 17 bp, Homo sapiens
tctattttacttttctg

SEQ ID NO: 4427600 - DNA, 17 bp, Homo sapiens
tctattttattttattg

SEQ ID NO: 4427601 - DNA, 20 bp, Homo sapiens
tctattttgatgcagcattt

SEQ ID NO: 4427602 - DNA, 18 bp, Homo sapiens
tctattttggattgtata

SEQ ID NO: 4427603 - DNA, 20 bp, Homo sapiens
tctattttttgaaaagcaga

SEQ ID NO: 4427604 - DNA, 23 bp, Homo sapiens
tctcaaaacaatattactttgtc

SEQ ID NO: 4427605 - DNA, 16 bp, Homo sapiens
tctcaaaggagcgagc

SEQ ID NO: 4427606 - DNA, 22 bp, Homo sapiens
tctcaaataggctattaaaaaa

SEQ ID NO: 4427607 - DNA, 16 bp, Homo sapiens
tctcaaattcagctct

SEQ ID NO: 4427608 - DNA, 20 bp, Homo sapiens
tctcaacatactgtaatcaa

SEQ ID NO: 4427609 - DNA, 19 bp, Homo sapiens
tctcaacttttttcccttg

SEQ ID NO: 4427610 - DNA, 17 bp, Homo sapiens
tctcaagaatctagaag

SEQ ID NO: 4427611 - DNA, 19 bp, Homo sapiens
tctcaagaatctagaagat

SEQ ID NO: 4427612 - DNA, 22 bp, Homo sapiens
tctcaagaatctagaagatgtg

SEQ ID NO: 4427613 - DNA, 22 bp, Homo sapiens
tctcaaggagaggcaaagaaag

SEQ ID NO: 4427614 - DNA, 22 bp, Homo sapiens
tctcaagtaacatgacttcctt

SEQ ID NO: 4427615 - DNA, 19 bp, Homo sapiens
tctcaatcttggtttgtca

SEQ ID NO: 4427616 - DNA, 14 bp, Homo sapiens
tctcaatgaaatag

SEQ ID NO: 4427617 - DNA, 23 bp, Homo sapiens
tctcaattgaaagcttttaaaat

SEQ ID NO: 4427618 - DNA, 22 bp, Homo sapiens
tctcacaaaaaggcaaatattg

SEQ ID NO: 4427619 - DNA, 15 bp, Homo sapiens
tctcacaaataagta

SEQ ID NO: 4427620 - DNA, 23 bp, Homo sapiens
tctcacaaataagtaatatcttt

SEQ ID NO: 4427621 - DNA, 17 bp, Homo sapiens
tctcaccacacataata

SEQ ID NO: 4427622 - DNA, 14 bp, Homo sapiens
tctcaccagctgca

SEQ ID NO: 4427623 - DNA, 17 bp, Homo sapiens
tctcaccagctgcaaag

SEQ ID NO: 4427624 - DNA, 19 bp, Homo sapiens
tctcaccagctgcaaagtg

SEQ ID NO: 4427625 - DNA, 20 bp, Homo sapiens
tctcaccagctgcaaagtgt

SEQ ID NO: 4427626 - DNA, 24 bp, Homo sapiens
tctcacctggacttaagcatctgg

SEQ ID NO: 4427627 - DNA, 16 bp, Homo sapiens
tctcactataccagta

SEQ ID NO: 4427628 - DNA, 13 bp, Homo sapiens
tctcactccacca

SEQ ID NO: 4427629 - DNA, 14 bp, Homo sapiens
tctcactccaccac

SEQ ID NO: 4427630 - DNA, 18 bp, Homo sapiens
tctcactccaccacccaa

SEQ ID NO: 4427631 - DNA, 16 bp, Homo sapiens
tctcactgcttgaact

SEQ ID NO: 4427632 - DNA, 20 bp, Homo sapiens
tctcactgtgggaaggccag

SEQ ID NO: 4427633 - DNA, 21 bp, Homo sapiens
tctcactgtgggaaggccagc

SEQ ID NO: 4427634 - DNA, 15 bp, Homo sapiens
tctcacttctaaatt

SEQ ID NO: 4427635 - DNA, 20 bp, Homo sapiens
tctcactttactttcaagta

SEQ ID NO: 4427636 - DNA, 14 bp, Homo sapiens
tctcagaaccattt

SEQ ID NO: 4427637 - DNA, 14 bp, Homo sapiens
tctcagaagcacag

SEQ ID NO: 4427638 - DNA, 15 bp, Homo sapiens
tctcagaagcacaga

SEQ ID NO: 4427639 - DNA, 21 bp, Homo sapiens
tctcagaatcccttaacagtt

SEQ ID NO: 4427640 - DNA, 22 bp, Homo sapiens
tctcagaattcggtgtgctgcc

SEQ ID NO: 4427641 - DNA, 16 bp, Homo sapiens
tctcagaccctgctta

SEQ ID NO: 4427642 - DNA, 20 bp, Homo sapiens
tctcagaggcctgctgccag

SEQ ID NO: 4427643 - DNA, 15 bp, Homo sapiens
tctcagagtccactg

SEQ ID NO: 4427644 - DNA, 19 bp, Homo sapiens
tctcagagtgacagtcata

SEQ ID NO: 4427645 - DNA, 15 bp, Homo sapiens
tctcagatgcagttt

SEQ ID NO: 4427646 - DNA, 18 bp, Homo sapiens
tctcagatttctgaggaa

SEQ ID NO: 4427647 - DNA, 13 bp, Homo sapiens
tctcagcccagaa

SEQ ID NO: 4427648 - DNA, 15 bp, Homo sapiens
tctcagcccagaaga

SEQ ID NO: 4427649 - DNA, 20 bp, Homo sapiens
tctcagcccagaagaaaatt

SEQ ID NO: 4427650 - DNA, 15 bp, Homo sapiens
tctcagcctcccaca

SEQ ID NO: 4427651 - DNA, 13 bp, Homo sapiens
tctcagctgctgg

SEQ ID NO: 4427652 - DNA, 18 bp, Homo sapiens
tctcagctgctggatgac

SEQ ID NO: 4427653 - DNA, 20 bp, Homo sapiens
tctcagcttgcagctggaag

SEQ ID NO: 4427654 - DNA, 12 bp, Homo sapiens
tctcaggaaatc

SEQ ID NO: 4427655 - DNA, 23 bp, Homo sapiens
tctcaggaaatcaaatatgcaaa

SEQ ID NO: 4427656 - DNA, 23 bp, Homo sapiens
tctcaggacagcatcccttccca

SEQ ID NO: 4427657 - DNA, 15 bp, Homo sapiens
tctcaggagatggag

SEQ ID NO: 4427658 - DNA, 22 bp, Homo sapiens
tctcaggagatggagggcttgg

SEQ ID NO: 4427659 - DNA, 17 bp, Homo sapiens
tctcaggccgagagcct

SEQ ID NO: 4427660 - DNA, 17 bp, Homo sapiens
tctcaggctcaagtttt

SEQ ID NO: 4427661 - DNA, 19 bp, Homo sapiens
tctcaggtaatcattttaa

SEQ ID NO: 4427662 - DNA, 19 bp, Homo sapiens
tctcaggtgagctggtaga

SEQ ID NO: 4427663 - DNA, 21 bp, Homo sapiens
tctcaggtttgttttgtgaat

SEQ ID NO: 4427664 - DNA, 11 bp, Homo sapiens
tctcagtctct

SEQ ID NO: 4427665 - DNA, 17 bp, Homo sapiens
tctcagtctctgagcag

SEQ ID NO: 4427666 - DNA, 15 bp, Homo sapiens
tctcagtgctttcct

SEQ ID NO: 4427667 - DNA, 20 bp, Homo sapiens
tctcagtggcttcatctgtc

SEQ ID NO: 4427668 - DNA, 14 bp, Homo sapiens
tctcagttgtttgc

SEQ ID NO: 4427669 - DNA, 18 bp, Homo sapiens
tctcagttgtttgcttct

SEQ ID NO: 4427670 - DNA, 18 bp, Homo sapiens
tctcataattcctacagc

SEQ ID NO: 4427671 - DNA, 15 bp, Homo sapiens
tctcataattttgca

SEQ ID NO: 4427672 - DNA, 19 bp, Homo sapiens
tctcatagcaggaaatgta

SEQ ID NO: 4427673 - DNA, 10 bp, Homo sapiens
tctcatcatg

SEQ ID NO: 4427674 - DNA, 15 bp, Homo sapiens
tctcatcatgtctat

SEQ ID NO: 4427675 - DNA, 18 bp, Homo sapiens
tctcatcatgtctattgt

SEQ ID NO: 4427676 - DNA, 22 bp, Homo sapiens
tctcatccccaggggtcccagc

SEQ ID NO: 4427677 - DNA, 14 bp, Homo sapiens
tctcatctcccagg

SEQ ID NO: 4427678 - DNA, 17 bp, Homo sapiens
tctcatgggtggcactc

SEQ ID NO: 4427679 - DNA, 18 bp, Homo sapiens
tctcatgtatcatctgga

SEQ ID NO: 4427680 - DNA, 15 bp, Homo sapiens
tctcatgtctcccca

SEQ ID NO: 4427681 - DNA, 14 bp, Homo sapiens
tctcattatttcaa

SEQ ID NO: 4427682 - DNA, 10 bp, Homo sapiens
tctcattccc

SEQ ID NO: 4427683 - DNA, 17 bp, Homo sapiens
tctcattgcctcttcta

SEQ ID NO: 4427684 - DNA, 14 bp, Homo sapiens
tctcattgcttctg

SEQ ID NO: 4427685 - DNA, 15 bp, Homo sapiens
tctcattgcttctga

SEQ ID NO: 4427686 - DNA, 19 bp, Homo sapiens
tctcatttaagggaaaaat

SEQ ID NO: 4427687 - DNA, 23 bp, Homo sapiens
tctcatttaagggaaaaatatat

SEQ ID NO: 4427688 - DNA, 17 bp, Homo sapiens
tctcatttcacccctcc

SEQ ID NO: 4427689 - DNA, 19 bp, Homo sapiens
tctccaaaaatctgcctgg

SEQ ID NO: 4427690 - DNA, 17 bp, Homo sapiens
tctccaaccccccagca

SEQ ID NO: 4427691 - DNA, 22 bp, Homo sapiens
tctccaaccccccagcactgag

SEQ ID NO: 4427692 - DNA, 20 bp, Homo sapiens
tctccaagacagcagcagcc

SEQ ID NO: 4427693 - DNA, 22 bp, Homo sapiens
tctccaagacagcagcagcctg

SEQ ID NO: 4427694 - DNA, 23 bp, Homo sapiens
tctccaagacagcagcagcctgc

SEQ ID NO: 4427695 - DNA, 22 bp, Homo sapiens
tctccaagtagtccaccttcat

SEQ ID NO: 4427696 - DNA, 19 bp, Homo sapiens
tctccaattctgaaatact

SEQ ID NO: 4427697 - DNA, 17 bp, Homo sapiens
tctccaccccagggtca

SEQ ID NO: 4427698 - DNA, 12 bp, Homo sapiens
tctccacctcag

SEQ ID NO: 4427699 - DNA, 18 bp, Homo sapiens
tctccacctcagccttgg

SEQ ID NO: 4427700 - DNA, 12 bp, Homo sapiens
tctccagctgac

SEQ ID NO: 4427701 - DNA, 13 bp, Homo sapiens
tctccagctgctg

SEQ ID NO: 4427702 - DNA, 19 bp, Homo sapiens
tctccaggattttaatttc

SEQ ID NO: 4427703 - DNA, 13 bp, Homo sapiens
tctccatcccctc

SEQ ID NO: 4427704 - DNA, 19 bp, Homo sapiens
tctccatcccctccctgcc

SEQ ID NO: 4427705 - DNA, 20 bp, Homo sapiens
tctccatcccctccctgcct

SEQ ID NO: 4427706 - DNA, 17 bp, Homo sapiens
tctccatctggcagggt

SEQ ID NO: 4427707 - DNA, 14 bp, Homo sapiens
tctccatggccctg

SEQ ID NO: 4427708 - DNA, 18 bp, Homo sapiens
tctccatggccctgtccc

SEQ ID NO: 4427709 - DNA, 21 bp, Homo sapiens
tctccatggccctgtcccagg

SEQ ID NO: 4427710 - DNA, 23 bp, Homo sapiens
tctccatgtagaataaatgaaga

SEQ ID NO: 4427711 - DNA, 16 bp, Homo sapiens
tctccatttaagacac

SEQ ID NO: 4427712 - DNA, 23 bp, Homo sapiens
tctcccaaacacataatttctgt

SEQ ID NO: 4427713 - DNA, 20 bp, Homo sapiens
tctcccaaagggcacacccc

SEQ ID NO: 4427714 - DNA, 17 bp, Homo sapiens
tctcccaacatgggagg

SEQ ID NO: 4427715 - DNA, 18 bp, Homo sapiens
tctcccaacatgggaggg

SEQ ID NO: 4427716 - DNA, 14 bp, Homo sapiens
tctcccaagaaacc

SEQ ID NO: 4427717 - DNA, 16 bp, Homo sapiens
tctcccacagagtgct

SEQ ID NO: 4427718 - DNA, 24 bp, Homo sapiens
tctcccacatgaggccatctcagg

SEQ ID NO: 4427719 - DNA, 22 bp, Homo sapiens
tctcccacccggccacagctgc

SEQ ID NO: 4427720 - DNA, 23 bp, Homo sapiens
tctcccagataatgtgaaaatgg

SEQ ID NO: 4427721 - DNA, 20 bp, Homo sapiens
tctcccagtctacccagaga

SEQ ID NO: 4427722 - DNA, 21 bp, Homo sapiens
tctcccagtgaactcctgcca

SEQ ID NO: 4427723 - DNA, 18 bp, Homo sapiens
tctcccatctcttccttg

SEQ ID NO: 4427724 - DNA, 13 bp, Homo sapiens
tctcccatggagc

SEQ ID NO: 4427725 - DNA, 20 bp, Homo sapiens
tctcccatggagccccagcc

SEQ ID NO: 4427726 - DNA, 21 bp, Homo sapiens
tctcccatggagccccagccc

SEQ ID NO: 4427727 - DNA, 23 bp, Homo sapiens
tctcccattttggaatttgcctg

SEQ ID NO: 4427728 - DNA, 10 bp, Homo sapiens
tctccccaca

SEQ ID NO: 4427729 - DNA, 23 bp, Homo sapiens
tctccccacgcccgtctctttct

SEQ ID NO: 4427730 - DNA, 14 bp, Homo sapiens
tctccccagccccc

SEQ ID NO: 4427731 - DNA, 21 bp, Homo sapiens
tctccccagccccctcccacc

SEQ ID NO: 4427732 - DNA, 14 bp, Homo sapiens
tctccccagtgcct

SEQ ID NO: 4427733 - DNA, 19 bp, Homo sapiens
tctccccagtgcctgccac

SEQ ID NO: 4427734 - DNA, 12 bp, Homo sapiens
tctcccccaccc

SEQ ID NO: 4427735 - DNA, 20 bp, Homo sapiens
tctcccccaccccctccccg

SEQ ID NO: 4427736 - DNA, 23 bp, Homo sapiens
tctccccctcctccagggaaggt

SEQ ID NO: 4427737 - DNA, 16 bp, Homo sapiens
tctccccgctctggat

SEQ ID NO: 4427738 - DNA, 14 bp, Homo sapiens
tctcccctctcgcc

SEQ ID NO: 4427739 - DNA, 12 bp, Homo sapiens
tctcccctgccc

SEQ ID NO: 4427740 - DNA, 14 bp, Homo sapiens
tctcccctgccccc

SEQ ID NO: 4427741 - DNA, 20 bp, Homo sapiens
tctcccctgcccccaggact

SEQ ID NO: 4427742 - DNA, 23 bp, Homo sapiens
tctcccctgcccccaggactggg

SEQ ID NO: 4427743 - DNA, 13 bp, Homo sapiens
tctccccttcctg

SEQ ID NO: 4427744 - DNA, 14 bp, Homo sapiens
tctccccttcctgg

SEQ ID NO: 4427745 - DNA, 15 bp, Homo sapiens
tctccccttcctggc

SEQ ID NO: 4427746 - DNA, 19 bp, Homo sapiens
tctccctccccagaaacag

SEQ ID NO: 4427747 - DNA, 18 bp, Homo sapiens
tctccctcctctgcccgg

SEQ ID NO: 4427748 - DNA, 15 bp, Homo sapiens
tctccctctcctgcc

SEQ ID NO: 4427749 - DNA, 18 bp, Homo sapiens
tctccctctcctgcctac

SEQ ID NO: 4427750 - DNA, 21 bp, Homo sapiens
tctccctctcctgcctactca

SEQ ID NO: 4427751 - DNA, 20 bp, Homo sapiens
tctccctctggccctgcctt

SEQ ID NO: 4427752 - DNA, 12 bp, Homo sapiens
tctccctgacct

SEQ ID NO: 4427753 - DNA, 10 bp, Homo sapiens
tctccctgcc

SEQ ID NO: 4427754 - DNA, 14 bp, Homo sapiens
tctccctgccgcct

SEQ ID NO: 4427755 - DNA, 11 bp, Homo sapiens
tctccctgcct

SEQ ID NO: 4427756 - DNA, 12 bp, Homo sapiens
tctccctgcctc

SEQ ID NO: 4427757 - DNA, 16 bp, Homo sapiens
tctccctgcctcactc

SEQ ID NO: 4427758 - DNA, 12 bp, Homo sapiens
tctccctgcctg

SEQ ID NO: 4427759 - DNA, 13 bp, Homo sapiens
tctccctgcctgg

SEQ ID NO: 4427760 - DNA, 14 bp, Homo sapiens
tctccctgcctggc

SEQ ID NO: 4427761 - DNA, 17 bp, Homo sapiens
tctccctgcctggcccc

SEQ ID NO: 4427762 - DNA, 18 bp, Homo sapiens
tctccctgctgctcctag

SEQ ID NO: 4427763 - DNA, 14 bp, Homo sapiens
tctccctggctccc

SEQ ID NO: 4427764 - DNA, 19 bp, Homo sapiens
tctcccttggcccagagac

SEQ ID NO: 4427765 - DNA, 17 bp, Homo sapiens
tctccctttctctctcc

SEQ ID NO: 4427766 - DNA, 19 bp, Homo sapiens
tctccctttctctctcctc

SEQ ID NO: 4427767 - DNA, 16 bp, Homo sapiens
tctccgactctgcacc

SEQ ID NO: 4427768 - DNA, 16 bp, Homo sapiens
tctccgggactgccct

SEQ ID NO: 4427769 - DNA, 23 bp, Homo sapiens
tctccgggtgtggcctcagccct

SEQ ID NO: 4427770 - DNA, 14 bp, Homo sapiens
tctccgttccatct

SEQ ID NO: 4427771 - DNA, 12 bp, Homo sapiens
tctcctattttt

SEQ ID NO: 4427772 - DNA, 16 bp, Homo sapiens
tctcctcactctgtcc

SEQ ID NO: 4427773 - DNA, 19 bp, Homo sapiens
tctcctcactctgtccctg

SEQ ID NO: 4427774 - DNA, 16 bp, Homo sapiens
tctcctcagggtgggg

SEQ ID NO: 4427775 - DNA, 13 bp, Homo sapiens
tctcctcatctcc

SEQ ID NO: 4427776 - DNA, 20 bp, Homo sapiens
tctcctccatgggagaaaat

SEQ ID NO: 4427777 - DNA, 16 bp, Homo sapiens
tctcctccccttcctg

SEQ ID NO: 4427778 - DNA, 22 bp, Homo sapiens
tctcctccccttcctgtttctc

SEQ ID NO: 4427779 - DNA, 18 bp, Homo sapiens
tctcctcccgccccgccc

SEQ ID NO: 4427780 - DNA, 12 bp, Homo sapiens
tctcctcctccc

SEQ ID NO: 4427781 - DNA, 17 bp, Homo sapiens
tctcctcctctgtcttt

SEQ ID NO: 4427782 - DNA, 9 bp, Homo sapiens
tctcctctc

SEQ ID NO: 4427783 - DNA, 16 bp, Homo sapiens
tctcctctcagagtga

SEQ ID NO: 4427784 - DNA, 14 bp, Homo sapiens
tctcctctctgctt

SEQ ID NO: 4427785 - DNA, 18 bp, Homo sapiens
tctcctctctgcttcata

SEQ ID NO: 4427786 - DNA, 16 bp, Homo sapiens
tctcctgacccctgcc

SEQ ID NO: 4427787 - DNA, 18 bp, Homo sapiens
tctcctgccctttcccag

SEQ ID NO: 4427788 - DNA, 11 bp, Homo sapiens
tctcctgccta

SEQ ID NO: 4427789 - DNA, 16 bp, Homo sapiens
tctcctgcctcagcct

SEQ ID NO: 4427790 - DNA, 16 bp, Homo sapiens
tctcctgccttcctcc

SEQ ID NO: 4427791 - DNA, 20 bp, Homo sapiens
tctcctgccttcctcctggg

SEQ ID NO: 4427792 - DNA, 16 bp, Homo sapiens
tctcctggcctggcca

SEQ ID NO: 4427793 - DNA, 12 bp, Homo sapiens
tctcctggctgt

SEQ ID NO: 4427794 - DNA, 15 bp, Homo sapiens
tctcctgggcccctc

SEQ ID NO: 4427795 - DNA, 23 bp, Homo sapiens
tctcctgggcccctccctacctc

SEQ ID NO: 4427796 - DNA, 19 bp, Homo sapiens
tctcctgggggtggcaggc

SEQ ID NO: 4427797 - DNA, 20 bp, Homo sapiens
tctcctgggggtggcaggca

SEQ ID NO: 4427798 - DNA, 14 bp, Homo sapiens
tctcctgtccaacc

SEQ ID NO: 4427799 - DNA, 16 bp, Homo sapiens
tctcctgtccaaccta

SEQ ID NO: 4427800 - DNA, 12 bp, Homo sapiens
tctcctgtgaat

SEQ ID NO: 4427801 - DNA, 14 bp, Homo sapiens
tctcctgttttata

SEQ ID NO: 4427802 - DNA, 17 bp, Homo sapiens
tctcctgttttatatat

SEQ ID NO: 4427803 - DNA, 21 bp, Homo sapiens
tctcctgttttatatattatg

SEQ ID NO: 4427804 - DNA, 12 bp, Homo sapiens
tctccttcactc

SEQ ID NO: 4427805 - DNA, 15 bp, Homo sapiens
tctccttcagccctc

SEQ ID NO: 4427806 - DNA, 20 bp, Homo sapiens
tctccttcagccctcacccc

SEQ ID NO: 4427807 - DNA, 14 bp, Homo sapiens
tctcctttgcaata

SEQ ID NO: 4427808 - DNA, 21 bp, Homo sapiens
tctcctttgcaatagcagtta

SEQ ID NO: 4427809 - DNA, 17 bp, Homo sapiens
tctccttttcctatcct

SEQ ID NO: 4427810 - DNA, 13 bp, Homo sapiens
tctcgagcccaga

SEQ ID NO: 4427811 - DNA, 16 bp, Homo sapiens
tctcgatctcctgacc

SEQ ID NO: 4427812 - DNA, 14 bp, Homo sapiens
tctcgatgcaatga

SEQ ID NO: 4427813 - DNA, 14 bp, Homo sapiens
tctcgccccatccc

SEQ ID NO: 4427814 - DNA, 22 bp, Homo sapiens
tctcgccccttccctctctccc

SEQ ID NO: 4427815 - DNA, 23 bp, Homo sapiens
tctcgccccttccctctctccct

SEQ ID NO: 4427816 - DNA, 21 bp, Homo sapiens
tctcgctctgtcgcccaggct

SEQ ID NO: 4427817 - DNA, 13 bp, Homo sapiens
tctcggccaggca

SEQ ID NO: 4427818 - DNA, 19 bp, Homo sapiens
tctcggcccctgtctgttc

SEQ ID NO: 4427819 - DNA, 13 bp, Homo sapiens
tctcgtgtttgct

SEQ ID NO: 4427820 - DNA, 19 bp, Homo sapiens
tctcgtgtttgcttaaaat

SEQ ID NO: 4427821 - DNA, 21 bp, Homo sapiens
tctctaaaaagaagccacaga

SEQ ID NO: 4427822 - DNA, 16 bp, Homo sapiens
tctctaactcctgcca

SEQ ID NO: 4427823 - DNA, 21 bp, Homo sapiens
tctctacaggcctcttcctgt

SEQ ID NO: 4427824 - DNA, 16 bp, Homo sapiens
tctctaccttttaaaa

SEQ ID NO: 4427825 - DNA, 15 bp, Homo sapiens
tctctactaaaaata

SEQ ID NO: 4427826 - DNA, 12 bp, Homo sapiens
tctctactgctt

SEQ ID NO: 4427827 - DNA, 14 bp, Homo sapiens
tctctataaagggt

SEQ ID NO: 4427828 - DNA, 14 bp, Homo sapiens
tctctattaaaatg

SEQ ID NO: 4427829 - DNA, 18 bp, Homo sapiens
tctctattggctcccttt

SEQ ID NO: 4427830 - DNA, 23 bp, Homo sapiens
tctctatttaaattcttttttaa

SEQ ID NO: 4427831 - DNA, 13 bp, Homo sapiens
tctctcaaaacaa

SEQ ID NO: 4427832 - DNA, 14 bp, Homo sapiens
tctctcaaaacaat

SEQ ID NO: 4427833 - DNA, 14 bp, Homo sapiens
tctctcacctgctc

SEQ ID NO: 4427834 - DNA, 15 bp, Homo sapiens
tctctcataccctcc

SEQ ID NO: 4427835 - DNA, 21 bp, Homo sapiens
tctctcatgcctcctgaggct

SEQ ID NO: 4427836 - DNA, 18 bp, Homo sapiens
tctctccagctgactaaa

SEQ ID NO: 4427837 - DNA, 19 bp, Homo sapiens
tctctccagctgactaaac

SEQ ID NO: 4427838 - DNA, 12 bp, Homo sapiens
tctctcccagga

SEQ ID NO: 4427839 - DNA, 13 bp, Homo sapiens
tctctcccaggac

SEQ ID NO: 4427840 - DNA, 21 bp, Homo sapiens
tctctcccagtctacccagag

SEQ ID NO: 4427841 - DNA, 14 bp, Homo sapiens
tctctccctgcctc

SEQ ID NO: 4427842 - DNA, 13 bp, Homo sapiens
tctctcctcccca

SEQ ID NO: 4427843 - DNA, 13 bp, Homo sapiens
tctctcctctctg

SEQ ID NO: 4427844 - DNA, 13 bp, Homo sapiens
tctctcctggcct

SEQ ID NO: 4427845 - DNA, 14 bp, Homo sapiens
tctctcctgtcctc

SEQ ID NO: 4427846 - DNA, 15 bp, Homo sapiens
tctctcctgtcctcc

SEQ ID NO: 4427847 - DNA, 13 bp, Homo sapiens
tctctccttgccc

SEQ ID NO: 4427848 - DNA, 14 bp, Homo sapiens
tctctcctttcttt

SEQ ID NO: 4427849 - DNA, 21 bp, Homo sapiens
tctctctaagtttagaagcgc

SEQ ID NO: 4427850 - DNA, 14 bp, Homo sapiens
tctctctcactccc

SEQ ID NO: 4427851 - DNA, 12 bp, Homo sapiens
tctctctcctct

SEQ ID NO: 4427852 - DNA, 11 bp, Homo sapiens
tctctctcctg

SEQ ID NO: 4427853 - DNA, 15 bp, Homo sapiens
tctctctgccctctc

SEQ ID NO: 4427854 - DNA, 20 bp, Homo sapiens
tctctctgccctctccctgt

SEQ ID NO: 4427855 - DNA, 12 bp, Homo sapiens
tctctctgctcc

SEQ ID NO: 4427856 - DNA, 17 bp, Homo sapiens
tctctctgggcccaggg

SEQ ID NO: 4427857 - DNA, 18 bp, Homo sapiens
tctctctggggccctggg

SEQ ID NO: 4427858 - DNA, 18 bp, Homo sapiens
tctctcttcagactctca

SEQ ID NO: 4427859 - DNA, 20 bp, Homo sapiens
tctctcttcagactctcagc

SEQ ID NO: 4427860 - DNA, 14 bp, Homo sapiens
tctctcttctgcct

SEQ ID NO: 4427861 - DNA, 17 bp, Homo sapiens
tctctcttggacccacc

SEQ ID NO: 4427862 - DNA, 18 bp, Homo sapiens
tctctcttggacccacct

SEQ ID NO: 4427863 - DNA, 21 bp, Homo sapiens
tctctctttccatctcccttg

SEQ ID NO: 4427864 - DNA, 20 bp, Homo sapiens
tctctcttttctacacactc

SEQ ID NO: 4427865 - DNA, 16 bp, Homo sapiens
tctctgaactggtaga

SEQ ID NO: 4427866 - DNA, 21 bp, Homo sapiens
tctctgaactggtagaaaaac

SEQ ID NO: 4427867 - DNA, 22 bp, Homo sapiens
tctctgaaggtaagatcattta

SEQ ID NO: 4427868 - DNA, 15 bp, Homo sapiens
tctctgaatacacag

SEQ ID NO: 4427869 - DNA, 15 bp, Homo sapiens
tctctgaattttcag

SEQ ID NO: 4427870 - DNA, 17 bp, Homo sapiens
tctctgagaagcatcct

SEQ ID NO: 4427871 - DNA, 22 bp, Homo sapiens
tctctgcacccagtgaacacat

SEQ ID NO: 4427872 - DNA, 15 bp, Homo sapiens
tctctgcagacttcc

SEQ ID NO: 4427873 - DNA, 20 bp, Homo sapiens
tctctgcagacttcccagct

SEQ ID NO: 4427874 - DNA, 14 bp, Homo sapiens
tctctgcagatgtg

SEQ ID NO: 4427875 - DNA, 14 bp, Homo sapiens
tctctgcagtaaaa

SEQ ID NO: 4427876 - DNA, 15 bp, Homo sapiens
tctctgccattctgt

SEQ ID NO: 4427877 - DNA, 19 bp, Homo sapiens
tctctgccattctgtgcag

SEQ ID NO: 4427878 - DNA, 14 bp, Homo sapiens
tctctgcccagccg

SEQ ID NO: 4427879 - DNA, 15 bp, Homo sapiens
tctctgcccagccgg

SEQ ID NO: 4427880 - DNA, 12 bp, Homo sapiens
tctctgctccac

SEQ ID NO: 4427881 - DNA, 22 bp, Homo sapiens
tctctgctctgcgtgtcacctg

SEQ ID NO: 4427882 - DNA, 20 bp, Homo sapiens
tctctggggccctgggcctc

SEQ ID NO: 4427883 - DNA, 16 bp, Homo sapiens
tctctggggctgtgtt

SEQ ID NO: 4427884 - DNA, 23 bp, Homo sapiens
tctctgtagaaggagtagctgcc

SEQ ID NO: 4427885 - DNA, 16 bp, Homo sapiens
tctctgtccctgtaaa

SEQ ID NO: 4427886 - DNA, 15 bp, Homo sapiens
tctctgtctcatcca

SEQ ID NO: 4427887 - DNA, 16 bp, Homo sapiens
tctctgtctcatccat

SEQ ID NO: 4427888 - DNA, 22 bp, Homo sapiens
tctctgtgtgttttctttggtt

SEQ ID NO: 4427889 - DNA, 22 bp, Homo sapiens
tctcttaagacagcatgtgtta

SEQ ID NO: 4427890 - DNA, 13 bp, Homo sapiens
tctcttagaattt

SEQ ID NO: 4427891 - DNA, 16 bp, Homo sapiens
tctcttagctcccctc

SEQ ID NO: 4427892 - DNA, 18 bp, Homo sapiens
tctcttagctcccctcca

SEQ ID NO: 4427893 - DNA, 21 bp, Homo sapiens
tctcttattgttctttcatat

SEQ ID NO: 4427894 - DNA, 18 bp, Homo sapiens
tctcttcacagtcacatt

SEQ ID NO: 4427895 - DNA, 19 bp, Homo sapiens
tctcttcagactctcagcc

SEQ ID NO: 4427896 - DNA, 16 bp, Homo sapiens
tctcttcatgcttgac

SEQ ID NO: 4427897 - DNA, 13 bp, Homo sapiens
tctcttccccaga

SEQ ID NO: 4427898 - DNA, 15 bp, Homo sapiens
tctcttccccagaga

SEQ ID NO: 4427899 - DNA, 17 bp, Homo sapiens
tctcttccccagagagg

SEQ ID NO: 4427900 - DNA, 17 bp, Homo sapiens
tctcttccccttagaaa

SEQ ID NO: 4427901 - DNA, 18 bp, Homo sapiens
tctcttccccttagaaac

SEQ ID NO: 4427902 - DNA, 19 bp, Homo sapiens
tctcttcctccgaggccag

SEQ ID NO: 4427903 - DNA, 12 bp, Homo sapiens
tctcttctctcc

SEQ ID NO: 4427904 - DNA, 14 bp, Homo sapiens
tctcttctctccag

SEQ ID NO: 4427905 - DNA, 16 bp, Homo sapiens
tctcttctctccagct

SEQ ID NO: 4427906 - DNA, 22 bp, Homo sapiens
tctcttctgagctatttcatct

SEQ ID NO: 4427907 - DNA, 13 bp, Homo sapiens
tctcttctgctcc

SEQ ID NO: 4427908 - DNA, 16 bp, Homo sapiens
tctcttctgctccacc

SEQ ID NO: 4427909 - DNA, 17 bp, Homo sapiens
tctcttctgctccaccc

SEQ ID NO: 4427910 - DNA, 13 bp, Homo sapiens
tctcttctggtgt

SEQ ID NO: 4427911 - DNA, 12 bp, Homo sapiens
tctcttctttaa

SEQ ID NO: 4427912 - DNA, 13 bp, Homo sapiens
tctcttctttaaa

SEQ ID NO: 4427913 - DNA, 15 bp, Homo sapiens
tctcttctttctgaa

SEQ ID NO: 4427914 - DNA, 15 bp, Homo sapiens
tctcttgactccact

SEQ ID NO: 4427915 - DNA, 21 bp, Homo sapiens
tctcttgactccactacttta

SEQ ID NO: 4427916 - DNA, 21 bp, Homo sapiens
tctcttgagcatcaatcttgt

SEQ ID NO: 4427917 - DNA, 23 bp, Homo sapiens
tctcttgagcatcaatcttgtta

SEQ ID NO: 4427918 - DNA, 12 bp, Homo sapiens
tctcttggaaaa

SEQ ID NO: 4427919 - DNA, 18 bp, Homo sapiens
tctcttggaaaataagac

SEQ ID NO: 4427920 - DNA, 13 bp, Homo sapiens
tctcttggaccca

SEQ ID NO: 4427921 - DNA, 16 bp, Homo sapiens
tctcttgggaactgaa

SEQ ID NO: 4427922 - DNA, 23 bp, Homo sapiens
tctcttgggaactgaactcactt

SEQ ID NO: 4427923 - DNA, 17 bp, Homo sapiens
tctcttgtaccatagaa

SEQ ID NO: 4427924 - DNA, 19 bp, Homo sapiens
tctctttaattttaactga

SEQ ID NO: 4427925 - DNA, 12 bp, Homo sapiens
tctctttccctt

SEQ ID NO: 4427926 - DNA, 10 bp, Homo sapiens
tctctttctc

SEQ ID NO: 4427927 - DNA, 12 bp, Homo sapiens
tctctttctgtc

SEQ ID NO: 4427928 - DNA, 22 bp, Homo sapiens
tctcttttaaagtatttataaa

SEQ ID NO: 4427929 - DNA, 14 bp, Homo sapiens
tctcttttctagtt

SEQ ID NO: 4427930 - DNA, 13 bp, Homo sapiens
tctcttttctttc

SEQ ID NO: 4427931 - DNA, 19 bp, Homo sapiens
tctcttttctttctgtctt

SEQ ID NO: 4427932 - DNA, 18 bp, Homo sapiens
tctgaaaatagcaaccca

SEQ ID NO: 4427933 - DNA, 15 bp, Homo sapiens
tctgaaaccagtgtt

SEQ ID NO: 4427934 - DNA, 20 bp, Homo sapiens
tctgaaaccagtgttaggga

SEQ ID NO: 4427935 - DNA, 11 bp, Homo sapiens
tctgaaactgg

SEQ ID NO: 4427936 - DNA, 15 bp, Homo sapiens
tctgaaactggcttc

SEQ ID NO: 4427937 - DNA, 16 bp, Homo sapiens
tctgaaaggagacatt

SEQ ID NO: 4427938 - DNA, 16 bp, Homo sapiens
tctgaaatatcccggg

SEQ ID NO: 4427939 - DNA, 13 bp, Homo sapiens
tctgaaatgaaga

SEQ ID NO: 4427940 - DNA, 20 bp, Homo sapiens
tctgaacaatttagggactc

SEQ ID NO: 4427941 - DNA, 19 bp, Homo sapiens
tctgaacacaaccagaggt

SEQ ID NO: 4427942 - DNA, 16 bp, Homo sapiens
tctgaactcaaactga

SEQ ID NO: 4427943 - DNA, 21 bp, Homo sapiens
tctgaactcaaactgaggaat

SEQ ID NO: 4427944 - DNA, 14 bp, Homo sapiens
tctgaactccattt

SEQ ID NO: 4427945 - DNA, 22 bp, Homo sapiens
tctgaactgaccttgaatcttt

SEQ ID NO: 4427946 - DNA, 18 bp, Homo sapiens
tctgaactggtagaaaaa

SEQ ID NO: 4427947 - DNA, 13 bp, Homo sapiens
tctgaactgttac

SEQ ID NO: 4427948 - DNA, 14 bp, Homo sapiens
tctgaactgttaca

SEQ ID NO: 4427949 - DNA, 15 bp, Homo sapiens
tctgaactgttacaa

SEQ ID NO: 4427950 - DNA, 19 bp, Homo sapiens
tctgaagaaggaaggcctg

SEQ ID NO: 4427951 - DNA, 15 bp, Homo sapiens
tctgaagaagttaat

SEQ ID NO: 4427952 - DNA, 19 bp, Homo sapiens
tctgaagaagttaattctt

SEQ ID NO: 4427953 - DNA, 18 bp, Homo sapiens
tcctttcctcagacctgg

SEQ ID NO: 4427954 - DNA, 14 bp, Homo sapiens
tcctttcctcctct

SEQ ID NO: 4427955 - DNA, 15 bp, Homo sapiens
tcctttctcagaggg

SEQ ID NO: 4427956 - DNA, 16 bp, Homo sapiens
tcctttctcctgtgaa

SEQ ID NO: 4427957 - DNA, 17 bp, Homo sapiens
tcctttctcctgtgaat

SEQ ID NO: 4427958 - DNA, 17 bp, Homo sapiens
tcctttggtcctggtgc

SEQ ID NO: 4427959 - DNA, 13 bp, Homo sapiens
tccttttatataa

SEQ ID NO: 4427960 - DNA, 22 bp, Homo sapiens
tccttttatctggtgcctcctc

SEQ ID NO: 4427961 - DNA, 12 bp, Homo sapiens
tccttttatgtg

SEQ ID NO: 4427962 - DNA, 11 bp, Homo sapiens
tccttttccta

SEQ ID NO: 4427963 - DNA, 14 bp, Homo sapiens
tccttttctaggaa

SEQ ID NO: 4427964 - DNA, 19 bp, Homo sapiens
tccttttcttcaccctccc

SEQ ID NO: 4427965 - DNA, 13 bp, Homo sapiens
tccttttgacact

SEQ ID NO: 4427966 - DNA, 16 bp, Homo sapiens
tccttttgacactgct

SEQ ID NO: 4427967 - DNA, 18 bp, Homo sapiens
tccttttgacactgctct

SEQ ID NO: 4427968 - DNA, 22 bp, Homo sapiens
tccttttgacactgctctaaca

SEQ ID NO: 4427969 - DNA, 16 bp, Homo sapiens
tccttttggcctgggg

SEQ ID NO: 4427970 - DNA, 15 bp, Homo sapiens
tccttttgggaagaa

SEQ ID NO: 4427971 - DNA, 19 bp, Homo sapiens
tcctttttattccttttaa

SEQ ID NO: 4427972 - DNA, 17 bp, Homo sapiens
tccttttttaaaataaa

SEQ ID NO: 4427973 - DNA, 19 bp, Homo sapiens
tccttttttaaaataaaat

SEQ ID NO: 4427974 - DNA, 12 bp, Homo sapiens
tccttttttccc

SEQ ID NO: 4427975 - DNA, 17 bp, Homo sapiens
tccttttttgagatttt

SEQ ID NO: 4427976 - DNA, 18 bp, Homo sapiens
tccttttttgagattttt

SEQ ID NO: 4427977 - DNA, 21 bp, Homo sapiens
tcctttttttccatctttaca

SEQ ID NO: 4427978 - DNA, 17 bp, Homo sapiens
tcgaaaaaataattatt

SEQ ID NO: 4427979 - DNA, 21 bp, Homo sapiens
tcgaaaagagtcttccaatta

SEQ ID NO: 4427980 - DNA, 22 bp, Homo sapiens
tcgaaatagatatcctctcccc

SEQ ID NO: 4427981 - DNA, 15 bp, Homo sapiens
tcgaagatatacaaa

SEQ ID NO: 4427982 - DNA, 19 bp, Homo sapiens
tcgaagtgtttatgtaata

SEQ ID NO: 4427983 - DNA, 17 bp, Homo sapiens
tcgaatctctgcccctc

SEQ ID NO: 4427984 - DNA, 17 bp, Homo sapiens
tcgaatcttaatttatt

SEQ ID NO: 4427985 - DNA, 21 bp, Homo sapiens
tcgaatcttaatttattattt

SEQ ID NO: 4427986 - DNA, 15 bp, Homo sapiens
tcgaatgaaaagaca

SEQ ID NO: 4427987 - DNA, 20 bp, Homo sapiens
tcgacaaaggccacaggcag

SEQ ID NO: 4427988 - DNA, 24 bp, Homo sapiens
tcgacaaaggccacaggcagtcca

SEQ ID NO: 4427989 - DNA, 18 bp, Homo sapiens
tcgacagggcctggagcc

SEQ ID NO: 4427990 - DNA, 21 bp, Homo sapiens
tcgaccacagcaagccatcat

SEQ ID NO: 4427991 - DNA, 22 bp, Homo sapiens
tcgaccacagcaagccatcatc

SEQ ID NO: 4427992 - DNA, 16 bp, Homo sapiens
tcgacctccccacccg

SEQ ID NO: 4427993 - DNA, 16 bp, Homo sapiens
tcgactggtttttcta

SEQ ID NO: 4427994 - DNA, 20 bp, Homo sapiens
tcgagaaagaggcaccagga

SEQ ID NO: 4427995 - DNA, 18 bp, Homo sapiens
tcgagatcccaacactgc

SEQ ID NO: 4427996 - DNA, 23 bp, Homo sapiens
tcgagatcccaacactgccagca

SEQ ID NO: 4427997 - DNA, 23 bp, Homo sapiens
tcgagatgttcgctcgtgcagta

SEQ ID NO: 4427998 - DNA, 16 bp, Homo sapiens
tcgagattgcactgct

SEQ ID NO: 4427999 - DNA, 17 bp, Homo sapiens
tcgagcagcattttatt

SEQ ID NO: 4428000 - DNA, 20 bp, Homo sapiens
tcgagcagggtgctgtgggt

SEQ ID NO: 4428001 - DNA, 23 bp, Homo sapiens
tcgaggggtcctcacctggttga

SEQ ID NO: 4428002 - DNA, 12 bp, Homo sapiens
tcgagtactgtg

SEQ ID NO: 4428003 - DNA, 13 bp, Homo sapiens
tcgagtactgtgg

SEQ ID NO: 4428004 - DNA, 16 bp, Homo sapiens
tcgagtactgtgggca

SEQ ID NO: 4428005 - DNA, 20 bp, Homo sapiens
tcgagtactgtgggcaattt

SEQ ID NO: 4428006 - DNA, 19 bp, Homo sapiens
tcgatcctggattcactca

SEQ ID NO: 4428007 - DNA, 15 bp, Homo sapiens
tcgatggacctcagc

SEQ ID NO: 4428008 - DNA, 20 bp, Homo sapiens
tcgatggacctcagcaagct

SEQ ID NO: 4428009 - DNA, 23 bp, Homo sapiens
tcgcaatagttttttacttctct

SEQ ID NO: 4428010 - DNA, 23 bp, Homo sapiens
tcgcacacacccatgtaaccact

SEQ ID NO: 4428011 - DNA, 13 bp, Homo sapiens
tcgcaccactgca

SEQ ID NO: 4428012 - DNA, 20 bp, Homo sapiens
tcgcaccactgcactccagc

SEQ ID NO: 4428013 - DNA, 22 bp, Homo sapiens
tcgcaccactgcactccagcct

SEQ ID NO: 4428014 - DNA, 21 bp, Homo sapiens
tcgcagactcctccacgtggc

SEQ ID NO: 4428015 - DNA, 20 bp, Homo sapiens
tcgcagggaatgcagcagga

SEQ ID NO: 4428016 - DNA, 18 bp, Homo sapiens
tcgcagtctcttagaatt

SEQ ID NO: 4428017 - DNA, 23 bp, Homo sapiens
tcgcagtctcttagaatttgttt

SEQ ID NO: 4428018 - DNA, 16 bp, Homo sapiens
tcgcatccagacagtc

SEQ ID NO: 4428019 - DNA, 15 bp, Homo sapiens
tcgcatttgtcaatg

SEQ ID NO: 4428020 - DNA, 21 bp, Homo sapiens
tcgccaggactggtgaatata

SEQ ID NO: 4428021 - DNA, 12 bp, Homo sapiens
tcgcccagcagg

SEQ ID NO: 4428022 - DNA, 19 bp, Homo sapiens
tcgcccaggctggactgca

SEQ ID NO: 4428023 - DNA, 21 bp, Homo sapiens
tcgcccctccttttggcctgg

SEQ ID NO: 4428024 - DNA, 22 bp, Homo sapiens
tcgcccgagctgtttatgtttt

SEQ ID NO: 4428025 - DNA, 17 bp, Homo sapiens
tcgccggatctgaggga

SEQ ID NO: 4428026 - DNA, 18 bp, Homo sapiens
tcgcctccccaccctcct

SEQ ID NO: 4428027 - DNA, 15 bp, Homo sapiens
tcgcctgcctgcagc

SEQ ID NO: 4428028 - DNA, 19 bp, Homo sapiens
tcgcctgcctgcagcaggc

SEQ ID NO: 4428029 - DNA, 12 bp, Homo sapiens
tcgccttaaact

SEQ ID NO: 4428030 - DNA, 19 bp, Homo sapiens
tcgccttcttagagtttta

SEQ ID NO: 4428031 - DNA, 23 bp, Homo sapiens
tcgcctttcccaggtgctacacc

SEQ ID NO: 4428032 - DNA, 20 bp, Homo sapiens
tcgcgccccccgcgcccctc

SEQ ID NO: 4428033 - DNA, 16 bp, Homo sapiens
tcgcggtcttgggcac

SEQ ID NO: 4428034 - DNA, 17 bp, Homo sapiens
tcgctaatcagtcattt

SEQ ID NO: 4428035 - DNA, 12 bp, Homo sapiens
tcgctagaaaaa

SEQ ID NO: 4428036 - DNA, 20 bp, Homo sapiens
tcgctatgtgacttgcgctt

SEQ ID NO: 4428037 - DNA, 16 bp, Homo sapiens
tcgctcagtctgttca

SEQ ID NO: 4428038 - DNA, 21 bp, Homo sapiens
tcgctccctgtagctctgcct

SEQ ID NO: 4428039 - DNA, 19 bp, Homo sapiens
tcgctctgtcgcccaggct

SEQ ID NO: 4428040 - DNA, 16 bp, Homo sapiens
tcgctgcacatggcct

SEQ ID NO: 4428041 - DNA, 19 bp, Homo sapiens
tcgctgcacatggcctgag

SEQ ID NO: 4428042 - DNA, 16 bp, Homo sapiens
tcgctgccctgtggac

SEQ ID NO: 4428043 - DNA, 23 bp, Homo sapiens
tcgctggactctcagtctctgag

SEQ ID NO: 4428044 - DNA, 19 bp, Homo sapiens
tcgcttccctgaaagactg

SEQ ID NO: 4428045 - DNA, 22 bp, Homo sapiens
tcgcttgctggaacacaggggc

SEQ ID NO: 4428046 - DNA, 15 bp, Homo sapiens
tcgcttgcttctgca

SEQ ID NO: 4428047 - DNA, 15 bp, Homo sapiens
tcggaaatcttaaac

SEQ ID NO: 4428048 - DNA, 18 bp, Homo sapiens
tcggaattcataataaat

SEQ ID NO: 4428049 - DNA, 13 bp, Homo sapiens
tcggacagagccc

SEQ ID NO: 4428050 - DNA, 17 bp, Homo sapiens
tcggaccactaggcctg

SEQ ID NO: 4428051 - DNA, 19 bp, Homo sapiens
tcggacccaccccaactct

SEQ ID NO: 4428052 - DNA, 23 bp, Homo sapiens
tcggactaagcctacctgctctc

SEQ ID NO: 4428053 - DNA, 15 bp, Homo sapiens
tcggactctgcccct

SEQ ID NO: 4428054 - DNA, 12 bp, Homo sapiens
tcggactgccaa

SEQ ID NO: 4428055 - DNA, 13 bp, Homo sapiens
tcggactgccaaa

SEQ ID NO: 4428056 - DNA, 19 bp, Homo sapiens
tcggactgcccccagaaag

SEQ ID NO: 4428057 - DNA, 12 bp, Homo sapiens
tcggagaagagc

SEQ ID NO: 4428058 - DNA, 14 bp, Homo sapiens
tcggagaagagctg

SEQ ID NO: 4428059 - DNA, 21 bp, Homo sapiens
tcggaggctacccgctgtggc

SEQ ID NO: 4428060 - DNA, 14 bp, Homo sapiens
tcggaggctgcccc

SEQ ID NO: 4428061 - DNA, 13 bp, Homo sapiens
tcggaggctgggc

SEQ ID NO: 4428062 - DNA, 15 bp, Homo sapiens
tcggaggctgggccc

SEQ ID NO: 4428063 - DNA, 21 bp, Homo sapiens
tcggaggctgggcccctggga

SEQ ID NO: 4428064 - DNA, 19 bp, Homo sapiens
tcggagggaaattgtaaat

SEQ ID NO: 4428065 - DNA, 15 bp, Homo sapiens
tcggagtgaatgtgg

SEQ ID NO: 4428066 - DNA, 16 bp, Homo sapiens
tcggagtgaatgtggc

SEQ ID NO: 4428067 - DNA, 23 bp, Homo sapiens
tcggatggaccaacctgctctgt

SEQ ID NO: 4428068 - DNA, 13 bp, Homo sapiens
tcggattttttcc

SEQ ID NO: 4428069 - DNA, 21 bp, Homo sapiens
tcggcatagtccccagagctc

SEQ ID NO: 4428070 - DNA, 16 bp, Homo sapiens
tcggcccacagctccc

SEQ ID NO: 4428071 - DNA, 19 bp, Homo sapiens
tcggccccaccagtgcctc

SEQ ID NO: 4428072 - DNA, 19 bp, Homo sapiens
tcggcctccgaggctcccc

SEQ ID NO: 4428073 - DNA, 16 bp, Homo sapiens
tcggctcactgcaacc

SEQ ID NO: 4428074 - DNA, 17 bp, Homo sapiens
tcgggagcacccagagc

SEQ ID NO: 4428075 - DNA, 13 bp, Homo sapiens
tcgggcagccagc

SEQ ID NO: 4428076 - DNA, 11 bp, Homo sapiens
tcgggcccagc

SEQ ID NO: 4428077 - DNA, 14 bp, Homo sapiens
tcgggcccagcccc

SEQ ID NO: 4428078 - DNA, 15 bp, Homo sapiens
tcgggcccagccccc

SEQ ID NO: 4428079 - DNA, 22 bp, Homo sapiens
tcgggccccatcctcatccctg

SEQ ID NO: 4428080 - DNA, 13 bp, Homo sapiens
tcgggcccttccc

SEQ ID NO: 4428081 - DNA, 20 bp, Homo sapiens
tcggggagccgggagcctga

SEQ ID NO: 4428082 - DNA, 14 bp, Homo sapiens
tcggggtggcccac

SEQ ID NO: 4428083 - DNA, 15 bp, Homo sapiens
tcgggtccagagacc

SEQ ID NO: 4428084 - DNA, 18 bp, Homo sapiens
tcggtgctccatctccgc

SEQ ID NO: 4428085 - DNA, 13 bp, Homo sapiens
tcggtgtgaactt

SEQ ID NO: 4428086 - DNA, 13 bp, Homo sapiens
tcggttccagaca

SEQ ID NO: 4428087 - DNA, 19 bp, Homo sapiens
tcgtaatgggtatattgat

SEQ ID NO: 4428088 - DNA, 23 bp, Homo sapiens
tcgtaatgggtatattgataaat

SEQ ID NO: 4428089 - DNA, 23 bp, Homo sapiens
tcgtcctccccctgccagtgcct

SEQ ID NO: 4428090 - DNA, 23 bp, Homo sapiens
tcgtctaatgggggcagtctccc

SEQ ID NO: 4428091 - DNA, 20 bp, Homo sapiens
tcgtgagctggggactcagg

SEQ ID NO: 4428092 - DNA, 14 bp, Homo sapiens
tcgtgagtcattta

SEQ ID NO: 4428093 - DNA, 22 bp, Homo sapiens
tcgtgatgggcccgcctcggcc

SEQ ID NO: 4428094 - DNA, 15 bp, Homo sapiens
tcgtgatgtggagga

SEQ ID NO: 4428095 - DNA, 18 bp, Homo sapiens
tcgtgccatgatctgtat

SEQ ID NO: 4428096 - DNA, 16 bp, Homo sapiens
tcgtgcctgagaccag

SEQ ID NO: 4428097 - DNA, 18 bp, Homo sapiens
tcgtgcctgagaccaggg

SEQ ID NO: 4428098 - DNA, 22 bp, Homo sapiens
tcgtgcctgagaccagggtggc

SEQ ID NO: 4428099 - DNA, 23 bp, Homo sapiens
tcgtgcctgagaccagggtggcc

SEQ ID NO: 4428100 - DNA, 17 bp, Homo sapiens
tcgtggacacacacaga

SEQ ID NO: 4428101 - DNA, 22 bp, Homo sapiens
tcgtggactgagtgggaagccc

SEQ ID NO: 4428102 - DNA, 14 bp, Homo sapiens
tcgtgtattccata

SEQ ID NO: 4428103 - DNA, 15 bp, Homo sapiens
tcgttagaccgctct

SEQ ID NO: 4428104 - DNA, 18 bp, Homo sapiens
tcgttagtaatctgtata

SEQ ID NO: 4428105 - DNA, 12 bp, Homo sapiens
tcgttctgctgg

SEQ ID NO: 4428106 - DNA, 13 bp, Homo sapiens
tcgttctgctggc

SEQ ID NO: 4428107 - DNA, 18 bp, Homo sapiens
tcgttctttttaagttaa

SEQ ID NO: 4428108 - DNA, 12 bp, Homo sapiens
tcgttgtgaggg

SEQ ID NO: 4428109 - DNA, 16 bp, Homo sapiens
tcgtttagaatcagaa

SEQ ID NO: 4428110 - DNA, 19 bp, Homo sapiens
tcgtttagaatcagaataa

SEQ ID NO: 4428111 - DNA, 19 bp, Homo sapiens
tcgtttattttcaagaata

SEQ ID NO: 4428112 - DNA, 16 bp, Homo sapiens
tcgtttccatcatgtc

SEQ ID NO: 4428113 - DNA, 13 bp, Homo sapiens
tcgtttgtttgtt

SEQ ID NO: 4428114 - DNA, 13 bp, Homo sapiens
tcgttttccaaac

SEQ ID NO: 4428115 - DNA, 15 bp, Homo sapiens
tcgttttccaaagag

SEQ ID NO: 4428116 - DNA, 14 bp, Homo sapiens
tctaaaacattccc

SEQ ID NO: 4428117 - DNA, 17 bp, Homo sapiens
tctaaaaccttagtcat

SEQ ID NO: 4428118 - DNA, 14 bp, Homo sapiens
tctaaaagctctgt

SEQ ID NO: 4428119 - DNA, 12 bp, Homo sapiens
tctaaaatagca

SEQ ID NO: 4428120 - DNA, 17 bp, Homo sapiens
tctaaaatagcaataac

SEQ ID NO: 4428121 - DNA, 19 bp, Homo sapiens
tctaaaatgttttatgaca

SEQ ID NO: 4428122 - DNA, 22 bp, Homo sapiens
tctaaaatgttttatgacattt

SEQ ID NO: 4428123 - DNA, 23 bp, Homo sapiens
tctaaaattgagttcttcctgta

SEQ ID NO: 4428124 - DNA, 23 bp, Homo sapiens
tctaaacacaacaataactttta

SEQ ID NO: 4428125 - DNA, 23 bp, Homo sapiens
tctaaaccaagattatgtgactt

SEQ ID NO: 4428126 - DNA, 22 bp, Homo sapiens
tctaaaccatctatgtgaatat

SEQ ID NO: 4428127 - DNA, 22 bp, Homo sapiens
tctaaagcactggtttcaagaa

SEQ ID NO: 4428128 - DNA, 13 bp, Homo sapiens
tctaaagctttat

SEQ ID NO: 4428129 - DNA, 18 bp, Homo sapiens
tctaaaggtggtgaggca

SEQ ID NO: 4428130 - DNA, 22 bp, Homo sapiens
tctaaagtaaaattgaagcaac

SEQ ID NO: 4428131 - DNA, 23 bp, Homo sapiens
tctaaataaatttcccagttaaa

SEQ ID NO: 4428132 - DNA, 12 bp, Homo sapiens
tctaaatgcaat

SEQ ID NO: 4428133 - DNA, 15 bp, Homo sapiens
tctaaatgcaataag

SEQ ID NO: 4428134 - DNA, 15 bp, Homo sapiens
tctaacaataatatt

SEQ ID NO: 4428135 - DNA, 20 bp, Homo sapiens
tctaacaataatatttcaag

SEQ ID NO: 4428136 - DNA, 22 bp, Homo sapiens
tctaacaataatatttcaagtg

SEQ ID NO: 4428137 - DNA, 11 bp, Homo sapiens
tctaacagcac

SEQ ID NO: 4428138 - DNA, 20 bp, Homo sapiens
tctaacagccctcctctgca

SEQ ID NO: 4428139 - DNA, 21 bp, Homo sapiens
tctaaccctcccatggcacct

SEQ ID NO: 4428140 - DNA, 13 bp, Homo sapiens
tctaacctggagg

SEQ ID NO: 4428141 - DNA, 22 bp, Homo sapiens
tctaactgatgagtaaactgag

SEQ ID NO: 4428142 - DNA, 12 bp, Homo sapiens
tctaactgtata

SEQ ID NO: 4428143 - DNA, 21 bp, Homo sapiens
tctaagaaatatctgtgaaat

SEQ ID NO: 4428144 - DNA, 17 bp, Homo sapiens
tctaagaataataaaat

SEQ ID NO: 4428145 - DNA, 19 bp, Homo sapiens
tctaagaataataaaatca

SEQ ID NO: 4428146 - DNA, 12 bp, Homo sapiens
tctaagactctg

SEQ ID NO: 4428147 - DNA, 21 bp, Homo sapiens
tctaagactctgtgtggctgt

SEQ ID NO: 4428148 - DNA, 22 bp, Homo sapiens
tctaagatacactgcactttgt

SEQ ID NO: 4428149 - DNA, 14 bp, Homo sapiens
tctaagcagttatg

SEQ ID NO: 4428150 - DNA, 19 bp, Homo sapiens
tctaagtaaaaccacagca

SEQ ID NO: 4428151 - DNA, 14 bp, Homo sapiens
tctaagtctttcca

SEQ ID NO: 4428152 - DNA, 19 bp, Homo sapiens
tctaagttattttgtacat

SEQ ID NO: 4428153 - DNA, 16 bp, Homo sapiens
tctaataaagtagtta

SEQ ID NO: 4428154 - DNA, 14 bp, Homo sapiens
tctaatatggccac

SEQ ID NO: 4428155 - DNA, 22 bp, Homo sapiens
tctaatattagttggctttcat

SEQ ID NO: 4428156 - DNA, 14 bp, Homo sapiens
tctaatattgcttc

SEQ ID NO: 4428157 - DNA, 15 bp, Homo sapiens
tctaatattgcttct

SEQ ID NO: 4428158 - DNA, 15 bp, Homo sapiens
tctaatccttttcct

SEQ ID NO: 4428159 - DNA, 21 bp, Homo sapiens
tctaatgacatgcctatatga

SEQ ID NO: 4428160 - DNA, 22 bp, Homo sapiens
tctaatgaggagagaaaatata

SEQ ID NO: 4428161 - DNA, 22 bp, Homo sapiens
tctaatgggggcagtctcccct

SEQ ID NO: 4428162 - DNA, 14 bp, Homo sapiens
tctaattaaaattg

SEQ ID NO: 4428163 - DNA, 13 bp, Homo sapiens
tctaattaagaaa

SEQ ID NO: 4428164 - DNA, 12 bp, Homo sapiens
tctaattaatag

SEQ ID NO: 4428165 - DNA, 14 bp, Homo sapiens
tctaatttataaaa

SEQ ID NO: 4428166 - DNA, 15 bp, Homo sapiens
tctacaaaaatttat

SEQ ID NO: 4428167 - DNA, 14 bp, Homo sapiens
tctacacattgcta

SEQ ID NO: 4428168 - DNA, 17 bp, Homo sapiens
tctacacattgctacct

SEQ ID NO: 4428169 - DNA, 23 bp, Homo sapiens
tctacacgcatgatggagctgat

SEQ ID NO: 4428170 - DNA, 14 bp, Homo sapiens
tctacactctcctg

SEQ ID NO: 4428171 - DNA, 18 bp, Homo sapiens
tctacactctcctgggcc

SEQ ID NO: 4428172 - DNA, 19 bp, Homo sapiens
tctacactcttgtaataaa

SEQ ID NO: 4428173 - DNA, 12 bp, Homo sapiens
tctacagaaaaa

SEQ ID NO: 4428174 - DNA, 17 bp, Homo sapiens
tctacagagcttccctg

SEQ ID NO: 4428175 - DNA, 20 bp, Homo sapiens
tctacaggcctcttcctgtt

SEQ ID NO: 4428176 - DNA, 21 bp, Homo sapiens
tctacagtggttttatactga

SEQ ID NO: 4428177 - DNA, 13 bp, Homo sapiens
tctacagtgtcct

SEQ ID NO: 4428178 - DNA, 16 bp, Homo sapiens
tctacatatgatctgt

SEQ ID NO: 4428179 - DNA, 21 bp, Homo sapiens
tctacatatgatctgtctgtg

SEQ ID NO: 4428180 - DNA, 22 bp, Homo sapiens
tctacatgccatgcctatgggc

SEQ ID NO: 4428181 - DNA, 11 bp, Homo sapiens
tctacatgtga

SEQ ID NO: 4428182 - DNA, 14 bp, Homo sapiens
tctacatgtgagat

SEQ ID NO: 4428183 - DNA, 22 bp, Homo sapiens
tctacatgtgagatagttttca

SEQ ID NO: 4428184 - DNA, 23 bp, Homo sapiens
tctacatgtgagatagttttcat

SEQ ID NO: 4428185 - DNA, 11 bp, Homo sapiens
tctacatttca

SEQ ID NO: 4428186 - DNA, 16 bp, Homo sapiens
tctacatttcacatta

SEQ ID NO: 4428187 - DNA, 16 bp, Homo sapiens
tctacatttctgcaga

SEQ ID NO: 4428188 - DNA, 19 bp, Homo sapiens
tctaccaaaaaaaggaagg

SEQ ID NO: 4428189 - DNA, 21 bp, Homo sapiens
tctaccccagactagatgtag

SEQ ID NO: 4428190 - DNA, 23 bp, Homo sapiens
tctaccccagactagatgtagta

SEQ ID NO: 4428191 - DNA, 16 bp, Homo sapiens
tctaccctcccacccc

SEQ ID NO: 4428192 - DNA, 21 bp, Homo sapiens
tctaccctctggttgggagat

SEQ ID NO: 4428193 - DNA, 12 bp, Homo sapiens
tctacctgccct

SEQ ID NO: 4428194 - DNA, 15 bp, Homo sapiens
tctacctggtctggt

SEQ ID NO: 4428195 - DNA, 15 bp, Homo sapiens
tctacctgtgttttt

SEQ ID NO: 4428196 - DNA, 19 bp, Homo sapiens
tctaccttttaaaattgaa

SEQ ID NO: 4428197 - DNA, 15 bp, Homo sapiens
tctactaaaaataca

SEQ ID NO: 4428198 - DNA, 17 bp, Homo sapiens
tctactaaaaatacaaa

SEQ ID NO: 4428199 - DNA, 18 bp, Homo sapiens
tctactaaaaataccaaa

SEQ ID NO: 4428200 - DNA, 18 bp, Homo sapiens
tctactaattccacacct

SEQ ID NO: 4428201 - DNA, 15 bp, Homo sapiens
tctactatgatcaga

SEQ ID NO: 4428202 - DNA, 17 bp, Homo sapiens
tctactcctagaagaac

SEQ ID NO: 4428203 - DNA, 15 bp, Homo sapiens
tctactcctgcctca

SEQ ID NO: 4428204 - DNA, 17 bp, Homo sapiens
tctactctagatggcaa

SEQ ID NO: 4428205 - DNA, 16 bp, Homo sapiens
tctactgaattggctt

SEQ ID NO: 4428206 - DNA, 21 bp, Homo sapiens
tctactgaattggcttccaga

SEQ ID NO: 4428207 - DNA, 16 bp, Homo sapiens
tctactgagcgagctg

SEQ ID NO: 4428208 - DNA, 19 bp, Homo sapiens
tctactgagcgagctgggc

SEQ ID NO: 4428209 - DNA, 21 bp, Homo sapiens
tctactggaaatgtagcactt

SEQ ID NO: 4428210 - DNA, 22 bp, Homo sapiens
tctactggaaatgtagcactta

SEQ ID NO: 4428211 - DNA, 14 bp, Homo sapiens
tctactgtatcaat

SEQ ID NO: 4428212 - DNA, 14 bp, Homo sapiens
tctactgttattat

SEQ ID NO: 4428213 - DNA, 19 bp, Homo sapiens
tctacttggcaaggtcata

SEQ ID NO: 4428214 - DNA, 18 bp, Homo sapiens
tctacttgtaaaatgctt

SEQ ID NO: 4428215 - DNA, 19 bp, Homo sapiens
tctacttgtaaaatgcttt

SEQ ID NO: 4428216 - DNA, 22 bp, Homo sapiens
tctacttgtcatatcactaaat

SEQ ID NO: 4428217 - DNA, 17 bp, Homo sapiens
tctactttcatcttaaa

SEQ ID NO: 4428218 - DNA, 12 bp, Homo sapiens
tctactttgaag

SEQ ID NO: 4428219 - DNA, 20 bp, Homo sapiens
tctactttgaagtcatacca

SEQ ID NO: 4428220 - DNA, 18 bp, Homo sapiens
tctactttttttttaatt

SEQ ID NO: 4428221 - DNA, 14 bp, Homo sapiens
tctagaaaaaaggg

SEQ ID NO: 4428222 - DNA, 12 bp, Homo sapiens
tctagaaaacca

SEQ ID NO: 4428223 - DNA, 19 bp, Homo sapiens
tctagaaagagaaacagtt

SEQ ID NO: 4428224 - DNA, 17 bp, Homo sapiens
tctagaagatgtgtaaa

SEQ ID NO: 4428225 - DNA, 19 bp, Homo sapiens
tctagaagatgtgtaaaca

SEQ ID NO: 4428226 - DNA, 17 bp, Homo sapiens
tctagaagccaagggaa

SEQ ID NO: 4428227 - DNA, 23 bp, Homo sapiens
tctagaagccaagggaaaggggt

SEQ ID NO: 4428228 - DNA, 17 bp, Homo sapiens
tctagaatgtctgaagt

SEQ ID NO: 4428229 - DNA, 20 bp, Homo sapiens
tctagacacaatttcatttc

SEQ ID NO: 4428230 - DNA, 23 bp, Homo sapiens
tctagacatcattgtcagccttg

SEQ ID NO: 4428231 - DNA, 16 bp, Homo sapiens
tctagacgcccctccc

SEQ ID NO: 4428232 - DNA, 18 bp, Homo sapiens
tctagacgcccctcccaa

SEQ ID NO: 4428233 - DNA, 13 bp, Homo sapiens
tctagagacacat

SEQ ID NO: 4428234 - DNA, 13 bp, Homo sapiens
tctagagccttca

SEQ ID NO: 4428235 - DNA, 23 bp, Homo sapiens
tctagaggtcaggacggctcctc

SEQ ID NO: 4428236 - DNA, 15 bp, Homo sapiens
tctagatacaataaa

SEQ ID NO: 4428237 - DNA, 22 bp, Homo sapiens
tctagatcctgcaccccagcat

SEQ ID NO: 4428238 - DNA, 19 bp, Homo sapiens
tctagatgaagttttacat

SEQ ID NO: 4428239 - DNA, 23 bp, Homo sapiens
tctagatgaagttttacattgtt

SEQ ID NO: 4428240 - DNA, 19 bp, Homo sapiens
tctagatggcaacattgga

SEQ ID NO: 4428241 - DNA, 23 bp, Homo sapiens
tctagatggcaacattggacaga

SEQ ID NO: 4428242 - DNA, 16 bp, Homo sapiens
tctagattaatactct

SEQ ID NO: 4428243 - DNA, 22 bp, Homo sapiens
tctagcccaaaggtaagttgct

SEQ ID NO: 4428244 - DNA, 14 bp, Homo sapiens
tctaggagctcctt

SEQ ID NO: 4428245 - DNA, 16 bp, Homo sapiens
tctaggagctgggagg

SEQ ID NO: 4428246 - DNA, 20 bp, Homo sapiens
tctaggagctgggaggaaaa

SEQ ID NO: 4428247 - DNA, 21 bp, Homo sapiens
tctaggagctgggaggaaaag

SEQ ID NO: 4428248 - DNA, 14 bp, Homo sapiens
tctaggatagctaa

SEQ ID NO: 4428249 - DNA, 23 bp, Homo sapiens
tctaggatagctaactgtaaatc

SEQ ID NO: 4428250 - DNA, 19 bp, Homo sapiens
tctaggatgaacaatgtat

SEQ ID NO: 4428251 - DNA, 18 bp, Homo sapiens
tctaggatgggaacaagg

SEQ ID NO: 4428252 - DNA, 16 bp, Homo sapiens
tctaggattgggcctc

SEQ ID NO: 4428253 - DNA, 14 bp, Homo sapiens
tctaggcatttcat

SEQ ID NO: 4428254 - DNA, 17 bp, Homo sapiens
tctaggctgttctgtag

SEQ ID NO: 4428255 - DNA, 22 bp, Homo sapiens
tctaggcttcaggttgcattgg

SEQ ID NO: 4428256 - DNA, 21 bp, Homo sapiens
tctagggactgccaggctgtt

SEQ ID NO: 4428257 - DNA, 17 bp, Homo sapiens
tctagggagagaccctt

SEQ ID NO: 4428258 - DNA, 17 bp, Homo sapiens
tctaggtctcctcaggg

SEQ ID NO: 4428259 - DNA, 18 bp, Homo sapiens
tctaggtctcctcagggt

SEQ ID NO: 4428260 - DNA, 15 bp, Homo sapiens
tctaggttaaagcta

SEQ ID NO: 4428261 - DNA, 16 bp, Homo sapiens
tctaggttaaagctaa

SEQ ID NO: 4428262 - DNA, 16 bp, Homo sapiens
tctagtagctgaaatg

SEQ ID NO: 4428263 - DNA, 22 bp, Homo sapiens
tctagtatttatgggtggattt

SEQ ID NO: 4428264 - DNA, 19 bp, Homo sapiens
tctagtgtaccaagtgctt

SEQ ID NO: 4428265 - DNA, 22 bp, Homo sapiens
tctagtgtaccaagtgcttcct

SEQ ID NO: 4428266 - DNA, 13 bp, Homo sapiens
tctagttctagat

SEQ ID NO: 4428267 - DNA, 16 bp, Homo sapiens
tctagttctgccagga

SEQ ID NO: 4428268 - DNA, 17 bp, Homo sapiens
tctagttctgccaggag

SEQ ID NO: 4428269 - DNA, 15 bp, Homo sapiens
tctagttctttcctc

SEQ ID NO: 4428270 - DNA, 15 bp, Homo sapiens
tctagtttattctaa

SEQ ID NO: 4428271 - DNA, 13 bp, Homo sapiens
tctagttttgtca

SEQ ID NO: 4428272 - DNA, 22 bp, Homo sapiens
tctagtttttggaaaaaccttg

SEQ ID NO: 4428273 - DNA, 22 bp, Homo sapiens
tctagttttttacttttgttta

SEQ ID NO: 4428274 - DNA, 15 bp, Homo sapiens
tctataaaaaatatg

SEQ ID NO: 4428275 - DNA, 12 bp, Homo sapiens
tctataaaaata

SEQ ID NO: 4428276 - DNA, 21 bp, Homo sapiens
tctataaactataacctctcc

SEQ ID NO: 4428277 - DNA, 20 bp, Homo sapiens
tctataaagggtcaggcccg

SEQ ID NO: 4428278 - DNA, 17 bp, Homo sapiens
tctataaatttaagaaa

SEQ ID NO: 4428279 - DNA, 18 bp, Homo sapiens
tctataaatttaagaaaa

SEQ ID NO: 4428280 - DNA, 20 bp, Homo sapiens
tctataaatttaagaaaaca

SEQ ID NO: 4428281 - DNA, 14 bp, Homo sapiens
tctataaggccata

SEQ ID NO: 4428282 - DNA, 16 bp, Homo sapiens
tctataaggccataaa

SEQ ID NO: 4428283 - DNA, 22 bp, Homo sapiens
tctataaggccataaaacaggt

SEQ ID NO: 4428284 - DNA, 22 bp, Homo sapiens
tctataagtgaggaagagttta

SEQ ID NO: 4428285 - DNA, 15 bp, Homo sapiens
tctatacctgccttt

SEQ ID NO: 4428286 - DNA, 18 bp, Homo sapiens
tctatactaatgcttaca

SEQ ID NO: 4428287 - DNA, 17 bp, Homo sapiens
tctatagccaaaaatag

SEQ ID NO: 4428288 - DNA, 18 bp, Homo sapiens
tctatagtagacacacta

SEQ ID NO: 4428289 - DNA, 12 bp, Homo sapiens
tctatataaaat

SEQ ID NO: 4428290 - DNA, 14 bp, Homo sapiens
tctatataaaataa

SEQ ID NO: 4428291 - DNA, 16 bp, Homo sapiens
tctatcagattaagtt

SEQ ID NO: 4428292 - DNA, 15 bp, Homo sapiens
tctatccaaaataaa

SEQ ID NO: 4428293 - DNA, 14 bp, Homo sapiens
tctatcctctgtaa

SEQ ID NO: 4428294 - DNA, 16 bp, Homo sapiens
tctatccttttgcctg

SEQ ID NO: 4428295 - DNA, 10 bp, Homo sapiens
tctatctact

SEQ ID NO: 4428296 - DNA, 14 bp, Homo sapiens
tctatctatttgag

SEQ ID NO: 4428297 - DNA, 18 bp, Homo sapiens
tctatcttttgtttcctt

SEQ ID NO: 4428298 - DNA, 21 bp, Homo sapiens
tctatgagggtgtttcctcta

SEQ ID NO: 4428299 - DNA, 14 bp, Homo sapiens
tctatggattcact

SEQ ID NO: 4428300 - DNA, 18 bp, Homo sapiens
tctatggattcacttcta

SEQ ID NO: 4428301 - DNA, 16 bp, Homo sapiens
tctatggctttcaaag

SEQ ID NO: 4428302 - DNA, 15 bp, Homo sapiens
tctatgtcattttta

SEQ ID NO: 4428303 - DNA, 14 bp, Homo sapiens
tctatgtctgcctt

SEQ ID NO: 4428304 - DNA, 15 bp, Homo sapiens
tctatgtctgccttc

SEQ ID NO: 4428305 - DNA, 19 bp, Homo sapiens
tctatgtgttttttgcaac

SEQ ID NO: 4428306 - DNA, 14 bp, Homo sapiens
tctatgttaatatt

SEQ ID NO: 4428307 - DNA, 21 bp, Homo sapiens
tctattaatcaagagaaactt

SEQ ID NO: 4428308 - DNA, 17 bp, Homo sapiens
tctattacattttcagt

SEQ ID NO: 4428309 - DNA, 18 bp, Homo sapiens
tctattatagtgaaacat

SEQ ID NO: 4428310 - DNA, 17 bp, Homo sapiens
tctattatggaaaactg

SEQ ID NO: 4428311 - DNA, 16 bp, Homo sapiens
tctattccctcagcct

SEQ ID NO: 4428312 - DNA, 22 bp, Homo sapiens
tctattgatttgaaaagaattt

SEQ ID NO: 4428313 - DNA, 12 bp, Homo sapiens
tctattggtctc

SEQ ID NO: 4428314 - DNA, 14 bp, Homo sapiens
tcctagtgaaagag

SEQ ID NO: 4428315 - DNA, 17 bp, Homo sapiens
tcctataaggaagattt

SEQ ID NO: 4428316 - DNA, 21 bp, Homo sapiens
tcctataaggaagatttggaa

SEQ ID NO: 4428317 - DNA, 14 bp, Homo sapiens
tcctataaggagag

SEQ ID NO: 4428318 - DNA, 22 bp, Homo sapiens
tcctatccttataggcctgtcc

SEQ ID NO: 4428319 - DNA, 17 bp, Homo sapiens
tcctatctgtgttttga

SEQ ID NO: 4428320 - DNA, 16 bp, Homo sapiens
tcctatgcaataaaat

SEQ ID NO: 4428321 - DNA, 20 bp, Homo sapiens
tcctatgctattgacaataa

SEQ ID NO: 4428322 - DNA, 22 bp, Homo sapiens
tcctatgctattgacaataaaa

SEQ ID NO: 4428323 - DNA, 18 bp, Homo sapiens
tcctatgtttttgttcaa

SEQ ID NO: 4428324 - DNA, 14 bp, Homo sapiens
tcctatttcaatga

SEQ ID NO: 4428325 - DNA, 13 bp, Homo sapiens
tcctatttttgta

SEQ ID NO: 4428326 - DNA, 17 bp, Homo sapiens
tcctatttttgtaaact

SEQ ID NO: 4428327 - DNA, 16 bp, Homo sapiens
tcctcaaaaagcagaa

SEQ ID NO: 4428328 - DNA, 17 bp, Homo sapiens
tcctcaaaaagcagaag

SEQ ID NO: 4428329 - DNA, 19 bp, Homo sapiens
tcctcaaaaagcagaagga

SEQ ID NO: 4428330 - DNA, 16 bp, Homo sapiens
tcctcaaacccagtct

SEQ ID NO: 4428331 - DNA, 16 bp, Homo sapiens
tcctcaaagaaagtgt

SEQ ID NO: 4428332 - DNA, 18 bp, Homo sapiens
tcctcaaagaaagtgtat

SEQ ID NO: 4428333 - DNA, 13 bp, Homo sapiens
tcctcaaatacat

SEQ ID NO: 4428334 - DNA, 15 bp, Homo sapiens
tcctcaaatacatgc

SEQ ID NO: 4428335 - DNA, 16 bp, Homo sapiens
tcctcaaatacatgca

SEQ ID NO: 4428336 - DNA, 19 bp, Homo sapiens
tcctcaaattttttgactt

SEQ ID NO: 4428337 - DNA, 22 bp, Homo sapiens
tcctcaatgggctttcccccaa

SEQ ID NO: 4428338 - DNA, 15 bp, Homo sapiens
tcctcacctcatgcc

SEQ ID NO: 4428339 - DNA, 16 bp, Homo sapiens
tcctcacctcatgccc

SEQ ID NO: 4428340 - DNA, 13 bp, Homo sapiens
tcctcacctctgg

SEQ ID NO: 4428341 - DNA, 21 bp, Homo sapiens
tcctcacctctggactggcta

SEQ ID NO: 4428342 - DNA, 23 bp, Homo sapiens
tcctcacctctggactggctaga

SEQ ID NO: 4428343 - DNA, 14 bp, Homo sapiens
tcctcactcccagt

SEQ ID NO: 4428344 - DNA, 14 bp, Homo sapiens
tcctcactctgtcc

SEQ ID NO: 4428345 - DNA, 15 bp, Homo sapiens
tcctcagccagcctc

SEQ ID NO: 4428346 - DNA, 11 bp, Homo sapiens
tcctcagcccc

SEQ ID NO: 4428347 - DNA, 19 bp, Homo sapiens
tcctcagctgcctcctgcg

SEQ ID NO: 4428348 - DNA, 15 bp, Homo sapiens
tcctcaggcacacag

SEQ ID NO: 4428349 - DNA, 16 bp, Homo sapiens
tcctcaggcacacagc

SEQ ID NO: 4428350 - DNA, 18 bp, Homo sapiens
tcctcaggcccagctgct

SEQ ID NO: 4428351 - DNA, 21 bp, Homo sapiens
tcctcaggcccagctgctccc

SEQ ID NO: 4428352 - DNA, 22 bp, Homo sapiens
tcctcagggacagagacacctg

SEQ ID NO: 4428353 - DNA, 15 bp, Homo sapiens
tcctcatatggccca

SEQ ID NO: 4428354 - DNA, 16 bp, Homo sapiens
tcctcatcctccctga

SEQ ID NO: 4428355 - DNA, 21 bp, Homo sapiens
tcctcatcctccctgaccctg

SEQ ID NO: 4428356 - DNA, 17 bp, Homo sapiens
tcctccaaaggccccct

SEQ ID NO: 4428357 - DNA, 18 bp, Homo sapiens
tcctccaaaggcccccta

SEQ ID NO: 4428358 - DNA, 23 bp, Homo sapiens
tcctccaaaggccccctacgcca

SEQ ID NO: 4428359 - DNA, 11 bp, Homo sapiens
tcctccacaga

SEQ ID NO: 4428360 - DNA, 14 bp, Homo sapiens
tcctccacagagag

SEQ ID NO: 4428361 - DNA, 19 bp, Homo sapiens
tcctccacgttctgctcat

SEQ ID NO: 4428362 - DNA, 14 bp, Homo sapiens
tcctccagaagcct

SEQ ID NO: 4428363 - DNA, 19 bp, Homo sapiens
tcctccagaagcctctggc

SEQ ID NO: 4428364 - DNA, 19 bp, Homo sapiens
tcctccagagacactgagc

SEQ ID NO: 4428365 - DNA, 14 bp, Homo sapiens
tcctccagcctccc

SEQ ID NO: 4428366 - DNA, 23 bp, Homo sapiens
tcctccagcctcccctcccctgg

SEQ ID NO: 4428367 - DNA, 17 bp, Homo sapiens
tcctccaggcctgcctc

SEQ ID NO: 4428368 - DNA, 13 bp, Homo sapiens
tcctccagggaag

SEQ ID NO: 4428369 - DNA, 23 bp, Homo sapiens
tcctccagggaaggtggccacag

SEQ ID NO: 4428370 - DNA, 22 bp, Homo sapiens
tcctccatcttactctgcccta

SEQ ID NO: 4428371 - DNA, 22 bp, Homo sapiens
tcctcccaaagtccccctcctc

SEQ ID NO: 4428372 - DNA, 19 bp, Homo sapiens
tcctcccaagtggtgccta

SEQ ID NO: 4428373 - DNA, 20 bp, Homo sapiens
tcctcccacctcagcctcct

SEQ ID NO: 4428374 - DNA, 11 bp, Homo sapiens
tcctcccagtg

SEQ ID NO: 4428375 - DNA, 20 bp, Homo sapiens
tcctcccatagatactctct

SEQ ID NO: 4428376 - DNA, 21 bp, Homo sapiens
tcctcccatagatactctctt

SEQ ID NO: 4428377 - DNA, 16 bp, Homo sapiens
tcctcccattgcccag

SEQ ID NO: 4428378 - DNA, 14 bp, Homo sapiens
tcctccccagagct

SEQ ID NO: 4428379 - DNA, 18 bp, Homo sapiens
tcctccccagagctggcg

SEQ ID NO: 4428380 - DNA, 21 bp, Homo sapiens
tcctcccccctcctctgaaac

SEQ ID NO: 4428381 - DNA, 14 bp, Homo sapiens
tcctccccctgcaa

SEQ ID NO: 4428382 - DNA, 15 bp, Homo sapiens
tcctccccctgcaac

SEQ ID NO: 4428383 - DNA, 23 bp, Homo sapiens
tcctccccctgccagtgccttac

SEQ ID NO: 4428384 - DNA, 17 bp, Homo sapiens
tcctcccctattttaag

SEQ ID NO: 4428385 - DNA, 20 bp, Homo sapiens
tcctcccctcctcttccctt

SEQ ID NO: 4428386 - DNA, 14 bp, Homo sapiens
tcctcccctctctt

SEQ ID NO: 4428387 - DNA, 14 bp, Homo sapiens
tcctcccctgtagg

SEQ ID NO: 4428388 - DNA, 19 bp, Homo sapiens
tcctccccttcctgtttct

SEQ ID NO: 4428389 - DNA, 22 bp, Homo sapiens
tcctccccttttttttctgatt

SEQ ID NO: 4428390 - DNA, 14 bp, Homo sapiens
tcctcccgccccgc

SEQ ID NO: 4428391 - DNA, 13 bp, Homo sapiens
tcctcccgccctt

SEQ ID NO: 4428392 - DNA, 18 bp, Homo sapiens
tcctcccgcccttccatg

SEQ ID NO: 4428393 - DNA, 9 bp, Homo sapiens
tcctccctc

SEQ ID NO: 4428394 - DNA, 10 bp, Homo sapiens
tcctccctca

SEQ ID NO: 4428395 - DNA, 11 bp, Homo sapiens
tcctccctcag

SEQ ID NO: 4428396 - DNA, 12 bp, Homo sapiens
tcctccctcaga

SEQ ID NO: 4428397 - DNA, 17 bp, Homo sapiens
tcctccctcaggcccag

SEQ ID NO: 4428398 - DNA, 19 bp, Homo sapiens
tcctccctcaggcccagga

SEQ ID NO: 4428399 - DNA, 15 bp, Homo sapiens
tcctccctggcagac

SEQ ID NO: 4428400 - DNA, 13 bp, Homo sapiens
tcctcccttcctt

SEQ ID NO: 4428401 - DNA, 17 bp, Homo sapiens
tcctcccttccttttcc

SEQ ID NO: 4428402 - DNA, 15 bp, Homo sapiens
tcctccgaggccagt

SEQ ID NO: 4428403 - DNA, 16 bp, Homo sapiens
tcctccgtgagcacca

SEQ ID NO: 4428404 - DNA, 16 bp, Homo sapiens
tcctcctcacctcatg

SEQ ID NO: 4428405 - DNA, 12 bp, Homo sapiens
tcctcctcaggc

SEQ ID NO: 4428406 - DNA, 12 bp, Homo sapiens
tcctcctctgcc

SEQ ID NO: 4428407 - DNA, 13 bp, Homo sapiens
tcctcctctgcct

SEQ ID NO: 4428408 - DNA, 11 bp, Homo sapiens
tcctcctctgt

SEQ ID NO: 4428409 - DNA, 20 bp, Homo sapiens
tcctcctgcagacacctgga

SEQ ID NO: 4428410 - DNA, 13 bp, Homo sapiens
tcctcctgcctca

SEQ ID NO: 4428411 - DNA, 13 bp, Homo sapiens
tcctcctggacac

SEQ ID NO: 4428412 - DNA, 22 bp, Homo sapiens
tcctcctgggccctctctgctc

SEQ ID NO: 4428413 - DNA, 13 bp, Homo sapiens
tcctcctggtggg

SEQ ID NO: 4428414 - DNA, 13 bp, Homo sapiens
tcctcctgtgtca

SEQ ID NO: 4428415 - DNA, 16 bp, Homo sapiens
tcctcctgtgtcactg

SEQ ID NO: 4428416 - DNA, 16 bp, Homo sapiens
tcctcctttcctcctc

SEQ ID NO: 4428417 - DNA, 16 bp, Homo sapiens
tcctcggactgtgtgc

SEQ ID NO: 4428418 - DNA, 16 bp, Homo sapiens
tcctcggagagcagca

SEQ ID NO: 4428419 - DNA, 17 bp, Homo sapiens
tcctcggagagcagcag

SEQ ID NO: 4428420 - DNA, 22 bp, Homo sapiens
tcctcggtcgccccgtgtttgc

SEQ ID NO: 4428421 - DNA, 17 bp, Homo sapiens
tcctctactaacaatca

SEQ ID NO: 4428422 - DNA, 19 bp, Homo sapiens
tcctctactaacaatcagc

SEQ ID NO: 4428423 - DNA, 21 bp, Homo sapiens
tcctctagttgagtttctggc

SEQ ID NO: 4428424 - DNA, 17 bp, Homo sapiens
tcctctatttaagatat

SEQ ID NO: 4428425 - DNA, 17 bp, Homo sapiens
tcctctcaaattcagct

SEQ ID NO: 4428426 - DNA, 21 bp, Homo sapiens
tcctctcaaattcagctctga

SEQ ID NO: 4428427 - DNA, 22 bp, Homo sapiens
tcctctcaagctagccagaggg

SEQ ID NO: 4428428 - DNA, 17 bp, Homo sapiens
tcctctcacctcagcct

SEQ ID NO: 4428429 - DNA, 17 bp, Homo sapiens
tcctctcagttctctcc

SEQ ID NO: 4428430 - DNA, 23 bp, Homo sapiens
tcctctcccacagagtgctggac

SEQ ID NO: 4428431 - DNA, 18 bp, Homo sapiens
tcctctccctgccaagtc

SEQ ID NO: 4428432 - DNA, 16 bp, Homo sapiens
tcctctcctggaggat

SEQ ID NO: 4428433 - DNA, 13 bp, Homo sapiens
tcctctcgagccc

SEQ ID NO: 4428434 - DNA, 18 bp, Homo sapiens
tcctctcgagcccagatg

SEQ ID NO: 4428435 - DNA, 22 bp, Homo sapiens
tcctctcgagcccagatggaaa

SEQ ID NO: 4428436 - DNA, 14 bp, Homo sapiens
tcctctctctcttc

SEQ ID NO: 4428437 - DNA, 13 bp, Homo sapiens
tcctctctgcttc

SEQ ID NO: 4428438 - DNA, 14 bp, Homo sapiens
tcctctctgcttca

SEQ ID NO: 4428439 - DNA, 14 bp, Homo sapiens
tcctctcttccaca

SEQ ID NO: 4428440 - DNA, 10 bp, Homo sapiens
tcctctgaaa

SEQ ID NO: 4428441 - DNA, 12 bp, Homo sapiens
tcctctgaaaca

SEQ ID NO: 4428442 - DNA, 17 bp, Homo sapiens
tcctctgaaacagctgc

SEQ ID NO: 4428443 - DNA, 19 bp, Homo sapiens
tcctctgaaacagctgcct

SEQ ID NO: 4428444 - DNA, 16 bp, Homo sapiens
tcctctgcactcccac

SEQ ID NO: 4428445 - DNA, 12 bp, Homo sapiens
tcctctgccacc

SEQ ID NO: 4428446 - DNA, 15 bp, Homo sapiens
tcctctgccacctcc

SEQ ID NO: 4428447 - DNA, 22 bp, Homo sapiens
tcctctgccacctcccctatcc

SEQ ID NO: 4428448 - DNA, 22 bp, Homo sapiens
tcctctgcccgggagctcagga

SEQ ID NO: 4428449 - DNA, 10 bp, Homo sapiens
tcctctgcct

SEQ ID NO: 4428450 - DNA, 24 bp, Homo sapiens
tcctctggacggcaggctcactgc

SEQ ID NO: 4428451 - DNA, 13 bp, Homo sapiens
tcctctggccgca

SEQ ID NO: 4428452 - DNA, 18 bp, Homo sapiens
tcctctggccgcagaggt

SEQ ID NO: 4428453 - DNA, 15 bp, Homo sapiens
tcctctggctttccc

SEQ ID NO: 4428454 - DNA, 17 bp, Homo sapiens
tcctctgggtttctaag

SEQ ID NO: 4428455 - DNA, 23 bp, Homo sapiens
tcctctgtgaactgtgtgtgaat

SEQ ID NO: 4428456 - DNA, 20 bp, Homo sapiens
tcctctgtgaccaatgtctt

SEQ ID NO: 4428457 - DNA, 21 bp, Homo sapiens
tcctctgtgaccaatgtcttg

SEQ ID NO: 4428458 - DNA, 20 bp, Homo sapiens
tcctcttagaagaatattgt

SEQ ID NO: 4428459 - DNA, 19 bp, Homo sapiens
tcctcttcccttagcctct

SEQ ID NO: 4428460 - DNA, 21 bp, Homo sapiens
tcctcttctaaaatagcaata

SEQ ID NO: 4428461 - DNA, 20 bp, Homo sapiens
tcctcttgtgatttctttaa

SEQ ID NO: 4428462 - DNA, 18 bp, Homo sapiens
tcctctttaaaacaaaac

SEQ ID NO: 4428463 - DNA, 20 bp, Homo sapiens
tcctcttttcctggcagctg

SEQ ID NO: 4428464 - DNA, 13 bp, Homo sapiens
tcctctttttcca

SEQ ID NO: 4428465 - DNA, 23 bp, Homo sapiens
tcctgaaaaggtttatgaaaaag

SEQ ID NO: 4428466 - DNA, 19 bp, Homo sapiens
tcctgaaacctcttcctag

SEQ ID NO: 4428467 - DNA, 14 bp, Homo sapiens
tcctgaaccatgtg

SEQ ID NO: 4428468 - DNA, 14 bp, Homo sapiens
tcctgaagctgctg

SEQ ID NO: 4428469 - DNA, 18 bp, Homo sapiens
tcctgaagctgctgtgtc

SEQ ID NO: 4428470 - DNA, 22 bp, Homo sapiens
tcctgaatccaaactaatccat

SEQ ID NO: 4428471 - DNA, 16 bp, Homo sapiens
tcctgaatctgtgcaa

SEQ ID NO: 4428472 - DNA, 13 bp, Homo sapiens
tcctgacatttgt

SEQ ID NO: 4428473 - DNA, 14 bp, Homo sapiens
tcctgacccccatg

SEQ ID NO: 4428474 - DNA, 17 bp, Homo sapiens
tcctgacccccatgtaa

SEQ ID NO: 4428475 - DNA, 15 bp, Homo sapiens
tcctgaccttgtgat

SEQ ID NO: 4428476 - DNA, 14 bp, Homo sapiens
tcctgactaagcct

SEQ ID NO: 4428477 - DNA, 23 bp, Homo sapiens
tcctgactctgccccctgctggc

SEQ ID NO: 4428478 - DNA, 19 bp, Homo sapiens
tcctgagaaaaaaggttcc

SEQ ID NO: 4428479 - DNA, 21 bp, Homo sapiens
tcctgagacccctggcctccg

SEQ ID NO: 4428480 - DNA, 13 bp, Homo sapiens
tcctgagctttat

SEQ ID NO: 4428481 - DNA, 15 bp, Homo sapiens
tcctgagctttatgg

SEQ ID NO: 4428482 - DNA, 14 bp, Homo sapiens
tcctgaggctgttt

SEQ ID NO: 4428483 - DNA, 22 bp, Homo sapiens
tcctgaggctgtttttggctgt

SEQ ID NO: 4428484 - DNA, 18 bp, Homo sapiens
tcctgaggctttggattt

SEQ ID NO: 4428485 - DNA, 22 bp, Homo sapiens
tcctgaggggcatctgcccctc

SEQ ID NO: 4428486 - DNA, 13 bp, Homo sapiens
tcctgagtagctg

SEQ ID NO: 4428487 - DNA, 16 bp, Homo sapiens
tcctgagtggccaggg

SEQ ID NO: 4428488 - DNA, 17 bp, Homo sapiens
tcctgagtggccaggga

SEQ ID NO: 4428489 - DNA, 14 bp, Homo sapiens
tcctgatcagagcc

SEQ ID NO: 4428490 - DNA, 21 bp, Homo sapiens
tcctgcaaatttagtttgtta

SEQ ID NO: 4428491 - DNA, 18 bp, Homo sapiens
tcctgcacaccctgggcc

SEQ ID NO: 4428492 - DNA, 20 bp, Homo sapiens
tcctgcaccggggcctgggc

SEQ ID NO: 4428493 - DNA, 11 bp, Homo sapiens
tcctgcagaca

SEQ ID NO: 4428494 - DNA, 20 bp, Homo sapiens
tcctgcagacacctggactg

SEQ ID NO: 4428495 - DNA, 17 bp, Homo sapiens
tcctgcaggcaggaaca

SEQ ID NO: 4428496 - DNA, 22 bp, Homo sapiens
tcctgcaggcaggaacaaacag

SEQ ID NO: 4428497 - DNA, 23 bp, Homo sapiens
tcctgcagggagccttctgccac

SEQ ID NO: 4428498 - DNA, 20 bp, Homo sapiens
tcctgccacatggagccccc

SEQ ID NO: 4428499 - DNA, 21 bp, Homo sapiens
tcctgccaggcacacacagcc

SEQ ID NO: 4428500 - DNA, 17 bp, Homo sapiens
tcctgccattcttctgg

SEQ ID NO: 4428501 - DNA, 18 bp, Homo sapiens
tcctgccattcttctggt

SEQ ID NO: 4428502 - DNA, 14 bp, Homo sapiens
tcctgcccaaaatg

SEQ ID NO: 4428503 - DNA, 11 bp, Homo sapiens
tcctgcccagg

SEQ ID NO: 4428504 - DNA, 13 bp, Homo sapiens
tcctgcccaggag

SEQ ID NO: 4428505 - DNA, 19 bp, Homo sapiens
tcctgcccaggagagccag

SEQ ID NO: 4428506 - DNA, 22 bp, Homo sapiens
tcctgcccaggagagccagccc

SEQ ID NO: 4428507 - DNA, 17 bp, Homo sapiens
tcctgcccaggccacag

SEQ ID NO: 4428508 - DNA, 18 bp, Homo sapiens
tcctgcccaggccacaga

SEQ ID NO: 4428509 - DNA, 13 bp, Homo sapiens
tcctgcccatgtg

SEQ ID NO: 4428510 - DNA, 18 bp, Homo sapiens
tcctgcccatgtgtcccc

SEQ ID NO: 4428511 - DNA, 16 bp, Homo sapiens
tcctgccccctgccag

SEQ ID NO: 4428512 - DNA, 21 bp, Homo sapiens
tcctgccccctgccagtgaag

SEQ ID NO: 4428513 - DNA, 20 bp, Homo sapiens
tcctgccctgtcaagcttct

SEQ ID NO: 4428514 - DNA, 14 bp, Homo sapiens
tcctgcccttccct

SEQ ID NO: 4428515 - DNA, 13 bp, Homo sapiens
tcctgccgcagag

SEQ ID NO: 4428516 - DNA, 15 bp, Homo sapiens
tcctgccgcagagct

SEQ ID NO: 4428517 - DNA, 17 bp, Homo sapiens
tcctgccgcagagctgg

SEQ ID NO: 4428518 - DNA, 18 bp, Homo sapiens
tcctgccgcagagctggc

SEQ ID NO: 4428519 - DNA, 20 bp, Homo sapiens
tcctgccgcagagctggccg

SEQ ID NO: 4428520 - DNA, 13 bp, Homo sapiens
tcctgcctaaggt

SEQ ID NO: 4428521 - DNA, 18 bp, Homo sapiens
tcctgcctcagcctccca

SEQ ID NO: 4428522 - DNA, 18 bp, Homo sapiens
tcctgcctcagccttcca

SEQ ID NO: 4428523 - DNA, 14 bp, Homo sapiens
tcctgcctcatgcg

SEQ ID NO: 4428524 - DNA, 15 bp, Homo sapiens
tcctgcctgccctgc

SEQ ID NO: 4428525 - DNA, 16 bp, Homo sapiens
tcctgccttcctcctg

SEQ ID NO: 4428526 - DNA, 19 bp, Homo sapiens
tcctgccttcctcctgggc

SEQ ID NO: 4428527 - DNA, 21 bp, Homo sapiens
tcctgcgaccttgcaacctca

SEQ ID NO: 4428528 - DNA, 13 bp, Homo sapiens
tcctgcgccctgt

SEQ ID NO: 4428529 - DNA, 20 bp, Homo sapiens
tcctgcgggcttttccccgg

SEQ ID NO: 4428530 - DNA, 17 bp, Homo sapiens
tcctgcgtcccagcctg

SEQ ID NO: 4428531 - DNA, 13 bp, Homo sapiens
tcctgcgtcctcc

SEQ ID NO: 4428532 - DNA, 14 bp, Homo sapiens
tcctgcgtcctcct

SEQ ID NO: 4428533 - DNA, 23 bp, Homo sapiens
tcctgctcaactctacccctgct

SEQ ID NO: 4428534 - DNA, 22 bp, Homo sapiens
tcctgctctctatccaaaataa

SEQ ID NO: 4428535 - DNA, 15 bp, Homo sapiens
tcctgctgagtcctt

SEQ ID NO: 4428536 - DNA, 16 bp, Homo sapiens
tcctgctgcctaataa

SEQ ID NO: 4428537 - DNA, 21 bp, Homo sapiens
tcctgctgcctaataaagaga

SEQ ID NO: 4428538 - DNA, 19 bp, Homo sapiens
tcctgctgcctctctttca

SEQ ID NO: 4428539 - DNA, 14 bp, Homo sapiens
tcctggaagccagc

SEQ ID NO: 4428540 - DNA, 18 bp, Homo sapiens
tcctggaagccagctttc

SEQ ID NO: 4428541 - DNA, 20 bp, Homo sapiens
tcctggaagccagctttccc

SEQ ID NO: 4428542 - DNA, 14 bp, Homo sapiens
tcctggaagctgtg

SEQ ID NO: 4428543 - DNA, 18 bp, Homo sapiens
tcctggacatcaccagtc

SEQ ID NO: 4428544 - DNA, 16 bp, Homo sapiens
tcctggactccggagg

SEQ ID NO: 4428545 - DNA, 21 bp, Homo sapiens
tcctggactccggaggactga

SEQ ID NO: 4428546 - DNA, 22 bp, Homo sapiens
tcctggagcccagaggagggca

SEQ ID NO: 4428547 - DNA, 19 bp, Homo sapiens
tcctggaggggctggggac

SEQ ID NO: 4428548 - DNA, 17 bp, Homo sapiens
tcctggatgtttggaaa

SEQ ID NO: 4428549 - DNA, 13 bp, Homo sapiens
tcctggcagggcg

SEQ ID NO: 4428550 - DNA, 18 bp, Homo sapiens
tcctggcagggcgccaag

SEQ ID NO: 4428551 - DNA, 22 bp, Homo sapiens
tcctggccaagcaggctggttt

SEQ ID NO: 4428552 - DNA, 23 bp, Homo sapiens
tcctggccaagcaggctggtttg

SEQ ID NO: 4428553 - DNA, 10 bp, Homo sapiens
tcctggccag

SEQ ID NO: 4428554 - DNA, 14 bp, Homo sapiens
tcctggcctatccg

SEQ ID NO: 4428555 - DNA, 18 bp, Homo sapiens
tcctggcctatccgctgc

SEQ ID NO: 4428556 - DNA, 14 bp, Homo sapiens
tcctggccttctga

SEQ ID NO: 4428557 - DNA, 20 bp, Homo sapiens
tcctggcgcctggcagtccg

SEQ ID NO: 4428558 - DNA, 14 bp, Homo sapiens
tcctgggaggacag

SEQ ID NO: 4428559 - DNA, 15 bp, Homo sapiens
tcctgggcccctccc

SEQ ID NO: 4428560 - DNA, 23 bp, Homo sapiens
tcctgggcccctccctacctcaa

SEQ ID NO: 4428561 - DNA, 13 bp, Homo sapiens
tcctgggcctgcc

SEQ ID NO: 4428562 - DNA, 15 bp, Homo sapiens
tcctgggcctgcccc

SEQ ID NO: 4428563 - DNA, 16 bp, Homo sapiens
tcctgggctccagagg

SEQ ID NO: 4428564 - DNA, 23 bp, Homo sapiens
tcctggggagctcctgggaccct

SEQ ID NO: 4428565 - DNA, 19 bp, Homo sapiens
tcctgggggtggcaggcac

SEQ ID NO: 4428566 - DNA, 18 bp, Homo sapiens
tcctgggttcaagtgatt

SEQ ID NO: 4428567 - DNA, 20 bp, Homo sapiens
tcctgggttttgtattctct

SEQ ID NO: 4428568 - DNA, 21 bp, Homo sapiens
tcctgggttttgtattctctg

SEQ ID NO: 4428569 - DNA, 22 bp, Homo sapiens
tcctgggttttgtattctctga

SEQ ID NO: 4428570 - DNA, 19 bp, Homo sapiens
tcctggtagaggggccggc

SEQ ID NO: 4428571 - DNA, 13 bp, Homo sapiens
tcctggtccctca

SEQ ID NO: 4428572 - DNA, 13 bp, Homo sapiens
tcctggtctgtga

SEQ ID NO: 4428573 - DNA, 22 bp, Homo sapiens
tcctggtgcaggtctccacctg

SEQ ID NO: 4428574 - DNA, 10 bp, Homo sapiens
tcctggtgct

SEQ ID NO: 4428575 - DNA, 18 bp, Homo sapiens
tcctggtgctgccgaggg

SEQ ID NO: 4428576 - DNA, 16 bp, Homo sapiens
tcctggtgggtccagg

SEQ ID NO: 4428577 - DNA, 17 bp, Homo sapiens
tcctggtgggtccaggg

SEQ ID NO: 4428578 - DNA, 15 bp, Homo sapiens
tcctggttggtcaca

SEQ ID NO: 4428579 - DNA, 21 bp, Homo sapiens
tcctggtttaattcagcagag

SEQ ID NO: 4428580 - DNA, 15 bp, Homo sapiens
tcctgtaaaatccat

SEQ ID NO: 4428581 - DNA, 16 bp, Homo sapiens
tcctgtaaaatccatt

SEQ ID NO: 4428582 - DNA, 18 bp, Homo sapiens
tcctgtaactgttacagt

SEQ ID NO: 4428583 - DNA, 15 bp, Homo sapiens
tcctgtacctcagtg

SEQ ID NO: 4428584 - DNA, 15 bp, Homo sapiens
tcctgtagttttatt

SEQ ID NO: 4428585 - DNA, 17 bp, Homo sapiens
tcctgtagttttatttt

SEQ ID NO: 4428586 - DNA, 21 bp, Homo sapiens
tcctgtagttttattttatgt

SEQ ID NO: 4428587 - DNA, 17 bp, Homo sapiens
tcctgtattcttgtttg

SEQ ID NO: 4428588 - DNA, 19 bp, Homo sapiens
tcctgtattcttgtttgaa

SEQ ID NO: 4428589 - DNA, 17 bp, Homo sapiens
tcctgtcagtgaggact

SEQ ID NO: 4428590 - DNA, 14 bp, Homo sapiens
tcctgtcagtgtca

SEQ ID NO: 4428591 - DNA, 18 bp, Homo sapiens
tcctgtccaacctaaccc

SEQ ID NO: 4428592 - DNA, 12 bp, Homo sapiens
tcctgtccctga

SEQ ID NO: 4428593 - DNA, 11 bp, Homo sapiens
tcctgtcctgc

SEQ ID NO: 4428594 - DNA, 13 bp, Homo sapiens
tcctgtctctgcc

SEQ ID NO: 4428595 - DNA, 15 bp, Homo sapiens
tcctgtctctgcctg

SEQ ID NO: 4428596 - DNA, 11 bp, Homo sapiens
tcctgtcttcc

SEQ ID NO: 4428597 - DNA, 12 bp, Homo sapiens
tcctgtcttccc

SEQ ID NO: 4428598 - DNA, 14 bp, Homo sapiens
tcctgtcttcccag

SEQ ID NO: 4428599 - DNA, 15 bp, Homo sapiens
tcctgtcttcccagg

SEQ ID NO: 4428600 - DNA, 17 bp, Homo sapiens
tcctgtcttcccagggt

SEQ ID NO: 4428601 - DNA, 22 bp, Homo sapiens
tcctgtgaagtttaattgtctc

SEQ ID NO: 4428602 - DNA, 16 bp, Homo sapiens
tcctgtgaatggaggc

SEQ ID NO: 4428603 - DNA, 20 bp, Homo sapiens
tcctgtgaatggaggcagag

SEQ ID NO: 4428604 - DNA, 17 bp, Homo sapiens
tcctgtgagatgtgtat

SEQ ID NO: 4428605 - DNA, 22 bp, Homo sapiens
tcctgtgagatgtgtatcagtg

SEQ ID NO: 4428606 - DNA, 14 bp, Homo sapiens
tcctgtgccctaga

SEQ ID NO: 4428607 - DNA, 23 bp, Homo sapiens
tcctgtgccctagatgcacgtgg

SEQ ID NO: 4428608 - DNA, 14 bp, Homo sapiens
tcctgtgcctggcc

SEQ ID NO: 4428609 - DNA, 20 bp, Homo sapiens
tcctgtgcctggccccagcc

SEQ ID NO: 4428610 - DNA, 23 bp, Homo sapiens
tcctgtgctcaccctctcttggt

SEQ ID NO: 4428611 - DNA, 13 bp, Homo sapiens
tcctgtggcctga

SEQ ID NO: 4428612 - DNA, 21 bp, Homo sapiens
tcctgtgggtgttctttcctg

SEQ ID NO: 4428613 - DNA, 15 bp, Homo sapiens
tcctgtgtaacatct

SEQ ID NO: 4428614 - DNA, 19 bp, Homo sapiens
tcctgtgtaacatctgcca

SEQ ID NO: 4428615 - DNA, 22 bp, Homo sapiens
tcctgtgtacctcactgtccaa

SEQ ID NO: 4428616 - DNA, 20 bp, Homo sapiens
tcctgtgtgaccctgggcag

SEQ ID NO: 4428617 - DNA, 18 bp, Homo sapiens
tcctgttcagcattctta

SEQ ID NO: 4428618 - DNA, 16 bp, Homo sapiens
tcctgttgatcccagt

SEQ ID NO: 4428619 - DNA, 19 bp, Homo sapiens
tcctgttgcacccagccct

SEQ ID NO: 4428620 - DNA, 16 bp, Homo sapiens
tcctgttggtttcatt

SEQ ID NO: 4428621 - DNA, 18 bp, Homo sapiens
tcctgttggtttcatttg

SEQ ID NO: 4428622 - DNA, 21 bp, Homo sapiens
tcctgtttgaaatatcatgtt

SEQ ID NO: 4428623 - DNA, 15 bp, Homo sapiens
tcctgttttatatat

SEQ ID NO: 4428624 - DNA, 15 bp, Homo sapiens
tccttaacccacctc

SEQ ID NO: 4428625 - DNA, 15 bp, Homo sapiens
tccttagccctgtct

SEQ ID NO: 4428626 - DNA, 13 bp, Homo sapiens
tccttatccctct

SEQ ID NO: 4428627 - DNA, 14 bp, Homo sapiens
tccttatccctctc

SEQ ID NO: 4428628 - DNA, 19 bp, Homo sapiens
tccttatccctctcttccc

SEQ ID NO: 4428629 - DNA, 22 bp, Homo sapiens
tccttatgtatcagtgtccttt

SEQ ID NO: 4428630 - DNA, 15 bp, Homo sapiens
tccttatgtcctgtc

SEQ ID NO: 4428631 - DNA, 18 bp, Homo sapiens
tccttatgtcctgtcata

SEQ ID NO: 4428632 - DNA, 19 bp, Homo sapiens
tccttatttgccttctact

SEQ ID NO: 4428633 - DNA, 18 bp, Homo sapiens
tccttcactcatccagcc

SEQ ID NO: 4428634 - DNA, 13 bp, Homo sapiens
tccttcactgttt

SEQ ID NO: 4428635 - DNA, 18 bp, Homo sapiens
tccttcagaagtttcgtc

SEQ ID NO: 4428636 - DNA, 15 bp, Homo sapiens
tccttcagccctcac

SEQ ID NO: 4428637 - DNA, 12 bp, Homo sapiens
tccttcaggact

SEQ ID NO: 4428638 - DNA, 23 bp, Homo sapiens
tccttcatatgaaaggtgccatg

SEQ ID NO: 4428639 - DNA, 22 bp, Homo sapiens
tccttcatcatgagttctgctg

SEQ ID NO: 4428640 - DNA, 14 bp, Homo sapiens
tccttcatctccca

SEQ ID NO: 4428641 - DNA, 14 bp, Homo sapiens
tccttcattaatga

SEQ ID NO: 4428642 - DNA, 21 bp, Homo sapiens
tccttccagggctcttccaga

SEQ ID NO: 4428643 - DNA, 15 bp, Homo sapiens
tccttccatctcttc

SEQ ID NO: 4428644 - DNA, 13 bp, Homo sapiens
tccttccattcca

SEQ ID NO: 4428645 - DNA, 15 bp, Homo sapiens
tccttccattttcat

SEQ ID NO: 4428646 - DNA, 20 bp, Homo sapiens
tccttcccaggagtggagga

SEQ ID NO: 4428647 - DNA, 14 bp, Homo sapiens
tccttccccagacc

SEQ ID NO: 4428648 - DNA, 20 bp, Homo sapiens
tccttccctccttttaaaat

SEQ ID NO: 4428649 - DNA, 23 bp, Homo sapiens
tccttccctctctgatgtcccag

SEQ ID NO: 4428650 - DNA, 16 bp, Homo sapiens
tccttccctgatggcc

SEQ ID NO: 4428651 - DNA, 19 bp, Homo sapiens
tccttccctgttctccctt

SEQ ID NO: 4428652 - DNA, 17 bp, Homo sapiens
tccttcccttttctgtt

SEQ ID NO: 4428653 - DNA, 13 bp, Homo sapiens
tccttcctaccct

SEQ ID NO: 4428654 - DNA, 14 bp, Homo sapiens
tccttcctctcaag

SEQ ID NO: 4428655 - DNA, 21 bp, Homo sapiens
tccttctaccccaaggccagt

SEQ ID NO: 4428656 - DNA, 18 bp, Homo sapiens
tccttctcccatctcttc

SEQ ID NO: 4428657 - DNA, 19 bp, Homo sapiens
tccttgaatatctttcgat

SEQ ID NO: 4428658 - DNA, 20 bp, Homo sapiens
tccttgacctgcattgtaaa

SEQ ID NO: 4428659 - DNA, 22 bp, Homo sapiens
tccttgacctgcattgtaaata

SEQ ID NO: 4428660 - DNA, 14 bp, Homo sapiens
tccttgcacctgca

SEQ ID NO: 4428661 - DNA, 21 bp, Homo sapiens
tccttgcctgaactccagagg

SEQ ID NO: 4428662 - DNA, 16 bp, Homo sapiens
tccttgcgcctcagcc

SEQ ID NO: 4428663 - DNA, 16 bp, Homo sapiens
tccttggactcatttt

SEQ ID NO: 4428664 - DNA, 21 bp, Homo sapiens
tccttggcagtggactcagaa

SEQ ID NO: 4428665 - DNA, 15 bp, Homo sapiens
tccttggccacagac

SEQ ID NO: 4428666 - DNA, 14 bp, Homo sapiens
tccttgggcccttt

SEQ ID NO: 4428667 - DNA, 23 bp, Homo sapiens
tccttgtcccgtctggacctggg

SEQ ID NO: 4428668 - DNA, 19 bp, Homo sapiens
tccttgtgacttacaattt

SEQ ID NO: 4428669 - DNA, 22 bp, Homo sapiens
tccttgtggttagcaagactgc

SEQ ID NO: 4428670 - DNA, 22 bp, Homo sapiens
tccttgtgttgcactgaacagg

SEQ ID NO: 4428671 - DNA, 13 bp, Homo sapiens
tcctttaaaatat

SEQ ID NO: 4428672 - DNA, 15 bp, Homo sapiens
tcctttaattgtaaa

SEQ ID NO: 4428673 - DNA, 20 bp, Homo sapiens
tcctttacaactaaataaca

SEQ ID NO: 4428674 - DNA, 14 bp, Homo sapiens
tcctttatctgtaa

SEQ ID NO: 4428675 - DNA, 20 bp, Homo sapiens
tcctttatgtgaatttttaa

SEQ ID NO: 4428676 - DNA, 17 bp, Homo sapiens
tcctttattattatttt

SEQ ID NO: 4428677 - DNA, 12 bp, Homo sapiens
tcctttcccttt

SEQ ID NO: 4428678 - DNA, 14 bp, Homo sapiens
tccccagcctacct

SEQ ID NO: 4428679 - DNA, 15 bp, Homo sapiens
tccccagcctacctc

SEQ ID NO: 4428680 - DNA, 18 bp, Homo sapiens
tccccagcctacctctcc

SEQ ID NO: 4428681 - DNA, 14 bp, Homo sapiens
tccccagctgttta

SEQ ID NO: 4428682 - DNA, 20 bp, Homo sapiens
tccccaggaagtggctcaga

SEQ ID NO: 4428683 - DNA, 16 bp, Homo sapiens
tccccaggctggagac

SEQ ID NO: 4428684 - DNA, 10 bp, Homo sapiens
tccccagggg

SEQ ID NO: 4428685 - DNA, 18 bp, Homo sapiens
tccccaggggtcccagcc

SEQ ID NO: 4428686 - DNA, 23 bp, Homo sapiens
tccccaggggtcccagccacccc

SEQ ID NO: 4428687 - DNA, 22 bp, Homo sapiens
tccccagggtgtctctatgaaa

SEQ ID NO: 4428688 - DNA, 18 bp, Homo sapiens
tccccaggtggctgaccc

SEQ ID NO: 4428689 - DNA, 11 bp, Homo sapiens
tccccagtgcc

SEQ ID NO: 4428690 - DNA, 17 bp, Homo sapiens
tccccagtgcctgccac

SEQ ID NO: 4428691 - DNA, 18 bp, Homo sapiens
tccccagtgcctgccact

SEQ ID NO: 4428692 - DNA, 16 bp, Homo sapiens
tccccatatataaatt

SEQ ID NO: 4428693 - DNA, 22 bp, Homo sapiens
tccccatcccgaagccatcact

SEQ ID NO: 4428694 - DNA, 14 bp, Homo sapiens
tccccatctccctg

SEQ ID NO: 4428695 - DNA, 19 bp, Homo sapiens
tccccatctccctgcctgg

SEQ ID NO: 4428696 - DNA, 20 bp, Homo sapiens
tccccatctccctgcctggc

SEQ ID NO: 4428697 - DNA, 22 bp, Homo sapiens
tccccatctccctgcctggccc

SEQ ID NO: 4428698 - DNA, 23 bp, Homo sapiens
tccccatgggaagacgaggccct

SEQ ID NO: 4428699 - DNA, 16 bp, Homo sapiens
tccccattctctgcct

SEQ ID NO: 4428700 - DNA, 23 bp, Homo sapiens
tccccattctgtgtcccatgtcc

SEQ ID NO: 4428701 - DNA, 18 bp, Homo sapiens
tcccccaaactttttgtt

SEQ ID NO: 4428702 - DNA, 14 bp, Homo sapiens
tcccccaaccccca

SEQ ID NO: 4428703 - DNA, 20 bp, Homo sapiens
tcccccaacccccaccccac

SEQ ID NO: 4428704 - DNA, 18 bp, Homo sapiens
tcccccaccccctcccca

SEQ ID NO: 4428705 - DNA, 19 bp, Homo sapiens
tcccccaccccctccccgc

SEQ ID NO: 4428706 - DNA, 13 bp, Homo sapiens
tcccccaccctcc

SEQ ID NO: 4428707 - DNA, 17 bp, Homo sapiens
tcccccaccctccatgc

SEQ ID NO: 4428708 - DNA, 22 bp, Homo sapiens
tcccccactttcaagacagatg

SEQ ID NO: 4428709 - DNA, 13 bp, Homo sapiens
tcccccaggaggc

SEQ ID NO: 4428710 - DNA, 23 bp, Homo sapiens
tcccccaggaggcagctcaggat

SEQ ID NO: 4428711 - DNA, 13 bp, Homo sapiens
tcccccatcccta

SEQ ID NO: 4428712 - DNA, 20 bp, Homo sapiens
tcccccatccctaccactgt

SEQ ID NO: 4428713 - DNA, 22 bp, Homo sapiens
tcccccatccctaccactgtgg

SEQ ID NO: 4428714 - DNA, 12 bp, Homo sapiens
tccccccactgc

SEQ ID NO: 4428715 - DNA, 19 bp, Homo sapiens
tccccccactgcaggcccc

SEQ ID NO: 4428716 - DNA, 18 bp, Homo sapiens
tccccccccaacctttcc

SEQ ID NO: 4428717 - DNA, 19 bp, Homo sapiens
tccccccccaacctttccc

SEQ ID NO: 4428718 - DNA, 19 bp, Homo sapiens
tccccccgagtctccggga

SEQ ID NO: 4428719 - DNA, 17 bp, Homo sapiens
tccccctaaaccaactg

SEQ ID NO: 4428720 - DNA, 16 bp, Homo sapiens
tccccctcctcagcca

SEQ ID NO: 4428721 - DNA, 21 bp, Homo sapiens
tccccctgcaacttccgctga

SEQ ID NO: 4428722 - DNA, 17 bp, Homo sapiens
tccccctgccagtgcct

SEQ ID NO: 4428723 - DNA, 12 bp, Homo sapiens
tcccccttccca

SEQ ID NO: 4428724 - DNA, 17 bp, Homo sapiens
tcccccttgccacccca

SEQ ID NO: 4428725 - DNA, 18 bp, Homo sapiens
tccccgaggagctgggcc

SEQ ID NO: 4428726 - DNA, 20 bp, Homo sapiens
tccccgatgtcccctgcggg

SEQ ID NO: 4428727 - DNA, 21 bp, Homo sapiens
tccccgatgtcccctgcgggc

SEQ ID NO: 4428728 - DNA, 14 bp, Homo sapiens
tccccgcctccact

SEQ ID NO: 4428729 - DNA, 19 bp, Homo sapiens
tccccgtgtcctctccctg

SEQ ID NO: 4428730 - DNA, 13 bp, Homo sapiens
tcccctagatcca

SEQ ID NO: 4428731 - DNA, 15 bp, Homo sapiens
tcccctagatccaga

SEQ ID NO: 4428732 - DNA, 18 bp, Homo sapiens
tcccctagtaagtgcctt

SEQ ID NO: 4428733 - DNA, 21 bp, Homo sapiens
tcccctagtaagtgccttcca

SEQ ID NO: 4428734 - DNA, 22 bp, Homo sapiens
tcccctagtaagtgccttccat

SEQ ID NO: 4428735 - DNA, 17 bp, Homo sapiens
tcccctatccacccagc

SEQ ID NO: 4428736 - DNA, 18 bp, Homo sapiens
tcccctatccacccagcc

SEQ ID NO: 4428737 - DNA, 20 bp, Homo sapiens
tcccctatccacccagccca

SEQ ID NO: 4428738 - DNA, 19 bp, Homo sapiens
tcccctcaaactcattgca

SEQ ID NO: 4428739 - DNA, 14 bp, Homo sapiens
tcccctcactctgt

SEQ ID NO: 4428740 - DNA, 21 bp, Homo sapiens
tcccctcactctgtcagccag

SEQ ID NO: 4428741 - DNA, 13 bp, Homo sapiens
tcccctcattcag

SEQ ID NO: 4428742 - DNA, 12 bp, Homo sapiens
tcccctccaacc

SEQ ID NO: 4428743 - DNA, 13 bp, Homo sapiens
tcccctccaacct

SEQ ID NO: 4428744 - DNA, 17 bp, Homo sapiens
tcccctccccactcctc

SEQ ID NO: 4428745 - DNA, 14 bp, Homo sapiens
tcccctccctgcct

SEQ ID NO: 4428746 - DNA, 15 bp, Homo sapiens
tcccctccctgcctg

SEQ ID NO: 4428747 - DNA, 16 bp, Homo sapiens
tcccctccctggctcc

SEQ ID NO: 4428748 - DNA, 13 bp, Homo sapiens
tcccctccctgta

SEQ ID NO: 4428749 - DNA, 16 bp, Homo sapiens
tcccctcctctattcc

SEQ ID NO: 4428750 - DNA, 15 bp, Homo sapiens
tcccctcctcttccc

SEQ ID NO: 4428751 - DNA, 16 bp, Homo sapiens
tcccctcctcttccct

SEQ ID NO: 4428752 - DNA, 16 bp, Homo sapiens
tcccctcggagaagag

SEQ ID NO: 4428753 - DNA, 16 bp, Homo sapiens
tcccctgcccagcctg

SEQ ID NO: 4428754 - DNA, 14 bp, Homo sapiens
tcccctgcccccag

SEQ ID NO: 4428755 - DNA, 17 bp, Homo sapiens
tcccctgcccccaggac

SEQ ID NO: 4428756 - DNA, 17 bp, Homo sapiens
tcccctgccctggtcca

SEQ ID NO: 4428757 - DNA, 24 bp, Homo sapiens
tcccctgccctggtccagggaagc

SEQ ID NO: 4428758 - DNA, 13 bp, Homo sapiens
tcccctggctggc

SEQ ID NO: 4428759 - DNA, 17 bp, Homo sapiens
tccccttccactgaggg

SEQ ID NO: 4428760 - DNA, 18 bp, Homo sapiens
tccccttccactgagggc

SEQ ID NO: 4428761 - DNA, 21 bp, Homo sapiens
tccccttcccccatccctacc

SEQ ID NO: 4428762 - DNA, 16 bp, Homo sapiens
tccccttcccctgctg

SEQ ID NO: 4428763 - DNA, 17 bp, Homo sapiens
tccccttcccctgctga

SEQ ID NO: 4428764 - DNA, 12 bp, Homo sapiens
tccccttcctgg

SEQ ID NO: 4428765 - DNA, 12 bp, Homo sapiens
tccccttcctgt

SEQ ID NO: 4428766 - DNA, 15 bp, Homo sapiens
tccccttctctcatc

SEQ ID NO: 4428767 - DNA, 19 bp, Homo sapiens
tcccgaagccatcacttct

SEQ ID NO: 4428768 - DNA, 18 bp, Homo sapiens
tcccgcactctgccccca

SEQ ID NO: 4428769 - DNA, 15 bp, Homo sapiens
tcccgccccgcccct

SEQ ID NO: 4428770 - DNA, 16 bp, Homo sapiens
tcccgccccgcccctc

SEQ ID NO: 4428771 - DNA, 21 bp, Homo sapiens
tcccgccccttcccactcacc

SEQ ID NO: 4428772 - DNA, 15 bp, Homo sapiens
tcccgctgctgtgct

SEQ ID NO: 4428773 - DNA, 20 bp, Homo sapiens
tcccggcccccggccaagga

SEQ ID NO: 4428774 - DNA, 21 bp, Homo sapiens
tcccggcccgcctgcccagac

SEQ ID NO: 4428775 - DNA, 16 bp, Homo sapiens
tcccggctttggtgcg

SEQ ID NO: 4428776 - DNA, 13 bp, Homo sapiens
tcccgggagctgg

SEQ ID NO: 4428777 - DNA, 15 bp, Homo sapiens
tcccgggagctgggc

SEQ ID NO: 4428778 - DNA, 20 bp, Homo sapiens
tcccgggagctgggccctgc

SEQ ID NO: 4428779 - DNA, 13 bp, Homo sapiens
tcccggggcctgg

SEQ ID NO: 4428780 - DNA, 16 bp, Homo sapiens
tcccggggcctggaca

SEQ ID NO: 4428781 - DNA, 17 bp, Homo sapiens
tcccggggcctggacag

SEQ ID NO: 4428782 - DNA, 16 bp, Homo sapiens
tcccgtatcacagtgt

SEQ ID NO: 4428783 - DNA, 14 bp, Homo sapiens
tccctaatgtgttt

SEQ ID NO: 4428784 - DNA, 17 bp, Homo sapiens
tccctaatttatgtgct

SEQ ID NO: 4428785 - DNA, 18 bp, Homo sapiens
tccctaatttatgtgcta

SEQ ID NO: 4428786 - DNA, 20 bp, Homo sapiens
tccctaatttatgtgctata

SEQ ID NO: 4428787 - DNA, 14 bp, Homo sapiens
tccctaccactgtg

SEQ ID NO: 4428788 - DNA, 11 bp, Homo sapiens
tccctacctca

SEQ ID NO: 4428789 - DNA, 21 bp, Homo sapiens
tccctacctcaacctgtaaat

SEQ ID NO: 4428790 - DNA, 13 bp, Homo sapiens
tccctacctcagg

SEQ ID NO: 4428791 - DNA, 17 bp, Homo sapiens
tccctacctcaggcagg

SEQ ID NO: 4428792 - DNA, 20 bp, Homo sapiens
tccctactgagtactctttc

SEQ ID NO: 4428793 - DNA, 16 bp, Homo sapiens
tccctacttaggaaat

SEQ ID NO: 4428794 - DNA, 13 bp, Homo sapiens
tccctactttctc

SEQ ID NO: 4428795 - DNA, 19 bp, Homo sapiens
tccctagaaacttccaaat

SEQ ID NO: 4428796 - DNA, 22 bp, Homo sapiens
tccctagaggggcaccttttca

SEQ ID NO: 4428797 - DNA, 11 bp, Homo sapiens
tccctagccca

SEQ ID NO: 4428798 - DNA, 21 bp, Homo sapiens
tccctagttagcatccaggct

SEQ ID NO: 4428799 - DNA, 22 bp, Homo sapiens
tccctagttagcatccaggctg

SEQ ID NO: 4428800 - DNA, 14 bp, Homo sapiens
tccctatggaaaga

SEQ ID NO: 4428801 - DNA, 20 bp, Homo sapiens
tccctatttttctctcctgt

SEQ ID NO: 4428802 - DNA, 12 bp, Homo sapiens
tccctcacccat

SEQ ID NO: 4428803 - DNA, 18 bp, Homo sapiens
tccctcacccatcctaga

SEQ ID NO: 4428804 - DNA, 15 bp, Homo sapiens
tccctcacccccatg

SEQ ID NO: 4428805 - DNA, 15 bp, Homo sapiens
tccctcaccccctcc

SEQ ID NO: 4428806 - DNA, 17 bp, Homo sapiens
tccctcaccccctccca

SEQ ID NO: 4428807 - DNA, 11 bp, Homo sapiens
tccctcagacc

SEQ ID NO: 4428808 - DNA, 13 bp, Homo sapiens
tccctcagaccca

SEQ ID NO: 4428809 - DNA, 22 bp, Homo sapiens
tccctcagacccaggagtccag

SEQ ID NO: 4428810 - DNA, 23 bp, Homo sapiens
tccctcagacccaggagtccagc

SEQ ID NO: 4428811 - DNA, 21 bp, Homo sapiens
tccctcaggcccaggagtcca

SEQ ID NO: 4428812 - DNA, 16 bp, Homo sapiens
tccctcatctgtccct

SEQ ID NO: 4428813 - DNA, 15 bp, Homo sapiens
tccctcatggctctg

SEQ ID NO: 4428814 - DNA, 16 bp, Homo sapiens
tccctccaccccagga

SEQ ID NO: 4428815 - DNA, 13 bp, Homo sapiens
tccctccacctca

SEQ ID NO: 4428816 - DNA, 14 bp, Homo sapiens
tccctccagctgcg

SEQ ID NO: 4428817 - DNA, 15 bp, Homo sapiens
tccctccagctgcga

SEQ ID NO: 4428818 - DNA, 16 bp, Homo sapiens
tccctccagctgcgac

SEQ ID NO: 4428819 - DNA, 16 bp, Homo sapiens
tccctccatttttctc

SEQ ID NO: 4428820 - DNA, 17 bp, Homo sapiens
tccctccccagaaacag

SEQ ID NO: 4428821 - DNA, 12 bp, Homo sapiens
tccctccccctc

SEQ ID NO: 4428822 - DNA, 18 bp, Homo sapiens
tccctccccctgcccctt

SEQ ID NO: 4428823 - DNA, 13 bp, Homo sapiens
tccctcccctgcc

SEQ ID NO: 4428824 - DNA, 14 bp, Homo sapiens
tccctcccctgccc

SEQ ID NO: 4428825 - DNA, 19 bp, Homo sapiens
tccctcccctgccctggtc

SEQ ID NO: 4428826 - DNA, 13 bp, Homo sapiens
tccctcctagctc

SEQ ID NO: 4428827 - DNA, 16 bp, Homo sapiens
tccctcctcacctctg

SEQ ID NO: 4428828 - DNA, 17 bp, Homo sapiens
tccctcctcacctctgg

SEQ ID NO: 4428829 - DNA, 14 bp, Homo sapiens
tccctcctccaggc

SEQ ID NO: 4428830 - DNA, 16 bp, Homo sapiens
tccctcctccaggcct

SEQ ID NO: 4428831 - DNA, 21 bp, Homo sapiens
tccctcctccaggcctgcctc

SEQ ID NO: 4428832 - DNA, 15 bp, Homo sapiens
tccctccttttaaaa

SEQ ID NO: 4428833 - DNA, 16 bp, Homo sapiens
tccctctcagaggcct

SEQ ID NO: 4428834 - DNA, 14 bp, Homo sapiens
tccctctccaagac

SEQ ID NO: 4428835 - DNA, 15 bp, Homo sapiens
tccctctcctgccta

SEQ ID NO: 4428836 - DNA, 15 bp, Homo sapiens
tccctctctccctgc

SEQ ID NO: 4428837 - DNA, 17 bp, Homo sapiens
tccctctctccctgcct

SEQ ID NO: 4428838 - DNA, 16 bp, Homo sapiens
tccctctctcttctgc

SEQ ID NO: 4428839 - DNA, 20 bp, Homo sapiens
tccctctctcttctgctcca

SEQ ID NO: 4428840 - DNA, 12 bp, Homo sapiens
tccctctctgat

SEQ ID NO: 4428841 - DNA, 19 bp, Homo sapiens
tccctctcttccccttccc

SEQ ID NO: 4428842 - DNA, 16 bp, Homo sapiens
tccctctggccctgcc

SEQ ID NO: 4428843 - DNA, 20 bp, Homo sapiens
tccctctggccctgccttct

SEQ ID NO: 4428844 - DNA, 23 bp, Homo sapiens
tccctctgggcacgcctgctggc

SEQ ID NO: 4428845 - DNA, 16 bp, Homo sapiens
tccctgaaaacccaga

SEQ ID NO: 4428846 - DNA, 19 bp, Homo sapiens
tccctgaaaacccagagag

SEQ ID NO: 4428847 - DNA, 20 bp, Homo sapiens
tccctgaaaacccagagagg

SEQ ID NO: 4428848 - DNA, 21 bp, Homo sapiens
tccctgaatcccccttgccac

SEQ ID NO: 4428849 - DNA, 17 bp, Homo sapiens
tccctgaccctgctcct

SEQ ID NO: 4428850 - DNA, 21 bp, Homo sapiens
tccctgaccttagcgttctgg

SEQ ID NO: 4428851 - DNA, 23 bp, Homo sapiens
tccctgaccttagcgttctggac

SEQ ID NO: 4428852 - DNA, 22 bp, Homo sapiens
tccctgactcattctgaaggag

SEQ ID NO: 4428853 - DNA, 14 bp, Homo sapiens
tccctgactggcca

SEQ ID NO: 4428854 - DNA, 14 bp, Homo sapiens
tccctgacttgctt

SEQ ID NO: 4428855 - DNA, 21 bp, Homo sapiens
tccctgagatttaacccctcc

SEQ ID NO: 4428856 - DNA, 15 bp, Homo sapiens
tccctgaggactgat

SEQ ID NO: 4428857 - DNA, 21 bp, Homo sapiens
tccctgaggactgatttcaga

SEQ ID NO: 4428858 - DNA, 22 bp, Homo sapiens
tccctgaggttaaacggtgccc

SEQ ID NO: 4428859 - DNA, 15 bp, Homo sapiens
tccctgagtcaccag

SEQ ID NO: 4428860 - DNA, 19 bp, Homo sapiens
tccctgataacaacctgga

SEQ ID NO: 4428861 - DNA, 16 bp, Homo sapiens
tccctgatcccacccc

SEQ ID NO: 4428862 - DNA, 19 bp, Homo sapiens
tccctgatgggggacagga

SEQ ID NO: 4428863 - DNA, 13 bp, Homo sapiens
tccctgcaagctc

SEQ ID NO: 4428864 - DNA, 11 bp, Homo sapiens
tccctgcacac

SEQ ID NO: 4428865 - DNA, 14 bp, Homo sapiens
tccctgcactgtgt

SEQ ID NO: 4428866 - DNA, 15 bp, Homo sapiens
tccctgcagacctca

SEQ ID NO: 4428867 - DNA, 19 bp, Homo sapiens
tccctgcagacctcaagcc

SEQ ID NO: 4428868 - DNA, 22 bp, Homo sapiens
tccctgcagacctcaagccatc

SEQ ID NO: 4428869 - DNA, 10 bp, Homo sapiens
tccctgccaa

SEQ ID NO: 4428870 - DNA, 19 bp, Homo sapiens
tccctgccaagtctcagaa

SEQ ID NO: 4428871 - DNA, 22 bp, Homo sapiens
tccctgccaagtctcagaagag

SEQ ID NO: 4428872 - DNA, 19 bp, Homo sapiens
tccctgcctcactcctccg

SEQ ID NO: 4428873 - DNA, 13 bp, Homo sapiens
tccctgcctcctg

SEQ ID NO: 4428874 - DNA, 14 bp, Homo sapiens
tccctgcctcctgc

SEQ ID NO: 4428875 - DNA, 23 bp, Homo sapiens
tccctgcctctcatcaactgaat

SEQ ID NO: 4428876 - DNA, 13 bp, Homo sapiens
tccctgcctgagg

SEQ ID NO: 4428877 - DNA, 18 bp, Homo sapiens
tccctgcctgctccttgg

SEQ ID NO: 4428878 - DNA, 23 bp, Homo sapiens
tccctgcctgctccttggcaccc

SEQ ID NO: 4428879 - DNA, 15 bp, Homo sapiens
tccctgcctggcccc

SEQ ID NO: 4428880 - DNA, 11 bp, Homo sapiens
tccctgcctgt

SEQ ID NO: 4428881 - DNA, 13 bp, Homo sapiens
tccctgcctgtgg

SEQ ID NO: 4428882 - DNA, 19 bp, Homo sapiens
tccctgcctgtggcccctc

SEQ ID NO: 4428883 - DNA, 15 bp, Homo sapiens
tccctgcgagacgca

SEQ ID NO: 4428884 - DNA, 23 bp, Homo sapiens
tccctgcgagacgcacacagctg

SEQ ID NO: 4428885 - DNA, 19 bp, Homo sapiens
tccctgctagcacagaggc

SEQ ID NO: 4428886 - DNA, 23 bp, Homo sapiens
tccctgctagcacagaggcctga

SEQ ID NO: 4428887 - DNA, 12 bp, Homo sapiens
tccctgctcagt

SEQ ID NO: 4428888 - DNA, 11 bp, Homo sapiens
tccctgctggg

SEQ ID NO: 4428889 - DNA, 21 bp, Homo sapiens
tccctgctgtgccatgctggg

SEQ ID NO: 4428890 - DNA, 22 bp, Homo sapiens
tccctgctgtgccatgctgggc

SEQ ID NO: 4428891 - DNA, 12 bp, Homo sapiens
tccctgcttcca

SEQ ID NO: 4428892 - DNA, 18 bp, Homo sapiens
tccctgcttccaggaaac

SEQ ID NO: 4428893 - DNA, 15 bp, Homo sapiens
tccctgcttgcccgc

SEQ ID NO: 4428894 - DNA, 22 bp, Homo sapiens
tccctgcttgcccgctcccaca

SEQ ID NO: 4428895 - DNA, 15 bp, Homo sapiens
tccctgctttgcatc

SEQ ID NO: 4428896 - DNA, 18 bp, Homo sapiens
tccctgctttgcatcttt

SEQ ID NO: 4428897 - DNA, 22 bp, Homo sapiens
tccctggaaaccttccacccag

SEQ ID NO: 4428898 - DNA, 18 bp, Homo sapiens
tccctggagatcatccta

SEQ ID NO: 4428899 - DNA, 19 bp, Homo sapiens
tccctggagcaggagcccc

SEQ ID NO: 4428900 - DNA, 23 bp, Homo sapiens
tccctggagcaggagccccgcca

SEQ ID NO: 4428901 - DNA, 19 bp, Homo sapiens
tccctggagggcaagccct

SEQ ID NO: 4428902 - DNA, 22 bp, Homo sapiens
tccctggagggcaagccctgcc

SEQ ID NO: 4428903 - DNA, 10 bp, Homo sapiens
tccctggagt

SEQ ID NO: 4428904 - DNA, 22 bp, Homo sapiens
tccctggatcacataccaggtc

SEQ ID NO: 4428905 - DNA, 15 bp, Homo sapiens
tccctggcagacaca

SEQ ID NO: 4428906 - DNA, 12 bp, Homo sapiens
tccctggcttct

SEQ ID NO: 4428907 - DNA, 17 bp, Homo sapiens
tccctggcttctgtggg

SEQ ID NO: 4428908 - DNA, 22 bp, Homo sapiens
tccctgggacacagacccagga

SEQ ID NO: 4428909 - DNA, 21 bp, Homo sapiens
tccctgggagtgttcccgtgc

SEQ ID NO: 4428910 - DNA, 16 bp, Homo sapiens
tccctgggcccctcca

SEQ ID NO: 4428911 - DNA, 19 bp, Homo sapiens
tccctgggcccctccacgc

SEQ ID NO: 4428912 - DNA, 22 bp, Homo sapiens
tccctgggctgccaccagcccc

SEQ ID NO: 4428913 - DNA, 20 bp, Homo sapiens
tccctgggggaagccctgga

SEQ ID NO: 4428914 - DNA, 22 bp, Homo sapiens
tccctgggggccttgggtgagt

SEQ ID NO: 4428915 - DNA, 17 bp, Homo sapiens
tccctggggttctctac

SEQ ID NO: 4428916 - DNA, 19 bp, Homo sapiens
tccctggggttctctacag

SEQ ID NO: 4428917 - DNA, 15 bp, Homo sapiens
tccctggtcccctcc

SEQ ID NO: 4428918 - DNA, 18 bp, Homo sapiens
tccctgtaacctcttcag

SEQ ID NO: 4428919 - DNA, 18 bp, Homo sapiens
tccctgtagctctgcctc

SEQ ID NO: 4428920 - DNA, 22 bp, Homo sapiens
tccctgtcaccaagctcacagt

SEQ ID NO: 4428921 - DNA, 15 bp, Homo sapiens
tccctgtcacctctt

SEQ ID NO: 4428922 - DNA, 18 bp, Homo sapiens
tccctgtcacctcttccg

SEQ ID NO: 4428923 - DNA, 15 bp, Homo sapiens
tccctgtcccagttg

SEQ ID NO: 4428924 - DNA, 12 bp, Homo sapiens
tccctgtcctcc

SEQ ID NO: 4428925 - DNA, 17 bp, Homo sapiens
tccctgtgttctgggct

SEQ ID NO: 4428926 - DNA, 15 bp, Homo sapiens
tccctgttctccctt

SEQ ID NO: 4428927 - DNA, 16 bp, Homo sapiens
tccctgttctcccttt

SEQ ID NO: 4428928 - DNA, 17 bp, Homo sapiens
tccctgttctccctttc

SEQ ID NO: 4428929 - DNA, 23 bp, Homo sapiens
tccctgtttattccaaatgccat

SEQ ID NO: 4428930 - DNA, 22 bp, Homo sapiens
tcccttaagcagcaacagccta

SEQ ID NO: 4428931 - DNA, 14 bp, Homo sapiens
tcccttaatatcct

SEQ ID NO: 4428932 - DNA, 14 bp, Homo sapiens
tcccttagcctctc

SEQ ID NO: 4428933 - DNA, 16 bp, Homo sapiens
tcccttagcctctccc

SEQ ID NO: 4428934 - DNA, 16 bp, Homo sapiens
tcccttcccacatgcc

SEQ ID NO: 4428935 - DNA, 17 bp, Homo sapiens
tcccttcccacatgcct

SEQ ID NO: 4428936 - DNA, 14 bp, Homo sapiens
tcccttcctattcc

SEQ ID NO: 4428937 - DNA, 16 bp, Homo sapiens
tcccttcctctctcct

SEQ ID NO: 4428938 - DNA, 18 bp, Homo sapiens
tcccttccttttccctgc

SEQ ID NO: 4428939 - DNA, 22 bp, Homo sapiens
tcccttctcatctccccacgcc

SEQ ID NO: 4428940 - DNA, 19 bp, Homo sapiens
tcccttctcgtgtttgctt

SEQ ID NO: 4428941 - DNA, 13 bp, Homo sapiens
tcccttgaccatt

SEQ ID NO: 4428942 - DNA, 15 bp, Homo sapiens
tcccttgcctctgcc

SEQ ID NO: 4428943 - DNA, 18 bp, Homo sapiens
tcccttggacattttatg

SEQ ID NO: 4428944 - DNA, 21 bp, Homo sapiens
tcccttggacattttatgtct

SEQ ID NO: 4428945 - DNA, 12 bp, Homo sapiens
tcccttggcctc

SEQ ID NO: 4428946 - DNA, 16 bp, Homo sapiens
tcccttggcctcagaa

SEQ ID NO: 4428947 - DNA, 14 bp, Homo sapiens
tcccttgggctccc

SEQ ID NO: 4428948 - DNA, 22 bp, Homo sapiens
tcccttgtgtcaagacatttct

SEQ ID NO: 4428949 - DNA, 20 bp, Homo sapiens
tccctttagcacgtttaaag

SEQ ID NO: 4428950 - DNA, 13 bp, Homo sapiens
tccctttccccta

SEQ ID NO: 4428951 - DNA, 16 bp, Homo sapiens
tccctttcccctagat

SEQ ID NO: 4428952 - DNA, 18 bp, Homo sapiens
tccctttcccctagatcc

SEQ ID NO: 4428953 - DNA, 14 bp, Homo sapiens
tccctttccttcca

SEQ ID NO: 4428954 - DNA, 17 bp, Homo sapiens
tccctttccttccatcc

SEQ ID NO: 4428955 - DNA, 16 bp, Homo sapiens
tccctttctcccctgc

SEQ ID NO: 4428956 - DNA, 17 bp, Homo sapiens
tccctttctcccctgcc

SEQ ID NO: 4428957 - DNA, 22 bp, Homo sapiens
tccctttctctctcctctctgc

SEQ ID NO: 4428958 - DNA, 13 bp, Homo sapiens
tccctttctcttc

SEQ ID NO: 4428959 - DNA, 16 bp, Homo sapiens
tccctttgtctttcaa

SEQ ID NO: 4428960 - DNA, 18 bp, Homo sapiens
tccctttgtctttcaaac

SEQ ID NO: 4428961 - DNA, 20 bp, Homo sapiens
tcccttttctgttctagttt

SEQ ID NO: 4428962 - DNA, 23 bp, Homo sapiens
tccgactctttctgagtgccttc

SEQ ID NO: 4428963 - DNA, 14 bp, Homo sapiens
tccgactgcccaga

SEQ ID NO: 4428964 - DNA, 23 bp, Homo sapiens
tccgactgcccctgctgtgctgc

SEQ ID NO: 4428965 - DNA, 14 bp, Homo sapiens
tccgagaagctctc

SEQ ID NO: 4428966 - DNA, 21 bp, Homo sapiens
tccgaggctccccgcctccac

SEQ ID NO: 4428967 - DNA, 20 bp, Homo sapiens
tccgcaccctgtcctgcaca

SEQ ID NO: 4428968 - DNA, 15 bp, Homo sapiens
tccgcaggtgctggt

SEQ ID NO: 4428969 - DNA, 15 bp, Homo sapiens
tccgcatcacctcac

SEQ ID NO: 4428970 - DNA, 11 bp, Homo sapiens
tccgccagcct

SEQ ID NO: 4428971 - DNA, 16 bp, Homo sapiens
tccgccagcctcctct

SEQ ID NO: 4428972 - DNA, 20 bp, Homo sapiens
tccgccagcctcctctggac

SEQ ID NO: 4428973 - DNA, 14 bp, Homo sapiens
tccgcccagcctct

SEQ ID NO: 4428974 - DNA, 15 bp, Homo sapiens
tccgcccagcctctc

SEQ ID NO: 4428975 - DNA, 16 bp, Homo sapiens
tccgcccagcctctcc

SEQ ID NO: 4428976 - DNA, 16 bp, Homo sapiens
tccgcctccacactga

SEQ ID NO: 4428977 - DNA, 20 bp, Homo sapiens
tccgcctccacactgaccaa

SEQ ID NO: 4428978 - DNA, 16 bp, Homo sapiens
tccgccttttagtttt

SEQ ID NO: 4428979 - DNA, 17 bp, Homo sapiens
tccgcgccgatgccacc

SEQ ID NO: 4428980 - DNA, 19 bp, Homo sapiens
tccgcgccgatgccaccgg

SEQ ID NO: 4428981 - DNA, 20 bp, Homo sapiens
tccgctgtcgccccaggccc

SEQ ID NO: 4428982 - DNA, 13 bp, Homo sapiens
tccggaggactga

SEQ ID NO: 4428983 - DNA, 20 bp, Homo sapiens
tccggaggactgagccccca

SEQ ID NO: 4428984 - DNA, 19 bp, Homo sapiens
tccggcctctccctgcctg

SEQ ID NO: 4428985 - DNA, 13 bp, Homo sapiens
tccggctgtgctg

SEQ ID NO: 4428986 - DNA, 16 bp, Homo sapiens
tccggctgtgctggga

SEQ ID NO: 4428987 - DNA, 19 bp, Homo sapiens
tccgggcaccaggggccaa

SEQ ID NO: 4428988 - DNA, 16 bp, Homo sapiens
tccgggtgtggcctca

SEQ ID NO: 4428989 - DNA, 17 bp, Homo sapiens
tccgggtgtggcctcag

SEQ ID NO: 4428990 - DNA, 15 bp, Homo sapiens
tccggtcagccaagt

SEQ ID NO: 4428991 - DNA, 16 bp, Homo sapiens
tccggtttctttttgc

SEQ ID NO: 4428992 - DNA, 16 bp, Homo sapiens
tccgtagctcccctgg

SEQ ID NO: 4428993 - DNA, 14 bp, Homo sapiens
tccgtagttccctg

SEQ ID NO: 4428994 - DNA, 18 bp, Homo sapiens
tccgtcagcttctcccaa

SEQ ID NO: 4428995 - DNA, 20 bp, Homo sapiens
tccgtccatccgactgcccc

SEQ ID NO: 4428996 - DNA, 20 bp, Homo sapiens
tccgtgaatggtctctgtca

SEQ ID NO: 4428997 - DNA, 15 bp, Homo sapiens
tccgtgagacacaag

SEQ ID NO: 4428998 - DNA, 20 bp, Homo sapiens
tccgtgggaccctcagcagc

SEQ ID NO: 4428999 - DNA, 22 bp, Homo sapiens
tccgtgttgcaggttcatggat

SEQ ID NO: 4429000 - DNA, 16 bp, Homo sapiens
tccgtttccttacaca

SEQ ID NO: 4429001 - DNA, 13 bp, Homo sapiens
tcctaaaactggg

SEQ ID NO: 4429002 - DNA, 14 bp, Homo sapiens
tcctaaactctcta

SEQ ID NO: 4429003 - DNA, 23 bp, Homo sapiens
tcctaaagaaaaatatcttggcc

SEQ ID NO: 4429004 - DNA, 18 bp, Homo sapiens
tcctaaagagttattcaa

SEQ ID NO: 4429005 - DNA, 18 bp, Homo sapiens
tcctaagaatttttcatt

SEQ ID NO: 4429006 - DNA, 13 bp, Homo sapiens
tcctaaggaacct

SEQ ID NO: 4429007 - DNA, 16 bp, Homo sapiens
tcctaaggttcttgct

SEQ ID NO: 4429008 - DNA, 20 bp, Homo sapiens
tcctaaggttcttgctttct

SEQ ID NO: 4429009 - DNA, 23 bp, Homo sapiens
tcctaatgaaggttttcatttgc

SEQ ID NO: 4429010 - DNA, 19 bp, Homo sapiens
tcctaatggctatttttga

SEQ ID NO: 4429011 - DNA, 15 bp, Homo sapiens
tcctaatgtgatcat

SEQ ID NO: 4429012 - DNA, 19 bp, Homo sapiens
tcctaatgtgatcatatga

SEQ ID NO: 4429013 - DNA, 19 bp, Homo sapiens
tcctaatttctcctccctt

SEQ ID NO: 4429014 - DNA, 13 bp, Homo sapiens
tcctacagcacta

SEQ ID NO: 4429015 - DNA, 15 bp, Homo sapiens
tcctacagcactact

SEQ ID NO: 4429016 - DNA, 21 bp, Homo sapiens
tcctacagcactactgggtgt

SEQ ID NO: 4429017 - DNA, 16 bp, Homo sapiens
tcctacaggcagtctc

SEQ ID NO: 4429018 - DNA, 22 bp, Homo sapiens
tcctacaggcagtctctctctt

SEQ ID NO: 4429019 - DNA, 21 bp, Homo sapiens
tcctacaggcctatttaacaa

SEQ ID NO: 4429020 - DNA, 14 bp, Homo sapiens
tcctaccaagtcaa

SEQ ID NO: 4429021 - DNA, 17 bp, Homo sapiens
tcctaccatcagctctg

SEQ ID NO: 4429022 - DNA, 21 bp, Homo sapiens
tcctaccatcagctctgcctt

SEQ ID NO: 4429023 - DNA, 15 bp, Homo sapiens
tcctacccacacctc

SEQ ID NO: 4429024 - DNA, 15 bp, Homo sapiens
tcctaccccctgtgc

SEQ ID NO: 4429025 - DNA, 16 bp, Homo sapiens
tcctaccccctgtgcc

SEQ ID NO: 4429026 - DNA, 15 bp, Homo sapiens
tcctaccctgcctcc

SEQ ID NO: 4429027 - DNA, 17 bp, Homo sapiens
tcctagaagaaccaaat

SEQ ID NO: 4429028 - DNA, 14 bp, Homo sapiens
tcctagaagtctta

SEQ ID NO: 4429029 - DNA, 17 bp, Homo sapiens
tcctagaagtcttaatt

SEQ ID NO: 4429030 - DNA, 23 bp, Homo sapiens
tcctagaagtcttaattgtgttt

SEQ ID NO: 4429031 - DNA, 17 bp, Homo sapiens
tcctagagaacgcagcc

SEQ ID NO: 4429032 - DNA, 19 bp, Homo sapiens
tcctagagaacgcagccct

SEQ ID NO: 4429033 - DNA, 19 bp, Homo sapiens
tcctagagaagacaggctg

SEQ ID NO: 4429034 - DNA, 20 bp, Homo sapiens
tcctagagaagacaggctgg

SEQ ID NO: 4429035 - DNA, 22 bp, Homo sapiens
tcctagcaagtaagaatggcca

SEQ ID NO: 4429036 - DNA, 22 bp, Homo sapiens
tcctagcactgccccacatgca

SEQ ID NO: 4429037 - DNA, 16 bp, Homo sapiens
tcctagcccagtgctt

SEQ ID NO: 4429038 - DNA, 17 bp, Homo sapiens
tcctagctgtgtgaata

SEQ ID NO: 4429039 - DNA, 13 bp, Homo sapiens
tcctagctgttct

SEQ ID NO: 4429040 - DNA, 16 bp, Homo sapiens
tcctagtctttccagt

SEQ ID NO: 4429041 - DNA, 23 bp, Homo sapiens
tcatctattttgatgcagcattt

SEQ ID NO: 4429042 - DNA, 20 bp, Homo sapiens
tcatctcagagtccactgtg

SEQ ID NO: 4429043 - DNA, 16 bp, Homo sapiens
tcatctcatttaaggg

SEQ ID NO: 4429044 - DNA, 23 bp, Homo sapiens
tcatctcatttaagggaaaaata

SEQ ID NO: 4429045 - DNA, 21 bp, Homo sapiens
tcatctcccaggccccagggg

SEQ ID NO: 4429046 - DNA, 22 bp, Homo sapiens
tcatctcctgccttcctcctgg

SEQ ID NO: 4429047 - DNA, 23 bp, Homo sapiens
tcatctcctgccttcctcctggg

SEQ ID NO: 4429048 - DNA, 21 bp, Homo sapiens
tcatctctctggggccctggg

SEQ ID NO: 4429049 - DNA, 14 bp, Homo sapiens
tcatctcttagctc

SEQ ID NO: 4429050 - DNA, 19 bp, Homo sapiens
tcatctcttagctcccctc

SEQ ID NO: 4429051 - DNA, 23 bp, Homo sapiens
tcatctgaaggggcaaattcttt

SEQ ID NO: 4429052 - DNA, 14 bp, Homo sapiens
tcatctgctctcct

SEQ ID NO: 4429053 - DNA, 15 bp, Homo sapiens
tcatctgctctcctt

SEQ ID NO: 4429054 - DNA, 16 bp, Homo sapiens
tcatctgctctccttc

SEQ ID NO: 4429055 - DNA, 21 bp, Homo sapiens
tcatctgctctccttcctgga

SEQ ID NO: 4429056 - DNA, 21 bp, Homo sapiens
tcatctggataggagcctgct

SEQ ID NO: 4429057 - DNA, 23 bp, Homo sapiens
tcatctggataggagcctgctgg

SEQ ID NO: 4429058 - DNA, 17 bp, Homo sapiens
tcatctggggacctggt

SEQ ID NO: 4429059 - DNA, 15 bp, Homo sapiens
tcatctgtcaagtgg

SEQ ID NO: 4429060 - DNA, 19 bp, Homo sapiens
tcatctgtgggatgctgaa

SEQ ID NO: 4429061 - DNA, 16 bp, Homo sapiens
tcatcttcttctttaa

SEQ ID NO: 4429062 - DNA, 17 bp, Homo sapiens
tcatcttgctaccagta

SEQ ID NO: 4429063 - DNA, 13 bp, Homo sapiens
tcatcttgtgaaa

SEQ ID NO: 4429064 - DNA, 12 bp, Homo sapiens
tcatctttcttc

SEQ ID NO: 4429065 - DNA, 13 bp, Homo sapiens
tcatctttcttga

SEQ ID NO: 4429066 - DNA, 22 bp, Homo sapiens
tcatctttcttgatcaacatct

SEQ ID NO: 4429067 - DNA, 15 bp, Homo sapiens
tcatctttttctaga

SEQ ID NO: 4429068 - DNA, 13 bp, Homo sapiens
tcatgaagcctgt

SEQ ID NO: 4429069 - DNA, 15 bp, Homo sapiens
tcatgaagcctgtgg

SEQ ID NO: 4429070 - DNA, 16 bp, Homo sapiens
tcatgaagcctgtgga

SEQ ID NO: 4429071 - DNA, 19 bp, Homo sapiens
tcatgaatattttcaagtt

SEQ ID NO: 4429072 - DNA, 12 bp, Homo sapiens
tcatgaatttta

SEQ ID NO: 4429073 - DNA, 15 bp, Homo sapiens
tcatgaattttaaag

SEQ ID NO: 4429074 - DNA, 12 bp, Homo sapiens
tcatgactttat

SEQ ID NO: 4429075 - DNA, 19 bp, Homo sapiens
tcatgaggagggtggggga

SEQ ID NO: 4429076 - DNA, 13 bp, Homo sapiens
tcatgatctccct

SEQ ID NO: 4429077 - DNA, 14 bp, Homo sapiens
tcatgatctccctg

SEQ ID NO: 4429078 - DNA, 15 bp, Homo sapiens
tcatgatctccctgc

SEQ ID NO: 4429079 - DNA, 18 bp, Homo sapiens
tcatgatctccctgccgc

SEQ ID NO: 4429080 - DNA, 16 bp, Homo sapiens
tcatgatgcagtctcc

SEQ ID NO: 4429081 - DNA, 19 bp, Homo sapiens
tcatgatgcagtctcctct

SEQ ID NO: 4429082 - DNA, 13 bp, Homo sapiens
tcatgattagcaa

SEQ ID NO: 4429083 - DNA, 14 bp, Homo sapiens
tcatgattagcaag

SEQ ID NO: 4429084 - DNA, 11 bp, Homo sapiens
tcatgcaaaat

SEQ ID NO: 4429085 - DNA, 19 bp, Homo sapiens
tcatgcaaactgctttatt

SEQ ID NO: 4429086 - DNA, 17 bp, Homo sapiens
tcatgcacccctgagcc

SEQ ID NO: 4429087 - DNA, 20 bp, Homo sapiens
tcatgcacccctgagccagc

SEQ ID NO: 4429088 - DNA, 18 bp, Homo sapiens
tcatgcatgtcctgtaaa

SEQ ID NO: 4429089 - DNA, 15 bp, Homo sapiens
tcatgccagtatttt

SEQ ID NO: 4429090 - DNA, 13 bp, Homo sapiens
tcatgcccacccc

SEQ ID NO: 4429091 - DNA, 15 bp, Homo sapiens
tcatgcccaccccct

SEQ ID NO: 4429092 - DNA, 19 bp, Homo sapiens
tcatgctggaacctgcaaa

SEQ ID NO: 4429093 - DNA, 20 bp, Homo sapiens
tcatgctggaacctgcaaaa

SEQ ID NO: 4429094 - DNA, 23 bp, Homo sapiens
tcatgctgttgctgctactgtct

SEQ ID NO: 4429095 - DNA, 14 bp, Homo sapiens
tcatgcttaataaa

SEQ ID NO: 4429096 - DNA, 22 bp, Homo sapiens
tcatggcagaaggcaaacccat

SEQ ID NO: 4429097 - DNA, 19 bp, Homo sapiens
tcatggctaatttaacacc

SEQ ID NO: 4429098 - DNA, 23 bp, Homo sapiens
tcatgggagggggcttgaagcca

SEQ ID NO: 4429099 - DNA, 19 bp, Homo sapiens
tcatgggccactgcttttc

SEQ ID NO: 4429100 - DNA, 14 bp, Homo sapiens
tcatggggagtaat

SEQ ID NO: 4429101 - DNA, 17 bp, Homo sapiens
tcatgggtcctagccct

SEQ ID NO: 4429102 - DNA, 16 bp, Homo sapiens
tcatggtactacccca

SEQ ID NO: 4429103 - DNA, 16 bp, Homo sapiens
tcatggtacttcctct

SEQ ID NO: 4429104 - DNA, 14 bp, Homo sapiens
tcatggtagatttt

SEQ ID NO: 4429105 - DNA, 20 bp, Homo sapiens
tcatggtagatttttttcat

SEQ ID NO: 4429106 - DNA, 14 bp, Homo sapiens
tcatggtcacagta

SEQ ID NO: 4429107 - DNA, 14 bp, Homo sapiens
tcatgtaaactgtg

SEQ ID NO: 4429108 - DNA, 17 bp, Homo sapiens
tcatgtaataaacaggt

SEQ ID NO: 4429109 - DNA, 13 bp, Homo sapiens
tcatgtaatttta

SEQ ID NO: 4429110 - DNA, 15 bp, Homo sapiens
tcatgtatcatctgg

SEQ ID NO: 4429111 - DNA, 18 bp, Homo sapiens
tcatgtatcatctggata

SEQ ID NO: 4429112 - DNA, 15 bp, Homo sapiens
tcatgtatgtatata

SEQ ID NO: 4429113 - DNA, 11 bp, Homo sapiens
tcatgtctgta

SEQ ID NO: 4429114 - DNA, 14 bp, Homo sapiens
tcatgtctgtatac

SEQ ID NO: 4429115 - DNA, 20 bp, Homo sapiens
tcatgtctgtatactcctgt

SEQ ID NO: 4429116 - DNA, 18 bp, Homo sapiens
tcatgtgactctttccaa

SEQ ID NO: 4429117 - DNA, 19 bp, Homo sapiens
tcatgtgactctttccaac

SEQ ID NO: 4429118 - DNA, 18 bp, Homo sapiens
tcatgtggtactactgaa

SEQ ID NO: 4429119 - DNA, 16 bp, Homo sapiens
tcatgttaaattagaa

SEQ ID NO: 4429120 - DNA, 23 bp, Homo sapiens
tcatgttagttaccttatagtta

SEQ ID NO: 4429121 - DNA, 21 bp, Homo sapiens
tcatgttgatcatgtactttt

SEQ ID NO: 4429122 - DNA, 22 bp, Homo sapiens
tcatgttgttgtgtgtatatgt

SEQ ID NO: 4429123 - DNA, 15 bp, Homo sapiens
tcatgtttattttga

SEQ ID NO: 4429124 - DNA, 20 bp, Homo sapiens
tcattaaaacagaagcaaat

SEQ ID NO: 4429125 - DNA, 12 bp, Homo sapiens
tcattaaataaa

SEQ ID NO: 4429126 - DNA, 19 bp, Homo sapiens
tcattaaataaatttgact

SEQ ID NO: 4429127 - DNA, 17 bp, Homo sapiens
tcattaatagctgcctt

SEQ ID NO: 4429128 - DNA, 14 bp, Homo sapiens
tcattaattctata

SEQ ID NO: 4429129 - DNA, 18 bp, Homo sapiens
tcattaccttaaagcatc

SEQ ID NO: 4429130 - DNA, 15 bp, Homo sapiens
tcattacttgaatgt

SEQ ID NO: 4429131 - DNA, 17 bp, Homo sapiens
tcattagaattaccatt

SEQ ID NO: 4429132 - DNA, 18 bp, Homo sapiens
tcattagactcctcctcc

SEQ ID NO: 4429133 - DNA, 15 bp, Homo sapiens
tcattaggttttgct

SEQ ID NO: 4429134 - DNA, 14 bp, Homo sapiens
tcattagttttgaa

SEQ ID NO: 4429135 - DNA, 15 bp, Homo sapiens
tcattatctcacttt

SEQ ID NO: 4429136 - DNA, 18 bp, Homo sapiens
tcattatctttgctgtta

SEQ ID NO: 4429137 - DNA, 13 bp, Homo sapiens
tcattatgctttg

SEQ ID NO: 4429138 - DNA, 21 bp, Homo sapiens
tcattattgtagtttgaaagt

SEQ ID NO: 4429139 - DNA, 11 bp, Homo sapiens
tcattatttat

SEQ ID NO: 4429140 - DNA, 13 bp, Homo sapiens
tcattatttgtca

SEQ ID NO: 4429141 - DNA, 20 bp, Homo sapiens
tcattcaaatgaactttaaa

SEQ ID NO: 4429142 - DNA, 19 bp, Homo sapiens
tcattcaacacatttttaa

SEQ ID NO: 4429143 - DNA, 23 bp, Homo sapiens
tcattcaactctccaatgttcta

SEQ ID NO: 4429144 - DNA, 22 bp, Homo sapiens
tcattcaagtgtaaaatatttt

SEQ ID NO: 4429145 - DNA, 21 bp, Homo sapiens
tcattcagcagcaaattttca

SEQ ID NO: 4429146 - DNA, 23 bp, Homo sapiens
tcattcagcagcaaattttcagc

SEQ ID NO: 4429147 - DNA, 15 bp, Homo sapiens
tcattcatacttaaa

SEQ ID NO: 4429148 - DNA, 19 bp, Homo sapiens
tcattcatacttaaaaatt

SEQ ID NO: 4429149 - DNA, 12 bp, Homo sapiens
tcattcatgaat

SEQ ID NO: 4429150 - DNA, 17 bp, Homo sapiens
tcattcattcagtattt

SEQ ID NO: 4429151 - DNA, 18 bp, Homo sapiens
tcattccagatcccaggc

SEQ ID NO: 4429152 - DNA, 16 bp, Homo sapiens
tcattccatgtccata

SEQ ID NO: 4429153 - DNA, 15 bp, Homo sapiens
tcattcccagagtca

SEQ ID NO: 4429154 - DNA, 14 bp, Homo sapiens
tcattccccaggtg

SEQ ID NO: 4429155 - DNA, 16 bp, Homo sapiens
tcattcctcacaatga

SEQ ID NO: 4429156 - DNA, 20 bp, Homo sapiens
tcattccttcactcatccag

SEQ ID NO: 4429157 - DNA, 14 bp, Homo sapiens
tcattcggtgtgaa

SEQ ID NO: 4429158 - DNA, 18 bp, Homo sapiens
tcattctgaaggagcccc

SEQ ID NO: 4429159 - DNA, 16 bp, Homo sapiens
tcattctgctacttca

SEQ ID NO: 4429160 - DNA, 18 bp, Homo sapiens
tccagacagcctgtatct

SEQ ID NO: 4429161 - DNA, 19 bp, Homo sapiens
tccagacattctcgcttcc

SEQ ID NO: 4429162 - DNA, 13 bp, Homo sapiens
tccagacccccca

SEQ ID NO: 4429163 - DNA, 17 bp, Homo sapiens
tccagaccccccagccc

SEQ ID NO: 4429164 - DNA, 14 bp, Homo sapiens
tccagacctgagcg

SEQ ID NO: 4429165 - DNA, 23 bp, Homo sapiens
tccagacctgagcgggagtcagg

SEQ ID NO: 4429166 - DNA, 13 bp, Homo sapiens
tccagactttctt

SEQ ID NO: 4429167 - DNA, 19 bp, Homo sapiens
tccagactttctttttcta

SEQ ID NO: 4429168 - DNA, 17 bp, Homo sapiens
tccagagagcagctccc

SEQ ID NO: 4429169 - DNA, 15 bp, Homo sapiens
tccagagcagagcct

SEQ ID NO: 4429170 - DNA, 18 bp, Homo sapiens
tccagagcccaaggtcag

SEQ ID NO: 4429171 - DNA, 12 bp, Homo sapiens
tccagagggcac

SEQ ID NO: 4429172 - DNA, 18 bp, Homo sapiens
tccagagtccctgcctgg

SEQ ID NO: 4429173 - DNA, 20 bp, Homo sapiens
tccagagtccctgcctggac

SEQ ID NO: 4429174 - DNA, 16 bp, Homo sapiens
tccagatcctctctgg

SEQ ID NO: 4429175 - DNA, 17 bp, Homo sapiens
tccagatcctctctggg

SEQ ID NO: 4429176 - DNA, 19 bp, Homo sapiens
tccagcaattctcctgcct

SEQ ID NO: 4429177 - DNA, 21 bp, Homo sapiens
tccagcaattctcctgcctca

SEQ ID NO: 4429178 - DNA, 22 bp, Homo sapiens
tccagcaccttctttctggact

SEQ ID NO: 4429179 - DNA, 12 bp, Homo sapiens
tccagcagcagc

SEQ ID NO: 4429180 - DNA, 20 bp, Homo sapiens
tccagcagtctgataaactg

SEQ ID NO: 4429181 - DNA, 17 bp, Homo sapiens
tccagccaaagcatgcc

SEQ ID NO: 4429182 - DNA, 11 bp, Homo sapiens
tccagccagcg

SEQ ID NO: 4429183 - DNA, 18 bp, Homo sapiens
tccagccagcgcctccct

SEQ ID NO: 4429184 - DNA, 21 bp, Homo sapiens
tccagccagcgcctccctcca

SEQ ID NO: 4429185 - DNA, 23 bp, Homo sapiens
tccagccagcgcctccctccacc

SEQ ID NO: 4429186 - DNA, 14 bp, Homo sapiens
tccagcccctcctc

SEQ ID NO: 4429187 - DNA, 18 bp, Homo sapiens
tccagcccctcctccctc

SEQ ID NO: 4429188 - DNA, 20 bp, Homo sapiens
tccagcccctcctccctcag

SEQ ID NO: 4429189 - DNA, 16 bp, Homo sapiens
tccagccgccattgcc

SEQ ID NO: 4429190 - DNA, 18 bp, Homo sapiens
tccagccgccattgccac

SEQ ID NO: 4429191 - DNA, 14 bp, Homo sapiens
tccagcctcagaga

SEQ ID NO: 4429192 - DNA, 15 bp, Homo sapiens
tccagcctcccctcc

SEQ ID NO: 4429193 - DNA, 17 bp, Homo sapiens
tccagcctctgccgctg

SEQ ID NO: 4429194 - DNA, 18 bp, Homo sapiens
tccagcctctgccgctgc

SEQ ID NO: 4429195 - DNA, 21 bp, Homo sapiens
tccagcctctgccgctgccat

SEQ ID NO: 4429196 - DNA, 23 bp, Homo sapiens
tccagcctctgccgctgccatgc

SEQ ID NO: 4429197 - DNA, 22 bp, Homo sapiens
tccagcctgagtgacagagcga

SEQ ID NO: 4429198 - DNA, 16 bp, Homo sapiens
tccagcctgcctggca

SEQ ID NO: 4429199 - DNA, 12 bp, Homo sapiens
tccagcctgggc

SEQ ID NO: 4429200 - DNA, 22 bp, Homo sapiens
tccagcctgggcaacgagtgaa

SEQ ID NO: 4429201 - DNA, 23 bp, Homo sapiens
tccagcctgggcagccaggctgc

SEQ ID NO: 4429202 - DNA, 19 bp, Homo sapiens
tccagccttatgtgttaca

SEQ ID NO: 4429203 - DNA, 20 bp, Homo sapiens
tccagcgatggtgctgccca

SEQ ID NO: 4429204 - DNA, 22 bp, Homo sapiens
tccagcgatggtgctgcccagg

SEQ ID NO: 4429205 - DNA, 18 bp, Homo sapiens
tccagctccccccaagat

SEQ ID NO: 4429206 - DNA, 13 bp, Homo sapiens
tccagctctgccc

SEQ ID NO: 4429207 - DNA, 23 bp, Homo sapiens
tccagctgaccctggttctctct

SEQ ID NO: 4429208 - DNA, 21 bp, Homo sapiens
tccagctgctgagatcctgga

SEQ ID NO: 4429209 - DNA, 21 bp, Homo sapiens
tccagctgggaagcccttttt

SEQ ID NO: 4429210 - DNA, 21 bp, Homo sapiens
tccagctggggccagaggctg

SEQ ID NO: 4429211 - DNA, 22 bp, Homo sapiens
tccagctggggccagaggctgg

SEQ ID NO: 4429212 - DNA, 16 bp, Homo sapiens
tccagcttcggagggc

SEQ ID NO: 4429213 - DNA, 23 bp, Homo sapiens
tccagcttcggagggcccctgcg

SEQ ID NO: 4429214 - DNA, 19 bp, Homo sapiens
tccagcttgctcttcagtg

SEQ ID NO: 4429215 - DNA, 17 bp, Homo sapiens
tccagcttgtggagccc

SEQ ID NO: 4429216 - DNA, 20 bp, Homo sapiens
tccaggaaagagcagtcaga

SEQ ID NO: 4429217 - DNA, 20 bp, Homo sapiens
tccaggaatggtgctttatg

SEQ ID NO: 4429218 - DNA, 20 bp, Homo sapiens
tccaggatctttgactgaaa

SEQ ID NO: 4429219 - DNA, 21 bp, Homo sapiens
tccaggatggatgcatcacac

SEQ ID NO: 4429220 - DNA, 21 bp, Homo sapiens
tccaggcaccaggactagggc

SEQ ID NO: 4429221 - DNA, 18 bp, Homo sapiens
tccaggcaccctcaggga

SEQ ID NO: 4429222 - DNA, 14 bp, Homo sapiens
tccaggcactgaga

SEQ ID NO: 4429223 - DNA, 11 bp, Homo sapiens
tccaggcccaa

SEQ ID NO: 4429224 - DNA, 20 bp, Homo sapiens
tccaggcccaaggctcccgg

SEQ ID NO: 4429225 - DNA, 21 bp, Homo sapiens
tccaggcccccaacccctcct

SEQ ID NO: 4429226 - DNA, 22 bp, Homo sapiens
tccaggcccccaacccctcctc

SEQ ID NO: 4429227 - DNA, 13 bp, Homo sapiens
tccaggcccccag

SEQ ID NO: 4429228 - DNA, 15 bp, Homo sapiens
tccaggcccccagcc

SEQ ID NO: 4429229 - DNA, 16 bp, Homo sapiens
tccaggcccccagccc

SEQ ID NO: 4429230 - DNA, 19 bp, Homo sapiens
tccaggcccccagcccctc

SEQ ID NO: 4429231 - DNA, 22 bp, Homo sapiens
tccaggcccccagcccctcctc

SEQ ID NO: 4429232 - DNA, 14 bp, Homo sapiens
tccaggccctccag

SEQ ID NO: 4429233 - DNA, 19 bp, Homo sapiens
tccaggcctctctctgctc

SEQ ID NO: 4429234 - DNA, 13 bp, Homo sapiens
tccaggcctgcct

SEQ ID NO: 4429235 - DNA, 13 bp, Homo sapiens
tccaggctggcca

SEQ ID NO: 4429236 - DNA, 14 bp, Homo sapiens
tccaggctgttctc

SEQ ID NO: 4429237 - DNA, 18 bp, Homo sapiens
tccaggctgttctcagcg

SEQ ID NO: 4429238 - DNA, 20 bp, Homo sapiens
tccaggctgttctcagcgtt

SEQ ID NO: 4429239 - DNA, 21 bp, Homo sapiens
tccaggctgttctcagcgttt

SEQ ID NO: 4429240 - DNA, 16 bp, Homo sapiens
tccagggaaacagcct

SEQ ID NO: 4429241 - DNA, 20 bp, Homo sapiens
tccagggaaacagcctctct

SEQ ID NO: 4429242 - DNA, 14 bp, Homo sapiens
tccagggaagctgg

SEQ ID NO: 4429243 - DNA, 16 bp, Homo sapiens
tccagggaagctggcc

SEQ ID NO: 4429244 - DNA, 18 bp, Homo sapiens
tccagggaagctggccga

SEQ ID NO: 4429245 - DNA, 23 bp, Homo sapiens
tccagggaagctggccgagggtc

SEQ ID NO: 4429246 - DNA, 19 bp, Homo sapiens
tccagggaaggtggccaca

SEQ ID NO: 4429247 - DNA, 19 bp, Homo sapiens
tccagggaattcttacagc

SEQ ID NO: 4429248 - DNA, 15 bp, Homo sapiens
tccagggatgagcca

SEQ ID NO: 4429249 - DNA, 22 bp, Homo sapiens
tccagggatgattcaagccatt

SEQ ID NO: 4429250 - DNA, 17 bp, Homo sapiens
tccagggctggactgag

SEQ ID NO: 4429251 - DNA, 14 bp, Homo sapiens
tccaggggtcctag

SEQ ID NO: 4429252 - DNA, 19 bp, Homo sapiens
tccaggggtcctaggcctc

SEQ ID NO: 4429253 - DNA, 23 bp, Homo sapiens
tccagggtcctctcttccacagt

SEQ ID NO: 4429254 - DNA, 18 bp, Homo sapiens
tccaggtgttactgtaat

SEQ ID NO: 4429255 - DNA, 20 bp, Homo sapiens
tccaggttccctcccagagg

SEQ ID NO: 4429256 - DNA, 16 bp, Homo sapiens
tccagtaacctcggag

SEQ ID NO: 4429257 - DNA, 15 bp, Homo sapiens
tccagtaatctaata

SEQ ID NO: 4429258 - DNA, 19 bp, Homo sapiens
tccagtacgtcccgctgct

SEQ ID NO: 4429259 - DNA, 16 bp, Homo sapiens
tccagtaggatccagt

SEQ ID NO: 4429260 - DNA, 21 bp, Homo sapiens
tccagtataagactactgaat

SEQ ID NO: 4429261 - DNA, 23 bp, Homo sapiens
tccagtcatggtactaccccagc

SEQ ID NO: 4429262 - DNA, 20 bp, Homo sapiens
tccagtcctaactttctgaa

SEQ ID NO: 4429263 - DNA, 14 bp, Homo sapiens
tccagtctggaaaa

SEQ ID NO: 4429264 - DNA, 17 bp, Homo sapiens
tccagtctggagagctg

SEQ ID NO: 4429265 - DNA, 19 bp, Homo sapiens
tccagtcttcctgacactt

SEQ ID NO: 4429266 - DNA, 16 bp, Homo sapiens
tccagtgctctgcctc

SEQ ID NO: 4429267 - DNA, 18 bp, Homo sapiens
tccagtgctctgcctcag

SEQ ID NO: 4429268 - DNA, 19 bp, Homo sapiens
tccagtgctggatttgatg

SEQ ID NO: 4429269 - DNA, 21 bp, Homo sapiens
tccagtgggctgatgctggga

SEQ ID NO: 4429270 - DNA, 14 bp, Homo sapiens
tccagtgttctatt

SEQ ID NO: 4429271 - DNA, 22 bp, Homo sapiens
tccagttaaaaaaaattttaat

SEQ ID NO: 4429272 - DNA, 14 bp, Homo sapiens
tccagtttctttcc

SEQ ID NO: 4429273 - DNA, 21 bp, Homo sapiens
tccagtttgcccaccacaact

SEQ ID NO: 4429274 - DNA, 17 bp, Homo sapiens
tccagtttgttctccgg

SEQ ID NO: 4429275 - DNA, 13 bp, Homo sapiens
tccagtttttctt

SEQ ID NO: 4429276 - DNA, 13 bp, Homo sapiens
tccataaagaccc

SEQ ID NO: 4429277 - DNA, 22 bp, Homo sapiens
tccataatgcattcttctctgt

SEQ ID NO: 4429278 - DNA, 16 bp, Homo sapiens
tccatacagcctctac

SEQ ID NO: 4429279 - DNA, 20 bp, Homo sapiens
tccataccttttctcttttc

SEQ ID NO: 4429280 - DNA, 17 bp, Homo sapiens
tccatagctgctgccct

SEQ ID NO: 4429281 - DNA, 15 bp, Homo sapiens
tccatatcacacaca

SEQ ID NO: 4429282 - DNA, 24 bp, Homo sapiens
tccatatctccttcccctacacct

SEQ ID NO: 4429283 - DNA, 14 bp, Homo sapiens
tccatcagaaaacc

SEQ ID NO: 4429284 - DNA, 21 bp, Homo sapiens
tccatcaggtgaggtgtgctc

SEQ ID NO: 4429285 - DNA, 17 bp, Homo sapiens
tccatcatcactgtaaa

SEQ ID NO: 4429286 - DNA, 14 bp, Homo sapiens
tccatcatgtctgt

SEQ ID NO: 4429287 - DNA, 16 bp, Homo sapiens
tccatccccctgcctc

SEQ ID NO: 4429288 - DNA, 12 bp, Homo sapiens
tccatcccctcc

SEQ ID NO: 4429289 - DNA, 16 bp, Homo sapiens
tccatcccctccctgc

SEQ ID NO: 4429290 - DNA, 17 bp, Homo sapiens
tccatcccctccctgcc

SEQ ID NO: 4429291 - DNA, 18 bp, Homo sapiens
tccatccgactgcccctg

SEQ ID NO: 4429292 - DNA, 22 bp, Homo sapiens
tccatctcaaaaaaaaaaaaga

SEQ ID NO: 4429293 - DNA, 18 bp, Homo sapiens
tccatctccgcctccaca

SEQ ID NO: 4429294 - DNA, 14 bp, Homo sapiens
tccatctcttctgc

SEQ ID NO: 4429295 - DNA, 14 bp, Homo sapiens
tccatctgacaaaa

SEQ ID NO: 4429296 - DNA, 15 bp, Homo sapiens
tccatctggcagggt

SEQ ID NO: 4429297 - DNA, 22 bp, Homo sapiens
tccatgaatcattgtggtggtt

SEQ ID NO: 4429298 - DNA, 15 bp, Homo sapiens
tccatgacaggcctg

SEQ ID NO: 4429299 - DNA, 20 bp, Homo sapiens
tccatgacaggcctgaagat

SEQ ID NO: 4429300 - DNA, 16 bp, Homo sapiens
tccatgatgatagttg

SEQ ID NO: 4429301 - DNA, 21 bp, Homo sapiens
tccatgcaactggagttcctt

SEQ ID NO: 4429302 - DNA, 19 bp, Homo sapiens
tccatgcatgacagcctct

SEQ ID NO: 4429303 - DNA, 20 bp, Homo sapiens
tccatgcctgtagctttcct

SEQ ID NO: 4429304 - DNA, 21 bp, Homo sapiens
tccatgcctgtagctttcctg

SEQ ID NO: 4429305 - DNA, 17 bp, Homo sapiens
tccatgctccttgagag

SEQ ID NO: 4429306 - DNA, 14 bp, Homo sapiens
tccatgctgggtct

SEQ ID NO: 4429307 - DNA, 17 bp, Homo sapiens
tccatgctgggtctgag

SEQ ID NO: 4429308 - DNA, 9 bp, Homo sapiens
tccatgctt

SEQ ID NO: 4429309 - DNA, 14 bp, Homo sapiens
tccatgcttcactc

SEQ ID NO: 4429310 - DNA, 23 bp, Homo sapiens
tccatgcttctcatcttgtgaaa

SEQ ID NO: 4429311 - DNA, 14 bp, Homo sapiens
tccatggccctgtc

SEQ ID NO: 4429312 - DNA, 20 bp, Homo sapiens
tccatggccctgtcccaggc

SEQ ID NO: 4429313 - DNA, 16 bp, Homo sapiens
tccatgggcagagccc

SEQ ID NO: 4429314 - DNA, 17 bp, Homo sapiens
tccatgggcagagccca

SEQ ID NO: 4429315 - DNA, 21 bp, Homo sapiens
tccatggtactgtagcagggg

SEQ ID NO: 4429316 - DNA, 15 bp, Homo sapiens
tccatgtagcaggac

SEQ ID NO: 4429317 - DNA, 14 bp, Homo sapiens
tccatgtcggcctc

SEQ ID NO: 4429318 - DNA, 21 bp, Homo sapiens
tccatgtcggcctctaacccc

SEQ ID NO: 4429319 - DNA, 12 bp, Homo sapiens
tccatgtgcctt

SEQ ID NO: 4429320 - DNA, 13 bp, Homo sapiens
tccatgtgccttt

SEQ ID NO: 4429321 - DNA, 22 bp, Homo sapiens
tccatgtgcctttctttgcctc

SEQ ID NO: 4429322 - DNA, 19 bp, Homo sapiens
tccattaaaaaaaacagaa

SEQ ID NO: 4429323 - DNA, 22 bp, Homo sapiens
tccattaatttaaatgatttaa

SEQ ID NO: 4429324 - DNA, 15 bp, Homo sapiens
tccattatgaaaatc

SEQ ID NO: 4429325 - DNA, 19 bp, Homo sapiens
tccattcacaagcctcctg

SEQ ID NO: 4429326 - DNA, 13 bp, Homo sapiens
tccattcctcagg

SEQ ID NO: 4429327 - DNA, 14 bp, Homo sapiens
tccattcctcaggg

SEQ ID NO: 4429328 - DNA, 15 bp, Homo sapiens
tccattcctcaggga

SEQ ID NO: 4429329 - DNA, 15 bp, Homo sapiens
tccattctcctcagt

SEQ ID NO: 4429330 - DNA, 18 bp, Homo sapiens
tccattctcctcagtggc

SEQ ID NO: 4429331 - DNA, 11 bp, Homo sapiens
tccattgttgt

SEQ ID NO: 4429332 - DNA, 16 bp, Homo sapiens
tccatttaagacacat

SEQ ID NO: 4429333 - DNA, 23 bp, Homo sapiens
tccatttaatcaatatttaagag

SEQ ID NO: 4429334 - DNA, 12 bp, Homo sapiens
tccatttcctaa

SEQ ID NO: 4429335 - DNA, 16 bp, Homo sapiens
tccatttctctcctta

SEQ ID NO: 4429336 - DNA, 19 bp, Homo sapiens
tccatttggcactatggtt

SEQ ID NO: 4429337 - DNA, 13 bp, Homo sapiens
tccattttaacaa

SEQ ID NO: 4429338 - DNA, 19 bp, Homo sapiens
tccattttaggtgataaaa

SEQ ID NO: 4429339 - DNA, 23 bp, Homo sapiens
tccattttcctacaggcagtctc

SEQ ID NO: 4429340 - DNA, 24 bp, Homo sapiens
tccatttttacaagttatagtact

SEQ ID NO: 4429341 - DNA, 23 bp, Homo sapiens
tccatttttctcccaagaaacct

SEQ ID NO: 4429342 - DNA, 17 bp, Homo sapiens
tccatttttttctttac

SEQ ID NO: 4429343 - DNA, 20 bp, Homo sapiens
tccatttttttctttactta

SEQ ID NO: 4429344 - DNA, 23 bp, Homo sapiens
tcccaaaacaatctatttaaaaa

SEQ ID NO: 4429345 - DNA, 20 bp, Homo sapiens
tcccaaaatgttgaaatatg

SEQ ID NO: 4429346 - DNA, 20 bp, Homo sapiens
tcccaaaccacgcctcttga

SEQ ID NO: 4429347 - DNA, 24 bp, Homo sapiens
tcccaaacgccctttcctcctcag

SEQ ID NO: 4429348 - DNA, 13 bp, Homo sapiens
tcccaaagcaagg

SEQ ID NO: 4429349 - DNA, 21 bp, Homo sapiens
tcccaaagtccccctcctcag

SEQ ID NO: 4429350 - DNA, 23 bp, Homo sapiens
tcccaaagtgaactctcaaatcc

SEQ ID NO: 4429351 - DNA, 21 bp, Homo sapiens
tcccaaagtgttgggattaca

SEQ ID NO: 4429352 - DNA, 17 bp, Homo sapiens
tcccaaatttgattgat

SEQ ID NO: 4429353 - DNA, 12 bp, Homo sapiens
tcccaacatggg

SEQ ID NO: 4429354 - DNA, 16 bp, Homo sapiens
tcccaacatgggaggg

SEQ ID NO: 4429355 - DNA, 20 bp, Homo sapiens
tcccaacatgggagggatca

SEQ ID NO: 4429356 - DNA, 21 bp, Homo sapiens
tcccaacatgggagggatcag

SEQ ID NO: 4429357 - DNA, 22 bp, Homo sapiens
tcccaacctctttttcctcctg

SEQ ID NO: 4429358 - DNA, 10 bp, Homo sapiens
tcccaactcc

SEQ ID NO: 4429359 - DNA, 21 bp, Homo sapiens
tcccaacttctcttgctttct

SEQ ID NO: 4429360 - DNA, 14 bp, Homo sapiens
tcccaagatttttt

SEQ ID NO: 4429361 - DNA, 21 bp, Homo sapiens
tcccaagcgttcctggccttc

SEQ ID NO: 4429362 - DNA, 13 bp, Homo sapiens
tcccaagctaggc

SEQ ID NO: 4429363 - DNA, 21 bp, Homo sapiens
tcccaagctgggccccagccc

SEQ ID NO: 4429364 - DNA, 22 bp, Homo sapiens
tcccaagctgggccccagccca

SEQ ID NO: 4429365 - DNA, 15 bp, Homo sapiens
tcccaaggcaagcat

SEQ ID NO: 4429366 - DNA, 23 bp, Homo sapiens
tcccaaggccaagattgtccttt

SEQ ID NO: 4429367 - DNA, 20 bp, Homo sapiens
tcccaagggtgccctttggg

SEQ ID NO: 4429368 - DNA, 12 bp, Homo sapiens
tcccaagtgcca

SEQ ID NO: 4429369 - DNA, 12 bp, Homo sapiens
tcccaagtggtg

SEQ ID NO: 4429370 - DNA, 16 bp, Homo sapiens
tcccaatcagcttttg

SEQ ID NO: 4429371 - DNA, 15 bp, Homo sapiens
tcccaatctgaaatt

SEQ ID NO: 4429372 - DNA, 21 bp, Homo sapiens
tcccaatctgaaattcaaaat

SEQ ID NO: 4429373 - DNA, 13 bp, Homo sapiens
tcccaattaaaat

SEQ ID NO: 4429374 - DNA, 17 bp, Homo sapiens
tcccaattaaaatacta

SEQ ID NO: 4429375 - DNA, 16 bp, Homo sapiens
tcccaattgagaaaaa

SEQ ID NO: 4429376 - DNA, 20 bp, Homo sapiens
tcccacaccgcgtcccagct

SEQ ID NO: 4429377 - DNA, 20 bp, Homo sapiens
tcccacagagtgctggactg

SEQ ID NO: 4429378 - DNA, 21 bp, Homo sapiens
tcccacagcagccccaggaga

SEQ ID NO: 4429379 - DNA, 17 bp, Homo sapiens
tcccacaggacatttct

SEQ ID NO: 4429380 - DNA, 21 bp, Homo sapiens
tcccacaggacatttctctaa

SEQ ID NO: 4429381 - DNA, 14 bp, Homo sapiens
tcccacaggagggc

SEQ ID NO: 4429382 - DNA, 14 bp, Homo sapiens
tcccacatgaggcc

SEQ ID NO: 4429383 - DNA, 23 bp, Homo sapiens
tcccacatgaggccatctcagga

SEQ ID NO: 4429384 - DNA, 15 bp, Homo sapiens
tcccacatgcctgcg

SEQ ID NO: 4429385 - DNA, 21 bp, Homo sapiens
tcccaccagaacgcaccccac

SEQ ID NO: 4429386 - DNA, 22 bp, Homo sapiens
tcccacccacccgccgcctccc

SEQ ID NO: 4429387 - DNA, 16 bp, Homo sapiens
tcccacccacctcacc

SEQ ID NO: 4429388 - DNA, 12 bp, Homo sapiens
tcccaccccacc

SEQ ID NO: 4429389 - DNA, 17 bp, Homo sapiens
tcccacccccagccccg

SEQ ID NO: 4429390 - DNA, 19 bp, Homo sapiens
tcccacccccttctctgct

SEQ ID NO: 4429391 - DNA, 22 bp, Homo sapiens
tcccacccccttctctgctcca

SEQ ID NO: 4429392 - DNA, 22 bp, Homo sapiens
tcccacccggccacagctgctg

SEQ ID NO: 4429393 - DNA, 12 bp, Homo sapiens
tcccaccctccc

SEQ ID NO: 4429394 - DNA, 16 bp, Homo sapiens
tcccaccgctgcctcg

SEQ ID NO: 4429395 - DNA, 16 bp, Homo sapiens
tcccacctggctctgt

SEQ ID NO: 4429396 - DNA, 17 bp, Homo sapiens
tcccacctgtttctgga

SEQ ID NO: 4429397 - DNA, 15 bp, Homo sapiens
tcccacgccaggcca

SEQ ID NO: 4429398 - DNA, 18 bp, Homo sapiens
tcccacgccaggccagca

SEQ ID NO: 4429399 - DNA, 13 bp, Homo sapiens
tcccactcacccc

SEQ ID NO: 4429400 - DNA, 15 bp, Homo sapiens
tcccactgttctgaa

SEQ ID NO: 4429401 - DNA, 18 bp, Homo sapiens
tcccacttaaaaattaaa

SEQ ID NO: 4429402 - DNA, 18 bp, Homo sapiens
tcccagaagtccacagga

SEQ ID NO: 4429403 - DNA, 21 bp, Homo sapiens
tcccagaagtccacaggacgc

SEQ ID NO: 4429404 - DNA, 15 bp, Homo sapiens
tcccagacaggccct

SEQ ID NO: 4429405 - DNA, 16 bp, Homo sapiens
tcccagacaggccctc

SEQ ID NO: 4429406 - DNA, 18 bp, Homo sapiens
tcccagacaggccctccc

SEQ ID NO: 4429407 - DNA, 16 bp, Homo sapiens
tcccagagacaggaaa

SEQ ID NO: 4429408 - DNA, 20 bp, Homo sapiens
tcccagagacaggaaaatcc

SEQ ID NO: 4429409 - DNA, 21 bp, Homo sapiens
tcccagaggagccaccagttc

SEQ ID NO: 4429410 - DNA, 21 bp, Homo sapiens
tcccagaggtgggatcctccc

SEQ ID NO: 4429411 - DNA, 16 bp, Homo sapiens
tcccagataatgtgaa

SEQ ID NO: 4429412 - DNA, 14 bp, Homo sapiens
tcccagatgtaaag

SEQ ID NO: 4429413 - DNA, 16 bp, Homo sapiens
tcccagatgtaaagaa

SEQ ID NO: 4429414 - DNA, 18 bp, Homo sapiens
tcccagattggctcacac

SEQ ID NO: 4429415 - DNA, 22 bp, Homo sapiens
tcccagcactatgctttccttc

SEQ ID NO: 4429416 - DNA, 15 bp, Homo sapiens
tcccagcatccctgg

SEQ ID NO: 4429417 - DNA, 22 bp, Homo sapiens
tcccagcattgctactgctcag

SEQ ID NO: 4429418 - DNA, 13 bp, Homo sapiens
tcccagccaggcc

SEQ ID NO: 4429419 - DNA, 15 bp, Homo sapiens
tcccagccaggccct

SEQ ID NO: 4429420 - DNA, 21 bp, Homo sapiens
tcccagccccggcaagccaca

SEQ ID NO: 4429421 - DNA, 22 bp, Homo sapiens
tcccagccccggcaagccacag

SEQ ID NO: 4429422 - DNA, 19 bp, Homo sapiens
tcccagcccctcctccctc

SEQ ID NO: 4429423 - DNA, 12 bp, Homo sapiens
tcccagcccctg

SEQ ID NO: 4429424 - DNA, 13 bp, Homo sapiens
tcccagcccctgc

SEQ ID NO: 4429425 - DNA, 16 bp, Homo sapiens
tcccagcccctgcaga

SEQ ID NO: 4429426 - DNA, 22 bp, Homo sapiens
tcccagctactggggaggctga

SEQ ID NO: 4429427 - DNA, 20 bp, Homo sapiens
tcccagctaggaagagcagg

SEQ ID NO: 4429428 - DNA, 19 bp, Homo sapiens
tcccagctctccctctggc

SEQ ID NO: 4429429 - DNA, 23 bp, Homo sapiens
tcccagctctccctctggccctg

SEQ ID NO: 4429430 - DNA, 15 bp, Homo sapiens
tcccaggaagcccag

SEQ ID NO: 4429431 - DNA, 16 bp, Homo sapiens
tcccaggaagcccagg

SEQ ID NO: 4429432 - DNA, 21 bp, Homo sapiens
tcccaggacctcggatgacca

SEQ ID NO: 4429433 - DNA, 15 bp, Homo sapiens
tcccaggagaccatt

SEQ ID NO: 4429434 - DNA, 19 bp, Homo sapiens
tcccaggagatgggtccag

SEQ ID NO: 4429435 - DNA, 22 bp, Homo sapiens
tcccaggagtggaggaggcctg

SEQ ID NO: 4429436 - DNA, 14 bp, Homo sapiens
tcccaggccccagg

SEQ ID NO: 4429437 - DNA, 22 bp, Homo sapiens
tcccaggcccctggaggctgcc

SEQ ID NO: 4429438 - DNA, 18 bp, Homo sapiens
tcccaggccggcccagat

SEQ ID NO: 4429439 - DNA, 19 bp, Homo sapiens
tcccaggccggcccagatg

SEQ ID NO: 4429440 - DNA, 12 bp, Homo sapiens
tcccagggacct

SEQ ID NO: 4429441 - DNA, 19 bp, Homo sapiens
tcccagggcacccaggcag

SEQ ID NO: 4429442 - DNA, 22 bp, Homo sapiens
tcccaggggcagccacaccact

SEQ ID NO: 4429443 - DNA, 19 bp, Homo sapiens
tcccaggggtctccctggc

SEQ ID NO: 4429444 - DNA, 20 bp, Homo sapiens
tcccaggggtctccctggct

SEQ ID NO: 4429445 - DNA, 18 bp, Homo sapiens
tcccagggtagcccgcct

SEQ ID NO: 4429446 - DNA, 22 bp, Homo sapiens
tcccagggtagcccgcctgcca

SEQ ID NO: 4429447 - DNA, 19 bp, Homo sapiens
tcccaggtaatttaaattg

SEQ ID NO: 4429448 - DNA, 16 bp, Homo sapiens
tcccaggtaccagctg

SEQ ID NO: 4429449 - DNA, 16 bp, Homo sapiens
tcccaggttcccccag

SEQ ID NO: 4429450 - DNA, 16 bp, Homo sapiens
tcccagtatgttttaa

SEQ ID NO: 4429451 - DNA, 19 bp, Homo sapiens
tcccagtatgttttaacaa

SEQ ID NO: 4429452 - DNA, 14 bp, Homo sapiens
tcccagtcatttaa

SEQ ID NO: 4429453 - DNA, 22 bp, Homo sapiens
tcccagtcatttaataaatgtg

SEQ ID NO: 4429454 - DNA, 20 bp, Homo sapiens
tcccagtccaaatgtcctcc

SEQ ID NO: 4429455 - DNA, 15 bp, Homo sapiens
tcccagtcctgcctg

SEQ ID NO: 4429456 - DNA, 17 bp, Homo sapiens
tcccagtctacccagag

SEQ ID NO: 4429457 - DNA, 18 bp, Homo sapiens
tcccagtctacccagaga

SEQ ID NO: 4429458 - DNA, 12 bp, Homo sapiens
tcccagtgacaa

SEQ ID NO: 4429459 - DNA, 15 bp, Homo sapiens
tcccatcagggaaga

SEQ ID NO: 4429460 - DNA, 13 bp, Homo sapiens
tcccatctggctc

SEQ ID NO: 4429461 - DNA, 15 bp, Homo sapiens
tcccatgaagccttt

SEQ ID NO: 4429462 - DNA, 19 bp, Homo sapiens
tcccatgaagccttttgaa

SEQ ID NO: 4429463 - DNA, 21 bp, Homo sapiens
tcccatgaagccttttgaaag

SEQ ID NO: 4429464 - DNA, 23 bp, Homo sapiens
tcccatgagggagatgccatgag

SEQ ID NO: 4429465 - DNA, 22 bp, Homo sapiens
tcccatgccggtacacagccag

SEQ ID NO: 4429466 - DNA, 17 bp, Homo sapiens
tcccatggagccccagc

SEQ ID NO: 4429467 - DNA, 22 bp, Homo sapiens
tcccatgtatttgttatatata

SEQ ID NO: 4429468 - DNA, 18 bp, Homo sapiens
tcccatgtcccaccctcc

SEQ ID NO: 4429469 - DNA, 18 bp, Homo sapiens
tcccatgttgaagtaatt

SEQ ID NO: 4429470 - DNA, 12 bp, Homo sapiens
tcccattaaaaa

SEQ ID NO: 4429471 - DNA, 15 bp, Homo sapiens
tcccattcctccctc

SEQ ID NO: 4429472 - DNA, 13 bp, Homo sapiens
tcccattctagat

SEQ ID NO: 4429473 - DNA, 14 bp, Homo sapiens
tcccattctagatc

SEQ ID NO: 4429474 - DNA, 22 bp, Homo sapiens
tcccattctagatcctgcaccc

SEQ ID NO: 4429475 - DNA, 15 bp, Homo sapiens
tcccattgcccagtg

SEQ ID NO: 4429476 - DNA, 18 bp, Homo sapiens
tcccattgcccagtgagc

SEQ ID NO: 4429477 - DNA, 16 bp, Homo sapiens
tcccattgtggctcct

SEQ ID NO: 4429478 - DNA, 15 bp, Homo sapiens
tcccatttcttgcta

SEQ ID NO: 4429479 - DNA, 18 bp, Homo sapiens
tcccattttggaatttgc

SEQ ID NO: 4429480 - DNA, 18 bp, Homo sapiens
tccccaaacaggacagca

SEQ ID NO: 4429481 - DNA, 18 bp, Homo sapiens
tccccaaaggacgcctgc

SEQ ID NO: 4429482 - DNA, 18 bp, Homo sapiens
tccccaaatcaatacact

SEQ ID NO: 4429483 - DNA, 17 bp, Homo sapiens
tccccaacacctgcctc

SEQ ID NO: 4429484 - DNA, 18 bp, Homo sapiens
tccccaacacctgcctct

SEQ ID NO: 4429485 - DNA, 15 bp, Homo sapiens
tccccaacgtcccct

SEQ ID NO: 4429486 - DNA, 18 bp, Homo sapiens
tccccaacgtcccctccg

SEQ ID NO: 4429487 - DNA, 19 bp, Homo sapiens
tccccaacgtcccctccgc

SEQ ID NO: 4429488 - DNA, 20 bp, Homo sapiens
tccccaacgtcccctccgcc

SEQ ID NO: 4429489 - DNA, 13 bp, Homo sapiens
tccccaactccat

SEQ ID NO: 4429490 - DNA, 13 bp, Homo sapiens
tccccaactgctc

SEQ ID NO: 4429491 - DNA, 14 bp, Homo sapiens
tccccaactgctcc

SEQ ID NO: 4429492 - DNA, 15 bp, Homo sapiens
tccccaactgctcca

SEQ ID NO: 4429493 - DNA, 17 bp, Homo sapiens
tccccaactgctccagc

SEQ ID NO: 4429494 - DNA, 15 bp, Homo sapiens
tccccaataaagcct

SEQ ID NO: 4429495 - DNA, 16 bp, Homo sapiens
tccccaatttagtcta

SEQ ID NO: 4429496 - DNA, 13 bp, Homo sapiens
tccccaccccacc

SEQ ID NO: 4429497 - DNA, 22 bp, Homo sapiens
tccccacccccctctctttctc

SEQ ID NO: 4429498 - DNA, 18 bp, Homo sapiens
tccccacccctgccccca

SEQ ID NO: 4429499 - DNA, 15 bp, Homo sapiens
tccccacgagggctg

SEQ ID NO: 4429500 - DNA, 20 bp, Homo sapiens
tccccacgagggctggctgg

SEQ ID NO: 4429501 - DNA, 23 bp, Homo sapiens
tccccactcccccgtttctcctt

SEQ ID NO: 4429502 - DNA, 21 bp, Homo sapiens
tccccacttcactttcttcaa

SEQ ID NO: 4429503 - DNA, 17 bp, Homo sapiens
tccccagaaaggagact

SEQ ID NO: 4429504 - DNA, 13 bp, Homo sapiens
tccccagacccag

SEQ ID NO: 4429505 - DNA, 14 bp, Homo sapiens
tccccagacccaga

SEQ ID NO: 4429506 - DNA, 19 bp, Homo sapiens
tccccagacccagaggtcc

SEQ ID NO: 4429507 - DNA, 11 bp, Homo sapiens
tccccagagag

SEQ ID NO: 4429508 - DNA, 12 bp, Homo sapiens
tccccagagctc

SEQ ID NO: 4429509 - DNA, 14 bp, Homo sapiens
tccccagaggctcc

SEQ ID NO: 4429510 - DNA, 16 bp, Homo sapiens
tccccagaggctccca

SEQ ID NO: 4429511 - DNA, 14 bp, Homo sapiens
tccccagccacagg

SEQ ID NO: 4429512 - DNA, 24 bp, Homo sapiens
tccccagccccagccccttccatg

SEQ ID NO: 4429513 - DNA, 18 bp, Homo sapiens
tccccagccccctcccac

SEQ ID NO: 4429514 - DNA, 22 bp, Homo sapiens
tccccagccccctcccaccgct

SEQ ID NO: 4429515 - DNA, 24 bp, Homo sapiens
tcagccctcagttccttcatttcc

SEQ ID NO: 4429516 - DNA, 18 bp, Homo sapiens
tcagccctgattgtgcca

SEQ ID NO: 4429517 - DNA, 23 bp, Homo sapiens
tcagccctgctccctgcctcctg

SEQ ID NO: 4429518 - DNA, 12 bp, Homo sapiens
tcagccctgggc

SEQ ID NO: 4429519 - DNA, 14 bp, Homo sapiens
tcagcctccagcct

SEQ ID NO: 4429520 - DNA, 15 bp, Homo sapiens
tcagcctccagcctc

SEQ ID NO: 4429521 - DNA, 16 bp, Homo sapiens
tcagcctccagcctct

SEQ ID NO: 4429522 - DNA, 17 bp, Homo sapiens
tcagcctccagcctctg

SEQ ID NO: 4429523 - DNA, 12 bp, Homo sapiens
tcagcctcccat

SEQ ID NO: 4429524 - DNA, 20 bp, Homo sapiens
tcagcctcccgagtagctgg

SEQ ID NO: 4429525 - DNA, 20 bp, Homo sapiens
tcagcctccctagtagctgg

SEQ ID NO: 4429526 - DNA, 17 bp, Homo sapiens
tcagcctctctcccagt

SEQ ID NO: 4429527 - DNA, 18 bp, Homo sapiens
tcagcctctctcccagtc

SEQ ID NO: 4429528 - DNA, 19 bp, Homo sapiens
tcagcctctctcccagtct

SEQ ID NO: 4429529 - DNA, 20 bp, Homo sapiens
tcagcctctctcccagtcta

SEQ ID NO: 4429530 - DNA, 21 bp, Homo sapiens
tcagcctctctcccagtctac

SEQ ID NO: 4429531 - DNA, 16 bp, Homo sapiens
tcagcctctgctggag

SEQ ID NO: 4429532 - DNA, 18 bp, Homo sapiens
tcagcctgctttcctgca

SEQ ID NO: 4429533 - DNA, 21 bp, Homo sapiens
tcagcctgctttcctgcagca

SEQ ID NO: 4429534 - DNA, 17 bp, Homo sapiens
tcagtggcaacttgtga

SEQ ID NO: 4429535 - DNA, 14 bp, Homo sapiens
tcagtggccaggtg

SEQ ID NO: 4429536 - DNA, 16 bp, Homo sapiens
tcagtggccaggtgcc

SEQ ID NO: 4429537 - DNA, 15 bp, Homo sapiens
tcagtgggaacgtga

SEQ ID NO: 4429538 - DNA, 19 bp, Homo sapiens
tcagtgggaacgtgactgc

SEQ ID NO: 4429539 - DNA, 12 bp, Homo sapiens
tcagtgggagaa

SEQ ID NO: 4429540 - DNA, 14 bp, Homo sapiens
tcagtgggagaaaa

SEQ ID NO: 4429541 - DNA, 15 bp, Homo sapiens
tcagtggggcagcct

SEQ ID NO: 4429542 - DNA, 14 bp, Homo sapiens
tcagtggtgggaga

SEQ ID NO: 4429543 - DNA, 14 bp, Homo sapiens
tcagtgtcaaataa

SEQ ID NO: 4429544 - DNA, 15 bp, Homo sapiens
tcagtgtcctttcca

SEQ ID NO: 4429545 - DNA, 17 bp, Homo sapiens
tcagtgttaaatgtgat

SEQ ID NO: 4429546 - DNA, 13 bp, Homo sapiens
tcagtgtttgtat

SEQ ID NO: 4429547 - DNA, 15 bp, Homo sapiens
tcagtgtttgtattt

SEQ ID NO: 4429548 - DNA, 16 bp, Homo sapiens
tcagttaactattgca

SEQ ID NO: 4429549 - DNA, 18 bp, Homo sapiens
tcagttactcagccctgg

SEQ ID NO: 4429550 - DNA, 20 bp, Homo sapiens
tcagttatctgtttgttact

SEQ ID NO: 4429551 - DNA, 18 bp, Homo sapiens
tcagttccagccttctct

SEQ ID NO: 4429552 - DNA, 22 bp, Homo sapiens
tcagttcccttggcctcagaat

SEQ ID NO: 4429553 - DNA, 13 bp, Homo sapiens
tcagttgaaaaga

SEQ ID NO: 4429554 - DNA, 20 bp, Homo sapiens
tcagttgatttttcttattt

SEQ ID NO: 4429555 - DNA, 20 bp, Homo sapiens
tcagttgctcaaaaagaaat

SEQ ID NO: 4429556 - DNA, 12 bp, Homo sapiens
tcagttgtaata

SEQ ID NO: 4429557 - DNA, 14 bp, Homo sapiens
tcagttgtgttttt

SEQ ID NO: 4429558 - DNA, 18 bp, Homo sapiens
tcagttgtgttttttaag

SEQ ID NO: 4429559 - DNA, 15 bp, Homo sapiens
tcagttgttcttttt

SEQ ID NO: 4429560 - DNA, 19 bp, Homo sapiens
tcagttgtttgcttcttgc

SEQ ID NO: 4429561 - DNA, 19 bp, Homo sapiens
tcagtttaaaagcacgaca

SEQ ID NO: 4429562 - DNA, 19 bp, Homo sapiens
tcagtttcataaaaggaga

SEQ ID NO: 4429563 - DNA, 12 bp, Homo sapiens
tcagtttctaca

SEQ ID NO: 4429564 - DNA, 12 bp, Homo sapiens
tcagttttcatt

SEQ ID NO: 4429565 - DNA, 15 bp, Homo sapiens
tcagttttgtacata

SEQ ID NO: 4429566 - DNA, 16 bp, Homo sapiens
tcataaaaaataatgg

SEQ ID NO: 4429567 - DNA, 20 bp, Homo sapiens
tcataaaaatctagcacact

SEQ ID NO: 4429568 - DNA, 11 bp, Homo sapiens
tcataaacttt

SEQ ID NO: 4429569 - DNA, 13 bp, Homo sapiens
tcataaatactgt

SEQ ID NO: 4429570 - DNA, 19 bp, Homo sapiens
tcataaatcatgttgttgt

SEQ ID NO: 4429571 - DNA, 19 bp, Homo sapiens
tcataacggttaagaaagc

SEQ ID NO: 4429572 - DNA, 15 bp, Homo sapiens
tcataagtatttcaa

SEQ ID NO: 4429573 - DNA, 15 bp, Homo sapiens
tcataagtggggaga

SEQ ID NO: 4429574 - DNA, 13 bp, Homo sapiens
tcataataaattt

SEQ ID NO: 4429575 - DNA, 13 bp, Homo sapiens
tcataatggcctg

SEQ ID NO: 4429576 - DNA, 13 bp, Homo sapiens
tcatacacagtta

SEQ ID NO: 4429577 - DNA, 17 bp, Homo sapiens
tcatacacagttaaata

SEQ ID NO: 4429578 - DNA, 18 bp, Homo sapiens
tcatacacagttaaataa

SEQ ID NO: 4429579 - DNA, 13 bp, Homo sapiens
tcatacaccagaa

SEQ ID NO: 4429580 - DNA, 13 bp, Homo sapiens
tcatacagttttc

SEQ ID NO: 4429581 - DNA, 17 bp, Homo sapiens
tcatacagttttcattg

SEQ ID NO: 4429582 - DNA, 15 bp, Homo sapiens
tcataccaatgaaaa

SEQ ID NO: 4429583 - DNA, 21 bp, Homo sapiens
tcatactacattgagtagaca

SEQ ID NO: 4429584 - DNA, 13 bp, Homo sapiens
tcatactcttcta

SEQ ID NO: 4429585 - DNA, 11 bp, Homo sapiens
tcatactgtac

SEQ ID NO: 4429586 - DNA, 15 bp, Homo sapiens
tcatactgtacacat

SEQ ID NO: 4429587 - DNA, 18 bp, Homo sapiens
tcatactgtgcaggcctg

SEQ ID NO: 4429588 - DNA, 16 bp, Homo sapiens
tcatacttaaaaattt

SEQ ID NO: 4429589 - DNA, 14 bp, Homo sapiens
tcatacttaacatt

SEQ ID NO: 4429590 - DNA, 19 bp, Homo sapiens
tcatagaacattgatctgt

SEQ ID NO: 4429591 - DNA, 15 bp, Homo sapiens
tcatagaattgcagt

SEQ ID NO: 4429592 - DNA, 23 bp, Homo sapiens
tcatagacaattcctccagagac

SEQ ID NO: 4429593 - DNA, 20 bp, Homo sapiens
tcatagattattataaacta

SEQ ID NO: 4429594 - DNA, 23 bp, Homo sapiens
tcatagattattataaactataa

SEQ ID NO: 4429595 - DNA, 19 bp, Homo sapiens
tcatagctcactgcagcct

SEQ ID NO: 4429596 - DNA, 20 bp, Homo sapiens
tcatagctcactgcagcctc

SEQ ID NO: 4429597 - DNA, 21 bp, Homo sapiens
tcatagctcactgcagcctca

SEQ ID NO: 4429598 - DNA, 22 bp, Homo sapiens
tcatagctcactgcagcctcat

SEQ ID NO: 4429599 - DNA, 23 bp, Homo sapiens
tcataggttaaaaaaaaaagtca

SEQ ID NO: 4429600 - DNA, 15 bp, Homo sapiens
tcataggttgagcaa

SEQ ID NO: 4429601 - DNA, 21 bp, Homo sapiens
tcatagtaacttcttatggaa

SEQ ID NO: 4429602 - DNA, 14 bp, Homo sapiens
tcatagttcagaat

SEQ ID NO: 4429603 - DNA, 16 bp, Homo sapiens
tcatagttcagaattt

SEQ ID NO: 4429604 - DNA, 13 bp, Homo sapiens
tcatagtttaatt

SEQ ID NO: 4429605 - DNA, 17 bp, Homo sapiens
tcatataccagcaatat

SEQ ID NO: 4429606 - DNA, 23 bp, Homo sapiens
tcatatataagactgctgcagtc

SEQ ID NO: 4429607 - DNA, 17 bp, Homo sapiens
tcatatataataaatta

SEQ ID NO: 4429608 - DNA, 20 bp, Homo sapiens
tcatatatactgtatcctga

SEQ ID NO: 4429609 - DNA, 16 bp, Homo sapiens
tcatatcatccacaca

SEQ ID NO: 4429610 - DNA, 12 bp, Homo sapiens
tcatatcatttc

SEQ ID NO: 4429611 - DNA, 16 bp, Homo sapiens
tcatatgaaaggtgcc

SEQ ID NO: 4429612 - DNA, 20 bp, Homo sapiens
tcatatgaaaggtgccatgg

SEQ ID NO: 4429613 - DNA, 22 bp, Homo sapiens
tcatatgtagccttcacacaga

SEQ ID NO: 4429614 - DNA, 18 bp, Homo sapiens
tcatatgtcacctttgct

SEQ ID NO: 4429615 - DNA, 14 bp, Homo sapiens
tcatattattttag

SEQ ID NO: 4429616 - DNA, 19 bp, Homo sapiens
tcatattattttagtgtgt

SEQ ID NO: 4429617 - DNA, 22 bp, Homo sapiens
tcatattattttagtgtgtaaa

SEQ ID NO: 4429618 - DNA, 20 bp, Homo sapiens
tcatattctaacttattaaa

SEQ ID NO: 4429619 - DNA, 13 bp, Homo sapiens
tcatatttctacc

SEQ ID NO: 4429620 - DNA, 22 bp, Homo sapiens
tcatcaactgaatgaggtcagc

SEQ ID NO: 4429621 - DNA, 17 bp, Homo sapiens
tcatcacataaagaaat

SEQ ID NO: 4429622 - DNA, 19 bp, Homo sapiens
tcatcaccatttcctcctt

SEQ ID NO: 4429623 - DNA, 21 bp, Homo sapiens
tcatcacccttccgacaggag

SEQ ID NO: 4429624 - DNA, 12 bp, Homo sapiens
tcatcactgtaa

SEQ ID NO: 4429625 - DNA, 19 bp, Homo sapiens
tcatcattctctgtctcat

SEQ ID NO: 4429626 - DNA, 14 bp, Homo sapiens
tcatcatttcagcc

SEQ ID NO: 4429627 - DNA, 20 bp, Homo sapiens
tcatcatttcagccaaagtc

SEQ ID NO: 4429628 - DNA, 15 bp, Homo sapiens
tcatcatttgcacaa

SEQ ID NO: 4429629 - DNA, 17 bp, Homo sapiens
tcatccagcctcagaga

SEQ ID NO: 4429630 - DNA, 13 bp, Homo sapiens
tcatccatagaca

SEQ ID NO: 4429631 - DNA, 18 bp, Homo sapiens
tcatccatagacacagta

SEQ ID NO: 4429632 - DNA, 15 bp, Homo sapiens
tcatccatcatcatg

SEQ ID NO: 4429633 - DNA, 17 bp, Homo sapiens
tcatccatcatcatgtg

SEQ ID NO: 4429634 - DNA, 20 bp, Homo sapiens
tcatccccaggggtcccagc

SEQ ID NO: 4429635 - DNA, 19 bp, Homo sapiens
tcatcccgtatcacagtgt

SEQ ID NO: 4429636 - DNA, 12 bp, Homo sapiens
tcatccctggac

SEQ ID NO: 4429637 - DNA, 13 bp, Homo sapiens
tcatccctggact

SEQ ID NO: 4429638 - DNA, 17 bp, Homo sapiens
tcatcctcaaagaaagt

SEQ ID NO: 4429639 - DNA, 22 bp, Homo sapiens
tcacataaagaaattcaagaag

SEQ ID NO: 4429640 - DNA, 24 bp, Homo sapiens
tcacataaagaaattcaagaagta

SEQ ID NO: 4429641 - DNA, 16 bp, Homo sapiens
tcacatagccaactct

SEQ ID NO: 4429642 - DNA, 14 bp, Homo sapiens
tcacatattttaaa

SEQ ID NO: 4429643 - DNA, 15 bp, Homo sapiens
tcacatctaaagctt

SEQ ID NO: 4429644 - DNA, 19 bp, Homo sapiens
tcacatctaaagctttatc

SEQ ID NO: 4429645 - DNA, 21 bp, Homo sapiens
tcacatcttaaattcatttct

SEQ ID NO: 4429646 - DNA, 14 bp, Homo sapiens
tcacatgcttgaat

SEQ ID NO: 4429647 - DNA, 22 bp, Homo sapiens
tcacatgtttaactttaaggat

SEQ ID NO: 4429648 - DNA, 22 bp, Homo sapiens
tcacattcctctgcccttcctg

SEQ ID NO: 4429649 - DNA, 18 bp, Homo sapiens
tcacattgttcaactccc

SEQ ID NO: 4429650 - DNA, 19 bp, Homo sapiens
tcacatttagaaaagtgaa

SEQ ID NO: 4429651 - DNA, 11 bp, Homo sapiens
tcacattttcc

SEQ ID NO: 4429652 - DNA, 17 bp, Homo sapiens
tcacattttccttttca

SEQ ID NO: 4429653 - DNA, 15 bp, Homo sapiens
tcacatttttttatg

SEQ ID NO: 4429654 - DNA, 20 bp, Homo sapiens
tcacatttttttatgctctt

SEQ ID NO: 4429655 - DNA, 15 bp, Homo sapiens
tcacatttttttcta

SEQ ID NO: 4429656 - DNA, 15 bp, Homo sapiens
tcaccacacataata

SEQ ID NO: 4429657 - DNA, 14 bp, Homo sapiens
tcaccagaatttct

SEQ ID NO: 4429658 - DNA, 15 bp, Homo sapiens
tcaccagagacttta

SEQ ID NO: 4429659 - DNA, 20 bp, Homo sapiens
tcaccagccccccgcgcgcc

SEQ ID NO: 4429660 - DNA, 16 bp, Homo sapiens
tcaccagccctgcagc

SEQ ID NO: 4429661 - DNA, 18 bp, Homo sapiens
tcaccagccctgcagccc

SEQ ID NO: 4429662 - DNA, 19 bp, Homo sapiens
tcaccagctatctgtcatc

SEQ ID NO: 4429663 - DNA, 13 bp, Homo sapiens
tcaccagctgcaa

SEQ ID NO: 4429664 - DNA, 17 bp, Homo sapiens
tcaccagctgcaaagtg

SEQ ID NO: 4429665 - DNA, 16 bp, Homo sapiens
tcaccaggagattaca

SEQ ID NO: 4429666 - DNA, 20 bp, Homo sapiens
tcaccagtgttcctgaagct

SEQ ID NO: 4429667 - DNA, 21 bp, Homo sapiens
tcaccagtgttcctgaagctg

SEQ ID NO: 4429668 - DNA, 23 bp, Homo sapiens
tcaccagtgttcctgaagctgct

SEQ ID NO: 4429669 - DNA, 19 bp, Homo sapiens
gctcttatgtgtgcctttg

SEQ ID NO: 4429670 - DNA, 15 bp, Homo sapiens
gctcttcaggcctcc

SEQ ID NO: 4429671 - DNA, 19 bp, Homo sapiens
gctcttcagtgggagaaaa

SEQ ID NO: 4429672 - DNA, 23 bp, Homo sapiens
gctcttctcatttcacccctccc

SEQ ID NO: 4429673 - DNA, 17 bp, Homo sapiens
gctcttctctccccagc

SEQ ID NO: 4429674 - DNA, 19 bp, Homo sapiens
gctcttctctccccagccc

SEQ ID NO: 4429675 - DNA, 20 bp, Homo sapiens
gctcttctctccccagcccc

SEQ ID NO: 4429676 - DNA, 23 bp, Homo sapiens
gctcttctctccccagccccctc

SEQ ID NO: 4429677 - DNA, 23 bp, Homo sapiens
gctcttctgcccaattggaggaa

SEQ ID NO: 4429678 - DNA, 18 bp, Homo sapiens
gctcttgaccttgtagag

SEQ ID NO: 4429679 - DNA, 14 bp, Homo sapiens
gctcttggcccggc

SEQ ID NO: 4429680 - DNA, 21 bp, Homo sapiens
gctctttgaaatagtctgtgt

SEQ ID NO: 4429681 - DNA, 23 bp, Homo sapiens
gctctttgaaatagtctgtgtga

SEQ ID NO: 4429682 - DNA, 19 bp, Homo sapiens
gctctttgactgtcagcaa

SEQ ID NO: 4429683 - DNA, 21 bp, Homo sapiens
gctcttttcctggtgctcttt

SEQ ID NO: 4429684 - DNA, 21 bp, Homo sapiens
gctcttttttgtttgtttctt

SEQ ID NO: 4429685 - DNA, 13 bp, Homo sapiens
gctgaaccacaga

SEQ ID NO: 4429686 - DNA, 16 bp, Homo sapiens
gctgaacggggagaaa

SEQ ID NO: 4429687 - DNA, 19 bp, Homo sapiens
gctgaactcagcacattcg

SEQ ID NO: 4429688 - DNA, 19 bp, Homo sapiens
gctgaagaggaccagagga

SEQ ID NO: 4429689 - DNA, 15 bp, Homo sapiens
gctgaagatccccaa

SEQ ID NO: 4429690 - DNA, 21 bp, Homo sapiens
gctgaagatccccaactgctc

SEQ ID NO: 4429691 - DNA, 22 bp, Homo sapiens
gctgaagatccccaactgctcc

SEQ ID NO: 4429692 - DNA, 17 bp, Homo sapiens
gctgaaggagaaaaaga

SEQ ID NO: 4429693 - DNA, 21 bp, Homo sapiens
gctgacatgaagctgttgtgt

SEQ ID NO: 4429694 - DNA, 17 bp, Homo sapiens
gctgaccatgcgtcagg

SEQ ID NO: 4429695 - DNA, 13 bp, Homo sapiens
gctgacccagtcc

SEQ ID NO: 4429696 - DNA, 15 bp, Homo sapiens
gctgaccctcctgtt

SEQ ID NO: 4429697 - DNA, 15 bp, Homo sapiens
gctgaccttggagga

SEQ ID NO: 4429698 - DNA, 22 bp, Homo sapiens
gctgaccttggaggaatgacaa

SEQ ID NO: 4429699 - DNA, 17 bp, Homo sapiens
gctgactcacacctgaa

SEQ ID NO: 4429700 - DNA, 18 bp, Homo sapiens
gctgactgatgttgaggg

SEQ ID NO: 4429701 - DNA, 22 bp, Homo sapiens
gctgactgccaataacattctt

SEQ ID NO: 4429702 - DNA, 14 bp, Homo sapiens
gctgagagacccaa

SEQ ID NO: 4429703 - DNA, 17 bp, Homo sapiens
gctgagagccctgctgt

SEQ ID NO: 4429704 - DNA, 21 bp, Homo sapiens
gctgagaggcaccagtccagc

SEQ ID NO: 4429705 - DNA, 21 bp, Homo sapiens
gctgagatctgctgtcctgtt

SEQ ID NO: 4429706 - DNA, 20 bp, Homo sapiens
gctgagcacttagcaggcac

SEQ ID NO: 4429707 - DNA, 13 bp, Homo sapiens
gctgagccacctg

SEQ ID NO: 4429708 - DNA, 15 bp, Homo sapiens
gctgagccacctgcc

SEQ ID NO: 4429709 - DNA, 20 bp, Homo sapiens
gctgagccacctgccctttt

SEQ ID NO: 4429710 - DNA, 16 bp, Homo sapiens
gctgagccctcctgag

SEQ ID NO: 4429711 - DNA, 12 bp, Homo sapiens
gctgagccctgc

SEQ ID NO: 4429712 - DNA, 16 bp, Homo sapiens
gctgagccctgcccca

SEQ ID NO: 4429713 - DNA, 15 bp, Homo sapiens
gctgaggcagaagaa

SEQ ID NO: 4429714 - DNA, 13 bp, Homo sapiens
gctgaggcaggag

SEQ ID NO: 4429715 - DNA, 15 bp, Homo sapiens
gctgaggccagagtc

SEQ ID NO: 4429716 - DNA, 22 bp, Homo sapiens
gctgaggtggtaggatcacctg

SEQ ID NO: 4429717 - DNA, 19 bp, Homo sapiens
gctgaggttcctctgcctg

SEQ ID NO: 4429718 - DNA, 20 bp, Homo sapiens
gctgaggttcctctgcctgc

SEQ ID NO: 4429719 - DNA, 22 bp, Homo sapiens
gctgaggttcctctgcctgccc

SEQ ID NO: 4429720 - DNA, 23 bp, Homo sapiens
gctgaggttcctctgcctgcccc

SEQ ID NO: 4429721 - DNA, 23 bp, Homo sapiens
gctgagtcatgatctccctgccg

SEQ ID NO: 4429722 - DNA, 15 bp, Homo sapiens
gctgagttctgggtt

SEQ ID NO: 4429723 - DNA, 13 bp, Homo sapiens
gctgataatttta

SEQ ID NO: 4429724 - DNA, 14 bp, Homo sapiens
gctgataattttaa

SEQ ID NO: 4429725 - DNA, 18 bp, Homo sapiens
gctgatatgcaagtaaga

SEQ ID NO: 4429726 - DNA, 22 bp, Homo sapiens
gctgatccagtaacctcggaga

SEQ ID NO: 4429727 - DNA, 15 bp, Homo sapiens
gctgatcgcttctcc

SEQ ID NO: 4429728 - DNA, 21 bp, Homo sapiens
gctgattaaaccaaggctaga

SEQ ID NO: 4429729 - DNA, 14 bp, Homo sapiens
gctgattgtattta

SEQ ID NO: 4429730 - DNA, 14 bp, Homo sapiens
gctgcaaaattaaa

SEQ ID NO: 4429731 - DNA, 16 bp, Homo sapiens
gctgcaaaattaaatc

SEQ ID NO: 4429732 - DNA, 13 bp, Homo sapiens
gctgcaaagtgtt

SEQ ID NO: 4429733 - DNA, 14 bp, Homo sapiens
gctgcaacaaaatg

SEQ ID NO: 4429734 - DNA, 13 bp, Homo sapiens
gctgcaatacatt

SEQ ID NO: 4429735 - DNA, 16 bp, Homo sapiens
gctgcaatgagccatg

SEQ ID NO: 4429736 - DNA, 17 bp, Homo sapiens
gctgcacaaaagcagat

SEQ ID NO: 4429737 - DNA, 17 bp, Homo sapiens
gctgcacatggcctgag

SEQ ID NO: 4429738 - DNA, 20 bp, Homo sapiens
gctgcaccacggcgtttttt

SEQ ID NO: 4429739 - DNA, 14 bp, Homo sapiens
gctgcacccctggg

SEQ ID NO: 4429740 - DNA, 16 bp, Homo sapiens
gctgcacccctgggcc

SEQ ID NO: 4429741 - DNA, 19 bp, Homo sapiens
gctgcacctcctaccctcc

SEQ ID NO: 4429742 - DNA, 23 bp, Homo sapiens
gctgcactctgtagcaaatttgt

SEQ ID NO: 4429743 - DNA, 19 bp, Homo sapiens
gctgcagattagttctttt

SEQ ID NO: 4429744 - DNA, 15 bp, Homo sapiens
gctgcagctccctgg

SEQ ID NO: 4429745 - DNA, 23 bp, Homo sapiens
gctgcaggagtgtcctgcccatg

SEQ ID NO: 4429746 - DNA, 15 bp, Homo sapiens
gctgcagtggctccc

SEQ ID NO: 4429747 - DNA, 17 bp, Homo sapiens
gctgcagtggctcccct

SEQ ID NO: 4429748 - DNA, 18 bp, Homo sapiens
gctgcatcgctgttctgg

SEQ ID NO: 4429749 - DNA, 22 bp, Homo sapiens
gctgcatctataatgtcagctt

SEQ ID NO: 4429750 - DNA, 16 bp, Homo sapiens
gctgcatgacctacca

SEQ ID NO: 4429751 - DNA, 20 bp, Homo sapiens
gctgccaagagtgaagggaa

SEQ ID NO: 4429752 - DNA, 17 bp, Homo sapiens
gctgccaaggccagagt

SEQ ID NO: 4429753 - DNA, 22 bp, Homo sapiens
gctgccaaggccagagtggcct

SEQ ID NO: 4429754 - DNA, 15 bp, Homo sapiens
ggaaatgagatgaca

SEQ ID NO: 4429755 - DNA, 23 bp, Homo sapiens
ggaaatgggaaaaaacttaaaaa

SEQ ID NO: 4429756 - DNA, 20 bp, Homo sapiens
ggaaattaaatccaataaaa

SEQ ID NO: 4429757 - DNA, 22 bp, Homo sapiens
ggaaatttataatataaatata

SEQ ID NO: 4429758 - DNA, 15 bp, Homo sapiens
ggaaattttatatgt

SEQ ID NO: 4429759 - DNA, 23 bp, Homo sapiens
ggaaattttatatgtaaatgtgt

SEQ ID NO: 4429760 - DNA, 15 bp, Homo sapiens
ggaacaaacagggct

SEQ ID NO: 4429761 - DNA, 11 bp, Homo sapiens
ggaacacaggg

SEQ ID NO: 4429762 - DNA, 16 bp, Homo sapiens
ggaacacctgatctta

SEQ ID NO: 4429763 - DNA, 13 bp, Homo sapiens
ggaacagacagga

SEQ ID NO: 4429764 - DNA, 15 bp, Homo sapiens
ggaacagacaggaga

SEQ ID NO: 4429765 - DNA, 16 bp, Homo sapiens
ggaacagatttcaaaa

SEQ ID NO: 4429766 - DNA, 17 bp, Homo sapiens
ggaacagcactggggag

SEQ ID NO: 4429767 - DNA, 23 bp, Homo sapiens
ggaacagctatgggagccccagg

SEQ ID NO: 4429768 - DNA, 19 bp, Homo sapiens
ggaacagtattacagtgtc

SEQ ID NO: 4429769 - DNA, 13 bp, Homo sapiens
ggaacataaaaag

SEQ ID NO: 4429770 - DNA, 14 bp, Homo sapiens
ggaacatggagctg

SEQ ID NO: 4429771 - DNA, 21 bp, Homo sapiens
tcaacaaagaaacaaagatgt

SEQ ID NO: 4429772 - DNA, 16 bp, Homo sapiens
tcaacaagaagaattt

SEQ ID NO: 4429773 - DNA, 18 bp, Homo sapiens
tcaacaataaaatttttt

SEQ ID NO: 4429774 - DNA, 15 bp, Homo sapiens
tcaacaattctaaaa

SEQ ID NO: 4429775 - DNA, 19 bp, Homo sapiens
tcaacagagaaggcaggaa

SEQ ID NO: 4429776 - DNA, 19 bp, Homo sapiens
tcaacagagaggaccaaca

SEQ ID NO: 4429777 - DNA, 23 bp, Homo sapiens
tcaacagagaggaccaacatcca

SEQ ID NO: 4429778 - DNA, 17 bp, Homo sapiens
tcaacagagggagttta

SEQ ID NO: 4429779 - DNA, 18 bp, Homo sapiens
tcaacatactgtaatcaa

SEQ ID NO: 4429780 - DNA, 19 bp, Homo sapiens
tcaacatactgtaatcaaa

SEQ ID NO: 4429781 - DNA, 12 bp, Homo sapiens
tcaacatctttt

SEQ ID NO: 4429782 - DNA, 14 bp, Homo sapiens
tcaacattccaggg

SEQ ID NO: 4429783 - DNA, 18 bp, Homo sapiens
tcaacattccagggatga

SEQ ID NO: 4429784 - DNA, 19 bp, Homo sapiens
tcaacattccagggatgag

SEQ ID NO: 4429785 - DNA, 18 bp, Homo sapiens
tcaacatttttttttctc

SEQ ID NO: 4429786 - DNA, 20 bp, Homo sapiens
tcaacatttttttttctcca

SEQ ID NO: 4429787 - DNA, 20 bp, Homo sapiens
tcaaccaccttttaggctgc

SEQ ID NO: 4429788 - DNA, 13 bp, Homo sapiens
tcaacccccctcc

SEQ ID NO: 4429789 - DNA, 17 bp, Homo sapiens
tcaacctgggcaaagcc

SEQ ID NO: 4429790 - DNA, 18 bp, Homo sapiens
tcaacctgggcaaagcct

SEQ ID NO: 4429791 - DNA, 17 bp, Homo sapiens
tcaacctgtaaattatt

SEQ ID NO: 4429792 - DNA, 18 bp, Homo sapiens
tcaacctgtaaattattt

SEQ ID NO: 4429793 - DNA, 19 bp, Homo sapiens
tcaacctgtaaattatttt

SEQ ID NO: 4429794 - DNA, 15 bp, Homo sapiens
tcaacgcctccccct

SEQ ID NO: 4429795 - DNA, 19 bp, Homo sapiens
tcaacgcttaaaggtgtct

SEQ ID NO: 4429796 - DNA, 20 bp, Homo sapiens
tcaacgcttaaaggtgtctt

SEQ ID NO: 4429797 - DNA, 22 bp, Homo sapiens
tcaacgcttaaaggtgtcttcc

SEQ ID NO: 4429798 - DNA, 21 bp, Homo sapiens
tcaacggaaagtgctgtctta

SEQ ID NO: 4429799 - DNA, 14 bp, Homo sapiens
tcaactcctcccat

SEQ ID NO: 4429800 - DNA, 17 bp, Homo sapiens
tcaactctacccctgct

SEQ ID NO: 4429801 - DNA, 14 bp, Homo sapiens
tcaactctttgtta

SEQ ID NO: 4429802 - DNA, 18 bp, Homo sapiens
tcaactgggctctgtccc

SEQ ID NO: 4429803 - DNA, 16 bp, Homo sapiens
tcaactgtcttcctca

SEQ ID NO: 4429804 - DNA, 23 bp, Homo sapiens
tcaactgtcttcctcaaaataaa

SEQ ID NO: 4429805 - DNA, 23 bp, Homo sapiens
tcaactttctgttggattccatg

SEQ ID NO: 4429806 - DNA, 19 bp, Homo sapiens
tcaactttttattgccttc

SEQ ID NO: 4429807 - DNA, 14 bp, Homo sapiens
tcaacttttttccc

SEQ ID NO: 4429808 - DNA, 14 bp, Homo sapiens
tcaagaaataagtt

SEQ ID NO: 4429809 - DNA, 22 bp, Homo sapiens
tcaagaaatgacagtcaaaaga

SEQ ID NO: 4429810 - DNA, 17 bp, Homo sapiens
tcaagaagtaatcagta

SEQ ID NO: 4429811 - DNA, 20 bp, Homo sapiens
tcaagaagtaatcagtatgc

SEQ ID NO: 4429812 - DNA, 22 bp, Homo sapiens
tcaagaagtatttttttaattt

SEQ ID NO: 4429813 - DNA, 21 bp, Homo sapiens
tcaagaataatcacgctttcc

SEQ ID NO: 4429814 - DNA, 17 bp, Homo sapiens
tcaagaatctagaagat

SEQ ID NO: 4429815 - DNA, 21 bp, Homo sapiens
tcaagaatctagaagatgtgt

SEQ ID NO: 4429816 - DNA, 20 bp, Homo sapiens
tcaagacagatgagcaggag

SEQ ID NO: 4429817 - DNA, 11 bp, Homo sapiens
tcaagacattt

SEQ ID NO: 4429818 - DNA, 14 bp, Homo sapiens
tcaagacatttgct

SEQ ID NO: 4429819 - DNA, 15 bp, Homo sapiens
tcaagaccagcctgt

SEQ ID NO: 4429820 - DNA, 11 bp, Homo sapiens
tcaagaccccc

SEQ ID NO: 4429821 - DNA, 19 bp, Homo sapiens
tcaagactatctacaaaaa

SEQ ID NO: 4429822 - DNA, 17 bp, Homo sapiens
tcaagactcaatgtgga

SEQ ID NO: 4429823 - DNA, 11 bp, Homo sapiens
tcaagagaaac

SEQ ID NO: 4429824 - DNA, 21 bp, Homo sapiens
tcaagagatctttctttccaa

SEQ ID NO: 4429825 - DNA, 18 bp, Homo sapiens
tcaagagtttattattgt

SEQ ID NO: 4429826 - DNA, 22 bp, Homo sapiens
tcaagataatcctagagtctta

SEQ ID NO: 4429827 - DNA, 13 bp, Homo sapiens
tcaagatagaaag

SEQ ID NO: 4429828 - DNA, 19 bp, Homo sapiens
tcaagatatatgtgtatac

SEQ ID NO: 4429829 - DNA, 20 bp, Homo sapiens
tcaagattttttttgtaact

SEQ ID NO: 4429830 - DNA, 22 bp, Homo sapiens
tcaagattttttttgtaacttc

SEQ ID NO: 4429831 - DNA, 20 bp, Homo sapiens
tcaagcaatccacctgcctt

SEQ ID NO: 4429832 - DNA, 21 bp, Homo sapiens
tcaagcaatccacctgccttg

SEQ ID NO: 4429833 - DNA, 19 bp, Homo sapiens
tcaagcaatcctcctgcct

SEQ ID NO: 4429834 - DNA, 20 bp, Homo sapiens
tcaagcaatcctcctgcctc

SEQ ID NO: 4429835 - DNA, 21 bp, Homo sapiens
tcaagcaatcctcctgcctca

SEQ ID NO: 4429836 - DNA, 23 bp, Homo sapiens
tcaagcaatcctcctgcctcagc

SEQ ID NO: 4429837 - DNA, 15 bp, Homo sapiens
tcaagcacactggaa

SEQ ID NO: 4429838 - DNA, 18 bp, Homo sapiens
tcaagcacactggaatat

SEQ ID NO: 4429839 - DNA, 15 bp, Homo sapiens
tcaagcacttcccag

SEQ ID NO: 4429840 - DNA, 16 bp, Homo sapiens
tcaagcacttcccagg

SEQ ID NO: 4429841 - DNA, 19 bp, Homo sapiens
tcaagcacttcccaggatc

SEQ ID NO: 4429842 - DNA, 21 bp, Homo sapiens
tcaagcacttcccaggatctg

SEQ ID NO: 4429843 - DNA, 14 bp, Homo sapiens
tcaagcctctaaac

SEQ ID NO: 4429844 - DNA, 15 bp, Homo sapiens
tcaagctagccagag

SEQ ID NO: 4429845 - DNA, 22 bp, Homo sapiens
tcaagctgttatttcttccctg

SEQ ID NO: 4429846 - DNA, 17 bp, Homo sapiens
tcaagcttctctgttct

SEQ ID NO: 4429847 - DNA, 21 bp, Homo sapiens
tcaaggaaaggctcatttaaa

SEQ ID NO: 4429848 - DNA, 20 bp, Homo sapiens
tcaaggaagtagaaacaaaa

SEQ ID NO: 4429849 - DNA, 21 bp, Homo sapiens
tcaaggaatttcttaacttct

SEQ ID NO: 4429850 - DNA, 19 bp, Homo sapiens
tcaaggagaggcaaagaaa

SEQ ID NO: 4429851 - DNA, 22 bp, Homo sapiens
tcaaggtttagtttaacttcca

SEQ ID NO: 4429852 - DNA, 23 bp, Homo sapiens
tcaagtaataggcattttaagta

SEQ ID NO: 4429853 - DNA, 16 bp, Homo sapiens
tcaagtaattgtgaaa

SEQ ID NO: 4429854 - DNA, 12 bp, Homo sapiens
tcaagtattact

SEQ ID NO: 4429855 - DNA, 12 bp, Homo sapiens
tcaagtatttgg

SEQ ID NO: 4429856 - DNA, 17 bp, Homo sapiens
tcaagtccatctgacaa

SEQ ID NO: 4429857 - DNA, 19 bp, Homo sapiens
tcaagtccatctgacaaaa

SEQ ID NO: 4429858 - DNA, 18 bp, Homo sapiens
tcaagtgccaaacagagt

SEQ ID NO: 4429859 - DNA, 16 bp, Homo sapiens
tcaagtgcttaaaaat

SEQ ID NO: 4429860 - DNA, 16 bp, Homo sapiens
tcaagttcctttgggt

SEQ ID NO: 4429861 - DNA, 16 bp, Homo sapiens
tcaagttgattagaaa

SEQ ID NO: 4429862 - DNA, 13 bp, Homo sapiens
tcaagttgtgctt

SEQ ID NO: 4429863 - DNA, 22 bp, Homo sapiens
tcaagttgtgcttgtttacagc

SEQ ID NO: 4429864 - DNA, 16 bp, Homo sapiens
tcaagtttttatagtt

SEQ ID NO: 4429865 - DNA, 16 bp, Homo sapiens
tcaagtttttcatact

SEQ ID NO: 4429866 - DNA, 19 bp, Homo sapiens
tcaagtttttcatactgta

SEQ ID NO: 4429867 - DNA, 22 bp, Homo sapiens
tcaagtttttcatactgtacac

SEQ ID NO: 4429868 - DNA, 24 bp, Homo sapiens
tcaagtttttcatactgtacacat

SEQ ID NO: 4429869 - DNA, 17 bp, Homo sapiens
tcaagttttttatactg

SEQ ID NO: 4429870 - DNA, 16 bp, Homo sapiens
tcaataaaattctgta

SEQ ID NO: 4429871 - DNA, 17 bp, Homo sapiens
tcaataaaattctgtaa

SEQ ID NO: 4429872 - DNA, 15 bp, Homo sapiens
tcaataaatctttca

SEQ ID NO: 4429873 - DNA, 17 bp, Homo sapiens
tcaataaatctttcaaa

SEQ ID NO: 4429874 - DNA, 16 bp, Homo sapiens
tcaatagcgtgtgtag

SEQ ID NO: 4429875 - DNA, 15 bp, Homo sapiens
tcaatagcttgtctt

SEQ ID NO: 4429876 - DNA, 15 bp, Homo sapiens
tcaatagtattaact

SEQ ID NO: 4429877 - DNA, 22 bp, Homo sapiens
tcaatagtggcataccaaatgg

SEQ ID NO: 4429878 - DNA, 19 bp, Homo sapiens
tcaatagtgtcctatgcaa

SEQ ID NO: 4429879 - DNA, 20 bp, Homo sapiens
tcaatatattgaacttttgt

SEQ ID NO: 4429880 - DNA, 15 bp, Homo sapiens
tcaatatcagctttg

SEQ ID NO: 4429881 - DNA, 20 bp, Homo sapiens
tcaatatcagctttgataat

SEQ ID NO: 4429882 - DNA, 15 bp, Homo sapiens
tcaatatgcaagcag

SEQ ID NO: 4429883 - DNA, 18 bp, Homo sapiens
tcaatatgcaagcagctt

SEQ ID NO: 4429884 - DNA, 15 bp, Homo sapiens
tcaatattgaatttt

SEQ ID NO: 4429885 - DNA, 18 bp, Homo sapiens
tcaatattttaacttttt

SEQ ID NO: 4429886 - DNA, 20 bp, Homo sapiens
tcaatattttctgcaatcca

SEQ ID NO: 4429887 - DNA, 16 bp, Homo sapiens
tcaatatttttagata

SEQ ID NO: 4429888 - DNA, 15 bp, Homo sapiens
gctaaaaatgaaaat

SEQ ID NO: 4429889 - DNA, 15 bp, Homo sapiens
gctaaaatatataat

SEQ ID NO: 4429890 - DNA, 22 bp, Homo sapiens
gctaaactgaatctatggcttt

SEQ ID NO: 4429891 - DNA, 17 bp, Homo sapiens
gctaaagcctgtgggtt

SEQ ID NO: 4429892 - DNA, 21 bp, Homo sapiens
gctaaagttatatttgtctgt

SEQ ID NO: 4429893 - DNA, 12 bp, Homo sapiens
gctaaatgaagt

SEQ ID NO: 4429894 - DNA, 18 bp, Homo sapiens
gctaaccatcgaaaagaa

SEQ ID NO: 4429895 - DNA, 15 bp, Homo sapiens
gctaaccatttatat

SEQ ID NO: 4429896 - DNA, 20 bp, Homo sapiens
gctaaccttatcctgcattg

SEQ ID NO: 4429897 - DNA, 18 bp, Homo sapiens
gctaacgtttatttaaaa

SEQ ID NO: 4429898 - DNA, 13 bp, Homo sapiens
gctaactgtaaat

SEQ ID NO: 4429899 - DNA, 20 bp, Homo sapiens
gctaagagctagcgctgccg

SEQ ID NO: 4429900 - DNA, 14 bp, Homo sapiens
gctaaggcagctga

SEQ ID NO: 4429901 - DNA, 19 bp, Homo sapiens
gctaagggcttgtttttct

SEQ ID NO: 4429902 - DNA, 11 bp, Homo sapiens
gctaataaatc

SEQ ID NO: 4429903 - DNA, 17 bp, Homo sapiens
gctaataaatctcttct

SEQ ID NO: 4429904 - DNA, 20 bp, Homo sapiens
gctaataatgagctattaaa

SEQ ID NO: 4429905 - DNA, 13 bp, Homo sapiens
gctaatctgcctg

SEQ ID NO: 4429906 - DNA, 14 bp, Homo sapiens
gctaatctgcctgg

SEQ ID NO: 4429907 - DNA, 17 bp, Homo sapiens
gctaattcaaggaattt

SEQ ID NO: 4429908 - DNA, 16 bp, Homo sapiens
gctaattctactcaca

SEQ ID NO: 4429909 - DNA, 12 bp, Homo sapiens
gctaatttgcat

SEQ ID NO: 4429910 - DNA, 15 bp, Homo sapiens
gctaatttgcattaa

SEQ ID NO: 4429911 - DNA, 12 bp, Homo sapiens
gctaatttttat

SEQ ID NO: 4429912 - DNA, 13 bp, Homo sapiens
gctaatttttgta

SEQ ID NO: 4429913 - DNA, 20 bp, Homo sapiens
gctaatttttgtatttttag

SEQ ID NO: 4429914 - DNA, 19 bp, Homo sapiens
gctaatttttttgtatttt

SEQ ID NO: 4429915 - DNA, 17 bp, Homo sapiens
gctacaaaaacacagca

SEQ ID NO: 4429916 - DNA, 18 bp, Homo sapiens
gctacaaggtaggctgca

SEQ ID NO: 4429917 - DNA, 17 bp, Homo sapiens
gctacaatattctctct

SEQ ID NO: 4429918 - DNA, 21 bp, Homo sapiens
gctacactcattgaaatgtaa

SEQ ID NO: 4429919 - DNA, 18 bp, Homo sapiens
gctacactgagcagggag

SEQ ID NO: 4429920 - DNA, 17 bp, Homo sapiens
gctacagctccacacgc

SEQ ID NO: 4429921 - DNA, 22 bp, Homo sapiens
gctacagctccacacgccccgg

SEQ ID NO: 4429922 - DNA, 23 bp, Homo sapiens
gctacagctccacacgccccggt

SEQ ID NO: 4429923 - DNA, 21 bp, Homo sapiens
gctacaggaagcaccccatgc

SEQ ID NO: 4429924 - DNA, 22 bp, Homo sapiens
gctacaggaagcaccccatgcc

SEQ ID NO: 4429925 - DNA, 22 bp, Homo sapiens
gctacatcagactctagaaaaa

SEQ ID NO: 4429926 - DNA, 21 bp, Homo sapiens
gctacattaaactcaaatgta

SEQ ID NO: 4429927 - DNA, 14 bp, Homo sapiens
gctaccaaaacagt

SEQ ID NO: 4429928 - DNA, 22 bp, Homo sapiens
gctaccccccctcctgctgcct

SEQ ID NO: 4429929 - DNA, 17 bp, Homo sapiens
gctacccgctgtggccg

SEQ ID NO: 4429930 - DNA, 17 bp, Homo sapiens
gctcctctcctggagga

SEQ ID NO: 4429931 - DNA, 12 bp, Homo sapiens
gctcctctgctt

SEQ ID NO: 4429932 - DNA, 18 bp, Homo sapiens
gctcctgaggggcatctg

SEQ ID NO: 4429933 - DNA, 23 bp, Homo sapiens
gctcctgaggggcatctgcccct

SEQ ID NO: 4429934 - DNA, 20 bp, Homo sapiens
gctcctgcaaaaggaggtga

SEQ ID NO: 4429935 - DNA, 15 bp, Homo sapiens
gctcctgcccaggcc

SEQ ID NO: 4429936 - DNA, 16 bp, Homo sapiens
gctcctgcccaggcca

SEQ ID NO: 4429937 - DNA, 22 bp, Homo sapiens
gctcctgccgcagagctggccg

SEQ ID NO: 4429938 - DNA, 14 bp, Homo sapiens
gctcctgggaggga

SEQ ID NO: 4429939 - DNA, 20 bp, Homo sapiens
gctcctggggagctcctggg

SEQ ID NO: 4429940 - DNA, 15 bp, Homo sapiens
gctcctgtctggctc

SEQ ID NO: 4429941 - DNA, 13 bp, Homo sapiens
gctcctgtgctca

SEQ ID NO: 4429942 - DNA, 15 bp, Homo sapiens
gctcctgtgctcacc

SEQ ID NO: 4429943 - DNA, 17 bp, Homo sapiens
gctcctgtgctcaccct

SEQ ID NO: 4429944 - DNA, 22 bp, Homo sapiens
gctcctgttttgcacagccaaa

SEQ ID NO: 4429945 - DNA, 15 bp, Homo sapiens
gctccttaaggctct

SEQ ID NO: 4429946 - DNA, 17 bp, Homo sapiens
gctccttaaggctcttt

SEQ ID NO: 4429947 - DNA, 12 bp, Homo sapiens
gctccttccaga

SEQ ID NO: 4429948 - DNA, 14 bp, Homo sapiens
gctccttcctggag

SEQ ID NO: 4429949 - DNA, 23 bp, Homo sapiens
gctccttcctggagactgcccag

SEQ ID NO: 4429950 - DNA, 19 bp, Homo sapiens
gctccttggcacccccatg

SEQ ID NO: 4429951 - DNA, 20 bp, Homo sapiens
gctccttggcacccccatgc

SEQ ID NO: 4429952 - DNA, 14 bp, Homo sapiens
gctccttgggccct

SEQ ID NO: 4429953 - DNA, 17 bp, Homo sapiens
gctcctttctcctgtga

SEQ ID NO: 4429954 - DNA, 19 bp, Homo sapiens
gctcctttctcctgtgaat

SEQ ID NO: 4429955 - DNA, 16 bp, Homo sapiens
gctcgatggacctcag

SEQ ID NO: 4429956 - DNA, 20 bp, Homo sapiens
gctcgatggacctcagcaag

SEQ ID NO: 4429957 - DNA, 20 bp, Homo sapiens
gctcgatgtggtcacagctg

SEQ ID NO: 4429958 - DNA, 15 bp, Homo sapiens
gctcgcccagacacc

SEQ ID NO: 4429959 - DNA, 12 bp, Homo sapiens
gctcgcccagca

SEQ ID NO: 4429960 - DNA, 18 bp, Homo sapiens
gctcgccgtgtctcagcc

SEQ ID NO: 4429961 - DNA, 16 bp, Homo sapiens
gctcgctccctgtagc

SEQ ID NO: 4429962 - DNA, 12 bp, Homo sapiens
gctcggacacag

SEQ ID NO: 4429963 - DNA, 16 bp, Homo sapiens
gctcggacccacccca

SEQ ID NO: 4429964 - DNA, 17 bp, Homo sapiens
gctcggacccaccccaa

SEQ ID NO: 4429965 - DNA, 23 bp, Homo sapiens
gctcggaggctacccgctgtggc

SEQ ID NO: 4429966 - DNA, 14 bp, Homo sapiens
gctcggcaccaact

SEQ ID NO: 4429967 - DNA, 14 bp, Homo sapiens
gctcggtctccacc

SEQ ID NO: 4429968 - DNA, 18 bp, Homo sapiens
gctctaattcacagtgct

SEQ ID NO: 4429969 - DNA, 19 bp, Homo sapiens
gctctaattcacagtgctc

SEQ ID NO: 4429970 - DNA, 15 bp, Homo sapiens
gctctaccttcctgt

SEQ ID NO: 4429971 - DNA, 22 bp, Homo sapiens
gctctaccttcctgtccctgag

SEQ ID NO: 4429972 - DNA, 16 bp, Homo sapiens
gctctaggctgttctg

SEQ ID NO: 4429973 - DNA, 19 bp, Homo sapiens
gctctagttttcagccttg

SEQ ID NO: 4429974 - DNA, 19 bp, Homo sapiens
gctctatcgcccaggctgg

SEQ ID NO: 4429975 - DNA, 15 bp, Homo sapiens
gctctatgtctgcct

SEQ ID NO: 4429976 - DNA, 22 bp, Homo sapiens
gctctatttcctcccccagtta

SEQ ID NO: 4429977 - DNA, 16 bp, Homo sapiens
gctctcacccccatcc

SEQ ID NO: 4429978 - DNA, 13 bp, Homo sapiens
gctctcaggccga

SEQ ID NO: 4429979 - DNA, 13 bp, Homo sapiens
gctctccacctca

SEQ ID NO: 4429980 - DNA, 15 bp, Homo sapiens
gctctccacctcagc

SEQ ID NO: 4429981 - DNA, 17 bp, Homo sapiens
gctctccacctcagcct

SEQ ID NO: 4429982 - DNA, 18 bp, Homo sapiens
gctctccacctcagcctt

SEQ ID NO: 4429983 - DNA, 20 bp, Homo sapiens
gctctccacctcagccttgg

SEQ ID NO: 4429984 - DNA, 21 bp, Homo sapiens
gctctccacctcagccttgga

SEQ ID NO: 4429985 - DNA, 12 bp, Homo sapiens
gctctcccaagg

SEQ ID NO: 4429986 - DNA, 17 bp, Homo sapiens
gctctccctctggccct

SEQ ID NO: 4429987 - DNA, 19 bp, Homo sapiens
gctctccctctggccctgc

SEQ ID NO: 4429988 - DNA, 23 bp, Homo sapiens
gctctccctctggccctgccttc

SEQ ID NO: 4429989 - DNA, 15 bp, Homo sapiens
gctctcctcccgccc

SEQ ID NO: 4429990 - DNA, 15 bp, Homo sapiens
gctctcctggctgtc

SEQ ID NO: 4429991 - DNA, 16 bp, Homo sapiens
gctctcgaggaaagtg

SEQ ID NO: 4429992 - DNA, 17 bp, Homo sapiens
gctctctattccctcag

SEQ ID NO: 4429993 - DNA, 18 bp, Homo sapiens
gctctctattccctcagc

SEQ ID NO: 4429994 - DNA, 19 bp, Homo sapiens
gctctctattccctcagcc

SEQ ID NO: 4429995 - DNA, 20 bp, Homo sapiens
gctctctattccctcagcct

SEQ ID NO: 4429996 - DNA, 15 bp, Homo sapiens
gctctctcacctgct

SEQ ID NO: 4429997 - DNA, 18 bp, Homo sapiens
gctctctcacctgctccc

SEQ ID NO: 4429998 - DNA, 22 bp, Homo sapiens
gctctctcacctgctcccagtc

SEQ ID NO: 4429999 - DNA, 18 bp, Homo sapiens
gctctctgcagccagccc

SEQ ID NO: 4430000 - DNA, 22 bp, Homo sapiens
gctctctgcagccagcccagcc

SEQ ID NO: 4430001 - DNA, 11 bp, Homo sapiens
gctctctggga

SEQ ID NO: 4430002 - DNA, 17 bp, Homo sapiens
gctctctgggacctcct

SEQ ID NO: 4430003 - DNA, 13 bp, Homo sapiens
gctctcttcaata

SEQ ID NO: 4430004 - DNA, 15 bp, Homo sapiens
gctctctttctgtct

SEQ ID NO: 4430005 - DNA, 17 bp, Homo sapiens
gctctcttttctgtact

SEQ ID NO: 4430006 - DNA, 18 bp, Homo sapiens
gctctcttttctgtactt

SEQ ID NO: 4430007 - DNA, 16 bp, Homo sapiens
gctctgaacttccaag

SEQ ID NO: 4430008 - DNA, 22 bp, Homo sapiens
gctctgaatagttaaaaattaa

SEQ ID NO: 4430009 - DNA, 16 bp, Homo sapiens
gctctgacagaaagca

SEQ ID NO: 4430010 - DNA, 13 bp, Homo sapiens
gctctgagccaga

SEQ ID NO: 4430011 - DNA, 13 bp, Homo sapiens
gctctgatccctc

SEQ ID NO: 4430012 - DNA, 17 bp, Homo sapiens
cccctctgccttgccct

SEQ ID NO: 4430013 - DNA, 12 bp, Homo sapiens
cccctctgctgc

SEQ ID NO: 4430014 - DNA, 12 bp, Homo sapiens
cccctctgtcca

SEQ ID NO: 4430015 - DNA, 14 bp, Homo sapiens
cccctctgtccagg

SEQ ID NO: 4430016 - DNA, 22 bp, Homo sapiens
cccctctgtccaggcactgaga

SEQ ID NO: 4430017 - DNA, 14 bp, Homo sapiens
cccctgagagcctg

SEQ ID NO: 4430018 - DNA, 17 bp, Homo sapiens
cccctgagccagcaggg

SEQ ID NO: 4430019 - DNA, 20 bp, Homo sapiens
cccctgagttgggcagccag

SEQ ID NO: 4430020 - DNA, 19 bp, Homo sapiens
cccctgatgacgggatgct

SEQ ID NO: 4430021 - DNA, 21 bp, Homo sapiens
cccctgcaacttccgctgagg

SEQ ID NO: 4430022 - DNA, 21 bp, Homo sapiens
cccctgcacagcaggctgcca

SEQ ID NO: 4430023 - DNA, 15 bp, Homo sapiens
cccctgcagattctg

SEQ ID NO: 4430024 - DNA, 14 bp, Homo sapiens
cccctgccagggca

SEQ ID NO: 4430025 - DNA, 15 bp, Homo sapiens
cccctgccagggcag

SEQ ID NO: 4430026 - DNA, 15 bp, Homo sapiens
cccctgcccagcctg

SEQ ID NO: 4430027 - DNA, 18 bp, Homo sapiens
cccctgcccagcctgctc

SEQ ID NO: 4430028 - DNA, 12 bp, Homo sapiens
cccctgccccca

SEQ ID NO: 4430029 - DNA, 19 bp, Homo sapiens
cccctgcccccaggactgg

SEQ ID NO: 4430030 - DNA, 17 bp, Homo sapiens
cccctgcctcccattct

SEQ ID NO: 4430031 - DNA, 19 bp, Homo sapiens
cccctgcctcccattctgc

SEQ ID NO: 4430032 - DNA, 21 bp, Homo sapiens
cccctgctcactgggcccgag

SEQ ID NO: 4430033 - DNA, 15 bp, Homo sapiens
cccctgctccaccag

SEQ ID NO: 4430034 - DNA, 19 bp, Homo sapiens
cccctgctccaccagcagc

SEQ ID NO: 4430035 - DNA, 21 bp, Homo sapiens
cccctgctcccattcctccct

SEQ ID NO: 4430036 - DNA, 22 bp, Homo sapiens
cccctgctggctcttctgccca

SEQ ID NO: 4430037 - DNA, 15 bp, Homo sapiens
cccctgctgtgctgc

SEQ ID NO: 4430038 - DNA, 16 bp, Homo sapiens
cccctggcactggcaa

SEQ ID NO: 4430039 - DNA, 10 bp, Homo sapiens
cccctggctt

SEQ ID NO: 4430040 - DNA, 23 bp, Homo sapiens
cccctgggcatcttctggcttga

SEQ ID NO: 4430041 - DNA, 11 bp, Homo sapiens
cccctggggac

SEQ ID NO: 4430042 - DNA, 20 bp, Homo sapiens
cccctggggctgagtctcca

SEQ ID NO: 4430043 - DNA, 23 bp, Homo sapiens
cccctggggctgagtctccaggg

SEQ ID NO: 4430044 - DNA, 20 bp, Homo sapiens
cccctggggtggccaccagt

SEQ ID NO: 4430045 - DNA, 20 bp, Homo sapiens
cccctgggtcagtctggtgg

SEQ ID NO: 4430046 - DNA, 21 bp, Homo sapiens
cccctgggtcagtctggtggg

SEQ ID NO: 4430047 - DNA, 22 bp, Homo sapiens
cccctggtcaccgagactcagc

SEQ ID NO: 4430048 - DNA, 14 bp, Homo sapiens
cccctgtcccattc

SEQ ID NO: 4430049 - DNA, 17 bp, Homo sapiens
cccctgtctgttcccag

SEQ ID NO: 4430050 - DNA, 23 bp, Homo sapiens
cccctgtctgttcccagcccctg

SEQ ID NO: 4430051 - DNA, 11 bp, Homo sapiens
cccctgtgcag

SEQ ID NO: 4430052 - DNA, 19 bp, Homo sapiens
cccctgtgtattcaccacc

SEQ ID NO: 4430053 - DNA, 14 bp, Homo sapiens
ccccttcagtgccc

SEQ ID NO: 4430054 - DNA, 13 bp, Homo sapiens
ccccttcccattt

SEQ ID NO: 4430055 - DNA, 16 bp, Homo sapiens
ccccttccccatggga

SEQ ID NO: 4430056 - DNA, 10 bp, Homo sapiens
ccccttcctg

SEQ ID NO: 4430057 - DNA, 23 bp, Homo sapiens
ccccttctacactctcctgggcc

SEQ ID NO: 4430058 - DNA, 14 bp, Homo sapiens
ccccttctctgctc

SEQ ID NO: 4430059 - DNA, 17 bp, Homo sapiens
cccgaaaaatgtgtggt

SEQ ID NO: 4430060 - DNA, 19 bp, Homo sapiens
cccgaacctcacctgacct

SEQ ID NO: 4430061 - DNA, 23 bp, Homo sapiens
cccgaagccatcacttctccccg

SEQ ID NO: 4430062 - DNA, 14 bp, Homo sapiens
cccgactgtttatt

SEQ ID NO: 4430063 - DNA, 12 bp, Homo sapiens
cccgagcacata

SEQ ID NO: 4430064 - DNA, 15 bp, Homo sapiens
cccgaggggagggca

SEQ ID NO: 4430065 - DNA, 15 bp, Homo sapiens
cccgagtctccggga

SEQ ID NO: 4430066 - DNA, 17 bp, Homo sapiens
cccgagttcctctgggt

SEQ ID NO: 4430067 - DNA, 16 bp, Homo sapiens
cccgatgtcccctgcg

SEQ ID NO: 4430068 - DNA, 12 bp, Homo sapiens
cccgcacacctg

SEQ ID NO: 4430069 - DNA, 17 bp, Homo sapiens
cccgcactctgccccca

SEQ ID NO: 4430070 - DNA, 18 bp, Homo sapiens
cccgccactcgccttctt

SEQ ID NO: 4430071 - DNA, 13 bp, Homo sapiens
cccgccagggctg

SEQ ID NO: 4430072 - DNA, 15 bp, Homo sapiens
cccgccagggctggg

SEQ ID NO: 4430073 - DNA, 16 bp, Homo sapiens
cccgccagggctgggg

SEQ ID NO: 4430074 - DNA, 20 bp, Homo sapiens
cccgcccacccgccttgtga

SEQ ID NO: 4430075 - DNA, 15 bp, Homo sapiens
cccgcccctcccacg

SEQ ID NO: 4430076 - DNA, 18 bp, Homo sapiens
cccgcccctcccacgcct

SEQ ID NO: 4430077 - DNA, 21 bp, Homo sapiens
cccgcccttccatgtgccttt

SEQ ID NO: 4430078 - DNA, 16 bp, Homo sapiens
cccgccgcctcccacg

SEQ ID NO: 4430079 - DNA, 22 bp, Homo sapiens
cccgcctccactctagttctag

SEQ ID NO: 4430080 - DNA, 23 bp, Homo sapiens
cccgcctcgacctccccacccgc

SEQ ID NO: 4430081 - DNA, 12 bp, Homo sapiens
cccgcctgccac

SEQ ID NO: 4430082 - DNA, 13 bp, Homo sapiens
cccgcctgccacc

SEQ ID NO: 4430083 - DNA, 13 bp, Homo sapiens
cccgcctgccagt

SEQ ID NO: 4430084 - DNA, 16 bp, Homo sapiens
cccgcctgcccagact

SEQ ID NO: 4430085 - DNA, 18 bp, Homo sapiens
cccgcctgccgtgcatgg

SEQ ID NO: 4430086 - DNA, 19 bp, Homo sapiens
cccgcctgccgtgcatggc

SEQ ID NO: 4430087 - DNA, 13 bp, Homo sapiens
cccgccttgtgag

SEQ ID NO: 4430088 - DNA, 17 bp, Homo sapiens
cccgcgctcgcccagca

SEQ ID NO: 4430089 - DNA, 15 bp, Homo sapiens
cccgcgttcaagact

SEQ ID NO: 4430090 - DNA, 17 bp, Homo sapiens
cccgcgttcaagacttg

SEQ ID NO: 4430091 - DNA, 13 bp, Homo sapiens
cccgctgctgtgc

SEQ ID NO: 4430092 - DNA, 19 bp, Homo sapiens
cccgctgctgtgctctggg

SEQ ID NO: 4430093 - DNA, 21 bp, Homo sapiens
cccgctgctgtgctctgggga

SEQ ID NO: 4430094 - DNA, 15 bp, Homo sapiens
cccgcttgtccagcg

SEQ ID NO: 4430095 - DNA, 19 bp, Homo sapiens
cccggagattggacggcct

SEQ ID NO: 4430096 - DNA, 22 bp, Homo sapiens
cccggcacagatgctccaggga

SEQ ID NO: 4430097 - DNA, 12 bp, Homo sapiens
cccggcagggcg

SEQ ID NO: 4430098 - DNA, 19 bp, Homo sapiens
cccggccaaggacccaggc

SEQ ID NO: 4430099 - DNA, 21 bp, Homo sapiens
cccggccaaggacccaggcgc

SEQ ID NO: 4430100 - DNA, 17 bp, Homo sapiens
cccggccacacccagcg

SEQ ID NO: 4430101 - DNA, 16 bp, Homo sapiens
cccggccacagctgct

SEQ ID NO: 4430102 - DNA, 19 bp, Homo sapiens
cccggccacagctgctgga

SEQ ID NO: 4430103 - DNA, 21 bp, Homo sapiens
cccggccacagctgctggaga

SEQ ID NO: 4430104 - DNA, 15 bp, Homo sapiens
cccggcccccggcca

SEQ ID NO: 4430105 - DNA, 19 bp, Homo sapiens
cccggcccccggccaagga

SEQ ID NO: 4430106 - DNA, 18 bp, Homo sapiens
cccggcccggctgagccc

SEQ ID NO: 4430107 - DNA, 22 bp, Homo sapiens
cccggcctcctcggagagcagc

SEQ ID NO: 4430108 - DNA, 23 bp, Homo sapiens
cccggcctcctcggagagcagca

SEQ ID NO: 4430109 - DNA, 15 bp, Homo sapiens
cccggcgccgggcac

SEQ ID NO: 4430110 - DNA, 22 bp, Homo sapiens
cccggcggaaagcctctgtccg

SEQ ID NO: 4430111 - DNA, 12 bp, Homo sapiens
cccggctgagcc

SEQ ID NO: 4430112 - DNA, 14 bp, Homo sapiens
cccgggagcggagg

SEQ ID NO: 4430113 - DNA, 12 bp, Homo sapiens
cccgggagctgg

SEQ ID NO: 4430114 - DNA, 13 bp, Homo sapiens
cccgggagctggg

SEQ ID NO: 4430115 - DNA, 19 bp, Homo sapiens
cccgggagctgggccctgc

SEQ ID NO: 4430116 - DNA, 21 bp, Homo sapiens
cccgggcgcggccagccccgg

SEQ ID NO: 4430117 - DNA, 16 bp, Homo sapiens
cccgggctctctgctg

SEQ ID NO: 4430118 - DNA, 21 bp, Homo sapiens
cccgggctgggcccctccagg

SEQ ID NO: 4430119 - DNA, 19 bp, Homo sapiens
cccgggggtggggggtggg

SEQ ID NO: 4430120 - DNA, 13 bp, Homo sapiens
cccggtccacagg

SEQ ID NO: 4430121 - DNA, 14 bp, Homo sapiens
cccggtccacaggt

SEQ ID NO: 4430122 - DNA, 22 bp, Homo sapiens
cccgtcagcatcactgatggga

SEQ ID NO: 4430123 - DNA, 14 bp, Homo sapiens
cccgtccccacacg

SEQ ID NO: 4430124 - DNA, 19 bp, Homo sapiens
cccgtcggactgcccccag

SEQ ID NO: 4430125 - DNA, 16 bp, Homo sapiens
cccgtctccagctgct

SEQ ID NO: 4430126 - DNA, 17 bp, Homo sapiens
cccgtctggacctgggg

SEQ ID NO: 4430127 - DNA, 17 bp, Homo sapiens
cccgtctggcccaccag

SEQ ID NO: 4430128 - DNA, 16 bp, Homo sapiens
cccgtgacgaggctca

SEQ ID NO: 4430129 - DNA, 17 bp, Homo sapiens
cccgtgacgaggctcaa

SEQ ID NO: 4430130 - DNA, 22 bp, Homo sapiens
cccgtgcccccgcctgccaccg

SEQ ID NO: 4430131 - DNA, 12 bp, Homo sapiens
ccctctctccct

SEQ ID NO: 4430132 - DNA, 18 bp, Homo sapiens
ccctctctctcactcccc

SEQ ID NO: 4430133 - DNA, 14 bp, Homo sapiens
ccctctctctgggc

SEQ ID NO: 4430134 - DNA, 13 bp, Homo sapiens
ccctctctcttct

SEQ ID NO: 4430135 - DNA, 15 bp, Homo sapiens
ccctctctcttctgc

SEQ ID NO: 4430136 - DNA, 23 bp, Homo sapiens
ccctctctcttctgctccaccct

SEQ ID NO: 4430137 - DNA, 16 bp, Homo sapiens
ccctctctgctctgcg

SEQ ID NO: 4430138 - DNA, 15 bp, Homo sapiens
ccctctctttctctg

SEQ ID NO: 4430139 - DNA, 22 bp, Homo sapiens
ccctctgccggtcgggcagcca

SEQ ID NO: 4430140 - DNA, 12 bp, Homo sapiens
ccctctgccttg

SEQ ID NO: 4430141 - DNA, 13 bp, Homo sapiens
ccctctgccttgc

SEQ ID NO: 4430142 - DNA, 22 bp, Homo sapiens
ccctctgccttgccctcctggg

SEQ ID NO: 4430143 - DNA, 12 bp, Homo sapiens
ccctctgctgct

SEQ ID NO: 4430144 - DNA, 22 bp, Homo sapiens
ccctctgggcacgcctgctggc

SEQ ID NO: 4430145 - DNA, 20 bp, Homo sapiens
ccctcttcctaccctgcctc

SEQ ID NO: 4430146 - DNA, 11 bp, Homo sapiens
ccctctttccc

SEQ ID NO: 4430147 - DNA, 15 bp, Homo sapiens
ccctgaaaacccaga

SEQ ID NO: 4430148 - DNA, 16 bp, Homo sapiens
ccctgaaaacccagag

SEQ ID NO: 4430149 - DNA, 18 bp, Homo sapiens
ccctgaaaacccagagag

SEQ ID NO: 4430150 - DNA, 16 bp, Homo sapiens
ccctgaccctgctcct

SEQ ID NO: 4430151 - DNA, 19 bp, Homo sapiens
ccctgacctccgcccctgc

SEQ ID NO: 4430152 - DNA, 22 bp, Homo sapiens
ccctgacctccgcccctgcccc

SEQ ID NO: 4430153 - DNA, 18 bp, Homo sapiens
ccctgactccctgtgggg

SEQ ID NO: 4430154 - DNA, 14 bp, Homo sapiens
ccctgactcctgga

SEQ ID NO: 4430155 - DNA, 17 bp, Homo sapiens
ccctgactcctggactc

SEQ ID NO: 4430156 - DNA, 15 bp, Homo sapiens
ccctgacttgcttta

SEQ ID NO: 4430157 - DNA, 13 bp, Homo sapiens
ccctgagagcctg

SEQ ID NO: 4430158 - DNA, 22 bp, Homo sapiens
ccctgagatctgcacagtcaga

SEQ ID NO: 4430159 - DNA, 17 bp, Homo sapiens
ccctgagcactcctggt

SEQ ID NO: 4430160 - DNA, 14 bp, Homo sapiens
ccctgagcaggatt

SEQ ID NO: 4430161 - DNA, 12 bp, Homo sapiens
ccctgagccggc

SEQ ID NO: 4430162 - DNA, 13 bp, Homo sapiens
ccctgagctcggg

SEQ ID NO: 4430163 - DNA, 15 bp, Homo sapiens
ccctgagctcgggga

SEQ ID NO: 4430164 - DNA, 18 bp, Homo sapiens
ccctgaggccctgggctg

SEQ ID NO: 4430165 - DNA, 19 bp, Homo sapiens
ccctgaggcctagactctg

SEQ ID NO: 4430166 - DNA, 17 bp, Homo sapiens
ccctgaggcggaggctg

SEQ ID NO: 4430167 - DNA, 20 bp, Homo sapiens
ccctgaggcggaggctgtgc

SEQ ID NO: 4430168 - DNA, 23 bp, Homo sapiens
ccctgaggcggaggctgtgctcc

SEQ ID NO: 4430169 - DNA, 20 bp, Homo sapiens
ccctgaggtgaaagggagct

SEQ ID NO: 4430170 - DNA, 14 bp, Homo sapiens
ccctgagtgcgggc

SEQ ID NO: 4430171 - DNA, 23 bp, Homo sapiens
ccctgagtgcgggctgaggccag

SEQ ID NO: 4430172 - DNA, 18 bp, Homo sapiens
ccctgagttgggcagcca

SEQ ID NO: 4430173 - DNA, 18 bp, Homo sapiens
ccctgataacaacctgga

SEQ ID NO: 4430174 - DNA, 21 bp, Homo sapiens
ccctgatgacgggatgctctt

SEQ ID NO: 4430175 - DNA, 20 bp, Homo sapiens
ccctgatggcctttggaccc

SEQ ID NO: 4430176 - DNA, 19 bp, Homo sapiens
ccctgattgtgccagtgca

SEQ ID NO: 4430177 - DNA, 20 bp, Homo sapiens
ccctgcaaaaggactctcag

SEQ ID NO: 4430178 - DNA, 23 bp, Homo sapiens
ccctgcaacaaagacttgcttta

SEQ ID NO: 4430179 - DNA, 19 bp, Homo sapiens
ccctgcaacttccgctgag

SEQ ID NO: 4430180 - DNA, 9 bp, Homo sapiens
ccctgcaat

SEQ ID NO: 4430181 - DNA, 17 bp, Homo sapiens
ccctgcacacacatgca

SEQ ID NO: 4430182 - DNA, 16 bp, Homo sapiens
ccctgcacaccagaga

SEQ ID NO: 4430183 - DNA, 14 bp, Homo sapiens
ccctgcacagcagg

SEQ ID NO: 4430184 - DNA, 20 bp, Homo sapiens
ccctgcacagcaggctgcca

SEQ ID NO: 4430185 - DNA, 12 bp, Homo sapiens
ccctgcacgacc

SEQ ID NO: 4430186 - DNA, 14 bp, Homo sapiens
ccctgcacgtcatg

SEQ ID NO: 4430187 - DNA, 14 bp, Homo sapiens
ccctgcagaaccca

SEQ ID NO: 4430188 - DNA, 14 bp, Homo sapiens
ccctgcagacctca

SEQ ID NO: 4430189 - DNA, 17 bp, Homo sapiens
ccctgcagacctcaagc

SEQ ID NO: 4430190 - DNA, 19 bp, Homo sapiens
ccctgcagacctcaagcca

SEQ ID NO: 4430191 - DNA, 17 bp, Homo sapiens
ccctgccaagtctcaga

SEQ ID NO: 4430192 - DNA, 15 bp, Homo sapiens
ccctgccacagccag

SEQ ID NO: 4430193 - DNA, 20 bp, Homo sapiens
ccctgccacagccagaggag

SEQ ID NO: 4430194 - DNA, 22 bp, Homo sapiens
ccctgccaggagctttggacct

SEQ ID NO: 4430195 - DNA, 22 bp, Homo sapiens
ccctgccagtgaagtccttcag

SEQ ID NO: 4430196 - DNA, 15 bp, Homo sapiens
ccctgccagtgcctt

SEQ ID NO: 4430197 - DNA, 20 bp, Homo sapiens
ccctgccatcatgtttacag

SEQ ID NO: 4430198 - DNA, 20 bp, Homo sapiens
ccctgcccaaacccttaact

SEQ ID NO: 4430199 - DNA, 22 bp, Homo sapiens
ccctgccccaccccatccagcc

SEQ ID NO: 4430200 - DNA, 14 bp, Homo sapiens
ccctgcccccagga

SEQ ID NO: 4430201 - DNA, 17 bp, Homo sapiens
ccctgcccccaggactg

SEQ ID NO: 4430202 - DNA, 20 bp, Homo sapiens
ccctgcccccaggactgggc

SEQ ID NO: 4430203 - DNA, 18 bp, Homo sapiens
ccctgccccttctacact

SEQ ID NO: 4430204 - DNA, 13 bp, Homo sapiens
ccctgccctgcac

SEQ ID NO: 4430205 - DNA, 15 bp, Homo sapiens
ccctgccctggtcca

SEQ ID NO: 4430206 - DNA, 22 bp, Homo sapiens
ccctgccggaatgaactgtccg

SEQ ID NO: 4430207 - DNA, 24 bp, Homo sapiens
ccctgcctcaggccaagggaccag

SEQ ID NO: 4430208 - DNA, 15 bp, Homo sapiens
ccctgcctccaccct

SEQ ID NO: 4430209 - DNA, 21 bp, Homo sapiens
ccctgcctccaccctctgagc

SEQ ID NO: 4430210 - DNA, 22 bp, Homo sapiens
ccctgcctccaccctctgagct

SEQ ID NO: 4430211 - DNA, 13 bp, Homo sapiens
ccctgcctcctgc

SEQ ID NO: 4430212 - DNA, 10 bp, Homo sapiens
ccctgcctgc

SEQ ID NO: 4430213 - DNA, 13 bp, Homo sapiens
ccctgcctgcagc

SEQ ID NO: 4430214 - DNA, 16 bp, Homo sapiens
ccctgcctgcagccag

SEQ ID NO: 4430215 - DNA, 12 bp, Homo sapiens
ccctgcctggac

SEQ ID NO: 4430216 - DNA, 13 bp, Homo sapiens
ccctgcctggacc

SEQ ID NO: 4430217 - DNA, 17 bp, Homo sapiens
ccctgcctggcccccaa

SEQ ID NO: 4430218 - DNA, 23 bp, Homo sapiens
ccctgcctgtgcccgcatgtgtg

SEQ ID NO: 4430219 - DNA, 13 bp, Homo sapiens
ccctgcggcctcc

SEQ ID NO: 4430220 - DNA, 14 bp, Homo sapiens
ccctgcggcctcca

SEQ ID NO: 4430221 - DNA, 21 bp, Homo sapiens
ccctgcgggcgcgggcagcca

SEQ ID NO: 4430222 - DNA, 21 bp, Homo sapiens
ccctgctagacgcaccgcctg

SEQ ID NO: 4430223 - DNA, 19 bp, Homo sapiens
ccctgctagcacagaggcc

SEQ ID NO: 4430224 - DNA, 21 bp, Homo sapiens
ccctgctagcacagaggcctg

SEQ ID NO: 4430225 - DNA, 17 bp, Homo sapiens
ccctgctcactgggccc

SEQ ID NO: 4430226 - DNA, 18 bp, Homo sapiens
ccctgctcactgggcccg

SEQ ID NO: 4430227 - DNA, 12 bp, Homo sapiens
ccctgctcagca

SEQ ID NO: 4430228 - DNA, 19 bp, Homo sapiens
ccctgctccaccagcagca

SEQ ID NO: 4430229 - DNA, 17 bp, Homo sapiens
ccctgctcccattcctc

SEQ ID NO: 4430230 - DNA, 14 bp, Homo sapiens
ccctgctgaccttg

SEQ ID NO: 4430231 - DNA, 12 bp, Homo sapiens
ccctgctggccg

SEQ ID NO: 4430232 - DNA, 15 bp, Homo sapiens
ccctgctggccgcct

SEQ ID NO: 4430233 - DNA, 13 bp, Homo sapiens
ccctgctggggaa

SEQ ID NO: 4430234 - DNA, 17 bp, Homo sapiens
ccctgctgtgccatgct

SEQ ID NO: 4430235 - DNA, 18 bp, Homo sapiens
ccctgctgtgctgctcaa

SEQ ID NO: 4430236 - DNA, 13 bp, Homo sapiens
ccctgcttaggat

SEQ ID NO: 4430237 - DNA, 18 bp, Homo sapiens
ccctgcttaggatggggg

SEQ ID NO: 4430238 - DNA, 15 bp, Homo sapiens
ccctgcttccaggaa

SEQ ID NO: 4430239 - DNA, 19 bp, Homo sapiens
ccctgcttgcccgctccca

SEQ ID NO: 4430240 - DNA, 21 bp, Homo sapiens
ccctgcttgcccgctcccaca

SEQ ID NO: 4430241 - DNA, 15 bp, Homo sapiens
ccctggaaaccttcc

SEQ ID NO: 4430242 - DNA, 16 bp, Homo sapiens
ccctggaaaccttcca

SEQ ID NO: 4430243 - DNA, 19 bp, Homo sapiens
ccctggaactcctggcctt

SEQ ID NO: 4430244 - DNA, 18 bp, Homo sapiens
ccctggagagtgcacatg

SEQ ID NO: 4430245 - DNA, 15 bp, Homo sapiens
ccctggagcctcaga

SEQ ID NO: 4430246 - DNA, 10 bp, Homo sapiens
ccctggagga

SEQ ID NO: 4430247 - DNA, 19 bp, Homo sapiens
ccctggagggcaagccctg

SEQ ID NO: 4430248 - DNA, 20 bp, Homo sapiens
ccctggagggcaagccctgc

SEQ ID NO: 4430249 - DNA, 20 bp, Homo sapiens
ccctggatcacataccaggt

SEQ ID NO: 4430250 - DNA, 13 bp, Homo sapiens
ccctttccttcca

SEQ ID NO: 4430251 - DNA, 15 bp, Homo sapiens
ccctttccttccatc

SEQ ID NO: 4430252 - DNA, 14 bp, Homo sapiens
ccctttctcttctt

SEQ ID NO: 4430253 - DNA, 14 bp, Homo sapiens
ccctttctgtccca

SEQ ID NO: 4430254 - DNA, 17 bp, Homo sapiens
ccctttgcccagaaaga

SEQ ID NO: 4430255 - DNA, 16 bp, Homo sapiens
cccttttcccccttcc

SEQ ID NO: 4430256 - DNA, 13 bp, Homo sapiens
ccgaagtcttttg

SEQ ID NO: 4430257 - DNA, 23 bp, Homo sapiens
ccgaatttggtacacatgtgtta

SEQ ID NO: 4430258 - DNA, 16 bp, Homo sapiens
ccgacactgagctgtg

SEQ ID NO: 4430259 - DNA, 13 bp, Homo sapiens
ccgacctcgtcct

SEQ ID NO: 4430260 - DNA, 12 bp, Homo sapiens
ccgactccagcc

SEQ ID NO: 4430261 - DNA, 15 bp, Homo sapiens
ccgactccagccagc

SEQ ID NO: 4430262 - DNA, 20 bp, Homo sapiens
ccgactgaaaatattgtttt

SEQ ID NO: 4430263 - DNA, 13 bp, Homo sapiens
ccgactgcccaga

SEQ ID NO: 4430264 - DNA, 13 bp, Homo sapiens
ccgactgcccctg

SEQ ID NO: 4430265 - DNA, 18 bp, Homo sapiens
ccgactgcccctgctgtg

SEQ ID NO: 4430266 - DNA, 17 bp, Homo sapiens
ccgacttggagactcct

SEQ ID NO: 4430267 - DNA, 19 bp, Homo sapiens
ccgacttggagactcctgg

SEQ ID NO: 4430268 - DNA, 22 bp, Homo sapiens
ccgacttttgtttaccagagaa

SEQ ID NO: 4430269 - DNA, 17 bp, Homo sapiens
ccgagactcagcctctg

SEQ ID NO: 4430270 - DNA, 19 bp, Homo sapiens
ccgagactcagcctctgct

SEQ ID NO: 4430271 - DNA, 14 bp, Homo sapiens
ccgagagcctgctc

SEQ ID NO: 4430272 - DNA, 16 bp, Homo sapiens
ccgagagtagccgaga

SEQ ID NO: 4430273 - DNA, 20 bp, Homo sapiens
ccgagagtccatcagcctcc

SEQ ID NO: 4430274 - DNA, 21 bp, Homo sapiens
ccgagagtccatcagcctcca

SEQ ID NO: 4430275 - DNA, 10 bp, Homo sapiens
ccgagcccag

SEQ ID NO: 4430276 - DNA, 13 bp, Homo sapiens
ccgagccctgact

SEQ ID NO: 4430277 - DNA, 19 bp, Homo sapiens
ccgagccctgactcctgga

SEQ ID NO: 4430278 - DNA, 23 bp, Homo sapiens
ccgagccctgactcctggactcc

SEQ ID NO: 4430279 - DNA, 19 bp, Homo sapiens
ccgagcctgaactgagccc

SEQ ID NO: 4430280 - DNA, 21 bp, Homo sapiens
ccgagcgggtgcaagcactcg

SEQ ID NO: 4430281 - DNA, 13 bp, Homo sapiens
ccgagctcctggg

SEQ ID NO: 4430282 - DNA, 14 bp, Homo sapiens
ccgagctcctgggg

SEQ ID NO: 4430283 - DNA, 16 bp, Homo sapiens
ccgaggacccagaccc

SEQ ID NO: 4430284 - DNA, 18 bp, Homo sapiens
ccgaggacccagacccag

SEQ ID NO: 4430285 - DNA, 13 bp, Homo sapiens
ccgaggacccagg

SEQ ID NO: 4430286 - DNA, 15 bp, Homo sapiens
ccgaggagctgggcc

SEQ ID NO: 4430287 - DNA, 21 bp, Homo sapiens
ccgaggcagacgtctgtcagg

SEQ ID NO: 4430288 - DNA, 14 bp, Homo sapiens
ccgaggcaggtgga

SEQ ID NO: 4430289 - DNA, 17 bp, Homo sapiens
ccgaggctacagctcca

SEQ ID NO: 4430290 - DNA, 23 bp, Homo sapiens
ccgagggaggggaagcttctgtc

SEQ ID NO: 4430291 - DNA, 21 bp, Homo sapiens
ccgagggtcctggctcctgag

SEQ ID NO: 4430292 - DNA, 13 bp, Homo sapiens
ccgagtgcactgc

SEQ ID NO: 4430293 - DNA, 13 bp, Homo sapiens
ccgatttctgtaa

SEQ ID NO: 4430294 - DNA, 22 bp, Homo sapiens
ccgcacatgtgccactgttcag

SEQ ID NO: 4430295 - DNA, 13 bp, Homo sapiens
ccgcaccccagag

SEQ ID NO: 4430296 - DNA, 16 bp, Homo sapiens
ccgcaccctgtcctgc

SEQ ID NO: 4430297 - DNA, 12 bp, Homo sapiens
ccgcactctgcc

SEQ ID NO: 4430298 - DNA, 17 bp, Homo sapiens
ccgcagacggtctgtgt

SEQ ID NO: 4430299 - DNA, 15 bp, Homo sapiens
ccgcagagctggccg

SEQ ID NO: 4430300 - DNA, 14 bp, Homo sapiens
ccgcagcccgcctg

SEQ ID NO: 4430301 - DNA, 14 bp, Homo sapiens
ccgcaggaaggcag

SEQ ID NO: 4430302 - DNA, 15 bp, Homo sapiens
ccgcaggagggcaga

SEQ ID NO: 4430303 - DNA, 12 bp, Homo sapiens
ccgcagggcggg

SEQ ID NO: 4430304 - DNA, 19 bp, Homo sapiens
ccgcatcttctccatctgg

SEQ ID NO: 4430305 - DNA, 14 bp, Homo sapiens
ccgcatgtgtgcct

SEQ ID NO: 4430306 - DNA, 15 bp, Homo sapiens
ccgcatgtgtgcctg

SEQ ID NO: 4430307 - DNA, 13 bp, Homo sapiens
ccgcattccctga

SEQ ID NO: 4430308 - DNA, 17 bp, Homo sapiens
ccgcattggtgactcac

SEQ ID NO: 4430309 - DNA, 14 bp, Homo sapiens
ccgccaacacgcct

SEQ ID NO: 4430310 - DNA, 19 bp, Homo sapiens
ccgccactaggtgtcccca

SEQ ID NO: 4430311 - DNA, 13 bp, Homo sapiens
ccgccagcctcct

SEQ ID NO: 4430312 - DNA, 14 bp, Homo sapiens
ccgccagcctcctc

SEQ ID NO: 4430313 - DNA, 23 bp, Homo sapiens
ccgccagcctcctctggacggca

SEQ ID NO: 4430314 - DNA, 12 bp, Homo sapiens
ccgccagggctg

SEQ ID NO: 4430315 - DNA, 14 bp, Homo sapiens
ccgccagggctggg

SEQ ID NO: 4430316 - DNA, 17 bp, Homo sapiens
ccgccagggctggggac

SEQ ID NO: 4430317 - DNA, 16 bp, Homo sapiens
ccgccatggtgtcccg

SEQ ID NO: 4430318 - DNA, 17 bp, Homo sapiens
ccgccatggtgtcccgg

SEQ ID NO: 4430319 - DNA, 15 bp, Homo sapiens
ccgccattgccacca

SEQ ID NO: 4430320 - DNA, 19 bp, Homo sapiens
ccgccattgccaccaggag

SEQ ID NO: 4430321 - DNA, 14 bp, Homo sapiens
ccgcccaaggcctt

SEQ ID NO: 4430322 - DNA, 17 bp, Homo sapiens
ccgcccaaggccttccc

SEQ ID NO: 4430323 - DNA, 14 bp, Homo sapiens
ccgcccacccgcct

SEQ ID NO: 4430324 - DNA, 18 bp, Homo sapiens
ccgccccagagtggccca

SEQ ID NO: 4430325 - DNA, 12 bp, Homo sapiens
ccgccctgtggg

SEQ ID NO: 4430326 - DNA, 20 bp, Homo sapiens
ccgcccttccatgtgccttt

SEQ ID NO: 4430327 - DNA, 18 bp, Homo sapiens
ccgcccttccgagcggcg

SEQ ID NO: 4430328 - DNA, 17 bp, Homo sapiens
ccgccgcctcccacggc

SEQ ID NO: 4430329 - DNA, 18 bp, Homo sapiens
ccgcctcaccccctcggg

SEQ ID NO: 4430330 - DNA, 21 bp, Homo sapiens
ccgcctccactctagttctag

SEQ ID NO: 4430331 - DNA, 22 bp, Homo sapiens
ccgcctccactctagttctaga

SEQ ID NO: 4430332 - DNA, 23 bp, Homo sapiens
ccgcctccactctagttctagat

SEQ ID NO: 4430333 - DNA, 15 bp, Homo sapiens
ccgcctcccacggca

SEQ ID NO: 4430334 - DNA, 23 bp, Homo sapiens
ccgcctccctagttagcatccag

SEQ ID NO: 4430335 - DNA, 20 bp, Homo sapiens
ccgcctcgacctccccaccc

SEQ ID NO: 4430336 - DNA, 12 bp, Homo sapiens
ccgcctgccacc

SEQ ID NO: 4430337 - DNA, 13 bp, Homo sapiens
ccgcctgccaccg

SEQ ID NO: 4430338 - DNA, 11 bp, Homo sapiens
ccgcctgccag

SEQ ID NO: 4430339 - DNA, 15 bp, Homo sapiens
ccgcctgccagtcct

SEQ ID NO: 4430340 - DNA, 21 bp, Homo sapiens
ccgcctgccagtcctagctgc

SEQ ID NO: 4430341 - DNA, 20 bp, Homo sapiens
ccgcctgcccagactgatga

SEQ ID NO: 4430342 - DNA, 14 bp, Homo sapiens
ccgcctgccgtgca

SEQ ID NO: 4430343 - DNA, 21 bp, Homo sapiens
ccgcctgggtcatgggcctgt

SEQ ID NO: 4430344 - DNA, 17 bp, Homo sapiens
ccgcctgtcacaataaa

SEQ ID NO: 4430345 - DNA, 16 bp, Homo sapiens
ccgccttctcccacat

SEQ ID NO: 4430346 - DNA, 17 bp, Homo sapiens
ccgccttgcccagcctg

SEQ ID NO: 4430347 - DNA, 22 bp, Homo sapiens
ccgccttgcccagcctggatgc

SEQ ID NO: 4430348 - DNA, 13 bp, Homo sapiens
ccgccttgtgaga

SEQ ID NO: 4430349 - DNA, 19 bp, Homo sapiens
ccgccttgtgagatggaat

SEQ ID NO: 4430350 - DNA, 17 bp, Homo sapiens
ccgcctttacaagggag

SEQ ID NO: 4430351 - DNA, 17 bp, Homo sapiens
ccgccttttagttttgg

SEQ ID NO: 4430352 - DNA, 21 bp, Homo sapiens
ccgcgggagacagcttctctg

SEQ ID NO: 4430353 - DNA, 23 bp, Homo sapiens
ccgcgggagacagcttctctgca

SEQ ID NO: 4430354 - DNA, 15 bp, Homo sapiens
ccgcgggttctagac

SEQ ID NO: 4430355 - DNA, 16 bp, Homo sapiens
ccgcgggttctagacg

SEQ ID NO: 4430356 - DNA, 15 bp, Homo sapiens
ccgcgtcccagctcc

SEQ ID NO: 4430357 - DNA, 16 bp, Homo sapiens
ccgcgtcccagctccc

SEQ ID NO: 4430358 - DNA, 18 bp, Homo sapiens
ccgctaaaagaaactttc

SEQ ID NO: 4430359 - DNA, 14 bp, Homo sapiens
ccgctcccacagct

SEQ ID NO: 4430360 - DNA, 21 bp, Homo sapiens
ccgctctcttttctgtacttc

SEQ ID NO: 4430361 - DNA, 21 bp, Homo sapiens
ccgctctgcatgcggcccagc

SEQ ID NO: 4430362 - DNA, 20 bp, Homo sapiens
ccgctgaagatggagggggc

SEQ ID NO: 4430363 - DNA, 20 bp, Homo sapiens
ccgctgccacccgcccaccc

SEQ ID NO: 4430364 - DNA, 15 bp, Homo sapiens
ccgctgccagccttg

SEQ ID NO: 4430365 - DNA, 19 bp, Homo sapiens
ccgctgccatgctttgagt

SEQ ID NO: 4430366 - DNA, 20 bp, Homo sapiens
ccgctgctgtgctctgggga

SEQ ID NO: 4430367 - DNA, 22 bp, Homo sapiens
ccgctggtgcctcccgggacga

SEQ ID NO: 4430368 - DNA, 19 bp, Homo sapiens
ccgctgtggccggtgccag

SEQ ID NO: 4430369 - DNA, 20 bp, Homo sapiens
ttcctctcaaattcagctct

SEQ ID NO: 4430370 - DNA, 15 bp, Homo sapiens
ttcctctgcctgccc

SEQ ID NO: 4430371 - DNA, 14 bp, Homo sapiens
ttcctctgctcacc

SEQ ID NO: 4430372 - DNA, 14 bp, Homo sapiens
ttcctctggccgca

SEQ ID NO: 4430373 - DNA, 23 bp, Homo sapiens
ttcctcttgaacgttatgttcag

SEQ ID NO: 4430374 - DNA, 14 bp, Homo sapiens
ttcctgaaccatgt

SEQ ID NO: 4430375 - DNA, 16 bp, Homo sapiens
ttcctgaagctgctgt

SEQ ID NO: 4430376 - DNA, 19 bp, Homo sapiens
ttcctgaagctgctgtgtc

SEQ ID NO: 4430377 - DNA, 22 bp, Homo sapiens
ttcctgaattctatttgctggg

SEQ ID NO: 4430378 - DNA, 13 bp, Homo sapiens
ttcctgacacttt

SEQ ID NO: 4430379 - DNA, 18 bp, Homo sapiens
ttcctgagacacccgatt

SEQ ID NO: 4430380 - DNA, 14 bp, Homo sapiens
ttcctgagctttat

SEQ ID NO: 4430381 - DNA, 22 bp, Homo sapiens
ttcctgattaccagtctgatta

SEQ ID NO: 4430382 - DNA, 15 bp, Homo sapiens
ttcctgcccttccct

SEQ ID NO: 4430383 - DNA, 18 bp, Homo sapiens
ttcctgcccttccctctg

SEQ ID NO: 4430384 - DNA, 23 bp, Homo sapiens
ttcctgcccttccctctgggcac

SEQ ID NO: 4430385 - DNA, 21 bp, Homo sapiens
ttcctgcgggcttttccccgg

SEQ ID NO: 4430386 - DNA, 17 bp, Homo sapiens
ttcctgcgtcctcctca

SEQ ID NO: 4430387 - DNA, 15 bp, Homo sapiens
ttcctgctgctgcta

SEQ ID NO: 4430388 - DNA, 16 bp, Homo sapiens
ttcctgctgctgctac

SEQ ID NO: 4430389 - DNA, 15 bp, Homo sapiens
ttcctggacatcacc

SEQ ID NO: 4430390 - DNA, 15 bp, Homo sapiens
ttcctggagcccaga

SEQ ID NO: 4430391 - DNA, 16 bp, Homo sapiens
ttcctggagcccagag

SEQ ID NO: 4430392 - DNA, 16 bp, Homo sapiens
ttcctggagttttcag

SEQ ID NO: 4430393 - DNA, 19 bp, Homo sapiens
ttcctggcacattgcccct

SEQ ID NO: 4430394 - DNA, 14 bp, Homo sapiens
ttcctggcagctgc

SEQ ID NO: 4430395 - DNA, 16 bp, Homo sapiens
ttcctggcagctgctg

SEQ ID NO: 4430396 - DNA, 17 bp, Homo sapiens
ttcctggcagctgctgt

SEQ ID NO: 4430397 - DNA, 19 bp, Homo sapiens
ttcctggcagctgctgtgg

SEQ ID NO: 4430398 - DNA, 14 bp, Homo sapiens
ttcctggccttctg

SEQ ID NO: 4430399 - DNA, 23 bp, Homo sapiens
ttcctggctgctgccatgtctca

SEQ ID NO: 4430400 - DNA, 17 bp, Homo sapiens
ttcctgggaggacaggc

SEQ ID NO: 4430401 - DNA, 19 bp, Homo sapiens
ttcctgggaggacaggcag

SEQ ID NO: 4430402 - DNA, 20 bp, Homo sapiens
ttcctgggaggacaggcagg

SEQ ID NO: 4430403 - DNA, 20 bp, Homo sapiens
ttcctggtgccaatttcaag

SEQ ID NO: 4430404 - DNA, 22 bp, Homo sapiens
ttcctggtttaattcagcagag

SEQ ID NO: 4430405 - DNA, 21 bp, Homo sapiens
ttcctgtaatatatttatata

SEQ ID NO: 4430406 - DNA, 14 bp, Homo sapiens
ttcctgtccctgag

SEQ ID NO: 4430407 - DNA, 12 bp, Homo sapiens
ttcctgtcctgc

SEQ ID NO: 4430408 - DNA, 14 bp, Homo sapiens
ttcctgtcctgccc

SEQ ID NO: 4430409 - DNA, 15 bp, Homo sapiens
ttcctgtctgtttat

SEQ ID NO: 4430410 - DNA, 21 bp, Homo sapiens
ttcctgtggaataaagatggt

SEQ ID NO: 4430411 - DNA, 21 bp, Homo sapiens
ttcctgtggttttattacaaa

SEQ ID NO: 4430412 - DNA, 18 bp, Homo sapiens
ttcctgtgtaacatctgc

SEQ ID NO: 4430413 - DNA, 12 bp, Homo sapiens
ttcctgtgtatt

SEQ ID NO: 4430414 - DNA, 14 bp, Homo sapiens
ttcctgttcagcat

SEQ ID NO: 4430415 - DNA, 17 bp, Homo sapiens
ttcctgttcagcattct

SEQ ID NO: 4430416 - DNA, 21 bp, Homo sapiens
ttcctgttcggttccagacac

SEQ ID NO: 4430417 - DNA, 23 bp, Homo sapiens
ttcctgtttttcacattttcctt

SEQ ID NO: 4430418 - DNA, 14 bp, Homo sapiens
ttccttatccctct

SEQ ID NO: 4430419 - DNA, 19 bp, Homo sapiens
ttccttatccctctcttcc

SEQ ID NO: 4430420 - DNA, 21 bp, Homo sapiens
ttccttatgtatcagtgtcct

SEQ ID NO: 4430421 - DNA, 15 bp, Homo sapiens
ttccttccctctctg

SEQ ID NO: 4430422 - DNA, 16 bp, Homo sapiens
ttccttccttccctgg

SEQ ID NO: 4430423 - DNA, 15 bp, Homo sapiens
ttccttccttcctcc

SEQ ID NO: 4430424 - DNA, 13 bp, Homo sapiens
ttccttgaggaca

SEQ ID NO: 4430425 - DNA, 15 bp, Homo sapiens
ttccttgctatttca

SEQ ID NO: 4430426 - DNA, 20 bp, Homo sapiens
ttccttggactcattttaaa

SEQ ID NO: 4430427 - DNA, 15 bp, Homo sapiens
ttccttgtgatccaa

SEQ ID NO: 4430428 - DNA, 12 bp, Homo sapiens
ttcctttaaaaa

SEQ ID NO: 4430429 - DNA, 17 bp, Homo sapiens
ttcctttaaaaatacat

SEQ ID NO: 4430430 - DNA, 22 bp, Homo sapiens
ttcctttaaaaatacatagcat

SEQ ID NO: 4430431 - DNA, 16 bp, Homo sapiens
ttcctttacaactaaa

SEQ ID NO: 4430432 - DNA, 18 bp, Homo sapiens
ttcctttacaactaaata

SEQ ID NO: 4430433 - DNA, 19 bp, Homo sapiens
ttcctttatgtgaattttt

SEQ ID NO: 4430434 - DNA, 19 bp, Homo sapiens
ttcctttattttgctgctt

SEQ ID NO: 4430435 - DNA, 16 bp, Homo sapiens
ttcctttccctttagc

SEQ ID NO: 4430436 - DNA, 12 bp, Homo sapiens
ttccttttaatt

SEQ ID NO: 4430437 - DNA, 15 bp, Homo sapiens
ttcctttttcttcgc

SEQ ID NO: 4430438 - DNA, 17 bp, Homo sapiens
ttcctttttcttcgctg

SEQ ID NO: 4430439 - DNA, 15 bp, Homo sapiens
ttccttttttcccat

SEQ ID NO: 4430440 - DNA, 19 bp, Homo sapiens
ttccttttttcccataaga

SEQ ID NO: 4430441 - DNA, 15 bp, Homo sapiens
ttccttttttgagat

SEQ ID NO: 4430442 - DNA, 18 bp, Homo sapiens
ttccttttttgagatttt

SEQ ID NO: 4430443 - DNA, 14 bp, Homo sapiens
ttcctttttttgat

SEQ ID NO: 4430444 - DNA, 15 bp, Homo sapiens
ttcgaatctctgccc

SEQ ID NO: 4430445 - DNA, 15 bp, Homo sapiens
ttcgatgaagttctg

SEQ ID NO: 4430446 - DNA, 15 bp, Homo sapiens
ttcgcacacacccat

SEQ ID NO: 4430447 - DNA, 17 bp, Homo sapiens
ttcgcagctgaagtgga

SEQ ID NO: 4430448 - DNA, 18 bp, Homo sapiens
ttcgcatggtcacacact

SEQ ID NO: 4430449 - DNA, 21 bp, Homo sapiens
ttcgctaagggcttgtttttc

SEQ ID NO: 4430450 - DNA, 17 bp, Homo sapiens
ttcggacagacatatgg

SEQ ID NO: 4430451 - DNA, 13 bp, Homo sapiens
ttcggtgtgcacc

SEQ ID NO: 4430452 - DNA, 16 bp, Homo sapiens
ttcgtaatagctcaga

SEQ ID NO: 4430453 - DNA, 18 bp, Homo sapiens
ttcgtcttccctgcttca

SEQ ID NO: 4430454 - DNA, 13 bp, Homo sapiens
ttcgtgagctggg

SEQ ID NO: 4430455 - DNA, 15 bp, Homo sapiens
ttcgtgagctgggga

SEQ ID NO: 4430456 - DNA, 16 bp, Homo sapiens
ttcgttagaccgctct

SEQ ID NO: 4430457 - DNA, 22 bp, Homo sapiens
ttcgttggtgaccagtttctta

SEQ ID NO: 4430458 - DNA, 14 bp, Homo sapiens
ttcgtttccatcat

SEQ ID NO: 4430459 - DNA, 20 bp, Homo sapiens
ttcgtttccatcatgtctgt

SEQ ID NO: 4430460 - DNA, 12 bp, Homo sapiens
ttcgttttggtt

SEQ ID NO: 4430461 - DNA, 15 bp, Homo sapiens
ttctaaaaagtcaga

SEQ ID NO: 4430462 - DNA, 18 bp, Homo sapiens
ttctaaaaagtcagatgt

SEQ ID NO: 4430463 - DNA, 20 bp, Homo sapiens
ttctaaaaagtcagatgttt

SEQ ID NO: 4430464 - DNA, 16 bp, Homo sapiens
ttctaaaatagcaata

SEQ ID NO: 4430465 - DNA, 17 bp, Homo sapiens
ttctaaaatagcaataa

SEQ ID NO: 4430466 - DNA, 23 bp, Homo sapiens
ttctaaaatagcaataactgaaa

SEQ ID NO: 4430467 - DNA, 19 bp, Homo sapiens
ttctaaaatataatcaacc

SEQ ID NO: 4430468 - DNA, 20 bp, Homo sapiens
ttctaaataaatttcccagt

SEQ ID NO: 4430469 - DNA, 15 bp, Homo sapiens
ttctaaatattgctt

SEQ ID NO: 4430470 - DNA, 17 bp, Homo sapiens
ttctaaatattgcttca

SEQ ID NO: 4430471 - DNA, 20 bp, Homo sapiens
ttctaaatattgcttcaatt

SEQ ID NO: 4430472 - DNA, 13 bp, Homo sapiens
ttctaaatgcaat

SEQ ID NO: 4430473 - DNA, 15 bp, Homo sapiens
ttctaaatgcaataa

SEQ ID NO: 4430474 - DNA, 12 bp, Homo sapiens
ttctaacttttc

SEQ ID NO: 4430475 - DNA, 18 bp, Homo sapiens
ttctaagaaatcaagtaa

SEQ ID NO: 4430476 - DNA, 17 bp, Homo sapiens
ttctaagaagacatttt

SEQ ID NO: 4430477 - DNA, 19 bp, Homo sapiens
ttctaagaagacattttgt

SEQ ID NO: 4430478 - DNA, 23 bp, Homo sapiens
ttctaagaagtgaaaatctacac

SEQ ID NO: 4430479 - DNA, 15 bp, Homo sapiens
ttctaagactctgtg

SEQ ID NO: 4430480 - DNA, 17 bp, Homo sapiens
ttctaagcataaaagat

SEQ ID NO: 4430481 - DNA, 16 bp, Homo sapiens
ttctaagtaaaaccac

SEQ ID NO: 4430482 - DNA, 20 bp, Homo sapiens
ttctaagtaaaaccacagca

SEQ ID NO: 4430483 - DNA, 20 bp, Homo sapiens
ttctaagtgaaatttctagc

SEQ ID NO: 4430484 - DNA, 13 bp, Homo sapiens
ttctaatataatg

SEQ ID NO: 4430485 - DNA, 21 bp, Homo sapiens
ttctaatgaggagagaaaata

SEQ ID NO: 4430486 - DNA, 16 bp, Homo sapiens
ttctaatgtttactat

SEQ ID NO: 4430487 - DNA, 19 bp, Homo sapiens
ttctaatgtttactatata

SEQ ID NO: 4430488 - DNA, 22 bp, Homo sapiens
ttctaattaaccttactaatta

SEQ ID NO: 4430489 - DNA, 16 bp, Homo sapiens
ttctacaataatttgt

SEQ ID NO: 4430490 - DNA, 17 bp, Homo sapiens
ttctacacactcagcca

SEQ ID NO: 4430491 - DNA, 15 bp, Homo sapiens
ttctacagtggtttt

SEQ ID NO: 4430492 - DNA, 22 bp, Homo sapiens
ttctacatgtgagatagttttc

SEQ ID NO: 4430493 - DNA, 19 bp, Homo sapiens
ttctaccacacacagcctg

SEQ ID NO: 4430494 - DNA, 16 bp, Homo sapiens
ttctactatgatcaga

SEQ ID NO: 4430495 - DNA, 12 bp, Homo sapiens
ttctactcccct

SEQ ID NO: 4430496 - DNA, 13 bp, Homo sapiens
ttctactgctctc

SEQ ID NO: 4430497 - DNA, 18 bp, Homo sapiens
ttctagacgcccctccca

SEQ ID NO: 4430498 - DNA, 19 bp, Homo sapiens
ttctagacgcccctcccaa

SEQ ID NO: 4430499 - DNA, 22 bp, Homo sapiens
ttctagactcaaaacctggaga

SEQ ID NO: 4430500 - DNA, 15 bp, Homo sapiens
ttctagacttcccca

SEQ ID NO: 4430501 - DNA, 17 bp, Homo sapiens
ttctagacttccccatc

SEQ ID NO: 4430502 - DNA, 15 bp, Homo sapiens
ttctagagacacatt

SEQ ID NO: 4430503 - DNA, 18 bp, Homo sapiens
ttctagatacaataaatt

SEQ ID NO: 4430504 - DNA, 19 bp, Homo sapiens
ttctagatcctgcacccca

SEQ ID NO: 4430505 - DNA, 15 bp, Homo sapiens
ttctagattaccatg

SEQ ID NO: 4430506 - DNA, 14 bp, Homo sapiens
ttctagcactggcc

SEQ ID NO: 4430507 - DNA, 16 bp, Homo sapiens
ttctagcactggcctg

SEQ ID NO: 4430508 - DNA, 17 bp, Homo sapiens
ttctagcactggcctgc

SEQ ID NO: 4430509 - DNA, 17 bp, Homo sapiens
ttctagcagtgagccaa

SEQ ID NO: 4430510 - DNA, 24 bp, Homo sapiens
ttctagcctgcactttgatgtcat

SEQ ID NO: 4430511 - DNA, 21 bp, Homo sapiens
ttctaggagtcaactggctgg

SEQ ID NO: 4430512 - DNA, 16 bp, Homo sapiens
ttctagggacatgaaa

SEQ ID NO: 4430513 - DNA, 14 bp, Homo sapiens
ttctagtattttat

SEQ ID NO: 4430514 - DNA, 15 bp, Homo sapiens
ttctagttctgccag

SEQ ID NO: 4430515 - DNA, 13 bp, Homo sapiens
ttctagtttgttt

SEQ ID NO: 4430516 - DNA, 13 bp, Homo sapiens
ttctagttttgtc

SEQ ID NO: 4430517 - DNA, 13 bp, Homo sapiens
ttctataaattta

SEQ ID NO: 4430518 - DNA, 14 bp, Homo sapiens
ttctataaatttaa

SEQ ID NO: 4430519 - DNA, 21 bp, Homo sapiens
ttctataaggccataaaacag

SEQ ID NO: 4430520 - DNA, 20 bp, Homo sapiens
ttctataggaacatatgaaa

SEQ ID NO: 4430521 - DNA, 12 bp, Homo sapiens
ttctatatcaaa

SEQ ID NO: 4430522 - DNA, 14 bp, Homo sapiens
ttctatccttttgc

SEQ ID NO: 4430523 - DNA, 15 bp, Homo sapiens
ttctatctactgatt

SEQ ID NO: 4430524 - DNA, 16 bp, Homo sapiens
ttctatgcaggcagca

SEQ ID NO: 4430525 - DNA, 21 bp, Homo sapiens
ttctatggagactttgctgtt

SEQ ID NO: 4430526 - DNA, 15 bp, Homo sapiens
ttctatggattcact

SEQ ID NO: 4430527 - DNA, 15 bp, Homo sapiens
ttctatggctttcaa

SEQ ID NO: 4430528 - DNA, 18 bp, Homo sapiens
ttctatggctttcaaagc

SEQ ID NO: 4430529 - DNA, 16 bp, Homo sapiens
ttctatgtcattttta

SEQ ID NO: 4430530 - DNA, 22 bp, Homo sapiens
ttctatgtcatttttaatgtat

SEQ ID NO: 4430531 - DNA, 16 bp, Homo sapiens
ttctattgtgtggatg

SEQ ID NO: 4430532 - DNA, 13 bp, Homo sapiens
ttctatttataat

SEQ ID NO: 4430533 - DNA, 19 bp, Homo sapiens
ttctatttatatgtacatg

SEQ ID NO: 4430534 - DNA, 18 bp, Homo sapiens
ttctatttcttgaagaat

SEQ ID NO: 4430535 - DNA, 20 bp, Homo sapiens
ttctattttgcaaacactgt

SEQ ID NO: 4430536 - DNA, 15 bp, Homo sapiens
ttctattttttgttt

SEQ ID NO: 4430537 - DNA, 23 bp, Homo sapiens
ttctattttttgttttgtttcct

SEQ ID NO: 4430538 - DNA, 18 bp, Homo sapiens
ttctcaaaggagcgagca

SEQ ID NO: 4430539 - DNA, 21 bp, Homo sapiens
ttctcaaagtctcatagcttt

SEQ ID NO: 4430540 - DNA, 12 bp, Homo sapiens
ttctcacaaaaa

SEQ ID NO: 4430541 - DNA, 15 bp, Homo sapiens
ttctcaccagctgca

SEQ ID NO: 4430542 - DNA, 16 bp, Homo sapiens
ttctcaccagctgcaa

SEQ ID NO: 4430543 - DNA, 23 bp, Homo sapiens
ttctcaccagctgcaaagtgttt

SEQ ID NO: 4430544 - DNA, 21 bp, Homo sapiens
ttctcacgaaagtatttactt

SEQ ID NO: 4430545 - DNA, 14 bp, Homo sapiens
ttctcacgctttgt

SEQ ID NO: 4430546 - DNA, 19 bp, Homo sapiens
ttctcacgctttgtttact

SEQ ID NO: 4430547 - DNA, 17 bp, Homo sapiens
ttctcagaaccatttca

SEQ ID NO: 4430548 - DNA, 13 bp, Homo sapiens
ttctcagaagcac

SEQ ID NO: 4430549 - DNA, 15 bp, Homo sapiens
ttctcagaattcggt

SEQ ID NO: 4430550 - DNA, 18 bp, Homo sapiens
ttctcagaggggccagct

SEQ ID NO: 4430551 - DNA, 15 bp, Homo sapiens
ttctcagatttctga

SEQ ID NO: 4430552 - DNA, 18 bp, Homo sapiens
ttctcagcttgcagctgg

SEQ ID NO: 4430553 - DNA, 15 bp, Homo sapiens
ttctcaggagcttca

SEQ ID NO: 4430554 - DNA, 16 bp, Homo sapiens
ttctcaggtaatcatt

SEQ ID NO: 4430555 - DNA, 20 bp, Homo sapiens
ttctcaggtaatcattttaa

SEQ ID NO: 4430556 - DNA, 22 bp, Homo sapiens
ttctcataagtagcattcatgt

SEQ ID NO: 4430557 - DNA, 24 bp, Homo sapiens
ttctcataagtagcattcatgtaa

SEQ ID NO: 4430558 - DNA, 16 bp, Homo sapiens
ttctcataattcctac

SEQ ID NO: 4430559 - DNA, 20 bp, Homo sapiens
ttctcataattcctacagca

SEQ ID NO: 4430560 - DNA, 12 bp, Homo sapiens
ttctcatcagta

SEQ ID NO: 4430561 - DNA, 13 bp, Homo sapiens
ttctcatcagtag

SEQ ID NO: 4430562 - DNA, 15 bp, Homo sapiens
ttctcatcttgtgaa

SEQ ID NO: 4430563 - DNA, 15 bp, Homo sapiens
ttctcatctttcttg

SEQ ID NO: 4430564 - DNA, 18 bp, Homo sapiens
ttctcatctttcttgatc

SEQ ID NO: 4430565 - DNA, 20 bp, Homo sapiens
ttctcatgaaaagtttgatt

SEQ ID NO: 4430566 - DNA, 14 bp, Homo sapiens
ttctcatgatccaa

SEQ ID NO: 4430567 - DNA, 15 bp, Homo sapiens
ttctcattaaaagaa

SEQ ID NO: 4430568 - DNA, 14 bp, Homo sapiens
ttctcattgcctct

SEQ ID NO: 4430569 - DNA, 18 bp, Homo sapiens
ttctccaacaagttgcct

SEQ ID NO: 4430570 - DNA, 20 bp, Homo sapiens
ttctccagggaattcttaca

SEQ ID NO: 4430571 - DNA, 19 bp, Homo sapiens
ttctccagtcattatgtta

SEQ ID NO: 4430572 - DNA, 19 bp, Homo sapiens
ttctccatcccctccctgc

SEQ ID NO: 4430573 - DNA, 18 bp, Homo sapiens
ttctccatctggcagggt

SEQ ID NO: 4430574 - DNA, 14 bp, Homo sapiens
ttctcccaaagatt

SEQ ID NO: 4430575 - DNA, 23 bp, Homo sapiens
ttctcccacatgaggccatctca

SEQ ID NO: 4430576 - DNA, 14 bp, Homo sapiens
ttctcccagtatgt

SEQ ID NO: 4430577 - DNA, 22 bp, Homo sapiens
ttctccccgcagcccgcctgcc

SEQ ID NO: 4430578 - DNA, 16 bp, Homo sapiens
ttctcccctccctcca

SEQ ID NO: 4430579 - DNA, 18 bp, Homo sapiens
ttctcccctgcccccagg

SEQ ID NO: 4430580 - DNA, 19 bp, Homo sapiens
ttctcccctgcccccagga

SEQ ID NO: 4430581 - DNA, 21 bp, Homo sapiens
ttctcccctgcccccaggact

SEQ ID NO: 4430582 - DNA, 12 bp, Homo sapiens
ttctccctgacc

SEQ ID NO: 4430583 - DNA, 14 bp, Homo sapiens
ttctccctttctct

SEQ ID NO: 4430584 - DNA, 15 bp, Homo sapiens
ttctccgccagcctc

SEQ ID NO: 4430585 - DNA, 21 bp, Homo sapiens
ttctcctcagtggcttctcca

SEQ ID NO: 4430586 - DNA, 14 bp, Homo sapiens
ttctcctgtgaatg

SEQ ID NO: 4430587 - DNA, 16 bp, Homo sapiens
ttctcctgtgaatgga

SEQ ID NO: 4430588 - DNA, 13 bp, Homo sapiens
ttctcctgtttta

SEQ ID NO: 4430589 - DNA, 15 bp, Homo sapiens
ttctccttcagccct

SEQ ID NO: 4430590 - DNA, 20 bp, Homo sapiens
ttctccttcagccctcaccc

SEQ ID NO: 4430591 - DNA, 22 bp, Homo sapiens
ttctccttcattaatgatgatc

SEQ ID NO: 4430592 - DNA, 15 bp, Homo sapiens
ttctcgccccttccc

SEQ ID NO: 4430593 - DNA, 15 bp, Homo sapiens
ttctcggaattcata

SEQ ID NO: 4430594 - DNA, 17 bp, Homo sapiens
ttctcgttgtcacaccc

SEQ ID NO: 4430595 - DNA, 18 bp, Homo sapiens
ttctcgttgtcacaccca

SEQ ID NO: 4430596 - DNA, 19 bp, Homo sapiens
ttctctaagagaacaatgt

SEQ ID NO: 4430597 - DNA, 24 bp, Homo sapiens
ttctctaagagaacaatgtgctat

SEQ ID NO: 4430598 - DNA, 12 bp, Homo sapiens
ttctctaatatt

SEQ ID NO: 4430599 - DNA, 15 bp, Homo sapiens
ttctctagaagctcc

SEQ ID NO: 4430600 - DNA, 13 bp, Homo sapiens
ttctctcacttct

SEQ ID NO: 4430601 - DNA, 18 bp, Homo sapiens
ttctctcacttctaaatt

SEQ ID NO: 4430602 - DNA, 19 bp, Homo sapiens
ttctctcatagaacattga

SEQ ID NO: 4430603 - DNA, 22 bp, Homo sapiens
ttctctcatctaactgatgagt

SEQ ID NO: 4430604 - DNA, 12 bp, Homo sapiens
ttctctcatctc

SEQ ID NO: 4430605 - DNA, 17 bp, Homo sapiens
ttctctcatctcttagc

SEQ ID NO: 4430606 - DNA, 20 bp, Homo sapiens
ttctctcatctcttagctcc

SEQ ID NO: 4430607 - DNA, 13 bp, Homo sapiens
ttctttttccagt

SEQ ID NO: 4430608 - DNA, 14 bp, Homo sapiens
ttctttttgccagt

SEQ ID NO: 4430609 - DNA, 18 bp, Homo sapiens
ttctttttggcattatct

SEQ ID NO: 4430610 - DNA, 16 bp, Homo sapiens
ttcttttttttaatgt

SEQ ID NO: 4430611 - DNA, 18 bp, Homo sapiens
ttcttttttttaatgttt

SEQ ID NO: 4430612 - DNA, 16 bp, Homo sapiens
ttgaaaaaaaagtttt

SEQ ID NO: 4430613 - DNA, 11 bp, Homo sapiens
ttgaaaaaagc

SEQ ID NO: 4430614 - DNA, 18 bp, Homo sapiens
ttgaaaaaagctcatttc

SEQ ID NO: 4430615 - DNA, 19 bp, Homo sapiens
ttgaaaaaatttaaaagta

SEQ ID NO: 4430616 - DNA, 12 bp, Homo sapiens
ttgaaaaacttt

SEQ ID NO: 4430617 - DNA, 13 bp, Homo sapiens
ttgaaaaagcgaa

SEQ ID NO: 4430618 - DNA, 19 bp, Homo sapiens
ttgaaaaatagcatatgcc

SEQ ID NO: 4430619 - DNA, 18 bp, Homo sapiens
ttgaaaaatctcattatt

SEQ ID NO: 4430620 - DNA, 20 bp, Homo sapiens
ttgaaaaatctcattatttc

SEQ ID NO: 4430621 - DNA, 21 bp, Homo sapiens
ttgaaaaccaaaatgacatct

SEQ ID NO: 4430622 - DNA, 23 bp, Homo sapiens
ttgaaaaccaaaatgacatcttt

SEQ ID NO: 4430623 - DNA, 18 bp, Homo sapiens
ttgaaaagactccaaaga

SEQ ID NO: 4430624 - DNA, 23 bp, Homo sapiens
ttgaaaagactccaaagaaatgt

SEQ ID NO: 4430625 - DNA, 17 bp, Homo sapiens
ttgaaaagcagacattt

SEQ ID NO: 4430626 - DNA, 16 bp, Homo sapiens
ttgaaaatgtccagga

SEQ ID NO: 4430627 - DNA, 13 bp, Homo sapiens
ttgaaaccagtat

SEQ ID NO: 4430628 - DNA, 16 bp, Homo sapiens
ttgaaaccagtattta

SEQ ID NO: 4430629 - DNA, 13 bp, Homo sapiens
ttgaaacctcagg

SEQ ID NO: 4430630 - DNA, 16 bp, Homo sapiens
ttgaaacctgctctgt

SEQ ID NO: 4430631 - DNA, 18 bp, Homo sapiens
ttgaaacgttatgatgac

SEQ ID NO: 4430632 - DNA, 16 bp, Homo sapiens
ttgaaactgcatttgt

SEQ ID NO: 4430633 - DNA, 12 bp, Homo sapiens
ttgaaagatgta

SEQ ID NO: 4430634 - DNA, 16 bp, Homo sapiens
ttgaaagccaagtgtt

SEQ ID NO: 4430635 - DNA, 20 bp, Homo sapiens
ttgaaagtgggcaaaagctt

SEQ ID NO: 4430636 - DNA, 14 bp, Homo sapiens
ttgaaagtttaaca

SEQ ID NO: 4430637 - DNA, 21 bp, Homo sapiens
ttgaaataactggaacaaatt

SEQ ID NO: 4430638 - DNA, 16 bp, Homo sapiens
ttgaaataagaattca

SEQ ID NO: 4430639 - DNA, 21 bp, Homo sapiens
ttgaaatagattttttcattt

SEQ ID NO: 4430640 - DNA, 17 bp, Homo sapiens
ttgaaatagtatacatt

SEQ ID NO: 4430641 - DNA, 19 bp, Homo sapiens
ttgaaatagtatacattgt

SEQ ID NO: 4430642 - DNA, 14 bp, Homo sapiens
ttgaaatatataat

SEQ ID NO: 4430643 - DNA, 18 bp, Homo sapiens
ttgaaatatataatattc

SEQ ID NO: 4430644 - DNA, 14 bp, Homo sapiens
ttgaaatatcatgt

SEQ ID NO: 4430645 - DNA, 14 bp, Homo sapiens
ttgaaatccaggaa

SEQ ID NO: 4430646 - DNA, 14 bp, Homo sapiens
ttgaaatgaaaggg

SEQ ID NO: 4430647 - DNA, 16 bp, Homo sapiens
ttgaaatgaaagggaa

SEQ ID NO: 4430648 - DNA, 14 bp, Homo sapiens
ttgaaatgatttca

SEQ ID NO: 4430649 - DNA, 21 bp, Homo sapiens
ttgaaatggaaagtcatgcaa

SEQ ID NO: 4430650 - DNA, 15 bp, Homo sapiens
ttgaaatggcattta

SEQ ID NO: 4430651 - DNA, 13 bp, Homo sapiens
ttgaaatgtaatt

SEQ ID NO: 4430652 - DNA, 18 bp, Homo sapiens
ttgaaattaacctctcac

SEQ ID NO: 4430653 - DNA, 14 bp, Homo sapiens
ttgaaattctattt

SEQ ID NO: 4430654 - DNA, 21 bp, Homo sapiens
ttgaaattctgaatttgcaaa

SEQ ID NO: 4430655 - DNA, 22 bp, Homo sapiens
ttgaaattctgaatttgcaaag

SEQ ID NO: 4430656 - DNA, 14 bp, Homo sapiens
ttgaaatttacaca

SEQ ID NO: 4430657 - DNA, 16 bp, Homo sapiens
ttgaaatttacacagt

SEQ ID NO: 4430658 - DNA, 19 bp, Homo sapiens
ttgaaatttacacagtgag

SEQ ID NO: 4430659 - DNA, 15 bp, Homo sapiens
ttgaacaaattttct

SEQ ID NO: 4430660 - DNA, 15 bp, Homo sapiens
ttgaacacaaactgt

SEQ ID NO: 4430661 - DNA, 18 bp, Homo sapiens
ttgaacacagtattttcc

SEQ ID NO: 4430662 - DNA, 20 bp, Homo sapiens
ttgaacctggatccagcact

SEQ ID NO: 4430663 - DNA, 15 bp, Homo sapiens
ttgaactctggtggc

SEQ ID NO: 4430664 - DNA, 23 bp, Homo sapiens
ttgaactctgttcccccaccctc

SEQ ID NO: 4430665 - DNA, 18 bp, Homo sapiens
ttgaactggaataatatt

SEQ ID NO: 4430666 - DNA, 18 bp, Homo sapiens
ttgaactttccaaaacct

SEQ ID NO: 4430667 - DNA, 14 bp, Homo sapiens
ttgaacttttgtac

SEQ ID NO: 4430668 - DNA, 15 bp, Homo sapiens
ttgaactttttttaa

SEQ ID NO: 4430669 - DNA, 17 bp, Homo sapiens
ttgaagacagcttccca

SEQ ID NO: 4430670 - DNA, 20 bp, Homo sapiens
ttgaagcaaatcgaatgaaa

SEQ ID NO: 4430671 - DNA, 19 bp, Homo sapiens
ttgaagcaactacaacttc

SEQ ID NO: 4430672 - DNA, 20 bp, Homo sapiens
ttgaagcaactacaacttct

SEQ ID NO: 4430673 - DNA, 18 bp, Homo sapiens
ttgaagcagtcttgctct

SEQ ID NO: 4430674 - DNA, 22 bp, Homo sapiens
ttgaagcatagctacaatttgt

SEQ ID NO: 4430675 - DNA, 11 bp, Homo sapiens
ttgaagctaac

SEQ ID NO: 4430676 - DNA, 16 bp, Homo sapiens
ttgaaggaatacaata

SEQ ID NO: 4430677 - DNA, 18 bp, Homo sapiens
ttgaaggaatacaatata

SEQ ID NO: 4430678 - DNA, 23 bp, Homo sapiens
ttgaaggaatacaatatatagct

SEQ ID NO: 4430679 - DNA, 12 bp, Homo sapiens
ttgaaggcaaaa

SEQ ID NO: 4430680 - DNA, 11 bp, Homo sapiens
ttgaaggctta

SEQ ID NO: 4430681 - DNA, 13 bp, Homo sapiens
ttgaagggtcctg

SEQ ID NO: 4430682 - DNA, 12 bp, Homo sapiens
ttgaaggtttca

SEQ ID NO: 4430683 - DNA, 17 bp, Homo sapiens
ttgaaggtttcagatga

SEQ ID NO: 4430684 - DNA, 19 bp, Homo sapiens
ttgaagttagctttaactt

SEQ ID NO: 4430685 - DNA, 11 bp, Homo sapiens
ttgaagttgtt

SEQ ID NO: 4430686 - DNA, 14 bp, Homo sapiens
ttgaataaaaatag

SEQ ID NO: 4430687 - DNA, 12 bp, Homo sapiens
ttgaataaagag

SEQ ID NO: 4430688 - DNA, 14 bp, Homo sapiens
ttgaataaattatg

SEQ ID NO: 4430689 - DNA, 16 bp, Homo sapiens
ttgaatactctgccct

SEQ ID NO: 4430690 - DNA, 15 bp, Homo sapiens
ttgaatactgtctgt

SEQ ID NO: 4430691 - DNA, 18 bp, Homo sapiens
ttgaataggaagatcgtt

SEQ ID NO: 4430692 - DNA, 16 bp, Homo sapiens
ttgaatagtattgtgt

SEQ ID NO: 4430693 - DNA, 17 bp, Homo sapiens
ttgaatagtttatttct

SEQ ID NO: 4430694 - DNA, 14 bp, Homo sapiens
ttgaatattatata

SEQ ID NO: 4430695 - DNA, 12 bp, Homo sapiens
ttgaatattttt

SEQ ID NO: 4430696 - DNA, 14 bp, Homo sapiens
ttgaatctgggact

SEQ ID NO: 4430697 - DNA, 16 bp, Homo sapiens
ttgaatggctatgttt

SEQ ID NO: 4430698 - DNA, 21 bp, Homo sapiens
ttgaatgtggcttgagaaata

SEQ ID NO: 4430699 - DNA, 14 bp, Homo sapiens
ttgaattagaaaat

SEQ ID NO: 4430700 - DNA, 15 bp, Homo sapiens
ttgaattagaaaatt

SEQ ID NO: 4430701 - DNA, 16 bp, Homo sapiens
ttgaattagaaaatta

SEQ ID NO: 4430702 - DNA, 21 bp, Homo sapiens
ttgaattcttggttgaggaaa

SEQ ID NO: 4430703 - DNA, 17 bp, Homo sapiens
ttgaattgatacctgtt

SEQ ID NO: 4430704 - DNA, 15 bp, Homo sapiens
ttgaattgtaactgt

SEQ ID NO: 4430705 - DNA, 17 bp, Homo sapiens
ttgaattgtgtcttaat

SEQ ID NO: 4430706 - DNA, 18 bp, Homo sapiens
ttgaattgtgtcttaatc

SEQ ID NO: 4430707 - DNA, 14 bp, Homo sapiens
ttgaattgttacat

SEQ ID NO: 4430708 - DNA, 18 bp, Homo sapiens
ttgaatttttaagcaaat

SEQ ID NO: 4430709 - DNA, 16 bp, Homo sapiens
ttgaatttttcctatg

SEQ ID NO: 4430710 - DNA, 17 bp, Homo sapiens
ttgaatttttcctatgc

SEQ ID NO: 4430711 - DNA, 19 bp, Homo sapiens
ttgacaatcatctccaatg

SEQ ID NO: 4430712 - DNA, 11 bp, Homo sapiens
ttgacacatag

SEQ ID NO: 4430713 - DNA, 22 bp, Homo sapiens
ttgacacttatagattgaaatt

SEQ ID NO: 4430714 - DNA, 15 bp, Homo sapiens
ttgacataaagttga

SEQ ID NO: 4430715 - DNA, 19 bp, Homo sapiens
ttgacataaagttgataaa

SEQ ID NO: 4430716 - DNA, 18 bp, Homo sapiens
ttgacatatttaatgttt

SEQ ID NO: 4430717 - DNA, 13 bp, Homo sapiens
ttgacatggaaat

SEQ ID NO: 4430718 - DNA, 16 bp, Homo sapiens
ttgacatggaaatgaa

SEQ ID NO: 4430719 - DNA, 17 bp, Homo sapiens
ttgacccacaagaaatg

SEQ ID NO: 4430720 - DNA, 21 bp, Homo sapiens
ttgacctttatttattaaact

SEQ ID NO: 4430721 - DNA, 16 bp, Homo sapiens
ttgactactagagctc

SEQ ID NO: 4430722 - DNA, 19 bp, Homo sapiens
ttgactagggattcaggct

SEQ ID NO: 4430723 - DNA, 15 bp, Homo sapiens
ttgactccactactt

SEQ ID NO: 4430724 - DNA, 21 bp, Homo sapiens
ttgactcctttccaatagaaa

SEQ ID NO: 4430725 - DNA, 17 bp, Homo sapiens
ttgactgatgattttcc

SEQ ID NO: 4430726 - DNA, 19 bp, Homo sapiens
ttgactgatgattttcctt

SEQ ID NO: 4430727 - DNA, 11 bp, Homo sapiens
ttgactgtaat

SEQ ID NO: 4430728 - DNA, 15 bp, Homo sapiens
ttgactgtcagcaag

SEQ ID NO: 4430729 - DNA, 23 bp, Homo sapiens
ttgacttcattttatatttaaaa

SEQ ID NO: 4430730 - DNA, 17 bp, Homo sapiens
ttgacttttcaataaat

SEQ ID NO: 4430731 - DNA, 16 bp, Homo sapiens
ttgagaagaggacatt

SEQ ID NO: 4430732 - DNA, 19 bp, Homo sapiens
ttgagaatcactgctccag

SEQ ID NO: 4430733 - DNA, 20 bp, Homo sapiens
ttgagaccaacttttcaatg

SEQ ID NO: 4430734 - DNA, 23 bp, Homo sapiens
ttgagaccatccattctcctcag

SEQ ID NO: 4430735 - DNA, 14 bp, Homo sapiens
ttgagactagtttt

SEQ ID NO: 4430736 - DNA, 23 bp, Homo sapiens
ttgagactttcttctagtgcttt

SEQ ID NO: 4430737 - DNA, 23 bp, Homo sapiens
ttgagagaagccacgctgtcctc

SEQ ID NO: 4430738 - DNA, 12 bp, Homo sapiens
ttgagagccagt

SEQ ID NO: 4430739 - DNA, 17 bp, Homo sapiens
ttgagattgccccaggt

SEQ ID NO: 4430740 - DNA, 20 bp, Homo sapiens
ttgagattgccccaggtctg

SEQ ID NO: 4430741 - DNA, 17 bp, Homo sapiens
ttgagattttttttccg

SEQ ID NO: 4430742 - DNA, 21 bp, Homo sapiens
ttgagcagtggcctacaaatc

SEQ ID NO: 4430743 - DNA, 22 bp, Homo sapiens
ttgagcagtggcctacaaatca

SEQ ID NO: 4430744 - DNA, 13 bp, Homo sapiens
ttgagcatatttt

SEQ ID NO: 4430745 - DNA, 16 bp, Homo sapiens
ttgagcatcaatcttg

SEQ ID NO: 4430746 - DNA, 17 bp, Homo sapiens
ttgagcatcaatcttgt

SEQ ID NO: 4430747 - DNA, 14 bp, Homo sapiens
ttgagccctggctg

SEQ ID NO: 4430748 - DNA, 19 bp, Homo sapiens
ttgagcgtgcgcactgcat

SEQ ID NO: 4430749 - DNA, 23 bp, Homo sapiens
ttgagcgtgcgcactgcatggga

SEQ ID NO: 4430750 - DNA, 20 bp, Homo sapiens
ttgagctactggattcttat

SEQ ID NO: 4430751 - DNA, 16 bp, Homo sapiens
ttgagctgccttccct

SEQ ID NO: 4430752 - DNA, 14 bp, Homo sapiens
ttgagctggtaaca

SEQ ID NO: 4430753 - DNA, 23 bp, Homo sapiens
ttgaggaaaacaagcattcacaa

SEQ ID NO: 4430754 - DNA, 14 bp, Homo sapiens
ttgaggaaagaaat

SEQ ID NO: 4430755 - DNA, 14 bp, Homo sapiens
ttgaggaactgtac

SEQ ID NO: 4430756 - DNA, 19 bp, Homo sapiens
ttgaggaactgtacagaaa

SEQ ID NO: 4430757 - DNA, 13 bp, Homo sapiens
ttgaggatctatt

SEQ ID NO: 4430758 - DNA, 12 bp, Homo sapiens
ttgaggtccatg

SEQ ID NO: 4430759 - DNA, 22 bp, Homo sapiens
ttgaggtttttaaatatatatt

SEQ ID NO: 4430760 - DNA, 15 bp, Homo sapiens
ttgagtagacacatt

SEQ ID NO: 4430761 - DNA, 20 bp, Homo sapiens
ttgagtagacacatttaagg

SEQ ID NO: 4430762 - DNA, 13 bp, Homo sapiens
ttgagtcattgac

SEQ ID NO: 4430763 - DNA, 15 bp, Homo sapiens
ttgagtccacgccca

SEQ ID NO: 4430764 - DNA, 19 bp, Homo sapiens
ttgagtcctaggacttaaa

SEQ ID NO: 4430765 - DNA, 20 bp, Homo sapiens
ttgagtcttaactgtatttc

SEQ ID NO: 4430766 - DNA, 14 bp, Homo sapiens
ttgagtgctctgat

SEQ ID NO: 4430767 - DNA, 15 bp, Homo sapiens
ttgagtgctctgatc

SEQ ID NO: 4430768 - DNA, 15 bp, Homo sapiens
ttgagttatcaggga

SEQ ID NO: 4430769 - DNA, 17 bp, Homo sapiens
ttgagttatcagggaac

SEQ ID NO: 4430770 - DNA, 22 bp, Homo sapiens
ttgagttattccacaaacacat

SEQ ID NO: 4430771 - DNA, 15 bp, Homo sapiens
ttgagttgctctgtc

SEQ ID NO: 4430772 - DNA, 13 bp, Homo sapiens
ttgagtttgtagg

SEQ ID NO: 4430773 - DNA, 15 bp, Homo sapiens
ttgagtttttcctcc

SEQ ID NO: 4430774 - DNA, 17 bp, Homo sapiens
ttgagtttttcctccca

SEQ ID NO: 4430775 - DNA, 23 bp, Homo sapiens
ttgagtttttcctcccagtgaga

SEQ ID NO: 4430776 - DNA, 14 bp, Homo sapiens
ttgataaacataat

SEQ ID NO: 4430777 - DNA, 16 bp, Homo sapiens
ttgatataattgtact

SEQ ID NO: 4430778 - DNA, 13 bp, Homo sapiens
ttgatataccaaa

SEQ ID NO: 4430779 - DNA, 15 bp, Homo sapiens
ttgatattatattaa

SEQ ID NO: 4430780 - DNA, 17 bp, Homo sapiens
ttgatcaacatcttttc

SEQ ID NO: 4430781 - DNA, 18 bp, Homo sapiens
ttgatcaacatcttttct

SEQ ID NO: 4430782 - DNA, 17 bp, Homo sapiens
ttgatcagatgctgaat

SEQ ID NO: 4430783 - DNA, 18 bp, Homo sapiens
ttgatccagtcattttat

SEQ ID NO: 4430784 - DNA, 13 bp, Homo sapiens
ttgatctctcttg

SEQ ID NO: 4430785 - DNA, 22 bp, Homo sapiens
ttgatctctcttgtcctcttct

SEQ ID NO: 4430786 - DNA, 22 bp, Homo sapiens
ttgatctgttgcaagcccctct

SEQ ID NO: 4430787 - DNA, 13 bp, Homo sapiens
ttgatctttgagc

SEQ ID NO: 4430788 - DNA, 12 bp, Homo sapiens
ttgatctttgtt

SEQ ID NO: 4430789 - DNA, 21 bp, Homo sapiens
ttgatctttgtttaaatgcca

SEQ ID NO: 4430790 - DNA, 17 bp, Homo sapiens
ttgatctttttatcatg

SEQ ID NO: 4430791 - DNA, 18 bp, Homo sapiens
ttgatgagttaactgtga

SEQ ID NO: 4430792 - DNA, 16 bp, Homo sapiens
ttgatgcatgctattc

SEQ ID NO: 4430793 - DNA, 15 bp, Homo sapiens
ttgatgcccaatata

SEQ ID NO: 4430794 - DNA, 16 bp, Homo sapiens
ttgatggagtgtgagc

SEQ ID NO: 4430795 - DNA, 20 bp, Homo sapiens
ttgatgtacagtctgtcatg

SEQ ID NO: 4430796 - DNA, 17 bp, Homo sapiens
ttgatgttttttctgta

SEQ ID NO: 4430797 - DNA, 17 bp, Homo sapiens
ttgattaagaaaggaag

SEQ ID NO: 4430798 - DNA, 18 bp, Homo sapiens
ttgattaagaaaggaagt

SEQ ID NO: 4430799 - DNA, 13 bp, Homo sapiens
ttgattatgcata

SEQ ID NO: 4430800 - DNA, 16 bp, Homo sapiens
ttgattattagccagg

SEQ ID NO: 4430801 - DNA, 15 bp, Homo sapiens
ttgattattcagtgt

SEQ ID NO: 4430802 - DNA, 18 bp, Homo sapiens
ttgattcaaaatatttaa

SEQ ID NO: 4430803 - DNA, 13 bp, Homo sapiens
ttgattctccttc

SEQ ID NO: 4430804 - DNA, 23 bp, Homo sapiens
ttgattctccttttatgtgtagt

SEQ ID NO: 4430805 - DNA, 12 bp, Homo sapiens
ttgattctgcag

SEQ ID NO: 4430806 - DNA, 20 bp, Homo sapiens
ttgattctgcagtaaatctt

SEQ ID NO: 4430807 - DNA, 12 bp, Homo sapiens
ttgattgtataa

SEQ ID NO: 4430808 - DNA, 16 bp, Homo sapiens
ttgatttcacatttct

SEQ ID NO: 4430809 - DNA, 23 bp, Homo sapiens
ttgatttgaacaaattttctggt

SEQ ID NO: 4430810 - DNA, 15 bp, Homo sapiens
ttgatttgcattgaa

SEQ ID NO: 4430811 - DNA, 17 bp, Homo sapiens
ttgatttgcattgaaca

SEQ ID NO: 4430812 - DNA, 14 bp, Homo sapiens
ttgatttttcttat

SEQ ID NO: 4430813 - DNA, 15 bp, Homo sapiens
ttgcaaagtactgta

SEQ ID NO: 4430814 - DNA, 19 bp, Homo sapiens
ttgcaaagtggaattaaag

SEQ ID NO: 4430815 - DNA, 16 bp, Homo sapiens
ttgcaaatcttgaaat

SEQ ID NO: 4430816 - DNA, 22 bp, Homo sapiens
ttgcaaatgggagctgagcagc

SEQ ID NO: 4430817 - DNA, 13 bp, Homo sapiens
ttgcaaccaggaa

SEQ ID NO: 4430818 - DNA, 18 bp, Homo sapiens
ttgcaaccaggaacagca

SEQ ID NO: 4430819 - DNA, 14 bp, Homo sapiens
ttgcaacctcgctg

SEQ ID NO: 4430820 - DNA, 21 bp, Homo sapiens
ttgcaagatgtgaattattga

SEQ ID NO: 4430821 - DNA, 14 bp, Homo sapiens
ttgcaagcccctct

SEQ ID NO: 4430822 - DNA, 14 bp, Homo sapiens
ttgcaaggccgctg

SEQ ID NO: 4430823 - DNA, 23 bp, Homo sapiens
ttgcaaggccgctgttcacccac

SEQ ID NO: 4430824 - DNA, 14 bp, Homo sapiens
ttgcaataatgcag

SEQ ID NO: 4430825 - DNA, 17 bp, Homo sapiens
ttgcaataatgcagtat

SEQ ID NO: 4430826 - DNA, 16 bp, Homo sapiens
ttgcaatctaatctga

SEQ ID NO: 4430827 - DNA, 24 bp, Homo sapiens
ttgcacaaacttgtgagcatcaga

SEQ ID NO: 4430828 - DNA, 17 bp, Homo sapiens
ttgcacaagttccctgg

SEQ ID NO: 4430829 - DNA, 17 bp, Homo sapiens
ttgcacaatatttcttt

SEQ ID NO: 4430830 - DNA, 23 bp, Homo sapiens
ttgcacaatatttcttttgttgt

SEQ ID NO: 4430831 - DNA, 22 bp, Homo sapiens
ttgcacacagatgtgaaatgaa

SEQ ID NO: 4430832 - DNA, 21 bp, Homo sapiens
ttgcacagccaacgagacaca

SEQ ID NO: 4430833 - DNA, 22 bp, Homo sapiens
ttgcacagccaacgagacacat

SEQ ID NO: 4430834 - DNA, 19 bp, Homo sapiens
ttgcacagggattctcaca

SEQ ID NO: 4430835 - DNA, 15 bp, Homo sapiens
ttgcacccagccctg

SEQ ID NO: 4430836 - DNA, 16 bp, Homo sapiens
ttgcacctatctcagc

SEQ ID NO: 4430837 - DNA, 20 bp, Homo sapiens
ttgcacctatctcagccata

SEQ ID NO: 4430838 - DNA, 21 bp, Homo sapiens
ttgcacctatctcagccatag

SEQ ID NO: 4430839 - DNA, 17 bp, Homo sapiens
ttgcactcatcatattt

SEQ ID NO: 4430840 - DNA, 12 bp, Homo sapiens
ttgcactttgta

SEQ ID NO: 4430841 - DNA, 23 bp, Homo sapiens
ttgcacttttttgtttgaatgtt

SEQ ID NO: 4430842 - DNA, 17 bp, Homo sapiens
ttgcagaaaagcacctg

SEQ ID NO: 4430843 - DNA, 20 bp, Homo sapiens
ttgcagaaaagcacctgccg

SEQ ID NO: 4430844 - DNA, 13 bp, Homo sapiens
ttgcagaagttct

SEQ ID NO: 4430845 - DNA, 13 bp, Homo sapiens
tcagcccctcctc

SEQ ID NO: 4430846 - DNA, 15 bp, Homo sapiens
tcagcccctcctctg

SEQ ID NO: 4430847 - DNA, 16 bp, Homo sapiens
tcagcccctcctctgc

SEQ ID NO: 4430848 - DNA, 17 bp, Homo sapiens
tcagcccctcctctgcc

SEQ ID NO: 4430849 - DNA, 13 bp, Homo sapiens
tcagccctgaggt

SEQ ID NO: 4430850 - DNA, 12 bp, Homo sapiens
tcagccctgcta

SEQ ID NO: 4430851 - DNA, 17 bp, Homo sapiens
tcagccctgctccctgc

SEQ ID NO: 4430852 - DNA, 19 bp, Homo sapiens
tcagccctgctccctgcct

SEQ ID NO: 4430853 - DNA, 18 bp, Homo sapiens
tcagccctgggccccacc

SEQ ID NO: 4430854 - DNA, 22 bp, Homo sapiens
tcagccctgggccccaccacct

SEQ ID NO: 4430855 - DNA, 23 bp, Homo sapiens
tcagccctgggccccaccaccta

SEQ ID NO: 4430856 - DNA, 16 bp, Homo sapiens
tcagccgagaaattgg

SEQ ID NO: 4430857 - DNA, 18 bp, Homo sapiens
tcagcctccagcctctgt

SEQ ID NO: 4430858 - DNA, 20 bp, Homo sapiens
tcagcctcctgagtagctgg

SEQ ID NO: 4430859 - DNA, 22 bp, Homo sapiens
tcagccttccaactagctggga

SEQ ID NO: 4430860 - DNA, 20 bp, Homo sapiens
tcagccttgctacttgaagg

SEQ ID NO: 4430861 - DNA, 21 bp, Homo sapiens
tcagcgcggtcctgactccgt

SEQ ID NO: 4430862 - DNA, 17 bp, Homo sapiens
tcagcgggagccagtgg

SEQ ID NO: 4430863 - DNA, 17 bp, Homo sapiens
tcagctagaatttctgg

SEQ ID NO: 4430864 - DNA, 22 bp, Homo sapiens
tcagctcccctcggagaagagc

SEQ ID NO: 4430865 - DNA, 14 bp, Homo sapiens
tcagctccttcctg

SEQ ID NO: 4430866 - DNA, 17 bp, Homo sapiens
tcagctccttcctggag

SEQ ID NO: 4430867 - DNA, 20 bp, Homo sapiens
tcagctctaggctgttctgt

SEQ ID NO: 4430868 - DNA, 17 bp, Homo sapiens
tcagctctcctgctgca

SEQ ID NO: 4430869 - DNA, 14 bp, Homo sapiens
tcagctctctggga

SEQ ID NO: 4430870 - DNA, 21 bp, Homo sapiens
tcagctctctgggacctcctt

SEQ ID NO: 4430871 - DNA, 16 bp, Homo sapiens
tcagctctgccttgca

SEQ ID NO: 4430872 - DNA, 22 bp, Homo sapiens
tcagctgcaaggtactctggtg

SEQ ID NO: 4430873 - DNA, 17 bp, Homo sapiens
tcagctgctggatgact

SEQ ID NO: 4430874 - DNA, 13 bp, Homo sapiens
tcagctgctttga

SEQ ID NO: 4430875 - DNA, 17 bp, Homo sapiens
tcagctggtgtcagtcc

SEQ ID NO: 4430876 - DNA, 19 bp, Homo sapiens
tcagcttcctacccacacc

SEQ ID NO: 4430877 - DNA, 23 bp, Homo sapiens
tcagcttcctacccacacctctg

SEQ ID NO: 4430878 - DNA, 14 bp, Homo sapiens
tcagcttctcccaa

SEQ ID NO: 4430879 - DNA, 18 bp, Homo sapiens
tcagcttttgttgtttat

SEQ ID NO: 4430880 - DNA, 14 bp, Homo sapiens
tcagcttttttcct

SEQ ID NO: 4430881 - DNA, 20 bp, Homo sapiens
tcaggaaaactgacagagga

SEQ ID NO: 4430882 - DNA, 22 bp, Homo sapiens
tcaggaaaactgacagaggagg

SEQ ID NO: 4430883 - DNA, 22 bp, Homo sapiens
tcaggaaaatgtattgattcaa

SEQ ID NO: 4430884 - DNA, 12 bp, Homo sapiens
aaggttaaattg

SEQ ID NO: 4430885 - DNA, 18 bp, Homo sapiens
aaggttactcagcagcag

SEQ ID NO: 4430886 - DNA, 21 bp, Homo sapiens
aaggttactcagcagcagaga

SEQ ID NO: 4430887 - DNA, 17 bp, Homo sapiens
aaggttcagaaaattaa

SEQ ID NO: 4430888 - DNA, 17 bp, Homo sapiens
aaggttgaataatatat

SEQ ID NO: 4430889 - DNA, 15 bp, Homo sapiens
aaggttgcacagcaa

SEQ ID NO: 4430890 - DNA, 17 bp, Homo sapiens
aaggtttatgaaaaaga

SEQ ID NO: 4430891 - DNA, 12 bp, Homo sapiens
aaggtttcagat

SEQ ID NO: 4430892 - DNA, 16 bp, Homo sapiens
aaggtttcagatgagg

SEQ ID NO: 4430893 - DNA, 17 bp, Homo sapiens
aaggtttcagatgaggt

SEQ ID NO: 4430894 - DNA, 15 bp, Homo sapiens
aaggttttcatttgc

SEQ ID NO: 4430895 - DNA, 21 bp, Homo sapiens
aaggttttggttatggagtct

SEQ ID NO: 4430896 - DNA, 13 bp, Homo sapiens
aaggtttttagca

SEQ ID NO: 4430897 - DNA, 11 bp, Homo sapiens
aaggttttttt

SEQ ID NO: 4430898 - DNA, 15 bp, Homo sapiens
aagtaaaaccacagc

SEQ ID NO: 4430899 - DNA, 18 bp, Homo sapiens
aagtaaaaccacagcagt

SEQ ID NO: 4430900 - DNA, 22 bp, Homo sapiens
catctttgccttgggctgctcc

SEQ ID NO: 4430901 - DNA, 23 bp, Homo sapiens
catctttgccttgggctgctcct

SEQ ID NO: 4430902 - DNA, 12 bp, Homo sapiens
catcttttattc

SEQ ID NO: 4430903 - DNA, 17 bp, Homo sapiens
catcttttattcttttt

SEQ ID NO: 4430904 - DNA, 19 bp, Homo sapiens
catcttttctagagacaca

SEQ ID NO: 4430905 - DNA, 13 bp, Homo sapiens
catcttttgtatt

SEQ ID NO: 4430906 - DNA, 14 bp, Homo sapiens
catcttttgtatta

SEQ ID NO: 4430907 - DNA, 22 bp, Homo sapiens
catcttttgtattaagaaagga

SEQ ID NO: 4430908 - DNA, 22 bp, Homo sapiens
catctttttaaagcttatccat

SEQ ID NO: 4430909 - DNA, 18 bp, Homo sapiens
catgaaaatagctatttt

SEQ ID NO: 4430910 - DNA, 19 bp, Homo sapiens
catgaaagagaaagactga

SEQ ID NO: 4430911 - DNA, 17 bp, Homo sapiens
catgaaatgtggaagtc

SEQ ID NO: 4430912 - DNA, 18 bp, Homo sapiens
catgaaattgtatctcag

SEQ ID NO: 4430913 - DNA, 14 bp, Homo sapiens
catgaacagcttgc

SEQ ID NO: 4430914 - DNA, 20 bp, Homo sapiens
catgaagataaacacagctg

SEQ ID NO: 4430915 - DNA, 21 bp, Homo sapiens
catgaagccacgggtgccaga

SEQ ID NO: 4430916 - DNA, 17 bp, Homo sapiens
catgaaggtaaataaaa

SEQ ID NO: 4430917 - DNA, 21 bp, Homo sapiens
catgaatattttcaagttttt

SEQ ID NO: 4430918 - DNA, 20 bp, Homo sapiens
catgacgtggtaaaatgtga

SEQ ID NO: 4430919 - DNA, 17 bp, Homo sapiens
catgactctttattgtc

SEQ ID NO: 4430920 - DNA, 18 bp, Homo sapiens
catgacttccttatttct

SEQ ID NO: 4430921 - DNA, 21 bp, Homo sapiens
catgacttccttatttctgaa

SEQ ID NO: 4430922 - DNA, 22 bp, Homo sapiens
catgacttccttatttctgaac

SEQ ID NO: 4430923 - DNA, 19 bp, Homo sapiens
catgagatgagatgaccac

SEQ ID NO: 4430924 - DNA, 22 bp, Homo sapiens
catgagcactactctaccatgg

SEQ ID NO: 4430925 - DNA, 21 bp, Homo sapiens
catgagccgcccaaggccttc

SEQ ID NO: 4430926 - DNA, 21 bp, Homo sapiens
catgagctgtgttcacagacc

SEQ ID NO: 4430927 - DNA, 20 bp, Homo sapiens
catgaggccatctcaggaga

SEQ ID NO: 4430928 - DNA, 23 bp, Homo sapiens
catgagtagtgggctatgcagga

SEQ ID NO: 4430929 - DNA, 14 bp, Homo sapiens
catgagtgtgcccc

SEQ ID NO: 4430930 - DNA, 19 bp, Homo sapiens
catgagttatcatgaattt

SEQ ID NO: 4430931 - DNA, 15 bp, Homo sapiens
catgagttctgctga

SEQ ID NO: 4430932 - DNA, 18 bp, Homo sapiens
catgataatgaacagaac

SEQ ID NO: 4430933 - DNA, 21 bp, Homo sapiens
catgatagaaagaataaaatg

SEQ ID NO: 4430934 - DNA, 19 bp, Homo sapiens
catgatataactttagaaa

SEQ ID NO: 4430935 - DNA, 14 bp, Homo sapiens
catgatcaagatat

SEQ ID NO: 4430936 - DNA, 24 bp, Homo sapiens
catgatcatagctcactgcagcct

SEQ ID NO: 4430937 - DNA, 15 bp, Homo sapiens
catgatctccctgcc

SEQ ID NO: 4430938 - DNA, 16 bp, Homo sapiens
catgatctccctgccg

SEQ ID NO: 4430939 - DNA, 17 bp, Homo sapiens
catgatctccctgccgc

SEQ ID NO: 4430940 - DNA, 15 bp, Homo sapiens
gtaatgttattttct

SEQ ID NO: 4430941 - DNA, 18 bp, Homo sapiens
gtaattaaaagcaaatca

SEQ ID NO: 4430942 - DNA, 18 bp, Homo sapiens
gtaattaaggtacatcat

SEQ ID NO: 4430943 - DNA, 21 bp, Homo sapiens
gtaattaataactttctctgt

SEQ ID NO: 4430944 - DNA, 15 bp, Homo sapiens
gtaattagtaacatg

SEQ ID NO: 4430945 - DNA, 22 bp, Homo sapiens
gtaattgtaaactagtactatt

SEQ ID NO: 4430946 - DNA, 13 bp, Homo sapiens
gtaattgtgaaaa

SEQ ID NO: 4430947 - DNA, 14 bp, Homo sapiens
gtaattgtgaaaaa

SEQ ID NO: 4430948 - DNA, 15 bp, Homo sapiens
gtaattgtgtggatt

SEQ ID NO: 4430949 - DNA, 22 bp, Homo sapiens
gtaatttcctgagctaaatgct

SEQ ID NO: 4430950 - DNA, 15 bp, Homo sapiens
gtaatttcgccttaa

SEQ ID NO: 4430951 - DNA, 20 bp, Homo sapiens
gtaatttgtgtaataaagtg

SEQ ID NO: 4430952 - DNA, 21 bp, Homo sapiens
gtaatttgtgtaataaagtgt

SEQ ID NO: 4430953 - DNA, 13 bp, Homo sapiens
gtaatttttgctc

SEQ ID NO: 4430954 - DNA, 20 bp, Homo sapiens
gtacaaacagtatttctggt

SEQ ID NO: 4430955 - DNA, 15 bp, Homo sapiens
gtacaaacatgaaaa

SEQ ID NO: 4430956 - DNA, 16 bp, Homo sapiens
gtacaaacatgaaaaa

SEQ ID NO: 4430957 - DNA, 11 bp, Homo sapiens
gtacaaccctg

SEQ ID NO: 4430958 - DNA, 12 bp, Homo sapiens
gtacaaccctga

SEQ ID NO: 4430959 - DNA, 13 bp, Homo sapiens
gtacaaccctgac

SEQ ID NO: 4430960 - DNA, 17 bp, Homo sapiens
gtacaagtcagtttcta

SEQ ID NO: 4430961 - DNA, 14 bp, Homo sapiens
gtacaatacaatgt

SEQ ID NO: 4430962 - DNA, 16 bp, Homo sapiens
gtacaatgtacacact

SEQ ID NO: 4430963 - DNA, 14 bp, Homo sapiens
gtacaattatgtct

SEQ ID NO: 4430964 - DNA, 14 bp, Homo sapiens
gtacacactttatt

SEQ ID NO: 4430965 - DNA, 15 bp, Homo sapiens
gtacacactttattt

SEQ ID NO: 4430966 - DNA, 16 bp, Homo sapiens
gtacacatgtgttatc

SEQ ID NO: 4430967 - DNA, 18 bp, Homo sapiens
gtacacctccccctgcgc

SEQ ID NO: 4430968 - DNA, 13 bp, Homo sapiens
gtacactctgctg

SEQ ID NO: 4430969 - DNA, 17 bp, Homo sapiens
gtacactttttacagca

SEQ ID NO: 4430970 - DNA, 23 bp, Homo sapiens
gtacactttttacagcagcaata

SEQ ID NO: 4430971 - DNA, 17 bp, Homo sapiens
gtacagaatttgaatta

SEQ ID NO: 4430972 - DNA, 20 bp, Homo sapiens
gtacagaggtcagcacacat

SEQ ID NO: 4430973 - DNA, 17 bp, Homo sapiens
gtacagatccccagccc

SEQ ID NO: 4430974 - DNA, 16 bp, Homo sapiens
gtacagcccttgcact

SEQ ID NO: 4430975 - DNA, 21 bp, Homo sapiens
gtacagcggctcccctctgct

SEQ ID NO: 4430976 - DNA, 23 bp, Homo sapiens
gtacagcggctcccctctgcttc

SEQ ID NO: 4430977 - DNA, 16 bp, Homo sapiens
gtacagggttatctgc

SEQ ID NO: 4430978 - DNA, 22 bp, Homo sapiens
gtacagtagtttccctactgaa

SEQ ID NO: 4430979 - DNA, 14 bp, Homo sapiens
gtacagtctgtcat

SEQ ID NO: 4430980 - DNA, 17 bp, Homo sapiens
gtacagttgagctcagg

SEQ ID NO: 4430981 - DNA, 18 bp, Homo sapiens
gtacagttgagctcaggt

SEQ ID NO: 4430982 - DNA, 12 bp, Homo sapiens
gtacagttttta

SEQ ID NO: 4430983 - DNA, 17 bp, Homo sapiens
gtacataactcctgtcc

SEQ ID NO: 4430984 - DNA, 20 bp, Homo sapiens
gtacataactcctgtccctt

SEQ ID NO: 4430985 - DNA, 16 bp, Homo sapiens
gtacataattgcatga

SEQ ID NO: 4430986 - DNA, 19 bp, Homo sapiens
gtacataattgcatgaaaa

SEQ ID NO: 4430987 - DNA, 14 bp, Homo sapiens
gtacataggcttct

SEQ ID NO: 4430988 - DNA, 21 bp, Homo sapiens
gtacatagttatttttctctt

SEQ ID NO: 4430989 - DNA, 15 bp, Homo sapiens
gtacatatcaaatag

SEQ ID NO: 4430990 - DNA, 20 bp, Homo sapiens
gtacatatcctttggtcctg

SEQ ID NO: 4430991 - DNA, 22 bp, Homo sapiens
gtacatcaagtccatctgacaa

SEQ ID NO: 4430992 - DNA, 18 bp, Homo sapiens
gtacatctattttggatt

SEQ ID NO: 4430993 - DNA, 18 bp, Homo sapiens
gtacatctgcaatatgaa

SEQ ID NO: 4430994 - DNA, 22 bp, Homo sapiens
gtacattacagattaaagaaga

SEQ ID NO: 4430995 - DNA, 14 bp, Homo sapiens
gtacattctagctg

SEQ ID NO: 4430996 - DNA, 23 bp, Homo sapiens
gtacattcttccatcatcactgt

SEQ ID NO: 4430997 - DNA, 12 bp, Homo sapiens
gtacattgctta

SEQ ID NO: 4430998 - DNA, 15 bp, Homo sapiens
gtacattgcttaaaa

SEQ ID NO: 4430999 - DNA, 18 bp, Homo sapiens
gtacattgtgagctctgg

SEQ ID NO: 4431000 - DNA, 13 bp, Homo sapiens
gtacatttaaatt

SEQ ID NO: 4431001 - DNA, 17 bp, Homo sapiens
gtacatttctctgagca

SEQ ID NO: 4431002 - DNA, 21 bp, Homo sapiens
gtacatttgagccatgtcaca

SEQ ID NO: 4431003 - DNA, 22 bp, Homo sapiens
gtacatttgggagtttttatga

SEQ ID NO: 4431004 - DNA, 19 bp, Homo sapiens
gtacattttgtaaaatatt

SEQ ID NO: 4431005 - DNA, 15 bp, Homo sapiens
gtacattttgtaaca

SEQ ID NO: 4431006 - DNA, 16 bp, Homo sapiens
gtacatttttcagcag

SEQ ID NO: 4431007 - DNA, 21 bp, Homo sapiens
gtaccagtgaatttttgcaat

SEQ ID NO: 4431008 - DNA, 22 bp, Homo sapiens
gtaccagttaatttttccaact

SEQ ID NO: 4431009 - DNA, 21 bp, Homo sapiens
gtaccatagaaaaatgtataa

SEQ ID NO: 4431010 - DNA, 20 bp, Homo sapiens
gtaccatttgtgtctcttta

SEQ ID NO: 4431011 - DNA, 11 bp, Homo sapiens
gtacccagcaa

SEQ ID NO: 4431012 - DNA, 18 bp, Homo sapiens
gtaccgccagcagctgtc

SEQ ID NO: 4431013 - DNA, 16 bp, Homo sapiens
gtacctattaaaagtt

SEQ ID NO: 4431014 - DNA, 15 bp, Homo sapiens
gtacctgattgtatt

SEQ ID NO: 4431015 - DNA, 15 bp, Homo sapiens
gtaccttaagatatt

SEQ ID NO: 4431016 - DNA, 21 bp, Homo sapiens
gtaccttaggttctttctgaa

SEQ ID NO: 4431017 - DNA, 23 bp, Homo sapiens
gtacgaacctacagttttaactg

SEQ ID NO: 4431018 - DNA, 12 bp, Homo sapiens
gtacgtcccaca

SEQ ID NO: 4431019 - DNA, 18 bp, Homo sapiens
gtacgttatatattgtat

SEQ ID NO: 4431020 - DNA, 18 bp, Homo sapiens
gtactaaacctcgtgctt

SEQ ID NO: 4431021 - DNA, 14 bp, Homo sapiens
gtactagagatatt

SEQ ID NO: 4431022 - DNA, 13 bp, Homo sapiens
gtactatgtctga

SEQ ID NO: 4431023 - DNA, 18 bp, Homo sapiens
gtactattcattcactct

SEQ ID NO: 4431024 - DNA, 11 bp, Homo sapiens
gtactccagcc

SEQ ID NO: 4431025 - DNA, 14 bp, Homo sapiens
gtactccagcctgg

SEQ ID NO: 4431026 - DNA, 14 bp, Homo sapiens
gtactgaaagcctt

SEQ ID NO: 4431027 - DNA, 22 bp, Homo sapiens
gtactgaaagccttagggaagc

SEQ ID NO: 4431028 - DNA, 15 bp, Homo sapiens
gtactgaattcttta

SEQ ID NO: 4431029 - DNA, 12 bp, Homo sapiens
gtactgaatttt

SEQ ID NO: 4431030 - DNA, 16 bp, Homo sapiens
gtactgcctgccaccg

SEQ ID NO: 4431031 - DNA, 15 bp, Homo sapiens
gtactggagcctgca

SEQ ID NO: 4431032 - DNA, 19 bp, Homo sapiens
gtactggttactttcaaaa

SEQ ID NO: 4431033 - DNA, 12 bp, Homo sapiens
gtactgtatcta

SEQ ID NO: 4431034 - DNA, 13 bp, Homo sapiens
gtactgttgaaaa

SEQ ID NO: 4431035 - DNA, 16 bp, Homo sapiens
gtactgttgaaaaaga

SEQ ID NO: 4431036 - DNA, 19 bp, Homo sapiens
gtactgttgaaaaagataa

SEQ ID NO: 4431037 - DNA, 20 bp, Homo sapiens
gtactgttgctttaatatga

SEQ ID NO: 4431038 - DNA, 19 bp, Homo sapiens
gtacttagagtttctgttt

SEQ ID NO: 4431039 - DNA, 11 bp, Homo sapiens
gtacttcctct

SEQ ID NO: 4431040 - DNA, 13 bp, Homo sapiens
gtacttcctctgt

SEQ ID NO: 4431041 - DNA, 15 bp, Homo sapiens
gtacttcctctgtga

SEQ ID NO: 4431042 - DNA, 16 bp, Homo sapiens
gtacttcctctgtgaa

SEQ ID NO: 4431043 - DNA, 12 bp, Homo sapiens
gtacttctaaga

SEQ ID NO: 4431044 - DNA, 18 bp, Homo sapiens
gtacttcttctgtaatat

SEQ ID NO: 4431045 - DNA, 19 bp, Homo sapiens
gtacttcttgaatataaaa

SEQ ID NO: 4431046 - DNA, 20 bp, Homo sapiens
gtacttcttgaatataaaaa

SEQ ID NO: 4431047 - DNA, 18 bp, Homo sapiens
gtacttgtaatatgtata

SEQ ID NO: 4431048 - DNA, 14 bp, Homo sapiens
gtactttatatctt

SEQ ID NO: 4431049 - DNA, 22 bp, Homo sapiens
gtactttgtgtttagctacctt

SEQ ID NO: 4431050 - DNA, 20 bp, Homo sapiens
gtacttttcattctctttta

SEQ ID NO: 4431051 - DNA, 20 bp, Homo sapiens
gtagaaaaaaaaattcacat

SEQ ID NO: 4431052 - DNA, 12 bp, Homo sapiens
gtagaaaaattt

SEQ ID NO: 4431053 - DNA, 20 bp, Homo sapiens
gtagaaaagggaactgaaca

SEQ ID NO: 4431054 - DNA, 16 bp, Homo sapiens
gtagaaactatttctg

SEQ ID NO: 4431055 - DNA, 18 bp, Homo sapiens
gtagaaagacatctgcct

SEQ ID NO: 4431056 - DNA, 17 bp, Homo sapiens
gtagaataaatgaagaa

SEQ ID NO: 4431057 - DNA, 11 bp, Homo sapiens
gtagaatattc

SEQ ID NO: 4431058 - DNA, 22 bp, Homo sapiens
gtagaattatctaatttataaa

SEQ ID NO: 4431059 - DNA, 23 bp, Homo sapiens
gtatatttgaaataaagttgaat

SEQ ID NO: 4431060 - DNA, 22 bp, Homo sapiens
gtatatttttatctatataaaa

SEQ ID NO: 4431061 - DNA, 11 bp, Homo sapiens
gtatcaaatca

SEQ ID NO: 4431062 - DNA, 21 bp, Homo sapiens
gtatcaataaaattctgtaat

SEQ ID NO: 4431063 - DNA, 21 bp, Homo sapiens
gtatcaatttctaatgtttac

SEQ ID NO: 4431064 - DNA, 12 bp, Homo sapiens
gtatcacagtgt

SEQ ID NO: 4431065 - DNA, 22 bp, Homo sapiens
gtatcagagatgtccattttta

SEQ ID NO: 4431066 - DNA, 21 bp, Homo sapiens
gtatcaggacccagaggaagg

SEQ ID NO: 4431067 - DNA, 19 bp, Homo sapiens
gtatcagtgtttatgtgct

SEQ ID NO: 4431068 - DNA, 24 bp, Homo sapiens
gtatcagtgtttatgtgctattaa

SEQ ID NO: 4431069 - DNA, 20 bp, Homo sapiens
gtatccaaaaatagccctgc

SEQ ID NO: 4431070 - DNA, 16 bp, Homo sapiens
gtatccccttctcatc

SEQ ID NO: 4431071 - DNA, 13 bp, Homo sapiens
gtatcctaaactt

SEQ ID NO: 4431072 - DNA, 17 bp, Homo sapiens
gtatcctccctggcaga

SEQ ID NO: 4431073 - DNA, 20 bp, Homo sapiens
gtatcctccctggcagacac

SEQ ID NO: 4431074 - DNA, 19 bp, Homo sapiens
gtatctacagtaatgaaat

SEQ ID NO: 4431075 - DNA, 22 bp, Homo sapiens
gtatctacagtaatgaaatgtt

SEQ ID NO: 4431076 - DNA, 15 bp, Homo sapiens
gtatctatttgtaca

SEQ ID NO: 4431077 - DNA, 16 bp, Homo sapiens
gtatctatttgtacaa

SEQ ID NO: 4431078 - DNA, 18 bp, Homo sapiens
gtatctatttgtacaatt

SEQ ID NO: 4431079 - DNA, 19 bp, Homo sapiens
gtatctcttacatcagtag

SEQ ID NO: 4431080 - DNA, 21 bp, Homo sapiens
gtatctggattcaaatttatt

SEQ ID NO: 4431081 - DNA, 21 bp, Homo sapiens
gtatcttgggggacagggctg

SEQ ID NO: 4431082 - DNA, 19 bp, Homo sapiens
gtatctttctttctctaat

SEQ ID NO: 4431083 - DNA, 17 bp, Homo sapiens
gtatcttttatcctggg

SEQ ID NO: 4431084 - DNA, 19 bp, Homo sapiens
gtatcttttatcctgggag

SEQ ID NO: 4431085 - DNA, 13 bp, Homo sapiens
gtatcttttgata

SEQ ID NO: 4431086 - DNA, 20 bp, Homo sapiens
gtatcttttttaaactgtaa

SEQ ID NO: 4431087 - DNA, 17 bp, Homo sapiens
gtatgaaatatatgtga

SEQ ID NO: 4431088 - DNA, 22 bp, Homo sapiens
gtatgaataatgaaaataaaac

SEQ ID NO: 4431089 - DNA, 14 bp, Homo sapiens
gtatgaatttgagc

SEQ ID NO: 4431090 - DNA, 21 bp, Homo sapiens
gtatgattactggcctttttc

SEQ ID NO: 4431091 - DNA, 18 bp, Homo sapiens
gtatgcattattaaattg

SEQ ID NO: 4431092 - DNA, 15 bp, Homo sapiens
gtatgctggccagca

SEQ ID NO: 4431093 - DNA, 18 bp, Homo sapiens
gtatgctggccagcaccc

SEQ ID NO: 4431094 - DNA, 21 bp, Homo sapiens
gtatggatatatttgaaatag

SEQ ID NO: 4431095 - DNA, 16 bp, Homo sapiens
gtatggatttccagtt

SEQ ID NO: 4431096 - DNA, 19 bp, Homo sapiens
gtatggcctgacagctctg

SEQ ID NO: 4431097 - DNA, 14 bp, Homo sapiens
gtatggtacatcta

SEQ ID NO: 4431098 - DNA, 13 bp, Homo sapiens
gtatgtcaaagct

SEQ ID NO: 4431099 - DNA, 15 bp, Homo sapiens
gtatgtggaagtgtg

SEQ ID NO: 4431100 - DNA, 16 bp, Homo sapiens
gtatgtggaagtgtgg

SEQ ID NO: 4431101 - DNA, 18 bp, Homo sapiens
gtatgtggaagtgtgggt

SEQ ID NO: 4431102 - DNA, 21 bp, Homo sapiens
gtatgtggaagtgtgggtctg

SEQ ID NO: 4431103 - DNA, 17 bp, Homo sapiens
gtatgtggcaaaacata

SEQ ID NO: 4431104 - DNA, 19 bp, Homo sapiens
gtatgtgggggtctgtgtg

SEQ ID NO: 4431105 - DNA, 16 bp, Homo sapiens
gtatgtttttctgtat

SEQ ID NO: 4431106 - DNA, 13 bp, Homo sapiens
gtattaaatgcca

SEQ ID NO: 4431107 - DNA, 19 bp, Homo sapiens
gtattaacatgcaataaca

SEQ ID NO: 4431108 - DNA, 14 bp, Homo sapiens
gtattaataaaaag

SEQ ID NO: 4431109 - DNA, 23 bp, Homo sapiens
gtattacagtgtcctaccactct

SEQ ID NO: 4431110 - DNA, 23 bp, Homo sapiens
gtattatccacaattattggcaa

SEQ ID NO: 4431111 - DNA, 23 bp, Homo sapiens
gtattatgtcctgtgagatgtgt

SEQ ID NO: 4431112 - DNA, 16 bp, Homo sapiens
gtattatgtctcttct

SEQ ID NO: 4431113 - DNA, 19 bp, Homo sapiens
gtattattaacactaataa

SEQ ID NO: 4431114 - DNA, 21 bp, Homo sapiens
gtattattacaaatattgtca

SEQ ID NO: 4431115 - DNA, 20 bp, Homo sapiens
gtattccaccttaaattaaa

SEQ ID NO: 4431116 - DNA, 18 bp, Homo sapiens
gtattctagttttgtcaa

SEQ ID NO: 4431117 - DNA, 19 bp, Homo sapiens
gtattctctgagctgtgca

SEQ ID NO: 4431118 - DNA, 14 bp, Homo sapiens
gtattctgacatgt

SEQ ID NO: 4431119 - DNA, 15 bp, Homo sapiens
gtattctgacatgta

SEQ ID NO: 4431120 - DNA, 16 bp, Homo sapiens
gtattctgacatgtaa

SEQ ID NO: 4431121 - DNA, 16 bp, Homo sapiens
gtattctgaggatgtt

SEQ ID NO: 4431122 - DNA, 12 bp, Homo sapiens
gtattctgtttg

SEQ ID NO: 4431123 - DNA, 14 bp, Homo sapiens
gtattcttcatgaa

SEQ ID NO: 4431124 - DNA, 21 bp, Homo sapiens
gtattgagtcttaactgtatt

SEQ ID NO: 4431125 - DNA, 14 bp, Homo sapiens
gtattgtcagccat

SEQ ID NO: 4431126 - DNA, 16 bp, Homo sapiens
gtatttaaaaacattt

SEQ ID NO: 4431127 - DNA, 17 bp, Homo sapiens
gtatttaacagaaattg

SEQ ID NO: 4431128 - DNA, 19 bp, Homo sapiens
gtatttaacagaaattgta

SEQ ID NO: 4431129 - DNA, 18 bp, Homo sapiens
gtatttaactacatctgc

SEQ ID NO: 4431130 - DNA, 21 bp, Homo sapiens
gtatttaactacatctgcctc

SEQ ID NO: 4431131 - DNA, 17 bp, Homo sapiens
gtatttaagatgtacat

SEQ ID NO: 4431132 - DNA, 19 bp, Homo sapiens
gtatttaagatgtacattt

SEQ ID NO: 4431133 - DNA, 14 bp, Homo sapiens
gtatttaagcaaat

SEQ ID NO: 4431134 - DNA, 15 bp, Homo sapiens
gtatttaagcaaata

SEQ ID NO: 4431135 - DNA, 17 bp, Homo sapiens
gtatttaagcaaatact

SEQ ID NO: 4431136 - DNA, 19 bp, Homo sapiens
gtatttaagctttaaatga

SEQ ID NO: 4431137 - DNA, 21 bp, Homo sapiens
gtatttaagctttaaatgaca

SEQ ID NO: 4431138 - DNA, 23 bp, Homo sapiens
gtatttaagctttaaatgacagt

SEQ ID NO: 4431139 - DNA, 16 bp, Homo sapiens
gtatttaattgtaaac

SEQ ID NO: 4431140 - DNA, 17 bp, Homo sapiens
gtatttaattgtaaact

SEQ ID NO: 4431141 - DNA, 19 bp, Homo sapiens
gtatttaattgtaaactgt

SEQ ID NO: 4431142 - DNA, 20 bp, Homo sapiens
gtatttaattgtaaactgta

SEQ ID NO: 4431143 - DNA, 21 bp, Homo sapiens
gtatttaattgtaaactgtac

SEQ ID NO: 4431144 - DNA, 20 bp, Homo sapiens
gtatttaccaaaaattttgt

SEQ ID NO: 4431145 - DNA, 16 bp, Homo sapiens
gtatttacgctttgat

SEQ ID NO: 4431146 - DNA, 17 bp, Homo sapiens
gtatttacgctttgatt

SEQ ID NO: 4431147 - DNA, 17 bp, Homo sapiens
gtatttataaaaatata

SEQ ID NO: 4431148 - DNA, 18 bp, Homo sapiens
gtatttataaaaatataa

SEQ ID NO: 4431149 - DNA, 18 bp, Homo sapiens
gtatttatttaaaactct

SEQ ID NO: 4431150 - DNA, 19 bp, Homo sapiens
gtatttatttaaaactctg

SEQ ID NO: 4431151 - DNA, 13 bp, Homo sapiens
gtatttcaaattg

SEQ ID NO: 4431152 - DNA, 12 bp, Homo sapiens
gtatttctcctt

SEQ ID NO: 4431153 - DNA, 21 bp, Homo sapiens
gtatttctttgtagaataaat

SEQ ID NO: 4431154 - DNA, 21 bp, Homo sapiens
gtatttgatgtacattacaga

SEQ ID NO: 4431155 - DNA, 12 bp, Homo sapiens
gtattttaaaat

SEQ ID NO: 4431156 - DNA, 22 bp, Homo sapiens
gtattttatctttgattctcct

SEQ ID NO: 4431157 - DNA, 23 bp, Homo sapiens
gtattttatctttgattctcctt

SEQ ID NO: 4431158 - DNA, 12 bp, Homo sapiens
gtattttcagtc

SEQ ID NO: 4431159 - DNA, 11 bp, Homo sapiens
gtattttcata

SEQ ID NO: 4431160 - DNA, 23 bp, Homo sapiens
gtattttccagccttatgtgtta

SEQ ID NO: 4431161 - DNA, 14 bp, Homo sapiens
gtattttcttcaaa

SEQ ID NO: 4431162 - DNA, 15 bp, Homo sapiens
gtatttttactatta

SEQ ID NO: 4431163 - DNA, 15 bp, Homo sapiens
gtatttttagtagag

SEQ ID NO: 4431164 - DNA, 13 bp, Homo sapiens
gtatttttatcca

SEQ ID NO: 4431165 - DNA, 16 bp, Homo sapiens
gtatttttatttaaat

SEQ ID NO: 4431166 - DNA, 18 bp, Homo sapiens
gtatttttttttctaaga

SEQ ID NO: 4431167 - DNA, 22 bp, Homo sapiens
gtattttttttttaaataaaag

SEQ ID NO: 4431168 - DNA, 14 bp, Homo sapiens
gtcaaaaagaacca

SEQ ID NO: 4431169 - DNA, 14 bp, Homo sapiens
gtcaaaactttaaa

SEQ ID NO: 4431170 - DNA, 14 bp, Homo sapiens
gtcaaaaggtgcct

SEQ ID NO: 4431171 - DNA, 13 bp, Homo sapiens
gtcaaaatttgct

SEQ ID NO: 4431172 - DNA, 20 bp, Homo sapiens
gtcaaacattcgtgagctgg

SEQ ID NO: 4431173 - DNA, 16 bp, Homo sapiens
gtcaaactgtagaaat

SEQ ID NO: 4431174 - DNA, 21 bp, Homo sapiens
gtcaaacttggatacttggat

SEQ ID NO: 4431175 - DNA, 14 bp, Homo sapiens
gtcaaagatgcccc

SEQ ID NO: 4431176 - DNA, 20 bp, Homo sapiens
gtcaaagatgccccattcct

SEQ ID NO: 4431177 - DNA, 11 bp, Homo sapiens
gtcataaacac

SEQ ID NO: 4431178 - DNA, 21 bp, Homo sapiens
gtcataaatttgaataagcag

SEQ ID NO: 4431179 - DNA, 21 bp, Homo sapiens
gtcataacggttaagaaagca

SEQ ID NO: 4431180 - DNA, 16 bp, Homo sapiens
gtcataagtggggaga

SEQ ID NO: 4431181 - DNA, 19 bp, Homo sapiens
gtcataagtggggagagag

SEQ ID NO: 4431182 - DNA, 19 bp, Homo sapiens
gtcatactgtgcaggcctg

SEQ ID NO: 4431183 - DNA, 12 bp, Homo sapiens
gtcatagaaata

SEQ ID NO: 4431184 - DNA, 21 bp, Homo sapiens
gtcatagacaattcctccaga

SEQ ID NO: 4431185 - DNA, 22 bp, Homo sapiens
gtcatagacaattcctccagag

SEQ ID NO: 4431186 - DNA, 16 bp, Homo sapiens
gtcatatatcaaagca

SEQ ID NO: 4431187 - DNA, 20 bp, Homo sapiens
gtcatatcactaaataaaca

SEQ ID NO: 4431188 - DNA, 22 bp, Homo sapiens
gtcatcctcaaagaaagtgtat

SEQ ID NO: 4431189 - DNA, 23 bp, Homo sapiens
gtcatcgctcgtgtgttctatcc

SEQ ID NO: 4431190 - DNA, 18 bp, Homo sapiens
gtcatcggaggctgggcc

SEQ ID NO: 4431191 - DNA, 21 bp, Homo sapiens
gtcatctgatgagaacaagct

SEQ ID NO: 4431192 - DNA, 15 bp, Homo sapiens
gtcatcttgctacca

SEQ ID NO: 4431193 - DNA, 23 bp, Homo sapiens
gtcatctttcttttctttgagtc

SEQ ID NO: 4431194 - DNA, 18 bp, Homo sapiens
gtcatgatctccctgccg

SEQ ID NO: 4431195 - DNA, 22 bp, Homo sapiens
gtcatgatctccctgccgcctc

SEQ ID NO: 4431196 - DNA, 19 bp, Homo sapiens
gtcatgcacagtatttgta

SEQ ID NO: 4431197 - DNA, 24 bp, Homo sapiens
gtcatgcacagtatttgtaattaa

SEQ ID NO: 4431198 - DNA, 16 bp, Homo sapiens
gtcatggtagattttt

SEQ ID NO: 4431199 - DNA, 14 bp, Homo sapiens
gtcatggtcacagt

SEQ ID NO: 4431200 - DNA, 17 bp, Homo sapiens
gtcattaaattactata

SEQ ID NO: 4431201 - DNA, 24 bp, Homo sapiens
gtcattaaattactatagcaaagt

SEQ ID NO: 4431202 - DNA, 13 bp, Homo sapiens
gtcattaacccat

SEQ ID NO: 4431203 - DNA, 13 bp, Homo sapiens
gtcattatattct

SEQ ID NO: 4431204 - DNA, 21 bp, Homo sapiens
gtcattatgagaggcaatgat

SEQ ID NO: 4431205 - DNA, 22 bp, Homo sapiens
gtcattcaggtgacctcctgca

SEQ ID NO: 4431206 - DNA, 20 bp, Homo sapiens
gtcattgacttcattttata

SEQ ID NO: 4431207 - DNA, 21 bp, Homo sapiens
gtcattgacttcattttatat

SEQ ID NO: 4431208 - DNA, 22 bp, Homo sapiens
gtcattgacttcattttatatt

SEQ ID NO: 4431209 - DNA, 15 bp, Homo sapiens
gtcatttaaatgtgt

SEQ ID NO: 4431210 - DNA, 14 bp, Homo sapiens
gtcatttcattcca

SEQ ID NO: 4431211 - DNA, 20 bp, Homo sapiens
gtcatttggtgctctgctaa

SEQ ID NO: 4431212 - DNA, 17 bp, Homo sapiens
gtcattttattttgtaa

SEQ ID NO: 4431213 - DNA, 13 bp, Homo sapiens
gtcattttcttga

SEQ ID NO: 4431214 - DNA, 20 bp, Homo sapiens
gtcattttggtactttggtg

SEQ ID NO: 4431215 - DNA, 14 bp, Homo sapiens
gtcatttttaatgt

SEQ ID NO: 4431216 - DNA, 17 bp, Homo sapiens
gtcatttttaatgtatc

SEQ ID NO: 4431217 - DNA, 18 bp, Homo sapiens
gtcatttttaatgtatct

SEQ ID NO: 4431218 - DNA, 19 bp, Homo sapiens
gtcatttttaatgtatcta

SEQ ID NO: 4431219 - DNA, 22 bp, Homo sapiens
gtcatttttaatgtatctattt

SEQ ID NO: 4431220 - DNA, 24 bp, Homo sapiens
gtcatttttaatgtatctatttgt

SEQ ID NO: 4431221 - DNA, 12 bp, Homo sapiens
gtcatttttgta

SEQ ID NO: 4431222 - DNA, 16 bp, Homo sapiens
gtcatttttgtatttt

SEQ ID NO: 4431223 - DNA, 16 bp, Homo sapiens
gtccaaagaggctgcc

SEQ ID NO: 4431224 - DNA, 14 bp, Homo sapiens
gtccaacctaaccc

SEQ ID NO: 4431225 - DNA, 17 bp, Homo sapiens
gtccaaggtggcagatg

SEQ ID NO: 4431226 - DNA, 12 bp, Homo sapiens
gtccaatcctat

SEQ ID NO: 4431227 - DNA, 16 bp, Homo sapiens
gtccaattttaattta

SEQ ID NO: 4431228 - DNA, 18 bp, Homo sapiens
gtccaattttaatttagt

SEQ ID NO: 4431229 - DNA, 20 bp, Homo sapiens
gtccacaaaataaccaatcc

SEQ ID NO: 4431230 - DNA, 19 bp, Homo sapiens
gtccacaggggccaccacc

SEQ ID NO: 4431231 - DNA, 20 bp, Homo sapiens
gtccacaggggccaccacct

SEQ ID NO: 4431232 - DNA, 24 bp, Homo sapiens
gtccaccatgctctctcacctgct

SEQ ID NO: 4431233 - DNA, 11 bp, Homo sapiens
gtccaccctgc

SEQ ID NO: 4431234 - DNA, 14 bp, Homo sapiens
gtccaccttcattt

SEQ ID NO: 4431235 - DNA, 18 bp, Homo sapiens
gtccacgactgtctccat

SEQ ID NO: 4431236 - DNA, 19 bp, Homo sapiens
gtccacgtactagaaaaat

SEQ ID NO: 4431237 - DNA, 21 bp, Homo sapiens
gtccactgtggcactggccac

SEQ ID NO: 4431238 - DNA, 16 bp, Homo sapiens
aatacatagcattaaa

SEQ ID NO: 4431239 - DNA, 17 bp, Homo sapiens
aatacatgacatttatt

SEQ ID NO: 4431240 - DNA, 20 bp, Homo sapiens
aatacatgcaacagaagtga

SEQ ID NO: 4431241 - DNA, 23 bp, Homo sapiens
aatacatgctaagagaagtagaa

SEQ ID NO: 4431242 - DNA, 12 bp, Homo sapiens
aatacattttat

SEQ ID NO: 4431243 - DNA, 20 bp, Homo sapiens
aataccacagctatttagaa

SEQ ID NO: 4431244 - DNA, 23 bp, Homo sapiens
aataccagagccttcaagtgcca

SEQ ID NO: 4431245 - DNA, 21 bp, Homo sapiens
aatacccttgtgagagcccat

SEQ ID NO: 4431246 - DNA, 17 bp, Homo sapiens
aatacctcaatttttgt

SEQ ID NO: 4431247 - DNA, 22 bp, Homo sapiens
aataccttctatgtattagtgt

SEQ ID NO: 4431248 - DNA, 22 bp, Homo sapiens
aatacgtgccagatataactgt

SEQ ID NO: 4431249 - DNA, 17 bp, Homo sapiens
aatactaccttgaaaat

SEQ ID NO: 4431250 - DNA, 18 bp, Homo sapiens
aatactaccttgaaaata

SEQ ID NO: 4431251 - DNA, 12 bp, Homo sapiens
aatactctattt

SEQ ID NO: 4431252 - DNA, 18 bp, Homo sapiens
aatactctatttttacat

SEQ ID NO: 4431253 - DNA, 22 bp, Homo sapiens
aatactgtccagttttcttgct

SEQ ID NO: 4431254 - DNA, 17 bp, Homo sapiens
aatactgtctgtatctt

SEQ ID NO: 4431255 - DNA, 18 bp, Homo sapiens
aatacttaaaaatagtct

SEQ ID NO: 4431256 - DNA, 14 bp, Homo sapiens
aatacttctcattt

SEQ ID NO: 4431257 - DNA, 19 bp, Homo sapiens
aatacttgaacttgcctct

SEQ ID NO: 4431258 - DNA, 20 bp, Homo sapiens
aatacttgaacttgcctctt

SEQ ID NO: 4431259 - DNA, 19 bp, Homo sapiens
aatactttctatgtgacat

SEQ ID NO: 4431260 - DNA, 23 bp, Homo sapiens
aatactttcttttattaatatat

SEQ ID NO: 4431261 - DNA, 17 bp, Homo sapiens
aatactttttaaattac

SEQ ID NO: 4431262 - DNA, 12 bp, Homo sapiens
aatagaaaaagt

SEQ ID NO: 4431263 - DNA, 13 bp, Homo sapiens
aatagaaaagtag

SEQ ID NO: 4431264 - DNA, 14 bp, Homo sapiens
aatagaaaagttat

SEQ ID NO: 4431265 - DNA, 21 bp, Homo sapiens
aatagaaacgtaaactatgac

SEQ ID NO: 4431266 - DNA, 14 bp, Homo sapiens
aatagaacaagatg

SEQ ID NO: 4431267 - DNA, 13 bp, Homo sapiens
aatagaacacagt

SEQ ID NO: 4431268 - DNA, 13 bp, Homo sapiens
aatagaaggtgat

SEQ ID NO: 4431269 - DNA, 22 bp, Homo sapiens
aatagacactccccgaagtctt

SEQ ID NO: 4431270 - DNA, 23 bp, Homo sapiens
aatagacactccccgaagtcttt

SEQ ID NO: 4431271 - DNA, 16 bp, Homo sapiens
aatagagcctgaggga

SEQ ID NO: 4431272 - DNA, 13 bp, Homo sapiens
aatagaggagctg

SEQ ID NO: 4431273 - DNA, 19 bp, Homo sapiens
aatagataaccaattttca

SEQ ID NO: 4431274 - DNA, 20 bp, Homo sapiens
aatagataaccaattttcag

SEQ ID NO: 4431275 - DNA, 12 bp, Homo sapiens
aatagatgtctt

SEQ ID NO: 4431276 - DNA, 20 bp, Homo sapiens
aatagatgtgcccttttata

SEQ ID NO: 4431277 - DNA, 11 bp, Homo sapiens
aatagatgttt

SEQ ID NO: 4431278 - DNA, 20 bp, Homo sapiens
aatagattactgatgtgata

SEQ ID NO: 4431279 - DNA, 14 bp, Homo sapiens
aatagattttttca

SEQ ID NO: 4431280 - DNA, 19 bp, Homo sapiens
aatagcaaaagaagaagtt

SEQ ID NO: 4431281 - DNA, 20 bp, Homo sapiens
aatagcaaaagaagaagttt

SEQ ID NO: 4431282 - DNA, 18 bp, Homo sapiens
aatagcaaagaattgact

SEQ ID NO: 4431283 - DNA, 12 bp, Homo sapiens
aatagcaataac

SEQ ID NO: 4431284 - DNA, 21 bp, Homo sapiens
aatagcaccaatacaaattga

SEQ ID NO: 4431285 - DNA, 16 bp, Homo sapiens
aatagcacttaaattc

SEQ ID NO: 4431286 - DNA, 19 bp, Homo sapiens
aatagcactttcattgcca

SEQ ID NO: 4431287 - DNA, 15 bp, Homo sapiens
aatagcagttataac

SEQ ID NO: 4431288 - DNA, 23 bp, Homo sapiens
aatagcagttataacagatgtga

SEQ ID NO: 4431289 - DNA, 18 bp, Homo sapiens
aatagcatttggaaacca

SEQ ID NO: 4431290 - DNA, 17 bp, Homo sapiens
aatagcctctcctttgt

SEQ ID NO: 4431291 - DNA, 18 bp, Homo sapiens
aatagcctctcctttgta

SEQ ID NO: 4431292 - DNA, 14 bp, Homo sapiens
aatagcctggccac

SEQ ID NO: 4431293 - DNA, 14 bp, Homo sapiens
aatagcggccctgg

SEQ ID NO: 4431294 - DNA, 21 bp, Homo sapiens
aatagctaaatacctcaatca

SEQ ID NO: 4431295 - DNA, 15 bp, Homo sapiens
aatagctgtagtttt

SEQ ID NO: 4431296 - DNA, 14 bp, Homo sapiens
aataggaccagagc

SEQ ID NO: 4431297 - DNA, 15 bp, Homo sapiens
aataggaccagagcg

SEQ ID NO: 4431298 - DNA, 23 bp, Homo sapiens
aataggaccagagcggtatctct

SEQ ID NO: 4431299 - DNA, 15 bp, Homo sapiens
aataggcaaattaat

SEQ ID NO: 4431300 - DNA, 16 bp, Homo sapiens
aataggcaaattaatc

SEQ ID NO: 4431301 - DNA, 15 bp, Homo sapiens
aataggcattttaag

SEQ ID NO: 4431302 - DNA, 17 bp, Homo sapiens
aataggcattttaagta

SEQ ID NO: 4431303 - DNA, 21 bp, Homo sapiens
aataggctattaaaaaagtct

SEQ ID NO: 4431304 - DNA, 21 bp, Homo sapiens
aataggctgatgggcaaaaaa

SEQ ID NO: 4431305 - DNA, 18 bp, Homo sapiens
aatagggactatctatct

SEQ ID NO: 4431306 - DNA, 15 bp, Homo sapiens
aataggggagccaag

SEQ ID NO: 4431307 - DNA, 21 bp, Homo sapiens
aatagggggatataatacata

SEQ ID NO: 4431308 - DNA, 19 bp, Homo sapiens
aataggtctttctctcagt

SEQ ID NO: 4431309 - DNA, 14 bp, Homo sapiens
aataggttcttctt

SEQ ID NO: 4431310 - DNA, 17 bp, Homo sapiens
aataggtttgtaaaatg

SEQ ID NO: 4431311 - DNA, 16 bp, Homo sapiens
aatagtaatttgtaaa

SEQ ID NO: 4431312 - DNA, 18 bp, Homo sapiens
aatagtatacattgtctt

SEQ ID NO: 4431313 - DNA, 14 bp, Homo sapiens
aatagtattaacta

SEQ ID NO: 4431314 - DNA, 15 bp, Homo sapiens
aatagtatttcccat

SEQ ID NO: 4431315 - DNA, 15 bp, Homo sapiens
aatagtcaaaaatta

SEQ ID NO: 4431316 - DNA, 13 bp, Homo sapiens
aatagtctgtgtg

SEQ ID NO: 4431317 - DNA, 14 bp, Homo sapiens
aatagtctgtgtga

SEQ ID NO: 4431318 - DNA, 15 bp, Homo sapiens
aatagtctgtgtgaa

SEQ ID NO: 4431319 - DNA, 16 bp, Homo sapiens
aatagtggaacatttt

SEQ ID NO: 4431320 - DNA, 18 bp, Homo sapiens
aatagtggcataccaaat

SEQ ID NO: 4431321 - DNA, 13 bp, Homo sapiens
aatagtggttaac

SEQ ID NO: 4431322 - DNA, 15 bp, Homo sapiens
aatagtgtaagaact

SEQ ID NO: 4431323 - DNA, 19 bp, Homo sapiens
aatagtgtaagaactgtac

SEQ ID NO: 4431324 - DNA, 21 bp, Homo sapiens
aatagtgtcctatgcaataaa

SEQ ID NO: 4431325 - DNA, 22 bp, Homo sapiens
aatagtgtcctatgcaataaaa

SEQ ID NO: 4431326 - DNA, 15 bp, Homo sapiens
aatagttgaattagt

SEQ ID NO: 4431327 - DNA, 14 bp, Homo sapiens
aatagtttacacac

SEQ ID NO: 4431328 - DNA, 15 bp, Homo sapiens
aatagtttatttctg

SEQ ID NO: 4431329 - DNA, 14 bp, Homo sapiens
aatagttttttact

SEQ ID NO: 4431330 - DNA, 20 bp, Homo sapiens
aatataaaaaatcatgccag

SEQ ID NO: 4431331 - DNA, 15 bp, Homo sapiens
aatataaaacagtca

SEQ ID NO: 4431332 - DNA, 16 bp, Homo sapiens
aatataaatgtgtgta

SEQ ID NO: 4431333 - DNA, 17 bp, Homo sapiens
aatataaattgtacatt

SEQ ID NO: 4431334 - DNA, 12 bp, Homo sapiens
aatataagaaaa

SEQ ID NO: 4431335 - DNA, 20 bp, Homo sapiens
aatataagaaaagtaatgaa

SEQ ID NO: 4431336 - DNA, 23 bp, Homo sapiens
aatataaggaaagcaataaatga

SEQ ID NO: 4431337 - DNA, 16 bp, Homo sapiens
aatataagtaaagtga

SEQ ID NO: 4431338 - DNA, 17 bp, Homo sapiens
aatataagtaaagtgat

SEQ ID NO: 4431339 - DNA, 17 bp, Homo sapiens
aatataagtttctttgc

SEQ ID NO: 4431340 - DNA, 17 bp, Homo sapiens
aatataataatgatgat

SEQ ID NO: 4431341 - DNA, 13 bp, Homo sapiens
aatataatgtatt

SEQ ID NO: 4431342 - DNA, 15 bp, Homo sapiens
aatataattgtttta

SEQ ID NO: 4431343 - DNA, 15 bp, Homo sapiens
aatataccttattta

SEQ ID NO: 4431344 - DNA, 22 bp, Homo sapiens
aatataccttatttatttttgt

SEQ ID NO: 4431345 - DNA, 21 bp, Homo sapiens
aatatagaaaaaaacattcta

SEQ ID NO: 4431346 - DNA, 22 bp, Homo sapiens
aatatagaaaaaaacattctat

SEQ ID NO: 4431347 - DNA, 14 bp, Homo sapiens
aatatagagatatt

SEQ ID NO: 4431348 - DNA, 16 bp, Homo sapiens
aatatagagatatttt

SEQ ID NO: 4431349 - DNA, 13 bp, Homo sapiens
aatatagcttaaa

SEQ ID NO: 4431350 - DNA, 22 bp, Homo sapiens
aatataggtcctgtgttaaaca

SEQ ID NO: 4431351 - DNA, 23 bp, Homo sapiens
aatatagttttttctttcccatg

SEQ ID NO: 4431352 - DNA, 20 bp, Homo sapiens
aatatataatttaatgtaaa

SEQ ID NO: 4431353 - DNA, 20 bp, Homo sapiens
aatatatagctggcaagaat

SEQ ID NO: 4431354 - DNA, 21 bp, Homo sapiens
aatatatagtgggtacatcaa

SEQ ID NO: 4431355 - DNA, 22 bp, Homo sapiens
aatatatagtgggtacatcaag

SEQ ID NO: 4431356 - DNA, 15 bp, Homo sapiens
aataaaattaatgaa

SEQ ID NO: 4431357 - DNA, 17 bp, Homo sapiens
aataaaattatttgcag

SEQ ID NO: 4431358 - DNA, 16 bp, Homo sapiens
aataaaattgcctctc

SEQ ID NO: 4431359 - DNA, 11 bp, Homo sapiens
aataaaatttc

SEQ ID NO: 4431360 - DNA, 14 bp, Homo sapiens
aataaaatttgttg

SEQ ID NO: 4431361 - DNA, 17 bp, Homo sapiens
aataaaatttgttgcat

SEQ ID NO: 4431362 - DNA, 13 bp, Homo sapiens
aataaaattttat

SEQ ID NO: 4431363 - DNA, 12 bp, Homo sapiens
aataaacactgt

SEQ ID NO: 4431364 - DNA, 13 bp, Homo sapiens
aataaacactgtg

SEQ ID NO: 4431365 - DNA, 16 bp, Homo sapiens
aataaaccacaagcat

SEQ ID NO: 4431366 - DNA, 10 bp, Homo sapiens
aataaaccag

SEQ ID NO: 4431367 - DNA, 16 bp, Homo sapiens
aataaaccagtgtgaa

SEQ ID NO: 4431368 - DNA, 13 bp, Homo sapiens
aataaactattta

SEQ ID NO: 4431369 - DNA, 14 bp, Homo sapiens
aataaagaatactt

SEQ ID NO: 4431370 - DNA, 15 bp, Homo sapiens
aataaagaatacttg

SEQ ID NO: 4431371 - DNA, 19 bp, Homo sapiens
aataaagaatacttgaact

SEQ ID NO: 4431372 - DNA, 20 bp, Homo sapiens
aataaagacaaccatattta

SEQ ID NO: 4431373 - DNA, 12 bp, Homo sapiens
aataaagcaaat

SEQ ID NO: 4431374 - DNA, 11 bp, Homo sapiens
aataaagcctt

SEQ ID NO: 4431375 - DNA, 15 bp, Homo sapiens
aataaaggaaaacaa

SEQ ID NO: 4431376 - DNA, 18 bp, Homo sapiens
aataaaggaaaacaaaaa

SEQ ID NO: 4431377 - DNA, 18 bp, Homo sapiens
aataaaggactgtaatct

SEQ ID NO: 4431378 - DNA, 10 bp, Homo sapiens
aataaaggca

SEQ ID NO: 4431379 - DNA, 22 bp, Homo sapiens
aataaaggcagctgcctctgct

SEQ ID NO: 4431380 - DNA, 15 bp, Homo sapiens
aataaaggcagtttt

SEQ ID NO: 4431381 - DNA, 23 bp, Homo sapiens
aataaagggagaatggtgctgtt

SEQ ID NO: 4431382 - DNA, 15 bp, Homo sapiens
aataaagtataatgt

SEQ ID NO: 4431383 - DNA, 11 bp, Homo sapiens
aataaagtatt

SEQ ID NO: 4431384 - DNA, 19 bp, Homo sapiens
aataaagtattccacctta

SEQ ID NO: 4431385 - DNA, 17 bp, Homo sapiens
aataaagtcagatggaa

SEQ ID NO: 4431386 - DNA, 14 bp, Homo sapiens
aataaagtgaactt

SEQ ID NO: 4431387 - DNA, 19 bp, Homo sapiens
aataaagtgaactttgttt

SEQ ID NO: 4431388 - DNA, 16 bp, Homo sapiens
aataaagtgccttctg

SEQ ID NO: 4431389 - DNA, 12 bp, Homo sapiens
aataaagttgta

SEQ ID NO: 4431390 - DNA, 13 bp, Homo sapiens
aataaagtttatt

SEQ ID NO: 4431391 - DNA, 14 bp, Homo sapiens
aataaataaaaatg

SEQ ID NO: 4431392 - DNA, 19 bp, Homo sapiens
aataaataaggaaaagctt

SEQ ID NO: 4431393 - DNA, 12 bp, Homo sapiens
aataaatatacc

SEQ ID NO: 4431394 - DNA, 15 bp, Homo sapiens
aataaatatatctac

SEQ ID NO: 4431395 - DNA, 13 bp, Homo sapiens
aataaatatgaaa

SEQ ID NO: 4431396 - DNA, 16 bp, Homo sapiens
aataaatctaggatgt

SEQ ID NO: 4431397 - DNA, 14 bp, Homo sapiens
aataaatgaagaaa

SEQ ID NO: 4431398 - DNA, 17 bp, Homo sapiens
aataaatgattatattc

SEQ ID NO: 4431399 - DNA, 22 bp, Homo sapiens
aataaatggtttggtgcttttt

SEQ ID NO: 4431400 - DNA, 11 bp, Homo sapiens
aataaatgttc

SEQ ID NO: 4431401 - DNA, 12 bp, Homo sapiens
aataaatgttca

SEQ ID NO: 4431402 - DNA, 13 bp, Homo sapiens
aataaatgttcaa

SEQ ID NO: 4431403 - DNA, 16 bp, Homo sapiens
aataaattaagatcct

SEQ ID NO: 4431404 - DNA, 22 bp, Homo sapiens
aataaattaagatcctaaactc

SEQ ID NO: 4431405 - DNA, 16 bp, Homo sapiens
aataaattatggcatt

SEQ ID NO: 4431406 - DNA, 20 bp, Homo sapiens
aataaattcaataaaaacct

SEQ ID NO: 4431407 - DNA, 23 bp, Homo sapiens
aataaattcacattttctcaaag

SEQ ID NO: 4431408 - DNA, 21 bp, Homo sapiens
aataaattcccaacttctctt

SEQ ID NO: 4431409 - DNA, 23 bp, Homo sapiens
aataaattctacctccttgtgtt

SEQ ID NO: 4431410 - DNA, 19 bp, Homo sapiens
aataaattgctaatgttgc

SEQ ID NO: 4431411 - DNA, 15 bp, Homo sapiens
aataaatttatatga

SEQ ID NO: 4431412 - DNA, 22 bp, Homo sapiens
aataaatttcccagttaaagat

SEQ ID NO: 4431413 - DNA, 13 bp, Homo sapiens
aataaatttgact

SEQ ID NO: 4431414 - DNA, 18 bp, Homo sapiens
aataaattttcaaatcct

SEQ ID NO: 4431415 - DNA, 22 bp, Homo sapiens
aataaattttcaaatccttatt

SEQ ID NO: 4431416 - DNA, 15 bp, Homo sapiens
aataaattttctaaa

SEQ ID NO: 4431417 - DNA, 19 bp, Homo sapiens
aataacaagcatgcataaa

SEQ ID NO: 4431418 - DNA, 18 bp, Homo sapiens
aataacacagatattgtt

SEQ ID NO: 4431419 - DNA, 23 bp, Homo sapiens
aataacactgtattttaatgtac

SEQ ID NO: 4431420 - DNA, 16 bp, Homo sapiens
aataacatatcaaatg

SEQ ID NO: 4431421 - DNA, 13 bp, Homo sapiens
aataactaaaatg

SEQ ID NO: 4431422 - DNA, 16 bp, Homo sapiens
aataactgaatttgga

SEQ ID NO: 4431423 - DNA, 18 bp, Homo sapiens
aataactgagatattatt

SEQ ID NO: 4431424 - DNA, 19 bp, Homo sapiens
aataactttctctgtgaaa

SEQ ID NO: 4431425 - DNA, 14 bp, Homo sapiens
aataagaacagatc

SEQ ID NO: 4431426 - DNA, 18 bp, Homo sapiens
aataagaatagaaataaa

SEQ ID NO: 4431427 - DNA, 13 bp, Homo sapiens
aataagacaaaaa

SEQ ID NO: 4431428 - DNA, 15 bp, Homo sapiens
aataagacaaaaata

SEQ ID NO: 4431429 - DNA, 20 bp, Homo sapiens
aataagacaagagatctaca

SEQ ID NO: 4431430 - DNA, 16 bp, Homo sapiens
aataagatttttcaaa

SEQ ID NO: 4431431 - DNA, 20 bp, Homo sapiens
aataagcagaacatactgtt

SEQ ID NO: 4431432 - DNA, 14 bp, Homo sapiens
aataaggaaaagct

SEQ ID NO: 4431433 - DNA, 15 bp, Homo sapiens
aataaggctaaccat

SEQ ID NO: 4431434 - DNA, 18 bp, Homo sapiens
aataagtgacaaataaga

SEQ ID NO: 4431435 - DNA, 19 bp, Homo sapiens
aataagtgacaaataagat

SEQ ID NO: 4431436 - DNA, 21 bp, Homo sapiens
aataagtgacaaataagatta

SEQ ID NO: 4431437 - DNA, 17 bp, Homo sapiens
aataagtgccaggatgg

SEQ ID NO: 4431438 - DNA, 23 bp, Homo sapiens
aataagtggattttgtattttaa

SEQ ID NO: 4431439 - DNA, 12 bp, Homo sapiens
aataagttctta

SEQ ID NO: 4431440 - DNA, 13 bp, Homo sapiens
aataagttcttaa

SEQ ID NO: 4431441 - DNA, 19 bp, Homo sapiens
aataataaagatggttttg

SEQ ID NO: 4431442 - DNA, 20 bp, Homo sapiens
aataataagtgatgtgctga

SEQ ID NO: 4431443 - DNA, 13 bp, Homo sapiens
aataatacatact

SEQ ID NO: 4431444 - DNA, 15 bp, Homo sapiens
aataatatattttct

SEQ ID NO: 4431445 - DNA, 15 bp, Homo sapiens
aataatattcaatac

SEQ ID NO: 4431446 - DNA, 13 bp, Homo sapiens
aataatattgttt

SEQ ID NO: 4431447 - DNA, 16 bp, Homo sapiens
aataatatttcaagtg

SEQ ID NO: 4431448 - DNA, 17 bp, Homo sapiens
aataatatttcaagtgc

SEQ ID NO: 4431449 - DNA, 22 bp, Homo sapiens
aataatatttcaagtgcctaga

SEQ ID NO: 4431450 - DNA, 20 bp, Homo sapiens
aataatcacgctttcctgaa

SEQ ID NO: 4431451 - DNA, 21 bp, Homo sapiens
aataatcacgctttcctgaat

SEQ ID NO: 4431452 - DNA, 13 bp, Homo sapiens
aataatcggccca

SEQ ID NO: 4431453 - DNA, 19 bp, Homo sapiens
aataatctatattaaatga

SEQ ID NO: 4431454 - DNA, 12 bp, Homo sapiens
aataatgaaaat

SEQ ID NO: 4431455 - DNA, 23 bp, Homo sapiens
aataatgcagtatggtacatttt

SEQ ID NO: 4431456 - DNA, 23 bp, Homo sapiens
aataatgcatccagcagtacaat

SEQ ID NO: 4431457 - DNA, 22 bp, Homo sapiens
aataatgcctttgtaaccacaa

SEQ ID NO: 4431458 - DNA, 12 bp, Homo sapiens
aataatgctttt

SEQ ID NO: 4431459 - DNA, 16 bp, Homo sapiens
aataatgcttttctaa

SEQ ID NO: 4431460 - DNA, 17 bp, Homo sapiens
aataatgcttttctaat

SEQ ID NO: 4431461 - DNA, 16 bp, Homo sapiens
aataattcatatctaa

SEQ ID NO: 4431462 - DNA, 13 bp, Homo sapiens
aataatttaacta

SEQ ID NO: 4431463 - DNA, 15 bp, Homo sapiens
aataatttatagtaa

SEQ ID NO: 4431464 - DNA, 16 bp, Homo sapiens
aatacaaaaacttaga

SEQ ID NO: 4431465 - DNA, 13 bp, Homo sapiens
aatacaaagatga

SEQ ID NO: 4431466 - DNA, 19 bp, Homo sapiens
aatacaacaacaacaaaaa

SEQ ID NO: 4431467 - DNA, 12 bp, Homo sapiens
aatacaatgtac

SEQ ID NO: 4431468 - DNA, 15 bp, Homo sapiens
aatacaggaaacagt

SEQ ID NO: 4431469 - DNA, 16 bp, Homo sapiens
aatacaggaaacagtt

SEQ ID NO: 4431470 - DNA, 22 bp, Homo sapiens
aagtctgttatttattattaat

SEQ ID NO: 4431471 - DNA, 17 bp, Homo sapiens
aagtctttgccttctct

SEQ ID NO: 4431472 - DNA, 18 bp, Homo sapiens
aagtgaaatttctagcct

SEQ ID NO: 4431473 - DNA, 16 bp, Homo sapiens
aagtgaagactggaag

SEQ ID NO: 4431474 - DNA, 16 bp, Homo sapiens
aagtgaagagtcagaa

SEQ ID NO: 4431475 - DNA, 21 bp, Homo sapiens
aagtgaattgaagtttcaagt

SEQ ID NO: 4431476 - DNA, 17 bp, Homo sapiens
aagtgaatttgaatact

SEQ ID NO: 4431477 - DNA, 20 bp, Homo sapiens
aagtgagcagtcgcctgcct

SEQ ID NO: 4431478 - DNA, 20 bp, Homo sapiens
aagtgagtggtgtgactctt

SEQ ID NO: 4431479 - DNA, 13 bp, Homo sapiens
aagtgatgtattt

SEQ ID NO: 4431480 - DNA, 19 bp, Homo sapiens
aagtgatgtcatttgagca

SEQ ID NO: 4431481 - DNA, 17 bp, Homo sapiens
aagtgattatctctttg

SEQ ID NO: 4431482 - DNA, 17 bp, Homo sapiens
aagtgcaatgggtaagg

SEQ ID NO: 4431483 - DNA, 21 bp, Homo sapiens
aagtgcatctggagagaacag

SEQ ID NO: 4431484 - DNA, 16 bp, Homo sapiens
aagtgcatgctctctg

SEQ ID NO: 4431485 - DNA, 11 bp, Homo sapiens
aagtgccaaac

SEQ ID NO: 4431486 - DNA, 19 bp, Homo sapiens
aagtgccgcaaattgtacc

SEQ ID NO: 4431487 - DNA, 18 bp, Homo sapiens
aagtgcctagactgttac

SEQ ID NO: 4431488 - DNA, 19 bp, Homo sapiens
aagtgcctagactgttact

SEQ ID NO: 4431489 - DNA, 19 bp, Homo sapiens
aagtgccttggatgagaag

SEQ ID NO: 4431490 - DNA, 22 bp, Homo sapiens
aagtgcgtccacgagctgttta

SEQ ID NO: 4431491 - DNA, 17 bp, Homo sapiens
aagtgctgcacaaaagc

SEQ ID NO: 4431492 - DNA, 15 bp, Homo sapiens
aagtgctgcactcaa

SEQ ID NO: 4431493 - DNA, 21 bp, Homo sapiens
aagtgctgtttattaatctta

SEQ ID NO: 4431494 - DNA, 19 bp, Homo sapiens
aagtgcttattacatttta

SEQ ID NO: 4431495 - DNA, 19 bp, Homo sapiens
aagtgcttcattctttgca

SEQ ID NO: 4431496 - DNA, 18 bp, Homo sapiens
aagtggacaaattttgag

SEQ ID NO: 4431497 - DNA, 16 bp, Homo sapiens
aagtggaccaggacag

SEQ ID NO: 4431498 - DNA, 19 bp, Homo sapiens
aagtggaccaggacaggac

SEQ ID NO: 4431499 - DNA, 23 bp, Homo sapiens
aagtggactggtgtcataaactt

SEQ ID NO: 4431500 - DNA, 19 bp, Homo sapiens
aagtggattgtttttccct

SEQ ID NO: 4431501 - DNA, 12 bp, Homo sapiens
aagtggctgcct

SEQ ID NO: 4431502 - DNA, 11 bp, Homo sapiens
aagtgggacat

SEQ ID NO: 4431503 - DNA, 16 bp, Homo sapiens
aagtgggcttgattct

SEQ ID NO: 4431504 - DNA, 22 bp, Homo sapiens
aagtgggcttgattctgcagta

SEQ ID NO: 4431505 - DNA, 19 bp, Homo sapiens
aagtggggagagagccctt

SEQ ID NO: 4431506 - DNA, 18 bp, Homo sapiens
aagtggggctaaatgaag

SEQ ID NO: 4431507 - DNA, 19 bp, Homo sapiens
aagtggggctaaatgaagt

SEQ ID NO: 4431508 - DNA, 19 bp, Homo sapiens
aagtgggggcagagggcag

SEQ ID NO: 4431509 - DNA, 20 bp, Homo sapiens
aagtgggttattctggagtt

SEQ ID NO: 4431510 - DNA, 18 bp, Homo sapiens
aagtggttccctctctta

SEQ ID NO: 4431511 - DNA, 13 bp, Homo sapiens
aagtgtatttgga

SEQ ID NO: 4431512 - DNA, 21 bp, Homo sapiens
aagtgtatttggaaataaagt

SEQ ID NO: 4431513 - DNA, 18 bp, Homo sapiens
aagtgtctttgtttaaaa

SEQ ID NO: 4431514 - DNA, 14 bp, Homo sapiens
aagtgtcttttaaa

SEQ ID NO: 4431515 - DNA, 13 bp, Homo sapiens
aagtgtgagcaaa

SEQ ID NO: 4431516 - DNA, 18 bp, Homo sapiens
aagtgtgagctcttccct

SEQ ID NO: 4431517 - DNA, 20 bp, Homo sapiens
aagtgtgctgggcagaggga

SEQ ID NO: 4431518 - DNA, 20 bp, Homo sapiens
aagtgtggggattttcactg

SEQ ID NO: 4431519 - DNA, 20 bp, Homo sapiens
aagtgtgggtctgtgtgtgt

SEQ ID NO: 4431520 - DNA, 13 bp, Homo sapiens
aagtgtgtttgcc

SEQ ID NO: 4431521 - DNA, 21 bp, Homo sapiens
aagtgttaattttaccttgtt

SEQ ID NO: 4431522 - DNA, 13 bp, Homo sapiens
aagtgttcatttt

SEQ ID NO: 4431523 - DNA, 14 bp, Homo sapiens
aagtgttggaaaaa

SEQ ID NO: 4431524 - DNA, 18 bp, Homo sapiens
aagttaaacattgaagta

SEQ ID NO: 4431525 - DNA, 12 bp, Homo sapiens
aagttaatagat

SEQ ID NO: 4431526 - DNA, 21 bp, Homo sapiens
aagttaatcagaaagaaaaaa

SEQ ID NO: 4431527 - DNA, 19 bp, Homo sapiens
aagttaatgtatataaaaa

SEQ ID NO: 4431528 - DNA, 19 bp, Homo sapiens
aagttaattcttaaaacta

SEQ ID NO: 4431529 - DNA, 23 bp, Homo sapiens
aagttagtggaaatctgaacatt

SEQ ID NO: 4431530 - DNA, 13 bp, Homo sapiens
aagttatatttca

SEQ ID NO: 4431531 - DNA, 20 bp, Homo sapiens
aagttattagtggtttatca

SEQ ID NO: 4431532 - DNA, 15 bp, Homo sapiens
aagttattgcagttt

SEQ ID NO: 4431533 - DNA, 22 bp, Homo sapiens
aagttatttccttttataatac

SEQ ID NO: 4431534 - DNA, 16 bp, Homo sapiens
aagttcaacatgttat

SEQ ID NO: 4431535 - DNA, 22 bp, Homo sapiens
aagttcagcacttgtctcattt

SEQ ID NO: 4431536 - DNA, 20 bp, Homo sapiens
aagttcataacagtgccatt

SEQ ID NO: 4431537 - DNA, 23 bp, Homo sapiens
aagttccctggagaaaaaaattg

SEQ ID NO: 4431538 - DNA, 20 bp, Homo sapiens
aagttccttggccatgcaga

SEQ ID NO: 4431539 - DNA, 12 bp, Homo sapiens
aagttcgtctgt

SEQ ID NO: 4431540 - DNA, 18 bp, Homo sapiens
aagttctatttcttgaag

SEQ ID NO: 4431541 - DNA, 13 bp, Homo sapiens
aagttctcagagc

SEQ ID NO: 4431542 - DNA, 17 bp, Homo sapiens
aagttctgcagataaac

SEQ ID NO: 4431543 - DNA, 19 bp, Homo sapiens
aagttctgtactcaaatgt

SEQ ID NO: 4431544 - DNA, 11 bp, Homo sapiens
aagttcttatg

SEQ ID NO: 4431545 - DNA, 20 bp, Homo sapiens
aagttcttatgaggagggga

SEQ ID NO: 4431546 - DNA, 22 bp, Homo sapiens
aagttcttatgaggaggggagg

SEQ ID NO: 4431547 - DNA, 15 bp, Homo sapiens
aagttcttattttag

SEQ ID NO: 4431548 - DNA, 18 bp, Homo sapiens
aagttcttattttagtat

SEQ ID NO: 4431549 - DNA, 23 bp, Homo sapiens
aagttgaaccattatactttata

SEQ ID NO: 4431550 - DNA, 13 bp, Homo sapiens
aagttgaccttta

SEQ ID NO: 4431551 - DNA, 16 bp, Homo sapiens
aagttgacttatagta

SEQ ID NO: 4431552 - DNA, 19 bp, Homo sapiens
aagttgacttatagtacat

SEQ ID NO: 4431553 - DNA, 20 bp, Homo sapiens
aagttgacttatagtacatg

SEQ ID NO: 4431554 - DNA, 22 bp, Homo sapiens
aagttgagcgtgcgcactgcat

SEQ ID NO: 4431555 - DNA, 11 bp, Homo sapiens
aagttggcttc

SEQ ID NO: 4431556 - DNA, 21 bp, Homo sapiens
aagttggcttctgtttctagt

SEQ ID NO: 4431557 - DNA, 14 bp, Homo sapiens
aagttgtacatgat

SEQ ID NO: 4431558 - DNA, 15 bp, Homo sapiens
aagttgtacatgata

SEQ ID NO: 4431559 - DNA, 16 bp, Homo sapiens
aagttgtacatgataa

SEQ ID NO: 4431560 - DNA, 15 bp, Homo sapiens
aagttgtatttcaaa

SEQ ID NO: 4431561 - DNA, 12 bp, Homo sapiens
aagttgtcaaag

SEQ ID NO: 4431562 - DNA, 18 bp, Homo sapiens
aagttgtcaaagaagctt

SEQ ID NO: 4431563 - DNA, 13 bp, Homo sapiens
aagttgtgctaaa

SEQ ID NO: 4431564 - DNA, 15 bp, Homo sapiens
aagttgttaataaaa

SEQ ID NO: 4431565 - DNA, 15 bp, Homo sapiens
aagttgttgactgtg

SEQ ID NO: 4431566 - DNA, 17 bp, Homo sapiens
aagttgttgactgtgat

SEQ ID NO: 4431567 - DNA, 17 bp, Homo sapiens
aagttgtttatcaactt

SEQ ID NO: 4431568 - DNA, 14 bp, Homo sapiens
aagtttaccatctg

SEQ ID NO: 4431569 - DNA, 14 bp, Homo sapiens
aagtttatttcctg

SEQ ID NO: 4431570 - DNA, 15 bp, Homo sapiens
aagtttatttcctga

SEQ ID NO: 4431571 - DNA, 19 bp, Homo sapiens
aagtttcaagttttaaagt

SEQ ID NO: 4431572 - DNA, 13 bp, Homo sapiens
aagtttcacctgt

SEQ ID NO: 4431573 - DNA, 23 bp, Homo sapiens
aagtttcattctccctttcacta

SEQ ID NO: 4431574 - DNA, 22 bp, Homo sapiens
aagtttctggtgccatttctga

SEQ ID NO: 4431575 - DNA, 10 bp, Homo sapiens
aagtttcttt

SEQ ID NO: 4431576 - DNA, 15 bp, Homo sapiens
aagtttctttagaaa

SEQ ID NO: 4431577 - DNA, 21 bp, Homo sapiens
aagttttaaacccaaaatata

SEQ ID NO: 4431578 - DNA, 15 bp, Homo sapiens
aagttttaaagttca

SEQ ID NO: 4431579 - DNA, 17 bp, Homo sapiens
aagttttatatgtagaa

SEQ ID NO: 4431580 - DNA, 21 bp, Homo sapiens
aagttttctcaacagagagca

SEQ ID NO: 4431581 - DNA, 21 bp, Homo sapiens
aagtttttaaaaataaaggaa

SEQ ID NO: 4431582 - DNA, 14 bp, Homo sapiens
aagtttttcatact

SEQ ID NO: 4431583 - DNA, 14 bp, Homo sapiens
aataaaaaatctga

SEQ ID NO: 4431584 - DNA, 17 bp, Homo sapiens
aataaaaaatctgaaga

SEQ ID NO: 4431585 - DNA, 18 bp, Homo sapiens
aataaaaaatctgaagag

SEQ ID NO: 4431586 - DNA, 17 bp, Homo sapiens
aataaaaacacacctta

SEQ ID NO: 4431587 - DNA, 23 bp, Homo sapiens
aataaaaacattgcctttgaatg

SEQ ID NO: 4431588 - DNA, 12 bp, Homo sapiens
aataaaaactat

SEQ ID NO: 4431589 - DNA, 23 bp, Homo sapiens
aataaaaagatcactttctcagt

SEQ ID NO: 4431590 - DNA, 18 bp, Homo sapiens
cagaaagcagaacagtga

SEQ ID NO: 4431591 - DNA, 19 bp, Homo sapiens
cagaaagcagaacagtgat

SEQ ID NO: 4431592 - DNA, 15 bp, Homo sapiens
cagaaagccaggagc

SEQ ID NO: 4431593 - DNA, 23 bp, Homo sapiens
cagaaagcctcctgccccctgcc

SEQ ID NO: 4431594 - DNA, 14 bp, Homo sapiens
cagaaagctgcctg

SEQ ID NO: 4431595 - DNA, 20 bp, Homo sapiens
cagaaagcttcatccacagc

SEQ ID NO: 4431596 - DNA, 20 bp, Homo sapiens
cagaaaggactcctcctttt

SEQ ID NO: 4431597 - DNA, 12 bp, Homo sapiens
cagaaaggagac

SEQ ID NO: 4431598 - DNA, 15 bp, Homo sapiens
cagaaaggttctgcc

SEQ ID NO: 4431599 - DNA, 21 bp, Homo sapiens
cagaaaggttctgcccgggaa

SEQ ID NO: 4431600 - DNA, 20 bp, Homo sapiens
cagaaagtgggggtggagga

SEQ ID NO: 4431601 - DNA, 12 bp, Homo sapiens
cagaaataaaga

SEQ ID NO: 4431602 - DNA, 14 bp, Homo sapiens
cagaaatagacaaa

SEQ ID NO: 4431603 - DNA, 16 bp, Homo sapiens
cagaaatagacaaaaa

SEQ ID NO: 4431604 - DNA, 21 bp, Homo sapiens
cagaaatagacaaaaagtata

SEQ ID NO: 4431605 - DNA, 19 bp, Homo sapiens
cagaaatattcttattact

SEQ ID NO: 4431606 - DNA, 22 bp, Homo sapiens
cagaaatcacagtcaatggatc

SEQ ID NO: 4431607 - DNA, 19 bp, Homo sapiens
cagaaatgtttatggaaat

SEQ ID NO: 4431608 - DNA, 13 bp, Homo sapiens
cagaaattgtata

SEQ ID NO: 4431609 - DNA, 13 bp, Homo sapiens
cagaacactaacc

SEQ ID NO: 4431610 - DNA, 15 bp, Homo sapiens
cagaacactaacctg

SEQ ID NO: 4431611 - DNA, 21 bp, Homo sapiens
cagaacactaacctgaccgtg

SEQ ID NO: 4431612 - DNA, 15 bp, Homo sapiens
cagaacagaggcatt

SEQ ID NO: 4431613 - DNA, 20 bp, Homo sapiens
cagaacagccctcggcctcc

SEQ ID NO: 4431614 - DNA, 17 bp, Homo sapiens
cagaacagtgattacca

SEQ ID NO: 4431615 - DNA, 17 bp, Homo sapiens
cagaacagtggtggcaa

SEQ ID NO: 4431616 - DNA, 23 bp, Homo sapiens
cagaacattcgaatctctgcccc

SEQ ID NO: 4431617 - DNA, 14 bp, Homo sapiens
cagaacccacagta

SEQ ID NO: 4431618 - DNA, 15 bp, Homo sapiens
cagaacccacagtag

SEQ ID NO: 4431619 - DNA, 18 bp, Homo sapiens
cagaaccctgccatggaa

SEQ ID NO: 4431620 - DNA, 21 bp, Homo sapiens
cagaacctcttccccagaaag

SEQ ID NO: 4431621 - DNA, 17 bp, Homo sapiens
cagaaccttcaacccag

SEQ ID NO: 4431622 - DNA, 16 bp, Homo sapiens
cagaacgcaccccact

SEQ ID NO: 4431623 - DNA, 13 bp, Homo sapiens
cagaactagaatt

SEQ ID NO: 4431624 - DNA, 14 bp, Homo sapiens
cagaactctttcaa

SEQ ID NO: 4431625 - DNA, 12 bp, Homo sapiens
cagaactgccct

SEQ ID NO: 4431626 - DNA, 22 bp, Homo sapiens
cagaactgcccttgctgcccgc

SEQ ID NO: 4431627 - DNA, 11 bp, Homo sapiens
cagaagaattt

SEQ ID NO: 4431628 - DNA, 20 bp, Homo sapiens
cagaagagttgtgcacgcag

SEQ ID NO: 4431629 - DNA, 15 bp, Homo sapiens
cagaagatcccctca

SEQ ID NO: 4431630 - DNA, 11 bp, Homo sapiens
cagaagcagag

SEQ ID NO: 4431631 - DNA, 19 bp, Homo sapiens
cagaagcctccaagcacag

SEQ ID NO: 4431632 - DNA, 21 bp, Homo sapiens
cagaagcctccaagcctgcct

SEQ ID NO: 4431633 - DNA, 22 bp, Homo sapiens
cagaagccttggaaccagcccc

SEQ ID NO: 4431634 - DNA, 20 bp, Homo sapiens
cagaaggaaagcactaagaa

SEQ ID NO: 4431635 - DNA, 12 bp, Homo sapiens
cagaaggaagga

SEQ ID NO: 4431636 - DNA, 18 bp, Homo sapiens
cagaaggacggcaggagt

SEQ ID NO: 4431637 - DNA, 18 bp, Homo sapiens
cagaaggcaaacccatca

SEQ ID NO: 4431638 - DNA, 18 bp, Homo sapiens
cagaagggaattgctcag

SEQ ID NO: 4431639 - DNA, 15 bp, Homo sapiens
cacctcggggacacc

SEQ ID NO: 4431640 - DNA, 15 bp, Homo sapiens
cacctctcagctgct

SEQ ID NO: 4431641 - DNA, 16 bp, Homo sapiens
cacctctcctgccctg

SEQ ID NO: 4431642 - DNA, 14 bp, Homo sapiens
cacctctctcccca

SEQ ID NO: 4431643 - DNA, 14 bp, Homo sapiens
cacctctgcctcaa

SEQ ID NO: 4431644 - DNA, 13 bp, Homo sapiens
cacctctggactg

SEQ ID NO: 4431645 - DNA, 23 bp, Homo sapiens
cacctgaagggtggatgtgctgg

SEQ ID NO: 4431646 - DNA, 20 bp, Homo sapiens
cacctgagaccctgggagag

SEQ ID NO: 4431647 - DNA, 12 bp, Homo sapiens
cacctgaggtca

SEQ ID NO: 4431648 - DNA, 11 bp, Homo sapiens
cacctgcaaga

SEQ ID NO: 4431649 - DNA, 12 bp, Homo sapiens
cacctgcaagat

SEQ ID NO: 4431650 - DNA, 13 bp, Homo sapiens
cacctgcacctcc

SEQ ID NO: 4431651 - DNA, 11 bp, Homo sapiens
cacctgccaca

SEQ ID NO: 4431652 - DNA, 22 bp, Homo sapiens
cacctgcccatcacagggttgg

SEQ ID NO: 4431653 - DNA, 13 bp, Homo sapiens
cacctgccctttt

SEQ ID NO: 4431654 - DNA, 16 bp, Homo sapiens
cacctgccttggcctc

SEQ ID NO: 4431655 - DNA, 16 bp, Homo sapiens
cacctggactgagcca

SEQ ID NO: 4431656 - DNA, 22 bp, Homo sapiens
cacctggactgagccaaggagg

SEQ ID NO: 4431657 - DNA, 16 bp, Homo sapiens
cacctggccccatgtc

SEQ ID NO: 4431658 - DNA, 20 bp, Homo sapiens
cacctggccccatgtctctc

SEQ ID NO: 4431659 - DNA, 12 bp, Homo sapiens
cacctggctctg

SEQ ID NO: 4431660 - DNA, 20 bp, Homo sapiens
cacctggctgaggttcctct

SEQ ID NO: 4431661 - DNA, 23 bp, Homo sapiens
cacctgtaaaactttattttata

SEQ ID NO: 4431662 - DNA, 14 bp, Homo sapiens
cacctgtaaacctg

SEQ ID NO: 4431663 - DNA, 16 bp, Homo sapiens
cacctgtaaacctgag

SEQ ID NO: 4431664 - DNA, 16 bp, Homo sapiens
cacctgtagtcccagc

SEQ ID NO: 4431665 - DNA, 17 bp, Homo sapiens
cacctgtagtcccagct

SEQ ID NO: 4431666 - DNA, 13 bp, Homo sapiens
caccttaaaacat

SEQ ID NO: 4431667 - DNA, 13 bp, Homo sapiens
caccttaaattaa

SEQ ID NO: 4431668 - DNA, 23 bp, Homo sapiens
caccttaatatgctgcaacaaaa

SEQ ID NO: 4431669 - DNA, 13 bp, Homo sapiens
caccttagaaaaa

SEQ ID NO: 4431670 - DNA, 16 bp, Homo sapiens
caccttagtctttcct

SEQ ID NO: 4431671 - DNA, 21 bp, Homo sapiens
caccttcatttaactctttga

SEQ ID NO: 4431672 - DNA, 15 bp, Homo sapiens
caccttcccagctct

SEQ ID NO: 4431673 - DNA, 17 bp, Homo sapiens
caccttcccagctctcc

SEQ ID NO: 4431674 - DNA, 19 bp, Homo sapiens
caccttcccagctctccct

SEQ ID NO: 4431675 - DNA, 24 bp, Homo sapiens
caccttcccctgaggacctttctg

SEQ ID NO: 4431676 - DNA, 15 bp, Homo sapiens
caccttcctcctgca

SEQ ID NO: 4431677 - DNA, 17 bp, Homo sapiens
caccttcctcctgcaga

SEQ ID NO: 4431678 - DNA, 20 bp, Homo sapiens
cacctttcctctaatccagc

SEQ ID NO: 4431679 - DNA, 14 bp, Homo sapiens
caccttttatgaat

SEQ ID NO: 4431680 - DNA, 21 bp, Homo sapiens
caccttttatgaatcaaatat

SEQ ID NO: 4431681 - DNA, 16 bp, Homo sapiens
caccttttctgtggct

SEQ ID NO: 4431682 - DNA, 21 bp, Homo sapiens
caccttttctgtggctggctc

SEQ ID NO: 4431683 - DNA, 21 bp, Homo sapiens
cacgaacttgaaagttttcta

SEQ ID NO: 4431684 - DNA, 16 bp, Homo sapiens
cacgactgcgggagcc

SEQ ID NO: 4431685 - DNA, 13 bp, Homo sapiens
cacgactgtctcc

SEQ ID NO: 4431686 - DNA, 21 bp, Homo sapiens
cacgactgttgtacaagctca

SEQ ID NO: 4431687 - DNA, 12 bp, Homo sapiens
cacgagccacaa

SEQ ID NO: 4431688 - DNA, 21 bp, Homo sapiens
cacgagccacaagctgcactg

SEQ ID NO: 4431689 - DNA, 15 bp, Homo sapiens
cacgagcctgggcga

SEQ ID NO: 4431690 - DNA, 20 bp, Homo sapiens
cacgagctgtttactaggga

SEQ ID NO: 4431691 - DNA, 20 bp, Homo sapiens
cacgataaataatcggccca

SEQ ID NO: 4431692 - DNA, 17 bp, Homo sapiens
cacgcaaatacactcca

SEQ ID NO: 4431693 - DNA, 18 bp, Homo sapiens
cacgcaaatacactccag

SEQ ID NO: 4431694 - DNA, 20 bp, Homo sapiens
cacgcagattagcaggccaa

SEQ ID NO: 4431695 - DNA, 18 bp, Homo sapiens
cacgcatgatggagctga

SEQ ID NO: 4431696 - DNA, 15 bp, Homo sapiens
cacgccattctcctg

SEQ ID NO: 4431697 - DNA, 21 bp, Homo sapiens
cacgccattctcctgcctcag

SEQ ID NO: 4431698 - DNA, 23 bp, Homo sapiens
cacgccattgtactccagcctgg

SEQ ID NO: 4431699 - DNA, 14 bp, Homo sapiens
cacgcccaccagcc

SEQ ID NO: 4431700 - DNA, 16 bp, Homo sapiens
cacgcccaccagcctt

SEQ ID NO: 4431701 - DNA, 19 bp, Homo sapiens
cacgcccaccagccttgct

SEQ ID NO: 4431702 - DNA, 14 bp, Homo sapiens
cacgccccggtccc

SEQ ID NO: 4431703 - DNA, 14 bp, Homo sapiens
cacgccctccctgc

SEQ ID NO: 4431704 - DNA, 17 bp, Homo sapiens
cacgccctccctgctag

SEQ ID NO: 4431705 - DNA, 22 bp, Homo sapiens
cacgccctccctgctagcacag

SEQ ID NO: 4431706 - DNA, 24 bp, Homo sapiens
cacgccctccctgctagcacagag

SEQ ID NO: 4431707 - DNA, 14 bp, Homo sapiens
cacgcctcctggcc

SEQ ID NO: 4431708 - DNA, 15 bp, Homo sapiens
cacgcctcctggcca

SEQ ID NO: 4431709 - DNA, 18 bp, Homo sapiens
cacgcctcctggccagac

SEQ ID NO: 4431710 - DNA, 17 bp, Homo sapiens
cacgcctgtaatcccag

SEQ ID NO: 4431711 - DNA, 20 bp, Homo sapiens
cacgcctgtaatcccagcac

SEQ ID NO: 4431712 - DNA, 12 bp, Homo sapiens
cacgctccagct

SEQ ID NO: 4431713 - DNA, 13 bp, Homo sapiens
cacgctccagctg

SEQ ID NO: 4431714 - DNA, 15 bp, Homo sapiens
cacgctccagctgcc

SEQ ID NO: 4431715 - DNA, 12 bp, Homo sapiens
cacgctgggcct

SEQ ID NO: 4431716 - DNA, 17 bp, Homo sapiens
cacgctgggcctaggat

SEQ ID NO: 4431717 - DNA, 13 bp, Homo sapiens
cacgctgtcctct

SEQ ID NO: 4431718 - DNA, 23 bp, Homo sapiens
cacgctgtcctctcgagcccaga

SEQ ID NO: 4431719 - DNA, 14 bp, Homo sapiens
cacgcttctgagca

SEQ ID NO: 4431720 - DNA, 17 bp, Homo sapiens
cacggaaggcgggctga

SEQ ID NO: 4431721 - DNA, 21 bp, Homo sapiens
cacggaaggcgggctgaggag

SEQ ID NO: 4431722 - DNA, 23 bp, Homo sapiens
cacggactctcccaggcctgcct

SEQ ID NO: 4431723 - DNA, 13 bp, Homo sapiens
cacggagacagag

SEQ ID NO: 4431724 - DNA, 17 bp, Homo sapiens
cacggagacagaggaaa

SEQ ID NO: 4431725 - DNA, 18 bp, Homo sapiens
cacggatggtgcatgggc

SEQ ID NO: 4431726 - DNA, 18 bp, Homo sapiens
cacggcgggatcctccac

SEQ ID NO: 4431727 - DNA, 20 bp, Homo sapiens
cacggctcctcgagatccca

SEQ ID NO: 4431728 - DNA, 21 bp, Homo sapiens
cacgggggagtgagacaggct

SEQ ID NO: 4431729 - DNA, 22 bp, Homo sapiens
cacggggttggctgttccagac

SEQ ID NO: 4431730 - DNA, 23 bp, Homo sapiens
cacggggttggctgttccagact

SEQ ID NO: 4431731 - DNA, 22 bp, Homo sapiens
cacggtcccccaggaggcagct

SEQ ID NO: 4431732 - DNA, 16 bp, Homo sapiens
cacggttatttaagca

SEQ ID NO: 4431733 - DNA, 14 bp, Homo sapiens
cacgtattgctgtg

SEQ ID NO: 4431734 - DNA, 15 bp, Homo sapiens
cacgtattgctgtgt

SEQ ID NO: 4431735 - DNA, 18 bp, Homo sapiens
cacgtcaggcctggcctc

SEQ ID NO: 4431736 - DNA, 14 bp, Homo sapiens
cacgtcatgggagg

SEQ ID NO: 4431737 - DNA, 13 bp, Homo sapiens
cacgtccaggtcc

SEQ ID NO: 4431738 - DNA, 13 bp, Homo sapiens
cacgtgccaggcc

SEQ ID NO: 4431739 - DNA, 23 bp, Homo sapiens
cacgtggagagctggtgcccgga

SEQ ID NO: 4431740 - DNA, 17 bp, Homo sapiens
cacgtggagatagtgcc

SEQ ID NO: 4431741 - DNA, 20 bp, Homo sapiens
cacgtggggcccactgctcg

SEQ ID NO: 4431742 - DNA, 16 bp, Homo sapiens
cacgtgtttgtgctgt

SEQ ID NO: 4431743 - DNA, 19 bp, Homo sapiens
cacgttagaggaaaaatat

SEQ ID NO: 4431744 - DNA, 13 bp, Homo sapiens
cacgttgacccaa

SEQ ID NO: 4431745 - DNA, 22 bp, Homo sapiens
cactaaaaatattgtttctgca

SEQ ID NO: 4431746 - DNA, 19 bp, Homo sapiens
cactaaaacacacaggtgc

SEQ ID NO: 4431747 - DNA, 15 bp, Homo sapiens
cactaaaagtctcca

SEQ ID NO: 4431748 - DNA, 19 bp, Homo sapiens
cactaacactttagttata

SEQ ID NO: 4431749 - DNA, 14 bp, Homo sapiens
cactaacagagtgg

SEQ ID NO: 4431750 - DNA, 14 bp, Homo sapiens
cactaacagggaga

SEQ ID NO: 4431751 - DNA, 17 bp, Homo sapiens
cactaacagggagaagt

SEQ ID NO: 4431752 - DNA, 20 bp, Homo sapiens
cactaaccatccccaactcc

SEQ ID NO: 4431753 - DNA, 22 bp, Homo sapiens
cactaagacaagaacattctct

SEQ ID NO: 4431754 - DNA, 21 bp, Homo sapiens
cactaaggccgtgtctctgag

SEQ ID NO: 4431755 - DNA, 12 bp, Homo sapiens
cactaataaagt

SEQ ID NO: 4431756 - DNA, 15 bp, Homo sapiens
cactaatcacaaact

SEQ ID NO: 4431757 - DNA, 20 bp, Homo sapiens
cactaatttttgtattattt

SEQ ID NO: 4431758 - DNA, 19 bp, Homo sapiens
cactgatgttgtgttttta

SEQ ID NO: 4431759 - DNA, 19 bp, Homo sapiens
cactgattaaaataggatt

SEQ ID NO: 4431760 - DNA, 14 bp, Homo sapiens
cactgcaacctccg

SEQ ID NO: 4431761 - DNA, 13 bp, Homo sapiens
cactgcaagagcc

SEQ ID NO: 4431762 - DNA, 17 bp, Homo sapiens
cactgcaagagccttgg

SEQ ID NO: 4431763 - DNA, 15 bp, Homo sapiens
cactgcaatatcttc

SEQ ID NO: 4431764 - DNA, 12 bp, Homo sapiens
cactgcacccct

SEQ ID NO: 4431765 - DNA, 17 bp, Homo sapiens
cactgcagaaaccttta

SEQ ID NO: 4431766 - DNA, 13 bp, Homo sapiens
cactgcagcctca

SEQ ID NO: 4431767 - DNA, 16 bp, Homo sapiens
cactgcaggccccgct

SEQ ID NO: 4431768 - DNA, 14 bp, Homo sapiens
cactgcagtcagat

SEQ ID NO: 4431769 - DNA, 21 bp, Homo sapiens
cactgcatgtcagagcacttt

SEQ ID NO: 4431770 - DNA, 21 bp, Homo sapiens
cactgcatttgcctgcttctt

SEQ ID NO: 4431771 - DNA, 13 bp, Homo sapiens
cactgccaggcca

SEQ ID NO: 4431772 - DNA, 14 bp, Homo sapiens
cactgccaggccag

SEQ ID NO: 4431773 - DNA, 17 bp, Homo sapiens
cactgccaggccagcct

SEQ ID NO: 4431774 - DNA, 22 bp, Homo sapiens
cactgccccccgaggctgctag

SEQ ID NO: 4431775 - DNA, 21 bp, Homo sapiens
cactgcgcccggcccaagaga

SEQ ID NO: 4431776 - DNA, 17 bp, Homo sapiens
cactgcgggagctctgt

SEQ ID NO: 4431777 - DNA, 18 bp, Homo sapiens
cactgcgggagctctgta

SEQ ID NO: 4431778 - DNA, 22 bp, Homo sapiens
cactgcgttttcctagctgtgt

SEQ ID NO: 4431779 - DNA, 15 bp, Homo sapiens
cactgctccaggcct

SEQ ID NO: 4431780 - DNA, 15 bp, Homo sapiens
cactgctctaacagc

SEQ ID NO: 4431781 - DNA, 13 bp, Homo sapiens
cactgctgcattc

SEQ ID NO: 4431782 - DNA, 20 bp, Homo sapiens
cactgcttgaactaggctga

SEQ ID NO: 4431783 - DNA, 13 bp, Homo sapiens
cactgcttgagga

SEQ ID NO: 4431784 - DNA, 15 bp, Homo sapiens
cactgcttgaggaaa

SEQ ID NO: 4431785 - DNA, 15 bp, Homo sapiens
cactggaaaggggag

SEQ ID NO: 4431786 - DNA, 24 bp, Homo sapiens
cactggaaaggggagagcctgctg

SEQ ID NO: 4431787 - DNA, 23 bp, Homo sapiens
cactggaaggaacatggagctgt

SEQ ID NO: 4431788 - DNA, 13 bp, Homo sapiens
cactggacagcat

SEQ ID NO: 4431789 - DNA, 16 bp, Homo sapiens
cactggagcaccaggc

SEQ ID NO: 4431790 - DNA, 17 bp, Homo sapiens
cactggagcaccaggca

SEQ ID NO: 4431791 - DNA, 15 bp, Homo sapiens
cactggatcctgctg

SEQ ID NO: 4431792 - DNA, 21 bp, Homo sapiens
cactggcatcgcagcttcctg

SEQ ID NO: 4431793 - DNA, 20 bp, Homo sapiens
cactggccacccctccccag

SEQ ID NO: 4431794 - DNA, 16 bp, Homo sapiens
cactggccgctgagcg

SEQ ID NO: 4431795 - DNA, 11 bp, Homo sapiens
cactggcctct

SEQ ID NO: 4431796 - DNA, 15 bp, Homo sapiens
cactggcctctcccc

SEQ ID NO: 4431797 - DNA, 20 bp, Homo sapiens
cactggcctctccccaggaa

SEQ ID NO: 4431798 - DNA, 20 bp, Homo sapiens
cactggccttctgatgaaat

SEQ ID NO: 4431799 - DNA, 12 bp, Homo sapiens
cactgggagagc

SEQ ID NO: 4431800 - DNA, 20 bp, Homo sapiens
cactgggccaattcaataca

SEQ ID NO: 4431801 - DNA, 10 bp, Homo sapiens
cactgggccc

SEQ ID NO: 4431802 - DNA, 19 bp, Homo sapiens
cactggggaatgctcccag

SEQ ID NO: 4431803 - DNA, 13 bp, Homo sapiens
cactggggctgac

SEQ ID NO: 4431804 - DNA, 16 bp, Homo sapiens
cactggggctgacacc

SEQ ID NO: 4431805 - DNA, 20 bp, Homo sapiens
cactggggctgacacccagg

SEQ ID NO: 4431806 - DNA, 22 bp, Homo sapiens
cactggggctgacacccaggcc

SEQ ID NO: 4431807 - DNA, 18 bp, Homo sapiens
cactggggtgccttcact

SEQ ID NO: 4431808 - DNA, 17 bp, Homo sapiens
cactgggtggtggcctg

SEQ ID NO: 4431809 - DNA, 14 bp, Homo sapiens
cactggtctgctgt

SEQ ID NO: 4431810 - DNA, 15 bp, Homo sapiens
cactggtctgctgtc

SEQ ID NO: 4431811 - DNA, 16 bp, Homo sapiens
cactggtctgctgttc

SEQ ID NO: 4431812 - DNA, 19 bp, Homo sapiens
cactggtggtttttgctct

SEQ ID NO: 4431813 - DNA, 19 bp, Homo sapiens
cactggtgtgaactcaccc

SEQ ID NO: 4431814 - DNA, 22 bp, Homo sapiens
cactggttcttcttggtctcag

SEQ ID NO: 4431815 - DNA, 16 bp, Homo sapiens
cactggtttcaagaat

SEQ ID NO: 4431816 - DNA, 18 bp, Homo sapiens
cactggtttgtttctcaa

SEQ ID NO: 4431817 - DNA, 13 bp, Homo sapiens
cactgtaaagaca

SEQ ID NO: 4431818 - DNA, 15 bp, Homo sapiens
cactgtaaagacaaa

SEQ ID NO: 4431819 - DNA, 18 bp, Homo sapiens
cactgtaaatatccctcc

SEQ ID NO: 4431820 - DNA, 21 bp, Homo sapiens
aagctaatgtgcagggatatt

SEQ ID NO: 4431821 - DNA, 14 bp, Homo sapiens
aagctactattttg

SEQ ID NO: 4431822 - DNA, 23 bp, Homo sapiens
aagctactgtgtgtgtgaatgaa

SEQ ID NO: 4431823 - DNA, 13 bp, Homo sapiens
aagctagaaatga

SEQ ID NO: 4431824 - DNA, 16 bp, Homo sapiens
aagctagaacctggag

SEQ ID NO: 4431825 - DNA, 18 bp, Homo sapiens
aagctagacacatgaagg

SEQ ID NO: 4431826 - DNA, 20 bp, Homo sapiens
aagctagacacatgaaggta

SEQ ID NO: 4431827 - DNA, 21 bp, Homo sapiens
aagctagacacatgaaggtaa

SEQ ID NO: 4431828 - DNA, 15 bp, Homo sapiens
aagctataaagcagt

SEQ ID NO: 4431829 - DNA, 15 bp, Homo sapiens
aagctatcttcatgt

SEQ ID NO: 4431830 - DNA, 17 bp, Homo sapiens
aagctcaaatgaaatgt

SEQ ID NO: 4431831 - DNA, 19 bp, Homo sapiens
aagctcacagttcctcgcc

SEQ ID NO: 4431832 - DNA, 23 bp, Homo sapiens
aagctcacttctgggcttcatct

SEQ ID NO: 4431833 - DNA, 15 bp, Homo sapiens
aagctcatccctgga

SEQ ID NO: 4431834 - DNA, 22 bp, Homo sapiens
aagctcatccctggacttctgg

SEQ ID NO: 4431835 - DNA, 15 bp, Homo sapiens
aagctcatttcatgc

SEQ ID NO: 4431836 - DNA, 16 bp, Homo sapiens
aagctccaccctcctg

SEQ ID NO: 4431837 - DNA, 13 bp, Homo sapiens
aagctctgaaaac

SEQ ID NO: 4431838 - DNA, 13 bp, Homo sapiens
aagctgaaatttt

SEQ ID NO: 4431839 - DNA, 17 bp, Homo sapiens
aagctgcactgtgaacc

SEQ ID NO: 4431840 - DNA, 16 bp, Homo sapiens
aagctgcccagccctg

SEQ ID NO: 4431841 - DNA, 22 bp, Homo sapiens
aagctgctaaatctcctatttt

SEQ ID NO: 4431842 - DNA, 19 bp, Homo sapiens
aagctggaggactagaacc

SEQ ID NO: 4431843 - DNA, 21 bp, Homo sapiens
aagctggccgagggtcctggc

SEQ ID NO: 4431844 - DNA, 13 bp, Homo sapiens
aagctggcctgag

SEQ ID NO: 4431845 - DNA, 19 bp, Homo sapiens
aagctgggccccagcccac

SEQ ID NO: 4431846 - DNA, 17 bp, Homo sapiens
aagctgtataaacagaa

SEQ ID NO: 4431847 - DNA, 22 bp, Homo sapiens
aagctgtataattaattgtcat

SEQ ID NO: 4431848 - DNA, 23 bp, Homo sapiens
aagctgtgtctgcccaatgaata

SEQ ID NO: 4431849 - DNA, 13 bp, Homo sapiens
aagctgttcttga

SEQ ID NO: 4431850 - DNA, 15 bp, Homo sapiens
aagctgttcttgaaa

SEQ ID NO: 4431851 - DNA, 14 bp, Homo sapiens
aagctgtttggaaa

SEQ ID NO: 4431852 - DNA, 13 bp, Homo sapiens
aagcttaaaactt

SEQ ID NO: 4431853 - DNA, 17 bp, Homo sapiens
aagcttaaaactttgaa

SEQ ID NO: 4431854 - DNA, 18 bp, Homo sapiens
aagcttaaataggaaagt

SEQ ID NO: 4431855 - DNA, 14 bp, Homo sapiens
aagcttaatgattc

SEQ ID NO: 4431856 - DNA, 18 bp, Homo sapiens
aagcttatccataaaaaa

SEQ ID NO: 4431857 - DNA, 16 bp, Homo sapiens
aagcttccatgattct

SEQ ID NO: 4431858 - DNA, 20 bp, Homo sapiens
aagcttccatgattctattt

SEQ ID NO: 4431859 - DNA, 15 bp, Homo sapiens
aagcttctataaaat

SEQ ID NO: 4431860 - DNA, 18 bp, Homo sapiens
aagctttaaatgacagta

SEQ ID NO: 4431861 - DNA, 9 bp, Homo sapiens
aagctttag

SEQ ID NO: 4431862 - DNA, 17 bp, Homo sapiens
aagctttatctttgtgt

SEQ ID NO: 4431863 - DNA, 12 bp, Homo sapiens
aagctttatgat

SEQ ID NO: 4431864 - DNA, 21 bp, Homo sapiens
aagctttattaccagtggcgt

SEQ ID NO: 4431865 - DNA, 13 bp, Homo sapiens
aagctttatttct

SEQ ID NO: 4431866 - DNA, 20 bp, Homo sapiens
aagctttatttctagctttt

SEQ ID NO: 4431867 - DNA, 22 bp, Homo sapiens
aagctttcatgtaaactgtgca

SEQ ID NO: 4431868 - DNA, 23 bp, Homo sapiens
aagctttcatgtaaactgtgcac

SEQ ID NO: 4431869 - DNA, 16 bp, Homo sapiens
aagctttcttttctaa

SEQ ID NO: 4431870 - DNA, 22 bp, Homo sapiens
aagctttgatttagattgagta

SEQ ID NO: 4431871 - DNA, 14 bp, Homo sapiens
aagctttggaaaaa

SEQ ID NO: 4431872 - DNA, 15 bp, Homo sapiens
aagctttggaaaaat

SEQ ID NO: 4431873 - DNA, 20 bp, Homo sapiens
aagctttggtttatggtttt

SEQ ID NO: 4431874 - DNA, 17 bp, Homo sapiens
aagcttttatttcttgt

SEQ ID NO: 4431875 - DNA, 17 bp, Homo sapiens
aagcttttcattttaat

SEQ ID NO: 4431876 - DNA, 23 bp, Homo sapiens
aagcttttcattttaatatataa

SEQ ID NO: 4431877 - DNA, 13 bp, Homo sapiens
aagcttttgctca

SEQ ID NO: 4431878 - DNA, 23 bp, Homo sapiens
aagctttttattcctcctgctca

SEQ ID NO: 4431879 - DNA, 16 bp, Homo sapiens
aaggaaaaacacaagc

SEQ ID NO: 4431880 - DNA, 20 bp, Homo sapiens
aaggaaaaacacaagcaaaa

SEQ ID NO: 4431881 - DNA, 18 bp, Homo sapiens
aaggaaaaagaaaataaa

SEQ ID NO: 4431882 - DNA, 14 bp, Homo sapiens
aaggaaaaagctcc

SEQ ID NO: 4431883 - DNA, 12 bp, Homo sapiens
aaggaaaccttt

SEQ ID NO: 4431884 - DNA, 21 bp, Homo sapiens
aaggaaacttctgatgtttat

SEQ ID NO: 4431885 - DNA, 17 bp, Homo sapiens
aaggaaactttttaatt

SEQ ID NO: 4431886 - DNA, 19 bp, Homo sapiens
aaggaaagatttgtgaact

SEQ ID NO: 4431887 - DNA, 18 bp, Homo sapiens
aaggaaaggctcatttaa

SEQ ID NO: 4431888 - DNA, 22 bp, Homo sapiens
aaggaaataaaaaagtctctat

SEQ ID NO: 4431889 - DNA, 13 bp, Homo sapiens
aaggaacaaagac

SEQ ID NO: 4431890 - DNA, 21 bp, Homo sapiens
aaggaaccttccttcctgctt

SEQ ID NO: 4431891 - DNA, 20 bp, Homo sapiens
aaggaaggagactcacctct

SEQ ID NO: 4431892 - DNA, 22 bp, Homo sapiens
aaggaaggagactcacctctgc

SEQ ID NO: 4431893 - DNA, 21 bp, Homo sapiens
aaggaagtcaaagcaaggaaa

SEQ ID NO: 4431894 - DNA, 21 bp, Homo sapiens
aaggaatagtcgcgcaagcat

SEQ ID NO: 4431895 - DNA, 14 bp, Homo sapiens
aaggaatataagaa

SEQ ID NO: 4431896 - DNA, 16 bp, Homo sapiens
aaggaatataagaaaa

SEQ ID NO: 4431897 - DNA, 18 bp, Homo sapiens
aaggaattatagacctct

SEQ ID NO: 4431898 - DNA, 17 bp, Homo sapiens
aaggaatttcttaactt

SEQ ID NO: 4431899 - DNA, 19 bp, Homo sapiens
aaggaatttcttaacttct

SEQ ID NO: 4431900 - DNA, 22 bp, Homo sapiens
aaggaatttgcatccagcagca

SEQ ID NO: 4431901 - DNA, 21 bp, Homo sapiens
aaggacaaatctaaaatgcaa

SEQ ID NO: 4431902 - DNA, 16 bp, Homo sapiens
aaggacacagtgatga

SEQ ID NO: 4431903 - DNA, 20 bp, Homo sapiens
aaggacacagtgatgaatgt

SEQ ID NO: 4431904 - DNA, 13 bp, Homo sapiens
aaggacaccctcc

SEQ ID NO: 4431905 - DNA, 13 bp, Homo sapiens
aaggacaggagcc

SEQ ID NO: 4431906 - DNA, 15 bp, Homo sapiens
aaggacaggagcctg

SEQ ID NO: 4431907 - DNA, 19 bp, Homo sapiens
aaggacaggagcctggtcc

SEQ ID NO: 4431908 - DNA, 17 bp, Homo sapiens
aaggacagtccctgctg

SEQ ID NO: 4431909 - DNA, 12 bp, Homo sapiens
aaggaccaggac

SEQ ID NO: 4431910 - DNA, 19 bp, Homo sapiens
aaggacgcctgcaggagag

SEQ ID NO: 4431911 - DNA, 15 bp, Homo sapiens
aaggactattatgtg

SEQ ID NO: 4431912 - DNA, 22 bp, Homo sapiens
aaggactcctcctttttccatg

SEQ ID NO: 4431913 - DNA, 17 bp, Homo sapiens
aaggactgagggactct

SEQ ID NO: 4431914 - DNA, 21 bp, Homo sapiens
aaggactgcatggtaatttat

SEQ ID NO: 4431915 - DNA, 12 bp, Homo sapiens
aaggagaacaaa

SEQ ID NO: 4431916 - DNA, 15 bp, Homo sapiens
aaggagaacaaatat

SEQ ID NO: 4431917 - DNA, 18 bp, Homo sapiens
aaggagaaggaaaaagaa

SEQ ID NO: 4431918 - DNA, 15 bp, Homo sapiens
aaggagaaggaagga

SEQ ID NO: 4431919 - DNA, 17 bp, Homo sapiens
aaggagactcacctctg

SEQ ID NO: 4431920 - DNA, 20 bp, Homo sapiens
aaggagactcacctctgcct

SEQ ID NO: 4431921 - DNA, 23 bp, Homo sapiens
aaggagactcacctctgcctcaa

SEQ ID NO: 4431922 - DNA, 18 bp, Homo sapiens
aaggagagactcccatga

SEQ ID NO: 4431923 - DNA, 20 bp, Homo sapiens
aaggagagactcccatgaag

SEQ ID NO: 4431924 - DNA, 22 bp, Homo sapiens
aaggagagactcccatgaagcc

SEQ ID NO: 4431925 - DNA, 17 bp, Homo sapiens
aaggagagttcaagcct

SEQ ID NO: 4431926 - DNA, 15 bp, Homo sapiens
aaggagcagggtcct

SEQ ID NO: 4431927 - DNA, 17 bp, Homo sapiens
aaggagccttttgctct

SEQ ID NO: 4431928 - DNA, 13 bp, Homo sapiens
aagggtcaggccc

SEQ ID NO: 4431929 - DNA, 17 bp, Homo sapiens
aagggtcaggcccgtca

SEQ ID NO: 4431930 - DNA, 16 bp, Homo sapiens
aagggtcccttttgca

SEQ ID NO: 4431931 - DNA, 16 bp, Homo sapiens
aagggtctagggagag

SEQ ID NO: 4431932 - DNA, 20 bp, Homo sapiens
aagggtgggagtggggcctt

SEQ ID NO: 4431933 - DNA, 17 bp, Homo sapiens
aagggttgagagccagt

SEQ ID NO: 4431934 - DNA, 21 bp, Homo sapiens
aagggttttccaggtgtagct

SEQ ID NO: 4431935 - DNA, 22 bp, Homo sapiens
aagggttttccaggtgtagcta

SEQ ID NO: 4431936 - DNA, 19 bp, Homo sapiens
aaggtaaataaaaagaaag

SEQ ID NO: 4431937 - DNA, 13 bp, Homo sapiens
aaggtaaatacaa

SEQ ID NO: 4431938 - DNA, 21 bp, Homo sapiens
aaggtaagctcaggatatggc

SEQ ID NO: 4431939 - DNA, 21 bp, Homo sapiens
aaggtaatgtagggttatatt

SEQ ID NO: 4431940 - DNA, 17 bp, Homo sapiens
aaggtacaactgtattt

SEQ ID NO: 4431941 - DNA, 20 bp, Homo sapiens
aaggtacaactgtatttatt

SEQ ID NO: 4431942 - DNA, 14 bp, Homo sapiens
aaggtagaaataga

SEQ ID NO: 4431943 - DNA, 14 bp, Homo sapiens
aaggtagactttta

SEQ ID NO: 4431944 - DNA, 15 bp, Homo sapiens
aaggtattagcaaag

SEQ ID NO: 4431945 - DNA, 17 bp, Homo sapiens
aaggtcactactgcatt

SEQ ID NO: 4431946 - DNA, 22 bp, Homo sapiens
aaggtccatggagtacggctgg

SEQ ID NO: 4431947 - DNA, 15 bp, Homo sapiens
aaggtcctcttgaaa

SEQ ID NO: 4431948 - DNA, 16 bp, Homo sapiens
aaggtcgggacagctg

SEQ ID NO: 4431949 - DNA, 20 bp, Homo sapiens
aaggtcgggacagctgtgcc

SEQ ID NO: 4431950 - DNA, 19 bp, Homo sapiens
aaggtctgagccacagcag

SEQ ID NO: 4431951 - DNA, 19 bp, Homo sapiens
aaggtcttttgagggctaa

SEQ ID NO: 4431952 - DNA, 14 bp, Homo sapiens
aaggtgaaaattgt

SEQ ID NO: 4431953 - DNA, 21 bp, Homo sapiens
aaggtgacatcggaaaaataa

SEQ ID NO: 4431954 - DNA, 21 bp, Homo sapiens
aaggtgagtttgagctgcctt

SEQ ID NO: 4431955 - DNA, 19 bp, Homo sapiens
aaggtgatttcagactgca

SEQ ID NO: 4431956 - DNA, 18 bp, Homo sapiens
aaggtgccatggaagagg

SEQ ID NO: 4431957 - DNA, 17 bp, Homo sapiens
aaggtggagtttctctg

SEQ ID NO: 4431958 - DNA, 16 bp, Homo sapiens
aaggtgtcttcctccc

SEQ ID NO: 4431959 - DNA, 22 bp, Homo sapiens
aaggttactcagcagcagagag

SEQ ID NO: 4431960 - DNA, 18 bp, Homo sapiens
aaggttagaaacattttg

SEQ ID NO: 4431961 - DNA, 23 bp, Homo sapiens
aaggttccgcttggagcagaggg

SEQ ID NO: 4431962 - DNA, 13 bp, Homo sapiens
aaggttgaataat

SEQ ID NO: 4431963 - DNA, 18 bp, Homo sapiens
aaggtttaaaactagtta

SEQ ID NO: 4431964 - DNA, 20 bp, Homo sapiens
aaggtttaaccttaaaatta

SEQ ID NO: 4431965 - DNA, 17 bp, Homo sapiens
aaggtttatttttctgt

SEQ ID NO: 4431966 - DNA, 18 bp, Homo sapiens
aaggtttcccaaaacaat

SEQ ID NO: 4431967 - DNA, 14 bp, Homo sapiens
aagtaaaacagtca

SEQ ID NO: 4431968 - DNA, 15 bp, Homo sapiens
aagtaaaacagtcat

SEQ ID NO: 4431969 - DNA, 16 bp, Homo sapiens
aagtaaaaccacagca

SEQ ID NO: 4431970 - DNA, 21 bp, Homo sapiens
aagtaaaagtctacctgtgtt

SEQ ID NO: 4431971 - DNA, 13 bp, Homo sapiens
aagtaaacagatt

SEQ ID NO: 4431972 - DNA, 17 bp, Homo sapiens
aagtaaagccattaaat

SEQ ID NO: 4431973 - DNA, 15 bp, Homo sapiens
aagtaaatatatatg

SEQ ID NO: 4431974 - DNA, 13 bp, Homo sapiens
aagtaacattttt

SEQ ID NO: 4431975 - DNA, 15 bp, Homo sapiens
aagtaacgtgctcac

SEQ ID NO: 4431976 - DNA, 18 bp, Homo sapiens
aagtaacgtgctcactgt

SEQ ID NO: 4431977 - DNA, 18 bp, Homo sapiens
aagtaagaaagtgaagca

SEQ ID NO: 4431978 - DNA, 21 bp, Homo sapiens
aagtaagaaagtgaagcaaat

SEQ ID NO: 4431979 - DNA, 16 bp, Homo sapiens
aagtaagcatttccag

SEQ ID NO: 4431980 - DNA, 14 bp, Homo sapiens
aagtaataaaaaga

SEQ ID NO: 4431981 - DNA, 15 bp, Homo sapiens
aagtaatatcaaagc

SEQ ID NO: 4431982 - DNA, 15 bp, Homo sapiens
aagtaatcacttaaa

SEQ ID NO: 4431983 - DNA, 16 bp, Homo sapiens
aagtaatcacttaaag

SEQ ID NO: 4431984 - DNA, 13 bp, Homo sapiens
aagtaatgaagaa

SEQ ID NO: 4431985 - DNA, 16 bp, Homo sapiens
aagtaatgaagaatca

SEQ ID NO: 4431986 - DNA, 21 bp, Homo sapiens
aagtaatgaatttttatgata

SEQ ID NO: 4431987 - DNA, 17 bp, Homo sapiens
aagtaatgacttagaaa

SEQ ID NO: 4431988 - DNA, 23 bp, Homo sapiens
aagtaatgccacacattgtgctt

SEQ ID NO: 4431989 - DNA, 21 bp, Homo sapiens
aagtaattaaggtacatcatt

SEQ ID NO: 4431990 - DNA, 19 bp, Homo sapiens
aagtaattatgcactaaat

SEQ ID NO: 4431991 - DNA, 13 bp, Homo sapiens
aagtaatttcagt

SEQ ID NO: 4431992 - DNA, 14 bp, Homo sapiens
aagtaatttcagtg

SEQ ID NO: 4431993 - DNA, 14 bp, Homo sapiens
aagtacaaacatga

SEQ ID NO: 4431994 - DNA, 16 bp, Homo sapiens
aagtacacaataagca

SEQ ID NO: 4431995 - DNA, 19 bp, Homo sapiens
aagtacactctgctgtttg

SEQ ID NO: 4431996 - DNA, 22 bp, Homo sapiens
aagtacagcggctcccctctgc

SEQ ID NO: 4431997 - DNA, 20 bp, Homo sapiens
aagtactgctgtaaataaat

SEQ ID NO: 4431998 - DNA, 21 bp, Homo sapiens
aagtactggtaagattgttat

SEQ ID NO: 4431999 - DNA, 22 bp, Homo sapiens
aagtactgtaagaataatttat

SEQ ID NO: 4432000 - DNA, 23 bp, Homo sapiens
aagtactgtaagaataatttata

SEQ ID NO: 4432001 - DNA, 20 bp, Homo sapiens
aagtactgtttaccattttt

SEQ ID NO: 4432002 - DNA, 16 bp, Homo sapiens
aagtagaaacaaaata

SEQ ID NO: 4432003 - DNA, 13 bp, Homo sapiens
aagtagaaatcat

SEQ ID NO: 4432004 - DNA, 15 bp, Homo sapiens
aagtagaaatcatag

SEQ ID NO: 4432005 - DNA, 15 bp, Homo sapiens
aagtagacaatcaca

SEQ ID NO: 4432006 - DNA, 18 bp, Homo sapiens
aagtagacaatcattgtt

SEQ ID NO: 4432007 - DNA, 19 bp, Homo sapiens
aagtagacaatcattgttt

SEQ ID NO: 4432008 - DNA, 16 bp, Homo sapiens
aagtagcaaatgttta

SEQ ID NO: 4432009 - DNA, 20 bp, Homo sapiens
aagtagcaaatgtttactgt

SEQ ID NO: 4432010 - DNA, 21 bp, Homo sapiens
aagtagcaaatgtttactgta

SEQ ID NO: 4432011 - DNA, 14 bp, Homo sapiens
aagtagcctctcct

SEQ ID NO: 4432012 - DNA, 21 bp, Homo sapiens
aagtagctagtagcaatgtgc

SEQ ID NO: 4432013 - DNA, 16 bp, Homo sapiens
aagtagggaagtttta

SEQ ID NO: 4432014 - DNA, 20 bp, Homo sapiens
aagtagtacttcttctgtaa

SEQ ID NO: 4432015 - DNA, 17 bp, Homo sapiens
aagtagtccttggcata

SEQ ID NO: 4432016 - DNA, 18 bp, Homo sapiens
aagtagttattttatagg

SEQ ID NO: 4432017 - DNA, 13 bp, Homo sapiens
aagtatagagaga

SEQ ID NO: 4432018 - DNA, 14 bp, Homo sapiens
aagtatagagagaa

SEQ ID NO: 4432019 - DNA, 15 bp, Homo sapiens
aagtatatgtgagaa

SEQ ID NO: 4432020 - DNA, 15 bp, Homo sapiens
aagtatcctgcgacc

SEQ ID NO: 4432021 - DNA, 20 bp, Homo sapiens
aagtatgacccacattactt

SEQ ID NO: 4432022 - DNA, 22 bp, Homo sapiens
aagtatgcattattaaattgta

SEQ ID NO: 4432023 - DNA, 16 bp, Homo sapiens
aagtatggtacatcta

SEQ ID NO: 4432024 - DNA, 19 bp, Homo sapiens
aagtattacaaccatatat

SEQ ID NO: 4432025 - DNA, 18 bp, Homo sapiens
aagtattacatgatttaa

SEQ ID NO: 4432026 - DNA, 16 bp, Homo sapiens
aagtattactaaattg

SEQ ID NO: 4432027 - DNA, 15 bp, Homo sapiens
aagtattccacctta

SEQ ID NO: 4432028 - DNA, 17 bp, Homo sapiens
aagtattccaccttaaa

SEQ ID NO: 4432029 - DNA, 20 bp, Homo sapiens
aagtattccaccttaaatta

SEQ ID NO: 4432030 - DNA, 21 bp, Homo sapiens
aagtattccaccttaaattaa

SEQ ID NO: 4432031 - DNA, 13 bp, Homo sapiens
aagtattgtaaat

SEQ ID NO: 4432032 - DNA, 15 bp, Homo sapiens
aagtattgtaaatta

SEQ ID NO: 4432033 - DNA, 16 bp, Homo sapiens
aagtatttaaactttc

SEQ ID NO: 4432034 - DNA, 19 bp, Homo sapiens
aagtatttaaactttcaat

SEQ ID NO: 4432035 - DNA, 21 bp, Homo sapiens
aagtatttcaaattggagctt

SEQ ID NO: 4432036 - DNA, 22 bp, Homo sapiens
aagtatttcaaattggagcttc

SEQ ID NO: 4432037 - DNA, 13 bp, Homo sapiens
aagtatttgggaa

SEQ ID NO: 4432038 - DNA, 16 bp, Homo sapiens
aagtattttaatttta

SEQ ID NO: 4432039 - DNA, 17 bp, Homo sapiens
aagtattttaattttaa

SEQ ID NO: 4432040 - DNA, 15 bp, Homo sapiens
aagtattttgctgga

SEQ ID NO: 4432041 - DNA, 22 bp, Homo sapiens
aagtatttttatttaaattatt

SEQ ID NO: 4432042 - DNA, 20 bp, Homo sapiens
aagtatttttttaatttctg

SEQ ID NO: 4432043 - DNA, 21 bp, Homo sapiens
aagtatttttttaatttctga

SEQ ID NO: 4432044 - DNA, 15 bp, Homo sapiens
gaaggggagagaggg

SEQ ID NO: 4432045 - DNA, 17 bp, Homo sapiens
gaaggggccagaggctc

SEQ ID NO: 4432046 - DNA, 12 bp, Homo sapiens
gaagggggtggt

SEQ ID NO: 4432047 - DNA, 19 bp, Homo sapiens
gaagggggtggtgtctcca

SEQ ID NO: 4432048 - DNA, 16 bp, Homo sapiens
gaagggtttctctatt

SEQ ID NO: 4432049 - DNA, 21 bp, Homo sapiens
gaagggtttgtggctgggggc

SEQ ID NO: 4432050 - DNA, 22 bp, Homo sapiens
gaaggtaaataaaaagaaaggc

SEQ ID NO: 4432051 - DNA, 15 bp, Homo sapiens
gaaggtagaatgttt

SEQ ID NO: 4432052 - DNA, 16 bp, Homo sapiens
gaaggtccttgcctga

SEQ ID NO: 4432053 - DNA, 23 bp, Homo sapiens
gaaggtgataagggaaaagataa

SEQ ID NO: 4432054 - DNA, 19 bp, Homo sapiens
gaaggtgatgttgccatcc

SEQ ID NO: 4432055 - DNA, 20 bp, Homo sapiens
gaaggtggaggttgcggtga

SEQ ID NO: 4432056 - DNA, 14 bp, Homo sapiens
gaaggtggccacag

SEQ ID NO: 4432057 - DNA, 18 bp, Homo sapiens
gaagtaacttatttgact

SEQ ID NO: 4432058 - DNA, 21 bp, Homo sapiens
gaagtaattaaggtacatcat

SEQ ID NO: 4432059 - DNA, 15 bp, Homo sapiens
gaagtacaaacatga

SEQ ID NO: 4432060 - DNA, 16 bp, Homo sapiens
gaagtacaaacatgaa

SEQ ID NO: 4432061 - DNA, 20 bp, Homo sapiens
gaagtagctgtcagatgtca

SEQ ID NO: 4432062 - DNA, 14 bp, Homo sapiens
gaagtagtccttgg

SEQ ID NO: 4432063 - DNA, 16 bp, Homo sapiens
gaagtatccttcagcc

SEQ ID NO: 4432064 - DNA, 15 bp, Homo sapiens
gaagtatttttttaa

SEQ ID NO: 4432065 - DNA, 22 bp, Homo sapiens
gaagtcacccctttctgtccca

SEQ ID NO: 4432066 - DNA, 23 bp, Homo sapiens
gaagtcacccctttctgtcccac

SEQ ID NO: 4432067 - DNA, 16 bp, Homo sapiens
gaagtcagtcaacatt

SEQ ID NO: 4432068 - DNA, 14 bp, Homo sapiens
gaagtccacaggac

SEQ ID NO: 4432069 - DNA, 15 bp, Homo sapiens
gaagtctaggagctg

SEQ ID NO: 4432070 - DNA, 20 bp, Homo sapiens
gaagtctaggagctgggagg

SEQ ID NO: 4432071 - DNA, 22 bp, Homo sapiens
gaagtctaggagctgggaggaa

SEQ ID NO: 4432072 - DNA, 17 bp, Homo sapiens
gaagtcttaattgtgtt

SEQ ID NO: 4432073 - DNA, 17 bp, Homo sapiens
gaagtcttctatttatt

SEQ ID NO: 4432074 - DNA, 18 bp, Homo sapiens
gaagtctttgccttctct

SEQ ID NO: 4432075 - DNA, 14 bp, Homo sapiens
gaagtcttttgttc

SEQ ID NO: 4432076 - DNA, 21 bp, Homo sapiens
gaagtgagcagtcgcctgcct

SEQ ID NO: 4432077 - DNA, 20 bp, Homo sapiens
gaagtgctgtttattaatct

SEQ ID NO: 4432078 - DNA, 18 bp, Homo sapiens
gaagtggactggcccctg

SEQ ID NO: 4432079 - DNA, 16 bp, Homo sapiens
gaagtggctgtccctg

SEQ ID NO: 4432080 - DNA, 16 bp, Homo sapiens
gaagtgggccaggaca

SEQ ID NO: 4432081 - DNA, 21 bp, Homo sapiens
gaagtgggccaggacaggccc

SEQ ID NO: 4432082 - DNA, 16 bp, Homo sapiens
gaagtgggcgtgagtg

SEQ ID NO: 4432083 - DNA, 15 bp, Homo sapiens
gaagtgtatttattt

SEQ ID NO: 4432084 - DNA, 15 bp, Homo sapiens
gaagtgtgactggct

SEQ ID NO: 4432085 - DNA, 13 bp, Homo sapiens
gaagtgtggctgg

SEQ ID NO: 4432086 - DNA, 15 bp, Homo sapiens
gaagtgtggctggtg

SEQ ID NO: 4432087 - DNA, 20 bp, Homo sapiens
gaagtgtggctggtgtcccc

SEQ ID NO: 4432088 - DNA, 19 bp, Homo sapiens
gaagtgtgggtctgtgtgt

SEQ ID NO: 4432089 - DNA, 15 bp, Homo sapiens
gaagttctttgatcc

SEQ ID NO: 4432090 - DNA, 23 bp, Homo sapiens
gaagttgacttatagtacatgat

SEQ ID NO: 4432091 - DNA, 21 bp, Homo sapiens
gaagttgttgctatacatgtt

SEQ ID NO: 4432092 - DNA, 18 bp, Homo sapiens
gaagtttaattgacttat

SEQ ID NO: 4432093 - DNA, 14 bp, Homo sapiens
gaagtttatttcct

SEQ ID NO: 4432094 - DNA, 21 bp, Homo sapiens
gaagtttcaagttttaaagtt

SEQ ID NO: 4432095 - DNA, 20 bp, Homo sapiens
aaaaatcctattctgatgaa

SEQ ID NO: 4432096 - DNA, 22 bp, Homo sapiens
aaaaatcctgcccaaaatgtga

SEQ ID NO: 4432097 - DNA, 19 bp, Homo sapiens
aaaaatctcattatttcaa

SEQ ID NO: 4432098 - DNA, 14 bp, Homo sapiens
aaaaatgatttaat

SEQ ID NO: 4432099 - DNA, 21 bp, Homo sapiens
aaaaatgcacaaacaatgcaa

SEQ ID NO: 4432100 - DNA, 22 bp, Homo sapiens
aaaaatgcccatttttgctaat

SEQ ID NO: 4432101 - DNA, 14 bp, Homo sapiens
aaaaatgctgctct

SEQ ID NO: 4432102 - DNA, 18 bp, Homo sapiens
aaaaatgtataaaaatta

SEQ ID NO: 4432103 - DNA, 16 bp, Homo sapiens
aaaaatgtatatgcac

SEQ ID NO: 4432104 - DNA, 13 bp, Homo sapiens
aaaaatgtgaaat

SEQ ID NO: 4432105 - DNA, 16 bp, Homo sapiens
aaaaatgtttccactg

SEQ ID NO: 4432106 - DNA, 22 bp, Homo sapiens
aaaaatgttttccaatatttta

SEQ ID NO: 4432107 - DNA, 12 bp, Homo sapiens
aaaaattaaaat

SEQ ID NO: 4432108 - DNA, 18 bp, Homo sapiens
aaaaattaacttagtttt

SEQ ID NO: 4432109 - DNA, 17 bp, Homo sapiens
aaaaattgaaataaata

SEQ ID NO: 4432110 - DNA, 20 bp, Homo sapiens
aaaaattgctctgtgtatat

SEQ ID NO: 4432111 - DNA, 17 bp, Homo sapiens
aaaatccttttgaatga

SEQ ID NO: 4432112 - DNA, 18 bp, Homo sapiens
aaaatctaaaatttcata

SEQ ID NO: 4432113 - DNA, 16 bp, Homo sapiens
aaaatctgaagaggct

SEQ ID NO: 4432114 - DNA, 21 bp, Homo sapiens
aaaatcttgtaggtcattgca

SEQ ID NO: 4432115 - DNA, 15 bp, Homo sapiens
aaaatgaaaagccaa

SEQ ID NO: 4432116 - DNA, 13 bp, Homo sapiens
aaaatgaaaatta

SEQ ID NO: 4432117 - DNA, 15 bp, Homo sapiens
aaaatgaaaattgta

SEQ ID NO: 4432118 - DNA, 14 bp, Homo sapiens
aaaatgaaatgcta

SEQ ID NO: 4432119 - DNA, 18 bp, Homo sapiens
aaaatgaaggaattacat

SEQ ID NO: 4432120 - DNA, 21 bp, Homo sapiens
aaaatgaattgaaaaacaatt

SEQ ID NO: 4432121 - DNA, 19 bp, Homo sapiens
aaaatgacaccatctttta

SEQ ID NO: 4432122 - DNA, 14 bp, Homo sapiens
aaaatgagaaagga

SEQ ID NO: 4432123 - DNA, 19 bp, Homo sapiens
aaaatgagagctgtaactg

SEQ ID NO: 4432124 - DNA, 15 bp, Homo sapiens
aaaatgagatttctt

SEQ ID NO: 4432125 - DNA, 23 bp, Homo sapiens
aaaatgagtcatttgtttaaaca

SEQ ID NO: 4432126 - DNA, 22 bp, Homo sapiens
aaaatgagtttgtattattaca

SEQ ID NO: 4432127 - DNA, 17 bp, Homo sapiens
aaaatgcaatatttgta

SEQ ID NO: 4432128 - DNA, 22 bp, Homo sapiens
aaaatgcacccatcagcactct

SEQ ID NO: 4432129 - DNA, 16 bp, Homo sapiens
aaaatgccatgaatta

SEQ ID NO: 4432130 - DNA, 15 bp, Homo sapiens
aaaatgcccatttgt

SEQ ID NO: 4432131 - DNA, 20 bp, Homo sapiens
aaaatgcccatttttgctaa

SEQ ID NO: 4432132 - DNA, 22 bp, Homo sapiens
aaaatgcttaaaaaataataca

SEQ ID NO: 4432133 - DNA, 22 bp, Homo sapiens
aaaatggagctcagtaacataa

SEQ ID NO: 4432134 - DNA, 23 bp, Homo sapiens
aaaatggatgccttgaataataa

SEQ ID NO: 4432135 - DNA, 18 bp, Homo sapiens
aaaatggcgaacatgtgt

SEQ ID NO: 4432136 - DNA, 13 bp, Homo sapiens
aaagagtagaatt

SEQ ID NO: 4432137 - DNA, 13 bp, Homo sapiens
aaagagtgtgtta

SEQ ID NO: 4432138 - DNA, 16 bp, Homo sapiens
aaagagttattcaaat

SEQ ID NO: 4432139 - DNA, 21 bp, Homo sapiens
aaagataatattttacataca

SEQ ID NO: 4432140 - DNA, 23 bp, Homo sapiens
aaagataatctcagtgctttcct

SEQ ID NO: 4432141 - DNA, 21 bp, Homo sapiens
aaagatataaggggaaagata

SEQ ID NO: 4432142 - DNA, 19 bp, Homo sapiens
aaagatatggagaattgct

SEQ ID NO: 4432143 - DNA, 17 bp, Homo sapiens
aaagatccttcatttta

SEQ ID NO: 4432144 - DNA, 12 bp, Homo sapiens
aaagatgacaaa

SEQ ID NO: 4432145 - DNA, 20 bp, Homo sapiens
aaagatgccccattccttgc

SEQ ID NO: 4432146 - DNA, 18 bp, Homo sapiens
aaagatgctagaaaaatg

SEQ ID NO: 4432147 - DNA, 18 bp, Homo sapiens
aaagatggcttatgtcat

SEQ ID NO: 4432148 - DNA, 20 bp, Homo sapiens
aaagatggcttatgtcatca

SEQ ID NO: 4432149 - DNA, 20 bp, Homo sapiens
aaagatgtcttaacctcagg

SEQ ID NO: 4432150 - DNA, 22 bp, Homo sapiens
aaagatgtcttaacctcaggga

SEQ ID NO: 4432151 - DNA, 21 bp, Homo sapiens
aaagattaggtcgttttccaa

SEQ ID NO: 4432152 - DNA, 23 bp, Homo sapiens
aaagattattgtgacttcactgt

SEQ ID NO: 4432153 - DNA, 17 bp, Homo sapiens
aaagatttattgtaagc

SEQ ID NO: 4432154 - DNA, 12 bp, Homo sapiens
aaagatttcata

SEQ ID NO: 4432155 - DNA, 15 bp, Homo sapiens
aaagatttcatatct

SEQ ID NO: 4432156 - DNA, 18 bp, Homo sapiens
aaagatttgtgaactgga

SEQ ID NO: 4432157 - DNA, 22 bp, Homo sapiens
aaagatttgtgaactggaagaa

SEQ ID NO: 4432158 - DNA, 23 bp, Homo sapiens
aaagatttgtggtaactgaaggt

SEQ ID NO: 4432159 - DNA, 14 bp, Homo sapiens
aaagattttgtttt

SEQ ID NO: 4432160 - DNA, 14 bp, Homo sapiens
aaagattttttaat

SEQ ID NO: 4432161 - DNA, 21 bp, Homo sapiens
aaagcaaaaaagaaaaccttt

SEQ ID NO: 4432162 - DNA, 14 bp, Homo sapiens
aaagcaagaatcag

SEQ ID NO: 4432163 - DNA, 20 bp, Homo sapiens
aaagcaaggaaactatgtaa

SEQ ID NO: 4432164 - DNA, 15 bp, Homo sapiens
aaagcaataaatgaa

SEQ ID NO: 4432165 - DNA, 14 bp, Homo sapiens
aaagcaatatgcat

SEQ ID NO: 4432166 - DNA, 14 bp, Homo sapiens
aaagcaatctttta

SEQ ID NO: 4432167 - DNA, 15 bp, Homo sapiens
aaagcaattccaacc

SEQ ID NO: 4432168 - DNA, 23 bp, Homo sapiens
aaagcacaaagttctcagagctc

SEQ ID NO: 4432169 - DNA, 13 bp, Homo sapiens
aaagcacctgccg

SEQ ID NO: 4432170 - DNA, 14 bp, Homo sapiens
aaagcacggactct

SEQ ID NO: 4432171 - DNA, 17 bp, Homo sapiens
aaagcactggtttcaag

SEQ ID NO: 4432172 - DNA, 13 bp, Homo sapiens
aaagcagaaggag

SEQ ID NO: 4432173 - DNA, 11 bp, Homo sapiens
aaactctctag

SEQ ID NO: 4432174 - DNA, 13 bp, Homo sapiens
aaactctctagct

SEQ ID NO: 4432175 - DNA, 15 bp, Homo sapiens
aaactctctcccagg

SEQ ID NO: 4432176 - DNA, 17 bp, Homo sapiens
aaactctgcatccagag

SEQ ID NO: 4432177 - DNA, 20 bp, Homo sapiens
aaactgaatctatggcttta

SEQ ID NO: 4432178 - DNA, 17 bp, Homo sapiens
aaactgaatttgtactt

SEQ ID NO: 4432179 - DNA, 13 bp, Homo sapiens
aaactgagaaatg

SEQ ID NO: 4432180 - DNA, 14 bp, Homo sapiens
aaactgcatttgtg

SEQ ID NO: 4432181 - DNA, 15 bp, Homo sapiens
aaactgccagcaacg

SEQ ID NO: 4432182 - DNA, 19 bp, Homo sapiens
aaactgccagcaacgcagg

SEQ ID NO: 4432183 - DNA, 15 bp, Homo sapiens
aaactgccctggctc

SEQ ID NO: 4432184 - DNA, 18 bp, Homo sapiens
aaactgcgaggacatcaa

SEQ ID NO: 4432185 - DNA, 12 bp, Homo sapiens
aaactgctcaga

SEQ ID NO: 4432186 - DNA, 15 bp, Homo sapiens
aaactgctcagacgt

SEQ ID NO: 4432187 - DNA, 16 bp, Homo sapiens
aaactgctgtcgttgt

SEQ ID NO: 4432188 - DNA, 18 bp, Homo sapiens
aaactgggataactgatt

SEQ ID NO: 4432189 - DNA, 21 bp, Homo sapiens
aaactgggataactgatttct

SEQ ID NO: 4432190 - DNA, 22 bp, Homo sapiens
aaactgggataactgatttcta

SEQ ID NO: 4432191 - DNA, 17 bp, Homo sapiens
aaactggggggaaaaag

SEQ ID NO: 4432192 - DNA, 23 bp, Homo sapiens
aaactggggggaaaaagaccagg

SEQ ID NO: 4432193 - DNA, 16 bp, Homo sapiens
aaactgggtcttcagc

SEQ ID NO: 4432194 - DNA, 16 bp, Homo sapiens
aaactggttcctacat

SEQ ID NO: 4432195 - DNA, 14 bp, Homo sapiens
aaactgtaaaaaat

SEQ ID NO: 4432196 - DNA, 21 bp, Homo sapiens
aaactgtaaaaaatgtgtgta

SEQ ID NO: 4432197 - DNA, 15 bp, Homo sapiens
aaactgtcactgttg

SEQ ID NO: 4432198 - DNA, 12 bp, Homo sapiens
aaactgtgcacc

SEQ ID NO: 4432199 - DNA, 10 bp, Homo sapiens
aaactgtgta

SEQ ID NO: 4432200 - DNA, 20 bp, Homo sapiens
aaactgtgtacataactgaa

SEQ ID NO: 4432201 - DNA, 19 bp, Homo sapiens
aaactgttggaatggattt

SEQ ID NO: 4432202 - DNA, 23 bp, Homo sapiens
aaactgtttcaagccctcctccc

SEQ ID NO: 4432203 - DNA, 20 bp, Homo sapiens
aaactgttttagacctataa

SEQ ID NO: 4432204 - DNA, 16 bp, Homo sapiens
aaacttaaatgttatt

SEQ ID NO: 4432205 - DNA, 12 bp, Homo sapiens
aaacttcagcaa

SEQ ID NO: 4432206 - DNA, 22 bp, Homo sapiens
aaacttcagtttcacagaaaat

SEQ ID NO: 4432207 - DNA, 22 bp, Homo sapiens
atttcttaattattataaaaat

SEQ ID NO: 4432208 - DNA, 16 bp, Homo sapiens
atttcttatgtgacat

SEQ ID NO: 4432209 - DNA, 17 bp, Homo sapiens
atttcttatgtgacatt

SEQ ID NO: 4432210 - DNA, 21 bp, Homo sapiens
atttcttatgtgacattaaca

SEQ ID NO: 4432211 - DNA, 17 bp, Homo sapiens
atttcttcgttcttttt

SEQ ID NO: 4432212 - DNA, 23 bp, Homo sapiens
atttcttcttctaagaagacatt

SEQ ID NO: 4432213 - DNA, 14 bp, Homo sapiens
atttcttgaagaat

SEQ ID NO: 4432214 - DNA, 21 bp, Homo sapiens
atttcttgaagaataaattct

SEQ ID NO: 4432215 - DNA, 16 bp, Homo sapiens
atttcttggcattgga

SEQ ID NO: 4432216 - DNA, 18 bp, Homo sapiens
atttctttaaaagaatga

SEQ ID NO: 4432217 - DNA, 17 bp, Homo sapiens
atttctttaaatgtgta

SEQ ID NO: 4432218 - DNA, 22 bp, Homo sapiens
atttctttaaatgtgtatttct

SEQ ID NO: 4432219 - DNA, 14 bp, Homo sapiens
atttctttctgttt

SEQ ID NO: 4432220 - DNA, 15 bp, Homo sapiens
atttctttgtagaat

SEQ ID NO: 4432221 - DNA, 17 bp, Homo sapiens
atttctttgtagaataa

SEQ ID NO: 4432222 - DNA, 13 bp, Homo sapiens
atttcttttaaaa

SEQ ID NO: 4432223 - DNA, 16 bp, Homo sapiens
atttcttttaaaataa

SEQ ID NO: 4432224 - DNA, 13 bp, Homo sapiens
atttcttttagaa

SEQ ID NO: 4432225 - DNA, 17 bp, Homo sapiens
atttcttttagaaaagg

SEQ ID NO: 4432226 - DNA, 20 bp, Homo sapiens
atttcttttagaaaaggcca

SEQ ID NO: 4432227 - DNA, 19 bp, Homo sapiens
atttcttttattaatactt

SEQ ID NO: 4432228 - DNA, 19 bp, Homo sapiens
atttcttttgttgtacttt

SEQ ID NO: 4432229 - DNA, 14 bp, Homo sapiens
atttgaaaaaaact

SEQ ID NO: 4432230 - DNA, 15 bp, Homo sapiens
atttgaaaagaattt

SEQ ID NO: 4432231 - DNA, 14 bp, Homo sapiens
atttgaaaattgta

SEQ ID NO: 4432232 - DNA, 15 bp, Homo sapiens
atttgaaataagaat

SEQ ID NO: 4432233 - DNA, 21 bp, Homo sapiens
atttgaaatagtatacattgt

SEQ ID NO: 4432234 - DNA, 18 bp, Homo sapiens
atttgaaggtagaatgtt

SEQ ID NO: 4432235 - DNA, 17 bp, Homo sapiens
atttgaagtaacttatt

SEQ ID NO: 4432236 - DNA, 24 bp, Homo sapiens
atttgaagtaacttatttgactat

SEQ ID NO: 4432237 - DNA, 13 bp, Homo sapiens
atttgaataaatt

SEQ ID NO: 4432238 - DNA, 15 bp, Homo sapiens
atttgaataagcaga

SEQ ID NO: 4432239 - DNA, 19 bp, Homo sapiens
atttgaataatcagatgct

SEQ ID NO: 4432240 - DNA, 13 bp, Homo sapiens
atttgacccccac

SEQ ID NO: 4432241 - DNA, 15 bp, Homo sapiens
atttgactaatttta

SEQ ID NO: 4432242 - DNA, 18 bp, Homo sapiens
atttgagagaaatatgaa

SEQ ID NO: 4432243 - DNA, 15 bp, Homo sapiens
atttgagagaagcca

SEQ ID NO: 4432244 - DNA, 20 bp, Homo sapiens
atttgaggagtgttaagatt

SEQ ID NO: 4432245 - DNA, 22 bp, Homo sapiens
atttgatctttgtttaaatgcc

SEQ ID NO: 4432246 - DNA, 22 bp, Homo sapiens
atttgatgagttaactgtgaaa

SEQ ID NO: 4432247 - DNA, 17 bp, Homo sapiens
atttgatgatagcagac

SEQ ID NO: 4432248 - DNA, 22 bp, Homo sapiens
atttgatgcccaatatattctg

SEQ ID NO: 4432249 - DNA, 17 bp, Homo sapiens
atttgatggactaatta

SEQ ID NO: 4432250 - DNA, 22 bp, Homo sapiens
atttgatggactaattattatt

SEQ ID NO: 4432251 - DNA, 17 bp, Homo sapiens
atttgatgtacattaca

SEQ ID NO: 4432252 - DNA, 18 bp, Homo sapiens
atttgattaataaaatat

SEQ ID NO: 4432253 - DNA, 19 bp, Homo sapiens
atttgattaataaaatatc

SEQ ID NO: 4432254 - DNA, 21 bp, Homo sapiens
atttgattaataaaatatcta

SEQ ID NO: 4432255 - DNA, 22 bp, Homo sapiens
atttgattaataaaatatctat

SEQ ID NO: 4432256 - DNA, 14 bp, Homo sapiens
atttgattatgtat

SEQ ID NO: 4432257 - DNA, 20 bp, Homo sapiens
atttgattcaaaatatttaa

SEQ ID NO: 4432258 - DNA, 13 bp, Homo sapiens
atttgcaaagtac

SEQ ID NO: 4432259 - DNA, 19 bp, Homo sapiens
atttgcaaagtactgtaag

SEQ ID NO: 4432260 - DNA, 20 bp, Homo sapiens
atttgcaaatatactttact

SEQ ID NO: 4432261 - DNA, 15 bp, Homo sapiens
atttgcaattagaaa

SEQ ID NO: 4432262 - DNA, 17 bp, Homo sapiens
atttgcaggatctgtct

SEQ ID NO: 4432263 - DNA, 18 bp, Homo sapiens
atttgcaggatctgtctg

SEQ ID NO: 4432264 - DNA, 21 bp, Homo sapiens
atttgcataacaattcctcta

SEQ ID NO: 4432265 - DNA, 19 bp, Homo sapiens
atttgcatatttattgcat

SEQ ID NO: 4432266 - DNA, 16 bp, Homo sapiens
atttgcattgaacaca

SEQ ID NO: 4432267 - DNA, 19 bp, Homo sapiens
atttgcccatttacacttt

SEQ ID NO: 4432268 - DNA, 21 bp, Homo sapiens
atttgcccatttacacttttg

SEQ ID NO: 4432269 - DNA, 16 bp, Homo sapiens
atttgcctccagtgca

SEQ ID NO: 4432270 - DNA, 14 bp, Homo sapiens
atttgcctgcttct

SEQ ID NO: 4432271 - DNA, 20 bp, Homo sapiens
atttgcctgcttctttccag

SEQ ID NO: 4432272 - DNA, 16 bp, Homo sapiens
atttgctaaggcagct

SEQ ID NO: 4432273 - DNA, 16 bp, Homo sapiens
atttgctactgtacat

SEQ ID NO: 4432274 - DNA, 11 bp, Homo sapiens
atttgctcact

SEQ ID NO: 4432275 - DNA, 14 bp, Homo sapiens
atttgctgaactca

SEQ ID NO: 4432276 - DNA, 16 bp, Homo sapiens
atttgctgaactcagc

SEQ ID NO: 4432277 - DNA, 15 bp, Homo sapiens
atttgctgccaaatg

SEQ ID NO: 4432278 - DNA, 22 bp, Homo sapiens
atttggaaataaagtcagatgg

SEQ ID NO: 4432279 - DNA, 20 bp, Homo sapiens
atttggagcacaaaattcaa

SEQ ID NO: 4432280 - DNA, 23 bp, Homo sapiens
atttggaggctggagtaatcaga

SEQ ID NO: 4432281 - DNA, 18 bp, Homo sapiens
atttggatgattgtcata

SEQ ID NO: 4432282 - DNA, 23 bp, Homo sapiens
atttggatttaaaagcctgctca

SEQ ID NO: 4432283 - DNA, 19 bp, Homo sapiens
atttggcaatgccatcatc

SEQ ID NO: 4432284 - DNA, 18 bp, Homo sapiens
atttggccttaagaactg

SEQ ID NO: 4432285 - DNA, 20 bp, Homo sapiens
atttgggctgaatgtatgta

SEQ ID NO: 4432286 - DNA, 13 bp, Homo sapiens
atttggtacacat

SEQ ID NO: 4432287 - DNA, 17 bp, Homo sapiens
atttggtacacatgtgt

SEQ ID NO: 4432288 - DNA, 21 bp, Homo sapiens
atttggttcattaattctata

SEQ ID NO: 4432289 - DNA, 14 bp, Homo sapiens
atttgtaaaaatga

SEQ ID NO: 4432290 - DNA, 18 bp, Homo sapiens
atttgtaaatttatgtga

SEQ ID NO: 4432291 - DNA, 19 bp, Homo sapiens
atttgtaaatttatgtgat

SEQ ID NO: 4432292 - DNA, 22 bp, Homo sapiens
atttgtaagcaacttgcttcta

SEQ ID NO: 4432293 - DNA, 16 bp, Homo sapiens
atttgtaataaaacta

SEQ ID NO: 4432294 - DNA, 22 bp, Homo sapiens
atttgtaataaaactatttgta

SEQ ID NO: 4432295 - DNA, 23 bp, Homo sapiens
atttgtaataaaactatttgtat

SEQ ID NO: 4432296 - DNA, 17 bp, Homo sapiens
atttgtaatagatgttt

SEQ ID NO: 4432297 - DNA, 15 bp, Homo sapiens
atttgtaatatggaa

SEQ ID NO: 4432298 - DNA, 22 bp, Homo sapiens
atttgtaatatggaaatctttt

SEQ ID NO: 4432299 - DNA, 14 bp, Homo sapiens
atttgtacatcttc

SEQ ID NO: 4432300 - DNA, 21 bp, Homo sapiens
atttgtacatcttctttggaa

SEQ ID NO: 4432301 - DNA, 13 bp, Homo sapiens
atttgtagttgtt

SEQ ID NO: 4432302 - DNA, 14 bp, Homo sapiens
atttgtatgatatt

SEQ ID NO: 4432303 - DNA, 23 bp, Homo sapiens
atttgtattaccattacttgtat

SEQ ID NO: 4432304 - DNA, 17 bp, Homo sapiens
atttgtcaatgacagtt

SEQ ID NO: 4432305 - DNA, 23 bp, Homo sapiens
atttgtcttaaaaaatgtgaaat

SEQ ID NO: 4432306 - DNA, 23 bp, Homo sapiens
atttgtctttgtaatattttcca

SEQ ID NO: 4432307 - DNA, 14 bp, Homo sapiens
atttgtctttttgt

SEQ ID NO: 4432308 - DNA, 15 bp, Homo sapiens
atttgtgaactggaa

SEQ ID NO: 4432309 - DNA, 15 bp, Homo sapiens
atttgtgcaaacatg

SEQ ID NO: 4432310 - DNA, 21 bp, Homo sapiens
atttgtgctatagtatttgat

SEQ ID NO: 4432311 - DNA, 14 bp, Homo sapiens
atttgtgcttttta

SEQ ID NO: 4432312 - DNA, 22 bp, Homo sapiens
atttgtggggagggatttgggg

SEQ ID NO: 4432313 - DNA, 18 bp, Homo sapiens
atttgtggtaatctacac

SEQ ID NO: 4432314 - DNA, 22 bp, Homo sapiens
atttgtgtaataaagtgttttc

SEQ ID NO: 4432315 - DNA, 17 bp, Homo sapiens
atttgtgtctctttatt

SEQ ID NO: 4432316 - DNA, 15 bp, Homo sapiens
atttgtgttgaagga

SEQ ID NO: 4432317 - DNA, 12 bp, Homo sapiens
atttgtgttttg

SEQ ID NO: 4432318 - DNA, 13 bp, Homo sapiens
atttgtgtttttc

SEQ ID NO: 4432319 - DNA, 19 bp, Homo sapiens
atttgtgtttttctttttc

SEQ ID NO: 4432320 - DNA, 17 bp, Homo sapiens
atttgttatatataata

SEQ ID NO: 4432321 - DNA, 18 bp, Homo sapiens
atttgttatatataataa

SEQ ID NO: 4432322 - DNA, 21 bp, Homo sapiens
atttgttatatataataaata

SEQ ID NO: 4432323 - DNA, 13 bp, Homo sapiens
atttgttcttgta

SEQ ID NO: 4432324 - DNA, 11 bp, Homo sapiens
atttgttgcat

SEQ ID NO: 4432325 - DNA, 20 bp, Homo sapiens
atttgtttatggtaaaaaat

SEQ ID NO: 4432326 - DNA, 17 bp, Homo sapiens
atttgtttcatctattt

SEQ ID NO: 4432327 - DNA, 21 bp, Homo sapiens
atttaatggcagctagtgcct

SEQ ID NO: 4432328 - DNA, 15 bp, Homo sapiens
atttaatgtaaataa

SEQ ID NO: 4432329 - DNA, 21 bp, Homo sapiens
atttaatgttttaaatgtaca

SEQ ID NO: 4432330 - DNA, 13 bp, Homo sapiens
atttaattataaa

SEQ ID NO: 4432331 - DNA, 14 bp, Homo sapiens
atttaattataaaa

SEQ ID NO: 4432332 - DNA, 18 bp, Homo sapiens
atttaattcctcttttta

SEQ ID NO: 4432333 - DNA, 14 bp, Homo sapiens
atttaattctttca

SEQ ID NO: 4432334 - DNA, 15 bp, Homo sapiens
atttaattgctttga

SEQ ID NO: 4432335 - DNA, 16 bp, Homo sapiens
atttaattgtaaactg

SEQ ID NO: 4432336 - DNA, 17 bp, Homo sapiens
atttaattgtaaactgt

SEQ ID NO: 4432337 - DNA, 20 bp, Homo sapiens
atttaatttcatgtatatct

SEQ ID NO: 4432338 - DNA, 13 bp, Homo sapiens
atttaatttgaag

SEQ ID NO: 4432339 - DNA, 16 bp, Homo sapiens
atttacaaaagattta

SEQ ID NO: 4432340 - DNA, 15 bp, Homo sapiens
atttacaatgtatta

SEQ ID NO: 4432341 - DNA, 13 bp, Homo sapiens
atttacacagtga

SEQ ID NO: 4432342 - DNA, 15 bp, Homo sapiens
atttacacagtgaga

SEQ ID NO: 4432343 - DNA, 16 bp, Homo sapiens
atttacacatcttaaa

SEQ ID NO: 4432344 - DNA, 20 bp, Homo sapiens
atttacacatcttaaaagtg

SEQ ID NO: 4432345 - DNA, 22 bp, Homo sapiens
atttacactcctctatcatgca

SEQ ID NO: 4432346 - DNA, 11 bp, Homo sapiens
atttacagaag

SEQ ID NO: 4432347 - DNA, 18 bp, Homo sapiens
atttacatagtcatttag

SEQ ID NO: 4432348 - DNA, 16 bp, Homo sapiens
atttaccatcatctct

SEQ ID NO: 4432349 - DNA, 23 bp, Homo sapiens
atttacccttttcccccttccca

SEQ ID NO: 4432350 - DNA, 17 bp, Homo sapiens
atttacctaagattaca

SEQ ID NO: 4432351 - DNA, 19 bp, Homo sapiens
atttacgctttgattcata

SEQ ID NO: 4432352 - DNA, 14 bp, Homo sapiens
atttactacagttt

SEQ ID NO: 4432353 - DNA, 15 bp, Homo sapiens
atttacttaagtgtt

SEQ ID NO: 4432354 - DNA, 17 bp, Homo sapiens
atttacttaagtgttca

SEQ ID NO: 4432355 - DNA, 18 bp, Homo sapiens
atttacttaagtgttcat

SEQ ID NO: 4432356 - DNA, 18 bp, Homo sapiens
atttactttcttcaccaa

SEQ ID NO: 4432357 - DNA, 13 bp, Homo sapiens
atttagaaaactt

SEQ ID NO: 4432358 - DNA, 13 bp, Homo sapiens
atttagaaatgtt

SEQ ID NO: 4432359 - DNA, 15 bp, Homo sapiens
atttagaagaaagat

SEQ ID NO: 4432360 - DNA, 12 bp, Homo sapiens
atttagaagata

SEQ ID NO: 4432361 - DNA, 12 bp, Homo sapiens
atttagaagcca

SEQ ID NO: 4432362 - DNA, 13 bp, Homo sapiens
atttagaagccaa

SEQ ID NO: 4432363 - DNA, 22 bp, Homo sapiens
atttagaagccaactatgatta

SEQ ID NO: 4432364 - DNA, 14 bp, Homo sapiens
atttagacaagaga

SEQ ID NO: 4432365 - DNA, 17 bp, Homo sapiens
atttagagataggaaac

SEQ ID NO: 4432366 - DNA, 19 bp, Homo sapiens
atttagagataggaaactg

SEQ ID NO: 4432367 - DNA, 22 bp, Homo sapiens
atttagagcgtttggttaaagt

SEQ ID NO: 4432368 - DNA, 12 bp, Homo sapiens
atttagatctta

SEQ ID NO: 4432369 - DNA, 16 bp, Homo sapiens
atttagatcttatatt

SEQ ID NO: 4432370 - DNA, 17 bp, Homo sapiens
atttagatgataaagag

SEQ ID NO: 4432371 - DNA, 14 bp, Homo sapiens
atttagcagtattg

SEQ ID NO: 4432372 - DNA, 13 bp, Homo sapiens
atttagccctcac

SEQ ID NO: 4432373 - DNA, 16 bp, Homo sapiens
atttagccctcacatt

SEQ ID NO: 4432374 - DNA, 20 bp, Homo sapiens
atttagtgaaagctagagat

SEQ ID NO: 4432375 - DNA, 18 bp, Homo sapiens
atttagtgatactggctc

SEQ ID NO: 4432376 - DNA, 10 bp, Homo sapiens
atttagtgtg

SEQ ID NO: 4432377 - DNA, 13 bp, Homo sapiens
atttagtgtgaat

SEQ ID NO: 4432378 - DNA, 14 bp, Homo sapiens
atttagtgtgaata

SEQ ID NO: 4432379 - DNA, 16 bp, Homo sapiens
atttagttgagttatt

SEQ ID NO: 4432380 - DNA, 21 bp, Homo sapiens
atttagttgattttaattact

SEQ ID NO: 4432381 - DNA, 15 bp, Homo sapiens
atttagtttgttaaa

SEQ ID NO: 4432382 - DNA, 20 bp, Homo sapiens
atttagtttgttaaagcctg

SEQ ID NO: 4432383 - DNA, 17 bp, Homo sapiens
atttagtttttaacaat

SEQ ID NO: 4432384 - DNA, 18 bp, Homo sapiens
atttataaaaatataaat

SEQ ID NO: 4432385 - DNA, 19 bp, Homo sapiens
atttataaaaatataaatt

SEQ ID NO: 4432386 - DNA, 22 bp, Homo sapiens
atttataaaaatataaattgta

SEQ ID NO: 4432387 - DNA, 17 bp, Homo sapiens
atttataatacagaatc

SEQ ID NO: 4432388 - DNA, 12 bp, Homo sapiens
atttataatgta

SEQ ID NO: 4432389 - DNA, 21 bp, Homo sapiens
atttataccagttttctttat

SEQ ID NO: 4432390 - DNA, 18 bp, Homo sapiens
atttatacttaaaaaatc

SEQ ID NO: 4432391 - DNA, 20 bp, Homo sapiens
atttatactttaaagtattt

SEQ ID NO: 4432392 - DNA, 22 bp, Homo sapiens
atttatactttgcaatccaaat

SEQ ID NO: 4432393 - DNA, 18 bp, Homo sapiens
atttataggcgttttttg

SEQ ID NO: 4432394 - DNA, 21 bp, Homo sapiens
atttatagtaatgagtttaaa

SEQ ID NO: 4432395 - DNA, 17 bp, Homo sapiens
atttatagtttatacag

SEQ ID NO: 4432396 - DNA, 20 bp, Homo sapiens
atttatataaaacttaaaaa

SEQ ID NO: 4432397 - DNA, 21 bp, Homo sapiens
atttatatactttttcatgaa

SEQ ID NO: 4432398 - DNA, 17 bp, Homo sapiens
atttatatcttgttatt

SEQ ID NO: 4432399 - DNA, 23 bp, Homo sapiens
atttatatcttgttattaatgtt

SEQ ID NO: 4432400 - DNA, 15 bp, Homo sapiens
atttatatgtacatg

SEQ ID NO: 4432401 - DNA, 16 bp, Homo sapiens
atttatcctctgttga

SEQ ID NO: 4432402 - DNA, 11 bp, Homo sapiens
atttatctata

SEQ ID NO: 4432403 - DNA, 15 bp, Homo sapiens
atttatctataattt

SEQ ID NO: 4432404 - DNA, 12 bp, Homo sapiens
atttatctttac

SEQ ID NO: 4432405 - DNA, 23 bp, Homo sapiens
atttatgaataaagaatgccatt

SEQ ID NO: 4432406 - DNA, 23 bp, Homo sapiens
atttatgaattgaattatcttgg

SEQ ID NO: 4432407 - DNA, 18 bp, Homo sapiens
atttatgacctgaaataa

SEQ ID NO: 4432408 - DNA, 17 bp, Homo sapiens
attctccttttatgtgt

SEQ ID NO: 4432409 - DNA, 18 bp, Homo sapiens
attctccttttatgtgta

SEQ ID NO: 4432410 - DNA, 19 bp, Homo sapiens
attctccttttatgtgtag

SEQ ID NO: 4432411 - DNA, 17 bp, Homo sapiens
attctctatttgaatta

SEQ ID NO: 4432412 - DNA, 14 bp, Homo sapiens
attctctattttac

SEQ ID NO: 4432413 - DNA, 20 bp, Homo sapiens
attctctcacttaattttcc

SEQ ID NO: 4432414 - DNA, 10 bp, Homo sapiens
attctctctc

SEQ ID NO: 4432415 - DNA, 12 bp, Homo sapiens
attctctctcct

SEQ ID NO: 4432416 - DNA, 17 bp, Homo sapiens
attctctgcaattttac

SEQ ID NO: 4432417 - DNA, 21 bp, Homo sapiens
attctgaaatacttttgagta

SEQ ID NO: 4432418 - DNA, 22 bp, Homo sapiens
attctgaaatacttttgagtat

SEQ ID NO: 4432419 - DNA, 23 bp, Homo sapiens
attctgaattaattaatttggag

SEQ ID NO: 4432420 - DNA, 17 bp, Homo sapiens
attctgaattgtccttt

SEQ ID NO: 4432421 - DNA, 16 bp, Homo sapiens
attctgaatttgcaaa

SEQ ID NO: 4432422 - DNA, 16 bp, Homo sapiens
attctgacatgtaaga

SEQ ID NO: 4432423 - DNA, 20 bp, Homo sapiens
attctgaccgttaaaaaatt

SEQ ID NO: 4432424 - DNA, 12 bp, Homo sapiens
attctgactgtc

SEQ ID NO: 4432425 - DNA, 15 bp, Homo sapiens
attctgactgtccag

SEQ ID NO: 4432426 - DNA, 14 bp, Homo sapiens
attctgagaccaaa

SEQ ID NO: 4432427 - DNA, 16 bp, Homo sapiens
attctgagcaaaggcc

SEQ ID NO: 4432428 - DNA, 21 bp, Homo sapiens
attctgagcaaaggccctggg

SEQ ID NO: 4432429 - DNA, 18 bp, Homo sapiens
attctgaggccctgccca

SEQ ID NO: 4432430 - DNA, 14 bp, Homo sapiens
attgtctgtctaca

SEQ ID NO: 4432431 - DNA, 19 bp, Homo sapiens
attgtctgtctacatttct

SEQ ID NO: 4432432 - DNA, 13 bp, Homo sapiens
attgtctgtctct

SEQ ID NO: 4432433 - DNA, 14 bp, Homo sapiens
attgtgaaatagtc

SEQ ID NO: 4432434 - DNA, 17 bp, Homo sapiens
attgtgaaccaatgcaa

SEQ ID NO: 4432435 - DNA, 13 bp, Homo sapiens
attgtgaatattt

SEQ ID NO: 4432436 - DNA, 14 bp, Homo sapiens
attgtgacttcact

SEQ ID NO: 4432437 - DNA, 15 bp, Homo sapiens
attgtgacttcactg

SEQ ID NO: 4432438 - DNA, 16 bp, Homo sapiens
attgtgacttcactgt

SEQ ID NO: 4432439 - DNA, 17 bp, Homo sapiens
attgtgacttcactgta

SEQ ID NO: 4432440 - DNA, 18 bp, Homo sapiens
attgtgacttcactgtat

SEQ ID NO: 4432441 - DNA, 14 bp, Homo sapiens
attgtgagctctgg

SEQ ID NO: 4432442 - DNA, 17 bp, Homo sapiens
attgtgaggcttctaat

SEQ ID NO: 4432443 - DNA, 15 bp, Homo sapiens
attgtgatgtgtcct

SEQ ID NO: 4432444 - DNA, 18 bp, Homo sapiens
attgtgattctgcctttg

SEQ ID NO: 4432445 - DNA, 15 bp, Homo sapiens
attgtgcaatgtaaa

SEQ ID NO: 4432446 - DNA, 17 bp, Homo sapiens
attgtgcaatgtaaata

SEQ ID NO: 4432447 - DNA, 20 bp, Homo sapiens
attgtgcaatgtaaatattt

SEQ ID NO: 4432448 - DNA, 17 bp, Homo sapiens
attgtgcataatgcttt

SEQ ID NO: 4432449 - DNA, 12 bp, Homo sapiens
attgtgcttctc

SEQ ID NO: 4432450 - DNA, 17 bp, Homo sapiens
attgtgcttctccccag

SEQ ID NO: 4432451 - DNA, 18 bp, Homo sapiens
attgtgcttctccccaga

SEQ ID NO: 4432452 - DNA, 19 bp, Homo sapiens
attgtgcttctccccagaa

SEQ ID NO: 4432453 - DNA, 18 bp, Homo sapiens
attgtgctttggttaata

SEQ ID NO: 4432454 - DNA, 17 bp, Homo sapiens
attgtggaatgttggat

SEQ ID NO: 4432455 - DNA, 22 bp, Homo sapiens
attgtggcatcagataatgcca

SEQ ID NO: 4432456 - DNA, 22 bp, Homo sapiens
attgtggtggtgctaaaggagg

SEQ ID NO: 4432457 - DNA, 20 bp, Homo sapiens
attgtgtaccttaagatatt

SEQ ID NO: 4432458 - DNA, 15 bp, Homo sapiens
attgtgtatatatct

SEQ ID NO: 4432459 - DNA, 21 bp, Homo sapiens
attgtgtatctgtgcttctaa

SEQ ID NO: 4432460 - DNA, 14 bp, Homo sapiens
attgtgtgtggaat

SEQ ID NO: 4432461 - DNA, 20 bp, Homo sapiens
attgtgttcccatttcagct

SEQ ID NO: 4432462 - DNA, 22 bp, Homo sapiens
attgtgttgactttataaattt

SEQ ID NO: 4432463 - DNA, 12 bp, Homo sapiens
attgtgtttcta

SEQ ID NO: 4432464 - DNA, 16 bp, Homo sapiens
attgttaatttcagtc

SEQ ID NO: 4432465 - DNA, 18 bp, Homo sapiens
attgttaatttcagtcct

SEQ ID NO: 4432466 - DNA, 21 bp, Homo sapiens
attgttacattatgtggaaaa

SEQ ID NO: 4432467 - DNA, 19 bp, Homo sapiens
attgttacgtagcctaagg

SEQ ID NO: 4432468 - DNA, 20 bp, Homo sapiens
attgttagaaaatgacttat

SEQ ID NO: 4432469 - DNA, 19 bp, Homo sapiens
attgttaggaaatgtcatc

SEQ ID NO: 4432470 - DNA, 18 bp, Homo sapiens
attgttataaataaaatt

SEQ ID NO: 4432471 - DNA, 13 bp, Homo sapiens
attgttattaaat

SEQ ID NO: 4432472 - DNA, 15 bp, Homo sapiens
attgtttaaaatcat

SEQ ID NO: 4432473 - DNA, 19 bp, Homo sapiens
attgtttaaaatcatttct

SEQ ID NO: 4432474 - DNA, 16 bp, Homo sapiens
attgtttagtggaaaa

SEQ ID NO: 4432475 - DNA, 23 bp, Homo sapiens
attgtttatgtgttatgaacatc

SEQ ID NO: 4432476 - DNA, 22 bp, Homo sapiens
attgtttcaattgcatctccca

SEQ ID NO: 4432477 - DNA, 15 bp, Homo sapiens
attgtttgatgtttt

SEQ ID NO: 4432478 - DNA, 13 bp, Homo sapiens
attgtttgctgtt

SEQ ID NO: 4432479 - DNA, 16 bp, Homo sapiens
attgtttggacctgca

SEQ ID NO: 4432480 - DNA, 17 bp, Homo sapiens
attgtttggacctgcat

SEQ ID NO: 4432481 - DNA, 14 bp, Homo sapiens
attgttttacaata

SEQ ID NO: 4432482 - DNA, 17 bp, Homo sapiens
attgttttacaatagtt

SEQ ID NO: 4432483 - DNA, 22 bp, Homo sapiens
attgttttggtctcaaaatggt

SEQ ID NO: 4432484 - DNA, 14 bp, Homo sapiens
attgtttttatata

SEQ ID NO: 4432485 - DNA, 15 bp, Homo sapiens
attgtttttatatat

SEQ ID NO: 4432486 - DNA, 23 bp, Homo sapiens
attgtttttatatattataagtt

SEQ ID NO: 4432487 - DNA, 22 bp, Homo sapiens
atttaaaaaactaaaaactaga

SEQ ID NO: 4432488 - DNA, 15 bp, Homo sapiens
atttaaaaaactgta

SEQ ID NO: 4432489 - DNA, 13 bp, Homo sapiens
atttaaaaacatt

SEQ ID NO: 4432490 - DNA, 18 bp, Homo sapiens
atttaaaaataagtcaac

SEQ ID NO: 4432491 - DNA, 19 bp, Homo sapiens
atttaaaaataagtcaaca

SEQ ID NO: 4432492 - DNA, 22 bp, Homo sapiens
atttaaaaataagtcaacagta

SEQ ID NO: 4432493 - DNA, 23 bp, Homo sapiens
atttaaaaataagtcaacagtaa

SEQ ID NO: 4432494 - DNA, 13 bp, Homo sapiens
atttaaaaatgtc

SEQ ID NO: 4432495 - DNA, 18 bp, Homo sapiens
atttaaaaatgtcttgct

SEQ ID NO: 4432496 - DNA, 16 bp, Homo sapiens
atttaaaacagacact

SEQ ID NO: 4432497 - DNA, 14 bp, Homo sapiens
atttaaaactctgg

SEQ ID NO: 4432498 - DNA, 13 bp, Homo sapiens
atttaaaactgtt

SEQ ID NO: 4432499 - DNA, 14 bp, Homo sapiens
atttaaaagcctgc

SEQ ID NO: 4432500 - DNA, 13 bp, Homo sapiens
atttaaaatagca

SEQ ID NO: 4432501 - DNA, 21 bp, Homo sapiens
atttaaaatagcaaaagaaga

SEQ ID NO: 4432502 - DNA, 15 bp, Homo sapiens
atttaaaattaaatt

SEQ ID NO: 4432503 - DNA, 18 bp, Homo sapiens
atttaaaccgctaaaaga

SEQ ID NO: 4432504 - DNA, 23 bp, Homo sapiens
atttaaaccgctaaaagaaactt

SEQ ID NO: 4432505 - DNA, 18 bp, Homo sapiens
atttaaactccagcattt

SEQ ID NO: 4432506 - DNA, 14 bp, Homo sapiens
atttaaactttcaa

SEQ ID NO: 4432507 - DNA, 12 bp, Homo sapiens
atttaaactttt

SEQ ID NO: 4432508 - DNA, 16 bp, Homo sapiens
atttaaactttttaaa

SEQ ID NO: 4432509 - DNA, 18 bp, Homo sapiens
atttaaagacaaagacat

SEQ ID NO: 4432510 - DNA, 19 bp, Homo sapiens
atttaaagactacaataaa

SEQ ID NO: 4432511 - DNA, 16 bp, Homo sapiens
atttaaagttgtatct

SEQ ID NO: 4432512 - DNA, 17 bp, Homo sapiens
atttaaagttgtatctt

SEQ ID NO: 4432513 - DNA, 19 bp, Homo sapiens
atttaaatagataaccaat

SEQ ID NO: 4432514 - DNA, 16 bp, Homo sapiens
atttaaatatctgtta

SEQ ID NO: 4432515 - DNA, 16 bp, Homo sapiens
attgcaaatcttgaaa

SEQ ID NO: 4432516 - DNA, 17 bp, Homo sapiens
attgcaaatcttgaaat

SEQ ID NO: 4432517 - DNA, 19 bp, Homo sapiens
attgcaaatcttgaaatta

SEQ ID NO: 4432518 - DNA, 13 bp, Homo sapiens
attgcaattaaac

SEQ ID NO: 4432519 - DNA, 18 bp, Homo sapiens
attgcaccagaaatgttt

SEQ ID NO: 4432520 - DNA, 15 bp, Homo sapiens
attgcaccattttca

SEQ ID NO: 4432521 - DNA, 16 bp, Homo sapiens
attgcactgttctgat

SEQ ID NO: 4432522 - DNA, 20 bp, Homo sapiens
attgcactttttaagtttga

SEQ ID NO: 4432523 - DNA, 18 bp, Homo sapiens
attgcagcagataacttt

SEQ ID NO: 4432524 - DNA, 19 bp, Homo sapiens
attgcagcttttggttaat

SEQ ID NO: 4432525 - DNA, 23 bp, Homo sapiens
attgcaggagtccctgccatcat

SEQ ID NO: 4432526 - DNA, 19 bp, Homo sapiens
attgcagtcatagaagaga

SEQ ID NO: 4432527 - DNA, 14 bp, Homo sapiens
attgcagtttatca

SEQ ID NO: 4432528 - DNA, 20 bp, Homo sapiens
attgcatgaaaatagctatt

SEQ ID NO: 4432529 - DNA, 21 bp, Homo sapiens
attgcatgaaaatagctattt

SEQ ID NO: 4432530 - DNA, 15 bp, Homo sapiens
attgccaaaaaggat

SEQ ID NO: 4432531 - DNA, 16 bp, Homo sapiens
attgccaaaaaggata

SEQ ID NO: 4432532 - DNA, 15 bp, Homo sapiens
attgccaccaggaga

SEQ ID NO: 4432533 - DNA, 15 bp, Homo sapiens
attgccagtgtcttt

SEQ ID NO: 4432534 - DNA, 16 bp, Homo sapiens
attgccagtgtctttc

SEQ ID NO: 4432535 - DNA, 18 bp, Homo sapiens
attgcccagtgagccctg

SEQ ID NO: 4432536 - DNA, 23 bp, Homo sapiens
attgccccatccagacctggctc

SEQ ID NO: 4432537 - DNA, 18 bp, Homo sapiens
attgccccatctagacta

SEQ ID NO: 4432538 - DNA, 12 bp, Homo sapiens
attgcccctctg

SEQ ID NO: 4432539 - DNA, 15 bp, Homo sapiens
attgcccctctgcct

SEQ ID NO: 4432540 - DNA, 17 bp, Homo sapiens
attgcccctggctttgc

SEQ ID NO: 4432541 - DNA, 19 bp, Homo sapiens
attgcccctggctttgcct

SEQ ID NO: 4432542 - DNA, 22 bp, Homo sapiens
attgcccctggctttgcctctt

SEQ ID NO: 4432543 - DNA, 19 bp, Homo sapiens
attgcctcttgcaggctga

SEQ ID NO: 4432544 - DNA, 19 bp, Homo sapiens
attgccttatttgtctgta

SEQ ID NO: 4432545 - DNA, 21 bp, Homo sapiens
attgccttatttgtctgtaaa

SEQ ID NO: 4432546 - DNA, 15 bp, Homo sapiens
attgccttctcacca

SEQ ID NO: 4432547 - DNA, 18 bp, Homo sapiens
attgccttctcaccagct

SEQ ID NO: 4432548 - DNA, 19 bp, Homo sapiens
attgccttctcaccagctg

SEQ ID NO: 4432549 - DNA, 22 bp, Homo sapiens
attgccttctcaccagctgcaa

SEQ ID NO: 4432550 - DNA, 12 bp, Homo sapiens
attgcctttaat

SEQ ID NO: 4432551 - DNA, 13 bp, Homo sapiens
attgcgctcaggg

SEQ ID NO: 4432552 - DNA, 14 bp, Homo sapiens
attgcgctcagggg

SEQ ID NO: 4432553 - DNA, 14 bp, Homo sapiens
attgctaatgttgc

SEQ ID NO: 4432554 - DNA, 22 bp, Homo sapiens
attgctacctcagtgctcctgg

SEQ ID NO: 4432555 - DNA, 18 bp, Homo sapiens
attgctactataatcaaa

SEQ ID NO: 4432556 - DNA, 20 bp, Homo sapiens
attgctactataatcaaatg

SEQ ID NO: 4432557 - DNA, 22 bp, Homo sapiens
attgctactgctcagcttcttc

SEQ ID NO: 4432558 - DNA, 19 bp, Homo sapiens
attgctagtactagtacta

SEQ ID NO: 4432559 - DNA, 23 bp, Homo sapiens
attgctcgcccagacaccatgtg

SEQ ID NO: 4432560 - DNA, 12 bp, Homo sapiens
attgctgaaatt

SEQ ID NO: 4432561 - DNA, 13 bp, Homo sapiens
attgctgaaattt

SEQ ID NO: 4432562 - DNA, 16 bp, Homo sapiens
attgctgaaattttat

SEQ ID NO: 4432563 - DNA, 22 bp, Homo sapiens
attgctgaagggcattctttcc

SEQ ID NO: 4432564 - DNA, 21 bp, Homo sapiens
attgctggtagagacccccag

SEQ ID NO: 4432565 - DNA, 12 bp, Homo sapiens
attgctgtgtct

SEQ ID NO: 4432566 - DNA, 14 bp, Homo sapiens
attgctgtgtctcc

SEQ ID NO: 4432567 - DNA, 22 bp, Homo sapiens
attgcttagtaaaatttatttc

SEQ ID NO: 4432568 - DNA, 23 bp, Homo sapiens
attgcttagtaaaatttatttca

SEQ ID NO: 4432569 - DNA, 13 bp, Homo sapiens
attgcttcaattt

SEQ ID NO: 4432570 - DNA, 20 bp, Homo sapiens
attgcttcaatttcaaactt

SEQ ID NO: 4432571 - DNA, 15 bp, Homo sapiens
attgcttcctgtgta

SEQ ID NO: 4432572 - DNA, 22 bp, Homo sapiens
attgcttcctgtgtaacatctg

SEQ ID NO: 4432573 - DNA, 15 bp, Homo sapiens
attgctttctgctct

SEQ ID NO: 4432574 - DNA, 20 bp, Homo sapiens
attgctttgccaaaatacca

SEQ ID NO: 4432575 - DNA, 14 bp, Homo sapiens
attggacagaaaat

SEQ ID NO: 4432576 - DNA, 18 bp, Homo sapiens
attggacagaaaatgcaa

SEQ ID NO: 4432577 - DNA, 15 bp, Homo sapiens
attggatttcctaat

SEQ ID NO: 4432578 - DNA, 22 bp, Homo sapiens
attggcaaagtttaaatgtatt

SEQ ID NO: 4432579 - DNA, 22 bp, Homo sapiens
attggccactggatcctgctgc

SEQ ID NO: 4432580 - DNA, 15 bp, Homo sapiens
attggccgagctcct

SEQ ID NO: 4432581 - DNA, 13 bp, Homo sapiens
attggctcacact

SEQ ID NO: 4432582 - DNA, 22 bp, Homo sapiens
attgggcacagtccagacccaa

SEQ ID NO: 4432583 - DNA, 13 bp, Homo sapiens
attgggcaggagg

SEQ ID NO: 4432584 - DNA, 12 bp, Homo sapiens
attggggaggag

SEQ ID NO: 4432585 - DNA, 14 bp, Homo sapiens
attggggctcccag

SEQ ID NO: 4432586 - DNA, 15 bp, Homo sapiens
attggggctcccagc

SEQ ID NO: 4432587 - DNA, 22 bp, Homo sapiens
attggggctcccagccaggccc

SEQ ID NO: 4432588 - DNA, 17 bp, Homo sapiens
attgggggaggaaaagt

SEQ ID NO: 4432589 - DNA, 22 bp, Homo sapiens
attgggggggccaaaaggaaaa

SEQ ID NO: 4432590 - DNA, 13 bp, Homo sapiens
attggggtgacct

SEQ ID NO: 4432591 - DNA, 14 bp, Homo sapiens
attggggtgacctt

SEQ ID NO: 4432592 - DNA, 14 bp, Homo sapiens
attggtccagcttg

SEQ ID NO: 4432593 - DNA, 15 bp, Homo sapiens
attggtccagcttgc

SEQ ID NO: 4432594 - DNA, 17 bp, Homo sapiens
attggtgctatttaaca

SEQ ID NO: 4432595 - DNA, 16 bp, Homo sapiens
attggtgtcattttct

SEQ ID NO: 4432596 - DNA, 20 bp, Homo sapiens
attggtgttcgtttccatca

SEQ ID NO: 4432597 - DNA, 12 bp, Homo sapiens
attggtgttgac

SEQ ID NO: 4432598 - DNA, 17 bp, Homo sapiens
attggttaaaatgtgat

SEQ ID NO: 4432599 - DNA, 15 bp, Homo sapiens
attggtttaaagaaa

SEQ ID NO: 4432600 - DNA, 20 bp, Homo sapiens
attggtttgcacaagttccc

SEQ ID NO: 4432601 - DNA, 15 bp, Homo sapiens
attgtaaaaatggca

SEQ ID NO: 4432602 - DNA, 13 bp, Homo sapiens
attgtaaaataat

SEQ ID NO: 4432603 - DNA, 17 bp, Homo sapiens
attgtaaaataattctg

SEQ ID NO: 4432604 - DNA, 13 bp, Homo sapiens
attgtaaagaagg

SEQ ID NO: 4432605 - DNA, 14 bp, Homo sapiens
attgtaaatgtgct

SEQ ID NO: 4432606 - DNA, 15 bp, Homo sapiens
attgtaaatgtgctt

SEQ ID NO: 4432607 - DNA, 15 bp, Homo sapiens
attgtaaatgtggat

SEQ ID NO: 4432608 - DNA, 21 bp, Homo sapiens
attgtaaattatatttgtgct

SEQ ID NO: 4432609 - DNA, 13 bp, Homo sapiens
attgtaactgttc

SEQ ID NO: 4432610 - DNA, 15 bp, Homo sapiens
attgtaactgttctt

SEQ ID NO: 4432611 - DNA, 22 bp, Homo sapiens
attgtaatatagaaaaaaacat

SEQ ID NO: 4432612 - DNA, 12 bp, Homo sapiens
attgtaatcact

SEQ ID NO: 4432613 - DNA, 13 bp, Homo sapiens
attgtaattccaa

SEQ ID NO: 4432614 - DNA, 15 bp, Homo sapiens
attgtactccagcct

SEQ ID NO: 4432615 - DNA, 16 bp, Homo sapiens
attgtactccagcctg

SEQ ID NO: 4432616 - DNA, 12 bp, Homo sapiens
attgtactgtgt

SEQ ID NO: 4432617 - DNA, 19 bp, Homo sapiens
attgtactgttgctttaat

SEQ ID NO: 4432618 - DNA, 17 bp, Homo sapiens
attgtagagccagaggt

SEQ ID NO: 4432619 - DNA, 14 bp, Homo sapiens
attgtagtttgaaa

SEQ ID NO: 4432620 - DNA, 20 bp, Homo sapiens
attgtataaattactttgat

SEQ ID NO: 4432621 - DNA, 18 bp, Homo sapiens
attgtatagatataatga

SEQ ID NO: 4432622 - DNA, 19 bp, Homo sapiens
attgtatattacaatgatc

SEQ ID NO: 4432623 - DNA, 17 bp, Homo sapiens
attgtatattgtgtttg

SEQ ID NO: 4432624 - DNA, 18 bp, Homo sapiens
attgtatatttttatcta

SEQ ID NO: 4432625 - DNA, 18 bp, Homo sapiens
attgtcacctcagcactg

SEQ ID NO: 4432626 - DNA, 18 bp, Homo sapiens
attgtccaatcctatgtt

SEQ ID NO: 4432627 - DNA, 23 bp, Homo sapiens
attgtcctcccctattttaagac

SEQ ID NO: 4432628 - DNA, 19 bp, Homo sapiens
attgtccttttctaggaag

SEQ ID NO: 4432629 - DNA, 16 bp, Homo sapiens
attgtccttttctccc

SEQ ID NO: 4432630 - DNA, 17 bp, Homo sapiens
attgtcgctatgtgact

SEQ ID NO: 4432631 - DNA, 19 bp, Homo sapiens
attgtcgctatgtgacttg

SEQ ID NO: 4432632 - DNA, 21 bp, Homo sapiens
attgtctcaacgcctccccct

SEQ ID NO: 4432633 - DNA, 20 bp, Homo sapiens
attgtctcctatatatttct

SEQ ID NO: 4432634 - DNA, 22 bp, Homo sapiens
attgtctcctatatatttctat

SEQ ID NO: 4432635 - DNA, 13 bp, Homo sapiens
attgtctgtaaat

SEQ ID NO: 4432636 - DNA, 23 bp, Homo sapiens
attatgagctatcctttcaaaca

SEQ ID NO: 4432637 - DNA, 13 bp, Homo sapiens
attatgctttgaa

SEQ ID NO: 4432638 - DNA, 16 bp, Homo sapiens
attatggaatatcatc

SEQ ID NO: 4432639 - DNA, 18 bp, Homo sapiens
attatggaatatcatctg

SEQ ID NO: 4432640 - DNA, 22 bp, Homo sapiens
attatggaatatcatctgtcat

SEQ ID NO: 4432641 - DNA, 13 bp, Homo sapiens
attatggcatttc

SEQ ID NO: 4432642 - DNA, 17 bp, Homo sapiens
attatggcatttctatt

SEQ ID NO: 4432643 - DNA, 14 bp, Homo sapiens
attatgtaagcatt

SEQ ID NO: 4432644 - DNA, 15 bp, Homo sapiens
attatgtcaaccagg

SEQ ID NO: 4432645 - DNA, 22 bp, Homo sapiens
attatgtgaagaatttagatct

SEQ ID NO: 4432646 - DNA, 13 bp, Homo sapiens
attatgtgacatt

SEQ ID NO: 4432647 - DNA, 21 bp, Homo sapiens
attatgtgttgccaaaaccaa

SEQ ID NO: 4432648 - DNA, 16 bp, Homo sapiens
attatgttaatatttc

SEQ ID NO: 4432649 - DNA, 17 bp, Homo sapiens
atagccctcagacattt

SEQ ID NO: 4432650 - DNA, 15 bp, Homo sapiens
atagcctctcctttg

SEQ ID NO: 4432651 - DNA, 17 bp, Homo sapiens
atagcctgaggtgggag

SEQ ID NO: 4432652 - DNA, 20 bp, Homo sapiens
atagcctggccaccagccat

SEQ ID NO: 4432653 - DNA, 22 bp, Homo sapiens
atagcctggccaccagccatcc

SEQ ID NO: 4432654 - DNA, 12 bp, Homo sapiens
atagcgtgtgta

SEQ ID NO: 4432655 - DNA, 13 bp, Homo sapiens
atagctaaatacc

SEQ ID NO: 4432656 - DNA, 15 bp, Homo sapiens
atagctaactgtaaa

SEQ ID NO: 4432657 - DNA, 19 bp, Homo sapiens
atagctacaatttgttttt

SEQ ID NO: 4432658 - DNA, 16 bp, Homo sapiens
atagctactaaatata

SEQ ID NO: 4432659 - DNA, 16 bp, Homo sapiens
atagctcactgcagcc

SEQ ID NO: 4432660 - DNA, 17 bp, Homo sapiens
atagctcactgcagcct

SEQ ID NO: 4432661 - DNA, 23 bp, Homo sapiens
atagctcctcaaagcctcaaaac

SEQ ID NO: 4432662 - DNA, 22 bp, Homo sapiens
atagctctggggtgggcagttt

SEQ ID NO: 4432663 - DNA, 17 bp, Homo sapiens
atagctgcttccagtgt

SEQ ID NO: 4432664 - DNA, 16 bp, Homo sapiens
atagctgtttcaaatg

SEQ ID NO: 4432665 - DNA, 17 bp, Homo sapiens
atagcttcgcatggtgg

SEQ ID NO: 4432666 - DNA, 15 bp, Homo sapiens
atagcttttatctgc

SEQ ID NO: 4432667 - DNA, 14 bp, Homo sapiens
ataggaaataaaat

SEQ ID NO: 4432668 - DNA, 15 bp, Homo sapiens
ataggaacatatgaa

SEQ ID NO: 4432669 - DNA, 21 bp, Homo sapiens
ataggaacatatgaaaataca

SEQ ID NO: 4432670 - DNA, 16 bp, Homo sapiens
ataggaatagaggaag

SEQ ID NO: 4432671 - DNA, 17 bp, Homo sapiens
ataggaatagaggaaga

SEQ ID NO: 4432672 - DNA, 16 bp, Homo sapiens
ataggaatttgtattt

SEQ ID NO: 4432673 - DNA, 18 bp, Homo sapiens
ataggaatttgtattttg

SEQ ID NO: 4432674 - DNA, 19 bp, Homo sapiens
ataggatgtactgttgaaa

SEQ ID NO: 4432675 - DNA, 23 bp, Homo sapiens
ataggatttatttaaaatagcaa

SEQ ID NO: 4432676 - DNA, 11 bp, Homo sapiens
ataggcagggg

SEQ ID NO: 4432677 - DNA, 21 bp, Homo sapiens
ataggcctgtcccttgcctct

SEQ ID NO: 4432678 - DNA, 18 bp, Homo sapiens
ataggcttctattaccta

SEQ ID NO: 4432679 - DNA, 22 bp, Homo sapiens
ataggcttctattacctattag

SEQ ID NO: 4432680 - DNA, 17 bp, Homo sapiens
atagggaatatatctct

SEQ ID NO: 4432681 - DNA, 17 bp, Homo sapiens
atagggctgagctctct

SEQ ID NO: 4432682 - DNA, 17 bp, Homo sapiens
ataggggatacttgaaa

SEQ ID NO: 4432683 - DNA, 18 bp, Homo sapiens
ataggtccagaagtcctt

SEQ ID NO: 4432684 - DNA, 21 bp, Homo sapiens
ataggtccagaagtccttatg

SEQ ID NO: 4432685 - DNA, 20 bp, Homo sapiens
ataggtcctgtgttaaacac

SEQ ID NO: 4432686 - DNA, 14 bp, Homo sapiens
ataggtgctacaaa

SEQ ID NO: 4432687 - DNA, 15 bp, Homo sapiens
ataggtgctacaaaa

SEQ ID NO: 4432688 - DNA, 22 bp, Homo sapiens
ataggttgagcaatttccccct

SEQ ID NO: 4432689 - DNA, 13 bp, Homo sapiens
atagtaaatggta

SEQ ID NO: 4432690 - DNA, 15 bp, Homo sapiens
atagtaactataaga

SEQ ID NO: 4432691 - DNA, 19 bp, Homo sapiens
atagtaacttcttatggaa

SEQ ID NO: 4432692 - DNA, 13 bp, Homo sapiens
atagtaatttgta

SEQ ID NO: 4432693 - DNA, 20 bp, Homo sapiens
atagtacatgataaatgata

SEQ ID NO: 4432694 - DNA, 13 bp, Homo sapiens
atagtatacattg

SEQ ID NO: 4432695 - DNA, 18 bp, Homo sapiens
atagtatacattgtcttg

SEQ ID NO: 4432696 - DNA, 15 bp, Homo sapiens
atagtatacatttta

SEQ ID NO: 4432697 - DNA, 13 bp, Homo sapiens
atagtatttctcc

SEQ ID NO: 4432698 - DNA, 12 bp, Homo sapiens
atagtatttgat

SEQ ID NO: 4432699 - DNA, 21 bp, Homo sapiens
atagtatttgattcaaaatat

SEQ ID NO: 4432700 - DNA, 22 bp, Homo sapiens
atagtatttgattcaaaatatt

SEQ ID NO: 4432701 - DNA, 18 bp, Homo sapiens
atagtccccagagctccc

SEQ ID NO: 4432702 - DNA, 19 bp, Homo sapiens
atagtccccagagctcccc

SEQ ID NO: 4432703 - DNA, 14 bp, Homo sapiens
atagtcctgaagtt

SEQ ID NO: 4432704 - DNA, 13 bp, Homo sapiens
atagtctgtgtga

SEQ ID NO: 4432705 - DNA, 14 bp, Homo sapiens
atagtcttccacaa

SEQ ID NO: 4432706 - DNA, 14 bp, Homo sapiens
atagtgaagtgtta

SEQ ID NO: 4432707 - DNA, 15 bp, Homo sapiens
atagtgactaaacta

SEQ ID NO: 4432708 - DNA, 16 bp, Homo sapiens
atagtgagttgcatgt

SEQ ID NO: 4432709 - DNA, 17 bp, Homo sapiens
atagtgcacaaaatgaa

SEQ ID NO: 4432710 - DNA, 18 bp, Homo sapiens
atagtgtaacttgcttaa

SEQ ID NO: 4432711 - DNA, 23 bp, Homo sapiens
atagtgtaacttgcttaaatttc

SEQ ID NO: 4432712 - DNA, 17 bp, Homo sapiens
atagtgtaagaactgta

SEQ ID NO: 4432713 - DNA, 18 bp, Homo sapiens
atagtgtaagaactgtac

SEQ ID NO: 4432714 - DNA, 23 bp, Homo sapiens
atagtgtaagaactgtacattgt

SEQ ID NO: 4432715 - DNA, 14 bp, Homo sapiens
atagtgtgaaatat

SEQ ID NO: 4432716 - DNA, 15 bp, Homo sapiens
atagtgtgaaatata

SEQ ID NO: 4432717 - DNA, 20 bp, Homo sapiens
atagtgtgctcggacacagt

SEQ ID NO: 4432718 - DNA, 20 bp, Homo sapiens
atagtgttcacaaactgtga

SEQ ID NO: 4432719 - DNA, 15 bp, Homo sapiens
atagttaaaaattaa

SEQ ID NO: 4432720 - DNA, 21 bp, Homo sapiens
atagttaaaaattaaatattt

SEQ ID NO: 4432721 - DNA, 20 bp, Homo sapiens
atagttaagcaaatttcatt

SEQ ID NO: 4432722 - DNA, 18 bp, Homo sapiens
atagttactgtgtaatta

SEQ ID NO: 4432723 - DNA, 20 bp, Homo sapiens
atagttactgtgtaattagt

SEQ ID NO: 4432724 - DNA, 23 bp, Homo sapiens
atagttagatctttgtaaatgca

SEQ ID NO: 4432725 - DNA, 15 bp, Homo sapiens
atagttattaaatgt

SEQ ID NO: 4432726 - DNA, 18 bp, Homo sapiens
atgtaatttgtgtaataa

SEQ ID NO: 4432727 - DNA, 14 bp, Homo sapiens
atgtacaaacatgt

SEQ ID NO: 4432728 - DNA, 15 bp, Homo sapiens
atgtacaaacatgtt

SEQ ID NO: 4432729 - DNA, 14 bp, Homo sapiens
atgtacaagatgaa

SEQ ID NO: 4432730 - DNA, 14 bp, Homo sapiens
atgtacaagttgag

SEQ ID NO: 4432731 - DNA, 16 bp, Homo sapiens
atgtacaagttgagta

SEQ ID NO: 4432732 - DNA, 17 bp, Homo sapiens
atgtacaatacaatgta

SEQ ID NO: 4432733 - DNA, 22 bp, Homo sapiens
atgtacaattatgtctcttgag

SEQ ID NO: 4432734 - DNA, 13 bp, Homo sapiens
atgtctgccttcg

SEQ ID NO: 4432735 - DNA, 22 bp, Homo sapiens
atgtctgtatactcctgtcacc

SEQ ID NO: 4432736 - DNA, 16 bp, Homo sapiens
atgtctgttctacata

SEQ ID NO: 4432737 - DNA, 19 bp, Homo sapiens
atgtcttaacctcagggag

SEQ ID NO: 4432738 - DNA, 12 bp, Homo sapiens
atgtcttatttt

SEQ ID NO: 4432739 - DNA, 13 bp, Homo sapiens
atgtcttccctgg

SEQ ID NO: 4432740 - DNA, 12 bp, Homo sapiens
atgtcttctgcc

SEQ ID NO: 4432741 - DNA, 17 bp, Homo sapiens
atgtcttctgcctgtta

SEQ ID NO: 4432742 - DNA, 19 bp, Homo sapiens
atgtcttctgcctgttata

SEQ ID NO: 4432743 - DNA, 23 bp, Homo sapiens
atgtcttgtatttaaaaacattt

SEQ ID NO: 4432744 - DNA, 13 bp, Homo sapiens
atgtcttgtcata

SEQ ID NO: 4432745 - DNA, 22 bp, Homo sapiens
atgtcttgtcatacaaatttat

SEQ ID NO: 4432746 - DNA, 11 bp, Homo sapiens
atgtcttgtgt

SEQ ID NO: 4432747 - DNA, 18 bp, Homo sapiens
atgtctttccaaattatt

SEQ ID NO: 4432748 - DNA, 21 bp, Homo sapiens
atgtctttccaaattatttct

SEQ ID NO: 4432749 - DNA, 14 bp, Homo sapiens
atgtcttttatagt

SEQ ID NO: 4432750 - DNA, 11 bp, Homo sapiens
atgtgaaaaac

SEQ ID NO: 4432751 - DNA, 22 bp, Homo sapiens
atgtgaaaatggtccaggagaa

SEQ ID NO: 4432752 - DNA, 16 bp, Homo sapiens
atgtgaaacatccgtt

SEQ ID NO: 4432753 - DNA, 22 bp, Homo sapiens
atgtgaaacatccgttttcatt

SEQ ID NO: 4432754 - DNA, 12 bp, Homo sapiens
atgtgaaagcac

SEQ ID NO: 4432755 - DNA, 13 bp, Homo sapiens
atgtgaaatgctt

SEQ ID NO: 4432756 - DNA, 15 bp, Homo sapiens
atgtgaacacatcag

SEQ ID NO: 4432757 - DNA, 12 bp, Homo sapiens
atgtgaagtttt

SEQ ID NO: 4432758 - DNA, 20 bp, Homo sapiens
atgtgaataggttatatgca

SEQ ID NO: 4432759 - DNA, 12 bp, Homo sapiens
atgtgaatcaga

SEQ ID NO: 4432760 - DNA, 14 bp, Homo sapiens
atgtgaatttttaa

SEQ ID NO: 4432761 - DNA, 16 bp, Homo sapiens
atgtgaatttttaagc

SEQ ID NO: 4432762 - DNA, 17 bp, Homo sapiens
atgtgaatttttaagct

SEQ ID NO: 4432763 - DNA, 19 bp, Homo sapiens
atgtgaatttttaagctgc

SEQ ID NO: 4432764 - DNA, 18 bp, Homo sapiens
atgtgacaattttgtaca

SEQ ID NO: 4432765 - DNA, 15 bp, Homo sapiens
atgtgacattaacaa

SEQ ID NO: 4432766 - DNA, 16 bp, Homo sapiens
atgtgacattttacat

SEQ ID NO: 4432767 - DNA, 18 bp, Homo sapiens
atgtgacattttacatta

SEQ ID NO: 4432768 - DNA, 18 bp, Homo sapiens
atgtgactcagcatcacc

SEQ ID NO: 4432769 - DNA, 17 bp, Homo sapiens
atgtgacttgcaataaa

SEQ ID NO: 4432770 - DNA, 17 bp, Homo sapiens
atgtgagatagttttca

SEQ ID NO: 4432771 - DNA, 15 bp, Homo sapiens
atgtgaggcaataag

SEQ ID NO: 4432772 - DNA, 19 bp, Homo sapiens
atgtgatattctgttgctt

SEQ ID NO: 4432773 - DNA, 21 bp, Homo sapiens
atgtgatattctgttgcttta

SEQ ID NO: 4432774 - DNA, 23 bp, Homo sapiens
atgtgatctgggcattttcctcc

SEQ ID NO: 4432775 - DNA, 17 bp, Homo sapiens
atgtgatgaatactgta

SEQ ID NO: 4432776 - DNA, 20 bp, Homo sapiens
atgtgattatttttctttta

SEQ ID NO: 4432777 - DNA, 19 bp, Homo sapiens
atgtgcaaaatctgttata

SEQ ID NO: 4432778 - DNA, 19 bp, Homo sapiens
atgtgcacatctgttttgt

SEQ ID NO: 4432779 - DNA, 23 bp, Homo sapiens
atgtgcagaaaatatttaatatc

SEQ ID NO: 4432780 - DNA, 15 bp, Homo sapiens
atgtgcagggatatt

SEQ ID NO: 4432781 - DNA, 22 bp, Homo sapiens
atgtgcagggatattgccttat

SEQ ID NO: 4432782 - DNA, 18 bp, Homo sapiens
atgtgccacagaggcccc

SEQ ID NO: 4432783 - DNA, 21 bp, Homo sapiens
atgtgccacagaggccccacc

SEQ ID NO: 4432784 - DNA, 14 bp, Homo sapiens
atgtgcccaaagct

SEQ ID NO: 4432785 - DNA, 21 bp, Homo sapiens
atgtgccttatgttgaaaaaa

SEQ ID NO: 4432786 - DNA, 21 bp, Homo sapiens
atgtgccttgattgattagat

SEQ ID NO: 4432787 - DNA, 11 bp, Homo sapiens
atgtgcctttc

SEQ ID NO: 4432788 - DNA, 14 bp, Homo sapiens
atgtgcctttcttt

SEQ ID NO: 4432789 - DNA, 18 bp, Homo sapiens
atgtgcctttctttgcct

SEQ ID NO: 4432790 - DNA, 18 bp, Homo sapiens
atgtgctattaatatttg

SEQ ID NO: 4432791 - DNA, 19 bp, Homo sapiens
atgtgctattaatatttgt

SEQ ID NO: 4432792 - DNA, 24 bp, Homo sapiens
atgtgctgccctgttgccgagccc

SEQ ID NO: 4432793 - DNA, 22 bp, Homo sapiens
atgtgctgttttctgtaaattc

SEQ ID NO: 4432794 - DNA, 15 bp, Homo sapiens
atgtggaagtgtggg

SEQ ID NO: 4432795 - DNA, 22 bp, Homo sapiens
atgtggaagtgtgggtctgtgt

SEQ ID NO: 4432796 - DNA, 23 bp, Homo sapiens
atgtggaagtgtgggtctgtgtg

SEQ ID NO: 4432797 - DNA, 16 bp, Homo sapiens
atgtggaataatacat

SEQ ID NO: 4432798 - DNA, 23 bp, Homo sapiens
atgtggaataatacatactaatg

SEQ ID NO: 4432799 - DNA, 18 bp, Homo sapiens
atgtggactggaacatgg

SEQ ID NO: 4432800 - DNA, 16 bp, Homo sapiens
atgtggaggaagagcc

SEQ ID NO: 4432801 - DNA, 17 bp, Homo sapiens
atgtggaggaagagcca

SEQ ID NO: 4432802 - DNA, 19 bp, Homo sapiens
atgtggaggaagagccacc

SEQ ID NO: 4432803 - DNA, 20 bp, Homo sapiens
atgtggaggaagagccacct

SEQ ID NO: 4432804 - DNA, 21 bp, Homo sapiens
atgtggaggaagagccacctg

SEQ ID NO: 4432805 - DNA, 23 bp, Homo sapiens
atgtggaggaagagccacctgca

SEQ ID NO: 4432806 - DNA, 18 bp, Homo sapiens
atgtggcaaggaaaaaca

SEQ ID NO: 4432807 - DNA, 17 bp, Homo sapiens
atgtggccaagcctatc

SEQ ID NO: 4432808 - DNA, 13 bp, Homo sapiens
atgtggccctggc

SEQ ID NO: 4432809 - DNA, 16 bp, Homo sapiens
atgtggcttgagaaat

SEQ ID NO: 4432810 - DNA, 19 bp, Homo sapiens
atgtgggagctgaaccaca

SEQ ID NO: 4432811 - DNA, 18 bp, Homo sapiens
atgtggtgacacctcccc

SEQ ID NO: 4432812 - DNA, 16 bp, Homo sapiens
atgtgtaaacaggtat

SEQ ID NO: 4432813 - DNA, 20 bp, Homo sapiens
atgtgtacaatgtacacact

SEQ ID NO: 4432814 - DNA, 15 bp, Homo sapiens
atgtgtatacataca

SEQ ID NO: 4432815 - DNA, 16 bp, Homo sapiens
atgtgtatacatacat

SEQ ID NO: 4432816 - DNA, 18 bp, Homo sapiens
atgtgtcccccccaggcc

SEQ ID NO: 4432817 - DNA, 15 bp, Homo sapiens
atgtgtcccctcact

SEQ ID NO: 4432818 - DNA, 24 bp, Homo sapiens
atgtgtcccctcactctgtcagcc

SEQ ID NO: 4432819 - DNA, 18 bp, Homo sapiens
atgtgtcctcagggagca

SEQ ID NO: 4432820 - DNA, 15 bp, Homo sapiens
atgtgtgactttcag

SEQ ID NO: 4432821 - DNA, 19 bp, Homo sapiens
atgtgtgaggagctgctgg

SEQ ID NO: 4432822 - DNA, 22 bp, Homo sapiens
atgtgtgaggagctgctggctt

SEQ ID NO: 4432823 - DNA, 13 bp, Homo sapiens
atgtgtgccctgg

SEQ ID NO: 4432824 - DNA, 14 bp, Homo sapiens
atgtgtgccctgga

SEQ ID NO: 4432825 - DNA, 15 bp, Homo sapiens
atgtgtgccctggac

SEQ ID NO: 4432826 - DNA, 16 bp, Homo sapiens
atgtgtgctcacaatg

SEQ ID NO: 4432827 - DNA, 17 bp, Homo sapiens
atgtgtgctcacaatgt

SEQ ID NO: 4432828 - DNA, 23 bp, Homo sapiens
atgtgtgtccacgactgtctcca

SEQ ID NO: 4432829 - DNA, 21 bp, Homo sapiens
atgtgtgtgccaagccctggc

SEQ ID NO: 4432830 - DNA, 18 bp, Homo sapiens
atgtgtgtgtgtggcagg

SEQ ID NO: 4432831 - DNA, 13 bp, Homo sapiens
atgtgttaatctt

SEQ ID NO: 4432832 - DNA, 14 bp, Homo sapiens
atgtgttaatctta

SEQ ID NO: 4432833 - DNA, 22 bp, Homo sapiens
atgtgttaatcttaatgtatat

SEQ ID NO: 4432834 - DNA, 14 bp, Homo sapiens
atgtgttatctacc

SEQ ID NO: 4432835 - DNA, 18 bp, Homo sapiens
atgtgttatctacctcaa

SEQ ID NO: 4432836 - DNA, 14 bp, Homo sapiens
atgtgttatgaaca

SEQ ID NO: 4432837 - DNA, 22 bp, Homo sapiens
atgtgttccctttgtctttcaa

SEQ ID NO: 4432838 - DNA, 13 bp, Homo sapiens
atgtgttcttatt

SEQ ID NO: 4432839 - DNA, 23 bp, Homo sapiens
atgtgttcttttctcctttacca

SEQ ID NO: 4432840 - DNA, 14 bp, Homo sapiens
atgtgttgaaaacc

SEQ ID NO: 4432841 - DNA, 18 bp, Homo sapiens
atgtgttgaaaaccaaaa

SEQ ID NO: 4432842 - DNA, 21 bp, Homo sapiens
atgtgttttcatcatttcagc

SEQ ID NO: 4432843 - DNA, 14 bp, Homo sapiens
atgtgttttctgta

SEQ ID NO: 4432844 - DNA, 15 bp, Homo sapiens
atgtgtttttctcca

SEQ ID NO: 4432845 - DNA, 19 bp, Homo sapiens
atgtgttttttgcaacata

SEQ ID NO: 4432846 - DNA, 22 bp, Homo sapiens
atgttaaaaaaataagaagaat

SEQ ID NO: 4432847 - DNA, 21 bp, Homo sapiens
atgttaacaatgcctattgta

SEQ ID NO: 4432848 - DNA, 23 bp, Homo sapiens
atgttaacaatgcctattgtaat

SEQ ID NO: 4432849 - DNA, 15 bp, Homo sapiens
atgttaagaaccaaa

SEQ ID NO: 4432850 - DNA, 16 bp, Homo sapiens
atgggcaaaccctggt

SEQ ID NO: 4432851 - DNA, 19 bp, Homo sapiens
atgggcaaaccctggtgct

SEQ ID NO: 4432852 - DNA, 20 bp, Homo sapiens
atgggcaaaccctggtgctt

SEQ ID NO: 4432853 - DNA, 12 bp, Homo sapiens
atgggcagccca

SEQ ID NO: 4432854 - DNA, 16 bp, Homo sapiens
atgggcagcccaacag

SEQ ID NO: 4432855 - DNA, 22 bp, Homo sapiens
atgggccaccgccttgcccagc

SEQ ID NO: 4432856 - DNA, 19 bp, Homo sapiens
atgggccactgaaatctgt

SEQ ID NO: 4432857 - DNA, 20 bp, Homo sapiens
atgggcctttaagaacctta

SEQ ID NO: 4432858 - DNA, 21 bp, Homo sapiens
atgggcctttaagaaccttaa

SEQ ID NO: 4432859 - DNA, 21 bp, Homo sapiens
atgggctcgccgtgtctcagc

SEQ ID NO: 4432860 - DNA, 23 bp, Homo sapiens
atgggctgtgtcctaaggcccat

SEQ ID NO: 4432861 - DNA, 15 bp, Homo sapiens
atggggaaaaaaatc

SEQ ID NO: 4432862 - DNA, 11 bp, Homo sapiens
atggggagggg

SEQ ID NO: 4432863 - DNA, 14 bp, Homo sapiens
atggggcagaagag

SEQ ID NO: 4432864 - DNA, 16 bp, Homo sapiens
atggggcagaagagaa

SEQ ID NO: 4432865 - DNA, 15 bp, Homo sapiens
atggggccaggaaag

SEQ ID NO: 4432866 - DNA, 19 bp, Homo sapiens
atgggggaaaattattttg

SEQ ID NO: 4432867 - DNA, 15 bp, Homo sapiens
atgggggcagtctcc

SEQ ID NO: 4432868 - DNA, 18 bp, Homo sapiens
atgggggcatctcttccc

SEQ ID NO: 4432869 - DNA, 22 bp, Homo sapiens
atggggtccatccccttccccc

SEQ ID NO: 4432870 - DNA, 15 bp, Homo sapiens
atgggtaagggaggg

SEQ ID NO: 4432871 - DNA, 16 bp, Homo sapiens
atgggtaagggaggga

SEQ ID NO: 4432872 - DNA, 12 bp, Homo sapiens
atgggtccaggg

SEQ ID NO: 4432873 - DNA, 22 bp, Homo sapiens
atgggtccaggggtctgtctgc

SEQ ID NO: 4432874 - DNA, 22 bp, Homo sapiens
atgggtgggacatggaaaagaa

SEQ ID NO: 4432875 - DNA, 12 bp, Homo sapiens
atgggtgggagg

SEQ ID NO: 4432876 - DNA, 18 bp, Homo sapiens
atggtaaaaaatttataa

SEQ ID NO: 4432877 - DNA, 15 bp, Homo sapiens
atggtaagagaaaag

SEQ ID NO: 4432878 - DNA, 19 bp, Homo sapiens
atggtacatttatcactga

SEQ ID NO: 4432879 - DNA, 18 bp, Homo sapiens
atggtacttcctctgtga

SEQ ID NO: 4432880 - DNA, 24 bp, Homo sapiens
atggtacttcctctgtgaactgtg

SEQ ID NO: 4432881 - DNA, 18 bp, Homo sapiens
atggtagggtataatgtg

SEQ ID NO: 4432882 - DNA, 22 bp, Homo sapiens
atggtagggtataatgtgtctg

SEQ ID NO: 4432883 - DNA, 19 bp, Homo sapiens
atggtagttattctgcctt

SEQ ID NO: 4432884 - DNA, 13 bp, Homo sapiens
atggtataaacag

SEQ ID NO: 4432885 - DNA, 21 bp, Homo sapiens
atggtatatttggtactgtat

SEQ ID NO: 4432886 - DNA, 21 bp, Homo sapiens
atggtatcaaaattacatata

SEQ ID NO: 4432887 - DNA, 23 bp, Homo sapiens
atggtatcatatattaaaacaat

SEQ ID NO: 4432888 - DNA, 15 bp, Homo sapiens
atggtatgctggcca

SEQ ID NO: 4432889 - DNA, 16 bp, Homo sapiens
atggtatgctggccag

SEQ ID NO: 4432890 - DNA, 17 bp, Homo sapiens
atggtatgctggccagc

SEQ ID NO: 4432891 - DNA, 15 bp, Homo sapiens
atggtcacacactga

SEQ ID NO: 4432892 - DNA, 16 bp, Homo sapiens
atggtcacacactgat

SEQ ID NO: 4432893 - DNA, 21 bp, Homo sapiens
atggtcacgtttggtgcttct

SEQ ID NO: 4432894 - DNA, 18 bp, Homo sapiens
atggtcagccctagggtg

SEQ ID NO: 4432895 - DNA, 13 bp, Homo sapiens
atggtcatataca

SEQ ID NO: 4432896 - DNA, 19 bp, Homo sapiens
atggtcatatacatattgt

SEQ ID NO: 4432897 - DNA, 17 bp, Homo sapiens
atggtcctttctggaag

SEQ ID NO: 4432898 - DNA, 23 bp, Homo sapiens
atggtcgagaaagaggcaccagg

SEQ ID NO: 4432899 - DNA, 16 bp, Homo sapiens
atggtcggatctcaca

SEQ ID NO: 4432900 - DNA, 15 bp, Homo sapiens
atggtcttacagcag

SEQ ID NO: 4432901 - DNA, 16 bp, Homo sapiens
atggtgaaaacgtctt

SEQ ID NO: 4432902 - DNA, 21 bp, Homo sapiens
atggtgaaacctggtctctac

SEQ ID NO: 4432903 - DNA, 17 bp, Homo sapiens
atggtgcctgagaggca

SEQ ID NO: 4432904 - DNA, 23 bp, Homo sapiens
atggtgcctgagaggcaggcata

SEQ ID NO: 4432905 - DNA, 15 bp, Homo sapiens
atggtgctcaccatg

SEQ ID NO: 4432906 - DNA, 20 bp, Homo sapiens
atggtggactcgcctgtaat

SEQ ID NO: 4432907 - DNA, 15 bp, Homo sapiens
atggtggccagaaat

SEQ ID NO: 4432908 - DNA, 23 bp, Homo sapiens
atggtggcttcttttctttgtat

SEQ ID NO: 4432909 - DNA, 21 bp, Homo sapiens
atggtgtcccggtaccttcca

SEQ ID NO: 4432910 - DNA, 13 bp, Homo sapiens
atggtgtctccca

SEQ ID NO: 4432911 - DNA, 18 bp, Homo sapiens
atggtgtgaacccgggag

SEQ ID NO: 4432912 - DNA, 17 bp, Homo sapiens
atggtgtgccttccaga

SEQ ID NO: 4432913 - DNA, 14 bp, Homo sapiens
atggtgttacatat

SEQ ID NO: 4432914 - DNA, 17 bp, Homo sapiens
atggtgttttgtcagac

SEQ ID NO: 4432915 - DNA, 17 bp, Homo sapiens
atggttaatactattaa

SEQ ID NO: 4432916 - DNA, 16 bp, Homo sapiens
atggttacactgttag

SEQ ID NO: 4432917 - DNA, 18 bp, Homo sapiens
atggttacttcttctctt

SEQ ID NO: 4432918 - DNA, 12 bp, Homo sapiens
atggttagctgt

SEQ ID NO: 4432919 - DNA, 22 bp, Homo sapiens
atggttatctttgagaccatcc

SEQ ID NO: 4432920 - DNA, 20 bp, Homo sapiens
atggttcaagtcttctgtta

SEQ ID NO: 4432921 - DNA, 13 bp, Homo sapiens
atggttgaataca

SEQ ID NO: 4432922 - DNA, 16 bp, Homo sapiens
atggttgggggaatgc

SEQ ID NO: 4432923 - DNA, 17 bp, Homo sapiens
atggttgggggaatgca

SEQ ID NO: 4432924 - DNA, 14 bp, Homo sapiens
atggtttaaaagaa

SEQ ID NO: 4432925 - DNA, 16 bp, Homo sapiens
atggtttgatatgtag

SEQ ID NO: 4432926 - DNA, 22 bp, Homo sapiens
atggtttggtgctttttataaa

SEQ ID NO: 4432927 - DNA, 21 bp, Homo sapiens
atggttttcattcattggtga

SEQ ID NO: 4432928 - DNA, 18 bp, Homo sapiens
atggtttttaaattttgt

SEQ ID NO: 4432929 - DNA, 20 bp, Homo sapiens
atggtttttatttctcgggt

SEQ ID NO: 4432930 - DNA, 13 bp, Homo sapiens
atgtaaaaaagaa

SEQ ID NO: 4432931 - DNA, 21 bp, Homo sapiens
atgtaaaaatccttttgaatg

SEQ ID NO: 4432932 - DNA, 14 bp, Homo sapiens
atgtaaaaatgaag

SEQ ID NO: 4432933 - DNA, 14 bp, Homo sapiens
atgtaaaaatgctt

SEQ ID NO: 4432934 - DNA, 20 bp, Homo sapiens
atgtaaaacatttattttga

SEQ ID NO: 4432935 - DNA, 13 bp, Homo sapiens
atgtaaaatgagt

SEQ ID NO: 4432936 - DNA, 14 bp, Homo sapiens
atgtaaactctctt

SEQ ID NO: 4432937 - DNA, 16 bp, Homo sapiens
atgtaaagatgattta

SEQ ID NO: 4432938 - DNA, 16 bp, Homo sapiens
atgtaaaggaaacata

SEQ ID NO: 4432939 - DNA, 19 bp, Homo sapiens
atgtaaaggggcagcagtg

SEQ ID NO: 4432940 - DNA, 15 bp, Homo sapiens
atgtaaagttatgta

SEQ ID NO: 4432941 - DNA, 22 bp, Homo sapiens
atgtaaagttatgtatttaaag

SEQ ID NO: 4432942 - DNA, 23 bp, Homo sapiens
atgtaaagttatgtatttaaagt

SEQ ID NO: 4432943 - DNA, 14 bp, Homo sapiens
atgtaaataaaaca

SEQ ID NO: 4432944 - DNA, 20 bp, Homo sapiens
atgtaaataaactatttata

SEQ ID NO: 4432945 - DNA, 21 bp, Homo sapiens
atgtaaataaccccattcttt

SEQ ID NO: 4432946 - DNA, 22 bp, Homo sapiens
atgtaaataaccccattctttg

SEQ ID NO: 4432947 - DNA, 18 bp, Homo sapiens
atgtaaataggtttctaa

SEQ ID NO: 4432948 - DNA, 11 bp, Homo sapiens
atgtaaatatt

SEQ ID NO: 4432949 - DNA, 13 bp, Homo sapiens
atgtaaatatttt

SEQ ID NO: 4432950 - DNA, 21 bp, Homo sapiens
atgtaaatattttaaagaatt

SEQ ID NO: 4432951 - DNA, 12 bp, Homo sapiens
atgtaaatgtgt

SEQ ID NO: 4432952 - DNA, 13 bp, Homo sapiens
atgtaaatgtgtt

SEQ ID NO: 4432953 - DNA, 17 bp, Homo sapiens
atgtaaattgactgtac

SEQ ID NO: 4432954 - DNA, 18 bp, Homo sapiens
atgtaaattgactgtact

SEQ ID NO: 4432955 - DNA, 19 bp, Homo sapiens
atgtaaatttttcttttct

SEQ ID NO: 4432956 - DNA, 14 bp, Homo sapiens
atgtaaccactgca

SEQ ID NO: 4432957 - DNA, 15 bp, Homo sapiens
atgtaagaaaatgtt

SEQ ID NO: 4432958 - DNA, 16 bp, Homo sapiens
atgtaagcatactttg

SEQ ID NO: 4432959 - DNA, 13 bp, Homo sapiens
atgtaagctggaa

SEQ ID NO: 4432960 - DNA, 14 bp, Homo sapiens
atgtaagggaaact

SEQ ID NO: 4432961 - DNA, 11 bp, Homo sapiens
atgtaataaag

SEQ ID NO: 4432962 - DNA, 14 bp, Homo sapiens
atgtaataaagtga

SEQ ID NO: 4432963 - DNA, 16 bp, Homo sapiens
atgtaataaagtgaac

SEQ ID NO: 4432964 - DNA, 17 bp, Homo sapiens
atgtaataaagtgaact

SEQ ID NO: 4432965 - DNA, 18 bp, Homo sapiens
atgtaataatcattttag

SEQ ID NO: 4432966 - DNA, 18 bp, Homo sapiens
atgtaatatatcctgaaa

SEQ ID NO: 4432967 - DNA, 18 bp, Homo sapiens
atgtaattaaactgttaa

SEQ ID NO: 4432968 - DNA, 12 bp, Homo sapiens
atgtaatttctt

SEQ ID NO: 4432969 - DNA, 18 bp, Homo sapiens
atgtaatttctttaaatg

SEQ ID NO: 4432970 - DNA, 17 bp, Homo sapiens
atgtaatttgtgtaata

SEQ ID NO: 4432971 - DNA, 15 bp, Homo sapiens
atggaaccttccctc

SEQ ID NO: 4432972 - DNA, 17 bp, Homo sapiens
atggaaccttccctcca

SEQ ID NO: 4432973 - DNA, 18 bp, Homo sapiens
atggaaccttccctccaa

SEQ ID NO: 4432974 - DNA, 21 bp, Homo sapiens
atggaaccttccctccaaatt

SEQ ID NO: 4432975 - DNA, 16 bp, Homo sapiens
atggaactgtgtattt

SEQ ID NO: 4432976 - DNA, 18 bp, Homo sapiens
atggaactgtgtatttat

SEQ ID NO: 4432977 - DNA, 16 bp, Homo sapiens
atggaacttagccatt

SEQ ID NO: 4432978 - DNA, 13 bp, Homo sapiens
atggaagaaagta

SEQ ID NO: 4432979 - DNA, 16 bp, Homo sapiens
atggaagggtttgtgg

SEQ ID NO: 4432980 - DNA, 17 bp, Homo sapiens
atggaagtaattaaggt

SEQ ID NO: 4432981 - DNA, 16 bp, Homo sapiens
atggaatatcatctgt

SEQ ID NO: 4432982 - DNA, 19 bp, Homo sapiens
atggaatcgaagtgtttat

SEQ ID NO: 4432983 - DNA, 21 bp, Homo sapiens
atggaatgatgggtcagttgt

SEQ ID NO: 4432984 - DNA, 21 bp, Homo sapiens
atggaatgattggttaaaatg

SEQ ID NO: 4432985 - DNA, 19 bp, Homo sapiens
atggaattgatttgcattg

SEQ ID NO: 4432986 - DNA, 17 bp, Homo sapiens
atggacacgagccacaa

SEQ ID NO: 4432987 - DNA, 20 bp, Homo sapiens
atggacatttagaagaaaga

SEQ ID NO: 4432988 - DNA, 18 bp, Homo sapiens
atggaccaacctgctctg

SEQ ID NO: 4432989 - DNA, 14 bp, Homo sapiens
atattttgaatcaa

SEQ ID NO: 4432990 - DNA, 19 bp, Homo sapiens
atattttgaatcaataata

SEQ ID NO: 4432991 - DNA, 18 bp, Homo sapiens
atattttgagaaactgct

SEQ ID NO: 4432992 - DNA, 14 bp, Homo sapiens
atattttgataata

SEQ ID NO: 4432993 - DNA, 17 bp, Homo sapiens
atattttgataataata

SEQ ID NO: 4432994 - DNA, 18 bp, Homo sapiens
atattttgataataatat

SEQ ID NO: 4432995 - DNA, 20 bp, Homo sapiens
atattttgtatattatgttt

SEQ ID NO: 4432996 - DNA, 19 bp, Homo sapiens
atattttgttaacttttgt

SEQ ID NO: 4432997 - DNA, 13 bp, Homo sapiens
atatttttagata

SEQ ID NO: 4432998 - DNA, 19 bp, Homo sapiens
atatttttatacaagtaat

SEQ ID NO: 4432999 - DNA, 17 bp, Homo sapiens
atatttttatactttat

SEQ ID NO: 4433000 - DNA, 19 bp, Homo sapiens
atatttttatatttccttt

SEQ ID NO: 4433001 - DNA, 21 bp, Homo sapiens
atatttttatatttcctttat

SEQ ID NO: 4433002 - DNA, 16 bp, Homo sapiens
atatttttatctatat

SEQ ID NO: 4433003 - DNA, 23 bp, Homo sapiens
atatttttgtacgttatatattg

SEQ ID NO: 4433004 - DNA, 22 bp, Homo sapiens
atcaaaaacaggcaggtacagg

SEQ ID NO: 4433005 - DNA, 12 bp, Homo sapiens
atcaaaaataat

SEQ ID NO: 4433006 - DNA, 13 bp, Homo sapiens
atcaaaaataatg

SEQ ID NO: 4433007 - DNA, 19 bp, Homo sapiens
atcaaaagaaaattgatat

SEQ ID NO: 4433008 - DNA, 20 bp, Homo sapiens
atcaaaaggaggaatttcag

SEQ ID NO: 4433009 - DNA, 14 bp, Homo sapiens
atcaaaattacata

SEQ ID NO: 4433010 - DNA, 22 bp, Homo sapiens
atcaaacaccaacataaaaatg

SEQ ID NO: 4433011 - DNA, 12 bp, Homo sapiens
atcaaagatgaa

SEQ ID NO: 4433012 - DNA, 16 bp, Homo sapiens
atcaaaggaatataag

SEQ ID NO: 4433013 - DNA, 16 bp, Homo sapiens
atcaaagtggtaaata

SEQ ID NO: 4433014 - DNA, 18 bp, Homo sapiens
atcaaagtggtaaatact

SEQ ID NO: 4433015 - DNA, 16 bp, Homo sapiens
atcaaagttttgatgt

SEQ ID NO: 4433016 - DNA, 19 bp, Homo sapiens
atcaaataaaaattctaga

SEQ ID NO: 4433017 - DNA, 21 bp, Homo sapiens
atcaaatagaaccactatgaa

SEQ ID NO: 4433018 - DNA, 15 bp, Homo sapiens
atcaaatatgcaaag

SEQ ID NO: 4433019 - DNA, 16 bp, Homo sapiens
atcaaatatgcaaagc

SEQ ID NO: 4433020 - DNA, 18 bp, Homo sapiens
atcaaatatgcaaagcac

SEQ ID NO: 4433021 - DNA, 20 bp, Homo sapiens
atcaaatatgcaaagcactg

SEQ ID NO: 4433022 - DNA, 15 bp, Homo sapiens
atcaaatgatttcat

SEQ ID NO: 4433023 - DNA, 16 bp, Homo sapiens
atcaaatgatttcata

SEQ ID NO: 4433024 - DNA, 17 bp, Homo sapiens
atcaaatgcagtatatt

SEQ ID NO: 4433025 - DNA, 16 bp, Homo sapiens
atcaacaaaaattgtc

SEQ ID NO: 4433026 - DNA, 17 bp, Homo sapiens
atcaacaataaaatttt

SEQ ID NO: 4433027 - DNA, 22 bp, Homo sapiens
atcaacaataaaatttttttaa

SEQ ID NO: 4433028 - DNA, 19 bp, Homo sapiens
atcaacaggagggcagccc

SEQ ID NO: 4433029 - DNA, 21 bp, Homo sapiens
atcaacaggagggcagcccgt

SEQ ID NO: 4433030 - DNA, 19 bp, Homo sapiens
atcaacattccagggatga

SEQ ID NO: 4433031 - DNA, 21 bp, Homo sapiens
atcaacttaccaggcaccaaa

SEQ ID NO: 4433032 - DNA, 12 bp, Homo sapiens
atcaacttttta

SEQ ID NO: 4433033 - DNA, 16 bp, Homo sapiens
atcaactttttattgc

SEQ ID NO: 4433034 - DNA, 20 bp, Homo sapiens
atcaactttttattgccttc

SEQ ID NO: 4433035 - DNA, 22 bp, Homo sapiens
atcaactttttattgccttctc

SEQ ID NO: 4433036 - DNA, 15 bp, Homo sapiens
atcaagactatctac

SEQ ID NO: 4433037 - DNA, 14 bp, Homo sapiens
atcaagagaaactt

SEQ ID NO: 4433038 - DNA, 15 bp, Homo sapiens
atcaagagctgccct

SEQ ID NO: 4433039 - DNA, 20 bp, Homo sapiens
atcaagagctgccctccttg

SEQ ID NO: 4433040 - DNA, 13 bp, Homo sapiens
atcaagatatatg

SEQ ID NO: 4433041 - DNA, 14 bp, Homo sapiens
atcaagatatatgt

SEQ ID NO: 4433042 - DNA, 18 bp, Homo sapiens
atcaagatttttttcctg

SEQ ID NO: 4433043 - DNA, 15 bp, Homo sapiens
atcaagcacttccca

SEQ ID NO: 4433044 - DNA, 19 bp, Homo sapiens
atcaagcacttcccaggat

SEQ ID NO: 4433045 - DNA, 23 bp, Homo sapiens
atcaaggttataattttttttaa

SEQ ID NO: 4433046 - DNA, 21 bp, Homo sapiens
atcaagtattactaaattgac

SEQ ID NO: 4433047 - DNA, 20 bp, Homo sapiens
atcaagtatttgggaagtga

SEQ ID NO: 4433048 - DNA, 18 bp, Homo sapiens
atcaagttgttgactgtg

SEQ ID NO: 4433049 - DNA, 17 bp, Homo sapiens
atcaataaaattctgta

SEQ ID NO: 4433050 - DNA, 19 bp, Homo sapiens
atcaataaaattctgtaat

SEQ ID NO: 4433051 - DNA, 18 bp, Homo sapiens
atcaataatatattttct

SEQ ID NO: 4433052 - DNA, 21 bp, Homo sapiens
atcaataatatattttctgtt

SEQ ID NO: 4433053 - DNA, 17 bp, Homo sapiens
atcaatacactagttgt

SEQ ID NO: 4433054 - DNA, 22 bp, Homo sapiens
atcaatagtgtcctatgcaata

SEQ ID NO: 4433055 - DNA, 13 bp, Homo sapiens
atcaatagttgaa

SEQ ID NO: 4433056 - DNA, 15 bp, Homo sapiens
atcaatattttctgc

SEQ ID NO: 4433057 - DNA, 13 bp, Homo sapiens
atcaatcttgtta

SEQ ID NO: 4433058 - DNA, 14 bp, Homo sapiens
atcaatcttgttac

SEQ ID NO: 4433059 - DNA, 19 bp, Homo sapiens
atcaatcttgttactgctg

SEQ ID NO: 4433060 - DNA, 20 bp, Homo sapiens
atcaatgaggtatcttcttt

SEQ ID NO: 4433061 - DNA, 19 bp, Homo sapiens
atcaatggctttgtacttg

SEQ ID NO: 4433062 - DNA, 16 bp, Homo sapiens
atcaatggttcaagtc

SEQ ID NO: 4433063 - DNA, 17 bp, Homo sapiens
atcaattagatctaaac

SEQ ID NO: 4433064 - DNA, 19 bp, Homo sapiens
atcaattctgtattccaga

SEQ ID NO: 4433065 - DNA, 12 bp, Homo sapiens
atcaatttaagt

SEQ ID NO: 4433066 - DNA, 19 bp, Homo sapiens
atcaatttctaatgtttac

SEQ ID NO: 4433067 - DNA, 20 bp, Homo sapiens
atcaatttctaatgtttact

SEQ ID NO: 4433068 - DNA, 17 bp, Homo sapiens
atcaattttaaggaaac

SEQ ID NO: 4433069 - DNA, 15 bp, Homo sapiens
atcacaaagtggaac

SEQ ID NO: 4433070 - DNA, 24 bp, Homo sapiens
atcacaaagtggaacgaaaatgaa

SEQ ID NO: 4433071 - DNA, 21 bp, Homo sapiens
atcacacaatatagttttttc

SEQ ID NO: 4433072 - DNA, 13 bp, Homo sapiens
atcacacacattg

SEQ ID NO: 4433073 - DNA, 22 bp, Homo sapiens
atcacactcaaggacaggagcc

SEQ ID NO: 4433074 - DNA, 19 bp, Homo sapiens
atcacacttatattttatg

SEQ ID NO: 4433075 - DNA, 23 bp, Homo sapiens
atcacacttatattttatgaaca

SEQ ID NO: 4433076 - DNA, 14 bp, Homo sapiens
atcacacttctgtg

SEQ ID NO: 4433077 - DNA, 18 bp, Homo sapiens
atcacacttctgtgagac

SEQ ID NO: 4433078 - DNA, 16 bp, Homo sapiens
atcacagaaaatttaa

SEQ ID NO: 4433079 - DNA, 14 bp, Homo sapiens
atcacagaccacag

SEQ ID NO: 4433080 - DNA, 17 bp, Homo sapiens
atcacagaccccagctg

SEQ ID NO: 4433081 - DNA, 14 bp, Homo sapiens
atcacagaggcttc

SEQ ID NO: 4433082 - DNA, 23 bp, Homo sapiens
atcacagggttgggcccagatct

SEQ ID NO: 4433083 - DNA, 18 bp, Homo sapiens
atcacagttgtgttcctg

SEQ ID NO: 4433084 - DNA, 15 bp, Homo sapiens
atcacataaagaaat

SEQ ID NO: 4433085 - DNA, 17 bp, Homo sapiens
atcacatagtattatgt

SEQ ID NO: 4433086 - DNA, 18 bp, Homo sapiens
atcacatctaaagcttta

SEQ ID NO: 4433087 - DNA, 20 bp, Homo sapiens
atcacatctaaagctttatc

SEQ ID NO: 4433088 - DNA, 14 bp, Homo sapiens
atcacatcttattt

SEQ ID NO: 4433089 - DNA, 16 bp, Homo sapiens
atcaccgactgaaaat

SEQ ID NO: 4433090 - DNA, 19 bp, Homo sapiens
atcaccgtgggctccctga

SEQ ID NO: 4433091 - DNA, 15 bp, Homo sapiens
atcacctatttccat

SEQ ID NO: 4433092 - DNA, 22 bp, Homo sapiens
atcacctatttccattcaacaa

SEQ ID NO: 4433093 - DNA, 21 bp, Homo sapiens
atcacctgaaccccagaggca

SEQ ID NO: 4433094 - DNA, 23 bp, Homo sapiens
atcacgccattgtactccagcct

SEQ ID NO: 4433095 - DNA, 21 bp, Homo sapiens
atcacgtaaagctagaaatga

SEQ ID NO: 4433096 - DNA, 18 bp, Homo sapiens
atcactatcaattttaag

SEQ ID NO: 4433097 - DNA, 21 bp, Homo sapiens
atcactgcagtcacctcttct

SEQ ID NO: 4433098 - DNA, 18 bp, Homo sapiens
atcactgctccaggcctg

SEQ ID NO: 4433099 - DNA, 19 bp, Homo sapiens
atcactggagcaccaggca

SEQ ID NO: 4433100 - DNA, 14 bp, Homo sapiens
atcactgtaaagac

SEQ ID NO: 4433101 - DNA, 17 bp, Homo sapiens
atcactgttgctttgaa

SEQ ID NO: 4433102 - DNA, 15 bp, Homo sapiens
atcacttaacattcc

SEQ ID NO: 4433103 - DNA, 14 bp, Homo sapiens
atcacttaagcctg

SEQ ID NO: 4433104 - DNA, 18 bp, Homo sapiens
atcacttaatttgaaatc

SEQ ID NO: 4433105 - DNA, 23 bp, Homo sapiens
atcagaaaacagggtccaggaat

SEQ ID NO: 4433106 - DNA, 18 bp, Homo sapiens
atcagaaagaaaaaattt

SEQ ID NO: 4433107 - DNA, 22 bp, Homo sapiens
atccaatggactgcataaataa

SEQ ID NO: 4433108 - DNA, 15 bp, Homo sapiens
atccacccagcccat

SEQ ID NO: 4433109 - DNA, 20 bp, Homo sapiens
atccacccgggggagcccag

SEQ ID NO: 4433110 - DNA, 21 bp, Homo sapiens
atccacccgggggagcccagt

SEQ ID NO: 4433111 - DNA, 11 bp, Homo sapiens
atccaccttca

SEQ ID NO: 4433112 - DNA, 12 bp, Homo sapiens
atccaccttcag

SEQ ID NO: 4433113 - DNA, 16 bp, Homo sapiens
atccactctaccctcc

SEQ ID NO: 4433114 - DNA, 22 bp, Homo sapiens
atccactctaccctcccacccc

SEQ ID NO: 4433115 - DNA, 15 bp, Homo sapiens
atccagaaatactta

SEQ ID NO: 4433116 - DNA, 22 bp, Homo sapiens
atccagacagtcgctcagtctg

SEQ ID NO: 4433117 - DNA, 23 bp, Homo sapiens
atccagacagtcgctcagtctgt

SEQ ID NO: 4433118 - DNA, 20 bp, Homo sapiens
atccagacctggctccactc

SEQ ID NO: 4433119 - DNA, 17 bp, Homo sapiens
atccagactttcttttt

SEQ ID NO: 4433120 - DNA, 15 bp, Homo sapiens
atccagagagcagct

SEQ ID NO: 4433121 - DNA, 14 bp, Homo sapiens
atccagccagaccc

SEQ ID NO: 4433122 - DNA, 21 bp, Homo sapiens
atccagcctggggctgaggct

SEQ ID NO: 4433123 - DNA, 21 bp, Homo sapiens
atccaggagtctttcaactgt

SEQ ID NO: 4433124 - DNA, 14 bp, Homo sapiens
atccaggtaatcca

SEQ ID NO: 4433125 - DNA, 15 bp, Homo sapiens
atccaggttccctcc

SEQ ID NO: 4433126 - DNA, 18 bp, Homo sapiens
atccagtaacctcggaga

SEQ ID NO: 4433127 - DNA, 13 bp, Homo sapiens
atccagtataaga

SEQ ID NO: 4433128 - DNA, 22 bp, Homo sapiens
atccagtcattttattttgtaa

SEQ ID NO: 4433129 - DNA, 14 bp, Homo sapiens
atccagtctggaaa

SEQ ID NO: 4433130 - DNA, 14 bp, Homo sapiens
atccagtttctttc

SEQ ID NO: 4433131 - DNA, 11 bp, Homo sapiens
atccataaaga

SEQ ID NO: 4433132 - DNA, 15 bp, Homo sapiens
atccatagacacagt

SEQ ID NO: 4433133 - DNA, 14 bp, Homo sapiens
atccatcttgagcc

SEQ ID NO: 4433134 - DNA, 18 bp, Homo sapiens
atccatcttgctttttcc

SEQ ID NO: 4433135 - DNA, 18 bp, Homo sapiens
atccatgacctagttttc

SEQ ID NO: 4433136 - DNA, 22 bp, Homo sapiens
atccatgacctagttttccatg

SEQ ID NO: 4433137 - DNA, 16 bp, Homo sapiens
atccatgcattatata

SEQ ID NO: 4433138 - DNA, 22 bp, Homo sapiens
atccattcacaagcctcctgta

SEQ ID NO: 4433139 - DNA, 22 bp, Homo sapiens
atccattcctcagggacagaga

SEQ ID NO: 4433140 - DNA, 20 bp, Homo sapiens
atcccaaagcaaggagatca

SEQ ID NO: 4433141 - DNA, 17 bp, Homo sapiens
atcccaggggcccaagg

SEQ ID NO: 4433142 - DNA, 15 bp, Homo sapiens
atcccatgttgaagt

SEQ ID NO: 4433143 - DNA, 13 bp, Homo sapiens
atccccaactcca

SEQ ID NO: 4433144 - DNA, 16 bp, Homo sapiens
atccccaactgctcca

SEQ ID NO: 4433145 - DNA, 18 bp, Homo sapiens
atccccaactgctccagc

SEQ ID NO: 4433146 - DNA, 14 bp, Homo sapiens
atccccaccccacc

SEQ ID NO: 4433147 - DNA, 21 bp, Homo sapiens
atccccagcccctcctccctc

SEQ ID NO: 4433148 - DNA, 13 bp, Homo sapiens
atccccatctccc

SEQ ID NO: 4433149 - DNA, 18 bp, Homo sapiens
atccccatctccctgcct

SEQ ID NO: 4433150 - DNA, 19 bp, Homo sapiens
atccccatctccctgcctg

SEQ ID NO: 4433151 - DNA, 20 bp, Homo sapiens
atccccatctccctgcctgg

SEQ ID NO: 4433152 - DNA, 13 bp, Homo sapiens
atcccccctgctc

SEQ ID NO: 4433153 - DNA, 15 bp, Homo sapiens
atcccccctgctcag

SEQ ID NO: 4433154 - DNA, 14 bp, Homo sapiens
atcccccttgccac

SEQ ID NO: 4433155 - DNA, 13 bp, Homo sapiens
atcccctcaggac

SEQ ID NO: 4433156 - DNA, 19 bp, Homo sapiens
atccccttcccccatccct

SEQ ID NO: 4433157 - DNA, 17 bp, Homo sapiens
atcccgagcacctccac

SEQ ID NO: 4433158 - DNA, 15 bp, Homo sapiens
atcccgtatcacagt

SEQ ID NO: 4433159 - DNA, 17 bp, Homo sapiens
atcccgtatcacagtgt

SEQ ID NO: 4433160 - DNA, 22 bp, Homo sapiens
atccctaccccctaagagccat

SEQ ID NO: 4433161 - DNA, 13 bp, Homo sapiens
atccctcatctgt

SEQ ID NO: 4433162 - DNA, 17 bp, Homo sapiens
atccctcatctgtccct

SEQ ID NO: 4433163 - DNA, 22 bp, Homo sapiens
atccctctacagagcttccctg

SEQ ID NO: 4433164 - DNA, 11 bp, Homo sapiens
atccctctctt

SEQ ID NO: 4433165 - DNA, 18 bp, Homo sapiens
atccctctcttccccttc

SEQ ID NO: 4433166 - DNA, 19 bp, Homo sapiens
atccctctcttccccttcc

SEQ ID NO: 4433167 - DNA, 22 bp, Homo sapiens
atccctctcttccccttccctt

SEQ ID NO: 4433168 - DNA, 20 bp, Homo sapiens
atccctgaatcccccttgcc

SEQ ID NO: 4433169 - DNA, 18 bp, Homo sapiens
atccctgactggccaaac

SEQ ID NO: 4433170 - DNA, 15 bp, Homo sapiens
atccctgaggactga

SEQ ID NO: 4433171 - DNA, 15 bp, Homo sapiens
atccctgcctcaggc

SEQ ID NO: 4433172 - DNA, 23 bp, Homo sapiens
atatcttggcctaaacctcagtt

SEQ ID NO: 4433173 - DNA, 14 bp, Homo sapiens
atatcttgtttaca

SEQ ID NO: 4433174 - DNA, 18 bp, Homo sapiens
atatcttgtttacaataa

SEQ ID NO: 4433175 - DNA, 16 bp, Homo sapiens
atatgaaaatacaact

SEQ ID NO: 4433176 - DNA, 20 bp, Homo sapiens
atatgaacatattgttgaaa

SEQ ID NO: 4433177 - DNA, 18 bp, Homo sapiens
atatgaaccctttgtttc

SEQ ID NO: 4433178 - DNA, 19 bp, Homo sapiens
atatgaaccctttgtttct

SEQ ID NO: 4433179 - DNA, 20 bp, Homo sapiens
atatgaccagaagccttgga

SEQ ID NO: 4433180 - DNA, 15 bp, Homo sapiens
atatgagaagaatag

SEQ ID NO: 4433181 - DNA, 13 bp, Homo sapiens
atatgatatgcat

SEQ ID NO: 4433182 - DNA, 15 bp, Homo sapiens
atatgatctgtctgt

SEQ ID NO: 4433183 - DNA, 12 bp, Homo sapiens
atatgatgagca

SEQ ID NO: 4433184 - DNA, 14 bp, Homo sapiens
atatgattggttca

SEQ ID NO: 4433185 - DNA, 15 bp, Homo sapiens
atatgcaaagcactg

SEQ ID NO: 4433186 - DNA, 23 bp, Homo sapiens
atatgcaaagcactgacttctaa

SEQ ID NO: 4433187 - DNA, 13 bp, Homo sapiens
atatgcaagcagc

SEQ ID NO: 4433188 - DNA, 16 bp, Homo sapiens
atatgcaagcagcttt

SEQ ID NO: 4433189 - DNA, 19 bp, Homo sapiens
atatgcacaaaactacttt

SEQ ID NO: 4433190 - DNA, 13 bp, Homo sapiens
atatgcacttata

SEQ ID NO: 4433191 - DNA, 14 bp, Homo sapiens
atatgcatatttgt

SEQ ID NO: 4433192 - DNA, 11 bp, Homo sapiens
atatgcatgta

SEQ ID NO: 4433193 - DNA, 17 bp, Homo sapiens
atatgcatgtagcatat

SEQ ID NO: 4433194 - DNA, 21 bp, Homo sapiens
atatgcatgtagcatataaat

SEQ ID NO: 4433195 - DNA, 23 bp, Homo sapiens
atatgccttggaggaaatgtgct

SEQ ID NO: 4433196 - DNA, 20 bp, Homo sapiens
atatgctgtatttctttgta

SEQ ID NO: 4433197 - DNA, 12 bp, Homo sapiens
atatggaacctt

SEQ ID NO: 4433198 - DNA, 19 bp, Homo sapiens
atatggaaccttccctcca

SEQ ID NO: 4433199 - DNA, 15 bp, Homo sapiens
atatggaagaaagta

SEQ ID NO: 4433200 - DNA, 16 bp, Homo sapiens
atatggaagcaaccag

SEQ ID NO: 4433201 - DNA, 15 bp, Homo sapiens
atatggacacttaat

SEQ ID NO: 4433202 - DNA, 15 bp, Homo sapiens
atatggaggattctt

SEQ ID NO: 4433203 - DNA, 11 bp, Homo sapiens
atatggctgcc

SEQ ID NO: 4433204 - DNA, 17 bp, Homo sapiens
atatgggggaaaattat

SEQ ID NO: 4433205 - DNA, 18 bp, Homo sapiens
atatgggggaaaattatt

SEQ ID NO: 4433206 - DNA, 21 bp, Homo sapiens
atatgggggcatctcttcccc

SEQ ID NO: 4433207 - DNA, 19 bp, Homo sapiens
atatggtcatatacatatt

SEQ ID NO: 4433208 - DNA, 13 bp, Homo sapiens
atatgtaaaacat

SEQ ID NO: 4433209 - DNA, 18 bp, Homo sapiens
atatgtaaaacatttatt

SEQ ID NO: 4433210 - DNA, 11 bp, Homo sapiens
atatgtaaatg

SEQ ID NO: 4433211 - DNA, 18 bp, Homo sapiens
atatgtaaatgtgttagc

SEQ ID NO: 4433212 - DNA, 23 bp, Homo sapiens
atatgtacctaacgaagtatcct

SEQ ID NO: 4433213 - DNA, 14 bp, Homo sapiens
atatgtactgtata

SEQ ID NO: 4433214 - DNA, 18 bp, Homo sapiens
atatgtagccttcacaca

SEQ ID NO: 4433215 - DNA, 13 bp, Homo sapiens
atatgtatgtaaa

SEQ ID NO: 4433216 - DNA, 14 bp, Homo sapiens
atatgtatttaaga

SEQ ID NO: 4433217 - DNA, 22 bp, Homo sapiens
atatgtatttaagatgtacatt

SEQ ID NO: 4433218 - DNA, 16 bp, Homo sapiens
atatgtccactgttct

SEQ ID NO: 4433219 - DNA, 11 bp, Homo sapiens
atatgtctttt

SEQ ID NO: 4433220 - DNA, 15 bp, Homo sapiens
atatgtgaaacattt

SEQ ID NO: 4433221 - DNA, 14 bp, Homo sapiens
atatgtgaagtttt

SEQ ID NO: 4433222 - DNA, 22 bp, Homo sapiens
atatgtgaagttttccttgcta

SEQ ID NO: 4433223 - DNA, 15 bp, Homo sapiens
atatgtgtatacata

SEQ ID NO: 4433224 - DNA, 14 bp, Homo sapiens
atatgtgttgaaaa

SEQ ID NO: 4433225 - DNA, 18 bp, Homo sapiens
atatgtgttgaaaaccaa

SEQ ID NO: 4433226 - DNA, 20 bp, Homo sapiens
atatgtgttgaaaaccaaaa

SEQ ID NO: 4433227 - DNA, 21 bp, Homo sapiens
atatgttcaccaggagattac

SEQ ID NO: 4433228 - DNA, 16 bp, Homo sapiens
atatgttgaatacttt

SEQ ID NO: 4433229 - DNA, 17 bp, Homo sapiens
atatgttgaatactttt

SEQ ID NO: 4433230 - DNA, 18 bp, Homo sapiens
atatgttgaatacttttt

SEQ ID NO: 4433231 - DNA, 22 bp, Homo sapiens
atatgtttagttttacatttta

SEQ ID NO: 4433232 - DNA, 21 bp, Homo sapiens
atatgtttatattctttctta

SEQ ID NO: 4433233 - DNA, 12 bp, Homo sapiens
atattaaaaaac

SEQ ID NO: 4433234 - DNA, 15 bp, Homo sapiens
atattaaaattccaa

SEQ ID NO: 4433235 - DNA, 20 bp, Homo sapiens
atattaaacaaagtttcaga

SEQ ID NO: 4433236 - DNA, 23 bp, Homo sapiens
atattaaacatacataatacaat

SEQ ID NO: 4433237 - DNA, 21 bp, Homo sapiens
atattaaagatttatttagct

SEQ ID NO: 4433238 - DNA, 22 bp, Homo sapiens
atattaaagatttatttagcta

SEQ ID NO: 4433239 - DNA, 17 bp, Homo sapiens
atattaaaggtgaaaat

SEQ ID NO: 4433240 - DNA, 20 bp, Homo sapiens
atattaaaggtgaaaattgt

SEQ ID NO: 4433241 - DNA, 13 bp, Homo sapiens
atattaaataata

SEQ ID NO: 4433242 - DNA, 12 bp, Homo sapiens
atattaaatctg

SEQ ID NO: 4433243 - DNA, 20 bp, Homo sapiens
atattaaatgagggtttctg

SEQ ID NO: 4433244 - DNA, 16 bp, Homo sapiens
atattaatataagttt

SEQ ID NO: 4433245 - DNA, 19 bp, Homo sapiens
atattaatataagtttctt

SEQ ID NO: 4433246 - DNA, 15 bp, Homo sapiens
atattacaacattta

SEQ ID NO: 4433247 - DNA, 17 bp, Homo sapiens
atattacctaatgaaag

SEQ ID NO: 4433248 - DNA, 15 bp, Homo sapiens
atattacctggatta

SEQ ID NO: 4433249 - DNA, 21 bp, Homo sapiens
atattactctagtttattcta

SEQ ID NO: 4433250 - DNA, 13 bp, Homo sapiens
atattagatcaaa

SEQ ID NO: 4433251 - DNA, 14 bp, Homo sapiens
atattagcaaagaa

SEQ ID NO: 4433252 - DNA, 19 bp, Homo sapiens
atattaggccagttgaagt

SEQ ID NO: 4433253 - DNA, 13 bp, Homo sapiens
atattagttgctt

SEQ ID NO: 4433254 - DNA, 20 bp, Homo sapiens
atattataactctgtataat

SEQ ID NO: 4433255 - DNA, 13 bp, Homo sapiens
atattatatacat

SEQ ID NO: 4433256 - DNA, 14 bp, Homo sapiens
atattatatacata

SEQ ID NO: 4433257 - DNA, 13 bp, Homo sapiens
atattatgtgaag

SEQ ID NO: 4433258 - DNA, 18 bp, Homo sapiens
atattatgtttaattatt

SEQ ID NO: 4433259 - DNA, 18 bp, Homo sapiens
atattatgtttatttcat

SEQ ID NO: 4433260 - DNA, 23 bp, Homo sapiens
atattattataatcttataattg

SEQ ID NO: 4433261 - DNA, 15 bp, Homo sapiens
atattatttgtctta

SEQ ID NO: 4433262 - DNA, 22 bp, Homo sapiens
atattattttagtgtgtaaaat

SEQ ID NO: 4433263 - DNA, 14 bp, Homo sapiens
atattcaaattcat

SEQ ID NO: 4433264 - DNA, 16 bp, Homo sapiens
atattcacagactgat

SEQ ID NO: 4433265 - DNA, 19 bp, Homo sapiens
atattcactggttttacac

SEQ ID NO: 4433266 - DNA, 20 bp, Homo sapiens
atattcactggttttacaca

SEQ ID NO: 4433267 - DNA, 13 bp, Homo sapiens
atattcagaaatt

SEQ ID NO: 4433268 - DNA, 16 bp, Homo sapiens
atattcagacaaaatg

SEQ ID NO: 4433269 - DNA, 17 bp, Homo sapiens
atattcagccagcttaa

SEQ ID NO: 4433270 - DNA, 20 bp, Homo sapiens
atattcagccagcttaaacc

SEQ ID NO: 4433271 - DNA, 19 bp, Homo sapiens
atattcatattggaaaaat

SEQ ID NO: 4433272 - DNA, 21 bp, Homo sapiens
atattcatctaataaatcagt

SEQ ID NO: 4433273 - DNA, 17 bp, Homo sapiens
atattcctttttctatg

SEQ ID NO: 4433274 - DNA, 19 bp, Homo sapiens
atattctaatagtttttca

SEQ ID NO: 4433275 - DNA, 18 bp, Homo sapiens
atattctctattttactt

SEQ ID NO: 4433276 - DNA, 14 bp, Homo sapiens
atattgaaaattga

SEQ ID NO: 4433277 - DNA, 16 bp, Homo sapiens
atattgaaaattgaaa

SEQ ID NO: 4433278 - DNA, 20 bp, Homo sapiens
atattgaaaattgaaaagta

SEQ ID NO: 4433279 - DNA, 19 bp, Homo sapiens
atattgaaagttgctttta

SEQ ID NO: 4433280 - DNA, 12 bp, Homo sapiens
atattgaacttt

SEQ ID NO: 4433281 - DNA, 20 bp, Homo sapiens
atattgaacttttgtactga

SEQ ID NO: 4433282 - DNA, 12 bp, Homo sapiens
atattgaatgtg

SEQ ID NO: 4433283 - DNA, 14 bp, Homo sapiens
atattgaatgtgaa

SEQ ID NO: 4433284 - DNA, 18 bp, Homo sapiens
atattgactcaaaccata

SEQ ID NO: 4433285 - DNA, 14 bp, Homo sapiens
atattgagcaatat

SEQ ID NO: 4433286 - DNA, 20 bp, Homo sapiens
atattgagcaatatgtcagt

SEQ ID NO: 4433287 - DNA, 13 bp, Homo sapiens
atattgagcagaa

SEQ ID NO: 4433288 - DNA, 14 bp, Homo sapiens
atattgagcagaat

SEQ ID NO: 4433289 - DNA, 16 bp, Homo sapiens
atattgagcagaattc

SEQ ID NO: 4433290 - DNA, 17 bp, Homo sapiens
atattgatctttttatc

SEQ ID NO: 4433291 - DNA, 18 bp, Homo sapiens
atattgatctttttatca

SEQ ID NO: 4433292 - DNA, 13 bp, Homo sapiens
atattgctactat

SEQ ID NO: 4433293 - DNA, 22 bp, Homo sapiens
atattgctactataatcaaatg

SEQ ID NO: 4433294 - DNA, 22 bp, Homo sapiens
atataagtctatactaatgctt

SEQ ID NO: 4433295 - DNA, 13 bp, Homo sapiens
atataataaagaa

SEQ ID NO: 4433296 - DNA, 14 bp, Homo sapiens
atataataaagtat

SEQ ID NO: 4433297 - DNA, 15 bp, Homo sapiens
atataataaagtatt

SEQ ID NO: 4433298 - DNA, 17 bp, Homo sapiens
atataataaagtattcc

SEQ ID NO: 4433299 - DNA, 14 bp, Homo sapiens
atataataaatact

SEQ ID NO: 4433300 - DNA, 18 bp, Homo sapiens
atataataaatactcagt

SEQ ID NO: 4433301 - DNA, 13 bp, Homo sapiens
atataatacatat

SEQ ID NO: 4433302 - DNA, 13 bp, Homo sapiens
atataatatacta

SEQ ID NO: 4433303 - DNA, 20 bp, Homo sapiens
atataatatctaaagttata

SEQ ID NO: 4433304 - DNA, 20 bp, Homo sapiens
atataatattcagccagctt

SEQ ID NO: 4433305 - DNA, 16 bp, Homo sapiens
atataatcatgctcat

SEQ ID NO: 4433306 - DNA, 16 bp, Homo sapiens
atataatgtattttct

SEQ ID NO: 4433307 - DNA, 12 bp, Homo sapiens
atataatgtgtg

SEQ ID NO: 4433308 - DNA, 21 bp, Homo sapiens
atataatttaatgtaaataaa

SEQ ID NO: 4433309 - DNA, 22 bp, Homo sapiens
atataatttatttccactaaaa

SEQ ID NO: 4433310 - DNA, 18 bp, Homo sapiens
atatacatactgcatctt

SEQ ID NO: 4433311 - DNA, 14 bp, Homo sapiens
atataccaaattaa

SEQ ID NO: 4433312 - DNA, 19 bp, Homo sapiens
atataccaaattaaaaaaa

SEQ ID NO: 4433313 - DNA, 16 bp, Homo sapiens
atataccccaaattgt

SEQ ID NO: 4433314 - DNA, 21 bp, Homo sapiens
atataccttatttatttttgt

SEQ ID NO: 4433315 - DNA, 22 bp, Homo sapiens
atatactaaaccaactctaata

SEQ ID NO: 4433316 - DNA, 16 bp, Homo sapiens
atatacttgactctaa

SEQ ID NO: 4433317 - DNA, 15 bp, Homo sapiens
atatactttactttt

SEQ ID NO: 4433318 - DNA, 18 bp, Homo sapiens
atatactttactttttcc

SEQ ID NO: 4433319 - DNA, 17 bp, Homo sapiens
atatactttttcatgaa

SEQ ID NO: 4433320 - DNA, 17 bp, Homo sapiens
atatagaatttcctgta

SEQ ID NO: 4433321 - DNA, 21 bp, Homo sapiens
atatagaatttcctgtaatat

SEQ ID NO: 4433322 - DNA, 13 bp, Homo sapiens
atatagctggcaa

SEQ ID NO: 4433323 - DNA, 21 bp, Homo sapiens
atataggtcctgtgttaaaca

SEQ ID NO: 4433324 - DNA, 18 bp, Homo sapiens
atatagtgaaaaatgtca

SEQ ID NO: 4433325 - DNA, 23 bp, Homo sapiens
atatagtggatgatatacacagt

SEQ ID NO: 4433326 - DNA, 18 bp, Homo sapiens
atatagtgggtacatcaa

SEQ ID NO: 4433327 - DNA, 23 bp, Homo sapiens
atatagttttacttttaaactgt

SEQ ID NO: 4433328 - DNA, 16 bp, Homo sapiens
atatataaagaatata

SEQ ID NO: 4433329 - DNA, 16 bp, Homo sapiens
atatataactatttta

SEQ ID NO: 4433330 - DNA, 13 bp, Homo sapiens
atatataatttaa

SEQ ID NO: 4433331 - DNA, 21 bp, Homo sapiens
atatataatttaatgtaaata

SEQ ID NO: 4433332 - DNA, 22 bp, Homo sapiens
atatatacacattagaaatatt

SEQ ID NO: 4433333 - DNA, 14 bp, Homo sapiens
atatatagtcaaat

SEQ ID NO: 4433334 - DNA, 11 bp, Homo sapiens
atatatatata

SEQ ID NO: 4433335 - DNA, 14 bp, Homo sapiens
atatatatataaag

SEQ ID NO: 4433336 - DNA, 16 bp, Homo sapiens
atatatatatatataa

SEQ ID NO: 4433337 - DNA, 21 bp, Homo sapiens
atatatatctatctatttgag

SEQ ID NO: 4433338 - DNA, 20 bp, Homo sapiens
atatatatggtcatatacat

SEQ ID NO: 4433339 - DNA, 18 bp, Homo sapiens
atatatattcatatacaa

SEQ ID NO: 4433340 - DNA, 14 bp, Homo sapiens
atatatcaaagcag

SEQ ID NO: 4433341 - DNA, 19 bp, Homo sapiens
atatatcctgaaagcatta

SEQ ID NO: 4433342 - DNA, 15 bp, Homo sapiens
atatatctatctatt

SEQ ID NO: 4433343 - DNA, 16 bp, Homo sapiens
atatatctatctattt

SEQ ID NO: 4433344 - DNA, 18 bp, Homo sapiens
atatatctatctatttga

SEQ ID NO: 4433345 - DNA, 20 bp, Homo sapiens
atatatctatctatttgagg

SEQ ID NO: 4433346 - DNA, 20 bp, Homo sapiens
atatatgaagacaataattc

SEQ ID NO: 4433347 - DNA, 13 bp, Homo sapiens
atatatggatcag

SEQ ID NO: 4433348 - DNA, 17 bp, Homo sapiens
atatatggcatttgcag

SEQ ID NO: 4433349 - DNA, 18 bp, Homo sapiens
atatatgggggaaaatta

SEQ ID NO: 4433350 - DNA, 19 bp, Homo sapiens
atatatgggggaaaattat

SEQ ID NO: 4433351 - DNA, 10 bp, Homo sapiens
atatatgtat

SEQ ID NO: 4433352 - DNA, 12 bp, Homo sapiens
atatatgtatgt

SEQ ID NO: 4433353 - DNA, 16 bp, Homo sapiens
atatatgtatgtaaaa

SEQ ID NO: 4433354 - DNA, 12 bp, Homo sapiens
atatatgtgtat

SEQ ID NO: 4433355 - DNA, 17 bp, Homo sapiens
atatatgtgtatacata

SEQ ID NO: 4433356 - DNA, 13 bp, Homo sapiens
atatattaaaaca

SEQ ID NO: 4433357 - DNA, 24 bp, Homo sapiens
atatattaaaacaataatgcaatt

SEQ ID NO: 4433358 - DNA, 13 bp, Homo sapiens
atatattataagt

SEQ ID NO: 4433359 - DNA, 14 bp, Homo sapiens
atatattatataca

SEQ ID NO: 4433360 - DNA, 14 bp, Homo sapiens
atatattattataa

SEQ ID NO: 4433361 - DNA, 19 bp, Homo sapiens
atatattcccaagctgaat

SEQ ID NO: 4433362 - DNA, 13 bp, Homo sapiens
atatattgaactt

SEQ ID NO: 4433363 - DNA, 18 bp, Homo sapiens
atatattgaacttttgta

SEQ ID NO: 4433364 - DNA, 14 bp, Homo sapiens
atatattgtaaaga

SEQ ID NO: 4433365 - DNA, 16 bp, Homo sapiens
atatatttaaaaataa

SEQ ID NO: 4433366 - DNA, 14 bp, Homo sapiens
atatatttacagaa

SEQ ID NO: 4433367 - DNA, 13 bp, Homo sapiens
atatatttgaaat

SEQ ID NO: 4433368 - DNA, 15 bp, Homo sapiens
atatatttgcagtat

SEQ ID NO: 4433369 - DNA, 12 bp, Homo sapiens
atatattttcat

SEQ ID NO: 4433370 - DNA, 16 bp, Homo sapiens
atatattttctttcta

SEQ ID NO: 4433371 - DNA, 19 bp, Homo sapiens
atatcaaaaaacctttaca

SEQ ID NO: 4433372 - DNA, 17 bp, Homo sapiens
atatcaaagagaagatg

SEQ ID NO: 4433373 - DNA, 23 bp, Homo sapiens
atatcaaagagaagatgcctgtt

SEQ ID NO: 4433374 - DNA, 17 bp, Homo sapiens
atatcacacaatatagt

SEQ ID NO: 4433375 - DNA, 23 bp, Homo sapiens
atatcactaaataaacacgattt

SEQ ID NO: 4433376 - DNA, 12 bp, Homo sapiens
atatcactgtct

SEQ ID NO: 4433377 - DNA, 15 bp, Homo sapiens
atatcagagctggga

SEQ ID NO: 4433378 - DNA, 14 bp, Homo sapiens
atatcagctttgat

SEQ ID NO: 4433379 - DNA, 19 bp, Homo sapiens
atatcagctttgataattg

SEQ ID NO: 4433380 - DNA, 20 bp, Homo sapiens
atatcagctttgataattgt

SEQ ID NO: 4433381 - DNA, 17 bp, Homo sapiens
atatcagggcacagtct

SEQ ID NO: 4433382 - DNA, 18 bp, Homo sapiens
atatcagtattctgacat

SEQ ID NO: 4433383 - DNA, 13 bp, Homo sapiens
atatcataactat

SEQ ID NO: 4433384 - DNA, 14 bp, Homo sapiens
atatcatctgtcat

SEQ ID NO: 4433385 - DNA, 21 bp, Homo sapiens
atatcatctgtcattatattc

SEQ ID NO: 4433386 - DNA, 13 bp, Homo sapiens
atatcatgcaaaa

SEQ ID NO: 4433387 - DNA, 20 bp, Homo sapiens
atatcatgcaaaatatgttt

SEQ ID NO: 4433388 - DNA, 18 bp, Homo sapiens
atatcattaaacaaataa

SEQ ID NO: 4433389 - DNA, 12 bp, Homo sapiens
atatcatttctt

SEQ ID NO: 4433390 - DNA, 13 bp, Homo sapiens
atatcatttttat

SEQ ID NO: 4433391 - DNA, 15 bp, Homo sapiens
atatccatttatctt

SEQ ID NO: 4433392 - DNA, 18 bp, Homo sapiens
atatccatttatcttttg

SEQ ID NO: 4433393 - DNA, 23 bp, Homo sapiens
atatccctcccctctctccctgg

SEQ ID NO: 4433394 - DNA, 23 bp, Homo sapiens
atatcccttggacattttatgtc

SEQ ID NO: 4433395 - DNA, 15 bp, Homo sapiens
atatcctaaacatca

SEQ ID NO: 4433396 - DNA, 22 bp, Homo sapiens
atatcctaaacatcattcattt

SEQ ID NO: 4433397 - DNA, 19 bp, Homo sapiens
atatcctctccccctcctc

SEQ ID NO: 4433398 - DNA, 19 bp, Homo sapiens
atatcctgtgtacctcact

SEQ ID NO: 4433399 - DNA, 12 bp, Homo sapiens
atatctaacttt

SEQ ID NO: 4433400 - DNA, 13 bp, Homo sapiens
atatctaactttg

SEQ ID NO: 4433401 - DNA, 22 bp, Homo sapiens
atatctaagcaagtgaactcat

SEQ ID NO: 4433402 - DNA, 21 bp, Homo sapiens
atatctaccccagactagatg

SEQ ID NO: 4433403 - DNA, 14 bp, Homo sapiens
atatctatctattt

SEQ ID NO: 4433404 - DNA, 16 bp, Homo sapiens
atatctatctatttga

SEQ ID NO: 4433405 - DNA, 17 bp, Homo sapiens
atatctatctatttgag

SEQ ID NO: 4433406 - DNA, 12 bp, Homo sapiens
atatctattatt

SEQ ID NO: 4433407 - DNA, 13 bp, Homo sapiens
atatctcctgaaa

SEQ ID NO: 4433408 - DNA, 23 bp, Homo sapiens
atatctcctgaaaaggtttatga

SEQ ID NO: 4433409 - DNA, 11 bp, Homo sapiens
atatctcttgg

SEQ ID NO: 4433410 - DNA, 15 bp, Homo sapiens
atatctcttggaaaa

SEQ ID NO: 4433411 - DNA, 14 bp, Homo sapiens
atatctgagcaagg

SEQ ID NO: 4433412 - DNA, 14 bp, Homo sapiens
atatctgattgttg

SEQ ID NO: 4433413 - DNA, 17 bp, Homo sapiens
atatctgttcccagccc

SEQ ID NO: 4433414 - DNA, 23 bp, Homo sapiens
atatcttcccatttaacattgtt

SEQ ID NO: 4433415 - DNA, 19 bp, Homo sapiens
atatcttggacaaatcaca

SEQ ID NO: 4433416 - DNA, 19 bp, Homo sapiens
atacgagagcagaggtctc

SEQ ID NO: 4433417 - DNA, 21 bp, Homo sapiens
atacgtatgcatttttttagt

SEQ ID NO: 4433418 - DNA, 17 bp, Homo sapiens
atacgtgccagatataa

SEQ ID NO: 4433419 - DNA, 20 bp, Homo sapiens
atacgtgccagatataactg

SEQ ID NO: 4433420 - DNA, 18 bp, Homo sapiens
atacgtgtcaatgtgtgc

SEQ ID NO: 4433421 - DNA, 17 bp, Homo sapiens
atactaaaaagaagtgc

SEQ ID NO: 4433422 - DNA, 19 bp, Homo sapiens
atactaaaaagaagtgctg

SEQ ID NO: 4433423 - DNA, 21 bp, Homo sapiens
atactaaaccaactctaatat

SEQ ID NO: 4433424 - DNA, 13 bp, Homo sapiens
atactcctgtcac

SEQ ID NO: 4433425 - DNA, 14 bp, Homo sapiens
atactcttctaaaa

SEQ ID NO: 4433426 - DNA, 15 bp, Homo sapiens
atactctttctgtat

SEQ ID NO: 4433427 - DNA, 23 bp, Homo sapiens
atactctttctgtatatactttt

SEQ ID NO: 4433428 - DNA, 17 bp, Homo sapiens
atactgaaccaggccag

SEQ ID NO: 4433429 - DNA, 20 bp, Homo sapiens
atactgaaggaaaaacacaa

SEQ ID NO: 4433430 - DNA, 18 bp, Homo sapiens
atactgacagaagttatt

SEQ ID NO: 4433431 - DNA, 22 bp, Homo sapiens
atactgactgctggacataaat

SEQ ID NO: 4433432 - DNA, 13 bp, Homo sapiens
atactgagctttt

SEQ ID NO: 4433433 - DNA, 15 bp, Homo sapiens
atactgcaactttaa

SEQ ID NO: 4433434 - DNA, 21 bp, Homo sapiens
atactgcatactttttaaatg

SEQ ID NO: 4433435 - DNA, 20 bp, Homo sapiens
atactgccttgtttaatggt

SEQ ID NO: 4433436 - DNA, 15 bp, Homo sapiens
atactggcacagagg

SEQ ID NO: 4433437 - DNA, 21 bp, Homo sapiens
atactggtgcagtcattatga

SEQ ID NO: 4433438 - DNA, 20 bp, Homo sapiens
atactgtacaataaaaacat

SEQ ID NO: 4433439 - DNA, 16 bp, Homo sapiens
atactgtacacatttc

SEQ ID NO: 4433440 - DNA, 20 bp, Homo sapiens
atactgtacacatttcttaa

SEQ ID NO: 4433441 - DNA, 23 bp, Homo sapiens
atactgtcttacgtttttctggt

SEQ ID NO: 4433442 - DNA, 19 bp, Homo sapiens
atactgttttaaaatgtga

SEQ ID NO: 4433443 - DNA, 20 bp, Homo sapiens
atacttaacacgtgaatatt

SEQ ID NO: 4433444 - DNA, 15 bp, Homo sapiens
atacttaacatttca

SEQ ID NO: 4433445 - DNA, 16 bp, Homo sapiens
atacttaacatttcat

SEQ ID NO: 4433446 - DNA, 22 bp, Homo sapiens
atacttaacatttcattgtaca

SEQ ID NO: 4433447 - DNA, 14 bp, Homo sapiens
atacttacagactg

SEQ ID NO: 4433448 - DNA, 18 bp, Homo sapiens
atacttagcaaaaagtgg

SEQ ID NO: 4433449 - DNA, 23 bp, Homo sapiens
atacttagcaaaaagtggggcag

SEQ ID NO: 4433450 - DNA, 16 bp, Homo sapiens
atacttatctctctgt

SEQ ID NO: 4433451 - DNA, 17 bp, Homo sapiens
atacttatctctctgtg

SEQ ID NO: 4433452 - DNA, 21 bp, Homo sapiens
atacttattaaaaaatttgta

SEQ ID NO: 4433453 - DNA, 17 bp, Homo sapiens
atacttcagctttgtgt

SEQ ID NO: 4433454 - DNA, 20 bp, Homo sapiens
atacttcagctttgtgtatc

SEQ ID NO: 4433455 - DNA, 18 bp, Homo sapiens
atacttgaacaaaagggt

SEQ ID NO: 4433456 - DNA, 12 bp, Homo sapiens
atacttgactct

SEQ ID NO: 4433457 - DNA, 17 bp, Homo sapiens
atacttgactctaatat

SEQ ID NO: 4433458 - DNA, 19 bp, Homo sapiens
atacttgactctaatatga

SEQ ID NO: 4433459 - DNA, 22 bp, Homo sapiens
atacttggatttagtttcagta

SEQ ID NO: 4433460 - DNA, 19 bp, Homo sapiens
atactttaaataatttaac

SEQ ID NO: 4433461 - DNA, 20 bp, Homo sapiens
atactttaaataatttaact

SEQ ID NO: 4433462 - DNA, 12 bp, Homo sapiens
atactttacagt

SEQ ID NO: 4433463 - DNA, 14 bp, Homo sapiens
atactttacttttt

SEQ ID NO: 4433464 - DNA, 17 bp, Homo sapiens
atactttactttttcca

SEQ ID NO: 4433465 - DNA, 14 bp, Homo sapiens
atactttatttctg

SEQ ID NO: 4433466 - DNA, 22 bp, Homo sapiens
atactttcaggggtggcccaat

SEQ ID NO: 4433467 - DNA, 21 bp, Homo sapiens
atactttcatcctgactctgc

SEQ ID NO: 4433468 - DNA, 16 bp, Homo sapiens
atactttctatgtgac

SEQ ID NO: 4433469 - DNA, 17 bp, Homo sapiens
atactttcttttattaa

SEQ ID NO: 4433470 - DNA, 18 bp, Homo sapiens
atactttgcaatccaaat

SEQ ID NO: 4433471 - DNA, 16 bp, Homo sapiens
atactttgtggaccaa

SEQ ID NO: 4433472 - DNA, 16 bp, Homo sapiens
atacttttgccctttg

SEQ ID NO: 4433473 - DNA, 13 bp, Homo sapiens
atactttttacaa

SEQ ID NO: 4433474 - DNA, 18 bp, Homo sapiens
atactttttcatgaaaat

SEQ ID NO: 4433475 - DNA, 19 bp, Homo sapiens
atagaaaaatgtataaaaa

SEQ ID NO: 4433476 - DNA, 22 bp, Homo sapiens
atagaaaacaggaaaaaaactt

SEQ ID NO: 4433477 - DNA, 13 bp, Homo sapiens
atagaaaattatt

SEQ ID NO: 4433478 - DNA, 19 bp, Homo sapiens
atagaaacgtaaactatga

SEQ ID NO: 4433479 - DNA, 12 bp, Homo sapiens
atagaaagaata

SEQ ID NO: 4433480 - DNA, 22 bp, Homo sapiens
atagaaagaataaaatgtttct

SEQ ID NO: 4433481 - DNA, 22 bp, Homo sapiens
atagaaataaaggatgtgattg

SEQ ID NO: 4433482 - DNA, 22 bp, Homo sapiens
atagaaatgctggtttttcagt

SEQ ID NO: 4433483 - DNA, 15 bp, Homo sapiens
atagaacaagatgca

SEQ ID NO: 4433484 - DNA, 20 bp, Homo sapiens
atagaacattgatctgtttt

SEQ ID NO: 4433485 - DNA, 20 bp, Homo sapiens
atagaataaaggcagttttc

SEQ ID NO: 4433486 - DNA, 17 bp, Homo sapiens
atagaattatattttct

SEQ ID NO: 4433487 - DNA, 14 bp, Homo sapiens
atagacaaaagaat

SEQ ID NO: 4433488 - DNA, 20 bp, Homo sapiens
atagacaaaagaataagaca

SEQ ID NO: 4433489 - DNA, 15 bp, Homo sapiens
atagacaaaggcctt

SEQ ID NO: 4433490 - DNA, 16 bp, Homo sapiens
atagacaaaggcctta

SEQ ID NO: 4433491 - DNA, 21 bp, Homo sapiens
atagacaaaggccttaacaaa

SEQ ID NO: 4433492 - DNA, 14 bp, Homo sapiens
atagacaagttttg

SEQ ID NO: 4433493 - DNA, 14 bp, Homo sapiens
atagacaattgagg

SEQ ID NO: 4433494 - DNA, 11 bp, Homo sapiens
atagacacagt

SEQ ID NO: 4433495 - DNA, 22 bp, Homo sapiens
atagacactccccgaagtcttt

SEQ ID NO: 4433496 - DNA, 13 bp, Homo sapiens
atagacagaagaa

SEQ ID NO: 4433497 - DNA, 22 bp, Homo sapiens
agttgttgtttgccaagctaat

SEQ ID NO: 4433498 - DNA, 19 bp, Homo sapiens
agtttaaaaatcaactttt

SEQ ID NO: 4433499 - DNA, 20 bp, Homo sapiens
agtttaaaaatcaacttttt

SEQ ID NO: 4433500 - DNA, 16 bp, Homo sapiens
agtttaaatgagacta

SEQ ID NO: 4433501 - DNA, 18 bp, Homo sapiens
agtttaacttccactgtt

SEQ ID NO: 4433502 - DNA, 20 bp, Homo sapiens
agtttaacttccactgttaa

SEQ ID NO: 4433503 - DNA, 21 bp, Homo sapiens
agtttaagggtggaaaaatgc

SEQ ID NO: 4433504 - DNA, 17 bp, Homo sapiens
agtttaatacaggaaat

SEQ ID NO: 4433505 - DNA, 12 bp, Homo sapiens
agtttagggtgg

SEQ ID NO: 4433506 - DNA, 13 bp, Homo sapiens
agtttagggtggg

SEQ ID NO: 4433507 - DNA, 14 bp, Homo sapiens
agtttagggtgggg

SEQ ID NO: 4433508 - DNA, 16 bp, Homo sapiens
agtttatatttaactc

SEQ ID NO: 4433509 - DNA, 17 bp, Homo sapiens
agtttatcatgaagcct

SEQ ID NO: 4433510 - DNA, 19 bp, Homo sapiens
agtttatcatgaagcctgt

SEQ ID NO: 4433511 - DNA, 15 bp, Homo sapiens
agtttatcattcaag

SEQ ID NO: 4433512 - DNA, 15 bp, Homo sapiens
agtttatcttaagca

SEQ ID NO: 4433513 - DNA, 17 bp, Homo sapiens
agtttatggcagaaggg

SEQ ID NO: 4433514 - DNA, 16 bp, Homo sapiens
agtttattacaatgta

SEQ ID NO: 4433515 - DNA, 22 bp, Homo sapiens
agtttattgtttgatgttttta

SEQ ID NO: 4433516 - DNA, 13 bp, Homo sapiens
agtttatttcctg

SEQ ID NO: 4433517 - DNA, 12 bp, Homo sapiens
agtttatttctg

SEQ ID NO: 4433518 - DNA, 17 bp, Homo sapiens
agtttatttctgtgaaa

SEQ ID NO: 4433519 - DNA, 20 bp, Homo sapiens
agtttcaagttttaaagttc

SEQ ID NO: 4433520 - DNA, 16 bp, Homo sapiens
agtttcatgtatgtat

SEQ ID NO: 4433521 - DNA, 18 bp, Homo sapiens
agtttcatgtatgtatat

SEQ ID NO: 4433522 - DNA, 21 bp, Homo sapiens
agtttccgaatctctttccct

SEQ ID NO: 4433523 - DNA, 18 bp, Homo sapiens
agtttcctatgactaatt

SEQ ID NO: 4433524 - DNA, 12 bp, Homo sapiens
agtttcctggag

SEQ ID NO: 4433525 - DNA, 13 bp, Homo sapiens
agtttctattctg

SEQ ID NO: 4433526 - DNA, 21 bp, Homo sapiens
agtttctattctgtcagtgtt

SEQ ID NO: 4433527 - DNA, 12 bp, Homo sapiens
agtttctctgtt

SEQ ID NO: 4433528 - DNA, 23 bp, Homo sapiens
agtttctggattagcttttccta

SEQ ID NO: 4433529 - DNA, 22 bp, Homo sapiens
agtttctggtaagactgctggt

SEQ ID NO: 4433530 - DNA, 18 bp, Homo sapiens
agtttctgtttgattctt

SEQ ID NO: 4433531 - DNA, 13 bp, Homo sapiens
agtttcttgcttg

SEQ ID NO: 4433532 - DNA, 19 bp, Homo sapiens
agtttcttgtgtagatttg

SEQ ID NO: 4433533 - DNA, 21 bp, Homo sapiens
agtttgaaaagcaatattgta

SEQ ID NO: 4433534 - DNA, 18 bp, Homo sapiens
agtttgaaattctgaatt

SEQ ID NO: 4433535 - DNA, 19 bp, Homo sapiens
agtttgaaattctgaattt

SEQ ID NO: 4433536 - DNA, 20 bp, Homo sapiens
agtttgaagcacaactccct

SEQ ID NO: 4433537 - DNA, 23 bp, Homo sapiens
agtttgactttttggaattcagc

SEQ ID NO: 4433538 - DNA, 15 bp, Homo sapiens
agtttgagctgcctt

SEQ ID NO: 4433539 - DNA, 23 bp, Homo sapiens
agtttgagctgccttccctagct

SEQ ID NO: 4433540 - DNA, 14 bp, Homo sapiens
agtttgaggctgca

SEQ ID NO: 4433541 - DNA, 19 bp, Homo sapiens
agtttgaggctgcaatgag

SEQ ID NO: 4433542 - DNA, 16 bp, Homo sapiens
agtttgatcagacagc

SEQ ID NO: 4433543 - DNA, 20 bp, Homo sapiens
agtttgatcagacagcttga

SEQ ID NO: 4433544 - DNA, 17 bp, Homo sapiens
agtttgattattcagtg

SEQ ID NO: 4433545 - DNA, 20 bp, Homo sapiens
agtttgcaaacctgcagttt

SEQ ID NO: 4433546 - DNA, 20 bp, Homo sapiens
agtttgcagaaaagcacctg

SEQ ID NO: 4433547 - DNA, 22 bp, Homo sapiens
agtttgcagaaaagcacctgcc

SEQ ID NO: 4433548 - DNA, 20 bp, Homo sapiens
agtttgcctgcagtttcttg

SEQ ID NO: 4433549 - DNA, 17 bp, Homo sapiens
agtttggaaataaaaat

SEQ ID NO: 4433550 - DNA, 21 bp, Homo sapiens
agtttggagagtcagatcttt

SEQ ID NO: 4433551 - DNA, 20 bp, Homo sapiens
agtttggatatgtaaaacat

SEQ ID NO: 4433552 - DNA, 15 bp, Homo sapiens
agtttgggcatattt

SEQ ID NO: 4433553 - DNA, 19 bp, Homo sapiens
agtttgtaggtaaaatgta

SEQ ID NO: 4433554 - DNA, 21 bp, Homo sapiens
agtttgtaggtaaaatgtatt

SEQ ID NO: 4433555 - DNA, 22 bp, Homo sapiens
agtttgtaggtaaaatgtattt

SEQ ID NO: 4433556 - DNA, 22 bp, Homo sapiens
agtttgtatgccaagtgagaag

SEQ ID NO: 4433557 - DNA, 22 bp, Homo sapiens
agtttgtggtaaccagccctgc

SEQ ID NO: 4433558 - DNA, 12 bp, Homo sapiens
agtttgttaaag

SEQ ID NO: 4433559 - DNA, 19 bp, Homo sapiens
agtttgttaaagcctgttc

SEQ ID NO: 4433560 - DNA, 12 bp, Homo sapiens
agtttgttttag

SEQ ID NO: 4433561 - DNA, 11 bp, Homo sapiens
agttttaaagt

SEQ ID NO: 4433562 - DNA, 14 bp, Homo sapiens
agttttaataagaa

SEQ ID NO: 4433563 - DNA, 21 bp, Homo sapiens
agttttaataagaacagatca

SEQ ID NO: 4433564 - DNA, 15 bp, Homo sapiens
agttttaattaaaaa

SEQ ID NO: 4433565 - DNA, 15 bp, Homo sapiens
agttttactcttaaa

SEQ ID NO: 4433566 - DNA, 20 bp, Homo sapiens
agttttactcttaaatcatt

SEQ ID NO: 4433567 - DNA, 22 bp, Homo sapiens
agttttactcttaaatcatttg

SEQ ID NO: 4433568 - DNA, 15 bp, Homo sapiens
agttttactgtgatt

SEQ ID NO: 4433569 - DNA, 20 bp, Homo sapiens
agttttacttttaaactgtg

SEQ ID NO: 4433570 - DNA, 19 bp, Homo sapiens
agttttagttaaaactcat

SEQ ID NO: 4433571 - DNA, 16 bp, Homo sapiens
agttttatgccatgtt

SEQ ID NO: 4433572 - DNA, 19 bp, Homo sapiens
agttttattttatgtttag

SEQ ID NO: 4433573 - DNA, 18 bp, Homo sapiens
agttttcagaacctcttc

SEQ ID NO: 4433574 - DNA, 14 bp, Homo sapiens
agttttccctgcac

SEQ ID NO: 4433575 - DNA, 21 bp, Homo sapiens
agttttccctgcactgtgtca

SEQ ID NO: 4433576 - DNA, 19 bp, Homo sapiens
agttttccttgctatttca

SEQ ID NO: 4433577 - DNA, 20 bp, Homo sapiens
agttttccttgctatttcaa

SEQ ID NO: 4433578 - DNA, 13 bp, Homo sapiens
agttttctgagaa

SEQ ID NO: 4433579 - DNA, 18 bp, Homo sapiens
agttttctgagaaagact

SEQ ID NO: 4433580 - DNA, 16 bp, Homo sapiens
agttttcttcctttga

SEQ ID NO: 4433581 - DNA, 18 bp, Homo sapiens
agttttctttcctccttt

SEQ ID NO: 4433582 - DNA, 19 bp, Homo sapiens
agttttctttcctcctttc

SEQ ID NO: 4433583 - DNA, 16 bp, Homo sapiens
agttttgtaaaagaaa

SEQ ID NO: 4433584 - DNA, 22 bp, Homo sapiens
agttttgtaaaagaaatcatgt

SEQ ID NO: 4433585 - DNA, 21 bp, Homo sapiens
agttttgtgaaggtgatttat

SEQ ID NO: 4433586 - DNA, 16 bp, Homo sapiens
agttttgtttcacttt

SEQ ID NO: 4433587 - DNA, 22 bp, Homo sapiens
agtttttaaaaacctgtatctg

SEQ ID NO: 4433588 - DNA, 21 bp, Homo sapiens
agtttttaacaatctaacaat

SEQ ID NO: 4433589 - DNA, 21 bp, Homo sapiens
agtttttaattaaaaacttta

SEQ ID NO: 4433590 - DNA, 18 bp, Homo sapiens
agtttttagaatgttgaa

SEQ ID NO: 4433591 - DNA, 13 bp, Homo sapiens
agtttttatacca

SEQ ID NO: 4433592 - DNA, 17 bp, Homo sapiens
agtttttatatgttgta

SEQ ID NO: 4433593 - DNA, 18 bp, Homo sapiens
agtttttatgagaaactt

SEQ ID NO: 4433594 - DNA, 16 bp, Homo sapiens
agtttttattaatcta

SEQ ID NO: 4433595 - DNA, 14 bp, Homo sapiens
agttatcaggtgca

SEQ ID NO: 4433596 - DNA, 19 bp, Homo sapiens
agttatggctataggtgct

SEQ ID NO: 4433597 - DNA, 21 bp, Homo sapiens
agttatgtcttgtatttaaaa

SEQ ID NO: 4433598 - DNA, 20 bp, Homo sapiens
agttattacatgtaatttga

SEQ ID NO: 4433599 - DNA, 17 bp, Homo sapiens
agttattcaaatgaagg

SEQ ID NO: 4433600 - DNA, 19 bp, Homo sapiens
agttattccacaaacacat

SEQ ID NO: 4433601 - DNA, 14 bp, Homo sapiens
agttatttccaagt

SEQ ID NO: 4433602 - DNA, 15 bp, Homo sapiens
agttattttataggg

SEQ ID NO: 4433603 - DNA, 14 bp, Homo sapiens
agttattttctaca

SEQ ID NO: 4433604 - DNA, 16 bp, Homo sapiens
agttatttttctcttt

SEQ ID NO: 4433605 - DNA, 21 bp, Homo sapiens
agttcaacctggtggcaccag

SEQ ID NO: 4433606 - DNA, 13 bp, Homo sapiens
agttcaagaaata

SEQ ID NO: 4433607 - DNA, 16 bp, Homo sapiens
agttcaagcctgtggg

SEQ ID NO: 4433608 - DNA, 16 bp, Homo sapiens
agttcaattgtgaaaa

SEQ ID NO: 4433609 - DNA, 16 bp, Homo sapiens
agttcaatttcatgtt

SEQ ID NO: 4433610 - DNA, 18 bp, Homo sapiens
agttcacaaaaaaatgtt

SEQ ID NO: 4433611 - DNA, 22 bp, Homo sapiens
agttcacttctttgcagagcct

SEQ ID NO: 4433612 - DNA, 13 bp, Homo sapiens
agttcagatctta

SEQ ID NO: 4433613 - DNA, 17 bp, Homo sapiens
agttcagcaccacccta

SEQ ID NO: 4433614 - DNA, 21 bp, Homo sapiens
agttcagcacttgtctcattt

SEQ ID NO: 4433615 - DNA, 19 bp, Homo sapiens
agttcataacagtgccatt

SEQ ID NO: 4433616 - DNA, 19 bp, Homo sapiens
agttcatcaccatttcctc

SEQ ID NO: 4433617 - DNA, 17 bp, Homo sapiens
agttccacatctgtgga

SEQ ID NO: 4433618 - DNA, 17 bp, Homo sapiens
agttccacttccaggtc

SEQ ID NO: 4433619 - DNA, 16 bp, Homo sapiens
agttccagccttctct

SEQ ID NO: 4433620 - DNA, 19 bp, Homo sapiens
agttccatcaggtcccccc

SEQ ID NO: 4433621 - DNA, 19 bp, Homo sapiens
agttcccgggagctgggcc

SEQ ID NO: 4433622 - DNA, 14 bp, Homo sapiens
agttccctgaaaac

SEQ ID NO: 4433623 - DNA, 24 bp, Homo sapiens
agttccctgaaaacccagagagga

SEQ ID NO: 4433624 - DNA, 17 bp, Homo sapiens
agttccgcctcccgggt

SEQ ID NO: 4433625 - DNA, 12 bp, Homo sapiens
agttcctcgccc

SEQ ID NO: 4433626 - DNA, 13 bp, Homo sapiens
agttcctcgccct

SEQ ID NO: 4433627 - DNA, 14 bp, Homo sapiens
agttcctcgccctg

SEQ ID NO: 4433628 - DNA, 14 bp, Homo sapiens
agttcctcttttgt

SEQ ID NO: 4433629 - DNA, 19 bp, Homo sapiens
agttccttactgtttacag

SEQ ID NO: 4433630 - DNA, 23 bp, Homo sapiens
agttccttatccctctcttcccc

SEQ ID NO: 4433631 - DNA, 17 bp, Homo sapiens
agttcgagaccagcctg

SEQ ID NO: 4433632 - DNA, 13 bp, Homo sapiens
agttctacagaaa

SEQ ID NO: 4433633 - DNA, 18 bp, Homo sapiens
agttctataagtgaggaa

SEQ ID NO: 4433634 - DNA, 20 bp, Homo sapiens
agttctatccttttgcctgc

SEQ ID NO: 4433635 - DNA, 23 bp, Homo sapiens
agttctcacgaaagtatttactt

SEQ ID NO: 4433636 - DNA, 20 bp, Homo sapiens
agttctcagagctctcgagg

SEQ ID NO: 4433637 - DNA, 19 bp, Homo sapiens
agttctccgtaacagtgta

SEQ ID NO: 4433638 - DNA, 21 bp, Homo sapiens
agttctccgtaacagtgtaaa

SEQ ID NO: 4433639 - DNA, 16 bp, Homo sapiens
agttctctgggaagtg

SEQ ID NO: 4433640 - DNA, 18 bp, Homo sapiens
agttctgcaaatagaaaa

SEQ ID NO: 4433641 - DNA, 21 bp, Homo sapiens
agttctgcagataaacagtag

SEQ ID NO: 4433642 - DNA, 16 bp, Homo sapiens
agttctgctctggttg

SEQ ID NO: 4433643 - DNA, 14 bp, Homo sapiens
agttctgggtttct

SEQ ID NO: 4433644 - DNA, 11 bp, Homo sapiens
agttctgtata

SEQ ID NO: 4433645 - DNA, 14 bp, Homo sapiens
agttctgtgcctcc

SEQ ID NO: 4433646 - DNA, 21 bp, Homo sapiens
agttctgtgcctccccccaga

SEQ ID NO: 4433647 - DNA, 16 bp, Homo sapiens
agttctgtggtttcat

SEQ ID NO: 4433648 - DNA, 19 bp, Homo sapiens
agttctgtggtttcatgtt

SEQ ID NO: 4433649 - DNA, 13 bp, Homo sapiens
agttctgtgtatt

SEQ ID NO: 4433650 - DNA, 16 bp, Homo sapiens
agttcttagttgctgt

SEQ ID NO: 4433651 - DNA, 21 bp, Homo sapiens
agttcttagttgctgtatgtc

SEQ ID NO: 4433652 - DNA, 17 bp, Homo sapiens
agttcttatgaggaggg

SEQ ID NO: 4433653 - DNA, 20 bp, Homo sapiens
agttcttatgaggaggggag

SEQ ID NO: 4433654 - DNA, 15 bp, Homo sapiens
agttcttattttagt

SEQ ID NO: 4433655 - DNA, 21 bp, Homo sapiens
agttcttgggggaggccaccc

SEQ ID NO: 4433656 - DNA, 21 bp, Homo sapiens
agttcttggtgactgtcccac

SEQ ID NO: 4433657 - DNA, 15 bp, Homo sapiens
agttctttcctcccc

SEQ ID NO: 4433658 - DNA, 18 bp, Homo sapiens
agttctttcctccccctg

SEQ ID NO: 4433659 - DNA, 14 bp, Homo sapiens
agttgaaaagactc

SEQ ID NO: 4433660 - DNA, 18 bp, Homo sapiens
agttgaaaagactccaaa

SEQ ID NO: 4433661 - DNA, 19 bp, Homo sapiens
agttgaaaagactccaaag

SEQ ID NO: 4433662 - DNA, 21 bp, Homo sapiens
agttgaaaagactccaaagaa

SEQ ID NO: 4433663 - DNA, 15 bp, Homo sapiens
agttgaaccattata

SEQ ID NO: 4433664 - DNA, 19 bp, Homo sapiens
agttgaagttagtggaaat

SEQ ID NO: 4433665 - DNA, 22 bp, Homo sapiens
agttgaagttagtggaaatctg

SEQ ID NO: 4433666 - DNA, 14 bp, Homo sapiens
agttgaataaaaat

SEQ ID NO: 4433667 - DNA, 22 bp, Homo sapiens
agttgaataaacataaaagcta

SEQ ID NO: 4433668 - DNA, 16 bp, Homo sapiens
agttgaatattatata

SEQ ID NO: 4433669 - DNA, 18 bp, Homo sapiens
agttgaatttcagtcctt

SEQ ID NO: 4433670 - DNA, 12 bp, Homo sapiens
agttgaccttta

SEQ ID NO: 4433671 - DNA, 17 bp, Homo sapiens
agttgacctttatttat

SEQ ID NO: 4433672 - DNA, 17 bp, Homo sapiens
agttgagaaaaatttat

SEQ ID NO: 4433673 - DNA, 21 bp, Homo sapiens
agttgagattcaaacccaggc

SEQ ID NO: 4433674 - DNA, 20 bp, Homo sapiens
agttgagcgtgcgcactgca

SEQ ID NO: 4433675 - DNA, 16 bp, Homo sapiens
agttgaggagtttcct

SEQ ID NO: 4433676 - DNA, 21 bp, Homo sapiens
agttgagttattccacaaaca

SEQ ID NO: 4433677 - DNA, 23 bp, Homo sapiens
agttgataaagattttttaataa

SEQ ID NO: 4433678 - DNA, 13 bp, Homo sapiens
agttgatttttct

SEQ ID NO: 4433679 - DNA, 15 bp, Homo sapiens
agttgcactcaggtg

SEQ ID NO: 4433680 - DNA, 18 bp, Homo sapiens
agttgcatagcagtatat

SEQ ID NO: 4433681 - DNA, 21 bp, Homo sapiens
agttgcatgtagtaacactaa

SEQ ID NO: 4433682 - DNA, 22 bp, Homo sapiens
agttgcatgtagtaacactaat

SEQ ID NO: 4433683 - DNA, 19 bp, Homo sapiens
agttgcatgtttttgaaaa

SEQ ID NO: 4433684 - DNA, 18 bp, Homo sapiens
agttgccgtctaggattg

SEQ ID NO: 4433685 - DNA, 15 bp, Homo sapiens
agttgcctccagggc

SEQ ID NO: 4433686 - DNA, 23 bp, Homo sapiens
agttgctaacttaaaaaactgca

SEQ ID NO: 4433687 - DNA, 15 bp, Homo sapiens
agttgctcaaaaaga

SEQ ID NO: 4433688 - DNA, 16 bp, Homo sapiens
agttgctcaaaaagaa

SEQ ID NO: 4433689 - DNA, 15 bp, Homo sapiens
agttgctcttctaca

SEQ ID NO: 4433690 - DNA, 17 bp, Homo sapiens
agttgctgaatgttgca

SEQ ID NO: 4433691 - DNA, 13 bp, Homo sapiens
agttgctgtaaaa

SEQ ID NO: 4433692 - DNA, 18 bp, Homo sapiens
agttgcttcttcagctga

SEQ ID NO: 4433693 - DNA, 15 bp, Homo sapiens
agttggactctcagg

SEQ ID NO: 4433694 - DNA, 17 bp, Homo sapiens
agttggactctcaggga

SEQ ID NO: 4433695 - DNA, 15 bp, Homo sapiens
agttggcttctgttt

SEQ ID NO: 4433696 - DNA, 19 bp, Homo sapiens
agttggcttctgtttctag

SEQ ID NO: 4433697 - DNA, 16 bp, Homo sapiens
agtggggggacagaga

SEQ ID NO: 4433698 - DNA, 15 bp, Homo sapiens
agtgggggtggagga

SEQ ID NO: 4433699 - DNA, 17 bp, Homo sapiens
agtgggggtggaggacc

SEQ ID NO: 4433700 - DNA, 21 bp, Homo sapiens
agtgggggtggaggaccgagg

SEQ ID NO: 4433701 - DNA, 18 bp, Homo sapiens
agtggggtgctgggagga

SEQ ID NO: 4433702 - DNA, 14 bp, Homo sapiens
agtgggtcccagat

SEQ ID NO: 4433703 - DNA, 16 bp, Homo sapiens
agtggtatagaaatgc

SEQ ID NO: 4433704 - DNA, 20 bp, Homo sapiens
agtggtatatccaagtatat

SEQ ID NO: 4433705 - DNA, 12 bp, Homo sapiens
agtggtcagcag

SEQ ID NO: 4433706 - DNA, 20 bp, Homo sapiens
agtggtggcctatttcagct

SEQ ID NO: 4433707 - DNA, 19 bp, Homo sapiens
agtggtggtatgtaatgga

SEQ ID NO: 4433708 - DNA, 14 bp, Homo sapiens
agtggtgtgactct

SEQ ID NO: 4433709 - DNA, 21 bp, Homo sapiens
agtctgaaactggcttcccca

SEQ ID NO: 4433710 - DNA, 16 bp, Homo sapiens
agtctgagagaggcca

SEQ ID NO: 4433711 - DNA, 13 bp, Homo sapiens
agtctgagtcctg

SEQ ID NO: 4433712 - DNA, 16 bp, Homo sapiens
agtctgagtcctgtct

SEQ ID NO: 4433713 - DNA, 15 bp, Homo sapiens
agtctgattatacca

SEQ ID NO: 4433714 - DNA, 22 bp, Homo sapiens
agtctgatttttaagatttcct

SEQ ID NO: 4433715 - DNA, 15 bp, Homo sapiens
agtctgcatttcata

SEQ ID NO: 4433716 - DNA, 20 bp, Homo sapiens
agtctgccaagtgggaatgt

SEQ ID NO: 4433717 - DNA, 23 bp, Homo sapiens
agtctgccgattttgtaaatgtt

SEQ ID NO: 4433718 - DNA, 20 bp, Homo sapiens
agtctgccttcccccaaccc

SEQ ID NO: 4433719 - DNA, 18 bp, Homo sapiens
agtctggaaaacagaaac

SEQ ID NO: 4433720 - DNA, 15 bp, Homo sapiens
agtctggctgcacct

SEQ ID NO: 4433721 - DNA, 19 bp, Homo sapiens
agtctggggacctggcact

SEQ ID NO: 4433722 - DNA, 21 bp, Homo sapiens
agtctgggtctgggtttggat

SEQ ID NO: 4433723 - DNA, 17 bp, Homo sapiens
agtctggtgggaggacg

SEQ ID NO: 4433724 - DNA, 12 bp, Homo sapiens
agtctgtaattt

SEQ ID NO: 4433725 - DNA, 22 bp, Homo sapiens
agtctgtggctttttgttcaga

SEQ ID NO: 4433726 - DNA, 12 bp, Homo sapiens
agtctgtgtgaa

SEQ ID NO: 4433727 - DNA, 15 bp, Homo sapiens
agtctgttcactgca

SEQ ID NO: 4433728 - DNA, 18 bp, Homo sapiens
agtcttaactgtatttca

SEQ ID NO: 4433729 - DNA, 19 bp, Homo sapiens
agtcttaattgtgtttatt

SEQ ID NO: 4433730 - DNA, 18 bp, Homo sapiens
agtcttaatttatttctt

SEQ ID NO: 4433731 - DNA, 16 bp, Homo sapiens
agtcttacgaatactt

SEQ ID NO: 4433732 - DNA, 17 bp, Homo sapiens
agtcttcactaaccttt

SEQ ID NO: 4433733 - DNA, 19 bp, Homo sapiens
agtcttccacaaagaaaat

SEQ ID NO: 4433734 - DNA, 16 bp, Homo sapiens
agtcttcctgacactt

SEQ ID NO: 4433735 - DNA, 18 bp, Homo sapiens
agtcttcctgacacttta

SEQ ID NO: 4433736 - DNA, 14 bp, Homo sapiens
agtcttctatttat

SEQ ID NO: 4433737 - DNA, 15 bp, Homo sapiens
agtcttgaaatgaaa

SEQ ID NO: 4433738 - DNA, 19 bp, Homo sapiens
agtcttgaaatgaaaggga

SEQ ID NO: 4433739 - DNA, 12 bp, Homo sapiens
agtcttgcctag

SEQ ID NO: 4433740 - DNA, 16 bp, Homo sapiens
agtcttggaagctgtt

SEQ ID NO: 4433741 - DNA, 16 bp, Homo sapiens
agtcttggtaaaacat

SEQ ID NO: 4433742 - DNA, 21 bp, Homo sapiens
agtcttggtaaaacattactt

SEQ ID NO: 4433743 - DNA, 18 bp, Homo sapiens
agtcttgtattaagttgt

SEQ ID NO: 4433744 - DNA, 22 bp, Homo sapiens
agtctttgccagtcattcagca

SEQ ID NO: 4433745 - DNA, 16 bp, Homo sapiens
agtctttgccttctct

SEQ ID NO: 4433746 - DNA, 17 bp, Homo sapiens
agtcttttgttcgcatg

SEQ ID NO: 4433747 - DNA, 16 bp, Homo sapiens
agtgaaagaggcagct

SEQ ID NO: 4433748 - DNA, 14 bp, Homo sapiens
agtgaaatttctag

SEQ ID NO: 4433749 - DNA, 20 bp, Homo sapiens
agtgaacaaatttacagaga

SEQ ID NO: 4433750 - DNA, 23 bp, Homo sapiens
agtgaacaaatttacagagacag

SEQ ID NO: 4433751 - DNA, 22 bp, Homo sapiens
agtgaaccaaaaatagaaatta

SEQ ID NO: 4433752 - DNA, 16 bp, Homo sapiens
agtgaacccatatttt

SEQ ID NO: 4433753 - DNA, 17 bp, Homo sapiens
agtgaactaaatatttt

SEQ ID NO: 4433754 - DNA, 14 bp, Homo sapiens
agtgaactcctgcc

SEQ ID NO: 4433755 - DNA, 15 bp, Homo sapiens
agtgaactcctgcca

SEQ ID NO: 4433756 - DNA, 20 bp, Homo sapiens
agtgaactcctgccaggcac

SEQ ID NO: 4433757 - DNA, 14 bp, Homo sapiens
agtgaagaatactt

SEQ ID NO: 4433758 - DNA, 16 bp, Homo sapiens
agtgaagactggaagc

SEQ ID NO: 4433759 - DNA, 16 bp, Homo sapiens
agtgaagcagcactgt

SEQ ID NO: 4433760 - DNA, 21 bp, Homo sapiens
agtgaaggcttctctctgtgg

SEQ ID NO: 4433761 - DNA, 22 bp, Homo sapiens
agtgaaggtggggagaagctga

SEQ ID NO: 4433762 - DNA, 22 bp, Homo sapiens
agtgaagtctagaatcatactt

SEQ ID NO: 4433763 - DNA, 12 bp, Homo sapiens
agtgaagtgtta

SEQ ID NO: 4433764 - DNA, 18 bp, Homo sapiens
agtgaagtgttaatacat

SEQ ID NO: 4433765 - DNA, 23 bp, Homo sapiens
agtgaagtgttaatacatcacat

SEQ ID NO: 4433766 - DNA, 15 bp, Homo sapiens
agtgaatacattaac

SEQ ID NO: 4433767 - DNA, 20 bp, Homo sapiens
agtgaatacattaacggtgc

SEQ ID NO: 4433768 - DNA, 13 bp, Homo sapiens
agtgaatgattca

SEQ ID NO: 4433769 - DNA, 17 bp, Homo sapiens
agtgaatttatgagatt

SEQ ID NO: 4433770 - DNA, 18 bp, Homo sapiens
agtgaatttatgagattt

SEQ ID NO: 4433771 - DNA, 14 bp, Homo sapiens
agtgaattttgcac

SEQ ID NO: 4433772 - DNA, 15 bp, Homo sapiens
agtgaatttttgcaa

SEQ ID NO: 4433773 - DNA, 18 bp, Homo sapiens
agtgaatttttgcaataa

SEQ ID NO: 4433774 - DNA, 22 bp, Homo sapiens
agtgaatttttgcaataatgca

SEQ ID NO: 4433775 - DNA, 21 bp, Homo sapiens
agtgacaaataagattaataa

SEQ ID NO: 4433776 - DNA, 13 bp, Homo sapiens
agtgacagagcga

SEQ ID NO: 4433777 - DNA, 14 bp, Homo sapiens
agtgacagctttcc

SEQ ID NO: 4433778 - DNA, 15 bp, Homo sapiens
agtgaccgagagaac

SEQ ID NO: 4433779 - DNA, 17 bp, Homo sapiens
agtgacctcggacagag

SEQ ID NO: 4433780 - DNA, 21 bp, Homo sapiens
agtgacctcggacagagcccc

SEQ ID NO: 4433781 - DNA, 17 bp, Homo sapiens
agtgacttttcagacat

SEQ ID NO: 4433782 - DNA, 15 bp, Homo sapiens
agtgagacaggctgg

SEQ ID NO: 4433783 - DNA, 19 bp, Homo sapiens
agtgagacccaaaggaaga

SEQ ID NO: 4433784 - DNA, 21 bp, Homo sapiens
agtgagacccagccctcatcc

SEQ ID NO: 4433785 - DNA, 17 bp, Homo sapiens
agtgagaccctgtctca

SEQ ID NO: 4433786 - DNA, 11 bp, Homo sapiens
agtgagactgc

SEQ ID NO: 4433787 - DNA, 15 bp, Homo sapiens
agtgagactgcccca

SEQ ID NO: 4433788 - DNA, 19 bp, Homo sapiens
agtgagactgtacataatt

SEQ ID NO: 4433789 - DNA, 22 bp, Homo sapiens
agtgagagagatgggagctcct

SEQ ID NO: 4433790 - DNA, 17 bp, Homo sapiens
agtgagatgtagaaagt

SEQ ID NO: 4433791 - DNA, 20 bp, Homo sapiens
agtgagccaagatcgcacca

SEQ ID NO: 4433792 - DNA, 11 bp, Homo sapiens
agtgagccctg

SEQ ID NO: 4433793 - DNA, 12 bp, Homo sapiens
agtgagccctgc

SEQ ID NO: 4433794 - DNA, 13 bp, Homo sapiens
agtgagccctgct

SEQ ID NO: 4433795 - DNA, 15 bp, Homo sapiens
agtgagccctgctct

SEQ ID NO: 4433796 - DNA, 16 bp, Homo sapiens
agtgagccgagattgt

SEQ ID NO: 4433797 - DNA, 13 bp, Homo sapiens
agtgagcctcctg

SEQ ID NO: 4433798 - DNA, 22 bp, Homo sapiens
agtgagcctcctgtgcctggcc

SEQ ID NO: 4433799 - DNA, 23 bp, Homo sapiens
agtgaggactctttccgactgcc

SEQ ID NO: 4433800 - DNA, 14 bp, Homo sapiens
agtgaggatgtctg

SEQ ID NO: 4433801 - DNA, 20 bp, Homo sapiens
agtgaggctcagattaaatt

SEQ ID NO: 4433802 - DNA, 16 bp, Homo sapiens
agtgagggagacagga

SEQ ID NO: 4433803 - DNA, 20 bp, Homo sapiens
agtgagggaggagggctttg

SEQ ID NO: 4433804 - DNA, 18 bp, Homo sapiens
agtgagtgccatgctttt

SEQ ID NO: 4433805 - DNA, 19 bp, Homo sapiens
agtgagttgttgccctggg

SEQ ID NO: 4433806 - DNA, 20 bp, Homo sapiens
agtgagttttactcttaaat

SEQ ID NO: 4433807 - DNA, 15 bp, Homo sapiens
agtgatattggaact

SEQ ID NO: 4433808 - DNA, 18 bp, Homo sapiens
agtgatcttcactgtata

SEQ ID NO: 4433809 - DNA, 19 bp, Homo sapiens
agtgatcttggctgtttca

SEQ ID NO: 4433810 - DNA, 14 bp, Homo sapiens
agtgatgaatgtac

SEQ ID NO: 4433811 - DNA, 18 bp, Homo sapiens
agtgatgtattttcatag

SEQ ID NO: 4433812 - DNA, 18 bp, Homo sapiens
agtgattaccagggactg

SEQ ID NO: 4433813 - DNA, 15 bp, Homo sapiens
agtgattatctcttt

SEQ ID NO: 4433814 - DNA, 16 bp, Homo sapiens
agtgcaaaaactgtaa

SEQ ID NO: 4433815 - DNA, 16 bp, Homo sapiens
agtgcaaaagattaag

SEQ ID NO: 4433816 - DNA, 16 bp, Homo sapiens
agtgcaacactggtct

SEQ ID NO: 4433817 - DNA, 21 bp, Homo sapiens
agtgcaacactggtctgctgt

SEQ ID NO: 4433818 - DNA, 22 bp, Homo sapiens
agtgcaatgggtaagggaggga

SEQ ID NO: 4433819 - DNA, 20 bp, Homo sapiens
agtgcaattccaagaaaata

SEQ ID NO: 4433820 - DNA, 13 bp, Homo sapiens
agtgcacaaaatg

SEQ ID NO: 4433821 - DNA, 16 bp, Homo sapiens
agtgcacatgcccctt

SEQ ID NO: 4433822 - DNA, 22 bp, Homo sapiens
agtgcacatgccccttggtcct

SEQ ID NO: 4433823 - DNA, 19 bp, Homo sapiens
agtgcactccggcctgggt

SEQ ID NO: 4433824 - DNA, 20 bp, Homo sapiens
agtgcactccggcctgggtg

SEQ ID NO: 4433825 - DNA, 21 bp, Homo sapiens
agtgcactgcattcctgtgcc

SEQ ID NO: 4433826 - DNA, 22 bp, Homo sapiens
agtgcactgcattcctgtgccc

SEQ ID NO: 4433827 - DNA, 20 bp, Homo sapiens
agtgcagacacctaacccca

SEQ ID NO: 4433828 - DNA, 21 bp, Homo sapiens
agtgcagacacctaaccccag

SEQ ID NO: 4433829 - DNA, 20 bp, Homo sapiens
agtcacaaactgatctaaaa

SEQ ID NO: 4433830 - DNA, 22 bp, Homo sapiens
agtcacaaactgatctaaaatg

SEQ ID NO: 4433831 - DNA, 13 bp, Homo sapiens
agtcacaaagact

SEQ ID NO: 4433832 - DNA, 12 bp, Homo sapiens
agtcacaatgag

SEQ ID NO: 4433833 - DNA, 16 bp, Homo sapiens
agtcacatctcttcct

SEQ ID NO: 4433834 - DNA, 20 bp, Homo sapiens
agtcacattccaagcctcat

SEQ ID NO: 4433835 - DNA, 19 bp, Homo sapiens
agtcacattgccatcactc

SEQ ID NO: 4433836 - DNA, 21 bp, Homo sapiens
agtcaccaaatagtgtgaaat

SEQ ID NO: 4433837 - DNA, 19 bp, Homo sapiens
agtcaccaggaatgttaaa

SEQ ID NO: 4433838 - DNA, 13 bp, Homo sapiens
agtcaccttttct

SEQ ID NO: 4433839 - DNA, 19 bp, Homo sapiens
agtcaccttttctgtggct

SEQ ID NO: 4433840 - DNA, 20 bp, Homo sapiens
agtcaccttttctgtggctg

SEQ ID NO: 4433841 - DNA, 21 bp, Homo sapiens
agtcactgcatttgcctgctt

SEQ ID NO: 4433842 - DNA, 13 bp, Homo sapiens
agtcactggaaag

SEQ ID NO: 4433843 - DNA, 23 bp, Homo sapiens
agtcactggtctgtttgcatttg

SEQ ID NO: 4433844 - DNA, 12 bp, Homo sapiens
agtcacttgtaa

SEQ ID NO: 4433845 - DNA, 15 bp, Homo sapiens
agtcagaggagaaga

SEQ ID NO: 4433846 - DNA, 20 bp, Homo sapiens
agtcagagtccagtgctctg

SEQ ID NO: 4433847 - DNA, 22 bp, Homo sapiens
agtcagatggaaaattcatttt

SEQ ID NO: 4433848 - DNA, 15 bp, Homo sapiens
agtcagcctctctcc

SEQ ID NO: 4433849 - DNA, 18 bp, Homo sapiens
agtcagcctctctcccag

SEQ ID NO: 4433850 - DNA, 22 bp, Homo sapiens
agtcaggagttttactgcctgt

SEQ ID NO: 4433851 - DNA, 16 bp, Homo sapiens
agtcagggacctgctg

SEQ ID NO: 4433852 - DNA, 19 bp, Homo sapiens
agtcagggacctgctgctc

SEQ ID NO: 4433853 - DNA, 22 bp, Homo sapiens
agtcagggtgggaagaaagaat

SEQ ID NO: 4433854 - DNA, 12 bp, Homo sapiens
agtcataaatac

SEQ ID NO: 4433855 - DNA, 16 bp, Homo sapiens
agtcatcaatgcaata

SEQ ID NO: 4433856 - DNA, 13 bp, Homo sapiens
agtcatcaggtgt

SEQ ID NO: 4433857 - DNA, 19 bp, Homo sapiens
agtcatctagaattcactg

SEQ ID NO: 4433858 - DNA, 15 bp, Homo sapiens
agtcatctgatgaga

SEQ ID NO: 4433859 - DNA, 11 bp, Homo sapiens
agtcatcttgc

SEQ ID NO: 4433860 - DNA, 19 bp, Homo sapiens
agtcatcttgctaccagta

SEQ ID NO: 4433861 - DNA, 17 bp, Homo sapiens
agtcatgatctccctgc

SEQ ID NO: 4433862 - DNA, 18 bp, Homo sapiens
agtcatgatctccctgcc

SEQ ID NO: 4433863 - DNA, 21 bp, Homo sapiens
agtcatgatctccctgccgcc

SEQ ID NO: 4433864 - DNA, 19 bp, Homo sapiens
agtcattagactcctcctc

SEQ ID NO: 4433865 - DNA, 12 bp, Homo sapiens
agtcattatgtt

SEQ ID NO: 4433866 - DNA, 22 bp, Homo sapiens
agtcattcaggtgacctcctgc

SEQ ID NO: 4433867 - DNA, 23 bp, Homo sapiens
agtcattcaggtgacctcctgca

SEQ ID NO: 4433868 - DNA, 18 bp, Homo sapiens
agtcattgacttcatttt

SEQ ID NO: 4433869 - DNA, 20 bp, Homo sapiens
agtcattgacttcattttat

SEQ ID NO: 4433870 - DNA, 20 bp, Homo sapiens
agtcatttaggatccatgca

SEQ ID NO: 4433871 - DNA, 15 bp, Homo sapiens
agtcatttgtttaaa

SEQ ID NO: 4433872 - DNA, 16 bp, Homo sapiens
agtcatttgtttaaac

SEQ ID NO: 4433873 - DNA, 16 bp, Homo sapiens
agtcattttattttgt

SEQ ID NO: 4433874 - DNA, 13 bp, Homo sapiens
agtcatttttgta

SEQ ID NO: 4433875 - DNA, 23 bp, Homo sapiens
agtccaaatgtcctccagaagcc

SEQ ID NO: 4433876 - DNA, 14 bp, Homo sapiens
agtccaatgtggca

SEQ ID NO: 4433877 - DNA, 17 bp, Homo sapiens
agtccaattttaattta

SEQ ID NO: 4433878 - DNA, 17 bp, Homo sapiens
agtccacaggggccacc

SEQ ID NO: 4433879 - DNA, 20 bp, Homo sapiens
agtccacgcccaccagcctt

SEQ ID NO: 4433880 - DNA, 23 bp, Homo sapiens
agtccacgcccaccagccttgct

SEQ ID NO: 4433881 - DNA, 19 bp, Homo sapiens
agtccagaccccccagccc

SEQ ID NO: 4433882 - DNA, 16 bp, Homo sapiens
agtccagcccctcctc

SEQ ID NO: 4433883 - DNA, 11 bp, Homo sapiens
agtccagctcc

SEQ ID NO: 4433884 - DNA, 19 bp, Homo sapiens
agtccagctccccccaaga

SEQ ID NO: 4433885 - DNA, 17 bp, Homo sapiens
agtccaggcctctctct

SEQ ID NO: 4433886 - DNA, 18 bp, Homo sapiens
agtccagtgctctgcctc

SEQ ID NO: 4433887 - DNA, 20 bp, Homo sapiens
agtccagtgctctgcctcag

SEQ ID NO: 4433888 - DNA, 14 bp, Homo sapiens
agtccatcagcctc

SEQ ID NO: 4433889 - DNA, 15 bp, Homo sapiens
agtccatgctccagg

SEQ ID NO: 4433890 - DNA, 14 bp, Homo sapiens
agtccattcatctt

SEQ ID NO: 4433891 - DNA, 14 bp, Homo sapiens
agtccattctccca

SEQ ID NO: 4433892 - DNA, 19 bp, Homo sapiens
agtccattctcccaggtac

SEQ ID NO: 4433893 - DNA, 21 bp, Homo sapiens
agtcccaggggcagccacacc

SEQ ID NO: 4433894 - DNA, 19 bp, Homo sapiens
agtcccatgctggctgaag

SEQ ID NO: 4433895 - DNA, 17 bp, Homo sapiens
agtcccattcagtggca

SEQ ID NO: 4433896 - DNA, 20 bp, Homo sapiens
agtcccattgtcagaaatat

SEQ ID NO: 4433897 - DNA, 15 bp, Homo sapiens
agtccccacccctgc

SEQ ID NO: 4433898 - DNA, 20 bp, Homo sapiens
agtccccacccctgccccca

SEQ ID NO: 4433899 - DNA, 19 bp, Homo sapiens
agtccccgaggagctgggc

SEQ ID NO: 4433900 - DNA, 15 bp, Homo sapiens
agtccctgcctggac

SEQ ID NO: 4433901 - DNA, 13 bp, Homo sapiens
agtccctgctggg

SEQ ID NO: 4433902 - DNA, 14 bp, Homo sapiens
agtcccttcccctc

SEQ ID NO: 4433903 - DNA, 20 bp, Homo sapiens
agtcccttcccctccctggc

SEQ ID NO: 4433904 - DNA, 17 bp, Homo sapiens
agtccgcagaagccctg

SEQ ID NO: 4433905 - DNA, 21 bp, Homo sapiens
agtccggccccagtacacagg

SEQ ID NO: 4433906 - DNA, 17 bp, Homo sapiens
agtcctaactttctgaa

SEQ ID NO: 4433907 - DNA, 12 bp, Homo sapiens
agtcctagctgc

SEQ ID NO: 4433908 - DNA, 13 bp, Homo sapiens
agtcctagctgca

SEQ ID NO: 4433909 - DNA, 23 bp, Homo sapiens
agtcctcacttctagatctcagc

SEQ ID NO: 4433910 - DNA, 14 bp, Homo sapiens
agtcctgaaggaca

SEQ ID NO: 4433911 - DNA, 13 bp, Homo sapiens
agtcctgcccgcc

SEQ ID NO: 4433912 - DNA, 10 bp, Homo sapiens
agtcctgcct

SEQ ID NO: 4433913 - DNA, 12 bp, Homo sapiens
agtcctgcctga

SEQ ID NO: 4433914 - DNA, 13 bp, Homo sapiens
agtcctgcctggc

SEQ ID NO: 4433915 - DNA, 14 bp, Homo sapiens
agtcctgcctggcc

SEQ ID NO: 4433916 - DNA, 17 bp, Homo sapiens
agtcctgcctggccagg

SEQ ID NO: 4433917 - DNA, 14 bp, Homo sapiens
agtcctggaagcca

SEQ ID NO: 4433918 - DNA, 19 bp, Homo sapiens
agtcctttttccaatgttt

SEQ ID NO: 4433919 - DNA, 16 bp, Homo sapiens
agtcgagattgcactg

SEQ ID NO: 4433920 - DNA, 14 bp, Homo sapiens
agtcgaggctgcag

SEQ ID NO: 4433921 - DNA, 23 bp, Homo sapiens
agtcgaggctgcagtcagccctg

SEQ ID NO: 4433922 - DNA, 17 bp, Homo sapiens
agtcgcagaccagagct

SEQ ID NO: 4433923 - DNA, 21 bp, Homo sapiens
agtcgcctgcctgcagcaggc

SEQ ID NO: 4433924 - DNA, 14 bp, Homo sapiens
agtcggtcctcttt

SEQ ID NO: 4433925 - DNA, 14 bp, Homo sapiens
agtcgtggggaacg

SEQ ID NO: 4433926 - DNA, 14 bp, Homo sapiens
agtcgttgtgaggg

SEQ ID NO: 4433927 - DNA, 11 bp, Homo sapiens
agtctaccaaa

SEQ ID NO: 4433928 - DNA, 16 bp, Homo sapiens
agtctaggagctggga

SEQ ID NO: 4433929 - DNA, 18 bp, Homo sapiens
agtctatctaatgacatg

SEQ ID NO: 4433930 - DNA, 14 bp, Homo sapiens
agtctatttttaat

SEQ ID NO: 4433931 - DNA, 18 bp, Homo sapiens
agtctcactgcttgaact

SEQ ID NO: 4433932 - DNA, 19 bp, Homo sapiens
agtctcatgccttgagatc

SEQ ID NO: 4433933 - DNA, 21 bp, Homo sapiens
agtctcatgccttgagatctg

SEQ ID NO: 4433934 - DNA, 17 bp, Homo sapiens
agtctcatttgggctag

SEQ ID NO: 4433935 - DNA, 18 bp, Homo sapiens
agtctccaaaacatttct

SEQ ID NO: 4433936 - DNA, 12 bp, Homo sapiens
agtctccagggc

SEQ ID NO: 4433937 - DNA, 22 bp, Homo sapiens
agtctccagggccccccaactg

SEQ ID NO: 4433938 - DNA, 16 bp, Homo sapiens
agtctccccttcctgg

SEQ ID NO: 4433939 - DNA, 17 bp, Homo sapiens
agtctccccttcctggc

SEQ ID NO: 4433940 - DNA, 18 bp, Homo sapiens
agtctccccttcctggca

SEQ ID NO: 4433941 - DNA, 13 bp, Homo sapiens
agtctcctcactc

SEQ ID NO: 4433942 - DNA, 21 bp, Homo sapiens
agtctcctcactctgtccctg

SEQ ID NO: 4433943 - DNA, 14 bp, Homo sapiens
agtctcctctttaa

SEQ ID NO: 4433944 - DNA, 20 bp, Homo sapiens
agtctcctctttaaaacaaa

SEQ ID NO: 4433945 - DNA, 22 bp, Homo sapiens
agtctcgctctgtcgcccaggc

SEQ ID NO: 4433946 - DNA, 22 bp, Homo sapiens
agcctctatcctacaaggccta

SEQ ID NO: 4433947 - DNA, 12 bp, Homo sapiens
agcctctcccac

SEQ ID NO: 4433948 - DNA, 14 bp, Homo sapiens
agcctctcccaccc

SEQ ID NO: 4433949 - DNA, 13 bp, Homo sapiens
agcctctcctgta

SEQ ID NO: 4433950 - DNA, 13 bp, Homo sapiens
agcctctcctttg

SEQ ID NO: 4433951 - DNA, 15 bp, Homo sapiens
agcctctctcccagt

SEQ ID NO: 4433952 - DNA, 17 bp, Homo sapiens
agcctctctcccagtct

SEQ ID NO: 4433953 - DNA, 13 bp, Homo sapiens
agcctctctcctt

SEQ ID NO: 4433954 - DNA, 20 bp, Homo sapiens
agcctctctccttggccaca

SEQ ID NO: 4433955 - DNA, 14 bp, Homo sapiens
agcctctgctggag

SEQ ID NO: 4433956 - DNA, 15 bp, Homo sapiens
agcctctgctggaga

SEQ ID NO: 4433957 - DNA, 20 bp, Homo sapiens
agcctctggatgcatttcca

SEQ ID NO: 4433958 - DNA, 13 bp, Homo sapiens
agcctctggctag

SEQ ID NO: 4433959 - DNA, 14 bp, Homo sapiens
agcctctggctaga

SEQ ID NO: 4433960 - DNA, 15 bp, Homo sapiens
agcctctggctagag

SEQ ID NO: 4433961 - DNA, 16 bp, Homo sapiens
agcctctgtccgcctt

SEQ ID NO: 4433962 - DNA, 22 bp, Homo sapiens
agcctgaaagaggaatgaagta

SEQ ID NO: 4433963 - DNA, 17 bp, Homo sapiens
agcctgaactgagcccc

SEQ ID NO: 4433964 - DNA, 21 bp, Homo sapiens
agcctgaactgagccccagcg

SEQ ID NO: 4433965 - DNA, 22 bp, Homo sapiens
agcctgaattgctttctgctct

SEQ ID NO: 4433966 - DNA, 19 bp, Homo sapiens
agcctgaccctcatctttc

SEQ ID NO: 4433967 - DNA, 17 bp, Homo sapiens
agcctgacgctcagccc

SEQ ID NO: 4433968 - DNA, 21 bp, Homo sapiens
agcctgacgctcagccccagg

SEQ ID NO: 4433969 - DNA, 22 bp, Homo sapiens
agcctgacgctcagccccaggc

SEQ ID NO: 4433970 - DNA, 16 bp, Homo sapiens
agcctgagcaactctt

SEQ ID NO: 4433971 - DNA, 19 bp, Homo sapiens
agcctgagcgacagtgaga

SEQ ID NO: 4433972 - DNA, 22 bp, Homo sapiens
agcctgatactttagccatcat

SEQ ID NO: 4433973 - DNA, 20 bp, Homo sapiens
agcctgatctttgggcatca

SEQ ID NO: 4433974 - DNA, 18 bp, Homo sapiens
agcctgcacctgccccgt

SEQ ID NO: 4433975 - DNA, 15 bp, Homo sapiens
agcctgcctggagcg

SEQ ID NO: 4433976 - DNA, 11 bp, Homo sapiens
agcctgctccc

SEQ ID NO: 4433977 - DNA, 22 bp, Homo sapiens
agcctgctccttcccaggagtg

SEQ ID NO: 4433978 - DNA, 12 bp, Homo sapiens
agcctgctgcat

SEQ ID NO: 4433979 - DNA, 12 bp, Homo sapiens
agcctgctggct

SEQ ID NO: 4433980 - DNA, 14 bp, Homo sapiens
agcctgctggctgc

SEQ ID NO: 4433981 - DNA, 15 bp, Homo sapiens
agcctgctggctgcg

SEQ ID NO: 4433982 - DNA, 21 bp, Homo sapiens
agcctgctggtcacagcctcc

SEQ ID NO: 4433983 - DNA, 17 bp, Homo sapiens
agcctgctttcctgcag

SEQ ID NO: 4433984 - DNA, 18 bp, Homo sapiens
agcctgctttcctgcagc

SEQ ID NO: 4433985 - DNA, 24 bp, Homo sapiens
agcctggaaggtggaagttgcagt

SEQ ID NO: 4433986 - DNA, 21 bp, Homo sapiens
agcctggccaccagccatcct

SEQ ID NO: 4433987 - DNA, 23 bp, Homo sapiens
agcctggccaccagccatcctcc

SEQ ID NO: 4433988 - DNA, 12 bp, Homo sapiens
agcctggcccca

SEQ ID NO: 4433989 - DNA, 14 bp, Homo sapiens
agcctggccccagg

SEQ ID NO: 4433990 - DNA, 22 bp, Homo sapiens
agcctggccccaggccccagac

SEQ ID NO: 4433991 - DNA, 23 bp, Homo sapiens
agcctggctctgccccctccccc

SEQ ID NO: 4433992 - DNA, 15 bp, Homo sapiens
agcctgggagcccag

SEQ ID NO: 4433993 - DNA, 19 bp, Homo sapiens
agcctgggagcccagaggg

SEQ ID NO: 4433994 - DNA, 15 bp, Homo sapiens
agcctgggcagccag

SEQ ID NO: 4433995 - DNA, 21 bp, Homo sapiens
agcctgggcagccaggctgcc

SEQ ID NO: 4433996 - DNA, 17 bp, Homo sapiens
agcctgggccatctctt

SEQ ID NO: 4433997 - DNA, 18 bp, Homo sapiens
agcctgggctcactgtgc

SEQ ID NO: 4433998 - DNA, 14 bp, Homo sapiens
agcctgggtcacag

SEQ ID NO: 4433999 - DNA, 14 bp, Homo sapiens
aggtgctgggggag

SEQ ID NO: 4434000 - DNA, 22 bp, Homo sapiens
aggtgctgtccccactgcccca

SEQ ID NO: 4434001 - DNA, 15 bp, Homo sapiens
aggtgcttgatctat

SEQ ID NO: 4434002 - DNA, 18 bp, Homo sapiens
aggtgcttgatctatcta

SEQ ID NO: 4434003 - DNA, 16 bp, Homo sapiens
aggtgcttgctcccca

SEQ ID NO: 4434004 - DNA, 13 bp, Homo sapiens
aggtggaaaaaca

SEQ ID NO: 4434005 - DNA, 18 bp, Homo sapiens
aggtggaaaaacatctga

SEQ ID NO: 4434006 - DNA, 16 bp, Homo sapiens
agtacaaacatgaaaa

SEQ ID NO: 4434007 - DNA, 17 bp, Homo sapiens
agtacaaaggcatgttt

SEQ ID NO: 4434008 - DNA, 20 bp, Homo sapiens
agtacaatgtgtttttctcc

SEQ ID NO: 4434009 - DNA, 13 bp, Homo sapiens
agtacaatttcaa

SEQ ID NO: 4434010 - DNA, 15 bp, Homo sapiens
agtacacaactatgg

SEQ ID NO: 4434011 - DNA, 18 bp, Homo sapiens
agtacacaataagcaaaa

SEQ ID NO: 4434012 - DNA, 22 bp, Homo sapiens
agtacacaataagcaaaaacaa

SEQ ID NO: 4434013 - DNA, 14 bp, Homo sapiens
agtacactcagcca

SEQ ID NO: 4434014 - DNA, 17 bp, Homo sapiens
agtacactcagccactg

SEQ ID NO: 4434015 - DNA, 14 bp, Homo sapiens
agtacactctgctg

SEQ ID NO: 4434016 - DNA, 15 bp, Homo sapiens
agtacactctgctgt

SEQ ID NO: 4434017 - DNA, 16 bp, Homo sapiens
agtacagaatttgaat

SEQ ID NO: 4434018 - DNA, 15 bp, Homo sapiens
agtacagcctggacc

SEQ ID NO: 4434019 - DNA, 22 bp, Homo sapiens
agtacagcggctcccctctgct

SEQ ID NO: 4434020 - DNA, 22 bp, Homo sapiens
agtacaggggtgctgcaggtgg

SEQ ID NO: 4434021 - DNA, 12 bp, Homo sapiens
agtacattgctt

SEQ ID NO: 4434022 - DNA, 15 bp, Homo sapiens
agtaccactcttggt

SEQ ID NO: 4434023 - DNA, 23 bp, Homo sapiens
agtacccactctggagcatttct

SEQ ID NO: 4434024 - DNA, 11 bp, Homo sapiens
agtacccagca

SEQ ID NO: 4434025 - DNA, 18 bp, Homo sapiens
agtacccctaaaatccca

SEQ ID NO: 4434026 - DNA, 18 bp, Homo sapiens
agtacgaacctacagttt

SEQ ID NO: 4434027 - DNA, 20 bp, Homo sapiens
agtacgatcaagttgttgac

SEQ ID NO: 4434028 - DNA, 22 bp, Homo sapiens
agtactattgctagtactagta

SEQ ID NO: 4434029 - DNA, 23 bp, Homo sapiens
agtactctttctctcccctcctc

SEQ ID NO: 4434030 - DNA, 19 bp, Homo sapiens
agtactggttactttcaaa

SEQ ID NO: 4434031 - DNA, 12 bp, Homo sapiens
agtactgtacta

SEQ ID NO: 4434032 - DNA, 15 bp, Homo sapiens
agtacttacattcca

SEQ ID NO: 4434033 - DNA, 18 bp, Homo sapiens
agtacttacattccagta

SEQ ID NO: 4434034 - DNA, 14 bp, Homo sapiens
agtacttcctccca

SEQ ID NO: 4434035 - DNA, 14 bp, Homo sapiens
agtacttctaagag

SEQ ID NO: 4434036 - DNA, 19 bp, Homo sapiens
agtacttcttctgtaatat

SEQ ID NO: 4434037 - DNA, 14 bp, Homo sapiens
agtacttgtcatat

SEQ ID NO: 4434038 - DNA, 15 bp, Homo sapiens
agtactttgtgcatt

SEQ ID NO: 4434039 - DNA, 16 bp, Homo sapiens
agtactttgtgcattc

SEQ ID NO: 4434040 - DNA, 15 bp, Homo sapiens
agtacttttttaaat

SEQ ID NO: 4434041 - DNA, 16 bp, Homo sapiens
agtagaaagacatctg

SEQ ID NO: 4434042 - DNA, 14 bp, Homo sapiens
agtagaaagctaaa

SEQ ID NO: 4434043 - DNA, 19 bp, Homo sapiens
agtagaaagctaaagtgat

SEQ ID NO: 4434044 - DNA, 15 bp, Homo sapiens
agtagacacatttaa

SEQ ID NO: 4434045 - DNA, 18 bp, Homo sapiens
agtagacacatttaagga

SEQ ID NO: 4434046 - DNA, 16 bp, Homo sapiens
agtagactgattacac

SEQ ID NO: 4434047 - DNA, 23 bp, Homo sapiens
agtagatctatattagatcaaat

SEQ ID NO: 4434048 - DNA, 13 bp, Homo sapiens
agtagatttcatg

SEQ ID NO: 4434049 - DNA, 16 bp, Homo sapiens
agtagcaatgtgcctt

SEQ ID NO: 4434050 - DNA, 15 bp, Homo sapiens
agtagccgagagcct

SEQ ID NO: 4434051 - DNA, 16 bp, Homo sapiens
agtagccgagagcctg

SEQ ID NO: 4434052 - DNA, 17 bp, Homo sapiens
agtagccgagagcctgc

SEQ ID NO: 4434053 - DNA, 19 bp, Homo sapiens
agtagccgagagcctgctc

SEQ ID NO: 4434054 - DNA, 21 bp, Homo sapiens
agtagcgctatagttactgtc

SEQ ID NO: 4434055 - DNA, 21 bp, Homo sapiens
agtagcgttttttaaatgtat

SEQ ID NO: 4434056 - DNA, 22 bp, Homo sapiens
agtagcgttttttaaatgtata

SEQ ID NO: 4434057 - DNA, 16 bp, Homo sapiens
agtagctgaaatgcaa

SEQ ID NO: 4434058 - DNA, 18 bp, Homo sapiens
agtagctgggattacagg

SEQ ID NO: 4434059 - DNA, 21 bp, Homo sapiens
agtagctgggattacaggcgc

SEQ ID NO: 4434060 - DNA, 15 bp, Homo sapiens
agtagctgtcagatg

SEQ ID NO: 4434061 - DNA, 13 bp, Homo sapiens
agtaggagcccag

SEQ ID NO: 4434062 - DNA, 16 bp, Homo sapiens
agtaggtaccatttgt

SEQ ID NO: 4434063 - DNA, 20 bp, Homo sapiens
agtaggtaccatttgtgtct

SEQ ID NO: 4434064 - DNA, 22 bp, Homo sapiens
agtagtacttcttctgtaatat

SEQ ID NO: 4434065 - DNA, 23 bp, Homo sapiens
agtagtacttcttctgtaatatt

SEQ ID NO: 4434066 - DNA, 20 bp, Homo sapiens
agtagtcaaaaacaaagctg

SEQ ID NO: 4434067 - DNA, 17 bp, Homo sapiens
agtagtcacaaactgat

SEQ ID NO: 4434068 - DNA, 13 bp, Homo sapiens
agtagtggccact

SEQ ID NO: 4434069 - DNA, 15 bp, Homo sapiens
agtagtggccactgg

SEQ ID NO: 4434070 - DNA, 22 bp, Homo sapiens
agtagtggccactggggtgcct

SEQ ID NO: 4434071 - DNA, 20 bp, Homo sapiens
agtagtgtctggatcagtaa

SEQ ID NO: 4434072 - DNA, 22 bp, Homo sapiens
agtagttactaaaatttacaca

SEQ ID NO: 4434073 - DNA, 14 bp, Homo sapiens
agtagttattagta

SEQ ID NO: 4434074 - DNA, 21 bp, Homo sapiens
agtagttgttggtctgtagca

SEQ ID NO: 4434075 - DNA, 14 bp, Homo sapiens
agtataaatgtaca

SEQ ID NO: 4434076 - DNA, 13 bp, Homo sapiens
agtataacagttt

SEQ ID NO: 4434077 - DNA, 13 bp, Homo sapiens
agtatacattgtc

SEQ ID NO: 4434078 - DNA, 19 bp, Homo sapiens
agtatacattttataatga

SEQ ID NO: 4434079 - DNA, 20 bp, Homo sapiens
agtatacattttataatgat

SEQ ID NO: 4434080 - DNA, 15 bp, Homo sapiens
agtatacctgatttt

SEQ ID NO: 4434081 - DNA, 20 bp, Homo sapiens
agtatacgtataaatatcag

SEQ ID NO: 4434082 - DNA, 16 bp, Homo sapiens
agtatatttatttcta

SEQ ID NO: 4434083 - DNA, 17 bp, Homo sapiens
agtatattttctgtatt

SEQ ID NO: 4434084 - DNA, 18 bp, Homo sapiens
agtatcagagatgtccat

SEQ ID NO: 4434085 - DNA, 21 bp, Homo sapiens
agtatccatgctcttgacctt

SEQ ID NO: 4434086 - DNA, 19 bp, Homo sapiens
agtatcttgcactgataaa

SEQ ID NO: 4434087 - DNA, 14 bp, Homo sapiens
agtatgtccttcag

SEQ ID NO: 4434088 - DNA, 18 bp, Homo sapiens
agtatgtggcaaaacata

SEQ ID NO: 4434089 - DNA, 18 bp, Homo sapiens
agtatgttttaacaaaaa

SEQ ID NO: 4434090 - DNA, 17 bp, Homo sapiens
agtattaccaccctttc

SEQ ID NO: 4434091 - DNA, 17 bp, Homo sapiens
agtattcaggcactgag

SEQ ID NO: 4434092 - DNA, 14 bp, Homo sapiens
agtattcttctctt

SEQ ID NO: 4434093 - DNA, 17 bp, Homo sapiens
agtattgggcaggagga

SEQ ID NO: 4434094 - DNA, 15 bp, Homo sapiens
agtattgtaaattat

SEQ ID NO: 4434095 - DNA, 17 bp, Homo sapiens
agtattgtaaattatat

SEQ ID NO: 4434096 - DNA, 18 bp, Homo sapiens
agtattgtaaattatatt

SEQ ID NO: 4434097 - DNA, 16 bp, Homo sapiens
agtattgtaatgagtg

SEQ ID NO: 4434098 - DNA, 19 bp, Homo sapiens
agtatttactttttaaaaa

SEQ ID NO: 4434099 - DNA, 16 bp, Homo sapiens
agtatttcaaattgga

SEQ ID NO: 4434100 - DNA, 18 bp, Homo sapiens
agtatttctcctttgcaa

SEQ ID NO: 4434101 - DNA, 13 bp, Homo sapiens
agtatttctcttt

SEQ ID NO: 4434102 - DNA, 23 bp, Homo sapiens
agtatttctcttttattctgtta

SEQ ID NO: 4434103 - DNA, 17 bp, Homo sapiens
agtatttgattcaaaat

SEQ ID NO: 4434104 - DNA, 17 bp, Homo sapiens
agtatttgggaagtgaa

SEQ ID NO: 4434105 - DNA, 23 bp, Homo sapiens
agtattttgtctaggagatgctt

SEQ ID NO: 4434106 - DNA, 20 bp, Homo sapiens
agtatttttgggctattgca

SEQ ID NO: 4434107 - DNA, 12 bp, Homo sapiens
agtcaaaaagaa

SEQ ID NO: 4434108 - DNA, 15 bp, Homo sapiens
agtcaaaaggtgcct

SEQ ID NO: 4434109 - DNA, 21 bp, Homo sapiens
agtcaaaaggtgcctgtgagg

SEQ ID NO: 4434110 - DNA, 16 bp, Homo sapiens
agtcaaagagagtttt

SEQ ID NO: 4434111 - DNA, 22 bp, Homo sapiens
agtcaaagagagtttttaatag

SEQ ID NO: 4434112 - DNA, 23 bp, Homo sapiens
agtcaaagagagtttttaataga

SEQ ID NO: 4434113 - DNA, 14 bp, Homo sapiens
agtcaacagtaaac

SEQ ID NO: 4434114 - DNA, 15 bp, Homo sapiens
agtcaacagtaaacc

SEQ ID NO: 4434115 - DNA, 17 bp, Homo sapiens
agtcaacagtaaaccac

SEQ ID NO: 4434116 - DNA, 18 bp, Homo sapiens
agtcaacggggggctcct

SEQ ID NO: 4434117 - DNA, 23 bp, Homo sapiens
agtcaacggggggctcctgccca

SEQ ID NO: 4434118 - DNA, 18 bp, Homo sapiens
agtcaactggctggccag

SEQ ID NO: 4434119 - DNA, 22 bp, Homo sapiens
agtcaagctgttgaagtctcag

SEQ ID NO: 4434120 - DNA, 10 bp, Homo sapiens
agtcaataca

SEQ ID NO: 4434121 - DNA, 21 bp, Homo sapiens
agtcaatacatagtgctgctg

SEQ ID NO: 4434122 - DNA, 20 bp, Homo sapiens
agtcaatggaagaaatggct

SEQ ID NO: 4434123 - DNA, 16 bp, Homo sapiens
agtcacaaactgatct

SEQ ID NO: 4434124 - DNA, 13 bp, Homo sapiens
agccccggctctt

SEQ ID NO: 4434125 - DNA, 19 bp, Homo sapiens
agcccctatagcactgagc

SEQ ID NO: 4434126 - DNA, 12 bp, Homo sapiens
agcccctcccca

SEQ ID NO: 4434127 - DNA, 16 bp, Homo sapiens
agcccctccccagcca

SEQ ID NO: 4434128 - DNA, 22 bp, Homo sapiens
agcccctccccagccagccctt

SEQ ID NO: 4434129 - DNA, 12 bp, Homo sapiens
agcccctcctcc

SEQ ID NO: 4434130 - DNA, 17 bp, Homo sapiens
agcccctcctccctcaa

SEQ ID NO: 4434131 - DNA, 20 bp, Homo sapiens
agcccctcctccctcagacc

SEQ ID NO: 4434132 - DNA, 23 bp, Homo sapiens
agcccctcctccctcagacccag

SEQ ID NO: 4434133 - DNA, 17 bp, Homo sapiens
agcccctcctctgccac

SEQ ID NO: 4434134 - DNA, 18 bp, Homo sapiens
agcccctcctctgccacc

SEQ ID NO: 4434135 - DNA, 22 bp, Homo sapiens
agcccctcctctgccacctccc

SEQ ID NO: 4434136 - DNA, 16 bp, Homo sapiens
agcccctggagcctca

SEQ ID NO: 4434137 - DNA, 12 bp, Homo sapiens
agcccctggggc

SEQ ID NO: 4434138 - DNA, 21 bp, Homo sapiens
agcccctggggtggccaccag

SEQ ID NO: 4434139 - DNA, 21 bp, Homo sapiens
agcccgcctgccagtcctagc

SEQ ID NO: 4434140 - DNA, 16 bp, Homo sapiens
agccctaagtggctgc

SEQ ID NO: 4434141 - DNA, 20 bp, Homo sapiens
agccctaagtggctgccttc

SEQ ID NO: 4434142 - DNA, 22 bp, Homo sapiens
agccctaagtggctgccttctt

SEQ ID NO: 4434143 - DNA, 22 bp, Homo sapiens
agccctagagcctgcctggagc

SEQ ID NO: 4434144 - DNA, 19 bp, Homo sapiens
agccctagcggctgctcct

SEQ ID NO: 4434145 - DNA, 17 bp, Homo sapiens
agccctagggtggagag

SEQ ID NO: 4434146 - DNA, 20 bp, Homo sapiens
agccctagggtggagagcca

SEQ ID NO: 4434147 - DNA, 13 bp, Homo sapiens
agccctcagaaca

SEQ ID NO: 4434148 - DNA, 22 bp, Homo sapiens
agccctcagacatttatatatt

SEQ ID NO: 4434149 - DNA, 16 bp, Homo sapiens
agccctcccccttccc

SEQ ID NO: 4434150 - DNA, 21 bp, Homo sapiens
agccctcccccttccccttct

SEQ ID NO: 4434151 - DNA, 22 bp, Homo sapiens
agccctcccccttccccttctg

SEQ ID NO: 4434152 - DNA, 14 bp, Homo sapiens
agccctccctgtcc

SEQ ID NO: 4434153 - DNA, 16 bp, Homo sapiens
agccctccctgtcctc

SEQ ID NO: 4434154 - DNA, 12 bp, Homo sapiens
agccctcctcac

SEQ ID NO: 4434155 - DNA, 12 bp, Homo sapiens
agccctcctccc

SEQ ID NO: 4434156 - DNA, 18 bp, Homo sapiens
agccctcctccccagagc

SEQ ID NO: 4434157 - DNA, 20 bp, Homo sapiens
agccctcctccccagagctg

SEQ ID NO: 4434158 - DNA, 17 bp, Homo sapiens
agccctcctctgcactc

SEQ ID NO: 4434159 - DNA, 11 bp, Homo sapiens
agccctccttc

SEQ ID NO: 4434160 - DNA, 12 bp, Homo sapiens
agccctccttcc

SEQ ID NO: 4434161 - DNA, 17 bp, Homo sapiens
agccctccttccacgga

SEQ ID NO: 4434162 - DNA, 14 bp, Homo sapiens
agccctcggcctcc

SEQ ID NO: 4434163 - DNA, 20 bp, Homo sapiens
agccctcggcctccgaggct

SEQ ID NO: 4434164 - DNA, 15 bp, Homo sapiens
agccctctctctcac

SEQ ID NO: 4434165 - DNA, 11 bp, Homo sapiens
agccctgactc

SEQ ID NO: 4434166 - DNA, 13 bp, Homo sapiens
agccctgactcct

SEQ ID NO: 4434167 - DNA, 18 bp, Homo sapiens
agccctgactcctggact

SEQ ID NO: 4434168 - DNA, 18 bp, Homo sapiens
agccctgcacgacccctg

SEQ ID NO: 4434169 - DNA, 18 bp, Homo sapiens
agccctgcagcccaccag

SEQ ID NO: 4434170 - DNA, 22 bp, Homo sapiens
agccctgcagcccaccagacgt

SEQ ID NO: 4434171 - DNA, 16 bp, Homo sapiens
agccctgcattttcat

SEQ ID NO: 4434172 - DNA, 12 bp, Homo sapiens
agccctgcccac

SEQ ID NO: 4434173 - DNA, 14 bp, Homo sapiens
agccctgcccacag

SEQ ID NO: 4434174 - DNA, 22 bp, Homo sapiens
agccctgccctcccaagtccca

SEQ ID NO: 4434175 - DNA, 16 bp, Homo sapiens
agccctgctccctgcc

SEQ ID NO: 4434176 - DNA, 20 bp, Homo sapiens
agccctgctccctgcctcct

SEQ ID NO: 4434177 - DNA, 12 bp, Homo sapiens
agccctgctctt

SEQ ID NO: 4434178 - DNA, 21 bp, Homo sapiens
agccctgctcttctctcccca

SEQ ID NO: 4434179 - DNA, 23 bp, Homo sapiens
agccctggatttcagaaagagca

SEQ ID NO: 4434180 - DNA, 19 bp, Homo sapiens
agccctggcaaatgcctga

SEQ ID NO: 4434181 - DNA, 22 bp, Homo sapiens
agccagagggtgggagcctaag

SEQ ID NO: 4434182 - DNA, 22 bp, Homo sapiens
agccagcagagggggagtagcc

SEQ ID NO: 4434183 - DNA, 19 bp, Homo sapiens
agccagccaagctttaaat

SEQ ID NO: 4434184 - DNA, 18 bp, Homo sapiens
agccagcccagcccagct

SEQ ID NO: 4434185 - DNA, 16 bp, Homo sapiens
agccagccctccctgt

SEQ ID NO: 4434186 - DNA, 22 bp, Homo sapiens
agccagccctccctgtcctcct

SEQ ID NO: 4434187 - DNA, 17 bp, Homo sapiens
agccagccgtggccaga

SEQ ID NO: 4434188 - DNA, 16 bp, Homo sapiens
agccagcctcagaagg

SEQ ID NO: 4434189 - DNA, 16 bp, Homo sapiens
agccagcctggctctg

SEQ ID NO: 4434190 - DNA, 21 bp, Homo sapiens
agccagcctggctctgccccc

SEQ ID NO: 4434191 - DNA, 12 bp, Homo sapiens
agccagcgcctc

SEQ ID NO: 4434192 - DNA, 15 bp, Homo sapiens
agccagcgcctccct

SEQ ID NO: 4434193 - DNA, 17 bp, Homo sapiens
agccagcgcctccctcc

SEQ ID NO: 4434194 - DNA, 22 bp, Homo sapiens
agccagcttaaacccatacaat

SEQ ID NO: 4434195 - DNA, 22 bp, Homo sapiens
agccaggagcagccctggcccc

SEQ ID NO: 4434196 - DNA, 19 bp, Homo sapiens
agccaggaggcctgctagg

SEQ ID NO: 4434197 - DNA, 11 bp, Homo sapiens
agccaggcaca

SEQ ID NO: 4434198 - DNA, 17 bp, Homo sapiens
agccaggcacacactgt

SEQ ID NO: 4434199 - DNA, 18 bp, Homo sapiens
agccaggccaacagcacc

SEQ ID NO: 4434200 - DNA, 16 bp, Homo sapiens
agccaggctctgtgct

SEQ ID NO: 4434201 - DNA, 21 bp, Homo sapiens
agccaggctctgtgctgaccc

SEQ ID NO: 4434202 - DNA, 16 bp, Homo sapiens
agccaggcttttctca

SEQ ID NO: 4434203 - DNA, 15 bp, Homo sapiens
agccagggctggggt

SEQ ID NO: 4434204 - DNA, 17 bp, Homo sapiens
agccaggtggcacctgc

SEQ ID NO: 4434205 - DNA, 18 bp, Homo sapiens
agccaggtggcacctgca

SEQ ID NO: 4434206 - DNA, 21 bp, Homo sapiens
agccaggtggcacctgcagcg

SEQ ID NO: 4434207 - DNA, 22 bp, Homo sapiens
agccaggttctcattaggtttt

SEQ ID NO: 4434208 - DNA, 13 bp, Homo sapiens
agccagtcagggc

SEQ ID NO: 4434209 - DNA, 18 bp, Homo sapiens
agccagtggcgggtgatg

SEQ ID NO: 4434210 - DNA, 16 bp, Homo sapiens
agccatagaccctgag

SEQ ID NO: 4434211 - DNA, 15 bp, Homo sapiens
agccataggtgcagt

SEQ ID NO: 4434212 - DNA, 20 bp, Homo sapiens
agccatatatgaccagaagc

SEQ ID NO: 4434213 - DNA, 21 bp, Homo sapiens
agccatatatgaccagaagcc

SEQ ID NO: 4434214 - DNA, 20 bp, Homo sapiens
agccatcaagcacttcccag

SEQ ID NO: 4434215 - DNA, 18 bp, Homo sapiens
agccatcacttctccccg

SEQ ID NO: 4434216 - DNA, 20 bp, Homo sapiens
agccatccctttttttacat

SEQ ID NO: 4434217 - DNA, 14 bp, Homo sapiens
agccatcctccctc

SEQ ID NO: 4434218 - DNA, 15 bp, Homo sapiens
agccatcctccctcc

SEQ ID NO: 4434219 - DNA, 22 bp, Homo sapiens
agccatcctccctccacctcaa

SEQ ID NO: 4434220 - DNA, 14 bp, Homo sapiens
agccatcgtcctgg

SEQ ID NO: 4434221 - DNA, 23 bp, Homo sapiens
agccatgagttccagaaagtaaa

SEQ ID NO: 4434222 - DNA, 22 bp, Homo sapiens
agccatgatttcccactgcact

SEQ ID NO: 4434223 - DNA, 16 bp, Homo sapiens
agccatgctacagtta

SEQ ID NO: 4434224 - DNA, 21 bp, Homo sapiens
agccatgctacagttagtctt

SEQ ID NO: 4434225 - DNA, 22 bp, Homo sapiens
agccatggggtccatccccttc

SEQ ID NO: 4434226 - DNA, 18 bp, Homo sapiens
agccattaaatgaatatt

SEQ ID NO: 4434227 - DNA, 19 bp, Homo sapiens
agccatttattttttaaaa

SEQ ID NO: 4434228 - DNA, 14 bp, Homo sapiens
agccatttgtccca

SEQ ID NO: 4434229 - DNA, 17 bp, Homo sapiens
agccatttgtcccaagt

SEQ ID NO: 4434230 - DNA, 18 bp, Homo sapiens
agccatttgtcccaagtg

SEQ ID NO: 4434231 - DNA, 18 bp, Homo sapiens
agccatttttcaaagcaa

SEQ ID NO: 4434232 - DNA, 23 bp, Homo sapiens
agcccaagttcatgcagctgtgg

SEQ ID NO: 4434233 - DNA, 16 bp, Homo sapiens
agcccacagagcctga

SEQ ID NO: 4434234 - DNA, 16 bp, Homo sapiens
agcccacagtatattt

SEQ ID NO: 4434235 - DNA, 19 bp, Homo sapiens
agcccacagtatattttat

SEQ ID NO: 4434236 - DNA, 22 bp, Homo sapiens
agcccaccccctttgactctgg

SEQ ID NO: 4434237 - DNA, 17 bp, Homo sapiens
agcccaccctcctgtct

SEQ ID NO: 4434238 - DNA, 18 bp, Homo sapiens
agcccaccctcctgtctt

SEQ ID NO: 4434239 - DNA, 21 bp, Homo sapiens
agcccaccctcctgtcttccc

SEQ ID NO: 4434240 - DNA, 23 bp, Homo sapiens
agcccaccctcctgtcttcccag

SEQ ID NO: 4434241 - DNA, 17 bp, Homo sapiens
agcccactgaggggcca

SEQ ID NO: 4434242 - DNA, 17 bp, Homo sapiens
agcatccaggctggcca

SEQ ID NO: 4434243 - DNA, 18 bp, Homo sapiens
agcatccaggctggccag

SEQ ID NO: 4434244 - DNA, 19 bp, Homo sapiens
agcatcgcttaggagaagt

SEQ ID NO: 4434245 - DNA, 23 bp, Homo sapiens
agcatcggacaagacccccagca

SEQ ID NO: 4434246 - DNA, 19 bp, Homo sapiens
agcatcgggagcacccaga

SEQ ID NO: 4434247 - DNA, 21 bp, Homo sapiens
agcatcgggagcacccagagc

SEQ ID NO: 4434248 - DNA, 22 bp, Homo sapiens
agcatcgggagcacccagagca

SEQ ID NO: 4434249 - DNA, 22 bp, Homo sapiens
agcatctcttcttccctgtcag

SEQ ID NO: 4434250 - DNA, 12 bp, Homo sapiens
agcatctgcccc

SEQ ID NO: 4434251 - DNA, 13 bp, Homo sapiens
agcatctgcccca

SEQ ID NO: 4434252 - DNA, 19 bp, Homo sapiens
agcatgaataacatttaaa

SEQ ID NO: 4434253 - DNA, 18 bp, Homo sapiens
agcatgcaatacatacca

SEQ ID NO: 4434254 - DNA, 18 bp, Homo sapiens
agcatgcacactgagaat

SEQ ID NO: 4434255 - DNA, 21 bp, Homo sapiens
agcatgcatatcattaaacaa

SEQ ID NO: 4434256 - DNA, 14 bp, Homo sapiens
agcatggacattta

SEQ ID NO: 4434257 - DNA, 20 bp, Homo sapiens
agcatggacatttagaagaa

SEQ ID NO: 4434258 - DNA, 16 bp, Homo sapiens
agcatggagctgtcac

SEQ ID NO: 4434259 - DNA, 11 bp, Homo sapiens
agcatggatgc

SEQ ID NO: 4434260 - DNA, 14 bp, Homo sapiens
agcatggatgcatt

SEQ ID NO: 4434261 - DNA, 17 bp, Homo sapiens
agcatggatgcatttca

SEQ ID NO: 4434262 - DNA, 22 bp, Homo sapiens
agcatggatgcatttcaaatgt

SEQ ID NO: 4434263 - DNA, 17 bp, Homo sapiens
agcatggcatagccccg

SEQ ID NO: 4434264 - DNA, 18 bp, Homo sapiens
agcatggctattttatat

SEQ ID NO: 4434265 - DNA, 14 bp, Homo sapiens
agcatggggccagg

SEQ ID NO: 4434266 - DNA, 17 bp, Homo sapiens
agcatgggtgtgccctt

SEQ ID NO: 4434267 - DNA, 20 bp, Homo sapiens
agcatgggtgtgcccttggg

SEQ ID NO: 4434268 - DNA, 21 bp, Homo sapiens
agcatgtacggattttcagtt

SEQ ID NO: 4434269 - DNA, 15 bp, Homo sapiens
agcatgtaggagaat

SEQ ID NO: 4434270 - DNA, 24 bp, Homo sapiens
agcatgtggcatcgcagtctctta

SEQ ID NO: 4434271 - DNA, 16 bp, Homo sapiens
agcatgtgtcccagga

SEQ ID NO: 4434272 - DNA, 22 bp, Homo sapiens
agcatgtgttaatcttaatgta

SEQ ID NO: 4434273 - DNA, 22 bp, Homo sapiens
agcatgttcctccttttcttca

SEQ ID NO: 4434274 - DNA, 16 bp, Homo sapiens
agcattaaatcccaaa

SEQ ID NO: 4434275 - DNA, 21 bp, Homo sapiens
agcattaactaaatgctcata

SEQ ID NO: 4434276 - DNA, 14 bp, Homo sapiens
agcattacattatt

SEQ ID NO: 4434277 - DNA, 17 bp, Homo sapiens
agcattacattattaaa

SEQ ID NO: 4434278 - DNA, 15 bp, Homo sapiens
agcattcaggcagca

SEQ ID NO: 4434279 - DNA, 20 bp, Homo sapiens
agcattcaggcagcactgac

SEQ ID NO: 4434280 - DNA, 13 bp, Homo sapiens
agcattccagact

SEQ ID NO: 4434281 - DNA, 17 bp, Homo sapiens
agcattccagacttcaa

SEQ ID NO: 4434282 - DNA, 20 bp, Homo sapiens
agcattccagacttcaaaaa

SEQ ID NO: 4434283 - DNA, 18 bp, Homo sapiens
agcattccagctctgccc

SEQ ID NO: 4434284 - DNA, 19 bp, Homo sapiens
agcattccagctctgcccc

SEQ ID NO: 4434285 - DNA, 18 bp, Homo sapiens
agcattcttagcctgtgg

SEQ ID NO: 4434286 - DNA, 12 bp, Homo sapiens
agcattgcctgg

SEQ ID NO: 4434287 - DNA, 17 bp, Homo sapiens
agcattgcctggccttc

SEQ ID NO: 4434288 - DNA, 19 bp, Homo sapiens
agcattgctactgctcagc

SEQ ID NO: 4434289 - DNA, 20 bp, Homo sapiens
agcattgtaaaataattctg

SEQ ID NO: 4434290 - DNA, 22 bp, Homo sapiens
agcattgtaaaattatttcatg

SEQ ID NO: 4434291 - DNA, 17 bp, Homo sapiens
agcattgtaaatgtgct

SEQ ID NO: 4434292 - DNA, 15 bp, Homo sapiens
agcatttatttctct

SEQ ID NO: 4434293 - DNA, 16 bp, Homo sapiens
agcatttatttctctg

SEQ ID NO: 4434294 - DNA, 16 bp, Homo sapiens
agcatttgataatgat

SEQ ID NO: 4434295 - DNA, 19 bp, Homo sapiens
agcatttgataatgataaa

SEQ ID NO: 4434296 - DNA, 22 bp, Homo sapiens
agcatttgatctgttgcaagcc

SEQ ID NO: 4434297 - DNA, 15 bp, Homo sapiens
agcatttgtattatt

SEQ ID NO: 4434298 - DNA, 17 bp, Homo sapiens
agcattttgtaagttga

SEQ ID NO: 4434299 - DNA, 16 bp, Homo sapiens
agcatttttcaatata

SEQ ID NO: 4434300 - DNA, 20 bp, Homo sapiens
agcatttttcaatatattga

SEQ ID NO: 4434301 - DNA, 23 bp, Homo sapiens
agcatttttcaatatattgaact

SEQ ID NO: 4434302 - DNA, 22 bp, Homo sapiens
agccaaaaatagctaaatacct

SEQ ID NO: 4434303 - DNA, 15 bp, Homo sapiens
agccaaaagtccctc

SEQ ID NO: 4434304 - DNA, 20 bp, Homo sapiens
agccaaaagtccctccctgc

SEQ ID NO: 4434305 - DNA, 12 bp, Homo sapiens
agccaaaccagg

SEQ ID NO: 4434306 - DNA, 16 bp, Homo sapiens
agccaaagaaatgaac

SEQ ID NO: 4434307 - DNA, 14 bp, Homo sapiens
agcaggcgggctcc

SEQ ID NO: 4434308 - DNA, 14 bp, Homo sapiens
agcaggctactgtc

SEQ ID NO: 4434309 - DNA, 16 bp, Homo sapiens
agcaggctactgtcag

SEQ ID NO: 4434310 - DNA, 19 bp, Homo sapiens
agcaggctactgtcagctc

SEQ ID NO: 4434311 - DNA, 14 bp, Homo sapiens
agcaggctgccagt

SEQ ID NO: 4434312 - DNA, 18 bp, Homo sapiens
agcaggctgccagtgcct

SEQ ID NO: 4434313 - DNA, 13 bp, Homo sapiens
agcaggctgttcc

SEQ ID NO: 4434314 - DNA, 21 bp, Homo sapiens
agcagggagaccatgcctccc

SEQ ID NO: 4434315 - DNA, 19 bp, Homo sapiens
agcagggagttagcactga

SEQ ID NO: 4434316 - DNA, 15 bp, Homo sapiens
agcaggggcaccttc

SEQ ID NO: 4434317 - DNA, 15 bp, Homo sapiens
agcaggggcccctgg

SEQ ID NO: 4434318 - DNA, 13 bp, Homo sapiens
agcaggggctcca

SEQ ID NO: 4434319 - DNA, 17 bp, Homo sapiens
agcaggtagcctgctgg

SEQ ID NO: 4434320 - DNA, 20 bp, Homo sapiens
agcaggtttgttttcagcac

SEQ ID NO: 4434321 - DNA, 14 bp, Homo sapiens
agcagtacaataaa

SEQ ID NO: 4434322 - DNA, 14 bp, Homo sapiens
agcagtatatgtta

SEQ ID NO: 4434323 - DNA, 15 bp, Homo sapiens
agcagtatattagta

SEQ ID NO: 4434324 - DNA, 20 bp, Homo sapiens
agcagtattctatttggtta

SEQ ID NO: 4434325 - DNA, 11 bp, Homo sapiens
agcagtatttt

SEQ ID NO: 4434326 - DNA, 16 bp, Homo sapiens
agcagtcagagtccag

SEQ ID NO: 4434327 - DNA, 19 bp, Homo sapiens
agcagtcagagtccagtgc

SEQ ID NO: 4434328 - DNA, 15 bp, Homo sapiens
agcagtccatgcatg

SEQ ID NO: 4434329 - DNA, 18 bp, Homo sapiens
agcagtctgataaactga

SEQ ID NO: 4434330 - DNA, 15 bp, Homo sapiens
agcagtcttgctctg

SEQ ID NO: 4434331 - DNA, 20 bp, Homo sapiens
agcagtgaatgattcagtgt

SEQ ID NO: 4434332 - DNA, 22 bp, Homo sapiens
agcagtgaatgattcagtgtta

SEQ ID NO: 4434333 - DNA, 20 bp, Homo sapiens
agcagtgagccaaatgtaaa

SEQ ID NO: 4434334 - DNA, 14 bp, Homo sapiens
agcagtgagccgca

SEQ ID NO: 4434335 - DNA, 14 bp, Homo sapiens
agcagtgtccagag

SEQ ID NO: 4434336 - DNA, 20 bp, Homo sapiens
agcagtgtgaatagcctggc

SEQ ID NO: 4434337 - DNA, 21 bp, Homo sapiens
agcagtgtgaggccagggcag

SEQ ID NO: 4434338 - DNA, 20 bp, Homo sapiens
agcagtgtggagaccctgcc

SEQ ID NO: 4434339 - DNA, 15 bp, Homo sapiens
agcagttataacaga

SEQ ID NO: 4434340 - DNA, 20 bp, Homo sapiens
agcagttatggtgatgactt

SEQ ID NO: 4434341 - DNA, 20 bp, Homo sapiens
agcagttctcctgcctcagc

SEQ ID NO: 4434342 - DNA, 13 bp, Homo sapiens
agcagttctgcaa

SEQ ID NO: 4434343 - DNA, 16 bp, Homo sapiens
agcagttctgcaaata

SEQ ID NO: 4434344 - DNA, 23 bp, Homo sapiens
agcagttgaaaagactccaaaga

SEQ ID NO: 4434345 - DNA, 14 bp, Homo sapiens
agcagttgatatta

SEQ ID NO: 4434346 - DNA, 16 bp, Homo sapiens
agcagtttctgtccta

SEQ ID NO: 4434347 - DNA, 14 bp, Homo sapiens
agcataaaacctaa

SEQ ID NO: 4434348 - DNA, 15 bp, Homo sapiens
agcataaaacctaaa

SEQ ID NO: 4434349 - DNA, 19 bp, Homo sapiens
agcataccaacacgagcag

SEQ ID NO: 4434350 - DNA, 22 bp, Homo sapiens
agcataccaacacgagcaggct

SEQ ID NO: 4434351 - DNA, 13 bp, Homo sapiens
agcatactttgta

SEQ ID NO: 4434352 - DNA, 23 bp, Homo sapiens
agcatatgggtgggattttgcaa

SEQ ID NO: 4434353 - DNA, 20 bp, Homo sapiens
agcatatgtgtaaagattta

SEQ ID NO: 4434354 - DNA, 13 bp, Homo sapiens
agcatcaatcttg

SEQ ID NO: 4434355 - DNA, 22 bp, Homo sapiens
agcatcactgatgggaataaaa

SEQ ID NO: 4434356 - DNA, 15 bp, Homo sapiens
agcatcagagggctg

SEQ ID NO: 4434357 - DNA, 13 bp, Homo sapiens
agcatccaggctg

SEQ ID NO: 4434358 - DNA, 14 bp, Homo sapiens
agcatccaggctgg

SEQ ID NO: 4434359 - DNA, 19 bp, Homo sapiens
agcaccccatgccaaagct

SEQ ID NO: 4434360 - DNA, 14 bp, Homo sapiens
agcaccccctgctc

SEQ ID NO: 4434361 - DNA, 13 bp, Homo sapiens
agcaccctccccc

SEQ ID NO: 4434362 - DNA, 14 bp, Homo sapiens
agcaccctctcctg

SEQ ID NO: 4434363 - DNA, 15 bp, Homo sapiens
agcaccctctcctgg

SEQ ID NO: 4434364 - DNA, 21 bp, Homo sapiens
agcacctacagtgtacagtct

SEQ ID NO: 4434365 - DNA, 22 bp, Homo sapiens
agcacctacagtgtacagtctt

SEQ ID NO: 4434366 - DNA, 17 bp, Homo sapiens
agcaccttcagggctga

SEQ ID NO: 4434367 - DNA, 20 bp, Homo sapiens
agcaccttctttctggactg

SEQ ID NO: 4434368 - DNA, 20 bp, Homo sapiens
agcacggggctggcagggcg

SEQ ID NO: 4434369 - DNA, 20 bp, Homo sapiens
agcacgggggagtgagacag

SEQ ID NO: 4434370 - DNA, 18 bp, Homo sapiens
agcacggtcccccaggag

SEQ ID NO: 4434371 - DNA, 20 bp, Homo sapiens
agcacggtcccccaggaggc

SEQ ID NO: 4434372 - DNA, 22 bp, Homo sapiens
agcacgtggagatagtgccagg

SEQ ID NO: 4434373 - DNA, 17 bp, Homo sapiens
agcacgtttaaagttct

SEQ ID NO: 4434374 - DNA, 18 bp, Homo sapiens
agcacgtttaaagttctg

SEQ ID NO: 4434375 - DNA, 14 bp, Homo sapiens
agcactactgggtg

SEQ ID NO: 4434376 - DNA, 16 bp, Homo sapiens
agcactactgggtgtc

SEQ ID NO: 4434377 - DNA, 20 bp, Homo sapiens
agcactactgggtgtcattt

SEQ ID NO: 4434378 - DNA, 23 bp, Homo sapiens
agcactactgggtgtcatttcat

SEQ ID NO: 4434379 - DNA, 20 bp, Homo sapiens
agcactagaaattgggcagt

SEQ ID NO: 4434380 - DNA, 23 bp, Homo sapiens
agcactccctaatttatgtgcta

SEQ ID NO: 4434381 - DNA, 17 bp, Homo sapiens
agcactcggggtccctg

SEQ ID NO: 4434382 - DNA, 24 bp, Homo sapiens
agcactctgtaaaacgcaccaatc

SEQ ID NO: 4434383 - DNA, 24 bp, Homo sapiens
agcactctgtaaaatgcaccaatc

SEQ ID NO: 4434384 - DNA, 17 bp, Homo sapiens
agcactgacttaaaacg

SEQ ID NO: 4434385 - DNA, 16 bp, Homo sapiens
agcactgacttctaag

SEQ ID NO: 4434386 - DNA, 16 bp, Homo sapiens
agcactgatagtcctt

SEQ ID NO: 4434387 - DNA, 22 bp, Homo sapiens
agcactgatagtcctttttcca

SEQ ID NO: 4434388 - DNA, 23 bp, Homo sapiens
agcactgcagaaacctttaaaaa

SEQ ID NO: 4434389 - DNA, 22 bp, Homo sapiens
agcactgcatgtcagagcactt

SEQ ID NO: 4434390 - DNA, 16 bp, Homo sapiens
agcactgccccacatg

SEQ ID NO: 4434391 - DNA, 12 bp, Homo sapiens
agcactggcctg

SEQ ID NO: 4434392 - DNA, 23 bp, Homo sapiens
agcactggtgaactgagctgggc

SEQ ID NO: 4434393 - DNA, 17 bp, Homo sapiens
agcactggtttcaagaa

SEQ ID NO: 4434394 - DNA, 17 bp, Homo sapiens
agcacttacgtaaaaca

SEQ ID NO: 4434395 - DNA, 18 bp, Homo sapiens
agcacttacgtaaaacat

SEQ ID NO: 4434396 - DNA, 16 bp, Homo sapiens
agcacttagacctgcc

SEQ ID NO: 4434397 - DNA, 23 bp, Homo sapiens
agcacttagacctgccagccact

SEQ ID NO: 4434398 - DNA, 15 bp, Homo sapiens
agcacttcccaggat

SEQ ID NO: 4434399 - DNA, 16 bp, Homo sapiens
agcacttcccaggatc

SEQ ID NO: 4434400 - DNA, 13 bp, Homo sapiens
agcacttctagaa

SEQ ID NO: 4434401 - DNA, 14 bp, Homo sapiens
agcacttctagaat

SEQ ID NO: 4434402 - DNA, 16 bp, Homo sapiens
agcacttctgctgcat

SEQ ID NO: 4434403 - DNA, 22 bp, Homo sapiens
agcacttgagaaccagtctcct

SEQ ID NO: 4434404 - DNA, 22 bp, Homo sapiens
agcacttgcaaccgtctgttat

SEQ ID NO: 4434405 - DNA, 13 bp, Homo sapiens
agatttgatgtat

SEQ ID NO: 4434406 - DNA, 20 bp, Homo sapiens
agatttgcccatttacactt

SEQ ID NO: 4434407 - DNA, 20 bp, Homo sapiens
agattttaaattttatgtca

SEQ ID NO: 4434408 - DNA, 14 bp, Homo sapiens
agattttatagtgt

SEQ ID NO: 4434409 - DNA, 19 bp, Homo sapiens
agattttcagcaaactctt

SEQ ID NO: 4434410 - DNA, 19 bp, Homo sapiens
agattttccattaactatt

SEQ ID NO: 4434411 - DNA, 19 bp, Homo sapiens
agattttctgctactttgc

SEQ ID NO: 4434412 - DNA, 22 bp, Homo sapiens
agattttcttttgccttttgca

SEQ ID NO: 4434413 - DNA, 19 bp, Homo sapiens
agattttgaggtaaagata

SEQ ID NO: 4434414 - DNA, 17 bp, Homo sapiens
agattttgataactgtt

SEQ ID NO: 4434415 - DNA, 19 bp, Homo sapiens
agattttgttatgttcaat

SEQ ID NO: 4434416 - DNA, 21 bp, Homo sapiens
agatttttatattagttgctt

SEQ ID NO: 4434417 - DNA, 15 bp, Homo sapiens
agatttttatcttaa

SEQ ID NO: 4434418 - DNA, 17 bp, Homo sapiens
agatttttatgttttct

SEQ ID NO: 4434419 - DNA, 14 bp, Homo sapiens
agatttttcaaaat

SEQ ID NO: 4434420 - DNA, 16 bp, Homo sapiens
agattttttaataatt

SEQ ID NO: 4434421 - DNA, 21 bp, Homo sapiens
agattttttcagacttgtcaa

SEQ ID NO: 4434422 - DNA, 21 bp, Homo sapiens
agatttttttcatagatttga

SEQ ID NO: 4434423 - DNA, 22 bp, Homo sapiens
agatttttttcatagatttgaa

SEQ ID NO: 4434424 - DNA, 13 bp, Homo sapiens
agatttttttcct

SEQ ID NO: 4434425 - DNA, 18 bp, Homo sapiens
agattttttttgtaactt

SEQ ID NO: 4434426 - DNA, 14 bp, Homo sapiens
agcaaaaaagaaaa

SEQ ID NO: 4434427 - DNA, 22 bp, Homo sapiens
agcaaaaagtggggcagagcct

SEQ ID NO: 4434428 - DNA, 14 bp, Homo sapiens
agcaaaaatgtttt

SEQ ID NO: 4434429 - DNA, 19 bp, Homo sapiens
agcaaaaccaaactgggtc

SEQ ID NO: 4434430 - DNA, 18 bp, Homo sapiens
agcaaaagtaatcactta

SEQ ID NO: 4434431 - DNA, 18 bp, Homo sapiens
agcaaaatctaaaatgtt

SEQ ID NO: 4434432 - DNA, 13 bp, Homo sapiens
agcaaacagaaaa

SEQ ID NO: 4434433 - DNA, 18 bp, Homo sapiens
agcaaactatgatttatt

SEQ ID NO: 4434434 - DNA, 13 bp, Homo sapiens
agcaaagaagctt

SEQ ID NO: 4434435 - DNA, 15 bp, Homo sapiens
agcaaaggagaaatc

SEQ ID NO: 4434436 - DNA, 24 bp, Homo sapiens
agcaaagtagtacttcttctgtaa

SEQ ID NO: 4434437 - DNA, 19 bp, Homo sapiens
agcaaagtgcccatggtgg

SEQ ID NO: 4434438 - DNA, 14 bp, Homo sapiens
agcaaataaagcag

SEQ ID NO: 4434439 - DNA, 12 bp, Homo sapiens
agcaaatactta

SEQ ID NO: 4434440 - DNA, 15 bp, Homo sapiens
agcaaatacttagca

SEQ ID NO: 4434441 - DNA, 16 bp, Homo sapiens
agcaaatcagaaactt

SEQ ID NO: 4434442 - DNA, 20 bp, Homo sapiens
agcaaatcagtatattttct

SEQ ID NO: 4434443 - DNA, 16 bp, Homo sapiens
agcaaatgacagattt

SEQ ID NO: 4434444 - DNA, 21 bp, Homo sapiens
agcaaatgggcattttacaag

SEQ ID NO: 4434445 - DNA, 15 bp, Homo sapiens
agcaaatgtttactg

SEQ ID NO: 4434446 - DNA, 16 bp, Homo sapiens
agcaaatgtttactgt

SEQ ID NO: 4434447 - DNA, 15 bp, Homo sapiens
agcaacagactctca

SEQ ID NO: 4434448 - DNA, 19 bp, Homo sapiens
acagtttgactttttggaa

SEQ ID NO: 4434449 - DNA, 19 bp, Homo sapiens
acagttttaataagaacag

SEQ ID NO: 4434450 - DNA, 19 bp, Homo sapiens
acagttttctgagaaagac

SEQ ID NO: 4434451 - DNA, 23 bp, Homo sapiens
acagttttgagtaaaaagacatt

SEQ ID NO: 4434452 - DNA, 17 bp, Homo sapiens
acagttttgctttagta

SEQ ID NO: 4434453 - DNA, 11 bp, Homo sapiens
acataaaaact

SEQ ID NO: 4434454 - DNA, 14 bp, Homo sapiens
acataaaaaggaca

SEQ ID NO: 4434455 - DNA, 13 bp, Homo sapiens
acataaacaatga

SEQ ID NO: 4434456 - DNA, 16 bp, Homo sapiens
acataaaccatttttg

SEQ ID NO: 4434457 - DNA, 22 bp, Homo sapiens
acataaaccatttttgttactc

SEQ ID NO: 4434458 - DNA, 16 bp, Homo sapiens
acataaagaaattcaa

SEQ ID NO: 4434459 - DNA, 21 bp, Homo sapiens
acataaagaaattcaagaagt

SEQ ID NO: 4434460 - DNA, 21 bp, Homo sapiens
acataaagccttttgctttat

SEQ ID NO: 4434461 - DNA, 15 bp, Homo sapiens
acataaagttgataa

SEQ ID NO: 4434462 - DNA, 16 bp, Homo sapiens
acataaatcacagaaa

SEQ ID NO: 4434463 - DNA, 15 bp, Homo sapiens
acataaattttaatt

SEQ ID NO: 4434464 - DNA, 16 bp, Homo sapiens
acataaattttaattc

SEQ ID NO: 4434465 - DNA, 20 bp, Homo sapiens
acataaattttaattcaaga

SEQ ID NO: 4434466 - DNA, 18 bp, Homo sapiens
acataaccaatttgtaat

SEQ ID NO: 4434467 - DNA, 12 bp, Homo sapiens
acataactgaaa

SEQ ID NO: 4434468 - DNA, 13 bp, Homo sapiens
acataactgcttc

SEQ ID NO: 4434469 - DNA, 14 bp, Homo sapiens
acataagaaggcaa

SEQ ID NO: 4434470 - DNA, 14 bp, Homo sapiens
acataagagaaaga

SEQ ID NO: 4434471 - DNA, 18 bp, Homo sapiens
acataagccattattcac

SEQ ID NO: 4434472 - DNA, 18 bp, Homo sapiens
acataatatagcttaaaa

SEQ ID NO: 4434473 - DNA, 23 bp, Homo sapiens
acataatgggccactgaaatctg

SEQ ID NO: 4434474 - DNA, 14 bp, Homo sapiens
acataattcttcct

SEQ ID NO: 4434475 - DNA, 19 bp, Homo sapiens
acataattcttccttccct

SEQ ID NO: 4434476 - DNA, 21 bp, Homo sapiens
acataattcttccttccctcc

SEQ ID NO: 4434477 - DNA, 15 bp, Homo sapiens
acataattgcatgaa

SEQ ID NO: 4434478 - DNA, 14 bp, Homo sapiens
acatactcattttt

SEQ ID NO: 4434479 - DNA, 24 bp, Homo sapiens
acatactccttccatcaaatagaa

SEQ ID NO: 4434480 - DNA, 15 bp, Homo sapiens
acatactgttctcaa

SEQ ID NO: 4434481 - DNA, 23 bp, Homo sapiens
acatactgttctcaacatactgt

SEQ ID NO: 4434482 - DNA, 16 bp, Homo sapiens
acatagacagaagaaa

SEQ ID NO: 4434483 - DNA, 17 bp, Homo sapiens
acatagactagagaaac

SEQ ID NO: 4434484 - DNA, 21 bp, Homo sapiens
acatagaggtatattggaaga

SEQ ID NO: 4434485 - DNA, 19 bp, Homo sapiens
acatagattcacctgtaaa

SEQ ID NO: 4434486 - DNA, 20 bp, Homo sapiens
acataggcttctattaccta

SEQ ID NO: 4434487 - DNA, 17 bp, Homo sapiens
acatagtaagttcagca

SEQ ID NO: 4434488 - DNA, 17 bp, Homo sapiens
acatagttcgtttacct

SEQ ID NO: 4434489 - DNA, 21 bp, Homo sapiens
acatatgagaatataccttat

SEQ ID NO: 4434490 - DNA, 15 bp, Homo sapiens
acatatgttcctaat

SEQ ID NO: 4434491 - DNA, 14 bp, Homo sapiens
acatatttaatgtt

SEQ ID NO: 4434492 - DNA, 16 bp, Homo sapiens
acatatttaatgtttt

SEQ ID NO: 4434493 - DNA, 15 bp, Homo sapiens
acatatttttatact

SEQ ID NO: 4434494 - DNA, 18 bp, Homo sapiens
acatatttttatacttta

SEQ ID NO: 4434495 - DNA, 22 bp, Homo sapiens
acatatttttatactttattga

SEQ ID NO: 4434496 - DNA, 14 bp, Homo sapiens
acatcaaagactcc

SEQ ID NO: 4434497 - DNA, 17 bp, Homo sapiens
acatcaacaagaagaaa

SEQ ID NO: 4434498 - DNA, 19 bp, Homo sapiens
acatcaacattccagggat

SEQ ID NO: 4434499 - DNA, 18 bp, Homo sapiens
acatcaagtccatctgac

SEQ ID NO: 4434500 - DNA, 17 bp, Homo sapiens
acatcaatggctttgta

SEQ ID NO: 4434501 - DNA, 17 bp, Homo sapiens
acatcacaatattcagt

SEQ ID NO: 4434502 - DNA, 12 bp, Homo sapiens
acatcaccagtc

SEQ ID NO: 4434503 - DNA, 19 bp, Homo sapiens
acatcagactctagaaaaa

SEQ ID NO: 4434504 - DNA, 20 bp, Homo sapiens
acatcagccttcaagaatca

SEQ ID NO: 4434505 - DNA, 20 bp, Homo sapiens
acatcagggcggcctcccag

SEQ ID NO: 4434506 - DNA, 18 bp, Homo sapiens
acatcagtacttttctct

SEQ ID NO: 4434507 - DNA, 16 bp, Homo sapiens
acatcagtagcatttt

SEQ ID NO: 4434508 - DNA, 20 bp, Homo sapiens
acatcagtagcatttttcta

SEQ ID NO: 4434509 - DNA, 20 bp, Homo sapiens
acatcagtctccaacatgtt

SEQ ID NO: 4434510 - DNA, 13 bp, Homo sapiens
acatcataaatct

SEQ ID NO: 4434511 - DNA, 18 bp, Homo sapiens
acatcattattgtagttt

SEQ ID NO: 4434512 - DNA, 14 bp, Homo sapiens
acatcattgtcagc

SEQ ID NO: 4434513 - DNA, 17 bp, Homo sapiens
acatcattgtcagcctt

SEQ ID NO: 4434514 - DNA, 18 bp, Homo sapiens
acatcattgtcagccttg

SEQ ID NO: 4434515 - DNA, 14 bp, Homo sapiens
acatcatttcaatc

SEQ ID NO: 4434516 - DNA, 14 bp, Homo sapiens
agagccctgctgtg

SEQ ID NO: 4434517 - DNA, 15 bp, Homo sapiens
agagcccttcccagg

SEQ ID NO: 4434518 - DNA, 16 bp, Homo sapiens
agagcccttcccaggg

SEQ ID NO: 4434519 - DNA, 18 bp, Homo sapiens
agagcccttcccagggca

SEQ ID NO: 4434520 - DNA, 19 bp, Homo sapiens
agagccggccgtggaagga

SEQ ID NO: 4434521 - DNA, 15 bp, Homo sapiens
agagccggtggtgcc

SEQ ID NO: 4434522 - DNA, 22 bp, Homo sapiens
agagcctcccaaggagaacaaa

SEQ ID NO: 4434523 - DNA, 23 bp, Homo sapiens
agagcctcccaaggagaacaaat

SEQ ID NO: 4434524 - DNA, 23 bp, Homo sapiens
agagcctcccaccagagccggga

SEQ ID NO: 4434525 - DNA, 11 bp, Homo sapiens
agagcctgagg

SEQ ID NO: 4434526 - DNA, 13 bp, Homo sapiens
agagcctgaggga

SEQ ID NO: 4434527 - DNA, 20 bp, Homo sapiens
agagcctgctcccccacccc

SEQ ID NO: 4434528 - DNA, 15 bp, Homo sapiens
agagcctgctgcatg

SEQ ID NO: 4434529 - DNA, 24 bp, Homo sapiens
agagcctgctggcacccaccgtgg

SEQ ID NO: 4434530 - DNA, 13 bp, Homo sapiens
agagcctgtggag

SEQ ID NO: 4434531 - DNA, 20 bp, Homo sapiens
agagccttagcagccctgga

SEQ ID NO: 4434532 - DNA, 17 bp, Homo sapiens
agagccttcaagtgcca

SEQ ID NO: 4434533 - DNA, 14 bp, Homo sapiens
agagccttcagcct

SEQ ID NO: 4434534 - DNA, 13 bp, Homo sapiens
agagccttctcag

SEQ ID NO: 4434535 - DNA, 19 bp, Homo sapiens
agagccttctcagaagcac

SEQ ID NO: 4434536 - DNA, 17 bp, Homo sapiens
agagccttggtgtccac

SEQ ID NO: 4434537 - DNA, 19 bp, Homo sapiens
agagccttggtgtccacct

SEQ ID NO: 4434538 - DNA, 22 bp, Homo sapiens
agagccttggtgtccacctggc

SEQ ID NO: 4434539 - DNA, 17 bp, Homo sapiens
agagcgccaggaagcca

SEQ ID NO: 4434540 - DNA, 19 bp, Homo sapiens
agagcgccaggaagccaga

SEQ ID NO: 4434541 - DNA, 17 bp, Homo sapiens
agagcgtccttggctgc

SEQ ID NO: 4434542 - DNA, 16 bp, Homo sapiens
agagctacataattta

SEQ ID NO: 4434543 - DNA, 18 bp, Homo sapiens
agagctacataatttagt

SEQ ID NO: 4434544 - DNA, 22 bp, Homo sapiens
agagctagaacatggagagcta

SEQ ID NO: 4434545 - DNA, 22 bp, Homo sapiens
agagctagaacctggagaacta

SEQ ID NO: 4434546 - DNA, 19 bp, Homo sapiens
agagctagaacctggagag

SEQ ID NO: 4434547 - DNA, 14 bp, Homo sapiens
agagctagcgctgc

SEQ ID NO: 4434548 - DNA, 13 bp, Homo sapiens
agagctattttag

SEQ ID NO: 4434549 - DNA, 16 bp, Homo sapiens
agagctattttagaaa

SEQ ID NO: 4434550 - DNA, 22 bp, Homo sapiens
agagctattttagaaagctaaa

SEQ ID NO: 4434551 - DNA, 23 bp, Homo sapiens
agagctcccccgtggtgcctgca

SEQ ID NO: 4434552 - DNA, 14 bp, Homo sapiens
agagctctgcacgt

SEQ ID NO: 4434553 - DNA, 14 bp, Homo sapiens
agagctcttggccc

SEQ ID NO: 4434554 - DNA, 23 bp, Homo sapiens
agagctgacccagagtggagtct

SEQ ID NO: 4434555 - DNA, 20 bp, Homo sapiens
agagctgccctccttgtcca

SEQ ID NO: 4434556 - DNA, 15 bp, Homo sapiens
agagctggagccccc

SEQ ID NO: 4434557 - DNA, 17 bp, Homo sapiens
agagctggagcccccag

SEQ ID NO: 4434558 - DNA, 23 bp, Homo sapiens
agagctggcgctcagcagcccta

SEQ ID NO: 4434559 - DNA, 24 bp, Homo sapiens
agagctggcgctcagcagccctag

SEQ ID NO: 4434560 - DNA, 18 bp, Homo sapiens
agagctgggaaattcatg

SEQ ID NO: 4434561 - DNA, 10 bp, Homo sapiens
agagctgggc

SEQ ID NO: 4434562 - DNA, 17 bp, Homo sapiens
agagctgtattaagcca

SEQ ID NO: 4434563 - DNA, 19 bp, Homo sapiens
agagctgtattaagccact

SEQ ID NO: 4434564 - DNA, 16 bp, Homo sapiens
agagctgtctgaactc

SEQ ID NO: 4434565 - DNA, 17 bp, Homo sapiens
agagctgtctgaactca

SEQ ID NO: 4434566 - DNA, 21 bp, Homo sapiens
agagctgttcacagccagact

SEQ ID NO: 4434567 - DNA, 13 bp, Homo sapiens
agagcttccctga

SEQ ID NO: 4434568 - DNA, 20 bp, Homo sapiens
agagcttccctgactcattc

SEQ ID NO: 4434569 - DNA, 20 bp, Homo sapiens
agagcttggactacacaata

SEQ ID NO: 4434570 - DNA, 20 bp, Homo sapiens
agagctttgtcacttgccac

SEQ ID NO: 4434571 - DNA, 14 bp, Homo sapiens
agagcttttcagat

SEQ ID NO: 4434572 - DNA, 13 bp, Homo sapiens
agaggaaaaatat

SEQ ID NO: 4434573 - DNA, 21 bp, Homo sapiens
agaggaacagcactggggagt

SEQ ID NO: 4434574 - DNA, 12 bp, Homo sapiens
agaggaagaaat

SEQ ID NO: 4434575 - DNA, 14 bp, Homo sapiens
agaggaagaaatgt

SEQ ID NO: 4434576 - DNA, 14 bp, Homo sapiens
agaggaagctgttg

SEQ ID NO: 4434577 - DNA, 18 bp, Homo sapiens
agaggaaggggccagagg

SEQ ID NO: 4434578 - DNA, 23 bp, Homo sapiens
agaggaaggggccagaggctcgt

SEQ ID NO: 4434579 - DNA, 15 bp, Homo sapiens
agaggaagttcagat

SEQ ID NO: 4434580 - DNA, 18 bp, Homo sapiens
agaggaagttcagatctt

SEQ ID NO: 4434581 - DNA, 14 bp, Homo sapiens
agaggaccagagga

SEQ ID NO: 4434582 - DNA, 17 bp, Homo sapiens
agaggaccagaggagca

SEQ ID NO: 4434583 - DNA, 14 bp, Homo sapiens
agaggagaaactga

SEQ ID NO: 4434584 - DNA, 22 bp, Homo sapiens
agaggagaaatgcaataactct

SEQ ID NO: 4434585 - DNA, 20 bp, Homo sapiens
agaggagcagaccagcactt

SEQ ID NO: 4434586 - DNA, 17 bp, Homo sapiens
agaggagccaccagttc

SEQ ID NO: 4434587 - DNA, 15 bp, Homo sapiens
agaggagcttttctg

SEQ ID NO: 4434588 - DNA, 13 bp, Homo sapiens
agaggagggcaga

SEQ ID NO: 4434589 - DNA, 14 bp, Homo sapiens
agaggagggcagag

SEQ ID NO: 4434590 - DNA, 18 bp, Homo sapiens
agaggagggcagagggag

SEQ ID NO: 4434591 - DNA, 19 bp, Homo sapiens
agaggagggcgtgactcac

SEQ ID NO: 4434592 - DNA, 18 bp, Homo sapiens
agaggatgatttcagaag

SEQ ID NO: 4434593 - DNA, 21 bp, Homo sapiens
agaggatggtcttacagcagg

SEQ ID NO: 4434594 - DNA, 15 bp, Homo sapiens
agaggattgtaaaat

SEQ ID NO: 4434595 - DNA, 18 bp, Homo sapiens
agaggcaaagaaaggaga

SEQ ID NO: 4434596 - DNA, 16 bp, Homo sapiens
agaggcaagctgaaat

SEQ ID NO: 4434597 - DNA, 22 bp, Homo sapiens
agaggcaataaataaatgtttt

SEQ ID NO: 4434598 - DNA, 19 bp, Homo sapiens
agaggcactcagtgagcct

SEQ ID NO: 4434599 - DNA, 21 bp, Homo sapiens
agaggcactcagtgagcctcc

SEQ ID NO: 4434600 - DNA, 23 bp, Homo sapiens
agaggcactcagtgagcctcctg

SEQ ID NO: 4434601 - DNA, 16 bp, Homo sapiens
agaggcatacacacag

SEQ ID NO: 4434602 - DNA, 17 bp, Homo sapiens
agaggcatttaaaatgg

SEQ ID NO: 4434603 - DNA, 19 bp, Homo sapiens
agaggcatttaaaatggaa

SEQ ID NO: 4434604 - DNA, 16 bp, Homo sapiens
agaggccagccccacc

SEQ ID NO: 4434605 - DNA, 17 bp, Homo sapiens
agaggccagccccaccc

SEQ ID NO: 4434606 - DNA, 23 bp, Homo sapiens
agaggccagccccacccaggagg

SEQ ID NO: 4434607 - DNA, 12 bp, Homo sapiens
agaggccccacc

SEQ ID NO: 4434608 - DNA, 22 bp, Homo sapiens
agaggccccacctgaagggtgg

SEQ ID NO: 4434609 - DNA, 23 bp, Homo sapiens
agaggccccacctgaagggtgga

SEQ ID NO: 4434610 - DNA, 19 bp, Homo sapiens
agaggccctcgctgccagc

SEQ ID NO: 4434611 - DNA, 12 bp, Homo sapiens
agaggccctgcc

SEQ ID NO: 4434612 - DNA, 14 bp, Homo sapiens
agaggccctggagg

SEQ ID NO: 4434613 - DNA, 16 bp, Homo sapiens
agaggccctggaggga

SEQ ID NO: 4434614 - DNA, 19 bp, Homo sapiens
agaggccctggagggaagg

SEQ ID NO: 4434615 - DNA, 20 bp, Homo sapiens
agaggcctgcctccagggct

SEQ ID NO: 4434616 - DNA, 21 bp, Homo sapiens
agaggcctgcctccagggctg

SEQ ID NO: 4434617 - DNA, 22 bp, Homo sapiens
agaggcctgcctccagggctgg

SEQ ID NO: 4434618 - DNA, 16 bp, Homo sapiens
agaggcctgctgccag

SEQ ID NO: 4434619 - DNA, 19 bp, Homo sapiens
agaggctagcttctgcttt

SEQ ID NO: 4434620 - DNA, 20 bp, Homo sapiens
agaggctccagctctggcac

SEQ ID NO: 4434621 - DNA, 15 bp, Homo sapiens
agaggctctggacag

SEQ ID NO: 4434622 - DNA, 20 bp, Homo sapiens
agaggctctggacagcagaa

SEQ ID NO: 4434623 - DNA, 18 bp, Homo sapiens
agaggctgcccctctcac

SEQ ID NO: 4434624 - DNA, 19 bp, Homo sapiens
agaggctgcccctctcacc

SEQ ID NO: 4434625 - DNA, 19 bp, Homo sapiens
agaggctggaggcagggcc

SEQ ID NO: 4434626 - DNA, 20 bp, Homo sapiens
agaggctggaggcagggcct

SEQ ID NO: 4434627 - DNA, 22 bp, Homo sapiens
agaggctgggagtccctacctg

SEQ ID NO: 4434628 - DNA, 19 bp, Homo sapiens
agaggcttctccgccagcc

SEQ ID NO: 4434629 - DNA, 20 bp, Homo sapiens
agaggcttctccgccagcct

SEQ ID NO: 4434630 - DNA, 23 bp, Homo sapiens
agaggcttctccgccagcctcct

SEQ ID NO: 4434631 - DNA, 14 bp, Homo sapiens
agaggcttctcctg

SEQ ID NO: 4434632 - DNA, 14 bp, Homo sapiens
agaggcttcttcag

SEQ ID NO: 4434633 - DNA, 21 bp, Homo sapiens
agaggcttgaaggccagcagc

SEQ ID NO: 4434634 - DNA, 16 bp, Homo sapiens
agaggctttggcccaa

SEQ ID NO: 4434635 - DNA, 17 bp, Homo sapiens
agagggaaaacagaaaa

SEQ ID NO: 4434636 - DNA, 22 bp, Homo sapiens
agagggaagccagtcagggccc

SEQ ID NO: 4434637 - DNA, 13 bp, Homo sapiens
agagggagagaga

SEQ ID NO: 4434638 - DNA, 23 bp, Homo sapiens
agagggagtttaatacaggaaat

SEQ ID NO: 4434639 - DNA, 15 bp, Homo sapiens
agagggatttccctg

SEQ ID NO: 4434640 - DNA, 16 bp, Homo sapiens
agagggatttccctgc

SEQ ID NO: 4434641 - DNA, 19 bp, Homo sapiens
agagggatttccctgcaga

SEQ ID NO: 4434642 - DNA, 22 bp, Homo sapiens
agagggatttccctgcagacct

SEQ ID NO: 4434643 - DNA, 14 bp, Homo sapiens
agagggcccagccc

SEQ ID NO: 4434644 - DNA, 16 bp, Homo sapiens
agagggcccaggtccc

SEQ ID NO: 4434645 - DNA, 13 bp, Homo sapiens
agagggccctggt

SEQ ID NO: 4434646 - DNA, 18 bp, Homo sapiens
agagggccctggtgtttc

SEQ ID NO: 4434647 - DNA, 23 bp, Homo sapiens
agagggccctggtgtttctagca

SEQ ID NO: 4434648 - DNA, 14 bp, Homo sapiens
agagggctagggag

SEQ ID NO: 4434649 - DNA, 18 bp, Homo sapiens
agagggctggaggcccag

SEQ ID NO: 4434650 - DNA, 19 bp, Homo sapiens
agagggctggaggcccagg

SEQ ID NO: 4434651 - DNA, 17 bp, Homo sapiens
agaggggcgggctcaga

SEQ ID NO: 4434652 - DNA, 19 bp, Homo sapiens
agaggggcgggctcagagc

SEQ ID NO: 4434653 - DNA, 19 bp, Homo sapiens
agagggggtggaggggtgt

SEQ ID NO: 4434654 - DNA, 15 bp, Homo sapiens
agaggggtattcttc

SEQ ID NO: 4434655 - DNA, 15 bp, Homo sapiens
agagggtagggcaca

SEQ ID NO: 4434656 - DNA, 14 bp, Homo sapiens
agaggtaaagggtg

SEQ ID NO: 4434657 - DNA, 19 bp, Homo sapiens
agaggtctcatctcccagg

SEQ ID NO: 4434658 - DNA, 12 bp, Homo sapiens
agaggtctgagc

SEQ ID NO: 4434659 - DNA, 16 bp, Homo sapiens
agaggtgaagccagct

SEQ ID NO: 4434660 - DNA, 19 bp, Homo sapiens
agaggtggaggttgcagtg

SEQ ID NO: 4434661 - DNA, 17 bp, Homo sapiens
agaggtggatcctgtag

SEQ ID NO: 4434662 - DNA, 14 bp, Homo sapiens
agaggtgggagggc

SEQ ID NO: 4434663 - DNA, 20 bp, Homo sapiens
agaggttgggcttccatgcc

SEQ ID NO: 4434664 - DNA, 21 bp, Homo sapiens
agaggttgtagtgagccaaga

SEQ ID NO: 4434665 - DNA, 19 bp, Homo sapiens
agagtaacgagaagtgctt

SEQ ID NO: 4434666 - DNA, 17 bp, Homo sapiens
agagtacgtgaaatgct

SEQ ID NO: 4434667 - DNA, 12 bp, Homo sapiens
agagtactttgg

SEQ ID NO: 4434668 - DNA, 13 bp, Homo sapiens
agagtagccgaga

SEQ ID NO: 4434669 - DNA, 19 bp, Homo sapiens
agagtagccgagagcctgc

SEQ ID NO: 4434670 - DNA, 22 bp, Homo sapiens
agagtagccgagagcctgctcc

SEQ ID NO: 4434671 - DNA, 23 bp, Homo sapiens
agagtagccgagagcctgctccc

SEQ ID NO: 4434672 - DNA, 14 bp, Homo sapiens
agagtagttatata

SEQ ID NO: 4434673 - DNA, 20 bp, Homo sapiens
agagtatgtggcaaaacata

SEQ ID NO: 4434674 - DNA, 13 bp, Homo sapiens
agagtcaaagctg

SEQ ID NO: 4434675 - DNA, 12 bp, Homo sapiens
agagtcaggagt

SEQ ID NO: 4434676 - DNA, 19 bp, Homo sapiens
agagtccagtgctctgcct

SEQ ID NO: 4434677 - DNA, 17 bp, Homo sapiens
agagtctccaagagaac

SEQ ID NO: 4434678 - DNA, 18 bp, Homo sapiens
agagtctggtgaagctca

SEQ ID NO: 4434679 - DNA, 14 bp, Homo sapiens
agagtgacagtcat

SEQ ID NO: 4434680 - DNA, 23 bp, Homo sapiens
agagtgacagtcataaatactgt

SEQ ID NO: 4434681 - DNA, 16 bp, Homo sapiens
agagtgactctccagg

SEQ ID NO: 4434682 - DNA, 15 bp, Homo sapiens
agagtgcactactgt

SEQ ID NO: 4434683 - DNA, 13 bp, Homo sapiens
agagtgcactgct

SEQ ID NO: 4434684 - DNA, 17 bp, Homo sapiens
agagtgccagtcagcag

SEQ ID NO: 4434685 - DNA, 20 bp, Homo sapiens
agagtggcctccctgctgtg

SEQ ID NO: 4434686 - DNA, 22 bp, Homo sapiens
agagtggcctccctgctgtgcc

SEQ ID NO: 4434687 - DNA, 13 bp, Homo sapiens
agagtggcctggc

SEQ ID NO: 4434688 - DNA, 15 bp, Homo sapiens
agagtggcctggcca

SEQ ID NO: 4434689 - DNA, 19 bp, Homo sapiens
agagtggggtaggttggga

SEQ ID NO: 4434690 - DNA, 15 bp, Homo sapiens
agagtgtctttccac

SEQ ID NO: 4434691 - DNA, 18 bp, Homo sapiens
agagtgttggtgttggct

SEQ ID NO: 4434692 - DNA, 14 bp, Homo sapiens
agagttaaatggtc

SEQ ID NO: 4434693 - DNA, 23 bp, Homo sapiens
agagttaataggagtatttttgg

SEQ ID NO: 4434694 - DNA, 17 bp, Homo sapiens
agagttacagttctgtg

SEQ ID NO: 4434695 - DNA, 23 bp, Homo sapiens
agagttatcttctttattattcc

SEQ ID NO: 4434696 - DNA, 12 bp, Homo sapiens
agagttattcaa

SEQ ID NO: 4434697 - DNA, 15 bp, Homo sapiens
agagttattcaaatg

SEQ ID NO: 4434698 - DNA, 18 bp, Homo sapiens
agagttattcaaatgaag

SEQ ID NO: 4434699 - DNA, 15 bp, Homo sapiens
agagttcaagaaata

SEQ ID NO: 4434700 - DNA, 21 bp, Homo sapiens
agagttcaagaaataagtttt

SEQ ID NO: 4434701 - DNA, 16 bp, Homo sapiens
agagttcaagcctgtg

SEQ ID NO: 4434702 - DNA, 17 bp, Homo sapiens
agagttcagacttcgct

SEQ ID NO: 4434703 - DNA, 16 bp, Homo sapiens
agagttgtgcacgcag

SEQ ID NO: 4434704 - DNA, 18 bp, Homo sapiens
agagtttctgtttgattc

SEQ ID NO: 4434705 - DNA, 19 bp, Homo sapiens
agagtttggaattattgta

SEQ ID NO: 4434706 - DNA, 16 bp, Homo sapiens
agagttttatcaactt

SEQ ID NO: 4434707 - DNA, 13 bp, Homo sapiens
agataaaagcaat

SEQ ID NO: 4434708 - DNA, 15 bp, Homo sapiens
agataaaaggtggag

SEQ ID NO: 4434709 - DNA, 22 bp, Homo sapiens
agataaaaggtggagtttctct

SEQ ID NO: 4434710 - DNA, 18 bp, Homo sapiens
agataaagaccagaaatt

SEQ ID NO: 4434711 - DNA, 19 bp, Homo sapiens
agataaagcttaggtcaaa

SEQ ID NO: 4434712 - DNA, 22 bp, Homo sapiens
agataactgaaaattatttaaa

SEQ ID NO: 4434713 - DNA, 16 bp, Homo sapiens
agataacttcttgaaa

SEQ ID NO: 4434714 - DNA, 19 bp, Homo sapiens
agataacttttttgagtca

SEQ ID NO: 4434715 - DNA, 21 bp, Homo sapiens
agataagtctacattaaacaa

SEQ ID NO: 4434716 - DNA, 14 bp, Homo sapiens
agataatatttctg

SEQ ID NO: 4434717 - DNA, 19 bp, Homo sapiens
agataatcgaagcaaaagt

SEQ ID NO: 4434718 - DNA, 20 bp, Homo sapiens
agataatcgaagcaaaagta

SEQ ID NO: 4434719 - DNA, 13 bp, Homo sapiens
agataatgtgaaa

SEQ ID NO: 4434720 - DNA, 18 bp, Homo sapiens
agataatttacaagatat

SEQ ID NO: 4434721 - DNA, 15 bp, Homo sapiens
agatacactgcactt

SEQ ID NO: 4434722 - DNA, 21 bp, Homo sapiens
agatacactgcactttgttta

SEQ ID NO: 4434723 - DNA, 23 bp, Homo sapiens
agatacactgcactttgtttaga

SEQ ID NO: 4434724 - DNA, 20 bp, Homo sapiens
agatacagaactctttcaaa

SEQ ID NO: 4434725 - DNA, 18 bp, Homo sapiens
agatacagtggagacatc

SEQ ID NO: 4434726 - DNA, 13 bp, Homo sapiens
agatacctcaccc

SEQ ID NO: 4434727 - DNA, 14 bp, Homo sapiens
agatacctcaccct

SEQ ID NO: 4434728 - DNA, 17 bp, Homo sapiens
agatacctcaccctgct

SEQ ID NO: 4434729 - DNA, 15 bp, Homo sapiens
agatactctcttctt

SEQ ID NO: 4434730 - DNA, 18 bp, Homo sapiens
agatacttatttttctga

SEQ ID NO: 4434731 - DNA, 12 bp, Homo sapiens
agatacttcagc

SEQ ID NO: 4434732 - DNA, 20 bp, Homo sapiens
agatacttcagctttgtgta

SEQ ID NO: 4434733 - DNA, 14 bp, Homo sapiens
agatactttgcatt

SEQ ID NO: 4434734 - DNA, 16 bp, Homo sapiens
agatagctgtgacttc

SEQ ID NO: 4434735 - DNA, 16 bp, Homo sapiens
agataggaaactgaag

SEQ ID NO: 4434736 - DNA, 15 bp, Homo sapiens
agatagggctgggca

SEQ ID NO: 4434737 - DNA, 23 bp, Homo sapiens
agatagggctgggcaaggaaaaa

SEQ ID NO: 4434738 - DNA, 13 bp, Homo sapiens
agatagtgccagg

SEQ ID NO: 4434739 - DNA, 15 bp, Homo sapiens
agatataactgtctt

SEQ ID NO: 4434740 - DNA, 20 bp, Homo sapiens
agatataaggggaaagataa

SEQ ID NO: 4434741 - DNA, 19 bp, Homo sapiens
agatataatgaacaaaatt

SEQ ID NO: 4434742 - DNA, 21 bp, Homo sapiens
agatataatgaacaaaattat

SEQ ID NO: 4434743 - DNA, 15 bp, Homo sapiens
agatatactttgtgg

SEQ ID NO: 4434744 - DNA, 17 bp, Homo sapiens
agatatactttgtggac

SEQ ID NO: 4434745 - DNA, 14 bp, Homo sapiens
agatatatgtgtat

SEQ ID NO: 4434746 - DNA, 17 bp, Homo sapiens
agatatatgtgtataca

SEQ ID NO: 4434747 - DNA, 18 bp, Homo sapiens
agatatatgtgtatacat

SEQ ID NO: 4434748 - DNA, 12 bp, Homo sapiens
agatatcctctc

SEQ ID NO: 4434749 - DNA, 13 bp, Homo sapiens
agatatcctctcc

SEQ ID NO: 4434750 - DNA, 22 bp, Homo sapiens
agatatcttggacaaatcacat

SEQ ID NO: 4434751 - DNA, 15 bp, Homo sapiens
agatatgaaagctga

SEQ ID NO: 4434752 - DNA, 14 bp, Homo sapiens
agatatgaatatat

SEQ ID NO: 4434753 - DNA, 20 bp, Homo sapiens
agatatggagaattgctgaa

SEQ ID NO: 4434754 - DNA, 14 bp, Homo sapiens
agatattattttaa

SEQ ID NO: 4434755 - DNA, 21 bp, Homo sapiens
agatattgaaggagaaaatag

SEQ ID NO: 4434756 - DNA, 14 bp, Homo sapiens
agatattgctacta

SEQ ID NO: 4434757 - DNA, 24 bp, Homo sapiens
agacggatgcccattcctgcctgg

SEQ ID NO: 4434758 - DNA, 17 bp, Homo sapiens
agacgtcaggccctgac

SEQ ID NO: 4434759 - DNA, 19 bp, Homo sapiens
agacgtgaatgtctcagcg

SEQ ID NO: 4434760 - DNA, 15 bp, Homo sapiens
agacgttgcctgaga

SEQ ID NO: 4434761 - DNA, 19 bp, Homo sapiens
agactaaaggatccagaga

SEQ ID NO: 4434762 - DNA, 13 bp, Homo sapiens
agactaaattcaa

SEQ ID NO: 4434763 - DNA, 14 bp, Homo sapiens
agactactaagagg

SEQ ID NO: 4434764 - DNA, 16 bp, Homo sapiens
agactactaaggcctt

SEQ ID NO: 4434765 - DNA, 18 bp, Homo sapiens
agactactggcctctgtg

SEQ ID NO: 4434766 - DNA, 12 bp, Homo sapiens
agactagagaaa

SEQ ID NO: 4434767 - DNA, 12 bp, Homo sapiens
agactagagcaa

SEQ ID NO: 4434768 - DNA, 12 bp, Homo sapiens
agactagatgta

SEQ ID NO: 4434769 - DNA, 16 bp, Homo sapiens
agactagattgccttt

SEQ ID NO: 4434770 - DNA, 19 bp, Homo sapiens
agactagattgcctttgtt

SEQ ID NO: 4434771 - DNA, 13 bp, Homo sapiens
agactatggcctc

SEQ ID NO: 4434772 - DNA, 15 bp, Homo sapiens
agactattcaaacag

SEQ ID NO: 4434773 - DNA, 13 bp, Homo sapiens
agactatttcttt

SEQ ID NO: 4434774 - DNA, 16 bp, Homo sapiens
agactatttcttttta

SEQ ID NO: 4434775 - DNA, 18 bp, Homo sapiens
agactatttgctaatgta

SEQ ID NO: 4434776 - DNA, 20 bp, Homo sapiens
agactattttctattttccc

SEQ ID NO: 4434777 - DNA, 18 bp, Homo sapiens
agactcaaaacctggaga

SEQ ID NO: 4434778 - DNA, 22 bp, Homo sapiens
agactcaaaacctggagatgca

SEQ ID NO: 4434779 - DNA, 16 bp, Homo sapiens
agactcaaaccacatg

SEQ ID NO: 4434780 - DNA, 14 bp, Homo sapiens
agactcaaattttg

SEQ ID NO: 4434781 - DNA, 17 bp, Homo sapiens
agactcaagcctcccca

SEQ ID NO: 4434782 - DNA, 14 bp, Homo sapiens
agactcacctctgc

SEQ ID NO: 4434783 - DNA, 15 bp, Homo sapiens
agactcagactccat

SEQ ID NO: 4434784 - DNA, 18 bp, Homo sapiens
agactcagcctctgctgg

SEQ ID NO: 4434785 - DNA, 18 bp, Homo sapiens
agactcaggagtctgcca

SEQ ID NO: 4434786 - DNA, 20 bp, Homo sapiens
agactcaggttccagaacag

SEQ ID NO: 4434787 - DNA, 16 bp, Homo sapiens
agactccaaagaaatg

SEQ ID NO: 4434788 - DNA, 15 bp, Homo sapiens
agactcccatgaagc

SEQ ID NO: 4434789 - DNA, 21 bp, Homo sapiens
agactcccatgaagccttttg

SEQ ID NO: 4434790 - DNA, 16 bp, Homo sapiens
agactcccatgaggga

SEQ ID NO: 4434791 - DNA, 11 bp, Homo sapiens
agactcctgct

SEQ ID NO: 4434792 - DNA, 22 bp, Homo sapiens
agactcctgctctctatccaaa

SEQ ID NO: 4434793 - DNA, 17 bp, Homo sapiens
agactcctggtctgtga

SEQ ID NO: 4434794 - DNA, 14 bp, Homo sapiens
agactcgagaactt

SEQ ID NO: 4434795 - DNA, 15 bp, Homo sapiens
agactcgagaacttt

SEQ ID NO: 4434796 - DNA, 18 bp, Homo sapiens
agactcgagaactttcat

SEQ ID NO: 4434797 - DNA, 23 bp, Homo sapiens
agactcgagaggtgggaggaact

SEQ ID NO: 4434798 - DNA, 17 bp, Homo sapiens
agactctagtatttatg

SEQ ID NO: 4434799 - DNA, 11 bp, Homo sapiens
agactctcagc

SEQ ID NO: 4434800 - DNA, 18 bp, Homo sapiens
agactctcagcccagaag

SEQ ID NO: 4434801 - DNA, 20 bp, Homo sapiens
agactctcagcccagaagaa

SEQ ID NO: 4434802 - DNA, 13 bp, Homo sapiens
agactctccctgt

SEQ ID NO: 4434803 - DNA, 14 bp, Homo sapiens
agactctccctgta

SEQ ID NO: 4434804 - DNA, 14 bp, Homo sapiens
agactctcttagga

SEQ ID NO: 4434805 - DNA, 21 bp, Homo sapiens
agactctgtgtggctgtgcaa

SEQ ID NO: 4434806 - DNA, 17 bp, Homo sapiens
agactgagcagccgcca

SEQ ID NO: 4434807 - DNA, 20 bp, Homo sapiens
agactgattggaattctttc

SEQ ID NO: 4434808 - DNA, 12 bp, Homo sapiens
agactgcaatat

SEQ ID NO: 4434809 - DNA, 21 bp, Homo sapiens
agactgccccacggagacaga

SEQ ID NO: 4434810 - DNA, 22 bp, Homo sapiens
agactgccccacggagacagag

SEQ ID NO: 4434811 - DNA, 18 bp, Homo sapiens
agactgcctgtctgcttg

SEQ ID NO: 4434812 - DNA, 12 bp, Homo sapiens
agactgctagct

SEQ ID NO: 4434813 - DNA, 23 bp, Homo sapiens
agactggaaaagtgatgtatttt

SEQ ID NO: 4434814 - DNA, 21 bp, Homo sapiens
agactggaagctaatttgcat

SEQ ID NO: 4434815 - DNA, 18 bp, Homo sapiens
agactggcacagttttct

SEQ ID NO: 4434816 - DNA, 20 bp, Homo sapiens
agactggcacagttttctga

SEQ ID NO: 4434817 - DNA, 15 bp, Homo sapiens
agactggcggagaag

SEQ ID NO: 4434818 - DNA, 21 bp, Homo sapiens
agactgggaaggcttgggatt

SEQ ID NO: 4434819 - DNA, 18 bp, Homo sapiens
agactgggcactggggcc

SEQ ID NO: 4434820 - DNA, 13 bp, Homo sapiens
agactgggcccca

SEQ ID NO: 4434821 - DNA, 15 bp, Homo sapiens
agactgggctgaggg

SEQ ID NO: 4434822 - DNA, 20 bp, Homo sapiens
agactgggctgagggagcct

SEQ ID NO: 4434823 - DNA, 14 bp, Homo sapiens
agactggttttctg

SEQ ID NO: 4434824 - DNA, 15 bp, Homo sapiens
agactggttttctgc

SEQ ID NO: 4434825 - DNA, 16 bp, Homo sapiens
agactggttttctgcc

SEQ ID NO: 4434826 - DNA, 13 bp, Homo sapiens
agactgtacataa

SEQ ID NO: 4434827 - DNA, 14 bp, Homo sapiens
agactgtccaggga

SEQ ID NO: 4434828 - DNA, 15 bp, Homo sapiens
agactgtgaacttga

SEQ ID NO: 4434829 - DNA, 18 bp, Homo sapiens
agactgtgaacttgactg

SEQ ID NO: 4434830 - DNA, 21 bp, Homo sapiens
agactgtgaacttgactgggt

SEQ ID NO: 4434831 - DNA, 22 bp, Homo sapiens
agactgtgaacttgactgggtg

SEQ ID NO: 4434832 - DNA, 17 bp, Homo sapiens
agactgtgattcagaaa

SEQ ID NO: 4434833 - DNA, 16 bp, Homo sapiens
agactgtgccagaggc

SEQ ID NO: 4434834 - DNA, 15 bp, Homo sapiens
agactgtgcttggga

SEQ ID NO: 4434835 - DNA, 23 bp, Homo sapiens
agactgtggccatatatgctgta

SEQ ID NO: 4434836 - DNA, 15 bp, Homo sapiens
agactgttactttgg

SEQ ID NO: 4434837 - DNA, 20 bp, Homo sapiens
agacttaatttcaaatctgt

SEQ ID NO: 4434838 - DNA, 18 bp, Homo sapiens
agacttcaaaaataaaaa

SEQ ID NO: 4434839 - DNA, 18 bp, Homo sapiens
agacttcaaaatattgag

SEQ ID NO: 4434840 - DNA, 20 bp, Homo sapiens
agacttcaaaatattgagca

SEQ ID NO: 4434841 - DNA, 12 bp, Homo sapiens
agacttccccat

SEQ ID NO: 4434842 - DNA, 15 bp, Homo sapiens
agacttccccatccc

SEQ ID NO: 4434843 - DNA, 17 bp, Homo sapiens
agacttccccatcccga

SEQ ID NO: 4434844 - DNA, 12 bp, Homo sapiens
agacttgctccc

SEQ ID NO: 4434845 - DNA, 13 bp, Homo sapiens
agacttgctccct

SEQ ID NO: 4434846 - DNA, 17 bp, Homo sapiens
agacttgctccctctcc

SEQ ID NO: 4434847 - DNA, 14 bp, Homo sapiens
agacttgtgtgcat

SEQ ID NO: 4434848 - DNA, 17 bp, Homo sapiens
agacttgtgtgcatgga

SEQ ID NO: 4434849 - DNA, 16 bp, Homo sapiens
agactttatgtagttt

SEQ ID NO: 4434850 - DNA, 16 bp, Homo sapiens
agactttctttttcta

SEQ ID NO: 4434851 - DNA, 17 bp, Homo sapiens
agactttctttttctac

SEQ ID NO: 4434852 - DNA, 13 bp, Homo sapiens
agagcatctgccc

SEQ ID NO: 4434853 - DNA, 15 bp, Homo sapiens
agagcatctgcccca

SEQ ID NO: 4434854 - DNA, 18 bp, Homo sapiens
agagcatctgccccaggt

SEQ ID NO: 4434855 - DNA, 19 bp, Homo sapiens
agagcatctgccccaggta

SEQ ID NO: 4434856 - DNA, 19 bp, Homo sapiens
agagcatggatgcatttca

SEQ ID NO: 4434857 - DNA, 23 bp, Homo sapiens
agagcatggatgcatttcaaatg

SEQ ID NO: 4434858 - DNA, 16 bp, Homo sapiens
agagcatggttccagt

SEQ ID NO: 4434859 - DNA, 19 bp, Homo sapiens
agagcatttggcagagtct

SEQ ID NO: 4434860 - DNA, 19 bp, Homo sapiens
agagccaccaagagggacg

SEQ ID NO: 4434861 - DNA, 15 bp, Homo sapiens
agagccacctgcaag

SEQ ID NO: 4434862 - DNA, 17 bp, Homo sapiens
agagccacctgcaagat

SEQ ID NO: 4434863 - DNA, 13 bp, Homo sapiens
agagccacctgga

SEQ ID NO: 4434864 - DNA, 16 bp, Homo sapiens
agagccactctatgag

SEQ ID NO: 4434865 - DNA, 13 bp, Homo sapiens
agagccagcctgg

SEQ ID NO: 4434866 - DNA, 22 bp, Homo sapiens
agagccagcctggctctgcccc

SEQ ID NO: 4434867 - DNA, 23 bp, Homo sapiens
agagccagcctggctctgccccc

SEQ ID NO: 4434868 - DNA, 18 bp, Homo sapiens
agagccagcggctccaac

SEQ ID NO: 4434869 - DNA, 21 bp, Homo sapiens
agagccagcggctccaactcc

SEQ ID NO: 4434870 - DNA, 13 bp, Homo sapiens
agagccaggcaca

SEQ ID NO: 4434871 - DNA, 19 bp, Homo sapiens
agagccaggcacacactgt

SEQ ID NO: 4434872 - DNA, 12 bp, Homo sapiens
agagccagggca

SEQ ID NO: 4434873 - DNA, 23 bp, Homo sapiens
agagccagtggcgggtgatggcc

SEQ ID NO: 4434874 - DNA, 22 bp, Homo sapiens
agagccatactgcgtccaccct

SEQ ID NO: 4434875 - DNA, 13 bp, Homo sapiens
agagcccagccca

SEQ ID NO: 4434876 - DNA, 14 bp, Homo sapiens
agagcccagcccag

SEQ ID NO: 4434877 - DNA, 16 bp, Homo sapiens
agagcccagcccagga

SEQ ID NO: 4434878 - DNA, 14 bp, Homo sapiens
agagccctgaggcc

SEQ ID NO: 4434879 - DNA, 18 bp, Homo sapiens
agagccctgaggcctaga

SEQ ID NO: 4434880 - DNA, 22 bp, Homo sapiens
agagccctgaggcctagactct

SEQ ID NO: 4434881 - DNA, 13 bp, Homo sapiens
agagccctgctgt

SEQ ID NO: 4434882 - DNA, 17 bp, Homo sapiens
actggtgtgacctgagg

SEQ ID NO: 4434883 - DNA, 21 bp, Homo sapiens
actggtgttatcaccgtgggc

SEQ ID NO: 4434884 - DNA, 22 bp, Homo sapiens
actggttaaaaaacaaatgttc

SEQ ID NO: 4434885 - DNA, 17 bp, Homo sapiens
actggttactttcaaaa

SEQ ID NO: 4434886 - DNA, 16 bp, Homo sapiens
actggttcaggctcaa

SEQ ID NO: 4434887 - DNA, 13 bp, Homo sapiens
actggttcctaca

SEQ ID NO: 4434888 - DNA, 13 bp, Homo sapiens
actggtttcaaga

SEQ ID NO: 4434889 - DNA, 17 bp, Homo sapiens
actggtttctcctggta

SEQ ID NO: 4434890 - DNA, 15 bp, Homo sapiens
actggttttacacag

SEQ ID NO: 4434891 - DNA, 20 bp, Homo sapiens
actggttttacacagagaaa

SEQ ID NO: 4434892 - DNA, 19 bp, Homo sapiens
actggttttctgccaatga

SEQ ID NO: 4434893 - DNA, 18 bp, Homo sapiens
actgtaaataaaaagaaa

SEQ ID NO: 4434894 - DNA, 19 bp, Homo sapiens
agacacagtattgacttct

SEQ ID NO: 4434895 - DNA, 15 bp, Homo sapiens
agacacattgccttc

SEQ ID NO: 4434896 - DNA, 13 bp, Homo sapiens
agacacatttaag

SEQ ID NO: 4434897 - DNA, 15 bp, Homo sapiens
agacaccatgtgcaa

SEQ ID NO: 4434898 - DNA, 16 bp, Homo sapiens
agacaccattcattcc

SEQ ID NO: 4434899 - DNA, 16 bp, Homo sapiens
agacacctaaccccag

SEQ ID NO: 4434900 - DNA, 23 bp, Homo sapiens
agacacctaaccccagggcactg

SEQ ID NO: 4434901 - DNA, 14 bp, Homo sapiens
agacacctgcacct

SEQ ID NO: 4434902 - DNA, 13 bp, Homo sapiens
agacacctggact

SEQ ID NO: 4434903 - DNA, 14 bp, Homo sapiens
agacacctggactg

SEQ ID NO: 4434904 - DNA, 15 bp, Homo sapiens
agacacgttctgatt

SEQ ID NO: 4434905 - DNA, 21 bp, Homo sapiens
agacactccagtttgcccacc

SEQ ID NO: 4434906 - DNA, 23 bp, Homo sapiens
agacactccccgaagtcttttgt

SEQ ID NO: 4434907 - DNA, 20 bp, Homo sapiens
agacactcctataaggagag

SEQ ID NO: 4434908 - DNA, 13 bp, Homo sapiens
agacactgagcca

SEQ ID NO: 4434909 - DNA, 16 bp, Homo sapiens
agacactgagccagtc

SEQ ID NO: 4434910 - DNA, 17 bp, Homo sapiens
agacactgagccagtct

SEQ ID NO: 4434911 - DNA, 16 bp, Homo sapiens
agacagaagaaacaag

SEQ ID NO: 4434912 - DNA, 16 bp, Homo sapiens
agacagaccacttgcc

SEQ ID NO: 4434913 - DNA, 15 bp, Homo sapiens
actgcatgggaaata

SEQ ID NO: 4434914 - DNA, 16 bp, Homo sapiens
actgcatggtaattta

SEQ ID NO: 4434915 - DNA, 16 bp, Homo sapiens
actgcattcctgtgcc

SEQ ID NO: 4434916 - DNA, 20 bp, Homo sapiens
actgcattggttttccatga

SEQ ID NO: 4434917 - DNA, 12 bp, Homo sapiens
actgcatttgtg

SEQ ID NO: 4434918 - DNA, 15 bp, Homo sapiens
actgccaaacctcct

SEQ ID NO: 4434919 - DNA, 19 bp, Homo sapiens
actgccaaacctcctgtca

SEQ ID NO: 4434920 - DNA, 16 bp, Homo sapiens
actgccaccttgtggc

SEQ ID NO: 4434921 - DNA, 23 bp, Homo sapiens
actgccaccttgtggccgcctga

SEQ ID NO: 4434922 - DNA, 12 bp, Homo sapiens
actgccagcatt

SEQ ID NO: 4434923 - DNA, 18 bp, Homo sapiens
actgccaggccagcctcc

SEQ ID NO: 4434924 - DNA, 16 bp, Homo sapiens
actgccaggctgcctc

SEQ ID NO: 4434925 - DNA, 13 bp, Homo sapiens
actgccaggctgt

SEQ ID NO: 4434926 - DNA, 16 bp, Homo sapiens
actgccagtctcactg

SEQ ID NO: 4434927 - DNA, 23 bp, Homo sapiens
actgccattacccagtgccgagg

SEQ ID NO: 4434928 - DNA, 18 bp, Homo sapiens
actgccccaactcctgga

SEQ ID NO: 4434929 - DNA, 21 bp, Homo sapiens
actgccccaactcctggaagc

SEQ ID NO: 4434930 - DNA, 14 bp, Homo sapiens
actatatagaattt

SEQ ID NO: 4434931 - DNA, 20 bp, Homo sapiens
actatatagaatttcctgta

SEQ ID NO: 4434932 - DNA, 23 bp, Homo sapiens
actatatagaatttcctgtaata

SEQ ID NO: 4434933 - DNA, 21 bp, Homo sapiens
actatatcttcccatttaaca

SEQ ID NO: 4434934 - DNA, 12 bp, Homo sapiens
actatatgtgaa

SEQ ID NO: 4434935 - DNA, 14 bp, Homo sapiens
actatcaattttaa

SEQ ID NO: 4434936 - DNA, 18 bp, Homo sapiens
actatcatagttaacata

SEQ ID NO: 4434937 - DNA, 13 bp, Homo sapiens
actatctacaaaa

SEQ ID NO: 4434938 - DNA, 19 bp, Homo sapiens
actatctccgttccatctg

SEQ ID NO: 4434939 - DNA, 20 bp, Homo sapiens
actatctctactgaatgtca

SEQ ID NO: 4434940 - DNA, 20 bp, Homo sapiens
actatcttactatttcacaa

SEQ ID NO: 4434941 - DNA, 21 bp, Homo sapiens
actatgaaaagctagaattga

SEQ ID NO: 4434942 - DNA, 17 bp, Homo sapiens
actatgatcagaagaac

SEQ ID NO: 4434943 - DNA, 22 bp, Homo sapiens
actatgatcagaagaacatgat

SEQ ID NO: 4434944 - DNA, 17 bp, Homo sapiens
actatggaatagattat

SEQ ID NO: 4434945 - DNA, 18 bp, Homo sapiens
actatggccagtctgccc

SEQ ID NO: 4434946 - DNA, 18 bp, Homo sapiens
actatggtatgctggcca

SEQ ID NO: 4434947 - DNA, 19 bp, Homo sapiens
actatggtatgctggccag

SEQ ID NO: 4434948 - DNA, 20 bp, Homo sapiens
actatggtatgctggccagc

SEQ ID NO: 4434949 - DNA, 20 bp, Homo sapiens
actatgtaataatgtacaga

SEQ ID NO: 4434950 - DNA, 19 bp, Homo sapiens
actatgtctgaacatagaa

SEQ ID NO: 4434951 - DNA, 15 bp, Homo sapiens
actattaagatatct

SEQ ID NO: 4434952 - DNA, 15 bp, Homo sapiens
actattacttgaact

SEQ ID NO: 4434953 - DNA, 13 bp, Homo sapiens
actattcaaacag

SEQ ID NO: 4434954 - DNA, 14 bp, Homo sapiens
actattcatggcta

SEQ ID NO: 4434955 - DNA, 16 bp, Homo sapiens
actattcgaatgaaaa

SEQ ID NO: 4434956 - DNA, 17 bp, Homo sapiens
actattctgtatctttc

SEQ ID NO: 4434957 - DNA, 13 bp, Homo sapiens
actattcttaata

SEQ ID NO: 4434958 - DNA, 13 bp, Homo sapiens
actattggcccta

SEQ ID NO: 4434959 - DNA, 23 bp, Homo sapiens
actccggaggactgagcccccac

SEQ ID NO: 4434960 - DNA, 19 bp, Homo sapiens
actccggccctccagagcc

SEQ ID NO: 4434961 - DNA, 23 bp, Homo sapiens
actccgtccatccgactgcccct

SEQ ID NO: 4434962 - DNA, 14 bp, Homo sapiens
actcctagaagaac

SEQ ID NO: 4434963 - DNA, 13 bp, Homo sapiens
actcctatttcaa

SEQ ID NO: 4434964 - DNA, 14 bp, Homo sapiens
actcctatttttgt

SEQ ID NO: 4434965 - DNA, 20 bp, Homo sapiens
actcctatttttgtaaactg

SEQ ID NO: 4434966 - DNA, 21 bp, Homo sapiens
actcctcctccaaaggccccc

SEQ ID NO: 4434967 - DNA, 22 bp, Homo sapiens
actcctctcccacagagtgctg

SEQ ID NO: 4434968 - DNA, 18 bp, Homo sapiens
actcctgagacccctggc

SEQ ID NO: 4434969 - DNA, 15 bp, Homo sapiens
actcctgccaggcac

SEQ ID NO: 4434970 - DNA, 15 bp, Homo sapiens
actcctgccaggccg

SEQ ID NO: 4434971 - DNA, 12 bp, Homo sapiens
actcctggaaat

SEQ ID NO: 4434972 - DNA, 18 bp, Homo sapiens
actcctgggctcaagcaa

SEQ ID NO: 4434973 - DNA, 14 bp, Homo sapiens
actcctgtcaccta

SEQ ID NO: 4434974 - DNA, 13 bp, Homo sapiens
actcctgtccctt

SEQ ID NO: 4434975 - DNA, 18 bp, Homo sapiens
actcctgtcccttttccc

SEQ ID NO: 4434976 - DNA, 19 bp, Homo sapiens
actcctgtcccttttccct

SEQ ID NO: 4434977 - DNA, 16 bp, Homo sapiens
actcctgtgctctgga

SEQ ID NO: 4434978 - DNA, 20 bp, Homo sapiens
actcctgtgctctggaggct

SEQ ID NO: 4434979 - DNA, 20 bp, Homo sapiens
actccttcaacaattctaaa

SEQ ID NO: 4434980 - DNA, 22 bp, Homo sapiens
actccttcaacaattctaaaat

SEQ ID NO: 4434981 - DNA, 15 bp, Homo sapiens
actccttccatctct

SEQ ID NO: 4434982 - DNA, 23 bp, Homo sapiens
actccttccttcaggactctgcg

SEQ ID NO: 4434983 - DNA, 14 bp, Homo sapiens
actcctttatctgt

SEQ ID NO: 4434984 - DNA, 15 bp, Homo sapiens
actcctttatctgta

SEQ ID NO: 4434985 - DNA, 13 bp, Homo sapiens
actcctttccaat

SEQ ID NO: 4434986 - DNA, 19 bp, Homo sapiens
actcgacaaaggccacagg

SEQ ID NO: 4434987 - DNA, 17 bp, Homo sapiens
actcgagaactttcatt

SEQ ID NO: 4434988 - DNA, 22 bp, Homo sapiens
actcggcctcccaaagtgctgg

SEQ ID NO: 4434989 - DNA, 14 bp, Homo sapiens
actcgggggctggt

SEQ ID NO: 4434990 - DNA, 15 bp, Homo sapiens
actcggggtccctgg

SEQ ID NO: 4434991 - DNA, 14 bp, Homo sapiens
actcgttttttaca

SEQ ID NO: 4434992 - DNA, 15 bp, Homo sapiens
actctaaaattataa

SEQ ID NO: 4434993 - DNA, 17 bp, Homo sapiens
actctaacactcgactc

SEQ ID NO: 4434994 - DNA, 18 bp, Homo sapiens
actctaactgtatatttg

SEQ ID NO: 4434995 - DNA, 21 bp, Homo sapiens
actctaactgtatatttgtat

SEQ ID NO: 4434996 - DNA, 13 bp, Homo sapiens
actctaatatgat

SEQ ID NO: 4434997 - DNA, 21 bp, Homo sapiens
actctaatatgattatacaaa

SEQ ID NO: 4434998 - DNA, 14 bp, Homo sapiens
actctaatattgct

SEQ ID NO: 4434999 - DNA, 17 bp, Homo sapiens
actctaatattgcttct

SEQ ID NO: 4435000 - DNA, 22 bp, Homo sapiens
actctaccatggttctgcctcc

SEQ ID NO: 4435001 - DNA, 23 bp, Homo sapiens
actctaccatggttctgcctcct

SEQ ID NO: 4435002 - DNA, 16 bp, Homo sapiens
actctacccctgctcc

SEQ ID NO: 4435003 - DNA, 23 bp, Homo sapiens
actctacccctgctcccattcct

SEQ ID NO: 4435004 - DNA, 16 bp, Homo sapiens
actctaccctcccacc

SEQ ID NO: 4435005 - DNA, 21 bp, Homo sapiens
actctagatggcaacattgga

SEQ ID NO: 4435006 - DNA, 18 bp, Homo sapiens
actctaggatgtatattt

SEQ ID NO: 4435007 - DNA, 21 bp, Homo sapiens
actctaggatgtatattttat

SEQ ID NO: 4435008 - DNA, 16 bp, Homo sapiens
actctagttctagatg

SEQ ID NO: 4435009 - DNA, 15 bp, Homo sapiens
actctatatgtagtg

SEQ ID NO: 4435010 - DNA, 12 bp, Homo sapiens
actctcaccatg

SEQ ID NO: 4435011 - DNA, 15 bp, Homo sapiens
actctcagcccagaa

SEQ ID NO: 4435012 - DNA, 13 bp, Homo sapiens
actctcagtctct

SEQ ID NO: 4435013 - DNA, 14 bp, Homo sapiens
actctcagtctctg

SEQ ID NO: 4435014 - DNA, 16 bp, Homo sapiens
actctcagtctctgag

SEQ ID NO: 4435015 - DNA, 14 bp, Homo sapiens
actctcattcccca

SEQ ID NO: 4435016 - DNA, 16 bp, Homo sapiens
actctcattccccagg

SEQ ID NO: 4435017 - DNA, 17 bp, Homo sapiens
actctcattccccaggt

SEQ ID NO: 4435018 - DNA, 21 bp, Homo sapiens
actctcattccccaggtggct

SEQ ID NO: 4435019 - DNA, 14 bp, Homo sapiens
actctccaacctgg

SEQ ID NO: 4435020 - DNA, 19 bp, Homo sapiens
actctccaatgttctatta

SEQ ID NO: 4435021 - DNA, 23 bp, Homo sapiens
actctccaggggtcctaggcctc

SEQ ID NO: 4435022 - DNA, 14 bp, Homo sapiens
actctcccaggcct

SEQ ID NO: 4435023 - DNA, 14 bp, Homo sapiens
actctccccacact

SEQ ID NO: 4435024 - DNA, 15 bp, Homo sapiens
actctccccacacta

SEQ ID NO: 4435025 - DNA, 21 bp, Homo sapiens
actctccccacgagggctggc

SEQ ID NO: 4435026 - DNA, 12 bp, Homo sapiens
actctccccagt

SEQ ID NO: 4435027 - DNA, 12 bp, Homo sapiens
actctcctcctc

SEQ ID NO: 4435028 - DNA, 20 bp, Homo sapiens
actctcctcctcccctcctc

SEQ ID NO: 4435029 - DNA, 12 bp, Homo sapiens
actctcctgggc

SEQ ID NO: 4435030 - DNA, 13 bp, Homo sapiens
actctcctgggcc

SEQ ID NO: 4435031 - DNA, 15 bp, Homo sapiens
actctcctgggcccc

SEQ ID NO: 4435032 - DNA, 16 bp, Homo sapiens
actctcctgggcccct

SEQ ID NO: 4435033 - DNA, 17 bp, Homo sapiens
actctcctgggcccctc

SEQ ID NO: 4435034 - DNA, 18 bp, Homo sapiens
actctcctgggcccctcc

SEQ ID NO: 4435035 - DNA, 12 bp, Homo sapiens
actctcttctct

SEQ ID NO: 4435036 - DNA, 19 bp, Homo sapiens
actctcttctctttctctc

SEQ ID NO: 4435037 - DNA, 20 bp, Homo sapiens
actctcttctctttctctct

SEQ ID NO: 4435038 - DNA, 16 bp, Homo sapiens
actctgaaagagcaaa

SEQ ID NO: 4435039 - DNA, 16 bp, Homo sapiens
actctgaagcctctgg

SEQ ID NO: 4435040 - DNA, 18 bp, Homo sapiens
actctgaagcctctggga

SEQ ID NO: 4435041 - DNA, 19 bp, Homo sapiens
actctgaagcctctgggaa

SEQ ID NO: 4435042 - DNA, 14 bp, Homo sapiens
actctgcactactc

SEQ ID NO: 4435043 - DNA, 23 bp, Homo sapiens
actctgccccaatcgggtccaga

SEQ ID NO: 4435044 - DNA, 17 bp, Homo sapiens
actctgccctctagagc

SEQ ID NO: 4435045 - DNA, 16 bp, Homo sapiens
actctgcctgcttaca

SEQ ID NO: 4435046 - DNA, 22 bp, Homo sapiens
actctgcgggaggctggggccc

SEQ ID NO: 4435047 - DNA, 23 bp, Homo sapiens
actctgctgctcatgggaagaac

SEQ ID NO: 4435048 - DNA, 15 bp, Homo sapiens
actctgcttcttgct

SEQ ID NO: 4435049 - DNA, 16 bp, Homo sapiens
actctggggtgcagct

SEQ ID NO: 4435050 - DNA, 19 bp, Homo sapiens
actctggggtgcagcttca

SEQ ID NO: 4435051 - DNA, 21 bp, Homo sapiens
actctggtgataaaaataaag

SEQ ID NO: 4435052 - DNA, 15 bp, Homo sapiens
actctggtgctcctg

SEQ ID NO: 4435053 - DNA, 19 bp, Homo sapiens
actctggtggcacaggagt

SEQ ID NO: 4435054 - DNA, 16 bp, Homo sapiens
actctgtaaaatgcac

SEQ ID NO: 4435055 - DNA, 16 bp, Homo sapiens
acccggccacagctgc

SEQ ID NO: 4435056 - DNA, 21 bp, Homo sapiens
acccgggaccaaactcacgga

SEQ ID NO: 4435057 - DNA, 13 bp, Homo sapiens
acccgggggacag

SEQ ID NO: 4435058 - DNA, 16 bp, Homo sapiens
acccgggggagcccag

SEQ ID NO: 4435059 - DNA, 20 bp, Homo sapiens
acccgggggagcccagtgaa

SEQ ID NO: 4435060 - DNA, 14 bp, Homo sapiens
acccgtatctgccc

SEQ ID NO: 4435061 - DNA, 17 bp, Homo sapiens
accctaaccaagttcct

SEQ ID NO: 4435062 - DNA, 15 bp, Homo sapiens
accctacagtatata

SEQ ID NO: 4435063 - DNA, 21 bp, Homo sapiens
accctacagtatataagcttt

SEQ ID NO: 4435064 - DNA, 19 bp, Homo sapiens
accctatgggtctaggaca

SEQ ID NO: 4435065 - DNA, 14 bp, Homo sapiens
accctcagagcctc

SEQ ID NO: 4435066 - DNA, 16 bp, Homo sapiens
accctcagcagctctg

SEQ ID NO: 4435067 - DNA, 13 bp, Homo sapiens
accctcagggagc

SEQ ID NO: 4435068 - DNA, 20 bp, Homo sapiens
accctcagggagcctcccca

SEQ ID NO: 4435069 - DNA, 16 bp, Homo sapiens
accctcatctttcttc

SEQ ID NO: 4435070 - DNA, 13 bp, Homo sapiens
accctcatgaaaa

SEQ ID NO: 4435071 - DNA, 15 bp, Homo sapiens
accctccagagacaa

SEQ ID NO: 4435072 - DNA, 19 bp, Homo sapiens
accctccagtgctggattt

SEQ ID NO: 4435073 - DNA, 13 bp, Homo sapiens
accctcccacccc

SEQ ID NO: 4435074 - DNA, 14 bp, Homo sapiens
accctcccaccccc

SEQ ID NO: 4435075 - DNA, 20 bp, Homo sapiens
accctcccacccccttctct

SEQ ID NO: 4435076 - DNA, 23 bp, Homo sapiens
accctcccacccccttctctgct

SEQ ID NO: 4435077 - DNA, 13 bp, Homo sapiens
accctcccccgca

SEQ ID NO: 4435078 - DNA, 15 bp, Homo sapiens
accctcccccgcagc

SEQ ID NO: 4435079 - DNA, 19 bp, Homo sapiens
accctccccttttttcttc

SEQ ID NO: 4435080 - DNA, 13 bp, Homo sapiens
accctccctggag

SEQ ID NO: 4435081 - DNA, 20 bp, Homo sapiens
accctccggcgggtgacagc

SEQ ID NO: 4435082 - DNA, 15 bp, Homo sapiens
accctcctcttggaa

SEQ ID NO: 4435083 - DNA, 13 bp, Homo sapiens
accctcctgtctt

SEQ ID NO: 4435084 - DNA, 21 bp, Homo sapiens
accctcctgtcttcccagggt

SEQ ID NO: 4435085 - DNA, 16 bp, Homo sapiens
accctccttggtgcct

SEQ ID NO: 4435086 - DNA, 15 bp, Homo sapiens
accctctcctggggg

SEQ ID NO: 4435087 - DNA, 18 bp, Homo sapiens
accctctgagctttgcat

SEQ ID NO: 4435088 - DNA, 18 bp, Homo sapiens
accctgaactcagaaggc

SEQ ID NO: 4435089 - DNA, 22 bp, Homo sapiens
accctgagatctgcacagtcag

SEQ ID NO: 4435090 - DNA, 12 bp, Homo sapiens
accctgagccgg

SEQ ID NO: 4435091 - DNA, 16 bp, Homo sapiens
accctgagctcgggga

SEQ ID NO: 4435092 - DNA, 23 bp, Homo sapiens
accctgagctcggggacaggtga

SEQ ID NO: 4435093 - DNA, 22 bp, Homo sapiens
accctgagctgaggcagcagtg

SEQ ID NO: 4435094 - DNA, 13 bp, Homo sapiens
accctgccacagc

SEQ ID NO: 4435095 - DNA, 15 bp, Homo sapiens
accctgccacagcca

SEQ ID NO: 4435096 - DNA, 16 bp, Homo sapiens
accctgccacagccag

SEQ ID NO: 4435097 - DNA, 17 bp, Homo sapiens
accctgccacagccaga

SEQ ID NO: 4435098 - DNA, 20 bp, Homo sapiens
accctgccacagccagagga

SEQ ID NO: 4435099 - DNA, 22 bp, Homo sapiens
accctgccatggaactgtttcc

SEQ ID NO: 4435100 - DNA, 13 bp, Homo sapiens
accctgcccagag

SEQ ID NO: 4435101 - DNA, 11 bp, Homo sapiens
accctgcctcc

SEQ ID NO: 4435102 - DNA, 14 bp, Homo sapiens
acctcagccttgga

SEQ ID NO: 4435103 - DNA, 15 bp, Homo sapiens
acctcaggcaggaag

SEQ ID NO: 4435104 - DNA, 15 bp, Homo sapiens
acctcagggctccca

SEQ ID NO: 4435105 - DNA, 16 bp, Homo sapiens
acctcagggctcccag

SEQ ID NO: 4435106 - DNA, 17 bp, Homo sapiens
acctcagggctcccagg

SEQ ID NO: 4435107 - DNA, 15 bp, Homo sapiens
acctcaggtgatcca

SEQ ID NO: 4435108 - DNA, 17 bp, Homo sapiens
acctcagtaatttagaa

SEQ ID NO: 4435109 - DNA, 14 bp, Homo sapiens
acctcagtgctcct

SEQ ID NO: 4435110 - DNA, 16 bp, Homo sapiens
acctcagtgctcctgg

SEQ ID NO: 4435111 - DNA, 20 bp, Homo sapiens
acctcagttcccttggcctc

SEQ ID NO: 4435112 - DNA, 16 bp, Homo sapiens
acctcatgcccacccc

SEQ ID NO: 4435113 - DNA, 19 bp, Homo sapiens
acctccaataaagtgcctt

SEQ ID NO: 4435114 - DNA, 21 bp, Homo sapiens
acctccacatcccatgttgaa

SEQ ID NO: 4435115 - DNA, 21 bp, Homo sapiens
acctccagcagactcctgctc

SEQ ID NO: 4435116 - DNA, 12 bp, Homo sapiens
acctccccaaag

SEQ ID NO: 4435117 - DNA, 18 bp, Homo sapiens
acctccccccactgcagg

SEQ ID NO: 4435118 - DNA, 20 bp, Homo sapiens
acctccccctgcgccccgca

SEQ ID NO: 4435119 - DNA, 11 bp, Homo sapiens
acctccccctt

SEQ ID NO: 4435120 - DNA, 17 bp, Homo sapiens
acctcccctatccaccc

SEQ ID NO: 4435121 - DNA, 23 bp, Homo sapiens
acctcccctatccacccagccca

SEQ ID NO: 4435122 - DNA, 11 bp, Homo sapiens
acctccctact

SEQ ID NO: 4435123 - DNA, 14 bp, Homo sapiens
acctccctactccc

SEQ ID NO: 4435124 - DNA, 14 bp, Homo sapiens
acctccctgctcag

SEQ ID NO: 4435125 - DNA, 18 bp, Homo sapiens
acctccctgctcagtgct

SEQ ID NO: 4435126 - DNA, 20 bp, Homo sapiens
acctcccttaagcagcaaca

SEQ ID NO: 4435127 - DNA, 14 bp, Homo sapiens
acctccgcccctgc

SEQ ID NO: 4435128 - DNA, 12 bp, Homo sapiens
acctcctaccct

SEQ ID NO: 4435129 - DNA, 19 bp, Homo sapiens
acctcctatgggttgtcac

SEQ ID NO: 4435130 - DNA, 23 bp, Homo sapiens
acctcctcccgaaaaatgtgtgg

SEQ ID NO: 4435131 - DNA, 15 bp, Homo sapiens
acctcctctgggccc

SEQ ID NO: 4435132 - DNA, 20 bp, Homo sapiens
acctcctctgggccctgtcg

SEQ ID NO: 4435133 - DNA, 12 bp, Homo sapiens
acctcctgccca

SEQ ID NO: 4435134 - DNA, 13 bp, Homo sapiens
acctcctgcccag

SEQ ID NO: 4435135 - DNA, 17 bp, Homo sapiens
acctcctgtcagtgagg

SEQ ID NO: 4435136 - DNA, 14 bp, Homo sapiens
acctcgagtactgt

SEQ ID NO: 4435137 - DNA, 16 bp, Homo sapiens
acctcgagtactgtgg

SEQ ID NO: 4435138 - DNA, 22 bp, Homo sapiens
acctcgagtactgtgggcaatt

SEQ ID NO: 4435139 - DNA, 18 bp, Homo sapiens
acctcggggacaccagag

SEQ ID NO: 4435140 - DNA, 23 bp, Homo sapiens
acctcggggacaccagagctgcc

SEQ ID NO: 4435141 - DNA, 15 bp, Homo sapiens
acctcggtgaccact

SEQ ID NO: 4435142 - DNA, 14 bp, Homo sapiens
acctcgtcaagagc

SEQ ID NO: 4435143 - DNA, 15 bp, Homo sapiens
acctcgtcctccccc

SEQ ID NO: 4435144 - DNA, 22 bp, Homo sapiens
acctcgtcctccccctgccagt

SEQ ID NO: 4435145 - DNA, 16 bp, Homo sapiens
acctctacttgctgaa

SEQ ID NO: 4435146 - DNA, 14 bp, Homo sapiens
acctctaggaggag

SEQ ID NO: 4435147 - DNA, 16 bp, Homo sapiens
acctctagtagctgaa

SEQ ID NO: 4435148 - DNA, 20 bp, Homo sapiens
acctctcagctgctggatga

SEQ ID NO: 4435149 - DNA, 14 bp, Homo sapiens
acctctcctgccct

SEQ ID NO: 4435150 - DNA, 20 bp, Homo sapiens
acctctctgtagtttatggc

SEQ ID NO: 4435151 - DNA, 16 bp, Homo sapiens
acctctctgtcatgtg

SEQ ID NO: 4435152 - DNA, 13 bp, Homo sapiens
acctctgagaaga

SEQ ID NO: 4435153 - DNA, 12 bp, Homo sapiens
acctctgcctca

SEQ ID NO: 4435154 - DNA, 14 bp, Homo sapiens
acctctggactggc

SEQ ID NO: 4435155 - DNA, 15 bp, Homo sapiens
acctctggactggct

SEQ ID NO: 4435156 - DNA, 19 bp, Homo sapiens
acctctggactggctagag

SEQ ID NO: 4435157 - DNA, 14 bp, Homo sapiens
acctcttccccaga

SEQ ID NO: 4435158 - DNA, 17 bp, Homo sapiens
acctcttcctaggccac

SEQ ID NO: 4435159 - DNA, 13 bp, Homo sapiens
acctctttttcct

SEQ ID NO: 4435160 - DNA, 18 bp, Homo sapiens
acctctttttcctcctgg

SEQ ID NO: 4435161 - DNA, 19 bp, Homo sapiens
acctctttttcctcctgga

SEQ ID NO: 4435162 - DNA, 18 bp, Homo sapiens
acctgaaaacactgtgca

SEQ ID NO: 4435163 - DNA, 14 bp, Homo sapiens
acctgaaataatat

SEQ ID NO: 4435164 - DNA, 18 bp, Homo sapiens
acctgaaccccagaggca

SEQ ID NO: 4435165 - DNA, 14 bp, Homo sapiens
acctgaacttgcct

SEQ ID NO: 4435166 - DNA, 22 bp, Homo sapiens
acctgaagggtggatgtgctgg

SEQ ID NO: 4435167 - DNA, 23 bp, Homo sapiens
acctgaagggtggatgtgctgga

SEQ ID NO: 4435168 - DNA, 18 bp, Homo sapiens
acctgaataaagaatgaa

SEQ ID NO: 4435169 - DNA, 21 bp, Homo sapiens
acctgacacaccaggcgctaa

SEQ ID NO: 4435170 - DNA, 17 bp, Homo sapiens
acctgacactcccttgg

SEQ ID NO: 4435171 - DNA, 19 bp, Homo sapiens
acctgaccaacatggagaa

SEQ ID NO: 4435172 - DNA, 15 bp, Homo sapiens
acctgacccctgctc

SEQ ID NO: 4435173 - DNA, 19 bp, Homo sapiens
acctgacccttctctcact

SEQ ID NO: 4435174 - DNA, 23 bp, Homo sapiens
acctgacctcctttatggttaat

SEQ ID NO: 4435175 - DNA, 14 bp, Homo sapiens
acctgagcattcag

SEQ ID NO: 4435176 - DNA, 17 bp, Homo sapiens
acctgagccccaaaagg

SEQ ID NO: 4435177 - DNA, 22 bp, Homo sapiens
acctgagctaaataaagatatt

SEQ ID NO: 4435178 - DNA, 19 bp, Homo sapiens
acctgagctagaagctgga

SEQ ID NO: 4435179 - DNA, 17 bp, Homo sapiens
acctgagctattttcct

SEQ ID NO: 4435180 - DNA, 18 bp, Homo sapiens
acctgagctattttcctc

SEQ ID NO: 4435181 - DNA, 21 bp, Homo sapiens
acctgagtcgtacagaaagct

SEQ ID NO: 4435182 - DNA, 20 bp, Homo sapiens
acctgagttcccgggagctg

SEQ ID NO: 4435183 - DNA, 14 bp, Homo sapiens
acctgatcttacag

SEQ ID NO: 4435184 - DNA, 13 bp, Homo sapiens
acctgatgctggg

SEQ ID NO: 4435185 - DNA, 22 bp, Homo sapiens
acctgattgatcacacagtgtt

SEQ ID NO: 4435186 - DNA, 16 bp, Homo sapiens
acctgattggccactg

SEQ ID NO: 4435187 - DNA, 14 bp, Homo sapiens
acctgattgtattt

SEQ ID NO: 4435188 - DNA, 16 bp, Homo sapiens
acctgattttttttcc

SEQ ID NO: 4435189 - DNA, 15 bp, Homo sapiens
acctgcaagatggac

SEQ ID NO: 4435190 - DNA, 18 bp, Homo sapiens
acctgcacattgggtggg

SEQ ID NO: 4435191 - DNA, 20 bp, Homo sapiens
acctgcaccgccccttctcc

SEQ ID NO: 4435192 - DNA, 17 bp, Homo sapiens
acctgcagtttttaatt

SEQ ID NO: 4435193 - DNA, 21 bp, Homo sapiens
acctgcatccgtagttccctg

SEQ ID NO: 4435194 - DNA, 22 bp, Homo sapiens
acctgcatccgtagttccctga

SEQ ID NO: 4435195 - DNA, 14 bp, Homo sapiens
acctgccactcaca

SEQ ID NO: 4435196 - DNA, 16 bp, Homo sapiens
acctgccactcacaca

SEQ ID NO: 4435197 - DNA, 19 bp, Homo sapiens
acctgccactcacacagcc

SEQ ID NO: 4435198 - DNA, 18 bp, Homo sapiens
acctgccaggcaggggtg

SEQ ID NO: 4435199 - DNA, 15 bp, Homo sapiens
acctgccctcaaggg

SEQ ID NO: 4435200 - DNA, 18 bp, Homo sapiens
acctgcccttttttctgc

SEQ ID NO: 4435201 - DNA, 22 bp, Homo sapiens
acctgcccttttttctgcctcc

SEQ ID NO: 4435202 - DNA, 23 bp, Homo sapiens
acctgcccttttttctgcctcct

SEQ ID NO: 4435203 - DNA, 12 bp, Homo sapiens
acctgccgacct

SEQ ID NO: 4435204 - DNA, 23 bp, Homo sapiens
acctgccgagagtccatcagcct

SEQ ID NO: 4435205 - DNA, 16 bp, Homo sapiens
acctgccgccctgtgg

SEQ ID NO: 4435206 - DNA, 18 bp, Homo sapiens
acctgccgccctgtggga

SEQ ID NO: 4435207 - DNA, 14 bp, Homo sapiens
acctgcctctgacc

SEQ ID NO: 4435208 - DNA, 21 bp, Homo sapiens
acctgcctgacatttggagtg

SEQ ID NO: 4435209 - DNA, 18 bp, Homo sapiens
acctgccttttaagtttg

SEQ ID NO: 4435210 - DNA, 16 bp, Homo sapiens
acctgctagaacctct

SEQ ID NO: 4435211 - DNA, 11 bp, Homo sapiens
acctgctcagg

SEQ ID NO: 4435212 - DNA, 13 bp, Homo sapiens
acctgctccaatt

SEQ ID NO: 4435213 - DNA, 16 bp, Homo sapiens
acctgctctgtcccca

SEQ ID NO: 4435214 - DNA, 16 bp, Homo sapiens
acctgctgagagaccc

SEQ ID NO: 4435215 - DNA, 22 bp, Homo sapiens
acctgctgagagacccaaggag

SEQ ID NO: 4435216 - DNA, 11 bp, Homo sapiens
acctgctgctt

SEQ ID NO: 4435217 - DNA, 13 bp, Homo sapiens
acctgctgcttct

SEQ ID NO: 4435218 - DNA, 14 bp, Homo sapiens
acctgctgcttctc

SEQ ID NO: 4435219 - DNA, 17 bp, Homo sapiens
acctgctgcttctccaa

SEQ ID NO: 4435220 - DNA, 19 bp, Homo sapiens
acctgcttccacccgtctc

SEQ ID NO: 4435221 - DNA, 21 bp, Homo sapiens
acgccattgtactccagcctg

SEQ ID NO: 4435222 - DNA, 13 bp, Homo sapiens
acgcccaccagcc

SEQ ID NO: 4435223 - DNA, 15 bp, Homo sapiens
acgcccaccagcctt

SEQ ID NO: 4435224 - DNA, 16 bp, Homo sapiens
acgcccaccagccttg

SEQ ID NO: 4435225 - DNA, 18 bp, Homo sapiens
acgcccaccagccttgct

SEQ ID NO: 4435226 - DNA, 19 bp, Homo sapiens
acgcccaccagccttgctc

SEQ ID NO: 4435227 - DNA, 18 bp, Homo sapiens
acgccccggtcccccaga

SEQ ID NO: 4435228 - DNA, 20 bp, Homo sapiens
acgccccggtcccccagagc

SEQ ID NO: 4435229 - DNA, 13 bp, Homo sapiens
acgccctatttct

SEQ ID NO: 4435230 - DNA, 22 bp, Homo sapiens
acgccctatttctatgtcattt

SEQ ID NO: 4435231 - DNA, 17 bp, Homo sapiens
acgccctccctgctagc

SEQ ID NO: 4435232 - DNA, 21 bp, Homo sapiens
acgccggggacagaggcctgc

SEQ ID NO: 4435233 - DNA, 12 bp, Homo sapiens
acgcctcctggc

SEQ ID NO: 4435234 - DNA, 15 bp, Homo sapiens
acgcctcctggccag

SEQ ID NO: 4435235 - DNA, 16 bp, Homo sapiens
acgcctcctggccaga

SEQ ID NO: 4435236 - DNA, 24 bp, Homo sapiens
acgcctcttgaccaggctgcctcc

SEQ ID NO: 4435237 - DNA, 14 bp, Homo sapiens
acgcctgctggccg

SEQ ID NO: 4435238 - DNA, 18 bp, Homo sapiens
acgcctgggggtgccagg

SEQ ID NO: 4435239 - DNA, 16 bp, Homo sapiens
acgcctgtaatcccag

SEQ ID NO: 4435240 - DNA, 17 bp, Homo sapiens
acgcctgtaatcccagc

SEQ ID NO: 4435241 - DNA, 17 bp, Homo sapiens
acgcggcgggaggccca

SEQ ID NO: 4435242 - DNA, 20 bp, Homo sapiens
acgctaaagagcccttgcct

SEQ ID NO: 4435243 - DNA, 21 bp, Homo sapiens
acgctaaagagcccttgcctc

SEQ ID NO: 4435244 - DNA, 19 bp, Homo sapiens
acgctaataaaaatttatt

SEQ ID NO: 4435245 - DNA, 18 bp, Homo sapiens
acgctcagccccaggcca

SEQ ID NO: 4435246 - DNA, 19 bp, Homo sapiens
acgctcagccccaggccag

SEQ ID NO: 4435247 - DNA, 16 bp, Homo sapiens
acgctccagctgcccc

SEQ ID NO: 4435248 - DNA, 22 bp, Homo sapiens
acgctgaccatgcgtcaggggc

SEQ ID NO: 4435249 - DNA, 15 bp, Homo sapiens
acgctgagccacctg

SEQ ID NO: 4435250 - DNA, 22 bp, Homo sapiens
acgctgagccacctgccctttt

SEQ ID NO: 4435251 - DNA, 23 bp, Homo sapiens
acgctgccgctgccgctgcacca

SEQ ID NO: 4435252 - DNA, 11 bp, Homo sapiens
acgctgggcct

SEQ ID NO: 4435253 - DNA, 21 bp, Homo sapiens
acgctgtcctctcgagcccag

SEQ ID NO: 4435254 - DNA, 16 bp, Homo sapiens
acgcttactagatgtg

SEQ ID NO: 4435255 - DNA, 14 bp, Homo sapiens
acgcttctgagcag

SEQ ID NO: 4435256 - DNA, 21 bp, Homo sapiens
acggacagttccagaagtgtg

SEQ ID NO: 4435257 - DNA, 19 bp, Homo sapiens
acggaccactcgaggcctg

SEQ ID NO: 4435258 - DNA, 19 bp, Homo sapiens
acggacgaaccttgaaaac

SEQ ID NO: 4435259 - DNA, 20 bp, Homo sapiens
acggagccactcctctgact

SEQ ID NO: 4435260 - DNA, 20 bp, Homo sapiens
acggatccatgtagcaggac

SEQ ID NO: 4435261 - DNA, 22 bp, Homo sapiens
acggatggtgcatgggctcgcc

SEQ ID NO: 4435262 - DNA, 12 bp, Homo sapiens
acggattccaaa

SEQ ID NO: 4435263 - DNA, 14 bp, Homo sapiens
acggattttcagtt

SEQ ID NO: 4435264 - DNA, 15 bp, Homo sapiens
acggattttcagtta

SEQ ID NO: 4435265 - DNA, 14 bp, Homo sapiens
acggcaacagcatg

SEQ ID NO: 4435266 - DNA, 18 bp, Homo sapiens
acggcaacgtagcctggg

SEQ ID NO: 4435267 - DNA, 20 bp, Homo sapiens
acggcaggctcactgccagg

SEQ ID NO: 4435268 - DNA, 12 bp, Homo sapiens
acggcccaggcc

SEQ ID NO: 4435269 - DNA, 14 bp, Homo sapiens
acggcccaggccag

SEQ ID NO: 4435270 - DNA, 17 bp, Homo sapiens
acggcccaggccaggtg

SEQ ID NO: 4435271 - DNA, 22 bp, Homo sapiens
acggcccaggccaggtgcccag

SEQ ID NO: 4435272 - DNA, 20 bp, Homo sapiens
acggcctgatgctccctccc

SEQ ID NO: 4435273 - DNA, 22 bp, Homo sapiens
acggcgaccaataaacagctcc

SEQ ID NO: 4435274 - DNA, 23 bp, Homo sapiens
acggcgggatcctccacagagag

SEQ ID NO: 4435275 - DNA, 13 bp, Homo sapiens
acggcgttttttt

SEQ ID NO: 4435276 - DNA, 13 bp, Homo sapiens
acggctcctcaga

SEQ ID NO: 4435277 - DNA, 14 bp, Homo sapiens
acggctcctcagag

SEQ ID NO: 4435278 - DNA, 15 bp, Homo sapiens
acggctcctcagagc

SEQ ID NO: 4435279 - DNA, 23 bp, Homo sapiens
acggcttctcacgctttgtttac

SEQ ID NO: 4435280 - DNA, 21 bp, Homo sapiens
acgggaccctgcccagagctg

SEQ ID NO: 4435281 - DNA, 22 bp, Homo sapiens
acgggaccctgcccagagctga

SEQ ID NO: 4435282 - DNA, 22 bp, Homo sapiens
acgggatggttctggctgtttg

SEQ ID NO: 4435283 - DNA, 15 bp, Homo sapiens
acgggcagcctgggc

SEQ ID NO: 4435284 - DNA, 15 bp, Homo sapiens
acgggcagtctgctc

SEQ ID NO: 4435285 - DNA, 16 bp, Homo sapiens
acgggcagtctgctct

SEQ ID NO: 4435286 - DNA, 17 bp, Homo sapiens
acgggcagtctgctctg

SEQ ID NO: 4435287 - DNA, 14 bp, Homo sapiens
acggggggccccag

SEQ ID NO: 4435288 - DNA, 22 bp, Homo sapiens
acggggggccccagtcagcctc

SEQ ID NO: 4435289 - DNA, 23 bp, Homo sapiens
acggggggccccagtcagcctct

SEQ ID NO: 4435290 - DNA, 21 bp, Homo sapiens
acggggttggctgttccagac

SEQ ID NO: 4435291 - DNA, 16 bp, Homo sapiens
acggtctgtgtgctgt

SEQ ID NO: 4435292 - DNA, 20 bp, Homo sapiens
acggtgctgtgagggagggg

SEQ ID NO: 4435293 - DNA, 20 bp, Homo sapiens
acggtgggccttgctgggga

SEQ ID NO: 4435294 - DNA, 15 bp, Homo sapiens
acggtgttttgccat

SEQ ID NO: 4435295 - DNA, 13 bp, Homo sapiens
acgtaaaacattt

SEQ ID NO: 4435296 - DNA, 12 bp, Homo sapiens
acgtagcatgtg

SEQ ID NO: 4435297 - DNA, 13 bp, Homo sapiens
acgtataaatatc

SEQ ID NO: 4435298 - DNA, 16 bp, Homo sapiens
acgtattgctgtgtct

SEQ ID NO: 4435299 - DNA, 21 bp, Homo sapiens
acgtattgctgtgtctcctct

SEQ ID NO: 4435300 - DNA, 13 bp, Homo sapiens
acgtatttaatag

SEQ ID NO: 4435301 - DNA, 21 bp, Homo sapiens
acgtatttaatagcaaagaat

SEQ ID NO: 4435302 - DNA, 18 bp, Homo sapiens
acgtcaggccctgactcc

SEQ ID NO: 4435303 - DNA, 17 bp, Homo sapiens
acagaggagcttttctg

SEQ ID NO: 4435304 - DNA, 17 bp, Homo sapiens
acagaggccccacctga

SEQ ID NO: 4435305 - DNA, 15 bp, Homo sapiens
acagaggcctgactg

SEQ ID NO: 4435306 - DNA, 17 bp, Homo sapiens
acagaggggctgttagg

SEQ ID NO: 4435307 - DNA, 24 bp, Homo sapiens
acagaggtagtctcactgcttgaa

SEQ ID NO: 4435308 - DNA, 22 bp, Homo sapiens
acagaggttgtagtgagccaag

SEQ ID NO: 4435309 - DNA, 21 bp, Homo sapiens
acagagtcttcactaaccttt

SEQ ID NO: 4435310 - DNA, 18 bp, Homo sapiens
acagagtggcctccctgc

SEQ ID NO: 4435311 - DNA, 20 bp, Homo sapiens
acagagtggcctccctgctg

SEQ ID NO: 4435312 - DNA, 16 bp, Homo sapiens
acagagttgatttttt

SEQ ID NO: 4435313 - DNA, 16 bp, Homo sapiens
acagatatcagtgtct

SEQ ID NO: 4435314 - DNA, 13 bp, Homo sapiens
acagatatcgaga

SEQ ID NO: 4435315 - DNA, 18 bp, Homo sapiens
acagatattgttataaat

SEQ ID NO: 4435316 - DNA, 19 bp, Homo sapiens
acagatattgttataaata

SEQ ID NO: 4435317 - DNA, 22 bp, Homo sapiens
acagatccccagcccctcctcc

SEQ ID NO: 4435318 - DNA, 23 bp, Homo sapiens
acagatccccagcccctcctccc

SEQ ID NO: 4435319 - DNA, 21 bp, Homo sapiens
acagatgagcaggagcttggg

SEQ ID NO: 4435320 - DNA, 14 bp, Homo sapiens
acagatgaggcccc

SEQ ID NO: 4435321 - DNA, 13 bp, Homo sapiens
acagatgccccag

SEQ ID NO: 4435322 - DNA, 14 bp, Homo sapiens
acagatgccccaga

SEQ ID NO: 4435323 - DNA, 17 bp, Homo sapiens
acagatgccccagagct

SEQ ID NO: 4435324 - DNA, 21 bp, Homo sapiens
acagatgccccagagctgttt

SEQ ID NO: 4435325 - DNA, 15 bp, Homo sapiens
acagatgcctggtga

SEQ ID NO: 4435326 - DNA, 21 bp, Homo sapiens
acagatgcctggtgagcaggg

SEQ ID NO: 4435327 - DNA, 12 bp, Homo sapiens
acagatgctcca

SEQ ID NO: 4435328 - DNA, 21 bp, Homo sapiens
acagatgctggtggaggaagg

SEQ ID NO: 4435329 - DNA, 12 bp, Homo sapiens
acagatgtgaaa

SEQ ID NO: 4435330 - DNA, 22 bp, Homo sapiens
acagatgtttttaattctagta

SEQ ID NO: 4435331 - DNA, 19 bp, Homo sapiens
acagattcaggccagccca

SEQ ID NO: 4435332 - DNA, 22 bp, Homo sapiens
acagattcaggccagcccagcc

SEQ ID NO: 4435333 - DNA, 23 bp, Homo sapiens
acagattcaggccagcccagcca

SEQ ID NO: 4435334 - DNA, 19 bp, Homo sapiens
acagatttcaaaaaaaaac

SEQ ID NO: 4435335 - DNA, 22 bp, Homo sapiens
acagatttttatgttttctttc

SEQ ID NO: 4435336 - DNA, 15 bp, Homo sapiens
acagcaaacaggtgc

SEQ ID NO: 4435337 - DNA, 15 bp, Homo sapiens
acagcaaagcagcag

SEQ ID NO: 4435338 - DNA, 19 bp, Homo sapiens
acagcaacgaaccctagaa

SEQ ID NO: 4435339 - DNA, 18 bp, Homo sapiens
acagcaagggtgatggga

SEQ ID NO: 4435340 - DNA, 12 bp, Homo sapiens
acagcacacagg

SEQ ID NO: 4435341 - DNA, 19 bp, Homo sapiens
acagcaccaccatttaatt

SEQ ID NO: 4435342 - DNA, 21 bp, Homo sapiens
acagcaccaccatttaatttc

SEQ ID NO: 4435343 - DNA, 22 bp, Homo sapiens
acagcaccaccatttaatttca

SEQ ID NO: 4435344 - DNA, 15 bp, Homo sapiens
acagcactactctgt

SEQ ID NO: 4435345 - DNA, 19 bp, Homo sapiens
acagcactactgggtgtca

SEQ ID NO: 4435346 - DNA, 20 bp, Homo sapiens
acagcactactgggtgtcat

SEQ ID NO: 4435347 - DNA, 14 bp, Homo sapiens
acagcactggggag

SEQ ID NO: 4435348 - DNA, 15 bp, Homo sapiens
acagcagcagcctgc

SEQ ID NO: 4435349 - DNA, 13 bp, Homo sapiens
acagcagcatttt

SEQ ID NO: 4435350 - DNA, 14 bp, Homo sapiens
acagcagcattttt

SEQ ID NO: 4435351 - DNA, 19 bp, Homo sapiens
acagcagcatttttatttc

SEQ ID NO: 4435352 - DNA, 19 bp, Homo sapiens
acagcagccccaggagaag

SEQ ID NO: 4435353 - DNA, 14 bp, Homo sapiens
acagcaggctgcca

SEQ ID NO: 4435354 - DNA, 15 bp, Homo sapiens
acagcaggctgccag

SEQ ID NO: 4435355 - DNA, 18 bp, Homo sapiens
acagcatcgggagcaccc

SEQ ID NO: 4435356 - DNA, 21 bp, Homo sapiens
acagcatgtacggattttcag

SEQ ID NO: 4435357 - DNA, 18 bp, Homo sapiens
acagccaacgagacacat

SEQ ID NO: 4435358 - DNA, 21 bp, Homo sapiens
acagccaactagcccctgggg

SEQ ID NO: 4435359 - DNA, 13 bp, Homo sapiens
acagccagactgg

SEQ ID NO: 4435360 - DNA, 12 bp, Homo sapiens
acagccagagga

SEQ ID NO: 4435361 - DNA, 15 bp, Homo sapiens
acagccaggtgcctt

SEQ ID NO: 4435362 - DNA, 19 bp, Homo sapiens
acagccaggtgccttggag

SEQ ID NO: 4435363 - DNA, 15 bp, Homo sapiens
acagccccggggccc

SEQ ID NO: 4435364 - DNA, 23 bp, Homo sapiens
acagccccggggccccctggtca

SEQ ID NO: 4435365 - DNA, 18 bp, Homo sapiens
acagcccctggagcctca

SEQ ID NO: 4435366 - DNA, 16 bp, Homo sapiens
acagccctcggcctcc

SEQ ID NO: 4435367 - DNA, 12 bp, Homo sapiens
acagccctggca

SEQ ID NO: 4435368 - DNA, 22 bp, Homo sapiens
acagcccttatgcggttaattt

SEQ ID NO: 4435369 - DNA, 23 bp, Homo sapiens
acagcccttatgcggttaatttt

SEQ ID NO: 4435370 - DNA, 17 bp, Homo sapiens
acagccgcgggccagga

SEQ ID NO: 4435371 - DNA, 20 bp, Homo sapiens
acagccgcgggccaggaggc

SEQ ID NO: 4435372 - DNA, 22 bp, Homo sapiens
acagccgtcccgcgttcaagac

SEQ ID NO: 4435373 - DNA, 12 bp, Homo sapiens
acagcctagggt

SEQ ID NO: 4435374 - DNA, 15 bp, Homo sapiens
acagcctcctctgtc

SEQ ID NO: 4435375 - DNA, 17 bp, Homo sapiens
acagcctcctctgtctg

SEQ ID NO: 4435376 - DNA, 23 bp, Homo sapiens
aattgtttatgtgttatgaacat

SEQ ID NO: 4435377 - DNA, 19 bp, Homo sapiens
aattgttttatctgaattt

SEQ ID NO: 4435378 - DNA, 22 bp, Homo sapiens
aattgttttatctgaattttta

SEQ ID NO: 4435379 - DNA, 23 bp, Homo sapiens
aatttaaaatccattttaggtga

SEQ ID NO: 4435380 - DNA, 13 bp, Homo sapiens
aatttaacagtat

SEQ ID NO: 4435381 - DNA, 21 bp, Homo sapiens
aatttaagaatgaaactataa

SEQ ID NO: 4435382 - DNA, 18 bp, Homo sapiens
aatttaagtgttggaaaa

SEQ ID NO: 4435383 - DNA, 14 bp, Homo sapiens
aatttaatactttt

SEQ ID NO: 4435384 - DNA, 14 bp, Homo sapiens
aatttaatgtaaat

SEQ ID NO: 4435385 - DNA, 13 bp, Homo sapiens
aatttacacagtg

SEQ ID NO: 4435386 - DNA, 16 bp, Homo sapiens
aatttacacagtgaga

SEQ ID NO: 4435387 - DNA, 14 bp, Homo sapiens
aatttacacatctt

SEQ ID NO: 4435388 - DNA, 18 bp, Homo sapiens
aatttacacatcttaaaa

SEQ ID NO: 4435389 - DNA, 14 bp, Homo sapiens
aatttacatggcaa

SEQ ID NO: 4435390 - DNA, 19 bp, Homo sapiens
aatttaccctcttgaatat

SEQ ID NO: 4435391 - DNA, 17 bp, Homo sapiens
aatttacctttaaaata

SEQ ID NO: 4435392 - DNA, 22 bp, Homo sapiens
aatttacttaagtgttcatttt

SEQ ID NO: 4435393 - DNA, 14 bp, Homo sapiens
aatttactttcttc

SEQ ID NO: 4435394 - DNA, 17 bp, Homo sapiens
aatttactttgtagact

SEQ ID NO: 4435395 - DNA, 18 bp, Homo sapiens
aatttactttgtagactg

SEQ ID NO: 4435396 - DNA, 22 bp, Homo sapiens
aatttagaaaaagaacatgcag

SEQ ID NO: 4435397 - DNA, 15 bp, Homo sapiens
aatttagaaaacttt

SEQ ID NO: 4435398 - DNA, 16 bp, Homo sapiens
aatttagaaaacttta

SEQ ID NO: 4435399 - DNA, 23 bp, Homo sapiens
aattttatttgttctttttctga

SEQ ID NO: 4435400 - DNA, 19 bp, Homo sapiens
aattttattttaaaatttc

SEQ ID NO: 4435401 - DNA, 22 bp, Homo sapiens
aattttattttaaaatttcata

SEQ ID NO: 4435402 - DNA, 22 bp, Homo sapiens
aattttcaactgtcttcctcaa

SEQ ID NO: 4435403 - DNA, 19 bp, Homo sapiens
aattttcagacacattttt

SEQ ID NO: 4435404 - DNA, 16 bp, Homo sapiens
aattttcagagacttt

SEQ ID NO: 4435405 - DNA, 22 bp, Homo sapiens
aattttcctgtggaataaagat

SEQ ID NO: 4435406 - DNA, 15 bp, Homo sapiens
aattttctaaaagct

SEQ ID NO: 4435407 - DNA, 13 bp, Homo sapiens
aattttctgtatt

SEQ ID NO: 4435408 - DNA, 19 bp, Homo sapiens
aattttgaagtgctgttta

SEQ ID NO: 4435409 - DNA, 15 bp, Homo sapiens
aattttgagaaaaat

SEQ ID NO: 4435410 - DNA, 11 bp, Homo sapiens
aattttgcaaa

SEQ ID NO: 4435411 - DNA, 18 bp, Homo sapiens
aattttgcatattctcta

SEQ ID NO: 4435412 - DNA, 18 bp, Homo sapiens
aattttggggattttcaa

SEQ ID NO: 4435413 - DNA, 13 bp, Homo sapiens
aatttttaaacaa

SEQ ID NO: 4435414 - DNA, 17 bp, Homo sapiens
aatttttaagctgcaaa

SEQ ID NO: 4435415 - DNA, 17 bp, Homo sapiens
aatttttacctttatct

SEQ ID NO: 4435416 - DNA, 14 bp, Homo sapiens
aatttttatttctt

SEQ ID NO: 4435417 - DNA, 15 bp, Homo sapiens
aatttttatttcttc

SEQ ID NO: 4435418 - DNA, 20 bp, Homo sapiens
aatttttccaactactaata

SEQ ID NO: 4435419 - DNA, 12 bp, Homo sapiens
aatttttgcaat

SEQ ID NO: 4435420 - DNA, 17 bp, Homo sapiens
aatttttgcaataatgc

SEQ ID NO: 4435421 - DNA, 18 bp, Homo sapiens
aatttttgcaataatgca

SEQ ID NO: 4435422 - DNA, 12 bp, Homo sapiens
aatttttgtatt

SEQ ID NO: 4435423 - DNA, 20 bp, Homo sapiens
aattttttggcacttgccat

SEQ ID NO: 4435424 - DNA, 15 bp, Homo sapiens
aattttttggtacaa

SEQ ID NO: 4435425 - DNA, 20 bp, Homo sapiens
aatttttttccttacctttt

SEQ ID NO: 4435426 - DNA, 12 bp, Homo sapiens
aattttttttac

SEQ ID NO: 4435427 - DNA, 16 bp, Homo sapiens
aattttttttacattt

SEQ ID NO: 4435428 - DNA, 23 bp, Homo sapiens
aattttttttcaaatgtgcaatt

SEQ ID NO: 4435429 - DNA, 12 bp, Homo sapiens
acaaaaaacttt

SEQ ID NO: 4435430 - DNA, 14 bp, Homo sapiens
acaaaaaatgtaat

SEQ ID NO: 4435431 - DNA, 14 bp, Homo sapiens
acaaaaacacagca

SEQ ID NO: 4435432 - DNA, 18 bp, Homo sapiens
acaaaaagaaaagaaaat

SEQ ID NO: 4435433 - DNA, 12 bp, Homo sapiens
acaaaaaggcaa

SEQ ID NO: 4435434 - DNA, 20 bp, Homo sapiens
acaaaaataaagactagagc

SEQ ID NO: 4435435 - DNA, 17 bp, Homo sapiens
acaaaaatgtttccact

SEQ ID NO: 4435436 - DNA, 11 bp, Homo sapiens
acaaaacaaaa

SEQ ID NO: 4435437 - DNA, 16 bp, Homo sapiens
acaaaacaaaacaaaa

SEQ ID NO: 4435438 - DNA, 14 bp, Homo sapiens
acaaaacaaaacta

SEQ ID NO: 4435439 - DNA, 17 bp, Homo sapiens
acaaaactacatgagaa

SEQ ID NO: 4435440 - DNA, 23 bp, Homo sapiens
acaaaactacatgagaacaaaca

SEQ ID NO: 4435441 - DNA, 15 bp, Homo sapiens
acaaaactatacttg

SEQ ID NO: 4435442 - DNA, 16 bp, Homo sapiens
acaaaactatacttga

SEQ ID NO: 4435443 - DNA, 16 bp, Homo sapiens
acaaaagaataagaca

SEQ ID NO: 4435444 - DNA, 18 bp, Homo sapiens
acaaaagagcatggatgc

SEQ ID NO: 4435445 - DNA, 24 bp, Homo sapiens
acaaaagagcatggatgcatttca

SEQ ID NO: 4435446 - DNA, 12 bp, Homo sapiens
acaaaagcagat

SEQ ID NO: 4435447 - DNA, 11 bp, Homo sapiens
acaaaagggtc

SEQ ID NO: 4435448 - DNA, 13 bp, Homo sapiens
acaaaagggtcag

SEQ ID NO: 4435449 - DNA, 22 bp, Homo sapiens
acaaaagtacattgcttaaaat

SEQ ID NO: 4435450 - DNA, 22 bp, Homo sapiens
acaaaatatttaagtgaaggag

SEQ ID NO: 4435451 - DNA, 17 bp, Homo sapiens
acaaaatccattccagg

SEQ ID NO: 4435452 - DNA, 22 bp, Homo sapiens
acaaaatccattccaggtagct

SEQ ID NO: 4435453 - DNA, 23 bp, Homo sapiens
acaaaatcttgtaggtcattgca

SEQ ID NO: 4435454 - DNA, 14 bp, Homo sapiens
acaaaatgaaagaa

SEQ ID NO: 4435455 - DNA, 16 bp, Homo sapiens
acaaaatgtagaatat

SEQ ID NO: 4435456 - DNA, 21 bp, Homo sapiens
acaaaatgtagaatattcaga

SEQ ID NO: 4435457 - DNA, 22 bp, Homo sapiens
acaaaatttcacagttctgtaa

SEQ ID NO: 4435458 - DNA, 20 bp, Homo sapiens
acaaaatttgactaatttta

SEQ ID NO: 4435459 - DNA, 15 bp, Homo sapiens
acaaacaaaaaatta

SEQ ID NO: 4435460 - DNA, 19 bp, Homo sapiens
acaaacaaaatttctatta

SEQ ID NO: 4435461 - DNA, 20 bp, Homo sapiens
acaaacaatatgatttgctg

SEQ ID NO: 4435462 - DNA, 16 bp, Homo sapiens
acaaacaatctcttaa

SEQ ID NO: 4435463 - DNA, 18 bp, Homo sapiens
acaaacacaattctagga

SEQ ID NO: 4435464 - DNA, 18 bp, Homo sapiens
acaaaccaccaggactga

SEQ ID NO: 4435465 - DNA, 20 bp, Homo sapiens
acaaaccaccaggactgaaa

SEQ ID NO: 4435466 - DNA, 16 bp, Homo sapiens
acaaaccttgccttga

SEQ ID NO: 4435467 - DNA, 17 bp, Homo sapiens
acaaaccttgccttgaa

SEQ ID NO: 4435468 - DNA, 19 bp, Homo sapiens
acaaacgtaatttgttata

SEQ ID NO: 4435469 - DNA, 13 bp, Homo sapiens
acaaacgtttgac

SEQ ID NO: 4435470 - DNA, 16 bp, Homo sapiens
acaaacgtttgacaaa

SEQ ID NO: 4435471 - DNA, 22 bp, Homo sapiens
acaaacgtttgacaaacacaat

SEQ ID NO: 4435472 - DNA, 16 bp, Homo sapiens
acaaactctcaccatg

SEQ ID NO: 4435473 - DNA, 16 bp, Homo sapiens
acaaactgatttctca

SEQ ID NO: 4435474 - DNA, 17 bp, Homo sapiens
acaaactgatttctcac

SEQ ID NO: 4435475 - DNA, 15 bp, Homo sapiens
acaaactgtgaaaat

SEQ ID NO: 4435476 - DNA, 22 bp, Homo sapiens
acaaactgtgaaaatagtgtaa

SEQ ID NO: 4435477 - DNA, 21 bp, Homo sapiens
acaaacttttaagatttctct

SEQ ID NO: 4435478 - DNA, 11 bp, Homo sapiens
acaaagaaaaa

SEQ ID NO: 4435479 - DNA, 17 bp, Homo sapiens
acaaagaaacaaagatg

SEQ ID NO: 4435480 - DNA, 14 bp, Homo sapiens
acaaagaattccaa

SEQ ID NO: 4435481 - DNA, 18 bp, Homo sapiens
acaaagacaaaagtctgt

SEQ ID NO: 4435482 - DNA, 21 bp, Homo sapiens
acaaagacatttatatgggtt

SEQ ID NO: 4435483 - DNA, 16 bp, Homo sapiens
acaaagagatatttag

SEQ ID NO: 4435484 - DNA, 21 bp, Homo sapiens
acaaagagttcaagaaataag

SEQ ID NO: 4435485 - DNA, 16 bp, Homo sapiens
acaaagattgagaagc

SEQ ID NO: 4435486 - DNA, 15 bp, Homo sapiens
acaaagcactagaga

SEQ ID NO: 4435487 - DNA, 17 bp, Homo sapiens
acaaagcactagagaat

SEQ ID NO: 4435488 - DNA, 15 bp, Homo sapiens
acacatgtgttatct

SEQ ID NO: 4435489 - DNA, 15 bp, Homo sapiens
acacatgttgccttg

SEQ ID NO: 4435490 - DNA, 13 bp, Homo sapiens
acacattatcttc

SEQ ID NO: 4435491 - DNA, 14 bp, Homo sapiens
acacattatcttct

SEQ ID NO: 4435492 - DNA, 16 bp, Homo sapiens
acacattcttgcttgt

SEQ ID NO: 4435493 - DNA, 19 bp, Homo sapiens
acacattggaatgccttgg

SEQ ID NO: 4435494 - DNA, 17 bp, Homo sapiens
acacatttcttaaaaca

SEQ ID NO: 4435495 - DNA, 21 bp, Homo sapiens
acacatttcttaaaacacatg

SEQ ID NO: 4435496 - DNA, 22 bp, Homo sapiens
acacatttcttaaaacacatga

SEQ ID NO: 4435497 - DNA, 22 bp, Homo sapiens
acacatttgggatgttcctttt

SEQ ID NO: 4435498 - DNA, 12 bp, Homo sapiens
acacattttatg

SEQ ID NO: 4435499 - DNA, 17 bp, Homo sapiens
acaccaacataaaaatg

SEQ ID NO: 4435500 - DNA, 23 bp, Homo sapiens
acaccaatttggtaaaaatgctg

SEQ ID NO: 4435501 - DNA, 18 bp, Homo sapiens
acaccacttagatttaaa

SEQ ID NO: 4435502 - DNA, 16 bp, Homo sapiens
acaccagccaggctct

SEQ ID NO: 4435503 - DNA, 22 bp, Homo sapiens
acaccagccaggctctgtgctg

SEQ ID NO: 4435504 - DNA, 23 bp, Homo sapiens
acaccataagctactgccatcct

SEQ ID NO: 4435505 - DNA, 18 bp, Homo sapiens
acaccatcttttattctt

SEQ ID NO: 4435506 - DNA, 14 bp, Homo sapiens
acaccatgtgcaat

SEQ ID NO: 4435507 - DNA, 23 bp, Homo sapiens
acaccatgtgcaataagattggt

SEQ ID NO: 4435508 - DNA, 12 bp, Homo sapiens
acacccagaggt

SEQ ID NO: 4435509 - DNA, 16 bp, Homo sapiens
acacccagcggccccc

SEQ ID NO: 4435510 - DNA, 16 bp, Homo sapiens
acacccaggcccgagc

SEQ ID NO: 4435511 - DNA, 22 bp, Homo sapiens
acacccaggcccgagcgcctgc

SEQ ID NO: 4435512 - DNA, 19 bp, Homo sapiens
acacccaggggaaggccct

SEQ ID NO: 4435513 - DNA, 14 bp, Homo sapiens
acacccatgccaga

SEQ ID NO: 4435514 - DNA, 17 bp, Homo sapiens
acacccatggcctcagc

SEQ ID NO: 4435515 - DNA, 22 bp, Homo sapiens
acacccatggcctcagccctgc

SEQ ID NO: 4435516 - DNA, 14 bp, Homo sapiens
acacccctctgctg

SEQ ID NO: 4435517 - DNA, 16 bp, Homo sapiens
acacccttcagcaatg

SEQ ID NO: 4435518 - DNA, 16 bp, Homo sapiens
acaccctttcatctca

SEQ ID NO: 4435519 - DNA, 13 bp, Homo sapiens
acaccctttctgt

SEQ ID NO: 4435520 - DNA, 14 bp, Homo sapiens
acaccgcgtcccag

SEQ ID NO: 4435521 - DNA, 19 bp, Homo sapiens
acacctaaccccagggcac

SEQ ID NO: 4435522 - DNA, 22 bp, Homo sapiens
acacctagccagctgtcaaggg

SEQ ID NO: 4435523 - DNA, 21 bp, Homo sapiens
acacctcagttcccttggcct

SEQ ID NO: 4435524 - DNA, 22 bp, Homo sapiens
acacctcagttcccttggcctc

SEQ ID NO: 4435525 - DNA, 12 bp, Homo sapiens
acacctccccct

SEQ ID NO: 4435526 - DNA, 15 bp, Homo sapiens
acacctccccctgcg

SEQ ID NO: 4435527 - DNA, 16 bp, Homo sapiens
acacctccccctgcgc

SEQ ID NO: 4435528 - DNA, 20 bp, Homo sapiens
acacctccccctgcgccccg

SEQ ID NO: 4435529 - DNA, 21 bp, Homo sapiens
acacctcgtcaagagcatgca

SEQ ID NO: 4435530 - DNA, 14 bp, Homo sapiens
acacctctgccaga

SEQ ID NO: 4435531 - DNA, 12 bp, Homo sapiens
acacctgcacct

SEQ ID NO: 4435532 - DNA, 22 bp, Homo sapiens
acacctgcctctgaccccagca

SEQ ID NO: 4435533 - DNA, 12 bp, Homo sapiens
acacctggactg

SEQ ID NO: 4435534 - DNA, 19 bp, Homo sapiens
acacctggctgaggttcct

SEQ ID NO: 4435535 - DNA, 13 bp, Homo sapiens
acacctgtacatt

SEQ ID NO: 4435536 - DNA, 16 bp, Homo sapiens
acacctgtacattctt

SEQ ID NO: 4435537 - DNA, 14 bp, Homo sapiens
acaccttaaaacat

SEQ ID NO: 4435538 - DNA, 18 bp, Homo sapiens
acaccttcctcctgcaga

SEQ ID NO: 4435539 - DNA, 22 bp, Homo sapiens
acaccttttccaggagttctga

SEQ ID NO: 4435540 - DNA, 14 bp, Homo sapiens
acacgagcaggcta

SEQ ID NO: 4435541 - DNA, 19 bp, Homo sapiens
acacgagccacaagctgca

SEQ ID NO: 4435542 - DNA, 23 bp, Homo sapiens
acacgatgttgtcaaggatggtt

SEQ ID NO: 4435543 - DNA, 14 bp, Homo sapiens
acacgattttattg

SEQ ID NO: 4435544 - DNA, 14 bp, Homo sapiens
acacgcagttgctc

SEQ ID NO: 4435545 - DNA, 20 bp, Homo sapiens
acacgcatgatggagctgat

SEQ ID NO: 4435546 - DNA, 23 bp, Homo sapiens
acacgccccggtcccccagagca

SEQ ID NO: 4435547 - DNA, 20 bp, Homo sapiens
acacgctccctccccctgcc

SEQ ID NO: 4435548 - DNA, 19 bp, Homo sapiens
acacggatctgctgggctc

SEQ ID NO: 4435549 - DNA, 11 bp, Homo sapiens
acacgtgaagg

SEQ ID NO: 4435550 - DNA, 21 bp, Homo sapiens
acacgttctgatttctgccct

SEQ ID NO: 4435551 - DNA, 13 bp, Homo sapiens
acactaaacattc

SEQ ID NO: 4435552 - DNA, 23 bp, Homo sapiens
acactaagtttgcaacatttatt

SEQ ID NO: 4435553 - DNA, 13 bp, Homo sapiens
acactaatatatt

SEQ ID NO: 4435554 - DNA, 17 bp, Homo sapiens
acactagcccaatgaaa

SEQ ID NO: 4435555 - DNA, 20 bp, Homo sapiens
acactagggactatcaggta

SEQ ID NO: 4435556 - DNA, 14 bp, Homo sapiens
acactattttcaga

SEQ ID NO: 4435557 - DNA, 15 bp, Homo sapiens
acactattttcagaa

SEQ ID NO: 4435558 - DNA, 16 bp, Homo sapiens
acactattttcagaat

SEQ ID NO: 4435559 - DNA, 15 bp, Homo sapiens
acactcaataaacag

SEQ ID NO: 4435560 - DNA, 21 bp, Homo sapiens
acactcagcagacatttatct

SEQ ID NO: 4435561 - DNA, 13 bp, Homo sapiens
acactcagccact

SEQ ID NO: 4435562 - DNA, 14 bp, Homo sapiens
acactcagccactg

SEQ ID NO: 4435563 - DNA, 23 bp, Homo sapiens
acactcagtggcccatggcattt

SEQ ID NO: 4435564 - DNA, 14 bp, Homo sapiens
acactccagcctgg

SEQ ID NO: 4435565 - DNA, 23 bp, Homo sapiens
acactcctagagaacgcagccct

SEQ ID NO: 4435566 - DNA, 18 bp, Homo sapiens
acactcctctatcatgca

SEQ ID NO: 4435567 - DNA, 16 bp, Homo sapiens
acactctaactgtata

SEQ ID NO: 4435568 - DNA, 12 bp, Homo sapiens
acactctcctgg

SEQ ID NO: 4435569 - DNA, 12 bp, Homo sapiens
acactctgctgt

SEQ ID NO: 4435570 - DNA, 13 bp, Homo sapiens
acactcttagcta

SEQ ID NO: 4435571 - DNA, 22 bp, Homo sapiens
acactcttagctatgttgacat

SEQ ID NO: 4435572 - DNA, 18 bp, Homo sapiens
acactgaagtgcttgcag

SEQ ID NO: 4435573 - DNA, 19 bp, Homo sapiens
acactgagctgtgacccag

SEQ ID NO: 4435574 - DNA, 22 bp, Homo sapiens
acactgatgcttagatgttcca

SEQ ID NO: 4435575 - DNA, 13 bp, Homo sapiens
acactgcaaattt

SEQ ID NO: 4435576 - DNA, 19 bp, Homo sapiens
acactgcactttgtttaga

SEQ ID NO: 4435577 - DNA, 21 bp, Homo sapiens
acactgcactttgtttagaaa

SEQ ID NO: 4435578 - DNA, 14 bp, Homo sapiens
acactgctctaaca

SEQ ID NO: 4435579 - DNA, 19 bp, Homo sapiens
acactgctctaacagccct

SEQ ID NO: 4435580 - DNA, 20 bp, Homo sapiens
acactggctcacccagtcct

SEQ ID NO: 4435581 - DNA, 15 bp, Homo sapiens
acactggtctgctgt

SEQ ID NO: 4435582 - DNA, 16 bp, Homo sapiens
acactggtctgctgtc

SEQ ID NO: 4435583 - DNA, 20 bp, Homo sapiens
acactgtatgttatagaact

SEQ ID NO: 4435584 - DNA, 21 bp, Homo sapiens
acactgtatgttatagaactt

SEQ ID NO: 4435585 - DNA, 23 bp, Homo sapiens
acactgtgattactctttgcttt

SEQ ID NO: 4435586 - DNA, 18 bp, Homo sapiens
acactgtgcacatctgtg

SEQ ID NO: 4435587 - DNA, 20 bp, Homo sapiens
acactgtgcacatctgtgtc

SEQ ID NO: 4435588 - DNA, 21 bp, Homo sapiens
acactgtgcacatctgtgtct

SEQ ID NO: 4435589 - DNA, 15 bp, Homo sapiens
acactgtgctttcta

SEQ ID NO: 4435590 - DNA, 23 bp, Homo sapiens
acactgtgctttctattgtacag

SEQ ID NO: 4435591 - DNA, 21 bp, Homo sapiens
acactgttagaacactatttt

SEQ ID NO: 4435592 - DNA, 18 bp, Homo sapiens
acacttaatcattttatg

SEQ ID NO: 4435593 - DNA, 22 bp, Homo sapiens
acacttatattttatgaacatt

SEQ ID NO: 4435594 - DNA, 14 bp, Homo sapiens
acacttatcttctg

SEQ ID NO: 4435595 - DNA, 13 bp, Homo sapiens
acacttccagtct

SEQ ID NO: 4435596 - DNA, 16 bp, Homo sapiens
acacttgctcccaacc

SEQ ID NO: 4435597 - DNA, 19 bp, Homo sapiens
acacttggcatacaaaata

SEQ ID NO: 4435598 - DNA, 19 bp, Homo sapiens
acacttgttccagctcttt

SEQ ID NO: 4435599 - DNA, 13 bp, Homo sapiens
acactttatttac

SEQ ID NO: 4435600 - DNA, 18 bp, Homo sapiens
acactttgccaaggctct

SEQ ID NO: 4435601 - DNA, 19 bp, Homo sapiens
acactttgccatattttca

SEQ ID NO: 4435602 - DNA, 16 bp, Homo sapiens
acactttgcctcctgt

SEQ ID NO: 4435603 - DNA, 23 bp, Homo sapiens
acactttgcctcctgtgtactgt

SEQ ID NO: 4435604 - DNA, 18 bp, Homo sapiens
acactttggcccagggtg

SEQ ID NO: 4435605 - DNA, 16 bp, Homo sapiens
acacttttcatatcat

SEQ ID NO: 4435606 - DNA, 22 bp, Homo sapiens
aatttagaaactaattgacttt

SEQ ID NO: 4435607 - DNA, 13 bp, Homo sapiens
aatttagagcgtt

SEQ ID NO: 4435608 - DNA, 20 bp, Homo sapiens
aatttagagcgtttggttaa

SEQ ID NO: 4435609 - DNA, 15 bp, Homo sapiens
aatttagatcttata

SEQ ID NO: 4435610 - DNA, 17 bp, Homo sapiens
aatttagatcttatatt

SEQ ID NO: 4435611 - DNA, 18 bp, Homo sapiens
aatttagtaaataaacaa

SEQ ID NO: 4435612 - DNA, 14 bp, Homo sapiens
aatttagtaaatgt

SEQ ID NO: 4435613 - DNA, 20 bp, Homo sapiens
aatttagtaaatgttatctt

SEQ ID NO: 4435614 - DNA, 15 bp, Homo sapiens
aatttagtggattaa

SEQ ID NO: 4435615 - DNA, 17 bp, Homo sapiens
aatttagtgtatccata

SEQ ID NO: 4435616 - DNA, 14 bp, Homo sapiens
aatttagtttcata

SEQ ID NO: 4435617 - DNA, 22 bp, Homo sapiens
aatttagtttgttaaagcctgt

SEQ ID NO: 4435618 - DNA, 13 bp, Homo sapiens
aatttataatgta

SEQ ID NO: 4435619 - DNA, 17 bp, Homo sapiens
aatttataatgtatttg

SEQ ID NO: 4435620 - DNA, 19 bp, Homo sapiens
aatttataatgtatttgaa

SEQ ID NO: 4435621 - DNA, 17 bp, Homo sapiens
aatttatagtttataca

SEQ ID NO: 4435622 - DNA, 16 bp, Homo sapiens
aatttatctttaccaa

SEQ ID NO: 4435623 - DNA, 18 bp, Homo sapiens
aatttatctttaccaaaa

SEQ ID NO: 4435624 - DNA, 14 bp, Homo sapiens
aatttatgggagaa

SEQ ID NO: 4435625 - DNA, 20 bp, Homo sapiens
aatttattagccctgcattt

SEQ ID NO: 4435626 - DNA, 22 bp, Homo sapiens
aatttattctacttttaaataa

SEQ ID NO: 4435627 - DNA, 23 bp, Homo sapiens
aatttattctcaggtaatcattt

SEQ ID NO: 4435628 - DNA, 19 bp, Homo sapiens
aatttattgtctgtctaca

SEQ ID NO: 4435629 - DNA, 20 bp, Homo sapiens
aatttatttcaataaatctt

SEQ ID NO: 4435630 - DNA, 16 bp, Homo sapiens
aatttatttcatccag

SEQ ID NO: 4435631 - DNA, 12 bp, Homo sapiens
aatttatttgca

SEQ ID NO: 4435632 - DNA, 14 bp, Homo sapiens
aatttatttgcaaa

SEQ ID NO: 4435633 - DNA, 22 bp, Homo sapiens
aatttattttattttagcagtt

SEQ ID NO: 4435634 - DNA, 13 bp, Homo sapiens
aatttattttctt

SEQ ID NO: 4435635 - DNA, 15 bp, Homo sapiens
aatttcaaaatttaa

SEQ ID NO: 4435636 - DNA, 15 bp, Homo sapiens
aatttcaaatctgta

SEQ ID NO: 4435637 - DNA, 19 bp, Homo sapiens
aatttcacagttctgtaat

SEQ ID NO: 4435638 - DNA, 20 bp, Homo sapiens
aatttcacagttctgtaatg

SEQ ID NO: 4435639 - DNA, 18 bp, Homo sapiens
aatttcaccccattttct

SEQ ID NO: 4435640 - DNA, 21 bp, Homo sapiens
aatttcagctagttaataatt

SEQ ID NO: 4435641 - DNA, 22 bp, Homo sapiens
aatttcagctagttaataattc

SEQ ID NO: 4435642 - DNA, 13 bp, Homo sapiens
aatttcaggaaaa

SEQ ID NO: 4435643 - DNA, 17 bp, Homo sapiens
aatttcataattctgaa

SEQ ID NO: 4435644 - DNA, 22 bp, Homo sapiens
aatttcatacctatcatcttaa

SEQ ID NO: 4435645 - DNA, 13 bp, Homo sapiens
aatttcatgtata

SEQ ID NO: 4435646 - DNA, 19 bp, Homo sapiens
aatttcatttccagcattt

SEQ ID NO: 4435647 - DNA, 20 bp, Homo sapiens
aatttcattttagtatttta

SEQ ID NO: 4435648 - DNA, 14 bp, Homo sapiens
aatttccaaaataa

SEQ ID NO: 4435649 - DNA, 17 bp, Homo sapiens
aatttcccagttaaaga

SEQ ID NO: 4435650 - DNA, 21 bp, Homo sapiens
aatttcctggccctccactcc

SEQ ID NO: 4435651 - DNA, 15 bp, Homo sapiens
aatttcctgtttgaa

SEQ ID NO: 4435652 - DNA, 17 bp, Homo sapiens
aatttcgccttaaactc

SEQ ID NO: 4435653 - DNA, 23 bp, Homo sapiens
aatttcgccttaaactctggaca

SEQ ID NO: 4435654 - DNA, 21 bp, Homo sapiens
aatttcggattttttccaaaa

SEQ ID NO: 4435655 - DNA, 15 bp, Homo sapiens
aatttctaaagtaaa

SEQ ID NO: 4435656 - DNA, 19 bp, Homo sapiens
aatttctaaagtaaaattg

SEQ ID NO: 4435657 - DNA, 15 bp, Homo sapiens
aatttctaatgttta

SEQ ID NO: 4435658 - DNA, 22 bp, Homo sapiens
aatttctagcctgcactttgat

SEQ ID NO: 4435659 - DNA, 22 bp, Homo sapiens
aatttctataaatttaagaaaa

SEQ ID NO: 4435660 - DNA, 12 bp, Homo sapiens
aatttctcctcc

SEQ ID NO: 4435661 - DNA, 14 bp, Homo sapiens
aatttctgccattt

SEQ ID NO: 4435662 - DNA, 13 bp, Homo sapiens
aatttctgtacat

SEQ ID NO: 4435663 - DNA, 14 bp, Homo sapiens
aatttcttatgtga

SEQ ID NO: 4435664 - DNA, 15 bp, Homo sapiens
aatttcttatttacc

SEQ ID NO: 4435665 - DNA, 17 bp, Homo sapiens
aatttctttaaatgtgt

SEQ ID NO: 4435666 - DNA, 16 bp, Homo sapiens
aatttcttttattaat

SEQ ID NO: 4435667 - DNA, 13 bp, Homo sapiens
aatttgaaatcta

SEQ ID NO: 4435668 - DNA, 18 bp, Homo sapiens
aatttgaagacttcaaaa

SEQ ID NO: 4435669 - DNA, 17 bp, Homo sapiens
aatttgaataagcagaa

SEQ ID NO: 4435670 - DNA, 16 bp, Homo sapiens
aatttgactaatttta

SEQ ID NO: 4435671 - DNA, 13 bp, Homo sapiens
aatttgagtgctc

SEQ ID NO: 4435672 - DNA, 23 bp, Homo sapiens
aatttgatggactaattattatt

SEQ ID NO: 4435673 - DNA, 15 bp, Homo sapiens
aatttgattgatttg

SEQ ID NO: 4435674 - DNA, 16 bp, Homo sapiens
aatttgattgatttga

SEQ ID NO: 4435675 - DNA, 20 bp, Homo sapiens
aatttgattgatttgaagaa

SEQ ID NO: 4435676 - DNA, 15 bp, Homo sapiens
aatttgcaaagtact

SEQ ID NO: 4435677 - DNA, 20 bp, Homo sapiens
aatttgcacaatatttcttt

SEQ ID NO: 4435678 - DNA, 15 bp, Homo sapiens
aatttgcatccagca

SEQ ID NO: 4435679 - DNA, 15 bp, Homo sapiens
aatttgcctgctggg

SEQ ID NO: 4435680 - DNA, 15 bp, Homo sapiens
aatttgcgtaactaa

SEQ ID NO: 4435681 - DNA, 23 bp, Homo sapiens
aatttggatttaaaagcctgctc

SEQ ID NO: 4435682 - DNA, 13 bp, Homo sapiens
aatttggccttaa

SEQ ID NO: 4435683 - DNA, 17 bp, Homo sapiens
aatttggccttaagaac

SEQ ID NO: 4435684 - DNA, 19 bp, Homo sapiens
aatttggccttaagaactg

SEQ ID NO: 4435685 - DNA, 22 bp, Homo sapiens
aatttgggagaagcaaatatag

SEQ ID NO: 4435686 - DNA, 17 bp, Homo sapiens
aatttggtacacatgtg

SEQ ID NO: 4435687 - DNA, 18 bp, Homo sapiens
aatttggtacacatgtgt

SEQ ID NO: 4435688 - DNA, 20 bp, Homo sapiens
aatttggtagatgacaaata

SEQ ID NO: 4435689 - DNA, 22 bp, Homo sapiens
aatttggtgccgatgttgaact

SEQ ID NO: 4435690 - DNA, 20 bp, Homo sapiens
aatttgtaagcaacttgctt

SEQ ID NO: 4435691 - DNA, 18 bp, Homo sapiens
aatttgtaataaaactat

SEQ ID NO: 4435692 - DNA, 22 bp, Homo sapiens
aatttgtctgaaacatttcata

SEQ ID NO: 4435693 - DNA, 13 bp, Homo sapiens
aatttgtgtaata

SEQ ID NO: 4435694 - DNA, 19 bp, Homo sapiens
aatttgtgtaataaagtgt

SEQ ID NO: 4435695 - DNA, 17 bp, Homo sapiens
aatttgtgtgtttttag

SEQ ID NO: 4435696 - DNA, 21 bp, Homo sapiens
aatttgtgtgtttttagctgt

SEQ ID NO: 4435697 - DNA, 18 bp, Homo sapiens
aatttgttaattaaatat

SEQ ID NO: 4435698 - DNA, 18 bp, Homo sapiens
aatttgttattttgcaac

SEQ ID NO: 4435699 - DNA, 19 bp, Homo sapiens
aatggtgttgtatgccttt

SEQ ID NO: 4435700 - DNA, 14 bp, Homo sapiens
aatggttcaagtct

SEQ ID NO: 4435701 - DNA, 17 bp, Homo sapiens
aatggtttggtgctttt

SEQ ID NO: 4435702 - DNA, 21 bp, Homo sapiens
aatggtttttaaattttgtaa

SEQ ID NO: 4435703 - DNA, 14 bp, Homo sapiens
aatgtaaactctct

SEQ ID NO: 4435704 - DNA, 14 bp, Homo sapiens
aatgtaaactgctc

SEQ ID NO: 4435705 - DNA, 12 bp, Homo sapiens
aatgtaaaggtt

SEQ ID NO: 4435706 - DNA, 16 bp, Homo sapiens
aatgtaaataaactat

SEQ ID NO: 4435707 - DNA, 20 bp, Homo sapiens
aatgtaagggaaactgccag

SEQ ID NO: 4435708 - DNA, 20 bp, Homo sapiens
aatgtaatataatgtatttt

SEQ ID NO: 4435709 - DNA, 20 bp, Homo sapiens
aatgtaattaactgtaaact

SEQ ID NO: 4435710 - DNA, 19 bp, Homo sapiens
aatgtacaattatgtctct

SEQ ID NO: 4435711 - DNA, 22 bp, Homo sapiens
aatgtacacactggtacttaga

SEQ ID NO: 4435712 - DNA, 20 bp, Homo sapiens
aatgtacaccacatgctatt

SEQ ID NO: 4435713 - DNA, 23 bp, Homo sapiens
aatgtacactttttacagcagca

SEQ ID NO: 4435714 - DNA, 17 bp, Homo sapiens
aatgtacagaggaagct

SEQ ID NO: 4435715 - DNA, 19 bp, Homo sapiens
aatgtacagttgagctcag

SEQ ID NO: 4435716 - DNA, 21 bp, Homo sapiens
aatgtacagttgagctcaggt

SEQ ID NO: 4435717 - DNA, 18 bp, Homo sapiens
aatgtactgaattcttta

SEQ ID NO: 4435718 - DNA, 19 bp, Homo sapiens
aatgtactgaattctttat

SEQ ID NO: 4435719 - DNA, 14 bp, Homo sapiens
aatgtacttaaatg

SEQ ID NO: 4435720 - DNA, 15 bp, Homo sapiens
aatgtacttaaatga

SEQ ID NO: 4435721 - DNA, 18 bp, Homo sapiens
aatgtagaacctcaaaca

SEQ ID NO: 4435722 - DNA, 20 bp, Homo sapiens
aatgtagaatattcagacaa

SEQ ID NO: 4435723 - DNA, 12 bp, Homo sapiens
aatgtagcactt

SEQ ID NO: 4435724 - DNA, 17 bp, Homo sapiens
aatgtagcttcagtcat

SEQ ID NO: 4435725 - DNA, 22 bp, Homo sapiens
aatgtagcttcagtcattaaat

SEQ ID NO: 4435726 - DNA, 23 bp, Homo sapiens
aatgtaggcacttttattttcat

SEQ ID NO: 4435727 - DNA, 19 bp, Homo sapiens
aatgtataaaaattatcaa

SEQ ID NO: 4435728 - DNA, 13 bp, Homo sapiens
aatgtatataaaa

SEQ ID NO: 4435729 - DNA, 17 bp, Homo sapiens
aatgtatataaaaatgg

SEQ ID NO: 4435730 - DNA, 13 bp, Homo sapiens
aatgtatctaaga

SEQ ID NO: 4435731 - DNA, 14 bp, Homo sapiens
aatgtatctaagaa

SEQ ID NO: 4435732 - DNA, 15 bp, Homo sapiens
aatgtatctatttgt

SEQ ID NO: 4435733 - DNA, 21 bp, Homo sapiens
aatgtatctatttgtacaatt

SEQ ID NO: 4435734 - DNA, 22 bp, Homo sapiens
aatgtatctatttgtacaattt

SEQ ID NO: 4435735 - DNA, 13 bp, Homo sapiens
aatgtatgtacaa

SEQ ID NO: 4435736 - DNA, 19 bp, Homo sapiens
aatgtatgtacaatacaat

SEQ ID NO: 4435737 - DNA, 18 bp, Homo sapiens
aatgtattcctttaaaat

SEQ ID NO: 4435738 - DNA, 15 bp, Homo sapiens
aatgtattgattcaa

SEQ ID NO: 4435739 - DNA, 19 bp, Homo sapiens
aatgtatttgaaaattaca

SEQ ID NO: 4435740 - DNA, 14 bp, Homo sapiens
aatgtatttttcta

SEQ ID NO: 4435741 - DNA, 19 bp, Homo sapiens
aatgtcacaacatggtgct

SEQ ID NO: 4435742 - DNA, 21 bp, Homo sapiens
aatgtcacaacatggtgctac

SEQ ID NO: 4435743 - DNA, 16 bp, Homo sapiens
aatgtcaccaccttcc

SEQ ID NO: 4435744 - DNA, 19 bp, Homo sapiens
aatgtcaggaatttaagaa

SEQ ID NO: 4435745 - DNA, 13 bp, Homo sapiens
aatgtcagtatgt

SEQ ID NO: 4435746 - DNA, 22 bp, Homo sapiens
aatgtcagttgttatttattga

SEQ ID NO: 4435747 - DNA, 21 bp, Homo sapiens
aatgtcataaagtgagaaaac

SEQ ID NO: 4435748 - DNA, 19 bp, Homo sapiens
aatgtcattttggtacttt

SEQ ID NO: 4435749 - DNA, 16 bp, Homo sapiens
aatgtcccctcaaact

SEQ ID NO: 4435750 - DNA, 17 bp, Homo sapiens
aatgtcctccagaagcc

SEQ ID NO: 4435751 - DNA, 14 bp, Homo sapiens
aatgtcctttctca

SEQ ID NO: 4435752 - DNA, 13 bp, Homo sapiens
aatgtctatttcc

SEQ ID NO: 4435753 - DNA, 20 bp, Homo sapiens
aatgtctgaagtacaaacat

SEQ ID NO: 4435754 - DNA, 20 bp, Homo sapiens
aatgtcttgatgcatgcact

SEQ ID NO: 4435755 - DNA, 19 bp, Homo sapiens
aatgtcttgttcctgtgca

SEQ ID NO: 4435756 - DNA, 14 bp, Homo sapiens
aatgtgaaaaacta

SEQ ID NO: 4435757 - DNA, 16 bp, Homo sapiens
aatgtgaaatgctttt

SEQ ID NO: 4435758 - DNA, 13 bp, Homo sapiens
aatgtgatcatat

SEQ ID NO: 4435759 - DNA, 22 bp, Homo sapiens
aatgtgatctatgtttcatctt

SEQ ID NO: 4435760 - DNA, 12 bp, Homo sapiens
aatgtgatgaat

SEQ ID NO: 4435761 - DNA, 20 bp, Homo sapiens
aatgtgatgaatactgtatt

SEQ ID NO: 4435762 - DNA, 14 bp, Homo sapiens
aatgtgattcttct

SEQ ID NO: 4435763 - DNA, 18 bp, Homo sapiens
aatgtgattcttctaaag

SEQ ID NO: 4435764 - DNA, 20 bp, Homo sapiens
aatgtgattttatggtgatg

SEQ ID NO: 4435765 - DNA, 14 bp, Homo sapiens
aatgtgcaataact

SEQ ID NO: 4435766 - DNA, 15 bp, Homo sapiens
aatgtgcaatagaag

SEQ ID NO: 4435767 - DNA, 18 bp, Homo sapiens
aatgtgcaatttgtaaat

SEQ ID NO: 4435768 - DNA, 16 bp, Homo sapiens
aatgtgccacagaggc

SEQ ID NO: 4435769 - DNA, 12 bp, Homo sapiens
aatgtggcttga

SEQ ID NO: 4435770 - DNA, 17 bp, Homo sapiens
aatgtggtgacacctcc

SEQ ID NO: 4435771 - DNA, 19 bp, Homo sapiens
aatgtgtacaatgtacaca

SEQ ID NO: 4435772 - DNA, 20 bp, Homo sapiens
aatgtgtatttcttaagaat

SEQ ID NO: 4435773 - DNA, 12 bp, Homo sapiens
aatgtgtcattg

SEQ ID NO: 4435774 - DNA, 14 bp, Homo sapiens
aatgtgtctgtgtt

SEQ ID NO: 4435775 - DNA, 17 bp, Homo sapiens
aatgtgtctgtgttgct

SEQ ID NO: 4435776 - DNA, 12 bp, Homo sapiens
aatgtgtgcttt

SEQ ID NO: 4435777 - DNA, 19 bp, Homo sapiens
aatgtgtgtgtgtggcagg

SEQ ID NO: 4435778 - DNA, 14 bp, Homo sapiens
aatgtgttcttttc

SEQ ID NO: 4435779 - DNA, 14 bp, Homo sapiens
aatgtgttttctgt

SEQ ID NO: 4435780 - DNA, 16 bp, Homo sapiens
aatgtgttttctgtag

SEQ ID NO: 4435781 - DNA, 22 bp, Homo sapiens
aatgttaaggacttctgcagct

SEQ ID NO: 4435782 - DNA, 16 bp, Homo sapiens
aatgttagacttgtgt

SEQ ID NO: 4435783 - DNA, 20 bp, Homo sapiens
aatgttagacttgtgtgcat

SEQ ID NO: 4435784 - DNA, 14 bp, Homo sapiens
aatgttagatattg

SEQ ID NO: 4435785 - DNA, 17 bp, Homo sapiens
aatgttagatattgcta

SEQ ID NO: 4435786 - DNA, 21 bp, Homo sapiens
aatgttatcttatactgtaca

SEQ ID NO: 4435787 - DNA, 13 bp, Homo sapiens
aatgttcatcaat

SEQ ID NO: 4435788 - DNA, 16 bp, Homo sapiens
aatgttcatcaatgaa

SEQ ID NO: 4435789 - DNA, 13 bp, Homo sapiens
aatgttcattgta

SEQ ID NO: 4435790 - DNA, 10 bp, Homo sapiens
aatgttcttt

SEQ ID NO: 4435791 - DNA, 14 bp, Homo sapiens
aatgttctttggaa

SEQ ID NO: 4435792 - DNA, 18 bp, Homo sapiens
aatgttggataaggaatt

SEQ ID NO: 4435793 - DNA, 15 bp, Homo sapiens
aatgtttaaaccttt

SEQ ID NO: 4435794 - DNA, 15 bp, Homo sapiens
aatgtttactatata

SEQ ID NO: 4435795 - DNA, 16 bp, Homo sapiens
aatgtttactgtatca

SEQ ID NO: 4435796 - DNA, 20 bp, Homo sapiens
aatgtttattccttctgtag

SEQ ID NO: 4435797 - DNA, 16 bp, Homo sapiens
aatgtttcaaaataga

SEQ ID NO: 4435798 - DNA, 14 bp, Homo sapiens
aatgtttccactgg

SEQ ID NO: 4435799 - DNA, 23 bp, Homo sapiens
aatgtttctctctctctaccttt

SEQ ID NO: 4435800 - DNA, 18 bp, Homo sapiens
aatgtttctgatttctga

SEQ ID NO: 4435801 - DNA, 12 bp, Homo sapiens
aatgtttgagca

SEQ ID NO: 4435802 - DNA, 13 bp, Homo sapiens
aatgttttaaagt

SEQ ID NO: 4435803 - DNA, 17 bp, Homo sapiens
aatgttttaaatgtaca

SEQ ID NO: 4435804 - DNA, 19 bp, Homo sapiens
aatgttttaaatgtacaga

SEQ ID NO: 4435805 - DNA, 23 bp, Homo sapiens
aattcaaatttgtaataaaacta

SEQ ID NO: 4435806 - DNA, 21 bp, Homo sapiens
aattcacatctaacctcatct

SEQ ID NO: 4435807 - DNA, 15 bp, Homo sapiens
aattcaccagtgttc

SEQ ID NO: 4435808 - DNA, 16 bp, Homo sapiens
aattcaccagtgttcc

SEQ ID NO: 4435809 - DNA, 21 bp, Homo sapiens
aattcactttcatttttgata

SEQ ID NO: 4435810 - DNA, 16 bp, Homo sapiens
aattcagacatctgag

SEQ ID NO: 4435811 - DNA, 14 bp, Homo sapiens
aattcagcatttga

SEQ ID NO: 4435812 - DNA, 13 bp, Homo sapiens
aattcagctctga

SEQ ID NO: 4435813 - DNA, 11 bp, Homo sapiens
aattcaggaag

SEQ ID NO: 4435814 - DNA, 15 bp, Homo sapiens
aattcagtctctgaa

SEQ ID NO: 4435815 - DNA, 14 bp, Homo sapiens
aattcagtttcata

SEQ ID NO: 4435816 - DNA, 15 bp, Homo sapiens
aattcagtttcataa

SEQ ID NO: 4435817 - DNA, 16 bp, Homo sapiens
aattcataaaaacaag

SEQ ID NO: 4435818 - DNA, 17 bp, Homo sapiens
aattcataataaatttt

SEQ ID NO: 4435819 - DNA, 22 bp, Homo sapiens
aattcatggcatgcttaaattt

SEQ ID NO: 4435820 - DNA, 19 bp, Homo sapiens
aattcattcatacttaaaa

SEQ ID NO: 4435821 - DNA, 15 bp, Homo sapiens
aattcatttctagac

SEQ ID NO: 4435822 - DNA, 11 bp, Homo sapiens
aattcatttgg

SEQ ID NO: 4435823 - DNA, 18 bp, Homo sapiens
aattcattttttaaattc

SEQ ID NO: 4435824 - DNA, 13 bp, Homo sapiens
aattccaaagcaa

SEQ ID NO: 4435825 - DNA, 18 bp, Homo sapiens
tacttagagtttctgttt

SEQ ID NO: 4435826 - DNA, 19 bp, Homo sapiens
tacttagagtttctgtttg

SEQ ID NO: 4435827 - DNA, 20 bp, Homo sapiens
tacttagagtttctgtttga

SEQ ID NO: 4435828 - DNA, 15 bp, Homo sapiens
tacttatctctcaaa

SEQ ID NO: 4435829 - DNA, 18 bp, Homo sapiens
tacttatttgtatatggt

SEQ ID NO: 4435830 - DNA, 15 bp, Homo sapiens
tacttatttttctga

SEQ ID NO: 4435831 - DNA, 14 bp, Homo sapiens
tacttcagctttgt

SEQ ID NO: 4435832 - DNA, 13 bp, Homo sapiens
tacttcctctgtg

SEQ ID NO: 4435833 - DNA, 22 bp, Homo sapiens
tacttcctgagtggccagggaa

SEQ ID NO: 4435834 - DNA, 12 bp, Homo sapiens
tacttccttatg

SEQ ID NO: 4435835 - DNA, 14 bp, Homo sapiens
tacttctctataaa

SEQ ID NO: 4435836 - DNA, 22 bp, Homo sapiens
tacttctgtaattgtgtggatt

SEQ ID NO: 4435837 - DNA, 21 bp, Homo sapiens
tacttcttgaatataaaaaat

SEQ ID NO: 4435838 - DNA, 16 bp, Homo sapiens
tacttctttttcatta

SEQ ID NO: 4435839 - DNA, 22 bp, Homo sapiens
tacttgaaaccagtatttaagc

SEQ ID NO: 4435840 - DNA, 19 bp, Homo sapiens
tacttgaacaaaagggtca

SEQ ID NO: 4435841 - DNA, 11 bp, Homo sapiens
tacttgaactt

SEQ ID NO: 4435842 - DNA, 21 bp, Homo sapiens
tacttgaacttgcctctttta

SEQ ID NO: 4435843 - DNA, 22 bp, Homo sapiens
tacttgaactttccaaaaccta

SEQ ID NO: 4435844 - DNA, 18 bp, Homo sapiens
tacttgaagaaacagagt

SEQ ID NO: 4435845 - DNA, 24 bp, Homo sapiens
tacttgaagaaacagagtggcctc

SEQ ID NO: 4435846 - DNA, 19 bp, Homo sapiens
tacttgaaggtacacccca

SEQ ID NO: 4435847 - DNA, 14 bp, Homo sapiens
tacttgaatgaaaa

SEQ ID NO: 4435848 - DNA, 22 bp, Homo sapiens
tacttgcagctcccattctatg

SEQ ID NO: 4435849 - DNA, 15 bp, Homo sapiens
tacttgcttcagtgg

SEQ ID NO: 4435850 - DNA, 14 bp, Homo sapiens
tacttggatttagt

SEQ ID NO: 4435851 - DNA, 18 bp, Homo sapiens
tacttggcaaggtcatag

SEQ ID NO: 4435852 - DNA, 18 bp, Homo sapiens
tacttgggaggctgaggc

SEQ ID NO: 4435853 - DNA, 22 bp, Homo sapiens
tacttggtttgtgaatccatct

SEQ ID NO: 4435854 - DNA, 17 bp, Homo sapiens
tacttgtaaaatgcttt

SEQ ID NO: 4435855 - DNA, 16 bp, Homo sapiens
tacttgtttgaatatt

SEQ ID NO: 4435856 - DNA, 16 bp, Homo sapiens
tactttaaattatatg

SEQ ID NO: 4435857 - DNA, 22 bp, Homo sapiens
tactttaaattatatgatatgc

SEQ ID NO: 4435858 - DNA, 15 bp, Homo sapiens
tactttaatataaac

SEQ ID NO: 4435859 - DNA, 22 bp, Homo sapiens
tactttaattactggaattctt

SEQ ID NO: 4435860 - DNA, 17 bp, Homo sapiens
tactttacagtaaaatt

SEQ ID NO: 4435861 - DNA, 17 bp, Homo sapiens
tactttacttttgctgt

SEQ ID NO: 4435862 - DNA, 17 bp, Homo sapiens
tactttagaagcctgca

SEQ ID NO: 4435863 - DNA, 21 bp, Homo sapiens
tactttagccatcataactca

SEQ ID NO: 4435864 - DNA, 23 bp, Homo sapiens
tactttataactaacatgtcctg

SEQ ID NO: 4435865 - DNA, 21 bp, Homo sapiens
tactttatatctgtaatgata

SEQ ID NO: 4435866 - DNA, 19 bp, Homo sapiens
tactttatgagcagcaaga

SEQ ID NO: 4435867 - DNA, 12 bp, Homo sapiens
tactttcaaaat

SEQ ID NO: 4435868 - DNA, 14 bp, Homo sapiens
tactttcaagtaat

SEQ ID NO: 4435869 - DNA, 16 bp, Homo sapiens
tactttctatgtgaca

SEQ ID NO: 4435870 - DNA, 13 bp, Homo sapiens
tactttctctctc

SEQ ID NO: 4435871 - DNA, 17 bp, Homo sapiens
tactttcttcaggtaaa

SEQ ID NO: 4435872 - DNA, 14 bp, Homo sapiens
tactttgaagtcat

SEQ ID NO: 4435873 - DNA, 18 bp, Homo sapiens
tactttgattccatttta

SEQ ID NO: 4435874 - DNA, 22 bp, Homo sapiens
tactttgcaatccaaataaaga

SEQ ID NO: 4435875 - DNA, 23 bp, Homo sapiens
tactttggtagctgggaaagcat

SEQ ID NO: 4435876 - DNA, 22 bp, Homo sapiens
tactttggtggccacataagcc

SEQ ID NO: 4435877 - DNA, 16 bp, Homo sapiens
tactttgtagactgtt

SEQ ID NO: 4435878 - DNA, 19 bp, Homo sapiens
tacttttaactaataaaat

SEQ ID NO: 4435879 - DNA, 16 bp, Homo sapiens
tacttttcattctctt

SEQ ID NO: 4435880 - DNA, 13 bp, Homo sapiens
tacttttctaaaa

SEQ ID NO: 4435881 - DNA, 16 bp, Homo sapiens
tacttttctaaaatct

SEQ ID NO: 4435882 - DNA, 17 bp, Homo sapiens
tacttttgctgtttata

SEQ ID NO: 4435883 - DNA, 14 bp, Homo sapiens
tactttttcatgaa

SEQ ID NO: 4435884 - DNA, 16 bp, Homo sapiens
tactttttctaatgag

SEQ ID NO: 4435885 - DNA, 23 bp, Homo sapiens
tactttttttgttatagattgtc

SEQ ID NO: 4435886 - DNA, 14 bp, Homo sapiens
tagaaaaaaaaaga

SEQ ID NO: 4435887 - DNA, 15 bp, Homo sapiens
tagaaaaaagtagca

SEQ ID NO: 4435888 - DNA, 18 bp, Homo sapiens
tagaaaaacatttaaact

SEQ ID NO: 4435889 - DNA, 20 bp, Homo sapiens
tagaaaaagtcaatgtactt

SEQ ID NO: 4435890 - DNA, 21 bp, Homo sapiens
tagaaaaagtcaatgtacttg

SEQ ID NO: 4435891 - DNA, 16 bp, Homo sapiens
tagaaaaatgtataaa

SEQ ID NO: 4435892 - DNA, 23 bp, Homo sapiens
tagaaaaattattagaacattca

SEQ ID NO: 4435893 - DNA, 17 bp, Homo sapiens
tagaaaacaggaaaaaa

SEQ ID NO: 4435894 - DNA, 23 bp, Homo sapiens
tagaaaacaggaaaaaaactttt

SEQ ID NO: 4435895 - DNA, 19 bp, Homo sapiens
tagaaaacccaagttttta

SEQ ID NO: 4435896 - DNA, 16 bp, Homo sapiens
tagaaaagtagacaat

SEQ ID NO: 4435897 - DNA, 18 bp, Homo sapiens
tagaaaagtgaattgaag

SEQ ID NO: 4435898 - DNA, 19 bp, Homo sapiens
tagaaaagttgctcttaaa

SEQ ID NO: 4435899 - DNA, 22 bp, Homo sapiens
tagaaaatataagtaaagtgat

SEQ ID NO: 4435900 - DNA, 13 bp, Homo sapiens
tagaaaatgagga

SEQ ID NO: 4435901 - DNA, 19 bp, Homo sapiens
tagaaaattatttgtatga

SEQ ID NO: 4435902 - DNA, 13 bp, Homo sapiens
tagaaacaaaata

SEQ ID NO: 4435903 - DNA, 16 bp, Homo sapiens
tagaaacgtaaactat

SEQ ID NO: 4435904 - DNA, 17 bp, Homo sapiens
tagaaacttcatggttt

SEQ ID NO: 4435905 - DNA, 13 bp, Homo sapiens
tagaaagaaacta

SEQ ID NO: 4435906 - DNA, 16 bp, Homo sapiens
tagaaagaaactaaac

SEQ ID NO: 4435907 - DNA, 21 bp, Homo sapiens
tagaaagaaactaaacagaaa

SEQ ID NO: 4435908 - DNA, 17 bp, Homo sapiens
tagaaagacatctgcct

SEQ ID NO: 4435909 - DNA, 19 bp, Homo sapiens
tagaaagacatctgcctgt

SEQ ID NO: 4435910 - DNA, 11 bp, Homo sapiens
tagaaagctaa

SEQ ID NO: 4435911 - DNA, 21 bp, Homo sapiens
tagaaagctgacattgccaaa

SEQ ID NO: 4435912 - DNA, 21 bp, Homo sapiens
tagaaaggacaacagttctga

SEQ ID NO: 4435913 - DNA, 20 bp, Homo sapiens
tagaaataaaggatgtgatt

SEQ ID NO: 4435914 - DNA, 15 bp, Homo sapiens
tagaaataaattact

SEQ ID NO: 4435915 - DNA, 18 bp, Homo sapiens
tagaaatatatcctgtgt

SEQ ID NO: 4435916 - DNA, 18 bp, Homo sapiens
tagaaatattaaagattt

SEQ ID NO: 4435917 - DNA, 15 bp, Homo sapiens
tagaaatattcacat

SEQ ID NO: 4435918 - DNA, 17 bp, Homo sapiens
tagaaatcattttgcaa

SEQ ID NO: 4435919 - DNA, 16 bp, Homo sapiens
tagaaatggaaatttt

SEQ ID NO: 4435920 - DNA, 18 bp, Homo sapiens
tagaaatgtttattgaca

SEQ ID NO: 4435921 - DNA, 17 bp, Homo sapiens
tagaaattagatttgtg

SEQ ID NO: 4435922 - DNA, 13 bp, Homo sapiens
tagaaattttcaa

SEQ ID NO: 4435923 - DNA, 13 bp, Homo sapiens
tagaaattttgta

SEQ ID NO: 4435924 - DNA, 16 bp, Homo sapiens
tagaaattttgtaaga

SEQ ID NO: 4435925 - DNA, 22 bp, Homo sapiens
tagaacaaggcaccttcttaaa

SEQ ID NO: 4435926 - DNA, 23 bp, Homo sapiens
tagaacacctgccttctaccctc

SEQ ID NO: 4435927 - DNA, 17 bp, Homo sapiens
tagaacactattttcag

SEQ ID NO: 4435928 - DNA, 18 bp, Homo sapiens
tagaacactattttcaga

SEQ ID NO: 4435929 - DNA, 22 bp, Homo sapiens
tagaacactattttcagaatct

SEQ ID NO: 4435930 - DNA, 23 bp, Homo sapiens
tagaacaggttcttaaaaaggaa

SEQ ID NO: 4435931 - DNA, 20 bp, Homo sapiens
tagaacagtggaaactatgt

SEQ ID NO: 4435932 - DNA, 21 bp, Homo sapiens
tagaacattcacttttgttaa

SEQ ID NO: 4435933 - DNA, 12 bp, Homo sapiens
tagaacattgat

SEQ ID NO: 4435934 - DNA, 15 bp, Homo sapiens
tagaacattgatctg

SEQ ID NO: 4435935 - DNA, 16 bp, Homo sapiens
tagaaccaagaagggc

SEQ ID NO: 4435936 - DNA, 17 bp, Homo sapiens
tagaaccacagcagaca

SEQ ID NO: 4435937 - DNA, 21 bp, Homo sapiens
tagaaccagccgtattttaca

SEQ ID NO: 4435938 - DNA, 17 bp, Homo sapiens
tagaacctggaagggct

SEQ ID NO: 4435939 - DNA, 23 bp, Homo sapiens
tagaacctggaagggctagaacc

SEQ ID NO: 4435940 - DNA, 13 bp, Homo sapiens
tagaacctggaga

SEQ ID NO: 4435941 - DNA, 22 bp, Homo sapiens
tagaacctggagagctagaacc

SEQ ID NO: 4435942 - DNA, 17 bp, Homo sapiens
tagaacctggagggctg

SEQ ID NO: 4435943 - DNA, 14 bp, Homo sapiens
tagaactatcattt

SEQ ID NO: 4435944 - DNA, 19 bp, Homo sapiens
tagaactatcatttttaca

SEQ ID NO: 4435945 - DNA, 22 bp, Homo sapiens
tagaactatcatttttacacta

SEQ ID NO: 4435946 - DNA, 15 bp, Homo sapiens
tagaactgattacat

SEQ ID NO: 4435947 - DNA, 16 bp, Homo sapiens
tagaactgtctgtgaa

SEQ ID NO: 4435948 - DNA, 15 bp, Homo sapiens
tagaacttcatggat

SEQ ID NO: 4435949 - DNA, 19 bp, Homo sapiens
tagaagaaccaaatacctc

SEQ ID NO: 4435950 - DNA, 23 bp, Homo sapiens
tagaagaaccaaatacctcaatt

SEQ ID NO: 4435951 - DNA, 16 bp, Homo sapiens
tagaagaatattgtat

SEQ ID NO: 4435952 - DNA, 15 bp, Homo sapiens
tagaagatgtgtaaa

SEQ ID NO: 4435953 - DNA, 20 bp, Homo sapiens
tagaagcaaggagaaaatat

SEQ ID NO: 4435954 - DNA, 12 bp, Homo sapiens
tagaagccaagg

SEQ ID NO: 4435955 - DNA, 19 bp, Homo sapiens
tagaagccttatgaaaatt

SEQ ID NO: 4435956 - DNA, 17 bp, Homo sapiens
tagaagctggaggacta

SEQ ID NO: 4435957 - DNA, 19 bp, Homo sapiens
tagaagggccagtcctgcc

SEQ ID NO: 4435958 - DNA, 22 bp, Homo sapiens
tagaagggccagtcctgcctgg

SEQ ID NO: 4435959 - DNA, 21 bp, Homo sapiens
tagaagtcttaattgtgttta

SEQ ID NO: 4435960 - DNA, 18 bp, Homo sapiens
tagaagtggaccaggaca

SEQ ID NO: 4435961 - DNA, 19 bp, Homo sapiens
tagaagtggaccaggacag

SEQ ID NO: 4435962 - DNA, 19 bp, Homo sapiens
tagaagtgggccaggacag

SEQ ID NO: 4435963 - DNA, 15 bp, Homo sapiens
tagaataaatgaaga

SEQ ID NO: 4435964 - DNA, 15 bp, Homo sapiens
tagaatataaaataa

SEQ ID NO: 4435965 - DNA, 16 bp, Homo sapiens
tagaatcaatttaagt

SEQ ID NO: 4435966 - DNA, 14 bp, Homo sapiens
tagaatcagaataa

SEQ ID NO: 4435967 - DNA, 19 bp, Homo sapiens
tagaatggaggaagaacaa

SEQ ID NO: 4435968 - DNA, 21 bp, Homo sapiens
tagaatgttattgtgtataga

SEQ ID NO: 4435969 - DNA, 16 bp, Homo sapiens
tagaatgtttcatttg

SEQ ID NO: 4435970 - DNA, 18 bp, Homo sapiens
tagaatgttttcaaatgt

SEQ ID NO: 4435971 - DNA, 18 bp, Homo sapiens
tagaattaacacatgatc

SEQ ID NO: 4435972 - DNA, 17 bp, Homo sapiens
tagaattaccatttgtt

SEQ ID NO: 4435973 - DNA, 22 bp, Homo sapiens
tagaattataactgtaaagatg

SEQ ID NO: 4435974 - DNA, 21 bp, Homo sapiens
tagaattatctaatttataaa

SEQ ID NO: 4435975 - DNA, 17 bp, Homo sapiens
tagaattgagtgtttaa

SEQ ID NO: 4435976 - DNA, 13 bp, Homo sapiens
tagaatttcctgt

SEQ ID NO: 4435977 - DNA, 13 bp, Homo sapiens
tagaatttgatta

SEQ ID NO: 4435978 - DNA, 14 bp, Homo sapiens
tagaatttgtttca

SEQ ID NO: 4435979 - DNA, 20 bp, Homo sapiens
tagacaaaaagtatattaaa

SEQ ID NO: 4435980 - DNA, 13 bp, Homo sapiens
tagacaaaggcct

SEQ ID NO: 4435981 - DNA, 18 bp, Homo sapiens
tagacaaaggccttaaca

SEQ ID NO: 4435982 - DNA, 12 bp, Homo sapiens
tagacaagtttt

SEQ ID NO: 4435983 - DNA, 23 bp, Homo sapiens
tagacaatcattgttttgaatat

SEQ ID NO: 4435984 - DNA, 21 bp, Homo sapiens
tagacaattcctccagagaca

SEQ ID NO: 4435985 - DNA, 19 bp, Homo sapiens
tagacacagtattgacttc

SEQ ID NO: 4435986 - DNA, 14 bp, Homo sapiens
tagacacatttaag

SEQ ID NO: 4435987 - DNA, 15 bp, Homo sapiens
tagacactttggaag

SEQ ID NO: 4435988 - DNA, 23 bp, Homo sapiens
tagacactttggaatctaaccac

SEQ ID NO: 4435989 - DNA, 15 bp, Homo sapiens
tagacagaagaaaca

SEQ ID NO: 4435990 - DNA, 18 bp, Homo sapiens
tagacagtctcactttgt

SEQ ID NO: 4435991 - DNA, 12 bp, Homo sapiens
tagacagtgccc

SEQ ID NO: 4435992 - DNA, 19 bp, Homo sapiens
tagacagtgcccttggtgc

SEQ ID NO: 4435993 - DNA, 22 bp, Homo sapiens
tagacatataccaaaaacaagt

SEQ ID NO: 4435994 - DNA, 19 bp, Homo sapiens
tagacatgcccaaaactta

SEQ ID NO: 4435995 - DNA, 21 bp, Homo sapiens
tagacatttgctatgagctgg

SEQ ID NO: 4435996 - DNA, 18 bp, Homo sapiens
tagaccctgaggccctgg

SEQ ID NO: 4435997 - DNA, 12 bp, Homo sapiens
tagaccctgggt

SEQ ID NO: 4435998 - DNA, 21 bp, Homo sapiens
tagacctataatccttgataa

SEQ ID NO: 4435999 - DNA, 16 bp, Homo sapiens
tagacctgccagccac

SEQ ID NO: 4436000 - DNA, 20 bp, Homo sapiens
tagaccttttttttttttcc

SEQ ID NO: 4436001 - DNA, 21 bp, Homo sapiens
tagaccttttttttttttcca

SEQ ID NO: 4436002 - DNA, 13 bp, Homo sapiens
tagacgcaccgcc

SEQ ID NO: 4436003 - DNA, 18 bp, Homo sapiens
tagacgcccctcccaagc

SEQ ID NO: 4436004 - DNA, 13 bp, Homo sapiens
tagactatttctt

SEQ ID NO: 4436005 - DNA, 16 bp, Homo sapiens
tagactctaagataca

SEQ ID NO: 4436006 - DNA, 14 bp, Homo sapiens
tagactctccctgt

SEQ ID NO: 4436007 - DNA, 21 bp, Homo sapiens
tagactcttttccttcccttt

SEQ ID NO: 4436008 - DNA, 18 bp, Homo sapiens
tagactgtgattcagaaa

SEQ ID NO: 4436009 - DNA, 17 bp, Homo sapiens
tagactgtgccagaggc

SEQ ID NO: 4436010 - DNA, 21 bp, Homo sapiens
tagactgtttcacattgcact

SEQ ID NO: 4436011 - DNA, 15 bp, Homo sapiens
tagacttccccatcc

SEQ ID NO: 4436012 - DNA, 18 bp, Homo sapiens
tagacttggacccaaaaa

SEQ ID NO: 4436013 - DNA, 16 bp, Homo sapiens
tagacttgtgtgcatg

SEQ ID NO: 4436014 - DNA, 21 bp, Homo sapiens
tagagaaaccgtcctcttttt

SEQ ID NO: 4436015 - DNA, 21 bp, Homo sapiens
tagagaacagtattgggcagg

SEQ ID NO: 4436016 - DNA, 23 bp, Homo sapiens
tagagaacagtattgggcaggag

SEQ ID NO: 4436017 - DNA, 17 bp, Homo sapiens
tagagaactaaactagt

SEQ ID NO: 4436018 - DNA, 13 bp, Homo sapiens
tagagaagacagg

SEQ ID NO: 4436019 - DNA, 13 bp, Homo sapiens
tagagaatgcaca

SEQ ID NO: 4436020 - DNA, 22 bp, Homo sapiens
tagagaatgttccagacattct

SEQ ID NO: 4436021 - DNA, 11 bp, Homo sapiens
tagagacacat

SEQ ID NO: 4436022 - DNA, 11 bp, Homo sapiens
tagagaccccg

SEQ ID NO: 4436023 - DNA, 19 bp, Homo sapiens
tagagagcagcattcccag

SEQ ID NO: 4436024 - DNA, 18 bp, Homo sapiens
tagagatacagtatacct

SEQ ID NO: 4436025 - DNA, 17 bp, Homo sapiens
tagagataggaaactga

SEQ ID NO: 4436026 - DNA, 14 bp, Homo sapiens
tagagccaggcaca

SEQ ID NO: 4436027 - DNA, 15 bp, Homo sapiens
tagagccaggcacac

SEQ ID NO: 4436028 - DNA, 14 bp, Homo sapiens
tagagcctgaggga

SEQ ID NO: 4436029 - DNA, 13 bp, Homo sapiens
tagagcctgcctg

SEQ ID NO: 4436030 - DNA, 20 bp, Homo sapiens
tagagcgtttggttaaagta

SEQ ID NO: 4436031 - DNA, 20 bp, Homo sapiens
tagagctttttaatagcact

SEQ ID NO: 4436032 - DNA, 13 bp, Homo sapiens
tagaggagctgct

SEQ ID NO: 4436033 - DNA, 16 bp, Homo sapiens
tagaggagctgcttgt

SEQ ID NO: 4436034 - DNA, 21 bp, Homo sapiens
tagaggctcagtggtgggaga

SEQ ID NO: 4436035 - DNA, 23 bp, Homo sapiens
tagaggctccagctctggcacag

SEQ ID NO: 4436036 - DNA, 19 bp, Homo sapiens
tagaggcttctccgccagc

SEQ ID NO: 4436037 - DNA, 22 bp, Homo sapiens
tagaggcttctccgccagcctc

SEQ ID NO: 4436038 - DNA, 16 bp, Homo sapiens
tagaggtgagaaattt

SEQ ID NO: 4436039 - DNA, 19 bp, Homo sapiens
tagagtgacctcggacaga

SEQ ID NO: 4436040 - DNA, 23 bp, Homo sapiens
tagagtgacctcggacagagccc

SEQ ID NO: 4436041 - DNA, 15 bp, Homo sapiens
tagagtttctgtttg

SEQ ID NO: 4436042 - DNA, 23 bp, Homo sapiens
tagagtttctgtttgattctttt

SEQ ID NO: 4436043 - DNA, 20 bp, Homo sapiens
tagagttttattcctttcct

SEQ ID NO: 4436044 - DNA, 15 bp, Homo sapiens
tagataatttacaag

SEQ ID NO: 4436045 - DNA, 23 bp, Homo sapiens
tagataccctacgctgtccagaa

SEQ ID NO: 4436046 - DNA, 14 bp, Homo sapiens
tagatataatgaac

SEQ ID NO: 4436047 - DNA, 20 bp, Homo sapiens
tagatataatgaacaaaatt

SEQ ID NO: 4436048 - DNA, 16 bp, Homo sapiens
tagatatcctctcccc

SEQ ID NO: 4436049 - DNA, 18 bp, Homo sapiens
tagatattgctactataa

SEQ ID NO: 4436050 - DNA, 22 bp, Homo sapiens
tagatatttcgaccctggggcg

SEQ ID NO: 4436051 - DNA, 13 bp, Homo sapiens
tagatatttgaaa

SEQ ID NO: 4436052 - DNA, 16 bp, Homo sapiens
tagatcacatcttaaa

SEQ ID NO: 4436053 - DNA, 13 bp, Homo sapiens
tagatcctgcacc

SEQ ID NO: 4436054 - DNA, 14 bp, Homo sapiens
tagatctcagccat

SEQ ID NO: 4436055 - DNA, 21 bp, Homo sapiens
tagatcttaagcagtaatctg

SEQ ID NO: 4436056 - DNA, 14 bp, Homo sapiens
tagatcttatattg

SEQ ID NO: 4436057 - DNA, 23 bp, Homo sapiens
tagatcttatattggtttgcaca

SEQ ID NO: 4436058 - DNA, 19 bp, Homo sapiens
tagatctttgtaaatgcat

SEQ ID NO: 4436059 - DNA, 21 bp, Homo sapiens
tagatgacaaatattctgaat

SEQ ID NO: 4436060 - DNA, 18 bp, Homo sapiens
tagatgattttttgaaag

SEQ ID NO: 4436061 - DNA, 20 bp, Homo sapiens
tagatgcctcttaggactgg

SEQ ID NO: 4436062 - DNA, 14 bp, Homo sapiens
tagatggttacact

SEQ ID NO: 4436063 - DNA, 16 bp, Homo sapiens
tagatggttacactgt

SEQ ID NO: 4436064 - DNA, 17 bp, Homo sapiens
tagatggttacactgtt

SEQ ID NO: 4436065 - DNA, 16 bp, Homo sapiens
tacagtaaatgttact

SEQ ID NO: 4436066 - DNA, 18 bp, Homo sapiens
tacagtaagtaaagtggt

SEQ ID NO: 4436067 - DNA, 15 bp, Homo sapiens
tacagtaatgtcata

SEQ ID NO: 4436068 - DNA, 17 bp, Homo sapiens
tacagtaatgtcataaa

SEQ ID NO: 4436069 - DNA, 18 bp, Homo sapiens
tacagtaatgtcataaag

SEQ ID NO: 4436070 - DNA, 13 bp, Homo sapiens
tacagtaggagcc

SEQ ID NO: 4436071 - DNA, 14 bp, Homo sapiens
tacagtaggagccc

SEQ ID NO: 4436072 - DNA, 15 bp, Homo sapiens
tacagtaggagccca

SEQ ID NO: 4436073 - DNA, 20 bp, Homo sapiens
tacagtagtttccctactga

SEQ ID NO: 4436074 - DNA, 16 bp, Homo sapiens
tacagtatataagctt

SEQ ID NO: 4436075 - DNA, 22 bp, Homo sapiens
tacagtattatagacaaaagaa

SEQ ID NO: 4436076 - DNA, 15 bp, Homo sapiens
tacagtattgtggca

SEQ ID NO: 4436077 - DNA, 16 bp, Homo sapiens
tacagtctgtcatgaa

SEQ ID NO: 4436078 - DNA, 18 bp, Homo sapiens
tacagtcttccatttgca

SEQ ID NO: 4436079 - DNA, 15 bp, Homo sapiens
tacagtgatagagca

SEQ ID NO: 4436080 - DNA, 12 bp, Homo sapiens
tacagtgcagtt

SEQ ID NO: 4436081 - DNA, 22 bp, Homo sapiens
tacagtggttttatactgaagg

SEQ ID NO: 4436082 - DNA, 22 bp, Homo sapiens
tacagtgtacagtcttgtatta

SEQ ID NO: 4436083 - DNA, 13 bp, Homo sapiens
tacagttagtctt

SEQ ID NO: 4436084 - DNA, 17 bp, Homo sapiens
tacagttataaaattaa

SEQ ID NO: 4436085 - DNA, 13 bp, Homo sapiens
tacagttatttca

SEQ ID NO: 4436086 - DNA, 21 bp, Homo sapiens
tacagttctgtggtttcatgt

SEQ ID NO: 4436087 - DNA, 16 bp, Homo sapiens
tacagttgagctcagg

SEQ ID NO: 4436088 - DNA, 12 bp, Homo sapiens
tacagttgtata

SEQ ID NO: 4436089 - DNA, 22 bp, Homo sapiens
tacagtttgactttttggaatt

SEQ ID NO: 4436090 - DNA, 16 bp, Homo sapiens
tacagttttaaagaat

SEQ ID NO: 4436091 - DNA, 14 bp, Homo sapiens
tacagttttaactg

SEQ ID NO: 4436092 - DNA, 20 bp, Homo sapiens
tacagttttaactgtggata

SEQ ID NO: 4436093 - DNA, 14 bp, Homo sapiens
tacataaacaatga

SEQ ID NO: 4436094 - DNA, 23 bp, Homo sapiens
tacataaaccatttttgttactc

SEQ ID NO: 4436095 - DNA, 18 bp, Homo sapiens
tacataaactgtctcatt

SEQ ID NO: 4436096 - DNA, 20 bp, Homo sapiens
tacataacggaaagttttta

SEQ ID NO: 4436097 - DNA, 19 bp, Homo sapiens
tacataactcctgtccctt

SEQ ID NO: 4436098 - DNA, 23 bp, Homo sapiens
tacataactcctgtcccttttcc

SEQ ID NO: 4436099 - DNA, 13 bp, Homo sapiens
tacataactgaaa

SEQ ID NO: 4436100 - DNA, 17 bp, Homo sapiens
tacataactgaaaatgt

SEQ ID NO: 4436101 - DNA, 21 bp, Homo sapiens
tacataactgaaaatgtgcta

SEQ ID NO: 4436102 - DNA, 17 bp, Homo sapiens
tacataaggatgacttt

SEQ ID NO: 4436103 - DNA, 19 bp, Homo sapiens
tacataatgggccactgaa

SEQ ID NO: 4436104 - DNA, 23 bp, Homo sapiens
tacataatgggccactgaaatct

SEQ ID NO: 4436105 - DNA, 14 bp, Homo sapiens
tacataattgcatg

SEQ ID NO: 4436106 - DNA, 15 bp, Homo sapiens
tacataattgcatga

SEQ ID NO: 4436107 - DNA, 17 bp, Homo sapiens
tacataattgcatgaaa

SEQ ID NO: 4436108 - DNA, 13 bp, Homo sapiens
tacatacagaggt

SEQ ID NO: 4436109 - DNA, 23 bp, Homo sapiens
tacataccacgctagggctggct

SEQ ID NO: 4436110 - DNA, 13 bp, Homo sapiens
tacatactaatga

SEQ ID NO: 4436111 - DNA, 14 bp, Homo sapiens
tacatagatgctta

SEQ ID NO: 4436112 - DNA, 20 bp, Homo sapiens
tacataggcttctattacct

SEQ ID NO: 4436113 - DNA, 17 bp, Homo sapiens
tacatagtgctgctgtg

SEQ ID NO: 4436114 - DNA, 21 bp, Homo sapiens
tacatagtgctgctgtgtgct

SEQ ID NO: 4436115 - DNA, 17 bp, Homo sapiens
tacatatagcagctctt

SEQ ID NO: 4436116 - DNA, 15 bp, Homo sapiens
tacatatataaaact

SEQ ID NO: 4436117 - DNA, 23 bp, Homo sapiens
tacatatcctttggtcctggtgc

SEQ ID NO: 4436118 - DNA, 20 bp, Homo sapiens
tacatcaagtccatctgaca

SEQ ID NO: 4436119 - DNA, 23 bp, Homo sapiens
tacatcaagtccatctgacaaaa

SEQ ID NO: 4436120 - DNA, 13 bp, Homo sapiens
tacatcacatctt

SEQ ID NO: 4436121 - DNA, 23 bp, Homo sapiens
tacatcattattgtagtttgaaa

SEQ ID NO: 4436122 - DNA, 20 bp, Homo sapiens
tacatccgtaggacaagttt

SEQ ID NO: 4436123 - DNA, 20 bp, Homo sapiens
tacatctattttggattgta

SEQ ID NO: 4436124 - DNA, 23 bp, Homo sapiens
tacatctattttggattgtatat

SEQ ID NO: 4436125 - DNA, 16 bp, Homo sapiens
tacatctgagtatttt

SEQ ID NO: 4436126 - DNA, 14 bp, Homo sapiens
tacatctgccttaa

SEQ ID NO: 4436127 - DNA, 16 bp, Homo sapiens
tacatcttctttggaa

SEQ ID NO: 4436128 - DNA, 21 bp, Homo sapiens
tacatgacatttatttttcat

SEQ ID NO: 4436129 - DNA, 18 bp, Homo sapiens
tacatgacgacaaagctg

SEQ ID NO: 4436130 - DNA, 23 bp, Homo sapiens
tacatgacgacaaagctgctaaa

SEQ ID NO: 4436131 - DNA, 14 bp, Homo sapiens
tacatgagaaagat

SEQ ID NO: 4436132 - DNA, 13 bp, Homo sapiens
tacatgagttcaa

SEQ ID NO: 4436133 - DNA, 18 bp, Homo sapiens
tacatgataagacatttt

SEQ ID NO: 4436134 - DNA, 22 bp, Homo sapiens
tacatgatttaaagactacaat

SEQ ID NO: 4436135 - DNA, 15 bp, Homo sapiens
tacatgcataaacta

SEQ ID NO: 4436136 - DNA, 17 bp, Homo sapiens
tacatgctaagagaagt

SEQ ID NO: 4436137 - DNA, 18 bp, Homo sapiens
tacatgctaagagaagta

SEQ ID NO: 4436138 - DNA, 17 bp, Homo sapiens
tacatgctgaaaaatat

SEQ ID NO: 4436139 - DNA, 15 bp, Homo sapiens
tacatggtttaaagt

SEQ ID NO: 4436140 - DNA, 13 bp, Homo sapiens
tacatgtaatttg

SEQ ID NO: 4436141 - DNA, 19 bp, Homo sapiens
tacatgtgagatagttttc

SEQ ID NO: 4436142 - DNA, 13 bp, Homo sapiens
tacatgtttataa

SEQ ID NO: 4436143 - DNA, 17 bp, Homo sapiens
tacatgttttttcattt

SEQ ID NO: 4436144 - DNA, 17 bp, Homo sapiens
tacattaaaataactaa

SEQ ID NO: 4436145 - DNA, 13 bp, Homo sapiens
tacattaaacaat

SEQ ID NO: 4436146 - DNA, 22 bp, Homo sapiens
tacattaacgacccactctgct

SEQ ID NO: 4436147 - DNA, 15 bp, Homo sapiens
tacattaacggtgct

SEQ ID NO: 4436148 - DNA, 12 bp, Homo sapiens
tacattacagat

SEQ ID NO: 4436149 - DNA, 17 bp, Homo sapiens
tacattataataaaatt

SEQ ID NO: 4436150 - DNA, 21 bp, Homo sapiens
tacattataataaaatttctt

SEQ ID NO: 4436151 - DNA, 21 bp, Homo sapiens
tacattattaaacgatttcta

SEQ ID NO: 4436152 - DNA, 13 bp, Homo sapiens
tacattcatttag

SEQ ID NO: 4436153 - DNA, 21 bp, Homo sapiens
tacattcttccatcatcactg

SEQ ID NO: 4436154 - DNA, 23 bp, Homo sapiens
tacattcttccatcatcactgta

SEQ ID NO: 4436155 - DNA, 17 bp, Homo sapiens
tacattgcttaaaatat

SEQ ID NO: 4436156 - DNA, 15 bp, Homo sapiens
tacattgtattctgt

SEQ ID NO: 4436157 - DNA, 16 bp, Homo sapiens
tacattgtgaaacttc

SEQ ID NO: 4436158 - DNA, 15 bp, Homo sapiens
tacattgtgagctct

SEQ ID NO: 4436159 - DNA, 18 bp, Homo sapiens
tacatttcatacaacaga

SEQ ID NO: 4436160 - DNA, 16 bp, Homo sapiens
tacatttcttttaaaa

SEQ ID NO: 4436161 - DNA, 19 bp, Homo sapiens
tacatttgatgcatgtctt

SEQ ID NO: 4436162 - DNA, 23 bp, Homo sapiens
tacattttataatgatgaactta

SEQ ID NO: 4436163 - DNA, 18 bp, Homo sapiens
tacattttgtaaaatatt

SEQ ID NO: 4436164 - DNA, 17 bp, Homo sapiens
tacatttttcaactttg

SEQ ID NO: 4436165 - DNA, 20 bp, Homo sapiens
tacatttttcaactttgaat

SEQ ID NO: 4436166 - DNA, 21 bp, Homo sapiens
tacatttttcaactttgaata

SEQ ID NO: 4436167 - DNA, 17 bp, Homo sapiens
taccaaaaaaaggaagg

SEQ ID NO: 4436168 - DNA, 19 bp, Homo sapiens
taccaaaaaccatgttgcg

SEQ ID NO: 4436169 - DNA, 13 bp, Homo sapiens
taccaaaatttta

SEQ ID NO: 4436170 - DNA, 23 bp, Homo sapiens
taccaaaattttaaaaaagggag

SEQ ID NO: 4436171 - DNA, 15 bp, Homo sapiens
taccaaatgaaatgc

SEQ ID NO: 4436172 - DNA, 13 bp, Homo sapiens
taccaaattaaaa

SEQ ID NO: 4436173 - DNA, 12 bp, Homo sapiens
taccaactttac

SEQ ID NO: 4436174 - DNA, 16 bp, Homo sapiens
taccaagtatgaagta

SEQ ID NO: 4436175 - DNA, 14 bp, Homo sapiens
taccaagtcaaact

SEQ ID NO: 4436176 - DNA, 19 bp, Homo sapiens
taccaatgtgttttctgta

SEQ ID NO: 4436177 - DNA, 15 bp, Homo sapiens
taccacaagacattt

SEQ ID NO: 4436178 - DNA, 12 bp, Homo sapiens
taccacaagcct

SEQ ID NO: 4436179 - DNA, 18 bp, Homo sapiens
taccacaagcctgagaac

SEQ ID NO: 4436180 - DNA, 15 bp, Homo sapiens
taccacacacagcct

SEQ ID NO: 4436181 - DNA, 21 bp, Homo sapiens
taccaccatgcactgtaaata

SEQ ID NO: 4436182 - DNA, 19 bp, Homo sapiens
taccagagaaaaagggagg

SEQ ID NO: 4436183 - DNA, 18 bp, Homo sapiens
taccagagccttcaagtg

SEQ ID NO: 4436184 - DNA, 22 bp, Homo sapiens
taccagaggaagttatggcagt

SEQ ID NO: 4436185 - DNA, 11 bp, Homo sapiens
taccagccagc

SEQ ID NO: 4436186 - DNA, 20 bp, Homo sapiens
taccagcgaggaggctccag

SEQ ID NO: 4436187 - DNA, 19 bp, Homo sapiens
taccagcttaatagctgta

SEQ ID NO: 4436188 - DNA, 21 bp, Homo sapiens
taccaggcaccaaaagaagta

SEQ ID NO: 4436189 - DNA, 20 bp, Homo sapiens
taccagggactatctttgct

SEQ ID NO: 4436190 - DNA, 19 bp, Homo sapiens
taccagtatttagaagcca

SEQ ID NO: 4436191 - DNA, 13 bp, Homo sapiens
taccagtgaattt

SEQ ID NO: 4436192 - DNA, 14 bp, Homo sapiens
taccagtgaatttt

SEQ ID NO: 4436193 - DNA, 18 bp, Homo sapiens
taccagtgaatttttgca

SEQ ID NO: 4436194 - DNA, 21 bp, Homo sapiens
taccagtgaatttttgcaata

SEQ ID NO: 4436195 - DNA, 18 bp, Homo sapiens
taccagttaatttttcca

SEQ ID NO: 4436196 - DNA, 16 bp, Homo sapiens
taccatagaaaaatgt

SEQ ID NO: 4436197 - DNA, 18 bp, Homo sapiens
taccatagagtaatgatg

SEQ ID NO: 4436198 - DNA, 12 bp, Homo sapiens
taccatcatctc

SEQ ID NO: 4436199 - DNA, 13 bp, Homo sapiens
taccatggttctg

SEQ ID NO: 4436200 - DNA, 19 bp, Homo sapiens
taccatggttctgcctcct

SEQ ID NO: 4436201 - DNA, 16 bp, Homo sapiens
taccatggtttgatat

SEQ ID NO: 4436202 - DNA, 17 bp, Homo sapiens
taccatgtgtgctaata

SEQ ID NO: 4436203 - DNA, 16 bp, Homo sapiens
taccattaacattttt

SEQ ID NO: 4436204 - DNA, 18 bp, Homo sapiens
taccattacttgtataaa

SEQ ID NO: 4436205 - DNA, 22 bp, Homo sapiens
taccattatggataaagatgag

SEQ ID NO: 4436206 - DNA, 23 bp, Homo sapiens
taccattatggataaagatgaga

SEQ ID NO: 4436207 - DNA, 13 bp, Homo sapiens
taccatttacatg

SEQ ID NO: 4436208 - DNA, 15 bp, Homo sapiens
taccatttgcctccc

SEQ ID NO: 4436209 - DNA, 20 bp, Homo sapiens
taccatttgtgtctctttat

SEQ ID NO: 4436210 - DNA, 19 bp, Homo sapiens
taccattttaacgctgcct

SEQ ID NO: 4436211 - DNA, 20 bp, Homo sapiens
taccattttaacgctgccta

SEQ ID NO: 4436212 - DNA, 14 bp, Homo sapiens
taccatttttcatt

SEQ ID NO: 4436213 - DNA, 17 bp, Homo sapiens
tacccaacagtttattt

SEQ ID NO: 4436214 - DNA, 17 bp, Homo sapiens
tacccacacctctgcca

SEQ ID NO: 4436215 - DNA, 18 bp, Homo sapiens
tacccagaatgtcagatt

SEQ ID NO: 4436216 - DNA, 19 bp, Homo sapiens
tacccagagaagccccttc

SEQ ID NO: 4436217 - DNA, 20 bp, Homo sapiens
tacccaggctggagtgcagt

SEQ ID NO: 4436218 - DNA, 20 bp, Homo sapiens
tacccatcagttccagcctt

SEQ ID NO: 4436219 - DNA, 19 bp, Homo sapiens
taccccccctcctgctgcc

SEQ ID NO: 4436220 - DNA, 16 bp, Homo sapiens
taccccctaagagcca

SEQ ID NO: 4436221 - DNA, 21 bp, Homo sapiens
tacccctaaaatcccaccaga

SEQ ID NO: 4436222 - DNA, 19 bp, Homo sapiens
taccccttagcctccctga

SEQ ID NO: 4436223 - DNA, 17 bp, Homo sapiens
taccctaaccaagttcc

SEQ ID NO: 4436224 - DNA, 16 bp, Homo sapiens
taccctattctctctt

SEQ ID NO: 4436225 - DNA, 13 bp, Homo sapiens
taccctcccaccc

SEQ ID NO: 4436226 - DNA, 16 bp, Homo sapiens
taccctgagctgaggc

SEQ ID NO: 4436227 - DNA, 12 bp, Homo sapiens
taccctgcctcc

SEQ ID NO: 4436228 - DNA, 20 bp, Homo sapiens
taccctgttcccaagcaaag

SEQ ID NO: 4436229 - DNA, 22 bp, Homo sapiens
tacccttcccgcctccctctca

SEQ ID NO: 4436230 - DNA, 16 bp, Homo sapiens
tacccttttccccctt

SEQ ID NO: 4436231 - DNA, 17 bp, Homo sapiens
tacccttttcccccttc

SEQ ID NO: 4436232 - DNA, 19 bp, Homo sapiens
tacccttttcccccttccc

SEQ ID NO: 4436233 - DNA, 23 bp, Homo sapiens
taccgagagcttggactacacaa

SEQ ID NO: 4436234 - DNA, 18 bp, Homo sapiens
taccggagagagaatgta

SEQ ID NO: 4436235 - DNA, 13 bp, Homo sapiens
taccgtctacatt

SEQ ID NO: 4436236 - DNA, 15 bp, Homo sapiens
tacctaatttcattt

SEQ ID NO: 4436237 - DNA, 15 bp, Homo sapiens
tacctactattggcc

SEQ ID NO: 4436238 - DNA, 17 bp, Homo sapiens
tacctactattggccct

SEQ ID NO: 4436239 - DNA, 21 bp, Homo sapiens
tacctactttgactttttgca

SEQ ID NO: 4436240 - DNA, 18 bp, Homo sapiens
tacctattaggtggaaat

SEQ ID NO: 4436241 - DNA, 16 bp, Homo sapiens
tacctcaacctgtaaa

SEQ ID NO: 4436242 - DNA, 22 bp, Homo sapiens
tacctcaacctgtaaattattt

SEQ ID NO: 4436243 - DNA, 22 bp, Homo sapiens
tacctcaagccccatttcctca

SEQ ID NO: 4436244 - DNA, 13 bp, Homo sapiens
tacctcactgtcc

SEQ ID NO: 4436245 - DNA, 18 bp, Homo sapiens
tacctcagataatatgtt

SEQ ID NO: 4436246 - DNA, 12 bp, Homo sapiens
tacctcaggaaa

SEQ ID NO: 4436247 - DNA, 15 bp, Homo sapiens
tacctcaggcaggaa

SEQ ID NO: 4436248 - DNA, 13 bp, Homo sapiens
tacctcaggtgcc

SEQ ID NO: 4436249 - DNA, 17 bp, Homo sapiens
tacctcaggtgccaacc

SEQ ID NO: 4436250 - DNA, 19 bp, Homo sapiens
tacctcaggtgccaaccca

SEQ ID NO: 4436251 - DNA, 20 bp, Homo sapiens
tacctcagtgctcctggaaa

SEQ ID NO: 4436252 - DNA, 13 bp, Homo sapiens
tacctcctgagaa

SEQ ID NO: 4436253 - DNA, 11 bp, Homo sapiens
tacctcctgcc

SEQ ID NO: 4436254 - DNA, 15 bp, Homo sapiens
tacctcctgcccagg

SEQ ID NO: 4436255 - DNA, 16 bp, Homo sapiens
tacctcctgcccagga

SEQ ID NO: 4436256 - DNA, 13 bp, Homo sapiens
tacctccttgtgt

SEQ ID NO: 4436257 - DNA, 16 bp, Homo sapiens
tacctctgagaagaca

SEQ ID NO: 4436258 - DNA, 15 bp, Homo sapiens
tacctcttcacctga

SEQ ID NO: 4436259 - DNA, 12 bp, Homo sapiens
tacctcttttgc

SEQ ID NO: 4436260 - DNA, 21 bp, Homo sapiens
tacctgaaaacactgtgcaca

SEQ ID NO: 4436261 - DNA, 20 bp, Homo sapiens
tacctgacactcccttgggc

SEQ ID NO: 4436262 - DNA, 13 bp, Homo sapiens
tacctgaggccag

SEQ ID NO: 4436263 - DNA, 14 bp, Homo sapiens
tacctgctgcttct

SEQ ID NO: 4436264 - DNA, 15 bp, Homo sapiens
tacctggatgttctt

SEQ ID NO: 4436265 - DNA, 17 bp, Homo sapiens
tacctggcaattcacaa

SEQ ID NO: 4436266 - DNA, 19 bp, Homo sapiens
tacctgtagattcaggtaa

SEQ ID NO: 4436267 - DNA, 12 bp, Homo sapiens
tacctgtataca

SEQ ID NO: 4436268 - DNA, 19 bp, Homo sapiens
tacctgtcaaaaattttga

SEQ ID NO: 4436269 - DNA, 15 bp, Homo sapiens
tacctgtgaagtgtt

SEQ ID NO: 4436270 - DNA, 11 bp, Homo sapiens
tacctgtggct

SEQ ID NO: 4436271 - DNA, 21 bp, Homo sapiens
tacctgtgtttttttctaaaa

SEQ ID NO: 4436272 - DNA, 19 bp, Homo sapiens
taccttagataatatttct

SEQ ID NO: 4436273 - DNA, 12 bp, Homo sapiens
taccttatttat

SEQ ID NO: 4436274 - DNA, 17 bp, Homo sapiens
taccttatttatttttg

SEQ ID NO: 4436275 - DNA, 14 bp, Homo sapiens
taccttcaaacttt

SEQ ID NO: 4436276 - DNA, 15 bp, Homo sapiens
taccttcaaacttta

SEQ ID NO: 4436277 - DNA, 15 bp, Homo sapiens
taccttcctgtccct

SEQ ID NO: 4436278 - DNA, 19 bp, Homo sapiens
taccttctgtttgtaagga

SEQ ID NO: 4436279 - DNA, 18 bp, Homo sapiens
taccttgaaatgctgtta

SEQ ID NO: 4436280 - DNA, 20 bp, Homo sapiens
taccttgaccatcgtccttc

SEQ ID NO: 4436281 - DNA, 13 bp, Homo sapiens
taccttggttccc

SEQ ID NO: 4436282 - DNA, 23 bp, Homo sapiens
tacctttgttcccaaatttcata

SEQ ID NO: 4436283 - DNA, 16 bp, Homo sapiens
taccttttaaaattga

SEQ ID NO: 4436284 - DNA, 18 bp, Homo sapiens
taccttttctcttttctt

SEQ ID NO: 4436285 - DNA, 21 bp, Homo sapiens
taccttttttgttttttcaaa

SEQ ID NO: 4436286 - DNA, 21 bp, Homo sapiens
tacgaaaaagtgattgtgaag

SEQ ID NO: 4436287 - DNA, 15 bp, Homo sapiens
tacgaatattttcag

SEQ ID NO: 4436288 - DNA, 21 bp, Homo sapiens
tacgaatcttatttttcctgt

SEQ ID NO: 4436289 - DNA, 22 bp, Homo sapiens
tacgaatcttatttttcctgtc

SEQ ID NO: 4436290 - DNA, 17 bp, Homo sapiens
tacgacctgtctgttct

SEQ ID NO: 4436291 - DNA, 15 bp, Homo sapiens
tacgctttgattcat

SEQ ID NO: 4436292 - DNA, 15 bp, Homo sapiens
tacggattttcagtt

SEQ ID NO: 4436293 - DNA, 14 bp, Homo sapiens
tacgtaaaacattt

SEQ ID NO: 4436294 - DNA, 15 bp, Homo sapiens
tacgtaaaacatttg

SEQ ID NO: 4436295 - DNA, 16 bp, Homo sapiens
tacgtacatgtgaggc

SEQ ID NO: 4436296 - DNA, 15 bp, Homo sapiens
tacgtagctctctta

SEQ ID NO: 4436297 - DNA, 15 bp, Homo sapiens
tacgtataaatatca

SEQ ID NO: 4436298 - DNA, 16 bp, Homo sapiens
tacgtataaatatcag

SEQ ID NO: 4436299 - DNA, 18 bp, Homo sapiens
tacgtataatgctttctg

SEQ ID NO: 4436300 - DNA, 16 bp, Homo sapiens
tacgtgtcaatgtgtg

SEQ ID NO: 4436301 - DNA, 17 bp, Homo sapiens
tacgtgtcaatgtgtgc

SEQ ID NO: 4436302 - DNA, 23 bp, Homo sapiens
tacgttaggaggacaaaaggaat

SEQ ID NO: 4436303 - DNA, 22 bp, Homo sapiens
tacgttgagaatcactgctcca

SEQ ID NO: 4436304 - DNA, 20 bp, Homo sapiens
tactaaaattatgttactgt

SEQ ID NO: 4436305 - DNA, 16 bp, Homo sapiens
tactaaaccaactcta

SEQ ID NO: 4436306 - DNA, 21 bp, Homo sapiens
tactaaaccaactctaatatt

SEQ ID NO: 4436307 - DNA, 23 bp, Homo sapiens
tactaacaatcagctccttcctg

SEQ ID NO: 4436308 - DNA, 13 bp, Homo sapiens
tactaaggaaaat

SEQ ID NO: 4436309 - DNA, 16 bp, Homo sapiens
tactaaggacgttgtt

SEQ ID NO: 4436310 - DNA, 22 bp, Homo sapiens
tactaatgaagtattacatgat

SEQ ID NO: 4436311 - DNA, 18 bp, Homo sapiens
tactacagctatatttga

SEQ ID NO: 4436312 - DNA, 13 bp, Homo sapiens
tactaccttgaaa

SEQ ID NO: 4436313 - DNA, 20 bp, Homo sapiens
tactaccttgaaaataagaa

SEQ ID NO: 4436314 - DNA, 20 bp, Homo sapiens
tactagagatattttgtaaa

SEQ ID NO: 4436315 - DNA, 23 bp, Homo sapiens
tactagagatattttgtaaaatg

SEQ ID NO: 4436316 - DNA, 20 bp, Homo sapiens
tactaggccattagcccttc

SEQ ID NO: 4436317 - DNA, 17 bp, Homo sapiens
tactagtctgtgtggga

SEQ ID NO: 4436318 - DNA, 19 bp, Homo sapiens
tactagtctgtgtgggact

SEQ ID NO: 4436319 - DNA, 23 bp, Homo sapiens
tactagtctgtgtgggactgtac

SEQ ID NO: 4436320 - DNA, 12 bp, Homo sapiens
tactagtgttta

SEQ ID NO: 4436321 - DNA, 16 bp, Homo sapiens
tactagtgtttaagtc

SEQ ID NO: 4436322 - DNA, 15 bp, Homo sapiens
tactataatcaaatg

SEQ ID NO: 4436323 - DNA, 13 bp, Homo sapiens
tactatagtacca

SEQ ID NO: 4436324 - DNA, 21 bp, Homo sapiens
tactatatagaatttcctgta

SEQ ID NO: 4436325 - DNA, 17 bp, Homo sapiens
tactatcacacatgaat

SEQ ID NO: 4436326 - DNA, 19 bp, Homo sapiens
tactatcctgtaaatatat

SEQ ID NO: 4436327 - DNA, 14 bp, Homo sapiens
tactatgacactgt

SEQ ID NO: 4436328 - DNA, 12 bp, Homo sapiens
tactattaaaca

SEQ ID NO: 4436329 - DNA, 18 bp, Homo sapiens
tactattaactctgcata

SEQ ID NO: 4436330 - DNA, 15 bp, Homo sapiens
tactattccttacaa

SEQ ID NO: 4436331 - DNA, 22 bp, Homo sapiens
tactatttttattttaaaataa

SEQ ID NO: 4436332 - DNA, 18 bp, Homo sapiens
tactatttttctttccaa

SEQ ID NO: 4436333 - DNA, 16 bp, Homo sapiens
tactcactcactctga

SEQ ID NO: 4436334 - DNA, 20 bp, Homo sapiens
tactcagcagcagagagccc

SEQ ID NO: 4436335 - DNA, 14 bp, Homo sapiens
tactcagcagccct

SEQ ID NO: 4436336 - DNA, 15 bp, Homo sapiens
tactcagcagccctc

SEQ ID NO: 4436337 - DNA, 18 bp, Homo sapiens
tactcagcagccctcctc

SEQ ID NO: 4436338 - DNA, 13 bp, Homo sapiens
tactcagccctgg

SEQ ID NO: 4436339 - DNA, 16 bp, Homo sapiens
tactcagctctcctgc

SEQ ID NO: 4436340 - DNA, 22 bp, Homo sapiens
tactcaggaggctgagacagga

SEQ ID NO: 4436341 - DNA, 22 bp, Homo sapiens
tactcaggaggctgaggcagaa

SEQ ID NO: 4436342 - DNA, 10 bp, Homo sapiens
tactcagggc

SEQ ID NO: 4436343 - DNA, 16 bp, Homo sapiens
tactcagtcaaacact

SEQ ID NO: 4436344 - DNA, 21 bp, Homo sapiens
tactcccttctcgtgtttgct

SEQ ID NO: 4436345 - DNA, 18 bp, Homo sapiens
tactcctatttttgtaaa

SEQ ID NO: 4436346 - DNA, 14 bp, Homo sapiens
tactcctctgcagt

SEQ ID NO: 4436347 - DNA, 16 bp, Homo sapiens
tactcctctgcagtgc

SEQ ID NO: 4436348 - DNA, 14 bp, Homo sapiens
tactctccaacctg

SEQ ID NO: 4436349 - DNA, 18 bp, Homo sapiens
tactctccaacctggaca

SEQ ID NO: 4436350 - DNA, 23 bp, Homo sapiens
tactctggaatgtttttccctcc

SEQ ID NO: 4436351 - DNA, 20 bp, Homo sapiens
tactctgggagtaatacttt

SEQ ID NO: 4436352 - DNA, 21 bp, Homo sapiens
tactcttaaatcatttggtta

SEQ ID NO: 4436353 - DNA, 13 bp, Homo sapiens
tactctttctctc

SEQ ID NO: 4436354 - DNA, 14 bp, Homo sapiens
tactctttgaaagc

SEQ ID NO: 4436355 - DNA, 18 bp, Homo sapiens
tactctttgctttgtagt

SEQ ID NO: 4436356 - DNA, 14 bp, Homo sapiens
tactgaaaatgcat

SEQ ID NO: 4436357 - DNA, 13 bp, Homo sapiens
tactgaaagcctt

SEQ ID NO: 4436358 - DNA, 16 bp, Homo sapiens
tactgaaccaggccag

SEQ ID NO: 4436359 - DNA, 17 bp, Homo sapiens
tactgaaccctgcctct

SEQ ID NO: 4436360 - DNA, 13 bp, Homo sapiens
tactgaaggaaaa

SEQ ID NO: 4436361 - DNA, 13 bp, Homo sapiens
tactgaatctgct

SEQ ID NO: 4436362 - DNA, 19 bp, Homo sapiens
tactgaatgaagcagtatt

SEQ ID NO: 4436363 - DNA, 15 bp, Homo sapiens
tactgaatgatctat

SEQ ID NO: 4436364 - DNA, 19 bp, Homo sapiens
tactgaatttttttgtaat

SEQ ID NO: 4436365 - DNA, 18 bp, Homo sapiens
tactgacaataaaaatgt

SEQ ID NO: 4436366 - DNA, 18 bp, Homo sapiens
tactgagcgagctgggcc

SEQ ID NO: 4436367 - DNA, 23 bp, Homo sapiens
tactgagggaccaactgggccca

SEQ ID NO: 4436368 - DNA, 20 bp, Homo sapiens
tactgataaaaatgatattg

SEQ ID NO: 4436369 - DNA, 14 bp, Homo sapiens
tactgatatatttt

SEQ ID NO: 4436370 - DNA, 15 bp, Homo sapiens
tactgattatgaaat

SEQ ID NO: 4436371 - DNA, 17 bp, Homo sapiens
tactgattatgaaatgt

SEQ ID NO: 4436372 - DNA, 23 bp, Homo sapiens
tactgatttgggctgaatgtatg

SEQ ID NO: 4436373 - DNA, 14 bp, Homo sapiens
tactgcaaatcagg

SEQ ID NO: 4436374 - DNA, 22 bp, Homo sapiens
tactgcaaatcaggcttttgtt

SEQ ID NO: 4436375 - DNA, 18 bp, Homo sapiens
tactgcactcttaaacag

SEQ ID NO: 4436376 - DNA, 15 bp, Homo sapiens
tactgccatcctggc

SEQ ID NO: 4436377 - DNA, 19 bp, Homo sapiens
tactgccatcctggcccag

SEQ ID NO: 4436378 - DNA, 14 bp, Homo sapiens
tactgctcagcttc

SEQ ID NO: 4436379 - DNA, 22 bp, Homo sapiens
tactgctcagcttcttctttca

SEQ ID NO: 4436380 - DNA, 15 bp, Homo sapiens
tactgctctcctcca

SEQ ID NO: 4436381 - DNA, 19 bp, Homo sapiens
tactgctctttattgcaga

SEQ ID NO: 4436382 - DNA, 22 bp, Homo sapiens
tactgctctttattgcagaatg

SEQ ID NO: 4436383 - DNA, 16 bp, Homo sapiens
tactgcttctctttgt

SEQ ID NO: 4436384 - DNA, 17 bp, Homo sapiens
tactgctttaatcagaa

SEQ ID NO: 4436385 - DNA, 17 bp, Homo sapiens
tactggaattcttctgc

SEQ ID NO: 4436386 - DNA, 19 bp, Homo sapiens
tactggaattcttctgcaa

SEQ ID NO: 4436387 - DNA, 14 bp, Homo sapiens
tactggataaattg

SEQ ID NO: 4436388 - DNA, 17 bp, Homo sapiens
tactggataaattgttt

SEQ ID NO: 4436389 - DNA, 13 bp, Homo sapiens
tactggattctta

SEQ ID NO: 4436390 - DNA, 15 bp, Homo sapiens
tactggccaattttt

SEQ ID NO: 4436391 - DNA, 19 bp, Homo sapiens
tactggggaggctgaggca

SEQ ID NO: 4436392 - DNA, 14 bp, Homo sapiens
tactgggtgtcatt

SEQ ID NO: 4436393 - DNA, 13 bp, Homo sapiens
tactggtaagatt

SEQ ID NO: 4436394 - DNA, 16 bp, Homo sapiens
tactggttactttcaa

SEQ ID NO: 4436395 - DNA, 17 bp, Homo sapiens
tactggttactttcaaa

SEQ ID NO: 4436396 - DNA, 14 bp, Homo sapiens
tactgtaagaataa

SEQ ID NO: 4436397 - DNA, 21 bp, Homo sapiens
tactgtaatacttctttgtta

SEQ ID NO: 4436398 - DNA, 16 bp, Homo sapiens
tactgtaattcctcaa

SEQ ID NO: 4436399 - DNA, 11 bp, Homo sapiens
tactgtacaca

SEQ ID NO: 4436400 - DNA, 15 bp, Homo sapiens
tactgtatgttttta

SEQ ID NO: 4436401 - DNA, 23 bp, Homo sapiens
tactgtattttgtattgtttcaa

SEQ ID NO: 4436402 - DNA, 22 bp, Homo sapiens
tactgtcagattaaattacagc

SEQ ID NO: 4436403 - DNA, 23 bp, Homo sapiens
tactgtcttacgtttttctggtg

SEQ ID NO: 4436404 - DNA, 18 bp, Homo sapiens
tactgtgaaaaaaaattt

SEQ ID NO: 4436405 - DNA, 19 bp, Homo sapiens
tactgtgaaaaaaaatttg

SEQ ID NO: 4436406 - DNA, 12 bp, Homo sapiens
tactgtgggcaa

SEQ ID NO: 4436407 - DNA, 16 bp, Homo sapiens
tactgttctcaacata

SEQ ID NO: 4436408 - DNA, 17 bp, Homo sapiens
tactgttgaaaaagata

SEQ ID NO: 4436409 - DNA, 18 bp, Homo sapiens
tactgttgctttaatatg

SEQ ID NO: 4436410 - DNA, 15 bp, Homo sapiens
tactgtttacagttt

SEQ ID NO: 4436411 - DNA, 21 bp, Homo sapiens
tactgtttaccatttttcatt

SEQ ID NO: 4436412 - DNA, 23 bp, Homo sapiens
tacttaaaaaaaaaaaaaagctt

SEQ ID NO: 4436413 - DNA, 23 bp, Homo sapiens
tacttaaaaatagtcttccacaa

SEQ ID NO: 4436414 - DNA, 18 bp, Homo sapiens
tacttaaaaatttattag

SEQ ID NO: 4436415 - DNA, 19 bp, Homo sapiens
tacttaaatatatatttct

SEQ ID NO: 4436416 - DNA, 22 bp, Homo sapiens
tacttaacatttcattgtacaa

SEQ ID NO: 4436417 - DNA, 13 bp, Homo sapiens
tacttaactgttt

SEQ ID NO: 4436418 - DNA, 15 bp, Homo sapiens
tacttaagtgttcat

SEQ ID NO: 4436419 - DNA, 17 bp, Homo sapiens
tacttaagtgttcattt

SEQ ID NO: 4436420 - DNA, 22 bp, Homo sapiens
tacttaagtttgtaagacagtg

SEQ ID NO: 4436421 - DNA, 15 bp, Homo sapiens
tacttaatttactta

SEQ ID NO: 4436422 - DNA, 18 bp, Homo sapiens
tacttaatttacttaagt

SEQ ID NO: 4436423 - DNA, 17 bp, Homo sapiens
tacttagaatgccataa

SEQ ID NO: 4436424 - DNA, 20 bp, Homo sapiens
tacttagaatgccataaaat

SEQ ID NO: 4436425 - DNA, 22 bp, Homo sapiens
tacttagaatgccataaaattg

SEQ ID NO: 4436426 - DNA, 22 bp, Homo sapiens
taatcttataattgttctcaga

SEQ ID NO: 4436427 - DNA, 15 bp, Homo sapiens
taatcttctgccttc

SEQ ID NO: 4436428 - DNA, 19 bp, Homo sapiens
taatcttgttgataaaaat

SEQ ID NO: 4436429 - DNA, 19 bp, Homo sapiens
taatctttcaaaccagctt

SEQ ID NO: 4436430 - DNA, 16 bp, Homo sapiens
taatctttgtgacagg

SEQ ID NO: 4436431 - DNA, 17 bp, Homo sapiens
taatgaaaataaaacac

SEQ ID NO: 4436432 - DNA, 18 bp, Homo sapiens
taatgaaaataaaacaca

SEQ ID NO: 4436433 - DNA, 16 bp, Homo sapiens
taatgaaacaaagagt

SEQ ID NO: 4436434 - DNA, 17 bp, Homo sapiens
taatgaaacaaagagtt

SEQ ID NO: 4436435 - DNA, 22 bp, Homo sapiens
taatgaaagtgatgacatattt

SEQ ID NO: 4436436 - DNA, 18 bp, Homo sapiens
taatgaaatgataaagac

SEQ ID NO: 4436437 - DNA, 22 bp, Homo sapiens
taatgaagaaagtggaaaacaa

SEQ ID NO: 4436438 - DNA, 16 bp, Homo sapiens
taatgaagtattacat

SEQ ID NO: 4436439 - DNA, 13 bp, Homo sapiens
taatgacaacact

SEQ ID NO: 4436440 - DNA, 16 bp, Homo sapiens
taatgacacaccttgg

SEQ ID NO: 4436441 - DNA, 16 bp, Homo sapiens
taatgacatgcctata

SEQ ID NO: 4436442 - DNA, 22 bp, Homo sapiens
taatgaccatgttatattgctt

SEQ ID NO: 4436443 - DNA, 17 bp, Homo sapiens
taatgactctttctgaa

SEQ ID NO: 4436444 - DNA, 14 bp, Homo sapiens
taatgacttagaaa

SEQ ID NO: 4436445 - DNA, 17 bp, Homo sapiens
taatgacttagaaactg

SEQ ID NO: 4436446 - DNA, 23 bp, Homo sapiens
taatgacttttaaaatttgtaga

SEQ ID NO: 4436447 - DNA, 13 bp, Homo sapiens
taatgagaataga

SEQ ID NO: 4436448 - DNA, 19 bp, Homo sapiens
taatgagctattaaaactc

SEQ ID NO: 4436449 - DNA, 15 bp, Homo sapiens
taatgaggaaatgtg

SEQ ID NO: 4436450 - DNA, 19 bp, Homo sapiens
taatgatactgattatgaa

SEQ ID NO: 4436451 - DNA, 20 bp, Homo sapiens
taatgatactgattatgaaa

SEQ ID NO: 4436452 - DNA, 22 bp, Homo sapiens
taatgatactgattatgaaatg

SEQ ID NO: 4436453 - DNA, 23 bp, Homo sapiens
taatgatactgattatgaaatgt

SEQ ID NO: 4436454 - DNA, 16 bp, Homo sapiens
taatgatcaaagtttt

SEQ ID NO: 4436455 - DNA, 16 bp, Homo sapiens
taatgatgaacttata

SEQ ID NO: 4436456 - DNA, 23 bp, Homo sapiens
taatgatgaacttataatgatta

SEQ ID NO: 4436457 - DNA, 18 bp, Homo sapiens
taatgatgtaacagtgca

SEQ ID NO: 4436458 - DNA, 21 bp, Homo sapiens
taatgattaagggacatttct

SEQ ID NO: 4436459 - DNA, 23 bp, Homo sapiens
taatgattcaaatgttttaaagt

SEQ ID NO: 4436460 - DNA, 17 bp, Homo sapiens
taatgcagtatggtaca

SEQ ID NO: 4436461 - DNA, 19 bp, Homo sapiens
taatgccaatgaacatctc

SEQ ID NO: 4436462 - DNA, 15 bp, Homo sapiens
taatgcctgcttttt

SEQ ID NO: 4436463 - DNA, 20 bp, Homo sapiens
taatgcctgctttttggaaa

SEQ ID NO: 4436464 - DNA, 16 bp, Homo sapiens
taatgctgttgcctca

SEQ ID NO: 4436465 - DNA, 19 bp, Homo sapiens
taatgcttgtttatgatat

SEQ ID NO: 4436466 - DNA, 14 bp, Homo sapiens
taatgctttggaaa

SEQ ID NO: 4436467 - DNA, 15 bp, Homo sapiens
taatgctttggaaaa

SEQ ID NO: 4436468 - DNA, 21 bp, Homo sapiens
taatgctttggaaaaatgggt

SEQ ID NO: 4436469 - DNA, 14 bp, Homo sapiens
taatgcttttctaa

SEQ ID NO: 4436470 - DNA, 15 bp, Homo sapiens
taatgcttttctaat

SEQ ID NO: 4436471 - DNA, 20 bp, Homo sapiens
taatggaagtgtatttattt

SEQ ID NO: 4436472 - DNA, 18 bp, Homo sapiens
taatggatcatagaattg

SEQ ID NO: 4436473 - DNA, 17 bp, Homo sapiens
taatgggtatattgata

SEQ ID NO: 4436474 - DNA, 15 bp, Homo sapiens
taatggttgtacata

SEQ ID NO: 4436475 - DNA, 15 bp, Homo sapiens
taatgtaaataaact

SEQ ID NO: 4436476 - DNA, 20 bp, Homo sapiens
taatgtaaataaactattta

SEQ ID NO: 4436477 - DNA, 20 bp, Homo sapiens
taatgtaataaagtgaactt

SEQ ID NO: 4436478 - DNA, 18 bp, Homo sapiens
taatgtactgaattcttt

SEQ ID NO: 4436479 - DNA, 15 bp, Homo sapiens
taatgtacttgaaaa

SEQ ID NO: 4436480 - DNA, 22 bp, Homo sapiens
taatgtagggttatatttggga

SEQ ID NO: 4436481 - DNA, 16 bp, Homo sapiens
taatgtatataaaaat

SEQ ID NO: 4436482 - DNA, 16 bp, Homo sapiens
taatgtatgttaccaa

SEQ ID NO: 4436483 - DNA, 17 bp, Homo sapiens
taatgtatttgaaaatt

SEQ ID NO: 4436484 - DNA, 15 bp, Homo sapiens
taatgtcaccacctt

SEQ ID NO: 4436485 - DNA, 22 bp, Homo sapiens
taatgtcaccaccttcccagct

SEQ ID NO: 4436486 - DNA, 21 bp, Homo sapiens
taatgtctcactttactttca

SEQ ID NO: 4436487 - DNA, 22 bp, Homo sapiens
taatgtctcactttactttcaa

SEQ ID NO: 4436488 - DNA, 14 bp, Homo sapiens
taatgtgaaatgta

SEQ ID NO: 4436489 - DNA, 13 bp, Homo sapiens
taatgtgcccaaa

SEQ ID NO: 4436490 - DNA, 11 bp, Homo sapiens
taatgtgctct

SEQ ID NO: 4436491 - DNA, 14 bp, Homo sapiens
taatgtgtctgtgt

SEQ ID NO: 4436492 - DNA, 17 bp, Homo sapiens
taatgttacatagtaaa

SEQ ID NO: 4436493 - DNA, 20 bp, Homo sapiens
taatgttcattttgaaaata

SEQ ID NO: 4436494 - DNA, 20 bp, Homo sapiens
taatgttgattttaatcctg

SEQ ID NO: 4436495 - DNA, 22 bp, Homo sapiens
taattaaaaaaaatccttgtga

SEQ ID NO: 4436496 - DNA, 15 bp, Homo sapiens
taattaaaaacttta

SEQ ID NO: 4436497 - DNA, 17 bp, Homo sapiens
taattaaaaactttaaa

SEQ ID NO: 4436498 - DNA, 18 bp, Homo sapiens
taattaaaagcaaatcat

SEQ ID NO: 4436499 - DNA, 16 bp, Homo sapiens
taattaaaattgtgca

SEQ ID NO: 4436500 - DNA, 18 bp, Homo sapiens
taattaaaattgtgcata

SEQ ID NO: 4436501 - DNA, 18 bp, Homo sapiens
taattaaactagtttaag

SEQ ID NO: 4436502 - DNA, 15 bp, Homo sapiens
taattaaactgttaa

SEQ ID NO: 4436503 - DNA, 16 bp, Homo sapiens
taattaaatatttctt

SEQ ID NO: 4436504 - DNA, 19 bp, Homo sapiens
taattaaatatttcttaag

SEQ ID NO: 4436505 - DNA, 16 bp, Homo sapiens
taattaactgtaaact

SEQ ID NO: 4436506 - DNA, 14 bp, Homo sapiens
taattaagaaaact

SEQ ID NO: 4436507 - DNA, 16 bp, Homo sapiens
taattaagcagaaaca

SEQ ID NO: 4436508 - DNA, 19 bp, Homo sapiens
taattaagcagaaacagca

SEQ ID NO: 4436509 - DNA, 16 bp, Homo sapiens
taattaaggtacatca

SEQ ID NO: 4436510 - DNA, 17 bp, Homo sapiens
taattaatatattaaaa

SEQ ID NO: 4436511 - DNA, 15 bp, Homo sapiens
taattaatttggagc

SEQ ID NO: 4436512 - DNA, 16 bp, Homo sapiens
taattaccaacctgtt

SEQ ID NO: 4436513 - DNA, 21 bp, Homo sapiens
taattaccaacctgttaccta

SEQ ID NO: 4436514 - DNA, 15 bp, Homo sapiens
taattaccagttttc

SEQ ID NO: 4436515 - DNA, 13 bp, Homo sapiens
taattactggaat

SEQ ID NO: 4436516 - DNA, 13 bp, Homo sapiens
taattacttaaaa

SEQ ID NO: 4436517 - DNA, 18 bp, Homo sapiens
taattagatccattaatt

SEQ ID NO: 4436518 - DNA, 11 bp, Homo sapiens
taattaggaat

SEQ ID NO: 4436519 - DNA, 18 bp, Homo sapiens
taattaggaattacttta

SEQ ID NO: 4436520 - DNA, 14 bp, Homo sapiens
taattagtgccact

SEQ ID NO: 4436521 - DNA, 15 bp, Homo sapiens
taattataatctctt

SEQ ID NO: 4436522 - DNA, 16 bp, Homo sapiens
taattatataactgta

SEQ ID NO: 4436523 - DNA, 21 bp, Homo sapiens
taattatgccttttttgatca

SEQ ID NO: 4436524 - DNA, 22 bp, Homo sapiens
taattatgggaataattgcttt

SEQ ID NO: 4436525 - DNA, 15 bp, Homo sapiens
taattattataaaaa

SEQ ID NO: 4436526 - DNA, 16 bp, Homo sapiens
taattattataaaaat

SEQ ID NO: 4436527 - DNA, 16 bp, Homo sapiens
taattattgatgtttt

SEQ ID NO: 4436528 - DNA, 12 bp, Homo sapiens
taattatttcta

SEQ ID NO: 4436529 - DNA, 14 bp, Homo sapiens
taattcaagaaatg

SEQ ID NO: 4436530 - DNA, 19 bp, Homo sapiens
taattcaagaaatgacagt

SEQ ID NO: 4436531 - DNA, 20 bp, Homo sapiens
taattcaagcctctaaacag

SEQ ID NO: 4436532 - DNA, 19 bp, Homo sapiens
taattcaattcaaagctgt

SEQ ID NO: 4436533 - DNA, 21 bp, Homo sapiens
taattcacagtgctcttttct

SEQ ID NO: 4436534 - DNA, 12 bp, Homo sapiens
taattcagcact

SEQ ID NO: 4436535 - DNA, 19 bp, Homo sapiens
taattcaggcatattttaa

SEQ ID NO: 4436536 - DNA, 17 bp, Homo sapiens
taattcaggtttttcct

SEQ ID NO: 4436537 - DNA, 19 bp, Homo sapiens
taattcaggtttttccttt

SEQ ID NO: 4436538 - DNA, 19 bp, Homo sapiens
taattcatatctaaatagt

SEQ ID NO: 4436539 - DNA, 17 bp, Homo sapiens
taattccacacctttta

SEQ ID NO: 4436540 - DNA, 13 bp, Homo sapiens
taattcctacagc

SEQ ID NO: 4436541 - DNA, 21 bp, Homo sapiens
taattcctacagcactactgg

SEQ ID NO: 4436542 - DNA, 13 bp, Homo sapiens
taattctaccctg

SEQ ID NO: 4436543 - DNA, 13 bp, Homo sapiens
taattctgaaaca

SEQ ID NO: 4436544 - DNA, 14 bp, Homo sapiens
taattctgaaacaa

SEQ ID NO: 4436545 - DNA, 17 bp, Homo sapiens
taattctgagttttgtg

SEQ ID NO: 4436546 - DNA, 13 bp, Homo sapiens
taattcttaaaac

SEQ ID NO: 4436547 - DNA, 14 bp, Homo sapiens
taattcttaaaact

SEQ ID NO: 4436548 - DNA, 16 bp, Homo sapiens
taattcttaaaactat

SEQ ID NO: 4436549 - DNA, 18 bp, Homo sapiens
taattcttaaaactataa

SEQ ID NO: 4436550 - DNA, 19 bp, Homo sapiens
taattctttgacctgttgg

SEQ ID NO: 4436551 - DNA, 23 bp, Homo sapiens
taattgaaaagaagtagtgtctg

SEQ ID NO: 4436552 - DNA, 23 bp, Homo sapiens
taattgatcagatgctgaattga

SEQ ID NO: 4436553 - DNA, 13 bp, Homo sapiens
taattgctttgaa

SEQ ID NO: 4436554 - DNA, 15 bp, Homo sapiens
taattgctttgaagc

SEQ ID NO: 4436555 - DNA, 16 bp, Homo sapiens
taattggatttcctaa

SEQ ID NO: 4436556 - DNA, 22 bp, Homo sapiens
taattggttattaaactgaata

SEQ ID NO: 4436557 - DNA, 14 bp, Homo sapiens
taattgtaaactgt

SEQ ID NO: 4436558 - DNA, 15 bp, Homo sapiens
taattgtaaactgta

SEQ ID NO: 4436559 - DNA, 22 bp, Homo sapiens
taattgtaaagtaaaagctata

SEQ ID NO: 4436560 - DNA, 20 bp, Homo sapiens
taattgtaattccaaaatcc

SEQ ID NO: 4436561 - DNA, 16 bp, Homo sapiens
taattgtacaagcagt

SEQ ID NO: 4436562 - DNA, 14 bp, Homo sapiens
taattgtgtggatt

SEQ ID NO: 4436563 - DNA, 13 bp, Homo sapiens
taattgtgtttat

SEQ ID NO: 4436564 - DNA, 20 bp, Homo sapiens
taattgttgaacaggtgttt

SEQ ID NO: 4436565 - DNA, 20 bp, Homo sapiens
taatttaaaaatctccatta

SEQ ID NO: 4436566 - DNA, 16 bp, Homo sapiens
taatttaaaattgtga

SEQ ID NO: 4436567 - DNA, 18 bp, Homo sapiens
taatttaaatgatttaaa

SEQ ID NO: 4436568 - DNA, 19 bp, Homo sapiens
taatttaactttctgggtt

SEQ ID NO: 4436569 - DNA, 17 bp, Homo sapiens
taatttaataaaaagga

SEQ ID NO: 4436570 - DNA, 15 bp, Homo sapiens
taatttaatgtaaat

SEQ ID NO: 4436571 - DNA, 17 bp, Homo sapiens
taatttaatgtaaataa

SEQ ID NO: 4436572 - DNA, 16 bp, Homo sapiens
taatttaattgctttg

SEQ ID NO: 4436573 - DNA, 17 bp, Homo sapiens
taatttaattgctttga

SEQ ID NO: 4436574 - DNA, 21 bp, Homo sapiens
taatttacctaagattacaaa

SEQ ID NO: 4436575 - DNA, 20 bp, Homo sapiens
taatttactggacaaagaat

SEQ ID NO: 4436576 - DNA, 21 bp, Homo sapiens
taatttacttaagtgttcatt

SEQ ID NO: 4436577 - DNA, 18 bp, Homo sapiens
taatttactttgtagact

SEQ ID NO: 4436578 - DNA, 14 bp, Homo sapiens
taatttagaaatca

SEQ ID NO: 4436579 - DNA, 14 bp, Homo sapiens
taatttagagcgtt

SEQ ID NO: 4436580 - DNA, 15 bp, Homo sapiens
taatttagtaaatgt

SEQ ID NO: 4436581 - DNA, 20 bp, Homo sapiens
taatttagtaaatgttatct

SEQ ID NO: 4436582 - DNA, 17 bp, Homo sapiens
taatttagttgtttcta

SEQ ID NO: 4436583 - DNA, 16 bp, Homo sapiens
taatttagtttcatat

SEQ ID NO: 4436584 - DNA, 16 bp, Homo sapiens
taatttataaaaaggt

SEQ ID NO: 4436585 - DNA, 14 bp, Homo sapiens
taatttataatgta

SEQ ID NO: 4436586 - DNA, 15 bp, Homo sapiens
taatttataatgtat

SEQ ID NO: 4436587 - DNA, 18 bp, Homo sapiens
taatttataatgtatttg

SEQ ID NO: 4436588 - DNA, 13 bp, Homo sapiens
taatttatacttt

SEQ ID NO: 4436589 - DNA, 12 bp, Homo sapiens
taatttatagta

SEQ ID NO: 4436590 - DNA, 11 bp, Homo sapiens
taatttattgg

SEQ ID NO: 4436591 - DNA, 12 bp, Homo sapiens
taatttcaaaat

SEQ ID NO: 4436592 - DNA, 15 bp, Homo sapiens
taatttcaaaatgct

SEQ ID NO: 4436593 - DNA, 21 bp, Homo sapiens
taatttcaggaaaatgtattg

SEQ ID NO: 4436594 - DNA, 11 bp, Homo sapiens
taatttcagtg

SEQ ID NO: 4436595 - DNA, 13 bp, Homo sapiens
taatttcatttaa

SEQ ID NO: 4436596 - DNA, 14 bp, Homo sapiens
taatttcatttaaa

SEQ ID NO: 4436597 - DNA, 17 bp, Homo sapiens
taatttcgccttaaact

SEQ ID NO: 4436598 - DNA, 19 bp, Homo sapiens
taatttctcctcccttcct

SEQ ID NO: 4436599 - DNA, 18 bp, Homo sapiens
taatttctttaaatgtgt

SEQ ID NO: 4436600 - DNA, 13 bp, Homo sapiens
taatttgaaatct

SEQ ID NO: 4436601 - DNA, 20 bp, Homo sapiens
taatttgaaggtagaatgtt

SEQ ID NO: 4436602 - DNA, 18 bp, Homo sapiens
taatttgaatgagttttt

SEQ ID NO: 4436603 - DNA, 15 bp, Homo sapiens
taatttgagagaaat

SEQ ID NO: 4436604 - DNA, 17 bp, Homo sapiens
taatttgatgaggtatt

SEQ ID NO: 4436605 - DNA, 17 bp, Homo sapiens
taatttggagcacaaaa

SEQ ID NO: 4436606 - DNA, 19 bp, Homo sapiens
taatttggtagatgacaaa

SEQ ID NO: 4436607 - DNA, 13 bp, Homo sapiens
taatttgtgtaat

SEQ ID NO: 4436608 - DNA, 22 bp, Homo sapiens
taatttgttggggctttacata

SEQ ID NO: 4436609 - DNA, 12 bp, Homo sapiens
taatttgtttcc

SEQ ID NO: 4436610 - DNA, 13 bp, Homo sapiens
taattttaaagag

SEQ ID NO: 4436611 - DNA, 12 bp, Homo sapiens
taattttaactg

SEQ ID NO: 4436612 - DNA, 14 bp, Homo sapiens
taattttaactgat

SEQ ID NO: 4436613 - DNA, 14 bp, Homo sapiens
taattttagttttt

SEQ ID NO: 4436614 - DNA, 21 bp, Homo sapiens
taattttagtttttcattaaa

SEQ ID NO: 4436615 - DNA, 16 bp, Homo sapiens
taattttattcaagaa

SEQ ID NO: 4436616 - DNA, 18 bp, Homo sapiens
taattttattttaaaatt

SEQ ID NO: 4436617 - DNA, 10 bp, Homo sapiens
taattttcag

SEQ ID NO: 4436618 - DNA, 20 bp, Homo sapiens
taattttcttggttctttca

SEQ ID NO: 4436619 - DNA, 11 bp, Homo sapiens
taattttgaat

SEQ ID NO: 4436620 - DNA, 13 bp, Homo sapiens
taattttggattt

SEQ ID NO: 4436621 - DNA, 17 bp, Homo sapiens
taatttttatactgaca

SEQ ID NO: 4436622 - DNA, 22 bp, Homo sapiens
taatttttattaattttagttt

SEQ ID NO: 4436623 - DNA, 13 bp, Homo sapiens
taatttttccaac

SEQ ID NO: 4436624 - DNA, 14 bp, Homo sapiens
taatttttccaact

SEQ ID NO: 4436625 - DNA, 23 bp, Homo sapiens
taatttttgatactaagcattga

SEQ ID NO: 4436626 - DNA, 14 bp, Homo sapiens
taatttttgtaatt

SEQ ID NO: 4436627 - DNA, 15 bp, Homo sapiens
taattttttggtaca

SEQ ID NO: 4436628 - DNA, 21 bp, Homo sapiens
taatttttttcacctagattt

SEQ ID NO: 4436629 - DNA, 14 bp, Homo sapiens
taattttttttcct

SEQ ID NO: 4436630 - DNA, 21 bp, Homo sapiens
tacaaaaaaaaaaaaaaatta

SEQ ID NO: 4436631 - DNA, 15 bp, Homo sapiens
tacaaaaaaacacgt

SEQ ID NO: 4436632 - DNA, 13 bp, Homo sapiens
tacaaaaaaatta

SEQ ID NO: 4436633 - DNA, 18 bp, Homo sapiens
tacaaaaacatacttcaa

SEQ ID NO: 4436634 - DNA, 22 bp, Homo sapiens
tacaaaaataaatttatatgaa

SEQ ID NO: 4436635 - DNA, 16 bp, Homo sapiens
tacaaaagagcatgga

SEQ ID NO: 4436636 - DNA, 12 bp, Homo sapiens
tacaaaatattt

SEQ ID NO: 4436637 - DNA, 19 bp, Homo sapiens
tacaaaatatttaagtgaa

SEQ ID NO: 4436638 - DNA, 16 bp, Homo sapiens
tacaaaatttattctc

SEQ ID NO: 4436639 - DNA, 15 bp, Homo sapiens
tacaaacagtatttc

SEQ ID NO: 4436640 - DNA, 11 bp, Homo sapiens
tacaaacatga

SEQ ID NO: 4436641 - DNA, 12 bp, Homo sapiens
tacaaacatgaa

SEQ ID NO: 4436642 - DNA, 13 bp, Homo sapiens
tacaaacatgaaa

SEQ ID NO: 4436643 - DNA, 19 bp, Homo sapiens
tacaaaccattacctgtac

SEQ ID NO: 4436644 - DNA, 12 bp, Homo sapiens
tacaaactctca

SEQ ID NO: 4436645 - DNA, 14 bp, Homo sapiens
tacaaactctcacc

SEQ ID NO: 4436646 - DNA, 12 bp, Homo sapiens
tacaaactttta

SEQ ID NO: 4436647 - DNA, 19 bp, Homo sapiens
tacaaacttttaagatttc

SEQ ID NO: 4436648 - DNA, 16 bp, Homo sapiens
tacaaagaaaaattaa

SEQ ID NO: 4436649 - DNA, 20 bp, Homo sapiens
tacaaagagatgcttggagc

SEQ ID NO: 4436650 - DNA, 16 bp, Homo sapiens
tacaaagcgtgcacaa

SEQ ID NO: 4436651 - DNA, 17 bp, Homo sapiens
tacaaagcgtgcacaag

SEQ ID NO: 4436652 - DNA, 14 bp, Homo sapiens
tacaaattctactt

SEQ ID NO: 4436653 - DNA, 20 bp, Homo sapiens
tacaaattggctttcaagtg

SEQ ID NO: 4436654 - DNA, 17 bp, Homo sapiens
tacaaatttataaaggt

SEQ ID NO: 4436655 - DNA, 20 bp, Homo sapiens
tacaaatttataaaggtctg

SEQ ID NO: 4436656 - DNA, 23 bp, Homo sapiens
tacaacagaaaccagaaaagcaa

SEQ ID NO: 4436657 - DNA, 14 bp, Homo sapiens
tacaaccatatatt

SEQ ID NO: 4436658 - DNA, 13 bp, Homo sapiens
tacaaccctgacc

SEQ ID NO: 4436659 - DNA, 18 bp, Homo sapiens
tacaactcattccagatc

SEQ ID NO: 4436660 - DNA, 18 bp, Homo sapiens
tacaactgtatttattaa

SEQ ID NO: 4436661 - DNA, 18 bp, Homo sapiens
tacaacttaaataataaa

SEQ ID NO: 4436662 - DNA, 22 bp, Homo sapiens
tacaacttctccttagacactt

SEQ ID NO: 4436663 - DNA, 19 bp, Homo sapiens
tacaagaagcattttgtaa

SEQ ID NO: 4436664 - DNA, 21 bp, Homo sapiens
tacaagaagcattttgtaagt

SEQ ID NO: 4436665 - DNA, 16 bp, Homo sapiens
tacaagagcagcctgt

SEQ ID NO: 4436666 - DNA, 20 bp, Homo sapiens
tacaagagcagcctgtggca

SEQ ID NO: 4436667 - DNA, 15 bp, Homo sapiens
tacaagcaagcaaaa

SEQ ID NO: 4436668 - DNA, 20 bp, Homo sapiens
tacaagcttaaagcttgatt

SEQ ID NO: 4436669 - DNA, 21 bp, Homo sapiens
tacaaggcccagaagcctgat

SEQ ID NO: 4436670 - DNA, 22 bp, Homo sapiens
tacaaggccccaaggtttacat

SEQ ID NO: 4436671 - DNA, 22 bp, Homo sapiens
tacaagggagaagacaacagaa

SEQ ID NO: 4436672 - DNA, 20 bp, Homo sapiens
tacaaggtaggctgcaaaat

SEQ ID NO: 4436673 - DNA, 19 bp, Homo sapiens
tacaagtaatgtaaagatg

SEQ ID NO: 4436674 - DNA, 18 bp, Homo sapiens
tacaagtactggtaagat

SEQ ID NO: 4436675 - DNA, 18 bp, Homo sapiens
tacaagtcagtttctaca

SEQ ID NO: 4436676 - DNA, 18 bp, Homo sapiens
tacaagtcatggtcacag

SEQ ID NO: 4436677 - DNA, 14 bp, Homo sapiens
tacaagttgagtat

SEQ ID NO: 4436678 - DNA, 23 bp, Homo sapiens
tacaagttttttaggattctttt

SEQ ID NO: 4436679 - DNA, 21 bp, Homo sapiens
tacaataaaacaaataaatat

SEQ ID NO: 4436680 - DNA, 23 bp, Homo sapiens
tacaataaaacaaataaatatga

SEQ ID NO: 4436681 - DNA, 21 bp, Homo sapiens
tacaataaaccctccttggtg

SEQ ID NO: 4436682 - DNA, 14 bp, Homo sapiens
tacaataaattgct

SEQ ID NO: 4436683 - DNA, 16 bp, Homo sapiens
tacaataaattgctaa

SEQ ID NO: 4436684 - DNA, 22 bp, Homo sapiens
tacaataaattgctaatgttgc

SEQ ID NO: 4436685 - DNA, 22 bp, Homo sapiens
tacaatagtatacattttataa

SEQ ID NO: 4436686 - DNA, 23 bp, Homo sapiens
tacaatatatagctggcaagaat

SEQ ID NO: 4436687 - DNA, 20 bp, Homo sapiens
tacaatcaaaggaaaatagt

SEQ ID NO: 4436688 - DNA, 20 bp, Homo sapiens
tacaatgatgtataattaat

SEQ ID NO: 4436689 - DNA, 14 bp, Homo sapiens
tacaatggaataaa

SEQ ID NO: 4436690 - DNA, 14 bp, Homo sapiens
tacaatgtacaatt

SEQ ID NO: 4436691 - DNA, 22 bp, Homo sapiens
tacaatgtacaattatgtctct

SEQ ID NO: 4436692 - DNA, 20 bp, Homo sapiens
tacaatgtatctttattaaa

SEQ ID NO: 4436693 - DNA, 17 bp, Homo sapiens
tacaatgtatgtacaat

SEQ ID NO: 4436694 - DNA, 13 bp, Homo sapiens
tacaatgtgtttt

SEQ ID NO: 4436695 - DNA, 21 bp, Homo sapiens
tacaatgtgtttttctccagt

SEQ ID NO: 4436696 - DNA, 14 bp, Homo sapiens
tacaattatgtctc

SEQ ID NO: 4436697 - DNA, 16 bp, Homo sapiens
tacaattatgtctctt

SEQ ID NO: 4436698 - DNA, 21 bp, Homo sapiens
tacaatttgtttttgcatttt

SEQ ID NO: 4436699 - DNA, 14 bp, Homo sapiens
tacaattttaaagt

SEQ ID NO: 4436700 - DNA, 22 bp, Homo sapiens
tacaattttaaagttcttattt

SEQ ID NO: 4436701 - DNA, 18 bp, Homo sapiens
tacaattttatctgtttc

SEQ ID NO: 4436702 - DNA, 13 bp, Homo sapiens
tacaatttttatt

SEQ ID NO: 4436703 - DNA, 21 bp, Homo sapiens
tacacaaagctttcttttcta

SEQ ID NO: 4436704 - DNA, 21 bp, Homo sapiens
tacacaactatggaatagatt

SEQ ID NO: 4436705 - DNA, 14 bp, Homo sapiens
tacacaatacagta

SEQ ID NO: 4436706 - DNA, 21 bp, Homo sapiens
tacacaatggtttttaaattt

SEQ ID NO: 4436707 - DNA, 17 bp, Homo sapiens
tacacacggtgccttta

SEQ ID NO: 4436708 - DNA, 16 bp, Homo sapiens
tacacactcaaatcaa

SEQ ID NO: 4436709 - DNA, 18 bp, Homo sapiens
tacacactggtacttaga

SEQ ID NO: 4436710 - DNA, 16 bp, Homo sapiens
tacacagtaattgtga

SEQ ID NO: 4436711 - DNA, 19 bp, Homo sapiens
tacacagtacttcctccca

SEQ ID NO: 4436712 - DNA, 17 bp, Homo sapiens
tacacagtgagactgta

SEQ ID NO: 4436713 - DNA, 19 bp, Homo sapiens
tacacagtgagactgtaca

SEQ ID NO: 4436714 - DNA, 13 bp, Homo sapiens
tacacagttaaat

SEQ ID NO: 4436715 - DNA, 23 bp, Homo sapiens
tacacatagcatgtaatggtatc

SEQ ID NO: 4436716 - DNA, 16 bp, Homo sapiens
tacacatggtaacatt

SEQ ID NO: 4436717 - DNA, 14 bp, Homo sapiens
tacacatgtgttat

SEQ ID NO: 4436718 - DNA, 17 bp, Homo sapiens
tacacattagaaatatt

SEQ ID NO: 4436719 - DNA, 16 bp, Homo sapiens
tacacattcttgcttg

SEQ ID NO: 4436720 - DNA, 22 bp, Homo sapiens
tacacattgctacctcagtgct

SEQ ID NO: 4436721 - DNA, 12 bp, Homo sapiens
tacacatttctt

SEQ ID NO: 4436722 - DNA, 13 bp, Homo sapiens
tacacatttctta

SEQ ID NO: 4436723 - DNA, 17 bp, Homo sapiens
tacacatttcttaaaac

SEQ ID NO: 4436724 - DNA, 17 bp, Homo sapiens
tacacatttttcagata

SEQ ID NO: 4436725 - DNA, 19 bp, Homo sapiens
tacacatttttcagatata

SEQ ID NO: 4436726 - DNA, 21 bp, Homo sapiens
tacacatttttcagatataaa

SEQ ID NO: 4436727 - DNA, 14 bp, Homo sapiens
tacaccaatgaaaa

SEQ ID NO: 4436728 - DNA, 22 bp, Homo sapiens
tacaccaatttggtaaaaatgc

SEQ ID NO: 4436729 - DNA, 24 bp, Homo sapiens
tacaccatgtttgagctcagaccc

SEQ ID NO: 4436730 - DNA, 16 bp, Homo sapiens
tacacccttttccagc

SEQ ID NO: 4436731 - DNA, 14 bp, Homo sapiens
tacacctccccctg

SEQ ID NO: 4436732 - DNA, 12 bp, Homo sapiens
tacacctggctg

SEQ ID NO: 4436733 - DNA, 14 bp, Homo sapiens
tacacctggctgag

SEQ ID NO: 4436734 - DNA, 15 bp, Homo sapiens
tacacctggctgagg

SEQ ID NO: 4436735 - DNA, 23 bp, Homo sapiens
tacacgtatttgaatggccttca

SEQ ID NO: 4436736 - DNA, 14 bp, Homo sapiens
tacacgtgcctgta

SEQ ID NO: 4436737 - DNA, 18 bp, Homo sapiens
tacactacgcactggaca

SEQ ID NO: 4436738 - DNA, 20 bp, Homo sapiens
tacactacgcactggacagc

SEQ ID NO: 4436739 - DNA, 18 bp, Homo sapiens
tacactcagccactgtca

SEQ ID NO: 4436740 - DNA, 23 bp, Homo sapiens
tacactcagccactgtcacaggc

SEQ ID NO: 4436741 - DNA, 14 bp, Homo sapiens
tacactctcctggg

SEQ ID NO: 4436742 - DNA, 22 bp, Homo sapiens
tacactctcctgggcccctccc

SEQ ID NO: 4436743 - DNA, 16 bp, Homo sapiens
tacactgcactttgtt

SEQ ID NO: 4436744 - DNA, 17 bp, Homo sapiens
tacactgcactttgttt

SEQ ID NO: 4436745 - DNA, 23 bp, Homo sapiens
tacactgcactttgtttagaaaa

SEQ ID NO: 4436746 - DNA, 16 bp, Homo sapiens
tacactgttagaacac

SEQ ID NO: 4436747 - DNA, 18 bp, Homo sapiens
tacactgttagaacacta

SEQ ID NO: 4436748 - DNA, 19 bp, Homo sapiens
tacactgttagaacactat

SEQ ID NO: 4436749 - DNA, 20 bp, Homo sapiens
tacactgttagaacactatt

SEQ ID NO: 4436750 - DNA, 23 bp, Homo sapiens
tacactgttagaacactattttc

SEQ ID NO: 4436751 - DNA, 22 bp, Homo sapiens
tacactttgttgcaagatgtga

SEQ ID NO: 4436752 - DNA, 19 bp, Homo sapiens
tacagaaaaacaatggtaa

SEQ ID NO: 4436753 - DNA, 14 bp, Homo sapiens
tacagaaagctgcc

SEQ ID NO: 4436754 - DNA, 16 bp, Homo sapiens
tacagaaatatccatg

SEQ ID NO: 4436755 - DNA, 16 bp, Homo sapiens
tacagaactctttcaa

SEQ ID NO: 4436756 - DNA, 19 bp, Homo sapiens
tacagaactctttcaaaac

SEQ ID NO: 4436757 - DNA, 15 bp, Homo sapiens
tacagaattggatac

SEQ ID NO: 4436758 - DNA, 14 bp, Homo sapiens
tacagaatttgaat

SEQ ID NO: 4436759 - DNA, 14 bp, Homo sapiens
tacagacaaggagg

SEQ ID NO: 4436760 - DNA, 15 bp, Homo sapiens
tacagacatatttaa

SEQ ID NO: 4436761 - DNA, 20 bp, Homo sapiens
tacagacatggagatgtaaa

SEQ ID NO: 4436762 - DNA, 22 bp, Homo sapiens
tacagacatggagatgtaaaat

SEQ ID NO: 4436763 - DNA, 23 bp, Homo sapiens
tacagactccatctcttctgcaa

SEQ ID NO: 4436764 - DNA, 15 bp, Homo sapiens
tacagagcttccctg

SEQ ID NO: 4436765 - DNA, 18 bp, Homo sapiens
tacagaggacagtatttg

SEQ ID NO: 4436766 - DNA, 16 bp, Homo sapiens
tacagatccccagccc

SEQ ID NO: 4436767 - DNA, 19 bp, Homo sapiens
tacagatccccagcccctc

SEQ ID NO: 4436768 - DNA, 22 bp, Homo sapiens
tacagcaacaatttatgaattg

SEQ ID NO: 4436769 - DNA, 17 bp, Homo sapiens
tacagcactactctgtg

SEQ ID NO: 4436770 - DNA, 22 bp, Homo sapiens
tacagcactactgggtgtcatt

SEQ ID NO: 4436771 - DNA, 20 bp, Homo sapiens
tacagccctaagtggctgcc

SEQ ID NO: 4436772 - DNA, 16 bp, Homo sapiens
tacagcggctcccctc

SEQ ID NO: 4436773 - DNA, 15 bp, Homo sapiens
tacagctactttaac

SEQ ID NO: 4436774 - DNA, 23 bp, Homo sapiens
tacagctatatttgattatgtat

SEQ ID NO: 4436775 - DNA, 18 bp, Homo sapiens
tacagctcattaaacttt

SEQ ID NO: 4436776 - DNA, 18 bp, Homo sapiens
tacagctttcatgattag

SEQ ID NO: 4436777 - DNA, 14 bp, Homo sapiens
tacagcttttatgg

SEQ ID NO: 4436778 - DNA, 15 bp, Homo sapiens
tacagcttttatgga

SEQ ID NO: 4436779 - DNA, 19 bp, Homo sapiens
tacagcttttatggatgat

SEQ ID NO: 4436780 - DNA, 21 bp, Homo sapiens
tacaggaaacagttgcatgta

SEQ ID NO: 4436781 - DNA, 21 bp, Homo sapiens
tacaggaagcaccccatgcca

SEQ ID NO: 4436782 - DNA, 23 bp, Homo sapiens
tacaggatttgaactcagatctg

SEQ ID NO: 4436783 - DNA, 17 bp, Homo sapiens
tacaggctgggaagtgt

SEQ ID NO: 4436784 - DNA, 15 bp, Homo sapiens
tacagggaggctccc

SEQ ID NO: 4436785 - DNA, 20 bp, Homo sapiens
tacaggggtagtttgtttta

SEQ ID NO: 4436786 - DNA, 23 bp, Homo sapiens
tacaggtgtgaaccactgtgccc

SEQ ID NO: 4436787 - DNA, 20 bp, Homo sapiens
tacagtaaaattaagtgtgt

SEQ ID NO: 4436788 - DNA, 17 bp, Homo sapiens
taacctcttcagaggcc

SEQ ID NO: 4436789 - DNA, 21 bp, Homo sapiens
taacctgttatttctatgaaa

SEQ ID NO: 4436790 - DNA, 14 bp, Homo sapiens
taaccttgaaatgg

SEQ ID NO: 4436791 - DNA, 14 bp, Homo sapiens
taacctttaaaaat

SEQ ID NO: 4436792 - DNA, 18 bp, Homo sapiens
taacctttaaaaatgtat

SEQ ID NO: 4436793 - DNA, 18 bp, Homo sapiens
taacctttctaaccttca

SEQ ID NO: 4436794 - DNA, 19 bp, Homo sapiens
taacctttctaaccttcac

SEQ ID NO: 4436795 - DNA, 19 bp, Homo sapiens
taacgtgctcactgtgtat

SEQ ID NO: 4436796 - DNA, 20 bp, Homo sapiens
taacgtgctcactgtgtata

SEQ ID NO: 4436797 - DNA, 21 bp, Homo sapiens
taacgttctataaatgaatgt

SEQ ID NO: 4436798 - DNA, 16 bp, Homo sapiens
taactaaaatgtatct

SEQ ID NO: 4436799 - DNA, 12 bp, Homo sapiens
taactaaatgct

SEQ ID NO: 4436800 - DNA, 15 bp, Homo sapiens
taactaaatgctcat

SEQ ID NO: 4436801 - DNA, 16 bp, Homo sapiens
taactaaatgctcata

SEQ ID NO: 4436802 - DNA, 15 bp, Homo sapiens
taactaactggcagg

SEQ ID NO: 4436803 - DNA, 18 bp, Homo sapiens
taactacccttaattact

SEQ ID NO: 4436804 - DNA, 23 bp, Homo sapiens
taactactttataactaacatgt

SEQ ID NO: 4436805 - DNA, 16 bp, Homo sapiens
taactatcaatattta

SEQ ID NO: 4436806 - DNA, 21 bp, Homo sapiens
taactattgcatttatatgta

SEQ ID NO: 4436807 - DNA, 16 bp, Homo sapiens
taactatttttttcaa

SEQ ID NO: 4436808 - DNA, 16 bp, Homo sapiens
taactccaccaaccca

SEQ ID NO: 4436809 - DNA, 22 bp, Homo sapiens
taactccaccaacccatcagaa

SEQ ID NO: 4436810 - DNA, 22 bp, Homo sapiens
taactctgcatagacaaaggcc

SEQ ID NO: 4436811 - DNA, 11 bp, Homo sapiens
taactctggga

SEQ ID NO: 4436812 - DNA, 17 bp, Homo sapiens
taactctttgaaactgt

SEQ ID NO: 4436813 - DNA, 14 bp, Homo sapiens
taactgaaaatgtg

SEQ ID NO: 4436814 - DNA, 21 bp, Homo sapiens
taactgaaaatgtgctatact

SEQ ID NO: 4436815 - DNA, 15 bp, Homo sapiens
taactgaaggagaag

SEQ ID NO: 4436816 - DNA, 17 bp, Homo sapiens
taactgacaagccatct

SEQ ID NO: 4436817 - DNA, 16 bp, Homo sapiens
taactgactctgttat

SEQ ID NO: 4436818 - DNA, 17 bp, Homo sapiens
taactgagatattattt

SEQ ID NO: 4436819 - DNA, 21 bp, Homo sapiens
taactgagatattattttaaa

SEQ ID NO: 4436820 - DNA, 16 bp, Homo sapiens
taactgatttaacact

SEQ ID NO: 4436821 - DNA, 19 bp, Homo sapiens
taactgatttaacactttt

SEQ ID NO: 4436822 - DNA, 17 bp, Homo sapiens
taactgatttctatggc

SEQ ID NO: 4436823 - DNA, 14 bp, Homo sapiens
taactgcatacact

SEQ ID NO: 4436824 - DNA, 20 bp, Homo sapiens
taactgctttctgttccaaa

SEQ ID NO: 4436825 - DNA, 14 bp, Homo sapiens
taactggaaacaaa

SEQ ID NO: 4436826 - DNA, 19 bp, Homo sapiens
taactggaacaaattattt

SEQ ID NO: 4436827 - DNA, 17 bp, Homo sapiens
taactgggtaatgaaac

SEQ ID NO: 4436828 - DNA, 20 bp, Homo sapiens
taactggtgcactttgtaaa

SEQ ID NO: 4436829 - DNA, 22 bp, Homo sapiens
taactggttaaaaaacaaatgt

SEQ ID NO: 4436830 - DNA, 21 bp, Homo sapiens
taactgtaaacttggaatcaa

SEQ ID NO: 4436831 - DNA, 12 bp, Homo sapiens
taactgtaaatc

SEQ ID NO: 4436832 - DNA, 13 bp, Homo sapiens
taactgtaaatca

SEQ ID NO: 4436833 - DNA, 14 bp, Homo sapiens
taactgtaaatcat

SEQ ID NO: 4436834 - DNA, 21 bp, Homo sapiens
taactgtaggtatgatctctt

SEQ ID NO: 4436835 - DNA, 19 bp, Homo sapiens
taactgtatatttgtatga

SEQ ID NO: 4436836 - DNA, 14 bp, Homo sapiens
taactgtgatttgt

SEQ ID NO: 4436837 - DNA, 15 bp, Homo sapiens
taactgtgtactgtt

SEQ ID NO: 4436838 - DNA, 16 bp, Homo sapiens
taactgttttagaaat

SEQ ID NO: 4436839 - DNA, 18 bp, Homo sapiens
taactgttttagaaattg

SEQ ID NO: 4436840 - DNA, 20 bp, Homo sapiens
taactgttttagaaattggt

SEQ ID NO: 4436841 - DNA, 16 bp, Homo sapiens
taacttaaatagtatt

SEQ ID NO: 4436842 - DNA, 19 bp, Homo sapiens
taacttatggactgttttg

SEQ ID NO: 4436843 - DNA, 21 bp, Homo sapiens
taacttatggactgttttgat

SEQ ID NO: 4436844 - DNA, 23 bp, Homo sapiens
taacttattgctgattttaatgg

SEQ ID NO: 4436845 - DNA, 17 bp, Homo sapiens
taacttcaaatatagag

SEQ ID NO: 4436846 - DNA, 17 bp, Homo sapiens
taacttcattgtttgga

SEQ ID NO: 4436847 - DNA, 17 bp, Homo sapiens
taacttcttatggaatt

SEQ ID NO: 4436848 - DNA, 19 bp, Homo sapiens
taacttcttgaaaaagatg

SEQ ID NO: 4436849 - DNA, 21 bp, Homo sapiens
taacttcttgaaaaagatggc

SEQ ID NO: 4436850 - DNA, 13 bp, Homo sapiens
taacttcttgctt

SEQ ID NO: 4436851 - DNA, 15 bp, Homo sapiens
taacttcttgcttct

SEQ ID NO: 4436852 - DNA, 19 bp, Homo sapiens
taacttgcttaaatttctt

SEQ ID NO: 4436853 - DNA, 17 bp, Homo sapiens
taactttaccaaatgaa

SEQ ID NO: 4436854 - DNA, 17 bp, Homo sapiens
taactttcataccactt

SEQ ID NO: 4436855 - DNA, 13 bp, Homo sapiens
taactttctctgt

SEQ ID NO: 4436856 - DNA, 18 bp, Homo sapiens
taactttctctgtgaaag

SEQ ID NO: 4436857 - DNA, 21 bp, Homo sapiens
taactttctctgtgaaagctt

SEQ ID NO: 4436858 - DNA, 22 bp, Homo sapiens
taactttctctgtgaaagcttt

SEQ ID NO: 4436859 - DNA, 22 bp, Homo sapiens
taactttgcgggatatttaggg

SEQ ID NO: 4436860 - DNA, 13 bp, Homo sapiens
taacttttatatt

SEQ ID NO: 4436861 - DNA, 22 bp, Homo sapiens
taacttttccaagcaaaatcta

SEQ ID NO: 4436862 - DNA, 18 bp, Homo sapiens
taactttttgtttttatt

SEQ ID NO: 4436863 - DNA, 22 bp, Homo sapiens
taactttttgtttttatttctt

SEQ ID NO: 4436864 - DNA, 19 bp, Homo sapiens
taacttttttttctctctt

SEQ ID NO: 4436865 - DNA, 22 bp, Homo sapiens
taacttttttttctctcttttg

SEQ ID NO: 4436866 - DNA, 20 bp, Homo sapiens
taagaaaaaaagcaaaaaca

SEQ ID NO: 4436867 - DNA, 18 bp, Homo sapiens
taagaaaaaattactaaa

SEQ ID NO: 4436868 - DNA, 14 bp, Homo sapiens
taagaaaacaagta

SEQ ID NO: 4436869 - DNA, 17 bp, Homo sapiens
taagaaaagtaatgaag

SEQ ID NO: 4436870 - DNA, 23 bp, Homo sapiens
taagaaaagtaatgaagaatcac

SEQ ID NO: 4436871 - DNA, 20 bp, Homo sapiens
taagaaacaactctttgaga

SEQ ID NO: 4436872 - DNA, 15 bp, Homo sapiens
taagaaaggaagcat

SEQ ID NO: 4436873 - DNA, 18 bp, Homo sapiens
taagaaaggaagcattgt

SEQ ID NO: 4436874 - DNA, 15 bp, Homo sapiens
taagaaagtgaagca

SEQ ID NO: 4436875 - DNA, 22 bp, Homo sapiens
taagaaagtgaagcaaatcaga

SEQ ID NO: 4436876 - DNA, 16 bp, Homo sapiens
taagaaataaggctaa

SEQ ID NO: 4436877 - DNA, 20 bp, Homo sapiens
taagaaataaggctaaccat

SEQ ID NO: 4436878 - DNA, 15 bp, Homo sapiens
taagaaataatgcct

SEQ ID NO: 4436879 - DNA, 15 bp, Homo sapiens
taagaaatatctgtg

SEQ ID NO: 4436880 - DNA, 14 bp, Homo sapiens
taagaaatcaagta

SEQ ID NO: 4436881 - DNA, 15 bp, Homo sapiens
taagaaatcaagtaa

SEQ ID NO: 4436882 - DNA, 16 bp, Homo sapiens
taagaacaactacctg

SEQ ID NO: 4436883 - DNA, 13 bp, Homo sapiens
taagaacatttta

SEQ ID NO: 4436884 - DNA, 16 bp, Homo sapiens
taagaaccaaactcct

SEQ ID NO: 4436885 - DNA, 15 bp, Homo sapiens
taagaaccttaatga

SEQ ID NO: 4436886 - DNA, 23 bp, Homo sapiens
taagaaccttaatgacaacactt

SEQ ID NO: 4436887 - DNA, 22 bp, Homo sapiens
taagaagaaagatttaaagtat

SEQ ID NO: 4436888 - DNA, 13 bp, Homo sapiens
taagaagaaagca

SEQ ID NO: 4436889 - DNA, 14 bp, Homo sapiens
taagaagaaagcaa

SEQ ID NO: 4436890 - DNA, 13 bp, Homo sapiens
taagaagacattt

SEQ ID NO: 4436891 - DNA, 20 bp, Homo sapiens
taagaagcaatctttgaaat

SEQ ID NO: 4436892 - DNA, 21 bp, Homo sapiens
taagaagcaatctttgaaata

SEQ ID NO: 4436893 - DNA, 22 bp, Homo sapiens
taagaagcaatctttgaaataa

SEQ ID NO: 4436894 - DNA, 18 bp, Homo sapiens
taagaagcggcatagcac

SEQ ID NO: 4436895 - DNA, 17 bp, Homo sapiens
taagaataataaaatca

SEQ ID NO: 4436896 - DNA, 15 bp, Homo sapiens
taagaataatttata

SEQ ID NO: 4436897 - DNA, 17 bp, Homo sapiens
taagaatgtctatttcc

SEQ ID NO: 4436898 - DNA, 12 bp, Homo sapiens
taagaattattt

SEQ ID NO: 4436899 - DNA, 18 bp, Homo sapiens
taagaatttctgctaaat

SEQ ID NO: 4436900 - DNA, 20 bp, Homo sapiens
taagaatttgaggtctacat

SEQ ID NO: 4436901 - DNA, 17 bp, Homo sapiens
taagacaagaacattct

SEQ ID NO: 4436902 - DNA, 18 bp, Homo sapiens
taagacaagaacattctc

SEQ ID NO: 4436903 - DNA, 20 bp, Homo sapiens
taagacaagagatctacaca

SEQ ID NO: 4436904 - DNA, 14 bp, Homo sapiens
taagacaagctgta

SEQ ID NO: 4436905 - DNA, 18 bp, Homo sapiens
taagacaatagtatttct

SEQ ID NO: 4436906 - DNA, 18 bp, Homo sapiens
taagacagtgccctgaga

SEQ ID NO: 4436907 - DNA, 21 bp, Homo sapiens
taagacatgatttccttgaat

SEQ ID NO: 4436908 - DNA, 18 bp, Homo sapiens
taagacattttgttttta

SEQ ID NO: 4436909 - DNA, 15 bp, Homo sapiens
taagacatttttcat

SEQ ID NO: 4436910 - DNA, 19 bp, Homo sapiens
taagacatttttcattcat

SEQ ID NO: 4436911 - DNA, 21 bp, Homo sapiens
taagactctgtgtggctgtgc

SEQ ID NO: 4436912 - DNA, 15 bp, Homo sapiens
taagactgtgtattc

SEQ ID NO: 4436913 - DNA, 12 bp, Homo sapiens
taagagaaagag

SEQ ID NO: 4436914 - DNA, 12 bp, Homo sapiens
taagagaagtag

SEQ ID NO: 4436915 - DNA, 14 bp, Homo sapiens
taagagaagtgagt

SEQ ID NO: 4436916 - DNA, 14 bp, Homo sapiens
taagagagatgaga

SEQ ID NO: 4436917 - DNA, 18 bp, Homo sapiens
taagaggctttggcccaa

SEQ ID NO: 4436918 - DNA, 20 bp, Homo sapiens
taagagggggaaaaacacat

SEQ ID NO: 4436919 - DNA, 16 bp, Homo sapiens
taagaggttgattata

SEQ ID NO: 4436920 - DNA, 16 bp, Homo sapiens
taagataaaataaaat

SEQ ID NO: 4436921 - DNA, 17 bp, Homo sapiens
taagatacaataaaaca

SEQ ID NO: 4436922 - DNA, 19 bp, Homo sapiens
taagatacactgcactttg

SEQ ID NO: 4436923 - DNA, 14 bp, Homo sapiens
taagatatatacat

SEQ ID NO: 4436924 - DNA, 13 bp, Homo sapiens
taagatccagaaa

SEQ ID NO: 4436925 - DNA, 17 bp, Homo sapiens
taagatctatgggaaga

SEQ ID NO: 4436926 - DNA, 15 bp, Homo sapiens
taagatgtacattta

SEQ ID NO: 4436927 - DNA, 19 bp, Homo sapiens
taagatgtacatttaataa

SEQ ID NO: 4436928 - DNA, 18 bp, Homo sapiens
taagattaataagatttt

SEQ ID NO: 4436929 - DNA, 22 bp, Homo sapiens
taagattaataagatttttcaa

SEQ ID NO: 4436930 - DNA, 23 bp, Homo sapiens
taagattcttttaaattagaaaa

SEQ ID NO: 4436931 - DNA, 18 bp, Homo sapiens
taagattgttattaaatg

SEQ ID NO: 4436932 - DNA, 12 bp, Homo sapiens
taagatttaccc

SEQ ID NO: 4436933 - DNA, 22 bp, Homo sapiens
taagatttacccagaatgtcag

SEQ ID NO: 4436934 - DNA, 13 bp, Homo sapiens
taagatttactta

SEQ ID NO: 4436935 - DNA, 19 bp, Homo sapiens
taagatttacttaattgct

SEQ ID NO: 4436936 - DNA, 14 bp, Homo sapiens
taagatttctttat

SEQ ID NO: 4436937 - DNA, 17 bp, Homo sapiens
taagattttatctgggg

SEQ ID NO: 4436938 - DNA, 14 bp, Homo sapiens
taagatttttcaaa

SEQ ID NO: 4436939 - DNA, 15 bp, Homo sapiens
taagatttttcaaaa

SEQ ID NO: 4436940 - DNA, 14 bp, Homo sapiens
taagcaaaatgtga

SEQ ID NO: 4436941 - DNA, 12 bp, Homo sapiens
taagcaaatact

SEQ ID NO: 4436942 - DNA, 14 bp, Homo sapiens
taagcaaatactta

SEQ ID NO: 4436943 - DNA, 14 bp, Homo sapiens
taagcaagaatgca

SEQ ID NO: 4436944 - DNA, 16 bp, Homo sapiens
taagcaatcattttat

SEQ ID NO: 4436945 - DNA, 15 bp, Homo sapiens
taagcaccagtggga

SEQ ID NO: 4436946 - DNA, 13 bp, Homo sapiens
taagcacttctag

SEQ ID NO: 4436947 - DNA, 14 bp, Homo sapiens
taagcacttctaga

SEQ ID NO: 4436948 - DNA, 18 bp, Homo sapiens
taagcagaacatactgtt

SEQ ID NO: 4436949 - DNA, 18 bp, Homo sapiens
taagcagattgctttaat

SEQ ID NO: 4436950 - DNA, 16 bp, Homo sapiens
taagcagcctttgtgg

SEQ ID NO: 4436951 - DNA, 22 bp, Homo sapiens
taagcaggtttgttttcagcac

SEQ ID NO: 4436952 - DNA, 15 bp, Homo sapiens
taagcagtaatctgt

SEQ ID NO: 4436953 - DNA, 18 bp, Homo sapiens
taagcagtgtctgtgttt

SEQ ID NO: 4436954 - DNA, 18 bp, Homo sapiens
taagcatactttgtaaat

SEQ ID NO: 4436955 - DNA, 12 bp, Homo sapiens
taagcatgtcaa

SEQ ID NO: 4436956 - DNA, 18 bp, Homo sapiens
taagcattaccactcagg

SEQ ID NO: 4436957 - DNA, 22 bp, Homo sapiens
taagcattgaatggctatgttt

SEQ ID NO: 4436958 - DNA, 14 bp, Homo sapiens
taagcatttgtaca

SEQ ID NO: 4436959 - DNA, 16 bp, Homo sapiens
taagccaaaacaatgt

SEQ ID NO: 4436960 - DNA, 23 bp, Homo sapiens
taagccaaagaaatgaacattcc

SEQ ID NO: 4436961 - DNA, 20 bp, Homo sapiens
taagccacttaaaatgttca

SEQ ID NO: 4436962 - DNA, 20 bp, Homo sapiens
taagccagacatcaacagat

SEQ ID NO: 4436963 - DNA, 16 bp, Homo sapiens
taagccaggcctggct

SEQ ID NO: 4436964 - DNA, 20 bp, Homo sapiens
taagccatagaccctgaggc

SEQ ID NO: 4436965 - DNA, 13 bp, Homo sapiens
taagccctggcag

SEQ ID NO: 4436966 - DNA, 22 bp, Homo sapiens
taagcctatatatatagtcaaa

SEQ ID NO: 4436967 - DNA, 21 bp, Homo sapiens
taagcgaagtctttgccttct

SEQ ID NO: 4436968 - DNA, 23 bp, Homo sapiens
taagcgaagtctttgccttctct

SEQ ID NO: 4436969 - DNA, 15 bp, Homo sapiens
taagctactgccatc

SEQ ID NO: 4436970 - DNA, 16 bp, Homo sapiens
taagctttaaatgaca

SEQ ID NO: 4436971 - DNA, 23 bp, Homo sapiens
taaggaaaaaagatttttaaaat

SEQ ID NO: 4436972 - DNA, 17 bp, Homo sapiens
taaggaaactttttaat

SEQ ID NO: 4436973 - DNA, 16 bp, Homo sapiens
taaggaaagcaataaa

SEQ ID NO: 4436974 - DNA, 18 bp, Homo sapiens
taaggaaagcaataaatg

SEQ ID NO: 4436975 - DNA, 17 bp, Homo sapiens
taaggaaccaacaatct

SEQ ID NO: 4436976 - DNA, 20 bp, Homo sapiens
taaggacctttttaaagaga

SEQ ID NO: 4436977 - DNA, 21 bp, Homo sapiens
taaggactgcatggtaattta

SEQ ID NO: 4436978 - DNA, 17 bp, Homo sapiens
taaggacttctgcagct

SEQ ID NO: 4436979 - DNA, 19 bp, Homo sapiens
taaggagaaatctatagaa

SEQ ID NO: 4436980 - DNA, 20 bp, Homo sapiens
taaggagaggagaaactgag

SEQ ID NO: 4436981 - DNA, 20 bp, Homo sapiens
taaggagcatgattttaaga

SEQ ID NO: 4436982 - DNA, 22 bp, Homo sapiens
taaggagttagaaccacagcag

SEQ ID NO: 4436983 - DNA, 22 bp, Homo sapiens
taaggataaatcataaagtcag

SEQ ID NO: 4436984 - DNA, 17 bp, Homo sapiens
taaggatccggaaagaa

SEQ ID NO: 4436985 - DNA, 13 bp, Homo sapiens
taaggatgacttt

SEQ ID NO: 4436986 - DNA, 18 bp, Homo sapiens
taaggatgacttttttat

SEQ ID NO: 4436987 - DNA, 16 bp, Homo sapiens
taaggcctgtgggggg

SEQ ID NO: 4436988 - DNA, 16 bp, Homo sapiens
taaggcttttatttct

SEQ ID NO: 4436989 - DNA, 15 bp, Homo sapiens
taagggagggaaggg

SEQ ID NO: 4436990 - DNA, 14 bp, Homo sapiens
taagggcactgacg

SEQ ID NO: 4436991 - DNA, 23 bp, Homo sapiens
taagggcttgtttttcttcagca

SEQ ID NO: 4436992 - DNA, 20 bp, Homo sapiens
taagggtctttggtgttttt

SEQ ID NO: 4436993 - DNA, 19 bp, Homo sapiens
taaggtacaagaagcattt

SEQ ID NO: 4436994 - DNA, 20 bp, Homo sapiens
taaggtacatcattattgta

SEQ ID NO: 4436995 - DNA, 18 bp, Homo sapiens
taaggtctttcagtactt

SEQ ID NO: 4436996 - DNA, 13 bp, Homo sapiens
taaggttcttgct

SEQ ID NO: 4436997 - DNA, 15 bp, Homo sapiens
taagtaaaaccacag

SEQ ID NO: 4436998 - DNA, 17 bp, Homo sapiens
taagtaaaaccacagca

SEQ ID NO: 4436999 - DNA, 18 bp, Homo sapiens
taagtaaaaccacagcag

SEQ ID NO: 4437000 - DNA, 12 bp, Homo sapiens
taagtagatttc

SEQ ID NO: 4437001 - DNA, 17 bp, Homo sapiens
taagtattatgtctctt

SEQ ID NO: 4437002 - DNA, 15 bp, Homo sapiens
taagtcaacagtaaa

SEQ ID NO: 4437003 - DNA, 17 bp, Homo sapiens
taagtcaacctgcctga

SEQ ID NO: 4437004 - DNA, 18 bp, Homo sapiens
taagtcagatttttattt

SEQ ID NO: 4437005 - DNA, 12 bp, Homo sapiens
taagtcattttt

SEQ ID NO: 4437006 - DNA, 16 bp, Homo sapiens
taagtcattttttact

SEQ ID NO: 4437007 - DNA, 17 bp, Homo sapiens
taagtcattttttactt

SEQ ID NO: 4437008 - DNA, 14 bp, Homo sapiens
taagtccagctcat

SEQ ID NO: 4437009 - DNA, 13 bp, Homo sapiens
taagtccctgtca

SEQ ID NO: 4437010 - DNA, 15 bp, Homo sapiens
taagtccctgtcacc

SEQ ID NO: 4437011 - DNA, 16 bp, Homo sapiens
taagtccctgtcacct

SEQ ID NO: 4437012 - DNA, 15 bp, Homo sapiens
taagtctacattaaa

SEQ ID NO: 4437013 - DNA, 21 bp, Homo sapiens
taagtctgatttttaagattt

SEQ ID NO: 4437014 - DNA, 19 bp, Homo sapiens
taagtctgtcttgccttca

SEQ ID NO: 4437015 - DNA, 20 bp, Homo sapiens
taagtcttacataaaccatt

SEQ ID NO: 4437016 - DNA, 13 bp, Homo sapiens
taagtgaaataag

SEQ ID NO: 4437017 - DNA, 15 bp, Homo sapiens
taagtgaccttctga

SEQ ID NO: 4437018 - DNA, 21 bp, Homo sapiens
taagtgaccttctgatcttgg

SEQ ID NO: 4437019 - DNA, 15 bp, Homo sapiens
taagtgtaagtaaat

SEQ ID NO: 4437020 - DNA, 13 bp, Homo sapiens
taagtgttcattt

SEQ ID NO: 4437021 - DNA, 16 bp, Homo sapiens
taagttaatgtatata

SEQ ID NO: 4437022 - DNA, 21 bp, Homo sapiens
taagttaatgtatataaaaat

SEQ ID NO: 4437023 - DNA, 16 bp, Homo sapiens
taagttattgcagttt

SEQ ID NO: 4437024 - DNA, 20 bp, Homo sapiens
taagttcaaattcttctgaa

SEQ ID NO: 4437025 - DNA, 14 bp, Homo sapiens
taagttcagcactt

SEQ ID NO: 4437026 - DNA, 15 bp, Homo sapiens
taagttcctatacct

SEQ ID NO: 4437027 - DNA, 12 bp, Homo sapiens
taagttctattc

SEQ ID NO: 4437028 - DNA, 17 bp, Homo sapiens
taagttgctattttcat

SEQ ID NO: 4437029 - DNA, 14 bp, Homo sapiens
taagttgctgtaaa

SEQ ID NO: 4437030 - DNA, 16 bp, Homo sapiens
taagttggcttctgtt

SEQ ID NO: 4437031 - DNA, 22 bp, Homo sapiens
taagttgtcaaagaagcttcca

SEQ ID NO: 4437032 - DNA, 19 bp, Homo sapiens
taagttgtctgtctgaatg

SEQ ID NO: 4437033 - DNA, 14 bp, Homo sapiens
taagtttctttaga

SEQ ID NO: 4437034 - DNA, 13 bp, Homo sapiens
taagtttgaagag

SEQ ID NO: 4437035 - DNA, 19 bp, Homo sapiens
taataaaaatttattattt

SEQ ID NO: 4437036 - DNA, 22 bp, Homo sapiens
taataaaactgcgaggacatca

SEQ ID NO: 4437037 - DNA, 23 bp, Homo sapiens
taataaaactgtttgacttctca

SEQ ID NO: 4437038 - DNA, 23 bp, Homo sapiens
taataaaataagtggattttgta

SEQ ID NO: 4437039 - DNA, 20 bp, Homo sapiens
taataaaatatctatttgaa

SEQ ID NO: 4437040 - DNA, 14 bp, Homo sapiens
taataaactgtgtt

SEQ ID NO: 4437041 - DNA, 13 bp, Homo sapiens
taataaaggactg

SEQ ID NO: 4437042 - DNA, 16 bp, Homo sapiens
taataaaggactgtaa

SEQ ID NO: 4437043 - DNA, 14 bp, Homo sapiens
taataaagtagtta

SEQ ID NO: 4437044 - DNA, 18 bp, Homo sapiens
taataaagtattccacct

SEQ ID NO: 4437045 - DNA, 10 bp, Homo sapiens
taataaagtg

SEQ ID NO: 4437046 - DNA, 17 bp, Homo sapiens
taataaagtttccatta

SEQ ID NO: 4437047 - DNA, 23 bp, Homo sapiens
taataaatgtgactcagcatcac

SEQ ID NO: 4437048 - DNA, 17 bp, Homo sapiens
taataactgtgtactgt

SEQ ID NO: 4437049 - DNA, 16 bp, Homo sapiens
taataagatttttcaa

SEQ ID NO: 4437050 - DNA, 23 bp, Homo sapiens
taataagtgacaaataagattaa

SEQ ID NO: 4437051 - DNA, 21 bp, Homo sapiens
taataatatcaaagagaagat

SEQ ID NO: 4437052 - DNA, 14 bp, Homo sapiens
taataatattgttt

SEQ ID NO: 4437053 - DNA, 19 bp, Homo sapiens
taataatattgtttttctt

SEQ ID NO: 4437054 - DNA, 21 bp, Homo sapiens
taataatgagctattaaaact

SEQ ID NO: 4437055 - DNA, 19 bp, Homo sapiens
taatacaaattggctttca

SEQ ID NO: 4437056 - DNA, 11 bp, Homo sapiens
taatacatcac

SEQ ID NO: 4437057 - DNA, 12 bp, Homo sapiens
taatacatcaca

SEQ ID NO: 4437058 - DNA, 19 bp, Homo sapiens
taatacatcacatcttatt

SEQ ID NO: 4437059 - DNA, 16 bp, Homo sapiens
taatacatctttccct

SEQ ID NO: 4437060 - DNA, 17 bp, Homo sapiens
taataccacagctattt

SEQ ID NO: 4437061 - DNA, 20 bp, Homo sapiens
taataccacagctatttaga

SEQ ID NO: 4437062 - DNA, 22 bp, Homo sapiens
taataccacagctatttagaag

SEQ ID NO: 4437063 - DNA, 16 bp, Homo sapiens
taatactgttttaaaa

SEQ ID NO: 4437064 - DNA, 22 bp, Homo sapiens
taatacttctttgttattataa

SEQ ID NO: 4437065 - DNA, 18 bp, Homo sapiens
taatactttttaaattac

SEQ ID NO: 4437066 - DNA, 22 bp, Homo sapiens
taatagaataaaggcagttttc

SEQ ID NO: 4437067 - DNA, 12 bp, Homo sapiens
taatagaggagc

SEQ ID NO: 4437068 - DNA, 14 bp, Homo sapiens
taatagaggagctg

SEQ ID NO: 4437069 - DNA, 16 bp, Homo sapiens
taatagatgtttgata

SEQ ID NO: 4437070 - DNA, 15 bp, Homo sapiens
taatagcaaagaatt

SEQ ID NO: 4437071 - DNA, 18 bp, Homo sapiens
taatagcactaaccaatg

SEQ ID NO: 4437072 - DNA, 11 bp, Homo sapiens
taatagctgta

SEQ ID NO: 4437073 - DNA, 14 bp, Homo sapiens
taataggcatttta

SEQ ID NO: 4437074 - DNA, 17 bp, Homo sapiens
taatagtaatttgtaaa

SEQ ID NO: 4437075 - DNA, 18 bp, Homo sapiens
taatagtaatttgtaaag

SEQ ID NO: 4437076 - DNA, 21 bp, Homo sapiens
taatagtaatttgtaaagttg

SEQ ID NO: 4437077 - DNA, 17 bp, Homo sapiens
taatagtggcaaatgaa

SEQ ID NO: 4437078 - DNA, 23 bp, Homo sapiens
taatagttctatccttttgcctg

SEQ ID NO: 4437079 - DNA, 14 bp, Homo sapiens
taatagtttatctt

SEQ ID NO: 4437080 - DNA, 20 bp, Homo sapiens
taatataaaagatcttgcag

SEQ ID NO: 4437081 - DNA, 13 bp, Homo sapiens
taatataaattca

SEQ ID NO: 4437082 - DNA, 18 bp, Homo sapiens
taatataaattcactttc

SEQ ID NO: 4437083 - DNA, 21 bp, Homo sapiens
taatataaattcactttcatt

SEQ ID NO: 4437084 - DNA, 22 bp, Homo sapiens
taatataagtttctttgcttca

SEQ ID NO: 4437085 - DNA, 16 bp, Homo sapiens
taatataccccaaatt

SEQ ID NO: 4437086 - DNA, 23 bp, Homo sapiens
taatatagaaaaaaacattctat

SEQ ID NO: 4437087 - DNA, 14 bp, Homo sapiens
taatatataattta

SEQ ID NO: 4437088 - DNA, 22 bp, Homo sapiens
taatatataatttaatgtaaat

SEQ ID NO: 4437089 - DNA, 18 bp, Homo sapiens
taatatatcattatcttt

SEQ ID NO: 4437090 - DNA, 19 bp, Homo sapiens
taatatatgaaataagtaa

SEQ ID NO: 4437091 - DNA, 22 bp, Homo sapiens
taatatatgggggaaaattatt

SEQ ID NO: 4437092 - DNA, 23 bp, Homo sapiens
taatatatgggggaaaattattt

SEQ ID NO: 4437093 - DNA, 12 bp, Homo sapiens
taatatattaaa

SEQ ID NO: 4437094 - DNA, 21 bp, Homo sapiens
taatatattaaaattccaaat

SEQ ID NO: 4437095 - DNA, 14 bp, Homo sapiens
taatatatttaaaa

SEQ ID NO: 4437096 - DNA, 17 bp, Homo sapiens
taatatatttaaaaata

SEQ ID NO: 4437097 - DNA, 14 bp, Homo sapiens
taatatcctaaaca

SEQ ID NO: 4437098 - DNA, 17 bp, Homo sapiens
taatatcctaaacatca

SEQ ID NO: 4437099 - DNA, 22 bp, Homo sapiens
taatatctttctgcacacaaat

SEQ ID NO: 4437100 - DNA, 12 bp, Homo sapiens
taatatgagctt

SEQ ID NO: 4437101 - DNA, 20 bp, Homo sapiens
taatatgcttataacctagt

SEQ ID NO: 4437102 - DNA, 18 bp, Homo sapiens
taatatggaaccttccct

SEQ ID NO: 4437103 - DNA, 16 bp, Homo sapiens
taatatggtgtatttt

SEQ ID NO: 4437104 - DNA, 20 bp, Homo sapiens
taatattgaaaattgaaaag

SEQ ID NO: 4437105 - DNA, 21 bp, Homo sapiens
taatattgaaaattgaaaagt

SEQ ID NO: 4437106 - DNA, 22 bp, Homo sapiens
taatattgaaaattgaaaagta

SEQ ID NO: 4437107 - DNA, 19 bp, Homo sapiens
taatattgagaaagaaact

SEQ ID NO: 4437108 - DNA, 11 bp, Homo sapiens
taatattgctt

SEQ ID NO: 4437109 - DNA, 12 bp, Homo sapiens
taatattgcttc

SEQ ID NO: 4437110 - DNA, 18 bp, Homo sapiens
taatattgcttcttgtgt

SEQ ID NO: 4437111 - DNA, 17 bp, Homo sapiens
taatattgtctgtctct

SEQ ID NO: 4437112 - DNA, 13 bp, Homo sapiens
taatatttacaat

SEQ ID NO: 4437113 - DNA, 15 bp, Homo sapiens
taatatttacaatgt

SEQ ID NO: 4437114 - DNA, 13 bp, Homo sapiens
taatatttatgtt

SEQ ID NO: 4437115 - DNA, 14 bp, Homo sapiens
taatatttcaagtg

SEQ ID NO: 4437116 - DNA, 17 bp, Homo sapiens
taatatttcaagtgcct

SEQ ID NO: 4437117 - DNA, 18 bp, Homo sapiens
taatatttcaagtgccta

SEQ ID NO: 4437118 - DNA, 17 bp, Homo sapiens
taatattttagattaca

SEQ ID NO: 4437119 - DNA, 20 bp, Homo sapiens
taatattttgtaatattctg

SEQ ID NO: 4437120 - DNA, 21 bp, Homo sapiens
taatattttgtaatattctgt

SEQ ID NO: 4437121 - DNA, 11 bp, Homo sapiens
taatcaaatga

SEQ ID NO: 4437122 - DNA, 18 bp, Homo sapiens
taatcaaatgatttcata

SEQ ID NO: 4437123 - DNA, 13 bp, Homo sapiens
taatcaagagaaa

SEQ ID NO: 4437124 - DNA, 19 bp, Homo sapiens
taatcaagatttttttcct

SEQ ID NO: 4437125 - DNA, 17 bp, Homo sapiens
taatcacaaactgaatg

SEQ ID NO: 4437126 - DNA, 15 bp, Homo sapiens
taatcaccatgtaag

SEQ ID NO: 4437127 - DNA, 12 bp, Homo sapiens
taatcacttaaa

SEQ ID NO: 4437128 - DNA, 19 bp, Homo sapiens
taatcagaaagaaaaaatt

SEQ ID NO: 4437129 - DNA, 23 bp, Homo sapiens
taatcagaaagaaaaaattttat

SEQ ID NO: 4437130 - DNA, 20 bp, Homo sapiens
taatcatccctccttgccta

SEQ ID NO: 4437131 - DNA, 13 bp, Homo sapiens
taatcatgaatat

SEQ ID NO: 4437132 - DNA, 13 bp, Homo sapiens
taatcattacctt

SEQ ID NO: 4437133 - DNA, 14 bp, Homo sapiens
taatcattatctca

SEQ ID NO: 4437134 - DNA, 14 bp, Homo sapiens
taatcattatttga

SEQ ID NO: 4437135 - DNA, 14 bp, Homo sapiens
taatcatttgttta

SEQ ID NO: 4437136 - DNA, 19 bp, Homo sapiens
taatcatttgtttacattt

SEQ ID NO: 4437137 - DNA, 20 bp, Homo sapiens
taatccaatattttgccttt

SEQ ID NO: 4437138 - DNA, 16 bp, Homo sapiens
taatcccacccacctc

SEQ ID NO: 4437139 - DNA, 13 bp, Homo sapiens
taatcccagcact

SEQ ID NO: 4437140 - DNA, 23 bp, Homo sapiens
taatcccagcactttgggaggcc

SEQ ID NO: 4437141 - DNA, 17 bp, Homo sapiens
taatccctgctttttgt

SEQ ID NO: 4437142 - DNA, 17 bp, Homo sapiens
taatccttttccttatt

SEQ ID NO: 4437143 - DNA, 22 bp, Homo sapiens
taatctacaccaatgaaaacat

SEQ ID NO: 4437144 - DNA, 18 bp, Homo sapiens
taatctacattataataa

SEQ ID NO: 4437145 - DNA, 11 bp, Homo sapiens
taatctactgt

SEQ ID NO: 4437146 - DNA, 23 bp, Homo sapiens
taatctcctattccttcacacag

SEQ ID NO: 4437147 - DNA, 20 bp, Homo sapiens
taatctgcaaaatgtagaaa

SEQ ID NO: 4437148 - DNA, 11 bp, Homo sapiens
taatctgcctg

SEQ ID NO: 4437149 - DNA, 18 bp, Homo sapiens
taatcttagtgtatgatt

SEQ ID NO: 4437150 - DNA, 15 bp, Homo sapiens
gttggccggcggcta

SEQ ID NO: 4437151 - DNA, 19 bp, Homo sapiens
gttggcctcttcaggcctg

SEQ ID NO: 4437152 - DNA, 13 bp, Homo sapiens
gttggctgtgctg

SEQ ID NO: 4437153 - DNA, 16 bp, Homo sapiens
gttggctttgcagctg

SEQ ID NO: 4437154 - DNA, 17 bp, Homo sapiens
gttggctttgcagctgc

SEQ ID NO: 4437155 - DNA, 19 bp, Homo sapiens
gttggctttgcagctgctg

SEQ ID NO: 4437156 - DNA, 14 bp, Homo sapiens
gttgggagaatgtc

SEQ ID NO: 4437157 - DNA, 14 bp, Homo sapiens
gttgggcagccaga

SEQ ID NO: 4437158 - DNA, 16 bp, Homo sapiens
gttgggcccagatctg

SEQ ID NO: 4437159 - DNA, 22 bp, Homo sapiens
gttgggggaatgcacctcccca

SEQ ID NO: 4437160 - DNA, 17 bp, Homo sapiens
gttgggggcagattggg

SEQ ID NO: 4437161 - DNA, 16 bp, Homo sapiens
gttgggggtgtggctc

SEQ ID NO: 4437162 - DNA, 19 bp, Homo sapiens
gttggtgaccagtttctta

SEQ ID NO: 4437163 - DNA, 13 bp, Homo sapiens
gttggtgttggct

SEQ ID NO: 4437164 - DNA, 14 bp, Homo sapiens
gttggttggataag

SEQ ID NO: 4437165 - DNA, 21 bp, Homo sapiens
gttgtaactaggctcagagat

SEQ ID NO: 4437166 - DNA, 14 bp, Homo sapiens
gttgtacaagctca

SEQ ID NO: 4437167 - DNA, 22 bp, Homo sapiens
gttgtacatgataagacatttt

SEQ ID NO: 4437168 - DNA, 15 bp, Homo sapiens
gttgtagacaaagta

SEQ ID NO: 4437169 - DNA, 21 bp, Homo sapiens
gttgtatctacagtaatgaaa

SEQ ID NO: 4437170 - DNA, 23 bp, Homo sapiens
gttgtatgcctttaaatctgtga

SEQ ID NO: 4437171 - DNA, 19 bp, Homo sapiens
gttgtattcctgcctttga

SEQ ID NO: 4437172 - DNA, 16 bp, Homo sapiens
gttgtatttaacagaa

SEQ ID NO: 4437173 - DNA, 14 bp, Homo sapiens
gttgtatttcaaat

SEQ ID NO: 4437174 - DNA, 15 bp, Homo sapiens
gttgtcaaagaagct

SEQ ID NO: 4437175 - DNA, 17 bp, Homo sapiens
gttgtcacacccatggc

SEQ ID NO: 4437176 - DNA, 18 bp, Homo sapiens
gttgtctacgggggcact

SEQ ID NO: 4437177 - DNA, 21 bp, Homo sapiens
gttgtctccacttgtatatat

SEQ ID NO: 4437178 - DNA, 14 bp, Homo sapiens
gttgtctggcaagg

SEQ ID NO: 4437179 - DNA, 20 bp, Homo sapiens
gttgtggggcctcaggctcc

SEQ ID NO: 4437180 - DNA, 16 bp, Homo sapiens
gttgtgtgtatatgta

SEQ ID NO: 4437181 - DNA, 16 bp, Homo sapiens
gttgtgtgtgggagtg

SEQ ID NO: 4437182 - DNA, 19 bp, Homo sapiens
gttgttaatactatattgc

SEQ ID NO: 4437183 - DNA, 14 bp, Homo sapiens
gttgttgcatgttt

SEQ ID NO: 4437184 - DNA, 13 bp, Homo sapiens
gttgttgttgttt

SEQ ID NO: 4437185 - DNA, 13 bp, Homo sapiens
gttgtttctgttc

SEQ ID NO: 4437186 - DNA, 19 bp, Homo sapiens
gtttaaaaatcaacttttt

SEQ ID NO: 4437187 - DNA, 12 bp, Homo sapiens
gtttaaaaatgg

SEQ ID NO: 4437188 - DNA, 20 bp, Homo sapiens
gtttaaaactagttagattc

SEQ ID NO: 4437189 - DNA, 14 bp, Homo sapiens
gtttaaaagaaaaa

SEQ ID NO: 4437190 - DNA, 18 bp, Homo sapiens
gtttaaaagaaaaaatga

SEQ ID NO: 4437191 - DNA, 19 bp, Homo sapiens
gtttaaaaggctaagaata

SEQ ID NO: 4437192 - DNA, 20 bp, Homo sapiens
gtttaaacccaagtgctgca

SEQ ID NO: 4437193 - DNA, 16 bp, Homo sapiens
gtttaaagaaagtgta

SEQ ID NO: 4437194 - DNA, 17 bp, Homo sapiens
gtttaaagaaagtgtat

SEQ ID NO: 4437195 - DNA, 21 bp, Homo sapiens
gtttaaagaaagtgtatttgg

SEQ ID NO: 4437196 - DNA, 17 bp, Homo sapiens
gtttaaagttctgtgta

SEQ ID NO: 4437197 - DNA, 21 bp, Homo sapiens
gtttaaagttctgtgtattta

SEQ ID NO: 4437198 - DNA, 23 bp, Homo sapiens
gtttaaccaaaaagaccagacta

SEQ ID NO: 4437199 - DNA, 13 bp, Homo sapiens
gtttaaccttaaa

SEQ ID NO: 4437200 - DNA, 15 bp, Homo sapiens
gtttaagtagatttc

SEQ ID NO: 4437201 - DNA, 18 bp, Homo sapiens
gtttaagtagatttcatg

SEQ ID NO: 4437202 - DNA, 19 bp, Homo sapiens
gtttaatattgagaaagaa

SEQ ID NO: 4437203 - DNA, 15 bp, Homo sapiens
gtttaatctacatta

SEQ ID NO: 4437204 - DNA, 12 bp, Homo sapiens
gtttaatggtag

SEQ ID NO: 4437205 - DNA, 17 bp, Homo sapiens
gtttaccatttttcatt

SEQ ID NO: 4437206 - DNA, 20 bp, Homo sapiens
gtttactcccttctgtagtt

SEQ ID NO: 4437207 - DNA, 22 bp, Homo sapiens
gtttagaaaaaaaactgaagat

SEQ ID NO: 4437208 - DNA, 13 bp, Homo sapiens
gtttagaaagctt

SEQ ID NO: 4437209 - DNA, 18 bp, Homo sapiens
gtttagaatcagaataaa

SEQ ID NO: 4437210 - DNA, 17 bp, Homo sapiens
gtttagatgaatgtcag

SEQ ID NO: 4437211 - DNA, 20 bp, Homo sapiens
gtttaggatgttgaaaaagt

SEQ ID NO: 4437212 - DNA, 13 bp, Homo sapiens
gtttagtaagttt

SEQ ID NO: 4437213 - DNA, 18 bp, Homo sapiens
gtttagtggctcaacatt

SEQ ID NO: 4437214 - DNA, 15 bp, Homo sapiens
gtttagtttgcattt

SEQ ID NO: 4437215 - DNA, 20 bp, Homo sapiens
gtttataaatgttctggtat

SEQ ID NO: 4437216 - DNA, 19 bp, Homo sapiens
gtttatacgtggaaacaca

SEQ ID NO: 4437217 - DNA, 20 bp, Homo sapiens
gtttatagcaaaaatgtttt

SEQ ID NO: 4437218 - DNA, 22 bp, Homo sapiens
gtttatatacagtacacagata

SEQ ID NO: 4437219 - DNA, 18 bp, Homo sapiens
gtttatatgtgttgaaaa

SEQ ID NO: 4437220 - DNA, 15 bp, Homo sapiens
gtttatcagcaaaaa

SEQ ID NO: 4437221 - DNA, 16 bp, Homo sapiens
gtttatcatgaagcct

SEQ ID NO: 4437222 - DNA, 17 bp, Homo sapiens
gtttatcatgaagcctg

SEQ ID NO: 4437223 - DNA, 15 bp, Homo sapiens
gtttatcattcaagt

SEQ ID NO: 4437224 - DNA, 16 bp, Homo sapiens
gtttatcattcaagtg

SEQ ID NO: 4437225 - DNA, 18 bp, Homo sapiens
gtttatgaaaaagaagaa

SEQ ID NO: 4437226 - DNA, 15 bp, Homo sapiens
gtttatgccaccagg

SEQ ID NO: 4437227 - DNA, 15 bp, Homo sapiens
gtttatggaaatatt

SEQ ID NO: 4437228 - DNA, 14 bp, Homo sapiens
gtttatggcctcag

SEQ ID NO: 4437229 - DNA, 15 bp, Homo sapiens
gtttatggcctcagc

SEQ ID NO: 4437230 - DNA, 18 bp, Homo sapiens
gtttatggcctcagctgc

SEQ ID NO: 4437231 - DNA, 23 bp, Homo sapiens
gtttatggcctcagctgcctcac

SEQ ID NO: 4437232 - DNA, 22 bp, Homo sapiens
gtttatgtgctattaatatttg

SEQ ID NO: 4437233 - DNA, 13 bp, Homo sapiens
gtttatgtgtgtg

SEQ ID NO: 4437234 - DNA, 17 bp, Homo sapiens
gtttatgtgttatgaac

SEQ ID NO: 4437235 - DNA, 22 bp, Homo sapiens
gtttattaaaattctgaatttt

SEQ ID NO: 4437236 - DNA, 18 bp, Homo sapiens
gtttattaatcttagtgt

SEQ ID NO: 4437237 - DNA, 20 bp, Homo sapiens
gtttattaatcttagtgtat

SEQ ID NO: 4437238 - DNA, 15 bp, Homo sapiens
gtttattacaagttt

SEQ ID NO: 4437239 - DNA, 19 bp, Homo sapiens
gtttattattgtactttat

SEQ ID NO: 4437240 - DNA, 19 bp, Homo sapiens
gtttattccttctgtagtg

SEQ ID NO: 4437241 - DNA, 22 bp, Homo sapiens
gtttattgagtttgtaggtaaa

SEQ ID NO: 4437242 - DNA, 14 bp, Homo sapiens
gtttatttcatgtg

SEQ ID NO: 4437243 - DNA, 22 bp, Homo sapiens
gtttcaaagccaagacctcaca

SEQ ID NO: 4437244 - DNA, 16 bp, Homo sapiens
gtttcaaatggactgt

SEQ ID NO: 4437245 - DNA, 14 bp, Homo sapiens
gtttcaagccctcc

SEQ ID NO: 4437246 - DNA, 17 bp, Homo sapiens
gtttcaagttttaaagt

SEQ ID NO: 4437247 - DNA, 12 bp, Homo sapiens
gtttcagatgag

SEQ ID NO: 4437248 - DNA, 20 bp, Homo sapiens
gtttcagattttttaaaatt

SEQ ID NO: 4437249 - DNA, 21 bp, Homo sapiens
gtttcagattttttaaaattt

SEQ ID NO: 4437250 - DNA, 23 bp, Homo sapiens
gtttcagtgtcaaataaacactg

SEQ ID NO: 4437251 - DNA, 12 bp, Homo sapiens
gtttcagtttga

SEQ ID NO: 4437252 - DNA, 21 bp, Homo sapiens
gtttcatgttagttaccttat

SEQ ID NO: 4437253 - DNA, 16 bp, Homo sapiens
gtttcattacttgaat

SEQ ID NO: 4437254 - DNA, 18 bp, Homo sapiens
gtttccatcatgtctgta

SEQ ID NO: 4437255 - DNA, 19 bp, Homo sapiens
gtttcccccacagttttaa

SEQ ID NO: 4437256 - DNA, 16 bp, Homo sapiens
gtttcctaaaagttca

SEQ ID NO: 4437257 - DNA, 15 bp, Homo sapiens
gtttcctaaatccaa

SEQ ID NO: 4437258 - DNA, 15 bp, Homo sapiens
gtttcctaactgtga

SEQ ID NO: 4437259 - DNA, 18 bp, Homo sapiens
gtttcctaactgtgattt

SEQ ID NO: 4437260 - DNA, 18 bp, Homo sapiens
gtttcctatttaatacag

SEQ ID NO: 4437261 - DNA, 13 bp, Homo sapiens
gtttctaagcagt

SEQ ID NO: 4437262 - DNA, 16 bp, Homo sapiens
gtttctagactataaa

SEQ ID NO: 4437263 - DNA, 14 bp, Homo sapiens
gtttctattctgtc

SEQ ID NO: 4437264 - DNA, 17 bp, Homo sapiens
gtttctattttttgaaa

SEQ ID NO: 4437265 - DNA, 15 bp, Homo sapiens
gtttctcattaaagt

SEQ ID NO: 4437266 - DNA, 17 bp, Homo sapiens
gtttctctgctgtcaac

SEQ ID NO: 4437267 - DNA, 20 bp, Homo sapiens
gtttctgaaagaatcatttg

SEQ ID NO: 4437268 - DNA, 15 bp, Homo sapiens
taaaagcaaaataaa

SEQ ID NO: 4437269 - DNA, 14 bp, Homo sapiens
taaaagcaaatcat

SEQ ID NO: 4437270 - DNA, 22 bp, Homo sapiens
taaaagcatttttattatattt

SEQ ID NO: 4437271 - DNA, 16 bp, Homo sapiens
taaaagctttcatgtc

SEQ ID NO: 4437272 - DNA, 20 bp, Homo sapiens
taaaaggtggagtttctctg

SEQ ID NO: 4437273 - DNA, 14 bp, Homo sapiens
taaaaggtgttgta

SEQ ID NO: 4437274 - DNA, 16 bp, Homo sapiens
taaaagtaaaatgtct

SEQ ID NO: 4437275 - DNA, 20 bp, Homo sapiens
taaaagtacatgttaaactt

SEQ ID NO: 4437276 - DNA, 23 bp, Homo sapiens
taaaagtgggcttgattctgcag

SEQ ID NO: 4437277 - DNA, 14 bp, Homo sapiens
taaaagtgtacaga

SEQ ID NO: 4437278 - DNA, 19 bp, Homo sapiens
taaaagtgtacagactctt

SEQ ID NO: 4437279 - DNA, 13 bp, Homo sapiens
taaaagttgaact

SEQ ID NO: 4437280 - DNA, 18 bp, Homo sapiens
taaaagttttgaaggaaa

SEQ ID NO: 4437281 - DNA, 22 bp, Homo sapiens
taaaagttttttattatgcatt

SEQ ID NO: 4437282 - DNA, 20 bp, Homo sapiens
taaaataaaatgaaaattgt

SEQ ID NO: 4437283 - DNA, 12 bp, Homo sapiens
taaaataaatgg

SEQ ID NO: 4437284 - DNA, 13 bp, Homo sapiens
taaaataaatggt

SEQ ID NO: 4437285 - DNA, 17 bp, Homo sapiens
taaaataactaaaatgt

SEQ ID NO: 4437286 - DNA, 18 bp, Homo sapiens
taaaataactaaaatgta

SEQ ID NO: 4437287 - DNA, 19 bp, Homo sapiens
taaaataactaaaatgtat

SEQ ID NO: 4437288 - DNA, 21 bp, Homo sapiens
taaaataactaaaatgtatct

SEQ ID NO: 4437289 - DNA, 17 bp, Homo sapiens
taaaataagttcttaaa

SEQ ID NO: 4437290 - DNA, 18 bp, Homo sapiens
taaaataattatataact

SEQ ID NO: 4437291 - DNA, 22 bp, Homo sapiens
taaaataattcatatctaaata

SEQ ID NO: 4437292 - DNA, 18 bp, Homo sapiens
taaaatactatgcagtat

SEQ ID NO: 4437293 - DNA, 19 bp, Homo sapiens
taaaatactatgcagtatc

SEQ ID NO: 4437294 - DNA, 15 bp, Homo sapiens
taaaatagcaataac

SEQ ID NO: 4437295 - DNA, 23 bp, Homo sapiens
taaaatatagagacaggacagaa

SEQ ID NO: 4437296 - DNA, 14 bp, Homo sapiens
taaaatatctacat

SEQ ID NO: 4437297 - DNA, 13 bp, Homo sapiens
taaaatatgtgaa

SEQ ID NO: 4437298 - DNA, 20 bp, Homo sapiens
taaaatattgttttcctaca

SEQ ID NO: 4437299 - DNA, 16 bp, Homo sapiens
taaaatattttgaatc

SEQ ID NO: 4437300 - DNA, 10 bp, Homo sapiens
taaaatcatt

SEQ ID NO: 4437301 - DNA, 22 bp, Homo sapiens
taaaatcatttctgcatcagct

SEQ ID NO: 4437302 - DNA, 15 bp, Homo sapiens
taaaatccagacttt

SEQ ID NO: 4437303 - DNA, 17 bp, Homo sapiens
taaaatccagactttct

SEQ ID NO: 4437304 - DNA, 18 bp, Homo sapiens
taaaatccagactttctt

SEQ ID NO: 4437305 - DNA, 17 bp, Homo sapiens
taaaatccattttaggt

SEQ ID NO: 4437306 - DNA, 15 bp, Homo sapiens
taaaatcccaccaga

SEQ ID NO: 4437307 - DNA, 15 bp, Homo sapiens
taaaatcctcaatcc

SEQ ID NO: 4437308 - DNA, 16 bp, Homo sapiens
taaaatctaaaatttc

SEQ ID NO: 4437309 - DNA, 15 bp, Homo sapiens
taaaatctcctaaat

SEQ ID NO: 4437310 - DNA, 15 bp, Homo sapiens
taaaatgaaaattgt

SEQ ID NO: 4437311 - DNA, 21 bp, Homo sapiens
taaaatgagtttgtattatta

SEQ ID NO: 4437312 - DNA, 12 bp, Homo sapiens
taaaatgcaata

SEQ ID NO: 4437313 - DNA, 15 bp, Homo sapiens
taaaatgcaatgtaa

SEQ ID NO: 4437314 - DNA, 19 bp, Homo sapiens
taaaatgctcaatttcagc

SEQ ID NO: 4437315 - DNA, 17 bp, Homo sapiens
taaaatggaataacata

SEQ ID NO: 4437316 - DNA, 18 bp, Homo sapiens
taaaatggatgccttgaa

SEQ ID NO: 4437317 - DNA, 18 bp, Homo sapiens
taaaatggctgtaatcat

SEQ ID NO: 4437318 - DNA, 21 bp, Homo sapiens
taaaatgtagaaacttaaaca

SEQ ID NO: 4437319 - DNA, 17 bp, Homo sapiens
taaaatgtatctaagaa

SEQ ID NO: 4437320 - DNA, 20 bp, Homo sapiens
taaaatgtattatgtcctgt

SEQ ID NO: 4437321 - DNA, 14 bp, Homo sapiens
taaaatgtattttt

SEQ ID NO: 4437322 - DNA, 17 bp, Homo sapiens
taaaatgtgaggcaata

SEQ ID NO: 4437323 - DNA, 18 bp, Homo sapiens
taaaatgtgaggcaataa

SEQ ID NO: 4437324 - DNA, 18 bp, Homo sapiens
taaaatgtgatttttctt

SEQ ID NO: 4437325 - DNA, 21 bp, Homo sapiens
taaaatgtgatttttcttcag

SEQ ID NO: 4437326 - DNA, 17 bp, Homo sapiens
taaaatgttcacttttg

SEQ ID NO: 4437327 - DNA, 19 bp, Homo sapiens
taaaatgttttatgacatt

SEQ ID NO: 4437328 - DNA, 21 bp, Homo sapiens
taaaatgttttatgacatttt

SEQ ID NO: 4437329 - DNA, 15 bp, Homo sapiens
taaaattaaaagttt

SEQ ID NO: 4437330 - DNA, 15 bp, Homo sapiens
taaaattaagatttc

SEQ ID NO: 4437331 - DNA, 13 bp, Homo sapiens
taaaattaatgta

SEQ ID NO: 4437332 - DNA, 15 bp, Homo sapiens
taaaattaatgtaat

SEQ ID NO: 4437333 - DNA, 17 bp, Homo sapiens
taaaattaatgtaataa

SEQ ID NO: 4437334 - DNA, 18 bp, Homo sapiens
taaaattaatgtaataaa

SEQ ID NO: 4437335 - DNA, 16 bp, Homo sapiens
taaaattatactgtgt

SEQ ID NO: 4437336 - DNA, 20 bp, Homo sapiens
taaaattatactgtgtgtga

SEQ ID NO: 4437337 - DNA, 18 bp, Homo sapiens
taaaattatatagctgct

SEQ ID NO: 4437338 - DNA, 13 bp, Homo sapiens
taaaattatttca

SEQ ID NO: 4437339 - DNA, 14 bp, Homo sapiens
taaaattatttgca

SEQ ID NO: 4437340 - DNA, 16 bp, Homo sapiens
taaaattgatattata

SEQ ID NO: 4437341 - DNA, 17 bp, Homo sapiens
taaaattgcagtttcat

SEQ ID NO: 4437342 - DNA, 18 bp, Homo sapiens
taaaattgcagtttcatg

SEQ ID NO: 4437343 - DNA, 22 bp, Homo sapiens
taaaattgcagtttcatgtatg

SEQ ID NO: 4437344 - DNA, 15 bp, Homo sapiens
taaaattgtgatgtg

SEQ ID NO: 4437345 - DNA, 17 bp, Homo sapiens
taaaattgtgcataatg

SEQ ID NO: 4437346 - DNA, 21 bp, Homo sapiens
taaaattgtgcataatgcttt

SEQ ID NO: 4437347 - DNA, 16 bp, Homo sapiens
taaaatttacacatct

SEQ ID NO: 4437348 - DNA, 19 bp, Homo sapiens
taaaatttatttgcaaata

SEQ ID NO: 4437349 - DNA, 17 bp, Homo sapiens
taaaatttcataattct

SEQ ID NO: 4437350 - DNA, 14 bp, Homo sapiens
taaaatttgttgca

SEQ ID NO: 4437351 - DNA, 17 bp, Homo sapiens
taaaattttagatgtag

SEQ ID NO: 4437352 - DNA, 19 bp, Homo sapiens
taaaattttagatgtagat

SEQ ID NO: 4437353 - DNA, 19 bp, Homo sapiens
taaaattttttaaaagttt

SEQ ID NO: 4437354 - DNA, 22 bp, Homo sapiens
taaaattttttaaaagttttga

SEQ ID NO: 4437355 - DNA, 18 bp, Homo sapiens
taaacaaagtttcagagt

SEQ ID NO: 4437356 - DNA, 23 bp, Homo sapiens
taaacaaagtttcagagtatatt

SEQ ID NO: 4437357 - DNA, 14 bp, Homo sapiens
taaacaaataaaat

SEQ ID NO: 4437358 - DNA, 18 bp, Homo sapiens
taaacaagtatttgttaa

SEQ ID NO: 4437359 - DNA, 20 bp, Homo sapiens
taaacaatctttcatgtctt

SEQ ID NO: 4437360 - DNA, 23 bp, Homo sapiens
taaacaatgatgccctgctccag

SEQ ID NO: 4437361 - DNA, 23 bp, Homo sapiens
taaacacaaaatccattccaggt

SEQ ID NO: 4437362 - DNA, 16 bp, Homo sapiens
taaacacatagattca

SEQ ID NO: 4437363 - DNA, 11 bp, Homo sapiens
taaacactgtg

SEQ ID NO: 4437364 - DNA, 19 bp, Homo sapiens
taaacacttatcttctgga

SEQ ID NO: 4437365 - DNA, 20 bp, Homo sapiens
taaacagaaattattttcta

SEQ ID NO: 4437366 - DNA, 16 bp, Homo sapiens
taaacagatgaataaa

SEQ ID NO: 4437367 - DNA, 17 bp, Homo sapiens
taaacagatttgattgt

SEQ ID NO: 4437368 - DNA, 12 bp, Homo sapiens
taaacagtgcct

SEQ ID NO: 4437369 - DNA, 18 bp, Homo sapiens
taaacagtgcctgctgaa

SEQ ID NO: 4437370 - DNA, 17 bp, Homo sapiens
taaacagttatttctgt

SEQ ID NO: 4437371 - DNA, 14 bp, Homo sapiens
taaacataaaaact

SEQ ID NO: 4437372 - DNA, 17 bp, Homo sapiens
taaacataattatttct

SEQ ID NO: 4437373 - DNA, 23 bp, Homo sapiens
taaacatatttttatactttatt

SEQ ID NO: 4437374 - DNA, 15 bp, Homo sapiens
taaacatcattcatt

SEQ ID NO: 4437375 - DNA, 13 bp, Homo sapiens
taaacatgcagaa

SEQ ID NO: 4437376 - DNA, 18 bp, Homo sapiens
taaacatgtttaaagtgt

SEQ ID NO: 4437377 - DNA, 21 bp, Homo sapiens
taaacattcaattccagagaa

SEQ ID NO: 4437378 - DNA, 15 bp, Homo sapiens
taaacattcctccag

SEQ ID NO: 4437379 - DNA, 21 bp, Homo sapiens
taaacattcctccagcctccc

SEQ ID NO: 4437380 - DNA, 14 bp, Homo sapiens
taaaccaaaaacat

SEQ ID NO: 4437381 - DNA, 16 bp, Homo sapiens
taaaccaaaaacattt

SEQ ID NO: 4437382 - DNA, 21 bp, Homo sapiens
taaaccaactctaatattgct

SEQ ID NO: 4437383 - DNA, 16 bp, Homo sapiens
taaaccacaagcatct

SEQ ID NO: 4437384 - DNA, 17 bp, Homo sapiens
taaaccacaagcatctc

SEQ ID NO: 4437385 - DNA, 12 bp, Homo sapiens
taaaccagtgtg

SEQ ID NO: 4437386 - DNA, 14 bp, Homo sapiens
taaaccagtgtgaa

SEQ ID NO: 4437387 - DNA, 18 bp, Homo sapiens
taaaccatttttgttact

SEQ ID NO: 4437388 - DNA, 19 bp, Homo sapiens
taaaccatttttgttactc

SEQ ID NO: 4437389 - DNA, 16 bp, Homo sapiens
taaacccaaaatatat

SEQ ID NO: 4437390 - DNA, 15 bp, Homo sapiens
taaaccctatctgtg

SEQ ID NO: 4437391 - DNA, 14 bp, Homo sapiens
taaaccctccttgg

SEQ ID NO: 4437392 - DNA, 15 bp, Homo sapiens
taaacctcagttatt

SEQ ID NO: 4437393 - DNA, 18 bp, Homo sapiens
taaacctggaacatctca

SEQ ID NO: 4437394 - DNA, 19 bp, Homo sapiens
taaacctgtagaatcaatt

SEQ ID NO: 4437395 - DNA, 19 bp, Homo sapiens
taaaccttaatatttcttc

SEQ ID NO: 4437396 - DNA, 14 bp, Homo sapiens
taaacggcccaggc

SEQ ID NO: 4437397 - DNA, 21 bp, Homo sapiens
taaacggtgcccatcctgcca

SEQ ID NO: 4437398 - DNA, 22 bp, Homo sapiens
taaacggtttttattaaagatg

SEQ ID NO: 4437399 - DNA, 14 bp, Homo sapiens
taaactaaaaacta

SEQ ID NO: 4437400 - DNA, 23 bp, Homo sapiens
taaactaatacgtgccagatata

SEQ ID NO: 4437401 - DNA, 15 bp, Homo sapiens
taaactactctttga

SEQ ID NO: 4437402 - DNA, 17 bp, Homo sapiens
taaactatttatatcac

SEQ ID NO: 4437403 - DNA, 18 bp, Homo sapiens
taaactatttatatcaca

SEQ ID NO: 4437404 - DNA, 16 bp, Homo sapiens
taaactatttttttct

SEQ ID NO: 4437405 - DNA, 21 bp, Homo sapiens
taaactcaaatgtaatagttt

SEQ ID NO: 4437406 - DNA, 14 bp, Homo sapiens
taaactctaaagat

SEQ ID NO: 4437407 - DNA, 17 bp, Homo sapiens
taaactctgcatccaga

SEQ ID NO: 4437408 - DNA, 22 bp, Homo sapiens
taaactctggacactctatatg

SEQ ID NO: 4437409 - DNA, 22 bp, Homo sapiens
taaactggaattaaaaggatag

SEQ ID NO: 4437410 - DNA, 20 bp, Homo sapiens
taaactggtattttatcttt

SEQ ID NO: 4437411 - DNA, 21 bp, Homo sapiens
taaactgttaacttattcaaa

SEQ ID NO: 4437412 - DNA, 14 bp, Homo sapiens
taaacttcacctac

SEQ ID NO: 4437413 - DNA, 12 bp, Homo sapiens
taaacttcagca

SEQ ID NO: 4437414 - DNA, 13 bp, Homo sapiens
taaacttccaaag

SEQ ID NO: 4437415 - DNA, 15 bp, Homo sapiens
taaacttccaaagaa

SEQ ID NO: 4437416 - DNA, 14 bp, Homo sapiens
taaacttgaaatat

SEQ ID NO: 4437417 - DNA, 21 bp, Homo sapiens
taaacttgaaatatataatat

SEQ ID NO: 4437418 - DNA, 16 bp, Homo sapiens
taaacttgtaaagaca

SEQ ID NO: 4437419 - DNA, 22 bp, Homo sapiens
taaacttgtttgctgtgaacaa

SEQ ID NO: 4437420 - DNA, 14 bp, Homo sapiens
taaactttcaatat

SEQ ID NO: 4437421 - DNA, 13 bp, Homo sapiens
taaactttgtcac

SEQ ID NO: 4437422 - DNA, 19 bp, Homo sapiens
taaactttgtcacttctgc

SEQ ID NO: 4437423 - DNA, 14 bp, Homo sapiens
taaacttttaccac

SEQ ID NO: 4437424 - DNA, 15 bp, Homo sapiens
taaagaaaggaaaag

SEQ ID NO: 4437425 - DNA, 14 bp, Homo sapiens
taaagaaagtgtat

SEQ ID NO: 4437426 - DNA, 22 bp, Homo sapiens
taaagaacccctcgttagcctt

SEQ ID NO: 4437427 - DNA, 20 bp, Homo sapiens
taaagaagaaacttgtaaat

SEQ ID NO: 4437428 - DNA, 21 bp, Homo sapiens
taaagaagaaacttgtaaata

SEQ ID NO: 4437429 - DNA, 20 bp, Homo sapiens
taaagaagggatattaagaa

SEQ ID NO: 4437430 - DNA, 13 bp, Homo sapiens
taaagaatacttg

SEQ ID NO: 4437431 - DNA, 15 bp, Homo sapiens
taaagaatacttgaa

SEQ ID NO: 4437432 - DNA, 16 bp, Homo sapiens
taaagaatacttgaac

SEQ ID NO: 4437433 - DNA, 18 bp, Homo sapiens
taaagaatacttgaactt

SEQ ID NO: 4437434 - DNA, 16 bp, Homo sapiens
taaagaatatgacttt

SEQ ID NO: 4437435 - DNA, 21 bp, Homo sapiens
taaagacaaataaatgattat

SEQ ID NO: 4437436 - DNA, 15 bp, Homo sapiens
taaagaccagaaatt

SEQ ID NO: 4437437 - DNA, 19 bp, Homo sapiens
taaagacccagggggagaa

SEQ ID NO: 4437438 - DNA, 22 bp, Homo sapiens
taaagactggttttctgccaat

SEQ ID NO: 4437439 - DNA, 13 bp, Homo sapiens
taaagagaaactt

SEQ ID NO: 4437440 - DNA, 20 bp, Homo sapiens
taaagagaaactttgtgcta

SEQ ID NO: 4437441 - DNA, 15 bp, Homo sapiens
taaagagcccttgcc

SEQ ID NO: 4437442 - DNA, 15 bp, Homo sapiens
taaagagtgtgttat

SEQ ID NO: 4437443 - DNA, 17 bp, Homo sapiens
taaagataagtctacat

SEQ ID NO: 4437444 - DNA, 19 bp, Homo sapiens
taaagataatcgaagcaaa

SEQ ID NO: 4437445 - DNA, 14 bp, Homo sapiens
taaagatacatgat

SEQ ID NO: 4437446 - DNA, 21 bp, Homo sapiens
taaagatatttttatctttat

SEQ ID NO: 4437447 - DNA, 15 bp, Homo sapiens
taaagatggttttga

SEQ ID NO: 4437448 - DNA, 23 bp, Homo sapiens
taaagattagggaaaatggatat

SEQ ID NO: 4437449 - DNA, 21 bp, Homo sapiens
taaagattttgttttgttgga

SEQ ID NO: 4437450 - DNA, 16 bp, Homo sapiens
taaagattttttaata

SEQ ID NO: 4437451 - DNA, 21 bp, Homo sapiens
taaagattttttaataattta

SEQ ID NO: 4437452 - DNA, 17 bp, Homo sapiens
taaagcaatatgcattt

SEQ ID NO: 4437453 - DNA, 19 bp, Homo sapiens
taaagcactggtttcaaga

SEQ ID NO: 4437454 - DNA, 21 bp, Homo sapiens
taaagcactggtttcaagaat

SEQ ID NO: 4437455 - DNA, 16 bp, Homo sapiens
taaagcagtgtttgct

SEQ ID NO: 4437456 - DNA, 17 bp, Homo sapiens
taaagccattctgatta

SEQ ID NO: 4437457 - DNA, 18 bp, Homo sapiens
taaagcctgaatttggga

SEQ ID NO: 4437458 - DNA, 18 bp, Homo sapiens
taaagccttttgctttat

SEQ ID NO: 4437459 - DNA, 17 bp, Homo sapiens
taaagcgcaaatgaatt

SEQ ID NO: 4437460 - DNA, 14 bp, Homo sapiens
taaagctagaaatg

SEQ ID NO: 4437461 - DNA, 15 bp, Homo sapiens
taaagctagaaatga

SEQ ID NO: 4437462 - DNA, 19 bp, Homo sapiens
taaagctcaaatgaaatgt

SEQ ID NO: 4437463 - DNA, 15 bp, Homo sapiens
taaagctggtttaat

SEQ ID NO: 4437464 - DNA, 16 bp, Homo sapiens
taaagcttaggtcaaa

SEQ ID NO: 4437465 - DNA, 16 bp, Homo sapiens
taaagcttatccataa

SEQ ID NO: 4437466 - DNA, 17 bp, Homo sapiens
taaagcttctataaaat

SEQ ID NO: 4437467 - DNA, 23 bp, Homo sapiens
taaagcttgatttgatctttgtt

SEQ ID NO: 4437468 - DNA, 21 bp, Homo sapiens
taaaggcagacagttttgctt

SEQ ID NO: 4437469 - DNA, 10 bp, Homo sapiens
taaaggcagc

SEQ ID NO: 4437470 - DNA, 13 bp, Homo sapiens
taaaggcagctgc

SEQ ID NO: 4437471 - DNA, 14 bp, Homo sapiens
taaaggcagctgcc

SEQ ID NO: 4437472 - DNA, 16 bp, Homo sapiens
taaaggcagctgcctc

SEQ ID NO: 4437473 - DNA, 22 bp, Homo sapiens
taaaggcagctgcctctgctcc

SEQ ID NO: 4437474 - DNA, 14 bp, Homo sapiens
taaaggcagttttc

SEQ ID NO: 4437475 - DNA, 17 bp, Homo sapiens
taaaggccgtcatttca

SEQ ID NO: 4437476 - DNA, 22 bp, Homo sapiens
taaaggcctttaataagtcatt

SEQ ID NO: 4437477 - DNA, 15 bp, Homo sapiens
taaagggagaaatgc

SEQ ID NO: 4437478 - DNA, 17 bp, Homo sapiens
taaagggagaaatgcca

SEQ ID NO: 4437479 - DNA, 19 bp, Homo sapiens
taaaggtgtcttcctccca

SEQ ID NO: 4437480 - DNA, 20 bp, Homo sapiens
taaaggtgtcttcctcccaa

SEQ ID NO: 4437481 - DNA, 22 bp, Homo sapiens
taaaggttacaagcctgcacaa

SEQ ID NO: 4437482 - DNA, 21 bp, Homo sapiens
taaaggtttatttttctgtta

SEQ ID NO: 4437483 - DNA, 18 bp, Homo sapiens
taaagtacagcctggacc

SEQ ID NO: 4437484 - DNA, 16 bp, Homo sapiens
taaagtacctttatgt

SEQ ID NO: 4437485 - DNA, 13 bp, Homo sapiens
taaagtagttatt

SEQ ID NO: 4437486 - DNA, 21 bp, Homo sapiens
taaagtagttattttataggg

SEQ ID NO: 4437487 - DNA, 17 bp, Homo sapiens
taaagtatcttgcactg

SEQ ID NO: 4437488 - DNA, 14 bp, Homo sapiens
taaagtattcttct

SEQ ID NO: 4437489 - DNA, 23 bp, Homo sapiens
taaagtattctttttctttttta

SEQ ID NO: 4437490 - DNA, 13 bp, Homo sapiens
taaagtatttata

SEQ ID NO: 4437491 - DNA, 17 bp, Homo sapiens
taaagtatttgatgtac

SEQ ID NO: 4437492 - DNA, 18 bp, Homo sapiens
taaagtatttgatgtaca

SEQ ID NO: 4437493 - DNA, 15 bp, Homo sapiens
taaagtattttaatt

SEQ ID NO: 4437494 - DNA, 18 bp, Homo sapiens
taaagtcacacatttcta

SEQ ID NO: 4437495 - DNA, 17 bp, Homo sapiens
taaagtcacatccctgt

SEQ ID NO: 4437496 - DNA, 15 bp, Homo sapiens
taaagtgaactttgt

SEQ ID NO: 4437497 - DNA, 23 bp, Homo sapiens
taaagtgcaatgggtaagggagg

SEQ ID NO: 4437498 - DNA, 15 bp, Homo sapiens
taaagtgccttctgg

SEQ ID NO: 4437499 - DNA, 19 bp, Homo sapiens
taaagtggttctctgcctt

SEQ ID NO: 4437500 - DNA, 15 bp, Homo sapiens
gtgttgtgtgtggga

SEQ ID NO: 4437501 - DNA, 19 bp, Homo sapiens
gtgtttcattacttgaatg

SEQ ID NO: 4437502 - DNA, 23 bp, Homo sapiens
gtgtttcctcatctatggttcta

SEQ ID NO: 4437503 - DNA, 22 bp, Homo sapiens
gtgtttctagcactggcctgca

SEQ ID NO: 4437504 - DNA, 13 bp, Homo sapiens
gtgtttctgtcct

SEQ ID NO: 4437505 - DNA, 20 bp, Homo sapiens
gtgtttctgtcctgtaactg

SEQ ID NO: 4437506 - DNA, 15 bp, Homo sapiens
gtgtttgactgtaat

SEQ ID NO: 4437507 - DNA, 23 bp, Homo sapiens
gtgtttgcctaaaacaatctaaa

SEQ ID NO: 4437508 - DNA, 14 bp, Homo sapiens
gtgtttgtctgtgt

SEQ ID NO: 4437509 - DNA, 16 bp, Homo sapiens
gtgtttgtgagcatgg

SEQ ID NO: 4437510 - DNA, 20 bp, Homo sapiens
gtgttttcatcatttcagcc

SEQ ID NO: 4437511 - DNA, 14 bp, Homo sapiens
gtgttttgtaccag

SEQ ID NO: 4437512 - DNA, 13 bp, Homo sapiens
gtgttttgtcttt

SEQ ID NO: 4437513 - DNA, 18 bp, Homo sapiens
gtgttttgttttggactc

SEQ ID NO: 4437514 - DNA, 23 bp, Homo sapiens
gtgttttgttttggactctctgt

SEQ ID NO: 4437515 - DNA, 19 bp, Homo sapiens
gtgtttttctcatatttga

SEQ ID NO: 4437516 - DNA, 15 bp, Homo sapiens
gtgtttttctccagt

SEQ ID NO: 4437517 - DNA, 19 bp, Homo sapiens
gtgtttttgggatgtctta

SEQ ID NO: 4437518 - DNA, 21 bp, Homo sapiens
gtgttttttaagatagtgtaa

SEQ ID NO: 4437519 - DNA, 15 bp, Homo sapiens
gtgtttttttctaaa

SEQ ID NO: 4437520 - DNA, 18 bp, Homo sapiens
gttaaaaaacaaatgttc

SEQ ID NO: 4437521 - DNA, 21 bp, Homo sapiens
gttaaaaattaaatatttatt

SEQ ID NO: 4437522 - DNA, 12 bp, Homo sapiens
gttaaaacatag

SEQ ID NO: 4437523 - DNA, 19 bp, Homo sapiens
gttaaacggtgcccatcct

SEQ ID NO: 4437524 - DNA, 19 bp, Homo sapiens
gttaaacttacttagtgtt

SEQ ID NO: 4437525 - DNA, 11 bp, Homo sapiens
gttaaagctaa

SEQ ID NO: 4437526 - DNA, 15 bp, Homo sapiens
gttaaagctaaactg

SEQ ID NO: 4437527 - DNA, 20 bp, Homo sapiens
gttaaagtcacacatttcta

SEQ ID NO: 4437528 - DNA, 16 bp, Homo sapiens
gttaaatacaggaaac

SEQ ID NO: 4437529 - DNA, 14 bp, Homo sapiens
gttaaattcagtaa

SEQ ID NO: 4437530 - DNA, 19 bp, Homo sapiens
gttaacatagtaagttcag

SEQ ID NO: 4437531 - DNA, 17 bp, Homo sapiens
gttaactattgcattta

SEQ ID NO: 4437532 - DNA, 18 bp, Homo sapiens
gttaactgtgaaatacca

SEQ ID NO: 4437533 - DNA, 14 bp, Homo sapiens
gttaacttggtcag

SEQ ID NO: 4437534 - DNA, 17 bp, Homo sapiens
gttaagacatgatttcc

SEQ ID NO: 4437535 - DNA, 19 bp, Homo sapiens
gttaagacatgatttcctt

SEQ ID NO: 4437536 - DNA, 18 bp, Homo sapiens
gttaagcattaccactca

SEQ ID NO: 4437537 - DNA, 21 bp, Homo sapiens
gttaagcattaccactcaggc

SEQ ID NO: 4437538 - DNA, 12 bp, Homo sapiens
gttaaggacttc

SEQ ID NO: 4437539 - DNA, 19 bp, Homo sapiens
gttaaggacttctgcagct

SEQ ID NO: 4437540 - DNA, 23 bp, Homo sapiens
gttaagttggcttctgtttctag

SEQ ID NO: 4437541 - DNA, 14 bp, Homo sapiens
gttaatacatcaca

SEQ ID NO: 4437542 - DNA, 22 bp, Homo sapiens
gttaatacatcacatcttattt

SEQ ID NO: 4437543 - DNA, 12 bp, Homo sapiens
gttaatataccc

SEQ ID NO: 4437544 - DNA, 18 bp, Homo sapiens
gttaatatcactcattaa

SEQ ID NO: 4437545 - DNA, 13 bp, Homo sapiens
gttaatgcattgt

SEQ ID NO: 4437546 - DNA, 19 bp, Homo sapiens
gttaatgcattgttgtaaa

SEQ ID NO: 4437547 - DNA, 20 bp, Homo sapiens
gttaatgcattgttgtaaag

SEQ ID NO: 4437548 - DNA, 22 bp, Homo sapiens
gttaatgcattgttgtaaagta

SEQ ID NO: 4437549 - DNA, 19 bp, Homo sapiens
gttaatgtagtatggtata

SEQ ID NO: 4437550 - DNA, 18 bp, Homo sapiens
gttaattaaatatttctt

SEQ ID NO: 4437551 - DNA, 23 bp, Homo sapiens
gttaattcttaaaactataacat

SEQ ID NO: 4437552 - DNA, 19 bp, Homo sapiens
gttaatttagaaaacttta

SEQ ID NO: 4437553 - DNA, 17 bp, Homo sapiens
gttaatttataatgtat

SEQ ID NO: 4437554 - DNA, 14 bp, Homo sapiens
gttaatttatttag

SEQ ID NO: 4437555 - DNA, 18 bp, Homo sapiens
gttaattttattcaagaa

SEQ ID NO: 4437556 - DNA, 14 bp, Homo sapiens
gttaatttttccaa

SEQ ID NO: 4437557 - DNA, 12 bp, Homo sapiens
gttaatttttga

SEQ ID NO: 4437558 - DNA, 14 bp, Homo sapiens
gttaatttttgata

SEQ ID NO: 4437559 - DNA, 20 bp, Homo sapiens
gttaattttttggtacaaaa

SEQ ID NO: 4437560 - DNA, 17 bp, Homo sapiens
gttacaacttgtatttc

SEQ ID NO: 4437561 - DNA, 19 bp, Homo sapiens
gttacactgttagaacact

SEQ ID NO: 4437562 - DNA, 22 bp, Homo sapiens
gttacactgttagaacactatt

SEQ ID NO: 4437563 - DNA, 13 bp, Homo sapiens
gttacagttctgt

SEQ ID NO: 4437564 - DNA, 22 bp, Homo sapiens
gttacataaggatgactttttt

SEQ ID NO: 4437565 - DNA, 16 bp, Homo sapiens
gttaccaaatctcagt

SEQ ID NO: 4437566 - DNA, 20 bp, Homo sapiens
gttacccaggctggagtgca

SEQ ID NO: 4437567 - DNA, 22 bp, Homo sapiens
gttacctgaaaacactgtgcac

SEQ ID NO: 4437568 - DNA, 15 bp, Homo sapiens
gttaccttatagtta

SEQ ID NO: 4437569 - DNA, 22 bp, Homo sapiens
gttacggcatcacacttatatt

SEQ ID NO: 4437570 - DNA, 18 bp, Homo sapiens
gttacgtagcctaaggct

SEQ ID NO: 4437571 - DNA, 17 bp, Homo sapiens
gttacgtataatgcttt

SEQ ID NO: 4437572 - DNA, 18 bp, Homo sapiens
gttacgtttgaagtctga

SEQ ID NO: 4437573 - DNA, 14 bp, Homo sapiens
gttactcagccctg

SEQ ID NO: 4437574 - DNA, 18 bp, Homo sapiens
gttactcagccctgggcc

SEQ ID NO: 4437575 - DNA, 23 bp, Homo sapiens
gttactcccttctcgtgtttgct

SEQ ID NO: 4437576 - DNA, 22 bp, Homo sapiens
gttactctccaacctggacaac

SEQ ID NO: 4437577 - DNA, 11 bp, Homo sapiens
gttactctctt

SEQ ID NO: 4437578 - DNA, 23 bp, Homo sapiens
gttactgacttggatcccaaagc

SEQ ID NO: 4437579 - DNA, 19 bp, Homo sapiens
gttactggataaattgttt

SEQ ID NO: 4437580 - DNA, 16 bp, Homo sapiens
gttactgtcattccca

SEQ ID NO: 4437581 - DNA, 13 bp, Homo sapiens
gttactgtgtaat

SEQ ID NO: 4437582 - DNA, 15 bp, Homo sapiens
gttacttgcttcagt

SEQ ID NO: 4437583 - DNA, 12 bp, Homo sapiens
gttactttcaaa

SEQ ID NO: 4437584 - DNA, 12 bp, Homo sapiens
gttactttggca

SEQ ID NO: 4437585 - DNA, 13 bp, Homo sapiens
gttagaacactat

SEQ ID NO: 4437586 - DNA, 14 bp, Homo sapiens
gttagaacactatt

SEQ ID NO: 4437587 - DNA, 19 bp, Homo sapiens
gttagaacactattttcag

SEQ ID NO: 4437588 - DNA, 16 bp, Homo sapiens
gttagaaccacagcag

SEQ ID NO: 4437589 - DNA, 17 bp, Homo sapiens
gttagaactgattacat

SEQ ID NO: 4437590 - DNA, 19 bp, Homo sapiens
gttagaagaggcctttgga

SEQ ID NO: 4437591 - DNA, 18 bp, Homo sapiens
gttagaatagtggttaac

SEQ ID NO: 4437592 - DNA, 21 bp, Homo sapiens
gttagacttgctccctctcca

SEQ ID NO: 4437593 - DNA, 21 bp, Homo sapiens
gttagacttgtgtgcatggaa

SEQ ID NO: 4437594 - DNA, 20 bp, Homo sapiens
gttagagaactaaactagtt

SEQ ID NO: 4437595 - DNA, 23 bp, Homo sapiens
gttagagaactaaactagttttt

SEQ ID NO: 4437596 - DNA, 16 bp, Homo sapiens
gttagatgcttagtgt

SEQ ID NO: 4437597 - DNA, 21 bp, Homo sapiens
gttagcactgaactgctttta

SEQ ID NO: 4437598 - DNA, 15 bp, Homo sapiens
gttagcactgatagt

SEQ ID NO: 4437599 - DNA, 16 bp, Homo sapiens
gttaggctagagacag

SEQ ID NO: 4437600 - DNA, 20 bp, Homo sapiens
gttagtaatctgtataatac

SEQ ID NO: 4437601 - DNA, 16 bp, Homo sapiens
gttataaaataatgta

SEQ ID NO: 4437602 - DNA, 17 bp, Homo sapiens
gttataaaataatgtac

SEQ ID NO: 4437603 - DNA, 18 bp, Homo sapiens
gttataaaataatgtact

SEQ ID NO: 4437604 - DNA, 15 bp, Homo sapiens
gttataaagatacag

SEQ ID NO: 4437605 - DNA, 18 bp, Homo sapiens
gttatacagttataaaat

SEQ ID NO: 4437606 - DNA, 14 bp, Homo sapiens
gttatactgaacca

SEQ ID NO: 4437607 - DNA, 16 bp, Homo sapiens
gttatagccctgccct

SEQ ID NO: 4437608 - DNA, 21 bp, Homo sapiens
gttatagccctgccctcccaa

SEQ ID NO: 4437609 - DNA, 18 bp, Homo sapiens
gttataggattttcacac

SEQ ID NO: 4437610 - DNA, 18 bp, Homo sapiens
gttatatataataaatac

SEQ ID NO: 4437611 - DNA, 17 bp, Homo sapiens
gttatatattgtattaa

SEQ ID NO: 4437612 - DNA, 21 bp, Homo sapiens
gttatatattgtattaagggc

SEQ ID NO: 4437613 - DNA, 18 bp, Homo sapiens
gttatatcagcagacact

SEQ ID NO: 4437614 - DNA, 15 bp, Homo sapiens
gttatatttcagatg

SEQ ID NO: 4437615 - DNA, 13 bp, Homo sapiens
gttatcatgaatt

SEQ ID NO: 4437616 - DNA, 17 bp, Homo sapiens
gttatcatgaattttaa

SEQ ID NO: 4437617 - DNA, 22 bp, Homo sapiens
gttatcatgaattttaaagtat

SEQ ID NO: 4437618 - DNA, 16 bp, Homo sapiens
gttctaaatgcaataa

SEQ ID NO: 4437619 - DNA, 19 bp, Homo sapiens
gttctacggatcatcaaca

SEQ ID NO: 4437620 - DNA, 17 bp, Homo sapiens
gttctagacgcccctcc

SEQ ID NO: 4437621 - DNA, 20 bp, Homo sapiens
gttctagacgcccctcccaa

SEQ ID NO: 4437622 - DNA, 17 bp, Homo sapiens
gttctagacttccccat

SEQ ID NO: 4437623 - DNA, 22 bp, Homo sapiens
gttctatccaaacatgtattta

SEQ ID NO: 4437624 - DNA, 19 bp, Homo sapiens
gttctcaacatactgtaat

SEQ ID NO: 4437625 - DNA, 21 bp, Homo sapiens
gttctcaacatactgtaatca

SEQ ID NO: 4437626 - DNA, 17 bp, Homo sapiens
gttctcaagaatctaga

SEQ ID NO: 4437627 - DNA, 15 bp, Homo sapiens
gttctcagaaccatt

SEQ ID NO: 4437628 - DNA, 11 bp, Homo sapiens
gttctcagagc

SEQ ID NO: 4437629 - DNA, 13 bp, Homo sapiens
gttctcagagctc

SEQ ID NO: 4437630 - DNA, 16 bp, Homo sapiens
gttctcatctttcttg

SEQ ID NO: 4437631 - DNA, 14 bp, Homo sapiens
gttctccctttctc

SEQ ID NO: 4437632 - DNA, 16 bp, Homo sapiens
gttctccctttctctc

SEQ ID NO: 4437633 - DNA, 17 bp, Homo sapiens
gttctccctttctctct

SEQ ID NO: 4437634 - DNA, 20 bp, Homo sapiens
gttctccctttctctctcct

SEQ ID NO: 4437635 - DNA, 21 bp, Homo sapiens
gttctccctttctctctcctc

SEQ ID NO: 4437636 - DNA, 20 bp, Homo sapiens
gttctccgggtgtggcctca

SEQ ID NO: 4437637 - DNA, 16 bp, Homo sapiens
gttctcctgaatattt

SEQ ID NO: 4437638 - DNA, 16 bp, Homo sapiens
gttctgaaaggagaca

SEQ ID NO: 4437639 - DNA, 12 bp, Homo sapiens
gttctgccagga

SEQ ID NO: 4437640 - DNA, 13 bp, Homo sapiens
gttctgccaggag

SEQ ID NO: 4437641 - DNA, 14 bp, Homo sapiens
gttctgccaggaga

SEQ ID NO: 4437642 - DNA, 19 bp, Homo sapiens
gttctgctagagcagacag

SEQ ID NO: 4437643 - DNA, 20 bp, Homo sapiens
gttctgctagagcagacagg

SEQ ID NO: 4437644 - DNA, 15 bp, Homo sapiens
gttctgctcatcatt

SEQ ID NO: 4437645 - DNA, 14 bp, Homo sapiens
gttctgctctggtt

SEQ ID NO: 4437646 - DNA, 12 bp, Homo sapiens
gttctgctgtct

SEQ ID NO: 4437647 - DNA, 17 bp, Homo sapiens
gttctgcttttaagttt

SEQ ID NO: 4437648 - DNA, 17 bp, Homo sapiens
gttctggatggtgtgcc

SEQ ID NO: 4437649 - DNA, 16 bp, Homo sapiens
gttctggctgtttgag

SEQ ID NO: 4437650 - DNA, 21 bp, Homo sapiens
gttctgtagcttatctgcccc

SEQ ID NO: 4437651 - DNA, 23 bp, Homo sapiens
gttctgtagcttatctgcccctc

SEQ ID NO: 4437652 - DNA, 16 bp, Homo sapiens
gttctgtatataaata

SEQ ID NO: 4437653 - DNA, 16 bp, Homo sapiens
gttctgtgacccatct

SEQ ID NO: 4437654 - DNA, 15 bp, Homo sapiens
gttctgtgcctcccc

SEQ ID NO: 4437655 - DNA, 18 bp, Homo sapiens
gttctgtgcctcccccca

SEQ ID NO: 4437656 - DNA, 20 bp, Homo sapiens
gttctgtgcctccccccaga

SEQ ID NO: 4437657 - DNA, 16 bp, Homo sapiens
gttctgtggtttcatg

SEQ ID NO: 4437658 - DNA, 19 bp, Homo sapiens
gttctgtgtatttaattgt

SEQ ID NO: 4437659 - DNA, 13 bp, Homo sapiens
gttctgttctcat

SEQ ID NO: 4437660 - DNA, 13 bp, Homo sapiens
gttctgtttgctg

SEQ ID NO: 4437661 - DNA, 15 bp, Homo sapiens
gttcttaaaaaggaa

SEQ ID NO: 4437662 - DNA, 17 bp, Homo sapiens
gttcttacaagcttaaa

SEQ ID NO: 4437663 - DNA, 21 bp, Homo sapiens
gttcttacaagcttaaagctt

SEQ ID NO: 4437664 - DNA, 19 bp, Homo sapiens
gttcttagttgctgtatgt

SEQ ID NO: 4437665 - DNA, 15 bp, Homo sapiens
gttcttatgaggagg

SEQ ID NO: 4437666 - DNA, 20 bp, Homo sapiens
gttcttatgaggaggggagg

SEQ ID NO: 4437667 - DNA, 11 bp, Homo sapiens
gttcttcatga

SEQ ID NO: 4437668 - DNA, 15 bp, Homo sapiens
gttcttcctgtaatc

SEQ ID NO: 4437669 - DNA, 16 bp, Homo sapiens
gttcttggattacttt

SEQ ID NO: 4437670 - DNA, 15 bp, Homo sapiens
gttcttgggggaggc

SEQ ID NO: 4437671 - DNA, 16 bp, Homo sapiens
gttcttggtaactgat

SEQ ID NO: 4437672 - DNA, 14 bp, Homo sapiens
gttctttcctgccc

SEQ ID NO: 4437673 - DNA, 16 bp, Homo sapiens
gttctttcctgccctg

SEQ ID NO: 4437674 - DNA, 17 bp, Homo sapiens
gttctttcctgccctgt

SEQ ID NO: 4437675 - DNA, 19 bp, Homo sapiens
gttctttcctgccctgtcc

SEQ ID NO: 4437676 - DNA, 12 bp, Homo sapiens
gttctttctgaa

SEQ ID NO: 4437677 - DNA, 22 bp, Homo sapiens
gttctttgctgcccctgtctgg

SEQ ID NO: 4437678 - DNA, 15 bp, Homo sapiens
gttctttttaagtta

SEQ ID NO: 4437679 - DNA, 22 bp, Homo sapiens
gttctttttctgaactccattt

SEQ ID NO: 4437680 - DNA, 21 bp, Homo sapiens
gttgaaaaaatttaaaagtaa

SEQ ID NO: 4437681 - DNA, 21 bp, Homo sapiens
gttgaaaaagtttgtttttgc

SEQ ID NO: 4437682 - DNA, 15 bp, Homo sapiens
gttgaaaacttgtaa

SEQ ID NO: 4437683 - DNA, 13 bp, Homo sapiens
gttgaaaggtttt

SEQ ID NO: 4437684 - DNA, 20 bp, Homo sapiens
gttgaaaggttttttttcag

SEQ ID NO: 4437685 - DNA, 23 bp, Homo sapiens
gttgaaaggttttttttcagttg

SEQ ID NO: 4437686 - DNA, 15 bp, Homo sapiens
gttgaagacagcttc

SEQ ID NO: 4437687 - DNA, 19 bp, Homo sapiens
gttgaagagacagagacaa

SEQ ID NO: 4437688 - DNA, 16 bp, Homo sapiens
gttgaagcgcggaccc

SEQ ID NO: 4437689 - DNA, 17 bp, Homo sapiens
gttgaatactttttaca

SEQ ID NO: 4437690 - DNA, 13 bp, Homo sapiens
gttgaatgttgca

SEQ ID NO: 4437691 - DNA, 18 bp, Homo sapiens
gttgacatatttaatgtt

SEQ ID NO: 4437692 - DNA, 22 bp, Homo sapiens
gttgacatatttaatgttttaa

SEQ ID NO: 4437693 - DNA, 13 bp, Homo sapiens
gttgaccactcca

SEQ ID NO: 4437694 - DNA, 17 bp, Homo sapiens
gttgaccactccagaga

SEQ ID NO: 4437695 - DNA, 22 bp, Homo sapiens
gttgacccaaaaatgttccctt

SEQ ID NO: 4437696 - DNA, 16 bp, Homo sapiens
gttgagaatcccaaat

SEQ ID NO: 4437697 - DNA, 13 bp, Homo sapiens
gttgagctcaggt

SEQ ID NO: 4437698 - DNA, 22 bp, Homo sapiens
gttgagggaacagacaggagaa

SEQ ID NO: 4437699 - DNA, 23 bp, Homo sapiens
gttgagggtgacttttcctgctg

SEQ ID NO: 4437700 - DNA, 16 bp, Homo sapiens
gttgaggtttttaaat

SEQ ID NO: 4437701 - DNA, 20 bp, Homo sapiens
gttgataaaccaaaaacatt

SEQ ID NO: 4437702 - DNA, 14 bp, Homo sapiens
gttgatctttcact

SEQ ID NO: 4437703 - DNA, 15 bp, Homo sapiens
gttgatctttcacta

SEQ ID NO: 4437704 - DNA, 19 bp, Homo sapiens
gttgattaagaaaggaagt

SEQ ID NO: 4437705 - DNA, 19 bp, Homo sapiens
gttgattaatttctgccat

SEQ ID NO: 4437706 - DNA, 17 bp, Homo sapiens
gttgcaagatgtgaatt

SEQ ID NO: 4437707 - DNA, 14 bp, Homo sapiens
gttgcaagcccctc

SEQ ID NO: 4437708 - DNA, 16 bp, Homo sapiens
gttgcaaggccgctgt

SEQ ID NO: 4437709 - DNA, 23 bp, Homo sapiens
gttgcaaggccgctgttcaccca

SEQ ID NO: 4437710 - DNA, 17 bp, Homo sapiens
gttgcaagtactgctgt

SEQ ID NO: 4437711 - DNA, 16 bp, Homo sapiens
gttgcaatgtgaaaaa

SEQ ID NO: 4437712 - DNA, 19 bp, Homo sapiens
gttgcaccatctgcttggt

SEQ ID NO: 4437713 - DNA, 18 bp, Homo sapiens
gttgcacccagccctggt

SEQ ID NO: 4437714 - DNA, 16 bp, Homo sapiens
gttgcatagcagtata

SEQ ID NO: 4437715 - DNA, 18 bp, Homo sapiens
gttgcatagcagtatatg

SEQ ID NO: 4437716 - DNA, 20 bp, Homo sapiens
ggggctgctcctccagggcc

SEQ ID NO: 4437717 - DNA, 22 bp, Homo sapiens
ggggctggggtcacagaggcat

SEQ ID NO: 4437718 - DNA, 22 bp, Homo sapiens
ggggctgtggccgtctcctccc

SEQ ID NO: 4437719 - DNA, 14 bp, Homo sapiens
ggggcttgggcctg

SEQ ID NO: 4437720 - DNA, 17 bp, Homo sapiens
gggggaatgcacctccc

SEQ ID NO: 4437721 - DNA, 24 bp, Homo sapiens
gggggacaggatttggccacactg

SEQ ID NO: 4437722 - DNA, 17 bp, Homo sapiens
gggggaccgggcccctc

SEQ ID NO: 4437723 - DNA, 15 bp, Homo sapiens
gggggaggccacccc

SEQ ID NO: 4437724 - DNA, 22 bp, Homo sapiens
gggggcagtctgagagaggcca

SEQ ID NO: 4437725 - DNA, 22 bp, Homo sapiens
gggggccccgccagggctgggg

SEQ ID NO: 4437726 - DNA, 18 bp, Homo sapiens
gggggccgggcaggtcct

SEQ ID NO: 4437727 - DNA, 18 bp, Homo sapiens
gggggcgcggctgggagg

SEQ ID NO: 4437728 - DNA, 18 bp, Homo sapiens
gggggctcctgcccaggc

SEQ ID NO: 4437729 - DNA, 23 bp, Homo sapiens
gggggctcctgcccaggccacag

SEQ ID NO: 4437730 - DNA, 18 bp, Homo sapiens
gggggctggggtcacaga

SEQ ID NO: 4437731 - DNA, 22 bp, Homo sapiens
gggggctggggtcacagaggca

SEQ ID NO: 4437732 - DNA, 13 bp, Homo sapiens
ggggggacagaca

SEQ ID NO: 4437733 - DNA, 10 bp, Homo sapiens
gggggtggca

SEQ ID NO: 4437734 - DNA, 18 bp, Homo sapiens
gggggtgtcttccctgcc

SEQ ID NO: 4437735 - DNA, 20 bp, Homo sapiens
gggggtgtggctctgccctg

SEQ ID NO: 4437736 - DNA, 15 bp, Homo sapiens
ggggtaagccagagc

SEQ ID NO: 4437737 - DNA, 19 bp, Homo sapiens
ggggtaagccagagcctgg

SEQ ID NO: 4437738 - DNA, 15 bp, Homo sapiens
ggggtccatcccctt

SEQ ID NO: 4437739 - DNA, 22 bp, Homo sapiens
ggggtccctggagggcaagccc

SEQ ID NO: 4437740 - DNA, 19 bp, Homo sapiens
ggggtctccctctcctgcc

SEQ ID NO: 4437741 - DNA, 20 bp, Homo sapiens
ggggtctccctctcctgcct

SEQ ID NO: 4437742 - DNA, 21 bp, Homo sapiens
ggggtctccctggctccctcc

SEQ ID NO: 4437743 - DNA, 23 bp, Homo sapiens
ggggtctcttctgaataaagcaa

SEQ ID NO: 4437744 - DNA, 22 bp, Homo sapiens
ggggtgagagacctgctcaggc

SEQ ID NO: 4437745 - DNA, 17 bp, Homo sapiens
ggggtgcatctcctccc

SEQ ID NO: 4437746 - DNA, 14 bp, Homo sapiens
ggggtgccgcctgc

SEQ ID NO: 4437747 - DNA, 21 bp, Homo sapiens
ggggtgccttcactgggccag

SEQ ID NO: 4437748 - DNA, 17 bp, Homo sapiens
ggggtggaggaccgagg

SEQ ID NO: 4437749 - DNA, 19 bp, Homo sapiens
ggggtgtcttccctgcctg

SEQ ID NO: 4437750 - DNA, 22 bp, Homo sapiens
ggggttaacttggtcagagcca

SEQ ID NO: 4437751 - DNA, 18 bp, Homo sapiens
ggggttcctcaaattttt

SEQ ID NO: 4437752 - DNA, 13 bp, Homo sapiens
ggggttgccagag

SEQ ID NO: 4437753 - DNA, 16 bp, Homo sapiens
ggggttgccagaggcc

SEQ ID NO: 4437754 - DNA, 19 bp, Homo sapiens
ggggttgccagaggccctg

SEQ ID NO: 4437755 - DNA, 14 bp, Homo sapiens
gggtaagccagagc

SEQ ID NO: 4437756 - DNA, 13 bp, Homo sapiens
gggtaagggaggg

SEQ ID NO: 4437757 - DNA, 14 bp, Homo sapiens
gggtaagggaggga

SEQ ID NO: 4437758 - DNA, 18 bp, Homo sapiens
gggtacagatccccagcc

SEQ ID NO: 4437759 - DNA, 12 bp, Homo sapiens
gggtagcccgcc

SEQ ID NO: 4437760 - DNA, 22 bp, Homo sapiens
gggtagcccgcctgccagtcct

SEQ ID NO: 4437761 - DNA, 17 bp, Homo sapiens
gggtataagttgctgta

SEQ ID NO: 4437762 - DNA, 12 bp, Homo sapiens
gggtcacagagg

SEQ ID NO: 4437763 - DNA, 19 bp, Homo sapiens
gggtcacagaggcatagaa

SEQ ID NO: 4437764 - DNA, 15 bp, Homo sapiens
gggtcactggcctct

SEQ ID NO: 4437765 - DNA, 23 bp, Homo sapiens
gggtcactggcctctccccagga

SEQ ID NO: 4437766 - DNA, 19 bp, Homo sapiens
gggtcagacgcctgaggaa

SEQ ID NO: 4437767 - DNA, 23 bp, Homo sapiens
gggtcagagaaaatgagaaagga

SEQ ID NO: 4437768 - DNA, 17 bp, Homo sapiens
gggtcagtggccaggtg

SEQ ID NO: 4437769 - DNA, 22 bp, Homo sapiens
gggtcatgacaagatgggacag

SEQ ID NO: 4437770 - DNA, 12 bp, Homo sapiens
gggtcatgggcc

SEQ ID NO: 4437771 - DNA, 14 bp, Homo sapiens
gggtcatgggcctg

SEQ ID NO: 4437772 - DNA, 15 bp, Homo sapiens
gggtcatgggcctgt

SEQ ID NO: 4437773 - DNA, 13 bp, Homo sapiens
gggtccaggcccc

SEQ ID NO: 4437774 - DNA, 14 bp, Homo sapiens
gggtccagggaggg

SEQ ID NO: 4437775 - DNA, 19 bp, Homo sapiens
gggtccagtggatgccaca

SEQ ID NO: 4437776 - DNA, 20 bp, Homo sapiens
gggtcccaagctgggcccca

SEQ ID NO: 4437777 - DNA, 15 bp, Homo sapiens
gggtccggcctctcc

SEQ ID NO: 4437778 - DNA, 14 bp, Homo sapiens
gggtcctagcccag

SEQ ID NO: 4437779 - DNA, 15 bp, Homo sapiens
gggtcctagcccttc

SEQ ID NO: 4437780 - DNA, 16 bp, Homo sapiens
gggtcctagcccttcc

SEQ ID NO: 4437781 - DNA, 21 bp, Homo sapiens
gggtcctagcccttccctgag

SEQ ID NO: 4437782 - DNA, 13 bp, Homo sapiens
gggtcctggctcc

SEQ ID NO: 4437783 - DNA, 15 bp, Homo sapiens
gggtctccctctcct

SEQ ID NO: 4437784 - DNA, 16 bp, Homo sapiens
gggtctccctctcctg

SEQ ID NO: 4437785 - DNA, 19 bp, Homo sapiens
gggtctccctctcctgcct

SEQ ID NO: 4437786 - DNA, 13 bp, Homo sapiens
gggtctccctggc

SEQ ID NO: 4437787 - DNA, 17 bp, Homo sapiens
gggtctccctggctccc

SEQ ID NO: 4437788 - DNA, 20 bp, Homo sapiens
gggtctctctcggcccctgt

SEQ ID NO: 4437789 - DNA, 18 bp, Homo sapiens
gggtctgcgcttggtctt

SEQ ID NO: 4437790 - DNA, 14 bp, Homo sapiens
gggtctgggcagca

SEQ ID NO: 4437791 - DNA, 16 bp, Homo sapiens
gggtctgtctgctttg

SEQ ID NO: 4437792 - DNA, 18 bp, Homo sapiens
gggtgaccttcttgggga

SEQ ID NO: 4437793 - DNA, 15 bp, Homo sapiens
gggtgagagacctgc

SEQ ID NO: 4437794 - DNA, 16 bp, Homo sapiens
gggtgagagacctgct

SEQ ID NO: 4437795 - DNA, 24 bp, Homo sapiens
gggtgagagacctgctcaggcgtc

SEQ ID NO: 4437796 - DNA, 23 bp, Homo sapiens
gggtgagctctcaggccgagagc

SEQ ID NO: 4437797 - DNA, 13 bp, Homo sapiens
gggtgaggtaggc

SEQ ID NO: 4437798 - DNA, 18 bp, Homo sapiens
gggtgatggccagcccct

SEQ ID NO: 4437799 - DNA, 16 bp, Homo sapiens
gggtgatggccggctg

SEQ ID NO: 4437800 - DNA, 15 bp, Homo sapiens
gggtgatggggaggg

SEQ ID NO: 4437801 - DNA, 18 bp, Homo sapiens
gggtgccttcactgggcc

SEQ ID NO: 4437802 - DNA, 15 bp, Homo sapiens
gggtgctcctgtgct

SEQ ID NO: 4437803 - DNA, 15 bp, Homo sapiens
gggtgctgggaggag

SEQ ID NO: 4437804 - DNA, 20 bp, Homo sapiens
gggtgcttttatagaggcta

SEQ ID NO: 4437805 - DNA, 22 bp, Homo sapiens
gggtgcttttatagaggctagc

SEQ ID NO: 4437806 - DNA, 13 bp, Homo sapiens
gggtggaggaccg

SEQ ID NO: 4437807 - DNA, 14 bp, Homo sapiens
gggtggaggggtgt

SEQ ID NO: 4437808 - DNA, 12 bp, Homo sapiens
gggtggccacac

SEQ ID NO: 4437809 - DNA, 18 bp, Homo sapiens
gggtggccacacaggcag

SEQ ID NO: 4437810 - DNA, 22 bp, Homo sapiens
gggtggccacacaggcagggcc

SEQ ID NO: 4437811 - DNA, 23 bp, Homo sapiens
gggtggccacacaggcagggcct

SEQ ID NO: 4437812 - DNA, 16 bp, Homo sapiens
gggtggctagtcagag

SEQ ID NO: 4437813 - DNA, 14 bp, Homo sapiens
gggtgggaagaaag

SEQ ID NO: 4437814 - DNA, 16 bp, Homo sapiens
gggtgggaagaaagaa

SEQ ID NO: 4437815 - DNA, 20 bp, Homo sapiens
gggtgggcctggccctgctt

SEQ ID NO: 4437816 - DNA, 13 bp, Homo sapiens
gggtggggagatg

SEQ ID NO: 4437817 - DNA, 16 bp, Homo sapiens
gggtgggggtgggtca

SEQ ID NO: 4437818 - DNA, 12 bp, Homo sapiens
gggtggggtgga

SEQ ID NO: 4437819 - DNA, 22 bp, Homo sapiens
gggtgtatagtgttcacaaact

SEQ ID NO: 4437820 - DNA, 20 bp, Homo sapiens
gggtgtcaagtgcctgcacc

SEQ ID NO: 4437821 - DNA, 21 bp, Homo sapiens
gggtgtcaagtgcctgcacca

SEQ ID NO: 4437822 - DNA, 17 bp, Homo sapiens
gggtgtcttccctgcct

SEQ ID NO: 4437823 - DNA, 18 bp, Homo sapiens
gggtgtggcctcagccct

SEQ ID NO: 4437824 - DNA, 16 bp, Homo sapiens
gggtgtggggtggggt

SEQ ID NO: 4437825 - DNA, 14 bp, Homo sapiens
gggtgttctttcct

SEQ ID NO: 4437826 - DNA, 21 bp, Homo sapiens
gggtgttctttcctgccctgt

SEQ ID NO: 4437827 - DNA, 21 bp, Homo sapiens
gggttaacttggtcagagcca

SEQ ID NO: 4437828 - DNA, 17 bp, Homo sapiens
gggttcacacagcccag

SEQ ID NO: 4437829 - DNA, 13 bp, Homo sapiens
gggttcaggggac

SEQ ID NO: 4437830 - DNA, 14 bp, Homo sapiens
gggttcatgatgca

SEQ ID NO: 4437831 - DNA, 19 bp, Homo sapiens
gggttctagacgcccctcc

SEQ ID NO: 4437832 - DNA, 14 bp, Homo sapiens
gggttgagagccag

SEQ ID NO: 4437833 - DNA, 13 bp, Homo sapiens
gggttgccagagg

SEQ ID NO: 4437834 - DNA, 21 bp, Homo sapiens
gtctccctctcctgcctactc

SEQ ID NO: 4437835 - DNA, 19 bp, Homo sapiens
gtctcctcactctgtccct

SEQ ID NO: 4437836 - DNA, 22 bp, Homo sapiens
gtctcctcagggtggggggtga

SEQ ID NO: 4437837 - DNA, 12 bp, Homo sapiens
gtctcctccctc

SEQ ID NO: 4437838 - DNA, 15 bp, Homo sapiens
gtctcctccctcagc

SEQ ID NO: 4437839 - DNA, 19 bp, Homo sapiens
gtctcctccctcagctctc

SEQ ID NO: 4437840 - DNA, 13 bp, Homo sapiens
gtctcctctttaa

SEQ ID NO: 4437841 - DNA, 18 bp, Homo sapiens
gtctcctctttaaaacaa

SEQ ID NO: 4437842 - DNA, 14 bp, Homo sapiens
gtctcgctctgtcg

SEQ ID NO: 4437843 - DNA, 16 bp, Homo sapiens
gtctcggactaagcct

SEQ ID NO: 4437844 - DNA, 23 bp, Homo sapiens
gtctcggcatagtccccagagct

SEQ ID NO: 4437845 - DNA, 23 bp, Homo sapiens
gtctcgggtggctagtcagagag

SEQ ID NO: 4437846 - DNA, 16 bp, Homo sapiens
gtctctaaaaagaagc

SEQ ID NO: 4437847 - DNA, 16 bp, Homo sapiens
gtctctactaaaaata

SEQ ID NO: 4437848 - DNA, 13 bp, Homo sapiens
gtctctatttaaa

SEQ ID NO: 4437849 - DNA, 19 bp, Homo sapiens
gtctctatttaaattcttt

SEQ ID NO: 4437850 - DNA, 21 bp, Homo sapiens
gtctctatttaaattcttttt

SEQ ID NO: 4437851 - DNA, 21 bp, Homo sapiens
gtctctcctgtaagccaaaga

SEQ ID NO: 4437852 - DNA, 12 bp, Homo sapiens
gtctctctccca

SEQ ID NO: 4437853 - DNA, 16 bp, Homo sapiens
gtctctctcccatgga

SEQ ID NO: 4437854 - DNA, 17 bp, Homo sapiens
gtctctctcccatggag

SEQ ID NO: 4437855 - DNA, 17 bp, Homo sapiens
gtctctctcggcccctg

SEQ ID NO: 4437856 - DNA, 22 bp, Homo sapiens
gtctctcttcagactctcagcc

SEQ ID NO: 4437857 - DNA, 15 bp, Homo sapiens
gtctctcttctctcc

SEQ ID NO: 4437858 - DNA, 19 bp, Homo sapiens
gtctctcttctctccagct

SEQ ID NO: 4437859 - DNA, 19 bp, Homo sapiens
gtctctcttggacccacct

SEQ ID NO: 4437860 - DNA, 12 bp, Homo sapiens
gtctctgaaggg

SEQ ID NO: 4437861 - DNA, 21 bp, Homo sapiens
gtctctgaaggtaagatcatt

SEQ ID NO: 4437862 - DNA, 23 bp, Homo sapiens
gtctctgatacacagtaattgtg

SEQ ID NO: 4437863 - DNA, 19 bp, Homo sapiens
gtctctgggccacttggag

SEQ ID NO: 4437864 - DNA, 16 bp, Homo sapiens
gtctctggtagcctgc

SEQ ID NO: 4437865 - DNA, 22 bp, Homo sapiens
gtctcttacatctccttgatca

SEQ ID NO: 4437866 - DNA, 12 bp, Homo sapiens
gtctgaaactgg

SEQ ID NO: 4437867 - DNA, 14 bp, Homo sapiens
gtctgaaactggct

SEQ ID NO: 4437868 - DNA, 22 bp, Homo sapiens
gtctgaaaggctatcctgctga

SEQ ID NO: 4437869 - DNA, 18 bp, Homo sapiens
gtctgaagaaggaaggcc

SEQ ID NO: 4437870 - DNA, 15 bp, Homo sapiens
gtctgaagctcgcat

SEQ ID NO: 4437871 - DNA, 17 bp, Homo sapiens
gtctgaagctcgcatcc

SEQ ID NO: 4437872 - DNA, 13 bp, Homo sapiens
gtctgaatatttt

SEQ ID NO: 4437873 - DNA, 13 bp, Homo sapiens
gtctgagagaggc

SEQ ID NO: 4437874 - DNA, 15 bp, Homo sapiens
gtctgagagaggcca

SEQ ID NO: 4437875 - DNA, 16 bp, Homo sapiens
gtctgaggcccctgcc

SEQ ID NO: 4437876 - DNA, 17 bp, Homo sapiens
gtctgaggcccctgcct

SEQ ID NO: 4437877 - DNA, 19 bp, Homo sapiens
gtctgaggcccctgcctcc

SEQ ID NO: 4437878 - DNA, 22 bp, Homo sapiens
gtctgaggggcaactgagtctg

SEQ ID NO: 4437879 - DNA, 17 bp, Homo sapiens
gtctgagtcctgtctct

SEQ ID NO: 4437880 - DNA, 22 bp, Homo sapiens
gtctgagtcctgtctctgcctg

SEQ ID NO: 4437881 - DNA, 22 bp, Homo sapiens
gtctgatctgtgctttccagct

SEQ ID NO: 4437882 - DNA, 24 bp, Homo sapiens
gtctgatctgtgctttccagctca

SEQ ID NO: 4437883 - DNA, 15 bp, Homo sapiens
gtctgcaccttagaa

SEQ ID NO: 4437884 - DNA, 20 bp, Homo sapiens
gtctgcactcctttatctgt

SEQ ID NO: 4437885 - DNA, 22 bp, Homo sapiens
gtctgcctatgcactgaagagc

SEQ ID NO: 4437886 - DNA, 15 bp, Homo sapiens
gtctgcctgtcccca

SEQ ID NO: 4437887 - DNA, 18 bp, Homo sapiens
gtctgctaggcgctgggg

SEQ ID NO: 4437888 - DNA, 14 bp, Homo sapiens
gtctgctctgctgc

SEQ ID NO: 4437889 - DNA, 20 bp, Homo sapiens
gtctgctctgctgctctgac

SEQ ID NO: 4437890 - DNA, 13 bp, Homo sapiens
gtctgctgtagaa

SEQ ID NO: 4437891 - DNA, 19 bp, Homo sapiens
gtctggatcagtaaaatta

SEQ ID NO: 4437892 - DNA, 17 bp, Homo sapiens
gtctggcacagcctggc

SEQ ID NO: 4437893 - DNA, 19 bp, Homo sapiens
gtctggcacagcctggctg

SEQ ID NO: 4437894 - DNA, 21 bp, Homo sapiens
gtctggcaccatgttggcctc

SEQ ID NO: 4437895 - DNA, 23 bp, Homo sapiens
gtctggcaccatgttggcctctt

SEQ ID NO: 4437896 - DNA, 15 bp, Homo sapiens
gtctggcccaccagg

SEQ ID NO: 4437897 - DNA, 19 bp, Homo sapiens
gtctggcgttctcaagaat

SEQ ID NO: 4437898 - DNA, 21 bp, Homo sapiens
gtctggcgttctcaagaatct

SEQ ID NO: 4437899 - DNA, 16 bp, Homo sapiens
gtctggctttggcact

SEQ ID NO: 4437900 - DNA, 19 bp, Homo sapiens
gtctgggatatggctgccc

SEQ ID NO: 4437901 - DNA, 21 bp, Homo sapiens
gtctgggatatggctgcccag

SEQ ID NO: 4437902 - DNA, 21 bp, Homo sapiens
gtctggggacgttgctgagcc

SEQ ID NO: 4437903 - DNA, 23 bp, Homo sapiens
gtctggggacgttgctgagccag

SEQ ID NO: 4437904 - DNA, 15 bp, Homo sapiens
gtctggggtgtgggg

SEQ ID NO: 4437905 - DNA, 16 bp, Homo sapiens
gtctggggttcagccc

SEQ ID NO: 4437906 - DNA, 18 bp, Homo sapiens
gtctggggttcagcccct

SEQ ID NO: 4437907 - DNA, 23 bp, Homo sapiens
gtctggttcctgtgtgaccctgg

SEQ ID NO: 4437908 - DNA, 18 bp, Homo sapiens
gtctggttgggcagccag

SEQ ID NO: 4437909 - DNA, 18 bp, Homo sapiens
gtctgtatactcctgtca

SEQ ID NO: 4437910 - DNA, 23 bp, Homo sapiens
gtctgtatttatgtgtgaggagc

SEQ ID NO: 4437911 - DNA, 20 bp, Homo sapiens
gtctgtcaccagctatctgt

SEQ ID NO: 4437912 - DNA, 13 bp, Homo sapiens
gtctgtcaggggc

SEQ ID NO: 4437913 - DNA, 18 bp, Homo sapiens
gtctgtcaggggcttgga

SEQ ID NO: 4437914 - DNA, 13 bp, Homo sapiens
gtctgtgaagagc

SEQ ID NO: 4437915 - DNA, 17 bp, Homo sapiens
gtctgtgatctctgctg

SEQ ID NO: 4437916 - DNA, 21 bp, Homo sapiens
gtctgtgatctctgctgggga

SEQ ID NO: 4437917 - DNA, 16 bp, Homo sapiens
gtctgtgcacatgcct

SEQ ID NO: 4437918 - DNA, 11 bp, Homo sapiens
gtctgtgtgct

SEQ ID NO: 4437919 - DNA, 15 bp, Homo sapiens
gtctgtgtgctgttt

SEQ ID NO: 4437920 - DNA, 16 bp, Homo sapiens
gtctgtgtgggactgt

SEQ ID NO: 4437921 - DNA, 12 bp, Homo sapiens
gtctgtgtgtgt

SEQ ID NO: 4437922 - DNA, 15 bp, Homo sapiens
gtctgtgttgcttca

SEQ ID NO: 4437923 - DNA, 16 bp, Homo sapiens
gtctgtgttgcttcaa

SEQ ID NO: 4437924 - DNA, 16 bp, Homo sapiens
gtctgttatgctgtga

SEQ ID NO: 4437925 - DNA, 20 bp, Homo sapiens
gtctgttcccagcccctgca

SEQ ID NO: 4437926 - DNA, 21 bp, Homo sapiens
gtctgttcccagcccctgcag

SEQ ID NO: 4437927 - DNA, 22 bp, Homo sapiens
gtcttaaagcatttcaggccag

SEQ ID NO: 4437928 - DNA, 17 bp, Homo sapiens
gtcttaacctcagggag

SEQ ID NO: 4437929 - DNA, 19 bp, Homo sapiens
gtcttaactgtatttcagt

SEQ ID NO: 4437930 - DNA, 20 bp, Homo sapiens
gtcttaagatggaaatacag

SEQ ID NO: 4437931 - DNA, 21 bp, Homo sapiens
gtcttaagatggaaatacagt

SEQ ID NO: 4437932 - DNA, 23 bp, Homo sapiens
gtcttaagggtcactggcctctc

SEQ ID NO: 4437933 - DNA, 14 bp, Homo sapiens
gtcttaattaaaag

SEQ ID NO: 4437934 - DNA, 16 bp, Homo sapiens
gtcttaatttatttct

SEQ ID NO: 4437935 - DNA, 19 bp, Homo sapiens
gtcttagaagtggaccagg

SEQ ID NO: 4437936 - DNA, 22 bp, Homo sapiens
gtcttagaagtggaccaggaca

SEQ ID NO: 4437937 - DNA, 14 bp, Homo sapiens
gtcttatttttaga

SEQ ID NO: 4437938 - DNA, 20 bp, Homo sapiens
gtcttcattttttaatgtgc

SEQ ID NO: 4437939 - DNA, 15 bp, Homo sapiens
gtcttccacaaagaa

SEQ ID NO: 4437940 - DNA, 17 bp, Homo sapiens
gtcttccacaaagaaaa

SEQ ID NO: 4437941 - DNA, 13 bp, Homo sapiens
gtcttcccagggt

SEQ ID NO: 4437942 - DNA, 15 bp, Homo sapiens
gtcttccctacctca

SEQ ID NO: 4437943 - DNA, 13 bp, Homo sapiens
gtcttccctgcct

SEQ ID NO: 4437944 - DNA, 14 bp, Homo sapiens
gtcttccctgcctg

SEQ ID NO: 4437945 - DNA, 18 bp, Homo sapiens
gtcttccctgggctgcca

SEQ ID NO: 4437946 - DNA, 23 bp, Homo sapiens
gtcttcctcaaaataaagaagta

SEQ ID NO: 4437947 - DNA, 18 bp, Homo sapiens
gtcttcctgacactttaa

SEQ ID NO: 4437948 - DNA, 14 bp, Homo sapiens
gtcttctaaacttc

SEQ ID NO: 4437949 - DNA, 12 bp, Homo sapiens
gtcttctattta

SEQ ID NO: 4437950 - DNA, 17 bp, Homo sapiens
gtcttctgcctgttata

SEQ ID NO: 4437951 - DNA, 15 bp, Homo sapiens
gtcttgaaatgaaag

SEQ ID NO: 4437952 - DNA, 12 bp, Homo sapiens
gtcttgctctgt

SEQ ID NO: 4437953 - DNA, 15 bp, Homo sapiens
gtcttgctctgtcac

SEQ ID NO: 4437954 - DNA, 21 bp, Homo sapiens
gtcttggaagctgtttggaaa

SEQ ID NO: 4437955 - DNA, 22 bp, Homo sapiens
gtcttggaagctgtttggaaaa

SEQ ID NO: 4437956 - DNA, 15 bp, Homo sapiens
gtcttggtgtaattt

SEQ ID NO: 4437957 - DNA, 17 bp, Homo sapiens
gtcttgtatttaaaaac

SEQ ID NO: 4437958 - DNA, 19 bp, Homo sapiens
gtcttgtatttaaaaacat

SEQ ID NO: 4437959 - DNA, 13 bp, Homo sapiens
gtcttgtccccac

SEQ ID NO: 4437960 - DNA, 14 bp, Homo sapiens
gtcttgtccccacc

SEQ ID NO: 4437961 - DNA, 13 bp, Homo sapiens
gtctttaatcatt

SEQ ID NO: 4437962 - DNA, 13 bp, Homo sapiens
gtctttagctatt

SEQ ID NO: 4437963 - DNA, 14 bp, Homo sapiens
gtctttataaagct

SEQ ID NO: 4437964 - DNA, 21 bp, Homo sapiens
gtctttcattcggtgtgaact

SEQ ID NO: 4437965 - DNA, 19 bp, Homo sapiens
gtctttcattgctaagact

SEQ ID NO: 4437966 - DNA, 22 bp, Homo sapiens
gtctttccaaattatttcttaa

SEQ ID NO: 4437967 - DNA, 16 bp, Homo sapiens
gtctttctctcagtga

SEQ ID NO: 4437968 - DNA, 22 bp, Homo sapiens
gtctttctttggtgcctttcct

SEQ ID NO: 4437969 - DNA, 23 bp, Homo sapiens
gtctttgaactgcagcaatcaca

SEQ ID NO: 4437970 - DNA, 15 bp, Homo sapiens
gtctttgccttctct

SEQ ID NO: 4437971 - DNA, 20 bp, Homo sapiens
gtctttgtaatgtcaccacc

SEQ ID NO: 4437972 - DNA, 22 bp, Homo sapiens
gtctttgtaatgtcaccacctt

SEQ ID NO: 4437973 - DNA, 12 bp, Homo sapiens
gtcttttcaatc

SEQ ID NO: 4437974 - DNA, 23 bp, Homo sapiens
gtcttttcagaagcaagccagac

SEQ ID NO: 4437975 - DNA, 13 bp, Homo sapiens
gtgaaaaatgtca

SEQ ID NO: 4437976 - DNA, 17 bp, Homo sapiens
gtgaaaataagacaaaa

SEQ ID NO: 4437977 - DNA, 17 bp, Homo sapiens
gtgaaaatatacttgac

SEQ ID NO: 4437978 - DNA, 16 bp, Homo sapiens
gtgaaaatatttaaag

SEQ ID NO: 4437979 - DNA, 15 bp, Homo sapiens
gtgaaaatggtccag

SEQ ID NO: 4437980 - DNA, 16 bp, Homo sapiens
gtgaaaccccgtctct

SEQ ID NO: 4437981 - DNA, 19 bp, Homo sapiens
gtgaaacgtaattgtacaa

SEQ ID NO: 4437982 - DNA, 14 bp, Homo sapiens
gtgaaactttcatt

SEQ ID NO: 4437983 - DNA, 19 bp, Homo sapiens
gtgaaaggatatgaatctg

SEQ ID NO: 4437984 - DNA, 23 bp, Homo sapiens
gtgaaataccacaagcctgagaa

SEQ ID NO: 4437985 - DNA, 12 bp, Homo sapiens
gtgaaatatcat

SEQ ID NO: 4437986 - DNA, 13 bp, Homo sapiens
gtgaaatggccac

SEQ ID NO: 4437987 - DNA, 18 bp, Homo sapiens
gtgaaatttctagcctgc

SEQ ID NO: 4437988 - DNA, 17 bp, Homo sapiens
gtgaaccagagggtgtg

SEQ ID NO: 4437989 - DNA, 22 bp, Homo sapiens
gtgaactcaccctgggagccag

SEQ ID NO: 4437990 - DNA, 14 bp, Homo sapiens
gtgaactctggtgc

SEQ ID NO: 4437991 - DNA, 13 bp, Homo sapiens
gtgaactggaaga

SEQ ID NO: 4437992 - DNA, 18 bp, Homo sapiens
gtgaactggaagaaagca

SEQ ID NO: 4437993 - DNA, 16 bp, Homo sapiens
gtgaacttgactgggt

SEQ ID NO: 4437994 - DNA, 15 bp, Homo sapiens
gtgaacttgtctggc

SEQ ID NO: 4437995 - DNA, 19 bp, Homo sapiens
gtgaacttgtctggctttg

SEQ ID NO: 4437996 - DNA, 22 bp, Homo sapiens
gtgaacttgtctggctttggca

SEQ ID NO: 4437997 - DNA, 22 bp, Homo sapiens
gtgaagaaagcctgttgtttaa

SEQ ID NO: 4437998 - DNA, 9 bp, Homo sapiens
gtgaagaat

SEQ ID NO: 4437999 - DNA, 14 bp, Homo sapiens
gtgaagaatacttc

SEQ ID NO: 4438000 - DNA, 17 bp, Homo sapiens
gtgaagaatttagatct

SEQ ID NO: 4438001 - DNA, 19 bp, Homo sapiens
gtgaagaatttagatctta

SEQ ID NO: 4438002 - DNA, 16 bp, Homo sapiens
gtgaagagtttcacaa

SEQ ID NO: 4438003 - DNA, 14 bp, Homo sapiens
gtgaaggcttctct

SEQ ID NO: 4438004 - DNA, 18 bp, Homo sapiens
gtgaagtgagaactccat

SEQ ID NO: 4438005 - DNA, 20 bp, Homo sapiens
gtgaagttttccttgctatt

SEQ ID NO: 4438006 - DNA, 23 bp, Homo sapiens
gtgaagttttccttgctatttca

SEQ ID NO: 4438007 - DNA, 18 bp, Homo sapiens
gtgaataaaaattgatga

SEQ ID NO: 4438008 - DNA, 14 bp, Homo sapiens
gtgaatataaatga

SEQ ID NO: 4438009 - DNA, 17 bp, Homo sapiens
gtgaatataaatgtgtg

SEQ ID NO: 4438010 - DNA, 21 bp, Homo sapiens
gtgaatatttgtaaaaataat

SEQ ID NO: 4438011 - DNA, 13 bp, Homo sapiens
gtgaatggaggca

SEQ ID NO: 4438012 - DNA, 14 bp, Homo sapiens
gtgaatggaggcag

SEQ ID NO: 4438013 - DNA, 13 bp, Homo sapiens
gtgaatgtctcag

SEQ ID NO: 4438014 - DNA, 19 bp, Homo sapiens
gtgaatgtggcagtttaaa

SEQ ID NO: 4438015 - DNA, 17 bp, Homo sapiens
gtgacaaaattcatttg

SEQ ID NO: 4438016 - DNA, 20 bp, Homo sapiens
gtgacaaataagattaataa

SEQ ID NO: 4438017 - DNA, 15 bp, Homo sapiens
gtgacacctccccct

SEQ ID NO: 4438018 - DNA, 15 bp, Homo sapiens
gtgacacgcttctga

SEQ ID NO: 4438019 - DNA, 18 bp, Homo sapiens
gtgacacgcttctgagca

SEQ ID NO: 4438020 - DNA, 20 bp, Homo sapiens
gtgacacgcttctgagcagg

SEQ ID NO: 4438021 - DNA, 18 bp, Homo sapiens
gtgacagagcgagactcc

SEQ ID NO: 4438022 - DNA, 16 bp, Homo sapiens
gtgacaggaaagccct

SEQ ID NO: 4438023 - DNA, 17 bp, Homo sapiens
gtgacaggaaagccctc

SEQ ID NO: 4438024 - DNA, 18 bp, Homo sapiens
gtgacatcggaaaaataa

SEQ ID NO: 4438025 - DNA, 22 bp, Homo sapiens
gtgacatggtgcctgagaggca

SEQ ID NO: 4438026 - DNA, 19 bp, Homo sapiens
gtgacattttacattaaat

SEQ ID NO: 4438027 - DNA, 20 bp, Homo sapiens
gtgacattttacattaaatt

SEQ ID NO: 4438028 - DNA, 16 bp, Homo sapiens
gtgaccaatgtcttga

SEQ ID NO: 4438029 - DNA, 15 bp, Homo sapiens
gtgaccagaaagctt

SEQ ID NO: 4438030 - DNA, 14 bp, Homo sapiens
gtgacctccatact

SEQ ID NO: 4438031 - DNA, 17 bp, Homo sapiens
gtgacctcggacagagc

SEQ ID NO: 4438032 - DNA, 18 bp, Homo sapiens
gtgacctcggacagagcc

SEQ ID NO: 4438033 - DNA, 23 bp, Homo sapiens
gtgacctcggacagagcccccct

SEQ ID NO: 4438034 - DNA, 20 bp, Homo sapiens
gtgactcagcatcacccacc

SEQ ID NO: 4438035 - DNA, 17 bp, Homo sapiens
gtgactctaggcttcag

SEQ ID NO: 4438036 - DNA, 22 bp, Homo sapiens
gtgactgcaagcatttttccat

SEQ ID NO: 4438037 - DNA, 14 bp, Homo sapiens
gtgacttcactgta

SEQ ID NO: 4438038 - DNA, 15 bp, Homo sapiens
gtgacttcactgtat

SEQ ID NO: 4438039 - DNA, 14 bp, Homo sapiens
gtgacttctgctgc

SEQ ID NO: 4438040 - DNA, 15 bp, Homo sapiens
gtgagaaaactgtga

SEQ ID NO: 4438041 - DNA, 23 bp, Homo sapiens
gtgagacaggctgggtcctgcca

SEQ ID NO: 4438042 - DNA, 20 bp, Homo sapiens
gtgagacccagccctcatcc

SEQ ID NO: 4438043 - DNA, 17 bp, Homo sapiens
gtgagacccccacacct

SEQ ID NO: 4438044 - DNA, 18 bp, Homo sapiens
gtgagaccctgtctcaaa

SEQ ID NO: 4438045 - DNA, 17 bp, Homo sapiens
gtgagactcgagaactt

SEQ ID NO: 4438046 - DNA, 22 bp, Homo sapiens
gtgagactcgagaactttcatt

SEQ ID NO: 4438047 - DNA, 23 bp, Homo sapiens
gtgagactgggaaggcttgggat

SEQ ID NO: 4438048 - DNA, 15 bp, Homo sapiens
gtgagactgtacata

SEQ ID NO: 4438049 - DNA, 17 bp, Homo sapiens
gtgagactgtacataat

SEQ ID NO: 4438050 - DNA, 18 bp, Homo sapiens
gtgagagacctgctcagg

SEQ ID NO: 4438051 - DNA, 11 bp, Homo sapiens
gtgagagagac

SEQ ID NO: 4438052 - DNA, 15 bp, Homo sapiens
gtgagatagttttca

SEQ ID NO: 4438053 - DNA, 12 bp, Homo sapiens
gtgagatggaat

SEQ ID NO: 4438054 - DNA, 15 bp, Homo sapiens
gtgagcaggggaagc

SEQ ID NO: 4438055 - DNA, 11 bp, Homo sapiens
gtgagccactg

SEQ ID NO: 4438056 - DNA, 13 bp, Homo sapiens
gtgagccactgcg

SEQ ID NO: 4438057 - DNA, 19 bp, Homo sapiens
gtgagcccctccccagcca

SEQ ID NO: 4438058 - DNA, 12 bp, Homo sapiens
gtgagccctgct

SEQ ID NO: 4438059 - DNA, 15 bp, Homo sapiens
gtgagccctgctctt

SEQ ID NO: 4438060 - DNA, 19 bp, Homo sapiens
gtgagccctgctcttctct

SEQ ID NO: 4438061 - DNA, 22 bp, Homo sapiens
gtgagccctgctcttctctccc

SEQ ID NO: 4438062 - DNA, 18 bp, Homo sapiens
gtgagcctcctgtgcctg

SEQ ID NO: 4438063 - DNA, 14 bp, Homo sapiens
gtgagctgagatca

SEQ ID NO: 4438064 - DNA, 19 bp, Homo sapiens
gtgagctggggactcaggg

SEQ ID NO: 4438065 - DNA, 22 bp, Homo sapiens
gtgagctgtgactgctttgctg

SEQ ID NO: 4438066 - DNA, 23 bp, Homo sapiens
gtgaggactctttccgactgccc

SEQ ID NO: 4438067 - DNA, 17 bp, Homo sapiens
gtgaggccagggcagag

SEQ ID NO: 4438068 - DNA, 17 bp, Homo sapiens
gtgaggcttctaataaa

SEQ ID NO: 4438069 - DNA, 21 bp, Homo sapiens
gtgagggaggggaaaagcatt

SEQ ID NO: 4438070 - DNA, 20 bp, Homo sapiens
gtgaggggaagacaaagcac

SEQ ID NO: 4438071 - DNA, 22 bp, Homo sapiens
gtgagtcaatacatagtgctgc

SEQ ID NO: 4438072 - DNA, 14 bp, Homo sapiens
gtgagtcaccactt

SEQ ID NO: 4438073 - DNA, 14 bp, Homo sapiens
gtgagtcagaatgt

SEQ ID NO: 4438074 - DNA, 16 bp, Homo sapiens
gtgagtctatttttaa

SEQ ID NO: 4438075 - DNA, 17 bp, Homo sapiens
gtgagtgagggagacag

SEQ ID NO: 4438076 - DNA, 20 bp, Homo sapiens
gtgagtgccatgctttttgg

SEQ ID NO: 4438077 - DNA, 15 bp, Homo sapiens
gtgagtggcctgcta

SEQ ID NO: 4438078 - DNA, 22 bp, Homo sapiens
gtgagttgcatgtttttgaaaa

SEQ ID NO: 4438079 - DNA, 21 bp, Homo sapiens
gtgagtttgagctgccttccc

SEQ ID NO: 4438080 - DNA, 13 bp, Homo sapiens
gtgataaaatttt

SEQ ID NO: 4438081 - DNA, 22 bp, Homo sapiens
gtgataaccagtaaggaaatat

SEQ ID NO: 4438082 - DNA, 12 bp, Homo sapiens
gtgatacagttt

SEQ ID NO: 4438083 - DNA, 14 bp, Homo sapiens
gtgatacagttttg

SEQ ID NO: 4438084 - DNA, 19 bp, Homo sapiens
gtgataggtacctgagtga

SEQ ID NO: 4438085 - DNA, 17 bp, Homo sapiens
gtgatcctaaatatgac

SEQ ID NO: 4438086 - DNA, 14 bp, Homo sapiens
gtgatctcagatca

SEQ ID NO: 4438087 - DNA, 22 bp, Homo sapiens
gtgatctgggcattttcctcct

SEQ ID NO: 4438088 - DNA, 13 bp, Homo sapiens
gtgatgatagcac

SEQ ID NO: 4438089 - DNA, 19 bp, Homo sapiens
gtgatggagaggacagagc

SEQ ID NO: 4438090 - DNA, 18 bp, Homo sapiens
gtgatgtattttcatagt

SEQ ID NO: 4438091 - DNA, 21 bp, Homo sapiens
gtgatgtggaggaagagccac

SEQ ID NO: 4438092 - DNA, 14 bp, Homo sapiens
gtgatgtttgtcct

SEQ ID NO: 4438093 - DNA, 19 bp, Homo sapiens
gtgattatctctttgatct

SEQ ID NO: 4438094 - DNA, 16 bp, Homo sapiens
gtgattcaatctgtaa

SEQ ID NO: 4438095 - DNA, 22 bp, Homo sapiens
gtgattctggaagcaaatggca

SEQ ID NO: 4438096 - DNA, 12 bp, Homo sapiens
gtgattgtgaag

SEQ ID NO: 4438097 - DNA, 19 bp, Homo sapiens
gtgattgtggaatggagat

SEQ ID NO: 4438098 - DNA, 23 bp, Homo sapiens
gtgattgtggaatggagattcag

SEQ ID NO: 4438099 - DNA, 19 bp, Homo sapiens
gtgatttcagactgcagag

SEQ ID NO: 4438100 - DNA, 23 bp, Homo sapiens
gtgatttcagactgcagagggga

SEQ ID NO: 4438101 - DNA, 19 bp, Homo sapiens
gtgatttttatgccacctg

SEQ ID NO: 4438102 - DNA, 16 bp, Homo sapiens
gtgcaaaaactgtaaa

SEQ ID NO: 4438103 - DNA, 13 bp, Homo sapiens
gtgcaacccaagg

SEQ ID NO: 4438104 - DNA, 23 bp, Homo sapiens
gtgcaacttagatctctcctgca

SEQ ID NO: 4438105 - DNA, 13 bp, Homo sapiens
gtgcaacttttta

SEQ ID NO: 4438106 - DNA, 13 bp, Homo sapiens
gtgcaagcactcg

SEQ ID NO: 4438107 - DNA, 21 bp, Homo sapiens
gtgcaatgcgtgttgtacata

SEQ ID NO: 4438108 - DNA, 20 bp, Homo sapiens
gtgcaatgggtaagggaggg

SEQ ID NO: 4438109 - DNA, 17 bp, Homo sapiens
gtgcaatgtaaatattt

SEQ ID NO: 4438110 - DNA, 23 bp, Homo sapiens
gtgcaatttctgtacatttgcaa

SEQ ID NO: 4438111 - DNA, 17 bp, Homo sapiens
gtgcacatctacatgcc

SEQ ID NO: 4438112 - DNA, 22 bp, Homo sapiens
gtgcacatctacatgccatgcc

SEQ ID NO: 4438113 - DNA, 17 bp, Homo sapiens
gtgcacatctgttttgt

SEQ ID NO: 4438114 - DNA, 15 bp, Homo sapiens
gtgcacatgcctctg

SEQ ID NO: 4438115 - DNA, 13 bp, Homo sapiens
gtgcactccagct

SEQ ID NO: 4438116 - DNA, 23 bp, Homo sapiens
gtgctataatctgtttttacgta

SEQ ID NO: 4438117 - DNA, 18 bp, Homo sapiens
gtgctatttaacatttta

SEQ ID NO: 4438118 - DNA, 16 bp, Homo sapiens
gtgctcaatagcttga

SEQ ID NO: 4438119 - DNA, 15 bp, Homo sapiens
gtgctcacaatgttc

SEQ ID NO: 4438120 - DNA, 20 bp, Homo sapiens
gtgctcacaatgttctggca

SEQ ID NO: 4438121 - DNA, 15 bp, Homo sapiens
gtgctcaccctctct

SEQ ID NO: 4438122 - DNA, 22 bp, Homo sapiens
gtgctcacgttaccttgacaca

SEQ ID NO: 4438123 - DNA, 13 bp, Homo sapiens
gtgctcagccaaa

SEQ ID NO: 4438124 - DNA, 19 bp, Homo sapiens
gtgctcagccaaatttcct

SEQ ID NO: 4438125 - DNA, 20 bp, Homo sapiens
gtgctcagccaaatttcctg

SEQ ID NO: 4438126 - DNA, 20 bp, Homo sapiens
gtgctccatctccgcctcca

SEQ ID NO: 4438127 - DNA, 23 bp, Homo sapiens
gtgctccatctccgcctccacac

SEQ ID NO: 4438128 - DNA, 13 bp, Homo sapiens
gtgctctctttct

SEQ ID NO: 4438129 - DNA, 13 bp, Homo sapiens
gtgctctgcctca

SEQ ID NO: 4438130 - DNA, 16 bp, Homo sapiens
gtgctctgtaaaacac

SEQ ID NO: 4438131 - DNA, 16 bp, Homo sapiens
gtgctgaccctcctgt

SEQ ID NO: 4438132 - DNA, 15 bp, Homo sapiens
gtgctgatccttgca

SEQ ID NO: 4438133 - DNA, 19 bp, Homo sapiens
gtgctgcagctccctggct

SEQ ID NO: 4438134 - DNA, 11 bp, Homo sapiens
gtgctgcagga

SEQ ID NO: 4438135 - DNA, 13 bp, Homo sapiens
gtgctgcaggagt

SEQ ID NO: 4438136 - DNA, 23 bp, Homo sapiens
gtgctgcaggagtgtcctgccca

SEQ ID NO: 4438137 - DNA, 18 bp, Homo sapiens
gtgctgcaggtggcagag

SEQ ID NO: 4438138 - DNA, 20 bp, Homo sapiens
gtgctgcccagcagcccctg

SEQ ID NO: 4438139 - DNA, 23 bp, Homo sapiens
gtgctgccctgttgccgagccca

SEQ ID NO: 4438140 - DNA, 15 bp, Homo sapiens
gtgctgccgagggct

SEQ ID NO: 4438141 - DNA, 16 bp, Homo sapiens
gtgctgccgagggctg

SEQ ID NO: 4438142 - DNA, 19 bp, Homo sapiens
gtgctgcctctacctgaca

SEQ ID NO: 4438143 - DNA, 12 bp, Homo sapiens
gtgctggactgt

SEQ ID NO: 4438144 - DNA, 17 bp, Homo sapiens
gtgctggaggggtggcc

SEQ ID NO: 4438145 - DNA, 17 bp, Homo sapiens
gtgctgggagaaatact

SEQ ID NO: 4438146 - DNA, 17 bp, Homo sapiens
gtgctgggaggagggag

SEQ ID NO: 4438147 - DNA, 18 bp, Homo sapiens
gtgctgggaggagggaga

SEQ ID NO: 4438148 - DNA, 23 bp, Homo sapiens
gtgctgggaggagggagagggag

SEQ ID NO: 4438149 - DNA, 12 bp, Homo sapiens
gtgctgggcaga

SEQ ID NO: 4438150 - DNA, 14 bp, Homo sapiens
gtgctgggggagcc

SEQ ID NO: 4438151 - DNA, 20 bp, Homo sapiens
gtgctggtcccggggccagc

SEQ ID NO: 4438152 - DNA, 17 bp, Homo sapiens
gtgctgtcttttgttct

SEQ ID NO: 4438153 - DNA, 13 bp, Homo sapiens
gtgctgtgaggga

SEQ ID NO: 4438154 - DNA, 13 bp, Homo sapiens
gtgctgtgggcag

SEQ ID NO: 4438155 - DNA, 17 bp, Homo sapiens
gtgctgtgggcagcacc

SEQ ID NO: 4438156 - DNA, 20 bp, Homo sapiens
gtgctgtgggcagcaccctc

SEQ ID NO: 4438157 - DNA, 15 bp, Homo sapiens
gtgctgtttattaat

SEQ ID NO: 4438158 - DNA, 15 bp, Homo sapiens
gtgctgtttgaaaat

SEQ ID NO: 4438159 - DNA, 19 bp, Homo sapiens
gtgcttattcttaacttat

SEQ ID NO: 4438160 - DNA, 12 bp, Homo sapiens
gtgcttcacagg

SEQ ID NO: 4438161 - DNA, 20 bp, Homo sapiens
gtgcttctagttctgccagg

SEQ ID NO: 4438162 - DNA, 19 bp, Homo sapiens
gtgcttctccaacactgaa

SEQ ID NO: 4438163 - DNA, 18 bp, Homo sapiens
gtgcttcttcacttaccc

SEQ ID NO: 4438164 - DNA, 12 bp, Homo sapiens
gtgcttgatcta

SEQ ID NO: 4438165 - DNA, 16 bp, Homo sapiens
gtgcttgatctatcta

SEQ ID NO: 4438166 - DNA, 16 bp, Homo sapiens
gtgcttgttagagaga

SEQ ID NO: 4438167 - DNA, 19 bp, Homo sapiens
gtgctttattgaattagaa

SEQ ID NO: 4438168 - DNA, 13 bp, Homo sapiens
gtgctttccagct

SEQ ID NO: 4438169 - DNA, 14 bp, Homo sapiens
gtgctttccagctc

SEQ ID NO: 4438170 - DNA, 13 bp, Homo sapiens
gtgctttccttca

SEQ ID NO: 4438171 - DNA, 18 bp, Homo sapiens
gtgcttttatagaggcta

SEQ ID NO: 4438172 - DNA, 22 bp, Homo sapiens
gtggaaattttatatgtaaatg

SEQ ID NO: 4438173 - DNA, 16 bp, Homo sapiens
gtggaagaagggagaa

SEQ ID NO: 4438174 - DNA, 18 bp, Homo sapiens
gtggaagaagggagaaga

SEQ ID NO: 4438175 - DNA, 14 bp, Homo sapiens
gtggaagcagaggc

SEQ ID NO: 4438176 - DNA, 15 bp, Homo sapiens
gtggaagcagaggcc

SEQ ID NO: 4438177 - DNA, 13 bp, Homo sapiens
gtggaagccctcc

SEQ ID NO: 4438178 - DNA, 15 bp, Homo sapiens
gtggaagtgtgggtc

SEQ ID NO: 4438179 - DNA, 22 bp, Homo sapiens
gtggaagtgtgggtctgtgtgt

SEQ ID NO: 4438180 - DNA, 14 bp, Homo sapiens
gtggaataaagatg

SEQ ID NO: 4438181 - DNA, 16 bp, Homo sapiens
gtggacacacacagac

SEQ ID NO: 4438182 - DNA, 17 bp, Homo sapiens
gtggacagcagacaaga

SEQ ID NO: 4438183 - DNA, 18 bp, Homo sapiens
gtggacagcgctgtattt

SEQ ID NO: 4438184 - DNA, 16 bp, Homo sapiens
gtggactggcccctgg

SEQ ID NO: 4438185 - DNA, 11 bp, Homo sapiens
gtggactggtg

SEQ ID NO: 4438186 - DNA, 20 bp, Homo sapiens
gtggagaagccacaggcctg

SEQ ID NO: 4438187 - DNA, 22 bp, Homo sapiens
gtggagaagccacaggcctgag

SEQ ID NO: 4438188 - DNA, 15 bp, Homo sapiens
gtggagaccctgcca

SEQ ID NO: 4438189 - DNA, 18 bp, Homo sapiens
gtggagaccctgccacag

SEQ ID NO: 4438190 - DNA, 15 bp, Homo sapiens
gtggaggaagagcca

SEQ ID NO: 4438191 - DNA, 20 bp, Homo sapiens
gtggaggaagagccacctgc

SEQ ID NO: 4438192 - DNA, 14 bp, Homo sapiens
gtggaggaccgagg

SEQ ID NO: 4438193 - DNA, 16 bp, Homo sapiens
gtggaggaccgaggct

SEQ ID NO: 4438194 - DNA, 14 bp, Homo sapiens
gtggaggaggcctg

SEQ ID NO: 4438195 - DNA, 15 bp, Homo sapiens
gtggaggaggcctgg

SEQ ID NO: 4438196 - DNA, 15 bp, Homo sapiens
gtggaggctgcccca

SEQ ID NO: 4438197 - DNA, 14 bp, Homo sapiens
gtggaggcttcctg

SEQ ID NO: 4438198 - DNA, 15 bp, Homo sapiens
gtggaggcttcctgc

SEQ ID NO: 4438199 - DNA, 20 bp, Homo sapiens
gtggagggagtgagccagca

SEQ ID NO: 4438200 - DNA, 14 bp, Homo sapiens
gtggaggggcttgg

SEQ ID NO: 4438201 - DNA, 15 bp, Homo sapiens
gtggaggggtgtggc

SEQ ID NO: 4438202 - DNA, 18 bp, Homo sapiens
gtggaggtgtcaggctgc

SEQ ID NO: 4438203 - DNA, 22 bp, Homo sapiens
gtggaggtgtcaggctgctggc

SEQ ID NO: 4438204 - DNA, 16 bp, Homo sapiens
gtggatatttgtataa

SEQ ID NO: 4438205 - DNA, 15 bp, Homo sapiens
gtggatcacagaggc

SEQ ID NO: 4438206 - DNA, 16 bp, Homo sapiens
gtggatcacagaggct

SEQ ID NO: 4438207 - DNA, 15 bp, Homo sapiens
gtggatcacctgagg

SEQ ID NO: 4438208 - DNA, 18 bp, Homo sapiens
gtggatgccgatttctgt

SEQ ID NO: 4438209 - DNA, 20 bp, Homo sapiens
gtggatgctgctgcccctgc

SEQ ID NO: 4438210 - DNA, 15 bp, Homo sapiens
gtggattaaaccttt

SEQ ID NO: 4438211 - DNA, 14 bp, Homo sapiens
gtggatttttatca

SEQ ID NO: 4438212 - DNA, 12 bp, Homo sapiens
gtggcacctgca

SEQ ID NO: 4438213 - DNA, 15 bp, Homo sapiens
gtggcagagttacag

SEQ ID NO: 4438214 - DNA, 18 bp, Homo sapiens
gtggcagatgtcttccct

SEQ ID NO: 4438215 - DNA, 19 bp, Homo sapiens
gtggcagatgtcttccctg

SEQ ID NO: 4438216 - DNA, 22 bp, Homo sapiens
gtggcagggggccccgccaggg

SEQ ID NO: 4438217 - DNA, 23 bp, Homo sapiens
gtggcaggtggaggtgtcaggct

SEQ ID NO: 4438218 - DNA, 17 bp, Homo sapiens
gtggcagtaaagagaaa

SEQ ID NO: 4438219 - DNA, 14 bp, Homo sapiens
gtggcagtttaaaa

SEQ ID NO: 4438220 - DNA, 21 bp, Homo sapiens
gtggcatcacagaccccagct

SEQ ID NO: 4438221 - DNA, 20 bp, Homo sapiens
gtggcatctttgccttgggc

SEQ ID NO: 4438222 - DNA, 15 bp, Homo sapiens
gtggccaagaagcag

SEQ ID NO: 4438223 - DNA, 17 bp, Homo sapiens
gtggccaagaagcagtg

SEQ ID NO: 4438224 - DNA, 14 bp, Homo sapiens
gtggccacacaggc

SEQ ID NO: 4438225 - DNA, 19 bp, Homo sapiens
gtggccacacaggcagggc

SEQ ID NO: 4438226 - DNA, 22 bp, Homo sapiens
gtggccacacaggcagggcctg

SEQ ID NO: 4438227 - DNA, 22 bp, Homo sapiens
gtggccacacctctatcccggc

SEQ ID NO: 4438228 - DNA, 16 bp, Homo sapiens
gtggccaggggtgctc

SEQ ID NO: 4438229 - DNA, 19 bp, Homo sapiens
gtggccatccctgggcccc

SEQ ID NO: 4438230 - DNA, 21 bp, Homo sapiens
gtggccatccctgggcccctc

SEQ ID NO: 4438231 - DNA, 18 bp, Homo sapiens
gtggccatccctgtgagg

SEQ ID NO: 4438232 - DNA, 14 bp, Homo sapiens
gtggcccagagcca

SEQ ID NO: 4438233 - DNA, 20 bp, Homo sapiens
gtggccgtctcctccctcag

SEQ ID NO: 4438234 - DNA, 22 bp, Homo sapiens
gtggcctatttcagctgctttg

SEQ ID NO: 4438235 - DNA, 22 bp, Homo sapiens
gtgtatttaattgtaaactgta

SEQ ID NO: 4438236 - DNA, 21 bp, Homo sapiens
gtgtatttacgctttgattca

SEQ ID NO: 4438237 - DNA, 14 bp, Homo sapiens
gtgtatttcattta

SEQ ID NO: 4438238 - DNA, 19 bp, Homo sapiens
gtgtatttggaaataaagt

SEQ ID NO: 4438239 - DNA, 17 bp, Homo sapiens
gtgtcaaataaacactg

SEQ ID NO: 4438240 - DNA, 16 bp, Homo sapiens
gtgtcaagacatttct

SEQ ID NO: 4438241 - DNA, 16 bp, Homo sapiens
gtgtcaagttgtgctt

SEQ ID NO: 4438242 - DNA, 23 bp, Homo sapiens
gtgtcaagttgtgcttgtttaca

SEQ ID NO: 4438243 - DNA, 16 bp, Homo sapiens
gtgtcaggctgctggc

SEQ ID NO: 4438244 - DNA, 22 bp, Homo sapiens
gtgtcaggctgctggcgcctct

SEQ ID NO: 4438245 - DNA, 16 bp, Homo sapiens
gtgtcagtatccaggc

SEQ ID NO: 4438246 - DNA, 19 bp, Homo sapiens
gtgtcatttccggctgctg

SEQ ID NO: 4438247 - DNA, 18 bp, Homo sapiens
gtgtccacgactgtctcc

SEQ ID NO: 4438248 - DNA, 22 bp, Homo sapiens
gtgtccccagcctacctctcca

SEQ ID NO: 4438249 - DNA, 20 bp, Homo sapiens
gtgtcccccccaggccttgt

SEQ ID NO: 4438250 - DNA, 13 bp, Homo sapiens
gtgtcccctcact

SEQ ID NO: 4438251 - DNA, 23 bp, Homo sapiens
gtgtcccctcactctgtcagcca

SEQ ID NO: 4438252 - DNA, 17 bp, Homo sapiens
gtgtccccttcccctgc

SEQ ID NO: 4438253 - DNA, 18 bp, Homo sapiens
gtgtccccttcccctgct

SEQ ID NO: 4438254 - DNA, 16 bp, Homo sapiens
gtgtcgggcaggtcag

SEQ ID NO: 4438255 - DNA, 20 bp, Homo sapiens
gtgtcgggcaggtcagcgcg

SEQ ID NO: 4438256 - DNA, 12 bp, Homo sapiens
gtgtctcagcct

SEQ ID NO: 4438257 - DNA, 20 bp, Homo sapiens
gtgtctcaggctcaagtttt

SEQ ID NO: 4438258 - DNA, 13 bp, Homo sapiens
gtgtctccaaccc

SEQ ID NO: 4438259 - DNA, 21 bp, Homo sapiens
gtgtctccaaccccccagcac

SEQ ID NO: 4438260 - DNA, 13 bp, Homo sapiens
gtgtctcccaaca

SEQ ID NO: 4438261 - DNA, 17 bp, Homo sapiens
gtgtctcccaacatggg

SEQ ID NO: 4438262 - DNA, 18 bp, Homo sapiens
gtgtctcccaacatggga

SEQ ID NO: 4438263 - DNA, 12 bp, Homo sapiens
gtgtctgcacct

SEQ ID NO: 4438264 - DNA, 20 bp, Homo sapiens
gtgtctggatcagtaaaatt

SEQ ID NO: 4438265 - DNA, 17 bp, Homo sapiens
gtgtctggcacagcctg

SEQ ID NO: 4438266 - DNA, 23 bp, Homo sapiens
gtgtctggcgttctcaagaatct

SEQ ID NO: 4438267 - DNA, 14 bp, Homo sapiens
gtgtctgtatttat

SEQ ID NO: 4438268 - DNA, 13 bp, Homo sapiens
gtgtcttccctgc

SEQ ID NO: 4438269 - DNA, 14 bp, Homo sapiens
gtgtcttccctgcc

SEQ ID NO: 4438270 - DNA, 15 bp, Homo sapiens
gtgtcttcctcccaa

SEQ ID NO: 4438271 - DNA, 19 bp, Homo sapiens
gtgtcttcctcccaagtgg

SEQ ID NO: 4438272 - DNA, 15 bp, Homo sapiens
gtgtctttctaagaa

SEQ ID NO: 4438273 - DNA, 13 bp, Homo sapiens
gtgtgaaatatat

SEQ ID NO: 4438274 - DNA, 15 bp, Homo sapiens
gtgtgaatagcctgg

SEQ ID NO: 4438275 - DNA, 15 bp, Homo sapiens
gtgtgaatgaacact

SEQ ID NO: 4438276 - DNA, 15 bp, Homo sapiens
gtgtgaccctgggca

SEQ ID NO: 4438277 - DNA, 17 bp, Homo sapiens
gtgtgagctcttccctt

SEQ ID NO: 4438278 - DNA, 16 bp, Homo sapiens
gtgtgaggagctgctg

SEQ ID NO: 4438279 - DNA, 19 bp, Homo sapiens
gtgtgaggagctgctggct

SEQ ID NO: 4438280 - DNA, 21 bp, Homo sapiens
gtgtgatcttaatatatttga

SEQ ID NO: 4438281 - DNA, 14 bp, Homo sapiens
gtgtgcactccagc

SEQ ID NO: 4438282 - DNA, 17 bp, Homo sapiens
gtgtgcagtgtttttcc

SEQ ID NO: 4438283 - DNA, 16 bp, Homo sapiens
gtgtgcctggttaata

SEQ ID NO: 4438284 - DNA, 11 bp, Homo sapiens
gtgtgctctga

SEQ ID NO: 4438285 - DNA, 14 bp, Homo sapiens
gtgtgctgtttgaa

SEQ ID NO: 4438286 - DNA, 15 bp, Homo sapiens
gtgtgctgtttgaaa

SEQ ID NO: 4438287 - DNA, 22 bp, Homo sapiens
gtgtggagaagccacaggcctg

SEQ ID NO: 4438288 - DNA, 10 bp, Homo sapiens
gtgtggagca

SEQ ID NO: 4438289 - DNA, 12 bp, Homo sapiens
gtgtggcagtgg

SEQ ID NO: 4438290 - DNA, 13 bp, Homo sapiens
gtgtggcccagca

SEQ ID NO: 4438291 - DNA, 19 bp, Homo sapiens
gtgtggccggcctcctcct

SEQ ID NO: 4438292 - DNA, 12 bp, Homo sapiens
gtgtggcctcag

SEQ ID NO: 4438293 - DNA, 15 bp, Homo sapiens
gtgtggcctcagccc

SEQ ID NO: 4438294 - DNA, 13 bp, Homo sapiens
gtgtggctggtgt

SEQ ID NO: 4438295 - DNA, 13 bp, Homo sapiens
gtgtggctgtgca

SEQ ID NO: 4438296 - DNA, 12 bp, Homo sapiens
gtgtggctttcc

SEQ ID NO: 4438297 - DNA, 16 bp, Homo sapiens
gtgtgggaagggagag

SEQ ID NO: 4438298 - DNA, 15 bp, Homo sapiens
gtgtgggactgtaca

SEQ ID NO: 4438299 - DNA, 17 bp, Homo sapiens
gtgtgggagtgtgtaat

SEQ ID NO: 4438300 - DNA, 14 bp, Homo sapiens
gtgtggggtggggt

SEQ ID NO: 4438301 - DNA, 15 bp, Homo sapiens
gtgtggtgtcttgcg

SEQ ID NO: 4438302 - DNA, 13 bp, Homo sapiens
gtgtgtaaaatta

SEQ ID NO: 4438303 - DNA, 16 bp, Homo sapiens
gtgtgtactcagggca

SEQ ID NO: 4438304 - DNA, 22 bp, Homo sapiens
gtgtgtattcttaaaatgcaat

SEQ ID NO: 4438305 - DNA, 22 bp, Homo sapiens
gtgtgtcatactgtgcaggcct

SEQ ID NO: 4438306 - DNA, 18 bp, Homo sapiens
gtgtgtccccctctgtcc

SEQ ID NO: 4438307 - DNA, 16 bp, Homo sapiens
gtgtgtcttctgcccc

SEQ ID NO: 4438308 - DNA, 17 bp, Homo sapiens
gtgtgtgaatgaacact

SEQ ID NO: 4438309 - DNA, 20 bp, Homo sapiens
gtgtgtgccaagccctggcc

SEQ ID NO: 4438310 - DNA, 21 bp, Homo sapiens
gtgtgtggccggcctcctcct

SEQ ID NO: 4438311 - DNA, 16 bp, Homo sapiens
gtgtgtgggagtgtgt

SEQ ID NO: 4438312 - DNA, 23 bp, Homo sapiens
gtgtgtggtcaacatttctcatg

SEQ ID NO: 4438313 - DNA, 18 bp, Homo sapiens
gtgtgtgtacctgtggct

SEQ ID NO: 4438314 - DNA, 17 bp, Homo sapiens
gtgtgtgttgtgtgtgg

SEQ ID NO: 4438315 - DNA, 22 bp, Homo sapiens
gtgtgttatttccccagccaca

SEQ ID NO: 4438316 - DNA, 17 bp, Homo sapiens
gtgtgttgtgtgtggga

SEQ ID NO: 4438317 - DNA, 23 bp, Homo sapiens
gtgtgtttattttttattatttt

SEQ ID NO: 4438318 - DNA, 15 bp, Homo sapiens
gtgtgtttctgtcct

SEQ ID NO: 4438319 - DNA, 19 bp, Homo sapiens
gtgtgtttttgggatgtct

SEQ ID NO: 4438320 - DNA, 11 bp, Homo sapiens
gtgttaaacac

SEQ ID NO: 4438321 - DNA, 22 bp, Homo sapiens
gtgttagcactgatagtccttt

SEQ ID NO: 4438322 - DNA, 23 bp, Homo sapiens
gtgttagggaagggcctgccaca

SEQ ID NO: 4438323 - DNA, 13 bp, Homo sapiens
gtgttatgtattt

SEQ ID NO: 4438324 - DNA, 20 bp, Homo sapiens
gtgttatttccccagccaca

SEQ ID NO: 4438325 - DNA, 13 bp, Homo sapiens
gggctaaatgaag

SEQ ID NO: 4438326 - DNA, 20 bp, Homo sapiens
gggctaagagctagcgctgc

SEQ ID NO: 4438327 - DNA, 21 bp, Homo sapiens
gggctaattctgggaagggag

SEQ ID NO: 4438328 - DNA, 20 bp, Homo sapiens
gggctaccctgagctgaggc

SEQ ID NO: 4438329 - DNA, 21 bp, Homo sapiens
gggctaccctgagctgaggca

SEQ ID NO: 4438330 - DNA, 17 bp, Homo sapiens
gggctagaacctggagg

SEQ ID NO: 4438331 - DNA, 17 bp, Homo sapiens
gggctaggtagaaaaag

SEQ ID NO: 4438332 - DNA, 21 bp, Homo sapiens
gggctcaaatgatcctcccac

SEQ ID NO: 4438333 - DNA, 20 bp, Homo sapiens
gggctcactgtgctggggca

SEQ ID NO: 4438334 - DNA, 22 bp, Homo sapiens
gggctcagagctttgtcacttg

SEQ ID NO: 4438335 - DNA, 23 bp, Homo sapiens
gggctcagagctttgtcacttgc

SEQ ID NO: 4438336 - DNA, 20 bp, Homo sapiens
gggctccatgctgggtctga

SEQ ID NO: 4438337 - DNA, 15 bp, Homo sapiens
gggctcccagccagg

SEQ ID NO: 4438338 - DNA, 11 bp, Homo sapiens
gggctcccagg

SEQ ID NO: 4438339 - DNA, 13 bp, Homo sapiens
gggctcccagggg

SEQ ID NO: 4438340 - DNA, 21 bp, Homo sapiens
gggctccctgtaacctcttca

SEQ ID NO: 4438341 - DNA, 11 bp, Homo sapiens
gggctcctgcc

SEQ ID NO: 4438342 - DNA, 14 bp, Homo sapiens
gggctcctgcccag

SEQ ID NO: 4438343 - DNA, 17 bp, Homo sapiens
gggctcctgcccaggcc

SEQ ID NO: 4438344 - DNA, 23 bp, Homo sapiens
gggctcggaggctacccgctgtg

SEQ ID NO: 4438345 - DNA, 14 bp, Homo sapiens
gggctcggaggctg

SEQ ID NO: 4438346 - DNA, 13 bp, Homo sapiens
gggctctccacct

SEQ ID NO: 4438347 - DNA, 14 bp, Homo sapiens
gggctctccacctc

SEQ ID NO: 4438348 - DNA, 17 bp, Homo sapiens
gggctctccacctcagc

SEQ ID NO: 4438349 - DNA, 23 bp, Homo sapiens
gggctctgacagccctgcggaga

SEQ ID NO: 4438350 - DNA, 15 bp, Homo sapiens
gggctgacacccagg

SEQ ID NO: 4438351 - DNA, 17 bp, Homo sapiens
gggctgagccctcctga

SEQ ID NO: 4438352 - DNA, 15 bp, Homo sapiens
gggctgaggccagag

SEQ ID NO: 4438353 - DNA, 17 bp, Homo sapiens
ggctggcacagcccctg

SEQ ID NO: 4438354 - DNA, 22 bp, Homo sapiens
ggctggcagggcgtgaggaact

SEQ ID NO: 4438355 - DNA, 18 bp, Homo sapiens
ggctggcattgaggctaa

SEQ ID NO: 4438356 - DNA, 17 bp, Homo sapiens
ggctggcccagccctgc

SEQ ID NO: 4438357 - DNA, 18 bp, Homo sapiens
ggctggcccagccctgct

SEQ ID NO: 4438358 - DNA, 21 bp, Homo sapiens
ggctggcccagccctgctggc

SEQ ID NO: 4438359 - DNA, 22 bp, Homo sapiens
ggctggccgggactgctgctct

SEQ ID NO: 4438360 - DNA, 23 bp, Homo sapiens
ggctggcctcacccacccctgca

SEQ ID NO: 4438361 - DNA, 15 bp, Homo sapiens
ggctggcctccgcct

SEQ ID NO: 4438362 - DNA, 15 bp, Homo sapiens
ggctggctccccctc

SEQ ID NO: 4438363 - DNA, 22 bp, Homo sapiens
ggctggctctaccttcctgtcc

SEQ ID NO: 4438364 - DNA, 23 bp, Homo sapiens
ggctggctctaccttcctgtccc

SEQ ID NO: 4438365 - DNA, 13 bp, Homo sapiens
ggctggctggcct

SEQ ID NO: 4438366 - DNA, 21 bp, Homo sapiens
ggctgggaactgcagacctgt

SEQ ID NO: 4438367 - DNA, 13 bp, Homo sapiens
ggctgggaggagg

SEQ ID NO: 4438368 - DNA, 20 bp, Homo sapiens
ggctgggaggagggcaggca

SEQ ID NO: 4438369 - DNA, 21 bp, Homo sapiens
gggaatctaatatccccaaat

SEQ ID NO: 4438370 - DNA, 14 bp, Homo sapiens
gggaatgcagcagg

SEQ ID NO: 4438371 - DNA, 22 bp, Homo sapiens
gggaatgctcccagctgtgctg

SEQ ID NO: 4438372 - DNA, 12 bp, Homo sapiens
gggaatggaaga

SEQ ID NO: 4438373 - DNA, 14 bp, Homo sapiens
gggaatgggagagg

SEQ ID NO: 4438374 - DNA, 16 bp, Homo sapiens
gggaattaaatagtgt

SEQ ID NO: 4438375 - DNA, 15 bp, Homo sapiens
gggaattgaaaaaaa

SEQ ID NO: 4438376 - DNA, 17 bp, Homo sapiens
gggaattgcgctcaggg

SEQ ID NO: 4438377 - DNA, 12 bp, Homo sapiens
gggaatttcctc

SEQ ID NO: 4438378 - DNA, 13 bp, Homo sapiens
gggaatttcctct

SEQ ID NO: 4438379 - DNA, 19 bp, Homo sapiens
gggacacacattctgcctt

SEQ ID NO: 4438380 - DNA, 20 bp, Homo sapiens
gggacacacattctgccttg

SEQ ID NO: 4438381 - DNA, 20 bp, Homo sapiens
gggacaccaagccttggctc

SEQ ID NO: 4438382 - DNA, 19 bp, Homo sapiens
gggacaccagccaggctct

SEQ ID NO: 4438383 - DNA, 14 bp, Homo sapiens
gggacagacaggag

SEQ ID NO: 4438384 - DNA, 14 bp, Homo sapiens
gggacagaggcctg

SEQ ID NO: 4438385 - DNA, 21 bp, Homo sapiens
gggacaggatttggccacact

SEQ ID NO: 4438386 - DNA, 22 bp, Homo sapiens
gggacagggctggcccagccct

SEQ ID NO: 4438387 - DNA, 16 bp, Homo sapiens
gggacatggaaaagaa

SEQ ID NO: 4438388 - DNA, 18 bp, Homo sapiens
gggaccaattctggacag

SEQ ID NO: 4438389 - DNA, 19 bp, Homo sapiens
gggaccaccctgagccggc

SEQ ID NO: 4438390 - DNA, 16 bp, Homo sapiens
gggaccactgggtgag

SEQ ID NO: 4438391 - DNA, 22 bp, Homo sapiens
gggaccactgggtgagagagga

SEQ ID NO: 4438392 - DNA, 18 bp, Homo sapiens
gggacccctcgccccagc

SEQ ID NO: 4438393 - DNA, 21 bp, Homo sapiens
gggacccctcgccccagcctc

SEQ ID NO: 4438394 - DNA, 15 bp, Homo sapiens
gggaccctcagcagc

SEQ ID NO: 4438395 - DNA, 16 bp, Homo sapiens
gggaccctttccttcc

SEQ ID NO: 4438396 - DNA, 20 bp, Homo sapiens
gggaccggcggaccccagcc

SEQ ID NO: 4438397 - DNA, 13 bp, Homo sapiens
gggaccggtgctg

SEQ ID NO: 4438398 - DNA, 18 bp, Homo sapiens
gggaccggtgctgcagga

SEQ ID NO: 4438399 - DNA, 17 bp, Homo sapiens
gggacctgccaggcagg

SEQ ID NO: 4438400 - DNA, 18 bp, Homo sapiens
gggacctgctgctcagta

SEQ ID NO: 4438401 - DNA, 21 bp, Homo sapiens
gggacgcctgggggtgccagg

SEQ ID NO: 4438402 - DNA, 21 bp, Homo sapiens
gggacgttgctgagccagctg

SEQ ID NO: 4438403 - DNA, 23 bp, Homo sapiens
gggacgttgctgagccagctgca

SEQ ID NO: 4438404 - DNA, 13 bp, Homo sapiens
gggactcagggac

SEQ ID NO: 4438405 - DNA, 15 bp, Homo sapiens
gggactcagggaccg

SEQ ID NO: 4438406 - DNA, 20 bp, Homo sapiens
gggactcagttgttctgagc

SEQ ID NO: 4438407 - DNA, 20 bp, Homo sapiens
gggactcctgtctaggtgcc

SEQ ID NO: 4438408 - DNA, 18 bp, Homo sapiens
gggactctcctcctcccc

SEQ ID NO: 4438409 - DNA, 24 bp, Homo sapiens
gggactgactttccgagcctccag

SEQ ID NO: 4438410 - DNA, 17 bp, Homo sapiens
gggactgccaggctgtt

SEQ ID NO: 4438411 - DNA, 18 bp, Homo sapiens
gggactgctgctctccca

SEQ ID NO: 4438412 - DNA, 21 bp, Homo sapiens
gggactggagcctgctgccct

SEQ ID NO: 4438413 - DNA, 13 bp, Homo sapiens
gggactgtacaca

SEQ ID NO: 4438414 - DNA, 17 bp, Homo sapiens
gggactgtgcctggctc

SEQ ID NO: 4438415 - DNA, 14 bp, Homo sapiens
gggacttgtgtctg

SEQ ID NO: 4438416 - DNA, 12 bp, Homo sapiens
gggacttttatt

SEQ ID NO: 4438417 - DNA, 23 bp, Homo sapiens
gggagaatgtcaaggaagacttt

SEQ ID NO: 4438418 - DNA, 19 bp, Homo sapiens
gggagaatgtcagtatgtg

SEQ ID NO: 4438419 - DNA, 22 bp, Homo sapiens
gggagaatgtcagtatgtggaa

SEQ ID NO: 4438420 - DNA, 23 bp, Homo sapiens
gggagaattgcacacagatgtga

SEQ ID NO: 4438421 - DNA, 21 bp, Homo sapiens
gggagacagcttctctgcagt

SEQ ID NO: 4438422 - DNA, 12 bp, Homo sapiens
gggagacaggaa

SEQ ID NO: 4438423 - DNA, 14 bp, Homo sapiens
gggagactgggctg

SEQ ID NO: 4438424 - DNA, 19 bp, Homo sapiens
gggagactgggctgaggga

SEQ ID NO: 4438425 - DNA, 21 bp, Homo sapiens
gggagagacaggcagcccagc

SEQ ID NO: 4438426 - DNA, 14 bp, Homo sapiens
gggagagagagaga

SEQ ID NO: 4438427 - DNA, 22 bp, Homo sapiens
gggagagagagagagagaggac

SEQ ID NO: 4438428 - DNA, 15 bp, Homo sapiens
gggagagagggaaaa

SEQ ID NO: 4438429 - DNA, 12 bp, Homo sapiens
gggagagcctgc

SEQ ID NO: 4438430 - DNA, 17 bp, Homo sapiens
gggagagtgcaggcctg

SEQ ID NO: 4438431 - DNA, 16 bp, Homo sapiens
gggagatgcttctctc

SEQ ID NO: 4438432 - DNA, 18 bp, Homo sapiens
gggagatgggtgggagga

SEQ ID NO: 4438433 - DNA, 23 bp, Homo sapiens
gggagattaaaaccagagagaaa

SEQ ID NO: 4438434 - DNA, 12 bp, Homo sapiens
gggagcacccag

SEQ ID NO: 4438435 - DNA, 20 bp, Homo sapiens
gggagcacggactgtcagtt

SEQ ID NO: 4438436 - DNA, 22 bp, Homo sapiens
gggagcatttaatggcagctag

SEQ ID NO: 4438437 - DNA, 16 bp, Homo sapiens
gggagccccagggtct

SEQ ID NO: 4438438 - DNA, 18 bp, Homo sapiens
gggagcctagctcctgcc

SEQ ID NO: 4438439 - DNA, 11 bp, Homo sapiens
gggagcctccc

SEQ ID NO: 4438440 - DNA, 16 bp, Homo sapiens
gggagcctgtggccag

SEQ ID NO: 4438441 - DNA, 23 bp, Homo sapiens
gggagccttctgccaccagcccc

SEQ ID NO: 4438442 - DNA, 13 bp, Homo sapiens
gggagcggaggtt

SEQ ID NO: 4438443 - DNA, 12 bp, Homo sapiens
gggagctcctgg

SEQ ID NO: 4438444 - DNA, 16 bp, Homo sapiens
gggagctcctgggacc

SEQ ID NO: 4438445 - DNA, 17 bp, Homo sapiens
gggagctcctgggaccc

SEQ ID NO: 4438446 - DNA, 19 bp, Homo sapiens
gggagctgagcagcctctg

SEQ ID NO: 4438447 - DNA, 15 bp, Homo sapiens
gggagctgggccctg

SEQ ID NO: 4438448 - DNA, 17 bp, Homo sapiens
gggagctgggccctgcc

SEQ ID NO: 4438449 - DNA, 19 bp, Homo sapiens
gggaggaaacctgagatct

SEQ ID NO: 4438450 - DNA, 13 bp, Homo sapiens
gggaggagggaga

SEQ ID NO: 4438451 - DNA, 16 bp, Homo sapiens
gggaggagggcaggca

SEQ ID NO: 4438452 - DNA, 11 bp, Homo sapiens
gggaggcagag

SEQ ID NO: 4438453 - DNA, 14 bp, Homo sapiens
gggaggcagggctc

SEQ ID NO: 4438454 - DNA, 22 bp, Homo sapiens
gggaggctcccggggcctggac

SEQ ID NO: 4438455 - DNA, 15 bp, Homo sapiens
gggaggctgaggcag

SEQ ID NO: 4438456 - DNA, 19 bp, Homo sapiens
gggaggctgaggcaggaga

SEQ ID NO: 4438457 - DNA, 13 bp, Homo sapiens
gggaggctggggc

SEQ ID NO: 4438458 - DNA, 11 bp, Homo sapiens
gggagggatta

SEQ ID NO: 4438459 - DNA, 16 bp, Homo sapiens
gggaggggaaaagcat

SEQ ID NO: 4438460 - DNA, 22 bp, Homo sapiens
gggaggggcgcaccccacagct

SEQ ID NO: 4438461 - DNA, 14 bp, Homo sapiens
gggagggggagagg

SEQ ID NO: 4438462 - DNA, 23 bp, Homo sapiens
gggaggtggaagaagggagaaga

SEQ ID NO: 4438463 - DNA, 16 bp, Homo sapiens
gggaggttgtggggcc

SEQ ID NO: 4438464 - DNA, 20 bp, Homo sapiens
gggagtccagggtttctctg

SEQ ID NO: 4438465 - DNA, 21 bp, Homo sapiens
gggagtggttaggcagcaagc

SEQ ID NO: 4438466 - DNA, 13 bp, Homo sapiens
gggagtgtgtgcc

SEQ ID NO: 4438467 - DNA, 20 bp, Homo sapiens
gggagttcgagaccaacctg

SEQ ID NO: 4438468 - DNA, 14 bp, Homo sapiens
gggatagatgtgtg

SEQ ID NO: 4438469 - DNA, 13 bp, Homo sapiens
gggatattgcctt

SEQ ID NO: 4438470 - DNA, 11 bp, Homo sapiens
gggatatttag

SEQ ID NO: 4438471 - DNA, 22 bp, Homo sapiens
gggatcagccccgcctgtcaca

SEQ ID NO: 4438472 - DNA, 23 bp, Homo sapiens
gggatcagccccgcctgtcacaa

SEQ ID NO: 4438473 - DNA, 19 bp, Homo sapiens
gggatccacgctgggccta

SEQ ID NO: 4438474 - DNA, 20 bp, Homo sapiens
gggatcctccacagagagga

SEQ ID NO: 4438475 - DNA, 22 bp, Homo sapiens
gggatcctccacagagaggagg

SEQ ID NO: 4438476 - DNA, 19 bp, Homo sapiens
gggatcttcccacaggagg

SEQ ID NO: 4438477 - DNA, 16 bp, Homo sapiens
gggatgattcaagcca

SEQ ID NO: 4438478 - DNA, 20 bp, Homo sapiens
gggatgcgtgttccagccaa

SEQ ID NO: 4438479 - DNA, 22 bp, Homo sapiens
gggatgctctttaaataataaa

SEQ ID NO: 4438480 - DNA, 15 bp, Homo sapiens
gggatgctgggctgg

SEQ ID NO: 4438481 - DNA, 19 bp, Homo sapiens
gggatggagaggcggcctc

SEQ ID NO: 4438482 - DNA, 15 bp, Homo sapiens
gggatggaggagaag

SEQ ID NO: 4438483 - DNA, 18 bp, Homo sapiens
gggatggaggagaagaat

SEQ ID NO: 4438484 - DNA, 20 bp, Homo sapiens
gggatggtcggatctcacag

SEQ ID NO: 4438485 - DNA, 14 bp, Homo sapiens
gggatgtctctcat

SEQ ID NO: 4438486 - DNA, 14 bp, Homo sapiens
gggattcaggctgc

SEQ ID NO: 4438487 - DNA, 16 bp, Homo sapiens
gggattcaggctgctt

SEQ ID NO: 4438488 - DNA, 14 bp, Homo sapiens
gggattctgtgttt

SEQ ID NO: 4438489 - DNA, 18 bp, Homo sapiens
gggattgaggggccctgg

SEQ ID NO: 4438490 - DNA, 20 bp, Homo sapiens
gggattggaccgagctggaa

SEQ ID NO: 4438491 - DNA, 17 bp, Homo sapiens
gggcaaaccctggtgct

SEQ ID NO: 4438492 - DNA, 14 bp, Homo sapiens
gggcaaagcctagt

SEQ ID NO: 4438493 - DNA, 13 bp, Homo sapiens
gggcaaataatga

SEQ ID NO: 4438494 - DNA, 22 bp, Homo sapiens
gggcaacagagcaagaccctgt

SEQ ID NO: 4438495 - DNA, 21 bp, Homo sapiens
gggcaaccaactgccccaggg

SEQ ID NO: 4438496 - DNA, 16 bp, Homo sapiens
gggcaactcttggaag

SEQ ID NO: 4438497 - DNA, 20 bp, Homo sapiens
gggcaaggaaaaagaaaata

SEQ ID NO: 4438498 - DNA, 17 bp, Homo sapiens
gggcaccacaaaatata

SEQ ID NO: 4438499 - DNA, 22 bp, Homo sapiens
gggcaccacaaaatatacaaaa

SEQ ID NO: 4438500 - DNA, 13 bp, Homo sapiens
gggcaccaggggc

SEQ ID NO: 4438501 - DNA, 14 bp, Homo sapiens
gggcaccaggggcc

SEQ ID NO: 4438502 - DNA, 22 bp, Homo sapiens
gggcacctatgagatggccatg

SEQ ID NO: 4438503 - DNA, 23 bp, Homo sapiens
gggcacctgcttccacccgtctc

SEQ ID NO: 4438504 - DNA, 23 bp, Homo sapiens
gggcactcagaagttgtgctaaa

SEQ ID NO: 4438505 - DNA, 13 bp, Homo sapiens
gggcactgccagc

SEQ ID NO: 4438506 - DNA, 22 bp, Homo sapiens
gggcagaacactaacctgaccg

SEQ ID NO: 4438507 - DNA, 18 bp, Homo sapiens
gggcagactgtgaacttg

SEQ ID NO: 4438508 - DNA, 22 bp, Homo sapiens
gggcagactgtgaacttgactg

SEQ ID NO: 4438509 - DNA, 12 bp, Homo sapiens
gggcagagccca

SEQ ID NO: 4438510 - DNA, 14 bp, Homo sapiens
ggcctctccctgcc

SEQ ID NO: 4438511 - DNA, 22 bp, Homo sapiens
ggcctctccttggaaggtcttt

SEQ ID NO: 4438512 - DNA, 20 bp, Homo sapiens
ggcctctctcctgcctgccc

SEQ ID NO: 4438513 - DNA, 14 bp, Homo sapiens
ggcctctctctgct

SEQ ID NO: 4438514 - DNA, 16 bp, Homo sapiens
ggcctctctctgctcc

SEQ ID NO: 4438515 - DNA, 20 bp, Homo sapiens
ggcctctgcggagcacactg

SEQ ID NO: 4438516 - DNA, 13 bp, Homo sapiens
ggcctctgctggc

SEQ ID NO: 4438517 - DNA, 18 bp, Homo sapiens
ggcctctgctggctcagg

SEQ ID NO: 4438518 - DNA, 10 bp, Homo sapiens
ggcctctggt

SEQ ID NO: 4438519 - DNA, 18 bp, Homo sapiens
ggcctctggttgcctccc

SEQ ID NO: 4438520 - DNA, 16 bp, Homo sapiens
ggcctgaaacccgccc

SEQ ID NO: 4438521 - DNA, 17 bp, Homo sapiens
ggcctgaactgaggaga

SEQ ID NO: 4438522 - DNA, 16 bp, Homo sapiens
ggcctgacagctctgt

SEQ ID NO: 4438523 - DNA, 14 bp, Homo sapiens
ggcctgacttgagc

SEQ ID NO: 4438524 - DNA, 22 bp, Homo sapiens
ggcctgagatttcatctgctct

SEQ ID NO: 4438525 - DNA, 21 bp, Homo sapiens
ggcctgagcgtccagaaatgg

SEQ ID NO: 4438526 - DNA, 14 bp, Homo sapiens
ggcctgatctctgc

SEQ ID NO: 4438527 - DNA, 18 bp, Homo sapiens
ggcctgatgctccctccc

SEQ ID NO: 4438528 - DNA, 23 bp, Homo sapiens
ggcctgatgctccctcccctgcc

SEQ ID NO: 4438529 - DNA, 13 bp, Homo sapiens
ggcctgcaaacct

SEQ ID NO: 4438530 - DNA, 23 bp, Homo sapiens
ggcctgcaaaccttcctgggagg

SEQ ID NO: 4438531 - DNA, 17 bp, Homo sapiens
ggcctgcacggtgggcc

SEQ ID NO: 4438532 - DNA, 18 bp, Homo sapiens
ggcctgcctccagggctg

SEQ ID NO: 4438533 - DNA, 20 bp, Homo sapiens
ggcctgcgggcccctggtga

SEQ ID NO: 4438534 - DNA, 17 bp, Homo sapiens
ggcctgcggtggaggga

SEQ ID NO: 4438535 - DNA, 17 bp, Homo sapiens
ggcctgctgccagtgca

SEQ ID NO: 4438536 - DNA, 20 bp, Homo sapiens
ggcctgctgccagtgcagcc

SEQ ID NO: 4438537 - DNA, 23 bp, Homo sapiens
ggcctgctgggctctccacctca

SEQ ID NO: 4438538 - DNA, 19 bp, Homo sapiens
ggcctgctgtgattccact

SEQ ID NO: 4438539 - DNA, 15 bp, Homo sapiens
ggcctggccaggagc

SEQ ID NO: 4438540 - DNA, 15 bp, Homo sapiens
ggcctggcctcatct

SEQ ID NO: 4438541 - DNA, 22 bp, Homo sapiens
ggcctggctggaggagcagcag

SEQ ID NO: 4438542 - DNA, 19 bp, Homo sapiens
ggcctgggcaggagggagg

SEQ ID NO: 4438543 - DNA, 17 bp, Homo sapiens
ggcctggggagcccact

SEQ ID NO: 4438544 - DNA, 15 bp, Homo sapiens
ggcctggggaggccc

SEQ ID NO: 4438545 - DNA, 17 bp, Homo sapiens
ggcctgggggaggtcag

SEQ ID NO: 4438546 - DNA, 19 bp, Homo sapiens
ggcctggtttcctcgagag

SEQ ID NO: 4438547 - DNA, 12 bp, Homo sapiens
ggcctgtcccaa

SEQ ID NO: 4438548 - DNA, 22 bp, Homo sapiens
ggcctgtcccaattctgcccgc

SEQ ID NO: 4438549 - DNA, 15 bp, Homo sapiens
ggcctgtccctggga

SEQ ID NO: 4438550 - DNA, 18 bp, Homo sapiens
ggcctgtcccttgcctct

SEQ ID NO: 4438551 - DNA, 18 bp, Homo sapiens
ggcctgtctcatccccag

SEQ ID NO: 4438552 - DNA, 19 bp, Homo sapiens
ggcctgtctcatccccagg

SEQ ID NO: 4438553 - DNA, 23 bp, Homo sapiens
ggcctgtctcatccccaggggtc

SEQ ID NO: 4438554 - DNA, 13 bp, Homo sapiens
ggccttaatttcc

SEQ ID NO: 4438555 - DNA, 17 bp, Homo sapiens
ggccttaatttcctttt

SEQ ID NO: 4438556 - DNA, 22 bp, Homo sapiens
ggccttagtagtcaaaaacaaa

SEQ ID NO: 4438557 - DNA, 13 bp, Homo sapiens
ggccttgcccaga

SEQ ID NO: 4438558 - DNA, 15 bp, Homo sapiens
ggccttgcccagaga

SEQ ID NO: 4438559 - DNA, 16 bp, Homo sapiens
ggccttgcccagagat

SEQ ID NO: 4438560 - DNA, 22 bp, Homo sapiens
ggccttgcggtatccgccccca

SEQ ID NO: 4438561 - DNA, 21 bp, Homo sapiens
ggccttgtcctacgtccaagg

SEQ ID NO: 4438562 - DNA, 15 bp, Homo sapiens
ggcctttccttccct

SEQ ID NO: 4438563 - DNA, 15 bp, Homo sapiens
ggcctttttcctgcg

SEQ ID NO: 4438564 - DNA, 11 bp, Homo sapiens
ggcgaataaat

SEQ ID NO: 4438565 - DNA, 16 bp, Homo sapiens
ggcgaataaatgttca

SEQ ID NO: 4438566 - DNA, 13 bp, Homo sapiens
ggcgagctgcagg

SEQ ID NO: 4438567 - DNA, 14 bp, Homo sapiens
ggcgagtctgggga

SEQ ID NO: 4438568 - DNA, 14 bp, Homo sapiens
ggcgcaagcctgta

SEQ ID NO: 4438569 - DNA, 14 bp, Homo sapiens
ggcgcaccccacag

SEQ ID NO: 4438570 - DNA, 17 bp, Homo sapiens
ggcgcaccccacagctg

SEQ ID NO: 4438571 - DNA, 23 bp, Homo sapiens
ggcgcaccccacagctggggccg

SEQ ID NO: 4438572 - DNA, 14 bp, Homo sapiens
ggcgcaggtgggct

SEQ ID NO: 4438573 - DNA, 21 bp, Homo sapiens
ggcgcccacccggcccggctg

SEQ ID NO: 4438574 - DNA, 13 bp, Homo sapiens
ggcgcctctgcaa

SEQ ID NO: 4438575 - DNA, 14 bp, Homo sapiens
ggcgcggccagccc

SEQ ID NO: 4438576 - DNA, 16 bp, Homo sapiens
ggcgcggccagccccg

SEQ ID NO: 4438577 - DNA, 16 bp, Homo sapiens
ggcgcgggcagccacc

SEQ ID NO: 4438578 - DNA, 21 bp, Homo sapiens
ggcgctcggtctccaccccag

SEQ ID NO: 4438579 - DNA, 14 bp, Homo sapiens
ggcgctgacactgg

SEQ ID NO: 4438580 - DNA, 18 bp, Homo sapiens
ggcgcttggatctggggt

SEQ ID NO: 4438581 - DNA, 12 bp, Homo sapiens
ggcggaggctgt

SEQ ID NO: 4438582 - DNA, 20 bp, Homo sapiens
ggcggatgttgaagtgagct

SEQ ID NO: 4438583 - DNA, 15 bp, Homo sapiens
ggcggcagccccact

SEQ ID NO: 4438584 - DNA, 13 bp, Homo sapiens
ggcggcctcccag

SEQ ID NO: 4438585 - DNA, 15 bp, Homo sapiens
ggcggcctcccaggt

SEQ ID NO: 4438586 - DNA, 17 bp, Homo sapiens
ggcggcctcccaggtcc

SEQ ID NO: 4438587 - DNA, 22 bp, Homo sapiens
ggcggctactcagcagccctcc

SEQ ID NO: 4438588 - DNA, 13 bp, Homo sapiens
ggcggctcctggt

SEQ ID NO: 4438589 - DNA, 22 bp, Homo sapiens
ggcgggatcctccacagagagg

SEQ ID NO: 4438590 - DNA, 14 bp, Homo sapiens
ggcgggctcagagc

SEQ ID NO: 4438591 - DNA, 10 bp, Homo sapiens
ggcgggtgac

SEQ ID NO: 4438592 - DNA, 20 bp, Homo sapiens
ggcgggtggatcacgaggtc

SEQ ID NO: 4438593 - DNA, 12 bp, Homo sapiens
ggcggtacacta

SEQ ID NO: 4438594 - DNA, 14 bp, Homo sapiens
ggcggtggctgccc

SEQ ID NO: 4438595 - DNA, 17 bp, Homo sapiens
ggcgtgactcacccaag

SEQ ID NO: 4438596 - DNA, 17 bp, Homo sapiens
ggcgttcacctccctgc

SEQ ID NO: 4438597 - DNA, 18 bp, Homo sapiens
ggcgttgggagcctagct

SEQ ID NO: 4438598 - DNA, 21 bp, Homo sapiens
ggctaaaagacatgcattttt

SEQ ID NO: 4438599 - DNA, 14 bp, Homo sapiens
ggctaaggcaggag

SEQ ID NO: 4438600 - DNA, 13 bp, Homo sapiens
ggctaatttttgt

SEQ ID NO: 4438601 - DNA, 12 bp, Homo sapiens
ggctacagctcc

SEQ ID NO: 4438602 - DNA, 17 bp, Homo sapiens
ggctacagctccacacg

SEQ ID NO: 4438603 - DNA, 19 bp, Homo sapiens
ggctaccctgagctgaggc

SEQ ID NO: 4438604 - DNA, 15 bp, Homo sapiens
ggctactcagcagcc

SEQ ID NO: 4438605 - DNA, 22 bp, Homo sapiens
ggctagaacctggagagctaga

SEQ ID NO: 4438606 - DNA, 22 bp, Homo sapiens
ggctagaacctgtagagctaga

SEQ ID NO: 4438607 - DNA, 19 bp, Homo sapiens
ggctagagacagatgctgg

SEQ ID NO: 4438608 - DNA, 20 bp, Homo sapiens
ggctagaggccagccccacc

SEQ ID NO: 4438609 - DNA, 20 bp, Homo sapiens
ggctagagtcctcactccca

SEQ ID NO: 4438610 - DNA, 15 bp, Homo sapiens
ggctaggtagaaaaa

SEQ ID NO: 4438611 - DNA, 23 bp, Homo sapiens
ggctaggtatcattcaactctcc

SEQ ID NO: 4438612 - DNA, 19 bp, Homo sapiens
ggctatagctacaggaagc

SEQ ID NO: 4438613 - DNA, 20 bp, Homo sapiens
ggctatagctacaggaagca

SEQ ID NO: 4438614 - DNA, 20 bp, Homo sapiens
ggctatgaaaatgagccctg

SEQ ID NO: 4438615 - DNA, 18 bp, Homo sapiens
ggctatgaggaaactgag

SEQ ID NO: 4438616 - DNA, 22 bp, Homo sapiens
ggctatttttgaagcaaagaag

SEQ ID NO: 4438617 - DNA, 23 bp, Homo sapiens
ggctcaagcaatcctcctgcctc

SEQ ID NO: 4438618 - DNA, 13 bp, Homo sapiens
ggctcacccagtc

SEQ ID NO: 4438619 - DNA, 13 bp, Homo sapiens
ggctcacgcctgt

SEQ ID NO: 4438620 - DNA, 24 bp, Homo sapiens
ggctcacgcctgtaatcccagcag

SEQ ID NO: 4438621 - DNA, 15 bp, Homo sapiens
ggctcactgccaggc

SEQ ID NO: 4438622 - DNA, 16 bp, Homo sapiens
ggctcactgccaggcc

SEQ ID NO: 4438623 - DNA, 20 bp, Homo sapiens
ggctcactgccaggccagcc

SEQ ID NO: 4438624 - DNA, 17 bp, Homo sapiens
ggctcagaagaatttaa

SEQ ID NO: 4438625 - DNA, 14 bp, Homo sapiens
ggctcagacccctc

SEQ ID NO: 4438626 - DNA, 15 bp, Homo sapiens
ggctcagacccctca

SEQ ID NO: 4438627 - DNA, 12 bp, Homo sapiens
ggctcagagctt

SEQ ID NO: 4438628 - DNA, 15 bp, Homo sapiens
ggctcagagctttgt

SEQ ID NO: 4438629 - DNA, 16 bp, Homo sapiens
ggctcagagctttgtc

SEQ ID NO: 4438630 - DNA, 23 bp, Homo sapiens
ggctcagagctttgtcacttgcc

SEQ ID NO: 4438631 - DNA, 21 bp, Homo sapiens
ggcatcttttgtattaagaaa

SEQ ID NO: 4438632 - DNA, 16 bp, Homo sapiens
ggcatggcagggccag

SEQ ID NO: 4438633 - DNA, 14 bp, Homo sapiens
ggcatggctgggaa

SEQ ID NO: 4438634 - DNA, 21 bp, Homo sapiens
ggcatggtggcgcaagcctgt

SEQ ID NO: 4438635 - DNA, 19 bp, Homo sapiens
ggcatgtcatttgcacaca

SEQ ID NO: 4438636 - DNA, 16 bp, Homo sapiens
ggcatgtcccacccac

SEQ ID NO: 4438637 - DNA, 20 bp, Homo sapiens
ggcatgtcccacccacccgc

SEQ ID NO: 4438638 - DNA, 12 bp, Homo sapiens
ggcatgtggaga

SEQ ID NO: 4438639 - DNA, 14 bp, Homo sapiens
ggcatgtggagaca

SEQ ID NO: 4438640 - DNA, 16 bp, Homo sapiens
ggcattttcctcctct

SEQ ID NO: 4438641 - DNA, 19 bp, Homo sapiens
ggccaaacccttgctttcc

SEQ ID NO: 4438642 - DNA, 21 bp, Homo sapiens
ggccaaacccttgctttcctg

SEQ ID NO: 4438643 - DNA, 17 bp, Homo sapiens
ggccaaatctagaattt

SEQ ID NO: 4438644 - DNA, 15 bp, Homo sapiens
ggccaaggacccagg

SEQ ID NO: 4438645 - DNA, 23 bp, Homo sapiens
ggccaaggacccaggcgctgcat

SEQ ID NO: 4438646 - DNA, 15 bp, Homo sapiens
ggccaaggtcctgct

SEQ ID NO: 4438647 - DNA, 22 bp, Homo sapiens
ggccaatgcacctaaagaaaaa

SEQ ID NO: 4438648 - DNA, 18 bp, Homo sapiens
ggccacacaggcagggcc

SEQ ID NO: 4438649 - DNA, 19 bp, Homo sapiens
ggccacacaggcagggcct

SEQ ID NO: 4438650 - DNA, 16 bp, Homo sapiens
ggccacacccagcggc

SEQ ID NO: 4438651 - DNA, 13 bp, Homo sapiens
ggccacacccagg

SEQ ID NO: 4438652 - DNA, 16 bp, Homo sapiens
ggccacacccaggaag

SEQ ID NO: 4438653 - DNA, 17 bp, Homo sapiens
ggccacacccaggaagg

SEQ ID NO: 4438654 - DNA, 14 bp, Homo sapiens
ggccacactggggc

SEQ ID NO: 4438655 - DNA, 17 bp, Homo sapiens
ggccacactggggctga

SEQ ID NO: 4438656 - DNA, 18 bp, Homo sapiens
ggccacactggggctgac

SEQ ID NO: 4438657 - DNA, 13 bp, Homo sapiens
ggccacagagaac

SEQ ID NO: 4438658 - DNA, 16 bp, Homo sapiens
ggccacatagatgctg

SEQ ID NO: 4438659 - DNA, 20 bp, Homo sapiens
ggccaccacctttggctggt

SEQ ID NO: 4438660 - DNA, 23 bp, Homo sapiens
ggccaccagccatcctccctcca

SEQ ID NO: 4438661 - DNA, 18 bp, Homo sapiens
ggccaccaggtgcctttc

SEQ ID NO: 4438662 - DNA, 20 bp, Homo sapiens
ggccaccgccttgcccagcc

SEQ ID NO: 4438663 - DNA, 14 bp, Homo sapiens
ggccacgctccagc

SEQ ID NO: 4438664 - DNA, 17 bp, Homo sapiens
ggccacgtgccaggccc

SEQ ID NO: 4438665 - DNA, 19 bp, Homo sapiens
ggccactcaacagagagga

SEQ ID NO: 4438666 - DNA, 12 bp, Homo sapiens
ggccactcctcc

SEQ ID NO: 4438667 - DNA, 14 bp, Homo sapiens
ggccactggaagga

SEQ ID NO: 4438668 - DNA, 16 bp, Homo sapiens
ggccactggatcctgc

SEQ ID NO: 4438669 - DNA, 20 bp, Homo sapiens
ggccactggatcctgctgct

SEQ ID NO: 4438670 - DNA, 22 bp, Homo sapiens
ggccactggggtgccttcactg

SEQ ID NO: 4438671 - DNA, 16 bp, Homo sapiens
ggccacttgcttgctg

SEQ ID NO: 4438672 - DNA, 12 bp, Homo sapiens
ggccagacatgg

SEQ ID NO: 4438673 - DNA, 23 bp, Homo sapiens
ggccagacccacgggctcatgca

SEQ ID NO: 4438674 - DNA, 16 bp, Homo sapiens
ggccagagcctctggc

SEQ ID NO: 4438675 - DNA, 18 bp, Homo sapiens
ggccagagcctctggccc

SEQ ID NO: 4438676 - DNA, 13 bp, Homo sapiens
ggccagaggctgg

SEQ ID NO: 4438677 - DNA, 15 bp, Homo sapiens
ggccagaggctggga

SEQ ID NO: 4438678 - DNA, 15 bp, Homo sapiens
ggccagagtggcctg

SEQ ID NO: 4438679 - DNA, 19 bp, Homo sapiens
ggccagagtggcctggcca

SEQ ID NO: 4438680 - DNA, 20 bp, Homo sapiens
ggccagagtggcctggccag

SEQ ID NO: 4438681 - DNA, 18 bp, Homo sapiens
ggccagatggcccctcca

SEQ ID NO: 4438682 - DNA, 18 bp, Homo sapiens
ggccagcaccatctcttt

SEQ ID NO: 4438683 - DNA, 21 bp, Homo sapiens
ggccagcaggcgggctccttt

SEQ ID NO: 4438684 - DNA, 16 bp, Homo sapiens
ggccagcccagccagg

SEQ ID NO: 4438685 - DNA, 17 bp, Homo sapiens
ggccagcccagccaggc

SEQ ID NO: 4438686 - DNA, 15 bp, Homo sapiens
ggccagccccaccca

SEQ ID NO: 4438687 - DNA, 15 bp, Homo sapiens
ggccagccccggccc

SEQ ID NO: 4438688 - DNA, 17 bp, Homo sapiens
ggccagccccggccctg

SEQ ID NO: 4438689 - DNA, 19 bp, Homo sapiens
ggccagccccggccctggg

SEQ ID NO: 4438690 - DNA, 23 bp, Homo sapiens
ggccagcccctggggcccagccc

SEQ ID NO: 4438691 - DNA, 16 bp, Homo sapiens
ggccagcctccgagag

SEQ ID NO: 4438692 - DNA, 22 bp, Homo sapiens
ggccagcggggctgctcaccca

SEQ ID NO: 4438693 - DNA, 15 bp, Homo sapiens
ggccagctcaggaat

SEQ ID NO: 4438694 - DNA, 23 bp, Homo sapiens
ggccagctcaggaattccctgga

SEQ ID NO: 4438695 - DNA, 18 bp, Homo sapiens
ggccagctgcggccaggc

SEQ ID NO: 4438696 - DNA, 15 bp, Homo sapiens
ggccaggagctcttc

SEQ ID NO: 4438697 - DNA, 13 bp, Homo sapiens
ggccaggaggctg

SEQ ID NO: 4438698 - DNA, 16 bp, Homo sapiens
ggccaggaggctgcca

SEQ ID NO: 4438699 - DNA, 22 bp, Homo sapiens
ggccaggcagatctgtgcccca

SEQ ID NO: 4438700 - DNA, 13 bp, Homo sapiens
ggccaggcctctg

SEQ ID NO: 4438701 - DNA, 17 bp, Homo sapiens
ggccaggcctctgctgg

SEQ ID NO: 4438702 - DNA, 22 bp, Homo sapiens
ggccaggcctgcgggcccctgg

SEQ ID NO: 4438703 - DNA, 11 bp, Homo sapiens
ggccagggagg

SEQ ID NO: 4438704 - DNA, 13 bp, Homo sapiens
ggccagggcagag

SEQ ID NO: 4438705 - DNA, 16 bp, Homo sapiens
ggccagtacctttcca

SEQ ID NO: 4438706 - DNA, 22 bp, Homo sapiens
ggccagtccccatttctgcctc

SEQ ID NO: 4438707 - DNA, 19 bp, Homo sapiens
ggccagtcctgcctggcca

SEQ ID NO: 4438708 - DNA, 20 bp, Homo sapiens
ggccagtgctgcccatgagc

SEQ ID NO: 4438709 - DNA, 15 bp, Homo sapiens
ggccagtggaagaaa

SEQ ID NO: 4438710 - DNA, 16 bp, Homo sapiens
ggccagtggaagaaac

SEQ ID NO: 4438711 - DNA, 19 bp, Homo sapiens
ggccagtggctggatctgt

SEQ ID NO: 4438712 - DNA, 14 bp, Homo sapiens
ggccagtgtttaaa

SEQ ID NO: 4438713 - DNA, 15 bp, Homo sapiens
ggccataattatgaa

SEQ ID NO: 4438714 - DNA, 14 bp, Homo sapiens
ggccatactgcctt

SEQ ID NO: 4438715 - DNA, 13 bp, Homo sapiens
ggccatccctggg

SEQ ID NO: 4438716 - DNA, 16 bp, Homo sapiens
ggccatccctgggccc

SEQ ID NO: 4438717 - DNA, 19 bp, Homo sapiens
ggccatccctgggcccctc

SEQ ID NO: 4438718 - DNA, 11 bp, Homo sapiens
ggccatgctca

SEQ ID NO: 4438719 - DNA, 16 bp, Homo sapiens
ggccatgctcaacccc

SEQ ID NO: 4438720 - DNA, 18 bp, Homo sapiens
ggccatgctcaacccccc

SEQ ID NO: 4438721 - DNA, 22 bp, Homo sapiens
ggccatgctcaacccccctccc

SEQ ID NO: 4438722 - DNA, 16 bp, Homo sapiens
ggccatgtgctgccct

SEQ ID NO: 4438723 - DNA, 20 bp, Homo sapiens
ggccattctttcccaacacc

SEQ ID NO: 4438724 - DNA, 16 bp, Homo sapiens
ggcccaaccctgtctg

SEQ ID NO: 4438725 - DNA, 17 bp, Homo sapiens
ggcccaactggttcagg

SEQ ID NO: 4438726 - DNA, 13 bp, Homo sapiens
ggcccaaggcggc

SEQ ID NO: 4438727 - DNA, 14 bp, Homo sapiens
ggcccaaggcggcc

SEQ ID NO: 4438728 - DNA, 16 bp, Homo sapiens
ggcccaatgcctataa

SEQ ID NO: 4438729 - DNA, 14 bp, Homo sapiens
ggcccacagctccc

SEQ ID NO: 4438730 - DNA, 14 bp, Homo sapiens
ggcccaccagggtc

SEQ ID NO: 4438731 - DNA, 20 bp, Homo sapiens
ggcccacccagtccatgctc

SEQ ID NO: 4438732 - DNA, 22 bp, Homo sapiens
ggcccacccagtccatgctcca

SEQ ID NO: 4438733 - DNA, 23 bp, Homo sapiens
ggcccacccagtccatgctccag

SEQ ID NO: 4438734 - DNA, 14 bp, Homo sapiens
ggcccactcagccc

SEQ ID NO: 4438735 - DNA, 17 bp, Homo sapiens
ggcccactgagtctcgg

SEQ ID NO: 4438736 - DNA, 12 bp, Homo sapiens
ggcccagagcca

SEQ ID NO: 4438737 - DNA, 15 bp, Homo sapiens
ggcccagagccatac

SEQ ID NO: 4438738 - DNA, 18 bp, Homo sapiens
ggcccagagcgaggaaag

SEQ ID NO: 4438739 - DNA, 20 bp, Homo sapiens
ggcccagagcgaggaaagga

SEQ ID NO: 4438740 - DNA, 13 bp, Homo sapiens
ggcccagccccca

SEQ ID NO: 4438741 - DNA, 12 bp, Homo sapiens
ggcccagcccgg

SEQ ID NO: 4438742 - DNA, 16 bp, Homo sapiens
ggcccagccctgctgg

SEQ ID NO: 4438743 - DNA, 14 bp, Homo sapiens
ggcccagctgctcc

SEQ ID NO: 4438744 - DNA, 15 bp, Homo sapiens
ggcccaggccaggtg

SEQ ID NO: 4438745 - DNA, 19 bp, Homo sapiens
ggcccagggacaccagcca

SEQ ID NO: 4438746 - DNA, 20 bp, Homo sapiens
ggcccagggacaccagccag

SEQ ID NO: 4438747 - DNA, 22 bp, Homo sapiens
ggcccagtacctagctggctct

SEQ ID NO: 4438748 - DNA, 19 bp, Homo sapiens
ggcccagtgccactgcccc

SEQ ID NO: 4438749 - DNA, 19 bp, Homo sapiens
ggcccagtgtcaagttgtg

SEQ ID NO: 4438750 - DNA, 17 bp, Homo sapiens
ggccccaccagtgcctc

SEQ ID NO: 4438751 - DNA, 14 bp, Homo sapiens
ggccccagcccacc

SEQ ID NO: 4438752 - DNA, 16 bp, Homo sapiens
ggccccagcccaccct

SEQ ID NO: 4438753 - DNA, 16 bp, Homo sapiens
ggccccagtcagcctc

SEQ ID NO: 4438754 - DNA, 17 bp, Homo sapiens
ggccccatcttgatctt

SEQ ID NO: 4438755 - DNA, 22 bp, Homo sapiens
ggccccatcttgatctttgagc

SEQ ID NO: 4438756 - DNA, 15 bp, Homo sapiens
ggcccccaacccctc

SEQ ID NO: 4438757 - DNA, 19 bp, Homo sapiens
ggcccccaacccctcctcc

SEQ ID NO: 4438758 - DNA, 21 bp, Homo sapiens
ggcccccaacctcagggctcc

SEQ ID NO: 4438759 - DNA, 16 bp, Homo sapiens
ggcccccaataaaggc

SEQ ID NO: 4438760 - DNA, 17 bp, Homo sapiens
ggcccccaataaaggca

SEQ ID NO: 4438761 - DNA, 20 bp, Homo sapiens
ggcccccaataaaggcagct

SEQ ID NO: 4438762 - DNA, 22 bp, Homo sapiens
ggcccccaataaaggcagctgc

SEQ ID NO: 4438763 - DNA, 20 bp, Homo sapiens
ggcccccatcagccctgcta

SEQ ID NO: 4438764 - DNA, 18 bp, Homo sapiens
ggccccccgcacagccac

SEQ ID NO: 4438765 - DNA, 19 bp, Homo sapiens
ggccccccgcacagccacc

SEQ ID NO: 4438766 - DNA, 23 bp, Homo sapiens
ggccccccgcgctcgcccagcag

SEQ ID NO: 4438767 - DNA, 16 bp, Homo sapiens
ggcccccggccaagga

SEQ ID NO: 4438768 - DNA, 13 bp, Homo sapiens
ggccccgccaggg

SEQ ID NO: 4438769 - DNA, 15 bp, Homo sapiens
ggccccgccagggct

SEQ ID NO: 4438770 - DNA, 19 bp, Homo sapiens
ggccccgccagggctgggg

SEQ ID NO: 4438771 - DNA, 15 bp, Homo sapiens
ggcccctcacctact

SEQ ID NO: 4438772 - DNA, 12 bp, Homo sapiens
ggcccctccagc

SEQ ID NO: 4438773 - DNA, 13 bp, Homo sapiens
ggcccctccatcc

SEQ ID NO: 4438774 - DNA, 17 bp, Homo sapiens
ggcccctccatccaccc

SEQ ID NO: 4438775 - DNA, 16 bp, Homo sapiens
ggcccctccccctgag

SEQ ID NO: 4438776 - DNA, 15 bp, Homo sapiens
ggcccctcccctgca

SEQ ID NO: 4438777 - DNA, 14 bp, Homo sapiens
ggcccctccctacc

SEQ ID NO: 4438778 - DNA, 16 bp, Homo sapiens
ggcccctccctacctc

SEQ ID NO: 4438779 - DNA, 17 bp, Homo sapiens
ggcccctccctacctca

SEQ ID NO: 4438780 - DNA, 20 bp, Homo sapiens
ggcccctccctacctcaacc

SEQ ID NO: 4438781 - DNA, 19 bp, Homo sapiens
ggcccctcgaccctgtgca

SEQ ID NO: 4438782 - DNA, 19 bp, Homo sapiens
ggcccctctctagggaccc

SEQ ID NO: 4438783 - DNA, 13 bp, Homo sapiens
ggcccctgcctcc

SEQ ID NO: 4438784 - DNA, 17 bp, Homo sapiens
ggcccctgcgtgggggc

SEQ ID NO: 4438785 - DNA, 12 bp, Homo sapiens
ggcccctgggat

SEQ ID NO: 4438786 - DNA, 20 bp, Homo sapiens
ggcccctgggcttggcctgc

SEQ ID NO: 4438787 - DNA, 23 bp, Homo sapiens
ggcccctgggcttggcctgctgt

SEQ ID NO: 4438788 - DNA, 12 bp, Homo sapiens
ggcccctgggga

SEQ ID NO: 4438789 - DNA, 21 bp, Homo sapiens
ggcccctgtctgttcccagcc

SEQ ID NO: 4438790 - DNA, 22 bp, Homo sapiens
ggcccgagcctgaactgagccc

SEQ ID NO: 4438791 - DNA, 24 bp, Homo sapiens
ggcccgagcctgaactgagcccca

SEQ ID NO: 4438792 - DNA, 14 bp, Homo sapiens
ggcccgagcgcctg

SEQ ID NO: 4438793 - DNA, 15 bp, Homo sapiens
ggcccgagcgcctgc

SEQ ID NO: 4438794 - DNA, 17 bp, Homo sapiens
ggcccgagcgcctgcgt

SEQ ID NO: 4438795 - DNA, 12 bp, Homo sapiens
ggcccgcctgcc

SEQ ID NO: 4438796 - DNA, 15 bp, Homo sapiens
ggcccgcctgcccag

SEQ ID NO: 4438797 - DNA, 14 bp, Homo sapiens
ggcccggccacacc

SEQ ID NO: 4438798 - DNA, 18 bp, Homo sapiens
ggcccggctgagccctgc

SEQ ID NO: 4438799 - DNA, 13 bp, Homo sapiens
ggcccggtccaca

SEQ ID NO: 4438800 - DNA, 20 bp, Homo sapiens
ggcccgtcagcatcactgat

SEQ ID NO: 4438801 - DNA, 20 bp, Homo sapiens
ggccctcaatccaccttcag

SEQ ID NO: 4438802 - DNA, 22 bp, Homo sapiens
ggccctccagtgggctgatgct

SEQ ID NO: 4438803 - DNA, 11 bp, Homo sapiens
ggccctccctg

SEQ ID NO: 4438804 - DNA, 22 bp, Homo sapiens
ggccctccctgactccctgtgg

SEQ ID NO: 4438805 - DNA, 23 bp, Homo sapiens
ggccctccctgactccctgtggg

SEQ ID NO: 4438806 - DNA, 16 bp, Homo sapiens
ggccctcgctgccagc

SEQ ID NO: 4438807 - DNA, 19 bp, Homo sapiens
ggccctcgctgccagctct

SEQ ID NO: 4438808 - DNA, 18 bp, Homo sapiens
ggccctcgggcccagccc

SEQ ID NO: 4438809 - DNA, 20 bp, Homo sapiens
ggccctcgggcccagccccc

SEQ ID NO: 4438810 - DNA, 15 bp, Homo sapiens
ggccctctttccctg

SEQ ID NO: 4438811 - DNA, 15 bp, Homo sapiens
ggccctgactcctct

SEQ ID NO: 4438812 - DNA, 23 bp, Homo sapiens
ggccctgaggcggaggctgtgct

SEQ ID NO: 4438813 - DNA, 22 bp, Homo sapiens
ggccctgcccccaccccttcct

SEQ ID NO: 4438814 - DNA, 18 bp, Homo sapiens
ggccctgcctgcagccag

SEQ ID NO: 4438815 - DNA, 23 bp, Homo sapiens
ggccctgcctgcagccagggctg

SEQ ID NO: 4438816 - DNA, 14 bp, Homo sapiens
ggccctgccttctt

SEQ ID NO: 4438817 - DNA, 20 bp, Homo sapiens
ggccctgctttctacgccaa

SEQ ID NO: 4438818 - DNA, 22 bp, Homo sapiens
ggccctggcctgctgggctctc

SEQ ID NO: 4438819 - DNA, 12 bp, Homo sapiens
ggccctgggctg

SEQ ID NO: 4438820 - DNA, 16 bp, Homo sapiens
ggccctgggctggcac

SEQ ID NO: 4438821 - DNA, 22 bp, Homo sapiens
ggccctgggctgggtgctggga

SEQ ID NO: 4438822 - DNA, 23 bp, Homo sapiens
ggccctggggatcttcccacagg

SEQ ID NO: 4438823 - DNA, 20 bp, Homo sapiens
ggccctgggtaagaagggtg

SEQ ID NO: 4438824 - DNA, 21 bp, Homo sapiens
ggccctgggtaagaagggtgg

SEQ ID NO: 4438825 - DNA, 22 bp, Homo sapiens
ggccctgggtaagaagggtggg

SEQ ID NO: 4438826 - DNA, 19 bp, Homo sapiens
ggccctggtgtttctagca

SEQ ID NO: 4438827 - DNA, 11 bp, Homo sapiens
ggccctgtccc

SEQ ID NO: 4438828 - DNA, 17 bp, Homo sapiens
ggccctgtcccaggccg

SEQ ID NO: 4438829 - DNA, 16 bp, Homo sapiens
ggccctgtcgcccctc

SEQ ID NO: 4438830 - DNA, 21 bp, Homo sapiens
ggcccttgcagttcagcacca

SEQ ID NO: 4438831 - DNA, 17 bp, Homo sapiens
ggcccttgtcggcccca

SEQ ID NO: 4438832 - DNA, 15 bp, Homo sapiens
ggccgagagccttat

SEQ ID NO: 4438833 - DNA, 19 bp, Homo sapiens
ggccgagctcctggggagc

SEQ ID NO: 4438834 - DNA, 18 bp, Homo sapiens
ggccgagggtcctggctc

SEQ ID NO: 4438835 - DNA, 17 bp, Homo sapiens
ggccgcattccctgagt

SEQ ID NO: 4438836 - DNA, 14 bp, Homo sapiens
ggccgctggctggt

SEQ ID NO: 4438837 - DNA, 19 bp, Homo sapiens
ggccgctgttcacccacag

SEQ ID NO: 4438838 - DNA, 20 bp, Homo sapiens
ggccgggcaggtcctgccca

SEQ ID NO: 4438839 - DNA, 13 bp, Homo sapiens
ggccggtgccagc

SEQ ID NO: 4438840 - DNA, 16 bp, Homo sapiens
ggccggtgccagctgc

SEQ ID NO: 4438841 - DNA, 19 bp, Homo sapiens
ggccggtgccagctgccct

SEQ ID NO: 4438842 - DNA, 23 bp, Homo sapiens
ggccggtgccagctgcccttgca

SEQ ID NO: 4438843 - DNA, 24 bp, Homo sapiens
ggccggttttcctcagctctaggc

SEQ ID NO: 4438844 - DNA, 18 bp, Homo sapiens
ggccgtctcctccctcag

SEQ ID NO: 4438845 - DNA, 18 bp, Homo sapiens
ggccgtgtctctgaggac

SEQ ID NO: 4438846 - DNA, 15 bp, Homo sapiens
ggcctaacctgccga

SEQ ID NO: 4438847 - DNA, 22 bp, Homo sapiens
ggcctaacctgccgagagtcca

SEQ ID NO: 4438848 - DNA, 16 bp, Homo sapiens
ggcctacaaatcagta

SEQ ID NO: 4438849 - DNA, 18 bp, Homo sapiens
ggcctactggggatcaga

SEQ ID NO: 4438850 - DNA, 18 bp, Homo sapiens
ggcctagactctgtctac

SEQ ID NO: 4438851 - DNA, 15 bp, Homo sapiens
ggcctatttcagctg

SEQ ID NO: 4438852 - DNA, 17 bp, Homo sapiens
ggcctatttcagctgct

SEQ ID NO: 4438853 - DNA, 19 bp, Homo sapiens
ggcctatttcagctgcttt

SEQ ID NO: 4438854 - DNA, 13 bp, Homo sapiens
ggcctcacccacc

SEQ ID NO: 4438855 - DNA, 10 bp, Homo sapiens
ggcctcagcc

SEQ ID NO: 4438856 - DNA, 12 bp, Homo sapiens
ggcctcagccct

SEQ ID NO: 4438857 - DNA, 17 bp, Homo sapiens
ggcctcagccctgctcc

SEQ ID NO: 4438858 - DNA, 20 bp, Homo sapiens
ggcctcagccctgctccctg

SEQ ID NO: 4438859 - DNA, 23 bp, Homo sapiens
ggcctcagccctgctccctgcct

SEQ ID NO: 4438860 - DNA, 17 bp, Homo sapiens
ggcctcagctgcctcac

SEQ ID NO: 4438861 - DNA, 13 bp, Homo sapiens
ggcctcaggctcc

SEQ ID NO: 4438862 - DNA, 15 bp, Homo sapiens
ggcctcccaggtccc

SEQ ID NO: 4438863 - DNA, 15 bp, Homo sapiens
ggcctccctctctct

SEQ ID NO: 4438864 - DNA, 12 bp, Homo sapiens
ggcctccctgct

SEQ ID NO: 4438865 - DNA, 23 bp, Homo sapiens
ggcctccgcctgggtcatgggcc

SEQ ID NO: 4438866 - DNA, 19 bp, Homo sapiens
ggcctccggcgtcagcctc

SEQ ID NO: 4438867 - DNA, 18 bp, Homo sapiens
ggcctcctcggagagcag

SEQ ID NO: 4438868 - DNA, 22 bp, Homo sapiens
ggcctcctcggagagcagcagc

SEQ ID NO: 4438869 - DNA, 15 bp, Homo sapiens
ggcctcgcctcccca

SEQ ID NO: 4438870 - DNA, 16 bp, Homo sapiens
ggcctcgcctccccac

SEQ ID NO: 4438871 - DNA, 23 bp, Homo sapiens
ggcctcgcctccccaccctcctc

SEQ ID NO: 4438872 - DNA, 18 bp, Homo sapiens
ggagtgcagccttctcca

SEQ ID NO: 4438873 - DNA, 20 bp, Homo sapiens
ggagtgctgtgttttagtct

SEQ ID NO: 4438874 - DNA, 18 bp, Homo sapiens
ggagtggggcctttgcca

SEQ ID NO: 4438875 - DNA, 20 bp, Homo sapiens
ggagtggggcctttgccagc

SEQ ID NO: 4438876 - DNA, 18 bp, Homo sapiens
ggagtggggggacagaga

SEQ ID NO: 4438877 - DNA, 17 bp, Homo sapiens
ggagtggttaggcagca

SEQ ID NO: 4438878 - DNA, 24 bp, Homo sapiens
ggagtgtcctcttccctctctgca

SEQ ID NO: 4438879 - DNA, 15 bp, Homo sapiens
ggagtgtcctggctg

SEQ ID NO: 4438880 - DNA, 19 bp, Homo sapiens
ggagtgtgagccacctaag

SEQ ID NO: 4438881 - DNA, 14 bp, Homo sapiens
ggagtgttatgtat

SEQ ID NO: 4438882 - DNA, 12 bp, Homo sapiens
ggagtgttcccc

SEQ ID NO: 4438883 - DNA, 18 bp, Homo sapiens
ggagttagaaccacagca

SEQ ID NO: 4438884 - DNA, 18 bp, Homo sapiens
ggagttcaagaccagcct

SEQ ID NO: 4438885 - DNA, 22 bp, Homo sapiens
ggagttccttatccctctcttc

SEQ ID NO: 4438886 - DNA, 19 bp, Homo sapiens
ggagtttcctaaaagttca

SEQ ID NO: 4438887 - DNA, 13 bp, Homo sapiens
ggagtttctctgt

SEQ ID NO: 4438888 - DNA, 15 bp, Homo sapiens
ggagtttgaggctgc

SEQ ID NO: 4438889 - DNA, 12 bp, Homo sapiens
ggataaagatga

SEQ ID NO: 4438890 - DNA, 14 bp, Homo sapiens
ggataaagatgaga

SEQ ID NO: 4438891 - DNA, 23 bp, Homo sapiens
ggataagctatccgtgttgcagg

SEQ ID NO: 4438892 - DNA, 17 bp, Homo sapiens
ggataccttcttattta

SEQ ID NO: 4438893 - DNA, 15 bp, Homo sapiens
ggatacgtgtcaatg

SEQ ID NO: 4438894 - DNA, 21 bp, Homo sapiens
ggatacttgaaaccagtattt

SEQ ID NO: 4438895 - DNA, 19 bp, Homo sapiens
ggatagagaatgttccaga

SEQ ID NO: 4438896 - DNA, 15 bp, Homo sapiens
ggataggagcctgct

SEQ ID NO: 4438897 - DNA, 21 bp, Homo sapiens
ggataggccttcattaacaaa

SEQ ID NO: 4438898 - DNA, 20 bp, Homo sapiens
ggatatagttttacttttaa

SEQ ID NO: 4438899 - DNA, 17 bp, Homo sapiens
ggatatggctgcccagg

SEQ ID NO: 4438900 - DNA, 12 bp, Homo sapiens
ggatattataga

SEQ ID NO: 4438901 - DNA, 18 bp, Homo sapiens
ggatatttagaactttgt

SEQ ID NO: 4438902 - DNA, 17 bp, Homo sapiens
ggatccaaactgatcca

SEQ ID NO: 4438903 - DNA, 14 bp, Homo sapiens
ggatccacacctgg

SEQ ID NO: 4438904 - DNA, 18 bp, Homo sapiens
ggatccacgctgggccta

SEQ ID NO: 4438905 - DNA, 17 bp, Homo sapiens
ggatcccatgagctcct

SEQ ID NO: 4438906 - DNA, 22 bp, Homo sapiens
ggatccctcatctgtccctccg

SEQ ID NO: 4438907 - DNA, 13 bp, Homo sapiens
ggatcctccacag

SEQ ID NO: 4438908 - DNA, 14 bp, Homo sapiens
ggatcgacaagaag

SEQ ID NO: 4438909 - DNA, 14 bp, Homo sapiens
ggatcgatgtgctc

SEQ ID NO: 4438910 - DNA, 16 bp, Homo sapiens
ggatcggactctgccc

SEQ ID NO: 4438911 - DNA, 18 bp, Homo sapiens
ggatctacagaacaaccc

SEQ ID NO: 4438912 - DNA, 12 bp, Homo sapiens
ggatctaccagc

SEQ ID NO: 4438913 - DNA, 11 bp, Homo sapiens
ggatctcacag

SEQ ID NO: 4438914 - DNA, 17 bp, Homo sapiens
ggatctcttaagacagc

SEQ ID NO: 4438915 - DNA, 18 bp, Homo sapiens
ggatctcttaagacagca

SEQ ID NO: 4438916 - DNA, 23 bp, Homo sapiens
ggatctgggaccctttccttcct

SEQ ID NO: 4438917 - DNA, 15 bp, Homo sapiens
ggatctgtctgtgca

SEQ ID NO: 4438918 - DNA, 16 bp, Homo sapiens
ggatctgtctgtgcac

SEQ ID NO: 4438919 - DNA, 16 bp, Homo sapiens
ggatcttcccacagga

SEQ ID NO: 4438920 - DNA, 19 bp, Homo sapiens
ggatcttcccacaggaggg

SEQ ID NO: 4438921 - DNA, 18 bp, Homo sapiens
ggatgacaccctggcctg

SEQ ID NO: 4438922 - DNA, 18 bp, Homo sapiens
ggatgattaaaggcagca

SEQ ID NO: 4438923 - DNA, 21 bp, Homo sapiens
ggatgattgcttgagctcagg

SEQ ID NO: 4438924 - DNA, 23 bp, Homo sapiens
ggatgattgcttgagctcaggag

SEQ ID NO: 4438925 - DNA, 12 bp, Homo sapiens
ggatgcatttca

SEQ ID NO: 4438926 - DNA, 21 bp, Homo sapiens
ggatgcccattcctgcctggt

SEQ ID NO: 4438927 - DNA, 13 bp, Homo sapiens
ggatgctgggctg

SEQ ID NO: 4438928 - DNA, 18 bp, Homo sapiens
ggatgctgggctgggccc

SEQ ID NO: 4438929 - DNA, 15 bp, Homo sapiens
ggatggaaggagact

SEQ ID NO: 4438930 - DNA, 20 bp, Homo sapiens
ggatggaccaacctgctctg

SEQ ID NO: 4438931 - DNA, 18 bp, Homo sapiens
ggatggactaaatgatct

SEQ ID NO: 4438932 - DNA, 16 bp, Homo sapiens
ggatggagaggcggcc

SEQ ID NO: 4438933 - DNA, 17 bp, Homo sapiens
ggatggagaggcggcct

SEQ ID NO: 4438934 - DNA, 20 bp, Homo sapiens
ggatggcatctccatgtaga

SEQ ID NO: 4438935 - DNA, 21 bp, Homo sapiens
ggatggggtatggattctaaa

SEQ ID NO: 4438936 - DNA, 17 bp, Homo sapiens
ggatggtgtgccttcca

SEQ ID NO: 4438937 - DNA, 14 bp, Homo sapiens
ggatgtctgtagca

SEQ ID NO: 4438938 - DNA, 22 bp, Homo sapiens
ggatgttgaaaaagttctgcag

SEQ ID NO: 4438939 - DNA, 18 bp, Homo sapiens
ggattaagaaaccttgct

SEQ ID NO: 4438940 - DNA, 13 bp, Homo sapiens
ggattagcttttc

SEQ ID NO: 4438941 - DNA, 17 bp, Homo sapiens
ggattagggagagaaga

SEQ ID NO: 4438942 - DNA, 12 bp, Homo sapiens
ggattcacttct

SEQ ID NO: 4438943 - DNA, 14 bp, Homo sapiens
ggattcaggctgct

SEQ ID NO: 4438944 - DNA, 15 bp, Homo sapiens
ggattcatgtccaga

SEQ ID NO: 4438945 - DNA, 22 bp, Homo sapiens
ggattccactcgtgtgtttcta

SEQ ID NO: 4438946 - DNA, 12 bp, Homo sapiens
ggattccatgct

SEQ ID NO: 4438947 - DNA, 22 bp, Homo sapiens
ggattctgaagttttattttaa

SEQ ID NO: 4438948 - DNA, 21 bp, Homo sapiens
ggattctgaggccctgcccaa

SEQ ID NO: 4438949 - DNA, 23 bp, Homo sapiens
ggattctgtacatgcattgagct

SEQ ID NO: 4438950 - DNA, 16 bp, Homo sapiens
ggattctttccccaga

SEQ ID NO: 4438951 - DNA, 19 bp, Homo sapiens
ggattgaaaatgtccagga

SEQ ID NO: 4438952 - DNA, 13 bp, Homo sapiens
ggattgagtctgt

SEQ ID NO: 4438953 - DNA, 15 bp, Homo sapiens
ggattgttcctgtca

SEQ ID NO: 4438954 - DNA, 23 bp, Homo sapiens
ggatttgatgagttaactgtgaa

SEQ ID NO: 4438955 - DNA, 15 bp, Homo sapiens
ggattttaatttcag

SEQ ID NO: 4438956 - DNA, 23 bp, Homo sapiens
ggattttggaaactcaaggaaaa

SEQ ID NO: 4438957 - DNA, 16 bp, Homo sapiens
ggatttttgtcttgtg

SEQ ID NO: 4438958 - DNA, 18 bp, Homo sapiens
ggattttttatgtacaac

SEQ ID NO: 4438959 - DNA, 17 bp, Homo sapiens
ggcaaacagggcctctg

SEQ ID NO: 4438960 - DNA, 16 bp, Homo sapiens
ggcaaaccctggtgct

SEQ ID NO: 4438961 - DNA, 23 bp, Homo sapiens
ggcaaagtttaaatgtattttac

SEQ ID NO: 4438962 - DNA, 20 bp, Homo sapiens
ggcaaatagagagtctccaa

SEQ ID NO: 4438963 - DNA, 11 bp, Homo sapiens
ggcaaatagcc

SEQ ID NO: 4438964 - DNA, 15 bp, Homo sapiens
ggcaaatattgaagt

SEQ ID NO: 4438965 - DNA, 14 bp, Homo sapiens
ggcaaattcttttg

SEQ ID NO: 4438966 - DNA, 16 bp, Homo sapiens
ggcaacattggacaga

SEQ ID NO: 4438967 - DNA, 23 bp, Homo sapiens
ggcaacattggacagaaaatgca

SEQ ID NO: 4438968 - DNA, 15 bp, Homo sapiens
ggcaacgtagcctgg

SEQ ID NO: 4438969 - DNA, 16 bp, Homo sapiens
ggcaagagggggtgga

SEQ ID NO: 4438970 - DNA, 20 bp, Homo sapiens
ggcaagccacaggaaggagg

SEQ ID NO: 4438971 - DNA, 13 bp, Homo sapiens
ggcaagcgtgttc

SEQ ID NO: 4438972 - DNA, 14 bp, Homo sapiens
ggcaaggaaaaaga

SEQ ID NO: 4438973 - DNA, 13 bp, Homo sapiens
ggcaatgaaaatt

SEQ ID NO: 4438974 - DNA, 17 bp, Homo sapiens
ggcaatgtgggatctca

SEQ ID NO: 4438975 - DNA, 19 bp, Homo sapiens
ggcaattccaatatttctg

SEQ ID NO: 4438976 - DNA, 13 bp, Homo sapiens
ggcacacactgtg

SEQ ID NO: 4438977 - DNA, 21 bp, Homo sapiens
ggcacacactgtgctttctat

SEQ ID NO: 4438978 - DNA, 13 bp, Homo sapiens
ggcacacagcagc

SEQ ID NO: 4438979 - DNA, 17 bp, Homo sapiens
ggcacacagcagccccc

SEQ ID NO: 4438980 - DNA, 16 bp, Homo sapiens
ggcacagcccctggag

SEQ ID NO: 4438981 - DNA, 16 bp, Homo sapiens
ggcacagctaaccact

SEQ ID NO: 4438982 - DNA, 17 bp, Homo sapiens
ggcacagtccagaccca

SEQ ID NO: 4438983 - DNA, 18 bp, Homo sapiens
ggcacattgcccctctgc

SEQ ID NO: 4438984 - DNA, 20 bp, Homo sapiens
ggcacccaccgtggaggagg

SEQ ID NO: 4438985 - DNA, 15 bp, Homo sapiens
ggcacccccatgctg

SEQ ID NO: 4438986 - DNA, 17 bp, Homo sapiens
ggcacccccatgctgcc

SEQ ID NO: 4438987 - DNA, 16 bp, Homo sapiens
ggcaccctcagggagc

SEQ ID NO: 4438988 - DNA, 21 bp, Homo sapiens
ggcaccctcagggagcctccc

SEQ ID NO: 4438989 - DNA, 22 bp, Homo sapiens
ggcaccctcagggagcctcccc

SEQ ID NO: 4438990 - DNA, 19 bp, Homo sapiens
ggcaccgccacgtcccagc

SEQ ID NO: 4438991 - DNA, 20 bp, Homo sapiens
ggcaccgccacgtcccagca

SEQ ID NO: 4438992 - DNA, 19 bp, Homo sapiens
ggcacctgcagcggctgcc

SEQ ID NO: 4438993 - DNA, 14 bp, Homo sapiens
ggcacgcctgctgg

SEQ ID NO: 4438994 - DNA, 20 bp, Homo sapiens
ggcacggcgggatcctccac

SEQ ID NO: 4438995 - DNA, 19 bp, Homo sapiens
ggcactattataagtgctt

SEQ ID NO: 4438996 - DNA, 18 bp, Homo sapiens
ggcactcagaagttgtgc

SEQ ID NO: 4438997 - DNA, 18 bp, Homo sapiens
ggcactcagtgagcctcc

SEQ ID NO: 4438998 - DNA, 15 bp, Homo sapiens
ggcactctctgccat

SEQ ID NO: 4438999 - DNA, 23 bp, Homo sapiens
ggcactggcaaacagggcctctg

SEQ ID NO: 4439000 - DNA, 19 bp, Homo sapiens
ggcactggccacccctccc

SEQ ID NO: 4439001 - DNA, 22 bp, Homo sapiens
ggcacttagcccaagaggtctg

SEQ ID NO: 4439002 - DNA, 13 bp, Homo sapiens
ggcacttgatatt

SEQ ID NO: 4439003 - DNA, 14 bp, Homo sapiens
ggcagaacactaac

SEQ ID NO: 4439004 - DNA, 15 bp, Homo sapiens
ggcagaacactaacc

SEQ ID NO: 4439005 - DNA, 17 bp, Homo sapiens
ggcagaagaattgaacc

SEQ ID NO: 4439006 - DNA, 11 bp, Homo sapiens
ggcagaagaga

SEQ ID NO: 4439007 - DNA, 12 bp, Homo sapiens
ggcagacacaac

SEQ ID NO: 4439008 - DNA, 17 bp, Homo sapiens
ggcagacgtctgtcagg

SEQ ID NO: 4439009 - DNA, 20 bp, Homo sapiens
ggcagacgtctgtcaggggc

SEQ ID NO: 4439010 - DNA, 18 bp, Homo sapiens
ggcagagacctccaataa

SEQ ID NO: 4439011 - DNA, 12 bp, Homo sapiens
ggcagagcccaa

SEQ ID NO: 4439012 - DNA, 12 bp, Homo sapiens
ggcagaggctgg

SEQ ID NO: 4439013 - DNA, 13 bp, Homo sapiens
ggcagaggctgga

SEQ ID NO: 4439014 - DNA, 20 bp, Homo sapiens
ggcagagggagaatccaagg

SEQ ID NO: 4439015 - DNA, 16 bp, Homo sapiens
ggcagagggcagaggc

SEQ ID NO: 4439016 - DNA, 20 bp, Homo sapiens
ggcagagggctggaggccca

SEQ ID NO: 4439017 - DNA, 21 bp, Homo sapiens
ggcagaggttgcagtgagccg

SEQ ID NO: 4439018 - DNA, 20 bp, Homo sapiens
ggcagatctgtgccccatgc

SEQ ID NO: 4439019 - DNA, 13 bp, Homo sapiens
ggcagatggagcc

SEQ ID NO: 4439020 - DNA, 15 bp, Homo sapiens
ggcagatgtcttccc

SEQ ID NO: 4439021 - DNA, 21 bp, Homo sapiens
ggcagatgtcttccctgggct

SEQ ID NO: 4439022 - DNA, 17 bp, Homo sapiens
ggcagattttcatgcaa

SEQ ID NO: 4439023 - DNA, 17 bp, Homo sapiens
ggcagcaccctataaat

SEQ ID NO: 4439024 - DNA, 19 bp, Homo sapiens
ggcagcaccctcccccgca

SEQ ID NO: 4439025 - DNA, 14 bp, Homo sapiens
ggcagcagaaaact

SEQ ID NO: 4439026 - DNA, 18 bp, Homo sapiens
ggcagcagaagggggtgg

SEQ ID NO: 4439027 - DNA, 13 bp, Homo sapiens
ggcagcagggcta

SEQ ID NO: 4439028 - DNA, 20 bp, Homo sapiens
ggcagcagtgtgaggccagg

SEQ ID NO: 4439029 - DNA, 23 bp, Homo sapiens
ggcagcatcggggtggcccactg

SEQ ID NO: 4439030 - DNA, 12 bp, Homo sapiens
ggcagccacagg

SEQ ID NO: 4439031 - DNA, 14 bp, Homo sapiens
ggcagccacaggga

SEQ ID NO: 4439032 - DNA, 22 bp, Homo sapiens
ggcagccacccaagcctgctgg

SEQ ID NO: 4439033 - DNA, 13 bp, Homo sapiens
ggcagccagacca

SEQ ID NO: 4439034 - DNA, 14 bp, Homo sapiens
ggcagccagaccag

SEQ ID NO: 4439035 - DNA, 13 bp, Homo sapiens
ggcagccaggctg

SEQ ID NO: 4439036 - DNA, 15 bp, Homo sapiens
ggcagccaggctgcc

SEQ ID NO: 4439037 - DNA, 18 bp, Homo sapiens
ggcagcccaacagcactt

SEQ ID NO: 4439038 - DNA, 14 bp, Homo sapiens
ggcagcccagcagt

SEQ ID NO: 4439039 - DNA, 16 bp, Homo sapiens
ggcagctagtgccttt

SEQ ID NO: 4439040 - DNA, 18 bp, Homo sapiens
ggcagctgagagccctgc

SEQ ID NO: 4439041 - DNA, 16 bp, Homo sapiens
ggcagctgatccaggc

SEQ ID NO: 4439042 - DNA, 19 bp, Homo sapiens
ggcagctgatccaggcaat

SEQ ID NO: 4439043 - DNA, 20 bp, Homo sapiens
ggcagctgcctctgctccct

SEQ ID NO: 4439044 - DNA, 11 bp, Homo sapiens
ggcagctgctg

SEQ ID NO: 4439045 - DNA, 12 bp, Homo sapiens
ggcagctgctgt

SEQ ID NO: 4439046 - DNA, 12 bp, Homo sapiens
ggcagctgggcc

SEQ ID NO: 4439047 - DNA, 18 bp, Homo sapiens
ggcagctgggcccaaccc

SEQ ID NO: 4439048 - DNA, 22 bp, Homo sapiens
ggcagctgggcccaaccctgtc

SEQ ID NO: 4439049 - DNA, 23 bp, Homo sapiens
ggcagctgtcctgtgatgtcagc

SEQ ID NO: 4439050 - DNA, 19 bp, Homo sapiens
ggcagcttctactcctgcc

SEQ ID NO: 4439051 - DNA, 15 bp, Homo sapiens
ggcaggagaatttct

SEQ ID NO: 4439052 - DNA, 20 bp, Homo sapiens
ggcaggaggaaaaggcttgg

SEQ ID NO: 4439053 - DNA, 23 bp, Homo sapiens
ggcaggatggcctttccttccct

SEQ ID NO: 4439054 - DNA, 17 bp, Homo sapiens
ggcaggcacacagcagc

SEQ ID NO: 4439055 - DNA, 19 bp, Homo sapiens
ggcaggcacacagcagccc

SEQ ID NO: 4439056 - DNA, 18 bp, Homo sapiens
ggcaggccagatggcccc

SEQ ID NO: 4439057 - DNA, 11 bp, Homo sapiens
ggcaggcccac

SEQ ID NO: 4439058 - DNA, 18 bp, Homo sapiens
ggcaggctagaacctggc

SEQ ID NO: 4439059 - DNA, 12 bp, Homo sapiens
ggcaggctgggc

SEQ ID NO: 4439060 - DNA, 23 bp, Homo sapiens
ggcagggccactcaacagagagg

SEQ ID NO: 4439061 - DNA, 16 bp, Homo sapiens
ggcagggccaggcctc

SEQ ID NO: 4439062 - DNA, 21 bp, Homo sapiens
ggcagggccaggcctctgctg

SEQ ID NO: 4439063 - DNA, 17 bp, Homo sapiens
ggcagggcccccaataa

SEQ ID NO: 4439064 - DNA, 19 bp, Homo sapiens
ggcagggcccccaataaac

SEQ ID NO: 4439065 - DNA, 14 bp, Homo sapiens
ggcagggcctggct

SEQ ID NO: 4439066 - DNA, 18 bp, Homo sapiens
ggcagggccttgcccaga

SEQ ID NO: 4439067 - DNA, 20 bp, Homo sapiens
ggcagggccttgcccagaga

SEQ ID NO: 4439068 - DNA, 14 bp, Homo sapiens
ggcagggcgagctg

SEQ ID NO: 4439069 - DNA, 22 bp, Homo sapiens
ggcagggcgccaagtctggcac

SEQ ID NO: 4439070 - DNA, 22 bp, Homo sapiens
ggcagggcgggcagagggctgg

SEQ ID NO: 4439071 - DNA, 23 bp, Homo sapiens
ggcagggcgggcagagggctgga

SEQ ID NO: 4439072 - DNA, 15 bp, Homo sapiens
ggcagggctctcccg

SEQ ID NO: 4439073 - DNA, 15 bp, Homo sapiens
ggcagggctgaggcc

SEQ ID NO: 4439074 - DNA, 19 bp, Homo sapiens
ggcaggggagacaggagcc

SEQ ID NO: 4439075 - DNA, 22 bp, Homo sapiens
ggcaggggagacaggagcctag

SEQ ID NO: 4439076 - DNA, 23 bp, Homo sapiens
ggcagggggccccgccagggctg

SEQ ID NO: 4439077 - DNA, 19 bp, Homo sapiens
ggcagggggccctgcccca

SEQ ID NO: 4439078 - DNA, 16 bp, Homo sapiens
ggcaggtcctgcccat

SEQ ID NO: 4439079 - DNA, 18 bp, Homo sapiens
ggcaggtgcagggaagtg

SEQ ID NO: 4439080 - DNA, 18 bp, Homo sapiens
ggcaggtggacgctgcag

SEQ ID NO: 4439081 - DNA, 16 bp, Homo sapiens
ggcaggttagaaccta

SEQ ID NO: 4439082 - DNA, 22 bp, Homo sapiens
ggcagtcattcagcaccagagc

SEQ ID NO: 4439083 - DNA, 15 bp, Homo sapiens
ggcagtccaggcctc

SEQ ID NO: 4439084 - DNA, 15 bp, Homo sapiens
ggcagtccgtgggac

SEQ ID NO: 4439085 - DNA, 19 bp, Homo sapiens
ggcagtcgatagagctgta

SEQ ID NO: 4439086 - DNA, 19 bp, Homo sapiens
ggcagtctgaatttttaaa

SEQ ID NO: 4439087 - DNA, 20 bp, Homo sapiens
ggcagtctgagagaggccat

SEQ ID NO: 4439088 - DNA, 13 bp, Homo sapiens
ggcagtctgctct

SEQ ID NO: 4439089 - DNA, 15 bp, Homo sapiens
ggcagtctgctctgc

SEQ ID NO: 4439090 - DNA, 14 bp, Homo sapiens
ggcagtgccagggc

SEQ ID NO: 4439091 - DNA, 17 bp, Homo sapiens
ggcagtgccccagggag

SEQ ID NO: 4439092 - DNA, 21 bp, Homo sapiens
ggcagtgccccagggagtcca

SEQ ID NO: 4439093 - DNA, 19 bp, Homo sapiens
ggcagtgctcacccacacc

SEQ ID NO: 4439094 - DNA, 15 bp, Homo sapiens
ggcataccaaatggc

SEQ ID NO: 4439095 - DNA, 21 bp, Homo sapiens
ggcatagcacccgtggtgcat

SEQ ID NO: 4439096 - DNA, 22 bp, Homo sapiens
ggcatagcacccgtggtgcatg

SEQ ID NO: 4439097 - DNA, 13 bp, Homo sapiens
ggcatagctctgg

SEQ ID NO: 4439098 - DNA, 15 bp, Homo sapiens
ggcatagctctgggg

SEQ ID NO: 4439099 - DNA, 15 bp, Homo sapiens
ggcatagtccccaga

SEQ ID NO: 4439100 - DNA, 15 bp, Homo sapiens
ggcatataataaaga

SEQ ID NO: 4439101 - DNA, 21 bp, Homo sapiens
ggcatatggtcctagacaaac

SEQ ID NO: 4439102 - DNA, 19 bp, Homo sapiens
ggcatattccctgcacaca

SEQ ID NO: 4439103 - DNA, 21 bp, Homo sapiens
ggcatcaagaggtgggagggc

SEQ ID NO: 4439104 - DNA, 21 bp, Homo sapiens
ggcatcacacttatattttat

SEQ ID NO: 4439105 - DNA, 20 bp, Homo sapiens
ggcatcacagaccccagctg

SEQ ID NO: 4439106 - DNA, 23 bp, Homo sapiens
ggcatcggggagccgggagcctg

SEQ ID NO: 4439107 - DNA, 19 bp, Homo sapiens
ggcatctcttccccagaga

SEQ ID NO: 4439108 - DNA, 16 bp, Homo sapiens
ggcatctttgccttgg

SEQ ID NO: 4439109 - DNA, 19 bp, Homo sapiens
ggcatctttgccttgggct

SEQ ID NO: 4439110 - DNA, 23 bp, Homo sapiens
ggcatctttgccttgggctgctc

SEQ ID NO: 4439111 - DNA, 21 bp, Homo sapiens
ggcatcttttctagagacaca

SEQ ID NO: 4439112 - DNA, 22 bp, Homo sapiens
ggcatcttttctagagacacat

SEQ ID NO: 4439113 - DNA, 15 bp, Homo sapiens
ggagccagtcctcca

SEQ ID NO: 4439114 - DNA, 21 bp, Homo sapiens
ggagcccactgaggggccagg

SEQ ID NO: 4439115 - DNA, 12 bp, Homo sapiens
ggagcccagcct

SEQ ID NO: 4439116 - DNA, 16 bp, Homo sapiens
ggagcccagctctgaa

SEQ ID NO: 4439117 - DNA, 22 bp, Homo sapiens
ggagcccagtccactgagcaag

SEQ ID NO: 4439118 - DNA, 12 bp, Homo sapiens
ggagcccagtga

SEQ ID NO: 4439119 - DNA, 20 bp, Homo sapiens
ggagcccagtgaagcctctg

SEQ ID NO: 4439120 - DNA, 13 bp, Homo sapiens
ggagccccagccc

SEQ ID NO: 4439121 - DNA, 16 bp, Homo sapiens
ggagccccagccccct

SEQ ID NO: 4439122 - DNA, 20 bp, Homo sapiens
ggagccccagccccctttgg

SEQ ID NO: 4439123 - DNA, 20 bp, Homo sapiens
ggagccccagggtcttccct

SEQ ID NO: 4439124 - DNA, 14 bp, Homo sapiens
ggagccctgggttc

SEQ ID NO: 4439125 - DNA, 15 bp, Homo sapiens
ggagccgcagagcct

SEQ ID NO: 4439126 - DNA, 22 bp, Homo sapiens
ggagcctagcggagcccagcct

SEQ ID NO: 4439127 - DNA, 15 bp, Homo sapiens
ggagcctagctcctg

SEQ ID NO: 4439128 - DNA, 12 bp, Homo sapiens
ggagcctcccca

SEQ ID NO: 4439129 - DNA, 14 bp, Homo sapiens
ggagcctccccctc

SEQ ID NO: 4439130 - DNA, 16 bp, Homo sapiens
ggagcctccccctcag

SEQ ID NO: 4439131 - DNA, 18 bp, Homo sapiens
ggagcctggtccttccct

SEQ ID NO: 4439132 - DNA, 17 bp, Homo sapiens
ggagctcatctgcaaaa

SEQ ID NO: 4439133 - DNA, 20 bp, Homo sapiens
ggagctcctccctccagctg

SEQ ID NO: 4439134 - DNA, 13 bp, Homo sapiens
ggagctcctctcc

SEQ ID NO: 4439135 - DNA, 17 bp, Homo sapiens
ggagctcctctcctgga

SEQ ID NO: 4439136 - DNA, 20 bp, Homo sapiens
ggagctcctctcctggagga

SEQ ID NO: 4439137 - DNA, 21 bp, Homo sapiens
ggagctcctctcctggaggat

SEQ ID NO: 4439138 - DNA, 17 bp, Homo sapiens
ggagctgagcagcctct

SEQ ID NO: 4439139 - DNA, 15 bp, Homo sapiens
ggagctgctgagtga

SEQ ID NO: 4439140 - DNA, 12 bp, Homo sapiens
ggagctggaacc

SEQ ID NO: 4439141 - DNA, 12 bp, Homo sapiens
ggagctgggccc

SEQ ID NO: 4439142 - DNA, 16 bp, Homo sapiens
ggagctgggcccctgc

SEQ ID NO: 4439143 - DNA, 14 bp, Homo sapiens
ggagctgtcacctc

SEQ ID NO: 4439144 - DNA, 22 bp, Homo sapiens
ggagctgtcacctctcagctgc

SEQ ID NO: 4439145 - DNA, 12 bp, Homo sapiens
ggagctgtcatc

SEQ ID NO: 4439146 - DNA, 22 bp, Homo sapiens
ggagcttgggcagtgccccagg

SEQ ID NO: 4439147 - DNA, 24 bp, Homo sapiens
ggagcttgggtctctctcggcccc

SEQ ID NO: 4439148 - DNA, 14 bp, Homo sapiens
ggagctttgtaatg

SEQ ID NO: 4439149 - DNA, 16 bp, Homo sapiens
ggaggaaaaggcttgg

SEQ ID NO: 4439150 - DNA, 15 bp, Homo sapiens
ggaggaagagccacc

SEQ ID NO: 4439151 - DNA, 16 bp, Homo sapiens
ggaggaagagccacct

SEQ ID NO: 4439152 - DNA, 14 bp, Homo sapiens
ggaggaaggaggcc

SEQ ID NO: 4439153 - DNA, 14 bp, Homo sapiens
ggaggaagggctgg

SEQ ID NO: 4439154 - DNA, 18 bp, Homo sapiens
ggaggaagggctgggcca

SEQ ID NO: 4439155 - DNA, 12 bp, Homo sapiens
ggaggaatgaca

SEQ ID NO: 4439156 - DNA, 16 bp, Homo sapiens
ggaggacaaaaggaat

SEQ ID NO: 4439157 - DNA, 14 bp, Homo sapiens
ggaggacaggcagg

SEQ ID NO: 4439158 - DNA, 14 bp, Homo sapiens
ggaggaccgaggct

SEQ ID NO: 4439159 - DNA, 19 bp, Homo sapiens
ggaggaccgaggctacagc

SEQ ID NO: 4439160 - DNA, 22 bp, Homo sapiens
ggaggaccgaggctacagctcc

SEQ ID NO: 4439161 - DNA, 21 bp, Homo sapiens
ggaggacctggcgtgctcaga

SEQ ID NO: 4439162 - DNA, 16 bp, Homo sapiens
ggaggactagaacctg

SEQ ID NO: 4439163 - DNA, 22 bp, Homo sapiens
ggaggactagaacctggagggc

SEQ ID NO: 4439164 - DNA, 14 bp, Homo sapiens
ggaggactgagccc

SEQ ID NO: 4439165 - DNA, 12 bp, Homo sapiens
ggaggaggcctg

SEQ ID NO: 4439166 - DNA, 19 bp, Homo sapiens
ggaggaggcctgtcccaat

SEQ ID NO: 4439167 - DNA, 14 bp, Homo sapiens
ggaggaggggtgag

SEQ ID NO: 4439168 - DNA, 14 bp, Homo sapiens
ggaggatacagagg

SEQ ID NO: 4439169 - DNA, 23 bp, Homo sapiens
ggaggatggtgtcctgaggcctc

SEQ ID NO: 4439170 - DNA, 23 bp, Homo sapiens
ggaggatgttagacttgctccct

SEQ ID NO: 4439171 - DNA, 20 bp, Homo sapiens
ggaggattgcctttaatatt

SEQ ID NO: 4439172 - DNA, 23 bp, Homo sapiens
ggaggcaagagactgggagccac

SEQ ID NO: 4439173 - DNA, 22 bp, Homo sapiens
ggaggcaagcgtgttctcagca

SEQ ID NO: 4439174 - DNA, 22 bp, Homo sapiens
ggaggccaccaagctgctctcc

SEQ ID NO: 4439175 - DNA, 22 bp, Homo sapiens
ggaggccaccccaaaccccagc

SEQ ID NO: 4439176 - DNA, 13 bp, Homo sapiens
ggaggcctgggga

SEQ ID NO: 4439177 - DNA, 22 bp, Homo sapiens
ggaggcggacgttccagccggc

SEQ ID NO: 4439178 - DNA, 18 bp, Homo sapiens
ggaggctacccgctgtgg

SEQ ID NO: 4439179 - DNA, 19 bp, Homo sapiens
ggaggctacccgctgtggc

SEQ ID NO: 4439180 - DNA, 21 bp, Homo sapiens
ggaggctacccgctgtggccg

SEQ ID NO: 4439181 - DNA, 15 bp, Homo sapiens
ggaggctccagaggg

SEQ ID NO: 4439182 - DNA, 19 bp, Homo sapiens
ggaggctcccggggcctgg

SEQ ID NO: 4439183 - DNA, 20 bp, Homo sapiens
ggaggctcccggggcctgga

SEQ ID NO: 4439184 - DNA, 15 bp, Homo sapiens
ggaggctgaggcagg

SEQ ID NO: 4439185 - DNA, 13 bp, Homo sapiens
ggaggctgcagag

SEQ ID NO: 4439186 - DNA, 21 bp, Homo sapiens
ggaggctgcagagctgaccca

SEQ ID NO: 4439187 - DNA, 21 bp, Homo sapiens
ggaggctgcccccggccccct

SEQ ID NO: 4439188 - DNA, 13 bp, Homo sapiens
ggaggctgggccc

SEQ ID NO: 4439189 - DNA, 14 bp, Homo sapiens
ggaggctgggcccc

SEQ ID NO: 4439190 - DNA, 16 bp, Homo sapiens
ggaggctgggcccctg

SEQ ID NO: 4439191 - DNA, 15 bp, Homo sapiens
ggagggagggtggct

SEQ ID NO: 4439192 - DNA, 12 bp, Homo sapiens
ggagggatttgg

SEQ ID NO: 4439193 - DNA, 16 bp, Homo sapiens
ggagggcagcagaagg

SEQ ID NO: 4439194 - DNA, 13 bp, Homo sapiens
ggagggcagcccg

SEQ ID NO: 4439195 - DNA, 16 bp, Homo sapiens
ggagggctagaacctg

SEQ ID NO: 4439196 - DNA, 20 bp, Homo sapiens
ggagggctagaacctggcag

SEQ ID NO: 4439197 - DNA, 19 bp, Homo sapiens
ggagggctagaactggaga

SEQ ID NO: 4439198 - DNA, 20 bp, Homo sapiens
ggagggctagaatctggaga

SEQ ID NO: 4439199 - DNA, 14 bp, Homo sapiens
ggagggctggaatc

SEQ ID NO: 4439200 - DNA, 16 bp, Homo sapiens
ggagggctggaatctg

SEQ ID NO: 4439201 - DNA, 17 bp, Homo sapiens
ggagggcttggcccagc

SEQ ID NO: 4439202 - DNA, 13 bp, Homo sapiens
ggaggggaggcag

SEQ ID NO: 4439203 - DNA, 19 bp, Homo sapiens
ggaggggcgcaccccacag

SEQ ID NO: 4439204 - DNA, 18 bp, Homo sapiens
ggaggggtggcccagagc

SEQ ID NO: 4439205 - DNA, 20 bp, Homo sapiens
ggagggtaaataaaccactg

SEQ ID NO: 4439206 - DNA, 20 bp, Homo sapiens
ggaggtcacctgccgccctg

SEQ ID NO: 4439207 - DNA, 13 bp, Homo sapiens
ggaggtcactgga

SEQ ID NO: 4439208 - DNA, 17 bp, Homo sapiens
ggaggtcactggaaagg

SEQ ID NO: 4439209 - DNA, 21 bp, Homo sapiens
ggaggtcactggaaaggggag

SEQ ID NO: 4439210 - DNA, 15 bp, Homo sapiens
ggaggtgctggggga

SEQ ID NO: 4439211 - DNA, 17 bp, Homo sapiens
ggaggtggaagaaggga

SEQ ID NO: 4439212 - DNA, 20 bp, Homo sapiens
ggaggtggaagaagggagaa

SEQ ID NO: 4439213 - DNA, 15 bp, Homo sapiens
ggaggtggaagcaga

SEQ ID NO: 4439214 - DNA, 16 bp, Homo sapiens
ggaggtggaagcagag

SEQ ID NO: 4439215 - DNA, 19 bp, Homo sapiens
ggaggtggaagcagaggcc

SEQ ID NO: 4439216 - DNA, 20 bp, Homo sapiens
ggaggtggaagcagaggccc

SEQ ID NO: 4439217 - DNA, 21 bp, Homo sapiens
ggaggtggaagcagaggccct

SEQ ID NO: 4439218 - DNA, 21 bp, Homo sapiens
ggaggtgggcaaagggaagta

SEQ ID NO: 4439219 - DNA, 14 bp, Homo sapiens
ggaggtgtcaggct

SEQ ID NO: 4439220 - DNA, 16 bp, Homo sapiens
ggaggtgtcaggctgc

SEQ ID NO: 4439221 - DNA, 14 bp, Homo sapiens
ggaggttgcagtga

SEQ ID NO: 4439222 - DNA, 16 bp, Homo sapiens
ggaggttgttgcagtg

SEQ ID NO: 4439223 - DNA, 20 bp, Homo sapiens
ggagtaataggaccagagcg

SEQ ID NO: 4439224 - DNA, 16 bp, Homo sapiens
ggagtacggctggtgt

SEQ ID NO: 4439225 - DNA, 13 bp, Homo sapiens
ggagtagccaagc

SEQ ID NO: 4439226 - DNA, 11 bp, Homo sapiens
ggagtccagac

SEQ ID NO: 4439227 - DNA, 19 bp, Homo sapiens
ggagtccaggcccccagcc

SEQ ID NO: 4439228 - DNA, 22 bp, Homo sapiens
ggagtccaggcccccagcccct

SEQ ID NO: 4439229 - DNA, 21 bp, Homo sapiens
ggagtcccaggggcagccaca

SEQ ID NO: 4439230 - DNA, 12 bp, Homo sapiens
ggagtctgagtc

SEQ ID NO: 4439231 - DNA, 14 bp, Homo sapiens
ggagtctgagtctg

SEQ ID NO: 4439232 - DNA, 22 bp, Homo sapiens
ggagtctgagtctgagtcctgt

SEQ ID NO: 4439233 - DNA, 18 bp, Homo sapiens
ggagtgagctggggagct

SEQ ID NO: 4439234 - DNA, 18 bp, Homo sapiens
gctgccacacggaagcaa

SEQ ID NO: 4439235 - DNA, 19 bp, Homo sapiens
gctgccacccgcccacccg

SEQ ID NO: 4439236 - DNA, 16 bp, Homo sapiens
gctgccagccttgagc

SEQ ID NO: 4439237 - DNA, 20 bp, Homo sapiens
gctgccagccttgagccctg

SEQ ID NO: 4439238 - DNA, 22 bp, Homo sapiens
gctgccagccttgagccctggc

SEQ ID NO: 4439239 - DNA, 19 bp, Homo sapiens
gctgccagctctcaggacc

SEQ ID NO: 4439240 - DNA, 19 bp, Homo sapiens
gctgccatgacagaggctg

SEQ ID NO: 4439241 - DNA, 13 bp, Homo sapiens
gctgcccagccct

SEQ ID NO: 4439242 - DNA, 17 bp, Homo sapiens
gctgcccagccctggcc

SEQ ID NO: 4439243 - DNA, 21 bp, Homo sapiens
gctgcccagccctggcccagg

SEQ ID NO: 4439244 - DNA, 14 bp, Homo sapiens
gctgcccatgagca

SEQ ID NO: 4439245 - DNA, 16 bp, Homo sapiens
gctgccccagccagat

SEQ ID NO: 4439246 - DNA, 14 bp, Homo sapiens
gctgcccccggccc

SEQ ID NO: 4439247 - DNA, 16 bp, Homo sapiens
gctgccccggcccctc

SEQ ID NO: 4439248 - DNA, 23 bp, Homo sapiens
gctgccccggcccctccccctga

SEQ ID NO: 4439249 - DNA, 14 bp, Homo sapiens
gctgcccctctcac

SEQ ID NO: 4439250 - DNA, 19 bp, Homo sapiens
gctgcccctgtctggaaga

SEQ ID NO: 4439251 - DNA, 23 bp, Homo sapiens
gctgccccttaaacacaggctgt

SEQ ID NO: 4439252 - DNA, 20 bp, Homo sapiens
gctgccctagttttctttcc

SEQ ID NO: 4439253 - DNA, 16 bp, Homo sapiens
gctgccctccttgtcc

SEQ ID NO: 4439254 - DNA, 22 bp, Homo sapiens
gctgccctccttgtccacccac

SEQ ID NO: 4439255 - DNA, 13 bp, Homo sapiens
gctgcccttgcag

SEQ ID NO: 4439256 - DNA, 17 bp, Homo sapiens
gctgcccttgcagggtg

SEQ ID NO: 4439257 - DNA, 14 bp, Homo sapiens
gctgccctttctca

SEQ ID NO: 4439258 - DNA, 15 bp, Homo sapiens
gctgccgagccacca

SEQ ID NO: 4439259 - DNA, 18 bp, Homo sapiens
gctgccgcaccccagagt

SEQ ID NO: 4439260 - DNA, 17 bp, Homo sapiens
gctgccgctgcaccacg

SEQ ID NO: 4439261 - DNA, 14 bp, Homo sapiens
gctgcctaaatcca

SEQ ID NO: 4439262 - DNA, 19 bp, Homo sapiens
gctgcctaataaagagact

SEQ ID NO: 4439263 - DNA, 12 bp, Homo sapiens
gctgcctcccaa

SEQ ID NO: 4439264 - DNA, 21 bp, Homo sapiens
gctgcctcccttgtggcagca

SEQ ID NO: 4439265 - DNA, 20 bp, Homo sapiens
gctgcctctctttcacacaa

SEQ ID NO: 4439266 - DNA, 11 bp, Homo sapiens
gctgcctctgc

SEQ ID NO: 4439267 - DNA, 17 bp, Homo sapiens
gctgcctctgctccctc

SEQ ID NO: 4439268 - DNA, 21 bp, Homo sapiens
gctgcctgcgcccaccccgct

SEQ ID NO: 4439269 - DNA, 13 bp, Homo sapiens
gctgcctgctgag

SEQ ID NO: 4439270 - DNA, 16 bp, Homo sapiens
gctgcctgctgagatg

SEQ ID NO: 4439271 - DNA, 20 bp, Homo sapiens
gctgcctggccctccccaca

SEQ ID NO: 4439272 - DNA, 12 bp, Homo sapiens
gctgccttagct

SEQ ID NO: 4439273 - DNA, 15 bp, Homo sapiens
gctgcctttggactt

SEQ ID NO: 4439274 - DNA, 19 bp, Homo sapiens
gctgcgcctgcaggcagag

SEQ ID NO: 4439275 - DNA, 16 bp, Homo sapiens
gctgcgctaaccccca

SEQ ID NO: 4439276 - DNA, 17 bp, Homo sapiens
gctgcgcttgcttttct

SEQ ID NO: 4439277 - DNA, 15 bp, Homo sapiens
gctgcggccaggcct

SEQ ID NO: 4439278 - DNA, 21 bp, Homo sapiens
gctgctaaatctcctattttt

SEQ ID NO: 4439279 - DNA, 18 bp, Homo sapiens
gctgctacatcagactct

SEQ ID NO: 4439280 - DNA, 14 bp, Homo sapiens
gctgctactgctgc

SEQ ID NO: 4439281 - DNA, 17 bp, Homo sapiens
gctgctcatgggaagaa

SEQ ID NO: 4439282 - DNA, 10 bp, Homo sapiens
gctgctccca

SEQ ID NO: 4439283 - DNA, 15 bp, Homo sapiens
gctgctcccacctgg

SEQ ID NO: 4439284 - DNA, 24 bp, Homo sapiens
gctgctcccacctggctctgtggc

SEQ ID NO: 4439285 - DNA, 13 bp, Homo sapiens
gctgctccccacg

SEQ ID NO: 4439286 - DNA, 13 bp, Homo sapiens
gctgctcccctgg

SEQ ID NO: 4439287 - DNA, 14 bp, Homo sapiens
gctgctcctccagg

SEQ ID NO: 4439288 - DNA, 15 bp, Homo sapiens
gctgctcctccaggg

SEQ ID NO: 4439289 - DNA, 23 bp, Homo sapiens
gctgctcctccagggccacgtgc

SEQ ID NO: 4439290 - DNA, 13 bp, Homo sapiens
gctgctccttcag

SEQ ID NO: 4439291 - DNA, 14 bp, Homo sapiens
gctgctccttcagg

SEQ ID NO: 4439292 - DNA, 16 bp, Homo sapiens
gctgctctcccaaggg

SEQ ID NO: 4439293 - DNA, 19 bp, Homo sapiens
gctgctctgcaggctgggg

SEQ ID NO: 4439294 - DNA, 20 bp, Homo sapiens
gctgctctgcaggctgggga

SEQ ID NO: 4439295 - DNA, 12 bp, Homo sapiens
gctgctctggga

SEQ ID NO: 4439296 - DNA, 13 bp, Homo sapiens
gctgctgaaacaa

SEQ ID NO: 4439297 - DNA, 16 bp, Homo sapiens
gctgctgactgatgtt

SEQ ID NO: 4439298 - DNA, 17 bp, Homo sapiens
gctgctgcccccacccc

SEQ ID NO: 4439299 - DNA, 15 bp, Homo sapiens
gctgctgctactgct

SEQ ID NO: 4439300 - DNA, 12 bp, Homo sapiens
gctgctggagaa

SEQ ID NO: 4439301 - DNA, 12 bp, Homo sapiens
gctgctggcccc

SEQ ID NO: 4439302 - DNA, 17 bp, Homo sapiens
gctgctggcgcctctgc

SEQ ID NO: 4439303 - DNA, 15 bp, Homo sapiens
gctgctggcttgcag

SEQ ID NO: 4439304 - DNA, 18 bp, Homo sapiens
gctgctgtgctctgggga

SEQ ID NO: 4439305 - DNA, 13 bp, Homo sapiens
gctgctttcttct

SEQ ID NO: 4439306 - DNA, 22 bp, Homo sapiens
gctgctttgacaaaatgactgg

SEQ ID NO: 4439307 - DNA, 15 bp, Homo sapiens
gctgctttgggctgg

SEQ ID NO: 4439308 - DNA, 23 bp, Homo sapiens
gctggaacacaggggccttttaa

SEQ ID NO: 4439309 - DNA, 17 bp, Homo sapiens
gctggaagatagctgtg

SEQ ID NO: 4439310 - DNA, 18 bp, Homo sapiens
gctggaatgtgccacaga

SEQ ID NO: 4439311 - DNA, 19 bp, Homo sapiens
gctggaatgtgccacagag

SEQ ID NO: 4439312 - DNA, 22 bp, Homo sapiens
gctggaatgtgccacagaggcc

SEQ ID NO: 4439313 - DNA, 15 bp, Homo sapiens
gctggactattgtgc

SEQ ID NO: 4439314 - DNA, 16 bp, Homo sapiens
gctggactattgtgcc

SEQ ID NO: 4439315 - DNA, 16 bp, Homo sapiens
gctggactgaggcctg

SEQ ID NO: 4439316 - DNA, 18 bp, Homo sapiens
gctggactgaggcctgag

SEQ ID NO: 4439317 - DNA, 23 bp, Homo sapiens
gctggactgttccaggccctcca

SEQ ID NO: 4439318 - DNA, 13 bp, Homo sapiens
gctggagaaagcc

SEQ ID NO: 4439319 - DNA, 20 bp, Homo sapiens
gctggagaaagccacgccct

SEQ ID NO: 4439320 - DNA, 19 bp, Homo sapiens
gctggagacttcctctggt

SEQ ID NO: 4439321 - DNA, 16 bp, Homo sapiens
gctggagctcctccct

SEQ ID NO: 4439322 - DNA, 22 bp, Homo sapiens
gctggagctcctccctccagct

SEQ ID NO: 4439323 - DNA, 17 bp, Homo sapiens
gctggagctctgcccat

SEQ ID NO: 4439324 - DNA, 23 bp, Homo sapiens
gctggaggactagaacctggagg

SEQ ID NO: 4439325 - DNA, 12 bp, Homo sapiens
gctggaggcagg

SEQ ID NO: 4439326 - DNA, 15 bp, Homo sapiens
gctggaggcccaggc

SEQ ID NO: 4439327 - DNA, 19 bp, Homo sapiens
gctggaggggtggcccaga

SEQ ID NO: 4439328 - DNA, 23 bp, Homo sapiens
gctggaggggtggcccagagcca

SEQ ID NO: 4439329 - DNA, 21 bp, Homo sapiens
gctggagttttgttggtgtga

SEQ ID NO: 4439330 - DNA, 20 bp, Homo sapiens
gctggatgagaatttgagtg

SEQ ID NO: 4439331 - DNA, 17 bp, Homo sapiens
gctggatttgatgagtt

SEQ ID NO: 4439332 - DNA, 21 bp, Homo sapiens
gctggcaacacagaggcagcc

SEQ ID NO: 4439333 - DNA, 15 bp, Homo sapiens
gctggcacagcccct

SEQ ID NO: 4439334 - DNA, 21 bp, Homo sapiens
gctggcacccaccgtggagga

SEQ ID NO: 4439335 - DNA, 19 bp, Homo sapiens
gctggcagctgagagccct

SEQ ID NO: 4439336 - DNA, 20 bp, Homo sapiens
gctggcagctgagagccctg

SEQ ID NO: 4439337 - DNA, 14 bp, Homo sapiens
gctggccagcaccc

SEQ ID NO: 4439338 - DNA, 15 bp, Homo sapiens
gctggccagcaccct

SEQ ID NO: 4439339 - DNA, 16 bp, Homo sapiens
gctggccagcaccctc

SEQ ID NO: 4439340 - DNA, 18 bp, Homo sapiens
gctggccagcaccctctc

SEQ ID NO: 4439341 - DNA, 19 bp, Homo sapiens
gctggccagcaccctctcc

SEQ ID NO: 4439342 - DNA, 12 bp, Homo sapiens
gctggccagtct

SEQ ID NO: 4439343 - DNA, 18 bp, Homo sapiens
gctggccagtgctgccca

SEQ ID NO: 4439344 - DNA, 23 bp, Homo sapiens
gctggcccacccagtccatgctc

SEQ ID NO: 4439345 - DNA, 15 bp, Homo sapiens
gctggcccagccctg

SEQ ID NO: 4439346 - DNA, 17 bp, Homo sapiens
gctggcccagccctgct

SEQ ID NO: 4439347 - DNA, 19 bp, Homo sapiens
gctggcccagccctgctgg

SEQ ID NO: 4439348 - DNA, 22 bp, Homo sapiens
gctggccctacttccaggatgg

SEQ ID NO: 4439349 - DNA, 15 bp, Homo sapiens
gctggccgagggtcc

SEQ ID NO: 4439350 - DNA, 20 bp, Homo sapiens
gctggccgagggtcctggct

SEQ ID NO: 4439351 - DNA, 19 bp, Homo sapiens
gctggccgggactgctgct

SEQ ID NO: 4439352 - DNA, 13 bp, Homo sapiens
gctggcgcctctg

SEQ ID NO: 4439353 - DNA, 14 bp, Homo sapiens
gctggcgcctctgc

SEQ ID NO: 4439354 - DNA, 20 bp, Homo sapiens
gctggcgctcagcagcccta

SEQ ID NO: 4439355 - DNA, 18 bp, Homo sapiens
ggaacatggagctgtcat

SEQ ID NO: 4439356 - DNA, 20 bp, Homo sapiens
ggaaccgaggcagggaagga

SEQ ID NO: 4439357 - DNA, 23 bp, Homo sapiens
ggaaccgagggggctgctcccac

SEQ ID NO: 4439358 - DNA, 19 bp, Homo sapiens
ggaacctagctacactgag

SEQ ID NO: 4439359 - DNA, 19 bp, Homo sapiens
ggaacctcgagtactgtgg

SEQ ID NO: 4439360 - DNA, 16 bp, Homo sapiens
ggaacctgcaaaaaat

SEQ ID NO: 4439361 - DNA, 16 bp, Homo sapiens
ggaaccttccctccaa

SEQ ID NO: 4439362 - DNA, 14 bp, Homo sapiens
ggaacgactggact

SEQ ID NO: 4439363 - DNA, 15 bp, Homo sapiens
ggaacggaggaggac

SEQ ID NO: 4439364 - DNA, 17 bp, Homo sapiens
ggaacgtgactgcccca

SEQ ID NO: 4439365 - DNA, 23 bp, Homo sapiens
ggaactaggctcttatgtgtgcc

SEQ ID NO: 4439366 - DNA, 19 bp, Homo sapiens
ggaactagtcattaaccca

SEQ ID NO: 4439367 - DNA, 15 bp, Homo sapiens
ggaactatgaggagc

SEQ ID NO: 4439368 - DNA, 17 bp, Homo sapiens
ggaactgaacattccag

SEQ ID NO: 4439369 - DNA, 14 bp, Homo sapiens
ggaactgcagacct

SEQ ID NO: 4439370 - DNA, 15 bp, Homo sapiens
ggaactgcagacctg

SEQ ID NO: 4439371 - DNA, 15 bp, Homo sapiens
ggaactgctgggctt

SEQ ID NO: 4439372 - DNA, 18 bp, Homo sapiens
ggaactggagtctgtctc

SEQ ID NO: 4439373 - DNA, 12 bp, Homo sapiens
ggaactgggctg

SEQ ID NO: 4439374 - DNA, 13 bp, Homo sapiens
ggaactgggctgg

SEQ ID NO: 4439375 - DNA, 15 bp, Homo sapiens
ggaactgtttccttc

SEQ ID NO: 4439376 - DNA, 15 bp, Homo sapiens
ggaagaaagaatgtt

SEQ ID NO: 4439377 - DNA, 16 bp, Homo sapiens
ggaagaaagagaagga

SEQ ID NO: 4439378 - DNA, 16 bp, Homo sapiens
ggaagaacaacaaaga

SEQ ID NO: 4439379 - DNA, 19 bp, Homo sapiens
ggaagaacaacaaagacat

SEQ ID NO: 4439380 - DNA, 14 bp, Homo sapiens
ggaagaaccactgt

SEQ ID NO: 4439381 - DNA, 19 bp, Homo sapiens
ggaagaagttttttacttt

SEQ ID NO: 4439382 - DNA, 20 bp, Homo sapiens
ggaagaataaaattgcctct

SEQ ID NO: 4439383 - DNA, 17 bp, Homo sapiens
ggaagaatccagtatta

SEQ ID NO: 4439384 - DNA, 23 bp, Homo sapiens
ggaagacagttctacagaaaaac

SEQ ID NO: 4439385 - DNA, 15 bp, Homo sapiens
ggaagacgaggccct

SEQ ID NO: 4439386 - DNA, 16 bp, Homo sapiens
ggaagacgaggccctc

SEQ ID NO: 4439387 - DNA, 22 bp, Homo sapiens
ggaagactcaggagtctgccac

SEQ ID NO: 4439388 - DNA, 19 bp, Homo sapiens
ggaagacttgaagcacaga

SEQ ID NO: 4439389 - DNA, 17 bp, Homo sapiens
ggaagagaagacaaaac

SEQ ID NO: 4439390 - DNA, 21 bp, Homo sapiens
ggaagagaagagggcccagcc

SEQ ID NO: 4439391 - DNA, 22 bp, Homo sapiens
ggaagagaagagggcccagccc

SEQ ID NO: 4439392 - DNA, 13 bp, Homo sapiens
ggaagagcaggac

SEQ ID NO: 4439393 - DNA, 13 bp, Homo sapiens
ggaagagccacct

SEQ ID NO: 4439394 - DNA, 14 bp, Homo sapiens
ggaagagccacctg

SEQ ID NO: 4439395 - DNA, 21 bp, Homo sapiens
ggaagagggaaatgtacactt

SEQ ID NO: 4439396 - DNA, 20 bp, Homo sapiens
ggaagagtgactctccaggg

SEQ ID NO: 4439397 - DNA, 16 bp, Homo sapiens
ggaagatcatggacct

SEQ ID NO: 4439398 - DNA, 23 bp, Homo sapiens
ggaagatcatggacctggtgccc

SEQ ID NO: 4439399 - DNA, 17 bp, Homo sapiens
ggaagatgggaggtgga

SEQ ID NO: 4439400 - DNA, 20 bp, Homo sapiens
ggaagatttgcccatttaca

SEQ ID NO: 4439401 - DNA, 18 bp, Homo sapiens
ggaagcagaggccctgcc

SEQ ID NO: 4439402 - DNA, 13 bp, Homo sapiens
ggaagcaggacag

SEQ ID NO: 4439403 - DNA, 17 bp, Homo sapiens
ggaagcatgtaggagaa

SEQ ID NO: 4439404 - DNA, 11 bp, Homo sapiens
ggaagccagag

SEQ ID NO: 4439405 - DNA, 12 bp, Homo sapiens
ggaagccagagc

SEQ ID NO: 4439406 - DNA, 17 bp, Homo sapiens
ggaagccagtcagggcc

SEQ ID NO: 4439407 - DNA, 17 bp, Homo sapiens
ggaagcccatcctgacc

SEQ ID NO: 4439408 - DNA, 20 bp, Homo sapiens
ggaagcccatcctgaccagc

SEQ ID NO: 4439409 - DNA, 15 bp, Homo sapiens
ggaagccctccttcc

SEQ ID NO: 4439410 - DNA, 15 bp, Homo sapiens
ggaagccgtcctggc

SEQ ID NO: 4439411 - DNA, 16 bp, Homo sapiens
ggaagctaatttgcat

SEQ ID NO: 4439412 - DNA, 18 bp, Homo sapiens
ggaagctagacacatgaa

SEQ ID NO: 4439413 - DNA, 20 bp, Homo sapiens
ggaaggaacaaagacaggca

SEQ ID NO: 4439414 - DNA, 22 bp, Homo sapiens
ggaaggaacatggagctgtcat

SEQ ID NO: 4439415 - DNA, 17 bp, Homo sapiens
ggaaggatcccatgagc

SEQ ID NO: 4439416 - DNA, 20 bp, Homo sapiens
ggaaggcccaactggttcag

SEQ ID NO: 4439417 - DNA, 22 bp, Homo sapiens
ggaaggcctcttggagacctta

SEQ ID NO: 4439418 - DNA, 14 bp, Homo sapiens
ggaaggcctgagcc

SEQ ID NO: 4439419 - DNA, 15 bp, Homo sapiens
ggaaggcctgagccc

SEQ ID NO: 4439420 - DNA, 19 bp, Homo sapiens
ggaaggcgagtctggggac

SEQ ID NO: 4439421 - DNA, 18 bp, Homo sapiens
ggaaggctgaggcaggag

SEQ ID NO: 4439422 - DNA, 23 bp, Homo sapiens
ggaagggacaccaagccttggct

SEQ ID NO: 4439423 - DNA, 15 bp, Homo sapiens
ggaagggcaggaagg

SEQ ID NO: 4439424 - DNA, 21 bp, Homo sapiens
ggaagggcaggaaggagagcc

SEQ ID NO: 4439425 - DNA, 15 bp, Homo sapiens
ggaaggggccagagg

SEQ ID NO: 4439426 - DNA, 14 bp, Homo sapiens
ggaagggtcccttt

SEQ ID NO: 4439427 - DNA, 20 bp, Homo sapiens
ggaaggtcttttgagggcta

SEQ ID NO: 4439428 - DNA, 16 bp, Homo sapiens
ggaaggtggccacagc

SEQ ID NO: 4439429 - DNA, 21 bp, Homo sapiens
ggaagtataggccaggcacag

SEQ ID NO: 4439430 - DNA, 19 bp, Homo sapiens
ggaagtcagtacgatcaag

SEQ ID NO: 4439431 - DNA, 17 bp, Homo sapiens
ggaagtcgaggctgcag

SEQ ID NO: 4439432 - DNA, 21 bp, Homo sapiens
ggaagtgaacccatattttaa

SEQ ID NO: 4439433 - DNA, 20 bp, Homo sapiens
ggaagtgacggtttaatggg

SEQ ID NO: 4439434 - DNA, 23 bp, Homo sapiens
ggaagtggggctaggtcttgcca

SEQ ID NO: 4439435 - DNA, 22 bp, Homo sapiens
ggaagtgtgggtctgtgtgtgt

SEQ ID NO: 4439436 - DNA, 18 bp, Homo sapiens
ggaagtgtgtgccaagag

SEQ ID NO: 4439437 - DNA, 19 bp, Homo sapiens
ggaagtgtgtgccaagagc

SEQ ID NO: 4439438 - DNA, 23 bp, Homo sapiens
ggaagttatggcagtgatgccga

SEQ ID NO: 4439439 - DNA, 13 bp, Homo sapiens
ggaataaaacagt

SEQ ID NO: 4439440 - DNA, 22 bp, Homo sapiens
ggaataaattatggcatttcta

SEQ ID NO: 4439441 - DNA, 19 bp, Homo sapiens
ggaataatacatactaatg

SEQ ID NO: 4439442 - DNA, 13 bp, Homo sapiens
ggaatacatttta

SEQ ID NO: 4439443 - DNA, 17 bp, Homo sapiens
ggaatacattttattct

SEQ ID NO: 4439444 - DNA, 12 bp, Homo sapiens
ggaatacttttt

SEQ ID NO: 4439445 - DNA, 15 bp, Homo sapiens
ggaatataaaacagt

SEQ ID NO: 4439446 - DNA, 14 bp, Homo sapiens
ggaatataagaaaa

SEQ ID NO: 4439447 - DNA, 15 bp, Homo sapiens
ggaatataattgttt

SEQ ID NO: 4439448 - DNA, 19 bp, Homo sapiens
ggaatatcatctgtcatta

SEQ ID NO: 4439449 - DNA, 23 bp, Homo sapiens
ggaatcaagagctgccctccttg

SEQ ID NO: 4439450 - DNA, 21 bp, Homo sapiens
ggaatcacccctctgcccctg

SEQ ID NO: 4439451 - DNA, 23 bp, Homo sapiens
ggaatcacccctctgcccctgca

SEQ ID NO: 4439452 - DNA, 22 bp, Homo sapiens
ggaatcctggaccaagcacaaa

SEQ ID NO: 4439453 - DNA, 19 bp, Homo sapiens
ggaatctggagagctagaa

SEQ ID NO: 4439454 - DNA, 15 bp, Homo sapiens
ggaatctgtttctct

SEQ ID NO: 4439455 - DNA, 16 bp, Homo sapiens
ggaatctgtttctctg

SEQ ID NO: 4439456 - DNA, 18 bp, Homo sapiens
ggaatctgtttctctgct

SEQ ID NO: 4439457 - DNA, 21 bp, Homo sapiens
ggaatctttgtaccaaaattt

SEQ ID NO: 4439458 - DNA, 20 bp, Homo sapiens
ggaatgaaattaacacaaag

SEQ ID NO: 4439459 - DNA, 12 bp, Homo sapiens
ggaatgaagaac

SEQ ID NO: 4439460 - DNA, 23 bp, Homo sapiens
ggaatgagccgcggggaagctgg

SEQ ID NO: 4439461 - DNA, 14 bp, Homo sapiens
ggaatgagctgtgt

SEQ ID NO: 4439462 - DNA, 20 bp, Homo sapiens
ggaatgaggggaagccattt

SEQ ID NO: 4439463 - DNA, 14 bp, Homo sapiens
ggaatgcagcagga

SEQ ID NO: 4439464 - DNA, 23 bp, Homo sapiens
ggaatgcggccgcattccctgag

SEQ ID NO: 4439465 - DNA, 21 bp, Homo sapiens
ggaatgctcccagctgtgctg

SEQ ID NO: 4439466 - DNA, 13 bp, Homo sapiens
ggaatggaagaga

SEQ ID NO: 4439467 - DNA, 22 bp, Homo sapiens
ggaatgtgccacagaggcccca

SEQ ID NO: 4439468 - DNA, 16 bp, Homo sapiens
ggaatgttaaagtcag

SEQ ID NO: 4439469 - DNA, 18 bp, Homo sapiens
ggaatgtttttccctccc

SEQ ID NO: 4439470 - DNA, 23 bp, Homo sapiens
ggaatgtttttccctccccagaa

SEQ ID NO: 4439471 - DNA, 13 bp, Homo sapiens
ggaattaaatagt

SEQ ID NO: 4439472 - DNA, 14 bp, Homo sapiens
ggaattaaatagtg

SEQ ID NO: 4439473 - DNA, 16 bp, Homo sapiens
ggaattctaaataaat

SEQ ID NO: 4439474 - DNA, 15 bp, Homo sapiens
ggaattgatttgcat

SEQ ID NO: 4439475 - DNA, 18 bp, Homo sapiens
ggaattgatttgcattga

SEQ ID NO: 4439476 - DNA, 14 bp, Homo sapiens
ggaattgcgctcag

SEQ ID NO: 4439477 - DNA, 24 bp, Homo sapiens
ggaattgcgctcaggggctccatg

SEQ ID NO: 4439478 - DNA, 23 bp, Homo sapiens
ggaatttctcccagtcatttaat

SEQ ID NO: 4439479 - DNA, 18 bp, Homo sapiens
ggaatttcttaacttctt

SEQ ID NO: 4439480 - DNA, 17 bp, Homo sapiens
ggaattttgagaaaaat

SEQ ID NO: 4439481 - DNA, 22 bp, Homo sapiens
ggacaaagaattccaaagcaaa

SEQ ID NO: 4439482 - DNA, 13 bp, Homo sapiens
ggacaaggagctg

SEQ ID NO: 4439483 - DNA, 21 bp, Homo sapiens
ggacacaataggtctttctct

SEQ ID NO: 4439484 - DNA, 23 bp, Homo sapiens
ggacacaataggtctttctctca

SEQ ID NO: 4439485 - DNA, 17 bp, Homo sapiens
ggacacagacccaggac

SEQ ID NO: 4439486 - DNA, 16 bp, Homo sapiens
ggacacagttcctggg

SEQ ID NO: 4439487 - DNA, 18 bp, Homo sapiens
ggacacagttcctgggaa

SEQ ID NO: 4439488 - DNA, 21 bp, Homo sapiens
ggacacattggaatgccttgg

SEQ ID NO: 4439489 - DNA, 22 bp, Homo sapiens
ggacacattggaatgccttgga

SEQ ID NO: 4439490 - DNA, 13 bp, Homo sapiens
ggacaccagccag

SEQ ID NO: 4439491 - DNA, 14 bp, Homo sapiens
ggacaccagccagg

SEQ ID NO: 4439492 - DNA, 18 bp, Homo sapiens
ggacaccagccaggctct

SEQ ID NO: 4439493 - DNA, 20 bp, Homo sapiens
ggacaccagccaggctctgt

SEQ ID NO: 4439494 - DNA, 16 bp, Homo sapiens
ggacaccccgactttt

SEQ ID NO: 4439495 - DNA, 12 bp, Homo sapiens
ggacaccctccc

SEQ ID NO: 4439496 - DNA, 16 bp, Homo sapiens
ggacacctaggctagg

SEQ ID NO: 4439497 - DNA, 22 bp, Homo sapiens
ggacacgagccacaagctgcac

SEQ ID NO: 4439498 - DNA, 19 bp, Homo sapiens
ggacactcgtcaccccagc

SEQ ID NO: 4439499 - DNA, 23 bp, Homo sapiens
ggacagacccacccccagccttg

SEQ ID NO: 4439500 - DNA, 18 bp, Homo sapiens
ggacagagacacctgcac

SEQ ID NO: 4439501 - DNA, 20 bp, Homo sapiens
ggacagagactcagatgagg

SEQ ID NO: 4439502 - DNA, 11 bp, Homo sapiens
ggacagagcca

SEQ ID NO: 4439503 - DNA, 19 bp, Homo sapiens
ggacagagccagcggctcc

SEQ ID NO: 4439504 - DNA, 22 bp, Homo sapiens
ggacagagggaagccagtcagg

SEQ ID NO: 4439505 - DNA, 14 bp, Homo sapiens
ggacagagggcaca

SEQ ID NO: 4439506 - DNA, 18 bp, Homo sapiens
ggacagagggcacatgaa

SEQ ID NO: 4439507 - DNA, 15 bp, Homo sapiens
ggacagcagaagcct

SEQ ID NO: 4439508 - DNA, 18 bp, Homo sapiens
ggacagcagaagcctcca

SEQ ID NO: 4439509 - DNA, 16 bp, Homo sapiens
ggacagcatcccttcc

SEQ ID NO: 4439510 - DNA, 23 bp, Homo sapiens
ggacagctgtgccgggaggcagc

SEQ ID NO: 4439511 - DNA, 19 bp, Homo sapiens
ggacagcttgagccgggcc

SEQ ID NO: 4439512 - DNA, 16 bp, Homo sapiens
ggacaggatgaggaca

SEQ ID NO: 4439513 - DNA, 17 bp, Homo sapiens
ggacaggatgaggacag

SEQ ID NO: 4439514 - DNA, 19 bp, Homo sapiens
ggacaggatgaggacagag

SEQ ID NO: 4439515 - DNA, 23 bp, Homo sapiens
ggacaggatgaggacagagggca

SEQ ID NO: 4439516 - DNA, 17 bp, Homo sapiens
ggacaggatttggccac

SEQ ID NO: 4439517 - DNA, 14 bp, Homo sapiens
ggacaggcaggcca

SEQ ID NO: 4439518 - DNA, 15 bp, Homo sapiens
ggacaggcaggccag

SEQ ID NO: 4439519 - DNA, 16 bp, Homo sapiens
ggacaggcaggccaga

SEQ ID NO: 4439520 - DNA, 12 bp, Homo sapiens
ggacaggcgggc

SEQ ID NO: 4439521 - DNA, 20 bp, Homo sapiens
ggacaggcgggctcggaggc

SEQ ID NO: 4439522 - DNA, 22 bp, Homo sapiens
ggacagggctggcccagccctg

SEQ ID NO: 4439523 - DNA, 16 bp, Homo sapiens
ggacagtgctgcagct

SEQ ID NO: 4439524 - DNA, 22 bp, Homo sapiens
ggacagttgcttttcagcatgg

SEQ ID NO: 4439525 - DNA, 15 bp, Homo sapiens
ggacatgccctgtgt

SEQ ID NO: 4439526 - DNA, 19 bp, Homo sapiens
ggacatggtgtttaaaatt

SEQ ID NO: 4439527 - DNA, 22 bp, Homo sapiens
ggacatggttgggggaatgcac

SEQ ID NO: 4439528 - DNA, 15 bp, Homo sapiens
ggaccaacctgctct

SEQ ID NO: 4439529 - DNA, 19 bp, Homo sapiens
ggaccaacctgctctgtcc

SEQ ID NO: 4439530 - DNA, 21 bp, Homo sapiens
ggaccaacctgctctgtcccc

SEQ ID NO: 4439531 - DNA, 23 bp, Homo sapiens
ggaccaacctgctctgtccccaa

SEQ ID NO: 4439532 - DNA, 24 bp, Homo sapiens
ggaccaattctggacagacagatg

SEQ ID NO: 4439533 - DNA, 18 bp, Homo sapiens
ggaccaccctgagccggc

SEQ ID NO: 4439534 - DNA, 20 bp, Homo sapiens
ggaccaccgttcagtcattt

SEQ ID NO: 4439535 - DNA, 14 bp, Homo sapiens
ggaccactaggcct

SEQ ID NO: 4439536 - DNA, 15 bp, Homo sapiens
ggaccactaggcctg

SEQ ID NO: 4439537 - DNA, 16 bp, Homo sapiens
ggaccactcgaggcct

SEQ ID NO: 4439538 - DNA, 17 bp, Homo sapiens
ggaccactcgaggcctg

SEQ ID NO: 4439539 - DNA, 17 bp, Homo sapiens
ggaccagcccttcatgg

SEQ ID NO: 4439540 - DNA, 17 bp, Homo sapiens
ggaccaggacaggacca

SEQ ID NO: 4439541 - DNA, 22 bp, Homo sapiens
ggacccaccccaactctcccca

SEQ ID NO: 4439542 - DNA, 11 bp, Homo sapiens
ggacccacctg

SEQ ID NO: 4439543 - DNA, 17 bp, Homo sapiens
ggacccagacccagtgg

SEQ ID NO: 4439544 - DNA, 11 bp, Homo sapiens
ggacccaggcg

SEQ ID NO: 4439545 - DNA, 14 bp, Homo sapiens
ggacccaggcgctg

SEQ ID NO: 4439546 - DNA, 17 bp, Homo sapiens
ggacccaggcgctgcat

SEQ ID NO: 4439547 - DNA, 19 bp, Homo sapiens
ggacccagtggtcagcagg

SEQ ID NO: 4439548 - DNA, 14 bp, Homo sapiens
ggaccccagcattt

SEQ ID NO: 4439549 - DNA, 17 bp, Homo sapiens
ggacccctcgccccagc

SEQ ID NO: 4439550 - DNA, 18 bp, Homo sapiens
ggacccctcgccccagcc

SEQ ID NO: 4439551 - DNA, 22 bp, Homo sapiens
ggaccctgacctccgcccctgc

SEQ ID NO: 4439552 - DNA, 20 bp, Homo sapiens
ggaccctgcccagagctgag

SEQ ID NO: 4439553 - DNA, 13 bp, Homo sapiens
ggaccctggggca

SEQ ID NO: 4439554 - DNA, 23 bp, Homo sapiens
ggaccctgtccggcccagtgcca

SEQ ID NO: 4439555 - DNA, 23 bp, Homo sapiens
ggaccctgtgacatggtgcctga

SEQ ID NO: 4439556 - DNA, 20 bp, Homo sapiens
ggacccttaggatggggctc

SEQ ID NO: 4439557 - DNA, 22 bp, Homo sapiens
ggacccttaggatggggctccc

SEQ ID NO: 4439558 - DNA, 15 bp, Homo sapiens
ggacccttcaggtgt

SEQ ID NO: 4439559 - DNA, 23 bp, Homo sapiens
ggaccctttccttccttccctgg

SEQ ID NO: 4439560 - DNA, 19 bp, Homo sapiens
ggaccgaggctacagctcc

SEQ ID NO: 4439561 - DNA, 15 bp, Homo sapiens
ggaccggtgctgcag

SEQ ID NO: 4439562 - DNA, 16 bp, Homo sapiens
ggaccggtgctgcagg

SEQ ID NO: 4439563 - DNA, 17 bp, Homo sapiens
ggaccggtgctgcagga

SEQ ID NO: 4439564 - DNA, 23 bp, Homo sapiens
ggaccgtgccctcgtcagctggg

SEQ ID NO: 4439565 - DNA, 13 bp, Homo sapiens
ggacctcagcaag

SEQ ID NO: 4439566 - DNA, 21 bp, Homo sapiens
ggacctccttagccctgtctg

SEQ ID NO: 4439567 - DNA, 17 bp, Homo sapiens
ggacctgccaggcaggg

SEQ ID NO: 4439568 - DNA, 21 bp, Homo sapiens
ggacctttaacttttttttct

SEQ ID NO: 4439569 - DNA, 23 bp, Homo sapiens
ggacctttaacttttttttctct

SEQ ID NO: 4439570 - DNA, 23 bp, Homo sapiens
ggacgatcaggaggaagtgagca

SEQ ID NO: 4439571 - DNA, 19 bp, Homo sapiens
ggacgccactcatttcatc

SEQ ID NO: 4439572 - DNA, 13 bp, Homo sapiens
ggacgcctgcagg

SEQ ID NO: 4439573 - DNA, 19 bp, Homo sapiens
ggacgcctgggggtgccag

SEQ ID NO: 4439574 - DNA, 19 bp, Homo sapiens
ggacgctgcagaccccagg

SEQ ID NO: 4439575 - DNA, 19 bp, Homo sapiens
ggacggggggccccagtca

SEQ ID NO: 4439576 - DNA, 21 bp, Homo sapiens
ggacggggggccccagtcagc

SEQ ID NO: 4439577 - DNA, 23 bp, Homo sapiens
ggacggttttgctttatggctag

SEQ ID NO: 4439578 - DNA, 16 bp, Homo sapiens
ggacgttccagccggc

SEQ ID NO: 4439579 - DNA, 11 bp, Homo sapiens
ggactacacaa

SEQ ID NO: 4439580 - DNA, 20 bp, Homo sapiens
ggactaggacctgagcctgg

SEQ ID NO: 4439581 - DNA, 19 bp, Homo sapiens
ggactattgtgccaactgc

SEQ ID NO: 4439582 - DNA, 13 bp, Homo sapiens
ggactcagccctg

SEQ ID NO: 4439583 - DNA, 20 bp, Homo sapiens
ggactcagttgttctgagca

SEQ ID NO: 4439584 - DNA, 21 bp, Homo sapiens
ggactcagttgttctgagcac

SEQ ID NO: 4439585 - DNA, 22 bp, Homo sapiens
ggactcattttaaaaaatggaa

SEQ ID NO: 4439586 - DNA, 18 bp, Homo sapiens
ggactccggaggactgag

SEQ ID NO: 4439587 - DNA, 16 bp, Homo sapiens
ggactccggctgtgct

SEQ ID NO: 4439588 - DNA, 21 bp, Homo sapiens
ggactcggagactatggcctc

SEQ ID NO: 4439589 - DNA, 15 bp, Homo sapiens
ggactctcagggatt

SEQ ID NO: 4439590 - DNA, 17 bp, Homo sapiens
ggactctcagtctctga

SEQ ID NO: 4439591 - DNA, 14 bp, Homo sapiens
ggactctcctcctc

SEQ ID NO: 4439592 - DNA, 16 bp, Homo sapiens
ggactctcctcctccc

SEQ ID NO: 4439593 - DNA, 19 bp, Homo sapiens
ggactctcctcctcccctc

SEQ ID NO: 4439594 - DNA, 20 bp, Homo sapiens
ggactctttccgactgccca

SEQ ID NO: 4439595 - DNA, 22 bp, Homo sapiens
ggactgactttccgagcctcca

SEQ ID NO: 4439596 - DNA, 21 bp, Homo sapiens
ggactgagccaaggaggcctg

SEQ ID NO: 4439597 - DNA, 22 bp, Homo sapiens
ggactgagccaaggaggcctgg

SEQ ID NO: 4439598 - DNA, 17 bp, Homo sapiens
ggactgagggactctga

SEQ ID NO: 4439599 - DNA, 21 bp, Homo sapiens
ggactgagggactctgaagcc

SEQ ID NO: 4439600 - DNA, 17 bp, Homo sapiens
ggactgcccccagaaag

SEQ ID NO: 4439601 - DNA, 22 bp, Homo sapiens
ggactgcccccagaaagcctcc

SEQ ID NO: 4439602 - DNA, 12 bp, Homo sapiens
ggactgctgctc

SEQ ID NO: 4439603 - DNA, 21 bp, Homo sapiens
ggactggcgttcacctccctg

SEQ ID NO: 4439604 - DNA, 13 bp, Homo sapiens
ggactgtgcctgg

SEQ ID NO: 4439605 - DNA, 14 bp, Homo sapiens
ggactgtgcctggc

SEQ ID NO: 4439606 - DNA, 17 bp, Homo sapiens
ggactgtgcctggctcc

SEQ ID NO: 4439607 - DNA, 20 bp, Homo sapiens
ggactgtgcctggctccctg

SEQ ID NO: 4439608 - DNA, 14 bp, Homo sapiens
ggactgttccaggc

SEQ ID NO: 4439609 - DNA, 20 bp, Homo sapiens
ggactgttccaggccctcca

SEQ ID NO: 4439610 - DNA, 16 bp, Homo sapiens
ggacttcaactgccca

SEQ ID NO: 4439611 - DNA, 20 bp, Homo sapiens
ggacttcaactgcccagcaa

SEQ ID NO: 4439612 - DNA, 17 bp, Homo sapiens
ggacttctacctgccct

SEQ ID NO: 4439613 - DNA, 14 bp, Homo sapiens
ggacttctgcagct

SEQ ID NO: 4439614 - DNA, 13 bp, Homo sapiens
ggacttctgggag

SEQ ID NO: 4439615 - DNA, 17 bp, Homo sapiens
ggactttatttatttct

SEQ ID NO: 4439616 - DNA, 20 bp, Homo sapiens
ggactttgtatactttaaat

SEQ ID NO: 4439617 - DNA, 14 bp, Homo sapiens
ggagaaagaaagta

SEQ ID NO: 4439618 - DNA, 21 bp, Homo sapiens
ggagaaagaaagtacccagca

SEQ ID NO: 4439619 - DNA, 22 bp, Homo sapiens
ggagaaagaaagtacccagcaa

SEQ ID NO: 4439620 - DNA, 18 bp, Homo sapiens
ggagaaagccacgccctc

SEQ ID NO: 4439621 - DNA, 17 bp, Homo sapiens
ggagaaatgcaataact

SEQ ID NO: 4439622 - DNA, 18 bp, Homo sapiens
ggagaaatgcaataactc

SEQ ID NO: 4439623 - DNA, 11 bp, Homo sapiens
ggagaaccagg

SEQ ID NO: 4439624 - DNA, 21 bp, Homo sapiens
ggagaaccagggctcttctca

SEQ ID NO: 4439625 - DNA, 22 bp, Homo sapiens
ggagaagaattttcagacccca

SEQ ID NO: 4439626 - DNA, 14 bp, Homo sapiens
ggagaagacccacg

SEQ ID NO: 4439627 - DNA, 15 bp, Homo sapiens
ggagaagagctgttc

SEQ ID NO: 4439628 - DNA, 18 bp, Homo sapiens
ggagaagccacaggcctg

SEQ ID NO: 4439629 - DNA, 19 bp, Homo sapiens
ggagaagccacaggcctga

SEQ ID NO: 4439630 - DNA, 20 bp, Homo sapiens
ggagaagccacaggcctgag

SEQ ID NO: 4439631 - DNA, 14 bp, Homo sapiens
ggagaaggaaaaag

SEQ ID NO: 4439632 - DNA, 22 bp, Homo sapiens
ggagaaggaaggagactcacct

SEQ ID NO: 4439633 - DNA, 19 bp, Homo sapiens
ggagaagtcttctatttat

SEQ ID NO: 4439634 - DNA, 12 bp, Homo sapiens
ggagaatcactt

SEQ ID NO: 4439635 - DNA, 18 bp, Homo sapiens
ggagaatcacttaagcct

SEQ ID NO: 4439636 - DNA, 21 bp, Homo sapiens
ggagacagaggaaagggctgg

SEQ ID NO: 4439637 - DNA, 15 bp, Homo sapiens
ggagacagccaggtg

SEQ ID NO: 4439638 - DNA, 20 bp, Homo sapiens
ggagacaggcagggagggct

SEQ ID NO: 4439639 - DNA, 15 bp, Homo sapiens
ggagaccccccccca

SEQ ID NO: 4439640 - DNA, 17 bp, Homo sapiens
ggagaccctgaactcag

SEQ ID NO: 4439641 - DNA, 16 bp, Homo sapiens
ggagaccctgccacag

SEQ ID NO: 4439642 - DNA, 19 bp, Homo sapiens
ggagaccctgccacagcca

SEQ ID NO: 4439643 - DNA, 22 bp, Homo sapiens
ggagaccctgccacagccagag

SEQ ID NO: 4439644 - DNA, 14 bp, Homo sapiens
ggagactagattgc

SEQ ID NO: 4439645 - DNA, 19 bp, Homo sapiens
ggagactagattgcctttg

SEQ ID NO: 4439646 - DNA, 13 bp, Homo sapiens
ggagactcacctc

SEQ ID NO: 4439647 - DNA, 16 bp, Homo sapiens
ggagactcacctctgc

SEQ ID NO: 4439648 - DNA, 17 bp, Homo sapiens
ggagactcacctctgcc

SEQ ID NO: 4439649 - DNA, 18 bp, Homo sapiens
ggagactcacctctgcct

SEQ ID NO: 4439650 - DNA, 19 bp, Homo sapiens
ggagactcacctctgcctc

SEQ ID NO: 4439651 - DNA, 21 bp, Homo sapiens
ggagactcacctctgcctcaa

SEQ ID NO: 4439652 - DNA, 16 bp, Homo sapiens
ggagactcctggtctg

SEQ ID NO: 4439653 - DNA, 23 bp, Homo sapiens
ggagactgataacttggggaggc

SEQ ID NO: 4439654 - DNA, 17 bp, Homo sapiens
ggagactgggctgaggg

SEQ ID NO: 4439655 - DNA, 16 bp, Homo sapiens
ggagagacgaggcatt

SEQ ID NO: 4439656 - DNA, 15 bp, Homo sapiens
ggagagacgggccct

SEQ ID NO: 4439657 - DNA, 15 bp, Homo sapiens
ggagagccagccctc

SEQ ID NO: 4439658 - DNA, 23 bp, Homo sapiens
ggagagccagccctccctgtcct

SEQ ID NO: 4439659 - DNA, 14 bp, Homo sapiens
ggagagcctgctgg

SEQ ID NO: 4439660 - DNA, 22 bp, Homo sapiens
ggagagctagaacccggcaggc

SEQ ID NO: 4439661 - DNA, 16 bp, Homo sapiens
ggagagctagaacctg

SEQ ID NO: 4439662 - DNA, 18 bp, Homo sapiens
ggagagctagaacctgga

SEQ ID NO: 4439663 - DNA, 19 bp, Homo sapiens
ggagagctagaacctggag

SEQ ID NO: 4439664 - DNA, 18 bp, Homo sapiens
ggagagctggtgcccgga

SEQ ID NO: 4439665 - DNA, 22 bp, Homo sapiens
ggagaggaacgggcagcctggg

SEQ ID NO: 4439666 - DNA, 17 bp, Homo sapiens
ggagaggcaaagaaagg

SEQ ID NO: 4439667 - DNA, 14 bp, Homo sapiens
ggagaggcggcctc

SEQ ID NO: 4439668 - DNA, 16 bp, Homo sapiens
ggagaggcggcctcgt

SEQ ID NO: 4439669 - DNA, 17 bp, Homo sapiens
ggagaggcggcctcgtg

SEQ ID NO: 4439670 - DNA, 21 bp, Homo sapiens
ggagaggctagaaccaagaag

SEQ ID NO: 4439671 - DNA, 13 bp, Homo sapiens
ggagagggaggtc

SEQ ID NO: 4439672 - DNA, 18 bp, Homo sapiens
ggagagggcccaggtccc

SEQ ID NO: 4439673 - DNA, 17 bp, Homo sapiens
ggagagggtctggagaa

SEQ ID NO: 4439674 - DNA, 15 bp, Homo sapiens
ggagagttaaatggt

SEQ ID NO: 4439675 - DNA, 23 bp, Homo sapiens
ggagataaaagcaattctgactg

SEQ ID NO: 4439676 - DNA, 14 bp, Homo sapiens
ggagatacagtgga

SEQ ID NO: 4439677 - DNA, 15 bp, Homo sapiens
ggagatagtgccagg

SEQ ID NO: 4439678 - DNA, 22 bp, Homo sapiens
ggagatatttatggggggagaa

SEQ ID NO: 4439679 - DNA, 14 bp, Homo sapiens
ggagatgaccaggg

SEQ ID NO: 4439680 - DNA, 18 bp, Homo sapiens
ggagatgaccagggatgc

SEQ ID NO: 4439681 - DNA, 18 bp, Homo sapiens
ggagatgagtgggcttcg

SEQ ID NO: 4439682 - DNA, 17 bp, Homo sapiens
ggagatgccatcctctt

SEQ ID NO: 4439683 - DNA, 15 bp, Homo sapiens
ggagatgctccttgg

SEQ ID NO: 4439684 - DNA, 18 bp, Homo sapiens
ggagatgcttctctcctt

SEQ ID NO: 4439685 - DNA, 17 bp, Homo sapiens
ggagattggacggcctg

SEQ ID NO: 4439686 - DNA, 22 bp, Homo sapiens
ggagatttttttgagtcaaaga

SEQ ID NO: 4439687 - DNA, 16 bp, Homo sapiens
ggagcacccagagcac

SEQ ID NO: 4439688 - DNA, 21 bp, Homo sapiens
ggagcactgcatgtcagagca

SEQ ID NO: 4439689 - DNA, 22 bp, Homo sapiens
ggagcagcacgattttgcacaa

SEQ ID NO: 4439690 - DNA, 15 bp, Homo sapiens
ggagcagccctggcc

SEQ ID NO: 4439691 - DNA, 16 bp, Homo sapiens
ggagcagggaaggcct

SEQ ID NO: 4439692 - DNA, 19 bp, Homo sapiens
ggagcagggaaggcctgac

SEQ ID NO: 4439693 - DNA, 19 bp, Homo sapiens
ggagcaggggtctgagcca

SEQ ID NO: 4439694 - DNA, 16 bp, Homo sapiens
ggagcagtccatgcat

SEQ ID NO: 4439695 - DNA, 17 bp, Homo sapiens
ggagcagtccatgcatg

SEQ ID NO: 4439696 - DNA, 15 bp, Homo sapiens
ggagcatcaagccac

SEQ ID NO: 4439697 - DNA, 16 bp, Homo sapiens
gctctgatctgaggct

SEQ ID NO: 4439698 - DNA, 16 bp, Homo sapiens
gctctgcaggctgggg

SEQ ID NO: 4439699 - DNA, 17 bp, Homo sapiens
gctctgcatgcggccca

SEQ ID NO: 4439700 - DNA, 21 bp, Homo sapiens
gctctgcccatcctgcccctg

SEQ ID NO: 4439701 - DNA, 22 bp, Homo sapiens
gctctgcccccgcgggttctag

SEQ ID NO: 4439702 - DNA, 14 bp, Homo sapiens
gctctgcctcagac

SEQ ID NO: 4439703 - DNA, 22 bp, Homo sapiens
gctctgcctcagacgttgcctg

SEQ ID NO: 4439704 - DNA, 22 bp, Homo sapiens
gctctggaataaagttgcagat

SEQ ID NO: 4439705 - DNA, 21 bp, Homo sapiens
gctctggacagcagaagcctc

SEQ ID NO: 4439706 - DNA, 12 bp, Homo sapiens
gctctggcacag

SEQ ID NO: 4439707 - DNA, 15 bp, Homo sapiens
gctctggctctgcct

SEQ ID NO: 4439708 - DNA, 19 bp, Homo sapiens
gctctggctctgcctcagg

SEQ ID NO: 4439709 - DNA, 17 bp, Homo sapiens
gctctggggatttctgg

SEQ ID NO: 4439710 - DNA, 19 bp, Homo sapiens
gctctggggatttctggga

SEQ ID NO: 4439711 - DNA, 18 bp, Homo sapiens
gctctgggggtgggaagt

SEQ ID NO: 4439712 - DNA, 22 bp, Homo sapiens
gctctgggggtgggaagtgggg

SEQ ID NO: 4439713 - DNA, 23 bp, Homo sapiens
gctctgggggtgggaagtggggc

SEQ ID NO: 4439714 - DNA, 19 bp, Homo sapiens
gctctggttgtttctgttc

SEQ ID NO: 4439715 - DNA, 22 bp, Homo sapiens
gctctgtatcaggacccagagg

SEQ ID NO: 4439716 - DNA, 16 bp, Homo sapiens
gctctgtccccaaagg

SEQ ID NO: 4439717 - DNA, 15 bp, Homo sapiens
gctctgtcccccagg

SEQ ID NO: 4439718 - DNA, 17 bp, Homo sapiens
gctctgtcccccaggct

SEQ ID NO: 4439719 - DNA, 15 bp, Homo sapiens
gctctgtcgcccagg

SEQ ID NO: 4439720 - DNA, 21 bp, Homo sapiens
gctctgtgcagtcactggagg

SEQ ID NO: 4439721 - DNA, 22 bp, Homo sapiens
gctctgtgctgaccctcctgtt

SEQ ID NO: 4439722 - DNA, 13 bp, Homo sapiens
gctctgtgggtga

SEQ ID NO: 4439723 - DNA, 19 bp, Homo sapiens
gctctgtgtatatctcttg

SEQ ID NO: 4439724 - DNA, 20 bp, Homo sapiens
gctctgtgtatatctcttgg

SEQ ID NO: 4439725 - DNA, 23 bp, Homo sapiens
gctctgtgtatatctcttggaaa

SEQ ID NO: 4439726 - DNA, 17 bp, Homo sapiens
gctctgttacccaggct

SEQ ID NO: 4439727 - DNA, 20 bp, Homo sapiens
gctctgtttagaggaggcaa

SEQ ID NO: 4439728 - DNA, 22 bp, Homo sapiens
gctctgtttagaggaggcaaca

SEQ ID NO: 4439729 - DNA, 17 bp, Homo sapiens
gctctgtttgtgggact

SEQ ID NO: 4439730 - DNA, 17 bp, Homo sapiens
gctcttatgtgtgcctt

SEQ ID NO: 4439731 - DNA, 13 bp, Homo sapiens
gcggagcccagcc

SEQ ID NO: 4439732 - DNA, 18 bp, Homo sapiens
gcggagccccggctctta

SEQ ID NO: 4439733 - DNA, 13 bp, Homo sapiens
gcggagcgggagg

SEQ ID NO: 4439734 - DNA, 16 bp, Homo sapiens
gcggaggaggctggtg

SEQ ID NO: 4439735 - DNA, 18 bp, Homo sapiens
gcggaggaggctggtgac

SEQ ID NO: 4439736 - DNA, 16 bp, Homo sapiens
gcggcaaaaggaaagc

SEQ ID NO: 4439737 - DNA, 13 bp, Homo sapiens
gcggccagccccg

SEQ ID NO: 4439738 - DNA, 20 bp, Homo sapiens
gcggccagccccggccctgg

SEQ ID NO: 4439739 - DNA, 21 bp, Homo sapiens
gcggccagccccggccctggg

SEQ ID NO: 4439740 - DNA, 21 bp, Homo sapiens
gcggcccagcccggctcccac

SEQ ID NO: 4439741 - DNA, 18 bp, Homo sapiens
gcggccccccgcacagcc

SEQ ID NO: 4439742 - DNA, 22 bp, Homo sapiens
gcggccccctctcggccaggca

SEQ ID NO: 4439743 - DNA, 19 bp, Homo sapiens
gcggccgcattccctgagt

SEQ ID NO: 4439744 - DNA, 21 bp, Homo sapiens
gcggcgaagaagagaaagatg

SEQ ID NO: 4439745 - DNA, 13 bp, Homo sapiens
gcggctcctggtg

SEQ ID NO: 4439746 - DNA, 14 bp, Homo sapiens
gcggctgccctctg

SEQ ID NO: 4439747 - DNA, 12 bp, Homo sapiens
gcggctgctcct

SEQ ID NO: 4439748 - DNA, 16 bp, Homo sapiens
gcgggaatgagctgtg

SEQ ID NO: 4439749 - DNA, 19 bp, Homo sapiens
gcgggaccggtacagaaag

SEQ ID NO: 4439750 - DNA, 12 bp, Homo sapiens
gcgggagccaga

SEQ ID NO: 4439751 - DNA, 15 bp, Homo sapiens
gcgggagtcagggac

SEQ ID NO: 4439752 - DNA, 23 bp, Homo sapiens
gcgggagtcagggacctgctgct

SEQ ID NO: 4439753 - DNA, 19 bp, Homo sapiens
gcgggcagagggctggagg

SEQ ID NO: 4439754 - DNA, 10 bp, Homo sapiens
gcgggcagcc

SEQ ID NO: 4439755 - DNA, 20 bp, Homo sapiens
gcgggccaggaggctgccac

SEQ ID NO: 4439756 - DNA, 21 bp, Homo sapiens
gcgggccaggaggctgccaca

SEQ ID NO: 4439757 - DNA, 14 bp, Homo sapiens
gcgggctcagagct

SEQ ID NO: 4439758 - DNA, 20 bp, Homo sapiens
gcgggctgaggagacaacca

SEQ ID NO: 4439759 - DNA, 15 bp, Homo sapiens
gcgggctgaggccag

SEQ ID NO: 4439760 - DNA, 16 bp, Homo sapiens
gcggggtttcaccatg

SEQ ID NO: 4439761 - DNA, 22 bp, Homo sapiens
gcgggtgacagctccgggatca

SEQ ID NO: 4439762 - DNA, 20 bp, Homo sapiens
gcgggtgatggccagcccct

SEQ ID NO: 4439763 - DNA, 22 bp, Homo sapiens
gcgggtgcaagcactcggggtc

SEQ ID NO: 4439764 - DNA, 20 bp, Homo sapiens
gcgggtggatcacctgaggt

SEQ ID NO: 4439765 - DNA, 19 bp, Homo sapiens
gcgggtggatcacgaggtc

SEQ ID NO: 4439766 - DNA, 22 bp, Homo sapiens
gcggtccaatgccacctagact

SEQ ID NO: 4439767 - DNA, 13 bp, Homo sapiens
gcggtgggtgctg

SEQ ID NO: 4439768 - DNA, 13 bp, Homo sapiens
gcgtcaagacatt

SEQ ID NO: 4439769 - DNA, 21 bp, Homo sapiens
gcgtcagcctccagcctctgt

SEQ ID NO: 4439770 - DNA, 13 bp, Homo sapiens
gcgtccaccctga

SEQ ID NO: 4439771 - DNA, 18 bp, Homo sapiens
gcgtccaccctgagctcg

SEQ ID NO: 4439772 - DNA, 14 bp, Homo sapiens
gcgtcccagctccc

SEQ ID NO: 4439773 - DNA, 16 bp, Homo sapiens
gcgtcccagctcccct

SEQ ID NO: 4439774 - DNA, 14 bp, Homo sapiens
gcgtccctggcgca

SEQ ID NO: 4439775 - DNA, 18 bp, Homo sapiens
gcgtccctggcgcaggtg

SEQ ID NO: 4439776 - DNA, 16 bp, Homo sapiens
gcgtcctcctctgtga

SEQ ID NO: 4439777 - DNA, 13 bp, Homo sapiens
gcgtcctgggctc

SEQ ID NO: 4439778 - DNA, 13 bp, Homo sapiens
gcgtcctgtccac

SEQ ID NO: 4439779 - DNA, 24 bp, Homo sapiens
gcgtcctgtccacacccagctcag

SEQ ID NO: 4439780 - DNA, 21 bp, Homo sapiens
gcgtctggaagtccaatgtgg

SEQ ID NO: 4439781 - DNA, 12 bp, Homo sapiens
gcgtgacggagc

SEQ ID NO: 4439782 - DNA, 16 bp, Homo sapiens
gcgtgactcacccaag

SEQ ID NO: 4439783 - DNA, 23 bp, Homo sapiens
gcgtgagccactgcgcccggccc

SEQ ID NO: 4439784 - DNA, 18 bp, Homo sapiens
gcgtgcccccctcctcca

SEQ ID NO: 4439785 - DNA, 21 bp, Homo sapiens
gcgtgcccccctcctccagta

SEQ ID NO: 4439786 - DNA, 18 bp, Homo sapiens
gcgtgcgcactgcatggg

SEQ ID NO: 4439787 - DNA, 14 bp, Homo sapiens
gcgtgctacctgca

SEQ ID NO: 4439788 - DNA, 15 bp, Homo sapiens
gcgtgctcagaccca

SEQ ID NO: 4439789 - DNA, 13 bp, Homo sapiens
gcgtgggtcagaa

SEQ ID NO: 4439790 - DNA, 13 bp, Homo sapiens
gcgtgtgaagaac

SEQ ID NO: 4439791 - DNA, 22 bp, Homo sapiens
gcgtgtgaagaacacctcctcc

SEQ ID NO: 4439792 - DNA, 22 bp, Homo sapiens
gcgtgtgggtcccgcactctgc

SEQ ID NO: 4439793 - DNA, 16 bp, Homo sapiens
gcgttcctttcttttc

SEQ ID NO: 4439794 - DNA, 16 bp, Homo sapiens
gcgttctcccaaagat

SEQ ID NO: 4439795 - DNA, 20 bp, Homo sapiens
gcgttctggactctgcccca

SEQ ID NO: 4439796 - DNA, 15 bp, Homo sapiens
gcgttgggagcctag

SEQ ID NO: 4439797 - DNA, 23 bp, Homo sapiens
gcgttgttgcatgtttgaaatga

SEQ ID NO: 4439798 - DNA, 20 bp, Homo sapiens
gcgtttcaccatgttggcca

SEQ ID NO: 4439799 - DNA, 19 bp, Homo sapiens
gcgttttttaaatgtatac

SEQ ID NO: 4439800 - DNA, 20 bp, Homo sapiens
gcgtttttttacaacattca

SEQ ID NO: 4439801 - DNA, 14 bp, Homo sapiens
gctaaaaaagcata

SEQ ID NO: 4439802 - DNA, 18 bp, Homo sapiens
gctaaaaaagctgaatca

SEQ ID NO: 4439803 - DNA, 13 bp, Homo sapiens
gctaaaaagcaac

SEQ ID NO: 4439804 - DNA, 16 bp, Homo sapiens
gctaaaaataaaacat

SEQ ID NO: 4439805 - DNA, 14 bp, Homo sapiens
gccttcctcctggg

SEQ ID NO: 4439806 - DNA, 16 bp, Homo sapiens
gccttcctcctgggcc

SEQ ID NO: 4439807 - DNA, 15 bp, Homo sapiens
gccttcgtgcctgag

SEQ ID NO: 4439808 - DNA, 18 bp, Homo sapiens
gccttctcaccagctgca

SEQ ID NO: 4439809 - DNA, 21 bp, Homo sapiens
gccttctcaccagctgcaaag

SEQ ID NO: 4439810 - DNA, 16 bp, Homo sapiens
gccttctcagaagcac

SEQ ID NO: 4439811 - DNA, 14 bp, Homo sapiens
gccttctcccacat

SEQ ID NO: 4439812 - DNA, 15 bp, Homo sapiens
gccttctcccacatg

SEQ ID NO: 4439813 - DNA, 21 bp, Homo sapiens
gccttctctattgggcacagc

SEQ ID NO: 4439814 - DNA, 15 bp, Homo sapiens
gccttctgaactcca

SEQ ID NO: 4439815 - DNA, 16 bp, Homo sapiens
gccttctgaactccat

SEQ ID NO: 4439816 - DNA, 17 bp, Homo sapiens
gccttctgaactccata

SEQ ID NO: 4439817 - DNA, 21 bp, Homo sapiens
gccttctgaactccatacagc

SEQ ID NO: 4439818 - DNA, 16 bp, Homo sapiens
gccttctgatgaaatg

SEQ ID NO: 4439819 - DNA, 13 bp, Homo sapiens
gccttctgccacc

SEQ ID NO: 4439820 - DNA, 20 bp, Homo sapiens
gccttctgccaccagcccct

SEQ ID NO: 4439821 - DNA, 22 bp, Homo sapiens
gccttctggtttcttccagcca

SEQ ID NO: 4439822 - DNA, 17 bp, Homo sapiens
gccttcttagagtttta

SEQ ID NO: 4439823 - DNA, 19 bp, Homo sapiens
gccttcttattctcactcc

SEQ ID NO: 4439824 - DNA, 14 bp, Homo sapiens
gccttgcccagaga

SEQ ID NO: 4439825 - DNA, 15 bp, Homo sapiens
gccttgcccagagat

SEQ ID NO: 4439826 - DNA, 20 bp, Homo sapiens
gccttgcccagagatgcctc

SEQ ID NO: 4439827 - DNA, 19 bp, Homo sapiens
gccttgccctcctgggccc

SEQ ID NO: 4439828 - DNA, 23 bp, Homo sapiens
gccttgccctcctgggccctggg

SEQ ID NO: 4439829 - DNA, 13 bp, Homo sapiens
gccttggaaccag

SEQ ID NO: 4439830 - DNA, 17 bp, Homo sapiens
gccttggaaccagcccc

SEQ ID NO: 4439831 - DNA, 18 bp, Homo sapiens
gccttggaaccagcccca

SEQ ID NO: 4439832 - DNA, 23 bp, Homo sapiens
gccttggaaccagccccatcaga

SEQ ID NO: 4439833 - DNA, 13 bp, Homo sapiens
gccttggagaggg

SEQ ID NO: 4439834 - DNA, 20 bp, Homo sapiens
gccttggaggaaatgtgctc

SEQ ID NO: 4439835 - DNA, 19 bp, Homo sapiens
gccttggataatgctgttg

SEQ ID NO: 4439836 - DNA, 18 bp, Homo sapiens
gccttggtgtccacctgg

SEQ ID NO: 4439837 - DNA, 22 bp, Homo sapiens
gccttggtgtccacctggcccc

SEQ ID NO: 4439838 - DNA, 14 bp, Homo sapiens
gccttgtacttgct

SEQ ID NO: 4439839 - DNA, 18 bp, Homo sapiens
gccttgtacttgcttgta

SEQ ID NO: 4439840 - DNA, 22 bp, Homo sapiens
gccttgtataatattgaaaatt

SEQ ID NO: 4439841 - DNA, 18 bp, Homo sapiens
gcctttaatattttgtaa

SEQ ID NO: 4439842 - DNA, 19 bp, Homo sapiens
gcctttaatattttgtaat

SEQ ID NO: 4439843 - DNA, 20 bp, Homo sapiens
gcctttaatattttgtaata

SEQ ID NO: 4439844 - DNA, 15 bp, Homo sapiens
gcctttacaagggag

SEQ ID NO: 4439845 - DNA, 14 bp, Homo sapiens
gcctttagaaaata

SEQ ID NO: 4439846 - DNA, 20 bp, Homo sapiens
gcctttagttctccactggg

SEQ ID NO: 4439847 - DNA, 19 bp, Homo sapiens
gcctttatttccactgtgc

SEQ ID NO: 4439848 - DNA, 20 bp, Homo sapiens
gcctttatttccactgtgca

SEQ ID NO: 4439849 - DNA, 13 bp, Homo sapiens
gcctttcctgttc

SEQ ID NO: 4439850 - DNA, 15 bp, Homo sapiens
gcctttcctgttcag

SEQ ID NO: 4439851 - DNA, 14 bp, Homo sapiens
gcctttccttccct

SEQ ID NO: 4439852 - DNA, 14 bp, Homo sapiens
gcctttctttgcct

SEQ ID NO: 4439853 - DNA, 15 bp, Homo sapiens
gcctttgaatgttaa

SEQ ID NO: 4439854 - DNA, 18 bp, Homo sapiens
gcctttgcaagatgcttg

SEQ ID NO: 4439855 - DNA, 18 bp, Homo sapiens
gcctttgccgtgagcatg

SEQ ID NO: 4439856 - DNA, 19 bp, Homo sapiens
gcctttgccgtgagcatgc

SEQ ID NO: 4439857 - DNA, 20 bp, Homo sapiens
gcctttgccgtgagcatgca

SEQ ID NO: 4439858 - DNA, 15 bp, Homo sapiens
gcctttgtatctttc

SEQ ID NO: 4439859 - DNA, 14 bp, Homo sapiens
gccttttaagtttg

SEQ ID NO: 4439860 - DNA, 14 bp, Homo sapiens
gccttttaattttt

SEQ ID NO: 4439861 - DNA, 16 bp, Homo sapiens
gccttttatgtaattt

SEQ ID NO: 4439862 - DNA, 20 bp, Homo sapiens
gccttttatgtaatttcttt

SEQ ID NO: 4439863 - DNA, 13 bp, Homo sapiens
gccttttcttttc

SEQ ID NO: 4439864 - DNA, 12 bp, Homo sapiens
gccttttgaaag

SEQ ID NO: 4439865 - DNA, 18 bp, Homo sapiens
gccttttgcaaccaggaa

SEQ ID NO: 4439866 - DNA, 14 bp, Homo sapiens
gccttttgctctct

SEQ ID NO: 4439867 - DNA, 16 bp, Homo sapiens
gccttttgctctctgt

SEQ ID NO: 4439868 - DNA, 17 bp, Homo sapiens
gcctttttcatttatct

SEQ ID NO: 4439869 - DNA, 12 bp, Homo sapiens
gcctttttcctg

SEQ ID NO: 4439870 - DNA, 17 bp, Homo sapiens
gcctttttcctgcgtcc

SEQ ID NO: 4439871 - DNA, 22 bp, Homo sapiens
gcgaagaccctcttgcccatcc

SEQ ID NO: 4439872 - DNA, 19 bp, Homo sapiens
gcgaagtctttgccttctc

SEQ ID NO: 4439873 - DNA, 12 bp, Homo sapiens
gcgacagtgaga

SEQ ID NO: 4439874 - DNA, 13 bp, Homo sapiens
gcgactaatttca

SEQ ID NO: 4439875 - DNA, 21 bp, Homo sapiens
gacgtttttgtgctgtgggca

SEQ ID NO: 4439876 - DNA, 23 bp, Homo sapiens
gactaaaacattttgactaagtt

SEQ ID NO: 4439877 - DNA, 20 bp, Homo sapiens
gactaaaggatccagagagc

SEQ ID NO: 4439878 - DNA, 17 bp, Homo sapiens
gactaatatattaatat

SEQ ID NO: 4439879 - DNA, 16 bp, Homo sapiens
gactaattcacaaaaa

SEQ ID NO: 4439880 - DNA, 21 bp, Homo sapiens
gactaattcctgccctgccca

SEQ ID NO: 4439881 - DNA, 12 bp, Homo sapiens
gactaatttcaa

SEQ ID NO: 4439882 - DNA, 22 bp, Homo sapiens
gactaatttcaaaatgcttttt

SEQ ID NO: 4439883 - DNA, 15 bp, Homo sapiens
gactaattttacatg

SEQ ID NO: 4439884 - DNA, 15 bp, Homo sapiens
gactactaaggcctt

SEQ ID NO: 4439885 - DNA, 16 bp, Homo sapiens
gactagaacctggagg

SEQ ID NO: 4439886 - DNA, 15 bp, Homo sapiens
gactagaagggccag

SEQ ID NO: 4439887 - DNA, 21 bp, Homo sapiens
gactagagcaaaataatgcaa

SEQ ID NO: 4439888 - DNA, 17 bp, Homo sapiens
gactagccactcctgcc

SEQ ID NO: 4439889 - DNA, 19 bp, Homo sapiens
gactagcctggccaacatg

SEQ ID NO: 4439890 - DNA, 24 bp, Homo sapiens
gactaggacctgagcctggtcctg

SEQ ID NO: 4439891 - DNA, 20 bp, Homo sapiens
gactagggattcaggctgct

SEQ ID NO: 4439892 - DNA, 21 bp, Homo sapiens
gactagggattcaggctgctt

SEQ ID NO: 4439893 - DNA, 20 bp, Homo sapiens
gactatgatgagaggccagc

SEQ ID NO: 4439894 - DNA, 21 bp, Homo sapiens
gactatggagtcttgtgaaag

SEQ ID NO: 4439895 - DNA, 13 bp, Homo sapiens
gactatggcctcg

SEQ ID NO: 4439896 - DNA, 16 bp, Homo sapiens
gactattcatggctac

SEQ ID NO: 4439897 - DNA, 19 bp, Homo sapiens
gactattctgtatctttca

SEQ ID NO: 4439898 - DNA, 13 bp, Homo sapiens
gactatttgctaa

SEQ ID NO: 4439899 - DNA, 14 bp, Homo sapiens
gactcaaaacctgg

SEQ ID NO: 4439900 - DNA, 17 bp, Homo sapiens
gactcaaaacctggaga

SEQ ID NO: 4439901 - DNA, 18 bp, Homo sapiens
gactcaaaacctggagat

SEQ ID NO: 4439902 - DNA, 22 bp, Homo sapiens
gactcaagaggaatctgtttct

SEQ ID NO: 4439903 - DNA, 18 bp, Homo sapiens
gactcaattatttgcata

SEQ ID NO: 4439904 - DNA, 23 bp, Homo sapiens
gactcacacctgaactgaacacc

SEQ ID NO: 4439905 - DNA, 13 bp, Homo sapiens
gactcacctctgc

SEQ ID NO: 4439906 - DNA, 14 bp, Homo sapiens
gactcacctctgcc

SEQ ID NO: 4439907 - DNA, 15 bp, Homo sapiens
gactcacctctgcct

SEQ ID NO: 4439908 - DNA, 17 bp, Homo sapiens
gactcacctctgcctca

SEQ ID NO: 4439909 - DNA, 15 bp, Homo sapiens
gactcactcataaag

SEQ ID NO: 4439910 - DNA, 16 bp, Homo sapiens
gactcagactccattt

SEQ ID NO: 4439911 - DNA, 18 bp, Homo sapiens
gactcagagagtgtgagc

SEQ ID NO: 4439912 - DNA, 18 bp, Homo sapiens
gactcagaggtccaggcc

SEQ ID NO: 4439913 - DNA, 20 bp, Homo sapiens
gactcagaggtccaggcccc

SEQ ID NO: 4439914 - DNA, 11 bp, Homo sapiens
gactcagccct

SEQ ID NO: 4439915 - DNA, 19 bp, Homo sapiens
gactcagccttcctcctca

SEQ ID NO: 4439916 - DNA, 19 bp, Homo sapiens
gactcaggagtctgccact

SEQ ID NO: 4439917 - DNA, 22 bp, Homo sapiens
gactcagggaccggtgctgcag

SEQ ID NO: 4439918 - DNA, 16 bp, Homo sapiens
gactcagggctcctgg

SEQ ID NO: 4439919 - DNA, 19 bp, Homo sapiens
gactcagggctcctgggtt

SEQ ID NO: 4439920 - DNA, 22 bp, Homo sapiens
gactcagtgtctgcctttaaat

SEQ ID NO: 4439921 - DNA, 19 bp, Homo sapiens
gactcatggtgtgttacac

SEQ ID NO: 4439922 - DNA, 13 bp, Homo sapiens
gactcattctgaa

SEQ ID NO: 4439923 - DNA, 16 bp, Homo sapiens
gactcattctgaagga

SEQ ID NO: 4439924 - DNA, 17 bp, Homo sapiens
gactcattctgaaggag

SEQ ID NO: 4439925 - DNA, 11 bp, Homo sapiens
gactccaaaga

SEQ ID NO: 4439926 - DNA, 12 bp, Homo sapiens
gactccaaagaa

SEQ ID NO: 4439927 - DNA, 15 bp, Homo sapiens
gactccaaagaaatg

SEQ ID NO: 4439928 - DNA, 23 bp, Homo sapiens
gactccactactttactgttggt

SEQ ID NO: 4439929 - DNA, 9 bp, Homo sapiens
gactccagc

SEQ ID NO: 4439930 - DNA, 15 bp, Homo sapiens
gactccagccagcgc

SEQ ID NO: 4439931 - DNA, 16 bp, Homo sapiens
gactccagccagcgcc

SEQ ID NO: 4439932 - DNA, 22 bp, Homo sapiens
gactccagccagcgcctccctc

SEQ ID NO: 4439933 - DNA, 12 bp, Homo sapiens
gactccatctct

SEQ ID NO: 4439934 - DNA, 15 bp, Homo sapiens
gactccatctcttct

SEQ ID NO: 4439935 - DNA, 18 bp, Homo sapiens
gactccatctcttctgca

SEQ ID NO: 4439936 - DNA, 15 bp, Homo sapiens
gactcccatgaagcc

SEQ ID NO: 4439937 - DNA, 17 bp, Homo sapiens
gactcccatgaagcctt

SEQ ID NO: 4439938 - DNA, 18 bp, Homo sapiens
gactcccatgagggagat

SEQ ID NO: 4439939 - DNA, 13 bp, Homo sapiens
gactccctcctca

SEQ ID NO: 4439940 - DNA, 12 bp, Homo sapiens
gactccctgtgg

SEQ ID NO: 4439941 - DNA, 14 bp, Homo sapiens
gactccctgtgggg

SEQ ID NO: 4439942 - DNA, 23 bp, Homo sapiens
gactccctgtgggggtggccatc

SEQ ID NO: 4439943 - DNA, 24 bp, Homo sapiens
gactccctgtgggggtggccatcc

SEQ ID NO: 4439944 - DNA, 13 bp, Homo sapiens
gactcctcctttt

SEQ ID NO: 4439945 - DNA, 15 bp, Homo sapiens
gactcctgaaacctc

SEQ ID NO: 4439946 - DNA, 14 bp, Homo sapiens
gactcctggactcc

SEQ ID NO: 4439947 - DNA, 15 bp, Homo sapiens
gactcgacaaaggcc

SEQ ID NO: 4439948 - DNA, 14 bp, Homo sapiens
gactcgccactggt

SEQ ID NO: 4439949 - DNA, 15 bp, Homo sapiens
gactctagcaaggct

SEQ ID NO: 4439950 - DNA, 16 bp, Homo sapiens
gactctcagcccagaa

SEQ ID NO: 4439951 - DNA, 12 bp, Homo sapiens
gactctccaggg

SEQ ID NO: 4439952 - DNA, 15 bp, Homo sapiens
gactctcccaggcct

SEQ ID NO: 4439953 - DNA, 22 bp, Homo sapiens
gactctcccaggcctgcctgca

SEQ ID NO: 4439954 - DNA, 12 bp, Homo sapiens
gactctgccccc

SEQ ID NO: 4439955 - DNA, 15 bp, Homo sapiens
gactctgccccctgc

SEQ ID NO: 4439956 - DNA, 17 bp, Homo sapiens
gactctgccccctgctg

SEQ ID NO: 4439957 - DNA, 15 bp, Homo sapiens
gactctgcgggaggc

SEQ ID NO: 4439958 - DNA, 18 bp, Homo sapiens
gactctgcgggaggctgg

SEQ ID NO: 4439959 - DNA, 12 bp, Homo sapiens
gctaccctgagc

SEQ ID NO: 4439960 - DNA, 14 bp, Homo sapiens
gctacccttttcct

SEQ ID NO: 4439961 - DNA, 19 bp, Homo sapiens
gctacccttttcctttgtg

SEQ ID NO: 4439962 - DNA, 14 bp, Homo sapiens
gctacctcagtgct

SEQ ID NO: 4439963 - DNA, 17 bp, Homo sapiens
gctacctcagtgctcct

SEQ ID NO: 4439964 - DNA, 18 bp, Homo sapiens
gctacctcagtgctcctg

SEQ ID NO: 4439965 - DNA, 19 bp, Homo sapiens
gctacctcagtgctcctgg

SEQ ID NO: 4439966 - DNA, 18 bp, Homo sapiens
gctacctgtttgaagggg

SEQ ID NO: 4439967 - DNA, 18 bp, Homo sapiens
gctacgtacatgtgaggc

SEQ ID NO: 4439968 - DNA, 13 bp, Homo sapiens
gctactataatca

SEQ ID NO: 4439969 - DNA, 12 bp, Homo sapiens
gctactcagcag

SEQ ID NO: 4439970 - DNA, 16 bp, Homo sapiens
gctactcagcagccct

SEQ ID NO: 4439971 - DNA, 19 bp, Homo sapiens
gctactcagcagccctcct

SEQ ID NO: 4439972 - DNA, 21 bp, Homo sapiens
gctactcagcagccctcctca

SEQ ID NO: 4439973 - DNA, 14 bp, Homo sapiens
gctactcaggaggc

SEQ ID NO: 4439974 - DNA, 15 bp, Homo sapiens
gctactcaggaggct

SEQ ID NO: 4439975 - DNA, 17 bp, Homo sapiens
gctactcaggaggctga

SEQ ID NO: 4439976 - DNA, 21 bp, Homo sapiens
gctactcaggaggctgagaca

SEQ ID NO: 4439977 - DNA, 23 bp, Homo sapiens
gctactcaggaggctgaggcaga

SEQ ID NO: 4439978 - DNA, 19 bp, Homo sapiens
gctactcgatagcctgagg

SEQ ID NO: 4439979 - DNA, 23 bp, Homo sapiens
gctactctccccacgagggctgg

SEQ ID NO: 4439980 - DNA, 20 bp, Homo sapiens
gctactgcactccagcctgg

SEQ ID NO: 4439981 - DNA, 21 bp, Homo sapiens
gctactgccatcctggcccag

SEQ ID NO: 4439982 - DNA, 21 bp, Homo sapiens
gctactgctgctgctgctgcc

SEQ ID NO: 4439983 - DNA, 16 bp, Homo sapiens
gctactggggaggctg

SEQ ID NO: 4439984 - DNA, 18 bp, Homo sapiens
gctactggggaggctgag

SEQ ID NO: 4439985 - DNA, 15 bp, Homo sapiens
gctactgtgtgtgtg

SEQ ID NO: 4439986 - DNA, 19 bp, Homo sapiens
gctactgtgtgtgtgaatg

SEQ ID NO: 4439987 - DNA, 17 bp, Homo sapiens
gctacttgggaggctga

SEQ ID NO: 4439988 - DNA, 18 bp, Homo sapiens
gctagaaaaatgttcttt

SEQ ID NO: 4439989 - DNA, 18 bp, Homo sapiens
gctagaaccaagaagggc

SEQ ID NO: 4439990 - DNA, 19 bp, Homo sapiens
gctagaaccaagaagggct

SEQ ID NO: 4439991 - DNA, 15 bp, Homo sapiens
gctagaacctggaga

SEQ ID NO: 4439992 - DNA, 19 bp, Homo sapiens
gctagaacctggagagcta

SEQ ID NO: 4439993 - DNA, 20 bp, Homo sapiens
gctagaacctggagagctag

SEQ ID NO: 4439994 - DNA, 15 bp, Homo sapiens
gctagacgcaccgcc

SEQ ID NO: 4439995 - DNA, 15 bp, Homo sapiens
gctagagcagacagg

SEQ ID NO: 4439996 - DNA, 18 bp, Homo sapiens
gctagaggccagccccac

SEQ ID NO: 4439997 - DNA, 16 bp, Homo sapiens
gctagagtcctcactc

SEQ ID NO: 4439998 - DNA, 15 bp, Homo sapiens
gctagccctgccctc

SEQ ID NO: 4439999 - DNA, 15 bp, Homo sapiens
gctagcgctgccgca

SEQ ID NO: 4440000 - DNA, 15 bp, Homo sapiens
gctagcttctgcttt

SEQ ID NO: 4440001 - DNA, 17 bp, Homo sapiens
gctagcttctgcttttc

SEQ ID NO: 4440002 - DNA, 18 bp, Homo sapiens
gctagcttctgcttttct

SEQ ID NO: 4440003 - DNA, 18 bp, Homo sapiens
gctaggacttaaccttga

SEQ ID NO: 4440004 - DNA, 20 bp, Homo sapiens
gctaggtagaaaaagggtca

SEQ ID NO: 4440005 - DNA, 16 bp, Homo sapiens
gctagtagcaatgtgc

SEQ ID NO: 4440006 - DNA, 19 bp, Homo sapiens
gctagtagcaatgtgcctt

SEQ ID NO: 4440007 - DNA, 19 bp, Homo sapiens
gctagtctatcagcatctg

SEQ ID NO: 4440008 - DNA, 11 bp, Homo sapiens
gctagtgcctt

SEQ ID NO: 4440009 - DNA, 18 bp, Homo sapiens
gctagtgtttaaaaggct

SEQ ID NO: 4440010 - DNA, 22 bp, Homo sapiens
gctagttatacttatttgtata

SEQ ID NO: 4440011 - DNA, 15 bp, Homo sapiens
gctataactaagcat

SEQ ID NO: 4440012 - DNA, 22 bp, Homo sapiens
gctatacatgttggaaatgtgt

SEQ ID NO: 4440013 - DNA, 16 bp, Homo sapiens
gctatagctacaggaa

SEQ ID NO: 4440014 - DNA, 13 bp, Homo sapiens
gctataggtgcta

SEQ ID NO: 4440015 - DNA, 18 bp, Homo sapiens
gctataggtgctacaaaa

SEQ ID NO: 4440016 - DNA, 21 bp, Homo sapiens
gctataggtgctacaaaaaca

SEQ ID NO: 4440017 - DNA, 13 bp, Homo sapiens
gctatagtatttg

SEQ ID NO: 4440018 - DNA, 20 bp, Homo sapiens
gctatagtatttgattcaaa

SEQ ID NO: 4440019 - DNA, 19 bp, Homo sapiens
gctatatttgattatgtat

SEQ ID NO: 4440020 - DNA, 19 bp, Homo sapiens
gctatccacagaacctttg

SEQ ID NO: 4440021 - DNA, 23 bp, Homo sapiens
gctatccacagaacctttgtcaa

SEQ ID NO: 4440022 - DNA, 19 bp, Homo sapiens
gctatccccatctccctgc

SEQ ID NO: 4440023 - DNA, 22 bp, Homo sapiens
gctatccccatctccctgcctg

SEQ ID NO: 4440024 - DNA, 13 bp, Homo sapiens
gctatctaatttt

SEQ ID NO: 4440025 - DNA, 18 bp, Homo sapiens
gctatcttcatgtaaatt

SEQ ID NO: 4440026 - DNA, 19 bp, Homo sapiens
gctatcttcatgtaaattg

SEQ ID NO: 4440027 - DNA, 19 bp, Homo sapiens
gctatgaaaatgagccctg

SEQ ID NO: 4440028 - DNA, 20 bp, Homo sapiens
gctatgaggaaactgagtca

SEQ ID NO: 4440029 - DNA, 14 bp, Homo sapiens
gctatggaacataa

SEQ ID NO: 4440030 - DNA, 12 bp, Homo sapiens
gctatggcattt

SEQ ID NO: 4440031 - DNA, 21 bp, Homo sapiens
gctatgggagccccagggtct

SEQ ID NO: 4440032 - DNA, 21 bp, Homo sapiens
gctatggggatagatgtgtgg

SEQ ID NO: 4440033 - DNA, 14 bp, Homo sapiens
gctatgtaagggtc

SEQ ID NO: 4440034 - DNA, 13 bp, Homo sapiens
gctatgtgacttg

SEQ ID NO: 4440035 - DNA, 14 bp, Homo sapiens
gctatgtgtggtac

SEQ ID NO: 4440036 - DNA, 16 bp, Homo sapiens
gctattaaaaaagtct

SEQ ID NO: 4440037 - DNA, 16 bp, Homo sapiens
gctattaaaactcagc

SEQ ID NO: 4440038 - DNA, 18 bp, Homo sapiens
gctattactagtactatt

SEQ ID NO: 4440039 - DNA, 15 bp, Homo sapiens
gctattgacaataaa

SEQ ID NO: 4440040 - DNA, 12 bp, Homo sapiens
gctattgctgct

SEQ ID NO: 4440041 - DNA, 17 bp, Homo sapiens
gctattttagaaagcta

SEQ ID NO: 4440042 - DNA, 18 bp, Homo sapiens
gctattttagaaagctaa

SEQ ID NO: 4440043 - DNA, 23 bp, Homo sapiens
gctattttatattacactacaca

SEQ ID NO: 4440044 - DNA, 16 bp, Homo sapiens
gctattttcctctggc

SEQ ID NO: 4440045 - DNA, 13 bp, Homo sapiens
gctcaaaactttc

SEQ ID NO: 4440046 - DNA, 16 bp, Homo sapiens
gctcaacccccctccc

SEQ ID NO: 4440047 - DNA, 20 bp, Homo sapiens
gctcaacccccctcccagac

SEQ ID NO: 4440048 - DNA, 13 bp, Homo sapiens
gctcaagaatgta

SEQ ID NO: 4440049 - DNA, 21 bp, Homo sapiens
gctcaagcaatcctcctgcct

SEQ ID NO: 4440050 - DNA, 23 bp, Homo sapiens
gctcaagcaatcctcctgcctca

SEQ ID NO: 4440051 - DNA, 24 bp, Homo sapiens
gctcaagcaatcctcctgcctcag

SEQ ID NO: 4440052 - DNA, 13 bp, Homo sapiens
gctcaatttcagc

SEQ ID NO: 4440053 - DNA, 15 bp, Homo sapiens
gctcaatttcagcac

SEQ ID NO: 4440054 - DNA, 17 bp, Homo sapiens
gctcacacatcctgtca

SEQ ID NO: 4440055 - DNA, 19 bp, Homo sapiens
gctcacacatcctgtcagt

SEQ ID NO: 4440056 - DNA, 13 bp, Homo sapiens
gctcacacctgta

SEQ ID NO: 4440057 - DNA, 23 bp, Homo sapiens
gctcacagttcctcgccctgggt

SEQ ID NO: 4440058 - DNA, 13 bp, Homo sapiens
gctcaccagccct

SEQ ID NO: 4440059 - DNA, 17 bp, Homo sapiens
gctcaccagccctgcag

SEQ ID NO: 4440060 - DNA, 14 bp, Homo sapiens
gctcacccacctct

SEQ ID NO: 4440061 - DNA, 15 bp, Homo sapiens
gctcacccagtcctg

SEQ ID NO: 4440062 - DNA, 17 bp, Homo sapiens
gctcaccccccacactc

SEQ ID NO: 4440063 - DNA, 20 bp, Homo sapiens
gctcacccccttctccatcc

SEQ ID NO: 4440064 - DNA, 22 bp, Homo sapiens
gctcacccccttctccatccac

SEQ ID NO: 4440065 - DNA, 20 bp, Homo sapiens
gctcaccctctcttggtgca

SEQ ID NO: 4440066 - DNA, 19 bp, Homo sapiens
gctcaccgctggcccttag

SEQ ID NO: 4440067 - DNA, 21 bp, Homo sapiens
gctcacgcctgtaatcccagc

SEQ ID NO: 4440068 - DNA, 19 bp, Homo sapiens
gctcactgcaacctctgcc

SEQ ID NO: 4440069 - DNA, 19 bp, Homo sapiens
gctcactgccaggccagcc

SEQ ID NO: 4440070 - DNA, 20 bp, Homo sapiens
gctcactgccaggccagcct

SEQ ID NO: 4440071 - DNA, 22 bp, Homo sapiens
gctcactgccaggccagcctcc

SEQ ID NO: 4440072 - DNA, 21 bp, Homo sapiens
gctcactgtgtataggaattt

SEQ ID NO: 4440073 - DNA, 23 bp, Homo sapiens
gctcacttctgggcttcatctgg

SEQ ID NO: 4440074 - DNA, 23 bp, Homo sapiens
gctcagacccccactctcattcc

SEQ ID NO: 4440075 - DNA, 21 bp, Homo sapiens
gctcagacccctcagccccag

SEQ ID NO: 4440076 - DNA, 18 bp, Homo sapiens
gctcagagatgtgcaccc

SEQ ID NO: 4440077 - DNA, 13 bp, Homo sapiens
gctcagagctttg

SEQ ID NO: 4440078 - DNA, 18 bp, Homo sapiens
gctcagagctttgtcact

SEQ ID NO: 4440079 - DNA, 23 bp, Homo sapiens
gctcagagctttgtcacttgcca

SEQ ID NO: 4440080 - DNA, 19 bp, Homo sapiens
gctcagagggtgtcctgca

SEQ ID NO: 4440081 - DNA, 12 bp, Homo sapiens
gctcagcagccc

SEQ ID NO: 4440082 - DNA, 14 bp, Homo sapiens
gctcagcagcccta

SEQ ID NO: 4440083 - DNA, 17 bp, Homo sapiens
gctcagcagccctagcg

SEQ ID NO: 4440084 - DNA, 23 bp, Homo sapiens
gctcagcagccctagcggctgct

SEQ ID NO: 4440085 - DNA, 16 bp, Homo sapiens
gctcagccccaactct

SEQ ID NO: 4440086 - DNA, 17 bp, Homo sapiens
gctcagccccaggccag

SEQ ID NO: 4440087 - DNA, 20 bp, Homo sapiens
gctcagccccaggccagctg

SEQ ID NO: 4440088 - DNA, 22 bp, Homo sapiens
gctcagccccaggccagctgcg

SEQ ID NO: 4440089 - DNA, 12 bp, Homo sapiens
gctcagcccgct

SEQ ID NO: 4440090 - DNA, 16 bp, Homo sapiens
gctcaggaaccgaggc

SEQ ID NO: 4440091 - DNA, 20 bp, Homo sapiens
gctcaggaaccgaggcaggg

SEQ ID NO: 4440092 - DNA, 16 bp, Homo sapiens
gctcaggcgtcgctgg

SEQ ID NO: 4440093 - DNA, 15 bp, Homo sapiens
gctcaggggctccat

SEQ ID NO: 4440094 - DNA, 18 bp, Homo sapiens
gctcaggggctccatgct

SEQ ID NO: 4440095 - DNA, 13 bp, Homo sapiens
gctcaggtgcaag

SEQ ID NO: 4440096 - DNA, 15 bp, Homo sapiens
gctcaggtgcaagtg

SEQ ID NO: 4440097 - DNA, 20 bp, Homo sapiens
gctcagtaacataactgctt

SEQ ID NO: 4440098 - DNA, 22 bp, Homo sapiens
gctcagtaagaagattctcgcc

SEQ ID NO: 4440099 - DNA, 11 bp, Homo sapiens
gctcagtctgt

SEQ ID NO: 4440100 - DNA, 15 bp, Homo sapiens
gctcagtctgttcac

SEQ ID NO: 4440101 - DNA, 16 bp, Homo sapiens
gctcagtctgttcact

SEQ ID NO: 4440102 - DNA, 19 bp, Homo sapiens
gctcagtctgttcactgca

SEQ ID NO: 4440103 - DNA, 17 bp, Homo sapiens
gctcagtgccacctatg

SEQ ID NO: 4440104 - DNA, 19 bp, Homo sapiens
gctcagtgccacctatgcc

SEQ ID NO: 4440105 - DNA, 22 bp, Homo sapiens
gctcagtgccacctatgcctgt

SEQ ID NO: 4440106 - DNA, 17 bp, Homo sapiens
gctcatcacccttccga

SEQ ID NO: 4440107 - DNA, 14 bp, Homo sapiens
gctcattaaacttt

SEQ ID NO: 4440108 - DNA, 17 bp, Homo sapiens
gctcattaaactttttt

SEQ ID NO: 4440109 - DNA, 21 bp, Homo sapiens
gctcattttcctgacatttgt

SEQ ID NO: 4440110 - DNA, 20 bp, Homo sapiens
gctccaactcctttcagcca

SEQ ID NO: 4440111 - DNA, 21 bp, Homo sapiens
gctccaactcctttcagccac

SEQ ID NO: 4440112 - DNA, 22 bp, Homo sapiens
gctccaactcctttcagccaca

SEQ ID NO: 4440113 - DNA, 23 bp, Homo sapiens
gctccaactcctttcagccacat

SEQ ID NO: 4440114 - DNA, 23 bp, Homo sapiens
gctccaatgactgagcagcatcc

SEQ ID NO: 4440115 - DNA, 19 bp, Homo sapiens
gctccacacgccccggtcc

SEQ ID NO: 4440116 - DNA, 13 bp, Homo sapiens
gctccaccagcag

SEQ ID NO: 4440117 - DNA, 14 bp, Homo sapiens
gctccaccagcagc

SEQ ID NO: 4440118 - DNA, 11 bp, Homo sapiens
gctccaccctt

SEQ ID NO: 4440119 - DNA, 13 bp, Homo sapiens
gctccacccttgg

SEQ ID NO: 4440120 - DNA, 15 bp, Homo sapiens
gctccacccttggcc

SEQ ID NO: 4440121 - DNA, 16 bp, Homo sapiens
gctccacccttggcct

SEQ ID NO: 4440122 - DNA, 19 bp, Homo sapiens
gctccacccttggcctgtc

SEQ ID NO: 4440123 - DNA, 17 bp, Homo sapiens
gctccacgggcaggggt

SEQ ID NO: 4440124 - DNA, 21 bp, Homo sapiens
gctccactcttgatctctctt

SEQ ID NO: 4440125 - DNA, 12 bp, Homo sapiens
gctccagagggc

SEQ ID NO: 4440126 - DNA, 20 bp, Homo sapiens
gctccagagggcactctgct

SEQ ID NO: 4440127 - DNA, 21 bp, Homo sapiens
gctccagcaccttctttctgg

SEQ ID NO: 4440128 - DNA, 16 bp, Homo sapiens
gctccagcctctgccg

SEQ ID NO: 4440129 - DNA, 21 bp, Homo sapiens
gctccagcctctgccgctgcc

SEQ ID NO: 4440130 - DNA, 21 bp, Homo sapiens
gctccagctgccccggcccct

SEQ ID NO: 4440131 - DNA, 16 bp, Homo sapiens
gctccaggagcctcat

SEQ ID NO: 4440132 - DNA, 22 bp, Homo sapiens
gctccaggagcctcatccagcc

SEQ ID NO: 4440133 - DNA, 16 bp, Homo sapiens
gctccaggatctttga

SEQ ID NO: 4440134 - DNA, 17 bp, Homo sapiens
gctccagtctcatcctc

SEQ ID NO: 4440135 - DNA, 23 bp, Homo sapiens
gctccagtctcatcctcccattg

SEQ ID NO: 4440136 - DNA, 16 bp, Homo sapiens
gctccataccttttct

SEQ ID NO: 4440137 - DNA, 14 bp, Homo sapiens
gctccatcaatgag

SEQ ID NO: 4440138 - DNA, 19 bp, Homo sapiens
gctccatccccctgcctcc

SEQ ID NO: 4440139 - DNA, 20 bp, Homo sapiens
gctccatctccgcctccaca

SEQ ID NO: 4440140 - DNA, 18 bp, Homo sapiens
gctccatgctgggtctga

SEQ ID NO: 4440141 - DNA, 23 bp, Homo sapiens
gctccatgctgggtctgaggccc

SEQ ID NO: 4440142 - DNA, 17 bp, Homo sapiens
gctccatgtgcctcttt

SEQ ID NO: 4440143 - DNA, 18 bp, Homo sapiens
gctcccaaaacattttaa

SEQ ID NO: 4440144 - DNA, 20 bp, Homo sapiens
gctcccacaccgcgtcccag

SEQ ID NO: 4440145 - DNA, 21 bp, Homo sapiens
gctcccacaccgcgtcccagc

SEQ ID NO: 4440146 - DNA, 23 bp, Homo sapiens
gctcccacaccgcgtcccagctc

SEQ ID NO: 4440147 - DNA, 12 bp, Homo sapiens
gctcccacagct

SEQ ID NO: 4440148 - DNA, 16 bp, Homo sapiens
gctcccacagcttcct

SEQ ID NO: 4440149 - DNA, 18 bp, Homo sapiens
gctcccacagcttcctga

SEQ ID NO: 4440150 - DNA, 20 bp, Homo sapiens
gctcccacagcttcctgagg

SEQ ID NO: 4440151 - DNA, 18 bp, Homo sapiens
gctcccaccccaccccct

SEQ ID NO: 4440152 - DNA, 21 bp, Homo sapiens
gctcccaccccacccccttca

SEQ ID NO: 4440153 - DNA, 14 bp, Homo sapiens
gctcccacctggct

SEQ ID NO: 4440154 - DNA, 12 bp, Homo sapiens
gctcccacctgt

SEQ ID NO: 4440155 - DNA, 14 bp, Homo sapiens
gctcccagccaggc

SEQ ID NO: 4440156 - DNA, 17 bp, Homo sapiens
gctcccagccaggccct

SEQ ID NO: 4440157 - DNA, 18 bp, Homo sapiens
gctcccagccaggccctt

SEQ ID NO: 4440158 - DNA, 21 bp, Homo sapiens
gctcccaggttcccccagcaa

SEQ ID NO: 4440159 - DNA, 15 bp, Homo sapiens
gctcccagtcctgcc

SEQ ID NO: 4440160 - DNA, 19 bp, Homo sapiens
gctcccagtcctgcctgaa

SEQ ID NO: 4440161 - DNA, 15 bp, Homo sapiens
gctcccattcctccc

SEQ ID NO: 4440162 - DNA, 17 bp, Homo sapiens
gctcccattcctccctc

SEQ ID NO: 4440163 - DNA, 21 bp, Homo sapiens
gctccccacagcgtccctggc

SEQ ID NO: 4440164 - DNA, 22 bp, Homo sapiens
gctcccccaccccctccccagg

SEQ ID NO: 4440165 - DNA, 20 bp, Homo sapiens
gctcccccgtggtgcctgca

SEQ ID NO: 4440166 - DNA, 21 bp, Homo sapiens
gctcccccgtggtgcctgcac

SEQ ID NO: 4440167 - DNA, 20 bp, Homo sapiens
gctccccctccccaggctgg

SEQ ID NO: 4440168 - DNA, 21 bp, Homo sapiens
gctccccctccccaggctgga

SEQ ID NO: 4440169 - DNA, 17 bp, Homo sapiens
gctccccgcctccactc

SEQ ID NO: 4440170 - DNA, 15 bp, Homo sapiens
gctcccctcggagaa

SEQ ID NO: 4440171 - DNA, 12 bp, Homo sapiens
gctcccctctgc

SEQ ID NO: 4440172 - DNA, 18 bp, Homo sapiens
gctcccctctgcttctca

SEQ ID NO: 4440173 - DNA, 18 bp, Homo sapiens
gctcccctgcccagcctg

SEQ ID NO: 4440174 - DNA, 22 bp, Homo sapiens
gctccctccccctgccccttct

SEQ ID NO: 4440175 - DNA, 23 bp, Homo sapiens
gctccctcccctgccctggtcca

SEQ ID NO: 4440176 - DNA, 14 bp, Homo sapiens
gctccctcctccag

SEQ ID NO: 4440177 - DNA, 16 bp, Homo sapiens
gctccctcctccaggc

SEQ ID NO: 4440178 - DNA, 19 bp, Homo sapiens
gctccctcctccaggcctg

SEQ ID NO: 4440179 - DNA, 12 bp, Homo sapiens
gctccctctcca

SEQ ID NO: 4440180 - DNA, 13 bp, Homo sapiens
gctccctctccaa

SEQ ID NO: 4440181 - DNA, 18 bp, Homo sapiens
gctccctctccaagacag

SEQ ID NO: 4440182 - DNA, 20 bp, Homo sapiens
gctccctctccaagacagca

SEQ ID NO: 4440183 - DNA, 21 bp, Homo sapiens
gctccctgcaagctccgcctc

SEQ ID NO: 4440184 - DNA, 14 bp, Homo sapiens
gctccctgcctcct

SEQ ID NO: 4440185 - DNA, 18 bp, Homo sapiens
gctccctggcttctgtgg

SEQ ID NO: 4440186 - DNA, 16 bp, Homo sapiens
gctccctgtagctctg

SEQ ID NO: 4440187 - DNA, 23 bp, Homo sapiens
gctccctgtagctctgcctccct

SEQ ID NO: 4440188 - DNA, 16 bp, Homo sapiens
gctccctgtggcactc

SEQ ID NO: 4440189 - DNA, 14 bp, Homo sapiens
gctccctttctcag

SEQ ID NO: 4440190 - DNA, 13 bp, Homo sapiens
gctccctttctct

SEQ ID NO: 4440191 - DNA, 12 bp, Homo sapiens
gctccgcctccc

SEQ ID NO: 4440192 - DNA, 14 bp, Homo sapiens
gctccgtcagcttc

SEQ ID NO: 4440193 - DNA, 15 bp, Homo sapiens
gctcctccctccagc

SEQ ID NO: 4440194 - DNA, 18 bp, Homo sapiens
gctcctccctccagctgc

SEQ ID NO: 4440195 - DNA, 23 bp, Homo sapiens
gacccccccccaatcggactgcc

SEQ ID NO: 4440196 - DNA, 13 bp, Homo sapiens
gaccccgcccctg

SEQ ID NO: 4440197 - DNA, 19 bp, Homo sapiens
gacccctcctgcccctctc

SEQ ID NO: 4440198 - DNA, 16 bp, Homo sapiens
gacccctcgccccagc

SEQ ID NO: 4440199 - DNA, 18 bp, Homo sapiens
gacccctcgccccagcct

SEQ ID NO: 4440200 - DNA, 11 bp, Homo sapiens
gacccctgcct

SEQ ID NO: 4440201 - DNA, 13 bp, Homo sapiens
gacccctggcctc

SEQ ID NO: 4440202 - DNA, 15 bp, Homo sapiens
gacccctggcctccg

SEQ ID NO: 4440203 - DNA, 12 bp, Homo sapiens
gacccctttgag

SEQ ID NO: 4440204 - DNA, 20 bp, Homo sapiens
gacccctttgagagacgcca

SEQ ID NO: 4440205 - DNA, 18 bp, Homo sapiens
gacccgtctccagctgct

SEQ ID NO: 4440206 - DNA, 13 bp, Homo sapiens
gaccctcagcagc

SEQ ID NO: 4440207 - DNA, 14 bp, Homo sapiens
gaccctcagcagct

SEQ ID NO: 4440208 - DNA, 18 bp, Homo sapiens
gaccctcagcagctctgg

SEQ ID NO: 4440209 - DNA, 15 bp, Homo sapiens
gaccctccagtgctg

SEQ ID NO: 4440210 - DNA, 15 bp, Homo sapiens
gaccctcctgttgca

SEQ ID NO: 4440211 - DNA, 14 bp, Homo sapiens
gaccctcttgccca

SEQ ID NO: 4440212 - DNA, 17 bp, Homo sapiens
gaccctgacctccgccc

SEQ ID NO: 4440213 - DNA, 20 bp, Homo sapiens
gaccctgacctccgcccctg

SEQ ID NO: 4440214 - DNA, 14 bp, Homo sapiens
gaccctgaggccct

SEQ ID NO: 4440215 - DNA, 23 bp, Homo sapiens
gaccctgaggccctgggctgggt

SEQ ID NO: 4440216 - DNA, 15 bp, Homo sapiens
gaccctgcaagacca

SEQ ID NO: 4440217 - DNA, 12 bp, Homo sapiens
gaccctgccaca

SEQ ID NO: 4440218 - DNA, 17 bp, Homo sapiens
gaccctgccacagccag

SEQ ID NO: 4440219 - DNA, 20 bp, Homo sapiens
gaccctgccacagccagagg

SEQ ID NO: 4440220 - DNA, 22 bp, Homo sapiens
gaccctgccacagccagaggag

SEQ ID NO: 4440221 - DNA, 23 bp, Homo sapiens
gaccctgccacagccagaggagg

SEQ ID NO: 4440222 - DNA, 17 bp, Homo sapiens
gaccctgggagagaagt

SEQ ID NO: 4440223 - DNA, 12 bp, Homo sapiens
gaccctggggcg

SEQ ID NO: 4440224 - DNA, 17 bp, Homo sapiens
gaccctgtccggcccag

SEQ ID NO: 4440225 - DNA, 23 bp, Homo sapiens
gaccctgtccggcccagtgccac

SEQ ID NO: 4440226 - DNA, 15 bp, Homo sapiens
gaccctgtgcaggag

SEQ ID NO: 4440227 - DNA, 20 bp, Homo sapiens
gacccttctgggtccaggga

SEQ ID NO: 4440228 - DNA, 16 bp, Homo sapiens
gaccgaggctacagct

SEQ ID NO: 4440229 - DNA, 18 bp, Homo sapiens
gaccgtgggcggggcctt

SEQ ID NO: 4440230 - DNA, 20 bp, Homo sapiens
gaccgtgggcggggccttgc

SEQ ID NO: 4440231 - DNA, 17 bp, Homo sapiens
gacctcagcaagctgcc

SEQ ID NO: 4440232 - DNA, 20 bp, Homo sapiens
gacctcagcaagctgcccag

SEQ ID NO: 4440233 - DNA, 15 bp, Homo sapiens
gacctcagcagggca

SEQ ID NO: 4440234 - DNA, 18 bp, Homo sapiens
gacctcatgatctgccca

SEQ ID NO: 4440235 - DNA, 19 bp, Homo sapiens
gacctccaataaagtgcct

SEQ ID NO: 4440236 - DNA, 22 bp, Homo sapiens
gacctccaataaagtgccttct

SEQ ID NO: 4440237 - DNA, 15 bp, Homo sapiens
gacctccgcccctgc

SEQ ID NO: 4440238 - DNA, 14 bp, Homo sapiens
gacctcctctgggc

SEQ ID NO: 4440239 - DNA, 12 bp, Homo sapiens
gacctcctgcag

SEQ ID NO: 4440240 - DNA, 21 bp, Homo sapiens
gacctcctgcagggagccttc

SEQ ID NO: 4440241 - DNA, 22 bp, Homo sapiens
gacctcgactggtttttctaag

SEQ ID NO: 4440242 - DNA, 17 bp, Homo sapiens
gacctcggacagagccc

SEQ ID NO: 4440243 - DNA, 18 bp, Homo sapiens
gacctcggatgaccatac

SEQ ID NO: 4440244 - DNA, 21 bp, Homo sapiens
gacctcggtgaccactcttct

SEQ ID NO: 4440245 - DNA, 13 bp, Homo sapiens
gacctcgtcctcc

SEQ ID NO: 4440246 - DNA, 17 bp, Homo sapiens
gacctcgtcctccccct

SEQ ID NO: 4440247 - DNA, 21 bp, Homo sapiens
gacctcgtcctccccctgcca

SEQ ID NO: 4440248 - DNA, 20 bp, Homo sapiens
gacctctacttgctgaagga

SEQ ID NO: 4440249 - DNA, 16 bp, Homo sapiens
gacctctccacacagg

SEQ ID NO: 4440250 - DNA, 11 bp, Homo sapiens
gacctcttgcc

SEQ ID NO: 4440251 - DNA, 15 bp, Homo sapiens
gacctgaccagtcag

SEQ ID NO: 4440252 - DNA, 19 bp, Homo sapiens
gacctgagcgggagtcagg

SEQ ID NO: 4440253 - DNA, 21 bp, Homo sapiens
gacctgagcgggagtcaggga

SEQ ID NO: 4440254 - DNA, 21 bp, Homo sapiens
gacctgccagccactgtcacc

SEQ ID NO: 4440255 - DNA, 20 bp, Homo sapiens
gacctgccaggcaggggtgg

SEQ ID NO: 4440256 - DNA, 21 bp, Homo sapiens
gacctgccaggcaggggtggg

SEQ ID NO: 4440257 - DNA, 13 bp, Homo sapiens
gacctgctgctca

SEQ ID NO: 4440258 - DNA, 14 bp, Homo sapiens
gacctgctgctcag

SEQ ID NO: 4440259 - DNA, 15 bp, Homo sapiens
gacctgctgctcagt

SEQ ID NO: 4440260 - DNA, 14 bp, Homo sapiens
gacctggcgtgctc

SEQ ID NO: 4440261 - DNA, 17 bp, Homo sapiens
gacctggcgtgctcaga

SEQ ID NO: 4440262 - DNA, 17 bp, Homo sapiens
gacctgggaacgactgg

SEQ ID NO: 4440263 - DNA, 18 bp, Homo sapiens
gacctgggaacgactgga

SEQ ID NO: 4440264 - DNA, 17 bp, Homo sapiens
gacctggtgctgcctct

SEQ ID NO: 4440265 - DNA, 14 bp, Homo sapiens
gacctggttcccac

SEQ ID NO: 4440266 - DNA, 19 bp, Homo sapiens
gacctgtatttaagcaaat

SEQ ID NO: 4440267 - DNA, 16 bp, Homo sapiens
gacctgtcagaataaa

SEQ ID NO: 4440268 - DNA, 19 bp, Homo sapiens
gacctgtcctcctggtggg

SEQ ID NO: 4440269 - DNA, 12 bp, Homo sapiens
gaccttagcgtt

SEQ ID NO: 4440270 - DNA, 18 bp, Homo sapiens
gaccttcatgcccttctg

SEQ ID NO: 4440271 - DNA, 15 bp, Homo sapiens
gaccttgaatctttt

SEQ ID NO: 4440272 - DNA, 16 bp, Homo sapiens
gaccttggcctctcct

SEQ ID NO: 4440273 - DNA, 13 bp, Homo sapiens
gacctttgacctc

SEQ ID NO: 4440274 - DNA, 14 bp, Homo sapiens
gaccttttgctgcc

SEQ ID NO: 4440275 - DNA, 13 bp, Homo sapiens
gaagatggctgtt

SEQ ID NO: 4440276 - DNA, 13 bp, Homo sapiens
gaagatgggaggt

SEQ ID NO: 4440277 - DNA, 16 bp, Homo sapiens
gaagatgggaggtgga

SEQ ID NO: 4440278 - DNA, 14 bp, Homo sapiens
gaagatgtgtaaac

SEQ ID NO: 4440279 - DNA, 17 bp, Homo sapiens
gaagattctatgttaat

SEQ ID NO: 4440280 - DNA, 19 bp, Homo sapiens
gaagattctcgccccttcc

SEQ ID NO: 4440281 - DNA, 18 bp, Homo sapiens
gaagattctctattggct

SEQ ID NO: 4440282 - DNA, 21 bp, Homo sapiens
gaagatttgcccatttacact

SEQ ID NO: 4440283 - DNA, 22 bp, Homo sapiens
gaagcaaagtgcccatggtggc

SEQ ID NO: 4440284 - DNA, 17 bp, Homo sapiens
gaagcaaatcgaatgaa

SEQ ID NO: 4440285 - DNA, 23 bp, Homo sapiens
gaagcaacccaaatgttcatcaa

SEQ ID NO: 4440286 - DNA, 22 bp, Homo sapiens
gaagcaagaggcaagctgaaat

SEQ ID NO: 4440287 - DNA, 14 bp, Homo sapiens
gaagcacacctaca

SEQ ID NO: 4440288 - DNA, 17 bp, Homo sapiens
gaagcacagaatatttt

SEQ ID NO: 4440289 - DNA, 18 bp, Homo sapiens
gaagcacttctgctgcat

SEQ ID NO: 4440290 - DNA, 23 bp, Homo sapiens
gaagcagaccattggggctccca

SEQ ID NO: 4440291 - DNA, 13 bp, Homo sapiens
gaagcagaggccc

SEQ ID NO: 4440292 - DNA, 16 bp, Homo sapiens
gaagcagaggccctgc

SEQ ID NO: 4440293 - DNA, 17 bp, Homo sapiens
gaagcagaggccctgcc

SEQ ID NO: 4440294 - DNA, 15 bp, Homo sapiens
gaagcaggacccagt

SEQ ID NO: 4440295 - DNA, 13 bp, Homo sapiens
gaagcagtatttt

SEQ ID NO: 4440296 - DNA, 17 bp, Homo sapiens
gaagcagtgtgtacttc

SEQ ID NO: 4440297 - DNA, 20 bp, Homo sapiens
gaagcatagctacaatttgt

SEQ ID NO: 4440298 - DNA, 10 bp, Homo sapiens
gaagcatgta

SEQ ID NO: 4440299 - DNA, 17 bp, Homo sapiens
gaagcattgtaaaataa

SEQ ID NO: 4440300 - DNA, 10 bp, Homo sapiens
gaagccaaag

SEQ ID NO: 4440301 - DNA, 12 bp, Homo sapiens
gaagccaaagaa

SEQ ID NO: 4440302 - DNA, 16 bp, Homo sapiens
gaagccaaagaaaaat

SEQ ID NO: 4440303 - DNA, 14 bp, Homo sapiens
gaagccaagggaaa

SEQ ID NO: 4440304 - DNA, 16 bp, Homo sapiens
gaagccaagggaaagg

SEQ ID NO: 4440305 - DNA, 17 bp, Homo sapiens
gaagccaagggaaaggg

SEQ ID NO: 4440306 - DNA, 13 bp, Homo sapiens
gaagccacagaaa

SEQ ID NO: 4440307 - DNA, 16 bp, Homo sapiens
gaagccacaggcctga

SEQ ID NO: 4440308 - DNA, 17 bp, Homo sapiens
gaagccacaggcctgag

SEQ ID NO: 4440309 - DNA, 15 bp, Homo sapiens
gaagccacgctgtcc

SEQ ID NO: 4440310 - DNA, 22 bp, Homo sapiens
gaagccagctttccctgcctct

SEQ ID NO: 4440311 - DNA, 12 bp, Homo sapiens
gaagccagttgc

SEQ ID NO: 4440312 - DNA, 18 bp, Homo sapiens
gaagcccagcccaagcac

SEQ ID NO: 4440313 - DNA, 19 bp, Homo sapiens
gaagcccatcctgaccagc

SEQ ID NO: 4440314 - DNA, 14 bp, Homo sapiens
gaagccccttcccc

SEQ ID NO: 4440315 - DNA, 19 bp, Homo sapiens
gaagccccttccccatggg

SEQ ID NO: 4440316 - DNA, 23 bp, Homo sapiens
gaagccctcaaagaagtcggaat

SEQ ID NO: 4440317 - DNA, 20 bp, Homo sapiens
gaagccgccagtacttgtca

SEQ ID NO: 4440318 - DNA, 17 bp, Homo sapiens
gaagcctccaagcacag

SEQ ID NO: 4440319 - DNA, 22 bp, Homo sapiens
gaagcctctctccttggccaca

SEQ ID NO: 4440320 - DNA, 13 bp, Homo sapiens
gaagcctctggct

SEQ ID NO: 4440321 - DNA, 20 bp, Homo sapiens
gaagcctgtggatgatcaat

SEQ ID NO: 4440322 - DNA, 16 bp, Homo sapiens
gaagccttggaaccag

SEQ ID NO: 4440323 - DNA, 15 bp, Homo sapiens
gaagcgctcatctgg

SEQ ID NO: 4440324 - DNA, 20 bp, Homo sapiens
gaagcggccctaagggagtg

SEQ ID NO: 4440325 - DNA, 20 bp, Homo sapiens
gaagcgttgtcctcagcccc

SEQ ID NO: 4440326 - DNA, 15 bp, Homo sapiens
gaagctaatttgcat

SEQ ID NO: 4440327 - DNA, 21 bp, Homo sapiens
gaagctagacacatgaaggta

SEQ ID NO: 4440328 - DNA, 20 bp, Homo sapiens
gaagctcgcatccagacagt

SEQ ID NO: 4440329 - DNA, 16 bp, Homo sapiens
gaagctgaagagcacg

SEQ ID NO: 4440330 - DNA, 19 bp, Homo sapiens
gaagctgaagagcacggtc

SEQ ID NO: 4440331 - DNA, 19 bp, Homo sapiens
gaagctgaagatccccaac

SEQ ID NO: 4440332 - DNA, 20 bp, Homo sapiens
gacaatggaccctttttgtt

SEQ ID NO: 4440333 - DNA, 19 bp, Homo sapiens
gacaattaacatacatcat

SEQ ID NO: 4440334 - DNA, 19 bp, Homo sapiens
gacaattcctccagagaca

SEQ ID NO: 4440335 - DNA, 22 bp, Homo sapiens
gacaattcctccagagacactg

SEQ ID NO: 4440336 - DNA, 17 bp, Homo sapiens
gacaattttttttcaaa

SEQ ID NO: 4440337 - DNA, 17 bp, Homo sapiens
gacacaacccaatagga

SEQ ID NO: 4440338 - DNA, 22 bp, Homo sapiens
gacacaataggtctttctctca

SEQ ID NO: 4440339 - DNA, 17 bp, Homo sapiens
gacacacacagactatt

SEQ ID NO: 4440340 - DNA, 18 bp, Homo sapiens
gacacacattctgccttg

SEQ ID NO: 4440341 - DNA, 22 bp, Homo sapiens
gacacactatcatagttaacat

SEQ ID NO: 4440342 - DNA, 19 bp, Homo sapiens
gacacagaaaatgttgaga

SEQ ID NO: 4440343 - DNA, 19 bp, Homo sapiens
gacacagaatagtttacac

SEQ ID NO: 4440344 - DNA, 13 bp, Homo sapiens
gacacagaattat

SEQ ID NO: 4440345 - DNA, 18 bp, Homo sapiens
gacacagtgatgaatgta

SEQ ID NO: 4440346 - DNA, 13 bp, Homo sapiens
gacacagttcctg

SEQ ID NO: 4440347 - DNA, 16 bp, Homo sapiens
gacacagttttgtctt

SEQ ID NO: 4440348 - DNA, 15 bp, Homo sapiens
gacacatatacatat

SEQ ID NO: 4440349 - DNA, 17 bp, Homo sapiens
gacacatatacatatga

SEQ ID NO: 4440350 - DNA, 19 bp, Homo sapiens
gacacatgaaggtaaataa

SEQ ID NO: 4440351 - DNA, 20 bp, Homo sapiens
gacacatgaaggtaaataaa

SEQ ID NO: 4440352 - DNA, 21 bp, Homo sapiens
gacacatgaaggtaaataaaa

SEQ ID NO: 4440353 - DNA, 13 bp, Homo sapiens
gacacattgcctt

SEQ ID NO: 4440354 - DNA, 19 bp, Homo sapiens
gacacattggaatgccttg

SEQ ID NO: 4440355 - DNA, 19 bp, Homo sapiens
gacaccacttagatttaaa

SEQ ID NO: 4440356 - DNA, 17 bp, Homo sapiens
gacaccagccaggctct

SEQ ID NO: 4440357 - DNA, 12 bp, Homo sapiens
gacacccaggcc

SEQ ID NO: 4440358 - DNA, 19 bp, Homo sapiens
gacacccatgccagagagg

SEQ ID NO: 4440359 - DNA, 12 bp, Homo sapiens
gacaccctggcc

SEQ ID NO: 4440360 - DNA, 15 bp, Homo sapiens
gacacctaggctagg

SEQ ID NO: 4440361 - DNA, 23 bp, Homo sapiens
gacacctccccctttcacactgg

SEQ ID NO: 4440362 - DNA, 17 bp, Homo sapiens
gacacctgcacctcccc

SEQ ID NO: 4440363 - DNA, 20 bp, Homo sapiens
gacacgagccacaagctgca

SEQ ID NO: 4440364 - DNA, 23 bp, Homo sapiens
gacacgctccctccccctgcccc

SEQ ID NO: 4440365 - DNA, 13 bp, Homo sapiens
gacacgcttctga

SEQ ID NO: 4440366 - DNA, 15 bp, Homo sapiens
gacacgttctgattt

SEQ ID NO: 4440367 - DNA, 15 bp, Homo sapiens
gacactaccctgaga

SEQ ID NO: 4440368 - DNA, 18 bp, Homo sapiens
gacactagcccaatgaaa

SEQ ID NO: 4440369 - DNA, 22 bp, Homo sapiens
gacactcctagagaacgcagcc

SEQ ID NO: 4440370 - DNA, 19 bp, Homo sapiens
gacactcctataaggagag

SEQ ID NO: 4440371 - DNA, 21 bp, Homo sapiens
gacactctataagattccaaa

SEQ ID NO: 4440372 - DNA, 19 bp, Homo sapiens
gacactgaaagttttgtaa

SEQ ID NO: 4440373 - DNA, 20 bp, Homo sapiens
gacactgaaagttttgtaaa

SEQ ID NO: 4440374 - DNA, 13 bp, Homo sapiens
gacactgagccag

SEQ ID NO: 4440375 - DNA, 15 bp, Homo sapiens
gacactgagccagtc

SEQ ID NO: 4440376 - DNA, 16 bp, Homo sapiens
gacacttaaaaatggt

SEQ ID NO: 4440377 - DNA, 21 bp, Homo sapiens
gacacttttcatatcatttct

SEQ ID NO: 4440378 - DNA, 17 bp, Homo sapiens
gacagaagctatttcat

SEQ ID NO: 4440379 - DNA, 15 bp, Homo sapiens
gacagaccacttgcc

SEQ ID NO: 4440380 - DNA, 20 bp, Homo sapiens
gacagacccacccccagcct

SEQ ID NO: 4440381 - DNA, 18 bp, Homo sapiens
gacagacgagacaacagc

SEQ ID NO: 4440382 - DNA, 19 bp, Homo sapiens
gacagacggaaatgaaatt

SEQ ID NO: 4440383 - DNA, 19 bp, Homo sapiens
gacagagactcagatgagg

SEQ ID NO: 4440384 - DNA, 19 bp, Homo sapiens
gacagagcaggggctccag

SEQ ID NO: 4440385 - DNA, 21 bp, Homo sapiens
gacagagcaggggctccagca

SEQ ID NO: 4440386 - DNA, 22 bp, Homo sapiens
gacagaggaaagggctggctcc

SEQ ID NO: 4440387 - DNA, 12 bp, Homo sapiens
gacagaggaggg

SEQ ID NO: 4440388 - DNA, 12 bp, Homo sapiens
gacagaggcctg

SEQ ID NO: 4440389 - DNA, 22 bp, Homo sapiens
gacagaggctgcacccctgggc

SEQ ID NO: 4440390 - DNA, 18 bp, Homo sapiens
gacagagggaagccagtc

SEQ ID NO: 4440391 - DNA, 19 bp, Homo sapiens
gacagagggcacatgaaca

SEQ ID NO: 4440392 - DNA, 12 bp, Homo sapiens
gacagagtgaga

SEQ ID NO: 4440393 - DNA, 14 bp, Homo sapiens
gacagatgagcagg

SEQ ID NO: 4440394 - DNA, 19 bp, Homo sapiens
gacagatgagcaggagctt

SEQ ID NO: 4440395 - DNA, 14 bp, Homo sapiens
gacagatgccccag

SEQ ID NO: 4440396 - DNA, 18 bp, Homo sapiens
gacagatgccccagagct

SEQ ID NO: 4440397 - DNA, 23 bp, Homo sapiens
gacagatgctggtggaggaaggg

SEQ ID NO: 4440398 - DNA, 18 bp, Homo sapiens
gacagcaaagcagcagtg

SEQ ID NO: 4440399 - DNA, 20 bp, Homo sapiens
gacagcaacaaaatcatggc

SEQ ID NO: 4440400 - DNA, 22 bp, Homo sapiens
gacagcaacaaaatcatggctt

SEQ ID NO: 4440401 - DNA, 16 bp, Homo sapiens
gacagcagaagcctcc

SEQ ID NO: 4440402 - DNA, 21 bp, Homo sapiens
gacagcagcagcctgcacctg

SEQ ID NO: 4440403 - DNA, 23 bp, Homo sapiens
gacagcatcccttcccacatgcc

SEQ ID NO: 4440404 - DNA, 22 bp, Homo sapiens
gacagcccaggatactggcaca

SEQ ID NO: 4440405 - DNA, 23 bp, Homo sapiens
gacagcccaggatactggcacag

SEQ ID NO: 4440406 - DNA, 15 bp, Homo sapiens
gacagctgtccctgt

SEQ ID NO: 4440407 - DNA, 13 bp, Homo sapiens
gacagcttctctg

SEQ ID NO: 4440408 - DNA, 15 bp, Homo sapiens
gacagcttctctgca

SEQ ID NO: 4440409 - DNA, 18 bp, Homo sapiens
gacagcttctctgcagta

SEQ ID NO: 4440410 - DNA, 22 bp, Homo sapiens
gacagcttgagccgggcccctg

SEQ ID NO: 4440411 - DNA, 19 bp, Homo sapiens
gacaggaaagccctccccc

SEQ ID NO: 4440412 - DNA, 15 bp, Homo sapiens
gacaggacagaatgt

SEQ ID NO: 4440413 - DNA, 16 bp, Homo sapiens
gacaggacagaatgtg

SEQ ID NO: 4440414 - DNA, 11 bp, Homo sapiens
gacaggagaaa

SEQ ID NO: 4440415 - DNA, 12 bp, Homo sapiens
gacaggagaaat

SEQ ID NO: 4440416 - DNA, 11 bp, Homo sapiens
gacaggagcct

SEQ ID NO: 4440417 - DNA, 19 bp, Homo sapiens
gacaggagcctagcggagc

SEQ ID NO: 4440418 - DNA, 13 bp, Homo sapiens
gacaggagcctgg

SEQ ID NO: 4440419 - DNA, 21 bp, Homo sapiens
gacaggatgaggacagagggc

SEQ ID NO: 4440420 - DNA, 16 bp, Homo sapiens
gacaggatttggccac

SEQ ID NO: 4440421 - DNA, 17 bp, Homo sapiens
gacaggcagcccagcag

SEQ ID NO: 4440422 - DNA, 12 bp, Homo sapiens
gacaggcaggcc

SEQ ID NO: 4440423 - DNA, 14 bp, Homo sapiens
gacaggcaggccag

SEQ ID NO: 4440424 - DNA, 12 bp, Homo sapiens
gacaggcgggct

SEQ ID NO: 4440425 - DNA, 23 bp, Homo sapiens
gacaggctctcctggctgtccta

SEQ ID NO: 4440426 - DNA, 13 bp, Homo sapiens
gacaggctgggtc

SEQ ID NO: 4440427 - DNA, 23 bp, Homo sapiens
gacaggctgggtcctgccagctg

SEQ ID NO: 4440428 - DNA, 21 bp, Homo sapiens
gacagggacatgccctgtgtg

SEQ ID NO: 4440429 - DNA, 12 bp, Homo sapiens
gacagggctggc

SEQ ID NO: 4440430 - DNA, 21 bp, Homo sapiens
gacagggtcttgctctgtccc

SEQ ID NO: 4440431 - DNA, 19 bp, Homo sapiens
gacagggtgggagggagga

SEQ ID NO: 4440432 - DNA, 15 bp, Homo sapiens
gacagggtgggcttc

SEQ ID NO: 4440433 - DNA, 17 bp, Homo sapiens
gacagggtgggcttcct

SEQ ID NO: 4440434 - DNA, 16 bp, Homo sapiens
gacaggtgacagtggc

SEQ ID NO: 4440435 - DNA, 16 bp, Homo sapiens
gacaggttagctgctc

SEQ ID NO: 4440436 - DNA, 21 bp, Homo sapiens
gacagtcataaatactgtcaa

SEQ ID NO: 4440437 - DNA, 14 bp, Homo sapiens
gacagtccacaggg

SEQ ID NO: 4440438 - DNA, 19 bp, Homo sapiens
gacagtccacaggggccac

SEQ ID NO: 4440439 - DNA, 12 bp, Homo sapiens
gacagtccctgc

SEQ ID NO: 4440440 - DNA, 22 bp, Homo sapiens
gacagtcgctcagtctgttcac

SEQ ID NO: 4440441 - DNA, 19 bp, Homo sapiens
gacagtgaagcagcactgt

SEQ ID NO: 4440442 - DNA, 19 bp, Homo sapiens
gacagtgatattggaactt

SEQ ID NO: 4440443 - DNA, 13 bp, Homo sapiens
gacagtgccttct

SEQ ID NO: 4440444 - DNA, 15 bp, Homo sapiens
gacagtgccttctct

SEQ ID NO: 4440445 - DNA, 16 bp, Homo sapiens
gacagtggctgctctg

SEQ ID NO: 4440446 - DNA, 20 bp, Homo sapiens
gacagtgttccccgatacca

SEQ ID NO: 4440447 - DNA, 21 bp, Homo sapiens
gacagtttatcatgaagcctg

SEQ ID NO: 4440448 - DNA, 19 bp, Homo sapiens
gacataagcaatcatttta

SEQ ID NO: 4440449 - DNA, 19 bp, Homo sapiens
gacatacctaccagtatta

SEQ ID NO: 4440450 - DNA, 20 bp, Homo sapiens
gacatatcactgctgctggg

SEQ ID NO: 4440451 - DNA, 14 bp, Homo sapiens
gacatatttaactg

SEQ ID NO: 4440452 - DNA, 12 bp, Homo sapiens
gacatatttaat

SEQ ID NO: 4440453 - DNA, 16 bp, Homo sapiens
gacatatttaatgttt

SEQ ID NO: 4440454 - DNA, 13 bp, Homo sapiens
gacatccagcaga

SEQ ID NO: 4440455 - DNA, 17 bp, Homo sapiens
gacatcccagaccagcc

SEQ ID NO: 4440456 - DNA, 23 bp, Homo sapiens
gacatccgtcccacatcagggcg

SEQ ID NO: 4440457 - DNA, 19 bp, Homo sapiens
gacatctgcacccctgagt

SEQ ID NO: 4440458 - DNA, 16 bp, Homo sapiens
gacatgaagctgttgt

SEQ ID NO: 4440459 - DNA, 17 bp, Homo sapiens
gacatgatttccttgaa

SEQ ID NO: 4440460 - DNA, 20 bp, Homo sapiens
gacatgatttccttgaatgt

SEQ ID NO: 4440461 - DNA, 22 bp, Homo sapiens
gacatgatttccttgaatgtgg

SEQ ID NO: 4440462 - DNA, 14 bp, Homo sapiens
gacatgccctgtgt

SEQ ID NO: 4440463 - DNA, 14 bp, Homo sapiens
gacatgctttccat

SEQ ID NO: 4440464 - DNA, 13 bp, Homo sapiens
gacatggaaaggg

SEQ ID NO: 4440465 - DNA, 17 bp, Homo sapiens
gacatggacaaggagct

SEQ ID NO: 4440466 - DNA, 23 bp, Homo sapiens
gacatggggaggttgtggggcct

SEQ ID NO: 4440467 - DNA, 20 bp, Homo sapiens
gacatgggtgaacttacttg

SEQ ID NO: 4440468 - DNA, 16 bp, Homo sapiens
gacatggtgcctgaga

SEQ ID NO: 4440469 - DNA, 15 bp, Homo sapiens
gacatggtgccttag

SEQ ID NO: 4440470 - DNA, 14 bp, Homo sapiens
gacatgtaagaaaa

SEQ ID NO: 4440471 - DNA, 18 bp, Homo sapiens
gacatgtaagaaaatgtt

SEQ ID NO: 4440472 - DNA, 14 bp, Homo sapiens
gacattagaaaaaa

SEQ ID NO: 4440473 - DNA, 23 bp, Homo sapiens
gacattcaaaaaactctctccca

SEQ ID NO: 4440474 - DNA, 12 bp, Homo sapiens
gacattcactgg

SEQ ID NO: 4440475 - DNA, 14 bp, Homo sapiens
gacattcctttgaa

SEQ ID NO: 4440476 - DNA, 22 bp, Homo sapiens
gacattggagaaggagatttta

SEQ ID NO: 4440477 - DNA, 21 bp, Homo sapiens
gacattgtctcctatatattt

SEQ ID NO: 4440478 - DNA, 14 bp, Homo sapiens
gacatttagaagaa

SEQ ID NO: 4440479 - DNA, 15 bp, Homo sapiens
gacatttagaagaaa

SEQ ID NO: 4440480 - DNA, 14 bp, Homo sapiens
gacatttcactaaa

SEQ ID NO: 4440481 - DNA, 13 bp, Homo sapiens
gacatttctctaa

SEQ ID NO: 4440482 - DNA, 16 bp, Homo sapiens
gacatttctctaagag

SEQ ID NO: 4440483 - DNA, 17 bp, Homo sapiens
gacatttgctgaactca

SEQ ID NO: 4440484 - DNA, 21 bp, Homo sapiens
gacattttacattaaattttt

SEQ ID NO: 4440485 - DNA, 16 bp, Homo sapiens
gacattttatgtcttt

SEQ ID NO: 4440486 - DNA, 20 bp, Homo sapiens
gacattttatgtctttcttg

SEQ ID NO: 4440487 - DNA, 21 bp, Homo sapiens
gacattttgtttttactgtat

SEQ ID NO: 4440488 - DNA, 12 bp, Homo sapiens
gacatttttcat

SEQ ID NO: 4440489 - DNA, 18 bp, Homo sapiens
gacatttttcattcatga

SEQ ID NO: 4440490 - DNA, 20 bp, Homo sapiens
gacatttttcattcatgaat

SEQ ID NO: 4440491 - DNA, 22 bp, Homo sapiens
gacatttttcattcatgaatat

SEQ ID NO: 4440492 - DNA, 19 bp, Homo sapiens
gaccaaatgtagttttgta

SEQ ID NO: 4440493 - DNA, 15 bp, Homo sapiens
gaccaaattgcttct

SEQ ID NO: 4440494 - DNA, 17 bp, Homo sapiens
gaccaaattgcttctag

SEQ ID NO: 4440495 - DNA, 16 bp, Homo sapiens
gaccaacatggagaaa

SEQ ID NO: 4440496 - DNA, 22 bp, Homo sapiens
gaccaacatggagaaaccctgt

SEQ ID NO: 4440497 - DNA, 14 bp, Homo sapiens
gaccaacctgacca

SEQ ID NO: 4440498 - DNA, 13 bp, Homo sapiens
gaccaacctgctc

SEQ ID NO: 4440499 - DNA, 14 bp, Homo sapiens
gaccaacctgctct

SEQ ID NO: 4440500 - DNA, 19 bp, Homo sapiens
gaccaactgggcccaagac

SEQ ID NO: 4440501 - DNA, 17 bp, Homo sapiens
gaccaagtgctggccca

SEQ ID NO: 4440502 - DNA, 15 bp, Homo sapiens
gaccaattctggaca

SEQ ID NO: 4440503 - DNA, 21 bp, Homo sapiens
gaccaattctggacagacaga

SEQ ID NO: 4440504 - DNA, 18 bp, Homo sapiens
gaccacacattttatgag

SEQ ID NO: 4440505 - DNA, 23 bp, Homo sapiens
gaccacagcaagccatcatcctc

SEQ ID NO: 4440506 - DNA, 20 bp, Homo sapiens
gaccacataagaaggcaatt

SEQ ID NO: 4440507 - DNA, 22 bp, Homo sapiens
gaccacccaacctcaccctcct

SEQ ID NO: 4440508 - DNA, 14 bp, Homo sapiens
gaccacccctgcct

SEQ ID NO: 4440509 - DNA, 17 bp, Homo sapiens
gaccacccctgcctcca

SEQ ID NO: 4440510 - DNA, 20 bp, Homo sapiens
gaccacccctgcctccaccc

SEQ ID NO: 4440511 - DNA, 22 bp, Homo sapiens
gaccactcttctttaagccata

SEQ ID NO: 4440512 - DNA, 21 bp, Homo sapiens
gaccactgcagaagacagtat

SEQ ID NO: 4440513 - DNA, 15 bp, Homo sapiens
gaccacttccagggg

SEQ ID NO: 4440514 - DNA, 17 bp, Homo sapiens
gaccagaagccttggaa

SEQ ID NO: 4440515 - DNA, 14 bp, Homo sapiens
gaccagagctgtct

SEQ ID NO: 4440516 - DNA, 16 bp, Homo sapiens
gaccagagctgtctga

SEQ ID NO: 4440517 - DNA, 14 bp, Homo sapiens
gaccagcctgtcca

SEQ ID NO: 4440518 - DNA, 15 bp, Homo sapiens
gaccagcctgtccaa

SEQ ID NO: 4440519 - DNA, 19 bp, Homo sapiens
gaccagcctgtccaacatg

SEQ ID NO: 4440520 - DNA, 16 bp, Homo sapiens
gaccaggacaggacca

SEQ ID NO: 4440521 - DNA, 16 bp, Homo sapiens
gaccaggactccctcc

SEQ ID NO: 4440522 - DNA, 23 bp, Homo sapiens
gaccaggactccctcctcacctc

SEQ ID NO: 4440523 - DNA, 13 bp, Homo sapiens
gaccagggatgct

SEQ ID NO: 4440524 - DNA, 18 bp, Homo sapiens
gaccagggatgctgggct

SEQ ID NO: 4440525 - DNA, 22 bp, Homo sapiens
gaccagggatgggggatgggcc

SEQ ID NO: 4440526 - DNA, 22 bp, Homo sapiens
gaaggtgccccaaaatgcaaga

SEQ ID NO: 4440527 - DNA, 18 bp, Homo sapiens
gaaggtggaagttgcagt

SEQ ID NO: 4440528 - DNA, 18 bp, Homo sapiens
gaagtaaattaggcagtg

SEQ ID NO: 4440529 - DNA, 19 bp, Homo sapiens
gaagtacagtagtttccct

SEQ ID NO: 4440530 - DNA, 14 bp, Homo sapiens
gaagtatcagcact

SEQ ID NO: 4440531 - DNA, 17 bp, Homo sapiens
gaagtatcagcactaga

SEQ ID NO: 4440532 - DNA, 18 bp, Homo sapiens
gaagtatttttttaattt

SEQ ID NO: 4440533 - DNA, 17 bp, Homo sapiens
gaagtcaaaatatgtaa

SEQ ID NO: 4440534 - DNA, 18 bp, Homo sapiens
gaagtcataccaatgaaa

SEQ ID NO: 4440535 - DNA, 14 bp, Homo sapiens
gaagtccaatgtgg

SEQ ID NO: 4440536 - DNA, 14 bp, Homo sapiens
gaagtccttatgtt

SEQ ID NO: 4440537 - DNA, 13 bp, Homo sapiens
gaagtcttctatt

SEQ ID NO: 4440538 - DNA, 19 bp, Homo sapiens
gaagtgaacccatatttta

SEQ ID NO: 4440539 - DNA, 19 bp, Homo sapiens
gaagtggaaggaagaacag

SEQ ID NO: 4440540 - DNA, 16 bp, Homo sapiens
gaagtggctgccacac

SEQ ID NO: 4440541 - DNA, 18 bp, Homo sapiens
gaagtgggccaggacagg

SEQ ID NO: 4440542 - DNA, 23 bp, Homo sapiens
gaagtggggggaacgcctctgtt

SEQ ID NO: 4440543 - DNA, 17 bp, Homo sapiens
gaagtgtgtgccaagag

SEQ ID NO: 4440544 - DNA, 16 bp, Homo sapiens
gaagtgttaatacatc

SEQ ID NO: 4440545 - DNA, 18 bp, Homo sapiens
gaagtgttaatacatcac

SEQ ID NO: 4440546 - DNA, 17 bp, Homo sapiens
gaagtgtttcagatttt

SEQ ID NO: 4440547 - DNA, 21 bp, Homo sapiens
gaagttaaaaaacagctgcat

SEQ ID NO: 4440548 - DNA, 17 bp, Homo sapiens
gaagttagctttaactt

SEQ ID NO: 4440549 - DNA, 15 bp, Homo sapiens
gaagttagtggaaat

SEQ ID NO: 4440550 - DNA, 14 bp, Homo sapiens
gaagttattttcca

SEQ ID NO: 4440551 - DNA, 20 bp, Homo sapiens
gaagttgaataaacataaaa

SEQ ID NO: 4440552 - DNA, 15 bp, Homo sapiens
gaagtttcaagtttt

SEQ ID NO: 4440553 - DNA, 21 bp, Homo sapiens
gaagttttatgccatgttaat

SEQ ID NO: 4440554 - DNA, 20 bp, Homo sapiens
gaataaaaaggttggcctta

SEQ ID NO: 4440555 - DNA, 16 bp, Homo sapiens
gaataaaatgtttctc

SEQ ID NO: 4440556 - DNA, 12 bp, Homo sapiens
gaataaaattag

SEQ ID NO: 4440557 - DNA, 18 bp, Homo sapiens
gaataaaattaggttaaa

SEQ ID NO: 4440558 - DNA, 17 bp, Homo sapiens
gaataaagaatgccatt

SEQ ID NO: 4440559 - DNA, 20 bp, Homo sapiens
gaataaagaatgccatttct

SEQ ID NO: 4440560 - DNA, 16 bp, Homo sapiens
gaataaaggcagtttt

SEQ ID NO: 4440561 - DNA, 17 bp, Homo sapiens
gaataaaggcagttttc

SEQ ID NO: 4440562 - DNA, 16 bp, Homo sapiens
gaataaatcatgactt

SEQ ID NO: 4440563 - DNA, 13 bp, Homo sapiens
gaataaatgttca

SEQ ID NO: 4440564 - DNA, 18 bp, Homo sapiens
gaataaatgttcaaactg

SEQ ID NO: 4440565 - DNA, 12 bp, Homo sapiens
gaataaattatg

SEQ ID NO: 4440566 - DNA, 20 bp, Homo sapiens
gaataaattatggcatttct

SEQ ID NO: 4440567 - DNA, 21 bp, Homo sapiens
gaataaattctacctccttgt

SEQ ID NO: 4440568 - DNA, 14 bp, Homo sapiens
gaataaattttcaa

SEQ ID NO: 4440569 - DNA, 14 bp, Homo sapiens
gaataacatttaaa

SEQ ID NO: 4440570 - DNA, 17 bp, Homo sapiens
gaataacatttaaattc

SEQ ID NO: 4440571 - DNA, 15 bp, Homo sapiens
gaataacattttcta

SEQ ID NO: 4440572 - DNA, 23 bp, Homo sapiens
gaataagacaagagatctacaca

SEQ ID NO: 4440573 - DNA, 23 bp, Homo sapiens
gaataagcagaacatactgttct

SEQ ID NO: 4440574 - DNA, 12 bp, Homo sapiens
gaataaggccca

SEQ ID NO: 4440575 - DNA, 20 bp, Homo sapiens
gaataagtgccaggatggaa

SEQ ID NO: 4440576 - DNA, 13 bp, Homo sapiens
gaataagttattg

SEQ ID NO: 4440577 - DNA, 16 bp, Homo sapiens
gaataataagcaggat

SEQ ID NO: 4440578 - DNA, 18 bp, Homo sapiens
gaataatacatactaatg

SEQ ID NO: 4440579 - DNA, 19 bp, Homo sapiens
gaatgtgccacagaggccc

SEQ ID NO: 4440580 - DNA, 20 bp, Homo sapiens
gaatgtgccacagaggcccc

SEQ ID NO: 4440581 - DNA, 21 bp, Homo sapiens
gaatgtgccacagaggcccca

SEQ ID NO: 4440582 - DNA, 23 bp, Homo sapiens
gaatgtgccacagaggccccacc

SEQ ID NO: 4440583 - DNA, 18 bp, Homo sapiens
gaatgtggcttgagaaat

SEQ ID NO: 4440584 - DNA, 16 bp, Homo sapiens
gaatgttactgcctta

SEQ ID NO: 4440585 - DNA, 23 bp, Homo sapiens
gaatgttagaagaggcctttgga

SEQ ID NO: 4440586 - DNA, 19 bp, Homo sapiens
gaatgttcttgaattatat

SEQ ID NO: 4440587 - DNA, 20 bp, Homo sapiens
gaatgttggataaggaatta

SEQ ID NO: 4440588 - DNA, 22 bp, Homo sapiens
gaatgtttcatttgcacaagta

SEQ ID NO: 4440589 - DNA, 16 bp, Homo sapiens
gaatgttttgtgtgta

SEQ ID NO: 4440590 - DNA, 14 bp, Homo sapiens
gaattaaaaaagca

SEQ ID NO: 4440591 - DNA, 12 bp, Homo sapiens
gaattaaaattt

SEQ ID NO: 4440592 - DNA, 21 bp, Homo sapiens
gaattaaattaggaataaata

SEQ ID NO: 4440593 - DNA, 15 bp, Homo sapiens
gaattaacacatgat

SEQ ID NO: 4440594 - DNA, 18 bp, Homo sapiens
gaattaattaatttggag

SEQ ID NO: 4440595 - DNA, 19 bp, Homo sapiens
gaattaccatagagtaatg

SEQ ID NO: 4440596 - DNA, 18 bp, Homo sapiens
gaattaccatttgttaat

SEQ ID NO: 4440597 - DNA, 17 bp, Homo sapiens
gaattaggctgtaacta

SEQ ID NO: 4440598 - DNA, 15 bp, Homo sapiens
gaattataaatgtgt

SEQ ID NO: 4440599 - DNA, 16 bp, Homo sapiens
gaattataaatgtgtt

SEQ ID NO: 4440600 - DNA, 12 bp, Homo sapiens
gaattatatttt

SEQ ID NO: 4440601 - DNA, 18 bp, Homo sapiens
gaattatcagcaaagaaa

SEQ ID NO: 4440602 - DNA, 14 bp, Homo sapiens
gaattatctaattt

SEQ ID NO: 4440603 - DNA, 15 bp, Homo sapiens
gaattattgacactg

SEQ ID NO: 4440604 - DNA, 21 bp, Homo sapiens
gaattatttctgtcacagtaa

SEQ ID NO: 4440605 - DNA, 19 bp, Homo sapiens
gaattcaaaagtgattatc

SEQ ID NO: 4440606 - DNA, 17 bp, Homo sapiens
gaattcaccagtgttcc

SEQ ID NO: 4440607 - DNA, 13 bp, Homo sapiens
gaattcactgagt

SEQ ID NO: 4440608 - DNA, 16 bp, Homo sapiens
gaattcagcagtttta

SEQ ID NO: 4440609 - DNA, 17 bp, Homo sapiens
gaattcagcagttttat

SEQ ID NO: 4440610 - DNA, 22 bp, Homo sapiens
gaattcataataaattttctaa

SEQ ID NO: 4440611 - DNA, 12 bp, Homo sapiens
gaattcattcat

SEQ ID NO: 4440612 - DNA, 12 bp, Homo sapiens
gaattccaaagc

SEQ ID NO: 4440613 - DNA, 15 bp, Homo sapiens
gaattccaaagcaaa

SEQ ID NO: 4440614 - DNA, 12 bp, Homo sapiens
gaattccctccc

SEQ ID NO: 4440615 - DNA, 17 bp, Homo sapiens
gaattcctagaattaaa

SEQ ID NO: 4440616 - DNA, 19 bp, Homo sapiens
gaattcggtgtgctgccaa

SEQ ID NO: 4440617 - DNA, 14 bp, Homo sapiens
gaattgaaaaacaa

SEQ ID NO: 4440618 - DNA, 15 bp, Homo sapiens
gaattgaaatgaggt

SEQ ID NO: 4440619 - DNA, 16 bp, Homo sapiens
gaattgaacccaggag

SEQ ID NO: 4440620 - DNA, 20 bp, Homo sapiens
gaattgatcattttcccccc

SEQ ID NO: 4440621 - DNA, 17 bp, Homo sapiens
gaattgatgatgcagtt

SEQ ID NO: 4440622 - DNA, 13 bp, Homo sapiens
gaattgatttgca

SEQ ID NO: 4440623 - DNA, 14 bp, Homo sapiens
gaattgcgctcagg

SEQ ID NO: 4440624 - DNA, 17 bp, Homo sapiens
gaattgctttctgctct

SEQ ID NO: 4440625 - DNA, 21 bp, Homo sapiens
gaattggaagttacatgctgt

SEQ ID NO: 4440626 - DNA, 21 bp, Homo sapiens
gaattggcataatttgtctta

SEQ ID NO: 4440627 - DNA, 16 bp, Homo sapiens
gaattgtaactgttct

SEQ ID NO: 4440628 - DNA, 23 bp, Homo sapiens
gaattgtccccagtttgcagaaa

SEQ ID NO: 4440629 - DNA, 12 bp, Homo sapiens
gaattgttacat

SEQ ID NO: 4440630 - DNA, 16 bp, Homo sapiens
gaatttaataatctgt

SEQ ID NO: 4440631 - DNA, 16 bp, Homo sapiens
gaatttactttcttca

SEQ ID NO: 4440632 - DNA, 22 bp, Homo sapiens
gaatttagatcttatattggtt

SEQ ID NO: 4440633 - DNA, 23 bp, Homo sapiens
gaatttagtgatactggctcaga

SEQ ID NO: 4440634 - DNA, 20 bp, Homo sapiens
gaatttatcacacttctgtg

SEQ ID NO: 4440635 - DNA, 15 bp, Homo sapiens
gaatttatctttacc

SEQ ID NO: 4440636 - DNA, 17 bp, Homo sapiens
gaatttatctttaccaa

SEQ ID NO: 4440637 - DNA, 23 bp, Homo sapiens
gaatttatgtgaaatgctttctg

SEQ ID NO: 4440638 - DNA, 13 bp, Homo sapiens
gaatttattgata

SEQ ID NO: 4440639 - DNA, 12 bp, Homo sapiens
gaatttcacctg

SEQ ID NO: 4440640 - DNA, 12 bp, Homo sapiens
gaatttctaaag

SEQ ID NO: 4440641 - DNA, 17 bp, Homo sapiens
gaatttcttaacttctt

SEQ ID NO: 4440642 - DNA, 18 bp, Homo sapiens
gaatttcttaacttcttg

SEQ ID NO: 4440643 - DNA, 19 bp, Homo sapiens
gaatttcttaacttcttgc

SEQ ID NO: 4440644 - DNA, 21 bp, Homo sapiens
gaatttcttaacttcttgctt

SEQ ID NO: 4440645 - DNA, 15 bp, Homo sapiens
gaatttgaagacttc

SEQ ID NO: 4440646 - DNA, 14 bp, Homo sapiens
gaatttgcctgctg

SEQ ID NO: 4440647 - DNA, 23 bp, Homo sapiens
gaatttgggagaagcaaatatag

SEQ ID NO: 4440648 - DNA, 15 bp, Homo sapiens
gaatttggtacacat

SEQ ID NO: 4440649 - DNA, 14 bp, Homo sapiens
gaaactaagccagg

SEQ ID NO: 4440650 - DNA, 15 bp, Homo sapiens
gaaactaagccaggc

SEQ ID NO: 4440651 - DNA, 19 bp, Homo sapiens
gaaactactgcctttagaa

SEQ ID NO: 4440652 - DNA, 22 bp, Homo sapiens
gaaactactgcctttagaaaat

SEQ ID NO: 4440653 - DNA, 14 bp, Homo sapiens
gaaactatgtgttt

SEQ ID NO: 4440654 - DNA, 18 bp, Homo sapiens
gaaactatgtgtttttct

SEQ ID NO: 4440655 - DNA, 20 bp, Homo sapiens
gaaactatgtgtttttctca

SEQ ID NO: 4440656 - DNA, 21 bp, Homo sapiens
gaaactcaaggaaaagttctt

SEQ ID NO: 4440657 - DNA, 18 bp, Homo sapiens
gaaactcatagacactga

SEQ ID NO: 4440658 - DNA, 16 bp, Homo sapiens
gaaactccacatctgc

SEQ ID NO: 4440659 - DNA, 18 bp, Homo sapiens
gaaactccacatctgcct

SEQ ID NO: 4440660 - DNA, 15 bp, Homo sapiens
gaaactccgaagaaa

SEQ ID NO: 4440661 - DNA, 15 bp, Homo sapiens
gaaactgagtcactc

SEQ ID NO: 4440662 - DNA, 16 bp, Homo sapiens
gaaactgagtcactca

SEQ ID NO: 4440663 - DNA, 15 bp, Homo sapiens
gaaactgcagggaaa

SEQ ID NO: 4440664 - DNA, 19 bp, Homo sapiens
gaaactgggaaactgggtt

SEQ ID NO: 4440665 - DNA, 16 bp, Homo sapiens
gaaactgggtttctca

SEQ ID NO: 4440666 - DNA, 20 bp, Homo sapiens
gaaactgtatcatctttgcc

SEQ ID NO: 4440667 - DNA, 19 bp, Homo sapiens
gaaacttaaatgttattat

SEQ ID NO: 4440668 - DNA, 14 bp, Homo sapiens
gaaacttgtaaata

SEQ ID NO: 4440669 - DNA, 16 bp, Homo sapiens
gaaactttttaattgt

SEQ ID NO: 4440670 - DNA, 22 bp, Homo sapiens
gaaagaagaaactccgaagaaa

SEQ ID NO: 4440671 - DNA, 12 bp, Homo sapiens
gaaagaagccat

SEQ ID NO: 4440672 - DNA, 14 bp, Homo sapiens
gaaagaagtattta

SEQ ID NO: 4440673 - DNA, 16 bp, Homo sapiens
gaaagaataaaatgtt

SEQ ID NO: 4440674 - DNA, 17 bp, Homo sapiens
gaaagaataaaatgttt

SEQ ID NO: 4440675 - DNA, 13 bp, Homo sapiens
gaaagaatagaac

SEQ ID NO: 4440676 - DNA, 22 bp, Homo sapiens
gaaagaatgttactgccttaat

SEQ ID NO: 4440677 - DNA, 22 bp, Homo sapiens
gaaagaccatgtggtttgctgt

SEQ ID NO: 4440678 - DNA, 20 bp, Homo sapiens
gaaagacgtttttgtgctgt

SEQ ID NO: 4440679 - DNA, 22 bp, Homo sapiens
gaaagactattcaaacagtctc

SEQ ID NO: 4440680 - DNA, 17 bp, Homo sapiens
gaaagaggcaccaggaa

SEQ ID NO: 4440681 - DNA, 18 bp, Homo sapiens
gaaagagtgccagtcagc

SEQ ID NO: 4440682 - DNA, 22 bp, Homo sapiens
gaaagataatattgtctgtctc

SEQ ID NO: 4440683 - DNA, 13 bp, Homo sapiens
gaaagatgacaaa

SEQ ID NO: 4440684 - DNA, 22 bp, Homo sapiens
gaaagatgtgtttttgggaaga

SEQ ID NO: 4440685 - DNA, 19 bp, Homo sapiens
gaaagcacttaaacagaag

SEQ ID NO: 4440686 - DNA, 13 bp, Homo sapiens
gaaagcagaacag

SEQ ID NO: 4440687 - DNA, 19 bp, Homo sapiens
gaaagccacgccctccctg

SEQ ID NO: 4440688 - DNA, 20 bp, Homo sapiens
gaaagccaggagcagccctg

SEQ ID NO: 4440689 - DNA, 23 bp, Homo sapiens
gaaagcctcctgccccctgccag

SEQ ID NO: 4440690 - DNA, 14 bp, Homo sapiens
gaaagcctctgtcc

SEQ ID NO: 4440691 - DNA, 16 bp, Homo sapiens
gaaagccttagggaag

SEQ ID NO: 4440692 - DNA, 14 bp, Homo sapiens
gaaagcgggcagcc

SEQ ID NO: 4440693 - DNA, 21 bp, Homo sapiens
gaaagcttgccctggtgcctc

SEQ ID NO: 4440694 - DNA, 15 bp, Homo sapiens
gaaagcttttattcc

SEQ ID NO: 4440695 - DNA, 12 bp, Homo sapiens
gaaaggaaaaga

SEQ ID NO: 4440696 - DNA, 14 bp, Homo sapiens
gaaaggaaaagaaa

SEQ ID NO: 4440697 - DNA, 14 bp, Homo sapiens
gaaaggaaaccttt

SEQ ID NO: 4440698 - DNA, 23 bp, Homo sapiens
gaaaggaagcattgtaaaataat

SEQ ID NO: 4440699 - DNA, 17 bp, Homo sapiens
gaaaggacagagccagc

SEQ ID NO: 4440700 - DNA, 12 bp, Homo sapiens
gaaaggagacat

SEQ ID NO: 4440701 - DNA, 11 bp, Homo sapiens
gaaaggagact

SEQ ID NO: 4440702 - DNA, 20 bp, Homo sapiens
gaaaggatgtaaacagtgcc

SEQ ID NO: 4440703 - DNA, 22 bp, Homo sapiens
gaaaggatgtaaacagtgcctg

SEQ ID NO: 4440704 - DNA, 14 bp, Homo sapiens
gaaaggattttacc

SEQ ID NO: 4440705 - DNA, 20 bp, Homo sapiens
gaaaggattttaccaaagca

SEQ ID NO: 4440706 - DNA, 21 bp, Homo sapiens
gaaaggattttaccaaagcat

SEQ ID NO: 4440707 - DNA, 17 bp, Homo sapiens
gaaaggcaggtttcatt

SEQ ID NO: 4440708 - DNA, 16 bp, Homo sapiens
gaaaggctcatttaaa

SEQ ID NO: 4440709 - DNA, 22 bp, Homo sapiens
gaaaggctcatttaaaacaggc

SEQ ID NO: 4440710 - DNA, 14 bp, Homo sapiens
gaaagggctggctc

SEQ ID NO: 4440711 - DNA, 15 bp, Homo sapiens
gaaaggggagagcct

SEQ ID NO: 4440712 - DNA, 18 bp, Homo sapiens
gaaaggggagagcctgct

SEQ ID NO: 4440713 - DNA, 21 bp, Homo sapiens
gaaagggtttgtaatacttta

SEQ ID NO: 4440714 - DNA, 22 bp, Homo sapiens
gaaaggtgccatggaagaggct

SEQ ID NO: 4440715 - DNA, 20 bp, Homo sapiens
gaaaggttagagaataaatt

SEQ ID NO: 4440716 - DNA, 20 bp, Homo sapiens
cttttacccctgcacagttt

SEQ ID NO: 4440717 - DNA, 15 bp, Homo sapiens
cttttacctgctgct

SEQ ID NO: 4440718 - DNA, 13 bp, Homo sapiens
cttttagaaaagg

SEQ ID NO: 4440719 - DNA, 11 bp, Homo sapiens
cttttataaat

SEQ ID NO: 4440720 - DNA, 18 bp, Homo sapiens
cttttataaattaaatat

SEQ ID NO: 4440721 - DNA, 20 bp, Homo sapiens
cttttataaattaaatatat

SEQ ID NO: 4440722 - DNA, 15 bp, Homo sapiens
cttttatattctaat

SEQ ID NO: 4440723 - DNA, 16 bp, Homo sapiens
cttttatattctaata

SEQ ID NO: 4440724 - DNA, 20 bp, Homo sapiens
cttttatattctaatagttt

SEQ ID NO: 4440725 - DNA, 15 bp, Homo sapiens
cttttatctcacaaa

SEQ ID NO: 4440726 - DNA, 14 bp, Homo sapiens
cttttatgaagttt

SEQ ID NO: 4440727 - DNA, 16 bp, Homo sapiens
cttttatgaagttttt

SEQ ID NO: 4440728 - DNA, 13 bp, Homo sapiens
cttttatggatga

SEQ ID NO: 4440729 - DNA, 23 bp, Homo sapiens
cttttatgtaatttctttaaatg

SEQ ID NO: 4440730 - DNA, 15 bp, Homo sapiens
cttttatgtagtaat

SEQ ID NO: 4440731 - DNA, 18 bp, Homo sapiens
cttttatgtagtaattga

SEQ ID NO: 4440732 - DNA, 22 bp, Homo sapiens
cttttatgtagtaattgacatg

SEQ ID NO: 4440733 - DNA, 13 bp, Homo sapiens
cttttatgtgaga

SEQ ID NO: 4440734 - DNA, 15 bp, Homo sapiens
cttttatgtgagatt

SEQ ID NO: 4440735 - DNA, 13 bp, Homo sapiens
cttttattaatac

SEQ ID NO: 4440736 - DNA, 22 bp, Homo sapiens
cttttattaatactttctttta

SEQ ID NO: 4440737 - DNA, 15 bp, Homo sapiens
cttttattaatatat

SEQ ID NO: 4440738 - DNA, 22 bp, Homo sapiens
cttttcaatcttctacttttaa

SEQ ID NO: 4440739 - DNA, 20 bp, Homo sapiens
cttttcaatgtctaaaaaca

SEQ ID NO: 4440740 - DNA, 18 bp, Homo sapiens
cttttcaatgtgattctt

SEQ ID NO: 4440741 - DNA, 21 bp, Homo sapiens
cttttcacatgctaatgtgca

SEQ ID NO: 4440742 - DNA, 21 bp, Homo sapiens
cttttcaccaaaatttctaca

SEQ ID NO: 4440743 - DNA, 21 bp, Homo sapiens
cttttcagaagcaagccagac

SEQ ID NO: 4440744 - DNA, 14 bp, Homo sapiens
cttttcatatcatt

SEQ ID NO: 4440745 - DNA, 17 bp, Homo sapiens
cttttcattctctttta

SEQ ID NO: 4440746 - DNA, 17 bp, Homo sapiens
cttttcattttaatata

SEQ ID NO: 4440747 - DNA, 22 bp, Homo sapiens
cttttccaggagttctgaagct

SEQ ID NO: 4440748 - DNA, 22 bp, Homo sapiens
cttttcccaaaatgttgaaata

SEQ ID NO: 4440749 - DNA, 18 bp, Homo sapiens
cttttcccactgtttaag

SEQ ID NO: 4440750 - DNA, 23 bp, Homo sapiens
cttttcccccattaatcagttca

SEQ ID NO: 4440751 - DNA, 23 bp, Homo sapiens
cttttcccccttcccatttcttc

SEQ ID NO: 4440752 - DNA, 18 bp, Homo sapiens
cttttcctggcagctgct

SEQ ID NO: 4440753 - DNA, 15 bp, Homo sapiens
cttttcctggtgctc

SEQ ID NO: 4440754 - DNA, 18 bp, Homo sapiens
cttttccttatttgcctt

SEQ ID NO: 4440755 - DNA, 16 bp, Homo sapiens
cttttccttccctttt

SEQ ID NO: 4440756 - DNA, 20 bp, Homo sapiens
cttttcgcttgcttctgcag

SEQ ID NO: 4440757 - DNA, 15 bp, Homo sapiens
cttttcgtttagaat

SEQ ID NO: 4440758 - DNA, 20 bp, Homo sapiens
cttttctaacagaaagcatg

SEQ ID NO: 4440759 - DNA, 17 bp, Homo sapiens
cttttctagagacacat

SEQ ID NO: 4440760 - DNA, 15 bp, Homo sapiens
cttttctcacaaaaa

SEQ ID NO: 4440761 - DNA, 17 bp, Homo sapiens
cttttctcctcactgta

SEQ ID NO: 4440762 - DNA, 16 bp, Homo sapiens
cttttctcctttacca

SEQ ID NO: 4440763 - DNA, 11 bp, Homo sapiens
cttttctcttt

SEQ ID NO: 4440764 - DNA, 22 bp, Homo sapiens
cttttctctttaattttaactg

SEQ ID NO: 4440765 - DNA, 19 bp, Homo sapiens
cttttctgccctggctgct

SEQ ID NO: 4440766 - DNA, 16 bp, Homo sapiens
cttttctgtaattcag

SEQ ID NO: 4440767 - DNA, 15 bp, Homo sapiens
cttttcttaaacctt

SEQ ID NO: 4440768 - DNA, 16 bp, Homo sapiens
cttttcttaaaccttc

SEQ ID NO: 4440769 - DNA, 11 bp, Homo sapiens
cttttcttgta

SEQ ID NO: 4440770 - DNA, 16 bp, Homo sapiens
cttttcttgtatctgg

SEQ ID NO: 4440771 - DNA, 14 bp, Homo sapiens
cttttgaaagatgt

SEQ ID NO: 4440772 - DNA, 16 bp, Homo sapiens
cttttgaatcaatctg

SEQ ID NO: 4440773 - DNA, 17 bp, Homo sapiens
cttttgaatcaatctgg

SEQ ID NO: 4440774 - DNA, 14 bp, Homo sapiens
cttttgaattgtta

SEQ ID NO: 4440775 - DNA, 16 bp, Homo sapiens
cttttgaattgttaca

SEQ ID NO: 4440776 - DNA, 12 bp, Homo sapiens
cttttgacactg

SEQ ID NO: 4440777 - DNA, 18 bp, Homo sapiens
cttttgacactgctctaa

SEQ ID NO: 4440778 - DNA, 15 bp, Homo sapiens
cttttgatatgcata

SEQ ID NO: 4440779 - DNA, 15 bp, Homo sapiens
cttttgcaaccagga

SEQ ID NO: 4440780 - DNA, 16 bp, Homo sapiens
cttttgcctgtaagaa

SEQ ID NO: 4440781 - DNA, 20 bp, Homo sapiens
cttttgccttttgcaaccag

SEQ ID NO: 4440782 - DNA, 13 bp, Homo sapiens
cttttgctgttta

SEQ ID NO: 4440783 - DNA, 13 bp, Homo sapiens
cttttggcctggg

SEQ ID NO: 4440784 - DNA, 18 bp, Homo sapiens
cttttggcctgggggagg

SEQ ID NO: 4440785 - DNA, 21 bp, Homo sapiens
cttttgggaagaatccagtat

SEQ ID NO: 4440786 - DNA, 14 bp, Homo sapiens
cttttgggggaggg

SEQ ID NO: 4440787 - DNA, 17 bp, Homo sapiens
cttttgtactgaatttt

SEQ ID NO: 4440788 - DNA, 23 bp, Homo sapiens
cttttgtactgaatttttttgta

SEQ ID NO: 4440789 - DNA, 13 bp, Homo sapiens
cttttgtattaag

SEQ ID NO: 4440790 - DNA, 14 bp, Homo sapiens
cttttgtattaaga

SEQ ID NO: 4440791 - DNA, 21 bp, Homo sapiens
cttttgtcctgcatcatcttg

SEQ ID NO: 4440792 - DNA, 19 bp, Homo sapiens
cttttgtccttcctgtgcc

SEQ ID NO: 4440793 - DNA, 13 bp, Homo sapiens
cttttgtgatgaa

SEQ ID NO: 4440794 - DNA, 15 bp, Homo sapiens
cttttgtgatgaaca

SEQ ID NO: 4440795 - DNA, 23 bp, Homo sapiens
cttttgtgtcacttttttctgcc

SEQ ID NO: 4440796 - DNA, 18 bp, Homo sapiens
cttttgttaatgcattgt

SEQ ID NO: 4440797 - DNA, 14 bp, Homo sapiens
cttttgttctctga

SEQ ID NO: 4440798 - DNA, 22 bp, Homo sapiens
cttttgttgtactttatatctt

SEQ ID NO: 4440799 - DNA, 19 bp, Homo sapiens
ctttttaaaaatagacact

SEQ ID NO: 4440800 - DNA, 15 bp, Homo sapiens
ctttttaaagcttat

SEQ ID NO: 4440801 - DNA, 12 bp, Homo sapiens
ctttttaacttt

SEQ ID NO: 4440802 - DNA, 18 bp, Homo sapiens
ctttttaatcatgaatat

SEQ ID NO: 4440803 - DNA, 19 bp, Homo sapiens
ctttttacagcagcaatat

SEQ ID NO: 4440804 - DNA, 17 bp, Homo sapiens
ctttttacctttcatac

SEQ ID NO: 4440805 - DNA, 14 bp, Homo sapiens
ctttttataaaaag

SEQ ID NO: 4440806 - DNA, 23 bp, Homo sapiens
ctttttatcccatttagtgtgaa

SEQ ID NO: 4440807 - DNA, 15 bp, Homo sapiens
ctttttattccctgc

SEQ ID NO: 4440808 - DNA, 18 bp, Homo sapiens
ctttttattccctgccca

SEQ ID NO: 4440809 - DNA, 16 bp, Homo sapiens
ctttttattcctttta

SEQ ID NO: 4440810 - DNA, 11 bp, Homo sapiens
ctttttattgc

SEQ ID NO: 4440811 - DNA, 13 bp, Homo sapiens
ctttttattgcct

SEQ ID NO: 4440812 - DNA, 14 bp, Homo sapiens
ctttttattgcctt

SEQ ID NO: 4440813 - DNA, 20 bp, Homo sapiens
ctttttcatgaaaatggagt

SEQ ID NO: 4440814 - DNA, 23 bp, Homo sapiens
ctttttcatttatctataattta

SEQ ID NO: 4440815 - DNA, 11 bp, Homo sapiens
ctttttccagt

SEQ ID NO: 4440816 - DNA, 12 bp, Homo sapiens
ctttttccagtg

SEQ ID NO: 4440817 - DNA, 20 bp, Homo sapiens
ctttttccccattggaacta

SEQ ID NO: 4440818 - DNA, 11 bp, Homo sapiens
ctttttcctcc

SEQ ID NO: 4440819 - DNA, 12 bp, Homo sapiens
ctttttcctcct

SEQ ID NO: 4440820 - DNA, 11 bp, Homo sapiens
ctttttcctgc

SEQ ID NO: 4440821 - DNA, 21 bp, Homo sapiens
ctttttcctgcgtcccagcct

SEQ ID NO: 4440822 - DNA, 15 bp, Homo sapiens
ctttttccttactgt

SEQ ID NO: 4440823 - DNA, 12 bp, Homo sapiens
ctttttctaatg

SEQ ID NO: 4440824 - DNA, 13 bp, Homo sapiens
ctttttctaatga

SEQ ID NO: 4440825 - DNA, 13 bp, Homo sapiens
ctttttctacatg

SEQ ID NO: 4440826 - DNA, 16 bp, Homo sapiens
ctttttctacatgtga

SEQ ID NO: 4440827 - DNA, 17 bp, Homo sapiens
ctttttctacatgtgag

SEQ ID NO: 4440828 - DNA, 13 bp, Homo sapiens
ctttttcttcact

SEQ ID NO: 4440829 - DNA, 15 bp, Homo sapiens
ctttttcttcttccc

SEQ ID NO: 4440830 - DNA, 19 bp, Homo sapiens
ctttttgaccagtttcttt

SEQ ID NO: 4440831 - DNA, 21 bp, Homo sapiens
ctttttgccagttttccctgg

SEQ ID NO: 4440832 - DNA, 22 bp, Homo sapiens
ctttttgccagttttccctgga

SEQ ID NO: 4440833 - DNA, 23 bp, Homo sapiens
ctttttgccagttttccctggaa

SEQ ID NO: 4440834 - DNA, 18 bp, Homo sapiens
ctttttgcttctactttc

SEQ ID NO: 4440835 - DNA, 13 bp, Homo sapiens
ctttttgctttcg

SEQ ID NO: 4440836 - DNA, 11 bp, Homo sapiens
ctttttggaat

SEQ ID NO: 4440837 - DNA, 19 bp, Homo sapiens
ctttttggtggatgtaaat

SEQ ID NO: 4440838 - DNA, 15 bp, Homo sapiens
ctttttgtgtttttt

SEQ ID NO: 4440839 - DNA, 11 bp, Homo sapiens
ctttttgttca

SEQ ID NO: 4440840 - DNA, 15 bp, Homo sapiens
cttttttaaattaat

SEQ ID NO: 4440841 - DNA, 18 bp, Homo sapiens
cttttttaaattttcttc

SEQ ID NO: 4440842 - DNA, 12 bp, Homo sapiens
cttttttcctgt

SEQ ID NO: 4440843 - DNA, 15 bp, Homo sapiens
cttttttgagatttt

SEQ ID NO: 4440844 - DNA, 19 bp, Homo sapiens
cttttttgagtcattgact

SEQ ID NO: 4440845 - DNA, 23 bp, Homo sapiens
cttttttgagtcattgacttcat

SEQ ID NO: 4440846 - DNA, 15 bp, Homo sapiens
cttttttgctttctt

SEQ ID NO: 4440847 - DNA, 16 bp, Homo sapiens
ctttttttacatttca

SEQ ID NO: 4440848 - DNA, 13 bp, Homo sapiens
ctttttttattac

SEQ ID NO: 4440849 - DNA, 14 bp, Homo sapiens
ctttttttattact

SEQ ID NO: 4440850 - DNA, 21 bp, Homo sapiens
ctttttttccttcctttttat

SEQ ID NO: 4440851 - DNA, 16 bp, Homo sapiens
ctttttttctgtacca

SEQ ID NO: 4440852 - DNA, 20 bp, Homo sapiens
ctttttttctgtaccagtta

SEQ ID NO: 4440853 - DNA, 12 bp, Homo sapiens
ctttttttgtat

SEQ ID NO: 4440854 - DNA, 14 bp, Homo sapiens
ctttttttgttata

SEQ ID NO: 4440855 - DNA, 14 bp, Homo sapiens
cttttttttaagtt

SEQ ID NO: 4440856 - DNA, 14 bp, Homo sapiens
cttttttttcttta

SEQ ID NO: 4440857 - DNA, 15 bp, Homo sapiens
cttttttttctttaa

SEQ ID NO: 4440858 - DNA, 15 bp, Homo sapiens
ctttttttttctctt

SEQ ID NO: 4440859 - DNA, 22 bp, Homo sapiens
ctttttttttctctttctctcc

SEQ ID NO: 4440860 - DNA, 18 bp, Homo sapiens
ctttttttttttgtttga

SEQ ID NO: 4440861 - DNA, 20 bp, Homo sapiens
gaaaaaaaaaaagaagaaga

SEQ ID NO: 4440862 - DNA, 18 bp, Homo sapiens
gaaaaaaaaaatgcattt

SEQ ID NO: 4440863 - DNA, 18 bp, Homo sapiens
gaaaaaaaaattcacatg

SEQ ID NO: 4440864 - DNA, 19 bp, Homo sapiens
gaaaaaaaactgaagatga

SEQ ID NO: 4440865 - DNA, 16 bp, Homo sapiens
gaaaaaaaagttttta

SEQ ID NO: 4440866 - DNA, 13 bp, Homo sapiens
gaaaaaaaatttg

SEQ ID NO: 4440867 - DNA, 16 bp, Homo sapiens
gaaaaaaactgggata

SEQ ID NO: 4440868 - DNA, 17 bp, Homo sapiens
gaaaaaaactgggataa

SEQ ID NO: 4440869 - DNA, 14 bp, Homo sapiens
gaaaaaaacttcat

SEQ ID NO: 4440870 - DNA, 23 bp, Homo sapiens
gaaaaaaacttttataaattaaa

SEQ ID NO: 4440871 - DNA, 14 bp, Homo sapiens
gaaaaaaagcaaaa

SEQ ID NO: 4440872 - DNA, 19 bp, Homo sapiens
gaaaaaaagggaaaacaaa

SEQ ID NO: 4440873 - DNA, 14 bp, Homo sapiens
gaaaaaaagtgctg

SEQ ID NO: 4440874 - DNA, 19 bp, Homo sapiens
gaaaaaaagtgctgaaaat

SEQ ID NO: 4440875 - DNA, 15 bp, Homo sapiens
gaaaaaaatgaaaca

SEQ ID NO: 4440876 - DNA, 16 bp, Homo sapiens
gaaaaaagatttttaa

SEQ ID NO: 4440877 - DNA, 11 bp, Homo sapiens
gaaaaaagctc

SEQ ID NO: 4440878 - DNA, 22 bp, Homo sapiens
gaaaaaagtagcaaatgtttac

SEQ ID NO: 4440879 - DNA, 16 bp, Homo sapiens
gaaaaaataattattt

SEQ ID NO: 4440880 - DNA, 12 bp, Homo sapiens
gaaaaaatattt

SEQ ID NO: 4440881 - DNA, 21 bp, Homo sapiens
gaaaaacaaactcgtttttta

SEQ ID NO: 4440882 - DNA, 17 bp, Homo sapiens
gaaaaacaattttctgt

SEQ ID NO: 4440883 - DNA, 21 bp, Homo sapiens
gaaaaacatttaaacttttta

SEQ ID NO: 4440884 - DNA, 23 bp, Homo sapiens
gaaaaacatttaaactttttaaa

SEQ ID NO: 4440885 - DNA, 23 bp, Homo sapiens
gaaaaagatggcttatgtcatca

SEQ ID NO: 4440886 - DNA, 13 bp, Homo sapiens
gaaaaagcgaaaa

SEQ ID NO: 4440887 - DNA, 19 bp, Homo sapiens
gaaaaatagagcaaaatca

SEQ ID NO: 4440888 - DNA, 13 bp, Homo sapiens
gaaaaatagcata

SEQ ID NO: 4440889 - DNA, 19 bp, Homo sapiens
gaaaaatcacaatttttaa

SEQ ID NO: 4440890 - DNA, 18 bp, Homo sapiens
gaaaaatctcaattgaaa

SEQ ID NO: 4440891 - DNA, 19 bp, Homo sapiens
gaaaaatctcattatttca

SEQ ID NO: 4440892 - DNA, 20 bp, Homo sapiens
gaaaaatctcattatttcaa

SEQ ID NO: 4440893 - DNA, 17 bp, Homo sapiens
gaaaaatgctccccaca

SEQ ID NO: 4440894 - DNA, 19 bp, Homo sapiens
gaaaaatgggtcttttata

SEQ ID NO: 4440895 - DNA, 15 bp, Homo sapiens
gaaaaatgttcttta

SEQ ID NO: 4440896 - DNA, 16 bp, Homo sapiens
gaaaaattaattagga

SEQ ID NO: 4440897 - DNA, 15 bp, Homo sapiens
gaaaaattgtctttc

SEQ ID NO: 4440898 - DNA, 20 bp, Homo sapiens
gaaaaatttataagccaaag

SEQ ID NO: 4440899 - DNA, 12 bp, Homo sapiens
gaaaacaaaaaa

SEQ ID NO: 4440900 - DNA, 20 bp, Homo sapiens
gaaaacaatggggctggttt

SEQ ID NO: 4440901 - DNA, 18 bp, Homo sapiens
gaaaacactatttccaaa

SEQ ID NO: 4440902 - DNA, 21 bp, Homo sapiens
gaaaacactgtgcacatctgt

SEQ ID NO: 4440903 - DNA, 19 bp, Homo sapiens
gaaaacaggaaaaaaactt

SEQ ID NO: 4440904 - DNA, 23 bp, Homo sapiens
gaaaacaggaaaaaaacttttat

SEQ ID NO: 4440905 - DNA, 16 bp, Homo sapiens
gaaaacatgtactaca

SEQ ID NO: 4440906 - DNA, 21 bp, Homo sapiens
gaaaaccaaaatgacatcttt

SEQ ID NO: 4440907 - DNA, 17 bp, Homo sapiens
gaaaacccaagttttta

SEQ ID NO: 4440908 - DNA, 12 bp, Homo sapiens
gaaaacccagag

SEQ ID NO: 4440909 - DNA, 15 bp, Homo sapiens
gaaaacccagagagg

SEQ ID NO: 4440910 - DNA, 22 bp, Homo sapiens
gaaaacccagagaggaatcaga

SEQ ID NO: 4440911 - DNA, 19 bp, Homo sapiens
gaaaaccgtaaagtgcctt

SEQ ID NO: 4440912 - DNA, 15 bp, Homo sapiens
gaaaacctttcttca

SEQ ID NO: 4440913 - DNA, 22 bp, Homo sapiens
gaaaacgggcagtctgctctgc

SEQ ID NO: 4440914 - DNA, 20 bp, Homo sapiens
gaaaactattaagatgagca

SEQ ID NO: 4440915 - DNA, 22 bp, Homo sapiens
gaaaactcatgatcaagatata

SEQ ID NO: 4440916 - DNA, 16 bp, Homo sapiens
gaaaactgacagagga

SEQ ID NO: 4440917 - DNA, 22 bp, Homo sapiens
gaaaactgaccatcagtatatt

SEQ ID NO: 4440918 - DNA, 12 bp, Homo sapiens
gaaaactttaaa

SEQ ID NO: 4440919 - DNA, 16 bp, Homo sapiens
gaaaagaaaacaaaaa

SEQ ID NO: 4440920 - DNA, 19 bp, Homo sapiens
gaaaagacagggtgggagg

SEQ ID NO: 4440921 - DNA, 24 bp, Homo sapiens
gaaaagacagggtgggagggagga

SEQ ID NO: 4440922 - DNA, 16 bp, Homo sapiens
gaaaagactccaaaga

SEQ ID NO: 4440923 - DNA, 18 bp, Homo sapiens
gaaaagactccaaagaaa

SEQ ID NO: 4440924 - DNA, 20 bp, Homo sapiens
gaaaagactccaaagaaatg

SEQ ID NO: 4440925 - DNA, 21 bp, Homo sapiens
gaaaagactccaaagaaatgt

SEQ ID NO: 4440926 - DNA, 19 bp, Homo sapiens
gaaaagataaagaccagaa

SEQ ID NO: 4440927 - DNA, 22 bp, Homo sapiens
gaaaagataaagaccagaaatt

SEQ ID NO: 4440928 - DNA, 14 bp, Homo sapiens
gaaaagcacagagg

SEQ ID NO: 4440929 - DNA, 16 bp, Homo sapiens
gaaaagcagacatttt

SEQ ID NO: 4440930 - DNA, 21 bp, Homo sapiens
gaaaaggctaagaaaaaggaa

SEQ ID NO: 4440931 - DNA, 14 bp, Homo sapiens
gaaaagtaatgaag

SEQ ID NO: 4440932 - DNA, 23 bp, Homo sapiens
gaaaagtagacaatcattgtttt

SEQ ID NO: 4440933 - DNA, 20 bp, Homo sapiens
gaaaagtatattgataacct

SEQ ID NO: 4440934 - DNA, 16 bp, Homo sapiens
gaaaagtcgttttcca

SEQ ID NO: 4440935 - DNA, 16 bp, Homo sapiens
gaaaagtgaattgaag

SEQ ID NO: 4440936 - DNA, 19 bp, Homo sapiens
gaaaagtgatgtattttca

SEQ ID NO: 4440937 - DNA, 18 bp, Homo sapiens
gaaaataaaacacacctc

SEQ ID NO: 4440938 - DNA, 17 bp, Homo sapiens
gaaaataaacagacaaa

SEQ ID NO: 4440939 - DNA, 22 bp, Homo sapiens
gaaaataaacagacaaaaacaa

SEQ ID NO: 4440940 - DNA, 23 bp, Homo sapiens
gaaaataaagacaaccatattta

SEQ ID NO: 4440941 - DNA, 12 bp, Homo sapiens
gaaaataacaga

SEQ ID NO: 4440942 - DNA, 15 bp, Homo sapiens
gaaaataactgaatt

SEQ ID NO: 4440943 - DNA, 13 bp, Homo sapiens
gaaaataaggcac

SEQ ID NO: 4440944 - DNA, 21 bp, Homo sapiens
gaaaataatattatttaaact

SEQ ID NO: 4440945 - DNA, 15 bp, Homo sapiens
gaaaataccagtgtt

SEQ ID NO: 4440946 - DNA, 16 bp, Homo sapiens
gaaaatagtgtaagaa

SEQ ID NO: 4440947 - DNA, 20 bp, Homo sapiens
gaaaatagtgtaagaactgt

SEQ ID NO: 4440948 - DNA, 14 bp, Homo sapiens
gaaaatataagtaa

SEQ ID NO: 4440949 - DNA, 22 bp, Homo sapiens
gaaaatatgtactgtataacat

SEQ ID NO: 4440950 - DNA, 13 bp, Homo sapiens
gaaaatattctct

SEQ ID NO: 4440951 - DNA, 20 bp, Homo sapiens
gaaaatattctctatttgaa

SEQ ID NO: 4440952 - DNA, 15 bp, Homo sapiens
gaaaatgacatttta

SEQ ID NO: 4440953 - DNA, 18 bp, Homo sapiens
gaaaatgagaaaggacag

SEQ ID NO: 4440954 - DNA, 19 bp, Homo sapiens
gaaaatgagaaaggacaga

SEQ ID NO: 4440955 - DNA, 12 bp, Homo sapiens
gaaaatgagccc

SEQ ID NO: 4440956 - DNA, 18 bp, Homo sapiens
gaaaatgagccctggctc

SEQ ID NO: 4440957 - DNA, 22 bp, Homo sapiens
gaaaatgagccctggctcccac

SEQ ID NO: 4440958 - DNA, 23 bp, Homo sapiens
gaaaatgagtttttatggggctg

SEQ ID NO: 4440959 - DNA, 21 bp, Homo sapiens
gaaaatgattcctggacatca

SEQ ID NO: 4440960 - DNA, 19 bp, Homo sapiens
gaaaatgcttaaaaaataa

SEQ ID NO: 4440961 - DNA, 13 bp, Homo sapiens
gaaaatgcttatt

SEQ ID NO: 4440962 - DNA, 23 bp, Homo sapiens
gaaaatgcttattgatgaggttt

SEQ ID NO: 4440963 - DNA, 22 bp, Homo sapiens
gaaaatggatatagaaaatctt

SEQ ID NO: 4440964 - DNA, 23 bp, Homo sapiens
gaaaatgggatgtgctgttttct

SEQ ID NO: 4440965 - DNA, 22 bp, Homo sapiens
gaaaatggtcgagaaagaggca

SEQ ID NO: 4440966 - DNA, 14 bp, Homo sapiens
gaaaatgtccagga

SEQ ID NO: 4440967 - DNA, 14 bp, Homo sapiens
gaaaatgtcttgtg

SEQ ID NO: 4440968 - DNA, 15 bp, Homo sapiens
gaaaatgttctgttt

SEQ ID NO: 4440969 - DNA, 15 bp, Homo sapiens
gaaaatgttgagaat

SEQ ID NO: 4440970 - DNA, 23 bp, Homo sapiens
gaaaattacatgttttttcattt

SEQ ID NO: 4440971 - DNA, 16 bp, Homo sapiens
gaaaattacgttctta

SEQ ID NO: 4440972 - DNA, 11 bp, Homo sapiens
gaaaattattt

SEQ ID NO: 4440973 - DNA, 12 bp, Homo sapiens
gaaaattatttt

SEQ ID NO: 4440974 - DNA, 14 bp, Homo sapiens
gaaaattgtatacc

SEQ ID NO: 4440975 - DNA, 13 bp, Homo sapiens
gaaaatttaacag

SEQ ID NO: 4440976 - DNA, 23 bp, Homo sapiens
gaaaattttaagaagaaagattt

SEQ ID NO: 4440977 - DNA, 20 bp, Homo sapiens
gaaaattttatgtattttaa

SEQ ID NO: 4440978 - DNA, 17 bp, Homo sapiens
gaaacaactctttgaga

SEQ ID NO: 4440979 - DNA, 14 bp, Homo sapiens
gaaacacagaaacc

SEQ ID NO: 4440980 - DNA, 20 bp, Homo sapiens
gaaacactttgcctcctgtg

SEQ ID NO: 4440981 - DNA, 22 bp, Homo sapiens
gaaacactttgcctcctgtgta

SEQ ID NO: 4440982 - DNA, 17 bp, Homo sapiens
gaaacagagtggcctcc

SEQ ID NO: 4440983 - DNA, 20 bp, Homo sapiens
gaaacagagtggcctccctg

SEQ ID NO: 4440984 - DNA, 21 bp, Homo sapiens
gaaacagagtggcctccctgc

SEQ ID NO: 4440985 - DNA, 20 bp, Homo sapiens
gaaacagattcaggccagcc

SEQ ID NO: 4440986 - DNA, 23 bp, Homo sapiens
gaaacagattcaggccagcccag

SEQ ID NO: 4440987 - DNA, 16 bp, Homo sapiens
gaaacagcctctctct

SEQ ID NO: 4440988 - DNA, 16 bp, Homo sapiens
gaaacagctgccttag

SEQ ID NO: 4440989 - DNA, 18 bp, Homo sapiens
gaaacagggacaaagaaa

SEQ ID NO: 4440990 - DNA, 16 bp, Homo sapiens
gaaacagttggcactg

SEQ ID NO: 4440991 - DNA, 20 bp, Homo sapiens
gaaacagttggtaacttttg

SEQ ID NO: 4440992 - DNA, 13 bp, Homo sapiens
gaaacattttgat

SEQ ID NO: 4440993 - DNA, 19 bp, Homo sapiens
gaaaccaccgtgaaccaga

SEQ ID NO: 4440994 - DNA, 20 bp, Homo sapiens
gaaaccaccgtgaaccagag

SEQ ID NO: 4440995 - DNA, 14 bp, Homo sapiens
gaaaccagtattta

SEQ ID NO: 4440996 - DNA, 21 bp, Homo sapiens
gaaaccagtatttaagcttta

SEQ ID NO: 4440997 - DNA, 18 bp, Homo sapiens
gaaacctagtactgcccc

SEQ ID NO: 4440998 - DNA, 16 bp, Homo sapiens
gaaacctcttcctagg

SEQ ID NO: 4440999 - DNA, 14 bp, Homo sapiens
gaaactaaacagaa

SEQ ID NO: 4441000 - DNA, 17 bp, Homo sapiens
gaaactaagattctttt

SEQ ID NO: 4441001 - DNA, 13 bp, Homo sapiens
cttgtccccaccc

SEQ ID NO: 4441002 - DNA, 19 bp, Homo sapiens
cttgtccccacccatgcgc

SEQ ID NO: 4441003 - DNA, 16 bp, Homo sapiens
cttgtcctcttctgct

SEQ ID NO: 4441004 - DNA, 22 bp, Homo sapiens
cttgtcctcttctgctcttttc

SEQ ID NO: 4441005 - DNA, 15 bp, Homo sapiens
cttgtcggccccacc

SEQ ID NO: 4441006 - DNA, 20 bp, Homo sapiens
cttgtcggccccaccagtgc

SEQ ID NO: 4441007 - DNA, 19 bp, Homo sapiens
cttgtctgtgatctctgct

SEQ ID NO: 4441008 - DNA, 13 bp, Homo sapiens
cttgtcttgaaaa

SEQ ID NO: 4441009 - DNA, 13 bp, Homo sapiens
cttgtgaactttg

SEQ ID NO: 4441010 - DNA, 19 bp, Homo sapiens
cttgtgaatgcttctcact

SEQ ID NO: 4441011 - DNA, 22 bp, Homo sapiens
cttgtgagagcccattcccacc

SEQ ID NO: 4441012 - DNA, 20 bp, Homo sapiens
cttgtgagagtggctttcta

SEQ ID NO: 4441013 - DNA, 19 bp, Homo sapiens
cttgtgagcatcagagggc

SEQ ID NO: 4441014 - DNA, 21 bp, Homo sapiens
cttgtgagcatcagagggctg

SEQ ID NO: 4441015 - DNA, 23 bp, Homo sapiens
cttgtgatttctttaaaagaatg

SEQ ID NO: 4441016 - DNA, 23 bp, Homo sapiens
cttgtgccaaacctactaggcca

SEQ ID NO: 4441017 - DNA, 12 bp, Homo sapiens
cttgtggagccc

SEQ ID NO: 4441018 - DNA, 13 bp, Homo sapiens
cttgtggagcccc

SEQ ID NO: 4441019 - DNA, 16 bp, Homo sapiens
cttgtggataagtggc

SEQ ID NO: 4441020 - DNA, 18 bp, Homo sapiens
cttgtgggcactgtgcca

SEQ ID NO: 4441021 - DNA, 19 bp, Homo sapiens
cttgtggggctaaggcagg

SEQ ID NO: 4441022 - DNA, 14 bp, Homo sapiens
cttgtgggtccatg

SEQ ID NO: 4441023 - DNA, 21 bp, Homo sapiens
cttgtgtagatttgaaaattg

SEQ ID NO: 4441024 - DNA, 10 bp, Homo sapiens
cttgtgtctg

SEQ ID NO: 4441025 - DNA, 15 bp, Homo sapiens
cttgtgtgtgtacct

SEQ ID NO: 4441026 - DNA, 16 bp, Homo sapiens
cttgtgtgtgtacctg

SEQ ID NO: 4441027 - DNA, 15 bp, Homo sapiens
cttgtgttcaatctg

SEQ ID NO: 4441028 - DNA, 16 bp, Homo sapiens
cttgtgttcaatctgt

SEQ ID NO: 4441029 - DNA, 20 bp, Homo sapiens
cttgtgttgcactgaacagg

SEQ ID NO: 4441030 - DNA, 21 bp, Homo sapiens
cttgtgtttctttagtttttg

SEQ ID NO: 4441031 - DNA, 22 bp, Homo sapiens
cttgttacaaattttttaattt

SEQ ID NO: 4441032 - DNA, 14 bp, Homo sapiens
cttgttactgctga

SEQ ID NO: 4441033 - DNA, 19 bp, Homo sapiens
cttgttatggtagaaaaat

SEQ ID NO: 4441034 - DNA, 22 bp, Homo sapiens
cttgttattaatgtttcttctc

SEQ ID NO: 4441035 - DNA, 13 bp, Homo sapiens
cttgttcatatgg

SEQ ID NO: 4441036 - DNA, 14 bp, Homo sapiens
cttgttcctgtgca

SEQ ID NO: 4441037 - DNA, 19 bp, Homo sapiens
cttgttctgagattcaata

SEQ ID NO: 4441038 - DNA, 23 bp, Homo sapiens
cttgttggatttttgtcttgtgt

SEQ ID NO: 4441039 - DNA, 14 bp, Homo sapiens
cttgttgtattcct

SEQ ID NO: 4441040 - DNA, 23 bp, Homo sapiens
cttgttgtttgttgacagcttgg

SEQ ID NO: 4441041 - DNA, 16 bp, Homo sapiens
cttgtttaatggtagt

SEQ ID NO: 4441042 - DNA, 19 bp, Homo sapiens
cttgtttacagcactactc

SEQ ID NO: 4441043 - DNA, 19 bp, Homo sapiens
cttgtttatgatatttctt

SEQ ID NO: 4441044 - DNA, 23 bp, Homo sapiens
cttgtttatgatatttcttgctt

SEQ ID NO: 4441045 - DNA, 12 bp, Homo sapiens
cttgtttattga

SEQ ID NO: 4441046 - DNA, 21 bp, Homo sapiens
cttgtttgagtttttcctccc

SEQ ID NO: 4441047 - DNA, 22 bp, Homo sapiens
cttgtttgagtttttcctccca

SEQ ID NO: 4441048 - DNA, 23 bp, Homo sapiens
cttgtttgattttagctgcagaa

SEQ ID NO: 4441049 - DNA, 21 bp, Homo sapiens
cttgtttggtttggtttgctt

SEQ ID NO: 4441050 - DNA, 17 bp, Homo sapiens
cttgtttgttactgtca

SEQ ID NO: 4441051 - DNA, 20 bp, Homo sapiens
cttgtttgttactgtcattc

SEQ ID NO: 4441052 - DNA, 23 bp, Homo sapiens
cttgtttttataataaaaagctt

SEQ ID NO: 4441053 - DNA, 16 bp, Homo sapiens
cttgtttttcttcagc

SEQ ID NO: 4441054 - DNA, 18 bp, Homo sapiens
cttgtttttcttcagcat

SEQ ID NO: 4441055 - DNA, 17 bp, Homo sapiens
ctttaaaaacaggccag

SEQ ID NO: 4441056 - DNA, 14 bp, Homo sapiens
ctttaaaaactgtt

SEQ ID NO: 4441057 - DNA, 15 bp, Homo sapiens
ctttaaaaatacata

SEQ ID NO: 4441058 - DNA, 12 bp, Homo sapiens
ctttaaaaatgt

SEQ ID NO: 4441059 - DNA, 16 bp, Homo sapiens
ctttaaataaattaag

SEQ ID NO: 4441060 - DNA, 17 bp, Homo sapiens
ctttaaataaattaaga

SEQ ID NO: 4441061 - DNA, 12 bp, Homo sapiens
ctttaaatcatt

SEQ ID NO: 4441062 - DNA, 15 bp, Homo sapiens
ctttaaatctgtgat

SEQ ID NO: 4441063 - DNA, 17 bp, Homo sapiens
ctttaaatggaataatt

SEQ ID NO: 4441064 - DNA, 17 bp, Homo sapiens
ctttaaatgtgtatttc

SEQ ID NO: 4441065 - DNA, 18 bp, Homo sapiens
ctttaaatgtgtatttct

SEQ ID NO: 4441066 - DNA, 12 bp, Homo sapiens
ctttaaattata

SEQ ID NO: 4441067 - DNA, 21 bp, Homo sapiens
ctttaactgccgtaatttaac

SEQ ID NO: 4441068 - DNA, 13 bp, Homo sapiens
ctttaactgtcat

SEQ ID NO: 4441069 - DNA, 19 bp, Homo sapiens
ctttaacttttttttctct

SEQ ID NO: 4441070 - DNA, 12 bp, Homo sapiens
ctttaagaaaaa

SEQ ID NO: 4441071 - DNA, 23 bp, Homo sapiens
ctttaagacatactccttccatc

SEQ ID NO: 4441072 - DNA, 19 bp, Homo sapiens
ctttaagagtttaaaatca

SEQ ID NO: 4441073 - DNA, 19 bp, Homo sapiens
ctttaatattttgtaatat

SEQ ID NO: 4441074 - DNA, 20 bp, Homo sapiens
ctttaatattttgtaatatt

SEQ ID NO: 4441075 - DNA, 16 bp, Homo sapiens
ctttaattttaactga

SEQ ID NO: 4441076 - DNA, 21 bp, Homo sapiens
ctttacaaaccattacctgta

SEQ ID NO: 4441077 - DNA, 15 bp, Homo sapiens
ctttacaactaaata

SEQ ID NO: 4441078 - DNA, 17 bp, Homo sapiens
ctttacaactaaataac

SEQ ID NO: 4441079 - DNA, 13 bp, Homo sapiens
ctttaccaaaaac

SEQ ID NO: 4441080 - DNA, 17 bp, Homo sapiens
ctttaccaaatgaaatg

SEQ ID NO: 4441081 - DNA, 23 bp, Homo sapiens
ctttaccaaatgaaatgccaaag

SEQ ID NO: 4441082 - DNA, 23 bp, Homo sapiens
ctttacttttgctgtttatactt

SEQ ID NO: 4441083 - DNA, 16 bp, Homo sapiens
ctttactttttccatt

SEQ ID NO: 4441084 - DNA, 13 bp, Homo sapiens
ctttagaaaatat

SEQ ID NO: 4441085 - DNA, 18 bp, Homo sapiens
ctttagaaaatataagta

SEQ ID NO: 4441086 - DNA, 22 bp, Homo sapiens
ctttagaaataaaccttaatat

SEQ ID NO: 4441087 - DNA, 15 bp, Homo sapiens
ctttagaagcctgca

SEQ ID NO: 4441088 - DNA, 18 bp, Homo sapiens
ctttagaatgagagtgtg

SEQ ID NO: 4441089 - DNA, 22 bp, Homo sapiens
ctttagaatgagagtgtgaaat

SEQ ID NO: 4441090 - DNA, 20 bp, Homo sapiens
ctttagaccctcgggcccca

SEQ ID NO: 4441091 - DNA, 12 bp, Homo sapiens
ctttagattaaa

SEQ ID NO: 4441092 - DNA, 12 bp, Homo sapiens
ctttagctctct

SEQ ID NO: 4441093 - DNA, 19 bp, Homo sapiens
ctttaggggaagtaaaaca

SEQ ID NO: 4441094 - DNA, 22 bp, Homo sapiens
ctttaggggaagtaaaacagtc

SEQ ID NO: 4441095 - DNA, 18 bp, Homo sapiens
ctttagggttctgcctct

SEQ ID NO: 4441096 - DNA, 18 bp, Homo sapiens
ctttaggtttttttaatg

SEQ ID NO: 4441097 - DNA, 21 bp, Homo sapiens
ctttataaatctttctctcac

SEQ ID NO: 4441098 - DNA, 18 bp, Homo sapiens
ctttataactaacatgtc

SEQ ID NO: 4441099 - DNA, 17 bp, Homo sapiens
ctttatagtgaagtgtt

SEQ ID NO: 4441100 - DNA, 23 bp, Homo sapiens
ctttatagtgaagtgttaataca

SEQ ID NO: 4441101 - DNA, 21 bp, Homo sapiens
ctttatagtgcacaaaatgaa

SEQ ID NO: 4441102 - DNA, 21 bp, Homo sapiens
ctttatatcttgtttacaata

SEQ ID NO: 4441103 - DNA, 19 bp, Homo sapiens
ctttatatgaacatagact

SEQ ID NO: 4441104 - DNA, 14 bp, Homo sapiens
ctttatcaatgtgt

SEQ ID NO: 4441105 - DNA, 21 bp, Homo sapiens
ctttatcatgaatgcttttag

SEQ ID NO: 4441106 - DNA, 19 bp, Homo sapiens
ctttatccccgtttcttgc

SEQ ID NO: 4441107 - DNA, 13 bp, Homo sapiens
ctttatctgtaat

SEQ ID NO: 4441108 - DNA, 18 bp, Homo sapiens
ctttatctttcacctttc

SEQ ID NO: 4441109 - DNA, 15 bp, Homo sapiens
ctttatgagcagcaa

SEQ ID NO: 4441110 - DNA, 18 bp, Homo sapiens
ctttatgattttcataac

SEQ ID NO: 4441111 - DNA, 20 bp, Homo sapiens
ctttatggtcctaaaagcaa

SEQ ID NO: 4441112 - DNA, 14 bp, Homo sapiens
ctttatgtgaattt

SEQ ID NO: 4441113 - DNA, 15 bp, Homo sapiens
ctttatgtgaatttt

SEQ ID NO: 4441114 - DNA, 17 bp, Homo sapiens
ctttattaaaacaaaag

SEQ ID NO: 4441115 - DNA, 13 bp, Homo sapiens
ctttattaccagt

SEQ ID NO: 4441116 - DNA, 15 bp, Homo sapiens
ctttattataaaatg

SEQ ID NO: 4441117 - DNA, 21 bp, Homo sapiens
ctttattgaattagaaaatta

SEQ ID NO: 4441118 - DNA, 16 bp, Homo sapiens
ctttattgcagaatgt

SEQ ID NO: 4441119 - DNA, 21 bp, Homo sapiens
ctttgaatattttttgaaggt

SEQ ID NO: 4441120 - DNA, 17 bp, Homo sapiens
ctttgaatgttaatttt

SEQ ID NO: 4441121 - DNA, 23 bp, Homo sapiens
ctttgacaaaatgactggctcct

SEQ ID NO: 4441122 - DNA, 14 bp, Homo sapiens
ctttgacacccagg

SEQ ID NO: 4441123 - DNA, 22 bp, Homo sapiens
ctttgacacttttcatatcatt

SEQ ID NO: 4441124 - DNA, 15 bp, Homo sapiens
ctttgaccagcacat

SEQ ID NO: 4441125 - DNA, 14 bp, Homo sapiens
ctttgactctgggg

SEQ ID NO: 4441126 - DNA, 15 bp, Homo sapiens
ctttgagaggctgag

SEQ ID NO: 4441127 - DNA, 19 bp, Homo sapiens
ctttgagcccattcttctg

SEQ ID NO: 4441128 - DNA, 21 bp, Homo sapiens
ctttgagcccattcttctggg

SEQ ID NO: 4441129 - DNA, 22 bp, Homo sapiens
ctttgatatgtgagcaacattt

SEQ ID NO: 4441130 - DNA, 23 bp, Homo sapiens
ctttgatgtggatgaaaaaaagg

SEQ ID NO: 4441131 - DNA, 20 bp, Homo sapiens
ctttgattaaagactccagt

SEQ ID NO: 4441132 - DNA, 12 bp, Homo sapiens
ctttgattcata

SEQ ID NO: 4441133 - DNA, 14 bp, Homo sapiens
ctttgattccattt

SEQ ID NO: 4441134 - DNA, 19 bp, Homo sapiens
ctttgatttagattgagta

SEQ ID NO: 4441135 - DNA, 19 bp, Homo sapiens
ctttgcaaagtattgtaaa

SEQ ID NO: 4441136 - DNA, 21 bp, Homo sapiens
ctttgcaaagtattgtaaatt

SEQ ID NO: 4441137 - DNA, 22 bp, Homo sapiens
ctttgcaaagtattgtaaatta

SEQ ID NO: 4441138 - DNA, 13 bp, Homo sapiens
ctttgcaatagca

SEQ ID NO: 4441139 - DNA, 15 bp, Homo sapiens
ctttgcaatccaaat

SEQ ID NO: 4441140 - DNA, 19 bp, Homo sapiens
ctttgcaatccaaataaag

SEQ ID NO: 4441141 - DNA, 19 bp, Homo sapiens
ctttgcacactttggccca

SEQ ID NO: 4441142 - DNA, 22 bp, Homo sapiens
ctttgcacactttggcccaggg

SEQ ID NO: 4441143 - DNA, 16 bp, Homo sapiens
ctttgcaccaaagaca

SEQ ID NO: 4441144 - DNA, 13 bp, Homo sapiens
ctttgcagctgct

SEQ ID NO: 4441145 - DNA, 14 bp, Homo sapiens
ctttgcagctgctg

SEQ ID NO: 4441146 - DNA, 21 bp, Homo sapiens
ctttgcagttggactctcagg

SEQ ID NO: 4441147 - DNA, 22 bp, Homo sapiens
ctttgcatgttccactaacccc

SEQ ID NO: 4441148 - DNA, 16 bp, Homo sapiens
ctttgccaaaatacca

SEQ ID NO: 4441149 - DNA, 22 bp, Homo sapiens
ctttgccaaaataccagagcct

SEQ ID NO: 4441150 - DNA, 18 bp, Homo sapiens
ctttgccagcagagccag

SEQ ID NO: 4441151 - DNA, 23 bp, Homo sapiens
ctttgccagcagagccagggcag

SEQ ID NO: 4441152 - DNA, 19 bp, Homo sapiens
ctttgccagtcattcagca

SEQ ID NO: 4441153 - DNA, 18 bp, Homo sapiens
ctttgccgtgagcatgca

SEQ ID NO: 4441154 - DNA, 18 bp, Homo sapiens
ctttgcctctgcagtctc

SEQ ID NO: 4441155 - DNA, 21 bp, Homo sapiens
ctttgcctcttctttgtgcct

SEQ ID NO: 4441156 - DNA, 23 bp, Homo sapiens
ctttgcctcttctttgtgccttt

SEQ ID NO: 4441157 - DNA, 20 bp, Homo sapiens
ctttgcgggatatttagggt

SEQ ID NO: 4441158 - DNA, 17 bp, Homo sapiens
ctgtataacattaagaa

SEQ ID NO: 4441159 - DNA, 20 bp, Homo sapiens
ctgtataagacactttgcca

SEQ ID NO: 4441160 - DNA, 19 bp, Homo sapiens
ctgtataatagagataagt

SEQ ID NO: 4441161 - DNA, 18 bp, Homo sapiens
ctgtataatctatttaca

SEQ ID NO: 4441162 - DNA, 20 bp, Homo sapiens
ctgtataattaattgtcatt

SEQ ID NO: 4441163 - DNA, 13 bp, Homo sapiens
ctgtatacagtgc

SEQ ID NO: 4441164 - DNA, 15 bp, Homo sapiens
ctgtatataaaggtg

SEQ ID NO: 4441165 - DNA, 15 bp, Homo sapiens
ctgtatataaatata

SEQ ID NO: 4441166 - DNA, 14 bp, Homo sapiens
ctgtatattcagga

SEQ ID NO: 4441167 - DNA, 16 bp, Homo sapiens
ctgtatatttctttta

SEQ ID NO: 4441168 - DNA, 21 bp, Homo sapiens
ctgtatatttgtatgatattt

SEQ ID NO: 4441169 - DNA, 15 bp, Homo sapiens
ctgtatattttgtag

SEQ ID NO: 4441170 - DNA, 21 bp, Homo sapiens
ctgtatcaataaaattctgta

SEQ ID NO: 4441171 - DNA, 23 bp, Homo sapiens
ctgtatcaggacccagaggaagg

SEQ ID NO: 4441172 - DNA, 17 bp, Homo sapiens
ctgtatcctgaaaggca

SEQ ID NO: 4441173 - DNA, 13 bp, Homo sapiens
ctgtatctgtgct

SEQ ID NO: 4441174 - DNA, 20 bp, Homo sapiens
ctgtatgaaaaattggggag

SEQ ID NO: 4441175 - DNA, 21 bp, Homo sapiens
ctgtatgaaaaattggggagg

SEQ ID NO: 4441176 - DNA, 19 bp, Homo sapiens
ctgtatgttatagaacttc

SEQ ID NO: 4441177 - DNA, 15 bp, Homo sapiens
ctgtattaagccact

SEQ ID NO: 4441178 - DNA, 16 bp, Homo sapiens
ctgtattcttgtttga

SEQ ID NO: 4441179 - DNA, 19 bp, Homo sapiens
ctgtattcttgtttgaatt

SEQ ID NO: 4441180 - DNA, 17 bp, Homo sapiens
ctgtatttaagcaaata

SEQ ID NO: 4441181 - DNA, 20 bp, Homo sapiens
ctgtatttcagtattttcca

SEQ ID NO: 4441182 - DNA, 15 bp, Homo sapiens
ctgtatttctttgta

SEQ ID NO: 4441183 - DNA, 22 bp, Homo sapiens
ctgtatttctttgtagaataaa

SEQ ID NO: 4441184 - DNA, 13 bp, Homo sapiens
ctgtattttgata

SEQ ID NO: 4441185 - DNA, 22 bp, Homo sapiens
ctgtatttttttttctaagaga

SEQ ID NO: 4441186 - DNA, 12 bp, Homo sapiens
ctgtcacaataa

SEQ ID NO: 4441187 - DNA, 14 bp, Homo sapiens
ctgtcacaataaag

SEQ ID NO: 4441188 - DNA, 21 bp, Homo sapiens
ctgtcacagtaaaaataaaat

SEQ ID NO: 4441189 - DNA, 14 bp, Homo sapiens
ctgtcaccaagctc

SEQ ID NO: 4441190 - DNA, 19 bp, Homo sapiens
ctgtcacctagaacgtgca

SEQ ID NO: 4441191 - DNA, 13 bp, Homo sapiens
ctgtcacctctca

SEQ ID NO: 4441192 - DNA, 21 bp, Homo sapiens
ctgtcacggggttccctccta

SEQ ID NO: 4441193 - DNA, 22 bp, Homo sapiens
ctgtcactttttttctttttct

SEQ ID NO: 4441194 - DNA, 13 bp, Homo sapiens
ctgtcagaataaa

SEQ ID NO: 4441195 - DNA, 21 bp, Homo sapiens
ctgtcagaataaaaatgtggt

SEQ ID NO: 4441196 - DNA, 12 bp, Homo sapiens
ctgtcagattaa

SEQ ID NO: 4441197 - DNA, 14 bp, Homo sapiens
ctgtcagattaaat

SEQ ID NO: 4441198 - DNA, 15 bp, Homo sapiens
ctgtcagattaaatt

SEQ ID NO: 4441199 - DNA, 12 bp, Homo sapiens
ctgtcagccagc

SEQ ID NO: 4441200 - DNA, 17 bp, Homo sapiens
ctgtcagccagccgccc

SEQ ID NO: 4441201 - DNA, 22 bp, Homo sapiens
ctgtcagccagccgccctgggc

SEQ ID NO: 4441202 - DNA, 23 bp, Homo sapiens
ctgtcagccagccgccctgggct

SEQ ID NO: 4441203 - DNA, 15 bp, Homo sapiens
ctgtcagcctgactc

SEQ ID NO: 4441204 - DNA, 23 bp, Homo sapiens
ctgtcagctcccctcggagaaga

SEQ ID NO: 4441205 - DNA, 16 bp, Homo sapiens
ctgtcagtatgacatt

SEQ ID NO: 4441206 - DNA, 12 bp, Homo sapiens
ctgtcagtgtca

SEQ ID NO: 4441207 - DNA, 13 bp, Homo sapiens
ctgtcagtgtcac

SEQ ID NO: 4441208 - DNA, 19 bp, Homo sapiens
ctgtcatccatatttgcta

SEQ ID NO: 4441209 - DNA, 21 bp, Homo sapiens
ctgtcatcctcaaagaaagtg

SEQ ID NO: 4441210 - DNA, 22 bp, Homo sapiens
ctgtcatcctcaaagaaagtgt

SEQ ID NO: 4441211 - DNA, 14 bp, Homo sapiens
ctgtcatctaaagt

SEQ ID NO: 4441212 - DNA, 23 bp, Homo sapiens
ctgtcatggtcctttctggaagt

SEQ ID NO: 4441213 - DNA, 16 bp, Homo sapiens
ctgtcattatattcta

SEQ ID NO: 4441214 - DNA, 23 bp, Homo sapiens
ctgtcattcccaccaccctgagg

SEQ ID NO: 4441215 - DNA, 22 bp, Homo sapiens
ctgtcattcctaaaacaccctt

SEQ ID NO: 4441216 - DNA, 17 bp, Homo sapiens
ctgtcatttgaacctgg

SEQ ID NO: 4441217 - DNA, 19 bp, Homo sapiens
ctgtccaatatgaaaaccg

SEQ ID NO: 4441218 - DNA, 20 bp, Homo sapiens
ctgtccacacccagctcagc

SEQ ID NO: 4441219 - DNA, 12 bp, Homo sapiens
ctgtccagaaag

SEQ ID NO: 4441220 - DNA, 15 bp, Homo sapiens
ctgtccagctggggc

SEQ ID NO: 4441221 - DNA, 17 bp, Homo sapiens
ctgtccagggaaacagc

SEQ ID NO: 4441222 - DNA, 19 bp, Homo sapiens
ctgtccagggaaacagcct

SEQ ID NO: 4441223 - DNA, 18 bp, Homo sapiens
ctgtcccactacatctgg

SEQ ID NO: 4441224 - DNA, 20 bp, Homo sapiens
ctgtcccactacatctggga

SEQ ID NO: 4441225 - DNA, 13 bp, Homo sapiens
ctgtcccagcccc

SEQ ID NO: 4441226 - DNA, 20 bp, Homo sapiens
ctgtcccaggccggcccaga

SEQ ID NO: 4441227 - DNA, 14 bp, Homo sapiens
ctgtcccattctag

SEQ ID NO: 4441228 - DNA, 15 bp, Homo sapiens
ctgtcccattctaga

SEQ ID NO: 4441229 - DNA, 16 bp, Homo sapiens
ctgtccccaaacagga

SEQ ID NO: 4441230 - DNA, 13 bp, Homo sapiens
ctgtccccactgc

SEQ ID NO: 4441231 - DNA, 14 bp, Homo sapiens
ctgtccccactgcc

SEQ ID NO: 4441232 - DNA, 15 bp, Homo sapiens
ctgtccccactgccc

SEQ ID NO: 4441233 - DNA, 16 bp, Homo sapiens
ctgtcccccaggctgg

SEQ ID NO: 4441234 - DNA, 20 bp, Homo sapiens
ctgtccccttctctcatctc

SEQ ID NO: 4441235 - DNA, 21 bp, Homo sapiens
ctgtccctccgggacctggtg

SEQ ID NO: 4441236 - DNA, 19 bp, Homo sapiens
ctgtccctctagtgccttc

SEQ ID NO: 4441237 - DNA, 17 bp, Homo sapiens
ctgtccctgtcaccaag

SEQ ID NO: 4441238 - DNA, 18 bp, Homo sapiens
ctgtccctgtccttccct

SEQ ID NO: 4441239 - DNA, 16 bp, Homo sapiens
ctgtcccttttccctt

SEQ ID NO: 4441240 - DNA, 17 bp, Homo sapiens
ctgtccggcccagtgcc

SEQ ID NO: 4441241 - DNA, 23 bp, Homo sapiens
ctgtccggcccagtgccactgcc

SEQ ID NO: 4441242 - DNA, 22 bp, Homo sapiens
ctgtccgtagtatcagagatgt

SEQ ID NO: 4441243 - DNA, 21 bp, Homo sapiens
ctgtccgttcacatgtgtggt

SEQ ID NO: 4441244 - DNA, 18 bp, Homo sapiens
ctgtcctaccatcagctc

SEQ ID NO: 4441245 - DNA, 19 bp, Homo sapiens
ctgtcctaccatcagctct

SEQ ID NO: 4441246 - DNA, 21 bp, Homo sapiens
ctgtcctaccatcagctctgc

SEQ ID NO: 4441247 - DNA, 21 bp, Homo sapiens
ctgtcctcctggtgggtccag

SEQ ID NO: 4441248 - DNA, 17 bp, Homo sapiens
ctgtcctctcgagccca

SEQ ID NO: 4441249 - DNA, 15 bp, Homo sapiens
ctgtcctgcacaccc

SEQ ID NO: 4441250 - DNA, 16 bp, Homo sapiens
ctgtcctgcacaccct

SEQ ID NO: 4441251 - DNA, 19 bp, Homo sapiens
ctgtcctgcacaccctggg

SEQ ID NO: 4441252 - DNA, 21 bp, Homo sapiens
ctgtcctgcacaccctgggcc

SEQ ID NO: 4441253 - DNA, 17 bp, Homo sapiens
ctgtcctgtaactgtta

SEQ ID NO: 4441254 - DNA, 19 bp, Homo sapiens
ctgtccttaacccacctct

SEQ ID NO: 4441255 - DNA, 21 bp, Homo sapiens
ctgtccttaacccacctctcc

SEQ ID NO: 4441256 - DNA, 19 bp, Homo sapiens
ctgtccttgaatgccatag

SEQ ID NO: 4441257 - DNA, 14 bp, Homo sapiens
ctgtcgcccaggct

SEQ ID NO: 4441258 - DNA, 15 bp, Homo sapiens
ctgtcgccccaggcc

SEQ ID NO: 4441259 - DNA, 14 bp, Homo sapiens
ctgtcgcccctcct

SEQ ID NO: 4441260 - DNA, 15 bp, Homo sapiens
ctgtcgctctcagtt

SEQ ID NO: 4441261 - DNA, 13 bp, Homo sapiens
ctgtctacatttc

SEQ ID NO: 4441262 - DNA, 20 bp, Homo sapiens
ctgtctacatttctgcagat

SEQ ID NO: 4441263 - DNA, 19 bp, Homo sapiens
ctgtctaggttaaagctaa

SEQ ID NO: 4441264 - DNA, 20 bp, Homo sapiens
ctgtctatactacagtagtt

SEQ ID NO: 4441265 - DNA, 19 bp, Homo sapiens
ctgtctatatcataactat

SEQ ID NO: 4441266 - DNA, 17 bp, Homo sapiens
ctgtctcaaaccctggc

SEQ ID NO: 4441267 - DNA, 22 bp, Homo sapiens
ctgtctcatccacataagcact

SEQ ID NO: 4441268 - DNA, 14 bp, Homo sapiens
ctgtctcatcccca

SEQ ID NO: 4441269 - DNA, 20 bp, Homo sapiens
ctgtctcatccccaggggtc

SEQ ID NO: 4441270 - DNA, 17 bp, Homo sapiens
ctgtctccagggccccc

SEQ ID NO: 4441271 - DNA, 19 bp, Homo sapiens
ctgtctgaatgatcttgtg

SEQ ID NO: 4441272 - DNA, 22 bp, Homo sapiens
ctgtggtgtgtccccctctgtc

SEQ ID NO: 4441273 - DNA, 16 bp, Homo sapiens
ctgtggttcctctgct

SEQ ID NO: 4441274 - DNA, 18 bp, Homo sapiens
ctgtgtaacatctgccat

SEQ ID NO: 4441275 - DNA, 18 bp, Homo sapiens
ctgtgtaactttctctta

SEQ ID NO: 4441276 - DNA, 21 bp, Homo sapiens
ctgtgtaactttctcttaaga

SEQ ID NO: 4441277 - DNA, 20 bp, Homo sapiens
ctgtgtacataactgaaaat

SEQ ID NO: 4441278 - DNA, 22 bp, Homo sapiens
ctgtgtacataactgaaaatgt

SEQ ID NO: 4441279 - DNA, 22 bp, Homo sapiens
ctgtgtactggagcctgcatta

SEQ ID NO: 4441280 - DNA, 16 bp, Homo sapiens
ctggtagcagcaggct

SEQ ID NO: 4441281 - DNA, 19 bp, Homo sapiens
ctggtagcagcaggctcag

SEQ ID NO: 4441282 - DNA, 17 bp, Homo sapiens
ctggtagcctgcagaag

SEQ ID NO: 4441283 - DNA, 23 bp, Homo sapiens
ctggtatattattgcttcatgtt

SEQ ID NO: 4441284 - DNA, 21 bp, Homo sapiens
ctggtatgcattctttatagt

SEQ ID NO: 4441285 - DNA, 19 bp, Homo sapiens
ctggtcacagcctcctctg

SEQ ID NO: 4441286 - DNA, 20 bp, Homo sapiens
ctggtcaccgagactcagcc

SEQ ID NO: 4441287 - DNA, 23 bp, Homo sapiens
ctggtcaccgagactcagcctct

SEQ ID NO: 4441288 - DNA, 13 bp, Homo sapiens
ctggtcagagaga

SEQ ID NO: 4441289 - DNA, 16 bp, Homo sapiens
ctggtcagagagacct

SEQ ID NO: 4441290 - DNA, 22 bp, Homo sapiens
ctggtcagagagacctcatcct

SEQ ID NO: 4441291 - DNA, 23 bp, Homo sapiens
ctggtcagagagacctcatcctg

SEQ ID NO: 4441292 - DNA, 22 bp, Homo sapiens
ctggtccagggaagctggccga

SEQ ID NO: 4441293 - DNA, 20 bp, Homo sapiens
ctggtcccctcccccatccc

SEQ ID NO: 4441294 - DNA, 19 bp, Homo sapiens
ctggtcccggggccagcac

SEQ ID NO: 4441295 - DNA, 20 bp, Homo sapiens
ctggtccggacactcctaga

SEQ ID NO: 4441296 - DNA, 21 bp, Homo sapiens
ctggtccggacactcctagag

SEQ ID NO: 4441297 - DNA, 22 bp, Homo sapiens
ctggtctcaaacttgtggcctc

SEQ ID NO: 4441298 - DNA, 14 bp, Homo sapiens
ctggtctcagcagc

SEQ ID NO: 4441299 - DNA, 23 bp, Homo sapiens
ctggtctgatggaactgtgtatt

SEQ ID NO: 4441300 - DNA, 21 bp, Homo sapiens
ctggtctggttgggcagccag

SEQ ID NO: 4441301 - DNA, 16 bp, Homo sapiens
ctggtcttcctttttg

SEQ ID NO: 4441302 - DNA, 17 bp, Homo sapiens
ctggtcttcctttttgg

SEQ ID NO: 4441303 - DNA, 15 bp, Homo sapiens
ctggtgagcagggga

SEQ ID NO: 4441304 - DNA, 24 bp, Homo sapiens
ctggtgagtcaccacttcagggct

SEQ ID NO: 4441305 - DNA, 21 bp, Homo sapiens
ctggtgataaaaataaagctg

SEQ ID NO: 4441306 - DNA, 14 bp, Homo sapiens
ctggtgcaggtctc

SEQ ID NO: 4441307 - DNA, 21 bp, Homo sapiens
ctggtgcaggtctccacctgc

SEQ ID NO: 4441308 - DNA, 15 bp, Homo sapiens
ctggtgctactccat

SEQ ID NO: 4441309 - DNA, 17 bp, Homo sapiens
ctggtgctactccatgc

SEQ ID NO: 4441310 - DNA, 14 bp, Homo sapiens
ctggtgctgcctct

SEQ ID NO: 4441311 - DNA, 12 bp, Homo sapiens
ctggtggaggaa

SEQ ID NO: 4441312 - DNA, 16 bp, Homo sapiens
ctggtggaggaagggc

SEQ ID NO: 4441313 - DNA, 20 bp, Homo sapiens
ctggtggaggaagggctggg

SEQ ID NO: 4441314 - DNA, 21 bp, Homo sapiens
ctggtggaggaagggctgggc

SEQ ID NO: 4441315 - DNA, 13 bp, Homo sapiens
ctggtggcaccag

SEQ ID NO: 4441316 - DNA, 23 bp, Homo sapiens
ctggtgggtcggccgccatagcc

SEQ ID NO: 4441317 - DNA, 21 bp, Homo sapiens
ctggtggtgcagccttcccct

SEQ ID NO: 4441318 - DNA, 21 bp, Homo sapiens
ctggtgtagtgtgtcagctct

SEQ ID NO: 4441319 - DNA, 11 bp, Homo sapiens
ctggtgtcccc

SEQ ID NO: 4441320 - DNA, 18 bp, Homo sapiens
ctggtgtccccttcccct

SEQ ID NO: 4441321 - DNA, 24 bp, Homo sapiens
ctggtgtttctagcactggcctgc

SEQ ID NO: 4441322 - DNA, 14 bp, Homo sapiens
ctggttactttcaa

SEQ ID NO: 4441323 - DNA, 13 bp, Homo sapiens
ctggttcacctga

SEQ ID NO: 4441324 - DNA, 12 bp, Homo sapiens
ctggttcctaca

SEQ ID NO: 4441325 - DNA, 23 bp, Homo sapiens
ctggttcggatttggggtggatt

SEQ ID NO: 4441326 - DNA, 16 bp, Homo sapiens
ctggttctcatctttc

SEQ ID NO: 4441327 - DNA, 21 bp, Homo sapiens
ctggttgttgcaccatctgct

SEQ ID NO: 4441328 - DNA, 22 bp, Homo sapiens
ctggttgttgcaccatctgctt

SEQ ID NO: 4441329 - DNA, 14 bp, Homo sapiens
ctggtttaatgttt

SEQ ID NO: 4441330 - DNA, 18 bp, Homo sapiens
ctggtttaattcagcaga

SEQ ID NO: 4441331 - DNA, 13 bp, Homo sapiens
ctggtttctcctg

SEQ ID NO: 4441332 - DNA, 14 bp, Homo sapiens
ctggtttctcctgg

SEQ ID NO: 4441333 - DNA, 15 bp, Homo sapiens
ctggtttgtttctca

SEQ ID NO: 4441334 - DNA, 14 bp, Homo sapiens
ctggtttttcagtt

SEQ ID NO: 4441335 - DNA, 20 bp, Homo sapiens
ctggtttttggattaaatta

SEQ ID NO: 4441336 - DNA, 14 bp, Homo sapiens
ctgtaaaactttat

SEQ ID NO: 4441337 - DNA, 21 bp, Homo sapiens
ctgtaaaagtgtacagactct

SEQ ID NO: 4441338 - DNA, 15 bp, Homo sapiens
ctgtaaaatccattt

SEQ ID NO: 4441339 - DNA, 23 bp, Homo sapiens
ctgtaaaatgcaccaatcagcag

SEQ ID NO: 4441340 - DNA, 14 bp, Homo sapiens
ctgtaaaatttgtg

SEQ ID NO: 4441341 - DNA, 21 bp, Homo sapiens
ctgtaaaatttgtgtaaattt

SEQ ID NO: 4441342 - DNA, 22 bp, Homo sapiens
ctgtaaaatttgtgtaaatttg

SEQ ID NO: 4441343 - DNA, 16 bp, Homo sapiens
ctgtaaagacaaataa

SEQ ID NO: 4441344 - DNA, 16 bp, Homo sapiens
ctgtaaagatgtttat

SEQ ID NO: 4441345 - DNA, 21 bp, Homo sapiens
ctgtaaagttcaattgtgaaa

SEQ ID NO: 4441346 - DNA, 21 bp, Homo sapiens
ctgtaaatatccctcccctct

SEQ ID NO: 4441347 - DNA, 11 bp, Homo sapiens
ctgtaaatcat

SEQ ID NO: 4441348 - DNA, 17 bp, Homo sapiens
ctgtaaatctaacatta

SEQ ID NO: 4441349 - DNA, 20 bp, Homo sapiens
ctgtaaatctaacattatta

SEQ ID NO: 4441350 - DNA, 18 bp, Homo sapiens
ctgtaaatctacacacgg

SEQ ID NO: 4441351 - DNA, 17 bp, Homo sapiens
ctgtaaattattttaaa

SEQ ID NO: 4441352 - DNA, 22 bp, Homo sapiens
ctgtaaattattttaaattata

SEQ ID NO: 4441353 - DNA, 23 bp, Homo sapiens
ctgtaacaagttccattatgaaa

SEQ ID NO: 4441354 - DNA, 23 bp, Homo sapiens
ctgtaacctcttcagaggccctc

SEQ ID NO: 4441355 - DNA, 17 bp, Homo sapiens
ctgtaactactttataa

SEQ ID NO: 4441356 - DNA, 21 bp, Homo sapiens
ctgtaagccaaagaaatgaac

SEQ ID NO: 4441357 - DNA, 21 bp, Homo sapiens
ctgtaaggatccggaaagaag

SEQ ID NO: 4441358 - DNA, 18 bp, Homo sapiens
ctgtaaggtgcttgctcc

SEQ ID NO: 4441359 - DNA, 19 bp, Homo sapiens
ctgtaaggtgcttgctccc

SEQ ID NO: 4441360 - DNA, 20 bp, Homo sapiens
ctgtaaggtgcttgctcccc

SEQ ID NO: 4441361 - DNA, 22 bp, Homo sapiens
ctgtaatatatttatatacttt

SEQ ID NO: 4441362 - DNA, 18 bp, Homo sapiens
ctgtaatatttacaatgt

SEQ ID NO: 4441363 - DNA, 13 bp, Homo sapiens
ctgtaatcccaga

SEQ ID NO: 4441364 - DNA, 16 bp, Homo sapiens
ctgtaatcccagcact

SEQ ID NO: 4441365 - DNA, 22 bp, Homo sapiens
ctgtaatcccagcactttgaga

SEQ ID NO: 4441366 - DNA, 20 bp, Homo sapiens
ctgtaatcttttatttaagt

SEQ ID NO: 4441367 - DNA, 23 bp, Homo sapiens
ctgtaatgatactgattatgaaa

SEQ ID NO: 4441368 - DNA, 22 bp, Homo sapiens
ctgtaatgtaactatctcacct

SEQ ID NO: 4441369 - DNA, 19 bp, Homo sapiens
ctgtaattaaactagttta

SEQ ID NO: 4441370 - DNA, 12 bp, Homo sapiens
ctgtaattgtgt

SEQ ID NO: 4441371 - DNA, 15 bp, Homo sapiens
ctgtacacagtgccc

SEQ ID NO: 4441372 - DNA, 17 bp, Homo sapiens
ctgtacacatttcttaa

SEQ ID NO: 4441373 - DNA, 24 bp, Homo sapiens
ctgtacacatttcttaaaacacat

SEQ ID NO: 4441374 - DNA, 16 bp, Homo sapiens
ctgtacagcagttcac

SEQ ID NO: 4441375 - DNA, 16 bp, Homo sapiens
ctgtacatacaaattc

SEQ ID NO: 4441376 - DNA, 20 bp, Homo sapiens
ctgtacatatttgagactag

SEQ ID NO: 4441377 - DNA, 18 bp, Homo sapiens
ctgtacatttgcaattag

SEQ ID NO: 4441378 - DNA, 18 bp, Homo sapiens
ctgtaccagttaattttt

SEQ ID NO: 4441379 - DNA, 18 bp, Homo sapiens
ctgtactaaggagcatga

SEQ ID NO: 4441380 - DNA, 18 bp, Homo sapiens
ctgtactatttaaaatgc

SEQ ID NO: 4441381 - DNA, 13 bp, Homo sapiens
ctgtactggccaa

SEQ ID NO: 4441382 - DNA, 16 bp, Homo sapiens
ctgtacttcttgaata

SEQ ID NO: 4441383 - DNA, 19 bp, Homo sapiens
ctgtagaaaagggaactga

SEQ ID NO: 4441384 - DNA, 22 bp, Homo sapiens
ctgtagaaaggggagaatgtca

SEQ ID NO: 4441385 - DNA, 18 bp, Homo sapiens
ctgtagacggctcagtat

SEQ ID NO: 4441386 - DNA, 20 bp, Homo sapiens
ctgtagagcatggttccagt

SEQ ID NO: 4441387 - DNA, 21 bp, Homo sapiens
ctgtagagctagaacatggag

SEQ ID NO: 4441388 - DNA, 19 bp, Homo sapiens
ctgtagcaatggccagagc

SEQ ID NO: 4441389 - DNA, 21 bp, Homo sapiens
ctgtagcaatggccagagcct

SEQ ID NO: 4441390 - DNA, 13 bp, Homo sapiens
ctgtagccacagc

SEQ ID NO: 4441391 - DNA, 16 bp, Homo sapiens
ctgtagcttatctgcc

SEQ ID NO: 4441392 - DNA, 18 bp, Homo sapiens
ctgtagcttatctgcccc

SEQ ID NO: 4441393 - DNA, 21 bp, Homo sapiens
ctgtagcttatctgcccctcc

SEQ ID NO: 4441394 - DNA, 22 bp, Homo sapiens
ctgtagctttcctggtccctca

SEQ ID NO: 4441395 - DNA, 22 bp, Homo sapiens
ctgtaggagctacccttttcct

SEQ ID NO: 4441396 - DNA, 19 bp, Homo sapiens
ctgggcctcggaccccact

SEQ ID NO: 4441397 - DNA, 20 bp, Homo sapiens
ctgggcctgaccaaacagcc

SEQ ID NO: 4441398 - DNA, 16 bp, Homo sapiens
ctgggcctgcccctgt

SEQ ID NO: 4441399 - DNA, 22 bp, Homo sapiens
ctgggctaaggaagtatcagca

SEQ ID NO: 4441400 - DNA, 20 bp, Homo sapiens
ctgggctaggtagaaaaagg

SEQ ID NO: 4441401 - DNA, 18 bp, Homo sapiens
ctgggctcggaggctgcc

SEQ ID NO: 4441402 - DNA, 20 bp, Homo sapiens
ctgggctctccacctcagcc

SEQ ID NO: 4441403 - DNA, 18 bp, Homo sapiens
ctgggctgagggagcctg

SEQ ID NO: 4441404 - DNA, 13 bp, Homo sapiens
ctgggctggcgct

SEQ ID NO: 4441405 - DNA, 14 bp, Homo sapiens
ctgggctggcgctt

SEQ ID NO: 4441406 - DNA, 14 bp, Homo sapiens
ctgggctgggccct

SEQ ID NO: 4441407 - DNA, 17 bp, Homo sapiens
ctgggctgggccctctt

SEQ ID NO: 4441408 - DNA, 18 bp, Homo sapiens
ctgggctgggtgctggga

SEQ ID NO: 4441409 - DNA, 19 bp, Homo sapiens
ctgggctgggtgctgggaa

SEQ ID NO: 4441410 - DNA, 22 bp, Homo sapiens
ctgggcttatatctggcctctg

SEQ ID NO: 4441411 - DNA, 15 bp, Homo sapiens
ctgggcttggcctgc

SEQ ID NO: 4441412 - DNA, 19 bp, Homo sapiens
ctgggcttggtaagtgaat

SEQ ID NO: 4441413 - DNA, 23 bp, Homo sapiens
ctgggctttttttttctctttct

SEQ ID NO: 4441414 - DNA, 19 bp, Homo sapiens
ctggggaaagacgccttca

SEQ ID NO: 4441415 - DNA, 17 bp, Homo sapiens
ctggggaagaacagccc

SEQ ID NO: 4441416 - DNA, 23 bp, Homo sapiens
ctggggacacacattctgccttg

SEQ ID NO: 4441417 - DNA, 13 bp, Homo sapiens
ctggggacagagg

SEQ ID NO: 4441418 - DNA, 14 bp, Homo sapiens
ctggggacagaggg

SEQ ID NO: 4441419 - DNA, 22 bp, Homo sapiens
ctggggacggggggccccagtc

SEQ ID NO: 4441420 - DNA, 18 bp, Homo sapiens
ctggggacgttgctgagc

SEQ ID NO: 4441421 - DNA, 20 bp, Homo sapiens
ctggggacgttgctgagcca

SEQ ID NO: 4441422 - DNA, 24 bp, Homo sapiens
ctggggacgttgctgagccagctg

SEQ ID NO: 4441423 - DNA, 13 bp, Homo sapiens
ctggggactcagg

SEQ ID NO: 4441424 - DNA, 21 bp, Homo sapiens
ctggggacttcaactgcccag

SEQ ID NO: 4441425 - DNA, 22 bp, Homo sapiens
ctggggacttcaactgcccagc

SEQ ID NO: 4441426 - DNA, 22 bp, Homo sapiens
ctggggagataaaaagattaag

SEQ ID NO: 4441427 - DNA, 16 bp, Homo sapiens
ctggggagcccactga

SEQ ID NO: 4441428 - DNA, 12 bp, Homo sapiens
ctggggagctgt

SEQ ID NO: 4441429 - DNA, 21 bp, Homo sapiens
ctggggaggaatcctggacca

SEQ ID NO: 4441430 - DNA, 15 bp, Homo sapiens
ctggggaggctgagg

SEQ ID NO: 4441431 - DNA, 20 bp, Homo sapiens
ctggggaggctgaggcagga

SEQ ID NO: 4441432 - DNA, 22 bp, Homo sapiens
ctggggagtaaacggcccaggc

SEQ ID NO: 4441433 - DNA, 16 bp, Homo sapiens
ctggggatgtctctca

SEQ ID NO: 4441434 - DNA, 18 bp, Homo sapiens
ctggggcagacaataaac

SEQ ID NO: 4441435 - DNA, 15 bp, Homo sapiens
ctggggcaggctggg

SEQ ID NO: 4441436 - DNA, 18 bp, Homo sapiens
ctggggcaggctgggcca

SEQ ID NO: 4441437 - DNA, 19 bp, Homo sapiens
ctggggcaggctgggccat

SEQ ID NO: 4441438 - DNA, 15 bp, Homo sapiens
ctggggccacctttg

SEQ ID NO: 4441439 - DNA, 17 bp, Homo sapiens
ctggggccacctttgtg

SEQ ID NO: 4441440 - DNA, 18 bp, Homo sapiens
ctggggccacctttgtgc

SEQ ID NO: 4441441 - DNA, 14 bp, Homo sapiens
ctggggccagaggc

SEQ ID NO: 4441442 - DNA, 17 bp, Homo sapiens
ctggggccagaggctgg

SEQ ID NO: 4441443 - DNA, 19 bp, Homo sapiens
ctggggccagaggctggga

SEQ ID NO: 4441444 - DNA, 14 bp, Homo sapiens
ctggggcccagccc

SEQ ID NO: 4441445 - DNA, 17 bp, Homo sapiens
ctggggccctgggcctc

SEQ ID NO: 4441446 - DNA, 18 bp, Homo sapiens
ctggggccctgggcctca

SEQ ID NO: 4441447 - DNA, 19 bp, Homo sapiens
ctggggccctgggcctcag

SEQ ID NO: 4441448 - DNA, 22 bp, Homo sapiens
ctggggccggttttcctcagct

SEQ ID NO: 4441449 - DNA, 22 bp, Homo sapiens
ctggggcctagcgatctctcct

SEQ ID NO: 4441450 - DNA, 22 bp, Homo sapiens
ctggggctgacacccaggcccg

SEQ ID NO: 4441451 - DNA, 20 bp, Homo sapiens
ctggggctgaggctgaggca

SEQ ID NO: 4441452 - DNA, 20 bp, Homo sapiens
ctggggctgagtctccaggg

SEQ ID NO: 4441453 - DNA, 17 bp, Homo sapiens
ctgggggaagccctgga

SEQ ID NO: 4441454 - DNA, 20 bp, Homo sapiens
ctgggggatagaggggctgc

SEQ ID NO: 4441455 - DNA, 20 bp, Homo sapiens
ctgggggctgccgagccacc

SEQ ID NO: 4441456 - DNA, 23 bp, Homo sapiens
ctgggggcttcgcttccttagcc

SEQ ID NO: 4441457 - DNA, 16 bp, Homo sapiens
ctgggggtggcaggca

SEQ ID NO: 4441458 - DNA, 17 bp, Homo sapiens
ctgggggtggcaggcac

SEQ ID NO: 4441459 - DNA, 13 bp, Homo sapiens
ctgggggtgggaa

SEQ ID NO: 4441460 - DNA, 15 bp, Homo sapiens
ctggggtcacagagg

SEQ ID NO: 4441461 - DNA, 14 bp, Homo sapiens
ctggggtgcatctc

SEQ ID NO: 4441462 - DNA, 18 bp, Homo sapiens
ctggggtgcatctcctcc

SEQ ID NO: 4441463 - DNA, 15 bp, Homo sapiens
ctggggtgccgcctg

SEQ ID NO: 4441464 - DNA, 19 bp, Homo sapiens
ctggggtgccgcctgcccg

SEQ ID NO: 4441465 - DNA, 12 bp, Homo sapiens
ctggggtgcctt

SEQ ID NO: 4441466 - DNA, 23 bp, Homo sapiens
ctggggtgggagtaacagggcag

SEQ ID NO: 4441467 - DNA, 11 bp, Homo sapiens
ctggggtgtca

SEQ ID NO: 4441468 - DNA, 15 bp, Homo sapiens
ctggggttcagcccc

SEQ ID NO: 4441469 - DNA, 17 bp, Homo sapiens
ctggggttcagcccctc

SEQ ID NO: 4441470 - DNA, 14 bp, Homo sapiens
ctggggttgccaga

SEQ ID NO: 4441471 - DNA, 17 bp, Homo sapiens
ctggggttgccagaggc

SEQ ID NO: 4441472 - DNA, 18 bp, Homo sapiens
ctggggttgccagaggcc

SEQ ID NO: 4441473 - DNA, 17 bp, Homo sapiens
ctggggtttgaagctga

SEQ ID NO: 4441474 - DNA, 16 bp, Homo sapiens
ctgggtaagaagggtg

SEQ ID NO: 4441475 - DNA, 18 bp, Homo sapiens
ctgggtaagaagggtggg

SEQ ID NO: 4441476 - DNA, 20 bp, Homo sapiens
ctgggtaagaagggtgggag

SEQ ID NO: 4441477 - DNA, 23 bp, Homo sapiens
ctgggtaagaagggtgggagtgg

SEQ ID NO: 4441478 - DNA, 18 bp, Homo sapiens
ctgggtaatgaaacaaag

SEQ ID NO: 4441479 - DNA, 17 bp, Homo sapiens
ctgggtcagtctggtgg

SEQ ID NO: 4441480 - DNA, 18 bp, Homo sapiens
ctgggtcagtctggtggg

SEQ ID NO: 4441481 - DNA, 21 bp, Homo sapiens
ctgggtcatgggcctgtgggg

SEQ ID NO: 4441482 - DNA, 13 bp, Homo sapiens
ctgggtccaggga

SEQ ID NO: 4441483 - DNA, 15 bp, Homo sapiens
ctgggtccagggagg

SEQ ID NO: 4441484 - DNA, 13 bp, Homo sapiens
ctgggtccatatc

SEQ ID NO: 4441485 - DNA, 16 bp, Homo sapiens
ctgggtcctgccagct

SEQ ID NO: 4441486 - DNA, 19 bp, Homo sapiens
ctgggtctgaggcccctgc

SEQ ID NO: 4441487 - DNA, 21 bp, Homo sapiens
ctgggtctgaggcccctgcct

SEQ ID NO: 4441488 - DNA, 23 bp, Homo sapiens
ctgggtctgaggcccctgcctcc

SEQ ID NO: 4441489 - DNA, 13 bp, Homo sapiens
ctgggtctggcca

SEQ ID NO: 4441490 - DNA, 18 bp, Homo sapiens
ctgggtctggccagggct

SEQ ID NO: 4441491 - DNA, 14 bp, Homo sapiens
ctgggtctgggttt

SEQ ID NO: 4441492 - DNA, 13 bp, Homo sapiens
ctgggtcttcagc

SEQ ID NO: 4441493 - DNA, 12 bp, Homo sapiens
ctgggtgatgga

SEQ ID NO: 4441494 - DNA, 20 bp, Homo sapiens
ctgggtgctgatccttgcac

SEQ ID NO: 4441495 - DNA, 13 bp, Homo sapiens
ctgggtgggctct

SEQ ID NO: 4441496 - DNA, 18 bp, Homo sapiens
ctgggtgtcaagtgcctg

SEQ ID NO: 4441497 - DNA, 21 bp, Homo sapiens
ctgggtgtcatttcattccat

SEQ ID NO: 4441498 - DNA, 14 bp, Homo sapiens
ctgggttccctttc

SEQ ID NO: 4441499 - DNA, 20 bp, Homo sapiens
ctgggttccctttccttcca

SEQ ID NO: 4441500 - DNA, 18 bp, Homo sapiens
ctgggtttctaagcagtt

SEQ ID NO: 4441501 - DNA, 17 bp, Homo sapiens
ctgggtttctagaggtc

SEQ ID NO: 4441502 - DNA, 23 bp, Homo sapiens
ctggtaaacattcctccagcctc

SEQ ID NO: 4441503 - DNA, 15 bp, Homo sapiens
ctggtaagattgtta

SEQ ID NO: 4441504 - DNA, 15 bp, Homo sapiens
ctggtaagcagaggc

SEQ ID NO: 4441505 - DNA, 16 bp, Homo sapiens
ctggtaagcagaggct

SEQ ID NO: 4441506 - DNA, 21 bp, Homo sapiens
ctggtaataaatgtgactcag

SEQ ID NO: 4441507 - DNA, 14 bp, Homo sapiens
ctggtaatagctgt

SEQ ID NO: 4441508 - DNA, 19 bp, Homo sapiens
ctggtacttagagtttctg

SEQ ID NO: 4441509 - DNA, 17 bp, Homo sapiens
ctggtagaggggccggc

SEQ ID NO: 4441510 - DNA, 15 bp, Homo sapiens
ctggtagcagcaggc

SEQ ID NO: 4441511 - DNA, 15 bp, Homo sapiens
ctggctccactcttg

SEQ ID NO: 4441512 - DNA, 23 bp, Homo sapiens
ctggctccactcttgatctctct

SEQ ID NO: 4441513 - DNA, 24 bp, Homo sapiens
ctggctccccctccccaggctgga

SEQ ID NO: 4441514 - DNA, 23 bp, Homo sapiens
ctggctccctcctccaggcctgc

SEQ ID NO: 4441515 - DNA, 15 bp, Homo sapiens
ctggctcctgagggg

SEQ ID NO: 4441516 - DNA, 16 bp, Homo sapiens
ctggctcctgaggggc

SEQ ID NO: 4441517 - DNA, 17 bp, Homo sapiens
ctggctcctgaggggca

SEQ ID NO: 4441518 - DNA, 17 bp, Homo sapiens
ctggctcggacccaccc

SEQ ID NO: 4441519 - DNA, 22 bp, Homo sapiens
ctggctcggacccaccccaact

SEQ ID NO: 4441520 - DNA, 21 bp, Homo sapiens
ctggctctaccttcctgtccc

SEQ ID NO: 4441521 - DNA, 14 bp, Homo sapiens
ctggctctgcctca

SEQ ID NO: 4441522 - DNA, 23 bp, Homo sapiens
ctgcccaggccacagagaacctg

SEQ ID NO: 4441523 - DNA, 21 bp, Homo sapiens
ctgcccaggcctctcggtgct

SEQ ID NO: 4441524 - DNA, 13 bp, Homo sapiens
ctgcccagttgca

SEQ ID NO: 4441525 - DNA, 22 bp, Homo sapiens
ctgcccatcacagggttgggcc

SEQ ID NO: 4441526 - DNA, 16 bp, Homo sapiens
ctgccccaactcctgg

SEQ ID NO: 4441527 - DNA, 17 bp, Homo sapiens
ctgccccaactcctgga

SEQ ID NO: 4441528 - DNA, 21 bp, Homo sapiens
ctgccccaatcgggtccagag

SEQ ID NO: 4441529 - DNA, 14 bp, Homo sapiens
ctgccccacatgca

SEQ ID NO: 4441530 - DNA, 15 bp, Homo sapiens
ctgccccacatgcat

SEQ ID NO: 4441531 - DNA, 22 bp, Homo sapiens
ctgccccacccaactccacagg

SEQ ID NO: 4441532 - DNA, 14 bp, Homo sapiens
ctgccccaccccat

SEQ ID NO: 4441533 - DNA, 23 bp, Homo sapiens
ctgccccaccccatccagccaga

SEQ ID NO: 4441534 - DNA, 20 bp, Homo sapiens
ctgccccacgttgtccctga

SEQ ID NO: 4441535 - DNA, 14 bp, Homo sapiens
ctgccccagccaga

SEQ ID NO: 4441536 - DNA, 14 bp, Homo sapiens
ctgccccaggggga

SEQ ID NO: 4441537 - DNA, 13 bp, Homo sapiens
ctgccccaggtac

SEQ ID NO: 4441538 - DNA, 23 bp, Homo sapiens
ctgccccaggtacacctccccct

SEQ ID NO: 4441539 - DNA, 22 bp, Homo sapiens
ctgccccattgagatcttcctg

SEQ ID NO: 4441540 - DNA, 18 bp, Homo sapiens
ctgcccccaccccttcct

SEQ ID NO: 4441541 - DNA, 23 bp, Homo sapiens
ctgcccccaccccttcctgtctc

SEQ ID NO: 4441542 - DNA, 15 bp, Homo sapiens
ctgcccccagaaagc

SEQ ID NO: 4441543 - DNA, 21 bp, Homo sapiens
ctgcccccagaaagcctcctg

SEQ ID NO: 4441544 - DNA, 13 bp, Homo sapiens
ctgcccccaggac

SEQ ID NO: 4441545 - DNA, 18 bp, Homo sapiens
ctgccccccgaggctgct

SEQ ID NO: 4441546 - DNA, 21 bp, Homo sapiens
ctgcccccgcgggttctagac

SEQ ID NO: 4441547 - DNA, 17 bp, Homo sapiens
ctgcccccggccccctg

SEQ ID NO: 4441548 - DNA, 20 bp, Homo sapiens
ctgccccctcccccatgggc

SEQ ID NO: 4441549 - DNA, 22 bp, Homo sapiens
ctgccccctcccccatgggctg

SEQ ID NO: 4441550 - DNA, 13 bp, Homo sapiens
ctgccccctcctg

SEQ ID NO: 4441551 - DNA, 13 bp, Homo sapiens
ctgccccctgcca

SEQ ID NO: 4441552 - DNA, 18 bp, Homo sapiens
ctgccccctgccagtgaa

SEQ ID NO: 4441553 - DNA, 14 bp, Homo sapiens
ctgccccctgctgg

SEQ ID NO: 4441554 - DNA, 14 bp, Homo sapiens
ctgccccgccccca

SEQ ID NO: 4441555 - DNA, 23 bp, Homo sapiens
ctgccccgcccccagtccccacc

SEQ ID NO: 4441556 - DNA, 22 bp, Homo sapiens
ctgccccggcccctccccctga

SEQ ID NO: 4441557 - DNA, 19 bp, Homo sapiens
ctgccccgtgtgtgtggcc

SEQ ID NO: 4441558 - DNA, 20 bp, Homo sapiens
ctgccccgtgtgtgtggccg

SEQ ID NO: 4441559 - DNA, 17 bp, Homo sapiens
ctgcccctaccctggac

SEQ ID NO: 4441560 - DNA, 13 bp, Homo sapiens
ctgcccctcactt

SEQ ID NO: 4441561 - DNA, 17 bp, Homo sapiens
ctgcccctcccccactt

SEQ ID NO: 4441562 - DNA, 17 bp, Homo sapiens
ctgcccctctcaccaaa

SEQ ID NO: 4441563 - DNA, 15 bp, Homo sapiens
ctgcccctgcagctg

SEQ ID NO: 4441564 - DNA, 17 bp, Homo sapiens
ctgcccctgcagctgga

SEQ ID NO: 4441565 - DNA, 22 bp, Homo sapiens
ctgccccttctacactctcctg

SEQ ID NO: 4441566 - DNA, 23 bp, Homo sapiens
ctgccccttctacactctcctgg

SEQ ID NO: 4441567 - DNA, 24 bp, Homo sapiens
ctgccccttctacactctcctggg

SEQ ID NO: 4441568 - DNA, 13 bp, Homo sapiens
ctgcccggctaca

SEQ ID NO: 4441569 - DNA, 21 bp, Homo sapiens
ctgcccgggaaggtcaccagc

SEQ ID NO: 4441570 - DNA, 18 bp, Homo sapiens
ctgcccgtctctctccca

SEQ ID NO: 4441571 - DNA, 23 bp, Homo sapiens
ctgcccgtctctctcccatggag

SEQ ID NO: 4441572 - DNA, 23 bp, Homo sapiens
ctgccctagttttctttcctcct

SEQ ID NO: 4441573 - DNA, 22 bp, Homo sapiens
ctgccctccacccacacctgcc

SEQ ID NO: 4441574 - DNA, 12 bp, Homo sapiens
ctgccctcccaa

SEQ ID NO: 4441575 - DNA, 14 bp, Homo sapiens
ctgccctcccaagt

SEQ ID NO: 4441576 - DNA, 20 bp, Homo sapiens
ctgccctccttgctggtaga

SEQ ID NO: 4441577 - DNA, 20 bp, Homo sapiens
ctgccctctagagccttcag

SEQ ID NO: 4441578 - DNA, 15 bp, Homo sapiens
ctgccctctccctgt

SEQ ID NO: 4441579 - DNA, 18 bp, Homo sapiens
ctgccctctccctgtgtt

SEQ ID NO: 4441580 - DNA, 12 bp, Homo sapiens
ctgccctctggg

SEQ ID NO: 4441581 - DNA, 16 bp, Homo sapiens
ctgccctctggggcca

SEQ ID NO: 4441582 - DNA, 17 bp, Homo sapiens
ctgccctctggggccac

SEQ ID NO: 4441583 - DNA, 17 bp, Homo sapiens
ctgccctgcctcagcca

SEQ ID NO: 4441584 - DNA, 15 bp, Homo sapiens
ctgccctggaggaag

SEQ ID NO: 4441585 - DNA, 20 bp, Homo sapiens
ctgccctggctgctgccccc

SEQ ID NO: 4441586 - DNA, 15 bp, Homo sapiens
ctgccctggtccagg

SEQ ID NO: 4441587 - DNA, 21 bp, Homo sapiens
ctgccctggtccagggaagct

SEQ ID NO: 4441588 - DNA, 16 bp, Homo sapiens
ctgccctgtcaagctt

SEQ ID NO: 4441589 - DNA, 21 bp, Homo sapiens
ctgccctgtgatatgtctgct

SEQ ID NO: 4441590 - DNA, 15 bp, Homo sapiens
ctgccctgtggacag

SEQ ID NO: 4441591 - DNA, 17 bp, Homo sapiens
ctgccctgtggacagga

SEQ ID NO: 4441592 - DNA, 12 bp, Homo sapiens
ctgcccttccct

SEQ ID NO: 4441593 - DNA, 16 bp, Homo sapiens
ctgcccttccctctgg

SEQ ID NO: 4441594 - DNA, 18 bp, Homo sapiens
ctgcccttccctctgggc

SEQ ID NO: 4441595 - DNA, 19 bp, Homo sapiens
ctgcccttttttctgcctc

SEQ ID NO: 4441596 - DNA, 15 bp, Homo sapiens
ctgccgacctcgtcc

SEQ ID NO: 4441597 - DNA, 17 bp, Homo sapiens
ctgccgacctcgtcctc

SEQ ID NO: 4441598 - DNA, 19 bp, Homo sapiens
ctgccgacctcgtcctccc

SEQ ID NO: 4441599 - DNA, 23 bp, Homo sapiens
ctgccgacttggagactcctggt

SEQ ID NO: 4441600 - DNA, 12 bp, Homo sapiens
ctgccgagccac

SEQ ID NO: 4441601 - DNA, 13 bp, Homo sapiens
ctgccgagggctg

SEQ ID NO: 4441602 - DNA, 14 bp, Homo sapiens
ctgccgagggctgg

SEQ ID NO: 4441603 - DNA, 17 bp, Homo sapiens
ctgccgagggctggccg

SEQ ID NO: 4441604 - DNA, 15 bp, Homo sapiens
ctgccgattttgtaa

SEQ ID NO: 4441605 - DNA, 15 bp, Homo sapiens
ctgccgcaccccaga

SEQ ID NO: 4441606 - DNA, 16 bp, Homo sapiens
ctgccgcaccccagag

SEQ ID NO: 4441607 - DNA, 14 bp, Homo sapiens
ctgccgcagagctg

SEQ ID NO: 4441608 - DNA, 15 bp, Homo sapiens
ctgccgcagagctgg

SEQ ID NO: 4441609 - DNA, 22 bp, Homo sapiens
ctgcagggaaaattatttgcat

SEQ ID NO: 4441610 - DNA, 17 bp, Homo sapiens
ctgcagggagccttctg

SEQ ID NO: 4441611 - DNA, 14 bp, Homo sapiens
ctgcagggcttctc

SEQ ID NO: 4441612 - DNA, 17 bp, Homo sapiens
ctgcaggtcagttgtaa

SEQ ID NO: 4441613 - DNA, 19 bp, Homo sapiens
ctgcaggtcagttgtaata

SEQ ID NO: 4441614 - DNA, 18 bp, Homo sapiens
ctgcagtcacatcacaat

SEQ ID NO: 4441615 - DNA, 15 bp, Homo sapiens
ctgcagtcacctctt

SEQ ID NO: 4441616 - DNA, 12 bp, Homo sapiens
ctgcagtcagat

SEQ ID NO: 4441617 - DNA, 12 bp, Homo sapiens
ctgcagtctcat

SEQ ID NO: 4441618 - DNA, 19 bp, Homo sapiens
ctgcagtggctcccctgcc

SEQ ID NO: 4441619 - DNA, 15 bp, Homo sapiens
ctgcagttttgctat

SEQ ID NO: 4441620 - DNA, 21 bp, Homo sapiens
ctgcagttttgctatctgggc

SEQ ID NO: 4441621 - DNA, 22 bp, Homo sapiens
ctgcatacaggggaggggcgca

SEQ ID NO: 4441622 - DNA, 20 bp, Homo sapiens
ctgcatactttttaaatgta

SEQ ID NO: 4441623 - DNA, 14 bp, Homo sapiens
ctgcatagacaaag

SEQ ID NO: 4441624 - DNA, 19 bp, Homo sapiens
ctgcatagacaaaggcctt

SEQ ID NO: 4441625 - DNA, 14 bp, Homo sapiens
ctgcatatgttgaa

SEQ ID NO: 4441626 - DNA, 20 bp, Homo sapiens
ctgcatccgtagttccctga

SEQ ID NO: 4441627 - DNA, 22 bp, Homo sapiens
ctgcatcgctgttctgggcatg

SEQ ID NO: 4441628 - DNA, 18 bp, Homo sapiens
ctgcatcttggttatttc

SEQ ID NO: 4441629 - DNA, 15 bp, Homo sapiens
ctgcatgcggcccag

SEQ ID NO: 4441630 - DNA, 19 bp, Homo sapiens
ctgcatggcatcagactag

SEQ ID NO: 4441631 - DNA, 20 bp, Homo sapiens
ctgcatgggaaatagcggcc

SEQ ID NO: 4441632 - DNA, 17 bp, Homo sapiens
ctgcatggtaatttata

SEQ ID NO: 4441633 - DNA, 21 bp, Homo sapiens
ctgcatgtactgtatattaca

SEQ ID NO: 4441634 - DNA, 16 bp, Homo sapiens
ctgcatgtcagagcac

SEQ ID NO: 4441635 - DNA, 17 bp, Homo sapiens
ctgcatgtcagagcact

SEQ ID NO: 4441636 - DNA, 23 bp, Homo sapiens
ctgcattattggaatataattgt

SEQ ID NO: 4441637 - DNA, 23 bp, Homo sapiens
ctgcattcatttttatagcaaca

SEQ ID NO: 4441638 - DNA, 15 bp, Homo sapiens
ctgcattcctgtgcc

SEQ ID NO: 4441639 - DNA, 17 bp, Homo sapiens
ctgcattgagcttgcat

SEQ ID NO: 4441640 - DNA, 23 bp, Homo sapiens
ctgcattgccgctgtataaagca

SEQ ID NO: 4441641 - DNA, 16 bp, Homo sapiens
ctgcattggttttcca

SEQ ID NO: 4441642 - DNA, 18 bp, Homo sapiens
ctgcatttataggacctt

SEQ ID NO: 4441643 - DNA, 14 bp, Homo sapiens
ctgcatttcatatt

SEQ ID NO: 4441644 - DNA, 18 bp, Homo sapiens
ctgcatttcatattattt

SEQ ID NO: 4441645 - DNA, 14 bp, Homo sapiens
ctgcatttgcctgc

SEQ ID NO: 4441646 - DNA, 15 bp, Homo sapiens
ctgcatttgcctgct

SEQ ID NO: 4441647 - DNA, 15 bp, Homo sapiens
ctgccaaacctcctg

SEQ ID NO: 4441648 - DNA, 17 bp, Homo sapiens
ctgccaaacctcctgtc

SEQ ID NO: 4441649 - DNA, 22 bp, Homo sapiens
ctgccaacctaaaactctttcg

SEQ ID NO: 4441650 - DNA, 18 bp, Homo sapiens
ctgccaagactcctcagg

SEQ ID NO: 4441651 - DNA, 19 bp, Homo sapiens
ctgccaagactcctcaggc

SEQ ID NO: 4441652 - DNA, 19 bp, Homo sapiens
ctgccaattgctaccgaga

SEQ ID NO: 4441653 - DNA, 16 bp, Homo sapiens
ctgccacacccagggg

SEQ ID NO: 4441654 - DNA, 15 bp, Homo sapiens
ctgccacacctgagc

SEQ ID NO: 4441655 - DNA, 20 bp, Homo sapiens
ctgccacacggaagcaagca

SEQ ID NO: 4441656 - DNA, 18 bp, Homo sapiens
ctgccaccaccagaaagc

SEQ ID NO: 4441657 - DNA, 14 bp, Homo sapiens
ctgccaccagcccc

SEQ ID NO: 4441658 - DNA, 16 bp, Homo sapiens
ctgccaccagcccctc

SEQ ID NO: 4441659 - DNA, 22 bp, Homo sapiens
ctgccaccagcccctccccaga

SEQ ID NO: 4441660 - DNA, 12 bp, Homo sapiens
ctgccacctccc

SEQ ID NO: 4441661 - DNA, 13 bp, Homo sapiens
ctgccacctcccc

SEQ ID NO: 4441662 - DNA, 13 bp, Homo sapiens
ctgccactcacac

SEQ ID NO: 4441663 - DNA, 19 bp, Homo sapiens
ctgccactctctgggactc

SEQ ID NO: 4441664 - DNA, 20 bp, Homo sapiens
ctgccactctctgggactct

SEQ ID NO: 4441665 - DNA, 21 bp, Homo sapiens
ctgccactctctgggactctc

SEQ ID NO: 4441666 - DNA, 19 bp, Homo sapiens
ctgccagccactgtcaccg

SEQ ID NO: 4441667 - DNA, 12 bp, Homo sapiens
ctgccagcccac

SEQ ID NO: 4441668 - DNA, 13 bp, Homo sapiens
ctgccagccttga

SEQ ID NO: 4441669 - DNA, 20 bp, Homo sapiens
ctgccagccttgagccctgg

SEQ ID NO: 4441670 - DNA, 15 bp, Homo sapiens
ctgccaggagctttg

SEQ ID NO: 4441671 - DNA, 16 bp, Homo sapiens
ctgccaggcacacaca

SEQ ID NO: 4441672 - DNA, 13 bp, Homo sapiens
ctgccaggcaggg

SEQ ID NO: 4441673 - DNA, 13 bp, Homo sapiens
ctgccaggccagc

SEQ ID NO: 4441674 - DNA, 15 bp, Homo sapiens
ctgccaggccagcct

SEQ ID NO: 4441675 - DNA, 19 bp, Homo sapiens
ctgccaggccagcctccga

SEQ ID NO: 4441676 - DNA, 13 bp, Homo sapiens
ctgccagggagct

SEQ ID NO: 4441677 - DNA, 16 bp, Homo sapiens
ctgccagggcagggcc

SEQ ID NO: 4441678 - DNA, 17 bp, Homo sapiens
ctgccagtctgccttcc

SEQ ID NO: 4441679 - DNA, 21 bp, Homo sapiens
ctgccagtgaagtccttcagt

SEQ ID NO: 4441680 - DNA, 16 bp, Homo sapiens
ctgccagtgcagccac

SEQ ID NO: 4441681 - DNA, 19 bp, Homo sapiens
ctgccagtgcagccactgg

SEQ ID NO: 4441682 - DNA, 13 bp, Homo sapiens
ctgccagtgcctg

SEQ ID NO: 4441683 - DNA, 17 bp, Homo sapiens
ctgccagtgcctgggtg

SEQ ID NO: 4441684 - DNA, 22 bp, Homo sapiens
ctgccatcatgtttacagagga

SEQ ID NO: 4441685 - DNA, 23 bp, Homo sapiens
ctgccatcatgtttacagaggac

SEQ ID NO: 4441686 - DNA, 18 bp, Homo sapiens
ctgccatcctggcccagg

SEQ ID NO: 4441687 - DNA, 22 bp, Homo sapiens
ctgccatcctggcccagggcat

SEQ ID NO: 4441688 - DNA, 17 bp, Homo sapiens
ctgccatgacagaggct

SEQ ID NO: 4441689 - DNA, 23 bp, Homo sapiens
ctgccatgacagaggctgcaccc

SEQ ID NO: 4441690 - DNA, 14 bp, Homo sapiens
ctgccatgccagga

SEQ ID NO: 4441691 - DNA, 13 bp, Homo sapiens
ctgccatgctttg

SEQ ID NO: 4441692 - DNA, 13 bp, Homo sapiens
ctgagcagcctct

SEQ ID NO: 4441693 - DNA, 15 bp, Homo sapiens
ctgagcagcctctgg

SEQ ID NO: 4441694 - DNA, 18 bp, Homo sapiens
ctgagcaggggcccctgg

SEQ ID NO: 4441695 - DNA, 20 bp, Homo sapiens
ctgagcaggggcccctgggg

SEQ ID NO: 4441696 - DNA, 20 bp, Homo sapiens
ctgagcagtgaatgattcag

SEQ ID NO: 4441697 - DNA, 20 bp, Homo sapiens
ctgagcatccagacctgagc

SEQ ID NO: 4441698 - DNA, 18 bp, Homo sapiens
ctgagccacagcagcatt

SEQ ID NO: 4441699 - DNA, 19 bp, Homo sapiens
ctgagccacagcagcattt

SEQ ID NO: 4441700 - DNA, 14 bp, Homo sapiens
ctgagccagattac

SEQ ID NO: 4441701 - DNA, 15 bp, Homo sapiens
ctgagccagattaca

SEQ ID NO: 4441702 - DNA, 16 bp, Homo sapiens
ctgagccagattacag

SEQ ID NO: 4441703 - DNA, 17 bp, Homo sapiens
ctgagccagattacagg

SEQ ID NO: 4441704 - DNA, 15 bp, Homo sapiens
ctgagccagctgcag

SEQ ID NO: 4441705 - DNA, 13 bp, Homo sapiens
ctgagccccagcg

SEQ ID NO: 4441706 - DNA, 15 bp, Homo sapiens
ctgagcccccaccgg

SEQ ID NO: 4441707 - DNA, 22 bp, Homo sapiens
ctgagcccctttgcctgtcaag

SEQ ID NO: 4441708 - DNA, 17 bp, Homo sapiens
ctgagccctcctgaggg

SEQ ID NO: 4441709 - DNA, 12 bp, Homo sapiens
ctgagccctgcc

SEQ ID NO: 4441710 - DNA, 16 bp, Homo sapiens
ctgagccggccccagg

SEQ ID NO: 4441711 - DNA, 23 bp, Homo sapiens
ctgagccggccccaggctcgtgg

SEQ ID NO: 4441712 - DNA, 20 bp, Homo sapiens
ctgagcgaggagatgctcct

SEQ ID NO: 4441713 - DNA, 18 bp, Homo sapiens
ctgagcgcccccgagccc

SEQ ID NO: 4441714 - DNA, 20 bp, Homo sapiens
ctgagcgcccccgagccctg

SEQ ID NO: 4441715 - DNA, 21 bp, Homo sapiens
ctgagcgcccccgagccctga

SEQ ID NO: 4441716 - DNA, 18 bp, Homo sapiens
ctgagcgtccagaaatgg

SEQ ID NO: 4441717 - DNA, 19 bp, Homo sapiens
ctgagctagaagctggagg

SEQ ID NO: 4441718 - DNA, 15 bp, Homo sapiens
ctgagctcggggaca

SEQ ID NO: 4441719 - DNA, 16 bp, Homo sapiens
ctgagctcggggacag

SEQ ID NO: 4441720 - DNA, 18 bp, Homo sapiens
ctgagctcggggacaggt

SEQ ID NO: 4441721 - DNA, 19 bp, Homo sapiens
ctgagctcggggacaggtg

SEQ ID NO: 4441722 - DNA, 12 bp, Homo sapiens
ctgagctgaggc

SEQ ID NO: 4441723 - DNA, 12 bp, Homo sapiens
ctgagctgtaat

SEQ ID NO: 4441724 - DNA, 21 bp, Homo sapiens
ctgagctgtaatttcgcctta

SEQ ID NO: 4441725 - DNA, 20 bp, Homo sapiens
ctgagctgtccagtggaggg

SEQ ID NO: 4441726 - DNA, 22 bp, Homo sapiens
ctgagctgtccagtggagggct

SEQ ID NO: 4441727 - DNA, 15 bp, Homo sapiens
ctgagctgtgcaggt

SEQ ID NO: 4441728 - DNA, 15 bp, Homo sapiens
ctgagctttgcatgt

SEQ ID NO: 4441729 - DNA, 18 bp, Homo sapiens
ctgaggaagaacggggct

SEQ ID NO: 4441730 - DNA, 23 bp, Homo sapiens
ctgaggaagaacggggctcttct

SEQ ID NO: 4441731 - DNA, 16 bp, Homo sapiens
ctgaggaatttcacct

SEQ ID NO: 4441732 - DNA, 14 bp, Homo sapiens
ctgaggactgattt

SEQ ID NO: 4441733 - DNA, 13 bp, Homo sapiens
ctgaggagacaac

SEQ ID NO: 4441734 - DNA, 17 bp, Homo sapiens
ctgaggagatgaccagg

SEQ ID NO: 4441735 - DNA, 20 bp, Homo sapiens
ctgaggagatgaccagggat

SEQ ID NO: 4441736 - DNA, 21 bp, Homo sapiens
ctgaggagatgaccagggatg

SEQ ID NO: 4441737 - DNA, 13 bp, Homo sapiens
ctgaggaggcctc

SEQ ID NO: 4441738 - DNA, 16 bp, Homo sapiens
ctgaggaggcctccat

SEQ ID NO: 4441739 - DNA, 18 bp, Homo sapiens
ctgatttgctggagttca

SEQ ID NO: 4441740 - DNA, 12 bp, Homo sapiens
ctgattttaatg

SEQ ID NO: 4441741 - DNA, 13 bp, Homo sapiens
ctgattttaatgg

SEQ ID NO: 4441742 - DNA, 15 bp, Homo sapiens
ctgattttttttcct

SEQ ID NO: 4441743 - DNA, 20 bp, Homo sapiens
ctgattttttttccttttaa

SEQ ID NO: 4441744 - DNA, 15 bp, Homo sapiens
ctgcaaaactccagg

SEQ ID NO: 4441745 - DNA, 17 bp, Homo sapiens
ctgcaaaaggactctca

SEQ ID NO: 4441746 - DNA, 18 bp, Homo sapiens
ctgcaaaaggagagactc

SEQ ID NO: 4441747 - DNA, 19 bp, Homo sapiens
ctgcaaaattaaatctaga

SEQ ID NO: 4441748 - DNA, 14 bp, Homo sapiens
ctgcaaaccttcct

SEQ ID NO: 4441749 - DNA, 16 bp, Homo sapiens
ctgcaaaccttcctgg

SEQ ID NO: 4441750 - DNA, 19 bp, Homo sapiens
ctgcaaaccttcctgggag

SEQ ID NO: 4441751 - DNA, 23 bp, Homo sapiens
ctgcaaagtgttttgtaccagtg

SEQ ID NO: 4441752 - DNA, 20 bp, Homo sapiens
ctgcaaatctgatggcctta

SEQ ID NO: 4441753 - DNA, 14 bp, Homo sapiens
ctgcaaatttagtt

SEQ ID NO: 4441754 - DNA, 22 bp, Homo sapiens
ctgcaacaagctcatccctgga

SEQ ID NO: 4441755 - DNA, 17 bp, Homo sapiens
ctgcaacatttgacaaa

SEQ ID NO: 4441756 - DNA, 20 bp, Homo sapiens
ctgcaaccttgtttattaaa

SEQ ID NO: 4441757 - DNA, 13 bp, Homo sapiens
ctgcaactcagcc

SEQ ID NO: 4441758 - DNA, 14 bp, Homo sapiens
ctgcaactcagccc

SEQ ID NO: 4441759 - DNA, 15 bp, Homo sapiens
ctgcaactcagcccc

SEQ ID NO: 4441760 - DNA, 16 bp, Homo sapiens
ctgcaacttccgctga

SEQ ID NO: 4441761 - DNA, 21 bp, Homo sapiens
ctgcaagaccacggagggagc

SEQ ID NO: 4441762 - DNA, 20 bp, Homo sapiens
ctgcaagagatggaaaaaaa

SEQ ID NO: 4441763 - DNA, 22 bp, Homo sapiens
ctgcaagagatggaaaaaaagt

SEQ ID NO: 4441764 - DNA, 18 bp, Homo sapiens
ctgcaagagccttggtgt

SEQ ID NO: 4441765 - DNA, 13 bp, Homo sapiens
ctgcaagatggac

SEQ ID NO: 4441766 - DNA, 22 bp, Homo sapiens
ctgcaagatggacacgagccac

SEQ ID NO: 4441767 - DNA, 22 bp, Homo sapiens
ctgcaagctccgcctcccgggt

SEQ ID NO: 4441768 - DNA, 22 bp, Homo sapiens
ctgcaagggcagaacactaacc

SEQ ID NO: 4441769 - DNA, 19 bp, Homo sapiens
ctgcaagtgtatctccttt

SEQ ID NO: 4441770 - DNA, 17 bp, Homo sapiens
ctgcaagttgctctgac

SEQ ID NO: 4441771 - DNA, 20 bp, Homo sapiens
ctgcaatacattaaaataac

SEQ ID NO: 4441772 - DNA, 16 bp, Homo sapiens
ctgcaatccaatgcac

SEQ ID NO: 4441773 - DNA, 19 bp, Homo sapiens
ctgcaattttactgtgaaa

SEQ ID NO: 4441774 - DNA, 17 bp, Homo sapiens
ctgcacaaaagcagata

SEQ ID NO: 4441775 - DNA, 23 bp, Homo sapiens
ctgcacaaaagcagatacttgag

SEQ ID NO: 4441776 - DNA, 16 bp, Homo sapiens
ctgcacacacatgcat

SEQ ID NO: 4441777 - DNA, 17 bp, Homo sapiens
ctgcacacacatgcata

SEQ ID NO: 4441778 - DNA, 14 bp, Homo sapiens
ctgcacaccagaga

SEQ ID NO: 4441779 - DNA, 16 bp, Homo sapiens
ctgcacaccctgggcc

SEQ ID NO: 4441780 - DNA, 22 bp, Homo sapiens
ctgcacagagcaagtcctcact

SEQ ID NO: 4441781 - DNA, 23 bp, Homo sapiens
ctgcacagattctttttttctgt

SEQ ID NO: 4441782 - DNA, 21 bp, Homo sapiens
ctgcacagcaggctgccagtg

SEQ ID NO: 4441783 - DNA, 16 bp, Homo sapiens
ctgcacagggcagctg

SEQ ID NO: 4441784 - DNA, 19 bp, Homo sapiens
ctgcacagggcagctgggc

SEQ ID NO: 4441785 - DNA, 20 bp, Homo sapiens
ctgcacagggcagctgggcc

SEQ ID NO: 4441786 - DNA, 22 bp, Homo sapiens
ctgcacagtcagaaggacggca

SEQ ID NO: 4441787 - DNA, 15 bp, Homo sapiens
ctgcacagttgaagg

SEQ ID NO: 4441788 - DNA, 20 bp, Homo sapiens
ctgcacagtttagaacagag

SEQ ID NO: 4441789 - DNA, 18 bp, Homo sapiens
ctgcacatctgtaaatct

SEQ ID NO: 4441790 - DNA, 17 bp, Homo sapiens
ctgcacatggcctgagc

SEQ ID NO: 4441791 - DNA, 22 bp, Homo sapiens
ctgcacattgggtggggctcct

SEQ ID NO: 4441792 - DNA, 12 bp, Homo sapiens
ctgcaccccagc

SEQ ID NO: 4441793 - DNA, 13 bp, Homo sapiens
ctgcaccccagca

SEQ ID NO: 4441794 - DNA, 17 bp, Homo sapiens
ctgcaccccagcattcc

SEQ ID NO: 4441795 - DNA, 23 bp, Homo sapiens
ctgcacccctgagttgggcagcc

SEQ ID NO: 4441796 - DNA, 14 bp, Homo sapiens
ctgcacccctgccc

SEQ ID NO: 4441797 - DNA, 13 bp, Homo sapiens
ctgcacccctggg

SEQ ID NO: 4441798 - DNA, 14 bp, Homo sapiens
ctgcacccctgggc

SEQ ID NO: 4441799 - DNA, 16 bp, Homo sapiens
ctgcacccctgggcca

SEQ ID NO: 4441800 - DNA, 17 bp, Homo sapiens
ctgcacccctgggccag

SEQ ID NO: 4441801 - DNA, 21 bp, Homo sapiens
ctgcaccccttctctcctccc

SEQ ID NO: 4441802 - DNA, 13 bp, Homo sapiens
ctgcacccttcca

SEQ ID NO: 4441803 - DNA, 18 bp, Homo sapiens
ctgcaccggggcctgggc

SEQ ID NO: 4441804 - DNA, 14 bp, Homo sapiens
ctgcacctcccccc

SEQ ID NO: 4441805 - DNA, 16 bp, Homo sapiens
ctgcacctcctaccct

SEQ ID NO: 4441806 - DNA, 21 bp, Homo sapiens
ctgcacctcctaccctcccac

SEQ ID NO: 4441807 - DNA, 24 bp, Homo sapiens
ctgcacctcctaccctcccaccag

SEQ ID NO: 4441808 - DNA, 13 bp, Homo sapiens
ctgcacctgcccc

SEQ ID NO: 4441809 - DNA, 14 bp, Homo sapiens
ctgcacctgccccg

SEQ ID NO: 4441810 - DNA, 15 bp, Homo sapiens
ctgcacctgccccgt

SEQ ID NO: 4441811 - DNA, 21 bp, Homo sapiens
ctgcaccttagaaaaaaaaag

SEQ ID NO: 4441812 - DNA, 14 bp, Homo sapiens
ctgcacgacccctg

SEQ ID NO: 4441813 - DNA, 16 bp, Homo sapiens
ctgcactcagaaaatg

SEQ ID NO: 4441814 - DNA, 13 bp, Homo sapiens
ctgcactccagcc

SEQ ID NO: 4441815 - DNA, 16 bp, Homo sapiens
ctgcactccagcctga

SEQ ID NO: 4441816 - DNA, 23 bp, Homo sapiens
ctgcactccagcctgagtgacag

SEQ ID NO: 4441817 - DNA, 18 bp, Homo sapiens
ctcttccgactctttctg

SEQ ID NO: 4441818 - DNA, 17 bp, Homo sapiens
ctcttcctaatcgctaa

SEQ ID NO: 4441819 - DNA, 14 bp, Homo sapiens
ctcttcctaccctc

SEQ ID NO: 4441820 - DNA, 17 bp, Homo sapiens
ctcttcctaccctgcct

SEQ ID NO: 4441821 - DNA, 19 bp, Homo sapiens
ctcttcctaccctgcctcc

SEQ ID NO: 4441822 - DNA, 15 bp, Homo sapiens
ctcttcctaggccac

SEQ ID NO: 4441823 - DNA, 20 bp, Homo sapiens
ctcttcgtttcagtgtcaaa

SEQ ID NO: 4441824 - DNA, 21 bp, Homo sapiens
ctcttctaaaatagcaataac

SEQ ID NO: 4441825 - DNA, 21 bp, Homo sapiens
ctcttctagatgattttttga

SEQ ID NO: 4441826 - DNA, 19 bp, Homo sapiens
ctcttctcatttcacccct

SEQ ID NO: 4441827 - DNA, 19 bp, Homo sapiens
ctcttctctccagctgact

SEQ ID NO: 4441828 - DNA, 22 bp, Homo sapiens
ctcttctctccagctgactaaa

SEQ ID NO: 4441829 - DNA, 16 bp, Homo sapiens
ctcttctctccccagc

SEQ ID NO: 4441830 - DNA, 19 bp, Homo sapiens
ctcttctctccccagcccc

SEQ ID NO: 4441831 - DNA, 16 bp, Homo sapiens
ctcttctgaataaagc

SEQ ID NO: 4441832 - DNA, 19 bp, Homo sapiens
ctcttctgaataaagcaat

SEQ ID NO: 4441833 - DNA, 17 bp, Homo sapiens
ctcttctgactgccccc

SEQ ID NO: 4441834 - DNA, 21 bp, Homo sapiens
ctcttctgagctatttcatct

SEQ ID NO: 4441835 - DNA, 22 bp, Homo sapiens
ctcttctgagctatttcatcta

SEQ ID NO: 4441836 - DNA, 23 bp, Homo sapiens
ctcttctgagctatttcatctat

SEQ ID NO: 4441837 - DNA, 14 bp, Homo sapiens
ctcttctgcaagcc

SEQ ID NO: 4441838 - DNA, 14 bp, Homo sapiens
ctcttctgctccac

SEQ ID NO: 4441839 - DNA, 19 bp, Homo sapiens
ctcttctgctccacccttg

SEQ ID NO: 4441840 - DNA, 12 bp, Homo sapiens
ctcttctgctct

SEQ ID NO: 4441841 - DNA, 20 bp, Homo sapiens
ctcttgaaatattcagaaat

SEQ ID NO: 4441842 - DNA, 15 bp, Homo sapiens
ctcttgatctctctt

SEQ ID NO: 4441843 - DNA, 21 bp, Homo sapiens
ctcttgattatccatattgag

SEQ ID NO: 4441844 - DNA, 18 bp, Homo sapiens
ctcttgcaggctgagtcc

SEQ ID NO: 4441845 - DNA, 16 bp, Homo sapiens
ctcttgcccatcctga

SEQ ID NO: 4441846 - DNA, 15 bp, Homo sapiens
ctcttggacccacct

SEQ ID NO: 4441847 - DNA, 16 bp, Homo sapiens
ctcttggacccacctg

SEQ ID NO: 4441848 - DNA, 21 bp, Homo sapiens
ctcttgggaactgaactcact

SEQ ID NO: 4441849 - DNA, 23 bp, Homo sapiens
ctcttggtgcatttttttggaag

SEQ ID NO: 4441850 - DNA, 22 bp, Homo sapiens
ctcttggttcgatacctggagc

SEQ ID NO: 4441851 - DNA, 14 bp, Homo sapiens
ctcttgtaaagact

SEQ ID NO: 4441852 - DNA, 15 bp, Homo sapiens
ctcttgtaaagactg

SEQ ID NO: 4441853 - DNA, 16 bp, Homo sapiens
ctcttgtaccatagaa

SEQ ID NO: 4441854 - DNA, 23 bp, Homo sapiens
ctcttgtaccatagaaaaatgta

SEQ ID NO: 4441855 - DNA, 14 bp, Homo sapiens
ctcttgtcctcttc

SEQ ID NO: 4441856 - DNA, 12 bp, Homo sapiens
ctcttgtgattt

SEQ ID NO: 4441857 - DNA, 19 bp, Homo sapiens
ctcttgtgcaaggtggcct

SEQ ID NO: 4441858 - DNA, 20 bp, Homo sapiens
ctcttgtgcaaggtggcctt

SEQ ID NO: 4441859 - DNA, 21 bp, Homo sapiens
ctcttgtgcaaggtggccttt

SEQ ID NO: 4441860 - DNA, 14 bp, Homo sapiens
ctctttaaaacaaa

SEQ ID NO: 4441861 - DNA, 12 bp, Homo sapiens
ctctttaaataa

SEQ ID NO: 4441862 - DNA, 15 bp, Homo sapiens
ctctttaattttaac

SEQ ID NO: 4441863 - DNA, 17 bp, Homo sapiens
ctctttagatgcaagtg

SEQ ID NO: 4441864 - DNA, 17 bp, Homo sapiens
ctctttagtgttctgtt

SEQ ID NO: 4441865 - DNA, 20 bp, Homo sapiens
ctctttattgtctgtaaatc

SEQ ID NO: 4441866 - DNA, 13 bp, Homo sapiens
ctctttccctgcg

SEQ ID NO: 4441867 - DNA, 15 bp, Homo sapiens
ctctttccctgcgag

SEQ ID NO: 4441868 - DNA, 20 bp, Homo sapiens
ctctttccctgcgagacgca

SEQ ID NO: 4441869 - DNA, 17 bp, Homo sapiens
ctctttccgactgccca

SEQ ID NO: 4441870 - DNA, 15 bp, Homo sapiens
ctctttctctccttt

SEQ ID NO: 4441871 - DNA, 21 bp, Homo sapiens
ctctttctctctttccatctc

SEQ ID NO: 4441872 - DNA, 18 bp, Homo sapiens
ctctttctgagtgccttc

SEQ ID NO: 4441873 - DNA, 19 bp, Homo sapiens
ctctttctgagtgccttct

SEQ ID NO: 4441874 - DNA, 22 bp, Homo sapiens
ctctttgaaatagtctgtgtga

SEQ ID NO: 4441875 - DNA, 19 bp, Homo sapiens
ctctttgactgtcagcaag

SEQ ID NO: 4441876 - DNA, 13 bp, Homo sapiens
ctctttgggcagt

SEQ ID NO: 4441877 - DNA, 19 bp, Homo sapiens
ctctttgggcagtgccatg

SEQ ID NO: 4441878 - DNA, 16 bp, Homo sapiens
ctcttttacctgctgc

SEQ ID NO: 4441879 - DNA, 18 bp, Homo sapiens
ctcttttacctgctgctt

SEQ ID NO: 4441880 - DNA, 17 bp, Homo sapiens
ctcttttcctggcagct

SEQ ID NO: 4441881 - DNA, 16 bp, Homo sapiens
ctcatggtacttcctc

SEQ ID NO: 4441882 - DNA, 16 bp, Homo sapiens
ctcatgtatcatctgg

SEQ ID NO: 4441883 - DNA, 16 bp, Homo sapiens
ctcatgttgctgaatt

SEQ ID NO: 4441884 - DNA, 19 bp, Homo sapiens
ctcatgtttacaggggttg

SEQ ID NO: 4441885 - DNA, 18 bp, Homo sapiens
ctcattaaactgattcca

SEQ ID NO: 4441886 - DNA, 17 bp, Homo sapiens
ctcattaatagctgcct

SEQ ID NO: 4441887 - DNA, 18 bp, Homo sapiens
ctcattaggatggctagt

SEQ ID NO: 4441888 - DNA, 16 bp, Homo sapiens
ctcattatttcaaaat

SEQ ID NO: 4441889 - DNA, 22 bp, Homo sapiens
ctcattcaggaaaactgacaga

SEQ ID NO: 4441890 - DNA, 19 bp, Homo sapiens
ctcattcattcattcagta

SEQ ID NO: 4441891 - DNA, 14 bp, Homo sapiens
ctcattccccaggt

SEQ ID NO: 4441892 - DNA, 22 bp, Homo sapiens
ctcattgaaatgtaatttcagt

SEQ ID NO: 4441893 - DNA, 19 bp, Homo sapiens
ctcattgcagcagataact

SEQ ID NO: 4441894 - DNA, 19 bp, Homo sapiens
ctcattgtctgtgtagagt

SEQ ID NO: 4441895 - DNA, 13 bp, Homo sapiens
ctcatttaaaaca

SEQ ID NO: 4441896 - DNA, 18 bp, Homo sapiens
ctcatttcatctcattta

SEQ ID NO: 4441897 - DNA, 15 bp, Homo sapiens
ctcatttgaatgctt

SEQ ID NO: 4441898 - DNA, 21 bp, Homo sapiens
ctcattttaatgtaaagattt

SEQ ID NO: 4441899 - DNA, 21 bp, Homo sapiens
ctccaaaaaaaaaaaaaatac

SEQ ID NO: 4441900 - DNA, 20 bp, Homo sapiens
ctccaaaaatctgcctgggt

SEQ ID NO: 4441901 - DNA, 17 bp, Homo sapiens
ctccaaaacatttctaa

SEQ ID NO: 4441902 - DNA, 18 bp, Homo sapiens
ctccaaaacatttctaag

SEQ ID NO: 4441903 - DNA, 16 bp, Homo sapiens
ctccaaaatattaaca

SEQ ID NO: 4441904 - DNA, 19 bp, Homo sapiens
ctccaaaatattaacattc

SEQ ID NO: 4441905 - DNA, 14 bp, Homo sapiens
ctccaaccccccag

SEQ ID NO: 4441906 - DNA, 18 bp, Homo sapiens
ctccaaccccccagcact

SEQ ID NO: 4441907 - DNA, 21 bp, Homo sapiens
ctccaaccccccagcactgag

SEQ ID NO: 4441908 - DNA, 14 bp, Homo sapiens
ctccaacctggaca

SEQ ID NO: 4441909 - DNA, 18 bp, Homo sapiens
ctccaacctggggggcag

SEQ ID NO: 4441910 - DNA, 15 bp, Homo sapiens
ctccaagacagcagc

SEQ ID NO: 4441911 - DNA, 18 bp, Homo sapiens
ctccaagacagcagcagc

SEQ ID NO: 4441912 - DNA, 13 bp, Homo sapiens
cgaggaaaggatt

SEQ ID NO: 4441913 - DNA, 16 bp, Homo sapiens
cgaggaatctgtgggt

SEQ ID NO: 4441914 - DNA, 22 bp, Homo sapiens
cgaggaatctgtgggtctggga

SEQ ID NO: 4441915 - DNA, 21 bp, Homo sapiens
cgaggacatgcatgacacttc

SEQ ID NO: 4441916 - DNA, 13 bp, Homo sapiens
cgaggacccagac

SEQ ID NO: 4441917 - DNA, 17 bp, Homo sapiens
cgaggacccagacccag

SEQ ID NO: 4441918 - DNA, 15 bp, Homo sapiens
cgggtcatctgtacc

SEQ ID NO: 4441919 - DNA, 21 bp, Homo sapiens
ctatttttttcctaagacatt

SEQ ID NO: 4441920 - DNA, 23 bp, Homo sapiens
ctatttttttcctaagacatttt

SEQ ID NO: 4441921 - DNA, 13 bp, Homo sapiens
ctcaaaaagcaga

SEQ ID NO: 4441922 - DNA, 23 bp, Homo sapiens
ctcaaaaagcagaaggagagtga

SEQ ID NO: 4441923 - DNA, 23 bp, Homo sapiens
ctcaaaacctgattggccactgg

SEQ ID NO: 4441924 - DNA, 13 bp, Homo sapiens
ctcaaaactgcac

SEQ ID NO: 4441925 - DNA, 18 bp, Homo sapiens
ctcaaaataaagaagtat

SEQ ID NO: 4441926 - DNA, 20 bp, Homo sapiens
ctcaaactaaattcaaagaa

SEQ ID NO: 4441927 - DNA, 21 bp, Homo sapiens
ctcaaactcctgacctcaggt

SEQ ID NO: 4441928 - DNA, 19 bp, Homo sapiens
ctcaaactgaggaatttca

SEQ ID NO: 4441929 - DNA, 22 bp, Homo sapiens
ctcaaactgaggaatttcacct

SEQ ID NO: 4441930 - DNA, 16 bp, Homo sapiens
ctcaaacttgtggcct

SEQ ID NO: 4441931 - DNA, 14 bp, Homo sapiens
ctcaaatacatgca

SEQ ID NO: 4441932 - DNA, 22 bp, Homo sapiens
ctcaacaaaaaaccgaggccct

SEQ ID NO: 4441933 - DNA, 15 bp, Homo sapiens
ctcaacagagaggac

SEQ ID NO: 4441934 - DNA, 24 bp, Homo sapiens
ctcaacagagaggaccaacatcca

SEQ ID NO: 4441935 - DNA, 16 bp, Homo sapiens
ctcaacccccctccca

SEQ ID NO: 4441936 - DNA, 18 bp, Homo sapiens
ctcaaccgcacatgtgcc

SEQ ID NO: 4441937 - DNA, 19 bp, Homo sapiens
ctcaacctgtaaattattt

SEQ ID NO: 4441938 - DNA, 21 bp, Homo sapiens
ctcaacctgtaaattatttta

SEQ ID NO: 4441939 - DNA, 21 bp, Homo sapiens
ctcaaccttccaacttcctgt

SEQ ID NO: 4441940 - DNA, 16 bp, Homo sapiens
ctcaacgcctccccct

SEQ ID NO: 4441941 - DNA, 15 bp, Homo sapiens
ctcaacgtattgttt

SEQ ID NO: 4441942 - DNA, 19 bp, Homo sapiens
ctcaactaacccttaaaaa

SEQ ID NO: 4441943 - DNA, 17 bp, Homo sapiens
ctcaactctacccctgc

SEQ ID NO: 4441944 - DNA, 15 bp, Homo sapiens
ctcaactgcctactc

SEQ ID NO: 4441945 - DNA, 13 bp, Homo sapiens
ctcaactttctgt

SEQ ID NO: 4441946 - DNA, 15 bp, Homo sapiens
ctcaacttttttccc

SEQ ID NO: 4441947 - DNA, 20 bp, Homo sapiens
ctcaagaatctagaagatgt

SEQ ID NO: 4441948 - DNA, 22 bp, Homo sapiens
ctcaagaatctagaagatgtgt

SEQ ID NO: 4441949 - DNA, 22 bp, Homo sapiens
ctcaagcaatccacctgccttg

SEQ ID NO: 4441950 - DNA, 23 bp, Homo sapiens
ctcaagcaatccacctgccttgg

SEQ ID NO: 4441951 - DNA, 17 bp, Homo sapiens
ctcaagcaatcctcctg

SEQ ID NO: 4441952 - DNA, 18 bp, Homo sapiens
ctcaagcaatcctcctgc

SEQ ID NO: 4441953 - DNA, 22 bp, Homo sapiens
ctcaagcaatcctcctgcctca

SEQ ID NO: 4441954 - DNA, 20 bp, Homo sapiens
ctcaagcgctatccacagaa

SEQ ID NO: 4441955 - DNA, 13 bp, Homo sapiens
ctcaagctagcca

SEQ ID NO: 4441956 - DNA, 17 bp, Homo sapiens
ctcaagctagccagagg

SEQ ID NO: 4441957 - DNA, 21 bp, Homo sapiens
ctcaagctatgatcagaagac

SEQ ID NO: 4441958 - DNA, 15 bp, Homo sapiens
ctcaaggaaaagttc

SEQ ID NO: 4441959 - DNA, 17 bp, Homo sapiens
ctcaaggacaggagcct

SEQ ID NO: 4441960 - DNA, 14 bp, Homo sapiens
ctcaaggattgatt

SEQ ID NO: 4441961 - DNA, 17 bp, Homo sapiens
ctcaagggttttccagg

SEQ ID NO: 4441962 - DNA, 21 bp, Homo sapiens
ctcaagtttttatagttatta

SEQ ID NO: 4441963 - DNA, 14 bp, Homo sapiens
ctcaataaacagtc

SEQ ID NO: 4441964 - DNA, 15 bp, Homo sapiens
ctcaatccctgagga

SEQ ID NO: 4441965 - DNA, 14 bp, Homo sapiens
ctcaatcctaattt

SEQ ID NO: 4441966 - DNA, 19 bp, Homo sapiens
ctcaatcctaatttctcct

SEQ ID NO: 4441967 - DNA, 22 bp, Homo sapiens
ctcaatcctaatttctcctccc

SEQ ID NO: 4441968 - DNA, 15 bp, Homo sapiens
ctcaatgggctttcc

SEQ ID NO: 4441969 - DNA, 17 bp, Homo sapiens
ctcaatgtgcaataact

SEQ ID NO: 4441970 - DNA, 21 bp, Homo sapiens
ctcaatgtgcaataacttgtg

SEQ ID NO: 4441971 - DNA, 14 bp, Homo sapiens
ctcaattatttgca

SEQ ID NO: 4441972 - DNA, 16 bp, Homo sapiens
ctcaattatttgcata

SEQ ID NO: 4441973 - DNA, 13 bp, Homo sapiens
ctcaatttcagca

SEQ ID NO: 4441974 - DNA, 14 bp, Homo sapiens
ctcaatttcagcac

SEQ ID NO: 4441975 - DNA, 19 bp, Homo sapiens
ctcacaaaaaggcaaatat

SEQ ID NO: 4441976 - DNA, 21 bp, Homo sapiens
ctcacaaaaaggcaaatattg

SEQ ID NO: 4441977 - DNA, 12 bp, Homo sapiens
ctcacacagcca

SEQ ID NO: 4441978 - DNA, 16 bp, Homo sapiens
ctcacacatcctgtca

SEQ ID NO: 4441979 - DNA, 21 bp, Homo sapiens
ctcacacgtttaatcccagca

SEQ ID NO: 4441980 - DNA, 13 bp, Homo sapiens
ctcacagaagaat

SEQ ID NO: 4441981 - DNA, 12 bp, Homo sapiens
ctcacaggctga

SEQ ID NO: 4441982 - DNA, 18 bp, Homo sapiens
ctcacagtcccactgtgc

SEQ ID NO: 4441983 - DNA, 15 bp, Homo sapiens
ctcacagtgctttta

SEQ ID NO: 4441984 - DNA, 17 bp, Homo sapiens
ctcacagttcctcgccc

SEQ ID NO: 4441985 - DNA, 18 bp, Homo sapiens
ctcacagttcctcgccct

SEQ ID NO: 4441986 - DNA, 20 bp, Homo sapiens
ctcacagttcctcgccctgg

SEQ ID NO: 4441987 - DNA, 13 bp, Homo sapiens
ctcacataagccc

SEQ ID NO: 4441988 - DNA, 13 bp, Homo sapiens
ctcacatgggact

SEQ ID NO: 4441989 - DNA, 22 bp, Homo sapiens
ctcacatgtcagtaccttcaaa

SEQ ID NO: 4441990 - DNA, 16 bp, Homo sapiens
ctcacattagatctag

SEQ ID NO: 4441991 - DNA, 17 bp, Homo sapiens
ctcaccagccccccgcg

SEQ ID NO: 4441992 - DNA, 11 bp, Homo sapiens
ctcaccagctg

SEQ ID NO: 4441993 - DNA, 19 bp, Homo sapiens
ctcaccatgatgtgaagag

SEQ ID NO: 4441994 - DNA, 14 bp, Homo sapiens
ctcacccaccatgg

SEQ ID NO: 4441995 - DNA, 21 bp, Homo sapiens
ctcacccaccatggaccagcc

SEQ ID NO: 4441996 - DNA, 15 bp, Homo sapiens
ctcacccatcctaga

SEQ ID NO: 4441997 - DNA, 16 bp, Homo sapiens
ctcaccccccacactc

SEQ ID NO: 4441998 - DNA, 16 bp, Homo sapiens
ctcacccccttctcca

SEQ ID NO: 4441999 - DNA, 17 bp, Homo sapiens
ctcacccccttctccat

SEQ ID NO: 4442000 - DNA, 19 bp, Homo sapiens
ctcacccccttctccatcc

SEQ ID NO: 4442001 - DNA, 15 bp, Homo sapiens
ctcaccccgtctggg

SEQ ID NO: 4442002 - DNA, 19 bp, Homo sapiens
ctcacccctggttctcatc

SEQ ID NO: 4442003 - DNA, 17 bp, Homo sapiens
ctcaccccttgccataa

SEQ ID NO: 4442004 - DNA, 10 bp, Homo sapiens
ctcaccctcc

SEQ ID NO: 4442005 - DNA, 15 bp, Homo sapiens
ctcacccttcccggc

SEQ ID NO: 4442006 - DNA, 13 bp, Homo sapiens
ctcaccgcccatc

SEQ ID NO: 4442007 - DNA, 17 bp, Homo sapiens
ctcaccgcccatcaggg

SEQ ID NO: 4442008 - DNA, 22 bp, Homo sapiens
ctcacctagacaaccagaggct

SEQ ID NO: 4442009 - DNA, 15 bp, Homo sapiens
ctcacctctggactg

SEQ ID NO: 4442010 - DNA, 22 bp, Homo sapiens
ctcacctctggactggctagag

SEQ ID NO: 4442011 - DNA, 17 bp, Homo sapiens
ctcacctgcactaacag

SEQ ID NO: 4442012 - DNA, 15 bp, Homo sapiens
ctcacctgctcccag

SEQ ID NO: 4442013 - DNA, 13 bp, Homo sapiens
ctcacctggttga

SEQ ID NO: 4442014 - DNA, 13 bp, Homo sapiens
ctcaccttcctgt

SEQ ID NO: 4442015 - DNA, 15 bp, Homo sapiens
ctcaccttcctgtgg

SEQ ID NO: 4442016 - DNA, 19 bp, Homo sapiens
ctcacgaaagtatttactt

SEQ ID NO: 4442017 - DNA, 19 bp, Homo sapiens
ctcacgcctgtaatcccag

SEQ ID NO: 4442018 - DNA, 22 bp, Homo sapiens
ctcacgcctgtaatcccagcag

SEQ ID NO: 4442019 - DNA, 23 bp, Homo sapiens
ctcacgcctgtaatcccagcagt

SEQ ID NO: 4442020 - DNA, 14 bp, Homo sapiens
ctcacgctttgttt

SEQ ID NO: 4442021 - DNA, 22 bp, Homo sapiens
ctcacggaccactcgaggcctg

SEQ ID NO: 4442022 - DNA, 22 bp, Homo sapiens
ctcacggggttggctgttccag

SEQ ID NO: 4442023 - DNA, 23 bp, Homo sapiens
ctcacggggttggctgttccaga

SEQ ID NO: 4442024 - DNA, 14 bp, Homo sapiens
ctcacgtcaaatgc

SEQ ID NO: 4442025 - DNA, 13 bp, Homo sapiens
ctcactaattttt

SEQ ID NO: 4442026 - DNA, 15 bp, Homo sapiens
ctcactaatttttgt

SEQ ID NO: 4442027 - DNA, 23 bp, Homo sapiens
ctcactaatttttgtattatttt

SEQ ID NO: 4442028 - DNA, 23 bp, Homo sapiens
ctcactagccatgctttatgtgg

SEQ ID NO: 4442029 - DNA, 20 bp, Homo sapiens
ctcactatggtatgctggcc

SEQ ID NO: 4442030 - DNA, 22 bp, Homo sapiens
ctcactatggtatgctggccag

SEQ ID NO: 4442031 - DNA, 20 bp, Homo sapiens
ctcactattacttgaacttt

SEQ ID NO: 4442032 - DNA, 22 bp, Homo sapiens
ctcactattcttggaccatgcc

SEQ ID NO: 4442033 - DNA, 16 bp, Homo sapiens
ctcactcactcattcc

SEQ ID NO: 4442034 - DNA, 12 bp, Homo sapiens
ctcactcactct

SEQ ID NO: 4442035 - DNA, 17 bp, Homo sapiens
ctcactcactgtttata

SEQ ID NO: 4442036 - DNA, 17 bp, Homo sapiens
ctcactccaccacccaa

SEQ ID NO: 4442037 - DNA, 23 bp, Homo sapiens
ctcaggacagcatcccttcccac

SEQ ID NO: 4442038 - DNA, 20 bp, Homo sapiens
ctcaggaggcgaataaatgt

SEQ ID NO: 4442039 - DNA, 21 bp, Homo sapiens
ctcaggaggcgaataaatgtt

SEQ ID NO: 4442040 - DNA, 23 bp, Homo sapiens
ctcaggaggcgaataaatgttca

SEQ ID NO: 4442041 - DNA, 15 bp, Homo sapiens
ctcaggaggctgaga

SEQ ID NO: 4442042 - DNA, 17 bp, Homo sapiens
ctcaggaggctgagaca

SEQ ID NO: 4442043 - DNA, 19 bp, Homo sapiens
ctcaggaggctgagacagg

SEQ ID NO: 4442044 - DNA, 23 bp, Homo sapiens
ctcaggaggctgaggcagaagaa

SEQ ID NO: 4442045 - DNA, 19 bp, Homo sapiens
ctcaggaggtcacctgccg

SEQ ID NO: 4442046 - DNA, 12 bp, Homo sapiens
ctcaggatatta

SEQ ID NO: 4442047 - DNA, 16 bp, Homo sapiens
ctcaggcacacagcta

SEQ ID NO: 4442048 - DNA, 22 bp, Homo sapiens
ctcaggcacccgtccccacacg

SEQ ID NO: 4442049 - DNA, 14 bp, Homo sapiens
ctcaggccaaggga

SEQ ID NO: 4442050 - DNA, 16 bp, Homo sapiens
ctcaggccaagggacc

SEQ ID NO: 4442051 - DNA, 18 bp, Homo sapiens
ctcaggccaagggaccag

SEQ ID NO: 4442052 - DNA, 11 bp, Homo sapiens
ctcaggcccag

SEQ ID NO: 4442053 - DNA, 12 bp, Homo sapiens
ctcaggcccagg

SEQ ID NO: 4442054 - DNA, 21 bp, Homo sapiens
ctcaggcccaggagtccaggc

SEQ ID NO: 4442055 - DNA, 22 bp, Homo sapiens
ctcaggcccaggagtccaggcc

SEQ ID NO: 4442056 - DNA, 23 bp, Homo sapiens
ctcaggccgaaggaggagtcagg

SEQ ID NO: 4442057 - DNA, 13 bp, Homo sapiens
ctcaggccgagag

SEQ ID NO: 4442058 - DNA, 16 bp, Homo sapiens
ctcaggccgagagcct

SEQ ID NO: 4442059 - DNA, 10 bp, Homo sapiens
ctcaggctcc

SEQ ID NO: 4442060 - DNA, 11 bp, Homo sapiens
ctcaggctccg

SEQ ID NO: 4442061 - DNA, 12 bp, Homo sapiens
ctcaggctcttg

SEQ ID NO: 4442062 - DNA, 21 bp, Homo sapiens
ctcagggacagagacacctgc

SEQ ID NO: 4442063 - DNA, 19 bp, Homo sapiens
cgtgggtgggcctggccct

SEQ ID NO: 4442064 - DNA, 22 bp, Homo sapiens
cgtgggtgggcctggccctgct

SEQ ID NO: 4442065 - DNA, 13 bp, Homo sapiens
cgtgggtgtgtgc

SEQ ID NO: 4442066 - DNA, 14 bp, Homo sapiens
cgtggtcagagtgc

SEQ ID NO: 4442067 - DNA, 16 bp, Homo sapiens
cgtggtgcctgcacac

SEQ ID NO: 4442068 - DNA, 16 bp, Homo sapiens
cgtggtgggactccag

SEQ ID NO: 4442069 - DNA, 22 bp, Homo sapiens
cgtggtgggactccagctcgtg

SEQ ID NO: 4442070 - DNA, 15 bp, Homo sapiens
cgtgtcaatgtgtgc

SEQ ID NO: 4442071 - DNA, 16 bp, Homo sapiens
cgtgtcacctgtgctt

SEQ ID NO: 4442072 - DNA, 20 bp, Homo sapiens
cgtgtcctctccctgccaag

SEQ ID NO: 4442073 - DNA, 16 bp, Homo sapiens
cgtgtctcagcctctg

SEQ ID NO: 4442074 - DNA, 14 bp, Homo sapiens
cgtgtctctgagga

SEQ ID NO: 4442075 - DNA, 14 bp, Homo sapiens
cgtgtctggcacag

SEQ ID NO: 4442076 - DNA, 22 bp, Homo sapiens
cgtgtctgtatttatgtgtgag

SEQ ID NO: 4442077 - DNA, 15 bp, Homo sapiens
cgtgtgttctatcca

SEQ ID NO: 4442078 - DNA, 23 bp, Homo sapiens
cgtgttccagccaaagcatgccg

SEQ ID NO: 4442079 - DNA, 13 bp, Homo sapiens
cgtgttgtcattg

SEQ ID NO: 4442080 - DNA, 12 bp, Homo sapiens
cgtgtttgctta

SEQ ID NO: 4442081 - DNA, 13 bp, Homo sapiens
cgttatatattgt

SEQ ID NO: 4442082 - DNA, 17 bp, Homo sapiens
cgttcacctccctgctc

SEQ ID NO: 4442083 - DNA, 13 bp, Homo sapiens
cgttcccagacca

SEQ ID NO: 4442084 - DNA, 23 bp, Homo sapiens
cgttcctagagaagacaggctgg

SEQ ID NO: 4442085 - DNA, 18 bp, Homo sapiens
cgttccttactgcagaat

SEQ ID NO: 4442086 - DNA, 15 bp, Homo sapiens
cgttctcccaaagat

SEQ ID NO: 4442087 - DNA, 19 bp, Homo sapiens
cgttctgccttccttgtta

SEQ ID NO: 4442088 - DNA, 13 bp, Homo sapiens
cgttctgctggcc

SEQ ID NO: 4442089 - DNA, 20 bp, Homo sapiens
cgttcttacaagcttaaagc

SEQ ID NO: 4442090 - DNA, 22 bp, Homo sapiens
cgttgcccaaggttgcacagca

SEQ ID NO: 4442091 - DNA, 19 bp, Homo sapiens
cgttgctgagccagctgca

SEQ ID NO: 4442092 - DNA, 15 bp, Homo sapiens
cgttgggagcctagc

SEQ ID NO: 4442093 - DNA, 17 bp, Homo sapiens
cgttgggagcctagctc

SEQ ID NO: 4442094 - DNA, 18 bp, Homo sapiens
cgttgttgtggaagcatg

SEQ ID NO: 4442095 - DNA, 18 bp, Homo sapiens
cgtttaagccaaaacaat

SEQ ID NO: 4442096 - DNA, 23 bp, Homo sapiens
cgtttaagcttaacatttcatgt

SEQ ID NO: 4442097 - DNA, 21 bp, Homo sapiens
cgtttaaggtgagcataaatc

SEQ ID NO: 4442098 - DNA, 17 bp, Homo sapiens
cgtttagaatcagaata

SEQ ID NO: 4442099 - DNA, 22 bp, Homo sapiens
cgtttcagtgtcaaataaacac

SEQ ID NO: 4442100 - DNA, 23 bp, Homo sapiens
cgtttcagtgtcaaataaacact

SEQ ID NO: 4442101 - DNA, 20 bp, Homo sapiens
cgtttccccaataaagcctt

SEQ ID NO: 4442102 - DNA, 22 bp, Homo sapiens
cgtttccccaataaagcctttt

SEQ ID NO: 4442103 - DNA, 16 bp, Homo sapiens
cgtttctccttttcct

SEQ ID NO: 4442104 - DNA, 14 bp, Homo sapiens
cgtttcttgcaagg

SEQ ID NO: 4442105 - DNA, 22 bp, Homo sapiens
cgttttaataatttttgctgaa

SEQ ID NO: 4442106 - DNA, 19 bp, Homo sapiens
cgtttttgtgctgtgggca

SEQ ID NO: 4442107 - DNA, 16 bp, Homo sapiens
cgttttttcctcagtg

SEQ ID NO: 4442108 - DNA, 14 bp, Homo sapiens
ctaaaaaaaagatg

SEQ ID NO: 4442109 - DNA, 12 bp, Homo sapiens
ctaaaaagcaac

SEQ ID NO: 4442110 - DNA, 17 bp, Homo sapiens
ctaaaaaggtcctgtaa

SEQ ID NO: 4442111 - DNA, 15 bp, Homo sapiens
ctaaaaatacaaaaa

SEQ ID NO: 4442112 - DNA, 16 bp, Homo sapiens
ctaaaacattcccctc

SEQ ID NO: 4442113 - DNA, 15 bp, Homo sapiens
ctaaaacctgagcta

SEQ ID NO: 4442114 - DNA, 22 bp, Homo sapiens
ctaaaacctgagctagaagctg

SEQ ID NO: 4442115 - DNA, 23 bp, Homo sapiens
ctaaaagatgcaattcaaagata

SEQ ID NO: 4442116 - DNA, 20 bp, Homo sapiens
ctaaaagcaaaataaaaact

SEQ ID NO: 4442117 - DNA, 22 bp, Homo sapiens
ctaaaagcaaaataaaaactat

SEQ ID NO: 4442118 - DNA, 20 bp, Homo sapiens
ctaaaagcatgtatagttag

SEQ ID NO: 4442119 - DNA, 20 bp, Homo sapiens
ctaaaagtgggcttgattct

SEQ ID NO: 4442120 - DNA, 23 bp, Homo sapiens
ctaaaagtgggcttgattctgca

SEQ ID NO: 4442121 - DNA, 13 bp, Homo sapiens
ctaaaatgttcta

SEQ ID NO: 4442122 - DNA, 17 bp, Homo sapiens
ctaaaatgtttattcct

SEQ ID NO: 4442123 - DNA, 15 bp, Homo sapiens
ctaaaattatgttac

SEQ ID NO: 4442124 - DNA, 23 bp, Homo sapiens
ctaaaatttcataattctgaaac

SEQ ID NO: 4442125 - DNA, 13 bp, Homo sapiens
ctaaaattttaga

SEQ ID NO: 4442126 - DNA, 19 bp, Homo sapiens
ctaaaattttagatgtaga

SEQ ID NO: 4442127 - DNA, 20 bp, Homo sapiens
ctaaacacaacaataacttt

SEQ ID NO: 4442128 - DNA, 17 bp, Homo sapiens
ctaaaccaactctaata

SEQ ID NO: 4442129 - DNA, 18 bp, Homo sapiens
ctaaaccaactctaatat

SEQ ID NO: 4442130 - DNA, 15 bp, Homo sapiens
ctaaacccaatccaa

SEQ ID NO: 4442131 - DNA, 16 bp, Homo sapiens
ctaaacccaatccaaa

SEQ ID NO: 4442132 - DNA, 17 bp, Homo sapiens
ctaaacggattccaaag

SEQ ID NO: 4442133 - DNA, 15 bp, Homo sapiens
ctaaactacattata

SEQ ID NO: 4442134 - DNA, 20 bp, Homo sapiens
ctaaactgaatctatggctt

SEQ ID NO: 4442135 - DNA, 22 bp, Homo sapiens
ctaaactgaatctatggcttta

SEQ ID NO: 4442136 - DNA, 17 bp, Homo sapiens
ctaaactttggcctttg

SEQ ID NO: 4442137 - DNA, 17 bp, Homo sapiens
ctaaactttttttctgt

SEQ ID NO: 4442138 - DNA, 13 bp, Homo sapiens
ctaaagaaaaaca

SEQ ID NO: 4442139 - DNA, 17 bp, Homo sapiens
ctaaagaaaaacaaact

SEQ ID NO: 4442140 - DNA, 15 bp, Homo sapiens
ctaaagagcccttgc

SEQ ID NO: 4442141 - DNA, 23 bp, Homo sapiens
ctaaagagcccttgcctccccat

SEQ ID NO: 4442142 - DNA, 23 bp, Homo sapiens
ctaaagagttattcaaatgaagg

SEQ ID NO: 4442143 - DNA, 15 bp, Homo sapiens
ctaaagcctgaattt

SEQ ID NO: 4442144 - DNA, 17 bp, Homo sapiens
ctaaagctggtttaatg

SEQ ID NO: 4442145 - DNA, 12 bp, Homo sapiens
ctaaagctttat

SEQ ID NO: 4442146 - DNA, 11 bp, Homo sapiens
ctaaaggaggc

SEQ ID NO: 4442147 - DNA, 20 bp, Homo sapiens
ctaaagggacaataactctg

SEQ ID NO: 4442148 - DNA, 16 bp, Homo sapiens
ctaaagggcttcattt

SEQ ID NO: 4442149 - DNA, 17 bp, Homo sapiens
ctaaagtacagcctgga

SEQ ID NO: 4442150 - DNA, 19 bp, Homo sapiens
ctaaagtgatcctaaatat

SEQ ID NO: 4442151 - DNA, 14 bp, Homo sapiens
ctaaagttatattt

SEQ ID NO: 4442152 - DNA, 15 bp, Homo sapiens
ctaaataaaatttgt

SEQ ID NO: 4442153 - DNA, 20 bp, Homo sapiens
ctaaataaacacatagattc

SEQ ID NO: 4442154 - DNA, 15 bp, Homo sapiens
ctaaataaacacgat

SEQ ID NO: 4442155 - DNA, 19 bp, Homo sapiens
ctaaatacctcaatcagtc

SEQ ID NO: 4442156 - DNA, 16 bp, Homo sapiens
ctaaatagtattttgt

SEQ ID NO: 4442157 - DNA, 23 bp, Homo sapiens
ctaaatatgaaccctttgtttct

SEQ ID NO: 4442158 - DNA, 19 bp, Homo sapiens
ctaaatgaaagtggtaatc

SEQ ID NO: 4442159 - DNA, 12 bp, Homo sapiens
ctaaatgcaata

SEQ ID NO: 4442160 - DNA, 19 bp, Homo sapiens
ctaaatgcaataagattta

SEQ ID NO: 4442161 - DNA, 12 bp, Homo sapiens
ctaaatgcccag

SEQ ID NO: 4442162 - DNA, 18 bp, Homo sapiens
ctaaatgtgcaatagaag

SEQ ID NO: 4442163 - DNA, 18 bp, Homo sapiens
ctaaattacagtgcagtt

SEQ ID NO: 4442164 - DNA, 15 bp, Homo sapiens
ctaaattatttactg

SEQ ID NO: 4442165 - DNA, 17 bp, Homo sapiens
ctaaattctactctaaa

SEQ ID NO: 4442166 - DNA, 17 bp, Homo sapiens
ctaaattgtctgccatt

SEQ ID NO: 4442167 - DNA, 20 bp, Homo sapiens
ctaaatttcccaattttctg

SEQ ID NO: 4442168 - DNA, 22 bp, Homo sapiens
ctaaatttgtgctttttaagaa

SEQ ID NO: 4442169 - DNA, 17 bp, Homo sapiens
ctaaattttaaagccat

SEQ ID NO: 4442170 - DNA, 14 bp, Homo sapiens
ctaaattttaagtg

SEQ ID NO: 4442171 - DNA, 16 bp, Homo sapiens
ctaaatttttcataga

SEQ ID NO: 4442172 - DNA, 15 bp, Homo sapiens
ctaacaataatattt

SEQ ID NO: 4442173 - DNA, 17 bp, Homo sapiens
ctaacaataatatttca

SEQ ID NO: 4442174 - DNA, 22 bp, Homo sapiens
ctaacaataatatttcaagtgc

SEQ ID NO: 4442175 - DNA, 20 bp, Homo sapiens
ctaacactagcttatttcca

SEQ ID NO: 4442176 - DNA, 22 bp, Homo sapiens
ctaacagccctcctctgcactc

SEQ ID NO: 4442177 - DNA, 23 bp, Homo sapiens
ctaacagggagaagtagctagta

SEQ ID NO: 4442178 - DNA, 20 bp, Homo sapiens
ctaacatgttatcaaatctg

SEQ ID NO: 4442179 - DNA, 12 bp, Homo sapiens
ctaacattatat

SEQ ID NO: 4442180 - DNA, 15 bp, Homo sapiens
ctaacattatattgc

SEQ ID NO: 4442181 - DNA, 14 bp, Homo sapiens
ctacaaacttttaa

SEQ ID NO: 4442182 - DNA, 19 bp, Homo sapiens
ctacaaacttttaagattt

SEQ ID NO: 4442183 - DNA, 19 bp, Homo sapiens
ctacaaagagatgcttgga

SEQ ID NO: 4442184 - DNA, 20 bp, Homo sapiens
ctacaagagcagcctgtggc

SEQ ID NO: 4442185 - DNA, 21 bp, Homo sapiens
ctacaagagcagcctgtggca

SEQ ID NO: 4442186 - DNA, 22 bp, Homo sapiens
ctacaaggtaggctgcaaaatt

SEQ ID NO: 4442187 - DNA, 17 bp, Homo sapiens
ctacaatattctctctt

SEQ ID NO: 4442188 - DNA, 16 bp, Homo sapiens
ctacaatttgtttttg

SEQ ID NO: 4442189 - DNA, 19 bp, Homo sapiens
ctactgggtgtcatttcat

SEQ ID NO: 4442190 - DNA, 13 bp, Homo sapiens
ctactgtacataa

SEQ ID NO: 4442191 - DNA, 20 bp, Homo sapiens
ctactgtatcaataaaattc

SEQ ID NO: 4442192 - DNA, 23 bp, Homo sapiens
ctactgtatcaataaaattctgt

SEQ ID NO: 4442193 - DNA, 19 bp, Homo sapiens
ctactgtgtgtgtgaatga

SEQ ID NO: 4442194 - DNA, 20 bp, Homo sapiens
ctactgtgtgtgtgaatgaa

SEQ ID NO: 4442195 - DNA, 15 bp, Homo sapiens
ctactgttcttgaca

SEQ ID NO: 4442196 - DNA, 20 bp, Homo sapiens
ctactgttcttgacaatcat

SEQ ID NO: 4442197 - DNA, 21 bp, Homo sapiens
ctacttaggaaatactcagca

SEQ ID NO: 4442198 - DNA, 15 bp, Homo sapiens
ctacttgctgaagga

SEQ ID NO: 4442199 - DNA, 16 bp, Homo sapiens
ctacttgggaggctga

SEQ ID NO: 4442200 - DNA, 15 bp, Homo sapiens
ctacttgtttaacat

SEQ ID NO: 4442201 - DNA, 18 bp, Homo sapiens
ctactttataactaacat

SEQ ID NO: 4442202 - DNA, 16 bp, Homo sapiens
ctactttcatcttaaa

SEQ ID NO: 4442203 - DNA, 17 bp, Homo sapiens
ctactttctctctcttt

SEQ ID NO: 4442204 - DNA, 21 bp, Homo sapiens
ctactttgactttttgcattt

SEQ ID NO: 4442205 - DNA, 14 bp, Homo sapiens
ctacttttaaataa

SEQ ID NO: 4442206 - DNA, 14 bp, Homo sapiens
ctacttttctaaaa

SEQ ID NO: 4442207 - DNA, 18 bp, Homo sapiens
ctagaaaaaaaaaacact

SEQ ID NO: 4442208 - DNA, 14 bp, Homo sapiens
ctagaaacttccaa

SEQ ID NO: 4442209 - DNA, 22 bp, Homo sapiens
ctagaaagcatccattaattaa

SEQ ID NO: 4442210 - DNA, 23 bp, Homo sapiens
ctagaaatgatccccagctgttt

SEQ ID NO: 4442211 - DNA, 14 bp, Homo sapiens
ctagaacctggaga

SEQ ID NO: 4442212 - DNA, 15 bp, Homo sapiens
ctagaacctggagag

SEQ ID NO: 4442213 - DNA, 16 bp, Homo sapiens
ctagaacctggagggc

SEQ ID NO: 4442214 - DNA, 16 bp, Homo sapiens
ctagaagaaccaaata

SEQ ID NO: 4442215 - DNA, 21 bp, Homo sapiens
ctagaagaaccaaatacctca

SEQ ID NO: 4442216 - DNA, 17 bp, Homo sapiens
ctagaagagtctattgt

SEQ ID NO: 4442217 - DNA, 14 bp, Homo sapiens
ctagaagatgtgta

SEQ ID NO: 4442218 - DNA, 15 bp, Homo sapiens
ctagaagatgtgtaa

SEQ ID NO: 4442219 - DNA, 16 bp, Homo sapiens
ctagaagatgtgtaaa

SEQ ID NO: 4442220 - DNA, 15 bp, Homo sapiens
ctagaagattagaaa

SEQ ID NO: 4442221 - DNA, 12 bp, Homo sapiens
ctagaagccaag

SEQ ID NO: 4442222 - DNA, 13 bp, Homo sapiens
ctagaagccaagg

SEQ ID NO: 4442223 - DNA, 16 bp, Homo sapiens
ctagaagccaagggaa

SEQ ID NO: 4442224 - DNA, 21 bp, Homo sapiens
ctagaagggctagaacctgga

SEQ ID NO: 4442225 - DNA, 17 bp, Homo sapiens
ctagaagtgggccagga

SEQ ID NO: 4442226 - DNA, 19 bp, Homo sapiens
ctagaagtgggccaggaca

SEQ ID NO: 4442227 - DNA, 20 bp, Homo sapiens
ctagaatctggagagctaga

SEQ ID NO: 4442228 - DNA, 14 bp, Homo sapiens
ctagaatgtaaagt

SEQ ID NO: 4442229 - DNA, 19 bp, Homo sapiens
ctagaatgtaaagttatgt

SEQ ID NO: 4442230 - DNA, 22 bp, Homo sapiens
ctagaatgtctgaagtacaaac

SEQ ID NO: 4442231 - DNA, 19 bp, Homo sapiens
ctagaattgagtgtttaaa

SEQ ID NO: 4442232 - DNA, 21 bp, Homo sapiens
ctagaattgagtgtttaaagt

SEQ ID NO: 4442233 - DNA, 20 bp, Homo sapiens
ctagacaaccagaggctggc

SEQ ID NO: 4442234 - DNA, 16 bp, Homo sapiens
ctagacaggaaccctt

SEQ ID NO: 4442235 - DNA, 19 bp, Homo sapiens
ctagactcaaaacctggag

SEQ ID NO: 4442236 - DNA, 16 bp, Homo sapiens
ctagactgttactttg

SEQ ID NO: 4442237 - DNA, 16 bp, Homo sapiens
ctagacttccccatcc

SEQ ID NO: 4442238 - DNA, 12 bp, Homo sapiens
ctagagaacact

SEQ ID NO: 4442239 - DNA, 12 bp, Homo sapiens
ctagagaacagt

SEQ ID NO: 4442240 - DNA, 21 bp, Homo sapiens
ctagagaacagtattgggcag

SEQ ID NO: 4442241 - DNA, 15 bp, Homo sapiens
ctagagaacgcagcc

SEQ ID NO: 4442242 - DNA, 17 bp, Homo sapiens
ctagagaacgcagccct

SEQ ID NO: 4442243 - DNA, 17 bp, Homo sapiens
ctagagaagacaggctg

SEQ ID NO: 4442244 - DNA, 22 bp, Homo sapiens
ctagagaagacaggctggaaga

SEQ ID NO: 4442245 - DNA, 15 bp, Homo sapiens
ctagagaatgcacag

SEQ ID NO: 4442246 - DNA, 15 bp, Homo sapiens
ctagagacagatgct

SEQ ID NO: 4442247 - DNA, 19 bp, Homo sapiens
ctagagacagatgctggtg

SEQ ID NO: 4442248 - DNA, 17 bp, Homo sapiens
ctagagatatggcagcg

SEQ ID NO: 4442249 - DNA, 19 bp, Homo sapiens
ctagagatattttgtaaaa

SEQ ID NO: 4442250 - DNA, 19 bp, Homo sapiens
ctagagcaaaataatgcaa

SEQ ID NO: 4442251 - DNA, 12 bp, Homo sapiens
ctagagcctgcc

SEQ ID NO: 4442252 - DNA, 13 bp, Homo sapiens
ctagagcctgcct

SEQ ID NO: 4442253 - DNA, 14 bp, Homo sapiens
ctagagcctgcctg

SEQ ID NO: 4442254 - DNA, 17 bp, Homo sapiens
ctagagcctgcctggag

SEQ ID NO: 4442255 - DNA, 19 bp, Homo sapiens
ctagagcctgcctggagcg

SEQ ID NO: 4442256 - DNA, 15 bp, Homo sapiens
ctagaggaaaagaaa

SEQ ID NO: 4442257 - DNA, 17 bp, Homo sapiens
ctagaggccagccccac

SEQ ID NO: 4442258 - DNA, 19 bp, Homo sapiens
ctagaggccagccccaccc

SEQ ID NO: 4442259 - DNA, 18 bp, Homo sapiens
ctagaggggcaccttttc

SEQ ID NO: 4442260 - DNA, 20 bp, Homo sapiens
ctagaggtcaggacggctcc

SEQ ID NO: 4442261 - DNA, 15 bp, Homo sapiens
ctagaggtgagaaat

SEQ ID NO: 4442262 - DNA, 15 bp, Homo sapiens
ctagagtcctcactc

SEQ ID NO: 4442263 - DNA, 15 bp, Homo sapiens
ctagatacaataaat

SEQ ID NO: 4442264 - DNA, 17 bp, Homo sapiens
ctagatacaataaattg

SEQ ID NO: 4442265 - DNA, 22 bp, Homo sapiens
ctagatatgaatatatggcatt

SEQ ID NO: 4442266 - DNA, 17 bp, Homo sapiens
ctagatcctgcacccca

SEQ ID NO: 4442267 - DNA, 19 bp, Homo sapiens
ctagatcctgcaccccagc

SEQ ID NO: 4442268 - DNA, 16 bp, Homo sapiens
ctagatgtagtatttt

SEQ ID NO: 4442269 - DNA, 23 bp, Homo sapiens
ctagatgtagtattttttgtata

SEQ ID NO: 4442270 - DNA, 21 bp, Homo sapiens
ctagcaaacagatgtttgttt

SEQ ID NO: 4442271 - DNA, 15 bp, Homo sapiens
ctagcaaattagaaa

SEQ ID NO: 4442272 - DNA, 15 bp, Homo sapiens
ctagcaatacaggga

SEQ ID NO: 4442273 - DNA, 21 bp, Homo sapiens
ctagcaatacagggaggctcc

SEQ ID NO: 4442274 - DNA, 19 bp, Homo sapiens
ctagcaatctcttcattat

SEQ ID NO: 4442275 - DNA, 14 bp, Homo sapiens
ctagcacagaggcc

SEQ ID NO: 4442276 - DNA, 23 bp, Homo sapiens
ctagcacagaggcctgactgact

SEQ ID NO: 4442277 - DNA, 16 bp, Homo sapiens
ctagcaccctggagag

SEQ ID NO: 4442278 - DNA, 17 bp, Homo sapiens
ctagcaccctggagagt

SEQ ID NO: 4442279 - DNA, 19 bp, Homo sapiens
ctagcaggctgttccatgt
